United States Patent 7,655,785 (BIOINFORMATICALLY DETECTABLE GROUP OF NOVEL REGULATORY OLIGONUCLEOTIDES AND USES THEREOF) - sequence listing, part 28

SEQ ID NO: 1140193 - RNA, 20 nt, Homo sapiens
ccaaaaagaguuacacugga

SEQ ID NO: 1140194 - RNA, 16 nt, Homo sapiens
ccaaaaaugcacccaa

SEQ ID NO: 1140195 - RNA, 17 nt, Homo sapiens
ccaaaacaguucuaggu

SEQ ID NO: 1140196 - RNA, 14 nt, Homo sapiens
ccaaaagucuucau

SEQ ID NO: 1140197 - RNA, 22 nt, Homo sapiens
ccaaaauauccaauucauuucu

SEQ ID NO: 1140198 - RNA, 15 nt, Homo sapiens
ccaaaaucucuuaaa

SEQ ID NO: 1140199 - RNA, 18 nt, Homo sapiens
ccaaaaucugucacuaca

SEQ ID NO: 1140200 - RNA, 20 nt, Homo sapiens
ccaaacaaaaccaaauucua

SEQ ID NO: 1140201 - RNA, 18 nt, Homo sapiens
ccaaacagcaaaccaaga

SEQ ID NO: 1140202 - RNA, 13 nt, Homo sapiens
ccaaacaugcacu

SEQ ID NO: 1140203 - RNA, 21 nt, Homo sapiens
ccaaacauguuguacauuuca

SEQ ID NO: 1140204 - RNA, 18 nt, Homo sapiens
ccaaacugagacucuuaa

SEQ ID NO: 1140205 - RNA, 22 nt, Homo sapiens
ccaaagaguagaauugcauuga

SEQ ID NO: 1140206 - RNA, 15 nt, Homo sapiens
ccaaagccacuggaa

SEQ ID NO: 1140207 - RNA, 21 nt, Homo sapiens
auggaugggggaacucagauc

SEQ ID NO: 1140208 - RNA, 22 nt, Homo sapiens
auggauucuccacucaguugca

SEQ ID NO: 1140209 - RNA, 16 nt, Homo sapiens
auggauuugaugcugu

SEQ ID NO: 1140210 - RNA, 15 nt, Homo sapiens
auggcagaaccaaag

SEQ ID NO: 1140211 - RNA, 23 nt, Homo sapiens
auggcaggaucucagaucacugc

SEQ ID NO: 1140212 - RNA, 15 nt, Homo sapiens
auggcauccugugaa

SEQ ID NO: 1140213 - RNA, 21 nt, Homo sapiens
auggcaugcgccaccaugccc

SEQ ID NO: 1140214 - RNA, 17 nt, Homo sapiens
auggcccugcaaaagga

SEQ ID NO: 1140215 - RNA, 15 nt, Homo sapiens
auggccuaaauuuau

SEQ ID NO: 1140216 - RNA, 20 nt, Homo sapiens
auggccuuccacgucuuccu

SEQ ID NO: 1140217 - RNA, 17 nt, Homo sapiens
auggcggggaucuggga

SEQ ID NO: 1140218 - RNA, 20 nt, Homo sapiens
auggcucacacagcuuaaga

SEQ ID NO: 1140219 - RNA, 20 nt, Homo sapiens
auggcuccggccucugccuu

SEQ ID NO: 1140220 - RNA, 14 nt, Homo sapiens
auggcucuaaaaag

SEQ ID NO: 1140221 - RNA, 11 nt, Homo sapiens
auggcucuccc

SEQ ID NO: 1140222 - RNA, 23 nt, Homo sapiens
auggcucuucaccugggcgccaa

SEQ ID NO: 1140223 - RNA, 13 nt, Homo sapiens
auggcugcugaaa

SEQ ID NO: 1140224 - RNA, 14 nt, Homo sapiens
augggaaagacaug

SEQ ID NO: 1140225 - RNA, 12 nt, Homo sapiens
augggaucugua

SEQ ID NO: 1140226 - RNA, 22 nt, Homo sapiens
augggaucuuucugacacacuu

SEQ ID NO: 1140227 - RNA, 19 nt, Homo sapiens
augggcagagcccaaggga

SEQ ID NO: 1140228 - RNA, 14 nt, Homo sapiens
augggccucaugga

SEQ ID NO: 1140229 - RNA, 17 nt, Homo sapiens
augggggaacucagauc

SEQ ID NO: 1140230 - RNA, 18 nt, Homo sapiens
auggggggggauguggau

SEQ ID NO: 1140231 - RNA, 16 nt, Homo sapiens
augggucaugacaaga

SEQ ID NO: 1140232 - RNA, 18 nt, Homo sapiens
auggguuaaaucaaagau

SEQ ID NO: 1140233 - RNA, 14 nt, Homo sapiens
auggguuagugcua

SEQ ID NO: 1140234 - RNA, 19 nt, Homo sapiens
augguaauagcuuuaguga

SEQ ID NO: 1140235 - RNA, 13 nt, Homo sapiens
augguagaccuuu

SEQ ID NO: 1140236 - RNA, 15 nt, Homo sapiens
auggucacacacuga

SEQ ID NO: 1140237 - RNA, 19 nt, Homo sapiens
augguccaucacuauucaa

SEQ ID NO: 1140238 - RNA, 20 nt, Homo sapiens
auggucuuggcagcaccugu

SEQ ID NO: 1140239 - RNA, 20 nt, Homo sapiens
auggugaaacccccaucucu

SEQ ID NO: 1140240 - RNA, 16 nt, Homo sapiens
auggugacuuuugaaa

SEQ ID NO: 1140241 - RNA, 17 nt, Homo sapiens
auggugcuacgccugca

SEQ ID NO: 1140242 - RNA, 18 nt, Homo sapiens
auggugcuggggagccaa

SEQ ID NO: 1140243 - RNA, 23 nt, Homo sapiens
augguggagggccacaugggagg

SEQ ID NO: 1140244 - RNA, 15 nt, Homo sapiens
augguggcaccagcg

SEQ ID NO: 1140245 - RNA, 20 nt, Homo sapiens
augguggcgcaugccuguag

SEQ ID NO: 1140246 - RNA, 17 nt, Homo sapiens
auggugguaacugauaa

SEQ ID NO: 1140247 - RNA, 23 nt, Homo sapiens
augguguagcccucccacuuugc

SEQ ID NO: 1140248 - RNA, 20 nt, Homo sapiens
auggugugugucucugacaa

SEQ ID NO: 1140249 - RNA, 15 nt, Homo sapiens
augguuagacagcac

SEQ ID NO: 1140250 - RNA, 15 nt, Homo sapiens
augguuccauucucu

SEQ ID NO: 1140251 - RNA, 13 nt, Homo sapiens
augguugccaagc

SEQ ID NO: 1140252 - RNA, 23 nt, Homo sapiens
auguaaaaucuucagcuggugga

SEQ ID NO: 1140253 - RNA, 16 nt, Homo sapiens
auguaaacugugcacc

SEQ ID NO: 1140254 - RNA, 16 nt, Homo sapiens
auguaaauauacaaaa

SEQ ID NO: 1140255 - RNA, 23 nt, Homo sapiens
auguaacauguaggaaguaggaa

SEQ ID NO: 1140256 - RNA, 13 nt, Homo sapiens
auguaacuugaaa

SEQ ID NO: 1140257 - RNA, 16 nt, Homo sapiens
auguaagaauucagaa

SEQ ID NO: 1140258 - RNA, 18 nt, Homo sapiens
auguaagaucguucucug

SEQ ID NO: 1140259 - RNA, 18 nt, Homo sapiens
auguaaguaagugacaau

SEQ ID NO: 1140260 - RNA, 22 nt, Homo sapiens
auguaauauacugagcugcuaa

SEQ ID NO: 1140261 - RNA, 19 nt, Homo sapiens
auguaauauuaauaguuau

SEQ ID NO: 1140262 - RNA, 17 nt, Homo sapiens
auguaaugaucuuggac

SEQ ID NO: 1140263 - RNA, 16 nt, Homo sapiens
auguacaagacuuuac

SEQ ID NO: 1140264 - RNA, 23 nt, Homo sapiens
auguacaucuguuuguagccaca

SEQ ID NO: 1140265 - RNA, 19 nt, Homo sapiens
auguacgcacgcauguguc

SEQ ID NO: 1140266 - RNA, 19 nt, Homo sapiens
auguacuggagaguggcaa

SEQ ID NO: 1140267 - RNA, 15 nt, Homo sapiens
auguagacauuaucu

SEQ ID NO: 1140268 - RNA, 21 nt, Homo sapiens
auguagcagcagccuacugag

SEQ ID NO: 1140269 - RNA, 20 nt, Homo sapiens
auguagguacccugccacgg

SEQ ID NO: 1140270 - RNA, 16 nt, Homo sapiens
auguauaguauacucu

SEQ ID NO: 1140271 - RNA, 19 nt, Homo sapiens
auguauauauauauaugca

SEQ ID NO: 1140272 - RNA, 15 nt, Homo sapiens
auguauaucucucca

SEQ ID NO: 1140273 - RNA, 13 nt, Homo sapiens
auguaugagacag

SEQ ID NO: 1140274 - RNA, 13 nt, Homo sapiens
auguaugcagcua

SEQ ID NO: 1140275 - RNA, 21 nt, Homo sapiens
auguauuaauaaauagagcaa

SEQ ID NO: 1140276 - RNA, 17 nt, Homo sapiens
auguauuagccagucau

SEQ ID NO: 1140277 - RNA, 16 nt, Homo sapiens
auguauuuagcuugaa

SEQ ID NO: 1140278 - RNA, 20 nt, Homo sapiens
augucaccuccccaucaucc

SEQ ID NO: 1140279 - RNA, 23 nt, Homo sapiens
augucacgagcguucaaacugcu

SEQ ID NO: 1140280 - RNA, 14 nt, Homo sapiens
augucacucagaug

SEQ ID NO: 1140281 - RNA, 21 nt, Homo sapiens
augucaggaaacauucaguga

SEQ ID NO: 1140282 - RNA, 18 nt, Homo sapiens
augucagguacauaacau

SEQ ID NO: 1140283 - RNA, 13 nt, Homo sapiens
augucauugcuaa

SEQ ID NO: 1140284 - RNA, 22 nt, Homo sapiens
auguccacucaguaacaaguau

SEQ ID NO: 1140285 - RNA, 17 nt, Homo sapiens
auguccagcaccuugug

SEQ ID NO: 1140286 - RNA, 20 nt, Homo sapiens
auguccucgguuucccauuu

SEQ ID NO: 1140287 - RNA, 18 nt, Homo sapiens
auguccucuauaccugug

SEQ ID NO: 1140288 - RNA, 15 nt, Homo sapiens
auguccugccuuuua

SEQ ID NO: 1140289 - RNA, 16 nt, Homo sapiens
augucuauuauuauga

SEQ ID NO: 1140290 - RNA, 15 nt, Homo sapiens
augucucugacaaag

SEQ ID NO: 1140291 - RNA, 13 nt, Homo sapiens
augucuuaagauu

SEQ ID NO: 1140292 - RNA, 18 nt, Homo sapiens
augucuucauucccaagg

SEQ ID NO: 1140293 - RNA, 21 nt, Homo sapiens
augucuucauuggcuauauaa

SEQ ID NO: 1140294 - RNA, 18 nt, Homo sapiens
augucuucuguauaacua

SEQ ID NO: 1140295 - RNA, 17 nt, Homo sapiens
augucuuguacaugugu

SEQ ID NO: 1140296 - RNA, 16 nt, Homo sapiens
augugaagucaccagu

SEQ ID NO: 1140297 - RNA, 22 nt, Homo sapiens
augugaauaaauucuauaggaa

SEQ ID NO: 1140298 - RNA, 16 nt, Homo sapiens
augugaauacucuucc

SEQ ID NO: 1140299 - RNA, 19 nt, Homo sapiens
augugaauacucuucccac

SEQ ID NO: 1140300 - RNA, 17 nt, Homo sapiens
augugacaugcccaagg

SEQ ID NO: 1140301 - RNA, 19 nt, Homo sapiens
augugaccagacugcacag

SEQ ID NO: 1140302 - RNA, 21 nt, Homo sapiens
augugaccagacugcacagga

SEQ ID NO: 1140303 - RNA, 20 nt, Homo sapiens
augugacuaaaaaugcaucu

SEQ ID NO: 1140304 - RNA, 16 nt, Homo sapiens
augugaguguguguga

SEQ ID NO: 1140305 - RNA, 22 nt, Homo sapiens
augugauaacgagguuccagua

SEQ ID NO: 1140306 - RNA, 16 nt, Homo sapiens
augugaucagcuuuca

SEQ ID NO: 1140307 - RNA, 17 nt, Homo sapiens
augugaucagcuuucaa

SEQ ID NO: 1140308 - RNA, 21 nt, Homo sapiens
aaaaaucaugagauccuuuaa

SEQ ID NO: 1140309 - RNA, 22 nt, Homo sapiens
aaaaaucuaagauucauguguu

SEQ ID NO: 1140310 - RNA, 17 nt, Homo sapiens
aaaaaucugagaaacuc

SEQ ID NO: 1140311 - RNA, 21 nt, Homo sapiens
aaaaaugagcauacaucuuaa

SEQ ID NO: 1140312 - RNA, 12 nt, Homo sapiens
aaaaaugaguaa

SEQ ID NO: 1140313 - RNA, 16 nt, Homo sapiens
aaaaaugcacaccuca

SEQ ID NO: 1140314 - RNA, 22 nt, Homo sapiens
aaaaaugcacaccucaugaguc

SEQ ID NO: 1140315 - RNA, 16 nt, Homo sapiens
aaaaaugcacccaacu

SEQ ID NO: 1140316 - RNA, 23 nt, Homo sapiens
aaaaaugguauaaguaacuuuau

SEQ ID NO: 1140317 - RNA, 17 nt, Homo sapiens
aaaaauuaaaaccugau

SEQ ID NO: 1140318 - RNA, 19 nt, Homo sapiens
aaaaauuauaguagcuuau

SEQ ID NO: 1140319 - RNA, 15 nt, Homo sapiens
aaaaauuuauuauuu

SEQ ID NO: 1140320 - RNA, 21 nt, Homo sapiens
aaaaauuuuaagccaguuuua

SEQ ID NO: 1140321 - RNA, 19 nt, Homo sapiens
aaaaauuuuaaguguucuc

SEQ ID NO: 1140322 - RNA, 19 nt, Homo sapiens
aaaaauuuuggucauagca

SEQ ID NO: 1140323 - RNA, 21 nt, Homo sapiens
aaaacaaugguguggugaaug

SEQ ID NO: 1140324 - RNA, 20 nt, Homo sapiens
aaaacaauguaagagccuaa

SEQ ID NO: 1140325 - RNA, 15 nt, Homo sapiens
aaaacacugugcaca

SEQ ID NO: 1140326 - RNA, 18 nt, Homo sapiens
aaaacagaggcacuuaau

SEQ ID NO: 1140327 - RNA, 12 nt, Homo sapiens
aaaacaguauuc

SEQ ID NO: 1140328 - RNA, 18 nt, Homo sapiens
aaaacaguucuaggugcu

SEQ ID NO: 1140329 - RNA, 12 nt, Homo sapiens
aaaacauguaug

SEQ ID NO: 1140330 - RNA, 10 nt, Homo sapiens
aaaaccaaau

SEQ ID NO: 1140331 - RNA, 13 nt, Homo sapiens
aaaaccaaauucu

SEQ ID NO: 1140332 - RNA, 23 nt, Homo sapiens
aaaaccacuaugcaaagaacuca

SEQ ID NO: 1140333 - RNA, 18 nt, Homo sapiens
aaaaccugagcagcaacu

SEQ ID NO: 1140334 - RNA, 13 nt, Homo sapiens
aaaaccugugauu

SEQ ID NO: 1140335 - RNA, 16 nt, Homo sapiens
aaaacuaagaaacuua

SEQ ID NO: 1140336 - RNA, 17 nt, Homo sapiens
aaaacuaguaguucucu

SEQ ID NO: 1140337 - RNA, 17 nt, Homo sapiens
aaaacuccccuuccuca

SEQ ID NO: 1140338 - RNA, 16 nt, Homo sapiens
aaaacucgaggacugu

SEQ ID NO: 1140339 - RNA, 17 nt, Homo sapiens
aaaacucuuauuacugu

SEQ ID NO: 1140340 - RNA, 16 nt, Homo sapiens
aaaacugcauuucacu

SEQ ID NO: 1140341 - RNA, 11 nt, Homo sapiens
aaaacugccuc

SEQ ID NO: 1140342 - RNA, 18 nt, Homo sapiens
aaaacuggcuacugcucu

SEQ ID NO: 1140343 - RNA, 13 nt, Homo sapiens
aaaacuguauuua

SEQ ID NO: 1140344 - RNA, 14 nt, Homo sapiens
aaaacuuaacauuc

SEQ ID NO: 1140345 - RNA, 20 nt, Homo sapiens
aaaacuuaccuauaaauuaa

SEQ ID NO: 1140346 - RNA, 19 nt, Homo sapiens
aaaacuuguuacuaaagaa

SEQ ID NO: 1140347 - RNA, 12 nt, Homo sapiens
aaaacuuuccaa

SEQ ID NO: 1140348 - RNA, 16 nt, Homo sapiens
aaaagaaaagccgaaa

SEQ ID NO: 1140349 - RNA, 22 nt, Homo sapiens
aaaagaacauaaguuaucaugg

SEQ ID NO: 1140350 - RNA, 13 nt, Homo sapiens
aaaagaagugugc

SEQ ID NO: 1140351 - RNA, 14 nt, Homo sapiens
aaaagaauuaccaa

SEQ ID NO: 1140352 - RNA, 20 nt, Homo sapiens
aaaagacaaauauguagaau

SEQ ID NO: 1140353 - RNA, 14 nt, Homo sapiens
aaaagagcagcaca

SEQ ID NO: 1140354 - RNA, 22 nt, Homo sapiens
aaaagauucccacccaauucaa

SEQ ID NO: 1140355 - RNA, 17 nt, Homo sapiens
aaaagcaaauagaucau

SEQ ID NO: 1140356 - RNA, 18 nt, Homo sapiens
aaaagcacacucaucccc

SEQ ID NO: 1140357 - RNA, 13 nt, Homo sapiens
aaaagcaccugcc

SEQ ID NO: 1140358 - RNA, 20 nt, Homo sapiens
aaaagcagauggacuugaaa

SEQ ID NO: 1140359 - RNA, 12 nt, Homo sapiens
aaaagccaaaaa

SEQ ID NO: 1140360 - RNA, 16 nt, Homo sapiens
aaaagccguaacccag

SEQ ID NO: 1140361 - RNA, 14 nt, Homo sapiens
aaaagccucagcuc

SEQ ID NO: 1140362 - RNA, 17 nt, Homo sapiens
aaaagccuuacaguuau

SEQ ID NO: 1140363 - RNA, 21 nt, Homo sapiens
aaaagcuuuaaaugucugcau

SEQ ID NO: 1140364 - RNA, 16 nt, Homo sapiens
aaaaggaacugcagca

SEQ ID NO: 1140365 - RNA, 20 nt, Homo sapiens
aaaaggaauccucugugucu

SEQ ID NO: 1140366 - RNA, 15 nt, Homo sapiens
aaaagggccaggugc

SEQ ID NO: 1140367 - RNA, 15 nt, Homo sapiens
aaaaggguaagcuag

SEQ ID NO: 1140368 - RNA, 23 nt, Homo sapiens
aaaagguaccgcugugugcauuc

SEQ ID NO: 1140369 - RNA, 13 nt, Homo sapiens
aaaagguaugaaa

SEQ ID NO: 1140370 - RNA, 23 nt, Homo sapiens
aaaaguaaagaugcuacuuccca

SEQ ID NO: 1140371 - RNA, 23 nt, Homo sapiens
aaaaguaaccugaacuaaucuga

SEQ ID NO: 1140372 - RNA, 22 nt, Homo sapiens
aaaagucauuuaauguagaaua

SEQ ID NO: 1140373 - RNA, 18 nt, Homo sapiens
aaaagucuacgcucuccu

SEQ ID NO: 1140374 - RNA, 19 nt, Homo sapiens
aaaaguuccaagagucuaa

SEQ ID NO: 1140375 - RNA, 19 nt, Homo sapiens
aaaaguucuuuuugcucua

SEQ ID NO: 1140376 - RNA, 19 nt, Homo sapiens
aaaaguuguucaacuauuu

SEQ ID NO: 1140377 - RNA, 14 nt, Homo sapiens
aaaaguuguuuguu

SEQ ID NO: 1140378 - RNA, 13 nt, Homo sapiens
aaaauaaaccaaa

SEQ ID NO: 1140379 - RNA, 12 nt, Homo sapiens
aaaauaaagcug

SEQ ID NO: 1140380 - RNA, 17 nt, Homo sapiens
aaaauaacugaaccaaa

SEQ ID NO: 1140381 - RNA, 12 nt, Homo sapiens
aaaauacaauua

SEQ ID NO: 1140382 - RNA, 13 nt, Homo sapiens
aaaauacaugaca

SEQ ID NO: 1140383 - RNA, 18 nt, Homo sapiens
aaaauacaugacauuuau

SEQ ID NO: 1140384 - RNA, 13 nt, Homo sapiens
aaaauacauuuau

SEQ ID NO: 1140385 - RNA, 23 nt, Homo sapiens
aaaauacuaugugggacaccuca

SEQ ID NO: 1140386 - RNA, 15 nt, Homo sapiens
aaaauacugccagau

SEQ ID NO: 1140387 - RNA, 13 nt, Homo sapiens
aaaauaguaaugu

SEQ ID NO: 1140388 - RNA, 16 nt, Homo sapiens
aaaauaucugcucaaa

SEQ ID NO: 1140389 - RNA, 12 nt, Homo sapiens
aaaauaugccuu

SEQ ID NO: 1140390 - RNA, 19 nt, Homo sapiens
aaaaucagagucuauaaca

SEQ ID NO: 1140391 - RNA, 13 nt, Homo sapiens
aaaaucaguuuug

SEQ ID NO: 1140392 - RNA, 20 nt, Homo sapiens
aaaaucuaauuagaauucuc

SEQ ID NO: 1140393 - RNA, 15 nt, Homo sapiens
aaaaucuuauaauuu

SEQ ID NO: 1140394 - RNA, 22 nt, Homo sapiens
aaaaucuucagcugguggaugg

SEQ ID NO: 1140395 - RNA, 21 nt, Homo sapiens
aaaaucuuuguuacucuguaa

SEQ ID NO: 1140396 - RNA, 11 nt, Homo sapiens
aaaaugaauuu

SEQ ID NO: 1140397 - RNA, 17 nt, Homo sapiens
aaaaugagugugaaggg

SEQ ID NO: 1140398 - RNA, 13 nt, Homo sapiens
aaaaugauccuca

SEQ ID NO: 1140399 - RNA, 14 nt, Homo sapiens
aaaaugcaguaaca

SEQ ID NO: 1140400 - RNA, 21 nt, Homo sapiens
aaaaugcaucacaugaugaaa

SEQ ID NO: 1140401 - RNA, 21 nt, Homo sapiens
aaaaugcuguuuucaacauug

SEQ ID NO: 1140402 - RNA, 16 nt, Homo sapiens
aaaauggaaaagagag

SEQ ID NO: 1140403 - RNA, 16 nt, Homo sapiens
aaaaugggacuucuuu

SEQ ID NO: 1140404 - RNA, 22 nt, Homo sapiens
aaaaugggagacagccucuuac

SEQ ID NO: 1140405 - RNA, 22 nt, Homo sapiens
aaaaugggaucuuucugacaca

SEQ ID NO: 1140406 - RNA, 17 nt, Homo sapiens
aaaaugguuuguccuga

SEQ ID NO: 1140407 - RNA, 16 nt, Homo sapiens
aaaauguagacugaaa

SEQ ID NO: 1140408 - RNA, 18 nt, Homo sapiens
aaaauguagacugaaaag

SEQ ID NO: 1140409 - RNA, 17 nt, Homo sapiens
aaaauguauauuuugau

SEQ ID NO: 1140410 - RNA, 15 nt, Homo sapiens
aaaauguccugccuu

SEQ ID NO: 1140411 - RNA, 14 nt, Homo sapiens
aaaauuacuuugaa

SEQ ID NO: 1140412 - RNA, 21 nt, Homo sapiens
aaaauuagccgggcauggugg

SEQ ID NO: 1140413 - RNA, 18 nt, Homo sapiens
aaaauuauuugcauaaca

SEQ ID NO: 1140414 - RNA, 20 nt, Homo sapiens
aaaauucucuuaaaccacag

SEQ ID NO: 1140415 - RNA, 15 nt, Homo sapiens
aaaauugacuuagau

SEQ ID NO: 1140416 - RNA, 22 nt, Homo sapiens
aaaauugcugcaccaaugcacu

SEQ ID NO: 1140417 - RNA, 14 nt, Homo sapiens
aaaauuguagcuuu

SEQ ID NO: 1140418 - RNA, 23 nt, Homo sapiens
aaaauuuguuugucacugccaaa

SEQ ID NO: 1140419 - RNA, 22 nt, Homo sapiens
aaaauuuuggucauagcauuca

SEQ ID NO: 1140420 - RNA, 23 nt, Homo sapiens
aaaauuuuggucauagcauucac

SEQ ID NO: 1140421 - RNA, 21 nt, Homo sapiens
aaaauuuuuuuuguaacugga

SEQ ID NO: 1140422 - RNA, 17 nt, Homo sapiens
aaacaaauguauuucaa

SEQ ID NO: 1140423 - RNA, 21 nt, Homo sapiens
aaacaagauuaauuucaucac

SEQ ID NO: 1140424 - RNA, 20 nt, Homo sapiens
aaacaagcuucaaagccaua

SEQ ID NO: 1140425 - RNA, 13 nt, Homo sapiens
aaacaauccaaaa

SEQ ID NO: 1140426 - RNA, 15 nt, Homo sapiens
aaacaaugaaauauu

SEQ ID NO: 1140427 - RNA, 13 nt, Homo sapiens
aaacacaaaaaca

SEQ ID NO: 1140428 - RNA, 19 nt, Homo sapiens
aaacacaaaugcagggauu

SEQ ID NO: 1140429 - RNA, 14 nt, Homo sapiens
aaacacaaggucau

SEQ ID NO: 1140430 - RNA, 13 nt, Homo sapiens
aaacaccaaaaau

SEQ ID NO: 1140431 - RNA, 17 nt, Homo sapiens
aaacaccgcuucugccu

SEQ ID NO: 1140432 - RNA, 14 nt, Homo sapiens
gaggcaaugggagc

SEQ ID NO: 1140433 - RNA, 14 nt, Homo sapiens
gaggcacaagaauc

SEQ ID NO: 1140434 - RNA, 21 nt, Homo sapiens
gaggcacaagaaucacuugaa

SEQ ID NO: 1140435 - RNA, 20 nt, Homo sapiens
gaggcagagcuugcagugag

SEQ ID NO: 1140436 - RNA, 12 nt, Homo sapiens
gaggcagggaag

SEQ ID NO: 1140437 - RNA, 19 nt, Homo sapiens
gaggcaggggacaagggag

SEQ ID NO: 1140438 - RNA, 19 nt, Homo sapiens
gaggcauggaaaccaaaag

SEQ ID NO: 1140439 - RNA, 19 nt, Homo sapiens
gaggccccugucucagggu

SEQ ID NO: 1140440 - RNA, 18 nt, Homo sapiens
gaggcccgcggcggugga

SEQ ID NO: 1140441 - RNA, 13 nt, Homo sapiens
gaggccucucuca

SEQ ID NO: 1140442 - RNA, 19 nt, Homo sapiens
gaggccuuccagggacgaa

SEQ ID NO: 1140443 - RNA, 16 nt, Homo sapiens
gaggcucuugcucaag

SEQ ID NO: 1140444 - RNA, 18 nt, Homo sapiens
gaggcugcccugaggggc

SEQ ID NO: 1140445 - RNA, 15 nt, Homo sapiens
gagggaaagacaaga

SEQ ID NO: 1140446 - RNA, 23 nt, Homo sapiens
gagggaagaucuugaugguguuu

SEQ ID NO: 1140447 - RNA, 15 nt, Homo sapiens
gagggagccauggaa

SEQ ID NO: 1140448 - RNA, 13 nt, Homo sapiens
gagggaugggaga

SEQ ID NO: 1140449 - RNA, 16 nt, Homo sapiens
gagggcagaucacuuc

SEQ ID NO: 1140450 - RNA, 22 nt, Homo sapiens
gagggcgccaucuauggugugg

SEQ ID NO: 1140451 - RNA, 21 nt, Homo sapiens
gagggcuacaaaggaggacaa

SEQ ID NO: 1140452 - RNA, 20 nt, Homo sapiens
gagggcuggcuggccucacc

SEQ ID NO: 1140453 - RNA, 12 nt, Homo sapiens
gagggcuuucag

SEQ ID NO: 1140454 - RNA, 21 nt, Homo sapiens
gaggggccggcccugugugca

SEQ ID NO: 1140455 - RNA, 20 nt, Homo sapiens
gagggggcacggcaggcgug

SEQ ID NO: 1140456 - RNA, 23 nt, Homo sapiens
gagggguguccgagaggcuggug

SEQ ID NO: 1140457 - RNA, 23 nt, Homo sapiens
gagggguugaugccagacaucac

SEQ ID NO: 1140458 - RNA, 14 nt, Homo sapiens
gaggguuugcagaa

SEQ ID NO: 1140459 - RNA, 17 nt, Homo sapiens
gagguaaauaaguaaaa

SEQ ID NO: 1140460 - RNA, 18 nt, Homo sapiens
gaggucccucagcugcga

SEQ ID NO: 1140461 - RNA, 19 nt, Homo sapiens
gagguggagguugcauuga

SEQ ID NO: 1140462 - RNA, 16 nt, Homo sapiens
gagguggagucuugcu

SEQ ID NO: 1140463 - RNA, 12 nt, Homo sapiens
gagguggcugcc

SEQ ID NO: 1140464 - RNA, 14 nt, Homo sapiens
gagguuaaggcaua

SEQ ID NO: 1140465 - RNA, 17 nt, Homo sapiens
gagguuugccagcauuu

SEQ ID NO: 1140466 - RNA, 15 nt, Homo sapiens
gaguaauaugccugc

SEQ ID NO: 1140467 - RNA, 15 nt, Homo sapiens
gaguacaccccaaca

SEQ ID NO: 1140468 - RNA, 17 nt, Homo sapiens
gaguacagacgucucaa

SEQ ID NO: 1140469 - RNA, 14 nt, Homo sapiens
gaguagaauugcau

SEQ ID NO: 1140470 - RNA, 17 nt, Homo sapiens
gaguagaauugcauuga

SEQ ID NO: 1140471 - RNA, 14 nt, Homo sapiens
gaguagggggagca

SEQ ID NO: 1140472 - RNA, 18 nt, Homo sapiens
gaguaguauuaaaagcua

SEQ ID NO: 1140473 - RNA, 18 nt, Homo sapiens
gagucaacuggcuggcca

SEQ ID NO: 1140474 - RNA, 13 nt, Homo sapiens
gagucacaccaga

SEQ ID NO: 1140475 - RNA, 14 nt, Homo sapiens
gagucacaccagaa

SEQ ID NO: 1140476 - RNA, 22 nt, Homo sapiens
gagucagccaugucugugcugu

SEQ ID NO: 1140477 - RNA, 20 nt, Homo sapiens
gagucaucucaaccaucccc

SEQ ID NO: 1140478 - RNA, 22 nt, Homo sapiens
gagucccucacguuucuucccc

SEQ ID NO: 1140479 - RNA, 19 nt, Homo sapiens
gagucccuuugcgccucuu

SEQ ID NO: 1140480 - RNA, 13 nt, Homo sapiens
gagucuagauuca

SEQ ID NO: 1140481 - RNA, 21 nt, Homo sapiens
gagucucccuaaggcaugugu

SEQ ID NO: 1140482 - RNA, 21 nt, Homo sapiens
gagucugugcaguuucugaca

SEQ ID NO: 1140483 - RNA, 19 nt, Homo sapiens
gagucugugcugguugcca

SEQ ID NO: 1140484 - RNA, 20 nt, Homo sapiens
gagucuugcuauauugccca

SEQ ID NO: 1140485 - RNA, 18 nt, Homo sapiens
gagugaaggggccaagga

SEQ ID NO: 1140486 - RNA, 20 nt, Homo sapiens
gagugaauuguguaccugaa

SEQ ID NO: 1140487 - RNA, 18 nt, Homo sapiens
gagugagagacauuaacu

SEQ ID NO: 1140488 - RNA, 15 nt, Homo sapiens
gagugcaaguaucau

SEQ ID NO: 1140489 - RNA, 19 nt, Homo sapiens
gagugcaauggugugaucu

SEQ ID NO: 1140490 - RNA, 15 nt, Homo sapiens
gagugcagugagcua

SEQ ID NO: 1140491 - RNA, 19 nt, Homo sapiens
gagugcaguggugugaucu

SEQ ID NO: 1140492 - RNA, 13 nt, Homo sapiens
gagugcauguguu

SEQ ID NO: 1140493 - RNA, 11 nt, Homo sapiens
gagugcugcuc

SEQ ID NO: 1140494 - RNA, 15 nt, Homo sapiens
gaguggccuagagca

SEQ ID NO: 1140495 - RNA, 19 nt, Homo sapiens
gaguggccuagagcacucu

SEQ ID NO: 1140496 - RNA, 18 nt, Homo sapiens
gagugggguggggagcau

SEQ ID NO: 1140497 - RNA, 16 nt, Homo sapiens
gaguguaguuuacaga

SEQ ID NO: 1140498 - RNA, 23 nt, Homo sapiens
gagugucuuuccacggagccacu

SEQ ID NO: 1140499 - RNA, 22 nt, Homo sapiens
gauuccuuuuuucaaaauccaa

SEQ ID NO: 1140500 - RNA, 18 nt, Homo sapiens
gauucgaaacuccauuga

SEQ ID NO: 1140501 - RNA, 14 nt, Homo sapiens
gauucuaacauauu

SEQ ID NO: 1140502 - RNA, 15 nt, Homo sapiens
gauucuccugccuca

SEQ ID NO: 1140503 - RNA, 14 nt, Homo sapiens
gauucucugugguu

SEQ ID NO: 1140504 - RNA, 21 nt, Homo sapiens
gauucucuuagacacuuuuau

SEQ ID NO: 1140505 - RNA, 16 nt, Homo sapiens
gauucugaaaccacag

SEQ ID NO: 1140506 - RNA, 21 nt, Homo sapiens
gauugaaauuccaguugcaau

SEQ ID NO: 1140507 - RNA, 19 nt, Homo sapiens
gauugaagcccagugaauu

SEQ ID NO: 1140508 - RNA, 17 nt, Homo sapiens
gauugcagaaauacagu

SEQ ID NO: 1140509 - RNA, 19 nt, Homo sapiens
gauugcaugugacucugaa

SEQ ID NO: 1140510 - RNA, 19 nt, Homo sapiens
gauuguaaaguagcuguaa

SEQ ID NO: 1140511 - RNA, 14 nt, Homo sapiens
gauuguauuaacua

SEQ ID NO: 1140512 - RNA, 13 nt, Homo sapiens
gauuuaaaaggga

SEQ ID NO: 1140513 - RNA, 17 nt, Homo sapiens
gauuuaaagaauucucu

SEQ ID NO: 1140514 - RNA, 15 nt, Homo sapiens
gauuuagaaguguca

SEQ ID NO: 1140515 - RNA, 15 nt, Homo sapiens
gauuucagcagggau

SEQ ID NO: 1140516 - RNA, 17 nt, Homo sapiens
gauuuccucacuaccug

SEQ ID NO: 1140517 - RNA, 22 nt, Homo sapiens
gauuuccuccucccagugccuu

SEQ ID NO: 1140518 - RNA, 12 nt, Homo sapiens
gauuugaccucc

SEQ ID NO: 1140519 - RNA, 12 nt, Homo sapiens
gauuugaugcuu

SEQ ID NO: 1140520 - RNA, 11 nt, Homo sapiens
gauuugcaaua

SEQ ID NO: 1140521 - RNA, 13 nt, Homo sapiens
gauuugcacagaa

SEQ ID NO: 1140522 - RNA, 22 nt, Homo sapiens
gauuugucccuaugcauaucag

SEQ ID NO: 1140523 - RNA, 15 nt, Homo sapiens
gauuugugcugugua

SEQ ID NO: 1140524 - RNA, 18 nt, Homo sapiens
gauuuuacacaccaccag

SEQ ID NO: 1140525 - RNA, 17 nt, Homo sapiens
gauuuucuccacaacac

SEQ ID NO: 1140526 - RNA, 15 nt, Homo sapiens
gauuuugcucugucu

SEQ ID NO: 1140527 - RNA, 14 nt, Homo sapiens
gauuuuguauucca

SEQ ID NO: 1140528 - RNA, 20 nt, Homo sapiens
gauuuugucugcccaaucca

SEQ ID NO: 1140529 - RNA, 19 nt, Homo sapiens
gauuuuuaugccaccugaa

SEQ ID NO: 1140530 - RNA, 20 nt, Homo sapiens
gauuuuuguuuuccacugug

SEQ ID NO: 1140531 - RNA, 19 nt, Homo sapiens
gauuuuuuuguaaauauga

SEQ ID NO: 1140532 - RNA, 15 nt, Homo sapiens
gcaaaaaaauuauuu

SEQ ID NO: 1140533 - RNA, 14 nt, Homo sapiens
gcaaaacuuuccaa

SEQ ID NO: 1140534 - RNA, 21 nt, Homo sapiens
gcaaaagaaagcaaauuauuu

SEQ ID NO: 1140535 - RNA, 22 nt, Homo sapiens
gcaaaaggaucuuuguggccaa

SEQ ID NO: 1140536 - RNA, 18 nt, Homo sapiens
gcaaacaaaaccaauuca

SEQ ID NO: 1140537 - RNA, 21 nt, Homo sapiens
gcaaaccaagagauugcuaau

SEQ ID NO: 1140538 - RNA, 11 nt, Homo sapiens
gcaaacccaga

SEQ ID NO: 1140539 - RNA, 14 nt, Homo sapiens
gcaaaccugccucc

SEQ ID NO: 1140540 - RNA, 17 nt, Homo sapiens
gcaaacggaggacugaa

SEQ ID NO: 1140541 - RNA, 18 nt, Homo sapiens
gcaaacugggaugaaacu

SEQ ID NO: 1140542 - RNA, 17 nt, Homo sapiens
gcaaagaucuguccuca

SEQ ID NO: 1140543 - RNA, 21 nt, Homo sapiens
gcaaagauuuucaaacaaaau

SEQ ID NO: 1140544 - RNA, 20 nt, Homo sapiens
gcaaagcaucggucaugugu

SEQ ID NO: 1140545 - RNA, 23 nt, Homo sapiens
gcaaaggaaauugucaucugcca

SEQ ID NO: 1140546 - RNA, 23 nt, Homo sapiens
gcaaaggauguguuuucagucuu

SEQ ID NO: 1140547 - RNA, 21 nt, Homo sapiens
gcaaaguacuguaagaauaau

SEQ ID NO: 1140548 - RNA, 22 nt, Homo sapiens
gcaaagucccagccgcacuggg

SEQ ID NO: 1140549 - RNA, 23 nt, Homo sapiens
gcaaaucuuucuguaaacagaau

SEQ ID NO: 1140550 - RNA, 18 nt, Homo sapiens
gcaaaugccaacuguugg

SEQ ID NO: 1140551 - RNA, 14 nt, Homo sapiens
gcaaaugcuguauu

SEQ ID NO: 1140552 - RNA, 18 nt, Homo sapiens
gcaaaugugcaguucagu

SEQ ID NO: 1140553 - RNA, 14 nt, Homo sapiens
gcaaauuugauaca

SEQ ID NO: 1140554 - RNA, 15 nt, Homo sapiens
gcaaauuuucuucca

SEQ ID NO: 1140555 - RNA, 21 nt, Homo sapiens
gcaacaagaccaccacuucga

SEQ ID NO: 1140556 - RNA, 14 nt, Homo sapiens
gcaacagagcaaaa

SEQ ID NO: 1140557 - RNA, 15 nt, Homo sapiens
gcaacagagcaagac

SEQ ID NO: 1140558 - RNA, 22 nt, Homo sapiens
gcaacagcaaaucacgaccacu

SEQ ID NO: 1140559 - RNA, 22 nt, Homo sapiens
gcaaccaguuugcccauucucu

SEQ ID NO: 1140560 - RNA, 15 nt, Homo sapiens
gcaaccauauuugua

SEQ ID NO: 1140561 - RNA, 21 nt, Homo sapiens
gcaaccuccgccuccuggguu

SEQ ID NO: 1140562 - RNA, 12 nt, Homo sapiens
gcaacuaacuaa

SEQ ID NO: 1140563 - RNA, 18 nt, Homo sapiens
gcaacuaacuaaccacau

SEQ ID NO: 1140564 - RNA, 21 nt, Homo sapiens
gcaagaacucaucacuguggc

SEQ ID NO: 1140565 - RNA, 21 nt, Homo sapiens
gcaagaaguugaaaaacaguu

SEQ ID NO: 1140566 - RNA, 15 nt, Homo sapiens
gcaagaccucaucuc

SEQ ID NO: 1140567 - RNA, 19 nt, Homo sapiens
cugagauacauacagaauu

SEQ ID NO: 1140568 - RNA, 20 nt, Homo sapiens
cugagauacauacagaauua

SEQ ID NO: 1140569 - RNA, 14 nt, Homo sapiens
cugagcaaggaguu

SEQ ID NO: 1140570 - RNA, 18 nt, Homo sapiens
cugagcagaaugccuuau

SEQ ID NO: 1140571 - RNA, 22 nt, Homo sapiens
cugagcagugaaugauucagug

SEQ ID NO: 1140572 - RNA, 23 nt, Homo sapiens
cugagccaaagccagaguggcca

SEQ ID NO: 1140573 - RNA, 20 nt, Homo sapiens
cugagccuccacagcagugg

SEQ ID NO: 1140574 - RNA, 23 nt, Homo sapiens
cugaggcaagccauggagugaga

SEQ ID NO: 1140575 - RNA, 20 nt, Homo sapiens
cugaggccacacucagcaca

SEQ ID NO: 1140576 - RNA, 22 nt, Homo sapiens
cugaggccacacucagcacaag

SEQ ID NO: 1140577 - RNA, 23 nt, Homo sapiens
cugaggugugugccacucagaga

SEQ ID NO: 1140578 - RNA, 19 nt, Homo sapiens
cugagguuugccagcauuu

SEQ ID NO: 1140579 - RNA, 20 nt, Homo sapiens
cugagguuuuuaacauguau

SEQ ID NO: 1140580 - RNA, 16 nt, Homo sapiens
cugaguagggggagca

SEQ ID NO: 1140581 - RNA, 15 nt, Homo sapiens
cugaguauugauaaa

SEQ ID NO: 1140582 - RNA, 22 nt, Homo sapiens
cugagucagcaccccuccuagc

SEQ ID NO: 1140583 - RNA, 16 nt, Homo sapiens
cugagugucucugccu

SEQ ID NO: 1140584 - RNA, 20 nt, Homo sapiens
cugauaaaacugguuuuaga

SEQ ID NO: 1140585 - RNA, 22 nt, Homo sapiens
cugauaagagaaucaacauuuc

SEQ ID NO: 1140586 - RNA, 14 nt, Homo sapiens
cugauaaugcucac

SEQ ID NO: 1140587 - RNA, 18 nt, Homo sapiens
cugauacuuauuuaccua

SEQ ID NO: 1140588 - RNA, 23 nt, Homo sapiens
cugauagguagcauuuuccagca

SEQ ID NO: 1140589 - RNA, 16 nt, Homo sapiens
cugaucaggaccucca

SEQ ID NO: 1140590 - RNA, 17 nt, Homo sapiens
cugaugacaaacccagg

SEQ ID NO: 1140591 - RNA, 15 nt, Homo sapiens
cugaugcaggauuug

SEQ ID NO: 1140592 - RNA, 21 nt, Homo sapiens
cugauguccuaccacuuugaa

SEQ ID NO: 1140593 - RNA, 17 nt, Homo sapiens
cugauguucaguguaau

SEQ ID NO: 1140594 - RNA, 21 nt, Homo sapiens
cugauuauuuucuacacauac

SEQ ID NO: 1140595 - RNA, 13 nt, Homo sapiens
cugauucaguggg

SEQ ID NO: 1140596 - RNA, 13 nt, Homo sapiens
cugauucauaaua

SEQ ID NO: 1140597 - RNA, 20 nt, Homo sapiens
cugauucauaauaaauaucu

SEQ ID NO: 1140598 - RNA, 18 nt, Homo sapiens
cugauugcuuuauccaaa

SEQ ID NO: 1140599 - RNA, 14 nt, Homo sapiens
cugauuuauugaaa

SEQ ID NO: 1140600 - RNA, 13 nt, Homo sapiens
cugauuugcaaua

SEQ ID NO: 1140601 - RNA, 15 nt, Homo sapiens
cugcaaacccuuuca

SEQ ID NO: 1140602 - RNA, 17 nt, Homo sapiens
cugcaaaccuugguaaa

SEQ ID NO: 1140603 - RNA, 14 nt, Homo sapiens
cugcaaacgcugcc

SEQ ID NO: 1140604 - RNA, 13 nt, Homo sapiens
cugcaaaugugca

SEQ ID NO: 1140605 - RNA, 14 nt, Homo sapiens
cugcaaaugugcag

SEQ ID NO: 1140606 - RNA, 18 nt, Homo sapiens
cugcaagcagaacuucca

SEQ ID NO: 1140607 - RNA, 12 nt, Homo sapiens
cugcaagcucca

SEQ ID NO: 1140608 - RNA, 14 nt, Homo sapiens
cugcacacagggug

SEQ ID NO: 1140609 - RNA, 18 nt, Homo sapiens
cugcacaggaaaugcaag

SEQ ID NO: 1140610 - RNA, 13 nt, Homo sapiens
cugcacagugaag

SEQ ID NO: 1140611 - RNA, 13 nt, Homo sapiens
cugcaccccaaga

SEQ ID NO: 1140612 - RNA, 15 nt, Homo sapiens
cugcacugaugcugc

SEQ ID NO: 1140613 - RNA, 22 nt, Homo sapiens
cugcacugaugcugccccucau

SEQ ID NO: 1140614 - RNA, 18 nt, Homo sapiens
cugcacuuugcuguggca

SEQ ID NO: 1140615 - RNA, 22 nt, Homo sapiens
cugcacuuuggguuuuuaacuc

SEQ ID NO: 1140616 - RNA, 15 nt, Homo sapiens
cugcagacgucugcc

SEQ ID NO: 1140617 - RNA, 16 nt, Homo sapiens
cugcagauagaaagca

SEQ ID NO: 1140618 - RNA, 19 nt, Homo sapiens
cugcagauagaaagcauua

SEQ ID NO: 1140619 - RNA, 15 nt, Homo sapiens
cugcagauccagggg

SEQ ID NO: 1140620 - RNA, 22 nt, Homo sapiens
cugcagauuagcuaggggacag

SEQ ID NO: 1140621 - RNA, 16 nt, Homo sapiens
cugcagccaggccacu

SEQ ID NO: 1140622 - RNA, 22 nt, Homo sapiens
cugcagcgccacccaguggaag

SEQ ID NO: 1140623 - RNA, 15 nt, Homo sapiens
cugcagcggcaggac

SEQ ID NO: 1140624 - RNA, 19 nt, Homo sapiens
cugcaggcagccugccuuu

SEQ ID NO: 1140625 - RNA, 18 nt, Homo sapiens
cugcaggccaggccagcu

SEQ ID NO: 1140626 - RNA, 23 nt, Homo sapiens
cugcaggcuguuuauauguucac

SEQ ID NO: 1140627 - RNA, 22 nt, Homo sapiens
cugcagggccauggcucagggu

SEQ ID NO: 1140628 - RNA, 23 nt, Homo sapiens
cugcagggguugagagcuuucug

SEQ ID NO: 1140629 - RNA, 20 nt, Homo sapiens
cugcagucaagguugucaau

SEQ ID NO: 1140630 - RNA, 17 nt, Homo sapiens
cugcagucaucuacuuu

SEQ ID NO: 1140631 - RNA, 23 nt, Homo sapiens
cugcauguaaacacgccugcaaa

SEQ ID NO: 1140632 - RNA, 18 nt, Homo sapiens
cugcauguuugcuguucc

SEQ ID NO: 1140633 - RNA, 21 nt, Homo sapiens
cugcauuguucuuugccagag

SEQ ID NO: 1140634 - RNA, 13 nt, Homo sapiens
cugccaacugucc

SEQ ID NO: 1140635 - RNA, 24 nt, Homo sapiens
cugccaagauacuugaacacugug

SEQ ID NO: 1140636 - RNA, 23 nt, Homo sapiens
cugccaaggaaacccccagugua

SEQ ID NO: 1140637 - RNA, 15 nt, Homo sapiens
cugccaaugauucca

SEQ ID NO: 1140638 - RNA, 18 nt, Homo sapiens
cugccaaugauuccagac

SEQ ID NO: 1140639 - RNA, 19 nt, Homo sapiens
cugccaaugauuccagacg

SEQ ID NO: 1140640 - RNA, 17 nt, Homo sapiens
cugccacucaaugggag

SEQ ID NO: 1140641 - RNA, 14 nt, Homo sapiens
cugccacucaggcc

SEQ ID NO: 1140642 - RNA, 19 nt, Homo sapiens
cugccacucaggcccaaag

SEQ ID NO: 1140643 - RNA, 15 nt, Homo sapiens
cugccagacccccug

SEQ ID NO: 1140644 - RNA, 16 nt, Homo sapiens
cugccagaugcugaug

SEQ ID NO: 1140645 - RNA, 20 nt, Homo sapiens
cugccagcaguuacugugaa

SEQ ID NO: 1140646 - RNA, 16 nt, Homo sapiens
cugccagcugcacuga

SEQ ID NO: 1140647 - RNA, 21 nt, Homo sapiens
cugccaggcccccaccacaca

SEQ ID NO: 1140648 - RNA, 16 nt, Homo sapiens
cugccagggaggccau

SEQ ID NO: 1140649 - RNA, 12 nt, Homo sapiens
augcucaagaaa

SEQ ID NO: 1140650 - RNA, 12 nt, Homo sapiens
augcucuugucc

SEQ ID NO: 1140651 - RNA, 19 nt, Homo sapiens
augcucuuucaaugcagca

SEQ ID NO: 1140652 - RNA, 22 nt, Homo sapiens
augcucuuuuguuuggguuaca

SEQ ID NO: 1140653 - RNA, 19 nt, Homo sapiens
augcugaaaaaucauccaa

SEQ ID NO: 1140654 - RNA, 22 nt, Homo sapiens
augcugagguuaugaacaaagu

SEQ ID NO: 1140655 - RNA, 20 nt, Homo sapiens
augcuggaaccugcaaaaaa

SEQ ID NO: 1140656 - RNA, 18 nt, Homo sapiens
augcugggaaugagacau

SEQ ID NO: 1140657 - RNA, 19 nt, Homo sapiens
augcuguggcuccuuccua

SEQ ID NO: 1140658 - RNA, 13 nt, Homo sapiens
augcugugugaga

SEQ ID NO: 1140659 - RNA, 17 nt, Homo sapiens
augcuguugauugcuaa

SEQ ID NO: 1140660 - RNA, 18 nt, Homo sapiens
augcuguuugacaaaguu

SEQ ID NO: 1140661 - RNA, 12 nt, Homo sapiens
augcuuaaggga

SEQ ID NO: 1140662 - RNA, 17 nt, Homo sapiens
augcuuaaucugaggau

SEQ ID NO: 1140663 - RNA, 12 nt, Homo sapiens
augcuuauggaa

SEQ ID NO: 1140664 - RNA, 17 nt, Homo sapiens
augcuuauguguugcau

SEQ ID NO: 1140665 - RNA, 16 nt, Homo sapiens
augcuucagugcugcu

SEQ ID NO: 1140666 - RNA, 14 nt, Homo sapiens
auggaacagugaaa

SEQ ID NO: 1140667 - RNA, 15 nt, Homo sapiens
auggaaccacuaaaa

SEQ ID NO: 1140668 - RNA, 15 nt, Homo sapiens
auggaagaacacugu

SEQ ID NO: 1140669 - RNA, 15 nt, Homo sapiens
auggaauuacuccaa

SEQ ID NO: 1140670 - RNA, 18 nt, Homo sapiens
auggaauucaaagcucua

SEQ ID NO: 1140671 - RNA, 15 nt, Homo sapiens
auggaauuuauaauu

SEQ ID NO: 1140672 - RNA, 21 nt, Homo sapiens
auggaauuuauaauucaguau

SEQ ID NO: 1140673 - RNA, 17 nt, Homo sapiens
auggaauuucauaucua

SEQ ID NO: 1140674 - RNA, 16 nt, Homo sapiens
auggacucagcucugu

SEQ ID NO: 1140675 - RNA, 19 nt, Homo sapiens
auggacuuacccuaaagau

SEQ ID NO: 1140676 - RNA, 16 nt, Homo sapiens
auggagaaaaugcuua

SEQ ID NO: 1140677 - RNA, 14 nt, Homo sapiens
auggagauucugau

SEQ ID NO: 1140678 - RNA, 17 nt, Homo sapiens
auggauaaacugagccu

SEQ ID NO: 1140679 - RNA, 15 nt, Homo sapiens
auggauggcuguuaa

SEQ ID NO: 1140680 - RNA, 19 nt, Homo sapiens
auggaugggggaacucaga

SEQ ID NO: 1140681 - RNA, 16 nt, Homo sapiens
auugaaguaaacugca

SEQ ID NO: 1140682 - RNA, 12 nt, Homo sapiens
auugaaguaaug

SEQ ID NO: 1140683 - RNA, 16 nt, Homo sapiens
auugaauuuacauaua

SEQ ID NO: 1140684 - RNA, 22 nt, Homo sapiens
auugacacagaaaauguugaga

SEQ ID NO: 1140685 - RNA, 22 nt, Homo sapiens
auugacauguagguacccugcc

SEQ ID NO: 1140686 - RNA, 14 nt, Homo sapiens
auugacgaacuggc

SEQ ID NO: 1140687 - RNA, 13 nt, Homo sapiens
auugacucauaca

SEQ ID NO: 1140688 - RNA, 18 nt, Homo sapiens
auugagacagugcacaug

SEQ ID NO: 1140689 - RNA, 16 nt, Homo sapiens
auugagccaguggugc

SEQ ID NO: 1140690 - RNA, 15 nt, Homo sapiens
auugaggaccucauc

SEQ ID NO: 1140691 - RNA, 18 nt, Homo sapiens
auugauagcagauaucac

SEQ ID NO: 1140692 - RNA, 16 nt, Homo sapiens
auugauauugugaaca

SEQ ID NO: 1140693 - RNA, 17 nt, Homo sapiens
auugauggguuaauuaa

SEQ ID NO: 1140694 - RNA, 14 nt, Homo sapiens
auugcaaaauuugg

SEQ ID NO: 1140695 - RNA, 15 nt, Homo sapiens
auugcaaagguucca

SEQ ID NO: 1140696 - RNA, 16 nt, Homo sapiens
auugcacauuguucaa

SEQ ID NO: 1140697 - RNA, 16 nt, Homo sapiens
auugcaccacugcacu

SEQ ID NO: 1140698 - RNA, 11 nt, Homo sapiens
auugcacuucu

SEQ ID NO: 1140699 - RNA, 20 nt, Homo sapiens
auugcagauucgagucacgu

SEQ ID NO: 1140700 - RNA, 24 nt, Homo sapiens
auugcagauucgagucacguccuu

SEQ ID NO: 1140701 - RNA, 18 nt, Homo sapiens
auugcagcuugaaaaaga

SEQ ID NO: 1140702 - RNA, 15 nt, Homo sapiens
auugcaugugacucu

SEQ ID NO: 1140703 - RNA, 12 nt, Homo sapiens
auugccaaaaag

SEQ ID NO: 1140704 - RNA, 14 nt, Homo sapiens
auugccucuacuuu

SEQ ID NO: 1140705 - RNA, 19 nt, Homo sapiens
auugcuagguuuugcuaca

SEQ ID NO: 1140706 - RNA, 15 nt, Homo sapiens
auugcuaguuuauuu

SEQ ID NO: 1140707 - RNA, 17 nt, Homo sapiens
auugcucagagaaggaa

SEQ ID NO: 1140708 - RNA, 20 nt, Homo sapiens
auugcuccauuuucuuguca

SEQ ID NO: 1140709 - RNA, 14 nt, Homo sapiens
auugcucccuacca

SEQ ID NO: 1140710 - RNA, 21 nt, Homo sapiens
auugcucucccagcccuugca

SEQ ID NO: 1140711 - RNA, 19 nt, Homo sapiens
auugcuguugaaagcaaaa

SEQ ID NO: 1140712 - RNA, 14 nt, Homo sapiens
auuggaaccuguua

SEQ ID NO: 1140713 - RNA, 15 nt, Homo sapiens
auuggaaugcacagg

SEQ ID NO: 1140714 - RNA, 19 nt, Homo sapiens
auuggaccauccuauuuaa

SEQ ID NO: 1140715 - RNA, 13 nt, Homo sapiens
auuggagaugcaa

SEQ ID NO: 1140716 - RNA, 22 nt, Homo sapiens
auuggaggugaacaagcaaacc

SEQ ID NO: 1140717 - RNA, 15 nt, Homo sapiens
auuggaucagugaaa

SEQ ID NO: 1140718 - RNA, 13 nt, Homo sapiens
auuggaugcauuu

SEQ ID NO: 1140719 - RNA, 20 nt, Homo sapiens
auuggauuuguccaaacagg

SEQ ID NO: 1140720 - RNA, 21 nt, Homo sapiens
auuggcaccuaauccaggcag

SEQ ID NO: 1140721 - RNA, 22 nt, Homo sapiens
auuggcggggcuuaugacugca

SEQ ID NO: 1140722 - RNA, 22 nt, Homo sapiens
auuggcuacuaguuuaagcaaa

SEQ ID NO: 1140723 - RNA, 13 nt, Homo sapiens
auugggcaccuga

SEQ ID NO: 1140724 - RNA, 15 nt, Homo sapiens
auuggucucugggua

SEQ ID NO: 1140725 - RNA, 17 nt, Homo sapiens
auuggugcauagcagau

SEQ ID NO: 1140726 - RNA, 18 nt, Homo sapiens
auuguacauaaguaccuc

SEQ ID NO: 1140727 - RNA, 19 nt, Homo sapiens
auuguacauaaguaccuca

SEQ ID NO: 1140728 - RNA, 15 nt, Homo sapiens
auuguacuaaagcca

SEQ ID NO: 1140729 - RNA, 12 nt, Homo sapiens
auuguagcuuuu

SEQ ID NO: 1140730 - RNA, 20 nt, Homo sapiens
auuguaguccuguaauggaa

SEQ ID NO: 1140731 - RNA, 21 nt, Homo sapiens
auugugaauaaaaauugauga

SEQ ID NO: 1140732 - RNA, 16 nt, Homo sapiens
auugugaauuccuuaa

SEQ ID NO: 1140733 - RNA, 14 nt, Homo sapiens
auugugaugccaau

SEQ ID NO: 1140734 - RNA, 14 nt, Homo sapiens
auugugauugugga

SEQ ID NO: 1140735 - RNA, 19 nt, Homo sapiens
auuguggagccaaagccga

SEQ ID NO: 1140736 - RNA, 11 nt, Homo sapiens
auugugugagu

SEQ ID NO: 1140737 - RNA, 19 nt, Homo sapiens
auuguguguccaucuguua

SEQ ID NO: 1140738 - RNA, 15 nt, Homo sapiens
auuguguguucucac

SEQ ID NO: 1140739 - RNA, 12 nt, Homo sapiens
auuguguucucu

SEQ ID NO: 1140740 - RNA, 21 nt, Homo sapiens
auuguuggaguguaaaccaaa

SEQ ID NO: 1140741 - RNA, 22 nt, Homo sapiens
auuguuggcacauccuaugcaa

SEQ ID NO: 1140742 - RNA, 20 nt, Homo sapiens
auuguuucaucccauguaca

SEQ ID NO: 1140743 - RNA, 20 nt, Homo sapiens
auuuaaaaaaacgagcaauu

SEQ ID NO: 1140744 - RNA, 13 nt, Homo sapiens
auuuaaaagggaa

SEQ ID NO: 1140745 - RNA, 18 nt, Homo sapiens
auuuaaacaaugccaagu

SEQ ID NO: 1140746 - RNA, 15 nt, Homo sapiens
auuuaaagacaaaga

SEQ ID NO: 1140747 - RNA, 13 nt, Homo sapiens
auuuaaagcacau

SEQ ID NO: 1140748 - RNA, 16 nt, Homo sapiens
auuuaaaugcuuuuaa

SEQ ID NO: 1140749 - RNA, 17 nt, Homo sapiens
auuuaacuuacacugau

SEQ ID NO: 1140750 - RNA, 12 nt, Homo sapiens
auuuaacuuucc

SEQ ID NO: 1140751 - RNA, 13 nt, Homo sapiens
auuuaacuuucca

SEQ ID NO: 1140752 - RNA, 14 nt, Homo sapiens
auuuaagacacugu

SEQ ID NO: 1140753 - RNA, 19 nt, Homo sapiens
auuuaagugauacauaccu

SEQ ID NO: 1140754 - RNA, 17 nt, Homo sapiens
auuuaaguucaagagaa

SEQ ID NO: 1140755 - RNA, 20 nt, Homo sapiens
auuuaauacacaaugcauca

SEQ ID NO: 1140756 - RNA, 11 nt, Homo sapiens
auuuaauuccu

SEQ ID NO: 1140757 - RNA, 13 nt, Homo sapiens
auuuacaccacac

SEQ ID NO: 1140758 - RNA, 17 nt, Homo sapiens
auuuacauauagcugau

SEQ ID NO: 1140759 - RNA, 18 nt, Homo sapiens
auuuacauauagcugaua

SEQ ID NO: 1140760 - RNA, 20 nt, Homo sapiens
auuuagaaaaagaacaugca

SEQ ID NO: 1140761 - RNA, 17 nt, Homo sapiens
auuuagaacagucauua

SEQ ID NO: 1140762 - RNA, 14 nt, Homo sapiens
auuuagaaguguca

SEQ ID NO: 1140763 - RNA, 18 nt, Homo sapiens
auuuagaccccauacaag

SEQ ID NO: 1140764 - RNA, 17 nt, Homo sapiens
auuuagacucaucuuac

SEQ ID NO: 1140765 - RNA, 22 nt, Homo sapiens
auuuagauccugguuucauaac

SEQ ID NO: 1140766 - RNA, 22 nt, Homo sapiens
auuuagccaggaccugccaaug

SEQ ID NO: 1140767 - RNA, 19 nt, Homo sapiens
auuuaggagaagccaggaa

SEQ ID NO: 1140768 - RNA, 18 nt, Homo sapiens
auuuauaaugaagacauc

SEQ ID NO: 1140769 - RNA, 14 nt, Homo sapiens
auuuaucaccuuaa

SEQ ID NO: 1140770 - RNA, 13 nt, Homo sapiens
auuuaucaguaca

SEQ ID NO: 1140771 - RNA, 16 nt, Homo sapiens
auuuaucccuggugca

SEQ ID NO: 1140772 - RNA, 19 nt, Homo sapiens
auuuaugaccagagcaaaa

SEQ ID NO: 1140773 - RNA, 16 nt, Homo sapiens
auuuauggccguauca

SEQ ID NO: 1140774 - RNA, 21 nt, Homo sapiens
auuuauguaacuugaaccuau

SEQ ID NO: 1140775 - RNA, 22 nt, Homo sapiens
auuuaugucucagaccacuauu

SEQ ID NO: 1140776 - RNA, 21 nt, Homo sapiens
auuucaagaaguguaguucaa

SEQ ID NO: 1140777 - RNA, 13 nt, Homo sapiens
auuucaagaccuc

SEQ ID NO: 1140778 - RNA, 20 nt, Homo sapiens
auuucaauaguuauccccag

SEQ ID NO: 1140779 - RNA, 15 nt, Homo sapiens
auuucaauauuagca

SEQ ID NO: 1140780 - RNA, 22 nt, Homo sapiens
auuucaauauuagcaagacagc

SEQ ID NO: 1140781 - RNA, 16 nt, Homo sapiens
auuucacaugccuugc

SEQ ID NO: 1140782 - RNA, 23 nt, Homo sapiens
auuucaccuugaaaaagcaccaa

SEQ ID NO: 1140783 - RNA, 18 nt, Homo sapiens
guaccagaugcagcucaa

SEQ ID NO: 1140784 - RNA, 14 nt, Homo sapiens
guacccagugccua

SEQ ID NO: 1140785 - RNA, 20 nt, Homo sapiens
guacccagugccuacagggc

SEQ ID NO: 1140786 - RNA, 12 nt, Homo sapiens
guaccccaugac

SEQ ID NO: 1140787 - RNA, 20 nt, Homo sapiens
guaccugcaaguauccagac

SEQ ID NO: 1140788 - RNA, 16 nt, Homo sapiens
guaccuuauugaucuu

SEQ ID NO: 1140789 - RNA, 21 nt, Homo sapiens
guaccuucaaacuagggccaa

SEQ ID NO: 1140790 - RNA, 18 nt, Homo sapiens
guaccuucccacuggccu

SEQ ID NO: 1140791 - RNA, 17 nt, Homo sapiens
guaccuuguuuugccau

SEQ ID NO: 1140792 - RNA, 12 nt, Homo sapiens
guacuaaagcca

SEQ ID NO: 1140793 - RNA, 14 nt, Homo sapiens
guacuacacaccgc

SEQ ID NO: 1140794 - RNA, 15 nt, Homo sapiens
guacuacauaccuca

SEQ ID NO: 1140795 - RNA, 22 nt, Homo sapiens
guacucaucugacuugaacucu

SEQ ID NO: 1140796 - RNA, 20 nt, Homo sapiens
guacugaagauuaucacuua

SEQ ID NO: 1140797 - RNA, 15 nt, Homo sapiens
guacuugucaaagaa

SEQ ID NO: 1140798 - RNA, 21 nt, Homo sapiens
guacuuuuuguuccagagcug

SEQ ID NO: 1140799 - RNA, 22 nt, Homo sapiens
guagaaaaacccaaacugagac

SEQ ID NO: 1140800 - RNA, 17 nt, Homo sapiens
guagaaagauacacuga

SEQ ID NO: 1140801 - RNA, 22 nt, Homo sapiens
guagaaauuaacaaaugugcug

SEQ ID NO: 1140802 - RNA, 17 nt, Homo sapiens
guagaacaauguacaag

SEQ ID NO: 1140803 - RNA, 14 nt, Homo sapiens
guagaagaagugaa

SEQ ID NO: 1140804 - RNA, 18 nt, Homo sapiens
guagacucauucuucaca

SEQ ID NO: 1140805 - RNA, 21 nt, Homo sapiens
guagagacgguguuuugccau

SEQ ID NO: 1140806 - RNA, 22 nt, Homo sapiens
guagagcaaaggagacaaagca

SEQ ID NO: 1140807 - RNA, 12 nt, Homo sapiens
guagaguggugc

SEQ ID NO: 1140808 - RNA, 14 nt, Homo sapiens
guagaguggugcug

SEQ ID NO: 1140809 - RNA, 17 nt, Homo sapiens
guagaguggugcugcuu

SEQ ID NO: 1140810 - RNA, 16 nt, Homo sapiens
guagcaaacuuuucac

SEQ ID NO: 1140811 - RNA, 19 nt, Homo sapiens
guagcauggcucuuucaua

SEQ ID NO: 1140812 - RNA, 20 nt, Homo sapiens
guagccaucaagcacuuccc

SEQ ID NO: 1140813 - RNA, 17 nt, Homo sapiens
guagccugugcauguau

SEQ ID NO: 1140814 - RNA, 15 nt, Homo sapiens
guagccuuacuguga

SEQ ID NO: 1140815 - RNA, 22 nt, Homo sapiens
guagccuuagugucaccuuucu

SEQ ID NO: 1140816 - RNA, 14 nt, Homo sapiens
guagcuacaggaca

SEQ ID NO: 1140817 - RNA, 20 nt, Homo sapiens
guagcugccccuggcucuga

SEQ ID NO: 1140818 - RNA, 11 nt, Homo sapiens
guagcugcuac

SEQ ID NO: 1140819 - RNA, 15 nt, Homo sapiens
guaggaaacaauucu

SEQ ID NO: 1140820 - RNA, 21 nt, Homo sapiens
guaggagcugccuuggcucag

SEQ ID NO: 1140821 - RNA, 23 nt, Homo sapiens
guaggcccugcuuuaucagggga

SEQ ID NO: 1140822 - RNA, 17 nt, Homo sapiens
guaggucauugcaccua

SEQ ID NO: 1140823 - RNA, 21 nt, Homo sapiens
guaguccagucucuccagcau

SEQ ID NO: 1140824 - RNA, 12 nt, Homo sapiens
guagucuugucu

SEQ ID NO: 1140825 - RNA, 18 nt, Homo sapiens
guagugauuaacugugaa

SEQ ID NO: 1140826 - RNA, 16 nt, Homo sapiens
guagugcuuuaagaau

SEQ ID NO: 1140827 - RNA, 15 nt, Homo sapiens
guauaacagcacaau

SEQ ID NO: 1140828 - RNA, 16 nt, Homo sapiens
guauacauuacaauca

SEQ ID NO: 1140829 - RNA, 14 nt, Homo sapiens
guauacauuuacug

SEQ ID NO: 1140830 - RNA, 15 nt, Homo sapiens
guauaccaaggcaaa

SEQ ID NO: 1140831 - RNA, 17 nt, Homo sapiens
guauacuaagugauaca

SEQ ID NO: 1140832 - RNA, 19 nt, Homo sapiens
guauauuacccaauggaaa

SEQ ID NO: 1140833 - RNA, 21 nt, Homo sapiens
guaucaaaugugacauuauau

SEQ ID NO: 1140834 - RNA, 16 nt, Homo sapiens
guaucauagcgauauu

SEQ ID NO: 1140835 - RNA, 12 nt, Homo sapiens
guaucaucagac

SEQ ID NO: 1140836 - RNA, 22 nt, Homo sapiens
guaucgcauauuaguuaaucuc

SEQ ID NO: 1140837 - RNA, 14 nt, Homo sapiens
guaucgcugagacu

SEQ ID NO: 1140838 - RNA, 16 nt, Homo sapiens
guaucuaaaaguguca

SEQ ID NO: 1140839 - RNA, 22 nt, Homo sapiens
guaucugcauguaaaaucuuca

SEQ ID NO: 1140840 - RNA, 22 nt, Homo sapiens
guaucuucguaacuucauauua

SEQ ID NO: 1140841 - RNA, 19 nt, Homo sapiens
guaucuuuuugaaaauguu

SEQ ID NO: 1140842 - RNA, 18 nt, Homo sapiens
guaugauuuauccucaca

SEQ ID NO: 1140843 - RNA, 18 nt, Homo sapiens
guauggcguugguuugug

SEQ ID NO: 1140844 - RNA, 22 nt, Homo sapiens
guauguuuuaauugcauuuaaa

SEQ ID NO: 1140845 - RNA, 21 nt, Homo sapiens
guauguuuucuguaaggaaua

SEQ ID NO: 1140846 - RNA, 13 nt, Homo sapiens
guauuaacacuua

SEQ ID NO: 1140847 - RNA, 22 nt, Homo sapiens
guauuauuacggagacuuucaa

SEQ ID NO: 1140848 - RNA, 15 nt, Homo sapiens
guauuauuugcuaua

SEQ ID NO: 1140849 - RNA, 23 nt, Homo sapiens
guauugaaucauguaguaucaaa

SEQ ID NO: 1140850 - RNA, 21 nt, Homo sapiens
guauuucacagagcacgccug

SEQ ID NO: 1140851 - RNA, 16 nt, Homo sapiens
guauuugggaaacuug

SEQ ID NO: 1140852 - RNA, 18 nt, Homo sapiens
guauuuuaauaguacaua

SEQ ID NO: 1140853 - RNA, 16 nt, Homo sapiens
guauuuuacuuuucca

SEQ ID NO: 1140854 - RNA, 16 nt, Homo sapiens
guauuuugaaaacacu

SEQ ID NO: 1140855 - RNA, 22 nt, Homo sapiens
guauuuuuaguagagacagggu

SEQ ID NO: 1140856 - RNA, 18 nt, Homo sapiens
guauuuuuucacuuguac

SEQ ID NO: 1140857 - RNA, 20 nt, Homo sapiens
guauuuuuucuugcauugac

SEQ ID NO: 1140858 - RNA, 20 nt, Homo sapiens
gucaaaacccaccaaaacca

SEQ ID NO: 1140859 - RNA, 13 nt, Homo sapiens
gucaaauacaaaa

SEQ ID NO: 1140860 - RNA, 16 nt, Homo sapiens
gucaacuuucauuuga

SEQ ID NO: 1140861 - RNA, 18 nt, Homo sapiens
gucaauccccucauucag

SEQ ID NO: 1140862 - RNA, 18 nt, Homo sapiens
gucacaaagaccuugcug

SEQ ID NO: 1140863 - RNA, 21 nt, Homo sapiens
gucacacauuucuauuuugca

SEQ ID NO: 1140864 - RNA, 12 nt, Homo sapiens
gucacacucugu

SEQ ID NO: 1140865 - RNA, 18 nt, Homo sapiens
gucacaucaagcaucauu

SEQ ID NO: 1140866 - RNA, 18 nt, Homo sapiens
gucacaugcccauucaca

SEQ ID NO: 1140867 - RNA, 16 nt, Homo sapiens
gucaccacgacuggcc

SEQ ID NO: 1140868 - RNA, 16 nt, Homo sapiens
gucaccccucacugug

SEQ ID NO: 1140869 - RNA, 20 nt, Homo sapiens
gucaccuaacccucugucac

SEQ ID NO: 1140870 - RNA, 21 nt, Homo sapiens
gucacgagcguucaaacugcu

SEQ ID NO: 1140871 - RNA, 22 nt, Homo sapiens
gucacgcuuucaugaauucugu

SEQ ID NO: 1140872 - RNA, 11 nt, Homo sapiens
gucacucagcc

SEQ ID NO: 1140873 - RNA, 15 nt, Homo sapiens
gucacucauugcuga

SEQ ID NO: 1140874 - RNA, 23 nt, Homo sapiens
gucacugaggccugagacccagg

SEQ ID NO: 1140875 - RNA, 16 nt, Homo sapiens
gucacuucuccaucac

SEQ ID NO: 1140876 - RNA, 13 nt, Homo sapiens
gucagaacuagaa

SEQ ID NO: 1140877 - RNA, 17 nt, Homo sapiens
gucagacuuuucuuugc

SEQ ID NO: 1140878 - RNA, 12 nt, Homo sapiens
gucagaugucac

SEQ ID NO: 1140879 - RNA, 16 nt, Homo sapiens
gucagccaugucugug

SEQ ID NO: 1140880 - RNA, 15 nt, Homo sapiens
gucaggaaacauuca

SEQ ID NO: 1140881 - RNA, 15 nt, Homo sapiens
gucaggcaauugauu

SEQ ID NO: 1140882 - RNA, 17 nt, Homo sapiens
gucaggcagggugcagu

SEQ ID NO: 1140883 - RNA, 17 nt, Homo sapiens
gucaggcuggucucaaa

SEQ ID NO: 1140884 - RNA, 11 nt, Homo sapiens
gucagggccau

SEQ ID NO: 1140885 - RNA, 16 nt, Homo sapiens
gucauaagugacaguu

SEQ ID NO: 1140886 - RNA, 18 nt, Homo sapiens
gucauaccuacauucaag

SEQ ID NO: 1140887 - RNA, 23 nt, Homo sapiens
gucauauuauuauuaauuuugcc

SEQ ID NO: 1140888 - RNA, 18 nt, Homo sapiens
gucaucaugaacuggcuu

SEQ ID NO: 1140889 - RNA, 22 nt, Homo sapiens
gucaucaugaacuggcuuguac

SEQ ID NO: 1140890 - RNA, 21 nt, Homo sapiens
gucaucucucacacauuccag

SEQ ID NO: 1140891 - RNA, 20 nt, Homo sapiens
gucaucugccaacuguccua

SEQ ID NO: 1140892 - RNA, 13 nt, Homo sapiens
gucaucugugcac

SEQ ID NO: 1140893 - RNA, 16 nt, Homo sapiens
gucaugcuucaucauu

SEQ ID NO: 1140894 - RNA, 13 nt, Homo sapiens
gucauggaugucc

SEQ ID NO: 1140895 - RNA, 17 nt, Homo sapiens
gucauggccacacugug

SEQ ID NO: 1140896 - RNA, 17 nt, Homo sapiens
gucauguggcuaccugu

SEQ ID NO: 1140897 - RNA, 17 nt, Homo sapiens
gucauugcaccuaucuc

SEQ ID NO: 1140898 - RNA, 18 nt, Homo sapiens
gucauuggaaacacugcc

SEQ ID NO: 1140899 - RNA, 16 nt, Homo sapiens
gucauuguaaucacug

SEQ ID NO: 1140900 - RNA, 19 nt, Homo sapiens
guccaaggcaggaggccau

SEQ ID NO: 1140901 - RNA, 18 nt, Homo sapiens
guccacuuguggguccug

SEQ ID NO: 1140902 - RNA, 23 nt, Homo sapiens
guccagacgcacugaucuuugca

SEQ ID NO: 1140903 - RNA, 15 nt, Homo sapiens
guccaggacuggguc

SEQ ID NO: 1140904 - RNA, 20 nt, Homo sapiens
guccagucucuccagcauca

SEQ ID NO: 1140905 - RNA, 14 nt, Homo sapiens
guccauacaccagc

SEQ ID NO: 1140906 - RNA, 12 nt, Homo sapiens
guccauuaucua

SEQ ID NO: 1140907 - RNA, 17 nt, Homo sapiens
guccauuguccaauccu

SEQ ID NO: 1140908 - RNA, 22 nt, Homo sapiens
guccauuugcugaguuucccuu

SEQ ID NO: 1140909 - RNA, 19 nt, Homo sapiens
guccauuuugcccuuccau

SEQ ID NO: 1140910 - RNA, 17 nt, Homo sapiens
gucccacuaucugggug

SEQ ID NO: 1140911 - RNA, 23 nt, Homo sapiens
gucccaugugauuuaaacaaaca

SEQ ID NO: 1140912 - RNA, 14 nt, Homo sapiens
guccccacagacug

SEQ ID NO: 1140913 - RNA, 15 nt, Homo sapiens
gucccccccaggugc

SEQ ID NO: 1140914 - RNA, 20 nt, Homo sapiens
guccccgaugcugaccucac

SEQ ID NO: 1140915 - RNA, 20 nt, Homo sapiens
guccccuucccaggggcgag

SEQ ID NO: 1140916 - RNA, 19 nt, Homo sapiens
gucccggggccagcacuuc

SEQ ID NO: 1140917 - RNA, 13 nt, Homo sapiens
gucccguggcauu

SEQ ID NO: 1140918 - RNA, 17 nt, Homo sapiens
gucccugaagucuugca

SEQ ID NO: 1140919 - RNA, 20 nt, Homo sapiens
gucccuggcaagacugucuu

SEQ ID NO: 1140920 - RNA, 18 nt, Homo sapiens
gucccugucaccaagcuc

SEQ ID NO: 1140921 - RNA, 21 nt, Homo sapiens
gucccuucagcaccugacccu

SEQ ID NO: 1140922 - RNA, 14 nt, Homo sapiens
guccuaccuauuau

SEQ ID NO: 1140923 - RNA, 17 nt, Homo sapiens
guccuagagcuacaggg

SEQ ID NO: 1140924 - RNA, 21 nt, Homo sapiens
guccuagagugccuccagggu

SEQ ID NO: 1140925 - RNA, 19 nt, Homo sapiens
guccuccacacaagggaag

SEQ ID NO: 1140926 - RNA, 16 nt, Homo sapiens
guccucccaggccagg

SEQ ID NO: 1140927 - RNA, 22 nt, Homo sapiens
guccucugucagucacagccac

SEQ ID NO: 1140928 - RNA, 21 nt, Homo sapiens
guccucuucugcaucuugggg

SEQ ID NO: 1140929 - RNA, 21 nt, Homo sapiens
guccucuuugugauaauucuc

SEQ ID NO: 1140930 - RNA, 15 nt, Homo sapiens
guccugaagcugcug

SEQ ID NO: 1140931 - RNA, 17 nt, Homo sapiens
guccugacagcacuccu

SEQ ID NO: 1140932 - RNA, 20 nt, Homo sapiens
guccugaugcuuuugucuaa

SEQ ID NO: 1140933 - RNA, 21 nt, Homo sapiens
guccugcuccgcugccuggaa

SEQ ID NO: 1140934 - RNA, 14 nt, Homo sapiens
guccuggcugugaa

SEQ ID NO: 1140935 - RNA, 19 nt, Homo sapiens
guccuucaccucacugaaa

SEQ ID NO: 1140936 - RNA, 22 nt, Homo sapiens
guccuuccugugcccugcaaau

SEQ ID NO: 1140937 - RNA, 20 nt, Homo sapiens
guccuucuugaauucaugua

SEQ ID NO: 1140938 - RNA, 21 nt, Homo sapiens
guccuuuuuuccuuccuucuc

SEQ ID NO: 1140939 - RNA, 16 nt, Homo sapiens
gucgaacaauucauau

SEQ ID NO: 1140940 - RNA, 18 nt, Homo sapiens
gucgaagcaaucagcaaa

SEQ ID NO: 1140941 - RNA, 20 nt, Homo sapiens
gucgaguuuucaaugugaau

SEQ ID NO: 1140942 - RNA, 21 nt, Homo sapiens
gucgcccuuacuucuugcccu

SEQ ID NO: 1140943 - RNA, 20 nt, Homo sapiens
gucgcugaaauuaaaugcca

SEQ ID NO: 1140944 - RNA, 14 nt, Homo sapiens
gucgugagugucuc

SEQ ID NO: 1140945 - RNA, 14 nt, Homo sapiens
gucuaaaagcagaa

SEQ ID NO: 1140946 - RNA, 22 nt, Homo sapiens
gucuaauucauuuacucaccau

SEQ ID NO: 1140947 - RNA, 19 nt, Homo sapiens
gucuacguaugcaugcuaa

SEQ ID NO: 1140948 - RNA, 14 nt, Homo sapiens
gucuagauucucug

SEQ ID NO: 1140949 - RNA, 18 nt, Homo sapiens
gucuaguagcggaucuca

SEQ ID NO: 1140950 - RNA, 17 nt, Homo sapiens
gucuaguuaacauuuca

SEQ ID NO: 1140951 - RNA, 23 nt, Homo sapiens
gucuauuguauauauaaucuaua

SEQ ID NO: 1140952 - RNA, 14 nt, Homo sapiens
gucucaauugggaa

SEQ ID NO: 1140953 - RNA, 14 nt, Homo sapiens
gucuccacugggga

SEQ ID NO: 1140954 - RNA, 17 nt, Homo sapiens
gucucccagcucagggc

SEQ ID NO: 1140955 - RNA, 15 nt, Homo sapiens
gucucgaacuccuga

SEQ ID NO: 1140956 - RNA, 14 nt, Homo sapiens
gucucgaugcugcu

SEQ ID NO: 1140957 - RNA, 23 nt, Homo sapiens
gucucgucuccugacaugucuca

SEQ ID NO: 1140958 - RNA, 18 nt, Homo sapiens
gucucuacccaguagaug

SEQ ID NO: 1140959 - RNA, 18 nt, Homo sapiens
gucucucauucuaggccu

SEQ ID NO: 1140960 - RNA, 22 nt, Homo sapiens
gucucugacaaagugugucuca

SEQ ID NO: 1140961 - RNA, 18 nt, Homo sapiens
gucucugcuccaccuuuc

SEQ ID NO: 1140962 - RNA, 16 nt, Homo sapiens
gucucuggaacccagg

SEQ ID NO: 1140963 - RNA, 21 nt, Homo sapiens
gucucuguuccaugucuccuu

SEQ ID NO: 1140964 - RNA, 18 nt, Homo sapiens
gucucuguugacuggcug

SEQ ID NO: 1140965 - RNA, 20 nt, Homo sapiens
gucucuuaauucugaugcua

SEQ ID NO: 1140966 - RNA, 17 nt, Homo sapiens
gucucuucuaagcaaaa

SEQ ID NO: 1140967 - RNA, 19 nt, Homo sapiens
gucugcaauggugacugau

SEQ ID NO: 1140968 - RNA, 13 nt, Homo sapiens
gucugcguggaau

SEQ ID NO: 1140969 - RNA, 15 nt, Homo sapiens
gucugcucaaugcca

SEQ ID NO: 1140970 - RNA, 21 nt, Homo sapiens
gucugcuggcuucuacacugg

SEQ ID NO: 1140971 - RNA, 16 nt, Homo sapiens
gucuggcaucucccac

SEQ ID NO: 1140972 - RNA, 18 nt, Homo sapiens
gucugggagucacacagu

SEQ ID NO: 1140973 - RNA, 21 nt, Homo sapiens
gucugggcucccugcgccuga

SEQ ID NO: 1140974 - RNA, 13 nt, Homo sapiens
gucugguuuauuu

SEQ ID NO: 1140975 - RNA, 17 nt, Homo sapiens
gucuguacuaaaaauac

SEQ ID NO: 1140976 - RNA, 22 nt, Homo sapiens
gucuguccuugggaugcucucu

SEQ ID NO: 1140977 - RNA, 20 nt, Homo sapiens
gucuguguagaguguuauac

SEQ ID NO: 1140978 - RNA, 15 nt, Homo sapiens
gucuguuacacugga

SEQ ID NO: 1140979 - RNA, 18 nt, Homo sapiens
gucuguuuggacugcaga

SEQ ID NO: 1140980 - RNA, 20 nt, Homo sapiens
gucuuaaggacaaagugcca

SEQ ID NO: 1140981 - RNA, 19 nt, Homo sapiens
gucuuaccuggcagcaaac

SEQ ID NO: 1140982 - RNA, 16 nt, Homo sapiens
gucuuacuuugugcaa

SEQ ID NO: 1140983 - RNA, 13 nt, Homo sapiens
gucuucuaaacuu

SEQ ID NO: 1140984 - RNA, 14 nt, Homo sapiens
gucuucugcuccau

SEQ ID NO: 1140985 - RNA, 21 nt, Homo sapiens
gucuugaccugaacucugcaa

SEQ ID NO: 1140986 - RNA, 11 nt, Homo sapiens
gucuugaucuc

SEQ ID NO: 1140987 - RNA, 14 nt, Homo sapiens
gucuugccaugugc

SEQ ID NO: 1140988 - RNA, 23 nt, Homo sapiens
gucuugccuugcugaacucccuc

SEQ ID NO: 1140989 - RNA, 17 nt, Homo sapiens
gucuuggcagcaccugu

SEQ ID NO: 1140990 - RNA, 14 nt, Homo sapiens
gucuuggcuuucau

SEQ ID NO: 1140991 - RNA, 20 nt, Homo sapiens
gucuuggcuuucauguuauu

SEQ ID NO: 1140992 - RNA, 17 nt, Homo sapiens
gucuugguguaguguaa

SEQ ID NO: 1140993 - RNA, 15 nt, Homo sapiens
gucuugucuauugua

SEQ ID NO: 1140994 - RNA, 17 nt, Homo sapiens
gucuugucuuagcucug

SEQ ID NO: 1140995 - RNA, 15 nt, Homo sapiens
gucuuuacagaauca

SEQ ID NO: 1140996 - RNA, 22 nt, Homo sapiens
gucuuuagggguugggcuggau

SEQ ID NO: 1140997 - RNA, 21 nt, Homo sapiens
gucuuuccacuccuccuagcc

SEQ ID NO: 1140998 - RNA, 21 nt, Homo sapiens
gucuuucccauuucuaccuaa

SEQ ID NO: 1140999 - RNA, 20 nt, Homo sapiens
gucuuuccuaaggcugcaag

SEQ ID NO: 1141000 - RNA, 19 nt, Homo sapiens
gucuuugccagucauucag

SEQ ID NO: 1141001 - RNA, 21 nt, Homo sapiens
gucuuuguaaugucaccaccu

SEQ ID NO: 1141002 - RNA, 23 nt, Homo sapiens
gucuuuugguugccauggucacc

SEQ ID NO: 1141003 - RNA, 21 nt, Homo sapiens
gugaaaaaguuaaacauugaa

SEQ ID NO: 1141004 - RNA, 22 nt, Homo sapiens
gugaaacccccaucucuacuaa

SEQ ID NO: 1141005 - RNA, 19 nt, Homo sapiens
gugaaagaaaauucuugga

SEQ ID NO: 1141006 - RNA, 17 nt, Homo sapiens
gugaaauaaacagucua

SEQ ID NO: 1141007 - RNA, 18 nt, Homo sapiens
gugaaauaguuacuauuu

SEQ ID NO: 1141008 - RNA, 12 nt, Homo sapiens
gugaaaugaagc

SEQ ID NO: 1141009 - RNA, 15 nt, Homo sapiens
gugaacugaaauuaa

SEQ ID NO: 1141010 - RNA, 17 nt, Homo sapiens
gugaagaaaaauguauu

SEQ ID NO: 1141011 - RNA, 22 nt, Homo sapiens
gugaagaacuauuuuauucuaa

SEQ ID NO: 1141012 - RNA, 23 nt, Homo sapiens
gugaagcauucgagacagaaccu

SEQ ID NO: 1141013 - RNA, 17 nt, Homo sapiens
gugaaguguucugcuga

SEQ ID NO: 1141014 - RNA, 18 nt, Homo sapiens
gugaaguguucugcugag

SEQ ID NO: 1141015 - RNA, 17 nt, Homo sapiens
gugaauacucuucccac

SEQ ID NO: 1141016 - RNA, 14 nt, Homo sapiens
gugaauccugugca

SEQ ID NO: 1141017 - RNA, 14 nt, Homo sapiens
gugaauugucuuug

SEQ ID NO: 1141018 - RNA, 14 nt, Homo sapiens
gugaauuuuugcaa

SEQ ID NO: 1141019 - RNA, 20 nt, Homo sapiens
gugaauuuuugcacauucua

SEQ ID NO: 1141020 - RNA, 23 nt, Homo sapiens
gugacacacuacaccacacacaa

SEQ ID NO: 1141021 - RNA, 13 nt, Homo sapiens
gugacacccaaga

SEQ ID NO: 1141022 - RNA, 20 nt, Homo sapiens
gugacacucuccuugcaguu

SEQ ID NO: 1141023 - RNA, 18 nt, Homo sapiens
gugacagcuuuccucaaa

SEQ ID NO: 1141024 - RNA, 17 nt, Homo sapiens
gugacauuuccaugcau

SEQ ID NO: 1141025 - RNA, 15 nt, Homo sapiens
gugaccaaaucagug

SEQ ID NO: 1141026 - RNA, 16 nt, Homo sapiens
gugaccacugaagcac

SEQ ID NO: 1141027 - RNA, 14 nt, Homo sapiens
gugaccagugcugc

SEQ ID NO: 1141028 - RNA, 22 nt, Homo sapiens
gugacuaaaaaugcaucuggcu

SEQ ID NO: 1141029 - RNA, 23 nt, Homo sapiens
uuuugggggggggcggacaggag

SEQ ID NO: 1141030 - RNA, 13 nt, Homo sapiens
uuuuguaaacagc

SEQ ID NO: 1141031 - RNA, 11 nt, Homo sapiens
uuuuguacugg

SEQ ID NO: 1141032 - RNA, 15 nt, Homo sapiens
uuuuguauaauugua

SEQ ID NO: 1141033 - RNA, 13 nt, Homo sapiens
uuuugugauugcc

SEQ ID NO: 1141034 - RNA, 13 nt, Homo sapiens
uuuugugcuacag

SEQ ID NO: 1141035 - RNA, 22 nt, Homo sapiens
uuuuguuaacugauuugcaaua

SEQ ID NO: 1141036 - RNA, 14 nt, Homo sapiens
uuuuguucauauuc

SEQ ID NO: 1141037 - RNA, 13 nt, Homo sapiens
uuuuguucuugcc

SEQ ID NO: 1141038 - RNA, 14 nt, Homo sapiens
uuuuguugccuuca

SEQ ID NO: 1141039 - RNA, 18 nt, Homo sapiens
uuuuguuuugaagcuguu

SEQ ID NO: 1141040 - RNA, 22 nt, Homo sapiens
uuuuuaacauguauucuguucu

SEQ ID NO: 1141041 - RNA, 15 nt, Homo sapiens
uuuuuaacugauucu

SEQ ID NO: 1141042 - RNA, 14 nt, Homo sapiens
uuuuuaauuaacca

SEQ ID NO: 1141043 - RNA, 20 nt, Homo sapiens
uuuuuacuaaucuuucugca

SEQ ID NO: 1141044 - RNA, 17 nt, Homo sapiens
uuuuuagaaaucacaac

SEQ ID NO: 1141045 - RNA, 14 nt, Homo sapiens
uuuuuagaaaucag

SEQ ID NO: 1141046 - RNA, 20 nt, Homo sapiens
uuuuuauaaaaaugagugcu

SEQ ID NO: 1141047 - RNA, 21 nt, Homo sapiens
uuuuuauauuuuauacugcac

SEQ ID NO: 1141048 - RNA, 18 nt, Homo sapiens
uuuuuauucugaauaaua

SEQ ID NO: 1141049 - RNA, 13 nt, Homo sapiens
uuuuuccaucccu

SEQ ID NO: 1141050 - RNA, 19 nt, Homo sapiens
uuuuucgauaaacuaacua

SEQ ID NO: 1141051 - RNA, 22 nt, Homo sapiens
uuuuucugauagaaaugguuuc

SEQ ID NO: 1141052 - RNA, 15 nt, Homo sapiens
uuuuucuuuuuccac

SEQ ID NO: 1141053 - RNA, 15 nt, Homo sapiens
uuuuugcaguauggu

SEQ ID NO: 1141054 - RNA, 22 nt, Homo sapiens
uuuuugcccagagaguccagcu

SEQ ID NO: 1141055 - RNA, 11 nt, Homo sapiens
uuuuugcugaa

SEQ ID NO: 1141056 - RNA, 13 nt, Homo sapiens
uuuuugcuuccaa

SEQ ID NO: 1141057 - RNA, 16 nt, Homo sapiens
uuuuuguaaagccaag

SEQ ID NO: 1141058 - RNA, 15 nt, Homo sapiens
uuuuuguuccugccu

SEQ ID NO: 1141059 - RNA, 13 nt, Homo sapiens
uuuuuuaaacuag

SEQ ID NO: 1141060 - RNA, 12 nt, Homo sapiens
uuuuuuccacaa

SEQ ID NO: 1141061 - RNA, 11 nt, Homo sapiens
uuuuuugccag

SEQ ID NO: 1141062 - RNA, 15 nt, Homo sapiens
uuucuucuaccagac

SEQ ID NO: 1141063 - RNA, 23 nt, Homo sapiens
uuucuucuacugcuaucuacuac

SEQ ID NO: 1141064 - RNA, 17 nt, Homo sapiens
uuucuugcuaagcucca

SEQ ID NO: 1141065 - RNA, 18 nt, Homo sapiens
uuucuuguauuuuuccaa

SEQ ID NO: 1141066 - RNA, 15 nt, Homo sapiens
uuucuuuaaagccag

SEQ ID NO: 1141067 - RNA, 18 nt, Homo sapiens
uuucuuuaagucaguuca

SEQ ID NO: 1141068 - RNA, 15 nt, Homo sapiens
uuucuuucauucucu

SEQ ID NO: 1141069 - RNA, 11 nt, Homo sapiens
uuucuuuccaa

SEQ ID NO: 1141070 - RNA, 13 nt, Homo sapiens
uuucuuuccucag

SEQ ID NO: 1141071 - RNA, 20 nt, Homo sapiens
uuucuuuugugcagaucacu

SEQ ID NO: 1141072 - RNA, 23 nt, Homo sapiens
uuugaaaaaaagaaagcauuugu

SEQ ID NO: 1141073 - RNA, 19 nt, Homo sapiens
uuugaaaaauaaugacucu

SEQ ID NO: 1141074 - RNA, 17 nt, Homo sapiens
uuugaacgugccagcag

SEQ ID NO: 1141075 - RNA, 18 nt, Homo sapiens
uuugaacgugccagcagc

SEQ ID NO: 1141076 - RNA, 15 nt, Homo sapiens
uuugaagaguacaaa

SEQ ID NO: 1141077 - RNA, 12 nt, Homo sapiens
uuugaaggcaaa

SEQ ID NO: 1141078 - RNA, 12 nt, Homo sapiens
uuugaaguagga

SEQ ID NO: 1141079 - RNA, 15 nt, Homo sapiens
uuugaaucaauguau

SEQ ID NO: 1141080 - RNA, 22 nt, Homo sapiens
uuugaaugguuuucuaauaucu

SEQ ID NO: 1141081 - RNA, 19 nt, Homo sapiens
uuugacaaaacccacuguu

SEQ ID NO: 1141082 - RNA, 19 nt, Homo sapiens
uuugacaacgccaacugcc

SEQ ID NO: 1141083 - RNA, 21 nt, Homo sapiens
uuugacaacgccaacugccca

SEQ ID NO: 1141084 - RNA, 22 nt, Homo sapiens
uuugagaagaaaacaucuauuc

SEQ ID NO: 1141085 - RNA, 13 nt, Homo sapiens
uuugagacuccaa

SEQ ID NO: 1141086 - RNA, 20 nt, Homo sapiens
uuugagcugcugacugccaa

SEQ ID NO: 1141087 - RNA, 19 nt, Homo sapiens
uuugaggggccugugugga

SEQ ID NO: 1141088 - RNA, 14 nt, Homo sapiens
uuugaggucagggg

SEQ ID NO: 1141089 - RNA, 11 nt, Homo sapiens
uuugaguacag

SEQ ID NO: 1141090 - RNA, 20 nt, Homo sapiens
uuugauggagggacuggggu

SEQ ID NO: 1141091 - RNA, 15 nt, Homo sapiens
uuugauuauucagug

SEQ ID NO: 1141092 - RNA, 22 nt, Homo sapiens
uuugcaaaguacuguaagaaua

SEQ ID NO: 1141093 - RNA, 18 nt, Homo sapiens
uuugcaauaccaaguaua

SEQ ID NO: 1141094 - RNA, 13 nt, Homo sapiens
uuugcagagccuu

SEQ ID NO: 1141095 - RNA, 15 nt, Homo sapiens
uuugcaguucaccug

SEQ ID NO: 1141096 - RNA, 18 nt, Homo sapiens
uuugcauauuucaauguc

SEQ ID NO: 1141097 - RNA, 19 nt, Homo sapiens
uuugcauuaaauucacaaa

SEQ ID NO: 1141098 - RNA, 18 nt, Homo sapiens
uuugcccacacacacucc

SEQ ID NO: 1141099 - RNA, 22 nt, Homo sapiens
uuugcccauccucccaaucuca

SEQ ID NO: 1141100 - RNA, 16 nt, Homo sapiens
uuugcccccuugcccu

SEQ ID NO: 1141101 - RNA, 23 nt, Homo sapiens
uuugccucucgguugaaaccugu

SEQ ID NO: 1141102 - RNA, 16 nt, Homo sapiens
uuugcugcuguggaaa

SEQ ID NO: 1141103 - RNA, 14 nt, Homo sapiens
uuugcuugacuuca

SEQ ID NO: 1141104 - RNA, 15 nt, Homo sapiens
uuugcuuucugcuca

SEQ ID NO: 1141105 - RNA, 19 nt, Homo sapiens
uuugcuuuuccuucagggu

SEQ ID NO: 1141106 - RNA, 16 nt, Homo sapiens
uuuggaaugcacacag

SEQ ID NO: 1141107 - RNA, 21 nt, Homo sapiens
uuuggaccaccguucagucau

SEQ ID NO: 1141108 - RNA, 21 nt, Homo sapiens
uuuggaccuuacgaucaggca

SEQ ID NO: 1141109 - RNA, 18 nt, Homo sapiens
uuuggagauagauggaua

SEQ ID NO: 1141110 - RNA, 16 nt, Homo sapiens
uuuggaggaaagucaa

SEQ ID NO: 1141111 - RNA, 23 nt, Homo sapiens
uuuggauuccuaaauauuuucaa

SEQ ID NO: 1141112 - RNA, 22 nt, Homo sapiens
uuuggcaaacucuccaccacac

SEQ ID NO: 1141113 - RNA, 14 nt, Homo sapiens
uuuggcuuugcaaa

SEQ ID NO: 1141114 - RNA, 11 nt, Homo sapiens
uuugggagcag

SEQ ID NO: 1141115 - RNA, 14 nt, Homo sapiens
uuugggcagugcca

SEQ ID NO: 1141116 - RNA, 22 nt, Homo sapiens
uuuggggggagggggguuuugu

SEQ ID NO: 1141117 - RNA, 20 nt, Homo sapiens
uuugggguccuagcccagug

SEQ ID NO: 1141118 - RNA, 17 nt, Homo sapiens
uuugguacaaaaccacu

SEQ ID NO: 1141119 - RNA, 21 nt, Homo sapiens
uuugguaucuuacacauuaau

SEQ ID NO: 1141120 - RNA, 19 nt, Homo sapiens
uuugguguuuuuacagagg

SEQ ID NO: 1141121 - RNA, 21 nt, Homo sapiens
uuugguuggcagcauuccaug

SEQ ID NO: 1141122 - RNA, 13 nt, Homo sapiens
uuuguaaauuccc

SEQ ID NO: 1141123 - RNA, 23 nt, Homo sapiens
uuuguaauaaaaugguacauuuc

SEQ ID NO: 1141124 - RNA, 14 nt, Homo sapiens
uuuguacaaaagag

SEQ ID NO: 1141125 - RNA, 14 nt, Homo sapiens
uuuguaccagugaa

SEQ ID NO: 1141126 - RNA, 23 nt, Homo sapiens
uuuguagcgucugccguguaaca

SEQ ID NO: 1141127 - RNA, 17 nt, Homo sapiens
uuuguaggagacuugcc

SEQ ID NO: 1141128 - RNA, 20 nt, Homo sapiens
uuugugauucaaacuucugu

SEQ ID NO: 1141129 - RNA, 23 nt, Homo sapiens
uuugugauucaaacuucugugua

SEQ ID NO: 1141130 - RNA, 20 nt, Homo sapiens
uuugugcaaaagcaggcuug

SEQ ID NO: 1141131 - RNA, 18 nt, Homo sapiens
uuugugccaucacugagc

SEQ ID NO: 1141132 - RNA, 15 nt, Homo sapiens
uuugugcugagauca

SEQ ID NO: 1141133 - RNA, 18 nt, Homo sapiens
uuuguggcaucuugccaa

SEQ ID NO: 1141134 - RNA, 14 nt, Homo sapiens
uuuguucacacucc

SEQ ID NO: 1141135 - RNA, 21 nt, Homo sapiens
uuuguuucagguucaguauua

SEQ ID NO: 1141136 - RNA, 19 nt, Homo sapiens
uggccaggcuggucucaaa

SEQ ID NO: 1141137 - RNA, 22 nt, Homo sapiens
uggccaguagcuaaagugcaag

SEQ ID NO: 1141138 - RNA, 22 nt, Homo sapiens
uggcccaaucucugccauauca

SEQ ID NO: 1141139 - RNA, 14 nt, Homo sapiens
uggccccaugucuc

SEQ ID NO: 1141140 - RNA, 13 nt, Homo sapiens
uggccgggacccc

SEQ ID NO: 1141141 - RNA, 19 nt, Homo sapiens
uggccucagggccaggaag

SEQ ID NO: 1141142 - RNA, 17 nt, Homo sapiens
uggccucucuguacacu

SEQ ID NO: 1141143 - RNA, 20 nt, Homo sapiens
uggccucucuguacacugcc

SEQ ID NO: 1141144 - RNA, 13 nt, Homo sapiens
uggccuggcacac

SEQ ID NO: 1141145 - RNA, 22 nt, Homo sapiens
uggccuggucccuguuuuccca

SEQ ID NO: 1141146 - RNA, 14 nt, Homo sapiens
uggccuggugcaca

SEQ ID NO: 1141147 - RNA, 15 nt, Homo sapiens
uggccuuacuguuga

SEQ ID NO: 1141148 - RNA, 21 nt, Homo sapiens
uggcgaggccucucucaggag

SEQ ID NO: 1141149 - RNA, 18 nt, Homo sapiens
uggcgcuggauguggauu

SEQ ID NO: 1141150 - RNA, 14 nt, Homo sapiens
uggcguuacugcuu

SEQ ID NO: 1141151 - RNA, 15 nt, Homo sapiens
uggcuaagauaccaa

SEQ ID NO: 1141152 - RNA, 20 nt, Homo sapiens
uggcuaagauacugcugaug

SEQ ID NO: 1141153 - RNA, 22 nt, Homo sapiens
uggcuagauucuaacauauugc

SEQ ID NO: 1141154 - RNA, 17 nt, Homo sapiens
uggcucagccagcacuu

SEQ ID NO: 1141155 - RNA, 14 nt, Homo sapiens
uggcucaucucuuu

SEQ ID NO: 1141156 - RNA, 17 nt, Homo sapiens
uggcuccaggacagacc

SEQ ID NO: 1141157 - RNA, 19 nt, Homo sapiens
uggcucccaaauuccauca

SEQ ID NO: 1141158 - RNA, 18 nt, Homo sapiens
uggcucguuugggcucaa

SEQ ID NO: 1141159 - RNA, 22 nt, Homo sapiens
uggcucuauuggauuuguccaa

SEQ ID NO: 1141160 - RNA, 12 nt, Homo sapiens
uggcucugugaa

SEQ ID NO: 1141161 - RNA, 13 nt, Homo sapiens
uggcucugugaaa

SEQ ID NO: 1141162 - RNA, 14 nt, Homo sapiens
uggcugcaaggugg

SEQ ID NO: 1141163 - RNA, 12 nt, Homo sapiens
uggcugccuuug

SEQ ID NO: 1141164 - RNA, 14 nt, Homo sapiens
uggcuggcucugca

SEQ ID NO: 1141165 - RNA, 16 nt, Homo sapiens
uggcugggaugcuggu

SEQ ID NO: 1141166 - RNA, 17 nt, Homo sapiens
uggcuguauguugcaug

SEQ ID NO: 1141167 - RNA, 20 nt, Homo sapiens
uggcuguugggagccuguga

SEQ ID NO: 1141168 - RNA, 23 nt, Homo sapiens
uggcuucagguuagugacauuua

SEQ ID NO: 1141169 - RNA, 18 nt, Homo sapiens
uggcuucucccaggauuc

SEQ ID NO: 1141170 - RNA, 17 nt, Homo sapiens
uggcuuuuaauugacag

SEQ ID NO: 1141171 - RNA, 21 nt, Homo sapiens
uggcuuuuccuggacagcuag

SEQ ID NO: 1141172 - RNA, 15 nt, Homo sapiens
ugggaaaaccagacu

SEQ ID NO: 1141173 - RNA, 17 nt, Homo sapiens
ugggaaaaugcacacau

SEQ ID NO: 1141174 - RNA, 15 nt, Homo sapiens
ugggaaacuugucac

SEQ ID NO: 1141175 - RNA, 18 nt, Homo sapiens
ugggaaacuugucacuug

SEQ ID NO: 1141176 - RNA, 12 nt, Homo sapiens
ugggaaagacau

SEQ ID NO: 1141177 - RNA, 16 nt, Homo sapiens
ugggaaauaugaaugc

SEQ ID NO: 1141178 - RNA, 14 nt, Homo sapiens
ugggaaccuucaua

SEQ ID NO: 1141179 - RNA, 21 nt, Homo sapiens
ugggaagaugugcaacacaaa

SEQ ID NO: 1141180 - RNA, 22 nt, Homo sapiens
ugggaaguuggcuggugucccu

SEQ ID NO: 1141181 - RNA, 17 nt, Homo sapiens
ugggaccaaguccaaca

SEQ ID NO: 1141182 - RNA, 20 nt, Homo sapiens
ugggacuguguggaccaagg

SEQ ID NO: 1141183 - RNA, 23 nt, Homo sapiens
ugggaggcuccuguuagcuccuc

SEQ ID NO: 1141184 - RNA, 21 nt, Homo sapiens
ugggagggaguuacugaaguc

SEQ ID NO: 1141185 - RNA, 19 nt, Homo sapiens
ugggagggguugaugccag

SEQ ID NO: 1141186 - RNA, 22 nt, Homo sapiens
ugggagguugguuuaaugcaau

SEQ ID NO: 1141187 - RNA, 15 nt, Homo sapiens
ugggaucuuucugac

SEQ ID NO: 1141188 - RNA, 22 nt, Homo sapiens
ugggaucuuucugacacacuua

SEQ ID NO: 1141189 - RNA, 20 nt, Homo sapiens
ugggaugaaacuaaagcaau

SEQ ID NO: 1141190 - RNA, 13 nt, Homo sapiens
ugggauuacaggc

SEQ ID NO: 1141191 - RNA, 14 nt, Homo sapiens
ugggauuacaggga

SEQ ID NO: 1141192 - RNA, 16 nt, Homo sapiens
ugggcaccccacugca

SEQ ID NO: 1141193 - RNA, 17 nt, Homo sapiens
ugggcagggucucugcu

SEQ ID NO: 1141194 - RNA, 13 nt, Homo sapiens
ugggcauggugcg

SEQ ID NO: 1141195 - RNA, 14 nt, Homo sapiens
ugggcauugagauc

SEQ ID NO: 1141196 - RNA, 15 nt, Homo sapiens
ugggcauuuugacaa

SEQ ID NO: 1141197 - RNA, 13 nt, Homo sapiens
ugggccaccagcc

SEQ ID NO: 1141198 - RNA, 16 nt, Homo sapiens
ugggccaccagccacu

SEQ ID NO: 1141199 - RNA, 19 nt, Homo sapiens
ugggccagacaugccacaa

SEQ ID NO: 1141200 - RNA, 16 nt, Homo sapiens
ugggccccaccaccua

SEQ ID NO: 1141201 - RNA, 23 nt, Homo sapiens
ugggccccugucgucaggaccuc

SEQ ID NO: 1141202 - RNA, 20 nt, Homo sapiens
ugggcgagcgguaaauccua

SEQ ID NO: 1141203 - RNA, 19 nt, Homo sapiens
ugggcgcucucccuaccuu

SEQ ID NO: 1141204 - RNA, 16 nt, Homo sapiens
ugggcggaucacuuga

SEQ ID NO: 1141205 - RNA, 22 nt, Homo sapiens
ugggcuccccaggaagcccacu

SEQ ID NO: 1141206 - RNA, 15 nt, Homo sapiens
ugggcucugcauccc

SEQ ID NO: 1141207 - RNA, 22 nt, Homo sapiens
ugggcugugauuacugcaauca

SEQ ID NO: 1141208 - RNA, 15 nt, Homo sapiens
uggggaaaacuugca

SEQ ID NO: 1141209 - RNA, 21 nt, Homo sapiens
uggggaaauaaaucuagcaaa

SEQ ID NO: 1141210 - RNA, 16 nt, Homo sapiens
uggggaacaaccagag

SEQ ID NO: 1141211 - RNA, 14 nt, Homo sapiens
uggggaagaaggga

SEQ ID NO: 1141212 - RNA, 21 nt, Homo sapiens
uggggaagugugucaaaucaa

SEQ ID NO: 1141213 - RNA, 17 nt, Homo sapiens
uggggagauuugccaca

SEQ ID NO: 1141214 - RNA, 23 nt, Homo sapiens
uggggagauuugccacaucuuaa

SEQ ID NO: 1141215 - RNA, 20 nt, Homo sapiens
uggggagguggcacuaggga

SEQ ID NO: 1141216 - RNA, 14 nt, Homo sapiens
uggggcaagaugag

SEQ ID NO: 1141217 - RNA, 19 nt, Homo sapiens
uggggcacugggcgucuga

SEQ ID NO: 1141218 - RNA, 19 nt, Homo sapiens
uggggccaagagucacuuc

SEQ ID NO: 1141219 - RNA, 13 nt, Homo sapiens
ugggggaaacuuc

SEQ ID NO: 1141220 - RNA, 15 nt, Homo sapiens
ugggggagaagcaag

SEQ ID NO: 1141221 - RNA, 23 nt, Homo sapiens
ugggggggcucccguggccugua

SEQ ID NO: 1141222 - RNA, 17 nt, Homo sapiens
uggggguuaccaaaaau

SEQ ID NO: 1141223 - RNA, 13 nt, Homo sapiens
uggggucaugccc

SEQ ID NO: 1141224 - RNA, 15 nt, Homo sapiens
uggggucaugcccuc

SEQ ID NO: 1141225 - RNA, 17 nt, Homo sapiens
ugggguguggagacuug

SEQ ID NO: 1141226 - RNA, 15 nt, Homo sapiens
ugggguuauguauca

SEQ ID NO: 1141227 - RNA, 15 nt, Homo sapiens
ugggguugggggaca

SEQ ID NO: 1141228 - RNA, 22 nt, Homo sapiens
ugggucauagaaauucuuuaua

SEQ ID NO: 1141229 - RNA, 19 nt, Homo sapiens
ugggucuaccacucagaga

SEQ ID NO: 1141230 - RNA, 22 nt, Homo sapiens
ugggucugggagucacacagug

SEQ ID NO: 1141231 - RNA, 11 nt, Homo sapiens
ugggucuugcc

SEQ ID NO: 1141232 - RNA, 22 nt, Homo sapiens
ugggugacagagcgagacucca

SEQ ID NO: 1141233 - RNA, 13 nt, Homo sapiens
ugggugacaggau

SEQ ID NO: 1141234 - RNA, 16 nt, Homo sapiens
ugggugggugggauga

SEQ ID NO: 1141235 - RNA, 23 nt, Homo sapiens
uggguuggagggcacuuggccag

SEQ ID NO: 1141236 - RNA, 21 nt, Homo sapiens
ugguaaaaugcaucaaaagac

SEQ ID NO: 1141237 - RNA, 21 nt, Homo sapiens
ugguaauuguacuaaagccaa

SEQ ID NO: 1141238 - RNA, 17 nt, Homo sapiens
ugguacuuguaccuccg

SEQ ID NO: 1141239 - RNA, 16 nt, Homo sapiens
ugguaggugugacaug

SEQ ID NO: 1141240 - RNA, 22 nt, Homo sapiens
ugguauaaacguccuacuguau

SEQ ID NO: 1141241 - RNA, 16 nt, Homo sapiens
ugguauaaagcucuca

SEQ ID NO: 1141242 - RNA, 15 nt, Homo sapiens
ugguauuuuuuacug

SEQ ID NO: 1141243 - RNA, 22 nt, Homo sapiens
uggucaaacaaacucucugaac

SEQ ID NO: 1141244 - RNA, 21 nt, Homo sapiens
uggucaaguaguuugacucag

SEQ ID NO: 1141245 - RNA, 14 nt, Homo sapiens
ugguccaacugcaa

SEQ ID NO: 1141246 - RNA, 15 nt, Homo sapiens
ugguccaacugcaac

SEQ ID NO: 1141247 - RNA, 18 nt, Homo sapiens
ugguccaucacuauucaa

SEQ ID NO: 1141248 - RNA, 20 nt, Homo sapiens
ugguccaugggccauaugaa

SEQ ID NO: 1141249 - RNA, 21 nt, Homo sapiens
uggucccaacaggaggacaau

SEQ ID NO: 1141250 - RNA, 20 nt, Homo sapiens
uggucccggggccagcacuu

SEQ ID NO: 1141251 - RNA, 21 nt, Homo sapiens
uggucccuaaauuugcaugaa

SEQ ID NO: 1141252 - RNA, 19 nt, Homo sapiens
ugguccuggcugcacucuu

SEQ ID NO: 1141253 - RNA, 22 nt, Homo sapiens
uggucucaaacuccugaccuca

SEQ ID NO: 1141254 - RNA, 16 nt, Homo sapiens
uggucuccacugggga

SEQ ID NO: 1141255 - RNA, 16 nt, Homo sapiens
uggucuccucucagcu

SEQ ID NO: 1141256 - RNA, 16 nt, Homo sapiens
uggucucgaugcugcu

SEQ ID NO: 1141257 - RNA, 17 nt, Homo sapiens
uggucucgaugcugcug

SEQ ID NO: 1141258 - RNA, 18 nt, Homo sapiens
uggucucuacuguggcaa

SEQ ID NO: 1141259 - RNA, 22 nt, Homo sapiens
uggucugcaggcagggcugacu

SEQ ID NO: 1141260 - RNA, 17 nt, Homo sapiens
uggucuugaacuccuga

SEQ ID NO: 1141261 - RNA, 17 nt, Homo sapiens
uggucuugaucuccuga

SEQ ID NO: 1141262 - RNA, 19 nt, Homo sapiens
uggugaaaaccccaucucu

SEQ ID NO: 1141263 - RNA, 14 nt, Homo sapiens
uggugaauuucaca

SEQ ID NO: 1141264 - RNA, 14 nt, Homo sapiens
uggugacuucacag

SEQ ID NO: 1141265 - RNA, 16 nt, Homo sapiens
uggugauggaaaaagc

SEQ ID NO: 1141266 - RNA, 23 nt, Homo sapiens
ugcuuccccuuuugccaaucuca

SEQ ID NO: 1141267 - RNA, 22 nt, Homo sapiens
ugcuucuaguucugccaggaga

SEQ ID NO: 1141268 - RNA, 16 nt, Homo sapiens
ugcuucuuaugguggu

SEQ ID NO: 1141269 - RNA, 15 nt, Homo sapiens
ugcuucuugugaagg

SEQ ID NO: 1141270 - RNA, 14 nt, Homo sapiens
ugcuugaaccuggg

SEQ ID NO: 1141271 - RNA, 15 nt, Homo sapiens
ugcuugaauggagcu

SEQ ID NO: 1141272 - RNA, 16 nt, Homo sapiens
ugcuugacaacaucug

SEQ ID NO: 1141273 - RNA, 19 nt, Homo sapiens
ugcuugagcaucaggauac

SEQ ID NO: 1141274 - RNA, 14 nt, Homo sapiens
ugcuugagccuuug

SEQ ID NO: 1141275 - RNA, 17 nt, Homo sapiens
ugcuugcaauguaguca

SEQ ID NO: 1141276 - RNA, 14 nt, Homo sapiens
ugcuuggcugcugu

SEQ ID NO: 1141277 - RNA, 21 nt, Homo sapiens
ugcuuguuugcucaccugggg

SEQ ID NO: 1141278 - RNA, 19 nt, Homo sapiens
ugcuuucacucuccuaugc

SEQ ID NO: 1141279 - RNA, 12 nt, Homo sapiens
ugcuuucugcuc

SEQ ID NO: 1141280 - RNA, 14 nt, Homo sapiens
ugcuuugcugcuuu

SEQ ID NO: 1141281 - RNA, 18 nt, Homo sapiens
ugcuuuguaggugucuca

SEQ ID NO: 1141282 - RNA, 13 nt, Homo sapiens
ugcuuuguugcac

SEQ ID NO: 1141283 - RNA, 20 nt, Homo sapiens
uggaaaaaaugauguucauu

SEQ ID NO: 1141284 - RNA, 15 nt, Homo sapiens
uggaaaagccaagag

SEQ ID NO: 1141285 - RNA, 21 nt, Homo sapiens
uggaaacaugggaaggugcca

SEQ ID NO: 1141286 - RNA, 18 nt, Homo sapiens
uggaaagacaagcucaag

SEQ ID NO: 1141287 - RNA, 21 nt, Homo sapiens
uggaaaugugaauaaguaaag

SEQ ID NO: 1141288 - RNA, 16 nt, Homo sapiens
uggaacaagcacagau

SEQ ID NO: 1141289 - RNA, 23 nt, Homo sapiens
uggaacacauaagaacugugcag

SEQ ID NO: 1141290 - RNA, 13 nt, Homo sapiens
uggaacaccagca

SEQ ID NO: 1141291 - RNA, 12 nt, Homo sapiens
uggaacacggcc

SEQ ID NO: 1141292 - RNA, 15 nt, Homo sapiens
uggaacccagacuca

SEQ ID NO: 1141293 - RNA, 15 nt, Homo sapiens
uggaacccaggaccu

SEQ ID NO: 1141294 - RNA, 16 nt, Homo sapiens
uggaacuauuccauca

SEQ ID NO: 1141295 - RNA, 15 nt, Homo sapiens
uggaacucuugcuau

SEQ ID NO: 1141296 - RNA, 15 nt, Homo sapiens
uggaagaacacuguu

SEQ ID NO: 1141297 - RNA, 18 nt, Homo sapiens
uggaagagggcugcaaau

SEQ ID NO: 1141298 - RNA, 19 nt, Homo sapiens
uggaagaugcagaagcaau

SEQ ID NO: 1141299 - RNA, 20 nt, Homo sapiens
uggaagcugccucccaucuc

SEQ ID NO: 1141300 - RNA, 16 nt, Homo sapiens
uggaagcuugcuuuuu

SEQ ID NO: 1141301 - RNA, 19 nt, Homo sapiens
uggaagugacauuguguca

SEQ ID NO: 1141302 - RNA, 21 nt, Homo sapiens
uggaauauuguccauugucca

SEQ ID NO: 1141303 - RNA, 20 nt, Homo sapiens
uggaaucccacuaaugcaaa

SEQ ID NO: 1141304 - RNA, 14 nt, Homo sapiens
uggaaucugaugaa

SEQ ID NO: 1141305 - RNA, 18 nt, Homo sapiens
uggaaugcacagggcaau

SEQ ID NO: 1141306 - RNA, 15 nt, Homo sapiens
uggaauguaaguaag

SEQ ID NO: 1141307 - RNA, 16 nt, Homo sapiens
uggaauuugcuuuauc

SEQ ID NO: 1141308 - RNA, 17 nt, Homo sapiens
uggacaaggagugugac

SEQ ID NO: 1141309 - RNA, 20 nt, Homo sapiens
uggacaaggagugugaccac

SEQ ID NO: 1141310 - RNA, 14 nt, Homo sapiens
uggacacugugcua

SEQ ID NO: 1141311 - RNA, 16 nt, Homo sapiens
uggacauagagaggga

SEQ ID NO: 1141312 - RNA, 16 nt, Homo sapiens
uggaccaccauuggaa

SEQ ID NO: 1141313 - RNA, 22 nt, Homo sapiens
uggaccgaggaacaacuuggaa

SEQ ID NO: 1141314 - RNA, 15 nt, Homo sapiens
uggaccugguacaaa

SEQ ID NO: 1141315 - RNA, 21 nt, Homo sapiens
uggaccuuacgaucaggcaca

SEQ ID NO: 1141316 - RNA, 14 nt, Homo sapiens
uggacgcugugcug

SEQ ID NO: 1141317 - RNA, 23 nt, Homo sapiens
uggacucagggcugguucagggc

SEQ ID NO: 1141318 - RNA, 16 nt, Homo sapiens
uggacucaguuuucuu

SEQ ID NO: 1141319 - RNA, 15 nt, Homo sapiens
uggacucugcacaug

SEQ ID NO: 1141320 - RNA, 22 nt, Homo sapiens
uggacugaccuuguaaaagaca

SEQ ID NO: 1141321 - RNA, 12 nt, Homo sapiens
uggacuuguccc

SEQ ID NO: 1141322 - RNA, 16 nt, Homo sapiens
uggagaaaauuuauca

SEQ ID NO: 1141323 - RNA, 17 nt, Homo sapiens
uggagaacagcaugaca

SEQ ID NO: 1141324 - RNA, 15 nt, Homo sapiens
uggagaauacugcca

SEQ ID NO: 1141325 - RNA, 20 nt, Homo sapiens
uggagaauacugccaaaaca

SEQ ID NO: 1141326 - RNA, 21 nt, Homo sapiens
uggagaauguggagaacuaaa

SEQ ID NO: 1141327 - RNA, 22 nt, Homo sapiens
uggagacccgccuggcuaacaa

SEQ ID NO: 1141328 - RNA, 17 nt, Homo sapiens
uggagaccgugaccagu

SEQ ID NO: 1141329 - RNA, 17 nt, Homo sapiens
uggagagaagugagaau

SEQ ID NO: 1141330 - RNA, 19 nt, Homo sapiens
uggagauagccccacagga

SEQ ID NO: 1141331 - RNA, 11 nt, Homo sapiens
uggagaugucu

SEQ ID NO: 1141332 - RNA, 23 nt, Homo sapiens
uggagauucaguuuucauuuggu

SEQ ID NO: 1141333 - RNA, 12 nt, Homo sapiens
uggagcauugau

SEQ ID NO: 1141334 - RNA, 15 nt, Homo sapiens
uggagccaaagccga

SEQ ID NO: 1141335 - RNA, 19 nt, Homo sapiens
uggagcccacauauuucaa

SEQ ID NO: 1141336 - RNA, 21 nt, Homo sapiens
uggaggaccuuaaaugcuacu

SEQ ID NO: 1141337 - RNA, 18 nt, Homo sapiens
uggaggagagaagaauga

SEQ ID NO: 1141338 - RNA, 16 nt, Homo sapiens
uggaggccucagggag

SEQ ID NO: 1141339 - RNA, 23 nt, Homo sapiens
uggaggcucuucugugauuuuga

SEQ ID NO: 1141340 - RNA, 21 nt, Homo sapiens
uggaggcugccugcugugcug

SEQ ID NO: 1141341 - RNA, 19 nt, Homo sapiens
uggaggcuggaugugcauu

SEQ ID NO: 1141342 - RNA, 16 nt, Homo sapiens
uggagggcagagacaa

SEQ ID NO: 1141343 - RNA, 18 nt, Homo sapiens
uggagggcucagggcagu

SEQ ID NO: 1141344 - RNA, 19 nt, Homo sapiens
uggagggggagcaccagcg

SEQ ID NO: 1141345 - RNA, 22 nt, Homo sapiens
uggagguauucaauauccuuug

SEQ ID NO: 1141346 - RNA, 23 nt, Homo sapiens
uggaguacuuagcuaguuuuauu

SEQ ID NO: 1141347 - RNA, 22 nt, Homo sapiens
uggaguauuuggaagcaacgug

SEQ ID NO: 1141348 - RNA, 14 nt, Homo sapiens
uggagugagaugaa

SEQ ID NO: 1141349 - RNA, 19 nt, Homo sapiens
uggagugagaugaaggaag

SEQ ID NO: 1141350 - RNA, 17 nt, Homo sapiens
uggagugcaguggugcg

SEQ ID NO: 1141351 - RNA, 13 nt, Homo sapiens
uggagugugucag

SEQ ID NO: 1141352 - RNA, 19 nt, Homo sapiens
uggagugugucagagccca

SEQ ID NO: 1141353 - RNA, 17 nt, Homo sapiens
uggaguucuugugccau

SEQ ID NO: 1141354 - RNA, 24 nt, Homo sapiens
uggaguuucauguacaagaugaag

SEQ ID NO: 1141355 - RNA, 19 nt, Homo sapiens
uggauaaaauaaaugcaau

SEQ ID NO: 1141356 - RNA, 17 nt, Homo sapiens
uggauaugggcuggaua

SEQ ID NO: 1141357 - RNA, 18 nt, Homo sapiens
uggaucaccugaggucag

SEQ ID NO: 1141358 - RNA, 15 nt, Homo sapiens
uggaucuaccagcau

SEQ ID NO: 1141359 - RNA, 18 nt, Homo sapiens
uggaucugucauuaucaa

SEQ ID NO: 1141360 - RNA, 22 nt, Homo sapiens
uggauuauaaggaaaggcacau

SEQ ID NO: 1141361 - RNA, 18 nt, Homo sapiens
uggauuccccaucucagg

SEQ ID NO: 1141362 - RNA, 18 nt, Homo sapiens
uggauugauaauugcauu

SEQ ID NO: 1141363 - RNA, 17 nt, Homo sapiens
uggauugccaguuacau

SEQ ID NO: 1141364 - RNA, 14 nt, Homo sapiens
uggauugggguccc

SEQ ID NO: 1141365 - RNA, 19 nt, Homo sapiens
uggauuuacgacugaagaa

SEQ ID NO: 1141366 - RNA, 17 nt, Homo sapiens
uggcaaacaugugcaac

SEQ ID NO: 1141367 - RNA, 21 nt, Homo sapiens
uggcaaauguaacugugccag

SEQ ID NO: 1141368 - RNA, 23 nt, Homo sapiens
uggcaacagaucuggaaccucag

SEQ ID NO: 1141369 - RNA, 23 nt, Homo sapiens
uggcaacaggccaaugcuacuuu

SEQ ID NO: 1141370 - RNA, 14 nt, Homo sapiens
uggcaagaaagcuu

SEQ ID NO: 1141371 - RNA, 20 nt, Homo sapiens
uggcaagauaaacacuuucu

SEQ ID NO: 1141372 - RNA, 20 nt, Homo sapiens
uggcacacaccaguaauccc

SEQ ID NO: 1141373 - RNA, 18 nt, Homo sapiens
uggcacauccuaugcaau

SEQ ID NO: 1141374 - RNA, 19 nt, Homo sapiens
uggcagaaccaaagcucaa

SEQ ID NO: 1141375 - RNA, 20 nt, Homo sapiens
uggcagaagggaauugcuca

SEQ ID NO: 1141376 - RNA, 13 nt, Homo sapiens
uggcaggaucuca

SEQ ID NO: 1141377 - RNA, 20 nt, Homo sapiens
uggcagugauccugcaaguu

SEQ ID NO: 1141378 - RNA, 13 nt, Homo sapiens
uggcaguguuugu

SEQ ID NO: 1141379 - RNA, 15 nt, Homo sapiens
uggcaguuuugacau

SEQ ID NO: 1141380 - RNA, 20 nt, Homo sapiens
uggcaucagugucuuuccac

SEQ ID NO: 1141381 - RNA, 20 nt, Homo sapiens
uggcaucgaccacaccagcc

SEQ ID NO: 1141382 - RNA, 22 nt, Homo sapiens
uggcaucucccacacaagaccc

SEQ ID NO: 1141383 - RNA, 12 nt, Homo sapiens
uggcaucugugc

SEQ ID NO: 1141384 - RNA, 12 nt, Homo sapiens
uggcaucugugu

SEQ ID NO: 1141385 - RNA, 13 nt, Homo sapiens
uggcaucugugug

SEQ ID NO: 1141386 - RNA, 15 nt, Homo sapiens
uggcaugauccaagc

SEQ ID NO: 1141387 - RNA, 19 nt, Homo sapiens
uggccaaggagcugcuaua

SEQ ID NO: 1141388 - RNA, 13 nt, Homo sapiens
uggccacacugug

SEQ ID NO: 1141389 - RNA, 18 nt, Homo sapiens
uggccacccaaacaggac

SEQ ID NO: 1141390 - RNA, 13 nt, Homo sapiens
ugcaaugacugug

SEQ ID NO: 1141391 - RNA, 13 nt, Homo sapiens
ugcaaugagccau

SEQ ID NO: 1141392 - RNA, 14 nt, Homo sapiens
ugcacaacaaagga

SEQ ID NO: 1141393 - RNA, 15 nt, Homo sapiens
ugcacaccucaugag

SEQ ID NO: 1141394 - RNA, 16 nt, Homo sapiens
ugcacaccuguggucc

SEQ ID NO: 1141395 - RNA, 22 nt, Homo sapiens
ugcacacuaguuuaugcuaccu

SEQ ID NO: 1141396 - RNA, 14 nt, Homo sapiens
ugcacacuuugcca

SEQ ID NO: 1141397 - RNA, 18 nt, Homo sapiens
ugcacagaagcacaugca

SEQ ID NO: 1141398 - RNA, 12 nt, Homo sapiens
ugcacagccacu

SEQ ID NO: 1141399 - RNA, 21 nt, Homo sapiens
ugcacauccgcgugugccugu

SEQ ID NO: 1141400 - RNA, 13 nt, Homo sapiens
ugcacaugaaucc

SEQ ID NO: 1141401 - RNA, 23 nt, Homo sapiens
ugcacaugucuuguacaugugua

SEQ ID NO: 1141402 - RNA, 20 nt, Homo sapiens
ugcaccaaaucaucucucau

SEQ ID NO: 1141403 - RNA, 19 nt, Homo sapiens
ugcaccaacccacugccca

SEQ ID NO: 1141404 - RNA, 15 nt, Homo sapiens
ugcaccaccaugccc

SEQ ID NO: 1141405 - RNA, 23 nt, Homo sapiens
ugcacccagcccagauugucuua

SEQ ID NO: 1141406 - RNA, 22 nt, Homo sapiens
ugcacccaggaggggaacacug

SEQ ID NO: 1141407 - RNA, 12 nt, Homo sapiens
ugcaccuaccca

SEQ ID NO: 1141408 - RNA, 16 nt, Homo sapiens
ugcacguugcuucagg

SEQ ID NO: 1141409 - RNA, 19 nt, Homo sapiens
ugcacuccagccuaggcaa

SEQ ID NO: 1141410 - RNA, 20 nt, Homo sapiens
ugcacuccagccugggcaac

SEQ ID NO: 1141411 - RNA, 20 nt, Homo sapiens
ugcacuccagcuugggcaac

SEQ ID NO: 1141412 - RNA, 13 nt, Homo sapiens
ugcacuguagggu

SEQ ID NO: 1141413 - RNA, 21 nt, Homo sapiens
ugcacuguucccccugugcag

SEQ ID NO: 1141414 - RNA, 14 nt, Homo sapiens
ugcacuuauucuca

SEQ ID NO: 1141415 - RNA, 12 nt, Homo sapiens
ugcacuuucuau

SEQ ID NO: 1141416 - RNA, 16 nt, Homo sapiens
ugcagaaauacaguau

SEQ ID NO: 1141417 - RNA, 16 nt, Homo sapiens
ugcagaaccagugaca

SEQ ID NO: 1141418 - RNA, 12 nt, Homo sapiens
ugcagaaguauu

SEQ ID NO: 1141419 - RNA, 16 nt, Homo sapiens
ugcagacgucuggccc

SEQ ID NO: 1141420 - RNA, 16 nt, Homo sapiens
ugcagaggaaguacaa

SEQ ID NO: 1141421 - RNA, 14 nt, Homo sapiens
ugcagaggagccca

SEQ ID NO: 1141422 - RNA, 16 nt, Homo sapiens
ugcagaguuuggauaa

SEQ ID NO: 1141423 - RNA, 21 nt, Homo sapiens
ugcagauuagcuaggggacag

SEQ ID NO: 1141424 - RNA, 19 nt, Homo sapiens
ugcagauuuugcccuugac

SEQ ID NO: 1141425 - RNA, 14 nt, Homo sapiens
ugcagcacugcugc

SEQ ID NO: 1141426 - RNA, 19 nt, Homo sapiens
ugcagcacugcugccucag

SEQ ID NO: 1141427 - RNA, 18 nt, Homo sapiens
ugcagccaggccacuggc

SEQ ID NO: 1141428 - RNA, 22 nt, Homo sapiens
ugcagccaggccucgccugccc

SEQ ID NO: 1141429 - RNA, 18 nt, Homo sapiens
ugcagcuccagucagugu

SEQ ID NO: 1141430 - RNA, 20 nt, Homo sapiens
ugcagcuggcccacugcugg

SEQ ID NO: 1141431 - RNA, 15 nt, Homo sapiens
ugcagcuuauauuca

SEQ ID NO: 1141432 - RNA, 22 nt, Homo sapiens
ugcaggaaauggcuguggagug

SEQ ID NO: 1141433 - RNA, 18 nt, Homo sapiens
ugcaggagcuaguucuca

SEQ ID NO: 1141434 - RNA, 21 nt, Homo sapiens
ugcaggagcuaguucucagcu

SEQ ID NO: 1141435 - RNA, 22 nt, Homo sapiens
ugcagggguuauguggaagugu

SEQ ID NO: 1141436 - RNA, 19 nt, Homo sapiens
ugcagggucacucaucuaa

SEQ ID NO: 1141437 - RNA, 18 nt, Homo sapiens
ugcaggucaaaagucaga

SEQ ID NO: 1141438 - RNA, 14 nt, Homo sapiens
ugcaguagccguuu

SEQ ID NO: 1141439 - RNA, 16 nt, Homo sapiens
ugcaguaugguacauu

SEQ ID NO: 1141440 - RNA, 22 nt, Homo sapiens
ugcagucauuaugagaggcaau

SEQ ID NO: 1141441 - RNA, 17 nt, Homo sapiens
ugcagugagugcugcuc

SEQ ID NO: 1141442 - RNA, 18 nt, Homo sapiens
ugcaguggugugaucucg

SEQ ID NO: 1141443 - RNA, 19 nt, Homo sapiens
ugcaguucaccugcacuua

SEQ ID NO: 1141444 - RNA, 21 nt, Homo sapiens
ugcauaaacaauccaaaugca

SEQ ID NO: 1141445 - RNA, 19 nt, Homo sapiens
ugcauaaagaauaguaauu

SEQ ID NO: 1141446 - RNA, 22 nt, Homo sapiens
ugcauaaaugcgauccacagaa

SEQ ID NO: 1141447 - RNA, 14 nt, Homo sapiens
ugcauacguacauu

SEQ ID NO: 1141448 - RNA, 21 nt, Homo sapiens
ugcauagaauucuagcuuuuu

SEQ ID NO: 1141449 - RNA, 15 nt, Homo sapiens
ugcauagcagcugcu

SEQ ID NO: 1141450 - RNA, 21 nt, Homo sapiens
ugcaucacagucacaugccca

SEQ ID NO: 1141451 - RNA, 14 nt, Homo sapiens
ugcaucaccaccuc

SEQ ID NO: 1141452 - RNA, 14 nt, Homo sapiens
ugcaucauagaaca

SEQ ID NO: 1141453 - RNA, 20 nt, Homo sapiens
ugcauccaggacugugccag

SEQ ID NO: 1141454 - RNA, 14 nt, Homo sapiens
ugcaucuacuugcc

SEQ ID NO: 1141455 - RNA, 13 nt, Homo sapiens
ugcaucugauaaa

SEQ ID NO: 1141456 - RNA, 23 nt, Homo sapiens
ugcaucugauaaaguugagagac

SEQ ID NO: 1141457 - RNA, 21 nt, Homo sapiens
ugcaucugcuacugugucagg

SEQ ID NO: 1141458 - RNA, 18 nt, Homo sapiens
ugcaucuucccacagugg

SEQ ID NO: 1141459 - RNA, 20 nt, Homo sapiens
ugcaugccuguagucucagc

SEQ ID NO: 1141460 - RNA, 18 nt, Homo sapiens
ugcaugggcuaaugaaga

SEQ ID NO: 1141461 - RNA, 21 nt, Homo sapiens
ugcauguaaacacgccugcaa

SEQ ID NO: 1141462 - RNA, 13 nt, Homo sapiens
ugcauguaugugu

SEQ ID NO: 1141463 - RNA, 21 nt, Homo sapiens
ugcaugucccaucacguguac

SEQ ID NO: 1141464 - RNA, 14 nt, Homo sapiens
ugcaugucuacuca

SEQ ID NO: 1141465 - RNA, 12 nt, Homo sapiens
ugcaugugaaga

SEQ ID NO: 1141466 - RNA, 15 nt, Homo sapiens
ugcaugugacucuga

SEQ ID NO: 1141467 - RNA, 16 nt, Homo sapiens
ugcaugugacucugaa

SEQ ID NO: 1141468 - RNA, 15 nt, Homo sapiens
ugcauuaaugccaca

SEQ ID NO: 1141469 - RNA, 19 nt, Homo sapiens
ugcauuacgauaaacauua

SEQ ID NO: 1141470 - RNA, 14 nt, Homo sapiens
ugcauuauugacga

SEQ ID NO: 1141471 - RNA, 18 nt, Homo sapiens
ugcauugagaacugcaua

SEQ ID NO: 1141472 - RNA, 15 nt, Homo sapiens
ugcauugagcucucu

SEQ ID NO: 1141473 - RNA, 17 nt, Homo sapiens
ugcauugagcugagauc

SEQ ID NO: 1141474 - RNA, 14 nt, Homo sapiens
ugcauugucugcaa

SEQ ID NO: 1141475 - RNA, 13 nt, Homo sapiens
ugcauuuauagca

SEQ ID NO: 1141476 - RNA, 23 nt, Homo sapiens
ugcauuucuggaccuugagcauc

SEQ ID NO: 1141477 - RNA, 10 nt, Homo sapiens
ugccaaaaaa

SEQ ID NO: 1141478 - RNA, 15 nt, Homo sapiens
ugccaaaaaaagaca

SEQ ID NO: 1141479 - RNA, 15 nt, Homo sapiens
ugccaaacuauauca

SEQ ID NO: 1141480 - RNA, 23 nt, Homo sapiens
ugccaacaagaaugcauugauau

SEQ ID NO: 1141481 - RNA, 20 nt, Homo sapiens
ugccaaccugcccagcugcu

SEQ ID NO: 1141482 - RNA, 16 nt, Homo sapiens
ugccaacuguuggaau

SEQ ID NO: 1141483 - RNA, 17 nt, Homo sapiens
ugccaagcagugcacau

SEQ ID NO: 1141484 - RNA, 21 nt, Homo sapiens
ugccaaggaaacccccagugu

SEQ ID NO: 1141485 - RNA, 22 nt, Homo sapiens
ugccaaggaaacccccagugua

SEQ ID NO: 1141486 - RNA, 22 nt, Homo sapiens
ugccacagaucuuuuguucucu

SEQ ID NO: 1141487 - RNA, 23 nt, Homo sapiens
ugccacagccuccccugccaggg

SEQ ID NO: 1141488 - RNA, 19 nt, Homo sapiens
ugccacaucccuauccugu

SEQ ID NO: 1141489 - RNA, 17 nt, Homo sapiens
ugccaccagcauccaca

SEQ ID NO: 1141490 - RNA, 12 nt, Homo sapiens
ugccacccaguu

SEQ ID NO: 1141491 - RNA, 19 nt, Homo sapiens
ugccacccaguugugacaa

SEQ ID NO: 1141492 - RNA, 13 nt, Homo sapiens
ugccacgcuuuuu

SEQ ID NO: 1141493 - RNA, 19 nt, Homo sapiens
ugccacugguaauggguaa

SEQ ID NO: 1141494 - RNA, 18 nt, Homo sapiens
ugccacuuuccaccaacu

SEQ ID NO: 1141495 - RNA, 19 nt, Homo sapiens
ugccagaagcagcauccuc

SEQ ID NO: 1141496 - RNA, 14 nt, Homo sapiens
ugccagcacaaagu

SEQ ID NO: 1141497 - RNA, 15 nt, Homo sapiens
ugccagcauuucccu

SEQ ID NO: 1141498 - RNA, 20 nt, Homo sapiens
ugccaggcccccaccacaca

SEQ ID NO: 1141499 - RNA, 20 nt, Homo sapiens
ugccagucucuucugauuaa

SEQ ID NO: 1141500 - RNA, 14 nt, Homo sapiens
ugccagugcacucc

SEQ ID NO: 1141501 - RNA, 13 nt, Homo sapiens
ugccaucaugccu

SEQ ID NO: 1141502 - RNA, 17 nt, Homo sapiens
ugccauccagccagaac

SEQ ID NO: 1141503 - RNA, 23 nt, Homo sapiens
ucaaguuguuccuuaagucagaa

SEQ ID NO: 1141504 - RNA, 13 nt, Homo sapiens
ucaaguuguuuaa

SEQ ID NO: 1141505 - RNA, 14 nt, Homo sapiens
ucaauaaagcuccu

SEQ ID NO: 1141506 - RNA, 18 nt, Homo sapiens
ucaauaaauuguaauugu

SEQ ID NO: 1141507 - RNA, 23 nt, Homo sapiens
ucaauaccugcugagaguacugu

SEQ ID NO: 1141508 - RNA, 16 nt, Homo sapiens
ucaaucaaguuuacau

SEQ ID NO: 1141509 - RNA, 13 nt, Homo sapiens
ucaaucacugucc

SEQ ID NO: 1141510 - RNA, 12 nt, Homo sapiens
ucaauccagcua

SEQ ID NO: 1141511 - RNA, 20 nt, Homo sapiens
ucaaucucguuuagugccaa

SEQ ID NO: 1141512 - RNA, 14 nt, Homo sapiens
ucaauggauuugau

SEQ ID NO: 1141513 - RNA, 21 nt, Homo sapiens
ucaaugggaagaugugcaaca

SEQ ID NO: 1141514 - RNA, 21 nt, Homo sapiens
ucaauguuucuuuuaucacga

SEQ ID NO: 1141515 - RNA, 16 nt, Homo sapiens
ucaauucagugcugua

SEQ ID NO: 1141516 - RNA, 19 nt, Homo sapiens
ucaauuccaucagcacaaa

SEQ ID NO: 1141517 - RNA, 15 nt, Homo sapiens
ucaauuccguagcca

SEQ ID NO: 1141518 - RNA, 15 nt, Homo sapiens
ucaauuucaacaugg

SEQ ID NO: 1141519 - RNA, 15 nt, Homo sapiens
ucacaaaacauuaaa

SEQ ID NO: 1141520 - RNA, 12 nt, Homo sapiens
ucacaagcuauu

SEQ ID NO: 1141521 - RNA, 15 nt, Homo sapiens
ucacaaggucaggag

SEQ ID NO: 1141522 - RNA, 17 nt, Homo sapiens
ucacaauaggaggagaa

SEQ ID NO: 1141523 - RNA, 22 nt, Homo sapiens
ucacaaucaucaucauucucau

SEQ ID NO: 1141524 - RNA, 13 nt, Homo sapiens
ucacaaugaaaug

SEQ ID NO: 1141525 - RNA, 21 nt, Homo sapiens
ucacaauuuacgaaaccaaaa

SEQ ID NO: 1141526 - RNA, 11 nt, Homo sapiens
ucacacacuga

SEQ ID NO: 1141527 - RNA, 17 nt, Homo sapiens
ucacacagagaggcaga

SEQ ID NO: 1141528 - RNA, 14 nt, Homo sapiens
ucacacccuaccuu

SEQ ID NO: 1141529 - RNA, 21 nt, Homo sapiens
ucacacugguucucaaugaaa

SEQ ID NO: 1141530 - RNA, 12 nt, Homo sapiens
ucacacuguaaa

SEQ ID NO: 1141531 - RNA, 23 nt, Homo sapiens
ucacagaaggguguggcauuugg

SEQ ID NO: 1141532 - RNA, 16 nt, Homo sapiens
ucacagacccacaaga

SEQ ID NO: 1141533 - RNA, 16 nt, Homo sapiens
ucacagagugagacuc

SEQ ID NO: 1141534 - RNA, 23 nt, Homo sapiens
ucacaggaaggaaacaacauuuu

SEQ ID NO: 1141535 - RNA, 18 nt, Homo sapiens
ucacaggacaugcuuugu

SEQ ID NO: 1141536 - RNA, 20 nt, Homo sapiens
ucacaggagcuuaaacagcu

SEQ ID NO: 1141537 - RNA, 16 nt, Homo sapiens
ucacagucacaugccc

SEQ ID NO: 1141538 - RNA, 20 nt, Homo sapiens
ucacaguccuggacuccugc

SEQ ID NO: 1141539 - RNA, 17 nt, Homo sapiens
ucacagugacacuggac

SEQ ID NO: 1141540 - RNA, 14 nt, Homo sapiens
ucacaguuacguga

SEQ ID NO: 1141541 - RNA, 23 nt, Homo sapiens
ucacaguucuuugggccagacau

SEQ ID NO: 1141542 - RNA, 16 nt, Homo sapiens
ucacaguuucuuccau

SEQ ID NO: 1141543 - RNA, 23 nt, Homo sapiens
ucacauaaaugcagcccauuucu

SEQ ID NO: 1141544 - RNA, 22 nt, Homo sapiens
ucacaucagaacagacaaucac

SEQ ID NO: 1141545 - RNA, 18 nt, Homo sapiens
ucacaugaacuuguaaag

SEQ ID NO: 1141546 - RNA, 11 nt, Homo sapiens
ucacaugacca

SEQ ID NO: 1141547 - RNA, 17 nt, Homo sapiens
ucacauggaaucuacau

SEQ ID NO: 1141548 - RNA, 22 nt, Homo sapiens
ucacauggccuaugcacauaug

SEQ ID NO: 1141549 - RNA, 20 nt, Homo sapiens
ucacauucuuauaaauauga

SEQ ID NO: 1141550 - RNA, 16 nt, Homo sapiens
ucaccacaucuugucu

SEQ ID NO: 1141551 - RNA, 12 nt, Homo sapiens
ucaccaugcaag

SEQ ID NO: 1141552 - RNA, 19 nt, Homo sapiens
ucaccauuuggcaaugcca

SEQ ID NO: 1141553 - RNA, 20 nt, Homo sapiens
ucacccaggcacugggcaag

SEQ ID NO: 1141554 - RNA, 19 nt, Homo sapiens
ucacccaggcuggagugca

SEQ ID NO: 1141555 - RNA, 21 nt, Homo sapiens
ucacccaggcuggagugcagu

SEQ ID NO: 1141556 - RNA, 19 nt, Homo sapiens
ucaccccgaggcccugcau

SEQ ID NO: 1141557 - RNA, 13 nt, Homo sapiens
ucaccccugacau

SEQ ID NO: 1141558 - RNA, 21 nt, Homo sapiens
ucacccucuccagcaagagaa

SEQ ID NO: 1141559 - RNA, 18 nt, Homo sapiens
ucaccguguuagccagga

SEQ ID NO: 1141560 - RNA, 14 nt, Homo sapiens
ucaccuaacuagag

SEQ ID NO: 1141561 - RNA, 16 nt, Homo sapiens
ucaccuacccaugacc

SEQ ID NO: 1141562 - RNA, 17 nt, Homo sapiens
ucaccuauuaccagugu

SEQ ID NO: 1141563 - RNA, 15 nt, Homo sapiens
ucaccucugccucaa

SEQ ID NO: 1141564 - RNA, 15 nt, Homo sapiens
ucaccuuaucuggaa

SEQ ID NO: 1141565 - RNA, 21 nt, Homo sapiens
ucacgaggaaaagagaaggaa

SEQ ID NO: 1141566 - RNA, 19 nt, Homo sapiens
ucacgccauucuccugccu

SEQ ID NO: 1141567 - RNA, 15 nt, Homo sapiens
ucacggaccccaugu

SEQ ID NO: 1141568 - RNA, 23 nt, Homo sapiens
ucacggaccccauguuggaucuu

SEQ ID NO: 1141569 - RNA, 20 nt, Homo sapiens
ucacguccuuuuuuccuucc

SEQ ID NO: 1141570 - RNA, 20 nt, Homo sapiens
ucacgucgucuucuguauac

SEQ ID NO: 1141571 - RNA, 19 nt, Homo sapiens
ucacgucuguaaucccagc

SEQ ID NO: 1141572 - RNA, 13 nt, Homo sapiens
ucacuaaaagugu

SEQ ID NO: 1141573 - RNA, 18 nt, Homo sapiens
ucacuaccugccaugcau

SEQ ID NO: 1141574 - RNA, 17 nt, Homo sapiens
ucacuauggacuuaccc

SEQ ID NO: 1141575 - RNA, 18 nt, Homo sapiens
ucacuauggacuuacccu

SEQ ID NO: 1141576 - RNA, 19 nt, Homo sapiens
ucacuauggacuuacccua

SEQ ID NO: 1141577 - RNA, 18 nt, Homo sapiens
ucacuauucaaggaugac

SEQ ID NO: 1141578 - RNA, 19 nt, Homo sapiens
ucacucagugauugcaauu

SEQ ID NO: 1141579 - RNA, 17 nt, Homo sapiens
ucacucugaguguuuua

SEQ ID NO: 1141580 - RNA, 12 nt, Homo sapiens
ucacucugcaau

SEQ ID NO: 1141581 - RNA, 18 nt, Homo sapiens
ucacugaaaacaucugga

SEQ ID NO: 1141582 - RNA, 22 nt, Homo sapiens
ucacugaagaaaccuucagauu

SEQ ID NO: 1141583 - RNA, 22 nt, Homo sapiens
ucacugaggccugagacccagg

SEQ ID NO: 1141584 - RNA, 14 nt, Homo sapiens
ucacugcaaccucc

SEQ ID NO: 1141585 - RNA, 15 nt, Homo sapiens
ucaucaggaguucca

SEQ ID NO: 1141586 - RNA, 16 nt, Homo sapiens
ucaucaggaguuccag

SEQ ID NO: 1141587 - RNA, 20 nt, Homo sapiens
ucaucaggaguuccagugcu

SEQ ID NO: 1141588 - RNA, 17 nt, Homo sapiens
ucaucaguaacaguauu

SEQ ID NO: 1141589 - RNA, 13 nt, Homo sapiens
ucaucaugauaag

SEQ ID NO: 1141590 - RNA, 17 nt, Homo sapiens
ucaucauuuugugauuc

SEQ ID NO: 1141591 - RNA, 13 nt, Homo sapiens
ucauccccuguga

SEQ ID NO: 1141592 - RNA, 20 nt, Homo sapiens
ucauccugaacagcauggca

SEQ ID NO: 1141593 - RNA, 23 nt, Homo sapiens
ucauccuguuggcugcugccacc

SEQ ID NO: 1141594 - RNA, 14 nt, Homo sapiens
ucaucgacuuagcc

SEQ ID NO: 1141595 - RNA, 19 nt, Homo sapiens
ucaucuaauucucugugga

SEQ ID NO: 1141596 - RNA, 16 nt, Homo sapiens
ucaucuauaacaugca

SEQ ID NO: 1141597 - RNA, 13 nt, Homo sapiens
ucaucucauucca

SEQ ID NO: 1141598 - RNA, 13 nt, Homo sapiens
ucaucucuuucua

SEQ ID NO: 1141599 - RNA, 21 nt, Homo sapiens
ucaucugaauuugcccuggga

SEQ ID NO: 1141600 - RNA, 13 nt, Homo sapiens
ucaucugacucau

SEQ ID NO: 1141601 - RNA, 23 nt, Homo sapiens
ucaucugccuggaaaguccuccu

SEQ ID NO: 1141602 - RNA, 23 nt, Homo sapiens
ucaucugugauucccuccugcua

SEQ ID NO: 1141603 - RNA, 18 nt, Homo sapiens
ucaucuucacugcaauuu

SEQ ID NO: 1141604 - RNA, 12 nt, Homo sapiens
ucaucuugccac

SEQ ID NO: 1141605 - RNA, 15 nt, Homo sapiens
ucaucuuucuuccaa

SEQ ID NO: 1141606 - RNA, 16 nt, Homo sapiens
ucaucuuugugccaau

SEQ ID NO: 1141607 - RNA, 13 nt, Homo sapiens
ucaugaagccuug

SEQ ID NO: 1141608 - RNA, 13 nt, Homo sapiens
ucaugaagugaau

SEQ ID NO: 1141609 - RNA, 13 nt, Homo sapiens
ucaugaauucaua

SEQ ID NO: 1141610 - RNA, 22 nt, Homo sapiens
ucaugaggaccaggguggagcu

SEQ ID NO: 1141611 - RNA, 13 nt, Homo sapiens
ucaugcaggugaa

SEQ ID NO: 1141612 - RNA, 18 nt, Homo sapiens
ucaugccaaguaucuuuc

SEQ ID NO: 1141613 - RNA, 19 nt, Homo sapiens
ucaugccucuaaucucagc

SEQ ID NO: 1141614 - RNA, 11 nt, Homo sapiens
ucaugccugua

SEQ ID NO: 1141615 - RNA, 17 nt, Homo sapiens
ucaugcuuuugcuugca

SEQ ID NO: 1141616 - RNA, 15 nt, Homo sapiens
ucauggaaagacugg

SEQ ID NO: 1141617 - RNA, 17 nt, Homo sapiens
ucauggccacacuguga

SEQ ID NO: 1141618 - RNA, 16 nt, Homo sapiens
ucauguaaaugcucaa

SEQ ID NO: 1141619 - RNA, 23 nt, Homo sapiens
ucauguccuccccuccacccgca

SEQ ID NO: 1141620 - RNA, 16 nt, Homo sapiens
ucaugugacucuuucc

SEQ ID NO: 1141621 - RNA, 12 nt, Homo sapiens
ucaugugcuaua

SEQ ID NO: 1141622 - RNA, 16 nt, Homo sapiens
ucaugugcuauagaca

SEQ ID NO: 1141623 - RNA, 16 nt, Homo sapiens
ucauguuuuucaccua

SEQ ID NO: 1141624 - RNA, 18 nt, Homo sapiens
ucauguuuuuucugcaau

SEQ ID NO: 1141625 - RNA, 17 nt, Homo sapiens
ucauuaaugcacaucug

SEQ ID NO: 1141626 - RNA, 13 nt, Homo sapiens
ucauuacauauag

SEQ ID NO: 1141627 - RNA, 23 nt, Homo sapiens
ucauuaccacgccuugaccuucc

SEQ ID NO: 1141628 - RNA, 23 nt, Homo sapiens
ucauucaacucuccaauguucua

SEQ ID NO: 1141629 - RNA, 17 nt, Homo sapiens
ucauucccucucaucuc

SEQ ID NO: 1141630 - RNA, 13 nt, Homo sapiens
ucauucucucuuc

SEQ ID NO: 1141631 - RNA, 11 nt, Homo sapiens
ucauucuugcc

SEQ ID NO: 1141632 - RNA, 18 nt, Homo sapiens
ucauugagggaccaaaaa

SEQ ID NO: 1141633 - RNA, 17 nt, Homo sapiens
ucauugggccaguuccu

SEQ ID NO: 1141634 - RNA, 18 nt, Homo sapiens
ucauuguaaucacuguug

SEQ ID NO: 1141635 - RNA, 15 nt, Homo sapiens
ucauuuaucccucaa

SEQ ID NO: 1141636 - RNA, 17 nt, Homo sapiens
ucauuucauguauaguu

SEQ ID NO: 1141637 - RNA, 15 nt, Homo sapiens
ucauuuccauuugag

SEQ ID NO: 1141638 - RNA, 21 nt, Homo sapiens
ucauuuccuauguaacugcau

SEQ ID NO: 1141639 - RNA, 15 nt, Homo sapiens
ucauuucuacugaag

SEQ ID NO: 1141640 - RNA, 21 nt, Homo sapiens
ucauuuguaccucgaguuuua

SEQ ID NO: 1141641 - RNA, 19 nt, Homo sapiens
ucauuuguuuacauuugau

SEQ ID NO: 1141642 - RNA, 16 nt, Homo sapiens
ucauuuucacuuuuaa

SEQ ID NO: 1141643 - RNA, 17 nt, Homo sapiens
ucauuuuggcaucugca

SEQ ID NO: 1141644 - RNA, 17 nt, Homo sapiens
gugacuucacagugaag

SEQ ID NO: 1141645 - RNA, 13 nt, Homo sapiens
gugagaacacagc

SEQ ID NO: 1141646 - RNA, 17 nt, Homo sapiens
gugagaccaggggacca

SEQ ID NO: 1141647 - RNA, 18 nt, Homo sapiens
gugagaccaggggaccag

SEQ ID NO: 1141648 - RNA, 18 nt, Homo sapiens
gugagacuccaucucuau

SEQ ID NO: 1141649 - RNA, 15 nt, Homo sapiens
gugagccaagauugc

SEQ ID NO: 1141650 - RNA, 18 nt, Homo sapiens
gugaggaugucacucaga

SEQ ID NO: 1141651 - RNA, 18 nt, Homo sapiens
gugaggugcuugagucuc

SEQ ID NO: 1141652 - RNA, 15 nt, Homo sapiens
gugaguacuguuaag

SEQ ID NO: 1141653 - RNA, 13 nt, Homo sapiens
aaaaaaacagcuc

SEQ ID NO: 1141654 - RNA, 12 nt, Homo sapiens
aaaaaaauggaa

SEQ ID NO: 1141655 - RNA, 13 nt, Homo sapiens
aaaaaaccaaagu

SEQ ID NO: 1141656 - RNA, 18 nt, Homo sapiens
aaaaaagaaaacauucca

SEQ ID NO: 1141657 - RNA, 12 nt, Homo sapiens
aaaaaagcuuuu

SEQ ID NO: 1141658 - RNA, 13 nt, Homo sapiens
aaaaaauggucaa

SEQ ID NO: 1141659 - RNA, 15 nt, Homo sapiens
aaaaacaagacugcc

SEQ ID NO: 1141660 - RNA, 13 nt, Homo sapiens
aaaaacacagaca

SEQ ID NO: 1141661 - RNA, 19 nt, Homo sapiens
aaaaacacagacauucugc

SEQ ID NO: 1141662 - RNA, 16 nt, Homo sapiens
aaaaaccaaaacugug

SEQ ID NO: 1141663 - RNA, 17 nt, Homo sapiens
aaaaacugcagucauca

SEQ ID NO: 1141664 - RNA, 20 nt, Homo sapiens
aaaaacuuaaaaaaaugggg

SEQ ID NO: 1141665 - RNA, 15 nt, Homo sapiens
aaaaacuuucacuga

SEQ ID NO: 1141666 - RNA, 18 nt, Homo sapiens
aaaaagaugguugccaag

SEQ ID NO: 1141667 - RNA, 12 nt, Homo sapiens
aaaaagcacaaa

SEQ ID NO: 1141668 - RNA, 13 nt, Homo sapiens
aaaaagcaggaaa

SEQ ID NO: 1141669 - RNA, 20 nt, Homo sapiens
aaaaagcaugugucaugcau

SEQ ID NO: 1141670 - RNA, 14 nt, Homo sapiens
aaaaagccugugaa

SEQ ID NO: 1141671 - RNA, 18 nt, Homo sapiens
aaaaaguuuguuacuuug

SEQ ID NO: 1141672 - RNA, 21 nt, Homo sapiens
aaaaauaaacggaaguuacau

SEQ ID NO: 1141673 - RNA, 13 nt, Homo sapiens
aaaaauacaauua

SEQ ID NO: 1141674 - RNA, 11 nt, Homo sapiens
aaaaauacuuu

SEQ ID NO: 1141675 - RNA, 19 nt, Homo sapiens
aaaaauaggauugcuucaa

SEQ ID NO: 1141676 - RNA, 22 nt, Homo sapiens
aaaaauauaaaguacaucucua

SEQ ID NO: 1141677 - RNA, 13 nt, Homo sapiens
aaaaaucauauaa

SEQ ID NO: 1141678 - RNA, 15 nt, Homo sapiens
aaaaaucccaaacaa

SEQ ID NO: 1141679 - RNA, 16 nt, Homo sapiens
aaaaauccuacuuuca

SEQ ID NO: 1141680 - RNA, 17 nt, Homo sapiens
aaaaaucuaccuguucc

SEQ ID NO: 1141681 - RNA, 16 nt, Homo sapiens
aaaaauggauagcuca

SEQ ID NO: 1141682 - RNA, 18 nt, Homo sapiens
aaaaauggcagugaugaa

SEQ ID NO: 1141683 - RNA, 12 nt, Homo sapiens
aaaaauggucaa

SEQ ID NO: 1141684 - RNA, 19 nt, Homo sapiens
aaaaauguauaaugacuuu

SEQ ID NO: 1141685 - RNA, 13 nt, Homo sapiens
aaaaauugacuua

SEQ ID NO: 1141686 - RNA, 21 nt, Homo sapiens
aaaaauuuauauuucagauuu

SEQ ID NO: 1141687 - RNA, 15 nt, Homo sapiens
aaaaauuuuuccuga

SEQ ID NO: 1141688 - RNA, 17 nt, Homo sapiens
aaaaauuuuuuuccuga

SEQ ID NO: 1141689 - RNA, 19 nt, Homo sapiens
aaaacaagaaaccaagugg

SEQ ID NO: 1141690 - RNA, 16 nt, Homo sapiens
aaaacaagauggagau

SEQ ID NO: 1141691 - RNA, 13 nt, Homo sapiens
aaaacaauaauuu

SEQ ID NO: 1141692 - RNA, 16 nt, Homo sapiens
aaaacaauguuuuaaa

SEQ ID NO: 1141693 - RNA, 14 nt, Homo sapiens
aaaacacagacauu

SEQ ID NO: 1141694 - RNA, 22 nt, Homo sapiens
aaaacaccacuaauuguguaca

SEQ ID NO: 1141695 - RNA, 19 nt, Homo sapiens
aaaacaccgcuucugccuu

SEQ ID NO: 1141696 - RNA, 23 nt, Homo sapiens
aaaacagaacaucauuagaacaa

SEQ ID NO: 1141697 - RNA, 15 nt, Homo sapiens
aaaacaggucuucau

SEQ ID NO: 1141698 - RNA, 20 nt, Homo sapiens
aaaacaguccagacauuugu

SEQ ID NO: 1141699 - RNA, 18 nt, Homo sapiens
aaaaccaaaacugugcag

SEQ ID NO: 1141700 - RNA, 22 nt, Homo sapiens
aaaaccaaauucuauacaugua

SEQ ID NO: 1141701 - RNA, 17 nt, Homo sapiens
aaaaccacgaaagcaca

SEQ ID NO: 1141702 - RNA, 12 nt, Homo sapiens
aaaaccagacaa

SEQ ID NO: 1141703 - RNA, 20 nt, Homo sapiens
aaaacccaccaaaaccaaga

SEQ ID NO: 1141704 - RNA, 20 nt, Homo sapiens
aaaaccccaucuuuacuaaa

SEQ ID NO: 1141705 - RNA, 21 nt, Homo sapiens
aaaaccuugaaaccuuugaca

SEQ ID NO: 1141706 - RNA, 14 nt, Homo sapiens
aaaacguguaaaug

SEQ ID NO: 1141707 - RNA, 14 nt, Homo sapiens
aaaacuacaaauca

SEQ ID NO: 1141708 - RNA, 21 nt, Homo sapiens
aaaacucaaagaauguguaug

SEQ ID NO: 1141709 - RNA, 12 nt, Homo sapiens
aaaacucagaga

SEQ ID NO: 1141710 - RNA, 20 nt, Homo sapiens
aaaacucauuuccuauguaa

SEQ ID NO: 1141711 - RNA, 23 nt, Homo sapiens
aaaacugaaagugaaaguccaga

SEQ ID NO: 1141712 - RNA, 14 nt, Homo sapiens
aaaacugacagagg

SEQ ID NO: 1141713 - RNA, 11 nt, Homo sapiens
aaaacugagug

SEQ ID NO: 1141714 - RNA, 22 nt, Homo sapiens
aaaacuggcaacauuccaagaa

SEQ ID NO: 1141715 - RNA, 15 nt, Homo sapiens
aaaacuucacugugc

SEQ ID NO: 1141716 - RNA, 16 nt, Homo sapiens
aaaacuucacugugcu

SEQ ID NO: 1141717 - RNA, 14 nt, Homo sapiens
aaaacuuguagaau

SEQ ID NO: 1141718 - RNA, 16 nt, Homo sapiens
aaaacuuucacugaau

SEQ ID NO: 1141719 - RNA, 17 nt, Homo sapiens
aaaagaaaacaccacua

SEQ ID NO: 1141720 - RNA, 15 nt, Homo sapiens
aaaagaaaccacuuc

SEQ ID NO: 1141721 - RNA, 15 nt, Homo sapiens
aaaagaagacauucu

SEQ ID NO: 1141722 - RNA, 16 nt, Homo sapiens
aaaagacaaauaugua

SEQ ID NO: 1141723 - RNA, 13 nt, Homo sapiens
aaaagacagugaa

SEQ ID NO: 1141724 - RNA, 15 nt, Homo sapiens
aaaagaccaucuccu

SEQ ID NO: 1141725 - RNA, 13 nt, Homo sapiens
aaaagaccuauga

SEQ ID NO: 1141726 - RNA, 21 nt, Homo sapiens
aaaagacuucccuaacacuua

SEQ ID NO: 1141727 - RNA, 15 nt, Homo sapiens
aaaagaggagccaga

SEQ ID NO: 1141728 - RNA, 16 nt, Homo sapiens
aaaagaguuacacugg

SEQ ID NO: 1141729 - RNA, 15 nt, Homo sapiens
aaaagaugcagagua

SEQ ID NO: 1141730 - RNA, 17 nt, Homo sapiens
aaaagaugguugccaag

SEQ ID NO: 1141731 - RNA, 10 nt, Homo sapiens
aaaagcaagg

SEQ ID NO: 1141732 - RNA, 18 nt, Homo sapiens
aaaagcaguaacugacaa

SEQ ID NO: 1141733 - RNA, 19 nt, Homo sapiens
aaaagcaucacaugaacuu

SEQ ID NO: 1141734 - RNA, 11 nt, Homo sapiens
aaaagccaaaa

SEQ ID NO: 1141735 - RNA, 13 nt, Homo sapiens
aaaagccaugugu

SEQ ID NO: 1141736 - RNA, 20 nt, Homo sapiens
aaaaggaauguuugaauuua

SEQ ID NO: 1141737 - RNA, 24 nt, Homo sapiens
aaaaggacuggaaaaaugaacugu

SEQ ID NO: 1141738 - RNA, 17 nt, Homo sapiens
aaaaggagccugugaga

SEQ ID NO: 1141739 - RNA, 16 nt, Homo sapiens
aaaaggauuaggcaaa

SEQ ID NO: 1141740 - RNA, 15 nt, Homo sapiens
aaaagggaugcugua

SEQ ID NO: 1141741 - RNA, 15 nt, Homo sapiens
aaaagguuuacagaa

SEQ ID NO: 1141742 - RNA, 14 nt, Homo sapiens
aaaagucaguauca

SEQ ID NO: 1141743 - RNA, 16 nt, Homo sapiens
aaaagucugccuaucc

SEQ ID NO: 1141744 - RNA, 19 nt, Homo sapiens
aaaagucugccuauccugg

SEQ ID NO: 1141745 - RNA, 10 nt, Homo sapiens
acagauuuga

SEQ ID NO: 1141746 - RNA, 21 nt, Homo sapiens
acagauuuuugguaguuucug

SEQ ID NO: 1141747 - RNA, 14 nt, Homo sapiens
acagcaaacugucc

SEQ ID NO: 1141748 - RNA, 18 nt, Homo sapiens
acagcaaccccaggcuga

SEQ ID NO: 1141749 - RNA, 18 nt, Homo sapiens
acagcacccucuccagau

SEQ ID NO: 1141750 - RNA, 15 nt, Homo sapiens
acagcaguagacauu

SEQ ID NO: 1141751 - RNA, 14 nt, Homo sapiens
acagccaacagcua

SEQ ID NO: 1141752 - RNA, 17 nt, Homo sapiens
acagccguguguucaaa

SEQ ID NO: 1141753 - RNA, 20 nt, Homo sapiens
acagccugaauaaaccaaga

SEQ ID NO: 1141754 - RNA, 19 nt, Homo sapiens
acagcgcuggccgggaccc

SEQ ID NO: 1141755 - RNA, 19 nt, Homo sapiens
acagcucacugcagccuca

SEQ ID NO: 1141756 - RNA, 14 nt, Homo sapiens
acagcugcauuaaa

SEQ ID NO: 1141757 - RNA, 14 nt, Homo sapiens
acagcugugcucug

SEQ ID NO: 1141758 - RNA, 16 nt, Homo sapiens
acagcuuagaagccau

SEQ ID NO: 1141759 - RNA, 22 nt, Homo sapiens
acagcuuauggcaucucauuga

SEQ ID NO: 1141760 - RNA, 17 nt, Homo sapiens
acaggaaagaugcauuu

SEQ ID NO: 1141761 - RNA, 22 nt, Homo sapiens
acaggacgaggcagaaaagcac

SEQ ID NO: 1141762 - RNA, 18 nt, Homo sapiens
acaggagaaacacuugaa

SEQ ID NO: 1141763 - RNA, 13 nt, Homo sapiens
acaggagauucca

SEQ ID NO: 1141764 - RNA, 23 nt, Homo sapiens
acaggagcugggauccuaagggc

SEQ ID NO: 1141765 - RNA, 17 nt, Homo sapiens
acaggaggcaggcaugg

SEQ ID NO: 1141766 - RNA, 23 nt, Homo sapiens
acaggaguguccucuucccucuc

SEQ ID NO: 1141767 - RNA, 13 nt, Homo sapiens
acaggaucaugua

SEQ ID NO: 1141768 - RNA, 23 nt, Homo sapiens
acaggaucauguaaaugcucaaa

SEQ ID NO: 1141769 - RNA, 13 nt, Homo sapiens
acaggcacccacc

SEQ ID NO: 1141770 - RNA, 20 nt, Homo sapiens
acaggccgagugaaggugcu

SEQ ID NO: 1141771 - RNA, 14 nt, Homo sapiens
acaggcuguagauu

SEQ ID NO: 1141772 - RNA, 17 nt, Homo sapiens
acagggccacaacugcc

SEQ ID NO: 1141773 - RNA, 16 nt, Homo sapiens
acaggguaccaggaua

SEQ ID NO: 1141774 - RNA, 21 nt, Homo sapiens
acagggucuugcuauauugcc

SEQ ID NO: 1141775 - RNA, 14 nt, Homo sapiens
acagguccccagau

SEQ ID NO: 1141776 - RNA, 18 nt, Homo sapiens
acagguggugucacuguc

SEQ ID NO: 1141777 - RNA, 19 nt, Homo sapiens
acagguguuuauacagcuc

SEQ ID NO: 1141778 - RNA, 15 nt, Homo sapiens
acagguuacaacaga

SEQ ID NO: 1141779 - RNA, 20 nt, Homo sapiens
acagguuacaacagauuugu

SEQ ID NO: 1141780 - RNA, 15 nt, Homo sapiens
acaguaacacaauua

SEQ ID NO: 1141781 - RNA, 17 nt, Homo sapiens
acaguaaguccaguaaa

SEQ ID NO: 1141782 - RNA, 21 nt, Homo sapiens
acaguaauaagaauggaaaag

SEQ ID NO: 1141783 - RNA, 19 nt, Homo sapiens
acaguaguuuauuugaacu

SEQ ID NO: 1141784 - RNA, 19 nt, Homo sapiens
acagucagcucuucaucug

SEQ ID NO: 1141785 - RNA, 18 nt, Homo sapiens
acagugaaucagucccau

SEQ ID NO: 1141786 - RNA, 18 nt, Homo sapiens
acagugaauuuaagcaug

SEQ ID NO: 1141787 - RNA, 22 nt, Homo sapiens
acagugacggcugcgccuccac

SEQ ID NO: 1141788 - RNA, 15 nt, Homo sapiens
acagugauauacuua

SEQ ID NO: 1141789 - RNA, 14 nt, Homo sapiens
acagugcccagggc

SEQ ID NO: 1141790 - RNA, 18 nt, Homo sapiens
acaguggccccaucauag

SEQ ID NO: 1141791 - RNA, 20 nt, Homo sapiens
acaguggcucacgccuguaa

SEQ ID NO: 1141792 - RNA, 14 nt, Homo sapiens
acagugggaaauau

SEQ ID NO: 1141793 - RNA, 18 nt, Homo sapiens
acaguguaacagguccuu

SEQ ID NO: 1141794 - RNA, 13 nt, Homo sapiens
acaguuaaggaau

SEQ ID NO: 1141795 - RNA, 20 nt, Homo sapiens
acaguuccuucagcuuccau

SEQ ID NO: 1141796 - RNA, 16 nt, Homo sapiens
acaguucugucauaug

SEQ ID NO: 1141797 - RNA, 14 nt, Homo sapiens
acaguugauuucca

SEQ ID NO: 1141798 - RNA, 15 nt, Homo sapiens
acaguugauuuccaa

SEQ ID NO: 1141799 - RNA, 16 nt, Homo sapiens
aauuucacaagcuauu

SEQ ID NO: 1141800 - RNA, 18 nt, Homo sapiens
aauuucacgucgucuucu

SEQ ID NO: 1141801 - RNA, 12 nt, Homo sapiens
aauuucacuuaa

SEQ ID NO: 1141802 - RNA, 20 nt, Homo sapiens
aauuucacuuaauaaugugu

SEQ ID NO: 1141803 - RNA, 14 nt, Homo sapiens
aauuuccuaaugag

SEQ ID NO: 1141804 - RNA, 11 nt, Homo sapiens
aauuucuacua

SEQ ID NO: 1141805 - RNA, 23 nt, Homo sapiens
aauuucugugucuaaauuucuuc

SEQ ID NO: 1141806 - RNA, 19 nt, Homo sapiens
aauuucuucuuuuccugca

SEQ ID NO: 1141807 - RNA, 15 nt, Homo sapiens
aauuugacaaaaccc

SEQ ID NO: 1141808 - RNA, 18 nt, Homo sapiens
aauuugacaaaacccacu

SEQ ID NO: 1141809 - RNA, 21 nt, Homo sapiens
aauuugacugucugauauuau

SEQ ID NO: 1141810 - RNA, 16 nt, Homo sapiens
aauuugagauacaaac

SEQ ID NO: 1141811 - RNA, 18 nt, Homo sapiens
aauuugcaaaguacugua

SEQ ID NO: 1141812 - RNA, 12 nt, Homo sapiens
aauuugccugua

SEQ ID NO: 1141813 - RNA, 20 nt, Homo sapiens
aauuugggcuggaacaugua

SEQ ID NO: 1141814 - RNA, 21 nt, Homo sapiens
aauuuguaagcaacuugcuuc

SEQ ID NO: 1141815 - RNA, 23 nt, Homo sapiens
aauuugucuuuuaauuuagcuua

SEQ ID NO: 1141816 - RNA, 20 nt, Homo sapiens
aauuuguuggagaugcagcc

SEQ ID NO: 1141817 - RNA, 22 nt, Homo sapiens
aauuuuaguucuuacugcuuaa

SEQ ID NO: 1141818 - RNA, 20 nt, Homo sapiens
aauuuuauucaagaaugcca

SEQ ID NO: 1141819 - RNA, 18 nt, Homo sapiens
aauuuuauuggggggcaa

SEQ ID NO: 1141820 - RNA, 15 nt, Homo sapiens
aauuuucagcauuaa

SEQ ID NO: 1141821 - RNA, 18 nt, Homo sapiens
aauuuucauucauucacu

SEQ ID NO: 1141822 - RNA, 18 nt, Homo sapiens
aauuuucuuccauuucau

SEQ ID NO: 1141823 - RNA, 12 nt, Homo sapiens
aauuuugcugga

SEQ ID NO: 1141824 - RNA, 14 nt, Homo sapiens
aauuuugggggaaa

SEQ ID NO: 1141825 - RNA, 15 nt, Homo sapiens
aauuuuuaaugcuua

SEQ ID NO: 1141826 - RNA, 15 nt, Homo sapiens
aauuuuuacauggag

SEQ ID NO: 1141827 - RNA, 21 nt, Homo sapiens
aauuuuuacuuagauacuaau

SEQ ID NO: 1141828 - RNA, 21 nt, Homo sapiens
aauuuuucucuaacucagaaa

SEQ ID NO: 1141829 - RNA, 15 nt, Homo sapiens
aauuuuucucuuuaa

SEQ ID NO: 1141830 - RNA, 16 nt, Homo sapiens
aauuuuugaaaacugg

SEQ ID NO: 1141831 - RNA, 21 nt, Homo sapiens
aauuuuuuaaaguuacuuugu

SEQ ID NO: 1141832 - RNA, 20 nt, Homo sapiens
aauuuuuuaaauaaauggaa

SEQ ID NO: 1141833 - RNA, 19 nt, Homo sapiens
aauuuuuuugaaucuuucg

SEQ ID NO: 1141834 - RNA, 22 nt, Homo sapiens
acaaaaaaaaaacccuauuuaa

SEQ ID NO: 1141835 - RNA, 22 nt, Homo sapiens
acaaaaauacuguaagucucaa

SEQ ID NO: 1141836 - RNA, 13 nt, Homo sapiens
acaaaaauuagcu

SEQ ID NO: 1141837 - RNA, 14 nt, Homo sapiens
acaaaaauuugcca

SEQ ID NO: 1141838 - RNA, 22 nt, Homo sapiens
acaaaacaccagacccuggaac

SEQ ID NO: 1141839 - RNA, 14 nt, Homo sapiens
acaaaacuuaucuc

SEQ ID NO: 1141840 - RNA, 17 nt, Homo sapiens
acaaaagcauuuugcua

SEQ ID NO: 1141841 - RNA, 21 nt, Homo sapiens
acaaaaggaaagaaacuaccu

SEQ ID NO: 1141842 - RNA, 22 nt, Homo sapiens
acaaaaggaaagaaacuaccuu

SEQ ID NO: 1141843 - RNA, 12 nt, Homo sapiens
acaaaaggcaga

SEQ ID NO: 1141844 - RNA, 22 nt, Homo sapiens
acaaaaggcuuuggcaacagaa

SEQ ID NO: 1141845 - RNA, 19 nt, Homo sapiens
acaaaaugggccucaugga

SEQ ID NO: 1141846 - RNA, 15 nt, Homo sapiens
acaaacccuuuucau

SEQ ID NO: 1141847 - RNA, 17 nt, Homo sapiens
acaaacccuuuucaucc

SEQ ID NO: 1141848 - RNA, 11 nt, Homo sapiens
acaaacuaagg

SEQ ID NO: 1141849 - RNA, 16 nt, Homo sapiens
acaaacuacuguguca

SEQ ID NO: 1141850 - RNA, 22 nt, Homo sapiens
acaaacuucccugacucuucaa

SEQ ID NO: 1141851 - RNA, 22 nt, Homo sapiens
acaaagaaaggugccaugucuu

SEQ ID NO: 1141852 - RNA, 16 nt, Homo sapiens
acaaagaccgagcaaa

SEQ ID NO: 1141853 - RNA, 16 nt, Homo sapiens
acaaagcaaaggcagu

SEQ ID NO: 1141854 - RNA, 22 nt, Homo sapiens
acaaagcaggaguggaagguga

SEQ ID NO: 1141855 - RNA, 22 nt, Homo sapiens
acaaagcggcucuaaaccucag

SEQ ID NO: 1141856 - RNA, 18 nt, Homo sapiens
acaaaggacagaguauga

SEQ ID NO: 1141857 - RNA, 19 nt, Homo sapiens
acaaaggacagaguaugaa

SEQ ID NO: 1141858 - RNA, 15 nt, Homo sapiens
acaaaggaggacaag

SEQ ID NO: 1141859 - RNA, 17 nt, Homo sapiens
acaaaggauuugaugcu

SEQ ID NO: 1141860 - RNA, 19 nt, Homo sapiens
acaaaggcaaaggguccag

SEQ ID NO: 1141861 - RNA, 18 nt, Homo sapiens
acaaagucaagccacaug

SEQ ID NO: 1141862 - RNA, 13 nt, Homo sapiens
acaaagugccaaa

SEQ ID NO: 1141863 - RNA, 22 nt, Homo sapiens
acaaauauggggaaaaaacugu

SEQ ID NO: 1141864 - RNA, 17 nt, Homo sapiens
acaaaugcacgucacag

SEQ ID NO: 1141865 - RNA, 11 nt, Homo sapiens
acaaauuccac

SEQ ID NO: 1141866 - RNA, 11 nt, Homo sapiens
acaacaaggac

SEQ ID NO: 1141867 - RNA, 12 nt, Homo sapiens
acaacagugcua

SEQ ID NO: 1141868 - RNA, 10 nt, Homo sapiens
acaacauguu

SEQ ID NO: 1141869 - RNA, 19 nt, Homo sapiens
acaacccaccccgcuuucg

SEQ ID NO: 1141870 - RNA, 13 nt, Homo sapiens
acaacccucugga

SEQ ID NO: 1141871 - RNA, 17 nt, Homo sapiens
acaaccuacucugcaaa

SEQ ID NO: 1141872 - RNA, 18 nt, Homo sapiens
acaacuaaauaacuguau

SEQ ID NO: 1141873 - RNA, 16 nt, Homo sapiens
acaacucaaugaaaau

SEQ ID NO: 1141874 - RNA, 21 nt, Homo sapiens
acaacuccuuccauccuugac

SEQ ID NO: 1141875 - RNA, 20 nt, Homo sapiens
acaacuuuauguagagaaaa

SEQ ID NO: 1141876 - RNA, 14 nt, Homo sapiens
acaagacauugugu

SEQ ID NO: 1141877 - RNA, 17 nt, Homo sapiens
acaagagaagcugaugg

SEQ ID NO: 1141878 - RNA, 21 nt, Homo sapiens
acaagauggauggaaagggag

SEQ ID NO: 1141879 - RNA, 22 nt, Homo sapiens
acaagcaacagcaaaagcccua

SEQ ID NO: 1141880 - RNA, 15 nt, Homo sapiens
auaucacgacagauu

SEQ ID NO: 1141881 - RNA, 13 nt, Homo sapiens
auaucauaaucug

SEQ ID NO: 1141882 - RNA, 13 nt, Homo sapiens
auaucauacuucc

SEQ ID NO: 1141883 - RNA, 14 nt, Homo sapiens
auaucauacuucca

SEQ ID NO: 1141884 - RNA, 20 nt, Homo sapiens
auauccaggcuuaccaaagu

SEQ ID NO: 1141885 - RNA, 19 nt, Homo sapiens
auauccuuugccucaagga

SEQ ID NO: 1141886 - RNA, 22 nt, Homo sapiens
auauccuuuucuucuauguagg

SEQ ID NO: 1141887 - RNA, 22 nt, Homo sapiens
auaucgcuggccagcauuauaa

SEQ ID NO: 1141888 - RNA, 23 nt, Homo sapiens
auaucuucuguuucauaaugcag

SEQ ID NO: 1141889 - RNA, 22 nt, Homo sapiens
auaucuuguaaauaaagacauu

SEQ ID NO: 1141890 - RNA, 16 nt, Homo sapiens
auaucuuuauacuuaa

SEQ ID NO: 1141891 - RNA, 15 nt, Homo sapiens
auaucuuuauugcau

SEQ ID NO: 1141892 - RNA, 22 nt, Homo sapiens
auaucuuuuguaagacauuucc

SEQ ID NO: 1141893 - RNA, 15 nt, Homo sapiens
auaugaaaacacuca

SEQ ID NO: 1141894 - RNA, 13 nt, Homo sapiens
auaugaagacaua

SEQ ID NO: 1141895 - RNA, 14 nt, Homo sapiens
auaugaagacauaa

SEQ ID NO: 1141896 - RNA, 17 nt, Homo sapiens
auaugaagaccaaauga

SEQ ID NO: 1141897 - RNA, 16 nt, Homo sapiens
auaugaaucugcucac

SEQ ID NO: 1141898 - RNA, 15 nt, Homo sapiens
auaugaauucaagaa

SEQ ID NO: 1141899 - RNA, 14 nt, Homo sapiens
auaugacaacucuu

SEQ ID NO: 1141900 - RNA, 22 nt, Homo sapiens
auaugaggcuugacagagucug

SEQ ID NO: 1141901 - RNA, 20 nt, Homo sapiens
auaugauuuaaaacauguaa

SEQ ID NO: 1141902 - RNA, 21 nt, Homo sapiens
auaugauuuauauuacugucu

SEQ ID NO: 1141903 - RNA, 21 nt, Homo sapiens
auaugcauugucugcaauggu

SEQ ID NO: 1141904 - RNA, 19 nt, Homo sapiens
auaugcugacagcucuuca

SEQ ID NO: 1141905 - RNA, 19 nt, Homo sapiens
auaugcuggagauggacaa

SEQ ID NO: 1141906 - RNA, 17 nt, Homo sapiens
auaugcuguacaugaca

SEQ ID NO: 1141907 - RNA, 14 nt, Homo sapiens
auauggacacugug

SEQ ID NO: 1141908 - RNA, 19 nt, Homo sapiens
auauggacacugugacaau

SEQ ID NO: 1141909 - RNA, 17 nt, Homo sapiens
auauggacucugcacau

SEQ ID NO: 1141910 - RNA, 13 nt, Homo sapiens
auauggcuugagu

SEQ ID NO: 1141911 - RNA, 23 nt, Homo sapiens
auaugugcagaagguuacuaccu

SEQ ID NO: 1141912 - RNA, 20 nt, Homo sapiens
auauguuuaucaacucaaga

SEQ ID NO: 1141913 - RNA, 15 nt, Homo sapiens
auauuaaaacacuua

SEQ ID NO: 1141914 - RNA, 17 nt, Homo sapiens
auauuagauuacuaagu

SEQ ID NO: 1141915 - RNA, 20 nt, Homo sapiens
auauuaggagacacagggaa

SEQ ID NO: 1141916 - RNA, 14 nt, Homo sapiens
auauucacuaagga

SEQ ID NO: 1141917 - RNA, 12 nt, Homo sapiens
auauucauauaa

SEQ ID NO: 1141918 - RNA, 14 nt, Homo sapiens
auauuccaccagga

SEQ ID NO: 1141919 - RNA, 20 nt, Homo sapiens
auauucccacucagcacuca

SEQ ID NO: 1141920 - RNA, 17 nt, Homo sapiens
auauucgguaauaucau

SEQ ID NO: 1141921 - RNA, 18 nt, Homo sapiens
auauucgguaauaucauu

SEQ ID NO: 1141922 - RNA, 15 nt, Homo sapiens
auauugcacaggcug

SEQ ID NO: 1141923 - RNA, 19 nt, Homo sapiens
auauugcagcuuauauuca

SEQ ID NO: 1141924 - RNA, 21 nt, Homo sapiens
auauugcucuauauguaauau

SEQ ID NO: 1141925 - RNA, 18 nt, Homo sapiens
auauuggaucauacuggu

SEQ ID NO: 1141926 - RNA, 15 nt, Homo sapiens
auauugucagucuuu

SEQ ID NO: 1141927 - RNA, 17 nt, Homo sapiens
auauuuaagcaacaucu

SEQ ID NO: 1141928 - RNA, 19 nt, Homo sapiens
auauuuaucucuuccugcu

SEQ ID NO: 1141929 - RNA, 20 nt, Homo sapiens
auauuuauuuaacuauucau

SEQ ID NO: 1141930 - RNA, 19 nt, Homo sapiens
auauuuuaaaaucugucac

SEQ ID NO: 1141931 - RNA, 19 nt, Homo sapiens
auauuuucaaagagacuau

SEQ ID NO: 1141932 - RNA, 22 nt, Homo sapiens
auauuuucuguguaagcuuuua

SEQ ID NO: 1141933 - RNA, 15 nt, Homo sapiens
auauuuuugugcaca

SEQ ID NO: 1141934 - RNA, 21 nt, Homo sapiens
aucaaaaagguuucugcacau

SEQ ID NO: 1141935 - RNA, 14 nt, Homo sapiens
aucaaaauccaaaa

SEQ ID NO: 1141936 - RNA, 15 nt, Homo sapiens
aucaaacaaccuuca

SEQ ID NO: 1141937 - RNA, 15 nt, Homo sapiens
aucaaagacagcauc

SEQ ID NO: 1141938 - RNA, 23 nt, Homo sapiens
aucaaagauuugucacaucccua

SEQ ID NO: 1141939 - RNA, 16 nt, Homo sapiens
aucaaagccacacucu

SEQ ID NO: 1141940 - RNA, 16 nt, Homo sapiens
aucaaaggcacacagc

SEQ ID NO: 1141941 - RNA, 21 nt, Homo sapiens
aucaaauauuagaugugauuu

SEQ ID NO: 1141942 - RNA, 12 nt, Homo sapiens
aucaaauuucac

SEQ ID NO: 1141943 - RNA, 18 nt, Homo sapiens
aucaaccccagacacugg

SEQ ID NO: 1141944 - RNA, 17 nt, Homo sapiens
aucaacugcugcuucac

SEQ ID NO: 1141945 - RNA, 21 nt, Homo sapiens
aucaacuggggggaccaaaua

SEQ ID NO: 1141946 - RNA, 12 nt, Homo sapiens
aucaagagucuc

SEQ ID NO: 1141947 - RNA, 14 nt, Homo sapiens
aucaagcaguuucu

SEQ ID NO: 1141948 - RNA, 15 nt, Homo sapiens
aucaagucuguuuac

SEQ ID NO: 1141949 - RNA, 18 nt, Homo sapiens
aucaaguguguguguguu

SEQ ID NO: 1141950 - RNA, 22 nt, Homo sapiens
aucaaguuugaccagugcaguu

SEQ ID NO: 1141951 - RNA, 19 nt, Homo sapiens
aucaauguauuaauaucuc

SEQ ID NO: 1141952 - RNA, 13 nt, Homo sapiens
aucaauuccauca

SEQ ID NO: 1141953 - RNA, 21 nt, Homo sapiens
aucacagcaaugcucuauucc

SEQ ID NO: 1141954 - RNA, 15 nt, Homo sapiens
aucaccaacuguccc

SEQ ID NO: 1141955 - RNA, 20 nt, Homo sapiens
aucaccagagaccaaacaag

SEQ ID NO: 1141956 - RNA, 23 nt, Homo sapiens
aucacgaaggaaaacugccauaa

SEQ ID NO: 1141957 - RNA, 21 nt, Homo sapiens
aucacgacagauuuaaccucu

SEQ ID NO: 1141958 - RNA, 21 nt, Homo sapiens
aucacgucacugcacuccagc

SEQ ID NO: 1141959 - RNA, 23 nt, Homo sapiens
aucacguguacuggcuccucugu

SEQ ID NO: 1141960 - RNA, 17 nt, Homo sapiens
aucacucucaccuucca

SEQ ID NO: 1141961 - RNA, 20 nt, Homo sapiens
aucacucuuagaccaugcua

SEQ ID NO: 1141962 - RNA, 11 nt, Homo sapiens
aucacuggguc

SEQ ID NO: 1141963 - RNA, 16 nt, Homo sapiens
aucagaaacuugugaa

SEQ ID NO: 1141964 - RNA, 17 nt, Homo sapiens
aucagaacuucaggugu

SEQ ID NO: 1141965 - RNA, 22 nt, Homo sapiens
aucagaagcgcugauggucaua

SEQ ID NO: 1141966 - RNA, 20 nt, Homo sapiens
aucagauuuggugauggaaa

SEQ ID NO: 1141967 - RNA, 14 nt, Homo sapiens
aucagcacaaagac

SEQ ID NO: 1141968 - RNA, 11 nt, Homo sapiens
aucagccagac

SEQ ID NO: 1141969 - RNA, 13 nt, Homo sapiens
aucagccagacau

SEQ ID NO: 1141970 - RNA, 21 nt, Homo sapiens
aucagccucgcucuugucucu

SEQ ID NO: 1141971 - RNA, 13 nt, Homo sapiens
aucagccuucaag

SEQ ID NO: 1141972 - RNA, 18 nt, Homo sapiens
aucagcgccgcaccagcc

SEQ ID NO: 1141973 - RNA, 23 nt, Homo sapiens
aucagcuacccauuauagcacaa

SEQ ID NO: 1141974 - RNA, 15 nt, Homo sapiens
aucaggaaacucaaa

SEQ ID NO: 1141975 - RNA, 16 nt, Homo sapiens
aucaggaccuccaagc

SEQ ID NO: 1141976 - RNA, 18 nt, Homo sapiens
aucaggaccuccaagcca

SEQ ID NO: 1141977 - RNA, 13 nt, Homo sapiens
aucaggacgagaa

SEQ ID NO: 1141978 - RNA, 22 nt, Homo sapiens
aucagggauccaauaugacuca

SEQ ID NO: 1141979 - RNA, 22 nt, Homo sapiens
aucaguccaucccagagggacc

SEQ ID NO: 1141980 - RNA, 22 nt, Homo sapiens
aucaguccucgcggcucuccag

SEQ ID NO: 1141981 - RNA, 23 nt, Homo sapiens
aucagugggauuugguaaugugu

SEQ ID NO: 1141982 - RNA, 16 nt, Homo sapiens
aucaguguuguugcuc

SEQ ID NO: 1141983 - RNA, 12 nt, Homo sapiens
aucaguugguuu

SEQ ID NO: 1141984 - RNA, 20 nt, Homo sapiens
aucaguuuuuucaccuggaa

SEQ ID NO: 1141985 - RNA, 20 nt, Homo sapiens
aucauaaaacuuuuguguca

SEQ ID NO: 1141986 - RNA, 19 nt, Homo sapiens
aucauaauuaauguaguag

SEQ ID NO: 1141987 - RNA, 18 nt, Homo sapiens
aucauagcaagaccucau

SEQ ID NO: 1141988 - RNA, 20 nt, Homo sapiens
aucauauuugaaaaccauau

SEQ ID NO: 1141989 - RNA, 14 nt, Homo sapiens
aucaucauucucau

SEQ ID NO: 1141990 - RNA, 13 nt, Homo sapiens
aucauccaagaca

SEQ ID NO: 1141991 - RNA, 22 nt, Homo sapiens
aucaucccacagacaauacguu

SEQ ID NO: 1141992 - RNA, 18 nt, Homo sapiens
aucaucuccugccuuccu

SEQ ID NO: 1141993 - RNA, 12 nt, Homo sapiens
aucaucucucau

SEQ ID NO: 1141994 - RNA, 21 nt, Homo sapiens
aucauggagaacagcaugaca

SEQ ID NO: 1141995 - RNA, 17 nt, Homo sapiens
aucauguaaaugcucaa

SEQ ID NO: 1141996 - RNA, 18 nt, Homo sapiens
aucauguaaaugcucaaa

SEQ ID NO: 1141997 - RNA, 13 nt, Homo sapiens
aucauguaucucu

SEQ ID NO: 1141998 - RNA, 23 nt, Homo sapiens
augcuuguauuuuacuuuuccau

SEQ ID NO: 1141999 - RNA, 14 nt, Homo sapiens
augcuuuccugcac

SEQ ID NO: 1142000 - RNA, 21 nt, Homo sapiens
augcuuugaaagcuuauuuga

SEQ ID NO: 1142001 - RNA, 15 nt, Homo sapiens
augcuuuugcuugca

SEQ ID NO: 1142002 - RNA, 18 nt, Homo sapiens
augcuuuugcuugcaaug

SEQ ID NO: 1142003 - RNA, 18 nt, Homo sapiens
auggaagccaacacauca

SEQ ID NO: 1142004 - RNA, 13 nt, Homo sapiens
auggaaugcuucu

SEQ ID NO: 1142005 - RNA, 17 nt, Homo sapiens
auggacaacucaaugaa

SEQ ID NO: 1142006 - RNA, 14 nt, Homo sapiens
auggacacugugac

SEQ ID NO: 1142007 - RNA, 11 nt, Homo sapiens
auggacaugcu

SEQ ID NO: 1142008 - RNA, 23 nt, Homo sapiens
auggacaugcuucagugcugcuc

SEQ ID NO: 1142009 - RNA, 19 nt, Homo sapiens
auggacauucaugcucagu

SEQ ID NO: 1142010 - RNA, 13 nt, Homo sapiens
auggacucugcac

SEQ ID NO: 1142011 - RNA, 12 nt, Homo sapiens
auggacuuaccc

SEQ ID NO: 1142012 - RNA, 15 nt, Homo sapiens
auggagaccgugacc

SEQ ID NO: 1142013 - RNA, 15 nt, Homo sapiens
auggaguacacagcu

SEQ ID NO: 1142014 - RNA, 13 nt, Homo sapiens
auggaguagccau

SEQ ID NO: 1142015 - RNA, 18 nt, Homo sapiens
auggaguucuugugccau

SEQ ID NO: 1142016 - RNA, 22 nt, Homo sapiens
auggaugccgugggaguacaaa

SEQ ID NO: 1142017 - RNA, 17 nt, Homo sapiens
auggaugggggaacuca

SEQ ID NO: 1142018 - RNA, 15 nt, Homo sapiens
auggauguguugccc

SEQ ID NO: 1142019 - RNA, 18 nt, Homo sapiens
auggauguuuuagccauu

SEQ ID NO: 1142020 - RNA, 21 nt, Homo sapiens
auggauugauaauugcauuca

SEQ ID NO: 1142021 - RNA, 23 nt, Homo sapiens
auggcaaaaccccaucuuuacua

SEQ ID NO: 1142022 - RNA, 17 nt, Homo sapiens
auggcacugcaggugag

SEQ ID NO: 1142023 - RNA, 20 nt, Homo sapiens
auggcauccagggcugccag

SEQ ID NO: 1142024 - RNA, 18 nt, Homo sapiens
auggcaugagaaauacaa

SEQ ID NO: 1142025 - RNA, 20 nt, Homo sapiens
auggcaugagauagcuggug

SEQ ID NO: 1142026 - RNA, 15 nt, Homo sapiens
auggccacaccuggg

SEQ ID NO: 1142027 - RNA, 14 nt, Homo sapiens
auggccacacugug

SEQ ID NO: 1142028 - RNA, 17 nt, Homo sapiens
auggccacacugugaca

SEQ ID NO: 1142029 - RNA, 19 nt, Homo sapiens
auggccccugccuucccag

SEQ ID NO: 1142030 - RNA, 20 nt, Homo sapiens
auggccucaagaucaaugaa

SEQ ID NO: 1142031 - RNA, 14 nt, Homo sapiens
auggcgacaaaagu

SEQ ID NO: 1142032 - RNA, 15 nt, Homo sapiens
auggcuaaauacaau

SEQ ID NO: 1142033 - RNA, 18 nt, Homo sapiens
auggcucccaaauuccau

SEQ ID NO: 1142034 - RNA, 21 nt, Homo sapiens
auggcuccugcagcacuuuuu

SEQ ID NO: 1142035 - RNA, 20 nt, Homo sapiens
auggcucuaacaaugacauu

SEQ ID NO: 1142036 - RNA, 21 nt, Homo sapiens
auggcuuauugugugaaggua

SEQ ID NO: 1142037 - RNA, 13 nt, Homo sapiens
augggaacacugg

SEQ ID NO: 1142038 - RNA, 21 nt, Homo sapiens
augggagccuuuaccuuuuau

SEQ ID NO: 1142039 - RNA, 13 nt, Homo sapiens
augggcucugcau

SEQ ID NO: 1142040 - RNA, 16 nt, Homo sapiens
auggggaaaaaacugu

SEQ ID NO: 1142041 - RNA, 21 nt, Homo sapiens
auggggaaaagaaaaaccacg

SEQ ID NO: 1142042 - RNA, 18 nt, Homo sapiens
auggguccauuuugcccu

SEQ ID NO: 1142043 - RNA, 12 nt, Homo sapiens
auggguggacca

SEQ ID NO: 1142044 - RNA, 14 nt, Homo sapiens
auggguuaaaucaa

SEQ ID NO: 1142045 - RNA, 16 nt, Homo sapiens
auggguuagugcuaug

SEQ ID NO: 1142046 - RNA, 20 nt, Homo sapiens
augguaguuuaaguuuccuu

SEQ ID NO: 1142047 - RNA, 18 nt, Homo sapiens
auggucagaaugggugca

SEQ ID NO: 1142048 - RNA, 13 nt, Homo sapiens
auggucauaucca

SEQ ID NO: 1142049 - RNA, 19 nt, Homo sapiens
auggucauauccaaucuca

SEQ ID NO: 1142050 - RNA, 16 nt, Homo sapiens
auggucauuugggaaa

SEQ ID NO: 1142051 - RNA, 19 nt, Homo sapiens
auggugaaaccccgucucu

SEQ ID NO: 1142052 - RNA, 22 nt, Homo sapiens
auggugccccaggaccagcuca

SEQ ID NO: 1142053 - RNA, 20 nt, Homo sapiens
augguggcucacgccuguaa

SEQ ID NO: 1142054 - RNA, 16 nt, Homo sapiens
augguggcucaugccu

SEQ ID NO: 1142055 - RNA, 13 nt, Homo sapiens
augguggggccaa

SEQ ID NO: 1142056 - RNA, 22 nt, Homo sapiens
augguguagcccucccacuuug

SEQ ID NO: 1142057 - RNA, 18 nt, Homo sapiens
augguuagaaccagcaga

SEQ ID NO: 1142058 - RNA, 18 nt, Homo sapiens
augguuuagauaaaggaa

SEQ ID NO: 1142059 - RNA, 20 nt, Homo sapiens
auguaaaaacuuucacugaa

SEQ ID NO: 1142060 - RNA, 17 nt, Homo sapiens
auguaaacagugccugc

SEQ ID NO: 1142061 - RNA, 14 nt, Homo sapiens
auguaaacugugca

SEQ ID NO: 1142062 - RNA, 15 nt, Homo sapiens
auguaaacugugcac

SEQ ID NO: 1142063 - RNA, 14 nt, Homo sapiens
auguaacagaaagg

SEQ ID NO: 1142064 - RNA, 13 nt, Homo sapiens
auguaacugcauu

SEQ ID NO: 1142065 - RNA, 23 nt, Homo sapiens
auguaauuucugcacaggucucu

SEQ ID NO: 1142066 - RNA, 17 nt, Homo sapiens
auguacaagguauguac

SEQ ID NO: 1142067 - RNA, 15 nt, Homo sapiens
auguacagacauauu

SEQ ID NO: 1142068 - RNA, 16 nt, Homo sapiens
auguacagacauauuu

SEQ ID NO: 1142069 - RNA, 17 nt, Homo sapiens
auguacucuugaacuuc

SEQ ID NO: 1142070 - RNA, 12 nt, Homo sapiens
auguacuugaua

SEQ ID NO: 1142071 - RNA, 16 nt, Homo sapiens
auguagaaacauuuag

SEQ ID NO: 1142072 - RNA, 22 nt, Homo sapiens
auguagaagcaugaagucuuaa

SEQ ID NO: 1142073 - RNA, 12 nt, Homo sapiens
auguagacugaa

SEQ ID NO: 1142074 - RNA, 18 nt, Homo sapiens
auguagacugaaaagcca

SEQ ID NO: 1142075 - RNA, 16 nt, Homo sapiens
auguagcagacaacac

SEQ ID NO: 1142076 - RNA, 15 nt, Homo sapiens
auguagcccauccuu

SEQ ID NO: 1142077 - RNA, 18 nt, Homo sapiens
auguaggcaucaugcaug

SEQ ID NO: 1142078 - RNA, 13 nt, Homo sapiens
auguaguauacac

SEQ ID NO: 1142079 - RNA, 14 nt, Homo sapiens
auguaguauacacu

SEQ ID NO: 1142080 - RNA, 22 nt, Homo sapiens
auguaugaauacagcagcaaga

SEQ ID NO: 1142081 - RNA, 12 nt, Homo sapiens
auguaugcagcu

SEQ ID NO: 1142082 - RNA, 14 nt, Homo sapiens
auguauucuguucu

SEQ ID NO: 1142083 - RNA, 21 nt, Homo sapiens
auguauuuauauuuugugcua

SEQ ID NO: 1142084 - RNA, 20 nt, Homo sapiens
augucaacagagcaaggaga

SEQ ID NO: 1142085 - RNA, 23 nt, Homo sapiens
augucacgaauauggacauauca

SEQ ID NO: 1142086 - RNA, 19 nt, Homo sapiens
augucaguuggcccuuuaa

SEQ ID NO: 1142087 - RNA, 18 nt, Homo sapiens
augucauauuggcaguug

SEQ ID NO: 1142088 - RNA, 18 nt, Homo sapiens
augucauguggcuaccug

SEQ ID NO: 1142089 - RNA, 13 nt, Homo sapiens
auguccuggacac

SEQ ID NO: 1142090 - RNA, 13 nt, Homo sapiens
augucuaaccuga

SEQ ID NO: 1142091 - RNA, 14 nt, Homo sapiens
augucuccacuuca

SEQ ID NO: 1142092 - RNA, 18 nt, Homo sapiens
augucucggucacaucag

SEQ ID NO: 1142093 - RNA, 21 nt, Homo sapiens
augucucuuuggcgaccuccu

SEQ ID NO: 1142094 - RNA, 19 nt, Homo sapiens
augucugagagaccaucuc

SEQ ID NO: 1142095 - RNA, 22 nt, Homo sapiens
augucuuuuacccggcacauuc

SEQ ID NO: 1142096 - RNA, 22 nt, Homo sapiens
augucuuuuuuuuaaugugcug

SEQ ID NO: 1142097 - RNA, 18 nt, Homo sapiens
augugaaaggaacauuuu

SEQ ID NO: 1142098 - RNA, 14 nt, Homo sapiens
augugaagcccagc

SEQ ID NO: 1142099 - RNA, 21 nt, Homo sapiens
augugaagucaccaguggccu

SEQ ID NO: 1142100 - RNA, 16 nt, Homo sapiens
augugaauauggacag

SEQ ID NO: 1142101 - RNA, 20 nt, Homo sapiens
augugaauuauuuccugcuu

SEQ ID NO: 1142102 - RNA, 17 nt, Homo sapiens
augugacaccccggggg

SEQ ID NO: 1142103 - RNA, 19 nt, Homo sapiens
augugacauuauaugcacu

SEQ ID NO: 1142104 - RNA, 13 nt, Homo sapiens
auccaaugguguu

SEQ ID NO: 1142105 - RNA, 15 nt, Homo sapiens
auccacaaucugaca

SEQ ID NO: 1142106 - RNA, 18 nt, Homo sapiens
auccaccaagaacauaag

SEQ ID NO: 1142107 - RNA, 24 nt, Homo sapiens
auccaccacugcuuaagugccuau

SEQ ID NO: 1142108 - RNA, 15 nt, Homo sapiens
auccacuucuuucag

SEQ ID NO: 1142109 - RNA, 17 nt, Homo sapiens
auccagaagagaauuag

SEQ ID NO: 1142110 - RNA, 15 nt, Homo sapiens
auccagacagucgcu

SEQ ID NO: 1142111 - RNA, 18 nt, Homo sapiens
auccaggacugugccagc

SEQ ID NO: 1142112 - RNA, 16 nt, Homo sapiens
auccaggcagauccag

SEQ ID NO: 1142113 - RNA, 16 nt, Homo sapiens
auccaggcuuaccaaa

SEQ ID NO: 1142114 - RNA, 19 nt, Homo sapiens
auccagguaauccaagaua

SEQ ID NO: 1142115 - RNA, 17 nt, Homo sapiens
auccagguacgcacaga

SEQ ID NO: 1142116 - RNA, 18 nt, Homo sapiens
auccaguuucccaugcac

SEQ ID NO: 1142117 - RNA, 20 nt, Homo sapiens
auccauaaagaagcaauaaa

SEQ ID NO: 1142118 - RNA, 17 nt, Homo sapiens
auccauccugcucagga

SEQ ID NO: 1142119 - RNA, 15 nt, Homo sapiens
auccauugaacuaaa

SEQ ID NO: 1142120 - RNA, 23 nt, Homo sapiens
auccauuuccaaaccuccacugc

SEQ ID NO: 1142121 - RNA, 15 nt, Homo sapiens
aucccaaacugugau

SEQ ID NO: 1142122 - RNA, 18 nt, Homo sapiens
aucccaaagcaaggagau

SEQ ID NO: 1142123 - RNA, 15 nt, Homo sapiens
aucccacuaaugcaa

SEQ ID NO: 1142124 - RNA, 16 nt, Homo sapiens
aucccacuaaugcaaa

SEQ ID NO: 1142125 - RNA, 16 nt, Homo sapiens
aucccagacacauuca

SEQ ID NO: 1142126 - RNA, 15 nt, Homo sapiens
aucccagcacuuugg

SEQ ID NO: 1142127 - RNA, 14 nt, Homo sapiens
aucccagcuacuca

SEQ ID NO: 1142128 - RNA, 23 nt, Homo sapiens
aucccaugugcccauaagcacag

SEQ ID NO: 1142129 - RNA, 18 nt, Homo sapiens
auccccaagugugaacaa

SEQ ID NO: 1142130 - RNA, 23 nt, Homo sapiens
auccccccgccaaaagcugcuca

SEQ ID NO: 1142131 - RNA, 20 nt, Homo sapiens
auccccgcagugugcacuaa

SEQ ID NO: 1142132 - RNA, 22 nt, Homo sapiens
aucccggcccauguugagccau

SEQ ID NO: 1142133 - RNA, 14 nt, Homo sapiens
aucccucuguucac

SEQ ID NO: 1142134 - RNA, 15 nt, Homo sapiens
auccgccuaccucag

SEQ ID NO: 1142135 - RNA, 17 nt, Homo sapiens
auccguaguucccugaa

SEQ ID NO: 1142136 - RNA, 21 nt, Homo sapiens
auccgucuaguuaacauuuca

SEQ ID NO: 1142137 - RNA, 14 nt, Homo sapiens
auccuaaucaucca

SEQ ID NO: 1142138 - RNA, 23 nt, Homo sapiens
auccuacccccugugccuuguca

SEQ ID NO: 1142139 - RNA, 19 nt, Homo sapiens
auccuagauuauaucaaag

SEQ ID NO: 1142140 - RNA, 17 nt, Homo sapiens
auccuagucucuaucau

SEQ ID NO: 1142141 - RNA, 22 nt, Homo sapiens
auccuagucucuaucauuaaag

SEQ ID NO: 1142142 - RNA, 18 nt, Homo sapiens
auccucacgccuuggccu

SEQ ID NO: 1142143 - RNA, 15 nt, Homo sapiens
auccuccaguaccuu

SEQ ID NO: 1142144 - RNA, 16 nt, Homo sapiens
auccucccaaucucaa

SEQ ID NO: 1142145 - RNA, 22 nt, Homo sapiens
auccucccaaucucaauacagc

SEQ ID NO: 1142146 - RNA, 14 nt, Homo sapiens
auccuccuaccuca

SEQ ID NO: 1142147 - RNA, 14 nt, Homo sapiens
auccuccucuccau

SEQ ID NO: 1142148 - RNA, 13 nt, Homo sapiens
auccugcaguggg

SEQ ID NO: 1142149 - RNA, 21 nt, Homo sapiens
auccuggcuggagaaugugga

SEQ ID NO: 1142150 - RNA, 22 nt, Homo sapiens
auccuggguggucugcaggcag

SEQ ID NO: 1142151 - RNA, 17 nt, Homo sapiens
auccugucucuaaaaag

SEQ ID NO: 1142152 - RNA, 15 nt, Homo sapiens
auccugugccuccau

SEQ ID NO: 1142153 - RNA, 11 nt, Homo sapiens
auccugugucc

SEQ ID NO: 1142154 - RNA, 13 nt, Homo sapiens
auccuucuacuug

SEQ ID NO: 1142155 - RNA, 18 nt, Homo sapiens
auccuucuggcuguagau

SEQ ID NO: 1142156 - RNA, 19 nt, Homo sapiens
auccuucuggcuguagaua

SEQ ID NO: 1142157 - RNA, 14 nt, Homo sapiens
auccuugaugaauc

SEQ ID NO: 1142158 - RNA, 19 nt, Homo sapiens
auccuuuagugcacccagu

SEQ ID NO: 1142159 - RNA, 11 nt, Homo sapiens
aucgacaagaa

SEQ ID NO: 1142160 - RNA, 16 nt, Homo sapiens
aucgaccacaccagcc

SEQ ID NO: 1142161 - RNA, 19 nt, Homo sapiens
aucgaggcucuugcucaag

SEQ ID NO: 1142162 - RNA, 19 nt, Homo sapiens
aucgcaccacugcacucca

SEQ ID NO: 1142163 - RNA, 14 nt, Homo sapiens
aucgcaguguucaa

SEQ ID NO: 1142164 - RNA, 15 nt, Homo sapiens
aucggggaagccaga

SEQ ID NO: 1142165 - RNA, 18 nt, Homo sapiens
aucgucauuugcugugaa

SEQ ID NO: 1142166 - RNA, 18 nt, Homo sapiens
aucguccucccaggccag

SEQ ID NO: 1142167 - RNA, 19 nt, Homo sapiens
aucgugccacugcacucca

SEQ ID NO: 1142168 - RNA, 15 nt, Homo sapiens
aucguucaacuccac

SEQ ID NO: 1142169 - RNA, 17 nt, Homo sapiens
aucguucucugccucac

SEQ ID NO: 1142170 - RNA, 11 nt, Homo sapiens
aucuaccagca

SEQ ID NO: 1142171 - RNA, 16 nt, Homo sapiens
aucuacuaauuccaca

SEQ ID NO: 1142172 - RNA, 13 nt, Homo sapiens
aucuagcaauuuc

SEQ ID NO: 1142173 - RNA, 18 nt, Homo sapiens
aucuagcauguaaggccu

SEQ ID NO: 1142174 - RNA, 16 nt, Homo sapiens
aucuaugauuccaggu

SEQ ID NO: 1142175 - RNA, 16 nt, Homo sapiens
aucuaugccuaaaaag

SEQ ID NO: 1142176 - RNA, 15 nt, Homo sapiens
aucuauuauuacaca

SEQ ID NO: 1142177 - RNA, 14 nt, Homo sapiens
aucucaaaacugua

SEQ ID NO: 1142178 - RNA, 19 nt, Homo sapiens
aucucaaaacuguacuguc

SEQ ID NO: 1142179 - RNA, 15 nt, Homo sapiens
aucucaaacuacugg

SEQ ID NO: 1142180 - RNA, 23 nt, Homo sapiens
aucucaauaucugggucaaucca

SEQ ID NO: 1142181 - RNA, 14 nt, Homo sapiens
aucucaauguacau

SEQ ID NO: 1142182 - RNA, 18 nt, Homo sapiens
aucucagaucacugcaac

SEQ ID NO: 1142183 - RNA, 20 nt, Homo sapiens
aucucagccauucuaacuca

SEQ ID NO: 1142184 - RNA, 22 nt, Homo sapiens
aucucaugccccuggcugggac

SEQ ID NO: 1142185 - RNA, 22 nt, Homo sapiens
aucucauuggacccuuccaugg

SEQ ID NO: 1142186 - RNA, 18 nt, Homo sapiens
aucuccaagaccagagau

SEQ ID NO: 1142187 - RNA, 15 nt, Homo sapiens
aucuccauacuuugg

SEQ ID NO: 1142188 - RNA, 13 nt, Homo sapiens
aucuccgccucca

SEQ ID NO: 1142189 - RNA, 17 nt, Homo sapiens
aucuccucagacaguaa

SEQ ID NO: 1142190 - RNA, 17 nt, Homo sapiens
aucucggcucacugcaa

SEQ ID NO: 1142191 - RNA, 14 nt, Homo sapiens
aucucuauguauau

SEQ ID NO: 1142192 - RNA, 20 nt, Homo sapiens
aucucugccauaucagugaa

SEQ ID NO: 1142193 - RNA, 15 nt, Homo sapiens
aucucugccuuugag

SEQ ID NO: 1142194 - RNA, 16 nt, Homo sapiens
aucucugguuuugcuu

SEQ ID NO: 1142195 - RNA, 21 nt, Homo sapiens
aucucuuccuccgaggccagu

SEQ ID NO: 1142196 - RNA, 17 nt, Homo sapiens
aucucuugcuguuaaau

SEQ ID NO: 1142197 - RNA, 21 nt, Homo sapiens
aucucuuucucuuuaauggaa

SEQ ID NO: 1142198 - RNA, 15 nt, Homo sapiens
aucucuuugauguca

SEQ ID NO: 1142199 - RNA, 16 nt, Homo sapiens
aucugaaaacuuggcu

SEQ ID NO: 1142200 - RNA, 15 nt, Homo sapiens
aucugaaacuuccca

SEQ ID NO: 1142201 - RNA, 18 nt, Homo sapiens
aucugaaugaaaauaacu

SEQ ID NO: 1142202 - RNA, 14 nt, Homo sapiens
aucugagaaacucu

SEQ ID NO: 1142203 - RNA, 23 nt, Homo sapiens
aucugagcaaaaugugaacuuca

SEQ ID NO: 1142204 - RNA, 18 nt, Homo sapiens
aucugaguugagaccuuu

SEQ ID NO: 1142205 - RNA, 13 nt, Homo sapiens
aucugauguuaac

SEQ ID NO: 1142206 - RNA, 18 nt, Homo sapiens
aucugauguuaaccaaug

SEQ ID NO: 1142207 - RNA, 20 nt, Homo sapiens
aucugcaauguuuuugugua

SEQ ID NO: 1142208 - RNA, 14 nt, Homo sapiens
aucugcaauucaaa

SEQ ID NO: 1142209 - RNA, 17 nt, Homo sapiens
aucugcaugucuacuca

SEQ ID NO: 1142210 - RNA, 15 nt, Homo sapiens
aucugcauugcccag

SEQ ID NO: 1142211 - RNA, 23 nt, Homo sapiens
aucugcuuuugguuauaaugugu

SEQ ID NO: 1142212 - RNA, 18 nt, Homo sapiens
aucuggaccugguacaaa

SEQ ID NO: 1142213 - RNA, 13 nt, Homo sapiens
aucugggugcaug

SEQ ID NO: 1142214 - RNA, 22 nt, Homo sapiens
aucuggucaaccuccuggacau

SEQ ID NO: 1142215 - RNA, 17 nt, Homo sapiens
aucugguccaacaugaa

SEQ ID NO: 1142216 - RNA, 13 nt, Homo sapiens
aucuguaaggaac

SEQ ID NO: 1142217 - RNA, 18 nt, Homo sapiens
aucuguaaggaacuggaa

SEQ ID NO: 1142218 - RNA, 17 nt, Homo sapiens
aucuguacaaaggggaa

SEQ ID NO: 1142219 - RNA, 22 nt, Homo sapiens
aaaaaaaccaaaacugugcaga

SEQ ID NO: 1142220 - RNA, 12 nt, Homo sapiens
aaaaaaagccaa

SEQ ID NO: 1142221 - RNA, 12 nt, Homo sapiens
aaaaaacauaua

SEQ ID NO: 1142222 - RNA, 22 nt, Homo sapiens
aaauggcaugacauauguagau

SEQ ID NO: 1142223 - RNA, 14 nt, Homo sapiens
aaauggcuguggag

SEQ ID NO: 1142224 - RNA, 18 nt, Homo sapiens
aaaugggaaaaccagacu

SEQ ID NO: 1142225 - RNA, 17 nt, Homo sapiens
aaaugggagacagccuc

SEQ ID NO: 1142226 - RNA, 19 nt, Homo sapiens
aaaugggagacagccucuu

SEQ ID NO: 1142227 - RNA, 19 nt, Homo sapiens
aaauggggauauguuaacu

SEQ ID NO: 1142228 - RNA, 18 nt, Homo sapiens
aaauggugauuucuugcu

SEQ ID NO: 1142229 - RNA, 14 nt, Homo sapiens
aaauguaaagccau

SEQ ID NO: 1142230 - RNA, 13 nt, Homo sapiens
aaauguaacuuga

SEQ ID NO: 1142231 - RNA, 17 nt, Homo sapiens
aaauguacagacauauu

SEQ ID NO: 1142232 - RNA, 21 nt, Homo sapiens
aaauguacucuugaacuucuu

SEQ ID NO: 1142233 - RNA, 22 nt, Homo sapiens
aaauguauuggcacagugcuua

SEQ ID NO: 1142234 - RNA, 20 nt, Homo sapiens
aaaugucugggaagcccucc

SEQ ID NO: 1142235 - RNA, 19 nt, Homo sapiens
aaaugugcagcucccauuu

SEQ ID NO: 1142236 - RNA, 12 nt, Homo sapiens
aaauguguaaua

SEQ ID NO: 1142237 - RNA, 12 nt, Homo sapiens
aaaugugucaaa

SEQ ID NO: 1142238 - RNA, 17 nt, Homo sapiens
aaaugugucugcaacau

SEQ ID NO: 1142239 - RNA, 18 nt, Homo sapiens
aaauguugagaaucccaa

SEQ ID NO: 1142240 - RNA, 12 nt, Homo sapiens
aaauguuuauaa

SEQ ID NO: 1142241 - RNA, 16 nt, Homo sapiens
aaauguuuauagcauu

SEQ ID NO: 1142242 - RNA, 19 nt, Homo sapiens
aaauguuugcugagugagu

SEQ ID NO: 1142243 - RNA, 14 nt, Homo sapiens
aaauuaaaugccac

SEQ ID NO: 1142244 - RNA, 13 nt, Homo sapiens
aaauuaacucacu

SEQ ID NO: 1142245 - RNA, 18 nt, Homo sapiens
aaauuaagacuugugcau

SEQ ID NO: 1142246 - RNA, 15 nt, Homo sapiens
aaauuaauagcuuuu

SEQ ID NO: 1142247 - RNA, 15 nt, Homo sapiens
aaauuaauugugccu

SEQ ID NO: 1142248 - RNA, 17 nt, Homo sapiens
aaauuagaaucugagua

SEQ ID NO: 1142249 - RNA, 21 nt, Homo sapiens
aaauuagcgaaaucaacccuu

SEQ ID NO: 1142250 - RNA, 19 nt, Homo sapiens
aaauuagcugggcauggug

SEQ ID NO: 1142251 - RNA, 16 nt, Homo sapiens
aaauuauaaagauaaa

SEQ ID NO: 1142252 - RNA, 19 nt, Homo sapiens
aaauuauauuugugcuaua

SEQ ID NO: 1142253 - RNA, 14 nt, Homo sapiens
aaauuaugaauauu

SEQ ID NO: 1142254 - RNA, 16 nt, Homo sapiens
aaauucacaaacuuuu

SEQ ID NO: 1142255 - RNA, 17 nt, Homo sapiens
aaauucacaaguugugu

SEQ ID NO: 1142256 - RNA, 18 nt, Homo sapiens
aaauucagucuuuucucu

SEQ ID NO: 1142257 - RNA, 17 nt, Homo sapiens
aaauucccaugagucag

SEQ ID NO: 1142258 - RNA, 21 nt, Homo sapiens
aaauucuauaggaacauauga

SEQ ID NO: 1142259 - RNA, 18 nt, Homo sapiens
aaauucucuccuaaugau

SEQ ID NO: 1142260 - RNA, 11 nt, Homo sapiens
aaauugaacaa

SEQ ID NO: 1142261 - RNA, 15 nt, Homo sapiens
aaauugacagaucaa

SEQ ID NO: 1142262 - RNA, 16 nt, Homo sapiens
aaauugacgacuucac

SEQ ID NO: 1142263 - RNA, 15 nt, Homo sapiens
aaauuggauacugcu

SEQ ID NO: 1142264 - RNA, 14 nt, Homo sapiens
aaauuuauauuuca

SEQ ID NO: 1142265 - RNA, 20 nt, Homo sapiens
aaauuuauggccguaucaaa

SEQ ID NO: 1142266 - RNA, 22 nt, Homo sapiens
aaauuuauuugaaaaugcauca

SEQ ID NO: 1142267 - RNA, 17 nt, Homo sapiens
aaauuuauuuuacacau

SEQ ID NO: 1142268 - RNA, 21 nt, Homo sapiens
aaauuucacuuaauaaugugu

SEQ ID NO: 1142269 - RNA, 15 nt, Homo sapiens
aaauuucagcagcug

SEQ ID NO: 1142270 - RNA, 11 nt, Homo sapiens
aaauuugcaac

SEQ ID NO: 1142271 - RNA, 21 nt, Homo sapiens
aaauuuggauuuacgacugaa

SEQ ID NO: 1142272 - RNA, 12 nt, Homo sapiens
aaauuuggugcu

SEQ ID NO: 1142273 - RNA, 16 nt, Homo sapiens
aaauuuggugcuuaua

SEQ ID NO: 1142274 - RNA, 23 nt, Homo sapiens
aaauuuugggggaaaaaauccaa

SEQ ID NO: 1142275 - RNA, 21 nt, Homo sapiens
aaauuuuggucauagcauuca

SEQ ID NO: 1142276 - RNA, 16 nt, Homo sapiens
aaauuuuuuuggucuu

SEQ ID NO: 1142277 - RNA, 20 nt, Homo sapiens
aacaaaaauuaaaauccuca

SEQ ID NO: 1142278 - RNA, 13 nt, Homo sapiens
aacaaaaggcuuu

SEQ ID NO: 1142279 - RNA, 12 nt, Homo sapiens
aacaaaauggac

SEQ ID NO: 1142280 - RNA, 13 nt, Homo sapiens
aacaaaauggacu

SEQ ID NO: 1142281 - RNA, 19 nt, Homo sapiens
aacaaaccagaaucccucu

SEQ ID NO: 1142282 - RNA, 15 nt, Homo sapiens
aacaaacuacugugu

SEQ ID NO: 1142283 - RNA, 13 nt, Homo sapiens
aacaaagaagaca

SEQ ID NO: 1142284 - RNA, 17 nt, Homo sapiens
aacaaagacuucuguca

SEQ ID NO: 1142285 - RNA, 16 nt, Homo sapiens
aacaaauguauuucaa

SEQ ID NO: 1142286 - RNA, 15 nt, Homo sapiens
aacaaaugugcugcu

SEQ ID NO: 1142287 - RNA, 19 nt, Homo sapiens
aacaaccuuuucucuggac

SEQ ID NO: 1142288 - RNA, 20 nt, Homo sapiens
aacaacguugacaaguuuug

SEQ ID NO: 1142289 - RNA, 19 nt, Homo sapiens
aacaacuaaauaacuguau

SEQ ID NO: 1142290 - RNA, 14 nt, Homo sapiens
aacaagaaugcauu

SEQ ID NO: 1142291 - RNA, 13 nt, Homo sapiens
aacaagacaugaa

SEQ ID NO: 1142292 - RNA, 14 nt, Homo sapiens
aacaagauggagau

SEQ ID NO: 1142293 - RNA, 13 nt, Homo sapiens
aacaagccuaaaa

SEQ ID NO: 1142294 - RNA, 17 nt, Homo sapiens
aacaauaaagacugaga

SEQ ID NO: 1142295 - RNA, 14 nt, Homo sapiens
aacaaucacuguuc

SEQ ID NO: 1142296 - RNA, 11 nt, Homo sapiens
aacaauccaaa

SEQ ID NO: 1142297 - RNA, 15 nt, Homo sapiens
aacaauccaaaaaug

SEQ ID NO: 1142298 - RNA, 16 nt, Homo sapiens
aacaaugaaauauugc

SEQ ID NO: 1142299 - RNA, 17 nt, Homo sapiens
aacaaugauuaaucagc

SEQ ID NO: 1142300 - RNA, 20 nt, Homo sapiens
aacaaugcugauuuggugac

SEQ ID NO: 1142301 - RNA, 11 nt, Homo sapiens
aacaauuccac

SEQ ID NO: 1142302 - RNA, 21 nt, Homo sapiens
aacaauucuuauugacucaua

SEQ ID NO: 1142303 - RNA, 13 nt, Homo sapiens
aacaauugcuuua

SEQ ID NO: 1142304 - RNA, 13 nt, Homo sapiens
aacacaaacacau

SEQ ID NO: 1142305 - RNA, 18 nt, Homo sapiens
aacacaaccuacucugca

SEQ ID NO: 1142306 - RNA, 20 nt, Homo sapiens
aacacaaccuacucugcaaa

SEQ ID NO: 1142307 - RNA, 16 nt, Homo sapiens
aacacauacaaaagaa

SEQ ID NO: 1142308 - RNA, 18 nt, Homo sapiens
aacacaucacucauuuua

SEQ ID NO: 1142309 - RNA, 16 nt, Homo sapiens
aacacauuuuguauaa

SEQ ID NO: 1142310 - RNA, 14 nt, Homo sapiens
aacaccaagcacag

SEQ ID NO: 1142311 - RNA, 15 nt, Homo sapiens
aacaccacgucacuu

SEQ ID NO: 1142312 - RNA, 20 nt, Homo sapiens
aacaccacuaauuguguaca

SEQ ID NO: 1142313 - RNA, 20 nt, Homo sapiens
aacaccaucgaucaugaugu

SEQ ID NO: 1142314 - RNA, 17 nt, Homo sapiens
aacaccugauguguaca

SEQ ID NO: 1142315 - RNA, 21 nt, Homo sapiens
aacaccugauuaacugaggca

SEQ ID NO: 1142316 - RNA, 21 nt, Homo sapiens
aacaccuuuccuuaugucucc

SEQ ID NO: 1142317 - RNA, 15 nt, Homo sapiens
aacacgccacagccu

SEQ ID NO: 1142318 - RNA, 15 nt, Homo sapiens
aacacugaagugcuu

SEQ ID NO: 1142319 - RNA, 14 nt, Homo sapiens
aacacugucccaag

SEQ ID NO: 1142320 - RNA, 14 nt, Homo sapiens
aacacuuaccccau

SEQ ID NO: 1142321 - RNA, 21 nt, Homo sapiens
aacacuuggugcugggaaccu

SEQ ID NO: 1142322 - RNA, 22 nt, Homo sapiens
aacagaaauguuuuuuggcauu

SEQ ID NO: 1142323 - RNA, 20 nt, Homo sapiens
aacagaacuucacagugaca

SEQ ID NO: 1142324 - RNA, 13 nt, Homo sapiens
aacagaagccuga

SEQ ID NO: 1142325 - RNA, 21 nt, Homo sapiens
aacagagaagggaaagcaguc

SEQ ID NO: 1142326 - RNA, 21 nt, Homo sapiens
aacagagcaagacuccaucuc

SEQ ID NO: 1142327 - RNA, 13 nt, Homo sapiens
aacagaucuggaa

SEQ ID NO: 1142328 - RNA, 16 nt, Homo sapiens
aacagauuguuugcaa

SEQ ID NO: 1142329 - RNA, 14 nt, Homo sapiens
aacagauuugagaa

SEQ ID NO: 1142330 - RNA, 13 nt, Homo sapiens
aacagcaaaucac

SEQ ID NO: 1142331 - RNA, 20 nt, Homo sapiens
aacagcccaaacuguauaca

SEQ ID NO: 1142332 - RNA, 14 nt, Homo sapiens
aacagccuuuuccc

SEQ ID NO: 1142333 - RNA, 20 nt, Homo sapiens
aacagcgcuggguccacccc

SEQ ID NO: 1142334 - RNA, 19 nt, Homo sapiens
aacagcuguuccuguguuc

SEQ ID NO: 1142335 - RNA, 18 nt, Homo sapiens
aacaggcuugaaucaaag

SEQ ID NO: 1142336 - RNA, 9 nt, Homo sapiens
aacagggaa

SEQ ID NO: 1142337 - RNA, 10 nt, Homo sapiens
aacagggaag

SEQ ID NO: 1142338 - RNA, 20 nt, Homo sapiens
aacagggguucuuagucuca

SEQ ID NO: 1142339 - RNA, 13 nt, Homo sapiens
aacaggguauaug

SEQ ID NO: 1142340 - RNA, 15 nt, Homo sapiens
aacagggucacuugg

SEQ ID NO: 1142341 - RNA, 22 nt, Homo sapiens
aacaguaauuauuauuuaacuc

SEQ ID NO: 1142342 - RNA, 11 nt, Homo sapiens
aacaguagcau

SEQ ID NO: 1142343 - RNA, 22 nt, Homo sapiens
aacagugccuggcacacaguaa

SEQ ID NO: 1142344 - RNA, 21 nt, Homo sapiens
aacagugcuaaaaaugggacu

SEQ ID NO: 1142345 - RNA, 18 nt, Homo sapiens
aacauaaaacuucuuuag

SEQ ID NO: 1142346 - RNA, 18 nt, Homo sapiens
aacauaagauauuguaca

SEQ ID NO: 1142347 - RNA, 18 nt, Homo sapiens
aacauacaagagacauau

SEQ ID NO: 1142348 - RNA, 19 nt, Homo sapiens
aacauacaagagacauaua

SEQ ID NO: 1142349 - RNA, 22 nt, Homo sapiens
aacauacaagagacauauaaug

SEQ ID NO: 1142350 - RNA, 22 nt, Homo sapiens
aacauaccguuuauaaugccau

SEQ ID NO: 1142351 - RNA, 18 nt, Homo sapiens
aacauagaaaaaugaugu

SEQ ID NO: 1142352 - RNA, 23 nt, Homo sapiens
aacauaguauucaugacuaugga

SEQ ID NO: 1142353 - RNA, 22 nt, Homo sapiens
aacauauaacuauugaguuaca

SEQ ID NO: 1142354 - RNA, 13 nt, Homo sapiens
aacauauaugugu

SEQ ID NO: 1142355 - RNA, 11 nt, Homo sapiens
aaggagucaaa

SEQ ID NO: 1142356 - RNA, 20 nt, Homo sapiens
aaggauauuuucaacaauua

SEQ ID NO: 1142357 - RNA, 12 nt, Homo sapiens
aaggaugugauu

SEQ ID NO: 1142358 - RNA, 12 nt, Homo sapiens
aaggauguugcc

SEQ ID NO: 1142359 - RNA, 13 nt, Homo sapiens
aaggcaagccagc

SEQ ID NO: 1142360 - RNA, 23 nt, Homo sapiens
aaggcaccuauaaaacaggucaa

SEQ ID NO: 1142361 - RNA, 14 nt, Homo sapiens
aaggcagaggaauu

SEQ ID NO: 1142362 - RNA, 16 nt, Homo sapiens
aaggcaggaggccauu

SEQ ID NO: 1142363 - RNA, 14 nt, Homo sapiens
aaggcauguacaaa

SEQ ID NO: 1142364 - RNA, 22 nt, Homo sapiens
aaggcauuccacaggaucauca

SEQ ID NO: 1142365 - RNA, 16 nt, Homo sapiens
aaggccaauaguuuua

SEQ ID NO: 1142366 - RNA, 13 nt, Homo sapiens
aaggccacuguuu

SEQ ID NO: 1142367 - RNA, 20 nt, Homo sapiens
aaggccacuguuugucucac

SEQ ID NO: 1142368 - RNA, 21 nt, Homo sapiens
aaggccccucugcaacuggag

SEQ ID NO: 1142369 - RNA, 22 nt, Homo sapiens
aaggccgagaccccaucuucca

SEQ ID NO: 1142370 - RNA, 17 nt, Homo sapiens
aaggccucauccugggg

SEQ ID NO: 1142371 - RNA, 15 nt, Homo sapiens
aaggccuccugugac

SEQ ID NO: 1142372 - RNA, 16 nt, Homo sapiens
aaggccuggucuggga

SEQ ID NO: 1142373 - RNA, 22 nt, Homo sapiens
aaggccuuuggaaagacuugaa

SEQ ID NO: 1142374 - RNA, 19 nt, Homo sapiens
aaggcgggcggaucacuua

SEQ ID NO: 1142375 - RNA, 19 nt, Homo sapiens
aaggcucaagggacauguu

SEQ ID NO: 1142376 - RNA, 18 nt, Homo sapiens
aaggcucauuuacuugaa

SEQ ID NO: 1142377 - RNA, 19 nt, Homo sapiens
aaggcucauuuacuugaaa

SEQ ID NO: 1142378 - RNA, 22 nt, Homo sapiens
aaggcucccggaauuccgucac

SEQ ID NO: 1142379 - RNA, 12 nt, Homo sapiens
aaggcugagacc

SEQ ID NO: 1142380 - RNA, 21 nt, Homo sapiens
aaggcugagaccuacugggcu

SEQ ID NO: 1142381 - RNA, 14 nt, Homo sapiens
aaggcuuuccuacc

SEQ ID NO: 1142382 - RNA, 14 nt, Homo sapiens
aaggcuuugaguua

SEQ ID NO: 1142383 - RNA, 17 nt, Homo sapiens
aagggaaggcaaaggca

SEQ ID NO: 1142384 - RNA, 16 nt, Homo sapiens
aagggaauaugcauug

SEQ ID NO: 1142385 - RNA, 17 nt, Homo sapiens
aagggauggggugccag

SEQ ID NO: 1142386 - RNA, 17 nt, Homo sapiens
aagggcaucacuggguc

SEQ ID NO: 1142387 - RNA, 13 nt, Homo sapiens
aagggcauggguc

SEQ ID NO: 1142388 - RNA, 13 nt, Homo sapiens
aagggccaggugc

SEQ ID NO: 1142389 - RNA, 14 nt, Homo sapiens
aaggggaaggaaga

SEQ ID NO: 1142390 - RNA, 20 nt, Homo sapiens
aagggggcggggacugcugg

SEQ ID NO: 1142391 - RNA, 20 nt, Homo sapiens
aaggguaagcuagagagaaa

SEQ ID NO: 1142392 - RNA, 14 nt, Homo sapiens
aagggucacaauac

SEQ ID NO: 1142393 - RNA, 14 nt, Homo sapiens
aaggguugugagcc

SEQ ID NO: 1142394 - RNA, 14 nt, Homo sapiens
aagguaacuguaca

SEQ ID NO: 1142395 - RNA, 19 nt, Homo sapiens
aagguccacaggucuagac

SEQ ID NO: 1142396 - RNA, 16 nt, Homo sapiens
aaggucccuuguuucc

SEQ ID NO: 1142397 - RNA, 18 nt, Homo sapiens
aagguccucugucaguca

SEQ ID NO: 1142398 - RNA, 15 nt, Homo sapiens
aaggucucacacucc

SEQ ID NO: 1142399 - RNA, 14 nt, Homo sapiens
aaggugacaaaagg

SEQ ID NO: 1142400 - RNA, 21 nt, Homo sapiens
aaggugaggccugucugugac

SEQ ID NO: 1142401 - RNA, 12 nt, Homo sapiens
aaggugccacug

SEQ ID NO: 1142402 - RNA, 12 nt, Homo sapiens
aaggugcucaau

SEQ ID NO: 1142403 - RNA, 20 nt, Homo sapiens
aaggugggcggaucacuuga

SEQ ID NO: 1142404 - RNA, 17 nt, Homo sapiens
aaggugugcaaacuugu

SEQ ID NO: 1142405 - RNA, 20 nt, Homo sapiens
aagguguucaaacacaaccu

SEQ ID NO: 1142406 - RNA, 20 nt, Homo sapiens
aagguuaaaggaaaagcaca

SEQ ID NO: 1142407 - RNA, 14 nt, Homo sapiens
aagguuacuggaua

SEQ ID NO: 1142408 - RNA, 15 nt, Homo sapiens
aagguuggcagugau

SEQ ID NO: 1142409 - RNA, 16 nt, Homo sapiens
aaguaaccauuugcac

SEQ ID NO: 1142410 - RNA, 16 nt, Homo sapiens
aaguaagagacucagc

SEQ ID NO: 1142411 - RNA, 20 nt, Homo sapiens
aaguaagcagaguucuuugc

SEQ ID NO: 1142412 - RNA, 18 nt, Homo sapiens
aaguaauccaccugccuc

SEQ ID NO: 1142413 - RNA, 11 nt, Homo sapiens
aaguacaucuc

SEQ ID NO: 1142414 - RNA, 14 nt, Homo sapiens
aaguaccucagcau

SEQ ID NO: 1142415 - RNA, 22 nt, Homo sapiens
aaguaccuuauucuacaucauu

SEQ ID NO: 1142416 - RNA, 15 nt, Homo sapiens
aaguacuacauaccu

SEQ ID NO: 1142417 - RNA, 17 nt, Homo sapiens
aaguagaaauggugaga

SEQ ID NO: 1142418 - RNA, 22 nt, Homo sapiens
aaguagaucugcuuucuguuca

SEQ ID NO: 1142419 - RNA, 12 nt, Homo sapiens
aaguagccacag

SEQ ID NO: 1142420 - RNA, 14 nt, Homo sapiens
aaguagcugcuacc

SEQ ID NO: 1142421 - RNA, 14 nt, Homo sapiens
aaguagcugggacu

SEQ ID NO: 1142422 - RNA, 21 nt, Homo sapiens
aaguagcugucagaugucaca

SEQ ID NO: 1142423 - RNA, 13 nt, Homo sapiens
aaguauccagacc

SEQ ID NO: 1142424 - RNA, 18 nt, Homo sapiens
aaguauccagucauugua

SEQ ID NO: 1142425 - RNA, 17 nt, Homo sapiens
aaguauuuuugauuaac

SEQ ID NO: 1142426 - RNA, 16 nt, Homo sapiens
aagucaacccucuuac

SEQ ID NO: 1142427 - RNA, 19 nt, Homo sapiens
aagucacaggacuauggac

SEQ ID NO: 1142428 - RNA, 15 nt, Homo sapiens
aagucacccuuccac

SEQ ID NO: 1142429 - RNA, 13 nt, Homo sapiens
aagucagcaacag

SEQ ID NO: 1142430 - RNA, 22 nt, Homo sapiens
aagucaggaguccaagaccaga

SEQ ID NO: 1142431 - RNA, 16 nt, Homo sapiens
aagucaggccaggugg

SEQ ID NO: 1142432 - RNA, 16 nt, Homo sapiens
aagucagguccaauuu

SEQ ID NO: 1142433 - RNA, 13 nt, Homo sapiens
aagucaguaucau

SEQ ID NO: 1142434 - RNA, 18 nt, Homo sapiens
aagucaguaucauauuau

SEQ ID NO: 1142435 - RNA, 18 nt, Homo sapiens
aagucauaccuacauuca

SEQ ID NO: 1142436 - RNA, 22 nt, Homo sapiens
aagucauccccuugggcucuca

SEQ ID NO: 1142437 - RNA, 22 nt, Homo sapiens
aagucaucucauuccacuguug

SEQ ID NO: 1142438 - RNA, 23 nt, Homo sapiens
aaguccagaaacuguucccaccu

SEQ ID NO: 1142439 - RNA, 18 nt, Homo sapiens
aagucccccuucaaucuc

SEQ ID NO: 1142440 - RNA, 17 nt, Homo sapiens
aaguccuucaccucacu

SEQ ID NO: 1142441 - RNA, 13 nt, Homo sapiens
aaguccuuuaugu

SEQ ID NO: 1142442 - RNA, 18 nt, Homo sapiens
aagucgucacuaauacac

SEQ ID NO: 1142443 - RNA, 14 nt, Homo sapiens
aagucuaaaaccuu

SEQ ID NO: 1142444 - RNA, 13 nt, Homo sapiens
aagucuacuucac

SEQ ID NO: 1142445 - RNA, 17 nt, Homo sapiens
aagucuacuucacuaau

SEQ ID NO: 1142446 - RNA, 17 nt, Homo sapiens
aagucucaacugcucuu

SEQ ID NO: 1142447 - RNA, 18 nt, Homo sapiens
aagucucagaugaacaau

SEQ ID NO: 1142448 - RNA, 16 nt, Homo sapiens
aagucucucuucugaa

SEQ ID NO: 1142449 - RNA, 16 nt, Homo sapiens
aagucugcuacccuca

SEQ ID NO: 1142450 - RNA, 16 nt, Homo sapiens
aagucuguuuacugca

SEQ ID NO: 1142451 - RNA, 20 nt, Homo sapiens
aagucuuaaucauuugugac

SEQ ID NO: 1142452 - RNA, 23 nt, Homo sapiens
aagucuucucccguccauuccag

SEQ ID NO: 1142453 - RNA, 14 nt, Homo sapiens
aagucuugcauuga

SEQ ID NO: 1142454 - RNA, 22 nt, Homo sapiens
aagugacauugugucaguuuca

SEQ ID NO: 1142455 - RNA, 14 nt, Homo sapiens
aagugaucagcaau

SEQ ID NO: 1142456 - RNA, 23 nt, Homo sapiens
aagugauccucacgccuuggccu

SEQ ID NO: 1142457 - RNA, 19 nt, Homo sapiens
aagugaucugcccaccuca

SEQ ID NO: 1142458 - RNA, 16 nt, Homo sapiens
aagugcaaauuugaua

SEQ ID NO: 1142459 - RNA, 12 nt, Homo sapiens
aagugcaucuac

SEQ ID NO: 1142460 - RNA, 13 nt, Homo sapiens
aagugcuauuuca

SEQ ID NO: 1142461 - RNA, 23 nt, Homo sapiens
aagugcuauuucagcaacaacca

SEQ ID NO: 1142462 - RNA, 21 nt, Homo sapiens
aagugcucuucagcacugucu

SEQ ID NO: 1142463 - RNA, 17 nt, Homo sapiens
aaguggaagccacugga

SEQ ID NO: 1142464 - RNA, 14 nt, Homo sapiens
aaguggacucaggg

SEQ ID NO: 1142465 - RNA, 20 nt, Homo sapiens
aagugggacauucaaaaaac

SEQ ID NO: 1142466 - RNA, 22 nt, Homo sapiens
aaguggggaccccaccccucau

SEQ ID NO: 1142467 - RNA, 15 nt, Homo sapiens
aaguggucuuaagaa

SEQ ID NO: 1142468 - RNA, 15 nt, Homo sapiens
aagugguucagucua

SEQ ID NO: 1142469 - RNA, 13 nt, Homo sapiens
aagugguucucau

SEQ ID NO: 1142470 - RNA, 22 nt, Homo sapiens
aaguguaagaaacacacugagg

SEQ ID NO: 1142471 - RNA, 20 nt, Homo sapiens
aaguguaguaugcuguauga

SEQ ID NO: 1142472 - RNA, 21 nt, Homo sapiens
aagugucaccccucacuguga

SEQ ID NO: 1142473 - RNA, 22 nt, Homo sapiens
aagugucaccccucacugugac

SEQ ID NO: 1142474 - RNA, 19 nt, Homo sapiens
aagugucuugagacuuuau

SEQ ID NO: 1142475 - RNA, 16 nt, Homo sapiens
aagugugcagccauag

SEQ ID NO: 1142476 - RNA, 13 nt, Homo sapiens
aaguguguuuccu

SEQ ID NO: 1142477 - RNA, 21 nt, Homo sapiens
aaguguuaauacuaguuguga

SEQ ID NO: 1142478 - RNA, 16 nt, Homo sapiens
aaguguucuucagugu

SEQ ID NO: 1142479 - RNA, 17 nt, Homo sapiens
aaguuacauguuugcac

SEQ ID NO: 1142480 - RNA, 16 nt, Homo sapiens
aaguuauuuaugcuau

SEQ ID NO: 1142481 - RNA, 21 nt, Homo sapiens
aaguucacaucagaacagaca

SEQ ID NO: 1142482 - RNA, 16 nt, Homo sapiens
aaguucauucaugcca

SEQ ID NO: 1142483 - RNA, 22 nt, Homo sapiens
aaguuccagcauguugcaucuc

SEQ ID NO: 1142484 - RNA, 17 nt, Homo sapiens
aaguugcucugaaguca

SEQ ID NO: 1142485 - RNA, 14 nt, Homo sapiens
aaguuuccuuccag

SEQ ID NO: 1142486 - RNA, 22 nt, Homo sapiens
aaguuuuguuuguucacacucc

SEQ ID NO: 1142487 - RNA, 17 nt, Homo sapiens
aauaaaaaauauauauc

SEQ ID NO: 1142488 - RNA, 21 nt, Homo sapiens
acacacgccacccagccucuu

SEQ ID NO: 1142489 - RNA, 21 nt, Homo sapiens
acacagacauccucuaugcca

SEQ ID NO: 1142490 - RNA, 18 nt, Homo sapiens
acacaggccugcucucuu

SEQ ID NO: 1142491 - RNA, 16 nt, Homo sapiens
acacagucugcaagau

SEQ ID NO: 1142492 - RNA, 20 nt, Homo sapiens
acacagugccuguaaaucuc

SEQ ID NO: 1142493 - RNA, 23 nt, Homo sapiens
acacaguguuggagguuaaggca

SEQ ID NO: 1142494 - RNA, 19 nt, Homo sapiens
acacaguuguaggguuaca

SEQ ID NO: 1142495 - RNA, 13 nt, Homo sapiens
acacauaugcacc

SEQ ID NO: 1142496 - RNA, 22 nt, Homo sapiens
acacaugucaagggauuacuua

SEQ ID NO: 1142497 - RNA, 16 nt, Homo sapiens
acacauucacacuggg

SEQ ID NO: 1142498 - RNA, 22 nt, Homo sapiens
acacauuuggaaugcacacagc

SEQ ID NO: 1142499 - RNA, 21 nt, Homo sapiens
acacauuuuuauaaaaaugag

SEQ ID NO: 1142500 - RNA, 14 nt, Homo sapiens
acaccacacacaac

SEQ ID NO: 1142501 - RNA, 17 nt, Homo sapiens
acaccagcaaugaagga

SEQ ID NO: 1142502 - RNA, 18 nt, Homo sapiens
acaccagcagcacuggaa

SEQ ID NO: 1142503 - RNA, 17 nt, Homo sapiens
acaccagcccugcugcu

SEQ ID NO: 1142504 - RNA, 15 nt, Homo sapiens
acaccaguaccugaa

SEQ ID NO: 1142505 - RNA, 19 nt, Homo sapiens
acaccauucaggucuuucu

SEQ ID NO: 1142506 - RNA, 22 nt, Homo sapiens
acacccagugcgugaagaccaa

SEQ ID NO: 1142507 - RNA, 19 nt, Homo sapiens
acacccaucucaacagggu

SEQ ID NO: 1142508 - RNA, 19 nt, Homo sapiens
acacccuuuuaacauuuau

SEQ ID NO: 1142509 - RNA, 22 nt, Homo sapiens
acaccugggucuuuaugcauga

SEQ ID NO: 1142510 - RNA, 22 nt, Homo sapiens
acaccuggucuguuuucugugc

SEQ ID NO: 1142511 - RNA, 15 nt, Homo sapiens
acaccuguaguccca

SEQ ID NO: 1142512 - RNA, 18 nt, Homo sapiens
acaccuguagucccagcu

SEQ ID NO: 1142513 - RNA, 16 nt, Homo sapiens
acaccugugugcugua

SEQ ID NO: 1142514 - RNA, 20 nt, Homo sapiens
acacgcacugcacugccauu

SEQ ID NO: 1142515 - RNA, 21 nt, Homo sapiens
acacggaugacuuaacugcau

SEQ ID NO: 1142516 - RNA, 18 nt, Homo sapiens
acacguccugcaguuccu

SEQ ID NO: 1142517 - RNA, 14 nt, Homo sapiens
acacuaacuaugca

SEQ ID NO: 1142518 - RNA, 15 nt, Homo sapiens
acacuacaaguuuau

SEQ ID NO: 1142519 - RNA, 22 nt, Homo sapiens
acacuagacaagccagaacuug

SEQ ID NO: 1142520 - RNA, 22 nt, Homo sapiens
acacuaugcacugcuguaacug

SEQ ID NO: 1142521 - RNA, 19 nt, Homo sapiens
acacucauccccucacuug

SEQ ID NO: 1142522 - RNA, 13 nt, Homo sapiens
acacugaguuucu

SEQ ID NO: 1142523 - RNA, 17 nt, Homo sapiens
acacugaucaauuucaa

SEQ ID NO: 1142524 - RNA, 13 nt, Homo sapiens
acacugaugcaag

SEQ ID NO: 1142525 - RNA, 15 nt, Homo sapiens
acacuggguucugcu

SEQ ID NO: 1142526 - RNA, 12 nt, Homo sapiens
acacugugaugu

SEQ ID NO: 1142527 - RNA, 20 nt, Homo sapiens
acacugugggugugugacuc

SEQ ID NO: 1142528 - RNA, 17 nt, Homo sapiens
acacuuacaguauacau

SEQ ID NO: 1142529 - RNA, 16 nt, Homo sapiens
acacuuccagcauuua

SEQ ID NO: 1142530 - RNA, 20 nt, Homo sapiens
acacuucuaaaugaagugca

SEQ ID NO: 1142531 - RNA, 23 nt, Homo sapiens
acacuugguccauccauuuccaa

SEQ ID NO: 1142532 - RNA, 13 nt, Homo sapiens
acacuuggugcug

SEQ ID NO: 1142533 - RNA, 14 nt, Homo sapiens
acacuugugccagc

SEQ ID NO: 1142534 - RNA, 19 nt, Homo sapiens
acacuuuucagcaaaaaua

SEQ ID NO: 1142535 - RNA, 21 nt, Homo sapiens
acacuuuuuuggggauaugcu

SEQ ID NO: 1142536 - RNA, 17 nt, Homo sapiens
acagaaaacaauuguuc

SEQ ID NO: 1142537 - RNA, 21 nt, Homo sapiens
acagaaaaguaggaaugcauu

SEQ ID NO: 1142538 - RNA, 21 nt, Homo sapiens
acagaaaauaaucugguguuc

SEQ ID NO: 1142539 - RNA, 15 nt, Homo sapiens
acagaaagcacaaag

SEQ ID NO: 1142540 - RNA, 19 nt, Homo sapiens
acagaaaguggugcucagu

SEQ ID NO: 1142541 - RNA, 21 nt, Homo sapiens
acagaaccuuguuauuucuca

SEQ ID NO: 1142542 - RNA, 16 nt, Homo sapiens
acagacacacccagug

SEQ ID NO: 1142543 - RNA, 11 nt, Homo sapiens
acagaccucag

SEQ ID NO: 1142544 - RNA, 19 nt, Homo sapiens
acagaccuggugcucuaau

SEQ ID NO: 1142545 - RNA, 13 nt, Homo sapiens
acagacgucucaa

SEQ ID NO: 1142546 - RNA, 19 nt, Homo sapiens
acagacgucucaagacuga

SEQ ID NO: 1142547 - RNA, 21 nt, Homo sapiens
acagacgucucaagacugaaa

SEQ ID NO: 1142548 - RNA, 14 nt, Homo sapiens
acagacuccugagg

SEQ ID NO: 1142549 - RNA, 15 nt, Homo sapiens
acagacuucuuggua

SEQ ID NO: 1142550 - RNA, 17 nt, Homo sapiens
acagagaagaagugcuu

SEQ ID NO: 1142551 - RNA, 19 nt, Homo sapiens
acagagaagaagugcuugg

SEQ ID NO: 1142552 - RNA, 22 nt, Homo sapiens
acagagccagcggcuccaacuc

SEQ ID NO: 1142553 - RNA, 20 nt, Homo sapiens
acagagcgagauuccgucuc

SEQ ID NO: 1142554 - RNA, 18 nt, Homo sapiens
acagagcuucccugacuc

SEQ ID NO: 1142555 - RNA, 18 nt, Homo sapiens
acagaggagaagcaaugg

SEQ ID NO: 1142556 - RNA, 18 nt, Homo sapiens
acagaggcuagaaagcau

SEQ ID NO: 1142557 - RNA, 14 nt, Homo sapiens
acagauaaaugaca

SEQ ID NO: 1142558 - RNA, 18 nt, Homo sapiens
acagaucaagcugugaga

SEQ ID NO: 1142559 - RNA, 16 nt, Homo sapiens
acagaucacuccugga

SEQ ID NO: 1142560 - RNA, 19 nt, Homo sapiens
acagaugcaaugugcuacu

SEQ ID NO: 1142561 - RNA, 16 nt, Homo sapiens
acagaugcugagccau

SEQ ID NO: 1142562 - RNA, 20 nt, Homo sapiens
acagaugcuggccucuuggc

SEQ ID NO: 1142563 - RNA, 15 nt, Homo sapiens
acagauuguuugcaa

SEQ ID NO: 1142564 - RNA, 22 nt, Homo sapiens
acagauuuacaucccagacaca

SEQ ID NO: 1142565 - RNA, 23 nt, Homo sapiens
acagauuuacaucccagacacau

SEQ ID NO: 1142566 - RNA, 15 nt, Homo sapiens
acagcacaucaccuc

SEQ ID NO: 1142567 - RNA, 15 nt, Homo sapiens
acagcacuaauucaa

SEQ ID NO: 1142568 - RNA, 15 nt, Homo sapiens
acagcagaacuucug

SEQ ID NO: 1142569 - RNA, 15 nt, Homo sapiens
acagcagccugugag

SEQ ID NO: 1142570 - RNA, 15 nt, Homo sapiens
acagcagucagggac

SEQ ID NO: 1142571 - RNA, 16 nt, Homo sapiens
acagcaugccuucaaa

SEQ ID NO: 1142572 - RNA, 18 nt, Homo sapiens
acagcaugccuucaaauc

SEQ ID NO: 1142573 - RNA, 12 nt, Homo sapiens
acagccacuuuu

SEQ ID NO: 1142574 - RNA, 16 nt, Homo sapiens
acagccauuuuucaau

SEQ ID NO: 1142575 - RNA, 23 nt, Homo sapiens
acagccccacccuggugggccaa

SEQ ID NO: 1142576 - RNA, 21 nt, Homo sapiens
acagccccuggcccacccacu

SEQ ID NO: 1142577 - RNA, 15 nt, Homo sapiens
acagcccucagcaau

SEQ ID NO: 1142578 - RNA, 21 nt, Homo sapiens
acagcccuggggacaccugcc

SEQ ID NO: 1142579 - RNA, 22 nt, Homo sapiens
acagccggcugcggcacugugc

SEQ ID NO: 1142580 - RNA, 21 nt, Homo sapiens
acagccucacuuggucugcca

SEQ ID NO: 1142581 - RNA, 17 nt, Homo sapiens
acagccucuuacuugcc

SEQ ID NO: 1142582 - RNA, 16 nt, Homo sapiens
acagccugucuuguca

SEQ ID NO: 1142583 - RNA, 22 nt, Homo sapiens
acagccugucuugucaggugga

SEQ ID NO: 1142584 - RNA, 11 nt, Homo sapiens
acagccuucag

SEQ ID NO: 1142585 - RNA, 16 nt, Homo sapiens
acagcgcuguauuuac

SEQ ID NO: 1142586 - RNA, 22 nt, Homo sapiens
acagcucccggcgggugcucug

SEQ ID NO: 1142587 - RNA, 20 nt, Homo sapiens
acagcucgggcccucuguga

SEQ ID NO: 1142588 - RNA, 21 nt, Homo sapiens
acagcucugggcuuccucgga

SEQ ID NO: 1142589 - RNA, 12 nt, Homo sapiens
acagcugcucag

SEQ ID NO: 1142590 - RNA, 14 nt, Homo sapiens
acagcugcuccuag

SEQ ID NO: 1142591 - RNA, 14 nt, Homo sapiens
acagcugucccugc

SEQ ID NO: 1142592 - RNA, 15 nt, Homo sapiens
acagcugucccuguc

SEQ ID NO: 1142593 - RNA, 18 nt, Homo sapiens
acagcuuauggcaucuca

SEQ ID NO: 1142594 - RNA, 22 nt, Homo sapiens
acagcuuucugaccuucagcuc

SEQ ID NO: 1142595 - RNA, 21 nt, Homo sapiens
acaggaaaauguauccagagg

SEQ ID NO: 1142596 - RNA, 22 nt, Homo sapiens
acaggagacccaacaaugagug

SEQ ID NO: 1142597 - RNA, 18 nt, Homo sapiens
acaggagcuuaaacagcu

SEQ ID NO: 1142598 - RNA, 16 nt, Homo sapiens
acaggaggacaauuca

SEQ ID NO: 1142599 - RNA, 18 nt, Homo sapiens
acaggaggucagcacaag

SEQ ID NO: 1142600 - RNA, 13 nt, Homo sapiens
acaggagugggaa

SEQ ID NO: 1142601 - RNA, 16 nt, Homo sapiens
acaggcaaacugcaaa

SEQ ID NO: 1142602 - RNA, 16 nt, Homo sapiens
acaggcaugugccaca

SEQ ID NO: 1142603 - RNA, 20 nt, Homo sapiens
acaggcgccugccaucaugc

SEQ ID NO: 1142604 - RNA, 22 nt, Homo sapiens
acaggcgugauccaccacaccu

SEQ ID NO: 1142605 - RNA, 23 nt, Homo sapiens
acaggcuucugagcacagcugca

SEQ ID NO: 1142606 - RNA, 19 nt, Homo sapiens
acagggacaugcccugugu

SEQ ID NO: 1142607 - RNA, 15 nt, Homo sapiens
acagggcaccugcca

SEQ ID NO: 1142608 - RNA, 21 nt, Homo sapiens
acagggcugggcuacuaagcu

SEQ ID NO: 1142609 - RNA, 19 nt, Homo sapiens
acaggggcucucugugcaa

SEQ ID NO: 1142610 - RNA, 14 nt, Homo sapiens
acagggucuugcua

SEQ ID NO: 1142611 - RNA, 17 nt, Homo sapiens
acagggugguggcacau

SEQ ID NO: 1142612 - RNA, 18 nt, Homo sapiens
acaggucaggggugacac

SEQ ID NO: 1142613 - RNA, 23 nt, Homo sapiens
acaggucuuugccauaacuuuau

SEQ ID NO: 1142614 - RNA, 12 nt, Homo sapiens
acaggugugagc

SEQ ID NO: 1142615 - RNA, 15 nt, Homo sapiens
acaggugugagccac

SEQ ID NO: 1142616 - RNA, 23 nt, Homo sapiens
acagguguuuuuccacaagugcc

SEQ ID NO: 1142617 - RNA, 23 nt, Homo sapiens
acagguuacuacccucacccuuu

SEQ ID NO: 1142618 - RNA, 14 nt, Homo sapiens
acagguuagaagca

SEQ ID NO: 1142619 - RNA, 15 nt, Homo sapiens
aggacuaugacaaau

SEQ ID NO: 1142620 - RNA, 19 nt, Homo sapiens
aggacucacccuccacaaa

SEQ ID NO: 1142621 - RNA, 23 nt, Homo sapiens
aggacucagaagccucuggguca

SEQ ID NO: 1142622 - RNA, 20 nt, Homo sapiens
aggacucuggacaaucucac

SEQ ID NO: 1142623 - RNA, 16 nt, Homo sapiens
aggacugcaccauugc

SEQ ID NO: 1142624 - RNA, 18 nt, Homo sapiens
aggacugugccagcacaa

SEQ ID NO: 1142625 - RNA, 20 nt, Homo sapiens
aggacuugaggccugagaca

SEQ ID NO: 1142626 - RNA, 13 nt, Homo sapiens
aggagaaaucacu

SEQ ID NO: 1142627 - RNA, 21 nt, Homo sapiens
aggagaacaucauaacccaug

SEQ ID NO: 1142628 - RNA, 15 nt, Homo sapiens
aggagaagcaauggg

SEQ ID NO: 1142629 - RNA, 13 nt, Homo sapiens
aggagaaucacuu

SEQ ID NO: 1142630 - RNA, 18 nt, Homo sapiens
aggagaaugaaauguaug

SEQ ID NO: 1142631 - RNA, 13 nt, Homo sapiens
aggagaauugaau

SEQ ID NO: 1142632 - RNA, 21 nt, Homo sapiens
aggagaccagcgguccauggg

SEQ ID NO: 1142633 - RNA, 20 nt, Homo sapiens
aggagacccaacaaugagug

SEQ ID NO: 1142634 - RNA, 14 nt, Homo sapiens
aggagagugagugc

SEQ ID NO: 1142635 - RNA, 17 nt, Homo sapiens
aggagccaccuugccac

SEQ ID NO: 1142636 - RNA, 21 nt, Homo sapiens
aggagccagacuuguucucag

SEQ ID NO: 1142637 - RNA, 17 nt, Homo sapiens
aggagcccuccauucca

SEQ ID NO: 1142638 - RNA, 20 nt, Homo sapiens
aggagccggacacuucucag

SEQ ID NO: 1142639 - RNA, 12 nt, Homo sapiens
aggagcucucca

SEQ ID NO: 1142640 - RNA, 18 nt, Homo sapiens
aggaggaacagauuugag

SEQ ID NO: 1142641 - RNA, 17 nt, Homo sapiens
aggaggaauaaggggaa

SEQ ID NO: 1142642 - RNA, 20 nt, Homo sapiens
aggaggacaauucaugaacu

SEQ ID NO: 1142643 - RNA, 13 nt, Homo sapiens
aggaggaugcuaa

SEQ ID NO: 1142644 - RNA, 17 nt, Homo sapiens
aggaggcugcccugagg

SEQ ID NO: 1142645 - RNA, 14 nt, Homo sapiens
aggagggaggugcu

SEQ ID NO: 1142646 - RNA, 15 nt, Homo sapiens
aggagggcaggcauc

SEQ ID NO: 1142647 - RNA, 23 nt, Homo sapiens
aggagggcgugacucacccaagc

SEQ ID NO: 1142648 - RNA, 17 nt, Homo sapiens
aggagggugagugcaag

SEQ ID NO: 1142649 - RNA, 18 nt, Homo sapiens
aggagguuuuuuugucaa

SEQ ID NO: 1142650 - RNA, 15 nt, Homo sapiens
aggagucaacuggcu

SEQ ID NO: 1142651 - RNA, 14 nt, Homo sapiens
aggagucugugcag

SEQ ID NO: 1142652 - RNA, 14 nt, Homo sapiens
aggauaaacugcag

SEQ ID NO: 1142653 - RNA, 18 nt, Homo sapiens
aggauaaccuugugccuu

SEQ ID NO: 1142654 - RNA, 22 nt, Homo sapiens
aggauagcgagaagaugcucug

SEQ ID NO: 1142655 - RNA, 17 nt, Homo sapiens
aggauauccucccucca

SEQ ID NO: 1142656 - RNA, 17 nt, Homo sapiens
aggaucuuuugaaccca

SEQ ID NO: 1142657 - RNA, 17 nt, Homo sapiens
aggaugauguuauucac

SEQ ID NO: 1142658 - RNA, 22 nt, Homo sapiens
aggaugcacgguuucuguucug

SEQ ID NO: 1142659 - RNA, 10 nt, Homo sapiens
aggaugcugc

SEQ ID NO: 1142660 - RNA, 13 nt, Homo sapiens
aggauuaggcaaa

SEQ ID NO: 1142661 - RNA, 17 nt, Homo sapiens
aggauucauguggaaua

SEQ ID NO: 1142662 - RNA, 20 nt, Homo sapiens
aggauugggaaaaaguaauu

SEQ ID NO: 1142663 - RNA, 12 nt, Homo sapiens
aggauugugcug

SEQ ID NO: 1142664 - RNA, 13 nt, Homo sapiens
aggauuucagcca

SEQ ID NO: 1142665 - RNA, 17 nt, Homo sapiens
aggauuuuguauugcca

SEQ ID NO: 1142666 - RNA, 15 nt, Homo sapiens
aggcaaagaacaauu

SEQ ID NO: 1142667 - RNA, 13 nt, Homo sapiens
aggcaaaggcaga

SEQ ID NO: 1142668 - RNA, 20 nt, Homo sapiens
aggcaaaggcagaggaauuu

SEQ ID NO: 1142669 - RNA, 14 nt, Homo sapiens
aggcaaauguguac

SEQ ID NO: 1142670 - RNA, 14 nt, Homo sapiens
aggcaacauccaaa

SEQ ID NO: 1142671 - RNA, 15 nt, Homo sapiens
aggcaacauccaaaa

SEQ ID NO: 1142672 - RNA, 19 nt, Homo sapiens
aggcacaagaaucacuuga

SEQ ID NO: 1142673 - RNA, 20 nt, Homo sapiens
aggcacccaccaccaugccc

SEQ ID NO: 1142674 - RNA, 17 nt, Homo sapiens
aggcaccucaagaagaa

SEQ ID NO: 1142675 - RNA, 14 nt, Homo sapiens
aggcacgugccugu

SEQ ID NO: 1142676 - RNA, 13 nt, Homo sapiens
aggcacuaaaaag

SEQ ID NO: 1142677 - RNA, 11 nt, Homo sapiens
aggcacugggc

SEQ ID NO: 1142678 - RNA, 16 nt, Homo sapiens
aggcacuguaguucua

SEQ ID NO: 1142679 - RNA, 20 nt, Homo sapiens
aggcacuguaguucuaagac

SEQ ID NO: 1142680 - RNA, 16 nt, Homo sapiens
aggcagaaaagcacau

SEQ ID NO: 1142681 - RNA, 19 nt, Homo sapiens
aggcagaucuuugauggag

SEQ ID NO: 1142682 - RNA, 18 nt, Homo sapiens
aggcagcagagggucucc

SEQ ID NO: 1142683 - RNA, 15 nt, Homo sapiens
aggcagcagugugag

SEQ ID NO: 1142684 - RNA, 20 nt, Homo sapiens
aggcagcccugccaugucac

SEQ ID NO: 1142685 - RNA, 13 nt, Homo sapiens
aggcaggggacaa

SEQ ID NO: 1142686 - RNA, 15 nt, Homo sapiens
aggcaggucugcaag

SEQ ID NO: 1142687 - RNA, 14 nt, Homo sapiens
aggcaguaaccaug

SEQ ID NO: 1142688 - RNA, 22 nt, Homo sapiens
aggcagugacagcagucaggga

SEQ ID NO: 1142689 - RNA, 16 nt, Homo sapiens
aggcaguuuagugcau

SEQ ID NO: 1142690 - RNA, 17 nt, Homo sapiens
aggcauacuuuuaauca

SEQ ID NO: 1142691 - RNA, 18 nt, Homo sapiens
aggcaucagguuguuaga

SEQ ID NO: 1142692 - RNA, 14 nt, Homo sapiens
aggcauccaggcca

SEQ ID NO: 1142693 - RNA, 19 nt, Homo sapiens
aggcauccaggccagggcu

SEQ ID NO: 1142694 - RNA, 19 nt, Homo sapiens
aggcaugagccacugcacu

SEQ ID NO: 1142695 - RNA, 18 nt, Homo sapiens
aggcaugagccacugugc

SEQ ID NO: 1142696 - RNA, 21 nt, Homo sapiens
aggcauucuaagucacaggau

SEQ ID NO: 1142697 - RNA, 15 nt, Homo sapiens
aggcauucucugaag

SEQ ID NO: 1142698 - RNA, 18 nt, Homo sapiens
aggcauuugcaggguccu

SEQ ID NO: 1142699 - RNA, 15 nt, Homo sapiens
aggccaacacugugg

SEQ ID NO: 1142700 - RNA, 23 nt, Homo sapiens
aggccaguauaaagggacuugaa

SEQ ID NO: 1142701 - RNA, 19 nt, Homo sapiens
aggccaucugcuuaccaca

SEQ ID NO: 1142702 - RNA, 14 nt, Homo sapiens
aggccaucuggggc

SEQ ID NO: 1142703 - RNA, 19 nt, Homo sapiens
aggccauucuuucccaaca

SEQ ID NO: 1142704 - RNA, 18 nt, Homo sapiens
aggccauuggcuacugac

SEQ ID NO: 1142705 - RNA, 20 nt, Homo sapiens
aggcccccucucaggagcca

SEQ ID NO: 1142706 - RNA, 20 nt, Homo sapiens
aggcccgcuagguccagaga

SEQ ID NO: 1142707 - RNA, 12 nt, Homo sapiens
aggcccucgcug

SEQ ID NO: 1142708 - RNA, 18 nt, Homo sapiens
aggccgagaagcaagaaa

SEQ ID NO: 1142709 - RNA, 21 nt, Homo sapiens
aggccucccuagccagcacuu

SEQ ID NO: 1142710 - RNA, 19 nt, Homo sapiens
aggccucucucaggagcag

SEQ ID NO: 1142711 - RNA, 15 nt, Homo sapiens
aggccucuguggcac

SEQ ID NO: 1142712 - RNA, 16 nt, Homo sapiens
aggccugugugacucc

SEQ ID NO: 1142713 - RNA, 11 nt, Homo sapiens
aggccuuccag

SEQ ID NO: 1142714 - RNA, 19 nt, Homo sapiens
aggccuuggugcccugaac

SEQ ID NO: 1142715 - RNA, 17 nt, Homo sapiens
aggcgccuauaauccca

SEQ ID NO: 1142716 - RNA, 15 nt, Homo sapiens
aggcggaucuuugga

SEQ ID NO: 1142717 - RNA, 19 nt, Homo sapiens
aggcguguggcagccacac

SEQ ID NO: 1142718 - RNA, 14 nt, Homo sapiens
aggcguucuccugc

SEQ ID NO: 1142719 - RNA, 14 nt, Homo sapiens
aggcuagagugcaa

SEQ ID NO: 1142720 - RNA, 14 nt, Homo sapiens
aggcucauuuacuu

SEQ ID NO: 1142721 - RNA, 23 nt, Homo sapiens
aggcuccagaaauguuugcugag

SEQ ID NO: 1142722 - RNA, 13 nt, Homo sapiens
aggcucugugccu

SEQ ID NO: 1142723 - RNA, 23 nt, Homo sapiens
aggcucugugccuuggucucucc

SEQ ID NO: 1142724 - RNA, 17 nt, Homo sapiens
aggcugaccacagcaca

SEQ ID NO: 1142725 - RNA, 22 nt, Homo sapiens
aggcugaucucgaacuccuaac

SEQ ID NO: 1142726 - RNA, 20 nt, Homo sapiens
aggcugcauugagcuaugau

SEQ ID NO: 1142727 - RNA, 13 nt, Homo sapiens
aggcugcccugag

SEQ ID NO: 1142728 - RNA, 12 nt, Homo sapiens
aggcugcucaga

SEQ ID NO: 1142729 - RNA, 15 nt, Homo sapiens
aggcuggaaaugguu

SEQ ID NO: 1142730 - RNA, 22 nt, Homo sapiens
aggcuggaaaugguuucacuug

SEQ ID NO: 1142731 - RNA, 20 nt, Homo sapiens
aggcuggagggcaguggcac

SEQ ID NO: 1142732 - RNA, 16 nt, Homo sapiens
aggcuggagugcaaug

SEQ ID NO: 1142733 - RNA, 20 nt, Homo sapiens
aggcuggagugcaauggcag

SEQ ID NO: 1142734 - RNA, 18 nt, Homo sapiens
aggcuggagugcaauggu

SEQ ID NO: 1142735 - RNA, 18 nt, Homo sapiens
aggcuggcuccagaugca

SEQ ID NO: 1142736 - RNA, 23 nt, Homo sapiens
aggcuggcuugagugaauugugu

SEQ ID NO: 1142737 - RNA, 12 nt, Homo sapiens
aggcuggcuugu

SEQ ID NO: 1142738 - RNA, 12 nt, Homo sapiens
aggcuggucuca

SEQ ID NO: 1142739 - RNA, 23 nt, Homo sapiens
aggcuggucucaaacuccugagc

SEQ ID NO: 1142740 - RNA, 18 nt, Homo sapiens
aggcuguuaaccuaugau

SEQ ID NO: 1142741 - RNA, 21 nt, Homo sapiens
aggcuguuuauauguucacag

SEQ ID NO: 1142742 - RNA, 20 nt, Homo sapiens
aggcuuaacucgcugaugag

SEQ ID NO: 1142743 - RNA, 21 nt, Homo sapiens
aggcuuaacucgcugaugagu

SEQ ID NO: 1142744 - RNA, 21 nt, Homo sapiens
aggcuuaauaccugggugauu

SEQ ID NO: 1142745 - RNA, 17 nt, Homo sapiens
aggcuuacguacuacuu

SEQ ID NO: 1142746 - RNA, 16 nt, Homo sapiens
aggcuuauaacaaaua

SEQ ID NO: 1142747 - RNA, 14 nt, Homo sapiens
aggcuucagucuca

SEQ ID NO: 1142748 - RNA, 17 nt, Homo sapiens
aggcuucaucaccaaga

SEQ ID NO: 1142749 - RNA, 17 nt, Homo sapiens
aggcuuccuggucagaa

SEQ ID NO: 1142750 - RNA, 22 nt, Homo sapiens
aggcuucucuucugacccaggg

SEQ ID NO: 1142751 - RNA, 20 nt, Homo sapiens
aggcuugacagagucugccc

SEQ ID NO: 1142752 - RNA, 23 nt, Homo sapiens
auaaagaagguuggugaauuuca

SEQ ID NO: 1142753 - RNA, 13 nt, Homo sapiens
auaaagcucucaa

SEQ ID NO: 1142754 - RNA, 19 nt, Homo sapiens
auaaagcuguucucauucc

SEQ ID NO: 1142755 - RNA, 16 nt, Homo sapiens
auaaagggacuugaag

SEQ ID NO: 1142756 - RNA, 22 nt, Homo sapiens
auaaaguguuugaaagcuuuau

SEQ ID NO: 1142757 - RNA, 20 nt, Homo sapiens
auaaauaaaagauagcaaua

SEQ ID NO: 1142758 - RNA, 19 nt, Homo sapiens
auaaauaaacuguugcucg

SEQ ID NO: 1142759 - RNA, 21 nt, Homo sapiens
auaaauacaagauucucugau

SEQ ID NO: 1142760 - RNA, 23 nt, Homo sapiens
auaaauagaguguuuuucaugga

SEQ ID NO: 1142761 - RNA, 23 nt, Homo sapiens
auaaauauuaggagacacaggga

SEQ ID NO: 1142762 - RNA, 23 nt, Homo sapiens
auaaauauuuauugaagaaauga

SEQ ID NO: 1142763 - RNA, 17 nt, Homo sapiens
auaaaucacaggcaucu

SEQ ID NO: 1142764 - RNA, 15 nt, Homo sapiens
auaaauuagaaucuc

SEQ ID NO: 1142765 - RNA, 24 nt, Homo sapiens
auaaauuuuuuugcaauccuuucc

SEQ ID NO: 1142766 - RNA, 20 nt, Homo sapiens
auaacaacuggaugcaucaa

SEQ ID NO: 1142767 - RNA, 15 nt, Homo sapiens
auaacaagcauauuu

SEQ ID NO: 1142768 - RNA, 13 nt, Homo sapiens
auaacagcacaau

SEQ ID NO: 1142769 - RNA, 11 nt, Homo sapiens
auaacaucacu

SEQ ID NO: 1142770 - RNA, 13 nt, Homo sapiens
auaaccacagggc

SEQ ID NO: 1142771 - RNA, 17 nt, Homo sapiens
auaacuauugaguuaca

SEQ ID NO: 1142772 - RNA, 10 nt, Homo sapiens
auaacuguau

SEQ ID NO: 1142773 - RNA, 21 nt, Homo sapiens
auaacuuuggaaacaugggaa

SEQ ID NO: 1142774 - RNA, 17 nt, Homo sapiens
auaagaaagaucaaaga

SEQ ID NO: 1142775 - RNA, 13 nt, Homo sapiens
auaagaacaaaga

SEQ ID NO: 1142776 - RNA, 14 nt, Homo sapiens
auaagagauccuuu

SEQ ID NO: 1142777 - RNA, 14 nt, Homo sapiens
auaagcuauaucau

SEQ ID NO: 1142778 - RNA, 19 nt, Homo sapiens
auaagcuuuauauaccucu

SEQ ID NO: 1142779 - RNA, 21 nt, Homo sapiens
auaagggaggaauauagaaug

SEQ ID NO: 1142780 - RNA, 15 nt, Homo sapiens
auaagggguggggga

SEQ ID NO: 1142781 - RNA, 19 nt, Homo sapiens
auaagguaaaaugccauga

SEQ ID NO: 1142782 - RNA, 23 nt, Homo sapiens
auaagguuuuaaguuguuugcau

SEQ ID NO: 1142783 - RNA, 16 nt, Homo sapiens
auaaguaccucagcau

SEQ ID NO: 1142784 - RNA, 16 nt, Homo sapiens
auaaguagaaagaauu

SEQ ID NO: 1142785 - RNA, 19 nt, Homo sapiens
auaagucaaaaggaacaaa

SEQ ID NO: 1142786 - RNA, 22 nt, Homo sapiens
auaaguuacaucuacaaacagg

SEQ ID NO: 1142787 - RNA, 20 nt, Homo sapiens
auaaguucuuaugccauguu

SEQ ID NO: 1142788 - RNA, 21 nt, Homo sapiens
auaaguuuuauguuaaaucaa

SEQ ID NO: 1142789 - RNA, 16 nt, Homo sapiens
auaauaaacaguggaa

SEQ ID NO: 1142790 - RNA, 16 nt, Homo sapiens
auaauaaauacacaau

SEQ ID NO: 1142791 - RNA, 22 nt, Homo sapiens
auaaucaacugaauugcaaaau

SEQ ID NO: 1142792 - RNA, 15 nt, Homo sapiens
auaaucauacugucu

SEQ ID NO: 1142793 - RNA, 13 nt, Homo sapiens
auaaucauuuuag

SEQ ID NO: 1142794 - RNA, 21 nt, Homo sapiens
auaauccaaagcgaucauguc

SEQ ID NO: 1142795 - RNA, 11 nt, Homo sapiens
auaaucccagc

SEQ ID NO: 1142796 - RNA, 16 nt, Homo sapiens
auaaucguguccugaa

SEQ ID NO: 1142797 - RNA, 15 nt, Homo sapiens
auaaucugaugauau

SEQ ID NO: 1142798 - RNA, 12 nt, Homo sapiens
auaaucuggugu

SEQ ID NO: 1142799 - RNA, 12 nt, Homo sapiens
auaaucuuugcu

SEQ ID NO: 1142800 - RNA, 15 nt, Homo sapiens
auaaugaucagcaaa

SEQ ID NO: 1142801 - RNA, 11 nt, Homo sapiens
auaaugcagaa

SEQ ID NO: 1142802 - RNA, 11 nt, Homo sapiens
auaaugcucac

SEQ ID NO: 1142803 - RNA, 15 nt, Homo sapiens
auaaugcucacuugg

SEQ ID NO: 1142804 - RNA, 18 nt, Homo sapiens
auaaugcuguugccucau

SEQ ID NO: 1142805 - RNA, 13 nt, Homo sapiens
auaauuaauuacu

SEQ ID NO: 1142806 - RNA, 21 nt, Homo sapiens
auaauuaccaauaucuugcca

SEQ ID NO: 1142807 - RNA, 17 nt, Homo sapiens
auaauugaagaauggga

SEQ ID NO: 1142808 - RNA, 18 nt, Homo sapiens
auaauuggcuugaugucc

SEQ ID NO: 1142809 - RNA, 17 nt, Homo sapiens
auaauuguccaugagga

SEQ ID NO: 1142810 - RNA, 17 nt, Homo sapiens
auaauuuacaugcaaua

SEQ ID NO: 1142811 - RNA, 15 nt, Homo sapiens
auaauuuucauucau

SEQ ID NO: 1142812 - RNA, 17 nt, Homo sapiens
auacaaaaauaccuacu

SEQ ID NO: 1142813 - RNA, 13 nt, Homo sapiens
auacaaaaauuag

SEQ ID NO: 1142814 - RNA, 14 nt, Homo sapiens
auacaaaacccuuu

SEQ ID NO: 1142815 - RNA, 17 nt, Homo sapiens
auacaaguauccaguca

SEQ ID NO: 1142816 - RNA, 19 nt, Homo sapiens
auacaauuauuuuuacagu

SEQ ID NO: 1142817 - RNA, 19 nt, Homo sapiens
auacacacacacacacagc

SEQ ID NO: 1142818 - RNA, 14 nt, Homo sapiens
auacacacauguau

SEQ ID NO: 1142819 - RNA, 12 nt, Homo sapiens
auacacaguguu

SEQ ID NO: 1142820 - RNA, 20 nt, Homo sapiens
auacacaugagauaauaugc

SEQ ID NO: 1142821 - RNA, 16 nt, Homo sapiens
auacagaauuacugua

SEQ ID NO: 1142822 - RNA, 16 nt, Homo sapiens
auacagcagcaagaaa

SEQ ID NO: 1142823 - RNA, 22 nt, Homo sapiens
auacagccugaauaaaccaaga

SEQ ID NO: 1142824 - RNA, 16 nt, Homo sapiens
auacagcucagcuuuu

SEQ ID NO: 1142825 - RNA, 12 nt, Homo sapiens
auacagcuuucu

SEQ ID NO: 1142826 - RNA, 22 nt, Homo sapiens
auacaggcaugaaccacugcac

SEQ ID NO: 1142827 - RNA, 14 nt, Homo sapiens
auacaguguacaug

SEQ ID NO: 1142828 - RNA, 22 nt, Homo sapiens
auacauauguagaaacauuuag

SEQ ID NO: 1142829 - RNA, 12 nt, Homo sapiens
auacaucaaaga

SEQ ID NO: 1142830 - RNA, 16 nt, Homo sapiens
auacauucugcuuuca

SEQ ID NO: 1142831 - RNA, 21 nt, Homo sapiens
auacauugauucaugucucac

SEQ ID NO: 1142832 - RNA, 17 nt, Homo sapiens
auacauuugaggggaaa

SEQ ID NO: 1142833 - RNA, 22 nt, Homo sapiens
auacauuuguauuuugugauga

SEQ ID NO: 1142834 - RNA, 22 nt, Homo sapiens
auaccaaccugaagacaccguu

SEQ ID NO: 1142835 - RNA, 17 nt, Homo sapiens
auaccaacugaagucaa

SEQ ID NO: 1142836 - RNA, 15 nt, Homo sapiens
auaccauuuccucag

SEQ ID NO: 1142837 - RNA, 19 nt, Homo sapiens
auaccauuuuuuaaggaaa

SEQ ID NO: 1142838 - RNA, 13 nt, Homo sapiens
auacccaguuuag

SEQ ID NO: 1142839 - RNA, 14 nt, Homo sapiens
auacccaugaacuu

SEQ ID NO: 1142840 - RNA, 12 nt, Homo sapiens
auaccguuuaua

SEQ ID NO: 1142841 - RNA, 17 nt, Homo sapiens
auaccuaaaacauaaga

SEQ ID NO: 1142842 - RNA, 14 nt, Homo sapiens
auaccuacauucaa

SEQ ID NO: 1142843 - RNA, 21 nt, Homo sapiens
auaccugaguacccaugggaa

SEQ ID NO: 1142844 - RNA, 17 nt, Homo sapiens
auaccugauauauucca

SEQ ID NO: 1142845 - RNA, 21 nt, Homo sapiens
auaccuuacugagagcauguu

SEQ ID NO: 1142846 - RNA, 17 nt, Homo sapiens
auaccuucaaugaauua

SEQ ID NO: 1142847 - RNA, 21 nt, Homo sapiens
auaccuugccuguaguccagu

SEQ ID NO: 1142848 - RNA, 14 nt, Homo sapiens
auacgguaugauau

SEQ ID NO: 1142849 - RNA, 13 nt, Homo sapiens
auacgucuagccu

SEQ ID NO: 1142850 - RNA, 16 nt, Homo sapiens
auacuaugugggacac

SEQ ID NO: 1142851 - RNA, 14 nt, Homo sapiens
auacucucuucccu

SEQ ID NO: 1142852 - RNA, 17 nt, Homo sapiens
auacucuucaaggacuu

SEQ ID NO: 1142853 - RNA, 15 nt, Homo sapiens
auacugaaugggaaa

SEQ ID NO: 1142854 - RNA, 18 nt, Homo sapiens
auacugcacuuuagugua

SEQ ID NO: 1142855 - RNA, 18 nt, Homo sapiens
auacugccagaugcugau

SEQ ID NO: 1142856 - RNA, 12 nt, Homo sapiens
auacuggucuca

SEQ ID NO: 1142857 - RNA, 16 nt, Homo sapiens
auacuguauuuuuacc

SEQ ID NO: 1142858 - RNA, 22 nt, Homo sapiens
auacugugugcuaaaacaagca

SEQ ID NO: 1142859 - RNA, 16 nt, Homo sapiens
auacuugaccuugcau

SEQ ID NO: 1142860 - RNA, 18 nt, Homo sapiens
auacuugguucucuccac

SEQ ID NO: 1142861 - RNA, 22 nt, Homo sapiens
auacuugguucucuccaccagg

SEQ ID NO: 1142862 - RNA, 18 nt, Homo sapiens
auacuuucuguucuccag

SEQ ID NO: 1142863 - RNA, 13 nt, Homo sapiens
auacuuugcauau

SEQ ID NO: 1142864 - RNA, 18 nt, Homo sapiens
auacuuugcauauugucu

SEQ ID NO: 1142865 - RNA, 13 nt, Homo sapiens
auacuuuuuacaa

SEQ ID NO: 1142866 - RNA, 14 nt, Homo sapiens
auagaaaugccaag

SEQ ID NO: 1142867 - RNA, 19 nt, Homo sapiens
auagaaauguauuuugaaa

SEQ ID NO: 1142868 - RNA, 16 nt, Homo sapiens
auagaagugauugaau

SEQ ID NO: 1142869 - RNA, 21 nt, Homo sapiens
auagaauuauuucacaaauaa

SEQ ID NO: 1142870 - RNA, 21 nt, Homo sapiens
auagaauucaauuugaacuca

SEQ ID NO: 1142871 - RNA, 14 nt, Homo sapiens
auagacaccaagga

SEQ ID NO: 1142872 - RNA, 16 nt, Homo sapiens
auagacugaagauuua

SEQ ID NO: 1142873 - RNA, 22 nt, Homo sapiens
auagacuuauguguuuugcuaa

SEQ ID NO: 1142874 - RNA, 12 nt, Homo sapiens
auagagcagugc

SEQ ID NO: 1142875 - RNA, 13 nt, Homo sapiens
auagagccugagg

SEQ ID NO: 1142876 - RNA, 18 nt, Homo sapiens
auagagggccacggggag

SEQ ID NO: 1142877 - RNA, 22 nt, Homo sapiens
auagaugcuggcccagggccca

SEQ ID NO: 1142878 - RNA, 20 nt, Homo sapiens
auagauggucacgcaccugg

SEQ ID NO: 1142879 - RNA, 17 nt, Homo sapiens
auagcaccauuccucaa

SEQ ID NO: 1142880 - RNA, 19 nt, Homo sapiens
auagcaggucccuauagca

SEQ ID NO: 1142881 - RNA, 17 nt, Homo sapiens
auagcaucuguacaaag

SEQ ID NO: 1142882 - RNA, 18 nt, Homo sapiens
auagcaugguuccaauuu

SEQ ID NO: 1142883 - RNA, 21 nt, Homo sapiens
auaggagagauaccuugaaaa

SEQ ID NO: 1142884 - RNA, 18 nt, Homo sapiens
auagggacauaaguucau

SEQ ID NO: 1142885 - RNA, 14 nt, Homo sapiens
augagaaguacuuu

SEQ ID NO: 1142886 - RNA, 22 nt, Homo sapiens
augagaauuugagugcucugau

SEQ ID NO: 1142887 - RNA, 21 nt, Homo sapiens
augagacaggaggucagcaca

SEQ ID NO: 1142888 - RNA, 16 nt, Homo sapiens
augagacucagugcag

SEQ ID NO: 1142889 - RNA, 20 nt, Homo sapiens
augagagaaggaggggagca

SEQ ID NO: 1142890 - RNA, 12 nt, Homo sapiens
augagauggauc

SEQ ID NO: 1142891 - RNA, 13 nt, Homo sapiens
augagcagggaug

SEQ ID NO: 1142892 - RNA, 16 nt, Homo sapiens
augagccacugugcuu

SEQ ID NO: 1142893 - RNA, 11 nt, Homo sapiens
augagccauga

SEQ ID NO: 1142894 - RNA, 15 nt, Homo sapiens
augagcccucagaac

SEQ ID NO: 1142895 - RNA, 16 nt, Homo sapiens
augaggcuguugucuu

SEQ ID NO: 1142896 - RNA, 16 nt, Homo sapiens
augagguggagagugg

SEQ ID NO: 1142897 - RNA, 22 nt, Homo sapiens
augagguuucuuugacuucaau

SEQ ID NO: 1142898 - RNA, 13 nt, Homo sapiens
augagugcuuaaa

SEQ ID NO: 1142899 - RNA, 11 nt, Homo sapiens
augaguuaaau

SEQ ID NO: 1142900 - RNA, 23 nt, Homo sapiens
augauaaaauacuaaacuacauu

SEQ ID NO: 1142901 - RNA, 19 nt, Homo sapiens
augauaaauguacagagua

SEQ ID NO: 1142902 - RNA, 16 nt, Homo sapiens
augauauuuaacuuuu

SEQ ID NO: 1142903 - RNA, 14 nt, Homo sapiens
augauccucagugc

SEQ ID NO: 1142904 - RNA, 22 nt, Homo sapiens
augaucugagcaaaaugugaac

SEQ ID NO: 1142905 - RNA, 19 nt, Homo sapiens
augaugagcuccucuuccu

SEQ ID NO: 1142906 - RNA, 18 nt, Homo sapiens
augaugcuuuacauuuaa

SEQ ID NO: 1142907 - RNA, 14 nt, Homo sapiens
augauggaugccaa

SEQ ID NO: 1142908 - RNA, 16 nt, Homo sapiens
augauggcaacagauc

SEQ ID NO: 1142909 - RNA, 14 nt, Homo sapiens
augauggcacugag

SEQ ID NO: 1142910 - RNA, 17 nt, Homo sapiens
augauggcacugagaaa

SEQ ID NO: 1142911 - RNA, 23 nt, Homo sapiens
augauggcacugagaaagccaau

SEQ ID NO: 1142912 - RNA, 16 nt, Homo sapiens
augauggcagugguuu

SEQ ID NO: 1142913 - RNA, 19 nt, Homo sapiens
augaugugguuuuuugcca

SEQ ID NO: 1142914 - RNA, 20 nt, Homo sapiens
augaugugguuuuuugccag

SEQ ID NO: 1142915 - RNA, 20 nt, Homo sapiens
augauuaaauaagauucuaa

SEQ ID NO: 1142916 - RNA, 22 nt, Homo sapiens
augauuaaauaagguaauacau

SEQ ID NO: 1142917 - RNA, 17 nt, Homo sapiens
augauuccagacagugg

SEQ ID NO: 1142918 - RNA, 14 nt, Homo sapiens
augauuccaggugg

SEQ ID NO: 1142919 - RNA, 17 nt, Homo sapiens
augauuuuuuaugauca

SEQ ID NO: 1142920 - RNA, 22 nt, Homo sapiens
augcaaacugggaugaaacuaa

SEQ ID NO: 1142921 - RNA, 14 nt, Homo sapiens
augcaaccauaaga

SEQ ID NO: 1142922 - RNA, 16 nt, Homo sapiens
augcaaugacucagga

SEQ ID NO: 1142923 - RNA, 20 nt, Homo sapiens
augcacauauggacucugca

SEQ ID NO: 1142924 - RNA, 21 nt, Homo sapiens
augcacauauggacucugcac

SEQ ID NO: 1142925 - RNA, 12 nt, Homo sapiens
augcaccaaaua

SEQ ID NO: 1142926 - RNA, 18 nt, Homo sapiens
augcaccuugugucugua

SEQ ID NO: 1142927 - RNA, 17 nt, Homo sapiens
augcagaguaaguauua

SEQ ID NO: 1142928 - RNA, 21 nt, Homo sapiens
augcagccuucaccauggauc

SEQ ID NO: 1142929 - RNA, 22 nt, Homo sapiens
augcagcgccguguccucucug

SEQ ID NO: 1142930 - RNA, 16 nt, Homo sapiens
augcagcuacccaggc

SEQ ID NO: 1142931 - RNA, 14 nt, Homo sapiens
augcagcucugcag

SEQ ID NO: 1142932 - RNA, 15 nt, Homo sapiens
augcagucuguccag

SEQ ID NO: 1142933 - RNA, 16 nt, Homo sapiens
augcauaaaugcgauc

SEQ ID NO: 1142934 - RNA, 15 nt, Homo sapiens
augcaucacaugaug

SEQ ID NO: 1142935 - RNA, 18 nt, Homo sapiens
augcaucacaugaugaaa

SEQ ID NO: 1142936 - RNA, 16 nt, Homo sapiens
augcauggugccccag

SEQ ID NO: 1142937 - RNA, 21 nt, Homo sapiens
augcauucuaucguuauuaua

SEQ ID NO: 1142938 - RNA, 11 nt, Homo sapiens
augccaaaaaa

SEQ ID NO: 1142939 - RNA, 20 nt, Homo sapiens
augccaacaagaaugcauug

SEQ ID NO: 1142940 - RNA, 21 nt, Homo sapiens
augccacccaguugugacaau

SEQ ID NO: 1142941 - RNA, 12 nt, Homo sapiens
augccacuccuc

SEQ ID NO: 1142942 - RNA, 22 nt, Homo sapiens
augccagcagccagccaacccu

SEQ ID NO: 1142943 - RNA, 17 nt, Homo sapiens
augccagugugcugaug

SEQ ID NO: 1142944 - RNA, 17 nt, Homo sapiens
augcccacaacuuguca

SEQ ID NO: 1142945 - RNA, 23 nt, Homo sapiens
augcccacugccuguaacagcca

SEQ ID NO: 1142946 - RNA, 22 nt, Homo sapiens
augccgauauacucuagaugaa

SEQ ID NO: 1142947 - RNA, 18 nt, Homo sapiens
augccuacugaguagggg

SEQ ID NO: 1142948 - RNA, 14 nt, Homo sapiens
augccugccucaaa

SEQ ID NO: 1142949 - RNA, 19 nt, Homo sapiens
augcgacuguaaauuggua

SEQ ID NO: 1142950 - RNA, 20 nt, Homo sapiens
augcggaguccauuauuuga

SEQ ID NO: 1142951 - RNA, 20 nt, Homo sapiens
augcgguagccagcacacag

SEQ ID NO: 1142952 - RNA, 19 nt, Homo sapiens
augcgguucuuacagcaca

SEQ ID NO: 1142953 - RNA, 20 nt, Homo sapiens
augcgucccaagauguugau

SEQ ID NO: 1142954 - RNA, 17 nt, Homo sapiens
augcuaauguuacuaga

SEQ ID NO: 1142955 - RNA, 15 nt, Homo sapiens
augcuacaacuacua

SEQ ID NO: 1142956 - RNA, 21 nt, Homo sapiens
augcuacaagacgggcaaaau

SEQ ID NO: 1142957 - RNA, 15 nt, Homo sapiens
augcuauuauacugu

SEQ ID NO: 1142958 - RNA, 22 nt, Homo sapiens
augcuauuucagccaaucugga

SEQ ID NO: 1142959 - RNA, 19 nt, Homo sapiens
augcucagaccagcucuuc

SEQ ID NO: 1142960 - RNA, 17 nt, Homo sapiens
augcucuugucccuguc

SEQ ID NO: 1142961 - RNA, 18 nt, Homo sapiens
augcugacagcucuucac

SEQ ID NO: 1142962 - RNA, 17 nt, Homo sapiens
augcugagaagaucuga

SEQ ID NO: 1142963 - RNA, 17 nt, Homo sapiens
augcugauaaacugauu

SEQ ID NO: 1142964 - RNA, 19 nt, Homo sapiens
augcugauauuuacuggaa

SEQ ID NO: 1142965 - RNA, 19 nt, Homo sapiens
augcugaugaaucacuguu

SEQ ID NO: 1142966 - RNA, 18 nt, Homo sapiens
augcugcaggacuugaga

SEQ ID NO: 1142967 - RNA, 18 nt, Homo sapiens
augcuggcugguggaaca

SEQ ID NO: 1142968 - RNA, 20 nt, Homo sapiens
augcugggcuguuuacuuua

SEQ ID NO: 1142969 - RNA, 14 nt, Homo sapiens
augcuguaugaaua

SEQ ID NO: 1142970 - RNA, 22 nt, Homo sapiens
augcugucauuaguauuucaca

SEQ ID NO: 1142971 - RNA, 21 nt, Homo sapiens
augcugucccugcacugugcc

SEQ ID NO: 1142972 - RNA, 15 nt, Homo sapiens
augcugugcuaugaa

SEQ ID NO: 1142973 - RNA, 19 nt, Homo sapiens
augcuguuuaugacacaau

SEQ ID NO: 1142974 - RNA, 21 nt, Homo sapiens
augcuuguggccaaugcaucc

SEQ ID NO: 1142975 - RNA, 20 nt, Homo sapiens
augcuuuugcuugcaaugua

SEQ ID NO: 1142976 - RNA, 21 nt, Homo sapiens
auggaaauaguacuaaaggcu

SEQ ID NO: 1142977 - RNA, 14 nt, Homo sapiens
auggaacacggcca

SEQ ID NO: 1142978 - RNA, 16 nt, Homo sapiens
auggaacacggccaca

SEQ ID NO: 1142979 - RNA, 13 nt, Homo sapiens
auggaagaguuaa

SEQ ID NO: 1142980 - RNA, 12 nt, Homo sapiens
auggaagcaucu

SEQ ID NO: 1142981 - RNA, 18 nt, Homo sapiens
auggaagccaaaguauuc

SEQ ID NO: 1142982 - RNA, 13 nt, Homo sapiens
auggaaucagauu

SEQ ID NO: 1142983 - RNA, 19 nt, Homo sapiens
auggaaugucaguguucag

SEQ ID NO: 1142984 - RNA, 19 nt, Homo sapiens
auggaaugugauguucaug

SEQ ID NO: 1142985 - RNA, 17 nt, Homo sapiens
auggaauuacuccaaaa

SEQ ID NO: 1142986 - RNA, 15 nt, Homo sapiens
auggaauucaaagcu

SEQ ID NO: 1142987 - RNA, 12 nt, Homo sapiens
auggacaacuua

SEQ ID NO: 1142988 - RNA, 15 nt, Homo sapiens
auggacacuuuucac

SEQ ID NO: 1142989 - RNA, 16 nt, Homo sapiens
auggacgaacugcgca

SEQ ID NO: 1142990 - RNA, 15 nt, Homo sapiens
auggacucaguuuuc

SEQ ID NO: 1142991 - RNA, 12 nt, Homo sapiens
auggacucugca

SEQ ID NO: 1142992 - RNA, 21 nt, Homo sapiens
auggacuuacccuaaagaucu

SEQ ID NO: 1142993 - RNA, 18 nt, Homo sapiens
auggaugggggaacucag

SEQ ID NO: 1142994 - RNA, 14 nt, Homo sapiens
auggauucuauuua

SEQ ID NO: 1142995 - RNA, 14 nt, Homo sapiens
auggcaacacugaa

SEQ ID NO: 1142996 - RNA, 23 nt, Homo sapiens
auggcaacagaucuggaaccuca

SEQ ID NO: 1142997 - RNA, 16 nt, Homo sapiens
auggcagaaccaaagc

SEQ ID NO: 1142998 - RNA, 14 nt, Homo sapiens
auggcagcuuaaag

SEQ ID NO: 1142999 - RNA, 15 nt, Homo sapiens
auggcaggauccaag

SEQ ID NO: 1143000 - RNA, 22 nt, Homo sapiens
auggcagggcugaggaugggcu

SEQ ID NO: 1143001 - RNA, 14 nt, Homo sapiens
auggcagugaugaa

SEQ ID NO: 1143002 - RNA, 21 nt, Homo sapiens
auggcaucucauugaggacaa

SEQ ID NO: 1143003 - RNA, 11 nt, Homo sapiens
auggcaucuuc

SEQ ID NO: 1143004 - RNA, 23 nt, Homo sapiens
auggccggcuggaaaugcugggc

SEQ ID NO: 1143005 - RNA, 20 nt, Homo sapiens
auggccuuaauauacuacuu

SEQ ID NO: 1143006 - RNA, 20 nt, Homo sapiens
auggcuauaaacaauuacau

SEQ ID NO: 1143007 - RNA, 14 nt, Homo sapiens
auggcucagggugg

SEQ ID NO: 1143008 - RNA, 15 nt, Homo sapiens
auggcucugugaaau

SEQ ID NO: 1143009 - RNA, 21 nt, Homo sapiens
auggcugguuaccaccagccu

SEQ ID NO: 1143010 - RNA, 20 nt, Homo sapiens
auggcuuaggaucgacaaga

SEQ ID NO: 1143011 - RNA, 18 nt, Homo sapiens
auggcuuuuagcauuuau

SEQ ID NO: 1143012 - RNA, 17 nt, Homo sapiens
augggaaaccaguucau

SEQ ID NO: 1143013 - RNA, 20 nt, Homo sapiens
augggaaggugccacuggua

SEQ ID NO: 1143014 - RNA, 18 nt, Homo sapiens
augggagcugaggccaca

SEQ ID NO: 1143015 - RNA, 22 nt, Homo sapiens
augggaggagaggacaagggaa

SEQ ID NO: 1143016 - RNA, 16 nt, Homo sapiens
augggauauuuugaaa

SEQ ID NO: 1143017 - RNA, 19 nt, Homo sapiens
caaacuguauacauuacaa

SEQ ID NO: 1143018 - RNA, 21 nt, Homo sapiens
caaacuucccugacucuucaa

SEQ ID NO: 1143019 - RNA, 13 nt, Homo sapiens
caaagacagcauc

SEQ ID NO: 1143020 - RNA, 18 nt, Homo sapiens
caaagacauuauuucuca

SEQ ID NO: 1143021 - RNA, 13 nt, Homo sapiens
caaagacuacuaa

SEQ ID NO: 1143022 - RNA, 21 nt, Homo sapiens
caaagacuacuaaugacuuug

SEQ ID NO: 1143023 - RNA, 14 nt, Homo sapiens
caaagagugaaaua

SEQ ID NO: 1143024 - RNA, 21 nt, Homo sapiens
caaagaugaccauaaccacug

SEQ ID NO: 1143025 - RNA, 16 nt, Homo sapiens
caaagaugacugugga

SEQ ID NO: 1143026 - RNA, 18 nt, Homo sapiens
caaagauugaacacugcg

SEQ ID NO: 1143027 - RNA, 23 nt, Homo sapiens
caaagcagccacgaggugcaaca

SEQ ID NO: 1143028 - RNA, 16 nt, Homo sapiens
caaagcaggaguggaa

SEQ ID NO: 1143029 - RNA, 14 nt, Homo sapiens
caaagcauuuccca

SEQ ID NO: 1143030 - RNA, 14 nt, Homo sapiens
caaagccaauguga

SEQ ID NO: 1143031 - RNA, 14 nt, Homo sapiens
caaagccacuggaa

SEQ ID NO: 1143032 - RNA, 21 nt, Homo sapiens
caaagcccucccuaccuacca

SEQ ID NO: 1143033 - RNA, 21 nt, Homo sapiens
caaaggaaagagaaaccugag

SEQ ID NO: 1143034 - RNA, 20 nt, Homo sapiens
caaaggacagaguaugaaca

SEQ ID NO: 1143035 - RNA, 16 nt, Homo sapiens
caaaggagacaaagca

SEQ ID NO: 1143036 - RNA, 14 nt, Homo sapiens
caaaggaugcguga

SEQ ID NO: 1143037 - RNA, 20 nt, Homo sapiens
caaaggauguguuuucaguc

SEQ ID NO: 1143038 - RNA, 22 nt, Homo sapiens
caaaggauguguuuucagucuu

SEQ ID NO: 1143039 - RNA, 20 nt, Homo sapiens
caaagggcaugggucgggag

SEQ ID NO: 1143040 - RNA, 19 nt, Homo sapiens
caaagguuccaacuguaua

SEQ ID NO: 1143041 - RNA, 18 nt, Homo sapiens
caaaguaauguagcauga

SEQ ID NO: 1143042 - RNA, 22 nt, Homo sapiens
caaagucaucccucuguucaca

SEQ ID NO: 1143043 - RNA, 13 nt, Homo sapiens
caaaguccagccu

SEQ ID NO: 1143044 - RNA, 12 nt, Homo sapiens
caaagugaggag

SEQ ID NO: 1143045 - RNA, 14 nt, Homo sapiens
caaagugccaaaga

SEQ ID NO: 1143046 - RNA, 11 nt, Homo sapiens
caaagugcuaa

SEQ ID NO: 1143047 - RNA, 11 nt, Homo sapiens
caaagugcugg

SEQ ID NO: 1143048 - RNA, 19 nt, Homo sapiens
caaagugcugggauuacag

SEQ ID NO: 1143049 - RNA, 18 nt, Homo sapiens
caaaguuaaggcuugaua

SEQ ID NO: 1143050 - RNA, 15 nt, Homo sapiens
caaauaaaaacccaa

SEQ ID NO: 1143051 - RNA, 15 nt, Homo sapiens
caaauaaaacauaau

SEQ ID NO: 1143052 - RNA, 13 nt, Homo sapiens
caaauaaaagcca

SEQ ID NO: 1143053 - RNA, 14 nt, Homo sapiens
caaauaaacuguaa

SEQ ID NO: 1143054 - RNA, 22 nt, Homo sapiens
caaauaaaggaaacccagcuca

SEQ ID NO: 1143055 - RNA, 17 nt, Homo sapiens
caaauaaguuacaucua

SEQ ID NO: 1143056 - RNA, 17 nt, Homo sapiens
caaauaauuugaacuuu

SEQ ID NO: 1143057 - RNA, 21 nt, Homo sapiens
caaauaauuugaacuuuggaa

SEQ ID NO: 1143058 - RNA, 14 nt, Homo sapiens
caaauacacauuuc

SEQ ID NO: 1143059 - RNA, 23 nt, Homo sapiens
caaauacauaccuacugacugau

SEQ ID NO: 1143060 - RNA, 17 nt, Homo sapiens
caaauacucauguguau

SEQ ID NO: 1143061 - RNA, 22 nt, Homo sapiens
caaauagaaccacuaugaagcu

SEQ ID NO: 1143062 - RNA, 20 nt, Homo sapiens
caaauagaauuugagcauca

SEQ ID NO: 1143063 - RNA, 19 nt, Homo sapiens
caaauagaucaugcauuua

SEQ ID NO: 1143064 - RNA, 20 nt, Homo sapiens
caaauauguagaauguaaua

SEQ ID NO: 1143065 - RNA, 20 nt, Homo sapiens
caaaucauccugucacaagg

SEQ ID NO: 1143066 - RNA, 22 nt, Homo sapiens
caaaucccaagcaucauaucau

SEQ ID NO: 1143067 - RNA, 15 nt, Homo sapiens
caaaucccuuucaug

SEQ ID NO: 1143068 - RNA, 17 nt, Homo sapiens
caaauccuaugugauuu

SEQ ID NO: 1143069 - RNA, 14 nt, Homo sapiens
caaaucgugccuug

SEQ ID NO: 1143070 - RNA, 15 nt, Homo sapiens
caaaucgugccuugu

SEQ ID NO: 1143071 - RNA, 18 nt, Homo sapiens
caaaucuguaaucagcaa

SEQ ID NO: 1143072 - RNA, 16 nt, Homo sapiens
caaaucuugaaauuaa

SEQ ID NO: 1143073 - RNA, 16 nt, Homo sapiens
caaaugauaaguacua

SEQ ID NO: 1143074 - RNA, 13 nt, Homo sapiens
caaaugcaauuuu

SEQ ID NO: 1143075 - RNA, 19 nt, Homo sapiens
caaauggacauaggacuca

SEQ ID NO: 1143076 - RNA, 13 nt, Homo sapiens
caaauggcacugc

SEQ ID NO: 1143077 - RNA, 13 nt, Homo sapiens
caaauggggccag

SEQ ID NO: 1143078 - RNA, 19 nt, Homo sapiens
caaauguacagugguccuu

SEQ ID NO: 1143079 - RNA, 18 nt, Homo sapiens
caaaugugucccagugaa

SEQ ID NO: 1143080 - RNA, 20 nt, Homo sapiens
caaauuagaaacaccauuca

SEQ ID NO: 1143081 - RNA, 22 nt, Homo sapiens
caaauugagacagugcacauga

SEQ ID NO: 1143082 - RNA, 14 nt, Homo sapiens
caaauugcuucuag

SEQ ID NO: 1143083 - RNA, 17 nt, Homo sapiens
caaauuucgagcauaag

SEQ ID NO: 1143084 - RNA, 21 nt, Homo sapiens
caaauuugauugauuugaaga

SEQ ID NO: 1143085 - RNA, 23 nt, Homo sapiens
caacaaaggauuaauugcugcaa

SEQ ID NO: 1143086 - RNA, 14 nt, Homo sapiens
caacaagaaugcau

SEQ ID NO: 1143087 - RNA, 15 nt, Homo sapiens
caacaagaccaccac

SEQ ID NO: 1143088 - RNA, 15 nt, Homo sapiens
caacaauaaagacug

SEQ ID NO: 1143089 - RNA, 21 nt, Homo sapiens
caacaaugugaggggucccua

SEQ ID NO: 1143090 - RNA, 21 nt, Homo sapiens
caacacaagaaaacucaaaga

SEQ ID NO: 1143091 - RNA, 22 nt, Homo sapiens
caacacacaaaauaaugcaguu

SEQ ID NO: 1143092 - RNA, 15 nt, Homo sapiens
caacaccaagcacag

SEQ ID NO: 1143093 - RNA, 23 nt, Homo sapiens
caacagagaggaccaacauccag

SEQ ID NO: 1143094 - RNA, 18 nt, Homo sapiens
caacagcaaaagcccuaa

SEQ ID NO: 1143095 - RNA, 15 nt, Homo sapiens
caacagcauuuucaa

SEQ ID NO: 1143096 - RNA, 19 nt, Homo sapiens
caacaggcuuaugaauaua

SEQ ID NO: 1143097 - RNA, 14 nt, Homo sapiens
caacagguguguuu

SEQ ID NO: 1143098 - RNA, 18 nt, Homo sapiens
caacaguuacauaauuca

SEQ ID NO: 1143099 - RNA, 12 nt, Homo sapiens
caacaucacuga

SEQ ID NO: 1143100 - RNA, 13 nt, Homo sapiens
caacaugacuguu

SEQ ID NO: 1143101 - RNA, 13 nt, Homo sapiens
caacaugagucaa

SEQ ID NO: 1143102 - RNA, 21 nt, Homo sapiens
caacauggcaaaaccccaucu

SEQ ID NO: 1143103 - RNA, 24 nt, Homo sapiens
caacauuccaagaauagcaucugu

SEQ ID NO: 1143104 - RNA, 17 nt, Homo sapiens
caacauuuacauguauu

SEQ ID NO: 1143105 - RNA, 17 nt, Homo sapiens
caaccaauggaauguga

SEQ ID NO: 1143106 - RNA, 20 nt, Homo sapiens
caaccaguuugcccauucuc

SEQ ID NO: 1143107 - RNA, 17 nt, Homo sapiens
caacccacuggcacauu

SEQ ID NO: 1143108 - RNA, 14 nt, Homo sapiens
caacccgagucauu

SEQ ID NO: 1143109 - RNA, 19 nt, Homo sapiens
caacccuuccuaaguuuaa

SEQ ID NO: 1143110 - RNA, 14 nt, Homo sapiens
caaccuaaccugug

SEQ ID NO: 1143111 - RNA, 15 nt, Homo sapiens
caaccuacucugcaa

SEQ ID NO: 1143112 - RNA, 13 nt, Homo sapiens
caaccugcacuuc

SEQ ID NO: 1143113 - RNA, 18 nt, Homo sapiens
caaccugccugacauuug

SEQ ID NO: 1143114 - RNA, 14 nt, Homo sapiens
caaccuugcaucca

SEQ ID NO: 1143115 - RNA, 20 nt, Homo sapiens
caaccuuuauucuuuuccaa

SEQ ID NO: 1143116 - RNA, 18 nt, Homo sapiens
caaccuuuucucuggaca

SEQ ID NO: 1143117 - RNA, 16 nt, Homo sapiens
caacgaagugccagaa

SEQ ID NO: 1143118 - RNA, 18 nt, Homo sapiens
caacguuucuucacuuuu

SEQ ID NO: 1143119 - RNA, 21 nt, Homo sapiens
caacguuucuucacuuuugca

SEQ ID NO: 1143120 - RNA, 20 nt, Homo sapiens
caacguuuuuggacacugug

SEQ ID NO: 1143121 - RNA, 17 nt, Homo sapiens
caacuaaauaacuguau

SEQ ID NO: 1143122 - RNA, 19 nt, Homo sapiens
caacuaguuuuguuuauaa

SEQ ID NO: 1143123 - RNA, 16 nt, Homo sapiens
caacucauuuucauau

SEQ ID NO: 1143124 - RNA, 13 nt, Homo sapiens
caacuccauucuc

SEQ ID NO: 1143125 - RNA, 19 nt, Homo sapiens
caacuccuuucagccacau

SEQ ID NO: 1143126 - RNA, 21 nt, Homo sapiens
caacucuaaagccaagcacuu

SEQ ID NO: 1143127 - RNA, 19 nt, Homo sapiens
caacucuguacaaagcccu

SEQ ID NO: 1143128 - RNA, 14 nt, Homo sapiens
caacugaaauuaca

SEQ ID NO: 1143129 - RNA, 12 nt, Homo sapiens
caacugacacuc

SEQ ID NO: 1143130 - RNA, 16 nt, Homo sapiens
caacugacuaaccauu

SEQ ID NO: 1143131 - RNA, 19 nt, Homo sapiens
caacugaggauguggcuua

SEQ ID NO: 1143132 - RNA, 21 nt, Homo sapiens
caacugcucuuuuauacugua

SEQ ID NO: 1143133 - RNA, 19 nt, Homo sapiens
caacugcugaucaaugaaa

SEQ ID NO: 1143134 - RNA, 23 nt, Homo sapiens
caacuguuggaauucacuuuauu

SEQ ID NO: 1143135 - RNA, 21 nt, Homo sapiens
caacuuaaaagucaguaucau

SEQ ID NO: 1143136 - RNA, 20 nt, Homo sapiens
caacuuauuaacaauuaggc

SEQ ID NO: 1143137 - RNA, 20 nt, Homo sapiens
caacuugaauaauacaccag

SEQ ID NO: 1143138 - RNA, 14 nt, Homo sapiens
caacuugcuucuaa

SEQ ID NO: 1143139 - RNA, 16 nt, Homo sapiens
caagaaaacucaaaga

SEQ ID NO: 1143140 - RNA, 19 nt, Homo sapiens
caagaaaaguugaagaaga

SEQ ID NO: 1143141 - RNA, 22 nt, Homo sapiens
caagaaccaggcagcccugcca

SEQ ID NO: 1143142 - RNA, 20 nt, Homo sapiens
caagaagaaugggagcugca

SEQ ID NO: 1143143 - RNA, 15 nt, Homo sapiens
caagaagaugaaugg

SEQ ID NO: 1143144 - RNA, 17 nt, Homo sapiens
caagaaugcauugauau

SEQ ID NO: 1143145 - RNA, 23 nt, Homo sapiens
caagaaugcauugauauugugaa

SEQ ID NO: 1143146 - RNA, 12 nt, Homo sapiens
caagaaugccag

SEQ ID NO: 1143147 - RNA, 22 nt, Homo sapiens
caagacagcaugccuucaaauc

SEQ ID NO: 1143148 - RNA, 20 nt, Homo sapiens
caagacagcucuucuugaaa

SEQ ID NO: 1143149 - RNA, 22 nt, Homo sapiens
ccaugauggccaggcugaucuc

SEQ ID NO: 1143150 - RNA, 21 nt, Homo sapiens
ccaugauguaaguuuaccuau

SEQ ID NO: 1143151 - RNA, 21 nt, Homo sapiens
ccaugccaucucaaccucuuc

SEQ ID NO: 1143152 - RNA, 22 nt, Homo sapiens
ccaugcuuguggccaaugcauc

SEQ ID NO: 1143153 - RNA, 18 nt, Homo sapiens
ccaugcuuuguagguguc

SEQ ID NO: 1143154 - RNA, 17 nt, Homo sapiens
ccauggucaccaaacag

SEQ ID NO: 1143155 - RNA, 16 nt, Homo sapiens
ccaugguccccaagac

SEQ ID NO: 1143156 - RNA, 15 nt, Homo sapiens
ccaugucugcauuuc

SEQ ID NO: 1143157 - RNA, 21 nt, Homo sapiens
ccaugugacuaaaaaugcauc

SEQ ID NO: 1143158 - RNA, 13 nt, Homo sapiens
ccauguuagcucc

SEQ ID NO: 1143159 - RNA, 23 nt, Homo sapiens
ccauguuucacaaggucuuuaaa

SEQ ID NO: 1143160 - RNA, 12 nt, Homo sapiens
ccauuacugcau

SEQ ID NO: 1143161 - RNA, 16 nt, Homo sapiens
ccauuacugcauaaaa

SEQ ID NO: 1143162 - RNA, 23 nt, Homo sapiens
ccauuauagcacaaaaucagcca

SEQ ID NO: 1143163 - RNA, 16 nt, Homo sapiens
ccauucagcaucagag

SEQ ID NO: 1143164 - RNA, 20 nt, Homo sapiens
ccauucaggucuuucuuucc

SEQ ID NO: 1143165 - RNA, 19 nt, Homo sapiens
ccauuccacagcucugggc

SEQ ID NO: 1143166 - RNA, 21 nt, Homo sapiens
ccauuggagucccugaaggac

SEQ ID NO: 1143167 - RNA, 15 nt, Homo sapiens
ccauuggaugcauuu

SEQ ID NO: 1143168 - RNA, 20 nt, Homo sapiens
ccauugugauuguggaagau

SEQ ID NO: 1143169 - RNA, 15 nt, Homo sapiens
ccauuucagcuugac

SEQ ID NO: 1143170 - RNA, 17 nt, Homo sapiens
ccauuuguuaacuguac

SEQ ID NO: 1143171 - RNA, 18 nt, Homo sapiens
ccauuuuagucacuuuuu

SEQ ID NO: 1143172 - RNA, 16 nt, Homo sapiens
cccaaaacaguucuag

SEQ ID NO: 1143173 - RNA, 22 nt, Homo sapiens
cccaaaacugauacccuuugaa

SEQ ID NO: 1143174 - RNA, 17 nt, Homo sapiens
cccaaacaugcacuucc

SEQ ID NO: 1143175 - RNA, 23 nt, Homo sapiens
cccaaacauguuguacauuucac

SEQ ID NO: 1143176 - RNA, 17 nt, Homo sapiens
cccaaagccaagaaaga

SEQ ID NO: 1143177 - RNA, 12 nt, Homo sapiens
cccaacaaugag

SEQ ID NO: 1143178 - RNA, 21 nt, Homo sapiens
cccaagaccugcgauggacuu

SEQ ID NO: 1143179 - RNA, 21 nt, Homo sapiens
cccaagcaaaaucauggaaug

SEQ ID NO: 1143180 - RNA, 16 nt, Homo sapiens
cccaaguagcugcuac

SEQ ID NO: 1143181 - RNA, 15 nt, Homo sapiens
cccaaucaccuuucc

SEQ ID NO: 1143182 - RNA, 22 nt, Homo sapiens
cccaaucucugccauaucagug

SEQ ID NO: 1143183 - RNA, 17 nt, Homo sapiens
cccacaccugcagugcc

SEQ ID NO: 1143184 - RNA, 17 nt, Homo sapiens
cccacacucuccuguga

SEQ ID NO: 1143185 - RNA, 19 nt, Homo sapiens
cccacauuugugccgacac

SEQ ID NO: 1143186 - RNA, 22 nt, Homo sapiens
cccacauuugugccgacacugu

SEQ ID NO: 1143187 - RNA, 17 nt, Homo sapiens
cccaccaguuauuccuu

SEQ ID NO: 1143188 - RNA, 23 nt, Homo sapiens
cccaccaugcaccccugauguuc

SEQ ID NO: 1143189 - RNA, 15 nt, Homo sapiens
cccacccaacuaauu

SEQ ID NO: 1143190 - RNA, 16 nt, Homo sapiens
cccaccccacaauucc

SEQ ID NO: 1143191 - RNA, 15 nt, Homo sapiens
cccacgucucucugc

SEQ ID NO: 1143192 - RNA, 19 nt, Homo sapiens
cccacuaucugggugcaug

SEQ ID NO: 1143193 - RNA, 17 nt, Homo sapiens
cccacugcacacagggu

SEQ ID NO: 1143194 - RNA, 16 nt, Homo sapiens
cccacugcuuuuccca

SEQ ID NO: 1143195 - RNA, 13 nt, Homo sapiens
cccacuggccuca

SEQ ID NO: 1143196 - RNA, 16 nt, Homo sapiens
cccacuguucuuguau

SEQ ID NO: 1143197 - RNA, 13 nt, Homo sapiens
cccacuucccacc

SEQ ID NO: 1143198 - RNA, 17 nt, Homo sapiens
cccacuucugugccacc

SEQ ID NO: 1143199 - RNA, 14 nt, Homo sapiens
cccagaacaugaag

SEQ ID NO: 1143200 - RNA, 14 nt, Homo sapiens
cccagacaaggaga

SEQ ID NO: 1143201 - RNA, 18 nt, Homo sapiens
cccagacccccugaucag

SEQ ID NO: 1143202 - RNA, 16 nt, Homo sapiens
cccagacggcuccacu

SEQ ID NO: 1143203 - RNA, 18 nt, Homo sapiens
cccagagacauacuugaa

SEQ ID NO: 1143204 - RNA, 17 nt, Homo sapiens
cccagagccacacaugg

SEQ ID NO: 1143205 - RNA, 18 nt, Homo sapiens
cccagauucaugcacugu

SEQ ID NO: 1143206 - RNA, 13 nt, Homo sapiens
cccagauuguauc

SEQ ID NO: 1143207 - RNA, 12 nt, Homo sapiens
cccagcacuuug

SEQ ID NO: 1143208 - RNA, 22 nt, Homo sapiens
cccagcacuuugggagaccaag

SEQ ID NO: 1143209 - RNA, 16 nt, Homo sapiens
cccagcagccugccag

SEQ ID NO: 1143210 - RNA, 22 nt, Homo sapiens
cccagcagccugccagcaguua

SEQ ID NO: 1143211 - RNA, 21 nt, Homo sapiens
cccagcaggacagugacccca

SEQ ID NO: 1143212 - RNA, 22 nt, Homo sapiens
cccagcauggaaucugaugaaa

SEQ ID NO: 1143213 - RNA, 10 nt, Homo sapiens
cccagcauuu

SEQ ID NO: 1143214 - RNA, 14 nt, Homo sapiens
cccagccaccgaag

SEQ ID NO: 1143215 - RNA, 14 nt, Homo sapiens
cccagcccaaucca

SEQ ID NO: 1143216 - RNA, 16 nt, Homo sapiens
cccagcccugcagcaa

SEQ ID NO: 1143217 - RNA, 15 nt, Homo sapiens
cccagccucccugaa

SEQ ID NO: 1143218 - RNA, 21 nt, Homo sapiens
cccagcgcuuugggaggccga

SEQ ID NO: 1143219 - RNA, 18 nt, Homo sapiens
cccagcuaccucaaccaa

SEQ ID NO: 1143220 - RNA, 14 nt, Homo sapiens
cccaggaaguugug

SEQ ID NO: 1143221 - RNA, 14 nt, Homo sapiens
cccaggaccagcuc

SEQ ID NO: 1143222 - RNA, 23 nt, Homo sapiens
cccaggacccugaaggggccaug

SEQ ID NO: 1143223 - RNA, 21 nt, Homo sapiens
cccaggagaaaagaagacauu

SEQ ID NO: 1143224 - RNA, 21 nt, Homo sapiens
cccaggagacggggugaagcu

SEQ ID NO: 1143225 - RNA, 13 nt, Homo sapiens
cccaggaguacac

SEQ ID NO: 1143226 - RNA, 16 nt, Homo sapiens
cccaggaguauccucu

SEQ ID NO: 1143227 - RNA, 16 nt, Homo sapiens
cccaggauuugacucg

SEQ ID NO: 1143228 - RNA, 15 nt, Homo sapiens
cccaggcacugcaaa

SEQ ID NO: 1143229 - RNA, 20 nt, Homo sapiens
cccaggcacuuugcaucaca

SEQ ID NO: 1143230 - RNA, 18 nt, Homo sapiens
cccaggcuagagugcaau

SEQ ID NO: 1143231 - RNA, 18 nt, Homo sapiens
cccaggcuggagugcagu

SEQ ID NO: 1143232 - RNA, 15 nt, Homo sapiens
cccaggcugggaacu

SEQ ID NO: 1143233 - RNA, 15 nt, Homo sapiens
cccagggggcaacug

SEQ ID NO: 1143234 - RNA, 15 nt, Homo sapiens
cccagguaauggcau

SEQ ID NO: 1143235 - RNA, 15 nt, Homo sapiens
cccagguacauccau

SEQ ID NO: 1143236 - RNA, 17 nt, Homo sapiens
cccagguacauccauga

SEQ ID NO: 1143237 - RNA, 16 nt, Homo sapiens
cccaggugaguccuag

SEQ ID NO: 1143238 - RNA, 21 nt, Homo sapiens
cccaguaauuauuuucuuccu

SEQ ID NO: 1143239 - RNA, 12 nt, Homo sapiens
cccagucagaag

SEQ ID NO: 1143240 - RNA, 22 nt, Homo sapiens
cccagugcuucuccaacacuga

SEQ ID NO: 1143241 - RNA, 13 nt, Homo sapiens
cccaguguaauaa

SEQ ID NO: 1143242 - RNA, 20 nt, Homo sapiens
cccauaaaaugauccugcca

SEQ ID NO: 1143243 - RNA, 19 nt, Homo sapiens
cccauaggcccacacacag

SEQ ID NO: 1143244 - RNA, 16 nt, Homo sapiens
cccauucacaccacac

SEQ ID NO: 1143245 - RNA, 14 nt, Homo sapiens
cccauugucuuuac

SEQ ID NO: 1143246 - RNA, 21 nt, Homo sapiens
ccccaaacccagaacaugaag

SEQ ID NO: 1143247 - RNA, 23 nt, Homo sapiens
ccccaacagcacccucuccagau

SEQ ID NO: 1143248 - RNA, 14 nt, Homo sapiens
ccccaauccaugaa

SEQ ID NO: 1143249 - RNA, 14 nt, Homo sapiens
ccccaaucccucaa

SEQ ID NO: 1143250 - RNA, 18 nt, Homo sapiens
ccccaaugaacuucagaa

SEQ ID NO: 1143251 - RNA, 23 nt, Homo sapiens
ccccacguugccucuacuuuauc

SEQ ID NO: 1143252 - RNA, 17 nt, Homo sapiens
ccccacuggacugaccu

SEQ ID NO: 1143253 - RNA, 16 nt, Homo sapiens
ccccacuuacuguccu

SEQ ID NO: 1143254 - RNA, 11 nt, Homo sapiens
ccccagcacuu

SEQ ID NO: 1143255 - RNA, 16 nt, Homo sapiens
ccccagcccacaggug

SEQ ID NO: 1143256 - RNA, 19 nt, Homo sapiens
ccccagcccagagacauac

SEQ ID NO: 1143257 - RNA, 15 nt, Homo sapiens
ccccagcccagagcc

SEQ ID NO: 1143258 - RNA, 19 nt, Homo sapiens
ccccagccugccuuugcca

SEQ ID NO: 1143259 - RNA, 15 nt, Homo sapiens
ccccaggcauugcca

SEQ ID NO: 1143260 - RNA, 22 nt, Homo sapiens
ccccaggccuggcacgucaaag

SEQ ID NO: 1143261 - RNA, 19 nt, Homo sapiens
ccccagggcugucaucuga

SEQ ID NO: 1143262 - RNA, 18 nt, Homo sapiens
ccccagguaauggcauga

SEQ ID NO: 1143263 - RNA, 18 nt, Homo sapiens
ccccaucauccacgccaa

SEQ ID NO: 1143264 - RNA, 22 nt, Homo sapiens
ccccaucuagagucuagacaga

SEQ ID NO: 1143265 - RNA, 17 nt, Homo sapiens
ccccaucuucgggacca

SEQ ID NO: 1143266 - RNA, 20 nt, Homo sapiens
cccccaaagggccuccucac

SEQ ID NO: 1143267 - RNA, 23 nt, Homo sapiens
cccccaccgccgggguccuggga

SEQ ID NO: 1143268 - RNA, 16 nt, Homo sapiens
cccccacugaccagaa

SEQ ID NO: 1143269 - RNA, 19 nt, Homo sapiens
cccccagacagcugcucag

SEQ ID NO: 1143270 - RNA, 12 nt, Homo sapiens
cccccaguguaa

SEQ ID NO: 1143271 - RNA, 13 nt, Homo sapiens
cccccaguguaau

SEQ ID NO: 1143272 - RNA, 19 nt, Homo sapiens
cccccaguucgcagugccu

SEQ ID NO: 1143273 - RNA, 12 nt, Homo sapiens
cccccauuagaa

SEQ ID NO: 1143274 - RNA, 17 nt, Homo sapiens
cccccgagccccagucu

SEQ ID NO: 1143275 - RNA, 23 nt, Homo sapiens
cccccgugaggaugucacucaga

SEQ ID NO: 1143276 - RNA, 14 nt, Homo sapiens
cccccuccugcaag

SEQ ID NO: 1143277 - RNA, 14 nt, Homo sapiens
cccccugggcugag

SEQ ID NO: 1143278 - RNA, 18 nt, Homo sapiens
ccccgcauuccaggcucc

SEQ ID NO: 1143279 - RNA, 19 nt, Homo sapiens
ccccgcauuccaggcuccu

SEQ ID NO: 1143280 - RNA, 14 nt, Homo sapiens
ccccgggcaucuuu

SEQ ID NO: 1143281 - RNA, 20 nt, Homo sapiens
ccccgucuggugccagugug

SEQ ID NO: 1143282 - RNA, 15 nt, Homo sapiens
ccccgugacugcaau

SEQ ID NO: 1143283 - RNA, 20 nt, Homo sapiens
ccccgugaggaugucacuca

SEQ ID NO: 1143284 - RNA, 13 nt, Homo sapiens
ccccuaaaccaaa

SEQ ID NO: 1143285 - RNA, 14 nt, Homo sapiens
ccccuaaaccaaaa

SEQ ID NO: 1143286 - RNA, 18 nt, Homo sapiens
ccccuauacaaaacacca

SEQ ID NO: 1143287 - RNA, 15 nt, Homo sapiens
ccccuccaggaauga

SEQ ID NO: 1143288 - RNA, 21 nt, Homo sapiens
ccccuccccaaagccacugga

SEQ ID NO: 1143289 - RNA, 16 nt, Homo sapiens
ccccuccggccugggc

SEQ ID NO: 1143290 - RNA, 13 nt, Homo sapiens
ccccuccuagcaa

SEQ ID NO: 1143291 - RNA, 14 nt, Homo sapiens
ccccucguugguaa

SEQ ID NO: 1143292 - RNA, 20 nt, Homo sapiens
ccccucucccagcccuggua

SEQ ID NO: 1143293 - RNA, 13 nt, Homo sapiens
ccccucuccuccg

SEQ ID NO: 1143294 - RNA, 23 nt, Homo sapiens
ccccugcagcuaguccuagugaa

SEQ ID NO: 1143295 - RNA, 14 nt, Homo sapiens
ccccugcuccagaa

SEQ ID NO: 1143296 - RNA, 18 nt, Homo sapiens
ccccuggaucuaccagca

SEQ ID NO: 1143297 - RNA, 14 nt, Homo sapiens
ccccugucucaggg

SEQ ID NO: 1143298 - RNA, 21 nt, Homo sapiens
ccccuuucgcccacagucuga

SEQ ID NO: 1143299 - RNA, 22 nt, Homo sapiens
ccccuuugggcccugcauguag

SEQ ID NO: 1143300 - RNA, 15 nt, Homo sapiens
cccgacugccugucu

SEQ ID NO: 1143301 - RNA, 19 nt, Homo sapiens
cccgaggaggggcccggug

SEQ ID NO: 1143302 - RNA, 20 nt, Homo sapiens
cccgcaggccugccuucuca

SEQ ID NO: 1143303 - RNA, 15 nt, Homo sapiens
cccgcauuccaggcu

SEQ ID NO: 1143304 - RNA, 18 nt, Homo sapiens
cccgcggccugcaccgac

SEQ ID NO: 1143305 - RNA, 14 nt, Homo sapiens
cccggaccucugga

SEQ ID NO: 1143306 - RNA, 16 nt, Homo sapiens
cccggccacaacuaca

SEQ ID NO: 1143307 - RNA, 14 nt, Homo sapiens
cccgggaagccacc

SEQ ID NO: 1143308 - RNA, 16 nt, Homo sapiens
cccggggccagcacuu

SEQ ID NO: 1143309 - RNA, 17 nt, Homo sapiens
cccggggccagcacuuc

SEQ ID NO: 1143310 - RNA, 13 nt, Homo sapiens
cccgucuggugcc

SEQ ID NO: 1143311 - RNA, 20 nt, Homo sapiens
cccgugacgaggcucaaaaa

SEQ ID NO: 1143312 - RNA, 21 nt, Homo sapiens
cccgugcacgguucaauggua

SEQ ID NO: 1143313 - RNA, 19 nt, Homo sapiens
cccguggcuuggcaucugu

SEQ ID NO: 1143314 - RNA, 18 nt, Homo sapiens
cccgugggagucaucuca

SEQ ID NO: 1143315 - RNA, 22 nt, Homo sapiens
cccguuucuuaaaaaacauaua

SEQ ID NO: 1143316 - RNA, 23 nt, Homo sapiens
cccguuucuuaaaaaacauauau

SEQ ID NO: 1143317 - RNA, 15 nt, Homo sapiens
cccuaaagaucuucu

SEQ ID NO: 1143318 - RNA, 17 nt, Homo sapiens
cccuaaaucuugacuac

SEQ ID NO: 1143319 - RNA, 21 nt, Homo sapiens
cccuaaucacaugugcugcaa

SEQ ID NO: 1143320 - RNA, 14 nt, Homo sapiens
cccuaggacaggag

SEQ ID NO: 1143321 - RNA, 12 nt, Homo sapiens
cccuaugucuca

SEQ ID NO: 1143322 - RNA, 22 nt, Homo sapiens
cccuauuagggaguuaugcaaa

SEQ ID NO: 1143323 - RNA, 20 nt, Homo sapiens
cccucaaaccuugaggagaa

SEQ ID NO: 1143324 - RNA, 13 nt, Homo sapiens
cccucacucuuga

SEQ ID NO: 1143325 - RNA, 15 nt, Homo sapiens
cccucacuuguccuc

SEQ ID NO: 1143326 - RNA, 18 nt, Homo sapiens
cccucagagugcaagccc

SEQ ID NO: 1143327 - RNA, 13 nt, Homo sapiens
cccucaucauagc

SEQ ID NO: 1143328 - RNA, 14 nt, Homo sapiens
cccucauugcauuu

SEQ ID NO: 1143329 - RNA, 18 nt, Homo sapiens
cccucccacaugauguca

SEQ ID NO: 1143330 - RNA, 20 nt, Homo sapiens
cccuccccaaagccacugga

SEQ ID NO: 1143331 - RNA, 19 nt, Homo sapiens
cccuccgaccucucucggc

SEQ ID NO: 1143332 - RNA, 14 nt, Homo sapiens
cccuccuacccugc

SEQ ID NO: 1143333 - RNA, 22 nt, Homo sapiens
cccucgaggcggaucuuuggac

SEQ ID NO: 1143334 - RNA, 15 nt, Homo sapiens
cccucgcccaucagu

SEQ ID NO: 1143335 - RNA, 19 nt, Homo sapiens
cccucggcucuggaggcaa

SEQ ID NO: 1143336 - RNA, 20 nt, Homo sapiens
cccucguuaaucacaggauc

SEQ ID NO: 1143337 - RNA, 13 nt, Homo sapiens
cccucucaggcug

SEQ ID NO: 1143338 - RNA, 19 nt, Homo sapiens
cccucuccuccguggcaca

SEQ ID NO: 1143339 - RNA, 12 nt, Homo sapiens
cccucugccuca

SEQ ID NO: 1143340 - RNA, 17 nt, Homo sapiens
cccucugcugaagacuu

SEQ ID NO: 1143341 - RNA, 11 nt, Homo sapiens
cccucuggaaa

SEQ ID NO: 1143342 - RNA, 22 nt, Homo sapiens
cccucuggaguggccacuaagc

SEQ ID NO: 1143343 - RNA, 19 nt, Homo sapiens
cccucuugaaucucugaau

SEQ ID NO: 1143344 - RNA, 21 nt, Homo sapiens
cccucuuguccuuuaauauuu

SEQ ID NO: 1143345 - RNA, 16 nt, Homo sapiens
cccugaaacacugcuu

SEQ ID NO: 1143346 - RNA, 19 nt, Homo sapiens
cccugaaggaaccaaagcg

SEQ ID NO: 1143347 - RNA, 13 nt, Homo sapiens
cccugaauucuuc

SEQ ID NO: 1143348 - RNA, 19 nt, Homo sapiens
cccugaccuguccagguga

SEQ ID NO: 1143349 - RNA, 15 nt, Homo sapiens
cccugacucaucauu

SEQ ID NO: 1143350 - RNA, 21 nt, Homo sapiens
cccugacugggaguugaucgc

SEQ ID NO: 1143351 - RNA, 16 nt, Homo sapiens
cccugagugcccagac

SEQ ID NO: 1143352 - RNA, 15 nt, Homo sapiens
cccugccaugucaca

SEQ ID NO: 1143353 - RNA, 23 nt, Homo sapiens
cccugcugacacagacauccucu

SEQ ID NO: 1143354 - RNA, 16 nt, Homo sapiens
cccugcugcuggugca

SEQ ID NO: 1143355 - RNA, 20 nt, Homo sapiens
cccuggaucuaccagcauaa

SEQ ID NO: 1143356 - RNA, 22 nt, Homo sapiens
cccuggcaccuguguuccagcc

SEQ ID NO: 1143357 - RNA, 16 nt, Homo sapiens
cccuggccgaguccaa

SEQ ID NO: 1143358 - RNA, 17 nt, Homo sapiens
cccuggcuaacagucua

SEQ ID NO: 1143359 - RNA, 19 nt, Homo sapiens
cccugggccccaccaccua

SEQ ID NO: 1143360 - RNA, 16 nt, Homo sapiens
cccuggggcugagucu

SEQ ID NO: 1143361 - RNA, 14 nt, Homo sapiens
cccugggguggcca

SEQ ID NO: 1143362 - RNA, 20 nt, Homo sapiens
cccugggguggccaccagua

SEQ ID NO: 1143363 - RNA, 17 nt, Homo sapiens
cccugguccuucacugg

SEQ ID NO: 1143364 - RNA, 21 nt, Homo sapiens
cccugguggcuacccaauaga

SEQ ID NO: 1143365 - RNA, 18 nt, Homo sapiens
cccugguuuucagucuug

SEQ ID NO: 1143366 - RNA, 14 nt, Homo sapiens
cccugucucaaaaa

SEQ ID NO: 1143367 - RNA, 19 nt, Homo sapiens
cccugugcaggagcuaguu

SEQ ID NO: 1143368 - RNA, 22 nt, Homo sapiens
cccuguuuuaauucaacccagc

SEQ ID NO: 1143369 - RNA, 18 nt, Homo sapiens
cccuuacagccucugacu

SEQ ID NO: 1143370 - RNA, 20 nt, Homo sapiens
cccuuagcagcccagcauuu

SEQ ID NO: 1143371 - RNA, 13 nt, Homo sapiens
cccuuagugaauu

SEQ ID NO: 1143372 - RNA, 13 nt, Homo sapiens
cccuucacaaagc

SEQ ID NO: 1143373 - RNA, 12 nt, Homo sapiens
cccuuccagugg

SEQ ID NO: 1143374 - RNA, 19 nt, Homo sapiens
cccuucccuacuuccccaa

SEQ ID NO: 1143375 - RNA, 16 nt, Homo sapiens
cccuuccuuaugucuc

SEQ ID NO: 1143376 - RNA, 15 nt, Homo sapiens
cccuucucuuuaauc

SEQ ID NO: 1143377 - RNA, 21 nt, Homo sapiens
cccuucuuuaccuucauuuca

SEQ ID NO: 1143378 - RNA, 18 nt, Homo sapiens
cccuuggggguucaggga

SEQ ID NO: 1143379 - RNA, 21 nt, Homo sapiens
cccuuguguuccuucugugaa

SEQ ID NO: 1143380 - RNA, 22 nt, Homo sapiens
cccuuucauaaagucuugccuu

SEQ ID NO: 1143381 - RNA, 21 nt, Homo sapiens
cccuuuccuccucaggcacac

SEQ ID NO: 1143382 - RNA, 14 nt, Homo sapiens
cccuuugccuucau

SEQ ID NO: 1143383 - RNA, 15 nt, Homo sapiens
cccuuuggccaguga

SEQ ID NO: 1143384 - RNA, 20 nt, Homo sapiens
ccgaaaacuucacugugcuc

SEQ ID NO: 1143385 - RNA, 13 nt, Homo sapiens
ccgaaaucagaag

SEQ ID NO: 1143386 - RNA, 19 nt, Homo sapiens
ccgagauaggguggcacau

SEQ ID NO: 1143387 - RNA, 20 nt, Homo sapiens
ccgagcaaaagacgagugau

SEQ ID NO: 1143388 - RNA, 17 nt, Homo sapiens
ccgagccaggaacugug

SEQ ID NO: 1143389 - RNA, 22 nt, Homo sapiens
ccgagcucagggcagcugugcu

SEQ ID NO: 1143390 - RNA, 18 nt, Homo sapiens
ccgaggggcucaguucug

SEQ ID NO: 1143391 - RNA, 16 nt, Homo sapiens
ccgaugcugaccucac

SEQ ID NO: 1143392 - RNA, 22 nt, Homo sapiens
ccgaugcugaccucaccugguc

SEQ ID NO: 1143393 - RNA, 15 nt, Homo sapiens
ccgauuuugcucugu

SEQ ID NO: 1143394 - RNA, 17 nt, Homo sapiens
ccgauuuugcucugucu

SEQ ID NO: 1143395 - RNA, 19 nt, Homo sapiens
ccgcaaaagacaagucuuu

SEQ ID NO: 1143396 - RNA, 20 nt, Homo sapiens
ccgcacccuggccugguccc

SEQ ID NO: 1143397 - RNA, 20 nt, Homo sapiens
ccgcaggccugccuucucag

SEQ ID NO: 1143398 - RNA, 21 nt, Homo sapiens
ccgccauggugcuggggagcc

SEQ ID NO: 1143399 - RNA, 15 nt, Homo sapiens
ccgcccgcacagcuc

SEQ ID NO: 1143400 - RNA, 17 nt, Homo sapiens
ccgcgcaaggggaagcc

SEQ ID NO: 1143401 - RNA, 23 nt, Homo sapiens
ccgcgcuggcggugaaaauuuca

SEQ ID NO: 1143402 - RNA, 20 nt, Homo sapiens
ccgcugcuuccaggcugggc

SEQ ID NO: 1143403 - RNA, 22 nt, Homo sapiens
ccgcuggggaccgguucccaca

SEQ ID NO: 1143404 - RNA, 19 nt, Homo sapiens
ccgcuggugacccucugcu

SEQ ID NO: 1143405 - RNA, 18 nt, Homo sapiens
ccggaggaaaauuugaca

SEQ ID NO: 1143406 - RNA, 22 nt, Homo sapiens
ccggauauauacauagcaugac

SEQ ID NO: 1143407 - RNA, 20 nt, Homo sapiens
ccgggaagagggugauugcu

SEQ ID NO: 1143408 - RNA, 19 nt, Homo sapiens
ccgggaaggaccugcggua

SEQ ID NO: 1143409 - RNA, 11 nt, Homo sapiens
ccgggacaccu

SEQ ID NO: 1143410 - RNA, 18 nt, Homo sapiens
ccgggcuggcccugugca

SEQ ID NO: 1143411 - RNA, 15 nt, Homo sapiens
ccggggaaaggcaag

SEQ ID NO: 1143412 - RNA, 22 nt, Homo sapiens
ccggggaagagauccaaagacu

SEQ ID NO: 1143413 - RNA, 20 nt, Homo sapiens
cggcuuucagggcagccccu

SEQ ID NO: 1143414 - RNA, 14 nt, Homo sapiens
cgggaccccgagcc

SEQ ID NO: 1143415 - RNA, 18 nt, Homo sapiens
cgggagccugacccucau

SEQ ID NO: 1143416 - RNA, 16 nt, Homo sapiens
cgggauggguggacca

SEQ ID NO: 1143417 - RNA, 15 nt, Homo sapiens
cgggcacucccggga

SEQ ID NO: 1143418 - RNA, 17 nt, Homo sapiens
cgggcugugcccgggga

SEQ ID NO: 1143419 - RNA, 16 nt, Homo sapiens
cgggcuucggaacacg

SEQ ID NO: 1143420 - RNA, 20 nt, Homo sapiens
cggggaagagauccaaagac

SEQ ID NO: 1143421 - RNA, 17 nt, Homo sapiens
cggggcauggcugcuga

SEQ ID NO: 1143422 - RNA, 13 nt, Homo sapiens
cgggggaagggag

SEQ ID NO: 1143423 - RNA, 16 nt, Homo sapiens
cggggucacuugcaau

SEQ ID NO: 1143424 - RNA, 16 nt, Homo sapiens
cggggugugguggccu

SEQ ID NO: 1143425 - RNA, 16 nt, Homo sapiens
cgggguuucuccaugu

SEQ ID NO: 1143426 - RNA, 13 nt, Homo sapiens
cggguaccugaag

SEQ ID NO: 1143427 - RNA, 15 nt, Homo sapiens
cggguccccuugaaa

SEQ ID NO: 1143428 - RNA, 16 nt, Homo sapiens
cgggucguaaugacuu

SEQ ID NO: 1143429 - RNA, 23 nt, Homo sapiens
cgggucucucacuguugcagugg

SEQ ID NO: 1143430 - RNA, 12 nt, Homo sapiens
cgggugugcuau

SEQ ID NO: 1143431 - RNA, 18 nt, Homo sapiens
cggguuggggguugcuag

SEQ ID NO: 1143432 - RNA, 20 nt, Homo sapiens
cgguaaacacgccugcaaac

SEQ ID NO: 1143433 - RNA, 14 nt, Homo sapiens
cgguaccuguguuu

SEQ ID NO: 1143434 - RNA, 20 nt, Homo sapiens
cggucagggucagggccauu

SEQ ID NO: 1143435 - RNA, 14 nt, Homo sapiens
cggugaacucuggc

SEQ ID NO: 1143436 - RNA, 21 nt, Homo sapiens
cggugagcuacaaaugcauuu

SEQ ID NO: 1143437 - RNA, 16 nt, Homo sapiens
cggugcagcugagguu

SEQ ID NO: 1143438 - RNA, 14 nt, Homo sapiens
cggugcuccaucuc

SEQ ID NO: 1143439 - RNA, 14 nt, Homo sapiens
cgguggccacagcg

SEQ ID NO: 1143440 - RNA, 14 nt, Homo sapiens
cgguggcccugacu

SEQ ID NO: 1143441 - RNA, 18 nt, Homo sapiens
cgguggcggcagggccag

SEQ ID NO: 1143442 - RNA, 17 nt, Homo sapiens
cgguguacaguuuaaca

SEQ ID NO: 1143443 - RNA, 14 nt, Homo sapiens
cgguguuuugccau

SEQ ID NO: 1143444 - RNA, 23 nt, Homo sapiens
cgguuucccauuuguugcugcug

SEQ ID NO: 1143445 - RNA, 18 nt, Homo sapiens
cgguuuggauaaucuuaa

SEQ ID NO: 1143446 - RNA, 22 nt, Homo sapiens
cguaacccauuaaaaugaauuu

SEQ ID NO: 1143447 - RNA, 13 nt, Homo sapiens
cguaggcaagaag

SEQ ID NO: 1143448 - RNA, 14 nt, Homo sapiens
cguaguucccugaa

SEQ ID NO: 1143449 - RNA, 13 nt, Homo sapiens
cguaucucuagaa

SEQ ID NO: 1143450 - RNA, 19 nt, Homo sapiens
cguauuaaaaaacaauuaa

SEQ ID NO: 1143451 - RNA, 11 nt, Homo sapiens
cgucacaaaga

SEQ ID NO: 1143452 - RNA, 15 nt, Homo sapiens
cgucagcugggacac

SEQ ID NO: 1143453 - RNA, 18 nt, Homo sapiens
cgucagugcugugcugug

SEQ ID NO: 1143454 - RNA, 17 nt, Homo sapiens
cgucaucaucacauuca

SEQ ID NO: 1143455 - RNA, 13 nt, Homo sapiens
cgucaucuucccu

SEQ ID NO: 1143456 - RNA, 11 nt, Homo sapiens
cguccacaggg

SEQ ID NO: 1143457 - RNA, 13 nt, Homo sapiens
cguccacagggca

SEQ ID NO: 1143458 - RNA, 13 nt, Homo sapiens
cguccacugucaa

SEQ ID NO: 1143459 - RNA, 17 nt, Homo sapiens
cgucccccaaacauguu

SEQ ID NO: 1143460 - RNA, 19 nt, Homo sapiens
cgucuaguuaacauuucaa

SEQ ID NO: 1143461 - RNA, 12 nt, Homo sapiens
cgucucaagacu

SEQ ID NO: 1143462 - RNA, 18 nt, Homo sapiens
cgucucuguuccaugucu

SEQ ID NO: 1143463 - RNA, 15 nt, Homo sapiens
cgucugggcucccug

SEQ ID NO: 1143464 - RNA, 15 nt, Homo sapiens
cgucuucuguauacu

SEQ ID NO: 1143465 - RNA, 14 nt, Homo sapiens
cgugaccagcagua

SEQ ID NO: 1143466 - RNA, 19 nt, Homo sapiens
cgugauucggccucuccac

SEQ ID NO: 1143467 - RNA, 13 nt, Homo sapiens
cgugcacugugaa

SEQ ID NO: 1143468 - RNA, 17 nt, Homo sapiens
cgugcaggacagcucuu

SEQ ID NO: 1143469 - RNA, 22 nt, Homo sapiens
cgugccacugcacuccaggcug

SEQ ID NO: 1143470 - RNA, 18 nt, Homo sapiens
cgugcuuguuugcucacc

SEQ ID NO: 1143471 - RNA, 13 nt, Homo sapiens
cguggacucugca

SEQ ID NO: 1143472 - RNA, 17 nt, Homo sapiens
cguggacucugcacaug

SEQ ID NO: 1143473 - RNA, 22 nt, Homo sapiens
cguggacucugcacaugucuug

SEQ ID NO: 1143474 - RNA, 13 nt, Homo sapiens
cguggcauuucaa

SEQ ID NO: 1143475 - RNA, 13 nt, Homo sapiens
cguggccuggcau

SEQ ID NO: 1143476 - RNA, 13 nt, Homo sapiens
cgugggcucccug

SEQ ID NO: 1143477 - RNA, 14 nt, Homo sapiens
cguggguugcacug

SEQ ID NO: 1143478 - RNA, 15 nt, Homo sapiens
cguggguugcacugg

SEQ ID NO: 1143479 - RNA, 14 nt, Homo sapiens
cguucaaaagugga

SEQ ID NO: 1143480 - RNA, 17 nt, Homo sapiens
cguugaaacaagugcaa

SEQ ID NO: 1143481 - RNA, 22 nt, Homo sapiens
cguugacaaguuuuguggggcu

SEQ ID NO: 1143482 - RNA, 23 nt, Homo sapiens
cguugcagucuguauuuuccacc

SEQ ID NO: 1143483 - RNA, 19 nt, Homo sapiens
cguugcccuaauucaucuu

SEQ ID NO: 1143484 - RNA, 23 nt, Homo sapiens
cguuuacaagcccccccuuccac

SEQ ID NO: 1143485 - RNA, 14 nt, Homo sapiens
cuaaaaaaauuuau

SEQ ID NO: 1143486 - RNA, 21 nt, Homo sapiens
cuaaaaauauuaaagccucau

SEQ ID NO: 1143487 - RNA, 23 nt, Homo sapiens
cuaaaaaugaaccugcaagccuu

SEQ ID NO: 1143488 - RNA, 18 nt, Homo sapiens
cuaaaaaugucacgaaua

SEQ ID NO: 1143489 - RNA, 14 nt, Homo sapiens
cuaaaacuuaacau

SEQ ID NO: 1143490 - RNA, 14 nt, Homo sapiens
cuaaaacuucaucu

SEQ ID NO: 1143491 - RNA, 15 nt, Homo sapiens
cuaaaagcacacuca

SEQ ID NO: 1143492 - RNA, 17 nt, Homo sapiens
cuaaaaguucucaaugu

SEQ ID NO: 1143493 - RNA, 18 nt, Homo sapiens
cuaaaaguucucaaugua

SEQ ID NO: 1143494 - RNA, 21 nt, Homo sapiens
cuaaaauucagguauuacuga

SEQ ID NO: 1143495 - RNA, 16 nt, Homo sapiens
cuaaaauuuaaugcau

SEQ ID NO: 1143496 - RNA, 20 nt, Homo sapiens
cuaaacaaugcugauuuggu

SEQ ID NO: 1143497 - RNA, 21 nt, Homo sapiens
cuaaacacgugacacaaacac

SEQ ID NO: 1143498 - RNA, 16 nt, Homo sapiens
cuaaacucauuuauaa

SEQ ID NO: 1143499 - RNA, 17 nt, Homo sapiens
cuaaacuugcaccucau

SEQ ID NO: 1143500 - RNA, 18 nt, Homo sapiens
cuaaagagagaugaacca

SEQ ID NO: 1143501 - RNA, 22 nt, Homo sapiens
cuaaagaguuauucaaaugaag

SEQ ID NO: 1143502 - RNA, 20 nt, Homo sapiens
cuaaagguccacaggucuag

SEQ ID NO: 1143503 - RNA, 21 nt, Homo sapiens
cuaaagguggugaggcaauaa

SEQ ID NO: 1143504 - RNA, 11 nt, Homo sapiens
cuaaaguuaua

SEQ ID NO: 1143505 - RNA, 14 nt, Homo sapiens
cuaaaguucuaaga

SEQ ID NO: 1143506 - RNA, 12 nt, Homo sapiens
cuaaaguuuuag

SEQ ID NO: 1143507 - RNA, 15 nt, Homo sapiens
cuaaaucacuuugag

SEQ ID NO: 1143508 - RNA, 15 nt, Homo sapiens
cuaaaugaagugcaa

SEQ ID NO: 1143509 - RNA, 19 nt, Homo sapiens
cuaaaugagucacugagca

SEQ ID NO: 1143510 - RNA, 15 nt, Homo sapiens
cuaaauggcaugaca

SEQ ID NO: 1143511 - RNA, 12 nt, Homo sapiens
cuaaauguauuc

SEQ ID NO: 1143512 - RNA, 16 nt, Homo sapiens
cuaaauguguacacaa

SEQ ID NO: 1143513 - RNA, 14 nt, Homo sapiens
cuaaauuaugacug

SEQ ID NO: 1143514 - RNA, 22 nt, Homo sapiens
cuaaauuuaagcuuaagccaua

SEQ ID NO: 1143515 - RNA, 16 nt, Homo sapiens
cuaacaaugacauuua

SEQ ID NO: 1143516 - RNA, 18 nt, Homo sapiens
cuaacacgugaugugaua

SEQ ID NO: 1143517 - RNA, 16 nt, Homo sapiens
cuaacaggcuguagau

SEQ ID NO: 1143518 - RNA, 23 nt, Homo sapiens
cuaacauaccguuuauaaugcca

SEQ ID NO: 1143519 - RNA, 16 nt, Homo sapiens
cuaacaugaguaucau

SEQ ID NO: 1143520 - RNA, 20 nt, Homo sapiens
cuaacauguaauugcagaua

SEQ ID NO: 1143521 - RNA, 17 nt, Homo sapiens
cuaaccaaagagucucu

SEQ ID NO: 1143522 - RNA, 16 nt, Homo sapiens
cuaaccccaccacacc

SEQ ID NO: 1143523 - RNA, 23 nt, Homo sapiens
cuaacccccagcccacagagccu

SEQ ID NO: 1143524 - RNA, 14 nt, Homo sapiens
cuaacccucuguca

SEQ ID NO: 1143525 - RNA, 22 nt, Homo sapiens
cuaaccugccgagaguccauca

SEQ ID NO: 1143526 - RNA, 13 nt, Homo sapiens
cuaaccugugacc

SEQ ID NO: 1143527 - RNA, 19 nt, Homo sapiens
cuaacuaaccacauuuuag

SEQ ID NO: 1143528 - RNA, 20 nt, Homo sapiens
cuaagaagugguguuccaug

SEQ ID NO: 1143529 - RNA, 13 nt, Homo sapiens
cuaagacauguaa

SEQ ID NO: 1143530 - RNA, 16 nt, Homo sapiens
cuaagauucuaaaggu

SEQ ID NO: 1143531 - RNA, 15 nt, Homo sapiens
cuaagcagaccacug

SEQ ID NO: 1143532 - RNA, 17 nt, Homo sapiens
cuaagcagaccacugau

SEQ ID NO: 1143533 - RNA, 17 nt, Homo sapiens
cuaagcccccacuacaa

SEQ ID NO: 1143534 - RNA, 17 nt, Homo sapiens
cuaagcuucacuguaaa

SEQ ID NO: 1143535 - RNA, 22 nt, Homo sapiens
cuaaggagaagcuaauaugauu

SEQ ID NO: 1143536 - RNA, 14 nt, Homo sapiens
cuaagggggaccau

SEQ ID NO: 1143537 - RNA, 15 nt, Homo sapiens
cuaaguuauuguuaa

SEQ ID NO: 1143538 - RNA, 21 nt, Homo sapiens
cuaaguuauuuuaugacauga

SEQ ID NO: 1143539 - RNA, 19 nt, Homo sapiens
cuaaguuucuaagauucua

SEQ ID NO: 1143540 - RNA, 18 nt, Homo sapiens
cuaauaaacagacuguuu

SEQ ID NO: 1143541 - RNA, 13 nt, Homo sapiens
cuaauaugccuag

SEQ ID NO: 1143542 - RNA, 18 nt, Homo sapiens
cuaauaugccuagcacaa

SEQ ID NO: 1143543 - RNA, 19 nt, Homo sapiens
cuaauauuagggaguaaaa

SEQ ID NO: 1143544 - RNA, 22 nt, Homo sapiens
cuaaucaauguacaagacuuua

SEQ ID NO: 1143545 - RNA, 20 nt, Homo sapiens
cuaaucacaugugcugcaaa

SEQ ID NO: 1143546 - RNA, 19 nt, Homo sapiens
cuaaucauccaaugcucaa

SEQ ID NO: 1143547 - RNA, 16 nt, Homo sapiens
cugaaacagcugccac

SEQ ID NO: 1143548 - RNA, 20 nt, Homo sapiens
cugaaacccauuuacuuagg

SEQ ID NO: 1143549 - RNA, 13 nt, Homo sapiens
cugaaacuugaac

SEQ ID NO: 1143550 - RNA, 14 nt, Homo sapiens
cugaaagcacugua

SEQ ID NO: 1143551 - RNA, 15 nt, Homo sapiens
cugaaauagaggcua

SEQ ID NO: 1143552 - RNA, 21 nt, Homo sapiens
cugaaauauuuaggugucuau

SEQ ID NO: 1143553 - RNA, 24 nt, Homo sapiens
cugaaaucugucaagaguaguuau

SEQ ID NO: 1143554 - RNA, 20 nt, Homo sapiens
cugaaauggaauucccaugc

SEQ ID NO: 1143555 - RNA, 22 nt, Homo sapiens
cugaaauucuucaacuuggaaa

SEQ ID NO: 1143556 - RNA, 14 nt, Homo sapiens
cugaacauugcacu

SEQ ID NO: 1143557 - RNA, 14 nt, Homo sapiens
cugaacguagcaua

SEQ ID NO: 1143558 - RNA, 18 nt, Homo sapiens
cugaacgucuccuagcca

SEQ ID NO: 1143559 - RNA, 19 nt, Homo sapiens
cugaacuaaucugauguua

SEQ ID NO: 1143560 - RNA, 15 nt, Homo sapiens
cugaacugacugaac

SEQ ID NO: 1143561 - RNA, 22 nt, Homo sapiens
cugaacuggagccaugggcaca

SEQ ID NO: 1143562 - RNA, 19 nt, Homo sapiens
cugaaggcugaaagacagg

SEQ ID NO: 1143563 - RNA, 21 nt, Homo sapiens
cugaagggaaggcaaaggcag

SEQ ID NO: 1143564 - RNA, 20 nt, Homo sapiens
cugaagggcaucaugcaucu

SEQ ID NO: 1143565 - RNA, 15 nt, Homo sapiens
cugaauaaaccaaga

SEQ ID NO: 1143566 - RNA, 20 nt, Homo sapiens
cugaauacauucugcuuuca

SEQ ID NO: 1143567 - RNA, 13 nt, Homo sapiens
cugaauacugcag

SEQ ID NO: 1143568 - RNA, 23 nt, Homo sapiens
cugaauagcagaagguugcaccu

SEQ ID NO: 1143569 - RNA, 12 nt, Homo sapiens
cugaaucuaccu

SEQ ID NO: 1143570 - RNA, 15 nt, Homo sapiens
cugaauggcaaugaa

SEQ ID NO: 1143571 - RNA, 13 nt, Homo sapiens
cugaauucucugc

SEQ ID NO: 1143572 - RNA, 19 nt, Homo sapiens
cugaauucuucuagcuccu

SEQ ID NO: 1143573 - RNA, 19 nt, Homo sapiens
cugacaaagugugucucaa

SEQ ID NO: 1143574 - RNA, 22 nt, Homo sapiens
cugacacuucaaggugacagaa

SEQ ID NO: 1143575 - RNA, 17 nt, Homo sapiens
cugacagaggugucauc

SEQ ID NO: 1143576 - RNA, 13 nt, Homo sapiens
cugacagcacucc

SEQ ID NO: 1143577 - RNA, 14 nt, Homo sapiens
cugacagcacuccu

SEQ ID NO: 1143578 - RNA, 13 nt, Homo sapiens
cugacaugucuca

SEQ ID NO: 1143579 - RNA, 15 nt, Homo sapiens
cugacauuagauuga

SEQ ID NO: 1143580 - RNA, 22 nt, Homo sapiens
cugacauuagauugaugugcac

SEQ ID NO: 1143581 - RNA, 16 nt, Homo sapiens
cugacauugccaaaaa

SEQ ID NO: 1143582 - RNA, 18 nt, Homo sapiens
cugacauuuaucaggcac

SEQ ID NO: 1143583 - RNA, 17 nt, Homo sapiens
cugaccaagugcuggcc

SEQ ID NO: 1143584 - RNA, 17 nt, Homo sapiens
cugaccacagcacagcc

SEQ ID NO: 1143585 - RNA, 16 nt, Homo sapiens
cugaccauuuggucag

SEQ ID NO: 1143586 - RNA, 15 nt, Homo sapiens
cugacccaaaugaau

SEQ ID NO: 1143587 - RNA, 23 nt, Homo sapiens
cugacccagaggguggguguuca

SEQ ID NO: 1143588 - RNA, 11 nt, Homo sapiens
cugacccugua

SEQ ID NO: 1143589 - RNA, 19 nt, Homo sapiens
cugacccuguaaaauggag

SEQ ID NO: 1143590 - RNA, 16 nt, Homo sapiens
cugacccugugcccca

SEQ ID NO: 1143591 - RNA, 15 nt, Homo sapiens
cugaccugagccaga

SEQ ID NO: 1143592 - RNA, 16 nt, Homo sapiens
cugacucaacauggag

SEQ ID NO: 1143593 - RNA, 15 nt, Homo sapiens
cugacuggugcugca

SEQ ID NO: 1143594 - RNA, 13 nt, Homo sapiens
cugagaaacacua

SEQ ID NO: 1143595 - RNA, 12 nt, Homo sapiens
cugagaaagccc

SEQ ID NO: 1143596 - RNA, 22 nt, Homo sapiens
cugagacaggagaaacacuuga

SEQ ID NO: 1143597 - RNA, 23 nt, Homo sapiens
cugagacaggagaaacacuugaa

SEQ ID NO: 1143598 - RNA, 21 nt, Homo sapiens
cugagacagguuaagggguga

SEQ ID NO: 1143599 - RNA, 15 nt, Homo sapiens
cugagagaaccucac

SEQ ID NO: 1143600 - RNA, 19 nt, Homo sapiens
cugagcaaaucaccacaaa

SEQ ID NO: 1143601 - RNA, 20 nt, Homo sapiens
cugagcaaaucaccacaaac

SEQ ID NO: 1143602 - RNA, 16 nt, Homo sapiens
cugagcaacaugguga

SEQ ID NO: 1143603 - RNA, 18 nt, Homo sapiens
cugagcacagcugcauua

SEQ ID NO: 1143604 - RNA, 13 nt, Homo sapiens
cugagcaucacua

SEQ ID NO: 1143605 - RNA, 21 nt, Homo sapiens
cugagcgggcuugugauaugc

SEQ ID NO: 1143606 - RNA, 20 nt, Homo sapiens
cugagcugccuguaacuuga

SEQ ID NO: 1143607 - RNA, 16 nt, Homo sapiens
cugagcugcuaaaaua

SEQ ID NO: 1143608 - RNA, 13 nt, Homo sapiens
cugagcugugcag

SEQ ID NO: 1143609 - RNA, 17 nt, Homo sapiens
cugaggacacucagugu

SEQ ID NO: 1143610 - RNA, 14 nt, Homo sapiens
cugaggacauucca

SEQ ID NO: 1143611 - RNA, 16 nt, Homo sapiens
cugaggacuaugccau

SEQ ID NO: 1143612 - RNA, 22 nt, Homo sapiens
cugaggcacaagaaucacuuga

SEQ ID NO: 1143613 - RNA, 14 nt, Homo sapiens
cugaggcagggaag

SEQ ID NO: 1143614 - RNA, 15 nt, Homo sapiens
cugaggccacacuca

SEQ ID NO: 1143615 - RNA, 20 nt, Homo sapiens
cugaggggauaccauaaaaa

SEQ ID NO: 1143616 - RNA, 16 nt, Homo sapiens
cugagggguggccauc

SEQ ID NO: 1143617 - RNA, 14 nt, Homo sapiens
cugaggugcaaagg

SEQ ID NO: 1143618 - RNA, 17 nt, Homo sapiens
cugagguggcuaagggg

SEQ ID NO: 1143619 - RNA, 22 nt, Homo sapiens
cugagguggcuaagggggacca

SEQ ID NO: 1143620 - RNA, 14 nt, Homo sapiens
cugagguuaugaac

SEQ ID NO: 1143621 - RNA, 15 nt, Homo sapiens
cugaguauaaauuua

SEQ ID NO: 1143622 - RNA, 18 nt, Homo sapiens
cugaguauaaauuuacuu

SEQ ID NO: 1143623 - RNA, 22 nt, Homo sapiens
cugaguauugauaaacuuugaa

SEQ ID NO: 1143624 - RNA, 22 nt, Homo sapiens
cugagucccucacguuucuucc

SEQ ID NO: 1143625 - RNA, 10 nt, Homo sapiens
cugaguucag

SEQ ID NO: 1143626 - RNA, 18 nt, Homo sapiens
cugauaagagaaucaaca

SEQ ID NO: 1143627 - RNA, 19 nt, Homo sapiens
cugauaagcuaacaccaga

SEQ ID NO: 1143628 - RNA, 15 nt, Homo sapiens
cugauagaaccuccg

SEQ ID NO: 1143629 - RNA, 19 nt, Homo sapiens
cugauagaauuauuucaca

SEQ ID NO: 1143630 - RNA, 17 nt, Homo sapiens
cugauauucagaauuau

SEQ ID NO: 1143631 - RNA, 18 nt, Homo sapiens
cugauauuggacaguaaa

SEQ ID NO: 1143632 - RNA, 13 nt, Homo sapiens
cugauauuuacug

SEQ ID NO: 1143633 - RNA, 21 nt, Homo sapiens
cugauauuuacuggaaaccua

SEQ ID NO: 1143634 - RNA, 15 nt, Homo sapiens
cugaucaaugacaga

SEQ ID NO: 1143635 - RNA, 13 nt, Homo sapiens
cugaucccagacc

SEQ ID NO: 1143636 - RNA, 18 nt, Homo sapiens
cugauccuccaacagcug

SEQ ID NO: 1143637 - RNA, 18 nt, Homo sapiens
cugauccuuauugcauug

SEQ ID NO: 1143638 - RNA, 13 nt, Homo sapiens
cugaucuauacaa

SEQ ID NO: 1143639 - RNA, 15 nt, Homo sapiens
cugaugaaucacugu

SEQ ID NO: 1143640 - RNA, 15 nt, Homo sapiens
cugaugggaaaacug

SEQ ID NO: 1143641 - RNA, 16 nt, Homo sapiens
cugauggucauaucca

SEQ ID NO: 1143642 - RNA, 16 nt, Homo sapiens
cugaugugcaguuuaa

SEQ ID NO: 1143643 - RNA, 22 nt, Homo sapiens
cugauguguacaucccauguaa

SEQ ID NO: 1143644 - RNA, 16 nt, Homo sapiens
cugauguucaguguaa

SEQ ID NO: 1143645 - RNA, 22 nt, Homo sapiens
cugauuaccugaaggacagcug

SEQ ID NO: 1143646 - RNA, 17 nt, Homo sapiens
cugauuugcaggauuuu

SEQ ID NO: 1143647 - RNA, 17 nt, Homo sapiens
cugcaaaucugccugau

SEQ ID NO: 1143648 - RNA, 19 nt, Homo sapiens
cugcaaaugugcaguucag

SEQ ID NO: 1143649 - RNA, 20 nt, Homo sapiens
cugcaacuuaaugcucugau

SEQ ID NO: 1143650 - RNA, 14 nt, Homo sapiens
cugcaagauucuga

SEQ ID NO: 1143651 - RNA, 13 nt, Homo sapiens
cugcaaguaucca

SEQ ID NO: 1143652 - RNA, 17 nt, Homo sapiens
cugcaagugacaucucu

SEQ ID NO: 1143653 - RNA, 18 nt, Homo sapiens
cugcaauaugaauucaag

SEQ ID NO: 1143654 - RNA, 22 nt, Homo sapiens
cugcacacagggugguggcaca

SEQ ID NO: 1143655 - RNA, 15 nt, Homo sapiens
cugcacagagucagg

SEQ ID NO: 1143656 - RNA, 15 nt, Homo sapiens
cugcaccccaagaga

SEQ ID NO: 1143657 - RNA, 22 nt, Homo sapiens
cugcaccgacccgaggcccaga

SEQ ID NO: 1143658 - RNA, 19 nt, Homo sapiens
cugcaccggggccugggca

SEQ ID NO: 1143659 - RNA, 17 nt, Homo sapiens
cugcaccguacugugga

SEQ ID NO: 1143660 - RNA, 19 nt, Homo sapiens
cugcacgugaccucugaca

SEQ ID NO: 1143661 - RNA, 15 nt, Homo sapiens
cugcacuuacaggcc

SEQ ID NO: 1143662 - RNA, 17 nt, Homo sapiens
cugcagaugaucaggga

SEQ ID NO: 1143663 - RNA, 19 nt, Homo sapiens
cugcagccaggccacuggc

SEQ ID NO: 1143664 - RNA, 20 nt, Homo sapiens
cugcagcccagagaccuuca

SEQ ID NO: 1143665 - RNA, 23 nt, Homo sapiens
cugcagcccugagaaagcccugu

SEQ ID NO: 1143666 - RNA, 16 nt, Homo sapiens
cugcagccucaaccuc

SEQ ID NO: 1143667 - RNA, 18 nt, Homo sapiens
cugcagcgaguacuuccc

SEQ ID NO: 1143668 - RNA, 15 nt, Homo sapiens
cugcagcucagggac

SEQ ID NO: 1143669 - RNA, 23 nt, Homo sapiens
cugcagcucagggacuggcacac

SEQ ID NO: 1143670 - RNA, 20 nt, Homo sapiens
cugcagcugcuuguugucaa

SEQ ID NO: 1143671 - RNA, 15 nt, Homo sapiens
cugcaggcagggcug

SEQ ID NO: 1143672 - RNA, 23 nt, Homo sapiens
cugcagucccauccucuugucag

SEQ ID NO: 1143673 - RNA, 18 nt, Homo sapiens
cugcagucgcuugccaaa

SEQ ID NO: 1143674 - RNA, 15 nt, Homo sapiens
cugcaguuccaucag

SEQ ID NO: 1143675 - RNA, 21 nt, Homo sapiens
cugcauaaaauagagugcauu

SEQ ID NO: 1143676 - RNA, 21 nt, Homo sapiens
cugcauaccaaccugggcaau

SEQ ID NO: 1143677 - RNA, 13 nt, Homo sapiens
cugcaucuaagca

SEQ ID NO: 1143678 - RNA, 19 nt, Homo sapiens
cugcaucugauaaaguuga

SEQ ID NO: 1143679 - RNA, 13 nt, Homo sapiens
cugggcauugcuu

SEQ ID NO: 1143680 - RNA, 23 nt, Homo sapiens
cugggccucagcaagccaugccc

SEQ ID NO: 1143681 - RNA, 20 nt, Homo sapiens
cugggccuggagggggagca

SEQ ID NO: 1143682 - RNA, 14 nt, Homo sapiens
cugggcuauauucc

SEQ ID NO: 1143683 - RNA, 17 nt, Homo sapiens
cugggcucaagugaucc

SEQ ID NO: 1143684 - RNA, 14 nt, Homo sapiens
cugggcucagcuca

SEQ ID NO: 1143685 - RNA, 16 nt, Homo sapiens
cugggcuuucacgggc

SEQ ID NO: 1143686 - RNA, 14 nt, Homo sapiens
cuggggacaccugc

SEQ ID NO: 1143687 - RNA, 17 nt, Homo sapiens
cuggggaggcugaggca

SEQ ID NO: 1143688 - RNA, 22 nt, Homo sapiens
cuggggaggugagagugcagaa

SEQ ID NO: 1143689 - RNA, 15 nt, Homo sapiens
cuggggcaagaugag

SEQ ID NO: 1143690 - RNA, 15 nt, Homo sapiens
cuggggccuguugaa

SEQ ID NO: 1143691 - RNA, 16 nt, Homo sapiens
cuggggggacccagug

SEQ ID NO: 1143692 - RNA, 17 nt, Homo sapiens
cuggggggacccagugc

SEQ ID NO: 1143693 - RNA, 14 nt, Homo sapiens
cugggucagugguc

SEQ ID NO: 1143694 - RNA, 15 nt, Homo sapiens
cugggucugaccugg

SEQ ID NO: 1143695 - RNA, 15 nt, Homo sapiens
cugggugacagagug

SEQ ID NO: 1143696 - RNA, 20 nt, Homo sapiens
cuggguugaucuagaugucu

SEQ ID NO: 1143697 - RNA, 21 nt, Homo sapiens
cugguaauggguaagguucua

SEQ ID NO: 1143698 - RNA, 20 nt, Homo sapiens
cugguaugaaacaaacuacu

SEQ ID NO: 1143699 - RNA, 17 nt, Homo sapiens
cugguauggugcuaaua

SEQ ID NO: 1143700 - RNA, 14 nt, Homo sapiens
cugguaugugccag

SEQ ID NO: 1143701 - RNA, 18 nt, Homo sapiens
cuggugcagucauuauga

SEQ ID NO: 1143702 - RNA, 15 nt, Homo sapiens
cugguggcacaggag

SEQ ID NO: 1143703 - RNA, 23 nt, Homo sapiens
cugguggcugggcccagcagggg

SEQ ID NO: 1143704 - RNA, 21 nt, Homo sapiens
cuggugggaaaaugcacacau

SEQ ID NO: 1143705 - RNA, 18 nt, Homo sapiens
cuggugguggcucgggag

SEQ ID NO: 1143706 - RNA, 16 nt, Homo sapiens
cuggugucaccccaga

SEQ ID NO: 1143707 - RNA, 13 nt, Homo sapiens
cugguucuugccu

SEQ ID NO: 1143708 - RNA, 13 nt, Homo sapiens
cugguuuucacau

SEQ ID NO: 1143709 - RNA, 12 nt, Homo sapiens
cuguaaauaugu

SEQ ID NO: 1143710 - RNA, 19 nt, Homo sapiens
cuguaaauauuuuucacau

SEQ ID NO: 1143711 - RNA, 14 nt, Homo sapiens
cuguaaccucuuca

SEQ ID NO: 1143712 - RNA, 15 nt, Homo sapiens
cuguaaucccaacac

SEQ ID NO: 1143713 - RNA, 19 nt, Homo sapiens
cuguaaucccaacacuuug

SEQ ID NO: 1143714 - RNA, 21 nt, Homo sapiens
cuguaaucccaacacuuuggg

SEQ ID NO: 1143715 - RNA, 18 nt, Homo sapiens
cuguaaucccagcacuuu

SEQ ID NO: 1143716 - RNA, 14 nt, Homo sapiens
cuguaaucccagcu

SEQ ID NO: 1143717 - RNA, 22 nt, Homo sapiens
cuguacaaaggggaaagaacau

SEQ ID NO: 1143718 - RNA, 21 nt, Homo sapiens
cuguacaaugaacccccauga

SEQ ID NO: 1143719 - RNA, 14 nt, Homo sapiens
cuguacaugcauug

SEQ ID NO: 1143720 - RNA, 12 nt, Homo sapiens
cuguacccagug

SEQ ID NO: 1143721 - RNA, 14 nt, Homo sapiens
cuguacugaaggug

SEQ ID NO: 1143722 - RNA, 14 nt, Homo sapiens
cuguagaaaugaug

SEQ ID NO: 1143723 - RNA, 13 nt, Homo sapiens
cuguagaugaugu

SEQ ID NO: 1143724 - RNA, 17 nt, Homo sapiens
cuguagauucacauaca

SEQ ID NO: 1143725 - RNA, 18 nt, Homo sapiens
cuguagauucuguggaac

SEQ ID NO: 1143726 - RNA, 23 nt, Homo sapiens
cuguagggugcugcgcagcaucc

SEQ ID NO: 1143727 - RNA, 21 nt, Homo sapiens
cuguagguacguuuuauauua

SEQ ID NO: 1143728 - RNA, 13 nt, Homo sapiens
cuguaguccaguc

SEQ ID NO: 1143729 - RNA, 22 nt, Homo sapiens
cuguaguccagucucuccagca

SEQ ID NO: 1143730 - RNA, 22 nt, Homo sapiens
cuguaguugcguggacucugca

SEQ ID NO: 1143731 - RNA, 13 nt, Homo sapiens
cuguauacauuac

SEQ ID NO: 1143732 - RNA, 23 nt, Homo sapiens
cuguauagaaugguaaaauacca

SEQ ID NO: 1143733 - RNA, 17 nt, Homo sapiens
cuguauauagcucuaca

SEQ ID NO: 1143734 - RNA, 14 nt, Homo sapiens
cuguauauuuugca

SEQ ID NO: 1143735 - RNA, 19 nt, Homo sapiens
cuguauccuuuaauuucag

SEQ ID NO: 1143736 - RNA, 16 nt, Homo sapiens
cuguauuauugcaauu

SEQ ID NO: 1143737 - RNA, 18 nt, Homo sapiens
cuguauucccaguuacuu

SEQ ID NO: 1143738 - RNA, 14 nt, Homo sapiens
cuguauugagcaag

SEQ ID NO: 1143739 - RNA, 22 nt, Homo sapiens
cugucaaguguuuuacuaucuc

SEQ ID NO: 1143740 - RNA, 16 nt, Homo sapiens
cugucagaaucacaua

SEQ ID NO: 1143741 - RNA, 17 nt, Homo sapiens
cugucagaugucacaua

SEQ ID NO: 1143742 - RNA, 13 nt, Homo sapiens
cugucagccugac

SEQ ID NO: 1143743 - RNA, 11 nt, Homo sapiens
cugucagggac

SEQ ID NO: 1143744 - RNA, 21 nt, Homo sapiens
cugucauuuuucuagcauuuu

SEQ ID NO: 1143745 - RNA, 12 nt, Homo sapiens
cuguccagcucc

SEQ ID NO: 1143746 - RNA, 19 nt, Homo sapiens
cugucccucacagcacuag

SEQ ID NO: 1143747 - RNA, 17 nt, Homo sapiens
cuguccucaccgucucg

SEQ ID NO: 1143748 - RNA, 20 nt, Homo sapiens
cuguccucagccuugccaga

SEQ ID NO: 1143749 - RNA, 15 nt, Homo sapiens
cuguccuccacacaa

SEQ ID NO: 1143750 - RNA, 16 nt, Homo sapiens
cugucuaaagccuuaa

SEQ ID NO: 1143751 - RNA, 17 nt, Homo sapiens
cugucuaucucuaauaa

SEQ ID NO: 1143752 - RNA, 13 nt, Homo sapiens
cugucucaaaaaa

SEQ ID NO: 1143753 - RNA, 14 nt, Homo sapiens
cugucucaggguga

SEQ ID NO: 1143754 - RNA, 13 nt, Homo sapiens
cugucuccauggc

SEQ ID NO: 1143755 - RNA, 16 nt, Homo sapiens
cugucucccgggacua

SEQ ID NO: 1143756 - RNA, 15 nt, Homo sapiens
cugucuccuuucacc

SEQ ID NO: 1143757 - RNA, 18 nt, Homo sapiens
cugucucucuugucacau

SEQ ID NO: 1143758 - RNA, 19 nt, Homo sapiens
cugucucuuucaugaguuu

SEQ ID NO: 1143759 - RNA, 19 nt, Homo sapiens
cugucucuuuccacuuugu

SEQ ID NO: 1143760 - RNA, 22 nt, Homo sapiens
cugucugacuuauaauuugcau

SEQ ID NO: 1143761 - RNA, 14 nt, Homo sapiens
cugucuguccuucu

SEQ ID NO: 1143762 - RNA, 14 nt, Homo sapiens
cugucuuuguggac

SEQ ID NO: 1143763 - RNA, 13 nt, Homo sapiens
cugugaacacugg

SEQ ID NO: 1143764 - RNA, 16 nt, Homo sapiens
cugugacccacuucuc

SEQ ID NO: 1143765 - RNA, 23 nt, Homo sapiens
cugugacccacuucucaucacac

SEQ ID NO: 1143766 - RNA, 13 nt, Homo sapiens
cugugacuauaaa

SEQ ID NO: 1143767 - RNA, 22 nt, Homo sapiens
cugugacuauaaagcuguuauu

SEQ ID NO: 1143768 - RNA, 15 nt, Homo sapiens
cugugacugauauga

SEQ ID NO: 1143769 - RNA, 14 nt, Homo sapiens
cugugacugugucc

SEQ ID NO: 1143770 - RNA, 19 nt, Homo sapiens
cugugagcccagcuggguc

SEQ ID NO: 1143771 - RNA, 18 nt, Homo sapiens
cugugagggagugcagaa

SEQ ID NO: 1143772 - RNA, 16 nt, Homo sapiens
cugugauuacugcaau

SEQ ID NO: 1143773 - RNA, 19 nt, Homo sapiens
cugugcacaaaacccagac

SEQ ID NO: 1143774 - RNA, 15 nt, Homo sapiens
cugugcagaccuuac

SEQ ID NO: 1143775 - RNA, 22 nt, Homo sapiens
cugugcagguggggagacuggg

SEQ ID NO: 1143776 - RNA, 16 nt, Homo sapiens
cugugcauuguaggau

SEQ ID NO: 1143777 - RNA, 13 nt, Homo sapiens
cugugccaguucu

SEQ ID NO: 1143778 - RNA, 22 nt, Homo sapiens
cugugccccagcagugccuugu

SEQ ID NO: 1143779 - RNA, 22 nt, Homo sapiens
cugugccccuugacaacuggca

SEQ ID NO: 1143780 - RNA, 20 nt, Homo sapiens
cugugcccggggaaaggcaa

SEQ ID NO: 1143781 - RNA, 18 nt, Homo sapiens
cugugccuccaucagcua

SEQ ID NO: 1143782 - RNA, 10 nt, Homo sapiens
cugugccugg

SEQ ID NO: 1143783 - RNA, 15 nt, Homo sapiens
cugugcuacguguga

SEQ ID NO: 1143784 - RNA, 15 nt, Homo sapiens
cugugcucacuaccu

SEQ ID NO: 1143785 - RNA, 22 nt, Homo sapiens
cugugcugaacauaacuucuca

SEQ ID NO: 1143786 - RNA, 22 nt, Homo sapiens
cugugcugcccugaagaauggc

SEQ ID NO: 1143787 - RNA, 16 nt, Homo sapiens
cugugcugggugagcu

SEQ ID NO: 1143788 - RNA, 19 nt, Homo sapiens
cugugcugggugagcucuu

SEQ ID NO: 1143789 - RNA, 21 nt, Homo sapiens
cuguggacguggguugcacug

SEQ ID NO: 1143790 - RNA, 12 nt, Homo sapiens
cuguggagcucu

SEQ ID NO: 1143791 - RNA, 23 nt, Homo sapiens
cuguggccuuuuggaaauccaaa

SEQ ID NO: 1143792 - RNA, 15 nt, Homo sapiens
cuguggcucacguga

SEQ ID NO: 1143793 - RNA, 18 nt, Homo sapiens
cuguggcugucuggaucc

SEQ ID NO: 1143794 - RNA, 19 nt, Homo sapiens
cuguggcuguggagacaau

SEQ ID NO: 1143795 - RNA, 18 nt, Homo sapiens
cugugggaagcucccaga

SEQ ID NO: 1143796 - RNA, 18 nt, Homo sapiens
cugugggauaucacauca

SEQ ID NO: 1143797 - RNA, 12 nt, Homo sapiens
cuguggggagcc

SEQ ID NO: 1143798 - RNA, 21 nt, Homo sapiens
cugugggucugggagucacac

SEQ ID NO: 1143799 - RNA, 16 nt, Homo sapiens
cugugguaaaugccac

SEQ ID NO: 1143800 - RNA, 21 nt, Homo sapiens
cuguguccccuucauccuuga

SEQ ID NO: 1143801 - RNA, 12 nt, Homo sapiens
cugugucccugc

SEQ ID NO: 1143802 - RNA, 12 nt, Homo sapiens
cuguguccuccc

SEQ ID NO: 1143803 - RNA, 19 nt, Homo sapiens
cuguguccuugcaccugca

SEQ ID NO: 1143804 - RNA, 16 nt, Homo sapiens
cugugucuucuccacc

SEQ ID NO: 1143805 - RNA, 16 nt, Homo sapiens
cuguguguccaaaacu

SEQ ID NO: 1143806 - RNA, 14 nt, Homo sapiens
cuguguuacuugaa

SEQ ID NO: 1143807 - RNA, 18 nt, Homo sapiens
cuguguucuuguuuucag

SEQ ID NO: 1143808 - RNA, 14 nt, Homo sapiens
cuguuaaccuauga

SEQ ID NO: 1143809 - RNA, 15 nt, Homo sapiens
cuguuacacaugaca

SEQ ID NO: 1143810 - RNA, 20 nt, Homo sapiens
cuguuaccugaucaaugaca

SEQ ID NO: 1143811 - RNA, 16 nt, Homo sapiens
cuguuacuauuccuuu

SEQ ID NO: 1143812 - RNA, 15 nt, Homo sapiens
gccacaccucuccaa

SEQ ID NO: 1143813 - RNA, 22 nt, Homo sapiens
gccacacucagcacaaggccau

SEQ ID NO: 1143814 - RNA, 16 nt, Homo sapiens
gccacacugugacaca

SEQ ID NO: 1143815 - RNA, 15 nt, Homo sapiens
gccacagagcuacau

SEQ ID NO: 1143816 - RNA, 23 nt, Homo sapiens
gccacaguuuccucaucugucca

SEQ ID NO: 1143817 - RNA, 11 nt, Homo sapiens
gccacauggga

SEQ ID NO: 1143818 - RNA, 18 nt, Homo sapiens
gccacauuuggaauacuu

SEQ ID NO: 1143819 - RNA, 22 nt, Homo sapiens
gccaccacccuacuucauuuuc

SEQ ID NO: 1143820 - RNA, 18 nt, Homo sapiens
gccaccagccacuuuagu

SEQ ID NO: 1143821 - RNA, 16 nt, Homo sapiens
gccacccauucuuccc

SEQ ID NO: 1143822 - RNA, 19 nt, Homo sapiens
gccacccucccagcucuga

SEQ ID NO: 1143823 - RNA, 15 nt, Homo sapiens
gccaccuacaauaca

SEQ ID NO: 1143824 - RNA, 12 nt, Homo sapiens
gccaccuagucc

SEQ ID NO: 1143825 - RNA, 23 nt, Homo sapiens
gccaccucucagggccacuggca

SEQ ID NO: 1143826 - RNA, 13 nt, Homo sapiens
gccaccuggcgcu

SEQ ID NO: 1143827 - RNA, 16 nt, Homo sapiens
gccacgaggugcaaca

SEQ ID NO: 1143828 - RNA, 19 nt, Homo sapiens
gccacucagagcucccuca

SEQ ID NO: 1143829 - RNA, 19 nt, Homo sapiens
gccacuccccuccacucuc

SEQ ID NO: 1143830 - RNA, 19 nt, Homo sapiens
gccacucuaccagugcagg

SEQ ID NO: 1143831 - RNA, 16 nt, Homo sapiens
gccacucuuagcuaaa

SEQ ID NO: 1143832 - RNA, 24 nt, Homo sapiens
gccacugcgcccagcuauacugua

SEQ ID NO: 1143833 - RNA, 16 nt, Homo sapiens
gccacugguaaugggu

SEQ ID NO: 1143834 - RNA, 14 nt, Homo sapiens
gccacuucaccaag

SEQ ID NO: 1143835 - RNA, 13 nt, Homo sapiens
gccagaaauugau

SEQ ID NO: 1143836 - RNA, 23 nt, Homo sapiens
gccagaacguggcucugcuggcc

SEQ ID NO: 1143837 - RNA, 21 nt, Homo sapiens
gccagacaugguggcaugcac

SEQ ID NO: 1143838 - RNA, 19 nt, Homo sapiens
gccagaccuuaagcucuau

SEQ ID NO: 1143839 - RNA, 16 nt, Homo sapiens
gccagagauaaacuaa

SEQ ID NO: 1143840 - RNA, 17 nt, Homo sapiens
gccagagauccaaaaga

SEQ ID NO: 1143841 - RNA, 15 nt, Homo sapiens
gccagaggcaccuca

SEQ ID NO: 1143842 - RNA, 17 nt, Homo sapiens
gccagauggacuccagc

SEQ ID NO: 1143843 - RNA, 17 nt, Homo sapiens
gccagccagugaccuga

SEQ ID NO: 1143844 - RNA, 16 nt, Homo sapiens
gccaggagaccugcuc

SEQ ID NO: 1143845 - RNA, 18 nt, Homo sapiens
gccaggagaccugcucuc

SEQ ID NO: 1143846 - RNA, 11 nt, Homo sapiens
gccaggagcuc

SEQ ID NO: 1143847 - RNA, 18 nt, Homo sapiens
gccaggcaugguggcuca

SEQ ID NO: 1143848 - RNA, 16 nt, Homo sapiens
gccaggcguguucaua

SEQ ID NO: 1143849 - RNA, 14 nt, Homo sapiens
gccaggcuugccug

SEQ ID NO: 1143850 - RNA, 13 nt, Homo sapiens
gccagggacccaa

SEQ ID NO: 1143851 - RNA, 17 nt, Homo sapiens
gccaggggaguuuccaa

SEQ ID NO: 1143852 - RNA, 21 nt, Homo sapiens
gccagggggaugccacuccuc

SEQ ID NO: 1143853 - RNA, 21 nt, Homo sapiens
gccaggugggcggacaaaagg

SEQ ID NO: 1143854 - RNA, 14 nt, Homo sapiens
gccagguguggaac

SEQ ID NO: 1143855 - RNA, 21 nt, Homo sapiens
gccagucaaaacccaccaaaa

SEQ ID NO: 1143856 - RNA, 13 nt, Homo sapiens
gccaguggugcua

SEQ ID NO: 1143857 - RNA, 21 nt, Homo sapiens
gccaguggugcuaaaugcuac

SEQ ID NO: 1143858 - RNA, 19 nt, Homo sapiens
gccauacuucuguuuccau

SEQ ID NO: 1143859 - RNA, 20 nt, Homo sapiens
gccauacuucuguuuccauc

SEQ ID NO: 1143860 - RNA, 14 nt, Homo sapiens
gccauaggguccug

SEQ ID NO: 1143861 - RNA, 16 nt, Homo sapiens
gccauauaaguuugaa

SEQ ID NO: 1143862 - RNA, 18 nt, Homo sapiens
gccaucaaaaugcuuuuu

SEQ ID NO: 1143863 - RNA, 13 nt, Homo sapiens
gccaucacugagc

SEQ ID NO: 1143864 - RNA, 16 nt, Homo sapiens
gccaucaugccugacu

SEQ ID NO: 1143865 - RNA, 13 nt, Homo sapiens
gccauccaugugc

SEQ ID NO: 1143866 - RNA, 13 nt, Homo sapiens
gccaucuaugcag

SEQ ID NO: 1143867 - RNA, 16 nt, Homo sapiens
gccaucugcuuaccac

SEQ ID NO: 1143868 - RNA, 16 nt, Homo sapiens
gccauguagcagacaa

SEQ ID NO: 1143869 - RNA, 21 nt, Homo sapiens
gccauuacugcauaaaauaga

SEQ ID NO: 1143870 - RNA, 12 nt, Homo sapiens
gccauuauuuaa

SEQ ID NO: 1143871 - RNA, 18 nt, Homo sapiens
gccauugcacuccagccu

SEQ ID NO: 1143872 - RNA, 21 nt, Homo sapiens
gccauugcagcuugaaaaaga

SEQ ID NO: 1143873 - RNA, 16 nt, Homo sapiens
gccauuggcuacugac

SEQ ID NO: 1143874 - RNA, 21 nt, Homo sapiens
gccauuggcuacugacuguau

SEQ ID NO: 1143875 - RNA, 18 nt, Homo sapiens
gccauugggcuacuguag

SEQ ID NO: 1143876 - RNA, 22 nt, Homo sapiens
gccauuuggccaggcuggucuu

SEQ ID NO: 1143877 - RNA, 15 nt, Homo sapiens
gcccaacagcacuuu

SEQ ID NO: 1143878 - RNA, 22 nt, Homo sapiens
gcccaaggaugccuuagcaugu

SEQ ID NO: 1143879 - RNA, 19 nt, Homo sapiens
gcccaagggcagaccuuuc

SEQ ID NO: 1143880 - RNA, 15 nt, Homo sapiens
gcccacacacaggug

SEQ ID NO: 1143881 - RNA, 16 nt, Homo sapiens
gcccacccuccagcuu

SEQ ID NO: 1143882 - RNA, 18 nt, Homo sapiens
gcccacucaggggucacu

SEQ ID NO: 1143883 - RNA, 18 nt, Homo sapiens
gcccacugcuggcugcag

SEQ ID NO: 1143884 - RNA, 13 nt, Homo sapiens
gcccagacccacu

SEQ ID NO: 1143885 - RNA, 14 nt, Homo sapiens
gcccagacccagcc

SEQ ID NO: 1143886 - RNA, 17 nt, Homo sapiens
gcccagagaguccagcu

SEQ ID NO: 1143887 - RNA, 13 nt, Homo sapiens
gcccagcaggggc

SEQ ID NO: 1143888 - RNA, 16 nt, Homo sapiens
gcccagccacauuuca

SEQ ID NO: 1143889 - RNA, 16 nt, Homo sapiens
gcccagccucaucucu

SEQ ID NO: 1143890 - RNA, 14 nt, Homo sapiens
gcccagcuauacug

SEQ ID NO: 1143891 - RNA, 17 nt, Homo sapiens
gcccaggaaacaagggg

SEQ ID NO: 1143892 - RNA, 21 nt, Homo sapiens
gcccaggaucguuuuuuccca

SEQ ID NO: 1143893 - RNA, 14 nt, Homo sapiens
gcccaggccaugug

SEQ ID NO: 1143894 - RNA, 19 nt, Homo sapiens
gcccaggccuccagcucag

SEQ ID NO: 1143895 - RNA, 20 nt, Homo sapiens
gcccaggcuagagugcaaug

SEQ ID NO: 1143896 - RNA, 19 nt, Homo sapiens
gcccaggcuggagugcaau

SEQ ID NO: 1143897 - RNA, 20 nt, Homo sapiens
gcccaggcuggagugcaaug

SEQ ID NO: 1143898 - RNA, 20 nt, Homo sapiens
gcccaggcuggagugcagug

SEQ ID NO: 1143899 - RNA, 17 nt, Homo sapiens
gcccaggcuggucuuga

SEQ ID NO: 1143900 - RNA, 15 nt, Homo sapiens
gcccagggugcagug

SEQ ID NO: 1143901 - RNA, 15 nt, Homo sapiens
gcccaguccuuccac

SEQ ID NO: 1143902 - RNA, 18 nt, Homo sapiens
gcccagucuggcaugcag

SEQ ID NO: 1143903 - RNA, 13 nt, Homo sapiens
gcccagucuuuca

SEQ ID NO: 1143904 - RNA, 11 nt, Homo sapiens
gcccagugcau

SEQ ID NO: 1143905 - RNA, 19 nt, Homo sapiens
gcccagugcaugguggcca

SEQ ID NO: 1143906 - RNA, 19 nt, Homo sapiens
gcccaguuagaagcgacuu

SEQ ID NO: 1143907 - RNA, 18 nt, Homo sapiens
gcccauaagcacagauuu

SEQ ID NO: 1143908 - RNA, 13 nt, Homo sapiens
gcccaucugucca

SEQ ID NO: 1143909 - RNA, 23 nt, Homo sapiens
gcccauucucuuccuauuacuug

SEQ ID NO: 1143910 - RNA, 22 nt, Homo sapiens
gccccacccaccccacaccugc

SEQ ID NO: 1143911 - RNA, 18 nt, Homo sapiens
gccccacugcccuucuca

SEQ ID NO: 1143912 - RNA, 15 nt, Homo sapiens
gccccaggaccagcu

SEQ ID NO: 1143913 - RNA, 17 nt, Homo sapiens
gccccaucugugcauuc

SEQ ID NO: 1143914 - RNA, 19 nt, Homo sapiens
gccccaugaagccacagcc

SEQ ID NO: 1143915 - RNA, 22 nt, Homo sapiens
gccccauucccaaagggcacau

SEQ ID NO: 1143916 - RNA, 14 nt, Homo sapiens
gcccccaccgccgg

SEQ ID NO: 1143917 - RNA, 16 nt, Homo sapiens
gcccccaccucagguu

SEQ ID NO: 1143918 - RNA, 15 nt, Homo sapiens
gcccccuccugcaag

SEQ ID NO: 1143919 - RNA, 23 nt, Homo sapiens
gccccgaaccucaccugaccuca

SEQ ID NO: 1143920 - RNA, 17 nt, Homo sapiens
gccccucggcucuggag

SEQ ID NO: 1143921 - RNA, 22 nt, Homo sapiens
gccccucugcaacuggagagaa

SEQ ID NO: 1143922 - RNA, 18 nt, Homo sapiens
gccccuggucaagugcug

SEQ ID NO: 1143923 - RNA, 19 nt, Homo sapiens
gccccugucucggggcuug

SEQ ID NO: 1143924 - RNA, 20 nt, Homo sapiens
gcccgcagccuggcaucugu

SEQ ID NO: 1143925 - RNA, 21 nt, Homo sapiens
gcccgguggcggcagggccag

SEQ ID NO: 1143926 - RNA, 14 nt, Homo sapiens
gcccguaaacacgc

SEQ ID NO: 1143927 - RNA, 16 nt, Homo sapiens
gcccgucggagcugcc

SEQ ID NO: 1143928 - RNA, 19 nt, Homo sapiens
gcccgugcccuaccacaca

SEQ ID NO: 1143929 - RNA, 14 nt, Homo sapiens
gcccuaguaugaaa

SEQ ID NO: 1143930 - RNA, 21 nt, Homo sapiens
gcccucagccccacuucucag

SEQ ID NO: 1143931 - RNA, 16 nt, Homo sapiens
gcccucccgcaccuuc

SEQ ID NO: 1143932 - RNA, 16 nt, Homo sapiens
gcccugcgggugaaca

SEQ ID NO: 1143933 - RNA, 15 nt, Homo sapiens
gcccuggaugugaau

SEQ ID NO: 1143934 - RNA, 18 nt, Homo sapiens
gcccuggcagggggcaug

SEQ ID NO: 1143935 - RNA, 21 nt, Homo sapiens
gcccuggcggguggcugcaag

SEQ ID NO: 1143936 - RNA, 19 nt, Homo sapiens
gcccugggccccaccaccu

SEQ ID NO: 1143937 - RNA, 13 nt, Homo sapiens
gcccuggguccug

SEQ ID NO: 1143938 - RNA, 15 nt, Homo sapiens
gcccugggucuugcc

SEQ ID NO: 1143939 - RNA, 16 nt, Homo sapiens
gcccugggucuugcca

SEQ ID NO: 1143940 - RNA, 18 nt, Homo sapiens
gcccugggucuugccaug

SEQ ID NO: 1143941 - RNA, 22 nt, Homo sapiens
gcccugggucuugccaugugcu

SEQ ID NO: 1143942 - RNA, 15 nt, Homo sapiens
gcccuguaacaggcu

SEQ ID NO: 1143943 - RNA, 16 nt, Homo sapiens
gcccuguucagcuacu

SEQ ID NO: 1143944 - RNA, 21 nt, Homo sapiens
gcccuucccacaggacauuuc

SEQ ID NO: 1143945 - RNA, 18 nt, Homo sapiens
ggaaucccacuaaugcaa

SEQ ID NO: 1143946 - RNA, 15 nt, Homo sapiens
ggaauccucuguguc

SEQ ID NO: 1143947 - RNA, 12 nt, Homo sapiens
ggaauguguuca

SEQ ID NO: 1143948 - RNA, 16 nt, Homo sapiens
ggaauuauauuugaug

SEQ ID NO: 1143949 - RNA, 13 nt, Homo sapiens
ggaauuccagucu

SEQ ID NO: 1143950 - RNA, 15 nt, Homo sapiens
ggaauugauuugcau

SEQ ID NO: 1143951 - RNA, 18 nt, Homo sapiens
ggacaaaauuuguacuau

SEQ ID NO: 1143952 - RNA, 14 nt, Homo sapiens
ggacaaauugagac

SEQ ID NO: 1143953 - RNA, 21 nt, Homo sapiens
ggacaagacccccagcacuug

SEQ ID NO: 1143954 - RNA, 23 nt, Homo sapiens
ggacaagagcagccuggggccaa

SEQ ID NO: 1143955 - RNA, 16 nt, Homo sapiens
ggacacccagggucua

SEQ ID NO: 1143956 - RNA, 11 nt, Homo sapiens
ggacacuguac

SEQ ID NO: 1143957 - RNA, 20 nt, Homo sapiens
ggacacuguggagacuuucu

SEQ ID NO: 1143958 - RNA, 13 nt, Homo sapiens
ggacagaagcagc

SEQ ID NO: 1143959 - RNA, 22 nt, Homo sapiens
ggacagaauuggauacauacac

SEQ ID NO: 1143960 - RNA, 16 nt, Homo sapiens
ggacagacaccgugga

SEQ ID NO: 1143961 - RNA, 17 nt, Homo sapiens
ggacauaaugggguccu

SEQ ID NO: 1143962 - RNA, 16 nt, Homo sapiens
ggacauacacuugcau

SEQ ID NO: 1143963 - RNA, 18 nt, Homo sapiens
ggacauuuuuucagucau

SEQ ID NO: 1143964 - RNA, 23 nt, Homo sapiens
ggaccaaagggggagucccucgu

SEQ ID NO: 1143965 - RNA, 21 nt, Homo sapiens
ggaccaaggagcuuccaucua

SEQ ID NO: 1143966 - RNA, 17 nt, Homo sapiens
ggaccaaugaggugagg

SEQ ID NO: 1143967 - RNA, 18 nt, Homo sapiens
ggaccaugcgacacuggg

SEQ ID NO: 1143968 - RNA, 18 nt, Homo sapiens
ggacccagggaacagcca

SEQ ID NO: 1143969 - RNA, 14 nt, Homo sapiens
ggacccagugcaga

SEQ ID NO: 1143970 - RNA, 15 nt, Homo sapiens
ggacccaucuuccac

SEQ ID NO: 1143971 - RNA, 13 nt, Homo sapiens
ggacccucaggug

SEQ ID NO: 1143972 - RNA, 21 nt, Homo sapiens
ggaccucacccuggggccaga

SEQ ID NO: 1143973 - RNA, 17 nt, Homo sapiens
ggaccuccaagccacug

SEQ ID NO: 1143974 - RNA, 22 nt, Homo sapiens
ggaccucggaugaccauacuca

SEQ ID NO: 1143975 - RNA, 18 nt, Homo sapiens
ggaccugaauucuacuga

SEQ ID NO: 1143976 - RNA, 18 nt, Homo sapiens
ggaccugcgguacaggag

SEQ ID NO: 1143977 - RNA, 23 nt, Homo sapiens
ggaccuucugagccuucuacuua

SEQ ID NO: 1143978 - RNA, 21 nt, Homo sapiens
ggacggcaaggcugagguggc

SEQ ID NO: 1143979 - RNA, 18 nt, Homo sapiens
ggacggcugugggaccag

SEQ ID NO: 1143980 - RNA, 22 nt, Homo sapiens
ggacguggcucagccagcacuu

SEQ ID NO: 1143981 - RNA, 20 nt, Homo sapiens
ggacuagugagucagcaccu

SEQ ID NO: 1143982 - RNA, 22 nt, Homo sapiens
ggacuauuuacaagacugcuga

SEQ ID NO: 1143983 - RNA, 13 nt, Homo sapiens
ggacuauuuucuu

SEQ ID NO: 1143984 - RNA, 12 nt, Homo sapiens
ggacucagagaa

SEQ ID NO: 1143985 - RNA, 18 nt, Homo sapiens
ggacucagggcugguuca

SEQ ID NO: 1143986 - RNA, 22 nt, Homo sapiens
ggacuccucuuaauguuuccaa

SEQ ID NO: 1143987 - RNA, 23 nt, Homo sapiens
ggacucugucuuguucacugcag

SEQ ID NO: 1143988 - RNA, 17 nt, Homo sapiens
ggacugagcgaggaaaa

SEQ ID NO: 1143989 - RNA, 22 nt, Homo sapiens
ggacugcaccauugcugcuccu

SEQ ID NO: 1143990 - RNA, 10 nt, Homo sapiens
ggacugcugg

SEQ ID NO: 1143991 - RNA, 15 nt, Homo sapiens
ggacuggaccagaca

SEQ ID NO: 1143992 - RNA, 11 nt, Homo sapiens
ggacugugaac

SEQ ID NO: 1143993 - RNA, 22 nt, Homo sapiens
ggacugugcucacuaccugggu

SEQ ID NO: 1143994 - RNA, 19 nt, Homo sapiens
ggacuguggcacuugccug

SEQ ID NO: 1143995 - RNA, 18 nt, Homo sapiens
ggacuuucugaagccuca

SEQ ID NO: 1143996 - RNA, 15 nt, Homo sapiens
ggagaaacacuugaa

SEQ ID NO: 1143997 - RNA, 22 nt, Homo sapiens
ggagaaauaugguacucauuaa

SEQ ID NO: 1143998 - RNA, 12 nt, Homo sapiens
ggagaagccauu

SEQ ID NO: 1143999 - RNA, 12 nt, Homo sapiens
ggagacaauguc

SEQ ID NO: 1144000 - RNA, 20 nt, Homo sapiens
ggagaugucucugcaaccau

SEQ ID NO: 1144001 - RNA, 13 nt, Homo sapiens
ggagccaccucuu

SEQ ID NO: 1144002 - RNA, 19 nt, Homo sapiens
ggagccccuucugcucagc

SEQ ID NO: 1144003 - RNA, 13 nt, Homo sapiens
ggagccucagaag

SEQ ID NO: 1144004 - RNA, 23 nt, Homo sapiens
ggagccugggauuucuaugcagu

SEQ ID NO: 1144005 - RNA, 21 nt, Homo sapiens
ggagcguguggcugugccccu

SEQ ID NO: 1144006 - RNA, 12 nt, Homo sapiens
ggagcucuccac

SEQ ID NO: 1144007 - RNA, 15 nt, Homo sapiens
ggagcugaggccaca

SEQ ID NO: 1144008 - RNA, 13 nt, Homo sapiens
ggagcugcugagu

SEQ ID NO: 1144009 - RNA, 16 nt, Homo sapiens
ggagcuggcccucucc

SEQ ID NO: 1144010 - RNA, 23 nt, Homo sapiens
ggagcugggcccgacauggcucc

SEQ ID NO: 1144011 - RNA, 14 nt, Homo sapiens
ggagcuggugagau

SEQ ID NO: 1144012 - RNA, 12 nt, Homo sapiens
ggagcuuugcaa

SEQ ID NO: 1144013 - RNA, 16 nt, Homo sapiens
ggaggaacagauuuga

SEQ ID NO: 1144014 - RNA, 16 nt, Homo sapiens
ggaggacacaguuucu

SEQ ID NO: 1144015 - RNA, 23 nt, Homo sapiens
ggaggagaaaagugacagauccu

SEQ ID NO: 1144016 - RNA, 14 nt, Homo sapiens
ggaggaugcuaaaa

SEQ ID NO: 1144017 - RNA, 15 nt, Homo sapiens
ggaggaugcuaaaaa

SEQ ID NO: 1144018 - RNA, 14 nt, Homo sapiens
ggaggccaaggugg

SEQ ID NO: 1144019 - RNA, 16 nt, Homo sapiens
ggaggccaaggugggc

SEQ ID NO: 1144020 - RNA, 16 nt, Homo sapiens
ggaggccagccaguga

SEQ ID NO: 1144021 - RNA, 21 nt, Homo sapiens
ggaggccagccagugaccuga

SEQ ID NO: 1144022 - RNA, 14 nt, Homo sapiens
ggaggccuuucauc

SEQ ID NO: 1144023 - RNA, 21 nt, Homo sapiens
ggaggcuccagagggcacucu

SEQ ID NO: 1144024 - RNA, 20 nt, Homo sapiens
ggaggcuccucccucugccu

SEQ ID NO: 1144025 - RNA, 21 nt, Homo sapiens
ggaggcugcacuggagccaca

SEQ ID NO: 1144026 - RNA, 13 nt, Homo sapiens
ggaggcugcagcc

SEQ ID NO: 1144027 - RNA, 19 nt, Homo sapiens
ggaggcugcagccaggccu

SEQ ID NO: 1144028 - RNA, 18 nt, Homo sapiens
ggagggaaaagagugccu

SEQ ID NO: 1144029 - RNA, 17 nt, Homo sapiens
ggagggcaguggcacga

SEQ ID NO: 1144030 - RNA, 17 nt, Homo sapiens
ggagggcucagggcagu

SEQ ID NO: 1144031 - RNA, 21 nt, Homo sapiens
ggagggcugucaucugugcac

SEQ ID NO: 1144032 - RNA, 15 nt, Homo sapiens
ggagguaaugaauua

SEQ ID NO: 1144033 - RNA, 14 nt, Homo sapiens
ggagguugcaguga

SEQ ID NO: 1144034 - RNA, 17 nt, Homo sapiens
ggaguaaucuguguaca

SEQ ID NO: 1144035 - RNA, 14 nt, Homo sapiens
ggaguacaccccaa

SEQ ID NO: 1144036 - RNA, 16 nt, Homo sapiens
ggaguagccauucuau

SEQ ID NO: 1144037 - RNA, 14 nt, Homo sapiens
ggagucuugcucug

SEQ ID NO: 1144038 - RNA, 19 nt, Homo sapiens
ggagugaauuaaagccuuu

SEQ ID NO: 1144039 - RNA, 14 nt, Homo sapiens
ggagugauucccaa

SEQ ID NO: 1144040 - RNA, 20 nt, Homo sapiens
ggaguggcucgccaggccaa

SEQ ID NO: 1144041 - RNA, 20 nt, Homo sapiens
ggaguggggaagugugucaa

SEQ ID NO: 1144042 - RNA, 10 nt, Homo sapiens
ggaguuacaa

SEQ ID NO: 1144043 - RNA, 21 nt, Homo sapiens
ggaguuuucuggagugagcac

SEQ ID NO: 1144044 - RNA, 15 nt, Homo sapiens
ggauaaacugcagag

SEQ ID NO: 1144045 - RNA, 18 nt, Homo sapiens
ggauaaccuugugccuug

SEQ ID NO: 1144046 - RNA, 23 nt, Homo sapiens
ggauaauauccagccucccacaa

SEQ ID NO: 1144047 - RNA, 18 nt, Homo sapiens
ggauaauguccaacuaaa

SEQ ID NO: 1144048 - RNA, 22 nt, Homo sapiens
ggauaauguccaacuaaaaaca

SEQ ID NO: 1144049 - RNA, 14 nt, Homo sapiens
ggauagaagccaac

SEQ ID NO: 1144050 - RNA, 22 nt, Homo sapiens
ggauagagcagauucaguguua

SEQ ID NO: 1144051 - RNA, 22 nt, Homo sapiens
ggauagccccgucuggugccag

SEQ ID NO: 1144052 - RNA, 20 nt, Homo sapiens
ggauauccucccuccagaua

SEQ ID NO: 1144053 - RNA, 21 nt, Homo sapiens
ggauauuaaauguugcuuuaa

SEQ ID NO: 1144054 - RNA, 18 nt, Homo sapiens
ggauauuggaaugcacag

SEQ ID NO: 1144055 - RNA, 17 nt, Homo sapiens
ggauauugucagucuuu

SEQ ID NO: 1144056 - RNA, 20 nt, Homo sapiens
ggaucauguaaaugcucaaa

SEQ ID NO: 1144057 - RNA, 21 nt, Homo sapiens
ggauccaauaugacucagaga

SEQ ID NO: 1144058 - RNA, 22 nt, Homo sapiens
ggauccaauaugacucagagaa

SEQ ID NO: 1144059 - RNA, 14 nt, Homo sapiens
ggaucccaccccau

SEQ ID NO: 1144060 - RNA, 20 nt, Homo sapiens
ggaucccacuauauugcaca

SEQ ID NO: 1144061 - RNA, 20 nt, Homo sapiens
ggaucgaggcauggggcaug

SEQ ID NO: 1144062 - RNA, 20 nt, Homo sapiens
ggaucguccuggauucacug

SEQ ID NO: 1144063 - RNA, 17 nt, Homo sapiens
ggaucuggaagggccaa

SEQ ID NO: 1144064 - RNA, 20 nt, Homo sapiens
ggaucuucauggccucagga

SEQ ID NO: 1144065 - RNA, 13 nt, Homo sapiens
ggaucuuuggaca

SEQ ID NO: 1144066 - RNA, 14 nt, Homo sapiens
ggaugauaccauuu

SEQ ID NO: 1144067 - RNA, 16 nt, Homo sapiens
ggaugccgagcacuuu

SEQ ID NO: 1144068 - RNA, 20 nt, Homo sapiens
ggauggcuggcucugcaccu

SEQ ID NO: 1144069 - RNA, 16 nt, Homo sapiens
ggauggguggaccaaa

SEQ ID NO: 1144070 - RNA, 14 nt, Homo sapiens
ggauguauucugua

SEQ ID NO: 1144071 - RNA, 16 nt, Homo sapiens
ggaugucugaacuuug

SEQ ID NO: 1144072 - RNA, 18 nt, Homo sapiens
ggaugucugaacuuuggg

SEQ ID NO: 1144073 - RNA, 16 nt, Homo sapiens
ggaugugcauucucca

SEQ ID NO: 1144074 - RNA, 18 nt, Homo sapiens
ggauuaaaaugagugaaa

SEQ ID NO: 1144075 - RNA, 22 nt, Homo sapiens
ggauuaaugucaauucuugcca

SEQ ID NO: 1144076 - RNA, 13 nt, Homo sapiens
ggauuacaggcau

SEQ ID NO: 1144077 - RNA, 19 nt, Homo sapiens
ggcucugugccuuggucuc

SEQ ID NO: 1144078 - RNA, 17 nt, Homo sapiens
ggcucuuguccaucugu

SEQ ID NO: 1144079 - RNA, 17 nt, Homo sapiens
ggcugaacagugcucug

SEQ ID NO: 1144080 - RNA, 21 nt, Homo sapiens
ggcugacccagauucccuucc

SEQ ID NO: 1144081 - RNA, 18 nt, Homo sapiens
ggcugaggguaccuuuuu

SEQ ID NO: 1144082 - RNA, 15 nt, Homo sapiens
ggcugagggugcccu

SEQ ID NO: 1144083 - RNA, 19 nt, Homo sapiens
ggcugauugggauuuccau

SEQ ID NO: 1144084 - RNA, 13 nt, Homo sapiens
ggcugcaagccca

SEQ ID NO: 1144085 - RNA, 13 nt, Homo sapiens
ggcugcagauaac

SEQ ID NO: 1144086 - RNA, 22 nt, Homo sapiens
ggcugccuuuguggugggcgcu

SEQ ID NO: 1144087 - RNA, 14 nt, Homo sapiens
ggcugcggugggca

SEQ ID NO: 1144088 - RNA, 16 nt, Homo sapiens
ggcugcugguggcgcu

SEQ ID NO: 1144089 - RNA, 13 nt, Homo sapiens
ggcugcuuuccaa

SEQ ID NO: 1144090 - RNA, 14 nt, Homo sapiens
ggcuggagugcaau

SEQ ID NO: 1144091 - RNA, 15 nt, Homo sapiens
ggcuggagugcaaug

SEQ ID NO: 1144092 - RNA, 20 nt, Homo sapiens
ggcuggagugcaaugacaca

SEQ ID NO: 1144093 - RNA, 19 nt, Homo sapiens
ggcuggagugcaauggugu

SEQ ID NO: 1144094 - RNA, 20 nt, Homo sapiens
ggcuggagugcaguggcgca

SEQ ID NO: 1144095 - RNA, 16 nt, Homo sapiens
ggcugggcugagccaa

SEQ ID NO: 1144096 - RNA, 22 nt, Homo sapiens
ggcugguauucucucuaugcaa

SEQ ID NO: 1144097 - RNA, 14 nt, Homo sapiens
ggcuguaguuacau

SEQ ID NO: 1144098 - RNA, 13 nt, Homo sapiens
ggcuucccaucug

SEQ ID NO: 1144099 - RNA, 16 nt, Homo sapiens
ggcuucuacacugggu

SEQ ID NO: 1144100 - RNA, 14 nt, Homo sapiens
ggcuucucugucuc

SEQ ID NO: 1144101 - RNA, 18 nt, Homo sapiens
ggcuuguaaaugugacac

SEQ ID NO: 1144102 - RNA, 14 nt, Homo sapiens
ggcuuugggguccu

SEQ ID NO: 1144103 - RNA, 14 nt, Homo sapiens
ggcuuuguggcacu

SEQ ID NO: 1144104 - RNA, 13 nt, Homo sapiens
ggcuuuugaacug

SEQ ID NO: 1144105 - RNA, 22 nt, Homo sapiens
gggaaacuuagaucaucaguca

SEQ ID NO: 1144106 - RNA, 21 nt, Homo sapiens
gggaaggaggccaagcagugc

SEQ ID NO: 1144107 - RNA, 20 nt, Homo sapiens
gggaaggcaaaggcagagga

SEQ ID NO: 1144108 - RNA, 15 nt, Homo sapiens
gggaagggacuggga

SEQ ID NO: 1144109 - RNA, 10 nt, Homo sapiens
gggaauuuaa

SEQ ID NO: 1144110 - RNA, 21 nt, Homo sapiens
gggacaucaaaaacagcagaa

SEQ ID NO: 1144111 - RNA, 17 nt, Homo sapiens
gggacaucacagggugg

SEQ ID NO: 1144112 - RNA, 16 nt, Homo sapiens
gggacauugcagagug

SEQ ID NO: 1144113 - RNA, 20 nt, Homo sapiens
gggacggcugugggaccagg

SEQ ID NO: 1144114 - RNA, 11 nt, Homo sapiens
gggacugcugg

SEQ ID NO: 1144115 - RNA, 14 nt, Homo sapiens
gggagaaagcaaua

SEQ ID NO: 1144116 - RNA, 20 nt, Homo sapiens
gggagaaccacugacccaaa

SEQ ID NO: 1144117 - RNA, 13 nt, Homo sapiens
gggagcaccagcg

SEQ ID NO: 1144118 - RNA, 15 nt, Homo sapiens
gggagcagaugcaau

SEQ ID NO: 1144119 - RNA, 16 nt, Homo sapiens
gggagcuaucacugua

SEQ ID NO: 1144120 - RNA, 14 nt, Homo sapiens
gggaggcgucuuca

SEQ ID NO: 1144121 - RNA, 21 nt, Homo sapiens
gggagucugaagcagaugcaa

SEQ ID NO: 1144122 - RNA, 12 nt, Homo sapiens
gggagucugggc

SEQ ID NO: 1144123 - RNA, 20 nt, Homo sapiens
gggagugcccccaacagcac

SEQ ID NO: 1144124 - RNA, 17 nt, Homo sapiens
gggauccguuuugacau

SEQ ID NO: 1144125 - RNA, 22 nt, Homo sapiens
gggaucuguaaggaacuggaac

SEQ ID NO: 1144126 - RNA, 23 nt, Homo sapiens
gggauuacaggcgugagccacug

SEQ ID NO: 1144127 - RNA, 22 nt, Homo sapiens
gggcacacgccucccacugggg

SEQ ID NO: 1144128 - RNA, 17 nt, Homo sapiens
gggcaccucucugggaa

SEQ ID NO: 1144129 - RNA, 19 nt, Homo sapiens
gggcagaagugaaugccug

SEQ ID NO: 1144130 - RNA, 17 nt, Homo sapiens
gggcagcgccaggcuga

SEQ ID NO: 1144131 - RNA, 16 nt, Homo sapiens
gggcagggacccgggg

SEQ ID NO: 1144132 - RNA, 17 nt, Homo sapiens
gggcagggccccugacc

SEQ ID NO: 1144133 - RNA, 14 nt, Homo sapiens
gggcaguggcacga

SEQ ID NO: 1144134 - RNA, 13 nt, Homo sapiens
gggcaguugacag

SEQ ID NO: 1144135 - RNA, 16 nt, Homo sapiens
gggcauggcugcugac

SEQ ID NO: 1144136 - RNA, 12 nt, Homo sapiens
gggccaccagcc

SEQ ID NO: 1144137 - RNA, 13 nt, Homo sapiens
gggccauggcuca

SEQ ID NO: 1144138 - RNA, 18 nt, Homo sapiens
gggccauucuccacagca

SEQ ID NO: 1144139 - RNA, 21 nt, Homo sapiens
gggcccccacauuugugccga

SEQ ID NO: 1144140 - RNA, 22 nt, Homo sapiens
gggcccccaccgccgggguccu

SEQ ID NO: 1144141 - RNA, 18 nt, Homo sapiens
gggccgcucgaugccuuu

SEQ ID NO: 1144142 - RNA, 15 nt, Homo sapiens
gggccugaugugugu

SEQ ID NO: 1144143 - RNA, 23 nt, Homo sapiens
gggcucagcuagacauugcaauu

SEQ ID NO: 1144144 - RNA, 23 nt, Homo sapiens
gggcucaggaggggaaguccagc

SEQ ID NO: 1144145 - RNA, 18 nt, Homo sapiens
gggcucagggagcugaga

SEQ ID NO: 1144146 - RNA, 15 nt, Homo sapiens
gggcuccauguagaa

SEQ ID NO: 1144147 - RNA, 19 nt, Homo sapiens
gggcuccccaggaagccca

SEQ ID NO: 1144148 - RNA, 14 nt, Homo sapiens
gggcucgugcccug

SEQ ID NO: 1144149 - RNA, 23 nt, Homo sapiens
gggcucuucugagcagaaauggc

SEQ ID NO: 1144150 - RNA, 14 nt, Homo sapiens
gggcugggucacag

SEQ ID NO: 1144151 - RNA, 22 nt, Homo sapiens
gggcuugguguuuguaagaaaa

SEQ ID NO: 1144152 - RNA, 19 nt, Homo sapiens
ggggagccugugguggccu

SEQ ID NO: 1144153 - RNA, 17 nt, Homo sapiens
ggggagucugaagcaga

SEQ ID NO: 1144154 - RNA, 12 nt, Homo sapiens
ggggaugcauag

SEQ ID NO: 1144155 - RNA, 22 nt, Homo sapiens
ggggcaauaguagaauggacaa

SEQ ID NO: 1144156 - RNA, 13 nt, Homo sapiens
ggggccuccagaa

SEQ ID NO: 1144157 - RNA, 17 nt, Homo sapiens
ggggcgaucgcggcgga

SEQ ID NO: 1144158 - RNA, 13 nt, Homo sapiens
ggggcuguggaug

SEQ ID NO: 1144159 - RNA, 12 nt, Homo sapiens
gggggaagggag

SEQ ID NO: 1144160 - RNA, 13 nt, Homo sapiens
gggggacguuucu

SEQ ID NO: 1144161 - RNA, 15 nt, Homo sapiens
gggggagcaccagcg

SEQ ID NO: 1144162 - RNA, 20 nt, Homo sapiens
ggggucugguuagucgugac

SEQ ID NO: 1144163 - RNA, 16 nt, Homo sapiens
ggggugccaguuugaa

SEQ ID NO: 1144164 - RNA, 15 nt, Homo sapiens
gggguggggagcaug

SEQ ID NO: 1144165 - RNA, 12 nt, Homo sapiens
ggggugugcaug

SEQ ID NO: 1144166 - RNA, 21 nt, Homo sapiens
ggggugugccugucuguuaca

SEQ ID NO: 1144167 - RNA, 16 nt, Homo sapiens
ggguauugcuugccac

SEQ ID NO: 1144168 - RNA, 18 nt, Homo sapiens
ggguauugugugagugca

SEQ ID NO: 1144169 - RNA, 15 nt, Homo sapiens
gggucacuugcaauu

SEQ ID NO: 1144170 - RNA, 21 nt, Homo sapiens
gggucucacucuguugcccag

SEQ ID NO: 1144171 - RNA, 22 nt, Homo sapiens
gggucucucacuguugcagugg

SEQ ID NO: 1144172 - RNA, 15 nt, Homo sapiens
gggucugcaggugag

SEQ ID NO: 1144173 - RNA, 16 nt, Homo sapiens
gggugaacugcagcga

SEQ ID NO: 1144174 - RNA, 17 nt, Homo sapiens
gggugauggccagagga

SEQ ID NO: 1144175 - RNA, 22 nt, Homo sapiens
gggugauuuuaugaucaguguu

SEQ ID NO: 1144176 - RNA, 20 nt, Homo sapiens
ggguggcucugauugcuuua

SEQ ID NO: 1144177 - RNA, 13 nt, Homo sapiens
gggugguggcaca

SEQ ID NO: 1144178 - RNA, 16 nt, Homo sapiens
ggguuaauucauuugg

SEQ ID NO: 1144179 - RNA, 21 nt, Homo sapiens
ggguucuugagccagccaggc

SEQ ID NO: 1144180 - RNA, 22 nt, Homo sapiens
ggguuugagcacaaucuguucu

SEQ ID NO: 1144181 - RNA, 22 nt, Homo sapiens
ggguuuugcuuuagagugcaag

SEQ ID NO: 1144182 - RNA, 13 nt, Homo sapiens
gguaaaacaaaac

SEQ ID NO: 1144183 - RNA, 19 nt, Homo sapiens
gguaaaagcaucacaugaa

SEQ ID NO: 1144184 - RNA, 22 nt, Homo sapiens
gguaaaaguucuuuuugcucua

SEQ ID NO: 1144185 - RNA, 22 nt, Homo sapiens
gguaaaugccacacaccuuuaa

SEQ ID NO: 1144186 - RNA, 21 nt, Homo sapiens
gguaaccccagauucaugcac

SEQ ID NO: 1144187 - RNA, 14 nt, Homo sapiens
gguaacuagcugag

SEQ ID NO: 1144188 - RNA, 14 nt, Homo sapiens
gguacaauuguaaa

SEQ ID NO: 1144189 - RNA, 15 nt, Homo sapiens
gguaccaagcauuua

SEQ ID NO: 1144190 - RNA, 15 nt, Homo sapiens
gguacccaggcuucc

SEQ ID NO: 1144191 - RNA, 18 nt, Homo sapiens
gguacuuguaaauuauua

SEQ ID NO: 1144192 - RNA, 15 nt, Homo sapiens
gguagauucgcuguc

SEQ ID NO: 1144193 - RNA, 14 nt, Homo sapiens
gguaguguucagua

SEQ ID NO: 1144194 - RNA, 18 nt, Homo sapiens
gguaguuagccaucuaau

SEQ ID NO: 1144195 - RNA, 18 nt, Homo sapiens
gguauauaaauuuuccca

SEQ ID NO: 1144196 - RNA, 18 nt, Homo sapiens
gguaucaagacauagcau

SEQ ID NO: 1144197 - RNA, 14 nt, Homo sapiens
gguaugauauugca

SEQ ID NO: 1144198 - RNA, 22 nt, Homo sapiens
gguauguguggaugaugcugcc

SEQ ID NO: 1144199 - RNA, 19 nt, Homo sapiens
ggucaaacaaacucucuga

SEQ ID NO: 1144200 - RNA, 17 nt, Homo sapiens
ggucaaccuccuggaca

SEQ ID NO: 1144201 - RNA, 16 nt, Homo sapiens
ggucacagagugagac

SEQ ID NO: 1144202 - RNA, 17 nt, Homo sapiens
ggucacccucuccagca

SEQ ID NO: 1144203 - RNA, 14 nt, Homo sapiens
ggucacucaucuaa

SEQ ID NO: 1144204 - RNA, 18 nt, Homo sapiens
ggucacuuccguuuaccu

SEQ ID NO: 1144205 - RNA, 20 nt, Homo sapiens
ggucagcuuuuguuguuuau

SEQ ID NO: 1144206 - RNA, 18 nt, Homo sapiens
ggucagggggcacugucu

SEQ ID NO: 1144207 - RNA, 19 nt, Homo sapiens
ggucaguuuggugucaaca

SEQ ID NO: 1144208 - RNA, 15 nt, Homo sapiens
ggucauagcauucac

SEQ ID NO: 1144209 - RNA, 23 nt, Homo sapiens
gguccacaucccgggacgcagca

SEQ ID NO: 1144210 - RNA, 18 nt, Homo sapiens
gugccuggccuggcacac

SEQ ID NO: 1144211 - RNA, 22 nt, Homo sapiens
gugcgaucucggcucagugcaa

SEQ ID NO: 1144212 - RNA, 22 nt, Homo sapiens
gugcgcucacaguugagcugcu

SEQ ID NO: 1144213 - RNA, 19 nt, Homo sapiens
gugcuacucucacucagcc

SEQ ID NO: 1144214 - RNA, 18 nt, Homo sapiens
gugcuauagacauuagag

SEQ ID NO: 1144215 - RNA, 16 nt, Homo sapiens
gugcuauggugcucug

SEQ ID NO: 1144216 - RNA, 15 nt, Homo sapiens
gugcucacugaccug

SEQ ID NO: 1144217 - RNA, 17 nt, Homo sapiens
gugcugacuaagccgaa

SEQ ID NO: 1144218 - RNA, 19 nt, Homo sapiens
gugcugggauuacaggcgu

SEQ ID NO: 1144219 - RNA, 14 nt, Homo sapiens
gugcugguuuauuu

SEQ ID NO: 1144220 - RNA, 18 nt, Homo sapiens
gugcuguuuuuguucuac

SEQ ID NO: 1144221 - RNA, 14 nt, Homo sapiens
gugcuugagucucc

SEQ ID NO: 1144222 - RNA, 17 nt, Homo sapiens
gugcuugcguugaugac

SEQ ID NO: 1144223 - RNA, 20 nt, Homo sapiens
gugcuuuauaccccauuuga

SEQ ID NO: 1144224 - RNA, 13 nt, Homo sapiens
guggaacuguaca

SEQ ID NO: 1144225 - RNA, 14 nt, Homo sapiens
guggaagugacauu

SEQ ID NO: 1144226 - RNA, 23 nt, Homo sapiens
guggaauauaaggaaagcaauaa

SEQ ID NO: 1144227 - RNA, 21 nt, Homo sapiens
guggaauaugucuucuguaua

SEQ ID NO: 1144228 - RNA, 18 nt, Homo sapiens
guggacagucugcucuag

SEQ ID NO: 1144229 - RNA, 21 nt, Homo sapiens
guggacaugcgugaccagcag

SEQ ID NO: 1144230 - RNA, 23 nt, Homo sapiens
guggagccgagcggggagccagg

SEQ ID NO: 1144231 - RNA, 14 nt, Homo sapiens
guggaugaagcaga

SEQ ID NO: 1144232 - RNA, 15 nt, Homo sapiens
guggaugaagcagag

SEQ ID NO: 1144233 - RNA, 18 nt, Homo sapiens
guggaugauaccauuucc

SEQ ID NO: 1144234 - RNA, 15 nt, Homo sapiens
guggaugauguuucg

SEQ ID NO: 1144235 - RNA, 12 nt, Homo sapiens
guggauguauaa

SEQ ID NO: 1144236 - RNA, 20 nt, Homo sapiens
guggauugugagaaauucca

SEQ ID NO: 1144237 - RNA, 13 nt, Homo sapiens
guggcacaggagu

SEQ ID NO: 1144238 - RNA, 23 nt, Homo sapiens
guggcaccgccuccccaccucca

SEQ ID NO: 1144239 - RNA, 19 nt, Homo sapiens
guggcacuauauucuggcc

SEQ ID NO: 1144240 - RNA, 20 nt, Homo sapiens
guggcacuugccugggucac

SEQ ID NO: 1144241 - RNA, 15 nt, Homo sapiens
guggcaucuugccaa

SEQ ID NO: 1144242 - RNA, 12 nt, Homo sapiens
guggcauuugaa

SEQ ID NO: 1144243 - RNA, 23 nt, Homo sapiens
guggccaaggagcugcuauagcc

SEQ ID NO: 1144244 - RNA, 17 nt, Homo sapiens
guggccacagcgugcug

SEQ ID NO: 1144245 - RNA, 18 nt, Homo sapiens
guggccacguucagggag

SEQ ID NO: 1144246 - RNA, 13 nt, Homo sapiens
guggccaucuccu

SEQ ID NO: 1144247 - RNA, 23 nt, Homo sapiens
guggccaugccucagcccugacc

SEQ ID NO: 1144248 - RNA, 20 nt, Homo sapiens
guggccucugcaggccuagg

SEQ ID NO: 1144249 - RNA, 18 nt, Homo sapiens
guggccuuugcaauugug

SEQ ID NO: 1144250 - RNA, 16 nt, Homo sapiens
guggcuaagggggacc

SEQ ID NO: 1144251 - RNA, 13 nt, Homo sapiens
guggcucacagug

SEQ ID NO: 1144252 - RNA, 22 nt, Homo sapiens
guggcucacgucuguaauccca

SEQ ID NO: 1144253 - RNA, 15 nt, Homo sapiens
guggcucagccagca

SEQ ID NO: 1144254 - RNA, 13 nt, Homo sapiens
guggcucaugccu

SEQ ID NO: 1144255 - RNA, 16 nt, Homo sapiens
guggcucgacugcuca

SEQ ID NO: 1144256 - RNA, 13 nt, Homo sapiens
guggcuucaagag

SEQ ID NO: 1144257 - RNA, 23 nt, Homo sapiens
gugggaacggcugauguggacug

SEQ ID NO: 1144258 - RNA, 21 nt, Homo sapiens
gugggaaggucccuuguuucc

SEQ ID NO: 1144259 - RNA, 23 nt, Homo sapiens
gugggaggcuccuguuagcuccu

SEQ ID NO: 1144260 - RNA, 21 nt, Homo sapiens
gugggcuguguugacugcugc

SEQ ID NO: 1144261 - RNA, 19 nt, Homo sapiens
guggggaccccaccccuca

SEQ ID NO: 1144262 - RNA, 13 nt, Homo sapiens
guggggugcacuc

SEQ ID NO: 1144263 - RNA, 22 nt, Homo sapiens
gugggucuggccguacuuguga

SEQ ID NO: 1144264 - RNA, 21 nt, Homo sapiens
gugguagccaucaagcacuuc

SEQ ID NO: 1144265 - RNA, 14 nt, Homo sapiens
guggucgagcuuuu

SEQ ID NO: 1144266 - RNA, 23 nt, Homo sapiens
guggugggcccugaugcugccag

SEQ ID NO: 1144267 - RNA, 18 nt, Homo sapiens
gugguguauguauggaaa

SEQ ID NO: 1144268 - RNA, 12 nt, Homo sapiens
guggugugccau

SEQ ID NO: 1144269 - RNA, 21 nt, Homo sapiens
gugguuauuuagggaacugcu

SEQ ID NO: 1144270 - RNA, 12 nt, Homo sapiens
gugguuugaaaa

SEQ ID NO: 1144271 - RNA, 14 nt, Homo sapiens
guguaagaaacaca

SEQ ID NO: 1144272 - RNA, 14 nt, Homo sapiens
guguacaacacugg

SEQ ID NO: 1144273 - RNA, 20 nt, Homo sapiens
guguaccuccucucaguguu

SEQ ID NO: 1144274 - RNA, 14 nt, Homo sapiens
guguagccugugca

SEQ ID NO: 1144275 - RNA, 18 nt, Homo sapiens
guguagggguguguguau

SEQ ID NO: 1144276 - RNA, 13 nt, Homo sapiens
guguauauaccuc

SEQ ID NO: 1144277 - RNA, 16 nt, Homo sapiens
guguaugcgugcauug

SEQ ID NO: 1144278 - RNA, 12 nt, Homo sapiens
guguauguguau

SEQ ID NO: 1144279 - RNA, 19 nt, Homo sapiens
gugucaccuuuucuugccu

SEQ ID NO: 1144280 - RNA, 11 nt, Homo sapiens
gugucagccau

SEQ ID NO: 1144281 - RNA, 15 nt, Homo sapiens
gugucaugccaguga

SEQ ID NO: 1144282 - RNA, 17 nt, Homo sapiens
guguccaguugcagcug

SEQ ID NO: 1144283 - RNA, 19 nt, Homo sapiens
guguccugaagcugcugga

SEQ ID NO: 1144284 - RNA, 14 nt, Homo sapiens
guguccugcaccgg

SEQ ID NO: 1144285 - RNA, 21 nt, Homo sapiens
guguccuucuuccucaagucu

SEQ ID NO: 1144286 - RNA, 13 nt, Homo sapiens
gugucucuguaua

SEQ ID NO: 1144287 - RNA, 19 nt, Homo sapiens
gugucugagagcaaaguga

SEQ ID NO: 1144288 - RNA, 18 nt, Homo sapiens
gugugaugggaucuguaa

SEQ ID NO: 1144289 - RNA, 22 nt, Homo sapiens
gugugcaagagagggaugcaug

SEQ ID NO: 1144290 - RNA, 20 nt, Homo sapiens
gugugccguugcuccggccu

SEQ ID NO: 1144291 - RNA, 22 nt, Homo sapiens
guguggacuguggcacuugccu

SEQ ID NO: 1144292 - RNA, 16 nt, Homo sapiens
guguguacaacacugg

SEQ ID NO: 1144293 - RNA, 19 nt, Homo sapiens
guguguccaaaacugccuc

SEQ ID NO: 1144294 - RNA, 14 nt, Homo sapiens
gugugucucgucuc

SEQ ID NO: 1144295 - RNA, 15 nt, Homo sapiens
gugugugacaauucu

SEQ ID NO: 1144296 - RNA, 16 nt, Homo sapiens
gugugugcgcacacau

SEQ ID NO: 1144297 - RNA, 14 nt, Homo sapiens
gugugugucucuga

SEQ ID NO: 1144298 - RNA, 16 nt, Homo sapiens
guguuauucuggggaa

SEQ ID NO: 1144299 - RNA, 15 nt, Homo sapiens
guguucaccauccca

SEQ ID NO: 1144300 - RNA, 17 nt, Homo sapiens
guguucaccaucccaaa

SEQ ID NO: 1144301 - RNA, 20 nt, Homo sapiens
guguucucggggaugcauag

SEQ ID NO: 1144302 - RNA, 20 nt, Homo sapiens
guguucuugcuaacuuugcc

SEQ ID NO: 1144303 - RNA, 15 nt, Homo sapiens
guguuggcaguguuu

SEQ ID NO: 1144304 - RNA, 16 nt, Homo sapiens
guguuuagaagccuaa

SEQ ID NO: 1144305 - RNA, 16 nt, Homo sapiens
guguuucaaacuguaa

SEQ ID NO: 1144306 - RNA, 19 nt, Homo sapiens
guguuucuauugacuucaa

SEQ ID NO: 1144307 - RNA, 15 nt, Homo sapiens
guguuugacgggaaa

SEQ ID NO: 1144308 - RNA, 23 nt, Homo sapiens
guguuuuacuaucucacugcugu

SEQ ID NO: 1144309 - RNA, 13 nt, Homo sapiens
guguuuucagucu

SEQ ID NO: 1144310 - RNA, 20 nt, Homo sapiens
guguuuuguaaaggauauca

SEQ ID NO: 1144311 - RNA, 22 nt, Homo sapiens
guguuuuuaauaaagacagggu

SEQ ID NO: 1144312 - RNA, 21 nt, Homo sapiens
guguuuuucuuuuuccacaag

SEQ ID NO: 1144313 - RNA, 19 nt, Homo sapiens
guuaaaaguguacaaguug

SEQ ID NO: 1144314 - RNA, 15 nt, Homo sapiens
guuaaaauugcucau

SEQ ID NO: 1144315 - RNA, 17 nt, Homo sapiens
guuaaagcauaugcuau

SEQ ID NO: 1144316 - RNA, 19 nt, Homo sapiens
guuaaaggaaaagcacaag

SEQ ID NO: 1144317 - RNA, 16 nt, Homo sapiens
guuaacugauuugcaa

SEQ ID NO: 1144318 - RNA, 18 nt, Homo sapiens
guuaaggugaacgcacuu

SEQ ID NO: 1144319 - RNA, 22 nt, Homo sapiens
guuaaguguuuccuuccuuugu

SEQ ID NO: 1144320 - RNA, 13 nt, Homo sapiens
guuaaucaaagau

SEQ ID NO: 1144321 - RNA, 14 nt, Homo sapiens
guuaaucauuucau

SEQ ID NO: 1144322 - RNA, 21 nt, Homo sapiens
guuaaugaaggugugcuacag

SEQ ID NO: 1144323 - RNA, 14 nt, Homo sapiens
guuaaugaauaugc

SEQ ID NO: 1144324 - RNA, 17 nt, Homo sapiens
guuaauuuaauuugcag

SEQ ID NO: 1144325 - RNA, 21 nt, Homo sapiens
guuaauuuuuugguacaaaaa

SEQ ID NO: 1144326 - RNA, 17 nt, Homo sapiens
guuacaaagcuguguug

SEQ ID NO: 1144327 - RNA, 15 nt, Homo sapiens
guuacagagauacug

SEQ ID NO: 1144328 - RNA, 22 nt, Homo sapiens
guuacauuaaaauaaaccaaau

SEQ ID NO: 1144329 - RNA, 12 nt, Homo sapiens
guuacccaugaa

SEQ ID NO: 1144330 - RNA, 21 nt, Homo sapiens
guuaccugaaaacacugugca

SEQ ID NO: 1144331 - RNA, 17 nt, Homo sapiens
guuaccugacuuaugaa

SEQ ID NO: 1144332 - RNA, 21 nt, Homo sapiens
guuacucccuacacugaugca

SEQ ID NO: 1144333 - RNA, 13 nt, Homo sapiens
guuacuugggagg

SEQ ID NO: 1144334 - RNA, 16 nt, Homo sapiens
guuagcuuguauauau

SEQ ID NO: 1144335 - RNA, 14 nt, Homo sapiens
guuaguguuuagaa

SEQ ID NO: 1144336 - RNA, 20 nt, Homo sapiens
guuaguuuuucuuacuugca

SEQ ID NO: 1144337 - RNA, 16 nt, Homo sapiens
guuauaagaaacagag

SEQ ID NO: 1144338 - RNA, 14 nt, Homo sapiens
guuauagaagguca

SEQ ID NO: 1144339 - RNA, 15 nt, Homo sapiens
guuauccugugcuac

SEQ ID NO: 1144340 - RNA, 16 nt, Homo sapiens
guuauggcagaugaca

SEQ ID NO: 1144341 - RNA, 18 nt, Homo sapiens
guuauucuaguacuagaa

SEQ ID NO: 1144342 - RNA, 15 nt, Homo sapiens
uaaguugagaacuua

SEQ ID NO: 1144343 - RNA, 15 nt, Homo sapiens
uaaguuuaagggaaa

SEQ ID NO: 1144344 - RNA, 21 nt, Homo sapiens
uaaguuugaaggaaacaguua

SEQ ID NO: 1144345 - RNA, 22 nt, Homo sapiens
uaaguuuuauguuaaaucaaua

SEQ ID NO: 1144346 - RNA, 18 nt, Homo sapiens
uaaguuuuguuuguucac

SEQ ID NO: 1144347 - RNA, 19 nt, Homo sapiens
uaauaaaauagucacugcc

SEQ ID NO: 1144348 - RNA, 13 nt, Homo sapiens
uaauaaagacagg

SEQ ID NO: 1144349 - RNA, 22 nt, Homo sapiens
uaauaaaguuuuuuuccaaaag

SEQ ID NO: 1144350 - RNA, 24 nt, Homo sapiens
uaauaaaucucuucuuugcugcag

SEQ ID NO: 1144351 - RNA, 12 nt, Homo sapiens
uaauaacuaaua

SEQ ID NO: 1144352 - RNA, 16 nt, Homo sapiens
uaauaaucauuuuaga

SEQ ID NO: 1144353 - RNA, 16 nt, Homo sapiens
uaauacuacuacuguu

SEQ ID NO: 1144354 - RNA, 23 nt, Homo sapiens
uaauacugguauuuuuacuuaau

SEQ ID NO: 1144355 - RNA, 19 nt, Homo sapiens
uaauaggcaccucuucaau

SEQ ID NO: 1144356 - RNA, 19 nt, Homo sapiens
uaauagucaauuucuacuu

SEQ ID NO: 1144357 - RNA, 16 nt, Homo sapiens
uaauagucuuugccag

SEQ ID NO: 1144358 - RNA, 17 nt, Homo sapiens
uaauagucuuugccagu

SEQ ID NO: 1144359 - RNA, 13 nt, Homo sapiens
uaauaguguuaau

SEQ ID NO: 1144360 - RNA, 15 nt, Homo sapiens
uaauaguucagugua

SEQ ID NO: 1144361 - RNA, 17 nt, Homo sapiens
uaauaguucaguguaug

SEQ ID NO: 1144362 - RNA, 18 nt, Homo sapiens
uaauaguuuaacugaaag

SEQ ID NO: 1144363 - RNA, 17 nt, Homo sapiens
uaauauaagcugccaua

SEQ ID NO: 1144364 - RNA, 23 nt, Homo sapiens
uaauaugaguaauacaucaaaga

SEQ ID NO: 1144365 - RNA, 18 nt, Homo sapiens
uaauaugguguacauucu

SEQ ID NO: 1144366 - RNA, 17 nt, Homo sapiens
uaauauuguauugcugc

SEQ ID NO: 1144367 - RNA, 13 nt, Homo sapiens
uaauauuuccaga

SEQ ID NO: 1144368 - RNA, 17 nt, Homo sapiens
uaauauuuuaaauugcu

SEQ ID NO: 1144369 - RNA, 21 nt, Homo sapiens
uaaucaaaacccaacaugacu

SEQ ID NO: 1144370 - RNA, 23 nt, Homo sapiens
uaaucaaagauugaacacugcgu

SEQ ID NO: 1144371 - RNA, 14 nt, Homo sapiens
uaaucaacagauaa

SEQ ID NO: 1144372 - RNA, 15 nt, Homo sapiens
uaaucaaguagaaca

SEQ ID NO: 1144373 - RNA, 23 nt, Homo sapiens
uaaucaccgcggggcggggagcg

SEQ ID NO: 1144374 - RNA, 15 nt, Homo sapiens
uaaucaccucucugu

SEQ ID NO: 1144375 - RNA, 23 nt, Homo sapiens
uaaucaguucuuagauucagggg

SEQ ID NO: 1144376 - RNA, 22 nt, Homo sapiens
uaaucaguuguuuaauaauuua

SEQ ID NO: 1144377 - RNA, 15 nt, Homo sapiens
uaauccaguguuacu

SEQ ID NO: 1144378 - RNA, 14 nt, Homo sapiens
uaaucccagcacuu

SEQ ID NO: 1144379 - RNA, 12 nt, Homo sapiens
uaauccuaaaca

SEQ ID NO: 1144380 - RNA, 16 nt, Homo sapiens
uaaucuguaagcauaa

SEQ ID NO: 1144381 - RNA, 16 nt, Homo sapiens
uaaucuguacaaugaa

SEQ ID NO: 1144382 - RNA, 12 nt, Homo sapiens
uaaugaacuuua

SEQ ID NO: 1144383 - RNA, 13 nt, Homo sapiens
uaaugacuuuuaa

SEQ ID NO: 1144384 - RNA, 20 nt, Homo sapiens
uaaugauaaaauacuaaacu

SEQ ID NO: 1144385 - RNA, 21 nt, Homo sapiens
uaaugauaaaauacuaaacua

SEQ ID NO: 1144386 - RNA, 13 nt, Homo sapiens
uaaugccaaguua

SEQ ID NO: 1144387 - RNA, 17 nt, Homo sapiens
uaaugcuacgugugauu

SEQ ID NO: 1144388 - RNA, 20 nt, Homo sapiens
uaaugcuacugucucacuga

SEQ ID NO: 1144389 - RNA, 12 nt, Homo sapiens
uaaugcucugaa

SEQ ID NO: 1144390 - RNA, 17 nt, Homo sapiens
uaaugcuguugccucau

SEQ ID NO: 1144391 - RNA, 14 nt, Homo sapiens
uaaugcuuucugug

SEQ ID NO: 1144392 - RNA, 20 nt, Homo sapiens
uaauguaguauacacuggca

SEQ ID NO: 1144393 - RNA, 15 nt, Homo sapiens
uaaugucaccaccuu

SEQ ID NO: 1144394 - RNA, 20 nt, Homo sapiens
uaauguuauaucauauguau

SEQ ID NO: 1144395 - RNA, 22 nt, Homo sapiens
uaauguugauuuuaauccugua

SEQ ID NO: 1144396 - RNA, 19 nt, Homo sapiens
uaauuaccuguauugugga

SEQ ID NO: 1144397 - RNA, 16 nt, Homo sapiens
uaauuaguaacaugug

SEQ ID NO: 1144398 - RNA, 21 nt, Homo sapiens
uaauuauguuuugugauucaa

SEQ ID NO: 1144399 - RNA, 14 nt, Homo sapiens
uaauucaaauaaua

SEQ ID NO: 1144400 - RNA, 18 nt, Homo sapiens
uaauuccagucauuuugg

SEQ ID NO: 1144401 - RNA, 22 nt, Homo sapiens
uaauuccccccacccccugcca

SEQ ID NO: 1144402 - RNA, 13 nt, Homo sapiens
uaauugcauuuaa

SEQ ID NO: 1144403 - RNA, 16 nt, Homo sapiens
uaauuguccaugagga

SEQ ID NO: 1144404 - RNA, 23 nt, Homo sapiens
uaauugugaauaaaaauugauga

SEQ ID NO: 1144405 - RNA, 15 nt, Homo sapiens
uaauuuaacuuucca

SEQ ID NO: 1144406 - RNA, 17 nt, Homo sapiens
uaauuuaccuguuguug

SEQ ID NO: 1144407 - RNA, 21 nt, Homo sapiens
uaauuuagccaggaccugcca

SEQ ID NO: 1144408 - RNA, 21 nt, Homo sapiens
uaauuuuagagaaacuuugag

SEQ ID NO: 1144409 - RNA, 16 nt, Homo sapiens
uaauuuuuaacuuauu

SEQ ID NO: 1144410 - RNA, 14 nt, Homo sapiens
uaauuuuuacaugg

SEQ ID NO: 1144411 - RNA, 17 nt, Homo sapiens
uaauuuuugugagguau

SEQ ID NO: 1144412 - RNA, 21 nt, Homo sapiens
uacaaaaauaccuacugcuga

SEQ ID NO: 1144413 - RNA, 19 nt, Homo sapiens
uacaaaaauagcugggcau

SEQ ID NO: 1144414 - RNA, 18 nt, Homo sapiens
uacaaaaaucagccagac

SEQ ID NO: 1144415 - RNA, 14 nt, Homo sapiens
uacaaaaugggccu

SEQ ID NO: 1144416 - RNA, 17 nt, Homo sapiens
uacaaagaaaaagccaa

SEQ ID NO: 1144417 - RNA, 13 nt, Homo sapiens
uacaaaugacaug

SEQ ID NO: 1144418 - RNA, 15 nt, Homo sapiens
uacaaaugcauuucu

SEQ ID NO: 1144419 - RNA, 20 nt, Homo sapiens
uacaacaaacacugugaugu

SEQ ID NO: 1144420 - RNA, 11 nt, Homo sapiens
uacaacacugg

SEQ ID NO: 1144421 - RNA, 21 nt, Homo sapiens
uacaaccaauggaaugugaug

SEQ ID NO: 1144422 - RNA, 19 nt, Homo sapiens
uacaacuaagugauuugua

SEQ ID NO: 1144423 - RNA, 17 nt, Homo sapiens
uacaacuguaaagcaaa

SEQ ID NO: 1144424 - RNA, 19 nt, Homo sapiens
uacaagaguuucaaaacau

SEQ ID NO: 1144425 - RNA, 12 nt, Homo sapiens
uacaaggacuuu

SEQ ID NO: 1144426 - RNA, 20 nt, Homo sapiens
uacaaguugaaauaugcucu

SEQ ID NO: 1144427 - RNA, 18 nt, Homo sapiens
uacaauaaaaacauugcc

SEQ ID NO: 1144428 - RNA, 16 nt, Homo sapiens
uacaauuauuguauau

SEQ ID NO: 1144429 - RNA, 13 nt, Homo sapiens
uacacaacuaguu

SEQ ID NO: 1144430 - RNA, 14 nt, Homo sapiens
uacacaagcaucac

SEQ ID NO: 1144431 - RNA, 17 nt, Homo sapiens
uacacacacacacacgc

SEQ ID NO: 1144432 - RNA, 18 nt, Homo sapiens
uacacagaaacacugccu

SEQ ID NO: 1144433 - RNA, 18 nt, Homo sapiens
uacacaguaagucauuua

SEQ ID NO: 1144434 - RNA, 13 nt, Homo sapiens
uacacauacaugu

SEQ ID NO: 1144435 - RNA, 23 nt, Homo sapiens
uacacauacauguaaaauauguc

SEQ ID NO: 1144436 - RNA, 19 nt, Homo sapiens
uacaccccaacagcacccu

SEQ ID NO: 1144437 - RNA, 22 nt, Homo sapiens
uacacgucacaaagaccuugcu

SEQ ID NO: 1144438 - RNA, 13 nt, Homo sapiens
uacacgugacaga

SEQ ID NO: 1144439 - RNA, 15 nt, Homo sapiens
uacacguguccugua

SEQ ID NO: 1144440 - RNA, 21 nt, Homo sapiens
uacacugaucaauuucaacau

SEQ ID NO: 1144441 - RNA, 9 nt, Homo sapiens
uacacugcc

SEQ ID NO: 1144442 - RNA, 12 nt, Homo sapiens
uacacuguauau

SEQ ID NO: 1144443 - RNA, 14 nt, Homo sapiens
uacagaacucuuuc

SEQ ID NO: 1144444 - RNA, 22 nt, Homo sapiens
uacagaaguccccucuacuuua

SEQ ID NO: 1144445 - RNA, 24 nt, Homo sapiens
uacagacaaauacuuagacaguau

SEQ ID NO: 1144446 - RNA, 15 nt, Homo sapiens
uacagacagacauac

SEQ ID NO: 1144447 - RNA, 21 nt, Homo sapiens
uacagagaaaaucaaagcagu

SEQ ID NO: 1144448 - RNA, 20 nt, Homo sapiens
uacagcacacacuuccauau

SEQ ID NO: 1144449 - RNA, 19 nt, Homo sapiens
uacagcucugacuuuacac

SEQ ID NO: 1144450 - RNA, 13 nt, Homo sapiens
uacagcuguuuac

SEQ ID NO: 1144451 - RNA, 17 nt, Homo sapiens
uacaggcaugaaccacu

SEQ ID NO: 1144452 - RNA, 20 nt, Homo sapiens
uacaggccuugcucacagcu

SEQ ID NO: 1144453 - RNA, 15 nt, Homo sapiens
uacagguuacaacag

SEQ ID NO: 1144454 - RNA, 15 nt, Homo sapiens
uacagguuagaagca

SEQ ID NO: 1144455 - RNA, 12 nt, Homo sapiens
uacaguaugcuu

SEQ ID NO: 1144456 - RNA, 18 nt, Homo sapiens
uacaguaugcuugcucua

SEQ ID NO: 1144457 - RNA, 15 nt, Homo sapiens
uacaguucugucaua

SEQ ID NO: 1144458 - RNA, 16 nt, Homo sapiens
uacaguucugucauau

SEQ ID NO: 1144459 - RNA, 14 nt, Homo sapiens
uacaguuuaacaga

SEQ ID NO: 1144460 - RNA, 19 nt, Homo sapiens
uacaguuuauaaagccaag

SEQ ID NO: 1144461 - RNA, 16 nt, Homo sapiens
uacaguuugugcucua

SEQ ID NO: 1144462 - RNA, 22 nt, Homo sapiens
uacaguuugugcucuacuguua

SEQ ID NO: 1144463 - RNA, 16 nt, Homo sapiens
uacauacagaauuacu

SEQ ID NO: 1144464 - RNA, 15 nt, Homo sapiens
uacauacagugauau

SEQ ID NO: 1144465 - RNA, 16 nt, Homo sapiens
uacauaccuacugacu

SEQ ID NO: 1144466 - RNA, 18 nt, Homo sapiens
uacauacuaggugccuuu

SEQ ID NO: 1144467 - RNA, 23 nt, Homo sapiens
uacauauuguggaauugacucaa

SEQ ID NO: 1144468 - RNA, 13 nt, Homo sapiens
uacaucacuguau

SEQ ID NO: 1144469 - RNA, 16 nt, Homo sapiens
uacauccaaagcagac

SEQ ID NO: 1144470 - RNA, 20 nt, Homo sapiens
uacaucccagacacauucac

SEQ ID NO: 1144471 - RNA, 20 nt, Homo sapiens
uacaucccauguaacagaaa

SEQ ID NO: 1144472 - RNA, 16 nt, Homo sapiens
uacaucuagcaauuuc

SEQ ID NO: 1144473 - RNA, 15 nt, Homo sapiens
uacaucugcaauaug

SEQ ID NO: 1144474 - RNA, 20 nt, Homo sapiens
uacaucuuuagauacguugu

SEQ ID NO: 1144475 - RNA, 14 nt, Homo sapiens
ucuucugacccagg

SEQ ID NO: 1144476 - RNA, 18 nt, Homo sapiens
ucuucugauuugucccua

SEQ ID NO: 1144477 - RNA, 16 nt, Homo sapiens
ucuucuggacugcaca

SEQ ID NO: 1144478 - RNA, 19 nt, Homo sapiens
ucuucuggacugguuuuca

SEQ ID NO: 1144479 - RNA, 17 nt, Homo sapiens
ucuucuuacuggugcua

SEQ ID NO: 1144480 - RNA, 15 nt, Homo sapiens
ucuucuuccugaaua

SEQ ID NO: 1144481 - RNA, 19 nt, Homo sapiens
ucuucuuggggcccagugc

SEQ ID NO: 1144482 - RNA, 20 nt, Homo sapiens
ucuugaaauuaagaaggcaa

SEQ ID NO: 1144483 - RNA, 17 nt, Homo sapiens
ucuugaauagacuucca

SEQ ID NO: 1144484 - RNA, 23 nt, Homo sapiens
ucuugaauguaguauucaaugau

SEQ ID NO: 1144485 - RNA, 23 nt, Homo sapiens
ucuugaauucauguacaugguau

SEQ ID NO: 1144486 - RNA, 19 nt, Homo sapiens
ucuugagauuggguuuugc

SEQ ID NO: 1144487 - RNA, 20 nt, Homo sapiens
ucuugaugguguuucuuucc

SEQ ID NO: 1144488 - RNA, 18 nt, Homo sapiens
ucuugauguucagacauu

SEQ ID NO: 1144489 - RNA, 18 nt, Homo sapiens
ucuugauugcggcuuuau

SEQ ID NO: 1144490 - RNA, 14 nt, Homo sapiens
ucuugcaauccaca

SEQ ID NO: 1144491 - RNA, 17 nt, Homo sapiens
ucuugcauugacauuau

SEQ ID NO: 1144492 - RNA, 18 nt, Homo sapiens
ucuugcauugacauuaua

SEQ ID NO: 1144493 - RNA, 13 nt, Homo sapiens
ucuugccaugugc

SEQ ID NO: 1144494 - RNA, 16 nt, Homo sapiens
ucuuggggcccagugc

SEQ ID NO: 1144495 - RNA, 16 nt, Homo sapiens
ucuugguauuacccuc

SEQ ID NO: 1144496 - RNA, 22 nt, Homo sapiens
ucuugguugaggaaacaaacau

SEQ ID NO: 1144497 - RNA, 16 nt, Homo sapiens
ucuugguugcuggaau

SEQ ID NO: 1144498 - RNA, 16 nt, Homo sapiens
ucuugguuugccuucc

SEQ ID NO: 1144499 - RNA, 18 nt, Homo sapiens
ucuuguaggucauugcac

SEQ ID NO: 1144500 - RNA, 15 nt, Homo sapiens
ucuugucucuggugu

SEQ ID NO: 1144501 - RNA, 12 nt, Homo sapiens
ucuugugcucag

SEQ ID NO: 1144502 - RNA, 13 nt, Homo sapiens
ucuugugcucagu

SEQ ID NO: 1144503 - RNA, 14 nt, Homo sapiens
ucuuguggugcauu

SEQ ID NO: 1144504 - RNA, 21 nt, Homo sapiens
ucuuguguauuucucugugaa

SEQ ID NO: 1144505 - RNA, 20 nt, Homo sapiens
ucuuuaaaaguauccagaga

SEQ ID NO: 1144506 - RNA, 20 nt, Homo sapiens
ucuuuacaauaaacauagcu

SEQ ID NO: 1144507 - RNA, 21 nt, Homo sapiens
ucuuuagaaacacaagaguau

SEQ ID NO: 1144508 - RNA, 16 nt, Homo sapiens
ucuuuagcaagauauu

SEQ ID NO: 1144509 - RNA, 12 nt, Homo sapiens
ucuuuauacuua

SEQ ID NO: 1144510 - RNA, 13 nt, Homo sapiens
ucuuuauacuuaa

SEQ ID NO: 1144511 - RNA, 18 nt, Homo sapiens
ucuuucaacugcagugua

SEQ ID NO: 1144512 - RNA, 15 nt, Homo sapiens
ucuuuccaggcuucc

SEQ ID NO: 1144513 - RNA, 20 nt, Homo sapiens
ucuuucuaacuccagugaag

SEQ ID NO: 1144514 - RNA, 12 nt, Homo sapiens
ucuuucuagccu

SEQ ID NO: 1144515 - RNA, 19 nt, Homo sapiens
ucuuucugaaggcuuugug

SEQ ID NO: 1144516 - RNA, 18 nt, Homo sapiens
ucuuucugacacacuuag

SEQ ID NO: 1144517 - RNA, 20 nt, Homo sapiens
ucuuucuuuuguaauuugua

SEQ ID NO: 1144518 - RNA, 18 nt, Homo sapiens
ucuuucuuuuuuccuuac

SEQ ID NO: 1144519 - RNA, 19 nt, Homo sapiens
ucuuugaacuguguggucu

SEQ ID NO: 1144520 - RNA, 18 nt, Homo sapiens
ucuuugacugucagcaag

SEQ ID NO: 1144521 - RNA, 21 nt, Homo sapiens
ucuuugauuuaacugacuuaa

SEQ ID NO: 1144522 - RNA, 14 nt, Homo sapiens
ucuuugcaaaguau

SEQ ID NO: 1144523 - RNA, 17 nt, Homo sapiens
ucuuugccagucauuca

SEQ ID NO: 1144524 - RNA, 20 nt, Homo sapiens
ucuuugccuguucaguuaca

SEQ ID NO: 1144525 - RNA, 24 nt, Homo sapiens
ucuuugcggggccugucucaguga

SEQ ID NO: 1144526 - RNA, 18 nt, Homo sapiens
ucuuuggacagaagcagc

SEQ ID NO: 1144527 - RNA, 22 nt, Homo sapiens
ucuuugggccagacaugccaca

SEQ ID NO: 1144528 - RNA, 16 nt, Homo sapiens
ucuuugguucuaagga

SEQ ID NO: 1144529 - RNA, 22 nt, Homo sapiens
ucuuugguugucacuaagucag

SEQ ID NO: 1144530 - RNA, 13 nt, Homo sapiens
ucuuugugugaca

SEQ ID NO: 1144531 - RNA, 15 nt, Homo sapiens
ucuuugugugacaug

SEQ ID NO: 1144532 - RNA, 21 nt, Homo sapiens
ucuuuuaaaaagugugcuuaa

SEQ ID NO: 1144533 - RNA, 18 nt, Homo sapiens
ucuuuuaugauuggugca

SEQ ID NO: 1144534 - RNA, 16 nt, Homo sapiens
ucuuuucaucugggaa

SEQ ID NO: 1144535 - RNA, 12 nt, Homo sapiens
ucuuuugccaag

SEQ ID NO: 1144536 - RNA, 16 nt, Homo sapiens
ucuuuuguuucauuaa

SEQ ID NO: 1144537 - RNA, 19 nt, Homo sapiens
ucuuuuucucccccuccca

SEQ ID NO: 1144538 - RNA, 21 nt, Homo sapiens
ugaaaaaaauaaauuuacuga

SEQ ID NO: 1144539 - RNA, 17 nt, Homo sapiens
ugaaaaaauacuaccua

SEQ ID NO: 1144540 - RNA, 22 nt, Homo sapiens
ugaaaaacuuaccuacugggga

SEQ ID NO: 1144541 - RNA, 19 nt, Homo sapiens
ugaaaaaguuaaugcuuaa

SEQ ID NO: 1144542 - RNA, 17 nt, Homo sapiens
ugaaaacacugugcaca

SEQ ID NO: 1144543 - RNA, 12 nt, Homo sapiens
ugaaaacacuua

SEQ ID NO: 1144544 - RNA, 17 nt, Homo sapiens
ugaaaacaucuggaagg

SEQ ID NO: 1144545 - RNA, 20 nt, Homo sapiens
ugaaaacaucuggaagggga

SEQ ID NO: 1144546 - RNA, 21 nt, Homo sapiens
ugaaaacaucuggaaggggau

SEQ ID NO: 1144547 - RNA, 11 nt, Homo sapiens
ugaaaagccau

SEQ ID NO: 1144548 - RNA, 13 nt, Homo sapiens
ugaaaagccaugu

SEQ ID NO: 1144549 - RNA, 17 nt, Homo sapiens
ugaaaagguugccugaa

SEQ ID NO: 1144550 - RNA, 15 nt, Homo sapiens
ugaaaaguaucagga

SEQ ID NO: 1144551 - RNA, 21 nt, Homo sapiens
ugaaaauaacugaaccaaauu

SEQ ID NO: 1144552 - RNA, 21 nt, Homo sapiens
ugaaaauagccaaccagcagc

SEQ ID NO: 1144553 - RNA, 22 nt, Homo sapiens
ugaaaaugcaucacaugaugaa

SEQ ID NO: 1144554 - RNA, 23 nt, Homo sapiens
ugaaaaugcaucacaugaugaaa

SEQ ID NO: 1144555 - RNA, 18 nt, Homo sapiens
ugaaaaugcuguuuucaa

SEQ ID NO: 1144556 - RNA, 19 nt, Homo sapiens
ugaaaaugguccaggagaa

SEQ ID NO: 1144557 - RNA, 13 nt, Homo sapiens
ugaaaauguguuc

SEQ ID NO: 1144558 - RNA, 24 nt, Homo sapiens
ugaaaauuuuacacaguucaucau

SEQ ID NO: 1144559 - RNA, 17 nt, Homo sapiens
ugaaacaaacuacugug

SEQ ID NO: 1144560 - RNA, 18 nt, Homo sapiens
ugaaacaaacuacugugu

SEQ ID NO: 1144561 - RNA, 21 nt, Homo sapiens
ugaaacacaauaccuacaaua

SEQ ID NO: 1144562 - RNA, 13 nt, Homo sapiens
ugaaacagcugcc

SEQ ID NO: 1144563 - RNA, 14 nt, Homo sapiens
ugaaacagcugcca

SEQ ID NO: 1144564 - RNA, 19 nt, Homo sapiens
ugaaacagcugcccugugu

SEQ ID NO: 1144565 - RNA, 14 nt, Homo sapiens
ugaaaccguaucuc

SEQ ID NO: 1144566 - RNA, 17 nt, Homo sapiens
ugaaacucccagccaca

SEQ ID NO: 1144567 - RNA, 17 nt, Homo sapiens
ugaaaggcauucucuga

SEQ ID NO: 1144568 - RNA, 18 nt, Homo sapiens
ugaaagguaauacagcuu

SEQ ID NO: 1144569 - RNA, 17 nt, Homo sapiens
ugaaagucaugcacaua

SEQ ID NO: 1144570 - RNA, 16 nt, Homo sapiens
ugaaaguggacaagga

SEQ ID NO: 1144571 - RNA, 14 nt, Homo sapiens
ugaaaguuuaacua

SEQ ID NO: 1144572 - RNA, 23 nt, Homo sapiens
ugaaauaccaaccugaagacacc

SEQ ID NO: 1144573 - RNA, 13 nt, Homo sapiens
ugaaauaugugaa

SEQ ID NO: 1144574 - RNA, 17 nt, Homo sapiens
ugaaauauugcuguaua

SEQ ID NO: 1144575 - RNA, 19 nt, Homo sapiens
ugaaauauuuugaauacac

SEQ ID NO: 1144576 - RNA, 22 nt, Homo sapiens
ugaaaucaagucaucuauaguu

SEQ ID NO: 1144577 - RNA, 15 nt, Homo sapiens
ugaaaugaacuuugu

SEQ ID NO: 1144578 - RNA, 11 nt, Homo sapiens
ugaaaugcuag

SEQ ID NO: 1144579 - RNA, 24 nt, Homo sapiens
ugaaauguaggcaucaugcauguc

SEQ ID NO: 1144580 - RNA, 17 nt, Homo sapiens
ugaaauguaugugcucu

SEQ ID NO: 1144581 - RNA, 19 nt, Homo sapiens
ugaaauuaacucagacaca

SEQ ID NO: 1144582 - RNA, 21 nt, Homo sapiens
ugaaauucugaauuugcaaag

SEQ ID NO: 1144583 - RNA, 18 nt, Homo sapiens
ugaaauuugagagacaaa

SEQ ID NO: 1144584 - RNA, 23 nt, Homo sapiens
ugaaauuuugccugcaacagaga

SEQ ID NO: 1144585 - RNA, 21 nt, Homo sapiens
ugaacaaaaacuguauggaau

SEQ ID NO: 1144586 - RNA, 14 nt, Homo sapiens
ugaacaaaauaagc

SEQ ID NO: 1144587 - RNA, 11 nt, Homo sapiens
ugaacaaagca

SEQ ID NO: 1144588 - RNA, 20 nt, Homo sapiens
ugaacaccauaccuuugcua

SEQ ID NO: 1144589 - RNA, 13 nt, Homo sapiens
ugaacagguguuu

SEQ ID NO: 1144590 - RNA, 11 nt, Homo sapiens
ugaacauaugu

SEQ ID NO: 1144591 - RNA, 14 nt, Homo sapiens
ugaacauauguaau

SEQ ID NO: 1144592 - RNA, 22 nt, Homo sapiens
ugaaccaagaccauugaauucu

SEQ ID NO: 1144593 - RNA, 22 nt, Homo sapiens
ugaaccuggcaagucacaggac

SEQ ID NO: 1144594 - RNA, 14 nt, Homo sapiens
ugaacuaaguuauu

SEQ ID NO: 1144595 - RNA, 19 nt, Homo sapiens
ugaacuaaguuauuguuaa

SEQ ID NO: 1144596 - RNA, 17 nt, Homo sapiens
ugaacuaaucugauguu

SEQ ID NO: 1144597 - RNA, 19 nt, Homo sapiens
ugaacuaauuucugugucu

SEQ ID NO: 1144598 - RNA, 14 nt, Homo sapiens
ugaacuacuaaagu

SEQ ID NO: 1144599 - RNA, 20 nt, Homo sapiens
ugaacuacuaaaguuuuaca

SEQ ID NO: 1144600 - RNA, 21 nt, Homo sapiens
ugaacucugguggcacaggag

SEQ ID NO: 1144601 - RNA, 13 nt, Homo sapiens
ugaacugugugua

SEQ ID NO: 1144602 - RNA, 23 nt, Homo sapiens
ugaacuguugguauuaaggcaga

SEQ ID NO: 1144603 - RNA, 19 nt, Homo sapiens
ugaacuucaaaagcuuuuu

SEQ ID NO: 1144604 - RNA, 15 nt, Homo sapiens
ugaacuucaguaugu

SEQ ID NO: 1144605 - RNA, 10 nt, Homo sapiens
ugaacuuugg

SEQ ID NO: 1144606 - RNA, 20 nt, Homo sapiens
ugaacuuugggaagccuuua

SEQ ID NO: 1144607 - RNA, 23 nt, Homo sapiens
ugcaucuaagcccaugggacaaa

SEQ ID NO: 1144608 - RNA, 17 nt, Homo sapiens
ugcaucugcuacugugu

SEQ ID NO: 1144609 - RNA, 14 nt, Homo sapiens
ugcaucuguuacuu

SEQ ID NO: 1144610 - RNA, 19 nt, Homo sapiens
ugcauguaucuucuaagaa

SEQ ID NO: 1144611 - RNA, 13 nt, Homo sapiens
ugcaugucccauc

SEQ ID NO: 1144612 - RNA, 19 nt, Homo sapiens
ugcauuaaaacaaaggaag

SEQ ID NO: 1144613 - RNA, 17 nt, Homo sapiens
ugcauugagcucucuca

SEQ ID NO: 1144614 - RNA, 15 nt, Homo sapiens
ugcauugucugcaau

SEQ ID NO: 1144615 - RNA, 18 nt, Homo sapiens
ugcauugucugcaauggu

SEQ ID NO: 1144616 - RNA, 20 nt, Homo sapiens
ugcauuuggauugggguccc

SEQ ID NO: 1144617 - RNA, 13 nt, Homo sapiens
ugcauuuguacug

SEQ ID NO: 1144618 - RNA, 14 nt, Homo sapiens
ugccaaaaccaaga

SEQ ID NO: 1144619 - RNA, 15 nt, Homo sapiens
ugccaaagaaagugg

SEQ ID NO: 1144620 - RNA, 22 nt, Homo sapiens
ugccaacgcaguucauguacaa

SEQ ID NO: 1144621 - RNA, 15 nt, Homo sapiens
ugccaagacacagca

SEQ ID NO: 1144622 - RNA, 20 nt, Homo sapiens
ugccaaggggcugagugagu

SEQ ID NO: 1144623 - RNA, 17 nt, Homo sapiens
ugccaaucuguacaaaa

SEQ ID NO: 1144624 - RNA, 14 nt, Homo sapiens
ugccacaucugugu

SEQ ID NO: 1144625 - RNA, 19 nt, Homo sapiens
ugccacauuagccuuugca

SEQ ID NO: 1144626 - RNA, 21 nt, Homo sapiens
ugccacgccgcccuaaaagca

SEQ ID NO: 1144627 - RNA, 14 nt, Homo sapiens
ugccacugcacucc

SEQ ID NO: 1144628 - RNA, 17 nt, Homo sapiens
ugccacugcacuccagg

SEQ ID NO: 1144629 - RNA, 14 nt, Homo sapiens
ugccagauccucuu

SEQ ID NO: 1144630 - RNA, 18 nt, Homo sapiens
ugccagauccucuucuca

SEQ ID NO: 1144631 - RNA, 13 nt, Homo sapiens
ugccagcacaaag

SEQ ID NO: 1144632 - RNA, 16 nt, Homo sapiens
ugccagccauucuuuc

SEQ ID NO: 1144633 - RNA, 22 nt, Homo sapiens
ugccaggagauucagagcucaa

SEQ ID NO: 1144634 - RNA, 15 nt, Homo sapiens
ugccagguguggaac

SEQ ID NO: 1144635 - RNA, 15 nt, Homo sapiens
ugccagugcacuccg

SEQ ID NO: 1144636 - RNA, 19 nt, Homo sapiens
ugccaguguggaagcugcc

SEQ ID NO: 1144637 - RNA, 20 nt, Homo sapiens
ugccaguguguuacucaucu

SEQ ID NO: 1144638 - RNA, 11 nt, Homo sapiens
ugccauaacau

SEQ ID NO: 1144639 - RNA, 16 nt, Homo sapiens
ugccauauacucuuca

SEQ ID NO: 1144640 - RNA, 24 nt, Homo sapiens
ugccauaucagugaaccuuuagaa

SEQ ID NO: 1144641 - RNA, 17 nt, Homo sapiens
ugccauccacauuuuaa

SEQ ID NO: 1144642 - RNA, 20 nt, Homo sapiens
ugccauccaugugcuaguca

SEQ ID NO: 1144643 - RNA, 16 nt, Homo sapiens
ugccaucgggugccaa

SEQ ID NO: 1144644 - RNA, 17 nt, Homo sapiens
ugccaucgggugccaaa

SEQ ID NO: 1144645 - RNA, 19 nt, Homo sapiens
ugccauggucaccaaacag

SEQ ID NO: 1144646 - RNA, 22 nt, Homo sapiens
ugccauguguggagugugcuga

SEQ ID NO: 1144647 - RNA, 18 nt, Homo sapiens
ugccauguuuuugccaaa

SEQ ID NO: 1144648 - RNA, 14 nt, Homo sapiens
ugcccaauugagau

SEQ ID NO: 1144649 - RNA, 22 nt, Homo sapiens
ugcccacccccgggauccugcc

SEQ ID NO: 1144650 - RNA, 21 nt, Homo sapiens
ugcccaggcuagagugcaaug

SEQ ID NO: 1144651 - RNA, 20 nt, Homo sapiens
ugcccaggcuggagugcaau

SEQ ID NO: 1144652 - RNA, 21 nt, Homo sapiens
ugcccaggcuggagugcaaug

SEQ ID NO: 1144653 - RNA, 20 nt, Homo sapiens
ugcccaucaucucugccuuu

SEQ ID NO: 1144654 - RNA, 19 nt, Homo sapiens
ugcccauggaagucucaaa

SEQ ID NO: 1144655 - RNA, 18 nt, Homo sapiens
ugccccacauguggccau

SEQ ID NO: 1144656 - RNA, 18 nt, Homo sapiens
ugccccagcagugccuug

SEQ ID NO: 1144657 - RNA, 16 nt, Homo sapiens
ugccccaggacuguca

SEQ ID NO: 1144658 - RNA, 14 nt, Homo sapiens
ugcccccaacagca

SEQ ID NO: 1144659 - RNA, 14 nt, Homo sapiens
ugcccccuccccca

SEQ ID NO: 1144660 - RNA, 19 nt, Homo sapiens
ugccccuugacaacuggca

SEQ ID NO: 1144661 - RNA, 15 nt, Homo sapiens
ugcccgccugcccac

SEQ ID NO: 1144662 - RNA, 17 nt, Homo sapiens
ugcccguaaacacgccu

SEQ ID NO: 1144663 - RNA, 13 nt, Homo sapiens
ugcccuaagugau

SEQ ID NO: 1144664 - RNA, 23 nt, Homo sapiens
ugcccuccucucccgucucgccu

SEQ ID NO: 1144665 - RNA, 19 nt, Homo sapiens
ugcccuccugggagcucau

SEQ ID NO: 1144666 - RNA, 17 nt, Homo sapiens
ugcccugaguccaagag

SEQ ID NO: 1144667 - RNA, 16 nt, Homo sapiens
ugcccuggggccacug

SEQ ID NO: 1144668 - RNA, 21 nt, Homo sapiens
ugcccuuggaggccagccagu

SEQ ID NO: 1144669 - RNA, 16 nt, Homo sapiens
ugccgauuucaggggc

SEQ ID NO: 1144670 - RNA, 19 nt, Homo sapiens
ugccgccuccuugugcaca

SEQ ID NO: 1144671 - RNA, 22 nt, Homo sapiens
ugccggagaggaagagacacuc

SEQ ID NO: 1144672 - RNA, 18 nt, Homo sapiens
ugccgggcccccaccgcc

SEQ ID NO: 1144673 - RNA, 17 nt, Homo sapiens
ugccggggguucagggu

SEQ ID NO: 1144674 - RNA, 21 nt, Homo sapiens
ugccgguaaacacgccugcaa

SEQ ID NO: 1144675 - RNA, 12 nt, Homo sapiens
ugccuacagggc

SEQ ID NO: 1144676 - RNA, 17 nt, Homo sapiens
ugccuaugaaauuucaa

SEQ ID NO: 1144677 - RNA, 19 nt, Homo sapiens
ugccuauggaguagccauu

SEQ ID NO: 1144678 - RNA, 13 nt, Homo sapiens
ugccucagcucag

SEQ ID NO: 1144679 - RNA, 16 nt, Homo sapiens
ugccuccagugcaguc

SEQ ID NO: 1144680 - RNA, 16 nt, Homo sapiens
ugccucccagguucca

SEQ ID NO: 1144681 - RNA, 19 nt, Homo sapiens
ugccuccugguaacagcua

SEQ ID NO: 1144682 - RNA, 15 nt, Homo sapiens
ugccuccuugccagc

SEQ ID NO: 1144683 - RNA, 16 nt, Homo sapiens
ugccucuuaagccugc

SEQ ID NO: 1144684 - RNA, 14 nt, Homo sapiens
ugccugacuaggga

SEQ ID NO: 1144685 - RNA, 19 nt, Homo sapiens
ugccugauccuccaacagc

SEQ ID NO: 1144686 - RNA, 20 nt, Homo sapiens
ugccugauccuccaacagcu

SEQ ID NO: 1144687 - RNA, 14 nt, Homo sapiens
ugccugcagaguuu

SEQ ID NO: 1144688 - RNA, 21 nt, Homo sapiens
ugccugccgguaaacacgccu

SEQ ID NO: 1144689 - RNA, 17 nt, Homo sapiens
ugccugcugggcucuua

SEQ ID NO: 1144690 - RNA, 16 nt, Homo sapiens
ugccuggaacaccagc

SEQ ID NO: 1144691 - RNA, 19 nt, Homo sapiens
ugccuggaacaccagcagc

SEQ ID NO: 1144692 - RNA, 22 nt, Homo sapiens
ugccuggaggagcugugcugcc

SEQ ID NO: 1144693 - RNA, 15 nt, Homo sapiens
ugccuggccuggcac

SEQ ID NO: 1144694 - RNA, 15 nt, Homo sapiens
ugccugggacacugc

SEQ ID NO: 1144695 - RNA, 22 nt, Homo sapiens
ugccugggagugugugguguua

SEQ ID NO: 1144696 - RNA, 16 nt, Homo sapiens
ugccuguaacuugaga

SEQ ID NO: 1144697 - RNA, 17 nt, Homo sapiens
ugccuucacugugcucc

SEQ ID NO: 1144698 - RNA, 20 nt, Homo sapiens
ugccuucaucuucacugcaa

SEQ ID NO: 1144699 - RNA, 19 nt, Homo sapiens
ugccuucccaggaguacac

SEQ ID NO: 1144700 - RNA, 21 nt, Homo sapiens
ugccuucuaaauggcaugaca

SEQ ID NO: 1144701 - RNA, 14 nt, Homo sapiens
ugccuuguucaagg

SEQ ID NO: 1144702 - RNA, 15 nt, Homo sapiens
ugccuuugugguggg

SEQ ID NO: 1144703 - RNA, 23 nt, Homo sapiens
ugccuuuuuauuuauauguacug

SEQ ID NO: 1144704 - RNA, 13 nt, Homo sapiens
ugcgaagacagag

SEQ ID NO: 1144705 - RNA, 22 nt, Homo sapiens
ugcgaucucggcucagugcaac

SEQ ID NO: 1144706 - RNA, 20 nt, Homo sapiens
ugcgcccagcuauacuguau

SEQ ID NO: 1144707 - RNA, 17 nt, Homo sapiens
ugcgcccaguccuucca

SEQ ID NO: 1144708 - RNA, 16 nt, Homo sapiens
ugcggaucuucauggc

SEQ ID NO: 1144709 - RNA, 13 nt, Homo sapiens
ugcggcaucagau

SEQ ID NO: 1144710 - RNA, 13 nt, Homo sapiens
ugcggccauucaa

SEQ ID NO: 1144711 - RNA, 16 nt, Homo sapiens
ugcgguagaugggagg

SEQ ID NO: 1144712 - RNA, 14 nt, Homo sapiens
ugcgucaggcagug

SEQ ID NO: 1144713 - RNA, 18 nt, Homo sapiens
ugcgucaggcagugugag

SEQ ID NO: 1144714 - RNA, 15 nt, Homo sapiens
ugcuaacugaacuuu

SEQ ID NO: 1144715 - RNA, 22 nt, Homo sapiens
ugcuaauccucgcaaccuugag

SEQ ID NO: 1144716 - RNA, 22 nt, Homo sapiens
ugcuaaugaggugcacacaaua

SEQ ID NO: 1144717 - RNA, 14 nt, Homo sapiens
ugcuacauacucca

SEQ ID NO: 1144718 - RNA, 20 nt, Homo sapiens
ugcuacaugguuuagauaaa

SEQ ID NO: 1144719 - RNA, 15 nt, Homo sapiens
ugcuacgugugauuu

SEQ ID NO: 1144720 - RNA, 21 nt, Homo sapiens
ugcuacucauggcaagauuag

SEQ ID NO: 1144721 - RNA, 20 nt, Homo sapiens
ugcuacuuuguauccucuga

SEQ ID NO: 1144722 - RNA, 22 nt, Homo sapiens
ugcuagaaaggacguggaugaa

SEQ ID NO: 1144723 - RNA, 16 nt, Homo sapiens
ugcuagcugcaaguga

SEQ ID NO: 1144724 - RNA, 23 nt, Homo sapiens
ugcuagcuuuccuuuacagcugu

SEQ ID NO: 1144725 - RNA, 20 nt, Homo sapiens
ugcuauaaaauuaacaguau

SEQ ID NO: 1144726 - RNA, 14 nt, Homo sapiens
ugcuauagacauua

SEQ ID NO: 1144727 - RNA, 19 nt, Homo sapiens
ugcuaucggggaagccaga

SEQ ID NO: 1144728 - RNA, 20 nt, Homo sapiens
ugcuaucggggaagccagac

SEQ ID NO: 1144729 - RNA, 17 nt, Homo sapiens
ugcuaugucucuaucca

SEQ ID NO: 1144730 - RNA, 20 nt, Homo sapiens
ugcuauuguaaggucuuugu

SEQ ID NO: 1144731 - RNA, 23 nt, Homo sapiens
ugcuauuucagcaacaaccaucu

SEQ ID NO: 1144732 - RNA, 17 nt, Homo sapiens
ugcucaaaacacuucca

SEQ ID NO: 1144733 - RNA, 13 nt, Homo sapiens
ugcucaaugccau

SEQ ID NO: 1144734 - RNA, 23 nt, Homo sapiens
ugcucagguacuuguaaauuauu

SEQ ID NO: 1144735 - RNA, 22 nt, Homo sapiens
ugcucagugggggcagagccac

SEQ ID NO: 1144736 - RNA, 17 nt, Homo sapiens
ugcuccagcaagcaaac

SEQ ID NO: 1144737 - RNA, 16 nt, Homo sapiens
ugcuccauuuacaaac

SEQ ID NO: 1144738 - RNA, 14 nt, Homo sapiens
ugcuccguuccuca

SEQ ID NO: 1144739 - RNA, 15 nt, Homo sapiens
uguaaauacauaaaa

SEQ ID NO: 1144740 - RNA, 21 nt, Homo sapiens
uguaaauaguuacuccagugc

SEQ ID NO: 1144741 - RNA, 16 nt, Homo sapiens
uguaacuauaccucug

SEQ ID NO: 1144742 - RNA, 23 nt, Homo sapiens
uguaacuugaagguggcuacaaa

SEQ ID NO: 1144743 - RNA, 20 nt, Homo sapiens
uguaacuuuuugcacuauug

SEQ ID NO: 1144744 - RNA, 17 nt, Homo sapiens
uguaagaaacacacuga

SEQ ID NO: 1144745 - RNA, 19 nt, Homo sapiens
uguaagaaacacacugagg

SEQ ID NO: 1144746 - RNA, 21 nt, Homo sapiens
uguaagaguguucaacuguga

SEQ ID NO: 1144747 - RNA, 20 nt, Homo sapiens
uguaagcaacuugcuucuaa

SEQ ID NO: 1144748 - RNA, 16 nt, Homo sapiens
uguaagcauacuuugu

SEQ ID NO: 1144749 - RNA, 14 nt, Homo sapiens
uguaaguuuaccua

SEQ ID NO: 1144750 - RNA, 14 nt, Homo sapiens
uguaaucagcaaua

SEQ ID NO: 1144751 - RNA, 20 nt, Homo sapiens
uguaaucccagcauuuuggg

SEQ ID NO: 1144752 - RNA, 19 nt, Homo sapiens
uguaaucccagcuacuugg

SEQ ID NO: 1144753 - RNA, 17 nt, Homo sapiens
uguaaucucaaugcaag

SEQ ID NO: 1144754 - RNA, 20 nt, Homo sapiens
uguacaaguugaaauaugcu

SEQ ID NO: 1144755 - RNA, 11 nt, Homo sapiens
uguacacugcc

SEQ ID NO: 1144756 - RNA, 19 nt, Homo sapiens
uguacagagaagaagugcu

SEQ ID NO: 1144757 - RNA, 22 nt, Homo sapiens
uguacauguguagccugugcau

SEQ ID NO: 1144758 - RNA, 12 nt, Homo sapiens
uguacauuucac

SEQ ID NO: 1144759 - RNA, 13 nt, Homo sapiens
uguacauuucacc

SEQ ID NO: 1144760 - RNA, 15 nt, Homo sapiens
uguaccguuuccuua

SEQ ID NO: 1144761 - RNA, 14 nt, Homo sapiens
uguaccugugcacg

SEQ ID NO: 1144762 - RNA, 19 nt, Homo sapiens
uguacuggagaguggcaaa

SEQ ID NO: 1144763 - RNA, 15 nt, Homo sapiens
uguacuugauauuau

SEQ ID NO: 1144764 - RNA, 22 nt, Homo sapiens
uguagaaaaacccaaacugaga

SEQ ID NO: 1144765 - RNA, 14 nt, Homo sapiens
uguagaagcaugaa

SEQ ID NO: 1144766 - RNA, 16 nt, Homo sapiens
uguagaauaaaugaag

SEQ ID NO: 1144767 - RNA, 17 nt, Homo sapiens
uguagaauaaaugaaga

SEQ ID NO: 1144768 - RNA, 18 nt, Homo sapiens
uguagacugaaaagccau

SEQ ID NO: 1144769 - RNA, 14 nt, Homo sapiens
uguagauuaccaaa

SEQ ID NO: 1144770 - RNA, 19 nt, Homo sapiens
uguagcaagaugagcaaug

SEQ ID NO: 1144771 - RNA, 21 nt, Homo sapiens
uguagcacucaggcucuccau

SEQ ID NO: 1144772 - RNA, 17 nt, Homo sapiens
uguagccccagugacag

SEQ ID NO: 1144773 - RNA, 20 nt, Homo sapiens
uguagccucgccgucuguga

SEQ ID NO: 1144774 - RNA, 22 nt, Homo sapiens
uguagccucgccgucugugaau

SEQ ID NO: 1144775 - RNA, 14 nt, Homo sapiens
uguagccugugcau

SEQ ID NO: 1144776 - RNA, 16 nt, Homo sapiens
uguagcugugcuuuga

SEQ ID NO: 1144777 - RNA, 20 nt, Homo sapiens
uguaggaaucugccuuccag

SEQ ID NO: 1144778 - RNA, 17 nt, Homo sapiens
uguaggcaucaugcaug

SEQ ID NO: 1144779 - RNA, 16 nt, Homo sapiens
uguaggguaaggugcc

SEQ ID NO: 1144780 - RNA, 22 nt, Homo sapiens
uguaggucauugcaccuaucuc

SEQ ID NO: 1144781 - RNA, 18 nt, Homo sapiens
uguaguaguaauauugcu

SEQ ID NO: 1144782 - RNA, 17 nt, Homo sapiens
uguaguccgugcugaca

SEQ ID NO: 1144783 - RNA, 22 nt, Homo sapiens
uguagucuccaugcaagauuuc

SEQ ID NO: 1144784 - RNA, 13 nt, Homo sapiens
uguagucuugucu

SEQ ID NO: 1144785 - RNA, 16 nt, Homo sapiens
uguagugagcccagau

SEQ ID NO: 1144786 - RNA, 19 nt, Homo sapiens
uguaguuaauuuaauuugc

SEQ ID NO: 1144787 - RNA, 20 nt, Homo sapiens
uguaguuaauuuaauuugca

SEQ ID NO: 1144788 - RNA, 17 nt, Homo sapiens
uguauauauaaucuaua

SEQ ID NO: 1144789 - RNA, 21 nt, Homo sapiens
uguauauuaagguguggcuuu

SEQ ID NO: 1144790 - RNA, 16 nt, Homo sapiens
uguauauuacauacau

SEQ ID NO: 1144791 - RNA, 15 nt, Homo sapiens
uguaucaugugcuag

SEQ ID NO: 1144792 - RNA, 20 nt, Homo sapiens
uguauccucugaccuacaua

SEQ ID NO: 1144793 - RNA, 20 nt, Homo sapiens
uguauggaaucccacuguau

SEQ ID NO: 1144794 - RNA, 17 nt, Homo sapiens
uguaugugugugcaugu

SEQ ID NO: 1144795 - RNA, 18 nt, Homo sapiens
uguauguugugaauuaug

SEQ ID NO: 1144796 - RNA, 17 nt, Homo sapiens
uguauguuuacguccuu

SEQ ID NO: 1144797 - RNA, 15 nt, Homo sapiens
uguauuaacuuguag

SEQ ID NO: 1144798 - RNA, 15 nt, Homo sapiens
uguauuaaugcuaua

SEQ ID NO: 1144799 - RNA, 21 nt, Homo sapiens
uguauucucugagcugugcag

SEQ ID NO: 1144800 - RNA, 15 nt, Homo sapiens
uguauucuguuucag

SEQ ID NO: 1144801 - RNA, 23 nt, Homo sapiens
uguauuggcgcaccaagaucucc

SEQ ID NO: 1144802 - RNA, 16 nt, Homo sapiens
uguauuguauugccca

SEQ ID NO: 1144803 - RNA, 18 nt, Homo sapiens
uguauuuaauuuuaacug

SEQ ID NO: 1144804 - RNA, 19 nt, Homo sapiens
uguauuuuaauaacauauc

SEQ ID NO: 1144805 - RNA, 18 nt, Homo sapiens
uguauuuuccaagugugc

SEQ ID NO: 1144806 - RNA, 21 nt, Homo sapiens
uguauuuuccuaugugcugua

SEQ ID NO: 1144807 - RNA, 18 nt, Homo sapiens
uguauuuugaaaacacuu

SEQ ID NO: 1144808 - RNA, 22 nt, Homo sapiens
ugucaaagugaaagacauuuca

SEQ ID NO: 1144809 - RNA, 18 nt, Homo sapiens
ugucaagggauuacuuau

SEQ ID NO: 1144810 - RNA, 16 nt, Homo sapiens
ugucaaugacaguuuc

SEQ ID NO: 1144811 - RNA, 18 nt, Homo sapiens
ugucaauucuugccaaau

SEQ ID NO: 1144812 - RNA, 13 nt, Homo sapiens
ugucaccacaucu

SEQ ID NO: 1144813 - RNA, 16 nt, Homo sapiens
ugucacccaaagccug

SEQ ID NO: 1144814 - RNA, 22 nt, Homo sapiens
ugucacgaauauggacauauca

SEQ ID NO: 1144815 - RNA, 16 nt, Homo sapiens
ugucagcaucugacca

SEQ ID NO: 1144816 - RNA, 17 nt, Homo sapiens
ugucagcaucugaccau

SEQ ID NO: 1144817 - RNA, 17 nt, Homo sapiens
ugucagcugcuguugaa

SEQ ID NO: 1144818 - RNA, 13 nt, Homo sapiens
ugucaggaggaaa

SEQ ID NO: 1144819 - RNA, 18 nt, Homo sapiens
ugucagguggacccugua

SEQ ID NO: 1144820 - RNA, 22 nt, Homo sapiens
ugucauaagcgaucacuuccua

SEQ ID NO: 1144821 - RNA, 16 nt, Homo sapiens
ugucauccacuuuaug

SEQ ID NO: 1144822 - RNA, 22 nt, Homo sapiens
ugucauguggcuaccuguaacu

SEQ ID NO: 1144823 - RNA, 15 nt, Homo sapiens
ugucauuucaaagac

SEQ ID NO: 1144824 - RNA, 21 nt, Homo sapiens
ugucauuuuggcaucugcaaa

SEQ ID NO: 1144825 - RNA, 14 nt, Homo sapiens
uguccaaaacugcc

SEQ ID NO: 1144826 - RNA, 13 nt, Homo sapiens
uguccacucagua

SEQ ID NO: 1144827 - RNA, 20 nt, Homo sapiens
uguccagcaccuugugccug

SEQ ID NO: 1144828 - RNA, 16 nt, Homo sapiens
uguccagcagcugcca

SEQ ID NO: 1144829 - RNA, 20 nt, Homo sapiens
uguccaggcuggagugcaau

SEQ ID NO: 1144830 - RNA, 13 nt, Homo sapiens
uguccauccuccu

SEQ ID NO: 1144831 - RNA, 23 nt, Homo sapiens
uguccauccuccucuccaugcaa

SEQ ID NO: 1144832 - RNA, 13 nt, Homo sapiens
uguccauuaucua

SEQ ID NO: 1144833 - RNA, 17 nt, Homo sapiens
ugucccaaacaugcacu

SEQ ID NO: 1144834 - RNA, 18 nt, Homo sapiens
ugucccaccaacuuaaaa

SEQ ID NO: 1144835 - RNA, 17 nt, Homo sapiens
ugucccacuaucugggu

SEQ ID NO: 1144836 - RNA, 12 nt, Homo sapiens
ugucccaggacu

SEQ ID NO: 1144837 - RNA, 20 nt, Homo sapiens
ugucccauaauaugcuuuuu

SEQ ID NO: 1144838 - RNA, 14 nt, Homo sapiens
ugucccccaaaaaa

SEQ ID NO: 1144839 - RNA, 13 nt, Homo sapiens
ugucccucugccc

SEQ ID NO: 1144840 - RNA, 14 nt, Homo sapiens
ugucccucuuccau

SEQ ID NO: 1144841 - RNA, 14 nt, Homo sapiens
ugucccugccuuca

SEQ ID NO: 1144842 - RNA, 17 nt, Homo sapiens
ugucccuuggaacucuu

SEQ ID NO: 1144843 - RNA, 19 nt, Homo sapiens
uguccguggcuacaauuca

SEQ ID NO: 1144844 - RNA, 22 nt, Homo sapiens
uguccucagccuugccagagau

SEQ ID NO: 1144845 - RNA, 16 nt, Homo sapiens
uguccucccagcuccu

SEQ ID NO: 1144846 - RNA, 19 nt, Homo sapiens
uguccugugagguuuccca

SEQ ID NO: 1144847 - RNA, 18 nt, Homo sapiens
uguccuguggcaugcaaa

SEQ ID NO: 1144848 - RNA, 18 nt, Homo sapiens
uguccuucaccuuuccca

SEQ ID NO: 1144849 - RNA, 22 nt, Homo sapiens
uguccuuucuagagcacugcca

SEQ ID NO: 1144850 - RNA, 14 nt, Homo sapiens
uguccuuuguggau

SEQ ID NO: 1144851 - RNA, 21 nt, Homo sapiens
ugucgagagcuggccaaagag

SEQ ID NO: 1144852 - RNA, 15 nt, Homo sapiens
ugucguaucugggag

SEQ ID NO: 1144853 - RNA, 22 nt, Homo sapiens
ugucuagaauccugcuuuacag

SEQ ID NO: 1144854 - RNA, 16 nt, Homo sapiens
ugucuagcaugccaac

SEQ ID NO: 1144855 - RNA, 13 nt, Homo sapiens
ugucuauucuugu

SEQ ID NO: 1144856 - RNA, 18 nt, Homo sapiens
ugucucagaccacuauuc

SEQ ID NO: 1144857 - RNA, 17 nt, Homo sapiens
ugucucuauccaucaga

SEQ ID NO: 1144858 - RNA, 24 nt, Homo sapiens
ugucucugacaaugcguggcacau

SEQ ID NO: 1144859 - RNA, 21 nt, Homo sapiens
ugucucugguguucucuggcu

SEQ ID NO: 1144860 - RNA, 18 nt, Homo sapiens
ugucucuuaaaucucuua

SEQ ID NO: 1144861 - RNA, 13 nt, Homo sapiens
ugucugaacuguu

SEQ ID NO: 1144862 - RNA, 12 nt, Homo sapiens
ugucugccuguu

SEQ ID NO: 1144863 - RNA, 16 nt, Homo sapiens
ugucugcuuucuccau

SEQ ID NO: 1144864 - RNA, 19 nt, Homo sapiens
ugucugcuuucuccauugu

SEQ ID NO: 1144865 - RNA, 17 nt, Homo sapiens
ugucugucuagugucug

SEQ ID NO: 1144866 - RNA, 19 nt, Homo sapiens
ugucuguuuccucuguaua

SEQ ID NO: 1144867 - RNA, 19 nt, Homo sapiens
ugucuuaaggagacuggua

SEQ ID NO: 1144868 - RNA, 23 nt, Homo sapiens
ugucuucaaggcuucagucucau

SEQ ID NO: 1144869 - RNA, 20 nt, Homo sapiens
ugucuucagcacccucauaa

SEQ ID NO: 1144870 - RNA, 19 nt, Homo sapiens
ugucuucuccaccacgcug

SEQ ID NO: 1144871 - RNA, 14 nt, Homo sapiens
uuaauuuagcuuag

SEQ ID NO: 1144872 - RNA, 13 nt, Homo sapiens
uuaauuugcacag

SEQ ID NO: 1144873 - RNA, 17 nt, Homo sapiens
uuaauuuuaacugccaa

SEQ ID NO: 1144874 - RNA, 17 nt, Homo sapiens
uuaauuuucaacucaau

SEQ ID NO: 1144875 - RNA, 22 nt, Homo sapiens
uuaauuuuccuuugucauuucc

SEQ ID NO: 1144876 - RNA, 20 nt, Homo sapiens
uuaauuuuuuuaaguuccca

SEQ ID NO: 1144877 - RNA, 15 nt, Homo sapiens
uuacaaaaguauuau

SEQ ID NO: 1144878 - RNA, 18 nt, Homo sapiens
uuacaaagggggaggcua

SEQ ID NO: 1144879 - RNA, 18 nt, Homo sapiens
uuacaaguuuauauauau

SEQ ID NO: 1144880 - RNA, 19 nt, Homo sapiens
uuacaauucccaaaggcaa

SEQ ID NO: 1144881 - RNA, 12 nt, Homo sapiens
uuacacaugaca

SEQ ID NO: 1144882 - RNA, 16 nt, Homo sapiens
uuacacucuuugccac

SEQ ID NO: 1144883 - RNA, 14 nt, Homo sapiens
uuacacuguauauu

SEQ ID NO: 1144884 - RNA, 17 nt, Homo sapiens
uuacacuuuggaccuua

SEQ ID NO: 1144885 - RNA, 20 nt, Homo sapiens
uuacagagauacuguugucc

SEQ ID NO: 1144886 - RNA, 18 nt, Homo sapiens
uuacagggagcugggaca

SEQ ID NO: 1144887 - RNA, 22 nt, Homo sapiens
uuacaggggagaaggaaaugca

SEQ ID NO: 1144888 - RNA, 18 nt, Homo sapiens
uuacagugccacugcaau

SEQ ID NO: 1144889 - RNA, 22 nt, Homo sapiens
uuacaucaugcuggaaccugca

SEQ ID NO: 1144890 - RNA, 15 nt, Homo sapiens
uuacaucuacaaaca

SEQ ID NO: 1144891 - RNA, 22 nt, Homo sapiens
uuacaucugaacaaaaugccuu

SEQ ID NO: 1144892 - RNA, 15 nt, Homo sapiens
uuacauugccugacu

SEQ ID NO: 1144893 - RNA, 20 nt, Homo sapiens
uuaccccacaacgugcaacu

SEQ ID NO: 1144894 - RNA, 22 nt, Homo sapiens
uuacccuugagcugugugccac

SEQ ID NO: 1144895 - RNA, 13 nt, Homo sapiens
uuacgguguacag

SEQ ID NO: 1144896 - RNA, 22 nt, Homo sapiens
uuacuaaggaguaaucugugua

SEQ ID NO: 1144897 - RNA, 13 nt, Homo sapiens
uuacuaaucuuuc

SEQ ID NO: 1144898 - RNA, 15 nt, Homo sapiens
uuacuagcaccugcc

SEQ ID NO: 1144899 - RNA, 15 nt, Homo sapiens
uuacucaaccaaauu

SEQ ID NO: 1144900 - RNA, 21 nt, Homo sapiens
uuacugaaagaaaaagaccua

SEQ ID NO: 1144901 - RNA, 14 nt, Homo sapiens
uuacugaagucuua

SEQ ID NO: 1144902 - RNA, 17 nt, Homo sapiens
uuacugagcaguaggua

SEQ ID NO: 1144903 - RNA, 16 nt, Homo sapiens
uuacugcuugaccaaa

SEQ ID NO: 1144904 - RNA, 18 nt, Homo sapiens
uuacugcuugaccaaaga

SEQ ID NO: 1144905 - RNA, 23 nt, Homo sapiens
uuacuggugcagaugguugacau

SEQ ID NO: 1144906 - RNA, 15 nt, Homo sapiens
uuacuguaagacauu

SEQ ID NO: 1144907 - RNA, 20 nt, Homo sapiens
uuacugugagcuuuugccug

SEQ ID NO: 1144908 - RNA, 13 nt, Homo sapiens
uuacugugucagg

SEQ ID NO: 1144909 - RNA, 12 nt, Homo sapiens
uuacuuaucccu

SEQ ID NO: 1144910 - RNA, 18 nt, Homo sapiens
uuacuugaaguaacuaua

SEQ ID NO: 1144911 - RNA, 20 nt, Homo sapiens
uuacuuguaaauaaagucua

SEQ ID NO: 1144912 - RNA, 10 nt, Homo sapiens
uuacuuugaa

SEQ ID NO: 1144913 - RNA, 20 nt, Homo sapiens
uuagaaaaagaacaugcagu

SEQ ID NO: 1144914 - RNA, 13 nt, Homo sapiens
uuagaaaacuaga

SEQ ID NO: 1144915 - RNA, 17 nt, Homo sapiens
uuagaaaauagagcuuu

SEQ ID NO: 1144916 - RNA, 17 nt, Homo sapiens
uuagaaacaccauucau

SEQ ID NO: 1144917 - RNA, 13 nt, Homo sapiens
uuagaaaggggug

SEQ ID NO: 1144918 - RNA, 23 nt, Homo sapiens
uuagaaaugacugcauuugauau

SEQ ID NO: 1144919 - RNA, 23 nt, Homo sapiens
uuagaacagucauuaauuuucaa

SEQ ID NO: 1144920 - RNA, 17 nt, Homo sapiens
uuagaagaaaaaucugc

SEQ ID NO: 1144921 - RNA, 17 nt, Homo sapiens
uuagaagcaaggcacaa

SEQ ID NO: 1144922 - RNA, 18 nt, Homo sapiens
uuagaaucugaguauaaa

SEQ ID NO: 1144923 - RNA, 21 nt, Homo sapiens
uuagaaugggaucacgaggaa

SEQ ID NO: 1144924 - RNA, 19 nt, Homo sapiens
uuagaaugguugaguuaca

SEQ ID NO: 1144925 - RNA, 19 nt, Homo sapiens
uuagaauuaaaaaagcaua

SEQ ID NO: 1144926 - RNA, 22 nt, Homo sapiens
uuagaccccauacaaguuuaua

SEQ ID NO: 1144927 - RNA, 15 nt, Homo sapiens
uuagacccugcauuu

SEQ ID NO: 1144928 - RNA, 23 nt, Homo sapiens
uuagacucaugguguguuacaca

SEQ ID NO: 1144929 - RNA, 14 nt, Homo sapiens
uuagacuccccuga

SEQ ID NO: 1144930 - RNA, 13 nt, Homo sapiens
uuagagaaugaga

SEQ ID NO: 1144931 - RNA, 16 nt, Homo sapiens
uuagaggaccagugag

SEQ ID NO: 1144932 - RNA, 13 nt, Homo sapiens
uuagauacuaaua

SEQ ID NO: 1144933 - RNA, 12 nt, Homo sapiens
uuagaucuggca

SEQ ID NO: 1144934 - RNA, 23 nt, Homo sapiens
uuagauguucuaagucuuuccau

SEQ ID NO: 1144935 - RNA, 14 nt, Homo sapiens
uuagauucuguaug

SEQ ID NO: 1144936 - RNA, 20 nt, Homo sapiens
uuagcaagcaacugagauuu

SEQ ID NO: 1144937 - RNA, 22 nt, Homo sapiens
uuagcauaaaauuuucuacucu

SEQ ID NO: 1144938 - RNA, 18 nt, Homo sapiens
uuagccgcccaugcacug

SEQ ID NO: 1144939 - RNA, 20 nt, Homo sapiens
uuagcuaguuuuauucuugg

SEQ ID NO: 1144940 - RNA, 20 nt, Homo sapiens
uuagcuccaaagcauuuccc

SEQ ID NO: 1144941 - RNA, 21 nt, Homo sapiens
uuagcuccaaagcauuuccca

SEQ ID NO: 1144942 - RNA, 21 nt, Homo sapiens
uuagcuugguaugagacagau

SEQ ID NO: 1144943 - RNA, 18 nt, Homo sapiens
uuaggagacacagggaag

SEQ ID NO: 1144944 - RNA, 23 nt, Homo sapiens
uuaggauuuucacauucuuggcu

SEQ ID NO: 1144945 - RNA, 17 nt, Homo sapiens
uuaggcccggagcugcc

SEQ ID NO: 1144946 - RNA, 15 nt, Homo sapiens
uuaggcuggaaaugg

SEQ ID NO: 1144947 - RNA, 16 nt, Homo sapiens
uuagggcuaucucagg

SEQ ID NO: 1144948 - RNA, 21 nt, Homo sapiens
uuaggucauuacuaaccauag

SEQ ID NO: 1144949 - RNA, 20 nt, Homo sapiens
uuaggugguguuugcuuguu

SEQ ID NO: 1144950 - RNA, 14 nt, Homo sapiens
uuaguaaacugugc

SEQ ID NO: 1144951 - RNA, 20 nt, Homo sapiens
uuaguacacagcaccagaau

SEQ ID NO: 1144952 - RNA, 20 nt, Homo sapiens
uuaguauugcagccaaagaa

SEQ ID NO: 1144953 - RNA, 16 nt, Homo sapiens
uuagugauugcuuuua

SEQ ID NO: 1144954 - RNA, 22 nt, Homo sapiens
uuagugccguuaucauggagaa

SEQ ID NO: 1144955 - RNA, 21 nt, Homo sapiens
uuaguggauaaccacagggcu

SEQ ID NO: 1144956 - RNA, 13 nt, Homo sapiens
uuaguuaaucucc

SEQ ID NO: 1144957 - RNA, 19 nt, Homo sapiens
uuauaaaaagaugaucgcu

SEQ ID NO: 1144958 - RNA, 13 nt, Homo sapiens
uuauaaaaaugag

SEQ ID NO: 1144959 - RNA, 20 nt, Homo sapiens
uuauaaaaaugagugcuuaa

SEQ ID NO: 1144960 - RNA, 19 nt, Homo sapiens
uuauaaagauaaagcugcc

SEQ ID NO: 1144961 - RNA, 19 nt, Homo sapiens
uuauaaagugcuuguguaa

SEQ ID NO: 1144962 - RNA, 21 nt, Homo sapiens
uuauaaauaaacuguugcucg

SEQ ID NO: 1144963 - RNA, 21 nt, Homo sapiens
uuauaacccagugaguucagc

SEQ ID NO: 1144964 - RNA, 20 nt, Homo sapiens
uuauaagaaagaucaaagac

SEQ ID NO: 1144965 - RNA, 22 nt, Homo sapiens
uuauaagguguuuucuguguaa

SEQ ID NO: 1144966 - RNA, 18 nt, Homo sapiens
uuauaauuggugcauagc

SEQ ID NO: 1144967 - RNA, 19 nt, Homo sapiens
uuauacaaaauaagaacga

SEQ ID NO: 1144968 - RNA, 12 nt, Homo sapiens
uuauacagugau

SEQ ID NO: 1144969 - RNA, 16 nt, Homo sapiens
uuauaccccauuugau

SEQ ID NO: 1144970 - RNA, 14 nt, Homo sapiens
uuauacuacuuugu

SEQ ID NO: 1144971 - RNA, 11 nt, Homo sapiens
uuauacuguac

SEQ ID NO: 1144972 - RNA, 14 nt, Homo sapiens
uuauacuguacaau

SEQ ID NO: 1144973 - RNA, 21 nt, Homo sapiens
uuauacuucucuauuaucuca

SEQ ID NO: 1144974 - RNA, 14 nt, Homo sapiens
uuauacuuuaucaa

SEQ ID NO: 1144975 - RNA, 22 nt, Homo sapiens
uuauagaauaaaagcuguggaa

SEQ ID NO: 1144976 - RNA, 18 nt, Homo sapiens
uuauaguaacaucaaaga

SEQ ID NO: 1144977 - RNA, 12 nt, Homo sapiens
uuauauaauuca

SEQ ID NO: 1144978 - RNA, 14 nt, Homo sapiens
uuauauaauucaag

SEQ ID NO: 1144979 - RNA, 16 nt, Homo sapiens
uuauauacaguacaca

SEQ ID NO: 1144980 - RNA, 19 nt, Homo sapiens
uuauauagcaagugcuauu

SEQ ID NO: 1144981 - RNA, 13 nt, Homo sapiens
uuauauauaaaga

SEQ ID NO: 1144982 - RNA, 18 nt, Homo sapiens
uuauauauaugcuacuuu

SEQ ID NO: 1144983 - RNA, 14 nt, Homo sapiens
uuauaucacuucac

SEQ ID NO: 1144984 - RNA, 15 nt, Homo sapiens
uuauauguacuguuu

SEQ ID NO: 1144985 - RNA, 19 nt, Homo sapiens
uuauauuguuucaucccau

SEQ ID NO: 1144986 - RNA, 18 nt, Homo sapiens
uuaucaccgugggcuccc

SEQ ID NO: 1144987 - RNA, 22 nt, Homo sapiens
uuaucacuguuuaaagcuuuga

SEQ ID NO: 1144988 - RNA, 15 nt, Homo sapiens
uuauccaaugguguu

SEQ ID NO: 1144989 - RNA, 21 nt, Homo sapiens
uuauccaccaagaacauaaga

SEQ ID NO: 1144990 - RNA, 23 nt, Homo sapiens
uuauccauggguuccuacgccuu

SEQ ID NO: 1144991 - RNA, 13 nt, Homo sapiens
uuauccugugcua

SEQ ID NO: 1144992 - RNA, 17 nt, Homo sapiens
uuaucuaaaucaccaga

SEQ ID NO: 1144993 - RNA, 13 nt, Homo sapiens
uuaugaacuacag

SEQ ID NO: 1144994 - RNA, 15 nt, Homo sapiens
uuaugaagugcuaca

SEQ ID NO: 1144995 - RNA, 22 nt, Homo sapiens
uuaugaccaugguauauuccua

SEQ ID NO: 1144996 - RNA, 21 nt, Homo sapiens
uuaugagaacugguucuugcc

SEQ ID NO: 1144997 - RNA, 22 nt, Homo sapiens
uuaugaggguccucuacuucag

SEQ ID NO: 1144998 - RNA, 15 nt, Homo sapiens
uuaugauagugcaag

SEQ ID NO: 1144999 - RNA, 18 nt, Homo sapiens
uuaugaugccacuuuucu

SEQ ID NO: 1145000 - RNA, 13 nt, Homo sapiens
uuaugaugcuaug

SEQ ID NO: 1145001 - RNA, 14 nt, Homo sapiens
uuaugcaaccauaa

SEQ ID NO: 1145002 - RNA, 11 nt, Homo sapiens
uuaugccaaau

SEQ ID NO: 1145003 - RNA, 20 nt, Homo sapiens
auuuauugccuggaguguga

SEQ ID NO: 1145004 - RNA, 17 nt, Homo sapiens
auuuauuuacagaugaa

SEQ ID NO: 1145005 - RNA, 16 nt, Homo sapiens
auuucaauuccuggcc

SEQ ID NO: 1145006 - RNA, 21 nt, Homo sapiens
auuucagcaacaaccaucuca

SEQ ID NO: 1145007 - RNA, 15 nt, Homo sapiens
auuucagcuugaccu

SEQ ID NO: 1145008 - RNA, 11 nt, Homo sapiens
auuucaucucu

SEQ ID NO: 1145009 - RNA, 22 nt, Homo sapiens
auuucaugugcggggaucaucu

SEQ ID NO: 1145010 - RNA, 16 nt, Homo sapiens
auuucaugugcuauag

SEQ ID NO: 1145011 - RNA, 14 nt, Homo sapiens
auuucaugugucaa

SEQ ID NO: 1145012 - RNA, 15 nt, Homo sapiens
auuucauucauaucc

SEQ ID NO: 1145013 - RNA, 19 nt, Homo sapiens
auuuccaaaccuccacugc

SEQ ID NO: 1145014 - RNA, 21 nt, Homo sapiens
auuuccaaaccuccacugcug

SEQ ID NO: 1145015 - RNA, 22 nt, Homo sapiens
auuuccaaaccuccacugcugc

SEQ ID NO: 1145016 - RNA, 12 nt, Homo sapiens
auuucccaggac

SEQ ID NO: 1145017 - RNA, 19 nt, Homo sapiens
auuucccaggacccugaag

SEQ ID NO: 1145018 - RNA, 16 nt, Homo sapiens
auuuccccagccacag

SEQ ID NO: 1145019 - RNA, 20 nt, Homo sapiens
auuucccuucauacuccuuu

SEQ ID NO: 1145020 - RNA, 15 nt, Homo sapiens
auuuccugacuugag

SEQ ID NO: 1145021 - RNA, 22 nt, Homo sapiens
auuuccuuuguugucuacauua

SEQ ID NO: 1145022 - RNA, 16 nt, Homo sapiens
auuucgagcauaagaa

SEQ ID NO: 1145023 - RNA, 20 nt, Homo sapiens
auuucggagcgcaaugccau

SEQ ID NO: 1145024 - RNA, 14 nt, Homo sapiens
auuucuaagcagau

SEQ ID NO: 1145025 - RNA, 18 nt, Homo sapiens
auuucuagggcugggaaa

SEQ ID NO: 1145026 - RNA, 22 nt, Homo sapiens
auuucuagggcugggaaacacu

SEQ ID NO: 1145027 - RNA, 15 nt, Homo sapiens
auuucuauaaauaga

SEQ ID NO: 1145028 - RNA, 12 nt, Homo sapiens
auuucuaugcag

SEQ ID NO: 1145029 - RNA, 18 nt, Homo sapiens
auuucuccagaacccauu

SEQ ID NO: 1145030 - RNA, 19 nt, Homo sapiens
auuucuccuccaugggaga

SEQ ID NO: 1145031 - RNA, 17 nt, Homo sapiens
auuucugauaagacaug

SEQ ID NO: 1145032 - RNA, 19 nt, Homo sapiens
auuucugaucuauacaaau

SEQ ID NO: 1145033 - RNA, 20 nt, Homo sapiens
auuucugggugaugaaaaug

SEQ ID NO: 1145034 - RNA, 15 nt, Homo sapiens
auuucuuaaguauaa

SEQ ID NO: 1145035 - RNA, 14 nt, Homo sapiens
auuucuuaguccau

SEQ ID NO: 1145036 - RNA, 19 nt, Homo sapiens
auuucuuugauuuaacuga

SEQ ID NO: 1145037 - RNA, 20 nt, Homo sapiens
auuucuuuguaaagcauccu

SEQ ID NO: 1145038 - RNA, 19 nt, Homo sapiens
auuucuuuugugcagauca

SEQ ID NO: 1145039 - RNA, 13 nt, Homo sapiens
auuugaaaacaua

SEQ ID NO: 1145040 - RNA, 21 nt, Homo sapiens
auuugagaucguccacuguca

SEQ ID NO: 1145041 - RNA, 14 nt, Homo sapiens
auuugaguugugau

SEQ ID NO: 1145042 - RNA, 16 nt, Homo sapiens
auuugaguugugauug

SEQ ID NO: 1145043 - RNA, 14 nt, Homo sapiens
auuugaugcauguc

SEQ ID NO: 1145044 - RNA, 11 nt, Homo sapiens
auuugaugcuu

SEQ ID NO: 1145045 - RNA, 16 nt, Homo sapiens
auuugcaaaguacugu

SEQ ID NO: 1145046 - RNA, 19 nt, Homo sapiens
auuugcauaacaauuccuc

SEQ ID NO: 1145047 - RNA, 13 nt, Homo sapiens
auuugcauaccau

SEQ ID NO: 1145048 - RNA, 21 nt, Homo sapiens
auuugccuguaacaagccaga

SEQ ID NO: 1145049 - RNA, 19 nt, Homo sapiens
auuuggaggagugaacauc

SEQ ID NO: 1145050 - RNA, 14 nt, Homo sapiens
auuuggagugaugg

SEQ ID NO: 1145051 - RNA, 21 nt, Homo sapiens
auuuggcuccuuaccaauauu

SEQ ID NO: 1145052 - RNA, 20 nt, Homo sapiens
auuugggccugcuccagacc

SEQ ID NO: 1145053 - RNA, 21 nt, Homo sapiens
auuugguaauucuguguaaca

SEQ ID NO: 1145054 - RNA, 15 nt, Homo sapiens
auuugguguacaauu

SEQ ID NO: 1145055 - RNA, 17 nt, Homo sapiens
auuugguuaugauggaa

SEQ ID NO: 1145056 - RNA, 15 nt, Homo sapiens
auuuguaugaauaug

SEQ ID NO: 1145057 - RNA, 22 nt, Homo sapiens
auuuguauuuucaagacuuuaa

SEQ ID NO: 1145058 - RNA, 13 nt, Homo sapiens
auuugugaacuca

SEQ ID NO: 1145059 - RNA, 22 nt, Homo sapiens
auuugugacuaauuguauaaca

SEQ ID NO: 1145060 - RNA, 17 nt, Homo sapiens
auuugugccgacacugu

SEQ ID NO: 1145061 - RNA, 21 nt, Homo sapiens
auuugugguccacugagcuau

SEQ ID NO: 1145062 - RNA, 18 nt, Homo sapiens
auuuguuaacuguacuga

SEQ ID NO: 1145063 - RNA, 19 nt, Homo sapiens
auuuguuaacuguacugaa

SEQ ID NO: 1145064 - RNA, 21 nt, Homo sapiens
auuuguucugggaguauaaag

SEQ ID NO: 1145065 - RNA, 13 nt, Homo sapiens
auuuguuuuuacc

SEQ ID NO: 1145066 - RNA, 20 nt, Homo sapiens
auuuuaaauauugucauuac

SEQ ID NO: 1145067 - RNA, 14 nt, Homo sapiens
auuuuaacucuguc

SEQ ID NO: 1145068 - RNA, 19 nt, Homo sapiens
auuuuaagaauuucacaag

SEQ ID NO: 1145069 - RNA, 21 nt, Homo sapiens
auuuuaaugaagaaaguggaa

SEQ ID NO: 1145070 - RNA, 23 nt, Homo sapiens
auuuuaauuuuuuuuaguauuua

SEQ ID NO: 1145071 - RNA, 18 nt, Homo sapiens
auuuuacccacacacaga

SEQ ID NO: 1145072 - RNA, 17 nt, Homo sapiens
auuuuagugaacuugaa

SEQ ID NO: 1145073 - RNA, 12 nt, Homo sapiens
auuuuauaaaga

SEQ ID NO: 1145074 - RNA, 23 nt, Homo sapiens
auuuuauaaagaucagaaugaua

SEQ ID NO: 1145075 - RNA, 15 nt, Homo sapiens
auuuuaucuguggag

SEQ ID NO: 1145076 - RNA, 14 nt, Homo sapiens
auuuuauucccaag

SEQ ID NO: 1145077 - RNA, 23 nt, Homo sapiens
auuuuauuuuuguaucuuaaaaa

SEQ ID NO: 1145078 - RNA, 13 nt, Homo sapiens
auuuucaagacuu

SEQ ID NO: 1145079 - RNA, 16 nt, Homo sapiens
auuuucacaucaaaga

SEQ ID NO: 1145080 - RNA, 16 nt, Homo sapiens
auuuucaccuauuacc

SEQ ID NO: 1145081 - RNA, 22 nt, Homo sapiens
auuuucacugcugcuccucuuu

SEQ ID NO: 1145082 - RNA, 15 nt, Homo sapiens
auuuucagagccaaa

SEQ ID NO: 1145083 - RNA, 21 nt, Homo sapiens
auuuucagagugacacccaag

SEQ ID NO: 1145084 - RNA, 20 nt, Homo sapiens
auuuucagcaaaacuuucca

SEQ ID NO: 1145085 - RNA, 13 nt, Homo sapiens
auuuucagcauca

SEQ ID NO: 1145086 - RNA, 13 nt, Homo sapiens
auuuucagccaaa

SEQ ID NO: 1145087 - RNA, 14 nt, Homo sapiens
auuuucagccaaag

SEQ ID NO: 1145088 - RNA, 18 nt, Homo sapiens
auuuuccaagugugcaua

SEQ ID NO: 1145089 - RNA, 17 nt, Homo sapiens
auuuuccuccaaaguaa

SEQ ID NO: 1145090 - RNA, 19 nt, Homo sapiens
auuuucuacacauacaugu

SEQ ID NO: 1145091 - RNA, 19 nt, Homo sapiens
auuuucucuuaacaagacu

SEQ ID NO: 1145092 - RNA, 16 nt, Homo sapiens
auuuucuucucugcac

SEQ ID NO: 1145093 - RNA, 23 nt, Homo sapiens
auuuugcacaguuaccugcacac

SEQ ID NO: 1145094 - RNA, 20 nt, Homo sapiens
auuuugcuaaggagaagcua

SEQ ID NO: 1145095 - RNA, 23 nt, Homo sapiens
auuuugcuaaggagaagcuaaua

SEQ ID NO: 1145096 - RNA, 20 nt, Homo sapiens
auuuuggagaguuuccugaa

SEQ ID NO: 1145097 - RNA, 14 nt, Homo sapiens
auuuuggaggcaaa

SEQ ID NO: 1145098 - RNA, 17 nt, Homo sapiens
auuuuguaagaaguuuc

SEQ ID NO: 1145099 - RNA, 17 nt, Homo sapiens
auuuuguauuccacauu

SEQ ID NO: 1145100 - RNA, 21 nt, Homo sapiens
auuuugugaugaaucuacauu

SEQ ID NO: 1145101 - RNA, 19 nt, Homo sapiens
auuuugugguuccuucccu

SEQ ID NO: 1145102 - RNA, 21 nt, Homo sapiens
auuuuguugccuucaucuuca

SEQ ID NO: 1145103 - RNA, 15 nt, Homo sapiens
auuuuuagaauuaaa

SEQ ID NO: 1145104 - RNA, 12 nt, Homo sapiens
auuuuuaucucc

SEQ ID NO: 1145105 - RNA, 21 nt, Homo sapiens
auuuuucauuuuuccaugaca

SEQ ID NO: 1145106 - RNA, 17 nt, Homo sapiens
auuuuuccacacuaugu

SEQ ID NO: 1145107 - RNA, 22 nt, Homo sapiens
auuuuuccuuccuuccuuccau

SEQ ID NO: 1145108 - RNA, 20 nt, Homo sapiens
auuuuugauuaacaauguau

SEQ ID NO: 1145109 - RNA, 12 nt, Homo sapiens
auuuuugcaaua

SEQ ID NO: 1145110 - RNA, 21 nt, Homo sapiens
caacuggguuuucagcauaaa

SEQ ID NO: 1145111 - RNA, 15 nt, Homo sapiens
caacuguccuacuca

SEQ ID NO: 1145112 - RNA, 19 nt, Homo sapiens
caacuuccuaaauauuaug

SEQ ID NO: 1145113 - RNA, 22 nt, Homo sapiens
caacuugaacuucaccugcaaa

SEQ ID NO: 1145114 - RNA, 19 nt, Homo sapiens
caacuuggaaaaagaaaga

SEQ ID NO: 1145115 - RNA, 21 nt, Homo sapiens
caagaaaggccugaauggagg

SEQ ID NO: 1145116 - RNA, 20 nt, Homo sapiens
caagaagggaguuccaguca

SEQ ID NO: 1145117 - RNA, 16 nt, Homo sapiens
caagaagucccaagac

SEQ ID NO: 1145118 - RNA, 15 nt, Homo sapiens
caagaaucacuugaa

SEQ ID NO: 1145119 - RNA, 17 nt, Homo sapiens
caagacaagccuggccu

SEQ ID NO: 1145120 - RNA, 13 nt, Homo sapiens
caagacagcucuu

SEQ ID NO: 1145121 - RNA, 20 nt, Homo sapiens
caagaccaccaacguguccu

SEQ ID NO: 1145122 - RNA, 21 nt, Homo sapiens
caagaccaccaacguguccuu

SEQ ID NO: 1145123 - RNA, 18 nt, Homo sapiens
caagacccccagcacuug

SEQ ID NO: 1145124 - RNA, 20 nt, Homo sapiens
caagaccuaaggguuuuauc

SEQ ID NO: 1145125 - RNA, 18 nt, Homo sapiens
caagaccucugugcacuu

SEQ ID NO: 1145126 - RNA, 12 nt, Homo sapiens
caagacugcuga

SEQ ID NO: 1145127 - RNA, 21 nt, Homo sapiens
caagacuuauggaacagggau

SEQ ID NO: 1145128 - RNA, 18 nt, Homo sapiens
caagacuugauacugcaa

SEQ ID NO: 1145129 - RNA, 19 nt, Homo sapiens
caagacuuuaaacauuuau

SEQ ID NO: 1145130 - RNA, 14 nt, Homo sapiens
caagagacugaguc

SEQ ID NO: 1145131 - RNA, 17 nt, Homo sapiens
caagagagggaugcaug

SEQ ID NO: 1145132 - RNA, 23 nt, Homo sapiens
caagagagggaugcauggagaua

SEQ ID NO: 1145133 - RNA, 15 nt, Homo sapiens
caagagccugagagu

SEQ ID NO: 1145134 - RNA, 16 nt, Homo sapiens
caagagggaaggugac

SEQ ID NO: 1145135 - RNA, 20 nt, Homo sapiens
caagagucucuccagccuca

SEQ ID NO: 1145136 - RNA, 19 nt, Homo sapiens
caagaguuucaaaacauac

SEQ ID NO: 1145137 - RNA, 21 nt, Homo sapiens
caagaguuucaaaacauacaa

SEQ ID NO: 1145138 - RNA, 16 nt, Homo sapiens
caagauaaacacuuuc

SEQ ID NO: 1145139 - RNA, 19 nt, Homo sapiens
caagauacacgucacaaag

SEQ ID NO: 1145140 - RNA, 14 nt, Homo sapiens
caagaucaaaccca

SEQ ID NO: 1145141 - RNA, 21 nt, Homo sapiens
caagauccaaaugcugugcaa

SEQ ID NO: 1145142 - RNA, 21 nt, Homo sapiens
caagaugcuggaugucugcca

SEQ ID NO: 1145143 - RNA, 17 nt, Homo sapiens
caagauggcgacaaaag

SEQ ID NO: 1145144 - RNA, 17 nt, Homo sapiens
caagauuaauuucauca

SEQ ID NO: 1145145 - RNA, 15 nt, Homo sapiens
caagauuuugaagga

SEQ ID NO: 1145146 - RNA, 13 nt, Homo sapiens
caagcaagacuga

SEQ ID NO: 1145147 - RNA, 19 nt, Homo sapiens
caagcacuuuauauuuucc

SEQ ID NO: 1145148 - RNA, 19 nt, Homo sapiens
caagcaggcgcugugcuau

SEQ ID NO: 1145149 - RNA, 22 nt, Homo sapiens
caagcagugccugccuaugaaa

SEQ ID NO: 1145150 - RNA, 19 nt, Homo sapiens
caagcauauuggaaaguga

SEQ ID NO: 1145151 - RNA, 21 nt, Homo sapiens
caagcauauuuuguggcauuu

SEQ ID NO: 1145152 - RNA, 13 nt, Homo sapiens
caagcaugcuugu

SEQ ID NO: 1145153 - RNA, 14 nt, Homo sapiens
caagcauugaauaa

SEQ ID NO: 1145154 - RNA, 17 nt, Homo sapiens
caagcccuguugacaca

SEQ ID NO: 1145155 - RNA, 17 nt, Homo sapiens
caagcgucugugcauuu

SEQ ID NO: 1145156 - RNA, 22 nt, Homo sapiens
caagcucuguccaaucagguag

SEQ ID NO: 1145157 - RNA, 13 nt, Homo sapiens
caagcugcugcuu

SEQ ID NO: 1145158 - RNA, 21 nt, Homo sapiens
caagcugguggccucugcagg

SEQ ID NO: 1145159 - RNA, 17 nt, Homo sapiens
caagcuguguuacuuga

SEQ ID NO: 1145160 - RNA, 21 nt, Homo sapiens
caaggaaacccccaguguaau

SEQ ID NO: 1145161 - RNA, 13 nt, Homo sapiens
caaggaagucaaa

SEQ ID NO: 1145162 - RNA, 22 nt, Homo sapiens
caaggagcaucccuaauucuuc

SEQ ID NO: 1145163 - RNA, 18 nt, Homo sapiens
caaggagggugagugcaa

SEQ ID NO: 1145164 - RNA, 20 nt, Homo sapiens
caaggagggugagugcaagg

SEQ ID NO: 1145165 - RNA, 15 nt, Homo sapiens
caaggaugcauacau

SEQ ID NO: 1145166 - RNA, 16 nt, Homo sapiens
caaggaugucugccac

SEQ ID NO: 1145167 - RNA, 17 nt, Homo sapiens
caaggaugucugccaca

SEQ ID NO: 1145168 - RNA, 18 nt, Homo sapiens
caaggcaaacccuguuca

SEQ ID NO: 1145169 - RNA, 14 nt, Homo sapiens
caaggcacaaguca

SEQ ID NO: 1145170 - RNA, 17 nt, Homo sapiens
caaggccagaugcacau

SEQ ID NO: 1145171 - RNA, 14 nt, Homo sapiens
caaggccuugccug

SEQ ID NO: 1145172 - RNA, 13 nt, Homo sapiens
caaggcucaaggg

SEQ ID NO: 1145173 - RNA, 15 nt, Homo sapiens
caaggcuccacaagc

SEQ ID NO: 1145174 - RNA, 21 nt, Homo sapiens
caagggaauucggugugcacc

SEQ ID NO: 1145175 - RNA, 17 nt, Homo sapiens
caagggacaaguauuaa

SEQ ID NO: 1145176 - RNA, 15 nt, Homo sapiens
caagggacccaugag

SEQ ID NO: 1145177 - RNA, 13 nt, Homo sapiens
caagggagaguga

SEQ ID NO: 1145178 - RNA, 16 nt, Homo sapiens
caagggagguaaggga

SEQ ID NO: 1145179 - RNA, 21 nt, Homo sapiens
caaggggaagccuccugucuc

SEQ ID NO: 1145180 - RNA, 22 nt, Homo sapiens
caaggggaagccuccugucucc

SEQ ID NO: 1145181 - RNA, 18 nt, Homo sapiens
caagguaaauauucauuu

SEQ ID NO: 1145182 - RNA, 21 nt, Homo sapiens
caagguccucugucagucaca

SEQ ID NO: 1145183 - RNA, 14 nt, Homo sapiens
caagguuccacaga

SEQ ID NO: 1145184 - RNA, 21 nt, Homo sapiens
caagguucuucccuuuuacau

SEQ ID NO: 1145185 - RNA, 15 nt, Homo sapiens
caaguaacucaguga

SEQ ID NO: 1145186 - RNA, 14 nt, Homo sapiens
caaguaauugugaa

SEQ ID NO: 1145187 - RNA, 16 nt, Homo sapiens
caaguacuacaaggaa

SEQ ID NO: 1145188 - RNA, 15 nt, Homo sapiens
caaguagcugcuacc

SEQ ID NO: 1145189 - RNA, 13 nt, Homo sapiens
caaguauccagac

SEQ ID NO: 1145190 - RNA, 23 nt, Homo sapiens
caaguauuaauaguucaguguau

SEQ ID NO: 1145191 - RNA, 23 nt, Homo sapiens
caagucauaccuacauucaagga

SEQ ID NO: 1145192 - RNA, 17 nt, Homo sapiens
caagucauggacauuca

SEQ ID NO: 1145193 - RNA, 22 nt, Homo sapiens
caagucccuuugugacuucaag

SEQ ID NO: 1145194 - RNA, 15 nt, Homo sapiens
caagucuacuucacu

SEQ ID NO: 1145195 - RNA, 18 nt, Homo sapiens
caagucucagauucccau

SEQ ID NO: 1145196 - RNA, 18 nt, Homo sapiens
caagugaaaaacauccag

SEQ ID NO: 1145197 - RNA, 14 nt, Homo sapiens
caagugacaucucu

SEQ ID NO: 1145198 - RNA, 16 nt, Homo sapiens
caagugacucuccugc

SEQ ID NO: 1145199 - RNA, 20 nt, Homo sapiens
caagugagucugguggagga

SEQ ID NO: 1145200 - RNA, 18 nt, Homo sapiens
caagugauccucaggcag

SEQ ID NO: 1145201 - RNA, 15 nt, Homo sapiens
caaguggagccaccu

SEQ ID NO: 1145202 - RNA, 15 nt, Homo sapiens
caaguggcagacaua

SEQ ID NO: 1145203 - RNA, 12 nt, Homo sapiens
caagugugaaca

SEQ ID NO: 1145204 - RNA, 22 nt, Homo sapiens
caagugugcauauuguacacuu

SEQ ID NO: 1145205 - RNA, 13 nt, Homo sapiens
caaguuacaguga

SEQ ID NO: 1145206 - RNA, 14 nt, Homo sapiens
caaguugauauuuc

SEQ ID NO: 1145207 - RNA, 17 nt, Homo sapiens
caaguuguguuugauau

SEQ ID NO: 1145208 - RNA, 19 nt, Homo sapiens
caaguuguuuaacugugca

SEQ ID NO: 1145209 - RNA, 18 nt, Homo sapiens
caaguuugaccagugcag

SEQ ID NO: 1145210 - RNA, 19 nt, Homo sapiens
caaguuugaccagugcagu

SEQ ID NO: 1145211 - RNA, 17 nt, Homo sapiens
caaguuuuguggggcuu

SEQ ID NO: 1145212 - RNA, 12 nt, Homo sapiens
caaguuuuuaca

SEQ ID NO: 1145213 - RNA, 19 nt, Homo sapiens
caauaaacugguaugaaua

SEQ ID NO: 1145214 - RNA, 15 nt, Homo sapiens
caauaaagcuccuuu

SEQ ID NO: 1145215 - RNA, 21 nt, Homo sapiens
cuuuaauucauaaaucacaaa

SEQ ID NO: 1145216 - RNA, 15 nt, Homo sapiens
cuuuacaaaaguauu

SEQ ID NO: 1145217 - RNA, 20 nt, Homo sapiens
cuuuacaaauagaauuugag

SEQ ID NO: 1145218 - RNA, 12 nt, Homo sapiens
cuuuacaauaaa

SEQ ID NO: 1145219 - RNA, 17 nt, Homo sapiens
cuuuacaguggcaaaaa

SEQ ID NO: 1145220 - RNA, 12 nt, Homo sapiens
cuuuacuccugg

SEQ ID NO: 1145221 - RNA, 14 nt, Homo sapiens
cuuuacuccuggcu

SEQ ID NO: 1145222 - RNA, 23 nt, Homo sapiens
cuuuacuguaaaggcaagccagc

SEQ ID NO: 1145223 - RNA, 14 nt, Homo sapiens
cuuuaggcuuucag

SEQ ID NO: 1145224 - RNA, 20 nt, Homo sapiens
cuuuaguguauuuucuguca

SEQ ID NO: 1145225 - RNA, 16 nt, Homo sapiens
cuuuaucaucuuucac

SEQ ID NO: 1145226 - RNA, 20 nt, Homo sapiens
cuuuaugaagugcuacagaa

SEQ ID NO: 1145227 - RNA, 16 nt, Homo sapiens
cuuuauugacuaccug

SEQ ID NO: 1145228 - RNA, 16 nt, Homo sapiens
cuuucaaacauguuga

SEQ ID NO: 1145229 - RNA, 21 nt, Homo sapiens
cuuucaauaucuuuauugcau

SEQ ID NO: 1145230 - RNA, 21 nt, Homo sapiens
cuuucacugagccuccacagc

SEQ ID NO: 1145231 - RNA, 16 nt, Homo sapiens
cuuucagcagacugau

SEQ ID NO: 1145232 - RNA, 14 nt, Homo sapiens
cuuucauaaucuuu

SEQ ID NO: 1145233 - RNA, 18 nt, Homo sapiens
cuuucauccaacucuaaa

SEQ ID NO: 1145234 - RNA, 17 nt, Homo sapiens
cuuucaucccauacuca

SEQ ID NO: 1145235 - RNA, 18 nt, Homo sapiens
cuuucaugaguuuuuccc

SEQ ID NO: 1145236 - RNA, 13 nt, Homo sapiens
cuuucaugugugc

SEQ ID NO: 1145237 - RNA, 14 nt, Homo sapiens
cuuucauucucucu

SEQ ID NO: 1145238 - RNA, 14 nt, Homo sapiens
cuuuccaaccggcu

SEQ ID NO: 1145239 - RNA, 15 nt, Homo sapiens
cuuuccaagucauuu

SEQ ID NO: 1145240 - RNA, 13 nt, Homo sapiens
cuuuccacuuugu

SEQ ID NO: 1145241 - RNA, 14 nt, Homo sapiens
cuuuccccagugac

SEQ ID NO: 1145242 - RNA, 22 nt, Homo sapiens
cuuucccccugugaaagcaaaa

SEQ ID NO: 1145243 - RNA, 21 nt, Homo sapiens
cuuuccgaggccccugucuca

SEQ ID NO: 1145244 - RNA, 19 nt, Homo sapiens
cuuuccucagaucauccag

SEQ ID NO: 1145245 - RNA, 24 nt, Homo sapiens
cuuuccuggaaaacucaugaauaa

SEQ ID NO: 1145246 - RNA, 22 nt, Homo sapiens
cuuuccugguucugucuagacu

SEQ ID NO: 1145247 - RNA, 23 nt, Homo sapiens
cuuuccugugugaagaaagccuc

SEQ ID NO: 1145248 - RNA, 13 nt, Homo sapiens
cuuuccuguucca

SEQ ID NO: 1145249 - RNA, 17 nt, Homo sapiens
cuuuccuuaugucuccu

SEQ ID NO: 1145250 - RNA, 23 nt, Homo sapiens
cuuucguagccuaaaagacaauu

SEQ ID NO: 1145251 - RNA, 20 nt, Homo sapiens
cuuucuccauuguaaaccac

SEQ ID NO: 1145252 - RNA, 18 nt, Homo sapiens
cuuucucccuaaccacua

SEQ ID NO: 1145253 - RNA, 20 nt, Homo sapiens
cuuucugacaucagcacuuu

SEQ ID NO: 1145254 - RNA, 19 nt, Homo sapiens
cuuucugaccuucagcuca

SEQ ID NO: 1145255 - RNA, 13 nt, Homo sapiens
cuuucuguucucc

SEQ ID NO: 1145256 - RNA, 15 nt, Homo sapiens
cuuucuguucuccag

SEQ ID NO: 1145257 - RNA, 13 nt, Homo sapiens
cuuucuguugcca

SEQ ID NO: 1145258 - RNA, 19 nt, Homo sapiens
cuuucuguuuggacccaug

SEQ ID NO: 1145259 - RNA, 16 nt, Homo sapiens
cuuucuuccaaacagg

SEQ ID NO: 1145260 - RNA, 13 nt, Homo sapiens
cuuucuucucgcc

SEQ ID NO: 1145261 - RNA, 14 nt, Homo sapiens
cuuucuucugaaua

SEQ ID NO: 1145262 - RNA, 23 nt, Homo sapiens
cuuucuuguuugucagcaucuga

SEQ ID NO: 1145263 - RNA, 11 nt, Homo sapiens
cuuucuuuauc

SEQ ID NO: 1145264 - RNA, 18 nt, Homo sapiens
cuuugaaucuaguuguua

SEQ ID NO: 1145265 - RNA, 19 nt, Homo sapiens
cuuugacauugauguguuc

SEQ ID NO: 1145266 - RNA, 21 nt, Homo sapiens
cuuugagaggcugagguggua

SEQ ID NO: 1145267 - RNA, 21 nt, Homo sapiens
cuuugagcaacuaacuaacca

SEQ ID NO: 1145268 - RNA, 16 nt, Homo sapiens
cuuugagccugggaaa

SEQ ID NO: 1145269 - RNA, 21 nt, Homo sapiens
cuuugagcugcugacugccaa

SEQ ID NO: 1145270 - RNA, 21 nt, Homo sapiens
cuuugaguacagauacuguga

SEQ ID NO: 1145271 - RNA, 22 nt, Homo sapiens
cuuugauacagucaacaagccu

SEQ ID NO: 1145272 - RNA, 18 nt, Homo sapiens
cuuugaugucauauggaa

SEQ ID NO: 1145273 - RNA, 16 nt, Homo sapiens
cuuugauucaaagcac

SEQ ID NO: 1145274 - RNA, 21 nt, Homo sapiens
cuuugauuuuugcccagaaag

SEQ ID NO: 1145275 - RNA, 20 nt, Homo sapiens
cuuugcagugagugcugcuc

SEQ ID NO: 1145276 - RNA, 16 nt, Homo sapiens
cuuugccaucggaacu

SEQ ID NO: 1145277 - RNA, 16 nt, Homo sapiens
cuuugccuuagcuuug

SEQ ID NO: 1145278 - RNA, 19 nt, Homo sapiens
cuuugccuuuccauaauca

SEQ ID NO: 1145279 - RNA, 18 nt, Homo sapiens
cuuugcucuuucuugacu

SEQ ID NO: 1145280 - RNA, 17 nt, Homo sapiens
cuuugcugcagucaucu

SEQ ID NO: 1145281 - RNA, 12 nt, Homo sapiens
cuuugcugugaa

SEQ ID NO: 1145282 - RNA, 17 nt, Homo sapiens
cuuuggaacaagacagc

SEQ ID NO: 1145283 - RNA, 22 nt, Homo sapiens
cuuuggacuugucccgggacac

SEQ ID NO: 1145284 - RNA, 15 nt, Homo sapiens
cuuuggagacuuucu

SEQ ID NO: 1145285 - RNA, 12 nt, Homo sapiens
cuuuggccagug

SEQ ID NO: 1145286 - RNA, 21 nt, Homo sapiens
cuuuggccccucgacccugug

SEQ ID NO: 1145287 - RNA, 19 nt, Homo sapiens
cuuugggccagacaugcca

SEQ ID NO: 1145288 - RNA, 20 nt, Homo sapiens
cuuugggccagacaugccac

SEQ ID NO: 1145289 - RNA, 23 nt, Homo sapiens
cuuugggcccugcauguagugug

SEQ ID NO: 1145290 - RNA, 13 nt, Homo sapiens
cuuugggcuguga

SEQ ID NO: 1145291 - RNA, 14 nt, Homo sapiens
cuuugguauuucac

SEQ ID NO: 1145292 - RNA, 18 nt, Homo sapiens
cuuugguauuucacugaa

SEQ ID NO: 1145293 - RNA, 20 nt, Homo sapiens
cuuuguaaagcauccucuac

SEQ ID NO: 1145294 - RNA, 14 nt, Homo sapiens
cuuuguaggugucu

SEQ ID NO: 1145295 - RNA, 19 nt, Homo sapiens
cuuuguauauuacauacau

SEQ ID NO: 1145296 - RNA, 24 nt, Homo sapiens
cuuuguauccucugaccuacauac

SEQ ID NO: 1145297 - RNA, 16 nt, Homo sapiens
cuuuguauuucaucuc

SEQ ID NO: 1145298 - RNA, 14 nt, Homo sapiens
cuuugucaguguug

SEQ ID NO: 1145299 - RNA, 17 nt, Homo sapiens
cuuugucccguggcauu

SEQ ID NO: 1145300 - RNA, 19 nt, Homo sapiens
cuuugucggcggcuugaua

SEQ ID NO: 1145301 - RNA, 22 nt, Homo sapiens
cuuuguggauggugucuccuuu

SEQ ID NO: 1145302 - RNA, 14 nt, Homo sapiens
cuuuguguuugcuu

SEQ ID NO: 1145303 - RNA, 14 nt, Homo sapiens
cuuuguuaggauuu

SEQ ID NO: 1145304 - RNA, 20 nt, Homo sapiens
cuuuguugaaagcagaagaa

SEQ ID NO: 1145305 - RNA, 21 nt, Homo sapiens
cuuuguuuuuacgucauuaca

SEQ ID NO: 1145306 - RNA, 22 nt, Homo sapiens
cuuuuaaaaacuagagcacaga

SEQ ID NO: 1145307 - RNA, 17 nt, Homo sapiens
cuuuuaaaauaaauucu

SEQ ID NO: 1145308 - RNA, 14 nt, Homo sapiens
cuuuuaaaauucac

SEQ ID NO: 1145309 - RNA, 23 nt, Homo sapiens
cuuuuaaagaaauauaaacacaa

SEQ ID NO: 1145310 - RNA, 15 nt, Homo sapiens
cuuuuaacaccugau

SEQ ID NO: 1145311 - RNA, 22 nt, Homo sapiens
cuuuuaaggcuaaaacuuaaca

SEQ ID NO: 1145312 - RNA, 18 nt, Homo sapiens
cuuuuacaacugccucga

SEQ ID NO: 1145313 - RNA, 15 nt, Homo sapiens
cuuuuaggccaagga

SEQ ID NO: 1145314 - RNA, 23 nt, Homo sapiens
cuuuuaggcguuuucuggcuuga

SEQ ID NO: 1145315 - RNA, 19 nt, Homo sapiens
cuuuuaguaaaaacauuua

SEQ ID NO: 1145316 - RNA, 19 nt, Homo sapiens
cuuuuauccacuuaccuag

SEQ ID NO: 1145317 - RNA, 20 nt, Homo sapiens
cuuuuaugagacccauuccu

SEQ ID NO: 1145318 - RNA, 17 nt, Homo sapiens
cuuuuaugcaaccauaa

SEQ ID NO: 1145319 - RNA, 16 nt, Homo sapiens
gagacaggguuucacc

SEQ ID NO: 1145320 - RNA, 13 nt, Homo sapiens
gagacagugcaca

SEQ ID NO: 1145321 - RNA, 15 nt, Homo sapiens
gagacauaggccaug

SEQ ID NO: 1145322 - RNA, 12 nt, Homo sapiens
gagacauauaau

SEQ ID NO: 1145323 - RNA, 17 nt, Homo sapiens
gagacaugagaaaggga

SEQ ID NO: 1145324 - RNA, 23 nt, Homo sapiens
gagaccaggggaccagagggaug

SEQ ID NO: 1145325 - RNA, 13 nt, Homo sapiens
gagaccccaaaaa

SEQ ID NO: 1145326 - RNA, 19 nt, Homo sapiens
gagacccgagggcugcuuu

SEQ ID NO: 1145327 - RNA, 19 nt, Homo sapiens
gagaccuagagaucuggcu

SEQ ID NO: 1145328 - RNA, 17 nt, Homo sapiens
gagaccucagauguguu

SEQ ID NO: 1145329 - RNA, 22 nt, Homo sapiens
gagaccugacccauccaguucu

SEQ ID NO: 1145330 - RNA, 20 nt, Homo sapiens
gagaccuuugauuuuugccc

SEQ ID NO: 1145331 - RNA, 22 nt, Homo sapiens
gagaccuuugauuuuuugccca

SEQ ID NO: 1145332 - RNA, 18 nt, Homo sapiens
gagacgguguuuugccau

SEQ ID NO: 1145333 - RNA, 18 nt, Homo sapiens
gagacgguuuccagggag

SEQ ID NO: 1145334 - RNA, 20 nt, Homo sapiens
gagacucaccucugccucaa

SEQ ID NO: 1145335 - RNA, 22 nt, Homo sapiens
gagacuccacucaggugcacac

SEQ ID NO: 1145336 - RNA, 23 nt, Homo sapiens
gagacuccaucucuuuaaaaaca

SEQ ID NO: 1145337 - RNA, 19 nt, Homo sapiens
gagacugcuacagugcaua

SEQ ID NO: 1145338 - RNA, 16 nt, Homo sapiens
gagacugguugcauaa

SEQ ID NO: 1145339 - RNA, 21 nt, Homo sapiens
gagacuguuaucaggacuuga

SEQ ID NO: 1145340 - RNA, 18 nt, Homo sapiens
gagagaaugcugaccuga

SEQ ID NO: 1145341 - RNA, 13 nt, Homo sapiens
gagagacccaagg

SEQ ID NO: 1145342 - RNA, 17 nt, Homo sapiens
gagagagcuggaggcac

SEQ ID NO: 1145343 - RNA, 18 nt, Homo sapiens
gagagauuagaauaucug

SEQ ID NO: 1145344 - RNA, 14 nt, Homo sapiens
gagagcaaagugac

SEQ ID NO: 1145345 - RNA, 15 nt, Homo sapiens
gagagcagaggucuc

SEQ ID NO: 1145346 - RNA, 22 nt, Homo sapiens
gagaggcccugggguucucccc

SEQ ID NO: 1145347 - RNA, 15 nt, Homo sapiens
gagaggcucugagaa

SEQ ID NO: 1145348 - RNA, 16 nt, Homo sapiens
gagagggugacaagau

SEQ ID NO: 1145349 - RNA, 18 nt, Homo sapiens
gagaguauauuauguauu

SEQ ID NO: 1145350 - RNA, 13 nt, Homo sapiens
gagagucaaggga

SEQ ID NO: 1145351 - RNA, 20 nt, Homo sapiens
gagaguccaucagccuccau

SEQ ID NO: 1145352 - RNA, 15 nt, Homo sapiens
gagagugagacucag

SEQ ID NO: 1145353 - RNA, 19 nt, Homo sapiens
gagaguugcuuccaguccu

SEQ ID NO: 1145354 - RNA, 16 nt, Homo sapiens
gagaguuuugucuuga

SEQ ID NO: 1145355 - RNA, 16 nt, Homo sapiens
gagauaggggaaauca

SEQ ID NO: 1145356 - RNA, 13 nt, Homo sapiens
gagaucaacaaca

SEQ ID NO: 1145357 - RNA, 20 nt, Homo sapiens
gagaucaucacuuccuugcc

SEQ ID NO: 1145358 - RNA, 17 nt, Homo sapiens
gagauccuuuaaauccu

SEQ ID NO: 1145359 - RNA, 14 nt, Homo sapiens
gagaucgugccacu

SEQ ID NO: 1145360 - RNA, 20 nt, Homo sapiens
gagaucgugccacugcacuc

SEQ ID NO: 1145361 - RNA, 21 nt, Homo sapiens
gagaucgugccauugcacucc

SEQ ID NO: 1145362 - RNA, 16 nt, Homo sapiens
gagaugaaggaaggac

SEQ ID NO: 1145363 - RNA, 22 nt, Homo sapiens
gagaugaaggaaggacuaugac

SEQ ID NO: 1145364 - RNA, 22 nt, Homo sapiens
gagaugaccccaucaaccccag

SEQ ID NO: 1145365 - RNA, 18 nt, Homo sapiens
gagaugcagccuucacca

SEQ ID NO: 1145366 - RNA, 13 nt, Homo sapiens
gagauggaguucu

SEQ ID NO: 1145367 - RNA, 14 nt, Homo sapiens
gagauguggaaaag

SEQ ID NO: 1145368 - RNA, 18 nt, Homo sapiens
gagauguggaaaagccaa

SEQ ID NO: 1145369 - RNA, 22 nt, Homo sapiens
gagauguggaaaagccaagagg

SEQ ID NO: 1145370 - RNA, 16 nt, Homo sapiens
gagauuaaccucuugu

SEQ ID NO: 1145371 - RNA, 21 nt, Homo sapiens
gagauucaagggacccaugag

SEQ ID NO: 1145372 - RNA, 12 nt, Homo sapiens
gagauugcacag

SEQ ID NO: 1145373 - RNA, 18 nt, Homo sapiens
gagauuguuguuugccau

SEQ ID NO: 1145374 - RNA, 18 nt, Homo sapiens
gagauuucuuguugcuca

SEQ ID NO: 1145375 - RNA, 13 nt, Homo sapiens
gagcaaaaugcuc

SEQ ID NO: 1145376 - RNA, 16 nt, Homo sapiens
gagcaaacugcucagc

SEQ ID NO: 1145377 - RNA, 18 nt, Homo sapiens
gagcaaggguucccucaa

SEQ ID NO: 1145378 - RNA, 16 nt, Homo sapiens
gagcacagaaggaaua

SEQ ID NO: 1145379 - RNA, 19 nt, Homo sapiens
gagcacagccccugcugug

SEQ ID NO: 1145380 - RNA, 19 nt, Homo sapiens
gagcacauacuaccuagaa

SEQ ID NO: 1145381 - RNA, 19 nt, Homo sapiens
gagcacucucaccccaagc

SEQ ID NO: 1145382 - RNA, 15 nt, Homo sapiens
gagcaggagccugca

SEQ ID NO: 1145383 - RNA, 18 nt, Homo sapiens
gagcaguagguaggcuca

SEQ ID NO: 1145384 - RNA, 17 nt, Homo sapiens
gagcauaguccaaaaag

SEQ ID NO: 1145385 - RNA, 19 nt, Homo sapiens
gagcaucaggauacucaaa

SEQ ID NO: 1145386 - RNA, 22 nt, Homo sapiens
gagcaucaggauacucaaagug

SEQ ID NO: 1145387 - RNA, 18 nt, Homo sapiens
gagccaaccaacagagaa

SEQ ID NO: 1145388 - RNA, 16 nt, Homo sapiens
gagccacaggugccug

SEQ ID NO: 1145389 - RNA, 19 nt, Homo sapiens
gagccaccugacucuugca

SEQ ID NO: 1145390 - RNA, 11 nt, Homo sapiens
gagccaggaaa

SEQ ID NO: 1145391 - RNA, 19 nt, Homo sapiens
gagccaggaaagcagcaaa

SEQ ID NO: 1145392 - RNA, 21 nt, Homo sapiens
gagccaggaaagcagcaaagg

SEQ ID NO: 1145393 - RNA, 16 nt, Homo sapiens
gagccaggacccagga

SEQ ID NO: 1145394 - RNA, 21 nt, Homo sapiens
gagccaugauuucccacugca

SEQ ID NO: 1145395 - RNA, 20 nt, Homo sapiens
gagccccagguaauggcaug

SEQ ID NO: 1145396 - RNA, 15 nt, Homo sapiens
gagccccucagacag

SEQ ID NO: 1145397 - RNA, 23 nt, Homo sapiens
gagccccuuggggguucagggaa

SEQ ID NO: 1145398 - RNA, 19 nt, Homo sapiens
gagcccggcaacucuagua

SEQ ID NO: 1145399 - RNA, 20 nt, Homo sapiens
gagcccuuagccuugcugua

SEQ ID NO: 1145400 - RNA, 20 nt, Homo sapiens
gagccggacacuucucagga

SEQ ID NO: 1145401 - RNA, 22 nt, Homo sapiens
gagccucagaagaaaacaaagu

SEQ ID NO: 1145402 - RNA, 17 nt, Homo sapiens
gagccucgggacaucaa

SEQ ID NO: 1145403 - RNA, 23 nt, Homo sapiens
gagccucugcagucgcuugccaa

SEQ ID NO: 1145404 - RNA, 18 nt, Homo sapiens
gagccuuagaggucuuua

SEQ ID NO: 1145405 - RNA, 15 nt, Homo sapiens
gagccuuuaccuuuu

SEQ ID NO: 1145406 - RNA, 21 nt, Homo sapiens
gagccuuugaucuucaggaug

SEQ ID NO: 1145407 - RNA, 23 nt, Homo sapiens
gagcuacugccgucagugcugug

SEQ ID NO: 1145408 - RNA, 15 nt, Homo sapiens
gagcuauacauaugu

SEQ ID NO: 1145409 - RNA, 16 nt, Homo sapiens
gagcuauucacagugc

SEQ ID NO: 1145410 - RNA, 23 nt, Homo sapiens
gagcucaccuguuugaaaccaag

SEQ ID NO: 1145411 - RNA, 15 nt, Homo sapiens
gagcucuugugucau

SEQ ID NO: 1145412 - RNA, 15 nt, Homo sapiens
gagcugaaaaacuua

SEQ ID NO: 1145413 - RNA, 22 nt, Homo sapiens
gagcugguuccucucucccacc

SEQ ID NO: 1145414 - RNA, 15 nt, Homo sapiens
gagcugugugccaca

SEQ ID NO: 1145415 - RNA, 12 nt, Homo sapiens
gagcuguucaac

SEQ ID NO: 1145416 - RNA, 17 nt, Homo sapiens
gagcuguucaacaucac

SEQ ID NO: 1145417 - RNA, 18 nt, Homo sapiens
gagcuucauauaccagca

SEQ ID NO: 1145418 - RNA, 13 nt, Homo sapiens
gagcuugcaguga

SEQ ID NO: 1145419 - RNA, 22 nt, Homo sapiens
gagcuuggcugagggucuggga

SEQ ID NO: 1145420 - RNA, 14 nt, Homo sapiens
gaggaaaaacaaca

SEQ ID NO: 1145421 - RNA, 16 nt, Homo sapiens
gaggaaaggccagcug

SEQ ID NO: 1145422 - RNA, 14 nt, Homo sapiens
gaggaaaugauuuc

SEQ ID NO: 1145423 - RNA, 13 nt, Homo sapiens
gaggaacagggaa

SEQ ID NO: 1145424 - RNA, 14 nt, Homo sapiens
gaggaacagggaag

SEQ ID NO: 1145425 - RNA, 23 nt, Homo sapiens
gaggaaguagcugucagauguca

SEQ ID NO: 1145426 - RNA, 17 nt, Homo sapiens
gaggaauugauugucag

SEQ ID NO: 1145427 - RNA, 21 nt, Homo sapiens
gaggacaagacccucucaggc

SEQ ID NO: 1145428 - RNA, 12 nt, Homo sapiens
gaggacaauuca

SEQ ID NO: 1145429 - RNA, 17 nt, Homo sapiens
gaggacacaguuucuau

SEQ ID NO: 1145430 - RNA, 15 nt, Homo sapiens
gaggacuaugccccu

SEQ ID NO: 1145431 - RNA, 13 nt, Homo sapiens
gaggagccucaga

SEQ ID NO: 1145432 - RNA, 12 nt, Homo sapiens
gaggagccuuuu

SEQ ID NO: 1145433 - RNA, 14 nt, Homo sapiens
gaggaggaggacag

SEQ ID NO: 1145434 - RNA, 15 nt, Homo sapiens
gaggcaaagaacaau

SEQ ID NO: 1145435 - RNA, 22 nt, Homo sapiens
gaggcacaagaaucacuugaac

SEQ ID NO: 1145436 - RNA, 17 nt, Homo sapiens
gaggcaccucaagaaga

SEQ ID NO: 1145437 - RNA, 21 nt, Homo sapiens
gaugggcauaugugucagugg

SEQ ID NO: 1145438 - RNA, 19 nt, Homo sapiens
gauggggaaggugugugaa

SEQ ID NO: 1145439 - RNA, 14 nt, Homo sapiens
gaugggugguguuu

SEQ ID NO: 1145440 - RNA, 15 nt, Homo sapiens
gauggugcaugccug

SEQ ID NO: 1145441 - RNA, 15 nt, Homo sapiens
gauggugcuggguaa

SEQ ID NO: 1145442 - RNA, 18 nt, Homo sapiens
gauguaauaaucauuuua

SEQ ID NO: 1145443 - RNA, 14 nt, Homo sapiens
gauguaugcagcua

SEQ ID NO: 1145444 - RNA, 13 nt, Homo sapiens
gauguauucugua

SEQ ID NO: 1145445 - RNA, 22 nt, Homo sapiens
gaugucaaaacaagacuccuca

SEQ ID NO: 1145446 - RNA, 22 nt, Homo sapiens
gaugucaggaaacauucaguga

SEQ ID NO: 1145447 - RNA, 22 nt, Homo sapiens
gaugugaauacucuucccacau

SEQ ID NO: 1145448 - RNA, 20 nt, Homo sapiens
gaugugauuuaauaguguua

SEQ ID NO: 1145449 - RNA, 19 nt, Homo sapiens
gaugugccgauccuuguca

SEQ ID NO: 1145450 - RNA, 23 nt, Homo sapiens
gauguuguguuucuguucaccuu

SEQ ID NO: 1145451 - RNA, 18 nt, Homo sapiens
gauguuuccagacuuccu

SEQ ID NO: 1145452 - RNA, 19 nt, Homo sapiens
gauguuuccagacuuccuu

SEQ ID NO: 1145453 - RNA, 18 nt, Homo sapiens
gauuaaaaucucuugauu

SEQ ID NO: 1145454 - RNA, 14 nt, Homo sapiens
gauuaagaaugcca

SEQ ID NO: 1145455 - RNA, 13 nt, Homo sapiens
gauuaagauuuua

SEQ ID NO: 1145456 - RNA, 12 nt, Homo sapiens
gauuaaguacaa

SEQ ID NO: 1145457 - RNA, 21 nt, Homo sapiens
gauuacaauacugaaugggaa

SEQ ID NO: 1145458 - RNA, 19 nt, Homo sapiens
gauuacaggcgugagccac

SEQ ID NO: 1145459 - RNA, 18 nt, Homo sapiens
gauuacaggugugcacca

SEQ ID NO: 1145460 - RNA, 20 nt, Homo sapiens
gauuacuaucauggcauaua

SEQ ID NO: 1145461 - RNA, 12 nt, Homo sapiens
gauuacuuauaa

SEQ ID NO: 1145462 - RNA, 21 nt, Homo sapiens
gauuagcagaagaaaggaaca

SEQ ID NO: 1145463 - RNA, 21 nt, Homo sapiens
gauuagcccuuccuugccagu

SEQ ID NO: 1145464 - RNA, 18 nt, Homo sapiens
gauuaggugagguuuaua

SEQ ID NO: 1145465 - RNA, 13 nt, Homo sapiens
gauuauagauucu

SEQ ID NO: 1145466 - RNA, 12 nt, Homo sapiens
gauucacauaca

SEQ ID NO: 1145467 - RNA, 20 nt, Homo sapiens
gauucacugcauggcuccca

SEQ ID NO: 1145468 - RNA, 23 nt, Homo sapiens
gauucauauguccccacuggcau

SEQ ID NO: 1145469 - RNA, 13 nt, Homo sapiens
gauucauauugaa

SEQ ID NO: 1145470 - RNA, 22 nt, Homo sapiens
gauucaucuucacagcacauuu

SEQ ID NO: 1145471 - RNA, 14 nt, Homo sapiens
gauucaugucucac

SEQ ID NO: 1145472 - RNA, 21 nt, Homo sapiens
gauuccaccaacagccggcug

SEQ ID NO: 1145473 - RNA, 17 nt, Homo sapiens
gauuccagucuacuuga

SEQ ID NO: 1145474 - RNA, 17 nt, Homo sapiens
gauuccauccugugucc

SEQ ID NO: 1145475 - RNA, 13 nt, Homo sapiens
gauucccagagac

SEQ ID NO: 1145476 - RNA, 21 nt, Homo sapiens
gauuccccaucucaggccaga

SEQ ID NO: 1145477 - RNA, 18 nt, Homo sapiens
gauuccggugccuccuga

SEQ ID NO: 1145478 - RNA, 18 nt, Homo sapiens
gauuccuuuccuguguga

SEQ ID NO: 1145479 - RNA, 14 nt, Homo sapiens
gauucgaaacucca

SEQ ID NO: 1145480 - RNA, 22 nt, Homo sapiens
gauucuauuuauuaugcuuuau

SEQ ID NO: 1145481 - RNA, 23 nt, Homo sapiens
gauucucuuguauaagauccuag

SEQ ID NO: 1145482 - RNA, 15 nt, Homo sapiens
gauucuucagcuuga

SEQ ID NO: 1145483 - RNA, 20 nt, Homo sapiens
gauugcaugugacucugaag

SEQ ID NO: 1145484 - RNA, 16 nt, Homo sapiens
gauuggaauaacccaa

SEQ ID NO: 1145485 - RNA, 19 nt, Homo sapiens
gauuggccggcuaguguuu

SEQ ID NO: 1145486 - RNA, 15 nt, Homo sapiens
gauugggaaagauag

SEQ ID NO: 1145487 - RNA, 20 nt, Homo sapiens
gauugugccagugcacuccg

SEQ ID NO: 1145488 - RNA, 16 nt, Homo sapiens
gauuuaaaaaugccaa

SEQ ID NO: 1145489 - RNA, 20 nt, Homo sapiens
gauuuaauccuagagauuug

SEQ ID NO: 1145490 - RNA, 20 nt, Homo sapiens
gauuuagcaaugcugugaau

SEQ ID NO: 1145491 - RNA, 19 nt, Homo sapiens
gauuuauuaaauaaucucu

SEQ ID NO: 1145492 - RNA, 12 nt, Homo sapiens
gauuucagccau

SEQ ID NO: 1145493 - RNA, 21 nt, Homo sapiens
gauuucaggucaacucugaag

SEQ ID NO: 1145494 - RNA, 23 nt, Homo sapiens
gauuuccuccucccagugccuuc

SEQ ID NO: 1145495 - RNA, 23 nt, Homo sapiens
gauuuccuugaauguggcuugag

SEQ ID NO: 1145496 - RNA, 21 nt, Homo sapiens
gauuuccuuuauacugugaag

SEQ ID NO: 1145497 - RNA, 19 nt, Homo sapiens
gauuugaagaacaugugag

SEQ ID NO: 1145498 - RNA, 16 nt, Homo sapiens
gauuugauuaaugaau

SEQ ID NO: 1145499 - RNA, 13 nt, Homo sapiens
gauuugccucuua

SEQ ID NO: 1145500 - RNA, 15 nt, Homo sapiens
gauuuggugaccaac

SEQ ID NO: 1145501 - RNA, 21 nt, Homo sapiens
gauuuguuuguuuucuugucu

SEQ ID NO: 1145502 - RNA, 15 nt, Homo sapiens
gauuuuaucuguuaa

SEQ ID NO: 1145503 - RNA, 23 nt, Homo sapiens
gauuuuauuuuugcaaaauaagu

SEQ ID NO: 1145504 - RNA, 19 nt, Homo sapiens
gauuuucuucuuugugguc

SEQ ID NO: 1145505 - RNA, 15 nt, Homo sapiens
gauuuuuagaaauca

SEQ ID NO: 1145506 - RNA, 13 nt, Homo sapiens
gauuuuugcaaua

SEQ ID NO: 1145507 - RNA, 12 nt, Homo sapiens
gauuuuugccca

SEQ ID NO: 1145508 - RNA, 18 nt, Homo sapiens
gcaaaaaaaucauauaag

SEQ ID NO: 1145509 - RNA, 22 nt, Homo sapiens
gcaaaaacauguaugugcauuu

SEQ ID NO: 1145510 - RNA, 20 nt, Homo sapiens
gcaaaacuccgucucaaaaa

SEQ ID NO: 1145511 - RNA, 22 nt, Homo sapiens
gcaaaacuuuuaaacuacaggu

SEQ ID NO: 1145512 - RNA, 21 nt, Homo sapiens
gcaaaaggaucuuuguggcca

SEQ ID NO: 1145513 - RNA, 15 nt, Homo sapiens
gcaaaaguguaacaa

SEQ ID NO: 1145514 - RNA, 18 nt, Homo sapiens
gcaaaauacaugacauuu

SEQ ID NO: 1145515 - RNA, 19 nt, Homo sapiens
gcaaaauacaugacauuua

SEQ ID NO: 1145516 - RNA, 16 nt, Homo sapiens
gcaaaauagcuuggac

SEQ ID NO: 1145517 - RNA, 23 nt, Homo sapiens
gcaaaaucuguucuaacauguaa

SEQ ID NO: 1145518 - RNA, 12 nt, Homo sapiens
gcaaaauugcaa

SEQ ID NO: 1145519 - RNA, 20 nt, Homo sapiens
gcaaacacugugauuacucu

SEQ ID NO: 1145520 - RNA, 15 nt, Homo sapiens
gcaaacaugugcaac

SEQ ID NO: 1145521 - RNA, 23 nt, Homo sapiens
gcaaacggaguacagacgucuca

SEQ ID NO: 1145522 - RNA, 20 nt, Homo sapiens
gcaaacucuccaccacacgu

SEQ ID NO: 1145523 - RNA, 17 nt, Homo sapiens
gcaaagaaugaaacaau

SEQ ID NO: 1145524 - RNA, 15 nt, Homo sapiens
gcaaaggcagaggaa

SEQ ID NO: 1145525 - RNA, 21 nt, Homo sapiens
gcaaaggggaggcaucagugu

SEQ ID NO: 1145526 - RNA, 15 nt, Homo sapiens
gcaggggacugggcc

SEQ ID NO: 1145527 - RNA, 16 nt, Homo sapiens
gcaggggcauugcuga

SEQ ID NO: 1145528 - RNA, 19 nt, Homo sapiens
gcagguaaccccagauuca

SEQ ID NO: 1145529 - RNA, 14 nt, Homo sapiens
gcaggugagcagac

SEQ ID NO: 1145530 - RNA, 12 nt, Homo sapiens
gcaggugcgauu

SEQ ID NO: 1145531 - RNA, 22 nt, Homo sapiens
gcaguagacauuuuaacaagaa

SEQ ID NO: 1145532 - RNA, 23 nt, Homo sapiens
gcaguagccauguuaacaugaca

SEQ ID NO: 1145533 - RNA, 19 nt, Homo sapiens
gcaguaucaugcccugugc

SEQ ID NO: 1145534 - RNA, 21 nt, Homo sapiens
gcaguauuggacaaagagcau

SEQ ID NO: 1145535 - RNA, 19 nt, Homo sapiens
gcaguauuuaaaucuugca

SEQ ID NO: 1145536 - RNA, 17 nt, Homo sapiens
gcagucaauuuucacau

SEQ ID NO: 1145537 - RNA, 22 nt, Homo sapiens
gcagucaggggucaggugucag

SEQ ID NO: 1145538 - RNA, 23 nt, Homo sapiens
gcagucaucuugaccaagcagga

SEQ ID NO: 1145539 - RNA, 17 nt, Homo sapiens
gcaguccauuuccuaau

SEQ ID NO: 1145540 - RNA, 21 nt, Homo sapiens
gcagugagcugagaucaugcc

SEQ ID NO: 1145541 - RNA, 12 nt, Homo sapiens
gcagugccuugu

SEQ ID NO: 1145542 - RNA, 21 nt, Homo sapiens
gcagugccuugugcaauguga

SEQ ID NO: 1145543 - RNA, 13 nt, Homo sapiens
gcagugcugaggg

SEQ ID NO: 1145544 - RNA, 19 nt, Homo sapiens
gcaguggccccuuaggcca

SEQ ID NO: 1145545 - RNA, 20 nt, Homo sapiens
gcaguuauuucaaccagcac

SEQ ID NO: 1145546 - RNA, 19 nt, Homo sapiens
gcaguucugggugcucccu

SEQ ID NO: 1145547 - RNA, 14 nt, Homo sapiens
gcaguugacucaga

SEQ ID NO: 1145548 - RNA, 18 nt, Homo sapiens
gcaguuucuaagcaugua

SEQ ID NO: 1145549 - RNA, 19 nt, Homo sapiens
gcaguuucugacacuuguu

SEQ ID NO: 1145550 - RNA, 18 nt, Homo sapiens
gcaguuugggaggcugag

SEQ ID NO: 1145551 - RNA, 21 nt, Homo sapiens
gcaguuuugugauaaguucua

SEQ ID NO: 1145552 - RNA, 20 nt, Homo sapiens
gcauacuccgugaggcugcu

SEQ ID NO: 1145553 - RNA, 23 nt, Homo sapiens
gcauacugguguuaacagucaca

SEQ ID NO: 1145554 - RNA, 13 nt, Homo sapiens
gcauauacaguga

SEQ ID NO: 1145555 - RNA, 21 nt, Homo sapiens
gcauauacagugaagaguaag

SEQ ID NO: 1145556 - RNA, 16 nt, Homo sapiens
gcaucacuagugacaa

SEQ ID NO: 1145557 - RNA, 19 nt, Homo sapiens
gcaucagagagacuguuau

SEQ ID NO: 1145558 - RNA, 18 nt, Homo sapiens
gcaucaguucacugcugc

SEQ ID NO: 1145559 - RNA, 18 nt, Homo sapiens
gcaucccccaaagccauc

SEQ ID NO: 1145560 - RNA, 18 nt, Homo sapiens
gcauccuccccaccagag

SEQ ID NO: 1145561 - RNA, 22 nt, Homo sapiens
gcauccucuuuuuccaacuugg

SEQ ID NO: 1145562 - RNA, 18 nt, Homo sapiens
gcaucggacaagaccccc

SEQ ID NO: 1145563 - RNA, 17 nt, Homo sapiens
gcaucucccacacaaga

SEQ ID NO: 1145564 - RNA, 22 nt, Homo sapiens
gcccaauugagauccaguuuuu

SEQ ID NO: 1145565 - RNA, 19 nt, Homo sapiens
gcccacagucugacuuccc

SEQ ID NO: 1145566 - RNA, 16 nt, Homo sapiens
gcccacauauuucaau

SEQ ID NO: 1145567 - RNA, 21 nt, Homo sapiens
gcccacaucccacaugcggcu

SEQ ID NO: 1145568 - RNA, 17 nt, Homo sapiens
gcccagacccccagugu

SEQ ID NO: 1145569 - RNA, 21 nt, Homo sapiens
gcccagauugugccacugcuc

SEQ ID NO: 1145570 - RNA, 22 nt, Homo sapiens
gcccagcauggaaucugaugaa

SEQ ID NO: 1145571 - RNA, 17 nt, Homo sapiens
gcccagcuauacuguau

SEQ ID NO: 1145572 - RNA, 20 nt, Homo sapiens
gcccaggaucagauugcaug

SEQ ID NO: 1145573 - RNA, 20 nt, Homo sapiens
gcccaggcuggagggcagug

SEQ ID NO: 1145574 - RNA, 18 nt, Homo sapiens
gcccaggcuggagugcaa

SEQ ID NO: 1145575 - RNA, 20 nt, Homo sapiens
gcccaggcugggaacucauc

SEQ ID NO: 1145576 - RNA, 23 nt, Homo sapiens
gcccagggggagcuaucacugua

SEQ ID NO: 1145577 - RNA, 20 nt, Homo sapiens
gcccaguuucacugccauau

SEQ ID NO: 1145578 - RNA, 22 nt, Homo sapiens
gcccauuaggucuggcaugccc

SEQ ID NO: 1145579 - RNA, 22 nt, Homo sapiens
gccccacccuggaaugccaaug

SEQ ID NO: 1145580 - RNA, 22 nt, Homo sapiens
gccccaccuuuccuuuccuucc

SEQ ID NO: 1145581 - RNA, 18 nt, Homo sapiens
gccccagacugagcucuc

SEQ ID NO: 1145582 - RNA, 23 nt, Homo sapiens
gccccagcucgcgggacccgacc

SEQ ID NO: 1145583 - RNA, 19 nt, Homo sapiens
gccccaggcauugccaagg

SEQ ID NO: 1145584 - RNA, 13 nt, Homo sapiens
gccccagugacag

SEQ ID NO: 1145585 - RNA, 20 nt, Homo sapiens
gcccccaccgccgggguccu

SEQ ID NO: 1145586 - RNA, 13 nt, Homo sapiens
gcccccacugacc

SEQ ID NO: 1145587 - RNA, 21 nt, Homo sapiens
gccccccagggcuagugaagu

SEQ ID NO: 1145588 - RNA, 19 nt, Homo sapiens
gcccccucucaggagccau

SEQ ID NO: 1145589 - RNA, 21 nt, Homo sapiens
gccccucaccugguaccugga

SEQ ID NO: 1145590 - RNA, 13 nt, Homo sapiens
gccccucauuuau

SEQ ID NO: 1145591 - RNA, 22 nt, Homo sapiens
gccccucccagaacacacucca

SEQ ID NO: 1145592 - RNA, 22 nt, Homo sapiens
gccccucuccuccguggcacau

SEQ ID NO: 1145593 - RNA, 17 nt, Homo sapiens
gccccugcuccagaaga

SEQ ID NO: 1145594 - RNA, 22 nt, Homo sapiens
gccccugucgucaggaccuccu

SEQ ID NO: 1145595 - RNA, 20 nt, Homo sapiens
gccccuuugggcccugcaug

SEQ ID NO: 1145596 - RNA, 16 nt, Homo sapiens
gcccgggagcucagga

SEQ ID NO: 1145597 - RNA, 21 nt, Homo sapiens
gcccgggguggggugcacucg

SEQ ID NO: 1145598 - RNA, 19 nt, Homo sapiens
gcccguaaucccagcuacu

SEQ ID NO: 1145599 - RNA, 13 nt, Homo sapiens
gcccgugcccuac

SEQ ID NO: 1145600 - RNA, 15 nt, Homo sapiens
gcccguuuguacaug

SEQ ID NO: 1145601 - RNA, 16 nt, Homo sapiens
gcccuaaaagcacacu

SEQ ID NO: 1145602 - RNA, 16 nt, Homo sapiens
gcccuaagggacuuaa

SEQ ID NO: 1145603 - RNA, 15 nt, Homo sapiens
gcccuccgaccucuc

SEQ ID NO: 1145604 - RNA, 16 nt, Homo sapiens
gcccuccgaccucucu

SEQ ID NO: 1145605 - RNA, 12 nt, Homo sapiens
gccugugcaaug

SEQ ID NO: 1145606 - RNA, 20 nt, Homo sapiens
gccugugcauguaugucuug

SEQ ID NO: 1145607 - RNA, 19 nt, Homo sapiens
gccugugcguucccuucag

SEQ ID NO: 1145608 - RNA, 10 nt, Homo sapiens
gccuguggug

SEQ ID NO: 1145609 - RNA, 16 nt, Homo sapiens
gccuguucaguuacag

SEQ ID NO: 1145610 - RNA, 15 nt, Homo sapiens
gccuuaaccaugagg

SEQ ID NO: 1145611 - RNA, 13 nt, Homo sapiens
gccuuacuguuga

SEQ ID NO: 1145612 - RNA, 14 nt, Homo sapiens
gccuuagcauguga

SEQ ID NO: 1145613 - RNA, 20 nt, Homo sapiens
gccuucacauuccccugggg

SEQ ID NO: 1145614 - RNA, 14 nt, Homo sapiens
gccuucauaagccu

SEQ ID NO: 1145615 - RNA, 19 nt, Homo sapiens
gccuucccaggaguacacc

SEQ ID NO: 1145616 - RNA, 18 nt, Homo sapiens
gccuucuaguuaccacau

SEQ ID NO: 1145617 - RNA, 12 nt, Homo sapiens
gccuucucacca

SEQ ID NO: 1145618 - RNA, 18 nt, Homo sapiens
gccuugccagagauccaa

SEQ ID NO: 1145619 - RNA, 22 nt, Homo sapiens
gccuuggagucgucuggcaucu

SEQ ID NO: 1145620 - RNA, 12 nt, Homo sapiens
gccuuggcagcc

SEQ ID NO: 1145621 - RNA, 19 nt, Homo sapiens
gccuuggccuugcagcugg

SEQ ID NO: 1145622 - RNA, 19 nt, Homo sapiens
gccuuggguuucugugcag

SEQ ID NO: 1145623 - RNA, 14 nt, Homo sapiens
gccuugugugucag

SEQ ID NO: 1145624 - RNA, 21 nt, Homo sapiens
gccuuuagaguuccaugaaca

SEQ ID NO: 1145625 - RNA, 20 nt, Homo sapiens
gccuuuauauccaaaauaaa

SEQ ID NO: 1145626 - RNA, 13 nt, Homo sapiens
gccuuuuccaaau

SEQ ID NO: 1145627 - RNA, 19 nt, Homo sapiens
gccuuuuccaaaugcccaa

SEQ ID NO: 1145628 - RNA, 18 nt, Homo sapiens
gccuuuugcuacgugccu

SEQ ID NO: 1145629 - RNA, 20 nt, Homo sapiens
gcgaacauguguuuucauca

SEQ ID NO: 1145630 - RNA, 13 nt, Homo sapiens
gcgacacucaggg

SEQ ID NO: 1145631 - RNA, 16 nt, Homo sapiens
gcgaggccucucucag

SEQ ID NO: 1145632 - RNA, 23 nt, Homo sapiens
gcgauccucuugggcucuccuag

SEQ ID NO: 1145633 - RNA, 20 nt, Homo sapiens
gcgcaauugaaggaucaucu

SEQ ID NO: 1145634 - RNA, 16 nt, Homo sapiens
gcgcacaccgccagca

SEQ ID NO: 1145635 - RNA, 22 nt, Homo sapiens
gcgcacuucagaaucagauaua

SEQ ID NO: 1145636 - RNA, 19 nt, Homo sapiens
gcgcagcgggagcgcacag

SEQ ID NO: 1145637 - RNA, 17 nt, Homo sapiens
gcgcaggaccauggacu

SEQ ID NO: 1145638 - RNA, 20 nt, Homo sapiens
gcgcaggccugcgugcgcug

SEQ ID NO: 1145639 - RNA, 14 nt, Homo sapiens
gcgcaggggcugcc

SEQ ID NO: 1145640 - RNA, 18 nt, Homo sapiens
gcgcaggggcugccgagu

SEQ ID NO: 1145641 - RNA, 23 nt, Homo sapiens
gcgcaggguggugguauucuguc

SEQ ID NO: 1145642 - RNA, 19 nt, Homo sapiens
gcgccagggcccaggccau

SEQ ID NO: 1145643 - RNA, 18 nt, Homo sapiens
gcgcccagccucaucucu

SEQ ID NO: 1145644 - RNA, 19 nt, Homo sapiens
gcgcccaguccuuccaccu

SEQ ID NO: 1145645 - RNA, 15 nt, Homo sapiens
gcgccccgcaccugu

SEQ ID NO: 1145646 - RNA, 18 nt, Homo sapiens
gucuuuagaacagugccu

SEQ ID NO: 1145647 - RNA, 18 nt, Homo sapiens
gucuuucacucacaacac

SEQ ID NO: 1145648 - RNA, 13 nt, Homo sapiens
gucuuuugaauau

SEQ ID NO: 1145649 - RNA, 21 nt, Homo sapiens
gugaaaccccgucucuacuaa

SEQ ID NO: 1145650 - RNA, 17 nt, Homo sapiens
gugaaaguuaauccacu

SEQ ID NO: 1145651 - RNA, 13 nt, Homo sapiens
gugaacaagcaaa

SEQ ID NO: 1145652 - RNA, 11 nt, Homo sapiens
gugaacacugg

SEQ ID NO: 1145653 - RNA, 20 nt, Homo sapiens
gugaacacuggagucuugca

SEQ ID NO: 1145654 - RNA, 12 nt, Homo sapiens
gugaacauuucc

SEQ ID NO: 1145655 - RNA, 20 nt, Homo sapiens
gugaacucagccaagcacag

SEQ ID NO: 1145656 - RNA, 13 nt, Homo sapiens
gugaagaccaaca

SEQ ID NO: 1145657 - RNA, 14 nt, Homo sapiens
gugaagcaggucuu

SEQ ID NO: 1145658 - RNA, 23 nt, Homo sapiens
gugaauaaaccaucaucuugcca

SEQ ID NO: 1145659 - RNA, 16 nt, Homo sapiens
gugaaugaacacucuu

SEQ ID NO: 1145660 - RNA, 16 nt, Homo sapiens
gugaaugauucagugu

SEQ ID NO: 1145661 - RNA, 21 nt, Homo sapiens
gugacaagugacccccagcua

SEQ ID NO: 1145662 - RNA, 19 nt, Homo sapiens
gugacaauuaaaagugucu

SEQ ID NO: 1145663 - RNA, 17 nt, Homo sapiens
gugacacucuccuugca

SEQ ID NO: 1145664 - RNA, 18 nt, Homo sapiens
gugacagggaagcuacag

SEQ ID NO: 1145665 - RNA, 23 nt, Homo sapiens
gugacagugacgugacucagagc

SEQ ID NO: 1145666 - RNA, 20 nt, Homo sapiens
gugacaugauacaaacacua

SEQ ID NO: 1145667 - RNA, 16 nt, Homo sapiens
gugacauuuccaugca

SEQ ID NO: 1145668 - RNA, 16 nt, Homo sapiens
gugaccaauacauuug

SEQ ID NO: 1145669 - RNA, 22 nt, Homo sapiens
gugaccccuccuggggccaggc

SEQ ID NO: 1145670 - RNA, 12 nt, Homo sapiens
gugacucagagc

SEQ ID NO: 1145671 - RNA, 18 nt, Homo sapiens
gugacuccugaagggaag

SEQ ID NO: 1145672 - RNA, 12 nt, Homo sapiens
gugacugcaaua

SEQ ID NO: 1145673 - RNA, 21 nt, Homo sapiens
gugacuggcagcauugacucu

SEQ ID NO: 1145674 - RNA, 12 nt, Homo sapiens
gugacugugucc

SEQ ID NO: 1145675 - RNA, 23 nt, Homo sapiens
gugagaauaaacuagacucugaa

SEQ ID NO: 1145676 - RNA, 23 nt, Homo sapiens
gugagacaguuuacuuugccaac

SEQ ID NO: 1145677 - RNA, 12 nt, Homo sapiens
gugagacccagc

SEQ ID NO: 1145678 - RNA, 23 nt, Homo sapiens
gugagaugaaggaaggacuauga

SEQ ID NO: 1145679 - RNA, 15 nt, Homo sapiens
gugagaugauuugua

SEQ ID NO: 1145680 - RNA, 14 nt, Homo sapiens
gugagaugcagcug

SEQ ID NO: 1145681 - RNA, 22 nt, Homo sapiens
gugagcagacugcaaaucugcc

SEQ ID NO: 1145682 - RNA, 21 nt, Homo sapiens
gugagccccaggcacuuugca

SEQ ID NO: 1145683 - RNA, 17 nt, Homo sapiens
gugagcugagauugcac

SEQ ID NO: 1145684 - RNA, 20 nt, Homo sapiens
gugagggcaccaccaagaau

SEQ ID NO: 1145685 - RNA, 19 nt, Homo sapiens
gugagggcagcacugggaa

SEQ ID NO: 1145686 - RNA, 18 nt, Homo sapiens
gugaguaaucuugcaaau

SEQ ID NO: 1145687 - RNA, 20 nt, Homo sapiens
gugagugugugugcauggaa

SEQ ID NO: 1145688 - RNA, 12 nt, Homo sapiens
gugaguucucac

SEQ ID NO: 1145689 - RNA, 14 nt, Homo sapiens
gugaucaaagccac

SEQ ID NO: 1145690 - RNA, 18 nt, Homo sapiens
gugauccgccuaccucag

SEQ ID NO: 1145691 - RNA, 22 nt, Homo sapiens
gugaugccagguucuauuugga

SEQ ID NO: 1145692 - RNA, 16 nt, Homo sapiens
gugaugggaucuguaa

SEQ ID NO: 1145693 - RNA, 12 nt, Homo sapiens
gugauguucuaa

SEQ ID NO: 1145694 - RNA, 15 nt, Homo sapiens
gugauugacauguag

SEQ ID NO: 1145695 - RNA, 16 nt, Homo sapiens
gugauuuaauaguguu

SEQ ID NO: 1145696 - RNA, 22 nt, Homo sapiens
gugauuuuauuuuugcaaaaua

SEQ ID NO: 1145697 - RNA, 12 nt, Homo sapiens
gugcaacacaaa

SEQ ID NO: 1145698 - RNA, 23 nt, Homo sapiens
gugcaaucacagcucacugcagc

SEQ ID NO: 1145699 - RNA, 16 nt, Homo sapiens
gugcacaucugugucu

SEQ ID NO: 1145700 - RNA, 20 nt, Homo sapiens
gugcacauuucauaguuuca

SEQ ID NO: 1145701 - RNA, 21 nt, Homo sapiens
gugcacauuucauaguuucaa

SEQ ID NO: 1145702 - RNA, 20 nt, Homo sapiens
gugcagaagguuacuaccua

SEQ ID NO: 1145703 - RNA, 23 nt, Homo sapiens
gugcagagugagcugccagacac

SEQ ID NO: 1145704 - RNA, 16 nt, Homo sapiens
gugcaggcuggccagc

SEQ ID NO: 1145705 - RNA, 16 nt, Homo sapiens
gugcaguagccguuug

SEQ ID NO: 1145706 - RNA, 12 nt, Homo sapiens
gugcaugcucuc

SEQ ID NO: 1145707 - RNA, 10 nt, Homo sapiens
gugcauuuag

SEQ ID NO: 1145708 - RNA, 16 nt, Homo sapiens
gugccaggcuugccug

SEQ ID NO: 1145709 - RNA, 21 nt, Homo sapiens
gugccaguucuuuccauaaua

SEQ ID NO: 1145710 - RNA, 16 nt, Homo sapiens
gugccauugcacucca

SEQ ID NO: 1145711 - RNA, 19 nt, Homo sapiens
gugccccagcagugccuug

SEQ ID NO: 1145712 - RNA, 13 nt, Homo sapiens
gugcccugcaaau

SEQ ID NO: 1145713 - RNA, 12 nt, Homo sapiens
gugccucugucu

SEQ ID NO: 1145714 - RNA, 15 nt, Homo sapiens
gugccugaucugcac

SEQ ID NO: 1145715 - RNA, 22 nt, Homo sapiens
gugccuggcucugauucuucau

SEQ ID NO: 1145716 - RNA, 15 nt, Homo sapiens
gugccugggguguua

SEQ ID NO: 1145717 - RNA, 17 nt, Homo sapiens
gugccuucccagacacu

SEQ ID NO: 1145718 - RNA, 22 nt, Homo sapiens
gugccuugucacgccagacuuc

SEQ ID NO: 1145719 - RNA, 18 nt, Homo sapiens
gugccuugugcaauguga

SEQ ID NO: 1145720 - RNA, 19 nt, Homo sapiens
gugcgaagacugagccaga

SEQ ID NO: 1145721 - RNA, 13 nt, Homo sapiens
gugcgcucacagu

SEQ ID NO: 1145722 - RNA, 19 nt, Homo sapiens
gugcuacagaaagcacaaa

SEQ ID NO: 1145723 - RNA, 16 nt, Homo sapiens
gugcuagucacuggca

SEQ ID NO: 1145724 - RNA, 12 nt, Homo sapiens
gugcucagagac

SEQ ID NO: 1145725 - RNA, 17 nt, Homo sapiens
gugcucagagaccugaa

SEQ ID NO: 1145726 - RNA, 18 nt, Homo sapiens
gugcucuggggcacuguu

SEQ ID NO: 1145727 - RNA, 21 nt, Homo sapiens
gugcugagacuacagguguga

SEQ ID NO: 1145728 - RNA, 13 nt, Homo sapiens
gugcugcuuuaau

SEQ ID NO: 1145729 - RNA, 11 nt, Homo sapiens
gugcugggauu

SEQ ID NO: 1145730 - RNA, 22 nt, Homo sapiens
gugcugggauuauaggcaugag

SEQ ID NO: 1145731 - RNA, 14 nt, Homo sapiens
gugcuguaauuuaa

SEQ ID NO: 1145732 - RNA, 13 nt, Homo sapiens
gugcuuggcacau

SEQ ID NO: 1145733 - RNA, 21 nt, Homo sapiens
gugcuuuauaccccauuugau

SEQ ID NO: 1145734 - RNA, 15 nt, Homo sapiens
guggaaaguguaaag

SEQ ID NO: 1145735 - RNA, 16 nt, Homo sapiens
guggaacaaccugcug

SEQ ID NO: 1145736 - RNA, 12 nt, Homo sapiens
guggaaggugag

SEQ ID NO: 1145737 - RNA, 15 nt, Homo sapiens
guggaagucccucag

SEQ ID NO: 1145738 - RNA, 18 nt, Homo sapiens
guggacaggaugaggaca

SEQ ID NO: 1145739 - RNA, 17 nt, Homo sapiens
guggacaugcgugacca

SEQ ID NO: 1145740 - RNA, 17 nt, Homo sapiens
guggaccacugcaugag

SEQ ID NO: 1145741 - RNA, 21 nt, Homo sapiens
guggaccacugcaugagcuuu

SEQ ID NO: 1145742 - RNA, 15 nt, Homo sapiens
guggaccuggacaaa

SEQ ID NO: 1145743 - RNA, 21 nt, Homo sapiens
guggagaaauuccuugauuca

SEQ ID NO: 1145744 - RNA, 22 nt, Homo sapiens
guggagaagaucgcauggcaga

SEQ ID NO: 1145745 - RNA, 20 nt, Homo sapiens
guggaggcggaauugcucuc

SEQ ID NO: 1145746 - RNA, 13 nt, Homo sapiens
guggaggggcccu

SEQ ID NO: 1145747 - RNA, 13 nt, Homo sapiens
guggagucauuau

SEQ ID NO: 1145748 - RNA, 13 nt, Homo sapiens
guggagugcagug

SEQ ID NO: 1145749 - RNA, 22 nt, Homo sapiens
guggauaaagauggauggcugu

SEQ ID NO: 1145750 - RNA, 12 nt, Homo sapiens
guggauaaccac

SEQ ID NO: 1145751 - RNA, 14 nt, Homo sapiens
guggauaaccacag

SEQ ID NO: 1145752 - RNA, 18 nt, Homo sapiens
uacccucacuuaaacuuu

SEQ ID NO: 1145753 - RNA, 21 nt, Homo sapiens
uaccgaguucaagugauuuuc

SEQ ID NO: 1145754 - RNA, 18 nt, Homo sapiens
uaccgugagcgacaaaga

SEQ ID NO: 1145755 - RNA, 14 nt, Homo sapiens
uaccuaagagggca

SEQ ID NO: 1145756 - RNA, 13 nt, Homo sapiens
uaccuacugcuga

SEQ ID NO: 1145757 - RNA, 19 nt, Homo sapiens
uaccucgcaucauugcaga

SEQ ID NO: 1145758 - RNA, 21 nt, Homo sapiens
uaccugaaaacacugugcaca

SEQ ID NO: 1145759 - RNA, 20 nt, Homo sapiens
uaccugaaauaaaauucauu

SEQ ID NO: 1145760 - RNA, 18 nt, Homo sapiens
uaccugaaggacagcuga

SEQ ID NO: 1145761 - RNA, 18 nt, Homo sapiens
uaccugaccaacaguucc

SEQ ID NO: 1145762 - RNA, 14 nt, Homo sapiens
uaccugccaugcau

SEQ ID NO: 1145763 - RNA, 17 nt, Homo sapiens
uaccuuaucauguggcu

SEQ ID NO: 1145764 - RNA, 15 nt, Homo sapiens
uaccuuauugaucuu

SEQ ID NO: 1145765 - RNA, 18 nt, Homo sapiens
uaccuuauugaucuuugc

SEQ ID NO: 1145766 - RNA, 16 nt, Homo sapiens
uaccuuguuuugccag

SEQ ID NO: 1145767 - RNA, 21 nt, Homo sapiens
uaccuuguuuugccagugaua

SEQ ID NO: 1145768 - RNA, 22 nt, Homo sapiens
uaccuuuuauuuuaauguuucc

SEQ ID NO: 1145769 - RNA, 14 nt, Homo sapiens
uaccuuuuuugaua

SEQ ID NO: 1145770 - RNA, 22 nt, Homo sapiens
uacgcaaccuccuuaucugcua

SEQ ID NO: 1145771 - RNA, 13 nt, Homo sapiens
uacgcugccucaa

SEQ ID NO: 1145772 - RNA, 14 nt, Homo sapiens
uacguacuacuugu

SEQ ID NO: 1145773 - RNA, 19 nt, Homo sapiens
uacguguuuugaauugcaa

SEQ ID NO: 1145774 - RNA, 15 nt, Homo sapiens
uacuaaaaauacaaa

SEQ ID NO: 1145775 - RNA, 18 nt, Homo sapiens
uacuaaaguuuuacagaa

SEQ ID NO: 1145776 - RNA, 23 nt, Homo sapiens
uacuaaggaguaaucuguguaca

SEQ ID NO: 1145777 - RNA, 20 nt, Homo sapiens
uacuaaggugacuuucugaa

SEQ ID NO: 1145778 - RNA, 21 nt, Homo sapiens
uacuaauuccacaccuuuuau

SEQ ID NO: 1145779 - RNA, 18 nt, Homo sapiens
uacuaauuuccaugugua

SEQ ID NO: 1145780 - RNA, 14 nt, Homo sapiens
uacuacauaccuca

SEQ ID NO: 1145781 - RNA, 16 nt, Homo sapiens
uacuaucauggcauau

SEQ ID NO: 1145782 - RNA, 15 nt, Homo sapiens
uacuauugcauuuua

SEQ ID NO: 1145783 - RNA, 11 nt, Homo sapiens
uacuauuucau

SEQ ID NO: 1145784 - RNA, 18 nt, Homo sapiens
uacuauuuuucuuuccaa

SEQ ID NO: 1145785 - RNA, 14 nt, Homo sapiens
uacucaaccaaauu

SEQ ID NO: 1145786 - RNA, 21 nt, Homo sapiens
uacucagguuaaugcugaaaa

SEQ ID NO: 1145787 - RNA, 13 nt, Homo sapiens
uacucauauuccu

SEQ ID NO: 1145788 - RNA, 13 nt, Homo sapiens
uacucauggcaag

SEQ ID NO: 1145789 - RNA, 22 nt, Homo sapiens
uacuccagccugggcaacagag

SEQ ID NO: 1145790 - RNA, 20 nt, Homo sapiens
uacuccccagaccucaggga

SEQ ID NO: 1145791 - RNA, 18 nt, Homo sapiens
uacucccuacacugaugc

SEQ ID NO: 1145792 - RNA, 19 nt, Homo sapiens
uacuccgugaggcugcugc

SEQ ID NO: 1145793 - RNA, 20 nt, Homo sapiens
uacucuaggcagugacagug

SEQ ID NO: 1145794 - RNA, 10 nt, Homo sapiens
uacucugcaa

SEQ ID NO: 1145795 - RNA, 12 nt, Homo sapiens
uacucugcaaac

SEQ ID NO: 1145796 - RNA, 21 nt, Homo sapiens
uacucuuagauggauucucca

SEQ ID NO: 1145797 - RNA, 14 nt, Homo sapiens
uacugaaaacaauu

SEQ ID NO: 1145798 - RNA, 21 nt, Homo sapiens
uacugaaagguuacccuguaa

SEQ ID NO: 1145799 - RNA, 13 nt, Homo sapiens
uacugaagccagg

SEQ ID NO: 1145800 - RNA, 14 nt, Homo sapiens
uacugaagucuuac

SEQ ID NO: 1145801 - RNA, 21 nt, Homo sapiens
uacugaauuucuuugauuuaa

SEQ ID NO: 1145802 - RNA, 18 nt, Homo sapiens
uacugacugaugacaaac

SEQ ID NO: 1145803 - RNA, 14 nt, Homo sapiens
uacugagagcaugu

SEQ ID NO: 1145804 - RNA, 16 nt, Homo sapiens
uacugaguagcuuuca

SEQ ID NO: 1145805 - RNA, 17 nt, Homo sapiens
uacugcuaccacaacua

SEQ ID NO: 1145806 - RNA, 19 nt, Homo sapiens
uacugcuaucuacuacaaa

SEQ ID NO: 1145807 - RNA, 14 nt, Homo sapiens
uacugcuguaaaua

SEQ ID NO: 1145808 - RNA, 23 nt, Homo sapiens
uacuggcguggauuaaacuuaug

SEQ ID NO: 1145809 - RNA, 16 nt, Homo sapiens
uacugggcugcauucc

SEQ ID NO: 1145810 - RNA, 19 nt, Homo sapiens
uacugguguuaacagucac

SEQ ID NO: 1145811 - RNA, 21 nt, Homo sapiens
uacugguuauccugugcuaca

SEQ ID NO: 1145812 - RNA, 15 nt, Homo sapiens
uacuguaugccuuca

SEQ ID NO: 1145813 - RNA, 17 nt, Homo sapiens
uacugucucacugaaac

SEQ ID NO: 1145814 - RNA, 15 nt, Homo sapiens
uacugucucuggcau

SEQ ID NO: 1145815 - RNA, 17 nt, Homo sapiens
uacugucucuuucauga

SEQ ID NO: 1145816 - RNA, 21 nt, Homo sapiens
uacugugucaggaaacauauu

SEQ ID NO: 1145817 - RNA, 14 nt, Homo sapiens
uacuguuacugugu

SEQ ID NO: 1145818 - RNA, 18 nt, Homo sapiens
uacuguugggacuuggga

SEQ ID NO: 1145819 - RNA, 16 nt, Homo sapiens
uacuguuuuaucucca

SEQ ID NO: 1145820 - RNA, 19 nt, Homo sapiens
uacuuaaaaauagucuucc

SEQ ID NO: 1145821 - RNA, 20 nt, Homo sapiens
uacuuaaaaauagucuucca

SEQ ID NO: 1145822 - RNA, 21 nt, Homo sapiens
uacuuacauguucccaaaaca

SEQ ID NO: 1145823 - RNA, 15 nt, Homo sapiens
uacuuagacaguaug

SEQ ID NO: 1145824 - RNA, 20 nt, Homo sapiens
uacuuagacaguaugcauac

SEQ ID NO: 1145825 - RNA, 17 nt, Homo sapiens
uacuucaggggcacuuc

SEQ ID NO: 1145826 - RNA, 19 nt, Homo sapiens
uacuucauuuucagaguga

SEQ ID NO: 1145827 - RNA, 20 nt, Homo sapiens
uacuuccagcaaaauccaaa

SEQ ID NO: 1145828 - RNA, 12 nt, Homo sapiens
uacuuccaucug

SEQ ID NO: 1145829 - RNA, 15 nt, Homo sapiens
uacuucccucaggcc

SEQ ID NO: 1145830 - RNA, 20 nt, Homo sapiens
uacuucuggaagucaucuca

SEQ ID NO: 1145831 - RNA, 20 nt, Homo sapiens
uacuucuugauaccugggau

SEQ ID NO: 1145832 - RNA, 14 nt, Homo sapiens
uacuugaaggucua

SEQ ID NO: 1145833 - RNA, 21 nt, Homo sapiens
uacuugauauuauuucagggu

SEQ ID NO: 1145834 - RNA, 17 nt, Homo sapiens
uacuugcaagccucaaa

SEQ ID NO: 1145835 - RNA, 18 nt, Homo sapiens
uacuugcuccauuuacaa

SEQ ID NO: 1145836 - RNA, 20 nt, Homo sapiens
uacuugggaggcugaggcag

SEQ ID NO: 1145837 - RNA, 15 nt, Homo sapiens
uacuuuaaaauuaca

SEQ ID NO: 1145838 - RNA, 14 nt, Homo sapiens
uacuuuacugccug

SEQ ID NO: 1145839 - RNA, 14 nt, Homo sapiens
uacuuucuuuacau

SEQ ID NO: 1145840 - RNA, 17 nt, Homo sapiens
uacuuucuuuacauacc

SEQ ID NO: 1145841 - RNA, 18 nt, Homo sapiens
uacuuugccaacuugcca

SEQ ID NO: 1145842 - RNA, 19 nt, Homo sapiens
uacuuugccaacuugccau

SEQ ID NO: 1145843 - RNA, 14 nt, Homo sapiens
uacuuuguaaagac

SEQ ID NO: 1145844 - RNA, 18 nt, Homo sapiens
uacuuuguaaauaggauu

SEQ ID NO: 1145845 - RNA, 17 nt, Homo sapiens
uacuuuguauccucuga

SEQ ID NO: 1145846 - RNA, 15 nt, Homo sapiens
uacuuuguuuacuua

SEQ ID NO: 1145847 - RNA, 16 nt, Homo sapiens
uacuuuucaagcuaua

SEQ ID NO: 1145848 - RNA, 17 nt, Homo sapiens
uacuuuugauccugggg

SEQ ID NO: 1145849 - RNA, 12 nt, Homo sapiens
uacuuuugccaa

SEQ ID NO: 1145850 - RNA, 21 nt, Homo sapiens
uagaaaaaaagugcuuaauau

SEQ ID NO: 1145851 - RNA, 16 nt, Homo sapiens
uagaaaagcacuugaa

SEQ ID NO: 1145852 - RNA, 19 nt, Homo sapiens
uagaaaagcuuccuagcuu

SEQ ID NO: 1145853 - RNA, 21 nt, Homo sapiens
uagaaacaacauagcaaauua

SEQ ID NO: 1145854 - RNA, 13 nt, Homo sapiens
uagaaacuuguau

SEQ ID NO: 1145855 - RNA, 22 nt, Homo sapiens
uagaaagacuacauguuacuaa

SEQ ID NO: 1145856 - RNA, 18 nt, Homo sapiens
uagaaagccaugugcuaa

SEQ ID NO: 1145857 - RNA, 20 nt, Homo sapiens
uagaaauaaauaacuuugga

SEQ ID NO: 1145858 - RNA, 12 nt, Homo sapiens
uagaaauaagcc

SEQ ID NO: 1145859 - RNA, 17 nt, Homo sapiens
uagaagcagcauaggaa

SEQ ID NO: 1145860 - RNA, 15 nt, Homo sapiens
uagaagcaugaaguc

SEQ ID NO: 1145861 - RNA, 18 nt, Homo sapiens
uagaagcaugaagucuua

SEQ ID NO: 1145862 - RNA, 20 nt, Homo sapiens
uagaagugguuuccugauaa

SEQ ID NO: 1145863 - RNA, 21 nt, Homo sapiens
uagaaguugacaggcagugcc

SEQ ID NO: 1145864 - RNA, 20 nt, Homo sapiens
uagaauacuuuuaauuucac

SEQ ID NO: 1145865 - RNA, 23 nt, Homo sapiens
uagaauagccuguggccuuugca

SEQ ID NO: 1145866 - RNA, 18 nt, Homo sapiens
uagaauaguaugaugcuu

SEQ ID NO: 1145867 - RNA, 19 nt, Homo sapiens
uagaauaucuagcauguaa

SEQ ID NO: 1145868 - RNA, 16 nt, Homo sapiens
uagaaugaaccacugc

SEQ ID NO: 1145869 - RNA, 15 nt, Homo sapiens
uauaaagcacuauac

SEQ ID NO: 1145870 - RNA, 16 nt, Homo sapiens
uauaaagccacccacg

SEQ ID NO: 1145871 - RNA, 13 nt, Homo sapiens
uauaaagcucuca

SEQ ID NO: 1145872 - RNA, 14 nt, Homo sapiens
uauaaagcuguuau

SEQ ID NO: 1145873 - RNA, 19 nt, Homo sapiens
uauaaauaaaggaaccuuu

SEQ ID NO: 1145874 - RNA, 19 nt, Homo sapiens
uauaaauaaauaccaaaaa

SEQ ID NO: 1145875 - RNA, 19 nt, Homo sapiens
uauaaauagaugcugugua

SEQ ID NO: 1145876 - RNA, 17 nt, Homo sapiens
uauaaaucaugaugcua

SEQ ID NO: 1145877 - RNA, 21 nt, Homo sapiens
uauaaaugugauugcagcuuu

SEQ ID NO: 1145878 - RNA, 21 nt, Homo sapiens
uauaaauguuaguucuagcuc

SEQ ID NO: 1145879 - RNA, 17 nt, Homo sapiens
uauaacuaggcuguuaa

SEQ ID NO: 1145880 - RNA, 21 nt, Homo sapiens
uauaacuaguccuuuacuaau

SEQ ID NO: 1145881 - RNA, 13 nt, Homo sapiens
uauaacuguuguc

SEQ ID NO: 1145882 - RNA, 16 nt, Homo sapiens
uauaagaaagaucaaa

SEQ ID NO: 1145883 - RNA, 16 nt, Homo sapiens
uauaaguuucuuuaga

SEQ ID NO: 1145884 - RNA, 13 nt, Homo sapiens
uauaaugcuauuu

SEQ ID NO: 1145885 - RNA, 17 nt, Homo sapiens
uauaauguuguauuuaa

SEQ ID NO: 1145886 - RNA, 16 nt, Homo sapiens
uauaauuggugcauag

SEQ ID NO: 1145887 - RNA, 16 nt, Homo sapiens
uauacacacaaaaagg

SEQ ID NO: 1145888 - RNA, 16 nt, Homo sapiens
uauacaguguacaugu

SEQ ID NO: 1145889 - RNA, 23 nt, Homo sapiens
uauacauguauaucucgagugag

SEQ ID NO: 1145890 - RNA, 16 nt, Homo sapiens
uauacauuacaaucau

SEQ ID NO: 1145891 - RNA, 17 nt, Homo sapiens
uauaccaacccacuggc

SEQ ID NO: 1145892 - RNA, 16 nt, Homo sapiens
uauaccaaggcaaaaa

SEQ ID NO: 1145893 - RNA, 17 nt, Homo sapiens
uauaccaaggcaaaaaa

SEQ ID NO: 1145894 - RNA, 17 nt, Homo sapiens
uauaccagccuacugua

SEQ ID NO: 1145895 - RNA, 20 nt, Homo sapiens
uauaccuuuuguuaccacag

SEQ ID NO: 1145896 - RNA, 18 nt, Homo sapiens
uauacugagcugcuaaaa

SEQ ID NO: 1145897 - RNA, 16 nt, Homo sapiens
uauacugcuuggagcu

SEQ ID NO: 1145898 - RNA, 21 nt, Homo sapiens
uauacuguaaagcgcagauaa

SEQ ID NO: 1145899 - RNA, 20 nt, Homo sapiens
uauacuucucuauuaucuca

SEQ ID NO: 1145900 - RNA, 13 nt, Homo sapiens
uauagaaacacca

SEQ ID NO: 1145901 - RNA, 15 nt, Homo sapiens
uauagaaacaccagu

SEQ ID NO: 1145902 - RNA, 17 nt, Homo sapiens
uauagacggacuucauu

SEQ ID NO: 1145903 - RNA, 20 nt, Homo sapiens
uauagagaaaggucuaugca

SEQ ID NO: 1145904 - RNA, 12 nt, Homo sapiens
uauagauucuaa

SEQ ID NO: 1145905 - RNA, 18 nt, Homo sapiens
uauagcauuuugcuaucu

SEQ ID NO: 1145906 - RNA, 20 nt, Homo sapiens
uauagccuauggcagaaaaa

SEQ ID NO: 1145907 - RNA, 12 nt, Homo sapiens
uauagccuuuac

SEQ ID NO: 1145908 - RNA, 14 nt, Homo sapiens
uauagcuacuaauu

SEQ ID NO: 1145909 - RNA, 19 nt, Homo sapiens
uauaguacuuuaugcaucu

SEQ ID NO: 1145910 - RNA, 13 nt, Homo sapiens
uauaguauacucu

SEQ ID NO: 1145911 - RNA, 14 nt, Homo sapiens
uauaguucuaggca

SEQ ID NO: 1145912 - RNA, 19 nt, Homo sapiens
uauaguugguacacaacua

SEQ ID NO: 1145913 - RNA, 22 nt, Homo sapiens
uauaguuugggcuucagccuag

SEQ ID NO: 1145914 - RNA, 23 nt, Homo sapiens
uauaguuuguuuuuaaacuaaua

SEQ ID NO: 1145915 - RNA, 20 nt, Homo sapiens
uauaguuuucccuauugaau

SEQ ID NO: 1145916 - RNA, 18 nt, Homo sapiens
uauauaaaugugauugca

SEQ ID NO: 1145917 - RNA, 23 nt, Homo sapiens
uauauaaggucauagauucuuga

SEQ ID NO: 1145918 - RNA, 23 nt, Homo sapiens
uauauagcucuacacaacaugua

SEQ ID NO: 1145919 - RNA, 20 nt, Homo sapiens
uauauauuuuugugcacauu

SEQ ID NO: 1145920 - RNA, 13 nt, Homo sapiens
uauaucauaugua

SEQ ID NO: 1145921 - RNA, 16 nt, Homo sapiens
uauaugcacuauguau

SEQ ID NO: 1145922 - RNA, 13 nt, Homo sapiens
uauauggccucaa

SEQ ID NO: 1145923 - RNA, 14 nt, Homo sapiens
uauauguacaugag

SEQ ID NO: 1145924 - RNA, 17 nt, Homo sapiens
uauauuacaagggauaa

SEQ ID NO: 1145925 - RNA, 16 nt, Homo sapiens
uauauucauccaugcc

SEQ ID NO: 1145926 - RNA, 14 nt, Homo sapiens
uauauuccaccagg

SEQ ID NO: 1145927 - RNA, 12 nt, Homo sapiens
uauauugcccag

SEQ ID NO: 1145928 - RNA, 15 nt, Homo sapiens
uauauugggcucaga

SEQ ID NO: 1145929 - RNA, 19 nt, Homo sapiens
uauauuugaaguggagcca

SEQ ID NO: 1145930 - RNA, 23 nt, Homo sapiens
uauauuuuuaaaaaucuaccugu

SEQ ID NO: 1145931 - RNA, 23 nt, Homo sapiens
uaucaaaaagguuucugcacauu

SEQ ID NO: 1145932 - RNA, 15 nt, Homo sapiens
uaucaaaauugccuu

SEQ ID NO: 1145933 - RNA, 21 nt, Homo sapiens
uaucaaauauuagaugugauu

SEQ ID NO: 1145934 - RNA, 21 nt, Homo sapiens
uaucaaaucagucagugcaaa

SEQ ID NO: 1145935 - RNA, 14 nt, Homo sapiens
uaucaacagcauuu

SEQ ID NO: 1145936 - RNA, 21 nt, Homo sapiens
uaucaacuggggggaccaaau

SEQ ID NO: 1145937 - RNA, 23 nt, Homo sapiens
uaucaacuggggggaccaaauag

SEQ ID NO: 1145938 - RNA, 13 nt, Homo sapiens
uaucaacuuccua

SEQ ID NO: 1145939 - RNA, 12 nt, Homo sapiens
uaucacuguugc

SEQ ID NO: 1145940 - RNA, 13 nt, Homo sapiens
uaucacuguugca

SEQ ID NO: 1145941 - RNA, 21 nt, Homo sapiens
uaucacuuaauaaaaaauaua

SEQ ID NO: 1145942 - RNA, 21 nt, Homo sapiens
uaucaggaguucuaggaacuc

SEQ ID NO: 1145943 - RNA, 14 nt, Homo sapiens
uaucauaaauacaa

SEQ ID NO: 1145944 - RNA, 17 nt, Homo sapiens
uaucauaaauacaagag

SEQ ID NO: 1145945 - RNA, 17 nt, Homo sapiens
uaucaugcccugugcaa

SEQ ID NO: 1145946 - RNA, 16 nt, Homo sapiens
uaucauggcauauaac

SEQ ID NO: 1145947 - RNA, 14 nt, Homo sapiens
uaucauuacauaua

SEQ ID NO: 1145948 - RNA, 13 nt, Homo sapiens
uaucauugcuaaa

SEQ ID NO: 1145949 - RNA, 15 nt, Homo sapiens
uauccacuggcauuu

SEQ ID NO: 1145950 - RNA, 21 nt, Homo sapiens
uaucccauggaaccacuaaaa

SEQ ID NO: 1145951 - RNA, 17 nt, Homo sapiens
uauccccaggccuggca

SEQ ID NO: 1145952 - RNA, 23 nt, Homo sapiens
uauccccagggacagaaaccaag

SEQ ID NO: 1145953 - RNA, 17 nt, Homo sapiens
uauccuccuguucugaa

SEQ ID NO: 1145954 - RNA, 18 nt, Homo sapiens
uauccuccuguucugaaa

SEQ ID NO: 1145955 - RNA, 20 nt, Homo sapiens
uauccucugaccuacauacg

SEQ ID NO: 1145956 - RNA, 14 nt, Homo sapiens
uauccucuugccaa

SEQ ID NO: 1145957 - RNA, 22 nt, Homo sapiens
uauccuguuccgagcaacuuuu

SEQ ID NO: 1145958 - RNA, 12 nt, Homo sapiens
uauccuguucua

SEQ ID NO: 1145959 - RNA, 14 nt, Homo sapiens
uauccuucuacuug

SEQ ID NO: 1145960 - RNA, 15 nt, Homo sapiens
uaucgaacacauuca

SEQ ID NO: 1145961 - RNA, 15 nt, Homo sapiens
uaucuaaaaucugcu

SEQ ID NO: 1145962 - RNA, 17 nt, Homo sapiens
uaucuauuaaccauucu

SEQ ID NO: 1145963 - RNA, 16 nt, Homo sapiens
uaucugaaaugugaua

SEQ ID NO: 1145964 - RNA, 16 nt, Homo sapiens
uaucugacaaugcuga

SEQ ID NO: 1145965 - RNA, 18 nt, Homo sapiens
uaucugcuauugugaugc

SEQ ID NO: 1145966 - RNA, 16 nt, Homo sapiens
uaucugguuucucuag

SEQ ID NO: 1145967 - RNA, 22 nt, Homo sapiens
uaucuguagugagauagcauug

SEQ ID NO: 1145968 - RNA, 14 nt, Homo sapiens
uaucuuaacacuga

SEQ ID NO: 1145969 - RNA, 21 nt, Homo sapiens
uaucuuaaugcagacaaacaa

SEQ ID NO: 1145970 - RNA, 20 nt, Homo sapiens
uaucuugaauguaguauuca

SEQ ID NO: 1145971 - RNA, 18 nt, Homo sapiens
uaucuuguaaauaaagac

SEQ ID NO: 1145972 - RNA, 23 nt, Homo sapiens
uaugaaaaggauauuaucuaccu

SEQ ID NO: 1145973 - RNA, 19 nt, Homo sapiens
uaugaaacaaacuacugug

SEQ ID NO: 1145974 - RNA, 14 nt, Homo sapiens
uaugaaacuugaaa

SEQ ID NO: 1145975 - RNA, 21 nt, Homo sapiens
uaugaaguaaagaacugcaca

SEQ ID NO: 1145976 - RNA, 15 nt, Homo sapiens
uaugaauacagcagc

SEQ ID NO: 1145977 - RNA, 19 nt, Homo sapiens
uaugacaacucuuauuuga

SEQ ID NO: 1145978 - RNA, 23 nt, Homo sapiens
uaugacucagagaaccagugcag

SEQ ID NO: 1145979 - RNA, 14 nt, Homo sapiens
uaugacugcaccaa

SEQ ID NO: 1145980 - RNA, 22 nt, Homo sapiens
uaugacugcugaaucaucauau

SEQ ID NO: 1145981 - RNA, 20 nt, Homo sapiens
uaugagaacugguucuugcc

SEQ ID NO: 1145982 - RNA, 15 nt, Homo sapiens
uaugagaugccugaa

SEQ ID NO: 1145983 - RNA, 17 nt, Homo sapiens
uaugagaugccugaagc

SEQ ID NO: 1145984 - RNA, 15 nt, Homo sapiens
uaugaggcuguuguc

SEQ ID NO: 1145985 - RNA, 18 nt, Homo sapiens
uaugaguaauacaucaaa

SEQ ID NO: 1145986 - RNA, 12 nt, Homo sapiens
uaugaguauaau

SEQ ID NO: 1145987 - RNA, 14 nt, Homo sapiens
uaugauacugaugc

SEQ ID NO: 1145988 - RNA, 16 nt, Homo sapiens
uaugaucucaguauuu

SEQ ID NO: 1145989 - RNA, 19 nt, Homo sapiens
uauggcucacacagcuuaa

SEQ ID NO: 1145990 - RNA, 14 nt, Homo sapiens
uauggcuccuccau

SEQ ID NO: 1145991 - RNA, 21 nt, Homo sapiens
uaugggggagauugaacuuuc

SEQ ID NO: 1145992 - RNA, 22 nt, Homo sapiens
uaugggggauggugagcuguga

SEQ ID NO: 1145993 - RNA, 16 nt, Homo sapiens
uauggugagaugcagc

SEQ ID NO: 1145994 - RNA, 13 nt, Homo sapiens
uauggugggagag

SEQ ID NO: 1145995 - RNA, 15 nt, Homo sapiens
uaugguuugccauua

SEQ ID NO: 1145996 - RNA, 21 nt, Homo sapiens
uaugguuuuucaccugggaag

SEQ ID NO: 1145997 - RNA, 17 nt, Homo sapiens
uauguagaaacauuuag

SEQ ID NO: 1145998 - RNA, 22 nt, Homo sapiens
uauguagcaaaauacaugacau

SEQ ID NO: 1145999 - RNA, 14 nt, Homo sapiens
uauguauauacaca

SEQ ID NO: 1146000 - RNA, 21 nt, Homo sapiens
uaugucaaauugucagcauga

SEQ ID NO: 1146001 - RNA, 18 nt, Homo sapiens
uaugucuuggacacugua

SEQ ID NO: 1146002 - RNA, 17 nt, Homo sapiens
uaugucuuuugaugaau

SEQ ID NO: 1146003 - RNA, 23 nt, Homo sapiens
uaugugagagaaagugugagcaa

SEQ ID NO: 1146004 - RNA, 15 nt, Homo sapiens
uauguggaacuguac

SEQ ID NO: 1146005 - RNA, 14 nt, Homo sapiens
uauguggcuguauc

SEQ ID NO: 1146006 - RNA, 14 nt, Homo sapiens
uauguucacaguua

SEQ ID NO: 1146007 - RNA, 15 nt, Homo sapiens
uauguucuuacuuug

SEQ ID NO: 1146008 - RNA, 19 nt, Homo sapiens
uauguuuaucaacucaaga

SEQ ID NO: 1146009 - RNA, 17 nt, Homo sapiens
uauuaaaauuagugcug

SEQ ID NO: 1146010 - RNA, 21 nt, Homo sapiens
uauuaaaauuuggugcuuaua

SEQ ID NO: 1146011 - RNA, 18 nt, Homo sapiens
uauuaaaccuuuccauuu

SEQ ID NO: 1146012 - RNA, 14 nt, Homo sapiens
uauuaaauguugcu

SEQ ID NO: 1146013 - RNA, 19 nt, Homo sapiens
uauuaaauguugcuuuaac

SEQ ID NO: 1146014 - RNA, 13 nt, Homo sapiens
uauuaaauuugaa

SEQ ID NO: 1146015 - RNA, 20 nt, Homo sapiens
uauuaacucuguaaaagugu

SEQ ID NO: 1146016 - RNA, 23 nt, Homo sapiens
uauuaagaggcagaaaauugcac

SEQ ID NO: 1146017 - RNA, 17 nt, Homo sapiens
uauuaagguguggcuuu

SEQ ID NO: 1146018 - RNA, 19 nt, Homo sapiens
uauuaauaguucaguguau

SEQ ID NO: 1146019 - RNA, 14 nt, Homo sapiens
uauuaauuuugcca

SEQ ID NO: 1146020 - RNA, 20 nt, Homo sapiens
uauuacaugguuaacaucaa

SEQ ID NO: 1146021 - RNA, 16 nt, Homo sapiens
uauuaccaguguuccc

SEQ ID NO: 1146022 - RNA, 16 nt, Homo sapiens
uauuaccauuacuugu

SEQ ID NO: 1146023 - RNA, 20 nt, Homo sapiens
uauuacguuguuucuuauag

SEQ ID NO: 1146024 - RNA, 15 nt, Homo sapiens
uauuacuaaggagua

SEQ ID NO: 1146025 - RNA, 17 nt, Homo sapiens
uauuacuuuucaucuaa

SEQ ID NO: 1146026 - RNA, 14 nt, Homo sapiens
uauuagauuacuaa

SEQ ID NO: 1146027 - RNA, 18 nt, Homo sapiens
uauuaggagacacaggga

SEQ ID NO: 1146028 - RNA, 18 nt, Homo sapiens
uauuaggccucagaaaga

SEQ ID NO: 1146029 - RNA, 17 nt, Homo sapiens
uauuauauauacuuaau

SEQ ID NO: 1146030 - RNA, 22 nt, Homo sapiens
uauuaucgcauacagauauucu

SEQ ID NO: 1146031 - RNA, 22 nt, Homo sapiens
uauuaucuaccuguucuguagc

SEQ ID NO: 1146032 - RNA, 22 nt, Homo sapiens
uauuaugcggaaagguauuugg

SEQ ID NO: 1146033 - RNA, 17 nt, Homo sapiens
uauuauguaaauuuugc

SEQ ID NO: 1146034 - RNA, 14 nt, Homo sapiens
uauuauuuaacucu

SEQ ID NO: 1146035 - RNA, 12 nt, Homo sapiens
uauuauuugcua

SEQ ID NO: 1146036 - RNA, 14 nt, Homo sapiens
uauucaaaugaagg

SEQ ID NO: 1146037 - RNA, 23 nt, Homo sapiens
uauucaauggugagcagacugca

SEQ ID NO: 1146038 - RNA, 19 nt, Homo sapiens
uauucagaaucaaaccuuu

SEQ ID NO: 1146039 - RNA, 12 nt, Homo sapiens
uauucauuugcu

SEQ ID NO: 1146040 - RNA, 14 nt, Homo sapiens
uauuccagugucca

SEQ ID NO: 1146041 - RNA, 16 nt, Homo sapiens
uauucgguaauaucau

SEQ ID NO: 1146042 - RNA, 23 nt, Homo sapiens
uauucuaguuuugucaaacugua

SEQ ID NO: 1146043 - RNA, 19 nt, Homo sapiens
uauucuguaauuuggcucc

SEQ ID NO: 1146044 - RNA, 20 nt, Homo sapiens
uauucuuggagaauaucaaa

SEQ ID NO: 1146045 - RNA, 16 nt, Homo sapiens
uauucuuuaaauuuca

SEQ ID NO: 1146046 - RNA, 18 nt, Homo sapiens
uauugaaucauguaguau

SEQ ID NO: 1146047 - RNA, 19 nt, Homo sapiens
uauugauaauaaauuauac

SEQ ID NO: 1146048 - RNA, 19 nt, Homo sapiens
uauugcagcuuauauucau

SEQ ID NO: 1146049 - RNA, 20 nt, Homo sapiens
uauugccaggaauguuucag

SEQ ID NO: 1146050 - RNA, 18 nt, Homo sapiens
uauugccuggagugugaa

SEQ ID NO: 1146051 - RNA, 18 nt, Homo sapiens
uauugcuggcaucugugc

SEQ ID NO: 1146052 - RNA, 14 nt, Homo sapiens
uauugcuguuucag

SEQ ID NO: 1146053 - RNA, 16 nt, Homo sapiens
uauugcuugaguuaua

SEQ ID NO: 1146054 - RNA, 21 nt, Homo sapiens
uauuggacaguaaaauccaca

SEQ ID NO: 1146055 - RNA, 22 nt, Homo sapiens
uauuggcgcaccaagaucucca

SEQ ID NO: 1146056 - RNA, 23 nt, Homo sapiens
uauuggcgcaccaagaucuccaa

SEQ ID NO: 1146057 - RNA, 15 nt, Homo sapiens
uauuguagucuugca

SEQ ID NO: 1146058 - RNA, 18 nt, Homo sapiens
uauuuaaaagacaaacac

SEQ ID NO: 1146059 - RNA, 13 nt, Homo sapiens
uauuuaacaugua

SEQ ID NO: 1146060 - RNA, 21 nt, Homo sapiens
uauuuaaggaaucaaaucuua

SEQ ID NO: 1146061 - RNA, 14 nt, Homo sapiens
uauuuaauucuuau

SEQ ID NO: 1146062 - RNA, 21 nt, Homo sapiens
uauuuauagucgaacaauuca

SEQ ID NO: 1146063 - RNA, 21 nt, Homo sapiens
uauuuauaugaagcaagcugu

SEQ ID NO: 1146064 - RNA, 20 nt, Homo sapiens
uauuuauccaaaauguguau

SEQ ID NO: 1146065 - RNA, 20 nt, Homo sapiens
uauuucaaaauauacauuca

SEQ ID NO: 1146066 - RNA, 19 nt, Homo sapiens
uauuucaauguuagccuca

SEQ ID NO: 1146067 - RNA, 16 nt, Homo sapiens
uauuucacaaauaaua

SEQ ID NO: 1146068 - RNA, 17 nt, Homo sapiens
uauuuccccagccacag

SEQ ID NO: 1146069 - RNA, 16 nt, Homo sapiens
uauuuccccucucaaa

SEQ ID NO: 1146070 - RNA, 19 nt, Homo sapiens
uauuucccucuacugagua

SEQ ID NO: 1146071 - RNA, 20 nt, Homo sapiens
uauuucggagcgcaaugcca

SEQ ID NO: 1146072 - RNA, 20 nt, Homo sapiens
uauuucuggagggcaauuug

SEQ ID NO: 1146073 - RNA, 20 nt, Homo sapiens
uauuucugucaacuuguauu

SEQ ID NO: 1146074 - RNA, 17 nt, Homo sapiens
uauuucuuaguccauca

SEQ ID NO: 1146075 - RNA, 22 nt, Homo sapiens
uauuucuucuacugcuaucuac

SEQ ID NO: 1146076 - RNA, 14 nt, Homo sapiens
uauuugaaagcagg

SEQ ID NO: 1146077 - RNA, 14 nt, Homo sapiens
uauuugacuuacca

SEQ ID NO: 1146078 - RNA, 15 nt, Homo sapiens
uauuugaucacuuaa

SEQ ID NO: 1146079 - RNA, 19 nt, Homo sapiens
uauuugcaguucaccugca

SEQ ID NO: 1146080 - RNA, 17 nt, Homo sapiens
uauuugugcaccugcuu

SEQ ID NO: 1146081 - RNA, 22 nt, Homo sapiens
uauuuguuauggcagaugacaa

SEQ ID NO: 1146082 - RNA, 14 nt, Homo sapiens
uauuuguucuuaua

SEQ ID NO: 1146083 - RNA, 19 nt, Homo sapiens
uauuuuaagaauuucacaa

SEQ ID NO: 1146084 - RNA, 23 nt, Homo sapiens
uauuuuacacguaucucuuggua

SEQ ID NO: 1146085 - RNA, 16 nt, Homo sapiens
uauuuuauagcuacua

SEQ ID NO: 1146086 - RNA, 22 nt, Homo sapiens
uauuuucagugauaacuccuaa

SEQ ID NO: 1146087 - RNA, 16 nt, Homo sapiens
uauuuucucuuaacaa

SEQ ID NO: 1146088 - RNA, 19 nt, Homo sapiens
uauuuuguguuccuaucaa

SEQ ID NO: 1146089 - RNA, 20 nt, Homo sapiens
uauuuuguguuccuaucaaa

SEQ ID NO: 1146090 - RNA, 14 nt, Homo sapiens
uauuuuuacaaaaa

SEQ ID NO: 1146091 - RNA, 13 nt, Homo sapiens
uauuuuucugaua

SEQ ID NO: 1146092 - RNA, 16 nt, Homo sapiens
ucaaaaauaccauuuu

SEQ ID NO: 1146093 - RNA, 18 nt, Homo sapiens
ucaaaacauugugccaug

SEQ ID NO: 1146094 - RNA, 18 nt, Homo sapiens
ucaaaacccaacaugacu

SEQ ID NO: 1146095 - RNA, 12 nt, Homo sapiens
ucaaaagcuuuu

SEQ ID NO: 1146096 - RNA, 15 nt, Homo sapiens
ucaaaaguaaugccu

SEQ ID NO: 1146097 - RNA, 19 nt, Homo sapiens
ucaaaagucuggccuuuca

SEQ ID NO: 1146098 - RNA, 17 nt, Homo sapiens
ucaaaagugccucaaga

SEQ ID NO: 1146099 - RNA, 17 nt, Homo sapiens
ucaaaauauacauucaa

SEQ ID NO: 1146100 - RNA, 14 nt, Homo sapiens
ucaaaauugcaauc

SEQ ID NO: 1146101 - RNA, 12 nt, Homo sapiens
ucaaacauauau

SEQ ID NO: 1146102 - RNA, 15 nt, Homo sapiens
ucaaacccauucccu

SEQ ID NO: 1146103 - RNA, 16 nt, Homo sapiens
ucaaacuucuguguac

SEQ ID NO: 1146104 - RNA, 13 nt, Homo sapiens
ucaaagaguccua

SEQ ID NO: 1146105 - RNA, 12 nt, Homo sapiens
ucaaagccauau

SEQ ID NO: 1146106 - RNA, 22 nt, Homo sapiens
ucaaagccauauggacacugug

SEQ ID NO: 1146107 - RNA, 23 nt, Homo sapiens
ucaaagccauauggacacuguga

SEQ ID NO: 1146108 - RNA, 20 nt, Homo sapiens
ucaaaggaaaauaguaaugu

SEQ ID NO: 1146109 - RNA, 14 nt, Homo sapiens
ucacuggagucucc

SEQ ID NO: 1146110 - RNA, 23 nt, Homo sapiens
ucacuggcagccugcaccuggug

SEQ ID NO: 1146111 - RNA, 23 nt, Homo sapiens
ucacuggccaagaaaauugccuu

SEQ ID NO: 1146112 - RNA, 12 nt, Homo sapiens
ucacuguaaaau

SEQ ID NO: 1146113 - RNA, 14 nt, Homo sapiens
ucacuguccuccaa

SEQ ID NO: 1146114 - RNA, 22 nt, Homo sapiens
ucacugugcuaucggcagauga

SEQ ID NO: 1146115 - RNA, 19 nt, Homo sapiens
ucacuguuuaaagcuuuga

SEQ ID NO: 1146116 - RNA, 23 nt, Homo sapiens
ucacuuccguuuaccuucauggu

SEQ ID NO: 1146117 - RNA, 19 nt, Homo sapiens
ucacuuccuauaugcacuu

SEQ ID NO: 1146118 - RNA, 19 nt, Homo sapiens
ucacuucuaauaaacagac

SEQ ID NO: 1146119 - RNA, 21 nt, Homo sapiens
ucacuucuaggguaugggaaa

SEQ ID NO: 1146120 - RNA, 12 nt, Homo sapiens
ucacuucuucca

SEQ ID NO: 1146121 - RNA, 15 nt, Homo sapiens
ucacuugaaccuggg

SEQ ID NO: 1146122 - RNA, 19 nt, Homo sapiens
ucacuugaauccauugaaa

SEQ ID NO: 1146123 - RNA, 17 nt, Homo sapiens
ucacuuguaccuuccac

SEQ ID NO: 1146124 - RNA, 15 nt, Homo sapiens
ucacuuuauuguaga

SEQ ID NO: 1146125 - RNA, 13 nt, Homo sapiens
ucacuuugcuaca

SEQ ID NO: 1146126 - RNA, 17 nt, Homo sapiens
ucacuuuuaaugaacaa

SEQ ID NO: 1146127 - RNA, 12 nt, Homo sapiens
ucagaacagaca

SEQ ID NO: 1146128 - RNA, 17 nt, Homo sapiens
ucagaacagacaaucac

SEQ ID NO: 1146129 - RNA, 22 nt, Homo sapiens
ucagaacccuuggcuugcccac

SEQ ID NO: 1146130 - RNA, 18 nt, Homo sapiens
ucagaacuagaauuugau

SEQ ID NO: 1146131 - RNA, 13 nt, Homo sapiens
ucagaacugaaau

SEQ ID NO: 1146132 - RNA, 21 nt, Homo sapiens
ucagaagggagcuagccagag

SEQ ID NO: 1146133 - RNA, 15 nt, Homo sapiens
ucagaauagccacau

SEQ ID NO: 1146134 - RNA, 12 nt, Homo sapiens
ucagacaaauuc

SEQ ID NO: 1146135 - RNA, 22 nt, Homo sapiens
ucagaccucuucauguuaaaag

SEQ ID NO: 1146136 - RNA, 21 nt, Homo sapiens
ucagacugaacuuacacugua

SEQ ID NO: 1146137 - RNA, 22 nt, Homo sapiens
ucagacugcggugaacauuucc

SEQ ID NO: 1146138 - RNA, 11 nt, Homo sapiens
ucagacuugcc

SEQ ID NO: 1146139 - RNA, 17 nt, Homo sapiens
ucagagaaccagugcag

SEQ ID NO: 1146140 - RNA, 17 nt, Homo sapiens
ucagagaccauugcaau

SEQ ID NO: 1146141 - RNA, 17 nt, Homo sapiens
ucagagcagaggcagca

SEQ ID NO: 1146142 - RNA, 13 nt, Homo sapiens
ucagagcagagua

SEQ ID NO: 1146143 - RNA, 19 nt, Homo sapiens
ucagagccaaauuacaagu

SEQ ID NO: 1146144 - RNA, 13 nt, Homo sapiens
ucagagugcaagc

SEQ ID NO: 1146145 - RNA, 23 nt, Homo sapiens
ucagagugggguggggagcaugu

SEQ ID NO: 1146146 - RNA, 18 nt, Homo sapiens
ucagaguugagaccuuug

SEQ ID NO: 1146147 - RNA, 22 nt, Homo sapiens
ucagauaagguaaaaugccaug

SEQ ID NO: 1146148 - RNA, 23 nt, Homo sapiens
ucagauaagguaaaaugccauga

SEQ ID NO: 1146149 - RNA, 15 nt, Homo sapiens
ucagauagaaugaca

SEQ ID NO: 1146150 - RNA, 19 nt, Homo sapiens
ucagaucacugcaaccucu

SEQ ID NO: 1146151 - RNA, 19 nt, Homo sapiens
ucagauggaaccgcaggaa

SEQ ID NO: 1146152 - RNA, 15 nt, Homo sapiens
ucagauggcauaaau

SEQ ID NO: 1146153 - RNA, 17 nt, Homo sapiens
ucagauugcaugugacu

SEQ ID NO: 1146154 - RNA, 15 nt, Homo sapiens
ucagauuuguguuau

SEQ ID NO: 1146155 - RNA, 18 nt, Homo sapiens
ucagauuuugguugcuaa

SEQ ID NO: 1146156 - RNA, 22 nt, Homo sapiens
ucagcaaaacuuuccaacugag

SEQ ID NO: 1146157 - RNA, 18 nt, Homo sapiens
ucagcaacaaccaucuca

SEQ ID NO: 1146158 - RNA, 17 nt, Homo sapiens
ucagcaacagagcaaaa

SEQ ID NO: 1146159 - RNA, 17 nt, Homo sapiens
ucagcaagaauuugauc

SEQ ID NO: 1146160 - RNA, 14 nt, Homo sapiens
ucagcacucagaga

SEQ ID NO: 1146161 - RNA, 16 nt, Homo sapiens
ucagcacugucuuguc

SEQ ID NO: 1146162 - RNA, 14 nt, Homo sapiens
ucagcagaggcagu

SEQ ID NO: 1146163 - RNA, 14 nt, Homo sapiens
ucagcaucugacca

SEQ ID NO: 1146164 - RNA, 18 nt, Homo sapiens
ucagcaucugaccaucug

SEQ ID NO: 1146165 - RNA, 23 nt, Homo sapiens
ucagcauuuucuucucugcacuu

SEQ ID NO: 1146166 - RNA, 13 nt, Homo sapiens
ucagccagaguug

SEQ ID NO: 1146167 - RNA, 21 nt, Homo sapiens
ucagccagcccguguguauaa

SEQ ID NO: 1146168 - RNA, 18 nt, Homo sapiens
ucagccauaggugcaguu

SEQ ID NO: 1146169 - RNA, 19 nt, Homo sapiens
ucagcccccaccucagguu

SEQ ID NO: 1146170 - RNA, 18 nt, Homo sapiens
ucagccuugccagagauc

SEQ ID NO: 1146171 - RNA, 19 nt, Homo sapiens
ucagcuauuuagugauaua

SEQ ID NO: 1146172 - RNA, 20 nt, Homo sapiens
ucagcucccacaaaugacag

SEQ ID NO: 1146173 - RNA, 19 nt, Homo sapiens
ucagcucggggagccuuag

SEQ ID NO: 1146174 - RNA, 12 nt, Homo sapiens
ucagcucugagg

SEQ ID NO: 1146175 - RNA, 13 nt, Homo sapiens
ucagcucuuggcu

SEQ ID NO: 1146176 - RNA, 14 nt, Homo sapiens
ucagcucuuugaca

SEQ ID NO: 1146177 - RNA, 16 nt, Homo sapiens
ucagcucuuugacaac

SEQ ID NO: 1146178 - RNA, 13 nt, Homo sapiens
ucagcuuaucucu

SEQ ID NO: 1146179 - RNA, 16 nt, Homo sapiens
ucagcuuggauaacca

SEQ ID NO: 1146180 - RNA, 14 nt, Homo sapiens
ucaggaaaacugac

SEQ ID NO: 1146181 - RNA, 13 nt, Homo sapiens
ucaggaaaccaca

SEQ ID NO: 1146182 - RNA, 14 nt, Homo sapiens
ucaggaaaccacaa

SEQ ID NO: 1146183 - RNA, 18 nt, Homo sapiens
ucaggaaucagaaaucau

SEQ ID NO: 1146184 - RNA, 20 nt, Homo sapiens
ucaggaguuccagugcugca

SEQ ID NO: 1146185 - RNA, 22 nt, Homo sapiens
ucaggauccaagcuaagcacug

SEQ ID NO: 1146186 - RNA, 14 nt, Homo sapiens
ucaggauguucucc

SEQ ID NO: 1146187 - RNA, 15 nt, Homo sapiens
ucaggcacacagcua

SEQ ID NO: 1146188 - RNA, 13 nt, Homo sapiens
ucaggcacagguc

SEQ ID NO: 1146189 - RNA, 12 nt, Homo sapiens
ucaggcaccugc

SEQ ID NO: 1146190 - RNA, 13 nt, Homo sapiens
ucaggcagggugc

SEQ ID NO: 1146191 - RNA, 17 nt, Homo sapiens
ucaggcagggugcagua

SEQ ID NO: 1146192 - RNA, 18 nt, Homo sapiens
ucaggcccucagcugucg

SEQ ID NO: 1146193 - RNA, 19 nt, Homo sapiens
ucaggcuggcuugagugaa

SEQ ID NO: 1146194 - RNA, 15 nt, Homo sapiens
ucagggauccaauau

SEQ ID NO: 1146195 - RNA, 16 nt, Homo sapiens
ucaggggauacaggcc

SEQ ID NO: 1146196 - RNA, 18 nt, Homo sapiens
ucaggggcgggugcauug

SEQ ID NO: 1146197 - RNA, 14 nt, Homo sapiens
ucaggggucacuga

SEQ ID NO: 1146198 - RNA, 13 nt, Homo sapiens
ucagggucccauu

SEQ ID NO: 1146199 - RNA, 21 nt, Homo sapiens
ucagggucccauugcuguuca

SEQ ID NO: 1146200 - RNA, 21 nt, Homo sapiens
ucaggugauccgccuaccuca

SEQ ID NO: 1146201 - RNA, 22 nt, Homo sapiens
ucagguuugaggguuugcagaa

SEQ ID NO: 1146202 - RNA, 19 nt, Homo sapiens
ucaguaacaaguauuggga

SEQ ID NO: 1146203 - RNA, 17 nt, Homo sapiens
ucaguacagcacuccug

SEQ ID NO: 1146204 - RNA, 18 nt, Homo sapiens
ucaguacuucagcaagag

SEQ ID NO: 1146205 - RNA, 18 nt, Homo sapiens
ucaguauguuuuacacug

SEQ ID NO: 1146206 - RNA, 22 nt, Homo sapiens
ucaguauuccaaacucuccagc

SEQ ID NO: 1146207 - RNA, 14 nt, Homo sapiens
ucagucacagccac

SEQ ID NO: 1146208 - RNA, 22 nt, Homo sapiens
ucagucacagccaccccugaga

SEQ ID NO: 1146209 - RNA, 13 nt, Homo sapiens
ucagucucugagc

SEQ ID NO: 1146210 - RNA, 21 nt, Homo sapiens
ucagugcucccucacauguca

SEQ ID NO: 1146211 - RNA, 14 nt, Homo sapiens
ucagugcugcugaa

SEQ ID NO: 1146212 - RNA, 16 nt, Homo sapiens
ucaguggcucugggua

SEQ ID NO: 1146213 - RNA, 13 nt, Homo sapiens
ucaguguccuuca

SEQ ID NO: 1146214 - RNA, 21 nt, Homo sapiens
ucaguguugccucuugcaaug

SEQ ID NO: 1146215 - RNA, 16 nt, Homo sapiens
ucaguuaaguguuucc

SEQ ID NO: 1146216 - RNA, 18 nt, Homo sapiens
ucaguuaauucuuagaua

SEQ ID NO: 1146217 - RNA, 18 nt, Homo sapiens
ucaguuauuauauuuaca

SEQ ID NO: 1146218 - RNA, 20 nt, Homo sapiens
ucaguucuuagauucagggg

SEQ ID NO: 1146219 - RNA, 16 nt, Homo sapiens
ucaguuggcccuuuaa

SEQ ID NO: 1146220 - RNA, 21 nt, Homo sapiens
ucauaaacuggaaauacugau

SEQ ID NO: 1146221 - RNA, 18 nt, Homo sapiens
ucauaaacuucaggcaau

SEQ ID NO: 1146222 - RNA, 19 nt, Homo sapiens
ucauaagacuuugggauag

SEQ ID NO: 1146223 - RNA, 21 nt, Homo sapiens
ucauaauuaaaaagagccuua

SEQ ID NO: 1146224 - RNA, 15 nt, Homo sapiens
ucauaccuacauuca

SEQ ID NO: 1146225 - RNA, 15 nt, Homo sapiens
ucauacuggugauua

SEQ ID NO: 1146226 - RNA, 18 nt, Homo sapiens
ucauagaaauucuuuaua

SEQ ID NO: 1146227 - RNA, 20 nt, Homo sapiens
ucauaggauuaagcaguuua

SEQ ID NO: 1146228 - RNA, 18 nt, Homo sapiens
ucauagggaggccuuuag

SEQ ID NO: 1146229 - RNA, 22 nt, Homo sapiens
ucauaggggcagguccuagucg

SEQ ID NO: 1146230 - RNA, 14 nt, Homo sapiens
ucauaguugcaaaa

SEQ ID NO: 1146231 - RNA, 15 nt, Homo sapiens
ucauauaagcuauau

SEQ ID NO: 1146232 - RNA, 14 nt, Homo sapiens
ucauauaccagcaa

SEQ ID NO: 1146233 - RNA, 16 nt, Homo sapiens
ucauauaccagcaaua

SEQ ID NO: 1146234 - RNA, 19 nt, Homo sapiens
uccguuugguagacuccuu

SEQ ID NO: 1146235 - RNA, 24 nt, Homo sapiens
uccuaaagaaaaauaucuuggccu

SEQ ID NO: 1146236 - RNA, 15 nt, Homo sapiens
uccuaaggccacugu

SEQ ID NO: 1146237 - RNA, 16 nt, Homo sapiens
uccuaaguagcugggu

SEQ ID NO: 1146238 - RNA, 18 nt, Homo sapiens
uccuaaucagccucgcuc

SEQ ID NO: 1146239 - RNA, 13 nt, Homo sapiens
uccuaaucaucca

SEQ ID NO: 1146240 - RNA, 18 nt, Homo sapiens
uccuagccacccaccaca

SEQ ID NO: 1146241 - RNA, 16 nt, Homo sapiens
uccuauaguacuuuau

SEQ ID NO: 1146242 - RNA, 20 nt, Homo sapiens
uccuauuucuggaauggaaa

SEQ ID NO: 1146243 - RNA, 14 nt, Homo sapiens
uccucaacugggaa

SEQ ID NO: 1146244 - RNA, 21 nt, Homo sapiens
uccucaagaagaaaguguuca

SEQ ID NO: 1146245 - RNA, 20 nt, Homo sapiens
uccucaagaucauucagugu

SEQ ID NO: 1146246 - RNA, 21 nt, Homo sapiens
uccucacuagaacucauccga

SEQ ID NO: 1146247 - RNA, 13 nt, Homo sapiens
uccucacugcuga

SEQ ID NO: 1146248 - RNA, 24 nt, Homo sapiens
uccucagggacagagacaccugca

SEQ ID NO: 1146249 - RNA, 18 nt, Homo sapiens
uccucagguaacagucgu

SEQ ID NO: 1146250 - RNA, 17 nt, Homo sapiens
uccucaggugaccaaaa

SEQ ID NO: 1146251 - RNA, 14 nt, Homo sapiens
uccucaguccacug

SEQ ID NO: 1146252 - RNA, 19 nt, Homo sapiens
uccucaguucucaaaugug

SEQ ID NO: 1146253 - RNA, 17 nt, Homo sapiens
uccucauaaacauuuga

SEQ ID NO: 1146254 - RNA, 16 nt, Homo sapiens
uccuccacacaaggga

SEQ ID NO: 1146255 - RNA, 18 nt, Homo sapiens
uccuccagaauggagcug

SEQ ID NO: 1146256 - RNA, 13 nt, Homo sapiens
uccuccaggguga

SEQ ID NO: 1146257 - RNA, 14 nt, Homo sapiens
uccuccaugggaga

SEQ ID NO: 1146258 - RNA, 15 nt, Homo sapiens
uccucccuccagaua

SEQ ID NO: 1146259 - RNA, 15 nt, Homo sapiens
uccucccugcaucug

SEQ ID NO: 1146260 - RNA, 14 nt, Homo sapiens
uccuccguggcaca

SEQ ID NO: 1146261 - RNA, 15 nt, Homo sapiens
uccuccguggcacau

SEQ ID NO: 1146262 - RNA, 18 nt, Homo sapiens
uccuccugauccugacac

SEQ ID NO: 1146263 - RNA, 19 nt, Homo sapiens
uccucggcccaucugucca

SEQ ID NO: 1146264 - RNA, 14 nt, Homo sapiens
uccucucucagggg

SEQ ID NO: 1146265 - RNA, 13 nt, Homo sapiens
uccucucugcaaa

SEQ ID NO: 1146266 - RNA, 21 nt, Homo sapiens
uccucucugugucccugcugc

SEQ ID NO: 1146267 - RNA, 16 nt, Homo sapiens
uccucugugaccaaug

SEQ ID NO: 1146268 - RNA, 18 nt, Homo sapiens
uccucuuaauguuuccaa

SEQ ID NO: 1146269 - RNA, 23 nt, Homo sapiens
uccucuuucaaagguagccauca

SEQ ID NO: 1146270 - RNA, 14 nt, Homo sapiens
uccucuuugugaua

SEQ ID NO: 1146271 - RNA, 14 nt, Homo sapiens
uccucuuuuuuaug

SEQ ID NO: 1146272 - RNA, 14 nt, Homo sapiens
uccugaagcugcug

SEQ ID NO: 1146273 - RNA, 17 nt, Homo sapiens
uccugaagcugcuggag

SEQ ID NO: 1146274 - RNA, 16 nt, Homo sapiens
uccugaaggucugggu

SEQ ID NO: 1146275 - RNA, 14 nt, Homo sapiens
uccugacacauucu

SEQ ID NO: 1146276 - RNA, 13 nt, Homo sapiens
uccugaccucagg

SEQ ID NO: 1146277 - RNA, 16 nt, Homo sapiens
uccugaccugagccag

SEQ ID NO: 1146278 - RNA, 21 nt, Homo sapiens
uccugagaaagcccaccuggg

SEQ ID NO: 1146279 - RNA, 23 nt, Homo sapiens
uccugaggcuuuggauuugacau

SEQ ID NO: 1146280 - RNA, 20 nt, Homo sapiens
uccugagggauuucuaacca

SEQ ID NO: 1146281 - RNA, 19 nt, Homo sapiens
uccugaguagcuggauuac

SEQ ID NO: 1146282 - RNA, 15 nt, Homo sapiens
uccugaguuagauuu

SEQ ID NO: 1146283 - RNA, 14 nt, Homo sapiens
uccugaguucaagc

SEQ ID NO: 1146284 - RNA, 23 nt, Homo sapiens
uccugauacuuucuguucuccag

SEQ ID NO: 1146285 - RNA, 14 nt, Homo sapiens
uccugcaaaauccu

SEQ ID NO: 1146286 - RNA, 16 nt, Homo sapiens
uccugcauguguauau

SEQ ID NO: 1146287 - RNA, 20 nt, Homo sapiens
uccuggaagcagagcaaaau

SEQ ID NO: 1146288 - RNA, 15 nt, Homo sapiens
uccuggcccagguga

SEQ ID NO: 1146289 - RNA, 16 nt, Homo sapiens
uccuggcccaggugag

SEQ ID NO: 1146290 - RNA, 22 nt, Homo sapiens
uccugggccucagcaagccaug

SEQ ID NO: 1146291 - RNA, 21 nt, Homo sapiens
uccuggggaggauacugaggc

SEQ ID NO: 1146292 - RNA, 14 nt, Homo sapiens
uccuggugugaagg

SEQ ID NO: 1146293 - RNA, 23 nt, Homo sapiens
uccuggugugaagguccugcuau

SEQ ID NO: 1146294 - RNA, 17 nt, Homo sapiens
uccugguucagugccac

SEQ ID NO: 1146295 - RNA, 18 nt, Homo sapiens
uccugguucagugccacg

SEQ ID NO: 1146296 - RNA, 20 nt, Homo sapiens
uccuguccaaccuaaccccu

SEQ ID NO: 1146297 - RNA, 15 nt, Homo sapiens
uccugugaacacugg

SEQ ID NO: 1146298 - RNA, 19 nt, Homo sapiens
uccugugagguuucccaau

SEQ ID NO: 1146299 - RNA, 15 nt, Homo sapiens
uccuguggucucuga

SEQ ID NO: 1146300 - RNA, 20 nt, Homo sapiens
uccuguggucucugaccagg

SEQ ID NO: 1146301 - RNA, 16 nt, Homo sapiens
uccuguucuauaacag

SEQ ID NO: 1146302 - RNA, 20 nt, Homo sapiens
uccuguuggauaucauacuu

SEQ ID NO: 1146303 - RNA, 14 nt, Homo sapiens
uccuguuguaaucu

SEQ ID NO: 1146304 - RNA, 20 nt, Homo sapiens
uccuguuuuaagcagcucua

SEQ ID NO: 1146305 - RNA, 21 nt, Homo sapiens
uccuuaaaaaucacacuguaa

SEQ ID NO: 1146306 - RNA, 20 nt, Homo sapiens
uccuuaaauaugugaaagga

SEQ ID NO: 1146307 - RNA, 18 nt, Homo sapiens
uccuuaaugucaccaugc

SEQ ID NO: 1146308 - RNA, 20 nt, Homo sapiens
uccuuacugaagccaggcac

SEQ ID NO: 1146309 - RNA, 14 nt, Homo sapiens
uccuucaauuccau

SEQ ID NO: 1146310 - RNA, 17 nt, Homo sapiens
uccuucaccucacugaa

SEQ ID NO: 1146311 - RNA, 16 nt, Homo sapiens
uccuuccauuggcaga

SEQ ID NO: 1146312 - RNA, 22 nt, Homo sapiens
uccuucccucggggccauacuu

SEQ ID NO: 1146313 - RNA, 23 nt, Homo sapiens
uccuucccucggggccauacuuc

SEQ ID NO: 1146314 - RNA, 15 nt, Homo sapiens
uccuuccucuuggcu

SEQ ID NO: 1146315 - RNA, 21 nt, Homo sapiens
uccuuccuuguuacccaugaa

SEQ ID NO: 1146316 - RNA, 12 nt, Homo sapiens
uccuucugauga

SEQ ID NO: 1146317 - RNA, 12 nt, Homo sapiens
uccuucugugaa

SEQ ID NO: 1146318 - RNA, 20 nt, Homo sapiens
uccuucuuucuaguucagcu

SEQ ID NO: 1146319 - RNA, 15 nt, Homo sapiens
uccuugacuccuuug

SEQ ID NO: 1146320 - RNA, 14 nt, Homo sapiens
uccuugcaccugca

SEQ ID NO: 1146321 - RNA, 20 nt, Homo sapiens
uccuuuaaauccuuccauga

SEQ ID NO: 1146322 - RNA, 14 nt, Homo sapiens
uccuuuaccagaug

SEQ ID NO: 1146323 - RNA, 15 nt, Homo sapiens
uccuuuacuaaucca

SEQ ID NO: 1146324 - RNA, 16 nt, Homo sapiens
uccuuuauaaguugcu

SEQ ID NO: 1146325 - RNA, 16 nt, Homo sapiens
uccuuuccugugugaa

SEQ ID NO: 1146326 - RNA, 14 nt, Homo sapiens
uccuuucuuccuug

SEQ ID NO: 1146327 - RNA, 13 nt, Homo sapiens
uccuuugauauua

SEQ ID NO: 1146328 - RNA, 21 nt, Homo sapiens
uccuuugcgcaaacuuuaaca

SEQ ID NO: 1146329 - RNA, 14 nt, Homo sapiens
uccuuuucugucuc

SEQ ID NO: 1146330 - RNA, 16 nt, Homo sapiens
ucgacaugcugccagg

SEQ ID NO: 1146331 - RNA, 14 nt, Homo sapiens
ucgacccugugcag

SEQ ID NO: 1146332 - RNA, 17 nt, Homo sapiens
ucgacuuccccggccac

SEQ ID NO: 1146333 - RNA, 20 nt, Homo sapiens
ucgagaauguauggauuuac

SEQ ID NO: 1146334 - RNA, 16 nt, Homo sapiens
ucgagaccaaccugac

SEQ ID NO: 1146335 - RNA, 20 nt, Homo sapiens
ucgagauggcagauucccac

SEQ ID NO: 1146336 - RNA, 21 nt, Homo sapiens
ucgagcauguuguuuuuucau

SEQ ID NO: 1146337 - RNA, 17 nt, Homo sapiens
ucgaguuuuaaacuggu

SEQ ID NO: 1146338 - RNA, 23 nt, Homo sapiens
ucgaugauucaggugcagaggaa

SEQ ID NO: 1146339 - RNA, 14 nt, Homo sapiens
ucgauuagacugga

SEQ ID NO: 1146340 - RNA, 13 nt, Homo sapiens
ucgcaauuacuug

SEQ ID NO: 1146341 - RNA, 17 nt, Homo sapiens
ucgcaccacugcacucc

SEQ ID NO: 1146342 - RNA, 19 nt, Homo sapiens
ucgcauggcagaaaggggg

SEQ ID NO: 1146343 - RNA, 15 nt, Homo sapiens
ucgccacaaacucua

SEQ ID NO: 1146344 - RNA, 21 nt, Homo sapiens
ucgcggcucuccagggcuccc

SEQ ID NO: 1146345 - RNA, 19 nt, Homo sapiens
ucgcgucucauuuugucca

SEQ ID NO: 1146346 - RNA, 16 nt, Homo sapiens
ucgcucagucuguuca

SEQ ID NO: 1146347 - RNA, 14 nt, Homo sapiens
ucgcuugccaaagc

SEQ ID NO: 1146348 - RNA, 23 nt, Homo sapiens
ucggacaagacccccagcacuug

SEQ ID NO: 1146349 - RNA, 14 nt, Homo sapiens
ugaaaggcuuuuaa

SEQ ID NO: 1146350 - RNA, 15 nt, Homo sapiens
ugaaaggugacaaaa

SEQ ID NO: 1146351 - RNA, 23 nt, Homo sapiens
ugaaagguuggccuuacuguuga

SEQ ID NO: 1146352 - RNA, 24 nt, Homo sapiens
ugaaagguuggccuuacuguugaa

SEQ ID NO: 1146353 - RNA, 13 nt, Homo sapiens
ugaaaguggacaa

SEQ ID NO: 1146354 - RNA, 20 nt, Homo sapiens
ugaaauaaaauuacacagua

SEQ ID NO: 1146355 - RNA, 19 nt, Homo sapiens
ugaaauaguuacuauuuca

SEQ ID NO: 1146356 - RNA, 14 nt, Homo sapiens
ugaaauaugugaag

SEQ ID NO: 1146357 - RNA, 14 nt, Homo sapiens
ugaaaugaacuuug

SEQ ID NO: 1146358 - RNA, 14 nt, Homo sapiens
ugaaaugaggagaa

SEQ ID NO: 1146359 - RNA, 23 nt, Homo sapiens
ugaaauguaugugcucuuagcaa

SEQ ID NO: 1146360 - RNA, 13 nt, Homo sapiens
ugaaauucuucaa

SEQ ID NO: 1146361 - RNA, 15 nt, Homo sapiens
ugaccagacugcaca

SEQ ID NO: 1146362 - RNA, 16 nt, Homo sapiens
ugaccauaaccacuga

SEQ ID NO: 1146363 - RNA, 20 nt, Homo sapiens
ugaccauaucacaagugauu

SEQ ID NO: 1146364 - RNA, 23 nt, Homo sapiens
ugaccaugagguggggguuuugg

SEQ ID NO: 1146365 - RNA, 12 nt, Homo sapiens
ugaccaugugau

SEQ ID NO: 1146366 - RNA, 15 nt, Homo sapiens
ugacccaaugauuca

SEQ ID NO: 1146367 - RNA, 23 nt, Homo sapiens
ugacccagaggguggguguucau

SEQ ID NO: 1146368 - RNA, 15 nt, Homo sapiens
ugacccauaggcuca

SEQ ID NO: 1146369 - RNA, 14 nt, Homo sapiens
ugacccccagcucc

SEQ ID NO: 1146370 - RNA, 14 nt, Homo sapiens
ugauucgaaugaca

SEQ ID NO: 1146371 - RNA, 23 nt, Homo sapiens
ugauucgucugcgauuuuaucug

SEQ ID NO: 1146372 - RNA, 19 nt, Homo sapiens
ugauucugauaaugcucac

SEQ ID NO: 1146373 - RNA, 19 nt, Homo sapiens
ugauuguaaaguagcugua

SEQ ID NO: 1146374 - RNA, 17 nt, Homo sapiens
ugauuucuguacaguca

SEQ ID NO: 1146375 - RNA, 16 nt, Homo sapiens
ugauuuggugaccaac

SEQ ID NO: 1146376 - RNA, 15 nt, Homo sapiens
ugauuuuuaucucca

SEQ ID NO: 1146377 - RNA, 15 nt, Homo sapiens
ugcaaaacauuucau

SEQ ID NO: 1146378 - RNA, 22 nt, Homo sapiens
ugcaaaagcaggcuugugcuuu

SEQ ID NO: 1146379 - RNA, 21 nt, Homo sapiens
ugcaaaaugucuuguguauuu

SEQ ID NO: 1146380 - RNA, 12 nt, Homo sapiens
ugcaaacagugu

SEQ ID NO: 1146381 - RNA, 16 nt, Homo sapiens
ugcaaacccuuucaua

SEQ ID NO: 1146382 - RNA, 14 nt, Homo sapiens
ugcaaauaccuccu

SEQ ID NO: 1146383 - RNA, 20 nt, Homo sapiens
ugcaaauagcaaaacuaaau

SEQ ID NO: 1146384 - RNA, 14 nt, Homo sapiens
ugcaaauauuugau

SEQ ID NO: 1146385 - RNA, 16 nt, Homo sapiens
ugcaaaucacucugca

SEQ ID NO: 1146386 - RNA, 22 nt, Homo sapiens
ugcaaaucacucugcaauggaa

SEQ ID NO: 1146387 - RNA, 17 nt, Homo sapiens
ugcaaauccuaugugau

SEQ ID NO: 1146388 - RNA, 18 nt, Homo sapiens
ugcaaauccuaugugauu

SEQ ID NO: 1146389 - RNA, 23 nt, Homo sapiens
ugcaaccaguuugcccauucucu

SEQ ID NO: 1146390 - RNA, 16 nt, Homo sapiens
ugcaaccauaagacaa

SEQ ID NO: 1146391 - RNA, 14 nt, Homo sapiens
ugcaaccucugccu

SEQ ID NO: 1146392 - RNA, 21 nt, Homo sapiens
ugcaacuaggaagagacacac

SEQ ID NO: 1146393 - RNA, 12 nt, Homo sapiens
ugcaacuggaga

SEQ ID NO: 1146394 - RNA, 14 nt, Homo sapiens
ugcaacuucugccu

SEQ ID NO: 1146395 - RNA, 18 nt, Homo sapiens
ugcaagcgucugugcauu

SEQ ID NO: 1146396 - RNA, 21 nt, Homo sapiens
ugcaagguuccacagaguaag

SEQ ID NO: 1146397 - RNA, 16 nt, Homo sapiens
ugcaagugacaucucu

SEQ ID NO: 1146398 - RNA, 15 nt, Homo sapiens
ugcaauaaugcagua

SEQ ID NO: 1146399 - RNA, 20 nt, Homo sapiens
ugcaauacacaguguuauuc

SEQ ID NO: 1146400 - RNA, 14 nt, Homo sapiens
ugcaauacugcuua

SEQ ID NO: 1146401 - RNA, 19 nt, Homo sapiens
ugcaauaucugaagcccuc

SEQ ID NO: 1146402 - RNA, 22 nt, Homo sapiens
ugcaauccaaauccagccuuug

SEQ ID NO: 1146403 - RNA, 15 nt, Homo sapiens
ugcaaucuucuacuu

SEQ ID NO: 1146404 - RNA, 19 nt, Homo sapiens
ugcaaucuucuacuuuaag

SEQ ID NO: 1146405 - RNA, 16 nt, Homo sapiens
ugcaaugacacagucu

SEQ ID NO: 1146406 - RNA, 12 nt, Homo sapiens
ugcaaugagcca

SEQ ID NO: 1146407 - RNA, 23 nt, Homo sapiens
ugcaaugggauguaugaauacag

SEQ ID NO: 1146408 - RNA, 16 nt, Homo sapiens
ugcaauguaagcauac

SEQ ID NO: 1146409 - RNA, 15 nt, Homo sapiens
ugcaauucuuuuugg

SEQ ID NO: 1146410 - RNA, 19 nt, Homo sapiens
ugcaauuggaauaaucacu

SEQ ID NO: 1146411 - RNA, 22 nt, Homo sapiens
ugcacacagggugguggcacau

SEQ ID NO: 1146412 - RNA, 14 nt, Homo sapiens
ugcacacaucacca

SEQ ID NO: 1146413 - RNA, 14 nt, Homo sapiens
ugcacacauuucug

SEQ ID NO: 1146414 - RNA, 18 nt, Homo sapiens
ugcacacccacucagcuc

SEQ ID NO: 1146415 - RNA, 16 nt, Homo sapiens
ugcacagggcaauuga

SEQ ID NO: 1146416 - RNA, 19 nt, Homo sapiens
ugcacaggucccacugccc

SEQ ID NO: 1146417 - RNA, 23 nt, Homo sapiens
ugcacauuaaggagaaaucuaua

SEQ ID NO: 1146418 - RNA, 12 nt, Homo sapiens
ugcaccaaauag

SEQ ID NO: 1146419 - RNA, 17 nt, Homo sapiens
ugcaccaccacacccgg

SEQ ID NO: 1146420 - RNA, 14 nt, Homo sapiens
ugcaccaccaugcc

SEQ ID NO: 1146421 - RNA, 14 nt, Homo sapiens
ugcaccacugcacu

SEQ ID NO: 1146422 - RNA, 13 nt, Homo sapiens
ugcaccuacccau

SEQ ID NO: 1146423 - RNA, 16 nt, Homo sapiens
ugcacuaugagccuau

SEQ ID NO: 1146424 - RNA, 18 nt, Homo sapiens
ugcacucagcucuuggcu

SEQ ID NO: 1146425 - RNA, 16 nt, Homo sapiens
ugcacuccagccuggg

SEQ ID NO: 1146426 - RNA, 16 nt, Homo sapiens
ugcacugaaguuuuug

SEQ ID NO: 1146427 - RNA, 23 nt, Homo sapiens
ugcacuguagccuuagugucacc

SEQ ID NO: 1146428 - RNA, 15 nt, Homo sapiens
ugcacugugaaggac

SEQ ID NO: 1146429 - RNA, 15 nt, Homo sapiens
ugcacuuauucucaa

SEQ ID NO: 1146430 - RNA, 15 nt, Homo sapiens
ugcagaaauacagua

SEQ ID NO: 1146431 - RNA, 24 nt, Homo sapiens
ugcagaagcgcuccaguaucucca

SEQ ID NO: 1146432 - RNA, 23 nt, Homo sapiens
ugcagaaucucuauguauauucu

SEQ ID NO: 1146433 - RNA, 17 nt, Homo sapiens
ugcagacaaacaaacau

SEQ ID NO: 1146434 - RNA, 17 nt, Homo sapiens
ugcagagagacaacaga

SEQ ID NO: 1146435 - RNA, 23 nt, Homo sapiens
ugcagauaaacagaaaugcucug

SEQ ID NO: 1146436 - RNA, 18 nt, Homo sapiens
ugcagauagaaagcauua

SEQ ID NO: 1146437 - RNA, 21 nt, Homo sapiens
ugcagaugaucagggauccaa

SEQ ID NO: 1146438 - RNA, 21 nt, Homo sapiens
ugcagcaccgaggggccuuug

SEQ ID NO: 1146439 - RNA, 18 nt, Homo sapiens
ugcagcagggaugcccug

SEQ ID NO: 1146440 - RNA, 11 nt, Homo sapiens
ugcagccaggc

SEQ ID NO: 1146441 - RNA, 16 nt, Homo sapiens
ugcagccucaaccucc

SEQ ID NO: 1146442 - RNA, 21 nt, Homo sapiens
ugcagcuaacaugaguaucau

SEQ ID NO: 1146443 - RNA, 13 nt, Homo sapiens
ugcagcuaucugg

SEQ ID NO: 1146444 - RNA, 14 nt, Homo sapiens
ugcagcucagggac

SEQ ID NO: 1146445 - RNA, 20 nt, Homo sapiens
ugcagcuggaaaagggucuu

SEQ ID NO: 1146446 - RNA, 17 nt, Homo sapiens
ugcagcuguacugagga

SEQ ID NO: 1146447 - RNA, 20 nt, Homo sapiens
ugcaggagcuaguucucagc

SEQ ID NO: 1146448 - RNA, 19 nt, Homo sapiens
ugcagggcacagaugacca

SEQ ID NO: 1146449 - RNA, 22 nt, Homo sapiens
ugcagguuuagaggaccaguga

SEQ ID NO: 1146450 - RNA, 15 nt, Homo sapiens
ugcaguagccguuug

SEQ ID NO: 1146451 - RNA, 17 nt, Homo sapiens
ugcaguaugguacauuu

SEQ ID NO: 1146452 - RNA, 18 nt, Homo sapiens
ugcagucaucaacaauga

SEQ ID NO: 1146453 - RNA, 18 nt, Homo sapiens
ugcagucaucuugaccaa

SEQ ID NO: 1146454 - RNA, 22 nt, Homo sapiens
ugcagugaaguguucugcugag

SEQ ID NO: 1146455 - RNA, 16 nt, Homo sapiens
ugcagugagugcugcu

SEQ ID NO: 1146456 - RNA, 17 nt, Homo sapiens
ugcaguggugugaucuc

SEQ ID NO: 1146457 - RNA, 21 nt, Homo sapiens
ugcaguguucuacaccuugcu

SEQ ID NO: 1146458 - RNA, 15 nt, Homo sapiens
ugcaguuucuaagca

SEQ ID NO: 1146459 - RNA, 14 nt, Homo sapiens
ugcaguuugaaauu

SEQ ID NO: 1146460 - RNA, 22 nt, Homo sapiens
ugcauaacagcaggguaccuga

SEQ ID NO: 1146461 - RNA, 14 nt, Homo sapiens
ugcauaagcuuuuu

SEQ ID NO: 1146462 - RNA, 22 nt, Homo sapiens
ugcauaagugaaaaucuuacaa

SEQ ID NO: 1146463 - RNA, 12 nt, Homo sapiens
ugcauauucaac

SEQ ID NO: 1146464 - RNA, 15 nt, Homo sapiens
ugcauauuuagcuuu

SEQ ID NO: 1146465 - RNA, 15 nt, Homo sapiens
ugcaucugaccagca

SEQ ID NO: 1146466 - RNA, 16 nt, Homo sapiens
ugcaucugaccagcag

SEQ ID NO: 1146467 - RNA, 14 nt, Homo sapiens
ugcaucuucccaca

SEQ ID NO: 1146468 - RNA, 19 nt, Homo sapiens
ugcaugaaagcacaaggua

SEQ ID NO: 1146469 - RNA, 19 nt, Homo sapiens
ugcaugauccagcugugug

SEQ ID NO: 1146470 - RNA, 19 nt, Homo sapiens
ugcaugcgccuacucgcuu

SEQ ID NO: 1146471 - RNA, 16 nt, Homo sapiens
ugcauggaguguuuga

SEQ ID NO: 1146472 - RNA, 15 nt, Homo sapiens
ugcaugucuaauuca

SEQ ID NO: 1146473 - RNA, 18 nt, Homo sapiens
ugcauucaugguuaugaa

SEQ ID NO: 1146474 - RNA, 13 nt, Homo sapiens
ugcauugagcucu

SEQ ID NO: 1146475 - RNA, 16 nt, Homo sapiens
ugcauugucugcaaug

SEQ ID NO: 1146476 - RNA, 23 nt, Homo sapiens
ugcauuuaaauacagucuuccau

SEQ ID NO: 1146477 - RNA, 16 nt, Homo sapiens
ugcauuucacaugccu

SEQ ID NO: 1146478 - RNA, 19 nt, Homo sapiens
ugcauuucuggaccuugag

SEQ ID NO: 1146479 - RNA, 13 nt, Homo sapiens
ugcauuuguuacu

SEQ ID NO: 1146480 - RNA, 14 nt, Homo sapiens
ugcauuuuacuaaa

SEQ ID NO: 1146481 - RNA, 16 nt, Homo sapiens
ugcauuuuguguacag

SEQ ID NO: 1146482 - RNA, 18 nt, Homo sapiens
ugcauuuuguguacagua

SEQ ID NO: 1146483 - RNA, 19 nt, Homo sapiens
ugccaaaaaggauacauaa

SEQ ID NO: 1146484 - RNA, 14 nt, Homo sapiens
ugccaaaaugcucu

SEQ ID NO: 1146485 - RNA, 16 nt, Homo sapiens
ugccaaccagcuuccc

SEQ ID NO: 1146486 - RNA, 20 nt, Homo sapiens
ugccaagccauacuuauuaa

SEQ ID NO: 1146487 - RNA, 14 nt, Homo sapiens
ugccacccacaucu

SEQ ID NO: 1146488 - RNA, 18 nt, Homo sapiens
ugccacccauuccaucuc

SEQ ID NO: 1146489 - RNA, 20 nt, Homo sapiens
ugccacccugccccuugcca

SEQ ID NO: 1146490 - RNA, 21 nt, Homo sapiens
ugccacccugccccuugccau

SEQ ID NO: 1146491 - RNA, 15 nt, Homo sapiens
ugccacuggggaaaa

SEQ ID NO: 1146492 - RNA, 19 nt, Homo sapiens
ugccacuggggaaaacucc

SEQ ID NO: 1146493 - RNA, 17 nt, Homo sapiens
ugccacuucaccaagga

SEQ ID NO: 1146494 - RNA, 15 nt, Homo sapiens
ugccagaacccaaau

SEQ ID NO: 1146495 - RNA, 20 nt, Homo sapiens
ugccagaugcugauguucag

SEQ ID NO: 1146496 - RNA, 21 nt, Homo sapiens
ugccagcauuuagacccugca

SEQ ID NO: 1146497 - RNA, 14 nt, Homo sapiens
ugccagcauuuccc

SEQ ID NO: 1146498 - RNA, 14 nt, Homo sapiens
ugccagccauucuu

SEQ ID NO: 1146499 - RNA, 24 nt, Homo sapiens
ugccaggcccccaccacacauccc

SEQ ID NO: 1146500 - RNA, 21 nt, Homo sapiens
ugccaggccugggaccuccca

SEQ ID NO: 1146501 - RNA, 20 nt, Homo sapiens
ugccagguucuauuuggaau

SEQ ID NO: 1146502 - RNA, 20 nt, Homo sapiens
ugccagugauaagagcagug

SEQ ID NO: 1146503 - RNA, 18 nt, Homo sapiens
ugccauacuuuccuguau

SEQ ID NO: 1146504 - RNA, 15 nt, Homo sapiens
acucucuugauuaag

SEQ ID NO: 1146505 - RNA, 16 nt, Homo sapiens
acucugauagaauuau

SEQ ID NO: 1146506 - RNA, 12 nt, Homo sapiens
acucugcacaug

SEQ ID NO: 1146507 - RNA, 14 nt, Homo sapiens
acucugcacaugaa

SEQ ID NO: 1146508 - RNA, 22 nt, Homo sapiens
acucugcucgccuuagcacuac

SEQ ID NO: 1146509 - RNA, 21 nt, Homo sapiens
acucugggguuuuuacuguua

SEQ ID NO: 1146510 - RNA, 17 nt, Homo sapiens
acucugugaucuugcuc

SEQ ID NO: 1146511 - RNA, 21 nt, Homo sapiens
acucuuagauggauucuccac

SEQ ID NO: 1146512 - RNA, 20 nt, Homo sapiens
acucuuagcuaaaucccucc

SEQ ID NO: 1146513 - RNA, 15 nt, Homo sapiens
acucuuaucugggug

SEQ ID NO: 1146514 - RNA, 21 nt, Homo sapiens
acucuuaucugggugccuuaa

SEQ ID NO: 1146515 - RNA, 18 nt, Homo sapiens
acucuuccauucaguuuu

SEQ ID NO: 1146516 - RNA, 16 nt, Homo sapiens
acucuucuuugcugca

SEQ ID NO: 1146517 - RNA, 22 nt, Homo sapiens
acucuugaacuucuuacuggaa

SEQ ID NO: 1146518 - RNA, 19 nt, Homo sapiens
acucuugaauagacuucca

SEQ ID NO: 1146519 - RNA, 14 nt, Homo sapiens
acugaaacauuuaa

SEQ ID NO: 1146520 - RNA, 15 nt, Homo sapiens
acugaaacuuaccug

SEQ ID NO: 1146521 - RNA, 21 nt, Homo sapiens
acugaaauuacggguaccuga

SEQ ID NO: 1146522 - RNA, 16 nt, Homo sapiens
acugaaucuaccugcc

SEQ ID NO: 1146523 - RNA, 23 nt, Homo sapiens
acugaaugagaaccaacaaguaa

SEQ ID NO: 1146524 - RNA, 20 nt, Homo sapiens
acugacaugauuagcagaag

SEQ ID NO: 1146525 - RNA, 17 nt, Homo sapiens
acugacucaacauggag

SEQ ID NO: 1146526 - RNA, 14 nt, Homo sapiens
acugagaaagccaa

SEQ ID NO: 1146527 - RNA, 16 nt, Homo sapiens
acugagaaugauagua

SEQ ID NO: 1146528 - RNA, 21 nt, Homo sapiens
acugagaguugcuuccagucc

SEQ ID NO: 1146529 - RNA, 15 nt, Homo sapiens
acugagcaguauuag

SEQ ID NO: 1146530 - RNA, 17 nt, Homo sapiens
acugagcucugccucaa

SEQ ID NO: 1146531 - RNA, 23 nt, Homo sapiens
acugaggaugauguuauucacag

SEQ ID NO: 1146532 - RNA, 15 nt, Homo sapiens
acugaggcauccacu

SEQ ID NO: 1146533 - RNA, 21 nt, Homo sapiens
acugaggccugagacccagga

SEQ ID NO: 1146534 - RNA, 19 nt, Homo sapiens
acugagguugggguguacu

SEQ ID NO: 1146535 - RNA, 22 nt, Homo sapiens
acugaguagcucuccugacuuu

SEQ ID NO: 1146536 - RNA, 16 nt, Homo sapiens
acugagugacucuaua

SEQ ID NO: 1146537 - RNA, 21 nt, Homo sapiens
acugauagaugucuauucuug

SEQ ID NO: 1146538 - RNA, 14 nt, Homo sapiens
acugaucaauuuca

SEQ ID NO: 1146539 - RNA, 23 nt, Homo sapiens
acugaucaauuucaacauggacu

SEQ ID NO: 1146540 - RNA, 17 nt, Homo sapiens
acugaucaggaccucca

SEQ ID NO: 1146541 - RNA, 23 nt, Homo sapiens
acugaucaggaccuccaagccac

SEQ ID NO: 1146542 - RNA, 13 nt, Homo sapiens
acugaucaucugc

SEQ ID NO: 1146543 - RNA, 11 nt, Homo sapiens
acugauccagc

SEQ ID NO: 1146544 - RNA, 20 nt, Homo sapiens
acugaucgugggguugacca

SEQ ID NO: 1146545 - RNA, 18 nt, Homo sapiens
acugaugacaaacccagg

SEQ ID NO: 1146546 - RNA, 19 nt, Homo sapiens
acugaugacaaacccagga

SEQ ID NO: 1146547 - RNA, 19 nt, Homo sapiens
acugauucuguuguguuca

SEQ ID NO: 1146548 - RNA, 18 nt, Homo sapiens
acugauuucaaaucaugu

SEQ ID NO: 1146549 - RNA, 12 nt, Homo sapiens
acugauuugcaa

SEQ ID NO: 1146550 - RNA, 14 nt, Homo sapiens
acugcaaaccgcca

SEQ ID NO: 1146551 - RNA, 19 nt, Homo sapiens
acugcaaagcucggugcuc

SEQ ID NO: 1146552 - RNA, 20 nt, Homo sapiens
acugcaaagcucggugcucc

SEQ ID NO: 1146553 - RNA, 19 nt, Homo sapiens
acugcaaaucugccugaua

SEQ ID NO: 1146554 - RNA, 14 nt, Homo sapiens
acugcaacucauca

SEQ ID NO: 1146555 - RNA, 16 nt, Homo sapiens
acugcaacuucugccu

SEQ ID NO: 1146556 - RNA, 13 nt, Homo sapiens
acugcacacuucc

SEQ ID NO: 1146557 - RNA, 16 nt, Homo sapiens
acugcaccaagucuca

SEQ ID NO: 1146558 - RNA, 17 nt, Homo sapiens
acugcacccaccuacuu

SEQ ID NO: 1146559 - RNA, 17 nt, Homo sapiens
acugcagagagacaaca

SEQ ID NO: 1146560 - RNA, 17 nt, Homo sapiens
acugcaggcgcgcacac

SEQ ID NO: 1146561 - RNA, 21 nt, Homo sapiens
acugcaguaucccaacugcag

SEQ ID NO: 1146562 - RNA, 21 nt, Homo sapiens
acugcagucaucaacaaugau

SEQ ID NO: 1146563 - RNA, 17 nt, Homo sapiens
acugccaaaaugcucua

SEQ ID NO: 1146564 - RNA, 19 nt, Homo sapiens
acugcccauggacaggcug

SEQ ID NO: 1146565 - RNA, 14 nt, Homo sapiens
acugcccccgccac

SEQ ID NO: 1146566 - RNA, 17 nt, Homo sapiens
acugccgucccaaauac

SEQ ID NO: 1146567 - RNA, 15 nt, Homo sapiens
acugccuggauucca

SEQ ID NO: 1146568 - RNA, 17 nt, Homo sapiens
acugccuggauuccauu

SEQ ID NO: 1146569 - RNA, 21 nt, Homo sapiens
acugcgcagccuuacccaguc

SEQ ID NO: 1146570 - RNA, 14 nt, Homo sapiens
acugcuaaaugcac

SEQ ID NO: 1146571 - RNA, 15 nt, Homo sapiens
acugcuaccuuccua

SEQ ID NO: 1146572 - RNA, 15 nt, Homo sapiens
acugcucaaccucac

SEQ ID NO: 1146573 - RNA, 12 nt, Homo sapiens
acugcucuuuua

SEQ ID NO: 1146574 - RNA, 15 nt, Homo sapiens
acugcugaucaauga

SEQ ID NO: 1146575 - RNA, 18 nt, Homo sapiens
acugcugaucaaugaaau

SEQ ID NO: 1146576 - RNA, 14 nt, Homo sapiens
acugcuugaggaaa

SEQ ID NO: 1146577 - RNA, 22 nt, Homo sapiens
acuggaagaagagccccuccuu

SEQ ID NO: 1146578 - RNA, 20 nt, Homo sapiens
acuggaggggucauccuugc

SEQ ID NO: 1146579 - RNA, 12 nt, Homo sapiens
acuggaugcauc

SEQ ID NO: 1146580 - RNA, 13 nt, Homo sapiens
acuggaugggaga

SEQ ID NO: 1146581 - RNA, 19 nt, Homo sapiens
acuggcacacuggccucca

SEQ ID NO: 1146582 - RNA, 16 nt, Homo sapiens
acuggcaguuuuccau

SEQ ID NO: 1146583 - RNA, 12 nt, Homo sapiens
acuggccuccag

SEQ ID NO: 1146584 - RNA, 20 nt, Homo sapiens
acuggcuccucugugguguc

SEQ ID NO: 1146585 - RNA, 14 nt, Homo sapiens
acugggcucaagag

SEQ ID NO: 1146586 - RNA, 14 nt, Homo sapiens
acugguaguguuca

SEQ ID NO: 1146587 - RNA, 13 nt, Homo sapiens
acuggucugggaa

SEQ ID NO: 1146588 - RNA, 14 nt, Homo sapiens
acuggucugggaag

SEQ ID NO: 1146589 - RNA, 19 nt, Homo sapiens
acugguuauccugugcuac

SEQ ID NO: 1146590 - RNA, 19 nt, Homo sapiens
acugguuauggaaggugac

SEQ ID NO: 1146591 - RNA, 15 nt, Homo sapiens
acugguucaccugaa

SEQ ID NO: 1146592 - RNA, 13 nt, Homo sapiens
acugguucucaau

SEQ ID NO: 1146593 - RNA, 20 nt, Homo sapiens
acuguaaaggcaagccagca

SEQ ID NO: 1146594 - RNA, 22 nt, Homo sapiens
acuguaaauaugaaucugcuca

SEQ ID NO: 1146595 - RNA, 16 nt, Homo sapiens
acuguacaaaauaagu

SEQ ID NO: 1146596 - RNA, 21 nt, Homo sapiens
acuguagcaaccugaaauuaa

SEQ ID NO: 1146597 - RNA, 22 nt, Homo sapiens
acuguagcccuggaccugccuc

SEQ ID NO: 1146598 - RNA, 23 nt, Homo sapiens
acuguagguauagaagaucugcc

SEQ ID NO: 1146599 - RNA, 15 nt, Homo sapiens
acuguauacauuaca

SEQ ID NO: 1146600 - RNA, 16 nt, Homo sapiens
acuguauacauuacaa

SEQ ID NO: 1146601 - RNA, 18 nt, Homo sapiens
acuguaugugggaauuua

SEQ ID NO: 1146602 - RNA, 16 nt, Homo sapiens
acuguauucgugcauu

SEQ ID NO: 1146603 - RNA, 17 nt, Homo sapiens
acugucaaguguuuuac

SEQ ID NO: 1146604 - RNA, 19 nt, Homo sapiens
acugucucucuugucacau

SEQ ID NO: 1146605 - RNA, 15 nt, Homo sapiens
acugucugacuuaua

SEQ ID NO: 1146606 - RNA, 17 nt, Homo sapiens
acugucugucuggcuac

SEQ ID NO: 1146607 - RNA, 22 nt, Homo sapiens
acugugaaccaacccccaucuc

SEQ ID NO: 1146608 - RNA, 18 nt, Homo sapiens
acugugaaguuacaugca

SEQ ID NO: 1146609 - RNA, 14 nt, Homo sapiens
acugugacaaugac

SEQ ID NO: 1146610 - RNA, 16 nt, Homo sapiens
acugugccagcacaaa

SEQ ID NO: 1146611 - RNA, 23 nt, Homo sapiens
acugugccuuguuucaacaguuu

SEQ ID NO: 1146612 - RNA, 15 nt, Homo sapiens
acugugcuacugaaa

SEQ ID NO: 1146613 - RNA, 11 nt, Homo sapiens
acuguggcaaa

SEQ ID NO: 1146614 - RNA, 17 nt, Homo sapiens
acuguggcacuugccug

SEQ ID NO: 1146615 - RNA, 17 nt, Homo sapiens
acugugggaaggccagc

SEQ ID NO: 1146616 - RNA, 11 nt, Homo sapiens
acuguugauaa

SEQ ID NO: 1146617 - RNA, 19 nt, Homo sapiens
acuguuggcaaggugacau

SEQ ID NO: 1146618 - RNA, 22 nt, Homo sapiens
acuguugguguucggagcucuu

SEQ ID NO: 1146619 - RNA, 19 nt, Homo sapiens
acuguuuauuugcacuaug

SEQ ID NO: 1146620 - RNA, 14 nt, Homo sapiens
acuguuucucucac

SEQ ID NO: 1146621 - RNA, 13 nt, Homo sapiens
acuguuugucuca

SEQ ID NO: 1146622 - RNA, 21 nt, Homo sapiens
acuuaaauaauaaacagugga

SEQ ID NO: 1146623 - RNA, 13 nt, Homo sapiens
acuuaagaaauaa

SEQ ID NO: 1146624 - RNA, 11 nt, Homo sapiens
acuuaaugucu

SEQ ID NO: 1146625 - RNA, 12 nt, Homo sapiens
acuuacacugua

SEQ ID NO: 1146626 - RNA, 13 nt, Homo sapiens
acuuacacuguau

SEQ ID NO: 1146627 - RNA, 16 nt, Homo sapiens
acuuacuaaauaucau

SEQ ID NO: 1146628 - RNA, 20 nt, Homo sapiens
acuuacuauuggucaugcaa

SEQ ID NO: 1146629 - RNA, 16 nt, Homo sapiens
acuuagauacuaauaa

SEQ ID NO: 1146630 - RNA, 19 nt, Homo sapiens
acuuagggcagaagugaau

SEQ ID NO: 1146631 - RNA, 23 nt, Homo sapiens
acuuauaauuugcauaccauuaa

SEQ ID NO: 1146632 - RNA, 22 nt, Homo sapiens
acuuauauggaaauucugcuca

SEQ ID NO: 1146633 - RNA, 20 nt, Homo sapiens
acuuaucucuaaaccaucua

SEQ ID NO: 1146634 - RNA, 17 nt, Homo sapiens
acuuaugaaacuugaaa

SEQ ID NO: 1146635 - RNA, 17 nt, Homo sapiens
acuuauggaacagggau

SEQ ID NO: 1146636 - RNA, 17 nt, Homo sapiens
acuuauguguuuugcua

SEQ ID NO: 1146637 - RNA, 23 nt, Homo sapiens
agauggcucaacguuuuuggaca

SEQ ID NO: 1146638 - RNA, 14 nt, Homo sapiens
agauggcuuuuccu

SEQ ID NO: 1146639 - RNA, 14 nt, Homo sapiens
agaugguugccaag

SEQ ID NO: 1146640 - RNA, 17 nt, Homo sapiens
agaugguuucuugcaag

SEQ ID NO: 1146641 - RNA, 20 nt, Homo sapiens
agaugguuuucaaaucauuu

SEQ ID NO: 1146642 - RNA, 22 nt, Homo sapiens
agauguaauguuuucuuugcaa

SEQ ID NO: 1146643 - RNA, 21 nt, Homo sapiens
agauguagauaaacucagaaa

SEQ ID NO: 1146644 - RNA, 22 nt, Homo sapiens
agauguauuuguuguagacuua

SEQ ID NO: 1146645 - RNA, 20 nt, Homo sapiens
agaugucaggaaacauucag

SEQ ID NO: 1146646 - RNA, 22 nt, Homo sapiens
agaugucauuuaguucagcauc

SEQ ID NO: 1146647 - RNA, 11 nt, Homo sapiens
agaugucuguu

SEQ ID NO: 1146648 - RNA, 19 nt, Homo sapiens
agauguucccccaucucgc

SEQ ID NO: 1146649 - RNA, 19 nt, Homo sapiens
agauguucuaagucuuucc

SEQ ID NO: 1146650 - RNA, 16 nt, Homo sapiens
agauuauagauucuaa

SEQ ID NO: 1146651 - RNA, 18 nt, Homo sapiens
agauuauauauuauuucu

SEQ ID NO: 1146652 - RNA, 14 nt, Homo sapiens
agauuauguauuaa

SEQ ID NO: 1146653 - RNA, 18 nt, Homo sapiens
agauucaccuaagagauu

SEQ ID NO: 1146654 - RNA, 18 nt, Homo sapiens
agauucagugguucaaua

SEQ ID NO: 1146655 - RNA, 22 nt, Homo sapiens
agauucaguguuacagugcuaa

SEQ ID NO: 1146656 - RNA, 18 nt, Homo sapiens
agauucccacccaauuca

SEQ ID NO: 1146657 - RNA, 21 nt, Homo sapiens
agauuccuguaaaugugacaa

SEQ ID NO: 1146658 - RNA, 16 nt, Homo sapiens
agauucuaaugaugau

SEQ ID NO: 1146659 - RNA, 19 nt, Homo sapiens
agauucuaaugaugaucaa

SEQ ID NO: 1146660 - RNA, 16 nt, Homo sapiens
agauucuauaguucua

SEQ ID NO: 1146661 - RNA, 17 nt, Homo sapiens
agauucucugugucuaa

SEQ ID NO: 1146662 - RNA, 15 nt, Homo sapiens
agauugaacacugcg

SEQ ID NO: 1146663 - RNA, 19 nt, Homo sapiens
agauugaagccuuugccag

SEQ ID NO: 1146664 - RNA, 21 nt, Homo sapiens
agauugagauguaagucucaa

SEQ ID NO: 1146665 - RNA, 16 nt, Homo sapiens
agauugccccacugca

SEQ ID NO: 1146666 - RNA, 19 nt, Homo sapiens
agauugcuggaaaccaagu

SEQ ID NO: 1146667 - RNA, 16 nt, Homo sapiens
agauuggaaagacagg

SEQ ID NO: 1146668 - RNA, 16 nt, Homo sapiens
agauuggguuuugcuu

SEQ ID NO: 1146669 - RNA, 22 nt, Homo sapiens
agauugugauaagaaaagccag

SEQ ID NO: 1146670 - RNA, 22 nt, Homo sapiens
agauuguguucuuccucucuca

SEQ ID NO: 1146671 - RNA, 22 nt, Homo sapiens
agauuuaauccuagagauuugg

SEQ ID NO: 1146672 - RNA, 21 nt, Homo sapiens
agauuuacaucccagacacau

SEQ ID NO: 1146673 - RNA, 16 nt, Homo sapiens
agauuuaucacuuuuu

SEQ ID NO: 1146674 - RNA, 20 nt, Homo sapiens
agauuuugcccuugacaaag

SEQ ID NO: 1146675 - RNA, 14 nt, Homo sapiens
agauuuuuauauca

SEQ ID NO: 1146676 - RNA, 16 nt, Homo sapiens
agcaaaaacauguaug

SEQ ID NO: 1146677 - RNA, 15 nt, Homo sapiens
agcaaaaauguaaaa

SEQ ID NO: 1146678 - RNA, 17 nt, Homo sapiens
agcaaaacuaaauacuu

SEQ ID NO: 1146679 - RNA, 17 nt, Homo sapiens
agcaaaacuccgucuca

SEQ ID NO: 1146680 - RNA, 12 nt, Homo sapiens
agcaaacccaga

SEQ ID NO: 1146681 - RNA, 12 nt, Homo sapiens
agcaaaggcagu

SEQ ID NO: 1146682 - RNA, 15 nt, Homo sapiens
agcaaaucacgacca

SEQ ID NO: 1146683 - RNA, 20 nt, Homo sapiens
agcaaauggcagaaccaaag

SEQ ID NO: 1146684 - RNA, 16 nt, Homo sapiens
agcaaauuuucagcau

SEQ ID NO: 1146685 - RNA, 16 nt, Homo sapiens
agcaacaaccaucuca

SEQ ID NO: 1146686 - RNA, 15 nt, Homo sapiens
agcaaccuacugucu

SEQ ID NO: 1146687 - RNA, 16 nt, Homo sapiens
agcaaccuucuugccu

SEQ ID NO: 1146688 - RNA, 13 nt, Homo sapiens
agcaacguguuaa

SEQ ID NO: 1146689 - RNA, 16 nt, Homo sapiens
agcaacucuugauuau

SEQ ID NO: 1146690 - RNA, 12 nt, Homo sapiens
agcaacuugaac

SEQ ID NO: 1146691 - RNA, 16 nt, Homo sapiens
agcaacuugaacuuca

SEQ ID NO: 1146692 - RNA, 22 nt, Homo sapiens
agcaacuugaacuucaccugca

SEQ ID NO: 1146693 - RNA, 23 nt, Homo sapiens
agcaacuugaacuucaccugcaa

SEQ ID NO: 1146694 - RNA, 22 nt, Homo sapiens
agcaagacagcucuucuugaaa

SEQ ID NO: 1146695 - RNA, 19 nt, Homo sapiens
agcaagcuagaacuggaag

SEQ ID NO: 1146696 - RNA, 21 nt, Homo sapiens
agcaagggggaaggcugcaaa

SEQ ID NO: 1146697 - RNA, 16 nt, Homo sapiens
agcaagucauucagcu

SEQ ID NO: 1146698 - RNA, 24 nt, Homo sapiens
agcaagucucuuuauauggccuca

SEQ ID NO: 1146699 - RNA, 15 nt, Homo sapiens
agcaaugcugugaau

SEQ ID NO: 1146700 - RNA, 22 nt, Homo sapiens
agcaauuuaauauuuugcacag

SEQ ID NO: 1146701 - RNA, 17 nt, Homo sapiens
agcacaagaaacuuugg

SEQ ID NO: 1146702 - RNA, 18 nt, Homo sapiens
agcacaaucuguucuacu

SEQ ID NO: 1146703 - RNA, 19 nt, Homo sapiens
agcacacacaaaauaaauc

SEQ ID NO: 1146704 - RNA, 15 nt, Homo sapiens
agcacagcugcauua

SEQ ID NO: 1146705 - RNA, 17 nt, Homo sapiens
agcacaggaagcugccc

SEQ ID NO: 1146706 - RNA, 21 nt, Homo sapiens
agcacauuuggcuuacaguaa

SEQ ID NO: 1146707 - RNA, 22 nt, Homo sapiens
agcacauuuggcuuacaguaaa

SEQ ID NO: 1146708 - RNA, 15 nt, Homo sapiens
agcacauuuugacac

SEQ ID NO: 1146709 - RNA, 14 nt, Homo sapiens
agcaccauuaacuc

SEQ ID NO: 1146710 - RNA, 18 nt, Homo sapiens
agcaccgccggcuuucag

SEQ ID NO: 1146711 - RNA, 16 nt, Homo sapiens
agcaccgugacaguuu

SEQ ID NO: 1146712 - RNA, 21 nt, Homo sapiens
agcaccguucugugcacaaaa

SEQ ID NO: 1146713 - RNA, 21 nt, Homo sapiens
agcaccugcgggagcugcacu

SEQ ID NO: 1146714 - RNA, 17 nt, Homo sapiens
agcacggccaccucuca

SEQ ID NO: 1146715 - RNA, 20 nt, Homo sapiens
agcacggccaccucucaggg

SEQ ID NO: 1146716 - RNA, 20 nt, Homo sapiens
agcacggugacucuguccag

SEQ ID NO: 1146717 - RNA, 18 nt, Homo sapiens
agcacuaauucaacauau

SEQ ID NO: 1146718 - RNA, 19 nt, Homo sapiens
agcacuaguugauaacuuu

SEQ ID NO: 1146719 - RNA, 16 nt, Homo sapiens
agcacuauuguuuaga

SEQ ID NO: 1146720 - RNA, 23 nt, Homo sapiens
agcacuccugauuuuuaucuaga

SEQ ID NO: 1146721 - RNA, 15 nt, Homo sapiens
agcacugccaccagu

SEQ ID NO: 1146722 - RNA, 16 nt, Homo sapiens
agcacugcugccucag

SEQ ID NO: 1146723 - RNA, 18 nt, Homo sapiens
agcacuggaaccaccugg

SEQ ID NO: 1146724 - RNA, 14 nt, Homo sapiens
agcacuuccauggg

SEQ ID NO: 1146725 - RNA, 20 nt, Homo sapiens
agcagaacagaucuuuuacu

SEQ ID NO: 1146726 - RNA, 15 nt, Homo sapiens
agcagaagccagagg

SEQ ID NO: 1146727 - RNA, 17 nt, Homo sapiens
agcagaaucucagagaa

SEQ ID NO: 1146728 - RNA, 17 nt, Homo sapiens
agcagacaaaaugaaag

SEQ ID NO: 1146729 - RNA, 20 nt, Homo sapiens
agcagacaggccccgugagg

SEQ ID NO: 1146730 - RNA, 20 nt, Homo sapiens
agcagaggaccagggccuuu

SEQ ID NO: 1146731 - RNA, 15 nt, Homo sapiens
agcagaggucuccca

SEQ ID NO: 1146732 - RNA, 15 nt, Homo sapiens
agcagaugguuucca

SEQ ID NO: 1146733 - RNA, 14 nt, Homo sapiens
agcagcaacugugu

SEQ ID NO: 1146734 - RNA, 23 nt, Homo sapiens
agcagccagccaacccuuucauu

SEQ ID NO: 1146735 - RNA, 15 nt, Homo sapiens
agcagcccagcauuu

SEQ ID NO: 1146736 - RNA, 18 nt, Homo sapiens
agcagcccuggcucucac

SEQ ID NO: 1146737 - RNA, 12 nt, Homo sapiens
agcagcugcuac

SEQ ID NO: 1146738 - RNA, 16 nt, Homo sapiens
agcagcugguaaucuu

SEQ ID NO: 1146739 - RNA, 15 nt, Homo sapiens
agcaggaagcucaga

SEQ ID NO: 1146740 - RNA, 14 nt, Homo sapiens
agcaggacagacac

SEQ ID NO: 1146741 - RNA, 22 nt, Homo sapiens
agcaggaccucugaaacccugg

SEQ ID NO: 1146742 - RNA, 15 nt, Homo sapiens
agcaggacugcacag

SEQ ID NO: 1146743 - RNA, 15 nt, Homo sapiens
agcagggacugugaa

SEQ ID NO: 1146744 - RNA, 20 nt, Homo sapiens
agcagggccaacaaccugug

SEQ ID NO: 1146745 - RNA, 13 nt, Homo sapiens
agcaggucuuuca

SEQ ID NO: 1146746 - RNA, 17 nt, Homo sapiens
agcaggugcugacuuca

SEQ ID NO: 1146747 - RNA, 18 nt, Homo sapiens
agcagguuaccacucugg

SEQ ID NO: 1146748 - RNA, 19 nt, Homo sapiens
agcagguuaccacucuggc

SEQ ID NO: 1146749 - RNA, 20 nt, Homo sapiens
agcagguucccaagcucaga

SEQ ID NO: 1146750 - RNA, 14 nt, Homo sapiens
agcaguagacauuu

SEQ ID NO: 1146751 - RNA, 15 nt, Homo sapiens
agcagucccugcuua

SEQ ID NO: 1146752 - RNA, 16 nt, Homo sapiens
agcagucccugcuuau

SEQ ID NO: 1146753 - RNA, 17 nt, Homo sapiens
agcagugggcagguggc

SEQ ID NO: 1146754 - RNA, 21 nt, Homo sapiens
agcaguuacucccuacacuga

SEQ ID NO: 1146755 - RNA, 17 nt, Homo sapiens
agcaguuggucuauuca

SEQ ID NO: 1146756 - RNA, 13 nt, Homo sapiens
agcaguuuuguga

SEQ ID NO: 1146757 - RNA, 17 nt, Homo sapiens
agcauaagcuuaugcuu

SEQ ID NO: 1146758 - RNA, 14 nt, Homo sapiens
agcauaagggcuuc

SEQ ID NO: 1146759 - RNA, 18 nt, Homo sapiens
agcauacgguaugauauu

SEQ ID NO: 1146760 - RNA, 20 nt, Homo sapiens
agcauaggcucuuuuugcug

SEQ ID NO: 1146761 - RNA, 18 nt, Homo sapiens
agcaucaacaagugggga

SEQ ID NO: 1146762 - RNA, 22 nt, Homo sapiens
agcaucagagagacuguuauca

SEQ ID NO: 1146763 - RNA, 23 nt, Homo sapiens
agcaucagagagacuguuaucag

SEQ ID NO: 1146764 - RNA, 16 nt, Homo sapiens
agcaucaggauacuca

SEQ ID NO: 1146765 - RNA, 20 nt, Homo sapiens
agcaucauuaaugcacaucu

SEQ ID NO: 1146766 - RNA, 12 nt, Homo sapiens
agcauccucuac

SEQ ID NO: 1146767 - RNA, 14 nt, Homo sapiens
agcaucucaguggu

SEQ ID NO: 1146768 - RNA, 17 nt, Homo sapiens
agcaucucuucuucccu

SEQ ID NO: 1146769 - RNA, 13 nt, Homo sapiens
cacccacauguga

SEQ ID NO: 1146770 - RNA, 22 nt, Homo sapiens
cacccaccccacaccugcagug

SEQ ID NO: 1146771 - RNA, 19 nt, Homo sapiens
cacccaggucccccgacug

SEQ ID NO: 1146772 - RNA, 13 nt, Homo sapiens
cacccaugcaagc

SEQ ID NO: 1146773 - RNA, 20 nt, Homo sapiens
cacccauggggagacaguug

SEQ ID NO: 1146774 - RNA, 23 nt, Homo sapiens
cacccccgcuuugguucuucaga

SEQ ID NO: 1146775 - RNA, 21 nt, Homo sapiens
caccccgucguauacccugga

SEQ ID NO: 1146776 - RNA, 16 nt, Homo sapiens
caccccugcacaguug

SEQ ID NO: 1146777 - RNA, 21 nt, Homo sapiens
cacccuaaugcauaagcuuuu

SEQ ID NO: 1146778 - RNA, 18 nt, Homo sapiens
cacccuccacaaagcaaa

SEQ ID NO: 1146779 - RNA, 14 nt, Homo sapiens
cacccucuccagau

SEQ ID NO: 1146780 - RNA, 17 nt, Homo sapiens
cacccucuguccccacg

SEQ ID NO: 1146781 - RNA, 17 nt, Homo sapiens
cacccugccccuugcca

SEQ ID NO: 1146782 - RNA, 20 nt, Homo sapiens
cacccugcugcuggugcaca

SEQ ID NO: 1146783 - RNA, 20 nt, Homo sapiens
cacccuguggcucacagugg

SEQ ID NO: 1146784 - RNA, 12 nt, Homo sapiens
caccgcaguuuu

SEQ ID NO: 1146785 - RNA, 20 nt, Homo sapiens
caccgggcuggcugcuugca

SEQ ID NO: 1146786 - RNA, 19 nt, Homo sapiens
caccguggggaaggggugc

SEQ ID NO: 1146787 - RNA, 17 nt, Homo sapiens
caccucaaauacauacc

SEQ ID NO: 1146788 - RNA, 23 nt, Homo sapiens
caccuccaggcuuucccacuucc

SEQ ID NO: 1146789 - RNA, 18 nt, Homo sapiens
caccucugccucaaugug

SEQ ID NO: 1146790 - RNA, 12 nt, Homo sapiens
caccucuugaaa

SEQ ID NO: 1146791 - RNA, 21 nt, Homo sapiens
caccugccaccacuauaaaau

SEQ ID NO: 1146792 - RNA, 16 nt, Homo sapiens
caccugcuggagugaa

SEQ ID NO: 1146793 - RNA, 15 nt, Homo sapiens
caccuggguguuaca

SEQ ID NO: 1146794 - RNA, 13 nt, Homo sapiens
caccuggucuguu

SEQ ID NO: 1146795 - RNA, 18 nt, Homo sapiens
caccuguugcuuacaauu

SEQ ID NO: 1146796 - RNA, 23 nt, Homo sapiens
caccuguuugaaaccaagcuuuc

SEQ ID NO: 1146797 - RNA, 13 nt, Homo sapiens
caccuuagugcaa

SEQ ID NO: 1146798 - RNA, 17 nt, Homo sapiens
caccuuaucuggaagau

SEQ ID NO: 1146799 - RNA, 14 nt, Homo sapiens
caccuucuucagcc

SEQ ID NO: 1146800 - RNA, 22 nt, Homo sapiens
caccuuggcaccagacacccag

SEQ ID NO: 1146801 - RNA, 20 nt, Homo sapiens
caccuuggcuuguuauugcc

SEQ ID NO: 1146802 - RNA, 13 nt, Homo sapiens
caccuugugccug

SEQ ID NO: 1146803 - RNA, 22 nt, Homo sapiens
caccuuguuuucuguucuccuu

SEQ ID NO: 1146804 - RNA, 15 nt, Homo sapiens
caccuuuagguucuu

SEQ ID NO: 1146805 - RNA, 14 nt, Homo sapiens
caccuuucccacuu

SEQ ID NO: 1146806 - RNA, 20 nt, Homo sapiens
caccuuucuggacggaacca

SEQ ID NO: 1146807 - RNA, 19 nt, Homo sapiens
caccuuuggugcuuuccag

SEQ ID NO: 1146808 - RNA, 13 nt, Homo sapiens
cacgaucuuggcu

SEQ ID NO: 1146809 - RNA, 17 nt, Homo sapiens
cacgcaacuauaguuuu

SEQ ID NO: 1146810 - RNA, 18 nt, Homo sapiens
cacgccauuguacuccag

SEQ ID NO: 1146811 - RNA, 20 nt, Homo sapiens
cacggucuguucuugaagca

SEQ ID NO: 1146812 - RNA, 16 nt, Homo sapiens
cacguaucucuuggua

SEQ ID NO: 1146813 - RNA, 15 nt, Homo sapiens
cacgucacaaagacc

SEQ ID NO: 1146814 - RNA, 21 nt, Homo sapiens
cacgucugcagaaacagugca

SEQ ID NO: 1146815 - RNA, 22 nt, Homo sapiens
cacgucugcagaaacagugcaa

SEQ ID NO: 1146816 - RNA, 13 nt, Homo sapiens
cacguguccugua

SEQ ID NO: 1146817 - RNA, 14 nt, Homo sapiens
cacguuucuucccc

SEQ ID NO: 1146818 - RNA, 13 nt, Homo sapiens
cacuaaugcuuua

SEQ ID NO: 1146819 - RNA, 15 nt, Homo sapiens
cacuaaugcuuuaag

SEQ ID NO: 1146820 - RNA, 19 nt, Homo sapiens
cacuacaagugauccucag

SEQ ID NO: 1146821 - RNA, 23 nt, Homo sapiens
cacuacacaggaggcugaggcag

SEQ ID NO: 1146822 - RNA, 20 nt, Homo sapiens
cacuacaccacacacaacag

SEQ ID NO: 1146823 - RNA, 22 nt, Homo sapiens
cacuacaccacacacaacagcc

SEQ ID NO: 1146824 - RNA, 14 nt, Homo sapiens
cacuacauuacuuc

SEQ ID NO: 1146825 - RNA, 15 nt, Homo sapiens
cacuacauucauuua

SEQ ID NO: 1146826 - RNA, 22 nt, Homo sapiens
cacuaccauugcuguucuacuu

SEQ ID NO: 1146827 - RNA, 23 nt, Homo sapiens
cacuagcauuuucucuaccuuca

SEQ ID NO: 1146828 - RNA, 12 nt, Homo sapiens
cacuauaucaug

SEQ ID NO: 1146829 - RNA, 18 nt, Homo sapiens
cacuauauugcacaggcu

SEQ ID NO: 1146830 - RNA, 18 nt, Homo sapiens
cacuaucugggugcauga

SEQ ID NO: 1146831 - RNA, 11 nt, Homo sapiens
cacuaugacau

SEQ ID NO: 1146832 - RNA, 14 nt, Homo sapiens
cacuauguauauac

SEQ ID NO: 1146833 - RNA, 17 nt, Homo sapiens
cacuauguauauacaua

SEQ ID NO: 1146834 - RNA, 19 nt, Homo sapiens
cacuauucuuaacuauuca

SEQ ID NO: 1146835 - RNA, 17 nt, Homo sapiens
cacucaagccaagcagc

SEQ ID NO: 1146836 - RNA, 15 nt, Homo sapiens
cacucaccccagcga

SEQ ID NO: 1146837 - RNA, 16 nt, Homo sapiens
cacucaggcuggagua

SEQ ID NO: 1146838 - RNA, 20 nt, Homo sapiens
cacucaggcuggaguacagu

SEQ ID NO: 1146839 - RNA, 23 nt, Homo sapiens
cacucccuuucuucuucuucuaa

SEQ ID NO: 1146840 - RNA, 16 nt, Homo sapiens
cacuccucuaagacaa

SEQ ID NO: 1146841 - RNA, 12 nt, Homo sapiens
cacuccuugcau

SEQ ID NO: 1146842 - RNA, 21 nt, Homo sapiens
cacucucagaacccacaccag

SEQ ID NO: 1146843 - RNA, 23 nt, Homo sapiens
cacucuuugaucagaaacagggu

SEQ ID NO: 1146844 - RNA, 20 nt, Homo sapiens
cacugaaaaaauacuaccua

SEQ ID NO: 1146845 - RNA, 16 nt, Homo sapiens
cacugaaggaacaguu

SEQ ID NO: 1146846 - RNA, 16 nt, Homo sapiens
cacugaagugcuugca

SEQ ID NO: 1146847 - RNA, 21 nt, Homo sapiens
cacugacacaucagcauguuu

SEQ ID NO: 1146848 - RNA, 18 nt, Homo sapiens
cacugaccaagugcuggc

SEQ ID NO: 1146849 - RNA, 16 nt, Homo sapiens
cacugagcaauguaua

SEQ ID NO: 1146850 - RNA, 22 nt, Homo sapiens
cacugaggccugagacccagga

SEQ ID NO: 1146851 - RNA, 12 nt, Homo sapiens
cacugaguuucu

SEQ ID NO: 1146852 - RNA, 15 nt, Homo sapiens
cacugauaaaaccau

SEQ ID NO: 1146853 - RNA, 18 nt, Homo sapiens
cacugauauucagaauua

SEQ ID NO: 1146854 - RNA, 18 nt, Homo sapiens
cacugaucugaacaucug

SEQ ID NO: 1146855 - RNA, 14 nt, Homo sapiens
cacugaugcaagga

SEQ ID NO: 1146856 - RNA, 19 nt, Homo sapiens
cacugcauaccaaccuggg

SEQ ID NO: 1146857 - RNA, 19 nt, Homo sapiens
cacugccagucucacugug

SEQ ID NO: 1146858 - RNA, 18 nt, Homo sapiens
cacugccauuacccagug

SEQ ID NO: 1146859 - RNA, 20 nt, Homo sapiens
cacugccccagacacagugc

SEQ ID NO: 1146860 - RNA, 23 nt, Homo sapiens
cacugccuuugucuuacuggcaa

SEQ ID NO: 1146861 - RNA, 22 nt, Homo sapiens
cacugcgcccagcuauacugua

SEQ ID NO: 1146862 - RNA, 16 nt, Homo sapiens
cacugcgggacagagg

SEQ ID NO: 1146863 - RNA, 16 nt, Homo sapiens
cacugcuacaugugcu

SEQ ID NO: 1146864 - RNA, 21 nt, Homo sapiens
cacugcugaggacacucagug

SEQ ID NO: 1146865 - RNA, 15 nt, Homo sapiens
cacugggaaacagag

SEQ ID NO: 1146866 - RNA, 18 nt, Homo sapiens
cacugggccuccaaccau

SEQ ID NO: 1146867 - RNA, 14 nt, Homo sapiens
cacuguacuuguag

SEQ ID NO: 1146868 - RNA, 14 nt, Homo sapiens
cacuguaucuaggc

SEQ ID NO: 1146869 - RNA, 23 nt, Homo sapiens
cacugucaaguguuuuacuaucu

SEQ ID NO: 1146870 - RNA, 20 nt, Homo sapiens
cacugucaugcuucaucauu

SEQ ID NO: 1146871 - RNA, 13 nt, Homo sapiens
cacugugcuacug

SEQ ID NO: 1146872 - RNA, 15 nt, Homo sapiens
cacugugcuacugaa

SEQ ID NO: 1146873 - RNA, 18 nt, Homo sapiens
cacugugggaaggccagc

SEQ ID NO: 1146874 - RNA, 21 nt, Homo sapiens
cacuguuuuuagacaccuuca

SEQ ID NO: 1146875 - RNA, 22 nt, Homo sapiens
cacuuaaaagcuggcuuucauc

SEQ ID NO: 1146876 - RNA, 19 nt, Homo sapiens
cacuuaacuacuuaucucu

SEQ ID NO: 1146877 - RNA, 17 nt, Homo sapiens
cacuuagguaccauaug

SEQ ID NO: 1146878 - RNA, 20 nt, Homo sapiens
cacuuaguauugcagccaaa

SEQ ID NO: 1146879 - RNA, 12 nt, Homo sapiens
cacuuaucugau

SEQ ID NO: 1146880 - RNA, 15 nt, Homo sapiens
cacuucaccaaggaa

SEQ ID NO: 1146881 - RNA, 16 nt, Homo sapiens
cacuuccauaugucau

SEQ ID NO: 1146882 - RNA, 16 nt, Homo sapiens
cacuuccguuuaccuu

SEQ ID NO: 1146883 - RNA, 20 nt, Homo sapiens
cacuuccugcugcgaaagac

SEQ ID NO: 1146884 - RNA, 19 nt, Homo sapiens
cacuucuaaaugaagugca

SEQ ID NO: 1146885 - RNA, 19 nt, Homo sapiens
cacuugauguuuccuggaa

SEQ ID NO: 1146886 - RNA, 15 nt, Homo sapiens
cacuugguaauugua

SEQ ID NO: 1146887 - RNA, 16 nt, Homo sapiens
cacuuuagaaagccag

SEQ ID NO: 1146888 - RNA, 17 nt, Homo sapiens
cacuuuauaacccaaaa

SEQ ID NO: 1146889 - RNA, 14 nt, Homo sapiens
cacuuuauggaaga

SEQ ID NO: 1146890 - RNA, 14 nt, Homo sapiens
cacuuucucacuua

SEQ ID NO: 1146891 - RNA, 15 nt, Homo sapiens
cacuuucucuucaau

SEQ ID NO: 1146892 - RNA, 21 nt, Homo sapiens
cacuuugggaggccaaggugg

SEQ ID NO: 1146893 - RNA, 23 nt, Homo sapiens
cacuuuggguuuuuaacucaucu

SEQ ID NO: 1146894 - RNA, 23 nt, Homo sapiens
cagaaaauguugagaaucccaaa

SEQ ID NO: 1146895 - RNA, 15 nt, Homo sapiens
cagaaaauugcacaa

SEQ ID NO: 1146896 - RNA, 13 nt, Homo sapiens
cagaaaccaaaac

SEQ ID NO: 1146897 - RNA, 14 nt, Homo sapiens
cagaaaccaaagcu

SEQ ID NO: 1146898 - RNA, 18 nt, Homo sapiens
cagaaacuaauccuuacu

SEQ ID NO: 1146899 - RNA, 20 nt, Homo sapiens
cagaaacuccagacuuguag

SEQ ID NO: 1146900 - RNA, 12 nt, Homo sapiens
cagaaagcacaa

SEQ ID NO: 1146901 - RNA, 18 nt, Homo sapiens
cagugagguuaaacuaag

SEQ ID NO: 1146902 - RNA, 14 nt, Homo sapiens
cagugagugcugcu

SEQ ID NO: 1146903 - RNA, 21 nt, Homo sapiens
cagugaugcuggaugcuccuu

SEQ ID NO: 1146904 - RNA, 17 nt, Homo sapiens
cagugaugcugugcuau

SEQ ID NO: 1146905 - RNA, 22 nt, Homo sapiens
cagugcacauuucauaguuuca

SEQ ID NO: 1146906 - RNA, 19 nt, Homo sapiens
cagugcaguccauuuccua

SEQ ID NO: 1146907 - RNA, 18 nt, Homo sapiens
cagugccagccccugcug

SEQ ID NO: 1146908 - RNA, 17 nt, Homo sapiens
cagugccaugggggcaa

SEQ ID NO: 1146909 - RNA, 15 nt, Homo sapiens
cagugcuguacuuga

SEQ ID NO: 1146910 - RNA, 19 nt, Homo sapiens
caguggccacguucaggga

SEQ ID NO: 1146911 - RNA, 16 nt, Homo sapiens
caguggcgcaugccug

SEQ ID NO: 1146912 - RNA, 23 nt, Homo sapiens
cagugggaaggggugauggauga

SEQ ID NO: 1146913 - RNA, 18 nt, Homo sapiens
cagugggaguaccaaaga

SEQ ID NO: 1146914 - RNA, 12 nt, Homo sapiens
caguggggcucu

SEQ ID NO: 1146915 - RNA, 16 nt, Homo sapiens
caguggugugaucucg

SEQ ID NO: 1146916 - RNA, 23 nt, Homo sapiens
caguggugugugaaguuuggaga

SEQ ID NO: 1146917 - RNA, 20 nt, Homo sapiens
caguguuaaaugugaugaau

SEQ ID NO: 1146918 - RNA, 17 nt, Homo sapiens
caguguuuacacuuugg

SEQ ID NO: 1146919 - RNA, 19 nt, Homo sapiens
caguguuuguauaccauga

SEQ ID NO: 1146920 - RNA, 21 nt, Homo sapiens
caguuaauuagcauucuggca

SEQ ID NO: 1146921 - RNA, 15 nt, Homo sapiens
caguuacaugcauac

SEQ ID NO: 1146922 - RNA, 19 nt, Homo sapiens
caguuacucccuacacuga

SEQ ID NO: 1146923 - RNA, 12 nt, Homo sapiens
caguuacugaaa

SEQ ID NO: 1146924 - RNA, 11 nt, Homo sapiens
caguuacugug

SEQ ID NO: 1146925 - RNA, 20 nt, Homo sapiens
caguuaggguuuugcaauaa

SEQ ID NO: 1146926 - RNA, 16 nt, Homo sapiens
caguucaagugcucuu

SEQ ID NO: 1146927 - RNA, 17 nt, Homo sapiens
caguucacugcugcaug

SEQ ID NO: 1146928 - RNA, 12 nt, Homo sapiens
caguucaugcag

SEQ ID NO: 1146929 - RNA, 15 nt, Homo sapiens
caguucccucuugcu

SEQ ID NO: 1146930 - RNA, 22 nt, Homo sapiens
caguucccuuugcuugucuucu

SEQ ID NO: 1146931 - RNA, 16 nt, Homo sapiens
caguucuaguuugcau

SEQ ID NO: 1146932 - RNA, 19 nt, Homo sapiens
caguucugccuuaucuaaa

SEQ ID NO: 1146933 - RNA, 16 nt, Homo sapiens
caguuuaacagaguuu

SEQ ID NO: 1146934 - RNA, 19 nt, Homo sapiens
caguuuacaaaugacaugg

SEQ ID NO: 1146935 - RNA, 14 nt, Homo sapiens
caguuuaccauccu

SEQ ID NO: 1146936 - RNA, 16 nt, Homo sapiens
caguuuacuuugccaa

SEQ ID NO: 1146937 - RNA, 13 nt, Homo sapiens
caguuuagugcau

SEQ ID NO: 1146938 - RNA, 22 nt, Homo sapiens
caguuucagauccugaucuuaa

SEQ ID NO: 1146939 - RNA, 19 nt, Homo sapiens
caguuucauuaacugguga

SEQ ID NO: 1146940 - RNA, 19 nt, Homo sapiens
caguuucuaucauucugcu

SEQ ID NO: 1146941 - RNA, 19 nt, Homo sapiens
caguuugugcucuacuguu

SEQ ID NO: 1146942 - RNA, 13 nt, Homo sapiens
caguuuucuugca

SEQ ID NO: 1146943 - RNA, 22 nt, Homo sapiens
caguuuuguaaauguacuggua

SEQ ID NO: 1146944 - RNA, 23 nt, Homo sapiens
caguuuuguuuugagggcuauua

SEQ ID NO: 1146945 - RNA, 23 nt, Homo sapiens
caguuuuuaaaauuggccuuuua

SEQ ID NO: 1146946 - RNA, 20 nt, Homo sapiens
cauaaaaaagaagcacuuug

SEQ ID NO: 1146947 - RNA, 21 nt, Homo sapiens
cauaaaaauaaaucaguucau

SEQ ID NO: 1146948 - RNA, 17 nt, Homo sapiens
cauaaaauagagugcau

SEQ ID NO: 1146949 - RNA, 14 nt, Homo sapiens
cauaaacauuugag

SEQ ID NO: 1146950 - RNA, 15 nt, Homo sapiens
cauaaagucagugcc

SEQ ID NO: 1146951 - RNA, 15 nt, Homo sapiens
cauaaagucuugccu

SEQ ID NO: 1146952 - RNA, 13 nt, Homo sapiens
cauaaauuucucu

SEQ ID NO: 1146953 - RNA, 22 nt, Homo sapiens
cauaacagcaggguaccugaaa

SEQ ID NO: 1146954 - RNA, 14 nt, Homo sapiens
cauaacauggguac

SEQ ID NO: 1146955 - RNA, 16 nt, Homo sapiens
cauaacucugugaucu

SEQ ID NO: 1146956 - RNA, 23 nt, Homo sapiens
cauaagacaaacuccugaaaugc

SEQ ID NO: 1146957 - RNA, 16 nt, Homo sapiens
cauaagugaaaaucuu

SEQ ID NO: 1146958 - RNA, 14 nt, Homo sapiens
cauaaguuaucaug

SEQ ID NO: 1146959 - RNA, 16 nt, Homo sapiens
cauaauaaauaucugu

SEQ ID NO: 1146960 - RNA, 19 nt, Homo sapiens
cauaauagaauuuccuaau

SEQ ID NO: 1146961 - RNA, 21 nt, Homo sapiens
cauaaucuauaaacaaugaaa

SEQ ID NO: 1146962 - RNA, 19 nt, Homo sapiens
cauaaucuguacaaugaac

SEQ ID NO: 1146963 - RNA, 19 nt, Homo sapiens
cauaauggcugaagccaaa

SEQ ID NO: 1146964 - RNA, 13 nt, Homo sapiens
cauaauuaaugua

SEQ ID NO: 1146965 - RNA, 13 nt, Homo sapiens
cauaauucagggg

SEQ ID NO: 1146966 - RNA, 19 nt, Homo sapiens
cauacaagagacauauaau

SEQ ID NO: 1146967 - RNA, 19 nt, Homo sapiens
cauacacacguuaccagac

SEQ ID NO: 1146968 - RNA, 15 nt, Homo sapiens
cauacacagaaacca

SEQ ID NO: 1146969 - RNA, 13 nt, Homo sapiens
cauacauagacau

SEQ ID NO: 1146970 - RNA, 23 nt, Homo sapiens
cauacauugauucaugucucacg

SEQ ID NO: 1146971 - RNA, 17 nt, Homo sapiens
cauaccguguaccucag

SEQ ID NO: 1146972 - RNA, 14 nt, Homo sapiens
cauaccuacauuca

SEQ ID NO: 1146973 - RNA, 14 nt, Homo sapiens
cauacgucagcauu

SEQ ID NO: 1146974 - RNA, 19 nt, Homo sapiens
cauacgucuuucacaguuu

SEQ ID NO: 1146975 - RNA, 19 nt, Homo sapiens
cauacucuguugccuccuc

SEQ ID NO: 1146976 - RNA, 21 nt, Homo sapiens
cauacugacauaagauucuau

SEQ ID NO: 1146977 - RNA, 19 nt, Homo sapiens
cauagaaagccaugugcua

SEQ ID NO: 1146978 - RNA, 20 nt, Homo sapiens
cauagaauucacaaugcauu

SEQ ID NO: 1146979 - RNA, 19 nt, Homo sapiens
cauagaauucuagcuuuuu

SEQ ID NO: 1146980 - RNA, 19 nt, Homo sapiens
cauagaguauagcucugua

SEQ ID NO: 1146981 - RNA, 16 nt, Homo sapiens
cauagauguuaugcaa

SEQ ID NO: 1146982 - RNA, 16 nt, Homo sapiens
cauagcaccauuccuc

SEQ ID NO: 1146983 - RNA, 18 nt, Homo sapiens
cauagcagaugguuucca

SEQ ID NO: 1146984 - RNA, 22 nt, Homo sapiens
cauagcugucuagaguagcuua

SEQ ID NO: 1146985 - RNA, 17 nt, Homo sapiens
cauaggaugguaccaag

SEQ ID NO: 1146986 - RNA, 14 nt, Homo sapiens
cauaggccaugaaa

SEQ ID NO: 1146987 - RNA, 13 nt, Homo sapiens
cauaggugcaguu

SEQ ID NO: 1146988 - RNA, 21 nt, Homo sapiens
cauaggugcaguuugcuucua

SEQ ID NO: 1146989 - RNA, 20 nt, Homo sapiens
cauaguaacugacaugauua

SEQ ID NO: 1146990 - RNA, 22 nt, Homo sapiens
cauaguagguacccaauucaau

SEQ ID NO: 1146991 - RNA, 17 nt, Homo sapiens
cauaguaguaugaugau

SEQ ID NO: 1146992 - RNA, 22 nt, Homo sapiens
cauagucacauggccuaugcac

SEQ ID NO: 1146993 - RNA, 13 nt, Homo sapiens
cauaguccaaaaa

SEQ ID NO: 1146994 - RNA, 14 nt, Homo sapiens
cauaguccaaaaag

SEQ ID NO: 1146995 - RNA, 13 nt, Homo sapiens
cauaguccagaga

SEQ ID NO: 1146996 - RNA, 19 nt, Homo sapiens
cauaguuauuuacuugaaa

SEQ ID NO: 1146997 - RNA, 22 nt, Homo sapiens
cauaguuucaaaucuguaauca

SEQ ID NO: 1146998 - RNA, 19 nt, Homo sapiens
cauauaaaagcuaugguga

SEQ ID NO: 1146999 - RNA, 18 nt, Homo sapiens
cauauaacgucaugugca

SEQ ID NO: 1147000 - RNA, 20 nt, Homo sapiens
cauauaagcuauaucauaaa

SEQ ID NO: 1147001 - RNA, 21 nt, Homo sapiens
cauauaggaaaacaauaauuu

SEQ ID NO: 1147002 - RNA, 21 nt, Homo sapiens
cauauauauuaauacugguau

SEQ ID NO: 1147003 - RNA, 13 nt, Homo sapiens
cauauauauuaca

SEQ ID NO: 1147004 - RNA, 16 nt, Homo sapiens
cauaugccccauuccc

SEQ ID NO: 1147005 - RNA, 15 nt, Homo sapiens
cauaugcuguacaug

SEQ ID NO: 1147006 - RNA, 19 nt, Homo sapiens
cauauggacucugcacaug

SEQ ID NO: 1147007 - RNA, 20 nt, Homo sapiens
cauauggacucugcacauga

SEQ ID NO: 1147008 - RNA, 18 nt, Homo sapiens
cauauguccccacuggca

SEQ ID NO: 1147009 - RNA, 19 nt, Homo sapiens
cauauguuaauaaacugca

SEQ ID NO: 1147010 - RNA, 15 nt, Homo sapiens
cauauuuaacaugua

SEQ ID NO: 1147011 - RNA, 17 nt, Homo sapiens
caucaaaccuuugccaa

SEQ ID NO: 1147012 - RNA, 18 nt, Homo sapiens
caucaacaaugauuaauc

SEQ ID NO: 1147013 - RNA, 23 nt, Homo sapiens
caucaagccccacaguucuuaau

SEQ ID NO: 1147014 - RNA, 17 nt, Homo sapiens
caucacaaccagauuug

SEQ ID NO: 1147015 - RNA, 16 nt, Homo sapiens
caucacagaacauccu

SEQ ID NO: 1147016 - RNA, 16 nt, Homo sapiens
caucacagaaugugau

SEQ ID NO: 1147017 - RNA, 16 nt, Homo sapiens
caucacugggucugcu

SEQ ID NO: 1147018 - RNA, 14 nt, Homo sapiens
caucacugguugca

SEQ ID NO: 1147019 - RNA, 17 nt, Homo sapiens
caucacugguugcacuu

SEQ ID NO: 1147020 - RNA, 14 nt, Homo sapiens
caucacuguauacc

SEQ ID NO: 1147021 - RNA, 18 nt, Homo sapiens
caucagacauuauaagua

SEQ ID NO: 1147022 - RNA, 13 nt, Homo sapiens
caucagcacaaag

SEQ ID NO: 1147023 - RNA, 21 nt, Homo sapiens
caucagccuucaagaaucaga

SEQ ID NO: 1147024 - RNA, 22 nt, Homo sapiens
caucaggaguuccagugcugca

SEQ ID NO: 1147025 - RNA, 15 nt, Homo sapiens
caucaggauacucaa

SEQ ID NO: 1147026 - RNA, 20 nt, Homo sapiens
caucaggauacucaaagugg

SEQ ID NO: 1147027 - RNA, 20 nt, Homo sapiens
caucaggcccgcuaggucca

SEQ ID NO: 1147028 - RNA, 18 nt, Homo sapiens
caucaguaacaguauuca

SEQ ID NO: 1147029 - RNA, 19 nt, Homo sapiens
caucaguaacaguauucag

SEQ ID NO: 1147030 - RNA, 17 nt, Homo sapiens
caucagugcucccucac

SEQ ID NO: 1147031 - RNA, 17 nt, Homo sapiens
caucaucuccugccuuc

SEQ ID NO: 1147032 - RNA, 15 nt, Homo sapiens
caucauuagaacaaa

SEQ ID NO: 1147033 - RNA, 15 nt, Homo sapiens
ccaacucuccacaaa

SEQ ID NO: 1147034 - RNA, 14 nt, Homo sapiens
ccaacugcugauca

SEQ ID NO: 1147035 - RNA, 22 nt, Homo sapiens
ccaacuuuuuccaaguccuuua

SEQ ID NO: 1147036 - RNA, 17 nt, Homo sapiens
ccaagaaaauugccuuu

SEQ ID NO: 1147037 - RNA, 15 nt, Homo sapiens
ccaagaagcaugcag

SEQ ID NO: 1147038 - RNA, 17 nt, Homo sapiens
ccaagaauagcaucugu

SEQ ID NO: 1147039 - RNA, 12 nt, Homo sapiens
ccaagaccucag

SEQ ID NO: 1147040 - RNA, 23 nt, Homo sapiens
ccaagaccucagggcacaaagau

SEQ ID NO: 1147041 - RNA, 17 nt, Homo sapiens
ccaagauacuugaacac

SEQ ID NO: 1147042 - RNA, 19 nt, Homo sapiens
ccaagauuuuuuauuugag

SEQ ID NO: 1147043 - RNA, 19 nt, Homo sapiens
ccaagcagagaagcucucg

SEQ ID NO: 1147044 - RNA, 16 nt, Homo sapiens
ccaagcaggaagcuca

SEQ ID NO: 1147045 - RNA, 22 nt, Homo sapiens
ccaagccuucgggcgucugugu

SEQ ID NO: 1147046 - RNA, 17 nt, Homo sapiens
ccaagcucccaagagcu

SEQ ID NO: 1147047 - RNA, 22 nt, Homo sapiens
ccaagcuccuugggaggcccca

SEQ ID NO: 1147048 - RNA, 19 nt, Homo sapiens
ccaagcugugcccugacca

SEQ ID NO: 1147049 - RNA, 18 nt, Homo sapiens
ccaaggagcaucccuaau

SEQ ID NO: 1147050 - RNA, 19 nt, Homo sapiens
ccaaggaggaaaaacagac

SEQ ID NO: 1147051 - RNA, 16 nt, Homo sapiens
ccaaggaugucugcca

SEQ ID NO: 1147052 - RNA, 23 nt, Homo sapiens
ccaaggcaaaaaaaucauauaag

SEQ ID NO: 1147053 - RNA, 23 nt, Homo sapiens
ccaaggccucauccuggggagga

SEQ ID NO: 1147054 - RNA, 15 nt, Homo sapiens
ccaaggccuucucag

SEQ ID NO: 1147055 - RNA, 15 nt, Homo sapiens
ccaaggggaaucaga

SEQ ID NO: 1147056 - RNA, 12 nt, Homo sapiens
ccaagugaagca

SEQ ID NO: 1147057 - RNA, 14 nt, Homo sapiens
ccaaguguauuuua

SEQ ID NO: 1147058 - RNA, 11 nt, Homo sapiens
ccaagugugaa

SEQ ID NO: 1147059 - RNA, 16 nt, Homo sapiens
ccaaguuauacccaac

SEQ ID NO: 1147060 - RNA, 13 nt, Homo sapiens
ccaauacauuugu

SEQ ID NO: 1147061 - RNA, 14 nt, Homo sapiens
ccaauacccuguaa

SEQ ID NO: 1147062 - RNA, 22 nt, Homo sapiens
ccaauauaguuuucuaacuccu

SEQ ID NO: 1147063 - RNA, 19 nt, Homo sapiens
ccaauaucagcucuuucuc

SEQ ID NO: 1147064 - RNA, 15 nt, Homo sapiens
ccaauaucuugccag

SEQ ID NO: 1147065 - RNA, 16 nt, Homo sapiens
ccaaucagaacuggcu

SEQ ID NO: 1147066 - RNA, 13 nt, Homo sapiens
ccaaucagaucaa

SEQ ID NO: 1147067 - RNA, 21 nt, Homo sapiens
ccaauccauccugcucaggaa

SEQ ID NO: 1147068 - RNA, 15 nt, Homo sapiens
ccaaucuguacaaaa

SEQ ID NO: 1147069 - RNA, 22 nt, Homo sapiens
ccaauggaaaauauaaugauca

SEQ ID NO: 1147070 - RNA, 14 nt, Homo sapiens
ccaaugguggcaaa

SEQ ID NO: 1147071 - RNA, 21 nt, Homo sapiens
ccaaugugaaagauuauuuaa

SEQ ID NO: 1147072 - RNA, 23 nt, Homo sapiens
ccaauguucuauuaaucaccucu

SEQ ID NO: 1147073 - RNA, 15 nt, Homo sapiens
ccaauuagcucuaua

SEQ ID NO: 1147074 - RNA, 14 nt, Homo sapiens
ccaauuauuugacu

SEQ ID NO: 1147075 - RNA, 12 nt, Homo sapiens
ccaauuccugau

SEQ ID NO: 1147076 - RNA, 19 nt, Homo sapiens
ccaauugcuggaguacuua

SEQ ID NO: 1147077 - RNA, 18 nt, Homo sapiens
ccacaaagcaaaggcagu

SEQ ID NO: 1147078 - RNA, 23 nt, Homo sapiens
ccacaaagcacaguuugaacaaa

SEQ ID NO: 1147079 - RNA, 22 nt, Homo sapiens
ccacaacuugucacccaaagcc

SEQ ID NO: 1147080 - RNA, 23 nt, Homo sapiens
ccacaaggaauccccagauauuu

SEQ ID NO: 1147081 - RNA, 22 nt, Homo sapiens
ccacaauuccuccucuggccac

SEQ ID NO: 1147082 - RNA, 21 nt, Homo sapiens
ccacacaagggaaggacagaa

SEQ ID NO: 1147083 - RNA, 18 nt, Homo sapiens
ccacacacacacacaugc

SEQ ID NO: 1147084 - RNA, 20 nt, Homo sapiens
ccacacacacacacaugcau

SEQ ID NO: 1147085 - RNA, 15 nt, Homo sapiens
ccacacacacuccuu

SEQ ID NO: 1147086 - RNA, 14 nt, Homo sapiens
ccacaccaagcagc

SEQ ID NO: 1147087 - RNA, 15 nt, Homo sapiens
ccacacccagcucag

SEQ ID NO: 1147088 - RNA, 18 nt, Homo sapiens
ccacaccugcagugccag

SEQ ID NO: 1147089 - RNA, 22 nt, Homo sapiens
ccacaccuggcccuugcaaucu

SEQ ID NO: 1147090 - RNA, 14 nt, Homo sapiens
ccacacugcuacac

SEQ ID NO: 1147091 - RNA, 18 nt, Homo sapiens
ccacagacucaaaugcuc

SEQ ID NO: 1147092 - RNA, 17 nt, Homo sapiens
ccacagaguaagacauu

SEQ ID NO: 1147093 - RNA, 19 nt, Homo sapiens
ccacagcaaccccaggcug

SEQ ID NO: 1147094 - RNA, 21 nt, Homo sapiens
ccacagcaaccccaggcugaa

SEQ ID NO: 1147095 - RNA, 19 nt, Homo sapiens
ccacagcgcuggccgggac

SEQ ID NO: 1147096 - RNA, 16 nt, Homo sapiens
ccacaggcucugacca

SEQ ID NO: 1147097 - RNA, 20 nt, Homo sapiens
ccacaggguaccaggauaaa

SEQ ID NO: 1147098 - RNA, 23 nt, Homo sapiens
ccacaggugcgggaccaucugau

SEQ ID NO: 1147099 - RNA, 14 nt, Homo sapiens
ccacaguggcuuca

SEQ ID NO: 1147100 - RNA, 15 nt, Homo sapiens
ccacaguguuaccug

SEQ ID NO: 1147101 - RNA, 14 nt, Homo sapiens
ccacaguuuccuca

SEQ ID NO: 1147102 - RNA, 12 nt, Homo sapiens
ccacaucuccug

SEQ ID NO: 1147103 - RNA, 19 nt, Homo sapiens
ccacaucugugucucugga

SEQ ID NO: 1147104 - RNA, 23 nt, Homo sapiens
ccacaugguugugagucuugaca

SEQ ID NO: 1147105 - RNA, 22 nt, Homo sapiens
ccacaugugacacauaugcacc

SEQ ID NO: 1147106 - RNA, 18 nt, Homo sapiens
ccacauuuucagccaaag

SEQ ID NO: 1147107 - RNA, 13 nt, Homo sapiens
ccaccacacaucc

SEQ ID NO: 1147108 - RNA, 13 nt, Homo sapiens
ccaccacacccag

SEQ ID NO: 1147109 - RNA, 20 nt, Homo sapiens
ccaccacugcuuaagugccu

SEQ ID NO: 1147110 - RNA, 20 nt, Homo sapiens
ccaccagcauccacacugcc

SEQ ID NO: 1147111 - RNA, 19 nt, Homo sapiens
ccaccaggccucacuggcu

SEQ ID NO: 1147112 - RNA, 18 nt, Homo sapiens
ccaccaguaugacaguau

SEQ ID NO: 1147113 - RNA, 21 nt, Homo sapiens
ccaccccagcaggacagugac

SEQ ID NO: 1147114 - RNA, 14 nt, Homo sapiens
ccaccgcagcuacu

SEQ ID NO: 1147115 - RNA, 17 nt, Homo sapiens
ccaccuccccagccuuu

SEQ ID NO: 1147116 - RNA, 16 nt, Homo sapiens
ccaccucccucugcca

SEQ ID NO: 1147117 - RNA, 21 nt, Homo sapiens
ccaccucccugccuccaggaa

SEQ ID NO: 1147118 - RNA, 12 nt, Homo sapiens
ccaccuccggga

SEQ ID NO: 1147119 - RNA, 15 nt, Homo sapiens
ccaccuggacgaaga

SEQ ID NO: 1147120 - RNA, 14 nt, Homo sapiens
ccaccuuucuggac

SEQ ID NO: 1147121 - RNA, 19 nt, Homo sapiens
ccacgaaagcacacacaaa

SEQ ID NO: 1147122 - RNA, 22 nt, Homo sapiens
ccacgagcuguuuacuagggau

SEQ ID NO: 1147123 - RNA, 14 nt, Homo sapiens
ccacguucagggag

SEQ ID NO: 1147124 - RNA, 20 nt, Homo sapiens
ccacguugccucuacuuuau

SEQ ID NO: 1147125 - RNA, 14 nt, Homo sapiens
ccacuaagaauuca

SEQ ID NO: 1147126 - RNA, 12 nt, Homo sapiens
ccacuaauacug

SEQ ID NO: 1147127 - RNA, 21 nt, Homo sapiens
ccacuacacagucugcaagau

SEQ ID NO: 1147128 - RNA, 19 nt, Homo sapiens
ccacuaccguaaaugucca

SEQ ID NO: 1147129 - RNA, 18 nt, Homo sapiens
ccacucaugugacucuuu

SEQ ID NO: 1147130 - RNA, 16 nt, Homo sapiens
ccacucucuaccagau

SEQ ID NO: 1147131 - RNA, 18 nt, Homo sapiens
ccacugaagcaccacagg

SEQ ID NO: 1147132 - RNA, 19 nt, Homo sapiens
ccacugcacccaccuacuu

SEQ ID NO: 1147133 - RNA, 17 nt, Homo sapiens
ccacugcuggcugcagc

SEQ ID NO: 1147134 - RNA, 22 nt, Homo sapiens
ccacuggccucaagugagccaa

SEQ ID NO: 1147135 - RNA, 13 nt, Homo sapiens
ccacuuaucagug

SEQ ID NO: 1147136 - RNA, 15 nt, Homo sapiens
ccacuucucaucaca

SEQ ID NO: 1147137 - RNA, 17 nt, Homo sapiens
ccacuuuauugcaaugc

SEQ ID NO: 1147138 - RNA, 18 nt, Homo sapiens
ccacuuugcuguuccuua

SEQ ID NO: 1147139 - RNA, 18 nt, Homo sapiens
ccagaacaaucuggauuu

SEQ ID NO: 1147140 - RNA, 15 nt, Homo sapiens
ccagaacacacucca

SEQ ID NO: 1147141 - RNA, 15 nt, Homo sapiens
ccagaacccauuuga

SEQ ID NO: 1147142 - RNA, 20 nt, Homo sapiens
ccagaacccauuugaggggu

SEQ ID NO: 1147143 - RNA, 22 nt, Homo sapiens
ccagaagcaagauucaaaucuc

SEQ ID NO: 1147144 - RNA, 18 nt, Homo sapiens
ccagaagccuccuuacau

SEQ ID NO: 1147145 - RNA, 20 nt, Homo sapiens
ccagaagcggccugugcguu

SEQ ID NO: 1147146 - RNA, 17 nt, Homo sapiens
ccagaagcuuccauagu

SEQ ID NO: 1147147 - RNA, 15 nt, Homo sapiens
ccagacaauguugug

SEQ ID NO: 1147148 - RNA, 16 nt, Homo sapiens
ccagacacguccugca

SEQ ID NO: 1147149 - RNA, 22 nt, Homo sapiens
ccagacacguccugcaguuccu

SEQ ID NO: 1147150 - RNA, 22 nt, Homo sapiens
ccagacacuggcguuacugcuu

SEQ ID NO: 1147151 - RNA, 15 nt, Homo sapiens
ccagacucagacauu

SEQ ID NO: 1147152 - RNA, 21 nt, Homo sapiens
ccagacucgccaacaugguga

SEQ ID NO: 1147153 - RNA, 16 nt, Homo sapiens
ccagacugaacuuacc

SEQ ID NO: 1147154 - RNA, 23 nt, Homo sapiens
ccagacuugcacuggggugggau

SEQ ID NO: 1147155 - RNA, 23 nt, Homo sapiens
ccagagaaugcccacugccugua

SEQ ID NO: 1147156 - RNA, 20 nt, Homo sapiens
ccagagcaaaaauguaaaaa

SEQ ID NO: 1147157 - RNA, 14 nt, Homo sapiens
ccagagcccagcuc

SEQ ID NO: 1147158 - RNA, 14 nt, Homo sapiens
ccagaggacaaaag

SEQ ID NO: 1147159 - RNA, 18 nt, Homo sapiens
ccagaggcccuggcuccu

SEQ ID NO: 1147160 - RNA, 14 nt, Homo sapiens
ccagagucccugcc

SEQ ID NO: 1147161 - RNA, 14 nt, Homo sapiens
ccagauagcucaau

SEQ ID NO: 1147162 - RNA, 17 nt, Homo sapiens
ccagaugcugauguuca

SEQ ID NO: 1147163 - RNA, 18 nt, Homo sapiens
ccagauguuuccagacuu

SEQ ID NO: 1147164 - RNA, 22 nt, Homo sapiens
ccagauuaucagaccucuucau

SEQ ID NO: 1147165 - RNA, 17 nt, Homo sapiens
uccagguguuacuguaa

SEQ ID NO: 1147166 - RNA, 15 nt, Homo sapiens
uccagucuacuugag

SEQ ID NO: 1147167 - RNA, 12 nt, Homo sapiens
uccagugcaguc

SEQ ID NO: 1147168 - RNA, 14 nt, Homo sapiens
uccagugcugcaug

SEQ ID NO: 1147169 - RNA, 14 nt, Homo sapiens
uccaguucaaauaa

SEQ ID NO: 1147170 - RNA, 17 nt, Homo sapiens
uccauaaugcuacuguc

SEQ ID NO: 1147171 - RNA, 22 nt, Homo sapiens
uccauagccuaaucccugggca

SEQ ID NO: 1147172 - RNA, 20 nt, Homo sapiens
uccauaguggaccacuugga

SEQ ID NO: 1147173 - RNA, 21 nt, Homo sapiens
uccauaguggaccacuuggaa

SEQ ID NO: 1147174 - RNA, 19 nt, Homo sapiens
uccauaucagaagugccaa

SEQ ID NO: 1147175 - RNA, 14 nt, Homo sapiens
uccaucagcacaaa

SEQ ID NO: 1147176 - RNA, 18 nt, Homo sapiens
uccaucagccuccauccu

SEQ ID NO: 1147177 - RNA, 15 nt, Homo sapiens
uccaucaucugcugc

SEQ ID NO: 1147178 - RNA, 11 nt, Homo sapiens
uccauccugac

SEQ ID NO: 1147179 - RNA, 17 nt, Homo sapiens
uccaucugacaaauuca

SEQ ID NO: 1147180 - RNA, 20 nt, Homo sapiens
uccaugauuuuaaauuguga

SEQ ID NO: 1147181 - RNA, 15 nt, Homo sapiens
uccaugcucuugacc

SEQ ID NO: 1147182 - RNA, 20 nt, Homo sapiens
uccaugcuuucaccuacaca

SEQ ID NO: 1147183 - RNA, 15 nt, Homo sapiens
uccauguguaucugg

SEQ ID NO: 1147184 - RNA, 20 nt, Homo sapiens
uccauguguuuugcuuuuau

SEQ ID NO: 1147185 - RNA, 18 nt, Homo sapiens
uccauuccaauuguccac

SEQ ID NO: 1147186 - RNA, 19 nt, Homo sapiens
uccauuguggagccaaagc

SEQ ID NO: 1147187 - RNA, 20 nt, Homo sapiens
gcgccgcaaaccacacugga

SEQ ID NO: 1147188 - RNA, 21 nt, Homo sapiens
gcgccugccaucaugccugac

SEQ ID NO: 1147189 - RNA, 16 nt, Homo sapiens
gcgccuggccagagcc

SEQ ID NO: 1147190 - RNA, 14 nt, Homo sapiens
gcgcgguggcucac

SEQ ID NO: 1147191 - RNA, 18 nt, Homo sapiens
gcgcugccugcguugcaa

SEQ ID NO: 1147192 - RNA, 20 nt, Homo sapiens
gcggaucacuuaaagucagg

SEQ ID NO: 1147193 - RNA, 22 nt, Homo sapiens
gcggaucaucuaauucucugug

SEQ ID NO: 1147194 - RNA, 15 nt, Homo sapiens
gcggccagggcggcc

SEQ ID NO: 1147195 - RNA, 14 nt, Homo sapiens
gcggcucugguccu

SEQ ID NO: 1147196 - RNA, 17 nt, Homo sapiens
gcgggcaccuguagucc

SEQ ID NO: 1147197 - RNA, 19 nt, Homo sapiens
gcggggcuuuccugcacau

SEQ ID NO: 1147198 - RNA, 21 nt, Homo sapiens
gcgguagccagcacacagggc

SEQ ID NO: 1147199 - RNA, 22 nt, Homo sapiens
gcgguggcucacgccuguaauc

SEQ ID NO: 1147200 - RNA, 23 nt, Homo sapiens
gcgguguggaccgaggaacaacu

SEQ ID NO: 1147201 - RNA, 18 nt, Homo sapiens
gcguacgcuggugcugag

SEQ ID NO: 1147202 - RNA, 20 nt, Homo sapiens
gcguccauauuuaacaugua

SEQ ID NO: 1147203 - RNA, 16 nt, Homo sapiens
gcgugaccagcaguac

SEQ ID NO: 1147204 - RNA, 19 nt, Homo sapiens
gcgugaccagcaguacuca

SEQ ID NO: 1147205 - RNA, 19 nt, Homo sapiens
gcgugauccaccacaccug

SEQ ID NO: 1147206 - RNA, 10 nt, Homo sapiens
gcgugcauug

SEQ ID NO: 1147207 - RNA, 23 nt, Homo sapiens
gcguggaacucgugucuggcaca

SEQ ID NO: 1147208 - RNA, 18 nt, Homo sapiens
gcguggacucugcacaug

SEQ ID NO: 1147209 - RNA, 14 nt, Homo sapiens
gcuaacucugaccu

SEQ ID NO: 1147210 - RNA, 13 nt, Homo sapiens
gcuaagaaccugg

SEQ ID NO: 1147211 - RNA, 19 nt, Homo sapiens
gcuaagaauauuugaaugu

SEQ ID NO: 1147212 - RNA, 22 nt, Homo sapiens
gcuaagacccaaacauaugcac

SEQ ID NO: 1147213 - RNA, 20 nt, Homo sapiens
gcuaagaugggaugugccga

SEQ ID NO: 1147214 - RNA, 15 nt, Homo sapiens
gcuaagggggaccau

SEQ ID NO: 1147215 - RNA, 20 nt, Homo sapiens
gcuaagggggaccaugggga

SEQ ID NO: 1147216 - RNA, 18 nt, Homo sapiens
gcuaauucagugucacau

SEQ ID NO: 1147217 - RNA, 12 nt, Homo sapiens
gcuacaccuuuc

SEQ ID NO: 1147218 - RNA, 20 nt, Homo sapiens
gcuacaccuuucuccuuugu

SEQ ID NO: 1147219 - RNA, 16 nt, Homo sapiens
gcuacagaaagcacaa

SEQ ID NO: 1147220 - RNA, 22 nt, Homo sapiens
gcuacccgcagaguucucagaa

SEQ ID NO: 1147221 - RNA, 10 nt, Homo sapiens
gcuaccuccc

SEQ ID NO: 1147222 - RNA, 21 nt, Homo sapiens
gcuacuccccagaccucaggg

SEQ ID NO: 1147223 - RNA, 22 nt, Homo sapiens
gcuacuccccagaccucaggga

SEQ ID NO: 1147224 - RNA, 20 nt, Homo sapiens
gcuacucuguuccuucacau

SEQ ID NO: 1147225 - RNA, 17 nt, Homo sapiens
gcuacugaaccagccac

SEQ ID NO: 1147226 - RNA, 23 nt, Homo sapiens
gcuacugccgucagugcugugcu

SEQ ID NO: 1147227 - RNA, 15 nt, Homo sapiens
gcuagaaauaagccc

SEQ ID NO: 1147228 - RNA, 16 nt, Homo sapiens
gcuagaauucuggugu

SEQ ID NO: 1147229 - RNA, 16 nt, Homo sapiens
gcuagacauugcaauu

SEQ ID NO: 1147230 - RNA, 15 nt, Homo sapiens
gcuaggccaucacca

SEQ ID NO: 1147231 - RNA, 15 nt, Homo sapiens
gcuagggaggaccaa

SEQ ID NO: 1147232 - RNA, 15 nt, Homo sapiens
gcuaguguaccuccu

SEQ ID NO: 1147233 - RNA, 19 nt, Homo sapiens
gcuaguguaccuccucuca

SEQ ID NO: 1147234 - RNA, 15 nt, Homo sapiens
gcuauaauaaagaag

SEQ ID NO: 1147235 - RNA, 19 nt, Homo sapiens
gcuaucaagaggcugagac

SEQ ID NO: 1147236 - RNA, 16 nt, Homo sapiens
gcuauccaggauuuug

SEQ ID NO: 1147237 - RNA, 21 nt, Homo sapiens
gcuauccaggauuuuguuucu

SEQ ID NO: 1147238 - RNA, 16 nt, Homo sapiens
gcuaugccugccucaa

SEQ ID NO: 1147239 - RNA, 19 nt, Homo sapiens
gcuauucccuggggcugcu

SEQ ID NO: 1147240 - RNA, 21 nt, Homo sapiens
gcuauuucagcaacaaccauc

SEQ ID NO: 1147241 - RNA, 16 nt, Homo sapiens
gcucaaagagccucac

SEQ ID NO: 1147242 - RNA, 17 nt, Homo sapiens
gcucaaaggcacaguga

SEQ ID NO: 1147243 - RNA, 22 nt, Homo sapiens
gcucaacugaggauguggcuua

SEQ ID NO: 1147244 - RNA, 14 nt, Homo sapiens
gcucaagacggggu

SEQ ID NO: 1147245 - RNA, 12 nt, Homo sapiens
gcucaaugccau

SEQ ID NO: 1147246 - RNA, 17 nt, Homo sapiens
gcucaaugccauugugc

SEQ ID NO: 1147247 - RNA, 17 nt, Homo sapiens
gcucacaggagcuuaaa

SEQ ID NO: 1147248 - RNA, 17 nt, Homo sapiens
gcucacugcagccucaa

SEQ ID NO: 1147249 - RNA, 18 nt, Homo sapiens
gcucagaaggaauggugc

SEQ ID NO: 1147250 - RNA, 14 nt, Homo sapiens
gcucagaccagcuc

SEQ ID NO: 1147251 - RNA, 22 nt, Homo sapiens
gcucagcuucuccugugugauu

SEQ ID NO: 1147252 - RNA, 19 nt, Homo sapiens
gcucaggacagaugccaca

SEQ ID NO: 1147253 - RNA, 14 nt, Homo sapiens
gcucaggacucaga

SEQ ID NO: 1147254 - RNA, 20 nt, Homo sapiens
gcucaggguggucucuucuu

SEQ ID NO: 1147255 - RNA, 12 nt, Homo sapiens
gcucagugcaac

SEQ ID NO: 1147256 - RNA, 17 nt, Homo sapiens
gcucaguucugccuuau

SEQ ID NO: 1147257 - RNA, 13 nt, Homo sapiens
gcucaucauucuc

SEQ ID NO: 1147258 - RNA, 19 nt, Homo sapiens
gcucaugccucuaaucuca

SEQ ID NO: 1147259 - RNA, 12 nt, Homo sapiens
gcucauguuugg

SEQ ID NO: 1147260 - RNA, 16 nt, Homo sapiens
gcuccaaccugcaaag

SEQ ID NO: 1147261 - RNA, 18 nt, Homo sapiens
gcuccagaagauagcuuc

SEQ ID NO: 1147262 - RNA, 17 nt, Homo sapiens
gcuccagcaagcaaaca

SEQ ID NO: 1147263 - RNA, 18 nt, Homo sapiens
gcuccaggauuaggaaau

SEQ ID NO: 1147264 - RNA, 16 nt, Homo sapiens
gcuccagucagugugc

SEQ ID NO: 1147265 - RNA, 23 nt, Homo sapiens
gcuccagucagugugcaggggac

SEQ ID NO: 1147266 - RNA, 15 nt, Homo sapiens
gcuccaugcucuucc

SEQ ID NO: 1147267 - RNA, 13 nt, Homo sapiens
gcuccauguagaa

SEQ ID NO: 1147268 - RNA, 16 nt, Homo sapiens
gcucccaaaacauuuu

SEQ ID NO: 1147269 - RNA, 21 nt, Homo sapiens
gcucccaacucccuucugcuu

SEQ ID NO: 1147270 - RNA, 22 nt, Homo sapiens
gcucccaacucccuucugcuug

SEQ ID NO: 1147271 - RNA, 17 nt, Homo sapiens
gcucccacaaaugacag

SEQ ID NO: 1147272 - RNA, 12 nt, Homo sapiens
gcucccaggugc

SEQ ID NO: 1147273 - RNA, 14 nt, Homo sapiens
gcucccggguccug

SEQ ID NO: 1147274 - RNA, 22 nt, Homo sapiens
gcucccucuauuuauguuugca

SEQ ID NO: 1147275 - RNA, 12 nt, Homo sapiens
gcucccugaacu

SEQ ID NO: 1147276 - RNA, 13 nt, Homo sapiens
gcuccgaccucuc

SEQ ID NO: 1147277 - RNA, 21 nt, Homo sapiens
gcuccgugcuuguuugcucac

SEQ ID NO: 1147278 - RNA, 17 nt, Homo sapiens
gcuccuacuuucaggaa

SEQ ID NO: 1147279 - RNA, 15 nt, Homo sapiens
gcuccucacucaccu

SEQ ID NO: 1147280 - RNA, 14 nt, Homo sapiens
gcuccuccacgccu

SEQ ID NO: 1147281 - RNA, 19 nt, Homo sapiens
caggcucccagggacaccu

SEQ ID NO: 1147282 - RNA, 14 nt, Homo sapiens
caggcucgucauug

SEQ ID NO: 1147283 - RNA, 17 nt, Homo sapiens
caggcugcggugggcag

SEQ ID NO: 1147284 - RNA, 17 nt, Homo sapiens
caggcuggagugcaaug

SEQ ID NO: 1147285 - RNA, 20 nt, Homo sapiens
caggcuggagugcaaugaca

SEQ ID NO: 1147286 - RNA, 20 nt, Homo sapiens
caggcuggagugcaauggca

SEQ ID NO: 1147287 - RNA, 23 nt, Homo sapiens
caggcuggagugcagugagcuau

SEQ ID NO: 1147288 - RNA, 12 nt, Homo sapiens
caggcugggaac

SEQ ID NO: 1147289 - RNA, 20 nt, Homo sapiens
caggcugggcucagcucagc

SEQ ID NO: 1147290 - RNA, 22 nt, Homo sapiens
caggcugggugacagagcgaga

SEQ ID NO: 1147291 - RNA, 20 nt, Homo sapiens
caggcuggucucaaacuccu

SEQ ID NO: 1147292 - RNA, 18 nt, Homo sapiens
caggcuggucuugaacuc

SEQ ID NO: 1147293 - RNA, 15 nt, Homo sapiens
caggcuuaugaauau

SEQ ID NO: 1147294 - RNA, 17 nt, Homo sapiens
caggcuuaugaauauau

SEQ ID NO: 1147295 - RNA, 19 nt, Homo sapiens
cagggaaaauuauuugcau

SEQ ID NO: 1147296 - RNA, 20 nt, Homo sapiens
cagggaaggaacucuggcca

SEQ ID NO: 1147297 - RNA, 14 nt, Homo sapiens
cagggaagggagca

SEQ ID NO: 1147298 - RNA, 14 nt, Homo sapiens
cagggacugugaac

SEQ ID NO: 1147299 - RNA, 21 nt, Homo sapiens
cagggagacgguuuccaggga

SEQ ID NO: 1147300 - RNA, 16 nt, Homo sapiens
cagggcaccugccacc

SEQ ID NO: 1147301 - RNA, 13 nt, Homo sapiens
cagggccagucuu

SEQ ID NO: 1147302 - RNA, 18 nt, Homo sapiens
cagggcgucccugacaga

SEQ ID NO: 1147303 - RNA, 13 nt, Homo sapiens
cagggcugcauug

SEQ ID NO: 1147304 - RNA, 20 nt, Homo sapiens
caggggaauguauuuuucaa

SEQ ID NO: 1147305 - RNA, 23 nt, Homo sapiens
caggggagcccggagcuuugcaa

SEQ ID NO: 1147306 - RNA, 13 nt, Homo sapiens
caggggcccucac

SEQ ID NO: 1147307 - RNA, 15 nt, Homo sapiens
caggggugacacaga

SEQ ID NO: 1147308 - RNA, 21 nt, Homo sapiens
cagggguuugccaaacagccc

SEQ ID NO: 1147309 - RNA, 14 nt, Homo sapiens
cagggucauagcau

SEQ ID NO: 1147310 - RNA, 12 nt, Homo sapiens
cagggugggccu

SEQ ID NO: 1147311 - RNA, 20 nt, Homo sapiens
caggguuucaccauguugcc

SEQ ID NO: 1147312 - RNA, 21 nt, Homo sapiens
caggguuucaccauguugccc

SEQ ID NO: 1147313 - RNA, 20 nt, Homo sapiens
caggguuucaccauguuggc

SEQ ID NO: 1147314 - RNA, 15 nt, Homo sapiens
cagguaauggcauga

SEQ ID NO: 1147315 - RNA, 13 nt, Homo sapiens
cagguaaugugaa

SEQ ID NO: 1147316 - RNA, 14 nt, Homo sapiens
caggucaaaaguca

SEQ ID NO: 1147317 - RNA, 14 nt, Homo sapiens
caggucaacucuga

SEQ ID NO: 1147318 - RNA, 13 nt, Homo sapiens
caggucuguggaa

SEQ ID NO: 1147319 - RNA, 16 nt, Homo sapiens
caggucuucuccaagg

SEQ ID NO: 1147320 - RNA, 15 nt, Homo sapiens
caggugaaacccagu

SEQ ID NO: 1147321 - RNA, 20 nt, Homo sapiens
caggugaaacccagucacug

SEQ ID NO: 1147322 - RNA, 17 nt, Homo sapiens
caggugauaauggaucc

SEQ ID NO: 1147323 - RNA, 17 nt, Homo sapiens
caggugauccaccugcc

SEQ ID NO: 1147324 - RNA, 21 nt, Homo sapiens
caggugcagccagaggcaccu

SEQ ID NO: 1147325 - RNA, 21 nt, Homo sapiens
caggugggguggagucccaga

SEQ ID NO: 1147326 - RNA, 20 nt, Homo sapiens
caggugugagccaccacucc

SEQ ID NO: 1147327 - RNA, 13 nt, Homo sapiens
caggugugcacca

SEQ ID NO: 1147328 - RNA, 22 nt, Homo sapiens
cagguuugcaccuaagugugua

SEQ ID NO: 1147329 - RNA, 15 nt, Homo sapiens
caguaaaauaauaau

SEQ ID NO: 1147330 - RNA, 18 nt, Homo sapiens
caguacaggcagcacaga

SEQ ID NO: 1147331 - RNA, 15 nt, Homo sapiens
caguaccugugccug

SEQ ID NO: 1147332 - RNA, 20 nt, Homo sapiens
caguacuucagcaagagaga

SEQ ID NO: 1147333 - RNA, 23 nt, Homo sapiens
caguacuugucuucaccaacacu

SEQ ID NO: 1147334 - RNA, 14 nt, Homo sapiens
caguagaugccacc

SEQ ID NO: 1147335 - RNA, 15 nt, Homo sapiens
caguagcacaaguua

SEQ ID NO: 1147336 - RNA, 19 nt, Homo sapiens
caguagccaaggcccgggg

SEQ ID NO: 1147337 - RNA, 19 nt, Homo sapiens
caguagccguuugugguuu

SEQ ID NO: 1147338 - RNA, 18 nt, Homo sapiens
caguauaaagggacuuga

SEQ ID NO: 1147339 - RNA, 20 nt, Homo sapiens
caguauccacaauagcugac

SEQ ID NO: 1147340 - RNA, 15 nt, Homo sapiens
caguaugcuugcucu

SEQ ID NO: 1147341 - RNA, 15 nt, Homo sapiens
caguauguuuacuau

SEQ ID NO: 1147342 - RNA, 13 nt, Homo sapiens
cagucaaccuggg

SEQ ID NO: 1147343 - RNA, 13 nt, Homo sapiens
cagucacagccac

SEQ ID NO: 1147344 - RNA, 22 nt, Homo sapiens
cagucacccagggcgucccuga

SEQ ID NO: 1147345 - RNA, 13 nt, Homo sapiens
cagucacugugag

SEQ ID NO: 1147346 - RNA, 13 nt, Homo sapiens
cagucagauuuau

SEQ ID NO: 1147347 - RNA, 14 nt, Homo sapiens
caguccacugcuga

SEQ ID NO: 1147348 - RNA, 16 nt, Homo sapiens
caguccauuuccuaau

SEQ ID NO: 1147349 - RNA, 21 nt, Homo sapiens
cagucccagcuaacucugacc

SEQ ID NO: 1147350 - RNA, 22 nt, Homo sapiens
cagucccagcuaacucugaccu

SEQ ID NO: 1147351 - RNA, 15 nt, Homo sapiens
cagucccaugaccuu

SEQ ID NO: 1147352 - RNA, 20 nt, Homo sapiens
cagucccuauguauuugcag

SEQ ID NO: 1147353 - RNA, 19 nt, Homo sapiens
caguccucccagacuaccu

SEQ ID NO: 1147354 - RNA, 15 nt, Homo sapiens
caguccuuaauguca

SEQ ID NO: 1147355 - RNA, 16 nt, Homo sapiens
caguccuuaaugucac

SEQ ID NO: 1147356 - RNA, 14 nt, Homo sapiens
cagucuaaagaaga

SEQ ID NO: 1147357 - RNA, 13 nt, Homo sapiens
cagucuagugcaa

SEQ ID NO: 1147358 - RNA, 13 nt, Homo sapiens
cagucucacuuug

SEQ ID NO: 1147359 - RNA, 23 nt, Homo sapiens
cagucucauauuuaguauugaau

SEQ ID NO: 1147360 - RNA, 19 nt, Homo sapiens
cagucuuggcucacugcaa

SEQ ID NO: 1147361 - RNA, 14 nt, Homo sapiens
cagucuuucuauca

SEQ ID NO: 1147362 - RNA, 21 nt, Homo sapiens
cagugaaagcugacaucugua

SEQ ID NO: 1147363 - RNA, 19 nt, Homo sapiens
cagugaauuuuugcaauaa

SEQ ID NO: 1147364 - RNA, 10 nt, Homo sapiens
cagugacacc

SEQ ID NO: 1147365 - RNA, 16 nt, Homo sapiens
cagugacacuggacca

SEQ ID NO: 1147366 - RNA, 20 nt, Homo sapiens
cagugagccaagauugcgcc

SEQ ID NO: 1147367 - RNA, 20 nt, Homo sapiens
cagugagccgagaucgugcc

SEQ ID NO: 1147368 - RNA, 22 nt, Homo sapiens
cagugagccgcaucuucuccau

SEQ ID NO: 1147369 - RNA, 15 nt, Homo sapiens
cagugagugcugcuc

SEQ ID NO: 1147370 - RNA, 21 nt, Homo sapiens
cagugaguggccccaccugug

SEQ ID NO: 1147371 - RNA, 23 nt, Homo sapiens
ccuguggugaugugccuguaauc

SEQ ID NO: 1147372 - RNA, 18 nt, Homo sapiens
ccuguguauucauucuca

SEQ ID NO: 1147373 - RNA, 16 nt, Homo sapiens
ccuguucugugacugu

SEQ ID NO: 1147374 - RNA, 18 nt, Homo sapiens
ccuguucuugaggucucu

SEQ ID NO: 1147375 - RNA, 14 nt, Homo sapiens
ccuguucuuucuua

SEQ ID NO: 1147376 - RNA, 16 nt, Homo sapiens
ccuguuuauugccauu

SEQ ID NO: 1147377 - RNA, 17 nt, Homo sapiens
ccuguuucaaucacugu

SEQ ID NO: 1147378 - RNA, 16 nt, Homo sapiens
ccuuaaaaaugcacac

SEQ ID NO: 1147379 - RNA, 17 nt, Homo sapiens
ccuuaaagauacuugaa

SEQ ID NO: 1147380 - RNA, 18 nt, Homo sapiens
ccuuaaaugcuacugaaa

SEQ ID NO: 1147381 - RNA, 17 nt, Homo sapiens
ccuuaccuuuaccccau

SEQ ID NO: 1147382 - RNA, 17 nt, Homo sapiens
ccuuacgugauuguuag

SEQ ID NO: 1147383 - RNA, 21 nt, Homo sapiens
ccuuacuccugguucagugcc

SEQ ID NO: 1147384 - RNA, 20 nt, Homo sapiens
ccuuacugagcgcaagccac

SEQ ID NO: 1147385 - RNA, 18 nt, Homo sapiens
ccuuagaaauuagugcca

SEQ ID NO: 1147386 - RNA, 23 nt, Homo sapiens
ccuuagauguucuaagucuuucc

SEQ ID NO: 1147387 - RNA, 13 nt, Homo sapiens
ccuuauacaucac

SEQ ID NO: 1147388 - RNA, 15 nt, Homo sapiens
ccuuaucagugccau

SEQ ID NO: 1147389 - RNA, 15 nt, Homo sapiens
ccuuaugacuuuuca

SEQ ID NO: 1147390 - RNA, 21 nt, Homo sapiens
ccuuauuucucaucacaucau

SEQ ID NO: 1147391 - RNA, 15 nt, Homo sapiens
ccuucaauuccauau

SEQ ID NO: 1147392 - RNA, 20 nt, Homo sapiens
ccuucacaaagcccaaggga

SEQ ID NO: 1147393 - RNA, 20 nt, Homo sapiens
ccuucacuggcgccuucucg

SEQ ID NO: 1147394 - RNA, 19 nt, Homo sapiens
ccuucacugugcuccaacc

SEQ ID NO: 1147395 - RNA, 13 nt, Homo sapiens
ccuucagagccag

SEQ ID NO: 1147396 - RNA, 19 nt, Homo sapiens
ccuucaucuucacugcaau

SEQ ID NO: 1147397 - RNA, 19 nt, Homo sapiens
ccuuccacggauccaugua

SEQ ID NO: 1147398 - RNA, 12 nt, Homo sapiens
ccuuccacugag

SEQ ID NO: 1147399 - RNA, 21 nt, Homo sapiens
ccuuccccagacuugcacugg

SEQ ID NO: 1147400 - RNA, 15 nt, Homo sapiens
ccuuccccucucuca

SEQ ID NO: 1147401 - RNA, 16 nt, Homo sapiens
ccuuccuuaugucucc

SEQ ID NO: 1147402 - RNA, 14 nt, Homo sapiens
ccuuccuugccagu

SEQ ID NO: 1147403 - RNA, 15 nt, Homo sapiens
ccuucuaggucacuu

SEQ ID NO: 1147404 - RNA, 17 nt, Homo sapiens
ccuucucugugcaguag

SEQ ID NO: 1147405 - RNA, 18 nt, Homo sapiens
ccuucucuuuaaucucau

SEQ ID NO: 1147406 - RNA, 22 nt, Homo sapiens
ccuucuggugccagauccucuu

SEQ ID NO: 1147407 - RNA, 13 nt, Homo sapiens
ccuucuggugucu

SEQ ID NO: 1147408 - RNA, 20 nt, Homo sapiens
ccuugacaaagucaagccac

SEQ ID NO: 1147409 - RNA, 14 nt, Homo sapiens
ccuugauauuugua

SEQ ID NO: 1147410 - RNA, 14 nt, Homo sapiens
ccuugauucacaau

SEQ ID NO: 1147411 - RNA, 21 nt, Homo sapiens
ccuugcaaucuucuacuuuaa

SEQ ID NO: 1147412 - RNA, 13 nt, Homo sapiens
ccuugcaccugca

SEQ ID NO: 1147413 - RNA, 20 nt, Homo sapiens
ccuugcaucaaggggucacu

SEQ ID NO: 1147414 - RNA, 13 nt, Homo sapiens
ccuugccaucaca

SEQ ID NO: 1147415 - RNA, 14 nt, Homo sapiens
ccuugcccagagau

SEQ ID NO: 1147416 - RNA, 14 nt, Homo sapiens
ccuugcugacucuc

SEQ ID NO: 1147417 - RNA, 16 nt, Homo sapiens
ccuuggcagcccugau

SEQ ID NO: 1147418 - RNA, 21 nt, Homo sapiens
ccuugggccuuucagucccaa

SEQ ID NO: 1147419 - RNA, 17 nt, Homo sapiens
ccuugguaugugccagg

SEQ ID NO: 1147420 - RNA, 13 nt, Homo sapiens
ccuugguucucau

SEQ ID NO: 1147421 - RNA, 14 nt, Homo sapiens
ccuugugucuguac

SEQ ID NO: 1147422 - RNA, 19 nt, Homo sapiens
ccuuguuauuuaacccauu

SEQ ID NO: 1147423 - RNA, 17 nt, Homo sapiens
ccuuguuccaauuugac

SEQ ID NO: 1147424 - RNA, 15 nt, Homo sapiens
ccuuguuuugccagu

SEQ ID NO: 1147425 - RNA, 21 nt, Homo sapiens
ccuuuaaaaauaugcaccaaa

SEQ ID NO: 1147426 - RNA, 19 nt, Homo sapiens
ccuuuaauauuuccaaugu

SEQ ID NO: 1147427 - RNA, 18 nt, Homo sapiens
ccuuuacuccuggcucaa

SEQ ID NO: 1147428 - RNA, 14 nt, Homo sapiens
ccuuuaucaccuca

SEQ ID NO: 1147429 - RNA, 18 nt, Homo sapiens
ccuuuaucaccucauucu

SEQ ID NO: 1147430 - RNA, 20 nt, Homo sapiens
ccuuuauuaaaaacugagug

SEQ ID NO: 1147431 - RNA, 23 nt, Homo sapiens
ccuuuauugucuugguugccagu

SEQ ID NO: 1147432 - RNA, 20 nt, Homo sapiens
ccuuucauaaagucuugccu

SEQ ID NO: 1147433 - RNA, 19 nt, Homo sapiens
ccuuucauggucugcugag

SEQ ID NO: 1147434 - RNA, 13 nt, Homo sapiens
ccuuuccauuuau

SEQ ID NO: 1147435 - RNA, 18 nt, Homo sapiens
ccuuucuucagacacuga

SEQ ID NO: 1147436 - RNA, 11 nt, Homo sapiens
ccuuugaucuu

SEQ ID NO: 1147437 - RNA, 17 nt, Homo sapiens
ccuuugauuuuuugccc

SEQ ID NO: 1147438 - RNA, 22 nt, Homo sapiens
ccuuugcuacuacuaugugcag

SEQ ID NO: 1147439 - RNA, 11 nt, Homo sapiens
ccuuugcugcc

SEQ ID NO: 1147440 - RNA, 16 nt, Homo sapiens
ccuuugggcccagcgg

SEQ ID NO: 1147441 - RNA, 14 nt, Homo sapiens
ccuuuguacuuugu

SEQ ID NO: 1147442 - RNA, 21 nt, Homo sapiens
gcugagauugcaccacugcac

SEQ ID NO: 1147443 - RNA, 14 nt, Homo sapiens
gcugagcgccagga

SEQ ID NO: 1147444 - RNA, 19 nt, Homo sapiens
gcugagcucccagaccccc

SEQ ID NO: 1147445 - RNA, 14 nt, Homo sapiens
gcugaggacacuca

SEQ ID NO: 1147446 - RNA, 22 nt, Homo sapiens
gcugagucccuccaugcaaaag

SEQ ID NO: 1147447 - RNA, 14 nt, Homo sapiens
gcugagugaguuca

SEQ ID NO: 1147448 - RNA, 13 nt, Homo sapiens
gcugaucaaugaa

SEQ ID NO: 1147449 - RNA, 14 nt, Homo sapiens
gcugaucaguuuuu

SEQ ID NO: 1147450 - RNA, 14 nt, Homo sapiens
gcugauuaccugaa

SEQ ID NO: 1147451 - RNA, 17 nt, Homo sapiens
gcugauugggcaccuga

SEQ ID NO: 1147452 - RNA, 17 nt, Homo sapiens
gcugcacugaugcugcc

SEQ ID NO: 1147453 - RNA, 14 nt, Homo sapiens
gcugcagagcagug

SEQ ID NO: 1147454 - RNA, 14 nt, Homo sapiens
gcugcagucaucua

SEQ ID NO: 1147455 - RNA, 18 nt, Homo sapiens
gcugcaucccccccaccu

SEQ ID NO: 1147456 - RNA, 17 nt, Homo sapiens
gcugcauucccaugagc

SEQ ID NO: 1147457 - RNA, 20 nt, Homo sapiens
gcugccaagccccauccugc

SEQ ID NO: 1147458 - RNA, 14 nt, Homo sapiens
gcugccauccaugu

SEQ ID NO: 1147459 - RNA, 17 nt, Homo sapiens
gcugcccuggguccugc

SEQ ID NO: 1147460 - RNA, 16 nt, Homo sapiens
gcugccucaacacuga

SEQ ID NO: 1147461 - RNA, 16 nt, Homo sapiens
gcugccucccaucuca

SEQ ID NO: 1147462 - RNA, 16 nt, Homo sapiens
gcugccucuaccugac

SEQ ID NO: 1147463 - RNA, 19 nt, Homo sapiens
gcugccucuaccugacacu

SEQ ID NO: 1147464 - RNA, 21 nt, Homo sapiens
gcugccugcccguaaacacgc

SEQ ID NO: 1147465 - RNA, 21 nt, Homo sapiens
gcugccuggccuuguccucag

SEQ ID NO: 1147466 - RNA, 19 nt, Homo sapiens
gcugccuuuggacuugucc

SEQ ID NO: 1147467 - RNA, 20 nt, Homo sapiens
gcugcggggggcaccagagg

SEQ ID NO: 1147468 - RNA, 13 nt, Homo sapiens
gcugcucagggaa

SEQ ID NO: 1147469 - RNA, 19 nt, Homo sapiens
gcugcucauacuggucuca

SEQ ID NO: 1147470 - RNA, 16 nt, Homo sapiens
gcugcuccucugacuu

SEQ ID NO: 1147471 - RNA, 14 nt, Homo sapiens
gcugcugaccucca

SEQ ID NO: 1147472 - RNA, 12 nt, Homo sapiens
gcugcugccagg

SEQ ID NO: 1147473 - RNA, 12 nt, Homo sapiens
gcugcugcucau

SEQ ID NO: 1147474 - RNA, 21 nt, Homo sapiens
gcugcuggggccucagacgag

SEQ ID NO: 1147475 - RNA, 18 nt, Homo sapiens
gcugcuuuccaaagccaa

SEQ ID NO: 1147476 - RNA, 15 nt, Homo sapiens
gcuggaggcacccau

SEQ ID NO: 1147477 - RNA, 21 nt, Homo sapiens
gcuggagguugagcucuucuu

SEQ ID NO: 1147478 - RNA, 20 nt, Homo sapiens
gcuggaguacagugguguga

SEQ ID NO: 1147479 - RNA, 20 nt, Homo sapiens
gcuggagugcaaugguguga

SEQ ID NO: 1147480 - RNA, 20 nt, Homo sapiens
gcuggagugcaguggugcaa

SEQ ID NO: 1147481 - RNA, 22 nt, Homo sapiens
gcuggagugcaguggugcaauc

SEQ ID NO: 1147482 - RNA, 18 nt, Homo sapiens
gcuggagugcaguggugu

SEQ ID NO: 1147483 - RNA, 18 nt, Homo sapiens
gcuggcaaccacuaagaa

SEQ ID NO: 1147484 - RNA, 15 nt, Homo sapiens
gcuggccagauuucc

SEQ ID NO: 1147485 - RNA, 15 nt, Homo sapiens
gcuggccagugcugc

SEQ ID NO: 1147486 - RNA, 15 nt, Homo sapiens
gcuggcccgugacag

SEQ ID NO: 1147487 - RNA, 19 nt, Homo sapiens
gcugggaaauucaugugga

SEQ ID NO: 1147488 - RNA, 13 nt, Homo sapiens
gcugggaaccuca

SEQ ID NO: 1147489 - RNA, 16 nt, Homo sapiens
gcugggacguggcuca

SEQ ID NO: 1147490 - RNA, 23 nt, Homo sapiens
gcugggacguggcucagccagca

SEQ ID NO: 1147491 - RNA, 20 nt, Homo sapiens
gcugggaugcugguggcucu

SEQ ID NO: 1147492 - RNA, 18 nt, Homo sapiens
gcugggcaugguggcgca

SEQ ID NO: 1147493 - RNA, 16 nt, Homo sapiens
gcugggccaccagcca

SEQ ID NO: 1147494 - RNA, 18 nt, Homo sapiens
gcugggccucuucugccu

SEQ ID NO: 1147495 - RNA, 17 nt, Homo sapiens
gcugggggagggacugc

SEQ ID NO: 1147496 - RNA, 15 nt, Homo sapiens
gcuggguccagggga

SEQ ID NO: 1147497 - RNA, 23 nt, Homo sapiens
gcuggguccuugggccuggccag

SEQ ID NO: 1147498 - RNA, 17 nt, Homo sapiens
gcugggugggcaucuca

SEQ ID NO: 1147499 - RNA, 17 nt, Homo sapiens
gcugguaaucuugcucu

SEQ ID NO: 1147500 - RNA, 23 nt, Homo sapiens
gcuggucccggggccagcacuuc

SEQ ID NO: 1147501 - RNA, 20 nt, Homo sapiens
gcuggucucaaacuccugac

SEQ ID NO: 1147502 - RNA, 18 nt, Homo sapiens
gcuggucuugaacuccug

SEQ ID NO: 1147503 - RNA, 15 nt, Homo sapiens
gcugguggugcugca

SEQ ID NO: 1147504 - RNA, 16 nt, Homo sapiens
gcugucaucugugcac

SEQ ID NO: 1147505 - RNA, 18 nt, Homo sapiens
gcugucaucugugcacug

SEQ ID NO: 1147506 - RNA, 16 nt, Homo sapiens
gcuguccuuacccauc

SEQ ID NO: 1147507 - RNA, 16 nt, Homo sapiens
gcugucgacuucauga

SEQ ID NO: 1147508 - RNA, 20 nt, Homo sapiens
gcugucuauguggcuguauc

SEQ ID NO: 1147509 - RNA, 15 nt, Homo sapiens
gcugucucaucccca

SEQ ID NO: 1147510 - RNA, 15 nt, Homo sapiens
gcugugcgcuccccc

SEQ ID NO: 1147511 - RNA, 16 nt, Homo sapiens
gcuguggcauccagag

SEQ ID NO: 1147512 - RNA, 22 nt, Homo sapiens
gcugugugagaccaggggacca

SEQ ID NO: 1147513 - RNA, 18 nt, Homo sapiens
gcuguguggaaccaccug

SEQ ID NO: 1147514 - RNA, 19 nt, Homo sapiens
gcuguguuguugcuucuug

SEQ ID NO: 1147515 - RNA, 18 nt, Homo sapiens
gcuguucucauuccuguu

SEQ ID NO: 1147516 - RNA, 18 nt, Homo sapiens
gcuguucucugucgugag

SEQ ID NO: 1147517 - RNA, 15 nt, Homo sapiens
gcuuaacccuggaaa

SEQ ID NO: 1147518 - RNA, 20 nt, Homo sapiens
gcuuaagggaauaugcauug

SEQ ID NO: 1147519 - RNA, 20 nt, Homo sapiens
gcuuaagugccuaugggaau

SEQ ID NO: 1147520 - RNA, 18 nt, Homo sapiens
gcuuacaggcauggacau

SEQ ID NO: 1147521 - RNA, 21 nt, Homo sapiens
gcuuaccagaagcuuccauag

SEQ ID NO: 1147522 - RNA, 18 nt, Homo sapiens
gcuuacuaugaccuucca

SEQ ID NO: 1147523 - RNA, 19 nt, Homo sapiens
gcuuagaaugcaucucauc

SEQ ID NO: 1147524 - RNA, 20 nt, Homo sapiens
gcuuaggaaagaacaucacu

SEQ ID NO: 1147525 - RNA, 15 nt, Homo sapiens
gcuuaggcauucuaa

SEQ ID NO: 1147526 - RNA, 23 nt, Homo sapiens
gcuuaguccaauuccuugcacau

SEQ ID NO: 1147527 - RNA, 20 nt, Homo sapiens
gcuuauaaauggcaccacau

SEQ ID NO: 1147528 - RNA, 16 nt, Homo sapiens
gcuuauaagacaauga

SEQ ID NO: 1147529 - RNA, 23 nt, Homo sapiens
gcuuaucucccugcuucauaucu

SEQ ID NO: 1147530 - RNA, 19 nt, Homo sapiens
gcuuauggcaucucauuga

SEQ ID NO: 1147531 - RNA, 22 nt, Homo sapiens
gcuuauucuuuccuucuuucau

SEQ ID NO: 1147532 - RNA, 18 nt, Homo sapiens
gcuucagguccaggcugu

SEQ ID NO: 1147533 - RNA, 13 nt, Homo sapiens
gcuucagugcugc

SEQ ID NO: 1147534 - RNA, 15 nt, Homo sapiens
gcuuccaugauucua

SEQ ID NO: 1147535 - RNA, 19 nt, Homo sapiens
gcuucccuacuccuacccu

SEQ ID NO: 1147536 - RNA, 15 nt, Homo sapiens
gcuucgcggucuguu

SEQ ID NO: 1147537 - RNA, 14 nt, Homo sapiens
gcuucuaguuugca

SEQ ID NO: 1147538 - RNA, 20 nt, Homo sapiens
gcuucuccaauucugcccaa

SEQ ID NO: 1147539 - RNA, 16 nt, Homo sapiens
gcuucuccugugugau

SEQ ID NO: 1147540 - RNA, 21 nt, Homo sapiens
gcuucugcguccaccaggccu

SEQ ID NO: 1147541 - RNA, 12 nt, Homo sapiens
gcuugaaccugg

SEQ ID NO: 1147542 - RNA, 15 nt, Homo sapiens
gcuugagccuuugac

SEQ ID NO: 1147543 - RNA, 16 nt, Homo sapiens
gcuugcaauguaguca

SEQ ID NO: 1147544 - RNA, 19 nt, Homo sapiens
gcuugcagugaaguguucu

SEQ ID NO: 1147545 - RNA, 23 nt, Homo sapiens
gcuugccugcagggccauggcuc

SEQ ID NO: 1147546 - RNA, 21 nt, Homo sapiens
gcuuguaaaauuucacuuaau

SEQ ID NO: 1147547 - RNA, 16 nt, Homo sapiens
gcuuguugugcuuuua

SEQ ID NO: 1147548 - RNA, 19 nt, Homo sapiens
gcuuuauaccccauuugau

SEQ ID NO: 1147549 - RNA, 16 nt, Homo sapiens
gcuuucauccuguguc

SEQ ID NO: 1147550 - RNA, 20 nt, Homo sapiens
gcuuucauguaaacugugca

SEQ ID NO: 1147551 - RNA, 20 nt, Homo sapiens
gcuuuccccauuccuaccca

SEQ ID NO: 1147552 - RNA, 17 nt, Homo sapiens
gcuuugaguuaacucac

SEQ ID NO: 1147553 - RNA, 17 nt, Homo sapiens
gcuuuggaaaggugccc

SEQ ID NO: 1147554 - RNA, 16 nt, Homo sapiens
gcuuuggauuugacau

SEQ ID NO: 1147555 - RNA, 15 nt, Homo sapiens
gcuuuggcaacagaa

SEQ ID NO: 1147556 - RNA, 20 nt, Homo sapiens
gcuuuggugagaaccugggu

SEQ ID NO: 1147557 - RNA, 14 nt, Homo sapiens
gcuuuguugcugga

SEQ ID NO: 1147558 - RNA, 15 nt, Homo sapiens
gcuuuguuucugcau

SEQ ID NO: 1147559 - RNA, 12 nt, Homo sapiens
gcuuuugaacug

SEQ ID NO: 1147560 - RNA, 16 nt, Homo sapiens
gcuuuugcuugcaaug

SEQ ID NO: 1147561 - RNA, 22 nt, Homo sapiens
ggaaaaaauaacaaugaaaguu

SEQ ID NO: 1147562 - RNA, 18 nt, Homo sapiens
ggaaaaacuugugcuaua

SEQ ID NO: 1147563 - RNA, 20 nt, Homo sapiens
ggaaaaagaaagaaacacuc

SEQ ID NO: 1147564 - RNA, 15 nt, Homo sapiens
ggaaaaaugaacugu

SEQ ID NO: 1147565 - RNA, 15 nt, Homo sapiens
ggaaaacuaccugua

SEQ ID NO: 1147566 - RNA, 17 nt, Homo sapiens
ggaaaagaaacacgcac

SEQ ID NO: 1147567 - RNA, 16 nt, Homo sapiens
ggaaaagauacccaaa

SEQ ID NO: 1147568 - RNA, 15 nt, Homo sapiens
ggaaaagccaucuca

SEQ ID NO: 1147569 - RNA, 19 nt, Homo sapiens
ggaaaagggucuugggaaa

SEQ ID NO: 1147570 - RNA, 18 nt, Homo sapiens
ggaaaaugcacacauuuc

SEQ ID NO: 1147571 - RNA, 15 nt, Homo sapiens
ggaaaauuugacauu

SEQ ID NO: 1147572 - RNA, 22 nt, Homo sapiens
ggaaacaaauuacguacuagag

SEQ ID NO: 1147573 - RNA, 23 nt, Homo sapiens
ggaaacaauauaaccacaaagca

SEQ ID NO: 1147574 - RNA, 17 nt, Homo sapiens
ggaaacgucucccagau

SEQ ID NO: 1147575 - RNA, 22 nt, Homo sapiens
ggaaacucaaaucgaauaggga

SEQ ID NO: 1147576 - RNA, 14 nt, Homo sapiens
ggaaagaugcauuu

SEQ ID NO: 1147577 - RNA, 18 nt, Homo sapiens
ggaaagcagucuguucug

SEQ ID NO: 1147578 - RNA, 18 nt, Homo sapiens
ggaaagcauuuucucuca

SEQ ID NO: 1147579 - RNA, 19 nt, Homo sapiens
ggaaaggaauccacaucau

SEQ ID NO: 1147580 - RNA, 23 nt, Homo sapiens
ggaaaggccuguggggagccgag

SEQ ID NO: 1147581 - RNA, 23 nt, Homo sapiens
ggaaauagcccuguaacaggcuu

SEQ ID NO: 1147582 - RNA, 17 nt, Homo sapiens
ggaaauguguguauuua

SEQ ID NO: 1147583 - RNA, 20 nt, Homo sapiens
ggaaauugggacuaguuuau

SEQ ID NO: 1147584 - RNA, 12 nt, Homo sapiens
ggaacaaccaga

SEQ ID NO: 1147585 - RNA, 16 nt, Homo sapiens
ggaacaauguuugaua

SEQ ID NO: 1147586 - RNA, 19 nt, Homo sapiens
ggaacacaaacacauuguu

SEQ ID NO: 1147587 - RNA, 18 nt, Homo sapiens
ggaacacauaagaacugu

SEQ ID NO: 1147588 - RNA, 21 nt, Homo sapiens
ggaacacuagacaagccagaa

SEQ ID NO: 1147589 - RNA, 11 nt, Homo sapiens
ggaacagggaa

SEQ ID NO: 1147590 - RNA, 14 nt, Homo sapiens
ggaacccagacuca

SEQ ID NO: 1147591 - RNA, 18 nt, Homo sapiens
ggaacccagacucagaca

SEQ ID NO: 1147592 - RNA, 22 nt, Homo sapiens
ggaaccucagccuggccagaca

SEQ ID NO: 1147593 - RNA, 17 nt, Homo sapiens
ggaaccucgaguacugu

SEQ ID NO: 1147594 - RNA, 22 nt, Homo sapiens
ggaacuaacacgugaugugaua

SEQ ID NO: 1147595 - RNA, 21 nt, Homo sapiens
ggaagaaagcuaaucuguuua

SEQ ID NO: 1147596 - RNA, 21 nt, Homo sapiens
ggaagauggagcucccccauc

SEQ ID NO: 1147597 - RNA, 14 nt, Homo sapiens
ggaagccaaagagu

SEQ ID NO: 1147598 - RNA, 19 nt, Homo sapiens
ggaagccaaaguauucaua

SEQ ID NO: 1147599 - RNA, 22 nt, Homo sapiens
ggaagcccccaaguugauauuu

SEQ ID NO: 1147600 - RNA, 14 nt, Homo sapiens
ggaagccucugggu

SEQ ID NO: 1147601 - RNA, 14 nt, Homo sapiens
ggaagccuguggug

SEQ ID NO: 1147602 - RNA, 22 nt, Homo sapiens
ggaaggaggccaagcagugccu

SEQ ID NO: 1147603 - RNA, 22 nt, Homo sapiens
ggaaggugaccgcccagcucuc

SEQ ID NO: 1147604 - RNA, 15 nt, Homo sapiens
ggaaggugugugaac

SEQ ID NO: 1147605 - RNA, 23 nt, Homo sapiens
ggaagguuaugcuccuggcacag

SEQ ID NO: 1147606 - RNA, 19 nt, Homo sapiens
ggaaguaaccauuugcacu

SEQ ID NO: 1147607 - RNA, 16 nt, Homo sapiens
ggaagucccucagagg

SEQ ID NO: 1147608 - RNA, 18 nt, Homo sapiens
ggaagugacauuguguca

SEQ ID NO: 1147609 - RNA, 17 nt, Homo sapiens
ggaagugaggaagccag

SEQ ID NO: 1147610 - RNA, 19 nt, Homo sapiens
ggaauaauagacacugggg

SEQ ID NO: 1147611 - RNA, 23 nt, Homo sapiens
ggaauaauuaagauuguuucaga

SEQ ID NO: 1147612 - RNA, 13 nt, Homo sapiens
ggaauaugcauug

SEQ ID NO: 1147613 - RNA, 13 nt, Homo sapiens
ggaauauuuccau

SEQ ID NO: 1147614 - RNA, 11 nt, Homo sapiens
ggaauauuugc

SEQ ID NO: 1147615 - RNA, 15 nt, Homo sapiens
ggaaucccacuguau

SEQ ID NO: 1147616 - RNA, 14 nt, Homo sapiens
ggaaucgacuguau

SEQ ID NO: 1147617 - RNA, 20 nt, Homo sapiens
ggaaugguuauaaaagugau

SEQ ID NO: 1147618 - RNA, 19 nt, Homo sapiens
ggaaugugggucugcaccu

SEQ ID NO: 1147619 - RNA, 23 nt, Homo sapiens
ggaauuacaaaacucagagaaau

SEQ ID NO: 1147620 - RNA, 23 nt, Homo sapiens
ggaauucuuuacaauaaacauag

SEQ ID NO: 1147621 - RNA, 21 nt, Homo sapiens
ggacaacucagucccuaaaaa

SEQ ID NO: 1147622 - RNA, 17 nt, Homo sapiens
ggacacacggucagggu

SEQ ID NO: 1147623 - RNA, 12 nt, Homo sapiens
ggacacccucac

SEQ ID NO: 1147624 - RNA, 16 nt, Homo sapiens
ggacacuucucaggaa

SEQ ID NO: 1147625 - RNA, 14 nt, Homo sapiens
ggacagacuggccg

SEQ ID NO: 1147626 - RNA, 17 nt, Homo sapiens
ggacaguugauuuccaa

SEQ ID NO: 1147627 - RNA, 16 nt, Homo sapiens
ggacaugcccugugug

SEQ ID NO: 1147628 - RNA, 19 nt, Homo sapiens
ggacaugcuucagugcugc

SEQ ID NO: 1147629 - RNA, 15 nt, Homo sapiens
ggacauucuaaggga

SEQ ID NO: 1147630 - RNA, 12 nt, Homo sapiens
ggaccacugcau

SEQ ID NO: 1147631 - RNA, 12 nt, Homo sapiens
ggaccagugagu

SEQ ID NO: 1147632 - RNA, 16 nt, Homo sapiens
ggaccaugaaacauug

SEQ ID NO: 1147633 - RNA, 20 nt, Homo sapiens
ggaccaugcgacacugggag

SEQ ID NO: 1147634 - RNA, 18 nt, Homo sapiens
ggaccauggggagguggc

SEQ ID NO: 1147635 - RNA, 23 nt, Homo sapiens
ggacccagggagaggcugugucc

SEQ ID NO: 1147636 - RNA, 21 nt, Homo sapiens
ggaccccaccccucaucagga

SEQ ID NO: 1147637 - RNA, 22 nt, Homo sapiens
ggaccccaccccucaucaggag

SEQ ID NO: 1147638 - RNA, 22 nt, Homo sapiens
ggaccccagcauuuaagugacc

SEQ ID NO: 1147639 - RNA, 14 nt, Homo sapiens
ggaccccugcccuu

SEQ ID NO: 1147640 - RNA, 22 nt, Homo sapiens
ggaccugccaaugauuccagac

SEQ ID NO: 1147641 - RNA, 16 nt, Homo sapiens
ggaccuggcaguggug

SEQ ID NO: 1147642 - RNA, 23 nt, Homo sapiens
ggacgccuguuguuuuggcucaa

SEQ ID NO: 1147643 - RNA, 17 nt, Homo sapiens
ggacguggguugcacug

SEQ ID NO: 1147644 - RNA, 17 nt, Homo sapiens
ggacuacauuuugcucu

SEQ ID NO: 1147645 - RNA, 23 nt, Homo sapiens
ggacuacauuuugcucugugaac

SEQ ID NO: 1147646 - RNA, 12 nt, Homo sapiens
ggacuaugacaa

SEQ ID NO: 1147647 - RNA, 11 nt, Homo sapiens
ggacucagaga

SEQ ID NO: 1147648 - RNA, 14 nt, Homo sapiens
ggacucagagaaaa

SEQ ID NO: 1147649 - RNA, 23 nt, Homo sapiens
ggacucagcucugucugcucaau

SEQ ID NO: 1147650 - RNA, 18 nt, Homo sapiens
ggacuccaucuccugacc

SEQ ID NO: 1147651 - RNA, 23 nt, Homo sapiens
ggacuccaucucucauccuccag

SEQ ID NO: 1147652 - RNA, 22 nt, Homo sapiens
ggacuccauuucuuucuuccau

SEQ ID NO: 1147653 - RNA, 20 nt, Homo sapiens
ggacucgccuguaaucucac

SEQ ID NO: 1147654 - RNA, 21 nt, Homo sapiens
ggacugauucuguuguguuca

SEQ ID NO: 1147655 - RNA, 23 nt, Homo sapiens
ggacugggcaaagaugauguuuc

SEQ ID NO: 1147656 - RNA, 18 nt, Homo sapiens
ggacugugccagcacaaa

SEQ ID NO: 1147657 - RNA, 19 nt, Homo sapiens
ggacuguguggaccaagga

SEQ ID NO: 1147658 - RNA, 14 nt, Homo sapiens
ggagaaacacuuga

SEQ ID NO: 1147659 - RNA, 19 nt, Homo sapiens
ggagaacaugaaucaaaag

SEQ ID NO: 1147660 - RNA, 19 nt, Homo sapiens
ggagaacuaaagguggcca

SEQ ID NO: 1147661 - RNA, 23 nt, Homo sapiens
ggagaacuucauaaagaugucuc

SEQ ID NO: 1147662 - RNA, 14 nt, Homo sapiens
ggagaagacugugc

SEQ ID NO: 1147663 - RNA, 15 nt, Homo sapiens
ggagaagacugugcg

SEQ ID NO: 1147664 - RNA, 13 nt, Homo sapiens
ggagaagaucgca

SEQ ID NO: 1147665 - RNA, 19 nt, Homo sapiens
ggagaauguggagaacuaa

SEQ ID NO: 1147666 - RNA, 15 nt, Homo sapiens
ggagaauuagauuuc

SEQ ID NO: 1147667 - RNA, 18 nt, Homo sapiens
ggagacauauuucaguga

SEQ ID NO: 1147668 - RNA, 12 nt, Homo sapiens
ggagagaaaauu

SEQ ID NO: 1147669 - RNA, 17 nt, Homo sapiens
ggagagugucaaccaga

SEQ ID NO: 1147670 - RNA, 19 nt, Homo sapiens
ggagaucagagcaacagcu

SEQ ID NO: 1147671 - RNA, 17 nt, Homo sapiens
guugcuauuuguauuuc

SEQ ID NO: 1147672 - RNA, 22 nt, Homo sapiens
guugcuguuauuauauuugaca

SEQ ID NO: 1147673 - RNA, 12 nt, Homo sapiens
guugcuucaggc

SEQ ID NO: 1147674 - RNA, 14 nt, Homo sapiens
guuggaagugcaga

SEQ ID NO: 1147675 - RNA, 14 nt, Homo sapiens
guuggauaagccaa

SEQ ID NO: 1147676 - RNA, 17 nt, Homo sapiens
guuggcaaggagccagg

SEQ ID NO: 1147677 - RNA, 17 nt, Homo sapiens
guuggccucagggccag

SEQ ID NO: 1147678 - RNA, 13 nt, Homo sapiens
guuggcuuucccu

SEQ ID NO: 1147679 - RNA, 20 nt, Homo sapiens
guuggucacauggagcucuu

SEQ ID NO: 1147680 - RNA, 10 nt, Homo sapiens
guuggugcaa

SEQ ID NO: 1147681 - RNA, 16 nt, Homo sapiens
guugguuuacuguguu

SEQ ID NO: 1147682 - RNA, 12 nt, Homo sapiens
guugguuuugac

SEQ ID NO: 1147683 - RNA, 22 nt, Homo sapiens
guuguacuguaugugaugaauu

SEQ ID NO: 1147684 - RNA, 20 nt, Homo sapiens
guuguagcagguuucacuau

SEQ ID NO: 1147685 - RNA, 22 nt, Homo sapiens
guugucaacauuuuuuuccuau

SEQ ID NO: 1147686 - RNA, 13 nt, Homo sapiens
guugucacuggug

SEQ ID NO: 1147687 - RNA, 14 nt, Homo sapiens
guuguccagaucac

SEQ ID NO: 1147688 - RNA, 20 nt, Homo sapiens
guugucuacauuaaaucacu

SEQ ID NO: 1147689 - RNA, 13 nt, Homo sapiens
guugugagacuuc

SEQ ID NO: 1147690 - RNA, 12 nt, Homo sapiens
guugugcaugga

SEQ ID NO: 1147691 - RNA, 15 nt, Homo sapiens
guuguggugugccau

SEQ ID NO: 1147692 - RNA, 17 nt, Homo sapiens
guugugugucaugccag

SEQ ID NO: 1147693 - RNA, 13 nt, Homo sapiens
guuguuuacuuaa

SEQ ID NO: 1147694 - RNA, 21 nt, Homo sapiens
guuguuuauauacaguacaca

SEQ ID NO: 1147695 - RNA, 13 nt, Homo sapiens
guuguuucaguga

SEQ ID NO: 1147696 - RNA, 24 nt, Homo sapiens
guuguuuucagacucagacuccau

SEQ ID NO: 1147697 - RNA, 21 nt, Homo sapiens
guuuaacacgguuacugacuu

SEQ ID NO: 1147698 - RNA, 13 nt, Homo sapiens
guuuaacugugca

SEQ ID NO: 1147699 - RNA, 22 nt, Homo sapiens
guuuaagaaacaggcacuuuuu

SEQ ID NO: 1147700 - RNA, 18 nt, Homo sapiens
guuuaagacuagucccuu

SEQ ID NO: 1147701 - RNA, 13 nt, Homo sapiens
guuuaaugcaaua

SEQ ID NO: 1147702 - RNA, 20 nt, Homo sapiens
guuuacaggaaagaugcauu

SEQ ID NO: 1147703 - RNA, 12 nt, Homo sapiens
guuuaccagaga

SEQ ID NO: 1147704 - RNA, 14 nt, Homo sapiens
guuuaccuucaugg

SEQ ID NO: 1147705 - RNA, 23 nt, Homo sapiens
guuuagugcaucuuugccucucg

SEQ ID NO: 1147706 - RNA, 13 nt, Homo sapiens
guuuauaaugcca

SEQ ID NO: 1147707 - RNA, 14 nt, Homo sapiens
guuuauaaugccau

SEQ ID NO: 1147708 - RNA, 21 nt, Homo sapiens
guuuauacaguguacauguac

SEQ ID NO: 1147709 - RNA, 18 nt, Homo sapiens
guuuauaugcccauucuu

SEQ ID NO: 1147710 - RNA, 15 nt, Homo sapiens
guuuauauguucaca

SEQ ID NO: 1147711 - RNA, 16 nt, Homo sapiens
guuuauuucauuuuau

SEQ ID NO: 1147712 - RNA, 19 nt, Homo sapiens
guuucaaacuguaaaccaa

SEQ ID NO: 1147713 - RNA, 14 nt, Homo sapiens
guuucaaucacugu

SEQ ID NO: 1147714 - RNA, 14 nt, Homo sapiens
guuucaccaugaug

SEQ ID NO: 1147715 - RNA, 19 nt, Homo sapiens
guuucaccguguuagccag

SEQ ID NO: 1147716 - RNA, 19 nt, Homo sapiens
guuucaguaauugucagag

SEQ ID NO: 1147717 - RNA, 20 nt, Homo sapiens
guuuccuugugauuagucaa

SEQ ID NO: 1147718 - RNA, 21 nt, Homo sapiens
guuucgaagaauaaaauauga

SEQ ID NO: 1147719 - RNA, 17 nt, Homo sapiens
guuucugucaagcauau

SEQ ID NO: 1147720 - RNA, 16 nt, Homo sapiens
guuucugugucauuaa

SEQ ID NO: 1147721 - RNA, 12 nt, Homo sapiens
guuucuguucug

SEQ ID NO: 1147722 - RNA, 19 nt, Homo sapiens
guuucuuaaaaaacauaua

SEQ ID NO: 1147723 - RNA, 21 nt, Homo sapiens
guuucuuccagcagaacagag

SEQ ID NO: 1147724 - RNA, 21 nt, Homo sapiens
guuucuucuucaagacucuga

SEQ ID NO: 1147725 - RNA, 23 nt, Homo sapiens
guuucuuuagcaguuuugugaua

SEQ ID NO: 1147726 - RNA, 20 nt, Homo sapiens
guuucuuugacuucaaugua

SEQ ID NO: 1147727 - RNA, 22 nt, Homo sapiens
guuucuuuguuuucgauuuuga

SEQ ID NO: 1147728 - RNA, 19 nt, Homo sapiens
guuucuuuuugccagcuau

SEQ ID NO: 1147729 - RNA, 22 nt, Homo sapiens
guuugaaauucugaauuugcaa

SEQ ID NO: 1147730 - RNA, 15 nt, Homo sapiens
guuugaacucaggga

SEQ ID NO: 1147731 - RNA, 20 nt, Homo sapiens
guuugaauggagauucugau

SEQ ID NO: 1147732 - RNA, 20 nt, Homo sapiens
guuugagaagaaaacaucua

SEQ ID NO: 1147733 - RNA, 14 nt, Homo sapiens
guuugcaccgccug

SEQ ID NO: 1147734 - RNA, 23 nt, Homo sapiens
guuugcaccuuucuaguugaaaa

SEQ ID NO: 1147735 - RNA, 21 nt, Homo sapiens
guuugcccuuuggccagugac

SEQ ID NO: 1147736 - RNA, 17 nt, Homo sapiens
guuugcuuugcuuugua

SEQ ID NO: 1147737 - RNA, 16 nt, Homo sapiens
guuuggauuauuccuc

SEQ ID NO: 1147738 - RNA, 22 nt, Homo sapiens
guuugggaucccugucuuuccu

SEQ ID NO: 1147739 - RNA, 21 nt, Homo sapiens
guuugguaguuagccaucuaa

SEQ ID NO: 1147740 - RNA, 18 nt, Homo sapiens
guuugugucuuaaacuag

SEQ ID NO: 1147741 - RNA, 11 nt, Homo sapiens
guuuguuaaaa

SEQ ID NO: 1147742 - RNA, 14 nt, Homo sapiens
guuuguuacuuuga

SEQ ID NO: 1147743 - RNA, 13 nt, Homo sapiens
guuuuaaauugca

SEQ ID NO: 1147744 - RNA, 14 nt, Homo sapiens
guuuuauaauuaau

SEQ ID NO: 1147745 - RNA, 22 nt, Homo sapiens
guuuuauaauuaaucagcucgu

SEQ ID NO: 1147746 - RNA, 16 nt, Homo sapiens
guuuuauauguugcua

SEQ ID NO: 1147747 - RNA, 20 nt, Homo sapiens
guuuuaucuccauacuuugg

SEQ ID NO: 1147748 - RNA, 14 nt, Homo sapiens
guuuucagcauaaa

SEQ ID NO: 1147749 - RNA, 18 nt, Homo sapiens
guuuucagcccaucuccu

SEQ ID NO: 1147750 - RNA, 19 nt, Homo sapiens
guuuuccagucucuuguac

SEQ ID NO: 1147751 - RNA, 19 nt, Homo sapiens
guuuuccucccuucugcua

SEQ ID NO: 1147752 - RNA, 20 nt, Homo sapiens
guuuuccucccuucugcuac

SEQ ID NO: 1147753 - RNA, 20 nt, Homo sapiens
guuuucucucuccgauuuug

SEQ ID NO: 1147754 - RNA, 14 nt, Homo sapiens
guuuucugugcacu

SEQ ID NO: 1147755 - RNA, 11 nt, Homo sapiens
guuuucuuaua

SEQ ID NO: 1147756 - RNA, 17 nt, Homo sapiens
guuuugaacaaaggaau

SEQ ID NO: 1147757 - RNA, 20 nt, Homo sapiens
guuuugaaggcaaaauugca

SEQ ID NO: 1147758 - RNA, 20 nt, Homo sapiens
guuuugcacaucauguaucu

SEQ ID NO: 1147759 - RNA, 12 nt, Homo sapiens
guuuugccaugu

SEQ ID NO: 1147760 - RNA, 16 nt, Homo sapiens
guuuugcuaaaauuca

SEQ ID NO: 1147761 - RNA, 16 nt, Homo sapiens
guuuuggaaaacuaau

SEQ ID NO: 1147762 - RNA, 17 nt, Homo sapiens
guuuuguuugcuaucuu

SEQ ID NO: 1147763 - RNA, 22 nt, Homo sapiens
guuuuuaaauagaguuugcuau

SEQ ID NO: 1147764 - RNA, 20 nt, Homo sapiens
guuuuuaauuuaucagagac

SEQ ID NO: 1147765 - RNA, 21 nt, Homo sapiens
guuuuucaagaaaacuggaaa

SEQ ID NO: 1147766 - RNA, 19 nt, Homo sapiens
guuuuuccacuacugcuac

SEQ ID NO: 1147767 - RNA, 17 nt, Homo sapiens
guuuuuggaguguuaug

SEQ ID NO: 1147768 - RNA, 17 nt, Homo sapiens
guuuuugucuacguuau

SEQ ID NO: 1147769 - RNA, 22 nt, Homo sapiens
guuuuugucuacguuauacuga

SEQ ID NO: 1147770 - RNA, 17 nt, Homo sapiens
uaaaaaaaacaauucca

SEQ ID NO: 1147771 - RNA, 18 nt, Homo sapiens
uaaaaaaaagaagugugc

SEQ ID NO: 1147772 - RNA, 14 nt, Homo sapiens
uaaaaaaaauguga

SEQ ID NO: 1147773 - RNA, 18 nt, Homo sapiens
uaaaaaaauuccaaguga

SEQ ID NO: 1147774 - RNA, 23 nt, Homo sapiens
uaaaaaagcugugugcucuccaa

SEQ ID NO: 1147775 - RNA, 21 nt, Homo sapiens
uaaaaaaugaaaaacauuauu

SEQ ID NO: 1147776 - RNA, 19 nt, Homo sapiens
uaaaaaccaagaagauguc

SEQ ID NO: 1147777 - RNA, 18 nt, Homo sapiens
uaaaaaccuucaaaggug

SEQ ID NO: 1147778 - RNA, 13 nt, Homo sapiens
uaaaaacugagug

SEQ ID NO: 1147779 - RNA, 16 nt, Homo sapiens
uaaaaacuuacacucu

SEQ ID NO: 1147780 - RNA, 23 nt, Homo sapiens
uaaaaagaaaaucaguugauuaa

SEQ ID NO: 1147781 - RNA, 21 nt, Homo sapiens
uaaaaagaugacuuaagguga

SEQ ID NO: 1147782 - RNA, 15 nt, Homo sapiens
uaaaaagccuuacag

SEQ ID NO: 1147783 - RNA, 23 nt, Homo sapiens
uaaaaauacaaaaaucagccaga

SEQ ID NO: 1147784 - RNA, 14 nt, Homo sapiens
uaaaaauacacaaa

SEQ ID NO: 1147785 - RNA, 23 nt, Homo sapiens
uaaaaauaugcuuguugaugcug

SEQ ID NO: 1147786 - RNA, 16 nt, Homo sapiens
uaaaaaucacacugua

SEQ ID NO: 1147787 - RNA, 18 nt, Homo sapiens
uaaaaaugagugugaagg

SEQ ID NO: 1147788 - RNA, 22 nt, Homo sapiens
uaaaaaugucuugcuguugaca

SEQ ID NO: 1147789 - RNA, 17 nt, Homo sapiens
uaaaaauuguagcuuuu

SEQ ID NO: 1147790 - RNA, 22 nt, Homo sapiens
uaaaacaaaauuugacuaauuu

SEQ ID NO: 1147791 - RNA, 24 nt, Homo sapiens
uaaaacaaagggcacagcaucugu

SEQ ID NO: 1147792 - RNA, 20 nt, Homo sapiens
uaaaacagaagccugaugcu

SEQ ID NO: 1147793 - RNA, 17 nt, Homo sapiens
uaaaaccuugaaggucu

SEQ ID NO: 1147794 - RNA, 23 nt, Homo sapiens
uaaaacucuuuugaccuguaacu

SEQ ID NO: 1147795 - RNA, 20 nt, Homo sapiens
uaaaacugguuuuagacaaa

SEQ ID NO: 1147796 - RNA, 20 nt, Homo sapiens
uaaaacuucuuuaguacuua

SEQ ID NO: 1147797 - RNA, 14 nt, Homo sapiens
uaaaagaacagccu

SEQ ID NO: 1147798 - RNA, 18 nt, Homo sapiens
uaaaagacaguaguuuau

SEQ ID NO: 1147799 - RNA, 13 nt, Homo sapiens
uaaaagacaguga

SEQ ID NO: 1147800 - RNA, 14 nt, Homo sapiens
uaaaagacagugaa

SEQ ID NO: 1147801 - RNA, 13 nt, Homo sapiens
uaaaagacuuuga

SEQ ID NO: 1147802 - RNA, 18 nt, Homo sapiens
uaaauuuacucuguugaa

SEQ ID NO: 1147803 - RNA, 17 nt, Homo sapiens
uaaauuuaucaaugaug

SEQ ID NO: 1147804 - RNA, 19 nt, Homo sapiens
uaaauuuccccaacagugu

SEQ ID NO: 1147805 - RNA, 21 nt, Homo sapiens
uaaauuuccccaacaguguga

SEQ ID NO: 1147806 - RNA, 13 nt, Homo sapiens
uaaauuucuuccu

SEQ ID NO: 1147807 - RNA, 21 nt, Homo sapiens
uaaauuuugaaaacugugcaa

SEQ ID NO: 1147808 - RNA, 20 nt, Homo sapiens
uaacaaaaaagcuaacccag

SEQ ID NO: 1147809 - RNA, 14 nt, Homo sapiens
uaacaaacucugag

SEQ ID NO: 1147810 - RNA, 19 nt, Homo sapiens
uaacaaagcccuuauucuc

SEQ ID NO: 1147811 - RNA, 16 nt, Homo sapiens
uaacaauaaaagacaa

SEQ ID NO: 1147812 - RNA, 20 nt, Homo sapiens
uaacacaauuaaaugacuua

SEQ ID NO: 1147813 - RNA, 16 nt, Homo sapiens
uaacacgguuacugac

SEQ ID NO: 1147814 - RNA, 14 nt, Homo sapiens
uaacagaguuuucu

SEQ ID NO: 1147815 - RNA, 12 nt, Homo sapiens
uaacagcacaau

SEQ ID NO: 1147816 - RNA, 19 nt, Homo sapiens
uaacagcaggguaccugaa

SEQ ID NO: 1147817 - RNA, 18 nt, Homo sapiens
uaacagcuguggcucacg

SEQ ID NO: 1147818 - RNA, 17 nt, Homo sapiens
uaacagguuuucuucua

SEQ ID NO: 1147819 - RNA, 19 nt, Homo sapiens
uaacaguaguccuuugaua

SEQ ID NO: 1147820 - RNA, 22 nt, Homo sapiens
uaacauaccguuuauaaugcca

SEQ ID NO: 1147821 - RNA, 21 nt, Homo sapiens
uaacauacuauauaagccagu

SEQ ID NO: 1147822 - RNA, 13 nt, Homo sapiens
uaacaucaaagau

SEQ ID NO: 1147823 - RNA, 20 nt, Homo sapiens
uaaucagcaauaaaaauccu

SEQ ID NO: 1147824 - RNA, 12 nt, Homo sapiens
uaaucauaacau

SEQ ID NO: 1147825 - RNA, 23 nt, Homo sapiens
uaaucauuuguuuacauuugaug

SEQ ID NO: 1147826 - RNA, 16 nt, Homo sapiens
uaauccaauaccucuu

SEQ ID NO: 1147827 - RNA, 18 nt, Homo sapiens
uaauccaggcagauccag

SEQ ID NO: 1147828 - RNA, 20 nt, Homo sapiens
uaaucccagcuacuugggag

SEQ ID NO: 1147829 - RNA, 18 nt, Homo sapiens
uaauccuaaacauaugaa

SEQ ID NO: 1147830 - RNA, 19 nt, Homo sapiens
uaaucggcuugaauuuuga

SEQ ID NO: 1147831 - RNA, 22 nt, Homo sapiens
uaaucuccucagacaguaacca

SEQ ID NO: 1147832 - RNA, 21 nt, Homo sapiens
uaaucuguaagcauaagcuua

SEQ ID NO: 1147833 - RNA, 20 nt, Homo sapiens
uaaucuugcucugcuugaca

SEQ ID NO: 1147834 - RNA, 18 nt, Homo sapiens
uaaugaaggugugcuaca

SEQ ID NO: 1147835 - RNA, 17 nt, Homo sapiens
uaaugaauaugccaucu

SEQ ID NO: 1147836 - RNA, 18 nt, Homo sapiens
uaaugaauuuuuaugaua

SEQ ID NO: 1147837 - RNA, 15 nt, Homo sapiens
uaaugagaagauaua

SEQ ID NO: 1147838 - RNA, 16 nt, Homo sapiens
uaaugagaauuccuua

SEQ ID NO: 1147839 - RNA, 16 nt, Homo sapiens
uaaugauguuaucuua

SEQ ID NO: 1147840 - RNA, 17 nt, Homo sapiens
uaaugauguuaucuuaa

SEQ ID NO: 1147841 - RNA, 16 nt, Homo sapiens
uaaugcacaucugcag

SEQ ID NO: 1147842 - RNA, 12 nt, Homo sapiens
aaaaagacauuu

SEQ ID NO: 1147843 - RNA, 19 nt, Homo sapiens
aaaaagaugguugccaagc

SEQ ID NO: 1147844 - RNA, 12 nt, Homo sapiens
aaaaagccaaaa

SEQ ID NO: 1147845 - RNA, 20 nt, Homo sapiens
aaaaaggaaagaacugucau

SEQ ID NO: 1147846 - RNA, 16 nt, Homo sapiens
aaaaaggaauccucug

SEQ ID NO: 1147847 - RNA, 12 nt, Homo sapiens
aaaaaggcaccu

SEQ ID NO: 1147848 - RNA, 16 nt, Homo sapiens
aaaaaguuaaacauug

SEQ ID NO: 1147849 - RNA, 16 nt, Homo sapiens
aaaaaguuucacaggu

SEQ ID NO: 1147850 - RNA, 19 nt, Homo sapiens
aaaaauaacugacaaacca

SEQ ID NO: 1147851 - RNA, 23 nt, Homo sapiens
aaaaauacugccagaugcugaug

SEQ ID NO: 1147852 - RNA, 17 nt, Homo sapiens
aaaaauagcaacuugug

SEQ ID NO: 1147853 - RNA, 23 nt, Homo sapiens
aagccuuaaguggcagaauauaa

SEQ ID NO: 1147854 - RNA, 21 nt, Homo sapiens
aagccuuugccagccauucuu

SEQ ID NO: 1147855 - RNA, 19 nt, Homo sapiens
aagcgagacuccaucucaa

SEQ ID NO: 1147856 - RNA, 17 nt, Homo sapiens
aagcgcacauucaugug

SEQ ID NO: 1147857 - RNA, 12 nt, Homo sapiens
aagcgugaaggc

SEQ ID NO: 1147858 - RNA, 15 nt, Homo sapiens
aagcgugugugaaca

SEQ ID NO: 1147859 - RNA, 14 nt, Homo sapiens
aagcuaggucgugg

SEQ ID NO: 1147860 - RNA, 17 nt, Homo sapiens
aagcuaguguaccuccu

SEQ ID NO: 1147861 - RNA, 21 nt, Homo sapiens
aagcuaguguaccuccucuca

SEQ ID NO: 1147862 - RNA, 20 nt, Homo sapiens
aagcuauauguuauggcuua

SEQ ID NO: 1147863 - RNA, 22 nt, Homo sapiens
aagcuauggugagaugcagcug

SEQ ID NO: 1147864 - RNA, 18 nt, Homo sapiens
aagcucagaguugagacc

SEQ ID NO: 1147865 - RNA, 16 nt, Homo sapiens
aagcucuaaagaccau

SEQ ID NO: 1147866 - RNA, 13 nt, Homo sapiens
aagcucuguccaa

SEQ ID NO: 1147867 - RNA, 14 nt, Homo sapiens
aagcugacauugcc

SEQ ID NO: 1147868 - RNA, 16 nt, Homo sapiens
aagcugauuaccugaa

SEQ ID NO: 1147869 - RNA, 22 nt, Homo sapiens
aagcugcuggagcccgcacugu

SEQ ID NO: 1147870 - RNA, 17 nt, Homo sapiens
aagcugugcccugacca

SEQ ID NO: 1147871 - RNA, 22 nt, Homo sapiens
aagcuguguccuugcaccugca

SEQ ID NO: 1147872 - RNA, 23 nt, Homo sapiens
aagcuguguccuugcaccugcau

SEQ ID NO: 1147873 - RNA, 12 nt, Homo sapiens
aagcuguugcua

SEQ ID NO: 1147874 - RNA, 13 nt, Homo sapiens
aagcuuaugcuua

SEQ ID NO: 1147875 - RNA, 19 nt, Homo sapiens
aagcuucugccuucuggaa

SEQ ID NO: 1147876 - RNA, 16 nt, Homo sapiens
aagcuugucugaucgu

SEQ ID NO: 1147877 - RNA, 15 nt, Homo sapiens
aagcuuuaaaugucu

SEQ ID NO: 1147878 - RNA, 19 nt, Homo sapiens
aaggaaaaauauuuugcac

SEQ ID NO: 1147879 - RNA, 19 nt, Homo sapiens
aaggaaaacuauguauuaa

SEQ ID NO: 1147880 - RNA, 14 nt, Homo sapiens
aaggaaaagcacaa

SEQ ID NO: 1147881 - RNA, 20 nt, Homo sapiens
aaggaaacccccaguguaau

SEQ ID NO: 1147882 - RNA, 13 nt, Homo sapiens
aaggaacuggaac

SEQ ID NO: 1147883 - RNA, 16 nt, Homo sapiens
aaggaacuggaacaca

SEQ ID NO: 1147884 - RNA, 21 nt, Homo sapiens
aaggaagcaaguuuucuucca

SEQ ID NO: 1147885 - RNA, 17 nt, Homo sapiens
aaggaagcuguguugaa

SEQ ID NO: 1147886 - RNA, 16 nt, Homo sapiens
aaggaaggacuaugac

SEQ ID NO: 1147887 - RNA, 16 nt, Homo sapiens
aaggaauacacuugug

SEQ ID NO: 1147888 - RNA, 13 nt, Homo sapiens
aaggaauggugcg

SEQ ID NO: 1147889 - RNA, 15 nt, Homo sapiens
aaggacaaagugcca

SEQ ID NO: 1147890 - RNA, 18 nt, Homo sapiens
aaggacagaccaaaaauc

SEQ ID NO: 1147891 - RNA, 22 nt, Homo sapiens
aaggacagugucaaagugauaa

SEQ ID NO: 1147892 - RNA, 14 nt, Homo sapiens
aaggacuaugacaa

SEQ ID NO: 1147893 - RNA, 11 nt, Homo sapiens
aaggacucuca

SEQ ID NO: 1147894 - RNA, 20 nt, Homo sapiens
aaggacuuccuguccagcuc

SEQ ID NO: 1147895 - RNA, 14 nt, Homo sapiens
aaggagacagaaga

SEQ ID NO: 1147896 - RNA, 22 nt, Homo sapiens
aaggagaucgguaucuuuguaa

SEQ ID NO: 1147897 - RNA, 23 nt, Homo sapiens
aaggagaugucugaauacugcag

SEQ ID NO: 1147898 - RNA, 12 nt, Homo sapiens
aaggagccaggg

SEQ ID NO: 1147899 - RNA, 22 nt, Homo sapiens
aaggagcccuuaucugugcuca

SEQ ID NO: 1147900 - RNA, 20 nt, Homo sapiens
aaggaggcugggcauggugg

SEQ ID NO: 1147901 - RNA, 20 nt, Homo sapiens
aaggagggcagaucacuuca

SEQ ID NO: 1147902 - RNA, 20 nt, Homo sapiens
aaggauaaugaauacuuuau

SEQ ID NO: 1147903 - RNA, 12 nt, Homo sapiens
aaggaugucugc

SEQ ID NO: 1147904 - RNA, 14 nt, Homo sapiens
aaggaugucugcca

SEQ ID NO: 1147905 - RNA, 22 nt, Homo sapiens
aaggauuacagaaacugaugcc

SEQ ID NO: 1147906 - RNA, 14 nt, Homo sapiens
aaggcaaaaaaauc

SEQ ID NO: 1147907 - RNA, 14 nt, Homo sapiens
aaggcacagugaag

SEQ ID NO: 1147908 - RNA, 19 nt, Homo sapiens
aaggcaggauuuagcccuu

SEQ ID NO: 1147909 - RNA, 23 nt, Homo sapiens
aaggcagggugguguaccugcug

SEQ ID NO: 1147910 - RNA, 13 nt, Homo sapiens
aaggcaguccaga

SEQ ID NO: 1147911 - RNA, 22 nt, Homo sapiens
aaggcagucccgggagaaaaga

SEQ ID NO: 1147912 - RNA, 19 nt, Homo sapiens
aaggccacuguuugucuca

SEQ ID NO: 1147913 - RNA, 16 nt, Homo sapiens
aaggccaucugcuuac

SEQ ID NO: 1147914 - RNA, 18 nt, Homo sapiens
aaggccuacugaccaaau

SEQ ID NO: 1147915 - RNA, 16 nt, Homo sapiens
aaggccuccugugacu

SEQ ID NO: 1147916 - RNA, 23 nt, Homo sapiens
aaggcucccggaauuccgucacc

SEQ ID NO: 1147917 - RNA, 14 nt, Homo sapiens
aaggcucuuuugua

SEQ ID NO: 1147918 - RNA, 14 nt, Homo sapiens
aaggcuucagucuc

SEQ ID NO: 1147919 - RNA, 16 nt, Homo sapiens
aagggaaaaguuauuu

SEQ ID NO: 1147920 - RNA, 14 nt, Homo sapiens
aagggaauccuccu

SEQ ID NO: 1147921 - RNA, 14 nt, Homo sapiens
aagggaauugcuca

SEQ ID NO: 1147922 - RNA, 15 nt, Homo sapiens
aagggaauugcucag

SEQ ID NO: 1147923 - RNA, 18 nt, Homo sapiens
aagggaauugcucagaga

SEQ ID NO: 1147924 - RNA, 16 nt, Homo sapiens
aagggacaaguauuaa

SEQ ID NO: 1147925 - RNA, 13 nt, Homo sapiens
aagggacugaggc

SEQ ID NO: 1147926 - RNA, 12 nt, Homo sapiens
aagggacuugaa

SEQ ID NO: 1147927 - RNA, 21 nt, Homo sapiens
aagggaggggcuguguuucca

SEQ ID NO: 1147928 - RNA, 15 nt, Homo sapiens
aagggcaucacuggg

SEQ ID NO: 1147929 - RNA, 16 nt, Homo sapiens
aagggcaucacugggu

SEQ ID NO: 1147930 - RNA, 14 nt, Homo sapiens
aagggcuagauuau

SEQ ID NO: 1147931 - RNA, 21 nt, Homo sapiens
aagggcugauugggauuucca

SEQ ID NO: 1147932 - RNA, 17 nt, Homo sapiens
aaggggaaggaagagag

SEQ ID NO: 1147933 - RNA, 17 nt, Homo sapiens
aaggggacaauggcaga

SEQ ID NO: 1147934 - RNA, 15 nt, Homo sapiens
aaggggagaagggaa

SEQ ID NO: 1147935 - RNA, 22 nt, Homo sapiens
aaggguuuaugcuuacgucucu

SEQ ID NO: 1147936 - RNA, 19 nt, Homo sapiens
aagguaaauauucauuugc

SEQ ID NO: 1147937 - RNA, 16 nt, Homo sapiens
aagguaagaucauuua

SEQ ID NO: 1147938 - RNA, 18 nt, Homo sapiens
aagguacugucaugggcu

SEQ ID NO: 1147939 - RNA, 15 nt, Homo sapiens
aagguauuugggaaa

SEQ ID NO: 1147940 - RNA, 22 nt, Homo sapiens
aagguauuuuccugugccuuua

SEQ ID NO: 1147941 - RNA, 20 nt, Homo sapiens
aaggucauggccacacugug

SEQ ID NO: 1147942 - RNA, 17 nt, Homo sapiens
aaggucccuuguuucca

SEQ ID NO: 1147943 - RNA, 20 nt, Homo sapiens
aagguccucugucagucaca

SEQ ID NO: 1147944 - RNA, 16 nt, Homo sapiens
aaggucucacacuccu

SEQ ID NO: 1147945 - RNA, 21 nt, Homo sapiens
aaggucugcucugcuccugaa

SEQ ID NO: 1147946 - RNA, 18 nt, Homo sapiens
aaggugacccaaugauuc

SEQ ID NO: 1147947 - RNA, 15 nt, Homo sapiens
aaggugccucaagaa

SEQ ID NO: 1147948 - RNA, 18 nt, Homo sapiens
aaggugcuggaaagggag

SEQ ID NO: 1147949 - RNA, 20 nt, Homo sapiens
aaggugcuggacuguuacug

SEQ ID NO: 1147950 - RNA, 22 nt, Homo sapiens
aagguggccacaaauucuuuga

SEQ ID NO: 1147951 - RNA, 19 nt, Homo sapiens
aaggugggcggaucacuug

SEQ ID NO: 1147952 - RNA, 23 nt, Homo sapiens
aaggugucccugccuucacugug

SEQ ID NO: 1147953 - RNA, 15 nt, Homo sapiens
aagguguucauuuug

SEQ ID NO: 1147954 - RNA, 21 nt, Homo sapiens
aagguuaaaggaaaagcacaa

SEQ ID NO: 1147955 - RNA, 21 nt, Homo sapiens
aagguuaguaucaucagauag

SEQ ID NO: 1147956 - RNA, 16 nt, Homo sapiens
aagguuccaacuguau

SEQ ID NO: 1147957 - RNA, 16 nt, Homo sapiens
aagguucuauccuguu

SEQ ID NO: 1147958 - RNA, 13 nt, Homo sapiens
aaguaaagcccag

SEQ ID NO: 1147959 - RNA, 14 nt, Homo sapiens
aaguaaagcccaga

SEQ ID NO: 1147960 - RNA, 20 nt, Homo sapiens
aaguaaagcccagaucucug

SEQ ID NO: 1147961 - RNA, 16 nt, Homo sapiens
aaguaaauccacaggc

SEQ ID NO: 1147962 - RNA, 14 nt, Homo sapiens
aaguaagcauuucc

SEQ ID NO: 1147963 - RNA, 13 nt, Homo sapiens
aaguaaugaauuu

SEQ ID NO: 1147964 - RNA, 19 nt, Homo sapiens
aaguacaucucuacuaaaa

SEQ ID NO: 1147965 - RNA, 20 nt, Homo sapiens
aaguaccuauauugauuuaa

SEQ ID NO: 1147966 - RNA, 21 nt, Homo sapiens
aaguacuacauuuucuuuugu

SEQ ID NO: 1147967 - RNA, 18 nt, Homo sapiens
aaguacugagcaguauua

SEQ ID NO: 1147968 - RNA, 18 nt, Homo sapiens
aaguagaucuuuucuuga

SEQ ID NO: 1147969 - RNA, 14 nt, Homo sapiens
aaguagcuguaaga

SEQ ID NO: 1147970 - RNA, 14 nt, Homo sapiens
aaguauccagaccu

SEQ ID NO: 1147971 - RNA, 12 nt, Homo sapiens
aaguaucuuucc

SEQ ID NO: 1147972 - RNA, 15 nt, Homo sapiens
aaguaucuuuccagc

SEQ ID NO: 1147973 - RNA, 22 nt, Homo sapiens
aaguauuuaguuauaucacuug

SEQ ID NO: 1147974 - RNA, 18 nt, Homo sapiens
aagucacaacaaaaggaa

SEQ ID NO: 1147975 - RNA, 19 nt, Homo sapiens
aagucacaggaugagacag

SEQ ID NO: 1147976 - RNA, 16 nt, Homo sapiens
aagucauggacauuca

SEQ ID NO: 1147977 - RNA, 14 nt, Homo sapiens
aaguccagcuuucu

SEQ ID NO: 1147978 - RNA, 14 nt, Homo sapiens
aagucccuuuguga

SEQ ID NO: 1147979 - RNA, 16 nt, Homo sapiens
aaguccuucaccucac

SEQ ID NO: 1147980 - RNA, 14 nt, Homo sapiens
aagucgaugaacua

SEQ ID NO: 1147981 - RNA, 16 nt, Homo sapiens
aagucgugucugucag

SEQ ID NO: 1147982 - RNA, 22 nt, Homo sapiens
aagucuuaaggacaaagugcca

SEQ ID NO: 1147983 - RNA, 15 nt, Homo sapiens
aagucuuacuacaga

SEQ ID NO: 1147984 - RNA, 11 nt, Homo sapiens
aagucuugccu

SEQ ID NO: 1147985 - RNA, 16 nt, Homo sapiens
aagugaagcuggugga

SEQ ID NO: 1147986 - RNA, 18 nt, Homo sapiens
aagugaaugccugucacg

SEQ ID NO: 1147987 - RNA, 21 nt, Homo sapiens
aagugaauugucuuuguuaua

SEQ ID NO: 1147988 - RNA, 13 nt, Homo sapiens
aagaagaugguua

SEQ ID NO: 1147989 - RNA, 16 nt, Homo sapiens
aagaagcuucaugcca

SEQ ID NO: 1147990 - RNA, 17 nt, Homo sapiens
aagaaggguguuuaaua

SEQ ID NO: 1147991 - RNA, 17 nt, Homo sapiens
aagaagguuaccaagaa

SEQ ID NO: 1147992 - RNA, 22 nt, Homo sapiens
aagaagguuggugaauuucaca

SEQ ID NO: 1147993 - RNA, 19 nt, Homo sapiens
aagaaguuuuguucugucc

SEQ ID NO: 1147994 - RNA, 16 nt, Homo sapiens
aagaauaaacacuggu

SEQ ID NO: 1147995 - RNA, 19 nt, Homo sapiens
aagaauaaacuccauuuaa

SEQ ID NO: 1147996 - RNA, 12 nt, Homo sapiens
aagaauacuuga

SEQ ID NO: 1147997 - RNA, 17 nt, Homo sapiens
aagaauaugacuuuuua

SEQ ID NO: 1147998 - RNA, 14 nt, Homo sapiens
aagaaugaggaaua

SEQ ID NO: 1147999 - RNA, 17 nt, Homo sapiens
aagaaugaguaauguga

SEQ ID NO: 1148000 - RNA, 22 nt, Homo sapiens
aagaaugucucggucacaucag

SEQ ID NO: 1148001 - RNA, 22 nt, Homo sapiens
aagaauguguuucaaacuguaa

SEQ ID NO: 1148002 - RNA, 12 nt, Homo sapiens
aagaauugccaa

SEQ ID NO: 1148003 - RNA, 17 nt, Homo sapiens
aagaauuucacaagcua

SEQ ID NO: 1148004 - RNA, 14 nt, Homo sapiens
aagacaaauucugu

SEQ ID NO: 1148005 - RNA, 13 nt, Homo sapiens
aagacaauucuuu

SEQ ID NO: 1148006 - RNA, 12 nt, Homo sapiens
aagacacuguua

SEQ ID NO: 1148007 - RNA, 21 nt, Homo sapiens
aagacauaaacccaguugcca

SEQ ID NO: 1148008 - RNA, 18 nt, Homo sapiens
aagacauagucucuaccu

SEQ ID NO: 1148009 - RNA, 18 nt, Homo sapiens
aagacauuguguguauua

SEQ ID NO: 1148010 - RNA, 22 nt, Homo sapiens
aagacccucucaggcuguccca

SEQ ID NO: 1148011 - RNA, 20 nt, Homo sapiens
aagaccugacaccuuucaua

SEQ ID NO: 1148012 - RNA, 15 nt, Homo sapiens
aagacuccaucucaa

SEQ ID NO: 1148013 - RNA, 11 nt, Homo sapiens
aagacuugaau

SEQ ID NO: 1148014 - RNA, 15 nt, Homo sapiens
aagacuugcauuuaa

SEQ ID NO: 1148015 - RNA, 13 nt, Homo sapiens
aagacuugugcau

SEQ ID NO: 1148016 - RNA, 18 nt, Homo sapiens
aagagaaaccaggcccug

SEQ ID NO: 1148017 - RNA, 22 nt, Homo sapiens
aagagaauauuagcuuuacugu

SEQ ID NO: 1148018 - RNA, 13 nt, Homo sapiens
aagagaauguauu

SEQ ID NO: 1148019 - RNA, 17 nt, Homo sapiens
aagagaauuuacuuuuc

SEQ ID NO: 1148020 - RNA, 14 nt, Homo sapiens
aagagacacugcuu

SEQ ID NO: 1148021 - RNA, 13 nt, Homo sapiens
aagagacugaguc

SEQ ID NO: 1148022 - RNA, 19 nt, Homo sapiens
aagagagaacaguugucca

SEQ ID NO: 1148023 - RNA, 13 nt, Homo sapiens
aagagcaaaacuc

SEQ ID NO: 1148024 - RNA, 20 nt, Homo sapiens
aagagcaaaacuccgucuca

SEQ ID NO: 1148025 - RNA, 14 nt, Homo sapiens
aagagcagcacagg

SEQ ID NO: 1148026 - RNA, 20 nt, Homo sapiens
aagagcagcuucggugugca

SEQ ID NO: 1148027 - RNA, 20 nt, Homo sapiens
aagagccaaccaacagagaa

SEQ ID NO: 1148028 - RNA, 19 nt, Homo sapiens
aagagccauauaaguuuga

SEQ ID NO: 1148029 - RNA, 18 nt, Homo sapiens
aagagccggagccuccag

SEQ ID NO: 1148030 - RNA, 21 nt, Homo sapiens
aagagccuuacuuucuuuaca

SEQ ID NO: 1148031 - RNA, 18 nt, Homo sapiens
aagaggagacaguuuacc

SEQ ID NO: 1148032 - RNA, 19 nt, Homo sapiens
aagaggagauuaaccucuu

SEQ ID NO: 1148033 - RNA, 21 nt, Homo sapiens
aagaggccaaaggaaugucca

SEQ ID NO: 1148034 - RNA, 15 nt, Homo sapiens
aagaggccuguucau

SEQ ID NO: 1148035 - RNA, 19 nt, Homo sapiens
aagaggcugagacaggaga

SEQ ID NO: 1148036 - RNA, 12 nt, Homo sapiens
aagaggggaaaa

SEQ ID NO: 1148037 - RNA, 18 nt, Homo sapiens
aagagguggguggugggc

SEQ ID NO: 1148038 - RNA, 18 nt, Homo sapiens
aagagguuuuucagcucu

SEQ ID NO: 1148039 - RNA, 15 nt, Homo sapiens
aagaguaguuauaua

SEQ ID NO: 1148040 - RNA, 18 nt, Homo sapiens
aagagucgggacuugaaa

SEQ ID NO: 1148041 - RNA, 13 nt, Homo sapiens
aagagugagaaaa

SEQ ID NO: 1148042 - RNA, 12 nt, Homo sapiens
aagagugcuaca

SEQ ID NO: 1148043 - RNA, 11 nt, Homo sapiens
aagaguuacac

SEQ ID NO: 1148044 - RNA, 23 nt, Homo sapiens
aagaguuggagugagaugaagga

SEQ ID NO: 1148045 - RNA, 19 nt, Homo sapiens
aagauaaaucaaaguaaua

SEQ ID NO: 1148046 - RNA, 14 nt, Homo sapiens
aagauaacuaggaa

SEQ ID NO: 1148047 - RNA, 14 nt, Homo sapiens
aagauacauaaaag

SEQ ID NO: 1148048 - RNA, 11 nt, Homo sapiens
aagauagcaau

SEQ ID NO: 1148049 - RNA, 17 nt, Homo sapiens
aagauagcuucacccca

SEQ ID NO: 1148050 - RNA, 15 nt, Homo sapiens
aagauaguaacugua

SEQ ID NO: 1148051 - RNA, 13 nt, Homo sapiens
aagauauggacac

SEQ ID NO: 1148052 - RNA, 22 nt, Homo sapiens
aagauccuagauccuaaggguc

SEQ ID NO: 1148053 - RNA, 17 nt, Homo sapiens
aagaucguucucugccu

SEQ ID NO: 1148054 - RNA, 23 nt, Homo sapiens
aagaucuccaacagccagugugu

SEQ ID NO: 1148055 - RNA, 19 nt, Homo sapiens
aagaucuuuccaaagacaa

SEQ ID NO: 1148056 - RNA, 15 nt, Homo sapiens
aagaugacauugcua

SEQ ID NO: 1148057 - RNA, 19 nt, Homo sapiens
aagaugacggaugccuaga

SEQ ID NO: 1148058 - RNA, 22 nt, Homo sapiens
aagaugcauuguaguuuaacca

SEQ ID NO: 1148059 - RNA, 17 nt, Homo sapiens
aagauggagcuccccca

SEQ ID NO: 1148060 - RNA, 19 nt, Homo sapiens
aagauggcgacaaaaguga

SEQ ID NO: 1148061 - RNA, 20 nt, Homo sapiens
aagauggcgacaaaagugau

SEQ ID NO: 1148062 - RNA, 18 nt, Homo sapiens
aagauggcugacuuugcu

SEQ ID NO: 1148063 - RNA, 16 nt, Homo sapiens
aagaugguuagaacca

SEQ ID NO: 1148064 - RNA, 19 nt, Homo sapiens
aagaugucaagggccaaga

SEQ ID NO: 1148065 - RNA, 17 nt, Homo sapiens
aagaugucucacagccc

SEQ ID NO: 1148066 - RNA, 14 nt, Homo sapiens
aagauuaauuucau

SEQ ID NO: 1148067 - RNA, 12 nt, Homo sapiens
aagauuacuuuu

SEQ ID NO: 1148068 - RNA, 21 nt, Homo sapiens
aagauuagugauucaucuuca

SEQ ID NO: 1148069 - RNA, 21 nt, Homo sapiens
aagauuauagauucuaaagau

SEQ ID NO: 1148070 - RNA, 21 nt, Homo sapiens
aagauuauauaguacuuaaau

SEQ ID NO: 1148071 - RNA, 12 nt, Homo sapiens
aagauucaugug

SEQ ID NO: 1148072 - RNA, 18 nt, Homo sapiens
aagauugaagccuuugcc

SEQ ID NO: 1148073 - RNA, 13 nt, Homo sapiens
aagcaaacccaga

SEQ ID NO: 1148074 - RNA, 14 nt, Homo sapiens
aagcaaagcucuuu

SEQ ID NO: 1148075 - RNA, 22 nt, Homo sapiens
aagcaaggugucccugccuuca

SEQ ID NO: 1148076 - RNA, 14 nt, Homo sapiens
aagcaaguuuucuu

SEQ ID NO: 1148077 - RNA, 20 nt, Homo sapiens
aagcaauccucucaccucag

SEQ ID NO: 1148078 - RNA, 17 nt, Homo sapiens
aagcaaugcugaugaau

SEQ ID NO: 1148079 - RNA, 22 nt, Homo sapiens
aagcacacucagaaggcuucau

SEQ ID NO: 1148080 - RNA, 22 nt, Homo sapiens
aagcacucaauaaaucuuugau

SEQ ID NO: 1148081 - RNA, 17 nt, Homo sapiens
aagcagaauguacuuga

SEQ ID NO: 1148082 - RNA, 15 nt, Homo sapiens
aagcagaccacugau

SEQ ID NO: 1148083 - RNA, 18 nt, Homo sapiens
aagcagaugcaaagaggc

SEQ ID NO: 1148084 - RNA, 13 nt, Homo sapiens
aagcagauuuucc

SEQ ID NO: 1148085 - RNA, 16 nt, Homo sapiens
aagcagcaacagcaaa

SEQ ID NO: 1148086 - RNA, 15 nt, Homo sapiens
aagcagcccuucccc

SEQ ID NO: 1148087 - RNA, 20 nt, Homo sapiens
aagcaggaaaugaaaauguc

SEQ ID NO: 1148088 - RNA, 12 nt, Homo sapiens
aagcaggauuuc

SEQ ID NO: 1148089 - RNA, 21 nt, Homo sapiens
aagcagguucccaagcucaga

SEQ ID NO: 1148090 - RNA, 17 nt, Homo sapiens
aagcagucaauuuucac

SEQ ID NO: 1148091 - RNA, 20 nt, Homo sapiens
aagcaguuacuaauaugccu

SEQ ID NO: 1148092 - RNA, 15 nt, Homo sapiens
aagcaguuaguuccu

SEQ ID NO: 1148093 - RNA, 12 nt, Homo sapiens
aagcauacuuug

SEQ ID NO: 1148094 - RNA, 13 nt, Homo sapiens
aagcauacuuugu

SEQ ID NO: 1148095 - RNA, 21 nt, Homo sapiens
aagcauccuccccaccagagc

SEQ ID NO: 1148096 - RNA, 13 nt, Homo sapiens
aagcaugaagucu

SEQ ID NO: 1148097 - RNA, 19 nt, Homo sapiens
aagcaugucucugcuucca

SEQ ID NO: 1148098 - RNA, 14 nt, Homo sapiens
aagcaugugucaug

SEQ ID NO: 1148099 - RNA, 14 nt, Homo sapiens
aagcauugugagua

SEQ ID NO: 1148100 - RNA, 23 nt, Homo sapiens
aagccaagaaagaaaaauuaucu

SEQ ID NO: 1148101 - RNA, 18 nt, Homo sapiens
aagccaagagugccacau

SEQ ID NO: 1148102 - RNA, 19 nt, Homo sapiens
aagccaauucagacaggca

SEQ ID NO: 1148103 - RNA, 12 nt, Homo sapiens
aagccacauggu

SEQ ID NO: 1148104 - RNA, 12 nt, Homo sapiens
aagccacccucc

SEQ ID NO: 1148105 - RNA, 12 nt, Homo sapiens
aagccaugcccc

SEQ ID NO: 1148106 - RNA, 13 nt, Homo sapiens
aagccauguguau

SEQ ID NO: 1148107 - RNA, 14 nt, Homo sapiens
aagcccagccacau

SEQ ID NO: 1148108 - RNA, 18 nt, Homo sapiens
aagcccaugaguccuuga

SEQ ID NO: 1148109 - RNA, 15 nt, Homo sapiens
aagccccauccugcc

SEQ ID NO: 1148110 - RNA, 19 nt, Homo sapiens
aagcccccacuacaaguga

SEQ ID NO: 1148111 - RNA, 21 nt, Homo sapiens
aagccccgcauaugugaguga

SEQ ID NO: 1148112 - RNA, 16 nt, Homo sapiens
aagcccuuuauuuccu

SEQ ID NO: 1148113 - RNA, 16 nt, Homo sapiens
aagccggccugagaaa

SEQ ID NO: 1148114 - RNA, 18 nt, Homo sapiens
aagccuauguaugccaug

SEQ ID NO: 1148115 - RNA, 13 nt, Homo sapiens
aagccucagcuca

SEQ ID NO: 1148116 - RNA, 14 nt, Homo sapiens
aagccucagugaaa

SEQ ID NO: 1148117 - RNA, 16 nt, Homo sapiens
aagccuccuuacauua

SEQ ID NO: 1148118 - RNA, 16 nt, Homo sapiens
aagccucgacugagcu

SEQ ID NO: 1148119 - RNA, 13 nt, Homo sapiens
aagccucucagua

SEQ ID NO: 1148120 - RNA, 17 nt, Homo sapiens
aagccucugaucuggca

SEQ ID NO: 1148121 - RNA, 22 nt, Homo sapiens
aagccugcagucaucuugacca

SEQ ID NO: 1148122 - RNA, 18 nt, Homo sapiens
aagccuggccuacauggu

SEQ ID NO: 1148123 - RNA, 16 nt, Homo sapiens
aagccugucccaggac

SEQ ID NO: 1148124 - RNA, 13 nt, Homo sapiens
acagaauuccacc

SEQ ID NO: 1148125 - RNA, 23 nt, Homo sapiens
acagacaccaucuuuugugagau

SEQ ID NO: 1148126 - RNA, 15 nt, Homo sapiens
acagacagcuuagaa

SEQ ID NO: 1148127 - RNA, 22 nt, Homo sapiens
acagacauacauagacauuuca

SEQ ID NO: 1148128 - RNA, 16 nt, Homo sapiens
acagacauacauuucu

SEQ ID NO: 1148129 - RNA, 11 nt, Homo sapiens
acagacauauu

SEQ ID NO: 1148130 - RNA, 18 nt, Homo sapiens
acagacauccucuaugcc

SEQ ID NO: 1148131 - RNA, 15 nt, Homo sapiens
acagacgcuccugaa

SEQ ID NO: 1148132 - RNA, 15 nt, Homo sapiens
acagacucauuacaa

SEQ ID NO: 1148133 - RNA, 12 nt, Homo sapiens
acagacucuucc

SEQ ID NO: 1148134 - RNA, 18 nt, Homo sapiens
acagagcaggacugcaca

SEQ ID NO: 1148135 - RNA, 18 nt, Homo sapiens
acagagcaucccacagga

SEQ ID NO: 1148136 - RNA, 14 nt, Homo sapiens
acagaggcauuuaa

SEQ ID NO: 1148137 - RNA, 21 nt, Homo sapiens
acagagggaggaaugugugcc

SEQ ID NO: 1148138 - RNA, 14 nt, Homo sapiens
acagagggccagua

SEQ ID NO: 1148139 - RNA, 18 nt, Homo sapiens
acagagggcucaccucuu

SEQ ID NO: 1148140 - RNA, 20 nt, Homo sapiens
acagaggggagucaccagcc

SEQ ID NO: 1148141 - RNA, 14 nt, Homo sapiens
acagagggucacag

SEQ ID NO: 1148142 - RNA, 18 nt, Homo sapiens
acagauaccucucagugu

SEQ ID NO: 1148143 - RNA, 14 nt, Homo sapiens
acagauauucccuc

SEQ ID NO: 1148144 - RNA, 21 nt, Homo sapiens
acagaugaguuaucuaagaau

SEQ ID NO: 1148145 - RNA, 17 nt, Homo sapiens
acagaugcuggccucuu

SEQ ID NO: 1148146 - RNA, 13 nt, Homo sapiens
acagauggcucaa

SEQ ID NO: 1148147 - RNA, 21 nt, Homo sapiens
acagauguucccccaucucgc

SEQ ID NO: 1148148 - RNA, 22 nt, Homo sapiens
acagauucuuuucuauaaugug

SEQ ID NO: 1148149 - RNA, 16 nt, Homo sapiens
acagauugcugccuca

SEQ ID NO: 1148150 - RNA, 14 nt, Homo sapiens
acagauuucaguaa

SEQ ID NO: 1148151 - RNA, 15 nt, Homo sapiens
acagauuugugaacu

SEQ ID NO: 1148152 - RNA, 16 nt, Homo sapiens
acagcaagucaggguu

SEQ ID NO: 1148153 - RNA, 14 nt, Homo sapiens
acagcacacacuuc

SEQ ID NO: 1148154 - RNA, 13 nt, Homo sapiens
acagcacagccaa

SEQ ID NO: 1148155 - RNA, 16 nt, Homo sapiens
acagcacccucuccag

SEQ ID NO: 1148156 - RNA, 11 nt, Homo sapiens
acagcacuccu

SEQ ID NO: 1148157 - RNA, 21 nt, Homo sapiens
acagcacuuuuccucuucuag

SEQ ID NO: 1148158 - RNA, 17 nt, Homo sapiens
acagcaggguaccugaa

SEQ ID NO: 1148159 - RNA, 23 nt, Homo sapiens
acagccaacagcuacaacagccu

SEQ ID NO: 1148160 - RNA, 20 nt, Homo sapiens
acagccccuuaagcaugcuu

SEQ ID NO: 1148161 - RNA, 23 nt, Homo sapiens
acagccccuuaagcaugcuucua

SEQ ID NO: 1148162 - RNA, 15 nt, Homo sapiens
acagccuccaaguca

SEQ ID NO: 1148163 - RNA, 23 nt, Homo sapiens
acagccuucagcagcagcucaca

SEQ ID NO: 1148164 - RNA, 19 nt, Homo sapiens
acagcgaagacugcuaaau

SEQ ID NO: 1148165 - RNA, 16 nt, Homo sapiens
acagcuacaacagccu

SEQ ID NO: 1148166 - RNA, 18 nt, Homo sapiens
acagcucacugcagccuc

SEQ ID NO: 1148167 - RNA, 23 nt, Homo sapiens
acagcucugacuuuacacucggc

SEQ ID NO: 1148168 - RNA, 12 nt, Homo sapiens
acagcucugggc

SEQ ID NO: 1148169 - RNA, 13 nt, Homo sapiens
acagcucuuguuu

SEQ ID NO: 1148170 - RNA, 14 nt, Homo sapiens
acagcuuacugcag

SEQ ID NO: 1148171 - RNA, 20 nt, Homo sapiens
acagcuuccccucucuccuc

SEQ ID NO: 1148172 - RNA, 20 nt, Homo sapiens
acagcuuugcugcugaaggc

SEQ ID NO: 1148173 - RNA, 23 nt, Homo sapiens
acaggaagaaaauagaacagcuc

SEQ ID NO: 1148174 - RNA, 13 nt, Homo sapiens
acaggaagcugcc

SEQ ID NO: 1148175 - RNA, 16 nt, Homo sapiens
acaggagaaacacuug

SEQ ID NO: 1148176 - RNA, 14 nt, Homo sapiens
acaggagcugggau

SEQ ID NO: 1148177 - RNA, 16 nt, Homo sapiens
acaggaggucagcaca

SEQ ID NO: 1148178 - RNA, 21 nt, Homo sapiens
acaggaucauguaaaugcuca

SEQ ID NO: 1148179 - RNA, 13 nt, Homo sapiens
acaggcaccugcc

SEQ ID NO: 1148180 - RNA, 20 nt, Homo sapiens
acaggccaaugcuacuuuca

SEQ ID NO: 1148181 - RNA, 14 nt, Homo sapiens
acaggccagcccuu

SEQ ID NO: 1148182 - RNA, 15 nt, Homo sapiens
acaggccgagugaag

SEQ ID NO: 1148183 - RNA, 14 nt, Homo sapiens
acaggcucugacca

SEQ ID NO: 1148184 - RNA, 15 nt, Homo sapiens
acaggcucugaccag

SEQ ID NO: 1148185 - RNA, 20 nt, Homo sapiens
acaggcuggucucaaacucc

SEQ ID NO: 1148186 - RNA, 20 nt, Homo sapiens
acagggaaaacugcaaagcu

SEQ ID NO: 1148187 - RNA, 20 nt, Homo sapiens
acagggacaugcccugugug

SEQ ID NO: 1148188 - RNA, 21 nt, Homo sapiens
acagggagacccguccauuug

SEQ ID NO: 1148189 - RNA, 22 nt, Homo sapiens
acagggcuggaaagaggcugcu

SEQ ID NO: 1148190 - RNA, 19 nt, Homo sapiens
acaggguuucaccauguua

SEQ ID NO: 1148191 - RNA, 23 nt, Homo sapiens
acagguaauauaaaaagcuucca

SEQ ID NO: 1148192 - RNA, 17 nt, Homo sapiens
acaggugccuucccaga

SEQ ID NO: 1148193 - RNA, 17 nt, Homo sapiens
acagguggugucacugu

SEQ ID NO: 1148194 - RNA, 14 nt, Homo sapiens
acaggugugcacca

SEQ ID NO: 1148195 - RNA, 13 nt, Homo sapiens
acaguaacuguaa

SEQ ID NO: 1148196 - RNA, 19 nt, Homo sapiens
acaguaacuuuauguguaa

SEQ ID NO: 1148197 - RNA, 12 nt, Homo sapiens
acaguacauugu

SEQ ID NO: 1148198 - RNA, 17 nt, Homo sapiens
acaguacuugucuucac

SEQ ID NO: 1148199 - RNA, 22 nt, Homo sapiens
acaguaguuagaauuauaucac

SEQ ID NO: 1148200 - RNA, 14 nt, Homo sapiens
acaguauccacaau

SEQ ID NO: 1148201 - RNA, 20 nt, Homo sapiens
acaguaugauggaacaguga

SEQ ID NO: 1148202 - RNA, 16 nt, Homo sapiens
acagucacaugcccau

SEQ ID NO: 1148203 - RNA, 21 nt, Homo sapiens
acagucacucagccauuucua

SEQ ID NO: 1148204 - RNA, 18 nt, Homo sapiens
acaguccuggacuccugc

SEQ ID NO: 1148205 - RNA, 14 nt, Homo sapiens
acagucuagugcaa

SEQ ID NO: 1148206 - RNA, 14 nt, Homo sapiens
acagucucacuuug

SEQ ID NO: 1148207 - RNA, 14 nt, Homo sapiens
acagugacacugga

SEQ ID NO: 1148208 - RNA, 15 nt, Homo sapiens
acagugacacuggac

SEQ ID NO: 1148209 - RNA, 16 nt, Homo sapiens
acagugaugaugcaug

SEQ ID NO: 1148210 - RNA, 21 nt, Homo sapiens
acagugaugcugugcuaugaa

SEQ ID NO: 1148211 - RNA, 14 nt, Homo sapiens
acagugcacaugaa

SEQ ID NO: 1148212 - RNA, 18 nt, Homo sapiens
acagugccgacagcucuc

SEQ ID NO: 1148213 - RNA, 19 nt, Homo sapiens
acagugccgacagcucucc

SEQ ID NO: 1148214 - RNA, 21 nt, Homo sapiens
acaguguuaccugacuuauga

SEQ ID NO: 1148215 - RNA, 13 nt, Homo sapiens
acaguuccuucag

SEQ ID NO: 1148216 - RNA, 16 nt, Homo sapiens
acaguuccuucagcuu

SEQ ID NO: 1148217 - RNA, 20 nt, Homo sapiens
acaguucggugagcuacaaa

SEQ ID NO: 1148218 - RNA, 21 nt, Homo sapiens
acaguugauuugggggcacuu

SEQ ID NO: 1148219 - RNA, 22 nt, Homo sapiens
acaguuguccagaucacugaau

SEQ ID NO: 1148220 - RNA, 17 nt, Homo sapiens
acaguuuacaaaugaca

SEQ ID NO: 1148221 - RNA, 18 nt, Homo sapiens
acaguuuacuuugccaac

SEQ ID NO: 1148222 - RNA, 19 nt, Homo sapiens
acaguuuauaaagccaaga

SEQ ID NO: 1148223 - RNA, 23 nt, Homo sapiens
acaguuucguagcaugaguuuaa

SEQ ID NO: 1148224 - RNA, 18 nt, Homo sapiens
acaguuuggagcccacau

SEQ ID NO: 1148225 - RNA, 17 nt, Homo sapiens
acaguuuguggcuuaua

SEQ ID NO: 1148226 - RNA, 18 nt, Homo sapiens
acaguuuuugacauuuau

SEQ ID NO: 1148227 - RNA, 18 nt, Homo sapiens
acauaaaacaaaagcauu

SEQ ID NO: 1148228 - RNA, 19 nt, Homo sapiens
acauaaaaccugagcagca

SEQ ID NO: 1148229 - RNA, 17 nt, Homo sapiens
acauaaaauaagagauc

SEQ ID NO: 1148230 - RNA, 17 nt, Homo sapiens
acauaaaauuuacauuu

SEQ ID NO: 1148231 - RNA, 17 nt, Homo sapiens
acauaaguaccucagca

SEQ ID NO: 1148232 - RNA, 13 nt, Homo sapiens
acauaaguuauca

SEQ ID NO: 1148233 - RNA, 14 nt, Homo sapiens
acauaauaaauuaa

SEQ ID NO: 1148234 - RNA, 20 nt, Homo sapiens
acauaauggcugaagccaaa

SEQ ID NO: 1148235 - RNA, 21 nt, Homo sapiens
acauaauugugaccaauacau

SEQ ID NO: 1148236 - RNA, 18 nt, Homo sapiens
acauaauuuaauuccuuc

SEQ ID NO: 1148237 - RNA, 21 nt, Homo sapiens
acauacaaacauaaggcacau

SEQ ID NO: 1148238 - RNA, 12 nt, Homo sapiens
acauacaauuau

SEQ ID NO: 1148239 - RNA, 12 nt, Homo sapiens
acauacagugau

SEQ ID NO: 1148240 - RNA, 15 nt, Homo sapiens
acauaccacauggac

SEQ ID NO: 1148241 - RNA, 21 nt, Homo sapiens
acauaccuaugggauuuuaca

SEQ ID NO: 1148242 - RNA, 11 nt, Homo sapiens
acauacugcug

SEQ ID NO: 1148243 - RNA, 19 nt, Homo sapiens
acauacuugaagggccaga

SEQ ID NO: 1148244 - RNA, 15 nt, Homo sapiens
acauagaaagccaug

SEQ ID NO: 1148245 - RNA, 23 nt, Homo sapiens
acauagaaauggaaauuuugcua

SEQ ID NO: 1148246 - RNA, 15 nt, Homo sapiens
acauagaagagccaa

SEQ ID NO: 1148247 - RNA, 22 nt, Homo sapiens
acauaguagguacccaauucaa

SEQ ID NO: 1148248 - RNA, 15 nt, Homo sapiens
acauauauauuacaa

SEQ ID NO: 1148249 - RNA, 22 nt, Homo sapiens
acauaucuaaagucaucaugaa

SEQ ID NO: 1148250 - RNA, 12 nt, Homo sapiens
acauaugcaccu

SEQ ID NO: 1148251 - RNA, 17 nt, Homo sapiens
acauauggacucugcac

SEQ ID NO: 1148252 - RNA, 17 nt, Homo sapiens
accauuuuuuaaggaaa

SEQ ID NO: 1148253 - RNA, 13 nt, Homo sapiens
acccaacagugau

SEQ ID NO: 1148254 - RNA, 13 nt, Homo sapiens
acccaacaugacu

SEQ ID NO: 1148255 - RNA, 13 nt, Homo sapiens
acccaacucugua

SEQ ID NO: 1148256 - RNA, 22 nt, Homo sapiens
acccaagcaaaaucauggaaug

SEQ ID NO: 1148257 - RNA, 21 nt, Homo sapiens
acccaagcagagaagcucucg

SEQ ID NO: 1148258 - RNA, 13 nt, Homo sapiens
acccaagggcaga

SEQ ID NO: 1148259 - RNA, 17 nt, Homo sapiens
agaaaauaauugcaaau

SEQ ID NO: 1148260 - RNA, 13 nt, Homo sapiens
agaaaaugaauuu

SEQ ID NO: 1148261 - RNA, 17 nt, Homo sapiens
agaaaaugaauuugacu

SEQ ID NO: 1148262 - RNA, 20 nt, Homo sapiens
agaaaaugugucugcaacau

SEQ ID NO: 1148263 - RNA, 21 nt, Homo sapiens
agaaacaacuucuacuucugc

SEQ ID NO: 1148264 - RNA, 12 nt, Homo sapiens
agaaacaauguu

SEQ ID NO: 1148265 - RNA, 14 nt, Homo sapiens
agaaacacuugaac

SEQ ID NO: 1148266 - RNA, 22 nt, Homo sapiens
agaaaccugcguaacuccaucu

SEQ ID NO: 1148267 - RNA, 14 nt, Homo sapiens
agaaacgucuucua

SEQ ID NO: 1148268 - RNA, 12 nt, Homo sapiens
agaaacucccau

SEQ ID NO: 1148269 - RNA, 20 nt, Homo sapiens
agaaacuuacuaaauaucau

SEQ ID NO: 1148270 - RNA, 19 nt, Homo sapiens
agaaagccuucauaagccu

SEQ ID NO: 1148271 - RNA, 20 nt, Homo sapiens
agaaagccuucauaagccua

SEQ ID NO: 1148272 - RNA, 21 nt, Homo sapiens
agaaaggccaaggugcuggac

SEQ ID NO: 1148273 - RNA, 14 nt, Homo sapiens
agaaaggcuuuuua

SEQ ID NO: 1148274 - RNA, 22 nt, Homo sapiens
agaaagguugauguauuuagcu

SEQ ID NO: 1148275 - RNA, 16 nt, Homo sapiens
agaaaguaagcauuuc

SEQ ID NO: 1148276 - RNA, 15 nt, Homo sapiens
agaaauaaccacugc

SEQ ID NO: 1148277 - RNA, 21 nt, Homo sapiens
agaaauaaggacaagccuaac

SEQ ID NO: 1148278 - RNA, 14 nt, Homo sapiens
agaaauacaguaug

SEQ ID NO: 1148279 - RNA, 10 nt, Homo sapiens
agaaauaucu

SEQ ID NO: 1148280 - RNA, 15 nt, Homo sapiens
agaaaucuagaauuu

SEQ ID NO: 1148281 - RNA, 19 nt, Homo sapiens
agaaaucucccaugugcau

SEQ ID NO: 1148282 - RNA, 18 nt, Homo sapiens
agaaaugaugauguggaa

SEQ ID NO: 1148283 - RNA, 15 nt, Homo sapiens
agaaaugcacauuga

SEQ ID NO: 1148284 - RNA, 20 nt, Homo sapiens
agaaaugguuuccucuggau

SEQ ID NO: 1148285 - RNA, 19 nt, Homo sapiens
agaaauguuucugugucau

SEQ ID NO: 1148286 - RNA, 19 nt, Homo sapiens
agaaauuaacaaaugugcu

SEQ ID NO: 1148287 - RNA, 15 nt, Homo sapiens
agaaauuugaugaag

SEQ ID NO: 1148288 - RNA, 13 nt, Homo sapiens
agaacaagccacc

SEQ ID NO: 1148289 - RNA, 18 nt, Homo sapiens
agaacacacugagacuug

SEQ ID NO: 1148290 - RNA, 10 nt, Homo sapiens
agaacacagg

SEQ ID NO: 1148291 - RNA, 17 nt, Homo sapiens
agaacagaggcauuuaa

SEQ ID NO: 1148292 - RNA, 23 nt, Homo sapiens
agaacauaaagguaaaacaaaac

SEQ ID NO: 1148293 - RNA, 13 nt, Homo sapiens
agaacaugcaguu

SEQ ID NO: 1148294 - RNA, 14 nt, Homo sapiens
agaaccacucauaa

SEQ ID NO: 1148295 - RNA, 17 nt, Homo sapiens
agaaccacucauaauuc

SEQ ID NO: 1148296 - RNA, 15 nt, Homo sapiens
agaaccccguggggu

SEQ ID NO: 1148297 - RNA, 21 nt, Homo sapiens
agaaccggccuggagcuccuu

SEQ ID NO: 1148298 - RNA, 19 nt, Homo sapiens
agaacucaaauggggccag

SEQ ID NO: 1148299 - RNA, 17 nt, Homo sapiens
agaacucaccacaagcc

SEQ ID NO: 1148300 - RNA, 12 nt, Homo sapiens
agaacucugaau

SEQ ID NO: 1148301 - RNA, 23 nt, Homo sapiens
agaacuucacagugacacuggac

SEQ ID NO: 1148302 - RNA, 20 nt, Homo sapiens
agaacuucuccuacuguagc

SEQ ID NO: 1148303 - RNA, 20 nt, Homo sapiens
agaacuuugcauagcagcug

SEQ ID NO: 1148304 - RNA, 15 nt, Homo sapiens
agaacuuuucuuacu

SEQ ID NO: 1148305 - RNA, 15 nt, Homo sapiens
agaagaaagcucaga

SEQ ID NO: 1148306 - RNA, 15 nt, Homo sapiens
agaagacaacauuaa

SEQ ID NO: 1148307 - RNA, 20 nt, Homo sapiens
agaagaccuuuacaguuugu

SEQ ID NO: 1148308 - RNA, 12 nt, Homo sapiens
agaagacugugc

SEQ ID NO: 1148309 - RNA, 14 nt, Homo sapiens
agaagagagaacuu

SEQ ID NO: 1148310 - RNA, 22 nt, Homo sapiens
agaagagcagcuucggugugca

SEQ ID NO: 1148311 - RNA, 21 nt, Homo sapiens
agaagaguuggagugagauga

SEQ ID NO: 1148312 - RNA, 17 nt, Homo sapiens
agaagauaggcucucag

SEQ ID NO: 1148313 - RNA, 12 nt, Homo sapiens
agaagcagcccu

SEQ ID NO: 1148314 - RNA, 15 nt, Homo sapiens
agaagccagagggug

SEQ ID NO: 1148315 - RNA, 10 nt, Homo sapiens
agaagccauu

SEQ ID NO: 1148316 - RNA, 24 nt, Homo sapiens
agaagcgcugauggucauauccaa

SEQ ID NO: 1148317 - RNA, 16 nt, Homo sapiens
agaagcugucagggac

SEQ ID NO: 1148318 - RNA, 21 nt, Homo sapiens
agaagcugucugcguuuacuc

SEQ ID NO: 1148319 - RNA, 17 nt, Homo sapiens
agaaggauguacauuuc

SEQ ID NO: 1148320 - RNA, 16 nt, Homo sapiens
agaaggcggaaaccca

SEQ ID NO: 1148321 - RNA, 20 nt, Homo sapiens
agaagguggaccuggcagug

SEQ ID NO: 1148322 - RNA, 20 nt, Homo sapiens
agaagguuaccaagaagccu

SEQ ID NO: 1148323 - RNA, 14 nt, Homo sapiens
agaaguaacuuauu

SEQ ID NO: 1148324 - RNA, 18 nt, Homo sapiens
agaaguaagaagaggagc

SEQ ID NO: 1148325 - RNA, 13 nt, Homo sapiens
agaaguagcuuca

SEQ ID NO: 1148326 - RNA, 13 nt, Homo sapiens
agaaguucacauc

SEQ ID NO: 1148327 - RNA, 19 nt, Homo sapiens
agaaguuggucuuacuuug

SEQ ID NO: 1148328 - RNA, 14 nt, Homo sapiens
agaaguuguggcuu

SEQ ID NO: 1148329 - RNA, 13 nt, Homo sapiens
agaaguuugcacu

SEQ ID NO: 1148330 - RNA, 14 nt, Homo sapiens
agaauaaacaacua

SEQ ID NO: 1148331 - RNA, 14 nt, Homo sapiens
agaauacaauggga

SEQ ID NO: 1148332 - RNA, 18 nt, Homo sapiens
agaauacugccaaaacau

SEQ ID NO: 1148333 - RNA, 15 nt, Homo sapiens
agaauagaacuauug

SEQ ID NO: 1148334 - RNA, 15 nt, Homo sapiens
agaauauaaugugca

SEQ ID NO: 1148335 - RNA, 13 nt, Homo sapiens
agaaucaaaugca

SEQ ID NO: 1148336 - RNA, 13 nt, Homo sapiens
agaaucacuugaa

SEQ ID NO: 1148337 - RNA, 14 nt, Homo sapiens
agaaucacuugaac

SEQ ID NO: 1148338 - RNA, 22 nt, Homo sapiens
agaauccaucuucagaccuuug

SEQ ID NO: 1148339 - RNA, 19 nt, Homo sapiens
agaaucccucuacauggac

SEQ ID NO: 1148340 - RNA, 22 nt, Homo sapiens
agaaucgcuugaaccugggaag

SEQ ID NO: 1148341 - RNA, 17 nt, Homo sapiens
agaaucuugguuugccu

SEQ ID NO: 1148342 - RNA, 18 nt, Homo sapiens
agaaugaaauguaugugc

SEQ ID NO: 1148343 - RNA, 20 nt, Homo sapiens
agaaugaaauguaugugcuc

SEQ ID NO: 1148344 - RNA, 14 nt, Homo sapiens
agaaugaaccacug

SEQ ID NO: 1148345 - RNA, 13 nt, Homo sapiens
agaaugcaucuca

SEQ ID NO: 1148346 - RNA, 16 nt, Homo sapiens
agaauggaagccugaa

SEQ ID NO: 1148347 - RNA, 11 nt, Homo sapiens
agaauggagcu

SEQ ID NO: 1148348 - RNA, 16 nt, Homo sapiens
agaaugguauuugaau

SEQ ID NO: 1148349 - RNA, 21 nt, Homo sapiens
agaauggugcucuuaucuuuc

SEQ ID NO: 1148350 - RNA, 11 nt, Homo sapiens
agaauguuucu

SEQ ID NO: 1148351 - RNA, 18 nt, Homo sapiens
agaauguuuugcacugac

SEQ ID NO: 1148352 - RNA, 20 nt, Homo sapiens
agaauucacuuuaugugaga

SEQ ID NO: 1148353 - RNA, 22 nt, Homo sapiens
agaauugauucauguucaucaa

SEQ ID NO: 1148354 - RNA, 17 nt, Homo sapiens
agaauugccaucgguca

SEQ ID NO: 1148355 - RNA, 22 nt, Homo sapiens
agaauugcucccuaccagcuga

SEQ ID NO: 1148356 - RNA, 12 nt, Homo sapiens
agaauuucacaa

SEQ ID NO: 1148357 - RNA, 16 nt, Homo sapiens
agaauuucccagugaa

SEQ ID NO: 1148358 - RNA, 18 nt, Homo sapiens
agaauuugagugcucuga

SEQ ID NO: 1148359 - RNA, 15 nt, Homo sapiens
agacaaaaucucuau

SEQ ID NO: 1148360 - RNA, 23 nt, Homo sapiens
agacaaauacuuagacaguaugc

SEQ ID NO: 1148361 - RNA, 14 nt, Homo sapiens
agacaacacuggga

SEQ ID NO: 1148362 - RNA, 17 nt, Homo sapiens
agacaaguaaucacuaa

SEQ ID NO: 1148363 - RNA, 14 nt, Homo sapiens
agacaagugcucaa

SEQ ID NO: 1148364 - RNA, 16 nt, Homo sapiens
agacaauagcccaaag

SEQ ID NO: 1148365 - RNA, 13 nt, Homo sapiens
agacaaugucugc

SEQ ID NO: 1148366 - RNA, 19 nt, Homo sapiens
agacaaugugccacagauc

SEQ ID NO: 1148367 - RNA, 18 nt, Homo sapiens
agacaauucuuuauacaa

SEQ ID NO: 1148368 - RNA, 17 nt, Homo sapiens
agacacauucacacugg

SEQ ID NO: 1148369 - RNA, 16 nt, Homo sapiens
agacaccaaaguucua

SEQ ID NO: 1148370 - RNA, 20 nt, Homo sapiens
agacacucagaccagagaag

SEQ ID NO: 1148371 - RNA, 19 nt, Homo sapiens
agacacuggcguuacugcu

SEQ ID NO: 1148372 - RNA, 22 nt, Homo sapiens
agacacuguuacagagauacug

SEQ ID NO: 1148373 - RNA, 17 nt, Homo sapiens
agacagaaccuuguuau

SEQ ID NO: 1148374 - RNA, 14 nt, Homo sapiens
agacagaguccugc

SEQ ID NO: 1148375 - RNA, 22 nt, Homo sapiens
agacagcccaacagcuguuccu

SEQ ID NO: 1148376 - RNA, 19 nt, Homo sapiens
agacagcuuacugcagcac

SEQ ID NO: 1148377 - RNA, 20 nt, Homo sapiens
agacaggaggucagcacaag

SEQ ID NO: 1148378 - RNA, 13 nt, Homo sapiens
agacagugaaaga

SEQ ID NO: 1148379 - RNA, 16 nt, Homo sapiens
agacagugaugccugc

SEQ ID NO: 1148380 - RNA, 16 nt, Homo sapiens
agacagugcacaugaa

SEQ ID NO: 1148381 - RNA, 18 nt, Homo sapiens
agacagugcacaugaacu

SEQ ID NO: 1148382 - RNA, 13 nt, Homo sapiens
agacagugggaaa

SEQ ID NO: 1148383 - RNA, 21 nt, Homo sapiens
agacaguguuuugcacaucau

SEQ ID NO: 1148384 - RNA, 18 nt, Homo sapiens
acucaugguguguuacac

SEQ ID NO: 1148385 - RNA, 13 nt, Homo sapiens
acucauugcugag

SEQ ID NO: 1148386 - RNA, 23 nt, Homo sapiens
acuccacccguucccacugcccu

SEQ ID NO: 1148387 - RNA, 14 nt, Homo sapiens
acuccagacuugua

SEQ ID NO: 1148388 - RNA, 17 nt, Homo sapiens
acuccagaguguucuca

SEQ ID NO: 1148389 - RNA, 14 nt, Homo sapiens
acuccagauaugaa

SEQ ID NO: 1148390 - RNA, 18 nt, Homo sapiens
acuccagauaugugccaa

SEQ ID NO: 1148391 - RNA, 19 nt, Homo sapiens
acuccagccugggugacag

SEQ ID NO: 1148392 - RNA, 21 nt, Homo sapiens
acuccagcuugggcaacagag

SEQ ID NO: 1148393 - RNA, 22 nt, Homo sapiens
acuccagcuugggcaacagagc

SEQ ID NO: 1148394 - RNA, 15 nt, Homo sapiens
acuccaucucaaaaa

SEQ ID NO: 1148395 - RNA, 17 nt, Homo sapiens
acuccaucugacaaauu

SEQ ID NO: 1148396 - RNA, 20 nt, Homo sapiens
acucccauuaaaaacaaaac

SEQ ID NO: 1148397 - RNA, 20 nt, Homo sapiens
acuccccagccuccucugga

SEQ ID NO: 1148398 - RNA, 16 nt, Homo sapiens
acucccccaaccaagg

SEQ ID NO: 1148399 - RNA, 17 nt, Homo sapiens
acucccccaaccaagga

SEQ ID NO: 1148400 - RNA, 17 nt, Homo sapiens
acuccccuuucuuccaa

SEQ ID NO: 1148401 - RNA, 17 nt, Homo sapiens
acucccuccucacacuc

SEQ ID NO: 1148402 - RNA, 20 nt, Homo sapiens
acucccugaucccaguuucu

SEQ ID NO: 1148403 - RNA, 20 nt, Homo sapiens
acuccgagagcaugcuuaau

SEQ ID NO: 1148404 - RNA, 17 nt, Homo sapiens
acuccuagauccaggga

SEQ ID NO: 1148405 - RNA, 15 nt, Homo sapiens
acuccuccuagccac

SEQ ID NO: 1148406 - RNA, 17 nt, Homo sapiens
acuccuccugagcucug

SEQ ID NO: 1148407 - RNA, 18 nt, Homo sapiens
acuccucucaacugccuc

SEQ ID NO: 1148408 - RNA, 20 nt, Homo sapiens
acuccugaagggaaggcaaa

SEQ ID NO: 1148409 - RNA, 23 nt, Homo sapiens
acuccugaagggaaggcaaaggc

SEQ ID NO: 1148410 - RNA, 12 nt, Homo sapiens
acuccugacccc

SEQ ID NO: 1148411 - RNA, 14 nt, Homo sapiens
acuccugagcucaa

SEQ ID NO: 1148412 - RNA, 20 nt, Homo sapiens
acuccugaggacagcugucc

SEQ ID NO: 1148413 - RNA, 21 nt, Homo sapiens
acuccugggggagaaccacug

SEQ ID NO: 1148414 - RNA, 23 nt, Homo sapiens
acuccuuaggaggagugagacag

SEQ ID NO: 1148415 - RNA, 17 nt, Homo sapiens
acucgcaggaccaaggg

SEQ ID NO: 1148416 - RNA, 13 nt, Homo sapiens
acucuacauuuaa

SEQ ID NO: 1148417 - RNA, 18 nt, Homo sapiens
acucuagggggacuuucu

SEQ ID NO: 1148418 - RNA, 22 nt, Homo sapiens
acucuaucggagaacaugaauc

SEQ ID NO: 1148419 - RNA, 18 nt, Homo sapiens
acucucaccaaaugagaa

SEQ ID NO: 1148420 - RNA, 16 nt, Homo sapiens
acucuccaauguucua

SEQ ID NO: 1148421 - RNA, 21 nt, Homo sapiens
acucuccacaaaaacucuuau

SEQ ID NO: 1148422 - RNA, 14 nt, Homo sapiens
acucuccaccacac

SEQ ID NO: 1148423 - RNA, 13 nt, Homo sapiens
acucuccagacau

SEQ ID NO: 1148424 - RNA, 13 nt, Homo sapiens
acucuccugccuc

SEQ ID NO: 1148425 - RNA, 19 nt, Homo sapiens
acucuccugugaacacugg

SEQ ID NO: 1148426 - RNA, 13 nt, Homo sapiens
acucuccuugcag

SEQ ID NO: 1148427 - RNA, 17 nt, Homo sapiens
acucucgcaucuuccca

SEQ ID NO: 1148428 - RNA, 15 nt, Homo sapiens
acucucuaccagaua

SEQ ID NO: 1148429 - RNA, 14 nt, Homo sapiens
acucugcacauguc

SEQ ID NO: 1148430 - RNA, 15 nt, Homo sapiens
acucugcacaugucu

SEQ ID NO: 1148431 - RNA, 19 nt, Homo sapiens
acucugcacaugucuugua

SEQ ID NO: 1148432 - RNA, 20 nt, Homo sapiens
acucugcacaugucuuguac

SEQ ID NO: 1148433 - RNA, 17 nt, Homo sapiens
acucugccucuguauau

SEQ ID NO: 1148434 - RNA, 14 nt, Homo sapiens
acucugcugucuaa

SEQ ID NO: 1148435 - RNA, 18 nt, Homo sapiens
acucuggccacccaaaca

SEQ ID NO: 1148436 - RNA, 19 nt, Homo sapiens
acucuggccacccaaacag

SEQ ID NO: 1148437 - RNA, 16 nt, Homo sapiens
acucugguucuuuuaa

SEQ ID NO: 1148438 - RNA, 17 nt, Homo sapiens
acucuguaaaagugucu

SEQ ID NO: 1148439 - RNA, 19 nt, Homo sapiens
acucugucuggauuugccu

SEQ ID NO: 1148440 - RNA, 17 nt, Homo sapiens
acucugucuuguucacu

SEQ ID NO: 1148441 - RNA, 15 nt, Homo sapiens
acucuguuuuucaca

SEQ ID NO: 1148442 - RNA, 21 nt, Homo sapiens
acucuuauagaaaguucaaaa

SEQ ID NO: 1148443 - RNA, 10 nt, Homo sapiens
acucuucccu

SEQ ID NO: 1148444 - RNA, 23 nt, Homo sapiens
acucuucccuuccccucucucau

SEQ ID NO: 1148445 - RNA, 19 nt, Homo sapiens
acucuuguuuucaguuuca

SEQ ID NO: 1148446 - RNA, 15 nt, Homo sapiens
acugaaaaccucucc

SEQ ID NO: 1148447 - RNA, 21 nt, Homo sapiens
acugaaacuguaugugcugua

SEQ ID NO: 1148448 - RNA, 14 nt, Homo sapiens
acugaaagugaaag

SEQ ID NO: 1148449 - RNA, 14 nt, Homo sapiens
acugaaaguuuaac

SEQ ID NO: 1148450 - RNA, 23 nt, Homo sapiens
acugaaauuaaaacuauucaugc

SEQ ID NO: 1148451 - RNA, 16 nt, Homo sapiens
acugaacuguguguaa

SEQ ID NO: 1148452 - RNA, 18 nt, Homo sapiens
acugaacuuacacuguau

SEQ ID NO: 1148453 - RNA, 18 nt, Homo sapiens
acugaagauuaucacuua

SEQ ID NO: 1148454 - RNA, 14 nt, Homo sapiens
acugaagccuuucu

SEQ ID NO: 1148455 - RNA, 19 nt, Homo sapiens
acugaaguagugugcaguu

SEQ ID NO: 1148456 - RNA, 14 nt, Homo sapiens
acugaagugcuugc

SEQ ID NO: 1148457 - RNA, 21 nt, Homo sapiens
acugaaguuuuugaaauaccu

SEQ ID NO: 1148458 - RNA, 13 nt, Homo sapiens
acugaauacuuga

SEQ ID NO: 1148459 - RNA, 15 nt, Homo sapiens
acugaauugcaaaau

SEQ ID NO: 1148460 - RNA, 16 nt, Homo sapiens
acugaauuucuuugau

SEQ ID NO: 1148461 - RNA, 19 nt, Homo sapiens
acugaauuuuggaggcaaa

SEQ ID NO: 1148462 - RNA, 17 nt, Homo sapiens
acugaccauguucuuca

SEQ ID NO: 1148463 - RNA, 15 nt, Homo sapiens
acugaccugccugua

SEQ ID NO: 1148464 - RNA, 13 nt, Homo sapiens
acugagaaagcca

SEQ ID NO: 1148465 - RNA, 16 nt, Homo sapiens
acugagaaagccaaug

SEQ ID NO: 1148466 - RNA, 17 nt, Homo sapiens
acugagaaagccaauga

SEQ ID NO: 1148467 - RNA, 21 nt, Homo sapiens
acugagcaucuccagcauucu

SEQ ID NO: 1148468 - RNA, 20 nt, Homo sapiens
acugagccuccacagcagug

SEQ ID NO: 1148469 - RNA, 23 nt, Homo sapiens
acugagcgaggaaaaacaacaaa

SEQ ID NO: 1148470 - RNA, 15 nt, Homo sapiens
acugagcugcuaaaa

SEQ ID NO: 1148471 - RNA, 18 nt, Homo sapiens
acugaggagcggacucac

SEQ ID NO: 1148472 - RNA, 21 nt, Homo sapiens
acugaggcaggcauggaguug

SEQ ID NO: 1148473 - RNA, 15 nt, Homo sapiens
acugaggcagggaag

SEQ ID NO: 1148474 - RNA, 15 nt, Homo sapiens
acugaggugcaaagg

SEQ ID NO: 1148475 - RNA, 21 nt, Homo sapiens
acugagguuuuuaacauguau

SEQ ID NO: 1148476 - RNA, 23 nt, Homo sapiens
acugagugugggagugcagagaa

SEQ ID NO: 1148477 - RNA, 17 nt, Homo sapiens
acugauaaaaaugauau

SEQ ID NO: 1148478 - RNA, 12 nt, Homo sapiens
acugaugcugcc

SEQ ID NO: 1148479 - RNA, 15 nt, Homo sapiens
acugauucacugcau

SEQ ID NO: 1148480 - RNA, 17 nt, Homo sapiens
acugcaaacccuuucau

SEQ ID NO: 1148481 - RNA, 15 nt, Homo sapiens
acugcaaccucugcc

SEQ ID NO: 1148482 - RNA, 13 nt, Homo sapiens
acugcaagcucca

SEQ ID NO: 1148483 - RNA, 24 nt, Homo sapiens
acugcacacagggugguggcacau

SEQ ID NO: 1148484 - RNA, 14 nt, Homo sapiens
acugcacacuucca

SEQ ID NO: 1148485 - RNA, 20 nt, Homo sapiens
acugcaccauugcugcuccu

SEQ ID NO: 1148486 - RNA, 15 nt, Homo sapiens
acugcacuccaggcu

SEQ ID NO: 1148487 - RNA, 21 nt, Homo sapiens
acugcagagagacaacagauu

SEQ ID NO: 1148488 - RNA, 23 nt, Homo sapiens
acugcagggaaaauuauuugcau

SEQ ID NO: 1148489 - RNA, 14 nt, Homo sapiens
acugcauacaaucu

SEQ ID NO: 1148490 - RNA, 20 nt, Homo sapiens
acugcauugccgaaguccag

SEQ ID NO: 1148491 - RNA, 17 nt, Homo sapiens
acugccaaaacauuuau

SEQ ID NO: 1148492 - RNA, 23 nt, Homo sapiens
acugccaggauuuuguauugcca

SEQ ID NO: 1148493 - RNA, 16 nt, Homo sapiens
acugccauuacccagu

SEQ ID NO: 1148494 - RNA, 21 nt, Homo sapiens
acugccggggguucaggguug

SEQ ID NO: 1148495 - RNA, 13 nt, Homo sapiens
acugccugaauaa

SEQ ID NO: 1148496 - RNA, 14 nt, Homo sapiens
acugcuacaugugc

SEQ ID NO: 1148497 - RNA, 20 nt, Homo sapiens
acugcuacuugcucugcucu

SEQ ID NO: 1148498 - RNA, 17 nt, Homo sapiens
acugcuggaaaucucaa

SEQ ID NO: 1148499 - RNA, 23 nt, Homo sapiens
acugcuguaacugguaguguuca

SEQ ID NO: 1148500 - RNA, 21 nt, Homo sapiens
acugcuguuuuuaugauucag

SEQ ID NO: 1148501 - RNA, 19 nt, Homo sapiens
acuggaaaaaugaacugua

SEQ ID NO: 1148502 - RNA, 20 nt, Homo sapiens
acuggaaccaccuggacgaa

SEQ ID NO: 1148503 - RNA, 14 nt, Homo sapiens
acuggaccagacaa

SEQ ID NO: 1148504 - RNA, 15 nt, Homo sapiens
acuggagaguggcaa

SEQ ID NO: 1148505 - RNA, 14 nt, Homo sapiens
acuggcagcauuga

SEQ ID NO: 1148506 - RNA, 15 nt, Homo sapiens
acuggccucaaguga

SEQ ID NO: 1148507 - RNA, 21 nt, Homo sapiens
acuggcuucucuugagucaca

SEQ ID NO: 1148508 - RNA, 14 nt, Homo sapiens
acugggaucacagg

SEQ ID NO: 1148509 - RNA, 20 nt, Homo sapiens
acugggguuggaagugcaga

SEQ ID NO: 1148510 - RNA, 18 nt, Homo sapiens
acugggucugaccuggug

SEQ ID NO: 1148511 - RNA, 22 nt, Homo sapiens
acugguauauacgugugguuca

SEQ ID NO: 1148512 - RNA, 16 nt, Homo sapiens
acugguauguguggau

SEQ ID NO: 1148513 - RNA, 14 nt, Homo sapiens
acuggucucuggcu

SEQ ID NO: 1148514 - RNA, 14 nt, Homo sapiens
acugguuaucacac

SEQ ID NO: 1148515 - RNA, 18 nt, Homo sapiens
acugguuauccugugcua

SEQ ID NO: 1148516 - RNA, 13 nt, Homo sapiens
acugguucuugcc

SEQ ID NO: 1148517 - RNA, 22 nt, Homo sapiens
acuguaagucauuuauggguua

SEQ ID NO: 1148518 - RNA, 22 nt, Homo sapiens
cacaagaaaucaaaauccaaaa

SEQ ID NO: 1148519 - RNA, 18 nt, Homo sapiens
cacaagaaucacuugaac

SEQ ID NO: 1148520 - RNA, 22 nt, Homo sapiens
cacaagauacacgucacaaaga

SEQ ID NO: 1148521 - RNA, 15 nt, Homo sapiens
cacaaggccuugccu

SEQ ID NO: 1148522 - RNA, 15 nt, Homo sapiens
cacaaggggcuccac

SEQ ID NO: 1148523 - RNA, 19 nt, Homo sapiens
cacaaggucuuuaaaguga

SEQ ID NO: 1148524 - RNA, 20 nt, Homo sapiens
cacaagucauaccuacauuc

SEQ ID NO: 1148525 - RNA, 21 nt, Homo sapiens
cacaagucauaccuacauuca

SEQ ID NO: 1148526 - RNA, 14 nt, Homo sapiens
cacaaguuacacug

SEQ ID NO: 1148527 - RNA, 14 nt, Homo sapiens
cacaauaccacuau

SEQ ID NO: 1148528 - RNA, 12 nt, Homo sapiens
cacaaucugaca

SEQ ID NO: 1148529 - RNA, 21 nt, Homo sapiens
cacaaucuguucuacucuuaa

SEQ ID NO: 1148530 - RNA, 16 nt, Homo sapiens
cacaauguuauuaccu

SEQ ID NO: 1148531 - RNA, 16 nt, Homo sapiens
cacaauuucuuuaaaa

SEQ ID NO: 1148532 - RNA, 20 nt, Homo sapiens
cacacaacagccaacagcua

SEQ ID NO: 1148533 - RNA, 15 nt, Homo sapiens
cacacacaguuugag

SEQ ID NO: 1148534 - RNA, 12 nt, Homo sapiens
cacacacuccuu

SEQ ID NO: 1148535 - RNA, 20 nt, Homo sapiens
cacacagaaaauauacugua

SEQ ID NO: 1148536 - RNA, 22 nt, Homo sapiens
cacacagaaaauauacuguaaa

SEQ ID NO: 1148537 - RNA, 22 nt, Homo sapiens
cacacagcuacucuccccacga

SEQ ID NO: 1148538 - RNA, 21 nt, Homo sapiens
cacacagggugguggcacauu

SEQ ID NO: 1148539 - RNA, 15 nt, Homo sapiens
cacacagugccugua

SEQ ID NO: 1148540 - RNA, 17 nt, Homo sapiens
cacacaucccagcccaa

SEQ ID NO: 1148541 - RNA, 21 nt, Homo sapiens
cacacaucccagcccaaucca

SEQ ID NO: 1148542 - RNA, 14 nt, Homo sapiens
cacacauugugcuu

SEQ ID NO: 1148543 - RNA, 15 nt, Homo sapiens
cacaccagaaagcua

SEQ ID NO: 1148544 - RNA, 14 nt, Homo sapiens
cacaccauucaggu

SEQ ID NO: 1148545 - RNA, 14 nt, Homo sapiens
cacacccaauucca

SEQ ID NO: 1148546 - RNA, 21 nt, Homo sapiens
cacacccaauuccacucugau

SEQ ID NO: 1148547 - RNA, 19 nt, Homo sapiens
cacaccuacaccucuugaa

SEQ ID NO: 1148548 - RNA, 17 nt, Homo sapiens
cacaccuagcaucucau

SEQ ID NO: 1148549 - RNA, 11 nt, Homo sapiens
cacaccugcag

SEQ ID NO: 1148550 - RNA, 11 nt, Homo sapiens
cacaccugugg

SEQ ID NO: 1148551 - RNA, 21 nt, Homo sapiens
cacacuauuucccucuacuga

SEQ ID NO: 1148552 - RNA, 10 nt, Homo sapiens
cacacuccua

SEQ ID NO: 1148553 - RNA, 14 nt, Homo sapiens
cacacucuccugug

SEQ ID NO: 1148554 - RNA, 12 nt, Homo sapiens
cacacucugugu

SEQ ID NO: 1148555 - RNA, 14 nt, Homo sapiens
cacacugugacaca

SEQ ID NO: 1148556 - RNA, 20 nt, Homo sapiens
cacagaacacagcaauuccu

SEQ ID NO: 1148557 - RNA, 13 nt, Homo sapiens
cacagaagcacau

SEQ ID NO: 1148558 - RNA, 14 nt, Homo sapiens
cacagaaggaauaa

SEQ ID NO: 1148559 - RNA, 17 nt, Homo sapiens
cacagaagguccuggug

SEQ ID NO: 1148560 - RNA, 14 nt, Homo sapiens
cacagaaugugaua

SEQ ID NO: 1148561 - RNA, 21 nt, Homo sapiens
cacagacauccucuaugccag

SEQ ID NO: 1148562 - RNA, 19 nt, Homo sapiens
cacagagcacgccugccau

SEQ ID NO: 1148563 - RNA, 16 nt, Homo sapiens
cacagaugcuguguaa

SEQ ID NO: 1148564 - RNA, 12 nt, Homo sapiens
cacagcacauuu

SEQ ID NO: 1148565 - RNA, 20 nt, Homo sapiens
cacagccacacacacagaaa

SEQ ID NO: 1148566 - RNA, 13 nt, Homo sapiens
cacagcggcugcc

SEQ ID NO: 1148567 - RNA, 19 nt, Homo sapiens
cacagcguccuguccacac

SEQ ID NO: 1148568 - RNA, 16 nt, Homo sapiens
cacagcugaacuuguu

SEQ ID NO: 1148569 - RNA, 19 nt, Homo sapiens
cacagcuuauggcaucuca

SEQ ID NO: 1148570 - RNA, 17 nt, Homo sapiens
cacaggaggugugauag

SEQ ID NO: 1148571 - RNA, 17 nt, Homo sapiens
cacagggugguggcaca

SEQ ID NO: 1148572 - RNA, 20 nt, Homo sapiens
cacaggucaggggugacaca

SEQ ID NO: 1148573 - RNA, 20 nt, Homo sapiens
cacaggugcgggaccaucug

SEQ ID NO: 1148574 - RNA, 13 nt, Homo sapiens
cacagguguugaa

SEQ ID NO: 1148575 - RNA, 14 nt, Homo sapiens
cacagucacaugcc

SEQ ID NO: 1148576 - RNA, 14 nt, Homo sapiens
cacagucaugugcc

SEQ ID NO: 1148577 - RNA, 15 nt, Homo sapiens
cacaguuucuuccau

SEQ ID NO: 1148578 - RNA, 18 nt, Homo sapiens
cacauacccucacuuaaa

SEQ ID NO: 1148579 - RNA, 13 nt, Homo sapiens
cacauacuaccua

SEQ ID NO: 1148580 - RNA, 23 nt, Homo sapiens
cacauagaggccuucccauccag

SEQ ID NO: 1148581 - RNA, 22 nt, Homo sapiens
cacauauauauuacaagggaua

SEQ ID NO: 1148582 - RNA, 17 nt, Homo sapiens
cacauauggacucugca

SEQ ID NO: 1148583 - RNA, 18 nt, Homo sapiens
cacauauggacucugcac

SEQ ID NO: 1148584 - RNA, 23 nt, Homo sapiens
cacaucccuggaaggacauccau

SEQ ID NO: 1148585 - RNA, 16 nt, Homo sapiens
cacaucuaaccucauc

SEQ ID NO: 1148586 - RNA, 19 nt, Homo sapiens
cacaucugugucucuggaa

SEQ ID NO: 1148587 - RNA, 18 nt, Homo sapiens
cacaucuuccauuuccau

SEQ ID NO: 1148588 - RNA, 13 nt, Homo sapiens
cacaucuuuucca

SEQ ID NO: 1148589 - RNA, 19 nt, Homo sapiens
cacaugaaaccuacacacu

SEQ ID NO: 1148590 - RNA, 14 nt, Homo sapiens
cacaugaucuggcc

SEQ ID NO: 1148591 - RNA, 15 nt, Homo sapiens
cacaugcuacaagac

SEQ ID NO: 1148592 - RNA, 15 nt, Homo sapiens
cacauggccuaugca

SEQ ID NO: 1148593 - RNA, 16 nt, Homo sapiens
cacauggccuaugcac

SEQ ID NO: 1148594 - RNA, 13 nt, Homo sapiens
cacaugguuguga

SEQ ID NO: 1148595 - RNA, 14 nt, Homo sapiens
cacauguggccaug

SEQ ID NO: 1148596 - RNA, 23 nt, Homo sapiens
cacauucuuaacacauguccuug

SEQ ID NO: 1148597 - RNA, 16 nt, Homo sapiens
cacauuucacauugaa

SEQ ID NO: 1148598 - RNA, 23 nt, Homo sapiens
cacauuuuuauaaaaaugagugc

SEQ ID NO: 1148599 - RNA, 12 nt, Homo sapiens
caccaaaugaau

SEQ ID NO: 1148600 - RNA, 20 nt, Homo sapiens
caccaagcagcaacagcaaa

SEQ ID NO: 1148601 - RNA, 17 nt, Homo sapiens
caccaauaucaguccuc

SEQ ID NO: 1148602 - RNA, 19 nt, Homo sapiens
caccaauuaaguguugaaa

SEQ ID NO: 1148603 - RNA, 16 nt, Homo sapiens
caccacacugauccag

SEQ ID NO: 1148604 - RNA, 23 nt, Homo sapiens
caccacagcuuauggcaucucau

SEQ ID NO: 1148605 - RNA, 15 nt, Homo sapiens
caccacaugccuuca

SEQ ID NO: 1148606 - RNA, 17 nt, Homo sapiens
caccacccccacuggug

SEQ ID NO: 1148607 - RNA, 20 nt, Homo sapiens
caccacccccacuggugaga

SEQ ID NO: 1148608 - RNA, 15 nt, Homo sapiens
caccacgucacuuca

SEQ ID NO: 1148609 - RNA, 17 nt, Homo sapiens
caccacuaacaugcccu

SEQ ID NO: 1148610 - RNA, 23 nt, Homo sapiens
caccacuaacaugcccuguucag

SEQ ID NO: 1148611 - RNA, 14 nt, Homo sapiens
caccacucuugacu

SEQ ID NO: 1148612 - RNA, 20 nt, Homo sapiens
caccacugcuuaagugccua

SEQ ID NO: 1148613 - RNA, 17 nt, Homo sapiens
caccagaacacaaugcu

SEQ ID NO: 1148614 - RNA, 14 nt, Homo sapiens
caccagaauguaua

SEQ ID NO: 1148615 - RNA, 18 nt, Homo sapiens
caccagcaccgugacagu

SEQ ID NO: 1148616 - RNA, 21 nt, Homo sapiens
caccagcucuauucuuugccu

SEQ ID NO: 1148617 - RNA, 14 nt, Homo sapiens
caccaguaccugaa

SEQ ID NO: 1148618 - RNA, 15 nt, Homo sapiens
caccaguuauuccuu

SEQ ID NO: 1148619 - RNA, 17 nt, Homo sapiens
caccaguuuacaggaaa

SEQ ID NO: 1148620 - RNA, 13 nt, Homo sapiens
cacuguacuugua

SEQ ID NO: 1148621 - RNA, 13 nt, Homo sapiens
cacuguagccuua

SEQ ID NO: 1148622 - RNA, 14 nt, Homo sapiens
cacuguaguucuaa

SEQ ID NO: 1148623 - RNA, 17 nt, Homo sapiens
cacuguaguucuaagac

SEQ ID NO: 1148624 - RNA, 16 nt, Homo sapiens
cacuguauaccgauca

SEQ ID NO: 1148625 - RNA, 16 nt, Homo sapiens
cacuguauauuuugca

SEQ ID NO: 1148626 - RNA, 17 nt, Homo sapiens
cacuguaugauuuauaa

SEQ ID NO: 1148627 - RNA, 21 nt, Homo sapiens
cacuguccugggccugcagaa

SEQ ID NO: 1148628 - RNA, 19 nt, Homo sapiens
cacugucuagagcaacuuu

SEQ ID NO: 1148629 - RNA, 16 nt, Homo sapiens
cacugucugaagcaau

SEQ ID NO: 1148630 - RNA, 23 nt, Homo sapiens
cacuguugguguucggagcucuu

SEQ ID NO: 1148631 - RNA, 14 nt, Homo sapiens
cacuguuucucuca

SEQ ID NO: 1148632 - RNA, 15 nt, Homo sapiens
cacuguuucucucac

SEQ ID NO: 1148633 - RNA, 13 nt, Homo sapiens
cacuguuugccau

SEQ ID NO: 1148634 - RNA, 17 nt, Homo sapiens
cacuguuugccauucuc

SEQ ID NO: 1148635 - RNA, 17 nt, Homo sapiens
cacuuacagaacaaaga

SEQ ID NO: 1148636 - RNA, 17 nt, Homo sapiens
cacuuauacccaugaac

SEQ ID NO: 1148637 - RNA, 19 nt, Homo sapiens
cacuuauacccaugaacuu

SEQ ID NO: 1148638 - RNA, 19 nt, Homo sapiens
cacuuaugauuucaugugc

SEQ ID NO: 1148639 - RNA, 16 nt, Homo sapiens
cacuuauucucaagaa

SEQ ID NO: 1148640 - RNA, 15 nt, Homo sapiens
cacuuccagcauuua

SEQ ID NO: 1148641 - RNA, 15 nt, Homo sapiens
cacuuccauauguca

SEQ ID NO: 1148642 - RNA, 18 nt, Homo sapiens
cacuuccuauaugcacuu

SEQ ID NO: 1148643 - RNA, 18 nt, Homo sapiens
cacuuccucuccacagga

SEQ ID NO: 1148644 - RNA, 13 nt, Homo sapiens
cacuuccuugccc

SEQ ID NO: 1148645 - RNA, 14 nt, Homo sapiens
cacuugcucaaaac

SEQ ID NO: 1148646 - RNA, 13 nt, Homo sapiens
cacuugcucuuug

SEQ ID NO: 1148647 - RNA, 18 nt, Homo sapiens
cacuuuacaaaaguauua

SEQ ID NO: 1148648 - RNA, 13 nt, Homo sapiens
cacuuuacuacuc

SEQ ID NO: 1148649 - RNA, 15 nt, Homo sapiens
cacuuucugccaaug

SEQ ID NO: 1148650 - RNA, 18 nt, Homo sapiens
cagaaaaauaagucaaaa

SEQ ID NO: 1148651 - RNA, 18 nt, Homo sapiens
cagaaaacaaaacugcau

SEQ ID NO: 1148652 - RNA, 21 nt, Homo sapiens
cagaaaaguaggaaugcauuu

SEQ ID NO: 1148653 - RNA, 16 nt, Homo sapiens
cagaaaauucccauga

SEQ ID NO: 1148654 - RNA, 21 nt, Homo sapiens
cagaaaccaagucuacuucac

SEQ ID NO: 1148655 - RNA, 19 nt, Homo sapiens
caagcaaaaucauggaaug

SEQ ID NO: 1148656 - RNA, 15 nt, Homo sapiens
caagcaacugagauu

SEQ ID NO: 1148657 - RNA, 22 nt, Homo sapiens
caagcacuuuauauuuuccucu

SEQ ID NO: 1148658 - RNA, 15 nt, Homo sapiens
caagcagcaaaaucc

SEQ ID NO: 1148659 - RNA, 12 nt, Homo sapiens
caagcagugcac

SEQ ID NO: 1148660 - RNA, 23 nt, Homo sapiens
caagcauuuugugaacuagggaa

SEQ ID NO: 1148661 - RNA, 17 nt, Homo sapiens
caagcccccccuuccac

SEQ ID NO: 1148662 - RNA, 16 nt, Homo sapiens
caagccccugcuccag

SEQ ID NO: 1148663 - RNA, 20 nt, Homo sapiens
caagccuaaaauuguauaga

SEQ ID NO: 1148664 - RNA, 13 nt, Homo sapiens
caagccugaauuu

SEQ ID NO: 1148665 - RNA, 17 nt, Homo sapiens
caagccugugcaaaaaa

SEQ ID NO: 1148666 - RNA, 15 nt, Homo sapiens
caagccugugcaaug

SEQ ID NO: 1148667 - RNA, 15 nt, Homo sapiens
caaggaaagggcagu

SEQ ID NO: 1148668 - RNA, 22 nt, Homo sapiens
caaggacuaauccaauaccucu

SEQ ID NO: 1148669 - RNA, 18 nt, Homo sapiens
caaggagaaaaaaggcag

SEQ ID NO: 1148670 - RNA, 18 nt, Homo sapiens
caaggaugcauacauuuc

SEQ ID NO: 1148671 - RNA, 21 nt, Homo sapiens
caaggcaaaaaaaucauauaa

SEQ ID NO: 1148672 - RNA, 18 nt, Homo sapiens
caaggcaggaggagcuga

SEQ ID NO: 1148673 - RNA, 17 nt, Homo sapiens
caaggcaggaggccauu

SEQ ID NO: 1148674 - RNA, 21 nt, Homo sapiens
caaggcauaucaugcuuugaa

SEQ ID NO: 1148675 - RNA, 21 nt, Homo sapiens
caaggccaucugcuuaccaca

SEQ ID NO: 1148676 - RNA, 18 nt, Homo sapiens
caaggcgguggacuugaa

SEQ ID NO: 1148677 - RNA, 22 nt, Homo sapiens
caaggcugccagguguggaaca

SEQ ID NO: 1148678 - RNA, 16 nt, Homo sapiens
caaggcuucagucuca

SEQ ID NO: 1148679 - RNA, 16 nt, Homo sapiens
caagggacccaugagu

SEQ ID NO: 1148680 - RNA, 9 nt, Homo sapiens
caagggagg

SEQ ID NO: 1148681 - RNA, 23 nt, Homo sapiens
caagggguggccgggcacagugg

SEQ ID NO: 1148682 - RNA, 19 nt, Homo sapiens
caaggguggcaggucacug

SEQ ID NO: 1148683 - RNA, 16 nt, Homo sapiens
caaggguggccuugaa

SEQ ID NO: 1148684 - RNA, 18 nt, Homo sapiens
caagguccucugucaguc

SEQ ID NO: 1148685 - RNA, 22 nt, Homo sapiens
caaggucucacacuccuccugc

SEQ ID NO: 1148686 - RNA, 12 nt, Homo sapiens
caaggucugcuc

SEQ ID NO: 1148687 - RNA, 12 nt, Homo sapiens
caagguuguuca

SEQ ID NO: 1148688 - RNA, 14 nt, Homo sapiens
caaguaagggcaca

SEQ ID NO: 1148689 - RNA, 14 nt, Homo sapiens
caaguagcugcuac

SEQ ID NO: 1148690 - RNA, 15 nt, Homo sapiens
caaguauaauuacau

SEQ ID NO: 1148691 - RNA, 15 nt, Homo sapiens
caagucacacugcau

SEQ ID NO: 1148692 - RNA, 19 nt, Homo sapiens
caagucauaccuacauuca

SEQ ID NO: 1148693 - RNA, 18 nt, Homo sapiens
caagucauggacauucau

SEQ ID NO: 1148694 - RNA, 23 nt, Homo sapiens
caagucauucagcuaauacaaag

SEQ ID NO: 1148695 - RNA, 18 nt, Homo sapiens
caagucccccaagaccua

SEQ ID NO: 1148696 - RNA, 16 nt, Homo sapiens
caagucccuuugugac

SEQ ID NO: 1148697 - RNA, 19 nt, Homo sapiens
caagucucacagauugcug

SEQ ID NO: 1148698 - RNA, 17 nt, Homo sapiens
caagucuguuuacugca

SEQ ID NO: 1148699 - RNA, 18 nt, Homo sapiens
caagugaauuugccugua

SEQ ID NO: 1148700 - RNA, 19 nt, Homo sapiens
caagugacucuccugccuc

SEQ ID NO: 1148701 - RNA, 24 nt, Homo sapiens
caagugagccaggaaagcagcaaa

SEQ ID NO: 1148702 - RNA, 15 nt, Homo sapiens
caagugauccuccca

SEQ ID NO: 1148703 - RNA, 11 nt, Homo sapiens
caagugcuauu

SEQ ID NO: 1148704 - RNA, 22 nt, Homo sapiens
caaguggaccuuaggccuuccu

SEQ ID NO: 1148705 - RNA, 21 nt, Homo sapiens
caaguggggaauucugaugga

SEQ ID NO: 1148706 - RNA, 19 nt, Homo sapiens
caaguggguagugucauuu

SEQ ID NO: 1148707 - RNA, 22 nt, Homo sapiens
caaguguaaaauauuuugaauc

SEQ ID NO: 1148708 - RNA, 13 nt, Homo sapiens
caagugugcucuc

SEQ ID NO: 1148709 - RNA, 19 nt, Homo sapiens
caaguguuuuacuaucuca

SEQ ID NO: 1148710 - RNA, 15 nt, Homo sapiens
caaguuccagugcag

SEQ ID NO: 1148711 - RNA, 16 nt, Homo sapiens
caaguuccagugcaga

SEQ ID NO: 1148712 - RNA, 16 nt, Homo sapiens
caaguuguguuugaua

SEQ ID NO: 1148713 - RNA, 16 nt, Homo sapiens
caauaaaaacauugcc

SEQ ID NO: 1148714 - RNA, 19 nt, Homo sapiens
caauaaaauagcaauccua

SEQ ID NO: 1148715 - RNA, 15 nt, Homo sapiens
caauaaacuuagagg

SEQ ID NO: 1148716 - RNA, 13 nt, Homo sapiens
caauaaagaccac

SEQ ID NO: 1148717 - RNA, 15 nt, Homo sapiens
caauaauaaacauau

SEQ ID NO: 1148718 - RNA, 22 nt, Homo sapiens
caauaaucaacugaauugcaaa

SEQ ID NO: 1148719 - RNA, 13 nt, Homo sapiens
caauaaugcagua

SEQ ID NO: 1148720 - RNA, 16 nt, Homo sapiens
caauaauuaccaauau

SEQ ID NO: 1148721 - RNA, 15 nt, Homo sapiens
caauacaguuuauaa

SEQ ID NO: 1148722 - RNA, 14 nt, Homo sapiens
caauagccauauaa

SEQ ID NO: 1148723 - RNA, 14 nt, Homo sapiens
caauaggagucuua

SEQ ID NO: 1148724 - RNA, 15 nt, Homo sapiens
caauaguuaccucaa

SEQ ID NO: 1148725 - RNA, 12 nt, Homo sapiens
caauaugacuca

SEQ ID NO: 1148726 - RNA, 12 nt, Homo sapiens
caauaugcauuu

SEQ ID NO: 1148727 - RNA, 15 nt, Homo sapiens
caauauguuuaucaa

SEQ ID NO: 1148728 - RNA, 23 nt, Homo sapiens
caauauugggccuaaaacaguau

SEQ ID NO: 1148729 - RNA, 22 nt, Homo sapiens
caauauuuccauguuucauuaa

SEQ ID NO: 1148730 - RNA, 12 nt, Homo sapiens
caauauuugcua

SEQ ID NO: 1148731 - RNA, 14 nt, Homo sapiens
caaucaaaugucug

SEQ ID NO: 1148732 - RNA, 17 nt, Homo sapiens
caaucaaccugcacuuc

SEQ ID NO: 1148733 - RNA, 20 nt, Homo sapiens
caaucacguuauaguccaug

SEQ ID NO: 1148734 - RNA, 14 nt, Homo sapiens
caaucacugugcua

SEQ ID NO: 1148735 - RNA, 19 nt, Homo sapiens
caaucaucaucauucucau

SEQ ID NO: 1148736 - RNA, 21 nt, Homo sapiens
caauccaaaaauguuuuucaa

SEQ ID NO: 1148737 - RNA, 13 nt, Homo sapiens
caauccuauguuu

SEQ ID NO: 1148738 - RNA, 22 nt, Homo sapiens
caaucggacuccuggucuccuc

SEQ ID NO: 1148739 - RNA, 19 nt, Homo sapiens
caaucuacaacuggaagau

SEQ ID NO: 1148740 - RNA, 13 nt, Homo sapiens
caaucucacaccu

SEQ ID NO: 1148741 - RNA, 19 nt, Homo sapiens
caaucuguaaaacuaagaa

SEQ ID NO: 1148742 - RNA, 16 nt, Homo sapiens
caaucuucuacuuuaa

SEQ ID NO: 1148743 - RNA, 19 nt, Homo sapiens
caaucuuuccuacuuucua

SEQ ID NO: 1148744 - RNA, 13 nt, Homo sapiens
caaucuuugccaa

SEQ ID NO: 1148745 - RNA, 18 nt, Homo sapiens
caaugaaggagauagauu

SEQ ID NO: 1148746 - RNA, 14 nt, Homo sapiens
caaugaauccccaa

SEQ ID NO: 1148747 - RNA, 16 nt, Homo sapiens
caaugaggcugcuuau

SEQ ID NO: 1148748 - RNA, 15 nt, Homo sapiens
caaugaguuugggca

SEQ ID NO: 1148749 - RNA, 15 nt, Homo sapiens
caaugcauuuuucaa

SEQ ID NO: 1148750 - RNA, 17 nt, Homo sapiens
caaugcuucuagaguuu

SEQ ID NO: 1148751 - RNA, 13 nt, Homo sapiens
caauggaauguga

SEQ ID NO: 1148752 - RNA, 15 nt, Homo sapiens
caaugggauguauga

SEQ ID NO: 1148753 - RNA, 19 nt, Homo sapiens
caauggugcaaucacagcu

SEQ ID NO: 1148754 - RNA, 23 nt, Homo sapiens
caauguaagagccuaacuccauc

SEQ ID NO: 1148755 - RNA, 22 nt, Homo sapiens
caauguacaguugaaauaacug

SEQ ID NO: 1148756 - RNA, 19 nt, Homo sapiens
caauguacauagacccucu

SEQ ID NO: 1148757 - RNA, 22 nt, Homo sapiens
aucccuuccugucugaacaaaa

SEQ ID NO: 1148758 - RNA, 19 nt, Homo sapiens
auccgaaccuccucuguga

SEQ ID NO: 1148759 - RNA, 22 nt, Homo sapiens
auccgagauaggguggcacauc

SEQ ID NO: 1148760 - RNA, 13 nt, Homo sapiens
auccgccuaccuc

SEQ ID NO: 1148761 - RNA, 14 nt, Homo sapiens
auccgcgugugccu

SEQ ID NO: 1148762 - RNA, 21 nt, Homo sapiens
auccuacccccugugccuugu

SEQ ID NO: 1148763 - RNA, 22 nt, Homo sapiens
auccuacuguaauaaagaugau

SEQ ID NO: 1148764 - RNA, 23 nt, Homo sapiens
auccucaggcagguaaccccaga

SEQ ID NO: 1148765 - RNA, 21 nt, Homo sapiens
auccuccacuuguucagggcu

SEQ ID NO: 1148766 - RNA, 18 nt, Homo sapiens
auccuccucuccaugcaa

SEQ ID NO: 1148767 - RNA, 23 nt, Homo sapiens
auccugggccucagcaagccaug

SEQ ID NO: 1148768 - RNA, 11 nt, Homo sapiens
auccugggcug

SEQ ID NO: 1148769 - RNA, 15 nt, Homo sapiens
auccugggggaccaa

SEQ ID NO: 1148770 - RNA, 22 nt, Homo sapiens
auccugugccagguacuaugca

SEQ ID NO: 1148771 - RNA, 20 nt, Homo sapiens
auccuguuccgagcaacuuu

SEQ ID NO: 1148772 - RNA, 11 nt, Homo sapiens
auccuguucua

SEQ ID NO: 1148773 - RNA, 16 nt, Homo sapiens
auccuuaacagaugaa

SEQ ID NO: 1148774 - RNA, 23 nt, Homo sapiens
auccuuaacagaugaacuaucca

SEQ ID NO: 1148775 - RNA, 18 nt, Homo sapiens
auccuucuuucuaguuca

SEQ ID NO: 1148776 - RNA, 15 nt, Homo sapiens
auccuugaugaaucu

SEQ ID NO: 1148777 - RNA, 24 nt, Homo sapiens
auccuuggaaauuggaagagcaca

SEQ ID NO: 1148778 - RNA, 21 nt, Homo sapiens
auccuugggagucauuaccac

SEQ ID NO: 1148779 - RNA, 16 nt, Homo sapiens
auccuuguuaagcaac

SEQ ID NO: 1148780 - RNA, 21 nt, Homo sapiens
auccuuuagugcacccaguga

SEQ ID NO: 1148781 - RNA, 13 nt, Homo sapiens
aucgaauagggaa

SEQ ID NO: 1148782 - RNA, 18 nt, Homo sapiens
aucgacacuuacuccagu

SEQ ID NO: 1148783 - RNA, 17 nt, Homo sapiens
aucgacccccaagggac

SEQ ID NO: 1148784 - RNA, 14 nt, Homo sapiens
aucgaucaugaugu

SEQ ID NO: 1148785 - RNA, 22 nt, Homo sapiens
aucgcauauuaguuaaucuccu

SEQ ID NO: 1148786 - RNA, 20 nt, Homo sapiens
aucgcucccuuggcuuugag

SEQ ID NO: 1148787 - RNA, 23 nt, Homo sapiens
aucgggaccagaaaccugggaga

SEQ ID NO: 1148788 - RNA, 16 nt, Homo sapiens
aucgggcccagggaca

SEQ ID NO: 1148789 - RNA, 17 nt, Homo sapiens
aucgugccacugcacuc

SEQ ID NO: 1148790 - RNA, 20 nt, Homo sapiens
aucguuccaguucccacuug

SEQ ID NO: 1148791 - RNA, 20 nt, Homo sapiens
aucuaaauagauacuuuuga

SEQ ID NO: 1148792 - RNA, 18 nt, Homo sapiens
aucuaaauguauucugca

SEQ ID NO: 1148793 - RNA, 14 nt, Homo sapiens
aucuaauacacuuu

SEQ ID NO: 1148794 - RNA, 22 nt, Homo sapiens
aucuaauauggccacaguaguc

SEQ ID NO: 1148795 - RNA, 14 nt, Homo sapiens
aucuaccagcauaa

SEQ ID NO: 1148796 - RNA, 19 nt, Homo sapiens
aucuaccccuuccagaagc

SEQ ID NO: 1148797 - RNA, 21 nt, Homo sapiens
aucuacuacaaacuucaaaga

SEQ ID NO: 1148798 - RNA, 21 nt, Homo sapiens
aucuacuauauaugacuggaa

SEQ ID NO: 1148799 - RNA, 21 nt, Homo sapiens
aucuagucugguggauaaaga

SEQ ID NO: 1148800 - RNA, 13 nt, Homo sapiens
aucuauuauuaca

SEQ ID NO: 1148801 - RNA, 22 nt, Homo sapiens
aucucaaacuacuggcaauuug

SEQ ID NO: 1148802 - RNA, 16 nt, Homo sapiens
aucucaaagaaggcau

SEQ ID NO: 1148803 - RNA, 18 nt, Homo sapiens
aucucaauacagccugaa

SEQ ID NO: 1148804 - RNA, 15 nt, Homo sapiens
aucuccaagaccaga

SEQ ID NO: 1148805 - RNA, 22 nt, Homo sapiens
aucucccugccgccucaaugug

SEQ ID NO: 1148806 - RNA, 20 nt, Homo sapiens
aucuccuguaaaacugaccu

SEQ ID NO: 1148807 - RNA, 20 nt, Homo sapiens
aucucgaacuccuaaccuca

SEQ ID NO: 1148808 - RNA, 24 nt, Homo sapiens
aucucuaacauaugauacugaugc

SEQ ID NO: 1148809 - RNA, 15 nt, Homo sapiens
aucucuacuaaaaau

SEQ ID NO: 1148810 - RNA, 19 nt, Homo sapiens
aucucucacacauuccagg

SEQ ID NO: 1148811 - RNA, 13 nt, Homo sapiens
aucucucaucacu

SEQ ID NO: 1148812 - RNA, 14 nt, Homo sapiens
aucucugcaucucu

SEQ ID NO: 1148813 - RNA, 16 nt, Homo sapiens
aucucugcuuaguucu

SEQ ID NO: 1148814 - RNA, 22 nt, Homo sapiens
aucucuuaaaguggucauauua

SEQ ID NO: 1148815 - RNA, 14 nt, Homo sapiens
aucugaauguucau

SEQ ID NO: 1148816 - RNA, 15 nt, Homo sapiens
aucugaauguucaug

SEQ ID NO: 1148817 - RNA, 14 nt, Homo sapiens
aucugacauucuca

SEQ ID NO: 1148818 - RNA, 12 nt, Homo sapiens
aucugaccaucu

SEQ ID NO: 1148819 - RNA, 18 nt, Homo sapiens
aucugagcaaaaugugaa

SEQ ID NO: 1148820 - RNA, 18 nt, Homo sapiens
aucugcccgccugcccac

SEQ ID NO: 1148821 - RNA, 14 nt, Homo sapiens
aucugcgugacaau

SEQ ID NO: 1148822 - RNA, 14 nt, Homo sapiens
aucugcuacugugu

SEQ ID NO: 1148823 - RNA, 18 nt, Homo sapiens
aucugcuacugugucagg

SEQ ID NO: 1148824 - RNA, 14 nt, Homo sapiens
aucugcuuaccaca

SEQ ID NO: 1148825 - RNA, 14 nt, Homo sapiens
aucuggaacccaga

SEQ ID NO: 1148826 - RNA, 18 nt, Homo sapiens
aucuggaacccagacuca

SEQ ID NO: 1148827 - RNA, 16 nt, Homo sapiens
aucuggaauuccaguc

SEQ ID NO: 1148828 - RNA, 17 nt, Homo sapiens
aucuggguaucuuucca

SEQ ID NO: 1148829 - RNA, 15 nt, Homo sapiens
aucugggucaaucca

SEQ ID NO: 1148830 - RNA, 17 nt, Homo sapiens
aucugggucaauccaca

SEQ ID NO: 1148831 - RNA, 16 nt, Homo sapiens
aucugguauggugcua

SEQ ID NO: 1148832 - RNA, 18 nt, Homo sapiens
aucugguguucuugcuaa

SEQ ID NO: 1148833 - RNA, 16 nt, Homo sapiens
aucuguaaaacuaaga

SEQ ID NO: 1148834 - RNA, 22 nt, Homo sapiens
aucugucauaagcauuacuuua

SEQ ID NO: 1148835 - RNA, 20 nt, Homo sapiens
aucugucuagaauccugcuu

SEQ ID NO: 1148836 - RNA, 10 nt, Homo sapiens
aucugugcac

SEQ ID NO: 1148837 - RNA, 15 nt, Homo sapiens
aucugugccugagaa

SEQ ID NO: 1148838 - RNA, 12 nt, Homo sapiens
aucuguuuccaa

SEQ ID NO: 1148839 - RNA, 17 nt, Homo sapiens
aucuguuuguagccaca

SEQ ID NO: 1148840 - RNA, 20 nt, Homo sapiens
aucuguuuugaaggcaaaau

SEQ ID NO: 1148841 - RNA, 15 nt, Homo sapiens
aucuuacaaaauccu

SEQ ID NO: 1148842 - RNA, 20 nt, Homo sapiens
aucuuaccagguucacuuaa

SEQ ID NO: 1148843 - RNA, 15 nt, Homo sapiens
aucuuacuguaccug

SEQ ID NO: 1148844 - RNA, 18 nt, Homo sapiens
aucuuauacuguacaaua

SEQ ID NO: 1148845 - RNA, 15 nt, Homo sapiens
aucuuauuucuguca

SEQ ID NO: 1148846 - RNA, 13 nt, Homo sapiens
aucuucaacagac

SEQ ID NO: 1148847 - RNA, 15 nt, Homo sapiens
aucuucacagcacau

SEQ ID NO: 1148848 - RNA, 17 nt, Homo sapiens
aucuucacagcacauuu

SEQ ID NO: 1148849 - RNA, 15 nt, Homo sapiens
aucuucacugcaauu

SEQ ID NO: 1148850 - RNA, 22 nt, Homo sapiens
aucuucagggaacugcauagau

SEQ ID NO: 1148851 - RNA, 21 nt, Homo sapiens
aucuuccaccucaccucuuug

SEQ ID NO: 1148852 - RNA, 17 nt, Homo sapiens
aucuuccagaagcugua

SEQ ID NO: 1148853 - RNA, 19 nt, Homo sapiens
aucuuccagccaccuaguc

SEQ ID NO: 1148854 - RNA, 15 nt, Homo sapiens
aucuucccacagugg

SEQ ID NO: 1148855 - RNA, 19 nt, Homo sapiens
aucuucuuuggacuucuga

SEQ ID NO: 1148856 - RNA, 19 nt, Homo sapiens
aucuugaauguaguauuca

SEQ ID NO: 1148857 - RNA, 16 nt, Homo sapiens
aucuugcaguuuugua

SEQ ID NO: 1148858 - RNA, 12 nt, Homo sapiens
aucuugcuccaa

SEQ ID NO: 1148859 - RNA, 22 nt, Homo sapiens
aucuugcucucggugcuuccaa

SEQ ID NO: 1148860 - RNA, 20 nt, Homo sapiens
aucuugcuucugcuucucau

SEQ ID NO: 1148861 - RNA, 15 nt, Homo sapiens
aucuuguuuuuccac

SEQ ID NO: 1148862 - RNA, 17 nt, Homo sapiens
caaaaucaagcaagccu

SEQ ID NO: 1148863 - RNA, 14 nt, Homo sapiens
caaaaucauggcuu

SEQ ID NO: 1148864 - RNA, 13 nt, Homo sapiens
caaaauccaaaaa

SEQ ID NO: 1148865 - RNA, 16 nt, Homo sapiens
caaaaugauacuuacu

SEQ ID NO: 1148866 - RNA, 13 nt, Homo sapiens
caaaaugcuuuuu

SEQ ID NO: 1148867 - RNA, 18 nt, Homo sapiens
caaaaugggccucaugga

SEQ ID NO: 1148868 - RNA, 16 nt, Homo sapiens
caaaaugucuguuuua

SEQ ID NO: 1148869 - RNA, 20 nt, Homo sapiens
caaacacaaggucauggcca

SEQ ID NO: 1148870 - RNA, 22 nt, Homo sapiens
caaacaggacaagagcagccug

SEQ ID NO: 1148871 - RNA, 17 nt, Homo sapiens
caaacaugaaaacauug

SEQ ID NO: 1148872 - RNA, 20 nt, Homo sapiens
caaacauguuguacauuuca

SEQ ID NO: 1148873 - RNA, 21 nt, Homo sapiens
caaaccaagagauugcuaauu

SEQ ID NO: 1148874 - RNA, 13 nt, Homo sapiens
caaacccauuccc

SEQ ID NO: 1148875 - RNA, 13 nt, Homo sapiens
caaaccuguagau

SEQ ID NO: 1148876 - RNA, 21 nt, Homo sapiens
caaacuacuggcaauuuguaa

SEQ ID NO: 1148877 - RNA, 21 nt, Homo sapiens
caaacucccgaccucagguga

SEQ ID NO: 1148878 - RNA, 17 nt, Homo sapiens
caaacuccugacuucag

SEQ ID NO: 1148879 - RNA, 13 nt, Homo sapiens
caaacugagaucc

SEQ ID NO: 1148880 - RNA, 16 nt, Homo sapiens
caaacugcaaaccaug

SEQ ID NO: 1148881 - RNA, 18 nt, Homo sapiens
caaacugcugccugauuu

SEQ ID NO: 1148882 - RNA, 22 nt, Homo sapiens
caaacugcugucccaaacaugc

SEQ ID NO: 1148883 - RNA, 15 nt, Homo sapiens
caaacuucaaagagg

SEQ ID NO: 1148884 - RNA, 14 nt, Homo sapiens
caaacuucccugac

SEQ ID NO: 1148885 - RNA, 14 nt, Homo sapiens
caaacuucugugua

SEQ ID NO: 1148886 - RNA, 17 nt, Homo sapiens
caaagaaaguggucuua

SEQ ID NO: 1148887 - RNA, 21 nt, Homo sapiens
caaagaacucaccacaagcca

SEQ ID NO: 1148888 - RNA, 18 nt, Homo sapiens
caaagagaauguauuucc

SEQ ID NO: 1148889 - RNA, 21 nt, Homo sapiens
caaagaguauguuguaagaaa

SEQ ID NO: 1148890 - RNA, 19 nt, Homo sapiens
caaagauaagguuauagua

SEQ ID NO: 1148891 - RNA, 22 nt, Homo sapiens
caaagauaagguuauaguaaca

SEQ ID NO: 1148892 - RNA, 17 nt, Homo sapiens
caaagaugauguuucca

SEQ ID NO: 1148893 - RNA, 17 nt, Homo sapiens
caaagaugggugaaggc

SEQ ID NO: 1148894 - RNA, 15 nt, Homo sapiens
caaagcaaaggcagu

SEQ ID NO: 1148895 - RNA, 14 nt, Homo sapiens
auacaagagacaua

SEQ ID NO: 1148896 - RNA, 17 nt, Homo sapiens
auacaagagacauauaa

SEQ ID NO: 1148897 - RNA, 15 nt, Homo sapiens
auacacaaagggaug

SEQ ID NO: 1148898 - RNA, 22 nt, Homo sapiens
auacacaucucugucaguguga

SEQ ID NO: 1148899 - RNA, 14 nt, Homo sapiens
auacaccagcaaug

SEQ ID NO: 1148900 - RNA, 13 nt, Homo sapiens
auacacuguucau

SEQ ID NO: 1148901 - RNA, 17 nt, Homo sapiens
auacagaauuacuguaa

SEQ ID NO: 1148902 - RNA, 13 nt, Homo sapiens
auacagaauuuua

SEQ ID NO: 1148903 - RNA, 20 nt, Homo sapiens
auacagcuuuuugcaguaug

SEQ ID NO: 1148904 - RNA, 16 nt, Homo sapiens
auacaguaugaucuca

SEQ ID NO: 1148905 - RNA, 13 nt, Homo sapiens
auacagugauaua

SEQ ID NO: 1148906 - RNA, 20 nt, Homo sapiens
auacauaaaacaaaagcauu

SEQ ID NO: 1148907 - RNA, 12 nt, Homo sapiens
auacauaccuac

SEQ ID NO: 1148908 - RNA, 18 nt, Homo sapiens
auacauauuuuuauuuga

SEQ ID NO: 1148909 - RNA, 17 nt, Homo sapiens
auacauguacagacaaa

SEQ ID NO: 1148910 - RNA, 14 nt, Homo sapiens
auaccaacuguaca

SEQ ID NO: 1148911 - RNA, 19 nt, Homo sapiens
auaccacuuuucauugcaa

SEQ ID NO: 1148912 - RNA, 16 nt, Homo sapiens
auaccagcucagggga

SEQ ID NO: 1148913 - RNA, 21 nt, Homo sapiens
auacccuccuuccaccaaguu

SEQ ID NO: 1148914 - RNA, 13 nt, Homo sapiens
auaccuacauuca

SEQ ID NO: 1148915 - RNA, 15 nt, Homo sapiens
auaccugauauauuc

SEQ ID NO: 1148916 - RNA, 16 nt, Homo sapiens
auaccugggauacugu

SEQ ID NO: 1148917 - RNA, 15 nt, Homo sapiens
auaccuuccccacau

SEQ ID NO: 1148918 - RNA, 12 nt, Homo sapiens
auaccuugccug

SEQ ID NO: 1148919 - RNA, 23 nt, Homo sapiens
auaccuuugcuacuacuaugugc

SEQ ID NO: 1148920 - RNA, 16 nt, Homo sapiens
auacgcccucuuucau

SEQ ID NO: 1148921 - RNA, 16 nt, Homo sapiens
auacuagggagccauu

SEQ ID NO: 1148922 - RNA, 13 nt, Homo sapiens
auacucagguuaa

SEQ ID NO: 1148923 - RNA, 15 nt, Homo sapiens
auacucuagaugaag

SEQ ID NO: 1148924 - RNA, 17 nt, Homo sapiens
auacugaauuucuuuga

SEQ ID NO: 1148925 - RNA, 17 nt, Homo sapiens
auacugaggcacacaga

SEQ ID NO: 1148926 - RNA, 19 nt, Homo sapiens
auacugccaaaacauuuau

SEQ ID NO: 1148927 - RNA, 20 nt, Homo sapiens
auacugguguuaacagucac

SEQ ID NO: 1148928 - RNA, 19 nt, Homo sapiens
auacugguuauccugugcu

SEQ ID NO: 1148929 - RNA, 20 nt, Homo sapiens
auacugugagcuuacauuga

SEQ ID NO: 1148930 - RNA, 13 nt, Homo sapiens
auacuuaauacug

SEQ ID NO: 1148931 - RNA, 15 nt, Homo sapiens
auacuuagacaguau

SEQ ID NO: 1148932 - RNA, 17 nt, Homo sapiens
auacuuagacaguaugc

SEQ ID NO: 1148933 - RNA, 19 nt, Homo sapiens
auacuucucuauuaucuca

SEQ ID NO: 1148934 - RNA, 17 nt, Homo sapiens
auacuuuagaaguagaa

SEQ ID NO: 1148935 - RNA, 19 nt, Homo sapiens
auacuuuauuucugaucua

SEQ ID NO: 1148936 - RNA, 24 nt, Homo sapiens
auacuuugguuggcagcauuccau

SEQ ID NO: 1148937 - RNA, 16 nt, Homo sapiens
auacuuugucugaaaa

SEQ ID NO: 1148938 - RNA, 15 nt, Homo sapiens
auacuuuugcuuuca

SEQ ID NO: 1148939 - RNA, 13 nt, Homo sapiens
auagaaaaaccaa

SEQ ID NO: 1148940 - RNA, 21 nt, Homo sapiens
auagaaacaccaguaccugaa

SEQ ID NO: 1148941 - RNA, 21 nt, Homo sapiens
auagaaacacuuucucacuua

SEQ ID NO: 1148942 - RNA, 14 nt, Homo sapiens
auagaaaguucaaa

SEQ ID NO: 1148943 - RNA, 14 nt, Homo sapiens
auagaaaucuagaa

SEQ ID NO: 1148944 - RNA, 12 nt, Homo sapiens
auagaaaugcca

SEQ ID NO: 1148945 - RNA, 17 nt, Homo sapiens
auagaacugaaugagaa

SEQ ID NO: 1148946 - RNA, 21 nt, Homo sapiens
auagaacugaaugagaaccaa

SEQ ID NO: 1148947 - RNA, 16 nt, Homo sapiens
auagaacuuuucuuac

SEQ ID NO: 1148948 - RNA, 18 nt, Homo sapiens
auagaagagaagagccau

SEQ ID NO: 1148949 - RNA, 22 nt, Homo sapiens
auagaauucaauuugaacucag

SEQ ID NO: 1148950 - RNA, 13 nt, Homo sapiens
auagacaccaaaa

SEQ ID NO: 1148951 - RNA, 20 nt, Homo sapiens
auagagaaaggucuaugcag

SEQ ID NO: 1148952 - RNA, 15 nt, Homo sapiens
auagagcuguucaac

SEQ ID NO: 1148953 - RNA, 18 nt, Homo sapiens
auagagucucacuguguc

SEQ ID NO: 1148954 - RNA, 21 nt, Homo sapiens
auagaguguuuuucauggaaa

SEQ ID NO: 1148955 - RNA, 17 nt, Homo sapiens
auagauacuuuugauaa

SEQ ID NO: 1148956 - RNA, 17 nt, Homo sapiens
auagauaggucagugca

SEQ ID NO: 1148957 - RNA, 22 nt, Homo sapiens
auagaugccgcggaaggucccu

SEQ ID NO: 1148958 - RNA, 19 nt, Homo sapiens
auagauuugaaacauuuau

SEQ ID NO: 1148959 - RNA, 17 nt, Homo sapiens
auagauuugaccuccuc

SEQ ID NO: 1148960 - RNA, 18 nt, Homo sapiens
auagcacccugcccucau

SEQ ID NO: 1148961 - RNA, 14 nt, Homo sapiens
auagcagcugcuac

SEQ ID NO: 1148962 - RNA, 22 nt, Homo sapiens
auagcagcugcuacuagcucuu

SEQ ID NO: 1148963 - RNA, 14 nt, Homo sapiens
auagcccuguaaca

SEQ ID NO: 1148964 - RNA, 19 nt, Homo sapiens
auagccuguggccuuugca

SEQ ID NO: 1148965 - RNA, 19 nt, Homo sapiens
auaggaacaauaagaacaa

SEQ ID NO: 1148966 - RNA, 13 nt, Homo sapiens
auaggacucugga

SEQ ID NO: 1148967 - RNA, 13 nt, Homo sapiens
auaggacuguggc

SEQ ID NO: 1148968 - RNA, 21 nt, Homo sapiens
auaggauggcuggcucugcac

SEQ ID NO: 1148969 - RNA, 16 nt, Homo sapiens
auaggaugguaccaag

SEQ ID NO: 1148970 - RNA, 16 nt, Homo sapiens
auaggauugcuucaau

SEQ ID NO: 1148971 - RNA, 13 nt, Homo sapiens
auaggguggcaca

SEQ ID NO: 1148972 - RNA, 21 nt, Homo sapiens
auaggucagugcaaauacucu

SEQ ID NO: 1148973 - RNA, 12 nt, Homo sapiens
auaggugcaguu

SEQ ID NO: 1148974 - RNA, 15 nt, Homo sapiens
auaggugugugagac

SEQ ID NO: 1148975 - RNA, 15 nt, Homo sapiens
auaguaacaucaaag

SEQ ID NO: 1148976 - RNA, 19 nt, Homo sapiens
auaguaccuucaauacuua

SEQ ID NO: 1148977 - RNA, 20 nt, Homo sapiens
auaguacucuuuguagcaaa

SEQ ID NO: 1148978 - RNA, 15 nt, Homo sapiens
auagucacauggccu

SEQ ID NO: 1148979 - RNA, 23 nt, Homo sapiens
auagucacauggccuaugcacau

SEQ ID NO: 1148980 - RNA, 18 nt, Homo sapiens
auagucuuugccagucau

SEQ ID NO: 1148981 - RNA, 13 nt, Homo sapiens
auaguggaccacu

SEQ ID NO: 1148982 - RNA, 16 nt, Homo sapiens
auaguuauuuacuuga

SEQ ID NO: 1148983 - RNA, 17 nt, Homo sapiens
auaguucaugucugcua

SEQ ID NO: 1148984 - RNA, 21 nt, Homo sapiens
auaguucuaggcacuguaguu

SEQ ID NO: 1148985 - RNA, 22 nt, Homo sapiens
auaguugauguaacauuguaga

SEQ ID NO: 1148986 - RNA, 15 nt, Homo sapiens
auaguugcugucauc

SEQ ID NO: 1148987 - RNA, 19 nt, Homo sapiens
auaguuucaaaucuguaau

SEQ ID NO: 1148988 - RNA, 19 nt, Homo sapiens
auaguuucauaauugugua

SEQ ID NO: 1148989 - RNA, 14 nt, Homo sapiens
auauaaaaggcaaa

SEQ ID NO: 1148990 - RNA, 15 nt, Homo sapiens
auauaaaaugcugau

SEQ ID NO: 1148991 - RNA, 18 nt, Homo sapiens
auauaaaguacaucucua

SEQ ID NO: 1148992 - RNA, 15 nt, Homo sapiens
auauaaaguguaaua

SEQ ID NO: 1148993 - RNA, 16 nt, Homo sapiens
auauaaauauccccag

SEQ ID NO: 1148994 - RNA, 18 nt, Homo sapiens
auauaaauuauuaguuua

SEQ ID NO: 1148995 - RNA, 16 nt, Homo sapiens
auauaagcugccauau

SEQ ID NO: 1148996 - RNA, 14 nt, Homo sapiens
auauaauaugcaca

SEQ ID NO: 1148997 - RNA, 19 nt, Homo sapiens
auauaauucccaagcuuuu

SEQ ID NO: 1148998 - RNA, 16 nt, Homo sapiens
auauacaguaacuuua

SEQ ID NO: 1148999 - RNA, 19 nt, Homo sapiens
auauacaguaacuuuaugu

SEQ ID NO: 1149000 - RNA, 14 nt, Homo sapiens
auauaccauuucaa

SEQ ID NO: 1149001 - RNA, 16 nt, Homo sapiens
auauacugagcugcua

SEQ ID NO: 1149002 - RNA, 20 nt, Homo sapiens
auauacuuaauaaaacauuu

SEQ ID NO: 1149003 - RNA, 13 nt, Homo sapiens
auauagacaccaa

SEQ ID NO: 1149004 - RNA, 16 nt, Homo sapiens
auauaggaaaacaaua

SEQ ID NO: 1149005 - RNA, 20 nt, Homo sapiens
auauaguuuucuaacuccug

SEQ ID NO: 1149006 - RNA, 23 nt, Homo sapiens
auccaggacugugccagcacaaa

SEQ ID NO: 1149007 - RNA, 15 nt, Homo sapiens
auccaggcagaucca

SEQ ID NO: 1149008 - RNA, 22 nt, Homo sapiens
auccauauuacguuguuucuua

SEQ ID NO: 1149009 - RNA, 17 nt, Homo sapiens
auccauauugagucaaa

SEQ ID NO: 1149010 - RNA, 14 nt, Homo sapiens
auccaucagcaaug

SEQ ID NO: 1149011 - RNA, 17 nt, Homo sapiens
auccauccagcuugcca

SEQ ID NO: 1149012 - RNA, 20 nt, Homo sapiens
auccaucugggcuaccccac

SEQ ID NO: 1149013 - RNA, 15 nt, Homo sapiens
auccauucacaguuc

SEQ ID NO: 1149014 - RNA, 16 nt, Homo sapiens
auccauuuaugucuca

SEQ ID NO: 1149015 - RNA, 13 nt, Homo sapiens
aucccaaacaaaa

SEQ ID NO: 1149016 - RNA, 21 nt, Homo sapiens
aucccaaagcaaggagaucau

SEQ ID NO: 1149017 - RNA, 14 nt, Homo sapiens
aucccaaagccaac

SEQ ID NO: 1149018 - RNA, 18 nt, Homo sapiens
aucccaagcaucauauca

SEQ ID NO: 1149019 - RNA, 17 nt, Homo sapiens
aucccacccacauguga

SEQ ID NO: 1149020 - RNA, 13 nt, Homo sapiens
aucccagcacuuu

SEQ ID NO: 1149021 - RNA, 14 nt, Homo sapiens
aucccagcacuuug

SEQ ID NO: 1149022 - RNA, 16 nt, Homo sapiens
aucccauggaaccacu

SEQ ID NO: 1149023 - RNA, 17 nt, Homo sapiens
aucccauggaaccacua

SEQ ID NO: 1149024 - RNA, 16 nt, Homo sapiens
aucccauuuuauccca

SEQ ID NO: 1149025 - RNA, 16 nt, Homo sapiens
auccccaggcaccuca

SEQ ID NO: 1149026 - RNA, 22 nt, Homo sapiens
auccccagggacagaaaccaag

SEQ ID NO: 1149027 - RNA, 19 nt, Homo sapiens
auccccuccguggcaucac

SEQ ID NO: 1149028 - RNA, 15 nt, Homo sapiens
auccccuguccccug

SEQ ID NO: 1149029 - RNA, 15 nt, Homo sapiens
aucccuagugcucca

SEQ ID NO: 1149030 - RNA, 13 nt, Homo sapiens
aucccuaugauga

SEQ ID NO: 1149031 - RNA, 19 nt, Homo sapiens
aucccucuccaacugccua

SEQ ID NO: 1149032 - RNA, 15 nt, Homo sapiens
aucccuggaaggaca

SEQ ID NO: 1149033 - RNA, 16 nt, Homo sapiens
aggcucaacugaggau

SEQ ID NO: 1149034 - RNA, 18 nt, Homo sapiens
aggcucaacugaggaugu

SEQ ID NO: 1149035 - RNA, 12 nt, Homo sapiens
aggcuccagaaa

SEQ ID NO: 1149036 - RNA, 13 nt, Homo sapiens
aggcuccagaaau

SEQ ID NO: 1149037 - RNA, 22 nt, Homo sapiens
aggcuccagagggcacucugcu

SEQ ID NO: 1149038 - RNA, 17 nt, Homo sapiens
aggcucguugacuggcu

SEQ ID NO: 1149039 - RNA, 20 nt, Homo sapiens
aggcugacagcuucuacuug

SEQ ID NO: 1149040 - RNA, 18 nt, Homo sapiens
aggcugaccacagcacag

SEQ ID NO: 1149041 - RNA, 17 nt, Homo sapiens
aggcugagacaggagaa

SEQ ID NO: 1149042 - RNA, 15 nt, Homo sapiens
aggcugaggcacaag

SEQ ID NO: 1149043 - RNA, 17 nt, Homo sapiens
aggcugaggcacaagaa

SEQ ID NO: 1149044 - RNA, 18 nt, Homo sapiens
aggcugaucccugagauc

SEQ ID NO: 1149045 - RNA, 22 nt, Homo sapiens
aggcugcagaugaucagggauc

SEQ ID NO: 1149046 - RNA, 22 nt, Homo sapiens
aggcugccccaggccggagccc

SEQ ID NO: 1149047 - RNA, 14 nt, Homo sapiens
aggcuggagugcaa

SEQ ID NO: 1149048 - RNA, 15 nt, Homo sapiens
aggcuggagugcaau

SEQ ID NO: 1149049 - RNA, 15 nt, Homo sapiens
aggcugggcagcaca

SEQ ID NO: 1149050 - RNA, 17 nt, Homo sapiens
aggcugggccugaacua

SEQ ID NO: 1149051 - RNA, 21 nt, Homo sapiens
aggcuuagagaagggcucuau

SEQ ID NO: 1149052 - RNA, 23 nt, Homo sapiens
aggcuuccucuucagcaugcccc

SEQ ID NO: 1149053 - RNA, 17 nt, Homo sapiens
aggcuuguugugcuuuu

SEQ ID NO: 1149054 - RNA, 16 nt, Homo sapiens
aggcuuucuguugcca

SEQ ID NO: 1149055 - RNA, 19 nt, Homo sapiens
aggcuuugaguuaacucac

SEQ ID NO: 1149056 - RNA, 23 nt, Homo sapiens
aggcuuuguagcaagaugagcaa

SEQ ID NO: 1149057 - RNA, 20 nt, Homo sapiens
aggcuuugugauagugacau

SEQ ID NO: 1149058 - RNA, 13 nt, Homo sapiens
agggaaaacugca

SEQ ID NO: 1149059 - RNA, 19 nt, Homo sapiens
agggaaacuggcugagggg

SEQ ID NO: 1149060 - RNA, 14 nt, Homo sapiens
agggaacagucaua

SEQ ID NO: 1149061 - RNA, 14 nt, Homo sapiens
agggaagccgugaa

SEQ ID NO: 1149062 - RNA, 15 nt, Homo sapiens
agggaaggcaaaggc

SEQ ID NO: 1149063 - RNA, 16 nt, Homo sapiens
agggaagggacuggga

SEQ ID NO: 1149064 - RNA, 19 nt, Homo sapiens
agggaaguugaacgagcau

SEQ ID NO: 1149065 - RNA, 22 nt, Homo sapiens
agggaauccugaccugagccag

SEQ ID NO: 1149066 - RNA, 14 nt, Homo sapiens
agggaauugcucag

SEQ ID NO: 1149067 - RNA, 19 nt, Homo sapiens
agggacauaaguucauuca

SEQ ID NO: 1149068 - RNA, 15 nt, Homo sapiens
agggacggucaguuu

SEQ ID NO: 1149069 - RNA, 12 nt, Homo sapiens
agggacuugaag

SEQ ID NO: 1149070 - RNA, 18 nt, Homo sapiens
agggagaaaggagaaauu

SEQ ID NO: 1149071 - RNA, 16 nt, Homo sapiens
agggagaagucugcaa

SEQ ID NO: 1149072 - RNA, 23 nt, Homo sapiens
agggagaugauccagagacaugu

SEQ ID NO: 1149073 - RNA, 14 nt, Homo sapiens
agggagccauggaa

SEQ ID NO: 1149074 - RNA, 14 nt, Homo sapiens
agggagcugaguaa

SEQ ID NO: 1149075 - RNA, 20 nt, Homo sapiens
agggagcugaguaacaccau

SEQ ID NO: 1149076 - RNA, 14 nt, Homo sapiens
agggagcuggaaaa

SEQ ID NO: 1149077 - RNA, 18 nt, Homo sapiens
agggaugcauggagauag

SEQ ID NO: 1149078 - RNA, 18 nt, Homo sapiens
agggaugugugagaauaa

SEQ ID NO: 1149079 - RNA, 17 nt, Homo sapiens
agggauuacccaagcaa

SEQ ID NO: 1149080 - RNA, 21 nt, Homo sapiens
agggcaauaugaaguuacuuu

SEQ ID NO: 1149081 - RNA, 16 nt, Homo sapiens
agggcaccaccaagaa

SEQ ID NO: 1149082 - RNA, 17 nt, Homo sapiens
agggcagagacaaucac

SEQ ID NO: 1149083 - RNA, 23 nt, Homo sapiens
agggcagaggagagcagcuguca

SEQ ID NO: 1149084 - RNA, 19 nt, Homo sapiens
agggcaguacaguggcuuc

SEQ ID NO: 1149085 - RNA, 14 nt, Homo sapiens
agggcaucacuggg

SEQ ID NO: 1149086 - RNA, 14 nt, Homo sapiens
agggccgccugccu

SEQ ID NO: 1149087 - RNA, 14 nt, Homo sapiens
agggcgcaaagggc

SEQ ID NO: 1149088 - RNA, 23 nt, Homo sapiens
agggcgccucaccugcucuucaa

SEQ ID NO: 1149089 - RNA, 18 nt, Homo sapiens
agggcgggcagagggcug

SEQ ID NO: 1149090 - RNA, 19 nt, Homo sapiens
agggcggugaacucuggcu

SEQ ID NO: 1149091 - RNA, 19 nt, Homo sapiens
agggcgugaggucuugcag

SEQ ID NO: 1149092 - RNA, 22 nt, Homo sapiens
agggcuacccaaaacaguucua

SEQ ID NO: 1149093 - RNA, 18 nt, Homo sapiens
agggcucacagaauucau

SEQ ID NO: 1149094 - RNA, 14 nt, Homo sapiens
agggcucccugcca

SEQ ID NO: 1149095 - RNA, 20 nt, Homo sapiens
agggcucugggggcagauuu

SEQ ID NO: 1149096 - RNA, 22 nt, Homo sapiens
agggcucuuuccuccacaccau

SEQ ID NO: 1149097 - RNA, 12 nt, Homo sapiens
agggcugaccca

SEQ ID NO: 1149098 - RNA, 16 nt, Homo sapiens
aggggaaccccggggu

SEQ ID NO: 1149099 - RNA, 22 nt, Homo sapiens
aggggaacuagguuaccgcuua

SEQ ID NO: 1149100 - RNA, 14 nt, Homo sapiens
aggggacgugggcc

SEQ ID NO: 1149101 - RNA, 22 nt, Homo sapiens
aggggagcccggagcuuugcaa

SEQ ID NO: 1149102 - RNA, 16 nt, Homo sapiens
aggggagugcauuuag

SEQ ID NO: 1149103 - RNA, 17 nt, Homo sapiens
aggggaucccaccccau

SEQ ID NO: 1149104 - RNA, 20 nt, Homo sapiens
aggggaucuggaagggccaa

SEQ ID NO: 1149105 - RNA, 17 nt, Homo sapiens
aggggaugguagaccuu

SEQ ID NO: 1149106 - RNA, 20 nt, Homo sapiens
aggggcagccacaccacugc

SEQ ID NO: 1149107 - RNA, 15 nt, Homo sapiens
aggggccaagcagug

SEQ ID NO: 1149108 - RNA, 15 nt, Homo sapiens
aggggccaaguguag

SEQ ID NO: 1149109 - RNA, 18 nt, Homo sapiens
aggggccaugcuguguga

SEQ ID NO: 1149110 - RNA, 19 nt, Homo sapiens
aggggccuaggccucagcc

SEQ ID NO: 1149111 - RNA, 18 nt, Homo sapiens
aggggccucucuauucau

SEQ ID NO: 1149112 - RNA, 16 nt, Homo sapiens
aggggcucucugugca

SEQ ID NO: 1149113 - RNA, 19 nt, Homo sapiens
aggggcugcugaccuccac

SEQ ID NO: 1149114 - RNA, 13 nt, Homo sapiens
aggggcuguguuu

SEQ ID NO: 1149115 - RNA, 23 nt, Homo sapiens
aggggcuucagguccaggcugug

SEQ ID NO: 1149116 - RNA, 22 nt, Homo sapiens
agggggagccccuucugcucag

SEQ ID NO: 1149117 - RNA, 18 nt, Homo sapiens
agggggugacgcugaaga

SEQ ID NO: 1149118 - RNA, 12 nt, Homo sapiens
aggggucacuua

SEQ ID NO: 1149119 - RNA, 18 nt, Homo sapiens
aggggugauaacucagga

SEQ ID NO: 1149120 - RNA, 19 nt, Homo sapiens
agggguggaaacauaggga

SEQ ID NO: 1149121 - RNA, 16 nt, Homo sapiens
agggguguguguaugu

SEQ ID NO: 1149122 - RNA, 17 nt, Homo sapiens
agggguucuugagccag

SEQ ID NO: 1149123 - RNA, 16 nt, Homo sapiens
agggucucugcuccag

SEQ ID NO: 1149124 - RNA, 22 nt, Homo sapiens
agggucuugcuauauugcccag

SEQ ID NO: 1149125 - RNA, 20 nt, Homo sapiens
agggucuuuucaucugggaa

SEQ ID NO: 1149126 - RNA, 13 nt, Homo sapiens
agggugagugcaa

SEQ ID NO: 1149127 - RNA, 19 nt, Homo sapiens
agggugcagccacacucuu

SEQ ID NO: 1149128 - RNA, 17 nt, Homo sapiens
agggugcugggugggca

SEQ ID NO: 1149129 - RNA, 14 nt, Homo sapiens
aggguggcacaucu

SEQ ID NO: 1149130 - RNA, 23 nt, Homo sapiens
aggguugcuucugagugguguuu

SEQ ID NO: 1149131 - RNA, 22 nt, Homo sapiens
aggguuuuaguuuuuaauuuau

SEQ ID NO: 1149132 - RNA, 19 nt, Homo sapiens
agguaaaagcaucacauga

SEQ ID NO: 1149133 - RNA, 18 nt, Homo sapiens
agguaaaggaugaggguu

SEQ ID NO: 1149134 - RNA, 22 nt, Homo sapiens
agguaaccccagauucaugcac

SEQ ID NO: 1149135 - RNA, 17 nt, Homo sapiens
agguacaggaaaacucc

SEQ ID NO: 1149136 - RNA, 19 nt, Homo sapiens
agguacuucaggggcacuu

SEQ ID NO: 1149137 - RNA, 21 nt, Homo sapiens
agguagauuguuuuguucaca

SEQ ID NO: 1149138 - RNA, 20 nt, Homo sapiens
agguagugauuaacugugaa

SEQ ID NO: 1149139 - RNA, 16 nt, Homo sapiens
agguauaacagcacaa

SEQ ID NO: 1149140 - RNA, 16 nt, Homo sapiens
aggucacugucacugc

SEQ ID NO: 1149141 - RNA, 15 nt, Homo sapiens
aggucaggaguucaa

SEQ ID NO: 1149142 - RNA, 19 nt, Homo sapiens
aggucagggggcacugucu

SEQ ID NO: 1149143 - RNA, 19 nt, Homo sapiens
aggucauuacuaaccauag

SEQ ID NO: 1149144 - RNA, 19 nt, Homo sapiens
aggucauugcaccuaucuc

SEQ ID NO: 1149145 - RNA, 22 nt, Homo sapiens
agguccacggucuguucuugaa

SEQ ID NO: 1149146 - RNA, 15 nt, Homo sapiens
aggucccucagacau

SEQ ID NO: 1149147 - RNA, 16 nt, Homo sapiens
agguccgguguucuaa

SEQ ID NO: 1149148 - RNA, 16 nt, Homo sapiens
gcuagguaucauucaa

SEQ ID NO: 1149149 - RNA, 14 nt, Homo sapiens
gcuagucacuggca

SEQ ID NO: 1149150 - RNA, 21 nt, Homo sapiens
gcuaguccuagugaaccucac

SEQ ID NO: 1149151 - RNA, 12 nt, Homo sapiens
gcuaguguuucc

SEQ ID NO: 1149152 - RNA, 15 nt, Homo sapiens
gcuauagugaacucc

SEQ ID NO: 1149153 - RNA, 16 nt, Homo sapiens
gcuauauauacuggaa

SEQ ID NO: 1149154 - RNA, 10 nt, Homo sapiens
gcuauauucc

SEQ ID NO: 1149155 - RNA, 19 nt, Homo sapiens
gcuaucacuguacuuguag

SEQ ID NO: 1149156 - RNA, 16 nt, Homo sapiens
gcuaugauaagauuga

SEQ ID NO: 1149157 - RNA, 20 nt, Homo sapiens
gcuauggugagaugcagcug

SEQ ID NO: 1149158 - RNA, 17 nt, Homo sapiens
gcuauguaaauauacaa

SEQ ID NO: 1149159 - RNA, 14 nt, Homo sapiens
gcuauguaaggguc

SEQ ID NO: 1149160 - RNA, 23 nt, Homo sapiens
gcuauugacuaaucuuugcugaa

SEQ ID NO: 1149161 - RNA, 22 nt, Homo sapiens
gcuauuucagcaacaaccaucu

SEQ ID NO: 1149162 - RNA, 20 nt, Homo sapiens
gcuauuucaggcccucagcu

SEQ ID NO: 1149163 - RNA, 21 nt, Homo sapiens
gcuauuucaggcccucagcug

SEQ ID NO: 1149164 - RNA, 19 nt, Homo sapiens
gcuauuucuucuacugcua

SEQ ID NO: 1149165 - RNA, 17 nt, Homo sapiens
gcucaaacaacauucca

SEQ ID NO: 1149166 - RNA, 17 nt, Homo sapiens
gcucaagaggccacuua

SEQ ID NO: 1149167 - RNA, 14 nt, Homo sapiens
gcucacauucugag

SEQ ID NO: 1149168 - RNA, 17 nt, Homo sapiens
gcucacauucugagaaa

SEQ ID NO: 1149169 - RNA, 19 nt, Homo sapiens
gcucacauucugagaaaca

SEQ ID NO: 1149170 - RNA, 17 nt, Homo sapiens
gcucacguguauucuau

SEQ ID NO: 1149171 - RNA, 19 nt, Homo sapiens
gcucagaaggaauggugcg

SEQ ID NO: 1149172 - RNA, 15 nt, Homo sapiens
gcucagcauuuccac

SEQ ID NO: 1149173 - RNA, 19 nt, Homo sapiens
gcucagggaaaagcagcuc

SEQ ID NO: 1149174 - RNA, 21 nt, Homo sapiens
gcucagggaaaagcagcucuc

SEQ ID NO: 1149175 - RNA, 18 nt, Homo sapiens
gcucaggggacacuggcc

SEQ ID NO: 1149176 - RNA, 15 nt, Homo sapiens
gcucagucagacaug

SEQ ID NO: 1149177 - RNA, 20 nt, Homo sapiens
gcucaucagaaacucaaaag

SEQ ID NO: 1149178 - RNA, 21 nt, Homo sapiens
gcucaucaguaacaguauuca

SEQ ID NO: 1149179 - RNA, 12 nt, Homo sapiens
gcucauuuacuu

SEQ ID NO: 1149180 - RNA, 13 nt, Homo sapiens
gcuccaaacccuc

SEQ ID NO: 1149181 - RNA, 20 nt, Homo sapiens
gcuccaaaggaaauccaaaa

SEQ ID NO: 1149182 - RNA, 22 nt, Homo sapiens
gcuccaaccugcaaagaucugu

SEQ ID NO: 1149183 - RNA, 20 nt, Homo sapiens
gcuccaagauguucuccuga

SEQ ID NO: 1149184 - RNA, 14 nt, Homo sapiens
gcuccacuaggacu

SEQ ID NO: 1149185 - RNA, 13 nt, Homo sapiens
gcuccacugggau

SEQ ID NO: 1149186 - RNA, 16 nt, Homo sapiens
gcuccagaugcagggc

SEQ ID NO: 1149187 - RNA, 19 nt, Homo sapiens
gcuccagaugcagggcagu

SEQ ID NO: 1149188 - RNA, 17 nt, Homo sapiens
gcuccagcgauggugcu

SEQ ID NO: 1149189 - RNA, 22 nt, Homo sapiens
gcuccauuucuacaaugcacau

SEQ ID NO: 1149190 - RNA, 19 nt, Homo sapiens
gcuccauuuuuagugaaau

SEQ ID NO: 1149191 - RNA, 17 nt, Homo sapiens
gcucccacuucuuggga

SEQ ID NO: 1149192 - RNA, 14 nt, Homo sapiens
gcuccccugaggaa

SEQ ID NO: 1149193 - RNA, 15 nt, Homo sapiens
gcucccucacccagg

SEQ ID NO: 1149194 - RNA, 21 nt, Homo sapiens
gcucccucuauuuauguuugc

SEQ ID NO: 1149195 - RNA, 18 nt, Homo sapiens
gcucccugcgccugacau

SEQ ID NO: 1149196 - RNA, 12 nt, Homo sapiens
gcuccucacuca

SEQ ID NO: 1149197 - RNA, 18 nt, Homo sapiens
gcuccucacucaccuuca

SEQ ID NO: 1149198 - RNA, 21 nt, Homo sapiens
gcuccuccccacuagcauuuu

SEQ ID NO: 1149199 - RNA, 21 nt, Homo sapiens
gcuccucuccccagcccagag

SEQ ID NO: 1149200 - RNA, 15 nt, Homo sapiens
gcuccuguggcagcu

SEQ ID NO: 1149201 - RNA, 19 nt, Homo sapiens
gcuccuuagcugccaagcc

SEQ ID NO: 1149202 - RNA, 18 nt, Homo sapiens
gcuccuuaucagugccau

SEQ ID NO: 1149203 - RNA, 18 nt, Homo sapiens
cgcugcccgcucagccca

SEQ ID NO: 1149204 - RNA, 24 nt, Homo sapiens
cgcugcgcuuuauuucggagcgca

SEQ ID NO: 1149205 - RNA, 21 nt, Homo sapiens
cgcuggcuuuccagcuuagaa

SEQ ID NO: 1149206 - RNA, 18 nt, Homo sapiens
cgcuguauuuacagacac

SEQ ID NO: 1149207 - RNA, 20 nt, Homo sapiens
cgcuucugccuuuucacugu

SEQ ID NO: 1149208 - RNA, 15 nt, Homo sapiens
cggaaucagcuucua

SEQ ID NO: 1149209 - RNA, 13 nt, Homo sapiens
cggacacuucuca

SEQ ID NO: 1149210 - RNA, 18 nt, Homo sapiens
cggaccaugcgacacugg

SEQ ID NO: 1149211 - RNA, 13 nt, Homo sapiens
cggacucacuucu

SEQ ID NO: 1149212 - RNA, 18 nt, Homo sapiens
cggagccccugaaagccu

SEQ ID NO: 1149213 - RNA, 13 nt, Homo sapiens
cggagcuuugcaa

SEQ ID NO: 1149214 - RNA, 14 nt, Homo sapiens
cggaggcugcucag

SEQ ID NO: 1149215 - RNA, 18 nt, Homo sapiens
cggaguacagacgucuca

SEQ ID NO: 1149216 - RNA, 24 nt, Homo sapiens
cggagucuccucucuuggcaucga

SEQ ID NO: 1149217 - RNA, 18 nt, Homo sapiens
cggaugaagauauggaau

SEQ ID NO: 1149218 - RNA, 16 nt, Homo sapiens
cggcaacauuccucag

SEQ ID NO: 1149219 - RNA, 19 nt, Homo sapiens
cggccacaacuacaccacg

SEQ ID NO: 1149220 - RNA, 21 nt, Homo sapiens
cggccugcaccgaccccgggc

SEQ ID NO: 1149221 - RNA, 16 nt, Homo sapiens
cggcucgauuucucca

SEQ ID NO: 1149222 - RNA, 21 nt, Homo sapiens
cggcugagucaugaucucccu

SEQ ID NO: 1149223 - RNA, 14 nt, Homo sapiens
cggcuucccaugcc

SEQ ID NO: 1149224 - RNA, 18 nt, Homo sapiens
cggcuucccaugccugag

SEQ ID NO: 1149225 - RNA, 15 nt, Homo sapiens
cgggacaccuaggcu

SEQ ID NO: 1149226 - RNA, 18 nt, Homo sapiens
cgggaggcagagguugua

SEQ ID NO: 1149227 - RNA, 21 nt, Homo sapiens
cgggcaaaauaaagugacaga

SEQ ID NO: 1149228 - RNA, 20 nt, Homo sapiens
cgggcagggccccugacccu

SEQ ID NO: 1149229 - RNA, 22 nt, Homo sapiens
cgggcuaggaagaucucugcag

SEQ ID NO: 1149230 - RNA, 13 nt, Homo sapiens
cggggacugcugg

SEQ ID NO: 1149231 - RNA, 15 nt, Homo sapiens
cggggccagcacuuc

SEQ ID NO: 1149232 - RNA, 15 nt, Homo sapiens
cgggggccuguggug

SEQ ID NO: 1149233 - RNA, 17 nt, Homo sapiens
cggggucacuugcaauu

SEQ ID NO: 1149234 - RNA, 23 nt, Homo sapiens
cgggucacccugugacccucuca

SEQ ID NO: 1149235 - RNA, 20 nt, Homo sapiens
cggguggaucaccugagguc

SEQ ID NO: 1149236 - RNA, 12 nt, Homo sapiens
cgguaauaucau

SEQ ID NO: 1149237 - RNA, 16 nt, Homo sapiens
cgguauaacacaucua

SEQ ID NO: 1149238 - RNA, 15 nt, Homo sapiens
cggugcuauguguuu

SEQ ID NO: 1149239 - RNA, 17 nt, Homo sapiens
cguaaacacgccugcaa

SEQ ID NO: 1149240 - RNA, 23 nt, Homo sapiens
cguaacaccugauuaacugaggc

SEQ ID NO: 1149241 - RNA, 16 nt, Homo sapiens
cguacaucugcaauau

SEQ ID NO: 1149242 - RNA, 13 nt, Homo sapiens
cguacuguucaca

SEQ ID NO: 1149243 - RNA, 19 nt, Homo sapiens
cguagcuucuaccaugaac

SEQ ID NO: 1149244 - RNA, 15 nt, Homo sapiens
cguauggaaugcuuc

SEQ ID NO: 1149245 - RNA, 17 nt, Homo sapiens
cgucaaagcugaaaugg

SEQ ID NO: 1149246 - RNA, 18 nt, Homo sapiens
cgucaaggaaagggcagu

SEQ ID NO: 1149247 - RNA, 13 nt, Homo sapiens
cgucacaaagacc

SEQ ID NO: 1149248 - RNA, 23 nt, Homo sapiens
cgucacccuugguagaguuuauu

SEQ ID NO: 1149249 - RNA, 15 nt, Homo sapiens
cgucacuaauacaca

SEQ ID NO: 1149250 - RNA, 14 nt, Homo sapiens
cgucagcugggaca

SEQ ID NO: 1149251 - RNA, 14 nt, Homo sapiens
cgucaggcugccag

SEQ ID NO: 1149252 - RNA, 19 nt, Homo sapiens
cgucauugcuggugacuca

SEQ ID NO: 1149253 - RNA, 12 nt, Homo sapiens
cguccaccaggc

SEQ ID NO: 1149254 - RNA, 21 nt, Homo sapiens
cguccacugucaaguguuuua

SEQ ID NO: 1149255 - RNA, 20 nt, Homo sapiens
cguccagggagcauuuuccu

SEQ ID NO: 1149256 - RNA, 13 nt, Homo sapiens
cguccuacuguau

SEQ ID NO: 1149257 - RNA, 13 nt, Homo sapiens
cguccuuuggacu

SEQ ID NO: 1149258 - RNA, 11 nt, Homo sapiens
cgucuccuagc

SEQ ID NO: 1149259 - RNA, 19 nt, Homo sapiens
cgucuccugacaugucuca

SEQ ID NO: 1149260 - RNA, 19 nt, Homo sapiens
cgucuucuguauacugugg

SEQ ID NO: 1149261 - RNA, 19 nt, Homo sapiens
cgucuuucacaguuucuuc

SEQ ID NO: 1149262 - RNA, 17 nt, Homo sapiens
cgugacacaaacacaca

SEQ ID NO: 1149263 - RNA, 14 nt, Homo sapiens
cgugaccagugcug

SEQ ID NO: 1149264 - RNA, 18 nt, Homo sapiens
cgugacccucugcugaag

SEQ ID NO: 1149265 - RNA, 18 nt, Homo sapiens
cgugacgaggcucaaaaa

SEQ ID NO: 1149266 - RNA, 16 nt, Homo sapiens
cgugaucaaagccaca

SEQ ID NO: 1149267 - RNA, 16 nt, Homo sapiens
cgugccacuuuccacc

SEQ ID NO: 1149268 - RNA, 13 nt, Homo sapiens
cgugccccugaag

SEQ ID NO: 1149269 - RNA, 23 nt, Homo sapiens
cguggauguauggggaaucuaag

SEQ ID NO: 1149270 - RNA, 19 nt, Homo sapiens
cguggcuaagaguguccua

SEQ ID NO: 1149271 - RNA, 18 nt, Homo sapiens
cgugggaucagauuuggu

SEQ ID NO: 1149272 - RNA, 20 nt, Homo sapiens
cgugguggaggaacagggcu

SEQ ID NO: 1149273 - RNA, 20 nt, Homo sapiens
cgugguggcucaugccugua

SEQ ID NO: 1149274 - RNA, 13 nt, Homo sapiens
cgugugaccucca

SEQ ID NO: 1149275 - RNA, 14 nt, Homo sapiens
cgugugugaacaaa

SEQ ID NO: 1149276 - RNA, 13 nt, Homo sapiens
cguuauacugaaa

SEQ ID NO: 1149277 - RNA, 20 nt, Homo sapiens
cguuaucauggagaacagca

SEQ ID NO: 1149278 - RNA, 15 nt, Homo sapiens
cguuaugguguuucu

SEQ ID NO: 1149279 - RNA, 17 nt, Homo sapiens
cguucaaacugcuggaa

SEQ ID NO: 1149280 - RNA, 13 nt, Homo sapiens
cguucguauuuau

SEQ ID NO: 1149281 - RNA, 18 nt, Homo sapiens
cguuggccucagggccag

SEQ ID NO: 1149282 - RNA, 19 nt, Homo sapiens
cguuguacuguaugugaug

SEQ ID NO: 1149283 - RNA, 18 nt, Homo sapiens
cguuuaauccacucccuu

SEQ ID NO: 1149284 - RNA, 14 nt, Homo sapiens
cguuucuguauaca

SEQ ID NO: 1149285 - RNA, 16 nt, Homo sapiens
cguuugaacucaggga

SEQ ID NO: 1149286 - RNA, 21 nt, Homo sapiens
cguuuucgaggaagaaccugu

SEQ ID NO: 1149287 - RNA, 23 nt, Homo sapiens
cguuuugugugguggcaccuccu

SEQ ID NO: 1149288 - RNA, 21 nt, Homo sapiens
cguuuuguucauauucacuau

SEQ ID NO: 1149289 - RNA, 16 nt, Homo sapiens
accuucauaugcagua

SEQ ID NO: 1149290 - RNA, 14 nt, Homo sapiens
accuugacagagca

SEQ ID NO: 1149291 - RNA, 16 nt, Homo sapiens
accuugagcaaauuag

SEQ ID NO: 1149292 - RNA, 14 nt, Homo sapiens
accuugcacagguc

SEQ ID NO: 1149293 - RNA, 20 nt, Homo sapiens
accuugccacccauucuucc

SEQ ID NO: 1149294 - RNA, 16 nt, Homo sapiens
accuuggagcauuuau

SEQ ID NO: 1149295 - RNA, 16 nt, Homo sapiens
accuuggcaccagaca

SEQ ID NO: 1149296 - RNA, 18 nt, Homo sapiens
ccucaaugucacuuggug

SEQ ID NO: 1149297 - RNA, 12 nt, Homo sapiens
ccucaccugguc

SEQ ID NO: 1149298 - RNA, 13 nt, Homo sapiens
ccucacucagcuc

SEQ ID NO: 1149299 - RNA, 14 nt, Homo sapiens
ccucacugcugauu

SEQ ID NO: 1149300 - RNA, 13 nt, Homo sapiens
ccucagacauccc

SEQ ID NO: 1149301 - RNA, 19 nt, Homo sapiens
ccucagccuugccagagau

SEQ ID NO: 1149302 - RNA, 19 nt, Homo sapiens
ccucagcgggggccuugaa

SEQ ID NO: 1149303 - RNA, 22 nt, Homo sapiens
ccucaggcagguaaccccagau

SEQ ID NO: 1149304 - RNA, 14 nt, Homo sapiens
ccucagggacaacu

SEQ ID NO: 1149305 - RNA, 14 nt, Homo sapiens
ccucaguccacugc

SEQ ID NO: 1149306 - RNA, 18 nt, Homo sapiens
ccucaguggcucugggua

SEQ ID NO: 1149307 - RNA, 12 nt, Homo sapiens
ccucaguucuca

SEQ ID NO: 1149308 - RNA, 15 nt, Homo sapiens
ccucaucauuuccca

SEQ ID NO: 1149309 - RNA, 18 nt, Homo sapiens
ccucaucccgagcaccuc

SEQ ID NO: 1149310 - RNA, 22 nt, Homo sapiens
ccucaugauccacccaccucag

SEQ ID NO: 1149311 - RNA, 16 nt, Homo sapiens
ccucauuuauagaugu

SEQ ID NO: 1149312 - RNA, 14 nt, Homo sapiens
ccuccaacaccaag

SEQ ID NO: 1149313 - RNA, 17 nt, Homo sapiens
ccuccaaucuugagauu

SEQ ID NO: 1149314 - RNA, 13 nt, Homo sapiens
ccuccacugcugc

SEQ ID NO: 1149315 - RNA, 13 nt, Homo sapiens
ccuccagauauac

SEQ ID NO: 1149316 - RNA, 19 nt, Homo sapiens
ccuccagcacaaacacaag

SEQ ID NO: 1149317 - RNA, 17 nt, Homo sapiens
ccuccagucuguucuca

SEQ ID NO: 1149318 - RNA, 16 nt, Homo sapiens
ccucccaccaccccau

SEQ ID NO: 1149319 - RNA, 18 nt, Homo sapiens
ccucccagaacacacucc

SEQ ID NO: 1149320 - RNA, 14 nt, Homo sapiens
ccuccccaauccau

SEQ ID NO: 1149321 - RNA, 14 nt, Homo sapiens
ccuccccaccagag

SEQ ID NO: 1149322 - RNA, 21 nt, Homo sapiens
ccuccccauguacccaaggaa

SEQ ID NO: 1149323 - RNA, 20 nt, Homo sapiens
ccuccccuugaauaugggug

SEQ ID NO: 1149324 - RNA, 22 nt, Homo sapiens
ccuccccuuuucuauguugcua

SEQ ID NO: 1149325 - RNA, 20 nt, Homo sapiens
ccucccuguuccccagagaa

SEQ ID NO: 1149326 - RNA, 20 nt, Homo sapiens
ccuccgccuuccggguucaa

SEQ ID NO: 1149327 - RNA, 22 nt, Homo sapiens
ccuccuacucugagacaaaaga

SEQ ID NO: 1149328 - RNA, 14 nt, Homo sapiens
ccuccucacacucc

SEQ ID NO: 1149329 - RNA, 17 nt, Homo sapiens
ccuccuccaccacagaa

SEQ ID NO: 1149330 - RNA, 15 nt, Homo sapiens
ccuccuccugggcua

SEQ ID NO: 1149331 - RNA, 21 nt, Homo sapiens
ccuccucucaguguuuuggac

SEQ ID NO: 1149332 - RNA, 19 nt, Homo sapiens
ccuccugcaaggggcucaa

SEQ ID NO: 1149333 - RNA, 18 nt, Homo sapiens
ccuccugcucuaccagga

SEQ ID NO: 1149334 - RNA, 19 nt, Homo sapiens
ccuccuggagcucuguggg

SEQ ID NO: 1149335 - RNA, 15 nt, Homo sapiens
ccuccuuacauuaaa

SEQ ID NO: 1149336 - RNA, 16 nt, Homo sapiens
ccuccuucaauuccau

SEQ ID NO: 1149337 - RNA, 19 nt, Homo sapiens
ccuccuucggcuuugcccc

SEQ ID NO: 1149338 - RNA, 21 nt, Homo sapiens
ccuccuugcuuguuacauacc

SEQ ID NO: 1149339 - RNA, 18 nt, Homo sapiens
ccucgaaagugucaucaa

SEQ ID NO: 1149340 - RNA, 21 nt, Homo sapiens
ccucgaaagugucaucaauuu

SEQ ID NO: 1149341 - RNA, 15 nt, Homo sapiens
ccucgcccuccacaa

SEQ ID NO: 1149342 - RNA, 23 nt, Homo sapiens
ccucgccuccuacucugagacaa

SEQ ID NO: 1149343 - RNA, 13 nt, Homo sapiens
ccucuaaaacccu

SEQ ID NO: 1149344 - RNA, 19 nt, Homo sapiens
ccucuaaauuuccauaucc

SEQ ID NO: 1149345 - RNA, 22 nt, Homo sapiens
ccucuccacucaugugacucuu

SEQ ID NO: 1149346 - RNA, 20 nt, Homo sapiens
ccucucuaucggggucacuu

SEQ ID NO: 1149347 - RNA, 14 nt, Homo sapiens
ccucucucaggggu

SEQ ID NO: 1149348 - RNA, 23 nt, Homo sapiens
ccucucugcagacuucccagcua

SEQ ID NO: 1149349 - RNA, 15 nt, Homo sapiens
ccucuggcuccagca

SEQ ID NO: 1149350 - RNA, 22 nt, Homo sapiens
ccucuucucuugacagucugaa

SEQ ID NO: 1149351 - RNA, 15 nt, Homo sapiens
ccucuuggcucugag

SEQ ID NO: 1149352 - RNA, 16 nt, Homo sapiens
ccucuuucaucuguaa

SEQ ID NO: 1149353 - RNA, 23 nt, Homo sapiens
ccucuuugaacauggucuaguga

SEQ ID NO: 1149354 - RNA, 18 nt, Homo sapiens
ccucuuugucuaaaacaa

SEQ ID NO: 1149355 - RNA, 19 nt, Homo sapiens
ccucuuugucuaaaacaau

SEQ ID NO: 1149356 - RNA, 17 nt, Homo sapiens
ccucuuuuuagggcuaa

SEQ ID NO: 1149357 - RNA, 18 nt, Homo sapiens
ccucuuuuucugaagcua

SEQ ID NO: 1149358 - RNA, 22 nt, Homo sapiens
ccugaaaugccaagugccugcu

SEQ ID NO: 1149359 - RNA, 12 nt, Homo sapiens
ccugaagaacca

SEQ ID NO: 1149360 - RNA, 14 nt, Homo sapiens
ccugaaggaaccaa

SEQ ID NO: 1149361 - RNA, 17 nt, Homo sapiens
ccugacaaaaguuccau

SEQ ID NO: 1149362 - RNA, 16 nt, Homo sapiens
ccugacaagugaaguu

SEQ ID NO: 1149363 - RNA, 18 nt, Homo sapiens
ccugacaaguuauuacug

SEQ ID NO: 1149364 - RNA, 15 nt, Homo sapiens
ccugacagcacuccu

SEQ ID NO: 1149365 - RNA, 14 nt, Homo sapiens
ccugacaugucuca

SEQ ID NO: 1149366 - RNA, 18 nt, Homo sapiens
ccugacucuugcaggggu

SEQ ID NO: 1149367 - RNA, 17 nt, Homo sapiens
ccugacuuuuaauguca

SEQ ID NO: 1149368 - RNA, 16 nt, Homo sapiens
ccugagaaacguccau

SEQ ID NO: 1149369 - RNA, 13 nt, Homo sapiens
ccugagaccucua

SEQ ID NO: 1149370 - RNA, 21 nt, Homo sapiens
ccugagauccggcaacaucaa

SEQ ID NO: 1149371 - RNA, 20 nt, Homo sapiens
ccugagaucugcacagucag

SEQ ID NO: 1149372 - RNA, 20 nt, Homo sapiens
ccugaggcaagccauggagu

SEQ ID NO: 1149373 - RNA, 15 nt, Homo sapiens
ccugagggagcucca

SEQ ID NO: 1149374 - RNA, 22 nt, Homo sapiens
ccugaguuggggggaauucuca

SEQ ID NO: 1149375 - RNA, 21 nt, Homo sapiens
ccugaucagagccgugguccu

SEQ ID NO: 1149376 - RNA, 18 nt, Homo sapiens
ccugauccugacacauuc

SEQ ID NO: 1149377 - RNA, 19 nt, Homo sapiens
ccugaucgccaaccuuucc

SEQ ID NO: 1149378 - RNA, 13 nt, Homo sapiens
ccugaugagauuu

SEQ ID NO: 1149379 - RNA, 16 nt, Homo sapiens
ccugauuaacugaggc

SEQ ID NO: 1149380 - RNA, 17 nt, Homo sapiens
ccugcaaaaggacucuc

SEQ ID NO: 1149381 - RNA, 14 nt, Homo sapiens
ccugcacacuuggu

SEQ ID NO: 1149382 - RNA, 13 nt, Homo sapiens
ccugcagaguaua

SEQ ID NO: 1149383 - RNA, 18 nt, Homo sapiens
ccugcagccucaucauuu

SEQ ID NO: 1149384 - RNA, 13 nt, Homo sapiens
ccugcaucaccac

SEQ ID NO: 1149385 - RNA, 20 nt, Homo sapiens
ccugccagcaguuacuguga

SEQ ID NO: 1149386 - RNA, 20 nt, Homo sapiens
ccugccagguuuaaacauca

SEQ ID NO: 1149387 - RNA, 21 nt, Homo sapiens
ccugccagguuuaaacaucac

SEQ ID NO: 1149388 - RNA, 14 nt, Homo sapiens
ccugcccacugcug

SEQ ID NO: 1149389 - RNA, 21 nt, Homo sapiens
ccugccuuuagaguuccauga

SEQ ID NO: 1149390 - RNA, 22 nt, Homo sapiens
ccugcgguggggcugaggggug

SEQ ID NO: 1149391 - RNA, 14 nt, Homo sapiens
ccugcgugcgcugg

SEQ ID NO: 1149392 - RNA, 19 nt, Homo sapiens
ccugcucaggaaaccacaa

SEQ ID NO: 1149393 - RNA, 18 nt, Homo sapiens
ccugcucccucacccagg

SEQ ID NO: 1149394 - RNA, 14 nt, Homo sapiens
ccugcugaagcugc

SEQ ID NO: 1149395 - RNA, 22 nt, Homo sapiens
ccugcugacuauuugaccccca

SEQ ID NO: 1149396 - RNA, 16 nt, Homo sapiens
ccugcugagucccuca

SEQ ID NO: 1149397 - RNA, 23 nt, Homo sapiens
ccugcugcaucuucccacagugg

SEQ ID NO: 1149398 - RNA, 21 nt, Homo sapiens
ccugcugggguccuuuguuag

SEQ ID NO: 1149399 - RNA, 15 nt, Homo sapiens
ccugcuucauaucuc

SEQ ID NO: 1149400 - RNA, 22 nt, Homo sapiens
ccuggaaauaucaguuacucag

SEQ ID NO: 1149401 - RNA, 14 nt, Homo sapiens
ccuggaacaccagc

SEQ ID NO: 1149402 - RNA, 18 nt, Homo sapiens
ccuggaaugccaauguca

SEQ ID NO: 1149403 - RNA, 18 nt, Homo sapiens
ccuggaauugcagcugua

SEQ ID NO: 1149404 - RNA, 16 nt, Homo sapiens
ccuggacgaagagcag

SEQ ID NO: 1149405 - RNA, 19 nt, Homo sapiens
ccuggagcauggacagugu

SEQ ID NO: 1149406 - RNA, 18 nt, Homo sapiens
ccuggaggagcugugcug

SEQ ID NO: 1149407 - RNA, 17 nt, Homo sapiens
ccuggagugcugugcug

SEQ ID NO: 1149408 - RNA, 19 nt, Homo sapiens
ccuggauccucaguucuca

SEQ ID NO: 1149409 - RNA, 23 nt, Homo sapiens
ccuggcauuauguccacugugua

SEQ ID NO: 1149410 - RNA, 18 nt, Homo sapiens
ccuggccuggcacacauc

SEQ ID NO: 1149411 - RNA, 17 nt, Homo sapiens
ccuggccuuguccucag

SEQ ID NO: 1149412 - RNA, 17 nt, Homo sapiens
ccugggaggcacagcaa

SEQ ID NO: 1149413 - RNA, 18 nt, Homo sapiens
ccugggccccaccaccua

SEQ ID NO: 1149414 - RNA, 20 nt, Homo sapiens
ccuggggcuagggggagccc

SEQ ID NO: 1149415 - RNA, 21 nt, Homo sapiens
ccugggguagccuccuaucca

SEQ ID NO: 1149416 - RNA, 22 nt, Homo sapiens
ccuggggugaggggaggcaucu

SEQ ID NO: 1149417 - RNA, 20 nt, Homo sapiens
ccugggguguuaguggcacc

SEQ ID NO: 1149418 - RNA, 15 nt, Homo sapiens
ccuggguauguguag

SEQ ID NO: 1149419 - RNA, 21 nt, Homo sapiens
ccugggucuuuaugcaugaag

SEQ ID NO: 1149420 - RNA, 13 nt, Homo sapiens
ccugggugacaaa

SEQ ID NO: 1149421 - RNA, 17 nt, Homo sapiens
ccuggguggggcugcuc

SEQ ID NO: 1149422 - RNA, 16 nt, Homo sapiens
ccuggucugcucagga

SEQ ID NO: 1149423 - RNA, 22 nt, Homo sapiens
ccuggugggaaaaugcacacau

SEQ ID NO: 1149424 - RNA, 11 nt, Homo sapiens
ccuggugggag

SEQ ID NO: 1149425 - RNA, 20 nt, Homo sapiens
ccuguaaucccaacacuuug

SEQ ID NO: 1149426 - RNA, 19 nt, Homo sapiens
ccuguaaucccagcacuuu

SEQ ID NO: 1149427 - RNA, 13 nt, Homo sapiens
ccuguacccagug

SEQ ID NO: 1149428 - RNA, 13 nt, Homo sapiens
cuaaggaguaauc

SEQ ID NO: 1149429 - RNA, 19 nt, Homo sapiens
cuaaggaguaaucugugua

SEQ ID NO: 1149430 - RNA, 17 nt, Homo sapiens
cuaagggaggcacuucc

SEQ ID NO: 1149431 - RNA, 23 nt, Homo sapiens
cuaaguagcuggguuuacaggca

SEQ ID NO: 1149432 - RNA, 14 nt, Homo sapiens
cuaaguuauuguua

SEQ ID NO: 1149433 - RNA, 17 nt, Homo sapiens
cuaauaaaaacaagaug

SEQ ID NO: 1149434 - RNA, 17 nt, Homo sapiens
cuaauaauaaauuaaua

SEQ ID NO: 1149435 - RNA, 20 nt, Homo sapiens
cuaauaauaaauuaauaaca

SEQ ID NO: 1149436 - RNA, 14 nt, Homo sapiens
cuaauacuacugca

SEQ ID NO: 1149437 - RNA, 17 nt, Homo sapiens
cuaauagucuuugccag

SEQ ID NO: 1149438 - RNA, 17 nt, Homo sapiens
cuaauauaagugaagga

SEQ ID NO: 1149439 - RNA, 18 nt, Homo sapiens
cuaauauuaaaagucaca

SEQ ID NO: 1149440 - RNA, 23 nt, Homo sapiens
cuaaucaacagauaaaugacaag

SEQ ID NO: 1149441 - RNA, 16 nt, Homo sapiens
cuaaucacaugugcug

SEQ ID NO: 1149442 - RNA, 18 nt, Homo sapiens
cuaaucacaugugcugca

SEQ ID NO: 1149443 - RNA, 21 nt, Homo sapiens
cuaaucugauguuaaccaaug

SEQ ID NO: 1149444 - RNA, 11 nt, Homo sapiens
cuaaugcauua

SEQ ID NO: 1149445 - RNA, 16 nt, Homo sapiens
cuaaugcucaccuuua

SEQ ID NO: 1149446 - RNA, 13 nt, Homo sapiens
cuaaugggcuaaa

SEQ ID NO: 1149447 - RNA, 23 nt, Homo sapiens
cuaauuauaaaauuaacaugaua

SEQ ID NO: 1149448 - RNA, 15 nt, Homo sapiens
cuaauucaacauaua

SEQ ID NO: 1149449 - RNA, 16 nt, Homo sapiens
cuaauucucuguggaa

SEQ ID NO: 1149450 - RNA, 17 nt, Homo sapiens
cuaauucugauguuugg

SEQ ID NO: 1149451 - RNA, 14 nt, Homo sapiens
cuaauuguguacau

SEQ ID NO: 1149452 - RNA, 11 nt, Homo sapiens
cuacaacagcc

SEQ ID NO: 1149453 - RNA, 17 nt, Homo sapiens
cuacaacaugauagaac

SEQ ID NO: 1149454 - RNA, 17 nt, Homo sapiens
cuacaagugauccucag

SEQ ID NO: 1149455 - RNA, 18 nt, Homo sapiens
cuacaaucgcuaccugac

SEQ ID NO: 1149456 - RNA, 24 nt, Homo sapiens
cuacaauuuggcuaagguagguga

SEQ ID NO: 1149457 - RNA, 17 nt, Homo sapiens
cuacacaagcaucaccu

SEQ ID NO: 1149458 - RNA, 19 nt, Homo sapiens
cuacacaccuaagggacau

SEQ ID NO: 1149459 - RNA, 15 nt, Homo sapiens
cuacacauacaugua

SEQ ID NO: 1149460 - RNA, 19 nt, Homo sapiens
cuacacgagauacagaauu

SEQ ID NO: 1149461 - RNA, 21 nt, Homo sapiens
cuacacucuugacuagugcaa

SEQ ID NO: 1149462 - RNA, 15 nt, Homo sapiens
cuacagaaagcacaa

SEQ ID NO: 1149463 - RNA, 16 nt, Homo sapiens
cuacagaaagcacaaa

SEQ ID NO: 1149464 - RNA, 17 nt, Homo sapiens
cuacauggacucagaga

SEQ ID NO: 1149465 - RNA, 13 nt, Homo sapiens
cuaccacuuugaa

SEQ ID NO: 1149466 - RNA, 13 nt, Homo sapiens
cuaccagcauaaa

SEQ ID NO: 1149467 - RNA, 19 nt, Homo sapiens
cuaccaggcacgucugcag

SEQ ID NO: 1149468 - RNA, 15 nt, Homo sapiens
cuaccaggcuguaaa

SEQ ID NO: 1149469 - RNA, 18 nt, Homo sapiens
cuacccacuuaggcuuug

SEQ ID NO: 1149470 - RNA, 14 nt, Homo sapiens
cuacccaugaccug

SEQ ID NO: 1149471 - RNA, 16 nt, Homo sapiens
cuacccccucaucccc

SEQ ID NO: 1149472 - RNA, 21 nt, Homo sapiens
cuacccccugugccuugucac

SEQ ID NO: 1149473 - RNA, 15 nt, Homo sapiens
cuacccuguucugua

SEQ ID NO: 1149474 - RNA, 17 nt, Homo sapiens
cuacccuuuucugggga

SEQ ID NO: 1149475 - RNA, 13 nt, Homo sapiens
cuaccuauauucc

SEQ ID NO: 1149476 - RNA, 14 nt, Homo sapiens
cuaccucagccucc

SEQ ID NO: 1149477 - RNA, 22 nt, Homo sapiens
cuacgccugcauguaaacacgc

SEQ ID NO: 1149478 - RNA, 15 nt, Homo sapiens
cuacguaucugcuac

SEQ ID NO: 1149479 - RNA, 22 nt, Homo sapiens
cuacgucaaacaugaagugugu

SEQ ID NO: 1149480 - RNA, 20 nt, Homo sapiens
cuacuacaaacuucaaagag

SEQ ID NO: 1149481 - RNA, 17 nt, Homo sapiens
cuacuagccauugggaa

SEQ ID NO: 1149482 - RNA, 19 nt, Homo sapiens
cuacuagcucuuugagaua

SEQ ID NO: 1149483 - RNA, 16 nt, Homo sapiens
cuacuauauaugacug

SEQ ID NO: 1149484 - RNA, 20 nt, Homo sapiens
cuacugaguagggggagcaa

SEQ ID NO: 1149485 - RNA, 20 nt, Homo sapiens
cuacugagucccuggcaaga

SEQ ID NO: 1149486 - RNA, 16 nt, Homo sapiens
cuacugauuguuucau

SEQ ID NO: 1149487 - RNA, 20 nt, Homo sapiens
cuacugggagccuacccacc

SEQ ID NO: 1149488 - RNA, 16 nt, Homo sapiens
cuacugggcugcauuc

SEQ ID NO: 1149489 - RNA, 20 nt, Homo sapiens
cuacugggcugcauucccau

SEQ ID NO: 1149490 - RNA, 21 nt, Homo sapiens
cuacuguuaucaguaaugcua

SEQ ID NO: 1149491 - RNA, 16 nt, Homo sapiens
cuacuuccccaaauga

SEQ ID NO: 1149492 - RNA, 18 nt, Homo sapiens
cuacuucugugucuguca

SEQ ID NO: 1149493 - RNA, 14 nt, Homo sapiens
cuacuugggagcac

SEQ ID NO: 1149494 - RNA, 16 nt, Homo sapiens
cuacuuuaucaauuaa

SEQ ID NO: 1149495 - RNA, 12 nt, Homo sapiens
cuagaaauugcc

SEQ ID NO: 1149496 - RNA, 23 nt, Homo sapiens
cuagaagaauuaagcugugcaau

SEQ ID NO: 1149497 - RNA, 18 nt, Homo sapiens
cuagaagauaacauuuuc

SEQ ID NO: 1149498 - RNA, 14 nt, Homo sapiens
cuagaaguagauuc

SEQ ID NO: 1149499 - RNA, 19 nt, Homo sapiens
cuagacaccuucugugcuc

SEQ ID NO: 1149500 - RNA, 20 nt, Homo sapiens
cuagacaccuucugugcuca

SEQ ID NO: 1149501 - RNA, 14 nt, Homo sapiens
cuagacauugcaau

SEQ ID NO: 1149502 - RNA, 15 nt, Homo sapiens
cuagacauugcaauu

SEQ ID NO: 1149503 - RNA, 22 nt, Homo sapiens
cuagagacaggcaaacugcaaa

SEQ ID NO: 1149504 - RNA, 19 nt, Homo sapiens
cuagagacagugaugccug

SEQ ID NO: 1149505 - RNA, 22 nt, Homo sapiens
cuagagagggaggcaagcccug

SEQ ID NO: 1149506 - RNA, 23 nt, Homo sapiens
cuagagauauggcagcgaaagga

SEQ ID NO: 1149507 - RNA, 19 nt, Homo sapiens
cuagagauuugguguacaa

SEQ ID NO: 1149508 - RNA, 14 nt, Homo sapiens
cuagagcacugcca

SEQ ID NO: 1149509 - RNA, 15 nt, Homo sapiens
cuagagcacugccac

SEQ ID NO: 1149510 - RNA, 15 nt, Homo sapiens
cuagagcuacagggg

SEQ ID NO: 1149511 - RNA, 18 nt, Homo sapiens
cuagagcuugcagugaag

SEQ ID NO: 1149512 - RNA, 15 nt, Homo sapiens
cuagagugcaauggu

SEQ ID NO: 1149513 - RNA, 20 nt, Homo sapiens
cuagauaccuaaaacauaag

SEQ ID NO: 1149514 - RNA, 14 nt, Homo sapiens
cugcugagaguacu

SEQ ID NO: 1149515 - RNA, 19 nt, Homo sapiens
cugcugaucaaugaaaugc

SEQ ID NO: 1149516 - RNA, 23 nt, Homo sapiens
cugcugccauacuguaugcagua

SEQ ID NO: 1149517 - RNA, 19 nt, Homo sapiens
cugcuggcugucuggcuuc

SEQ ID NO: 1149518 - RNA, 12 nt, Homo sapiens
cugcuggucucu

SEQ ID NO: 1149519 - RNA, 15 nt, Homo sapiens
cugcugugacugugu

SEQ ID NO: 1149520 - RNA, 14 nt, Homo sapiens
cugcuuaauucaaa

SEQ ID NO: 1149521 - RNA, 22 nt, Homo sapiens
cugcuuaucugaaacuucccaa

SEQ ID NO: 1149522 - RNA, 14 nt, Homo sapiens
cugcuucucggggu

SEQ ID NO: 1149523 - RNA, 16 nt, Homo sapiens
cugcuuuaucagggga

SEQ ID NO: 1149524 - RNA, 18 nt, Homo sapiens
cugcuuuccaaagccaau

SEQ ID NO: 1149525 - RNA, 12 nt, Homo sapiens
cugcuuugccua

SEQ ID NO: 1149526 - RNA, 17 nt, Homo sapiens
cugcuuugggaagccgu

SEQ ID NO: 1149527 - RNA, 18 nt, Homo sapiens
cuggaaaacucaugaaua

SEQ ID NO: 1149528 - RNA, 15 nt, Homo sapiens
cuggaaaaugaaucc

SEQ ID NO: 1149529 - RNA, 21 nt, Homo sapiens
cuggaacaccagcagcacugg

SEQ ID NO: 1149530 - RNA, 18 nt, Homo sapiens
cuggaaccaccuggacga

SEQ ID NO: 1149531 - RNA, 12 nt, Homo sapiens
cuggaacccagg

SEQ ID NO: 1149532 - RNA, 22 nt, Homo sapiens
cuggaacccgagacuuggccau

SEQ ID NO: 1149533 - RNA, 16 nt, Homo sapiens
cuggaaccugcaaaaa

SEQ ID NO: 1149534 - RNA, 23 nt, Homo sapiens
cuggaagcauguaggagaaucca

SEQ ID NO: 1149535 - RNA, 15 nt, Homo sapiens
cuggaagcauuuguu

SEQ ID NO: 1149536 - RNA, 16 nt, Homo sapiens
cuggaaggagcacaua

SEQ ID NO: 1149537 - RNA, 16 nt, Homo sapiens
cuggaagguacuuuaa

SEQ ID NO: 1149538 - RNA, 15 nt, Homo sapiens
cuggaagucaucuca

SEQ ID NO: 1149539 - RNA, 16 nt, Homo sapiens
cuggaaguugaagguu

SEQ ID NO: 1149540 - RNA, 15 nt, Homo sapiens
cuggaaucacauucu

SEQ ID NO: 1149541 - RNA, 24 nt, Homo sapiens
cuggaauguaaguaagugacaaug

SEQ ID NO: 1149542 - RNA, 12 nt, Homo sapiens
cuggacacagag

SEQ ID NO: 1149543 - RNA, 22 nt, Homo sapiens
cuggacaccgggccaguaucua

SEQ ID NO: 1149544 - RNA, 20 nt, Homo sapiens
cuggacauuuuuucagucau

SEQ ID NO: 1149545 - RNA, 14 nt, Homo sapiens
cuggaccagugguc

SEQ ID NO: 1149546 - RNA, 13 nt, Homo sapiens
cuggaccauuuga

SEQ ID NO: 1149547 - RNA, 19 nt, Homo sapiens
cuggagccgccauucugca

SEQ ID NO: 1149548 - RNA, 19 nt, Homo sapiens
cuggagggaagcacugccu

SEQ ID NO: 1149549 - RNA, 19 nt, Homo sapiens
cuggagggggagcaccagc

SEQ ID NO: 1149550 - RNA, 22 nt, Homo sapiens
cuggaguacaguggugugaucc

SEQ ID NO: 1149551 - RNA, 13 nt, Homo sapiens
cuggagugcaaug

SEQ ID NO: 1149552 - RNA, 20 nt, Homo sapiens
cuggagugcaguggcgcaau

SEQ ID NO: 1149553 - RNA, 20 nt, Homo sapiens
cuggagugcaguggugugau

SEQ ID NO: 1149554 - RNA, 14 nt, Homo sapiens
cuggagugcugcuu

SEQ ID NO: 1149555 - RNA, 22 nt, Homo sapiens
cuggauauucgguaauaucauu

SEQ ID NO: 1149556 - RNA, 17 nt, Homo sapiens
cuggaucccaucaaaga

SEQ ID NO: 1149557 - RNA, 20 nt, Homo sapiens
cuggauuacaggcaugugcc

SEQ ID NO: 1149558 - RNA, 18 nt, Homo sapiens
cuggauuaggucucuguu

SEQ ID NO: 1149559 - RNA, 21 nt, Homo sapiens
cuggauuugccugcagaguuu

SEQ ID NO: 1149560 - RNA, 14 nt, Homo sapiens
cuggcaaacaugug

SEQ ID NO: 1149561 - RNA, 15 nt, Homo sapiens
cuggcaacacagagg

SEQ ID NO: 1149562 - RNA, 15 nt, Homo sapiens
cuggcaagacugucu

SEQ ID NO: 1149563 - RNA, 19 nt, Homo sapiens
cuggcacacaguaagcacu

SEQ ID NO: 1149564 - RNA, 13 nt, Homo sapiens
cuggcacacuggc

SEQ ID NO: 1149565 - RNA, 18 nt, Homo sapiens
cuggcaguuuugacauca

SEQ ID NO: 1149566 - RNA, 21 nt, Homo sapiens
cuggccacccaaacaggacaa

SEQ ID NO: 1149567 - RNA, 19 nt, Homo sapiens
cuggccacugaaaagcuuu

SEQ ID NO: 1149568 - RNA, 23 nt, Homo sapiens
cuggccaguccugguccuggcug

SEQ ID NO: 1149569 - RNA, 15 nt, Homo sapiens
cuggccaugcugucc

SEQ ID NO: 1149570 - RNA, 14 nt, Homo sapiens
cuggcccaaccaga

SEQ ID NO: 1149571 - RNA, 15 nt, Homo sapiens
cuggccuguacccag

SEQ ID NO: 1149572 - RNA, 21 nt, Homo sapiens
cuggcuccuuaucagugccau

SEQ ID NO: 1149573 - RNA, 16 nt, Homo sapiens
cuggcucuuugcugug

SEQ ID NO: 1149574 - RNA, 20 nt, Homo sapiens
cuggcuguuccccugcucug

SEQ ID NO: 1149575 - RNA, 15 nt, Homo sapiens
cuggcuucacucucc

SEQ ID NO: 1149576 - RNA, 15 nt, Homo sapiens
cuggcuucagccucc

SEQ ID NO: 1149577 - RNA, 23 nt, Homo sapiens
cuggcuuguuguaaagcaauaaa

SEQ ID NO: 1149578 - RNA, 15 nt, Homo sapiens
cuggcuuuccagcuu

SEQ ID NO: 1149579 - RNA, 19 nt, Homo sapiens
cuggcuuuucuuucuacca

SEQ ID NO: 1149580 - RNA, 14 nt, Homo sapiens
cugggaaagacauc

SEQ ID NO: 1149581 - RNA, 18 nt, Homo sapiens
cugggacacuuaacagau

SEQ ID NO: 1149582 - RNA, 18 nt, Homo sapiens
cugggaccucccacugcc

SEQ ID NO: 1149583 - RNA, 20 nt, Homo sapiens
cugggaccucccacugcccc

SEQ ID NO: 1149584 - RNA, 19 nt, Homo sapiens
cugggagccauggggagca

SEQ ID NO: 1149585 - RNA, 15 nt, Homo sapiens
cugggauuacaggca

SEQ ID NO: 1149586 - RNA, 22 nt, Homo sapiens
cugggauuacaggcaugugcca

SEQ ID NO: 1149587 - RNA, 22 nt, Homo sapiens
cugggauuacaggcgugagcca

SEQ ID NO: 1149588 - RNA, 15 nt, Homo sapiens
cugggcaauauagca

SEQ ID NO: 1149589 - RNA, 13 nt, Homo sapiens
cugggcauggugg

SEQ ID NO: 1149590 - RNA, 15 nt, Homo sapiens
cugggcccacaaagg

SEQ ID NO: 1149591 - RNA, 15 nt, Homo sapiens
cugggccccaccacc

SEQ ID NO: 1149592 - RNA, 22 nt, Homo sapiens
cugggccccaccaccuaggcca

SEQ ID NO: 1149593 - RNA, 17 nt, Homo sapiens
cugggccuggcagcuca

SEQ ID NO: 1149594 - RNA, 19 nt, Homo sapiens
cugggcgcuucccuuuuaa

SEQ ID NO: 1149595 - RNA, 15 nt, Homo sapiens
cuuacugaagccagg

SEQ ID NO: 1149596 - RNA, 16 nt, Homo sapiens
cuuacuuccagcaaaa

SEQ ID NO: 1149597 - RNA, 20 nt, Homo sapiens
cuuacuuccagcaaaaucca

SEQ ID NO: 1149598 - RNA, 16 nt, Homo sapiens
cuuagaaacacauaaa

SEQ ID NO: 1149599 - RNA, 18 nt, Homo sapiens
cuuagacaguaugcauac

SEQ ID NO: 1149600 - RNA, 14 nt, Homo sapiens
cuuagauauuaaaa

SEQ ID NO: 1149601 - RNA, 19 nt, Homo sapiens
cuuagauguuccaguaauc

SEQ ID NO: 1149602 - RNA, 21 nt, Homo sapiens
cuuaguauugcagccaaagaa

SEQ ID NO: 1149603 - RNA, 18 nt, Homo sapiens
cuuaguguuucugugcau

SEQ ID NO: 1149604 - RNA, 15 nt, Homo sapiens
cuuauaaauaugaag

SEQ ID NO: 1149605 - RNA, 20 nt, Homo sapiens
cuuauaagaaagaucaaaga

SEQ ID NO: 1149606 - RNA, 14 nt, Homo sapiens
cuuauacuguacaa

SEQ ID NO: 1149607 - RNA, 21 nt, Homo sapiens
cuuauacuucggguaaccuug

SEQ ID NO: 1149608 - RNA, 18 nt, Homo sapiens
cuuauagaaaguucaaaa

SEQ ID NO: 1149609 - RNA, 18 nt, Homo sapiens
cuuauauucauccaugcc

SEQ ID NO: 1149610 - RNA, 18 nt, Homo sapiens
cuuaucuccaagaccaga

SEQ ID NO: 1149611 - RNA, 21 nt, Homo sapiens
cuuaucucccugcuucauauc

SEQ ID NO: 1149612 - RNA, 15 nt, Homo sapiens
cuuauggcugcugaa

SEQ ID NO: 1149613 - RNA, 13 nt, Homo sapiens
cuuauguguugca

SEQ ID NO: 1149614 - RNA, 13 nt, Homo sapiens
cuuauuaaagcaa

SEQ ID NO: 1149615 - RNA, 17 nt, Homo sapiens
cuuauuguggauaacaa

SEQ ID NO: 1149616 - RNA, 16 nt, Homo sapiens
cuuauugugugaaggu

SEQ ID NO: 1149617 - RNA, 16 nt, Homo sapiens
cuuauuuuucuacuug

SEQ ID NO: 1149618 - RNA, 17 nt, Homo sapiens
cuucaaagccauaugga

SEQ ID NO: 1149619 - RNA, 22 nt, Homo sapiens
cuucaaucucguuuagugccaa

SEQ ID NO: 1149620 - RNA, 22 nt, Homo sapiens
cuucaauuuggauauuuggagg

SEQ ID NO: 1149621 - RNA, 18 nt, Homo sapiens
cuucaccugcaaagcucu

SEQ ID NO: 1149622 - RNA, 14 nt, Homo sapiens
cuucaccuuaggaa

SEQ ID NO: 1149623 - RNA, 23 nt, Homo sapiens
cuucaccuuucccacuuucuucu

SEQ ID NO: 1149624 - RNA, 17 nt, Homo sapiens
cuucacggcacuggauc

SEQ ID NO: 1149625 - RNA, 19 nt, Homo sapiens
cuucacucuucaaaugccu

SEQ ID NO: 1149626 - RNA, 23 nt, Homo sapiens
cuucacuguccuccaagccagcg

SEQ ID NO: 1149627 - RNA, 23 nt, Homo sapiens
cuucacuuacaagaaaggccuga

SEQ ID NO: 1149628 - RNA, 11 nt, Homo sapiens
cuucagaacag

SEQ ID NO: 1149629 - RNA, 15 nt, Homo sapiens
cuucagaagugccau

SEQ ID NO: 1149630 - RNA, 24 nt, Homo sapiens
cuucagccuaguggcuuguccuca

SEQ ID NO: 1149631 - RNA, 17 nt, Homo sapiens
cuucagggaacugcaua

SEQ ID NO: 1149632 - RNA, 23 nt, Homo sapiens
cuucaggggagcccggagcuuug

SEQ ID NO: 1149633 - RNA, 23 nt, Homo sapiens
cuucaggggcacuucauugagag

SEQ ID NO: 1149634 - RNA, 14 nt, Homo sapiens
cuucagucucauau

SEQ ID NO: 1149635 - RNA, 13 nt, Homo sapiens
cuucagugcugcu

SEQ ID NO: 1149636 - RNA, 22 nt, Homo sapiens
cuucauacagggaugguguuca

SEQ ID NO: 1149637 - RNA, 14 nt, Homo sapiens
cuucauacuccuuu

SEQ ID NO: 1149638 - RNA, 16 nt, Homo sapiens
cuucauagaaaccucu

SEQ ID NO: 1149639 - RNA, 15 nt, Homo sapiens
cuucauauaccagca

SEQ ID NO: 1149640 - RNA, 12 nt, Homo sapiens
cuucaugcuuuu

SEQ ID NO: 1149641 - RNA, 23 nt, Homo sapiens
cuucaugcuuuugcuugcaaugu

SEQ ID NO: 1149642 - RNA, 17 nt, Homo sapiens
cuucauggccucaggag

SEQ ID NO: 1149643 - RNA, 18 nt, Homo sapiens
cuucauucuguaugugac

SEQ ID NO: 1149644 - RNA, 17 nt, Homo sapiens
cuucauuuaacaaguaa

SEQ ID NO: 1149645 - RNA, 19 nt, Homo sapiens
cuucauuucauccuguugg

SEQ ID NO: 1149646 - RNA, 14 nt, Homo sapiens
cuuccaaacaggcu

SEQ ID NO: 1149647 - RNA, 14 nt, Homo sapiens
cuuccaaagaaugu

SEQ ID NO: 1149648 - RNA, 20 nt, Homo sapiens
cuuccaaugaaaucucagga

SEQ ID NO: 1149649 - RNA, 17 nt, Homo sapiens
cuuccacaccuagcauc

SEQ ID NO: 1149650 - RNA, 17 nt, Homo sapiens
cuuccagaaaacaaaac

SEQ ID NO: 1149651 - RNA, 16 nt, Homo sapiens
cuuccagaagcaaaaa

SEQ ID NO: 1149652 - RNA, 13 nt, Homo sapiens
cuuccagcaaaau

SEQ ID NO: 1149653 - RNA, 22 nt, Homo sapiens
cuuccaggagccaccuugccac

SEQ ID NO: 1149654 - RNA, 14 nt, Homo sapiens
cuuccaucuaguga

SEQ ID NO: 1149655 - RNA, 13 nt, Homo sapiens
cuuccaucuggcu

SEQ ID NO: 1149656 - RNA, 11 nt, Homo sapiens
cuuccauuugc

SEQ ID NO: 1149657 - RNA, 14 nt, Homo sapiens
cuucccaacuuccc

SEQ ID NO: 1149658 - RNA, 15 nt, Homo sapiens
cuucccacggcuccu

SEQ ID NO: 1149659 - RNA, 13 nt, Homo sapiens
cuucccagguagc

SEQ ID NO: 1149660 - RNA, 16 nt, Homo sapiens
cuucccucuucccuca

SEQ ID NO: 1149661 - RNA, 20 nt, Homo sapiens
cuucccuugcuucuuggacu

SEQ ID NO: 1149662 - RNA, 13 nt, Homo sapiens
cuuccgaaaacca

SEQ ID NO: 1149663 - RNA, 17 nt, Homo sapiens
cuuccgcaguguggcca

SEQ ID NO: 1149664 - RNA, 15 nt, Homo sapiens
cuuccuccagaggag

SEQ ID NO: 1149665 - RNA, 21 nt, Homo sapiens
cuuccucccaacaagcagcug

SEQ ID NO: 1149666 - RNA, 16 nt, Homo sapiens
cuuccucuccacagga

SEQ ID NO: 1149667 - RNA, 22 nt, Homo sapiens
cuuccugccaggagcucuccac

SEQ ID NO: 1149668 - RNA, 22 nt, Homo sapiens
cuuccugcuuaaacuugaccca

SEQ ID NO: 1149669 - RNA, 23 nt, Homo sapiens
cuuccugguugagcuucugcuaa

SEQ ID NO: 1149670 - RNA, 15 nt, Homo sapiens
cuuccuguccagcuc

SEQ ID NO: 1149671 - RNA, 16 nt, Homo sapiens
cuuccuugccagugag

SEQ ID NO: 1149672 - RNA, 21 nt, Homo sapiens
cuucgggagugcuuacacuua

SEQ ID NO: 1149673 - RNA, 21 nt, Homo sapiens
cuguauagccuauacugcauu

SEQ ID NO: 1149674 - RNA, 22 nt, Homo sapiens
cuguauaugauucucugugguu

SEQ ID NO: 1149675 - RNA, 20 nt, Homo sapiens
cuguaugccuucagcauugc

SEQ ID NO: 1149676 - RNA, 21 nt, Homo sapiens
cuguauuuucaaagacugcca

SEQ ID NO: 1149677 - RNA, 22 nt, Homo sapiens
cuguauuuuuuuuuuccauuag

SEQ ID NO: 1149678 - RNA, 12 nt, Homo sapiens
cugucaaacaaa

SEQ ID NO: 1149679 - RNA, 18 nt, Homo sapiens
cugucaaacaaagccaga

SEQ ID NO: 1149680 - RNA, 22 nt, Homo sapiens
cugucaaacaaagccagaagcu

SEQ ID NO: 1149681 - RNA, 19 nt, Homo sapiens
cugucaccacaucuugucu

SEQ ID NO: 1149682 - RNA, 19 nt, Homo sapiens
cugucacguagaacuugga

SEQ ID NO: 1149683 - RNA, 23 nt, Homo sapiens
cugucacuacaauuuaaacacca

SEQ ID NO: 1149684 - RNA, 15 nt, Homo sapiens
cugucagucacagcc

SEQ ID NO: 1149685 - RNA, 12 nt, Homo sapiens
cugucauccacu

SEQ ID NO: 1149686 - RNA, 16 nt, Homo sapiens
cugucauccucaggaa

SEQ ID NO: 1149687 - RNA, 16 nt, Homo sapiens
cugucaucugcugcga

SEQ ID NO: 1149688 - RNA, 20 nt, Homo sapiens
cugucauuaguauuucacaa

SEQ ID NO: 1149689 - RNA, 21 nt, Homo sapiens
cugucauuuuggcaucugcaa

SEQ ID NO: 1149690 - RNA, 14 nt, Homo sapiens
cuguccacacccag

SEQ ID NO: 1149691 - RNA, 17 nt, Homo sapiens
cuguccaccaccaccug

SEQ ID NO: 1149692 - RNA, 17 nt, Homo sapiens
cuguccagcagucacuu

SEQ ID NO: 1149693 - RNA, 16 nt, Homo sapiens
cuguccauuaucuaua

SEQ ID NO: 1149694 - RNA, 22 nt, Homo sapiens
cugucccaaggugaaaugaagc

SEQ ID NO: 1149695 - RNA, 14 nt, Homo sapiens
cugucccccaaaaa

SEQ ID NO: 1149696 - RNA, 19 nt, Homo sapiens
cugucccuugcuguaugcu

SEQ ID NO: 1149697 - RNA, 19 nt, Homo sapiens
cuguccuagucuccuuuga

SEQ ID NO: 1149698 - RNA, 15 nt, Homo sapiens
cuguccucagccuug

SEQ ID NO: 1149699 - RNA, 21 nt, Homo sapiens
cuguccuucugaagugugucc

SEQ ID NO: 1149700 - RNA, 21 nt, Homo sapiens
cuguccuuucuagagcacugc

SEQ ID NO: 1149701 - RNA, 18 nt, Homo sapiens
cugucgguggcugccuuu

SEQ ID NO: 1149702 - RNA, 14 nt, Homo sapiens
cugucuagacuggc

SEQ ID NO: 1149703 - RNA, 16 nt, Homo sapiens
cugucuagacuggccu

SEQ ID NO: 1149704 - RNA, 12 nt, Homo sapiens
cugucucaguga

SEQ ID NO: 1149705 - RNA, 13 nt, Homo sapiens
cugucucagugau

SEQ ID NO: 1149706 - RNA, 20 nt, Homo sapiens
cugucuccccuuuccccgcg

SEQ ID NO: 1149707 - RNA, 13 nt, Homo sapiens
cugucuccuuuga

SEQ ID NO: 1149708 - RNA, 22 nt, Homo sapiens
cugucucuggcauuuguuuccu

SEQ ID NO: 1149709 - RNA, 21 nt, Homo sapiens
cugucuggcuuuaaccugagc

SEQ ID NO: 1149710 - RNA, 15 nt, Homo sapiens
cugucuguaccuaaa

SEQ ID NO: 1149711 - RNA, 22 nt, Homo sapiens
cugucuguguuucuuuuugcca

SEQ ID NO: 1149712 - RNA, 18 nt, Homo sapiens
cugucuguuacacuggag

SEQ ID NO: 1149713 - RNA, 22 nt, Homo sapiens
cugucuucaccugauucaacua

SEQ ID NO: 1149714 - RNA, 18 nt, Homo sapiens
cugucuuccaaauugaag

SEQ ID NO: 1149715 - RNA, 15 nt, Homo sapiens
cugugaagaucucac

SEQ ID NO: 1149716 - RNA, 19 nt, Homo sapiens
cugugaagcaggucuuuca

SEQ ID NO: 1149717 - RNA, 20 nt, Homo sapiens
cugugaagcaggucuuucac

SEQ ID NO: 1149718 - RNA, 23 nt, Homo sapiens
cugugaagcccuuugccuguaga

SEQ ID NO: 1149719 - RNA, 17 nt, Homo sapiens
cugugaaguuacaugca

SEQ ID NO: 1149720 - RNA, 13 nt, Homo sapiens
cugugaaugcuuc

SEQ ID NO: 1149721 - RNA, 21 nt, Homo sapiens
cugugacaaugacuaagccaa

SEQ ID NO: 1149722 - RNA, 20 nt, Homo sapiens
cugugacccucucacuuugg

SEQ ID NO: 1149723 - RNA, 19 nt, Homo sapiens
cugugagacagugggaaau

SEQ ID NO: 1149724 - RNA, 21 nt, Homo sapiens
cugugagccuugcaugacauc

SEQ ID NO: 1149725 - RNA, 23 nt, Homo sapiens
cugugagguuucccaaugguguu

SEQ ID NO: 1149726 - RNA, 21 nt, Homo sapiens
cugugauucccuccugcuacu

SEQ ID NO: 1149727 - RNA, 12 nt, Homo sapiens
cugugcacugua

SEQ ID NO: 1149728 - RNA, 16 nt, Homo sapiens
cugugcaguagcauca

SEQ ID NO: 1149729 - RNA, 12 nt, Homo sapiens
cugugcauuuau

SEQ ID NO: 1149730 - RNA, 15 nt, Homo sapiens
cugugccagcacaaa

SEQ ID NO: 1149731 - RNA, 17 nt, Homo sapiens
cugugccccagcagugc

SEQ ID NO: 1149732 - RNA, 19 nt, Homo sapiens
cugugcccuggcuccaugc

SEQ ID NO: 1149733 - RNA, 22 nt, Homo sapiens
cugugccucggcuuuucucagc

SEQ ID NO: 1149734 - RNA, 17 nt, Homo sapiens
cugugcguggaaaaaga

SEQ ID NO: 1149735 - RNA, 14 nt, Homo sapiens
cugugcuacugaaa

SEQ ID NO: 1149736 - RNA, 15 nt, Homo sapiens
cugugcuauggugcu

SEQ ID NO: 1149737 - RNA, 15 nt, Homo sapiens
cugugcuguguggaa

SEQ ID NO: 1149738 - RNA, 15 nt, Homo sapiens
cuguggacaccacug

SEQ ID NO: 1149739 - RNA, 20 nt, Homo sapiens
cuguggacaccacugagcuc

SEQ ID NO: 1149740 - RNA, 21 nt, Homo sapiens
cuguggagcucuggggggcaa

SEQ ID NO: 1149741 - RNA, 14 nt, Homo sapiens
cuguggaugccagg

SEQ ID NO: 1149742 - RNA, 17 nt, Homo sapiens
cuguggcucacaguggg

SEQ ID NO: 1149743 - RNA, 17 nt, Homo sapiens
cuguggcugguccucau

SEQ ID NO: 1149744 - RNA, 15 nt, Homo sapiens
cugugggaagcuccc

SEQ ID NO: 1149745 - RNA, 21 nt, Homo sapiens
cugugguggccuggugcacag

SEQ ID NO: 1149746 - RNA, 18 nt, Homo sapiens
cuguggugucugccuguu

SEQ ID NO: 1149747 - RNA, 15 nt, Homo sapiens
cuguguacacaagau

SEQ ID NO: 1149748 - RNA, 13 nt, Homo sapiens
cuguguacuguac

SEQ ID NO: 1149749 - RNA, 17 nt, Homo sapiens
cugugucacaucacgaa

SEQ ID NO: 1149750 - RNA, 20 nt, Homo sapiens
cugugucagggaacauauuu

SEQ ID NO: 1149751 - RNA, 16 nt, Homo sapiens
cugugugauugacagc

SEQ ID NO: 1149752 - RNA, 14 nt, Homo sapiens
uaauuuaugcagaa

SEQ ID NO: 1149753 - RNA, 14 nt, Homo sapiens
uaauuugaacuuug

SEQ ID NO: 1149754 - RNA, 23 nt, Homo sapiens
uaauuugagaucguccacuguca

SEQ ID NO: 1149755 - RNA, 14 nt, Homo sapiens
uaauuuuacauguu

SEQ ID NO: 1149756 - RNA, 20 nt, Homo sapiens
uaauuuugugcucuuuccug

SEQ ID NO: 1149757 - RNA, 20 nt, Homo sapiens
uaauuuuuaaaagacuuuga

SEQ ID NO: 1149758 - RNA, 21 nt, Homo sapiens
uaauuuuuaaaagacuuugau

SEQ ID NO: 1149759 - RNA, 20 nt, Homo sapiens
uaauuuuuaaggauguugcc

SEQ ID NO: 1149760 - RNA, 23 nt, Homo sapiens
uaauuuuuccuuccucuguaaga

SEQ ID NO: 1149761 - RNA, 22 nt, Homo sapiens
uacaaaaauaccuacugcugag

SEQ ID NO: 1149762 - RNA, 23 nt, Homo sapiens
uacaaaaaugguaacuagguuga

SEQ ID NO: 1149763 - RNA, 20 nt, Homo sapiens
uacaaaaccacuggaaaguu

SEQ ID NO: 1149764 - RNA, 18 nt, Homo sapiens
uacaaaacuacaugagaa

SEQ ID NO: 1149765 - RNA, 12 nt, Homo sapiens
uacaaacauguu

SEQ ID NO: 1149766 - RNA, 13 nt, Homo sapiens
uacaaagaaauaa

SEQ ID NO: 1149767 - RNA, 11 nt, Homo sapiens
uacaaauggac

SEQ ID NO: 1149768 - RNA, 14 nt, Homo sapiens
uaaacugauuuauc

SEQ ID NO: 1149769 - RNA, 22 nt, Homo sapiens
uaaacugugugcaacagacaaa

SEQ ID NO: 1149770 - RNA, 14 nt, Homo sapiens
uaaacuuguuuaca

SEQ ID NO: 1149771 - RNA, 17 nt, Homo sapiens
uaaagaaauaaccacug

SEQ ID NO: 1149772 - RNA, 20 nt, Homo sapiens
uaaagaaauauauaugauau

SEQ ID NO: 1149773 - RNA, 19 nt, Homo sapiens
uaaagaaggguguuuaaua

SEQ ID NO: 1149774 - RNA, 23 nt, Homo sapiens
uaaagaaggugauaaaugucagu

SEQ ID NO: 1149775 - RNA, 12 nt, Homo sapiens
uaaagaauacuu

SEQ ID NO: 1149776 - RNA, 14 nt, Homo sapiens
uaaagaauacuuga

SEQ ID NO: 1149777 - RNA, 19 nt, Homo sapiens
uaaagacaaagacauuauu

SEQ ID NO: 1149778 - RNA, 15 nt, Homo sapiens
uaaagauaaugcugc

SEQ ID NO: 1149779 - RNA, 17 nt, Homo sapiens
uaaagaucuacaugaau

SEQ ID NO: 1149780 - RNA, 15 nt, Homo sapiens
uaaagcaaacaugca

SEQ ID NO: 1149781 - RNA, 18 nt, Homo sapiens
uaaagcaaaccagccuca

SEQ ID NO: 1149782 - RNA, 13 nt, Homo sapiens
uaaagcaggauuu

SEQ ID NO: 1149783 - RNA, 20 nt, Homo sapiens
uaaagcagggacugugaaca

SEQ ID NO: 1149784 - RNA, 16 nt, Homo sapiens
uaaagcauuacaguau

SEQ ID NO: 1149785 - RNA, 21 nt, Homo sapiens
uaaagcccagaucucugcauc

SEQ ID NO: 1149786 - RNA, 17 nt, Homo sapiens
uaaagccgaacugguac

SEQ ID NO: 1149787 - RNA, 15 nt, Homo sapiens
uaaagccucaugugu

SEQ ID NO: 1149788 - RNA, 22 nt, Homo sapiens
uaaagcgacaucccaguagugu

SEQ ID NO: 1149789 - RNA, 14 nt, Homo sapiens
uaaagcgcagauaa

SEQ ID NO: 1149790 - RNA, 17 nt, Homo sapiens
uaaagcgugugugaaca

SEQ ID NO: 1149791 - RNA, 22 nt, Homo sapiens
uaaagcuauuuaugggccccug

SEQ ID NO: 1149792 - RNA, 14 nt, Homo sapiens
uaaaggacaaacag

SEQ ID NO: 1149793 - RNA, 13 nt, Homo sapiens
uaaaggauauuaa

SEQ ID NO: 1149794 - RNA, 14 nt, Homo sapiens
uaaagggacuugaa

SEQ ID NO: 1149795 - RNA, 19 nt, Homo sapiens
uaaagggcgcaaagggcau

SEQ ID NO: 1149796 - RNA, 24 nt, Homo sapiens
uaaagucaggaguccaagaccaga

SEQ ID NO: 1149797 - RNA, 19 nt, Homo sapiens
uaaagucuagugaccuuaa

SEQ ID NO: 1149798 - RNA, 14 nt, Homo sapiens
uaaagugacagaug

SEQ ID NO: 1149799 - RNA, 19 nt, Homo sapiens
uaaagugacauaauuuaca

SEQ ID NO: 1149800 - RNA, 18 nt, Homo sapiens
uaaagugaguacuguuaa

SEQ ID NO: 1149801 - RNA, 13 nt, Homo sapiens
uaaagugcucuua

SEQ ID NO: 1149802 - RNA, 14 nt, Homo sapiens
uaaagugugccaca

SEQ ID NO: 1149803 - RNA, 18 nt, Homo sapiens
uaaaguguuugaaagcuu

SEQ ID NO: 1149804 - RNA, 15 nt, Homo sapiens
uaaaguucuagugac

SEQ ID NO: 1149805 - RNA, 19 nt, Homo sapiens
uaaaguuguuugugccuuu

SEQ ID NO: 1149806 - RNA, 16 nt, Homo sapiens
uaaauaaaagauagca

SEQ ID NO: 1149807 - RNA, 13 nt, Homo sapiens
uaaauaacauguu

SEQ ID NO: 1149808 - RNA, 22 nt, Homo sapiens
uaaauaacuuuggaaacauggg

SEQ ID NO: 1149809 - RNA, 18 nt, Homo sapiens
uaaauaagauucuaacgg

SEQ ID NO: 1149810 - RNA, 17 nt, Homo sapiens
uaaauacacaaagggau

SEQ ID NO: 1149811 - RNA, 22 nt, Homo sapiens
uaaauacauccuuuuucugcua

SEQ ID NO: 1149812 - RNA, 13 nt, Homo sapiens
uaaauaccaaaaa

SEQ ID NO: 1149813 - RNA, 17 nt, Homo sapiens
uaaauacgaaacucgag

SEQ ID NO: 1149814 - RNA, 18 nt, Homo sapiens
uaaauacucccuuuuuga

SEQ ID NO: 1149815 - RNA, 16 nt, Homo sapiens
uaaauacuugcuccau

SEQ ID NO: 1149816 - RNA, 22 nt, Homo sapiens
uaaauaucuauuaaccauucua

SEQ ID NO: 1149817 - RNA, 15 nt, Homo sapiens
uaaauauuauuuauc

SEQ ID NO: 1149818 - RNA, 14 nt, Homo sapiens
uaaauauugucaua

SEQ ID NO: 1149819 - RNA, 15 nt, Homo sapiens
uaaaucacauccuua

SEQ ID NO: 1149820 - RNA, 13 nt, Homo sapiens
uaaauccuuccau

SEQ ID NO: 1149821 - RNA, 14 nt, Homo sapiens
uaaaucguccuccc

SEQ ID NO: 1149822 - RNA, 16 nt, Homo sapiens
uaaaucguccucccag

SEQ ID NO: 1149823 - RNA, 18 nt, Homo sapiens
uaaaucuagaguuuauac

SEQ ID NO: 1149824 - RNA, 15 nt, Homo sapiens
uaaaugaagugcaaa

SEQ ID NO: 1149825 - RNA, 16 nt, Homo sapiens
uaaaugaagugcaaau

SEQ ID NO: 1149826 - RNA, 16 nt, Homo sapiens
uaaaugauguguuggu

SEQ ID NO: 1149827 - RNA, 21 nt, Homo sapiens
uaaaugccacuucaccaagga

SEQ ID NO: 1149828 - RNA, 13 nt, Homo sapiens
uaaaugcccaguu

SEQ ID NO: 1149829 - RNA, 16 nt, Homo sapiens
uaaauguacagacaua

SEQ ID NO: 1149830 - RNA, 15 nt, Homo sapiens
uaaauuaacucacua

SEQ ID NO: 1149831 - RNA, 15 nt, Homo sapiens
uaaauuaauugugcc

SEQ ID NO: 1149832 - RNA, 13 nt, Homo sapiens
uaaauuagcuuuu

SEQ ID NO: 1149833 - RNA, 17 nt, Homo sapiens
uaaauuaugacugcuga

SEQ ID NO: 1149834 - RNA, 19 nt, Homo sapiens
uaaauuauggcucuucacc

SEQ ID NO: 1149835 - RNA, 20 nt, Homo sapiens
uaaauuaugggaaucaagau

SEQ ID NO: 1149836 - RNA, 17 nt, Homo sapiens
uaaauuauuaguuuaca

SEQ ID NO: 1149837 - RNA, 20 nt, Homo sapiens
uaaauuauuaguuuacauca

SEQ ID NO: 1149838 - RNA, 22 nt, Homo sapiens
uaaauuauuuuuguucauauaa

SEQ ID NO: 1149839 - RNA, 13 nt, Homo sapiens
uaaauucauaucc

SEQ ID NO: 1149840 - RNA, 23 nt, Homo sapiens
uaaauucuauaggaacauaugaa

SEQ ID NO: 1149841 - RNA, 18 nt, Homo sapiens
uaaauugauucaagugag

SEQ ID NO: 1149842 - RNA, 21 nt, Homo sapiens
uaaauugcauuucuaugccau

SEQ ID NO: 1149843 - RNA, 16 nt, Homo sapiens
uaaauugguacaguau

SEQ ID NO: 1149844 - RNA, 15 nt, Homo sapiens
uaaauuucaucucag

SEQ ID NO: 1149845 - RNA, 17 nt, Homo sapiens
uaaauuuuacccuuuag

SEQ ID NO: 1149846 - RNA, 16 nt, Homo sapiens
uaaauuuugugcaaaa

SEQ ID NO: 1149847 - RNA, 21 nt, Homo sapiens
uaacaaagacuucugucauaa

SEQ ID NO: 1149848 - RNA, 14 nt, Homo sapiens
uaacaagccagauu

SEQ ID NO: 1149849 - RNA, 20 nt, Homo sapiens
uaacaagucgaugaacuauu

SEQ ID NO: 1149850 - RNA, 22 nt, Homo sapiens
uaacacacagagcucaccuguu

SEQ ID NO: 1149851 - RNA, 20 nt, Homo sapiens
uaacaccaucgaucaugaug

SEQ ID NO: 1149852 - RNA, 13 nt, Homo sapiens
uaacaccugaugu

SEQ ID NO: 1149853 - RNA, 15 nt, Homo sapiens
uaacacggugcucau

SEQ ID NO: 1149854 - RNA, 17 nt, Homo sapiens
uaacacugaaauugccu

SEQ ID NO: 1149855 - RNA, 15 nt, Homo sapiens
uaacacuuaccccau

SEQ ID NO: 1149856 - RNA, 17 nt, Homo sapiens
uaacagaguaucagauc

SEQ ID NO: 1149857 - RNA, 15 nt, Homo sapiens
uaacagaugcaaugu

SEQ ID NO: 1149858 - RNA, 15 nt, Homo sapiens
uaacauaugauacug

SEQ ID NO: 1149859 - RNA, 20 nt, Homo sapiens
uaacaucagcaggaaugcuc

SEQ ID NO: 1149860 - RNA, 17 nt, Homo sapiens
uaacaugacauuuacca

SEQ ID NO: 1149861 - RNA, 19 nt, Homo sapiens
uaacaugcccuguucagcu

SEQ ID NO: 1149862 - RNA, 20 nt, Homo sapiens
uaacaugcccuguucagcua

SEQ ID NO: 1149863 - RNA, 13 nt, Homo sapiens
uaacauguuauca

SEQ ID NO: 1149864 - RNA, 17 nt, Homo sapiens
uaacauguuaucaaauc

SEQ ID NO: 1149865 - RNA, 15 nt, Homo sapiens
uaacauucccacugc

SEQ ID NO: 1149866 - RNA, 17 nt, Homo sapiens
uaacauucccacugcca

SEQ ID NO: 1149867 - RNA, 22 nt, Homo sapiens
uaaccaaaagacaccagccacu

SEQ ID NO: 1149868 - RNA, 20 nt, Homo sapiens
uaaccaaauaaaacauaaua

SEQ ID NO: 1149869 - RNA, 21 nt, Homo sapiens
uaaccacaaagcacaguuuga

SEQ ID NO: 1149870 - RNA, 14 nt, Homo sapiens
uaaccauuugcacu

SEQ ID NO: 1149871 - RNA, 17 nt, Homo sapiens
uaaccguuuuucaagaa

SEQ ID NO: 1149872 - RNA, 15 nt, Homo sapiens
uaaccucacauaccc

SEQ ID NO: 1149873 - RNA, 13 nt, Homo sapiens
uaaccuugccuua

SEQ ID NO: 1149874 - RNA, 22 nt, Homo sapiens
uaacguauauuaaaccuguuga

SEQ ID NO: 1149875 - RNA, 15 nt, Homo sapiens
uaacuaaugaauuga

SEQ ID NO: 1149876 - RNA, 14 nt, Homo sapiens
uaacuagcugagca

SEQ ID NO: 1149877 - RNA, 15 nt, Homo sapiens
uaacuagcugagcac

SEQ ID NO: 1149878 - RNA, 11 nt, Homo sapiens
uaacuauucaa

SEQ ID NO: 1149879 - RNA, 14 nt, Homo sapiens
uaacuauuucuuca

SEQ ID NO: 1149880 - RNA, 15 nt, Homo sapiens
uaacucacugagggu

SEQ ID NO: 1149881 - RNA, 18 nt, Homo sapiens
uaacuccccuguuucaau

SEQ ID NO: 1149882 - RNA, 20 nt, Homo sapiens
uaacucugaccugggagccc

SEQ ID NO: 1149883 - RNA, 14 nt, Homo sapiens
uaacugaaccaaau

SEQ ID NO: 1149884 - RNA, 20 nt, Homo sapiens
uaacugaaccaaauugcacu

SEQ ID NO: 1149885 - RNA, 20 nt, Homo sapiens
uaacugacaaaccauugaaa

SEQ ID NO: 1149886 - RNA, 13 nt, Homo sapiens
uaacugacaugau

SEQ ID NO: 1149887 - RNA, 21 nt, Homo sapiens
uaacugcauugagaacugcau

SEQ ID NO: 1149888 - RNA, 15 nt, Homo sapiens
uaacuggcaguuuuc

SEQ ID NO: 1149889 - RNA, 20 nt, Homo sapiens
uaacuguucaaacucaggcc

SEQ ID NO: 1149890 - RNA, 13 nt, Homo sapiens
uaacuuacacuga

SEQ ID NO: 1149891 - RNA, 21 nt, Homo sapiens
uaacuuauuuuguacuagugu

SEQ ID NO: 1149892 - RNA, 10 nt, Homo sapiens
uaacuuuauu

SEQ ID NO: 1149893 - RNA, 19 nt, Homo sapiens
uaacuuuucggucuuuccc

SEQ ID NO: 1149894 - RNA, 18 nt, Homo sapiens
uaagaaaagccagucaaa

SEQ ID NO: 1149895 - RNA, 18 nt, Homo sapiens
uaagaaaccauuauuuca

SEQ ID NO: 1149896 - RNA, 20 nt, Homo sapiens
uaagaaagguaaagacugcc

SEQ ID NO: 1149897 - RNA, 22 nt, Homo sapiens
uaagaaauaaaucaguaaggca

SEQ ID NO: 1149898 - RNA, 20 nt, Homo sapiens
uaagaaauaaauuuauuuca

SEQ ID NO: 1149899 - RNA, 19 nt, Homo sapiens
uaagaaauacuagaguaaa

SEQ ID NO: 1149900 - RNA, 21 nt, Homo sapiens
uaagaaaucucccaugugcau

SEQ ID NO: 1149901 - RNA, 13 nt, Homo sapiens
uaagaaauguaua

SEQ ID NO: 1149902 - RNA, 21 nt, Homo sapiens
uaagacaugauuuccuugaau

SEQ ID NO: 1149903 - RNA, 17 nt, Homo sapiens
gacaguuuuugacauuu

SEQ ID NO: 1149904 - RNA, 17 nt, Homo sapiens
gacauaaguucauucau

SEQ ID NO: 1149905 - RNA, 21 nt, Homo sapiens
gacauaaugggguccuggcca

SEQ ID NO: 1149906 - RNA, 13 nt, Homo sapiens
gacauagccucau

SEQ ID NO: 1149907 - RNA, 14 nt, Homo sapiens
gacaucaaaaugag

SEQ ID NO: 1149908 - RNA, 21 nt, Homo sapiens
gacaucagaaguaacucccac

SEQ ID NO: 1149909 - RNA, 14 nt, Homo sapiens
gacaucccggccca

SEQ ID NO: 1149910 - RNA, 16 nt, Homo sapiens
gacaugauuagcagaa

SEQ ID NO: 1149911 - RNA, 15 nt, Homo sapiens
gacaugcccugugug

SEQ ID NO: 1149912 - RNA, 16 nt, Homo sapiens
gacauggacacaucag

SEQ ID NO: 1149913 - RNA, 23 nt, Homo sapiens
gacauguaacgaaacacuucaau

SEQ ID NO: 1149914 - RNA, 16 nt, Homo sapiens
gacauucacacagaga

SEQ ID NO: 1149915 - RNA, 22 nt, Homo sapiens
gacauugaggaccucauccaaa

SEQ ID NO: 1149916 - RNA, 18 nt, Homo sapiens
gacauugcuggucauccu

SEQ ID NO: 1149917 - RNA, 17 nt, Homo sapiens
gacauuuugugacugaa

SEQ ID NO: 1149918 - RNA, 23 nt, Homo sapiens
gaccaagugcaauaugggcgggc

SEQ ID NO: 1149919 - RNA, 20 nt, Homo sapiens
gaccacacgcccccacaggc

SEQ ID NO: 1149920 - RNA, 15 nt, Homo sapiens
gaccaccacuucgaa

SEQ ID NO: 1149921 - RNA, 18 nt, Homo sapiens
gaccagagugggaccaag

SEQ ID NO: 1149922 - RNA, 16 nt, Homo sapiens
gaccagcccuugaggg

SEQ ID NO: 1149923 - RNA, 15 nt, Homo sapiens
gaccaggcaguuuuu

SEQ ID NO: 1149924 - RNA, 13 nt, Homo sapiens
gaccagugcaguu

SEQ ID NO: 1149925 - RNA, 18 nt, Homo sapiens
gaccagugcaguuucuaa

SEQ ID NO: 1149926 - RNA, 23 nt, Homo sapiens
gaccaguggucucacauggugcu

SEQ ID NO: 1149927 - RNA, 22 nt, Homo sapiens
gaccaucaguucuuuugucuua

SEQ ID NO: 1149928 - RNA, 13 nt, Homo sapiens
gaccaucugugac

SEQ ID NO: 1149929 - RNA, 17 nt, Homo sapiens
gaccaugcgacacuggg

SEQ ID NO: 1149930 - RNA, 14 nt, Homo sapiens
gaccaugcugauga

SEQ ID NO: 1149931 - RNA, 13 nt, Homo sapiens
gacccaagcugcc

SEQ ID NO: 1149932 - RNA, 15 nt, Homo sapiens
gacccacagccucca

SEQ ID NO: 1149933 - RNA, 12 nt, Homo sapiens
gacccagugcag

SEQ ID NO: 1149934 - RNA, 17 nt, Homo sapiens
gacccaucuuccaccuc

SEQ ID NO: 1149935 - RNA, 13 nt, Homo sapiens
gaccccaaaaaga

SEQ ID NO: 1149936 - RNA, 14 nt, Homo sapiens
gacccccagcacuu

SEQ ID NO: 1149937 - RNA, 23 nt, Homo sapiens
gacccccagcacuuggggguuca

SEQ ID NO: 1149938 - RNA, 21 nt, Homo sapiens
gaccccugccuacuuccuucc

SEQ ID NO: 1149939 - RNA, 13 nt, Homo sapiens
gacccgaggccca

SEQ ID NO: 1149940 - RNA, 13 nt, Homo sapiens
gacccucucaggc

SEQ ID NO: 1149941 - RNA, 18 nt, Homo sapiens
gacccuuggaacuuugaa

SEQ ID NO: 1149942 - RNA, 21 nt, Homo sapiens
gaccgagcccagcagaucuca

SEQ ID NO: 1149943 - RNA, 16 nt, Homo sapiens
gaccuaguauaucagu

SEQ ID NO: 1149944 - RNA, 19 nt, Homo sapiens
gaccucagggacaacugcc

SEQ ID NO: 1149945 - RNA, 22 nt, Homo sapiens
gaccucccaacucuaaagccaa

SEQ ID NO: 1149946 - RNA, 23 nt, Homo sapiens
gaccuccuuuuuugaggucaggg

SEQ ID NO: 1149947 - RNA, 21 nt, Homo sapiens
gaccucuauauuugcucuuuu

SEQ ID NO: 1149948 - RNA, 15 nt, Homo sapiens
gaccucugacaaagc

SEQ ID NO: 1149949 - RNA, 16 nt, Homo sapiens
gaccuggcagcucugg

SEQ ID NO: 1149950 - RNA, 16 nt, Homo sapiens
gaccugguccacaggg

SEQ ID NO: 1149951 - RNA, 19 nt, Homo sapiens
gaccuggugggagcaccug

SEQ ID NO: 1149952 - RNA, 16 nt, Homo sapiens
gaccugguuaaacaaa

SEQ ID NO: 1149953 - RNA, 17 nt, Homo sapiens
gaccuguccaggugagu

SEQ ID NO: 1149954 - RNA, 15 nt, Homo sapiens
gaccuuaguguuucu

SEQ ID NO: 1149955 - RNA, 14 nt, Homo sapiens
gaccuugcauguaa

SEQ ID NO: 1149956 - RNA, 13 nt, Homo sapiens
gaccuugcugaua

SEQ ID NO: 1149957 - RNA, 19 nt, Homo sapiens
gaccuuugauuuuuugccc

SEQ ID NO: 1149958 - RNA, 22 nt, Homo sapiens
gacgggcaaaauaaagugacag

SEQ ID NO: 1149959 - RNA, 15 nt, Homo sapiens
gacgggccaggcccu

SEQ ID NO: 1149960 - RNA, 20 nt, Homo sapiens
gacggggggugggaacaaga

SEQ ID NO: 1149961 - RNA, 24 nt, Homo sapiens
gacggugucuuguucugucacuca

SEQ ID NO: 1149962 - RNA, 19 nt, Homo sapiens
gacguacuuugugcuggga

SEQ ID NO: 1149963 - RNA, 15 nt, Homo sapiens
gacguggguugcacu

SEQ ID NO: 1149964 - RNA, 16 nt, Homo sapiens
gacguggguugcacug

SEQ ID NO: 1149965 - RNA, 17 nt, Homo sapiens
gacguggguugcacugg

SEQ ID NO: 1149966 - RNA, 20 nt, Homo sapiens
gacuaagccaagcuguguuc

SEQ ID NO: 1149967 - RNA, 14 nt, Homo sapiens
gacuaauuucaaaa

SEQ ID NO: 1149968 - RNA, 20 nt, Homo sapiens
gacuacauuugugaacaaaa

SEQ ID NO: 1149969 - RNA, 22 nt, Homo sapiens
gacuacauuuugcucugugaac

SEQ ID NO: 1149970 - RNA, 21 nt, Homo sapiens
gacuagagacgcaccuugcug

SEQ ID NO: 1149971 - RNA, 14 nt, Homo sapiens
gacuaucaguuccc

SEQ ID NO: 1149972 - RNA, 17 nt, Homo sapiens
gacuaugcagaggccug

SEQ ID NO: 1149973 - RNA, 22 nt, Homo sapiens
gacuauggaaugucaguguuca

SEQ ID NO: 1149974 - RNA, 18 nt, Homo sapiens
gcauugcccagucuuuca

SEQ ID NO: 1149975 - RNA, 15 nt, Homo sapiens
gcauugucugcaaug

SEQ ID NO: 1149976 - RNA, 22 nt, Homo sapiens
gcauuuauuuaagacacuguua

SEQ ID NO: 1149977 - RNA, 23 nt, Homo sapiens
gcauuuauuuaagacacuguuac

SEQ ID NO: 1149978 - RNA, 9 nt, Homo sapiens
gcauuucaa

SEQ ID NO: 1149979 - RNA, 19 nt, Homo sapiens
gcauuucacaaaacagccu

SEQ ID NO: 1149980 - RNA, 21 nt, Homo sapiens
gcauuuuccagcacuuugcaa

SEQ ID NO: 1149981 - RNA, 21 nt, Homo sapiens
gcauuuuccugccugguuucu

SEQ ID NO: 1149982 - RNA, 14 nt, Homo sapiens
gccaaaagcugcuc

SEQ ID NO: 1149983 - RNA, 13 nt, Homo sapiens
gccaaaaugcucu

SEQ ID NO: 1149984 - RNA, 13 nt, Homo sapiens
gccaacccuuuca

SEQ ID NO: 1149985 - RNA, 14 nt, Homo sapiens
gccaacccuuucau

SEQ ID NO: 1149986 - RNA, 22 nt, Homo sapiens
gccaaccgugggguuagcucua

SEQ ID NO: 1149987 - RNA, 12 nt, Homo sapiens
gccaacugaaaa

SEQ ID NO: 1149988 - RNA, 17 nt, Homo sapiens
gccaagaaaauugccuu

SEQ ID NO: 1149989 - RNA, 19 nt, Homo sapiens
gccaagaaacgucuucuaa

SEQ ID NO: 1149990 - RNA, 20 nt, Homo sapiens
gccaagagcagcugccauug

SEQ ID NO: 1149991 - RNA, 13 nt, Homo sapiens
gccaagagucacu

SEQ ID NO: 1149992 - RNA, 21 nt, Homo sapiens
gccaagaguccaggaggcccu

SEQ ID NO: 1149993 - RNA, 16 nt, Homo sapiens
gccaagauacuugaac

SEQ ID NO: 1149994 - RNA, 14 nt, Homo sapiens
gccaagcuguguuc

SEQ ID NO: 1149995 - RNA, 21 nt, Homo sapiens
gccaaggaaacccccagugua

SEQ ID NO: 1149996 - RNA, 11 nt, Homo sapiens
gccaaggagcu

SEQ ID NO: 1149997 - RNA, 17 nt, Homo sapiens
gccaaguaucuuuccag

SEQ ID NO: 1149998 - RNA, 21 nt, Homo sapiens
gccaaguggaagccacuggac

SEQ ID NO: 1149999 - RNA, 11 nt, Homo sapiens
gccaaucucaa

SEQ ID NO: 1150000 - RNA, 15 nt, Homo sapiens
gccaaucuuguuuua

SEQ ID NO: 1150001 - RNA, 14 nt, Homo sapiens
gccaauuagggggu

SEQ ID NO: 1150002 - RNA, 21 nt, Homo sapiens
gccacaaauaaguuacaucua

SEQ ID NO: 1150003 - RNA, 15 nt, Homo sapiens
gccacacacacagaa

SEQ ID NO: 1150004 - RNA, 21 nt, Homo sapiens
gccacaucugugucucuggaa

SEQ ID NO: 1150005 - RNA, 19 nt, Homo sapiens
gccacaugguguggccauc

SEQ ID NO: 1150006 - RNA, 18 nt, Homo sapiens
gccacauuuucagccaaa

SEQ ID NO: 1150007 - RNA, 22 nt, Homo sapiens
gccacccaaggaugucugccac

SEQ ID NO: 1150008 - RNA, 16 nt, Homo sapiens
gccaccgcccagagac

SEQ ID NO: 1150009 - RNA, 13 nt, Homo sapiens
gccaccucacccu

SEQ ID NO: 1150010 - RNA, 17 nt, Homo sapiens
gccaccuugccacccau

SEQ ID NO: 1150011 - RNA, 21 nt, Homo sapiens
gccacucuuagcuaaaucccu

SEQ ID NO: 1150012 - RNA, 20 nt, Homo sapiens
gccacugauauucagaauua

SEQ ID NO: 1150013 - RNA, 13 nt, Homo sapiens
gccacugcacucc

SEQ ID NO: 1150014 - RNA, 15 nt, Homo sapiens
gccacuggcuucaca

SEQ ID NO: 1150015 - RNA, 11 nt, Homo sapiens
gccacugggca

SEQ ID NO: 1150016 - RNA, 16 nt, Homo sapiens
gccacuguuugucuca

SEQ ID NO: 1150017 - RNA, 15 nt, Homo sapiens
gccacuucaccaagg

SEQ ID NO: 1150018 - RNA, 13 nt, Homo sapiens
gccagaagacucc

SEQ ID NO: 1150019 - RNA, 19 nt, Homo sapiens
gccagacaugccacaagga

SEQ ID NO: 1150020 - RNA, 17 nt, Homo sapiens
gccagacaugguggcau

SEQ ID NO: 1150021 - RNA, 18 nt, Homo sapiens
gccagacaugguggcaug

SEQ ID NO: 1150022 - RNA, 12 nt, Homo sapiens
gccagacuuccc

SEQ ID NO: 1150023 - RNA, 18 nt, Homo sapiens
gccagacuucccacggcu

SEQ ID NO: 1150024 - RNA, 21 nt, Homo sapiens
gccagagggugggaggggcca

SEQ ID NO: 1150025 - RNA, 23 nt, Homo sapiens
gccagagggugggaggggccaug

SEQ ID NO: 1150026 - RNA, 16 nt, Homo sapiens
gccagaggugcuucac

SEQ ID NO: 1150027 - RNA, 17 nt, Homo sapiens
gccagcacccaguccuc

SEQ ID NO: 1150028 - RNA, 22 nt, Homo sapiens
gccagcaguggccuuugcaauu

SEQ ID NO: 1150029 - RNA, 17 nt, Homo sapiens
gccagccggcuaugaaa

SEQ ID NO: 1150030 - RNA, 14 nt, Homo sapiens
gccagcgcugcaac

SEQ ID NO: 1150031 - RNA, 19 nt, Homo sapiens
gccagcucccucgucuuca

SEQ ID NO: 1150032 - RNA, 20 nt, Homo sapiens
gccagcucuaaaacagauug

SEQ ID NO: 1150033 - RNA, 15 nt, Homo sapiens
gccagcugcacugau

SEQ ID NO: 1150034 - RNA, 15 nt, Homo sapiens
gccaggagcugucac

SEQ ID NO: 1150035 - RNA, 21 nt, Homo sapiens
gccaggcaaaggaaauuguca

SEQ ID NO: 1150036 - RNA, 17 nt, Homo sapiens
gccaggcccccaccaca

SEQ ID NO: 1150037 - RNA, 18 nt, Homo sapiens
gccaggcugcggugggca

SEQ ID NO: 1150038 - RNA, 21 nt, Homo sapiens
gccaggcuggucucaaacucc

SEQ ID NO: 1150039 - RNA, 16 nt, Homo sapiens
gccaggcuggucuuga

SEQ ID NO: 1150040 - RNA, 14 nt, Homo sapiens
gccagggaugggca

SEQ ID NO: 1150041 - RNA, 17 nt, Homo sapiens
gccagguagcagcaaau

SEQ ID NO: 1150042 - RNA, 15 nt, Homo sapiens
gccagguguggaaca

SEQ ID NO: 1150043 - RNA, 19 nt, Homo sapiens
gccaggugugguggcucac

SEQ ID NO: 1150044 - RNA, 17 nt, Homo sapiens
gccagugaugugcggug

SEQ ID NO: 1150045 - RNA, 16 nt, Homo sapiens
gccaguuuuacuguga

SEQ ID NO: 1150046 - RNA, 22 nt, Homo sapiens
cuugcccagggccacagagcua

SEQ ID NO: 1150047 - RNA, 18 nt, Homo sapiens
cuugccugcagggccaug

SEQ ID NO: 1150048 - RNA, 16 nt, Homo sapiens
cuugcgaacuagagau

SEQ ID NO: 1150049 - RNA, 22 nt, Homo sapiens
cuugcuaucggggaagccagac

SEQ ID NO: 1150050 - RNA, 18 nt, Homo sapiens
cuugcucacagcugugcu

SEQ ID NO: 1150051 - RNA, 12 nt, Homo sapiens
cuugcucagugg

SEQ ID NO: 1150052 - RNA, 12 nt, Homo sapiens
cuugcugauaaa

SEQ ID NO: 1150053 - RNA, 15 nt, Homo sapiens
cuugcuggaccugaa

SEQ ID NO: 1150054 - RNA, 18 nt, Homo sapiens
cuugcuggguugaucuag

SEQ ID NO: 1150055 - RNA, 15 nt, Homo sapiens
cuuggaacccggugc

SEQ ID NO: 1150056 - RNA, 15 nt, Homo sapiens
cuuggaacuguccca

SEQ ID NO: 1150057 - RNA, 15 nt, Homo sapiens
cuuggagccugcaga

SEQ ID NO: 1150058 - RNA, 17 nt, Homo sapiens
cuuggaguuacaacaga

SEQ ID NO: 1150059 - RNA, 21 nt, Homo sapiens
cuuggcaccagacacccagga

SEQ ID NO: 1150060 - RNA, 15 nt, Homo sapiens
cuuggcagcaccugu

SEQ ID NO: 1150061 - RNA, 15 nt, Homo sapiens
cuuggcagcccugau

SEQ ID NO: 1150062 - RNA, 21 nt, Homo sapiens
cuuggcaucgaccacaccagc

SEQ ID NO: 1150063 - RNA, 13 nt, Homo sapiens
cuuggccaagaga

SEQ ID NO: 1150064 - RNA, 17 nt, Homo sapiens
cuuggccaagcugcugc

SEQ ID NO: 1150065 - RNA, 20 nt, Homo sapiens
cuugggacuuagaacaccgc

SEQ ID NO: 1150066 - RNA, 17 nt, Homo sapiens
cuuggggcccagugcau

SEQ ID NO: 1150067 - RNA, 15 nt, Homo sapiens
cuuggguaucaauga

SEQ ID NO: 1150068 - RNA, 17 nt, Homo sapiens
cuuggguucaagugauu

SEQ ID NO: 1150069 - RNA, 15 nt, Homo sapiens
cuugguaauuguacu

SEQ ID NO: 1150070 - RNA, 16 nt, Homo sapiens
cuugguacaguugcag

SEQ ID NO: 1150071 - RNA, 13 nt, Homo sapiens
cuugguaugugcc

SEQ ID NO: 1150072 - RNA, 15 nt, Homo sapiens
cuugguauuacccuc

SEQ ID NO: 1150073 - RNA, 16 nt, Homo sapiens
cuuggucacaugugac

SEQ ID NO: 1150074 - RNA, 22 nt, Homo sapiens
cuugguccaacugcaacucauc

SEQ ID NO: 1150075 - RNA, 21 nt, Homo sapiens
cuuggugcaaggccaucugcu

SEQ ID NO: 1150076 - RNA, 16 nt, Homo sapiens
cuugguguaguugaac

SEQ ID NO: 1150077 - RNA, 14 nt, Homo sapiens
cuugguguuuguga

SEQ ID NO: 1150078 - RNA, 22 nt, Homo sapiens
cuugguuaaaauggcuacacuc

SEQ ID NO: 1150079 - RNA, 15 nt, Homo sapiens
cuugguucucuccac

SEQ ID NO: 1150080 - RNA, 17 nt, Homo sapiens
cuugguuuucccuuugc

SEQ ID NO: 1150081 - RNA, 19 nt, Homo sapiens
cuuguaaaagacaguguau

SEQ ID NO: 1150082 - RNA, 17 nt, Homo sapiens
cuuguauuuaauacaca

SEQ ID NO: 1150083 - RNA, 15 nt, Homo sapiens
cuugucaaucccaac

SEQ ID NO: 1150084 - RNA, 18 nt, Homo sapiens
cuugucacauggaaucua

SEQ ID NO: 1150085 - RNA, 16 nt, Homo sapiens
cuugucacgaauucca

SEQ ID NO: 1150086 - RNA, 19 nt, Homo sapiens
cuugucuaacuuuugugaa

SEQ ID NO: 1150087 - RNA, 16 nt, Homo sapiens
cuugucucugguguuc

SEQ ID NO: 1150088 - RNA, 17 nt, Homo sapiens
cuugugaaguggaaaug

SEQ ID NO: 1150089 - RNA, 20 nt, Homo sapiens
cuugugacccuccaugccaa

SEQ ID NO: 1150090 - RNA, 16 nt, Homo sapiens
cuugugagaacacagc

SEQ ID NO: 1150091 - RNA, 21 nt, Homo sapiens
cuugugccuaguuaagugggu

SEQ ID NO: 1150092 - RNA, 20 nt, Homo sapiens
cuuguggucucgaugcugcu

SEQ ID NO: 1150093 - RNA, 20 nt, Homo sapiens
cuugugugauguuuuacaca

SEQ ID NO: 1150094 - RNA, 21 nt, Homo sapiens
cuuguuauuuaacccauuugu

SEQ ID NO: 1150095 - RNA, 22 nt, Homo sapiens
cuuguucagggcuuuucuuaau

SEQ ID NO: 1150096 - RNA, 18 nt, Homo sapiens
cuuguucauuuuucucuc

SEQ ID NO: 1150097 - RNA, 12 nt, Homo sapiens
cuuguugccccc

SEQ ID NO: 1150098 - RNA, 13 nt, Homo sapiens
cuuguugcucaaa

SEQ ID NO: 1150099 - RNA, 18 nt, Homo sapiens
cuuguugcuuuguugcac

SEQ ID NO: 1150100 - RNA, 17 nt, Homo sapiens
cuuguuguuauugaugu

SEQ ID NO: 1150101 - RNA, 14 nt, Homo sapiens
cuuguuucuccugc

SEQ ID NO: 1150102 - RNA, 17 nt, Homo sapiens
cuuguuugucagcaucu

SEQ ID NO: 1150103 - RNA, 12 nt, Homo sapiens
cuuguuuugcca

SEQ ID NO: 1150104 - RNA, 14 nt, Homo sapiens
cuuguuuugccagu

SEQ ID NO: 1150105 - RNA, 23 nt, Homo sapiens
cuuguuuuuccacuacugcuacc

SEQ ID NO: 1150106 - RNA, 22 nt, Homo sapiens
cuuuaaaaauaugcaccaaauc

SEQ ID NO: 1150107 - RNA, 18 nt, Homo sapiens
cuuuaaagaugauuguuc

SEQ ID NO: 1150108 - RNA, 22 nt, Homo sapiens
cuuuaaagccagucaucaucuc

SEQ ID NO: 1150109 - RNA, 14 nt, Homo sapiens
cuuuaacagucaaa

SEQ ID NO: 1150110 - RNA, 20 nt, Homo sapiens
cuuuaagccugcauucuuaa

SEQ ID NO: 1150111 - RNA, 15 nt, Homo sapiens
cuuuaaggugcuaaa

SEQ ID NO: 1150112 - RNA, 20 nt, Homo sapiens
cuuuaauauuuccaauguga

SEQ ID NO: 1150113 - RNA, 17 nt, Homo sapiens
cuuuaaucaaugugaca

SEQ ID NO: 1150114 - RNA, 16 nt, Homo sapiens
cuuuaauccaguguua

SEQ ID NO: 1150115 - RNA, 19 nt, Homo sapiens
cuuuacauggacagaauuu

SEQ ID NO: 1150116 - RNA, 17 nt, Homo sapiens
cuuuaccaaacagcaaa

SEQ ID NO: 1150117 - RNA, 23 nt, Homo sapiens
cuuuaccaaacagcaaaccaaga

SEQ ID NO: 1150118 - RNA, 14 nt, Homo sapiens
cuuuaccuuccuca

SEQ ID NO: 1150119 - RNA, 22 nt, Homo sapiens
cuuuacuaagaugacauugcua

SEQ ID NO: 1150120 - RNA, 15 nt, Homo sapiens
cuuuacuaauggugu

SEQ ID NO: 1150121 - RNA, 18 nt, Homo sapiens
cuuuacuccucacacuua

SEQ ID NO: 1150122 - RNA, 17 nt, Homo sapiens
gaacucugaauaugccu

SEQ ID NO: 1150123 - RNA, 16 nt, Homo sapiens
gaacucugcaacugaa

SEQ ID NO: 1150124 - RNA, 14 nt, Homo sapiens
gaacucugguggca

SEQ ID NO: 1150125 - RNA, 23 nt, Homo sapiens
gaacucuucuuugcugcauuccu

SEQ ID NO: 1150126 - RNA, 14 nt, Homo sapiens
gaacuggagccaug

SEQ ID NO: 1150127 - RNA, 22 nt, Homo sapiens
gaacugguucaagagacacugc

SEQ ID NO: 1150128 - RNA, 15 nt, Homo sapiens
gaacugguucuugcc

SEQ ID NO: 1150129 - RNA, 21 nt, Homo sapiens
gaacuuaccgugagcgacaaa

SEQ ID NO: 1150130 - RNA, 17 nt, Homo sapiens
gaacuucacagugacac

SEQ ID NO: 1150131 - RNA, 18 nt, Homo sapiens
gaacuucaggugugacuc

SEQ ID NO: 1150132 - RNA, 14 nt, Homo sapiens
gaacuuuaagcaac

SEQ ID NO: 1150133 - RNA, 23 nt, Homo sapiens
gaacuuugcauagcagcugcuac

SEQ ID NO: 1150134 - RNA, 22 nt, Homo sapiens
gaagaaaauagaacagcucaua

SEQ ID NO: 1150135 - RNA, 22 nt, Homo sapiens
gaagaacagauaaucccuguau

SEQ ID NO: 1150136 - RNA, 23 nt, Homo sapiens
gaagaagauaugugaagaaaaau

SEQ ID NO: 1150137 - RNA, 15 nt, Homo sapiens
gaagaagcagcguua

SEQ ID NO: 1150138 - RNA, 14 nt, Homo sapiens
gaagaaggacauuu

SEQ ID NO: 1150139 - RNA, 18 nt, Homo sapiens
gaagaaguggcugccccu

SEQ ID NO: 1150140 - RNA, 16 nt, Homo sapiens
gaagacgauguguuga

SEQ ID NO: 1150141 - RNA, 23 nt, Homo sapiens
gaagagaauauuagcuuuacugu

SEQ ID NO: 1150142 - RNA, 17 nt, Homo sapiens
gaagagagaauucuguu

SEQ ID NO: 1150143 - RNA, 17 nt, Homo sapiens
gaagagcucaagggaca

SEQ ID NO: 1150144 - RNA, 15 nt, Homo sapiens
gaagaggaggaggug

SEQ ID NO: 1150145 - RNA, 16 nt, Homo sapiens
gaagagggcugcaaau

SEQ ID NO: 1150146 - RNA, 22 nt, Homo sapiens
gaagaggggcauaaacuuuccu

SEQ ID NO: 1150147 - RNA, 21 nt, Homo sapiens
gaagaucauauacgugaaaau

SEQ ID NO: 1150148 - RNA, 17 nt, Homo sapiens
gaagaucuugauggugu

SEQ ID NO: 1150149 - RNA, 18 nt, Homo sapiens
gaagaugggcuucaucca

SEQ ID NO: 1150150 - RNA, 15 nt, Homo sapiens
gaagauguaaggaau

SEQ ID NO: 1150151 - RNA, 23 nt, Homo sapiens
gaagcaaaucagaaacuugugaa

SEQ ID NO: 1150152 - RNA, 15 nt, Homo sapiens
gaagcagcauccucc

SEQ ID NO: 1150153 - RNA, 22 nt, Homo sapiens
gaagcagucaauuuucacauca

SEQ ID NO: 1150154 - RNA, 17 nt, Homo sapiens
gaagcagucuugcucug

SEQ ID NO: 1150155 - RNA, 23 nt, Homo sapiens
gaagcauggcauauagugcccuu

SEQ ID NO: 1150156 - RNA, 14 nt, Homo sapiens
gaagccacccuccc

SEQ ID NO: 1150157 - RNA, 15 nt, Homo sapiens
gaagccaccuuccca

SEQ ID NO: 1150158 - RNA, 20 nt, Homo sapiens
gaagccacuauuacugggac

SEQ ID NO: 1150159 - RNA, 22 nt, Homo sapiens
gaagccaggcaccguggcucac

SEQ ID NO: 1150160 - RNA, 12 nt, Homo sapiens
gaagcccagcau

SEQ ID NO: 1150161 - RNA, 17 nt, Homo sapiens
gaagccuauguaugcca

SEQ ID NO: 1150162 - RNA, 18 nt, Homo sapiens
gaagccuuugccagccau

SEQ ID NO: 1150163 - RNA, 17 nt, Homo sapiens
gaagcguuguccucagc

SEQ ID NO: 1150164 - RNA, 15 nt, Homo sapiens
gaagcuacagguuac

SEQ ID NO: 1150165 - RNA, 22 nt, Homo sapiens
gaagcucaccuguugcuuacaa

SEQ ID NO: 1150166 - RNA, 15 nt, Homo sapiens
gaagcugcuagggga

SEQ ID NO: 1150167 - RNA, 11 nt, Homo sapiens
gaagcuuuguc

SEQ ID NO: 1150168 - RNA, 14 nt, Homo sapiens
gaaggaacuuccag

SEQ ID NO: 1150169 - RNA, 18 nt, Homo sapiens
gaaggaacuuugucacau

SEQ ID NO: 1150170 - RNA, 19 nt, Homo sapiens
gaaggaaggacuaugacaa

SEQ ID NO: 1150171 - RNA, 14 nt, Homo sapiens
gaaggaauggugcg

SEQ ID NO: 1150172 - RNA, 18 nt, Homo sapiens
gaaggacaaucccaggaa

SEQ ID NO: 1150173 - RNA, 14 nt, Homo sapiens
gaaggacuaugaca

SEQ ID NO: 1150174 - RNA, 15 nt, Homo sapiens
gaaggagacaggcag

SEQ ID NO: 1150175 - RNA, 23 nt, Homo sapiens
gaaggaggcuggcuuguccccuc

SEQ ID NO: 1150176 - RNA, 10 nt, Homo sapiens
gaaggccagc

SEQ ID NO: 1150177 - RNA, 19 nt, Homo sapiens
gaaggcuucaucaccaaga

SEQ ID NO: 1150178 - RNA, 16 nt, Homo sapiens
gaagggaaagcagucu

SEQ ID NO: 1150179 - RNA, 23 nt, Homo sapiens
gaagggcugauugggauuuccau

SEQ ID NO: 1150180 - RNA, 16 nt, Homo sapiens
gaaggucccucagaca

SEQ ID NO: 1150181 - RNA, 21 nt, Homo sapiens
gaaggucugucauaggacucu

SEQ ID NO: 1150182 - RNA, 15 nt, Homo sapiens
gaaggugaacuuugu

SEQ ID NO: 1150183 - RNA, 17 nt, Homo sapiens
gcuuuaaaugucugcau

SEQ ID NO: 1150184 - RNA, 14 nt, Homo sapiens
gcuuuaacuauauc

SEQ ID NO: 1150185 - RNA, 22 nt, Homo sapiens
gcuuuaaguaaaaauccaaaaa

SEQ ID NO: 1150186 - RNA, 13 nt, Homo sapiens
gcuuuaccuuuau

SEQ ID NO: 1150187 - RNA, 12 nt, Homo sapiens
gcuuuaucuacu

SEQ ID NO: 1150188 - RNA, 21 nt, Homo sapiens
gcuuucauguaaacugugcac

SEQ ID NO: 1150189 - RNA, 15 nt, Homo sapiens
gcuuucccacuuccc

SEQ ID NO: 1150190 - RNA, 20 nt, Homo sapiens
gcuuucguaguuuucauuua

SEQ ID NO: 1150191 - RNA, 15 nt, Homo sapiens
gcuuucuccauugua

SEQ ID NO: 1150192 - RNA, 14 nt, Homo sapiens
gcuuucuguugcca

SEQ ID NO: 1150193 - RNA, 16 nt, Homo sapiens
gcuuugaacgugccag

SEQ ID NO: 1150194 - RNA, 21 nt, Homo sapiens
gcuuuggcaaauaaaccuccu

SEQ ID NO: 1150195 - RNA, 18 nt, Homo sapiens
gcuuugugccaucacuga

SEQ ID NO: 1150196 - RNA, 15 nt, Homo sapiens
gcuuuguggcacugg

SEQ ID NO: 1150197 - RNA, 19 nt, Homo sapiens
gcuuuuaagagcaauguuu

SEQ ID NO: 1150198 - RNA, 20 nt, Homo sapiens
gcuuuuaauugacagucacu

SEQ ID NO: 1150199 - RNA, 16 nt, Homo sapiens
gcuuuuaccugugcac

SEQ ID NO: 1150200 - RNA, 19 nt, Homo sapiens
gcuuuuacugaagccuuuc

SEQ ID NO: 1150201 - RNA, 17 nt, Homo sapiens
gcuuuuauccacuggca

SEQ ID NO: 1150202 - RNA, 18 nt, Homo sapiens
gcuuuucagccaauuugu

SEQ ID NO: 1150203 - RNA, 20 nt, Homo sapiens
gcuuuucuuuggacaacagg

SEQ ID NO: 1150204 - RNA, 17 nt, Homo sapiens
gcuuuugcuugcaaugu

SEQ ID NO: 1150205 - RNA, 15 nt, Homo sapiens
gcuuuuucaguugaa

SEQ ID NO: 1150206 - RNA, 23 nt, Homo sapiens
gcuuuuuuuuuuuuuaacugacg

SEQ ID NO: 1150207 - RNA, 18 nt, Homo sapiens
ggaaaaaaacaguugcau

SEQ ID NO: 1150208 - RNA, 16 nt, Homo sapiens
ggaaaaaaacuauuaa

SEQ ID NO: 1150209 - RNA, 18 nt, Homo sapiens
ggaaaaaaauggggaaaa

SEQ ID NO: 1150210 - RNA, 15 nt, Homo sapiens
ggaaaacaagcauuc

SEQ ID NO: 1150211 - RNA, 16 nt, Homo sapiens
ggaaaacccaggguga

SEQ ID NO: 1150212 - RNA, 21 nt, Homo sapiens
ggaaaacuauuccauguuuua

SEQ ID NO: 1150213 - RNA, 14 nt, Homo sapiens
ggaaacaacagcuu

SEQ ID NO: 1150214 - RNA, 15 nt, Homo sapiens
ggaaacacugccuuu

SEQ ID NO: 1150215 - RNA, 19 nt, Homo sapiens
ggaaaccaagucaggccag

SEQ ID NO: 1150216 - RNA, 16 nt, Homo sapiens
ggaaacccagcucaca

SEQ ID NO: 1150217 - RNA, 19 nt, Homo sapiens
ggaaacuaguguacauuuc

SEQ ID NO: 1150218 - RNA, 13 nt, Homo sapiens
ggaaacuugucac

SEQ ID NO: 1150219 - RNA, 20 nt, Homo sapiens
ggaaacuugucacuugcaug

SEQ ID NO: 1150220 - RNA, 16 nt, Homo sapiens
ggaaagaacugucaug

SEQ ID NO: 1150221 - RNA, 14 nt, Homo sapiens
ggaaagauuacuuu

SEQ ID NO: 1150222 - RNA, 17 nt, Homo sapiens
ggaaaggggcaggccag

SEQ ID NO: 1150223 - RNA, 20 nt, Homo sapiens
ggaaagucgugucugucaga

SEQ ID NO: 1150224 - RNA, 19 nt, Homo sapiens
ggaaagucucucuucugaa

SEQ ID NO: 1150225 - RNA, 17 nt, Homo sapiens
ggaaaguguaaagcauu

SEQ ID NO: 1150226 - RNA, 17 nt, Homo sapiens
ggaaaugaguggccagc

SEQ ID NO: 1150227 - RNA, 15 nt, Homo sapiens
ggaacacccccauga

SEQ ID NO: 1150228 - RNA, 23 nt, Homo sapiens
ggaacacggccacaucaaagagg

SEQ ID NO: 1150229 - RNA, 16 nt, Homo sapiens
ggaacacugaaacugu

SEQ ID NO: 1150230 - RNA, 12 nt, Homo sapiens
ggaacacugccc

SEQ ID NO: 1150231 - RNA, 21 nt, Homo sapiens
ggaacagugaaucagucccau

SEQ ID NO: 1150232 - RNA, 20 nt, Homo sapiens
ggaaccacaccacaucuaag

SEQ ID NO: 1150233 - RNA, 19 nt, Homo sapiens
ggaaccguaggacccaagc

SEQ ID NO: 1150234 - RNA, 20 nt, Homo sapiens
ggaaccucagccuggccaga

SEQ ID NO: 1150235 - RNA, 23 nt, Homo sapiens
ggaacugccuuauuaaagcaaaa

SEQ ID NO: 1150236 - RNA, 16 nt, Homo sapiens
ggaacugguucaagag

SEQ ID NO: 1150237 - RNA, 17 nt, Homo sapiens
ggaacugguucaagaga

SEQ ID NO: 1150238 - RNA, 22 nt, Homo sapiens
ggaacugguucaagagacacug

SEQ ID NO: 1150239 - RNA, 20 nt, Homo sapiens
ggaacuuugaagaguacaaa

SEQ ID NO: 1150240 - RNA, 19 nt, Homo sapiens
ggaacuuuuauuacugggg

SEQ ID NO: 1150241 - RNA, 19 nt, Homo sapiens
ggaagaaaucuggucuaau

SEQ ID NO: 1150242 - RNA, 17 nt, Homo sapiens
ggaagagggugauugcu

SEQ ID NO: 1150243 - RNA, 12 nt, Homo sapiens
ggaagagguggc

SEQ ID NO: 1150244 - RNA, 23 nt, Homo sapiens
ggaagauagaauucaauuugaac

SEQ ID NO: 1150245 - RNA, 15 nt, Homo sapiens
ggaagcaacguguua

SEQ ID NO: 1150246 - RNA, 21 nt, Homo sapiens
ggaagccacccucccagcucu

SEQ ID NO: 1150247 - RNA, 15 nt, Homo sapiens
ggaagcgauuacuuu

SEQ ID NO: 1150248 - RNA, 13 nt, Homo sapiens
ggaagcugccucc

SEQ ID NO: 1150249 - RNA, 13 nt, Homo sapiens
ggaaggacaaaua

SEQ ID NO: 1150250 - RNA, 14 nt, Homo sapiens
ggaaggacuaugac

SEQ ID NO: 1150251 - RNA, 19 nt, Homo sapiens
ggaagggccuacagcccau

SEQ ID NO: 1150252 - RNA, 21 nt, Homo sapiens
ggaaggguggauugauguuua

SEQ ID NO: 1150253 - RNA, 14 nt, Homo sapiens
ggaagguacuuuaa

SEQ ID NO: 1150254 - RNA, 19 nt, Homo sapiens
ggaaggucccuuguuucca

SEQ ID NO: 1150255 - RNA, 16 nt, Homo sapiens
ggaaggugccacuggu

SEQ ID NO: 1150256 - RNA, 17 nt, Homo sapiens
ggaagucuaaauauuca

SEQ ID NO: 1150257 - RNA, 20 nt, Homo sapiens
ggaagugugucaaaucaaua

SEQ ID NO: 1150258 - RNA, 22 nt, Homo sapiens
ggaauaauccuaaacauaugaa

SEQ ID NO: 1150259 - RNA, 12 nt, Homo sapiens
ggaauaaucucc

SEQ ID NO: 1150260 - RNA, 21 nt, Homo sapiens
ggaauauaaggaaagcaauaa

SEQ ID NO: 1150261 - RNA, 16 nt, Homo sapiens
ggaaucuacaacuguu

SEQ ID NO: 1150262 - RNA, 13 nt, Homo sapiens
ggaaucugaugaa

SEQ ID NO: 1150263 - RNA, 21 nt, Homo sapiens
ggaaugcugggcuguuuacuu

SEQ ID NO: 1150264 - RNA, 16 nt, Homo sapiens
ggaauuaagcaaaauc

SEQ ID NO: 1150265 - RNA, 18 nt, Homo sapiens
ggaauucuuuacaauaaa

SEQ ID NO: 1150266 - RNA, 14 nt, Homo sapiens
ggaauugguguaua

SEQ ID NO: 1150267 - RNA, 23 nt, Homo sapiens
ucuuuucucuacuccaugguucu

SEQ ID NO: 1150268 - RNA, 21 nt, Homo sapiens
ucuuuugggggucaacaguuu

SEQ ID NO: 1150269 - RNA, 20 nt, Homo sapiens
ucuuuuuccaucccuagcca

SEQ ID NO: 1150270 - RNA, 13 nt, Homo sapiens
ugaaaaaaagcuu

SEQ ID NO: 1150271 - RNA, 23 nt, Homo sapiens
ugaaaaaguauaaauaaaaugag

SEQ ID NO: 1150272 - RNA, 15 nt, Homo sapiens
ugaaaaaucauccaa

SEQ ID NO: 1150273 - RNA, 14 nt, Homo sapiens
ugaaaacaauguaa

SEQ ID NO: 1150274 - RNA, 16 nt, Homo sapiens
ugaaaacacugugcac

SEQ ID NO: 1150275 - RNA, 12 nt, Homo sapiens
ugaaaacagaua

SEQ ID NO: 1150276 - RNA, 15 nt, Homo sapiens
ugaaaacagugauuu

SEQ ID NO: 1150277 - RNA, 21 nt, Homo sapiens
ugaaaacauauaaagcacuau

SEQ ID NO: 1150278 - RNA, 24 nt, Homo sapiens
ugaaaacucagaagaaagcucaga

SEQ ID NO: 1150279 - RNA, 22 nt, Homo sapiens
ugaaaagcagauugcagaaaua

SEQ ID NO: 1150280 - RNA, 23 nt, Homo sapiens
ugaaaaggauauuaucuaccugu

SEQ ID NO: 1150281 - RNA, 19 nt, Homo sapiens
ugaaaagggaugauguggu

SEQ ID NO: 1150282 - RNA, 18 nt, Homo sapiens
ugaaaauaauuguuccaa

SEQ ID NO: 1150283 - RNA, 19 nt, Homo sapiens
ugaaaauauuuuguugccu

SEQ ID NO: 1150284 - RNA, 18 nt, Homo sapiens
ugaaaaugcaucacauga

SEQ ID NO: 1150285 - RNA, 15 nt, Homo sapiens
ugaaacagcugccuu

SEQ ID NO: 1150286 - RNA, 21 nt, Homo sapiens
ugaaaccaacucuugcucuca

SEQ ID NO: 1150287 - RNA, 13 nt, Homo sapiens
ugaaacccaguca

SEQ ID NO: 1150288 - RNA, 15 nt, Homo sapiens
ugaaaccccgucucu

SEQ ID NO: 1150289 - RNA, 22 nt, Homo sapiens
ugaaacccuggaccaguggucu

SEQ ID NO: 1150290 - RNA, 15 nt, Homo sapiens
ugaaacccugucuug

SEQ ID NO: 1150291 - RNA, 20 nt, Homo sapiens
ugaaaccguaucucuaauaa

SEQ ID NO: 1150292 - RNA, 15 nt, Homo sapiens
ugaaaccgucccuga

SEQ ID NO: 1150293 - RNA, 18 nt, Homo sapiens
ugaaaccuacacacuguc

SEQ ID NO: 1150294 - RNA, 23 nt, Homo sapiens
ugaaaccuuaguuucaagagucu

SEQ ID NO: 1150295 - RNA, 20 nt, Homo sapiens
ugaaacuauuuacaaugugu

SEQ ID NO: 1150296 - RNA, 12 nt, Homo sapiens
ugaaacuugaaa

SEQ ID NO: 1150297 - RNA, 18 nt, Homo sapiens
ugaaacuugugucauuga

SEQ ID NO: 1150298 - RNA, 15 nt, Homo sapiens
ugaaagaaaauaacg

SEQ ID NO: 1150299 - RNA, 15 nt, Homo sapiens
ugaaagaaauuugau

SEQ ID NO: 1150300 - RNA, 22 nt, Homo sapiens
ugaaagaggacguguuacccac

SEQ ID NO: 1150301 - RNA, 20 nt, Homo sapiens
ugaaagaguaaaggaaauga

SEQ ID NO: 1150302 - RNA, 18 nt, Homo sapiens
ugaaagauuccacagaga

SEQ ID NO: 1150303 - RNA, 20 nt, Homo sapiens
ugaaagcaaaaaugcuaaua

SEQ ID NO: 1150304 - RNA, 15 nt, Homo sapiens
ugaaagcaguagcau

SEQ ID NO: 1150305 - RNA, 20 nt, Homo sapiens
ugaaaggacaguuaaguauu

SEQ ID NO: 1150306 - RNA, 22 nt, Homo sapiens
ugaaaggguuuuuaaucuccau

SEQ ID NO: 1150307 - RNA, 14 nt, Homo sapiens
ugaaaguuaaucca

SEQ ID NO: 1150308 - RNA, 19 nt, Homo sapiens
ugaaaguuuuuaauucaua

SEQ ID NO: 1150309 - RNA, 14 nt, Homo sapiens
ugaaauacugucua

SEQ ID NO: 1150310 - RNA, 15 nt, Homo sapiens
ugaaauagacuguga

SEQ ID NO: 1150311 - RNA, 14 nt, Homo sapiens
ugaaaucucaggaa

SEQ ID NO: 1150312 - RNA, 15 nt, Homo sapiens
ugaaaucucaggaau

SEQ ID NO: 1150313 - RNA, 16 nt, Homo sapiens
ugaaaucuguaucugu

SEQ ID NO: 1150314 - RNA, 22 nt, Homo sapiens
ugaaaugauagauuugaccucc

SEQ ID NO: 1150315 - RNA, 11 nt, Homo sapiens
ugaaauggagu

SEQ ID NO: 1150316 - RNA, 16 nt, Homo sapiens
ugaaauuaaaugccac

SEQ ID NO: 1150317 - RNA, 17 nt, Homo sapiens
ugaaauuaagaaggcaa

SEQ ID NO: 1150318 - RNA, 12 nt, Homo sapiens
ugaaauuacuua

SEQ ID NO: 1150319 - RNA, 16 nt, Homo sapiens
ugaaauuagggcccaa

SEQ ID NO: 1150320 - RNA, 15 nt, Homo sapiens
ugaaauuauaaucug

SEQ ID NO: 1150321 - RNA, 19 nt, Homo sapiens
ugaaauucugaauuugcaa

SEQ ID NO: 1150322 - RNA, 20 nt, Homo sapiens
ugaacaauuaugaacaucca

SEQ ID NO: 1150323 - RNA, 20 nt, Homo sapiens
ugaacacucuuuugcuuuau

SEQ ID NO: 1150324 - RNA, 12 nt, Homo sapiens
ugaacacuggag

SEQ ID NO: 1150325 - RNA, 14 nt, Homo sapiens
ugaacauagggaca

SEQ ID NO: 1150326 - RNA, 17 nt, Homo sapiens
ugaacaucuggcccaag

SEQ ID NO: 1150327 - RNA, 11 nt, Homo sapiens
ugaaccaaauu

SEQ ID NO: 1150328 - RNA, 12 nt, Homo sapiens
ugaaccauaaag

SEQ ID NO: 1150329 - RNA, 19 nt, Homo sapiens
ugaaccauuauagccucag

SEQ ID NO: 1150330 - RNA, 24 nt, Homo sapiens
ugaacuaaauuuaagcuuaagcca

SEQ ID NO: 1150331 - RNA, 16 nt, Homo sapiens
ugaacuagccaaucag

SEQ ID NO: 1150332 - RNA, 23 nt, Homo sapiens
ugaacucuccccuccccaucugu

SEQ ID NO: 1150333 - RNA, 18 nt, Homo sapiens
ugaacuggcuuguacauu

SEQ ID NO: 1150334 - RNA, 15 nt, Homo sapiens
ugaacuuacacugua

SEQ ID NO: 1150335 - RNA, 13 nt, Homo sapiens
ugaacuucaccug

SEQ ID NO: 1150336 - RNA, 12 nt, Homo sapiens
ugaagaaaggga

SEQ ID NO: 1150337 - RNA, 20 nt, Homo sapiens
ugaagaagcaaacaugacua

SEQ ID NO: 1150338 - RNA, 20 nt, Homo sapiens
ugaagaauauaccauuucaa

SEQ ID NO: 1150339 - RNA, 11 nt, Homo sapiens
ugaagacauaa

SEQ ID NO: 1150340 - RNA, 14 nt, Homo sapiens
ugaagaccuggacu

SEQ ID NO: 1150341 - RNA, 22 nt, Homo sapiens
ugaagaccuggacuauugaaug

SEQ ID NO: 1150342 - RNA, 20 nt, Homo sapiens
ugaagacuuuuaaguuuccu

SEQ ID NO: 1150343 - RNA, 15 nt, Homo sapiens
ugaagagcuauuaua

SEQ ID NO: 1150344 - RNA, 15 nt, Homo sapiens
ugaagaguccucuga

SEQ ID NO: 1150345 - RNA, 19 nt, Homo sapiens
ugaagaguccucugaauga

SEQ ID NO: 1150346 - RNA, 19 nt, Homo sapiens
ugaagaucauauacgugaa

SEQ ID NO: 1150347 - RNA, 16 nt, Homo sapiens
ugaagcaaaucagaaa

SEQ ID NO: 1150348 - RNA, 23 nt, Homo sapiens
ugaagcaaaucagaaacuuguga

SEQ ID NO: 1150349 - RNA, 20 nt, Homo sapiens
ugaagcaacagagaggaaau

SEQ ID NO: 1150350 - RNA, 20 nt, Homo sapiens
ugaagcaagcuguguuacuu

SEQ ID NO: 1150351 - RNA, 22 nt, Homo sapiens
ugaagcagcucugccuucuuag

SEQ ID NO: 1150352 - RNA, 15 nt, Homo sapiens
ugaagcagucuugcu

SEQ ID NO: 1150353 - RNA, 16 nt, Homo sapiens
ugaagcagucuugcuc

SEQ ID NO: 1150354 - RNA, 21 nt, Homo sapiens
ugaagccaauucagacaggca

SEQ ID NO: 1150355 - RNA, 14 nt, Homo sapiens
ugaagccugcaugu

SEQ ID NO: 1150356 - RNA, 18 nt, Homo sapiens
ugaagcgaacaucuucau

SEQ ID NO: 1150357 - RNA, 14 nt, Homo sapiens
ugaagcugaggcuc

SEQ ID NO: 1150358 - RNA, 22 nt, Homo sapiens
ugaagcugcuguaacuaaagga

SEQ ID NO: 1150359 - RNA, 17 nt, Homo sapiens
ugaaggaaggacuauga

SEQ ID NO: 1150360 - RNA, 18 nt, Homo sapiens
uacuccuuuuaagcagug

SEQ ID NO: 1150361 - RNA, 20 nt, Homo sapiens
uacucgggaggcugaggcag

SEQ ID NO: 1150362 - RNA, 22 nt, Homo sapiens
uacucugaagggcaucaugcau

SEQ ID NO: 1150363 - RNA, 15 nt, Homo sapiens
uacucuuaucugggu

SEQ ID NO: 1150364 - RNA, 15 nt, Homo sapiens
uacucuuuguagcaa

SEQ ID NO: 1150365 - RNA, 23 nt, Homo sapiens
uacugaaacuauuuacaaugugu

SEQ ID NO: 1150366 - RNA, 15 nt, Homo sapiens
uacugaaaucuugua

SEQ ID NO: 1150367 - RNA, 21 nt, Homo sapiens
uacugaagucuuacuacagaa

SEQ ID NO: 1150368 - RNA, 13 nt, Homo sapiens
uacugacugauga

SEQ ID NO: 1150369 - RNA, 19 nt, Homo sapiens
uacugacuuggaucccaaa

SEQ ID NO: 1150370 - RNA, 18 nt, Homo sapiens
uacugaguagggggagca

SEQ ID NO: 1150371 - RNA, 15 nt, Homo sapiens
uacugauucacugca

SEQ ID NO: 1150372 - RNA, 16 nt, Homo sapiens
uacugauucacugcau

SEQ ID NO: 1150373 - RNA, 21 nt, Homo sapiens
uacugcaagguucaacuuauu

SEQ ID NO: 1150374 - RNA, 17 nt, Homo sapiens
uacugcuugaccaaaga

SEQ ID NO: 1150375 - RNA, 16 nt, Homo sapiens
uacuggagagauuuaa

SEQ ID NO: 1150376 - RNA, 17 nt, Homo sapiens
uacugggacugugcuca

SEQ ID NO: 1150377 - RNA, 17 nt, Homo sapiens
uacuggucccuuccuuu

SEQ ID NO: 1150378 - RNA, 14 nt, Homo sapiens
uacuggugcaguca

SEQ ID NO: 1150379 - RNA, 16 nt, Homo sapiens
uacugucuaagcaguu

SEQ ID NO: 1150380 - RNA, 19 nt, Homo sapiens
uacugugagcuuacauuga

SEQ ID NO: 1150381 - RNA, 19 nt, Homo sapiens
uacuguuacugugucagga

SEQ ID NO: 1150382 - RNA, 21 nt, Homo sapiens
uacuguucacacacacaguuu

SEQ ID NO: 1150383 - RNA, 15 nt, Homo sapiens
uacuuacuuuuccaa

SEQ ID NO: 1150384 - RNA, 16 nt, Homo sapiens
uacuuagacaguaugc

SEQ ID NO: 1150385 - RNA, 14 nt, Homo sapiens
uacuuagcuggcca

SEQ ID NO: 1150386 - RNA, 16 nt, Homo sapiens
uacuucaaacugagau

SEQ ID NO: 1150387 - RNA, 18 nt, Homo sapiens
uacuuccagcaaaaucca

SEQ ID NO: 1150388 - RNA, 23 nt, Homo sapiens
uacuucugugucugucaccacau

SEQ ID NO: 1150389 - RNA, 23 nt, Homo sapiens
uacuugaaggucuaggugcuuua

SEQ ID NO: 1150390 - RNA, 14 nt, Homo sapiens
uacuugccaagaaa

SEQ ID NO: 1150391 - RNA, 20 nt, Homo sapiens
uacuugccagaaguugugga

SEQ ID NO: 1150392 - RNA, 20 nt, Homo sapiens
uacuugcuuauuacauuuaa

SEQ ID NO: 1150393 - RNA, 20 nt, Homo sapiens
uacuuguagaguggugcugc

SEQ ID NO: 1150394 - RNA, 14 nt, Homo sapiens
uacuuuauugcccu

SEQ ID NO: 1150395 - RNA, 20 nt, Homo sapiens
uacuuuauuucugaucuaua

SEQ ID NO: 1150396 - RNA, 22 nt, Homo sapiens
uacuuuauuucugaucuauaca

SEQ ID NO: 1150397 - RNA, 21 nt, Homo sapiens
uacuuugaagucauaccaaug

SEQ ID NO: 1150398 - RNA, 15 nt, Homo sapiens
uacuuuguuaggauu

SEQ ID NO: 1150399 - RNA, 18 nt, Homo sapiens
uacuuuuaugcaaccaua

SEQ ID NO: 1150400 - RNA, 21 nt, Homo sapiens
uacuuuugcccuuugauuaaa

SEQ ID NO: 1150401 - RNA, 15 nt, Homo sapiens
uacuuuuuaguaauu

SEQ ID NO: 1150402 - RNA, 15 nt, Homo sapiens
uagaaaagcacuuga

SEQ ID NO: 1150403 - RNA, 20 nt, Homo sapiens
uagaaagaaacugcucuaau

SEQ ID NO: 1150404 - RNA, 16 nt, Homo sapiens
uagaaagccaugugcu

SEQ ID NO: 1150405 - RNA, 12 nt, Homo sapiens
uagaaaggacgu

SEQ ID NO: 1150406 - RNA, 14 nt, Homo sapiens
uagaaaguucaaaa

SEQ ID NO: 1150407 - RNA, 13 nt, Homo sapiens
uagaaaucagcua

SEQ ID NO: 1150408 - RNA, 11 nt, Homo sapiens
uagaaaugcca

SEQ ID NO: 1150409 - RNA, 22 nt, Homo sapiens
uagaaauguauuuugaaaacac

SEQ ID NO: 1150410 - RNA, 19 nt, Homo sapiens
uagaaauugggcagucuua

SEQ ID NO: 1150411 - RNA, 15 nt, Homo sapiens
uagaacgacauguua

SEQ ID NO: 1150412 - RNA, 22 nt, Homo sapiens
uagaacgagccuggaagcacua

SEQ ID NO: 1150413 - RNA, 13 nt, Homo sapiens
uagaacugccugg

SEQ ID NO: 1150414 - RNA, 12 nt, Homo sapiens
uagaacuugaga

SEQ ID NO: 1150415 - RNA, 21 nt, Homo sapiens
uagaagccacuauuacuggga

SEQ ID NO: 1150416 - RNA, 22 nt, Homo sapiens
uagaagccacuauuacugggac

SEQ ID NO: 1150417 - RNA, 19 nt, Homo sapiens
uagaagccuaauugucaca

SEQ ID NO: 1150418 - RNA, 22 nt, Homo sapiens
uagaagcugucugcguuuacuc

SEQ ID NO: 1150419 - RNA, 21 nt, Homo sapiens
uagaauagccuguggccuuug

SEQ ID NO: 1150420 - RNA, 21 nt, Homo sapiens
uagaauauuuuaagaauuuca

SEQ ID NO: 1150421 - RNA, 18 nt, Homo sapiens
uagaauccugcuuuacag

SEQ ID NO: 1150422 - RNA, 17 nt, Homo sapiens
uagaaucugaguauaaa

SEQ ID NO: 1150423 - RNA, 15 nt, Homo sapiens
uagaaugaaagacug

SEQ ID NO: 1150424 - RNA, 11 nt, Homo sapiens
uagaauggugc

SEQ ID NO: 1150425 - RNA, 12 nt, Homo sapiens
uagaaugugauu

SEQ ID NO: 1150426 - RNA, 16 nt, Homo sapiens
uagaauucuagcuuuu

SEQ ID NO: 1150427 - RNA, 20 nt, Homo sapiens
uagaauugaauuuacauaua

SEQ ID NO: 1150428 - RNA, 21 nt, Homo sapiens
uagaauugaauuuacauauag

SEQ ID NO: 1150429 - RNA, 15 nt, Homo sapiens
uagaauugauuucca

SEQ ID NO: 1150430 - RNA, 20 nt, Homo sapiens
uagaauuugagcaucaguga

SEQ ID NO: 1150431 - RNA, 21 nt, Homo sapiens
uagacaaauacucauguguau

SEQ ID NO: 1150432 - RNA, 22 nt, Homo sapiens
uagacaccuucauuuugagggg

SEQ ID NO: 1150433 - RNA, 19 nt, Homo sapiens
uagacacuacaacauaugg

SEQ ID NO: 1150434 - RNA, 12 nt, Homo sapiens
uagacauugcaa

SEQ ID NO: 1150435 - RNA, 23 nt, Homo sapiens
uagacccgaggaaacucagaguc

SEQ ID NO: 1150436 - RNA, 20 nt, Homo sapiens
uagacucaugguguguuaca

SEQ ID NO: 1150437 - RNA, 15 nt, Homo sapiens
uagacucauucuuca

SEQ ID NO: 1150438 - RNA, 16 nt, Homo sapiens
uagacugaaaagccau

SEQ ID NO: 1150439 - RNA, 19 nt, Homo sapiens
uagacuuaucugcauauug

SEQ ID NO: 1150440 - RNA, 19 nt, Homo sapiens
uagagacagugaugccugc

SEQ ID NO: 1150441 - RNA, 14 nt, Homo sapiens
uagagcaacaguaa

SEQ ID NO: 1150442 - RNA, 15 nt, Homo sapiens
uagagcagugcacau

SEQ ID NO: 1150443 - RNA, 22 nt, Homo sapiens
uagagcauuaaaauaacuauca

SEQ ID NO: 1150444 - RNA, 15 nt, Homo sapiens
uagagcuguucaaca

SEQ ID NO: 1150445 - RNA, 18 nt, Homo sapiens
uagagggauuucuuugcu

SEQ ID NO: 1150446 - RNA, 20 nt, Homo sapiens
uagagugccuccaggguggu

SEQ ID NO: 1150447 - RNA, 14 nt, Homo sapiens
uagaguggugcugc

SEQ ID NO: 1150448 - RNA, 23 nt, Homo sapiens
uagaguuuggaaucccacuaaug

SEQ ID NO: 1150449 - RNA, 18 nt, Homo sapiens
uagauauggaguggaggu

SEQ ID NO: 1150450 - RNA, 20 nt, Homo sapiens
uagauauuucaugugcuaua

SEQ ID NO: 1150451 - RNA, 14 nt, Homo sapiens
uagaugauguauuu

SEQ ID NO: 1150452 - RNA, 22 nt, Homo sapiens
uagaugauuaaauaagauucua

SEQ ID NO: 1150453 - RNA, 21 nt, Homo sapiens
uagauguugccauguguuuua

SEQ ID NO: 1150454 - RNA, 14 nt, Homo sapiens
uagauugaugugca

SEQ ID NO: 1150455 - RNA, 19 nt, Homo sapiens
uagauugaugugcacugca

SEQ ID NO: 1150456 - RNA, 21 nt, Homo sapiens
uagauuucuauaggauuuuuc

SEQ ID NO: 1150457 - RNA, 21 nt, Homo sapiens
uagauuuuuucagacuuguca

SEQ ID NO: 1150458 - RNA, 14 nt, Homo sapiens
uagcaaacuuugua

SEQ ID NO: 1150459 - RNA, 20 nt, Homo sapiens
uagcaaacuuuguaugucau

SEQ ID NO: 1150460 - RNA, 21 nt, Homo sapiens
uagcaaacuuuguaugucauu

SEQ ID NO: 1150461 - RNA, 19 nt, Homo sapiens
uagcaaauaguaaucugua

SEQ ID NO: 1150462 - RNA, 14 nt, Homo sapiens
uagcaagugcuauu

SEQ ID NO: 1150463 - RNA, 15 nt, Homo sapiens
uagcaccauuaacuc

SEQ ID NO: 1150464 - RNA, 21 nt, Homo sapiens
uagcaccuuuucuccucuuug

SEQ ID NO: 1150465 - RNA, 22 nt, Homo sapiens
ucuccagcauucucagccacaa

SEQ ID NO: 1150466 - RNA, 22 nt, Homo sapiens
ucuccagccaucaagagacuga

SEQ ID NO: 1150467 - RNA, 17 nt, Homo sapiens
ucuccagcccugcagcu

SEQ ID NO: 1150468 - RNA, 21 nt, Homo sapiens
ucuccagccugggaggcacag

SEQ ID NO: 1150469 - RNA, 17 nt, Homo sapiens
ucuccaucacaaccaga

SEQ ID NO: 1150470 - RNA, 16 nt, Homo sapiens
ucucccagcucagggc

SEQ ID NO: 1150471 - RNA, 20 nt, Homo sapiens
ucuccccugaccugugagcc

SEQ ID NO: 1150472 - RNA, 15 nt, Homo sapiens
ucucccgugagccag

SEQ ID NO: 1150473 - RNA, 12 nt, Homo sapiens
ucucccuaccuu

SEQ ID NO: 1150474 - RNA, 16 nt, Homo sapiens
ucucccuccucugccc

SEQ ID NO: 1150475 - RNA, 13 nt, Homo sapiens
ucucccugacccu

SEQ ID NO: 1150476 - RNA, 12 nt, Homo sapiens
ucucccuuccac

SEQ ID NO: 1150477 - RNA, 16 nt, Homo sapiens
ucuccgcacuuggaaa

SEQ ID NO: 1150478 - RNA, 14 nt, Homo sapiens
ucuccuaauucugc

SEQ ID NO: 1150479 - RNA, 18 nt, Homo sapiens
ucuccuaggaucccccca

SEQ ID NO: 1150480 - RNA, 14 nt, Homo sapiens
ucuccucugcagcu

SEQ ID NO: 1150481 - RNA, 13 nt, Homo sapiens
ucuccucuuguaa

SEQ ID NO: 1150482 - RNA, 14 nt, Homo sapiens
ucuccucuuugaac

SEQ ID NO: 1150483 - RNA, 17 nt, Homo sapiens
ucuccugaccucgugau

SEQ ID NO: 1150484 - RNA, 19 nt, Homo sapiens
ucuccugccuuugccucca

SEQ ID NO: 1150485 - RNA, 23 nt, Homo sapiens
ucuccugucugaaccugcccuua

SEQ ID NO: 1150486 - RNA, 19 nt, Homo sapiens
ucuccuucaaaacauucuc

SEQ ID NO: 1150487 - RNA, 16 nt, Homo sapiens
ucuccuuggaggacag

SEQ ID NO: 1150488 - RNA, 15 nt, Homo sapiens
ucuccuuuacuaaau

SEQ ID NO: 1150489 - RNA, 19 nt, Homo sapiens
ucucgaacuccuaaccuca

SEQ ID NO: 1150490 - RNA, 19 nt, Homo sapiens
ucucggggaugcauagauu

SEQ ID NO: 1150491 - RNA, 19 nt, Homo sapiens
ucucgguugaaaccuguau

SEQ ID NO: 1150492 - RNA, 15 nt, Homo sapiens
ucucuaaaccaucua

SEQ ID NO: 1150493 - RNA, 20 nt, Homo sapiens
ucucuaacauaugauacuga

SEQ ID NO: 1150494 - RNA, 13 nt, Homo sapiens
ucucuacccagua

SEQ ID NO: 1150495 - RNA, 11 nt, Homo sapiens
ucucuaguucc

SEQ ID NO: 1150496 - RNA, 20 nt, Homo sapiens
ucucuaucggggucacuugc

SEQ ID NO: 1150497 - RNA, 21 nt, Homo sapiens
ucucuaucggggucacuugca

SEQ ID NO: 1150498 - RNA, 15 nt, Homo sapiens
ucucuaugugaauau

SEQ ID NO: 1150499 - RNA, 22 nt, Homo sapiens
ucucuauuauguuaucauccuc

SEQ ID NO: 1150500 - RNA, 17 nt, Homo sapiens
ucucucacggcuuguaa

SEQ ID NO: 1150501 - RNA, 17 nt, Homo sapiens
ucucuccaccagguucu

SEQ ID NO: 1150502 - RNA, 21 nt, Homo sapiens
ucucucccugccucacaucuc

SEQ ID NO: 1150503 - RNA, 18 nt, Homo sapiens
ucucucuugucacaugga

SEQ ID NO: 1150504 - RNA, 19 nt, Homo sapiens
ucucucuuucccuuuggca

SEQ ID NO: 1150505 - RNA, 17 nt, Homo sapiens
ucucugaauuugagaua

SEQ ID NO: 1150506 - RNA, 19 nt, Homo sapiens
ucucugagcagugaaugau

SEQ ID NO: 1150507 - RNA, 11 nt, Homo sapiens
ucucugcaaau

SEQ ID NO: 1150508 - RNA, 21 nt, Homo sapiens
ucucugcagggccgccaggga

SEQ ID NO: 1150509 - RNA, 12 nt, Homo sapiens
ucucugcuccag

SEQ ID NO: 1150510 - RNA, 13 nt, Homo sapiens
ucucuggaguauu

SEQ ID NO: 1150511 - RNA, 14 nt, Homo sapiens
ucucuggaguauuc

SEQ ID NO: 1150512 - RNA, 23 nt, Homo sapiens
ucucuggccuguacccaguagau

SEQ ID NO: 1150513 - RNA, 17 nt, Homo sapiens
ucucuggcucuugucca

SEQ ID NO: 1150514 - RNA, 11 nt, Homo sapiens
ucucugggcug

SEQ ID NO: 1150515 - RNA, 15 nt, Homo sapiens
ucucugguuguccuc

SEQ ID NO: 1150516 - RNA, 15 nt, Homo sapiens
ucucuguacacugcc

SEQ ID NO: 1150517 - RNA, 19 nt, Homo sapiens
ucucugucagugugaaaau

SEQ ID NO: 1150518 - RNA, 19 nt, Homo sapiens
ucucugucccuugcuguau

SEQ ID NO: 1150519 - RNA, 16 nt, Homo sapiens
ucucugugcaaggaug

SEQ ID NO: 1150520 - RNA, 11 nt, Homo sapiens
ucucugugcau

SEQ ID NO: 1150521 - RNA, 11 nt, Homo sapiens
ucucuguguau

SEQ ID NO: 1150522 - RNA, 16 nt, Homo sapiens
ucucuucuaagcaaaa

SEQ ID NO: 1150523 - RNA, 16 nt, Homo sapiens
ucucuucuguccauca

SEQ ID NO: 1150524 - RNA, 22 nt, Homo sapiens
ucucuucuuuuggcuuccauga

SEQ ID NO: 1150525 - RNA, 14 nt, Homo sapiens
ucucuugacagucu

SEQ ID NO: 1150526 - RNA, 15 nt, Homo sapiens
ucucuugucacaugg

SEQ ID NO: 1150527 - RNA, 12 nt, Homo sapiens
ucucuugugcau

SEQ ID NO: 1150528 - RNA, 15 nt, Homo sapiens
ucucuuuaaucucau

SEQ ID NO: 1150529 - RNA, 20 nt, Homo sapiens
ucugaaaaaguauccugcuu

SEQ ID NO: 1150530 - RNA, 19 nt, Homo sapiens
ucugaaaauauaaccagcc

SEQ ID NO: 1150531 - RNA, 21 nt, Homo sapiens
ucugaaaggguuuuuaaucuc

SEQ ID NO: 1150532 - RNA, 18 nt, Homo sapiens
ucugaaauaggaaacaag

SEQ ID NO: 1150533 - RNA, 22 nt, Homo sapiens
ucugaaauuugugauggaauca

SEQ ID NO: 1150534 - RNA, 15 nt, Homo sapiens
ucugaagacagucuu

SEQ ID NO: 1150535 - RNA, 21 nt, Homo sapiens
ucugaaggagccccauuccug

SEQ ID NO: 1150536 - RNA, 17 nt, Homo sapiens
ucugaagucaguuucua

SEQ ID NO: 1150537 - RNA, 17 nt, Homo sapiens
ucugaagugcugcucca

SEQ ID NO: 1150538 - RNA, 15 nt, Homo sapiens
ucugaauugacugua

SEQ ID NO: 1150539 - RNA, 21 nt, Homo sapiens
ucugaauuugcaaaguacugu

SEQ ID NO: 1150540 - RNA, 16 nt, Homo sapiens
ucugaccaucugugac

SEQ ID NO: 1150541 - RNA, 23 nt, Homo sapiens
ucugacuuaagcugccucaagga

SEQ ID NO: 1150542 - RNA, 13 nt, Homo sapiens
ucugagaaacucu

SEQ ID NO: 1150543 - RNA, 14 nt, Homo sapiens
ucugagagcaaagu

SEQ ID NO: 1150544 - RNA, 19 nt, Homo sapiens
ucugagcacagcugcauua

SEQ ID NO: 1150545 - RNA, 19 nt, Homo sapiens
ucugagcagugaaugauuc

SEQ ID NO: 1150546 - RNA, 15 nt, Homo sapiens
ucugagcugagccag

SEQ ID NO: 1150547 - RNA, 12 nt, Homo sapiens
ucugagcuucua

SEQ ID NO: 1150548 - RNA, 12 nt, Homo sapiens
aauaaugcagua

SEQ ID NO: 1150549 - RNA, 16 nt, Homo sapiens
aauaauguguacauua

SEQ ID NO: 1150550 - RNA, 17 nt, Homo sapiens
aauaauugcaaauaucc

SEQ ID NO: 1150551 - RNA, 16 nt, Homo sapiens
aauaauuguccaugag

SEQ ID NO: 1150552 - RNA, 15 nt, Homo sapiens
aauaauuguuccaaa

SEQ ID NO: 1150553 - RNA, 18 nt, Homo sapiens
acauguuguacauuucac

SEQ ID NO: 1150554 - RNA, 14 nt, Homo sapiens
acauguuucacuua

SEQ ID NO: 1150555 - RNA, 23 nt, Homo sapiens
acauuaaaaagccuuacaguuau

SEQ ID NO: 1150556 - RNA, 15 nt, Homo sapiens
acauuaaaagacaaa

SEQ ID NO: 1150557 - RNA, 17 nt, Homo sapiens
acauuaaaagacaaaua

SEQ ID NO: 1150558 - RNA, 19 nt, Homo sapiens
acauuaaaauaaaccaaau

SEQ ID NO: 1150559 - RNA, 16 nt, Homo sapiens
acauuaaacucccuuu

SEQ ID NO: 1150560 - RNA, 15 nt, Homo sapiens
acauuaaaucacuug

SEQ ID NO: 1150561 - RNA, 17 nt, Homo sapiens
acauuaaaucacuugaa

SEQ ID NO: 1150562 - RNA, 15 nt, Homo sapiens
acauuaaauguccau

SEQ ID NO: 1150563 - RNA, 18 nt, Homo sapiens
acauuagaagacaauuga

SEQ ID NO: 1150564 - RNA, 19 nt, Homo sapiens
acauuagauugaugugcac

SEQ ID NO: 1150565 - RNA, 20 nt, Homo sapiens
acauuaggauggugaaccag

SEQ ID NO: 1150566 - RNA, 13 nt, Homo sapiens
acauuccacccca

SEQ ID NO: 1150567 - RNA, 22 nt, Homo sapiens
acauucguuuuguucauauuca

SEQ ID NO: 1150568 - RNA, 22 nt, Homo sapiens
acauucuuauaaauaugaagcu

SEQ ID NO: 1150569 - RNA, 23 nt, Homo sapiens
acauucuuauaaauaugaagcuc

SEQ ID NO: 1150570 - RNA, 12 nt, Homo sapiens
acauugcaauuu

SEQ ID NO: 1150571 - RNA, 14 nt, Homo sapiens
acauugccuugcau

SEQ ID NO: 1150572 - RNA, 16 nt, Homo sapiens
acauugcuaagaugcu

SEQ ID NO: 1150573 - RNA, 16 nt, Homo sapiens
acauuggcaaguguaa

SEQ ID NO: 1150574 - RNA, 18 nt, Homo sapiens
acauuuagccaaucuuuc

SEQ ID NO: 1150575 - RNA, 19 nt, Homo sapiens
acauuuagccaaucuuucu

SEQ ID NO: 1150576 - RNA, 17 nt, Homo sapiens
acauuuauauauugucu

SEQ ID NO: 1150577 - RNA, 23 nt, Homo sapiens
acauuucaaaauuaauagcuuuu

SEQ ID NO: 1150578 - RNA, 16 nt, Homo sapiens
acauuucauaguuuca

SEQ ID NO: 1150579 - RNA, 17 nt, Homo sapiens
agacauggagguucuaa

SEQ ID NO: 1150580 - RNA, 20 nt, Homo sapiens
agacaugguggcaugcaccu

SEQ ID NO: 1150581 - RNA, 14 nt, Homo sapiens
agacauugcaauuu

SEQ ID NO: 1150582 - RNA, 18 nt, Homo sapiens
agacauuggcaccuaauc

SEQ ID NO: 1150583 - RNA, 21 nt, Homo sapiens
agacauuggcaccuaauccag

SEQ ID NO: 1150584 - RNA, 20 nt, Homo sapiens
agacauuucaaaucuguagc

SEQ ID NO: 1150585 - RNA, 15 nt, Homo sapiens
agacauuuguuucau

SEQ ID NO: 1150586 - RNA, 18 nt, Homo sapiens
agaccaagcugugcccug

SEQ ID NO: 1150587 - RNA, 23 nt, Homo sapiens
agaccacuauucuuaacuauuca

SEQ ID NO: 1150588 - RNA, 18 nt, Homo sapiens
agaccagacucgccaaca

SEQ ID NO: 1150589 - RNA, 23 nt, Homo sapiens
agaccagcccaccccugugccca

SEQ ID NO: 1150590 - RNA, 18 nt, Homo sapiens
agaccaggggaccagagg

SEQ ID NO: 1150591 - RNA, 16 nt, Homo sapiens
agaccaucaguucuuu

SEQ ID NO: 1150592 - RNA, 18 nt, Homo sapiens
agacccaaacauaugcac

SEQ ID NO: 1150593 - RNA, 14 nt, Homo sapiens
agaccccaaaaaga

SEQ ID NO: 1150594 - RNA, 14 nt, Homo sapiens
agacccucucaggc

SEQ ID NO: 1150595 - RNA, 20 nt, Homo sapiens
agaccgugaccagugcugcu

SEQ ID NO: 1150596 - RNA, 15 nt, Homo sapiens
agaccguugguucca

SEQ ID NO: 1150597 - RNA, 13 nt, Homo sapiens
agaccucagggac

SEQ ID NO: 1150598 - RNA, 13 nt, Homo sapiens
agaccucagggca

SEQ ID NO: 1150599 - RNA, 22 nt, Homo sapiens
agaccucuagacugguucauuc

SEQ ID NO: 1150600 - RNA, 16 nt, Homo sapiens
agaccucugugcacuu

SEQ ID NO: 1150601 - RNA, 20 nt, Homo sapiens
agaccugaagugugcacguu

SEQ ID NO: 1150602 - RNA, 14 nt, Homo sapiens
agaccugauccugg

SEQ ID NO: 1150603 - RNA, 20 nt, Homo sapiens
agaccugcgauggacuucac

SEQ ID NO: 1150604 - RNA, 23 nt, Homo sapiens
agaccuugcugauaaaacagauu

SEQ ID NO: 1150605 - RNA, 15 nt, Homo sapiens
agaccuuggcgcuac

SEQ ID NO: 1150606 - RNA, 23 nt, Homo sapiens
agaccuuuuggcccaaucucugc

SEQ ID NO: 1150607 - RNA, 21 nt, Homo sapiens
agacgggcccuggugguggcu

SEQ ID NO: 1150608 - RNA, 16 nt, Homo sapiens
agacgguuuccaggga

SEQ ID NO: 1150609 - RNA, 13 nt, Homo sapiens
agacgucugccuu

SEQ ID NO: 1150610 - RNA, 13 nt, Homo sapiens
agacuaaggccau

SEQ ID NO: 1150611 - RNA, 12 nt, Homo sapiens
agacuacaggug

SEQ ID NO: 1150612 - RNA, 16 nt, Homo sapiens
agacuacauuugugaa

SEQ ID NO: 1150613 - RNA, 19 nt, Homo sapiens
agacuauuaggugcaauuu

SEQ ID NO: 1150614 - RNA, 17 nt, Homo sapiens
agacucaaaugcucaga

SEQ ID NO: 1150615 - RNA, 14 nt, Homo sapiens
agacucaagacuua

SEQ ID NO: 1150616 - RNA, 19 nt, Homo sapiens
agacucagacauuggcacc

SEQ ID NO: 1150617 - RNA, 13 nt, Homo sapiens
agacucagugcag

SEQ ID NO: 1150618 - RNA, 15 nt, Homo sapiens
agacucagugcagau

SEQ ID NO: 1150619 - RNA, 16 nt, Homo sapiens
agacucauccugaaca

SEQ ID NO: 1150620 - RNA, 23 nt, Homo sapiens
agacucauggauuggucugaggg

SEQ ID NO: 1150621 - RNA, 15 nt, Homo sapiens
agacuccaagccaag

SEQ ID NO: 1150622 - RNA, 16 nt, Homo sapiens
agacucccugauccca

SEQ ID NO: 1150623 - RNA, 17 nt, Homo sapiens
agacuccucaucaugau

SEQ ID NO: 1150624 - RNA, 22 nt, Homo sapiens
agacucggauggggacauggag

SEQ ID NO: 1150625 - RNA, 18 nt, Homo sapiens
agacucuuccaccagagc

SEQ ID NO: 1150626 - RNA, 21 nt, Homo sapiens
auaauguaucccgauaacuuu

SEQ ID NO: 1150627 - RNA, 19 nt, Homo sapiens
auaauguuccuuaguggua

SEQ ID NO: 1150628 - RNA, 15 nt, Homo sapiens
auaauuaaucagcuc

SEQ ID NO: 1150629 - RNA, 19 nt, Homo sapiens
auaauucuauacuguugau

SEQ ID NO: 1150630 - RNA, 20 nt, Homo sapiens
auaauuuagaccccauacaa

SEQ ID NO: 1150631 - RNA, 14 nt, Homo sapiens
auaauuucuaaugu

SEQ ID NO: 1150632 - RNA, 22 nt, Homo sapiens
auacaaaaauaccuacugcuga

SEQ ID NO: 1150633 - RNA, 19 nt, Homo sapiens
auacaaaaaucagccagac

SEQ ID NO: 1150634 - RNA, 20 nt, Homo sapiens
auacaaaacccuuucugccc

SEQ ID NO: 1150635 - RNA, 18 nt, Homo sapiens
auacaaaucaaagauuug

SEQ ID NO: 1150636 - RNA, 24 nt, Homo sapiens
auacaaaucaaagauuugucacau

SEQ ID NO: 1150637 - RNA, 15 nt, Homo sapiens
auacaaguugcaaau

SEQ ID NO: 1150638 - RNA, 22 nt, Homo sapiens
auacaauuauuuuuacaguucu

SEQ ID NO: 1150639 - RNA, 14 nt, Homo sapiens
auacacacacacac

SEQ ID NO: 1150640 - RNA, 18 nt, Homo sapiens
auacacuaaaaaucugag

SEQ ID NO: 1150641 - RNA, 23 nt, Homo sapiens
auacagaaguccccucuacuuua

SEQ ID NO: 1150642 - RNA, 15 nt, Homo sapiens
auacagccugaauaa

SEQ ID NO: 1150643 - RNA, 15 nt, Homo sapiens
auacagggacagggu

SEQ ID NO: 1150644 - RNA, 18 nt, Homo sapiens
auacaguacaggcagcac

SEQ ID NO: 1150645 - RNA, 18 nt, Homo sapiens
auacaguaugaucucagu

SEQ ID NO: 1150646 - RNA, 18 nt, Homo sapiens
auacagugaagaguaagu

SEQ ID NO: 1150647 - RNA, 13 nt, Homo sapiens
auacagugauaug

SEQ ID NO: 1150648 - RNA, 20 nt, Homo sapiens
auacauugauucaugucuca

SEQ ID NO: 1150649 - RNA, 12 nt, Homo sapiens
auacauuuacug

SEQ ID NO: 1150650 - RNA, 20 nt, Homo sapiens
auacauuuuuagaaaucaca

SEQ ID NO: 1150651 - RNA, 20 nt, Homo sapiens
auaccaacccacuggcacau

SEQ ID NO: 1150652 - RNA, 21 nt, Homo sapiens
auaccaacuguacaaaauaac

SEQ ID NO: 1150653 - RNA, 12 nt, Homo sapiens
auaccagcaaua

SEQ ID NO: 1150654 - RNA, 15 nt, Homo sapiens
auaccagcucagggg

SEQ ID NO: 1150655 - RNA, 22 nt, Homo sapiens
auaccauuaaauaaugcauaau

SEQ ID NO: 1150656 - RNA, 14 nt, Homo sapiens
auaccccauuugau

SEQ ID NO: 1150657 - RNA, 23 nt, Homo sapiens
auacccucacuuaaacuuuuauc

SEQ ID NO: 1150658 - RNA, 14 nt, Homo sapiens
auaccuacugcuga

SEQ ID NO: 1150659 - RNA, 22 nt, Homo sapiens
auaccuccucccuaaugcucac

SEQ ID NO: 1150660 - RNA, 18 nt, Homo sapiens
auaccuggcccaaccaga

SEQ ID NO: 1150661 - RNA, 19 nt, Homo sapiens
auaccuuccccacaucuga

SEQ ID NO: 1150662 - RNA, 16 nt, Homo sapiens
auaccuugauugggga

SEQ ID NO: 1150663 - RNA, 13 nt, Homo sapiens
auacgcacuuugc

SEQ ID NO: 1150664 - RNA, 14 nt, Homo sapiens
auacguacauuccu

SEQ ID NO: 1150665 - RNA, 16 nt, Homo sapiens
auacuaguagucauac

SEQ ID NO: 1150666 - RNA, 21 nt, Homo sapiens
auacuccaacugaaauguuaa

SEQ ID NO: 1150667 - RNA, 23 nt, Homo sapiens
auacucuagaugaaguuuuacau

SEQ ID NO: 1150668 - RNA, 22 nt, Homo sapiens
auacugaauuucuuugauuuaa

SEQ ID NO: 1150669 - RNA, 14 nt, Homo sapiens
auacugacaaacca

SEQ ID NO: 1150670 - RNA, 13 nt, Homo sapiens
auacugacuccua

SEQ ID NO: 1150671 - RNA, 21 nt, Homo sapiens
auacugcauuagcccaagaga

SEQ ID NO: 1150672 - RNA, 20 nt, Homo sapiens
auacugguuauccugugcua

SEQ ID NO: 1150673 - RNA, 13 nt, Homo sapiens
auacuguuuauuu

SEQ ID NO: 1150674 - RNA, 13 nt, Homo sapiens
auacuuacugaac

SEQ ID NO: 1150675 - RNA, 15 nt, Homo sapiens
auacuugaacacugu

SEQ ID NO: 1150676 - RNA, 17 nt, Homo sapiens
auacuugaccuugcaug

SEQ ID NO: 1150677 - RNA, 17 nt, Homo sapiens
auacuugaguaacauuu

SEQ ID NO: 1150678 - RNA, 17 nt, Homo sapiens
auacuuuuaauuucacu

SEQ ID NO: 1150679 - RNA, 20 nt, Homo sapiens
auacuuuuaugcaaccauaa

SEQ ID NO: 1150680 - RNA, 13 nt, Homo sapiens
auagaaaccucuc

SEQ ID NO: 1150681 - RNA, 22 nt, Homo sapiens
auagaaaugguuuccucuggau

SEQ ID NO: 1150682 - RNA, 15 nt, Homo sapiens
auagaaccacuauga

SEQ ID NO: 1150683 - RNA, 15 nt, Homo sapiens
auagacccgaggaaa

SEQ ID NO: 1150684 - RNA, 17 nt, Homo sapiens
auagagaaaggucuaug

SEQ ID NO: 1150685 - RNA, 14 nt, Homo sapiens
auagagccuuugau

SEQ ID NO: 1150686 - RNA, 17 nt, Homo sapiens
auagagccuuugaucuu

SEQ ID NO: 1150687 - RNA, 23 nt, Homo sapiens
auagagcuuuuaaaaauguccug

SEQ ID NO: 1150688 - RNA, 23 nt, Homo sapiens
auagaguauagcucuguagugga

SEQ ID NO: 1150689 - RNA, 15 nt, Homo sapiens
auagagugcauuuga

SEQ ID NO: 1150690 - RNA, 19 nt, Homo sapiens
auagauaggucagugcaaa

SEQ ID NO: 1150691 - RNA, 23 nt, Homo sapiens
auagaugcuggcccagggcccag

SEQ ID NO: 1150692 - RNA, 21 nt, Homo sapiens
auagaugucaggaaacauuca

SEQ ID NO: 1150693 - RNA, 14 nt, Homo sapiens
auagcaaaacuaaa

SEQ ID NO: 1150694 - RNA, 16 nt, Homo sapiens
auagcacuaaugcuuu

SEQ ID NO: 1150695 - RNA, 18 nt, Homo sapiens
auagcagaugguuuccac

SEQ ID NO: 1150696 - RNA, 19 nt, Homo sapiens
auagcaugcaucuguuuau

SEQ ID NO: 1150697 - RNA, 15 nt, Homo sapiens
auagcauguaauggu

SEQ ID NO: 1150698 - RNA, 23 nt, Homo sapiens
auagccuguggccuuugcaauuu

SEQ ID NO: 1150699 - RNA, 16 nt, Homo sapiens
auagcgccuguauaag

SEQ ID NO: 1150700 - RNA, 13 nt, Homo sapiens
auagcucuucacu

SEQ ID NO: 1150701 - RNA, 10 nt, Homo sapiens
auaggacaaa

SEQ ID NO: 1150702 - RNA, 11 nt, Homo sapiens
auaggacaaau

SEQ ID NO: 1150703 - RNA, 16 nt, Homo sapiens
auaggacccauauucc

SEQ ID NO: 1150704 - RNA, 20 nt, Homo sapiens
auaggacucuagacggcauc

SEQ ID NO: 1150705 - RNA, 15 nt, Homo sapiens
auaggauugcuucaa

SEQ ID NO: 1150706 - RNA, 16 nt, Homo sapiens
auaggcaccucuucaa

SEQ ID NO: 1150707 - RNA, 15 nt, Homo sapiens
auaggcaugagccac

SEQ ID NO: 1150708 - RNA, 13 nt, Homo sapiens
auaggcuuaugau

SEQ ID NO: 1150709 - RNA, 19 nt, Homo sapiens
auagggacuuggggcuugg

SEQ ID NO: 1150710 - RNA, 14 nt, Homo sapiens
auagguacauugga

SEQ ID NO: 1150711 - RNA, 17 nt, Homo sapiens
auaguaaacacagggaa

SEQ ID NO: 1150712 - RNA, 22 nt, Homo sapiens
auaguaaaguuguuguaaaaau

SEQ ID NO: 1150713 - RNA, 15 nt, Homo sapiens
auaguacauaaucuu

SEQ ID NO: 1150714 - RNA, 16 nt, Homo sapiens
auaguacuaagcauuu

SEQ ID NO: 1150715 - RNA, 16 nt, Homo sapiens
auaguauuuucuacua

SEQ ID NO: 1150716 - RNA, 13 nt, Homo sapiens
auaguccaaaaag

SEQ ID NO: 1150717 - RNA, 14 nt, Homo sapiens
auaguuaagacaug

SEQ ID NO: 1150718 - RNA, 21 nt, Homo sapiens
auaguuguuuuauauguugcu

SEQ ID NO: 1150719 - RNA, 22 nt, Homo sapiens
auaguuuguuuuuaaacuaaua

SEQ ID NO: 1150720 - RNA, 18 nt, Homo sapiens
auaguuuuuagucugugu

SEQ ID NO: 1150721 - RNA, 20 nt, Homo sapiens
auauaaaauguuuaaucucu

SEQ ID NO: 1150722 - RNA, 17 nt, Homo sapiens
auauaaauuuucccaaa

SEQ ID NO: 1150723 - RNA, 18 nt, Homo sapiens
auauaaggaaagcaauaa

SEQ ID NO: 1150724 - RNA, 20 nt, Homo sapiens
auauaaggacagaccaaaaa

SEQ ID NO: 1150725 - RNA, 13 nt, Homo sapiens
auauacacacaca

SEQ ID NO: 1150726 - RNA, 22 nt, Homo sapiens
auauaccuuuuguuaccacaga

SEQ ID NO: 1150727 - RNA, 16 nt, Homo sapiens
auauacucuucaagga

SEQ ID NO: 1150728 - RNA, 16 nt, Homo sapiens
auauagcaagauccca

SEQ ID NO: 1150729 - RNA, 17 nt, Homo sapiens
auauagcaagugcuauu

SEQ ID NO: 1150730 - RNA, 17 nt, Homo sapiens
auauaggugugugagac

SEQ ID NO: 1150731 - RNA, 14 nt, Homo sapiens
auauauaacauaua

SEQ ID NO: 1150732 - RNA, 18 nt, Homo sapiens
auauauaagaaagacauc

SEQ ID NO: 1150733 - RNA, 20 nt, Homo sapiens
auauauagagagguacacau

SEQ ID NO: 1150734 - RNA, 14 nt, Homo sapiens
auauauauauacac

SEQ ID NO: 1150735 - RNA, 15 nt, Homo sapiens
auauauauauauaca

SEQ ID NO: 1150736 - RNA, 13 nt, Homo sapiens
auauauauuacaa

SEQ ID NO: 1150737 - RNA, 17 nt, Homo sapiens
auauaucuuuauacuua

SEQ ID NO: 1150738 - RNA, 23 nt, Homo sapiens
auauaugauauauaaaugugauu

SEQ ID NO: 1150739 - RNA, 16 nt, Homo sapiens
auauaugcacuaugua

SEQ ID NO: 1150740 - RNA, 16 nt, Homo sapiens
auauaugcaggaaaga

SEQ ID NO: 1150741 - RNA, 18 nt, Homo sapiens
auauaugccuucccccac

SEQ ID NO: 1150742 - RNA, 14 nt, Homo sapiens
auauauuauucucg

SEQ ID NO: 1150743 - RNA, 17 nt, Homo sapiens
auauauuccaccaggau

SEQ ID NO: 1150744 - RNA, 12 nt, Homo sapiens
auauauugauuc

SEQ ID NO: 1150745 - RNA, 13 nt, Homo sapiens
auauauuuccuca

SEQ ID NO: 1150746 - RNA, 23 nt, Homo sapiens
auauauuuuuaaaaaucuaccug

SEQ ID NO: 1150747 - RNA, 14 nt, Homo sapiens
auaucaaaagcaaa

SEQ ID NO: 1150748 - RNA, 14 nt, Homo sapiens
auaucaaaauucua

SEQ ID NO: 1150749 - RNA, 16 nt, Homo sapiens
auaucaaaauugcaau

SEQ ID NO: 1150750 - RNA, 16 nt, Homo sapiens
auaucacaagugauug

SEQ ID NO: 1150751 - RNA, 16 nt, Homo sapiens
auaucagaagugccaa

SEQ ID NO: 1150752 - RNA, 16 nt, Homo sapiens
auaucagcucuuucuc

SEQ ID NO: 1150753 - RNA, 16 nt, Homo sapiens
auaucauaaauacaag

SEQ ID NO: 1150754 - RNA, 17 nt, Homo sapiens
auaucauauuguuaaau

SEQ ID NO: 1150755 - RNA, 15 nt, Homo sapiens
auaucaucuguggac

SEQ ID NO: 1150756 - RNA, 19 nt, Homo sapiens
auaucaugcuaaaauucua

SEQ ID NO: 1150757 - RNA, 22 nt, Homo sapiens
aucacaucuuaaagcuaaaaau

SEQ ID NO: 1150758 - RNA, 15 nt, Homo sapiens
aucacaugugcugca

SEQ ID NO: 1150759 - RNA, 19 nt, Homo sapiens
aucacauguuuucucugga

SEQ ID NO: 1150760 - RNA, 16 nt, Homo sapiens
aucaccaggugcaucu

SEQ ID NO: 1150761 - RNA, 17 nt, Homo sapiens
aucaccauguauuuugu

SEQ ID NO: 1150762 - RNA, 20 nt, Homo sapiens
aucaccgugggcucccugac

SEQ ID NO: 1150763 - RNA, 15 nt, Homo sapiens
aucacggugugaguu

SEQ ID NO: 1150764 - RNA, 18 nt, Homo sapiens
aucacguuauaguccaug

SEQ ID NO: 1150765 - RNA, 14 nt, Homo sapiens
aucacguugcaaug

SEQ ID NO: 1150766 - RNA, 17 nt, Homo sapiens
aucacucuauacaucuu

SEQ ID NO: 1150767 - RNA, 16 nt, Homo sapiens
aucacugggucugcug

SEQ ID NO: 1150768 - RNA, 20 nt, Homo sapiens
aucacuuccuauaugcacuu

SEQ ID NO: 1150769 - RNA, 23 nt, Homo sapiens
aucacuugaacccgggaggcaga

SEQ ID NO: 1150770 - RNA, 23 nt, Homo sapiens
aucacuuguaccuuccacaagac

SEQ ID NO: 1150771 - RNA, 14 nt, Homo sapiens
aucagaaacucaaa

SEQ ID NO: 1150772 - RNA, 16 nt, Homo sapiens
aucagaacuguuggca

SEQ ID NO: 1150773 - RNA, 20 nt, Homo sapiens
aucagaagcgcugaugguca

SEQ ID NO: 1150774 - RNA, 22 nt, Homo sapiens
aucagacugaacuuacacugua

SEQ ID NO: 1150775 - RNA, 22 nt, Homo sapiens
aucagacugcggugaacauuuc

SEQ ID NO: 1150776 - RNA, 17 nt, Homo sapiens
aucagaugcuccaagau

SEQ ID NO: 1150777 - RNA, 22 nt, Homo sapiens
aucagauugcaugugacucuga

SEQ ID NO: 1150778 - RNA, 16 nt, Homo sapiens
aucagccaaagcagaa

SEQ ID NO: 1150779 - RNA, 22 nt, Homo sapiens
aucagccagacaugguggcaug

SEQ ID NO: 1150780 - RNA, 19 nt, Homo sapiens
aucagccucgcucuugucu

SEQ ID NO: 1150781 - RNA, 17 nt, Homo sapiens
aucaggaguuccagugc

SEQ ID NO: 1150782 - RNA, 18 nt, Homo sapiens
aucaguauuuaauaucug

SEQ ID NO: 1150783 - RNA, 20 nt, Homo sapiens
aucaguccaucccagaggga

SEQ ID NO: 1150784 - RNA, 11 nt, Homo sapiens
aucagugcaug

SEQ ID NO: 1150785 - RNA, 16 nt, Homo sapiens
aucaguguaccauuug

SEQ ID NO: 1150786 - RNA, 11 nt, Homo sapiens
aucaguguuua

SEQ ID NO: 1150787 - RNA, 18 nt, Homo sapiens
aucaguugguuuggauuu

SEQ ID NO: 1150788 - RNA, 15 nt, Homo sapiens
aucauacccuucccu

SEQ ID NO: 1150789 - RNA, 13 nt, Homo sapiens
aucauacuuccau

SEQ ID NO: 1150790 - RNA, 13 nt, Homo sapiens
aucauagcaauau

SEQ ID NO: 1150791 - RNA, 15 nt, Homo sapiens
aucauaguugcaaaa

SEQ ID NO: 1150792 - RNA, 16 nt, Homo sapiens
aucauaguugcaaaau

SEQ ID NO: 1150793 - RNA, 14 nt, Homo sapiens
aucaucaacacaau

SEQ ID NO: 1150794 - RNA, 15 nt, Homo sapiens
aucaucagacuagua

SEQ ID NO: 1150795 - RNA, 20 nt, Homo sapiens
aucaucaggaagccuguggu

SEQ ID NO: 1150796 - RNA, 19 nt, Homo sapiens
aucaugcaaaugcuguauu

SEQ ID NO: 1150797 - RNA, 18 nt, Homo sapiens
aucaugcccugugcaacc

SEQ ID NO: 1150798 - RNA, 14 nt, Homo sapiens
aucaugcugagaga

SEQ ID NO: 1150799 - RNA, 18 nt, Homo sapiens
aucauggaacacaaacac

SEQ ID NO: 1150800 - RNA, 19 nt, Homo sapiens
aucauggaauuuaugcaaa

SEQ ID NO: 1150801 - RNA, 17 nt, Homo sapiens
aucauggagaacagcau

SEQ ID NO: 1150802 - RNA, 22 nt, Homo sapiens
aucaugugugagauaacuuccu

SEQ ID NO: 1150803 - RNA, 15 nt, Homo sapiens
aucauguguguccac

SEQ ID NO: 1150804 - RNA, 23 nt, Homo sapiens
aucauguuuuuucugcaaugacu

SEQ ID NO: 1150805 - RNA, 20 nt, Homo sapiens
aucuauauauguguauguac

SEQ ID NO: 1150806 - RNA, 15 nt, Homo sapiens
aucuaugcagaacag

SEQ ID NO: 1150807 - RNA, 21 nt, Homo sapiens
aucuaugccuaaaaaguauca

SEQ ID NO: 1150808 - RNA, 14 nt, Homo sapiens
aucuauucucucca

SEQ ID NO: 1150809 - RNA, 15 nt, Homo sapiens
aucucaaagaaggca

SEQ ID NO: 1150810 - RNA, 17 nt, Homo sapiens
aucucaaagaaggcauu

SEQ ID NO: 1150811 - RNA, 18 nt, Homo sapiens
aucucaaguauaugucau

SEQ ID NO: 1150812 - RNA, 17 nt, Homo sapiens
aucucaauguacauaga

SEQ ID NO: 1150813 - RNA, 18 nt, Homo sapiens
aucucaggccucccucaa

SEQ ID NO: 1150814 - RNA, 23 nt, Homo sapiens
aucucaguauuuugaaauuguaa

SEQ ID NO: 1150815 - RNA, 20 nt, Homo sapiens
aucucaugagugccaagcaa

SEQ ID NO: 1150816 - RNA, 20 nt, Homo sapiens
aucucauuggacccuuccau

SEQ ID NO: 1150817 - RNA, 13 nt, Homo sapiens
aucuccacuacuu

SEQ ID NO: 1150818 - RNA, 13 nt, Homo sapiens
aucuccaguaucc

SEQ ID NO: 1150819 - RNA, 17 nt, Homo sapiens
aucucccacaaguauau

SEQ ID NO: 1150820 - RNA, 14 nt, Homo sapiens
aucucccacacaag

SEQ ID NO: 1150821 - RNA, 16 nt, Homo sapiens
aucucccacacaagac

SEQ ID NO: 1150822 - RNA, 14 nt, Homo sapiens
aucucccaccagcu

SEQ ID NO: 1150823 - RNA, 14 nt, Homo sapiens
aucucccaugugca

SEQ ID NO: 1150824 - RNA, 19 nt, Homo sapiens
aucucccugcuucauaucu

SEQ ID NO: 1150825 - RNA, 16 nt, Homo sapiens
aucucgccuuccugca

SEQ ID NO: 1150826 - RNA, 22 nt, Homo sapiens
aucucuaacauaugauacugau

SEQ ID NO: 1150827 - RNA, 16 nt, Homo sapiens
aucucuagaaagcucu

SEQ ID NO: 1150828 - RNA, 17 nt, Homo sapiens
aucucugccauaucagu

SEQ ID NO: 1150829 - RNA, 12 nt, Homo sapiens
aucucugugaaa

SEQ ID NO: 1150830 - RNA, 17 nt, Homo sapiens
aucugaaaugugauaag

SEQ ID NO: 1150831 - RNA, 14 nt, Homo sapiens
aucugacauaguua

SEQ ID NO: 1150832 - RNA, 22 nt, Homo sapiens
aucugcaaaggaaucacuuuag

SEQ ID NO: 1150833 - RNA, 23 nt, Homo sapiens
aucugcaaaggaaucacuuuaga

SEQ ID NO: 1150834 - RNA, 15 nt, Homo sapiens
aucugcacauuucau

SEQ ID NO: 1150835 - RNA, 21 nt, Homo sapiens
aucugccaacuguccuacuca

SEQ ID NO: 1150836 - RNA, 18 nt, Homo sapiens
aucugccugccaacccau

SEQ ID NO: 1150837 - RNA, 20 nt, Homo sapiens
aucugcuagggaauaucaau

SEQ ID NO: 1150838 - RNA, 20 nt, Homo sapiens
aucugcugggccaccagcca

SEQ ID NO: 1150839 - RNA, 19 nt, Homo sapiens
aucuggaacccagacucag

SEQ ID NO: 1150840 - RNA, 22 nt, Homo sapiens
aucuggaaguaaccauuugcac

SEQ ID NO: 1150841 - RNA, 15 nt, Homo sapiens
aucuggaauuccagu

SEQ ID NO: 1150842 - RNA, 21 nt, Homo sapiens
aucugggugggauaauggacu

SEQ ID NO: 1150843 - RNA, 17 nt, Homo sapiens
aucugguguucuugcua

SEQ ID NO: 1150844 - RNA, 18 nt, Homo sapiens
aucuguaaaaggccuuca

SEQ ID NO: 1150845 - RNA, 19 nt, Homo sapiens
aucuguaaggaacuggaac

SEQ ID NO: 1150846 - RNA, 16 nt, Homo sapiens
aucuguccacaucccc

SEQ ID NO: 1150847 - RNA, 20 nt, Homo sapiens
aucuguccacauccccagag

SEQ ID NO: 1150848 - RNA, 16 nt, Homo sapiens
aucuguccauccuccu

SEQ ID NO: 1150849 - RNA, 14 nt, Homo sapiens
cagacauucugcca

SEQ ID NO: 1150850 - RNA, 20 nt, Homo sapiens
cagacccccacucucauucc

SEQ ID NO: 1150851 - RNA, 17 nt, Homo sapiens
cagaccggcaacaucag

SEQ ID NO: 1150852 - RNA, 16 nt, Homo sapiens
auggggcauguccuuu

SEQ ID NO: 1150853 - RNA, 17 nt, Homo sapiens
auggguauucaaaaaug

SEQ ID NO: 1150854 - RNA, 17 nt, Homo sapiens
augguaauaaucuggaa

SEQ ID NO: 1150855 - RNA, 18 nt, Homo sapiens
augguagaaaaugcacca

SEQ ID NO: 1150856 - RNA, 14 nt, Homo sapiens
augguagagcaaua

SEQ ID NO: 1150857 - RNA, 14 nt, Homo sapiens
augguagcauuuua

SEQ ID NO: 1150858 - RNA, 15 nt, Homo sapiens
augguccugucuguc

SEQ ID NO: 1150859 - RNA, 23 nt, Homo sapiens
auggugaaaccccgucucuacua

SEQ ID NO: 1150860 - RNA, 20 nt, Homo sapiens
auggugaaaccguaucucua

SEQ ID NO: 1150861 - RNA, 14 nt, Homo sapiens
auggugauaaggga

SEQ ID NO: 1150862 - RNA, 16 nt, Homo sapiens
auggugauuucuugcu

SEQ ID NO: 1150863 - RNA, 19 nt, Homo sapiens
augguggacucgccuguaa

SEQ ID NO: 1150864 - RNA, 19 nt, Homo sapiens
augguggcgcaugccugua

SEQ ID NO: 1150865 - RNA, 20 nt, Homo sapiens
augguggcucacaccuguaa

SEQ ID NO: 1150866 - RNA, 22 nt, Homo sapiens
augguguggacugaaugggauc

SEQ ID NO: 1150867 - RNA, 11 nt, Homo sapiens
augguguuucu

SEQ ID NO: 1150868 - RNA, 19 nt, Homo sapiens
augguuccauucucucucc

SEQ ID NO: 1150869 - RNA, 19 nt, Homo sapiens
augguuuuucaccugggaa

SEQ ID NO: 1150870 - RNA, 12 nt, Homo sapiens
auguaaagccau

SEQ ID NO: 1150871 - RNA, 13 nt, Homo sapiens
auguaaagccaug

SEQ ID NO: 1150872 - RNA, 15 nt, Homo sapiens
auguaaaugcucaaa

SEQ ID NO: 1150873 - RNA, 14 nt, Homo sapiens
auguaacugugcca

SEQ ID NO: 1150874 - RNA, 22 nt, Homo sapiens
auguaagauuauagauucuaaa

SEQ ID NO: 1150875 - RNA, 16 nt, Homo sapiens
auguaaggccuuucaa

SEQ ID NO: 1150876 - RNA, 20 nt, Homo sapiens
auguaaggccuuucaauauu

SEQ ID NO: 1150877 - RNA, 16 nt, Homo sapiens
auguacaaaaccauuu

SEQ ID NO: 1150878 - RNA, 14 nt, Homo sapiens
auguacaacauuua

SEQ ID NO: 1150879 - RNA, 21 nt, Homo sapiens
auguacagacaaauacuuaga

SEQ ID NO: 1150880 - RNA, 19 nt, Homo sapiens
auguacuguuacuguguca

SEQ ID NO: 1150881 - RNA, 19 nt, Homo sapiens
auguagaaagauacacuga

SEQ ID NO: 1150882 - RNA, 19 nt, Homo sapiens
auguagacugaaaagccau

SEQ ID NO: 1150883 - RNA, 22 nt, Homo sapiens
auguaggggccaagcagugccc

SEQ ID NO: 1150884 - RNA, 18 nt, Homo sapiens
auguaggguaaggugccu

SEQ ID NO: 1150885 - RNA, 17 nt, Homo sapiens
auguauaaaacuaggaa

SEQ ID NO: 1150886 - RNA, 18 nt, Homo sapiens
auguauaccaaggcaaaa

SEQ ID NO: 1150887 - RNA, 14 nt, Homo sapiens
auguauaugcacuu

SEQ ID NO: 1150888 - RNA, 18 nt, Homo sapiens
caagcaggcgcugugcua

SEQ ID NO: 1150889 - RNA, 13 nt, Homo sapiens
caagccacagccu

SEQ ID NO: 1150890 - RNA, 17 nt, Homo sapiens
caagccacugagcaaug

SEQ ID NO: 1150891 - RNA, 16 nt, Homo sapiens
caagccagcccggccg

SEQ ID NO: 1150892 - RNA, 23 nt, Homo sapiens
caagccagccuugcuccuggcug

SEQ ID NO: 1150893 - RNA, 18 nt, Homo sapiens
caagcccuguugacacag

SEQ ID NO: 1150894 - RNA, 24 nt, Homo sapiens
caagccugccucgccuuguguuac

SEQ ID NO: 1150895 - RNA, 16 nt, Homo sapiens
caagccugugcaaaaa

SEQ ID NO: 1150896 - RNA, 18 nt, Homo sapiens
caagcugaauuugaaaua

SEQ ID NO: 1150897 - RNA, 12 nt, Homo sapiens
caagcugcauuu

SEQ ID NO: 1150898 - RNA, 17 nt, Homo sapiens
caagcugguauuuucau

SEQ ID NO: 1150899 - RNA, 20 nt, Homo sapiens
caaggaaacccccaguguaa

SEQ ID NO: 1150900 - RNA, 22 nt, Homo sapiens
caaggaaacccccaguguaaua

SEQ ID NO: 1150901 - RNA, 23 nt, Homo sapiens
caaggaaacccccaguguaauaa

SEQ ID NO: 1150902 - RNA, 19 nt, Homo sapiens
caaggaaacgcuaccucuc

SEQ ID NO: 1150903 - RNA, 22 nt, Homo sapiens
caaggagaucgguaucuuugua

SEQ ID NO: 1150904 - RNA, 14 nt, Homo sapiens
caaggaugucugcc

SEQ ID NO: 1150905 - RNA, 18 nt, Homo sapiens
caaggauuuuguaagaag

SEQ ID NO: 1150906 - RNA, 13 nt, Homo sapiens
caaggcaaacccu

SEQ ID NO: 1150907 - RNA, 15 nt, Homo sapiens
caaggcacucuagau

SEQ ID NO: 1150908 - RNA, 20 nt, Homo sapiens
caaggcccuuuccuuuggaa

SEQ ID NO: 1150909 - RNA, 22 nt, Homo sapiens
caaggcgguggacuugaacuuu

SEQ ID NO: 1150910 - RNA, 15 nt, Homo sapiens
caaggcuucagucuc

SEQ ID NO: 1150911 - RNA, 19 nt, Homo sapiens
caagggacaaggacacgcg

SEQ ID NO: 1150912 - RNA, 20 nt, Homo sapiens
caagggcggggacagccaca

SEQ ID NO: 1150913 - RNA, 21 nt, Homo sapiens
caagggcuuuguuuugcacac

SEQ ID NO: 1150914 - RNA, 14 nt, Homo sapiens
caaggggucacuua

SEQ ID NO: 1150915 - RNA, 18 nt, Homo sapiens
caaggucucacacuccuc

SEQ ID NO: 1150916 - RNA, 18 nt, Homo sapiens
caaguaagaauguuaaaa

SEQ ID NO: 1150917 - RNA, 19 nt, Homo sapiens
caaguagcugggauuacag

SEQ ID NO: 1150918 - RNA, 21 nt, Homo sapiens
caaguauacuagggagccauu

SEQ ID NO: 1150919 - RNA, 14 nt, Homo sapiens
caaguauccaguca

SEQ ID NO: 1150920 - RNA, 16 nt, Homo sapiens
caagucccccaagacc

SEQ ID NO: 1150921 - RNA, 16 nt, Homo sapiens
caagucuacuucacua

SEQ ID NO: 1150922 - RNA, 20 nt, Homo sapiens
caagucuuuacagaaucaaa

SEQ ID NO: 1150923 - RNA, 17 nt, Homo sapiens
caagugaaaaacaucca

SEQ ID NO: 1150924 - RNA, 21 nt, Homo sapiens
caagugaucugcccaccucag

SEQ ID NO: 1150925 - RNA, 15 nt, Homo sapiens
caagugcuacucuca

SEQ ID NO: 1150926 - RNA, 15 nt, Homo sapiens
caagugcuauuucag

SEQ ID NO: 1150927 - RNA, 13 nt, Homo sapiens
caaguguucacaa

SEQ ID NO: 1150928 - RNA, 20 nt, Homo sapiens
caaguguucuaaaaugaaau

SEQ ID NO: 1150929 - RNA, 15 nt, Homo sapiens
caaguucuaagauuc

SEQ ID NO: 1150930 - RNA, 14 nt, Homo sapiens
caauaaacuuguag

SEQ ID NO: 1150931 - RNA, 16 nt, Homo sapiens
caauaaagucauuaau

SEQ ID NO: 1150932 - RNA, 20 nt, Homo sapiens
caauaauaaaguacuugacu

SEQ ID NO: 1150933 - RNA, 23 nt, Homo sapiens
caauacaggcaugaaccacugca

SEQ ID NO: 1150934 - RNA, 21 nt, Homo sapiens
caauagaaggauguacauuuc

SEQ ID NO: 1150935 - RNA, 22 nt, Homo sapiens
caauauacaacuguaaagcaaa

SEQ ID NO: 1150936 - RNA, 20 nt, Homo sapiens
caauaugaaguuacuuucuu

SEQ ID NO: 1150937 - RNA, 22 nt, Homo sapiens
caauauucccggucagcaguau

SEQ ID NO: 1150938 - RNA, 15 nt, Homo sapiens
caauauugacuuugu

SEQ ID NO: 1150939 - RNA, 23 nt, Homo sapiens
caauauuugauugguauucuguu

SEQ ID NO: 1150940 - RNA, 22 nt, Homo sapiens
caaucaauucauaucuauuuau

SEQ ID NO: 1150941 - RNA, 17 nt, Homo sapiens
caaucacuguauagaau

SEQ ID NO: 1150942 - RNA, 16 nt, Homo sapiens
caaucagaucaacucu

SEQ ID NO: 1150943 - RNA, 17 nt, Homo sapiens
caaucauacugacauaa

SEQ ID NO: 1150944 - RNA, 16 nt, Homo sapiens
caauccagcuauguua

SEQ ID NO: 1150945 - RNA, 18 nt, Homo sapiens
caauccagcuauguuaua

SEQ ID NO: 1150946 - RNA, 17 nt, Homo sapiens
caauccagguacgcaca

SEQ ID NO: 1150947 - RNA, 15 nt, Homo sapiens
caaucccucaaaccu

SEQ ID NO: 1150948 - RNA, 21 nt, Homo sapiens
caauccuagcccucauuuuaa

SEQ ID NO: 1150949 - RNA, 15 nt, Homo sapiens
caauccuagugcuuu

SEQ ID NO: 1150950 - RNA, 20 nt, Homo sapiens
caauccuccuaccucagccu

SEQ ID NO: 1150951 - RNA, 21 nt, Homo sapiens
caaucucgccuuccugcaguc

SEQ ID NO: 1150952 - RNA, 21 nt, Homo sapiens
caaucucguuuagugccaaug

SEQ ID NO: 1150953 - RNA, 12 nt, Homo sapiens
caaucucuuaau

SEQ ID NO: 1150954 - RNA, 15 nt, Homo sapiens
caaucucuugcauuu

SEQ ID NO: 1150955 - RNA, 13 nt, Homo sapiens
caaucugacauuc

SEQ ID NO: 1150956 - RNA, 12 nt, Homo sapiens
caaucuguucua

SEQ ID NO: 1150957 - RNA, 17 nt, Homo sapiens
caaugaacccccaugau

SEQ ID NO: 1150958 - RNA, 21 nt, Homo sapiens
caaugaaggagauagauuugu

SEQ ID NO: 1150959 - RNA, 11 nt, Homo sapiens
caaugacugug

SEQ ID NO: 1150960 - RNA, 19 nt, Homo sapiens
caaugagggagcauguacc

SEQ ID NO: 1150961 - RNA, 18 nt, Homo sapiens
caaugaguggacaaguca

SEQ ID NO: 1150962 - RNA, 20 nt, Homo sapiens
caaugauccuguauucagac

SEQ ID NO: 1150963 - RNA, 12 nt, Homo sapiens
caaugauucagc

SEQ ID NO: 1150964 - RNA, 15 nt, Homo sapiens
caaugccuauaaaau

SEQ ID NO: 1150965 - RNA, 12 nt, Homo sapiens
caaugcugaggu

SEQ ID NO: 1150966 - RNA, 22 nt, Homo sapiens
caauggauauuuguacuguuua

SEQ ID NO: 1150967 - RNA, 17 nt, Homo sapiens
caauggcaggaucucag

SEQ ID NO: 1150968 - RNA, 19 nt, Homo sapiens
caaugggagcugaggccac

SEQ ID NO: 1150969 - RNA, 23 nt, Homo sapiens
caauggugacugauuucaaauca

SEQ ID NO: 1150970 - RNA, 14 nt, Homo sapiens
caauguaagcauac

SEQ ID NO: 1150971 - RNA, 18 nt, Homo sapiens
caauguaccguuuccuua

SEQ ID NO: 1150972 - RNA, 19 nt, Homo sapiens
caauguauugagcauguga

SEQ ID NO: 1150973 - RNA, 15 nt, Homo sapiens
caaugucaaugugaa

SEQ ID NO: 1150974 - RNA, 15 nt, Homo sapiens
caauguccuaaaaag

SEQ ID NO: 1150975 - RNA, 15 nt, Homo sapiens
caaugugcacuucac

SEQ ID NO: 1150976 - RNA, 15 nt, Homo sapiens
caauguuacuaucug

SEQ ID NO: 1150977 - RNA, 13 nt, Homo sapiens
caauguucuauua

SEQ ID NO: 1150978 - RNA, 22 nt, Homo sapiens
caauguuguguguugcacucaa

SEQ ID NO: 1150979 - RNA, 14 nt, Homo sapiens
caauuaaagcaaaa

SEQ ID NO: 1150980 - RNA, 20 nt, Homo sapiens
caauuaacugcccucugaaa

SEQ ID NO: 1150981 - RNA, 17 nt, Homo sapiens
caauuagaacuccugac

SEQ ID NO: 1150982 - RNA, 13 nt, Homo sapiens
caauuagcuccuc

SEQ ID NO: 1150983 - RNA, 13 nt, Homo sapiens
caauucacagccu

SEQ ID NO: 1150984 - RNA, 20 nt, Homo sapiens
caauuccaucagcacaaaga

SEQ ID NO: 1150985 - RNA, 20 nt, Homo sapiens
caauucuguuuuagguuaaa

SEQ ID NO: 1150986 - RNA, 16 nt, Homo sapiens
caauuuaaauuacgua

SEQ ID NO: 1150987 - RNA, 12 nt, Homo sapiens
caauuuacuuuu

SEQ ID NO: 1150988 - RNA, 22 nt, Homo sapiens
caauuucauuuuuggcagucua

SEQ ID NO: 1150989 - RNA, 13 nt, Homo sapiens
caauuucccuuca

SEQ ID NO: 1150990 - RNA, 13 nt, Homo sapiens
caauuugaagaga

SEQ ID NO: 1150991 - RNA, 13 nt, Homo sapiens
caauuugccauug

SEQ ID NO: 1150992 - RNA, 12 nt, Homo sapiens
caauuugggcuu

SEQ ID NO: 1150993 - RNA, 19 nt, Homo sapiens
caauuuguuaagguucaag

SEQ ID NO: 1150994 - RNA, 23 nt, Homo sapiens
caauuuuuuguucuucagagauc

SEQ ID NO: 1150995 - RNA, 12 nt, Homo sapiens
cacaaaacagaa

SEQ ID NO: 1150996 - RNA, 14 nt, Homo sapiens
cacaaaauugggaa

SEQ ID NO: 1150997 - RNA, 14 nt, Homo sapiens
cacaaacggagccc

SEQ ID NO: 1150998 - RNA, 17 nt, Homo sapiens
cacaaagcaaaggcagu

SEQ ID NO: 1150999 - RNA, 15 nt, Homo sapiens
cacaaauaaaagcca

SEQ ID NO: 1151000 - RNA, 18 nt, Homo sapiens
cacaaauuagcuaggcau

SEQ ID NO: 1151001 - RNA, 14 nt, Homo sapiens
cacaacacaguucu

SEQ ID NO: 1151002 - RNA, 16 nt, Homo sapiens
cacaaccacucauuca

SEQ ID NO: 1151003 - RNA, 17 nt, Homo sapiens
cacaacuguugauggua

SEQ ID NO: 1151004 - RNA, 13 nt, Homo sapiens
cacaagagcugga

SEQ ID NO: 1151005 - RNA, 18 nt, Homo sapiens
cacaagguaaauauucau

SEQ ID NO: 1151006 - RNA, 23 nt, Homo sapiens
cacaaggucauggccacacugug

SEQ ID NO: 1151007 - RNA, 19 nt, Homo sapiens
augaguuucuuaacccuuu

SEQ ID NO: 1151008 - RNA, 23 nt, Homo sapiens
augaguuuuuauuuugucucuga

SEQ ID NO: 1151009 - RNA, 18 nt, Homo sapiens
augauaauuauguaaaga

SEQ ID NO: 1151010 - RNA, 18 nt, Homo sapiens
augauaccauuuccugac

SEQ ID NO: 1151011 - RNA, 21 nt, Homo sapiens
augauagaacuuuucuuacua

SEQ ID NO: 1151012 - RNA, 19 nt, Homo sapiens
augauagauuugaccuccu

SEQ ID NO: 1151013 - RNA, 22 nt, Homo sapiens
augauaguuuucuagaugacau

SEQ ID NO: 1151014 - RNA, 22 nt, Homo sapiens
augaucaguguuguugcucuag

SEQ ID NO: 1151015 - RNA, 23 nt, Homo sapiens
augauccaagcaagacugagggg

SEQ ID NO: 1151016 - RNA, 12 nt, Homo sapiens
augaugaugaua

SEQ ID NO: 1151017 - RNA, 14 nt, Homo sapiens
augaugaugaugau

SEQ ID NO: 1151018 - RNA, 18 nt, Homo sapiens
augaugcuagccagcaaa

SEQ ID NO: 1151019 - RNA, 21 nt, Homo sapiens
augaugcuagccagcaaagau

SEQ ID NO: 1151020 - RNA, 16 nt, Homo sapiens
augauggcacugagaa

SEQ ID NO: 1151021 - RNA, 18 nt, Homo sapiens
augaugggcuuuuguucu

SEQ ID NO: 1151022 - RNA, 17 nt, Homo sapiens
augauguaggggccaag

SEQ ID NO: 1151023 - RNA, 18 nt, Homo sapiens
augauguugucacuggug

SEQ ID NO: 1151024 - RNA, 15 nt, Homo sapiens
augauguuuccagau

SEQ ID NO: 1151025 - RNA, 11 nt, Homo sapiens
augauguuucg

SEQ ID NO: 1151026 - RNA, 17 nt, Homo sapiens
augauucuaguacauaa

SEQ ID NO: 1151027 - RNA, 15 nt, Homo sapiens
augauucuccugccu

SEQ ID NO: 1151028 - RNA, 14 nt, Homo sapiens
augauucucugugg

SEQ ID NO: 1151029 - RNA, 16 nt, Homo sapiens
augauuuaauguugau

SEQ ID NO: 1151030 - RNA, 20 nt, Homo sapiens
augauuuauuaaauaaucuc

SEQ ID NO: 1151031 - RNA, 18 nt, Homo sapiens
augauuuuuguguaucca

SEQ ID NO: 1151032 - RNA, 22 nt, Homo sapiens
augauuuuuguguauccaguau

SEQ ID NO: 1151033 - RNA, 17 nt, Homo sapiens
augcaaagaacucacca

SEQ ID NO: 1151034 - RNA, 22 nt, Homo sapiens
augcaaagaaucccuagacuuu

SEQ ID NO: 1151035 - RNA, 19 nt, Homo sapiens
augcaaauccuaugugauu

SEQ ID NO: 1151036 - RNA, 12 nt, Homo sapiens
augcaaccauaa

SEQ ID NO: 1151037 - RNA, 14 nt, Homo sapiens
augcaagaugaacc

SEQ ID NO: 1151038 - RNA, 19 nt, Homo sapiens
augcaagccccaacuuucu

SEQ ID NO: 1151039 - RNA, 14 nt, Homo sapiens
augcaaugugcuac

SEQ ID NO: 1151040 - RNA, 19 nt, Homo sapiens
augcacaaaacuuugauuc

SEQ ID NO: 1151041 - RNA, 14 nt, Homo sapiens
augcacauauggac

SEQ ID NO: 1151042 - RNA, 22 nt, Homo sapiens
augcaccaacccacugcccaug

SEQ ID NO: 1151043 - RNA, 17 nt, Homo sapiens
augcacccauugugauu

SEQ ID NO: 1151044 - RNA, 13 nt, Homo sapiens
augcaccuaccca

SEQ ID NO: 1151045 - RNA, 22 nt, Homo sapiens
augcacuguucccccugugcag

SEQ ID NO: 1151046 - RNA, 15 nt, Homo sapiens
augcagaguugacau

SEQ ID NO: 1151047 - RNA, 13 nt, Homo sapiens
cagaccucaggga

SEQ ID NO: 1151048 - RNA, 23 nt, Homo sapiens
cagaccuuucuuugggacugugu

SEQ ID NO: 1151049 - RNA, 14 nt, Homo sapiens
cagacgaaggcaac

SEQ ID NO: 1151050 - RNA, 21 nt, Homo sapiens
cagacugcggugaacauuucc

SEQ ID NO: 1151051 - RNA, 18 nt, Homo sapiens
cagacuguaggauuugaa

SEQ ID NO: 1151052 - RNA, 15 nt, Homo sapiens
cagacuuguugugac

SEQ ID NO: 1151053 - RNA, 23 nt, Homo sapiens
cagacuuuggaaaaugcauugua

SEQ ID NO: 1151054 - RNA, 17 nt, Homo sapiens
cagacuuuuguuugugu

SEQ ID NO: 1151055 - RNA, 15 nt, Homo sapiens
cagagaaaaugagaa

SEQ ID NO: 1151056 - RNA, 23 nt, Homo sapiens
cagagaaaggggagcccacuguc

SEQ ID NO: 1151057 - RNA, 19 nt, Homo sapiens
cagagaaaguuggugcugc

SEQ ID NO: 1151058 - RNA, 15 nt, Homo sapiens
cagagaaaucugcau

SEQ ID NO: 1151059 - RNA, 17 nt, Homo sapiens
cagagaaccagugcaga

SEQ ID NO: 1151060 - RNA, 13 nt, Homo sapiens
cagagacauacuu

SEQ ID NO: 1151061 - RNA, 16 nt, Homo sapiens
cagagaccauugcaau

SEQ ID NO: 1151062 - RNA, 18 nt, Homo sapiens
cagagacccaagcugccu

SEQ ID NO: 1151063 - RNA, 21 nt, Homo sapiens
cagagacccgagggcugcuuu

SEQ ID NO: 1151064 - RNA, 19 nt, Homo sapiens
cagagaccucccuguucaa

SEQ ID NO: 1151065 - RNA, 19 nt, Homo sapiens
cagagacuggcauuuuccu

SEQ ID NO: 1151066 - RNA, 18 nt, Homo sapiens
cagagacuuuagucuuug

SEQ ID NO: 1151067 - RNA, 15 nt, Homo sapiens
cagagauccaaaaga

SEQ ID NO: 1151068 - RNA, 16 nt, Homo sapiens
cagagaugaucuugcc

SEQ ID NO: 1151069 - RNA, 19 nt, Homo sapiens
cagagauggaugcauguuc

SEQ ID NO: 1151070 - RNA, 19 nt, Homo sapiens
cagagcaagacccaucuca

SEQ ID NO: 1151071 - RNA, 19 nt, Homo sapiens
cagagcauuuaagagugaa

SEQ ID NO: 1151072 - RNA, 17 nt, Homo sapiens
cagagccagugugguca

SEQ ID NO: 1151073 - RNA, 17 nt, Homo sapiens
cagagccucgcucuguu

SEQ ID NO: 1151074 - RNA, 20 nt, Homo sapiens
cagagcgagacuccaucuca

SEQ ID NO: 1151075 - RNA, 20 nt, Homo sapiens
cagagcgagacuccaucucu

SEQ ID NO: 1151076 - RNA, 13 nt, Homo sapiens
cagagcugccucc

SEQ ID NO: 1151077 - RNA, 21 nt, Homo sapiens
cagagcugcuccccucugcac

SEQ ID NO: 1151078 - RNA, 13 nt, Homo sapiens
cagagcuguggug

SEQ ID NO: 1151079 - RNA, 15 nt, Homo sapiens
cagagcuucccugac

SEQ ID NO: 1151080 - RNA, 14 nt, Homo sapiens
cagaggaaguggaa

SEQ ID NO: 1151081 - RNA, 22 nt, Homo sapiens
cagaggagagauagccuguggc

SEQ ID NO: 1151082 - RNA, 22 nt, Homo sapiens
cagaggaggggccgcugccacc

SEQ ID NO: 1151083 - RNA, 14 nt, Homo sapiens
cagaggcaccucaa

SEQ ID NO: 1151084 - RNA, 21 nt, Homo sapiens
cagaggcauuuaaaauggaaa

SEQ ID NO: 1151085 - RNA, 19 nt, Homo sapiens
cagaggccaacacuguggg

SEQ ID NO: 1151086 - RNA, 20 nt, Homo sapiens
cagaggccgcgcguccagcu

SEQ ID NO: 1151087 - RNA, 16 nt, Homo sapiens
cagaggcgucccgcac

SEQ ID NO: 1151088 - RNA, 18 nt, Homo sapiens
cagagggccuuugcuaca

SEQ ID NO: 1151089 - RNA, 20 nt, Homo sapiens
cagagggcguguuguuuuac

SEQ ID NO: 1151090 - RNA, 15 nt, Homo sapiens
cagaggguacuuuaa

SEQ ID NO: 1151091 - RNA, 17 nt, Homo sapiens
cagaggguggguguuca

SEQ ID NO: 1151092 - RNA, 15 nt, Homo sapiens
cagaggugucaucca

SEQ ID NO: 1151093 - RNA, 19 nt, Homo sapiens
cagagguugcagugagcca

SEQ ID NO: 1151094 - RNA, 13 nt, Homo sapiens
cagaguaucagau

SEQ ID NO: 1151095 - RNA, 20 nt, Homo sapiens
cagagugagacuccaucuca

SEQ ID NO: 1151096 - RNA, 14 nt, Homo sapiens
cagagugggaccaa

SEQ ID NO: 1151097 - RNA, 20 nt, Homo sapiens
cagagugggaccaaguccaa

SEQ ID NO: 1151098 - RNA, 23 nt, Homo sapiens
cagaguguguuuuugcacugucu

SEQ ID NO: 1151099 - RNA, 15 nt, Homo sapiens
cagaguguucccuga

SEQ ID NO: 1151100 - RNA, 21 nt, Homo sapiens
cagaguucuauaauguaaaca

SEQ ID NO: 1151101 - RNA, 17 nt, Homo sapiens
cagauaaguguucuuca

SEQ ID NO: 1151102 - RNA, 13 nt, Homo sapiens
cagauaaugugaa

SEQ ID NO: 1151103 - RNA, 14 nt, Homo sapiens
cagauaauuggcaa

SEQ ID NO: 1151104 - RNA, 19 nt, Homo sapiens
cagauacgggggcugugac

SEQ ID NO: 1151105 - RNA, 14 nt, Homo sapiens
cagauacugugagc

SEQ ID NO: 1151106 - RNA, 14 nt, Homo sapiens
cagauagaaagcau

SEQ ID NO: 1151107 - RNA, 22 nt, Homo sapiens
cagaucacuucaggucaggagu

SEQ ID NO: 1151108 - RNA, 17 nt, Homo sapiens
cagaucuaucuugucaa

SEQ ID NO: 1151109 - RNA, 16 nt, Homo sapiens
cagaucuuggacucau

SEQ ID NO: 1151110 - RNA, 20 nt, Homo sapiens
cagaugagaguacaccccaa

SEQ ID NO: 1151111 - RNA, 23 nt, Homo sapiens
cagaugagaguacaccccaacag

SEQ ID NO: 1151112 - RNA, 12 nt, Homo sapiens
cagaugcaauga

SEQ ID NO: 1151113 - RNA, 16 nt, Homo sapiens
cagaugcaaugacuca

SEQ ID NO: 1151114 - RNA, 17 nt, Homo sapiens
cagaugcuccaagauuc

SEQ ID NO: 1151115 - RNA, 20 nt, Homo sapiens
cagauggaaagaggugaaaa

SEQ ID NO: 1151116 - RNA, 13 nt, Homo sapiens
cagaugucccuga

SEQ ID NO: 1151117 - RNA, 20 nt, Homo sapiens
cagaugugagggcaccacca

SEQ ID NO: 1151118 - RNA, 21 nt, Homo sapiens
cagauguugaauucuuuugcc

SEQ ID NO: 1151119 - RNA, 17 nt, Homo sapiens
cagauguuuuggucaag

SEQ ID NO: 1151120 - RNA, 18 nt, Homo sapiens
cagauuacacuccagccu

SEQ ID NO: 1151121 - RNA, 16 nt, Homo sapiens
cagauucgagucacgu

SEQ ID NO: 1151122 - RNA, 15 nt, Homo sapiens
cagauucuucagcuu

SEQ ID NO: 1151123 - RNA, 19 nt, Homo sapiens
cagauugcagaaauacagu

SEQ ID NO: 1151124 - RNA, 22 nt, Homo sapiens
cagauugcagaaauacaguaug

SEQ ID NO: 1151125 - RNA, 13 nt, Homo sapiens
cagauugcaugug

SEQ ID NO: 1151126 - RNA, 16 nt, Homo sapiens
cagauuguaucaugug

SEQ ID NO: 1151127 - RNA, 22 nt, Homo sapiens
cagauuuacaucccagacacau

SEQ ID NO: 1151128 - RNA, 19 nt, Homo sapiens
cagauuuuaacagcucucu

SEQ ID NO: 1151129 - RNA, 15 nt, Homo sapiens
cagauuuuugcaaua

SEQ ID NO: 1151130 - RNA, 14 nt, Homo sapiens
cagcaaaauccaaa

SEQ ID NO: 1151131 - RNA, 13 nt, Homo sapiens
cagcaaacugucc

SEQ ID NO: 1151132 - RNA, 13 nt, Homo sapiens
cagcaacuugaac

SEQ ID NO: 1151133 - RNA, 17 nt, Homo sapiens
cagcaagcaaacagggu

SEQ ID NO: 1151134 - RNA, 16 nt, Homo sapiens
cagcaagccaugcccc

SEQ ID NO: 1151135 - RNA, 23 nt, Homo sapiens
cagcaaggccagaugcacauccc

SEQ ID NO: 1151136 - RNA, 16 nt, Homo sapiens
cagcaagucaggguug

SEQ ID NO: 1151137 - RNA, 13 nt, Homo sapiens
cagcaagucccag

SEQ ID NO: 1151138 - RNA, 20 nt, Homo sapiens
cagcaauucuccugccucag

SEQ ID NO: 1151139 - RNA, 14 nt, Homo sapiens
cagcacaaacacaa

SEQ ID NO: 1151140 - RNA, 19 nt, Homo sapiens
cagcacaagauacacguca

SEQ ID NO: 1151141 - RNA, 14 nt, Homo sapiens
cagcacaaggccau

SEQ ID NO: 1151142 - RNA, 23 nt, Homo sapiens
cagcacacacuuccauaugucau

SEQ ID NO: 1151143 - RNA, 21 nt, Homo sapiens
cagcacagcgaagacugcuaa

SEQ ID NO: 1151144 - RNA, 16 nt, Homo sapiens
cagcacauugauaaga

SEQ ID NO: 1151145 - RNA, 18 nt, Homo sapiens
cagcaccccuccuagcaa

SEQ ID NO: 1151146 - RNA, 15 nt, Homo sapiens
cagcacccucuccag

SEQ ID NO: 1151147 - RNA, 17 nt, Homo sapiens
cagcacccucuccagau

SEQ ID NO: 1151148 - RNA, 23 nt, Homo sapiens
cagcaccgccggcuuucagggca

SEQ ID NO: 1151149 - RNA, 19 nt, Homo sapiens
cagcacucccuuuuuuaua

SEQ ID NO: 1151150 - RNA, 12 nt, Homo sapiens
cagcacuuccau

SEQ ID NO: 1151151 - RNA, 13 nt, Homo sapiens
cagcacuuugcaa

SEQ ID NO: 1151152 - RNA, 11 nt, Homo sapiens
cagcacuuugg

SEQ ID NO: 1151153 - RNA, 19 nt, Homo sapiens
cagcacuuugggagaccaa

SEQ ID NO: 1151154 - RNA, 24 nt, Homo sapiens
cagcagaaagguuaguaucaucag

SEQ ID NO: 1151155 - RNA, 17 nt, Homo sapiens
cagcagaacuucugaaa

SEQ ID NO: 1151156 - RNA, 16 nt, Homo sapiens
cagcagaauggaggca

SEQ ID NO: 1151157 - RNA, 12 nt, Homo sapiens
cagcagacugau

SEQ ID NO: 1151158 - RNA, 17 nt, Homo sapiens
cagcagcaaauuuucag

SEQ ID NO: 1151159 - RNA, 14 nt, Homo sapiens
cagcagugccuugu

SEQ ID NO: 1151160 - RNA, 18 nt, Homo sapiens
cagcaguggccuuugcaa

SEQ ID NO: 1151161 - RNA, 17 nt, Homo sapiens
cagcaucaauuccauca

SEQ ID NO: 1151162 - RNA, 22 nt, Homo sapiens
cagcaucaauuccaucagcaca

SEQ ID NO: 1151163 - RNA, 18 nt, Homo sapiens
cagcaucuuuaacacagc

SEQ ID NO: 1151164 - RNA, 13 nt, Homo sapiens
cagcaugccuuca

SEQ ID NO: 1151165 - RNA, 19 nt, Homo sapiens
cagcaugccuucaaaucaa

SEQ ID NO: 1151166 - RNA, 13 nt, Homo sapiens
cagcauguguucu

SEQ ID NO: 1151167 - RNA, 15 nt, Homo sapiens
cagcauuagcuuccu

SEQ ID NO: 1151168 - RNA, 14 nt, Homo sapiens
cagcauugccuagg

SEQ ID NO: 1151169 - RNA, 14 nt, Homo sapiens
cagcauuuccacac

SEQ ID NO: 1151170 - RNA, 20 nt, Homo sapiens
cagcauuuuacuacuuuaaa

SEQ ID NO: 1151171 - RNA, 16 nt, Homo sapiens
cagcauuuuugcacug

SEQ ID NO: 1151172 - RNA, 19 nt, Homo sapiens
cagccaacagcuacaacag

SEQ ID NO: 1151173 - RNA, 14 nt, Homo sapiens
cagccacaacugca

SEQ ID NO: 1151174 - RNA, 16 nt, Homo sapiens
cagccacgaggugcaa

SEQ ID NO: 1151175 - RNA, 17 nt, Homo sapiens
cagccacgaggugcaac

SEQ ID NO: 1151176 - RNA, 18 nt, Homo sapiens
cagccagaggcaccucaa

SEQ ID NO: 1151177 - RNA, 18 nt, Homo sapiens
cagccagaguuggauaag

SEQ ID NO: 1151178 - RNA, 12 nt, Homo sapiens
cagccagugacc

SEQ ID NO: 1151179 - RNA, 14 nt, Homo sapiens
caguuaauuugcac

SEQ ID NO: 1151180 - RNA, 15 nt, Homo sapiens
caguuacauaauuca

SEQ ID NO: 1151181 - RNA, 22 nt, Homo sapiens
caguuacucccuacacugaugc

SEQ ID NO: 1151182 - RNA, 14 nt, Homo sapiens
caguuacugaaauc

SEQ ID NO: 1151183 - RNA, 12 nt, Homo sapiens
caguuacuguga

SEQ ID NO: 1151184 - RNA, 19 nt, Homo sapiens
caguuauuucaaccagcac

SEQ ID NO: 1151185 - RNA, 22 nt, Homo sapiens
ccccugucucggggcuugcccc

SEQ ID NO: 1151186 - RNA, 13 nt, Homo sapiens
ccccugugccucu

SEQ ID NO: 1151187 - RNA, 17 nt, Homo sapiens
ccccugugccuugucac

SEQ ID NO: 1151188 - RNA, 20 nt, Homo sapiens
ccccuuaagcaugcuucuau

SEQ ID NO: 1151189 - RNA, 23 nt, Homo sapiens
ccccuuacugagcgcaagccaca

SEQ ID NO: 1151190 - RNA, 10 nt, Homo sapiens
ccccuugaau

SEQ ID NO: 1151191 - RNA, 22 nt, Homo sapiens
cccggaauccgagauagggugg

SEQ ID NO: 1151192 - RNA, 15 nt, Homo sapiens
cccggagcuuugcaa

SEQ ID NO: 1151193 - RNA, 21 nt, Homo sapiens
cccggcugacccugugcccca

SEQ ID NO: 1151194 - RNA, 18 nt, Homo sapiens
cccggggugguccaaugg

SEQ ID NO: 1151195 - RNA, 18 nt, Homo sapiens
cccgggucucucacuguu

SEQ ID NO: 1151196 - RNA, 19 nt, Homo sapiens
cccguggccuggcaucugu

SEQ ID NO: 1151197 - RNA, 21 nt, Homo sapiens
cccuaaaccaaaaacugaaag

SEQ ID NO: 1151198 - RNA, 17 nt, Homo sapiens
cccuaaagauaggaauu

SEQ ID NO: 1151199 - RNA, 23 nt, Homo sapiens
cccuaaauguacucuugaacuuc

SEQ ID NO: 1151200 - RNA, 18 nt, Homo sapiens
cccuaagcagaccacuga

SEQ ID NO: 1151201 - RNA, 16 nt, Homo sapiens
cccuaaucacaugugc

SEQ ID NO: 1151202 - RNA, 20 nt, Homo sapiens
cccuaaucuuucacuugaaa

SEQ ID NO: 1151203 - RNA, 19 nt, Homo sapiens
cccuaaugcauaagcuuuu

SEQ ID NO: 1151204 - RNA, 22 nt, Homo sapiens
cccuaccguccuccugagccac

SEQ ID NO: 1151205 - RNA, 11 nt, Homo sapiens
cccuaccuaag

SEQ ID NO: 1151206 - RNA, 17 nt, Homo sapiens
cccuagaacaagccacc

SEQ ID NO: 1151207 - RNA, 15 nt, Homo sapiens
cccuaugucucagga

SEQ ID NO: 1151208 - RNA, 17 nt, Homo sapiens
cccucaaaucugaggga

SEQ ID NO: 1151209 - RNA, 18 nt, Homo sapiens
cccucaucuuucuuccaa

SEQ ID NO: 1151210 - RNA, 18 nt, Homo sapiens
cccucauucuacugaaaa

SEQ ID NO: 1151211 - RNA, 22 nt, Homo sapiens
cccucauugcauuuauugcagu

SEQ ID NO: 1151212 - RNA, 22 nt, Homo sapiens
cccuccacaaagcaaaggcagu

SEQ ID NO: 1151213 - RNA, 13 nt, Homo sapiens
cccuccucuccca

SEQ ID NO: 1151214 - RNA, 17 nt, Homo sapiens
cccuccucucccaguga

SEQ ID NO: 1151215 - RNA, 16 nt, Homo sapiens
cccuccuggucuguau

SEQ ID NO: 1151216 - RNA, 15 nt, Homo sapiens
cccucuaacaucucc

SEQ ID NO: 1151217 - RNA, 21 nt, Homo sapiens
cccucuacauggacucagaga

SEQ ID NO: 1151218 - RNA, 18 nt, Homo sapiens
cccucuccaacugccuaa

SEQ ID NO: 1151219 - RNA, 19 nt, Homo sapiens
cccucugucauccucagga

SEQ ID NO: 1151220 - RNA, 13 nt, Homo sapiens
cccucuucccuga

SEQ ID NO: 1151221 - RNA, 12 nt, Homo sapiens
cccucuucugag

SEQ ID NO: 1151222 - RNA, 17 nt, Homo sapiens
cccugaaaacccagaga

SEQ ID NO: 1151223 - RNA, 16 nt, Homo sapiens
cccugaagucuugcau

SEQ ID NO: 1151224 - RNA, 17 nt, Homo sapiens
cccugagaaagcccugu

SEQ ID NO: 1151225 - RNA, 19 nt, Homo sapiens
cccugagauucagauguca

SEQ ID NO: 1151226 - RNA, 17 nt, Homo sapiens
cccugaguuccuagcca

SEQ ID NO: 1151227 - RNA, 20 nt, Homo sapiens
cccugcacucccuccuggag

SEQ ID NO: 1151228 - RNA, 18 nt, Homo sapiens
cccugcccuuggcaccca

SEQ ID NO: 1151229 - RNA, 14 nt, Homo sapiens
cccugccuucacug

SEQ ID NO: 1151230 - RNA, 21 nt, Homo sapiens
cccugcgggugaacaaagcag

SEQ ID NO: 1151231 - RNA, 18 nt, Homo sapiens
cccuggaaggacauccau

SEQ ID NO: 1151232 - RNA, 18 nt, Homo sapiens
cccuggcccuccaugaca

SEQ ID NO: 1151233 - RNA, 22 nt, Homo sapiens
cccuggcgcugugcuagcuuuc

SEQ ID NO: 1151234 - RNA, 23 nt, Homo sapiens
cccugggccuggcagcucagcuu

SEQ ID NO: 1151235 - RNA, 18 nt, Homo sapiens
cccuggguguccccgcug

SEQ ID NO: 1151236 - RNA, 12 nt, Homo sapiens
cccugguccuuc

SEQ ID NO: 1151237 - RNA, 15 nt, Homo sapiens
cccuggugccucuca

SEQ ID NO: 1151238 - RNA, 21 nt, Homo sapiens
cccuggugggccaacaaagaa

SEQ ID NO: 1151239 - RNA, 17 nt, Homo sapiens
cccuguaccugugcacg

SEQ ID NO: 1151240 - RNA, 22 nt, Homo sapiens
cccuguggcucacaguggggcc

SEQ ID NO: 1151241 - RNA, 11 nt, Homo sapiens
cccuguuacaa

SEQ ID NO: 1151242 - RNA, 17 nt, Homo sapiens
cccuuauaauuggugca

SEQ ID NO: 1151243 - RNA, 14 nt, Homo sapiens
cccuucccaguggg

SEQ ID NO: 1151244 - RNA, 12 nt, Homo sapiens
cccuucugcuuu

SEQ ID NO: 1151245 - RNA, 20 nt, Homo sapiens
cccuugacaaagucaagcca

SEQ ID NO: 1151246 - RNA, 18 nt, Homo sapiens
cccuugaggaaacaacag

SEQ ID NO: 1151247 - RNA, 23 nt, Homo sapiens
cccuuggucuuuucuugccuuuu

SEQ ID NO: 1151248 - RNA, 17 nt, Homo sapiens
cccuuuaacucaugagg

SEQ ID NO: 1151249 - RNA, 13 nt, Homo sapiens
cccuuuccacgaa

SEQ ID NO: 1151250 - RNA, 16 nt, Homo sapiens
cccuuuccccagugac

SEQ ID NO: 1151251 - RNA, 14 nt, Homo sapiens
cccuuuucagaaua

SEQ ID NO: 1151252 - RNA, 11 nt, Homo sapiens
cccuuuuccau

SEQ ID NO: 1151253 - RNA, 19 nt, Homo sapiens
ccgaagagugaagggcagu

SEQ ID NO: 1151254 - RNA, 22 nt, Homo sapiens
ccgaaguccagcuuucugcaga

SEQ ID NO: 1151255 - RNA, 19 nt, Homo sapiens
ccgacaccacuccugccag

SEQ ID NO: 1151256 - RNA, 19 nt, Homo sapiens
ccgacucccccaaccaagg

SEQ ID NO: 1151257 - RNA, 19 nt, Homo sapiens
ccgagcggggagccaggaa

SEQ ID NO: 1151258 - RNA, 17 nt, Homo sapiens
ccgcaaaccacacugga

SEQ ID NO: 1151259 - RNA, 12 nt, Homo sapiens
ccgcacaccucu

SEQ ID NO: 1151260 - RNA, 19 nt, Homo sapiens
ccgcaccuguacaguggaa

SEQ ID NO: 1151261 - RNA, 16 nt, Homo sapiens
ccgcauccuagucucu

SEQ ID NO: 1151262 - RNA, 23 nt, Homo sapiens
ccgcgugaucaaagccacacucu

SEQ ID NO: 1151263 - RNA, 12 nt, Homo sapiens
ccgcuacuucca

SEQ ID NO: 1151264 - RNA, 16 nt, Homo sapiens
ccgcucacugaacucc

SEQ ID NO: 1151265 - RNA, 14 nt, Homo sapiens
ccggacacuucuca

SEQ ID NO: 1151266 - RNA, 15 nt, Homo sapiens
ccggacacuucucag

SEQ ID NO: 1151267 - RNA, 19 nt, Homo sapiens
ccggaggaaaauuugacau

SEQ ID NO: 1151268 - RNA, 17 nt, Homo sapiens
ccggaugaaacuucuca

SEQ ID NO: 1151269 - RNA, 15 nt, Homo sapiens
ccggcccugugugca

SEQ ID NO: 1151270 - RNA, 13 nt, Homo sapiens
ccggcuuuccucu

SEQ ID NO: 1151271 - RNA, 18 nt, Homo sapiens
ccgggacccucaggugua

SEQ ID NO: 1151272 - RNA, 16 nt, Homo sapiens
ccggggccagcacuuc

SEQ ID NO: 1151273 - RNA, 17 nt, Homo sapiens
ccgggugugguggcaca

SEQ ID NO: 1151274 - RNA, 15 nt, Homo sapiens
ccggguucuccugau

SEQ ID NO: 1151275 - RNA, 19 nt, Homo sapiens
ccgguguuuuaaguggaaa

SEQ ID NO: 1151276 - RNA, 15 nt, Homo sapiens
ccgguucccagcugc

SEQ ID NO: 1151277 - RNA, 17 nt, Homo sapiens
ccguacaucugcaauau

SEQ ID NO: 1151278 - RNA, 13 nt, Homo sapiens
ccguccauuccag

SEQ ID NO: 1151279 - RNA, 17 nt, Homo sapiens
ccgugaccagugcugcu

SEQ ID NO: 1151280 - RNA, 13 nt, Homo sapiens
ccgugacugcaau

SEQ ID NO: 1151281 - RNA, 18 nt, Homo sapiens
ccgugagccaggcaaagg

SEQ ID NO: 1151282 - RNA, 18 nt, Homo sapiens
ccgugaggcaaugggagc

SEQ ID NO: 1151283 - RNA, 18 nt, Homo sapiens
ccguggcuaagagugucc

SEQ ID NO: 1151284 - RNA, 14 nt, Homo sapiens
ccguggcuuggcau

SEQ ID NO: 1151285 - RNA, 18 nt, Homo sapiens
ccguucugugcacaaaac

SEQ ID NO: 1151286 - RNA, 21 nt, Homo sapiens
ccguuucuuaaaaaacauaua

SEQ ID NO: 1151287 - RNA, 18 nt, Homo sapiens
ccguuuuccccaugacaa

SEQ ID NO: 1151288 - RNA, 12 nt, Homo sapiens
ccguuuugacau

SEQ ID NO: 1151289 - RNA, 11 nt, Homo sapiens
ccguuuugccu

SEQ ID NO: 1151290 - RNA, 16 nt, Homo sapiens
ccuaaaacaguauucu

SEQ ID NO: 1151291 - RNA, 16 nt, Homo sapiens
ccuaaaucacuuugag

SEQ ID NO: 1151292 - RNA, 17 nt, Homo sapiens
ccuaaaugcacagucau

SEQ ID NO: 1151293 - RNA, 17 nt, Homo sapiens
ccuaacacacuccaaga

SEQ ID NO: 1151294 - RNA, 13 nt, Homo sapiens
ccuaacuucuuau

SEQ ID NO: 1151295 - RNA, 18 nt, Homo sapiens
ccugagaucucugcagga

SEQ ID NO: 1151296 - RNA, 21 nt, Homo sapiens
ccugagauucagaugucauuu

SEQ ID NO: 1151297 - RNA, 16 nt, Homo sapiens
ccugagcaacauggug

SEQ ID NO: 1151298 - RNA, 15 nt, Homo sapiens
ccugagcgcaccauc

SEQ ID NO: 1151299 - RNA, 20 nt, Homo sapiens
ccugagguuugccagcauuu

SEQ ID NO: 1151300 - RNA, 22 nt, Homo sapiens
ccugagguuugccagcauuuag

SEQ ID NO: 1151301 - RNA, 20 nt, Homo sapiens
ccugauaggacccauauucc

SEQ ID NO: 1151302 - RNA, 17 nt, Homo sapiens
ccugaucugcacauuuc

SEQ ID NO: 1151303 - RNA, 17 nt, Homo sapiens
ccugauggagagugaga

SEQ ID NO: 1151304 - RNA, 15 nt, Homo sapiens
ccugauuauuuucua

SEQ ID NO: 1151305 - RNA, 17 nt, Homo sapiens
ccugauuuguugggacc

SEQ ID NO: 1151306 - RNA, 13 nt, Homo sapiens
ccugcaaaaucug

SEQ ID NO: 1151307 - RNA, 20 nt, Homo sapiens
ccugcaacacaacauuugug

SEQ ID NO: 1151308 - RNA, 24 nt, Homo sapiens
ccugcaacacaacauuugugucac

SEQ ID NO: 1151309 - RNA, 16 nt, Homo sapiens
ccugcaaucccagcua

SEQ ID NO: 1151310 - RNA, 23 nt, Homo sapiens
ccugcacauucuccugauuugag

SEQ ID NO: 1151311 - RNA, 20 nt, Homo sapiens
ccugcagcuccagucagugu

SEQ ID NO: 1151312 - RNA, 19 nt, Homo sapiens
ccugcagucaucuugacca

SEQ ID NO: 1151313 - RNA, 17 nt, Homo sapiens
ccugccacccauuccau

SEQ ID NO: 1151314 - RNA, 15 nt, Homo sapiens
ccugcccaccuguca

SEQ ID NO: 1151315 - RNA, 19 nt, Homo sapiens
ccugcccagccaccccuca

SEQ ID NO: 1151316 - RNA, 22 nt, Homo sapiens
ccugcccuccucucccgucucg

SEQ ID NO: 1151317 - RNA, 17 nt, Homo sapiens
ccugcccugugccgcac

SEQ ID NO: 1151318 - RNA, 17 nt, Homo sapiens
ccugccgguaaacacgc

SEQ ID NO: 1151319 - RNA, 16 nt, Homo sapiens
ccugccuaaggaagcu

SEQ ID NO: 1151320 - RNA, 14 nt, Homo sapiens
ccugccuacuuccu

SEQ ID NO: 1151321 - RNA, 16 nt, Homo sapiens
ccugccucacuucuuc

SEQ ID NO: 1151322 - RNA, 15 nt, Homo sapiens
cguucugugcacaaa

SEQ ID NO: 1151323 - RNA, 12 nt, Homo sapiens
cguugcuuucac

SEQ ID NO: 1151324 - RNA, 19 nt, Homo sapiens
cguuuaaucccagcacuuu

SEQ ID NO: 1151325 - RNA, 14 nt, Homo sapiens
cguuuagugccaau

SEQ ID NO: 1151326 - RNA, 15 nt, Homo sapiens
cguuucaaaaacaca

SEQ ID NO: 1151327 - RNA, 19 nt, Homo sapiens
cguuucaaaaacacagugu

SEQ ID NO: 1151328 - RNA, 21 nt, Homo sapiens
cguuugagaagaaaacaucua

SEQ ID NO: 1151329 - RNA, 16 nt, Homo sapiens
cuaaaaagaagccaca

SEQ ID NO: 1151330 - RNA, 17 nt, Homo sapiens
cuaaaaagaagccacag

SEQ ID NO: 1151331 - RNA, 13 nt, Homo sapiens
cuaaaaaguauca

SEQ ID NO: 1151332 - RNA, 13 nt, Homo sapiens
cuaaaaaucauga

SEQ ID NO: 1151333 - RNA, 17 nt, Homo sapiens
cuaaaaaucaugagauc

SEQ ID NO: 1151334 - RNA, 18 nt, Homo sapiens
cuaaaaaugcaucuggcu

SEQ ID NO: 1151335 - RNA, 18 nt, Homo sapiens
cuaaaagaaaaaggaacu

SEQ ID NO: 1151336 - RNA, 18 nt, Homo sapiens
cuaaaagaggccuguuca

SEQ ID NO: 1151337 - RNA, 18 nt, Homo sapiens
cuaaaagcacacucaucc

SEQ ID NO: 1151338 - RNA, 18 nt, Homo sapiens
cuaaaaguuguacuucau

SEQ ID NO: 1151339 - RNA, 15 nt, Homo sapiens
cuaaaauacauuuau

SEQ ID NO: 1151340 - RNA, 20 nt, Homo sapiens
cuaaaaugaaguaacacaau

SEQ ID NO: 1151341 - RNA, 11 nt, Homo sapiens
cuaaaauucag

SEQ ID NO: 1151342 - RNA, 12 nt, Homo sapiens
cuaaaauucagg

SEQ ID NO: 1151343 - RNA, 21 nt, Homo sapiens
cuaaaauuguauagaccuaaa

SEQ ID NO: 1151344 - RNA, 22 nt, Homo sapiens
cuaaaauuguaucaaaugugac

SEQ ID NO: 1151345 - RNA, 16 nt, Homo sapiens
cuaaacaaugcugauu

SEQ ID NO: 1151346 - RNA, 15 nt, Homo sapiens
cuaaacaccacguca

SEQ ID NO: 1151347 - RNA, 21 nt, Homo sapiens
cuaaacaccacgucacuucau

SEQ ID NO: 1151348 - RNA, 12 nt, Homo sapiens
cuaaaccaaaaa

SEQ ID NO: 1151349 - RNA, 15 nt, Homo sapiens
cuaaacuacauuuua

SEQ ID NO: 1151350 - RNA, 22 nt, Homo sapiens
cuaaacuguuuauuugcacuau

SEQ ID NO: 1151351 - RNA, 21 nt, Homo sapiens
cuaaagaguuauucaaaugaa

SEQ ID NO: 1151352 - RNA, 15 nt, Homo sapiens
cuaaagcaauaugca

SEQ ID NO: 1151353 - RNA, 18 nt, Homo sapiens
cuaaagccuuaacuaaga

SEQ ID NO: 1151354 - RNA, 23 nt, Homo sapiens
cuaaagugcugggauuacaggcg

SEQ ID NO: 1151355 - RNA, 18 nt, Homo sapiens
cuaaauaaucuuacucua

SEQ ID NO: 1151356 - RNA, 22 nt, Homo sapiens
cuaaauagaaauaaaugauccc

SEQ ID NO: 1151357 - RNA, 16 nt, Homo sapiens
cuaaaugaagugcaaa

SEQ ID NO: 1151358 - RNA, 15 nt, Homo sapiens
cuaaaugcacaguca

SEQ ID NO: 1151359 - RNA, 21 nt, Homo sapiens
cuaaaugcacagucaugugcc

SEQ ID NO: 1151360 - RNA, 15 nt, Homo sapiens
cuaaaugcacugacc

SEQ ID NO: 1151361 - RNA, 17 nt, Homo sapiens
cuaaauggugcuuuaua

SEQ ID NO: 1151362 - RNA, 19 nt, Homo sapiens
cuaaauguaacagucugau

SEQ ID NO: 1151363 - RNA, 21 nt, Homo sapiens
cuaaauuuucugaaacugcau

SEQ ID NO: 1151364 - RNA, 23 nt, Homo sapiens
cuaacacacuuuauaacccaaaa

SEQ ID NO: 1151365 - RNA, 16 nt, Homo sapiens
cuaacacuuaccccau

SEQ ID NO: 1151366 - RNA, 18 nt, Homo sapiens
cuaacagucuagugcaaa

SEQ ID NO: 1151367 - RNA, 16 nt, Homo sapiens
cuaacauauugccaug

SEQ ID NO: 1151368 - RNA, 14 nt, Homo sapiens
cuaaccacuaaugu

SEQ ID NO: 1151369 - RNA, 14 nt, Homo sapiens
cuaacuaaccacau

SEQ ID NO: 1151370 - RNA, 22 nt, Homo sapiens
cuaacucccuccucacacucca

SEQ ID NO: 1151371 - RNA, 11 nt, Homo sapiens
cuaacuccugu

SEQ ID NO: 1151372 - RNA, 16 nt, Homo sapiens
cuaacugucugacuua

SEQ ID NO: 1151373 - RNA, 16 nt, Homo sapiens
cuaagaauaaacucca

SEQ ID NO: 1151374 - RNA, 20 nt, Homo sapiens
cuaagaauaaacuccauuua

SEQ ID NO: 1151375 - RNA, 21 nt, Homo sapiens
cuaagaauguuuugcacugac

SEQ ID NO: 1151376 - RNA, 19 nt, Homo sapiens
cuaagacuaaugcuuucug

SEQ ID NO: 1151377 - RNA, 20 nt, Homo sapiens
cuaagaucucgguuugccaa

SEQ ID NO: 1151378 - RNA, 18 nt, Homo sapiens
cuaagcccccacuacaag

SEQ ID NO: 1151379 - RNA, 21 nt, Homo sapiens
cuaagcccccacuacaaguga

SEQ ID NO: 1151380 - RNA, 16 nt, Homo sapiens
cuaagcgcacauucau

SEQ ID NO: 1151381 - RNA, 20 nt, Homo sapiens
cuaaggaaguaucagcacua

SEQ ID NO: 1151382 - RNA, 20 nt, Homo sapiens
cuaaggcucugagagucuag

SEQ ID NO: 1151383 - RNA, 15 nt, Homo sapiens
cuaagggggaccaug

SEQ ID NO: 1151384 - RNA, 12 nt, Homo sapiens
cuaagucucaac

SEQ ID NO: 1151385 - RNA, 22 nt, Homo sapiens
cuaagucuuauauauuguagau

SEQ ID NO: 1151386 - RNA, 13 nt, Homo sapiens
cuaauaaacagac

SEQ ID NO: 1151387 - RNA, 17 nt, Homo sapiens
cuaauaaacagacuguu

SEQ ID NO: 1151388 - RNA, 16 nt, Homo sapiens
cuaauagucuuugcca

SEQ ID NO: 1151389 - RNA, 18 nt, Homo sapiens
cuaauaucuuaaugaaua

SEQ ID NO: 1151390 - RNA, 18 nt, Homo sapiens
cuaaucacuccaacccug

SEQ ID NO: 1151391 - RNA, 13 nt, Homo sapiens
cuaaucauaacau

SEQ ID NO: 1151392 - RNA, 18 nt, Homo sapiens
cuaaucauccaaugcuca

SEQ ID NO: 1151393 - RNA, 18 nt, Homo sapiens
cuaaucccaacaagcaag

SEQ ID NO: 1151394 - RNA, 15 nt, Homo sapiens
cuaaucucagcacuu

SEQ ID NO: 1151395 - RNA, 18 nt, Homo sapiens
cuaaucucagcacuuugg

SEQ ID NO: 1151396 - RNA, 15 nt, Homo sapiens
cuaaugaauugaaau

SEQ ID NO: 1151397 - RNA, 15 nt, Homo sapiens
cuaaugagauauauc

SEQ ID NO: 1151398 - RNA, 20 nt, Homo sapiens
cuaaugccuuucaucuugaa

SEQ ID NO: 1151399 - RNA, 13 nt, Homo sapiens
cuaaugcuuuaag

SEQ ID NO: 1151400 - RNA, 18 nt, Homo sapiens
cuaauuauacuacuuugu

SEQ ID NO: 1151401 - RNA, 14 nt, Homo sapiens
cuaauucaacauau

SEQ ID NO: 1151402 - RNA, 21 nt, Homo sapiens
cuaauucuguaggacuuugaa

SEQ ID NO: 1151403 - RNA, 22 nt, Homo sapiens
cuaauuuuucaacuuggaucau

SEQ ID NO: 1151404 - RNA, 18 nt, Homo sapiens
cuaauuuuuuauccuuuu

SEQ ID NO: 1151405 - RNA, 17 nt, Homo sapiens
cuacaaaaccacuggaa

SEQ ID NO: 1151406 - RNA, 13 nt, Homo sapiens
cuacaacauaugg

SEQ ID NO: 1151407 - RNA, 18 nt, Homo sapiens
cuacaaggaaaacaaugu

SEQ ID NO: 1151408 - RNA, 20 nt, Homo sapiens
cuacaagugauccucaggca

SEQ ID NO: 1151409 - RNA, 19 nt, Homo sapiens
cuacaauaaacugguauga

SEQ ID NO: 1151410 - RNA, 19 nt, Homo sapiens
cuacaauccuaccuuuuga

SEQ ID NO: 1151411 - RNA, 13 nt, Homo sapiens
cuacacaacaugu

SEQ ID NO: 1151412 - RNA, 14 nt, Homo sapiens
cuacaccacacaca

SEQ ID NO: 1151413 - RNA, 22 nt, Homo sapiens
cuacacuggguucugcuacucc

SEQ ID NO: 1151414 - RNA, 18 nt, Homo sapiens
cuacagaaagcacaaaga

SEQ ID NO: 1151415 - RNA, 16 nt, Homo sapiens
cuacagcauauucuuc

SEQ ID NO: 1151416 - RNA, 18 nt, Homo sapiens
cuacaggaggaacagugg

SEQ ID NO: 1151417 - RNA, 18 nt, Homo sapiens
cuacaggauuugaaauug

SEQ ID NO: 1151418 - RNA, 13 nt, Homo sapiens
cuacauaccucau

SEQ ID NO: 1151419 - RNA, 21 nt, Homo sapiens
cuacauauucuuuaaauuuca

SEQ ID NO: 1151420 - RNA, 13 nt, Homo sapiens
cuacaucagccuu

SEQ ID NO: 1151421 - RNA, 14 nt, Homo sapiens
cuacaugugcugga

SEQ ID NO: 1151422 - RNA, 18 nt, Homo sapiens
cuacauguguuugaacua

SEQ ID NO: 1151423 - RNA, 19 nt, Homo sapiens
cuacauuuugcucugugaa

SEQ ID NO: 1151424 - RNA, 13 nt, Homo sapiens
cuaccaagauaua

SEQ ID NO: 1151425 - RNA, 19 nt, Homo sapiens
cucaaccaccuaggcaaug

SEQ ID NO: 1151426 - RNA, 23 nt, Homo sapiens
cucaaccaccuaggcaaugaaga

SEQ ID NO: 1151427 - RNA, 13 nt, Homo sapiens
cucaacucugucc

SEQ ID NO: 1151428 - RNA, 18 nt, Homo sapiens
cucaagaaacaacuucua

SEQ ID NO: 1151429 - RNA, 23 nt, Homo sapiens
cucaagaaauaaaaggaagccaa

SEQ ID NO: 1151430 - RNA, 14 nt, Homo sapiens
cucaagaauuuaau

SEQ ID NO: 1151431 - RNA, 22 nt, Homo sapiens
cucaagacuuauggaacaggga

SEQ ID NO: 1151432 - RNA, 23 nt, Homo sapiens
cucaagcccgcggggacauuggg

SEQ ID NO: 1151433 - RNA, 20 nt, Homo sapiens
cucaaguauaugucauuuac

SEQ ID NO: 1151434 - RNA, 13 nt, Homo sapiens
cucaagugagcca

SEQ ID NO: 1151435 - RNA, 20 nt, Homo sapiens
cucaagugagccaagaaaca

SEQ ID NO: 1151436 - RNA, 15 nt, Homo sapiens
cucaaguuccagugc

SEQ ID NO: 1151437 - RNA, 17 nt, Homo sapiens
cucaaguuccagugcag

SEQ ID NO: 1151438 - RNA, 19 nt, Homo sapiens
cucaaguucuaagauucua

SEQ ID NO: 1151439 - RNA, 15 nt, Homo sapiens
cucaauaaaucuuug

SEQ ID NO: 1151440 - RNA, 23 nt, Homo sapiens
cucacaaugucccuucagcaccu

SEQ ID NO: 1151441 - RNA, 16 nt, Homo sapiens
cucacacccuaccuuc

SEQ ID NO: 1151442 - RNA, 13 nt, Homo sapiens
cucacaccuguaa

SEQ ID NO: 1151443 - RNA, 17 nt, Homo sapiens
cucacaccuguaauccc

SEQ ID NO: 1151444 - RNA, 19 nt, Homo sapiens
cucacaccuguaaucccag

SEQ ID NO: 1151445 - RNA, 20 nt, Homo sapiens
cucacaccuguaaucccagc

SEQ ID NO: 1151446 - RNA, 20 nt, Homo sapiens
cucacauacccucacuuaaa

SEQ ID NO: 1151447 - RNA, 13 nt, Homo sapiens
cucacauuggcaa

SEQ ID NO: 1151448 - RNA, 21 nt, Homo sapiens
cucacauuuggggcuagacag

SEQ ID NO: 1151449 - RNA, 12 nt, Homo sapiens
cucacccaugca

SEQ ID NO: 1151450 - RNA, 20 nt, Homo sapiens
cucaccccgaggcccugcau

SEQ ID NO: 1151451 - RNA, 15 nt, Homo sapiens
cucacccuccacaaa

SEQ ID NO: 1151452 - RNA, 19 nt, Homo sapiens
cucacccuccacaaagcaa

SEQ ID NO: 1151453 - RNA, 19 nt, Homo sapiens
cucacgcccuaagcgcaca

SEQ ID NO: 1151454 - RNA, 18 nt, Homo sapiens
cucacgcuucacagugau

SEQ ID NO: 1151455 - RNA, 17 nt, Homo sapiens
cucacgucuguaauccc

SEQ ID NO: 1151456 - RNA, 15 nt, Homo sapiens
cucacuaguugucag

SEQ ID NO: 1151457 - RNA, 15 nt, Homo sapiens
cucacuccaccaccc

SEQ ID NO: 1151458 - RNA, 15 nt, Homo sapiens
gaaagacauccauaa

SEQ ID NO: 1151459 - RNA, 20 nt, Homo sapiens
gaaagacuuucucugccccu

SEQ ID NO: 1151460 - RNA, 21 nt, Homo sapiens
gaaagaguaaaggaaaugauu

SEQ ID NO: 1151461 - RNA, 22 nt, Homo sapiens
gaaagaguuuccgaagagugaa

SEQ ID NO: 1151462 - RNA, 21 nt, Homo sapiens
gaaagauuagugauucaucuu

SEQ ID NO: 1151463 - RNA, 21 nt, Homo sapiens
gaaagcaacuuuacugagaca

SEQ ID NO: 1151464 - RNA, 22 nt, Homo sapiens
gaaagcaugucucugcuuccau

SEQ ID NO: 1151465 - RNA, 18 nt, Homo sapiens
gaaagcauuuucucucau

SEQ ID NO: 1151466 - RNA, 14 nt, Homo sapiens
gaaagccucaguga

SEQ ID NO: 1151467 - RNA, 17 nt, Homo sapiens
gaaagccucagugaaac

SEQ ID NO: 1151468 - RNA, 23 nt, Homo sapiens
gaaagccucucaguacagcacuc

SEQ ID NO: 1151469 - RNA, 17 nt, Homo sapiens
gaaagcugacaucugua

SEQ ID NO: 1151470 - RNA, 23 nt, Homo sapiens
gaaagcuugagucucaagggugg

SEQ ID NO: 1151471 - RNA, 14 nt, Homo sapiens
gaaaggaacauuuu

SEQ ID NO: 1151472 - RNA, 13 nt, Homo sapiens
gaaaggagacaau

SEQ ID NO: 1151473 - RNA, 13 nt, Homo sapiens
gaaagggacugag

SEQ ID NO: 1151474 - RNA, 18 nt, Homo sapiens
gaaaggguuuuuaaucuc

SEQ ID NO: 1151475 - RNA, 19 nt, Homo sapiens
gaaaggguuuuuaaucucc

SEQ ID NO: 1151476 - RNA, 22 nt, Homo sapiens
gaaagucagcugaaggaugguu

SEQ ID NO: 1151477 - RNA, 15 nt, Homo sapiens
gaaagugcuuuccag

SEQ ID NO: 1151478 - RNA, 19 nt, Homo sapiens
gaaaguuaauccacuguga

SEQ ID NO: 1151479 - RNA, 14 nt, Homo sapiens
gaaaguucaaaaag

SEQ ID NO: 1151480 - RNA, 18 nt, Homo sapiens
gaaaguucagaguuuucu

SEQ ID NO: 1151481 - RNA, 21 nt, Homo sapiens
gaaauaaaaaaaaauuuuaag

SEQ ID NO: 1151482 - RNA, 19 nt, Homo sapiens
gaaauaaaggaugugauug

SEQ ID NO: 1151483 - RNA, 19 nt, Homo sapiens
gaaauaacaagucgaugaa

SEQ ID NO: 1151484 - RNA, 23 nt, Homo sapiens
gaaauacacagugcugaccagac

SEQ ID NO: 1151485 - RNA, 19 nt, Homo sapiens
gaaauaccaacugaaguca

SEQ ID NO: 1151486 - RNA, 18 nt, Homo sapiens
gaaauaguuacuauuuca

SEQ ID NO: 1151487 - RNA, 23 nt, Homo sapiens
gaaaucauaggguucugaucaca

SEQ ID NO: 1151488 - RNA, 19 nt, Homo sapiens
gaaaucuauagaacugaau

SEQ ID NO: 1151489 - RNA, 16 nt, Homo sapiens
gaaaugaaugcugauu

SEQ ID NO: 1151490 - RNA, 14 nt, Homo sapiens
gaaaugagcaggga

SEQ ID NO: 1151491 - RNA, 22 nt, Homo sapiens
gaaauguauuuugaaaacacuu

SEQ ID NO: 1151492 - RNA, 18 nt, Homo sapiens
gaaauguuugcugaguua

SEQ ID NO: 1151493 - RNA, 13 nt, Homo sapiens
gaaauuaaccaua

SEQ ID NO: 1151494 - RNA, 20 nt, Homo sapiens
gaaauuaacucagacacaaa

SEQ ID NO: 1151495 - RNA, 16 nt, Homo sapiens
gaaauuaagaaggcaa

SEQ ID NO: 1151496 - RNA, 11 nt, Homo sapiens
gaaauuacuua

SEQ ID NO: 1151497 - RNA, 18 nt, Homo sapiens
gaaauuccaguugcaauu

SEQ ID NO: 1151498 - RNA, 16 nt, Homo sapiens
gaaauugacagaucaa

SEQ ID NO: 1151499 - RNA, 21 nt, Homo sapiens
gaaauuguugcuuuguuucuc

SEQ ID NO: 1151500 - RNA, 20 nt, Homo sapiens
gaaauuuacugugagacugu

SEQ ID NO: 1151501 - RNA, 11 nt, Homo sapiens
gaaauuuugcc

SEQ ID NO: 1151502 - RNA, 12 nt, Homo sapiens
gaaauuuugccu

SEQ ID NO: 1151503 - RNA, 19 nt, Homo sapiens
gaacaaaaauuacaaagaa

SEQ ID NO: 1151504 - RNA, 17 nt, Homo sapiens
gaacaagcaaacccaga

SEQ ID NO: 1151505 - RNA, 15 nt, Homo sapiens
gaacaauauugacuu

SEQ ID NO: 1151506 - RNA, 23 nt, Homo sapiens
gaacacacaccaguuuacaggaa

SEQ ID NO: 1151507 - RNA, 13 nt, Homo sapiens
gaacacacugaga

SEQ ID NO: 1151508 - RNA, 22 nt, Homo sapiens
gaacacacugagacuugaauca

SEQ ID NO: 1151509 - RNA, 18 nt, Homo sapiens
gaacaccagcagcacugg

SEQ ID NO: 1151510 - RNA, 17 nt, Homo sapiens
gaacagaggcauuuaaa

SEQ ID NO: 1151511 - RNA, 14 nt, Homo sapiens
gaacaggcagaaau

SEQ ID NO: 1151512 - RNA, 15 nt, Homo sapiens
gaacauaacuucuca

SEQ ID NO: 1151513 - RNA, 19 nt, Homo sapiens
gaacaucauaacccaugaa

SEQ ID NO: 1151514 - RNA, 12 nt, Homo sapiens
gaacaugcaguu

SEQ ID NO: 1151515 - RNA, 23 nt, Homo sapiens
uuguaaauuauauuugugcuaua

SEQ ID NO: 1151516 - RNA, 15 nt, Homo sapiens
uuguacaauacuugc

SEQ ID NO: 1151517 - RNA, 22 nt, Homo sapiens
uuguacguucugcaaaacauuu

SEQ ID NO: 1151518 - RNA, 20 nt, Homo sapiens
uuguacuccagccugggcaa

SEQ ID NO: 1151519 - RNA, 11 nt, Homo sapiens
uuguacuggau

SEQ ID NO: 1151520 - RNA, 18 nt, Homo sapiens
uuguacuucuguaccugu

SEQ ID NO: 1151521 - RNA, 23 nt, Homo sapiens
uuguagaaauuaacaaaugugcu

SEQ ID NO: 1151522 - RNA, 18 nt, Homo sapiens
uuguagcaagaugagcaa

SEQ ID NO: 1151523 - RNA, 17 nt, Homo sapiens
uuguagugagcccagau

SEQ ID NO: 1151524 - RNA, 20 nt, Homo sapiens
uuguaucaaaugugacauua

SEQ ID NO: 1151525 - RNA, 15 nt, Homo sapiens
uuguaucaugugcua

SEQ ID NO: 1151526 - RNA, 14 nt, Homo sapiens
uuguaucugaagac

SEQ ID NO: 1151527 - RNA, 17 nt, Homo sapiens
uuguauuaucaacagca

SEQ ID NO: 1151528 - RNA, 16 nt, Homo sapiens
uuguauucauguucau

SEQ ID NO: 1151529 - RNA, 13 nt, Homo sapiens
uuguauuguggaa

SEQ ID NO: 1151530 - RNA, 19 nt, Homo sapiens
uuguauuuuaauaguacau

SEQ ID NO: 1151531 - RNA, 20 nt, Homo sapiens
uuguauuuuuuuucuuguau

SEQ ID NO: 1151532 - RNA, 13 nt, Homo sapiens
uugucaaagaagg

SEQ ID NO: 1151533 - RNA, 18 nt, Homo sapiens
uugucacccaaagccugu

SEQ ID NO: 1151534 - RNA, 19 nt, Homo sapiens
uuguccuccugauccugac

SEQ ID NO: 1151535 - RNA, 22 nt, Homo sapiens
uugucuacauuaaaucacuuga

SEQ ID NO: 1151536 - RNA, 17 nt, Homo sapiens
uugucucccagcucagg

SEQ ID NO: 1151537 - RNA, 13 nt, Homo sapiens
uugucuguuuauu

SEQ ID NO: 1151538 - RNA, 15 nt, Homo sapiens
uugucuuacuggcaa

SEQ ID NO: 1151539 - RNA, 17 nt, Homo sapiens
uugucuuuacuccauga

SEQ ID NO: 1151540 - RNA, 23 nt, Homo sapiens
uugugagaugauuuguacuugga

SEQ ID NO: 1151541 - RNA, 19 nt, Homo sapiens
uugugagccuugcugccaa

SEQ ID NO: 1151542 - RNA, 15 nt, Homo sapiens
uugugauuguggaag

SEQ ID NO: 1151543 - RNA, 23 nt, Homo sapiens
uugugcuuaguccaauuccuugc

SEQ ID NO: 1151544 - RNA, 16 nt, Homo sapiens
uuguggauaacaaaga

SEQ ID NO: 1151545 - RNA, 14 nt, Homo sapiens
uuguggugcauuga

SEQ ID NO: 1151546 - RNA, 14 nt, Homo sapiens
uugugucacuguac

SEQ ID NO: 1151547 - RNA, 15 nt, Homo sapiens
uugugugucaugcca

SEQ ID NO: 1151548 - RNA, 13 nt, Homo sapiens
uuguguguucuaa

SEQ ID NO: 1151549 - RNA, 14 nt, Homo sapiens
uuguguuucuguuc

SEQ ID NO: 1151550 - RNA, 18 nt, Homo sapiens
uuguuaucagauauguga

SEQ ID NO: 1151551 - RNA, 19 nt, Homo sapiens
uuguuaugaaaaugcuguu

SEQ ID NO: 1151552 - RNA, 13 nt, Homo sapiens
uuguucacacucc

SEQ ID NO: 1151553 - RNA, 15 nt, Homo sapiens
uuguugagaguguga

SEQ ID NO: 1151554 - RNA, 14 nt, Homo sapiens
uuguugcugcugcu

SEQ ID NO: 1151555 - RNA, 16 nt, Homo sapiens
uuguugcugcugcugc

SEQ ID NO: 1151556 - RNA, 13 nt, Homo sapiens
uuguuucuacuuu

SEQ ID NO: 1151557 - RNA, 13 nt, Homo sapiens
uuguuucuugaua

SEQ ID NO: 1151558 - RNA, 18 nt, Homo sapiens
uuguuuucuguucuccuu

SEQ ID NO: 1151559 - RNA, 17 nt, Homo sapiens
uuguuuuucucucuucc

SEQ ID NO: 1151560 - RNA, 20 nt, Homo sapiens
uuuaaaaaaaaauugaacaa

SEQ ID NO: 1151561 - RNA, 23 nt, Homo sapiens
uuuaaaaaagaaauuaucuuuag

SEQ ID NO: 1151562 - RNA, 17 nt, Homo sapiens
uuuaaaaagugugcuua

SEQ ID NO: 1151563 - RNA, 21 nt, Homo sapiens
acucagcucugucugcucaau

SEQ ID NO: 1151564 - RNA, 18 nt, Homo sapiens
acucagcucuuggcucca

SEQ ID NO: 1151565 - RNA, 13 nt, Homo sapiens
acucaggacaucc

SEQ ID NO: 1151566 - RNA, 16 nt, Homo sapiens
acucaggcccaaagcc

SEQ ID NO: 1151567 - RNA, 20 nt, Homo sapiens
acucaggcgggcaccaaggc

SEQ ID NO: 1151568 - RNA, 13 nt, Homo sapiens
acucagggcuccu

SEQ ID NO: 1151569 - RNA, 21 nt, Homo sapiens
acucagugauugcaauuugca

SEQ ID NO: 1151570 - RNA, 14 nt, Homo sapiens
acucagugcagaug

SEQ ID NO: 1151571 - RNA, 17 nt, Homo sapiens
acucaucacuguggcug

SEQ ID NO: 1151572 - RNA, 23 nt, Homo sapiens
acucaucuuuagagcaacaguaa

SEQ ID NO: 1151573 - RNA, 21 nt, Homo sapiens
acucaucuuuauccuaaaaau

SEQ ID NO: 1151574 - RNA, 21 nt, Homo sapiens
acucaugacugagucuggcaa

SEQ ID NO: 1151575 - RNA, 19 nt, Homo sapiens
acucaugugacucuuucca

SEQ ID NO: 1151576 - RNA, 16 nt, Homo sapiens
acuccaaaaagacaag

SEQ ID NO: 1151577 - RNA, 14 nt, Homo sapiens
acuccaaccucucg

SEQ ID NO: 1151578 - RNA, 12 nt, Homo sapiens
acuccaacugaa

SEQ ID NO: 1151579 - RNA, 20 nt, Homo sapiens
acuccagccugagugacaga

SEQ ID NO: 1151580 - RNA, 18 nt, Homo sapiens
acuccagccugggugaca

SEQ ID NO: 1151581 - RNA, 19 nt, Homo sapiens
acuccagccugggugacaa

SEQ ID NO: 1151582 - RNA, 17 nt, Homo sapiens
acuccauuuaaaaaaca

SEQ ID NO: 1151583 - RNA, 20 nt, Homo sapiens
acucccaccagcaccgugac

SEQ ID NO: 1151584 - RNA, 15 nt, Homo sapiens
acucccauuccugaa

SEQ ID NO: 1151585 - RNA, 17 nt, Homo sapiens
acucccuccuucuuuua

SEQ ID NO: 1151586 - RNA, 21 nt, Homo sapiens
acucccucguuaaucacagga

SEQ ID NO: 1151587 - RNA, 20 nt, Homo sapiens
acuccucacacuuacuguaa

SEQ ID NO: 1151588 - RNA, 23 nt, Homo sapiens
acuccuggucuccuccggggaug

SEQ ID NO: 1151589 - RNA, 16 nt, Homo sapiens
acucgccaacauggug

SEQ ID NO: 1151590 - RNA, 17 nt, Homo sapiens
acucgcugaugaguuaa

SEQ ID NO: 1151591 - RNA, 21 nt, Homo sapiens
acucguauagcaugcaucugu

SEQ ID NO: 1151592 - RNA, 19 nt, Homo sapiens
acucuaaagccaagcacuu

SEQ ID NO: 1151593 - RNA, 17 nt, Homo sapiens
acucuaggcagugacag

SEQ ID NO: 1151594 - RNA, 18 nt, Homo sapiens
acucuaucaaaugugaug

SEQ ID NO: 1151595 - RNA, 16 nt, Homo sapiens
acucuccacaaaaacu

SEQ ID NO: 1151596 - RNA, 20 nt, Homo sapiens
acucuccagacaucaccaac

SEQ ID NO: 1151597 - RNA, 20 nt, Homo sapiens
acucuccugugaacacugga

SEQ ID NO: 1151598 - RNA, 11 nt, Homo sapiens
acucucugaac

SEQ ID NO: 1151599 - RNA, 15 nt, Homo sapiens
gaagggcaauaucua

SEQ ID NO: 1151600 - RNA, 17 nt, Homo sapiens
gaagggcgagugaaucu

SEQ ID NO: 1151601 - RNA, 15 nt, Homo sapiens
gaaggggacaauggc

SEQ ID NO: 1151602 - RNA, 14 nt, Homo sapiens
gaaggggcuaggga

SEQ ID NO: 1151603 - RNA, 17 nt, Homo sapiens
gaagggggagcugggga

SEQ ID NO: 1151604 - RNA, 13 nt, Homo sapiens
gaagggguggcug

SEQ ID NO: 1151605 - RNA, 14 nt, Homo sapiens
gaagguacugucau

SEQ ID NO: 1151606 - RNA, 15 nt, Homo sapiens
gaaggucccucagac

SEQ ID NO: 1151607 - RNA, 14 nt, Homo sapiens
gaaggugacuuugg

SEQ ID NO: 1151608 - RNA, 16 nt, Homo sapiens
gaagguguucaaacac

SEQ ID NO: 1151609 - RNA, 15 nt, Homo sapiens
gaagguuacuaccua

SEQ ID NO: 1151610 - RNA, 22 nt, Homo sapiens
gaagguuaugcuccuggcacag

SEQ ID NO: 1151611 - RNA, 18 nt, Homo sapiens
gaagguugacacaggaaa

SEQ ID NO: 1151612 - RNA, 22 nt, Homo sapiens
gaagguuggcgggggcacgugu

SEQ ID NO: 1151613 - RNA, 20 nt, Homo sapiens
gaagguuggugaauuucaca

SEQ ID NO: 1151614 - RNA, 18 nt, Homo sapiens
gaagguuuucauuugcca

SEQ ID NO: 1151615 - RNA, 13 nt, Homo sapiens
gaaguacuucccu

SEQ ID NO: 1151616 - RNA, 16 nt, Homo sapiens
gaagucaucucauucc

SEQ ID NO: 1151617 - RNA, 14 nt, Homo sapiens
gaagucccaagacc

SEQ ID NO: 1151618 - RNA, 12 nt, Homo sapiens
gaagucccucag

SEQ ID NO: 1151619 - RNA, 17 nt, Homo sapiens
gaaguccuucaccucac

SEQ ID NO: 1151620 - RNA, 18 nt, Homo sapiens
gaagucuaaaagcagaaa

SEQ ID NO: 1151621 - RNA, 16 nt, Homo sapiens
gaagucuagaguuccu

SEQ ID NO: 1151622 - RNA, 22 nt, Homo sapiens
gaagugagccagcaguggccuu

SEQ ID NO: 1151623 - RNA, 15 nt, Homo sapiens
gaagugaggacaaaa

SEQ ID NO: 1151624 - RNA, 17 nt, Homo sapiens
gaagugcagaggcagac

SEQ ID NO: 1151625 - RNA, 17 nt, Homo sapiens
gaagugcagcagguuaa

SEQ ID NO: 1151626 - RNA, 19 nt, Homo sapiens
gaagugcuggcaaccacua

SEQ ID NO: 1151627 - RNA, 15 nt, Homo sapiens
gaaguggacauucua

SEQ ID NO: 1151628 - RNA, 18 nt, Homo sapiens
gaaguggagaggguguca

SEQ ID NO: 1151629 - RNA, 22 nt, Homo sapiens
gaaguggagagggugucaucua

SEQ ID NO: 1151630 - RNA, 16 nt, Homo sapiens
gaagugguucagucua

SEQ ID NO: 1151631 - RNA, 18 nt, Homo sapiens
gaaguguaagaaacacac

SEQ ID NO: 1151632 - RNA, 18 nt, Homo sapiens
gaaguguaguaugcugua

SEQ ID NO: 1151633 - RNA, 20 nt, Homo sapiens
gaaguguguccauccugacc

SEQ ID NO: 1151634 - RNA, 19 nt, Homo sapiens
gaaguuaggucauuacuaa

SEQ ID NO: 1151635 - RNA, 21 nt, Homo sapiens
gaaguugacaggcagugccau

SEQ ID NO: 1151636 - RNA, 20 nt, Homo sapiens
gaaguuucuguugcuguuaa

SEQ ID NO: 1151637 - RNA, 17 nt, Homo sapiens
gaauaaaaguuccucuc

SEQ ID NO: 1151638 - RNA, 21 nt, Homo sapiens
gaauaaacacugguuguaguc

SEQ ID NO: 1151639 - RNA, 21 nt, Homo sapiens
gaauaaaccaucaucuugcca

SEQ ID NO: 1151640 - RNA, 16 nt, Homo sapiens
gaauaaacuccauuua

SEQ ID NO: 1151641 - RNA, 19 nt, Homo sapiens
gaauaaguaccuuuguguc

SEQ ID NO: 1151642 - RNA, 17 nt, Homo sapiens
gaauaauaguaugagua

SEQ ID NO: 1151643 - RNA, 14 nt, Homo sapiens
gaauaaucacuugg

SEQ ID NO: 1151644 - RNA, 19 nt, Homo sapiens
gaauaaugggcauugagau

SEQ ID NO: 1151645 - RNA, 23 nt, Homo sapiens
gaauacagcuuucugaccuucag

SEQ ID NO: 1151646 - RNA, 18 nt, Homo sapiens
gaauacuuacauucucua

SEQ ID NO: 1151647 - RNA, 17 nt, Homo sapiens
gaauacuuuuaauuuca

SEQ ID NO: 1151648 - RNA, 23 nt, Homo sapiens
gaauagaaauaaaggaugugauu

SEQ ID NO: 1151649 - RNA, 16 nt, Homo sapiens
gaauaguaauuuagaa

SEQ ID NO: 1151650 - RNA, 19 nt, Homo sapiens
gaauaugcauugucugcaa

SEQ ID NO: 1151651 - RNA, 13 nt, Homo sapiens
gaauauggacaua

SEQ ID NO: 1151652 - RNA, 19 nt, Homo sapiens
gaauauguguggcagugaa

SEQ ID NO: 1151653 - RNA, 21 nt, Homo sapiens
gaauauuguuucuuuaucacc

SEQ ID NO: 1151654 - RNA, 12 nt, Homo sapiens
gaauauuugaau

SEQ ID NO: 1151655 - RNA, 20 nt, Homo sapiens
gaaucaaaagugccucaaga

SEQ ID NO: 1151656 - RNA, 16 nt, Homo sapiens
gaaucaaaugcaauuu

SEQ ID NO: 1151657 - RNA, 20 nt, Homo sapiens
gaaucaagucagcaacagag

SEQ ID NO: 1151658 - RNA, 20 nt, Homo sapiens
gaaucagauuuuaacagcuc

SEQ ID NO: 1151659 - RNA, 20 nt, Homo sapiens
ccuucuucuuagcaccacaa

SEQ ID NO: 1151660 - RNA, 21 nt, Homo sapiens
ccuucuuggaguuacaacaga

SEQ ID NO: 1151661 - RNA, 23 nt, Homo sapiens
ccuucuugguuuccaaaggcauu

SEQ ID NO: 1151662 - RNA, 13 nt, Homo sapiens
ccuugaagacaga

SEQ ID NO: 1151663 - RNA, 18 nt, Homo sapiens
ccuugacaaagucaagcc

SEQ ID NO: 1151664 - RNA, 20 nt, Homo sapiens
ccuugcauccaucugggcua

SEQ ID NO: 1151665 - RNA, 18 nt, Homo sapiens
ccuugcauguaaaaaccu

SEQ ID NO: 1151666 - RNA, 13 nt, Homo sapiens
ccuugcccagaga

SEQ ID NO: 1151667 - RNA, 18 nt, Homo sapiens
ccuugcccccauuucacc

SEQ ID NO: 1151668 - RNA, 13 nt, Homo sapiens
ccuugcuggcgcu

SEQ ID NO: 1151669 - RNA, 13 nt, Homo sapiens
ccuuggauaccua

SEQ ID NO: 1151670 - RNA, 17 nt, Homo sapiens
ccuuggcacccaagacc

SEQ ID NO: 1151671 - RNA, 15 nt, Homo sapiens
ccuuggcuuguuauu

SEQ ID NO: 1151672 - RNA, 22 nt, Homo sapiens
ccuuggcuuuuacugaagccuu

SEQ ID NO: 1151673 - RNA, 19 nt, Homo sapiens
ccuugggcagaaugaauuc

SEQ ID NO: 1151674 - RNA, 17 nt, Homo sapiens
ccuugggcagggucucu

SEQ ID NO: 1151675 - RNA, 17 nt, Homo sapiens
ccuugguaucauuuucu

SEQ ID NO: 1151676 - RNA, 16 nt, Homo sapiens
ccuuguacccuggcua

SEQ ID NO: 1151677 - RNA, 16 nt, Homo sapiens
ccuuguccucagccag

SEQ ID NO: 1151678 - RNA, 13 nt, Homo sapiens
ccuugugccuugg

SEQ ID NO: 1151679 - RNA, 12 nt, Homo sapiens
ccuuuaccccau

SEQ ID NO: 1151680 - RNA, 21 nt, Homo sapiens
ccuuuaccuuuuaugcaaaag

SEQ ID NO: 1151681 - RNA, 23 nt, Homo sapiens
ccuuuccagaguccuccuuugcc

SEQ ID NO: 1151682 - RNA, 11 nt, Homo sapiens
ccuuuccugug

SEQ ID NO: 1151683 - RNA, 18 nt, Homo sapiens
ccuuucuccuuuguacuu

SEQ ID NO: 1151684 - RNA, 21 nt, Homo sapiens
ccuuucucuccagccugacuu

SEQ ID NO: 1151685 - RNA, 22 nt, Homo sapiens
ccuuucuuucuaacuccaguga

SEQ ID NO: 1151686 - RNA, 22 nt, Homo sapiens
ccuuugaaguagacucauucuu

SEQ ID NO: 1151687 - RNA, 17 nt, Homo sapiens
cuguuuuucggacaguu

SEQ ID NO: 1151688 - RNA, 15 nt, Homo sapiens
cuuaaaaauaacuag

SEQ ID NO: 1151689 - RNA, 13 nt, Homo sapiens
cuuaaaaugaaag

SEQ ID NO: 1151690 - RNA, 19 nt, Homo sapiens
cuuaaaauguaagauuaua

SEQ ID NO: 1151691 - RNA, 14 nt, Homo sapiens
cuuaaacacuugca

SEQ ID NO: 1151692 - RNA, 16 nt, Homo sapiens
cuuaaaccacagcacu

SEQ ID NO: 1151693 - RNA, 15 nt, Homo sapiens
cuuaaacuugaccca

SEQ ID NO: 1151694 - RNA, 19 nt, Homo sapiens
cuuaaagauuuaucaaauc

SEQ ID NO: 1151695 - RNA, 19 nt, Homo sapiens
cuuaaagucaggaguccaa

SEQ ID NO: 1151696 - RNA, 12 nt, Homo sapiens
cuuaaagugaau

SEQ ID NO: 1151697 - RNA, 13 nt, Homo sapiens
cuuaaagugaauu

SEQ ID NO: 1151698 - RNA, 23 nt, Homo sapiens
cuuaaauaauaaacaguggaaua

SEQ ID NO: 1151699 - RNA, 14 nt, Homo sapiens
cuuaaauaugugaa

SEQ ID NO: 1151700 - RNA, 13 nt, Homo sapiens
cuuaaaucauggg

SEQ ID NO: 1151701 - RNA, 23 nt, Homo sapiens
cuuaaauugguauuaacuaugau

SEQ ID NO: 1151702 - RNA, 20 nt, Homo sapiens
cuuaacacugaaauugccug

SEQ ID NO: 1151703 - RNA, 17 nt, Homo sapiens
cuuaacagaugcaaugu

SEQ ID NO: 1151704 - RNA, 18 nt, Homo sapiens
cuuaacugcauuuuuaga

SEQ ID NO: 1151705 - RNA, 20 nt, Homo sapiens
cuuaacuuaaaauugcuaac

SEQ ID NO: 1151706 - RNA, 20 nt, Homo sapiens
cuuaacuuguuugguaguua

SEQ ID NO: 1151707 - RNA, 20 nt, Homo sapiens
cuuaacuuugaaccauaaag

SEQ ID NO: 1151708 - RNA, 16 nt, Homo sapiens
cuuaagauuugcucau

SEQ ID NO: 1151709 - RNA, 21 nt, Homo sapiens
cuuaagccagcacucacacca

SEQ ID NO: 1151710 - RNA, 20 nt, Homo sapiens
cuuaaggaagaagaguauua

SEQ ID NO: 1151711 - RNA, 22 nt, Homo sapiens
cuuaaggacaaagugccaaaga

SEQ ID NO: 1151712 - RNA, 12 nt, Homo sapiens
cuuaagugccua

SEQ ID NO: 1151713 - RNA, 16 nt, Homo sapiens
cuuaaguuuaccaaau

SEQ ID NO: 1151714 - RNA, 14 nt, Homo sapiens
cuuaauaaugugua

SEQ ID NO: 1151715 - RNA, 20 nt, Homo sapiens
cuuaauacuuuaugaugcua

SEQ ID NO: 1151716 - RNA, 14 nt, Homo sapiens
cuuaauucugaugc

SEQ ID NO: 1151717 - RNA, 17 nt, Homo sapiens
cuuacaguuauccugca

SEQ ID NO: 1151718 - RNA, 22 nt, Homo sapiens
cuuaccccaguuuuuugaacau

SEQ ID NO: 1151719 - RNA, 19 nt, Homo sapiens
cuuacccuaaagaucuucu

SEQ ID NO: 1151720 - RNA, 14 nt, Homo sapiens
cuuaccgagcaugg

SEQ ID NO: 1151721 - RNA, 14 nt, Homo sapiens
cuuacuaugaccuu

SEQ ID NO: 1151722 - RNA, 16 nt, Homo sapiens
cuuacucuaagaucuu

SEQ ID NO: 1151723 - RNA, 18 nt, Homo sapiens
cuuacugcuuaauucaaa

SEQ ID NO: 1151724 - RNA, 14 nt, Homo sapiens
cuuacugugaagga

SEQ ID NO: 1151725 - RNA, 16 nt, Homo sapiens
cuuacuuuuccaaaau

SEQ ID NO: 1151726 - RNA, 22 nt, Homo sapiens
cuuagaccuguagauagugaua

SEQ ID NO: 1151727 - RNA, 14 nt, Homo sapiens
cuuagaggcaaaga

SEQ ID NO: 1151728 - RNA, 15 nt, Homo sapiens
cuuagauacuaauaa

SEQ ID NO: 1151729 - RNA, 20 nt, Homo sapiens
cuuagaucucuccugcaaaa

SEQ ID NO: 1151730 - RNA, 15 nt, Homo sapiens
cuuagauucagggga

SEQ ID NO: 1151731 - RNA, 14 nt, Homo sapiens
cuuagccucuggau

SEQ ID NO: 1151732 - RNA, 21 nt, Homo sapiens
cuuagcuaguuuuauucuugg

SEQ ID NO: 1151733 - RNA, 20 nt, Homo sapiens
cuuaggcauucuaagucaca

SEQ ID NO: 1151734 - RNA, 13 nt, Homo sapiens
cuuaggucuuccu

SEQ ID NO: 1151735 - RNA, 18 nt, Homo sapiens
cuuagguuguagcagaaa

SEQ ID NO: 1151736 - RNA, 12 nt, Homo sapiens
cuuaguguuucu

SEQ ID NO: 1151737 - RNA, 17 nt, Homo sapiens
cuuaguuaucaguauuu

SEQ ID NO: 1151738 - RNA, 20 nt, Homo sapiens
cuuauaauuuaaaauaugcu

SEQ ID NO: 1151739 - RNA, 14 nt, Homo sapiens
cuuauaauuugcau

SEQ ID NO: 1151740 - RNA, 19 nt, Homo sapiens
cuuauaauuugcauaccau

SEQ ID NO: 1151741 - RNA, 14 nt, Homo sapiens
cuuauacccaugaa

SEQ ID NO: 1151742 - RNA, 23 nt, Homo sapiens
cuuauacgaguaauaugccugcu

SEQ ID NO: 1151743 - RNA, 20 nt, Homo sapiens
cuuauacucuugagaaugaa

SEQ ID NO: 1151744 - RNA, 16 nt, Homo sapiens
cuuauaggguaaaaaa

SEQ ID NO: 1151745 - RNA, 19 nt, Homo sapiens
cuuauauggaaauucugcu

SEQ ID NO: 1151746 - RNA, 19 nt, Homo sapiens
cuuaucccugcccauuuca

SEQ ID NO: 1151747 - RNA, 16 nt, Homo sapiens
cuuaucugauacuuau

SEQ ID NO: 1151748 - RNA, 16 nt, Homo sapiens
cuuaugaaacuugaaa

SEQ ID NO: 1151749 - RNA, 18 nt, Homo sapiens
cuuaugacugcaccaaca

SEQ ID NO: 1151750 - RNA, 16 nt, Homo sapiens
cuuaugccagcgugac

SEQ ID NO: 1151751 - RNA, 18 nt, Homo sapiens
cuuaugcuuaaauucaag

SEQ ID NO: 1151752 - RNA, 23 nt, Homo sapiens
cuuauggaauugauuugcauuga

SEQ ID NO: 1151753 - RNA, 14 nt, Homo sapiens
cuuauguguuuuaa

SEQ ID NO: 1151754 - RNA, 18 nt, Homo sapiens
cuuauguguuuugcuaaa

SEQ ID NO: 1151755 - RNA, 14 nt, Homo sapiens
cuuauuaaagcaaa

SEQ ID NO: 1151756 - RNA, 16 nt, Homo sapiens
cuuauuaaauauucua

SEQ ID NO: 1151757 - RNA, 14 nt, Homo sapiens
cuuauuacauuuaa

SEQ ID NO: 1151758 - RNA, 14 nt, Homo sapiens
cuuauucucaagaa

SEQ ID NO: 1151759 - RNA, 14 nt, Homo sapiens
cuuauugcuguuuc

SEQ ID NO: 1151760 - RNA, 19 nt, Homo sapiens
cuuauugugugcgcugccu

SEQ ID NO: 1151761 - RNA, 15 nt, Homo sapiens
cuucaaaacauucuc

SEQ ID NO: 1151762 - RNA, 19 nt, Homo sapiens
cuucaacaugucacacugg

SEQ ID NO: 1151763 - RNA, 19 nt, Homo sapiens
cuucaacauuuacauguau

SEQ ID NO: 1151764 - RNA, 19 nt, Homo sapiens
cuucaacguuucuucacuu

SEQ ID NO: 1151765 - RNA, 21 nt, Homo sapiens
cuucaacuuggaaaugacaca

SEQ ID NO: 1151766 - RNA, 15 nt, Homo sapiens
cuucaagacucugaa

SEQ ID NO: 1151767 - RNA, 18 nt, Homo sapiens
cuucaaucggcuuguggg

SEQ ID NO: 1151768 - RNA, 22 nt, Homo sapiens
cuucaauguauugagcauguga

SEQ ID NO: 1151769 - RNA, 18 nt, Homo sapiens
cuucaccauggauccugg

SEQ ID NO: 1151770 - RNA, 14 nt, Homo sapiens
cuucaccucacuga

SEQ ID NO: 1151771 - RNA, 13 nt, Homo sapiens
cuucacuauacaa

SEQ ID NO: 1151772 - RNA, 16 nt, Homo sapiens
cuucagauuuguguua

SEQ ID NO: 1151773 - RNA, 14 nt, Homo sapiens
cuucagcaagagag

SEQ ID NO: 1151774 - RNA, 21 nt, Homo sapiens
cuucaggaaccucgaguacug

SEQ ID NO: 1151775 - RNA, 18 nt, Homo sapiens
cuucaggcagccagugug

SEQ ID NO: 1151776 - RNA, 11 nt, Homo sapiens
cuucaguauua

SEQ ID NO: 1151777 - RNA, 20 nt, Homo sapiens
cuucagucuuaauacuuuau

SEQ ID NO: 1151778 - RNA, 14 nt, Homo sapiens
cuucagugcugcuc

SEQ ID NO: 1151779 - RNA, 16 nt, Homo sapiens
cuucaguguaauguga

SEQ ID NO: 1151780 - RNA, 14 nt, Homo sapiens
cuucauagcaaugu

SEQ ID NO: 1151781 - RNA, 19 nt, Homo sapiens
cuucauauaccagcaauau

SEQ ID NO: 1151782 - RNA, 22 nt, Homo sapiens
cuucaucgaaucuacuaauucc

SEQ ID NO: 1151783 - RNA, 18 nt, Homo sapiens
cuucaucuucacugcaau

SEQ ID NO: 1151784 - RNA, 14 nt, Homo sapiens
cuucaugcagguga

SEQ ID NO: 1151785 - RNA, 22 nt, Homo sapiens
cuucaugcaggugaaacccagu

SEQ ID NO: 1151786 - RNA, 11 nt, Homo sapiens
cuucauugaaa

SEQ ID NO: 1151787 - RNA, 16 nt, Homo sapiens
cuucauuucauguaua

SEQ ID NO: 1151788 - RNA, 22 nt, Homo sapiens
cuuccaaacuccucaacuggga

SEQ ID NO: 1151789 - RNA, 22 nt, Homo sapiens
cuuccacgucuuccuccaagag

SEQ ID NO: 1151790 - RNA, 14 nt, Homo sapiens
cuuccacugagggc

SEQ ID NO: 1151791 - RNA, 16 nt, Homo sapiens
cuuccagcaaaaucca

SEQ ID NO: 1151792 - RNA, 23 nt, Homo sapiens
cuuccagguguuacuguaauucc

SEQ ID NO: 1151793 - RNA, 20 nt, Homo sapiens
cuuccauaaugcuacugucu

SEQ ID NO: 1151794 - RNA, 21 nt, Homo sapiens
cuuccaucaaaccuuugccaa

SEQ ID NO: 1151795 - RNA, 17 nt, Homo sapiens
cuuccauucuuucuucc

SEQ ID NO: 1151796 - RNA, 18 nt, Homo sapiens
cuuccauuugcaagggaa

SEQ ID NO: 1151797 - RNA, 13 nt, Homo sapiens
cuucccacagugg

SEQ ID NO: 1151798 - RNA, 12 nt, Homo sapiens
cuucccacggcu

SEQ ID NO: 1151799 - RNA, 16 nt, Homo sapiens
cuucccacggucaacu

SEQ ID NO: 1151800 - RNA, 19 nt, Homo sapiens
cuucccaggaucugcucca

SEQ ID NO: 1151801 - RNA, 15 nt, Homo sapiens
cuuccccaucagccu

SEQ ID NO: 1151802 - RNA, 16 nt, Homo sapiens
cuuccccaucuucuaa

SEQ ID NO: 1151803 - RNA, 21 nt, Homo sapiens
cuucccccacccagcuuucuu

SEQ ID NO: 1151804 - RNA, 21 nt, Homo sapiens
cuucccucucugcagacuucc

SEQ ID NO: 1151805 - RNA, 22 nt, Homo sapiens
cuucccucucugcagacuuccc

SEQ ID NO: 1151806 - RNA, 17 nt, Homo sapiens
cuuccgcauccuagucu

SEQ ID NO: 1151807 - RNA, 14 nt, Homo sapiens
cuuccuaagccugu

SEQ ID NO: 1151808 - RNA, 15 nt, Homo sapiens
cuuccucuccugucu

SEQ ID NO: 1151809 - RNA, 20 nt, Homo sapiens
cuuccucuuuggacugaaua

SEQ ID NO: 1151810 - RNA, 20 nt, Homo sapiens
cuuccugaauacugaaacua

SEQ ID NO: 1151811 - RNA, 15 nt, Homo sapiens
cuuccugcaguguuu

SEQ ID NO: 1151812 - RNA, 14 nt, Homo sapiens
cuuccuguccuccc

SEQ ID NO: 1151813 - RNA, 18 nt, Homo sapiens
cuuccugugcccugcaaa

SEQ ID NO: 1151814 - RNA, 22 nt, Homo sapiens
cuuccuguguguccaaaacugc

SEQ ID NO: 1151815 - RNA, 14 nt, Homo sapiens
cuuccuuacugucu

SEQ ID NO: 1151816 - RNA, 19 nt, Homo sapiens
cuuccuuauuuuaagcauu

SEQ ID NO: 1151817 - RNA, 16 nt, Homo sapiens
cuucgcaucaaaagac

SEQ ID NO: 1151818 - RNA, 19 nt, Homo sapiens
cuucuaaacccaauccaaa

SEQ ID NO: 1151819 - RNA, 18 nt, Homo sapiens
cuucuaaaugaagugcaa

SEQ ID NO: 1151820 - RNA, 20 nt, Homo sapiens
cuucuaaaugaagugcaaau

SEQ ID NO: 1151821 - RNA, 22 nt, Homo sapiens
cuucuaauugcuguguguccca

SEQ ID NO: 1151822 - RNA, 20 nt, Homo sapiens
uauagccuggggugggguca

SEQ ID NO: 1151823 - RNA, 18 nt, Homo sapiens
uauaguaguaccuuucag

SEQ ID NO: 1151824 - RNA, 20 nt, Homo sapiens
uauauagcucuacacaacau

SEQ ID NO: 1151825 - RNA, 17 nt, Homo sapiens
uauauauggggcuuuag

SEQ ID NO: 1151826 - RNA, 13 nt, Homo sapiens
uauauauuacaag

SEQ ID NO: 1151827 - RNA, 13 nt, Homo sapiens
uauauauucccaa

SEQ ID NO: 1151828 - RNA, 18 nt, Homo sapiens
uauauauuuuugugcaca

SEQ ID NO: 1151829 - RNA, 13 nt, Homo sapiens
uauaucaguccuc

SEQ ID NO: 1151830 - RNA, 20 nt, Homo sapiens
uauaucgcuggccagcauua

SEQ ID NO: 1151831 - RNA, 16 nt, Homo sapiens
uauaucugaagagcua

SEQ ID NO: 1151832 - RNA, 16 nt, Homo sapiens
uauaucuuaaugcaga

SEQ ID NO: 1151833 - RNA, 23 nt, Homo sapiens
uauaucuuaaugcagacaaacaa

SEQ ID NO: 1151834 - RNA, 16 nt, Homo sapiens
uauaugcuaagucuua

SEQ ID NO: 1151835 - RNA, 15 nt, Homo sapiens
uauauguaaaggaca

SEQ ID NO: 1151836 - RNA, 18 nt, Homo sapiens
uauauguguuuuucacau

SEQ ID NO: 1151837 - RNA, 22 nt, Homo sapiens
uauauguugaauguuaacaggu

SEQ ID NO: 1151838 - RNA, 14 nt, Homo sapiens
uauauguugcuaua

SEQ ID NO: 1151839 - RNA, 14 nt, Homo sapiens
uauauucacuuuca

SEQ ID NO: 1151840 - RNA, 21 nt, Homo sapiens
uauauuccaccaggauauccu

SEQ ID NO: 1151841 - RNA, 16 nt, Homo sapiens
uauauucuuguaaaua

SEQ ID NO: 1151842 - RNA, 12 nt, Homo sapiens
uauauuucacau

SEQ ID NO: 1151843 - RNA, 15 nt, Homo sapiens
uauauuugugugagg

SEQ ID NO: 1151844 - RNA, 15 nt, Homo sapiens
uauauuuuauacugc

SEQ ID NO: 1151845 - RNA, 13 nt, Homo sapiens
uauauuuugcaau

SEQ ID NO: 1151846 - RNA, 15 nt, Homo sapiens
uauauuuuugugcac

SEQ ID NO: 1151847 - RNA, 16 nt, Homo sapiens
uauauuuuuuugcaag

SEQ ID NO: 1151848 - RNA, 14 nt, Homo sapiens
uaucaaaauugcaa

SEQ ID NO: 1151849 - RNA, 12 nt, Homo sapiens
uaucaacucaag

SEQ ID NO: 1151850 - RNA, 19 nt, Homo sapiens
uaucaagaggcugagacag

SEQ ID NO: 1151851 - RNA, 13 nt, Homo sapiens
uaucaagcuuuua

SEQ ID NO: 1151852 - RNA, 22 nt, Homo sapiens
uaucaaguguucuaaaaugaaa

SEQ ID NO: 1151853 - RNA, 22 nt, Homo sapiens
uaucaccucauucugaacccuu

SEQ ID NO: 1151854 - RNA, 18 nt, Homo sapiens
uaucacuucacuguucuc

SEQ ID NO: 1151855 - RNA, 13 nt, Homo sapiens
uaucagcaaaaaa

SEQ ID NO: 1151856 - RNA, 23 nt, Homo sapiens
uaucagcauagugacuaaacuac

SEQ ID NO: 1151857 - RNA, 18 nt, Homo sapiens
uaucauguaaauguauug

SEQ ID NO: 1151858 - RNA, 14 nt, Homo sapiens
uaucaugugucuuc

SEQ ID NO: 1151859 - RNA, 21 nt, Homo sapiens
uaucauugauacgggauuucu

SEQ ID NO: 1151860 - RNA, 13 nt, Homo sapiens
uauccaccaagaa

SEQ ID NO: 1151861 - RNA, 22 nt, Homo sapiens
uauccacccagcccauucucuc

SEQ ID NO: 1151862 - RNA, 22 nt, Homo sapiens
uauccagaggaauugauuguca

SEQ ID NO: 1151863 - RNA, 16 nt, Homo sapiens
uauccccccaaaugga

SEQ ID NO: 1151864 - RNA, 21 nt, Homo sapiens
uaucggggucacuugcaauug

SEQ ID NO: 1151865 - RNA, 13 nt, Homo sapiens
uauuucacaagaa

SEQ ID NO: 1151866 - RNA, 14 nt, Homo sapiens
uauuucacagagca

SEQ ID NO: 1151867 - RNA, 12 nt, Homo sapiens
uauuucaucucu

SEQ ID NO: 1151868 - RNA, 14 nt, Homo sapiens
uauuucaucucuuu

SEQ ID NO: 1151869 - RNA, 18 nt, Homo sapiens
uauuuccuauacgugugu

SEQ ID NO: 1151870 - RNA, 16 nt, Homo sapiens
uauuugaaaacauaua

SEQ ID NO: 1151871 - RNA, 16 nt, Homo sapiens
uauuugaguugugauu

SEQ ID NO: 1151872 - RNA, 14 nt, Homo sapiens
uauuugaugcuaca

SEQ ID NO: 1151873 - RNA, 13 nt, Homo sapiens
uauuugcacuaug

SEQ ID NO: 1151874 - RNA, 19 nt, Homo sapiens
uauuugccuccagugcagu

SEQ ID NO: 1151875 - RNA, 17 nt, Homo sapiens
uauuugugcuauaguau

SEQ ID NO: 1151876 - RNA, 19 nt, Homo sapiens
uauuuguguucaguuccag

SEQ ID NO: 1151877 - RNA, 22 nt, Homo sapiens
uauuuuaagaauuucacaagcu

SEQ ID NO: 1151878 - RNA, 18 nt, Homo sapiens
uauuuuauacugcacuuu

SEQ ID NO: 1151879 - RNA, 14 nt, Homo sapiens
uauuuucuuuauca

SEQ ID NO: 1151880 - RNA, 16 nt, Homo sapiens
uauuuuguugccuuca

SEQ ID NO: 1151881 - RNA, 22 nt, Homo sapiens
uauuuuguugccuucaucuuca

SEQ ID NO: 1151882 - RNA, 20 nt, Homo sapiens
uauuuuucuaaacguaagca

SEQ ID NO: 1151883 - RNA, 23 nt, Homo sapiens
uauuuuugcccugaguccaagag

SEQ ID NO: 1151884 - RNA, 15 nt, Homo sapiens
uauuuuuguaucuua

SEQ ID NO: 1151885 - RNA, 16 nt, Homo sapiens
uauuuuuuauauauac

SEQ ID NO: 1151886 - RNA, 15 nt, Homo sapiens
uauuuuuucuugcaa

SEQ ID NO: 1151887 - RNA, 16 nt, Homo sapiens
ucaaaaacacaguguu

SEQ ID NO: 1151888 - RNA, 14 nt, Homo sapiens
ucaaaaacagcaga

SEQ ID NO: 1151889 - RNA, 13 nt, Homo sapiens
ucaaaaacauucu

SEQ ID NO: 1151890 - RNA, 14 nt, Homo sapiens
ucaaaaacauucuu

SEQ ID NO: 1151891 - RNA, 16 nt, Homo sapiens
ucaaaaagcauuugau

SEQ ID NO: 1151892 - RNA, 15 nt, Homo sapiens
ucaaaaaucuguccg

SEQ ID NO: 1151893 - RNA, 15 nt, Homo sapiens
ucaaaacucuaucaa

SEQ ID NO: 1151894 - RNA, 15 nt, Homo sapiens
ucaaaacuguacugu

SEQ ID NO: 1151895 - RNA, 18 nt, Homo sapiens
ucaaaacuguacugucuu

SEQ ID NO: 1151896 - RNA, 15 nt, Homo sapiens
ucaaaagugccucaa

SEQ ID NO: 1151897 - RNA, 18 nt, Homo sapiens
ucaaaauauacauucaaa

SEQ ID NO: 1151898 - RNA, 13 nt, Homo sapiens
ucaaaauccaaaa

SEQ ID NO: 1151899 - RNA, 20 nt, Homo sapiens
ucaaaaugagucaggcaauu

SEQ ID NO: 1151900 - RNA, 20 nt, Homo sapiens
ucaaaaugaugcaaccaaaa

SEQ ID NO: 1151901 - RNA, 13 nt, Homo sapiens
ucaaaauugccuu

SEQ ID NO: 1151902 - RNA, 17 nt, Homo sapiens
ucaaacaaacucucuga

SEQ ID NO: 1151903 - RNA, 11 nt, Homo sapiens
ucaaacaaagc

SEQ ID NO: 1151904 - RNA, 22 nt, Homo sapiens
ucaaacaacauuccaccccagc

SEQ ID NO: 1151905 - RNA, 20 nt, Homo sapiens
ucaaacuaccuauauuccuu

SEQ ID NO: 1151906 - RNA, 19 nt, Homo sapiens
ucaaagauugaacacugcg

SEQ ID NO: 1151907 - RNA, 17 nt, Homo sapiens
ucaaagccacacucugg

SEQ ID NO: 1151908 - RNA, 10 nt, Homo sapiens
ucaaagccag

SEQ ID NO: 1151909 - RNA, 21 nt, Homo sapiens
ucaaagcccugccucugugua

SEQ ID NO: 1151910 - RNA, 20 nt, Homo sapiens
ucaaagcucuaauggaccuu

SEQ ID NO: 1151911 - RNA, 15 nt, Homo sapiens
ucaaagggacugccg

SEQ ID NO: 1151912 - RNA, 22 nt, Homo sapiens
ucaaagugucguaucugggaga

SEQ ID NO: 1151913 - RNA, 23 nt, Homo sapiens
ucaaauagagcuguucaacauca

SEQ ID NO: 1151914 - RNA, 16 nt, Homo sapiens
ucaaaucuuacaaaau

SEQ ID NO: 1151915 - RNA, 12 nt, Homo sapiens
ucaaaugccuga

SEQ ID NO: 1151916 - RNA, 18 nt, Homo sapiens
ucaaaugugacauuauau

SEQ ID NO: 1151917 - RNA, 18 nt, Homo sapiens
ucaaauuccaaggaacua

SEQ ID NO: 1151918 - RNA, 20 nt, Homo sapiens
ucaacaaauauuuaccaagu

SEQ ID NO: 1151919 - RNA, 16 nt, Homo sapiens
ucaacaacagugugau

SEQ ID NO: 1151920 - RNA, 18 nt, Homo sapiens
ucaacaacagugugauca

SEQ ID NO: 1151921 - RNA, 16 nt, Homo sapiens
ucaacaauaaagacug

SEQ ID NO: 1151922 - RNA, 20 nt, Homo sapiens
ucaacaauaaagacugagac

SEQ ID NO: 1151923 - RNA, 19 nt, Homo sapiens
ucaacacuuguaucuggcc

SEQ ID NO: 1151924 - RNA, 18 nt, Homo sapiens
ucaacagauaaaugacaa

SEQ ID NO: 1151925 - RNA, 18 nt, Homo sapiens
ucaacauuuacauguauu

SEQ ID NO: 1151926 - RNA, 12 nt, Homo sapiens
ucaaccagacag

SEQ ID NO: 1151927 - RNA, 13 nt, Homo sapiens
ucaaccagacaga

SEQ ID NO: 1151928 - RNA, 23 nt, Homo sapiens
ucaaccauccccuccguggcauc

SEQ ID NO: 1151929 - RNA, 22 nt, Homo sapiens
ucaacccuucuggaaacuguga

SEQ ID NO: 1151930 - RNA, 15 nt, Homo sapiens
ucaaccuccuggaca

SEQ ID NO: 1151931 - RNA, 16 nt, Homo sapiens
ucaaccugcacuucau

SEQ ID NO: 1151932 - RNA, 20 nt, Homo sapiens
ucaaccugcacuucauaucu

SEQ ID NO: 1151933 - RNA, 23 nt, Homo sapiens
ucaacguuuuuggacacugugcu

SEQ ID NO: 1151934 - RNA, 16 nt, Homo sapiens
ucaacucccugagagc

SEQ ID NO: 1151935 - RNA, 21 nt, Homo sapiens
ucaacugaggauguggcuuau

SEQ ID NO: 1151936 - RNA, 21 nt, Homo sapiens
ucaacugccucagcgauuuca

SEQ ID NO: 1151937 - RNA, 21 nt, Homo sapiens
ucaacuggguuuucagcauaa

SEQ ID NO: 1151938 - RNA, 16 nt, Homo sapiens
ucaacuuuuccuuuca

SEQ ID NO: 1151939 - RNA, 18 nt, Homo sapiens
ucaacuuuuuauugccuu

SEQ ID NO: 1151940 - RNA, 14 nt, Homo sapiens
ucaagaaaacugga

SEQ ID NO: 1151941 - RNA, 23 nt, Homo sapiens
ucaagaaauaaaaggaagccaaa

SEQ ID NO: 1151942 - RNA, 15 nt, Homo sapiens
ucaagaacacaguga

SEQ ID NO: 1151943 - RNA, 21 nt, Homo sapiens
ucaagaagucagagaaaacac

SEQ ID NO: 1151944 - RNA, 19 nt, Homo sapiens
ucaagagaaaaguugacac

SEQ ID NO: 1151945 - RNA, 16 nt, Homo sapiens
ucaagagagauuugau

SEQ ID NO: 1151946 - RNA, 15 nt, Homo sapiens
ucaagaggcugagac

SEQ ID NO: 1151947 - RNA, 23 nt, Homo sapiens
ucaagcuauaaugcuauuuugau

SEQ ID NO: 1151948 - RNA, 18 nt, Homo sapiens
ucacauggccuaugcaca

SEQ ID NO: 1151949 - RNA, 18 nt, Homo sapiens
ucacauucugcauacuaa

SEQ ID NO: 1151950 - RNA, 21 nt, Homo sapiens
ucacauuggcaaguguaaaaa

SEQ ID NO: 1151951 - RNA, 21 nt, Homo sapiens
ucaccaaggaaacgcuaccuc

SEQ ID NO: 1151952 - RNA, 17 nt, Homo sapiens
ucaccacaaacuguaau

SEQ ID NO: 1151953 - RNA, 17 nt, Homo sapiens
ucaccaccucaugucau

SEQ ID NO: 1151954 - RNA, 22 nt, Homo sapiens
ucaccaggauuuauacauacag

SEQ ID NO: 1151955 - RNA, 14 nt, Homo sapiens
ucaccaugcuugug

SEQ ID NO: 1151956 - RNA, 22 nt, Homo sapiens
ucacccagggcgucccugacag

SEQ ID NO: 1151957 - RNA, 21 nt, Homo sapiens
ucaccccacacccauguguac

SEQ ID NO: 1151958 - RNA, 22 nt, Homo sapiens
ucaccccagagccacacauggg

SEQ ID NO: 1151959 - RNA, 20 nt, Homo sapiens
ucaccccagcgagcucucaa

SEQ ID NO: 1151960 - RNA, 22 nt, Homo sapiens
ucaccccaggcucaacugagga

SEQ ID NO: 1151961 - RNA, 22 nt, Homo sapiens
ucacccuccacaaagcaaaggc

SEQ ID NO: 1151962 - RNA, 21 nt, Homo sapiens
ucacccucuguaccccaugac

SEQ ID NO: 1151963 - RNA, 16 nt, Homo sapiens
ucacccucuucaagcu

SEQ ID NO: 1151964 - RNA, 14 nt, Homo sapiens
ucaccucacugaaa

SEQ ID NO: 1151965 - RNA, 22 nt, Homo sapiens
ucaccucacugaaaacaucugg

SEQ ID NO: 1151966 - RNA, 21 nt, Homo sapiens
ucaccucugugccucugucuc

SEQ ID NO: 1151967 - RNA, 14 nt, Homo sapiens
ucaccucuugccuu

SEQ ID NO: 1151968 - RNA, 21 nt, Homo sapiens
ucaccugagcaggaccucuga

SEQ ID NO: 1151969 - RNA, 19 nt, Homo sapiens
ucaccuuaggaauaaucuc

SEQ ID NO: 1151970 - RNA, 16 nt, Homo sapiens
ucaccuuccuaaucac

SEQ ID NO: 1151971 - RNA, 22 nt, Homo sapiens
ucaccuucguuuacuaugccug

SEQ ID NO: 1151972 - RNA, 18 nt, Homo sapiens
ucaccuuggcaccagaca

SEQ ID NO: 1151973 - RNA, 19 nt, Homo sapiens
ucaccuuggcaccagacac

SEQ ID NO: 1151974 - RNA, 14 nt, Homo sapiens
ucaccuuuguccug

SEQ ID NO: 1151975 - RNA, 14 nt, Homo sapiens
ucacgauauuauua

SEQ ID NO: 1151976 - RNA, 14 nt, Homo sapiens
ucacgauuccuucc

SEQ ID NO: 1151977 - RNA, 18 nt, Homo sapiens
ucacgcagagauuuucau

SEQ ID NO: 1151978 - RNA, 21 nt, Homo sapiens
ucacggagacagcaaccagaa

SEQ ID NO: 1151979 - RNA, 16 nt, Homo sapiens
ucacuaaggacuuaaa

SEQ ID NO: 1151980 - RNA, 21 nt, Homo sapiens
ucacuaguugucagcuucucu

SEQ ID NO: 1151981 - RNA, 14 nt, Homo sapiens
ucacucauugcuga

SEQ ID NO: 1151982 - RNA, 18 nt, Homo sapiens
ucacucuuaggcacuuug

SEQ ID NO: 1151983 - RNA, 17 nt, Homo sapiens
ucacucuucaaaugccu

SEQ ID NO: 1151984 - RNA, 18 nt, Homo sapiens
ucacucuucaaaugccug

SEQ ID NO: 1151985 - RNA, 14 nt, Homo sapiens
ucacucuuguggau

SEQ ID NO: 1151986 - RNA, 19 nt, Homo sapiens
ucacugaaaacaucuggaa

SEQ ID NO: 1151987 - RNA, 20 nt, Homo sapiens
ucacugaaaacaucuggaag

SEQ ID NO: 1151988 - RNA, 18 nt, Homo sapiens
ucacugaauuucaaacau

SEQ ID NO: 1151989 - RNA, 16 nt, Homo sapiens
ucacugagcauacuca

SEQ ID NO: 1151990 - RNA, 18 nt, Homo sapiens
ucacugaguuuuccaugg

SEQ ID NO: 1151991 - RNA, 18 nt, Homo sapiens
ucacugcaacuucugccu

SEQ ID NO: 1151992 - RNA, 16 nt, Homo sapiens
ucacugccauauacuc

SEQ ID NO: 1151993 - RNA, 15 nt, Homo sapiens
ucacugcuacaugug

SEQ ID NO: 1151994 - RNA, 12 nt, Homo sapiens
ucacugcugcuc

SEQ ID NO: 1151995 - RNA, 18 nt, Homo sapiens
ucacugggucugcuggcu

SEQ ID NO: 1151996 - RNA, 17 nt, Homo sapiens
ucacuguccagguagga

SEQ ID NO: 1151997 - RNA, 19 nt, Homo sapiens
ucacugugcuccaaccuga

SEQ ID NO: 1151998 - RNA, 13 nt, Homo sapiens
ucacuguugcaua

SEQ ID NO: 1151999 - RNA, 20 nt, Homo sapiens
ucacuguugcuuaauuguga

SEQ ID NO: 1152000 - RNA, 21 nt, Homo sapiens
ucacuuaauaauguguacauu

SEQ ID NO: 1152001 - RNA, 16 nt, Homo sapiens
ucacuucacuguucuc

SEQ ID NO: 1152002 - RNA, 15 nt, Homo sapiens
ucacuuccuauaugc

SEQ ID NO: 1152003 - RNA, 18 nt, Homo sapiens
ucacuucucacaaugucc

SEQ ID NO: 1152004 - RNA, 13 nt, Homo sapiens
ucacuucuuccau

SEQ ID NO: 1152005 - RNA, 20 nt, Homo sapiens
ucacuucuuccauccaaaga

SEQ ID NO: 1152006 - RNA, 16 nt, Homo sapiens
ucacuugaaccuggga

SEQ ID NO: 1152007 - RNA, 13 nt, Homo sapiens
ucacuugcaauug

SEQ ID NO: 1152008 - RNA, 12 nt, Homo sapiens
ucacuugcucaa

SEQ ID NO: 1152009 - RNA, 13 nt, Homo sapiens
ucacuugcucaaa

SEQ ID NO: 1152010 - RNA, 15 nt, Homo sapiens
ucacuugcucuuuga

SEQ ID NO: 1152011 - RNA, 19 nt, Homo sapiens
ucacuuuagaaagccagca

SEQ ID NO: 1152012 - RNA, 23 nt, Homo sapiens
ucagaaauuuaauucauguuucu

SEQ ID NO: 1152013 - RNA, 21 nt, Homo sapiens
ucagaacagaugcugagccau

SEQ ID NO: 1152014 - RNA, 16 nt, Homo sapiens
ucagaacuggcugugg

SEQ ID NO: 1152015 - RNA, 23 nt, Homo sapiens
ucagaagcaucgcuccucuccag

SEQ ID NO: 1152016 - RNA, 19 nt, Homo sapiens
ucagaagggagcuagccag

SEQ ID NO: 1152017 - RNA, 22 nt, Homo sapiens
ucagaaguaacucccacuccua

SEQ ID NO: 1152018 - RNA, 15 nt, Homo sapiens
ucagaaguucugggu

SEQ ID NO: 1152019 - RNA, 13 nt, Homo sapiens
ucagaauagccac

SEQ ID NO: 1152020 - RNA, 17 nt, Homo sapiens
ucagaaugggugcaguu

SEQ ID NO: 1152021 - RNA, 14 nt, Homo sapiens
ucagacaccugugu

SEQ ID NO: 1152022 - RNA, 13 nt, Homo sapiens
ucagacaggcaaa

SEQ ID NO: 1152023 - RNA, 13 nt, Homo sapiens
ucagaccacaagg

SEQ ID NO: 1152024 - RNA, 20 nt, Homo sapiens
ucagacccuaccccaccacg

SEQ ID NO: 1152025 - RNA, 16 nt, Homo sapiens
ucagaccuggcugcuu

SEQ ID NO: 1152026 - RNA, 20 nt, Homo sapiens
ucuaagaucuuagauucucu

SEQ ID NO: 1152027 - RNA, 14 nt, Homo sapiens
ucuaagauucuaaa

SEQ ID NO: 1152028 - RNA, 17 nt, Homo sapiens
ucuaagcuuuucauuaa

SEQ ID NO: 1152029 - RNA, 21 nt, Homo sapiens
ucuaaggccuaggauucuaaa

SEQ ID NO: 1152030 - RNA, 17 nt, Homo sapiens
ucuaagucaaauuccaa

SEQ ID NO: 1152031 - RNA, 12 nt, Homo sapiens
ucuaauccuuua

SEQ ID NO: 1152032 - RNA, 20 nt, Homo sapiens
ucuaaucuauaugauaugca

SEQ ID NO: 1152033 - RNA, 14 nt, Homo sapiens
ucuaauuagaauuc

SEQ ID NO: 1152034 - RNA, 22 nt, Homo sapiens
ucuaauucuauuaaagugcuaa

SEQ ID NO: 1152035 - RNA, 12 nt, Homo sapiens
ucuaauucugua

SEQ ID NO: 1152036 - RNA, 22 nt, Homo sapiens
ucuaauucuguaggacuuugaa

SEQ ID NO: 1152037 - RNA, 14 nt, Homo sapiens
ucuacaagguguuc

SEQ ID NO: 1152038 - RNA, 14 nt, Homo sapiens
ucuacacaacaugu

SEQ ID NO: 1152039 - RNA, 19 nt, Homo sapiens
ucuacagagcuucccugac

SEQ ID NO: 1152040 - RNA, 19 nt, Homo sapiens
ucuacgugauuuggcugca

SEQ ID NO: 1152041 - RNA, 22 nt, Homo sapiens
ucuacgugauuuggcugcacuu

SEQ ID NO: 1152042 - RNA, 15 nt, Homo sapiens
ucuacuaacaaucag

SEQ ID NO: 1152043 - RNA, 18 nt, Homo sapiens
ucuacuaaggcuuuccua

SEQ ID NO: 1152044 - RNA, 12 nt, Homo sapiens
ucuacuaauucc

SEQ ID NO: 1152045 - RNA, 19 nt, Homo sapiens
ucuacuauauaugacugga

SEQ ID NO: 1152046 - RNA, 18 nt, Homo sapiens
ucuacucuuaagccaucu

SEQ ID NO: 1152047 - RNA, 19 nt, Homo sapiens
ucuacucuuuugaaguguu

SEQ ID NO: 1152048 - RNA, 12 nt, Homo sapiens
ucuacugggacu

SEQ ID NO: 1152049 - RNA, 17 nt, Homo sapiens
ucuacuuaucauguaaa

SEQ ID NO: 1152050 - RNA, 16 nt, Homo sapiens
ucuacuucugcccuug

SEQ ID NO: 1152051 - RNA, 22 nt, Homo sapiens
ucuacuucuggaagucaucuca

SEQ ID NO: 1152052 - RNA, 22 nt, Homo sapiens
ucuacuugcuuauuacauuuaa

SEQ ID NO: 1152053 - RNA, 14 nt, Homo sapiens
ucuacuuugauucu

SEQ ID NO: 1152054 - RNA, 11 nt, Homo sapiens
ucuacuuuuaa

SEQ ID NO: 1152055 - RNA, 21 nt, Homo sapiens
ucuagaaagcucuaaagacca

SEQ ID NO: 1152056 - RNA, 23 nt, Homo sapiens
ucuagacauggagguucuaaggc

SEQ ID NO: 1152057 - RNA, 15 nt, Homo sapiens
ucuagagcacugcca

SEQ ID NO: 1152058 - RNA, 21 nt, Homo sapiens
ucuagcauguaaggccuuuca

SEQ ID NO: 1152059 - RNA, 18 nt, Homo sapiens
ucuaggagucaacuggcu

SEQ ID NO: 1152060 - RNA, 16 nt, Homo sapiens
ucuaggcaacauagua

SEQ ID NO: 1152061 - RNA, 14 nt, Homo sapiens
ucuaggugcuuuaa

SEQ ID NO: 1152062 - RNA, 23 nt, Homo sapiens
ucuaguuaacauuucaagggcaa

SEQ ID NO: 1152063 - RNA, 23 nt, Homo sapiens
ucuaguuaaccaaucgcaaagca

SEQ ID NO: 1152064 - RNA, 13 nt, Homo sapiens
ucuauaacaguuu

SEQ ID NO: 1152065 - RNA, 16 nt, Homo sapiens
ucuauaggaacauaug

SEQ ID NO: 1152066 - RNA, 11 nt, Homo sapiens
ucuauaugauu

SEQ ID NO: 1152067 - RNA, 16 nt, Homo sapiens
ucuauccucuguaaac

SEQ ID NO: 1152068 - RNA, 19 nt, Homo sapiens
ucuaucggagaacaugaau

SEQ ID NO: 1152069 - RNA, 12 nt, Homo sapiens
ucuaucugcaau

SEQ ID NO: 1152070 - RNA, 19 nt, Homo sapiens
ucuaucuugucaaucccaa

SEQ ID NO: 1152071 - RNA, 21 nt, Homo sapiens
ucuaugaguggaaaaagccaa

SEQ ID NO: 1152072 - RNA, 23 nt, Homo sapiens
ucuaugcucucgcaccuuuccaa

SEQ ID NO: 1152073 - RNA, 23 nt, Homo sapiens
ucuaugugaccagacugcacagg

SEQ ID NO: 1152074 - RNA, 14 nt, Homo sapiens
ucuauuaaucaccu

SEQ ID NO: 1152075 - RNA, 17 nt, Homo sapiens
ucuauucuuugccuuag

SEQ ID NO: 1152076 - RNA, 19 nt, Homo sapiens
ucuauuucuccuccauggg

SEQ ID NO: 1152077 - RNA, 20 nt, Homo sapiens
ucuauuugccuccagugcag

SEQ ID NO: 1152078 - RNA, 21 nt, Homo sapiens
ucuauuuuaguugguuuguau

SEQ ID NO: 1152079 - RNA, 22 nt, Homo sapiens
ucucaagaagaacaucuuuaug

SEQ ID NO: 1152080 - RNA, 14 nt, Homo sapiens
ucucaauguacaua

SEQ ID NO: 1152081 - RNA, 15 nt, Homo sapiens
ucucacacauuccag

SEQ ID NO: 1152082 - RNA, 17 nt, Homo sapiens
ucucaccagcugcaaag

SEQ ID NO: 1152083 - RNA, 19 nt, Homo sapiens
ucucaccuacccaugaccu

SEQ ID NO: 1152084 - RNA, 23 nt, Homo sapiens
ucucacucccuguuuuaauucaa

SEQ ID NO: 1152085 - RNA, 12 nt, Homo sapiens
ucucacucugcc

SEQ ID NO: 1152086 - RNA, 17 nt, Homo sapiens
ucucacugaaacauuua

SEQ ID NO: 1152087 - RNA, 22 nt, Homo sapiens
ucucacugugggaaggccagcu

SEQ ID NO: 1152088 - RNA, 14 nt, Homo sapiens
ucucagaauucuuc

SEQ ID NO: 1152089 - RNA, 22 nt, Homo sapiens
ucucagacuuuggaaaaugcau

SEQ ID NO: 1152090 - RNA, 19 nt, Homo sapiens
ucucagccauaggugcagu

SEQ ID NO: 1152091 - RNA, 9 nt, Homo sapiens
ucucagcuc

SEQ ID NO: 1152092 - RNA, 9 nt, Homo sapiens
ucucagcuu

SEQ ID NO: 1152093 - RNA, 14 nt, Homo sapiens
ucucaggaccaaag

SEQ ID NO: 1152094 - RNA, 23 nt, Homo sapiens
ucucaggagcaggggcauugcug

SEQ ID NO: 1152095 - RNA, 20 nt, Homo sapiens
ucucaggggugauaacucag

SEQ ID NO: 1152096 - RNA, 22 nt, Homo sapiens
ucucaggggugauaacucagga

SEQ ID NO: 1152097 - RNA, 14 nt, Homo sapiens
ucucaguuaggaga

SEQ ID NO: 1152098 - RNA, 16 nt, Homo sapiens
ucucauaaauuucucu

SEQ ID NO: 1152099 - RNA, 15 nt, Homo sapiens
ucucauaacucugug

SEQ ID NO: 1152100 - RNA, 22 nt, Homo sapiens
ucucauccuccaguaccuugcu

SEQ ID NO: 1152101 - RNA, 22 nt, Homo sapiens
ucuuugcucccuccaaucuuga

SEQ ID NO: 1152102 - RNA, 15 nt, Homo sapiens
ucuuuggacagaagc

SEQ ID NO: 1152103 - RNA, 21 nt, Homo sapiens
ucuuuguaaugucaccaccuu

SEQ ID NO: 1152104 - RNA, 13 nt, Homo sapiens
ucuuuguauuuca

SEQ ID NO: 1152105 - RNA, 18 nt, Homo sapiens
ucuuugugauaauucuca

SEQ ID NO: 1152106 - RNA, 18 nt, Homo sapiens
ucuuuuaggccaaggaaa

SEQ ID NO: 1152107 - RNA, 14 nt, Homo sapiens
ucuuuucacauucu

SEQ ID NO: 1152108 - RNA, 15 nt, Homo sapiens
ucuuuucaucuggga

SEQ ID NO: 1152109 - RNA, 19 nt, Homo sapiens
ucuuuucauuuuugauuag

SEQ ID NO: 1152110 - RNA, 20 nt, Homo sapiens
ucuuuuuaauaaaaaggcac

SEQ ID NO: 1152111 - RNA, 13 nt, Homo sapiens
ugaaaaacuuaag

SEQ ID NO: 1152112 - RNA, 22 nt, Homo sapiens
ugaaaagauucuucuguguuua

SEQ ID NO: 1152113 - RNA, 14 nt, Homo sapiens
ugaaaagcaaagga

SEQ ID NO: 1152114 - RNA, 21 nt, Homo sapiens
ugaaaaggauauuaucuaccu

SEQ ID NO: 1152115 - RNA, 15 nt, Homo sapiens
ugaaaagguugccug

SEQ ID NO: 1152116 - RNA, 20 nt, Homo sapiens
ugaaaauaacugaaccaaau

SEQ ID NO: 1152117 - RNA, 17 nt, Homo sapiens
ugaaaauaagaauuauu

SEQ ID NO: 1152118 - RNA, 22 nt, Homo sapiens
ugaaaauaauuguuccaaauga

SEQ ID NO: 1152119 - RNA, 20 nt, Homo sapiens
ugaaaauauuuuguugccuu

SEQ ID NO: 1152120 - RNA, 16 nt, Homo sapiens
ugaaaauguauuugug

SEQ ID NO: 1152121 - RNA, 22 nt, Homo sapiens
ugaaaauuauuugaaaacauau

SEQ ID NO: 1152122 - RNA, 22 nt, Homo sapiens
ugaaacaaaaauugucuuuaug

SEQ ID NO: 1152123 - RNA, 13 nt, Homo sapiens
ugaaacaauccaa

SEQ ID NO: 1152124 - RNA, 23 nt, Homo sapiens
ugaaacaggggcucucugugcaa

SEQ ID NO: 1152125 - RNA, 20 nt, Homo sapiens
ugaaacauguucaucuggaa

SEQ ID NO: 1152126 - RNA, 20 nt, Homo sapiens
ugaaacccagucacugugag

SEQ ID NO: 1152127 - RNA, 15 nt, Homo sapiens
ugaaacccccaucuc

SEQ ID NO: 1152128 - RNA, 16 nt, Homo sapiens
ugaaacccccaucucu

SEQ ID NO: 1152129 - RNA, 15 nt, Homo sapiens
ugaaaccgccucugg

SEQ ID NO: 1152130 - RNA, 15 nt, Homo sapiens
ugaaacuagaaaucu

SEQ ID NO: 1152131 - RNA, 21 nt, Homo sapiens
ugaaacucccuuguguuccuu

SEQ ID NO: 1152132 - RNA, 13 nt, Homo sapiens
ugaaacugcauaa

SEQ ID NO: 1152133 - RNA, 16 nt, Homo sapiens
ugaaacuugaaaugag

SEQ ID NO: 1152134 - RNA, 17 nt, Homo sapiens
ugaaacuugaacucugg

SEQ ID NO: 1152135 - RNA, 23 nt, Homo sapiens
ugaaacuugugucauugauguaa

SEQ ID NO: 1152136 - RNA, 17 nt, Homo sapiens
ugaaacuuuaucaucuu

SEQ ID NO: 1152137 - RNA, 23 nt, Homo sapiens
ugaaagaguaaaggaaaugauug

SEQ ID NO: 1152138 - RNA, 19 nt, Homo sapiens
ugaaagaugauuugcaaug

SEQ ID NO: 1152139 - RNA, 13 nt, Homo sapiens
ugaaagauggguc

SEQ ID NO: 1152140 - RNA, 20 nt, Homo sapiens
ugaaagcaaccuucuugccu

SEQ ID NO: 1152141 - RNA, 20 nt, Homo sapiens
ugaaagccucacguauuuca

SEQ ID NO: 1152142 - RNA, 20 nt, Homo sapiens
ugaaaggguuuuuaaucucc

SEQ ID NO: 1152143 - RNA, 18 nt, Homo sapiens
ugaaagguaguggcugau

SEQ ID NO: 1152144 - RNA, 16 nt, Homo sapiens
ugaaaggugacaaaag

SEQ ID NO: 1152145 - RNA, 22 nt, Homo sapiens
ugaaagguuggccuuacuguug

SEQ ID NO: 1152146 - RNA, 17 nt, Homo sapiens
ugaaaguggacaaggag

SEQ ID NO: 1152147 - RNA, 21 nt, Homo sapiens
ugacagaucaagcugugagac

SEQ ID NO: 1152148 - RNA, 15 nt, Homo sapiens
ugacagcucuucaca

SEQ ID NO: 1152149 - RNA, 19 nt, Homo sapiens
ugacagcuuugcugcugaa

SEQ ID NO: 1152150 - RNA, 16 nt, Homo sapiens
ugacaggcagugccau

SEQ ID NO: 1152151 - RNA, 16 nt, Homo sapiens
ugacagggaaaacugc

SEQ ID NO: 1152152 - RNA, 17 nt, Homo sapiens
ugacagggaaaacugca

SEQ ID NO: 1152153 - RNA, 22 nt, Homo sapiens
ugacagguuuuccaaaaguaaa

SEQ ID NO: 1152154 - RNA, 19 nt, Homo sapiens
ugacagugggaggggauaa

SEQ ID NO: 1152155 - RNA, 20 nt, Homo sapiens
ugacaguuuuugacauuuau

SEQ ID NO: 1152156 - RNA, 17 nt, Homo sapiens
ugacaucaaaaugaguc

SEQ ID NO: 1152157 - RNA, 21 nt, Homo sapiens
ugacauggagaccgugaccag

SEQ ID NO: 1152158 - RNA, 20 nt, Homo sapiens
ugacauuagauugaugugca

SEQ ID NO: 1152159 - RNA, 15 nt, Homo sapiens
ugacauuauaugcac

SEQ ID NO: 1152160 - RNA, 21 nt, Homo sapiens
ugacauuuaauaacuuugcug

SEQ ID NO: 1152161 - RNA, 22 nt, Homo sapiens
ugacauuuaccagcaacuugaa

SEQ ID NO: 1152162 - RNA, 19 nt, Homo sapiens
ugacauuucuuugugcuuu

SEQ ID NO: 1152163 - RNA, 17 nt, Homo sapiens
ugaccacagcacagcca

SEQ ID NO: 1152164 - RNA, 18 nt, Homo sapiens
ugaccacagcacagccaa

SEQ ID NO: 1152165 - RNA, 22 nt, Homo sapiens
ugaccacucuuccugaguucag

SEQ ID NO: 1152166 - RNA, 15 nt, Homo sapiens
ugaccauaaccacug

SEQ ID NO: 1152167 - RNA, 23 nt, Homo sapiens
ugaccauaaccacugaagggaau

SEQ ID NO: 1152168 - RNA, 13 nt, Homo sapiens
ugaccauaucaca

SEQ ID NO: 1152169 - RNA, 16 nt, Homo sapiens
ugaccaucugugacua

SEQ ID NO: 1152170 - RNA, 21 nt, Homo sapiens
ugacccucaucuuucuuccaa

SEQ ID NO: 1152171 - RNA, 16 nt, Homo sapiens
ugacccuccaugccaa

SEQ ID NO: 1152172 - RNA, 18 nt, Homo sapiens
ugaccucccaacucuaaa

SEQ ID NO: 1152173 - RNA, 15 nt, Homo sapiens
ugaccugagccagac

SEQ ID NO: 1152174 - RNA, 22 nt, Homo sapiens
ugaccuggugggagcaccugcc

SEQ ID NO: 1152175 - RNA, 17 nt, Homo sapiens
ugacgaacuuccauggc

SEQ ID NO: 1152176 - RNA, 17 nt, Homo sapiens
ugacgacuucacacuau

SEQ ID NO: 1152177 - RNA, 15 nt, Homo sapiens
ugacuaaaaaugcau

SEQ ID NO: 1152178 - RNA, 17 nt, Homo sapiens
ugacuaaccauugauga

SEQ ID NO: 1152179 - RNA, 13 nt, Homo sapiens
ugacuaagccaag

SEQ ID NO: 1152180 - RNA, 18 nt, Homo sapiens
ugacuauaaagcuguuau

SEQ ID NO: 1152181 - RNA, 17 nt, Homo sapiens
ugacucagagugcaaga

SEQ ID NO: 1152182 - RNA, 15 nt, Homo sapiens
ugacucaggacaucc

SEQ ID NO: 1152183 - RNA, 15 nt, Homo sapiens
ugacucgggccuuag

SEQ ID NO: 1152184 - RNA, 22 nt, Homo sapiens
ugacucuccugccucagccucc

SEQ ID NO: 1152185 - RNA, 15 nt, Homo sapiens
ugacucuucaggcca

SEQ ID NO: 1152186 - RNA, 17 nt, Homo sapiens
ugacugauuucaaauca

SEQ ID NO: 1152187 - RNA, 17 nt, Homo sapiens
ugacugcugcuccccac

SEQ ID NO: 1152188 - RNA, 22 nt, Homo sapiens
ugacuguauuuuccaacuuguu

SEQ ID NO: 1152189 - RNA, 13 nt, Homo sapiens
uucuaagauucug

SEQ ID NO: 1152190 - RNA, 22 nt, Homo sapiens
uucuaaggaccugaaauuccaa

SEQ ID NO: 1152191 - RNA, 21 nt, Homo sapiens
uucuaaggccuaggauucuaa

SEQ ID NO: 1152192 - RNA, 22 nt, Homo sapiens
uucuaagguccgguguucuaag

SEQ ID NO: 1152193 - RNA, 20 nt, Homo sapiens
uucuaagucacaggaugaga

SEQ ID NO: 1152194 - RNA, 15 nt, Homo sapiens
uucuaauaaacagac

SEQ ID NO: 1152195 - RNA, 15 nt, Homo sapiens
uucuaauuaaccuua

SEQ ID NO: 1152196 - RNA, 13 nt, Homo sapiens
ugaguauguguau

SEQ ID NO: 1152197 - RNA, 20 nt, Homo sapiens
ugagucaugaucucccugcc

SEQ ID NO: 1152198 - RNA, 22 nt, Homo sapiens
ugaguccaagaggguccuuuag

SEQ ID NO: 1152199 - RNA, 20 nt, Homo sapiens
ugagucuauuuuuguacaaa

SEQ ID NO: 1152200 - RNA, 14 nt, Homo sapiens
ugagucugugccac

SEQ ID NO: 1152201 - RNA, 19 nt, Homo sapiens
ugagucuguugugugucau

SEQ ID NO: 1152202 - RNA, 22 nt, Homo sapiens
ugagugaguucccuuagugaau

SEQ ID NO: 1152203 - RNA, 11 nt, Homo sapiens
ugagugcaagg

SEQ ID NO: 1152204 - RNA, 17 nt, Homo sapiens
ugaguggaugauguuuc

SEQ ID NO: 1152205 - RNA, 19 nt, Homo sapiens
ugaguggcuuuaaugaaua

SEQ ID NO: 1152206 - RNA, 20 nt, Homo sapiens
ugaguucccuuagugaauuu

SEQ ID NO: 1152207 - RNA, 17 nt, Homo sapiens
ugaguucuauaauauaa

SEQ ID NO: 1152208 - RNA, 13 nt, Homo sapiens
ugaguuucucuca

SEQ ID NO: 1152209 - RNA, 12 nt, Homo sapiens
ugaguuugacau

SEQ ID NO: 1152210 - RNA, 23 nt, Homo sapiens
ugaguuuggucccuaaauuugca

SEQ ID NO: 1152211 - RNA, 19 nt, Homo sapiens
ugauaaaacugguuuuaga

SEQ ID NO: 1152212 - RNA, 19 nt, Homo sapiens
ugauaaacauucaucaccu

SEQ ID NO: 1152213 - RNA, 20 nt, Homo sapiens
ugauaaauggaacuauucca

SEQ ID NO: 1152214 - RNA, 12 nt, Homo sapiens
ugauacauccaa

SEQ ID NO: 1152215 - RNA, 19 nt, Homo sapiens
ugauaccauaugaaugaaa

SEQ ID NO: 1152216 - RNA, 13 nt, Homo sapiens
ugauacugcaaua

SEQ ID NO: 1152217 - RNA, 20 nt, Homo sapiens
ugauacuggaggaacacuug

SEQ ID NO: 1152218 - RNA, 13 nt, Homo sapiens
ugauacuuacuca

SEQ ID NO: 1152219 - RNA, 14 nt, Homo sapiens
ugauagaaaugcca

SEQ ID NO: 1152220 - RNA, 16 nt, Homo sapiens
ugauagcagauaucac

SEQ ID NO: 1152221 - RNA, 17 nt, Homo sapiens
ugauagugcaaggaaug

SEQ ID NO: 1152222 - RNA, 23 nt, Homo sapiens
ugauauaacaaagacuucuguca

SEQ ID NO: 1152223 - RNA, 16 nt, Homo sapiens
ugauauacuuacucau

SEQ ID NO: 1152224 - RNA, 17 nt, Homo sapiens
ugauauauaaaugugau

SEQ ID NO: 1152225 - RNA, 17 nt, Homo sapiens
ugauauauuccaccagg

SEQ ID NO: 1152226 - RNA, 20 nt, Homo sapiens
ugauauauuccaccaggaua

SEQ ID NO: 1152227 - RNA, 13 nt, Homo sapiens
ugauaugacuguu

SEQ ID NO: 1152228 - RNA, 22 nt, Homo sapiens
ugauaugcauuugacuuguuaa

SEQ ID NO: 1152229 - RNA, 21 nt, Homo sapiens
ugauauuauuucaggguccca

SEQ ID NO: 1152230 - RNA, 18 nt, Homo sapiens
ugauauugaccaugugau

SEQ ID NO: 1152231 - RNA, 17 nt, Homo sapiens
ugauauuucucuaguag

SEQ ID NO: 1152232 - RNA, 20 nt, Homo sapiens
ugauauuuuuuauacaguga

SEQ ID NO: 1152233 - RNA, 17 nt, Homo sapiens
ugaucaacaauuugggc

SEQ ID NO: 1152234 - RNA, 20 nt, Homo sapiens
ugaucagcgccgcaccagcc

SEQ ID NO: 1152235 - RNA, 21 nt, Homo sapiens
ugaucagcuuucaaagcauuu

SEQ ID NO: 1152236 - RNA, 15 nt, Homo sapiens
ugaucaggaccucca

SEQ ID NO: 1152237 - RNA, 19 nt, Homo sapiens
ugaucccagcucacugcaa

SEQ ID NO: 1152238 - RNA, 13 nt, Homo sapiens
ugauccgccuacc

SEQ ID NO: 1152239 - RNA, 19 nt, Homo sapiens
ugaucgugggguugaccaa

SEQ ID NO: 1152240 - RNA, 21 nt, Homo sapiens
ugaugaaaauguaacuugaaa

SEQ ID NO: 1152241 - RNA, 14 nt, Homo sapiens
ugaugaaucacugu

SEQ ID NO: 1152242 - RNA, 22 nt, Homo sapiens
ugaugcugccaggccugggacc

SEQ ID NO: 1152243 - RNA, 16 nt, Homo sapiens
ugaugcuuuacauuua

SEQ ID NO: 1152244 - RNA, 15 nt, Homo sapiens
ugaugggcuccccag

SEQ ID NO: 1152245 - RNA, 21 nt, Homo sapiens
ugauggggaguaaacccugga

SEQ ID NO: 1152246 - RNA, 22 nt, Homo sapiens
ugauguucauggguauaguuca

SEQ ID NO: 1152247 - RNA, 16 nt, Homo sapiens
ugauguugucacuggu

SEQ ID NO: 1152248 - RNA, 21 nt, Homo sapiens
ugauuaaacucgagauacagc

SEQ ID NO: 1152249 - RNA, 18 nt, Homo sapiens
ugauuaaagaaaauaugc

SEQ ID NO: 1152250 - RNA, 22 nt, Homo sapiens
ugauuaaagaaaauaugcauaa

SEQ ID NO: 1152251 - RNA, 21 nt, Homo sapiens
ugauuaacucuuagaaguguu

SEQ ID NO: 1152252 - RNA, 14 nt, Homo sapiens
ugauuaacugugaa

SEQ ID NO: 1152253 - RNA, 21 nt, Homo sapiens
ugauuauccauauugagucaa

SEQ ID NO: 1152254 - RNA, 23 nt, Homo sapiens
ugauuauccauauugagucaaau

SEQ ID NO: 1152255 - RNA, 18 nt, Homo sapiens
ugauuauggagccuuaga

SEQ ID NO: 1152256 - RNA, 13 nt, Homo sapiens
ugauucaagugag

SEQ ID NO: 1152257 - RNA, 13 nt, Homo sapiens
ugauucacugcau

SEQ ID NO: 1152258 - RNA, 16 nt, Homo sapiens
ugauucaggcuuauaa

SEQ ID NO: 1152259 - RNA, 19 nt, Homo sapiens
ugauucauaguaacuucuu

SEQ ID NO: 1152260 - RNA, 21 nt, Homo sapiens
ugauucaucuucacagcacau

SEQ ID NO: 1152261 - RNA, 15 nt, Homo sapiens
ugauucaugucucac

SEQ ID NO: 1152262 - RNA, 14 nt, Homo sapiens
ugauuccauuuuaa

SEQ ID NO: 1152263 - RNA, 14 nt, Homo sapiens
ugauucggccucuc

SEQ ID NO: 1152264 - RNA, 17 nt, Homo sapiens
ugauucggccucuccac

SEQ ID NO: 1152265 - RNA, 22 nt, Homo sapiens
ugauucuccugccucagccucc

SEQ ID NO: 1152266 - RNA, 20 nt, Homo sapiens
ugauugaaguauucaaucaa

SEQ ID NO: 1152267 - RNA, 13 nt, Homo sapiens
ugauugcuuuuau

SEQ ID NO: 1152268 - RNA, 18 nt, Homo sapiens
ugauuguaaaguagcugu

SEQ ID NO: 1152269 - RNA, 16 nt, Homo sapiens
ugauugugccagugca

SEQ ID NO: 1152270 - RNA, 20 nt, Homo sapiens
ugauuuaaaagggaagucua

SEQ ID NO: 1152271 - RNA, 19 nt, Homo sapiens
ugauuuauuaaauaaucuc

SEQ ID NO: 1152272 - RNA, 12 nt, Homo sapiens
ugauuucuugcu

SEQ ID NO: 1152273 - RNA, 18 nt, Homo sapiens
ugauuugucccuaugcau

SEQ ID NO: 1152274 - RNA, 22 nt, Homo sapiens
ugauuuuaaaauccccaugccu

SEQ ID NO: 1152275 - RNA, 14 nt, Homo sapiens
ugauuuuacaauug

SEQ ID NO: 1152276 - RNA, 13 nt, Homo sapiens
ugauuuucuccau

SEQ ID NO: 1152277 - RNA, 17 nt, Homo sapiens
ugauuuugagaaguaua

SEQ ID NO: 1152278 - RNA, 17 nt, Homo sapiens
ugauuuuugcccagaaa

SEQ ID NO: 1152279 - RNA, 21 nt, Homo sapiens
ugcaaaaaaaaaaaaagcaau

SEQ ID NO: 1152280 - RNA, 16 nt, Homo sapiens
ugcaaaaggacucuca

SEQ ID NO: 1152281 - RNA, 19 nt, Homo sapiens
ugcaaacauuaccuaaaua

SEQ ID NO: 1152282 - RNA, 12 nt, Homo sapiens
ugcaaaccuugg

SEQ ID NO: 1152283 - RNA, 14 nt, Homo sapiens
ugcaaacgcugccu

SEQ ID NO: 1152284 - RNA, 17 nt, Homo sapiens
ugcaaacugagcugcuu

SEQ ID NO: 1152285 - RNA, 18 nt, Homo sapiens
ugcaaagggguugaggaa

SEQ ID NO: 1152286 - RNA, 16 nt, Homo sapiens
ugcaaaggugugcaaa

SEQ ID NO: 1152287 - RNA, 15 nt, Homo sapiens
ugcaaaguacuguaa

SEQ ID NO: 1152288 - RNA, 18 nt, Homo sapiens
ugcaaauaacugaucuca

SEQ ID NO: 1152289 - RNA, 17 nt, Homo sapiens
ugcaaauaagacucuua

SEQ ID NO: 1152290 - RNA, 13 nt, Homo sapiens
ugcaaaugugcag

SEQ ID NO: 1152291 - RNA, 13 nt, Homo sapiens
ugcaaccucugcc

SEQ ID NO: 1152292 - RNA, 16 nt, Homo sapiens
ugcaagagaaacugca

SEQ ID NO: 1152293 - RNA, 21 nt, Homo sapiens
ugcaagcgucugugcauuuau

SEQ ID NO: 1152294 - RNA, 23 nt, Homo sapiens
ugcaagguuccacagaguaagac

SEQ ID NO: 1152295 - RNA, 16 nt, Homo sapiens
ugcaaguauacuaggg

SEQ ID NO: 1152296 - RNA, 14 nt, Homo sapiens
ugcaagugcuguca

SEQ ID NO: 1152297 - RNA, 22 nt, Homo sapiens
ugcaauaaaucugacccagugc

SEQ ID NO: 1152298 - RNA, 17 nt, Homo sapiens
ugcaauaguuaccucaa

SEQ ID NO: 1152299 - RNA, 16 nt, Homo sapiens
ugcaauguagucaaua

SEQ ID NO: 1152300 - RNA, 12 nt, Homo sapiens
ugcaauuacugc

SEQ ID NO: 1152301 - RNA, 14 nt, Homo sapiens
ugcaauugcuccca

SEQ ID NO: 1152302 - RNA, 14 nt, Homo sapiens
ugcaauuugcacaa

SEQ ID NO: 1152303 - RNA, 15 nt, Homo sapiens
ugcacaaaaucuuuu

SEQ ID NO: 1152304 - RNA, 17 nt, Homo sapiens
ugcacaaacuugugagc

SEQ ID NO: 1152305 - RNA, 17 nt, Homo sapiens
ugcacacuuacaguaua

SEQ ID NO: 1152306 - RNA, 12 nt, Homo sapiens
ugcacacuucca

SEQ ID NO: 1152307 - RNA, 13 nt, Homo sapiens
ugcacacuuugcc

SEQ ID NO: 1152308 - RNA, 22 nt, Homo sapiens
ugcacagagucaggaucucaca

SEQ ID NO: 1152309 - RNA, 17 nt, Homo sapiens
ugcacaggucccacugc

SEQ ID NO: 1152310 - RNA, 13 nt, Homo sapiens
ugcacaggucucu

SEQ ID NO: 1152311 - RNA, 23 nt, Homo sapiens
ugcacauaguagguacccaauuc

SEQ ID NO: 1152312 - RNA, 22 nt, Homo sapiens
ugcacauauggacucugcacau

SEQ ID NO: 1152313 - RNA, 20 nt, Homo sapiens
ugcacaugucuuguacaugu

SEQ ID NO: 1152314 - RNA, 11 nt, Homo sapiens
ugcacauuguu

SEQ ID NO: 1152315 - RNA, 12 nt, Homo sapiens
ugcaccacugca

SEQ ID NO: 1152316 - RNA, 17 nt, Homo sapiens
ugcacccauugugauug

SEQ ID NO: 1152317 - RNA, 15 nt, Homo sapiens
ugcaccuaagugugu

SEQ ID NO: 1152318 - RNA, 21 nt, Homo sapiens
ugcaccuugugucuguacacg

SEQ ID NO: 1152319 - RNA, 22 nt, Homo sapiens
ugcaccuugugucuguacacgu

SEQ ID NO: 1152320 - RNA, 19 nt, Homo sapiens
ugcacguuaugguguuucu

SEQ ID NO: 1152321 - RNA, 19 nt, Homo sapiens
ugcacuacagcccuggccu

SEQ ID NO: 1152322 - RNA, 20 nt, Homo sapiens
ugcacuagaggaacccuaca

SEQ ID NO: 1152323 - RNA, 20 nt, Homo sapiens
ugcacuauguauauacauau

SEQ ID NO: 1152324 - RNA, 21 nt, Homo sapiens
ugcacuccagauaugugccaa

SEQ ID NO: 1152325 - RNA, 23 nt, Homo sapiens
ugcacuccagccugggugacaaa

SEQ ID NO: 1152326 - RNA, 22 nt, Homo sapiens
ugcacucuugaacugggcgaau

SEQ ID NO: 1152327 - RNA, 15 nt, Homo sapiens
ugcacugcauuagaa

SEQ ID NO: 1152328 - RNA, 22 nt, Homo sapiens
ugcacuuauaagaaagaucaaa

SEQ ID NO: 1152329 - RNA, 16 nt, Homo sapiens
ugcacuuaugauuuca

SEQ ID NO: 1152330 - RNA, 15 nt, Homo sapiens
uugcaauuuugcaua

SEQ ID NO: 1152331 - RNA, 12 nt, Homo sapiens
uugcacagcagc

SEQ ID NO: 1152332 - RNA, 18 nt, Homo sapiens
uugcacaggucccacugc

SEQ ID NO: 1152333 - RNA, 12 nt, Homo sapiens
uugcacauucua

SEQ ID NO: 1152334 - RNA, 21 nt, Homo sapiens
uugcaccacugcacuccaguc

SEQ ID NO: 1152335 - RNA, 18 nt, Homo sapiens
uugcaccguucucuguau

SEQ ID NO: 1152336 - RNA, 17 nt, Homo sapiens
uugcaccuaucucagcc

SEQ ID NO: 1152337 - RNA, 14 nt, Homo sapiens
uugcaccuuucuag

SEQ ID NO: 1152338 - RNA, 16 nt, Homo sapiens
uugcacugaaauggaa

SEQ ID NO: 1152339 - RNA, 18 nt, Homo sapiens
uugcacugaaauggaauu

SEQ ID NO: 1152340 - RNA, 11 nt, Homo sapiens
uugcacugggg

SEQ ID NO: 1152341 - RNA, 20 nt, Homo sapiens
uugcagcuuauauucaucca

SEQ ID NO: 1152342 - RNA, 11 nt, Homo sapiens
uugcagugaag

SEQ ID NO: 1152343 - RNA, 14 nt, Homo sapiens
uugcagugagcuga

SEQ ID NO: 1152344 - RNA, 18 nt, Homo sapiens
uugcauagaguauagcuc

SEQ ID NO: 1152345 - RNA, 21 nt, Homo sapiens
uugcauggauguuuuagccau

SEQ ID NO: 1152346 - RNA, 15 nt, Homo sapiens
uugcauggcauuaau

SEQ ID NO: 1152347 - RNA, 12 nt, Homo sapiens
uugcaugggcua

SEQ ID NO: 1152348 - RNA, 17 nt, Homo sapiens
uugcaugugacucugaa

SEQ ID NO: 1152349 - RNA, 12 nt, Homo sapiens
uugcauugacau

SEQ ID NO: 1152350 - RNA, 21 nt, Homo sapiens
uugcauuuauuuaagacacug

SEQ ID NO: 1152351 - RNA, 23 nt, Homo sapiens
uugccaaucuuguuuuaagcaaa

SEQ ID NO: 1152352 - RNA, 14 nt, Homo sapiens
uugccacaucuuaa

SEQ ID NO: 1152353 - RNA, 13 nt, Homo sapiens
uugccagccauuc

SEQ ID NO: 1152354 - RNA, 11 nt, Homo sapiens
uugccagugau

SEQ ID NO: 1152355 - RNA, 19 nt, Homo sapiens
uugccaucggaacugccuu

SEQ ID NO: 1152356 - RNA, 19 nt, Homo sapiens
uugccauggucaccaaaca

SEQ ID NO: 1152357 - RNA, 18 nt, Homo sapiens
uugcccacacacacuccu

SEQ ID NO: 1152358 - RNA, 21 nt, Homo sapiens
uugcccaggcuggagugcaau

SEQ ID NO: 1152359 - RNA, 23 nt, Homo sapiens
uugcccauggaagucucaaagau

SEQ ID NO: 1152360 - RNA, 19 nt, Homo sapiens
uugcccccgacggcuguga

SEQ ID NO: 1152361 - RNA, 15 nt, Homo sapiens
uugccucuacuuuga

SEQ ID NO: 1152362 - RNA, 17 nt, Homo sapiens
uugccuggagugugaac

SEQ ID NO: 1152363 - RNA, 20 nt, Homo sapiens
uugccuucuccacuuuggga

SEQ ID NO: 1152364 - RNA, 15 nt, Homo sapiens
uugcgauagagucuc

SEQ ID NO: 1152365 - RNA, 20 nt, Homo sapiens
uugcgccguuguacuccagc

SEQ ID NO: 1152366 - RNA, 17 nt, Homo sapiens
uugcguggacucugcac

SEQ ID NO: 1152367 - RNA, 13 nt, Homo sapiens
uugcuaaacacug

SEQ ID NO: 1152368 - RNA, 21 nt, Homo sapiens
uugcuaaauguaacagucuga

SEQ ID NO: 1152369 - RNA, 17 nt, Homo sapiens
uugcuaacacacagagc

SEQ ID NO: 1152370 - RNA, 18 nt, Homo sapiens
uugcucucggugcuucca

SEQ ID NO: 1152371 - RNA, 14 nt, Homo sapiens
uugcucuuacuuga

SEQ ID NO: 1152372 - RNA, 13 nt, Homo sapiens
uugcugaauucuc

SEQ ID NO: 1152373 - RNA, 18 nt, Homo sapiens
uugcugauaaaacagauu

SEQ ID NO: 1152374 - RNA, 18 nt, Homo sapiens
uugcugauaccauaugaa

SEQ ID NO: 1152375 - RNA, 18 nt, Homo sapiens
uugcugcaccaaugcacu

SEQ ID NO: 1152376 - RNA, 20 nt, Homo sapiens
uugcugucuuggggucccac

SEQ ID NO: 1152377 - RNA, 19 nt, Homo sapiens
uugcuguuccuuacuuuac

SEQ ID NO: 1152378 - RNA, 12 nt, Homo sapiens
uugcuguucuac

SEQ ID NO: 1152379 - RNA, 12 nt, Homo sapiens
uugcuucaauua

SEQ ID NO: 1152380 - RNA, 13 nt, Homo sapiens
uugcuugagcuca

SEQ ID NO: 1152381 - RNA, 15 nt, Homo sapiens
uugcuuggugcuggu

SEQ ID NO: 1152382 - RNA, 22 nt, Homo sapiens
uuggaaaaagaaaaaaggguuu

SEQ ID NO: 1152383 - RNA, 18 nt, Homo sapiens
uuggaaaaagccugugaa

SEQ ID NO: 1152384 - RNA, 17 nt, Homo sapiens
uuggaaagaaauucuga

SEQ ID NO: 1152385 - RNA, 18 nt, Homo sapiens
uuggaaagcaagguuucc

SEQ ID NO: 1152386 - RNA, 21 nt, Homo sapiens
uuggaagcauucacaaaguag

SEQ ID NO: 1152387 - RNA, 13 nt, Homo sapiens
uuggaagugcaga

SEQ ID NO: 1152388 - RNA, 12 nt, Homo sapiens
uuggaauucacc

SEQ ID NO: 1152389 - RNA, 21 nt, Homo sapiens
uuggacaacuagccucaucuc

SEQ ID NO: 1152390 - RNA, 12 nt, Homo sapiens
uuggacacugug

SEQ ID NO: 1152391 - RNA, 19 nt, Homo sapiens
uuggacacugugcuacuga

SEQ ID NO: 1152392 - RNA, 14 nt, Homo sapiens
uuggacagauuuca

SEQ ID NO: 1152393 - RNA, 16 nt, Homo sapiens
uuggaccauccuauuu

SEQ ID NO: 1152394 - RNA, 14 nt, Homo sapiens
uuggacuugcugaa

SEQ ID NO: 1152395 - RNA, 23 nt, Homo sapiens
uuggagucccaggggcagccaca

SEQ ID NO: 1152396 - RNA, 13 nt, Homo sapiens
uuggagugagaug

SEQ ID NO: 1152397 - RNA, 18 nt, Homo sapiens
uuggagugagaugaagga

SEQ ID NO: 1152398 - RNA, 20 nt, Homo sapiens
uuggaguguaaaccaaauac

SEQ ID NO: 1152399 - RNA, 18 nt, Homo sapiens
uuggaguuaguggauaac

SEQ ID NO: 1152400 - RNA, 12 nt, Homo sapiens
uuggaguuuucu

SEQ ID NO: 1152401 - RNA, 13 nt, Homo sapiens
uuggauaagccaa

SEQ ID NO: 1152402 - RNA, 17 nt, Homo sapiens
uuggauuauuccucuac

SEQ ID NO: 1152403 - RNA, 19 nt, Homo sapiens
uuggcaacaauauaguauu

SEQ ID NO: 1152404 - RNA, 13 nt, Homo sapiens
uuggcaacagaaa

SEQ ID NO: 1152405 - RNA, 17 nt, Homo sapiens
uuggcagagcuucuucc

SEQ ID NO: 1152406 - RNA, 14 nt, Homo sapiens
uuggcagcauucca

SEQ ID NO: 1152407 - RNA, 19 nt, Homo sapiens
uuggcagugauccugcaag

SEQ ID NO: 1152408 - RNA, 18 nt, Homo sapiens
uuggccaagcugcugcuu

SEQ ID NO: 1152409 - RNA, 19 nt, Homo sapiens
uuggccaccaggugccuuu

SEQ ID NO: 1152410 - RNA, 23 nt, Homo sapiens
uuggcccgcggccugcaccgacc

SEQ ID NO: 1152411 - RNA, 23 nt, Homo sapiens
uuggcgggugggagacuccgggu

SEQ ID NO: 1152412 - RNA, 13 nt, Homo sapiens
uuggcucuaguaa

SEQ ID NO: 1152413 - RNA, 14 nt, Homo sapiens
uuggcugcacuuga

SEQ ID NO: 1152414 - RNA, 14 nt, Homo sapiens
uuggcugcugccac

SEQ ID NO: 1152415 - RNA, 15 nt, Homo sapiens
uuggcuuccaugaug

SEQ ID NO: 1152416 - RNA, 21 nt, Homo sapiens
uugggagcaccgccugugaaa

SEQ ID NO: 1152417 - RNA, 16 nt, Homo sapiens
uugggauauucugaaa

SEQ ID NO: 1152418 - RNA, 21 nt, Homo sapiens
uugggauauucugaaacuuga

SEQ ID NO: 1152419 - RNA, 20 nt, Homo sapiens
uugggauugagucugugcca

SEQ ID NO: 1152420 - RNA, 22 nt, Homo sapiens
uugggcaggagucaccaugcaa

SEQ ID NO: 1152421 - RNA, 15 nt, Homo sapiens
uugggcccuuugagu

SEQ ID NO: 1152422 - RNA, 15 nt, Homo sapiens
uugggccugcuccag

SEQ ID NO: 1152423 - RNA, 21 nt, Homo sapiens
uugggcguuugaacucaggga

SEQ ID NO: 1152424 - RNA, 20 nt, Homo sapiens
uugggcuacuguagauuugu

SEQ ID NO: 1152425 - RNA, 14 nt, Homo sapiens
uuggggccagggaa

SEQ ID NO: 1152426 - RNA, 20 nt, Homo sapiens
uuggggggaauucucagugc

SEQ ID NO: 1152427 - RNA, 18 nt, Homo sapiens
uugggugugugguggauu

SEQ ID NO: 1152428 - RNA, 15 nt, Homo sapiens
uugguaugagacaga

SEQ ID NO: 1152429 - RNA, 14 nt, Homo sapiens
uuggucacauggag

SEQ ID NO: 1152430 - RNA, 14 nt, Homo sapiens
uuggugaauuucac

SEQ ID NO: 1152431 - RNA, 16 nt, Homo sapiens
uuggugaauuucacaa

SEQ ID NO: 1152432 - RNA, 11 nt, Homo sapiens
uuggugacaau

SEQ ID NO: 1152433 - RNA, 23 nt, Homo sapiens
uuggugacuaucccaacagucau

SEQ ID NO: 1152434 - RNA, 14 nt, Homo sapiens
uuggugcuuuccag

SEQ ID NO: 1152435 - RNA, 17 nt, Homo sapiens
uuggugcuuuccagaau

SEQ ID NO: 1152436 - RNA, 11 nt, Homo sapiens
uugguggcaug

SEQ ID NO: 1152437 - RNA, 23 nt, Homo sapiens
uugguguuaaaacacuucugucc

SEQ ID NO: 1152438 - RNA, 17 nt, Homo sapiens
uugguucagggugauaa

SEQ ID NO: 1152439 - RNA, 14 nt, Homo sapiens
uugguucucuccac

SEQ ID NO: 1152440 - RNA, 16 nt, Homo sapiens
uugguuuuguacugga

SEQ ID NO: 1152441 - RNA, 19 nt, Homo sapiens
uuguaaaagaugcagagua

SEQ ID NO: 1152442 - RNA, 19 nt, Homo sapiens
uuguaaaauuucacuuaau

SEQ ID NO: 1152443 - RNA, 22 nt, Homo sapiens
uuguaaaggauaucaaugccuu

SEQ ID NO: 1152444 - RNA, 15 nt, Homo sapiens
uuguaaauacaugua

SEQ ID NO: 1152445 - RNA, 17 nt, Homo sapiens
uuguaaaucacauccuu

SEQ ID NO: 1152446 - RNA, 17 nt, Homo sapiens
uuguaaauguacuggua

SEQ ID NO: 1152447 - RNA, 15 nt, Homo sapiens
uuguaaaugugacac

SEQ ID NO: 1152448 - RNA, 15 nt, Homo sapiens
uuguaacuauaccuc

SEQ ID NO: 1152449 - RNA, 18 nt, Homo sapiens
uuguaacuuuuugcacua

SEQ ID NO: 1152450 - RNA, 20 nt, Homo sapiens
uuaaaaaugucuugcuguug

SEQ ID NO: 1152451 - RNA, 19 nt, Homo sapiens
uuaaaaauuaaauucucuc

SEQ ID NO: 1152452 - RNA, 18 nt, Homo sapiens
uuaaaacguguaaaugaa

SEQ ID NO: 1152453 - RNA, 16 nt, Homo sapiens
uucacugugcucauca

SEQ ID NO: 1152454 - RNA, 19 nt, Homo sapiens
uucacuucgaaauucugag

SEQ ID NO: 1152455 - RNA, 12 nt, Homo sapiens
uucagaaacuca

SEQ ID NO: 1152456 - RNA, 19 nt, Homo sapiens
accuucaggcagccagugu

SEQ ID NO: 1152457 - RNA, 14 nt, Homo sapiens
accuuccuuaccuc

SEQ ID NO: 1152458 - RNA, 22 nt, Homo sapiens
accuucguuuacuaugccugug

SEQ ID NO: 1152459 - RNA, 13 nt, Homo sapiens
accuugagcagaa

SEQ ID NO: 1152460 - RNA, 18 nt, Homo sapiens
accuugccacccauucuu

SEQ ID NO: 1152461 - RNA, 21 nt, Homo sapiens
accuugccuguaguccagucu

SEQ ID NO: 1152462 - RNA, 23 nt, Homo sapiens
accuuggagcauuuauguagaca

SEQ ID NO: 1152463 - RNA, 21 nt, Homo sapiens
accuuguaaaagacaguguau

SEQ ID NO: 1152464 - RNA, 15 nt, Homo sapiens
accuugugagggaga

SEQ ID NO: 1152465 - RNA, 13 nt, Homo sapiens
accuugugccugg

SEQ ID NO: 1152466 - RNA, 17 nt, Homo sapiens
accuugugucuguacac

SEQ ID NO: 1152467 - RNA, 19 nt, Homo sapiens
accuuugauuuuuugccca

SEQ ID NO: 1152468 - RNA, 20 nt, Homo sapiens
accuuugauuuuuugcccag

SEQ ID NO: 1152469 - RNA, 22 nt, Homo sapiens
accuuugcccacacacacuccu

SEQ ID NO: 1152470 - RNA, 10 nt, Homo sapiens
accuuuucau

SEQ ID NO: 1152471 - RNA, 19 nt, Homo sapiens
accuuuuuauauuuuauac

SEQ ID NO: 1152472 - RNA, 15 nt, Homo sapiens
acgaacccaccugcu

SEQ ID NO: 1152473 - RNA, 21 nt, Homo sapiens
acgaagugccagaacccaaau

SEQ ID NO: 1152474 - RNA, 16 nt, Homo sapiens
acgaauauggacauau

SEQ ID NO: 1152475 - RNA, 17 nt, Homo sapiens
acgaauauggacauauc

SEQ ID NO: 1152476 - RNA, 22 nt, Homo sapiens
acgaauuaauuaccuggcacca

SEQ ID NO: 1152477 - RNA, 18 nt, Homo sapiens
acgacuggccagggccac

SEQ ID NO: 1152478 - RNA, 17 nt, Homo sapiens
acgacugucuccauggc

SEQ ID NO: 1152479 - RNA, 16 nt, Homo sapiens
acgagaagguacugaa

SEQ ID NO: 1152480 - RNA, 21 nt, Homo sapiens
acgagguggcucgacugcuca

SEQ ID NO: 1152481 - RNA, 23 nt, Homo sapiens
acgauguguugaccggcugccgu

SEQ ID NO: 1152482 - RNA, 18 nt, Homo sapiens
acgcaccuggguguuaca

SEQ ID NO: 1152483 - RNA, 18 nt, Homo sapiens
acgcaccuguagucccag

SEQ ID NO: 1152484 - RNA, 23 nt, Homo sapiens
acgcagaagagggggaggggaag

SEQ ID NO: 1152485 - RNA, 22 nt, Homo sapiens
acgcagagauuuucaucuauua

SEQ ID NO: 1152486 - RNA, 22 nt, Homo sapiens
acgcaggccccucuccuccgug

SEQ ID NO: 1152487 - RNA, 21 nt, Homo sapiens
acgccauuuaaaagucugccu

SEQ ID NO: 1152488 - RNA, 19 nt, Homo sapiens
aaagacacucccaccagca

SEQ ID NO: 1152489 - RNA, 9 nt, Homo sapiens
aaagacaga

SEQ ID NO: 1152490 - RNA, 21 nt, Homo sapiens
aaagacauaauuuaauuccuu

SEQ ID NO: 1152491 - RNA, 17 nt, Homo sapiens
aaagacauccauaaaga

SEQ ID NO: 1152492 - RNA, 22 nt, Homo sapiens
aaagaccuuuuccaugcacccu

SEQ ID NO: 1152493 - RNA, 22 nt, Homo sapiens
aaagacggauggcaggauccaa

SEQ ID NO: 1152494 - RNA, 23 nt, Homo sapiens
aaagacugaaucuaccugcccua

SEQ ID NO: 1152495 - RNA, 17 nt, Homo sapiens
aaagacuucugucauaa

SEQ ID NO: 1152496 - RNA, 23 nt, Homo sapiens
aaagagacagagacuggcauuuu

SEQ ID NO: 1152497 - RNA, 15 nt, Homo sapiens
aaagaggaaaacccu

SEQ ID NO: 1152498 - RNA, 16 nt, Homo sapiens
aaagaggacaggcuac

SEQ ID NO: 1152499 - RNA, 19 nt, Homo sapiens
aaagaggagauuaaccucu

SEQ ID NO: 1152500 - RNA, 21 nt, Homo sapiens
aaagaggcugaggcuggcaca

SEQ ID NO: 1152501 - RNA, 18 nt, Homo sapiens
aaagauauaaaugccaaa

SEQ ID NO: 1152502 - RNA, 18 nt, Homo sapiens
aaagaucauaguugcaaa

SEQ ID NO: 1152503 - RNA, 20 nt, Homo sapiens
aaagaucauaguugcaaaau

SEQ ID NO: 1152504 - RNA, 14 nt, Homo sapiens
aaagaucuucugua

SEQ ID NO: 1152505 - RNA, 13 nt, Homo sapiens
aaagaugaugcuc

SEQ ID NO: 1152506 - RNA, 12 nt, Homo sapiens
aaagaugcauuu

SEQ ID NO: 1152507 - RNA, 15 nt, Homo sapiens
aaagauucugucuua

SEQ ID NO: 1152508 - RNA, 20 nt, Homo sapiens
aaagcaaaucuuucuguaaa

SEQ ID NO: 1152509 - RNA, 15 nt, Homo sapiens
aaagcacaguuugaa

SEQ ID NO: 1152510 - RNA, 18 nt, Homo sapiens
aaagcacuguuucucuca

SEQ ID NO: 1152511 - RNA, 14 nt, Homo sapiens
aaagcagauuuucc

SEQ ID NO: 1152512 - RNA, 16 nt, Homo sapiens
aaagcagccacgaggu

SEQ ID NO: 1152513 - RNA, 22 nt, Homo sapiens
aaagcagccacgaggugcaaca

SEQ ID NO: 1152514 - RNA, 17 nt, Homo sapiens
aaagcagggacugugaa

SEQ ID NO: 1152515 - RNA, 13 nt, Homo sapiens
aaagcaguagcau

SEQ ID NO: 1152516 - RNA, 16 nt, Homo sapiens
aaagcagucuguucug

SEQ ID NO: 1152517 - RNA, 22 nt, Homo sapiens
aaagcaguggcuuagcugccau

SEQ ID NO: 1152518 - RNA, 21 nt, Homo sapiens
aaagcaugucucugcuuccau

SEQ ID NO: 1152519 - RNA, 11 nt, Homo sapiens
aaagcauuuac

SEQ ID NO: 1152520 - RNA, 21 nt, Homo sapiens
aaagcauuuucucucauaggc

SEQ ID NO: 1152521 - RNA, 21 nt, Homo sapiens
aaagccaaccagccuuugggu

SEQ ID NO: 1152522 - RNA, 15 nt, Homo sapiens
aaagccagucaaaac

SEQ ID NO: 1152523 - RNA, 23 nt, Homo sapiens
aaagccauauggacacugugaca

SEQ ID NO: 1152524 - RNA, 14 nt, Homo sapiens
aaagccaugugcua

SEQ ID NO: 1152525 - RNA, 19 nt, Homo sapiens
aaagcccacuuuguucgca

SEQ ID NO: 1152526 - RNA, 23 nt, Homo sapiens
aaagcccccuguuuuaugcccuu

SEQ ID NO: 1152527 - RNA, 21 nt, Homo sapiens
aaagccgggggccugcaucac

SEQ ID NO: 1152528 - RNA, 19 nt, Homo sapiens
aaagcgagacuccaucuca

SEQ ID NO: 1152529 - RNA, 15 nt, Homo sapiens
aaagcgugugugaac

SEQ ID NO: 1152530 - RNA, 16 nt, Homo sapiens
aaagcgugugugaaca

SEQ ID NO: 1152531 - RNA, 17 nt, Homo sapiens
aaagcuagguguuuaau

SEQ ID NO: 1152532 - RNA, 21 nt, Homo sapiens
aaagcuccauuuuuagugaaa

SEQ ID NO: 1152533 - RNA, 17 nt, Homo sapiens
aaagcugacaucuguaa

SEQ ID NO: 1152534 - RNA, 21 nt, Homo sapiens
aaagcugccccaucuggggac

SEQ ID NO: 1152535 - RNA, 23 nt, Homo sapiens
aaagcuguaagaaaaugcuguca

SEQ ID NO: 1152536 - RNA, 21 nt, Homo sapiens
aaagcuguucucauuccuguu

SEQ ID NO: 1152537 - RNA, 13 nt, Homo sapiens
aaagcuguuuuau

SEQ ID NO: 1152538 - RNA, 18 nt, Homo sapiens
aaagcuuuaaaugucugc

SEQ ID NO: 1152539 - RNA, 23 nt, Homo sapiens
aaagcuuucauguaaacugugca

SEQ ID NO: 1152540 - RNA, 16 nt, Homo sapiens
aaaggaaaaaaagacu

SEQ ID NO: 1152541 - RNA, 17 nt, Homo sapiens
aaaggaaaaauaaucaa

SEQ ID NO: 1152542 - RNA, 16 nt, Homo sapiens
aaaggaauccacauca

SEQ ID NO: 1152543 - RNA, 19 nt, Homo sapiens
aaaggacagaguaugaaca

SEQ ID NO: 1152544 - RNA, 18 nt, Homo sapiens
aaaggauuaauugcugca

SEQ ID NO: 1152545 - RNA, 16 nt, Homo sapiens
aaaggcaagccagcau

SEQ ID NO: 1152546 - RNA, 13 nt, Homo sapiens
aaaggcacaguga

SEQ ID NO: 1152547 - RNA, 23 nt, Homo sapiens
aaaggccuuuggaaagacuugaa

SEQ ID NO: 1152548 - RNA, 13 nt, Homo sapiens
aaaggcuuuuuau

SEQ ID NO: 1152549 - RNA, 19 nt, Homo sapiens
aaagggcagcccuccuuac

SEQ ID NO: 1152550 - RNA, 19 nt, Homo sapiens
aaagggcgcaaagggcaug

SEQ ID NO: 1152551 - RNA, 16 nt, Homo sapiens
aaaggggaacugucaa

SEQ ID NO: 1152552 - RNA, 19 nt, Homo sapiens
aaaggugguguuucuguaa

SEQ ID NO: 1152553 - RNA, 16 nt, Homo sapiens
aaagguuacccuguaa

SEQ ID NO: 1152554 - RNA, 21 nt, Homo sapiens
aaagguuugagauuccuguaa

SEQ ID NO: 1152555 - RNA, 16 nt, Homo sapiens
aaaguaagcauuucca

SEQ ID NO: 1152556 - RNA, 12 nt, Homo sapiens
aaaguaaugccu

SEQ ID NO: 1152557 - RNA, 19 nt, Homo sapiens
aaaguacaucucuacuaaa

SEQ ID NO: 1152558 - RNA, 13 nt, Homo sapiens
aaaguacuugacu

SEQ ID NO: 1152559 - RNA, 14 nt, Homo sapiens
aaaguagugaguua

SEQ ID NO: 1152560 - RNA, 16 nt, Homo sapiens
aaaguaucauuacaua

SEQ ID NO: 1152561 - RNA, 15 nt, Homo sapiens
aaaguauuuauugua

SEQ ID NO: 1152562 - RNA, 16 nt, Homo sapiens
aaagucaaaaggugcc

SEQ ID NO: 1152563 - RNA, 18 nt, Homo sapiens
aaagucaagccacauggu

SEQ ID NO: 1152564 - RNA, 15 nt, Homo sapiens
aaagucagcuacaaa

SEQ ID NO: 1152565 - RNA, 15 nt, Homo sapiens
aaagucaucaugaac

SEQ ID NO: 1152566 - RNA, 16 nt, Homo sapiens
aaagucauuuaaugua

SEQ ID NO: 1152567 - RNA, 15 nt, Homo sapiens
aaagucugucagguu

SEQ ID NO: 1152568 - RNA, 15 nt, Homo sapiens
aaagucuuaccucag

SEQ ID NO: 1152569 - RNA, 12 nt, Homo sapiens
aaagugccaaag

SEQ ID NO: 1152570 - RNA, 14 nt, Homo sapiens
aaagugccaaagaa

SEQ ID NO: 1152571 - RNA, 19 nt, Homo sapiens
aaaguggaagugacauugu

SEQ ID NO: 1152572 - RNA, 21 nt, Homo sapiens
aaaguggcguuguucauagaa

SEQ ID NO: 1152573 - RNA, 14 nt, Homo sapiens
aaagugugagcaaa

SEQ ID NO: 1152574 - RNA, 20 nt, Homo sapiens
aaaguuacugauucacugca

SEQ ID NO: 1152575 - RNA, 21 nt, Homo sapiens
aaaguuacugauucacugcau

SEQ ID NO: 1152576 - RNA, 13 nt, Homo sapiens
aaaguucuaguga

SEQ ID NO: 1152577 - RNA, 20 nt, Homo sapiens
aaaguugauaaguacaugau

SEQ ID NO: 1152578 - RNA, 18 nt, Homo sapiens
aaaguuguuugugccuuu

SEQ ID NO: 1152579 - RNA, 18 nt, Homo sapiens
aaaguuguuuuacagcug

SEQ ID NO: 1152580 - RNA, 20 nt, Homo sapiens
aaaguuuuauuugaaugaac

SEQ ID NO: 1152581 - RNA, 20 nt, Homo sapiens
aaaguuuuuauucugaauaa

SEQ ID NO: 1152582 - RNA, 19 nt, Homo sapiens
aaauaaaaaacauauacaa

SEQ ID NO: 1152583 - RNA, 13 nt, Homo sapiens
aaauaaaccuccu

SEQ ID NO: 1152584 - RNA, 18 nt, Homo sapiens
aaauaaaguuuuuauucu

SEQ ID NO: 1152585 - RNA, 16 nt, Homo sapiens
aaauaaauaaaagccu

SEQ ID NO: 1152586 - RNA, 13 nt, Homo sapiens
aaauaaauucucu

SEQ ID NO: 1152587 - RNA, 12 nt, Homo sapiens
aaauaaccacug

SEQ ID NO: 1152588 - RNA, 15 nt, Homo sapiens
aaauaacugaaccaa

SEQ ID NO: 1152589 - RNA, 13 nt, Homo sapiens
aaauaacuguauu

SEQ ID NO: 1152590 - RNA, 14 nt, Homo sapiens
aaauaaucagugac

SEQ ID NO: 1152591 - RNA, 19 nt, Homo sapiens
aaauaauuuauuuugcucu

SEQ ID NO: 1152592 - RNA, 20 nt, Homo sapiens
aaauaauuuuauuaugcaac

SEQ ID NO: 1152593 - RNA, 18 nt, Homo sapiens
aaauacaauuauuguaua

SEQ ID NO: 1152594 - RNA, 14 nt, Homo sapiens
aaauacacaaugaa

SEQ ID NO: 1152595 - RNA, 14 nt, Homo sapiens
aaauacacauagca

SEQ ID NO: 1152596 - RNA, 16 nt, Homo sapiens
aaauacacucucuuau

SEQ ID NO: 1152597 - RNA, 16 nt, Homo sapiens
aaauacacuuccugcu

SEQ ID NO: 1152598 - RNA, 13 nt, Homo sapiens
aaauacaguauga

SEQ ID NO: 1152599 - RNA, 15 nt, Homo sapiens
aaauacagucuucca

SEQ ID NO: 1152600 - RNA, 13 nt, Homo sapiens
aaauacauaccua

SEQ ID NO: 1152601 - RNA, 23 nt, Homo sapiens
aaauacauguacagacaaauacu

SEQ ID NO: 1152602 - RNA, 16 nt, Homo sapiens
aaauaccaacuguaca

SEQ ID NO: 1152603 - RNA, 14 nt, Homo sapiens
aaauaccacaguug

SEQ ID NO: 1152604 - RNA, 14 nt, Homo sapiens
aaauacuauuucaa

SEQ ID NO: 1152605 - RNA, 13 nt, Homo sapiens
aaauacuugcucc

SEQ ID NO: 1152606 - RNA, 15 nt, Homo sapiens
aaauagaaacauauc

SEQ ID NO: 1152607 - RNA, 22 nt, Homo sapiens
aaauagagcuuuuaaaaauguc

SEQ ID NO: 1152608 - RNA, 15 nt, Homo sapiens
aaauaggauugcuuc

SEQ ID NO: 1152609 - RNA, 16 nt, Homo sapiens
aaauaggauugcuuca

SEQ ID NO: 1152610 - RNA, 15 nt, Homo sapiens
aaauaguacuaaagg

SEQ ID NO: 1152611 - RNA, 13 nt, Homo sapiens
aaauagucuucca

SEQ ID NO: 1152612 - RNA, 22 nt, Homo sapiens
aaauaguugcugucauccacuu

SEQ ID NO: 1152613 - RNA, 23 nt, Homo sapiens
aaauaguugcugucauccacuuu

SEQ ID NO: 1152614 - RNA, 12 nt, Homo sapiens
aaauauagccuu

SEQ ID NO: 1152615 - RNA, 18 nt, Homo sapiens
aaauaucuuggccuaaac

SEQ ID NO: 1152616 - RNA, 17 nt, Homo sapiens
aaauaugaagacauaaa

SEQ ID NO: 1152617 - RNA, 23 nt, Homo sapiens
aaauaugaagcucaccuguugcu

SEQ ID NO: 1152618 - RNA, 22 nt, Homo sapiens
aaauaugauuuuuagaaaucag

SEQ ID NO: 1152619 - RNA, 18 nt, Homo sapiens
aaauaugcaccaaaucau

SEQ ID NO: 1152620 - RNA, 22 nt, Homo sapiens
aaauaugcaccaaaucaucucu

SEQ ID NO: 1152621 - RNA, 22 nt, Homo sapiens
aaauauuguauccuuuauuucu

SEQ ID NO: 1152622 - RNA, 20 nt, Homo sapiens
aaauauugucauaggauuaa

SEQ ID NO: 1152623 - RNA, 16 nt, Homo sapiens
aaauauuuacauuuug

SEQ ID NO: 1152624 - RNA, 16 nt, Homo sapiens
aaauauuugacaucua

SEQ ID NO: 1152625 - RNA, 19 nt, Homo sapiens
aaauauuuggauguuaaau

SEQ ID NO: 1152626 - RNA, 21 nt, Homo sapiens
aaaucaaacacaacacaagaa

SEQ ID NO: 1152627 - RNA, 14 nt, Homo sapiens
aaaucaaacuguag

SEQ ID NO: 1152628 - RNA, 16 nt, Homo sapiens
aaaucaacccuuccua

SEQ ID NO: 1152629 - RNA, 13 nt, Homo sapiens
aaaucaacuugcu

SEQ ID NO: 1152630 - RNA, 21 nt, Homo sapiens
aaaucaacuuuuuauugccuu

SEQ ID NO: 1152631 - RNA, 20 nt, Homo sapiens
aaaucaauaaagaccacuuu

SEQ ID NO: 1152632 - RNA, 18 nt, Homo sapiens
aaaucagccagacauggu

SEQ ID NO: 1152633 - RNA, 20 nt, Homo sapiens
aaaucauccaagacaguuau

SEQ ID NO: 1152634 - RNA, 21 nt, Homo sapiens
aaaucauccugucacaaggca

SEQ ID NO: 1152635 - RNA, 13 nt, Homo sapiens
aaauccaaaaaga

SEQ ID NO: 1152636 - RNA, 17 nt, Homo sapiens
aaauccccaugccugug

SEQ ID NO: 1152637 - RNA, 13 nt, Homo sapiens
aaauccucauugu

SEQ ID NO: 1152638 - RNA, 15 nt, Homo sapiens
aaauccuuccaugaa

SEQ ID NO: 1152639 - RNA, 14 nt, Homo sapiens
aaaucgugccuugu

SEQ ID NO: 1152640 - RNA, 18 nt, Homo sapiens
aaaucuauagaacugaau

SEQ ID NO: 1152641 - RNA, 18 nt, Homo sapiens
aaaucucccaugugcaua

SEQ ID NO: 1152642 - RNA, 12 nt, Homo sapiens
aaaucugaggga

SEQ ID NO: 1152643 - RNA, 19 nt, Homo sapiens
aaaucuggguaucuuucca

SEQ ID NO: 1152644 - RNA, 20 nt, Homo sapiens
aaaucuguaaucagcaauaa

SEQ ID NO: 1152645 - RNA, 23 nt, Homo sapiens
aaaucuguaucuguagugagaua

SEQ ID NO: 1152646 - RNA, 16 nt, Homo sapiens
aaaucuuauaguucua

SEQ ID NO: 1152647 - RNA, 15 nt, Homo sapiens
aaaucuugacuacag

SEQ ID NO: 1152648 - RNA, 23 nt, Homo sapiens
aaaugaauuuuuuuuauccuccu

SEQ ID NO: 1152649 - RNA, 13 nt, Homo sapiens
aaaugagcaggga

SEQ ID NO: 1152650 - RNA, 18 nt, Homo sapiens
aaaugaggaggaugcuaa

SEQ ID NO: 1152651 - RNA, 13 nt, Homo sapiens
aaaugaguagaca

SEQ ID NO: 1152652 - RNA, 22 nt, Homo sapiens
aaaugagucaggcaauugauug

SEQ ID NO: 1152653 - RNA, 14 nt, Homo sapiens
aaaugagugcuuaa

SEQ ID NO: 1152654 - RNA, 18 nt, Homo sapiens
aaaugauacuuacugaac

SEQ ID NO: 1152655 - RNA, 16 nt, Homo sapiens
aaaugauccucagugc

SEQ ID NO: 1152656 - RNA, 14 nt, Homo sapiens
aaaugauguuguca

SEQ ID NO: 1152657 - RNA, 13 nt, Homo sapiens
aaaugcaaaauaa

SEQ ID NO: 1152658 - RNA, 18 nt, Homo sapiens
aaaugcaagcucuggaaa

SEQ ID NO: 1152659 - RNA, 22 nt, Homo sapiens
aaaugcaauguaagcauacuuu

SEQ ID NO: 1152660 - RNA, 21 nt, Homo sapiens
aaaugcacgucacaggcucag

SEQ ID NO: 1152661 - RNA, 16 nt, Homo sapiens
aaaugcaucacaugau

SEQ ID NO: 1152662 - RNA, 15 nt, Homo sapiens
aaaugcguauuugca

SEQ ID NO: 1152663 - RNA, 18 nt, Homo sapiens
aaaugcucaauuucagca

SEQ ID NO: 1152664 - RNA, 24 nt, Homo sapiens
aaauggcacuauccguguacgaau

SEQ ID NO: 1152665 - RNA, 13 nt, Homo sapiens
aaauggcacugca

SEQ ID NO: 1152666 - RNA, 15 nt, Homo sapiens
aaauggcagaaccaa

SEQ ID NO: 1152667 - RNA, 14 nt, Homo sapiens
aaauggcaugacau

SEQ ID NO: 1152668 - RNA, 21 nt, Homo sapiens
aaaugggaucuuucugacaca

SEQ ID NO: 1152669 - RNA, 20 nt, Homo sapiens
aaaugggcuacuuuguccuu

SEQ ID NO: 1152670 - RNA, 20 nt, Homo sapiens
aaauggucaauaaagcuccu

SEQ ID NO: 1152671 - RNA, 18 nt, Homo sapiens
aaaugguggcuucagcuc

SEQ ID NO: 1152672 - RNA, 15 nt, Homo sapiens
aaaugguuucacuug

SEQ ID NO: 1152673 - RNA, 15 nt, Homo sapiens
aaauguaacugugcc

SEQ ID NO: 1152674 - RNA, 15 nt, Homo sapiens
aaauguaacuugaaa

SEQ ID NO: 1152675 - RNA, 21 nt, Homo sapiens
aaauguacagaguaaccuaua

SEQ ID NO: 1152676 - RNA, 21 nt, Homo sapiens
aaauguaggcaucaugcaugu

SEQ ID NO: 1152677 - RNA, 17 nt, Homo sapiens
aaauguaugugcucuua

SEQ ID NO: 1152678 - RNA, 20 nt, Homo sapiens
aaauguauuggcacagugcu

SEQ ID NO: 1152679 - RNA, 21 nt, Homo sapiens
aaaugucauguggcuaccugu

SEQ ID NO: 1152680 - RNA, 23 nt, Homo sapiens
aaaugucuauuauuaugaagaau

SEQ ID NO: 1152681 - RNA, 23 nt, Homo sapiens
aaaugucuugcuguugacauauu

SEQ ID NO: 1152682 - RNA, 13 nt, Homo sapiens
aaaugugaugaau

SEQ ID NO: 1152683 - RNA, 19 nt, Homo sapiens
aaaugugguuuuccugaaa

SEQ ID NO: 1152684 - RNA, 21 nt, Homo sapiens
aaaugugucugcaacauggau

SEQ ID NO: 1152685 - RNA, 13 nt, Homo sapiens
aaauguugacagg

SEQ ID NO: 1152686 - RNA, 17 nt, Homo sapiens
aaauguugacauaccuu

SEQ ID NO: 1152687 - RNA, 15 nt, Homo sapiens
aaauguugcuuuaac

SEQ ID NO: 1152688 - RNA, 15 nt, Homo sapiens
aaauuaagaaggcaa

SEQ ID NO: 1152689 - RNA, 21 nt, Homo sapiens
aaauuaauuuugguugguguu

SEQ ID NO: 1152690 - RNA, 20 nt, Homo sapiens
aaauuaccauaaaaugucag

SEQ ID NO: 1152691 - RNA, 23 nt, Homo sapiens
aaauuagccaggugugguggugc

SEQ ID NO: 1152692 - RNA, 21 nt, Homo sapiens
aaauuagcugggcauggugcg

SEQ ID NO: 1152693 - RNA, 15 nt, Homo sapiens
aaauuaggccucaaa

SEQ ID NO: 1152694 - RNA, 15 nt, Homo sapiens
aaauuauauagcaaa

SEQ ID NO: 1152695 - RNA, 13 nt, Homo sapiens
aaauuaugacugc

SEQ ID NO: 1152696 - RNA, 20 nt, Homo sapiens
aaauuaugucuuaguuauaa

SEQ ID NO: 1152697 - RNA, 13 nt, Homo sapiens
aaauuauuaucuu

SEQ ID NO: 1152698 - RNA, 22 nt, Homo sapiens
aaauuauuugaaaacauauaaa

SEQ ID NO: 1152699 - RNA, 21 nt, Homo sapiens
aaauuauuuuuguucauauaa

SEQ ID NO: 1152700 - RNA, 12 nt, Homo sapiens
aaauucaauaaa

SEQ ID NO: 1152701 - RNA, 13 nt, Homo sapiens
aaauucagucuuu

SEQ ID NO: 1152702 - RNA, 21 nt, Homo sapiens
aaauucauuaguuguuaguga

SEQ ID NO: 1152703 - RNA, 12 nt, Homo sapiens
aaauuccaagga

SEQ ID NO: 1152704 - RNA, 18 nt, Homo sapiens
aaauuccuacaacuuaau

SEQ ID NO: 1152705 - RNA, 20 nt, Homo sapiens
aaauucuauaggaacauaug

SEQ ID NO: 1152706 - RNA, 17 nt, Homo sapiens
aaauucugaauuugcaa

SEQ ID NO: 1152707 - RNA, 19 nt, Homo sapiens
aaauucuucuaauugcugu

SEQ ID NO: 1152708 - RNA, 16 nt, Homo sapiens
aaauugagacagugca

SEQ ID NO: 1152709 - RNA, 20 nt, Homo sapiens
aaauugcugcaccaaugcac

SEQ ID NO: 1152710 - RNA, 21 nt, Homo sapiens
aaauugcugcaccaaugcacu

SEQ ID NO: 1152711 - RNA, 21 nt, Homo sapiens
aaauuguacauaaguaccuca

SEQ ID NO: 1152712 - RNA, 22 nt, Homo sapiens
aaauuguauuaucaacagcauu

SEQ ID NO: 1152713 - RNA, 14 nt, Homo sapiens
aaauuuacugugag

SEQ ID NO: 1152714 - RNA, 12 nt, Homo sapiens
aaauuuacuuuu

SEQ ID NO: 1152715 - RNA, 18 nt, Homo sapiens
aaauuuauauuacuggca

SEQ ID NO: 1152716 - RNA, 10 nt, Homo sapiens
aaauuucagg

SEQ ID NO: 1152717 - RNA, 22 nt, Homo sapiens
aaauuucccccucucccccagu

SEQ ID NO: 1152718 - RNA, 16 nt, Homo sapiens
aaauuugagagacaaa

SEQ ID NO: 1152719 - RNA, 24 nt, Homo sapiens
aaauuuggauuuacgacugaagaa

SEQ ID NO: 1152720 - RNA, 14 nt, Homo sapiens
aaauuuguuugaca

SEQ ID NO: 1152721 - RNA, 18 nt, Homo sapiens
aaauuuguuugucacugc

SEQ ID NO: 1152722 - RNA, 23 nt, Homo sapiens
aaauuuucuuuuuauacuauuaa

SEQ ID NO: 1152723 - RNA, 15 nt, Homo sapiens
aaauuuugagauuaa

SEQ ID NO: 1152724 - RNA, 14 nt, Homo sapiens
aaauuuugugcaaa

SEQ ID NO: 1152725 - RNA, 21 nt, Homo sapiens
aaauuuuuccacacuaugugu

SEQ ID NO: 1152726 - RNA, 15 nt, Homo sapiens
aacaaaacaacauuu

SEQ ID NO: 1152727 - RNA, 22 nt, Homo sapiens
aacaaacugaauuaaacaugaa

SEQ ID NO: 1152728 - RNA, 12 nt, Homo sapiens
aacaaacuggag

SEQ ID NO: 1152729 - RNA, 13 nt, Homo sapiens
aacaaagaacuga

SEQ ID NO: 1152730 - RNA, 21 nt, Homo sapiens
aacaaagauucaugauuuaua

SEQ ID NO: 1152731 - RNA, 17 nt, Homo sapiens
aacaaauagucuaucaa

SEQ ID NO: 1152732 - RNA, 17 nt, Homo sapiens
aacaacagugugaucau

SEQ ID NO: 1152733 - RNA, 22 nt, Homo sapiens
aacaacaugggagcguuccuaa

SEQ ID NO: 1152734 - RNA, 12 nt, Homo sapiens
aacaaccaucuc

SEQ ID NO: 1152735 - RNA, 12 nt, Homo sapiens
aacaaccugcug

SEQ ID NO: 1152736 - RNA, 23 nt, Homo sapiens
aacaaccuuuccagcuacuuuug

SEQ ID NO: 1152737 - RNA, 19 nt, Homo sapiens
aacaagcuucaaagccaua

SEQ ID NO: 1152738 - RNA, 14 nt, Homo sapiens
aacaaggacuugga

SEQ ID NO: 1152739 - RNA, 13 nt, Homo sapiens
aacaaguacuucu

SEQ ID NO: 1152740 - RNA, 18 nt, Homo sapiens
aacaauccaaaugcauuc

SEQ ID NO: 1152741 - RNA, 15 nt, Homo sapiens
aacaaugacauuuau

SEQ ID NO: 1152742 - RNA, 15 nt, Homo sapiens
aacaaugcugagaau

SEQ ID NO: 1152743 - RNA, 19 nt, Homo sapiens
aacacacugagacuugaau

SEQ ID NO: 1152744 - RNA, 14 nt, Homo sapiens
aacacacugaggca

SEQ ID NO: 1152745 - RNA, 23 nt, Homo sapiens
aacacaguguuuuuguaaagugu

SEQ ID NO: 1152746 - RNA, 23 nt, Homo sapiens
aacacauuguuauuuucagugau

SEQ ID NO: 1152747 - RNA, 16 nt, Homo sapiens
aacaccagcagcacug

SEQ ID NO: 1152748 - RNA, 22 nt, Homo sapiens
aacaccagcagcacuggaacca

SEQ ID NO: 1152749 - RNA, 15 nt, Homo sapiens
aacaccaguaccuga

SEQ ID NO: 1152750 - RNA, 16 nt, Homo sapiens
aacaccaguaccugaa

SEQ ID NO: 1152751 - RNA, 18 nt, Homo sapiens
aacaccgcuucugccuuu

SEQ ID NO: 1152752 - RNA, 19 nt, Homo sapiens
aacaccgcuucugccuuuu

SEQ ID NO: 1152753 - RNA, 14 nt, Homo sapiens
aacacgcugaaggg

SEQ ID NO: 1152754 - RNA, 19 nt, Homo sapiens
aacacgugacacaaacaca

SEQ ID NO: 1152755 - RNA, 16 nt, Homo sapiens
aacacuagacaagcca

SEQ ID NO: 1152756 - RNA, 16 nt, Homo sapiens
aacacucaacaauaaa

SEQ ID NO: 1152757 - RNA, 22 nt, Homo sapiens
aacacugaaaaaauacuaccua

SEQ ID NO: 1152758 - RNA, 16 nt, Homo sapiens
aacacugaaacuguau

SEQ ID NO: 1152759 - RNA, 22 nt, Homo sapiens
aacacuguguuuuauuguggua

SEQ ID NO: 1152760 - RNA, 14 nt, Homo sapiens
aacacuuaccugga

SEQ ID NO: 1152761 - RNA, 14 nt, Homo sapiens
aacacuugaaccug

SEQ ID NO: 1152762 - RNA, 22 nt, Homo sapiens
aacacuuugggaggcugaggca

SEQ ID NO: 1152763 - RNA, 16 nt, Homo sapiens
aacagaaaaauaugua

SEQ ID NO: 1152764 - RNA, 18 nt, Homo sapiens
aacagaacaucauuagaa

SEQ ID NO: 1152765 - RNA, 13 nt, Homo sapiens
aacagaugccaau

SEQ ID NO: 1152766 - RNA, 13 nt, Homo sapiens
aacagcacccucu

SEQ ID NO: 1152767 - RNA, 17 nt, Homo sapiens
aacagcacccucuccag

SEQ ID NO: 1152768 - RNA, 17 nt, Homo sapiens
aacagccacuacauuac

SEQ ID NO: 1152769 - RNA, 20 nt, Homo sapiens
aacagccacuacauuacuuc

SEQ ID NO: 1152770 - RNA, 14 nt, Homo sapiens
aacagccagugugu

SEQ ID NO: 1152771 - RNA, 23 nt, Homo sapiens
aacagccggcugcggcacugugc

SEQ ID NO: 1152772 - RNA, 21 nt, Homo sapiens
aacagccuaucuuugugugac

SEQ ID NO: 1152773 - RNA, 17 nt, Homo sapiens
aacagccuauuccugaa

SEQ ID NO: 1152774 - RNA, 15 nt, Homo sapiens
aacagcuacaacagc

SEQ ID NO: 1152775 - RNA, 20 nt, Homo sapiens
aacagcuguggcucacguga

SEQ ID NO: 1152776 - RNA, 17 nt, Homo sapiens
aacagcuguuccugugu

SEQ ID NO: 1152777 - RNA, 20 nt, Homo sapiens
aacaggaugauggcacugag

SEQ ID NO: 1152778 - RNA, 22 nt, Homo sapiens
aacaggaugauggcacugagaa

SEQ ID NO: 1152779 - RNA, 20 nt, Homo sapiens
aacaggucuuucaaaaagca

SEQ ID NO: 1152780 - RNA, 18 nt, Homo sapiens
aacagguguuggugacaa

SEQ ID NO: 1152781 - RNA, 21 nt, Homo sapiens
aacaguacuuggguuugcaac

SEQ ID NO: 1152782 - RNA, 19 nt, Homo sapiens
aacagucauuaauuuucaa

SEQ ID NO: 1152783 - RNA, 19 nt, Homo sapiens
aacagugaugaugcaugga

SEQ ID NO: 1152784 - RNA, 20 nt, Homo sapiens
aacaguuccuucagcuucca

SEQ ID NO: 1152785 - RNA, 18 nt, Homo sapiens
aacauaaaaugaggcagu

SEQ ID NO: 1152786 - RNA, 14 nt, Homo sapiens
aacauaacuucuca

SEQ ID NO: 1152787 - RNA, 16 nt, Homo sapiens
aacauaaguuaucaug

SEQ ID NO: 1152788 - RNA, 12 nt, Homo sapiens
aacauacaagag

SEQ ID NO: 1152789 - RNA, 21 nt, Homo sapiens
aacauaccguuuauaaugcca

SEQ ID NO: 1152790 - RNA, 14 nt, Homo sapiens
aacauauugccaug

SEQ ID NO: 1152791 - RNA, 16 nt, Homo sapiens
aacauauuuaagaaau

SEQ ID NO: 1152792 - RNA, 20 nt, Homo sapiens
aacaucaaaaggcugccuaa

SEQ ID NO: 1152793 - RNA, 17 nt, Homo sapiens
aacaugaaaacauugau

SEQ ID NO: 1152794 - RNA, 20 nt, Homo sapiens
aacaugaaaacauugaugaa

SEQ ID NO: 1152795 - RNA, 14 nt, Homo sapiens
aacaugaagcauaa

SEQ ID NO: 1152796 - RNA, 20 nt, Homo sapiens
aacaugacauuuaccagcaa

SEQ ID NO: 1152797 - RNA, 18 nt, Homo sapiens
aacaugcuuuuacuuuau

SEQ ID NO: 1152798 - RNA, 15 nt, Homo sapiens
aacaugggcugugau

SEQ ID NO: 1152799 - RNA, 14 nt, Homo sapiens
aacauggugugugu

SEQ ID NO: 1152800 - RNA, 16 nt, Homo sapiens
aacauguaauugcaga

SEQ ID NO: 1152801 - RNA, 16 nt, Homo sapiens
aacauguaugugcauu

SEQ ID NO: 1152802 - RNA, 17 nt, Homo sapiens
aacauguccuaauucuu

SEQ ID NO: 1152803 - RNA, 22 nt, Homo sapiens
aacauguuccuuauauuuacuc

SEQ ID NO: 1152804 - RNA, 14 nt, Homo sapiens
aacauuaguauacg

SEQ ID NO: 1152805 - RNA, 20 nt, Homo sapiens
aacauuauuuggauaucaaa

SEQ ID NO: 1152806 - RNA, 13 nt, Homo sapiens
aacauuuacaugu

SEQ ID NO: 1152807 - RNA, 14 nt, Homo sapiens
aacauuuacaugua

SEQ ID NO: 1152808 - RNA, 15 nt, Homo sapiens
aacauuuacauguau

SEQ ID NO: 1152809 - RNA, 20 nt, Homo sapiens
aacauuuccaaaaguggcua

SEQ ID NO: 1152810 - RNA, 21 nt, Homo sapiens
aaccaaaaggccguguguuua

SEQ ID NO: 1152811 - RNA, 19 nt, Homo sapiens
aaccaaaaugauacuuacu

SEQ ID NO: 1152812 - RNA, 21 nt, Homo sapiens
aaccaaauucuauacauguau

SEQ ID NO: 1152813 - RNA, 23 nt, Homo sapiens
aaccaaauuuguauuuaagguau

SEQ ID NO: 1152814 - RNA, 17 nt, Homo sapiens
aaccaagauggcgacaa

SEQ ID NO: 1152815 - RNA, 16 nt, Homo sapiens
aaccaauggaauguga

SEQ ID NO: 1152816 - RNA, 20 nt, Homo sapiens
aaccaauucaugaagugaau

SEQ ID NO: 1152817 - RNA, 14 nt, Homo sapiens
aaccacagcacuau

SEQ ID NO: 1152818 - RNA, 15 nt, Homo sapiens
aaccaccugaugaca

SEQ ID NO: 1152819 - RNA, 19 nt, Homo sapiens
aaccacucauaauucuuca

SEQ ID NO: 1152820 - RNA, 21 nt, Homo sapiens
aaccagacagagggucacagu

SEQ ID NO: 1152821 - RNA, 23 nt, Homo sapiens
aaccagacagagggucacagugu

SEQ ID NO: 1152822 - RNA, 24 nt, Homo sapiens
aaccagacagagggucacaguguu

SEQ ID NO: 1152823 - RNA, 13 nt, Homo sapiens
aaccagcacauuc

SEQ ID NO: 1152824 - RNA, 14 nt, Homo sapiens
aaccaggcagcccu

SEQ ID NO: 1152825 - RNA, 20 nt, Homo sapiens
aaccaguccccccacccuca

SEQ ID NO: 1152826 - RNA, 17 nt, Homo sapiens
aaccagugacaaucuua

SEQ ID NO: 1152827 - RNA, 23 nt, Homo sapiens
aaccaguuucuaucccuuaccug

SEQ ID NO: 1152828 - RNA, 20 nt, Homo sapiens
aaccauaggacuguggcaaa

SEQ ID NO: 1152829 - RNA, 17 nt, Homo sapiens
aaccaucacugguugca

SEQ ID NO: 1152830 - RNA, 16 nt, Homo sapiens
aacccaaauccaagcu

SEQ ID NO: 1152831 - RNA, 17 nt, Homo sapiens
aacccaccaaaaccaag

SEQ ID NO: 1152832 - RNA, 12 nt, Homo sapiens
aacccagacuca

SEQ ID NO: 1152833 - RNA, 14 nt, Homo sapiens
aacccagucacugu

SEQ ID NO: 1152834 - RNA, 17 nt, Homo sapiens
aacccauucccucucca

SEQ ID NO: 1152835 - RNA, 13 nt, Homo sapiens
aacccauuugucu

SEQ ID NO: 1152836 - RNA, 17 nt, Homo sapiens
aaccccagauucaugca

SEQ ID NO: 1152837 - RNA, 14 nt, Homo sapiens
aaccccaucucuac

SEQ ID NO: 1152838 - RNA, 13 nt, Homo sapiens
aacccccagugua

SEQ ID NO: 1152839 - RNA, 22 nt, Homo sapiens
aaccccuuuucaguuugaacuc

SEQ ID NO: 1152840 - RNA, 21 nt, Homo sapiens
aacccgaggaagaugcucauc

SEQ ID NO: 1152841 - RNA, 19 nt, Homo sapiens
aacccuaaucuuucacuug

SEQ ID NO: 1152842 - RNA, 18 nt, Homo sapiens
aacccucuggggagcuca

SEQ ID NO: 1152843 - RNA, 14 nt, Homo sapiens
aacccucugucacc

SEQ ID NO: 1152844 - RNA, 15 nt, Homo sapiens
aacccuuaucuguaa

SEQ ID NO: 1152845 - RNA, 21 nt, Homo sapiens
aaccgccauugggcuacugua

SEQ ID NO: 1152846 - RNA, 14 nt, Homo sapiens
aaccuacucugcaa

SEQ ID NO: 1152847 - RNA, 11 nt, Homo sapiens
aaccuaugaag

SEQ ID NO: 1152848 - RNA, 21 nt, Homo sapiens
aaccucaguuauuacauguaa

SEQ ID NO: 1152849 - RNA, 16 nt, Homo sapiens
aaccuccgacucaaca

SEQ ID NO: 1152850 - RNA, 13 nt, Homo sapiens
aaccuccuaaaau

SEQ ID NO: 1152851 - RNA, 17 nt, Homo sapiens
aaccuuaaacuuucaau

SEQ ID NO: 1152852 - RNA, 22 nt, Homo sapiens
aaccuuacuaauuauacuacuu

SEQ ID NO: 1152853 - RNA, 23 nt, Homo sapiens
aaccuuauuuugauaaaauguaa

SEQ ID NO: 1152854 - RNA, 23 nt, Homo sapiens
aaccuugcacaggucccacugcc

SEQ ID NO: 1152855 - RNA, 21 nt, Homo sapiens
aaccuugguguaguugaacug

SEQ ID NO: 1152856 - RNA, 18 nt, Homo sapiens
aaccuugguuaugacugc

SEQ ID NO: 1152857 - RNA, 16 nt, Homo sapiens
aaccuugucaguuuuu

SEQ ID NO: 1152858 - RNA, 14 nt, Homo sapiens
aaccuugugccuug

SEQ ID NO: 1152859 - RNA, 17 nt, Homo sapiens
aaccuuuuaucaauaaa

SEQ ID NO: 1152860 - RNA, 20 nt, Homo sapiens
aacgagcauaguccaaaaag

SEQ ID NO: 1152861 - RNA, 15 nt, Homo sapiens
aacgauuuaauucuc

SEQ ID NO: 1152862 - RNA, 12 nt, Homo sapiens
aacgcacaaaac

SEQ ID NO: 1152863 - RNA, 13 nt, Homo sapiens
aacgccuggcuaa

SEQ ID NO: 1152864 - RNA, 21 nt, Homo sapiens
aacggaguacagacgucucaa

SEQ ID NO: 1152865 - RNA, 13 nt, Homo sapiens
aacggcaagggaa

SEQ ID NO: 1152866 - RNA, 16 nt, Homo sapiens
aacguaacccauuaaa

SEQ ID NO: 1152867 - RNA, 13 nt, Homo sapiens
aacgucucuucaa

SEQ ID NO: 1152868 - RNA, 16 nt, Homo sapiens
aacgucuuuuuauauc

SEQ ID NO: 1152869 - RNA, 12 nt, Homo sapiens
aacgugcaacug

SEQ ID NO: 1152870 - RNA, 23 nt, Homo sapiens
aacguggguucaauuugccauug

SEQ ID NO: 1152871 - RNA, 21 nt, Homo sapiens
aacguuuuuggacacugugcu

SEQ ID NO: 1152872 - RNA, 16 nt, Homo sapiens
aacuaaacucauuuau

SEQ ID NO: 1152873 - RNA, 12 nt, Homo sapiens
aacuaaccacau

SEQ ID NO: 1152874 - RNA, 23 nt, Homo sapiens
aacuaaucugauguuaaccaaug

SEQ ID NO: 1152875 - RNA, 21 nt, Homo sapiens
aacuaaugguccacacccaau

SEQ ID NO: 1152876 - RNA, 22 nt, Homo sapiens
aacuaccagugggcauguauua

SEQ ID NO: 1152877 - RNA, 12 nt, Homo sapiens
aacuacuaaagu

SEQ ID NO: 1152878 - RNA, 16 nt, Homo sapiens
aacuagagcacagaag

SEQ ID NO: 1152879 - RNA, 20 nt, Homo sapiens
aacuagguuaccgcuuauca

SEQ ID NO: 1152880 - RNA, 17 nt, Homo sapiens
aacuauaacaccugcca

SEQ ID NO: 1152881 - RNA, 16 nt, Homo sapiens
aacuauguaaugcuua

SEQ ID NO: 1152882 - RNA, 18 nt, Homo sapiens
aacucaaauggggccaga

SEQ ID NO: 1152883 - RNA, 16 nt, Homo sapiens
aacucaccacaagcca

SEQ ID NO: 1152884 - RNA, 14 nt, Homo sapiens
aacucacugagggu

SEQ ID NO: 1152885 - RNA, 22 nt, Homo sapiens
aacucagagucggaacggagaa

SEQ ID NO: 1152886 - RNA, 11 nt, Homo sapiens
aacucagggag

SEQ ID NO: 1152887 - RNA, 20 nt, Homo sapiens
aacucauccacguccugucu

SEQ ID NO: 1152888 - RNA, 12 nt, Homo sapiens
aacuccagugaa

SEQ ID NO: 1152889 - RNA, 20 nt, Homo sapiens
aacucccuccucacacucca

SEQ ID NO: 1152890 - RNA, 15 nt, Homo sapiens
aacucccuuucaugu

SEQ ID NO: 1152891 - RNA, 14 nt, Homo sapiens
aacuccugaccuca

SEQ ID NO: 1152892 - RNA, 12 nt, Homo sapiens
aacuccuuccau

SEQ ID NO: 1152893 - RNA, 17 nt, Homo sapiens
aacuccuuucagccaca

SEQ ID NO: 1152894 - RNA, 18 nt, Homo sapiens
aacuccuuucagccacau

SEQ ID NO: 1152895 - RNA, 14 nt, Homo sapiens
aacucgcugaugag

SEQ ID NO: 1152896 - RNA, 16 nt, Homo sapiens
aacucuacaucuagca

SEQ ID NO: 1152897 - RNA, 21 nt, Homo sapiens
aacucuccaauguucuauuaa

SEQ ID NO: 1152898 - RNA, 17 nt, Homo sapiens
aacucuccugcccauga

SEQ ID NO: 1152899 - RNA, 20 nt, Homo sapiens
aacucuggcuccaggcagaa

SEQ ID NO: 1152900 - RNA, 20 nt, Homo sapiens
aacucugucuucaccugauu

SEQ ID NO: 1152901 - RNA, 17 nt, Homo sapiens
aacucugugaucuugcu

SEQ ID NO: 1152902 - RNA, 13 nt, Homo sapiens
aacucuugcuauc

SEQ ID NO: 1152903 - RNA, 20 nt, Homo sapiens
aacucuugguauuacccucc

SEQ ID NO: 1152904 - RNA, 15 nt, Homo sapiens
aacugaaagcuuuaa

SEQ ID NO: 1152905 - RNA, 21 nt, Homo sapiens
aacugaaaguuuaacuauuua

SEQ ID NO: 1152906 - RNA, 14 nt, Homo sapiens
aacugaacucacuu

SEQ ID NO: 1152907 - RNA, 23 nt, Homo sapiens
aacugaagaaagagaagucacaa

SEQ ID NO: 1152908 - RNA, 14 nt, Homo sapiens
aacugaaucaggaa

SEQ ID NO: 1152909 - RNA, 17 nt, Homo sapiens
aacugaaugagaaccaa

SEQ ID NO: 1152910 - RNA, 22 nt, Homo sapiens
aacugacaggcagccuggacau

SEQ ID NO: 1152911 - RNA, 17 nt, Homo sapiens
aacugacauugcuccaa

SEQ ID NO: 1152912 - RNA, 15 nt, Homo sapiens
aacugagcaucucca

SEQ ID NO: 1152913 - RNA, 18 nt, Homo sapiens
aacugauucacaucucau

SEQ ID NO: 1152914 - RNA, 14 nt, Homo sapiens
aacugcaaaccaug

SEQ ID NO: 1152915 - RNA, 14 nt, Homo sapiens
aacugcauugagaa

SEQ ID NO: 1152916 - RNA, 21 nt, Homo sapiens
aacugcucuuuuauacuguac

SEQ ID NO: 1152917 - RNA, 23 nt, Homo sapiens
aacugcugagagacagagcuauu

SEQ ID NO: 1152918 - RNA, 20 nt, Homo sapiens
aacugggaugaaacuaaagc

SEQ ID NO: 1152919 - RNA, 20 nt, Homo sapiens
aacugguaguguucaguaaa

SEQ ID NO: 1152920 - RNA, 16 nt, Homo sapiens
aacuguagaugaugua

SEQ ID NO: 1152921 - RNA, 16 nt, Homo sapiens
aacuguauauauuccc

SEQ ID NO: 1152922 - RNA, 17 nt, Homo sapiens
aacuguauauauuccca

SEQ ID NO: 1152923 - RNA, 20 nt, Homo sapiens
aacugucacucauugcugag

SEQ ID NO: 1152924 - RNA, 9 nt, Homo sapiens
aacugucau

SEQ ID NO: 1152925 - RNA, 13 nt, Homo sapiens
aacugucauguaa

SEQ ID NO: 1152926 - RNA, 15 nt, Homo sapiens
aacugucugacuuau

SEQ ID NO: 1152927 - RNA, 15 nt, Homo sapiens
aacugugaugaagcc

SEQ ID NO: 1152928 - RNA, 18 nt, Homo sapiens
aacuguucccaccugcug

SEQ ID NO: 1152929 - RNA, 13 nt, Homo sapiens
aacuguugucaua

SEQ ID NO: 1152930 - RNA, 15 nt, Homo sapiens
aacuuaaagugaauu

SEQ ID NO: 1152931 - RNA, 17 nt, Homo sapiens
aacuuaagagaggggcc

SEQ ID NO: 1152932 - RNA, 13 nt, Homo sapiens
aacuuacacugua

SEQ ID NO: 1152933 - RNA, 20 nt, Homo sapiens
aacuuaccgugagcgacaaa

SEQ ID NO: 1152934 - RNA, 17 nt, Homo sapiens
aacuuaccuacugggga

SEQ ID NO: 1152935 - RNA, 14 nt, Homo sapiens
aacuuacuuccaag

SEQ ID NO: 1152936 - RNA, 15 nt, Homo sapiens
aacuucaaagaggaa

SEQ ID NO: 1152937 - RNA, 12 nt, Homo sapiens
aacuuccaguca

SEQ ID NO: 1152938 - RNA, 17 nt, Homo sapiens
aacuucuacuucugccc

SEQ ID NO: 1152939 - RNA, 20 nt, Homo sapiens
aacuucuacuucugcccuug

SEQ ID NO: 1152940 - RNA, 19 nt, Homo sapiens
aacuucuccuacuguagca

SEQ ID NO: 1152941 - RNA, 17 nt, Homo sapiens
aacuucugaacuuggaa

SEQ ID NO: 1152942 - RNA, 16 nt, Homo sapiens
aacuucuuauacgucu

SEQ ID NO: 1152943 - RNA, 19 nt, Homo sapiens
aacuugcuucuaaaugccc

SEQ ID NO: 1152944 - RNA, 18 nt, Homo sapiens
aacuugggaauaaaucau

SEQ ID NO: 1152945 - RNA, 20 nt, Homo sapiens
aacuuguaucugaagaccua

SEQ ID NO: 1152946 - RNA, 15 nt, Homo sapiens
aacuuugaaccauaa

SEQ ID NO: 1152947 - RNA, 18 nt, Homo sapiens
aacuuugauacuuacuca

SEQ ID NO: 1152948 - RNA, 16 nt, Homo sapiens
aacuuugcaaacaaca

SEQ ID NO: 1152949 - RNA, 14 nt, Homo sapiens
aacuuuugcaaucu

SEQ ID NO: 1152950 - RNA, 19 nt, Homo sapiens
aagaaaaaaaaagucuuug

SEQ ID NO: 1152951 - RNA, 15 nt, Homo sapiens
aagaaaaaggaacua

SEQ ID NO: 1152952 - RNA, 22 nt, Homo sapiens
aagaaaaaugagcauacaucuu

SEQ ID NO: 1152953 - RNA, 15 nt, Homo sapiens
aagaaaacauuccag

SEQ ID NO: 1152954 - RNA, 13 nt, Homo sapiens
aagaaaacuggaa

SEQ ID NO: 1152955 - RNA, 14 nt, Homo sapiens
aagaaaacuggaaa

SEQ ID NO: 1152956 - RNA, 20 nt, Homo sapiens
aagaaaagccucagcucaua

SEQ ID NO: 1152957 - RNA, 13 nt, Homo sapiens
aagaaaaucauua

SEQ ID NO: 1152958 - RNA, 19 nt, Homo sapiens
aagaaaauuaggccucaaa

SEQ ID NO: 1152959 - RNA, 18 nt, Homo sapiens
aagaaaauuugccaaucu

SEQ ID NO: 1152960 - RNA, 16 nt, Homo sapiens
aagaaacaugugagua

SEQ ID NO: 1152961 - RNA, 13 nt, Homo sapiens
aagaaacccaagu

SEQ ID NO: 1152962 - RNA, 12 nt, Homo sapiens
aagaaacgucua

SEQ ID NO: 1152963 - RNA, 16 nt, Homo sapiens
aagaaagaucaaagac

SEQ ID NO: 1152964 - RNA, 13 nt, Homo sapiens
aagaaagccucag

SEQ ID NO: 1152965 - RNA, 15 nt, Homo sapiens
aagaaauuaucuuua

SEQ ID NO: 1152966 - RNA, 12 nt, Homo sapiens
aagaacagcuca

SEQ ID NO: 1152967 - RNA, 14 nt, Homo sapiens
aagaacaugcaguu

SEQ ID NO: 1152968 - RNA, 21 nt, Homo sapiens
aagaaccacucauaauucuuc

SEQ ID NO: 1152969 - RNA, 12 nt, Homo sapiens
aagaaccuggaa

SEQ ID NO: 1152970 - RNA, 18 nt, Homo sapiens
aagaacucaucacugugg

SEQ ID NO: 1152971 - RNA, 15 nt, Homo sapiens
aagaagaaaguguuc

SEQ ID NO: 1152972 - RNA, 20 nt, Homo sapiens
aagaagaguuggagugagau

SEQ ID NO: 1152973 - RNA, 20 nt, Homo sapiens
aagaagcagucaauuuucac

SEQ ID NO: 1152974 - RNA, 12 nt, Homo sapiens
aagaagccacag

SEQ ID NO: 1152975 - RNA, 14 nt, Homo sapiens
aagaagccuuuccu

SEQ ID NO: 1152976 - RNA, 21 nt, Homo sapiens
aagaaggaaaagauacccaaa

SEQ ID NO: 1152977 - RNA, 22 nt, Homo sapiens
aagaaggccacuguuugucuca

SEQ ID NO: 1152978 - RNA, 14 nt, Homo sapiens
aagaaggguguuua

SEQ ID NO: 1152979 - RNA, 14 nt, Homo sapiens
aagaaguuaaauga

SEQ ID NO: 1152980 - RNA, 14 nt, Homo sapiens
aagaaguugcucug

SEQ ID NO: 1152981 - RNA, 19 nt, Homo sapiens
aagaauaaacaacuaaaua

SEQ ID NO: 1152982 - RNA, 16 nt, Homo sapiens
aagaauagcaucugua

SEQ ID NO: 1152983 - RNA, 17 nt, Homo sapiens
aagaaucggcaguauuu

SEQ ID NO: 1152984 - RNA, 18 nt, Homo sapiens
aagaaugaaacaauccaa

SEQ ID NO: 1152985 - RNA, 15 nt, Homo sapiens
aagaauuacuugugu

SEQ ID NO: 1152986 - RNA, 16 nt, Homo sapiens
aagaauuaugcaucug

SEQ ID NO: 1152987 - RNA, 23 nt, Homo sapiens
aagaauucaaacuggggccucca

SEQ ID NO: 1152988 - RNA, 19 nt, Homo sapiens
aagaauuucccagugaaau

SEQ ID NO: 1152989 - RNA, 20 nt, Homo sapiens
aagaauuucccagugaaaua

SEQ ID NO: 1152990 - RNA, 14 nt, Homo sapiens
aagacaaacuccug

SEQ ID NO: 1152991 - RNA, 16 nt, Homo sapiens
aagacaauaguauuac

SEQ ID NO: 1152992 - RNA, 14 nt, Homo sapiens
aagacaaugugcca

SEQ ID NO: 1152993 - RNA, 18 nt, Homo sapiens
aagacaauucuuuauaca

SEQ ID NO: 1152994 - RNA, 17 nt, Homo sapiens
aagacaccguucauuca

SEQ ID NO: 1152995 - RNA, 14 nt, Homo sapiens
aagacacuguuaca

SEQ ID NO: 1152996 - RNA, 22 nt, Homo sapiens
aagacagauuuucggaacacau

SEQ ID NO: 1152997 - RNA, 20 nt, Homo sapiens
aagacauacuccuuccauca

SEQ ID NO: 1152998 - RNA, 15 nt, Homo sapiens
aagacaucauguauc

SEQ ID NO: 1152999 - RNA, 19 nt, Homo sapiens
aagacaugaaaagaguggu

SEQ ID NO: 1153000 - RNA, 21 nt, Homo sapiens
aagacaugcuacaacuacuau

SEQ ID NO: 1153001 - RNA, 24 nt, Homo sapiens
aagacauucuaauuccagucauuu

SEQ ID NO: 1153002 - RNA, 21 nt, Homo sapiens
aagacauugggucuauuccag

SEQ ID NO: 1153003 - RNA, 15 nt, Homo sapiens
aagaccaaucucuug

SEQ ID NO: 1153004 - RNA, 16 nt, Homo sapiens
aagaccagcuuucuca

SEQ ID NO: 1153005 - RNA, 16 nt, Homo sapiens
aagacccccagcacuu

SEQ ID NO: 1153006 - RNA, 19 nt, Homo sapiens
aagacccccagcacuuggg

SEQ ID NO: 1153007 - RNA, 21 nt, Homo sapiens
aagaccggggugacaagcaga

SEQ ID NO: 1153008 - RNA, 14 nt, Homo sapiens
aagaccuugcugau

SEQ ID NO: 1153009 - RNA, 13 nt, Homo sapiens
aagacgcuuccuu

SEQ ID NO: 1153010 - RNA, 18 nt, Homo sapiens
aagacuaaaugcacauuu

SEQ ID NO: 1153011 - RNA, 20 nt, Homo sapiens
aagacucucgcaucuuccca

SEQ ID NO: 1153012 - RNA, 17 nt, Homo sapiens
aagacugaaucuaccug

SEQ ID NO: 1153013 - RNA, 21 nt, Homo sapiens
aagacuggaagcuaauuugca

SEQ ID NO: 1153014 - RNA, 22 nt, Homo sapiens
aagacuggagaaaugcuuacuu

SEQ ID NO: 1153015 - RNA, 22 nt, Homo sapiens
aagacuucccuaacacuuaccc

SEQ ID NO: 1153016 - RNA, 13 nt, Homo sapiens
aagacuugacagu

SEQ ID NO: 1153017 - RNA, 14 nt, Homo sapiens
aagagaaaugaugu

SEQ ID NO: 1153018 - RNA, 21 nt, Homo sapiens
aagagaaucaacauuucucaa

SEQ ID NO: 1153019 - RNA, 15 nt, Homo sapiens
aagagagacauggaa

SEQ ID NO: 1153020 - RNA, 20 nt, Homo sapiens
aagagaguuaaaagcagcag

SEQ ID NO: 1153021 - RNA, 15 nt, Homo sapiens
aagagauccaaagac

SEQ ID NO: 1153022 - RNA, 23 nt, Homo sapiens
aagagauugagauguaagucuca

SEQ ID NO: 1153023 - RNA, 17 nt, Homo sapiens
aagagauugcacaguca

SEQ ID NO: 1153024 - RNA, 18 nt, Homo sapiens
aagagauuguuguuugcc

SEQ ID NO: 1153025 - RNA, 22 nt, Homo sapiens
aagagcagccuggggccaagca

SEQ ID NO: 1153026 - RNA, 22 nt, Homo sapiens
aagagcagcugccauugcagau

SEQ ID NO: 1153027 - RNA, 18 nt, Homo sapiens
aaggugacaaaaggcaga

SEQ ID NO: 1153028 - RNA, 15 nt, Homo sapiens
aaggugaguucucac

SEQ ID NO: 1153029 - RNA, 16 nt, Homo sapiens
aaggugaguucucacu

SEQ ID NO: 1153030 - RNA, 19 nt, Homo sapiens
aagguggaacaagcacaga

SEQ ID NO: 1153031 - RNA, 18 nt, Homo sapiens
aagguuauaguaacauca

SEQ ID NO: 1153032 - RNA, 15 nt, Homo sapiens
aagguugacacagga

SEQ ID NO: 1153033 - RNA, 19 nt, Homo sapiens
aagguuggugaauuucaca

SEQ ID NO: 1153034 - RNA, 15 nt, Homo sapiens
aagguuuucauuugc

SEQ ID NO: 1153035 - RNA, 13 nt, Homo sapiens
aaguaaaaaucca

SEQ ID NO: 1153036 - RNA, 16 nt, Homo sapiens
aaguaacaaaugugca

SEQ ID NO: 1153037 - RNA, 16 nt, Homo sapiens
aaguaacaucagccau

SEQ ID NO: 1153038 - RNA, 12 nt, Homo sapiens
aaguaacuauaa

SEQ ID NO: 1153039 - RNA, 18 nt, Homo sapiens
aaguaacucccacuccua

SEQ ID NO: 1153040 - RNA, 14 nt, Homo sapiens
aaguaagugacaau

SEQ ID NO: 1153041 - RNA, 15 nt, Homo sapiens
aaguaauucuuuucc

SEQ ID NO: 1153042 - RNA, 21 nt, Homo sapiens
aaguaauugguuaguuaacac

SEQ ID NO: 1153043 - RNA, 14 nt, Homo sapiens
aaguaauugugaaa

SEQ ID NO: 1153044 - RNA, 15 nt, Homo sapiens
aaguacuacaaggaa

SEQ ID NO: 1153045 - RNA, 16 nt, Homo sapiens
aaguacugagcaguau

SEQ ID NO: 1153046 - RNA, 23 nt, Homo sapiens
aaguagaccucuuuuucuuacca

SEQ ID NO: 1153047 - RNA, 19 nt, Homo sapiens
aaguagaucuuuucuugac

SEQ ID NO: 1153048 - RNA, 16 nt, Homo sapiens
aaguagccaucauucc

SEQ ID NO: 1153049 - RNA, 20 nt, Homo sapiens
aaguagccucuuucauccca

SEQ ID NO: 1153050 - RNA, 13 nt, Homo sapiens
aaguagcugcuac

SEQ ID NO: 1153051 - RNA, 16 nt, Homo sapiens
aaguagcugcuaccuu

SEQ ID NO: 1153052 - RNA, 16 nt, Homo sapiens
aaguaggaaugcauuu

SEQ ID NO: 1153053 - RNA, 19 nt, Homo sapiens
aaguaucuuuccagcaugu

SEQ ID NO: 1153054 - RNA, 15 nt, Homo sapiens
aaguauuggcauuca

SEQ ID NO: 1153055 - RNA, 17 nt, Homo sapiens
aagucagagaaaacacu

SEQ ID NO: 1153056 - RNA, 13 nt, Homo sapiens
aagucagcuuuca

SEQ ID NO: 1153057 - RNA, 17 nt, Homo sapiens
aagucaggguuggagca

SEQ ID NO: 1153058 - RNA, 22 nt, Homo sapiens
aagucagugcccaacuguuaua

SEQ ID NO: 1153059 - RNA, 16 nt, Homo sapiens
aagucauaccaaugaa

SEQ ID NO: 1153060 - RNA, 18 nt, Homo sapiens
aagucauccccuugggcu

SEQ ID NO: 1153061 - RNA, 17 nt, Homo sapiens
aaguccaacaguagcau

SEQ ID NO: 1153062 - RNA, 16 nt, Homo sapiens
aaguccagccuagucu

SEQ ID NO: 1153063 - RNA, 20 nt, Homo sapiens
aagucccuuugugacuucaa

SEQ ID NO: 1153064 - RNA, 19 nt, Homo sapiens
aaguccuucaccucacuga

SEQ ID NO: 1153065 - RNA, 17 nt, Homo sapiens
aagucguacuguucaca

SEQ ID NO: 1153066 - RNA, 16 nt, Homo sapiens
aagucuacuucacuaa

SEQ ID NO: 1153067 - RNA, 11 nt, Homo sapiens
aagucuugaca

SEQ ID NO: 1153068 - RNA, 22 nt, Homo sapiens
aagucuugccuugcugaacucc

SEQ ID NO: 1153069 - RNA, 16 nt, Homo sapiens
aagugaaaaaagcaaa

SEQ ID NO: 1153070 - RNA, 19 nt, Homo sapiens
aagugaaaaaagcaaauag

SEQ ID NO: 1153071 - RNA, 13 nt, Homo sapiens
aagugaaagugag

SEQ ID NO: 1153072 - RNA, 17 nt, Homo sapiens
aagugaacacuuaccug

SEQ ID NO: 1153073 - RNA, 18 nt, Homo sapiens
aagugacauugugucagu

SEQ ID NO: 1153074 - RNA, 11 nt, Homo sapiens
aagugagccaa

SEQ ID NO: 1153075 - RNA, 21 nt, Homo sapiens
aagugaggacaaaaucacauu

SEQ ID NO: 1153076 - RNA, 16 nt, Homo sapiens
aagugaguacuguuaa

SEQ ID NO: 1153077 - RNA, 20 nt, Homo sapiens
aagugaguguuucuaugagu

SEQ ID NO: 1153078 - RNA, 17 nt, Homo sapiens
aagugauacauaccucu

SEQ ID NO: 1153079 - RNA, 12 nt, Homo sapiens
aagugauccuca

SEQ ID NO: 1153080 - RNA, 22 nt, Homo sapiens
aagugaucucugguuguccuca

SEQ ID NO: 1153081 - RNA, 15 nt, Homo sapiens
aagugcaagacugaa

SEQ ID NO: 1153082 - RNA, 17 nt, Homo sapiens
aagugcauauuuaucca

SEQ ID NO: 1153083 - RNA, 14 nt, Homo sapiens
aagugcugcuccau

SEQ ID NO: 1153084 - RNA, 17 nt, Homo sapiens
aagugggaaagcauuuu

SEQ ID NO: 1153085 - RNA, 18 nt, Homo sapiens
aagugggcccacccggug

SEQ ID NO: 1153086 - RNA, 21 nt, Homo sapiens
aaguguaaaaagaugacuuaa

SEQ ID NO: 1153087 - RNA, 15 nt, Homo sapiens
aagugucuuuugaca

SEQ ID NO: 1153088 - RNA, 18 nt, Homo sapiens
aagugugucucaaaaaua

SEQ ID NO: 1153089 - RNA, 23 nt, Homo sapiens
aagugugugccaccaugccucac

SEQ ID NO: 1153090 - RNA, 20 nt, Homo sapiens
aaguuaaauuagcuuucuga

SEQ ID NO: 1153091 - RNA, 15 nt, Homo sapiens
aaguuauuacugucu

SEQ ID NO: 1153092 - RNA, 13 nt, Homo sapiens
aaguucaagagaa

SEQ ID NO: 1153093 - RNA, 21 nt, Homo sapiens
aaguuccaagagucuaaagau

SEQ ID NO: 1153094 - RNA, 20 nt, Homo sapiens
aaguuccauauagacaccaa

SEQ ID NO: 1153095 - RNA, 23 nt, Homo sapiens
aaguucuccuuuugaacuuguca

SEQ ID NO: 1153096 - RNA, 17 nt, Homo sapiens
aaguugcauagguuuaa

SEQ ID NO: 1153097 - RNA, 16 nt, Homo sapiens
aaguugcuuuguuaca

SEQ ID NO: 1153098 - RNA, 22 nt, Homo sapiens
aaguuuaagugugcagccauag

SEQ ID NO: 1153099 - RNA, 19 nt, Homo sapiens
aaguuuacaaucaaaggaa

SEQ ID NO: 1153100 - RNA, 16 nt, Homo sapiens
aaguuucugucuuccu

SEQ ID NO: 1153101 - RNA, 15 nt, Homo sapiens
aaguuucuuuaccua

SEQ ID NO: 1153102 - RNA, 19 nt, Homo sapiens
aaguuugaccagugcaguu

SEQ ID NO: 1153103 - RNA, 15 nt, Homo sapiens
aaguuugcuagugac

SEQ ID NO: 1153104 - RNA, 22 nt, Homo sapiens
aaguuugugaaugugacuacuu

SEQ ID NO: 1153105 - RNA, 17 nt, Homo sapiens
aauaaaaauuguagcuu

SEQ ID NO: 1153106 - RNA, 19 nt, Homo sapiens
aauaaaaguuuuacaaagg

SEQ ID NO: 1153107 - RNA, 20 nt, Homo sapiens
aauaaaauaugagagcaaua

SEQ ID NO: 1153108 - RNA, 22 nt, Homo sapiens
aauaaaaugaaguggugagcuu

SEQ ID NO: 1153109 - RNA, 18 nt, Homo sapiens
aauaaaaugguacauuuc

SEQ ID NO: 1153110 - RNA, 14 nt, Homo sapiens
aaucuacuaauucc

SEQ ID NO: 1153111 - RNA, 18 nt, Homo sapiens
aaucuauaaacaaugaaa

SEQ ID NO: 1153112 - RNA, 15 nt, Homo sapiens
aaucuauaugauuaa

SEQ ID NO: 1153113 - RNA, 22 nt, Homo sapiens
aaucuaugccuaaaaaguauca

SEQ ID NO: 1153114 - RNA, 20 nt, Homo sapiens
aaucucaaaacuguacuguc

SEQ ID NO: 1153115 - RNA, 14 nt, Homo sapiens
aaucuccucagaca

SEQ ID NO: 1153116 - RNA, 23 nt, Homo sapiens
aaucuccucuuuuagcugaugaa

SEQ ID NO: 1153117 - RNA, 19 nt, Homo sapiens
aaucucuauguauauucua

SEQ ID NO: 1153118 - RNA, 18 nt, Homo sapiens
aaucucugaauuugagau

SEQ ID NO: 1153119 - RNA, 14 nt, Homo sapiens
aaucucugccuaga

SEQ ID NO: 1153120 - RNA, 17 nt, Homo sapiens
aaucugauguuaaccaa

SEQ ID NO: 1153121 - RNA, 14 nt, Homo sapiens
aaucugccuuccag

SEQ ID NO: 1153122 - RNA, 22 nt, Homo sapiens
aaucuguagcauaggcuagugg

SEQ ID NO: 1153123 - RNA, 16 nt, Homo sapiens
aaucuuacaacaggcu

SEQ ID NO: 1153124 - RNA, 21 nt, Homo sapiens
aaucuuccuuuguugcacaaa

SEQ ID NO: 1153125 - RNA, 12 nt, Homo sapiens
aaucuucuacuu

SEQ ID NO: 1153126 - RNA, 20 nt, Homo sapiens
aaucuugcucugcuugacaa

SEQ ID NO: 1153127 - RNA, 17 nt, Homo sapiens
aaucuuucugugucuuc

SEQ ID NO: 1153128 - RNA, 15 nt, Homo sapiens
aaucuuuuacauuga

SEQ ID NO: 1153129 - RNA, 18 nt, Homo sapiens
aaugaaaauaacugaacc

SEQ ID NO: 1153130 - RNA, 21 nt, Homo sapiens
aaugaaacaagcuuacaaaga

SEQ ID NO: 1153131 - RNA, 14 nt, Homo sapiens
aaugaaaggugaca

SEQ ID NO: 1153132 - RNA, 13 nt, Homo sapiens
aaugaaccuucug

SEQ ID NO: 1153133 - RNA, 23 nt, Homo sapiens
aaugaacuguauuauugcaauuu

SEQ ID NO: 1153134 - RNA, 22 nt, Homo sapiens
aaugaagaacugcauguggcuu

SEQ ID NO: 1153135 - RNA, 17 nt, Homo sapiens
aaugaaggugugcuaca

SEQ ID NO: 1153136 - RNA, 12 nt, Homo sapiens
aaugaauauuua

SEQ ID NO: 1153137 - RNA, 19 nt, Homo sapiens
aaugaauuccucauuugga

SEQ ID NO: 1153138 - RNA, 20 nt, Homo sapiens
aaugacacagucuuggcuca

SEQ ID NO: 1153139 - RNA, 21 nt, Homo sapiens
aaugacuaagccaagcugugu

SEQ ID NO: 1153140 - RNA, 23 nt, Homo sapiens
aaugacugaaagaagaacagcug

SEQ ID NO: 1153141 - RNA, 15 nt, Homo sapiens
aaugacugcauuuga

SEQ ID NO: 1153142 - RNA, 13 nt, Homo sapiens
aaugagacuugcc

SEQ ID NO: 1153143 - RNA, 23 nt, Homo sapiens
aaugaggcugcuuuccaaagcca

SEQ ID NO: 1153144 - RNA, 15 nt, Homo sapiens
aaugaggucacuaug

SEQ ID NO: 1153145 - RNA, 23 nt, Homo sapiens
aaugaggugagggggguucuccu

SEQ ID NO: 1153146 - RNA, 17 nt, Homo sapiens
aaugauaaguacuacau

SEQ ID NO: 1153147 - RNA, 14 nt, Homo sapiens
aaugauaguuauaa

SEQ ID NO: 1153148 - RNA, 22 nt, Homo sapiens
aaugauguuaucuuaacacuga

SEQ ID NO: 1153149 - RNA, 19 nt, Homo sapiens
aaugauguugucacuggug

SEQ ID NO: 1153150 - RNA, 14 nt, Homo sapiens
aaugauuaaucagc

SEQ ID NO: 1153151 - RNA, 20 nt, Homo sapiens
aaugcaaacucaccgcucca

SEQ ID NO: 1153152 - RNA, 20 nt, Homo sapiens
aaugcaagcuuauaauguau

SEQ ID NO: 1153153 - RNA, 14 nt, Homo sapiens
aaugcacauuuuau

SEQ ID NO: 1153154 - RNA, 16 nt, Homo sapiens
aaugcagucuguccag

SEQ ID NO: 1153155 - RNA, 17 nt, Homo sapiens
aaugcauuauggguggu

SEQ ID NO: 1153156 - RNA, 19 nt, Homo sapiens
aaugcauuuggaaccaaag

SEQ ID NO: 1153157 - RNA, 16 nt, Homo sapiens
aaugccaaguuauaca

SEQ ID NO: 1153158 - RNA, 13 nt, Homo sapiens
aaugccauugugc

SEQ ID NO: 1153159 - RNA, 19 nt, Homo sapiens
aaugccccuguucauguuu

SEQ ID NO: 1153160 - RNA, 22 nt, Homo sapiens
aaugcuacugaaacuuaccuga

SEQ ID NO: 1153161 - RNA, 13 nt, Homo sapiens
aaugcuacugucu

SEQ ID NO: 1153162 - RNA, 20 nt, Homo sapiens
acuaagaugacauugcuaag

SEQ ID NO: 1153163 - RNA, 20 nt, Homo sapiens
acuaagccaagcuguguuca

SEQ ID NO: 1153164 - RNA, 16 nt, Homo sapiens
acuaaucuuugcugaa

SEQ ID NO: 1153165 - RNA, 15 nt, Homo sapiens
acuaaugaauugaaa

SEQ ID NO: 1153166 - RNA, 14 nt, Homo sapiens
acuaaugacuuugu

SEQ ID NO: 1153167 - RNA, 12 nt, Homo sapiens
acuaaugcuuua

SEQ ID NO: 1153168 - RNA, 15 nt, Homo sapiens
acuacaaacuucaaa

SEQ ID NO: 1153169 - RNA, 20 nt, Homo sapiens
acuacaccacacacaacagc

SEQ ID NO: 1153170 - RNA, 22 nt, Homo sapiens
acuacaggugugagccaccacu

SEQ ID NO: 1153171 - RNA, 16 nt, Homo sapiens
acuaccauugcuguuc

SEQ ID NO: 1153172 - RNA, 17 nt, Homo sapiens
acuaccugcccucagcu

SEQ ID NO: 1153173 - RNA, 14 nt, Homo sapiens
acuaccugugagca

SEQ ID NO: 1153174 - RNA, 23 nt, Homo sapiens
acuacuaugugcaggaacccuug

SEQ ID NO: 1153175 - RNA, 15 nt, Homo sapiens
acuacuggcaauuug

SEQ ID NO: 1153176 - RNA, 22 nt, Homo sapiens
acuagaaauaaauaacuuugga

SEQ ID NO: 1153177 - RNA, 14 nt, Homo sapiens
acuaggaaauucca

SEQ ID NO: 1153178 - RNA, 13 nt, Homo sapiens
acuaggcuguuaa

SEQ ID NO: 1153179 - RNA, 11 nt, Homo sapiens
acuagggccaa

SEQ ID NO: 1153180 - RNA, 19 nt, Homo sapiens
acuagguuaccgcuuauca

SEQ ID NO: 1153181 - RNA, 13 nt, Homo sapiens
acuaguagucaua

SEQ ID NO: 1153182 - RNA, 22 nt, Homo sapiens
acuaguaguucucuugguguua

SEQ ID NO: 1153183 - RNA, 19 nt, Homo sapiens
acuaguugauaacuuugga

SEQ ID NO: 1153184 - RNA, 16 nt, Homo sapiens
acuauaaagcuguuau

SEQ ID NO: 1153185 - RNA, 16 nt, Homo sapiens
acuaucucacugcugu

SEQ ID NO: 1153186 - RNA, 19 nt, Homo sapiens
acuaugaagcuaccucaaa

SEQ ID NO: 1153187 - RNA, 10 nt, Homo sapiens
acuaugacaa

SEQ ID NO: 1153188 - RNA, 14 nt, Homo sapiens
acuaugcacugcug

SEQ ID NO: 1153189 - RNA, 22 nt, Homo sapiens
acuaugcauggugccccaggac

SEQ ID NO: 1153190 - RNA, 18 nt, Homo sapiens
acuauguuuggaguuuaa

SEQ ID NO: 1153191 - RNA, 12 nt, Homo sapiens
acuauuacuggg

SEQ ID NO: 1153192 - RNA, 14 nt, Homo sapiens
acuauucauaagau

SEQ ID NO: 1153193 - RNA, 22 nt, Homo sapiens
acuauuccaucaauaggcaaaa

SEQ ID NO: 1153194 - RNA, 21 nt, Homo sapiens
acuauucccacuuucauucaa

SEQ ID NO: 1153195 - RNA, 18 nt, Homo sapiens
acuauucuuaacuauuca

SEQ ID NO: 1153196 - RNA, 15 nt, Homo sapiens
acuauuuaccaggga

SEQ ID NO: 1153197 - RNA, 22 nt, Homo sapiens
acucaaaaucugucauaagcau

SEQ ID NO: 1153198 - RNA, 23 nt, Homo sapiens
acucaaauagcaguccccaguga

SEQ ID NO: 1153199 - RNA, 19 nt, Homo sapiens
acucaagucccccaagacc

SEQ ID NO: 1153200 - RNA, 12 nt, Homo sapiens
acucaaugggag

SEQ ID NO: 1153201 - RNA, 18 nt, Homo sapiens
acucagaagaaagcucag

SEQ ID NO: 1153202 - RNA, 17 nt, Homo sapiens
acucagagaaacaaugg

SEQ ID NO: 1153203 - RNA, 19 nt, Homo sapiens
acucagagcugcgggcuga

SEQ ID NO: 1153204 - RNA, 12 nt, Homo sapiens
acucagcacaag

SEQ ID NO: 1153205 - RNA, 17 nt, Homo sapiens
acucagcacucagagac

SEQ ID NO: 1153206 - RNA, 13 nt, Homo sapiens
acucagcacucca

SEQ ID NO: 1153207 - RNA, 16 nt, Homo sapiens
acucagccaagcacag

SEQ ID NO: 1153208 - RNA, 22 nt, Homo sapiens
acucagccauuucuaagcagau

SEQ ID NO: 1153209 - RNA, 19 nt, Homo sapiens
acucagcucuuggcuccac

SEQ ID NO: 1153210 - RNA, 17 nt, Homo sapiens
acucaggaggcugagac

SEQ ID NO: 1153211 - RNA, 16 nt, Homo sapiens
acucaggcuggaguac

SEQ ID NO: 1153212 - RNA, 22 nt, Homo sapiens
acucaggggcuuggcccuaaga

SEQ ID NO: 1153213 - RNA, 16 nt, Homo sapiens
acucagugauugcaau

SEQ ID NO: 1153214 - RNA, 11 nt, Homo sapiens
acucagugcag

SEQ ID NO: 1153215 - RNA, 14 nt, Homo sapiens
acucaguugcaacu

SEQ ID NO: 1153216 - RNA, 16 nt, Homo sapiens
acucaguuuucuugca

SEQ ID NO: 1153217 - RNA, 20 nt, Homo sapiens
acucauaggggaguaggggu

SEQ ID NO: 1153218 - RNA, 18 nt, Homo sapiens
acucaucgggcccaggga

SEQ ID NO: 1153219 - RNA, 23 nt, Homo sapiens
acucaugaauaauccaccccuug

SEQ ID NO: 1153220 - RNA, 20 nt, Homo sapiens
acucaugugacucuuuccaa

SEQ ID NO: 1153221 - RNA, 18 nt, Homo sapiens
acucauuucuuauaucau

SEQ ID NO: 1153222 - RNA, 18 nt, Homo sapiens
acuccaaccuaaccugug

SEQ ID NO: 1153223 - RNA, 21 nt, Homo sapiens
acuccaagcuccucugugaag

SEQ ID NO: 1153224 - RNA, 19 nt, Homo sapiens
acuccaaugcguggcucuc

SEQ ID NO: 1153225 - RNA, 15 nt, Homo sapiens
acuccacucacugaa

SEQ ID NO: 1153226 - RNA, 16 nt, Homo sapiens
acuccagccugaguca

SEQ ID NO: 1153227 - RNA, 22 nt, Homo sapiens
acuccagccugagugacagagc

SEQ ID NO: 1153228 - RNA, 20 nt, Homo sapiens
acuccagccugggugacaaa

SEQ ID NO: 1153229 - RNA, 14 nt, Homo sapiens
acuccagcugcaag

SEQ ID NO: 1153230 - RNA, 20 nt, Homo sapiens
acuccaggaaccauuuucac

SEQ ID NO: 1153231 - RNA, 12 nt, Homo sapiens
acuccauucucu

SEQ ID NO: 1153232 - RNA, 19 nt, Homo sapiens
acuccccagaccucaggga

SEQ ID NO: 1153233 - RNA, 19 nt, Homo sapiens
acucccuccucacacucca

SEQ ID NO: 1153234 - RNA, 22 nt, Homo sapiens
acuccggccugggugacagagu

SEQ ID NO: 1153235 - RNA, 15 nt, Homo sapiens
acuccgucucaaaaa

SEQ ID NO: 1153236 - RNA, 15 nt, Homo sapiens
acuccucaacuggga

SEQ ID NO: 1153237 - RNA, 16 nt, Homo sapiens
acuccucaacugggaa

SEQ ID NO: 1153238 - RNA, 19 nt, Homo sapiens
acuccuccaaggaaaggga

SEQ ID NO: 1153239 - RNA, 18 nt, Homo sapiens
agcuacuugggaggcuga

SEQ ID NO: 1153240 - RNA, 15 nt, Homo sapiens
agcuagaacuggaag

SEQ ID NO: 1153241 - RNA, 15 nt, Homo sapiens
agcuagacauugcaa

SEQ ID NO: 1153242 - RNA, 17 nt, Homo sapiens
agcuaguguaccuccuc

SEQ ID NO: 1153243 - RNA, 15 nt, Homo sapiens
agcuauaacuuacuu

SEQ ID NO: 1153244 - RNA, 16 nt, Homo sapiens
agcuauacauaugugc

SEQ ID NO: 1153245 - RNA, 13 nt, Homo sapiens
agcuauacuguau

SEQ ID NO: 1153246 - RNA, 19 nt, Homo sapiens
agcuaugauaagauugaaa

SEQ ID NO: 1153247 - RNA, 21 nt, Homo sapiens
agcuauggugagaugcagcug

SEQ ID NO: 1153248 - RNA, 21 nt, Homo sapiens
agcuauuccccacacucuccu

SEQ ID NO: 1153249 - RNA, 17 nt, Homo sapiens
agcuauuuaagugauac

SEQ ID NO: 1153250 - RNA, 17 nt, Homo sapiens
agcucacacccuaccuu

SEQ ID NO: 1153251 - RNA, 13 nt, Homo sapiens
agcucagcuucgu

SEQ ID NO: 1153252 - RNA, 22 nt, Homo sapiens
agcucaggaaccgaggcaggga

SEQ ID NO: 1153253 - RNA, 22 nt, Homo sapiens
agcucagggacuggcacacugg

SEQ ID NO: 1153254 - RNA, 21 nt, Homo sapiens
agcuccacccuggccgagucc

SEQ ID NO: 1153255 - RNA, 18 nt, Homo sapiens
agcucccaagagcuucca

SEQ ID NO: 1153256 - RNA, 15 nt, Homo sapiens
agcuccgaccucucu

SEQ ID NO: 1153257 - RNA, 15 nt, Homo sapiens
agcuccucugugaag

SEQ ID NO: 1153258 - RNA, 19 nt, Homo sapiens
agcucuaagucucaacugc

SEQ ID NO: 1153259 - RNA, 15 nt, Homo sapiens
agcucuauguuuaca

SEQ ID NO: 1153260 - RNA, 20 nt, Homo sapiens
agcucuauucuuugccuuag

SEQ ID NO: 1153261 - RNA, 23 nt, Homo sapiens
agcucuccccucagagugcaagc

SEQ ID NO: 1153262 - RNA, 23 nt, Homo sapiens
agcucugaaaccaguguuaggga

SEQ ID NO: 1153263 - RNA, 16 nt, Homo sapiens
agcucugcucucagca

SEQ ID NO: 1153264 - RNA, 20 nt, Homo sapiens
agcucuggggggcaaccugg

SEQ ID NO: 1153265 - RNA, 17 nt, Homo sapiens
agcucuguaguggaaua

SEQ ID NO: 1153266 - RNA, 21 nt, Homo sapiens
agcucuguggccacauuuuca

SEQ ID NO: 1153267 - RNA, 17 nt, Homo sapiens
agcucuuccaggagcca

SEQ ID NO: 1153268 - RNA, 20 nt, Homo sapiens
agcucuuggcuccacuggga

SEQ ID NO: 1153269 - RNA, 15 nt, Homo sapiens
agcucuugggccuga

SEQ ID NO: 1153270 - RNA, 15 nt, Homo sapiens
agcucuuuacuguaa

SEQ ID NO: 1153271 - RNA, 22 nt, Homo sapiens
agcucuuucucuuuguauuuca

SEQ ID NO: 1153272 - RNA, 14 nt, Homo sapiens
agcugaacaauagg

SEQ ID NO: 1153273 - RNA, 18 nt, Homo sapiens
agcugaacaauaggcugu

SEQ ID NO: 1153274 - RNA, 17 nt, Homo sapiens
agcugaauuauuggaca

SEQ ID NO: 1153275 - RNA, 19 nt, Homo sapiens
agcugagaucgugccacug

SEQ ID NO: 1153276 - RNA, 20 nt, Homo sapiens
agcugagucucccuaaggca

SEQ ID NO: 1153277 - RNA, 17 nt, Homo sapiens
agcugauaaagccuaaa

SEQ ID NO: 1153278 - RNA, 15 nt, Homo sapiens
agcugauuaccugaa

SEQ ID NO: 1153279 - RNA, 21 nt, Homo sapiens
agcugauugggcaccugacca

SEQ ID NO: 1153280 - RNA, 23 nt, Homo sapiens
agcugauugggcaccugaccaca

SEQ ID NO: 1153281 - RNA, 16 nt, Homo sapiens
agcugcaucugauaaa

SEQ ID NO: 1153282 - RNA, 22 nt, Homo sapiens
agcugcauuucacaugccuugc

SEQ ID NO: 1153283 - RNA, 18 nt, Homo sapiens
agcugcccucagccagag

SEQ ID NO: 1153284 - RNA, 16 nt, Homo sapiens
agcugccugcagcaca

SEQ ID NO: 1153285 - RNA, 14 nt, Homo sapiens
agcugcuacaaaga

SEQ ID NO: 1153286 - RNA, 18 nt, Homo sapiens
agcugcuccccucugcac

SEQ ID NO: 1153287 - RNA, 15 nt, Homo sapiens
agcuggagccuggga

SEQ ID NO: 1153288 - RNA, 22 nt, Homo sapiens
agcuggcagcagaguguggccu

SEQ ID NO: 1153289 - RNA, 16 nt, Homo sapiens
agcuggcccacugcug

SEQ ID NO: 1153290 - RNA, 16 nt, Homo sapiens
agcugggcauggugcg

SEQ ID NO: 1153291 - RNA, 18 nt, Homo sapiens
agcugguguuagggcuau

SEQ ID NO: 1153292 - RNA, 14 nt, Homo sapiens
agcuguacugagga

SEQ ID NO: 1153293 - RNA, 15 nt, Homo sapiens
agcuguacuuuuacc

SEQ ID NO: 1153294 - RNA, 20 nt, Homo sapiens
agcuguauuuauguaauauu

SEQ ID NO: 1153295 - RNA, 22 nt, Homo sapiens
agcugucccaucuccacuguua

SEQ ID NO: 1153296 - RNA, 23 nt, Homo sapiens
agcugucccuugcuugccugcag

SEQ ID NO: 1153297 - RNA, 15 nt, Homo sapiens
agcugucgacuucau

SEQ ID NO: 1153298 - RNA, 19 nt, Homo sapiens
agcugucgacuucaugaca

SEQ ID NO: 1153299 - RNA, 22 nt, Homo sapiens
agcugucugucaucugcugcga

SEQ ID NO: 1153300 - RNA, 12 nt, Homo sapiens
agcuguggcuca

SEQ ID NO: 1153301 - RNA, 12 nt, Homo sapiens
agcuguguuacu

SEQ ID NO: 1153302 - RNA, 17 nt, Homo sapiens
agcuguuccuguucagu

SEQ ID NO: 1153303 - RNA, 16 nt, Homo sapiens
agcuuaaauacaccuu

SEQ ID NO: 1153304 - RNA, 20 nt, Homo sapiens
agcuuauaagagggcauaua

SEQ ID NO: 1153305 - RNA, 22 nt, Homo sapiens
agcuuauaagagggcauauaca

SEQ ID NO: 1153306 - RNA, 17 nt, Homo sapiens
agcuugcucuucagugg

SEQ ID NO: 1153307 - RNA, 14 nt, Homo sapiens
agcuuggaccccuu

SEQ ID NO: 1153308 - RNA, 21 nt, Homo sapiens
agcuuggcugagggucuggga

SEQ ID NO: 1153309 - RNA, 16 nt, Homo sapiens
agcuuggggccaggga

SEQ ID NO: 1153310 - RNA, 20 nt, Homo sapiens
agcuugucugaucguucaaa

SEQ ID NO: 1153311 - RNA, 22 nt, Homo sapiens
agcuuguuucugucaagcauau

SEQ ID NO: 1153312 - RNA, 14 nt, Homo sapiens
agcuuuauuucaaa

SEQ ID NO: 1153313 - RNA, 22 nt, Homo sapiens
agcuuucauguaaacugugcac

SEQ ID NO: 1153314 - RNA, 16 nt, Homo sapiens
agcuuuccugacaaua

SEQ ID NO: 1153315 - RNA, 15 nt, Homo sapiens
agcuuugagguggaa

SEQ ID NO: 1153316 - RNA, 16 nt, Homo sapiens
agcuuuggacccaagg

SEQ ID NO: 1153317 - RNA, 15 nt, Homo sapiens
aggaaaaauaaucaa

SEQ ID NO: 1153318 - RNA, 18 nt, Homo sapiens
aggaaaaugggaauuuau

SEQ ID NO: 1153319 - RNA, 17 nt, Homo sapiens
aggaaacaacagcuuua

SEQ ID NO: 1153320 - RNA, 19 nt, Homo sapiens
aggaaacaagugaaagcau

SEQ ID NO: 1153321 - RNA, 13 nt, Homo sapiens
aggaaacaauaua

SEQ ID NO: 1153322 - RNA, 13 nt, Homo sapiens
aggaaacaguuaa

SEQ ID NO: 1153323 - RNA, 12 nt, Homo sapiens
aggaaacauuca

SEQ ID NO: 1153324 - RNA, 11 nt, Homo sapiens
aggaaaccaca

SEQ ID NO: 1153325 - RNA, 12 nt, Homo sapiens
aggaaaccacaa

SEQ ID NO: 1153326 - RNA, 20 nt, Homo sapiens
aggaaacccagcucacagga

SEQ ID NO: 1153327 - RNA, 18 nt, Homo sapiens
aggaaacccccaguguaa

SEQ ID NO: 1153328 - RNA, 20 nt, Homo sapiens
aggaaacccccaguguaaua

SEQ ID NO: 1153329 - RNA, 22 nt, Homo sapiens
aggaaacccccaguguaauaau

SEQ ID NO: 1153330 - RNA, 15 nt, Homo sapiens
aggaaagaacaucac

SEQ ID NO: 1153331 - RNA, 15 nt, Homo sapiens
aggaaagagaaaccu

SEQ ID NO: 1153332 - RNA, 12 nt, Homo sapiens
aggaaagugauu

SEQ ID NO: 1153333 - RNA, 13 nt, Homo sapiens
aggaaagugauuu

SEQ ID NO: 1153334 - RNA, 13 nt, Homo sapiens
aggaaaugaaugc

SEQ ID NO: 1153335 - RNA, 20 nt, Homo sapiens
aggaaauguguguauuuagu

SEQ ID NO: 1153336 - RNA, 22 nt, Homo sapiens
aggaaauguguguauuuaguga

SEQ ID NO: 1153337 - RNA, 16 nt, Homo sapiens
aggaacccuuggucac

SEQ ID NO: 1153338 - RNA, 22 nt, Homo sapiens
aggaacccuuggucacauguga

SEQ ID NO: 1153339 - RNA, 19 nt, Homo sapiens
aggaacucgcaccugugcu

SEQ ID NO: 1153340 - RNA, 13 nt, Homo sapiens
aggaacuuuguca

SEQ ID NO: 1153341 - RNA, 23 nt, Homo sapiens
aggaagcccuaagacgucccuuu

SEQ ID NO: 1153342 - RNA, 15 nt, Homo sapiens
aggaagccucugggu

SEQ ID NO: 1153343 - RNA, 23 nt, Homo sapiens
aggaagccugagguugaccagcu

SEQ ID NO: 1153344 - RNA, 19 nt, Homo sapiens
aggaaggacuaugacaaau

SEQ ID NO: 1153345 - RNA, 18 nt, Homo sapiens
aggaaguaugguuuuauu

SEQ ID NO: 1153346 - RNA, 20 nt, Homo sapiens
aggaauauagaaugaaagac

SEQ ID NO: 1153347 - RNA, 22 nt, Homo sapiens
aggaaucggaauccugucgauu

SEQ ID NO: 1153348 - RNA, 18 nt, Homo sapiens
aggaauggugcguggcuu

SEQ ID NO: 1153349 - RNA, 19 nt, Homo sapiens
aggaauguguucaccaucc

SEQ ID NO: 1153350 - RNA, 14 nt, Homo sapiens
aggaauuucaagaa

SEQ ID NO: 1153351 - RNA, 12 nt, Homo sapiens
aggacaaaauca

SEQ ID NO: 1153352 - RNA, 20 nt, Homo sapiens
aggacaaacagugaauuuaa

SEQ ID NO: 1153353 - RNA, 17 nt, Homo sapiens
aggacaaauugagacag

SEQ ID NO: 1153354 - RNA, 23 nt, Homo sapiens
aggacaaauugagacagugcaca

SEQ ID NO: 1153355 - RNA, 19 nt, Homo sapiens
aggacaagacccucucagg

SEQ ID NO: 1153356 - RNA, 15 nt, Homo sapiens
aggacaagggaaaug

SEQ ID NO: 1153357 - RNA, 21 nt, Homo sapiens
aggacaagggaaaugucaggg

SEQ ID NO: 1153358 - RNA, 14 nt, Homo sapiens
aggacacagauuau

SEQ ID NO: 1153359 - RNA, 13 nt, Homo sapiens
aggacagacuggc

SEQ ID NO: 1153360 - RNA, 14 nt, Homo sapiens
aggacagcugugcc

SEQ ID NO: 1153361 - RNA, 15 nt, Homo sapiens
aggacaggucucuga

SEQ ID NO: 1153362 - RNA, 19 nt, Homo sapiens
aggaccagcccuugaggga

SEQ ID NO: 1153363 - RNA, 12 nt, Homo sapiens
aggaccagugaa

SEQ ID NO: 1153364 - RNA, 17 nt, Homo sapiens
aggacccaagcagagaa

SEQ ID NO: 1153365 - RNA, 19 nt, Homo sapiens
aggacccaggaggugugau

SEQ ID NO: 1153366 - RNA, 21 nt, Homo sapiens
aggacccugaaggggccauga

SEQ ID NO: 1153367 - RNA, 22 nt, Homo sapiens
aggacccugaaggggccaugau

SEQ ID NO: 1153368 - RNA, 19 nt, Homo sapiens
aggaccgccauggugcugg

SEQ ID NO: 1153369 - RNA, 17 nt, Homo sapiens
aggaccugccaaugauu

SEQ ID NO: 1153370 - RNA, 16 nt, Homo sapiens
aggacggacucacuuc

SEQ ID NO: 1153371 - RNA, 19 nt, Homo sapiens
aggacuacauuuugcucug

SEQ ID NO: 1153372 - RNA, 22 nt, Homo sapiens
aggacuacauuuugcucuguga

SEQ ID NO: 1153373 - RNA, 14 nt, Homo sapiens
aggcuuaccaaagu

SEQ ID NO: 1153374 - RNA, 20 nt, Homo sapiens
aggcuuuaaaaagaaaauca

SEQ ID NO: 1153375 - RNA, 14 nt, Homo sapiens
aggcuuucagcuua

SEQ ID NO: 1153376 - RNA, 12 nt, Homo sapiens
agggaaaacugc

SEQ ID NO: 1153377 - RNA, 15 nt, Homo sapiens
agggaagcucagggg

SEQ ID NO: 1153378 - RNA, 15 nt, Homo sapiens
agggaaguccuggga

SEQ ID NO: 1153379 - RNA, 16 nt, Homo sapiens
agggacagaaaccaag

SEQ ID NO: 1153380 - RNA, 21 nt, Homo sapiens
agggacaugcccuguguggcu

SEQ ID NO: 1153381 - RNA, 21 nt, Homo sapiens
agggaccccugcccuuguccc

SEQ ID NO: 1153382 - RNA, 14 nt, Homo sapiens
agggaccuugucuc

SEQ ID NO: 1153383 - RNA, 15 nt, Homo sapiens
agggacugaaaaccu

SEQ ID NO: 1153384 - RNA, 14 nt, Homo sapiens
agggagaacgggaa

SEQ ID NO: 1153385 - RNA, 15 nt, Homo sapiens
agggagaagacugug

SEQ ID NO: 1153386 - RNA, 22 nt, Homo sapiens
agggagaccccaaaaagagaga

SEQ ID NO: 1153387 - RNA, 13 nt, Homo sapiens
agggagaggaaga

SEQ ID NO: 1153388 - RNA, 21 nt, Homo sapiens
agggagaguuggggaaggcaa

SEQ ID NO: 1153389 - RNA, 16 nt, Homo sapiens
agggagcuagccagag

SEQ ID NO: 1153390 - RNA, 20 nt, Homo sapiens
agggaggcgggggcugcccu

SEQ ID NO: 1153391 - RNA, 16 nt, Homo sapiens
agggagggaaagacaa

SEQ ID NO: 1153392 - RNA, 15 nt, Homo sapiens
agggagggcugucau

SEQ ID NO: 1153393 - RNA, 21 nt, Homo sapiens
agggauaguacuaagcauuuc

SEQ ID NO: 1153394 - RNA, 13 nt, Homo sapiens
agggcacauuucu

SEQ ID NO: 1153395 - RNA, 14 nt, Homo sapiens
agggcaccagggac

SEQ ID NO: 1153396 - RNA, 14 nt, Homo sapiens
agggcagagacaau

SEQ ID NO: 1153397 - RNA, 13 nt, Homo sapiens
agggcaugagcau

SEQ ID NO: 1153398 - RNA, 20 nt, Homo sapiens
agggcccccaucucaugccc

SEQ ID NO: 1153399 - RNA, 22 nt, Homo sapiens
agggccucaguuucauuaacug

SEQ ID NO: 1153400 - RNA, 15 nt, Homo sapiens
agggcuccuguggca

SEQ ID NO: 1153401 - RNA, 23 nt, Homo sapiens
agggcugacucuaggugcccuug

SEQ ID NO: 1153402 - RNA, 15 nt, Homo sapiens
agggcugccuuugga

SEQ ID NO: 1153403 - RNA, 19 nt, Homo sapiens
agggcugucaucugugcac

SEQ ID NO: 1153404 - RNA, 16 nt, Homo sapiens
agggcuuccucuuccg

SEQ ID NO: 1153405 - RNA, 22 nt, Homo sapiens
aggggacacuggccccacagga

SEQ ID NO: 1153406 - RNA, 19 nt, Homo sapiens
aggggagccugugguggcc

SEQ ID NO: 1153407 - RNA, 19 nt, Homo sapiens
aggggagucaccagccaga

SEQ ID NO: 1153408 - RNA, 12 nt, Homo sapiens
aggggagugcau

SEQ ID NO: 1153409 - RNA, 21 nt, Homo sapiens
aggggcagccacaccacugcc

SEQ ID NO: 1153410 - RNA, 17 nt, Homo sapiens
aggggccaugcugugug

SEQ ID NO: 1153411 - RNA, 13 nt, Homo sapiens
aggggccugugug

SEQ ID NO: 1153412 - RNA, 20 nt, Homo sapiens
aggggcuccccgggucucuc

SEQ ID NO: 1153413 - RNA, 21 nt, Homo sapiens
agggggaggcuaaagcccaga

SEQ ID NO: 1153414 - RNA, 21 nt, Homo sapiens
agggggaugccacuccucccu

SEQ ID NO: 1153415 - RNA, 19 nt, Homo sapiens
agggggcugaaacuugaac

SEQ ID NO: 1153416 - RNA, 13 nt, Homo sapiens
agggguaguggga

SEQ ID NO: 1153417 - RNA, 21 nt, Homo sapiens
agggguggcugggucuucaag

SEQ ID NO: 1153418 - RNA, 18 nt, Homo sapiens
agggguucuugagccagc

SEQ ID NO: 1153419 - RNA, 18 nt, Homo sapiens
agggguuggauugcaaua

SEQ ID NO: 1153420 - RNA, 18 nt, Homo sapiens
aggguaacuuaacagagu

SEQ ID NO: 1153421 - RNA, 19 nt, Homo sapiens
aggguaugauaagcuuuau

SEQ ID NO: 1153422 - RNA, 22 nt, Homo sapiens
agggucuugggaaauaugaaug

SEQ ID NO: 1153423 - RNA, 16 nt, Homo sapiens
agggucuuugguguuu

SEQ ID NO: 1153424 - RNA, 19 nt, Homo sapiens
agggucuuuucaucuggga

SEQ ID NO: 1153425 - RNA, 21 nt, Homo sapiens
agggugaggugcuugagucuc

SEQ ID NO: 1153426 - RNA, 18 nt, Homo sapiens
agggugcugccccaugaa

SEQ ID NO: 1153427 - RNA, 22 nt, Homo sapiens
aggguggaugauaccauuuccu

SEQ ID NO: 1153428 - RNA, 12 nt, Homo sapiens
aggguggcacau

SEQ ID NO: 1153429 - RNA, 11 nt, Homo sapiens
agggugguggu

SEQ ID NO: 1153430 - RNA, 20 nt, Homo sapiens
aggguuucaccauguugccc

SEQ ID NO: 1153431 - RNA, 19 nt, Homo sapiens
aggguuuuguggaugauuu

SEQ ID NO: 1153432 - RNA, 18 nt, Homo sapiens
aggguuuuucucacugug

SEQ ID NO: 1153433 - RNA, 16 nt, Homo sapiens
agguaaagacugccag

SEQ ID NO: 1153434 - RNA, 12 nt, Homo sapiens
agguaaagcuau

SEQ ID NO: 1153435 - RNA, 14 nt, Homo sapiens
agguaaugugaaua

SEQ ID NO: 1153436 - RNA, 11 nt, Homo sapiens
agguaauuccc

SEQ ID NO: 1153437 - RNA, 19 nt, Homo sapiens
agguacaaguaaagcccag

SEQ ID NO: 1153438 - RNA, 22 nt, Homo sapiens
agguacuucaggggcacuucau

SEQ ID NO: 1153439 - RNA, 22 nt, Homo sapiens
aggucacuauggacuuacccua

SEQ ID NO: 1153440 - RNA, 15 nt, Homo sapiens
aggucagacuaggau

SEQ ID NO: 1153441 - RNA, 21 nt, Homo sapiens
aggucaggggugacacagacu

SEQ ID NO: 1153442 - RNA, 18 nt, Homo sapiens
aggucauggccacacugu

SEQ ID NO: 1153443 - RNA, 19 nt, Homo sapiens
aggucauggccacacugug

SEQ ID NO: 1153444 - RNA, 14 nt, Homo sapiens
agguccauuuugcc

SEQ ID NO: 1153445 - RNA, 19 nt, Homo sapiens
aggucccagcgagccacag

SEQ ID NO: 1153446 - RNA, 19 nt, Homo sapiens
agguccucugucagucaca

SEQ ID NO: 1153447 - RNA, 16 nt, Homo sapiens
agguccuggugguauu

SEQ ID NO: 1153448 - RNA, 13 nt, Homo sapiens
aggucuaugcaga

SEQ ID NO: 1153449 - RNA, 13 nt, Homo sapiens
aggucucccggga

SEQ ID NO: 1153450 - RNA, 14 nt, Homo sapiens
aggucugaaggauu

SEQ ID NO: 1153451 - RNA, 15 nt, Homo sapiens
aggucugauuugcag

SEQ ID NO: 1153452 - RNA, 13 nt, Homo sapiens
aggucuucuccaa

SEQ ID NO: 1153453 - RNA, 17 nt, Homo sapiens
aggugacaaaaggcaga

SEQ ID NO: 1153454 - RNA, 21 nt, Homo sapiens
aggugacccaaugauucagcu

SEQ ID NO: 1153455 - RNA, 15 nt, Homo sapiens
aggugagagugcaga

SEQ ID NO: 1153456 - RNA, 23 nt, Homo sapiens
aggugagugugagggcagcacug

SEQ ID NO: 1153457 - RNA, 14 nt, Homo sapiens
aggugaguucucac

SEQ ID NO: 1153458 - RNA, 19 nt, Homo sapiens
aggugcaaagggguugagg

SEQ ID NO: 1153459 - RNA, 15 nt, Homo sapiens
aggugcagucuuuga

SEQ ID NO: 1153460 - RNA, 17 nt, Homo sapiens
aggugccaugucuuuac

SEQ ID NO: 1153461 - RNA, 16 nt, Homo sapiens
aggugcuaaacuugca

SEQ ID NO: 1153462 - RNA, 19 nt, Homo sapiens
aggugcugacuucaucucc

SEQ ID NO: 1153463 - RNA, 17 nt, Homo sapiens
aggugcuugagucucca

SEQ ID NO: 1153464 - RNA, 15 nt, Homo sapiens
agguggaccuggcag

SEQ ID NO: 1153465 - RNA, 19 nt, Homo sapiens
agguggcacuagggaucaa

SEQ ID NO: 1153466 - RNA, 16 nt, Homo sapiens
agguggccacaaauuc

SEQ ID NO: 1153467 - RNA, 18 nt, Homo sapiens
aggugggcggaucacuug

SEQ ID NO: 1153468 - RNA, 18 nt, Homo sapiens
aggugguaguaaaacaca

SEQ ID NO: 1153469 - RNA, 15 nt, Homo sapiens
agguggugaggcaau

SEQ ID NO: 1153470 - RNA, 14 nt, Homo sapiens
aggugucccugccu

SEQ ID NO: 1153471 - RNA, 15 nt, Homo sapiens
aggugugacauguua

SEQ ID NO: 1153472 - RNA, 15 nt, Homo sapiens
aggugugguggcuca

SEQ ID NO: 1153473 - RNA, 13 nt, Homo sapiens
agguuaaggcaua

SEQ ID NO: 1153474 - RNA, 13 nt, Homo sapiens
agguuacuaccua

SEQ ID NO: 1153475 - RNA, 16 nt, Homo sapiens
agguucacagcagcuu

SEQ ID NO: 1153476 - RNA, 17 nt, Homo sapiens
agguucccgacaccaga

SEQ ID NO: 1153477 - RNA, 20 nt, Homo sapiens
agguucuaaaguucuaagau

SEQ ID NO: 1153478 - RNA, 22 nt, Homo sapiens
agguucuuaaaguuugcaguau

SEQ ID NO: 1153479 - RNA, 14 nt, Homo sapiens
agguugacagauac

SEQ ID NO: 1153480 - RNA, 17 nt, Homo sapiens
agguugacagauacuuu

SEQ ID NO: 1153481 - RNA, 19 nt, Homo sapiens
agguuggccuuacuguuga

SEQ ID NO: 1153482 - RNA, 13 nt, Homo sapiens
agguugugcaugg

SEQ ID NO: 1153483 - RNA, 19 nt, Homo sapiens
agguuuagaggaccaguga

SEQ ID NO: 1153484 - RNA, 13 nt, Homo sapiens
agguuucaagacu

SEQ ID NO: 1153485 - RNA, 18 nt, Homo sapiens
agguuucaagacuugaua

SEQ ID NO: 1153486 - RNA, 22 nt, Homo sapiens
agguuuccgggggaugaaugau

SEQ ID NO: 1153487 - RNA, 13 nt, Homo sapiens
agguuuccugccu

SEQ ID NO: 1153488 - RNA, 13 nt, Homo sapiens
aguaaaaacauuu

SEQ ID NO: 1153489 - RNA, 19 nt, Homo sapiens
aguaaaacggauaccaagu

SEQ ID NO: 1153490 - RNA, 15 nt, Homo sapiens
aguaaacacagggaa

SEQ ID NO: 1153491 - RNA, 21 nt, Homo sapiens
aguaaacgguguauauaccuu

SEQ ID NO: 1153492 - RNA, 11 nt, Homo sapiens
aguaacaugug

SEQ ID NO: 1153493 - RNA, 21 nt, Homo sapiens
aguaaccauggggaagaaauc

SEQ ID NO: 1153494 - RNA, 18 nt, Homo sapiens
aguaagcauuuccagccu

SEQ ID NO: 1153495 - RNA, 21 nt, Homo sapiens
aguaauaguaaacacagggaa

SEQ ID NO: 1153496 - RNA, 16 nt, Homo sapiens
aguaaucuguguacaa

SEQ ID NO: 1153497 - RNA, 18 nt, Homo sapiens
aguaaucuguguacaaag

SEQ ID NO: 1153498 - RNA, 12 nt, Homo sapiens
aguaaucuugca

SEQ ID NO: 1153499 - RNA, 21 nt, Homo sapiens
aguaaugaauuuuuaugauau

SEQ ID NO: 1153500 - RNA, 21 nt, Homo sapiens
aguaaugccacacauugugcu

SEQ ID NO: 1153501 - RNA, 21 nt, Homo sapiens
aguaaugccucugucuagcau

SEQ ID NO: 1153502 - RNA, 23 nt, Homo sapiens
aguaauguugacuguauuuucca

SEQ ID NO: 1153503 - RNA, 16 nt, Homo sapiens
aguacaccccaacagc

SEQ ID NO: 1153504 - RNA, 18 nt, Homo sapiens
aguacaccccaacagcac

SEQ ID NO: 1153505 - RNA, 21 nt, Homo sapiens
aguacaccccaacagcacccu

SEQ ID NO: 1153506 - RNA, 19 nt, Homo sapiens
aguacagacgucucaagac

SEQ ID NO: 1153507 - RNA, 16 nt, Homo sapiens
aguacauugaaggccu

SEQ ID NO: 1153508 - RNA, 14 nt, Homo sapiens
aguaccuucaauac

SEQ ID NO: 1153509 - RNA, 21 nt, Homo sapiens
aguaccuugcuucuuacugau

SEQ ID NO: 1153510 - RNA, 21 nt, Homo sapiens
aguacgucccagcggccucag

SEQ ID NO: 1153511 - RNA, 15 nt, Homo sapiens
aguacuuacaucagg

SEQ ID NO: 1153512 - RNA, 22 nt, Homo sapiens
aguacuuggguuugcaacagcu

SEQ ID NO: 1153513 - RNA, 23 nt, Homo sapiens
aguagaacaaaaacuauuaucac

SEQ ID NO: 1153514 - RNA, 19 nt, Homo sapiens
aguagacauuuuaacaaga

SEQ ID NO: 1153515 - RNA, 16 nt, Homo sapiens
aguagcuggauuacag

SEQ ID NO: 1153516 - RNA, 16 nt, Homo sapiens
aguaggacuuuccuaa

SEQ ID NO: 1153517 - RNA, 21 nt, Homo sapiens
aguaguaccuuucagaacuca

SEQ ID NO: 1153518 - RNA, 16 nt, Homo sapiens
aguaguaugaugauac

SEQ ID NO: 1153519 - RNA, 16 nt, Homo sapiens
aguaucuccaagggua

SEQ ID NO: 1153520 - RNA, 15 nt, Homo sapiens
aguaugcauacuggu

SEQ ID NO: 1153521 - RNA, 22 nt, Homo sapiens
aguauggccagcagacaggcug

SEQ ID NO: 1153522 - RNA, 11 nt, Homo sapiens
aguaugucuug

SEQ ID NO: 1153523 - RNA, 13 nt, Homo sapiens
aguauguguaugu

SEQ ID NO: 1153524 - RNA, 16 nt, Homo sapiens
aguauguguaugugua

SEQ ID NO: 1153525 - RNA, 16 nt, Homo sapiens
aguauuacugcugcug

SEQ ID NO: 1153526 - RNA, 22 nt, Homo sapiens
aguauugaauacuuacauucuc

SEQ ID NO: 1153527 - RNA, 15 nt, Homo sapiens
aguauugcagccaaa

SEQ ID NO: 1153528 - RNA, 18 nt, Homo sapiens
aguauuuaggauaaccuu

SEQ ID NO: 1153529 - RNA, 17 nt, Homo sapiens
aguauuuggcauucucu

SEQ ID NO: 1153530 - RNA, 17 nt, Homo sapiens
agucaaaacuacaaauc

SEQ ID NO: 1153531 - RNA, 18 nt, Homo sapiens
agucaagagcauccugcu

SEQ ID NO: 1153532 - RNA, 13 nt, Homo sapiens
agucaauuucuac

SEQ ID NO: 1153533 - RNA, 22 nt, Homo sapiens
agucacaaugaguuugggcaua

SEQ ID NO: 1153534 - RNA, 12 nt, Homo sapiens
agucacacagug

SEQ ID NO: 1153535 - RNA, 17 nt, Homo sapiens
agucacaggaugagaca

SEQ ID NO: 1153536 - RNA, 15 nt, Homo sapiens
agucacaguucaaaa

SEQ ID NO: 1153537 - RNA, 19 nt, Homo sapiens
agucacauggccuaugcac

SEQ ID NO: 1153538 - RNA, 13 nt, Homo sapiens
agucaccaugcaa

SEQ ID NO: 1153539 - RNA, 12 nt, Homo sapiens
agucacugugag

SEQ ID NO: 1153540 - RNA, 21 nt, Homo sapiens
agucagagagggugacaagau

SEQ ID NO: 1153541 - RNA, 13 nt, Homo sapiens
agucagauuuauu

SEQ ID NO: 1153542 - RNA, 19 nt, Homo sapiens
agucagcaacagagcaaaa

SEQ ID NO: 1153543 - RNA, 18 nt, Homo sapiens
agucagcucuucaucugc

SEQ ID NO: 1153544 - RNA, 18 nt, Homo sapiens
agucauaccuacauucaa

SEQ ID NO: 1153545 - RNA, 17 nt, Homo sapiens
agucaucaucucuugau

SEQ ID NO: 1153546 - RNA, 18 nt, Homo sapiens
agucauguaaauacuguu

SEQ ID NO: 1153547 - RNA, 16 nt, Homo sapiens
agucauguagccccag

SEQ ID NO: 1153548 - RNA, 12 nt, Homo sapiens
agucauuaccac

SEQ ID NO: 1153549 - RNA, 21 nt, Homo sapiens
agucauugaaauuuacuguga

SEQ ID NO: 1153550 - RNA, 15 nt, Homo sapiens
aguccaacaguagca

SEQ ID NO: 1153551 - RNA, 19 nt, Homo sapiens
aguccagacauuuguuuca

SEQ ID NO: 1153552 - RNA, 15 nt, Homo sapiens
aguccaggacugggu

SEQ ID NO: 1153553 - RNA, 14 nt, Homo sapiens
aguccaugcuccag

SEQ ID NO: 1153554 - RNA, 14 nt, Homo sapiens
aguccauuguggag

SEQ ID NO: 1153555 - RNA, 19 nt, Homo sapiens
aguccccaaccugcacucu

SEQ ID NO: 1153556 - RNA, 14 nt, Homo sapiens
agucccccaaaggg

SEQ ID NO: 1153557 - RNA, 19 nt, Homo sapiens
agucccucacguuucuucc

SEQ ID NO: 1153558 - RNA, 18 nt, Homo sapiens
agucccuuugugacuuca

SEQ ID NO: 1153559 - RNA, 18 nt, Homo sapiens
aguccuaacuuccugugc

SEQ ID NO: 1153560 - RNA, 19 nt, Homo sapiens
aguccucccagacuaccug

SEQ ID NO: 1153561 - RNA, 16 nt, Homo sapiens
aguccugacugggcug

SEQ ID NO: 1153562 - RNA, 15 nt, Homo sapiens
aguccuuuucuugcu

SEQ ID NO: 1153563 - RNA, 15 nt, Homo sapiens
agucgacacuaagaa

SEQ ID NO: 1153564 - RNA, 13 nt, Homo sapiens
agucgaugaacua

SEQ ID NO: 1153565 - RNA, 16 nt, Homo sapiens
agucuagaagaauuaa

SEQ ID NO: 1153566 - RNA, 19 nt, Homo sapiens
agucuaucaaccccagaca

SEQ ID NO: 1153567 - RNA, 15 nt, Homo sapiens
agucucugccuugcc

SEQ ID NO: 1153568 - RNA, 17 nt, Homo sapiens
agucucuuaauucugau

SEQ ID NO: 1153569 - RNA, 20 nt, Homo sapiens
agucucuucuaagcaaaauu

SEQ ID NO: 1153570 - RNA, 13 nt, Homo sapiens
agucucuucugau

SEQ ID NO: 1153571 - RNA, 15 nt, Homo sapiens
agucugagcuucuuu

SEQ ID NO: 1153572 - RNA, 13 nt, Homo sapiens
agucugaugguga

SEQ ID NO: 1153573 - RNA, 22 nt, Homo sapiens
agucugcuacccucauuucuca

SEQ ID NO: 1153574 - RNA, 22 nt, Homo sapiens
agucugguggauaaagauggau

SEQ ID NO: 1153575 - RNA, 15 nt, Homo sapiens
agucuguucacugca

SEQ ID NO: 1153576 - RNA, 15 nt, Homo sapiens
agucuguuuacugca

SEQ ID NO: 1153577 - RNA, 19 nt, Homo sapiens
agucuugcauugaauuuag

SEQ ID NO: 1153578 - RNA, 10 nt, Homo sapiens
agucuugucu

SEQ ID NO: 1153579 - RNA, 20 nt, Homo sapiens
agugaaacaggucuuugcca

SEQ ID NO: 1153580 - RNA, 16 nt, Homo sapiens
agugaaacauugaacu

SEQ ID NO: 1153581 - RNA, 17 nt, Homo sapiens
agugaagacgucagggg

SEQ ID NO: 1153582 - RNA, 19 nt, Homo sapiens
agugaagcugguggaacau

SEQ ID NO: 1153583 - RNA, 19 nt, Homo sapiens
agugaaugccagugugcug

SEQ ID NO: 1153584 - RNA, 15 nt, Homo sapiens
agugaauugucuuug

SEQ ID NO: 1153585 - RNA, 12 nt, Homo sapiens
agugacacugga

SEQ ID NO: 1153586 - RNA, 13 nt, Homo sapiens
agugacacuggac

SEQ ID NO: 1153587 - RNA, 12 nt, Homo sapiens
agugacagaucc

SEQ ID NO: 1153588 - RNA, 21 nt, Homo sapiens
agugacauaauuuacaugcaa

SEQ ID NO: 1153589 - RNA, 12 nt, Homo sapiens
agugacauagcc

SEQ ID NO: 1153590 - RNA, 19 nt, Homo sapiens
agugacaugauacaaacac

SEQ ID NO: 1153591 - RNA, 22 nt, Homo sapiens
agugaccccugccuacuuccuu

SEQ ID NO: 1153592 - RNA, 22 nt, Homo sapiens
agugaccugguuaaacaaacca

SEQ ID NO: 1153593 - RNA, 18 nt, Homo sapiens
agugagacuccaucucaa

SEQ ID NO: 1153594 - RNA, 21 nt, Homo sapiens
agugagccaagaaacacugcc

SEQ ID NO: 1153595 - RNA, 15 nt, Homo sapiens
agugagccagcagug

SEQ ID NO: 1153596 - RNA, 14 nt, Homo sapiens
agugaggaaagccu

SEQ ID NO: 1153597 - RNA, 15 nt, Homo sapiens
agugaggaaagccuc

SEQ ID NO: 1153598 - RNA, 19 nt, Homo sapiens
agugaggacaaaaucacau

SEQ ID NO: 1153599 - RNA, 14 nt, Homo sapiens
agugaggcccuaaa

SEQ ID NO: 1153600 - RNA, 16 nt, Homo sapiens
agugagguggaauuau

SEQ ID NO: 1153601 - RNA, 14 nt, Homo sapiens
agugaguacuguua

SEQ ID NO: 1153602 - RNA, 17 nt, Homo sapiens
agugauaagagcagugg

SEQ ID NO: 1153603 - RNA, 15 nt, Homo sapiens
agugaugaaucagca

SEQ ID NO: 1153604 - RNA, 15 nt, Homo sapiens
agugaugaugcaugg

SEQ ID NO: 1153605 - RNA, 12 nt, Homo sapiens
agugauggagcu

SEQ ID NO: 1153606 - RNA, 12 nt, Homo sapiens
agugauguaauc

SEQ ID NO: 1153607 - RNA, 15 nt, Homo sapiens
agugauucccaacuc

SEQ ID NO: 1153608 - RNA, 22 nt, Homo sapiens
agugauugaagcccagugaauu

SEQ ID NO: 1153609 - RNA, 16 nt, Homo sapiens
agugauuggcucugug

SEQ ID NO: 1153610 - RNA, 23 nt, Homo sapiens
agugauuuuauuagaaguuucau

SEQ ID NO: 1153611 - RNA, 17 nt, Homo sapiens
agugcaaauuugauaca

SEQ ID NO: 1153612 - RNA, 21 nt, Homo sapiens
agugcaaccucugcuucccag

SEQ ID NO: 1153613 - RNA, 21 nt, Homo sapiens
agugcaagccccugcuccaga

SEQ ID NO: 1153614 - RNA, 23 nt, Homo sapiens
agugcagaaaggacguggaugaa

SEQ ID NO: 1153615 - RNA, 12 nt, Homo sapiens
agugcagacuca

SEQ ID NO: 1153616 - RNA, 21 nt, Homo sapiens
agugcagagaaagaaagggaa

SEQ ID NO: 1153617 - RNA, 16 nt, Homo sapiens
agugcaguggugcaau

SEQ ID NO: 1153618 - RNA, 11 nt, Homo sapiens
agugcauuuag

SEQ ID NO: 1153619 - RNA, 16 nt, Homo sapiens
agugccaacuguggcu

SEQ ID NO: 1153620 - RNA, 17 nt, Homo sapiens
agugccgaggacaugca

SEQ ID NO: 1153621 - RNA, 22 nt, Homo sapiens
agugccucaagaggaaugaaaa

SEQ ID NO: 1153622 - RNA, 20 nt, Homo sapiens
agugcuacagaaagcacaaa

SEQ ID NO: 1153623 - RNA, 20 nt, Homo sapiens
agugcucuggggcacuguug

SEQ ID NO: 1153624 - RNA, 16 nt, Homo sapiens
agugcugggauuacag

SEQ ID NO: 1153625 - RNA, 19 nt, Homo sapiens
agugcugugcugugcuaug

SEQ ID NO: 1153626 - RNA, 13 nt, Homo sapiens
agugcuucuugua

SEQ ID NO: 1153627 - RNA, 13 nt, Homo sapiens
agugcuuguguaa

SEQ ID NO: 1153628 - RNA, 22 nt, Homo sapiens
aguggaauaugucuucuguaua

SEQ ID NO: 1153629 - RNA, 15 nt, Homo sapiens
aguggauaaccacag

SEQ ID NO: 1153630 - RNA, 19 nt, Homo sapiens
aguggauaaccacagggcu

SEQ ID NO: 1153631 - RNA, 17 nt, Homo sapiens
aguggaugccugcugca

SEQ ID NO: 1153632 - RNA, 17 nt, Homo sapiens
aguggaugcugugcuac

SEQ ID NO: 1153633 - RNA, 19 nt, Homo sapiens
aguggcacgaucucagcuc

SEQ ID NO: 1153634 - RNA, 18 nt, Homo sapiens
aguggccacguucaggga

SEQ ID NO: 1153635 - RNA, 16 nt, Homo sapiens
aguggccucuuugucu

SEQ ID NO: 1153636 - RNA, 23 nt, Homo sapiens
aguggcucacgccuguaauccca

SEQ ID NO: 1153637 - RNA, 18 nt, Homo sapiens
agugggagguugugcaug

SEQ ID NO: 1153638 - RNA, 13 nt, Homo sapiens
agugggcauguau

SEQ ID NO: 1153639 - RNA, 15 nt, Homo sapiens
aguggguagugucau

SEQ ID NO: 1153640 - RNA, 17 nt, Homo sapiens
aguggucucuacugugg

SEQ ID NO: 1153641 - RNA, 12 nt, Homo sapiens
aguggugcaauc

SEQ ID NO: 1153642 - RNA, 21 nt, Homo sapiens
agugguggcaggacaagagaa

SEQ ID NO: 1153643 - RNA, 12 nt, Homo sapiens
aguggugucauu

SEQ ID NO: 1153644 - RNA, 20 nt, Homo sapiens
aguggugugaucucggcuca

SEQ ID NO: 1153645 - RNA, 16 nt, Homo sapiens
agugguuaagauuccu

SEQ ID NO: 1153646 - RNA, 14 nt, Homo sapiens
aguguaaaccaaau

SEQ ID NO: 1153647 - RNA, 16 nt, Homo sapiens
aguguaaauucagucu

SEQ ID NO: 1153648 - RNA, 15 nt, Homo sapiens
aguguaauugagaag

SEQ ID NO: 1153649 - RNA, 13 nt, Homo sapiens
aguguacauguac

SEQ ID NO: 1153650 - RNA, 18 nt, Homo sapiens
aguguauuuuaaauguga

SEQ ID NO: 1153651 - RNA, 23 nt, Homo sapiens
agugucaccccucacugugacug

SEQ ID NO: 1153652 - RNA, 20 nt, Homo sapiens
aguguccauguuggccucca

SEQ ID NO: 1153653 - RNA, 22 nt, Homo sapiens
aguguccuggcugugaaugcca

SEQ ID NO: 1153654 - RNA, 21 nt, Homo sapiens
aguguccuucacggcacugga

SEQ ID NO: 1153655 - RNA, 19 nt, Homo sapiens
agugucuugagacuuuauc

SEQ ID NO: 1153656 - RNA, 11 nt, Homo sapiens
agugugccaca

SEQ ID NO: 1153657 - RNA, 22 nt, Homo sapiens
agugugugguguuagggugcag

SEQ ID NO: 1153658 - RNA, 12 nt, Homo sapiens
aguguucaucuc

SEQ ID NO: 1153659 - RNA, 19 nt, Homo sapiens
aguguuccaagucucugug

SEQ ID NO: 1153660 - RNA, 23 nt, Homo sapiens
aguguuccccuuccacugagggc

SEQ ID NO: 1153661 - RNA, 13 nt, Homo sapiens
aguguucuacacc

SEQ ID NO: 1153662 - RNA, 23 nt, Homo sapiens
aguguuugcccuuuggccaguga

SEQ ID NO: 1153663 - RNA, 17 nt, Homo sapiens
aguguuuugcacaucau

SEQ ID NO: 1153664 - RNA, 19 nt, Homo sapiens
aguuaaacauugaaguaau

SEQ ID NO: 1153665 - RNA, 16 nt, Homo sapiens
aguuaauuuaauuugc

SEQ ID NO: 1153666 - RNA, 23 nt, Homo sapiens
aguuacauuaaaauaaaccaaau

SEQ ID NO: 1153667 - RNA, 15 nt, Homo sapiens
aguuagauuauugaa

SEQ ID NO: 1153668 - RNA, 16 nt, Homo sapiens
aguuaguaauggugcu

SEQ ID NO: 1153669 - RNA, 20 nt, Homo sapiens
aguuauaucacuugcauauc

SEQ ID NO: 1153670 - RNA, 20 nt, Homo sapiens
aguuauuacauguaauuuga

SEQ ID NO: 1153671 - RNA, 15 nt, Homo sapiens
aguuauuuaugcuau

SEQ ID NO: 1153672 - RNA, 22 nt, Homo sapiens
aguuauuucaaccagcacauuc

SEQ ID NO: 1153673 - RNA, 17 nt, Homo sapiens
aguucaaggaacuugaa

SEQ ID NO: 1153674 - RNA, 19 nt, Homo sapiens
aguucaauaaaugucuguu

SEQ ID NO: 1153675 - RNA, 13 nt, Homo sapiens
aguucacugcugc

SEQ ID NO: 1153676 - RNA, 16 nt, Homo sapiens
aguuccauucuuggca

SEQ ID NO: 1153677 - RNA, 14 nt, Homo sapiens
aguucccucuugcu

SEQ ID NO: 1153678 - RNA, 15 nt, Homo sapiens
aguucuaagauucua

SEQ ID NO: 1153679 - RNA, 16 nt, Homo sapiens
aguucuaagauucuga

SEQ ID NO: 1153680 - RNA, 13 nt, Homo sapiens
aguucuaggcacu

SEQ ID NO: 1153681 - RNA, 17 nt, Homo sapiens
aguucugauucauuuga

SEQ ID NO: 1153682 - RNA, 13 nt, Homo sapiens
aguucugccuuau

SEQ ID NO: 1153683 - RNA, 21 nt, Homo sapiens
aguucuguaaaauauacuuaa

SEQ ID NO: 1153684 - RNA, 18 nt, Homo sapiens
aguucuuugggccagaca

SEQ ID NO: 1153685 - RNA, 19 nt, Homo sapiens
aguucuuugggccagacau

SEQ ID NO: 1153686 - RNA, 14 nt, Homo sapiens
aguugauuuuacaa

SEQ ID NO: 1153687 - RNA, 18 nt, Homo sapiens
aguugauuuuacaauuga

SEQ ID NO: 1153688 - RNA, 17 nt, Homo sapiens
aguugcaauugaauuaa

SEQ ID NO: 1153689 - RNA, 23 nt, Homo sapiens
aguugcauugauucaguauuaca

SEQ ID NO: 1153690 - RNA, 20 nt, Homo sapiens
aguugcguggacucugcaca

SEQ ID NO: 1153691 - RNA, 15 nt, Homo sapiens
aguugcuugcuaaua

SEQ ID NO: 1153692 - RNA, 17 nt, Homo sapiens
aguuggggaauugugag

SEQ ID NO: 1153693 - RNA, 22 nt, Homo sapiens
aguuggggcacugggcgucuga

SEQ ID NO: 1153694 - RNA, 11 nt, Homo sapiens
aguugugauug

SEQ ID NO: 1153695 - RNA, 18 nt, Homo sapiens
aguuguggugugccaugc

SEQ ID NO: 1153696 - RNA, 21 nt, Homo sapiens
aguuguuucuacuacauggaa

SEQ ID NO: 1153697 - RNA, 21 nt, Homo sapiens
aguuguuuuaacagaugccaa

SEQ ID NO: 1153698 - RNA, 15 nt, Homo sapiens
aguuuaaaucaagau

SEQ ID NO: 1153699 - RNA, 14 nt, Homo sapiens
aguuuaaaugagac

SEQ ID NO: 1153700 - RNA, 22 nt, Homo sapiens
aguuuaagcaaauaaacuguaa

SEQ ID NO: 1153701 - RNA, 17 nt, Homo sapiens
aguuuaauuaugccuuu

SEQ ID NO: 1153702 - RNA, 21 nt, Homo sapiens
aguuuaauuuuugaaaacugg

SEQ ID NO: 1153703 - RNA, 15 nt, Homo sapiens
aguuuauacuucucu

SEQ ID NO: 1153704 - RNA, 13 nt, Homo sapiens
aguuuauuuacuc

SEQ ID NO: 1153705 - RNA, 19 nt, Homo sapiens
aguuuauuugaaccaauaa

SEQ ID NO: 1153706 - RNA, 20 nt, Homo sapiens
aguuuccaucccaacaugau

SEQ ID NO: 1153707 - RNA, 16 nt, Homo sapiens
aguuucuaagauucua

SEQ ID NO: 1153708 - RNA, 18 nt, Homo sapiens
aguuucucucacauuacu

SEQ ID NO: 1153709 - RNA, 20 nt, Homo sapiens
aguuucugggucuacaagga

SEQ ID NO: 1153710 - RNA, 18 nt, Homo sapiens
aguuugagaccagccuga

SEQ ID NO: 1153711 - RNA, 22 nt, Homo sapiens
aguuugaggcugcaaugagcca

SEQ ID NO: 1153712 - RNA, 17 nt, Homo sapiens
aguuugcuagugacuaa

SEQ ID NO: 1153713 - RNA, 18 nt, Homo sapiens
aguuugucauauacugcu

SEQ ID NO: 1153714 - RNA, 15 nt, Homo sapiens
aguuuguuauguguc

SEQ ID NO: 1153715 - RNA, 18 nt, Homo sapiens
aguuuguuuuuaaacuaa

SEQ ID NO: 1153716 - RNA, 21 nt, Homo sapiens
aguuuuaaagaagucucuuaa

SEQ ID NO: 1153717 - RNA, 17 nt, Homo sapiens
aguuuuaaggacuucau

SEQ ID NO: 1153718 - RNA, 18 nt, Homo sapiens
aguuuuaaggacuucauc

SEQ ID NO: 1153719 - RNA, 19 nt, Homo sapiens
aguuuucuguucagcuuuu

SEQ ID NO: 1153720 - RNA, 15 nt, Homo sapiens
aguuuugacaucagc

SEQ ID NO: 1153721 - RNA, 20 nt, Homo sapiens
aguuuugcccuuuuuaagga

SEQ ID NO: 1153722 - RNA, 12 nt, Homo sapiens
aguuuugcucuu

SEQ ID NO: 1153723 - RNA, 16 nt, Homo sapiens
aguuuuggacuggaua

SEQ ID NO: 1153724 - RNA, 21 nt, Homo sapiens
aguuuuguuuguucacacucc

SEQ ID NO: 1153725 - RNA, 13 nt, Homo sapiens
auaaaaaacaguc

SEQ ID NO: 1153726 - RNA, 16 nt, Homo sapiens
auaaaaaacauauaca

SEQ ID NO: 1153727 - RNA, 23 nt, Homo sapiens
auaaaaaguuucacaggucaaua

SEQ ID NO: 1153728 - RNA, 13 nt, Homo sapiens
auaaaaauacaaa

SEQ ID NO: 1153729 - RNA, 15 nt, Homo sapiens
auaaaaaugagugcu

SEQ ID NO: 1153730 - RNA, 20 nt, Homo sapiens
auaaaaccaagccucuggaa

SEQ ID NO: 1153731 - RNA, 15 nt, Homo sapiens
auaaaacucuuugaa

SEQ ID NO: 1153732 - RNA, 14 nt, Homo sapiens
auaaaagacacucc

SEQ ID NO: 1153733 - RNA, 12 nt, Homo sapiens
auaaaaguuccu

SEQ ID NO: 1153734 - RNA, 20 nt, Homo sapiens
auaaaaucuaauuaauucuu

SEQ ID NO: 1153735 - RNA, 21 nt, Homo sapiens
auaaacaacuaaauaacugua

SEQ ID NO: 1153736 - RNA, 19 nt, Homo sapiens
auaaacaagaucgucagga

SEQ ID NO: 1153737 - RNA, 12 nt, Homo sapiens
auaaacacaaaa

SEQ ID NO: 1153738 - RNA, 13 nt, Homo sapiens
auaaacaccacac

SEQ ID NO: 1153739 - RNA, 17 nt, Homo sapiens
auaaacagucuaaagaa

SEQ ID NO: 1153740 - RNA, 13 nt, Homo sapiens
auaaacaguuuua

SEQ ID NO: 1153741 - RNA, 17 nt, Homo sapiens
auaaaccaagacaagac

SEQ ID NO: 1153742 - RNA, 18 nt, Homo sapiens
auaaaccagguuugcacc

SEQ ID NO: 1153743 - RNA, 19 nt, Homo sapiens
auaaacugcaaaugugcag

SEQ ID NO: 1153744 - RNA, 16 nt, Homo sapiens
auaaacugcagaaagg

SEQ ID NO: 1153745 - RNA, 14 nt, Homo sapiens
auaaacugcagaga

SEQ ID NO: 1153746 - RNA, 16 nt, Homo sapiens
auaaacugugugcaac

SEQ ID NO: 1153747 - RNA, 18 nt, Homo sapiens
auaaacugugugcaacag

SEQ ID NO: 1153748 - RNA, 21 nt, Homo sapiens
auaaacuuuagaguagaguuu

SEQ ID NO: 1153749 - RNA, 15 nt, Homo sapiens
auaaacuuugaauuu

SEQ ID NO: 1153750 - RNA, 19 nt, Homo sapiens
auaaagcagggacugugaa

SEQ ID NO: 1153751 - RNA, 15 nt, Homo sapiens
auaaagggacuugaa

SEQ ID NO: 1153752 - RNA, 14 nt, Homo sapiens
auaaagggugccag

SEQ ID NO: 1153753 - RNA, 15 nt, Homo sapiens
auaaagggugccagg

SEQ ID NO: 1153754 - RNA, 13 nt, Homo sapiens
auaaagucuugcc

SEQ ID NO: 1153755 - RNA, 14 nt, Homo sapiens
auaaagucuugccu

SEQ ID NO: 1153756 - RNA, 13 nt, Homo sapiens
auaaagugacaga

SEQ ID NO: 1153757 - RNA, 21 nt, Homo sapiens
auaaaguugagagacaguaac

SEQ ID NO: 1153758 - RNA, 18 nt, Homo sapiens
auaaaguuuuuuuccaaa

SEQ ID NO: 1153759 - RNA, 20 nt, Homo sapiens
auaaauaaaagaacagccuu

SEQ ID NO: 1153760 - RNA, 15 nt, Homo sapiens
auaaauacgaaacuc

SEQ ID NO: 1153761 - RNA, 14 nt, Homo sapiens
auaaauaugaagcu

SEQ ID NO: 1153762 - RNA, 18 nt, Homo sapiens
auaaauauuuguuugggu

SEQ ID NO: 1153763 - RNA, 18 nt, Homo sapiens
auaaaucauggaauuuau

SEQ ID NO: 1153764 - RNA, 22 nt, Homo sapiens
auaaaucucuucuuugcugcag

SEQ ID NO: 1153765 - RNA, 18 nt, Homo sapiens
auaaaugaagaaagggag

SEQ ID NO: 1153766 - RNA, 22 nt, Homo sapiens
auaaaugacaagcaaagaauga

SEQ ID NO: 1153767 - RNA, 16 nt, Homo sapiens
auaaaugaggucacua

SEQ ID NO: 1153768 - RNA, 18 nt, Homo sapiens
auaaauuccuacaacuua

SEQ ID NO: 1153769 - RNA, 15 nt, Homo sapiens
auaacaaagcccuua

SEQ ID NO: 1153770 - RNA, 14 nt, Homo sapiens
auaaccacagggcu

SEQ ID NO: 1153771 - RNA, 21 nt, Homo sapiens
auaaccaggcugggcucagcu

SEQ ID NO: 1153772 - RNA, 22 nt, Homo sapiens
auaacgguuaagaaagcacuua

SEQ ID NO: 1153773 - RNA, 21 nt, Homo sapiens
auaacuuuaugaagugcuaca

SEQ ID NO: 1153774 - RNA, 20 nt, Homo sapiens
auaacuuuuuaaagugacau

SEQ ID NO: 1153775 - RNA, 18 nt, Homo sapiens
auaagaaagaucaaagac

SEQ ID NO: 1153776 - RNA, 17 nt, Homo sapiens
auaagaacugugcagua

SEQ ID NO: 1153777 - RNA, 19 nt, Homo sapiens
auaagagaaucaacauuuc

SEQ ID NO: 1153778 - RNA, 19 nt, Homo sapiens
auaagaggaguaggcccug

SEQ ID NO: 1153779 - RNA, 15 nt, Homo sapiens
auaagaggauaugaa

SEQ ID NO: 1153780 - RNA, 16 nt, Homo sapiens
auaagauauuguacau

SEQ ID NO: 1153781 - RNA, 17 nt, Homo sapiens
auaagauugaaauucca

SEQ ID NO: 1153782 - RNA, 17 nt, Homo sapiens
auaagcaugacauacuu

SEQ ID NO: 1153783 - RNA, 16 nt, Homo sapiens
auaagccagugagacc

SEQ ID NO: 1153784 - RNA, 20 nt, Homo sapiens
auaagcuauagacccgagga

SEQ ID NO: 1153785 - RNA, 16 nt, Homo sapiens
auaaggaaagcaauaa

SEQ ID NO: 1153786 - RNA, 16 nt, Homo sapiens
auaaguaaagaauuac

SEQ ID NO: 1153787 - RNA, 14 nt, Homo sapiens
auaaguacuacaua

SEQ ID NO: 1153788 - RNA, 21 nt, Homo sapiens
auaagucaugugucccagcau

SEQ ID NO: 1153789 - RNA, 16 nt, Homo sapiens
auaaguuaucuuguuu

SEQ ID NO: 1153790 - RNA, 19 nt, Homo sapiens
auaaguucuaguugcuugu

SEQ ID NO: 1153791 - RNA, 21 nt, Homo sapiens
auaauaaaaauuguagcuuuu

SEQ ID NO: 1153792 - RNA, 13 nt, Homo sapiens
auaauaacuggga

SEQ ID NO: 1153793 - RNA, 17 nt, Homo sapiens
auaauagacacugggga

SEQ ID NO: 1153794 - RNA, 17 nt, Homo sapiens
auaauagagcucagaca

SEQ ID NO: 1153795 - RNA, 20 nt, Homo sapiens
auaauaugaagaccaaauga

SEQ ID NO: 1153796 - RNA, 21 nt, Homo sapiens
auaauccuaaacauaugaauu

SEQ ID NO: 1153797 - RNA, 15 nt, Homo sapiens
auaaucuugcucaca

SEQ ID NO: 1153798 - RNA, 16 nt, Homo sapiens
auaaugaaauaaucag

SEQ ID NO: 1153799 - RNA, 21 nt, Homo sapiens
auaauggacucagcucugucu

SEQ ID NO: 1153800 - RNA, 18 nt, Homo sapiens
auaauggcugaagccaaa

SEQ ID NO: 1153801 - RNA, 17 nt, Homo sapiens
auaauguccaacuaaaa

SEQ ID NO: 1153802 - RNA, 17 nt, Homo sapiens
auaauguuuauaaguca

SEQ ID NO: 1153803 - RNA, 22 nt, Homo sapiens
auaauuaccaauaucuugccag

SEQ ID NO: 1153804 - RNA, 12 nt, Homo sapiens
auaauuccauga

SEQ ID NO: 1153805 - RNA, 14 nt, Homo sapiens
auaauuuacaugca

SEQ ID NO: 1153806 - RNA, 18 nt, Homo sapiens
auaauuuuugugagguau

SEQ ID NO: 1153807 - RNA, 17 nt, Homo sapiens
auacaaaaauacucaga

SEQ ID NO: 1153808 - RNA, 21 nt, Homo sapiens
auacaaacauguuccugggau

SEQ ID NO: 1153809 - RNA, 23 nt, Homo sapiens
auacaauggguaucgcugagacu

SEQ ID NO: 1153810 - RNA, 14 nt, Homo sapiens
auacacaaagggau

SEQ ID NO: 1153811 - RNA, 22 nt, Homo sapiens
auacacaaauauauacguauau

SEQ ID NO: 1153812 - RNA, 12 nt, Homo sapiens
auacacacaaaa

SEQ ID NO: 1153813 - RNA, 15 nt, Homo sapiens
auacacagugcugac

SEQ ID NO: 1153814 - RNA, 16 nt, Homo sapiens
auacacaucucuguca

SEQ ID NO: 1153815 - RNA, 16 nt, Homo sapiens
auacacgucacaaaga

SEQ ID NO: 1153816 - RNA, 20 nt, Homo sapiens
auacacuuuuuaaaaucuca

SEQ ID NO: 1153817 - RNA, 21 nt, Homo sapiens
auacacuuuuuaaaaucucaa

SEQ ID NO: 1153818 - RNA, 23 nt, Homo sapiens
auacaggagacccaacaaugagu

SEQ ID NO: 1153819 - RNA, 21 nt, Homo sapiens
auacagugauauacuuacuca

SEQ ID NO: 1153820 - RNA, 17 nt, Homo sapiens
auacaguguacauguac

SEQ ID NO: 1153821 - RNA, 23 nt, Homo sapiens
auacauaagcggcguaaguuuaa

SEQ ID NO: 1153822 - RNA, 16 nt, Homo sapiens
auacauagcaugacau

SEQ ID NO: 1153823 - RNA, 16 nt, Homo sapiens
auacaucaauauguau

SEQ ID NO: 1153824 - RNA, 14 nt, Homo sapiens
auacaucacuguau

SEQ ID NO: 1153825 - RNA, 21 nt, Homo sapiens
auacaucugagguccugugau

SEQ ID NO: 1153826 - RNA, 19 nt, Homo sapiens
auacaugcuuugaaguuuc

SEQ ID NO: 1153827 - RNA, 13 nt, Homo sapiens
auacauuuacugu

SEQ ID NO: 1153828 - RNA, 18 nt, Homo sapiens
auaccaacugaagucaau

SEQ ID NO: 1153829 - RNA, 17 nt, Homo sapiens
auaccugggauacugug

SEQ ID NO: 1153830 - RNA, 16 nt, Homo sapiens
auaccuguguccgaug

SEQ ID NO: 1153831 - RNA, 23 nt, Homo sapiens
auacgggggcugugacucugggc

SEQ ID NO: 1153832 - RNA, 18 nt, Homo sapiens
auacuaaaaaucaugaga

SEQ ID NO: 1153833 - RNA, 16 nt, Homo sapiens
auacuacuacuguuau

SEQ ID NO: 1153834 - RNA, 15 nt, Homo sapiens
auacuaggugccuuu

SEQ ID NO: 1153835 - RNA, 17 nt, Homo sapiens
auacucuguugccuccu

SEQ ID NO: 1153836 - RNA, 14 nt, Homo sapiens
auacucuucaagga

SEQ ID NO: 1153837 - RNA, 15 nt, Homo sapiens
auacucuucaaggac

SEQ ID NO: 1153838 - RNA, 23 nt, Homo sapiens
auacugcaauaaauuauggcucu

SEQ ID NO: 1153839 - RNA, 21 nt, Homo sapiens
auacuggguucggauugugaa

SEQ ID NO: 1153840 - RNA, 14 nt, Homo sapiens
auacuguaugcagu

SEQ ID NO: 1153841 - RNA, 15 nt, Homo sapiens
auacuguaugcagua

SEQ ID NO: 1153842 - RNA, 21 nt, Homo sapiens
auacugugaaguuacaugcau

SEQ ID NO: 1153843 - RNA, 16 nt, Homo sapiens
auacugugugcuaaaa

SEQ ID NO: 1153844 - RNA, 23 nt, Homo sapiens
auacuuccaucuggcugccuuug

SEQ ID NO: 1153845 - RNA, 16 nt, Homo sapiens
auacuugaacacugug

SEQ ID NO: 1153846 - RNA, 17 nt, Homo sapiens
auacuugaagggccaga

SEQ ID NO: 1153847 - RNA, 14 nt, Homo sapiens
auagaaaaaccaaa

SEQ ID NO: 1153848 - RNA, 14 nt, Homo sapiens
auagaaacaccagu

SEQ ID NO: 1153849 - RNA, 22 nt, Homo sapiens
auagaaacacuuucucacuuac

SEQ ID NO: 1153850 - RNA, 20 nt, Homo sapiens
auagagagguacacauuuau

SEQ ID NO: 1153851 - RNA, 20 nt, Homo sapiens
auagagcagauucaguguua

SEQ ID NO: 1153852 - RNA, 23 nt, Homo sapiens
auagagcuguucaacaucacuga

SEQ ID NO: 1153853 - RNA, 15 nt, Homo sapiens
auagaugcuguguau

SEQ ID NO: 1153854 - RNA, 20 nt, Homo sapiens
auagaugucuagguacuuca

SEQ ID NO: 1153855 - RNA, 18 nt, Homo sapiens
auagauuuccugugagua

SEQ ID NO: 1153856 - RNA, 15 nt, Homo sapiens
auagauuuuuucaga

SEQ ID NO: 1153857 - RNA, 18 nt, Homo sapiens
auagcaagaccucaucuc

SEQ ID NO: 1153858 - RNA, 15 nt, Homo sapiens
auagcaagaucccau

SEQ ID NO: 1153859 - RNA, 12 nt, Homo sapiens
auagcaagugaa

SEQ ID NO: 1153860 - RNA, 15 nt, Homo sapiens
auagcaagugcuauu

SEQ ID NO: 1153861 - RNA, 19 nt, Homo sapiens
auagcaauaucauaauuaa

SEQ ID NO: 1153862 - RNA, 15 nt, Homo sapiens
auagcaaugugauuu

SEQ ID NO: 1153863 - RNA, 20 nt, Homo sapiens
auagcaguccccagugauuu

SEQ ID NO: 1153864 - RNA, 18 nt, Homo sapiens
auagcgagaagaugcucu

SEQ ID NO: 1153865 - RNA, 22 nt, Homo sapiens
auagcgauauuuaucucuuccu

SEQ ID NO: 1153866 - RNA, 18 nt, Homo sapiens
auagcucuguaguggaau

SEQ ID NO: 1153867 - RNA, 19 nt, Homo sapiens
auagcucuguaguggaaua

SEQ ID NO: 1153868 - RNA, 17 nt, Homo sapiens
auagcucuucacuuccu

SEQ ID NO: 1153869 - RNA, 18 nt, Homo sapiens
auaggacuaaguucucau

SEQ ID NO: 1153870 - RNA, 20 nt, Homo sapiens
auaggacucaaaguuucaga

SEQ ID NO: 1153871 - RNA, 17 nt, Homo sapiens
auaggcacaugcaucuu

SEQ ID NO: 1153872 - RNA, 19 nt, Homo sapiens
auagggagcagaugcaaug

SEQ ID NO: 1153873 - RNA, 13 nt, Homo sapiens
auagggguugagu

SEQ ID NO: 1153874 - RNA, 21 nt, Homo sapiens
auagguguugguuuugggggu

SEQ ID NO: 1153875 - RNA, 15 nt, Homo sapiens
auaguaaacacaggg

SEQ ID NO: 1153876 - RNA, 16 nt, Homo sapiens
auaguaaacacaggga

SEQ ID NO: 1153877 - RNA, 17 nt, Homo sapiens
auaguaacaucaaagau

SEQ ID NO: 1153878 - RNA, 13 nt, Homo sapiens
auaguacuaguuu

SEQ ID NO: 1153879 - RNA, 20 nt, Homo sapiens
auaguauucaugacuaugga

SEQ ID NO: 1153880 - RNA, 14 nt, Homo sapiens
auagucuuugccag

SEQ ID NO: 1153881 - RNA, 19 nt, Homo sapiens
auagugaauggucucucuu

SEQ ID NO: 1153882 - RNA, 21 nt, Homo sapiens
auagugcaaggaaugacucau

SEQ ID NO: 1153883 - RNA, 20 nt, Homo sapiens
auagugggcaccccacugca

SEQ ID NO: 1153884 - RNA, 21 nt, Homo sapiens
auagugggcaccccacugcaa

SEQ ID NO: 1153885 - RNA, 19 nt, Homo sapiens
auagugguaugacauugga

SEQ ID NO: 1153886 - RNA, 15 nt, Homo sapiens
auaguuaugccugua

SEQ ID NO: 1153887 - RNA, 17 nt, Homo sapiens
auaguuauuuacuugaa

SEQ ID NO: 1153888 - RNA, 18 nt, Homo sapiens
auaguuauuuacuugaaa

SEQ ID NO: 1153889 - RNA, 21 nt, Homo sapiens
auaguugcugucauccacuuu

SEQ ID NO: 1153890 - RNA, 20 nt, Homo sapiens
auaguuggggaauugugaga

SEQ ID NO: 1153891 - RNA, 16 nt, Homo sapiens
auauaaacacaaauau

SEQ ID NO: 1153892 - RNA, 13 nt, Homo sapiens
auauaaacuuuau

SEQ ID NO: 1153893 - RNA, 13 nt, Homo sapiens
auauaaaugccaa

SEQ ID NO: 1153894 - RNA, 21 nt, Homo sapiens
auauaaaugugauugcagcuu

SEQ ID NO: 1153895 - RNA, 15 nt, Homo sapiens
auauaacaaguauaa

SEQ ID NO: 1153896 - RNA, 16 nt, Homo sapiens
auauaagcccaauauc

SEQ ID NO: 1153897 - RNA, 18 nt, Homo sapiens
auauaaguuugaaggaaa

SEQ ID NO: 1153898 - RNA, 13 nt, Homo sapiens
auauaauaucaua

SEQ ID NO: 1153899 - RNA, 13 nt, Homo sapiens
auauaaucaagaa

SEQ ID NO: 1153900 - RNA, 15 nt, Homo sapiens
auauacaagcuacag

SEQ ID NO: 1153901 - RNA, 22 nt, Homo sapiens
auauacugcuugucaucugcau

SEQ ID NO: 1153902 - RNA, 19 nt, Homo sapiens
auauacuugguucucucca

SEQ ID NO: 1153903 - RNA, 20 nt, Homo sapiens
auauacuugguucucuccac

SEQ ID NO: 1153904 - RNA, 22 nt, Homo sapiens
auauagcucuacacaacaugua

SEQ ID NO: 1153905 - RNA, 22 nt, Homo sapiens
auauauacguauguauauacac

SEQ ID NO: 1153906 - RNA, 13 nt, Homo sapiens
auauauauauaca

SEQ ID NO: 1153907 - RNA, 12 nt, Homo sapiens
auauauaugcac

SEQ ID NO: 1153908 - RNA, 13 nt, Homo sapiens
auauauucacuuu

SEQ ID NO: 1153909 - RNA, 15 nt, Homo sapiens
auauauuccaccagg

SEQ ID NO: 1153910 - RNA, 12 nt, Homo sapiens
auauauucccaa

SEQ ID NO: 1153911 - RNA, 15 nt, Homo sapiens
auauauuucccugaa

SEQ ID NO: 1153912 - RNA, 15 nt, Homo sapiens
auaucacaucagugg

SEQ ID NO: 1153913 - RNA, 14 nt, Homo sapiens
auguuauaucauau

SEQ ID NO: 1153914 - RNA, 16 nt, Homo sapiens
auguucacuuccaaga

SEQ ID NO: 1153915 - RNA, 18 nt, Homo sapiens
auguucagacauuuaugu

SEQ ID NO: 1153916 - RNA, 14 nt, Homo sapiens
auguucauuuguac

SEQ ID NO: 1153917 - RNA, 17 nt, Homo sapiens
auguuccgagaagaaca

SEQ ID NO: 1153918 - RNA, 16 nt, Homo sapiens
auguucuaaguuucua

SEQ ID NO: 1153919 - RNA, 13 nt, Homo sapiens
auguucugcuuuc

SEQ ID NO: 1153920 - RNA, 18 nt, Homo sapiens
auguucugugggggucau

SEQ ID NO: 1153921 - RNA, 16 nt, Homo sapiens
auguugaccaugucua

SEQ ID NO: 1153922 - RNA, 15 nt, Homo sapiens
auguugaucauguac

SEQ ID NO: 1153923 - RNA, 18 nt, Homo sapiens
auguugcauguaugugua

SEQ ID NO: 1153924 - RNA, 15 nt, Homo sapiens
auguugguguuccac

SEQ ID NO: 1153925 - RNA, 21 nt, Homo sapiens
auguuuauaaaucuuaugcuc

SEQ ID NO: 1153926 - RNA, 17 nt, Homo sapiens
auguuuauagcauuccu

SEQ ID NO: 1153927 - RNA, 19 nt, Homo sapiens
auguuuauguucuuauaga

SEQ ID NO: 1153928 - RNA, 19 nt, Homo sapiens
auguuucgcugauauaugu

SEQ ID NO: 1153929 - RNA, 23 nt, Homo sapiens
auguuucgugaaguauacuguau

SEQ ID NO: 1153930 - RNA, 15 nt, Homo sapiens
auguuugcugaguga

SEQ ID NO: 1153931 - RNA, 20 nt, Homo sapiens
auguuuggguauugugugag

SEQ ID NO: 1153932 - RNA, 14 nt, Homo sapiens
auguuuuaacuuau

SEQ ID NO: 1153933 - RNA, 21 nt, Homo sapiens
auguuuuagccauuguuggcu

SEQ ID NO: 1153934 - RNA, 22 nt, Homo sapiens
auguuuucucuggaguauucua

SEQ ID NO: 1153935 - RNA, 14 nt, Homo sapiens
auguuuuugccaaa

SEQ ID NO: 1153936 - RNA, 16 nt, Homo sapiens
auguuuuuucugcaau

SEQ ID NO: 1153937 - RNA, 18 nt, Homo sapiens
auguuuuuucugcaauga

SEQ ID NO: 1153938 - RNA, 13 nt, Homo sapiens
auuaaaacacuua

SEQ ID NO: 1153939 - RNA, 22 nt, Homo sapiens
auuaaaagaacauaaguuauca

SEQ ID NO: 1153940 - RNA, 18 nt, Homo sapiens
auuaaacucuccuuugau

SEQ ID NO: 1153941 - RNA, 13 nt, Homo sapiens
auuaaacuuauga

SEQ ID NO: 1153942 - RNA, 17 nt, Homo sapiens
auuaaacuuaugaaugu

SEQ ID NO: 1153943 - RNA, 12 nt, Homo sapiens
auuaaagcaauc

SEQ ID NO: 1153944 - RNA, 13 nt, Homo sapiens
auuaaagccucau

SEQ ID NO: 1153945 - RNA, 14 nt, Homo sapiens
auuaaauaaucucu

SEQ ID NO: 1153946 - RNA, 15 nt, Homo sapiens
auuaaauauauacug

SEQ ID NO: 1153947 - RNA, 13 nt, Homo sapiens
auuaaauuaggaa

SEQ ID NO: 1153948 - RNA, 17 nt, Homo sapiens
auuaacaaaugugcugc

SEQ ID NO: 1153949 - RNA, 12 nt, Homo sapiens
auuaaccaucuu

SEQ ID NO: 1153950 - RNA, 18 nt, Homo sapiens
auuaaccaucuuuaauca

SEQ ID NO: 1153951 - RNA, 16 nt, Homo sapiens
auuaaccgaugcuuua

SEQ ID NO: 1153952 - RNA, 12 nt, Homo sapiens
auuaacugguga

SEQ ID NO: 1153953 - RNA, 16 nt, Homo sapiens
auuaacuuacuuccaa

SEQ ID NO: 1153954 - RNA, 21 nt, Homo sapiens
auuaaggauguagcuuuucac

SEQ ID NO: 1153955 - RNA, 13 nt, Homo sapiens
auuaaggucauua

SEQ ID NO: 1153956 - RNA, 20 nt, Homo sapiens
auuaaggucauuacucucaa

SEQ ID NO: 1153957 - RNA, 23 nt, Homo sapiens
auuaaggucauuacucucaacca

SEQ ID NO: 1153958 - RNA, 22 nt, Homo sapiens
auuaagucccuuuuaguuugau

SEQ ID NO: 1153959 - RNA, 23 nt, Homo sapiens
auuaauaacgucuuuuuauaucu

SEQ ID NO: 1153960 - RNA, 18 nt, Homo sapiens
auuaauagcuuuugauua

SEQ ID NO: 1153961 - RNA, 18 nt, Homo sapiens
auuaauaguucaguguau

SEQ ID NO: 1153962 - RNA, 15 nt, Homo sapiens
auuaauauaagccca

SEQ ID NO: 1153963 - RNA, 18 nt, Homo sapiens
auuaaugaaaagcagauu

SEQ ID NO: 1153964 - RNA, 23 nt, Homo sapiens
auuaaugcuauacuggaaaugua

SEQ ID NO: 1153965 - RNA, 21 nt, Homo sapiens
auuaauuacuucacuauacaa

SEQ ID NO: 1153966 - RNA, 23 nt, Homo sapiens
auuacaaaugguuaccuuguuau

SEQ ID NO: 1153967 - RNA, 23 nt, Homo sapiens
auuacaaauuuucacugcugcuc

SEQ ID NO: 1153968 - RNA, 19 nt, Homo sapiens
auuacagaaacugaugcca

SEQ ID NO: 1153969 - RNA, 18 nt, Homo sapiens
auuacaggcgugagccac

SEQ ID NO: 1153970 - RNA, 15 nt, Homo sapiens
auuacaggugugcac

SEQ ID NO: 1153971 - RNA, 17 nt, Homo sapiens
auuacaggugugcacca

SEQ ID NO: 1153972 - RNA, 18 nt, Homo sapiens
auuacauaaucuguacaa

SEQ ID NO: 1153973 - RNA, 22 nt, Homo sapiens
auuacauaaucuguacaaugaa

SEQ ID NO: 1153974 - RNA, 12 nt, Homo sapiens
auuacauuuuaa

SEQ ID NO: 1153975 - RNA, 13 nt, Homo sapiens
auuaccaaaacaa

SEQ ID NO: 1153976 - RNA, 16 nt, Homo sapiens
auuacggggugaccuu

SEQ ID NO: 1153977 - RNA, 23 nt, Homo sapiens
auuacgguguacaguuuaacaga

SEQ ID NO: 1153978 - RNA, 17 nt, Homo sapiens
auuacuauaagaacuuu

SEQ ID NO: 1153979 - RNA, 23 nt, Homo sapiens
auuacugagguuuuuaacaugua

SEQ ID NO: 1153980 - RNA, 15 nt, Homo sapiens
auuacuuguguuacu

SEQ ID NO: 1153981 - RNA, 16 nt, Homo sapiens
auuacuuguguuacuu

SEQ ID NO: 1153982 - RNA, 18 nt, Homo sapiens
auuagaaacaacauagca

SEQ ID NO: 1153983 - RNA, 19 nt, Homo sapiens
auuagaaacaacauagcaa

SEQ ID NO: 1153984 - RNA, 14 nt, Homo sapiens
auuagaaauaucuu

SEQ ID NO: 1153985 - RNA, 14 nt, Homo sapiens
auuagaacuucaag

SEQ ID NO: 1153986 - RNA, 18 nt, Homo sapiens
auuagaacuucaagcucu

SEQ ID NO: 1153987 - RNA, 22 nt, Homo sapiens
auuagaacuucaagcucuccaa

SEQ ID NO: 1153988 - RNA, 16 nt, Homo sapiens
auuagaaucugaguau

SEQ ID NO: 1153989 - RNA, 13 nt, Homo sapiens
auuagacccuuaa

SEQ ID NO: 1153990 - RNA, 22 nt, Homo sapiens
auuagacuggaacuugaacuga

SEQ ID NO: 1153991 - RNA, 23 nt, Homo sapiens
auuagccaggugugguggugcac

SEQ ID NO: 1153992 - RNA, 18 nt, Homo sapiens
auuagcugggcauggugc

SEQ ID NO: 1153993 - RNA, 15 nt, Homo sapiens
auuaggagacacagg

SEQ ID NO: 1153994 - RNA, 17 nt, Homo sapiens
auuaggagacacaggga

SEQ ID NO: 1153995 - RNA, 19 nt, Homo sapiens
auuaggagacacagggaag

SEQ ID NO: 1153996 - RNA, 13 nt, Homo sapiens
auuaggugcaauu

SEQ ID NO: 1153997 - RNA, 15 nt, Homo sapiens
auuaguaacugcaca

SEQ ID NO: 1153998 - RNA, 12 nt, Homo sapiens
auuaguuuacau

SEQ ID NO: 1153999 - RNA, 16 nt, Homo sapiens
auuauaaaaguuccua

SEQ ID NO: 1154000 - RNA, 14 nt, Homo sapiens
auuauagcacaaaa

SEQ ID NO: 1154001 - RNA, 15 nt, Homo sapiens
auuauauaaggacag

SEQ ID NO: 1154002 - RNA, 14 nt, Homo sapiens
auuaucaagcuuuu

SEQ ID NO: 1154003 - RNA, 15 nt, Homo sapiens
auuaucagaugcuuu

SEQ ID NO: 1154004 - RNA, 13 nt, Homo sapiens
auuaucaugcaaa

SEQ ID NO: 1154005 - RNA, 14 nt, Homo sapiens
auuauccacaugaa

SEQ ID NO: 1154006 - RNA, 16 nt, Homo sapiens
auuauccuucuacuug

SEQ ID NO: 1154007 - RNA, 17 nt, Homo sapiens
auuauccuucuacuugu

SEQ ID NO: 1154008 - RNA, 20 nt, Homo sapiens
auuaucuaaaguaugaagca

SEQ ID NO: 1154009 - RNA, 16 nt, Homo sapiens
auuaucuuauaaucuu

SEQ ID NO: 1154010 - RNA, 18 nt, Homo sapiens
auuauguccacuguguau

SEQ ID NO: 1154011 - RNA, 17 nt, Homo sapiens
auuauguuuugugauuc

SEQ ID NO: 1154012 - RNA, 20 nt, Homo sapiens
auuauuaaugaaaauaagaa

SEQ ID NO: 1154013 - RNA, 17 nt, Homo sapiens
auuauuguagucuugca

SEQ ID NO: 1154014 - RNA, 18 nt, Homo sapiens
auuauuuuucacugcccc

SEQ ID NO: 1154015 - RNA, 19 nt, Homo sapiens
auuauuuuucacugcccca

SEQ ID NO: 1154016 - RNA, 15 nt, Homo sapiens
auucaaagcacuguu

SEQ ID NO: 1154017 - RNA, 15 nt, Homo sapiens
auucaagaaugccag

SEQ ID NO: 1154018 - RNA, 21 nt, Homo sapiens
auucaaggagaauaugauaaa

SEQ ID NO: 1154019 - RNA, 22 nt, Homo sapiens
auucaaggagaggggaccaugc

SEQ ID NO: 1154020 - RNA, 12 nt, Homo sapiens
auucaaggggag

SEQ ID NO: 1154021 - RNA, 14 nt, Homo sapiens
auucaaggggagcc

SEQ ID NO: 1154022 - RNA, 17 nt, Homo sapiens
auucaagugagccagga

SEQ ID NO: 1154023 - RNA, 15 nt, Homo sapiens
auucaaguuuaguuu

SEQ ID NO: 1154024 - RNA, 21 nt, Homo sapiens
auucacacugggccaagagca

SEQ ID NO: 1154025 - RNA, 19 nt, Homo sapiens
auucacagccccuggccca

SEQ ID NO: 1154026 - RNA, 14 nt, Homo sapiens
auucaccaucaugu

SEQ ID NO: 1154027 - RNA, 16 nt, Homo sapiens
auucaccuucacuuag

SEQ ID NO: 1154028 - RNA, 17 nt, Homo sapiens
auucagcacacugugaa

SEQ ID NO: 1154029 - RNA, 17 nt, Homo sapiens
auucagcggcagugugu

SEQ ID NO: 1154030 - RNA, 16 nt, Homo sapiens
auucaggcacugagaa

SEQ ID NO: 1154031 - RNA, 14 nt, Homo sapiens
auucaggcuuugga

SEQ ID NO: 1154032 - RNA, 18 nt, Homo sapiens
auucaggggcugacacuu

SEQ ID NO: 1154033 - RNA, 16 nt, Homo sapiens
auucagguauguugcc

SEQ ID NO: 1154034 - RNA, 21 nt, Homo sapiens
auucaguaugauuuauccuca

SEQ ID NO: 1154035 - RNA, 23 nt, Homo sapiens
auucagugcuguacuugaugaca

SEQ ID NO: 1154036 - RNA, 19 nt, Homo sapiens
auucauaaagauucaccua

SEQ ID NO: 1154037 - RNA, 15 nt, Homo sapiens
auucaucauccagga

SEQ ID NO: 1154038 - RNA, 15 nt, Homo sapiens
auucauguggaauau

SEQ ID NO: 1154039 - RNA, 21 nt, Homo sapiens
auuccaaacucuccagccacu

SEQ ID NO: 1154040 - RNA, 17 nt, Homo sapiens
auuccaaauggugugaa

SEQ ID NO: 1154041 - RNA, 21 nt, Homo sapiens
auuccaauuguccaccccuuu

SEQ ID NO: 1154042 - RNA, 23 nt, Homo sapiens
auuccaccccagcaggacaguga

SEQ ID NO: 1154043 - RNA, 15 nt, Homo sapiens
auuccaucacaucac

SEQ ID NO: 1154044 - RNA, 16 nt, Homo sapiens
auuccaucagcacaaa

SEQ ID NO: 1154045 - RNA, 13 nt, Homo sapiens
auuccauccugug

SEQ ID NO: 1154046 - RNA, 18 nt, Homo sapiens
auucccaagcuuuuggag

SEQ ID NO: 1154047 - RNA, 20 nt, Homo sapiens
auucccacucagcacucaga

SEQ ID NO: 1154048 - RNA, 17 nt, Homo sapiens
auucccacuuucauuca

SEQ ID NO: 1154049 - RNA, 19 nt, Homo sapiens
auucccaucuacuaaaaaa

SEQ ID NO: 1154050 - RNA, 16 nt, Homo sapiens
auucccuccugcuacu

SEQ ID NO: 1154051 - RNA, 20 nt, Homo sapiens
auuccggauccuaagcaucu

SEQ ID NO: 1154052 - RNA, 18 nt, Homo sapiens
auuccggugccuccugaa

SEQ ID NO: 1154053 - RNA, 16 nt, Homo sapiens
auuccuacaaguuuaa

SEQ ID NO: 1154054 - RNA, 15 nt, Homo sapiens
auuccucuacagauu

SEQ ID NO: 1154055 - RNA, 16 nt, Homo sapiens
auuccuuagaaauuag

SEQ ID NO: 1154056 - RNA, 14 nt, Homo sapiens
auuccuugauucac

SEQ ID NO: 1154057 - RNA, 14 nt, Homo sapiens
auuccuugcacaua

SEQ ID NO: 1154058 - RNA, 19 nt, Homo sapiens
auuccuuuuucuucacuua

SEQ ID NO: 1154059 - RNA, 16 nt, Homo sapiens
auucgacuucuuucca

SEQ ID NO: 1154060 - RNA, 15 nt, Homo sapiens
auucggccucuccac

SEQ ID NO: 1154061 - RNA, 19 nt, Homo sapiens
auucguucuacaacaugau

SEQ ID NO: 1154062 - RNA, 19 nt, Homo sapiens
auucguuuuuucauuugaa

SEQ ID NO: 1154063 - RNA, 14 nt, Homo sapiens
auucuaagucacag

SEQ ID NO: 1154064 - RNA, 17 nt, Homo sapiens
auucuaagucacaggau

SEQ ID NO: 1154065 - RNA, 21 nt, Homo sapiens
auucuaaucccaacaagcaag

SEQ ID NO: 1154066 - RNA, 13 nt, Homo sapiens
auucuacacacag

SEQ ID NO: 1154067 - RNA, 17 nt, Homo sapiens
auucuacguaucugcua

SEQ ID NO: 1154068 - RNA, 19 nt, Homo sapiens
auucuacuugcuuauuaca

SEQ ID NO: 1154069 - RNA, 14 nt, Homo sapiens
auucuaguacauaa

SEQ ID NO: 1154070 - RNA, 18 nt, Homo sapiens
auucuaguacauaauuga

SEQ ID NO: 1154071 - RNA, 19 nt, Homo sapiens
auucuauuuauauguacau

SEQ ID NO: 1154072 - RNA, 16 nt, Homo sapiens
auucucaaaauuccua

SEQ ID NO: 1154073 - RNA, 12 nt, Homo sapiens
auucucaggaug

SEQ ID NO: 1154074 - RNA, 18 nt, Homo sapiens
auucugagccacacugaa

SEQ ID NO: 1154075 - RNA, 21 nt, Homo sapiens
auucugaguaacaucagcagg

SEQ ID NO: 1154076 - RNA, 17 nt, Homo sapiens
auucugauggauucaau

SEQ ID NO: 1154077 - RNA, 22 nt, Homo sapiens
auucugcucagauagaaugaca

SEQ ID NO: 1154078 - RNA, 14 nt, Homo sapiens
auucugucauuuca

SEQ ID NO: 1154079 - RNA, 16 nt, Homo sapiens
auucuguucuacuuga

SEQ ID NO: 1154080 - RNA, 15 nt, Homo sapiens
auucuguuguguuca

SEQ ID NO: 1154081 - RNA, 16 nt, Homo sapiens
auucuguuucaggcaa

SEQ ID NO: 1154082 - RNA, 15 nt, Homo sapiens
auucuuguaguuuac

SEQ ID NO: 1154083 - RNA, 20 nt, Homo sapiens
auucuuuaaauuucaucuca

SEQ ID NO: 1154084 - RNA, 13 nt, Homo sapiens
auucuuucccaac

SEQ ID NO: 1154085 - RNA, 17 nt, Homo sapiens
auucuuucccaacaccu

SEQ ID NO: 1154086 - RNA, 16 nt, Homo sapiens
auugaaagaaccagag

SEQ ID NO: 1154087 - RNA, 21 nt, Homo sapiens
auugaaaggcauucucugaag

SEQ ID NO: 1154088 - RNA, 15 nt, Homo sapiens
auugaaaugcagauu

SEQ ID NO: 1154089 - RNA, 18 nt, Homo sapiens
auugaaauuuacugugag

SEQ ID NO: 1154090 - RNA, 14 nt, Homo sapiens
auugaacauucuag

SEQ ID NO: 1154091 - RNA, 12 nt, Homo sapiens
auugaacuuucc

SEQ ID NO: 1154092 - RNA, 13 nt, Homo sapiens
auugaacuuuccc

SEQ ID NO: 1154093 - RNA, 17 nt, Homo sapiens
auugaauaacaguaguc

SEQ ID NO: 1154094 - RNA, 16 nt, Homo sapiens
auugacauuauagaca

SEQ ID NO: 1154095 - RNA, 15 nt, Homo sapiens
auugacgaacuggcu

SEQ ID NO: 1154096 - RNA, 22 nt, Homo sapiens
auugacgaacuggcuacaguac

SEQ ID NO: 1154097 - RNA, 14 nt, Homo sapiens
auugacgacuucac

SEQ ID NO: 1154098 - RNA, 22 nt, Homo sapiens
auugacgacuucacacuaugga

SEQ ID NO: 1154099 - RNA, 18 nt, Homo sapiens
auugacucuguggcuuug

SEQ ID NO: 1154100 - RNA, 12 nt, Homo sapiens
auugacuuuguc

SEQ ID NO: 1154101 - RNA, 19 nt, Homo sapiens
auugagaaagaaacuaaua

SEQ ID NO: 1154102 - RNA, 14 nt, Homo sapiens
auugagagugauuc

SEQ ID NO: 1154103 - RNA, 19 nt, Homo sapiens
auugagauguaagucucaa

SEQ ID NO: 1154104 - RNA, 18 nt, Homo sapiens
auugagccaguggugcua

SEQ ID NO: 1154105 - RNA, 14 nt, Homo sapiens
auugagcugagauc

SEQ ID NO: 1154106 - RNA, 16 nt, Homo sapiens
auugaguuuucagugg

SEQ ID NO: 1154107 - RNA, 15 nt, Homo sapiens
auugauucauguuca

SEQ ID NO: 1154108 - RNA, 18 nt, Homo sapiens
auugcagaaauacaguau

SEQ ID NO: 1154109 - RNA, 21 nt, Homo sapiens
auugccaggaauguuucagcu

SEQ ID NO: 1154110 - RNA, 20 nt, Homo sapiens
auugccugaaacccauuuac

SEQ ID NO: 1154111 - RNA, 21 nt, Homo sapiens
auugcuccauuuucuugucaa

SEQ ID NO: 1154112 - RNA, 22 nt, Homo sapiens
auugcucccuaccagcugaaca

SEQ ID NO: 1154113 - RNA, 19 nt, Homo sapiens
auugcugcaccaaugcacu

SEQ ID NO: 1154114 - RNA, 21 nt, Homo sapiens
auugcugcaccaaugcacuga

SEQ ID NO: 1154115 - RNA, 17 nt, Homo sapiens
auugcuggaaaccaagu

SEQ ID NO: 1154116 - RNA, 13 nt, Homo sapiens
auugcuguuucag

SEQ ID NO: 1154117 - RNA, 17 nt, Homo sapiens
auugcuuauaacaagca

SEQ ID NO: 1154118 - RNA, 14 nt, Homo sapiens
auugcuugagcuca

SEQ ID NO: 1154119 - RNA, 15 nt, Homo sapiens
auugcuugagcucag

SEQ ID NO: 1154120 - RNA, 18 nt, Homo sapiens
auugcuuuauccaaaagu

SEQ ID NO: 1154121 - RNA, 16 nt, Homo sapiens
auuggacagauuucag

SEQ ID NO: 1154122 - RNA, 22 nt, Homo sapiens
auuggagaugcaaauagcaaaa

SEQ ID NO: 1154123 - RNA, 24 nt, Homo sapiens
auuggagugcagcuaacaugagua

SEQ ID NO: 1154124 - RNA, 20 nt, Homo sapiens
auuggcaccuaauccaggca

SEQ ID NO: 1154125 - RNA, 21 nt, Homo sapiens
auuggguaucaagacauagca

SEQ ID NO: 1154126 - RNA, 22 nt, Homo sapiens
auugguccagcuugcucuucag

SEQ ID NO: 1154127 - RNA, 16 nt, Homo sapiens
auugguguuauguuua

SEQ ID NO: 1154128 - RNA, 18 nt, Homo sapiens
auuguaaaguagcuguaa

SEQ ID NO: 1154129 - RNA, 20 nt, Homo sapiens
auuguaucaaaugugacauu

SEQ ID NO: 1154130 - RNA, 13 nt, Homo sapiens
auuguaugguggg

SEQ ID NO: 1154131 - RNA, 14 nt, Homo sapiens
auugucacaucuau

SEQ ID NO: 1154132 - RNA, 20 nt, Homo sapiens
auugucagcucaaugaccug

SEQ ID NO: 1154133 - RNA, 18 nt, Homo sapiens
auuguccccuaaaccaaa

SEQ ID NO: 1154134 - RNA, 21 nt, Homo sapiens
auuguccccuaaaccaaaaac

SEQ ID NO: 1154135 - RNA, 15 nt, Homo sapiens
auugucccucugccc

SEQ ID NO: 1154136 - RNA, 17 nt, Homo sapiens
auugugagaaauuccac

SEQ ID NO: 1154137 - RNA, 14 nt, Homo sapiens
auugugagcacuga

SEQ ID NO: 1154138 - RNA, 17 nt, Homo sapiens
auugugauauuugacag

SEQ ID NO: 1154139 - RNA, 13 nt, Homo sapiens
auuguggagccaa

SEQ ID NO: 1154140 - RNA, 21 nt, Homo sapiens
auugugugcgcugccuggcca

SEQ ID NO: 1154141 - RNA, 19 nt, Homo sapiens
auuguuagaaaucccuguc

SEQ ID NO: 1154142 - RNA, 18 nt, Homo sapiens
auuguuauuuucagugau

SEQ ID NO: 1154143 - RNA, 18 nt, Homo sapiens
auuguucuuguaagcuuu

SEQ ID NO: 1154144 - RNA, 16 nt, Homo sapiens
auuguuugaaacaaag

SEQ ID NO: 1154145 - RNA, 20 nt, Homo sapiens
auuuaaaaaaaaaagaggaa

SEQ ID NO: 1154146 - RNA, 18 nt, Homo sapiens
auuuaaaaauaaauacca

SEQ ID NO: 1154147 - RNA, 15 nt, Homo sapiens
auuuaaaacauguaa

SEQ ID NO: 1154148 - RNA, 13 nt, Homo sapiens
auuuaaaagacua

SEQ ID NO: 1154149 - RNA, 21 nt, Homo sapiens
auuuaaaguuguuugugccuu

SEQ ID NO: 1154150 - RNA, 14 nt, Homo sapiens
auuuaacuauucau

SEQ ID NO: 1154151 - RNA, 13 nt, Homo sapiens
auuuaagucuguc

SEQ ID NO: 1154152 - RNA, 21 nt, Homo sapiens
auuuaagucuguccauuaucu

SEQ ID NO: 1154153 - RNA, 16 nt, Homo sapiens
auuuaauaguguuaau

SEQ ID NO: 1154154 - RNA, 13 nt, Homo sapiens
auuuaauuccuuc

SEQ ID NO: 1154155 - RNA, 13 nt, Homo sapiens
auuuaauucuuaa

SEQ ID NO: 1154156 - RNA, 20 nt, Homo sapiens
auuuacagcccucagcaaug

SEQ ID NO: 1154157 - RNA, 14 nt, Homo sapiens
auuuacauauagcu

SEQ ID NO: 1154158 - RNA, 13 nt, Homo sapiens
auuuacaucccag

SEQ ID NO: 1154159 - RNA, 16 nt, Homo sapiens
auuuacaucccagaca

SEQ ID NO: 1154160 - RNA, 19 nt, Homo sapiens
auuuaccagcaacuugaac

SEQ ID NO: 1154161 - RNA, 16 nt, Homo sapiens
auuuaccucuuaccug

SEQ ID NO: 1154162 - RNA, 14 nt, Homo sapiens
auuuacucacuuca

SEQ ID NO: 1154163 - RNA, 15 nt, Homo sapiens
auuuacucuguugaa

SEQ ID NO: 1154164 - RNA, 17 nt, Homo sapiens
auuuacuggugcagaug

SEQ ID NO: 1154165 - RNA, 19 nt, Homo sapiens
auuuacuugaaauguaaaa

SEQ ID NO: 1154166 - RNA, 19 nt, Homo sapiens
auuuacuuuucaagcuaua

SEQ ID NO: 1154167 - RNA, 22 nt, Homo sapiens
auuuagaaaauagagcuuuuaa

SEQ ID NO: 1154168 - RNA, 21 nt, Homo sapiens
auuuagaccccauacaaguuu

SEQ ID NO: 1154169 - RNA, 23 nt, Homo sapiens
auuuagaccccauacaaguuuau

SEQ ID NO: 1154170 - RNA, 16 nt, Homo sapiens
auuuagauuuaucacu

SEQ ID NO: 1154171 - RNA, 17 nt, Homo sapiens
auuuagcuggccauuca

SEQ ID NO: 1154172 - RNA, 23 nt, Homo sapiens
auuuaggauaaccuugugccuug

SEQ ID NO: 1154173 - RNA, 23 nt, Homo sapiens
auuuauauaaaauguuuaaucuc

SEQ ID NO: 1154174 - RNA, 14 nt, Homo sapiens
auuuauauguacug

SEQ ID NO: 1154175 - RNA, 23 nt, Homo sapiens
auuuauccaaaauguguauuucu

SEQ ID NO: 1154176 - RNA, 19 nt, Homo sapiens
auuuaugacagugaacauu

SEQ ID NO: 1154177 - RNA, 20 nt, Homo sapiens
auuuaugauuucaacaugga

SEQ ID NO: 1154178 - RNA, 13 nt, Homo sapiens
auuuaugucucag

SEQ ID NO: 1154179 - RNA, 23 nt, Homo sapiens
auuuauguuuuuucugauuccau

SEQ ID NO: 1154180 - RNA, 17 nt, Homo sapiens
auuuauuaaauaaucuc

SEQ ID NO: 1154181 - RNA, 18 nt, Homo sapiens
auuuauuaaauaaucucu

SEQ ID NO: 1154182 - RNA, 13 nt, Homo sapiens
auuuauuaaucua

SEQ ID NO: 1154183 - RNA, 20 nt, Homo sapiens
aggacuauggacuuggcugu

SEQ ID NO: 1154184 - RNA, 13 nt, Homo sapiens
aggacucaaaagu

SEQ ID NO: 1154185 - RNA, 22 nt, Homo sapiens
aggacucacccuccacaaagca

SEQ ID NO: 1154186 - RNA, 23 nt, Homo sapiens
aggacucacccuccacaaagcaa

SEQ ID NO: 1154187 - RNA, 17 nt, Homo sapiens
aggacugugccagcaca

SEQ ID NO: 1154188 - RNA, 21 nt, Homo sapiens
aggacugugccagcacaaagu

SEQ ID NO: 1154189 - RNA, 17 nt, Homo sapiens
aggagaagcuaauauga

SEQ ID NO: 1154190 - RNA, 14 nt, Homo sapiens
aggagacacaggga

SEQ ID NO: 1154191 - RNA, 15 nt, Homo sapiens
aggagacacagggaa

SEQ ID NO: 1154192 - RNA, 13 nt, Homo sapiens
aggagacagauca

SEQ ID NO: 1154193 - RNA, 22 nt, Homo sapiens
aggagacaguuuaccauccuca

SEQ ID NO: 1154194 - RNA, 22 nt, Homo sapiens
aggagaccauuuguauuaccau

SEQ ID NO: 1154195 - RNA, 22 nt, Homo sapiens
aggagaccuacccuccacaggc

SEQ ID NO: 1154196 - RNA, 16 nt, Homo sapiens
aggagacuaggaggga

SEQ ID NO: 1154197 - RNA, 15 nt, Homo sapiens
aggagacucaccucu

SEQ ID NO: 1154198 - RNA, 19 nt, Homo sapiens
aggagagcaaacugcucag

SEQ ID NO: 1154199 - RNA, 15 nt, Homo sapiens
aggagaugggugcaa

SEQ ID NO: 1154200 - RNA, 22 nt, Homo sapiens
aggagcaucagcugucugucau

SEQ ID NO: 1154201 - RNA, 19 nt, Homo sapiens
aggagcccagcggcccaag

SEQ ID NO: 1154202 - RNA, 18 nt, Homo sapiens
aggagcccuccauuccaa

SEQ ID NO: 1154203 - RNA, 20 nt, Homo sapiens
aggagcccuuaucugugcuc

SEQ ID NO: 1154204 - RNA, 15 nt, Homo sapiens
aggagccggacacuu

SEQ ID NO: 1154205 - RNA, 21 nt, Homo sapiens
aggagccuuuuuaaaacacau

SEQ ID NO: 1154206 - RNA, 23 nt, Homo sapiens
aggagcgcuagugccuugcccac

SEQ ID NO: 1154207 - RNA, 13 nt, Homo sapiens
aggagcucuccac

SEQ ID NO: 1154208 - RNA, 21 nt, Homo sapiens
aggagcucuccacccacucac

SEQ ID NO: 1154209 - RNA, 15 nt, Homo sapiens
aggagcucugcgcca

SEQ ID NO: 1154210 - RNA, 22 nt, Homo sapiens
aggagcugauaaugaacuuuau

SEQ ID NO: 1154211 - RNA, 18 nt, Homo sapiens
aggaggaauaaggggaag

SEQ ID NO: 1154212 - RNA, 13 nt, Homo sapiens
aggaggacagagg

SEQ ID NO: 1154213 - RNA, 20 nt, Homo sapiens
aggaggcagagguugcagug

SEQ ID NO: 1154214 - RNA, 19 nt, Homo sapiens
aggaggcugcccugagggg

SEQ ID NO: 1154215 - RNA, 21 nt, Homo sapiens
aggagggagggacacuuaccc

SEQ ID NO: 1154216 - RNA, 15 nt, Homo sapiens
aggagggcucaggga

SEQ ID NO: 1154217 - RNA, 22 nt, Homo sapiens
aggaggggccgcugccacccac

SEQ ID NO: 1154218 - RNA, 23 nt, Homo sapiens
aggaggugaccaaaucaguguga

SEQ ID NO: 1154219 - RNA, 20 nt, Homo sapiens
aggagugggaaaacacugcc

SEQ ID NO: 1154220 - RNA, 22 nt, Homo sapiens
aggagugggaaaacacugccau

SEQ ID NO: 1154221 - RNA, 19 nt, Homo sapiens
aggaguguccucuucccuc

SEQ ID NO: 1154222 - RNA, 21 nt, Homo sapiens
aggaguucgagaccaaccuag

SEQ ID NO: 1154223 - RNA, 22 nt, Homo sapiens
aggaguugugagcccucuaggg

SEQ ID NO: 1154224 - RNA, 22 nt, Homo sapiens
aggauacauaaugggccacuga

SEQ ID NO: 1154225 - RNA, 22 nt, Homo sapiens
aggauaccacuuuucauugcaa

SEQ ID NO: 1154226 - RNA, 18 nt, Homo sapiens
aggauauuaucuaccugu

SEQ ID NO: 1154227 - RNA, 14 nt, Homo sapiens
aggauauugucagu

SEQ ID NO: 1154228 - RNA, 16 nt, Homo sapiens
aggaucucacauuuca

SEQ ID NO: 1154229 - RNA, 17 nt, Homo sapiens
aggaugccuuagcaugu

SEQ ID NO: 1154230 - RNA, 13 nt, Homo sapiens
aggauguggcuua

SEQ ID NO: 1154231 - RNA, 20 nt, Homo sapiens
aggauguguuuucagucuuu

SEQ ID NO: 1154232 - RNA, 13 nt, Homo sapiens
aggauuggggacc

SEQ ID NO: 1154233 - RNA, 22 nt, Homo sapiens
aggauuucucaacuuugauacu

SEQ ID NO: 1154234 - RNA, 14 nt, Homo sapiens
aggauuugcacaga

SEQ ID NO: 1154235 - RNA, 14 nt, Homo sapiens
aggcaaaauugcaa

SEQ ID NO: 1154236 - RNA, 19 nt, Homo sapiens
aggcaacgauggaguacac

SEQ ID NO: 1154237 - RNA, 12 nt, Homo sapiens
aggcaagcacuu

SEQ ID NO: 1154238 - RNA, 14 nt, Homo sapiens
aggcaauauggcca

SEQ ID NO: 1154239 - RNA, 13 nt, Homo sapiens
aggcaaugggagc

SEQ ID NO: 1154240 - RNA, 21 nt, Homo sapiens
aggcacaagaaucacuugaac

SEQ ID NO: 1154241 - RNA, 14 nt, Homo sapiens
aggcacaagucaua

SEQ ID NO: 1154242 - RNA, 15 nt, Homo sapiens
aggcacaagucauac

SEQ ID NO: 1154243 - RNA, 18 nt, Homo sapiens
aggcacagcaaacugucc

SEQ ID NO: 1154244 - RNA, 12 nt, Homo sapiens
aggcacaguggc

SEQ ID NO: 1154245 - RNA, 19 nt, Homo sapiens
aggcacgugccugucucau

SEQ ID NO: 1154246 - RNA, 12 nt, Homo sapiens
aggcacugaagc

SEQ ID NO: 1154247 - RNA, 22 nt, Homo sapiens
aggcacuguaguucuaagacuc

SEQ ID NO: 1154248 - RNA, 15 nt, Homo sapiens
aggcagaaggaggga

SEQ ID NO: 1154249 - RNA, 15 nt, Homo sapiens
aggcagacucuuuau

SEQ ID NO: 1154250 - RNA, 13 nt, Homo sapiens
aggcagaggaauu

SEQ ID NO: 1154251 - RNA, 12 nt, Homo sapiens
aggcagcacaga

SEQ ID NO: 1154252 - RNA, 15 nt, Homo sapiens
aggcagcucauccaa

SEQ ID NO: 1154253 - RNA, 16 nt, Homo sapiens
aggcaggagaaucacu

SEQ ID NO: 1154254 - RNA, 15 nt, Homo sapiens
aggcaggcagaucac

SEQ ID NO: 1154255 - RNA, 21 nt, Homo sapiens
aggcaggcagcugccugcucu

SEQ ID NO: 1154256 - RNA, 14 nt, Homo sapiens
aggcaggguggugu

SEQ ID NO: 1154257 - RNA, 23 nt, Homo sapiens
aggcagugaugcuggaugcuccu

SEQ ID NO: 1154258 - RNA, 22 nt, Homo sapiens
aggcaguggccacguucaggga

SEQ ID NO: 1154259 - RNA, 13 nt, Homo sapiens
aggcagugucuua

SEQ ID NO: 1154260 - RNA, 20 nt, Homo sapiens
aggcaguuccaggaguacuu

SEQ ID NO: 1154261 - RNA, 19 nt, Homo sapiens
aggcaguuuagugcaucuu

SEQ ID NO: 1154262 - RNA, 22 nt, Homo sapiens
aggcaucucccaccagcucuau

SEQ ID NO: 1154263 - RNA, 21 nt, Homo sapiens
aggcaucugucuuuuuacugg

SEQ ID NO: 1154264 - RNA, 14 nt, Homo sapiens
aggcaugagccacc

SEQ ID NO: 1154265 - RNA, 16 nt, Homo sapiens
aggcaugguggcucac

SEQ ID NO: 1154266 - RNA, 13 nt, Homo sapiens
aggcauguacaaa

SEQ ID NO: 1154267 - RNA, 14 nt, Homo sapiens
aggcauguacaaaa

SEQ ID NO: 1154268 - RNA, 20 nt, Homo sapiens
aggccaaggaaauauuuugu

SEQ ID NO: 1154269 - RNA, 15 nt, Homo sapiens
aggccagacauggug

SEQ ID NO: 1154270 - RNA, 15 nt, Homo sapiens
aggccagaugcacau

SEQ ID NO: 1154271 - RNA, 19 nt, Homo sapiens
aggccagcuggcagcagag

SEQ ID NO: 1154272 - RNA, 18 nt, Homo sapiens
aggccaggccagcugccu

SEQ ID NO: 1154273 - RNA, 17 nt, Homo sapiens
aggccaggugggcggac

SEQ ID NO: 1154274 - RNA, 20 nt, Homo sapiens
aggccagguguggugacuca

SEQ ID NO: 1154275 - RNA, 16 nt, Homo sapiens
aggccagugagccacu

SEQ ID NO: 1154276 - RNA, 21 nt, Homo sapiens
aggccauugggauauucugaa

SEQ ID NO: 1154277 - RNA, 12 nt, Homo sapiens
aggcccaaagcc

SEQ ID NO: 1154278 - RNA, 21 nt, Homo sapiens
aggcccaugaaauugaugaac

SEQ ID NO: 1154279 - RNA, 16 nt, Homo sapiens
aggccccugucucagg

SEQ ID NO: 1154280 - RNA, 20 nt, Homo sapiens
aggcccucugccugcacucc

SEQ ID NO: 1154281 - RNA, 21 nt, Homo sapiens
aggcccugggucuugccaugu

SEQ ID NO: 1154282 - RNA, 21 nt, Homo sapiens
aggccuccuggcccaggugag

SEQ ID NO: 1154283 - RNA, 19 nt, Homo sapiens
aggccucgccugcccuccu

SEQ ID NO: 1154284 - RNA, 22 nt, Homo sapiens
aggccucgccugcccuccucuc

SEQ ID NO: 1154285 - RNA, 21 nt, Homo sapiens
aggccucucaccucugugccu

SEQ ID NO: 1154286 - RNA, 15 nt, Homo sapiens
aggccucucucagga

SEQ ID NO: 1154287 - RNA, 16 nt, Homo sapiens
aggccugccuucucag

SEQ ID NO: 1154288 - RNA, 18 nt, Homo sapiens
aggccugccuucucaggg

SEQ ID NO: 1154289 - RNA, 15 nt, Homo sapiens
aggccuggauaauau

SEQ ID NO: 1154290 - RNA, 16 nt, Homo sapiens
aggccuggcacgucaa

SEQ ID NO: 1154291 - RNA, 22 nt, Homo sapiens
aggccuuuggaaagacuugaau

SEQ ID NO: 1154292 - RNA, 21 nt, Homo sapiens
aggcgagccugacucuguuga

SEQ ID NO: 1154293 - RNA, 22 nt, Homo sapiens
aggcgcugguguuuugcucuga

SEQ ID NO: 1154294 - RNA, 22 nt, Homo sapiens
aggcggaucuuuggacagaagc

SEQ ID NO: 1154295 - RNA, 15 nt, Homo sapiens
aggcgggagcucucc

SEQ ID NO: 1154296 - RNA, 16 nt, Homo sapiens
aggcggggcccagcgc

SEQ ID NO: 1154297 - RNA, 14 nt, Homo sapiens
aggcggugcuugau

SEQ ID NO: 1154298 - RNA, 16 nt, Homo sapiens
aggcgucuucaucucc

SEQ ID NO: 1154299 - RNA, 20 nt, Homo sapiens
aggcguuugaaucagaguga

SEQ ID NO: 1154300 - RNA, 22 nt, Homo sapiens
aggcuaaaacaccuuggcuugu

SEQ ID NO: 1154301 - RNA, 19 nt, Homo sapiens
aggcucacugcaacuucug

SEQ ID NO: 1154302 - RNA, 19 nt, Homo sapiens
aggcucaggucccuggggc

SEQ ID NO: 1154303 - RNA, 16 nt, Homo sapiens
aggcucuagaucauaa

SEQ ID NO: 1154304 - RNA, 15 nt, Homo sapiens
aggcucuugcucaag

SEQ ID NO: 1154305 - RNA, 19 nt, Homo sapiens
aggcugaccacagcacagc

SEQ ID NO: 1154306 - RNA, 23 nt, Homo sapiens
aggcugaggcuggcacaggacau

SEQ ID NO: 1154307 - RNA, 21 nt, Homo sapiens
aggcugaggugguaggaucac

SEQ ID NO: 1154308 - RNA, 18 nt, Homo sapiens
aggcugcaaaguaugcca

SEQ ID NO: 1154309 - RNA, 18 nt, Homo sapiens
aggcugcacuugugagag

SEQ ID NO: 1154310 - RNA, 16 nt, Homo sapiens
aggcugcugccaucca

SEQ ID NO: 1154311 - RNA, 16 nt, Homo sapiens
aggcuggaaaugguuu

SEQ ID NO: 1154312 - RNA, 20 nt, Homo sapiens
aggcuggaguacaguggugu

SEQ ID NO: 1154313 - RNA, 17 nt, Homo sapiens
aggcuggcacaggacau

SEQ ID NO: 1154314 - RNA, 15 nt, Homo sapiens
aggcuggcuuguccc

SEQ ID NO: 1154315 - RNA, 22 nt, Homo sapiens
aggcugggaacucaucugguug

SEQ ID NO: 1154316 - RNA, 17 nt, Homo sapiens
aaugaaauguaugugcu

SEQ ID NO: 1154317 - RNA, 14 nt, Homo sapiens
aaugaaccacugcc

SEQ ID NO: 1154318 - RNA, 16 nt, Homo sapiens
aaugaaccuucuggcc

SEQ ID NO: 1154319 - RNA, 15 nt, Homo sapiens
aaugaagaaagggag

SEQ ID NO: 1154320 - RNA, 21 nt, Homo sapiens
aaugaaggcucauuuacuuga

SEQ ID NO: 1154321 - RNA, 13 nt, Homo sapiens
aaugaagugcaaa

SEQ ID NO: 1154322 - RNA, 16 nt, Homo sapiens
aaugaauaugccaucu

SEQ ID NO: 1154323 - RNA, 19 nt, Homo sapiens
aaugacauggacacaucag

SEQ ID NO: 1154324 - RNA, 22 nt, Homo sapiens
aaugacauuauauucuguucca

SEQ ID NO: 1154325 - RNA, 23 nt, Homo sapiens
acagcuuucugaccuucagcuca

SEQ ID NO: 1154326 - RNA, 11 nt, Homo sapiens
acagcuuuguu

SEQ ID NO: 1154327 - RNA, 19 nt, Homo sapiens
acagcuuuuugcaguaugg

SEQ ID NO: 1154328 - RNA, 17 nt, Homo sapiens
acaggaaaauguaucca

SEQ ID NO: 1154329 - RNA, 19 nt, Homo sapiens
acaggagaaacacuugaac

SEQ ID NO: 1154330 - RNA, 19 nt, Homo sapiens
acaggagaaucaccugaac

SEQ ID NO: 1154331 - RNA, 19 nt, Homo sapiens
acaggagaugggugcaacu

SEQ ID NO: 1154332 - RNA, 18 nt, Homo sapiens
acaggagcccugcuauga

SEQ ID NO: 1154333 - RNA, 13 nt, Homo sapiens
acaggaguguccu

SEQ ID NO: 1154334 - RNA, 18 nt, Homo sapiens
acaggcaacgcagaccaa

SEQ ID NO: 1154335 - RNA, 20 nt, Homo sapiens
acaggcacauuaacuguugc

SEQ ID NO: 1154336 - RNA, 14 nt, Homo sapiens
acaggcaccugcca

SEQ ID NO: 1154337 - RNA, 15 nt, Homo sapiens
acaggcgugagccac

SEQ ID NO: 1154338 - RNA, 23 nt, Homo sapiens
acaggcgugagccacugcgccca

SEQ ID NO: 1154339 - RNA, 18 nt, Homo sapiens
acagggacugaaaaccuc

SEQ ID NO: 1154340 - RNA, 18 nt, Homo sapiens
acaggguauaugaacaaa

SEQ ID NO: 1154341 - RNA, 17 nt, Homo sapiens
acaggucccacugcccu

SEQ ID NO: 1154342 - RNA, 21 nt, Homo sapiens
acaggugugagccaccacucc

SEQ ID NO: 1154343 - RNA, 17 nt, Homo sapiens
acagguguuggugacaa

SEQ ID NO: 1154344 - RNA, 21 nt, Homo sapiens
acagguuuucuucuaaucaua

SEQ ID NO: 1154345 - RNA, 18 nt, Homo sapiens
acaguaaaugaacugauu

SEQ ID NO: 1154346 - RNA, 19 nt, Homo sapiens
acaguaauaagaauggaaa

SEQ ID NO: 1154347 - RNA, 19 nt, Homo sapiens
acaguacacagauaccuug

SEQ ID NO: 1154348 - RNA, 19 nt, Homo sapiens
acaguacaggcagcacaga

SEQ ID NO: 1154349 - RNA, 21 nt, Homo sapiens
acaguacaggcagcacagaga

SEQ ID NO: 1154350 - RNA, 15 nt, Homo sapiens
acaguagcauggcuc

SEQ ID NO: 1154351 - RNA, 21 nt, Homo sapiens
acaguaugauggaacagugaa

SEQ ID NO: 1154352 - RNA, 19 nt, Homo sapiens
acaguaugcauacuggugu

SEQ ID NO: 1154353 - RNA, 21 nt, Homo sapiens
acaguaugcauacugguguua

SEQ ID NO: 1154354 - RNA, 12 nt, Homo sapiens
acagucagcucu

SEQ ID NO: 1154355 - RNA, 18 nt, Homo sapiens
acagucuuccauuugcaa

SEQ ID NO: 1154356 - RNA, 13 nt, Homo sapiens
acagugaauuuaa

SEQ ID NO: 1154357 - RNA, 15 nt, Homo sapiens
acagugaugccugcc

SEQ ID NO: 1154358 - RNA, 12 nt, Homo sapiens
acagugaugcug

SEQ ID NO: 1154359 - RNA, 23 nt, Homo sapiens
acagugcauacagccuuugccau

SEQ ID NO: 1154360 - RNA, 14 nt, Homo sapiens
acagugccacugca

SEQ ID NO: 1154361 - RNA, 14 nt, Homo sapiens
acaguguaagcuua

SEQ ID NO: 1154362 - RNA, 16 nt, Homo sapiens
acaguguuuacacuuu

SEQ ID NO: 1154363 - RNA, 21 nt, Homo sapiens
acaguuauugcaagaguuuaa

SEQ ID NO: 1154364 - RNA, 14 nt, Homo sapiens
acaguucugaagaa

SEQ ID NO: 1154365 - RNA, 21 nt, Homo sapiens
acaguucuuugggccagacau

SEQ ID NO: 1154366 - RNA, 16 nt, Homo sapiens
acaguugcagcccuug

SEQ ID NO: 1154367 - RNA, 19 nt, Homo sapiens
acaguuugagacuccaagc

SEQ ID NO: 1154368 - RNA, 17 nt, Homo sapiens
acaguuugugcucuacu

SEQ ID NO: 1154369 - RNA, 13 nt, Homo sapiens
acauaaagguaaa

SEQ ID NO: 1154370 - RNA, 14 nt, Homo sapiens
acauaaguaccuca

SEQ ID NO: 1154371 - RNA, 17 nt, Homo sapiens
acauaauagaauuuccu

SEQ ID NO: 1154372 - RNA, 15 nt, Homo sapiens
acauaaucuguacaa

SEQ ID NO: 1154373 - RNA, 16 nt, Homo sapiens
acauaauugugaccaa

SEQ ID NO: 1154374 - RNA, 20 nt, Homo sapiens
acauacauuaaacacacuua

SEQ ID NO: 1154375 - RNA, 22 nt, Homo sapiens
acauacauugauucaugucuca

SEQ ID NO: 1154376 - RNA, 16 nt, Homo sapiens
acauacauuucucaua

SEQ ID NO: 1154377 - RNA, 21 nt, Homo sapiens
acauaccguuuauaaugccau

SEQ ID NO: 1154378 - RNA, 16 nt, Homo sapiens
acauacuccuuccauc

SEQ ID NO: 1154379 - RNA, 20 nt, Homo sapiens
acauagaaaaaugaugucuu

SEQ ID NO: 1154380 - RNA, 21 nt, Homo sapiens
acauagaaagccaugugcuaa

SEQ ID NO: 1154381 - RNA, 19 nt, Homo sapiens
acauagacaaaaaauuuga

SEQ ID NO: 1154382 - RNA, 12 nt, Homo sapiens
acauagcugugc

SEQ ID NO: 1154383 - RNA, 14 nt, Homo sapiens
acauagcugugcua

SEQ ID NO: 1154384 - RNA, 14 nt, Homo sapiens
acauauaaagcacu

SEQ ID NO: 1154385 - RNA, 18 nt, Homo sapiens
acauauaaagcacuauac

SEQ ID NO: 1154386 - RNA, 18 nt, Homo sapiens
acauauauauuaauacug

SEQ ID NO: 1154387 - RNA, 13 nt, Homo sapiens
acauauauauuac

SEQ ID NO: 1154388 - RNA, 16 nt, Homo sapiens
acaucacagaacaucc

SEQ ID NO: 1154389 - RNA, 17 nt, Homo sapiens
acaucacugaaaugcua

SEQ ID NO: 1154390 - RNA, 23 nt, Homo sapiens
acaucacuguccaccaccaccug

SEQ ID NO: 1154391 - RNA, 15 nt, Homo sapiens
acaucaggaguucaa

SEQ ID NO: 1154392 - RNA, 18 nt, Homo sapiens
acaucaguuacucugaag

SEQ ID NO: 1154393 - RNA, 19 nt, Homo sapiens
acauccaaagcagacagcu

SEQ ID NO: 1154394 - RNA, 20 nt, Homo sapiens
acauccaaagcagacagcuc

SEQ ID NO: 1154395 - RNA, 13 nt, Homo sapiens
acaucccagacac

SEQ ID NO: 1154396 - RNA, 18 nt, Homo sapiens
acaucccagacacauuca

SEQ ID NO: 1154397 - RNA, 17 nt, Homo sapiens
acauccugugccuccau

SEQ ID NO: 1154398 - RNA, 23 nt, Homo sapiens
acauccugugccuccaucagcua

SEQ ID NO: 1154399 - RNA, 21 nt, Homo sapiens
acaucgacaaccacguaccaa

SEQ ID NO: 1154400 - RNA, 17 nt, Homo sapiens
acaucguuguuuugcug

SEQ ID NO: 1154401 - RNA, 14 nt, Homo sapiens
acaucuacaaacag

SEQ ID NO: 1154402 - RNA, 15 nt, Homo sapiens
acaucuauucucucc

SEQ ID NO: 1154403 - RNA, 15 nt, Homo sapiens
acaucucccuuccac

SEQ ID NO: 1154404 - RNA, 20 nt, Homo sapiens
acaucugcaauaugaauuca

SEQ ID NO: 1154405 - RNA, 18 nt, Homo sapiens
acaucugugucucuggaa

SEQ ID NO: 1154406 - RNA, 13 nt, Homo sapiens
acaucuuucacau

SEQ ID NO: 1154407 - RNA, 22 nt, Homo sapiens
acaugaagaagaccuuuacagu

SEQ ID NO: 1154408 - RNA, 22 nt, Homo sapiens
acaugaaucaaaagugccucaa

SEQ ID NO: 1154409 - RNA, 19 nt, Homo sapiens
acaugagaaggaacuucca

SEQ ID NO: 1154410 - RNA, 17 nt, Homo sapiens
acaugcacucagcucuu

SEQ ID NO: 1154411 - RNA, 13 nt, Homo sapiens
acaugcccugugu

SEQ ID NO: 1154412 - RNA, 18 nt, Homo sapiens
acaugcccuguguggcug

SEQ ID NO: 1154413 - RNA, 18 nt, Homo sapiens
acaugcccuguucagcua

SEQ ID NO: 1154414 - RNA, 16 nt, Homo sapiens
acaugccugguggaag

SEQ ID NO: 1154415 - RNA, 19 nt, Homo sapiens
acaugcgugaccagcagua

SEQ ID NO: 1154416 - RNA, 14 nt, Homo sapiens
acaugcuucagugc

SEQ ID NO: 1154417 - RNA, 16 nt, Homo sapiens
acaugcuuugaaguuu

SEQ ID NO: 1154418 - RNA, 22 nt, Homo sapiens
acauggagaaaaccaaaaugau

SEQ ID NO: 1154419 - RNA, 21 nt, Homo sapiens
acauggccuaugcacauaugg

SEQ ID NO: 1154420 - RNA, 16 nt, Homo sapiens
acauggcugacuuugc

SEQ ID NO: 1154421 - RNA, 16 nt, Homo sapiens
acauggugacuuuuga

SEQ ID NO: 1154422 - RNA, 21 nt, Homo sapiens
acaugguggcaugcaccugca

SEQ ID NO: 1154423 - RNA, 21 nt, Homo sapiens
acauguaaaauaugucuuucu

SEQ ID NO: 1154424 - RNA, 21 nt, Homo sapiens
acauguaacgaaacacuucaa

SEQ ID NO: 1154425 - RNA, 13 nt, Homo sapiens
acauguaugugca

SEQ ID NO: 1154426 - RNA, 17 nt, Homo sapiens
acauguauucuguucuu

SEQ ID NO: 1154427 - RNA, 17 nt, Homo sapiens
acaugugacacauaugc

SEQ ID NO: 1154428 - RNA, 19 nt, Homo sapiens
acauguguagccugugcau

SEQ ID NO: 1154429 - RNA, 20 nt, Homo sapiens
acauguguagccugugcaug

SEQ ID NO: 1154430 - RNA, 21 nt, Homo sapiens
acauguuaguuuuucuuacuu

SEQ ID NO: 1154431 - RNA, 16 nt, Homo sapiens
acauguucaucuggaa

SEQ ID NO: 1154432 - RNA, 21 nt, Homo sapiens
acauguuccuuauauuuacuc

SEQ ID NO: 1154433 - RNA, 19 nt, Homo sapiens
acaaugaggcugcuuauga

SEQ ID NO: 1154434 - RNA, 15 nt, Homo sapiens
acaaugaguggacaa

SEQ ID NO: 1154435 - RNA, 22 nt, Homo sapiens
acaaugcaucauaaaacaaauc

SEQ ID NO: 1154436 - RNA, 18 nt, Homo sapiens
acaaugcugagguuauga

SEQ ID NO: 1154437 - RNA, 20 nt, Homo sapiens
acaaugcuuauggaaagcca

SEQ ID NO: 1154438 - RNA, 18 nt, Homo sapiens
acaauggcagaacaggug

SEQ ID NO: 1154439 - RNA, 13 nt, Homo sapiens
acaaugucccuuc

SEQ ID NO: 1154440 - RNA, 20 nt, Homo sapiens
acaauguucuuuauauacaa

SEQ ID NO: 1154441 - RNA, 15 nt, Homo sapiens
acaauguuugauacu

SEQ ID NO: 1154442 - RNA, 23 nt, Homo sapiens
acaauuaaaagugucuugagacu

SEQ ID NO: 1154443 - RNA, 15 nt, Homo sapiens
acaauuaaagcaaaa

SEQ ID NO: 1154444 - RNA, 17 nt, Homo sapiens
acaauuaugaacaucca

SEQ ID NO: 1154445 - RNA, 13 nt, Homo sapiens
acaauuauuguau

SEQ ID NO: 1154446 - RNA, 10 nt, Homo sapiens
acaauuccac

SEQ ID NO: 1154447 - RNA, 22 nt, Homo sapiens
acaauucguuuuuucauuugaa

SEQ ID NO: 1154448 - RNA, 20 nt, Homo sapiens
acaauugcuuuaacagucaa

SEQ ID NO: 1154449 - RNA, 21 nt, Homo sapiens
acaauuuaguuuuaaggacuu

SEQ ID NO: 1154450 - RNA, 15 nt, Homo sapiens
acaauuucaucccag

SEQ ID NO: 1154451 - RNA, 16 nt, Homo sapiens
acacaaaucuauuuaa

SEQ ID NO: 1154452 - RNA, 16 nt, Homo sapiens
acacaacagccaacag

SEQ ID NO: 1154453 - RNA, 14 nt, Homo sapiens
acacaacauguaug

SEQ ID NO: 1154454 - RNA, 18 nt, Homo sapiens
acacaaccuacucugcaa

SEQ ID NO: 1154455 - RNA, 18 nt, Homo sapiens
acacaaggauagaugcug

SEQ ID NO: 1154456 - RNA, 23 nt, Homo sapiens
acacaaggucauggccacacugu

SEQ ID NO: 1154457 - RNA, 13 nt, Homo sapiens
acacaaugcauca

SEQ ID NO: 1154458 - RNA, 15 nt, Homo sapiens
acacacacaccucuu

SEQ ID NO: 1154459 - RNA, 13 nt, Homo sapiens
acacacacuccuu

SEQ ID NO: 1154460 - RNA, 22 nt, Homo sapiens
acacacagaaaauauacuguaa

SEQ ID NO: 1154461 - RNA, 22 nt, Homo sapiens
acacacagguggugucacuguc

SEQ ID NO: 1154462 - RNA, 14 nt, Homo sapiens
acacacgcacauau

SEQ ID NO: 1154463 - RNA, 10 nt, Homo sapiens
acacacucca

SEQ ID NO: 1154464 - RNA, 13 nt, Homo sapiens
acacacuccauca

SEQ ID NO: 1154465 - RNA, 11 nt, Homo sapiens
acacacuccuu

SEQ ID NO: 1154466 - RNA, 18 nt, Homo sapiens
acacacugagacuugaau

SEQ ID NO: 1154467 - RNA, 18 nt, Homo sapiens
acacacugaggcagggaa

SEQ ID NO: 1154468 - RNA, 20 nt, Homo sapiens
acacagagcuuuggucugug

SEQ ID NO: 1154469 - RNA, 17 nt, Homo sapiens
acacagagggccaguaa

SEQ ID NO: 1154470 - RNA, 19 nt, Homo sapiens
acacaggaggcugaggcag

SEQ ID NO: 1154471 - RNA, 18 nt, Homo sapiens
acacagggugguggcaca

SEQ ID NO: 1154472 - RNA, 15 nt, Homo sapiens
acacauucagugaua

SEQ ID NO: 1154473 - RNA, 20 nt, Homo sapiens
acacauucuuaacacauguc

SEQ ID NO: 1154474 - RNA, 13 nt, Homo sapiens
acaccacacccag

SEQ ID NO: 1154475 - RNA, 17 nt, Homo sapiens
acaccacacccagcuaa

SEQ ID NO: 1154476 - RNA, 18 nt, Homo sapiens
acaccagacccucagcga

SEQ ID NO: 1154477 - RNA, 23 nt, Homo sapiens
acacccaaguugaagacuuuguu

SEQ ID NO: 1154478 - RNA, 14 nt, Homo sapiens
acacccaauuccac

SEQ ID NO: 1154479 - RNA, 20 nt, Homo sapiens
acacccagcucagcauuucc

SEQ ID NO: 1154480 - RNA, 13 nt, Homo sapiens
acacccagggucu

SEQ ID NO: 1154481 - RNA, 12 nt, Homo sapiens
acacccaugugu

SEQ ID NO: 1154482 - RNA, 14 nt, Homo sapiens
acacccauguguac

SEQ ID NO: 1154483 - RNA, 16 nt, Homo sapiens
acaccggguuccagca

SEQ ID NO: 1154484 - RNA, 17 nt, Homo sapiens
acaccguggacagcgcu

SEQ ID NO: 1154485 - RNA, 21 nt, Homo sapiens
acaccugagaaacaucuagaa

SEQ ID NO: 1154486 - RNA, 19 nt, Homo sapiens
acaccugauuaacugaggc

SEQ ID NO: 1154487 - RNA, 18 nt, Homo sapiens
acaccugcagugccagcu

SEQ ID NO: 1154488 - RNA, 20 nt, Homo sapiens
acaccuggcccuugcaaucu

SEQ ID NO: 1154489 - RNA, 17 nt, Homo sapiens
acaccuguaaucccagc

SEQ ID NO: 1154490 - RNA, 14 nt, Homo sapiens
acaccugugugcug

SEQ ID NO: 1154491 - RNA, 17 nt, Homo sapiens
acaccuucugugcucau

SEQ ID NO: 1154492 - RNA, 17 nt, Homo sapiens
acacgccugcaaacgcu

SEQ ID NO: 1154493 - RNA, 13 nt, Homo sapiens
acacggucagggu

SEQ ID NO: 1154494 - RNA, 16 nt, Homo sapiens
acacggucagggucag

SEQ ID NO: 1154495 - RNA, 23 nt, Homo sapiens
acacggucagggucagggccauu

SEQ ID NO: 1154496 - RNA, 22 nt, Homo sapiens
acacguaucucuugguaugcau

SEQ ID NO: 1154497 - RNA, 15 nt, Homo sapiens
acacgucacaaagac

SEQ ID NO: 1154498 - RNA, 12 nt, Homo sapiens
acacgugacaga

SEQ ID NO: 1154499 - RNA, 22 nt, Homo sapiens
acacuacaaguuuauaagccca

SEQ ID NO: 1154500 - RNA, 15 nt, Homo sapiens
acacucaacaauaaa

SEQ ID NO: 1154501 - RNA, 18 nt, Homo sapiens
acacucaacaauaaagac

SEQ ID NO: 1154502 - RNA, 11 nt, Homo sapiens
acacucagggc

SEQ ID NO: 1154503 - RNA, 21 nt, Homo sapiens
acacucauccccucacuugcc

SEQ ID NO: 1154504 - RNA, 21 nt, Homo sapiens
acacucuccugugaacacugg

SEQ ID NO: 1154505 - RNA, 22 nt, Homo sapiens
acacucuccugugaacacugga

SEQ ID NO: 1154506 - RNA, 23 nt, Homo sapiens
acacugaaacuguaugugcugua

SEQ ID NO: 1154507 - RNA, 15 nt, Homo sapiens
acacugaaauugccu

SEQ ID NO: 1154508 - RNA, 23 nt, Homo sapiens
acacugacuuggugcaaggccau

SEQ ID NO: 1154509 - RNA, 17 nt, Homo sapiens
acacugagacuugaauc

SEQ ID NO: 1154510 - RNA, 22 nt, Homo sapiens
acacugagacuugaaucaaguc

SEQ ID NO: 1154511 - RNA, 21 nt, Homo sapiens
acacugccccaggacugucau

SEQ ID NO: 1154512 - RNA, 15 nt, Homo sapiens
acacuggagucuugc

SEQ ID NO: 1154513 - RNA, 12 nt, Homo sapiens
acacuguacaag

SEQ ID NO: 1154514 - RNA, 13 nt, Homo sapiens
acacuuacuccag

SEQ ID NO: 1154515 - RNA, 22 nt, Homo sapiens
acacuucaaggugacagaagga

SEQ ID NO: 1154516 - RNA, 22 nt, Homo sapiens
acacuucaauaauuguccauga

SEQ ID NO: 1154517 - RNA, 22 nt, Homo sapiens
acacuuccauaugucauugcua

SEQ ID NO: 1154518 - RNA, 17 nt, Homo sapiens
acacuugcaaccuaccu

SEQ ID NO: 1154519 - RNA, 18 nt, Homo sapiens
acacuuggugcugggaac

SEQ ID NO: 1154520 - RNA, 15 nt, Homo sapiens
acagaaacugaugcc

SEQ ID NO: 1154521 - RNA, 12 nt, Homo sapiens
acagaacaaagu

SEQ ID NO: 1154522 - RNA, 20 nt, Homo sapiens
acagaacacacugagacuug

SEQ ID NO: 1154523 - RNA, 23 nt, Homo sapiens
acagaagagugacauguuuacaa

SEQ ID NO: 1154524 - RNA, 23 nt, Homo sapiens
acagaagcuucugcccaccuacu

SEQ ID NO: 1154525 - RNA, 12 nt, Homo sapiens
acagaagguccu

SEQ ID NO: 1154526 - RNA, 13 nt, Homo sapiens
acagaauucacuu

SEQ ID NO: 1154527 - RNA, 22 nt, Homo sapiens
acagaauuuuaugcggcauuuu

SEQ ID NO: 1154528 - RNA, 14 nt, Homo sapiens
acagacacaauuua

SEQ ID NO: 1154529 - RNA, 18 nt, Homo sapiens
acagaccgaccaccagca

SEQ ID NO: 1154530 - RNA, 21 nt, Homo sapiens
acagaccgaccaccagcacag

SEQ ID NO: 1154531 - RNA, 21 nt, Homo sapiens
acagagcaagacuccaucuca

SEQ ID NO: 1154532 - RNA, 19 nt, Homo sapiens
acagagcuucccugacuca

SEQ ID NO: 1154533 - RNA, 19 nt, Homo sapiens
acagaggugucauccacag

SEQ ID NO: 1154534 - RNA, 18 nt, Homo sapiens
acagagucaggaucucac

SEQ ID NO: 1154535 - RNA, 21 nt, Homo sapiens
acagagugagacuccaucuca

SEQ ID NO: 1154536 - RNA, 21 nt, Homo sapiens
acagaguggacuguucccuga

SEQ ID NO: 1154537 - RNA, 13 nt, Homo sapiens
acagauaaaugac

SEQ ID NO: 1154538 - RNA, 19 nt, Homo sapiens
acagaucaagcugugagac

SEQ ID NO: 1154539 - RNA, 18 nt, Homo sapiens
acagaucuggaaccucag

SEQ ID NO: 1154540 - RNA, 18 nt, Homo sapiens
acagaugccacacaagga

SEQ ID NO: 1154541 - RNA, 12 nt, Homo sapiens
acagauggcuca

SEQ ID NO: 1154542 - RNA, 19 nt, Homo sapiens
acagauguucccccaucuc

SEQ ID NO: 1154543 - RNA, 15 nt, Homo sapiens
acagauuuacauccc

SEQ ID NO: 1154544 - RNA, 14 nt, Homo sapiens
acagcacagccaac

SEQ ID NO: 1154545 - RNA, 19 nt, Homo sapiens
cugcccacacagguucacg

SEQ ID NO: 1154546 - RNA, 20 nt, Homo sapiens
cugcccauggcaugucuuug

SEQ ID NO: 1154547 - RNA, 17 nt, Homo sapiens
cugccccaggacuguca

SEQ ID NO: 1154548 - RNA, 20 nt, Homo sapiens
cugcccccagacccauguga

SEQ ID NO: 1154549 - RNA, 23 nt, Homo sapiens
cugcccguaaacacgccugcaaa

SEQ ID NO: 1154550 - RNA, 14 nt, Homo sapiens
cugcccucccucag

SEQ ID NO: 1154551 - RNA, 17 nt, Homo sapiens
cugcccugcucccacag

SEQ ID NO: 1154552 - RNA, 20 nt, Homo sapiens
cugcccuuauccgcugucca

SEQ ID NO: 1154553 - RNA, 15 nt, Homo sapiens
cugccgagaguccau

SEQ ID NO: 1154554 - RNA, 15 nt, Homo sapiens
cugccgcuaccuccc

SEQ ID NO: 1154555 - RNA, 23 nt, Homo sapiens
cugccggggguucaggguuggua

SEQ ID NO: 1154556 - RNA, 23 nt, Homo sapiens
cugccgguaaacacgccugcaaa

SEQ ID NO: 1154557 - RNA, 18 nt, Homo sapiens
cugccuaaguggcugcug

SEQ ID NO: 1154558 - RNA, 16 nt, Homo sapiens
cugccuaauaggcacc

SEQ ID NO: 1154559 - RNA, 20 nt, Homo sapiens
cugccucagcugcaucugau

SEQ ID NO: 1154560 - RNA, 17 nt, Homo sapiens
cugccucccaucucaac

SEQ ID NO: 1154561 - RNA, 23 nt, Homo sapiens
cugccuccuggguucaagcgauu

SEQ ID NO: 1154562 - RNA, 22 nt, Homo sapiens
cugccucugacagcagccugug

SEQ ID NO: 1154563 - RNA, 20 nt, Homo sapiens
cugccugccgguaaacacgc

SEQ ID NO: 1154564 - RNA, 16 nt, Homo sapiens
cugccuguaacagcca

SEQ ID NO: 1154565 - RNA, 14 nt, Homo sapiens
cugccuuagccuac

SEQ ID NO: 1154566 - RNA, 20 nt, Homo sapiens
cugccuuauuaaagcaaaaa

SEQ ID NO: 1154567 - RNA, 15 nt, Homo sapiens
cugccuucuggaaua

SEQ ID NO: 1154568 - RNA, 13 nt, Homo sapiens
cugccuucuuuau

SEQ ID NO: 1154569 - RNA, 20 nt, Homo sapiens
cugccuuuagaguuccauga

SEQ ID NO: 1154570 - RNA, 21 nt, Homo sapiens
cugccuuugaucacaggagca

SEQ ID NO: 1154571 - RNA, 23 nt, Homo sapiens
cugccuuugggagcaggauuuuu

SEQ ID NO: 1154572 - RNA, 19 nt, Homo sapiens
cugcgcccaguccuuccac

SEQ ID NO: 1154573 - RNA, 19 nt, Homo sapiens
cugcggggggcaccagagg

SEQ ID NO: 1154574 - RNA, 19 nt, Homo sapiens
cugcgucaggcagugugag

SEQ ID NO: 1154575 - RNA, 18 nt, Homo sapiens
cugcuacaaagaagacau

SEQ ID NO: 1154576 - RNA, 15 nt, Homo sapiens
cugcuaccuuccuag

SEQ ID NO: 1154577 - RNA, 20 nt, Homo sapiens
cugcuauugcagcaauuaaa

SEQ ID NO: 1154578 - RNA, 15 nt, Homo sapiens
cugcucaaccucacc

SEQ ID NO: 1154579 - RNA, 22 nt, Homo sapiens
cugcucagcgcgucucagcuca

SEQ ID NO: 1154580 - RNA, 21 nt, Homo sapiens
cugcucaggaaaccacaaccu

SEQ ID NO: 1154581 - RNA, 23 nt, Homo sapiens
cugcuccaaaggaaauccaaaaa

SEQ ID NO: 1154582 - RNA, 12 nt, Homo sapiens
cugcuccagaag

SEQ ID NO: 1154583 - RNA, 15 nt, Homo sapiens
cugcuccagaccuga

SEQ ID NO: 1154584 - RNA, 19 nt, Homo sapiens
cugcucccucacccaggca

SEQ ID NO: 1154585 - RNA, 16 nt, Homo sapiens
cugcucucccacugca

SEQ ID NO: 1154586 - RNA, 19 nt, Homo sapiens
cugcucuuuuauacuguac

SEQ ID NO: 1154587 - RNA, 18 nt, Homo sapiens
cugcugaccuccacagcu

SEQ ID NO: 1154588 - RNA, 22 nt, Homo sapiens
cugcugacugccaauaacauuc

SEQ ID NO: 1154589 - RNA, 20 nt, Homo sapiens
cugcugagcagaaugccuua

SEQ ID NO: 1154590 - RNA, 19 nt, Homo sapiens
cugcugauauaauaucaua

SEQ ID NO: 1154591 - RNA, 14 nt, Homo sapiens
cugcugaucaauga

SEQ ID NO: 1154592 - RNA, 16 nt, Homo sapiens
cugcugcauccaggac

SEQ ID NO: 1154593 - RNA, 17 nt, Homo sapiens
cugcuggaaaucucaaa

SEQ ID NO: 1154594 - RNA, 21 nt, Homo sapiens
cugcuggagugaaggggccaa

SEQ ID NO: 1154595 - RNA, 18 nt, Homo sapiens
cugcugggggcaacuggc

SEQ ID NO: 1154596 - RNA, 23 nt, Homo sapiens
cugcugucaccucucccacggga

SEQ ID NO: 1154597 - RNA, 11 nt, Homo sapiens
cugcuguggaa

SEQ ID NO: 1154598 - RNA, 15 nt, Homo sapiens
cugcugugucuuuag

SEQ ID NO: 1154599 - RNA, 15 nt, Homo sapiens
cugcuuaagugccua

SEQ ID NO: 1154600 - RNA, 18 nt, Homo sapiens
cugcuucccagguucaag

SEQ ID NO: 1154601 - RNA, 20 nt, Homo sapiens
cugcuucuacggccaugaga

SEQ ID NO: 1154602 - RNA, 11 nt, Homo sapiens
cugcuucucac

SEQ ID NO: 1154603 - RNA, 16 nt, Homo sapiens
cugcuucugauaugca

SEQ ID NO: 1154604 - RNA, 18 nt, Homo sapiens
cugcuugcagccaggaga

SEQ ID NO: 1154605 - RNA, 22 nt, Homo sapiens
cugcuugcagccaggagaaggu

SEQ ID NO: 1154606 - RNA, 20 nt, Homo sapiens
cugcuuuagagcuagggugg

SEQ ID NO: 1154607 - RNA, 19 nt, Homo sapiens
cugcuuuugaaaucuguau

SEQ ID NO: 1154608 - RNA, 22 nt, Homo sapiens
cuggaaaggaaagaugaugcuc

SEQ ID NO: 1154609 - RNA, 20 nt, Homo sapiens
cuggaaaucuggauuuucag

SEQ ID NO: 1154610 - RNA, 14 nt, Homo sapiens
cuggaacaauguuu

SEQ ID NO: 1154611 - RNA, 13 nt, Homo sapiens
cuggaacaccagc

SEQ ID NO: 1154612 - RNA, 21 nt, Homo sapiens
cuggaacaugcuuuuacuuua

SEQ ID NO: 1154613 - RNA, 17 nt, Homo sapiens
cuggaaccugcaaaaaa

SEQ ID NO: 1154614 - RNA, 14 nt, Homo sapiens
cuggaagaaccacu

SEQ ID NO: 1154615 - RNA, 18 nt, Homo sapiens
cuggaagcacuacagagc

SEQ ID NO: 1154616 - RNA, 16 nt, Homo sapiens
cuggaagcagagcaaa

SEQ ID NO: 1154617 - RNA, 17 nt, Homo sapiens
cuggaagcuaauuugca

SEQ ID NO: 1154618 - RNA, 21 nt, Homo sapiens
cuggaagcuuuguccccugcu

SEQ ID NO: 1154619 - RNA, 16 nt, Homo sapiens
cuggaaggacaaauaa

SEQ ID NO: 1154620 - RNA, 13 nt, Homo sapiens
cuggaaugccaau

SEQ ID NO: 1154621 - RNA, 23 nt, Homo sapiens
cuggaauguaaguaagugacaau

SEQ ID NO: 1154622 - RNA, 15 nt, Homo sapiens
cuggaauuauuuuag

SEQ ID NO: 1154623 - RNA, 14 nt, Homo sapiens
cuggaauuuaccuc

SEQ ID NO: 1154624 - RNA, 17 nt, Homo sapiens
cuggacaaccagaggag

SEQ ID NO: 1154625 - RNA, 18 nt, Homo sapiens
cuggaccagccucuccac

SEQ ID NO: 1154626 - RNA, 23 nt, Homo sapiens
cuggaccauaauagacaccaaaa

SEQ ID NO: 1154627 - RNA, 14 nt, Homo sapiens
cuggaccucagguu

SEQ ID NO: 1154628 - RNA, 16 nt, Homo sapiens
cuggaccugguacaaa

SEQ ID NO: 1154629 - RNA, 17 nt, Homo sapiens
cuggacggaaccacgua

SEQ ID NO: 1154630 - RNA, 18 nt, Homo sapiens
cuggacugcacacuucca

SEQ ID NO: 1154631 - RNA, 17 nt, Homo sapiens
cuggagacuaaccccac

SEQ ID NO: 1154632 - RNA, 21 nt, Homo sapiens
cuggagacuaaccccaccaca

SEQ ID NO: 1154633 - RNA, 20 nt, Homo sapiens
cuggagauggacaacucaau

SEQ ID NO: 1154634 - RNA, 22 nt, Homo sapiens
cuggagauggacaacucaauga

SEQ ID NO: 1154635 - RNA, 15 nt, Homo sapiens
cuguggcacuugccu

SEQ ID NO: 1154636 - RNA, 22 nt, Homo sapiens
cugugggaagcucccagaguuu

SEQ ID NO: 1154637 - RNA, 22 nt, Homo sapiens
cugugggcauggucaaaggcuc

SEQ ID NO: 1154638 - RNA, 13 nt, Homo sapiens
cuguguacugggu

SEQ ID NO: 1154639 - RNA, 23 nt, Homo sapiens
cuguguagcaucugcauugccca

SEQ ID NO: 1154640 - RNA, 17 nt, Homo sapiens
cuguguauucauucuca

SEQ ID NO: 1154641 - RNA, 13 nt, Homo sapiens
cugugucacuguc

SEQ ID NO: 1154642 - RNA, 20 nt, Homo sapiens
cugugucaggaaacauauuu

SEQ ID NO: 1154643 - RNA, 18 nt, Homo sapiens
cugugucauuaaccaucu

SEQ ID NO: 1154644 - RNA, 19 nt, Homo sapiens
cugugucauuaaccaucuu

SEQ ID NO: 1154645 - RNA, 16 nt, Homo sapiens
cuguguccgaugcugg

SEQ ID NO: 1154646 - RNA, 23 nt, Homo sapiens
cugugugaagaaagccucaguga

SEQ ID NO: 1154647 - RNA, 15 nt, Homo sapiens
cugugugcgugcgca

SEQ ID NO: 1154648 - RNA, 18 nt, Homo sapiens
cuguguguguuagcuugu

SEQ ID NO: 1154649 - RNA, 22 nt, Homo sapiens
cuguguuacuugaaguaacuau

SEQ ID NO: 1154650 - RNA, 18 nt, Homo sapiens
cuguguuuaaccuguugc

SEQ ID NO: 1154651 - RNA, 17 nt, Homo sapiens
cuguguuucuuuuugcc

SEQ ID NO: 1154652 - RNA, 14 nt, Homo sapiens
cuguuaaccaaaua

SEQ ID NO: 1154653 - RNA, 13 nt, Homo sapiens
cuguuacccaggc

SEQ ID NO: 1154654 - RNA, 22 nt, Homo sapiens
cuguuagcuccucacuguggua

SEQ ID NO: 1154655 - RNA, 14 nt, Homo sapiens
cuguucaacaugua

SEQ ID NO: 1154656 - RNA, 20 nt, Homo sapiens
cuguucacacacacaguuug

SEQ ID NO: 1154657 - RNA, 21 nt, Homo sapiens
cuguucagcuuuucagugaau

SEQ ID NO: 1154658 - RNA, 15 nt, Homo sapiens
cuguucaucccaugu

SEQ ID NO: 1154659 - RNA, 14 nt, Homo sapiens
cuguuccccagaga

SEQ ID NO: 1154660 - RNA, 16 nt, Homo sapiens
cuguucccuugccauc

SEQ ID NO: 1154661 - RNA, 12 nt, Homo sapiens
cuguucuacuuu

SEQ ID NO: 1154662 - RNA, 20 nt, Homo sapiens
cuguucucuugggaacugaa

SEQ ID NO: 1154663 - RNA, 16 nt, Homo sapiens
cuguucugaaaccuua

SEQ ID NO: 1154664 - RNA, 13 nt, Homo sapiens
cuguucuguggaa

SEQ ID NO: 1154665 - RNA, 22 nt, Homo sapiens
cuguucuguggaaaguguaaag

SEQ ID NO: 1154666 - RNA, 14 nt, Homo sapiens
cuguugaacaauaa

SEQ ID NO: 1154667 - RNA, 21 nt, Homo sapiens
cuguugcggaucuucauggcc

SEQ ID NO: 1154668 - RNA, 17 nt, Homo sapiens
cuguuggcaaggugaca

SEQ ID NO: 1154669 - RNA, 20 nt, Homo sapiens
cuguugggagaaagcaauac

SEQ ID NO: 1154670 - RNA, 21 nt, Homo sapiens
cuguugggagccugugagccc

SEQ ID NO: 1154671 - RNA, 20 nt, Homo sapiens
cuguugugugucaugccagu

SEQ ID NO: 1154672 - RNA, 18 nt, Homo sapiens
cuguuuaaagcuuugaau

SEQ ID NO: 1154673 - RNA, 15 nt, Homo sapiens
cuguuuaaaguguca

SEQ ID NO: 1154674 - RNA, 21 nt, Homo sapiens
cuguuuauugaaagaauuauc

SEQ ID NO: 1154675 - RNA, 16 nt, Homo sapiens
cuguuucaaucacugu

SEQ ID NO: 1154676 - RNA, 12 nt, Homo sapiens
cuguuuccauag

SEQ ID NO: 1154677 - RNA, 18 nt, Homo sapiens
cuguuuccauagcaccau

SEQ ID NO: 1154678 - RNA, 22 nt, Homo sapiens
cuguuugaaaccaagcuuucaa

SEQ ID NO: 1154679 - RNA, 22 nt, Homo sapiens
cuguuuggauuauuccucuaca

SEQ ID NO: 1154680 - RNA, 22 nt, Homo sapiens
cuguuuguguccucaggagcaa

SEQ ID NO: 1154681 - RNA, 16 nt, Homo sapiens
gcaaauuuucuuccau

SEQ ID NO: 1154682 - RNA, 16 nt, Homo sapiens
gcaacaaccaccaccu

SEQ ID NO: 1154683 - RNA, 14 nt, Homo sapiens
gcaacaaccaucuc

SEQ ID NO: 1154684 - RNA, 18 nt, Homo sapiens
gcaacaagaccaccacuu

SEQ ID NO: 1154685 - RNA, 22 nt, Homo sapiens
gcaacaagaccaccacuucgaa

SEQ ID NO: 1154686 - RNA, 13 nt, Homo sapiens
gcaaccauauuug

SEQ ID NO: 1154687 - RNA, 22 nt, Homo sapiens
gcaacguagcuucuaccaugaa

SEQ ID NO: 1154688 - RNA, 19 nt, Homo sapiens
gcaacuaaaugagaccuaa

SEQ ID NO: 1154689 - RNA, 16 nt, Homo sapiens
gcaacugaaauuacau

SEQ ID NO: 1154690 - RNA, 18 nt, Homo sapiens
gcaacuggccauuugcca

SEQ ID NO: 1154691 - RNA, 20 nt, Homo sapiens
gcaagacagcccaacagcug

SEQ ID NO: 1154692 - RNA, 16 nt, Homo sapiens
gcaagagaaacugcag

SEQ ID NO: 1154693 - RNA, 15 nt, Homo sapiens
gcaagcuguguuacu

SEQ ID NO: 1154694 - RNA, 23 nt, Homo sapiens
gcaaggaaacuauguaacaugua

SEQ ID NO: 1154695 - RNA, 15 nt, Homo sapiens
gcaaggaaugacuca

SEQ ID NO: 1154696 - RNA, 17 nt, Homo sapiens
gcaaggagccagggaau

SEQ ID NO: 1154697 - RNA, 16 nt, Homo sapiens
gcaaggauuacagaaa

SEQ ID NO: 1154698 - RNA, 15 nt, Homo sapiens
gcaaggcacaaguca

SEQ ID NO: 1154699 - RNA, 23 nt, Homo sapiens
gcaagguuuaggcugguggccca

SEQ ID NO: 1154700 - RNA, 15 nt, Homo sapiens
gcaagguuuccuuuc

SEQ ID NO: 1154701 - RNA, 16 nt, Homo sapiens
gcaaguauccagaccu

SEQ ID NO: 1154702 - RNA, 19 nt, Homo sapiens
gcaagugugcucuccuggg

SEQ ID NO: 1154703 - RNA, 15 nt, Homo sapiens
gcaaguuagugaaac

SEQ ID NO: 1154704 - RNA, 21 nt, Homo sapiens
gcaauaaaucugacccagugc

SEQ ID NO: 1154705 - RNA, 23 nt, Homo sapiens
gcaauacugcuuaauugcugaua

SEQ ID NO: 1154706 - RNA, 21 nt, Homo sapiens
gcaauccacaaucugacauuc

SEQ ID NO: 1154707 - RNA, 12 nt, Homo sapiens
gcaaugacugug

SEQ ID NO: 1154708 - RNA, 19 nt, Homo sapiens
gcaaugggauguaugaaua

SEQ ID NO: 1154709 - RNA, 22 nt, Homo sapiens
gcaaugggauguaugaauacag

SEQ ID NO: 1154710 - RNA, 23 nt, Homo sapiens
gcaauguagaggggaaaagagau

SEQ ID NO: 1154711 - RNA, 18 nt, Homo sapiens
gcaauguguuucugguau

SEQ ID NO: 1154712 - RNA, 14 nt, Homo sapiens
gcaauuaacucugg

SEQ ID NO: 1154713 - RNA, 17 nt, Homo sapiens
gcaauucagucugcucu

SEQ ID NO: 1154714 - RNA, 21 nt, Homo sapiens
gcaauugaaggaucaucugaa

SEQ ID NO: 1154715 - RNA, 16 nt, Homo sapiens
gcaauuucuacuacag

SEQ ID NO: 1154716 - RNA, 15 nt, Homo sapiens
gcacaaagugggagc

SEQ ID NO: 1154717 - RNA, 18 nt, Homo sapiens
gcacaaggccaucugggc

SEQ ID NO: 1154718 - RNA, 13 nt, Homo sapiens
gcacaaggccuug

SEQ ID NO: 1154719 - RNA, 22 nt, Homo sapiens
gcacaagucauaccuacauuca

SEQ ID NO: 1154720 - RNA, 15 nt, Homo sapiens
gcacacccacucagc

SEQ ID NO: 1154721 - RNA, 15 nt, Homo sapiens
gcacacuggccucca

SEQ ID NO: 1154722 - RNA, 14 nt, Homo sapiens
gcacagagucagga

SEQ ID NO: 1154723 - RNA, 21 nt, Homo sapiens
gcacagagucaggaucucaca

SEQ ID NO: 1154724 - RNA, 14 nt, Homo sapiens
gcacagauguuccc

SEQ ID NO: 1154725 - RNA, 16 nt, Homo sapiens
gcacagcagcaauugu

SEQ ID NO: 1154726 - RNA, 22 nt, Homo sapiens
gcacaggaguguccucuucccu

SEQ ID NO: 1154727 - RNA, 15 nt, Homo sapiens
gcacaggucaggggu

SEQ ID NO: 1154728 - RNA, 19 nt, Homo sapiens
gcacaggucccacugcccu

SEQ ID NO: 1154729 - RNA, 17 nt, Homo sapiens
gcacaguacauaauaca

SEQ ID NO: 1154730 - RNA, 18 nt, Homo sapiens
gcacaguggccccaucau

SEQ ID NO: 1154731 - RNA, 12 nt, Homo sapiens
gcacaguuugaa

SEQ ID NO: 1154732 - RNA, 21 nt, Homo sapiens
gcacauagugggccuucauua

SEQ ID NO: 1154733 - RNA, 18 nt, Homo sapiens
gcacauaucuccucuugg

SEQ ID NO: 1154734 - RNA, 21 nt, Homo sapiens
gcacauauggacucugcacau

SEQ ID NO: 1154735 - RNA, 17 nt, Homo sapiens
gcacaugcaccuaccca

SEQ ID NO: 1154736 - RNA, 16 nt, Homo sapiens
gcaccauuccucaaga

SEQ ID NO: 1154737 - RNA, 18 nt, Homo sapiens
gcacccagcccagauugu

SEQ ID NO: 1154738 - RNA, 13 nt, Homo sapiens
gcaccccacugca

SEQ ID NO: 1154739 - RNA, 15 nt, Homo sapiens
gcacccucuccagau

SEQ ID NO: 1154740 - RNA, 16 nt, Homo sapiens
gcaccguucugugcac

SEQ ID NO: 1154741 - RNA, 18 nt, Homo sapiens
gcaccguucugugcacaa

SEQ ID NO: 1154742 - RNA, 15 nt, Homo sapiens
gcaccuaauccaggc

SEQ ID NO: 1154743 - RNA, 21 nt, Homo sapiens
gcaccuaauccaggcagaucc

SEQ ID NO: 1154744 - RNA, 14 nt, Homo sapiens
gcaccucaagaaga

SEQ ID NO: 1154745 - RNA, 17 nt, Homo sapiens
gcaccucuccugugagu

SEQ ID NO: 1154746 - RNA, 19 nt, Homo sapiens
gcaccugccucagcuaccu

SEQ ID NO: 1154747 - RNA, 13 nt, Homo sapiens
gcaccugcgcaca

SEQ ID NO: 1154748 - RNA, 12 nt, Homo sapiens
gcaccugucuga

SEQ ID NO: 1154749 - RNA, 24 nt, Homo sapiens
gcaccuugugucuguacacguguc

SEQ ID NO: 1154750 - RNA, 17 nt, Homo sapiens
gcacggaucacgaugua

SEQ ID NO: 1154751 - RNA, 19 nt, Homo sapiens
gcacggccaccucucaggg

SEQ ID NO: 1154752 - RNA, 13 nt, Homo sapiens
gcacgucaaagag

SEQ ID NO: 1154753 - RNA, 20 nt, Homo sapiens
gcacuaaagaauacauuuaa

SEQ ID NO: 1154754 - RNA, 16 nt, Homo sapiens
gcacuaaugcuuuaag

SEQ ID NO: 1154755 - RNA, 21 nt, Homo sapiens
gcacuacauucauuuagcuaa

SEQ ID NO: 1154756 - RNA, 13 nt, Homo sapiens
gcacuauguauau

SEQ ID NO: 1154757 - RNA, 18 nt, Homo sapiens
gcacucccuccagcacaa

SEQ ID NO: 1154758 - RNA, 17 nt, Homo sapiens
gcacugagaaagccaau

SEQ ID NO: 1154759 - RNA, 22 nt, Homo sapiens
gcacugauaucaucgauuagaa

SEQ ID NO: 1154760 - RNA, 20 nt, Homo sapiens
gcacugaugcugccccucau

SEQ ID NO: 1154761 - RNA, 20 nt, Homo sapiens
gcacuggauaaacaaaggua

SEQ ID NO: 1154762 - RNA, 17 nt, Homo sapiens
gcacuggccacccaagg

SEQ ID NO: 1154763 - RNA, 15 nt, Homo sapiens
gcacugggagccaug

SEQ ID NO: 1154764 - RNA, 18 nt, Homo sapiens
gcacugguguugagcaau

SEQ ID NO: 1154765 - RNA, 17 nt, Homo sapiens
gcacugucugaagcaau

SEQ ID NO: 1154766 - RNA, 18 nt, Homo sapiens
gcacugugccuacaggug

SEQ ID NO: 1154767 - RNA, 16 nt, Homo sapiens
agcacuguuucucuca

SEQ ID NO: 1154768 - RNA, 23 nt, Homo sapiens
agcacuuugggaggccaaggugg

SEQ ID NO: 1154769 - RNA, 22 nt, Homo sapiens
agcagaaaccaagucuacuuca

SEQ ID NO: 1154770 - RNA, 22 nt, Homo sapiens
agcagaaaguaagcauuuccag

SEQ ID NO: 1154771 - RNA, 14 nt, Homo sapiens
agcagaacagccau

SEQ ID NO: 1154772 - RNA, 15 nt, Homo sapiens
agcagaacuucugaa

SEQ ID NO: 1154773 - RNA, 18 nt, Homo sapiens
agcagaauacaaugggaa

SEQ ID NO: 1154774 - RNA, 18 nt, Homo sapiens
agcagaaucucagagaaa

SEQ ID NO: 1154775 - RNA, 13 nt, Homo sapiens
agcagaaugccuu

SEQ ID NO: 1154776 - RNA, 13 nt, Homo sapiens
agcagagacuuua

SEQ ID NO: 1154777 - RNA, 15 nt, Homo sapiens
agcagagacuuuagu

SEQ ID NO: 1154778 - RNA, 15 nt, Homo sapiens
agcagagagcacagc

SEQ ID NO: 1154779 - RNA, 22 nt, Homo sapiens
agcagagaguccaauuuauuga

SEQ ID NO: 1154780 - RNA, 23 nt, Homo sapiens
agcagagcaaaaugcucuugucc

SEQ ID NO: 1154781 - RNA, 19 nt, Homo sapiens
agcagaggcccuucaccca

SEQ ID NO: 1154782 - RNA, 17 nt, Homo sapiens
agcagaguucuuugcaa

SEQ ID NO: 1154783 - RNA, 15 nt, Homo sapiens
agcagauacugcugu

SEQ ID NO: 1154784 - RNA, 13 nt, Homo sapiens
agcagcacuggaa

SEQ ID NO: 1154785 - RNA, 18 nt, Homo sapiens
agcagcauaggaacaaua

SEQ ID NO: 1154786 - RNA, 13 nt, Homo sapiens
agcagccaggagg

SEQ ID NO: 1154787 - RNA, 18 nt, Homo sapiens
agcagcccagcauuuccc

SEQ ID NO: 1154788 - RNA, 16 nt, Homo sapiens
agcagcccuuuuuaca

SEQ ID NO: 1154789 - RNA, 22 nt, Homo sapiens
agcagcucaaaggcacagugaa

SEQ ID NO: 1154790 - RNA, 20 nt, Homo sapiens
agcagcucacacccuaccuu

SEQ ID NO: 1154791 - RNA, 16 nt, Homo sapiens
agcaggaaugcucuga

SEQ ID NO: 1154792 - RNA, 14 nt, Homo sapiens
agcaggauuucuca

SEQ ID NO: 1154793 - RNA, 23 nt, Homo sapiens
agcagggaguacccagugccuac

SEQ ID NO: 1154794 - RNA, 17 nt, Homo sapiens
agcaggucuuucacuca

SEQ ID NO: 1154795 - RNA, 22 nt, Homo sapiens
agcaggugcugacuucaucucc

SEQ ID NO: 1154796 - RNA, 16 nt, Homo sapiens
agcagguuaagaauuu

SEQ ID NO: 1154797 - RNA, 20 nt, Homo sapiens
agcagguuaccacucuggca

SEQ ID NO: 1154798 - RNA, 16 nt, Homo sapiens
agcaguccccagugau

SEQ ID NO: 1154799 - RNA, 13 nt, Homo sapiens
agcagucuugcuc

SEQ ID NO: 1154800 - RNA, 13 nt, Homo sapiens
agcagugcacauc

SEQ ID NO: 1154801 - RNA, 20 nt, Homo sapiens
agcaguuaguuccuucauga

SEQ ID NO: 1154802 - RNA, 15 nt, Homo sapiens
agcaucaacaagugg

SEQ ID NO: 1154803 - RNA, 18 nt, Homo sapiens
agcauccaaguggcauaa

SEQ ID NO: 1154804 - RNA, 18 nt, Homo sapiens
agcaucccuaauucuuca

SEQ ID NO: 1154805 - RNA, 12 nt, Homo sapiens
agcaucuaagaa

SEQ ID NO: 1154806 - RNA, 21 nt, Homo sapiens
agcaucuaaguuauaagacuc

SEQ ID NO: 1154807 - RNA, 21 nt, Homo sapiens
agcaucucuggccuguaccca

SEQ ID NO: 1154808 - RNA, 16 nt, Homo sapiens
agcaucugaccaucug

SEQ ID NO: 1154809 - RNA, 20 nt, Homo sapiens
agcaugaaaguggacaagga

SEQ ID NO: 1154810 - RNA, 16 nt, Homo sapiens
agcaugccuucaaauc

SEQ ID NO: 1154811 - RNA, 14 nt, Homo sapiens
agcauguaccccag

SEQ ID NO: 1154812 - RNA, 16 nt, Homo sapiens
agcaugucgucaaagc

SEQ ID NO: 1154813 - RNA, 17 nt, Homo sapiens
agcaugugucaugcaug

SEQ ID NO: 1154814 - RNA, 19 nt, Homo sapiens
agcauuaaaauaacuauca

SEQ ID NO: 1154815 - RNA, 14 nt, Homo sapiens
agcauuacaguauu

SEQ ID NO: 1154816 - RNA, 22 nt, Homo sapiens
agcauuauuuuuuguugaauag

SEQ ID NO: 1154817 - RNA, 15 nt, Homo sapiens
agcauucuggcaguu

SEQ ID NO: 1154818 - RNA, 23 nt, Homo sapiens
agcauuggauacagcaguagaca

SEQ ID NO: 1154819 - RNA, 16 nt, Homo sapiens
agcauuuagugcacag

SEQ ID NO: 1154820 - RNA, 21 nt, Homo sapiens
agcauuuccagccuaucuaau

SEQ ID NO: 1154821 - RNA, 12 nt, Homo sapiens
agcuguuccucc

SEQ ID NO: 1154822 - RNA, 17 nt, Homo sapiens
agcuguucucauuccug

SEQ ID NO: 1154823 - RNA, 12 nt, Homo sapiens
agcuguucucug

SEQ ID NO: 1154824 - RNA, 22 nt, Homo sapiens
agcuuaaacagcuggucagccc

SEQ ID NO: 1154825 - RNA, 17 nt, Homo sapiens
agcuuaaaucauggguc

SEQ ID NO: 1154826 - RNA, 21 nt, Homo sapiens
agcuuacauugaaaacagaua

SEQ ID NO: 1154827 - RNA, 18 nt, Homo sapiens
agcuuagacuaaggccau

SEQ ID NO: 1154828 - RNA, 22 nt, Homo sapiens
agcuuaggggcugcugaccucc

SEQ ID NO: 1154829 - RNA, 17 nt, Homo sapiens
agcuuaucucuuuuaua

SEQ ID NO: 1154830 - RNA, 21 nt, Homo sapiens
agcuucauauaccagcaauau

SEQ ID NO: 1154831 - RNA, 14 nt, Homo sapiens
agcuucccuacucc

SEQ ID NO: 1154832 - RNA, 18 nt, Homo sapiens
agcuucucagccuuccua

SEQ ID NO: 1154833 - RNA, 18 nt, Homo sapiens
agcuucugcccaccuacu

SEQ ID NO: 1154834 - RNA, 22 nt, Homo sapiens
agcuugaauauuguuuuugcac

SEQ ID NO: 1154835 - RNA, 17 nt, Homo sapiens
agcuugcuuaaggcaua

SEQ ID NO: 1154836 - RNA, 22 nt, Homo sapiens
agcuugcuuuuaagagcaaugu

SEQ ID NO: 1154837 - RNA, 18 nt, Homo sapiens
agcuuggggccagggaag

SEQ ID NO: 1154838 - RNA, 17 nt, Homo sapiens
agcuugguaugagacag

SEQ ID NO: 1154839 - RNA, 22 nt, Homo sapiens
agcuuguuuuauuuugugcuau

SEQ ID NO: 1154840 - RNA, 22 nt, Homo sapiens
agcuuuaauguuacauaguaaa

SEQ ID NO: 1154841 - RNA, 13 nt, Homo sapiens
agcuuuacgcuca

SEQ ID NO: 1154842 - RNA, 13 nt, Homo sapiens
agcuuuacugugg

SEQ ID NO: 1154843 - RNA, 19 nt, Homo sapiens
agcuuucugccuuagccua

SEQ ID NO: 1154844 - RNA, 12 nt, Homo sapiens
agcuuugcugcu

SEQ ID NO: 1154845 - RNA, 15 nt, Homo sapiens
agcuuuuggucauca

SEQ ID NO: 1154846 - RNA, 17 nt, Homo sapiens
aggaaaaaaacuauuaa

SEQ ID NO: 1154847 - RNA, 16 nt, Homo sapiens
aggaaaaaugaguaau

SEQ ID NO: 1154848 - RNA, 21 nt, Homo sapiens
aggaaaacuaccuguauuuaa

SEQ ID NO: 1154849 - RNA, 13 nt, Homo sapiens
aggaaaagcacaa

SEQ ID NO: 1154850 - RNA, 19 nt, Homo sapiens
aggaaaagcggacaucagc

SEQ ID NO: 1154851 - RNA, 16 nt, Homo sapiens
aggaaaauaaugacau

SEQ ID NO: 1154852 - RNA, 13 nt, Homo sapiens
aggaaacaacagc

SEQ ID NO: 1154853 - RNA, 22 nt, Homo sapiens
aggaaacaaggggucugaggau

SEQ ID NO: 1154854 - RNA, 13 nt, Homo sapiens
aggaaacacuggc

SEQ ID NO: 1154855 - RNA, 12 nt, Homo sapiens
aggaaacaguua

SEQ ID NO: 1154856 - RNA, 17 nt, Homo sapiens
aggaaacccccagugua

SEQ ID NO: 1154857 - RNA, 16 nt, Homo sapiens
aggaaacgcuaccucu

SEQ ID NO: 1154858 - RNA, 21 nt, Homo sapiens
aggaaagugauuuuuuuccac

SEQ ID NO: 1154859 - RNA, 13 nt, Homo sapiens
aggaaauaaagua

SEQ ID NO: 1154860 - RNA, 23 nt, Homo sapiens
aggaaauaguaccuucaauacuu

SEQ ID NO: 1154861 - RNA, 20 nt, Homo sapiens
aggaaauauaucuuaaugca

SEQ ID NO: 1154862 - RNA, 19 nt, Homo sapiens
aggaaaucagccuuucauc

SEQ ID NO: 1154863 - RNA, 11 nt, Homo sapiens
aggaaauccaa

SEQ ID NO: 1154864 - RNA, 23 nt, Homo sapiens
aggaaauccauucacaguucuuu

SEQ ID NO: 1154865 - RNA, 13 nt, Homo sapiens
aggaaauggcugu

SEQ ID NO: 1154866 - RNA, 18 nt, Homo sapiens
aggaacacccccaugaca

SEQ ID NO: 1154867 - RNA, 23 nt, Homo sapiens
aggaacacccccaugacauugca

SEQ ID NO: 1154868 - RNA, 12 nt, Homo sapiens
aggaacagggaa

SEQ ID NO: 1154869 - RNA, 19 nt, Homo sapiens
aggaaccaaagcgaauuuu

SEQ ID NO: 1154870 - RNA, 18 nt, Homo sapiens
aggaaccaaauuuaagac

SEQ ID NO: 1154871 - RNA, 14 nt, Homo sapiens
aggaaccauuuuca

SEQ ID NO: 1154872 - RNA, 20 nt, Homo sapiens
aggaaccucgaguacugugg

SEQ ID NO: 1154873 - RNA, 22 nt, Homo sapiens
aggaacucuggccacccaaaca

SEQ ID NO: 1154874 - RNA, 13 nt, Homo sapiens
aggaacuucugaa

SEQ ID NO: 1154875 - RNA, 15 nt, Homo sapiens
aggaagagagacaga

SEQ ID NO: 1154876 - RNA, 22 nt, Homo sapiens
aggaagaugcucaucugagcca

SEQ ID NO: 1154877 - RNA, 11 nt, Homo sapiens
aggaagcccac

SEQ ID NO: 1154878 - RNA, 14 nt, Homo sapiens
aggaagcucagacu

SEQ ID NO: 1154879 - RNA, 18 nt, Homo sapiens
aggaaggacuaugacaaa

SEQ ID NO: 1154880 - RNA, 19 nt, Homo sapiens
aggaaggcuuguugugcuu

SEQ ID NO: 1154881 - RNA, 17 nt, Homo sapiens
aggaaguaucagcacua

SEQ ID NO: 1154882 - RNA, 18 nt, Homo sapiens
auuaaggauguagcuuuu

SEQ ID NO: 1154883 - RNA, 22 nt, Homo sapiens
auuaaggcagcucauccaagcu

SEQ ID NO: 1154884 - RNA, 16 nt, Homo sapiens
auuaagguguggcuuu

SEQ ID NO: 1154885 - RNA, 22 nt, Homo sapiens
auuaauagaacacagagugugu

SEQ ID NO: 1154886 - RNA, 15 nt, Homo sapiens
auuaaucaaguaccu

SEQ ID NO: 1154887 - RNA, 18 nt, Homo sapiens
auuaaucagcuguugcag

SEQ ID NO: 1154888 - RNA, 19 nt, Homo sapiens
auuaaugaaaagcagauug

SEQ ID NO: 1154889 - RNA, 15 nt, Homo sapiens
auuaaugcacuuucu

SEQ ID NO: 1154890 - RNA, 18 nt, Homo sapiens
auuaauuacuucacuaua

SEQ ID NO: 1154891 - RNA, 20 nt, Homo sapiens
auuaauucuauaaggccaua

SEQ ID NO: 1154892 - RNA, 13 nt, Homo sapiens
auuacaacuaagu

SEQ ID NO: 1154893 - RNA, 17 nt, Homo sapiens
auuacacuccagccuga

SEQ ID NO: 1154894 - RNA, 21 nt, Homo sapiens
auuacagaaacugaugccaag

SEQ ID NO: 1154895 - RNA, 15 nt, Homo sapiens
auuacaggcaccugc

SEQ ID NO: 1154896 - RNA, 17 nt, Homo sapiens
auuacaggcgugagcca

SEQ ID NO: 1154897 - RNA, 17 nt, Homo sapiens
auuacaggcgugaucca

SEQ ID NO: 1154898 - RNA, 14 nt, Homo sapiens
auuacauuuagucu

SEQ ID NO: 1154899 - RNA, 12 nt, Homo sapiens
auuacccuccua

SEQ ID NO: 1154900 - RNA, 24 nt, Homo sapiens
auuacccuuccucaucugugccug

SEQ ID NO: 1154901 - RNA, 16 nt, Homo sapiens
auuaccuccugagaaa

SEQ ID NO: 1154902 - RNA, 15 nt, Homo sapiens
auuacuaucauggca

SEQ ID NO: 1154903 - RNA, 14 nt, Homo sapiens
auuacugcauaaaa

SEQ ID NO: 1154904 - RNA, 16 nt, Homo sapiens
auuacuguauauacuu

SEQ ID NO: 1154905 - RNA, 15 nt, Homo sapiens
auuacuuuucaucua

SEQ ID NO: 1154906 - RNA, 23 nt, Homo sapiens
auuacuuuugauccugggggacc

SEQ ID NO: 1154907 - RNA, 19 nt, Homo sapiens
auuagaaaaauagcaacuu

SEQ ID NO: 1154908 - RNA, 15 nt, Homo sapiens
auuagaaucugagua

SEQ ID NO: 1154909 - RNA, 16 nt, Homo sapiens
auuagaguauuuucca

SEQ ID NO: 1154910 - RNA, 20 nt, Homo sapiens
auuagcccuuccuugccagu

SEQ ID NO: 1154911 - RNA, 22 nt, Homo sapiens
auuagcccuuccuugccaguga

SEQ ID NO: 1154912 - RNA, 23 nt, Homo sapiens
auuagcccuuccuugccagugag

SEQ ID NO: 1154913 - RNA, 18 nt, Homo sapiens
auuagccgggcauggugg

SEQ ID NO: 1154914 - RNA, 19 nt, Homo sapiens
auuagccgucccagugaaa

SEQ ID NO: 1154915 - RNA, 18 nt, Homo sapiens
auuuuguguuccuaucaa

SEQ ID NO: 1154916 - RNA, 17 nt, Homo sapiens
auuuuuaaaggacaaac

SEQ ID NO: 1154917 - RNA, 19 nt, Homo sapiens
auuuuuaaggauguugcca

SEQ ID NO: 1154918 - RNA, 21 nt, Homo sapiens
auuuuuaauuuaaaaaagcaa

SEQ ID NO: 1154919 - RNA, 13 nt, Homo sapiens
auuuuuacugugu

SEQ ID NO: 1154920 - RNA, 18 nt, Homo sapiens
auuuuuagaaaucagcua

SEQ ID NO: 1154921 - RNA, 22 nt, Homo sapiens
auuuuuauaaaaaugagugcuu

SEQ ID NO: 1154922 - RNA, 17 nt, Homo sapiens
auuuuucacugccccag

SEQ ID NO: 1154923 - RNA, 15 nt, Homo sapiens
auuuuucagcuauuu

SEQ ID NO: 1154924 - RNA, 22 nt, Homo sapiens
auuuuucuaaacguaagcacug

SEQ ID NO: 1154925 - RNA, 12 nt, Homo sapiens
auuuuucuacuu

SEQ ID NO: 1154926 - RNA, 15 nt, Homo sapiens
auuuuugaaaacugg

SEQ ID NO: 1154927 - RNA, 23 nt, Homo sapiens
auuuuugaauugagaugaucaau

SEQ ID NO: 1154928 - RNA, 19 nt, Homo sapiens
auuuuugccacguuuaaca

SEQ ID NO: 1154929 - RNA, 22 nt, Homo sapiens
auuuuugcccagaaaguccagc

SEQ ID NO: 1154930 - RNA, 22 nt, Homo sapiens
auuuuuguguauccaguaugca

SEQ ID NO: 1154931 - RNA, 17 nt, Homo sapiens
auuuuuuaaggaaacaa

SEQ ID NO: 1154932 - RNA, 14 nt, Homo sapiens
auuuuuucccccac

SEQ ID NO: 1154933 - RNA, 17 nt, Homo sapiens
auuuuuucuugcauuga

SEQ ID NO: 1154934 - RNA, 19 nt, Homo sapiens
auuuuuucuuuaucaagga

SEQ ID NO: 1154935 - RNA, 14 nt, Homo sapiens
auuuuuugucuguu

SEQ ID NO: 1154936 - RNA, 14 nt, Homo sapiens
auuuuuuucuacau

SEQ ID NO: 1154937 - RNA, 23 nt, Homo sapiens
caaaaaaaaaaaaaaauuacaaa

SEQ ID NO: 1154938 - RNA, 16 nt, Homo sapiens
caaaaaaaacaacaaa

SEQ ID NO: 1154939 - RNA, 15 nt, Homo sapiens
caaaaaaagcacaaa

SEQ ID NO: 1154940 - RNA, 22 nt, Homo sapiens
caaaaaaaguuuguuacuuuga

SEQ ID NO: 1154941 - RNA, 23 nt, Homo sapiens
caaaaaaaguuuguuacuuugaa

SEQ ID NO: 1154942 - RNA, 22 nt, Homo sapiens
caaaaaaauacugccagaugcu

SEQ ID NO: 1154943 - RNA, 19 nt, Homo sapiens
caaaaaaauuaaaauggau

SEQ ID NO: 1154944 - RNA, 13 nt, Homo sapiens
caaaaaauuugag

SEQ ID NO: 1154945 - RNA, 21 nt, Homo sapiens
caaaaacagcagaacuucuga

SEQ ID NO: 1154946 - RNA, 21 nt, Homo sapiens
caaaaacagcuggacuuauuu

SEQ ID NO: 1154947 - RNA, 15 nt, Homo sapiens
caaaaagaagacauu

SEQ ID NO: 1154948 - RNA, 16 nt, Homo sapiens
caaaaagagcagcaca

SEQ ID NO: 1154949 - RNA, 15 nt, Homo sapiens
caaaaaugcacccaa

SEQ ID NO: 1154950 - RNA, 22 nt, Homo sapiens
caaaaaugcacccaacuagcuc

SEQ ID NO: 1154951 - RNA, 11 nt, Homo sapiens
caaaaauugac

SEQ ID NO: 1154952 - RNA, 21 nt, Homo sapiens
caaaaauuuuuuaaauucaua

SEQ ID NO: 1154953 - RNA, 15 nt, Homo sapiens
caaaacacaaacugu

SEQ ID NO: 1154954 - RNA, 17 nt, Homo sapiens
caaaacagaaaaugaag

SEQ ID NO: 1154955 - RNA, 14 nt, Homo sapiens
caaaaccuugcaca

SEQ ID NO: 1154956 - RNA, 15 nt, Homo sapiens
caaaacuacaugaga

SEQ ID NO: 1154957 - RNA, 15 nt, Homo sapiens
caaaacugcauuuca

SEQ ID NO: 1154958 - RNA, 15 nt, Homo sapiens
caaaacuugggaaua

SEQ ID NO: 1154959 - RNA, 14 nt, Homo sapiens
caaaagcugcucag

SEQ ID NO: 1154960 - RNA, 20 nt, Homo sapiens
caaaagcugcucagggaaaa

SEQ ID NO: 1154961 - RNA, 12 nt, Homo sapiens
caaaagcuuuuu

SEQ ID NO: 1154962 - RNA, 20 nt, Homo sapiens
caaaaggaaagaaacuaccu

SEQ ID NO: 1154963 - RNA, 21 nt, Homo sapiens
caaaaguagccaucauuccuu

SEQ ID NO: 1154964 - RNA, 16 nt, Homo sapiens
caaaagucuggccuuu

SEQ ID NO: 1154965 - RNA, 21 nt, Homo sapiens
caaaaguggggcuaaaugaag

SEQ ID NO: 1154966 - RNA, 17 nt, Homo sapiens
caaaauaaagugacaga

SEQ ID NO: 1154967 - RNA, 17 nt, Homo sapiens
caaaauaaauguuuaaa

SEQ ID NO: 1154968 - RNA, 19 nt, Homo sapiens
caaaauaggauuucuuaaa

SEQ ID NO: 1154969 - RNA, 15 nt, Homo sapiens
caaaauauacauuca

SEQ ID NO: 1154970 - RNA, 13 nt, Homo sapiens
caaaaucuuuuca

SEQ ID NO: 1154971 - RNA, 20 nt, Homo sapiens
caaaauggacucaagagaga

SEQ ID NO: 1154972 - RNA, 19 nt, Homo sapiens
caaaaugggccucauggaa

SEQ ID NO: 1154973 - RNA, 15 nt, Homo sapiens
caaaaugugaacuuc

SEQ ID NO: 1154974 - RNA, 16 nt, Homo sapiens
caaaauuaauagcuuu

SEQ ID NO: 1154975 - RNA, 12 nt, Homo sapiens
caaaauugcuaa

SEQ ID NO: 1154976 - RNA, 17 nt, Homo sapiens
caaaauuugggggaaaa

SEQ ID NO: 1154977 - RNA, 18 nt, Homo sapiens
caaaauuuuucaacccca

SEQ ID NO: 1154978 - RNA, 20 nt, Homo sapiens
caaacaaagccagaagcuga

SEQ ID NO: 1154979 - RNA, 17 nt, Homo sapiens
caaacaauaugcuccug

SEQ ID NO: 1154980 - RNA, 19 nt, Homo sapiens
caaacacugugauuacucu

SEQ ID NO: 1154981 - RNA, 19 nt, Homo sapiens
caaacagcaaaccaagaga

SEQ ID NO: 1154982 - RNA, 20 nt, Homo sapiens
caaacagcaaaccaagagau

SEQ ID NO: 1154983 - RNA, 11 nt, Homo sapiens
caaacagugaa

SEQ ID NO: 1154984 - RNA, 11 nt, Homo sapiens
caaacauauau

SEQ ID NO: 1154985 - RNA, 19 nt, Homo sapiens
caaaccaagagauugcuaa

SEQ ID NO: 1154986 - RNA, 19 nt, Homo sapiens
caaaccuguagaugcagaa

SEQ ID NO: 1154987 - RNA, 14 nt, Homo sapiens
caaaccuuugccaa

SEQ ID NO: 1154988 - RNA, 17 nt, Homo sapiens
caaacgcccuuuccucc

SEQ ID NO: 1154989 - RNA, 22 nt, Homo sapiens
caaacggaguacagacgucuca

SEQ ID NO: 1154990 - RNA, 15 nt, Homo sapiens
caaacguguagccaa

SEQ ID NO: 1154991 - RNA, 12 nt, Homo sapiens
caaacuacugug

SEQ ID NO: 1154992 - RNA, 17 nt, Homo sapiens
caaacuccugaccucaa

SEQ ID NO: 1154993 - RNA, 17 nt, Homo sapiens
caaacucuccaccacac

SEQ ID NO: 1154994 - RNA, 22 nt, Homo sapiens
caaacugggaugaaacuaaagc

SEQ ID NO: 1154995 - RNA, 23 nt, Homo sapiens
caaacugggaugaaacuaaagca

SEQ ID NO: 1154996 - RNA, 23 nt, Homo sapiens
caaacuggggccuccagaacuca

SEQ ID NO: 1154997 - RNA, 21 nt, Homo sapiens
caaacuggugugugccucauu

SEQ ID NO: 1154998 - RNA, 20 nt, Homo sapiens
caaacuguagaaaugaugau

SEQ ID NO: 1154999 - RNA, 16 nt, Homo sapiens
caaacuguaguuguuu

SEQ ID NO: 1155000 - RNA, 20 nt, Homo sapiens
caaacuucuguguacugggu

SEQ ID NO: 1155001 - RNA, 16 nt, Homo sapiens
caaacuuuuauacucu

SEQ ID NO: 1155002 - RNA, 23 nt, Homo sapiens
caaagaaccuucucuauggggca

SEQ ID NO: 1155003 - RNA, 21 nt, Homo sapiens
caaagaacuucuccuacugua

SEQ ID NO: 1155004 - RNA, 22 nt, Homo sapiens
caaagaacuucuccuacuguag

SEQ ID NO: 1155005 - RNA, 22 nt, Homo sapiens
caaagaaugaaacaauccaaaa

SEQ ID NO: 1155006 - RNA, 22 nt, Homo sapiens
caaagaauuaugcaucugcuac

SEQ ID NO: 1155007 - RNA, 24 nt, Homo sapiens
caaagaauugauucauguucauca

SEQ ID NO: 1155008 - RNA, 15 nt, Homo sapiens
caaagacuucuguca

SEQ ID NO: 1155009 - RNA, 16 nt, Homo sapiens
caaagaggcuccagaa

SEQ ID NO: 1155010 - RNA, 17 nt, Homo sapiens
caaagaggcuccagaaa

SEQ ID NO: 1155011 - RNA, 22 nt, Homo sapiens
caaagaguauguuguaagaaag

SEQ ID NO: 1155012 - RNA, 14 nt, Homo sapiens
caaagagugaagga

SEQ ID NO: 1155013 - RNA, 11 nt, Homo sapiens
caaagaugacc

SEQ ID NO: 1155014 - RNA, 14 nt, Homo sapiens
caaagaugacugug

SEQ ID NO: 1155015 - RNA, 17 nt, Homo sapiens
caaagauguggguggca

SEQ ID NO: 1155016 - RNA, 13 nt, Homo sapiens
caaagauguucau

SEQ ID NO: 1155017 - RNA, 21 nt, Homo sapiens
caaagcaacauggcagagcag

SEQ ID NO: 1155018 - RNA, 23 nt, Homo sapiens
caaagcaaggaaacuauguaaca

SEQ ID NO: 1155019 - RNA, 16 nt, Homo sapiens
caaagcaaggagauca

SEQ ID NO: 1155020 - RNA, 19 nt, Homo sapiens
caaagcacuguuucucuca

SEQ ID NO: 1155021 - RNA, 20 nt, Homo sapiens
caaagcacuguuucucucac

SEQ ID NO: 1155022 - RNA, 21 nt, Homo sapiens
caaagcaggaguggaagguga

SEQ ID NO: 1155023 - RNA, 21 nt, Homo sapiens
caaagccaacgaagugccaga

SEQ ID NO: 1155024 - RNA, 14 nt, Homo sapiens
caucccuagucucu

SEQ ID NO: 1155025 - RNA, 15 nt, Homo sapiens
caucccuggaaggac

SEQ ID NO: 1155026 - RNA, 20 nt, Homo sapiens
cauccgcaaauuuucuucca

SEQ ID NO: 1155027 - RNA, 17 nt, Homo sapiens
cauccgugcuaugacau

SEQ ID NO: 1155028 - RNA, 17 nt, Homo sapiens
cauccuagucucuauca

SEQ ID NO: 1155029 - RNA, 16 nt, Homo sapiens
cauccugaacagcaug

SEQ ID NO: 1155030 - RNA, 15 nt, Homo sapiens
cauccugcucaggaa

SEQ ID NO: 1155031 - RNA, 22 nt, Homo sapiens
cauccugcucaggaaaccacaa

SEQ ID NO: 1155032 - RNA, 15 nt, Homo sapiens
cauccugugaagucc

SEQ ID NO: 1155033 - RNA, 15 nt, Homo sapiens
cauccuugacuccuu

SEQ ID NO: 1155034 - RNA, 22 nt, Homo sapiens
caucgaaucuacuaauuccaca

SEQ ID NO: 1155035 - RNA, 21 nt, Homo sapiens
caucgcaguguucaaggccau

SEQ ID NO: 1155036 - RNA, 22 nt, Homo sapiens
caucuaaccucaucuucuucac

SEQ ID NO: 1155037 - RNA, 13 nt, Homo sapiens
caucuaagccuga

SEQ ID NO: 1155038 - RNA, 19 nt, Homo sapiens
caucuagcgcaauugaagg

SEQ ID NO: 1155039 - RNA, 13 nt, Homo sapiens
caucuagugacaa

SEQ ID NO: 1155040 - RNA, 13 nt, Homo sapiens
caucuauggugug

SEQ ID NO: 1155041 - RNA, 19 nt, Homo sapiens
caucuauucucuccaaaaa

SEQ ID NO: 1155042 - RNA, 12 nt, Homo sapiens
caucucaugccc

SEQ ID NO: 1155043 - RNA, 16 nt, Homo sapiens
caucuccauguagaau

SEQ ID NO: 1155044 - RNA, 23 nt, Homo sapiens
caucucuaacauaugauacugau

SEQ ID NO: 1155045 - RNA, 12 nt, Homo sapiens
caucucuacuaa

SEQ ID NO: 1155046 - RNA, 22 nt, Homo sapiens
caucucugcauuuauccuauau

SEQ ID NO: 1155047 - RNA, 16 nt, Homo sapiens
caucucugguucaagg

SEQ ID NO: 1155048 - RNA, 13 nt, Homo sapiens
caucucuuucuac

SEQ ID NO: 1155049 - RNA, 11 nt, Homo sapiens
caucugaccau

SEQ ID NO: 1155050 - RNA, 17 nt, Homo sapiens
caucugaccaucuguga

SEQ ID NO: 1155051 - RNA, 18 nt, Homo sapiens
caucugaccaucugugac

SEQ ID NO: 1155052 - RNA, 18 nt, Homo sapiens
caucugauaaaguugaga

SEQ ID NO: 1155053 - RNA, 22 nt, Homo sapiens
caucugcaaaggaaucacuuua

SEQ ID NO: 1155054 - RNA, 11 nt, Homo sapiens
caucugcaaua

SEQ ID NO: 1155055 - RNA, 21 nt, Homo sapiens
caucugcauugcccagucuuu

SEQ ID NO: 1155056 - RNA, 22 nt, Homo sapiens
caucugccaacuguccuacuca

SEQ ID NO: 1155057 - RNA, 17 nt, Homo sapiens
caucugcccaacugugu

SEQ ID NO: 1155058 - RNA, 15 nt, Homo sapiens
caucugcgaacccaa

SEQ ID NO: 1155059 - RNA, 15 nt, Homo sapiens
caucugcgugacaau

SEQ ID NO: 1155060 - RNA, 15 nt, Homo sapiens
caucugcugcacaua

SEQ ID NO: 1155061 - RNA, 18 nt, Homo sapiens
caucuggaauuccagucu

SEQ ID NO: 1155062 - RNA, 20 nt, Homo sapiens
caucuggcccaagugaagca

SEQ ID NO: 1155063 - RNA, 20 nt, Homo sapiens
caucugggaaagacauccau

SEQ ID NO: 1155064 - RNA, 11 nt, Homo sapiens
caucuuagucu

SEQ ID NO: 1155065 - RNA, 15 nt, Homo sapiens
caucuuagucuuacc

SEQ ID NO: 1155066 - RNA, 17 nt, Homo sapiens
caucuuagucuuaccuu

SEQ ID NO: 1155067 - RNA, 20 nt, Homo sapiens
caucuuauuucugucaacuu

SEQ ID NO: 1155068 - RNA, 15 nt, Homo sapiens
caucuuccaccucac

SEQ ID NO: 1155069 - RNA, 16 nt, Homo sapiens
caucuucccacagugg

SEQ ID NO: 1155070 - RNA, 21 nt, Homo sapiens
caucuugaccaagcaggaagc

SEQ ID NO: 1155071 - RNA, 15 nt, Homo sapiens
caucuuuaacacagc

SEQ ID NO: 1155072 - RNA, 22 nt, Homo sapiens
caucuuuacaaaacuacaugag

SEQ ID NO: 1155073 - RNA, 21 nt, Homo sapiens
caucuuucuuccaaacaggcu

SEQ ID NO: 1155074 - RNA, 17 nt, Homo sapiens
caucuuuuaaucaugag

SEQ ID NO: 1155075 - RNA, 16 nt, Homo sapiens
caucuuuuugugugca

SEQ ID NO: 1155076 - RNA, 18 nt, Homo sapiens
caugaaaaaaaugauccc

SEQ ID NO: 1155077 - RNA, 21 nt, Homo sapiens
caugaaaaguuauuuaugcua

SEQ ID NO: 1155078 - RNA, 16 nt, Homo sapiens
caugaacucauuucca

SEQ ID NO: 1155079 - RNA, 12 nt, Homo sapiens
caugaacugucu

SEQ ID NO: 1155080 - RNA, 18 nt, Homo sapiens
caugaagaaauacugcac

SEQ ID NO: 1155081 - RNA, 12 nt, Homo sapiens
caugaagccuug

SEQ ID NO: 1155082 - RNA, 21 nt, Homo sapiens
caugaaggauaaaagccccaa

SEQ ID NO: 1155083 - RNA, 10 nt, Homo sapiens
caugaaggug

SEQ ID NO: 1155084 - RNA, 13 nt, Homo sapiens
caugaaguggaaa

SEQ ID NO: 1155085 - RNA, 17 nt, Homo sapiens
caugacacuuccaaaga

SEQ ID NO: 1155086 - RNA, 15 nt, Homo sapiens
caugacauugcauuu

SEQ ID NO: 1155087 - RNA, 17 nt, Homo sapiens
caugaccacauagcaug

SEQ ID NO: 1155088 - RNA, 18 nt, Homo sapiens
caugagacucagugcaga

SEQ ID NO: 1155089 - RNA, 19 nt, Homo sapiens
caugagaugauacauccaa

SEQ ID NO: 1155090 - RNA, 23 nt, Homo sapiens
caugagauguguggacuguggca

SEQ ID NO: 1155091 - RNA, 23 nt, Homo sapiens
caugagcauuggauacagcagua

SEQ ID NO: 1155092 - RNA, 20 nt, Homo sapiens
caugaggagggaaaagagug

SEQ ID NO: 1155093 - RNA, 20 nt, Homo sapiens
caugaggccaccaguaaaag

SEQ ID NO: 1155094 - RNA, 16 nt, Homo sapiens
caugaguaucaucaga

SEQ ID NO: 1155095 - RNA, 15 nt, Homo sapiens
caugaguccuugaaa

SEQ ID NO: 1155096 - RNA, 18 nt, Homo sapiens
caugaguuacugugcauu

SEQ ID NO: 1155097 - RNA, 15 nt, Homo sapiens
caugauaaggcucuu

SEQ ID NO: 1155098 - RNA, 15 nt, Homo sapiens
caugauccaagcaag

SEQ ID NO: 1155099 - RNA, 21 nt, Homo sapiens
caugauccaagcaagacugag

SEQ ID NO: 1155100 - RNA, 15 nt, Homo sapiens
caugaugcuaaaggc

SEQ ID NO: 1155101 - RNA, 20 nt, Homo sapiens
caugaugcuaaaggcugcga

SEQ ID NO: 1155102 - RNA, 17 nt, Homo sapiens
caugaugcuuuuacuga

SEQ ID NO: 1155103 - RNA, 16 nt, Homo sapiens
caugauggugcaugcc

SEQ ID NO: 1155104 - RNA, 18 nt, Homo sapiens
caugcaaaagcaaucaua

SEQ ID NO: 1155105 - RNA, 18 nt, Homo sapiens
caugcacccucauacaca

SEQ ID NO: 1155106 - RNA, 19 nt, Homo sapiens
caugcagccagccaucaaa

SEQ ID NO: 1155107 - RNA, 23 nt, Homo sapiens
caugcaggaaggaaaacuaugua

SEQ ID NO: 1155108 - RNA, 16 nt, Homo sapiens
caugcauaaaugcgau

SEQ ID NO: 1155109 - RNA, 19 nt, Homo sapiens
caugcccacaacuugucac

SEQ ID NO: 1155110 - RNA, 17 nt, Homo sapiens
caugcccuguaccugug

SEQ ID NO: 1155111 - RNA, 15 nt, Homo sapiens
caugcccugugcaac

SEQ ID NO: 1155112 - RNA, 23 nt, Homo sapiens
caugccuucaaaucaaucuguaa

SEQ ID NO: 1155113 - RNA, 15 nt, Homo sapiens
caugccuugcaaugg

SEQ ID NO: 1155114 - RNA, 20 nt, Homo sapiens
caugcgguagccagcacaca

SEQ ID NO: 1155115 - RNA, 22 nt, Homo sapiens
caugcuaaaauucuauagagau

SEQ ID NO: 1155116 - RNA, 17 nt, Homo sapiens
caugcuucagugcugcu

SEQ ID NO: 1155117 - RNA, 21 nt, Homo sapiens
caugcuuguggccaaugcauc

SEQ ID NO: 1155118 - RNA, 20 nt, Homo sapiens
caugcuuugaaaaaucacuu

SEQ ID NO: 1155119 - RNA, 16 nt, Homo sapiens
caugcuuuuacuuuau

SEQ ID NO: 1155120 - RNA, 15 nt, Homo sapiens
cauggaauauuucca

SEQ ID NO: 1155121 - RNA, 20 nt, Homo sapiens
cauggaaucuacauguguuu

SEQ ID NO: 1155122 - RNA, 21 nt, Homo sapiens
cauggacacaucaggaaguua

SEQ ID NO: 1155123 - RNA, 12 nt, Homo sapiens
cauggacagugu

SEQ ID NO: 1155124 - RNA, 12 nt, Homo sapiens
cauggacaguug

SEQ ID NO: 1155125 - RNA, 15 nt, Homo sapiens
cauggagacgcauuu

SEQ ID NO: 1155126 - RNA, 20 nt, Homo sapiens
cauggcacucccuccagcac

SEQ ID NO: 1155127 - RNA, 23 nt, Homo sapiens
cauggcagaguuuguguguuguc

SEQ ID NO: 1155128 - RNA, 13 nt, Homo sapiens
cauggcaugucuu

SEQ ID NO: 1155129 - RNA, 16 nt, Homo sapiens
cauggccacacuguga

SEQ ID NO: 1155130 - RNA, 17 nt, Homo sapiens
cauggccacacugugac

SEQ ID NO: 1155131 - RNA, 20 nt, Homo sapiens
cauggccacacugugacaca

SEQ ID NO: 1155132 - RNA, 15 nt, Homo sapiens
cauggccuaugcaca

SEQ ID NO: 1155133 - RNA, 16 nt, Homo sapiens
cauggccuaugcacau

SEQ ID NO: 1155134 - RNA, 19 nt, Homo sapiens
cauggccuaugcacauaug

SEQ ID NO: 1155135 - RNA, 23 nt, Homo sapiens
cauggcgaaaccccucucuacua

SEQ ID NO: 1155136 - RNA, 23 nt, Homo sapiens
cauggcgagauacugcauguuug

SEQ ID NO: 1155137 - RNA, 21 nt, Homo sapiens
cauggcuauaaacaauuacau

SEQ ID NO: 1155138 - RNA, 19 nt, Homo sapiens
cauggcuuuggcuuugcaa

SEQ ID NO: 1155139 - RNA, 19 nt, Homo sapiens
caugggcaucuaugggaga

SEQ ID NO: 1155140 - RNA, 16 nt, Homo sapiens
cauggucaccaaacag

SEQ ID NO: 1155141 - RNA, 21 nt, Homo sapiens
cauggugaaacccccaucucu

SEQ ID NO: 1155142 - RNA, 22 nt, Homo sapiens
cauggugaaaccguaucucuaa

SEQ ID NO: 1155143 - RNA, 16 nt, Homo sapiens
cauggugccccaggac

SEQ ID NO: 1155144 - RNA, 21 nt, Homo sapiens
cauggugccccaggaccagcu

SEQ ID NO: 1155145 - RNA, 17 nt, Homo sapiens
ccaaagcuuucauguaa

SEQ ID NO: 1155146 - RNA, 21 nt, Homo sapiens
ccaaagggugaagcuauuuau

SEQ ID NO: 1155147 - RNA, 20 nt, Homo sapiens
ccaaaguaucaggacgagaa

SEQ ID NO: 1155148 - RNA, 15 nt, Homo sapiens
ccaaaguauucauau

SEQ ID NO: 1155149 - RNA, 20 nt, Homo sapiens
ccaaagucuaaacugagcuc

SEQ ID NO: 1155150 - RNA, 22 nt, Homo sapiens
ccaaauacgaagcccucuugca

SEQ ID NO: 1155151 - RNA, 22 nt, Homo sapiens
ccaaauuggauacugcugccaa

SEQ ID NO: 1155152 - RNA, 19 nt, Homo sapiens
ccaacaagaaugcauugau

SEQ ID NO: 1155153 - RNA, 15 nt, Homo sapiens
ccaacagcacccucu

SEQ ID NO: 1155154 - RNA, 16 nt, Homo sapiens
ccaacagcacccucuc

SEQ ID NO: 1155155 - RNA, 12 nt, Homo sapiens
ccaacagcacuu

SEQ ID NO: 1155156 - RNA, 13 nt, Homo sapiens
ccaacagcacuuu

SEQ ID NO: 1155157 - RNA, 15 nt, Homo sapiens
ccaacagccagugug

SEQ ID NO: 1155158 - RNA, 16 nt, Homo sapiens
ccaacagcuuuuccca

SEQ ID NO: 1155159 - RNA, 15 nt, Homo sapiens
ccaacaguagccaaa

SEQ ID NO: 1155160 - RNA, 11 nt, Homo sapiens
ccaacauggau

SEQ ID NO: 1155161 - RNA, 14 nt, Homo sapiens
cucugguuuuagua

SEQ ID NO: 1155162 - RNA, 14 nt, Homo sapiens
cucuguacacugcc

SEQ ID NO: 1155163 - RNA, 23 nt, Homo sapiens
cucuguauuuuuucuugcauuga

SEQ ID NO: 1155164 - RNA, 15 nt, Homo sapiens
cucuguccaaucagg

SEQ ID NO: 1155165 - RNA, 10 nt, Homo sapiens
cucuguccag

SEQ ID NO: 1155166 - RNA, 19 nt, Homo sapiens
cucugucugcucaaugcca

SEQ ID NO: 1155167 - RNA, 18 nt, Homo sapiens
cucugucuggauuugccu

SEQ ID NO: 1155168 - RNA, 20 nt, Homo sapiens
cucugugggauaucacauca

SEQ ID NO: 1155169 - RNA, 18 nt, Homo sapiens
cucugugggucucuggaa

SEQ ID NO: 1155170 - RNA, 15 nt, Homo sapiens
cucugugucuucaaa

SEQ ID NO: 1155171 - RNA, 14 nt, Homo sapiens
cucuguugcacaug

SEQ ID NO: 1155172 - RNA, 12 nt, Homo sapiens
cucuuaacaaga

SEQ ID NO: 1155173 - RNA, 21 nt, Homo sapiens
cucuuaaugauguuaucuuaa

SEQ ID NO: 1155174 - RNA, 13 nt, Homo sapiens
cucuuaauguuuc

SEQ ID NO: 1155175 - RNA, 13 nt, Homo sapiens
cucuuacagcuuu

SEQ ID NO: 1155176 - RNA, 19 nt, Homo sapiens
cucuuagccucuggaucua

SEQ ID NO: 1155177 - RNA, 16 nt, Homo sapiens
cucuuaguaacauaga

SEQ ID NO: 1155178 - RNA, 14 nt, Homo sapiens
cucuuauuacuguu

SEQ ID NO: 1155179 - RNA, 23 nt, Homo sapiens
cucuucaccccacacccaugugu

SEQ ID NO: 1155180 - RNA, 16 nt, Homo sapiens
cucuucagcaugcccc

SEQ ID NO: 1155181 - RNA, 16 nt, Homo sapiens
cucuucaguuaauucu

SEQ ID NO: 1155182 - RNA, 13 nt, Homo sapiens
cucuucuguggac

SEQ ID NO: 1155183 - RNA, 21 nt, Homo sapiens
cucuucuuggggcccagugca

SEQ ID NO: 1155184 - RNA, 20 nt, Homo sapiens
cucuucuuuagaacagggaa

SEQ ID NO: 1155185 - RNA, 18 nt, Homo sapiens
cucuugauuaagaucuca

SEQ ID NO: 1155186 - RNA, 12 nt, Homo sapiens
cucuugcucaag

SEQ ID NO: 1155187 - RNA, 15 nt, Homo sapiens
cucuugcuguuaaau

SEQ ID NO: 1155188 - RNA, 19 nt, Homo sapiens
cucuuggcuccacugggau

SEQ ID NO: 1155189 - RNA, 21 nt, Homo sapiens
cucuuggcuccccacauuggc

SEQ ID NO: 1155190 - RNA, 22 nt, Homo sapiens
cucuuggcugagauagcagagg

SEQ ID NO: 1155191 - RNA, 20 nt, Homo sapiens
cucuuggguucaagugauuc

SEQ ID NO: 1155192 - RNA, 16 nt, Homo sapiens
cucuugucacauggaa

SEQ ID NO: 1155193 - RNA, 17 nt, Homo sapiens
cucuuguggugcauuga

SEQ ID NO: 1155194 - RNA, 14 nt, Homo sapiens
cucuuuaaucucau

SEQ ID NO: 1155195 - RNA, 16 nt, Homo sapiens
cucuuuccugcccuuu

SEQ ID NO: 1155196 - RNA, 13 nt, Homo sapiens
cucuuucuugacu

SEQ ID NO: 1155197 - RNA, 13 nt, Homo sapiens
cucuuucuuguuu

SEQ ID NO: 1155198 - RNA, 22 nt, Homo sapiens
cucuuuggcugaaauucuucaa

SEQ ID NO: 1155199 - RNA, 13 nt, Homo sapiens
gccaacuguccua

SEQ ID NO: 1155200 - RNA, 21 nt, Homo sapiens
gccaagaagauaggcucucag

SEQ ID NO: 1155201 - RNA, 18 nt, Homo sapiens
gccaagaaguugcucuga

SEQ ID NO: 1155202 - RNA, 15 nt, Homo sapiens
gccaagcagugccca

SEQ ID NO: 1155203 - RNA, 17 nt, Homo sapiens
gccaaggagcugcuaua

SEQ ID NO: 1155204 - RNA, 20 nt, Homo sapiens
gccaaggagggugagugcaa

SEQ ID NO: 1155205 - RNA, 20 nt, Homo sapiens
gccaaggucugagcacugga

SEQ ID NO: 1155206 - RNA, 16 nt, Homo sapiens
gccaaucuguacaaaa

SEQ ID NO: 1155207 - RNA, 16 nt, Homo sapiens
gccaauucacaaguua

SEQ ID NO: 1155208 - RNA, 21 nt, Homo sapiens
gccaauugggaagagugacuu

SEQ ID NO: 1155209 - RNA, 18 nt, Homo sapiens
gccacaaauaaguuacau

SEQ ID NO: 1155210 - RNA, 22 nt, Homo sapiens
gccacaaaugugucccagugaa

SEQ ID NO: 1155211 - RNA, 14 nt, Homo sapiens
gccacacacacaga

SEQ ID NO: 1155212 - RNA, 12 nt, Homo sapiens
gccacacucugg

SEQ ID NO: 1155213 - RNA, 18 nt, Homo sapiens
gccacagaaggugaacuu

SEQ ID NO: 1155214 - RNA, 21 nt, Homo sapiens
gccacaucuccuguggucucu

SEQ ID NO: 1155215 - RNA, 19 nt, Homo sapiens
gccacauggcggagaguuu

SEQ ID NO: 1155216 - RNA, 11 nt, Homo sapiens
gccacccaaga

SEQ ID NO: 1155217 - RNA, 16 nt, Homo sapiens
gccacccagccucuug

SEQ ID NO: 1155218 - RNA, 14 nt, Homo sapiens
gccaccgcacucca

SEQ ID NO: 1155219 - RNA, 20 nt, Homo sapiens
gccaccggggcaagagggaa

SEQ ID NO: 1155220 - RNA, 19 nt, Homo sapiens
gccaccucccucugccagu

SEQ ID NO: 1155221 - RNA, 16 nt, Homo sapiens
gccacuauuacuggga

SEQ ID NO: 1155222 - RNA, 19 nt, Homo sapiens
gccacucaggcccaaagcc

SEQ ID NO: 1155223 - RNA, 20 nt, Homo sapiens
gccacucaggcccaaagccu

SEQ ID NO: 1155224 - RNA, 14 nt, Homo sapiens
gccacugggcaccu

SEQ ID NO: 1155225 - RNA, 22 nt, Homo sapiens
gccacuguguuucugugcucca

SEQ ID NO: 1155226 - RNA, 17 nt, Homo sapiens
gccagaaauugauuaag

SEQ ID NO: 1155227 - RNA, 13 nt, Homo sapiens
gccagaacuugac

SEQ ID NO: 1155228 - RNA, 15 nt, Homo sapiens
gccagacaugccaca

SEQ ID NO: 1155229 - RNA, 15 nt, Homo sapiens
gccagagaagugaca

SEQ ID NO: 1155230 - RNA, 13 nt, Homo sapiens
gccagaggcaccu

SEQ ID NO: 1155231 - RNA, 20 nt, Homo sapiens
gccagauuaucagaccucuu

SEQ ID NO: 1155232 - RNA, 24 nt, Homo sapiens
gccagcaccugcgggagcugcacu

SEQ ID NO: 1155233 - RNA, 11 nt, Homo sapiens
gccagcacuuc

SEQ ID NO: 1155234 - RNA, 21 nt, Homo sapiens
gccagcauuucccuuccuucc

SEQ ID NO: 1155235 - RNA, 21 nt, Homo sapiens
gccagcuucgagcuacaugca

SEQ ID NO: 1155236 - RNA, 16 nt, Homo sapiens
gccaggaaagcagcaa

SEQ ID NO: 1155237 - RNA, 12 nt, Homo sapiens
uggccaggacau

SEQ ID NO: 1155238 - RNA, 16 nt, Homo sapiens
uggccaggcugaucuc

SEQ ID NO: 1155239 - RNA, 13 nt, Homo sapiens
uggcccacccacu

SEQ ID NO: 1155240 - RNA, 19 nt, Homo sapiens
uggcccacugcuggcugca

SEQ ID NO: 1155241 - RNA, 18 nt, Homo sapiens
uggcccaguuaauuugca

SEQ ID NO: 1155242 - RNA, 13 nt, Homo sapiens
uggccccugagau

SEQ ID NO: 1155243 - RNA, 21 nt, Homo sapiens
uggccccuuugggcccugcau

SEQ ID NO: 1155244 - RNA, 24 nt, Homo sapiens
uggcccucccagugccuccuagcc

SEQ ID NO: 1155245 - RNA, 22 nt, Homo sapiens
uggcccuggcggguggcugcaa

SEQ ID NO: 1155246 - RNA, 14 nt, Homo sapiens
uggccgucuacugg

SEQ ID NO: 1155247 - RNA, 21 nt, Homo sapiens
uggccuacccagauuguauca

SEQ ID NO: 1155248 - RNA, 14 nt, Homo sapiens
uggccuaugcacau

SEQ ID NO: 1155249 - RNA, 23 nt, Homo sapiens
uggccucacccaccccugcacag

SEQ ID NO: 1155250 - RNA, 23 nt, Homo sapiens
uggccucccaaagugcugggauu

SEQ ID NO: 1155251 - RNA, 15 nt, Homo sapiens
uggccucccacagac

SEQ ID NO: 1155252 - RNA, 16 nt, Homo sapiens
uggccucugcaacugc

SEQ ID NO: 1155253 - RNA, 21 nt, Homo sapiens
uggccucugugccuucuuuug

SEQ ID NO: 1155254 - RNA, 22 nt, Homo sapiens
uggccugaagaguccucugaau

SEQ ID NO: 1155255 - RNA, 16 nt, Homo sapiens
uggccugcagugacac

SEQ ID NO: 1155256 - RNA, 12 nt, Homo sapiens
uggccuggcaca

SEQ ID NO: 1155257 - RNA, 19 nt, Homo sapiens
ugguagaaaaugcaccaaa

SEQ ID NO: 1155258 - RNA, 17 nt, Homo sapiens
ugguagaucuucaauuu

SEQ ID NO: 1155259 - RNA, 15 nt, Homo sapiens
ugguagccucacuuu

SEQ ID NO: 1155260 - RNA, 15 nt, Homo sapiens
ugguaggcauuuccu

SEQ ID NO: 1155261 - RNA, 15 nt, Homo sapiens
ugguaugaaacaaac

SEQ ID NO: 1155262 - RNA, 13 nt, Homo sapiens
ugguaugagacag

SEQ ID NO: 1155263 - RNA, 13 nt, Homo sapiens
ugguaugugccag

SEQ ID NO: 1155264 - RNA, 17 nt, Homo sapiens
uggucaauaaagcuccu

SEQ ID NO: 1155265 - RNA, 15 nt, Homo sapiens
uggucacacacugau

SEQ ID NO: 1155266 - RNA, 23 nt, Homo sapiens
uggucaggauuccuguugccuuu

SEQ ID NO: 1155267 - RNA, 21 nt, Homo sapiens
uggucccaggaagcagggaga

SEQ ID NO: 1155268 - RNA, 18 nt, Homo sapiens
ugguccuggcugcacucu

SEQ ID NO: 1155269 - RNA, 15 nt, Homo sapiens
uggucgggaagggag

SEQ ID NO: 1155270 - RNA, 14 nt, Homo sapiens
uggucuccacuggg

SEQ ID NO: 1155271 - RNA, 22 nt, Homo sapiens
uggucucugauagguagcauuu

SEQ ID NO: 1155272 - RNA, 15 nt, Homo sapiens
uguauuguggaacac

SEQ ID NO: 1155273 - RNA, 16 nt, Homo sapiens
uguauuucaagaccuc

SEQ ID NO: 1155274 - RNA, 11 nt, Homo sapiens
uguauuucccc

SEQ ID NO: 1155275 - RNA, 17 nt, Homo sapiens
uguauuuuaaaugugac

SEQ ID NO: 1155276 - RNA, 23 nt, Homo sapiens
uguauuuuauuacaucuuucaca

SEQ ID NO: 1155277 - RNA, 18 nt, Homo sapiens
uguauuuuccaacuuguu

SEQ ID NO: 1155278 - RNA, 15 nt, Homo sapiens
ugucaaaacaagacu

SEQ ID NO: 1155279 - RNA, 16 nt, Homo sapiens
ugucaaaaugagauuc

SEQ ID NO: 1155280 - RNA, 14 nt, Homo sapiens
ugucacaucaagca

SEQ ID NO: 1155281 - RNA, 12 nt, Homo sapiens
ugucacauggaa

SEQ ID NO: 1155282 - RNA, 19 nt, Homo sapiens
ugucacauggaaucuacau

SEQ ID NO: 1155283 - RNA, 16 nt, Homo sapiens
ugucacccagucuguu

SEQ ID NO: 1155284 - RNA, 15 nt, Homo sapiens
uuuuaaccauuccaa

SEQ ID NO: 1155285 - RNA, 16 nt, Homo sapiens
uuuuaacuuauugaca

SEQ ID NO: 1155286 - RNA, 16 nt, Homo sapiens
uuuuaauaacauaucu

SEQ ID NO: 1155287 - RNA, 18 nt, Homo sapiens
uuuuaaucaugagccugu

SEQ ID NO: 1155288 - RNA, 17 nt, Homo sapiens
uuuuaaugcuauuugaa

SEQ ID NO: 1155289 - RNA, 21 nt, Homo sapiens
uuuuacaguagaacucaucua

SEQ ID NO: 1155290 - RNA, 22 nt, Homo sapiens
uuuuacauacauugauucaugu

SEQ ID NO: 1155291 - RNA, 18 nt, Homo sapiens
uuuuaguagacaguagga

SEQ ID NO: 1155292 - RNA, 19 nt, Homo sapiens
uuuuauaaaaaugagugcu

SEQ ID NO: 1155293 - RNA, 13 nt, Homo sapiens
uuuuauauguugc

SEQ ID NO: 1155294 - RNA, 19 nt, Homo sapiens
uuuuauccacuuaccuaga

SEQ ID NO: 1155295 - RNA, 14 nt, Homo sapiens
uuuuaucuccaagu

SEQ ID NO: 1155296 - RNA, 13 nt, Homo sapiens
uuuuaucuuaucu

SEQ ID NO: 1155297 - RNA, 16 nt, Homo sapiens
uuuuaugcccuucuaa

SEQ ID NO: 1155298 - RNA, 19 nt, Homo sapiens
uuuuauguacagguguaua

SEQ ID NO: 1155299 - RNA, 15 nt, Homo sapiens
uuuuauugugcuuca

SEQ ID NO: 1155300 - RNA, 14 nt, Homo sapiens
uuuuauuuauaugu

SEQ ID NO: 1155301 - RNA, 12 nt, Homo sapiens
uuuuauuugacu

SEQ ID NO: 1155302 - RNA, 15 nt, Homo sapiens
uuuucaacauuguau

SEQ ID NO: 1155303 - RNA, 16 nt, Homo sapiens
uuuucaacuuggauca

SEQ ID NO: 1155304 - RNA, 15 nt, Homo sapiens
uuuucaagcuauaau

SEQ ID NO: 1155305 - RNA, 19 nt, Homo sapiens
uuuucaauuuuucuuuaaa

SEQ ID NO: 1155306 - RNA, 19 nt, Homo sapiens
uuuucagaggugaauuaau

SEQ ID NO: 1155307 - RNA, 15 nt, Homo sapiens
uuuucagaugucuua

SEQ ID NO: 1155308 - RNA, 14 nt, Homo sapiens
uuuucagcaaaaau

SEQ ID NO: 1155309 - RNA, 14 nt, Homo sapiens
uuuucagcaaagaa

SEQ ID NO: 1155310 - RNA, 19 nt, Homo sapiens
uuuucagcucuuugacaac

SEQ ID NO: 1155311 - RNA, 23 nt, Homo sapiens
uuuuccccaauuaauugcuauug

SEQ ID NO: 1155312 - RNA, 15 nt, Homo sapiens
uuuuccuuaccuuua

SEQ ID NO: 1155313 - RNA, 12 nt, Homo sapiens
uuuuccuuccag

SEQ ID NO: 1155314 - RNA, 23 nt, Homo sapiens
uuuuccuuuuaacaauaugcacu

SEQ ID NO: 1155315 - RNA, 21 nt, Homo sapiens
uuuucuaagaaagaaauugua

SEQ ID NO: 1155316 - RNA, 17 nt, Homo sapiens
uuuucucacugugccaa

SEQ ID NO: 1155317 - RNA, 15 nt, Homo sapiens
uuuucucuaccuuca

SEQ ID NO: 1155318 - RNA, 22 nt, Homo sapiens
uuuucugaagcuacuuucuuaa

SEQ ID NO: 1155319 - RNA, 20 nt, Homo sapiens
uuuucugccuuuagcuuuga

SEQ ID NO: 1155320 - RNA, 19 nt, Homo sapiens
uuuucuggagguugauaac

SEQ ID NO: 1155321 - RNA, 17 nt, Homo sapiens
uuuucugugcacuguag

SEQ ID NO: 1155322 - RNA, 12 nt, Homo sapiens
uuuucuguucuc

SEQ ID NO: 1155323 - RNA, 13 nt, Homo sapiens
uuuucuugcauug

SEQ ID NO: 1155324 - RNA, 23 nt, Homo sapiens
uuuucuuuuuuaaagacaggguc

SEQ ID NO: 1155325 - RNA, 19 nt, Homo sapiens
uuuugaaauaccacaguug

SEQ ID NO: 1155326 - RNA, 19 nt, Homo sapiens
uuuugaccuguaacuuaaa

SEQ ID NO: 1155327 - RNA, 14 nt, Homo sapiens
uuuugagggagcaa

SEQ ID NO: 1155328 - RNA, 24 nt, Homo sapiens
uuuugauaauagauaacugcucuu

SEQ ID NO: 1155329 - RNA, 16 nt, Homo sapiens
uuuugaugacuggcau

SEQ ID NO: 1155330 - RNA, 14 nt, Homo sapiens
uuuugaugagcuua

SEQ ID NO: 1155331 - RNA, 21 nt, Homo sapiens
uuuugcaauuggaauaaucac

SEQ ID NO: 1155332 - RNA, 18 nt, Homo sapiens
uuuugcacacuuugccau

SEQ ID NO: 1155333 - RNA, 18 nt, Homo sapiens
uuuugcacaguuagcaaa

SEQ ID NO: 1155334 - RNA, 18 nt, Homo sapiens
uuuuggcaagaccccacc

SEQ ID NO: 1155335 - RNA, 17 nt, Homo sapiens
uuuuggcaucugcaaag

SEQ ID NO: 1155336 - RNA, 19 nt, Homo sapiens
uuuuggcccaaucucugcc

SEQ ID NO: 1155337 - RNA, 18 nt, Homo sapiens
uuuuguauuccacauucu

SEQ ID NO: 1155338 - RNA, 20 nt, Homo sapiens
uuuuguauuguuuucugaca

SEQ ID NO: 1155339 - RNA, 19 nt, Homo sapiens
uuuuguccuguacccagug

SEQ ID NO: 1155340 - RNA, 13 nt, Homo sapiens
uuuuguguguaua

SEQ ID NO: 1155341 - RNA, 19 nt, Homo sapiens
uuuuuaaaauguuggugca

SEQ ID NO: 1155342 - RNA, 18 nt, Homo sapiens
uuuuuaaauaaaagucau

SEQ ID NO: 1155343 - RNA, 20 nt, Homo sapiens
uuuuuaaccauggcagggug

SEQ ID NO: 1155344 - RNA, 22 nt, Homo sapiens
uuuuuacuaaacucagaggcag

SEQ ID NO: 1155345 - RNA, 13 nt, Homo sapiens
uuuuuagucugug

SEQ ID NO: 1155346 - RNA, 12 nt, Homo sapiens
uuuuuauccaug

SEQ ID NO: 1155347 - RNA, 20 nt, Homo sapiens
uuuuuauucaaacuaccuau

SEQ ID NO: 1155348 - RNA, 18 nt, Homo sapiens
uuuuuccaauuagcuccu

SEQ ID NO: 1155349 - RNA, 15 nt, Homo sapiens
uuuuucuaaugagga

SEQ ID NO: 1155350 - RNA, 18 nt, Homo sapiens
uuuuucugauuccauccu

SEQ ID NO: 1155351 - RNA, 20 nt, Homo sapiens
uuuuucuucaugccugauga

SEQ ID NO: 1155352 - RNA, 22 nt, Homo sapiens
uuuuugaagagaaguuguggcu

SEQ ID NO: 1155353 - RNA, 11 nt, Homo sapiens
uuuuugccagg

SEQ ID NO: 1155354 - RNA, 11 nt, Homo sapiens
uuuuugcucuc

SEQ ID NO: 1155355 - RNA, 10 nt, Homo sapiens
uuuuuggaca

SEQ ID NO: 1155356 - RNA, 20 nt, Homo sapiens
uuuuuuauaaucaagccuaa

SEQ ID NO: 1155357 - RNA, 13 nt, Homo sapiens
uuuuuucccccac

SEQ ID NO: 1155358 - RNA, 16 nt, Homo sapiens
aagugaauuguugaca

SEQ ID NO: 1155359 - RNA, 20 nt, Homo sapiens
aagugacauaauuuacaugc

SEQ ID NO: 1155360 - RNA, 22 nt, Homo sapiens
aagugaggagaaugaaauguau

SEQ ID NO: 1155361 - RNA, 13 nt, Homo sapiens
aagugaguggcau

SEQ ID NO: 1155362 - RNA, 16 nt, Homo sapiens
aagugauccucaggca

SEQ ID NO: 1155363 - RNA, 12 nt, Homo sapiens
aagugaucucug

SEQ ID NO: 1155364 - RNA, 22 nt, Homo sapiens
aagugauuuuuuuccacaagau

SEQ ID NO: 1155365 - RNA, 15 nt, Homo sapiens
aagugcauauuuauc

SEQ ID NO: 1155366 - RNA, 22 nt, Homo sapiens
aagugcauuuuuaaauuuccuc

SEQ ID NO: 1155367 - RNA, 13 nt, Homo sapiens
aagugccaaagaa

SEQ ID NO: 1155368 - RNA, 14 nt, Homo sapiens
aagugccucaagag

SEQ ID NO: 1155369 - RNA, 20 nt, Homo sapiens
aagugcugccuuaguugcua

SEQ ID NO: 1155370 - RNA, 18 nt, Homo sapiens
aagugcuggcaaccacua

SEQ ID NO: 1155371 - RNA, 17 nt, Homo sapiens
aagugcuuugcauugaa

SEQ ID NO: 1155372 - RNA, 17 nt, Homo sapiens
aaguggaaaaaggagag

SEQ ID NO: 1155373 - RNA, 16 nt, Homo sapiens
aagugggacauucaaa

SEQ ID NO: 1155374 - RNA, 13 nt, Homo sapiens
aaguggucuuaag

SEQ ID NO: 1155375 - RNA, 14 nt, Homo sapiens
aaguguaauagauu

SEQ ID NO: 1155376 - RNA, 11 nt, Homo sapiens
aagugugcaua

SEQ ID NO: 1155377 - RNA, 19 nt, Homo sapiens
aagugugccacauggacuu

SEQ ID NO: 1155378 - RNA, 16 nt, Homo sapiens
aaguguuccugucuca

SEQ ID NO: 1155379 - RNA, 11 nt, Homo sapiens
aaguguugcau

SEQ ID NO: 1155380 - RNA, 19 nt, Homo sapiens
aaguuaaaccaugugacua

SEQ ID NO: 1155381 - RNA, 17 nt, Homo sapiens
aaguuaauccacuguga

SEQ ID NO: 1155382 - RNA, 14 nt, Homo sapiens
aaguuacauuguua

SEQ ID NO: 1155383 - RNA, 15 nt, Homo sapiens
aaguuaucauggugu

SEQ ID NO: 1155384 - RNA, 17 nt, Homo sapiens
aaguuccacuugguuca

SEQ ID NO: 1155385 - RNA, 19 nt, Homo sapiens
aaguuccacuugguucagg

SEQ ID NO: 1155386 - RNA, 20 nt, Homo sapiens
aaguuccuaauauaagugaa

SEQ ID NO: 1155387 - RNA, 20 nt, Homo sapiens
aaguuccugcugccugggua

SEQ ID NO: 1155388 - RNA, 14 nt, Homo sapiens
aaguugauaaugaa

SEQ ID NO: 1155389 - RNA, 22 nt, Homo sapiens
aaguuggucuuacuuugugcaa

SEQ ID NO: 1155390 - RNA, 15 nt, Homo sapiens
aaguugguuacaaac

SEQ ID NO: 1155391 - RNA, 20 nt, Homo sapiens
aaguuuagugcccucaucca

SEQ ID NO: 1155392 - RNA, 20 nt, Homo sapiens
aaguuuauguucuuacuuug

SEQ ID NO: 1155393 - RNA, 12 nt, Homo sapiens
aaguuucauccg

SEQ ID NO: 1155394 - RNA, 19 nt, Homo sapiens
aaguuuucuuccaugauuu

SEQ ID NO: 1155395 - RNA, 16 nt, Homo sapiens
aauaaaaacauugccu

SEQ ID NO: 1155396 - RNA, 19 nt, Homo sapiens
aauaaaaauuguagcuuuu

SEQ ID NO: 1155397 - RNA, 13 nt, Homo sapiens
aauaaaacuuuac

SEQ ID NO: 1155398 - RNA, 19 nt, Homo sapiens
aauaaaauguuuauagcau

SEQ ID NO: 1155399 - RNA, 18 nt, Homo sapiens
aauaaacaccacacccag

SEQ ID NO: 1155400 - RNA, 13 nt, Homo sapiens
aauaaaccaaaua

SEQ ID NO: 1155401 - RNA, 19 nt, Homo sapiens
aauaaacuugcuuucacuu

SEQ ID NO: 1155402 - RNA, 12 nt, Homo sapiens
aauaaagacagg

SEQ ID NO: 1155403 - RNA, 12 nt, Homo sapiens
aauaaaguguau

SEQ ID NO: 1155404 - RNA, 13 nt, Homo sapiens
aauaaauaagaau

SEQ ID NO: 1155405 - RNA, 15 nt, Homo sapiens
aauaaauaccaaaaa

SEQ ID NO: 1155406 - RNA, 14 nt, Homo sapiens
aauaaauaucugua

SEQ ID NO: 1155407 - RNA, 16 nt, Homo sapiens
aauaaauauuuaauga

SEQ ID NO: 1155408 - RNA, 18 nt, Homo sapiens
aauaaauauuuaaugaau

SEQ ID NO: 1155409 - RNA, 17 nt, Homo sapiens
aauaaaucugacccagu

SEQ ID NO: 1155410 - RNA, 12 nt, Homo sapiens
aauaaaugcuca

SEQ ID NO: 1155411 - RNA, 18 nt, Homo sapiens
aauaaauuaugcuucaua

SEQ ID NO: 1155412 - RNA, 15 nt, Homo sapiens
aauaaauuccuacaa

SEQ ID NO: 1155413 - RNA, 18 nt, Homo sapiens
aauaacucuccaguaaca

SEQ ID NO: 1155414 - RNA, 21 nt, Homo sapiens
aauaacugaaccaaauugcac

SEQ ID NO: 1155415 - RNA, 14 nt, Homo sapiens
aauaagcaggaugu

SEQ ID NO: 1155416 - RNA, 15 nt, Homo sapiens
aauaaggcugagacc

SEQ ID NO: 1155417 - RNA, 19 nt, Homo sapiens
aauaauaaaucguccuccc

SEQ ID NO: 1155418 - RNA, 16 nt, Homo sapiens
aauaauagaauugcuc

SEQ ID NO: 1155419 - RNA, 12 nt, Homo sapiens
aauaauccauuu

SEQ ID NO: 1155420 - RNA, 23 nt, Homo sapiens
aauaaucgacuuuuuaaauguga

SEQ ID NO: 1155421 - RNA, 21 nt, Homo sapiens
aauaaugaauggacucaucuu

SEQ ID NO: 1155422 - RNA, 22 nt, Homo sapiens
aauaauuaccaauaucuugcca

SEQ ID NO: 1155423 - RNA, 19 nt, Homo sapiens
aauaauuaguaagcuagca

SEQ ID NO: 1155424 - RNA, 18 nt, Homo sapiens
aauaauuuuauuaugcaa

SEQ ID NO: 1155425 - RNA, 14 nt, Homo sapiens
aauacaaaucugua

SEQ ID NO: 1155426 - RNA, 12 nt, Homo sapiens
aauacacauuuc

SEQ ID NO: 1155427 - RNA, 17 nt, Homo sapiens
aauacaggcaugaacca

SEQ ID NO: 1155428 - RNA, 21 nt, Homo sapiens
aauacaggcaugaaccacugc

SEQ ID NO: 1155429 - RNA, 20 nt, Homo sapiens
aauacagucuuccauuugca

SEQ ID NO: 1155430 - RNA, 21 nt, Homo sapiens
aauacaguuuauaaagccaag

SEQ ID NO: 1155431 - RNA, 14 nt, Homo sapiens
aauacaucaaagag

SEQ ID NO: 1155432 - RNA, 17 nt, Homo sapiens
aauacauguacagacaa

SEQ ID NO: 1155433 - RNA, 20 nt, Homo sapiens
aauacauuuucagagccaaa

SEQ ID NO: 1155434 - RNA, 15 nt, Homo sapiens
aauaccuacugcuga

SEQ ID NO: 1155435 - RNA, 20 nt, Homo sapiens
aauacuacugcacagaguca

SEQ ID NO: 1155436 - RNA, 16 nt, Homo sapiens
aauacugcagcacucu

SEQ ID NO: 1155437 - RNA, 16 nt, Homo sapiens
aauacugccagaugcu

SEQ ID NO: 1155438 - RNA, 21 nt, Homo sapiens
aauacugguuauccugugcua

SEQ ID NO: 1155439 - RNA, 17 nt, Homo sapiens
aauacuuuaugaugcua

SEQ ID NO: 1155440 - RNA, 16 nt, Homo sapiens
aauacuuuuccuuacc

SEQ ID NO: 1155441 - RNA, 15 nt, Homo sapiens
aauagaaaaagugau

SEQ ID NO: 1155442 - RNA, 16 nt, Homo sapiens
aauagaacagcucaua

SEQ ID NO: 1155443 - RNA, 20 nt, Homo sapiens
aauagaaccacuaugaagcu

SEQ ID NO: 1155444 - RNA, 16 nt, Homo sapiens
aauagcacugccagga

SEQ ID NO: 1155445 - RNA, 13 nt, Homo sapiens
aauagccacugca

SEQ ID NO: 1155446 - RNA, 20 nt, Homo sapiens
aauagcuccaagcuguuaaa

SEQ ID NO: 1155447 - RNA, 20 nt, Homo sapiens
aauagguagguuaguagccc

SEQ ID NO: 1155448 - RNA, 17 nt, Homo sapiens
aauaguaaacacaggga

SEQ ID NO: 1155449 - RNA, 22 nt, Homo sapiens
aauaguuaaugaaggugugcua

SEQ ID NO: 1155450 - RNA, 16 nt, Homo sapiens
aauaguuacuauuuca

SEQ ID NO: 1155451 - RNA, 14 nt, Homo sapiens
aauaguugcuguca

SEQ ID NO: 1155452 - RNA, 16 nt, Homo sapiens
aauauaaaguguaaua

SEQ ID NO: 1155453 - RNA, 20 nt, Homo sapiens
aauauaaauauccccaggga

SEQ ID NO: 1155454 - RNA, 15 nt, Homo sapiens
aauauaagugaagga

SEQ ID NO: 1155455 - RNA, 15 nt, Homo sapiens
aauauaguugguaca

SEQ ID NO: 1155456 - RNA, 22 nt, Homo sapiens
aauauaucuuaaugcagacaaa

SEQ ID NO: 1155457 - RNA, 14 nt, Homo sapiens
aauaucuagcaugu

SEQ ID NO: 1155458 - RNA, 19 nt, Homo sapiens
aauaucuuuauugcaugag

SEQ ID NO: 1155459 - RNA, 16 nt, Homo sapiens
aauaugaaucugcuca

SEQ ID NO: 1155460 - RNA, 21 nt, Homo sapiens
aauaugaguaauacaucaaag

SEQ ID NO: 1155461 - RNA, 22 nt, Homo sapiens
aauaugaguaauacaucaaaga

SEQ ID NO: 1155462 - RNA, 23 nt, Homo sapiens
aauaugcacugaauaauucaucu

SEQ ID NO: 1155463 - RNA, 20 nt, Homo sapiens
aauaugcauugucugcaaug

SEQ ID NO: 1155464 - RNA, 19 nt, Homo sapiens
aauaugcuuguugaugcug

SEQ ID NO: 1155465 - RNA, 22 nt, Homo sapiens
aauaugucuucuguauaacuag

SEQ ID NO: 1155466 - RNA, 13 nt, Homo sapiens
aauaugucuuucu

SEQ ID NO: 1155467 - RNA, 22 nt, Homo sapiens
aauauguuuaucaacucaagaa

SEQ ID NO: 1155468 - RNA, 21 nt, Homo sapiens
aauauuagcaaagaagcuuca

SEQ ID NO: 1155469 - RNA, 18 nt, Homo sapiens
aauauucuguuuccauag

SEQ ID NO: 1155470 - RNA, 22 nt, Homo sapiens
aauauuguauugcugcugugcg

SEQ ID NO: 1155471 - RNA, 16 nt, Homo sapiens
aauauuguuuuugcac

SEQ ID NO: 1155472 - RNA, 17 nt, Homo sapiens
aauauuuaucugauuaa

SEQ ID NO: 1155473 - RNA, 15 nt, Homo sapiens
aauauuuauuuaacu

SEQ ID NO: 1155474 - RNA, 18 nt, Homo sapiens
aauauuuccuccauuccu

SEQ ID NO: 1155475 - RNA, 17 nt, Homo sapiens
aauauuugaagcagcuc

SEQ ID NO: 1155476 - RNA, 16 nt, Homo sapiens
aauauuuucagcaaaa

SEQ ID NO: 1155477 - RNA, 18 nt, Homo sapiens
aauauuuugaauacacau

SEQ ID NO: 1155478 - RNA, 21 nt, Homo sapiens
aauauuuuucuguagugugaa

SEQ ID NO: 1155479 - RNA, 22 nt, Homo sapiens
aaucaaccugcacuucauaucu

SEQ ID NO: 1155480 - RNA, 24 nt, Homo sapiens
aaucaaggcauaaaauacaauuaa

SEQ ID NO: 1155481 - RNA, 22 nt, Homo sapiens
aaucaaguauuugggaagugaa

SEQ ID NO: 1155482 - RNA, 18 nt, Homo sapiens
aaucaagucagcaacaga

SEQ ID NO: 1155483 - RNA, 12 nt, Homo sapiens
aaucacuaaccc

SEQ ID NO: 1155484 - RNA, 14 nt, Homo sapiens
aaucacucagugau

SEQ ID NO: 1155485 - RNA, 14 nt, Homo sapiens
aaucagaaaucaua

SEQ ID NO: 1155486 - RNA, 23 nt, Homo sapiens
aaucagagugcacaagcaccucu

SEQ ID NO: 1155487 - RNA, 14 nt, Homo sapiens
aaucagaucauuuc

SEQ ID NO: 1155488 - RNA, 12 nt, Homo sapiens
aaucagccagac

SEQ ID NO: 1155489 - RNA, 11 nt, Homo sapiens
aaucagggugg

SEQ ID NO: 1155490 - RNA, 17 nt, Homo sapiens
aaucaguucuguccuug

SEQ ID NO: 1155491 - RNA, 17 nt, Homo sapiens
aaucaguuucuuacaaa

SEQ ID NO: 1155492 - RNA, 16 nt, Homo sapiens
aaucauauaagcuaua

SEQ ID NO: 1155493 - RNA, 19 nt, Homo sapiens
aaucauauaagcuauauca

SEQ ID NO: 1155494 - RNA, 21 nt, Homo sapiens
aaucaucucucaucacuuuuc

SEQ ID NO: 1155495 - RNA, 22 nt, Homo sapiens
aaucaugagauccuuuaaaucc

SEQ ID NO: 1155496 - RNA, 21 nt, Homo sapiens
aaucauuuguuuacauuugau

SEQ ID NO: 1155497 - RNA, 18 nt, Homo sapiens
aaucauuuucauuccuaa

SEQ ID NO: 1155498 - RNA, 14 nt, Homo sapiens
aauccacugugacu

SEQ ID NO: 1155499 - RNA, 20 nt, Homo sapiens
aauccagguacgcacagaca

SEQ ID NO: 1155500 - RNA, 17 nt, Homo sapiens
aauccaucagcaaugcu

SEQ ID NO: 1155501 - RNA, 15 nt, Homo sapiens
aaucccagcacuuug

SEQ ID NO: 1155502 - RNA, 20 nt, Homo sapiens
aauccccaauaauugcagaa

SEQ ID NO: 1155503 - RNA, 21 nt, Homo sapiens
aauccccacaggcacauuaac

SEQ ID NO: 1155504 - RNA, 19 nt, Homo sapiens
aauccccaugccuguggcu

SEQ ID NO: 1155505 - RNA, 20 nt, Homo sapiens
aaucccuauguuugucucac

SEQ ID NO: 1155506 - RNA, 16 nt, Homo sapiens
aaucccucauccugac

SEQ ID NO: 1155507 - RNA, 20 nt, Homo sapiens
aaucccuccccgugacugca

SEQ ID NO: 1155508 - RNA, 21 nt, Homo sapiens
aauccgaaaacuuccauugua

SEQ ID NO: 1155509 - RNA, 17 nt, Homo sapiens
aauccuacacaccuaag

SEQ ID NO: 1155510 - RNA, 14 nt, Homo sapiens
aauccuccuaccuc

SEQ ID NO: 1155511 - RNA, 15 nt, Homo sapiens
aauccucucugcaag

SEQ ID NO: 1155512 - RNA, 19 nt, Homo sapiens
aauccugucuguacuaaaa

SEQ ID NO: 1155513 - RNA, 22 nt, Homo sapiens
aauccuuucugccccccagggc

SEQ ID NO: 1155514 - RNA, 16 nt, Homo sapiens
aaucgaauacaaauca

SEQ ID NO: 1155515 - RNA, 18 nt, Homo sapiens
aaucuaacagugacuuca

SEQ ID NO: 1155516 - RNA, 17 nt, Homo sapiens
aaucuaaggauaaugaa

SEQ ID NO: 1155517 - RNA, 13 nt, Homo sapiens
aaucuacaugugu

SEQ ID NO: 1155518 - RNA, 16 nt, Homo sapiens
aaucuaugauuccagg

SEQ ID NO: 1155519 - RNA, 11 nt, Homo sapiens
aaucucaauac

SEQ ID NO: 1155520 - RNA, 13 nt, Homo sapiens
aaucucacuacac

SEQ ID NO: 1155521 - RNA, 14 nt, Homo sapiens
aaucucacuacaca

SEQ ID NO: 1155522 - RNA, 18 nt, Homo sapiens
aaucucgucaggcugcca

SEQ ID NO: 1155523 - RNA, 22 nt, Homo sapiens
aaucucugccuagaaucuuuau

SEQ ID NO: 1155524 - RNA, 17 nt, Homo sapiens
aaucugagaaacucuac

SEQ ID NO: 1155525 - RNA, 12 nt, Homo sapiens
aaucugaguaua

SEQ ID NO: 1155526 - RNA, 16 nt, Homo sapiens
aaucugaugaaaauau

SEQ ID NO: 1155527 - RNA, 14 nt, Homo sapiens
aaucuggauuucac

SEQ ID NO: 1155528 - RNA, 17 nt, Homo sapiens
aaucuggcauucuacac

SEQ ID NO: 1155529 - RNA, 12 nt, Homo sapiens
aaucuguacaaa

SEQ ID NO: 1155530 - RNA, 14 nt, Homo sapiens
aaucuguaucugua

SEQ ID NO: 1155531 - RNA, 18 nt, Homo sapiens
aaucuguccgugaccuau

SEQ ID NO: 1155532 - RNA, 13 nt, Homo sapiens
aaucuguccugug

SEQ ID NO: 1155533 - RNA, 13 nt, Homo sapiens
aaucuuaugcucu

SEQ ID NO: 1155534 - RNA, 19 nt, Homo sapiens
aaucuugcaaauauuuuag

SEQ ID NO: 1155535 - RNA, 16 nt, Homo sapiens
aaucuuucacuugaaa

SEQ ID NO: 1155536 - RNA, 12 nt, Homo sapiens
aaucuuugccaa

SEQ ID NO: 1155537 - RNA, 16 nt, Homo sapiens
aaucuuugcugaagcu

SEQ ID NO: 1155538 - RNA, 22 nt, Homo sapiens
aaucuuuguuaagguccugaaa

SEQ ID NO: 1155539 - RNA, 18 nt, Homo sapiens
aaucuuuuacaacugccu

SEQ ID NO: 1155540 - RNA, 20 nt, Homo sapiens
aaucuuuuucuuuaccucca

SEQ ID NO: 1155541 - RNA, 15 nt, Homo sapiens
aaugaaaauaagcau

SEQ ID NO: 1155542 - RNA, 17 nt, Homo sapiens
aaugaaagaaaaugaga

SEQ ID NO: 1155543 - RNA, 18 nt, Homo sapiens
aaugaaaggugacaaaag

SEQ ID NO: 1155544 - RNA, 22 nt, Homo sapiens
aaugaaaguauuggcauucaaa

SEQ ID NO: 1155545 - RNA, 15 nt, Homo sapiens
aaugaaaugaguuuu

SEQ ID NO: 1155546 - RNA, 22 nt, Homo sapiens
aaugaacacucuuuugcuuuau

SEQ ID NO: 1155547 - RNA, 13 nt, Homo sapiens
aaugaacacuuaa

SEQ ID NO: 1155548 - RNA, 20 nt, Homo sapiens
aaugaacccccaugauguaa

SEQ ID NO: 1155549 - RNA, 21 nt, Homo sapiens
aaugaacuucagaagugccau

SEQ ID NO: 1155550 - RNA, 13 nt, Homo sapiens
aaugaacuuuguc

SEQ ID NO: 1155551 - RNA, 15 nt, Homo sapiens
aaugaaggugugcua

SEQ ID NO: 1155552 - RNA, 14 nt, Homo sapiens
aaugaauacuuuau

SEQ ID NO: 1155553 - RNA, 15 nt, Homo sapiens
aaugaauucaguuuc

SEQ ID NO: 1155554 - RNA, 22 nt, Homo sapiens
aaugaauuuuuuuuauccuccu

SEQ ID NO: 1155555 - RNA, 15 nt, Homo sapiens
aaugacacagucuug

SEQ ID NO: 1155556 - RNA, 22 nt, Homo sapiens
aaugacacuagcuaauaucaau

SEQ ID NO: 1155557 - RNA, 14 nt, Homo sapiens
aaugacaguagcau

SEQ ID NO: 1155558 - RNA, 15 nt, Homo sapiens
aaugacauguauagu

SEQ ID NO: 1155559 - RNA, 19 nt, Homo sapiens
aaugacuaaaaaacaaaga

SEQ ID NO: 1155560 - RNA, 20 nt, Homo sapiens
aaugacucaugccucugagc

SEQ ID NO: 1155561 - RNA, 16 nt, Homo sapiens
aaugacucuuaggaca

SEQ ID NO: 1155562 - RNA, 14 nt, Homo sapiens
aaugacugcauuug

SEQ ID NO: 1155563 - RNA, 23 nt, Homo sapiens
aaugagauauaucuuuauacuua

SEQ ID NO: 1155564 - RNA, 16 nt, Homo sapiens
aaugaggaggaugcua

SEQ ID NO: 1155565 - RNA, 18 nt, Homo sapiens
aaugaggaggaugcuaaa

SEQ ID NO: 1155566 - RNA, 19 nt, Homo sapiens
aaugaggaggaugcuaaaa

SEQ ID NO: 1155567 - RNA, 15 nt, Homo sapiens
aaugagguaaauaag

SEQ ID NO: 1155568 - RNA, 19 nt, Homo sapiens
aaugaguggacaagucaug

SEQ ID NO: 1155569 - RNA, 16 nt, Homo sapiens
aaugauaaaauacuaa

SEQ ID NO: 1155570 - RNA, 14 nt, Homo sapiens
aaugauacugaugg

SEQ ID NO: 1155571 - RNA, 13 nt, Homo sapiens
aaugauccugcca

SEQ ID NO: 1155572 - RNA, 21 nt, Homo sapiens
aaugauguugauaauuucagg

SEQ ID NO: 1155573 - RNA, 16 nt, Homo sapiens
aaugcaaaacauuuca

SEQ ID NO: 1155574 - RNA, 15 nt, Homo sapiens
aaugcaagcuuauaa

SEQ ID NO: 1155575 - RNA, 19 nt, Homo sapiens
aaugcagcacugcugccuc

SEQ ID NO: 1155576 - RNA, 17 nt, Homo sapiens
aaugcagggcacaugau

SEQ ID NO: 1155577 - RNA, 13 nt, Homo sapiens
aaugcauccaaau

SEQ ID NO: 1155578 - RNA, 14 nt, Homo sapiens
aaugcaucuggcua

SEQ ID NO: 1155579 - RNA, 17 nt, Homo sapiens
aaugcauuuucugggug

SEQ ID NO: 1155580 - RNA, 20 nt, Homo sapiens
aaugccaaguuauacacggg

SEQ ID NO: 1155581 - RNA, 15 nt, Homo sapiens
aaugccaaugucagc

SEQ ID NO: 1155582 - RNA, 15 nt, Homo sapiens
aaugccacuucacca

SEQ ID NO: 1155583 - RNA, 20 nt, Homo sapiens
aaugcccaguucacuucuuu

SEQ ID NO: 1155584 - RNA, 14 nt, Homo sapiens
aaugccuacugagu

SEQ ID NO: 1155585 - RNA, 15 nt, Homo sapiens
aaugccuacugagua

SEQ ID NO: 1155586 - RNA, 23 nt, Homo sapiens
aaugcguggcacaucuaaauuga

SEQ ID NO: 1155587 - RNA, 15 nt, Homo sapiens
aaugcucaagaaaca

SEQ ID NO: 1155588 - RNA, 19 nt, Homo sapiens
aaugcucagaccagcucuu

SEQ ID NO: 1155589 - RNA, 13 nt, Homo sapiens
aaugcucccugaa

SEQ ID NO: 1155590 - RNA, 13 nt, Homo sapiens
aaugcugagguua

SEQ ID NO: 1155591 - RNA, 17 nt, Homo sapiens
aaugcugagguuaugaa

SEQ ID NO: 1155592 - RNA, 19 nt, Homo sapiens
aaugcuguuuucaacauug

SEQ ID NO: 1155593 - RNA, 22 nt, Homo sapiens
aaugcuguuuucaacauuguau

SEQ ID NO: 1155594 - RNA, 17 nt, Homo sapiens
aauggaaaaaaugaugu

SEQ ID NO: 1155595 - RNA, 16 nt, Homo sapiens
aauggaauucccaugc

SEQ ID NO: 1155596 - RNA, 19 nt, Homo sapiens
aauggacacuuuucaccuc

SEQ ID NO: 1155597 - RNA, 13 nt, Homo sapiens
aauggacugcaua

SEQ ID NO: 1155598 - RNA, 16 nt, Homo sapiens
aauggaggcaacgcca

SEQ ID NO: 1155599 - RNA, 21 nt, Homo sapiens
aauggauuugaugcuguuuga

SEQ ID NO: 1155600 - RNA, 13 nt, Homo sapiens
aauggcagcuuaa

SEQ ID NO: 1155601 - RNA, 16 nt, Homo sapiens
aauggccggcuggaaa

SEQ ID NO: 1155602 - RNA, 21 nt, Homo sapiens
aauggcuacacucaucugacu

SEQ ID NO: 1155603 - RNA, 16 nt, Homo sapiens
aauggcuguaucauag

SEQ ID NO: 1155604 - RNA, 11 nt, Homo sapiens
aaugggagaaa

SEQ ID NO: 1155605 - RNA, 12 nt, Homo sapiens
aauggggccaga

SEQ ID NO: 1155606 - RNA, 23 nt, Homo sapiens
aauggggccuguuacacaugaca

SEQ ID NO: 1155607 - RNA, 19 nt, Homo sapiens
aauggucaauaaagcuccu

SEQ ID NO: 1155608 - RNA, 22 nt, Homo sapiens
aauggugggauucauuggccca

SEQ ID NO: 1155609 - RNA, 16 nt, Homo sapiens
aauguaaaugaauuau

SEQ ID NO: 1155610 - RNA, 15 nt, Homo sapiens
aauguaauaauggaa

SEQ ID NO: 1155611 - RNA, 16 nt, Homo sapiens
aauguaauauacugag

SEQ ID NO: 1155612 - RNA, 13 nt, Homo sapiens
aauguagucaaua

SEQ ID NO: 1155613 - RNA, 13 nt, Homo sapiens
aauguaugugcuc

SEQ ID NO: 1155614 - RNA, 15 nt, Homo sapiens
aauguaugugcucuu

SEQ ID NO: 1155615 - RNA, 21 nt, Homo sapiens
aauguaugugcucuuagcaaa

SEQ ID NO: 1155616 - RNA, 20 nt, Homo sapiens
aaugucaguguucagccaaa

SEQ ID NO: 1155617 - RNA, 15 nt, Homo sapiens
aauguccaacuaaaa

SEQ ID NO: 1155618 - RNA, 16 nt, Homo sapiens
aaugucuccacuucac

SEQ ID NO: 1155619 - RNA, 19 nt, Homo sapiens
aaugucuccacuucacucc

SEQ ID NO: 1155620 - RNA, 20 nt, Homo sapiens
aaugucuuuugaauauuccc

SEQ ID NO: 1155621 - RNA, 21 nt, Homo sapiens
aaugucuuuugaauauuccca

SEQ ID NO: 1155622 - RNA, 22 nt, Homo sapiens
aaugucuuuuuucaaacuuuau

SEQ ID NO: 1155623 - RNA, 23 nt, Homo sapiens
aaugucuuuuuuuuaaugugcug

SEQ ID NO: 1155624 - RNA, 22 nt, Homo sapiens
aaugugaaaaugguccaggaga

SEQ ID NO: 1155625 - RNA, 20 nt, Homo sapiens
aaugugaauaaguaaagaau

SEQ ID NO: 1155626 - RNA, 15 nt, Homo sapiens
aaugugaugcuuuca

SEQ ID NO: 1155627 - RNA, 12 nt, Homo sapiens
aaugugauugca

SEQ ID NO: 1155628 - RNA, 19 nt, Homo sapiens
aacccaccccgcuuucgua

SEQ ID NO: 1155629 - RNA, 12 nt, Homo sapiens
aacccaccugcu

SEQ ID NO: 1155630 - RNA, 19 nt, Homo sapiens
aacccagaagaggagacag

SEQ ID NO: 1155631 - RNA, 19 nt, Homo sapiens
aacccaggaguucaggguc

SEQ ID NO: 1155632 - RNA, 19 nt, Homo sapiens
aaaggauaugguagcauuu

SEQ ID NO: 1155633 - RNA, 13 nt, Homo sapiens
aaaggaucacaga

SEQ ID NO: 1155634 - RNA, 18 nt, Homo sapiens
aaaggcacauuacauuua

SEQ ID NO: 1155635 - RNA, 16 nt, Homo sapiens
aaacagggacaaagaa

SEQ ID NO: 1155636 - RNA, 12 nt, Homo sapiens
aaacaggucaau

SEQ ID NO: 1155637 - RNA, 19 nt, Homo sapiens
aaacagguggagaaauucc

SEQ ID NO: 1155638 - RNA, 23 nt, Homo sapiens
aaacagugauuuagguuuguaac

SEQ ID NO: 1155639 - RNA, 18 nt, Homo sapiens
aaacauaaggcacauugu

SEQ ID NO: 1155640 - RNA, 22 nt, Homo sapiens
aaacaucacagaacauccugga

SEQ ID NO: 1155641 - RNA, 17 nt, Homo sapiens
aaacauguaugugcauu

SEQ ID NO: 1155642 - RNA, 18 nt, Homo sapiens
aaacauucaggagcuucc

SEQ ID NO: 1155643 - RNA, 13 nt, Homo sapiens
aaacauucaguga

SEQ ID NO: 1155644 - RNA, 14 nt, Homo sapiens
aaacauugccuuug

SEQ ID NO: 1155645 - RNA, 23 nt, Homo sapiens
aaacauugccuuugaauguuaau

SEQ ID NO: 1155646 - RNA, 15 nt, Homo sapiens
aaaccaaaaacugaa

SEQ ID NO: 1155647 - RNA, 19 nt, Homo sapiens
aaaccaacucuugcucuca

SEQ ID NO: 1155648 - RNA, 20 nt, Homo sapiens
aaaccagagaacaacauggg

SEQ ID NO: 1155649 - RNA, 14 nt, Homo sapiens
aaaccagagucaaa

SEQ ID NO: 1155650 - RNA, 20 nt, Homo sapiens
aaaccaucuaugugaauauu

SEQ ID NO: 1155651 - RNA, 17 nt, Homo sapiens
aaaccauuuuuuccuac

SEQ ID NO: 1155652 - RNA, 20 nt, Homo sapiens
aaacccaaccuuucauuucc

SEQ ID NO: 1155653 - RNA, 15 nt, Homo sapiens
aaacccauuuacuua

SEQ ID NO: 1155654 - RNA, 13 nt, Homo sapiens
aaaccccgucucu

SEQ ID NO: 1155655 - RNA, 13 nt, Homo sapiens
aaacccucgaggc

SEQ ID NO: 1155656 - RNA, 21 nt, Homo sapiens
aaacccuuccacguguaugca

SEQ ID NO: 1155657 - RNA, 21 nt, Homo sapiens
aaacccuuuuuauggcucaca

SEQ ID NO: 1155658 - RNA, 12 nt, Homo sapiens
aaaccuccacug

SEQ ID NO: 1155659 - RNA, 14 nt, Homo sapiens
aaaccucuccucau

SEQ ID NO: 1155660 - RNA, 15 nt, Homo sapiens
aaaccugugccuccc

SEQ ID NO: 1155661 - RNA, 15 nt, Homo sapiens
aaaccuuaguuucaa

SEQ ID NO: 1155662 - RNA, 15 nt, Homo sapiens
aaaccuuuuacguua

SEQ ID NO: 1155663 - RNA, 18 nt, Homo sapiens
aaacgccaguguguuuaa

SEQ ID NO: 1155664 - RNA, 13 nt, Homo sapiens
aaacgcugccugc

SEQ ID NO: 1155665 - RNA, 19 nt, Homo sapiens
aaacgucuucuaaacuucc

SEQ ID NO: 1155666 - RNA, 15 nt, Homo sapiens
aaacgugcgcucaca

SEQ ID NO: 1155667 - RNA, 18 nt, Homo sapiens
aaacuaaugguccacacc

SEQ ID NO: 1155668 - RNA, 13 nt, Homo sapiens
aaacuacauuuua

SEQ ID NO: 1155669 - RNA, 17 nt, Homo sapiens
aaacuaccuauauuccu

SEQ ID NO: 1155670 - RNA, 23 nt, Homo sapiens
aaacuagguaaaaucuacaguac

SEQ ID NO: 1155671 - RNA, 17 nt, Homo sapiens
aaacuauguaacaugua

SEQ ID NO: 1155672 - RNA, 18 nt, Homo sapiens
aaacuccucaacugggaa

SEQ ID NO: 1155673 - RNA, 17 nt, Homo sapiens
aaacucuuaaguccuaa

SEQ ID NO: 1155674 - RNA, 18 nt, Homo sapiens
aaacucuuauuacuguug

SEQ ID NO: 1155675 - RNA, 17 nt, Homo sapiens
aaacugaaagcuuuaau

SEQ ID NO: 1155676 - RNA, 20 nt, Homo sapiens
aaacugcaaagcucggugcu

SEQ ID NO: 1155677 - RNA, 23 nt, Homo sapiens
aaacugcagucaucaacaaugau

SEQ ID NO: 1155678 - RNA, 20 nt, Homo sapiens
aaacugcgaagucaagcuca

SEQ ID NO: 1155679 - RNA, 22 nt, Homo sapiens
aaacugcugucccaaacaugca

SEQ ID NO: 1155680 - RNA, 15 nt, Homo sapiens
aaacuguaugugcug

SEQ ID NO: 1155681 - RNA, 12 nt, Homo sapiens
aaacugugcacc

SEQ ID NO: 1155682 - RNA, 22 nt, Homo sapiens
aaacuguuuauuugcacuauga

SEQ ID NO: 1155683 - RNA, 18 nt, Homo sapiens
aaacuuacuaaauaucau

SEQ ID NO: 1155684 - RNA, 19 nt, Homo sapiens
aaacuuagacagcauguau

SEQ ID NO: 1155685 - RNA, 18 nt, Homo sapiens
aaacuucaucuuccccaa

SEQ ID NO: 1155686 - RNA, 13 nt, Homo sapiens
aaacuuccaguca

SEQ ID NO: 1155687 - RNA, 10 nt, Homo sapiens
aaacuugaac

SEQ ID NO: 1155688 - RNA, 20 nt, Homo sapiens
aaacuugaacucugguucuu

SEQ ID NO: 1155689 - RNA, 21 nt, Homo sapiens
aaacuuggauuugcucagugu

SEQ ID NO: 1155690 - RNA, 17 nt, Homo sapiens
aaacuuguuacuaaaga

SEQ ID NO: 1155691 - RNA, 13 nt, Homo sapiens
aaacuuguuuaca

SEQ ID NO: 1155692 - RNA, 13 nt, Homo sapiens
aaacuuuacuaag

SEQ ID NO: 1155693 - RNA, 16 nt, Homo sapiens
aaacuuuauugacaag

SEQ ID NO: 1155694 - RNA, 20 nt, Homo sapiens
aaacuuuccucuuccugccu

SEQ ID NO: 1155695 - RNA, 22 nt, Homo sapiens
aaacuuuuuuucaaaaaaagca

SEQ ID NO: 1155696 - RNA, 19 nt, Homo sapiens
aaagaaaaugugucugcaa

SEQ ID NO: 1155697 - RNA, 15 nt, Homo sapiens
aaagaaacaagaugc

SEQ ID NO: 1155698 - RNA, 13 nt, Homo sapiens
aaagaaccagaga

SEQ ID NO: 1155699 - RNA, 23 nt, Homo sapiens
aaagaaggcauuugcaggguccu

SEQ ID NO: 1155700 - RNA, 21 nt, Homo sapiens
aaagaauauucauaguuuaau

SEQ ID NO: 1155701 - RNA, 16 nt, Homo sapiens
aaagaauucucuugcu

SEQ ID NO: 1155702 - RNA, 22 nt, Homo sapiens
aaagaauuggccaggcauggug

SEQ ID NO: 1155703 - RNA, 16 nt, Homo sapiens
aaagacaagaugcaac

SEQ ID NO: 1155704 - RNA, 21 nt, Homo sapiens
aaagacaagcucaaguguuca

SEQ ID NO: 1155705 - RNA, 12 nt, Homo sapiens
aaagacagugaa

SEQ ID NO: 1155706 - RNA, 18 nt, Homo sapiens
aaagaccaucuccuguaa

SEQ ID NO: 1155707 - RNA, 14 nt, Homo sapiens
aaagaccuaugagc

SEQ ID NO: 1155708 - RNA, 12 nt, Homo sapiens
aaagacugccag

SEQ ID NO: 1155709 - RNA, 17 nt, Homo sapiens
aaagacuggauuugcag

SEQ ID NO: 1155710 - RNA, 16 nt, Homo sapiens
aaagacuggcuuuuau

SEQ ID NO: 1155711 - RNA, 22 nt, Homo sapiens
aaagagccucacaguuacguga

SEQ ID NO: 1155712 - RNA, 15 nt, Homo sapiens
aaagagggacaagag

SEQ ID NO: 1155713 - RNA, 14 nt, Homo sapiens
aaagaguccuauuu

SEQ ID NO: 1155714 - RNA, 14 nt, Homo sapiens
aaagauacacugac

SEQ ID NO: 1155715 - RNA, 15 nt, Homo sapiens
aaagauaccauucuu

SEQ ID NO: 1155716 - RNA, 17 nt, Homo sapiens
aaagaucgccuggcuca

SEQ ID NO: 1155717 - RNA, 15 nt, Homo sapiens
aaagaucuacaugaa

SEQ ID NO: 1155718 - RNA, 21 nt, Homo sapiens
aaagaugcagaguaaguauua

SEQ ID NO: 1155719 - RNA, 17 nt, Homo sapiens
aaagaugccauaggaga

SEQ ID NO: 1155720 - RNA, 15 nt, Homo sapiens
aaagaugucucacag

SEQ ID NO: 1155721 - RNA, 20 nt, Homo sapiens
aaagauuaggugagguuuau

SEQ ID NO: 1155722 - RNA, 19 nt, Homo sapiens
aaagauucaccuaagagau

SEQ ID NO: 1155723 - RNA, 14 nt, Homo sapiens
aaagauuggccaug

SEQ ID NO: 1155724 - RNA, 17 nt, Homo sapiens
aaagcaaaccagccuca

SEQ ID NO: 1155725 - RNA, 14 nt, Homo sapiens
aaagcaaagcucuu

SEQ ID NO: 1155726 - RNA, 21 nt, Homo sapiens
aaagcaaaggauguguuuuca

SEQ ID NO: 1155727 - RNA, 14 nt, Homo sapiens
aaagcaaagucacu

SEQ ID NO: 1155728 - RNA, 23 nt, Homo sapiens
aaagcaauucuaguguaaaucau

SEQ ID NO: 1155729 - RNA, 12 nt, Homo sapiens
aaagcacaguuu

SEQ ID NO: 1155730 - RNA, 12 nt, Homo sapiens
aaagcaccugcc

SEQ ID NO: 1155731 - RNA, 13 nt, Homo sapiens
aaagcacuguagc

SEQ ID NO: 1155732 - RNA, 22 nt, Homo sapiens
aaagcagacagcuccacccugg

SEQ ID NO: 1155733 - RNA, 19 nt, Homo sapiens
aaagcagcucaaaggcaca

SEQ ID NO: 1155734 - RNA, 19 nt, Homo sapiens
aaagcagggacugugaaca

SEQ ID NO: 1155735 - RNA, 15 nt, Homo sapiens
aaagcauuugcugug

SEQ ID NO: 1155736 - RNA, 22 nt, Homo sapiens
aaagcauuuguacuaagcuccu

SEQ ID NO: 1155737 - RNA, 15 nt, Homo sapiens
aaagccaagcacuuu

SEQ ID NO: 1155738 - RNA, 20 nt, Homo sapiens
aaagccacuggaaggagcac

SEQ ID NO: 1155739 - RNA, 14 nt, Homo sapiens
aaagccaucucagg

SEQ ID NO: 1155740 - RNA, 16 nt, Homo sapiens
aaagcccagaucucug

SEQ ID NO: 1155741 - RNA, 11 nt, Homo sapiens
aaagcccuccc

SEQ ID NO: 1155742 - RNA, 23 nt, Homo sapiens
aaagcccucccuaccuaccaaga

SEQ ID NO: 1155743 - RNA, 21 nt, Homo sapiens
aaagcccuuguccccaugaaa

SEQ ID NO: 1155744 - RNA, 18 nt, Homo sapiens
aaagccucaaaucuuccu

SEQ ID NO: 1155745 - RNA, 20 nt, Homo sapiens
aaagccucaaaucuuccuua

SEQ ID NO: 1155746 - RNA, 18 nt, Homo sapiens
aaagccucaugugugaaa

SEQ ID NO: 1155747 - RNA, 12 nt, Homo sapiens
aaagccucugau

SEQ ID NO: 1155748 - RNA, 21 nt, Homo sapiens
aaagcggacaucagcugguca

SEQ ID NO: 1155749 - RNA, 23 nt, Homo sapiens
aaagcuaagugaauuuuugcaca

SEQ ID NO: 1155750 - RNA, 16 nt, Homo sapiens
aaagcugagccugcag

SEQ ID NO: 1155751 - RNA, 12 nt, Homo sapiens
aaagcugcucag

SEQ ID NO: 1155752 - RNA, 23 nt, Homo sapiens
aaagcuugucugaucguucaaag

SEQ ID NO: 1155753 - RNA, 19 nt, Homo sapiens
aaaggaaaauaguaauguu

SEQ ID NO: 1155754 - RNA, 14 nt, Homo sapiens
aaaggaaacauaua

SEQ ID NO: 1155755 - RNA, 18 nt, Homo sapiens
aaaggaaacccagcucac

SEQ ID NO: 1155756 - RNA, 20 nt, Homo sapiens
aaaggaaacccagcucacag

SEQ ID NO: 1155757 - RNA, 12 nt, Homo sapiens
aaaggaacugca

SEQ ID NO: 1155758 - RNA, 16 nt, Homo sapiens
aaaggaauccucugug

SEQ ID NO: 1155759 - RNA, 17 nt, Homo sapiens
aaaggaauccucugugu

SEQ ID NO: 1155760 - RNA, 22 nt, Homo sapiens
aaaggaauccucugugucuuca

SEQ ID NO: 1155761 - RNA, 12 nt, Homo sapiens
aaaggagcauua

SEQ ID NO: 1155762 - RNA, 13 nt, Homo sapiens
auguuggccucca

SEQ ID NO: 1155763 - RNA, 18 nt, Homo sapiens
auguuguaagaaagacaa

SEQ ID NO: 1155764 - RNA, 22 nt, Homo sapiens
auguuguauaugguauugugag

SEQ ID NO: 1155765 - RNA, 14 nt, Homo sapiens
auguugucacuggu

SEQ ID NO: 1155766 - RNA, 22 nt, Homo sapiens
auguuguguuucuguucaccuu

SEQ ID NO: 1155767 - RNA, 15 nt, Homo sapiens
auguuucgcugauau

SEQ ID NO: 1155768 - RNA, 21 nt, Homo sapiens
auguuugauacucuaguaugu

SEQ ID NO: 1155769 - RNA, 20 nt, Homo sapiens
auguuuuagacaaauacuca

SEQ ID NO: 1155770 - RNA, 13 nt, Homo sapiens
auguuuugugauu

SEQ ID NO: 1155771 - RNA, 14 nt, Homo sapiens
auguuuuucaccua

SEQ ID NO: 1155772 - RNA, 22 nt, Homo sapiens
auuaaaaaauauauauauguau

SEQ ID NO: 1155773 - RNA, 15 nt, Homo sapiens
auuaaaacuauucau

SEQ ID NO: 1155774 - RNA, 22 nt, Homo sapiens
auuaaaaggcaguugcugugga

SEQ ID NO: 1155775 - RNA, 12 nt, Homo sapiens
auuaaaagucau

SEQ ID NO: 1155776 - RNA, 23 nt, Homo sapiens
auuaaagaaaauaugcauaauca

SEQ ID NO: 1155777 - RNA, 20 nt, Homo sapiens
auuaaagugaauuguugaca

SEQ ID NO: 1155778 - RNA, 12 nt, Homo sapiens
auuaaaugccac

SEQ ID NO: 1155779 - RNA, 21 nt, Homo sapiens
auuaaauggugauuucuugcu

SEQ ID NO: 1155780 - RNA, 14 nt, Homo sapiens
auuaaauguugcuu

SEQ ID NO: 1155781 - RNA, 18 nt, Homo sapiens
auuaaauuaccuugccaa

SEQ ID NO: 1155782 - RNA, 17 nt, Homo sapiens
auuaaauucacaaacuu

SEQ ID NO: 1155783 - RNA, 13 nt, Homo sapiens
auuaacaaaugug

SEQ ID NO: 1155784 - RNA, 16 nt, Homo sapiens
auuaacaguauaacau

SEQ ID NO: 1155785 - RNA, 16 nt, Homo sapiens
auuaacauaagaaaag

SEQ ID NO: 1155786 - RNA, 23 nt, Homo sapiens
auuaaccgaugcuuuaccaaaca

SEQ ID NO: 1155787 - RNA, 22 nt, Homo sapiens
auuaacuccuccugagcucuga

SEQ ID NO: 1155788 - RNA, 15 nt, Homo sapiens
auuaacuuacuucca

SEQ ID NO: 1155789 - RNA, 20 nt, Homo sapiens
auuaagaauugguugccaua

SEQ ID NO: 1155790 - RNA, 17 nt, Homo sapiens
auuaagccuuagaguau

SEQ ID NO: 1155791 - RNA, 22 nt, Homo sapiens
auuaagggauuaguauuuuucc

SEQ ID NO: 1155792 - RNA, 21 nt, Homo sapiens
auuaauaguuauuauuuacug

SEQ ID NO: 1155793 - RNA, 18 nt, Homo sapiens
auuaaucaaggcauaaaa

SEQ ID NO: 1155794 - RNA, 14 nt, Homo sapiens
auuaaucaccucuc

SEQ ID NO: 1155795 - RNA, 18 nt, Homo sapiens
auuaaugagaauuccuua

SEQ ID NO: 1155796 - RNA, 14 nt, Homo sapiens
auuaauugcugcaa

SEQ ID NO: 1155797 - RNA, 17 nt, Homo sapiens
auuaauuggagugcagc

SEQ ID NO: 1155798 - RNA, 23 nt, Homo sapiens
auuaauuuuuaaggauguugcca

SEQ ID NO: 1155799 - RNA, 15 nt, Homo sapiens
auuacaaaacucaga

SEQ ID NO: 1155800 - RNA, 14 nt, Homo sapiens
auuacaaauuuuca

SEQ ID NO: 1155801 - RNA, 19 nt, Homo sapiens
auuacagcaguugacucag

SEQ ID NO: 1155802 - RNA, 21 nt, Homo sapiens
auuacaggcgugauccaccac

SEQ ID NO: 1155803 - RNA, 12 nt, Homo sapiens
auuaccaagaga

SEQ ID NO: 1155804 - RNA, 20 nt, Homo sapiens
auuacccccuuuccucuugg

SEQ ID NO: 1155805 - RNA, 16 nt, Homo sapiens
auuacucucaaccacc

SEQ ID NO: 1155806 - RNA, 16 nt, Homo sapiens
auuacuuuucaucuaa

SEQ ID NO: 1155807 - RNA, 19 nt, Homo sapiens
auuagaaaauuuuauggac

SEQ ID NO: 1155808 - RNA, 22 nt, Homo sapiens
auuagcaaguuacagugaugcu

SEQ ID NO: 1155809 - RNA, 19 nt, Homo sapiens
auuagcccuuccuugccag

SEQ ID NO: 1155810 - RNA, 18 nt, Homo sapiens
auuagccggguguggcac

SEQ ID NO: 1155811 - RNA, 16 nt, Homo sapiens
auuaggagacacaggg

SEQ ID NO: 1155812 - RNA, 23 nt, Homo sapiens
auuagugguuuaucagcaaaaaa

SEQ ID NO: 1155813 - RNA, 15 nt, Homo sapiens
auuauaaacagcagg

SEQ ID NO: 1155814 - RNA, 17 nt, Homo sapiens
auuauaaauaaauacca

SEQ ID NO: 1155815 - RNA, 23 nt, Homo sapiens
auuauaagggagagcugagccag

SEQ ID NO: 1155816 - RNA, 23 nt, Homo sapiens
auuauacgcuggcaacacagagg

SEQ ID NO: 1155817 - RNA, 15 nt, Homo sapiens
auuauaguagcuuau

SEQ ID NO: 1155818 - RNA, 13 nt, Homo sapiens
auuaucaacagca

SEQ ID NO: 1155819 - RNA, 16 nt, Homo sapiens
auuaucaacagcauuu

SEQ ID NO: 1155820 - RNA, 17 nt, Homo sapiens
auuaucauguguaauca

SEQ ID NO: 1155821 - RNA, 14 nt, Homo sapiens
auuauccuugcuau

SEQ ID NO: 1155822 - RNA, 16 nt, Homo sapiens
auuaucuaaaguauga

SEQ ID NO: 1155823 - RNA, 22 nt, Homo sapiens
auuaucuugaauguaguauuca

SEQ ID NO: 1155824 - RNA, 15 nt, Homo sapiens
auuaugaacauccaa

SEQ ID NO: 1155825 - RNA, 18 nt, Homo sapiens
auuaugcaucugcuacug

SEQ ID NO: 1155826 - RNA, 16 nt, Homo sapiens
auuauggaauacaaaa

SEQ ID NO: 1155827 - RNA, 20 nt, Homo sapiens
auuauucuuguaguuuaccu

SEQ ID NO: 1155828 - RNA, 13 nt, Homo sapiens
auuauuuaacucu

SEQ ID NO: 1155829 - RNA, 18 nt, Homo sapiens
auuauuuuuucugugguc

SEQ ID NO: 1155830 - RNA, 12 nt, Homo sapiens
auucaaagcucu

SEQ ID NO: 1155831 - RNA, 22 nt, Homo sapiens
auucaacaagagcacuacauuc

SEQ ID NO: 1155832 - RNA, 16 nt, Homo sapiens
auucaacucuccaaug

SEQ ID NO: 1155833 - RNA, 21 nt, Homo sapiens
auucaacuuugcaaacaacag

SEQ ID NO: 1155834 - RNA, 20 nt, Homo sapiens
auucaccucucucacugacu

SEQ ID NO: 1155835 - RNA, 19 nt, Homo sapiens
auucagaacugauuccuga

SEQ ID NO: 1155836 - RNA, 23 nt, Homo sapiens
auucagaguagaaccacuugugg

SEQ ID NO: 1155837 - RNA, 16 nt, Homo sapiens
auucagcaucagagag

SEQ ID NO: 1155838 - RNA, 17 nt, Homo sapiens
auucaggcaacgcacaa

SEQ ID NO: 1155839 - RNA, 23 nt, Homo sapiens
auucagguauguugccuuuaugg

SEQ ID NO: 1155840 - RNA, 18 nt, Homo sapiens
auucaggugcagaggaag

SEQ ID NO: 1155841 - RNA, 22 nt, Homo sapiens
auucagucucuucuaagcaaaa

SEQ ID NO: 1155842 - RNA, 18 nt, Homo sapiens
auucagucuuuucucuga

SEQ ID NO: 1155843 - RNA, 23 nt, Homo sapiens
auucaugaagcggucacagauca

SEQ ID NO: 1155844 - RNA, 15 nt, Homo sapiens
auucaugaagugaau

SEQ ID NO: 1155845 - RNA, 13 nt, Homo sapiens
auucaugcacugu

SEQ ID NO: 1155846 - RNA, 19 nt, Homo sapiens
auucauuguuuugcaaaag

SEQ ID NO: 1155847 - RNA, 22 nt, Homo sapiens
auuccaaaggggaccccuauga

SEQ ID NO: 1155848 - RNA, 15 nt, Homo sapiens
auuccaaagucucua

SEQ ID NO: 1155849 - RNA, 20 nt, Homo sapiens
auuccaagacucuagagucc

SEQ ID NO: 1155850 - RNA, 13 nt, Homo sapiens
auuccaccaacag

SEQ ID NO: 1155851 - RNA, 16 nt, Homo sapiens
auuccagaugcaugau

SEQ ID NO: 1155852 - RNA, 16 nt, Homo sapiens
auuccauccucaacac

SEQ ID NO: 1155853 - RNA, 18 nt, Homo sapiens
auucccacagcacuaauu

SEQ ID NO: 1155854 - RNA, 13 nt, Homo sapiens
auucccacugccg

SEQ ID NO: 1155855 - RNA, 15 nt, Homo sapiens
auuccccaucucagg

SEQ ID NO: 1155856 - RNA, 23 nt, Homo sapiens
auucccggagggaaacugugaau

SEQ ID NO: 1155857 - RNA, 19 nt, Homo sapiens
auuccuauuggaaacagag

SEQ ID NO: 1155858 - RNA, 20 nt, Homo sapiens
auuccuauuggaaacagaga

SEQ ID NO: 1155859 - RNA, 18 nt, Homo sapiens
auuccucagaaaccaaag

SEQ ID NO: 1155860 - RNA, 21 nt, Homo sapiens
auuccugcucucccacugcac

SEQ ID NO: 1155861 - RNA, 13 nt, Homo sapiens
auuccuugauuca

SEQ ID NO: 1155862 - RNA, 15 nt, Homo sapiens
auuccuugguaauau

SEQ ID NO: 1155863 - RNA, 14 nt, Homo sapiens
cagguuagaagcaa

SEQ ID NO: 1155864 - RNA, 20 nt, Homo sapiens
cagguuagaagcaaggcaca

SEQ ID NO: 1155865 - RNA, 20 nt, Homo sapiens
cagguuuacuagcaccugcc

SEQ ID NO: 1155866 - RNA, 13 nt, Homo sapiens
cagguuuuugccc

SEQ ID NO: 1155867 - RNA, 14 nt, Homo sapiens
caguaaauauccca

SEQ ID NO: 1155868 - RNA, 10 nt, Homo sapiens
caguaacuga

SEQ ID NO: 1155869 - RNA, 16 nt, Homo sapiens
caguaccaguguaaau

SEQ ID NO: 1155870 - RNA, 16 nt, Homo sapiens
caguacuucagcaaga

SEQ ID NO: 1155871 - RNA, 19 nt, Homo sapiens
caguagcaaacuuuucaca

SEQ ID NO: 1155872 - RNA, 17 nt, Homo sapiens
caguagcacaaguuauu

SEQ ID NO: 1155873 - RNA, 20 nt, Homo sapiens
caguagcauggcucuuucau

SEQ ID NO: 1155874 - RNA, 14 nt, Homo sapiens
caguagcauuugcu

SEQ ID NO: 1155875 - RNA, 20 nt, Homo sapiens
caguagcuaaagugcaagac

SEQ ID NO: 1155876 - RNA, 21 nt, Homo sapiens
caguaggggaggagcacaguu

SEQ ID NO: 1155877 - RNA, 17 nt, Homo sapiens
caguauaaucuuuucau

SEQ ID NO: 1155878 - RNA, 14 nt, Homo sapiens
caguauacaguccu

SEQ ID NO: 1155879 - RNA, 12 nt, Homo sapiens
caguaucuccaa

SEQ ID NO: 1155880 - RNA, 21 nt, Homo sapiens
caguauuccaaacucuccagc

SEQ ID NO: 1155881 - RNA, 23 nt, Homo sapiens
caguauuucuggagggcaauuug

SEQ ID NO: 1155882 - RNA, 18 nt, Homo sapiens
cagucaaucuaugagggu

SEQ ID NO: 1155883 - RNA, 17 nt, Homo sapiens
cagucauuaauuuucaa

SEQ ID NO: 1155884 - RNA, 15 nt, Homo sapiens
caguccacugcugag

SEQ ID NO: 1155885 - RNA, 21 nt, Homo sapiens
caguccaucccagagggaccg

SEQ ID NO: 1155886 - RNA, 21 nt, Homo sapiens
caguccauuuccuaauguaua

SEQ ID NO: 1155887 - RNA, 18 nt, Homo sapiens
cagucgcacacacauuug

SEQ ID NO: 1155888 - RNA, 15 nt, Homo sapiens
cagucuagugcaaaa

SEQ ID NO: 1155889 - RNA, 20 nt, Homo sapiens
cagucucaauuuuguauuua

SEQ ID NO: 1155890 - RNA, 18 nt, Homo sapiens
cagucuccuccccuacuc

SEQ ID NO: 1155891 - RNA, 20 nt, Homo sapiens
cagucugacccuuacagccu

SEQ ID NO: 1155892 - RNA, 23 nt, Homo sapiens
cagucugugccuacauguucuca

SEQ ID NO: 1155893 - RNA, 15 nt, Homo sapiens
cagucuguucucaca

SEQ ID NO: 1155894 - RNA, 17 nt, Homo sapiens
cagucuuccauuugcaa

SEQ ID NO: 1155895 - RNA, 22 nt, Homo sapiens
cagugaaagcugacaucuguaa

SEQ ID NO: 1155896 - RNA, 17 nt, Homo sapiens
cagugaaggcccaugaa

SEQ ID NO: 1155897 - RNA, 22 nt, Homo sapiens
cagugaaguguucugcugagac

SEQ ID NO: 1155898 - RNA, 23 nt, Homo sapiens
cagugaauuuuugcaauaaugca

SEQ ID NO: 1155899 - RNA, 16 nt, Homo sapiens
cagugacagugcccag

SEQ ID NO: 1155900 - RNA, 20 nt, Homo sapiens
cagugaugcuggaugcuccu

SEQ ID NO: 1155901 - RNA, 19 nt, Homo sapiens
agccuccuauccaccacug

SEQ ID NO: 1155902 - RNA, 17 nt, Homo sapiens
agccuccuuacauuaaa

SEQ ID NO: 1155903 - RNA, 22 nt, Homo sapiens
agccucucaguacagcacuccu

SEQ ID NO: 1155904 - RNA, 13 nt, Homo sapiens
agccucucuucac

SEQ ID NO: 1155905 - RNA, 19 nt, Homo sapiens
agccucugggucagugguc

SEQ ID NO: 1155906 - RNA, 18 nt, Homo sapiens
agccucuguccgccuuua

SEQ ID NO: 1155907 - RNA, 21 nt, Homo sapiens
agccugaauaaaccaagacaa

SEQ ID NO: 1155908 - RNA, 13 nt, Homo sapiens
agccugaccucua

SEQ ID NO: 1155909 - RNA, 15 nt, Homo sapiens
agccugaccucuagc

SEQ ID NO: 1155910 - RNA, 16 nt, Homo sapiens
agccugacucuucccu

SEQ ID NO: 1155911 - RNA, 21 nt, Homo sapiens
agccugagcagagacaugacu

SEQ ID NO: 1155912 - RNA, 18 nt, Homo sapiens
agccugagucaccugcag

SEQ ID NO: 1155913 - RNA, 13 nt, Homo sapiens
agccugcagggaa

SEQ ID NO: 1155914 - RNA, 23 nt, Homo sapiens
agccugccagcaguuacugugaa

SEQ ID NO: 1155915 - RNA, 13 nt, Homo sapiens
agccugccuuuaa

SEQ ID NO: 1155916 - RNA, 16 nt, Homo sapiens
agccuggaagcacuac

SEQ ID NO: 1155917 - RNA, 14 nt, Homo sapiens
agccuggcaucugu

SEQ ID NO: 1155918 - RNA, 16 nt, Homo sapiens
agccuggccaacaugg

SEQ ID NO: 1155919 - RNA, 19 nt, Homo sapiens
agccuggccaacaugguga

SEQ ID NO: 1155920 - RNA, 20 nt, Homo sapiens
agccuggccagacacaggcc

SEQ ID NO: 1155921 - RNA, 18 nt, Homo sapiens
agccuguccaacauggug

SEQ ID NO: 1155922 - RNA, 13 nt, Homo sapiens
agccugucucucc

SEQ ID NO: 1155923 - RNA, 21 nt, Homo sapiens
agccugugagggcugggaugg

SEQ ID NO: 1155924 - RNA, 16 nt, Homo sapiens
agccugugcaaugcau

SEQ ID NO: 1155925 - RNA, 20 nt, Homo sapiens
agccuguugcggaucuucau

SEQ ID NO: 1155926 - RNA, 22 nt, Homo sapiens
agccuuacaguuauccugcaag

SEQ ID NO: 1155927 - RNA, 17 nt, Homo sapiens
agccuucagcagcagcu

SEQ ID NO: 1155928 - RNA, 19 nt, Homo sapiens
agccuucagcagcagcuca

SEQ ID NO: 1155929 - RNA, 13 nt, Homo sapiens
agccuugcaugac

SEQ ID NO: 1155930 - RNA, 20 nt, Homo sapiens
agccuugggggggcugccuu

SEQ ID NO: 1155931 - RNA, 17 nt, Homo sapiens
agccuuuccuguagccu

SEQ ID NO: 1155932 - RNA, 13 nt, Homo sapiens
agcgaacaucuuc

SEQ ID NO: 1155933 - RNA, 17 nt, Homo sapiens
agcgagacuccaucuca

SEQ ID NO: 1155934 - RNA, 17 nt, Homo sapiens
agcgagacuccaucucu

SEQ ID NO: 1155935 - RNA, 19 nt, Homo sapiens
agcgaggaggcuccagagg

SEQ ID NO: 1155936 - RNA, 20 nt, Homo sapiens
agcgauucuccugccucagc

SEQ ID NO: 1155937 - RNA, 15 nt, Homo sapiens
agcgcaaugccaucu

SEQ ID NO: 1155938 - RNA, 20 nt, Homo sapiens
agcgcuguauuuacagacac

SEQ ID NO: 1155939 - RNA, 14 nt, Homo sapiens
agcggaucucacuc

SEQ ID NO: 1155940 - RNA, 14 nt, Homo sapiens
agcggccucagggu

SEQ ID NO: 1155941 - RNA, 14 nt, Homo sapiens
agcgggaauggcag

SEQ ID NO: 1155942 - RNA, 23 nt, Homo sapiens
agcggggagccaggaaagaagag

SEQ ID NO: 1155943 - RNA, 18 nt, Homo sapiens
agcgugugugaacaaaug

SEQ ID NO: 1155944 - RNA, 20 nt, Homo sapiens
agcguucuaaauaugaauga

SEQ ID NO: 1155945 - RNA, 18 nt, Homo sapiens
agcguuugcugugccagg

SEQ ID NO: 1155946 - RNA, 22 nt, Homo sapiens
agcuaaaagaggccuguucaua

SEQ ID NO: 1155947 - RNA, 18 nt, Homo sapiens
agcuaaggaggggaaaaa

SEQ ID NO: 1155948 - RNA, 22 nt, Homo sapiens
agcuaagugaauuuuugcacau

SEQ ID NO: 1155949 - RNA, 12 nt, Homo sapiens
agcuaauuugca

SEQ ID NO: 1155950 - RNA, 21 nt, Homo sapiens
agcuacaccuuucuccuuugu

SEQ ID NO: 1155951 - RNA, 15 nt, Homo sapiens
agcuacaggacauuu

SEQ ID NO: 1155952 - RNA, 16 nt, Homo sapiens
agcuacaggacauuuu

SEQ ID NO: 1155953 - RNA, 17 nt, Homo sapiens
agcuacaugguggagca

SEQ ID NO: 1155954 - RNA, 21 nt, Homo sapiens
agcuacucuccccacgagggc

SEQ ID NO: 1155955 - RNA, 21 nt, Homo sapiens
agcuacugccgucagugcugu

SEQ ID NO: 1155956 - RNA, 12 nt, Homo sapiens
agcuagccagag

SEQ ID NO: 1155957 - RNA, 16 nt, Homo sapiens
agcuaguguaccuccu

SEQ ID NO: 1155958 - RNA, 12 nt, Homo sapiens
agcuaucacugu

SEQ ID NO: 1155959 - RNA, 22 nt, Homo sapiens
agcuauuuaagugauacauacc

SEQ ID NO: 1155960 - RNA, 16 nt, Homo sapiens
agcuauuuaaugacac

SEQ ID NO: 1155961 - RNA, 14 nt, Homo sapiens
agcucaagggacaa

SEQ ID NO: 1155962 - RNA, 19 nt, Homo sapiens
agcucacacccuaccuucc

SEQ ID NO: 1155963 - RNA, 20 nt, Homo sapiens
agcucagcauuuccacacca

SEQ ID NO: 1155964 - RNA, 18 nt, Homo sapiens
agcucagggacuggcaca

SEQ ID NO: 1155965 - RNA, 12 nt, Homo sapiens
agcucauguguc

SEQ ID NO: 1155966 - RNA, 22 nt, Homo sapiens
agcuccaagagguuuuucagcu

SEQ ID NO: 1155967 - RNA, 16 nt, Homo sapiens
agcucgcauuugucaa

SEQ ID NO: 1155968 - RNA, 20 nt, Homo sapiens
agcucgcgggacccgacccc

SEQ ID NO: 1155969 - RNA, 21 nt, Homo sapiens
agcucuaagucucaacugcuc

SEQ ID NO: 1155970 - RNA, 14 nt, Homo sapiens
agcucuaucugcaa

SEQ ID NO: 1155971 - RNA, 20 nt, Homo sapiens
agcucugaaaccaguguuag

SEQ ID NO: 1155972 - RNA, 21 nt, Homo sapiens
agcucugggguuuguaaggca

SEQ ID NO: 1155973 - RNA, 22 nt, Homo sapiens
agcucugucugcucaaugccau

SEQ ID NO: 1155974 - RNA, 14 nt, Homo sapiens
agcucuucugggca

SEQ ID NO: 1155975 - RNA, 15 nt, Homo sapiens
agcugaauacauucu

SEQ ID NO: 1155976 - RNA, 17 nt, Homo sapiens
agcugacauugccaaaa

SEQ ID NO: 1155977 - RNA, 16 nt, Homo sapiens
agcugagaucaugcca

SEQ ID NO: 1155978 - RNA, 23 nt, Homo sapiens
agcugagaucaugccacugcacu

SEQ ID NO: 1155979 - RNA, 23 nt, Homo sapiens
agcugagauugcaccacugcacu

SEQ ID NO: 1155980 - RNA, 15 nt, Homo sapiens
agcugaggacucugc

SEQ ID NO: 1155981 - RNA, 22 nt, Homo sapiens
agcugauuucagugcugcugaa

SEQ ID NO: 1155982 - RNA, 23 nt, Homo sapiens
agcugccaaggaaacccccagug

SEQ ID NO: 1155983 - RNA, 17 nt, Homo sapiens
agcugccucccaucuca

SEQ ID NO: 1155984 - RNA, 16 nt, Homo sapiens
agcugccuuggcucag

SEQ ID NO: 1155985 - RNA, 18 nt, Homo sapiens
agcugcgccugcgcugca

SEQ ID NO: 1155986 - RNA, 21 nt, Homo sapiens
agcugcuacaaagaagacaug

SEQ ID NO: 1155987 - RNA, 13 nt, Homo sapiens
agcugcucaggga

SEQ ID NO: 1155988 - RNA, 19 nt, Homo sapiens
agcugcuccuagagggagg

SEQ ID NO: 1155989 - RNA, 12 nt, Homo sapiens
agcugcugugac

SEQ ID NO: 1155990 - RNA, 18 nt, Homo sapiens
agcuggaaaaaguguccu

SEQ ID NO: 1155991 - RNA, 20 nt, Homo sapiens
agcuggagcccgugcccuac

SEQ ID NO: 1155992 - RNA, 23 nt, Homo sapiens
agcuggagcccgugcccuaccac

SEQ ID NO: 1155993 - RNA, 16 nt, Homo sapiens
agcuggagugcugcuu

SEQ ID NO: 1155994 - RNA, 14 nt, Homo sapiens
agcugggauuacag

SEQ ID NO: 1155995 - RNA, 21 nt, Homo sapiens
agcugggauuacaggugugca

SEQ ID NO: 1155996 - RNA, 20 nt, Homo sapiens
agcugguccuguccagacac

SEQ ID NO: 1155997 - RNA, 12 nt, Homo sapiens
agcuggugacag

SEQ ID NO: 1155998 - RNA, 14 nt, Homo sapiens
agcuggugagauca

SEQ ID NO: 1155999 - RNA, 19 nt, Homo sapiens
agcuggugccugcuuugac

SEQ ID NO: 1156000 - RNA, 15 nt, Homo sapiens
agcugguggacccag

SEQ ID NO: 1156001 - RNA, 20 nt, Homo sapiens
agcugguggauggugacuuu

SEQ ID NO: 1156002 - RNA, 13 nt, Homo sapiens
agcugugcugggu

SEQ ID NO: 1156003 - RNA, 14 nt, Homo sapiens
agcugugugccaca

SEQ ID NO: 1156004 - RNA, 19 nt, Homo sapiens
agcuguuaauuugaguacu

SEQ ID NO: 1156005 - RNA, 19 nt, Homo sapiens
agcuguucaacaucacuga

SEQ ID NO: 1156006 - RNA, 20 nt, Homo sapiens
agcuuaggaaagaacaucac

SEQ ID NO: 1156007 - RNA, 16 nt, Homo sapiens
agcuuaggcauucuaa

SEQ ID NO: 1156008 - RNA, 22 nt, Homo sapiens
agcuuaggcauucuaagucaca

SEQ ID NO: 1156009 - RNA, 16 nt, Homo sapiens
agcuuauggcaucuca

SEQ ID NO: 1156010 - RNA, 13 nt, Homo sapiens
agcuucaaaaacu

SEQ ID NO: 1156011 - RNA, 12 nt, Homo sapiens
agcuuccuccag

SEQ ID NO: 1156012 - RNA, 21 nt, Homo sapiens
agcuuccugcugaauguagua

SEQ ID NO: 1156013 - RNA, 19 nt, Homo sapiens
agcuucugccuucuggaau

SEQ ID NO: 1156014 - RNA, 17 nt, Homo sapiens
agcuugaaagcaguuaa

SEQ ID NO: 1156015 - RNA, 21 nt, Homo sapiens
agcuugaauccuucacuuuag

SEQ ID NO: 1156016 - RNA, 14 nt, Homo sapiens
agcuuggauaacca

SEQ ID NO: 1156017 - RNA, 19 nt, Homo sapiens
agcuugggcaacagagcaa

SEQ ID NO: 1156018 - RNA, 14 nt, Homo sapiens
agcuuuacuguggc

SEQ ID NO: 1156019 - RNA, 12 nt, Homo sapiens
augaagugcaaa

SEQ ID NO: 1156020 - RNA, 20 nt, Homo sapiens
augaaguggaaaaaggagag

SEQ ID NO: 1156021 - RNA, 20 nt, Homo sapiens
augaaguuccacuugguuca

SEQ ID NO: 1156022 - RNA, 23 nt, Homo sapiens
augaauauguguggcagugaaga

SEQ ID NO: 1156023 - RNA, 13 nt, Homo sapiens
augaaugcugauu

SEQ ID NO: 1156024 - RNA, 22 nt, Homo sapiens
augaauucauacucuguugccu

SEQ ID NO: 1156025 - RNA, 22 nt, Homo sapiens
augaauuccuauauaccuaaua

SEQ ID NO: 1156026 - RNA, 23 nt, Homo sapiens
augaauucgaugcguauucugug

SEQ ID NO: 1156027 - RNA, 19 nt, Homo sapiens
augaauuuuuuucaucuuc

SEQ ID NO: 1156028 - RNA, 14 nt, Homo sapiens
augacaaacccagg

SEQ ID NO: 1156029 - RNA, 21 nt, Homo sapiens
augacaaauguauuaaugcua

SEQ ID NO: 1156030 - RNA, 14 nt, Homo sapiens
augacacuuguccc

SEQ ID NO: 1156031 - RNA, 11 nt, Homo sapiens
augacagugaa

SEQ ID NO: 1156032 - RNA, 16 nt, Homo sapiens
augacaucaaaaugag

SEQ ID NO: 1156033 - RNA, 23 nt, Homo sapiens
augacauuuuuuuuaacuacuau

SEQ ID NO: 1156034 - RNA, 14 nt, Homo sapiens
augaccagagcaaa

SEQ ID NO: 1156035 - RNA, 16 nt, Homo sapiens
augaccauaaccacug

SEQ ID NO: 1156036 - RNA, 18 nt, Homo sapiens
augaccauaaccacugaa

SEQ ID NO: 1156037 - RNA, 16 nt, Homo sapiens
augaccuugggguaca

SEQ ID NO: 1156038 - RNA, 15 nt, Homo sapiens
augacgucaucauca

SEQ ID NO: 1156039 - RNA, 21 nt, Homo sapiens
augacuaguaaacauguggga

SEQ ID NO: 1156040 - RNA, 21 nt, Homo sapiens
augacugagucuggcaaacau

SEQ ID NO: 1156041 - RNA, 16 nt, Homo sapiens
augacugcaccaacau

SEQ ID NO: 1156042 - RNA, 17 nt, Homo sapiens
augacuggucucuggcu

SEQ ID NO: 1156043 - RNA, 15 nt, Homo sapiens
augacuguugcauag

SEQ ID NO: 1156044 - RNA, 15 nt, Homo sapiens
augagaaaugaugaa

SEQ ID NO: 1156045 - RNA, 21 nt, Homo sapiens
augagaagaaaauggaaccag

SEQ ID NO: 1156046 - RNA, 14 nt, Homo sapiens
augagaagauauau

SEQ ID NO: 1156047 - RNA, 13 nt, Homo sapiens
augagacuugccu

SEQ ID NO: 1156048 - RNA, 19 nt, Homo sapiens
augagagggugcuauccau

SEQ ID NO: 1156049 - RNA, 18 nt, Homo sapiens
augagcuccuuaaggcuc

SEQ ID NO: 1156050 - RNA, 13 nt, Homo sapiens
augaggacagagg

SEQ ID NO: 1156051 - RNA, 17 nt, Homo sapiens
augaggagcugcagauu

SEQ ID NO: 1156052 - RNA, 16 nt, Homo sapiens
augaggaggaugcuaa

SEQ ID NO: 1156053 - RNA, 15 nt, Homo sapiens
augaggaucugaaaa

SEQ ID NO: 1156054 - RNA, 24 nt, Homo sapiens
augaggccacugcugcuucuccau

SEQ ID NO: 1156055 - RNA, 23 nt, Homo sapiens
augaggcugcuuuccaaagccaa

SEQ ID NO: 1156056 - RNA, 21 nt, Homo sapiens
augaggguucaucaucccucc

SEQ ID NO: 1156057 - RNA, 21 nt, Homo sapiens
augagguuucuuugacuucaa

SEQ ID NO: 1156058 - RNA, 20 nt, Homo sapiens
augaguaauacaucaaagag

SEQ ID NO: 1156059 - RNA, 18 nt, Homo sapiens
augaguauaaugaacacu

SEQ ID NO: 1156060 - RNA, 19 nt, Homo sapiens
augaguauaaugaacacuc

SEQ ID NO: 1156061 - RNA, 16 nt, Homo sapiens
augaguggcuuuaaug

SEQ ID NO: 1156062 - RNA, 12 nt, Homo sapiens
augaguuugaca

SEQ ID NO: 1156063 - RNA, 22 nt, Homo sapiens
augauaaguacuacauaccuca

SEQ ID NO: 1156064 - RNA, 16 nt, Homo sapiens
augauacugaugccau

SEQ ID NO: 1156065 - RNA, 14 nt, Homo sapiens
augauacuuacuga

SEQ ID NO: 1156066 - RNA, 16 nt, Homo sapiens
augauagaacuguacu

SEQ ID NO: 1156067 - RNA, 12 nt, Homo sapiens
augaucagcaaa

SEQ ID NO: 1156068 - RNA, 12 nt, Homo sapiens
augaucagggau

SEQ ID NO: 1156069 - RNA, 22 nt, Homo sapiens
augauccaagcaagacugaggg

SEQ ID NO: 1156070 - RNA, 18 nt, Homo sapiens
augauccccaagugugaa

SEQ ID NO: 1156071 - RNA, 15 nt, Homo sapiens
augaucucaguauuu

SEQ ID NO: 1156072 - RNA, 22 nt, Homo sapiens
augaugaaaaauuauaguagcu

SEQ ID NO: 1156073 - RNA, 15 nt, Homo sapiens
augaugauguggaag

SEQ ID NO: 1156074 - RNA, 20 nt, Homo sapiens
augauggcuuuaccuuuauu

SEQ ID NO: 1156075 - RNA, 23 nt, Homo sapiens
augauguagagugugguuaugaa

SEQ ID NO: 1156076 - RNA, 13 nt, Homo sapiens
augaugucuuuaa

SEQ ID NO: 1156077 - RNA, 12 nt, Homo sapiens
augauucaucuu

SEQ ID NO: 1156078 - RNA, 14 nt, Homo sapiens
augauuccagacag

SEQ ID NO: 1156079 - RNA, 20 nt, Homo sapiens
augauugagaguuggcugua

SEQ ID NO: 1156080 - RNA, 12 nt, Homo sapiens
augauuugcacu

SEQ ID NO: 1156081 - RNA, 18 nt, Homo sapiens
augauuuuaagaggcuuu

SEQ ID NO: 1156082 - RNA, 15 nt, Homo sapiens
augcaaaagguuuau

SEQ ID NO: 1156083 - RNA, 20 nt, Homo sapiens
augcaaagaacucaccacaa

SEQ ID NO: 1156084 - RNA, 13 nt, Homo sapiens
augcaaugaacac

SEQ ID NO: 1156085 - RNA, 19 nt, Homo sapiens
augcaauguaagcauacuu

SEQ ID NO: 1156086 - RNA, 13 nt, Homo sapiens
augcacacagugc

SEQ ID NO: 1156087 - RNA, 20 nt, Homo sapiens
augcaccaaaucaucucuca

SEQ ID NO: 1156088 - RNA, 19 nt, Homo sapiens
augcaccugcaaucccagc

SEQ ID NO: 1156089 - RNA, 19 nt, Homo sapiens
augcacucagcucuuggcu

SEQ ID NO: 1156090 - RNA, 12 nt, Homo sapiens
augcacugugaa

SEQ ID NO: 1156091 - RNA, 14 nt, Homo sapiens
augcagaaguauuc

SEQ ID NO: 1156092 - RNA, 20 nt, Homo sapiens
augcagaaguauucuuuuca

SEQ ID NO: 1156093 - RNA, 17 nt, Homo sapiens
augcagaguugacauga

SEQ ID NO: 1156094 - RNA, 14 nt, Homo sapiens
augcagauugcuac

SEQ ID NO: 1156095 - RNA, 22 nt, Homo sapiens
augcagauuuugcccuugacaa

SEQ ID NO: 1156096 - RNA, 13 nt, Homo sapiens
augcagcagggau

SEQ ID NO: 1156097 - RNA, 18 nt, Homo sapiens
augcagccagccaucaaa

SEQ ID NO: 1156098 - RNA, 20 nt, Homo sapiens
augcaguuguggugugccau

SEQ ID NO: 1156099 - RNA, 17 nt, Homo sapiens
augcauaaaagggucaa

SEQ ID NO: 1156100 - RNA, 14 nt, Homo sapiens
augcauaaaugcga

SEQ ID NO: 1156101 - RNA, 14 nt, Homo sapiens
augcauacacacac

SEQ ID NO: 1156102 - RNA, 13 nt, Homo sapiens
augcauacuggug

SEQ ID NO: 1156103 - RNA, 22 nt, Homo sapiens
augcaugugaagaaaggguguu

SEQ ID NO: 1156104 - RNA, 22 nt, Homo sapiens
augcauuauugacgaacuggcu

SEQ ID NO: 1156105 - RNA, 19 nt, Homo sapiens
augccaacaagaaugcauu

SEQ ID NO: 1156106 - RNA, 23 nt, Homo sapiens
augccacaaggacuuccugucca

SEQ ID NO: 1156107 - RNA, 16 nt, Homo sapiens
augccacuucaccaag

SEQ ID NO: 1156108 - RNA, 13 nt, Homo sapiens
augccauuugggc

SEQ ID NO: 1156109 - RNA, 17 nt, Homo sapiens
augcccccuccugcaag

SEQ ID NO: 1156110 - RNA, 15 nt, Homo sapiens
augccuagaguuuac

SEQ ID NO: 1156111 - RNA, 23 nt, Homo sapiens
augccucagcccugacccugugg

SEQ ID NO: 1156112 - RNA, 15 nt, Homo sapiens
augccucuaaucuca

SEQ ID NO: 1156113 - RNA, 18 nt, Homo sapiens
augccuggaagcuuuguc

SEQ ID NO: 1156114 - RNA, 22 nt, Homo sapiens
augccuucccccaguauguccu

SEQ ID NO: 1156115 - RNA, 17 nt, Homo sapiens
augcgccaccaugcccu

SEQ ID NO: 1156116 - RNA, 14 nt, Homo sapiens
augcggccauucaa

SEQ ID NO: 1156117 - RNA, 17 nt, Homo sapiens
augcuaccggggaccgg

SEQ ID NO: 1156118 - RNA, 15 nt, Homo sapiens
augcuacgugugauu

SEQ ID NO: 1156119 - RNA, 21 nt, Homo sapiens
augcuacugaaacuuaccuga

SEQ ID NO: 1156120 - RNA, 16 nt, Homo sapiens
augcuauacuggaaau

SEQ ID NO: 1156121 - RNA, 13 nt, Homo sapiens
augcuauauaucu

SEQ ID NO: 1156122 - RNA, 12 nt, Homo sapiens
caugcuggugaa

SEQ ID NO: 1156123 - RNA, 18 nt, Homo sapiens
caugcuucagugcugcuc

SEQ ID NO: 1156124 - RNA, 19 nt, Homo sapiens
caugcuuguggccaaugca

SEQ ID NO: 1156125 - RNA, 17 nt, Homo sapiens
cauggacacaucaggaa

SEQ ID NO: 1156126 - RNA, 24 nt, Homo sapiens
cauggacaguuguuuggagaacaa

SEQ ID NO: 1156127 - RNA, 12 nt, Homo sapiens
cauggacaugca

SEQ ID NO: 1156128 - RNA, 21 nt, Homo sapiens
cauggacaugcuucagugcug

SEQ ID NO: 1156129 - RNA, 14 nt, Homo sapiens
cauggagaacagca

SEQ ID NO: 1156130 - RNA, 19 nt, Homo sapiens
cauggagaacagcaugaca

SEQ ID NO: 1156131 - RNA, 17 nt, Homo sapiens
cauggagaccgugacca

SEQ ID NO: 1156132 - RNA, 12 nt, Homo sapiens
cauggagcucuu

SEQ ID NO: 1156133 - RNA, 14 nt, Homo sapiens
cauggaguguuuga

SEQ ID NO: 1156134 - RNA, 20 nt, Homo sapiens
cauggaguuaacaucaugaa

SEQ ID NO: 1156135 - RNA, 16 nt, Homo sapiens
cauggauguguugccc

SEQ ID NO: 1156136 - RNA, 21 nt, Homo sapiens
cauggccuuccacgucuuccu

SEQ ID NO: 1156137 - RNA, 18 nt, Homo sapiens
cauggcuaaauacaaugg

SEQ ID NO: 1156138 - RNA, 16 nt, Homo sapiens
cauggcucuaaaaagu

SEQ ID NO: 1156139 - RNA, 19 nt, Homo sapiens
caugggccucugauggaag

SEQ ID NO: 1156140 - RNA, 20 nt, Homo sapiens
caugggcuaaugaagaucau

SEQ ID NO: 1156141 - RNA, 19 nt, Homo sapiens
caugggucgggagagggga

SEQ ID NO: 1156142 - RNA, 22 nt, Homo sapiens
cauggguggauuuagccaagga

SEQ ID NO: 1156143 - RNA, 23 nt, Homo sapiens
cauggugagccuagcccugggac

SEQ ID NO: 1156144 - RNA, 19 nt, Homo sapiens
caugguggcaugcaccugc

SEQ ID NO: 1156145 - RNA, 20 nt, Homo sapiens
caugguggcaugcaccugca

SEQ ID NO: 1156146 - RNA, 15 nt, Homo sapiens
caugguuauugauga

SEQ ID NO: 1156147 - RNA, 18 nt, Homo sapiens
caugguugaaaccccauc

SEQ ID NO: 1156148 - RNA, 20 nt, Homo sapiens
cauguaaaauaugucuuucu

SEQ ID NO: 1156149 - RNA, 14 nt, Homo sapiens
cauguaaaaucuuc

SEQ ID NO: 1156150 - RNA, 19 nt, Homo sapiens
cauguaaagaaaaaaacuu

SEQ ID NO: 1156151 - RNA, 20 nt, Homo sapiens
cauguaacuauuucuucaga

SEQ ID NO: 1156152 - RNA, 14 nt, Homo sapiens
cauguacaugguau

SEQ ID NO: 1156153 - RNA, 22 nt, Homo sapiens
cauguacaugguauuaacacuu

SEQ ID NO: 1156154 - RNA, 12 nt, Homo sapiens
cauguaccucac

SEQ ID NO: 1156155 - RNA, 21 nt, Homo sapiens
cauguagguacccugccacgg

SEQ ID NO: 1156156 - RNA, 14 nt, Homo sapiens
cauguauacuuaau

SEQ ID NO: 1156157 - RNA, 13 nt, Homo sapiens
cauguaugucuug

SEQ ID NO: 1156158 - RNA, 17 nt, Homo sapiens
cauguaugucuuggaca

SEQ ID NO: 1156159 - RNA, 22 nt, Homo sapiens
cauguauguggauacagucauu

SEQ ID NO: 1156160 - RNA, 14 nt, Homo sapiens
caugucacacuggc

SEQ ID NO: 1156161 - RNA, 17 nt, Homo sapiens
caugucacuacuguccg

SEQ ID NO: 1156162 - RNA, 15 nt, Homo sapiens
cauguccuaauucuu

SEQ ID NO: 1156163 - RNA, 14 nt, Homo sapiens
gaucuaacuauguu

SEQ ID NO: 1156164 - RNA, 20 nt, Homo sapiens
gaucuaccugcaacacaaca

SEQ ID NO: 1156165 - RNA, 15 nt, Homo sapiens
gaucucacauuucac

SEQ ID NO: 1156166 - RNA, 19 nt, Homo sapiens
gaucuccaacagccagugu

SEQ ID NO: 1156167 - RNA, 20 nt, Homo sapiens
gaucuccaacagccagugug

SEQ ID NO: 1156168 - RNA, 19 nt, Homo sapiens
gaucucccugccgccucaa

SEQ ID NO: 1156169 - RNA, 20 nt, Homo sapiens
gaucucggcucagugcaacc

SEQ ID NO: 1156170 - RNA, 16 nt, Homo sapiens
gaucugcacauuucau

SEQ ID NO: 1156171 - RNA, 18 nt, Homo sapiens
gaucugcuuucuguucau

SEQ ID NO: 1156172 - RNA, 18 nt, Homo sapiens
gaucuggaaccucagccu

SEQ ID NO: 1156173 - RNA, 19 nt, Homo sapiens
gaucuguuuugaaggcaaa

SEQ ID NO: 1156174 - RNA, 18 nt, Homo sapiens
gaucuuccagaagcugua

SEQ ID NO: 1156175 - RNA, 23 nt, Homo sapiens
gaucuugagcucugcucucagca

SEQ ID NO: 1156176 - RNA, 17 nt, Homo sapiens
gaucuuugcccauggaa

SEQ ID NO: 1156177 - RNA, 15 nt, Homo sapiens
gaucuuuggacagaa

SEQ ID NO: 1156178 - RNA, 14 nt, Homo sapiens
gaugaaaaccugca

SEQ ID NO: 1156179 - RNA, 20 nt, Homo sapiens
gaugaaggaaggacuaugac

SEQ ID NO: 1156180 - RNA, 15 nt, Homo sapiens
gaugacaaacccagg

SEQ ID NO: 1156181 - RNA, 17 nt, Homo sapiens
gaugaccccaucaaccc

SEQ ID NO: 1156182 - RNA, 14 nt, Homo sapiens
gaugacuggucucu

SEQ ID NO: 1156183 - RNA, 13 nt, Homo sapiens
gaugagaguacac

SEQ ID NO: 1156184 - RNA, 16 nt, Homo sapiens
gaugaggguucaucau

SEQ ID NO: 1156185 - RNA, 13 nt, Homo sapiens
gaugaguuugaca

SEQ ID NO: 1156186 - RNA, 14 nt, Homo sapiens
gaugauccagagac

SEQ ID NO: 1156187 - RNA, 20 nt, Homo sapiens
gaugauggucuucagccucu

SEQ ID NO: 1156188 - RNA, 20 nt, Homo sapiens
gaugcacuaccauugcuguu

SEQ ID NO: 1156189 - RNA, 22 nt, Homo sapiens
gaugcacuaccauugcuguucu

SEQ ID NO: 1156190 - RNA, 19 nt, Homo sapiens
gaugcaggccucugguguu

SEQ ID NO: 1156191 - RNA, 17 nt, Homo sapiens
gaugcauuucuaucaaa

SEQ ID NO: 1156192 - RNA, 15 nt, Homo sapiens
gaugcguauucugug

SEQ ID NO: 1156193 - RNA, 16 nt, Homo sapiens
gaugcuaaaaauguca

SEQ ID NO: 1156194 - RNA, 22 nt, Homo sapiens
gaugcugaccucaccugguccu

SEQ ID NO: 1156195 - RNA, 20 nt, Homo sapiens
gaugcugccccucaucucuc

SEQ ID NO: 1156196 - RNA, 18 nt, Homo sapiens
gauggaacaugcccacaa

SEQ ID NO: 1156197 - RNA, 16 nt, Homo sapiens
gauggaagacaggaaa

SEQ ID NO: 1156198 - RNA, 17 nt, Homo sapiens
gauggcauccugugaag

SEQ ID NO: 1156199 - RNA, 23 nt, Homo sapiens
gauggcgaggccucucucaggag

SEQ ID NO: 1156200 - RNA, 19 nt, Homo sapiens
gauggcuuuaccuuuauua

SEQ ID NO: 1156201 - RNA, 16 nt, Homo sapiens
gauggguggaccaaac

SEQ ID NO: 1156202 - RNA, 12 nt, Homo sapiens
gaugguacguga

SEQ ID NO: 1156203 - RNA, 19 nt, Homo sapiens
gauggucccaggaagcagg

SEQ ID NO: 1156204 - RNA, 17 nt, Homo sapiens
gauggucccuauuccuc

SEQ ID NO: 1156205 - RNA, 23 nt, Homo sapiens
gauggugcaugccuguagucuca

SEQ ID NO: 1156206 - RNA, 13 nt, Homo sapiens
gaugguugccaag

SEQ ID NO: 1156207 - RNA, 15 nt, Homo sapiens
gauguagcuuuucac

SEQ ID NO: 1156208 - RNA, 19 nt, Homo sapiens
gauguaugaauacagcagc

SEQ ID NO: 1156209 - RNA, 17 nt, Homo sapiens
gauguauuuagcuugaa

SEQ ID NO: 1156210 - RNA, 13 nt, Homo sapiens
gaugugaagccaa

SEQ ID NO: 1156211 - RNA, 13 nt, Homo sapiens
gaugugagggcac

SEQ ID NO: 1156212 - RNA, 13 nt, Homo sapiens
gaugugcacugca

SEQ ID NO: 1156213 - RNA, 17 nt, Homo sapiens
gaugugcugcagcgcuu

SEQ ID NO: 1156214 - RNA, 15 nt, Homo sapiens
gaugugugucagaag

SEQ ID NO: 1156215 - RNA, 19 nt, Homo sapiens
gauguguuaggaaugucaa

SEQ ID NO: 1156216 - RNA, 13 nt, Homo sapiens
gauguuaaccaau

SEQ ID NO: 1156217 - RNA, 22 nt, Homo sapiens
gauuaaugaaucguaaugaagu

SEQ ID NO: 1156218 - RNA, 16 nt, Homo sapiens
gauuacaggcaccugc

SEQ ID NO: 1156219 - RNA, 15 nt, Homo sapiens
gauuacaggcgugag

SEQ ID NO: 1156220 - RNA, 12 nt, Homo sapiens
gauuauguugcu

SEQ ID NO: 1156221 - RNA, 22 nt, Homo sapiens
gauuauuaaaauuagugcugua

SEQ ID NO: 1156222 - RNA, 22 nt, Homo sapiens
gauuauuagccagguaauguga

SEQ ID NO: 1156223 - RNA, 13 nt, Homo sapiens
gauuauucagugu

SEQ ID NO: 1156224 - RNA, 20 nt, Homo sapiens
gauucacaucucauuuuucc

SEQ ID NO: 1156225 - RNA, 15 nt, Homo sapiens
gauucaguauuacaa

SEQ ID NO: 1156226 - RNA, 22 nt, Homo sapiens
gauucaucauccaggagguuca

SEQ ID NO: 1156227 - RNA, 15 nt, Homo sapiens
gauucaugucucacg

SEQ ID NO: 1156228 - RNA, 14 nt, Homo sapiens
gauuccauccugug

SEQ ID NO: 1156229 - RNA, 15 nt, Homo sapiens
gauuccccaucucag

SEQ ID NO: 1156230 - RNA, 15 nt, Homo sapiens
gcagaaauacaguau

SEQ ID NO: 1156231 - RNA, 21 nt, Homo sapiens
gcagaaauacaguaugaucuc

SEQ ID NO: 1156232 - RNA, 21 nt, Homo sapiens
gcagaagaauugaacccagga

SEQ ID NO: 1156233 - RNA, 21 nt, Homo sapiens
gcagaauuuaaguugguaaua

SEQ ID NO: 1156234 - RNA, 18 nt, Homo sapiens
gcagacaguguuuugcac

SEQ ID NO: 1156235 - RNA, 19 nt, Homo sapiens
gcagacauagaagagccaa

SEQ ID NO: 1156236 - RNA, 14 nt, Homo sapiens
gcagaccacugaua

SEQ ID NO: 1156237 - RNA, 16 nt, Homo sapiens
gcagacccccaugaga

SEQ ID NO: 1156238 - RNA, 14 nt, Homo sapiens
gcagaccugacucu

SEQ ID NO: 1156239 - RNA, 15 nt, Homo sapiens
gcagacucauugcag

SEQ ID NO: 1156240 - RNA, 22 nt, Homo sapiens
gcagagcaaaaugcucuugucc

SEQ ID NO: 1156241 - RNA, 20 nt, Homo sapiens
gcagaggcuaauucaguguc

SEQ ID NO: 1156242 - RNA, 15 nt, Homo sapiens
gcagauaacugcugu

SEQ ID NO: 1156243 - RNA, 14 nt, Homo sapiens
gcagauacugcugu

SEQ ID NO: 1156244 - RNA, 13 nt, Homo sapiens
gcagaucaccuga

SEQ ID NO: 1156245 - RNA, 18 nt, Homo sapiens
gcagauggccacugcucu

SEQ ID NO: 1156246 - RNA, 16 nt, Homo sapiens
gcagauuuuugcaaua

SEQ ID NO: 1156247 - RNA, 23 nt, Homo sapiens
gcagcaaggaggaagaggacuca

SEQ ID NO: 1156248 - RNA, 13 nt, Homo sapiens
gcagcacugcugc

SEQ ID NO: 1156249 - RNA, 12 nt, Homo sapiens
gcagcacuggaa

SEQ ID NO: 1156250 - RNA, 18 nt, Homo sapiens
gcagcagagggucuccaa

SEQ ID NO: 1156251 - RNA, 22 nt, Homo sapiens
gcagcagcucacacccuaccuu

SEQ ID NO: 1156252 - RNA, 23 nt, Homo sapiens
gcagcaucccuagucucuaccca

SEQ ID NO: 1156253 - RNA, 19 nt, Homo sapiens
gcagccacgaggugcaaca

SEQ ID NO: 1156254 - RNA, 18 nt, Homo sapiens
gcagccagaggcaccuca

SEQ ID NO: 1156255 - RNA, 20 nt, Homo sapiens
gcagcccuuguuuauaugcc

SEQ ID NO: 1156256 - RNA, 21 nt, Homo sapiens
gcagccuaacacggugcucau

SEQ ID NO: 1156257 - RNA, 17 nt, Homo sapiens
gcagcgccaggcugacc

SEQ ID NO: 1156258 - RNA, 14 nt, Homo sapiens
gcagcuacuccccu

SEQ ID NO: 1156259 - RNA, 17 nt, Homo sapiens
gcagcuccagucagugu

SEQ ID NO: 1156260 - RNA, 23 nt, Homo sapiens
gcagcucuccccucagagugcaa

SEQ ID NO: 1156261 - RNA, 20 nt, Homo sapiens
gcagcugccauugcagauuc

SEQ ID NO: 1156262 - RNA, 22 nt, Homo sapiens
gcagcugugcugggugagcucu

SEQ ID NO: 1156263 - RNA, 12 nt, Homo sapiens
gcagcuucaggg

SEQ ID NO: 1156264 - RNA, 18 nt, Homo sapiens
gcaggaaauggcugugga

SEQ ID NO: 1156265 - RNA, 12 nt, Homo sapiens
gcaggaccaagg

SEQ ID NO: 1156266 - RNA, 13 nt, Homo sapiens
gcaggaccgccau

SEQ ID NO: 1156267 - RNA, 12 nt, Homo sapiens
gcaggagaauca

SEQ ID NO: 1156268 - RNA, 17 nt, Homo sapiens
gcaggagauuugcuuga

SEQ ID NO: 1156269 - RNA, 20 nt, Homo sapiens
gcaggaggccauuuacuuga

SEQ ID NO: 1156270 - RNA, 13 nt, Homo sapiens
gcaggaugaccuc

SEQ ID NO: 1156271 - RNA, 14 nt, Homo sapiens
gcaggcccacuguc

SEQ ID NO: 1156272 - RNA, 20 nt, Homo sapiens
gcaggcccguggcaggagga

SEQ ID NO: 1156273 - RNA, 17 nt, Homo sapiens
gcaggccugccuucuca

SEQ ID NO: 1156274 - RNA, 21 nt, Homo sapiens
gcaggcguguggcagccacac

SEQ ID NO: 1156275 - RNA, 13 nt, Homo sapiens
gcagggcagagga

SEQ ID NO: 1156276 - RNA, 20 nt, Homo sapiens
gcagggccuugcccagagau

SEQ ID NO: 1156277 - RNA, 23 nt, Homo sapiens
gcaggggcggguggaucaccuga

SEQ ID NO: 1156278 - RNA, 21 nt, Homo sapiens
gcaggggggcaguaacucccc

SEQ ID NO: 1156279 - RNA, 21 nt, Homo sapiens
gcagggugcaguaucaugccc

SEQ ID NO: 1156280 - RNA, 14 nt, Homo sapiens
gcagggugcuagug

SEQ ID NO: 1156281 - RNA, 15 nt, Homo sapiens
gcagguaaccccaga

SEQ ID NO: 1156282 - RNA, 21 nt, Homo sapiens
gcaggucacugucacugccga

SEQ ID NO: 1156283 - RNA, 15 nt, Homo sapiens
gcaggucugcaaggg

SEQ ID NO: 1156284 - RNA, 22 nt, Homo sapiens
gcaggugcugacuucaucuccc

SEQ ID NO: 1156285 - RNA, 24 nt, Homo sapiens
gcaguagccuaacacacuccaaga

SEQ ID NO: 1156286 - RNA, 21 nt, Homo sapiens
gcaguaucaugcccugugcaa

SEQ ID NO: 1156287 - RNA, 15 nt, Homo sapiens
gcaguccauuuccua

SEQ ID NO: 1156288 - RNA, 21 nt, Homo sapiens
gcagugagccgagaucgugcc

SEQ ID NO: 1156289 - RNA, 14 nt, Homo sapiens
gcagugauuugaag

SEQ ID NO: 1156290 - RNA, 14 nt, Homo sapiens
gcagugcacaucug

SEQ ID NO: 1156291 - RNA, 15 nt, Homo sapiens
gcagugcacauuuca

SEQ ID NO: 1156292 - RNA, 16 nt, Homo sapiens
gcagugccuugugcaa

SEQ ID NO: 1156293 - RNA, 17 nt, Homo sapiens
gcaguguucaaggccau

SEQ ID NO: 1156294 - RNA, 14 nt, Homo sapiens
gcaguucugauuca

SEQ ID NO: 1156295 - RNA, 17 nt, Homo sapiens
gcaguugaaagggcaau

SEQ ID NO: 1156296 - RNA, 12 nt, Homo sapiens
gcaguuggucua

SEQ ID NO: 1156297 - RNA, 18 nt, Homo sapiens
gcaguuguggugugccau

SEQ ID NO: 1156298 - RNA, 18 nt, Homo sapiens
gcaguuuaagagcagaac

SEQ ID NO: 1156299 - RNA, 17 nt, Homo sapiens
gcaguuucuaagcaugu

SEQ ID NO: 1156300 - RNA, 20 nt, Homo sapiens
gagaacuccuaggguggcug

SEQ ID NO: 1156301 - RNA, 19 nt, Homo sapiens
gagaacugcauauguuucg

SEQ ID NO: 1156302 - RNA, 14 nt, Homo sapiens
gagaagcagugagc

SEQ ID NO: 1156303 - RNA, 18 nt, Homo sapiens
gagaaggaaaagacugaa

SEQ ID NO: 1156304 - RNA, 16 nt, Homo sapiens
gagaaggaaagugauu

SEQ ID NO: 1156305 - RNA, 19 nt, Homo sapiens
gagaaggaaggagacucac

SEQ ID NO: 1156306 - RNA, 16 nt, Homo sapiens
gagaaggaggggagca

SEQ ID NO: 1156307 - RNA, 21 nt, Homo sapiens
gagaaguaagcagaguucuuu

SEQ ID NO: 1156308 - RNA, 12 nt, Homo sapiens
gagaagugccua

SEQ ID NO: 1156309 - RNA, 15 nt, Homo sapiens
gagaaguggggaccc

SEQ ID NO: 1156310 - RNA, 21 nt, Homo sapiens
gagaaguuucgagggguccuc

SEQ ID NO: 1156311 - RNA, 19 nt, Homo sapiens
gagaaucaacauuucucaa

SEQ ID NO: 1156312 - RNA, 18 nt, Homo sapiens
gagaaucagaucauuuca

SEQ ID NO: 1156313 - RNA, 13 nt, Homo sapiens
gagacacagggaa

SEQ ID NO: 1156314 - RNA, 23 nt, Homo sapiens
gagacagcuuacugcagcacugu

SEQ ID NO: 1156315 - RNA, 19 nt, Homo sapiens
gagacaggacgaggcagaa

SEQ ID NO: 1156316 - RNA, 21 nt, Homo sapiens
gagacaggagaaacacuugaa

SEQ ID NO: 1156317 - RNA, 19 nt, Homo sapiens
gagacaggaggucagcaca

SEQ ID NO: 1156318 - RNA, 20 nt, Homo sapiens
gagacaguuuacuuugccaa

SEQ ID NO: 1156319 - RNA, 22 nt, Homo sapiens
gagaccaaggcccccgggccga

SEQ ID NO: 1156320 - RNA, 14 nt, Homo sapiens
gagacccaacaaug

SEQ ID NO: 1156321 - RNA, 17 nt, Homo sapiens
gagacccaggacuccuc

SEQ ID NO: 1156322 - RNA, 22 nt, Homo sapiens
gagaccccaucuuccagccacc

SEQ ID NO: 1156323 - RNA, 16 nt, Homo sapiens
gagacgaaugccauug

SEQ ID NO: 1156324 - RNA, 19 nt, Homo sapiens
gagacuccaucucaaaaaa

SEQ ID NO: 1156325 - RNA, 14 nt, Homo sapiens
gagacuccaucucu

SEQ ID NO: 1156326 - RNA, 18 nt, Homo sapiens
gagacuugaaucaaguca

SEQ ID NO: 1156327 - RNA, 17 nt, Homo sapiens
gagacuuuagucuuugg

SEQ ID NO: 1156328 - RNA, 23 nt, Homo sapiens
gagacuuuagucuuuggggcaag

SEQ ID NO: 1156329 - RNA, 20 nt, Homo sapiens
gagagaugaaccacauuaua

SEQ ID NO: 1156330 - RNA, 16 nt, Homo sapiens
gagagccaccaagagg

SEQ ID NO: 1156331 - RNA, 20 nt, Homo sapiens
gagagcggcggagacaagcc

SEQ ID NO: 1156332 - RNA, 22 nt, Homo sapiens
gagagcucgcuuugagugacug

SEQ ID NO: 1156333 - RNA, 14 nt, Homo sapiens
gagaggaacaagcu

SEQ ID NO: 1156334 - RNA, 13 nt, Homo sapiens
gagaggcuguguc

SEQ ID NO: 1156335 - RNA, 13 nt, Homo sapiens
gagagggugacaa

SEQ ID NO: 1156336 - RNA, 17 nt, Homo sapiens
gagagggugcuauccau

SEQ ID NO: 1156337 - RNA, 16 nt, Homo sapiens
gagaggugucugccac

SEQ ID NO: 1156338 - RNA, 19 nt, Homo sapiens
gagaguacaccccaacagc

SEQ ID NO: 1156339 - RNA, 14 nt, Homo sapiens
gagagucaagggaa

SEQ ID NO: 1156340 - RNA, 21 nt, Homo sapiens
gagaguccagcuaacacacuu

SEQ ID NO: 1156341 - RNA, 22 nt, Homo sapiens
gagagucuuaucugagcugagc

SEQ ID NO: 1156342 - RNA, 14 nt, Homo sapiens
gagagugagacuca

SEQ ID NO: 1156343 - RNA, 11 nt, Homo sapiens
gagagugcaga

SEQ ID NO: 1156344 - RNA, 18 nt, Homo sapiens
gagaguuaaaagcagcag

SEQ ID NO: 1156345 - RNA, 14 nt, Homo sapiens
gagauaaacuaaug

SEQ ID NO: 1156346 - RNA, 19 nt, Homo sapiens
gagauagcauugugaacug

SEQ ID NO: 1156347 - RNA, 20 nt, Homo sapiens
gagaucacgucacugcacuc

SEQ ID NO: 1156348 - RNA, 23 nt, Homo sapiens
gagauccuuuagugcacccagug

SEQ ID NO: 1156349 - RNA, 20 nt, Homo sapiens
gagaucgugccauugcacuc

SEQ ID NO: 1156350 - RNA, 12 nt, Homo sapiens
gagaucugcaca

SEQ ID NO: 1156351 - RNA, 18 nt, Homo sapiens
gagaugaaccacauuaua

SEQ ID NO: 1156352 - RNA, 15 nt, Homo sapiens
gagaugcagcuggaa

SEQ ID NO: 1156353 - RNA, 14 nt, Homo sapiens
gagauggagaaaau

SEQ ID NO: 1156354 - RNA, 19 nt, Homo sapiens
gagauggagucuugcuaua

SEQ ID NO: 1156355 - RNA, 20 nt, Homo sapiens
gagauggcuggcuggugaua

SEQ ID NO: 1156356 - RNA, 20 nt, Homo sapiens
gagaugggugcaacucccuc

SEQ ID NO: 1156357 - RNA, 17 nt, Homo sapiens
gagauguggaaaagcca

SEQ ID NO: 1156358 - RNA, 19 nt, Homo sapiens
gagauucagugaacuaauu

SEQ ID NO: 1156359 - RNA, 19 nt, Homo sapiens
gagauuccagucuacuuga

SEQ ID NO: 1156360 - RNA, 20 nt, Homo sapiens
gagauugcaccacugcacuc

SEQ ID NO: 1156361 - RNA, 22 nt, Homo sapiens
gagauugcaccacugcacucca

SEQ ID NO: 1156362 - RNA, 19 nt, Homo sapiens
gagauuuaaagaauucucu

SEQ ID NO: 1156363 - RNA, 16 nt, Homo sapiens
gagauuugguguacaa

SEQ ID NO: 1156364 - RNA, 15 nt, Homo sapiens
gagcaaaaugcucuu

SEQ ID NO: 1156365 - RNA, 17 nt, Homo sapiens
gagcaaaucgugccuug

SEQ ID NO: 1156366 - RNA, 20 nt, Homo sapiens
gagcaacuaacuaaccacau

SEQ ID NO: 1156367 - RNA, 22 nt, Homo sapiens
gagcacaaucuguucuacucuu

SEQ ID NO: 1156368 - RNA, 23 nt, Homo sapiens
gagcacauacuaccuagaaguaa

SEQ ID NO: 1156369 - RNA, 16 nt, Homo sapiens
gagcaccagcggucca

SEQ ID NO: 1156370 - RNA, 20 nt, Homo sapiens
gagcagaaaguaagcauuuc

SEQ ID NO: 1156371 - RNA, 17 nt, Homo sapiens
gagcagaggucucccaa

SEQ ID NO: 1156372 - RNA, 10 nt, Homo sapiens
gagcagagua

SEQ ID NO: 1156373 - RNA, 21 nt, Homo sapiens
gagcaggccauuggcuacuga

SEQ ID NO: 1156374 - RNA, 20 nt, Homo sapiens
gagcaggggcauugcugauu

SEQ ID NO: 1156375 - RNA, 13 nt, Homo sapiens
gagcaggguccug

SEQ ID NO: 1156376 - RNA, 18 nt, Homo sapiens
gagcaguccauuucuacc

SEQ ID NO: 1156377 - RNA, 21 nt, Homo sapiens
gagcagugaaugauucagugu

SEQ ID NO: 1156378 - RNA, 14 nt, Homo sapiens
gagcaguucagagu

SEQ ID NO: 1156379 - RNA, 18 nt, Homo sapiens
gagcaucacuagugacaa

SEQ ID NO: 1156380 - RNA, 15 nt, Homo sapiens
gagcauggacagugu

SEQ ID NO: 1156381 - RNA, 21 nt, Homo sapiens
gagcauuuaagagugaaguca

SEQ ID NO: 1156382 - RNA, 15 nt, Homo sapiens
gagccaaaaucucaa

SEQ ID NO: 1156383 - RNA, 19 nt, Homo sapiens
gagccaaaggcauccaggc

SEQ ID NO: 1156384 - RNA, 22 nt, Homo sapiens
gagccaagaucgcaccacugca

SEQ ID NO: 1156385 - RNA, 17 nt, Homo sapiens
gagccagcggcuccaac

SEQ ID NO: 1156386 - RNA, 15 nt, Homo sapiens
gagccagcucccucu

SEQ ID NO: 1156387 - RNA, 16 nt, Homo sapiens
gagccaggaaagaaga

SEQ ID NO: 1156388 - RNA, 20 nt, Homo sapiens
gagccaggagaccugcucuc

SEQ ID NO: 1156389 - RNA, 18 nt, Homo sapiens
gagcccagauugugccac

SEQ ID NO: 1156390 - RNA, 17 nt, Homo sapiens
gagcccagcagaucuca

SEQ ID NO: 1156391 - RNA, 13 nt, Homo sapiens
gagcccaguuuca

SEQ ID NO: 1156392 - RNA, 13 nt, Homo sapiens
gagcccgcacugu

SEQ ID NO: 1156393 - RNA, 16 nt, Homo sapiens
gagcccuccccaggaa

SEQ ID NO: 1156394 - RNA, 23 nt, Homo sapiens
gagcccuccgccuucacauuccc

SEQ ID NO: 1156395 - RNA, 15 nt, Homo sapiens
gagcccugcuaugaa

SEQ ID NO: 1156396 - RNA, 20 nt, Homo sapiens
gagccgagaucgugccauug

SEQ ID NO: 1156397 - RNA, 22 nt, Homo sapiens
gagccggacacuucucaggaaa

SEQ ID NO: 1156398 - RNA, 16 nt, Homo sapiens
gagccggcauccuugc

SEQ ID NO: 1156399 - RNA, 12 nt, Homo sapiens
gagccugaggca

SEQ ID NO: 1156400 - RNA, 15 nt, Homo sapiens
gagccugcagggaag

SEQ ID NO: 1156401 - RNA, 16 nt, Homo sapiens
gagccuggcuccaaac

SEQ ID NO: 1156402 - RNA, 19 nt, Homo sapiens
gagccuggcuccaaacccu

SEQ ID NO: 1156403 - RNA, 19 nt, Homo sapiens
gagccuuuuaacugugcaa

SEQ ID NO: 1156404 - RNA, 23 nt, Homo sapiens
gagccuuuuaccccugcacaguu

SEQ ID NO: 1156405 - RNA, 19 nt, Homo sapiens
gagcgagacuccaucucaa

SEQ ID NO: 1156406 - RNA, 19 nt, Homo sapiens
gagcgagauuccgucucaa

SEQ ID NO: 1156407 - RNA, 21 nt, Homo sapiens
gagcggcugcucgcccaggaa

SEQ ID NO: 1156408 - RNA, 19 nt, Homo sapiens
gagcuaggaagagucuacc

SEQ ID NO: 1156409 - RNA, 13 nt, Homo sapiens
gagcucaagggac

SEQ ID NO: 1156410 - RNA, 21 nt, Homo sapiens
gagcucagacaccugugugcu

SEQ ID NO: 1156411 - RNA, 17 nt, Homo sapiens
gagcugagaucaugcca

SEQ ID NO: 1156412 - RNA, 18 nt, Homo sapiens
gagcugagccaggcuagc

SEQ ID NO: 1156413 - RNA, 20 nt, Homo sapiens
gagcugccucuucucuugac

SEQ ID NO: 1156414 - RNA, 19 nt, Homo sapiens
gagcuggcccagggggccu

SEQ ID NO: 1156415 - RNA, 23 nt, Homo sapiens
gagcuggcccagggggccuggag

SEQ ID NO: 1156416 - RNA, 16 nt, Homo sapiens
gagcuggggaucccuc

SEQ ID NO: 1156417 - RNA, 11 nt, Homo sapiens
gagcugugcag

SEQ ID NO: 1156418 - RNA, 14 nt, Homo sapiens
gagcuuaaacagcu

SEQ ID NO: 1156419 - RNA, 21 nt, Homo sapiens
gagcuuaggcauucuaaguca

SEQ ID NO: 1156420 - RNA, 21 nt, Homo sapiens
gagcuugcagugaaguguucu

SEQ ID NO: 1156421 - RNA, 22 nt, Homo sapiens
gaggaaaaaaagcaugcauucu

SEQ ID NO: 1156422 - RNA, 20 nt, Homo sapiens
gaggaaaggccagcuggcag

SEQ ID NO: 1156423 - RNA, 16 nt, Homo sapiens
gaggaagaaaaacagg

SEQ ID NO: 1156424 - RNA, 13 nt, Homo sapiens
gaggaauuuuucu

SEQ ID NO: 1156425 - RNA, 19 nt, Homo sapiens
gaggacauaaugggguccu

SEQ ID NO: 1156426 - RNA, 22 nt, Homo sapiens
gaggacaugcaugacacuucca

SEQ ID NO: 1156427 - RNA, 21 nt, Homo sapiens
gaggacugcaccauugcugcu

SEQ ID NO: 1156428 - RNA, 16 nt, Homo sapiens
gaggagaagcaauggg

SEQ ID NO: 1156429 - RNA, 17 nt, Homo sapiens
gaggagagcagcuguca

SEQ ID NO: 1156430 - RNA, 12 nt, Homo sapiens
gaggagccucag

SEQ ID NO: 1156431 - RNA, 12 nt, Homo sapiens
gaggaugcucuu

SEQ ID NO: 1156432 - RNA, 20 nt, Homo sapiens
gaggauguguccaguuugug

SEQ ID NO: 1156433 - RNA, 16 nt, Homo sapiens
gaggcaaauggcacug

SEQ ID NO: 1156434 - RNA, 13 nt, Homo sapiens
uccaaaaaugcac

SEQ ID NO: 1156435 - RNA, 11 nt, Homo sapiens
uccaaagccaa

SEQ ID NO: 1156436 - RNA, 16 nt, Homo sapiens
uccaaagccaauguga

SEQ ID NO: 1156437 - RNA, 18 nt, Homo sapiens
uccaaagcccucccuacc

SEQ ID NO: 1156438 - RNA, 16 nt, Homo sapiens
uccaaaggcucuguua

SEQ ID NO: 1156439 - RNA, 21 nt, Homo sapiens
uccaaaguaauguagcaugau

SEQ ID NO: 1156440 - RNA, 21 nt, Homo sapiens
uccaacagaccuggugcucua

SEQ ID NO: 1156441 - RNA, 17 nt, Homo sapiens
uccaacagccagugugu

SEQ ID NO: 1156442 - RNA, 16 nt, Homo sapiens
uccaaccuaaccccuu

SEQ ID NO: 1156443 - RNA, 17 nt, Homo sapiens
uccaaccugcaaagauc

SEQ ID NO: 1156444 - RNA, 15 nt, Homo sapiens
uccaaccuucccaaa

SEQ ID NO: 1156445 - RNA, 20 nt, Homo sapiens
uccaacuccuuucagccaca

SEQ ID NO: 1156446 - RNA, 16 nt, Homo sapiens
uccaagauguucuccu

SEQ ID NO: 1156447 - RNA, 12 nt, Homo sapiens
uccaagcugugu

SEQ ID NO: 1156448 - RNA, 16 nt, Homo sapiens
uccaagcuuggcuguc

SEQ ID NO: 1156449 - RNA, 17 nt, Homo sapiens
uccaagcuuguauuuaa

SEQ ID NO: 1156450 - RNA, 12 nt, Homo sapiens
uccaaggcuuuu

SEQ ID NO: 1156451 - RNA, 15 nt, Homo sapiens
uccaagucccucuca

SEQ ID NO: 1156452 - RNA, 21 nt, Homo sapiens
uccaaguggcauaauucaggg

SEQ ID NO: 1156453 - RNA, 14 nt, Homo sapiens
uccaauaugacuca

SEQ ID NO: 1156454 - RNA, 18 nt, Homo sapiens
uccaaugaaaucucagga

SEQ ID NO: 1156455 - RNA, 20 nt, Homo sapiens
uccaauguaccguuuccuua

SEQ ID NO: 1156456 - RNA, 18 nt, Homo sapiens
uccaaugucaaugugaac

SEQ ID NO: 1156457 - RNA, 18 nt, Homo sapiens
uccaauuguccaccccuu

SEQ ID NO: 1156458 - RNA, 19 nt, Homo sapiens
uccacaaauuauuaaugaa

SEQ ID NO: 1156459 - RNA, 14 nt, Homo sapiens
uccacacccagcuc

SEQ ID NO: 1156460 - RNA, 20 nt, Homo sapiens
uccacaccuagcaucucaug

SEQ ID NO: 1156461 - RNA, 14 nt, Homo sapiens
uccacacuaugugu

SEQ ID NO: 1156462 - RNA, 17 nt, Homo sapiens
uccacaggcaacgcaga

SEQ ID NO: 1156463 - RNA, 22 nt, Homo sapiens
uccacaguaacacgcugaaggg

SEQ ID NO: 1156464 - RNA, 18 nt, Homo sapiens
uccacaugaaaauaaaga

SEQ ID NO: 1156465 - RNA, 15 nt, Homo sapiens
uccaccaaaugaauu

SEQ ID NO: 1156466 - RNA, 11 nt, Homo sapiens
uccacccacag

SEQ ID NO: 1156467 - RNA, 18 nt, Homo sapiens
uccacgcggccaccucac

SEQ ID NO: 1156468 - RNA, 23 nt, Homo sapiens
uccacguaucuuuccuaggcaga

SEQ ID NO: 1156469 - RNA, 19 nt, Homo sapiens
uccacguucugcucaucau

SEQ ID NO: 1156470 - RNA, 16 nt, Homo sapiens
uccacuaggacuucaa

SEQ ID NO: 1156471 - RNA, 20 nt, Homo sapiens
uccagaaaacaaaacugcau

SEQ ID NO: 1156472 - RNA, 13 nt, Homo sapiens
uccagaagcacug

SEQ ID NO: 1156473 - RNA, 21 nt, Homo sapiens
uccagaagccuccuuacauua

SEQ ID NO: 1156474 - RNA, 13 nt, Homo sapiens
uccagaaguguga

SEQ ID NO: 1156475 - RNA, 18 nt, Homo sapiens
uccagaaugugcugccuu

SEQ ID NO: 1156476 - RNA, 12 nt, Homo sapiens
uccagacauuug

SEQ ID NO: 1156477 - RNA, 17 nt, Homo sapiens
uccagagacauguggca

SEQ ID NO: 1156478 - RNA, 20 nt, Homo sapiens
uccagcacaaacacaagguc

SEQ ID NO: 1156479 - RNA, 19 nt, Homo sapiens
uccagcccccagugcgcuc

SEQ ID NO: 1156480 - RNA, 21 nt, Homo sapiens
uccagcccugaguuccuagcc

SEQ ID NO: 1156481 - RNA, 20 nt, Homo sapiens
uccagccugggcaacagagc

SEQ ID NO: 1156482 - RNA, 16 nt, Homo sapiens
uccagcgguugccuuu

SEQ ID NO: 1156483 - RNA, 15 nt, Homo sapiens
uccagcuaacacacu

SEQ ID NO: 1156484 - RNA, 15 nt, Homo sapiens
uccagcuuuaagggu

SEQ ID NO: 1156485 - RNA, 15 nt, Homo sapiens
uccaggacagggaag

SEQ ID NO: 1156486 - RNA, 16 nt, Homo sapiens
uccaggagaaggccaa

SEQ ID NO: 1156487 - RNA, 20 nt, Homo sapiens
uccaggcugggcugagccaa

SEQ ID NO: 1156488 - RNA, 18 nt, Homo sapiens
uccagguauuuuccacuu

SEQ ID NO: 1156489 - RNA, 20 nt, Homo sapiens
uccagguggcaucagugucu

SEQ ID NO: 1156490 - RNA, 14 nt, Homo sapiens
uccaguaucuccaa

SEQ ID NO: 1156491 - RNA, 14 nt, Homo sapiens
uccagucuguucuc

SEQ ID NO: 1156492 - RNA, 12 nt, Homo sapiens
uccagucuuccu

SEQ ID NO: 1156493 - RNA, 21 nt, Homo sapiens
uccaguguuuaaacuuugaca

SEQ ID NO: 1156494 - RNA, 14 nt, Homo sapiens
uccauagcaccauu

SEQ ID NO: 1156495 - RNA, 17 nt, Homo sapiens
uccauagcaccauuccu

SEQ ID NO: 1156496 - RNA, 15 nt, Homo sapiens
uccauagcugggaaa

SEQ ID NO: 1156497 - RNA, 13 nt, Homo sapiens
uccauaggacaaa

SEQ ID NO: 1156498 - RNA, 19 nt, Homo sapiens
uccauaguaguaugaugau

SEQ ID NO: 1156499 - RNA, 17 nt, Homo sapiens
uccauauagacaccaag

SEQ ID NO: 1156500 - RNA, 18 nt, Homo sapiens
uccaucaauggugagcac

SEQ ID NO: 1156501 - RNA, 23 nt, Homo sapiens
uccaucaggcagauaacugcugu

SEQ ID NO: 1156502 - RNA, 14 nt, Homo sapiens
uccaucccuagcca

SEQ ID NO: 1156503 - RNA, 23 nt, Homo sapiens
uccaucgcaguguucaaggccau

SEQ ID NO: 1156504 - RNA, 14 nt, Homo sapiens
uccaucuccaucca

SEQ ID NO: 1156505 - RNA, 14 nt, Homo sapiens
ucagccaaagcaga

SEQ ID NO: 1156506 - RNA, 12 nt, Homo sapiens
ucagccagacau

SEQ ID NO: 1156507 - RNA, 20 nt, Homo sapiens
ucagccauccgcagacugcu

SEQ ID NO: 1156508 - RNA, 22 nt, Homo sapiens
ucagccgcagacaaguaaucac

SEQ ID NO: 1156509 - RNA, 18 nt, Homo sapiens
ucagccucgcucuugucu

SEQ ID NO: 1156510 - RNA, 22 nt, Homo sapiens
ucagccuuuaagauaccuugau

SEQ ID NO: 1156511 - RNA, 19 nt, Homo sapiens
ucagcgccuggccuaccca

SEQ ID NO: 1156512 - RNA, 18 nt, Homo sapiens
ucagcgggggccuugaag

SEQ ID NO: 1156513 - RNA, 19 nt, Homo sapiens
ucagcuagacauugcaauu

SEQ ID NO: 1156514 - RNA, 21 nt, Homo sapiens
ucagcucagcuucgugccugg

SEQ ID NO: 1156515 - RNA, 12 nt, Homo sapiens
ucagcucccaca

SEQ ID NO: 1156516 - RNA, 20 nt, Homo sapiens
ucagcuccgugaacuuguga

SEQ ID NO: 1156517 - RNA, 21 nt, Homo sapiens
ucagcucugaggauguauacc

SEQ ID NO: 1156518 - RNA, 15 nt, Homo sapiens
ucagcugcucccaca

SEQ ID NO: 1156519 - RNA, 12 nt, Homo sapiens
ucagcugcugaa

SEQ ID NO: 1156520 - RNA, 14 nt, Homo sapiens
ucagcuuggggaca

SEQ ID NO: 1156521 - RNA, 19 nt, Homo sapiens
ucagcuuucaaagcauuua

SEQ ID NO: 1156522 - RNA, 23 nt, Homo sapiens
ucagcuuuuguuguuuauauaca

SEQ ID NO: 1156523 - RNA, 14 nt, Homo sapiens
ucaggaaacauuca

SEQ ID NO: 1156524 - RNA, 20 nt, Homo sapiens
ucaggaacacccccaugaca

SEQ ID NO: 1156525 - RNA, 20 nt, Homo sapiens
ucaggaaccucgaguacugu

SEQ ID NO: 1156526 - RNA, 18 nt, Homo sapiens
ucaggaaggggugugcug

SEQ ID NO: 1156527 - RNA, 17 nt, Homo sapiens
ucaggaaucagaaauca

SEQ ID NO: 1156528 - RNA, 14 nt, Homo sapiens
ucaggacagaugcc

SEQ ID NO: 1156529 - RNA, 16 nt, Homo sapiens
ucaggacagaugccac

SEQ ID NO: 1156530 - RNA, 23 nt, Homo sapiens
ucaggagcaggggcauugcugau

SEQ ID NO: 1156531 - RNA, 16 nt, Homo sapiens
ucaggaguuccagugc

SEQ ID NO: 1156532 - RNA, 14 nt, Homo sapiens
ucaggcacacagcu

SEQ ID NO: 1156533 - RNA, 16 nt, Homo sapiens
ucaggcagggugcagu

SEQ ID NO: 1156534 - RNA, 13 nt, Homo sapiens
ucaggccaggugg

SEQ ID NO: 1156535 - RNA, 18 nt, Homo sapiens
ucaggcccgcuaggucca

SEQ ID NO: 1156536 - RNA, 22 nt, Homo sapiens
ucaggcucuguuccucaauggc

SEQ ID NO: 1156537 - RNA, 16 nt, Homo sapiens
ucagggggcacugucu

SEQ ID NO: 1156538 - RNA, 22 nt, Homo sapiens
ucaggggugauaacucaggaag

SEQ ID NO: 1156539 - RNA, 21 nt, Homo sapiens
ucaggguauugcuugccacua

SEQ ID NO: 1156540 - RNA, 23 nt, Homo sapiens
ucagguaacagucguagauacca

SEQ ID NO: 1156541 - RNA, 22 nt, Homo sapiens
ucagguagaagguugacacagu

SEQ ID NO: 1156542 - RNA, 21 nt, Homo sapiens
ucaggugguguccuucuuccu

SEQ ID NO: 1156543 - RNA, 14 nt, Homo sapiens
ucaguaacaaguau

SEQ ID NO: 1156544 - RNA, 13 nt, Homo sapiens
ucaguaacaguau

SEQ ID NO: 1156545 - RNA, 21 nt, Homo sapiens
ucaguauuaaauuagauaucu

SEQ ID NO: 1156546 - RNA, 17 nt, Homo sapiens
ucaguauuuaauaucug

SEQ ID NO: 1156547 - RNA, 15 nt, Homo sapiens
ucagucacagccacc

SEQ ID NO: 1156548 - RNA, 20 nt, Homo sapiens
ucagucccuaaaaacacaga

SEQ ID NO: 1156549 - RNA, 19 nt, Homo sapiens
ucagucugugccuacaugu

SEQ ID NO: 1156550 - RNA, 18 nt, Homo sapiens
ucagugaauaaaccauca

SEQ ID NO: 1156551 - RNA, 17 nt, Homo sapiens
ucagugauaacuccuaa

SEQ ID NO: 1156552 - RNA, 12 nt, Homo sapiens
ucagugccaacu

SEQ ID NO: 1156553 - RNA, 17 nt, Homo sapiens
ucagugccuucucucag

SEQ ID NO: 1156554 - RNA, 20 nt, Homo sapiens
ucagugucuuuccacuccuc

SEQ ID NO: 1156555 - RNA, 13 nt, Homo sapiens
ucaguuacucuga

SEQ ID NO: 1156556 - RNA, 12 nt, Homo sapiens
ucaguuccagcu

SEQ ID NO: 1156557 - RNA, 18 nt, Homo sapiens
ucaguugugcagcuuuug

SEQ ID NO: 1156558 - RNA, 20 nt, Homo sapiens
ucaguuucaauucagugcug

SEQ ID NO: 1156559 - RNA, 22 nt, Homo sapiens
ucaguuuuaacaaaugcuauua

SEQ ID NO: 1156560 - RNA, 15 nt, Homo sapiens
ucauaaauauaaucu

SEQ ID NO: 1156561 - RNA, 14 nt, Homo sapiens
ucauaacccaugaa

SEQ ID NO: 1156562 - RNA, 20 nt, Homo sapiens
ucauaacuaaugaauugaaa

SEQ ID NO: 1156563 - RNA, 21 nt, Homo sapiens
ucauaacucugugaucuugcu

SEQ ID NO: 1156564 - RNA, 23 nt, Homo sapiens
ucauaagccuaccaauguagaca

SEQ ID NO: 1156565 - RNA, 16 nt, Homo sapiens
ucauaagugacaguuu

SEQ ID NO: 1156566 - RNA, 17 nt, Homo sapiens
ucauaaucugaugauau

SEQ ID NO: 1156567 - RNA, 16 nt, Homo sapiens
ucauaauuaauguagu

SEQ ID NO: 1156568 - RNA, 12 nt, Homo sapiens
ucauacacauga

SEQ ID NO: 1156569 - RNA, 20 nt, Homo sapiens
ucauaccuacauucaaggag

SEQ ID NO: 1156570 - RNA, 14 nt, Homo sapiens
ucauacuuccaucu

SEQ ID NO: 1156571 - RNA, 14 nt, Homo sapiens
ucauagcaggauau

SEQ ID NO: 1156572 - RNA, 14 nt, Homo sapiens
ucauagcauucacu

SEQ ID NO: 1156573 - RNA, 23 nt, Homo sapiens
ucauaggcaagucacacugcauu

SEQ ID NO: 1156574 - RNA, 22 nt, Homo sapiens
ucauagucccaccuuggagcau

SEQ ID NO: 1156575 - RNA, 13 nt, Homo sapiens
ucauaguugcaaa

SEQ ID NO: 1156576 - RNA, 13 nt, Homo sapiens
ucauauaccagca

SEQ ID NO: 1156577 - RNA, 20 nt, Homo sapiens
ucauaugagaaggaacuuug

SEQ ID NO: 1156578 - RNA, 13 nt, Homo sapiens
ucaucaacacaau

SEQ ID NO: 1156579 - RNA, 18 nt, Homo sapiens
ucaucacaauuagggaau

SEQ ID NO: 1156580 - RNA, 15 nt, Homo sapiens
ucaucacauucaggg

SEQ ID NO: 1156581 - RNA, 15 nt, Homo sapiens
uauugucaaagagua

SEQ ID NO: 1156582 - RNA, 18 nt, Homo sapiens
uauugucuugguugccag

SEQ ID NO: 1156583 - RNA, 19 nt, Homo sapiens
uauugucuugguugccagu

SEQ ID NO: 1156584 - RNA, 18 nt, Homo sapiens
uauugugugagugcaugu

SEQ ID NO: 1156585 - RNA, 16 nt, Homo sapiens
uauuguuucaauugca

SEQ ID NO: 1156586 - RNA, 18 nt, Homo sapiens
uauuuaaagacaaagaca

SEQ ID NO: 1156587 - RNA, 23 nt, Homo sapiens
uauuuaaaucuugcaagaauauu

SEQ ID NO: 1156588 - RNA, 22 nt, Homo sapiens
uauuuacuugaaagaugggucu

SEQ ID NO: 1156589 - RNA, 18 nt, Homo sapiens
uauuuauguuugcacuug

SEQ ID NO: 1156590 - RNA, 16 nt, Homo sapiens
uauuucagccaaucug

SEQ ID NO: 1156591 - RNA, 18 nt, Homo sapiens
uauuucaucucuuucuac

SEQ ID NO: 1156592 - RNA, 13 nt, Homo sapiens
uauuucaugugcu

SEQ ID NO: 1156593 - RNA, 21 nt, Homo sapiens
uauuuccacuuauaaaggaaa

SEQ ID NO: 1156594 - RNA, 22 nt, Homo sapiens
uauuucccugaaggaaccaaag

SEQ ID NO: 1156595 - RNA, 16 nt, Homo sapiens
uauuuccucuccuucc

SEQ ID NO: 1156596 - RNA, 14 nt, Homo sapiens
uauuuccugcuuau

SEQ ID NO: 1156597 - RNA, 16 nt, Homo sapiens
uauuucugaaucgaga

SEQ ID NO: 1156598 - RNA, 16 nt, Homo sapiens
uauuucugcauggaaa

SEQ ID NO: 1156599 - RNA, 18 nt, Homo sapiens
uauuucuuaauuuggaua

SEQ ID NO: 1156600 - RNA, 15 nt, Homo sapiens
uauuucuugcuuuca

SEQ ID NO: 1156601 - RNA, 15 nt, Homo sapiens
uauuugaacugguua

SEQ ID NO: 1156602 - RNA, 23 nt, Homo sapiens
uauuugagagagagaaccuuucc

SEQ ID NO: 1156603 - RNA, 18 nt, Homo sapiens
uauuugcagaagcuguga

SEQ ID NO: 1156604 - RNA, 21 nt, Homo sapiens
uauuugcaguucaccugcacu

SEQ ID NO: 1156605 - RNA, 14 nt, Homo sapiens
uauuugcauaacaa

SEQ ID NO: 1156606 - RNA, 15 nt, Homo sapiens
uauuuggauaucaaa

SEQ ID NO: 1156607 - RNA, 13 nt, Homo sapiens
uauuugguacugu

SEQ ID NO: 1156608 - RNA, 22 nt, Homo sapiens
uauuuguauuuucaagacuuua

SEQ ID NO: 1156609 - RNA, 11 nt, Homo sapiens
uauuugucauu

SEQ ID NO: 1156610 - RNA, 13 nt, Homo sapiens
uauuuuacacaga

SEQ ID NO: 1156611 - RNA, 14 nt, Homo sapiens
uauuuuacacagca

SEQ ID NO: 1156612 - RNA, 23 nt, Homo sapiens
uauuuuacuacuucucucuguau

SEQ ID NO: 1156613 - RNA, 15 nt, Homo sapiens
uauuuuauaaauuag

SEQ ID NO: 1156614 - RNA, 22 nt, Homo sapiens
uauuuuauacugcacuuuagug

SEQ ID NO: 1156615 - RNA, 21 nt, Homo sapiens
uauuuucagaugugaaccauu

SEQ ID NO: 1156616 - RNA, 15 nt, Homo sapiens
uauuuucagugauaa

SEQ ID NO: 1156617 - RNA, 13 nt, Homo sapiens
uauuuucuacaca

SEQ ID NO: 1156618 - RNA, 19 nt, Homo sapiens
uauuuucuuuucuuucaac

SEQ ID NO: 1156619 - RNA, 16 nt, Homo sapiens
uauuuugaaaacacuu

SEQ ID NO: 1156620 - RNA, 18 nt, Homo sapiens
uauuuuuauucaaacuac

SEQ ID NO: 1156621 - RNA, 20 nt, Homo sapiens
uauuuuucuuuaaagccagu

SEQ ID NO: 1156622 - RNA, 16 nt, Homo sapiens
uauuuuugaaaaggga

SEQ ID NO: 1156623 - RNA, 13 nt, Homo sapiens
uauuuuuguggac

SEQ ID NO: 1156624 - RNA, 20 nt, Homo sapiens
uauuuuuucuugcaaauacc

SEQ ID NO: 1156625 - RNA, 20 nt, Homo sapiens
uauuuuuugaaucuaugaac

SEQ ID NO: 1156626 - RNA, 23 nt, Homo sapiens
uauuuuuuuucuuguauuuuucc

SEQ ID NO: 1156627 - RNA, 23 nt, Homo sapiens
ucaaaaaagaaaaaagaaaagaa

SEQ ID NO: 1156628 - RNA, 21 nt, Homo sapiens
ucaaaacauacaagagacaua

SEQ ID NO: 1156629 - RNA, 13 nt, Homo sapiens
ucaaaacauucuc

SEQ ID NO: 1156630 - RNA, 21 nt, Homo sapiens
ucaaaacccaacaugacuguu

SEQ ID NO: 1156631 - RNA, 15 nt, Homo sapiens
ucaaaagacaauucu

SEQ ID NO: 1156632 - RNA, 12 nt, Homo sapiens
ucaaaaggugcc

SEQ ID NO: 1156633 - RNA, 12 nt, Homo sapiens
ucaaaagugccu

SEQ ID NO: 1156634 - RNA, 13 nt, Homo sapiens
ucaaaagugccuc

SEQ ID NO: 1156635 - RNA, 16 nt, Homo sapiens
ucaaaauauacauuca

SEQ ID NO: 1156636 - RNA, 15 nt, Homo sapiens
ucaaaauccaaaaag

SEQ ID NO: 1156637 - RNA, 16 nt, Homo sapiens
ucaaaauccaaaaaga

SEQ ID NO: 1156638 - RNA, 14 nt, Homo sapiens
ucaaaaugcuuuuu

SEQ ID NO: 1156639 - RNA, 18 nt, Homo sapiens
ucaaaauuaauagcuuuu

SEQ ID NO: 1156640 - RNA, 14 nt, Homo sapiens
ucaaaauugccuuu

SEQ ID NO: 1156641 - RNA, 13 nt, Homo sapiens
ucaaacaaagcca

SEQ ID NO: 1156642 - RNA, 15 nt, Homo sapiens
ucaaacaaagccaga

SEQ ID NO: 1156643 - RNA, 20 nt, Homo sapiens
ucaaacaugaaaacauugau

SEQ ID NO: 1156644 - RNA, 23 nt, Homo sapiens
ucaaacaugaaguguguuuccuu

SEQ ID NO: 1156645 - RNA, 14 nt, Homo sapiens
ucaaacauuuguca

SEQ ID NO: 1156646 - RNA, 13 nt, Homo sapiens
ucaaaccuguaga

SEQ ID NO: 1156647 - RNA, 14 nt, Homo sapiens
ucaaaccuguagau

SEQ ID NO: 1156648 - RNA, 15 nt, Homo sapiens
ucaaaccuuugccaa

SEQ ID NO: 1156649 - RNA, 17 nt, Homo sapiens
ucaaacucccgaccuca

SEQ ID NO: 1156650 - RNA, 16 nt, Homo sapiens
ucaaacuccugagcuc

SEQ ID NO: 1156651 - RNA, 12 nt, Homo sapiens
ucaaacuuuuau

SEQ ID NO: 1156652 - RNA, 20 nt, Homo sapiens
ucaaagacaaucacugaaac

SEQ ID NO: 1156653 - RNA, 14 nt, Homo sapiens
ucaaagaucuuucg

SEQ ID NO: 1156654 - RNA, 22 nt, Homo sapiens
ucaaagauuaggugagguuuau

SEQ ID NO: 1156655 - RNA, 16 nt, Homo sapiens
ucaaagcaaagcucuu

SEQ ID NO: 1156656 - RNA, 17 nt, Homo sapiens
ucaaagcauuuacaagu

SEQ ID NO: 1156657 - RNA, 20 nt, Homo sapiens
ucaaagccauauggacacug

SEQ ID NO: 1156658 - RNA, 15 nt, Homo sapiens
ucaaaggcacaguga

SEQ ID NO: 1156659 - RNA, 14 nt, Homo sapiens
ucaaagggacuuuu

SEQ ID NO: 1156660 - RNA, 22 nt, Homo sapiens
ucaaaguggaaaggaucacaga

SEQ ID NO: 1156661 - RNA, 20 nt, Homo sapiens
ucaaaguguaaacaccauag

SEQ ID NO: 1156662 - RNA, 23 nt, Homo sapiens
ucaaauacauaccuacugacuga

SEQ ID NO: 1156663 - RNA, 20 nt, Homo sapiens
ucaaauagaaccacuaugaa

SEQ ID NO: 1156664 - RNA, 17 nt, Homo sapiens
ucaaauauuagauguga

SEQ ID NO: 1156665 - RNA, 14 nt, Homo sapiens
ucaaaucagucagu

SEQ ID NO: 1156666 - RNA, 23 nt, Homo sapiens
ucaaaucauguuuuuucugcaau

SEQ ID NO: 1156667 - RNA, 21 nt, Homo sapiens
ucaaaucauuuuugagacugg

SEQ ID NO: 1156668 - RNA, 19 nt, Homo sapiens
ucaaauguacagugguccu

SEQ ID NO: 1156669 - RNA, 20 nt, Homo sapiens
ucaaauuaagauucucugcc

SEQ ID NO: 1156670 - RNA, 19 nt, Homo sapiens
uuuaaaagaaaaaaaccaa

SEQ ID NO: 1156671 - RNA, 13 nt, Homo sapiens
uuuaaaagugauc

SEQ ID NO: 1156672 - RNA, 12 nt, Homo sapiens
uuuaaaauucac

SEQ ID NO: 1156673 - RNA, 12 nt, Homo sapiens
uuuaaaauucuc

SEQ ID NO: 1156674 - RNA, 14 nt, Homo sapiens
uuuaaacauaggaa

SEQ ID NO: 1156675 - RNA, 15 nt, Homo sapiens
uuuaaagaagucucu

SEQ ID NO: 1156676 - RNA, 12 nt, Homo sapiens
uuuaaagacaga

SEQ ID NO: 1156677 - RNA, 18 nt, Homo sapiens
uuuaaagacuaccuggga

SEQ ID NO: 1156678 - RNA, 23 nt, Homo sapiens
uuuaaauaaacgucuuugcugcg

SEQ ID NO: 1156679 - RNA, 15 nt, Homo sapiens
uuuaaauaaauggaa

SEQ ID NO: 1156680 - RNA, 23 nt, Homo sapiens
uuuaaauacagucuuccauuugc

SEQ ID NO: 1156681 - RNA, 22 nt, Homo sapiens
uuuaaauguuauauacaucuca

SEQ ID NO: 1156682 - RNA, 22 nt, Homo sapiens
uuuaaauuacaauuuuaucugu

SEQ ID NO: 1156683 - RNA, 22 nt, Homo sapiens
uuuaaauuuuuuuuuuaauugc

SEQ ID NO: 1156684 - RNA, 14 nt, Homo sapiens
uuuaacagcucucu

SEQ ID NO: 1156685 - RNA, 13 nt, Homo sapiens
uuuaaccauucca

SEQ ID NO: 1156686 - RNA, 13 nt, Homo sapiens
uuuaacguugaug

SEQ ID NO: 1156687 - RNA, 15 nt, Homo sapiens
uuuaagaauuucaca

SEQ ID NO: 1156688 - RNA, 16 nt, Homo sapiens
uuuaagaguagcagua

SEQ ID NO: 1156689 - RNA, 23 nt, Homo sapiens
uuuaaggauguugccacuggcaa

SEQ ID NO: 1156690 - RNA, 23 nt, Homo sapiens
uuuaaggugacccaaugauucag

SEQ ID NO: 1156691 - RNA, 17 nt, Homo sapiens
uuuaaguuuccuuccag

SEQ ID NO: 1156692 - RNA, 19 nt, Homo sapiens
uuuaauagaaauaaauucc

SEQ ID NO: 1156693 - RNA, 18 nt, Homo sapiens
uuuaauauuuccaaugug

SEQ ID NO: 1156694 - RNA, 17 nt, Homo sapiens
uuuaaucccagcacuuu

SEQ ID NO: 1156695 - RNA, 18 nt, Homo sapiens
uuuaauuagaaauaucuu

SEQ ID NO: 1156696 - RNA, 13 nt, Homo sapiens
uuuaauugugaua

SEQ ID NO: 1156697 - RNA, 23 nt, Homo sapiens
uuuaauuuuuaaaagacuuugau

SEQ ID NO: 1156698 - RNA, 13 nt, Homo sapiens
uuuacagacacac

SEQ ID NO: 1156699 - RNA, 13 nt, Homo sapiens
uuuacagcugugu

SEQ ID NO: 1156700 - RNA, 12 nt, Homo sapiens
uuuacauuugau

SEQ ID NO: 1156701 - RNA, 21 nt, Homo sapiens
uuuaccugaaauaaaauucau

SEQ ID NO: 1156702 - RNA, 14 nt, Homo sapiens
uuuacgaaaccaaa

SEQ ID NO: 1156703 - RNA, 15 nt, Homo sapiens
uuuacgacugaagaa

SEQ ID NO: 1156704 - RNA, 22 nt, Homo sapiens
uuuacggacacccccucgcuug

SEQ ID NO: 1156705 - RNA, 21 nt, Homo sapiens
uuuacuaaaauggcagcuuaa

SEQ ID NO: 1156706 - RNA, 20 nt, Homo sapiens
uuuacuaagacauagucucu

SEQ ID NO: 1156707 - RNA, 15 nt, Homo sapiens
uuuacuccaugaagg

SEQ ID NO: 1156708 - RNA, 21 nt, Homo sapiens
uuuacuggugcagaugguuga

SEQ ID NO: 1156709 - RNA, 10 nt, Homo sapiens
uuuacuguua

SEQ ID NO: 1156710 - RNA, 14 nt, Homo sapiens
uuuagaacagggaa

SEQ ID NO: 1156711 - RNA, 16 nt, Homo sapiens
uuuagaccccauacaa

SEQ ID NO: 1156712 - RNA, 19 nt, Homo sapiens
uuuagcuuugacaguucuu

SEQ ID NO: 1156713 - RNA, 23 nt, Homo sapiens
uuuaggauaaccuugugccuugg

SEQ ID NO: 1156714 - RNA, 13 nt, Homo sapiens
uuuaggaugcuuu

SEQ ID NO: 1156715 - RNA, 12 nt, Homo sapiens
uuuagggagaac

SEQ ID NO: 1156716 - RNA, 16 nt, Homo sapiens
uuuaggugaaagccag

SEQ ID NO: 1156717 - RNA, 15 nt, Homo sapiens
uuuagugcacuuaau

SEQ ID NO: 1156718 - RNA, 17 nt, Homo sapiens
uuuaguguuuuuaccuc

SEQ ID NO: 1156719 - RNA, 19 nt, Homo sapiens
uuuaguuugaucagacagc

SEQ ID NO: 1156720 - RNA, 21 nt, Homo sapiens
uuuauaauacuacuacuguua

SEQ ID NO: 1156721 - RNA, 17 nt, Homo sapiens
uuuauagaugucaggaa

SEQ ID NO: 1156722 - RNA, 21 nt, Homo sapiens
uuuauaguuguagacuaugga

SEQ ID NO: 1156723 - RNA, 19 nt, Homo sapiens
uuuauauaacauuagauaa

SEQ ID NO: 1156724 - RNA, 19 nt, Homo sapiens
uuuauauagaaacacuuuc

SEQ ID NO: 1156725 - RNA, 14 nt, Homo sapiens
uuuauaucugagca

SEQ ID NO: 1156726 - RNA, 20 nt, Homo sapiens
uuuaucaaggagauauauca

SEQ ID NO: 1156727 - RNA, 20 nt, Homo sapiens
uuuaucaauaaagcacuauu

SEQ ID NO: 1156728 - RNA, 17 nt, Homo sapiens
uuuaucauuucuacuga

SEQ ID NO: 1156729 - RNA, 17 nt, Homo sapiens
uuuauccaaaaugugua

SEQ ID NO: 1156730 - RNA, 23 nt, Homo sapiens
uuuaucgcaauuacuuguaucau

SEQ ID NO: 1156731 - RNA, 14 nt, Homo sapiens
uuuaucuagaacau

SEQ ID NO: 1156732 - RNA, 16 nt, Homo sapiens
uuuaugaagugcuaca

SEQ ID NO: 1156733 - RNA, 19 nt, Homo sapiens
uuuauuauauuuuucccua

SEQ ID NO: 1156734 - RNA, 21 nt, Homo sapiens
uuuauugcaggauggugucuc

SEQ ID NO: 1156735 - RNA, 15 nt, Homo sapiens
uuuauuuaacuauuc

SEQ ID NO: 1156736 - RNA, 16 nt, Homo sapiens
uuuauuuaacuauuca

SEQ ID NO: 1156737 - RNA, 19 nt, Homo sapiens
uuuauuucauucauauccu

SEQ ID NO: 1156738 - RNA, 18 nt, Homo sapiens
uuuauuuuugagacagag

SEQ ID NO: 1156739 - RNA, 18 nt, Homo sapiens
uuucaaaaaaagcacaaa

SEQ ID NO: 1156740 - RNA, 16 nt, Homo sapiens
uuucaaaaccuuuuga

SEQ ID NO: 1156741 - RNA, 19 nt, Homo sapiens
uuucaaaauauacauucaa

SEQ ID NO: 1156742 - RNA, 18 nt, Homo sapiens
uuucaaaauuaagucgau

SEQ ID NO: 1156743 - RNA, 20 nt, Homo sapiens
uuucaaaauuaauagcuuuu

SEQ ID NO: 1156744 - RNA, 18 nt, Homo sapiens
uuucaaagacugccacgu

SEQ ID NO: 1156745 - RNA, 16 nt, Homo sapiens
uuucaaccagcacauu

SEQ ID NO: 1156746 - RNA, 13 nt, Homo sapiens
uuucaacugccaa

SEQ ID NO: 1156747 - RNA, 21 nt, Homo sapiens
uuucaaggauuguuaacaugc

SEQ ID NO: 1156748 - RNA, 20 nt, Homo sapiens
uuucaauaucuuuauugcau

SEQ ID NO: 1156749 - RNA, 13 nt, Homo sapiens
uuucaauuacaaa

SEQ ID NO: 1156750 - RNA, 15 nt, Homo sapiens
uuucaauuacaaagc

SEQ ID NO: 1156751 - RNA, 19 nt, Homo sapiens
uuuguuuguucacauauga

SEQ ID NO: 1156752 - RNA, 17 nt, Homo sapiens
uuuuaaaaagugugcuu

SEQ ID NO: 1156753 - RNA, 15 nt, Homo sapiens
uuuuaaagugcucuu

SEQ ID NO: 1156754 - RNA, 18 nt, Homo sapiens
uuuuaaaugaaaguauug

SEQ ID NO: 1156755 - RNA, 12 nt, Homo sapiens
uuuuaacucugu

SEQ ID NO: 1156756 - RNA, 17 nt, Homo sapiens
uuuuaacucugucuuca

SEQ ID NO: 1156757 - RNA, 15 nt, Homo sapiens
uuuuaaggauguugc

SEQ ID NO: 1156758 - RNA, 20 nt, Homo sapiens
uuuuaaggcuaaaacuuaac

SEQ ID NO: 1156759 - RNA, 15 nt, Homo sapiens
uuuuaagugauguca

SEQ ID NO: 1156760 - RNA, 18 nt, Homo sapiens
uuuuaaguuuccuuccag

SEQ ID NO: 1156761 - RNA, 15 nt, Homo sapiens
uuuuaauacagggac

SEQ ID NO: 1156762 - RNA, 18 nt, Homo sapiens
uuuuaauuagaaauaucu

SEQ ID NO: 1156763 - RNA, 17 nt, Homo sapiens
uuuuacacaccaccagc

SEQ ID NO: 1156764 - RNA, 13 nt, Homo sapiens
uuuuacacuguac

SEQ ID NO: 1156765 - RNA, 16 nt, Homo sapiens
uuuuacauacugcugu

SEQ ID NO: 1156766 - RNA, 14 nt, Homo sapiens
uuuuaccuggauau

SEQ ID NO: 1156767 - RNA, 19 nt, Homo sapiens
uuuuaccuuugucuuucug

SEQ ID NO: 1156768 - RNA, 12 nt, Homo sapiens
uuuuacugcuug

SEQ ID NO: 1156769 - RNA, 15 nt, Homo sapiens
uuuuaggaacuuuau

SEQ ID NO: 1156770 - RNA, 22 nt, Homo sapiens
uuuuagucuaguuauuggauca

SEQ ID NO: 1156771 - RNA, 17 nt, Homo sapiens
uuuuaucaauaaagcac

SEQ ID NO: 1156772 - RNA, 18 nt, Homo sapiens
uuuuaucuagaacauuca

SEQ ID NO: 1156773 - RNA, 18 nt, Homo sapiens
uuuuaucuccaaguggca

SEQ ID NO: 1156774 - RNA, 18 nt, Homo sapiens
uuuuaucuguuaaccaaa

SEQ ID NO: 1156775 - RNA, 18 nt, Homo sapiens
uuuuaucuugaguguuau

SEQ ID NO: 1156776 - RNA, 20 nt, Homo sapiens
uuuuaugggaauucuuuaca

SEQ ID NO: 1156777 - RNA, 17 nt, Homo sapiens
uuuuauuuugucucuga

SEQ ID NO: 1156778 - RNA, 17 nt, Homo sapiens
uuuucaaaauccaaaaa

SEQ ID NO: 1156779 - RNA, 19 nt, Homo sapiens
uuuucaaaauccaaaaaga

SEQ ID NO: 1156780 - RNA, 16 nt, Homo sapiens
uuuucaacuuugaaua

SEQ ID NO: 1156781 - RNA, 22 nt, Homo sapiens
uuuucaagacuuuaaacauuua

SEQ ID NO: 1156782 - RNA, 21 nt, Homo sapiens
uuuucagaaacucaucggaaa

SEQ ID NO: 1156783 - RNA, 23 nt, Homo sapiens
uuuucagacaaauuacugauaaa

SEQ ID NO: 1156784 - RNA, 14 nt, Homo sapiens
uuuucagaugugaa

SEQ ID NO: 1156785 - RNA, 11 nt, Homo sapiens
uuuucauucau

SEQ ID NO: 1156786 - RNA, 17 nt, Homo sapiens
uuuuccaacuuggcugc

SEQ ID NO: 1156787 - RNA, 22 nt, Homo sapiens
uuuuccacaagauucccagaga

SEQ ID NO: 1156788 - RNA, 20 nt, Homo sapiens
uuuuccacuuguggaaaaaa

SEQ ID NO: 1156789 - RNA, 16 nt, Homo sapiens
uuuuccagcauguguu

SEQ ID NO: 1156790 - RNA, 23 nt, Homo sapiens
uuuuccaguccccagaagcagag

SEQ ID NO: 1156791 - RNA, 13 nt, Homo sapiens
uuuuccaugacau

SEQ ID NO: 1156792 - RNA, 23 nt, Homo sapiens
uuuuccauuguuugaaacaaaga

SEQ ID NO: 1156793 - RNA, 19 nt, Homo sapiens
uuuucccaggaggcuccag

SEQ ID NO: 1156794 - RNA, 14 nt, Homo sapiens
uuuuccccauugua

SEQ ID NO: 1156795 - RNA, 15 nt, Homo sapiens
uuuuccccauuguau

SEQ ID NO: 1156796 - RNA, 20 nt, Homo sapiens
uuuuccccucauugcauuua

SEQ ID NO: 1156797 - RNA, 13 nt, Homo sapiens
uuuucugaagaca

SEQ ID NO: 1156798 - RNA, 15 nt, Homo sapiens
uuuucuguaguguga

SEQ ID NO: 1156799 - RNA, 21 nt, Homo sapiens
uuuucuuguccucauucuugc

SEQ ID NO: 1156800 - RNA, 15 nt, Homo sapiens
uuuugaaaacacuua

SEQ ID NO: 1156801 - RNA, 16 nt, Homo sapiens
uuuugaaaacacuuau

SEQ ID NO: 1156802 - RNA, 13 nt, Homo sapiens
uuuugaaagucag

SEQ ID NO: 1156803 - RNA, 17 nt, Homo sapiens
uuuugaaauuaaccucu

SEQ ID NO: 1156804 - RNA, 12 nt, Homo sapiens
uuuugaaggcaa

SEQ ID NO: 1156805 - RNA, 16 nt, Homo sapiens
uuuugaauacacaucu

SEQ ID NO: 1156806 - RNA, 23 nt, Homo sapiens
uuuugagacugguugcauaacag

SEQ ID NO: 1156807 - RNA, 18 nt, Homo sapiens
uuuugcaauaguuaccuc

SEQ ID NO: 1156808 - RNA, 16 nt, Homo sapiens
uuuugcagugauuuga

SEQ ID NO: 1156809 - RNA, 22 nt, Homo sapiens
uuuuggacacugugcuacugaa

SEQ ID NO: 1156810 - RNA, 16 nt, Homo sapiens
uuuuggcaucugcaaa

SEQ ID NO: 1156811 - RNA, 17 nt, Homo sapiens
ugccaucgcugugaugc

SEQ ID NO: 1156812 - RNA, 20 nt, Homo sapiens
ugccaugggggcaacagcca

SEQ ID NO: 1156813 - RNA, 22 nt, Homo sapiens
ugccauuauagcgccuguauaa

SEQ ID NO: 1156814 - RNA, 15 nt, Homo sapiens
ugccauugcacucca

SEQ ID NO: 1156815 - RNA, 17 nt, Homo sapiens
ugcccaaccugacuuug

SEQ ID NO: 1156816 - RNA, 18 nt, Homo sapiens
ugcccaauccauccugcu

SEQ ID NO: 1156817 - RNA, 23 nt, Homo sapiens
ugcccacaacuugucacccaaag

SEQ ID NO: 1156818 - RNA, 13 nt, Homo sapiens
ugcccacaggccg

SEQ ID NO: 1156819 - RNA, 12 nt, Homo sapiens
ugcccagccaau

SEQ ID NO: 1156820 - RNA, 15 nt, Homo sapiens
ugcccaggcacugca

SEQ ID NO: 1156821 - RNA, 19 nt, Homo sapiens
ugcccaggcuagagugcaa

SEQ ID NO: 1156822 - RNA, 20 nt, Homo sapiens
ugcccaggcuagagugcaau

SEQ ID NO: 1156823 - RNA, 20 nt, Homo sapiens
ugcccaggcuggagugcagu

SEQ ID NO: 1156824 - RNA, 13 nt, Homo sapiens
ugcccauccuccc

SEQ ID NO: 1156825 - RNA, 12 nt, Homo sapiens
ugccccaccugc

SEQ ID NO: 1156826 - RNA, 14 nt, Homo sapiens
ugugggacugagug

SEQ ID NO: 1156827 - RNA, 17 nt, Homo sapiens
ugugggcccucuuucaa

SEQ ID NO: 1156828 - RNA, 15 nt, Homo sapiens
ugugggucucuggaa

SEQ ID NO: 1156829 - RNA, 20 nt, Homo sapiens
uguggucagcgguaugugcg

SEQ ID NO: 1156830 - RNA, 15 nt, Homo sapiens
uguguaaugugcaaa

SEQ ID NO: 1156831 - RNA, 15 nt, Homo sapiens
uguguacaacacugg

SEQ ID NO: 1156832 - RNA, 19 nt, Homo sapiens
uguguacauuagucauuca

SEQ ID NO: 1156833 - RNA, 17 nt, Homo sapiens
acaccagcagcacugga

SEQ ID NO: 1156834 - RNA, 21 nt, Homo sapiens
acaccauucaucucuaacaua

SEQ ID NO: 1156835 - RNA, 13 nt, Homo sapiens
acacccaugugua

SEQ ID NO: 1156836 - RNA, 19 nt, Homo sapiens
acacccccaugacauugca

SEQ ID NO: 1156837 - RNA, 22 nt, Homo sapiens
acacccccaugacauugcauuu

SEQ ID NO: 1156838 - RNA, 23 nt, Homo sapiens
acacccccaugacauugcauuug

SEQ ID NO: 1156839 - RNA, 21 nt, Homo sapiens
acacccucccucuacugggag

SEQ ID NO: 1156840 - RNA, 22 nt, Homo sapiens
acaccggguuccagcaccacac

SEQ ID NO: 1156841 - RNA, 20 nt, Homo sapiens
acaccguacaucugcaauau

SEQ ID NO: 1156842 - RNA, 13 nt, Homo sapiens
acaccucaaauac

SEQ ID NO: 1156843 - RNA, 12 nt, Homo sapiens
acaccucuccaa

SEQ ID NO: 1156844 - RNA, 15 nt, Homo sapiens
acaccucugcuccaa

SEQ ID NO: 1156845 - RNA, 16 nt, Homo sapiens
acaccuggaccauuug

SEQ ID NO: 1156846 - RNA, 15 nt, Homo sapiens
acaccuguaauccca

SEQ ID NO: 1156847 - RNA, 16 nt, Homo sapiens
acaccuguggucccag

SEQ ID NO: 1156848 - RNA, 23 nt, Homo sapiens
acaccuuaauaaucauaggcacu

SEQ ID NO: 1156849 - RNA, 23 nt, Homo sapiens
acaccuuugaauuacagcaguug

SEQ ID NO: 1156850 - RNA, 13 nt, Homo sapiens
acaccuuuuauua

SEQ ID NO: 1156851 - RNA, 20 nt, Homo sapiens
acaccuuuuuucaacaguga

SEQ ID NO: 1156852 - RNA, 19 nt, Homo sapiens
acacgcaccugccucagga

SEQ ID NO: 1156853 - RNA, 13 nt, Homo sapiens
acacgcacugcac

SEQ ID NO: 1156854 - RNA, 23 nt, Homo sapiens
acacgcccccacaggcucugacc

SEQ ID NO: 1156855 - RNA, 21 nt, Homo sapiens
acacgccugcaaacgcugccu

SEQ ID NO: 1156856 - RNA, 14 nt, Homo sapiens
acacggaggcaucc

SEQ ID NO: 1156857 - RNA, 17 nt, Homo sapiens
acacggcggggucugua

SEQ ID NO: 1156858 - RNA, 18 nt, Homo sapiens
acacggcggggucuguag

SEQ ID NO: 1156859 - RNA, 20 nt, Homo sapiens
acacguaaugaaacuuggau

SEQ ID NO: 1156860 - RNA, 15 nt, Homo sapiens
acacguguccuguag

SEQ ID NO: 1156861 - RNA, 15 nt, Homo sapiens
acacuaaagagaaau

SEQ ID NO: 1156862 - RNA, 15 nt, Homo sapiens
acacuacaacauaug

SEQ ID NO: 1156863 - RNA, 18 nt, Homo sapiens
acacucagaaggcuucau

SEQ ID NO: 1156864 - RNA, 13 nt, Homo sapiens
acacuccuugcau

SEQ ID NO: 1156865 - RNA, 14 nt, Homo sapiens
acacuccuugcauc

SEQ ID NO: 1156866 - RNA, 21 nt, Homo sapiens
acacugaaaaaauacuaccua

SEQ ID NO: 1156867 - RNA, 15 nt, Homo sapiens
acacugaaaaggaaa

SEQ ID NO: 1156868 - RNA, 23 nt, Homo sapiens
acacugagacuugaaucaaguca

SEQ ID NO: 1156869 - RNA, 13 nt, Homo sapiens
acacugcuuuaaa

SEQ ID NO: 1156870 - RNA, 21 nt, Homo sapiens
acacuggaggagagaagaaug

SEQ ID NO: 1156871 - RNA, 10 nt, Homo sapiens
acacuggguu

SEQ ID NO: 1156872 - RNA, 16 nt, Homo sapiens
acacuggugacuccag

SEQ ID NO: 1156873 - RNA, 11 nt, Homo sapiens
acacugugcua

SEQ ID NO: 1156874 - RNA, 16 nt, Homo sapiens
acacugugcuacugaa

SEQ ID NO: 1156875 - RNA, 20 nt, Homo sapiens
acacugugucacaucacgaa

SEQ ID NO: 1156876 - RNA, 20 nt, Homo sapiens
acacuguguuuuauuguggu

SEQ ID NO: 1156877 - RNA, 21 nt, Homo sapiens
acacuguguuuuauuguggua

SEQ ID NO: 1156878 - RNA, 14 nt, Homo sapiens
acacuuaacagaug

SEQ ID NO: 1156879 - RNA, 19 nt, Homo sapiens
acacuuacuguaagacauu

SEQ ID NO: 1156880 - RNA, 15 nt, Homo sapiens
acacuuguauuugga

SEQ ID NO: 1156881 - RNA, 13 nt, Homo sapiens
acacuugugccag

SEQ ID NO: 1156882 - RNA, 15 nt, Homo sapiens
acacuuucucuucaa

SEQ ID NO: 1156883 - RNA, 22 nt, Homo sapiens
acacuuugggaggcugaggcag

SEQ ID NO: 1156884 - RNA, 14 nt, Homo sapiens
acagaaacacugcc

SEQ ID NO: 1156885 - RNA, 17 nt, Homo sapiens
acagaaacuaauccuua

SEQ ID NO: 1156886 - RNA, 13 nt, Homo sapiens
acagaaagcacaa

SEQ ID NO: 1156887 - RNA, 23 nt, Homo sapiens
acagaaaugaggaggaugcuaaa

SEQ ID NO: 1156888 - RNA, 14 nt, Homo sapiens
acagaacuucacag

SEQ ID NO: 1156889 - RNA, 21 nt, Homo sapiens
acagaagccugaugcugacau

SEQ ID NO: 1156890 - RNA, 22 nt, Homo sapiens
acagaauucacuuuaugugaga

SEQ ID NO: 1156891 - RNA, 18 nt, Homo sapiens
acagaauuuuauggugca

SEQ ID NO: 1156892 - RNA, 13 nt, Homo sapiens
acagacaaauacu

SEQ ID NO: 1156893 - RNA, 13 nt, Homo sapiens
acagacaacacug

SEQ ID NO: 1156894 - RNA, 14 nt, Homo sapiens
acagacgucucaag

SEQ ID NO: 1156895 - RNA, 12 nt, Homo sapiens
acagacgugugc

SEQ ID NO: 1156896 - RNA, 23 nt, Homo sapiens
acagacucauccugaacagcaug

SEQ ID NO: 1156897 - RNA, 14 nt, Homo sapiens
acagagacuggcau

SEQ ID NO: 1156898 - RNA, 20 nt, Homo sapiens
acagagcaagacccaucuca

SEQ ID NO: 1156899 - RNA, 20 nt, Homo sapiens
acagagcaagacuccaucuc

SEQ ID NO: 1156900 - RNA, 16 nt, Homo sapiens
acagagcgagacucca

SEQ ID NO: 1156901 - RNA, 20 nt, Homo sapiens
acagagcgagacuccaucuc

SEQ ID NO: 1156902 - RNA, 21 nt, Homo sapiens
acagagcgagacuccaucuca

SEQ ID NO: 1156903 - RNA, 16 nt, Homo sapiens
acagagcuucccugac

SEQ ID NO: 1156904 - RNA, 19 nt, Homo sapiens
acagagguucccugccuug

SEQ ID NO: 1156905 - RNA, 15 nt, Homo sapiens
acagaguaucagauc

SEQ ID NO: 1156906 - RNA, 16 nt, Homo sapiens
acagaguccugcagag

SEQ ID NO: 1156907 - RNA, 20 nt, Homo sapiens
acagagugagacuccaucuc

SEQ ID NO: 1156908 - RNA, 23 nt, Homo sapiens
acagagugagacuccaucucaaa

SEQ ID NO: 1156909 - RNA, 14 nt, Homo sapiens
acagauacugugag

SEQ ID NO: 1156910 - RNA, 13 nt, Homo sapiens
acagauacuuugu

SEQ ID NO: 1156911 - RNA, 13 nt, Homo sapiens
acagauugugaua

SEQ ID NO: 1156912 - RNA, 23 nt, Homo sapiens
acagauugugauaagaaaagcca

SEQ ID NO: 1156913 - RNA, 22 nt, Homo sapiens
acauucaugcucaguagcuuaa

SEQ ID NO: 1156914 - RNA, 17 nt, Homo sapiens
acauuccagaugcauga

SEQ ID NO: 1156915 - RNA, 20 nt, Homo sapiens
acauucuacacacagugccu

SEQ ID NO: 1156916 - RNA, 19 nt, Homo sapiens
acauucugaguaacaucag

SEQ ID NO: 1156917 - RNA, 21 nt, Homo sapiens
acauucuuccugauuauuuuc

SEQ ID NO: 1156918 - RNA, 16 nt, Homo sapiens
acauuggaaagcacac

SEQ ID NO: 1156919 - RNA, 13 nt, Homo sapiens
acauugugcuugg

SEQ ID NO: 1156920 - RNA, 12 nt, Homo sapiens
acauuuacuguu

SEQ ID NO: 1156921 - RNA, 14 nt, Homo sapiens
acauuuagucuucc

SEQ ID NO: 1156922 - RNA, 17 nt, Homo sapiens
acauuucccuacccuaa

SEQ ID NO: 1156923 - RNA, 18 nt, Homo sapiens
acauuucucauaccuucc

SEQ ID NO: 1156924 - RNA, 22 nt, Homo sapiens
acauuucucauaccuuccccac

SEQ ID NO: 1156925 - RNA, 19 nt, Homo sapiens
acauuuggcuuacaguaaa

SEQ ID NO: 1156926 - RNA, 19 nt, Homo sapiens
acauuuguauuuugugaug

SEQ ID NO: 1156927 - RNA, 18 nt, Homo sapiens
acauuuguuuguauucau

SEQ ID NO: 1156928 - RNA, 14 nt, Homo sapiens
acauuuuaacaaga

SEQ ID NO: 1156929 - RNA, 23 nt, Homo sapiens
acauuuuacuuuuuccuggcuca

SEQ ID NO: 1156930 - RNA, 15 nt, Homo sapiens
acauuuucucuuuaa

SEQ ID NO: 1156931 - RNA, 21 nt, Homo sapiens
acauuuugcucugugaacuau

SEQ ID NO: 1156932 - RNA, 18 nt, Homo sapiens
acauuuuguaacaaagaa

SEQ ID NO: 1156933 - RNA, 19 nt, Homo sapiens
acauuuuucccuauuuucc

SEQ ID NO: 1156934 - RNA, 18 nt, Homo sapiens
acauuuuuccguuugcuu

SEQ ID NO: 1156935 - RNA, 17 nt, Homo sapiens
accaaaaauguucuuca

SEQ ID NO: 1156936 - RNA, 14 nt, Homo sapiens
accaaacacccaca

SEQ ID NO: 1156937 - RNA, 16 nt, Homo sapiens
accaaauucuauacau

SEQ ID NO: 1156938 - RNA, 17 nt, Homo sapiens
accaacaguuccuucag

SEQ ID NO: 1156939 - RNA, 15 nt, Homo sapiens
accaacccauguaua

SEQ ID NO: 1156940 - RNA, 11 nt, Homo sapiens
accaagagauu

SEQ ID NO: 1156941 - RNA, 13 nt, Homo sapiens
accaagcaggaag

SEQ ID NO: 1156942 - RNA, 17 nt, Homo sapiens
accaagcauguuucaca

SEQ ID NO: 1156943 - RNA, 14 nt, Homo sapiens
accaagccucugga

SEQ ID NO: 1156944 - RNA, 14 nt, Homo sapiens
accaagcucugucc

SEQ ID NO: 1156945 - RNA, 19 nt, Homo sapiens
accaagcugugcccugacc

SEQ ID NO: 1156946 - RNA, 22 nt, Homo sapiens
accaaggcgggcggaucacuua

SEQ ID NO: 1156947 - RNA, 23 nt, Homo sapiens
accaagggggcggggacugcugg

SEQ ID NO: 1156948 - RNA, 18 nt, Homo sapiens
accaaggucucacacucc

SEQ ID NO: 1156949 - RNA, 20 nt, Homo sapiens
accaaggucucacacuccuc

SEQ ID NO: 1156950 - RNA, 22 nt, Homo sapiens
accaagucuacuucacuaauga

SEQ ID NO: 1156951 - RNA, 22 nt, Homo sapiens
accaaugccaaaaaaagacagg

SEQ ID NO: 1156952 - RNA, 12 nt, Homo sapiens
accaauguagaa

SEQ ID NO: 1156953 - RNA, 13 nt, Homo sapiens
accaaugucuuga

SEQ ID NO: 1156954 - RNA, 12 nt, Homo sapiens
accacaccagcc

SEQ ID NO: 1156955 - RNA, 21 nt, Homo sapiens
accacaccuggcccuugcaau

SEQ ID NO: 1156956 - RNA, 19 nt, Homo sapiens
accacacgcccccacaggc

SEQ ID NO: 1156957 - RNA, 18 nt, Homo sapiens
accacagagccucgggac

SEQ ID NO: 1156958 - RNA, 16 nt, Homo sapiens
accacagcacagccaa

SEQ ID NO: 1156959 - RNA, 12 nt, Homo sapiens
accacccuagca

SEQ ID NO: 1156960 - RNA, 18 nt, Homo sapiens
accacgacuggccagggc

SEQ ID NO: 1156961 - RNA, 21 nt, Homo sapiens
accacuauucuuaacuauuca

SEQ ID NO: 1156962 - RNA, 13 nt, Homo sapiens
accacucuugacu

SEQ ID NO: 1156963 - RNA, 14 nt, Homo sapiens
accacugaagggaa

SEQ ID NO: 1156964 - RNA, 17 nt, Homo sapiens
accacugauaaaaccau

SEQ ID NO: 1156965 - RNA, 14 nt, Homo sapiens
accacugcacucca

SEQ ID NO: 1156966 - RNA, 10 nt, Homo sapiens
accacuucag

SEQ ID NO: 1156967 - RNA, 11 nt, Homo sapiens
accacuuugaa

SEQ ID NO: 1156968 - RNA, 13 nt, Homo sapiens
aaugcuacuuuca

SEQ ID NO: 1156969 - RNA, 21 nt, Homo sapiens
aaugcuagcugcaagugacau

SEQ ID NO: 1156970 - RNA, 10 nt, Homo sapiens
aaugcucacc

SEQ ID NO: 1156971 - RNA, 17 nt, Homo sapiens
aaugcucccaccugaau

SEQ ID NO: 1156972 - RNA, 12 nt, Homo sapiens
aaugcucugaaa

SEQ ID NO: 1156973 - RNA, 18 nt, Homo sapiens
aaugcuggagcaggcugu

SEQ ID NO: 1156974 - RNA, 14 nt, Homo sapiens
aaugcuuauggaaa

SEQ ID NO: 1156975 - RNA, 16 nt, Homo sapiens
aauggacacuuuucac

SEQ ID NO: 1156976 - RNA, 16 nt, Homo sapiens
aauggacucaucuuag

SEQ ID NO: 1156977 - RNA, 15 nt, Homo sapiens
aauggagucauuuga

SEQ ID NO: 1156978 - RNA, 14 nt, Homo sapiens
aauggcagcugcca

SEQ ID NO: 1156979 - RNA, 22 nt, Homo sapiens
aauggcccccaaaaucugucac

SEQ ID NO: 1156980 - RNA, 23 nt, Homo sapiens
aaugggaaaguauucuguacucu

SEQ ID NO: 1156981 - RNA, 23 nt, Homo sapiens
aaugggauguaugaauacagcag

SEQ ID NO: 1156982 - RNA, 17 nt, Homo sapiens
aaugggcauugagaucu

SEQ ID NO: 1156983 - RNA, 22 nt, Homo sapiens
aaugggccacugaaaucuguca

SEQ ID NO: 1156984 - RNA, 17 nt, Homo sapiens
aauggguguaugaaugg

SEQ ID NO: 1156985 - RNA, 22 nt, Homo sapiens
aauggugacugauuucaaauca

SEQ ID NO: 1156986 - RNA, 17 nt, Homo sapiens
aauggugauuucuugcu

SEQ ID NO: 1156987 - RNA, 15 nt, Homo sapiens
aaugguuccauucuc

SEQ ID NO: 1156988 - RNA, 14 nt, Homo sapiens
aaugguuucacuug

SEQ ID NO: 1156989 - RNA, 16 nt, Homo sapiens
aaugguuuccucugga

SEQ ID NO: 1156990 - RNA, 15 nt, Homo sapiens
aaugguuuugaauag

SEQ ID NO: 1156991 - RNA, 21 nt, Homo sapiens
aaugguuuugaauagaucuuu

SEQ ID NO: 1156992 - RNA, 18 nt, Homo sapiens
aauguaaaauaaauuggu

SEQ ID NO: 1156993 - RNA, 15 nt, Homo sapiens
aauguaaacaauauc

SEQ ID NO: 1156994 - RNA, 13 nt, Homo sapiens
aauguaaacauuu

SEQ ID NO: 1156995 - RNA, 13 nt, Homo sapiens
aauguaaagccau

SEQ ID NO: 1156996 - RNA, 15 nt, Homo sapiens
aauguaaagccaugc

SEQ ID NO: 1156997 - RNA, 14 nt, Homo sapiens
aauguaagcauacu

SEQ ID NO: 1156998 - RNA, 21 nt, Homo sapiens
aauguaauauacugagcugcu

SEQ ID NO: 1156999 - RNA, 22 nt, Homo sapiens
aauguacaagacuuuaccauac

SEQ ID NO: 1157000 - RNA, 23 nt, Homo sapiens
aauguacaagacuuuaccauaca

SEQ ID NO: 1157001 - RNA, 19 nt, Homo sapiens
aauguacagaguaaccuau

SEQ ID NO: 1157002 - RNA, 19 nt, Homo sapiens
aauguagacauuaucuuuu

SEQ ID NO: 1157003 - RNA, 23 nt, Homo sapiens
aauguagcagcagccuacugagu

SEQ ID NO: 1157004 - RNA, 19 nt, Homo sapiens
aauguaggcaucaugcaug

SEQ ID NO: 1157005 - RNA, 15 nt, Homo sapiens
aauguaugcuucaua

SEQ ID NO: 1157006 - RNA, 18 nt, Homo sapiens
aauguauugagcauguga

SEQ ID NO: 1157007 - RNA, 19 nt, Homo sapiens
aauguauuggcacagugcu

SEQ ID NO: 1157008 - RNA, 11 nt, Homo sapiens
aauguauuuaa

SEQ ID NO: 1157009 - RNA, 14 nt, Homo sapiens
aaugucaccaccuu

SEQ ID NO: 1157010 - RNA, 15 nt, Homo sapiens
aaugucagcaucaag

SEQ ID NO: 1157011 - RNA, 15 nt, Homo sapiens
aaugucuccacuuca

SEQ ID NO: 1157012 - RNA, 20 nt, Homo sapiens
aaugucuucaguggaacaca

SEQ ID NO: 1157013 - RNA, 19 nt, Homo sapiens
aaugucuugcuguugacau

SEQ ID NO: 1157014 - RNA, 23 nt, Homo sapiens
aaugucuugcuguugacauauuu

SEQ ID NO: 1157015 - RNA, 17 nt, Homo sapiens
aaugugacauguugcuc

SEQ ID NO: 1157016 - RNA, 20 nt, Homo sapiens
aaugugacauuauaugcacu

SEQ ID NO: 1157017 - RNA, 13 nt, Homo sapiens
aaugugacuucau

SEQ ID NO: 1157018 - RNA, 18 nt, Homo sapiens
aaugugcagcucccauuu

SEQ ID NO: 1157019 - RNA, 18 nt, Homo sapiens
aaugugguuuuccugaaa

SEQ ID NO: 1157020 - RNA, 22 nt, Homo sapiens
aauguguaaagaucuacaugaa

SEQ ID NO: 1157021 - RNA, 17 nt, Homo sapiens
aauguguggcugaagac

SEQ ID NO: 1157022 - RNA, 23 nt, Homo sapiens
aauguuaagacuugacaguggaa

SEQ ID NO: 1157023 - RNA, 14 nt, Homo sapiens
aauguuaauguuau

SEQ ID NO: 1157024 - RNA, 18 nt, Homo sapiens
aauguuaauguuauauca

SEQ ID NO: 1157025 - RNA, 17 nt, Homo sapiens
aauguuauauacaucuc

SEQ ID NO: 1157026 - RNA, 16 nt, Homo sapiens
aauguugacaggcaaa

SEQ ID NO: 1157027 - RNA, 13 nt, Homo sapiens
aauguuuaaucuc

SEQ ID NO: 1157028 - RNA, 18 nt, Homo sapiens
aauguuuguauacauguu

SEQ ID NO: 1157029 - RNA, 16 nt, Homo sapiens
aauuaaaaaagcauac

SEQ ID NO: 1157030 - RNA, 17 nt, Homo sapiens
aauuaaaaaagcauacu

SEQ ID NO: 1157031 - RNA, 17 nt, Homo sapiens
aauuaaaacacuuucaa

SEQ ID NO: 1157032 - RNA, 12 nt, Homo sapiens
aauuaaaaccaa

SEQ ID NO: 1157033 - RNA, 23 nt, Homo sapiens
aauuaaaccagauuggagcaauu

SEQ ID NO: 1157034 - RNA, 22 nt, Homo sapiens
aauuaaagugaauuguugacaa

SEQ ID NO: 1157035 - RNA, 14 nt, Homo sapiens
aauuaauguucuga

SEQ ID NO: 1157036 - RNA, 18 nt, Homo sapiens
aauuacuuguaucauuga

SEQ ID NO: 1157037 - RNA, 19 nt, Homo sapiens
aauuacuuugauuccauuu

SEQ ID NO: 1157038 - RNA, 13 nt, Homo sapiens
aauuacuuuguga

SEQ ID NO: 1157039 - RNA, 20 nt, Homo sapiens
aauuagaaacaacauagcaa

SEQ ID NO: 1157040 - RNA, 18 nt, Homo sapiens
aauuagcuuuuucauccc

SEQ ID NO: 1157041 - RNA, 18 nt, Homo sapiens
aauuagugccacaaauaa

SEQ ID NO: 1157042 - RNA, 16 nt, Homo sapiens
aauuauaaacaucaca

SEQ ID NO: 1157043 - RNA, 13 nt, Homo sapiens
aauuauaucacuu

SEQ ID NO: 1157044 - RNA, 15 nt, Homo sapiens
aauuauaucacuuca

SEQ ID NO: 1157045 - RNA, 21 nt, Homo sapiens
aauuaucuaaaguaugaagca

SEQ ID NO: 1157046 - RNA, 23 nt, Homo sapiens
aauuaucuugaauguaguauuca

SEQ ID NO: 1157047 - RNA, 13 nt, Homo sapiens
aauuaugaccaug

SEQ ID NO: 1157048 - RNA, 19 nt, Homo sapiens
aauuaugacugcugaauca

SEQ ID NO: 1157049 - RNA, 22 nt, Homo sapiens
aauuauuugcauaacaauuccu

SEQ ID NO: 1157050 - RNA, 23 nt, Homo sapiens
aucugucauaagcauuacuuuau

SEQ ID NO: 1157051 - RNA, 23 nt, Homo sapiens
aucugugcacugcccauggacag

SEQ ID NO: 1157052 - RNA, 16 nt, Homo sapiens
aucugugucucuggaa

SEQ ID NO: 1157053 - RNA, 22 nt, Homo sapiens
aucugugucucuggaacccagg

SEQ ID NO: 1157054 - RNA, 19 nt, Homo sapiens
aucuguguuaaucugagua

SEQ ID NO: 1157055 - RNA, 21 nt, Homo sapiens
aucuuaaaaguguuguuauca

SEQ ID NO: 1157056 - RNA, 22 nt, Homo sapiens
aucuuaaaaguguuguuaucau

SEQ ID NO: 1157057 - RNA, 20 nt, Homo sapiens
aucuuacaagguugcaagag

SEQ ID NO: 1157058 - RNA, 22 nt, Homo sapiens
aucuuagguauaacagcacaau

SEQ ID NO: 1157059 - RNA, 17 nt, Homo sapiens
aucuuaguucuguauau

SEQ ID NO: 1157060 - RNA, 20 nt, Homo sapiens
aucuuauucuuuuguaauau

SEQ ID NO: 1157061 - RNA, 13 nt, Homo sapiens
aucuucacugcaa

SEQ ID NO: 1157062 - RNA, 23 nt, Homo sapiens
aucuuccuuuguugcacaaauag

SEQ ID NO: 1157063 - RNA, 16 nt, Homo sapiens
aucuucgggaccagga

SEQ ID NO: 1157064 - RNA, 12 nt, Homo sapiens
aucuucucuggg

SEQ ID NO: 1157065 - RNA, 13 nt, Homo sapiens
aucuucucugggu

SEQ ID NO: 1157066 - RNA, 22 nt, Homo sapiens
aucuugaaauuaagaaggcaaa

SEQ ID NO: 1157067 - RNA, 16 nt, Homo sapiens
aucuuggggacaucuc

SEQ ID NO: 1157068 - RNA, 16 nt, Homo sapiens
aucuugugacccucca

SEQ ID NO: 1157069 - RNA, 22 nt, Homo sapiens
aucuuguuuuuccacuacugcu

SEQ ID NO: 1157070 - RNA, 24 nt, Homo sapiens
aucuuguuuuuccacuacugcuac

SEQ ID NO: 1157071 - RNA, 15 nt, Homo sapiens
aucuuuaacacagcc

SEQ ID NO: 1157072 - RNA, 20 nt, Homo sapiens
aucuuuacaaaacuacauga

SEQ ID NO: 1157073 - RNA, 20 nt, Homo sapiens
aucuuucugugucuucacau

SEQ ID NO: 1157074 - RNA, 11 nt, Homo sapiens
aucuuuggaca

SEQ ID NO: 1157075 - RNA, 17 nt, Homo sapiens
aucuuuguauauuacau

SEQ ID NO: 1157076 - RNA, 18 nt, Homo sapiens
aucuuuuaaaauucacac

SEQ ID NO: 1157077 - RNA, 16 nt, Homo sapiens
aucuuuuuuagcauaa

SEQ ID NO: 1157078 - RNA, 18 nt, Homo sapiens
augaaaaagucagcuaca

SEQ ID NO: 1157079 - RNA, 16 nt, Homo sapiens
augaaaagagugguga

SEQ ID NO: 1157080 - RNA, 22 nt, Homo sapiens
augaaaauaacugaaccaaauu

SEQ ID NO: 1157081 - RNA, 13 nt, Homo sapiens
augaaaauauucu

SEQ ID NO: 1157082 - RNA, 15 nt, Homo sapiens
augaaacaaacuacu

SEQ ID NO: 1157083 - RNA, 18 nt, Homo sapiens
augaaacucuacauuuaa

SEQ ID NO: 1157084 - RNA, 18 nt, Homo sapiens
augaaagaacccaagaca

SEQ ID NO: 1157085 - RNA, 22 nt, Homo sapiens
augaaaggugacaaaaggcaga

SEQ ID NO: 1157086 - RNA, 14 nt, Homo sapiens
augaaaguggacaa

SEQ ID NO: 1157087 - RNA, 12 nt, Homo sapiens
augaaaucucag

SEQ ID NO: 1157088 - RNA, 15 nt, Homo sapiens
augaaaugcucuccu

SEQ ID NO: 1157089 - RNA, 18 nt, Homo sapiens
augaaauguaugugcucu

SEQ ID NO: 1157090 - RNA, 14 nt, Homo sapiens
augaaauuacuuau

SEQ ID NO: 1157091 - RNA, 17 nt, Homo sapiens
augaaauuauaaucugu

SEQ ID NO: 1157092 - RNA, 18 nt, Homo sapiens
augaacacuauauguaug

SEQ ID NO: 1157093 - RNA, 14 nt, Homo sapiens
augaacauccaaau

SEQ ID NO: 1157094 - RNA, 23 nt, Homo sapiens
augaaccugcccugcucccacag

SEQ ID NO: 1157095 - RNA, 21 nt, Homo sapiens
augaacuguauuauugcaauu

SEQ ID NO: 1157096 - RNA, 22 nt, Homo sapiens
augaagagcuauuuaaugacac

SEQ ID NO: 1157097 - RNA, 15 nt, Homo sapiens
augaagaucauauac

SEQ ID NO: 1157098 - RNA, 21 nt, Homo sapiens
augaagaucuuuauauuucaa

SEQ ID NO: 1157099 - RNA, 16 nt, Homo sapiens
augaaggcagagccau

SEQ ID NO: 1157100 - RNA, 13 nt, Homo sapiens
augaagugcuaca

SEQ ID NO: 1157101 - RNA, 20 nt, Homo sapiens
augaaguguguuuccuucag

SEQ ID NO: 1157102 - RNA, 14 nt, Homo sapiens
augaauacagcagc

SEQ ID NO: 1157103 - RNA, 13 nt, Homo sapiens
augaaucaaaagu

SEQ ID NO: 1157104 - RNA, 17 nt, Homo sapiens
augaaucaaaagugccu

SEQ ID NO: 1157105 - RNA, 21 nt, Homo sapiens
augaaucccacccacauguga

SEQ ID NO: 1157106 - RNA, 18 nt, Homo sapiens
augacagcugucccuguc

SEQ ID NO: 1157107 - RNA, 21 nt, Homo sapiens
augacauaaaauuuacauuua

SEQ ID NO: 1157108 - RNA, 15 nt, Homo sapiens
augacauauguagau

SEQ ID NO: 1157109 - RNA, 13 nt, Homo sapiens
augacuaagccaa

SEQ ID NO: 1157110 - RNA, 17 nt, Homo sapiens
augacucagagaaccag

SEQ ID NO: 1157111 - RNA, 23 nt, Homo sapiens
augacuguacauuuuagugauuu

SEQ ID NO: 1157112 - RNA, 19 nt, Homo sapiens
augacuuaaggugaaguga

SEQ ID NO: 1157113 - RNA, 17 nt, Homo sapiens
augagaacaaacagauc

SEQ ID NO: 1157114 - RNA, 16 nt, Homo sapiens
augagaaguacuuugu

SEQ ID NO: 1157115 - RNA, 20 nt, Homo sapiens
augagaaucagaucauuuca

SEQ ID NO: 1157116 - RNA, 18 nt, Homo sapiens
augagagaaggaggggag

SEQ ID NO: 1157117 - RNA, 18 nt, Homo sapiens
augagaugauacauccaa

SEQ ID NO: 1157118 - RNA, 19 nt, Homo sapiens
augagauuccagguccuga

SEQ ID NO: 1157119 - RNA, 23 nt, Homo sapiens
augagcaagccuagguacgaaga

SEQ ID NO: 1157120 - RNA, 13 nt, Homo sapiens
augagccaugaga

SEQ ID NO: 1157121 - RNA, 20 nt, Homo sapiens
augagccuguuuauugccau

SEQ ID NO: 1157122 - RNA, 21 nt, Homo sapiens
augaggcugcuuuccaaagcc

SEQ ID NO: 1157123 - RNA, 21 nt, Homo sapiens
augaguaauacaucaaagagu

SEQ ID NO: 1157124 - RNA, 19 nt, Homo sapiens
augaguauuauaggacuuu

SEQ ID NO: 1157125 - RNA, 14 nt, Homo sapiens
augaguccuugaaa

SEQ ID NO: 1157126 - RNA, 20 nt, Homo sapiens
augaguggagguuaaggcug

SEQ ID NO: 1157127 - RNA, 15 nt, Homo sapiens
augauaaaauacuaa

SEQ ID NO: 1157128 - RNA, 13 nt, Homo sapiens
augauaaacauuc

SEQ ID NO: 1157129 - RNA, 20 nt, Homo sapiens
augauaaguacuacauaccu

SEQ ID NO: 1157130 - RNA, 13 nt, Homo sapiens
augauacauccaa

SEQ ID NO: 1157131 - RNA, 19 nt, Homo sapiens
augauagaacuguacuguu

SEQ ID NO: 1157132 - RNA, 14 nt, Homo sapiens
augaucaaggugaa

SEQ ID NO: 1157133 - RNA, 16 nt, Homo sapiens
augaucaaggugaaau

SEQ ID NO: 1157134 - RNA, 15 nt, Homo sapiens
augaucaccauguau

SEQ ID NO: 1157135 - RNA, 22 nt, Homo sapiens
augaucaucacaaucaucauca

SEQ ID NO: 1157136 - RNA, 12 nt, Homo sapiens
augauccagaga

SEQ ID NO: 1157137 - RNA, 16 nt, Homo sapiens
augauccugccaaucu

SEQ ID NO: 1157138 - RNA, 13 nt, Homo sapiens
augaucucccugc

SEQ ID NO: 1157139 - RNA, 14 nt, Homo sapiens
augaugcaaccaaa

SEQ ID NO: 1157140 - RNA, 15 nt, Homo sapiens
augaugcaaccaaaa

SEQ ID NO: 1157141 - RNA, 21 nt, Homo sapiens
augaugcuaugguuugccauu

SEQ ID NO: 1157142 - RNA, 17 nt, Homo sapiens
augauggccaggcugau

SEQ ID NO: 1157143 - RNA, 19 nt, Homo sapiens
augauguuuccagauuaca

SEQ ID NO: 1157144 - RNA, 17 nt, Homo sapiens
augauuucagcagggau

SEQ ID NO: 1157145 - RNA, 15 nt, Homo sapiens
augcaaaacauuuca

SEQ ID NO: 1157146 - RNA, 17 nt, Homo sapiens
augcaaauccuauguga

SEQ ID NO: 1157147 - RNA, 13 nt, Homo sapiens
augcaaccauaag

SEQ ID NO: 1157148 - RNA, 22 nt, Homo sapiens
augcaagaacucaucacugugg

SEQ ID NO: 1157149 - RNA, 16 nt, Homo sapiens
augcaaugaacacuua

SEQ ID NO: 1157150 - RNA, 15 nt, Homo sapiens
augcaaugccaaaua

SEQ ID NO: 1157151 - RNA, 23 nt, Homo sapiens
augcaccuaaaaucuaauuagaa

SEQ ID NO: 1157152 - RNA, 11 nt, Homo sapiens
augcacugcug

SEQ ID NO: 1157153 - RNA, 14 nt, Homo sapiens
augcagacaaacaa

SEQ ID NO: 1157154 - RNA, 16 nt, Homo sapiens
augcagaggaauauua

SEQ ID NO: 1157155 - RNA, 21 nt, Homo sapiens
augcagcaggugcaaggcagc

SEQ ID NO: 1157156 - RNA, 20 nt, Homo sapiens
augcagccagccaucaaaua

SEQ ID NO: 1157157 - RNA, 18 nt, Homo sapiens
augcagucuguccaggcu

SEQ ID NO: 1157158 - RNA, 16 nt, Homo sapiens
augcaguuuuccuuaa

SEQ ID NO: 1157159 - RNA, 17 nt, Homo sapiens
augcaucaaaagacuua

SEQ ID NO: 1157160 - RNA, 18 nt, Homo sapiens
augcaucugcuacugugu

SEQ ID NO: 1157161 - RNA, 21 nt, Homo sapiens
augcaucugcuacugugucag

SEQ ID NO: 1157162 - RNA, 21 nt, Homo sapiens
augcauggugccccaggacca

SEQ ID NO: 1157163 - RNA, 23 nt, Homo sapiens
augcauggugccccaggaccagc

SEQ ID NO: 1157164 - RNA, 17 nt, Homo sapiens
augcaugucuaaccuga

SEQ ID NO: 1157165 - RNA, 20 nt, Homo sapiens
augcauuaaaccaaguccau

SEQ ID NO: 1157166 - RNA, 16 nt, Homo sapiens
augcauugucugcaau

SEQ ID NO: 1157167 - RNA, 17 nt, Homo sapiens
augcauugucugcaaug

SEQ ID NO: 1157168 - RNA, 18 nt, Homo sapiens
augcauugucugcaaugg

SEQ ID NO: 1157169 - RNA, 14 nt, Homo sapiens
augcauuucuauca

SEQ ID NO: 1157170 - RNA, 15 nt, Homo sapiens
augcauuucuaucaa

SEQ ID NO: 1157171 - RNA, 19 nt, Homo sapiens
augccaaugucagcaucaa

SEQ ID NO: 1157172 - RNA, 23 nt, Homo sapiens
augccacccaguugugacaauua

SEQ ID NO: 1157173 - RNA, 15 nt, Homo sapiens
augccagaauauaau

SEQ ID NO: 1157174 - RNA, 22 nt, Homo sapiens
augccaucuaccggcguccugc

SEQ ID NO: 1157175 - RNA, 20 nt, Homo sapiens
augcccauucuuuucacuuc

SEQ ID NO: 1157176 - RNA, 14 nt, Homo sapiens
augccccaccugcc

SEQ ID NO: 1157177 - RNA, 21 nt, Homo sapiens
augccccccucuucaccccac

SEQ ID NO: 1157178 - RNA, 13 nt, Homo sapiens
augcccugugugg

SEQ ID NO: 1157179 - RNA, 14 nt, Homo sapiens
augcccuugccuau

SEQ ID NO: 1157180 - RNA, 22 nt, Homo sapiens
augugauauuuuucuuauaauu

SEQ ID NO: 1157181 - RNA, 13 nt, Homo sapiens
augugaucagcuu

SEQ ID NO: 1157182 - RNA, 11 nt, Homo sapiens
augugaugaau

SEQ ID NO: 1157183 - RNA, 17 nt, Homo sapiens
augugcacuucacugga

SEQ ID NO: 1157184 - RNA, 15 nt, Homo sapiens
augugcaguauuuau

SEQ ID NO: 1157185 - RNA, 19 nt, Homo sapiens
augugccaggccuacugua

SEQ ID NO: 1157186 - RNA, 17 nt, Homo sapiens
augugccaggcuugccu

SEQ ID NO: 1157187 - RNA, 15 nt, Homo sapiens
augugcuguguaaag

SEQ ID NO: 1157188 - RNA, 16 nt, Homo sapiens
auguggagaacuaaag

SEQ ID NO: 1157189 - RNA, 20 nt, Homo sapiens
auguggauugaguaauggga

SEQ ID NO: 1157190 - RNA, 22 nt, Homo sapiens
auguggcaaggaaaaacagguc

SEQ ID NO: 1157191 - RNA, 15 nt, Homo sapiens
auguggguugugaua

SEQ ID NO: 1157192 - RNA, 15 nt, Homo sapiens
augugguagccucac

SEQ ID NO: 1157193 - RNA, 21 nt, Homo sapiens
auguguaaagaucuacaugaa

SEQ ID NO: 1157194 - RNA, 14 nt, Homo sapiens
auguguaacacuca

SEQ ID NO: 1157195 - RNA, 14 nt, Homo sapiens
auguguaugcgugc

SEQ ID NO: 1157196 - RNA, 23 nt, Homo sapiens
auguguauggguuaaaucaaaga

SEQ ID NO: 1157197 - RNA, 19 nt, Homo sapiens
auguguauguacguuugua

SEQ ID NO: 1157198 - RNA, 13 nt, Homo sapiens
augugucaaauac

SEQ ID NO: 1157199 - RNA, 14 nt, Homo sapiens
augugucccaguga

SEQ ID NO: 1157200 - RNA, 15 nt, Homo sapiens
augugucccagugaa

SEQ ID NO: 1157201 - RNA, 20 nt, Homo sapiens
augugugagauaacuuccuu

SEQ ID NO: 1157202 - RNA, 20 nt, Homo sapiens
auguguguguacaacacugg

SEQ ID NO: 1157203 - RNA, 11 nt, Homo sapiens
auguguugcau

SEQ ID NO: 1157204 - RNA, 18 nt, Homo sapiens
auguguuuucagucuuuc

SEQ ID NO: 1157205 - RNA, 16 nt, Homo sapiens
auguguuuuuguauga

SEQ ID NO: 1157206 - RNA, 21 nt, Homo sapiens
auguuaauuuuuugguacaaa

SEQ ID NO: 1157207 - RNA, 18 nt, Homo sapiens
auguuagccacaguguau

SEQ ID NO: 1157208 - RNA, 20 nt, Homo sapiens
auguuaguuucuugguaaag

SEQ ID NO: 1157209 - RNA, 17 nt, Homo sapiens
cacaugcaccuacccau

SEQ ID NO: 1157210 - RNA, 18 nt, Homo sapiens
cacaugcaccuacccaua

SEQ ID NO: 1157211 - RNA, 14 nt, Homo sapiens
cacaugcccauuca

SEQ ID NO: 1157212 - RNA, 17 nt, Homo sapiens
cacaugcuuuucuuccu

SEQ ID NO: 1157213 - RNA, 18 nt, Homo sapiens
cacauggccuaugcacau

SEQ ID NO: 1157214 - RNA, 21 nt, Homo sapiens
cacauggccuaugcacauaug

SEQ ID NO: 1157215 - RNA, 22 nt, Homo sapiens
cacaugggggucgcugcccuuc

SEQ ID NO: 1157216 - RNA, 19 nt, Homo sapiens
cacaugucuuguacaugug

SEQ ID NO: 1157217 - RNA, 13 nt, Homo sapiens
cacaugugcugca

SEQ ID NO: 1157218 - RNA, 20 nt, Homo sapiens
cacauuacauuuagucuucc

SEQ ID NO: 1157219 - RNA, 16 nt, Homo sapiens
cacauuaggaugguga

SEQ ID NO: 1157220 - RNA, 17 nt, Homo sapiens
cacauuggaacagugaa

SEQ ID NO: 1157221 - RNA, 19 nt, Homo sapiens
cacauuggaacagugaauc

SEQ ID NO: 1157222 - RNA, 20 nt, Homo sapiens
cacauuuauuuuuauaucua

SEQ ID NO: 1157223 - RNA, 18 nt, Homo sapiens
caccaaaacaaacccaaa

SEQ ID NO: 1157224 - RNA, 20 nt, Homo sapiens
caccaaaucaucucucauca

SEQ ID NO: 1157225 - RNA, 22 nt, Homo sapiens
caccaaaucaucucucaucacu

SEQ ID NO: 1157226 - RNA, 22 nt, Homo sapiens
caccaacacugucccaagguga

SEQ ID NO: 1157227 - RNA, 21 nt, Homo sapiens
caccaagcucuguccaaucag

SEQ ID NO: 1157228 - RNA, 17 nt, Homo sapiens
caccaauacccuguaaa

SEQ ID NO: 1157229 - RNA, 15 nt, Homo sapiens
caccacacccggcua

SEQ ID NO: 1157230 - RNA, 15 nt, Homo sapiens
caccaccagcuuaaa

SEQ ID NO: 1157231 - RNA, 16 nt, Homo sapiens
caccaccuuauacauc

SEQ ID NO: 1157232 - RNA, 15 nt, Homo sapiens
caccacgacuggcca

SEQ ID NO: 1157233 - RNA, 16 nt, Homo sapiens
caccacgucacuucau

SEQ ID NO: 1157234 - RNA, 14 nt, Homo sapiens
caccacuccugcca

SEQ ID NO: 1157235 - RNA, 14 nt, Homo sapiens
caccagccacuuua

SEQ ID NO: 1157236 - RNA, 15 nt, Homo sapiens
caccagccacuuuag

SEQ ID NO: 1157237 - RNA, 21 nt, Homo sapiens
caccaggauagagacuggaac

SEQ ID NO: 1157238 - RNA, 18 nt, Homo sapiens
caccaggauuuauacaua

SEQ ID NO: 1157239 - RNA, 15 nt, Homo sapiens
caccaggugccuuuc

SEQ ID NO: 1157240 - RNA, 22 nt, Homo sapiens
caccaucuuuugugagauguaa

SEQ ID NO: 1157241 - RNA, 11 nt, Homo sapiens
caccaugcaag

SEQ ID NO: 1157242 - RNA, 15 nt, Homo sapiens
caccaugcaccccug

SEQ ID NO: 1157243 - RNA, 15 nt, Homo sapiens
caccauuaacuccuc

SEQ ID NO: 1157244 - RNA, 23 nt, Homo sapiens
caccauucuuucuuggugcauuc

SEQ ID NO: 1157245 - RNA, 23 nt, Homo sapiens
cacccaaaagucaaaaggugccu

SEQ ID NO: 1157246 - RNA, 21 nt, Homo sapiens
cacccaaagccugucccagga

SEQ ID NO: 1157247 - RNA, 21 nt, Homo sapiens
cacccaagagggcugcuuccc

SEQ ID NO: 1157248 - RNA, 19 nt, Homo sapiens
cacccaaggaugucugcca

SEQ ID NO: 1157249 - RNA, 12 nt, Homo sapiens
cacccacaucuu

SEQ ID NO: 1157250 - RNA, 12 nt, Homo sapiens
cacccacaugug

SEQ ID NO: 1157251 - RNA, 14 nt, Homo sapiens
cacccacguggaga

SEQ ID NO: 1157252 - RNA, 18 nt, Homo sapiens
cacccagagccagugugg

SEQ ID NO: 1157253 - RNA, 19 nt, Homo sapiens
cacccagcccccacauccu

SEQ ID NO: 1157254 - RNA, 16 nt, Homo sapiens
cacccagugacugaca

SEQ ID NO: 1157255 - RNA, 17 nt, Homo sapiens
cacccaguugugacaau

SEQ ID NO: 1157256 - RNA, 17 nt, Homo sapiens
cacccaucacgugugau

SEQ ID NO: 1157257 - RNA, 12 nt, Homo sapiens
caccccaacagc

SEQ ID NO: 1157258 - RNA, 18 nt, Homo sapiens
caccccacacccaugugu

SEQ ID NO: 1157259 - RNA, 15 nt, Homo sapiens
cacccccaugacauu

SEQ ID NO: 1157260 - RNA, 14 nt, Homo sapiens
caccccucaucagg

SEQ ID NO: 1157261 - RNA, 21 nt, Homo sapiens
caccccuucgacaugcugcca

SEQ ID NO: 1157262 - RNA, 20 nt, Homo sapiens
caccccuuguuuagcauaua

SEQ ID NO: 1157263 - RNA, 12 nt, Homo sapiens
cacccuaccuuc

SEQ ID NO: 1157264 - RNA, 21 nt, Homo sapiens
cacccuccagcuuuuccucag

SEQ ID NO: 1157265 - RNA, 22 nt, Homo sapiens
caccgcgcccagccucaucucu

SEQ ID NO: 1157266 - RNA, 19 nt, Homo sapiens
caccgcugucucuuuguca

SEQ ID NO: 1157267 - RNA, 17 nt, Homo sapiens
caccguacaucugcaau

SEQ ID NO: 1157268 - RNA, 22 nt, Homo sapiens
caccguacaucugcaauaugaa

SEQ ID NO: 1157269 - RNA, 20 nt, Homo sapiens
caccgugccugaucugcaca

SEQ ID NO: 1157270 - RNA, 12 nt, Homo sapiens
caccuaauccag

SEQ ID NO: 1157271 - RNA, 18 nt, Homo sapiens
caccuaucccuaacaggc

SEQ ID NO: 1157272 - RNA, 12 nt, Homo sapiens
caccuauuucca

SEQ ID NO: 1157273 - RNA, 20 nt, Homo sapiens
caccucacaggccccaggaa

SEQ ID NO: 1157274 - RNA, 21 nt, Homo sapiens
caccucaugagucuaccugag

SEQ ID NO: 1157275 - RNA, 16 nt, Homo sapiens
caccucaugucauuuc

SEQ ID NO: 1157276 - RNA, 19 nt, Homo sapiens
caccucauucugaacccuu

SEQ ID NO: 1157277 - RNA, 21 nt, Homo sapiens
caccuccccagccuuugauca

SEQ ID NO: 1157278 - RNA, 18 nt, Homo sapiens
caccuccuucaauuccau

SEQ ID NO: 1157279 - RNA, 21 nt, Homo sapiens
caccucuuacuuccugccuca

SEQ ID NO: 1157280 - RNA, 11 nt, Homo sapiens
caccugcaauc

SEQ ID NO: 1157281 - RNA, 16 nt, Homo sapiens
caccugcagugccagc

SEQ ID NO: 1157282 - RNA, 19 nt, Homo sapiens
caccugggagaaaucuggc

SEQ ID NO: 1157283 - RNA, 13 nt, Homo sapiens
caccugggucuuu

SEQ ID NO: 1157284 - RNA, 21 nt, Homo sapiens
caccugggucuuuaugcauga

SEQ ID NO: 1157285 - RNA, 21 nt, Homo sapiens
caccugucaaacaaagccaga

SEQ ID NO: 1157286 - RNA, 21 nt, Homo sapiens
caccugugugcuguagauuca

SEQ ID NO: 1157287 - RNA, 19 nt, Homo sapiens
caccuucugugcucauguu

SEQ ID NO: 1157288 - RNA, 17 nt, Homo sapiens
caccuugugucuguaca

SEQ ID NO: 1157289 - RNA, 17 nt, Homo sapiens
caccuuuuauugacaca

SEQ ID NO: 1157290 - RNA, 18 nt, Homo sapiens
caccuuuuuucuuugguu

SEQ ID NO: 1157291 - RNA, 12 nt, Homo sapiens
cacgaguguucc

SEQ ID NO: 1157292 - RNA, 15 nt, Homo sapiens
cacgcacugcacugc

SEQ ID NO: 1157293 - RNA, 20 nt, Homo sapiens
cacgcaggagcacacccagc

SEQ ID NO: 1157294 - RNA, 22 nt, Homo sapiens
cacgccuguaaucccaacacuu

SEQ ID NO: 1157295 - RNA, 18 nt, Homo sapiens
cacgcggauuaauuugca

SEQ ID NO: 1157296 - RNA, 17 nt, Homo sapiens
cacggauccauguagca

SEQ ID NO: 1157297 - RNA, 17 nt, Homo sapiens
cacggcggggucuguag

SEQ ID NO: 1157298 - RNA, 14 nt, Homo sapiens
cacggugcugagac

SEQ ID NO: 1157299 - RNA, 13 nt, Homo sapiens
cacgucacaaaga

SEQ ID NO: 1157300 - RNA, 20 nt, Homo sapiens
cacgucacugcacuccagcu

SEQ ID NO: 1157301 - RNA, 13 nt, Homo sapiens
cacgucuguaauc

SEQ ID NO: 1157302 - RNA, 16 nt, Homo sapiens
cacgucuguaauccca

SEQ ID NO: 1157303 - RNA, 20 nt, Homo sapiens
cacgucuguaaucccagcgc

SEQ ID NO: 1157304 - RNA, 12 nt, Homo sapiens
cacguguaugca

SEQ ID NO: 1157305 - RNA, 15 nt, Homo sapiens
cacguucugcucauc

SEQ ID NO: 1157306 - RNA, 21 nt, Homo sapiens
cacguuuaaucccagcacuuu

SEQ ID NO: 1157307 - RNA, 20 nt, Homo sapiens
cacuaagaauucaaacuggg

SEQ ID NO: 1157308 - RNA, 12 nt, Homo sapiens
cacuaaugcuuu

SEQ ID NO: 1157309 - RNA, 14 nt, Homo sapiens
cacuacaacauaug

SEQ ID NO: 1157310 - RNA, 19 nt, Homo sapiens
cacuacaaucgcuaccuga

SEQ ID NO: 1157311 - RNA, 13 nt, Homo sapiens
cacuacaccacac

SEQ ID NO: 1157312 - RNA, 16 nt, Homo sapiens
cacuaccguaaauguc

SEQ ID NO: 1157313 - RNA, 21 nt, Homo sapiens
cacuaccguaaauguccauuu

SEQ ID NO: 1157314 - RNA, 21 nt, Homo sapiens
cacuagcaauaaaaugcuaau

SEQ ID NO: 1157315 - RNA, 22 nt, Homo sapiens
cacuagcccuccucucccagug

SEQ ID NO: 1157316 - RNA, 16 nt, Homo sapiens
cacuagccuaggucau

SEQ ID NO: 1157317 - RNA, 17 nt, Homo sapiens
cacuauauugcacaggc

SEQ ID NO: 1157318 - RNA, 13 nt, Homo sapiens
cacuauggacuua

SEQ ID NO: 1157319 - RNA, 16 nt, Homo sapiens
cacuauucucugccuu

SEQ ID NO: 1157320 - RNA, 20 nt, Homo sapiens
cacuauuucccucuacugag

SEQ ID NO: 1157321 - RNA, 13 nt, Homo sapiens
cacucaauccauc

SEQ ID NO: 1157322 - RNA, 12 nt, Homo sapiens
cacucaauggga

SEQ ID NO: 1157323 - RNA, 18 nt, Homo sapiens
cacucaggcccaaagccu

SEQ ID NO: 1157324 - RNA, 18 nt, Homo sapiens
cacucauccccucacuug

SEQ ID NO: 1157325 - RNA, 22 nt, Homo sapiens
cacuccaccacccaaaagucaa

SEQ ID NO: 1157326 - RNA, 14 nt, Homo sapiens
cacuccagcuccuu

SEQ ID NO: 1157327 - RNA, 13 nt, Homo sapiens
cacuccucggcag

SEQ ID NO: 1157328 - RNA, 22 nt, Homo sapiens
cacuccugggggagaaccacug

SEQ ID NO: 1157329 - RNA, 21 nt, Homo sapiens
cacucucccuuguacagccuu

SEQ ID NO: 1157330 - RNA, 14 nt, Homo sapiens
cacucuccuugcag

SEQ ID NO: 1157331 - RNA, 22 nt, Homo sapiens
cacucugcucgccuuagcacua

SEQ ID NO: 1157332 - RNA, 20 nt, Homo sapiens
cacucuuauagaaaguucaa

SEQ ID NO: 1157333 - RNA, 20 nt, Homo sapiens
cacucuuuugcuuuauucca

SEQ ID NO: 1157334 - RNA, 18 nt, Homo sapiens
cacugaaaacaucuggaa

SEQ ID NO: 1157335 - RNA, 18 nt, Homo sapiens
cacugaagggaaucacau

SEQ ID NO: 1157336 - RNA, 20 nt, Homo sapiens
cacugacagauguguuugca

SEQ ID NO: 1157337 - RNA, 19 nt, Homo sapiens
cacugauuguccauuuaca

SEQ ID NO: 1157338 - RNA, 18 nt, Homo sapiens
cacugcaccccaagagag

SEQ ID NO: 1157339 - RNA, 15 nt, Homo sapiens
cacugcacuccagcu

SEQ ID NO: 1157340 - RNA, 13 nt, Homo sapiens
cacugcauacaau

SEQ ID NO: 1157341 - RNA, 24 nt, Homo sapiens
cagaguggggaugacaugcacuca

SEQ ID NO: 1157342 - RNA, 22 nt, Homo sapiens
cagaguuggacuucuagacuca

SEQ ID NO: 1157343 - RNA, 19 nt, Homo sapiens
cagaguuggauaagccaau

SEQ ID NO: 1157344 - RNA, 20 nt, Homo sapiens
cagauacugugagcuuacau

SEQ ID NO: 1157345 - RNA, 16 nt, Homo sapiens
cagauagaaagcauua

SEQ ID NO: 1157346 - RNA, 22 nt, Homo sapiens
cagauagagaguuguuguguac

SEQ ID NO: 1157347 - RNA, 22 nt, Homo sapiens
cagauauacuugguucucucca

SEQ ID NO: 1157348 - RNA, 17 nt, Homo sapiens
cagauauuacagcuuau

SEQ ID NO: 1157349 - RNA, 15 nt, Homo sapiens
cagaucacagugucu

SEQ ID NO: 1157350 - RNA, 16 nt, Homo sapiens
cagaucacgaggucag

SEQ ID NO: 1157351 - RNA, 15 nt, Homo sapiens
cagauccucuucuca

SEQ ID NO: 1157352 - RNA, 18 nt, Homo sapiens
cagaugaacuauccacag

SEQ ID NO: 1157353 - RNA, 17 nt, Homo sapiens
cagaugagaguacaccc

SEQ ID NO: 1157354 - RNA, 19 nt, Homo sapiens
cagaugaucagggauccaa

SEQ ID NO: 1157355 - RNA, 22 nt, Homo sapiens
cagaugaucagggauccaauau

SEQ ID NO: 1157356 - RNA, 17 nt, Homo sapiens
cagaugccacacaagga

SEQ ID NO: 1157357 - RNA, 17 nt, Homo sapiens
cagaugcugauguucag

SEQ ID NO: 1157358 - RNA, 14 nt, Homo sapiens
cagauggauugaua

SEQ ID NO: 1157359 - RNA, 19 nt, Homo sapiens
cagaugggcauauguguca

SEQ ID NO: 1157360 - RNA, 23 nt, Homo sapiens
cagauguaauguuuucuuugcaa

SEQ ID NO: 1157361 - RNA, 17 nt, Homo sapiens
cagaugugaaccauuaa

SEQ ID NO: 1157362 - RNA, 22 nt, Homo sapiens
cagauguuuuacgucugggaga

SEQ ID NO: 1157363 - RNA, 16 nt, Homo sapiens
cagauucaugcacugu

SEQ ID NO: 1157364 - RNA, 23 nt, Homo sapiens
cagauugcaguucugauucauuu

SEQ ID NO: 1157365 - RNA, 16 nt, Homo sapiens
cagauuggccaauuaa

SEQ ID NO: 1157366 - RNA, 15 nt, Homo sapiens
cagauuuaccauaau

SEQ ID NO: 1157367 - RNA, 14 nt, Homo sapiens
cagauuuguguuau

SEQ ID NO: 1157368 - RNA, 16 nt, Homo sapiens
cagauuuucagaggau

SEQ ID NO: 1157369 - RNA, 15 nt, Homo sapiens
cagcaaaacuuucca

SEQ ID NO: 1157370 - RNA, 14 nt, Homo sapiens
cagcaacacagccu

SEQ ID NO: 1157371 - RNA, 23 nt, Homo sapiens
cagcaacuugaacuucaccugca

SEQ ID NO: 1157372 - RNA, 12 nt, Homo sapiens
cagcaagccaug

SEQ ID NO: 1157373 - RNA, 13 nt, Homo sapiens
cagcaagucucuu

SEQ ID NO: 1157374 - RNA, 14 nt, Homo sapiens
cagcacaagauaca

SEQ ID NO: 1157375 - RNA, 12 nt, Homo sapiens
cagcacagccaa

SEQ ID NO: 1157376 - RNA, 19 nt, Homo sapiens
cagcacagcgaagacugcu

SEQ ID NO: 1157377 - RNA, 20 nt, Homo sapiens
cagcaccccccauuuuuuca

SEQ ID NO: 1157378 - RNA, 20 nt, Homo sapiens
cagcaccugcgggagcugca

SEQ ID NO: 1157379 - RNA, 20 nt, Homo sapiens
cagcacuggaaccaccugga

SEQ ID NO: 1157380 - RNA, 17 nt, Homo sapiens
cagcacuguugguguuc

SEQ ID NO: 1157381 - RNA, 15 nt, Homo sapiens
cagcacuuuccguca

SEQ ID NO: 1157382 - RNA, 17 nt, Homo sapiens
cagcagcacuggaacca

SEQ ID NO: 1157383 - RNA, 13 nt, Homo sapiens
cagcagugccuug

SEQ ID NO: 1157384 - RNA, 15 nt, Homo sapiens
cagcaguuacuguga

SEQ ID NO: 1157385 - RNA, 13 nt, Homo sapiens
cagcauacgucag

SEQ ID NO: 1157386 - RNA, 15 nt, Homo sapiens
cagcaucaccugccu

SEQ ID NO: 1157387 - RNA, 20 nt, Homo sapiens
cagcaucagagagacuguua

SEQ ID NO: 1157388 - RNA, 19 nt, Homo sapiens
cagcaucuaagaaguuuug

SEQ ID NO: 1157389 - RNA, 10 nt, Homo sapiens
cagcaucuga

SEQ ID NO: 1157390 - RNA, 14 nt, Homo sapiens
cagcaucuuuaaca

SEQ ID NO: 1157391 - RNA, 15 nt, Homo sapiens
cagcaugccuucaaa

SEQ ID NO: 1157392 - RNA, 20 nt, Homo sapiens
cagcauguuucucccauuua

SEQ ID NO: 1157393 - RNA, 12 nt, Homo sapiens
cagcauucucag

SEQ ID NO: 1157394 - RNA, 19 nt, Homo sapiens
cagcauugacucuguggcu

SEQ ID NO: 1157395 - RNA, 11 nt, Homo sapiens
cagcauugcuu

SEQ ID NO: 1157396 - RNA, 21 nt, Homo sapiens
cagcauuuagacccugcauuu

SEQ ID NO: 1157397 - RNA, 16 nt, Homo sapiens
cagccaacccuuucau

SEQ ID NO: 1157398 - RNA, 19 nt, Homo sapiens
cagccaccucccucugcca

SEQ ID NO: 1157399 - RNA, 22 nt, Homo sapiens
cagccacuuuuagcuacugcua

SEQ ID NO: 1157400 - RNA, 18 nt, Homo sapiens
cagccaucaagagacuga

SEQ ID NO: 1157401 - RNA, 21 nt, Homo sapiens
cagccaucaagagacugaguc

SEQ ID NO: 1157402 - RNA, 17 nt, Homo sapiens
cagccaugcaaugccaa

SEQ ID NO: 1157403 - RNA, 22 nt, Homo sapiens
cagccaugcaaugccaaauaau

SEQ ID NO: 1157404 - RNA, 17 nt, Homo sapiens
cagccaugucugcauuu

SEQ ID NO: 1157405 - RNA, 15 nt, Homo sapiens
cagcccaacagcacu

SEQ ID NO: 1157406 - RNA, 16 nt, Homo sapiens
cagcccaacagcacuu

SEQ ID NO: 1157407 - RNA, 16 nt, Homo sapiens
cagcccaccccugugc

SEQ ID NO: 1157408 - RNA, 15 nt, Homo sapiens
cagcccacccugcug

SEQ ID NO: 1157409 - RNA, 21 nt, Homo sapiens
cagcccagaggccaacacugu

SEQ ID NO: 1157410 - RNA, 14 nt, Homo sapiens
cagcccccaccuca

SEQ ID NO: 1157411 - RNA, 22 nt, Homo sapiens
cagcccuacagggacugggcaa

SEQ ID NO: 1157412 - RNA, 13 nt, Homo sapiens
cagcccuccccau

SEQ ID NO: 1157413 - RNA, 16 nt, Homo sapiens
cagcccugaaucagau

SEQ ID NO: 1157414 - RNA, 20 nt, Homo sapiens
cagcccugaguuccuagcca

SEQ ID NO: 1157415 - RNA, 16 nt, Homo sapiens
cagcccugccauguca

SEQ ID NO: 1157416 - RNA, 22 nt, Homo sapiens
cagcccuggggacaccugccca

SEQ ID NO: 1157417 - RNA, 15 nt, Homo sapiens
cagccgauucaccug

SEQ ID NO: 1157418 - RNA, 20 nt, Homo sapiens
cagccggcuaugaaagggag

SEQ ID NO: 1157419 - RNA, 13 nt, Homo sapiens
cagccucaucucu

SEQ ID NO: 1157420 - RNA, 20 nt, Homo sapiens
cagccuccugaguagcugga

SEQ ID NO: 1157421 - RNA, 17 nt, Homo sapiens
cagccuggcaucugugc

SEQ ID NO: 1157422 - RNA, 17 nt, Homo sapiens
cagccuggccaacaugg

SEQ ID NO: 1157423 - RNA, 14 nt, Homo sapiens
cagccuggccagac

SEQ ID NO: 1157424 - RNA, 16 nt, Homo sapiens
cagccuggggccaagc

SEQ ID NO: 1157425 - RNA, 16 nt, Homo sapiens
cagccuuacccagucc

SEQ ID NO: 1157426 - RNA, 16 nt, Homo sapiens
cagccuugaacucugg

SEQ ID NO: 1157427 - RNA, 14 nt, Homo sapiens
cagccuugccagag

SEQ ID NO: 1157428 - RNA, 14 nt, Homo sapiens
cagcgaacaugccu

SEQ ID NO: 1157429 - RNA, 16 nt, Homo sapiens
cagcgaacaugccuga

SEQ ID NO: 1157430 - RNA, 13 nt, Homo sapiens
cagcuaaaaccua

SEQ ID NO: 1157431 - RNA, 20 nt, Homo sapiens
cagcuaaacaccacgucacu

SEQ ID NO: 1157432 - RNA, 22 nt, Homo sapiens
cagcuaaacaccacgucacuuc

SEQ ID NO: 1157433 - RNA, 13 nt, Homo sapiens
cagcuaaauuuuc

SEQ ID NO: 1157434 - RNA, 14 nt, Homo sapiens
cagcuacaacagcc

SEQ ID NO: 1157435 - RNA, 15 nt, Homo sapiens
cagcuagacauugca

SEQ ID NO: 1157436 - RNA, 16 nt, Homo sapiens
cagcuagacauugcaa

SEQ ID NO: 1157437 - RNA, 20 nt, Homo sapiens
cagcucaaaggcacagugaa

SEQ ID NO: 1157438 - RNA, 18 nt, Homo sapiens
cagcuccaaccugcaaag

SEQ ID NO: 1157439 - RNA, 16 nt, Homo sapiens
cagcucccgcuguggc

SEQ ID NO: 1157440 - RNA, 23 nt, Homo sapiens
cagcuccuccccacuagcauuuu

SEQ ID NO: 1157441 - RNA, 13 nt, Homo sapiens
cagcucuaagcag

SEQ ID NO: 1157442 - RNA, 23 nt, Homo sapiens
cagcucuccccucagagugcaag

SEQ ID NO: 1157443 - RNA, 19 nt, Homo sapiens
cagcugauugggcaccuga

SEQ ID NO: 1157444 - RNA, 15 nt, Homo sapiens
cagcugcaucugaua

SEQ ID NO: 1157445 - RNA, 15 nt, Homo sapiens
cagcugccccgggga

SEQ ID NO: 1157446 - RNA, 14 nt, Homo sapiens
cagcugcccugugu

SEQ ID NO: 1157447 - RNA, 18 nt, Homo sapiens
cagcugcucccacacuug

SEQ ID NO: 1157448 - RNA, 21 nt, Homo sapiens
cagcuggucaaacaaacucuc

SEQ ID NO: 1157449 - RNA, 19 nt, Homo sapiens
cagcuguacugaggaugau

SEQ ID NO: 1157450 - RNA, 14 nt, Homo sapiens
cagcugucugucau

SEQ ID NO: 1157451 - RNA, 19 nt, Homo sapiens
cagcugugauuuggaaggg

SEQ ID NO: 1157452 - RNA, 17 nt, Homo sapiens
cagcugugcugggugag

SEQ ID NO: 1157453 - RNA, 18 nt, Homo sapiens
cagcuguugcaggcagug

SEQ ID NO: 1157454 - RNA, 17 nt, Homo sapiens
cagcuuaagaguagcug

SEQ ID NO: 1157455 - RNA, 20 nt, Homo sapiens
cagcuuaggggcugcugacc

SEQ ID NO: 1157456 - RNA, 12 nt, Homo sapiens
cagcuuaucucu

SEQ ID NO: 1157457 - RNA, 22 nt, Homo sapiens
cagcuuauugugugcgcugccu

SEQ ID NO: 1157458 - RNA, 13 nt, Homo sapiens
cagcuuuacugug

SEQ ID NO: 1157459 - RNA, 16 nt, Homo sapiens
cagcuuuucagugaau

SEQ ID NO: 1157460 - RNA, 23 nt, Homo sapiens
cagcuuuucccaggagaccauuu

SEQ ID NO: 1157461 - RNA, 13 nt, Homo sapiens
caggaaacauuca

SEQ ID NO: 1157462 - RNA, 15 nt, Homo sapiens
caggaaagcagcaaa

SEQ ID NO: 1157463 - RNA, 19 nt, Homo sapiens
caggaaccucgaguacugu

SEQ ID NO: 1157464 - RNA, 18 nt, Homo sapiens
caggaagaaaauagaaca

SEQ ID NO: 1157465 - RNA, 12 nt, Homo sapiens
caggaagccugu

SEQ ID NO: 1157466 - RNA, 13 nt, Homo sapiens
caggaagcugccc

SEQ ID NO: 1157467 - RNA, 19 nt, Homo sapiens
caggaaggaaaacuaugua

SEQ ID NO: 1157468 - RNA, 20 nt, Homo sapiens
caggaauauuuccuccauuc

SEQ ID NO: 1157469 - RNA, 18 nt, Homo sapiens
caggaaucuugcuccaau

SEQ ID NO: 1157470 - RNA, 17 nt, Homo sapiens
caggaccagcucaggac

SEQ ID NO: 1157471 - RNA, 17 nt, Homo sapiens
caggaccaucccggccg

SEQ ID NO: 1157472 - RNA, 22 nt, Homo sapiens
caggacugugccagcacaaagu

SEQ ID NO: 1157473 - RNA, 16 nt, Homo sapiens
caggacuuguuuacaa

SEQ ID NO: 1157474 - RNA, 15 nt, Homo sapiens
caggagcaaucacag

SEQ ID NO: 1157475 - RNA, 17 nt, Homo sapiens
caggagccucugcaguc

SEQ ID NO: 1157476 - RNA, 17 nt, Homo sapiens
caggagcuuaaacagcu

SEQ ID NO: 1157477 - RNA, 20 nt, Homo sapiens
caggaggagucauguagccc

SEQ ID NO: 1157478 - RNA, 19 nt, Homo sapiens
caggagguggucugggacu

SEQ ID NO: 1157479 - RNA, 19 nt, Homo sapiens
caggaguacaccccaacag

SEQ ID NO: 1157480 - RNA, 18 nt, Homo sapiens
caggaguauccucuugcc

SEQ ID NO: 1157481 - RNA, 15 nt, Homo sapiens
caggagucaccaugc

SEQ ID NO: 1157482 - RNA, 15 nt, Homo sapiens
caggagucagccaug

SEQ ID NO: 1157483 - RNA, 14 nt, Homo sapiens
caggaguucagggu

SEQ ID NO: 1157484 - RNA, 15 nt, Homo sapiens
caggaguuccagugc

SEQ ID NO: 1157485 - RNA, 13 nt, Homo sapiens
caggauaugacaa

SEQ ID NO: 1157486 - RNA, 20 nt, Homo sapiens
caggaucauguaaaugcuca

SEQ ID NO: 1157487 - RNA, 17 nt, Homo sapiens
caggaugaaaaugaaga

SEQ ID NO: 1157488 - RNA, 14 nt, Homo sapiens
caggauggacucca

SEQ ID NO: 1157489 - RNA, 18 nt, Homo sapiens
caggcaagcuuauucuuu

SEQ ID NO: 1157490 - RNA, 18 nt, Homo sapiens
caggcacaggucaggggu

SEQ ID NO: 1157491 - RNA, 12 nt, Homo sapiens
caggcaccucac

SEQ ID NO: 1157492 - RNA, 23 nt, Homo sapiens
caggcaccugcacuuacaggccu

SEQ ID NO: 1157493 - RNA, 19 nt, Homo sapiens
caggcacucuccugucuga

SEQ ID NO: 1157494 - RNA, 14 nt, Homo sapiens
caggcacugagaau

SEQ ID NO: 1157495 - RNA, 12 nt, Homo sapiens
caggcacugggc

SEQ ID NO: 1157496 - RNA, 16 nt, Homo sapiens
caggcagauccaggac

SEQ ID NO: 1157497 - RNA, 18 nt, Homo sapiens
caggcagccugccuuuaa

SEQ ID NO: 1157498 - RNA, 15 nt, Homo sapiens
caggcagggugcagu

SEQ ID NO: 1157499 - RNA, 22 nt, Homo sapiens
caggcagguaaccccagauuca

SEQ ID NO: 1157500 - RNA, 14 nt, Homo sapiens
caggcagugugagu

SEQ ID NO: 1157501 - RNA, 21 nt, Homo sapiens
caggcauggcuggugccugaa

SEQ ID NO: 1157502 - RNA, 16 nt, Homo sapiens
caggcaugugccacaa

SEQ ID NO: 1157503 - RNA, 15 nt, Homo sapiens
caggccacaaaugug

SEQ ID NO: 1157504 - RNA, 13 nt, Homo sapiens
caggccagguggg

SEQ ID NO: 1157505 - RNA, 17 nt, Homo sapiens
caggccccgcuugucca

SEQ ID NO: 1157506 - RNA, 13 nt, Homo sapiens
caggcccuagcuu

SEQ ID NO: 1157507 - RNA, 14 nt, Homo sapiens
caggcccuguggca

SEQ ID NO: 1157508 - RNA, 22 nt, Homo sapiens
caggccgcccugcgggugaaca

SEQ ID NO: 1157509 - RNA, 14 nt, Homo sapiens
caggccuacuguaa

SEQ ID NO: 1157510 - RNA, 23 nt, Homo sapiens
caggccucucggugcuccaucuc

SEQ ID NO: 1157511 - RNA, 22 nt, Homo sapiens
caggccucugguguuugcaaag

SEQ ID NO: 1157512 - RNA, 14 nt, Homo sapiens
caggccugccuucu

SEQ ID NO: 1157513 - RNA, 16 nt, Homo sapiens
caggccuuaucuccaa

SEQ ID NO: 1157514 - RNA, 14 nt, Homo sapiens
caggcguguucaua

SEQ ID NO: 1157515 - RNA, 17 nt, Homo sapiens
aaaaugugauguucuaa

SEQ ID NO: 1157516 - RNA, 20 nt, Homo sapiens
aaaaugugucugcaacaugg

SEQ ID NO: 1157517 - RNA, 14 nt, Homo sapiens
aaaauguucucuua

SEQ ID NO: 1157518 - RNA, 19 nt, Homo sapiens
aaaauguugagaaucccaa

SEQ ID NO: 1157519 - RNA, 16 nt, Homo sapiens
aaaauuaaaaccaauu

SEQ ID NO: 1157520 - RNA, 16 nt, Homo sapiens
aaaauuaaaauggaug

SEQ ID NO: 1157521 - RNA, 14 nt, Homo sapiens
aaaauuaauuccua

SEQ ID NO: 1157522 - RNA, 22 nt, Homo sapiens
aaaauuagcugggcauggugcg

SEQ ID NO: 1157523 - RNA, 21 nt, Homo sapiens
aaaauuauuugaaaacauaua

SEQ ID NO: 1157524 - RNA, 18 nt, Homo sapiens
aaaauucauuucuaauua

SEQ ID NO: 1157525 - RNA, 15 nt, Homo sapiens
aaaauuguagcuuuu

SEQ ID NO: 1157526 - RNA, 21 nt, Homo sapiens
aaaauuucacuuaauaaugug

SEQ ID NO: 1157527 - RNA, 13 nt, Homo sapiens
aaacaaacaugac

SEQ ID NO: 1157528 - RNA, 18 nt, Homo sapiens
aaacaaauagucuaucaa

SEQ ID NO: 1157529 - RNA, 12 nt, Homo sapiens
aaacaacagcuu

SEQ ID NO: 1157530 - RNA, 12 nt, Homo sapiens
aaacaacucuuu

SEQ ID NO: 1157531 - RNA, 22 nt, Homo sapiens
aaacaauaaagaaagaaauauu

SEQ ID NO: 1157532 - RNA, 19 nt, Homo sapiens
aaacaauaucagacuuuuu

SEQ ID NO: 1157533 - RNA, 22 nt, Homo sapiens
aaacaauguuuuaaacauucuu

SEQ ID NO: 1157534 - RNA, 19 nt, Homo sapiens
aaacaauucuuauugacuc

SEQ ID NO: 1157535 - RNA, 15 nt, Homo sapiens
aaacacaaccuacuc

SEQ ID NO: 1157536 - RNA, 16 nt, Homo sapiens
aaacacaauaccuaca

SEQ ID NO: 1157537 - RNA, 15 nt, Homo sapiens
aaacacacaaaaagu

SEQ ID NO: 1157538 - RNA, 13 nt, Homo sapiens
aaacacacuucca

SEQ ID NO: 1157539 - RNA, 20 nt, Homo sapiens
aaacacauguuuuuauacaa

SEQ ID NO: 1157540 - RNA, 13 nt, Homo sapiens
aaacaccauucau

SEQ ID NO: 1157541 - RNA, 22 nt, Homo sapiens
aaacacccacauaccuggccca

SEQ ID NO: 1157542 - RNA, 18 nt, Homo sapiens
aaacaccuuguacuuuau

SEQ ID NO: 1157543 - RNA, 23 nt, Homo sapiens
aaacacgccugcaaacgcugccu

SEQ ID NO: 1157544 - RNA, 20 nt, Homo sapiens
aaacacugccuuugucuuac

SEQ ID NO: 1157545 - RNA, 16 nt, Homo sapiens
aaacacuuauuuuaca

SEQ ID NO: 1157546 - RNA, 14 nt, Homo sapiens
aaacagcaaaccaa

SEQ ID NO: 1157547 - RNA, 17 nt, Homo sapiens
aaacagcugcccugugu

SEQ ID NO: 1157548 - RNA, 19 nt, Homo sapiens
aaacaggccgagugaaggu

SEQ ID NO: 1157549 - RNA, 13 nt, Homo sapiens
aaacaggucuuug

SEQ ID NO: 1157550 - RNA, 19 nt, Homo sapiens
aaacauaaggcacauugug

SEQ ID NO: 1157551 - RNA, 17 nt, Homo sapiens
aaacauaccaacauguu

SEQ ID NO: 1157552 - RNA, 13 nt, Homo sapiens
aaacauauacaaa

SEQ ID NO: 1157553 - RNA, 22 nt, Homo sapiens
aaacaucaguuacucugaaggg

SEQ ID NO: 1157554 - RNA, 16 nt, Homo sapiens
aaacaucauuacuaua

SEQ ID NO: 1157555 - RNA, 17 nt, Homo sapiens
aaacaucauuacuauaa

SEQ ID NO: 1157556 - RNA, 14 nt, Homo sapiens
aaacaucuauucuc

SEQ ID NO: 1157557 - RNA, 18 nt, Homo sapiens
aaacaugggcugugauua

SEQ ID NO: 1157558 - RNA, 20 nt, Homo sapiens
aaacaugguggguccauggg

SEQ ID NO: 1157559 - RNA, 18 nt, Homo sapiens
aaacaugugcaacucuug

SEQ ID NO: 1157560 - RNA, 23 nt, Homo sapiens
aaacauguuccuuauauuuacuc

SEQ ID NO: 1157561 - RNA, 18 nt, Homo sapiens
aaacauuucuaaaccaga

SEQ ID NO: 1157562 - RNA, 11 nt, Homo sapiens
aaaccaaauac

SEQ ID NO: 1157563 - RNA, 21 nt, Homo sapiens
aaaccaaauucuauacaugua

SEQ ID NO: 1157564 - RNA, 15 nt, Homo sapiens
aaaccaaccagcuga

SEQ ID NO: 1157565 - RNA, 21 nt, Homo sapiens
aaaccaagucuacuucacuaa

SEQ ID NO: 1157566 - RNA, 14 nt, Homo sapiens
aaaccacaacuuuu

SEQ ID NO: 1157567 - RNA, 17 nt, Homo sapiens
aaaccaguugauuuaaa

SEQ ID NO: 1157568 - RNA, 18 nt, Homo sapiens
aaaccaugacugaggcag

SEQ ID NO: 1157569 - RNA, 12 nt, Homo sapiens
aaaccaugugac

SEQ ID NO: 1157570 - RNA, 13 nt, Homo sapiens
aaacccaccaaaa

SEQ ID NO: 1157571 - RNA, 16 nt, Homo sapiens
aaacccagucacugug

SEQ ID NO: 1157572 - RNA, 20 nt, Homo sapiens
aaaccccaucuuuacuaaaa

SEQ ID NO: 1157573 - RNA, 14 nt, Homo sapiens
aaacccccacucca

SEQ ID NO: 1157574 - RNA, 17 nt, Homo sapiens
aaacccccacuccagcu

SEQ ID NO: 1157575 - RNA, 18 nt, Homo sapiens
aaacccccacuccagcuc

SEQ ID NO: 1157576 - RNA, 17 nt, Homo sapiens
aaacccccaguguaaua

SEQ ID NO: 1157577 - RNA, 14 nt, Homo sapiens
aaacccccaucucu

SEQ ID NO: 1157578 - RNA, 19 nt, Homo sapiens
aaaccccuucucugugacc

SEQ ID NO: 1157579 - RNA, 22 nt, Homo sapiens
aaaccccuuuucaguuugaacu

SEQ ID NO: 1157580 - RNA, 14 nt, Homo sapiens
aaaccucaagccag

SEQ ID NO: 1157581 - RNA, 13 nt, Homo sapiens
aaaccuccacugc

SEQ ID NO: 1157582 - RNA, 18 nt, Homo sapiens
aaaccuccacugcugcuc

SEQ ID NO: 1157583 - RNA, 12 nt, Homo sapiens
aaaccugaguga

SEQ ID NO: 1157584 - RNA, 16 nt, Homo sapiens
aaaccugcccaugugu

SEQ ID NO: 1157585 - RNA, 23 nt, Homo sapiens
aaaccuguauaacccuguuacaa

SEQ ID NO: 1157586 - RNA, 21 nt, Homo sapiens
aaaccuguugaaaugauaauu

SEQ ID NO: 1157587 - RNA, 15 nt, Homo sapiens
aaaccuugcacaggu

SEQ ID NO: 1157588 - RNA, 12 nt, Homo sapiens
aaaccuuuccau

SEQ ID NO: 1157589 - RNA, 19 nt, Homo sapiens
aaacgagaagguacugaaa

SEQ ID NO: 1157590 - RNA, 21 nt, Homo sapiens
aaacgauuagugauguccuua

SEQ ID NO: 1157591 - RNA, 18 nt, Homo sapiens
aaacggagugcgucaugc

SEQ ID NO: 1157592 - RNA, 20 nt, Homo sapiens
aaacgucuucuaaacuuccc

SEQ ID NO: 1157593 - RNA, 21 nt, Homo sapiens
aaacgugucccgagcuuagau

SEQ ID NO: 1157594 - RNA, 13 nt, Homo sapiens
aaacuaaaacaga

SEQ ID NO: 1157595 - RNA, 17 nt, Homo sapiens
aaacuaaagcaauagaa

SEQ ID NO: 1157596 - RNA, 13 nt, Homo sapiens
aaacuaacuugau

SEQ ID NO: 1157597 - RNA, 14 nt, Homo sapiens
aaacuaccugugag

SEQ ID NO: 1157598 - RNA, 22 nt, Homo sapiens
aaacuacuauuuuucuuuccaa

SEQ ID NO: 1157599 - RNA, 22 nt, Homo sapiens
aaacucaaaagaaggccacugu

SEQ ID NO: 1157600 - RNA, 21 nt, Homo sapiens
aaacucccagccacagcauuu

SEQ ID NO: 1157601 - RNA, 23 nt, Homo sapiens
aaacucccagccacagcauuuau

SEQ ID NO: 1157602 - RNA, 13 nt, Homo sapiens
aaacuccuuguua

SEQ ID NO: 1157603 - RNA, 11 nt, Homo sapiens
aaacucuucag

SEQ ID NO: 1157604 - RNA, 22 nt, Homo sapiens
aaacugagaaauuuacuacagu

SEQ ID NO: 1157605 - RNA, 16 nt, Homo sapiens
aaacugcaaaugugca

SEQ ID NO: 1157606 - RNA, 17 nt, Homo sapiens
aaacugcaaaugugcag

SEQ ID NO: 1157607 - RNA, 19 nt, Homo sapiens
aaacugcaaaugugcaguu

SEQ ID NO: 1157608 - RNA, 21 nt, Homo sapiens
aaacugcugucccaaacaugc

SEQ ID NO: 1157609 - RNA, 23 nt, Homo sapiens
aaacugggaugaaacuaaagcaa

SEQ ID NO: 1157610 - RNA, 21 nt, Homo sapiens
aaacugucgguuugcuuugau

SEQ ID NO: 1157611 - RNA, 15 nt, Homo sapiens
aaacuuaacauucau

SEQ ID NO: 1157612 - RNA, 16 nt, Homo sapiens
aaacuuaccugagaac

SEQ ID NO: 1157613 - RNA, 13 nt, Homo sapiens
aaacuuagaucau

SEQ ID NO: 1157614 - RNA, 17 nt, Homo sapiens
aaacuuaugaauguuuc

SEQ ID NO: 1157615 - RNA, 13 nt, Homo sapiens
aaacuuccucuaa

SEQ ID NO: 1157616 - RNA, 23 nt, Homo sapiens
aaacuugaaguagguagcaacgu

SEQ ID NO: 1157617 - RNA, 11 nt, Homo sapiens
aaacuuuccaa

SEQ ID NO: 1157618 - RNA, 19 nt, Homo sapiens
aaagaaaaacaaguuugcu

SEQ ID NO: 1157619 - RNA, 23 nt, Homo sapiens
aaagaaaaauaucuuggccuaaa

SEQ ID NO: 1157620 - RNA, 15 nt, Homo sapiens
aaagaaaacauucca

SEQ ID NO: 1157621 - RNA, 23 nt, Homo sapiens
aaagaagagaugagaaaugauga

SEQ ID NO: 1157622 - RNA, 13 nt, Homo sapiens
aaagaagccacag

SEQ ID NO: 1157623 - RNA, 21 nt, Homo sapiens
aaagaaucccuagacuuuagg

SEQ ID NO: 1157624 - RNA, 15 nt, Homo sapiens
aaagaaucuacuaua

SEQ ID NO: 1157625 - RNA, 17 nt, Homo sapiens
aaagaauuaccaagaga

SEQ ID NO: 1157626 - RNA, 14 nt, Homo sapiens
aaagacaaagacau

SEQ ID NO: 1157627 - RNA, 14 nt, Homo sapiens
aaagacaagacauu

SEQ ID NO: 1157628 - RNA, 12 nt, Homo sapiens
aaagacaauucu

SEQ ID NO: 1157629 - RNA, 16 nt, Homo sapiens
aaagacacucccacca

SEQ ID NO: 1157630 - RNA, 12 nt, Homo sapiens
aaagacacugcc

SEQ ID NO: 1157631 - RNA, 18 nt, Homo sapiens
aaagacaggguuucacca

SEQ ID NO: 1157632 - RNA, 19 nt, Homo sapiens
aaagaccaucuccuguaaa

SEQ ID NO: 1157633 - RNA, 12 nt, Homo sapiens
aaagacuugaau

SEQ ID NO: 1157634 - RNA, 21 nt, Homo sapiens
aaagacuugaauauguauuua

SEQ ID NO: 1157635 - RNA, 15 nt, Homo sapiens
aaagagaaguuccca

SEQ ID NO: 1157636 - RNA, 18 nt, Homo sapiens
aaagagagaugaaccaca

SEQ ID NO: 1157637 - RNA, 13 nt, Homo sapiens
aaagagcagcaca

SEQ ID NO: 1157638 - RNA, 22 nt, Homo sapiens
aaagaggacaggcuaccccuuu

SEQ ID NO: 1157639 - RNA, 15 nt, Homo sapiens
aaagagucacucaca

SEQ ID NO: 1157640 - RNA, 19 nt, Homo sapiens
aaagagucucuaccccuuu

SEQ ID NO: 1157641 - RNA, 18 nt, Homo sapiens
aaagagugaaggauuuau

SEQ ID NO: 1157642 - RNA, 16 nt, Homo sapiens
aaagauccaagcuccu

SEQ ID NO: 1157643 - RNA, 20 nt, Homo sapiens
aaagaugaccauaaccacug

SEQ ID NO: 1157644 - RNA, 12 nt, Homo sapiens
aaagaugaugcu

SEQ ID NO: 1157645 - RNA, 12 nt, Homo sapiens
aaagcacacuca

SEQ ID NO: 1157646 - RNA, 21 nt, Homo sapiens
aaagcacacucauccccucac

SEQ ID NO: 1157647 - RNA, 24 nt, Homo sapiens
aaagcagaauuuuaaugugaagac

SEQ ID NO: 1157648 - RNA, 18 nt, Homo sapiens
aacauauuuuacaucuga

SEQ ID NO: 1157649 - RNA, 20 nt, Homo sapiens
aacaucacugaaaugcuagc

SEQ ID NO: 1157650 - RNA, 18 nt, Homo sapiens
aacaucauaacccaugaa

SEQ ID NO: 1157651 - RNA, 20 nt, Homo sapiens
aacaucccugccagcucuuc

SEQ ID NO: 1157652 - RNA, 19 nt, Homo sapiens
aacaucgcgaugggaaccg

SEQ ID NO: 1157653 - RNA, 15 nt, Homo sapiens
aacaugaaaacaauu

SEQ ID NO: 1157654 - RNA, 18 nt, Homo sapiens
aacauggauguguugccc

SEQ ID NO: 1157655 - RNA, 14 nt, Homo sapiens
aacauguaugugca

SEQ ID NO: 1157656 - RNA, 19 nt, Homo sapiens
aacaugucacacuggcuau

SEQ ID NO: 1157657 - RNA, 19 nt, Homo sapiens
aacauguuguacauuucac

SEQ ID NO: 1157658 - RNA, 13 nt, Homo sapiens
aacauucccacug

SEQ ID NO: 1157659 - RNA, 18 nt, Homo sapiens
aacauugaacucauaucu

SEQ ID NO: 1157660 - RNA, 13 nt, Homo sapiens
aacauugugaugu

SEQ ID NO: 1157661 - RNA, 22 nt, Homo sapiens
aacauugugccaugucaaacaa

SEQ ID NO: 1157662 - RNA, 16 nt, Homo sapiens
aacauuguugauuuca

SEQ ID NO: 1157663 - RNA, 22 nt, Homo sapiens
aacauuucauuaugaggucaga

SEQ ID NO: 1157664 - RNA, 16 nt, Homo sapiens
aacauuuuguuuaugu

SEQ ID NO: 1157665 - RNA, 21 nt, Homo sapiens
aaccaaagucuaaacugagcu

SEQ ID NO: 1157666 - RNA, 20 nt, Homo sapiens
aaccaaauucuauacaugua

SEQ ID NO: 1157667 - RNA, 16 nt, Homo sapiens
aaccaaauugcacuga

SEQ ID NO: 1157668 - RNA, 13 nt, Homo sapiens
aaccaacagagaa

SEQ ID NO: 1157669 - RNA, 15 nt, Homo sapiens
aaccaacccauguau

SEQ ID NO: 1157670 - RNA, 14 nt, Homo sapiens
aaccaagucuacuu

SEQ ID NO: 1157671 - RNA, 17 nt, Homo sapiens
aaccaagucuacuucac

SEQ ID NO: 1157672 - RNA, 19 nt, Homo sapiens
aaccaagucuacuucacua

SEQ ID NO: 1157673 - RNA, 19 nt, Homo sapiens
aaccaauuccucauccuca

SEQ ID NO: 1157674 - RNA, 16 nt, Homo sapiens
aaccacaaacggagcc

SEQ ID NO: 1157675 - RNA, 21 nt, Homo sapiens
aaccacaaccuugcaguauuu

SEQ ID NO: 1157676 - RNA, 21 nt, Homo sapiens
aaccaccaccuuauacaucac

SEQ ID NO: 1157677 - RNA, 16 nt, Homo sapiens
aaccacuaauguuaga

SEQ ID NO: 1157678 - RNA, 13 nt, Homo sapiens
aaccagacuucuc

SEQ ID NO: 1157679 - RNA, 19 nt, Homo sapiens
aaccagagaacaacauggg

SEQ ID NO: 1157680 - RNA, 13 nt, Homo sapiens
aaccagagaggcu

SEQ ID NO: 1157681 - RNA, 23 nt, Homo sapiens
aaccagaggaggaggaggacaga

SEQ ID NO: 1157682 - RNA, 23 nt, Homo sapiens
aaccagcagaacagccauuuuuc

SEQ ID NO: 1157683 - RNA, 17 nt, Homo sapiens
aaccagcagaagccaga

SEQ ID NO: 1157684 - RNA, 19 nt, Homo sapiens
aaccagcugaaccuuucag

SEQ ID NO: 1157685 - RNA, 16 nt, Homo sapiens
aaccaggcugggcuca

SEQ ID NO: 1157686 - RNA, 16 nt, Homo sapiens
aaccagguuugcaccu

SEQ ID NO: 1157687 - RNA, 23 nt, Homo sapiens
aaccagucagcuggccagauuuc

SEQ ID NO: 1157688 - RNA, 21 nt, Homo sapiens
aaccauaguuauuuacuugaa

SEQ ID NO: 1157689 - RNA, 18 nt, Homo sapiens
aaccaugaaaauagccaa

SEQ ID NO: 1157690 - RNA, 15 nt, Homo sapiens
aaccaugaaaauggg

SEQ ID NO: 1157691 - RNA, 12 nt, Homo sapiens
aaccauuugcac

SEQ ID NO: 1157692 - RNA, 14 nt, Homo sapiens
aacccaaacucucc

SEQ ID NO: 1157693 - RNA, 22 nt, Homo sapiens
aacccacaagcugccucugaca

SEQ ID NO: 1157694 - RNA, 22 nt, Homo sapiens
aacccagcucuaauacauucca

SEQ ID NO: 1157695 - RNA, 21 nt, Homo sapiens
aacccaggaguucagggucau

SEQ ID NO: 1157696 - RNA, 19 nt, Homo sapiens
aacccauuugucucuacuu

SEQ ID NO: 1157697 - RNA, 16 nt, Homo sapiens
aaccccaaacuguuga

SEQ ID NO: 1157698 - RNA, 22 nt, Homo sapiens
aacccccagcccacagagccug

SEQ ID NO: 1157699 - RNA, 16 nt, Homo sapiens
aacccccaucucccua

SEQ ID NO: 1157700 - RNA, 23 nt, Homo sapiens
aacccccucgccuccuacucuga

SEQ ID NO: 1157701 - RNA, 21 nt, Homo sapiens
aaccccuucucugugacccac

SEQ ID NO: 1157702 - RNA, 23 nt, Homo sapiens
aaccccuuuucaguuugaacucu

SEQ ID NO: 1157703 - RNA, 22 nt, Homo sapiens
aaccccuuuuuguaccauuaau

SEQ ID NO: 1157704 - RNA, 19 nt, Homo sapiens
aacccucccuguucauccc

SEQ ID NO: 1157705 - RNA, 23 nt, Homo sapiens
aacccugacuccucuuugugcag

SEQ ID NO: 1157706 - RNA, 18 nt, Homo sapiens
aacccuggugguugcugu

SEQ ID NO: 1157707 - RNA, 23 nt, Homo sapiens
aacccuucccucaccuuggcacc

SEQ ID NO: 1157708 - RNA, 20 nt, Homo sapiens
aacccuucuggaaacuguga

SEQ ID NO: 1157709 - RNA, 13 nt, Homo sapiens
aacccuugcacua

SEQ ID NO: 1157710 - RNA, 14 nt, Homo sapiens
aacccuuggucaca

SEQ ID NO: 1157711 - RNA, 16 nt, Homo sapiens
aaccgagaagguuuau

SEQ ID NO: 1157712 - RNA, 17 nt, Homo sapiens
aaccgcaggaagcugcu

SEQ ID NO: 1157713 - RNA, 16 nt, Homo sapiens
aaccuacucugcaaac

SEQ ID NO: 1157714 - RNA, 22 nt, Homo sapiens
aaccucacauacccucacuuaa

SEQ ID NO: 1157715 - RNA, 17 nt, Homo sapiens
aaccucacgcaccuccc

SEQ ID NO: 1157716 - RNA, 20 nt, Homo sapiens
aaccucagccuggccagaca

SEQ ID NO: 1157717 - RNA, 21 nt, Homo sapiens
aaccucagccuggccagacac

SEQ ID NO: 1157718 - RNA, 13 nt, Homo sapiens
aaccuccacugcu

SEQ ID NO: 1157719 - RNA, 15 nt, Homo sapiens
aaccuccacugcugc

SEQ ID NO: 1157720 - RNA, 20 nt, Homo sapiens
aaccucccccccaaauacuc

SEQ ID NO: 1157721 - RNA, 18 nt, Homo sapiens
aaccuccuggguucaagc

SEQ ID NO: 1157722 - RNA, 14 nt, Homo sapiens
aaccuccuuuacca

SEQ ID NO: 1157723 - RNA, 15 nt, Homo sapiens
aaccucgaguacugu

SEQ ID NO: 1157724 - RNA, 13 nt, Homo sapiens
aaccucugaugcc

SEQ ID NO: 1157725 - RNA, 17 nt, Homo sapiens
aaccucuucuggcucaa

SEQ ID NO: 1157726 - RNA, 15 nt, Homo sapiens
aaccugauuuaccuc

SEQ ID NO: 1157727 - RNA, 12 nt, Homo sapiens
aaccugccuccc

SEQ ID NO: 1157728 - RNA, 12 nt, Homo sapiens
aaccugugauuc

SEQ ID NO: 1157729 - RNA, 10 nt, Homo sapiens
aaccuuccaa

SEQ ID NO: 1157730 - RNA, 16 nt, Homo sapiens
aaccuuugcuauguaa

SEQ ID NO: 1157731 - RNA, 23 nt, Homo sapiens
aacgagauugcuggaaaccaagu

SEQ ID NO: 1157732 - RNA, 18 nt, Homo sapiens
aacgagccuggaagcacu

SEQ ID NO: 1157733 - RNA, 21 nt, Homo sapiens
aacgauggaguacacagcuga

SEQ ID NO: 1157734 - RNA, 19 nt, Homo sapiens
aacgcccuuuccuccucag

SEQ ID NO: 1157735 - RNA, 22 nt, Homo sapiens
aacgccuaaaccucgguauuag

SEQ ID NO: 1157736 - RNA, 19 nt, Homo sapiens
aacggagagcgccugcccc

SEQ ID NO: 1157737 - RNA, 20 nt, Homo sapiens
aacgguuaagaaagcacuua

SEQ ID NO: 1157738 - RNA, 22 nt, Homo sapiens
aacguagcuucuaccaugaaca

SEQ ID NO: 1157739 - RNA, 23 nt, Homo sapiens
aacguccagcucguucucugggc

SEQ ID NO: 1157740 - RNA, 16 nt, Homo sapiens
aacgugcucaugggcu

SEQ ID NO: 1157741 - RNA, 20 nt, Homo sapiens
aacguuuuuggacacugugc

SEQ ID NO: 1157742 - RNA, 22 nt, Homo sapiens
aacuaacccuuaaaaaugcaca

SEQ ID NO: 1157743 - RNA, 14 nt, Homo sapiens
aacuaacuacugua

SEQ ID NO: 1157744 - RNA, 12 nt, Homo sapiens
aacuaacuugau

SEQ ID NO: 1157745 - RNA, 17 nt, Homo sapiens
aacuacauuaguacaca

SEQ ID NO: 1157746 - RNA, 19 nt, Homo sapiens
aacuacccccagcugugcu

SEQ ID NO: 1157747 - RNA, 13 nt, Homo sapiens
aacuaccucgcau

SEQ ID NO: 1157748 - RNA, 14 nt, Homo sapiens
aacuacuaucucag

SEQ ID NO: 1157749 - RNA, 21 nt, Homo sapiens
aacuacuauuuuucuuuccaa

SEQ ID NO: 1157750 - RNA, 14 nt, Homo sapiens
aacuagccaaucag

SEQ ID NO: 1157751 - RNA, 15 nt, Homo sapiens
aacuagguuaccgcu

SEQ ID NO: 1157752 - RNA, 21 nt, Homo sapiens
aacuauacauuuauuguuacg

SEQ ID NO: 1157753 - RNA, 18 nt, Homo sapiens
aacuauauaagacauuaa

SEQ ID NO: 1157754 - RNA, 16 nt, Homo sapiens
aacuauguaacaugua

SEQ ID NO: 1157755 - RNA, 21 nt, Homo sapiens
aacuauguauguauuaugcau

SEQ ID NO: 1157756 - RNA, 24 nt, Homo sapiens
aacuauuaaggauguagcuuuuca

SEQ ID NO: 1157757 - RNA, 16 nt, Homo sapiens
aacuauuuuugcacau

SEQ ID NO: 1157758 - RNA, 21 nt, Homo sapiens
aacucacugaggguaucugac

SEQ ID NO: 1157759 - RNA, 16 nt, Homo sapiens
aacucagaaacaucag

SEQ ID NO: 1157760 - RNA, 23 nt, Homo sapiens
aacucagaagaaagcucagaguu

SEQ ID NO: 1157761 - RNA, 13 nt, Homo sapiens
aacuccauucucu

SEQ ID NO: 1157762 - RNA, 16 nt, Homo sapiens
aacucccucccauccu

SEQ ID NO: 1157763 - RNA, 19 nt, Homo sapiens
aacucccuccucacacucc

SEQ ID NO: 1157764 - RNA, 17 nt, Homo sapiens
aacuccuuguuaaucca

SEQ ID NO: 1157765 - RNA, 20 nt, Homo sapiens
aacucgagaagauucaauca

SEQ ID NO: 1157766 - RNA, 19 nt, Homo sapiens
aacucuaaagccaagcacu

SEQ ID NO: 1157767 - RNA, 14 nt, Homo sapiens
aacucuacauuuaa

SEQ ID NO: 1157768 - RNA, 23 nt, Homo sapiens
aacucuccugggccacguaucaa

SEQ ID NO: 1157769 - RNA, 22 nt, Homo sapiens
aacucugcaacugaauacuuga

SEQ ID NO: 1157770 - RNA, 18 nt, Homo sapiens
aacucugugaucuugcuc

SEQ ID NO: 1157771 - RNA, 18 nt, Homo sapiens
aacucuuauuugaauuga

SEQ ID NO: 1157772 - RNA, 23 nt, Homo sapiens
aacucuucacucuucaaaugccu

SEQ ID NO: 1157773 - RNA, 23 nt, Homo sapiens
aacucuucaguuaauucuuagau

SEQ ID NO: 1157774 - RNA, 17 nt, Homo sapiens
aacucuucuuugcugca

SEQ ID NO: 1157775 - RNA, 13 nt, Homo sapiens
aacugaaauguua

SEQ ID NO: 1157776 - RNA, 13 nt, Homo sapiens
aacugaaccaaau

SEQ ID NO: 1157777 - RNA, 14 nt, Homo sapiens
aacugaagcucuaa

SEQ ID NO: 1157778 - RNA, 23 nt, Homo sapiens
aacugacaugauuagcagaagaa

SEQ ID NO: 1157779 - RNA, 13 nt, Homo sapiens
aauaaaacaaagg

SEQ ID NO: 1157780 - RNA, 11 nt, Homo sapiens
aauaaaacaca

SEQ ID NO: 1157781 - RNA, 21 nt, Homo sapiens
aauaaaagccaauuagcucua

SEQ ID NO: 1157782 - RNA, 16 nt, Homo sapiens
aauaaaaucuaauuaa

SEQ ID NO: 1157783 - RNA, 16 nt, Homo sapiens
aauaaaaugagcaaaa

SEQ ID NO: 1157784 - RNA, 12 nt, Homo sapiens
aauaaaauuucu

SEQ ID NO: 1157785 - RNA, 20 nt, Homo sapiens
aauaaaccaucaucuugcca

SEQ ID NO: 1157786 - RNA, 21 nt, Homo sapiens
aauaaacgagauguuugccaa

SEQ ID NO: 1157787 - RNA, 14 nt, Homo sapiens
aauaaacugcaaau

SEQ ID NO: 1157788 - RNA, 21 nt, Homo sapiens
aauaaagcuguucucauuccu

SEQ ID NO: 1157789 - RNA, 22 nt, Homo sapiens
aauaaaugagagggaaucgacu

SEQ ID NO: 1157790 - RNA, 13 nt, Homo sapiens
aauaaaugaguag

SEQ ID NO: 1157791 - RNA, 23 nt, Homo sapiens
aauaaaugaucuagauauuuucc

SEQ ID NO: 1157792 - RNA, 19 nt, Homo sapiens
aauaaauuccaaaauaucc

SEQ ID NO: 1157793 - RNA, 20 nt, Homo sapiens
aauaaauuuauuucaauauu

SEQ ID NO: 1157794 - RNA, 16 nt, Homo sapiens
aauaacaauaaaagac

SEQ ID NO: 1157795 - RNA, 12 nt, Homo sapiens
aauaacauguuu

SEQ ID NO: 1157796 - RNA, 23 nt, Homo sapiens
aauaaccggauauauacauagca

SEQ ID NO: 1157797 - RNA, 16 nt, Homo sapiens
aauaacgauaaaagac

SEQ ID NO: 1157798 - RNA, 20 nt, Homo sapiens
aauaacgucuuuuuauaucu

SEQ ID NO: 1157799 - RNA, 15 nt, Homo sapiens
aauaacugaaccaaa

SEQ ID NO: 1157800 - RNA, 14 nt, Homo sapiens
aauaacugaucuca

SEQ ID NO: 1157801 - RNA, 21 nt, Homo sapiens
aauaacugaucucaaguauau

SEQ ID NO: 1157802 - RNA, 14 nt, Homo sapiens
aauaauaauaguua

SEQ ID NO: 1157803 - RNA, 12 nt, Homo sapiens
aauaaucacuug

SEQ ID NO: 1157804 - RNA, 13 nt, Homo sapiens
aauaaucacuugg

SEQ ID NO: 1157805 - RNA, 23 nt, Homo sapiens
aauaauccucaguuuuugugaaa

SEQ ID NO: 1157806 - RNA, 22 nt, Homo sapiens
aauaaucugguguucuugcuaa

SEQ ID NO: 1157807 - RNA, 14 nt, Homo sapiens
aauaaugacaugua

SEQ ID NO: 1157808 - RNA, 16 nt, Homo sapiens
aauaaugaguuguucc

SEQ ID NO: 1157809 - RNA, 16 nt, Homo sapiens
aauaauggaagccaaa

SEQ ID NO: 1157810 - RNA, 18 nt, Homo sapiens
aauaaugggcauugagau

SEQ ID NO: 1157811 - RNA, 17 nt, Homo sapiens
aauaauuaguaagcuag

SEQ ID NO: 1157812 - RNA, 15 nt, Homo sapiens
aauaauucaucuuug

SEQ ID NO: 1157813 - RNA, 15 nt, Homo sapiens
aauaauuuccuccac

SEQ ID NO: 1157814 - RNA, 21 nt, Homo sapiens
aauaauuuuuaauugcuuaua

SEQ ID NO: 1157815 - RNA, 20 nt, Homo sapiens
aauacaagaguuucaaaaca

SEQ ID NO: 1157816 - RNA, 14 nt, Homo sapiens
aauacaaguucuuu

SEQ ID NO: 1157817 - RNA, 12 nt, Homo sapiens
aauacaauggga

SEQ ID NO: 1157818 - RNA, 21 nt, Homo sapiens
aauacagauaaguguucuuca

SEQ ID NO: 1157819 - RNA, 20 nt, Homo sapiens
aauacaggcaugaaccacug

SEQ ID NO: 1157820 - RNA, 17 nt, Homo sapiens
aauacauaaaacaaaag

SEQ ID NO: 1157821 - RNA, 16 nt, Homo sapiens
aauacggucuggugua

SEQ ID NO: 1157822 - RNA, 22 nt, Homo sapiens
aauacuaguugugaccuuagug

SEQ ID NO: 1157823 - RNA, 16 nt, Homo sapiens
aauacuauugcauuuu

SEQ ID NO: 1157824 - RNA, 14 nt, Homo sapiens
aauacucucugaaa

SEQ ID NO: 1157825 - RNA, 20 nt, Homo sapiens
aauacugccaaaacauuuau

SEQ ID NO: 1157826 - RNA, 21 nt, Homo sapiens
aauacugccagaugcugaugu

SEQ ID NO: 1157827 - RNA, 20 nt, Homo sapiens
aauacugguuauccugugcu

SEQ ID NO: 1157828 - RNA, 19 nt, Homo sapiens
aauacugucuaucucuaau

SEQ ID NO: 1157829 - RNA, 23 nt, Homo sapiens
aauacuuagacaguaugcauacu

SEQ ID NO: 1157830 - RNA, 21 nt, Homo sapiens
aauacuugcuccauuuacaaa

SEQ ID NO: 1157831 - RNA, 17 nt, Homo sapiens
aauacuuuuccuuaccu

SEQ ID NO: 1157832 - RNA, 14 nt, Homo sapiens
aauagaaaagcacu

SEQ ID NO: 1157833 - RNA, 16 nt, Homo sapiens
aauagaaauaaauucc

SEQ ID NO: 1157834 - RNA, 16 nt, Homo sapiens
aauagauacuuuugau

SEQ ID NO: 1157835 - RNA, 20 nt, Homo sapiens
aauagauuugaaacauuuau

SEQ ID NO: 1157836 - RNA, 20 nt, Homo sapiens
aauagauuugggucauuuag

SEQ ID NO: 1157837 - RNA, 17 nt, Homo sapiens
aauagcaaaacuaaaua

SEQ ID NO: 1157838 - RNA, 19 nt, Homo sapiens
aauagcaacguagcuucua

SEQ ID NO: 1157839 - RNA, 15 nt, Homo sapiens
aauagccacauuugg

SEQ ID NO: 1157840 - RNA, 17 nt, Homo sapiens
aauagccacauuuggaa

SEQ ID NO: 1157841 - RNA, 16 nt, Homo sapiens
aauagguaaagcuaua

SEQ ID NO: 1157842 - RNA, 20 nt, Homo sapiens
aauaguaccuucaauacuua

SEQ ID NO: 1157843 - RNA, 20 nt, Homo sapiens
aauaguggaucucaguuuuu

SEQ ID NO: 1157844 - RNA, 18 nt, Homo sapiens
aauauaagcugccauaua

SEQ ID NO: 1157845 - RNA, 20 nt, Homo sapiens
aauauaauaggacaaucauc

SEQ ID NO: 1157846 - RNA, 19 nt, Homo sapiens
aauauaauaugcacacagu

SEQ ID NO: 1157847 - RNA, 16 nt, Homo sapiens
aauauagaaugaaaga

SEQ ID NO: 1157848 - RNA, 22 nt, Homo sapiens
aauauaguugucuuucuuugcu

SEQ ID NO: 1157849 - RNA, 15 nt, Homo sapiens
aauaucaguuacuca

SEQ ID NO: 1157850 - RNA, 13 nt, Homo sapiens
aauauccuuugcc

SEQ ID NO: 1157851 - RNA, 14 nt, Homo sapiens
aauaucgacuuccc

SEQ ID NO: 1157852 - RNA, 12 nt, Homo sapiens
aauaucuuggcc

SEQ ID NO: 1157853 - RNA, 17 nt, Homo sapiens
aauaugaagaccaaaug

SEQ ID NO: 1157854 - RNA, 16 nt, Homo sapiens
aauaugcauugucugc

SEQ ID NO: 1157855 - RNA, 14 nt, Homo sapiens
aauauggacauauc

SEQ ID NO: 1157856 - RNA, 22 nt, Homo sapiens
aauaugggaaagacaugcagcu

SEQ ID NO: 1157857 - RNA, 21 nt, Homo sapiens
aauauggggauagucuggguc

SEQ ID NO: 1157858 - RNA, 17 nt, Homo sapiens
aauaugguguacauucu

SEQ ID NO: 1157859 - RNA, 21 nt, Homo sapiens
aauaugguguacauucuuccu

SEQ ID NO: 1157860 - RNA, 16 nt, Homo sapiens
aauaugugaucuguga

SEQ ID NO: 1157861 - RNA, 16 nt, Homo sapiens
aauauuaacauaagaa

SEQ ID NO: 1157862 - RNA, 21 nt, Homo sapiens
aauauuaggagacacagggaa

SEQ ID NO: 1157863 - RNA, 19 nt, Homo sapiens
aauauuaucuuuguucucc

SEQ ID NO: 1157864 - RNA, 16 nt, Homo sapiens
aauauucuaauuuuag

SEQ ID NO: 1157865 - RNA, 17 nt, Homo sapiens
aauauucugauuggucu

SEQ ID NO: 1157866 - RNA, 23 nt, Homo sapiens
aauauuguccauuguccaauccu

SEQ ID NO: 1157867 - RNA, 20 nt, Homo sapiens
aauauuuuucuguaguguga

SEQ ID NO: 1157868 - RNA, 17 nt, Homo sapiens
aaucaaaagugccucaa

SEQ ID NO: 1157869 - RNA, 17 nt, Homo sapiens
aaucaaagaacuucucc

SEQ ID NO: 1157870 - RNA, 22 nt, Homo sapiens
aaucaaaggaaaauaguaaugu

SEQ ID NO: 1157871 - RNA, 14 nt, Homo sapiens
aaucaaaugcaauu

SEQ ID NO: 1157872 - RNA, 21 nt, Homo sapiens
aaucaagacugcaaacccuuu

SEQ ID NO: 1157873 - RNA, 22 nt, Homo sapiens
aaucaauaagaagguagaauga

SEQ ID NO: 1157874 - RNA, 22 nt, Homo sapiens
aaucacauaacugguacaagua

SEQ ID NO: 1157875 - RNA, 13 nt, Homo sapiens
aaucacaugugcu

SEQ ID NO: 1157876 - RNA, 15 nt, Homo sapiens
aaucacucagugauu

SEQ ID NO: 1157877 - RNA, 22 nt, Homo sapiens
aaucacucagugauugcaauuu

SEQ ID NO: 1157878 - RNA, 17 nt, Homo sapiens
aaucacuccaacccugc

SEQ ID NO: 1157879 - RNA, 11 nt, Homo sapiens
aaucacuugaa

SEQ ID NO: 1157880 - RNA, 12 nt, Homo sapiens
aaucacuugaau

SEQ ID NO: 1157881 - RNA, 19 nt, Homo sapiens
aaucacuugaauccauuga

SEQ ID NO: 1157882 - RNA, 23 nt, Homo sapiens
aaucagaauaaauuaauauugua

SEQ ID NO: 1157883 - RNA, 15 nt, Homo sapiens
aaucagaucauuuca

SEQ ID NO: 1157884 - RNA, 18 nt, Homo sapiens
aaucagcaaacacaauaa

SEQ ID NO: 1157885 - RNA, 13 nt, Homo sapiens
aaucagcaauaaa

SEQ ID NO: 1157886 - RNA, 18 nt, Homo sapiens
aaucagcuacccauuaua

SEQ ID NO: 1157887 - RNA, 14 nt, Homo sapiens
aaucaggaaacuca

SEQ ID NO: 1157888 - RNA, 20 nt, Homo sapiens
aaucaggggcaaacggagua

SEQ ID NO: 1157889 - RNA, 21 nt, Homo sapiens
aaucauauuugaaaaccauau

SEQ ID NO: 1157890 - RNA, 16 nt, Homo sapiens
aaucaucauaucuacu

SEQ ID NO: 1157891 - RNA, 18 nt, Homo sapiens
aaucauccaagacaguua

SEQ ID NO: 1157892 - RNA, 15 nt, Homo sapiens
aaucaugaaucuuug

SEQ ID NO: 1157893 - RNA, 21 nt, Homo sapiens
aaucauguuuuuucugcaaug

SEQ ID NO: 1157894 - RNA, 11 nt, Homo sapiens
aauccaaaaag

SEQ ID NO: 1157895 - RNA, 12 nt, Homo sapiens
aauccaaaaaga

SEQ ID NO: 1157896 - RNA, 20 nt, Homo sapiens
aauccaaauggcgucuggaa

SEQ ID NO: 1157897 - RNA, 15 nt, Homo sapiens
aauccaauaccucuu

SEQ ID NO: 1157898 - RNA, 16 nt, Homo sapiens
aauccaggcagaucca

SEQ ID NO: 1157899 - RNA, 20 nt, Homo sapiens
aauccaggcagauccaggac

SEQ ID NO: 1157900 - RNA, 21 nt, Homo sapiens
aauccagguacgcacagacag

SEQ ID NO: 1157901 - RNA, 15 nt, Homo sapiens
aauccauccugcuca

SEQ ID NO: 1157902 - RNA, 23 nt, Homo sapiens
aauccaucguauuaaaaaacaau

SEQ ID NO: 1157903 - RNA, 20 nt, Homo sapiens
aauccaugaaccaagaccau

SEQ ID NO: 1157904 - RNA, 22 nt, Homo sapiens
aaucccaacguuuuacauaaaa

SEQ ID NO: 1157905 - RNA, 16 nt, Homo sapiens
aaucccacuaaugcaa

SEQ ID NO: 1157906 - RNA, 12 nt, Homo sapiens
aauccuguucca

SEQ ID NO: 1157907 - RNA, 14 nt, Homo sapiens
aaucgaauagggaa

SEQ ID NO: 1157908 - RNA, 22 nt, Homo sapiens
aaucgacuguauucgugcauuu

SEQ ID NO: 1157909 - RNA, 12 nt, Homo sapiens
aaucguccuccc

SEQ ID NO: 1157910 - RNA, 14 nt, Homo sapiens
aaucuaacagugac

SEQ ID NO: 1157911 - RNA, 14 nt, Homo sapiens
acaguaaaauccac

SEQ ID NO: 1157912 - RNA, 22 nt, Homo sapiens
acaguaauuauuauuuaacucu

SEQ ID NO: 1157913 - RNA, 13 nt, Homo sapiens
acagucaaucuau

SEQ ID NO: 1157914 - RNA, 14 nt, Homo sapiens
acagucacaugccc

SEQ ID NO: 1157915 - RNA, 22 nt, Homo sapiens
acagucacaugcccauucacac

SEQ ID NO: 1157916 - RNA, 23 nt, Homo sapiens
acagucauuaauuuucaacucaa

SEQ ID NO: 1157917 - RNA, 18 nt, Homo sapiens
acagugaaggcuguccuu

SEQ ID NO: 1157918 - RNA, 17 nt, Homo sapiens
acagugacacuggacca

SEQ ID NO: 1157919 - RNA, 19 nt, Homo sapiens
acagugauauacuuacuca

SEQ ID NO: 1157920 - RNA, 15 nt, Homo sapiens
acagugcacaugaac

SEQ ID NO: 1157921 - RNA, 17 nt, Homo sapiens
acagugcagugcgcugu

SEQ ID NO: 1157922 - RNA, 17 nt, Homo sapiens
acagugccgacagcucu

SEQ ID NO: 1157923 - RNA, 20 nt, Homo sapiens
acagugccgacagcucucca

SEQ ID NO: 1157924 - RNA, 20 nt, Homo sapiens
acaguggcuucaagaguccu

SEQ ID NO: 1157925 - RNA, 13 nt, Homo sapiens
acaguggggccag

SEQ ID NO: 1157926 - RNA, 23 nt, Homo sapiens
acaguguuggagguuaaggcaua

SEQ ID NO: 1157927 - RNA, 20 nt, Homo sapiens
acaguguuuuguagauuuca

SEQ ID NO: 1157928 - RNA, 23 nt, Homo sapiens
acaguucuaggugcuaaaauuca

SEQ ID NO: 1157929 - RNA, 17 nt, Homo sapiens
acaguucuuugggccag

SEQ ID NO: 1157930 - RNA, 13 nt, Homo sapiens
acaguugcauaga

SEQ ID NO: 1157931 - RNA, 17 nt, Homo sapiens
acaguuuacuuugccaa

SEQ ID NO: 1157932 - RNA, 20 nt, Homo sapiens
acaguuuauaaagccaagaa

SEQ ID NO: 1157933 - RNA, 20 nt, Homo sapiens
acaguuuggauguccucaaa

SEQ ID NO: 1157934 - RNA, 20 nt, Homo sapiens
acaguuugugcucuacuguu

SEQ ID NO: 1157935 - RNA, 13 nt, Homo sapiens
acauaauugauua

SEQ ID NO: 1157936 - RNA, 13 nt, Homo sapiens
acauaauugugac

SEQ ID NO: 1157937 - RNA, 16 nt, Homo sapiens
acauaauuuaauuccu

SEQ ID NO: 1157938 - RNA, 23 nt, Homo sapiens
acauacauugauucaugucucac

SEQ ID NO: 1157939 - RNA, 17 nt, Homo sapiens
acauaccacauggacag

SEQ ID NO: 1157940 - RNA, 15 nt, Homo sapiens
acauacgucuuucac

SEQ ID NO: 1157941 - RNA, 20 nt, Homo sapiens
acauacuauauaagccagug

SEQ ID NO: 1157942 - RNA, 14 nt, Homo sapiens
acauagacugaaga

SEQ ID NO: 1157943 - RNA, 14 nt, Homo sapiens
acauagcaaauuaa

SEQ ID NO: 1157944 - RNA, 16 nt, Homo sapiens
acauauaaaauaaugc

SEQ ID NO: 1157945 - RNA, 14 nt, Homo sapiens
acauauacacacac

SEQ ID NO: 1157946 - RNA, 13 nt, Homo sapiens
acauauagcugau

SEQ ID NO: 1157947 - RNA, 21 nt, Homo sapiens
acauauagcugauaaagccua

SEQ ID NO: 1157948 - RNA, 20 nt, Homo sapiens
acauauggacucugcacaug

SEQ ID NO: 1157949 - RNA, 14 nt, Homo sapiens
acauaugugcagaa

SEQ ID NO: 1157950 - RNA, 20 nt, Homo sapiens
acauauguuaauaaacugca

SEQ ID NO: 1157951 - RNA, 14 nt, Homo sapiens
acauauuaagaaua

SEQ ID NO: 1157952 - RNA, 10 nt, Homo sapiens
acaucaaaga

SEQ ID NO: 1157953 - RNA, 14 nt, Homo sapiens
acaucaagcaucau

SEQ ID NO: 1157954 - RNA, 19 nt, Homo sapiens
acaucacucucaccuucca

SEQ ID NO: 1157955 - RNA, 19 nt, Homo sapiens
acaucaggagacugggcuc

SEQ ID NO: 1157956 - RNA, 22 nt, Homo sapiens
acaucauuagaacaaaggacag

SEQ ID NO: 1157957 - RNA, 17 nt, Homo sapiens
acauccaaaauaguuaa

SEQ ID NO: 1157958 - RNA, 19 nt, Homo sapiens
acauccgcgugugccugug

SEQ ID NO: 1157959 - RNA, 16 nt, Homo sapiens
acauccugugccucca

SEQ ID NO: 1157960 - RNA, 18 nt, Homo sapiens
acauccugugccuccauc

SEQ ID NO: 1157961 - RNA, 21 nt, Homo sapiens
acaucgaggcucuugcucaag

SEQ ID NO: 1157962 - RNA, 22 nt, Homo sapiens
acaucucaaggguuaaccagac

SEQ ID NO: 1157963 - RNA, 21 nt, Homo sapiens
acaucuccuguggucucugac

SEQ ID NO: 1157964 - RNA, 18 nt, Homo sapiens
acaucucugucaguguga

SEQ ID NO: 1157965 - RNA, 18 nt, Homo sapiens
acaucugagagaugacag

SEQ ID NO: 1157966 - RNA, 18 nt, Homo sapiens
acaucugggugcccugaa

SEQ ID NO: 1157967 - RNA, 15 nt, Homo sapiens
acaugaaaacauuga

SEQ ID NO: 1157968 - RNA, 12 nt, Homo sapiens
acaugacuguuu

SEQ ID NO: 1157969 - RNA, 13 nt, Homo sapiens
acaugcaccuacc

SEQ ID NO: 1157970 - RNA, 13 nt, Homo sapiens
acaugcacucagc

SEQ ID NO: 1157971 - RNA, 14 nt, Homo sapiens
acaugcacucagcu

SEQ ID NO: 1157972 - RNA, 16 nt, Homo sapiens
acaugcagcucugcag

SEQ ID NO: 1157973 - RNA, 19 nt, Homo sapiens
acaugcccacaacuuguca

SEQ ID NO: 1157974 - RNA, 15 nt, Homo sapiens
acaugcccauucaca

SEQ ID NO: 1157975 - RNA, 17 nt, Homo sapiens
acaugcccuguguggcu

SEQ ID NO: 1157976 - RNA, 19 nt, Homo sapiens
acaugccugggauugggaa

SEQ ID NO: 1157977 - RNA, 14 nt, Homo sapiens
acaugccuucacuc

SEQ ID NO: 1157978 - RNA, 17 nt, Homo sapiens
acaugcgguagccagca

SEQ ID NO: 1157979 - RNA, 18 nt, Homo sapiens
acaugcuucaauaguuca

SEQ ID NO: 1157980 - RNA, 16 nt, Homo sapiens
acaugcuucagugcug

SEQ ID NO: 1157981 - RNA, 15 nt, Homo sapiens
acauggcagagcagu

SEQ ID NO: 1157982 - RNA, 24 nt, Homo sapiens
acauggcuaaauacaauggguauc

SEQ ID NO: 1157983 - RNA, 17 nt, Homo sapiens
acaugggaaggugccac

SEQ ID NO: 1157984 - RNA, 23 nt, Homo sapiens
acaugggcugugauuacugcaau

SEQ ID NO: 1157985 - RNA, 17 nt, Homo sapiens
acaugguccaugucuau

SEQ ID NO: 1157986 - RNA, 18 nt, Homo sapiens
acaugguggcaugcaccu

SEQ ID NO: 1157987 - RNA, 22 nt, Homo sapiens
acaugguugugagucuugacaa

SEQ ID NO: 1157988 - RNA, 19 nt, Homo sapiens
acauguaacgaaacacuuc

SEQ ID NO: 1157989 - RNA, 22 nt, Homo sapiens
acauguguagccugugcaugua

SEQ ID NO: 1157990 - RNA, 18 nt, Homo sapiens
acauguucucaugcaugu

SEQ ID NO: 1157991 - RNA, 17 nt, Homo sapiens
acauguuuucuagccuu

SEQ ID NO: 1157992 - RNA, 20 nt, Homo sapiens
acauuaaaauaaaccaaaua

SEQ ID NO: 1157993 - RNA, 16 nt, Homo sapiens
acauuaaacacacuua

SEQ ID NO: 1157994 - RNA, 18 nt, Homo sapiens
acauuaagagaacaaaga

SEQ ID NO: 1157995 - RNA, 18 nt, Homo sapiens
acauuaaugagaauuccu

SEQ ID NO: 1157996 - RNA, 12 nt, Homo sapiens
acauuacaauca

SEQ ID NO: 1157997 - RNA, 18 nt, Homo sapiens
acauuagauugaugugca

SEQ ID NO: 1157998 - RNA, 14 nt, Homo sapiens
acauuagucauuca

SEQ ID NO: 1157999 - RNA, 14 nt, Homo sapiens
acauucacacuggg

SEQ ID NO: 1158000 - RNA, 14 nt, Homo sapiens
acauucagggcuau

SEQ ID NO: 1158001 - RNA, 18 nt, Homo sapiens
acauucagugauaaagcu

SEQ ID NO: 1158002 - RNA, 14 nt, Homo sapiens
acauucccacugcc

SEQ ID NO: 1158003 - RNA, 20 nt, Homo sapiens
acauuccucagaaaccaaag

SEQ ID NO: 1158004 - RNA, 21 nt, Homo sapiens
acauucugcauacuaaccuau

SEQ ID NO: 1158005 - RNA, 18 nt, Homo sapiens
acauucugggcugacuca

SEQ ID NO: 1158006 - RNA, 12 nt, Homo sapiens
acauucuuggcu

SEQ ID NO: 1158007 - RNA, 16 nt, Homo sapiens
acauugaaaacagaua

SEQ ID NO: 1158008 - RNA, 21 nt, Homo sapiens
acauugaggaccucauccaaa

SEQ ID NO: 1158009 - RNA, 14 nt, Homo sapiens
acauugauucaugu

SEQ ID NO: 1158010 - RNA, 18 nt, Homo sapiens
acauugauucaugucuca

SEQ ID NO: 1158011 - RNA, 18 nt, Homo sapiens
acauuggcaaguguaaaa

SEQ ID NO: 1158012 - RNA, 22 nt, Homo sapiens
acauuggcaccuaauccaggca

SEQ ID NO: 1158013 - RNA, 17 nt, Homo sapiens
acauuuaauacagauaa

SEQ ID NO: 1158014 - RNA, 22 nt, Homo sapiens
acauuuacauguauuauuucau

SEQ ID NO: 1158015 - RNA, 15 nt, Homo sapiens
acauuuagaugcacu

SEQ ID NO: 1158016 - RNA, 20 nt, Homo sapiens
acauuuagaugcacuaccau

SEQ ID NO: 1158017 - RNA, 15 nt, Homo sapiens
acauuuagucuuccu

SEQ ID NO: 1158018 - RNA, 13 nt, Homo sapiens
acauuucaccaug

SEQ ID NO: 1158019 - RNA, 20 nt, Homo sapiens
acauuucaccccaggcucaa

SEQ ID NO: 1158020 - RNA, 13 nt, Homo sapiens
acauuuccaugca

SEQ ID NO: 1158021 - RNA, 16 nt, Homo sapiens
acauuucuaaaccaga

SEQ ID NO: 1158022 - RNA, 14 nt, Homo sapiens
acauuugcuggaga

SEQ ID NO: 1158023 - RNA, 22 nt, Homo sapiens
acauuuguauuuugugaugaau

SEQ ID NO: 1158024 - RNA, 23 nt, Homo sapiens
acauuuguuuguauucauguuca

SEQ ID NO: 1158025 - RNA, 16 nt, Homo sapiens
acauuuuaaaugaaag

SEQ ID NO: 1158026 - RNA, 22 nt, Homo sapiens
acauuuuauuuuuucuugcaaa

SEQ ID NO: 1158027 - RNA, 16 nt, Homo sapiens
acauuuugcucuguga

SEQ ID NO: 1158028 - RNA, 12 nt, Homo sapiens
acauuuugugac

SEQ ID NO: 1158029 - RNA, 22 nt, Homo sapiens
acauuuuguuuauguuacuuaa

SEQ ID NO: 1158030 - RNA, 20 nt, Homo sapiens
acauuuuuccucucugcaaa

SEQ ID NO: 1158031 - RNA, 15 nt, Homo sapiens
acauuuuuuaccaaa

SEQ ID NO: 1158032 - RNA, 21 nt, Homo sapiens
acauuuuuucagucauauaaa

SEQ ID NO: 1158033 - RNA, 13 nt, Homo sapiens
accaaaaccacag

SEQ ID NO: 1158034 - RNA, 22 nt, Homo sapiens
accaaacaggaaguggacauuc

SEQ ID NO: 1158035 - RNA, 18 nt, Homo sapiens
accaaagcuuuauuucaa

SEQ ID NO: 1158036 - RNA, 13 nt, Homo sapiens
accaaaugaauuu

SEQ ID NO: 1158037 - RNA, 21 nt, Homo sapiens
accaaauucuauacauguaua

SEQ ID NO: 1158038 - RNA, 17 nt, Homo sapiens
accaaccccgcggccca

SEQ ID NO: 1158039 - RNA, 22 nt, Homo sapiens
accaaccuagccaacaugguga

SEQ ID NO: 1158040 - RNA, 17 nt, Homo sapiens
accaacucuugcucuca

SEQ ID NO: 1158041 - RNA, 15 nt, Homo sapiens
accaacuguacaaaa

SEQ ID NO: 1158042 - RNA, 14 nt, Homo sapiens
accaagaucuccaa

SEQ ID NO: 1158043 - RNA, 15 nt, Homo sapiens
aggcuuuaugauaau

SEQ ID NO: 1158044 - RNA, 13 nt, Homo sapiens
aggcuuucagcuu

SEQ ID NO: 1158045 - RNA, 18 nt, Homo sapiens
agggaaauaugcuuucau

SEQ ID NO: 1158046 - RNA, 12 nt, Homo sapiens
agggaacauauu

SEQ ID NO: 1158047 - RNA, 14 nt, Homo sapiens
agggacccaaagca

SEQ ID NO: 1158048 - RNA, 17 nt, Homo sapiens
agggaccccugcccuug

SEQ ID NO: 1158049 - RNA, 17 nt, Homo sapiens
agggaccuugucuccca

SEQ ID NO: 1158050 - RNA, 16 nt, Homo sapiens
agggacgccugggggu

SEQ ID NO: 1158051 - RNA, 16 nt, Homo sapiens
agggacggcuguggga

SEQ ID NO: 1158052 - RNA, 15 nt, Homo sapiens
agggacugagccaga

SEQ ID NO: 1158053 - RNA, 13 nt, Homo sapiens
agggacuggcaca

SEQ ID NO: 1158054 - RNA, 23 nt, Homo sapiens
agggacuucacgaaguguugcau

SEQ ID NO: 1158055 - RNA, 14 nt, Homo sapiens
agggaggcacuucc

SEQ ID NO: 1158056 - RNA, 12 nt, Homo sapiens
agggaggcucag

SEQ ID NO: 1158057 - RNA, 23 nt, Homo sapiens
agggagggcgugaggucuugcag

SEQ ID NO: 1158058 - RNA, 16 nt, Homo sapiens
agggagggcugucauc

SEQ ID NO: 1158059 - RNA, 18 nt, Homo sapiens
agggaguuacugaagucu

SEQ ID NO: 1158060 - RNA, 16 nt, Homo sapiens
agggaugaugugguuu

SEQ ID NO: 1158061 - RNA, 18 nt, Homo sapiens
agggcacagcaucuguag

SEQ ID NO: 1158062 - RNA, 15 nt, Homo sapiens
agggcacuggagcug

SEQ ID NO: 1158063 - RNA, 12 nt, Homo sapiens
agggcagcacug

SEQ ID NO: 1158064 - RNA, 17 nt, Homo sapiens
agggcaguggcuucuuu

SEQ ID NO: 1158065 - RNA, 14 nt, Homo sapiens
agggccacauggga

SEQ ID NO: 1158066 - RNA, 12 nt, Homo sapiens
agggccaggugc

SEQ ID NO: 1158067 - RNA, 23 nt, Homo sapiens
agggccgucaaggaaagggcagu

SEQ ID NO: 1158068 - RNA, 17 nt, Homo sapiens
agggcgcaaagggcaug

SEQ ID NO: 1158069 - RNA, 14 nt, Homo sapiens
agggcgccuagucc

SEQ ID NO: 1158070 - RNA, 15 nt, Homo sapiens
agggcucagggcagu

SEQ ID NO: 1158071 - RNA, 16 nt, Homo sapiens
agggcucccugccauu

SEQ ID NO: 1158072 - RNA, 17 nt, Homo sapiens
aggggaaggaagagaga

SEQ ID NO: 1158073 - RNA, 17 nt, Homo sapiens
aggggaggaacagggaa

SEQ ID NO: 1158074 - RNA, 15 nt, Homo sapiens
aggggaguaggggug

SEQ ID NO: 1158075 - RNA, 16 nt, Homo sapiens
aggggcacuucauuga

SEQ ID NO: 1158076 - RNA, 22 nt, Homo sapiens
aggggcugccgagugcugugca

SEQ ID NO: 1158077 - RNA, 23 nt, Homo sapiens
aggggcuguugaauuucccacau

SEQ ID NO: 1158078 - RNA, 19 nt, Homo sapiens
aggggcuuaaaagaaacua

SEQ ID NO: 1158079 - RNA, 17 nt, Homo sapiens
agggggaaggcugcaaa

SEQ ID NO: 1158080 - RNA, 20 nt, Homo sapiens
agggggagcaaaucgugccu

SEQ ID NO: 1158081 - RNA, 20 nt, Homo sapiens
agggggccaggcgguggcuu

SEQ ID NO: 1158082 - RNA, 19 nt, Homo sapiens
agggguccccaacauggau

SEQ ID NO: 1158083 - RNA, 14 nt, Homo sapiens
aggggugacacaga

SEQ ID NO: 1158084 - RNA, 16 nt, Homo sapiens
aggggugauggaugau

SEQ ID NO: 1158085 - RNA, 14 nt, Homo sapiens
aggggugugcugag

SEQ ID NO: 1158086 - RNA, 23 nt, Homo sapiens
aggguauauuuuugauaccuuca

SEQ ID NO: 1158087 - RNA, 19 nt, Homo sapiens
aggguccucaguccacugc

SEQ ID NO: 1158088 - RNA, 20 nt, Homo sapiens
aggguccucaguccacugcu

SEQ ID NO: 1158089 - RNA, 20 nt, Homo sapiens
aggguccuuuaguaccugaa

SEQ ID NO: 1158090 - RNA, 19 nt, Homo sapiens
agggucgggggagcaaaag

SEQ ID NO: 1158091 - RNA, 13 nt, Homo sapiens
agggucuuucaug

SEQ ID NO: 1158092 - RNA, 15 nt, Homo sapiens
agggugagaugaagu

SEQ ID NO: 1158093 - RNA, 15 nt, Homo sapiens
agggugagugcaagg

SEQ ID NO: 1158094 - RNA, 11 nt, Homo sapiens
agggugcuagu

SEQ ID NO: 1158095 - RNA, 23 nt, Homo sapiens
aggguggcuggguccaggggaug

SEQ ID NO: 1158096 - RNA, 20 nt, Homo sapiens
agggugggauuaaguacaag

SEQ ID NO: 1158097 - RNA, 11 nt, Homo sapiens
agggugguggc

SEQ ID NO: 1158098 - RNA, 14 nt, Homo sapiens
agguaaaagcauca

SEQ ID NO: 1158099 - RNA, 16 nt, Homo sapiens
agguaaaaugccauga

SEQ ID NO: 1158100 - RNA, 19 nt, Homo sapiens
agguaacuagcugagcacu

SEQ ID NO: 1158101 - RNA, 12 nt, Homo sapiens
agguaauggcau

SEQ ID NO: 1158102 - RNA, 13 nt, Homo sapiens
agguacauuggaa

SEQ ID NO: 1158103 - RNA, 13 nt, Homo sapiens
agguacccugcca

SEQ ID NO: 1158104 - RNA, 20 nt, Homo sapiens
agguagcugccccuggcucu

SEQ ID NO: 1158105 - RNA, 20 nt, Homo sapiens
agguauauaaauuuucccaa

SEQ ID NO: 1158106 - RNA, 21 nt, Homo sapiens
agguaucugguaucugcaugu

SEQ ID NO: 1158107 - RNA, 16 nt, Homo sapiens
aggucagcacaagaua

SEQ ID NO: 1158108 - RNA, 13 nt, Homo sapiens
aggucagggguga

SEQ ID NO: 1158109 - RNA, 11 nt, Homo sapiens
aggucauggcc

SEQ ID NO: 1158110 - RNA, 16 nt, Homo sapiens
aggucauuacuaacca

SEQ ID NO: 1158111 - RNA, 16 nt, Homo sapiens
aggucauuacucucaa

SEQ ID NO: 1158112 - RNA, 23 nt, Homo sapiens
agguccagcuuuacuguggcugu

SEQ ID NO: 1158113 - RNA, 18 nt, Homo sapiens
agguccgguguucuaaga

SEQ ID NO: 1158114 - RNA, 23 nt, Homo sapiens
agguccugcuccgcugccuggaa

SEQ ID NO: 1158115 - RNA, 21 nt, Homo sapiens
aggucucgucccagcccuccc

SEQ ID NO: 1158116 - RNA, 20 nt, Homo sapiens
aggucugcucugcuccugaa

SEQ ID NO: 1158117 - RNA, 17 nt, Homo sapiens
aggucuggaguuugaga

SEQ ID NO: 1158118 - RNA, 20 nt, Homo sapiens
aggucugguuuauuucccag

SEQ ID NO: 1158119 - RNA, 21 nt, Homo sapiens
aggucuguggaaaguggugca

SEQ ID NO: 1158120 - RNA, 20 nt, Homo sapiens
aggucuuuuacauacaguga

SEQ ID NO: 1158121 - RNA, 21 nt, Homo sapiens
aggucuuuuacauacagugau

SEQ ID NO: 1158122 - RNA, 23 nt, Homo sapiens
aggugaaacccagucacugugag

SEQ ID NO: 1158123 - RNA, 20 nt, Homo sapiens
aggugaaaugaagcaacaga

SEQ ID NO: 1158124 - RNA, 21 nt, Homo sapiens
aggugaacaagcaaacccaga

SEQ ID NO: 1158125 - RNA, 16 nt, Homo sapiens
aggugaacgcacuuau

SEQ ID NO: 1158126 - RNA, 22 nt, Homo sapiens
aggugacaaaaggcagaaggag

SEQ ID NO: 1158127 - RNA, 15 nt, Homo sapiens
aggugaguucucacu

SEQ ID NO: 1158128 - RNA, 16 nt, Homo sapiens
aggugauuccagugaa

SEQ ID NO: 1158129 - RNA, 15 nt, Homo sapiens
aggugcagcuccuca

SEQ ID NO: 1158130 - RNA, 17 nt, Homo sapiens
agguggcacuagggauc

SEQ ID NO: 1158131 - RNA, 13 nt, Homo sapiens
aggugucauccac

SEQ ID NO: 1158132 - RNA, 21 nt, Homo sapiens
aggugucuggccugaggucaa

SEQ ID NO: 1158133 - RNA, 21 nt, Homo sapiens
agguuaggaaggcagcauucc

SEQ ID NO: 1158134 - RNA, 17 nt, Homo sapiens
agguuagggcucugccc

SEQ ID NO: 1158135 - RNA, 17 nt, Homo sapiens
agguuagugacauuuaa

SEQ ID NO: 1158136 - RNA, 11 nt, Homo sapiens
agguucaagac

SEQ ID NO: 1158137 - RNA, 13 nt, Homo sapiens
agguucaguauua

SEQ ID NO: 1158138 - RNA, 16 nt, Homo sapiens
agguucuaaaguucua

SEQ ID NO: 1158139 - RNA, 20 nt, Homo sapiens
agguucuagguuucaaagau

SEQ ID NO: 1158140 - RNA, 14 nt, Homo sapiens
agguucuuccugcc

SEQ ID NO: 1158141 - RNA, 18 nt, Homo sapiens
agguugagcucuucuuaa

SEQ ID NO: 1158142 - RNA, 17 nt, Homo sapiens
agguuggccuuacuguu

SEQ ID NO: 1158143 - RNA, 19 nt, Homo sapiens
agguuggugaauuucacaa

SEQ ID NO: 1158144 - RNA, 18 nt, Homo sapiens
agguuuauagaaagauag

SEQ ID NO: 1158145 - RNA, 15 nt, Homo sapiens
agguuucaccaugau

SEQ ID NO: 1158146 - RNA, 21 nt, Homo sapiens
agguuuuuuugucaacauugu

SEQ ID NO: 1158147 - RNA, 21 nt, Homo sapiens
aguaaaaagcuuacuaaagca

SEQ ID NO: 1158148 - RNA, 13 nt, Homo sapiens
aguaaaacacaga

SEQ ID NO: 1158149 - RNA, 13 nt, Homo sapiens
aguaaacacaggg

SEQ ID NO: 1158150 - RNA, 14 nt, Homo sapiens
aguaaacacaggga

SEQ ID NO: 1158151 - RNA, 12 nt, Homo sapiens
aguaaacugugc

SEQ ID NO: 1158152 - RNA, 22 nt, Homo sapiens
aguaaagcccagaucucugcau

SEQ ID NO: 1158153 - RNA, 21 nt, Homo sapiens
aguaaagccguuguuuacuua

SEQ ID NO: 1158154 - RNA, 19 nt, Homo sapiens
aguaaaguuguuguaaaaa

SEQ ID NO: 1158155 - RNA, 22 nt, Homo sapiens
aguaaauaucccaaacugugau

SEQ ID NO: 1158156 - RNA, 20 nt, Homo sapiens
aguaacucagugaaggccca

SEQ ID NO: 1158157 - RNA, 14 nt, Homo sapiens
aguaagacgugaaa

SEQ ID NO: 1158158 - RNA, 19 nt, Homo sapiens
aguaauauagcugagacua

SEQ ID NO: 1158159 - RNA, 18 nt, Homo sapiens
aguaaucuguaagcauaa

SEQ ID NO: 1158160 - RNA, 21 nt, Homo sapiens
aguaaucuuuggcuguaaggc

SEQ ID NO: 1158161 - RNA, 16 nt, Homo sapiens
aguaaugccacacauu

SEQ ID NO: 1158162 - RNA, 17 nt, Homo sapiens
aguaauuauuuucuucc

SEQ ID NO: 1158163 - RNA, 21 nt, Homo sapiens
aguaauuauuuucuuccuuuc

SEQ ID NO: 1158164 - RNA, 15 nt, Homo sapiens
aguacacagauaccu

SEQ ID NO: 1158165 - RNA, 17 nt, Homo sapiens
aguacacagcugagcaa

SEQ ID NO: 1158166 - RNA, 17 nt, Homo sapiens
aguacaccccaacagca

SEQ ID NO: 1158167 - RNA, 15 nt, Homo sapiens
aguacagacgucuca

SEQ ID NO: 1158168 - RNA, 16 nt, Homo sapiens
aguacagacgucucaa

SEQ ID NO: 1158169 - RNA, 17 nt, Homo sapiens
aguacauaauacacuug

SEQ ID NO: 1158170 - RNA, 12 nt, Homo sapiens
aguacauugugc

SEQ ID NO: 1158171 - RNA, 20 nt, Homo sapiens
aguaccuuguuuugccaugu

SEQ ID NO: 1158172 - RNA, 22 nt, Homo sapiens
aguaccuuuccauuuauucuuu

SEQ ID NO: 1158173 - RNA, 19 nt, Homo sapiens
aguacucacuuuucacuug

SEQ ID NO: 1158174 - RNA, 20 nt, Homo sapiens
aguacuugacuaccuacugg

SEQ ID NO: 1158175 - RNA, 19 nt, Homo sapiens
aguagagacgggguuucau

SEQ ID NO: 1158176 - RNA, 22 nt, Homo sapiens
auaggggagccugugguggccu

SEQ ID NO: 1158177 - RNA, 18 nt, Homo sapiens
auaguaaaaccaaccagc

SEQ ID NO: 1158178 - RNA, 19 nt, Homo sapiens
auaguaaaaccaaccagcu

SEQ ID NO: 1158179 - RNA, 14 nt, Homo sapiens
auaguaaacacagg

SEQ ID NO: 1158180 - RNA, 18 nt, Homo sapiens
auaguaaacacagggaag

SEQ ID NO: 1158181 - RNA, 16 nt, Homo sapiens
auaguaacaucaaaga

SEQ ID NO: 1158182 - RNA, 18 nt, Homo sapiens
auagucaauuucuacuuc

SEQ ID NO: 1158183 - RNA, 21 nt, Homo sapiens
auagugagaccuuggcgcuac

SEQ ID NO: 1158184 - RNA, 20 nt, Homo sapiens
auagugagauuuaaguuccu

SEQ ID NO: 1158185 - RNA, 18 nt, Homo sapiens
auagugcuucuuguaaua

SEQ ID NO: 1158186 - RNA, 21 nt, Homo sapiens
auaguucuagacauggagguu

SEQ ID NO: 1158187 - RNA, 14 nt, Homo sapiens
auaguuuaccugaa

SEQ ID NO: 1158188 - RNA, 19 nt, Homo sapiens
auaguuucacccugcacua

SEQ ID NO: 1158189 - RNA, 20 nt, Homo sapiens
auaguuuuuagucuguguag

SEQ ID NO: 1158190 - RNA, 22 nt, Homo sapiens
auauaaaccgugugucauguca

SEQ ID NO: 1158191 - RNA, 17 nt, Homo sapiens
auauaaaguaccgcuua

SEQ ID NO: 1158192 - RNA, 16 nt, Homo sapiens
auauaaggaaagcaau

SEQ ID NO: 1158193 - RNA, 20 nt, Homo sapiens
auauaauaugcacacagugc

SEQ ID NO: 1158194 - RNA, 14 nt, Homo sapiens
auauaauuuauuga

SEQ ID NO: 1158195 - RNA, 15 nt, Homo sapiens
auauacaaagggaua

SEQ ID NO: 1158196 - RNA, 10 nt, Homo sapiens
auauacaaau

SEQ ID NO: 1158197 - RNA, 15 nt, Homo sapiens
auauacaauauaaca

SEQ ID NO: 1158198 - RNA, 14 nt, Homo sapiens
auauaccuuacuga

SEQ ID NO: 1158199 - RNA, 18 nt, Homo sapiens
auauaccuuuuguuacca

SEQ ID NO: 1158200 - RNA, 16 nt, Homo sapiens
auauagacaccaagga

SEQ ID NO: 1158201 - RNA, 13 nt, Homo sapiens
auauauacacaca

SEQ ID NO: 1158202 - RNA, 14 nt, Homo sapiens
auauauacacacac

SEQ ID NO: 1158203 - RNA, 14 nt, Homo sapiens
auauauacuggaag

SEQ ID NO: 1158204 - RNA, 14 nt, Homo sapiens
auauauauuacaag

SEQ ID NO: 1158205 - RNA, 19 nt, Homo sapiens
auauauauuuuugugcaca

SEQ ID NO: 1158206 - RNA, 20 nt, Homo sapiens
auauauauuuuugugcacau

SEQ ID NO: 1158207 - RNA, 13 nt, Homo sapiens
auauauccaagaa

SEQ ID NO: 1158208 - RNA, 20 nt, Homo sapiens
auauauggggcuuuagcaag

SEQ ID NO: 1158209 - RNA, 20 nt, Homo sapiens
auauauguguuuuucacauu

SEQ ID NO: 1158210 - RNA, 16 nt, Homo sapiens
auauauuaaauuugaa

SEQ ID NO: 1158211 - RNA, 13 nt, Homo sapiens
auauauuccacca

SEQ ID NO: 1158212 - RNA, 15 nt, Homo sapiens
auauauuuaacaugu

SEQ ID NO: 1158213 - RNA, 22 nt, Homo sapiens
auauauuuuuaaaaaucuaccu

SEQ ID NO: 1158214 - RNA, 13 nt, Homo sapiens
auaucaacacuug

SEQ ID NO: 1158215 - RNA, 20 nt, Homo sapiens
auaucaauauugggccuaaa

SEQ ID NO: 1158216 - RNA, 23 nt, Homo sapiens
auaucacaauuuacgaaaccaaa

SEQ ID NO: 1158217 - RNA, 18 nt, Homo sapiens
auaucaguccucuuucaa

SEQ ID NO: 1158218 - RNA, 13 nt, Homo sapiens
auaucagugacag

SEQ ID NO: 1158219 - RNA, 13 nt, Homo sapiens
auaucauaaauac

SEQ ID NO: 1158220 - RNA, 15 nt, Homo sapiens
auaucauacuuccau

SEQ ID NO: 1158221 - RNA, 16 nt, Homo sapiens
auauccaguggaugga

SEQ ID NO: 1158222 - RNA, 16 nt, Homo sapiens
auaucucuccagcugu

SEQ ID NO: 1158223 - RNA, 13 nt, Homo sapiens
auaucucuugccc

SEQ ID NO: 1158224 - RNA, 21 nt, Homo sapiens
auaucuuuuguaagacauuuc

SEQ ID NO: 1158225 - RNA, 20 nt, Homo sapiens
auaugaaacucuacauuuaa

SEQ ID NO: 1158226 - RNA, 20 nt, Homo sapiens
auaugaaauaaaauuacaca

SEQ ID NO: 1158227 - RNA, 12 nt, Homo sapiens
auaugacucaga

SEQ ID NO: 1158228 - RNA, 12 nt, Homo sapiens
auaugacugcau

SEQ ID NO: 1158229 - RNA, 14 nt, Homo sapiens
auaugauucccuuu

SEQ ID NO: 1158230 - RNA, 19 nt, Homo sapiens
auaugauuuauauuacugu

SEQ ID NO: 1158231 - RNA, 19 nt, Homo sapiens
auaugcaccccuggaacca

SEQ ID NO: 1158232 - RNA, 18 nt, Homo sapiens
auaugcaccuugugucug

SEQ ID NO: 1158233 - RNA, 19 nt, Homo sapiens
auaugcacuuauucucaag

SEQ ID NO: 1158234 - RNA, 19 nt, Homo sapiens
auaugcauugucugcaaug

SEQ ID NO: 1158235 - RNA, 18 nt, Homo sapiens
auaugccuuuuugaagca

SEQ ID NO: 1158236 - RNA, 13 nt, Homo sapiens
auauggacacugu

SEQ ID NO: 1158237 - RNA, 15 nt, Homo sapiens
auauggacacuguga

SEQ ID NO: 1158238 - RNA, 15 nt, Homo sapiens
auauguacuugucaa

SEQ ID NO: 1158239 - RNA, 16 nt, Homo sapiens
auauguauauauguau

SEQ ID NO: 1158240 - RNA, 20 nt, Homo sapiens
auaugugaagaaaaauguau

SEQ ID NO: 1158241 - RNA, 12 nt, Homo sapiens
auaugugucagu

SEQ ID NO: 1158242 - RNA, 15 nt, Homo sapiens
auauguucacaguua

SEQ ID NO: 1158243 - RNA, 13 nt, Homo sapiens
auauguugcuaua

SEQ ID NO: 1158244 - RNA, 16 nt, Homo sapiens
auauguuggaaaaaag

SEQ ID NO: 1158245 - RNA, 21 nt, Homo sapiens
auauguuuuccuuuuauucac

SEQ ID NO: 1158246 - RNA, 22 nt, Homo sapiens
auauguuuuuaaagguggauuu

SEQ ID NO: 1158247 - RNA, 19 nt, Homo sapiens
auauuaggagacacaggga

SEQ ID NO: 1158248 - RNA, 21 nt, Homo sapiens
auauuaggagacacagggaag

SEQ ID NO: 1158249 - RNA, 14 nt, Homo sapiens
auauuagggaguaa

SEQ ID NO: 1158250 - RNA, 15 nt, Homo sapiens
auauuaucuaccugu

SEQ ID NO: 1158251 - RNA, 20 nt, Homo sapiens
auauuauuauuaauuuugcc

SEQ ID NO: 1158252 - RNA, 15 nt, Homo sapiens
auauucaacucauaa

SEQ ID NO: 1158253 - RNA, 17 nt, Homo sapiens
auauucacuaaggacuu

SEQ ID NO: 1158254 - RNA, 22 nt, Homo sapiens
auauucacuuucauuuuugaca

SEQ ID NO: 1158255 - RNA, 13 nt, Homo sapiens
auauucagaauua

SEQ ID NO: 1158256 - RNA, 20 nt, Homo sapiens
auauucauguaccugugauc

SEQ ID NO: 1158257 - RNA, 16 nt, Homo sapiens
auauuccuuugaagau

SEQ ID NO: 1158258 - RNA, 22 nt, Homo sapiens
auauucuuuaaauuucaucuca

SEQ ID NO: 1158259 - RNA, 12 nt, Homo sapiens
auauucuuucaa

SEQ ID NO: 1158260 - RNA, 16 nt, Homo sapiens
auauugaaguacuugc

SEQ ID NO: 1158261 - RNA, 20 nt, Homo sapiens
auauugcagcuuauauucau

SEQ ID NO: 1158262 - RNA, 14 nt, Homo sapiens
auauuggaaugcac

SEQ ID NO: 1158263 - RNA, 22 nt, Homo sapiens
auauugggccuaaaacaguauu

SEQ ID NO: 1158264 - RNA, 16 nt, Homo sapiens
auauugugaacauuug

SEQ ID NO: 1158265 - RNA, 23 nt, Homo sapiens
auauuguucuuguaagcuuuaac

SEQ ID NO: 1158266 - RNA, 13 nt, Homo sapiens
auauuuaucugau

SEQ ID NO: 1158267 - RNA, 19 nt, Homo sapiens
auauuuauuuaacuauuca

SEQ ID NO: 1158268 - RNA, 19 nt, Homo sapiens
auauuuccuucaccaccuc

SEQ ID NO: 1158269 - RNA, 17 nt, Homo sapiens
auauuucuugcuuucaa

SEQ ID NO: 1158270 - RNA, 19 nt, Homo sapiens
auauuugggccugcuccag

SEQ ID NO: 1158271 - RNA, 23 nt, Homo sapiens
auauuuuaagaauuucacaagcu

SEQ ID NO: 1158272 - RNA, 16 nt, Homo sapiens
auauuuuauuaucuua

SEQ ID NO: 1158273 - RNA, 14 nt, Homo sapiens
auauuuuauuuccu

SEQ ID NO: 1158274 - RNA, 22 nt, Homo sapiens
auauuuucagcaaaacuuucca

SEQ ID NO: 1158275 - RNA, 19 nt, Homo sapiens
auauuuugaaaugaacuuu

SEQ ID NO: 1158276 - RNA, 18 nt, Homo sapiens
auauuuuguuuugugcag

SEQ ID NO: 1158277 - RNA, 21 nt, Homo sapiens
auauuuuuauucaaacuaccu

SEQ ID NO: 1158278 - RNA, 14 nt, Homo sapiens
aucaaaauugccuu

SEQ ID NO: 1158279 - RNA, 20 nt, Homo sapiens
aucaaagauugaacacugcg

SEQ ID NO: 1158280 - RNA, 16 nt, Homo sapiens
aucaaaucagucagug

SEQ ID NO: 1158281 - RNA, 15 nt, Homo sapiens
aucaaaugagcaucu

SEQ ID NO: 1158282 - RNA, 20 nt, Homo sapiens
aucaacaaguggggaauucu

SEQ ID NO: 1158283 - RNA, 19 nt, Homo sapiens
aucaacauucuugugucug

SEQ ID NO: 1158284 - RNA, 15 nt, Homo sapiens
aucaacauuucucaa

SEQ ID NO: 1158285 - RNA, 20 nt, Homo sapiens
aucaacugcugcuucaccag

SEQ ID NO: 1158286 - RNA, 19 nt, Homo sapiens
aucaacuuccuaaauauua

SEQ ID NO: 1158287 - RNA, 20 nt, Homo sapiens
aucaagacugcaaacccuuu

SEQ ID NO: 1158288 - RNA, 18 nt, Homo sapiens
aucaagaggcugagacag

SEQ ID NO: 1158289 - RNA, 16 nt, Homo sapiens
aucaagagucucucca

SEQ ID NO: 1158290 - RNA, 22 nt, Homo sapiens
aucaagauuuaauccuagagau

SEQ ID NO: 1158291 - RNA, 15 nt, Homo sapiens
aucaagcugugagac

SEQ ID NO: 1158292 - RNA, 17 nt, Homo sapiens
aucaagguacaggaaaa

SEQ ID NO: 1158293 - RNA, 12 nt, Homo sapiens
aucaagucagca

SEQ ID NO: 1158294 - RNA, 17 nt, Homo sapiens
aucaaguuugaccagug

SEQ ID NO: 1158295 - RNA, 21 nt, Homo sapiens
aucaaguuugaccagugcagu

SEQ ID NO: 1158296 - RNA, 15 nt, Homo sapiens
aucaauaaagcacua

SEQ ID NO: 1158297 - RNA, 12 nt, Homo sapiens
aucaauaccugc

SEQ ID NO: 1158298 - RNA, 18 nt, Homo sapiens
aucaauaccugcugagag

SEQ ID NO: 1158299 - RNA, 19 nt, Homo sapiens
aucaauagaaggauguaca

SEQ ID NO: 1158300 - RNA, 18 nt, Homo sapiens
aucaaugaaaugauguca

SEQ ID NO: 1158301 - RNA, 12 nt, Homo sapiens
aucacaacaaac

SEQ ID NO: 1158302 - RNA, 19 nt, Homo sapiens
aucacacugggugguggcc

SEQ ID NO: 1158303 - RNA, 22 nt, Homo sapiens
aucacagaugaguuaucuaaga

SEQ ID NO: 1158304 - RNA, 19 nt, Homo sapiens
aucacaggagcaaucacag

SEQ ID NO: 1158305 - RNA, 14 nt, Homo sapiens
aucacaucaugcug

SEQ ID NO: 1158306 - RNA, 19 nt, Homo sapiens
aucacauccuuauccuuca

SEQ ID NO: 1158307 - RNA, 12 nt, Homo sapiens
aucacgaccacu

SEQ ID NO: 1158308 - RNA, 18 nt, Homo sapiens
aucacgggcgguccugca

SEQ ID NO: 1158309 - RNA, 23 nt, Homo sapiens
augggaucuguaaggaacuggaa

SEQ ID NO: 1158310 - RNA, 23 nt, Homo sapiens
augggauuugaaucaauguauua

SEQ ID NO: 1158311 - RNA, 22 nt, Homo sapiens
augggcagcccaacagcacuuu

SEQ ID NO: 1158312 - RNA, 20 nt, Homo sapiens
augggcccacaggguaccag

SEQ ID NO: 1158313 - RNA, 17 nt, Homo sapiens
augggcccuaugucuca

SEQ ID NO: 1158314 - RNA, 13 nt, Homo sapiens
auggggccagauc

SEQ ID NO: 1158315 - RNA, 15 nt, Homo sapiens
auggggggugggggg

SEQ ID NO: 1158316 - RNA, 13 nt, Homo sapiens
auggggugggggg

SEQ ID NO: 1158317 - RNA, 18 nt, Homo sapiens
augggugaaggcuggcau

SEQ ID NO: 1158318 - RNA, 12 nt, Homo sapiens
auggguggcucu

SEQ ID NO: 1158319 - RNA, 17 nt, Homo sapiens
augguaccaagcauuua

SEQ ID NO: 1158320 - RNA, 17 nt, Homo sapiens
augguagaaaaugcacc

SEQ ID NO: 1158321 - RNA, 17 nt, Homo sapiens
augguaggggcuuaaaa

SEQ ID NO: 1158322 - RNA, 20 nt, Homo sapiens
auggucacuuaaaaugugca

SEQ ID NO: 1158323 - RNA, 15 nt, Homo sapiens
auggucagaaugggu

SEQ ID NO: 1158324 - RNA, 20 nt, Homo sapiens
auggucccaggaagcaggga

SEQ ID NO: 1158325 - RNA, 14 nt, Homo sapiens
auggucuugaucuc

SEQ ID NO: 1158326 - RNA, 16 nt, Homo sapiens
auggugagaugcagcu

SEQ ID NO: 1158327 - RNA, 22 nt, Homo sapiens
auggugagaugcagcuggaaaa

SEQ ID NO: 1158328 - RNA, 19 nt, Homo sapiens
auggugcaaucacagcuca

SEQ ID NO: 1158329 - RNA, 16 nt, Homo sapiens
auggugccccaggacc

SEQ ID NO: 1158330 - RNA, 22 nt, Homo sapiens
auggugcguggcuucccugucc

SEQ ID NO: 1158331 - RNA, 15 nt, Homo sapiens
augguggcucaugcc

SEQ ID NO: 1158332 - RNA, 19 nt, Homo sapiens
augguggugugugccugua

SEQ ID NO: 1158333 - RNA, 22 nt, Homo sapiens
augguuacuaggcuuaauaccu

SEQ ID NO: 1158334 - RNA, 13 nt, Homo sapiens
augguuagacagc

SEQ ID NO: 1158335 - RNA, 20 nt, Homo sapiens
augguuauuuagcuggccau

SEQ ID NO: 1158336 - RNA, 21 nt, Homo sapiens
auguaaaaaccuuguagauag

SEQ ID NO: 1158337 - RNA, 16 nt, Homo sapiens
auguaaaaacuuucac

SEQ ID NO: 1158338 - RNA, 14 nt, Homo sapiens
auguaaaacaagaa

SEQ ID NO: 1158339 - RNA, 16 nt, Homo sapiens
auguaaaggccuuuaa

SEQ ID NO: 1158340 - RNA, 13 nt, Homo sapiens
auguaaagguuuu

SEQ ID NO: 1158341 - RNA, 16 nt, Homo sapiens
auguaagucucaacuc

SEQ ID NO: 1158342 - RNA, 15 nt, Homo sapiens
auguaagugggccca

SEQ ID NO: 1158343 - RNA, 20 nt, Homo sapiens
auguaaugaucuuggaccau

SEQ ID NO: 1158344 - RNA, 11 nt, Homo sapiens
auguacaugag

SEQ ID NO: 1158345 - RNA, 22 nt, Homo sapiens
auguacaugguauuaacacuua

SEQ ID NO: 1158346 - RNA, 17 nt, Homo sapiens
auguacuguuacugugu

SEQ ID NO: 1158347 - RNA, 21 nt, Homo sapiens
auguagaagcaugaagucuua

SEQ ID NO: 1158348 - RNA, 23 nt, Homo sapiens
auguagacugaaaagccaugugu

SEQ ID NO: 1158349 - RNA, 20 nt, Homo sapiens
auguaguccgugcugacagc

SEQ ID NO: 1158350 - RNA, 22 nt, Homo sapiens
auguaguucuuuguuccugcuu

SEQ ID NO: 1158351 - RNA, 14 nt, Homo sapiens
auguauaccagccu

SEQ ID NO: 1158352 - RNA, 16 nt, Homo sapiens
auguauauuuugauga

SEQ ID NO: 1158353 - RNA, 14 nt, Homo sapiens
auguauguauuuau

SEQ ID NO: 1158354 - RNA, 21 nt, Homo sapiens
auguauuuauuugggagaccg

SEQ ID NO: 1158355 - RNA, 18 nt, Homo sapiens
augucaacagagcaagga

SEQ ID NO: 1158356 - RNA, 17 nt, Homo sapiens
augucaagggauuacuu

SEQ ID NO: 1158357 - RNA, 17 nt, Homo sapiens
augucaagggccaagaa

SEQ ID NO: 1158358 - RNA, 13 nt, Homo sapiens
augucaccaccuu

SEQ ID NO: 1158359 - RNA, 17 nt, Homo sapiens
augucaggaaacauuca

SEQ ID NO: 1158360 - RNA, 14 nt, Homo sapiens
auguccaacuaaaa

SEQ ID NO: 1158361 - RNA, 20 nt, Homo sapiens
augucccugaagucuugcau

SEQ ID NO: 1158362 - RNA, 13 nt, Homo sapiens
auguccuauccaa

SEQ ID NO: 1158363 - RNA, 20 nt, Homo sapiens
auguccuuuccaucugucca

SEQ ID NO: 1158364 - RNA, 22 nt, Homo sapiens
augucuaaaauccugcuuaaaa

SEQ ID NO: 1158365 - RNA, 20 nt, Homo sapiens
augucuaauucauuuacuca

SEQ ID NO: 1158366 - RNA, 23 nt, Homo sapiens
augucucacgucucccuaaaaau

SEQ ID NO: 1158367 - RNA, 15 nt, Homo sapiens
augucucagaccacu

SEQ ID NO: 1158368 - RNA, 17 nt, Homo sapiens
augucucagaccacuau

SEQ ID NO: 1158369 - RNA, 21 nt, Homo sapiens
augucucucagaauucuucag

SEQ ID NO: 1158370 - RNA, 13 nt, Homo sapiens
augucugugcugu

SEQ ID NO: 1158371 - RNA, 20 nt, Homo sapiens
augucugugcuguguggaac

SEQ ID NO: 1158372 - RNA, 22 nt, Homo sapiens
augucuugcuguugacauauuu

SEQ ID NO: 1158373 - RNA, 20 nt, Homo sapiens
augucuuggacacuguacaa

SEQ ID NO: 1158374 - RNA, 17 nt, Homo sapiens
augucuuuuuaagaaua

SEQ ID NO: 1158375 - RNA, 20 nt, Homo sapiens
augugaaccauuaaccagau

SEQ ID NO: 1158376 - RNA, 21 nt, Homo sapiens
augugaagccaauucagacag

SEQ ID NO: 1158377 - RNA, 15 nt, Homo sapiens
augugaaucugggug

SEQ ID NO: 1158378 - RNA, 21 nt, Homo sapiens
augugaauuauuuccugcuua

SEQ ID NO: 1158379 - RNA, 15 nt, Homo sapiens
augugaccaugugaa

SEQ ID NO: 1158380 - RNA, 21 nt, Homo sapiens
augugagggcaccaccaagaa

SEQ ID NO: 1158381 - RNA, 18 nt, Homo sapiens
augugagugccuuuugca

SEQ ID NO: 1158382 - RNA, 21 nt, Homo sapiens
augugagugccuuuugcagaa

SEQ ID NO: 1158383 - RNA, 15 nt, Homo sapiens
augugauguucuaag

SEQ ID NO: 1158384 - RNA, 14 nt, Homo sapiens
augugauugcagcu

SEQ ID NO: 1158385 - RNA, 16 nt, Homo sapiens
augugcacacuuacag

SEQ ID NO: 1158386 - RNA, 21 nt, Homo sapiens
augugcacucauacauaugua

SEQ ID NO: 1158387 - RNA, 16 nt, Homo sapiens
augugcuauagacauu

SEQ ID NO: 1158388 - RNA, 16 nt, Homo sapiens
auguggaaaagccaag

SEQ ID NO: 1158389 - RNA, 21 nt, Homo sapiens
auguggaagaaaacaagacau

SEQ ID NO: 1158390 - RNA, 18 nt, Homo sapiens
auguggaguuuacauggg

SEQ ID NO: 1158391 - RNA, 15 nt, Homo sapiens
auguggauacaguca

SEQ ID NO: 1158392 - RNA, 16 nt, Homo sapiens
auguggauacagucau

SEQ ID NO: 1158393 - RNA, 15 nt, Homo sapiens
augugggaguggaac

SEQ ID NO: 1158394 - RNA, 14 nt, Homo sapiens
auguggguggcaaa

SEQ ID NO: 1158395 - RNA, 18 nt, Homo sapiens
auguggguugugauauug

SEQ ID NO: 1158396 - RNA, 18 nt, Homo sapiens
augugguuuuuugccagg

SEQ ID NO: 1158397 - RNA, 16 nt, Homo sapiens
auguguagaccuugau

SEQ ID NO: 1158398 - RNA, 19 nt, Homo sapiens
auguguauauaugucaaau

SEQ ID NO: 1158399 - RNA, 14 nt, Homo sapiens
augugucaaauaca

SEQ ID NO: 1158400 - RNA, 17 nt, Homo sapiens
augugucaucaggagaa

SEQ ID NO: 1158401 - RNA, 22 nt, Homo sapiens
augugucccuggcgcugugcua

SEQ ID NO: 1158402 - RNA, 18 nt, Homo sapiens
augugucccuuccaagcu

SEQ ID NO: 1158403 - RNA, 15 nt, Homo sapiens
auguguggacugugg

SEQ ID NO: 1158404 - RNA, 17 nt, Homo sapiens
auguguucauucuggaa

SEQ ID NO: 1158405 - RNA, 18 nt, Homo sapiens
auguguuccuugguugua

SEQ ID NO: 1158406 - RNA, 19 nt, Homo sapiens
auguguuuucagucuuucu

SEQ ID NO: 1158407 - RNA, 16 nt, Homo sapiens
auguuaaaaagugaaa

SEQ ID NO: 1158408 - RNA, 17 nt, Homo sapiens
auguuaaagaugcacag

SEQ ID NO: 1158409 - RNA, 15 nt, Homo sapiens
auguuaaccaaugua

SEQ ID NO: 1158410 - RNA, 14 nt, Homo sapiens
auguuaagacuuga

SEQ ID NO: 1158411 - RNA, 12 nt, Homo sapiens
auguuagccuca

SEQ ID NO: 1158412 - RNA, 17 nt, Homo sapiens
auguuauauacaucuca

SEQ ID NO: 1158413 - RNA, 12 nt, Homo sapiens
auguuauaucau

SEQ ID NO: 1158414 - RNA, 14 nt, Homo sapiens
auguucaguguaau

SEQ ID NO: 1158415 - RNA, 15 nt, Homo sapiens
auguucuuacuuugu

SEQ ID NO: 1158416 - RNA, 20 nt, Homo sapiens
auguucuuacuuuguuuacu

SEQ ID NO: 1158417 - RNA, 22 nt, Homo sapiens
auguucuuauuaaaaaucuaac

SEQ ID NO: 1158418 - RNA, 14 nt, Homo sapiens
auguucuucaucca

SEQ ID NO: 1158419 - RNA, 21 nt, Homo sapiens
auguugaauucuuuugccaag

SEQ ID NO: 1158420 - RNA, 23 nt, Homo sapiens
auguugauuuuuacuguguuuua

SEQ ID NO: 1158421 - RNA, 21 nt, Homo sapiens
auguuggccuccaguccuuaa

SEQ ID NO: 1158422 - RNA, 17 nt, Homo sapiens
auguugggaagcuauuu

SEQ ID NO: 1158423 - RNA, 23 nt, Homo sapiens
auguugguguuccacguguuuua

SEQ ID NO: 1158424 - RNA, 19 nt, Homo sapiens
auguuuauguaacauaguc

SEQ ID NO: 1158425 - RNA, 16 nt, Homo sapiens
auguuuauucuguucc

SEQ ID NO: 1158426 - RNA, 13 nt, Homo sapiens
auguuucagacca

SEQ ID NO: 1158427 - RNA, 16 nt, Homo sapiens
auguuugcacuuguga

SEQ ID NO: 1158428 - RNA, 17 nt, Homo sapiens
auguuugggucuuuuau

SEQ ID NO: 1158429 - RNA, 16 nt, Homo sapiens
auguuuguccugaaca

SEQ ID NO: 1158430 - RNA, 17 nt, Homo sapiens
auguuuuaagcugcuaa

SEQ ID NO: 1158431 - RNA, 16 nt, Homo sapiens
auguuuuacacuguac

SEQ ID NO: 1158432 - RNA, 14 nt, Homo sapiens
auguuuugcacuga

SEQ ID NO: 1158433 - RNA, 23 nt, Homo sapiens
auguuuuuguguagaguggcgau

SEQ ID NO: 1158434 - RNA, 14 nt, Homo sapiens
auguuuuuucugca

SEQ ID NO: 1158435 - RNA, 15 nt, Homo sapiens
auuaaaaacugagug

SEQ ID NO: 1158436 - RNA, 13 nt, Homo sapiens
auuaaaaccaauu

SEQ ID NO: 1158437 - RNA, 13 nt, Homo sapiens
auuaaaaccugau

SEQ ID NO: 1158438 - RNA, 14 nt, Homo sapiens
auuaaaaccugaua

SEQ ID NO: 1158439 - RNA, 22 nt, Homo sapiens
auuaaaagcaaggcucaaggga

SEQ ID NO: 1158440 - RNA, 16 nt, Homo sapiens
auuaaaauaaaccaaa

SEQ ID NO: 1158441 - RNA, 14 nt, Homo sapiens
auucugcugacaaa

SEQ ID NO: 1158442 - RNA, 16 nt, Homo sapiens
auucuggagucacugu

SEQ ID NO: 1158443 - RNA, 15 nt, Homo sapiens
auucugguuucuaga

SEQ ID NO: 1158444 - RNA, 16 nt, Homo sapiens
auucuguuguguucac

SEQ ID NO: 1158445 - RNA, 18 nt, Homo sapiens
auucuguuuuuaaugcua

SEQ ID NO: 1158446 - RNA, 16 nt, Homo sapiens
auucuuauggcugcug

SEQ ID NO: 1158447 - RNA, 17 nt, Homo sapiens
auucuugaggucuugag

SEQ ID NO: 1158448 - RNA, 13 nt, Homo sapiens
auucuuguaaaua

SEQ ID NO: 1158449 - RNA, 20 nt, Homo sapiens
auucuuguaguuuaccucuu

SEQ ID NO: 1158450 - RNA, 22 nt, Homo sapiens
auucuuguuggagacaugggau

SEQ ID NO: 1158451 - RNA, 16 nt, Homo sapiens
auucuuuaagaaccuu

SEQ ID NO: 1158452 - RNA, 19 nt, Homo sapiens
auucuuuaagaaccuuauu

SEQ ID NO: 1158453 - RNA, 19 nt, Homo sapiens
auucuuuauacaacagugc

SEQ ID NO: 1158454 - RNA, 20 nt, Homo sapiens
auucuuucccaauucacauc

SEQ ID NO: 1158455 - RNA, 19 nt, Homo sapiens
auucuuuccuucuuucauu

SEQ ID NO: 1158456 - RNA, 19 nt, Homo sapiens
auucuuugcaauacugcuu

SEQ ID NO: 1158457 - RNA, 14 nt, Homo sapiens
auucuuuugccaag

SEQ ID NO: 1158458 - RNA, 15 nt, Homo sapiens
auucuuuuguaauau

SEQ ID NO: 1158459 - RNA, 12 nt, Homo sapiens
auugaaaacacu

SEQ ID NO: 1158460 - RNA, 23 nt, Homo sapiens
auugaaaacagauauuacagcuu

SEQ ID NO: 1158461 - RNA, 16 nt, Homo sapiens
auugaaacaguuuauu

SEQ ID NO: 1158462 - RNA, 14 nt, Homo sapiens
auugaaagaaccag

SEQ ID NO: 1158463 - RNA, 15 nt, Homo sapiens
auugaacacaaacug

SEQ ID NO: 1158464 - RNA, 17 nt, Homo sapiens
auugaagccuuugccag

SEQ ID NO: 1158465 - RNA, 21 nt, Homo sapiens
auugacaaccgagaagguuua

SEQ ID NO: 1158466 - RNA, 24 nt, Homo sapiens
auugacaugugccagggcaaugau

SEQ ID NO: 1158467 - RNA, 23 nt, Homo sapiens
auugaccuguccucuuugugaua

SEQ ID NO: 1158468 - RNA, 15 nt, Homo sapiens
auugagaacugcaua

SEQ ID NO: 1158469 - RNA, 14 nt, Homo sapiens
auugagacuauuua

SEQ ID NO: 1158470 - RNA, 15 nt, Homo sapiens
auugagauacuugac

SEQ ID NO: 1158471 - RNA, 15 nt, Homo sapiens
auugagcucucucau

SEQ ID NO: 1158472 - RNA, 23 nt, Homo sapiens
auugaguaugaguguguuuuaua

SEQ ID NO: 1158473 - RNA, 16 nt, Homo sapiens
auugagugaaacauug

SEQ ID NO: 1158474 - RNA, 15 nt, Homo sapiens
auugaguuuuuacaa

SEQ ID NO: 1158475 - RNA, 23 nt, Homo sapiens
auugauagcagauaucacgacag

SEQ ID NO: 1158476 - RNA, 18 nt, Homo sapiens
auugauauaaauuacuga

SEQ ID NO: 1158477 - RNA, 15 nt, Homo sapiens
auugaucuguguuaa

SEQ ID NO: 1158478 - RNA, 19 nt, Homo sapiens
auugaugagcacuccugau

SEQ ID NO: 1158479 - RNA, 16 nt, Homo sapiens
auugcaagaguuuaau

SEQ ID NO: 1158480 - RNA, 19 nt, Homo sapiens
auugcagaggggcccauga

SEQ ID NO: 1158481 - RNA, 20 nt, Homo sapiens
auugcagauaacuuugacuu

SEQ ID NO: 1158482 - RNA, 22 nt, Homo sapiens
auugcaguucugauucauuuga

SEQ ID NO: 1158483 - RNA, 24 nt, Homo sapiens
auugccaggaauguuucagcugca

SEQ ID NO: 1158484 - RNA, 21 nt, Homo sapiens
auugccuucucaccagcugca

SEQ ID NO: 1158485 - RNA, 21 nt, Homo sapiens
auugcugauuuugucugccca

SEQ ID NO: 1158486 - RNA, 19 nt, Homo sapiens
auugcuuauaacaagcaua

SEQ ID NO: 1158487 - RNA, 22 nt, Homo sapiens
auugcuugaguuauauguucac

SEQ ID NO: 1158488 - RNA, 14 nt, Homo sapiens
auuggaaagcacac

SEQ ID NO: 1158489 - RNA, 17 nt, Homo sapiens
auuggaccauccuauuu

SEQ ID NO: 1158490 - RNA, 20 nt, Homo sapiens
auuggccggcuaguguuucc

SEQ ID NO: 1158491 - RNA, 21 nt, Homo sapiens
auuggccggcuucccaugccu

SEQ ID NO: 1158492 - RNA, 15 nt, Homo sapiens
auugggccaguuccu

SEQ ID NO: 1158493 - RNA, 13 nt, Homo sapiens
auuggggucuguu

SEQ ID NO: 1158494 - RNA, 24 nt, Homo sapiens
auuggguuuugcuuuagagugcaa

SEQ ID NO: 1158495 - RNA, 21 nt, Homo sapiens
auuggucuggguggaugugag

SEQ ID NO: 1158496 - RNA, 19 nt, Homo sapiens
auuggugcaaauuggcuaa

SEQ ID NO: 1158497 - RNA, 17 nt, Homo sapiens
auuguaaauacauguac

SEQ ID NO: 1158498 - RNA, 16 nt, Homo sapiens
auuguacaauacuugc

SEQ ID NO: 1158499 - RNA, 15 nt, Homo sapiens
auuguacaguuuaaa

SEQ ID NO: 1158500 - RNA, 16 nt, Homo sapiens
auuguacuaaagccaa

SEQ ID NO: 1158501 - RNA, 17 nt, Homo sapiens
auuguaucaugugcuag

SEQ ID NO: 1158502 - RNA, 16 nt, Homo sapiens
auugucguuucauuca

SEQ ID NO: 1158503 - RNA, 14 nt, Homo sapiens
auugucugcaaugg

SEQ ID NO: 1158504 - RNA, 17 nt, Homo sapiens
auugucuugguugccag

SEQ ID NO: 1158505 - RNA, 18 nt, Homo sapiens
auugucuugguugccagu

SEQ ID NO: 1158506 - RNA, 15 nt, Homo sapiens
auuguggagccaaag

SEQ ID NO: 1158507 - RNA, 18 nt, Homo sapiens
auuguggauaacaaagau

SEQ ID NO: 1158508 - RNA, 17 nt, Homo sapiens
auugugugagugcaugu

SEQ ID NO: 1158509 - RNA, 14 nt, Homo sapiens
auuguguguucuca

SEQ ID NO: 1158510 - RNA, 15 nt, Homo sapiens
auuguuaauuaucua

SEQ ID NO: 1158511 - RNA, 21 nt, Homo sapiens
auuguuccaaaugaauguugu

SEQ ID NO: 1158512 - RNA, 17 nt, Homo sapiens
auuguucugggugauuu

SEQ ID NO: 1158513 - RNA, 12 nt, Homo sapiens
auuuaaaaggga

SEQ ID NO: 1158514 - RNA, 15 nt, Homo sapiens
auuuaaaagucugcc

SEQ ID NO: 1158515 - RNA, 21 nt, Homo sapiens
auuuaaaaugcucaauuucag

SEQ ID NO: 1158516 - RNA, 13 nt, Homo sapiens
auuuaaaauggaa

SEQ ID NO: 1158517 - RNA, 19 nt, Homo sapiens
auuuaaagggaaaacccuc

SEQ ID NO: 1158518 - RNA, 15 nt, Homo sapiens
auuuaacugacuuaa

SEQ ID NO: 1158519 - RNA, 20 nt, Homo sapiens
auuuaacuuacacugaucaa

SEQ ID NO: 1158520 - RNA, 21 nt, Homo sapiens
auuuaauaaaugacaaaugua

SEQ ID NO: 1158521 - RNA, 15 nt, Homo sapiens
auuuaauccaaacag

SEQ ID NO: 1158522 - RNA, 21 nt, Homo sapiens
auuuacccaacucuguacaaa

SEQ ID NO: 1158523 - RNA, 16 nt, Homo sapiens
auuuacgacugaagaa

SEQ ID NO: 1158524 - RNA, 18 nt, Homo sapiens
auuuacugucuuaaauca

SEQ ID NO: 1158525 - RNA, 17 nt, Homo sapiens
auuuagaacgacauguu

SEQ ID NO: 1158526 - RNA, 14 nt, Homo sapiens
auuuagaauaucua

SEQ ID NO: 1158527 - RNA, 18 nt, Homo sapiens
auuuagacccugcauuua

SEQ ID NO: 1158528 - RNA, 12 nt, Homo sapiens
auuuagacucau

SEQ ID NO: 1158529 - RNA, 21 nt, Homo sapiens
auuuagacucaucuuacugua

SEQ ID NO: 1158530 - RNA, 17 nt, Homo sapiens
auuuagaugcacuacca

SEQ ID NO: 1158531 - RNA, 21 nt, Homo sapiens
auuuagccaggaccugccaau

SEQ ID NO: 1158532 - RNA, 21 nt, Homo sapiens
auuuagcccuucuaggcaaaa

SEQ ID NO: 1158533 - RNA, 12 nt, Homo sapiens
auuuagcuugaa

SEQ ID NO: 1158534 - RNA, 13 nt, Homo sapiens
auuuagugauaua

SEQ ID NO: 1158535 - RNA, 19 nt, Homo sapiens
auuuaguguuuuuaccucu

SEQ ID NO: 1158536 - RNA, 23 nt, Homo sapiens
auuuauaucgcuggccagcauua

SEQ ID NO: 1158537 - RNA, 23 nt, Homo sapiens
auuuauauguaaacaagcaauaa

SEQ ID NO: 1158538 - RNA, 16 nt, Homo sapiens
auuuauauuacugucu

SEQ ID NO: 1158539 - RNA, 19 nt, Homo sapiens
auuuauauuuuuuugcaag

SEQ ID NO: 1158540 - RNA, 14 nt, Homo sapiens
auuuaucacuuuuu

SEQ ID NO: 1158541 - RNA, 12 nt, Homo sapiens
auuuaucugugu

SEQ ID NO: 1158542 - RNA, 14 nt, Homo sapiens
auuuauucuacuuu

SEQ ID NO: 1158543 - RNA, 13 nt, Homo sapiens
auuuauugccugg

SEQ ID NO: 1158544 - RNA, 13 nt, Homo sapiens
auuuauuuuacac

SEQ ID NO: 1158545 - RNA, 19 nt, Homo sapiens
auuuauuuugcucuuguuu

SEQ ID NO: 1158546 - RNA, 23 nt, Homo sapiens
auuucaaaacucauuuccuaugu

SEQ ID NO: 1158547 - RNA, 19 nt, Homo sapiens
auuucaaaauauacauuca

SEQ ID NO: 1158548 - RNA, 21 nt, Homo sapiens
auuucaaacauuugucagaga

SEQ ID NO: 1158549 - RNA, 17 nt, Homo sapiens
auuucaaccagcacauu

SEQ ID NO: 1158550 - RNA, 13 nt, Homo sapiens
auuucacaagcua

SEQ ID NO: 1158551 - RNA, 15 nt, Homo sapiens
auuucacaagcuauu

SEQ ID NO: 1158552 - RNA, 12 nt, Homo sapiens
auuucacugucu

SEQ ID NO: 1158553 - RNA, 12 nt, Homo sapiens
auuucagacucc

SEQ ID NO: 1158554 - RNA, 15 nt, Homo sapiens
auuucagagcagagg

SEQ ID NO: 1158555 - RNA, 15 nt, Homo sapiens
auuucagcagggaug

SEQ ID NO: 1158556 - RNA, 15 nt, Homo sapiens
auuucaguacuucag

SEQ ID NO: 1158557 - RNA, 17 nt, Homo sapiens
auuucagugcugcugaa

SEQ ID NO: 1158558 - RNA, 20 nt, Homo sapiens
auuucaugugucaacuucaa

SEQ ID NO: 1158559 - RNA, 22 nt, Homo sapiens
auuucauugcucagaaauguca

SEQ ID NO: 1158560 - RNA, 18 nt, Homo sapiens
auuuccaaaccuccacug

SEQ ID NO: 1158561 - RNA, 16 nt, Homo sapiens
auuuccaaauucacaa

SEQ ID NO: 1158562 - RNA, 11 nt, Homo sapiens
auuuccauguu

SEQ ID NO: 1158563 - RNA, 15 nt, Homo sapiens
auuucccucuacuga

SEQ ID NO: 1158564 - RNA, 22 nt, Homo sapiens
auuucccugaaggaaccaaagc

SEQ ID NO: 1158565 - RNA, 20 nt, Homo sapiens
auuuccuuuauacugugaag

SEQ ID NO: 1158566 - RNA, 17 nt, Homo sapiens
auuuccuuugcgcaaac

SEQ ID NO: 1158567 - RNA, 23 nt, Homo sapiens
auuucuacuucuggaagucaucu

SEQ ID NO: 1158568 - RNA, 18 nt, Homo sapiens
auuucuauuuccuggaau

SEQ ID NO: 1158569 - RNA, 16 nt, Homo sapiens
auuucuccuccauggg

SEQ ID NO: 1158570 - RNA, 17 nt, Homo sapiens
auuucucugcucacaga

SEQ ID NO: 1158571 - RNA, 18 nt, Homo sapiens
auuucugggugaugaaaa

SEQ ID NO: 1158572 - RNA, 20 nt, Homo sapiens
auuucuuaaacacuugcaac

SEQ ID NO: 1158573 - RNA, 22 nt, Homo sapiens
caauuaaaaaaaauuaaaacca

SEQ ID NO: 1158574 - RNA, 15 nt, Homo sapiens
caauuaacaaucaaa

SEQ ID NO: 1158575 - RNA, 14 nt, Homo sapiens
caauuaacucugga

SEQ ID NO: 1158576 - RNA, 14 nt, Homo sapiens
caauuaacugcccu

SEQ ID NO: 1158577 - RNA, 21 nt, Homo sapiens
caauucaaaacauugugccau

SEQ ID NO: 1158578 - RNA, 12 nt, Homo sapiens
caauucagucug

SEQ ID NO: 1158579 - RNA, 14 nt, Homo sapiens
caauucuuuauaca

SEQ ID NO: 1158580 - RNA, 14 nt, Homo sapiens
caauugacaacagu

SEQ ID NO: 1158581 - RNA, 17 nt, Homo sapiens
caauuguuaaucaaaga

SEQ ID NO: 1158582 - RNA, 21 nt, Homo sapiens
caauuuaaaaaugagugugaa

SEQ ID NO: 1158583 - RNA, 17 nt, Homo sapiens
caauuuacgaaaccaaa

SEQ ID NO: 1158584 - RNA, 21 nt, Homo sapiens
caauuucaccuugaaaaagca

SEQ ID NO: 1158585 - RNA, 14 nt, Homo sapiens
caauuucagacucc

SEQ ID NO: 1158586 - RNA, 15 nt, Homo sapiens
caauuucagacuccc

SEQ ID NO: 1158587 - RNA, 21 nt, Homo sapiens
caauuucccuucauacuccuu

SEQ ID NO: 1158588 - RNA, 14 nt, Homo sapiens
caauuuguuuauau

SEQ ID NO: 1158589 - RNA, 17 nt, Homo sapiens
caauuuuaaaucugaga

SEQ ID NO: 1158590 - RNA, 23 nt, Homo sapiens
caauuuucuuuuuuauacucaau

SEQ ID NO: 1158591 - RNA, 15 nt, Homo sapiens
cacaaaacagccuuu

SEQ ID NO: 1158592 - RNA, 15 nt, Homo sapiens
cacaaaauaaugcag

SEQ ID NO: 1158593 - RNA, 17 nt, Homo sapiens
cacaaaauaaugcaguu

SEQ ID NO: 1158594 - RNA, 17 nt, Homo sapiens
cacaaacccccacucca

SEQ ID NO: 1158595 - RNA, 19 nt, Homo sapiens
cacaaaggauuugaugcuu

SEQ ID NO: 1158596 - RNA, 15 nt, Homo sapiens
cacaaaugauagcau

SEQ ID NO: 1158597 - RNA, 12 nt, Homo sapiens
cacaaauuccac

SEQ ID NO: 1158598 - RNA, 20 nt, Homo sapiens
cacaaccaacgcgaaaccaa

SEQ ID NO: 1158599 - RNA, 20 nt, Homo sapiens
cacaagaagcugguggagca

SEQ ID NO: 1158600 - RNA, 13 nt, Homo sapiens
cacaagaaucacu

SEQ ID NO: 1158601 - RNA, 19 nt, Homo sapiens
cacaagccugaauuucuca

SEQ ID NO: 1158602 - RNA, 14 nt, Homo sapiens
cacaaggggcucca

SEQ ID NO: 1158603 - RNA, 18 nt, Homo sapiens
cacaaguuacacugccau

SEQ ID NO: 1158604 - RNA, 12 nt, Homo sapiens
cacaauacuguu

SEQ ID NO: 1158605 - RNA, 12 nt, Homo sapiens
cacaauguugca

SEQ ID NO: 1158606 - RNA, 15 nt, Homo sapiens
cacacacacaguuug

SEQ ID NO: 1158607 - RNA, 11 nt, Homo sapiens
cacacaccagu

SEQ ID NO: 1158608 - RNA, 11 nt, Homo sapiens
cacacacuccu

SEQ ID NO: 1158609 - RNA, 20 nt, Homo sapiens
cacacacuggcugguggaga

SEQ ID NO: 1158610 - RNA, 15 nt, Homo sapiens
cacacacuuccauau

SEQ ID NO: 1158611 - RNA, 16 nt, Homo sapiens
cacacagaggggaguc

SEQ ID NO: 1158612 - RNA, 19 nt, Homo sapiens
cacacagggugguggcaca

SEQ ID NO: 1158613 - RNA, 17 nt, Homo sapiens
cacacaguaagcacuca

SEQ ID NO: 1158614 - RNA, 23 nt, Homo sapiens
cacacaucccagcccaauccagg

SEQ ID NO: 1158615 - RNA, 16 nt, Homo sapiens
cacacaucuguggaga

SEQ ID NO: 1158616 - RNA, 21 nt, Homo sapiens
cacacaugggcaucuauggga

SEQ ID NO: 1158617 - RNA, 23 nt, Homo sapiens
cacacauuggcuuaugugaaacu

SEQ ID NO: 1158618 - RNA, 16 nt, Homo sapiens
cacacauuucugaggg

SEQ ID NO: 1158619 - RNA, 13 nt, Homo sapiens
cacacccaugugu

SEQ ID NO: 1158620 - RNA, 19 nt, Homo sapiens
cacaccccaacacuuccag

SEQ ID NO: 1158621 - RNA, 14 nt, Homo sapiens
cacaccugcagugc

SEQ ID NO: 1158622 - RNA, 17 nt, Homo sapiens
cacaccuuuuauugaca

SEQ ID NO: 1158623 - RNA, 16 nt, Homo sapiens
cacacgcacauauaca

SEQ ID NO: 1158624 - RNA, 22 nt, Homo sapiens
cacacguuuaaucccagcacuu

SEQ ID NO: 1158625 - RNA, 20 nt, Homo sapiens
cacacuaguuuaugcuaccu

SEQ ID NO: 1158626 - RNA, 18 nt, Homo sapiens
cacacugaggcagggaag

SEQ ID NO: 1158627 - RNA, 12 nt, Homo sapiens
cacacugaucug

SEQ ID NO: 1158628 - RNA, 16 nt, Homo sapiens
cacacuguaaauauga

SEQ ID NO: 1158629 - RNA, 13 nt, Homo sapiens
cacacuuacugua

SEQ ID NO: 1158630 - RNA, 17 nt, Homo sapiens
cacacuugguccaucca

SEQ ID NO: 1158631 - RNA, 17 nt, Homo sapiens
cacacuuuauaacccaa

SEQ ID NO: 1158632 - RNA, 13 nt, Homo sapiens
cacagaaacacug

SEQ ID NO: 1158633 - RNA, 17 nt, Homo sapiens
cacagaagcacaugcac

SEQ ID NO: 1158634 - RNA, 22 nt, Homo sapiens
cacagaaggguguggcauuugg

SEQ ID NO: 1158635 - RNA, 21 nt, Homo sapiens
cacagaagguguucaaacaca

SEQ ID NO: 1158636 - RNA, 16 nt, Homo sapiens
cacagacccacagaag

SEQ ID NO: 1158637 - RNA, 16 nt, Homo sapiens
cacagagggcgcuccu

SEQ ID NO: 1158638 - RNA, 20 nt, Homo sapiens
cacagaggggagucaccagc

SEQ ID NO: 1158639 - RNA, 19 nt, Homo sapiens
cacagauccccccacaaag

SEQ ID NO: 1158640 - RNA, 17 nt, Homo sapiens
cacagauguucccccau

SEQ ID NO: 1158641 - RNA, 13 nt, Homo sapiens
cacagcacagcca

SEQ ID NO: 1158642 - RNA, 16 nt, Homo sapiens
cacagcacuaauucaa

SEQ ID NO: 1158643 - RNA, 18 nt, Homo sapiens
cacagcccuaguaugaaa

SEQ ID NO: 1158644 - RNA, 14 nt, Homo sapiens
cacagcccugaauc

SEQ ID NO: 1158645 - RNA, 18 nt, Homo sapiens
cacagcccugaaucagau

SEQ ID NO: 1158646 - RNA, 17 nt, Homo sapiens
cacagccuccccugcca

SEQ ID NO: 1158647 - RNA, 19 nt, Homo sapiens
cacagcgaagacugcuaaa

SEQ ID NO: 1158648 - RNA, 22 nt, Homo sapiens
cacagcugagcaaucucuugca

SEQ ID NO: 1158649 - RNA, 20 nt, Homo sapiens
cacaggagcccugcuaugaa

SEQ ID NO: 1158650 - RNA, 18 nt, Homo sapiens
cacaggcacauuaacugu

SEQ ID NO: 1158651 - RNA, 17 nt, Homo sapiens
cacaggcaggggugaga

SEQ ID NO: 1158652 - RNA, 15 nt, Homo sapiens
cacagggacugaaaa

SEQ ID NO: 1158653 - RNA, 12 nt, Homo sapiens
cacaggucccac

SEQ ID NO: 1158654 - RNA, 16 nt, Homo sapiens
cacaguaagucauuua

SEQ ID NO: 1158655 - RNA, 22 nt, Homo sapiens
cacagucacaugcccauucaca

SEQ ID NO: 1158656 - RNA, 17 nt, Homo sapiens
cacagugcugaccagac

SEQ ID NO: 1158657 - RNA, 15 nt, Homo sapiens
cacaguggcuucaca

SEQ ID NO: 1158658 - RNA, 21 nt, Homo sapiens
cacaguucuuaauacaggaga

SEQ ID NO: 1158659 - RNA, 22 nt, Homo sapiens
cacauaaaugcagcccauuucu

SEQ ID NO: 1158660 - RNA, 22 nt, Homo sapiens
cacauacccucacuuaaacuuu

SEQ ID NO: 1158661 - RNA, 12 nt, Homo sapiens
cacauacuccuu

SEQ ID NO: 1158662 - RNA, 22 nt, Homo sapiens
cacauaguagguacccaauuca

SEQ ID NO: 1158663 - RNA, 13 nt, Homo sapiens
cacauaugcaccu

SEQ ID NO: 1158664 - RNA, 11 nt, Homo sapiens
cacaucaccuc

SEQ ID NO: 1158665 - RNA, 20 nt, Homo sapiens
cacauccuaugcaauauauc

SEQ ID NO: 1158666 - RNA, 17 nt, Homo sapiens
cacaugaccacauagca

SEQ ID NO: 1158667 - RNA, 16 nt, Homo sapiens
cacaugcccauucaca

SEQ ID NO: 1158668 - RNA, 15 nt, Homo sapiens
cacaugccuugcaau

SEQ ID NO: 1158669 - RNA, 16 nt, Homo sapiens
cacauggaaacccaua

SEQ ID NO: 1158670 - RNA, 20 nt, Homo sapiens
cacauggaaucuacaugugu

SEQ ID NO: 1158671 - RNA, 21 nt, Homo sapiens
cacaugucaagggauuacuua

SEQ ID NO: 1158672 - RNA, 16 nt, Homo sapiens
cacaugucuuguacau

SEQ ID NO: 1158673 - RNA, 20 nt, Homo sapiens
cacaugucuuguacaugugu

SEQ ID NO: 1158674 - RNA, 22 nt, Homo sapiens
cacaugucuuguacauguguag

SEQ ID NO: 1158675 - RNA, 15 nt, Homo sapiens
cacaugugacacaua

SEQ ID NO: 1158676 - RNA, 20 nt, Homo sapiens
cacaugugacacauaugcac

SEQ ID NO: 1158677 - RNA, 14 nt, Homo sapiens
cacauuaaaagaca

SEQ ID NO: 1158678 - RNA, 22 nt, Homo sapiens
cacauuaggauggugaaccagc

SEQ ID NO: 1158679 - RNA, 14 nt, Homo sapiens
cacauugaaucaug

SEQ ID NO: 1158680 - RNA, 16 nt, Homo sapiens
cacauugucaucagag

SEQ ID NO: 1158681 - RNA, 22 nt, Homo sapiens
cacauuguuauuuucagugaua

SEQ ID NO: 1158682 - RNA, 22 nt, Homo sapiens
cacauuuacuguuucuguuaua

SEQ ID NO: 1158683 - RNA, 21 nt, Homo sapiens
cacauuuagauccugguuuca

SEQ ID NO: 1158684 - RNA, 14 nt, Homo sapiens
cacauuuucagcca

SEQ ID NO: 1158685 - RNA, 15 nt, Homo sapiens
caccaaaaccaagau

SEQ ID NO: 1158686 - RNA, 18 nt, Homo sapiens
caccaaaucaucucucau

SEQ ID NO: 1158687 - RNA, 15 nt, Homo sapiens
caccaagcucugucc

SEQ ID NO: 1158688 - RNA, 16 nt, Homo sapiens
caccaccuucccagcu

SEQ ID NO: 1158689 - RNA, 18 nt, Homo sapiens
caccacgggacaucacag

SEQ ID NO: 1158690 - RNA, 15 nt, Homo sapiens
caccagacacccagg

SEQ ID NO: 1158691 - RNA, 15 nt, Homo sapiens
caccagagaccaaac

SEQ ID NO: 1158692 - RNA, 20 nt, Homo sapiens
caccagagauaauaugagaa

SEQ ID NO: 1158693 - RNA, 20 nt, Homo sapiens
caccagcaccgugacaguuu

SEQ ID NO: 1158694 - RNA, 15 nt, Homo sapiens
caccagcagcacugg

SEQ ID NO: 1158695 - RNA, 15 nt, Homo sapiens
caccagccagaggau

SEQ ID NO: 1158696 - RNA, 23 nt, Homo sapiens
caccagcucuauucuuugccuua

SEQ ID NO: 1158697 - RNA, 23 nt, Homo sapiens
caccaggucucccgggaagccac

SEQ ID NO: 1158698 - RNA, 11 nt, Homo sapiens
caccagguguc

SEQ ID NO: 1158699 - RNA, 22 nt, Homo sapiens
caccaguaccugaaagcacugu

SEQ ID NO: 1158700 - RNA, 17 nt, Homo sapiens
caccauguauuuuguaa

SEQ ID NO: 1158701 - RNA, 13 nt, Homo sapiens
caccaugugaacc

SEQ ID NO: 1158702 - RNA, 16 nt, Homo sapiens
caccauugcugcuccu

SEQ ID NO: 1158703 - RNA, 22 nt, Homo sapiens
cacccaaagccugucccaggac

SEQ ID NO: 1158704 - RNA, 13 nt, Homo sapiens
cacccaauuccac

SEQ ID NO: 1158705 - RNA, 15 nt, Homo sapiens
cacccacauaccugg

SEQ ID NO: 1158706 - RNA, 23 nt, Homo sapiens
ccucuccacaggagccucugcag

SEQ ID NO: 1158707 - RNA, 15 nt, Homo sapiens
ccucuccuccguggc

SEQ ID NO: 1158708 - RNA, 16 nt, Homo sapiens
ccucucggugcuccau

SEQ ID NO: 1158709 - RNA, 20 nt, Homo sapiens
ccucucggugcuccaucucc

SEQ ID NO: 1158710 - RNA, 14 nt, Homo sapiens
ccucucucauuccc

SEQ ID NO: 1158711 - RNA, 24 nt, Homo sapiens
ccucucucccugccucacaucucc

SEQ ID NO: 1158712 - RNA, 12 nt, Homo sapiens
ccucucugcaaa

SEQ ID NO: 1158713 - RNA, 13 nt, Homo sapiens
ccucucugcaaau

SEQ ID NO: 1158714 - RNA, 12 nt, Homo sapiens
ccucucugcucu

SEQ ID NO: 1158715 - RNA, 20 nt, Homo sapiens
ccucucugugggauaucaca

SEQ ID NO: 1158716 - RNA, 16 nt, Homo sapiens
ccucucuuagggugag

SEQ ID NO: 1158717 - RNA, 21 nt, Homo sapiens
ccucugaaacagcugccuuag

SEQ ID NO: 1158718 - RNA, 15 nt, Homo sapiens
ccucugauuuucucc

SEQ ID NO: 1158719 - RNA, 17 nt, Homo sapiens
ccucugggucagugguc

SEQ ID NO: 1158720 - RNA, 18 nt, Homo sapiens
ccucugggucaguggucc

SEQ ID NO: 1158721 - RNA, 18 nt, Homo sapiens
ccucuguccaggcacuga

SEQ ID NO: 1158722 - RNA, 16 nt, Homo sapiens
ccucuucccugaccuc

SEQ ID NO: 1158723 - RNA, 12 nt, Homo sapiens
ccucuugcaaag

SEQ ID NO: 1158724 - RNA, 22 nt, Homo sapiens
ccucuuggccugaucagaccac

SEQ ID NO: 1158725 - RNA, 13 nt, Homo sapiens
ccucuuugcuuug

SEQ ID NO: 1158726 - RNA, 11 nt, Homo sapiens
ccucuuuggag

SEQ ID NO: 1158727 - RNA, 21 nt, Homo sapiens
ccucuuuuucugaagcuacuu

SEQ ID NO: 1158728 - RNA, 16 nt, Homo sapiens
ccucuuuuucuuacca

SEQ ID NO: 1158729 - RNA, 21 nt, Homo sapiens
ccugaaacaacuuggaaagau

SEQ ID NO: 1158730 - RNA, 19 nt, Homo sapiens
ccugaaauuaacucagaca

SEQ ID NO: 1158731 - RNA, 20 nt, Homo sapiens
ccugaacagcauggcacucc

SEQ ID NO: 1158732 - RNA, 16 nt, Homo sapiens
ccugaaccucugaugc

SEQ ID NO: 1158733 - RNA, 14 nt, Homo sapiens
ccugaacucugcaa

SEQ ID NO: 1158734 - RNA, 19 nt, Homo sapiens
ccugaagaaucccccaugg

SEQ ID NO: 1158735 - RNA, 15 nt, Homo sapiens
ccugaaggucugggu

SEQ ID NO: 1158736 - RNA, 16 nt, Homo sapiens
ccugaauaaaccaaga

SEQ ID NO: 1158737 - RNA, 20 nt, Homo sapiens
ccugaaucuaacagugacuu

SEQ ID NO: 1158738 - RNA, 20 nt, Homo sapiens
ccugaauggcuuugucuuga

SEQ ID NO: 1158739 - RNA, 19 nt, Homo sapiens
ccugaauguuucagaccac

SEQ ID NO: 1158740 - RNA, 15 nt, Homo sapiens
ccugaauucuacuga

SEQ ID NO: 1158741 - RNA, 15 nt, Homo sapiens
ccugacaagugaagu

SEQ ID NO: 1158742 - RNA, 14 nt, Homo sapiens
ccugacaccuuuca

SEQ ID NO: 1158743 - RNA, 20 nt, Homo sapiens
ccugacagaggugucaucca

SEQ ID NO: 1158744 - RNA, 16 nt, Homo sapiens
ccugaccugagccaga

SEQ ID NO: 1158745 - RNA, 16 nt, Homo sapiens
ccugacuggugcugca

SEQ ID NO: 1158746 - RNA, 19 nt, Homo sapiens
ccugagauucagaugucau

SEQ ID NO: 1158747 - RNA, 20 nt, Homo sapiens
ccugagcgugcuuuccaaaa

SEQ ID NO: 1158748 - RNA, 19 nt, Homo sapiens
ccugaggcaagccauggag

SEQ ID NO: 1158749 - RNA, 21 nt, Homo sapiens
ccugaggugggagauguggaa

SEQ ID NO: 1158750 - RNA, 15 nt, Homo sapiens
ccugagguuugccag

SEQ ID NO: 1158751 - RNA, 23 nt, Homo sapiens
ccugaguuggccaggcauggugg

SEQ ID NO: 1158752 - RNA, 21 nt, Homo sapiens
ccugaguuggcguugugggca

SEQ ID NO: 1158753 - RNA, 19 nt, Homo sapiens
ccugauuuaggagaagcca

SEQ ID NO: 1158754 - RNA, 23 nt, Homo sapiens
ccugcacucccuccuggagcucu

SEQ ID NO: 1158755 - RNA, 17 nt, Homo sapiens
ccugcaucuaagcccau

SEQ ID NO: 1158756 - RNA, 22 nt, Homo sapiens
ccugccagauuaucagaccucu

SEQ ID NO: 1158757 - RNA, 17 nt, Homo sapiens
ccugccagggaggccau

SEQ ID NO: 1158758 - RNA, 17 nt, Homo sapiens
ccugcccguaaacacgc

SEQ ID NO: 1158759 - RNA, 14 nt, Homo sapiens
ccugcccuuggcac

SEQ ID NO: 1158760 - RNA, 13 nt, Homo sapiens
ccugccucagcuu

SEQ ID NO: 1158761 - RNA, 22 nt, Homo sapiens
ccugccuuuuaacguagauaua

SEQ ID NO: 1158762 - RNA, 20 nt, Homo sapiens
ccugcgccaccgcccagaga

SEQ ID NO: 1158763 - RNA, 14 nt, Homo sapiens
ccugcucccacaga

SEQ ID NO: 1158764 - RNA, 14 nt, Homo sapiens
ccugcugccagaag

SEQ ID NO: 1158765 - RNA, 23 nt, Homo sapiens
ccugcuggcacuauccagaugga

SEQ ID NO: 1158766 - RNA, 17 nt, Homo sapiens
ccugcuguugguccucu

SEQ ID NO: 1158767 - RNA, 18 nt, Homo sapiens
ccugcuuaaaacuuuuca

SEQ ID NO: 1158768 - RNA, 22 nt, Homo sapiens
ccugcuucagauguggagccag

SEQ ID NO: 1158769 - RNA, 23 nt, Homo sapiens
ccugcuuggguggagaagccauu

SEQ ID NO: 1158770 - RNA, 16 nt, Homo sapiens
ccugcuuugggaagcc

SEQ ID NO: 1158771 - RNA, 12 nt, Homo sapiens
ccuggaaacaga

SEQ ID NO: 1158772 - RNA, 22 nt, Homo sapiens
ccuggaacaccagcagcacugg

SEQ ID NO: 1158773 - RNA, 14 nt, Homo sapiens
ccuggaccauuuga

SEQ ID NO: 1158774 - RNA, 22 nt, Homo sapiens
ccuggacuagagggaccucucc

SEQ ID NO: 1158775 - RNA, 13 nt, Homo sapiens
ccuggagcagcug

SEQ ID NO: 1158776 - RNA, 20 nt, Homo sapiens
ccuggagcuauucacagugc

SEQ ID NO: 1158777 - RNA, 20 nt, Homo sapiens
ccuggaggagcugugcugcc

SEQ ID NO: 1158778 - RNA, 23 nt, Homo sapiens
ccuggaucaguccuuugaucagu

SEQ ID NO: 1158779 - RNA, 16 nt, Homo sapiens
ccuggaucuaccagca

SEQ ID NO: 1158780 - RNA, 17 nt, Homo sapiens
ccuggauuccauuuaug

SEQ ID NO: 1158781 - RNA, 17 nt, Homo sapiens
ccuggcagcaaacugcu

SEQ ID NO: 1158782 - RNA, 15 nt, Homo sapiens
ccuggcagcucugga

SEQ ID NO: 1158783 - RNA, 14 nt, Homo sapiens
ccuggcaucugugu

SEQ ID NO: 1158784 - RNA, 20 nt, Homo sapiens
ccuggccccuccaauccucc

SEQ ID NO: 1158785 - RNA, 18 nt, Homo sapiens
ccuggcccuccaugacac

SEQ ID NO: 1158786 - RNA, 21 nt, Homo sapiens
ccuggccuggucccugguccu

SEQ ID NO: 1158787 - RNA, 15 nt, Homo sapiens
ccuggcugcacucuu

SEQ ID NO: 1158788 - RNA, 18 nt, Homo sapiens
ccuggcuggcugggaugc

SEQ ID NO: 1158789 - RNA, 20 nt, Homo sapiens
ccuggcuggggccuguugaa

SEQ ID NO: 1158790 - RNA, 13 nt, Homo sapiens
ccugggacaucag

SEQ ID NO: 1158791 - RNA, 18 nt, Homo sapiens
ccugggaggaaauuugaa

SEQ ID NO: 1158792 - RNA, 16 nt, Homo sapiens
ccugggcaggugggag

SEQ ID NO: 1158793 - RNA, 23 nt, Homo sapiens
ccugggccacguaucaacaaucu

SEQ ID NO: 1158794 - RNA, 20 nt, Homo sapiens
ccugggccucagcaagccau

SEQ ID NO: 1158795 - RNA, 16 nt, Homo sapiens
ccugggggugccagga

SEQ ID NO: 1158796 - RNA, 18 nt, Homo sapiens
ccuggguaggccccacaa

SEQ ID NO: 1158797 - RNA, 18 nt, Homo sapiens
ccugggugacagagugag

SEQ ID NO: 1158798 - RNA, 16 nt, Homo sapiens
ccugguacucaagccc

SEQ ID NO: 1158799 - RNA, 12 nt, Homo sapiens
ccuggucacugg

SEQ ID NO: 1158800 - RNA, 16 nt, Homo sapiens
ccugguccacagggca

SEQ ID NO: 1158801 - RNA, 19 nt, Homo sapiens
ccuggugcucuaaugccaa

SEQ ID NO: 1158802 - RNA, 20 nt, Homo sapiens
ccugguucugucuagacugg

SEQ ID NO: 1158803 - RNA, 18 nt, Homo sapiens
ccuguaaucccagcauuu

SEQ ID NO: 1158804 - RNA, 17 nt, Homo sapiens
ccuguaaucucacuaca

SEQ ID NO: 1158805 - RNA, 16 nt, Homo sapiens
ccuguccacacccagc

SEQ ID NO: 1158806 - RNA, 21 nt, Homo sapiens
ccugucccccaucuucucugg

SEQ ID NO: 1158807 - RNA, 23 nt, Homo sapiens
ccuguccuccaacaccaagcaca

SEQ ID NO: 1158808 - RNA, 23 nt, Homo sapiens
ccugucgguggcugccuuugauc

SEQ ID NO: 1158809 - RNA, 23 nt, Homo sapiens
ccugucuaaagccuuaacuaaga

SEQ ID NO: 1158810 - RNA, 18 nt, Homo sapiens
ccugucuguuacacugga

SEQ ID NO: 1158811 - RNA, 17 nt, Homo sapiens
ccugugaacacuggagu

SEQ ID NO: 1158812 - RNA, 16 nt, Homo sapiens
ccugugcccaccaguu

SEQ ID NO: 1158813 - RNA, 17 nt, Homo sapiens
ccuguggccuuugcaau

SEQ ID NO: 1158814 - RNA, 18 nt, Homo sapiens
ccuguggucucugaccag

SEQ ID NO: 1158815 - RNA, 21 nt, Homo sapiens
ccugugguggccuggugcaca

SEQ ID NO: 1158816 - RNA, 20 nt, Homo sapiens
ccuguguguccaaaacugcc

SEQ ID NO: 1158817 - RNA, 20 nt, Homo sapiens
ccuguuacaaagcuguguug

SEQ ID NO: 1158818 - RNA, 23 nt, Homo sapiens
ccuguuagcuccucacuguggua

SEQ ID NO: 1158819 - RNA, 18 nt, Homo sapiens
ccuguucucguugcccua

SEQ ID NO: 1158820 - RNA, 18 nt, Homo sapiens
ccuguugagcaucacaga

SEQ ID NO: 1158821 - RNA, 22 nt, Homo sapiens
ccuguuuuaauucaacccagcc

SEQ ID NO: 1158822 - RNA, 17 nt, Homo sapiens
ccuguuuuaugcccuuc

SEQ ID NO: 1158823 - RNA, 19 nt, Homo sapiens
ccuguuuucuacagguuag

SEQ ID NO: 1158824 - RNA, 17 nt, Homo sapiens
ccuuaaacuuucaauau

SEQ ID NO: 1158825 - RNA, 21 nt, Homo sapiens
ccuuaagcccuggcccccuga

SEQ ID NO: 1158826 - RNA, 19 nt, Homo sapiens
ccuuaaugucaccaugcuu

SEQ ID NO: 1158827 - RNA, 22 nt, Homo sapiens
ccuuacaaauauuucagagcag

SEQ ID NO: 1158828 - RNA, 20 nt, Homo sapiens
ccuuacccaucuugcuucca

SEQ ID NO: 1158829 - RNA, 22 nt, Homo sapiens
ccuuagauguucuaagucuuuc

SEQ ID NO: 1158830 - RNA, 20 nt, Homo sapiens
ccuuagcugccaagccccau

SEQ ID NO: 1158831 - RNA, 23 nt, Homo sapiens
ccuuaggaauacuguuuuaucuc

SEQ ID NO: 1158832 - RNA, 20 nt, Homo sapiens
ccuuaugucuccugaccuga

SEQ ID NO: 1158833 - RNA, 20 nt, Homo sapiens
ccuuauuagagugucuuucc

SEQ ID NO: 1158834 - RNA, 18 nt, Homo sapiens
ccuuauucuacaucauua

SEQ ID NO: 1158835 - RNA, 16 nt, Homo sapiens
ccuuauugaacauucu

SEQ ID NO: 1158836 - RNA, 23 nt, Homo sapiens
ccuucaaucucguuuagugccaa

SEQ ID NO: 1158837 - RNA, 13 nt, Homo sapiens
cuaaugcucugaa

SEQ ID NO: 1158838 - RNA, 11 nt, Homo sapiens
cuaauucauuu

SEQ ID NO: 1158839 - RNA, 15 nt, Homo sapiens
cuaauugucacauca

SEQ ID NO: 1158840 - RNA, 23 nt, Homo sapiens
cuaauuuugugcucuuuccugcc

SEQ ID NO: 1158841 - RNA, 15 nt, Homo sapiens
cuacaacagccucac

SEQ ID NO: 1158842 - RNA, 17 nt, Homo sapiens
cuacaacauauggggug

SEQ ID NO: 1158843 - RNA, 22 nt, Homo sapiens
cuacaauaaacugguaugaaua

SEQ ID NO: 1158844 - RNA, 21 nt, Homo sapiens
cuacaauauuaacauaagaaa

SEQ ID NO: 1158845 - RNA, 13 nt, Homo sapiens
cuacaaugcacau

SEQ ID NO: 1158846 - RNA, 14 nt, Homo sapiens
cuacacaauuuaau

SEQ ID NO: 1158847 - RNA, 21 nt, Homo sapiens
cuacaccacacacaacagcca

SEQ ID NO: 1158848 - RNA, 14 nt, Homo sapiens
cuacacucuugacu

SEQ ID NO: 1158849 - RNA, 13 nt, Homo sapiens
cuacacugaugca

SEQ ID NO: 1158850 - RNA, 19 nt, Homo sapiens
cuacagggccacaacugcc

SEQ ID NO: 1158851 - RNA, 14 nt, Homo sapiens
cuacauaauuguga

SEQ ID NO: 1158852 - RNA, 22 nt, Homo sapiens
cuacaugaaugcaaaacauuuc

SEQ ID NO: 1158853 - RNA, 23 nt, Homo sapiens
cuacauuaguacacagcaccaga

SEQ ID NO: 1158854 - RNA, 18 nt, Homo sapiens
cuacauuuugcucuguga

SEQ ID NO: 1158855 - RNA, 18 nt, Homo sapiens
cuaccccauucucuagac

SEQ ID NO: 1158856 - RNA, 20 nt, Homo sapiens
cuacccccugugccuuguca

SEQ ID NO: 1158857 - RNA, 15 nt, Homo sapiens
cuaccccuuuacaaa

SEQ ID NO: 1158858 - RNA, 23 nt, Homo sapiens
cuacccuuaguauuuauuacuaa

SEQ ID NO: 1158859 - RNA, 15 nt, Homo sapiens
cuaccguaaaugucc

SEQ ID NO: 1158860 - RNA, 15 nt, Homo sapiens
cuaccuaccaagaua

SEQ ID NO: 1158861 - RNA, 13 nt, Homo sapiens
cuaccuagucucc

SEQ ID NO: 1158862 - RNA, 16 nt, Homo sapiens
cuaccucaaacuucca

SEQ ID NO: 1158863 - RNA, 19 nt, Homo sapiens
cuaccucucagcugcugaa

SEQ ID NO: 1158864 - RNA, 19 nt, Homo sapiens
cuaccuggccuuccugcca

SEQ ID NO: 1158865 - RNA, 18 nt, Homo sapiens
cuacgccuugucauugga

SEQ ID NO: 1158866 - RNA, 18 nt, Homo sapiens
cuacuaauccucucugca

SEQ ID NO: 1158867 - RNA, 15 nt, Homo sapiens
cuacuagccauuggg

SEQ ID NO: 1158868 - RNA, 17 nt, Homo sapiens
cuacuauauaugacugg

SEQ ID NO: 1158869 - RNA, 20 nt, Homo sapiens
cuacuccccagaccucaggg

SEQ ID NO: 1158870 - RNA, 14 nt, Homo sapiens
cuacucugagacaa

SEQ ID NO: 1158871 - RNA, 13 nt, Homo sapiens
cuacucugcaaac

SEQ ID NO: 1158872 - RNA, 14 nt, Homo sapiens
cuacugaccaaauu

SEQ ID NO: 1158873 - RNA, 14 nt, Homo sapiens
cuacugcucugugu

SEQ ID NO: 1158874 - RNA, 16 nt, Homo sapiens
cuacuguaaaccccaa

SEQ ID NO: 1158875 - RNA, 18 nt, Homo sapiens
cuacuguaaaccccaaga

SEQ ID NO: 1158876 - RNA, 13 nt, Homo sapiens
cuacuguggcaaa

SEQ ID NO: 1158877 - RNA, 22 nt, Homo sapiens
cuacugugucagggaacauauu

SEQ ID NO: 1158878 - RNA, 13 nt, Homo sapiens
cuagaaacagugu

SEQ ID NO: 1158879 - RNA, 16 nt, Homo sapiens
cuagaaaucuauuuau

SEQ ID NO: 1158880 - RNA, 18 nt, Homo sapiens
cuagaaaucuguccugug

SEQ ID NO: 1158881 - RNA, 23 nt, Homo sapiens
cuagaagugguuuccugauaaca

SEQ ID NO: 1158882 - RNA, 17 nt, Homo sapiens
cuagaauucugguguuu

SEQ ID NO: 1158883 - RNA, 22 nt, Homo sapiens
cuagacaccuucugugcucaug

SEQ ID NO: 1158884 - RNA, 18 nt, Homo sapiens
cuagacauggagguucua

SEQ ID NO: 1158885 - RNA, 18 nt, Homo sapiens
cuagacuuguguguucua

SEQ ID NO: 1158886 - RNA, 18 nt, Homo sapiens
cuagagaucuggcugugg

SEQ ID NO: 1158887 - RNA, 13 nt, Homo sapiens
cuagagaugugca

SEQ ID NO: 1158888 - RNA, 16 nt, Homo sapiens
cuagagcuacaggggu

SEQ ID NO: 1158889 - RNA, 18 nt, Homo sapiens
cuagagggagaagacugu

SEQ ID NO: 1158890 - RNA, 19 nt, Homo sapiens
cuagagggagaagacugug

SEQ ID NO: 1158891 - RNA, 13 nt, Homo sapiens
cuagagugcaaug

SEQ ID NO: 1158892 - RNA, 18 nt, Homo sapiens
cuagagugccuccagggu

SEQ ID NO: 1158893 - RNA, 20 nt, Homo sapiens
cuagauuaaaauauccuuuc

SEQ ID NO: 1158894 - RNA, 14 nt, Homo sapiens
cuagauuauaucaa

SEQ ID NO: 1158895 - RNA, 18 nt, Homo sapiens
cuagauucaaagguucua

SEQ ID NO: 1158896 - RNA, 23 nt, Homo sapiens
cuagcaaauggcagaaccaaagc

SEQ ID NO: 1158897 - RNA, 17 nt, Homo sapiens
cuagcaucucaugagug

SEQ ID NO: 1158898 - RNA, 21 nt, Homo sapiens
cuagcauguaaggccuuucaa

SEQ ID NO: 1158899 - RNA, 14 nt, Homo sapiens
cuagccagcaaaga

SEQ ID NO: 1158900 - RNA, 14 nt, Homo sapiens
cuagcccugggaca

SEQ ID NO: 1158901 - RNA, 17 nt, Homo sapiens
cuagcccugggacauca

SEQ ID NO: 1158902 - RNA, 13 nt, Homo sapiens
cuagcuaucaaga

SEQ ID NO: 1158903 - RNA, 17 nt, Homo sapiens
cuagcugcaagugacau

SEQ ID NO: 1158904 - RNA, 18 nt, Homo sapiens
cuaggauuugaacacuug

SEQ ID NO: 1158905 - RNA, 18 nt, Homo sapiens
cuaggcaaaagaaaagcu

SEQ ID NO: 1158906 - RNA, 13 nt, Homo sapiens
cuagggagccauu

SEQ ID NO: 1158907 - RNA, 22 nt, Homo sapiens
cuagggaggaccaaagggaugg

SEQ ID NO: 1158908 - RNA, 16 nt, Homo sapiens
cuagggccaagcccag

SEQ ID NO: 1158909 - RNA, 21 nt, Homo sapiens
cuaggugagaacccuugcacu

SEQ ID NO: 1158910 - RNA, 23 nt, Homo sapiens
cuagguuguuuuuaaaaccacua

SEQ ID NO: 1158911 - RNA, 22 nt, Homo sapiens
cuagucccuguguucugcacau

SEQ ID NO: 1158912 - RNA, 16 nt, Homo sapiens
cuaguccuuuacuaau

SEQ ID NO: 1158913 - RNA, 17 nt, Homo sapiens
cuagucucuacccagua

SEQ ID NO: 1158914 - RNA, 19 nt, Homo sapiens
cuagugagucagcaccuug

SEQ ID NO: 1158915 - RNA, 13 nt, Homo sapiens
cuagugggcaggu

SEQ ID NO: 1158916 - RNA, 14 nt, Homo sapiens
cuaguguaguauuc

SEQ ID NO: 1158917 - RNA, 13 nt, Homo sapiens
cuaguucugccag

SEQ ID NO: 1158918 - RNA, 17 nt, Homo sapiens
cuaguucugccaggaga

SEQ ID NO: 1158919 - RNA, 20 nt, Homo sapiens
cuaguucugccaggagacag

SEQ ID NO: 1158920 - RNA, 20 nt, Homo sapiens
cuaguuuugucaaacuguag

SEQ ID NO: 1158921 - RNA, 24 nt, Homo sapiens
cuauaaaguuuuauuugaaugaac

SEQ ID NO: 1158922 - RNA, 20 nt, Homo sapiens
cuauaaauagaugcugugua

SEQ ID NO: 1158923 - RNA, 15 nt, Homo sapiens
cuauaaauuuacucu

SEQ ID NO: 1158924 - RNA, 20 nt, Homo sapiens
cuauaauuuaaauauaugcu

SEQ ID NO: 1158925 - RNA, 23 nt, Homo sapiens
cuauagaaacaccaguaccugaa

SEQ ID NO: 1158926 - RNA, 17 nt, Homo sapiens
cuauaggaacauaugaa

SEQ ID NO: 1158927 - RNA, 14 nt, Homo sapiens
cuauaguauuugau

SEQ ID NO: 1158928 - RNA, 19 nt, Homo sapiens
cuauauguauguacuuuau

SEQ ID NO: 1158929 - RNA, 23 nt, Homo sapiens
cuaucaaagugucguaucuggga

SEQ ID NO: 1158930 - RNA, 13 nt, Homo sapiens
cuaucaguucccu

SEQ ID NO: 1158931 - RNA, 15 nt, Homo sapiens
cuaucauucugcucu

SEQ ID NO: 1158932 - RNA, 19 nt, Homo sapiens
cuaucccaacagucauguu

SEQ ID NO: 1158933 - RNA, 14 nt, Homo sapiens
cuaucccuuaccug

SEQ ID NO: 1158934 - RNA, 22 nt, Homo sapiens
cuaucggggucacuugcaauug

SEQ ID NO: 1158935 - RNA, 13 nt, Homo sapiens
cuaucucacugcu

SEQ ID NO: 1158936 - RNA, 23 nt, Homo sapiens
cuaucucagccauaggugcaguu

SEQ ID NO: 1158937 - RNA, 16 nt, Homo sapiens
cuaucuucuuuggacu

SEQ ID NO: 1158938 - RNA, 13 nt, Homo sapiens
cuaugaagacagg

SEQ ID NO: 1158939 - RNA, 17 nt, Homo sapiens
cuaugaauuuucaagua

SEQ ID NO: 1158940 - RNA, 18 nt, Homo sapiens
cuaugaggggguuuggca

SEQ ID NO: 1158941 - RNA, 19 nt, Homo sapiens
cuaugaggggguuuggcac

SEQ ID NO: 1158942 - RNA, 20 nt, Homo sapiens
cuaugauggaccagcccuga

SEQ ID NO: 1158943 - RNA, 22 nt, Homo sapiens
cuaugauucguguaauuacuua

SEQ ID NO: 1158944 - RNA, 14 nt, Homo sapiens
cuaugcauguguuu

SEQ ID NO: 1158945 - RNA, 12 nt, Homo sapiens
cuaugccuaaaa

SEQ ID NO: 1158946 - RNA, 18 nt, Homo sapiens
cuaugccugccucaaagg

SEQ ID NO: 1158947 - RNA, 20 nt, Homo sapiens
cuaugccuuuuacgagugcu

SEQ ID NO: 1158948 - RNA, 22 nt, Homo sapiens
cuaugcugggguacacagugag

SEQ ID NO: 1158949 - RNA, 16 nt, Homo sapiens
cuauggaguagccauu

SEQ ID NO: 1158950 - RNA, 22 nt, Homo sapiens
cuaugggagagugucaaccaga

SEQ ID NO: 1158951 - RNA, 19 nt, Homo sapiens
cuauggugagaugcagcug

SEQ ID NO: 1158952 - RNA, 23 nt, Homo sapiens
cuauguaauuguaacuauaccuc

SEQ ID NO: 1158953 - RNA, 20 nt, Homo sapiens
cuauguugucuuuuaaaaag

SEQ ID NO: 1158954 - RNA, 22 nt, Homo sapiens
cuauuaaagugcuaagguucua

SEQ ID NO: 1158955 - RNA, 15 nt, Homo sapiens
cuauuaaccauucua

SEQ ID NO: 1158956 - RNA, 18 nt, Homo sapiens
cuauuauaaaacuugaau

SEQ ID NO: 1158957 - RNA, 19 nt, Homo sapiens
cuauuccagcucauucauu

SEQ ID NO: 1158958 - RNA, 16 nt, Homo sapiens
cuauuccaguguccau

SEQ ID NO: 1158959 - RNA, 19 nt, Homo sapiens
cuauucccacuuucauuca

SEQ ID NO: 1158960 - RNA, 16 nt, Homo sapiens
cuauucucugccuuuu

SEQ ID NO: 1158961 - RNA, 18 nt, Homo sapiens
cuauucugagaaaacaag

SEQ ID NO: 1158962 - RNA, 18 nt, Homo sapiens
cuauugcucuuacuugaa

SEQ ID NO: 1158963 - RNA, 19 nt, Homo sapiens
cuauuucuucuacugcuau

SEQ ID NO: 1158964 - RNA, 13 nt, Homo sapiens
cuauuucuuuaaa

SEQ ID NO: 1158965 - RNA, 16 nt, Homo sapiens
cucaaacuuccaguca

SEQ ID NO: 1158966 - RNA, 18 nt, Homo sapiens
cucaaaucugagggagcu

SEQ ID NO: 1158967 - RNA, 18 nt, Homo sapiens
cucaacaauaaagacuga

SEQ ID NO: 1158968 - RNA, 13 nt, Homo sapiens
cucaacaccagac

SEQ ID NO: 1158969 - RNA, 16 nt, Homo sapiens
cugcauguaaacacgc

SEQ ID NO: 1158970 - RNA, 19 nt, Homo sapiens
cugcauguuguuuggaauu

SEQ ID NO: 1158971 - RNA, 20 nt, Homo sapiens
cugcauugagaacugcauau

SEQ ID NO: 1158972 - RNA, 22 nt, Homo sapiens
cugcauuuauagcauacgguau

SEQ ID NO: 1158973 - RNA, 14 nt, Homo sapiens
cugccaacuguccu

SEQ ID NO: 1158974 - RNA, 17 nt, Homo sapiens
cugccaagauacuugaa

SEQ ID NO: 1158975 - RNA, 18 nt, Homo sapiens
cugccaaguccugccuuu

SEQ ID NO: 1158976 - RNA, 19 nt, Homo sapiens
cugccaaguccugccuuug

SEQ ID NO: 1158977 - RNA, 22 nt, Homo sapiens
cugccacgccgcccuaaaagca

SEQ ID NO: 1158978 - RNA, 23 nt, Homo sapiens
cugccacucaggcccaaagccuc

SEQ ID NO: 1158979 - RNA, 16 nt, Homo sapiens
cugccagaggaugcuc

SEQ ID NO: 1158980 - RNA, 15 nt, Homo sapiens
cugccaggagcucuc

SEQ ID NO: 1158981 - RNA, 20 nt, Homo sapiens
cugccagugccuuaccuccu

SEQ ID NO: 1158982 - RNA, 17 nt, Homo sapiens
cugccaucaugccugac

SEQ ID NO: 1158983 - RNA, 21 nt, Homo sapiens
cugccaucuguuuuggcaaga

SEQ ID NO: 1158984 - RNA, 15 nt, Homo sapiens
cugccaugucacaau

SEQ ID NO: 1158985 - RNA, 23 nt, Homo sapiens
cugcccauuucauauucuuucaa

SEQ ID NO: 1158986 - RNA, 21 nt, Homo sapiens
cugcccuccucucccgucucg

SEQ ID NO: 1158987 - RNA, 17 nt, Homo sapiens
cugcccugcccaaguga

SEQ ID NO: 1158988 - RNA, 16 nt, Homo sapiens
cugcccuugucccacu

SEQ ID NO: 1158989 - RNA, 12 nt, Homo sapiens
cugccgacuccc

SEQ ID NO: 1158990 - RNA, 18 nt, Homo sapiens
cugccgagaguccaucag

SEQ ID NO: 1158991 - RNA, 22 nt, Homo sapiens
cugccuccuucccucggggcca

SEQ ID NO: 1158992 - RNA, 14 nt, Homo sapiens
cugccugcagagau

SEQ ID NO: 1158993 - RNA, 20 nt, Homo sapiens
cugccugcccguaaacacgc

SEQ ID NO: 1158994 - RNA, 20 nt, Homo sapiens
cugccuggagugcugugcug

SEQ ID NO: 1158995 - RNA, 17 nt, Homo sapiens
cugccugggacacugcg

SEQ ID NO: 1158996 - RNA, 12 nt, Homo sapiens
cugccuguaacu

SEQ ID NO: 1158997 - RNA, 18 nt, Homo sapiens
cugccuguugcgugacac

SEQ ID NO: 1158998 - RNA, 16 nt, Homo sapiens
cugccuucucagggac

SEQ ID NO: 1158999 - RNA, 22 nt, Homo sapiens
cugccuuguuuggauuggcacu

SEQ ID NO: 1159000 - RNA, 19 nt, Homo sapiens
cugccuuugcuuaagccau

SEQ ID NO: 1159001 - RNA, 21 nt, Homo sapiens
cugcgaacccaagcaaugggg

SEQ ID NO: 1159002 - RNA, 13 nt, Homo sapiens
cugcgcagcaucc

SEQ ID NO: 1159003 - RNA, 19 nt, Homo sapiens
cugcgcauguuuucuucau

SEQ ID NO: 1159004 - RNA, 18 nt, Homo sapiens
cugcgggcccgcacguuu

SEQ ID NO: 1159005 - RNA, 14 nt, Homo sapiens
cugcguccaccagg

SEQ ID NO: 1159006 - RNA, 12 nt, Homo sapiens
cugcuaaaugca

SEQ ID NO: 1159007 - RNA, 15 nt, Homo sapiens
cugcuacuugcucug

SEQ ID NO: 1159008 - RNA, 12 nt, Homo sapiens
cugcuauaacua

SEQ ID NO: 1159009 - RNA, 19 nt, Homo sapiens
cugcucaaugccauugugc

SEQ ID NO: 1159010 - RNA, 19 nt, Homo sapiens
cugcucacggaccccaugu

SEQ ID NO: 1159011 - RNA, 20 nt, Homo sapiens
cugcucccacacuugugcca

SEQ ID NO: 1159012 - RNA, 14 nt, Homo sapiens
cugcuccgcugccu

SEQ ID NO: 1159013 - RNA, 17 nt, Homo sapiens
cugcuccgcugccugga

SEQ ID NO: 1159014 - RNA, 14 nt, Homo sapiens
cugcucuaauauca

SEQ ID NO: 1159015 - RNA, 23 nt, Homo sapiens
cugcucuugugauguuugcucag

SEQ ID NO: 1159016 - RNA, 14 nt, Homo sapiens
cugcugaccuccac

SEQ ID NO: 1159017 - RNA, 18 nt, Homo sapiens
cugcugagagggcugcug

SEQ ID NO: 1159018 - RNA, 16 nt, Homo sapiens
cugcugagaguacugu

SEQ ID NO: 1159019 - RNA, 23 nt, Homo sapiens
cugcugcgcguggugcugagucu

SEQ ID NO: 1159020 - RNA, 18 nt, Homo sapiens
cugcuggcuggugccuga

SEQ ID NO: 1159021 - RNA, 15 nt, Homo sapiens
cugcuguugaacuuu

SEQ ID NO: 1159022 - RNA, 19 nt, Homo sapiens
cugcuuaguagcuuuggaa

SEQ ID NO: 1159023 - RNA, 17 nt, Homo sapiens
cugcuuccuggcuccuu

SEQ ID NO: 1159024 - RNA, 14 nt, Homo sapiens
cugcuugaccaaag

SEQ ID NO: 1159025 - RNA, 15 nt, Homo sapiens
cugcuugaccaaaga

SEQ ID NO: 1159026 - RNA, 16 nt, Homo sapiens
cugcuugaccaaagag

SEQ ID NO: 1159027 - RNA, 22 nt, Homo sapiens
cugcuugaggaaaacaagcauu

SEQ ID NO: 1159028 - RNA, 22 nt, Homo sapiens
cugcuuggguggagaagccauu

SEQ ID NO: 1159029 - RNA, 16 nt, Homo sapiens
cugcuuguacuaagcc

SEQ ID NO: 1159030 - RNA, 18 nt, Homo sapiens
cugcuuuaaacugcauuu

SEQ ID NO: 1159031 - RNA, 16 nt, Homo sapiens
cugcuuugacgggcca

SEQ ID NO: 1159032 - RNA, 23 nt, Homo sapiens
cuggaaaagggucuugggaaaua

SEQ ID NO: 1159033 - RNA, 20 nt, Homo sapiens
cuggaaauagcccuguaaca

SEQ ID NO: 1159034 - RNA, 22 nt, Homo sapiens
cuggaacaccagcagcacugga

SEQ ID NO: 1159035 - RNA, 12 nt, Homo sapiens
cuggaacccaga

SEQ ID NO: 1159036 - RNA, 13 nt, Homo sapiens
cuggaacccagga

SEQ ID NO: 1159037 - RNA, 14 nt, Homo sapiens
cuggaagaagcagc

SEQ ID NO: 1159038 - RNA, 16 nt, Homo sapiens
cuggaagcacuacaga

SEQ ID NO: 1159039 - RNA, 22 nt, Homo sapiens
cuggaaucacauucuuagcaca

SEQ ID NO: 1159040 - RNA, 17 nt, Homo sapiens
cuggaaugccaauguca

SEQ ID NO: 1159041 - RNA, 22 nt, Homo sapiens
cuggaauguaaguaagugacaa

SEQ ID NO: 1159042 - RNA, 16 nt, Homo sapiens
cuggaauuacaaaacu

SEQ ID NO: 1159043 - RNA, 12 nt, Homo sapiens
cuggacugaccu

SEQ ID NO: 1159044 - RNA, 19 nt, Homo sapiens
cuggagcaaccuacugucu

SEQ ID NO: 1159045 - RNA, 17 nt, Homo sapiens
cuggagccccacugccc

SEQ ID NO: 1159046 - RNA, 23 nt, Homo sapiens
cuggagcucuugugucauuguua

SEQ ID NO: 1159047 - RNA, 17 nt, Homo sapiens
cuggaggagcugugcug

SEQ ID NO: 1159048 - RNA, 22 nt, Homo sapiens
cuggaggcccaguucacccuga

SEQ ID NO: 1159049 - RNA, 12 nt, Homo sapiens
cuggagggauuc

SEQ ID NO: 1159050 - RNA, 22 nt, Homo sapiens
cuggagggcaguggcacgaucu

SEQ ID NO: 1159051 - RNA, 20 nt, Homo sapiens
cuggaguacaguggugccau

SEQ ID NO: 1159052 - RNA, 14 nt, Homo sapiens
cuggagugcaaugg

SEQ ID NO: 1159053 - RNA, 20 nt, Homo sapiens
cuggagugcaauggugugau

SEQ ID NO: 1159054 - RNA, 19 nt, Homo sapiens
cuggagugcaguggcgcau

SEQ ID NO: 1159055 - RNA, 21 nt, Homo sapiens
cuggagugcaguggugcaauc

SEQ ID NO: 1159056 - RNA, 20 nt, Homo sapiens
cuggagugcugugcuguguu

SEQ ID NO: 1159057 - RNA, 18 nt, Homo sapiens
cuggaguggccacuaagc

SEQ ID NO: 1159058 - RNA, 22 nt, Homo sapiens
cuggaguugaucuggaacccag

SEQ ID NO: 1159059 - RNA, 21 nt, Homo sapiens
cuggaguuucauguacaagau

SEQ ID NO: 1159060 - RNA, 21 nt, Homo sapiens
cuggauauucgguaauaucau

SEQ ID NO: 1159061 - RNA, 17 nt, Homo sapiens
cuggaucccguucagaa

SEQ ID NO: 1159062 - RNA, 15 nt, Homo sapiens
cuggaucuaccagca

SEQ ID NO: 1159063 - RNA, 20 nt, Homo sapiens
cuggaucuugugacccucca

SEQ ID NO: 1159064 - RNA, 21 nt, Homo sapiens
cuggauucacuuggauucuga

SEQ ID NO: 1159065 - RNA, 22 nt, Homo sapiens
cuggcaagaaagcuugagucuc

SEQ ID NO: 1159066 - RNA, 21 nt, Homo sapiens
cuggcacucuuguucccacac

SEQ ID NO: 1159067 - RNA, 20 nt, Homo sapiens
cuggcagggggugaaggcag

SEQ ID NO: 1159068 - RNA, 14 nt, Homo sapiens
cuggcaugcagcua

SEQ ID NO: 1159069 - RNA, 23 nt, Homo sapiens
cuggccacccaaacaggacaaga

SEQ ID NO: 1159070 - RNA, 18 nt, Homo sapiens
cuggccacugaaaagcuu

SEQ ID NO: 1159071 - RNA, 19 nt, Homo sapiens
cuggccaguccugguccug

SEQ ID NO: 1159072 - RNA, 15 nt, Homo sapiens
cuggcccacccaguc

SEQ ID NO: 1159073 - RNA, 18 nt, Homo sapiens
cuggccccugagaucucu

SEQ ID NO: 1159074 - RNA, 22 nt, Homo sapiens
cuggccccuuugggcccugcau

SEQ ID NO: 1159075 - RNA, 18 nt, Homo sapiens
cuggccucaagugagcca

SEQ ID NO: 1159076 - RNA, 19 nt, Homo sapiens
cuggccuccaggcccgucu

SEQ ID NO: 1159077 - RNA, 12 nt, Homo sapiens
cuggccuggucc

SEQ ID NO: 1159078 - RNA, 17 nt, Homo sapiens
cuggcgacacucagggc

SEQ ID NO: 1159079 - RNA, 16 nt, Homo sapiens
cuggcggguggcugca

SEQ ID NO: 1159080 - RNA, 23 nt, Homo sapiens
cuggcggguggcugcaagcccac

SEQ ID NO: 1159081 - RNA, 18 nt, Homo sapiens
cuggcucaagcccugaau

SEQ ID NO: 1159082 - RNA, 20 nt, Homo sapiens
cuggcucccucuucuuucag

SEQ ID NO: 1159083 - RNA, 15 nt, Homo sapiens
cuggcuggugccuga

SEQ ID NO: 1159084 - RNA, 15 nt, Homo sapiens
cuggcugguggaaca

SEQ ID NO: 1159085 - RNA, 20 nt, Homo sapiens
cuggcuguggccuaaccugc

SEQ ID NO: 1159086 - RNA, 15 nt, Homo sapiens
cuggcuucacauucu

SEQ ID NO: 1159087 - RNA, 16 nt, Homo sapiens
cuggcuuguuguaaag

SEQ ID NO: 1159088 - RNA, 18 nt, Homo sapiens
cuggcuuuguucuuguca

SEQ ID NO: 1159089 - RNA, 12 nt, Homo sapiens
cugggaacuggu

SEQ ID NO: 1159090 - RNA, 15 nt, Homo sapiens
cugggacucauucac

SEQ ID NO: 1159091 - RNA, 22 nt, Homo sapiens
cugggagcccggcaacucuagu

SEQ ID NO: 1159092 - RNA, 17 nt, Homo sapiens
cugggagcccucaggca

SEQ ID NO: 1159093 - RNA, 16 nt, Homo sapiens
cugggagccuacccac

SEQ ID NO: 1159094 - RNA, 16 nt, Homo sapiens
cugggagucacacagu

SEQ ID NO: 1159095 - RNA, 16 nt, Homo sapiens
cugggauuacaggugu

SEQ ID NO: 1159096 - RNA, 20 nt, Homo sapiens
cugggauuacaggugugcac

SEQ ID NO: 1159097 - RNA, 22 nt, Homo sapiens
cugggauuauaggcaugagcca

SEQ ID NO: 1159098 - RNA, 17 nt, Homo sapiens
cugggauuucuaugcag

SEQ ID NO: 1159099 - RNA, 15 nt, Homo sapiens
cugggcagagccugu

SEQ ID NO: 1159100 - RNA, 12 nt, Homo sapiens
cuguuacugugu

SEQ ID NO: 1159101 - RNA, 17 nt, Homo sapiens
cuguuaugucagaggaa

SEQ ID NO: 1159102 - RNA, 15 nt, Homo sapiens
cuguuauucuuguua

SEQ ID NO: 1159103 - RNA, 13 nt, Homo sapiens
cuguucagccuuu

SEQ ID NO: 1159104 - RNA, 23 nt, Homo sapiens
cuguucaguguaaauaguuacuc

SEQ ID NO: 1159105 - RNA, 15 nt, Homo sapiens
cuguuccaugucucc

SEQ ID NO: 1159106 - RNA, 15 nt, Homo sapiens
cuguuccccagagaa

SEQ ID NO: 1159107 - RNA, 16 nt, Homo sapiens
cuguucugaugccacc

SEQ ID NO: 1159108 - RNA, 21 nt, Homo sapiens
cuguucuguagcuuucuggaa

SEQ ID NO: 1159109 - RNA, 14 nt, Homo sapiens
cuguucuguggaaa

SEQ ID NO: 1159110 - RNA, 17 nt, Homo sapiens
cuguucuuguauuguau

SEQ ID NO: 1159111 - RNA, 19 nt, Homo sapiens
cuguugaacaauaaguaaa

SEQ ID NO: 1159112 - RNA, 22 nt, Homo sapiens
cuguugacuggcugugugaccu

SEQ ID NO: 1159113 - RNA, 21 nt, Homo sapiens
cuguugaugguaggcuguaua

SEQ ID NO: 1159114 - RNA, 19 nt, Homo sapiens
cuguugauucgucugcgau

SEQ ID NO: 1159115 - RNA, 23 nt, Homo sapiens
cuguugcacuuuugaauguccaa

SEQ ID NO: 1159116 - RNA, 12 nt, Homo sapiens
cuguugcuauuu

SEQ ID NO: 1159117 - RNA, 23 nt, Homo sapiens
cuguuggcguggggccuuuguca

SEQ ID NO: 1159118 - RNA, 17 nt, Homo sapiens
cuguuuagguacugaag

SEQ ID NO: 1159119 - RNA, 16 nt, Homo sapiens
cuguuucacuugcucu

SEQ ID NO: 1159120 - RNA, 21 nt, Homo sapiens
cuguuuccuacagacacccau

SEQ ID NO: 1159121 - RNA, 13 nt, Homo sapiens
cuguuucuguaua

SEQ ID NO: 1159122 - RNA, 16 nt, Homo sapiens
cuguuugcucacguga

SEQ ID NO: 1159123 - RNA, 14 nt, Homo sapiens
cuguuugucucacc

SEQ ID NO: 1159124 - RNA, 18 nt, Homo sapiens
cuguuuucaacauuguau

SEQ ID NO: 1159125 - RNA, 17 nt, Homo sapiens
cuguuuucguaccuucc

SEQ ID NO: 1159126 - RNA, 20 nt, Homo sapiens
cuguuuucugggccagugag

SEQ ID NO: 1159127 - RNA, 19 nt, Homo sapiens
cuguuuuugucuacacucu

SEQ ID NO: 1159128 - RNA, 23 nt, Homo sapiens
cuuaaaaaaauagaaauuauucu

SEQ ID NO: 1159129 - RNA, 21 nt, Homo sapiens
cuuaaaaauauauuuccucau

SEQ ID NO: 1159130 - RNA, 14 nt, Homo sapiens
cuuaaaauugauau

SEQ ID NO: 1159131 - RNA, 20 nt, Homo sapiens
cuuaaacucucuucuuccau

SEQ ID NO: 1159132 - RNA, 13 nt, Homo sapiens
cuuaaacuuucaa

SEQ ID NO: 1159133 - RNA, 20 nt, Homo sapiens
cuuaaaguuugcaguauucu

SEQ ID NO: 1159134 - RNA, 23 nt, Homo sapiens
cuuaaaucuuaaaaguguuguua

SEQ ID NO: 1159135 - RNA, 15 nt, Homo sapiens
cuuaaaugcuacuga

SEQ ID NO: 1159136 - RNA, 22 nt, Homo sapiens
cuuaaaugcuacugaaacuuac

SEQ ID NO: 1159137 - RNA, 15 nt, Homo sapiens
cuuaaauuuuaguuc

SEQ ID NO: 1159138 - RNA, 12 nt, Homo sapiens
cuuaacauucau

SEQ ID NO: 1159139 - RNA, 15 nt, Homo sapiens
cuuaacauucauaga

SEQ ID NO: 1159140 - RNA, 16 nt, Homo sapiens
cuuaagaaagugucuc

SEQ ID NO: 1159141 - RNA, 14 nt, Homo sapiens
cuuaagaguagcug

SEQ ID NO: 1159142 - RNA, 14 nt, Homo sapiens
cuuaagauuugcuc

SEQ ID NO: 1159143 - RNA, 18 nt, Homo sapiens
cuuaaggacaaagugcca

SEQ ID NO: 1159144 - RNA, 20 nt, Homo sapiens
cuuaaggacaaagugccaaa

SEQ ID NO: 1159145 - RNA, 16 nt, Homo sapiens
cuuaauacuaccuuga

SEQ ID NO: 1159146 - RNA, 17 nt, Homo sapiens
cuuaaugaaccuuagaa

SEQ ID NO: 1159147 - RNA, 19 nt, Homo sapiens
cuuaauguugaaugcugcu

SEQ ID NO: 1159148 - RNA, 14 nt, Homo sapiens
cuuaauucaaauaa

SEQ ID NO: 1159149 - RNA, 18 nt, Homo sapiens
cuuaauugugaacagcca

SEQ ID NO: 1159150 - RNA, 12 nt, Homo sapiens
cuuacagaacaa

SEQ ID NO: 1159151 - RNA, 17 nt, Homo sapiens
cuuacagucagcacaga

SEQ ID NO: 1159152 - RNA, 14 nt, Homo sapiens
cuuaccacugugga

SEQ ID NO: 1159153 - RNA, 18 nt, Homo sapiens
cuuaccagaagcuuccau

SEQ ID NO: 1159154 - RNA, 21 nt, Homo sapiens
cuuaccagggccucaguuuca

SEQ ID NO: 1159155 - RNA, 23 nt, Homo sapiens
cuuaccuggaggcucaccuugca

SEQ ID NO: 1159156 - RNA, 21 nt, Homo sapiens
cuuacgaucaggcacagguca

SEQ ID NO: 1159157 - RNA, 14 nt, Homo sapiens
cuuacuaaauauca

SEQ ID NO: 1159158 - RNA, 13 nt, Homo sapiens
cuuacuggugcua

SEQ ID NO: 1159159 - RNA, 20 nt, Homo sapiens
cuuacuuucuuuacauacca

SEQ ID NO: 1159160 - RNA, 15 nt, Homo sapiens
cuuacuuugugcaaa

SEQ ID NO: 1159161 - RNA, 22 nt, Homo sapiens
cuuagauauuucaugugcuaua

SEQ ID NO: 1159162 - RNA, 18 nt, Homo sapiens
cuuagaucugguguccag

SEQ ID NO: 1159163 - RNA, 18 nt, Homo sapiens
cuuagcagcccagcauuu

SEQ ID NO: 1159164 - RNA, 21 nt, Homo sapiens
cuuagcaugaauccuacauac

SEQ ID NO: 1159165 - RNA, 20 nt, Homo sapiens
cuuagcaugugacuccugaa

SEQ ID NO: 1159166 - RNA, 12 nt, Homo sapiens
cuuagcuacuug

SEQ ID NO: 1159167 - RNA, 18 nt, Homo sapiens
cuuaggcauucuaaguca

SEQ ID NO: 1159168 - RNA, 15 nt, Homo sapiens
cuuaggccagugaug

SEQ ID NO: 1159169 - RNA, 23 nt, Homo sapiens
cuuaggccuuccucucuccagau

SEQ ID NO: 1159170 - RNA, 17 nt, Homo sapiens
cuuaggucgccauuccc

SEQ ID NO: 1159171 - RNA, 17 nt, Homo sapiens
cuuaguauuaacagaaa

SEQ ID NO: 1159172 - RNA, 19 nt, Homo sapiens
cuuauaagaaagaucaaag

SEQ ID NO: 1159173 - RNA, 16 nt, Homo sapiens
cuuauagaaaguucaa

SEQ ID NO: 1159174 - RNA, 17 nt, Homo sapiens
cuuauauucagucugug

SEQ ID NO: 1159175 - RNA, 16 nt, Homo sapiens
cuuaucagugccauga

SEQ ID NO: 1159176 - RNA, 22 nt, Homo sapiens
cuuauccuguucuauaacaguu

SEQ ID NO: 1159177 - RNA, 22 nt, Homo sapiens
cuuaucucccugcuucauaucu

SEQ ID NO: 1159178 - RNA, 19 nt, Homo sapiens
cuuaugacuuuucaugcag

SEQ ID NO: 1159179 - RNA, 22 nt, Homo sapiens
cuuaugaguauaaugaacacuc

SEQ ID NO: 1159180 - RNA, 14 nt, Homo sapiens
cuuauggcaucuca

SEQ ID NO: 1159181 - RNA, 20 nt, Homo sapiens
cuuauuaaaaaucuaacaaa

SEQ ID NO: 1159182 - RNA, 21 nt, Homo sapiens
cuuauuaacaauuaggcagac

SEQ ID NO: 1159183 - RNA, 15 nt, Homo sapiens
cuuauugaacauucu

SEQ ID NO: 1159184 - RNA, 17 nt, Homo sapiens
cuuauugaacauucuag

SEQ ID NO: 1159185 - RNA, 15 nt, Homo sapiens
cuuauuguggauaac

SEQ ID NO: 1159186 - RNA, 19 nt, Homo sapiens
cuucaaagaggaaccagga

SEQ ID NO: 1159187 - RNA, 18 nt, Homo sapiens
cuucaaagcaagcuggua

SEQ ID NO: 1159188 - RNA, 16 nt, Homo sapiens
cuucaacaugucacac

SEQ ID NO: 1159189 - RNA, 21 nt, Homo sapiens
cuucaagaacccugacuccuc

SEQ ID NO: 1159190 - RNA, 14 nt, Homo sapiens
cuucaagccaaguc

SEQ ID NO: 1159191 - RNA, 18 nt, Homo sapiens
cuucaagccugugcaaug

SEQ ID NO: 1159192 - RNA, 20 nt, Homo sapiens
cuucaagggacaaguauuaa

SEQ ID NO: 1159193 - RNA, 13 nt, Homo sapiens
cuucaauacuuaa

SEQ ID NO: 1159194 - RNA, 14 nt, Homo sapiens
cuucaauacuuaaa

SEQ ID NO: 1159195 - RNA, 19 nt, Homo sapiens
cuucaauuaaaauuacaaa

SEQ ID NO: 1159196 - RNA, 15 nt, Homo sapiens
cuucacagauuuguc

SEQ ID NO: 1159197 - RNA, 17 nt, Homo sapiens
cuucacagugacacugg

SEQ ID NO: 1159198 - RNA, 17 nt, Homo sapiens
cuucacccagagccagu

SEQ ID NO: 1159199 - RNA, 22 nt, Homo sapiens
cuucacuguccuccaagccagc

SEQ ID NO: 1159200 - RNA, 16 nt, Homo sapiens
cuucagacucauggau

SEQ ID NO: 1159201 - RNA, 23 nt, Homo sapiens
cuucagagaaaucugcauucuau

SEQ ID NO: 1159202 - RNA, 22 nt, Homo sapiens
cuucagagaucauggaacacaa

SEQ ID NO: 1159203 - RNA, 16 nt, Homo sapiens
cuucagaguaucuaau

SEQ ID NO: 1159204 - RNA, 16 nt, Homo sapiens
cuucagcagcagcuca

SEQ ID NO: 1159205 - RNA, 12 nt, Homo sapiens
cuucaguguccu

SEQ ID NO: 1159206 - RNA, 14 nt, Homo sapiens
cuucaguuaauucu

SEQ ID NO: 1159207 - RNA, 23 nt, Homo sapiens
cuucaucauucccucucaucuca

SEQ ID NO: 1159208 - RNA, 19 nt, Homo sapiens
cuucaucuucacugcaauu

SEQ ID NO: 1159209 - RNA, 21 nt, Homo sapiens
cuucaugaucaucacaaucau

SEQ ID NO: 1159210 - RNA, 14 nt, Homo sapiens
cuucauucugcaag

SEQ ID NO: 1159211 - RNA, 22 nt, Homo sapiens
cuuccaaagagaguuaaaagca

SEQ ID NO: 1159212 - RNA, 12 nt, Homo sapiens
cuuccaccucac

SEQ ID NO: 1159213 - RNA, 23 nt, Homo sapiens
cuuccagcauuuagcuggccaca

SEQ ID NO: 1159214 - RNA, 17 nt, Homo sapiens
cuuccagccuaggccug

SEQ ID NO: 1159215 - RNA, 15 nt, Homo sapiens
cuuccagggcuacgc

SEQ ID NO: 1159216 - RNA, 21 nt, Homo sapiens
cuuccauuucguuuagcugaa

SEQ ID NO: 1159217 - RNA, 21 nt, Homo sapiens
cuucccacggcuccucgagau

SEQ ID NO: 1159218 - RNA, 13 nt, Homo sapiens
cuucccguucuua

SEQ ID NO: 1159219 - RNA, 19 nt, Homo sapiens
cuucccucggggccauacu

SEQ ID NO: 1159220 - RNA, 18 nt, Homo sapiens
cuucccugacucuucaag

SEQ ID NO: 1159221 - RNA, 14 nt, Homo sapiens
cuucccugccccug

SEQ ID NO: 1159222 - RNA, 21 nt, Homo sapiens
cuucccuggcuuguaacucca

SEQ ID NO: 1159223 - RNA, 17 nt, Homo sapiens
cuucccuuuuaaacaca

SEQ ID NO: 1159224 - RNA, 20 nt, Homo sapiens
cuuccgcggugcaggugcag

SEQ ID NO: 1159225 - RNA, 13 nt, Homo sapiens
cuuccuaaucacc

SEQ ID NO: 1159226 - RNA, 18 nt, Homo sapiens
cuuccucucucaggggug

SEQ ID NO: 1159227 - RNA, 13 nt, Homo sapiens
cuuccucuuggcu

SEQ ID NO: 1159228 - RNA, 21 nt, Homo sapiens
cuuccugcccuuuccuuccuu

SEQ ID NO: 1159229 - RNA, 17 nt, Homo sapiens
cuuccuggcuucuuacu

SEQ ID NO: 1159230 - RNA, 16 nt, Homo sapiens
cuuccuguucugugac

SEQ ID NO: 1159231 - RNA, 16 nt, Homo sapiens
cuuccuuaugucucca

SEQ ID NO: 1159232 - RNA, 17 nt, Homo sapiens
gcccuuccuugccagug

SEQ ID NO: 1159233 - RNA, 15 nt, Homo sapiens
gcccuucuaggcaaa

SEQ ID NO: 1159234 - RNA, 18 nt, Homo sapiens
gcccuuguccccaugaaa

SEQ ID NO: 1159235 - RNA, 20 nt, Homo sapiens
gcccuuucauggucugcuga

SEQ ID NO: 1159236 - RNA, 13 nt, Homo sapiens
gcccuuugcaucg

SEQ ID NO: 1159237 - RNA, 16 nt, Homo sapiens
gcccuuuggccaguga

SEQ ID NO: 1159238 - RNA, 19 nt, Homo sapiens
gcccuuuuauacuaggacu

SEQ ID NO: 1159239 - RNA, 12 nt, Homo sapiens
gccgacacuguu

SEQ ID NO: 1159240 - RNA, 13 nt, Homo sapiens
gccgaccuuagau

SEQ ID NO: 1159241 - RNA, 19 nt, Homo sapiens
gccgcaaaccacacuggac

SEQ ID NO: 1159242 - RNA, 14 nt, Homo sapiens
gccgcggcccagac

SEQ ID NO: 1159243 - RNA, 17 nt, Homo sapiens
gccggcugugcucagag

SEQ ID NO: 1159244 - RNA, 18 nt, Homo sapiens
gccgggcccccaccgccg

SEQ ID NO: 1159245 - RNA, 20 nt, Homo sapiens
gccggugugccugacugccc

SEQ ID NO: 1159246 - RNA, 19 nt, Homo sapiens
gccguguguuuagaagccu

SEQ ID NO: 1159247 - RNA, 17 nt, Homo sapiens
gccuaaaugcacaguca

SEQ ID NO: 1159248 - RNA, 20 nt, Homo sapiens
gccuaauaggcaccucuuca

SEQ ID NO: 1159249 - RNA, 22 nt, Homo sapiens
gccuacauguucucaugcaugu

SEQ ID NO: 1159250 - RNA, 19 nt, Homo sapiens
gccuagacuuguguguucu

SEQ ID NO: 1159251 - RNA, 14 nt, Homo sapiens
gccuaggauuucag

SEQ ID NO: 1159252 - RNA, 19 nt, Homo sapiens
gccuauaaauaaauuccaa

SEQ ID NO: 1159253 - RNA, 19 nt, Homo sapiens
gccuaugcacauauggacu

SEQ ID NO: 1159254 - RNA, 22 nt, Homo sapiens
gccuauggaguagccauucuau

SEQ ID NO: 1159255 - RNA, 14 nt, Homo sapiens
gccucaagaucaau

SEQ ID NO: 1159256 - RNA, 13 nt, Homo sapiens
gccucaaguucca

SEQ ID NO: 1159257 - RNA, 17 nt, Homo sapiens
gccucaaguuccagugc

SEQ ID NO: 1159258 - RNA, 13 nt, Homo sapiens
gccucacaucucc

SEQ ID NO: 1159259 - RNA, 12 nt, Homo sapiens
gccucacuuuua

SEQ ID NO: 1159260 - RNA, 17 nt, Homo sapiens
gccucagcccugacccu

SEQ ID NO: 1159261 - RNA, 14 nt, Homo sapiens
gccucaggcacucu

SEQ ID NO: 1159262 - RNA, 16 nt, Homo sapiens
gccucaggcacucucc

SEQ ID NO: 1159263 - RNA, 12 nt, Homo sapiens
gccucagugaaa

SEQ ID NO: 1159264 - RNA, 22 nt, Homo sapiens
gccucauuauuuuucacugccc

SEQ ID NO: 1159265 - RNA, 23 nt, Homo sapiens
gccucauuauuuuucacugcccc

SEQ ID NO: 1159266 - RNA, 16 nt, Homo sapiens
gccuccagaagcacug

SEQ ID NO: 1159267 - RNA, 19 nt, Homo sapiens
gccuccagaagcacuggga

SEQ ID NO: 1159268 - RNA, 14 nt, Homo sapiens
gccuccauccaucu

SEQ ID NO: 1159269 - RNA, 18 nt, Homo sapiens
gccucccacuggggucca

SEQ ID NO: 1159270 - RNA, 16 nt, Homo sapiens
gccucccauccagggc

SEQ ID NO: 1159271 - RNA, 18 nt, Homo sapiens
gccuccuauccaccacug

SEQ ID NO: 1159272 - RNA, 20 nt, Homo sapiens
gccuccuccagaauggagcu

SEQ ID NO: 1159273 - RNA, 22 nt, Homo sapiens
gccuccucucucccugccucac

SEQ ID NO: 1159274 - RNA, 22 nt, Homo sapiens
gccuccugauguuuguaucaua

SEQ ID NO: 1159275 - RNA, 18 nt, Homo sapiens
gccuccuggcccagguga

SEQ ID NO: 1159276 - RNA, 19 nt, Homo sapiens
gccuccugguaacagcuau

SEQ ID NO: 1159277 - RNA, 20 nt, Homo sapiens
gccuccugugacuggcagca

SEQ ID NO: 1159278 - RNA, 13 nt, Homo sapiens
gccuccuugccag

SEQ ID NO: 1159279 - RNA, 13 nt, Homo sapiens
gccucgacacaga

SEQ ID NO: 1159280 - RNA, 23 nt, Homo sapiens
gccucgaggugccuucuucaggg

SEQ ID NO: 1159281 - RNA, 18 nt, Homo sapiens
gccucgcccccacuuuuc

SEQ ID NO: 1159282 - RNA, 14 nt, Homo sapiens
gccucuacuuuauc

SEQ ID NO: 1159283 - RNA, 14 nt, Homo sapiens
gccucucucaggag

SEQ ID NO: 1159284 - RNA, 23 nt, Homo sapiens
gccucucuucacugcuacaugug

SEQ ID NO: 1159285 - RNA, 14 nt, Homo sapiens
gccucugaagccua

SEQ ID NO: 1159286 - RNA, 17 nt, Homo sapiens
gccucugccuuugcacc

SEQ ID NO: 1159287 - RNA, 14 nt, Homo sapiens
gccucugugccuuc

SEQ ID NO: 1159288 - RNA, 13 nt, Homo sapiens
gccugacaacuca

SEQ ID NO: 1159289 - RNA, 22 nt, Homo sapiens
gccugacuuggggagauggagu

SEQ ID NO: 1159290 - RNA, 18 nt, Homo sapiens
gccugagcaacaugguga

SEQ ID NO: 1159291 - RNA, 20 nt, Homo sapiens
gccugagcaacucuugauua

SEQ ID NO: 1159292 - RNA, 17 nt, Homo sapiens
gccugagguuugccagc

SEQ ID NO: 1159293 - RNA, 19 nt, Homo sapiens
gccugaucugcacauuuca

SEQ ID NO: 1159294 - RNA, 16 nt, Homo sapiens
gccugaugagacucca

SEQ ID NO: 1159295 - RNA, 20 nt, Homo sapiens
gccugcauguaaacacgccu

SEQ ID NO: 1159296 - RNA, 21 nt, Homo sapiens
gccugcccgccuccuauagca

SEQ ID NO: 1159297 - RNA, 23 nt, Homo sapiens
gccugcccuccucucccgucucg

SEQ ID NO: 1159298 - RNA, 20 nt, Homo sapiens
gccugccgguaaacacgccu

SEQ ID NO: 1159299 - RNA, 14 nt, Homo sapiens
gccugccuaugaaa

SEQ ID NO: 1159300 - RNA, 22 nt, Homo sapiens
gccugcuauuugaaguguaauu

SEQ ID NO: 1159301 - RNA, 13 nt, Homo sapiens
gccugcugugcug

SEQ ID NO: 1159302 - RNA, 22 nt, Homo sapiens
gccuggaccccuggaccgcuuu

SEQ ID NO: 1159303 - RNA, 22 nt, Homo sapiens
gccuggacuagagggaccucuc

SEQ ID NO: 1159304 - RNA, 13 nt, Homo sapiens
gccuggacugcua

SEQ ID NO: 1159305 - RNA, 21 nt, Homo sapiens
gccuggagcccuccgccuuca

SEQ ID NO: 1159306 - RNA, 13 nt, Homo sapiens
gccuggccagucc

SEQ ID NO: 1159307 - RNA, 19 nt, Homo sapiens
gccugggauuucuaugcag

SEQ ID NO: 1159308 - RNA, 16 nt, Homo sapiens
gccugggccccggaaa

SEQ ID NO: 1159309 - RNA, 23 nt, Homo sapiens
gccugggguggggucaugcccuc

SEQ ID NO: 1159310 - RNA, 13 nt, Homo sapiens
gccuguaacagcc

SEQ ID NO: 1159311 - RNA, 22 nt, Homo sapiens
gccuguaaucccaacacuuugg

SEQ ID NO: 1159312 - RNA, 19 nt, Homo sapiens
gccuguaaucccagcacuu

SEQ ID NO: 1159313 - RNA, 20 nt, Homo sapiens
gccuguaaucccagcacuuu

SEQ ID NO: 1159314 - RNA, 19 nt, Homo sapiens
gccuguaaucucacuacac

SEQ ID NO: 1159315 - RNA, 12 nt, Homo sapiens
gccuguacccag

SEQ ID NO: 1159316 - RNA, 20 nt, Homo sapiens
gccuguagucucagcuaguu

SEQ ID NO: 1159317 - RNA, 14 nt, Homo sapiens
gccugucucaguga

SEQ ID NO: 1159318 - RNA, 13 nt, Homo sapiens
gccugucucauuc

SEQ ID NO: 1159319 - RNA, 15 nt, Homo sapiens
gccugucucauucgc

SEQ ID NO: 1159320 - RNA, 17 nt, Homo sapiens
gccuuacaaauauuuca

SEQ ID NO: 1159321 - RNA, 14 nt, Homo sapiens
gccuucacauuccc

SEQ ID NO: 1159322 - RNA, 18 nt, Homo sapiens
gccuuccagaaaacaaaa

SEQ ID NO: 1159323 - RNA, 20 nt, Homo sapiens
gccuucccaagguucuaucc

SEQ ID NO: 1159324 - RNA, 19 nt, Homo sapiens
gccuugaaaacaaacaaau

SEQ ID NO: 1159325 - RNA, 16 nt, Homo sapiens
gccuugaguuccaguu

SEQ ID NO: 1159326 - RNA, 15 nt, Homo sapiens
gccuuggccuugcag

SEQ ID NO: 1159327 - RNA, 22 nt, Homo sapiens
gccuugggacuuagaacaccgc

SEQ ID NO: 1159328 - RNA, 18 nt, Homo sapiens
gccuugguaugugccagg

SEQ ID NO: 1159329 - RNA, 15 nt, Homo sapiens
gccuugucauuuuau

SEQ ID NO: 1159330 - RNA, 21 nt, Homo sapiens
gccuuuauuaaaaacugagug

SEQ ID NO: 1159331 - RNA, 16 nt, Homo sapiens
gccuuucccccuguga

SEQ ID NO: 1159332 - RNA, 18 nt, Homo sapiens
gccuuuggaaagacuuga

SEQ ID NO: 1159333 - RNA, 20 nt, Homo sapiens
gccuuuggaaagacuugaau

SEQ ID NO: 1159334 - RNA, 19 nt, Homo sapiens
gccuuugucagaacuagaa

SEQ ID NO: 1159335 - RNA, 15 nt, Homo sapiens
gccuuuuggaaaucc

SEQ ID NO: 1159336 - RNA, 23 nt, Homo sapiens
gcgaauuuuaaaagaugcaaugu

SEQ ID NO: 1159337 - RNA, 17 nt, Homo sapiens
gcgaccuccuuucauca

SEQ ID NO: 1159338 - RNA, 23 nt, Homo sapiens
gcgauuuuaucuguuaaccaaau

SEQ ID NO: 1159339 - RNA, 14 nt, Homo sapiens
gcgcagaugugcag

SEQ ID NO: 1159340 - RNA, 19 nt, Homo sapiens
gcgcagcaucccuagucuc

SEQ ID NO: 1159341 - RNA, 21 nt, Homo sapiens
gcgcaggaccauggacugggg

SEQ ID NO: 1159342 - RNA, 21 nt, Homo sapiens
gcgccaggauggaacacggcc

SEQ ID NO: 1159343 - RNA, 17 nt, Homo sapiens
gcgcccagcuauacugu

SEQ ID NO: 1159344 - RNA, 13 nt, Homo sapiens
gcgcccuccaggg

SEQ ID NO: 1159345 - RNA, 15 nt, Homo sapiens
gcgccuccauccauc

SEQ ID NO: 1159346 - RNA, 22 nt, Homo sapiens
gcgccugacauucacacagaga

SEQ ID NO: 1159347 - RNA, 15 nt, Homo sapiens
gcgcgcucaucccac

SEQ ID NO: 1159348 - RNA, 23 nt, Homo sapiens
gcgcuagugccuugcccacaggu

SEQ ID NO: 1159349 - RNA, 23 nt, Homo sapiens
gcgcucuaauuccuauaaauacg

SEQ ID NO: 1159350 - RNA, 18 nt, Homo sapiens
gcgcucucccuaccuugc

SEQ ID NO: 1159351 - RNA, 10 nt, Homo sapiens
gcgcugugcu

SEQ ID NO: 1159352 - RNA, 19 nt, Homo sapiens
gcggaaggucccucagaca

SEQ ID NO: 1159353 - RNA, 15 nt, Homo sapiens
gcggcccagacccag

SEQ ID NO: 1159354 - RNA, 12 nt, Homo sapiens
gcggcucuccag

SEQ ID NO: 1159355 - RNA, 12 nt, Homo sapiens
gcgggcaccugu

SEQ ID NO: 1159356 - RNA, 18 nt, Homo sapiens
gcggugggcagccaugag

SEQ ID NO: 1159357 - RNA, 21 nt, Homo sapiens
gcguccaccaggccucacugg

SEQ ID NO: 1159358 - RNA, 19 nt, Homo sapiens
gcgucuucaucucccugcc

SEQ ID NO: 1159359 - RNA, 22 nt, Homo sapiens
gcgugaaggccgagaagcaaga

SEQ ID NO: 1159360 - RNA, 20 nt, Homo sapiens
gcgugacacucuccuugcag

SEQ ID NO: 1159361 - RNA, 17 nt, Homo sapiens
gcgugaguauguguaug

SEQ ID NO: 1159362 - RNA, 20 nt, Homo sapiens
gcgugauucggccucuccac

SEQ ID NO: 1159363 - RNA, 22 nt, Homo sapiens
gcguguucuguuggcaagccac

SEQ ID NO: 1159364 - RNA, 16 nt, Homo sapiens
ggauucauuggcccau

SEQ ID NO: 1159365 - RNA, 23 nt, Homo sapiens
ggauuccccaucucaggccagag

SEQ ID NO: 1159366 - RNA, 13 nt, Homo sapiens
ggauuggggaccu

SEQ ID NO: 1159367 - RNA, 14 nt, Homo sapiens
ggauuucuuguauu

SEQ ID NO: 1159368 - RNA, 20 nt, Homo sapiens
ggauuugaugcuguuugaca

SEQ ID NO: 1159369 - RNA, 13 nt, Homo sapiens
ggauuugaugcuu

SEQ ID NO: 1159370 - RNA, 17 nt, Homo sapiens
ggauuugcucagugucu

SEQ ID NO: 1159371 - RNA, 17 nt, Homo sapiens
ggcaaaaauaaugacau

SEQ ID NO: 1159372 - RNA, 16 nt, Homo sapiens
ggcaacauuccucaga

SEQ ID NO: 1159373 - RNA, 15 nt, Homo sapiens
ggcaaggcugaggug

SEQ ID NO: 1159374 - RNA, 18 nt, Homo sapiens
ggcaaguggagccaccuc

SEQ ID NO: 1159375 - RNA, 20 nt, Homo sapiens
ggcaaguguaaaaagaugac

SEQ ID NO: 1159376 - RNA, 20 nt, Homo sapiens
ggcacaagaaucacuugaac

SEQ ID NO: 1159377 - RNA, 21 nt, Homo sapiens
ggcacagccuggcuguggccu

SEQ ID NO: 1159378 - RNA, 16 nt, Homo sapiens
ggcacaugaucuggcc

SEQ ID NO: 1159379 - RNA, 11 nt, Homo sapiens
ggcacauuccc

SEQ ID NO: 1159380 - RNA, 9 nt, Homo sapiens
ggcacauug

SEQ ID NO: 1159381 - RNA, 18 nt, Homo sapiens
ggcaccagacacccagga

SEQ ID NO: 1159382 - RNA, 11 nt, Homo sapiens
ggcacccaaga

SEQ ID NO: 1159383 - RNA, 16 nt, Homo sapiens
ggcaccuaauccaggc

SEQ ID NO: 1159384 - RNA, 13 nt, Homo sapiens
ggcaccugaccac

SEQ ID NO: 1159385 - RNA, 18 nt, Homo sapiens
ggcaccuguguuccagcc

SEQ ID NO: 1159386 - RNA, 15 nt, Homo sapiens
ggcacuauuuuuauu

SEQ ID NO: 1159387 - RNA, 18 nt, Homo sapiens
ggcacucaacaugaguca

SEQ ID NO: 1159388 - RNA, 22 nt, Homo sapiens
ggcacuccucucgcauggugug

SEQ ID NO: 1159389 - RNA, 14 nt, Homo sapiens
ggcacugugccuac

SEQ ID NO: 1159390 - RNA, 15 nt, Homo sapiens
ggcagaaccaaagcu

SEQ ID NO: 1159391 - RNA, 17 nt, Homo sapiens
ggcagaaggagggagac

SEQ ID NO: 1159392 - RNA, 15 nt, Homo sapiens
ggcagaaugcuuuuu

SEQ ID NO: 1159393 - RNA, 16 nt, Homo sapiens
ggcagacacauuguca

SEQ ID NO: 1159394 - RNA, 16 nt, Homo sapiens
ggcagcaaacugcugc

SEQ ID NO: 1159395 - RNA, 16 nt, Homo sapiens
ggcagcauuuuugcac

SEQ ID NO: 1159396 - RNA, 18 nt, Homo sapiens
ggcagccacaacugcagu

SEQ ID NO: 1159397 - RNA, 22 nt, Homo sapiens
ggcaggaaucuauccauugaac

SEQ ID NO: 1159398 - RNA, 20 nt, Homo sapiens
ggcaggaccgccauggugcu

SEQ ID NO: 1159399 - RNA, 20 nt, Homo sapiens
ggcaggagaaucacuugaac

SEQ ID NO: 1159400 - RNA, 20 nt, Homo sapiens
ggcaggagaauugcuugaac

SEQ ID NO: 1159401 - RNA, 16 nt, Homo sapiens
ggcaguacaguggcuu

SEQ ID NO: 1159402 - RNA, 17 nt, Homo sapiens
ggcagucgcugcaggga

SEQ ID NO: 1159403 - RNA, 20 nt, Homo sapiens
ggcagucugagagaggccau

SEQ ID NO: 1159404 - RNA, 22 nt, Homo sapiens
ggcaguggccacguucagggag

SEQ ID NO: 1159405 - RNA, 13 nt, Homo sapiens
ggcaucagugucu

SEQ ID NO: 1159406 - RNA, 22 nt, Homo sapiens
ggcaucaugcaugucaaacaug

SEQ ID NO: 1159407 - RNA, 18 nt, Homo sapiens
ggcaucucccaccagcuc

SEQ ID NO: 1159408 - RNA, 14 nt, Homo sapiens
ggcaugaaccacug

SEQ ID NO: 1159409 - RNA, 14 nt, Homo sapiens
ggcaugacccagug

SEQ ID NO: 1159410 - RNA, 17 nt, Homo sapiens
ggcaugauccaagcaag

SEQ ID NO: 1159411 - RNA, 19 nt, Homo sapiens
ggcaugauccaagcaagac

SEQ ID NO: 1159412 - RNA, 13 nt, Homo sapiens
ggcaugauggugc

SEQ ID NO: 1159413 - RNA, 23 nt, Homo sapiens
ggcaugcaaaagcaaucauagag

SEQ ID NO: 1159414 - RNA, 17 nt, Homo sapiens
ggcaugcuaagaauaaa

SEQ ID NO: 1159415 - RNA, 15 nt, Homo sapiens
ggcaugguggcucau

SEQ ID NO: 1159416 - RNA, 17 nt, Homo sapiens
ggcauuagugcugauag

SEQ ID NO: 1159417 - RNA, 17 nt, Homo sapiens
ggcauucuaagucacag

SEQ ID NO: 1159418 - RNA, 14 nt, Homo sapiens
ggcauucucugaag

SEQ ID NO: 1159419 - RNA, 15 nt, Homo sapiens
ggcauuucacaaaac

SEQ ID NO: 1159420 - RNA, 22 nt, Homo sapiens
ggcauuucacaaaacagccuuu

SEQ ID NO: 1159421 - RNA, 19 nt, Homo sapiens
ggccaacugccuccuugcc

SEQ ID NO: 1159422 - RNA, 22 nt, Homo sapiens
ggccaaggagggugagugcaag

SEQ ID NO: 1159423 - RNA, 21 nt, Homo sapiens
ggccacagaaggugaacuuug

SEQ ID NO: 1159424 - RNA, 17 nt, Homo sapiens
ggccaccagccacuuua

SEQ ID NO: 1159425 - RNA, 18 nt, Homo sapiens
ggccacggagcaguucag

SEQ ID NO: 1159426 - RNA, 16 nt, Homo sapiens
ggccagagccaagggg

SEQ ID NO: 1159427 - RNA, 17 nt, Homo sapiens
ggccagaugcacauccc

SEQ ID NO: 1159428 - RNA, 12 nt, Homo sapiens
ggccagcacuuc

SEQ ID NO: 1159429 - RNA, 15 nt, Homo sapiens
ggccagcacuuccau

SEQ ID NO: 1159430 - RNA, 20 nt, Homo sapiens
ggccagccgcucuccugcca

SEQ ID NO: 1159431 - RNA, 23 nt, Homo sapiens
ggccagccuccggcggggaccca

SEQ ID NO: 1159432 - RNA, 22 nt, Homo sapiens
ggccagcuucgagcuacaugca

SEQ ID NO: 1159433 - RNA, 19 nt, Homo sapiens
ggccaggcaugguggcuca

SEQ ID NO: 1159434 - RNA, 14 nt, Homo sapiens
ggccaguaacgggu

SEQ ID NO: 1159435 - RNA, 17 nt, Homo sapiens
ggccaguaccuuuccau

SEQ ID NO: 1159436 - RNA, 19 nt, Homo sapiens
ggccaucucuaagauguca

SEQ ID NO: 1159437 - RNA, 22 nt, Homo sapiens
ggccaugcugugugagaccagg

SEQ ID NO: 1159438 - RNA, 16 nt, Homo sapiens
ggccauucuuucccaa

SEQ ID NO: 1159439 - RNA, 12 nt, Homo sapiens
ggcccagugcau

SEQ ID NO: 1159440 - RNA, 20 nt, Homo sapiens
ggcccaugaaauugaugaac

SEQ ID NO: 1159441 - RNA, 23 nt, Homo sapiens
ggcccccacauuugugccgacac

SEQ ID NO: 1159442 - RNA, 21 nt, Homo sapiens
ggcccccaccgccgggguccu

SEQ ID NO: 1159443 - RNA, 11 nt, Homo sapiens
ggccccugaca

SEQ ID NO: 1159444 - RNA, 19 nt, Homo sapiens
ggccccuuaggccagugau

SEQ ID NO: 1159445 - RNA, 23 nt, Homo sapiens
ggcccuuccucuuugguggcaug

SEQ ID NO: 1159446 - RNA, 19 nt, Homo sapiens
ggccgccgcugacccuggg

SEQ ID NO: 1159447 - RNA, 20 nt, Homo sapiens
ggccggcugugcucagagac

SEQ ID NO: 1159448 - RNA, 16 nt, Homo sapiens
ggccuaaaacaguauu

SEQ ID NO: 1159449 - RNA, 23 nt, Homo sapiens
ggccuacaugguugaaaccccau

SEQ ID NO: 1159450 - RNA, 17 nt, Homo sapiens
ggccuaugcacauaugg

SEQ ID NO: 1159451 - RNA, 22 nt, Homo sapiens
ggccucacccaccccugcacag

SEQ ID NO: 1159452 - RNA, 17 nt, Homo sapiens
ggccucagcaagccaug

SEQ ID NO: 1159453 - RNA, 12 nt, Homo sapiens
ggccucaggguc

SEQ ID NO: 1159454 - RNA, 17 nt, Homo sapiens
ggccucagugugcccau

SEQ ID NO: 1159455 - RNA, 11 nt, Homo sapiens
ggccuccagaa

SEQ ID NO: 1159456 - RNA, 22 nt, Homo sapiens
ggccucccacggugcugagacu

SEQ ID NO: 1159457 - RNA, 17 nt, Homo sapiens
ggccucccccgugacag

SEQ ID NO: 1159458 - RNA, 20 nt, Homo sapiens
ggccuccuggcccaggugag

SEQ ID NO: 1159459 - RNA, 22 nt, Homo sapiens
ggccucugccugggacacugcg

SEQ ID NO: 1159460 - RNA, 17 nt, Homo sapiens
ggccugcaccgacccga

SEQ ID NO: 1159461 - RNA, 23 nt, Homo sapiens
ggccugcgacccugggggcacag

SEQ ID NO: 1159462 - RNA, 20 nt, Homo sapiens
ggccuggccagucuuccucu

SEQ ID NO: 1159463 - RNA, 15 nt, Homo sapiens
ggccuguacccagua

SEQ ID NO: 1159464 - RNA, 11 nt, Homo sapiens
ggccuguggug

SEQ ID NO: 1159465 - RNA, 21 nt, Homo sapiens
ggccuguugaagaugcuugua

SEQ ID NO: 1159466 - RNA, 14 nt, Homo sapiens
ggccuuaaccauga

SEQ ID NO: 1159467 - RNA, 20 nt, Homo sapiens
ggccuuccacgucuuccucc

SEQ ID NO: 1159468 - RNA, 19 nt, Homo sapiens
ggccuuccucucuccagau

SEQ ID NO: 1159469 - RNA, 12 nt, Homo sapiens
ggccuucucacc

SEQ ID NO: 1159470 - RNA, 15 nt, Homo sapiens
ggccuugcucuucuc

SEQ ID NO: 1159471 - RNA, 21 nt, Homo sapiens
ggcgaccuccuuucaucacac

SEQ ID NO: 1159472 - RNA, 21 nt, Homo sapiens
ggcgcagacaggcggggccca

SEQ ID NO: 1159473 - RNA, 20 nt, Homo sapiens
ggcgccgcaaaccacacugg

SEQ ID NO: 1159474 - RNA, 21 nt, Homo sapiens
ggcgcugccugcguugcaaac

SEQ ID NO: 1159475 - RNA, 21 nt, Homo sapiens
ggcgcuucggcucccaggaca

SEQ ID NO: 1159476 - RNA, 23 nt, Homo sapiens
ggcggaauaaugggcauugagau

SEQ ID NO: 1159477 - RNA, 21 nt, Homo sapiens
ggcggugucaggucccagcga

SEQ ID NO: 1159478 - RNA, 17 nt, Homo sapiens
ggcguggagacuggcag

SEQ ID NO: 1159479 - RNA, 19 nt, Homo sapiens
ggcuaaaugaaguguguua

SEQ ID NO: 1159480 - RNA, 16 nt, Homo sapiens
ggcuaagaguguccua

SEQ ID NO: 1159481 - RNA, 16 nt, Homo sapiens
ggcuaaugaagaucau

SEQ ID NO: 1159482 - RNA, 16 nt, Homo sapiens
ggcuaauucaguguca

SEQ ID NO: 1159483 - RNA, 20 nt, Homo sapiens
ggcuacacucaucugacuca

SEQ ID NO: 1159484 - RNA, 19 nt, Homo sapiens
ggcuauuuaaaacuuguaa

SEQ ID NO: 1159485 - RNA, 13 nt, Homo sapiens
ggcucagccagca

SEQ ID NO: 1159486 - RNA, 13 nt, Homo sapiens
ggcucauuuacuu

SEQ ID NO: 1159487 - RNA, 16 nt, Homo sapiens
ggcucauuuacuugaa

SEQ ID NO: 1159488 - RNA, 11 nt, Homo sapiens
ggcuccagaaa

SEQ ID NO: 1159489 - RNA, 21 nt, Homo sapiens
ggcuccucgagaucccaacac

SEQ ID NO: 1159490 - RNA, 19 nt, Homo sapiens
ggcucgaccucgcugcugc

SEQ ID NO: 1159491 - RNA, 16 nt, Homo sapiens
ggcucgacugcucaac

SEQ ID NO: 1159492 - RNA, 21 nt, Homo sapiens
ggcucuaacaaugacauuuau

SEQ ID NO: 1159493 - RNA, 21 nt, Homo sapiens
ggcucucgcugcccuguggac

SEQ ID NO: 1159494 - RNA, 19 nt, Homo sapiens
ggcucucuugugcauugua

SEQ ID NO: 1159495 - RNA, 12 nt, Homo sapiens
ggcucuggucuc

SEQ ID NO: 1159496 - RNA, 17 nt, Homo sapiens
gucccuaaaaacacaga

SEQ ID NO: 1159497 - RNA, 17 nt, Homo sapiens
gucccucacagcacuag

SEQ ID NO: 1159498 - RNA, 19 nt, Homo sapiens
gucccucacguuucuuccc

SEQ ID NO: 1159499 - RNA, 16 nt, Homo sapiens
gucccucucagugccu

SEQ ID NO: 1159500 - RNA, 21 nt, Homo sapiens
gucccucuggaaagaaacaug

SEQ ID NO: 1159501 - RNA, 16 nt, Homo sapiens
gucccugcugcugcca

SEQ ID NO: 1159502 - RNA, 23 nt, Homo sapiens
gucccugguccuucacuggcgcc

SEQ ID NO: 1159503 - RNA, 16 nt, Homo sapiens
guccgguguucuaaga

SEQ ID NO: 1159504 - RNA, 20 nt, Homo sapiens
guccuaacucuccucgcuga

SEQ ID NO: 1159505 - RNA, 22 nt, Homo sapiens
guccucaagaagaaaguguuca

SEQ ID NO: 1159506 - RNA, 19 nt, Homo sapiens
guccucagccuugccagag

SEQ ID NO: 1159507 - RNA, 21 nt, Homo sapiens
guccucagccuugccagagau

SEQ ID NO: 1159508 - RNA, 19 nt, Homo sapiens
guccuggucugcucaggaa

SEQ ID NO: 1159509 - RNA, 17 nt, Homo sapiens
guccuguacccaguguu

SEQ ID NO: 1159510 - RNA, 23 nt, Homo sapiens
guccuuaaaaaucacacuguaaa

SEQ ID NO: 1159511 - RNA, 14 nt, Homo sapiens
guccuuacucagag

SEQ ID NO: 1159512 - RNA, 14 nt, Homo sapiens
guccuucaccucac

SEQ ID NO: 1159513 - RNA, 18 nt, Homo sapiens
guccuucaccucacugaa

SEQ ID NO: 1159514 - RNA, 13 nt, Homo sapiens
guccuuccugugc

SEQ ID NO: 1159515 - RNA, 20 nt, Homo sapiens
guccuugggccuggccaguc

SEQ ID NO: 1159516 - RNA, 16 nt, Homo sapiens
gucgaaagcucuagaa

SEQ ID NO: 1159517 - RNA, 13 nt, Homo sapiens
gucggacuaugua

SEQ ID NO: 1159518 - RNA, 12 nt, Homo sapiens
gucuaaaaccuu

SEQ ID NO: 1159519 - RNA, 17 nt, Homo sapiens
gucuaaucaacagauaa

SEQ ID NO: 1159520 - RNA, 18 nt, Homo sapiens
gucuacucuuaagccauc

SEQ ID NO: 1159521 - RNA, 14 nt, Homo sapiens
gucuacuucacuaa

SEQ ID NO: 1159522 - RNA, 18 nt, Homo sapiens
gucuacuugaguuagcau

SEQ ID NO: 1159523 - RNA, 21 nt, Homo sapiens
gucuacuugcucagguacuug

SEQ ID NO: 1159524 - RNA, 22 nt, Homo sapiens
gucuaggauaacuugcuuucuu

SEQ ID NO: 1159525 - RNA, 17 nt, Homo sapiens
gucuagguacuucaggg

SEQ ID NO: 1159526 - RNA, 15 nt, Homo sapiens
gucuauuguauauau

SEQ ID NO: 1159527 - RNA, 21 nt, Homo sapiens
gucucaaacuccugaccucaa

SEQ ID NO: 1159528 - RNA, 20 nt, Homo sapiens
gucuccaagggcaucacugg

SEQ ID NO: 1159529 - RNA, 22 nt, Homo sapiens
gucuccaagggcaucacugggu

SEQ ID NO: 1159530 - RNA, 16 nt, Homo sapiens
gucuccauggcaucuu

SEQ ID NO: 1159531 - RNA, 18 nt, Homo sapiens
gucucccgggaagccacc

SEQ ID NO: 1159532 - RNA, 17 nt, Homo sapiens
gucuccucugcagcuca

SEQ ID NO: 1159533 - RNA, 14 nt, Homo sapiens
gucucuacccagua

SEQ ID NO: 1159534 - RNA, 22 nt, Homo sapiens
gucucuacccaguagaugccac

SEQ ID NO: 1159535 - RNA, 13 nt, Homo sapiens
gucucuacugugg

SEQ ID NO: 1159536 - RNA, 18 nt, Homo sapiens
gucucuaguuccacgccu

SEQ ID NO: 1159537 - RNA, 16 nt, Homo sapiens
gucucuaugugaauau

SEQ ID NO: 1159538 - RNA, 16 nt, Homo sapiens
gucucuccuuguugcc

SEQ ID NO: 1159539 - RNA, 12 nt, Homo sapiens
gucucucucuuu

SEQ ID NO: 1159540 - RNA, 18 nt, Homo sapiens
gucucuucuuggggccca

SEQ ID NO: 1159541 - RNA, 11 nt, Homo sapiens
gucucuuuaua

SEQ ID NO: 1159542 - RNA, 21 nt, Homo sapiens
gucugaacgucuccuagccaa

SEQ ID NO: 1159543 - RNA, 14 nt, Homo sapiens
gucugagagcaaag

SEQ ID NO: 1159544 - RNA, 15 nt, Homo sapiens
gucugagucuugggu

SEQ ID NO: 1159545 - RNA, 13 nt, Homo sapiens
gucugcagucacc

SEQ ID NO: 1159546 - RNA, 14 nt, Homo sapiens
gucugcaucauccu

SEQ ID NO: 1159547 - RNA, 19 nt, Homo sapiens
gucuggcaaacaugugcaa

SEQ ID NO: 1159548 - RNA, 19 nt, Homo sapiens
gucuggcaucucccacaca

SEQ ID NO: 1159549 - RNA, 22 nt, Homo sapiens
gucugggaguauacggaaacaa

SEQ ID NO: 1159550 - RNA, 16 nt, Homo sapiens
gucugggagucacaca

SEQ ID NO: 1159551 - RNA, 15 nt, Homo sapiens
gucuguacacguguc

SEQ ID NO: 1159552 - RNA, 13 nt, Homo sapiens
gucugucaucugc

SEQ ID NO: 1159553 - RNA, 13 nt, Homo sapiens
gucugugaugcuc

SEQ ID NO: 1159554 - RNA, 12 nt, Homo sapiens
gucuguucucac

SEQ ID NO: 1159555 - RNA, 21 nt, Homo sapiens
gucuuaaggacaaagugccaa

SEQ ID NO: 1159556 - RNA, 13 nt, Homo sapiens
gucuucaguggaa

SEQ ID NO: 1159557 - RNA, 23 nt, Homo sapiens
gucuuccacaaaaaauacuuuau

SEQ ID NO: 1159558 - RNA, 17 nt, Homo sapiens
gucuucuugacugucuu

SEQ ID NO: 1159559 - RNA, 12 nt, Homo sapiens
gucuugaacucc

SEQ ID NO: 1159560 - RNA, 15 nt, Homo sapiens
gucuugcuuacugua

SEQ ID NO: 1159561 - RNA, 20 nt, Homo sapiens
gucuugcuuacuguacagaa

SEQ ID NO: 1159562 - RNA, 16 nt, Homo sapiens
gucuugguugccagua

SEQ ID NO: 1159563 - RNA, 19 nt, Homo sapiens
gucuuuccuaaggcugcaa

SEQ ID NO: 1159564 - RNA, 13 nt, Homo sapiens
gucuuucuuugcu

SEQ ID NO: 1159565 - RNA, 20 nt, Homo sapiens
gucuuugcggggccugucuc

SEQ ID NO: 1159566 - RNA, 20 nt, Homo sapiens
gucuuuuccccucauugcau

SEQ ID NO: 1159567 - RNA, 14 nt, Homo sapiens
gucuuuucucugaa

SEQ ID NO: 1159568 - RNA, 14 nt, Homo sapiens
gucuuuugaugaau

SEQ ID NO: 1159569 - RNA, 15 nt, Homo sapiens
gugaaaaaagcaaau

SEQ ID NO: 1159570 - RNA, 16 nt, Homo sapiens
gugaaacaggucuuug

SEQ ID NO: 1159571 - RNA, 19 nt, Homo sapiens
gugaacuagggaagcucag

SEQ ID NO: 1159572 - RNA, 17 nt, Homo sapiens
gugaagcaggucuuuca

SEQ ID NO: 1159573 - RNA, 22 nt, Homo sapiens
gugaaggcuggcaugauccaag

SEQ ID NO: 1159574 - RNA, 21 nt, Homo sapiens
gugaauacucuucccacauac

SEQ ID NO: 1159575 - RNA, 14 nt, Homo sapiens
gugaaucagacccu

SEQ ID NO: 1159576 - RNA, 15 nt, Homo sapiens
gugaaucagucccau

SEQ ID NO: 1159577 - RNA, 20 nt, Homo sapiens
gugaaugccagugugcugau

SEQ ID NO: 1159578 - RNA, 17 nt, Homo sapiens
gugaauggucucuguca

SEQ ID NO: 1159579 - RNA, 18 nt, Homo sapiens
gugaauuaaagaugcuga

SEQ ID NO: 1159580 - RNA, 23 nt, Homo sapiens
gugaauuuuucucuaacucagaa

SEQ ID NO: 1159581 - RNA, 13 nt, Homo sapiens
gugacaaucugcc

SEQ ID NO: 1159582 - RNA, 12 nt, Homo sapiens
gugacacauaug

SEQ ID NO: 1159583 - RNA, 12 nt, Homo sapiens
gugacacuggac

SEQ ID NO: 1159584 - RNA, 22 nt, Homo sapiens
gugacauaauuuacaugcaaua

SEQ ID NO: 1159585 - RNA, 20 nt, Homo sapiens
gugacaucucuuugauguca

SEQ ID NO: 1159586 - RNA, 19 nt, Homo sapiens
gugacauuuccaugcauaa

SEQ ID NO: 1159587 - RNA, 17 nt, Homo sapiens
gugaccagacugcacag

SEQ ID NO: 1159588 - RNA, 16 nt, Homo sapiens
gugaccagugcugcug

SEQ ID NO: 1159589 - RNA, 20 nt, Homo sapiens
gugaccuugggaccaaaggg

SEQ ID NO: 1159590 - RNA, 16 nt, Homo sapiens
gugacgugcacuguga

SEQ ID NO: 1159591 - RNA, 19 nt, Homo sapiens
gugacuaaacuacauuaua

SEQ ID NO: 1159592 - RNA, 16 nt, Homo sapiens
gugacuaauggcauga

SEQ ID NO: 1159593 - RNA, 15 nt, Homo sapiens
gugacuauuuauaua

SEQ ID NO: 1159594 - RNA, 21 nt, Homo sapiens
gugacucuauauagcugauca

SEQ ID NO: 1159595 - RNA, 14 nt, Homo sapiens
gugagaccuggcag

SEQ ID NO: 1159596 - RNA, 18 nt, Homo sapiens
gugagaccuuggcgcuac

SEQ ID NO: 1159597 - RNA, 15 nt, Homo sapiens
gugagacuccaucuc

SEQ ID NO: 1159598 - RNA, 13 nt, Homo sapiens
gugagagugcaga

SEQ ID NO: 1159599 - RNA, 13 nt, Homo sapiens
gugagauguaauu

SEQ ID NO: 1159600 - RNA, 21 nt, Homo sapiens
gugagccaagaaacacugccu

SEQ ID NO: 1159601 - RNA, 14 nt, Homo sapiens
gugagccacugcgu

SEQ ID NO: 1159602 - RNA, 17 nt, Homo sapiens
gugagggguagugggau

SEQ ID NO: 1159603 - RNA, 12 nt, Homo sapiens
gugagugcaagg

SEQ ID NO: 1159604 - RNA, 17 nt, Homo sapiens
gugauaagaaaagccag

SEQ ID NO: 1159605 - RNA, 17 nt, Homo sapiens
gugauagagccuuugau

SEQ ID NO: 1159606 - RNA, 16 nt, Homo sapiens
gugaucccguuuuccc

SEQ ID NO: 1159607 - RNA, 22 nt, Homo sapiens
gugauucaucuucacagcacau

SEQ ID NO: 1159608 - RNA, 23 nt, Homo sapiens
gugauucccuccugcuacucugu

SEQ ID NO: 1159609 - RNA, 21 nt, Homo sapiens
gugcacauccgcgugugccug

SEQ ID NO: 1159610 - RNA, 12 nt, Homo sapiens
gugcagacucaa

SEQ ID NO: 1159611 - RNA, 22 nt, Homo sapiens
gugcagcuccucagcggcucca

SEQ ID NO: 1159612 - RNA, 17 nt, Homo sapiens
gugcaguccauuuccua

SEQ ID NO: 1159613 - RNA, 19 nt, Homo sapiens
gugcaguggugcgaucucg

SEQ ID NO: 1159614 - RNA, 19 nt, Homo sapiens
gugcaguggugugaucuca

SEQ ID NO: 1159615 - RNA, 21 nt, Homo sapiens
gugcauagaauucuagcuuuu

SEQ ID NO: 1159616 - RNA, 20 nt, Homo sapiens
gugcaugccuguagucucag

SEQ ID NO: 1159617 - RNA, 17 nt, Homo sapiens
gugccacgcagggcaga

SEQ ID NO: 1159618 - RNA, 20 nt, Homo sapiens
gugccacgcagggcagagga

SEQ ID NO: 1159619 - RNA, 13 nt, Homo sapiens
gugccagcacaaa

SEQ ID NO: 1159620 - RNA, 14 nt, Homo sapiens
gugccagcacaaag

SEQ ID NO: 1159621 - RNA, 15 nt, Homo sapiens
gugccagcacaaagu

SEQ ID NO: 1159622 - RNA, 18 nt, Homo sapiens
gugccagcacccaguccu

SEQ ID NO: 1159623 - RNA, 16 nt, Homo sapiens
gugccagugcacuccg

SEQ ID NO: 1159624 - RNA, 15 nt, Homo sapiens
gugccaguucuuucc

SEQ ID NO: 1159625 - RNA, 19 nt, Homo sapiens
gugccaugggggcaacagc

SEQ ID NO: 1159626 - RNA, 20 nt, Homo sapiens
gugcccuccugggagcucau

SEQ ID NO: 1159627 - RNA, 19 nt, Homo sapiens
gugcccugcaucccucucc

SEQ ID NO: 1159628 - RNA, 17 nt, Homo sapiens
gugccuacauguucuca

SEQ ID NO: 1159629 - RNA, 23 nt, Homo sapiens
guuuuuggacacugugcuacuga

SEQ ID NO: 1159630 - RNA, 23 nt, Homo sapiens
guuuuugugaaaagcuccauuuu

SEQ ID NO: 1159631 - RNA, 14 nt, Homo sapiens
guuuuuucugcaau

SEQ ID NO: 1159632 - RNA, 20 nt, Homo sapiens
uaaaaaaaaaaaccaaaacu

SEQ ID NO: 1159633 - RNA, 23 nt, Homo sapiens
uaaaaaacaauuaacugcccucu

SEQ ID NO: 1159634 - RNA, 19 nt, Homo sapiens
uaaaaaagaaaacauucca

SEQ ID NO: 1159635 - RNA, 13 nt, Homo sapiens
uaaaaaagcauac

SEQ ID NO: 1159636 - RNA, 14 nt, Homo sapiens
uaaaaaaucuuaau

SEQ ID NO: 1159637 - RNA, 20 nt, Homo sapiens
uaaaaaauuaaacuaaagau

SEQ ID NO: 1159638 - RNA, 17 nt, Homo sapiens
uaaaaacaaagugcuaa

SEQ ID NO: 1159639 - RNA, 16 nt, Homo sapiens
uaaaaacaagauggag

SEQ ID NO: 1159640 - RNA, 12 nt, Homo sapiens
uaaaaacaggag

SEQ ID NO: 1159641 - RNA, 15 nt, Homo sapiens
uaaaaacauugccuu

SEQ ID NO: 1159642 - RNA, 13 nt, Homo sapiens
uaaaaaccaaauu

SEQ ID NO: 1159643 - RNA, 17 nt, Homo sapiens
uaaaaacugagugacuc

SEQ ID NO: 1159644 - RNA, 20 nt, Homo sapiens
uaaaaagaagagacugcuac

SEQ ID NO: 1159645 - RNA, 21 nt, Homo sapiens
uaaaaagacacgguugcucua

SEQ ID NO: 1159646 - RNA, 22 nt, Homo sapiens
uaaaaagagcuguccugguauc

SEQ ID NO: 1159647 - RNA, 15 nt, Homo sapiens
uaaaaagugugcuua

SEQ ID NO: 1159648 - RNA, 18 nt, Homo sapiens
uaaaaauaaaucccaugg

SEQ ID NO: 1159649 - RNA, 19 nt, Homo sapiens
uaaaaauauacaagcuaca

SEQ ID NO: 1159650 - RNA, 15 nt, Homo sapiens
uaaaaaucacacugu

SEQ ID NO: 1159651 - RNA, 13 nt, Homo sapiens
uaaaaaucuaccu

SEQ ID NO: 1159652 - RNA, 18 nt, Homo sapiens
uaaaaaugagugcuuaaa

SEQ ID NO: 1159653 - RNA, 12 nt, Homo sapiens
uaaaaaugcaaa

SEQ ID NO: 1159654 - RNA, 21 nt, Homo sapiens
uaaaaauggauagcucauuaa

SEQ ID NO: 1159655 - RNA, 16 nt, Homo sapiens
uaaaaauguccugccu

SEQ ID NO: 1159656 - RNA, 23 nt, Homo sapiens
uaaaaauugucuucauguacauu

SEQ ID NO: 1159657 - RNA, 16 nt, Homo sapiens
uaaaacaaaagcauuu

SEQ ID NO: 1159658 - RNA, 16 nt, Homo sapiens
uaaaacaaaauuugac

SEQ ID NO: 1159659 - RNA, 19 nt, Homo sapiens
uaaaacaagcacuaaacaa

SEQ ID NO: 1159660 - RNA, 13 nt, Homo sapiens
uaaaacacagagg

SEQ ID NO: 1159661 - RNA, 23 nt, Homo sapiens
uaaaacaccuuuccuuaugucuc

SEQ ID NO: 1159662 - RNA, 11 nt, Homo sapiens
uaaaacacuua

SEQ ID NO: 1159663 - RNA, 13 nt, Homo sapiens
uaaaacaguauuc

SEQ ID NO: 1159664 - RNA, 21 nt, Homo sapiens
uaaaacauaagaucacugcca

SEQ ID NO: 1159665 - RNA, 17 nt, Homo sapiens
uaaaacaugcuggugaa

SEQ ID NO: 1159666 - RNA, 15 nt, Homo sapiens
uaaaaccacuaugca

SEQ ID NO: 1159667 - RNA, 19 nt, Homo sapiens
uaaaaccaguuuugcugcu

SEQ ID NO: 1159668 - RNA, 20 nt, Homo sapiens
uaaaaccaguuuugcugcua

SEQ ID NO: 1159669 - RNA, 17 nt, Homo sapiens
uaaaacggauaccaagu

SEQ ID NO: 1159670 - RNA, 17 nt, Homo sapiens
uaaaacuucaucuuccc

SEQ ID NO: 1159671 - RNA, 20 nt, Homo sapiens
uaaaacuuuuaaaacuucua

SEQ ID NO: 1159672 - RNA, 19 nt, Homo sapiens
uaaaagaaaaaaaccaaag

SEQ ID NO: 1159673 - RNA, 20 nt, Homo sapiens
uaaaagaaaaaaaccaaagu

SEQ ID NO: 1159674 - RNA, 18 nt, Homo sapiens
uaaaagaccaucuccugu

SEQ ID NO: 1159675 - RNA, 15 nt, Homo sapiens
uaaaagacuuugaug

SEQ ID NO: 1159676 - RNA, 20 nt, Homo sapiens
uaaaagaucauaguugcaaa

SEQ ID NO: 1159677 - RNA, 14 nt, Homo sapiens
uaaaagaugcagag

SEQ ID NO: 1159678 - RNA, 19 nt, Homo sapiens
uaaaagcaaggcucaaggg

SEQ ID NO: 1159679 - RNA, 23 nt, Homo sapiens
uaaaagcacacucauccccucac

SEQ ID NO: 1159680 - RNA, 22 nt, Homo sapiens
uaaaagccccaaauggugguaa

SEQ ID NO: 1159681 - RNA, 19 nt, Homo sapiens
uaaaaggcaaauguguaca

SEQ ID NO: 1159682 - RNA, 15 nt, Homo sapiens
uaaaagguacuggua

SEQ ID NO: 1159683 - RNA, 19 nt, Homo sapiens
uaaaagucauuuaauguag

SEQ ID NO: 1159684 - RNA, 12 nt, Homo sapiens
uaaaaguucuuu

SEQ ID NO: 1159685 - RNA, 14 nt, Homo sapiens
uaaaauaaaacaca

SEQ ID NO: 1159686 - RNA, 16 nt, Homo sapiens
uaaaauaagagauccu

SEQ ID NO: 1159687 - RNA, 19 nt, Homo sapiens
uaaaauaauuuucauucau

SEQ ID NO: 1159688 - RNA, 22 nt, Homo sapiens
uaaaauacuaaacuacauuuua

SEQ ID NO: 1159689 - RNA, 13 nt, Homo sapiens
uaaaauagaaacu

SEQ ID NO: 1159690 - RNA, 18 nt, Homo sapiens
uaaaauagagugcauuug

SEQ ID NO: 1159691 - RNA, 21 nt, Homo sapiens
uaaaauagaguguaguuuaca

SEQ ID NO: 1159692 - RNA, 16 nt, Homo sapiens
uaaaauagcaauccua

SEQ ID NO: 1159693 - RNA, 18 nt, Homo sapiens
uaaaaucuugcauggcau

SEQ ID NO: 1159694 - RNA, 22 nt, Homo sapiens
uaaaaugaaguggugagcuuaa

SEQ ID NO: 1159695 - RNA, 16 nt, Homo sapiens
uaaaauguaaagccau

SEQ ID NO: 1159696 - RNA, 17 nt, Homo sapiens
uaaaauguaaagccaug

SEQ ID NO: 1159697 - RNA, 21 nt, Homo sapiens
uaaaaugugauguucuaaggc

SEQ ID NO: 1159698 - RNA, 19 nt, Homo sapiens
uaaaauguuggugcaauua

SEQ ID NO: 1159699 - RNA, 23 nt, Homo sapiens
uaaaauuagaaucugaguauaaa

SEQ ID NO: 1159700 - RNA, 15 nt, Homo sapiens
uaaaauuagugcugu

SEQ ID NO: 1159701 - RNA, 13 nt, Homo sapiens
uaaaauucaggua

SEQ ID NO: 1159702 - RNA, 20 nt, Homo sapiens
uaaaauucagguauuacuga

SEQ ID NO: 1159703 - RNA, 12 nt, Homo sapiens
uaaaauucauuu

SEQ ID NO: 1159704 - RNA, 15 nt, Homo sapiens
uaaaauuucacuuaa

SEQ ID NO: 1159705 - RNA, 18 nt, Homo sapiens
uaaaauuucacuuaauaa

SEQ ID NO: 1159706 - RNA, 21 nt, Homo sapiens
uaaacaaaacccacauuuccu

SEQ ID NO: 1159707 - RNA, 12 nt, Homo sapiens
uaaacaaaccag

SEQ ID NO: 1159708 - RNA, 16 nt, Homo sapiens
uaaacacgccugcaaa

SEQ ID NO: 1159709 - RNA, 23 nt, Homo sapiens
uaaacagcaggguuugagcacaa

SEQ ID NO: 1159710 - RNA, 12 nt, Homo sapiens
uaaacagggucu

SEQ ID NO: 1159711 - RNA, 11 nt, Homo sapiens
uaaacagugcc

SEQ ID NO: 1159712 - RNA, 12 nt, Homo sapiens
uaaaccaaaaac

SEQ ID NO: 1159713 - RNA, 17 nt, Homo sapiens
uaaaccaucaucuugcc

SEQ ID NO: 1159714 - RNA, 15 nt, Homo sapiens
uaaaccaugugacua

SEQ ID NO: 1159715 - RNA, 23 nt, Homo sapiens
uaaacccgaggaagaugcucauc

SEQ ID NO: 1159716 - RNA, 13 nt, Homo sapiens
uaaaccuuuccau

SEQ ID NO: 1159717 - RNA, 19 nt, Homo sapiens
uaaacuaauauuuguuuca

SEQ ID NO: 1159718 - RNA, 22 nt, Homo sapiens
uaaacucuagggggacuuucuu

SEQ ID NO: 1159719 - RNA, 22 nt, Homo sapiens
uaaacucuguugcaagugcaau

SEQ ID NO: 1159720 - RNA, 14 nt, Homo sapiens
uaaacucuuuuugg

SEQ ID NO: 1159721 - RNA, 13 nt, Homo sapiens
uaaacugugcacc

SEQ ID NO: 1159722 - RNA, 21 nt, Homo sapiens
uaaacuguuuauuugcacuau

SEQ ID NO: 1159723 - RNA, 12 nt, Homo sapiens
uaaagaacuuuu

SEQ ID NO: 1159724 - RNA, 22 nt, Homo sapiens
uaaagaagguuggugaauuuca

SEQ ID NO: 1159725 - RNA, 14 nt, Homo sapiens
uaaagaccacuuua

SEQ ID NO: 1159726 - RNA, 22 nt, Homo sapiens
uaaagagaaagcccgcuuuagu

SEQ ID NO: 1159727 - RNA, 18 nt, Homo sapiens
uaaagagugcuacauggu

SEQ ID NO: 1159728 - RNA, 16 nt, Homo sapiens
uaaagcaaacaugcaa

SEQ ID NO: 1159729 - RNA, 23 nt, Homo sapiens
uaaagcaaagcaaaugaacacac

SEQ ID NO: 1159730 - RNA, 13 nt, Homo sapiens
uaaagccaagaau

SEQ ID NO: 1159731 - RNA, 15 nt, Homo sapiens
uaaagccaagcacuu

SEQ ID NO: 1159732 - RNA, 16 nt, Homo sapiens
uaaagccaagcacuuu

SEQ ID NO: 1159733 - RNA, 23 nt, Homo sapiens
uaaagcccagaucucugcaucuc

SEQ ID NO: 1159734 - RNA, 18 nt, Homo sapiens
uaaagcuccuuuggcaga

SEQ ID NO: 1159735 - RNA, 13 nt, Homo sapiens
uaaagcucucaaa

SEQ ID NO: 1159736 - RNA, 18 nt, Homo sapiens
uaaagcuguuauucuugu

SEQ ID NO: 1159737 - RNA, 23 nt, Homo sapiens
uaaagcuguuauucuuguuauac

SEQ ID NO: 1159738 - RNA, 19 nt, Homo sapiens
uaaagcuguucucauuccu

SEQ ID NO: 1159739 - RNA, 17 nt, Homo sapiens
uaaagcuuaacacuuga

SEQ ID NO: 1159740 - RNA, 14 nt, Homo sapiens
uaaaggaaacauau

SEQ ID NO: 1159741 - RNA, 15 nt, Homo sapiens
uaaaggcauuccaca

SEQ ID NO: 1159742 - RNA, 19 nt, Homo sapiens
uaaagggacuugaaguauu

SEQ ID NO: 1159743 - RNA, 22 nt, Homo sapiens
uaaagguccacaggucuagacu

SEQ ID NO: 1159744 - RNA, 15 nt, Homo sapiens
uaaaguacaucucua

SEQ ID NO: 1159745 - RNA, 21 nt, Homo sapiens
uaaagucaggaguccaagacc

SEQ ID NO: 1159746 - RNA, 13 nt, Homo sapiens
uaaagucuugccu

SEQ ID NO: 1159747 - RNA, 15 nt, Homo sapiens
uaaagugcuaagguu

SEQ ID NO: 1159748 - RNA, 16 nt, Homo sapiens
uaaagugcuuguguaa

SEQ ID NO: 1159749 - RNA, 12 nt, Homo sapiens
uaaagugguggu

SEQ ID NO: 1159750 - RNA, 23 nt, Homo sapiens
uaaagugucaccccucacuguga

SEQ ID NO: 1159751 - RNA, 15 nt, Homo sapiens
uaaaguuaaguuugu

SEQ ID NO: 1159752 - RNA, 21 nt, Homo sapiens
uaaauaaaauucauuucuaca

SEQ ID NO: 1159753 - RNA, 16 nt, Homo sapiens
uaaauaaaauuuguug

SEQ ID NO: 1159754 - RNA, 14 nt, Homo sapiens
uaaauaaauaccaa

SEQ ID NO: 1159755 - RNA, 15 nt, Homo sapiens
uaaauaaauggaaua

SEQ ID NO: 1159756 - RNA, 21 nt, Homo sapiens
uaaauaaccggggauucugua

SEQ ID NO: 1159757 - RNA, 11 nt, Homo sapiens
uaaauaaucuc

SEQ ID NO: 1159758 - RNA, 16 nt, Homo sapiens
uaaauacaaguucuuu

SEQ ID NO: 1159759 - RNA, 15 nt, Homo sapiens
uaaauagaguuugcu

SEQ ID NO: 1159760 - RNA, 19 nt, Homo sapiens
uaaauaggcuggcaagaua

SEQ ID NO: 1159761 - RNA, 17 nt, Homo sapiens
ucugagccuucuacuua

SEQ ID NO: 1159762 - RNA, 19 nt, Homo sapiens
ucugagcguuuaaaguacu

SEQ ID NO: 1159763 - RNA, 21 nt, Homo sapiens
ucugagcguuuaaaguacuga

SEQ ID NO: 1159764 - RNA, 14 nt, Homo sapiens
ucugagcugugcag

SEQ ID NO: 1159765 - RNA, 21 nt, Homo sapiens
ucugaguugagaccuuugauu

SEQ ID NO: 1159766 - RNA, 22 nt, Homo sapiens
ucugauaugcaguuuuccuuaa

SEQ ID NO: 1159767 - RNA, 18 nt, Homo sapiens
ucugaugauauguggucc

SEQ ID NO: 1159768 - RNA, 23 nt, Homo sapiens
ucugcaacugaaauuacauauug

SEQ ID NO: 1159769 - RNA, 20 nt, Homo sapiens
ucugcaaugacuguggaguu

SEQ ID NO: 1159770 - RNA, 23 nt, Homo sapiens
ucugcaaugacuguggaguucca

SEQ ID NO: 1159771 - RNA, 20 nt, Homo sapiens
ucugcacccagaacaguggu

SEQ ID NO: 1159772 - RNA, 16 nt, Homo sapiens
ucugcagaacauauca

SEQ ID NO: 1159773 - RNA, 22 nt, Homo sapiens
ucugcagauagaaagcauuaca

SEQ ID NO: 1159774 - RNA, 19 nt, Homo sapiens
ucugcagggccgccaggga

SEQ ID NO: 1159775 - RNA, 17 nt, Homo sapiens
ucugcauacuaaccuau

SEQ ID NO: 1159776 - RNA, 15 nt, Homo sapiens
ucugcaucaguucac

SEQ ID NO: 1159777 - RNA, 18 nt, Homo sapiens
ucugcaucuuacagucag

SEQ ID NO: 1159778 - RNA, 14 nt, Homo sapiens
ucugcaucuugggg

SEQ ID NO: 1159779 - RNA, 17 nt, Homo sapiens
ucugcaugucuacucag

SEQ ID NO: 1159780 - RNA, 19 nt, Homo sapiens
ucugccaauuuuugccuuc

SEQ ID NO: 1159781 - RNA, 18 nt, Homo sapiens
ucugccacaccucuccaa

SEQ ID NO: 1159782 - RNA, 20 nt, Homo sapiens
ucugccacaccucuccaaag

SEQ ID NO: 1159783 - RNA, 16 nt, Homo sapiens
ucugccauaucaguga

SEQ ID NO: 1159784 - RNA, 21 nt, Homo sapiens
ucugccauaucagugaaccuu

SEQ ID NO: 1159785 - RNA, 21 nt, Homo sapiens
ucugccuagaaacaguguuug

SEQ ID NO: 1159786 - RNA, 21 nt, Homo sapiens
ucugcuauuaaccuugccuua

SEQ ID NO: 1159787 - RNA, 13 nt, Homo sapiens
ucugcucacuuua

SEQ ID NO: 1159788 - RNA, 14 nt, Homo sapiens
ucugcucacuuuaa

SEQ ID NO: 1159789 - RNA, 18 nt, Homo sapiens
ucugcucaucauucucug

SEQ ID NO: 1159790 - RNA, 20 nt, Homo sapiens
ucugcucgccuuagcacuac

SEQ ID NO: 1159791 - RNA, 15 nt, Homo sapiens
ucugcuucucggggu

SEQ ID NO: 1159792 - RNA, 13 nt, Homo sapiens
ucugcuuugcucu

SEQ ID NO: 1159793 - RNA, 13 nt, Homo sapiens
ucuggaaccucag

SEQ ID NO: 1159794 - RNA, 23 nt, Homo sapiens
ucuggaaguauuuuccuccaaag

SEQ ID NO: 1159795 - RNA, 13 nt, Homo sapiens
ucuggaaucugga

SEQ ID NO: 1159796 - RNA, 17 nt, Homo sapiens
ucuggaccugguacaaa

SEQ ID NO: 1159797 - RNA, 18 nt, Homo sapiens
ucuggaccuugagcauca

SEQ ID NO: 1159798 - RNA, 15 nt, Homo sapiens
ucuggacgugaaaua

SEQ ID NO: 1159799 - RNA, 16 nt, Homo sapiens
ucuggaguauucuaua

SEQ ID NO: 1159800 - RNA, 21 nt, Homo sapiens
ucuggcaucucccacacaaga

SEQ ID NO: 1159801 - RNA, 15 nt, Homo sapiens
ucuggcccaguuaau

SEQ ID NO: 1159802 - RNA, 18 nt, Homo sapiens
ucuggccuguacccagua

SEQ ID NO: 1159803 - RNA, 22 nt, Homo sapiens
ucuggccuguacccaguagaug

SEQ ID NO: 1159804 - RNA, 23 nt, Homo sapiens
ucuggcuagauuaccuagcuuag

SEQ ID NO: 1159805 - RNA, 23 nt, Homo sapiens
ucuggcugcaacuuaaugcucug

SEQ ID NO: 1159806 - RNA, 15 nt, Homo sapiens
ucugggagucacaca

SEQ ID NO: 1159807 - RNA, 23 nt, Homo sapiens
ucugggggaaaaagccauaucau

SEQ ID NO: 1159808 - RNA, 16 nt, Homo sapiens
ucugggucagacccau

SEQ ID NO: 1159809 - RNA, 19 nt, Homo sapiens
ucugggucagugguccaca

SEQ ID NO: 1159810 - RNA, 17 nt, Homo sapiens
ucugggugccuuaagga

SEQ ID NO: 1159811 - RNA, 17 nt, Homo sapiens
ucugguccuguuuucua

SEQ ID NO: 1159812 - RNA, 16 nt, Homo sapiens
ucuggucuccacagau

SEQ ID NO: 1159813 - RNA, 13 nt, Homo sapiens
ucuguacacugcc

SEQ ID NO: 1159814 - RNA, 16 nt, Homo sapiens
ucuguaggacuuugaa

SEQ ID NO: 1159815 - RNA, 15 nt, Homo sapiens
ucuguaguaaacuau

SEQ ID NO: 1159816 - RNA, 15 nt, Homo sapiens
ucuguagugagauag

SEQ ID NO: 1159817 - RNA, 13 nt, Homo sapiens
ucuguaguggaau

SEQ ID NO: 1159818 - RNA, 15 nt, Homo sapiens
ucuguagugugaaac

SEQ ID NO: 1159819 - RNA, 21 nt, Homo sapiens
ucuguaguuauucugaugaua

SEQ ID NO: 1159820 - RNA, 22 nt, Homo sapiens
ucuguauuuucaaagacugcca

SEQ ID NO: 1159821 - RNA, 23 nt, Homo sapiens
ucuguauuuucaaagacugccac

SEQ ID NO: 1159822 - RNA, 14 nt, Homo sapiens
ucugucacccaguc

SEQ ID NO: 1159823 - RNA, 18 nt, Homo sapiens
ucuguccauuaucuauau

SEQ ID NO: 1159824 - RNA, 15 nt, Homo sapiens
ucuguccuaccucca

SEQ ID NO: 1159825 - RNA, 15 nt, Homo sapiens
ucugucugucucucc

SEQ ID NO: 1159826 - RNA, 14 nt, Homo sapiens
ucugugaagcauuc

SEQ ID NO: 1159827 - RNA, 17 nt, Homo sapiens
ucugugcaugguggcac

SEQ ID NO: 1159828 - RNA, 16 nt, Homo sapiens
ucugugccgccaccuc

SEQ ID NO: 1159829 - RNA, 19 nt, Homo sapiens
ucugugccuuggucucucc

SEQ ID NO: 1159830 - RNA, 20 nt, Homo sapiens
ucuguggaaaguggugcaug

SEQ ID NO: 1159831 - RNA, 13 nt, Homo sapiens
ucuguggccacau

SEQ ID NO: 1159832 - RNA, 16 nt, Homo sapiens
ucugugggaaaaaaga

SEQ ID NO: 1159833 - RNA, 19 nt, Homo sapiens
ucugugggcuccauguaga

SEQ ID NO: 1159834 - RNA, 12 nt, Homo sapiens
ucuguguacaaa

SEQ ID NO: 1159835 - RNA, 15 nt, Homo sapiens
ucugugucucuggaa

SEQ ID NO: 1159836 - RNA, 13 nt, Homo sapiens
ucugugucuguca

SEQ ID NO: 1159837 - RNA, 21 nt, Homo sapiens
ucugugugcgcucuguggaug

SEQ ID NO: 1159838 - RNA, 21 nt, Homo sapiens
ucuguguugacccuuugucca

SEQ ID NO: 1159839 - RNA, 13 nt, Homo sapiens
ucuguuccauguc

SEQ ID NO: 1159840 - RNA, 17 nt, Homo sapiens
ucuguucugaugccacc

SEQ ID NO: 1159841 - RNA, 19 nt, Homo sapiens
ucuguucuguuucaaggca

SEQ ID NO: 1159842 - RNA, 13 nt, Homo sapiens
ucuguugccaugg

SEQ ID NO: 1159843 - RNA, 13 nt, Homo sapiens
ucuguugcugcuc

SEQ ID NO: 1159844 - RNA, 19 nt, Homo sapiens
ucuguuugaucacugugaa

SEQ ID NO: 1159845 - RNA, 17 nt, Homo sapiens
ucuuaaaaaacauauau

SEQ ID NO: 1159846 - RNA, 19 nt, Homo sapiens
ucuuaaaaaucuaugccua

SEQ ID NO: 1159847 - RNA, 23 nt, Homo sapiens
ucuuaaaaucacucagcacucca

SEQ ID NO: 1159848 - RNA, 22 nt, Homo sapiens
ucuuaacaaaccaacaucuuug

SEQ ID NO: 1159849 - RNA, 22 nt, Homo sapiens
ucuuaaccaguuguggugugag

SEQ ID NO: 1159850 - RNA, 20 nt, Homo sapiens
ucuuaaccuuugcuauguaa

SEQ ID NO: 1159851 - RNA, 13 nt, Homo sapiens
ucuuaagcagaga

SEQ ID NO: 1159852 - RNA, 17 nt, Homo sapiens
ucuuaauguuuccaaau

SEQ ID NO: 1159853 - RNA, 18 nt, Homo sapiens
ucuuacagucagcacaga

SEQ ID NO: 1159854 - RNA, 17 nt, Homo sapiens
ucuuaccuggcagcaaa

SEQ ID NO: 1159855 - RNA, 16 nt, Homo sapiens
ucuuaccuguaaccua

SEQ ID NO: 1159856 - RNA, 16 nt, Homo sapiens
ucuuacucccuccuuc

SEQ ID NO: 1159857 - RNA, 18 nt, Homo sapiens
ucuuacugcuuaauucaa

SEQ ID NO: 1159858 - RNA, 16 nt, Homo sapiens
ucuuacuugcauuuau

SEQ ID NO: 1159859 - RNA, 13 nt, Homo sapiens
ucuuagaccaugc

SEQ ID NO: 1159860 - RNA, 20 nt, Homo sapiens
ucuuagaucugguguccagc

SEQ ID NO: 1159861 - RNA, 17 nt, Homo sapiens
ucuuagucucagcacua

SEQ ID NO: 1159862 - RNA, 15 nt, Homo sapiens
ucuuaugccauguua

SEQ ID NO: 1159863 - RNA, 16 nt, Homo sapiens
ucuuauggcugcugaa

SEQ ID NO: 1159864 - RNA, 18 nt, Homo sapiens
ucuuauucucacuccacc

SEQ ID NO: 1159865 - RNA, 15 nt, Homo sapiens
ucuucaagacucuga

SEQ ID NO: 1159866 - RNA, 21 nt, Homo sapiens
ucuucaaggcuucagucucau

SEQ ID NO: 1159867 - RNA, 18 nt, Homo sapiens
ucuucaauuuggauauuu

SEQ ID NO: 1159868 - RNA, 24 nt, Homo sapiens
ucuucaccauuuggcaaugccauc

SEQ ID NO: 1159869 - RNA, 18 nt, Homo sapiens
ucuucaccugauucaacu

SEQ ID NO: 1159870 - RNA, 17 nt, Homo sapiens
ucuucacugcuacaugu

SEQ ID NO: 1159871 - RNA, 22 nt, Homo sapiens
ucuucacugcuacaugugcugg

SEQ ID NO: 1159872 - RNA, 20 nt, Homo sapiens
ucuucacuguguguuuuaaa

SEQ ID NO: 1159873 - RNA, 17 nt, Homo sapiens
ucuucagagaucaugga

SEQ ID NO: 1159874 - RNA, 14 nt, Homo sapiens
ucuucagaggagca

SEQ ID NO: 1159875 - RNA, 21 nt, Homo sapiens
ucuucagggaacugcauagau

SEQ ID NO: 1159876 - RNA, 19 nt, Homo sapiens
ucuucauaguuuauuuuca

SEQ ID NO: 1159877 - RNA, 18 nt, Homo sapiens
ucuuccaaacaggcucag

SEQ ID NO: 1159878 - RNA, 16 nt, Homo sapiens
ucuuccagaugugaug

SEQ ID NO: 1159879 - RNA, 19 nt, Homo sapiens
ucuucccgccucagccucu

SEQ ID NO: 1159880 - RNA, 19 nt, Homo sapiens
ucuucccuuuuaaacacau

SEQ ID NO: 1159881 - RNA, 21 nt, Homo sapiens
ucuuccucaagucuugacaau

SEQ ID NO: 1159882 - RNA, 23 nt, Homo sapiens
ucuuccuccgaggccaguaccuu

SEQ ID NO: 1159883 - RNA, 14 nt, Homo sapiens
ucuuccuuuuauca

SEQ ID NO: 1159884 - RNA, 15 nt, Homo sapiens
ucuucuaaacuuccc

SEQ ID NO: 1159885 - RNA, 22 nt, Homo sapiens
ucuucuaagaauuuuaucuguu

SEQ ID NO: 1159886 - RNA, 13 nt, Homo sapiens
ucuucuaagcaaa

SEQ ID NO: 1159887 - RNA, 15 nt, Homo sapiens
ucuucuaccagaccc

SEQ ID NO: 1159888 - RNA, 14 nt, Homo sapiens
ucuucuacuuuaag

SEQ ID NO: 1159889 - RNA, 19 nt, Homo sapiens
ucuucuccuggaguugcau

SEQ ID NO: 1159890 - RNA, 13 nt, Homo sapiens
ucuucuccuugau

SEQ ID NO: 1159891 - RNA, 15 nt, Homo sapiens
ucuucucuccacuuc

SEQ ID NO: 1159892 - RNA, 18 nt, Homo sapiens
ucuucugaauugacugua

SEQ ID NO: 1159893 - RNA, 16 nt, Homo sapiens
ugaagaaaagaccuuu

SEQ ID NO: 1159894 - RNA, 19 nt, Homo sapiens
ugaagaaaugaaaggugac

SEQ ID NO: 1159895 - RNA, 18 nt, Homo sapiens
ugaagaccagcuuucuca

SEQ ID NO: 1159896 - RNA, 12 nt, Homo sapiens
ugaagacuugcc

SEQ ID NO: 1159897 - RNA, 16 nt, Homo sapiens
ugaagaugcauuguag

SEQ ID NO: 1159898 - RNA, 19 nt, Homo sapiens
ugaagaugcauuguaguuu

SEQ ID NO: 1159899 - RNA, 17 nt, Homo sapiens
ugaagauguaaggaauu

SEQ ID NO: 1159900 - RNA, 14 nt, Homo sapiens
ugaagauuauuuca

SEQ ID NO: 1159901 - RNA, 12 nt, Homo sapiens
ugaagcauaauu

SEQ ID NO: 1159902 - RNA, 14 nt, Homo sapiens
ugaagccaauucag

SEQ ID NO: 1159903 - RNA, 14 nt, Homo sapiens
ugaagcccagugaa

SEQ ID NO: 1159904 - RNA, 15 nt, Homo sapiens
ugaagcccagugaau

SEQ ID NO: 1159905 - RNA, 16 nt, Homo sapiens
ugaagcccagugaauu

SEQ ID NO: 1159906 - RNA, 19 nt, Homo sapiens
ugaagccuuugccagccau

SEQ ID NO: 1159907 - RNA, 20 nt, Homo sapiens
ugaagcugagcuagaauucu

SEQ ID NO: 1159908 - RNA, 20 nt, Homo sapiens
ugaagcugaggcucaggggu

SEQ ID NO: 1159909 - RNA, 19 nt, Homo sapiens
ugaaggaaggacuaugaca

SEQ ID NO: 1159910 - RNA, 17 nt, Homo sapiens
ugaaggaauaauuaaga

SEQ ID NO: 1159911 - RNA, 16 nt, Homo sapiens
ugaaggagaaggugcc

SEQ ID NO: 1159912 - RNA, 14 nt, Homo sapiens
ugaaggccuggaau

SEQ ID NO: 1159913 - RNA, 20 nt, Homo sapiens
ugaaggcucauuuacuugaa

SEQ ID NO: 1159914 - RNA, 16 nt, Homo sapiens
ugaagggacggcugug

SEQ ID NO: 1159915 - RNA, 22 nt, Homo sapiens
ugaagggacggcugugggacca

SEQ ID NO: 1159916 - RNA, 24 nt, Homo sapiens
ugaaggggaaccccggggugccca

SEQ ID NO: 1159917 - RNA, 17 nt, Homo sapiens
ugaagguugacacagga

SEQ ID NO: 1159918 - RNA, 18 nt, Homo sapiens
ugaagguugacacaggaa

SEQ ID NO: 1159919 - RNA, 21 nt, Homo sapiens
ugaaguagacucauucuucac

SEQ ID NO: 1159920 - RNA, 16 nt, Homo sapiens
ugaaguccuucaccuc

SEQ ID NO: 1159921 - RNA, 12 nt, Homo sapiens
ugaagugcaaau

SEQ ID NO: 1159922 - RNA, 11 nt, Homo sapiens
ugaagugcuug

SEQ ID NO: 1159923 - RNA, 17 nt, Homo sapiens
ugaagugguucagucua

SEQ ID NO: 1159924 - RNA, 17 nt, Homo sapiens
ugaaguugggaaauuca

SEQ ID NO: 1159925 - RNA, 14 nt, Homo sapiens
ugaauaaaccaaga

SEQ ID NO: 1159926 - RNA, 13 nt, Homo sapiens
ugaauaacaguag

SEQ ID NO: 1159927 - RNA, 22 nt, Homo sapiens
ugaauacauuuucagagccaaa

SEQ ID NO: 1159928 - RNA, 14 nt, Homo sapiens
ugaauacuugcuau

SEQ ID NO: 1159929 - RNA, 13 nt, Homo sapiens
ugaauagcuuguu

SEQ ID NO: 1159930 - RNA, 17 nt, Homo sapiens
ugaaucagacccuaccc

SEQ ID NO: 1159931 - RNA, 23 nt, Homo sapiens
ugaaucccucuaucucuaaagaa

SEQ ID NO: 1159932 - RNA, 19 nt, Homo sapiens
ugaaucuaacagugacuuc

SEQ ID NO: 1159933 - RNA, 12 nt, Homo sapiens
ugaaucuaugaa

SEQ ID NO: 1159934 - RNA, 17 nt, Homo sapiens
ugaaucucugaauuuga

SEQ ID NO: 1159935 - RNA, 15 nt, Homo sapiens
ugaaucugcucacuu

SEQ ID NO: 1159936 - RNA, 21 nt, Homo sapiens
ugaaugaaacccccacacaca

SEQ ID NO: 1159937 - RNA, 20 nt, Homo sapiens
ugaaugaacacucuuuugcu

SEQ ID NO: 1159938 - RNA, 18 nt, Homo sapiens
ugaaugcagcacugcugc

SEQ ID NO: 1159939 - RNA, 13 nt, Homo sapiens
ugaaugucauuau

SEQ ID NO: 1159940 - RNA, 20 nt, Homo sapiens
ugaauuagcguuuaauccac

SEQ ID NO: 1159941 - RNA, 15 nt, Homo sapiens
ugaauuauggaucag

SEQ ID NO: 1159942 - RNA, 18 nt, Homo sapiens
ugaauucauguacauggu

SEQ ID NO: 1159943 - RNA, 15 nt, Homo sapiens
ugaauuccaagugua

SEQ ID NO: 1159944 - RNA, 12 nt, Homo sapiens
ugaauucuacug

SEQ ID NO: 1159945 - RNA, 17 nt, Homo sapiens
ugaauuggaccauccua

SEQ ID NO: 1159946 - RNA, 15 nt, Homo sapiens
ugaauuucacaagcu

SEQ ID NO: 1159947 - RNA, 16 nt, Homo sapiens
ugaauuucccacauac

SEQ ID NO: 1159948 - RNA, 21 nt, Homo sapiens
ugaauuugaaauagacuguga

SEQ ID NO: 1159949 - RNA, 16 nt, Homo sapiens
ugaauuuuuaugauau

SEQ ID NO: 1159950 - RNA, 15 nt, Homo sapiens
ugaauuuuugcaaua

SEQ ID NO: 1159951 - RNA, 10 nt, Homo sapiens
ugacaaaagg

SEQ ID NO: 1159952 - RNA, 14 nt, Homo sapiens
ugacaaaaggcaga

SEQ ID NO: 1159953 - RNA, 22 nt, Homo sapiens
ugacaaagcccaucccaggaga

SEQ ID NO: 1159954 - RNA, 14 nt, Homo sapiens
ugacaagcaaagaa

SEQ ID NO: 1159955 - RNA, 20 nt, Homo sapiens
ugacaauugcaaaucagagc

SEQ ID NO: 1159956 - RNA, 18 nt, Homo sapiens
ugacacaaguggaccuua

SEQ ID NO: 1159957 - RNA, 13 nt, Homo sapiens
ugacacauaugca

SEQ ID NO: 1159958 - RNA, 23 nt, Homo sapiens
ugacacucaagucccccaagacc

SEQ ID NO: 1159959 - RNA, 16 nt, Homo sapiens
ugacacucuccuugca

SEQ ID NO: 1159960 - RNA, 11 nt, Homo sapiens
ugacacuggac

SEQ ID NO: 1159961 - RNA, 22 nt, Homo sapiens
ugacacuggaccagguccugcu

SEQ ID NO: 1159962 - RNA, 14 nt, Homo sapiens
ugacagagcgagac

SEQ ID NO: 1159963 - RNA, 22 nt, Homo sapiens
ugacagagcgagacuccaucuc

SEQ ID NO: 1159964 - RNA, 23 nt, Homo sapiens
ugacagagcgagauuccgucuca

SEQ ID NO: 1159965 - RNA, 12 nt, Homo sapiens
ugacagagguac

SEQ ID NO: 1159966 - RNA, 14 nt, Homo sapiens
ugacagagguacaa

SEQ ID NO: 1159967 - RNA, 13 nt, Homo sapiens
ugacagagugccu

SEQ ID NO: 1159968 - RNA, 16 nt, Homo sapiens
ugacagcugucuuugg

SEQ ID NO: 1159969 - RNA, 20 nt, Homo sapiens
ugacagcuucuacuugcugu

SEQ ID NO: 1159970 - RNA, 17 nt, Homo sapiens
ugacagugggaggggau

SEQ ID NO: 1159971 - RNA, 19 nt, Homo sapiens
ugacaguuuacaaaugaca

SEQ ID NO: 1159972 - RNA, 16 nt, Homo sapiens
ugacaguuuguggcau

SEQ ID NO: 1159973 - RNA, 20 nt, Homo sapiens
ugacauaaaauuuacauuua

SEQ ID NO: 1159974 - RNA, 16 nt, Homo sapiens
ugacauggaaaggguc

SEQ ID NO: 1159975 - RNA, 23 nt, Homo sapiens
ugacauggacacaucaggaaguu

SEQ ID NO: 1159976 - RNA, 17 nt, Homo sapiens
ugacauggaggcacuga

SEQ ID NO: 1159977 - RNA, 20 nt, Homo sapiens
ugacauguauaguauacucu

SEQ ID NO: 1159978 - RNA, 23 nt, Homo sapiens
ugacauuagauugaugugcacug

SEQ ID NO: 1159979 - RNA, 15 nt, Homo sapiens
ugacauugcauuugg

SEQ ID NO: 1159980 - RNA, 15 nt, Homo sapiens
ugacauugccaaaaa

SEQ ID NO: 1159981 - RNA, 11 nt, Homo sapiens
ugacauuuuau

SEQ ID NO: 1159982 - RNA, 12 nt, Homo sapiens
ugaccacagcac

SEQ ID NO: 1159983 - RNA, 15 nt, Homo sapiens
ugaccacagcacagc

SEQ ID NO: 1159984 - RNA, 21 nt, Homo sapiens
ugaccaccgauuccagcugcg

SEQ ID NO: 1159985 - RNA, 21 nt, Homo sapiens
ugaccacugaagcaccacagg

SEQ ID NO: 1159986 - RNA, 17 nt, Homo sapiens
ugaccagagugggacca

SEQ ID NO: 1159987 - RNA, 18 nt, Homo sapiens
ugaccaggcuggucucaa

SEQ ID NO: 1159988 - RNA, 15 nt, Homo sapiens
ugaccagugcugcug

SEQ ID NO: 1159989 - RNA, 15 nt, Homo sapiens
ugaccuaacauaccg

SEQ ID NO: 1159990 - RNA, 17 nt, Homo sapiens
ugaccuagcaauaggca

SEQ ID NO: 1159991 - RNA, 15 nt, Homo sapiens
ugaccucaccugguc

SEQ ID NO: 1159992 - RNA, 20 nt, Homo sapiens
ugaccucgcccuccacaaau

SEQ ID NO: 1159993 - RNA, 12 nt, Homo sapiens
ugaccucuagcc

SEQ ID NO: 1159994 - RNA, 20 nt, Homo sapiens
ugaccugaacucugcaacug

SEQ ID NO: 1159995 - RNA, 18 nt, Homo sapiens
ugaccugaggaagcguga

SEQ ID NO: 1159996 - RNA, 14 nt, Homo sapiens
ugaccuucagcuca

SEQ ID NO: 1159997 - RNA, 18 nt, Homo sapiens
ugaccuugggguacaauu

SEQ ID NO: 1159998 - RNA, 19 nt, Homo sapiens
ugaccuugggguacaauug

SEQ ID NO: 1159999 - RNA, 16 nt, Homo sapiens
ugacggggggugggaa

SEQ ID NO: 1160000 - RNA, 20 nt, Homo sapiens
ugacgucaucaucacauuca

SEQ ID NO: 1160001 - RNA, 17 nt, Homo sapiens
ugacuaacuagacacca

SEQ ID NO: 1160002 - RNA, 15 nt, Homo sapiens
ugacucaguauaggu

SEQ ID NO: 1160003 - RNA, 16 nt, Homo sapiens
ugacuccuccaaggaa

SEQ ID NO: 1160004 - RNA, 19 nt, Homo sapiens
ugacucuagcaaggcucau

SEQ ID NO: 1160005 - RNA, 15 nt, Homo sapiens
ugacucuuccauuca

SEQ ID NO: 1160006 - RNA, 15 nt, Homo sapiens
ugacugaacuagagc

SEQ ID NO: 1160007 - RNA, 11 nt, Homo sapiens
ugacugaugac

SEQ ID NO: 1160008 - RNA, 16 nt, Homo sapiens
ugacuuauaauuugca

SEQ ID NO: 1160009 - RNA, 14 nt, Homo sapiens
ugacuucaaugaua

SEQ ID NO: 1160010 - RNA, 19 nt, Homo sapiens
ugacuuuaauuuauguaac

SEQ ID NO: 1160011 - RNA, 15 nt, Homo sapiens
ugacuuuuaucugua

SEQ ID NO: 1160012 - RNA, 19 nt, Homo sapiens
ugacuuuugaagaacaaaa

SEQ ID NO: 1160013 - RNA, 18 nt, Homo sapiens
ugagaaacucuacaugua

SEQ ID NO: 1160014 - RNA, 14 nt, Homo sapiens
ugagaaagcccugu

SEQ ID NO: 1160015 - RNA, 17 nt, Homo sapiens
ugagaaagggagaggaa

SEQ ID NO: 1160016 - RNA, 23 nt, Homo sapiens
ugagaaauuuacuacaguaguua

SEQ ID NO: 1160017 - RNA, 13 nt, Homo sapiens
ugagaacaaagau

SEQ ID NO: 1160018 - RNA, 14 nt, Homo sapiens
ugagaacaccagag

SEQ ID NO: 1160019 - RNA, 20 nt, Homo sapiens
ugagaacaccagagaccuca

SEQ ID NO: 1160020 - RNA, 14 nt, Homo sapiens
ugagaacugcauau

SEQ ID NO: 1160021 - RNA, 21 nt, Homo sapiens
ugagaacugguucuugccuuc

SEQ ID NO: 1160022 - RNA, 22 nt, Homo sapiens
ugagaagaaaacaucuauucuc

SEQ ID NO: 1160023 - RNA, 13 nt, Homo sapiens
ugagaagaucuga

SEQ ID NO: 1160024 - RNA, 16 nt, Homo sapiens
ugagaaggaacuucca

SEQ ID NO: 1160025 - RNA, 18 nt, Homo sapiens
ugagaaggaacuuuguca

SEQ ID NO: 1160026 - RNA, 20 nt, Homo sapiens
ugagaaggaacuuugucaca

SEQ ID NO: 1160027 - RNA, 19 nt, Homo sapiens
ugcuccuugggcccuuuga

SEQ ID NO: 1160028 - RNA, 20 nt, Homo sapiens
ugcucuaagucaaauuccaa

SEQ ID NO: 1160029 - RNA, 11 nt, Homo sapiens
ugcucuacugu

SEQ ID NO: 1160030 - RNA, 16 nt, Homo sapiens
ugcucugcucuaccau

SEQ ID NO: 1160031 - RNA, 23 nt, Homo sapiens
ugcucuugugauguuugcucaga

SEQ ID NO: 1160032 - RNA, 14 nt, Homo sapiens
ugcucuuuuacuaa

SEQ ID NO: 1160033 - RNA, 19 nt, Homo sapiens
ugcugaaacucagugcaaa

SEQ ID NO: 1160034 - RNA, 16 nt, Homo sapiens
ugcugaagacuugccc

SEQ ID NO: 1160035 - RNA, 13 nt, Homo sapiens
ugcugaagcugcu

SEQ ID NO: 1160036 - RNA, 14 nt, Homo sapiens
ugcugaagcugcug

SEQ ID NO: 1160037 - RNA, 22 nt, Homo sapiens
ugcugaguaacaggugccuucc

SEQ ID NO: 1160038 - RNA, 16 nt, Homo sapiens
ugcugcaccaaugcac

SEQ ID NO: 1160039 - RNA, 19 nt, Homo sapiens
ugcugcaccaaugcacuga

SEQ ID NO: 1160040 - RNA, 21 nt, Homo sapiens
ugcugcauuuuucugucagaa

SEQ ID NO: 1160041 - RNA, 21 nt, Homo sapiens
ugcugcccagggucaguguau

SEQ ID NO: 1160042 - RNA, 19 nt, Homo sapiens
ugcugcgcguggugcugag

SEQ ID NO: 1160043 - RNA, 21 nt, Homo sapiens
ugcugcuccuuagcugccaag

SEQ ID NO: 1160044 - RNA, 14 nt, Homo sapiens
ugcugcugcucauu

SEQ ID NO: 1160045 - RNA, 15 nt, Homo sapiens
ugcugcugcugcuca

SEQ ID NO: 1160046 - RNA, 14 nt, Homo sapiens
ugcugcuucuccau

SEQ ID NO: 1160047 - RNA, 19 nt, Homo sapiens
ugcugcuucuccauggcca

SEQ ID NO: 1160048 - RNA, 19 nt, Homo sapiens
ugcugcuuuuggugcucuc

SEQ ID NO: 1160049 - RNA, 18 nt, Homo sapiens
ugcuggaaaaucuguaaa

SEQ ID NO: 1160050 - RNA, 15 nt, Homo sapiens
ugcuggagaaaucau

SEQ ID NO: 1160051 - RNA, 15 nt, Homo sapiens
ugcuggcacuaucca

SEQ ID NO: 1160052 - RNA, 16 nt, Homo sapiens
ugcugggcuguuuacu

SEQ ID NO: 1160053 - RNA, 12 nt, Homo sapiens
ugcuggggagcc

SEQ ID NO: 1160054 - RNA, 16 nt, Homo sapiens
ugcuggggccucagac

SEQ ID NO: 1160055 - RNA, 19 nt, Homo sapiens
ugcuggguaauaaaaucau

SEQ ID NO: 1160056 - RNA, 17 nt, Homo sapiens
ugcuggugacucaugcc

SEQ ID NO: 1160057 - RNA, 16 nt, Homo sapiens
ugcuguacuugaugac

SEQ ID NO: 1160058 - RNA, 19 nt, Homo sapiens
ugcuguagauucacauaca

SEQ ID NO: 1160059 - RNA, 14 nt, Homo sapiens
ugcuguaugcugau

SEQ ID NO: 1160060 - RNA, 22 nt, Homo sapiens
ugcugucauuaguauuucacaa

SEQ ID NO: 1160061 - RNA, 22 nt, Homo sapiens
ugcugucccaaacaugcacuuc

SEQ ID NO: 1160062 - RNA, 11 nt, Homo sapiens
ugcugugcaaa

SEQ ID NO: 1160063 - RNA, 19 nt, Homo sapiens
ugcuguuaaaauugcucau

SEQ ID NO: 1160064 - RNA, 21 nt, Homo sapiens
ugcuguugacucuuccauuca

SEQ ID NO: 1160065 - RNA, 20 nt, Homo sapiens
ugcuguuuuaaauugcauuu

SEQ ID NO: 1160066 - RNA, 13 nt, Homo sapiens
ugcuuaagccauc

SEQ ID NO: 1160067 - RNA, 19 nt, Homo sapiens
ugcuuaagguaugguacaa

SEQ ID NO: 1160068 - RNA, 14 nt, Homo sapiens
ugcuuaauugcuga

SEQ ID NO: 1160069 - RNA, 22 nt, Homo sapiens
ugcuuaauugugaacagccaaa

SEQ ID NO: 1160070 - RNA, 17 nt, Homo sapiens
ugcuuacaaucuuuauu

SEQ ID NO: 1160071 - RNA, 16 nt, Homo sapiens
ugcuuaccacaucaca

SEQ ID NO: 1160072 - RNA, 17 nt, Homo sapiens
ugcuuauggaaagccag

SEQ ID NO: 1160073 - RNA, 19 nt, Homo sapiens
ugcuucaauuaaaauuaca

SEQ ID NO: 1160074 - RNA, 17 nt, Homo sapiens
ugcuucagcgaaaggga

SEQ ID NO: 1160075 - RNA, 14 nt, Homo sapiens
ugcuuccaacucau

SEQ ID NO: 1160076 - RNA, 18 nt, Homo sapiens
ugcuuccaacucauccac

SEQ ID NO: 1160077 - RNA, 23 nt, Homo sapiens
ugcuuccucccaacaagcagcug

SEQ ID NO: 1160078 - RNA, 18 nt, Homo sapiens
ugcuuccuugcuuuuaug

SEQ ID NO: 1160079 - RNA, 18 nt, Homo sapiens
ugcuucuacaugaugcua

SEQ ID NO: 1160080 - RNA, 14 nt, Homo sapiens
ugcuugccuuccuc

SEQ ID NO: 1160081 - RNA, 14 nt, Homo sapiens
ugcuuggugcuggu

SEQ ID NO: 1160082 - RNA, 17 nt, Homo sapiens
ugcuuguggccaaugca

SEQ ID NO: 1160083 - RNA, 14 nt, Homo sapiens
ugcuuguuauuaga

SEQ ID NO: 1160084 - RNA, 13 nt, Homo sapiens
ugcuuuaucuacu

SEQ ID NO: 1160085 - RNA, 18 nt, Homo sapiens
ugcuuuaugaaguuugag

SEQ ID NO: 1160086 - RNA, 15 nt, Homo sapiens
ugcuuucaauuacaa

SEQ ID NO: 1160087 - RNA, 23 nt, Homo sapiens
ugcuuuccuuuuuuaaaaaugca

SEQ ID NO: 1160088 - RNA, 19 nt, Homo sapiens
ugcuuucuuauaacuuugg

SEQ ID NO: 1160089 - RNA, 14 nt, Homo sapiens
ugcuuugcugugaa

SEQ ID NO: 1160090 - RNA, 18 nt, Homo sapiens
ugcuuuugaaaucuguau

SEQ ID NO: 1160091 - RNA, 18 nt, Homo sapiens
ugcuuuuguuccaauguc

SEQ ID NO: 1160092 - RNA, 21 nt, Homo sapiens
uggaaaaagcgcuguuuccuu

SEQ ID NO: 1160093 - RNA, 15 nt, Homo sapiens
uggaaaaaugaacug

SEQ ID NO: 1160094 - RNA, 23 nt, Homo sapiens
uggaaaagccuucuuauaucuga

SEQ ID NO: 1160095 - RNA, 18 nt, Homo sapiens
uggaaacaguuuggguua

SEQ ID NO: 1160096 - RNA, 16 nt, Homo sapiens
uggaaagacugggaca

SEQ ID NO: 1160097 - RNA, 13 nt, Homo sapiens
uggaaagguuuca

SEQ ID NO: 1160098 - RNA, 20 nt, Homo sapiens
uggaaagucucucuucugaa

SEQ ID NO: 1160099 - RNA, 14 nt, Homo sapiens
uggaaaguguaaag

SEQ ID NO: 1160100 - RNA, 16 nt, Homo sapiens
uggaaauggcaugcaa

SEQ ID NO: 1160101 - RNA, 17 nt, Homo sapiens
uggaacaagacagccuu

SEQ ID NO: 1160102 - RNA, 13 nt, Homo sapiens
uggaacaagcaca

SEQ ID NO: 1160103 - RNA, 14 nt, Homo sapiens
uggaacaagcacag

SEQ ID NO: 1160104 - RNA, 17 nt, Homo sapiens
uggaacacacauguccu

SEQ ID NO: 1160105 - RNA, 19 nt, Homo sapiens
uggaacacggccacaucaa

SEQ ID NO: 1160106 - RNA, 13 nt, Homo sapiens
uggaacagggaug

SEQ ID NO: 1160107 - RNA, 22 nt, Homo sapiens
uggaacaugcccacaacuuguc

SEQ ID NO: 1160108 - RNA, 23 nt, Homo sapiens
uggaacaugcccacaacuuguca

SEQ ID NO: 1160109 - RNA, 23 nt, Homo sapiens
uggaacuacauuaguacacagca

SEQ ID NO: 1160110 - RNA, 13 nt, Homo sapiens
uggaacucuugcu

SEQ ID NO: 1160111 - RNA, 16 nt, Homo sapiens
uggaagagcacaagag

SEQ ID NO: 1160112 - RNA, 20 nt, Homo sapiens
uggaagaugcagaagcaaua

SEQ ID NO: 1160113 - RNA, 16 nt, Homo sapiens
uggaagcaacguguua

SEQ ID NO: 1160114 - RNA, 11 nt, Homo sapiens
uggaagcagag

SEQ ID NO: 1160115 - RNA, 16 nt, Homo sapiens
uggaagcccuccuucc

SEQ ID NO: 1160116 - RNA, 17 nt, Homo sapiens
uggaagcuuguuuucca

SEQ ID NO: 1160117 - RNA, 13 nt, Homo sapiens
uggaaggagcaca

SEQ ID NO: 1160118 - RNA, 22 nt, Homo sapiens
uggaaggagcacauacuaccua

SEQ ID NO: 1160119 - RNA, 14 nt, Homo sapiens
uggaagucccucag

SEQ ID NO: 1160120 - RNA, 15 nt, Homo sapiens
uggaagucucaaaga

SEQ ID NO: 1160121 - RNA, 12 nt, Homo sapiens
uggaagugcaga

SEQ ID NO: 1160122 - RNA, 18 nt, Homo sapiens
uggaauaauccuaaacau

SEQ ID NO: 1160123 - RNA, 23 nt, Homo sapiens
uggaauaauccuaaacauaugaa

SEQ ID NO: 1160124 - RNA, 14 nt, Homo sapiens
uggaauauuugcug

SEQ ID NO: 1160125 - RNA, 18 nt, Homo sapiens
uggaaucccacuaaugca

SEQ ID NO: 1160126 - RNA, 19 nt, Homo sapiens
uggaaugccaaugucagca

SEQ ID NO: 1160127 - RNA, 15 nt, Homo sapiens
uggaauggagauuca

SEQ ID NO: 1160128 - RNA, 15 nt, Homo sapiens
uggaauugacucaaa

SEQ ID NO: 1160129 - RNA, 23 nt, Homo sapiens
uggaauuugcuuuaucuacuuua

SEQ ID NO: 1160130 - RNA, 16 nt, Homo sapiens
uggacaaagaaccuuc

SEQ ID NO: 1160131 - RNA, 14 nt, Homo sapiens
uggacacacgguca

SEQ ID NO: 1160132 - RNA, 13 nt, Homo sapiens
uggacacuguggu

SEQ ID NO: 1160133 - RNA, 12 nt, Homo sapiens
uggacagaagca

SEQ ID NO: 1160134 - RNA, 16 nt, Homo sapiens
uggacagccugaguca

SEQ ID NO: 1160135 - RNA, 18 nt, Homo sapiens
uggacagucucaccuccu

SEQ ID NO: 1160136 - RNA, 13 nt, Homo sapiens
uggacauaucauc

SEQ ID NO: 1160137 - RNA, 18 nt, Homo sapiens
uggacauuuuuucaguca

SEQ ID NO: 1160138 - RNA, 21 nt, Homo sapiens
uggaccaccguucagucauuu

SEQ ID NO: 1160139 - RNA, 12 nt, Homo sapiens
uggaccacugca

SEQ ID NO: 1160140 - RNA, 15 nt, Homo sapiens
uggaccacugcauga

SEQ ID NO: 1160141 - RNA, 14 nt, Homo sapiens
uggaccuauugcca

SEQ ID NO: 1160142 - RNA, 12 nt, Homo sapiens
uggacggaacca

SEQ ID NO: 1160143 - RNA, 22 nt, Homo sapiens
uggacuccaucucucauccucc

SEQ ID NO: 1160144 - RNA, 14 nt, Homo sapiens
uggacugguuuuca

SEQ ID NO: 1160145 - RNA, 21 nt, Homo sapiens
uggacuguggcacuugccugg

SEQ ID NO: 1160146 - RNA, 21 nt, Homo sapiens
uggagaaagggcagaggaaga

SEQ ID NO: 1160147 - RNA, 16 nt, Homo sapiens
uggagaacaacccaag

SEQ ID NO: 1160148 - RNA, 23 nt, Homo sapiens
uggagaacuaaagguggccacaa

SEQ ID NO: 1160149 - RNA, 14 nt, Homo sapiens
uggagacaggccau

SEQ ID NO: 1160150 - RNA, 23 nt, Homo sapiens
uggagaccgugaccagugcugcu

SEQ ID NO: 1160151 - RNA, 16 nt, Homo sapiens
uggagacuaaccccac

SEQ ID NO: 1160152 - RNA, 20 nt, Homo sapiens
uggagacuaaccccaccaca

SEQ ID NO: 1160153 - RNA, 16 nt, Homo sapiens
uggagagacagcuaca

SEQ ID NO: 1160154 - RNA, 21 nt, Homo sapiens
uggagagaccagccuuucuuc

SEQ ID NO: 1160155 - RNA, 21 nt, Homo sapiens
uggagagccccucacacagcc

SEQ ID NO: 1160156 - RNA, 19 nt, Homo sapiens
uggagagggugucaucuag

SEQ ID NO: 1160157 - RNA, 21 nt, Homo sapiens
uggagauaggggaaaucacau

SEQ ID NO: 1160158 - RNA, 23 nt, Homo sapiens
uggagauccagaagagaauuaga

SEQ ID NO: 1160159 - RNA, 17 nt, Homo sapiens
uggagauucuaauccca

SEQ ID NO: 1160160 - RNA, 23 nt, Homo sapiens
ugucuucuccuucaaaacauucu

SEQ ID NO: 1160161 - RNA, 18 nt, Homo sapiens
ugucuugcagauguagaa

SEQ ID NO: 1160162 - RNA, 14 nt, Homo sapiens
ugucuuugccaagu

SEQ ID NO: 1160163 - RNA, 12 nt, Homo sapiens
ugugaacacugg

SEQ ID NO: 1160164 - RNA, 21 nt, Homo sapiens
ugugaacacuggagucuugca

SEQ ID NO: 1160165 - RNA, 18 nt, Homo sapiens
ugugaacauuugugauau

SEQ ID NO: 1160166 - RNA, 21 nt, Homo sapiens
ugugaaccaacccccaucucc

SEQ ID NO: 1160167 - RNA, 14 nt, Homo sapiens
ugugaagaaagggu

SEQ ID NO: 1160168 - RNA, 17 nt, Homo sapiens
ugugaagaaaggguguu

SEQ ID NO: 1160169 - RNA, 18 nt, Homo sapiens
ugugaagcaggucuuuca

SEQ ID NO: 1160170 - RNA, 17 nt, Homo sapiens
ugugaaggccaugauau

SEQ ID NO: 1160171 - RNA, 13 nt, Homo sapiens
ugugaaguuacau

SEQ ID NO: 1160172 - RNA, 19 nt, Homo sapiens
ugugaaucugggugggaua

SEQ ID NO: 1160173 - RNA, 20 nt, Homo sapiens
ugugacaaucugccuuucac

SEQ ID NO: 1160174 - RNA, 18 nt, Homo sapiens
ugugaccaaaaguuacau

SEQ ID NO: 1160175 - RNA, 19 nt, Homo sapiens
ugugaccaauacauuugua

SEQ ID NO: 1160176 - RNA, 20 nt, Homo sapiens
ugugaccugaaccaaucacu

SEQ ID NO: 1160177 - RNA, 16 nt, Homo sapiens
ugugaccuugggacca

SEQ ID NO: 1160178 - RNA, 20 nt, Homo sapiens
ugugacguagcaaucuuggu

SEQ ID NO: 1160179 - RNA, 21 nt, Homo sapiens
ugugacgugcacugugaaucc

SEQ ID NO: 1160180 - RNA, 17 nt, Homo sapiens
ugugagaauaaacuaga

SEQ ID NO: 1160181 - RNA, 18 nt, Homo sapiens
ugugagaauaaacuagac

SEQ ID NO: 1160182 - RNA, 15 nt, Homo sapiens
ugugagaccagggga

SEQ ID NO: 1160183 - RNA, 15 nt, Homo sapiens
ugugagaugauuugu

SEQ ID NO: 1160184 - RNA, 18 nt, Homo sapiens
ugugagccuugcugccaa

SEQ ID NO: 1160185 - RNA, 20 nt, Homo sapiens
ugugaguuugccguuugucc

SEQ ID NO: 1160186 - RNA, 16 nt, Homo sapiens
ugugauauuugacaga

SEQ ID NO: 1160187 - RNA, 16 nt, Homo sapiens
ugugauguuugcucag

SEQ ID NO: 1160188 - RNA, 14 nt, Homo sapiens
ugugcaaacagugu

SEQ ID NO: 1160189 - RNA, 15 nt, Homo sapiens
ugugcaccuuuacac

SEQ ID NO: 1160190 - RNA, 17 nt, Homo sapiens
ugugcauauuguacacu

SEQ ID NO: 1160191 - RNA, 14 nt, Homo sapiens
ugugcauuccucac

SEQ ID NO: 1160192 - RNA, 23 nt, Homo sapiens
ugugccaggaggcggcagcucuu

SEQ ID NO: 1160193 - RNA, 20 nt, Homo sapiens
ugugccaugcuaugugcaca

SEQ ID NO: 1160194 - RNA, 14 nt, Homo sapiens
ugugccgccaccuc

SEQ ID NO: 1160195 - RNA, 14 nt, Homo sapiens
ugugccuacauguu

SEQ ID NO: 1160196 - RNA, 22 nt, Homo sapiens
ugugccuuaggaaaagcauuug

SEQ ID NO: 1160197 - RNA, 15 nt, Homo sapiens
ugugcggcagauugc

SEQ ID NO: 1160198 - RNA, 18 nt, Homo sapiens
ugugcguguauaugugcu

SEQ ID NO: 1160199 - RNA, 22 nt, Homo sapiens
ugugcucuacuguuacuaggcu

SEQ ID NO: 1160200 - RNA, 14 nt, Homo sapiens
ugugcugaacacac

SEQ ID NO: 1160201 - RNA, 15 nt, Homo sapiens
ugugcuuaacauuga

SEQ ID NO: 1160202 - RNA, 19 nt, Homo sapiens
uguggaauugacucaaaaa

SEQ ID NO: 1160203 - RNA, 17 nt, Homo sapiens
uguggacgcugugcugg

SEQ ID NO: 1160204 - RNA, 21 nt, Homo sapiens
uguggacguggguugcacugg

SEQ ID NO: 1160205 - RNA, 17 nt, Homo sapiens
uguggaggccucaggga

SEQ ID NO: 1160206 - RNA, 17 nt, Homo sapiens
uguggaucuugagcucu

SEQ ID NO: 1160207 - RNA, 22 nt, Homo sapiens
uguggaugggaaacugcuccag

SEQ ID NO: 1160208 - RNA, 17 nt, Homo sapiens
uguggauggucauugca

SEQ ID NO: 1160209 - RNA, 23 nt, Homo sapiens
uguggauggugucuccuuuacua

SEQ ID NO: 1160210 - RNA, 19 nt, Homo sapiens
uguggauguguaaauggcu

SEQ ID NO: 1160211 - RNA, 14 nt, Homo sapiens
uguggcagccacac

SEQ ID NO: 1160212 - RNA, 12 nt, Homo sapiens
uguggcagugaa

SEQ ID NO: 1160213 - RNA, 15 nt, Homo sapiens
uguggccaucacuca

SEQ ID NO: 1160214 - RNA, 14 nt, Homo sapiens
uguggccaucugcu

SEQ ID NO: 1160215 - RNA, 19 nt, Homo sapiens
uguggcccuguccugccau

SEQ ID NO: 1160216 - RNA, 20 nt, Homo sapiens
uguggccuucggacaacuca

SEQ ID NO: 1160217 - RNA, 18 nt, Homo sapiens
uguggcuuauguggaguu

SEQ ID NO: 1160218 - RNA, 12 nt, Homo sapiens
ugugggaccagg

SEQ ID NO: 1160219 - RNA, 21 nt, Homo sapiens
ugugggcgcucucccuaccuu

SEQ ID NO: 1160220 - RNA, 15 nt, Homo sapiens
ugugggcuccaugua

SEQ ID NO: 1160221 - RNA, 18 nt, Homo sapiens
uguggggugggcacauug

SEQ ID NO: 1160222 - RNA, 15 nt, Homo sapiens
uguggguaccuguau

SEQ ID NO: 1160223 - RNA, 20 nt, Homo sapiens
ugugguccacugagcuauaa

SEQ ID NO: 1160224 - RNA, 20 nt, Homo sapiens
uguguaaagaucuacaugaa

SEQ ID NO: 1160225 - RNA, 21 nt, Homo sapiens
uguguauuuacgcuuugauuc

SEQ ID NO: 1160226 - RNA, 17 nt, Homo sapiens
uguguauuucucuguga

SEQ ID NO: 1160227 - RNA, 13 nt, Homo sapiens
ugugucaccauca

SEQ ID NO: 1160228 - RNA, 18 nt, Homo sapiens
ugugucagggaacauauu

SEQ ID NO: 1160229 - RNA, 22 nt, Homo sapiens
ugugucaguggggcucucugag

SEQ ID NO: 1160230 - RNA, 19 nt, Homo sapiens
ugugucccaggcagggaga

SEQ ID NO: 1160231 - RNA, 19 nt, Homo sapiens
ugugucccccucuguccag

SEQ ID NO: 1160232 - RNA, 16 nt, Homo sapiens
ugugucuaagauucua

SEQ ID NO: 1160233 - RNA, 23 nt, Homo sapiens
ugugucucuggaacccaggaccu

SEQ ID NO: 1160234 - RNA, 12 nt, Homo sapiens
ugugucuguaca

SEQ ID NO: 1160235 - RNA, 22 nt, Homo sapiens
ugugugaaaccuacagcauauu

SEQ ID NO: 1160236 - RNA, 14 nt, Homo sapiens
ugugugacuccauu

SEQ ID NO: 1160237 - RNA, 17 nt, Homo sapiens
ugugugagaccagggga

SEQ ID NO: 1160238 - RNA, 21 nt, Homo sapiens
ugugugaggacuucugcaucu

SEQ ID NO: 1160239 - RNA, 11 nt, Homo sapiens
ugugugcacau

SEQ ID NO: 1160240 - RNA, 16 nt, Homo sapiens
ugugugcgugcgcauc

SEQ ID NO: 1160241 - RNA, 14 nt, Homo sapiens
uguguguacaacac

SEQ ID NO: 1160242 - RNA, 17 nt, Homo sapiens
uguguguacaacacugg

SEQ ID NO: 1160243 - RNA, 16 nt, Homo sapiens
ugugugugugugcaca

SEQ ID NO: 1160244 - RNA, 17 nt, Homo sapiens
uguguguuauaccuuga

SEQ ID NO: 1160245 - RNA, 16 nt, Homo sapiens
uguguuagcuuguaua

SEQ ID NO: 1160246 - RNA, 22 nt, Homo sapiens
uguguucuuccucucucagggg

SEQ ID NO: 1160247 - RNA, 20 nt, Homo sapiens
uguguuucuagaaucacagc

SEQ ID NO: 1160248 - RNA, 18 nt, Homo sapiens
uguguuucuauugacuuc

SEQ ID NO: 1160249 - RNA, 20 nt, Homo sapiens
uguguuuuuaauaaagacag

SEQ ID NO: 1160250 - RNA, 19 nt, Homo sapiens
uguuaaauuaacucacuau

SEQ ID NO: 1160251 - RNA, 14 nt, Homo sapiens
uguuaacuauugua

SEQ ID NO: 1160252 - RNA, 15 nt, Homo sapiens
uguuaagacuugaca

SEQ ID NO: 1160253 - RNA, 23 nt, Homo sapiens
uguuaagguccugaaaguaacuc

SEQ ID NO: 1160254 - RNA, 18 nt, Homo sapiens
uguuaauaaacaaaguaa

SEQ ID NO: 1160255 - RNA, 15 nt, Homo sapiens
uguuaauguucauau

SEQ ID NO: 1160256 - RNA, 20 nt, Homo sapiens
uguuacacaugacacucuuc

SEQ ID NO: 1160257 - RNA, 23 nt, Homo sapiens
uguuaccugaaaacacugugcac

SEQ ID NO: 1160258 - RNA, 16 nt, Homo sapiens
uguuacuaaauccuuu

SEQ ID NO: 1160259 - RNA, 15 nt, Homo sapiens
uguuacuauuccuuu

SEQ ID NO: 1160260 - RNA, 15 nt, Homo sapiens
uguuacugugucagg

SEQ ID NO: 1160261 - RNA, 20 nt, Homo sapiens
uguuagccgggauggucuug

SEQ ID NO: 1160262 - RNA, 17 nt, Homo sapiens
uguuaucaggacuugag

SEQ ID NO: 1160263 - RNA, 11 nt, Homo sapiens
uguuauccaua

SEQ ID NO: 1160264 - RNA, 17 nt, Homo sapiens
uguuaugaggagcugca

SEQ ID NO: 1160265 - RNA, 16 nt, Homo sapiens
uguuauugauguugcu

SEQ ID NO: 1160266 - RNA, 20 nt, Homo sapiens
uguuauuuccccagccacag

SEQ ID NO: 1160267 - RNA, 15 nt, Homo sapiens
uguuauuuucaguga

SEQ ID NO: 1160268 - RNA, 14 nt, Homo sapiens
uguucaacugugag

SEQ ID NO: 1160269 - RNA, 19 nt, Homo sapiens
uguucacacacacaguuug

SEQ ID NO: 1160270 - RNA, 16 nt, Homo sapiens
uguucaggaagcuggu

SEQ ID NO: 1160271 - RNA, 15 nt, Homo sapiens
uguucauauucacua

SEQ ID NO: 1160272 - RNA, 15 nt, Homo sapiens
uguucaucaauaccu

SEQ ID NO: 1160273 - RNA, 13 nt, Homo sapiens
uguucaucucuuu

SEQ ID NO: 1160274 - RNA, 22 nt, Homo sapiens
uguucauuuugucacaagcugu

SEQ ID NO: 1160275 - RNA, 11 nt, Homo sapiens
uguuccagagc

SEQ ID NO: 1160276 - RNA, 15 nt, Homo sapiens
uguuccccaccgcug

SEQ ID NO: 1160277 - RNA, 15 nt, Homo sapiens
uguucccuugaccau

SEQ ID NO: 1160278 - RNA, 18 nt, Homo sapiens
uguuccuuauauuuacuc

SEQ ID NO: 1160279 - RNA, 14 nt, Homo sapiens
uguucggagcucuu

SEQ ID NO: 1160280 - RNA, 22 nt, Homo sapiens
uguucuaaagguggugaggcaa

SEQ ID NO: 1160281 - RNA, 14 nt, Homo sapiens
uguucuccaacucc

SEQ ID NO: 1160282 - RNA, 20 nt, Homo sapiens
uguucucuggcucuugucca

SEQ ID NO: 1160283 - RNA, 18 nt, Homo sapiens
uguucuguggaaagugua

SEQ ID NO: 1160284 - RNA, 24 nt, Homo sapiens
uguucuuggaccuuuuguacugaa

SEQ ID NO: 1160285 - RNA, 16 nt, Homo sapiens
uguucuuuuuauugaa

SEQ ID NO: 1160286 - RNA, 21 nt, Homo sapiens
uguugaagcucuuuacuguaa

SEQ ID NO: 1160287 - RNA, 21 nt, Homo sapiens
uguugaauucuuuugccaagg

SEQ ID NO: 1160288 - RNA, 18 nt, Homo sapiens
uguugaccggcugccguu

SEQ ID NO: 1160289 - RNA, 19 nt, Homo sapiens
uguugagaugauauuuaac

SEQ ID NO: 1160290 - RNA, 20 nt, Homo sapiens
uguugagcaaugugcacuuc

SEQ ID NO: 1160291 - RNA, 17 nt, Homo sapiens
uguugagcaucacagaa

SEQ ID NO: 1160292 - RNA, 21 nt, Homo sapiens
uucccauuuguaauuuguaaa

SEQ ID NO: 1160293 - RNA, 19 nt, Homo sapiens
uucccauuuguugcugcug

SEQ ID NO: 1160294 - RNA, 15 nt, Homo sapiens
uuccccaaaugaagg

SEQ ID NO: 1160295 - RNA, 13 nt, Homo sapiens
uuccccauuguau

SEQ ID NO: 1160296 - RNA, 15 nt, Homo sapiens
uuccccuauggaauu

SEQ ID NO: 1160297 - RNA, 18 nt, Homo sapiens
uuccccucauugcauuua

SEQ ID NO: 1160298 - RNA, 18 nt, Homo sapiens
uuccccucucaaagggga

SEQ ID NO: 1160299 - RNA, 17 nt, Homo sapiens
uuccccuucggucuuaa

SEQ ID NO: 1160300 - RNA, 18 nt, Homo sapiens
uucccgcacaaauuccac

SEQ ID NO: 1160301 - RNA, 13 nt, Homo sapiens
uucccuaccuaag

SEQ ID NO: 1160302 - RNA, 16 nt, Homo sapiens
uucccucuucccugac

SEQ ID NO: 1160303 - RNA, 17 nt, Homo sapiens
uucccugacuugcuuua

SEQ ID NO: 1160304 - RNA, 20 nt, Homo sapiens
uucccuguggguggggagcu

SEQ ID NO: 1160305 - RNA, 13 nt, Homo sapiens
uucccuugccauc

SEQ ID NO: 1160306 - RNA, 18 nt, Homo sapiens
uucccuuuggcagcugca

SEQ ID NO: 1160307 - RNA, 23 nt, Homo sapiens
uucccuuuuggggcaagacagac

SEQ ID NO: 1160308 - RNA, 15 nt, Homo sapiens
uuccgagccauggaa

SEQ ID NO: 1160309 - RNA, 21 nt, Homo sapiens
uuccgaggccccugucucagg

SEQ ID NO: 1160310 - RNA, 16 nt, Homo sapiens
uuccguggcacugcau

SEQ ID NO: 1160311 - RNA, 20 nt, Homo sapiens
uuccuaaccccuaaggcaac

SEQ ID NO: 1160312 - RNA, 18 nt, Homo sapiens
uuccuaaguuuaagggaa

SEQ ID NO: 1160313 - RNA, 22 nt, Homo sapiens
uuccuaccugcagauccagggg

SEQ ID NO: 1160314 - RNA, 13 nt, Homo sapiens
uuccuacuucauu

SEQ ID NO: 1160315 - RNA, 19 nt, Homo sapiens
uuccuacuucauuccagca

SEQ ID NO: 1160316 - RNA, 16 nt, Homo sapiens
uuccuaucaaaguguc

SEQ ID NO: 1160317 - RNA, 17 nt, Homo sapiens
uuccucaagaacacagc

SEQ ID NO: 1160318 - RNA, 18 nt, Homo sapiens
uuccucagaaaccaaagc

SEQ ID NO: 1160319 - RNA, 13 nt, Homo sapiens
uuccucagaucau

SEQ ID NO: 1160320 - RNA, 16 nt, Homo sapiens
uuccuccaaacccaac

SEQ ID NO: 1160321 - RNA, 15 nt, Homo sapiens
uuccucucucccacc

SEQ ID NO: 1160322 - RNA, 16 nt, Homo sapiens
uuccucugauuugaag

SEQ ID NO: 1160323 - RNA, 17 nt, Homo sapiens
uuccugaaaagauccua

SEQ ID NO: 1160324 - RNA, 19 nt, Homo sapiens
uuccugaaauaaugcaagc

SEQ ID NO: 1160325 - RNA, 15 nt, Homo sapiens
uuccugaauacugaa

SEQ ID NO: 1160326 - RNA, 20 nt, Homo sapiens
uuccugacaaaaguuccaua

SEQ ID NO: 1160327 - RNA, 23 nt, Homo sapiens
uuccugacuuaaaacaaaaggaa

SEQ ID NO: 1160328 - RNA, 20 nt, Homo sapiens
uuccugagaggaagccugag

SEQ ID NO: 1160329 - RNA, 21 nt, Homo sapiens
uuccugccaggagcucuccac

SEQ ID NO: 1160330 - RNA, 20 nt, Homo sapiens
uuccugcuuauucauaauaa

SEQ ID NO: 1160331 - RNA, 19 nt, Homo sapiens
uuccugcuucaucuuccca

SEQ ID NO: 1160332 - RNA, 18 nt, Homo sapiens
uuccuguauguuguccaa

SEQ ID NO: 1160333 - RNA, 15 nt, Homo sapiens
uuccugugcuuauau

SEQ ID NO: 1160334 - RNA, 15 nt, Homo sapiens
uuccuguucaguaau

SEQ ID NO: 1160335 - RNA, 19 nt, Homo sapiens
uuccuucucaucugugauu

SEQ ID NO: 1160336 - RNA, 18 nt, Homo sapiens
uuccuucuuuaaacacuc

SEQ ID NO: 1160337 - RNA, 17 nt, Homo sapiens
uuccuuuauacugugaa

SEQ ID NO: 1160338 - RNA, 18 nt, Homo sapiens
uuccuuuccuaaaagugu

SEQ ID NO: 1160339 - RNA, 16 nt, Homo sapiens
uuccuuuguugcacaa

SEQ ID NO: 1160340 - RNA, 19 nt, Homo sapiens
uucgagaccagccugacca

SEQ ID NO: 1160341 - RNA, 15 nt, Homo sapiens
uucgagguggaucac

SEQ ID NO: 1160342 - RNA, 13 nt, Homo sapiens
uucgagucuugcu

SEQ ID NO: 1160343 - RNA, 16 nt, Homo sapiens
uucgauauuucaggaa

SEQ ID NO: 1160344 - RNA, 13 nt, Homo sapiens
uucgccucuggau

SEQ ID NO: 1160345 - RNA, 19 nt, Homo sapiens
uucggccagagcugaagag

SEQ ID NO: 1160346 - RNA, 21 nt, Homo sapiens
uucguagauauuggacaaaga

SEQ ID NO: 1160347 - RNA, 15 nt, Homo sapiens
uucgucaucuucccu

SEQ ID NO: 1160348 - RNA, 23 nt, Homo sapiens
uucuaaagauggaaaaaccaccc

SEQ ID NO: 1160349 - RNA, 17 nt, Homo sapiens
uucuaaaguucuaagau

SEQ ID NO: 1160350 - RNA, 23 nt, Homo sapiens
uucuaaauaugaaugaaugggau

SEQ ID NO: 1160351 - RNA, 17 nt, Homo sapiens
uucuaagacuacuauga

SEQ ID NO: 1160352 - RNA, 13 nt, Homo sapiens
uucuaagauucua

SEQ ID NO: 1160353 - RNA, 12 nt, Homo sapiens
uucuaagcaugu

SEQ ID NO: 1160354 - RNA, 13 nt, Homo sapiens
uucuaagcaugua

SEQ ID NO: 1160355 - RNA, 23 nt, Homo sapiens
uucuaagguccgguguucuaaga

SEQ ID NO: 1160356 - RNA, 17 nt, Homo sapiens
uucuaaguuucuaagau

SEQ ID NO: 1160357 - RNA, 21 nt, Homo sapiens
uucuacgcugccucaacacug

SEQ ID NO: 1160358 - RNA, 14 nt, Homo sapiens
uucuacugccauuc

SEQ ID NO: 1160359 - RNA, 23 nt, Homo sapiens
uucuacuucuggaagucaucuca

SEQ ID NO: 1160360 - RNA, 21 nt, Homo sapiens
uucuacuuuaagguuugcaga

SEQ ID NO: 1160361 - RNA, 18 nt, Homo sapiens
uucuagaaaagcuuccua

SEQ ID NO: 1160362 - RNA, 21 nt, Homo sapiens
uucuaggcacuguaguucuaa

SEQ ID NO: 1160363 - RNA, 16 nt, Homo sapiens
uucuaguugcuuguaa

SEQ ID NO: 1160364 - RNA, 18 nt, Homo sapiens
uucuauaagaaaaaggaa

SEQ ID NO: 1160365 - RNA, 16 nt, Homo sapiens
uucuauaaugugccug

SEQ ID NO: 1160366 - RNA, 14 nt, Homo sapiens
uucuauacauucua

SEQ ID NO: 1160367 - RNA, 17 nt, Homo sapiens
uucuauaggaacauaug

SEQ ID NO: 1160368 - RNA, 21 nt, Homo sapiens
uucuauauauauauaaauaua

SEQ ID NO: 1160369 - RNA, 21 nt, Homo sapiens
uucuaugugaccagacugcac

SEQ ID NO: 1160370 - RNA, 22 nt, Homo sapiens
uucuaugugaccagacugcaca

SEQ ID NO: 1160371 - RNA, 16 nt, Homo sapiens
uucuauuuccuggaau

SEQ ID NO: 1160372 - RNA, 15 nt, Homo sapiens
uucucaagaagaaca

SEQ ID NO: 1160373 - RNA, 22 nt, Homo sapiens
uucucagacuuuggaaaaugca

SEQ ID NO: 1160374 - RNA, 17 nt, Homo sapiens
uucucagccacaaccaa

SEQ ID NO: 1160375 - RNA, 16 nt, Homo sapiens
uucucagcuggaugau

SEQ ID NO: 1160376 - RNA, 23 nt, Homo sapiens
uucucaggaagcccccaaguuga

SEQ ID NO: 1160377 - RNA, 15 nt, Homo sapiens
uucuccaaacgauua

SEQ ID NO: 1160378 - RNA, 22 nt, Homo sapiens
uucuccacaacacugugucaca

SEQ ID NO: 1160379 - RNA, 16 nt, Homo sapiens
uucuccaucacaacca

SEQ ID NO: 1160380 - RNA, 12 nt, Homo sapiens
uucucccauuua

SEQ ID NO: 1160381 - RNA, 17 nt, Homo sapiens
uucucccuuuaaggugc

SEQ ID NO: 1160382 - RNA, 19 nt, Homo sapiens
uucuccuaaugcucugaaa

SEQ ID NO: 1160383 - RNA, 17 nt, Homo sapiens
uucuccugugugauuga

SEQ ID NO: 1160384 - RNA, 15 nt, Homo sapiens
uucuccuuuugaacu

SEQ ID NO: 1160385 - RNA, 14 nt, Homo sapiens
uucucuccaccagg

SEQ ID NO: 1160386 - RNA, 19 nt, Homo sapiens
uucucugaaaagcaaagga

SEQ ID NO: 1160387 - RNA, 16 nt, Homo sapiens
uucucuuuaaucucau

SEQ ID NO: 1160388 - RNA, 15 nt, Homo sapiens
uucugaaacugcaua

SEQ ID NO: 1160389 - RNA, 17 nt, Homo sapiens
uucugaagccucacuua

SEQ ID NO: 1160390 - RNA, 16 nt, Homo sapiens
uucugaagugcugcuc

SEQ ID NO: 1160391 - RNA, 14 nt, Homo sapiens
uucugaaugugauc

SEQ ID NO: 1160392 - RNA, 15 nt, Homo sapiens
uucugaauuguccuu

SEQ ID NO: 1160393 - RNA, 15 nt, Homo sapiens
uucugaauuugcaaa

SEQ ID NO: 1160394 - RNA, 22 nt, Homo sapiens
uucugacacacuuagggcagaa

SEQ ID NO: 1160395 - RNA, 12 nt, Homo sapiens
uucugagcauuu

SEQ ID NO: 1160396 - RNA, 15 nt, Homo sapiens
uucugagccugccuu

SEQ ID NO: 1160397 - RNA, 11 nt, Homo sapiens
uucugcaauga

SEQ ID NO: 1160398 - RNA, 17 nt, Homo sapiens
uucugcauauguugaau

SEQ ID NO: 1160399 - RNA, 23 nt, Homo sapiens
uucugccaggcccccaagccugc

SEQ ID NO: 1160400 - RNA, 18 nt, Homo sapiens
uucugccuuuagcuuuga

SEQ ID NO: 1160401 - RNA, 22 nt, Homo sapiens
uucugcuguugccucucuuuga

SEQ ID NO: 1160402 - RNA, 16 nt, Homo sapiens
uucuggaaacauucag

SEQ ID NO: 1160403 - RNA, 22 nt, Homo sapiens
uucuggcaguuuugacaucagc

SEQ ID NO: 1160404 - RNA, 23 nt, Homo sapiens
uucugggagacacccaaagggug

SEQ ID NO: 1160405 - RNA, 19 nt, Homo sapiens
uucuggggaaagacacugc

SEQ ID NO: 1160406 - RNA, 23 nt, Homo sapiens
uucugggggaaaaagccauauca

SEQ ID NO: 1160407 - RNA, 19 nt, Homo sapiens
uucuguggacaccacugag

SEQ ID NO: 1160408 - RNA, 21 nt, Homo sapiens
uucuguggaccacugcaugag

SEQ ID NO: 1160409 - RNA, 17 nt, Homo sapiens
uucuguuuccaucugcu

SEQ ID NO: 1160410 - RNA, 22 nt, Homo sapiens
uucuguuuuuaaugcuauuuga

SEQ ID NO: 1160411 - RNA, 18 nt, Homo sapiens
uucuuaacccuuuccaga

SEQ ID NO: 1160412 - RNA, 13 nt, Homo sapiens
uucuuaacuauuc

SEQ ID NO: 1160413 - RNA, 14 nt, Homo sapiens
uucuuaacuuugaa

SEQ ID NO: 1160414 - RNA, 21 nt, Homo sapiens
uucuuaaggaagaagaguauu

SEQ ID NO: 1160415 - RNA, 18 nt, Homo sapiens
uucuuaauaaacuugcuu

SEQ ID NO: 1160416 - RNA, 23 nt, Homo sapiens
uucuuaaugaaccuuagaaagac

SEQ ID NO: 1160417 - RNA, 22 nt, Homo sapiens
uucuuaauggggacgagcagac

SEQ ID NO: 1160418 - RNA, 12 nt, Homo sapiens
uucuuacuuugu

SEQ ID NO: 1160419 - RNA, 20 nt, Homo sapiens
uucuuagauacacuaaaaau

SEQ ID NO: 1160420 - RNA, 15 nt, Homo sapiens
uucuuagucucagca

SEQ ID NO: 1160421 - RNA, 13 nt, Homo sapiens
uucuuauaucuga

SEQ ID NO: 1160422 - RNA, 18 nt, Homo sapiens
uucuucaguguaauguga

SEQ ID NO: 1160423 - RNA, 14 nt, Homo sapiens
uucuucaugaggcc

SEQ ID NO: 1160424 - RNA, 17 nt, Homo sapiens
uggaucuaccagcauaa

SEQ ID NO: 1160425 - RNA, 17 nt, Homo sapiens
uggaucugcugcaucca

SEQ ID NO: 1160426 - RNA, 14 nt, Homo sapiens
auuuuugugcacau

SEQ ID NO: 1160427 - RNA, 23 nt, Homo sapiens
auuuuuuaaaacaagccaagaaa

SEQ ID NO: 1160428 - RNA, 14 nt, Homo sapiens
auuuuuucuugcau

SEQ ID NO: 1160429 - RNA, 14 nt, Homo sapiens
caaaaaaaacaaca

SEQ ID NO: 1160430 - RNA, 23 nt, Homo sapiens
caaaaacauguaugugcauuuca

SEQ ID NO: 1160431 - RNA, 22 nt, Homo sapiens
caaaaacauucuuacauuuuac

SEQ ID NO: 1160432 - RNA, 15 nt, Homo sapiens
caaaaacuacacaua

SEQ ID NO: 1160433 - RNA, 16 nt, Homo sapiens
caaaaagaaaugaugu

SEQ ID NO: 1160434 - RNA, 16 nt, Homo sapiens
caaaaagaagacauua

SEQ ID NO: 1160435 - RNA, 15 nt, Homo sapiens
caaaaauguaaaaaa

SEQ ID NO: 1160436 - RNA, 23 nt, Homo sapiens
caaaaccaauucaugaagugaau

SEQ ID NO: 1160437 - RNA, 14 nt, Homo sapiens
caaaacuccgucuc

SEQ ID NO: 1160438 - RNA, 12 nt, Homo sapiens
caaaagacaauu

SEQ ID NO: 1160439 - RNA, 16 nt, Homo sapiens
caaaagacaccagcca

SEQ ID NO: 1160440 - RNA, 11 nt, Homo sapiens
caaaagcuuuu

SEQ ID NO: 1160441 - RNA, 20 nt, Homo sapiens
caaaaggaacaaaaauuaca

SEQ ID NO: 1160442 - RNA, 16 nt, Homo sapiens
caaaaggaagacugga

SEQ ID NO: 1160443 - RNA, 22 nt, Homo sapiens
caaaaguggggcuaaaugaagu

SEQ ID NO: 1160444 - RNA, 19 nt, Homo sapiens
caaaaguuacauguuugca

SEQ ID NO: 1160445 - RNA, 20 nt, Homo sapiens
caaaaguuacauguuugcac

SEQ ID NO: 1160446 - RNA, 17 nt, Homo sapiens
caaaaucagccaaagca

SEQ ID NO: 1160447 - RNA, 15 nt, Homo sapiens
caaaauccaaaaaga

SEQ ID NO: 1160448 - RNA, 19 nt, Homo sapiens
caaaauccagaaguuuaaa

SEQ ID NO: 1160449 - RNA, 19 nt, Homo sapiens
caaaaugauacuuacugaa

SEQ ID NO: 1160450 - RNA, 19 nt, Homo sapiens
caaaaugaugcaaccaaaa

SEQ ID NO: 1160451 - RNA, 13 nt, Homo sapiens
caaaaugugaacu

SEQ ID NO: 1160452 - RNA, 16 nt, Homo sapiens
caaaauuaugguguuc

SEQ ID NO: 1160453 - RNA, 18 nt, Homo sapiens
caacaggaggacaauuca

SEQ ID NO: 1160454 - RNA, 20 nt, Homo sapiens
caacauauaaaauaaugcaa

SEQ ID NO: 1160455 - RNA, 14 nt, Homo sapiens
caacauccaaaaua

SEQ ID NO: 1160456 - RNA, 22 nt, Homo sapiens
caacauggugaaaaccccaucu

SEQ ID NO: 1160457 - RNA, 16 nt, Homo sapiens
caacauugugauguau

SEQ ID NO: 1160458 - RNA, 21 nt, Homo sapiens
caaccaccaccuuauacauca

SEQ ID NO: 1160459 - RNA, 21 nt, Homo sapiens
caaccaccuaggcaaugaaga

SEQ ID NO: 1160460 - RNA, 18 nt, Homo sapiens
caaccagaggaaucuaua

SEQ ID NO: 1160461 - RNA, 20 nt, Homo sapiens
caaccagccuuuggguccug

SEQ ID NO: 1160462 - RNA, 14 nt, Homo sapiens
caaccccaccacuu

SEQ ID NO: 1160463 - RNA, 14 nt, Homo sapiens
caacccccaucucc

SEQ ID NO: 1160464 - RNA, 15 nt, Homo sapiens
caacccuucauuuaa

SEQ ID NO: 1160465 - RNA, 21 nt, Homo sapiens
caaccgaaucucaauguacau

SEQ ID NO: 1160466 - RNA, 18 nt, Homo sapiens
caaccgagaagguuuauc

SEQ ID NO: 1160467 - RNA, 16 nt, Homo sapiens
caaccuacucugcaaa

SEQ ID NO: 1160468 - RNA, 12 nt, Homo sapiens
caaccuacuguc

SEQ ID NO: 1160469 - RNA, 12 nt, Homo sapiens
caaccucaguga

SEQ ID NO: 1160470 - RNA, 14 nt, Homo sapiens
caaccucugccucc

SEQ ID NO: 1160471 - RNA, 14 nt, Homo sapiens
caaccuugucaguu

SEQ ID NO: 1160472 - RNA, 20 nt, Homo sapiens
caaccuuuucucuggacacu

SEQ ID NO: 1160473 - RNA, 13 nt, Homo sapiens
caacgugcaacug

SEQ ID NO: 1160474 - RNA, 15 nt, Homo sapiens
caacuaccauuccuu

SEQ ID NO: 1160475 - RNA, 14 nt, Homo sapiens
caacuacuaucuca

SEQ ID NO: 1160476 - RNA, 12 nt, Homo sapiens
caacucuugauu

SEQ ID NO: 1160477 - RNA, 12 nt, Homo sapiens
caacugcaacuc

SEQ ID NO: 1160478 - RNA, 20 nt, Homo sapiens
caacugccggggguucaggg

SEQ ID NO: 1160479 - RNA, 21 nt, Homo sapiens
caacugccggggguucagggu

SEQ ID NO: 1160480 - RNA, 17 nt, Homo sapiens
caaugcguggcucuccu

SEQ ID NO: 1160481 - RNA, 15 nt, Homo sapiens
caaugcugagaauga

SEQ ID NO: 1160482 - RNA, 13 nt, Homo sapiens
caaugggagcuga

SEQ ID NO: 1160483 - RNA, 20 nt, Homo sapiens
caaugggauguaugaauaca

SEQ ID NO: 1160484 - RNA, 11 nt, Homo sapiens
caaugguguuu

SEQ ID NO: 1160485 - RNA, 20 nt, Homo sapiens
caauguauaaccccaaagaa

SEQ ID NO: 1160486 - RNA, 16 nt, Homo sapiens
caauguauucaguaua

SEQ ID NO: 1160487 - RNA, 20 nt, Homo sapiens
caaugugacauguugcucuu

SEQ ID NO: 1160488 - RNA, 14 nt, Homo sapiens
caaugugcacuuca

SEQ ID NO: 1160489 - RNA, 17 nt, Homo sapiens
caauguuauuaccuaua

SEQ ID NO: 1160490 - RNA, 17 nt, Homo sapiens
caauuacugccugcaga

SEQ ID NO: 1160491 - RNA, 15 nt, Homo sapiens
caauuagacuugaaa

SEQ ID NO: 1160492 - RNA, 23 nt, Homo sapiens
caauuauaucaguccucuuucaa

SEQ ID NO: 1160493 - RNA, 19 nt, Homo sapiens
caauucaaaacauugugcc

SEQ ID NO: 1160494 - RNA, 16 nt, Homo sapiens
caauucagucugcucu

SEQ ID NO: 1160495 - RNA, 18 nt, Homo sapiens
caauuccaucagcacaaa

SEQ ID NO: 1160496 - RNA, 22 nt, Homo sapiens
caauucguuuuuucauuugaau

SEQ ID NO: 1160497 - RNA, 20 nt, Homo sapiens
caauucuaguguaaaucaug

SEQ ID NO: 1160498 - RNA, 15 nt, Homo sapiens
caauugggagagaaa

SEQ ID NO: 1160499 - RNA, 22 nt, Homo sapiens
caauuguugacaguucugaaga

SEQ ID NO: 1160500 - RNA, 14 nt, Homo sapiens
caauuuaaaacaau

SEQ ID NO: 1160501 - RNA, 16 nt, Homo sapiens
caauuucaagguucua

SEQ ID NO: 1160502 - RNA, 13 nt, Homo sapiens
cacaaaacccaga

SEQ ID NO: 1160503 - RNA, 18 nt, Homo sapiens
cacaaaauaaccaauccu

SEQ ID NO: 1160504 - RNA, 13 nt, Homo sapiens
cacaaacccaagg

SEQ ID NO: 1160505 - RNA, 18 nt, Homo sapiens
cacaaaggauuugaugcu

SEQ ID NO: 1160506 - RNA, 11 nt, Homo sapiens
cacaaagggau

SEQ ID NO: 1160507 - RNA, 14 nt, Homo sapiens
cacaaauagaguuu

SEQ ID NO: 1160508 - RNA, 21 nt, Homo sapiens
cacaaaucagaccuggcugcu

SEQ ID NO: 1160509 - RNA, 20 nt, Homo sapiens
cacaacaaaaggaagacugg

SEQ ID NO: 1160510 - RNA, 15 nt, Homo sapiens
cacaacacaguucuc

SEQ ID NO: 1160511 - RNA, 18 nt, Homo sapiens
cacaaccuacucugcaaa

SEQ ID NO: 1160512 - RNA, 17 nt, Homo sapiens
cacaaccuugcaguauu

SEQ ID NO: 1160513 - RNA, 13 nt, Homo sapiens
cacaacugcaguc

SEQ ID NO: 1160514 - RNA, 17 nt, Homo sapiens
cacaagaaguagcuuca

SEQ ID NO: 1160515 - RNA, 22 nt, Homo sapiens
cacaagacccaaguagcugcua

SEQ ID NO: 1160516 - RNA, 18 nt, Homo sapiens
cacaagauacacgucaca

SEQ ID NO: 1160517 - RNA, 16 nt, Homo sapiens
cacaaggacuuccugu

SEQ ID NO: 1160518 - RNA, 22 nt, Homo sapiens
cacaaggucauggccacacugu

SEQ ID NO: 1160519 - RNA, 22 nt, Homo sapiens
cacaagucauaccuacauucaa

SEQ ID NO: 1160520 - RNA, 21 nt, Homo sapiens
cacaauaagagucuccuucuc

SEQ ID NO: 1160521 - RNA, 18 nt, Homo sapiens
cacaauaccuacaauaaa

SEQ ID NO: 1160522 - RNA, 15 nt, Homo sapiens
cacaaugaugaugau

SEQ ID NO: 1160523 - RNA, 23 nt, Homo sapiens
cacaauuaaaugacuuagaaaca

SEQ ID NO: 1160524 - RNA, 15 nt, Homo sapiens
cacaauuucccuuca

SEQ ID NO: 1160525 - RNA, 19 nt, Homo sapiens
cacaauuucugggugauga

SEQ ID NO: 1160526 - RNA, 19 nt, Homo sapiens
cacacaaaauaaugcaguu

SEQ ID NO: 1160527 - RNA, 14 nt, Homo sapiens
cacacaaguggaga

SEQ ID NO: 1160528 - RNA, 15 nt, Homo sapiens
cacacacaacagcca

SEQ ID NO: 1160529 - RNA, 14 nt, Homo sapiens
cacacacacaguuu

SEQ ID NO: 1160530 - RNA, 16 nt, Homo sapiens
cacacacaguuugaga

SEQ ID NO: 1160531 - RNA, 17 nt, Homo sapiens
cacacagaggggaguca

SEQ ID NO: 1160532 - RNA, 20 nt, Homo sapiens
cacacagcaagucaggguug

SEQ ID NO: 1160533 - RNA, 20 nt, Homo sapiens
cacacaugcuuuucuuccua

SEQ ID NO: 1160534 - RNA, 15 nt, Homo sapiens
cacacccaauuccac

SEQ ID NO: 1160535 - RNA, 16 nt, Homo sapiens
cacaccccaacacuuc

SEQ ID NO: 1160536 - RNA, 13 nt, Homo sapiens
cacaccuguaauc

SEQ ID NO: 1160537 - RNA, 14 nt, Homo sapiens
cacacgcacauaua

SEQ ID NO: 1160538 - RNA, 16 nt, Homo sapiens
cacacuacaccacaca

SEQ ID NO: 1160539 - RNA, 21 nt, Homo sapiens
cacacuaguuuaugcuaccua

SEQ ID NO: 1160540 - RNA, 20 nt, Homo sapiens
cacacuauucucugccuuuu

SEQ ID NO: 1160541 - RNA, 14 nt, Homo sapiens
cacacucagcacaa

SEQ ID NO: 1160542 - RNA, 20 nt, Homo sapiens
cacacugagacuugaaucaa

SEQ ID NO: 1160543 - RNA, 14 nt, Homo sapiens
cacacugaucugaa

SEQ ID NO: 1160544 - RNA, 12 nt, Homo sapiens
cacacugugaca

SEQ ID NO: 1160545 - RNA, 20 nt, Homo sapiens
cacacugugacacacuacac

SEQ ID NO: 1160546 - RNA, 20 nt, Homo sapiens
cacacuuccauaugucauug

SEQ ID NO: 1160547 - RNA, 19 nt, Homo sapiens
cacacuuuucagcaaaaau

SEQ ID NO: 1160548 - RNA, 14 nt, Homo sapiens
cacagaaacacugc

SEQ ID NO: 1160549 - RNA, 21 nt, Homo sapiens
cacagaagggccuggaugcaa

SEQ ID NO: 1160550 - RNA, 17 nt, Homo sapiens
cacagaaggugaacuuu

SEQ ID NO: 1160551 - RNA, 16 nt, Homo sapiens
cacagacccacaagag

SEQ ID NO: 1160552 - RNA, 20 nt, Homo sapiens
cacagagcaggacugcacag

SEQ ID NO: 1160553 - RNA, 13 nt, Homo sapiens
cacagagcuacau

SEQ ID NO: 1160554 - RNA, 16 nt, Homo sapiens
cacagauaaaguuuuc

SEQ ID NO: 1160555 - RNA, 13 nt, Homo sapiens
cacagauggcuca

SEQ ID NO: 1160556 - RNA, 21 nt, Homo sapiens
cacagauuuuugguaguuucu

SEQ ID NO: 1160557 - RNA, 11 nt, Homo sapiens
cacagcacauu

SEQ ID NO: 1160558 - RNA, 14 nt, Homo sapiens
cacagccaacacgc

SEQ ID NO: 1160559 - RNA, 14 nt, Homo sapiens
cacagcccauccau

SEQ ID NO: 1160560 - RNA, 17 nt, Homo sapiens
cacagcccugaaucaga

SEQ ID NO: 1160561 - RNA, 23 nt, Homo sapiens
cacagcccuggggacaccugccc

SEQ ID NO: 1160562 - RNA, 23 nt, Homo sapiens
cacagcucccggcgggugcucug

SEQ ID NO: 1160563 - RNA, 20 nt, Homo sapiens
cacagcugaacuuguugaga

SEQ ID NO: 1160564 - RNA, 19 nt, Homo sapiens
cacagcugauugggcaccu

SEQ ID NO: 1160565 - RNA, 22 nt, Homo sapiens
cacagcuuauggcaucucauug

SEQ ID NO: 1160566 - RNA, 22 nt, Homo sapiens
cacaggacgaaugcauauucaa

SEQ ID NO: 1160567 - RNA, 19 nt, Homo sapiens
cacaggagccucugcaguc

SEQ ID NO: 1160568 - RNA, 14 nt, Homo sapiens
cacaggaguguccu

SEQ ID NO: 1160569 - RNA, 17 nt, Homo sapiens
cacaggcccuagcuuua

SEQ ID NO: 1160570 - RNA, 21 nt, Homo sapiens
cacagggcaaaaucgccauag

SEQ ID NO: 1160571 - RNA, 15 nt, Homo sapiens
cacagggcaauugag

SEQ ID NO: 1160572 - RNA, 16 nt, Homo sapiens
cacaggucagggguga

SEQ ID NO: 1160573 - RNA, 18 nt, Homo sapiens
cacaggucccacugcccu

SEQ ID NO: 1160574 - RNA, 22 nt, Homo sapiens
cacagugcuggggaacaaccag

SEQ ID NO: 1160575 - RNA, 12 nt, Homo sapiens
cacaguguccca

SEQ ID NO: 1160576 - RNA, 12 nt, Homo sapiens
cacaguguuacc

SEQ ID NO: 1160577 - RNA, 19 nt, Homo sapiens
cacaguucuuaauacagga

SEQ ID NO: 1160578 - RNA, 13 nt, Homo sapiens
cacauacauguaa

SEQ ID NO: 1160579 - RNA, 21 nt, Homo sapiens
cacauacauguaaaauauguc

SEQ ID NO: 1160580 - RNA, 14 nt, Homo sapiens
cacaucucccccau

SEQ ID NO: 1160581 - RNA, 16 nt, Homo sapiens
cacaucuguccugaca

SEQ ID NO: 1160582 - RNA, 22 nt, Homo sapiens
cacaucuuuuaagacaaauuca

SEQ ID NO: 1160583 - RNA, 23 nt, Homo sapiens
ccaaucccuuuauuacccccucc

SEQ ID NO: 1160584 - RNA, 19 nt, Homo sapiens
ccaauccuagcccucauuu

SEQ ID NO: 1160585 - RNA, 17 nt, Homo sapiens
ccaauccuggacaugaa

SEQ ID NO: 1160586 - RNA, 16 nt, Homo sapiens
ccaaucuggacacuuc

SEQ ID NO: 1160587 - RNA, 23 nt, Homo sapiens
ccaaucuuaguuucuaaccaaag

SEQ ID NO: 1160588 - RNA, 18 nt, Homo sapiens
ccaaugccaaaaaaagac

SEQ ID NO: 1160589 - RNA, 16 nt, Homo sapiens
ccaaugcguggcucuc

SEQ ID NO: 1160590 - RNA, 13 nt, Homo sapiens
ccaauguauuuau

SEQ ID NO: 1160591 - RNA, 13 nt, Homo sapiens
ccaauuagacuug

SEQ ID NO: 1160592 - RNA, 17 nt, Homo sapiens
ccaauuagucacugcug

SEQ ID NO: 1160593 - RNA, 19 nt, Homo sapiens
ccaauucaauuacuauuga

SEQ ID NO: 1160594 - RNA, 16 nt, Homo sapiens
ccaauuccuugcacau

SEQ ID NO: 1160595 - RNA, 13 nt, Homo sapiens
ccaauuuauaugu

SEQ ID NO: 1160596 - RNA, 15 nt, Homo sapiens
ccaauuucagacucc

SEQ ID NO: 1160597 - RNA, 16 nt, Homo sapiens
ccaauuugacaaaacc

SEQ ID NO: 1160598 - RNA, 16 nt, Homo sapiens
ccacaaaaaauacuuu

SEQ ID NO: 1160599 - RNA, 14 nt, Homo sapiens
ccacaaacuguaau

SEQ ID NO: 1160600 - RNA, 16 nt, Homo sapiens
ccacaagccugaauuu

SEQ ID NO: 1160601 - RNA, 12 nt, Homo sapiens
ccacacccaaag

SEQ ID NO: 1160602 - RNA, 15 nt, Homo sapiens
ccacaccugcagugc

SEQ ID NO: 1160603 - RNA, 14 nt, Homo sapiens
ccacacucagcaca

SEQ ID NO: 1160604 - RNA, 21 nt, Homo sapiens
ccacagaagguguucaaacac

SEQ ID NO: 1160605 - RNA, 21 nt, Homo sapiens
ccacagacucaaaugcucaga

SEQ ID NO: 1160606 - RNA, 18 nt, Homo sapiens
ccacagagagaggggaga

SEQ ID NO: 1160607 - RNA, 16 nt, Homo sapiens
ccacagcaaccccagg

SEQ ID NO: 1160608 - RNA, 18 nt, Homo sapiens
ccacagccugucuuguca

SEQ ID NO: 1160609 - RNA, 18 nt, Homo sapiens
ccacaggagccucugcag

SEQ ID NO: 1160610 - RNA, 21 nt, Homo sapiens
ccacaggagugggaaaacacu

SEQ ID NO: 1160611 - RNA, 17 nt, Homo sapiens
ccacaggcucugaccag

SEQ ID NO: 1160612 - RNA, 14 nt, Homo sapiens
ccacaggugccugg

SEQ ID NO: 1160613 - RNA, 14 nt, Homo sapiens
ccacaggugugagc

SEQ ID NO: 1160614 - RNA, 14 nt, Homo sapiens
ccacauaccuggcc

SEQ ID NO: 1160615 - RNA, 19 nt, Homo sapiens
ccacaugugacacauaugc

SEQ ID NO: 1160616 - RNA, 15 nt, Homo sapiens
ccaccacucuugacu

SEQ ID NO: 1160617 - RNA, 16 nt, Homo sapiens
ccaccacuucuuuuau

SEQ ID NO: 1160618 - RNA, 16 nt, Homo sapiens
ccaccagccacuuuag

SEQ ID NO: 1160619 - RNA, 19 nt, Homo sapiens
ccaccaggugccuuucaaa

SEQ ID NO: 1160620 - RNA, 12 nt, Homo sapiens
ccaccaugcccu

SEQ ID NO: 1160621 - RNA, 16 nt, Homo sapiens
ccacccaaaagucaaa

SEQ ID NO: 1160622 - RNA, 15 nt, Homo sapiens
ccacccaacagugau

SEQ ID NO: 1160623 - RNA, 15 nt, Homo sapiens
ccacccaagagagaa

SEQ ID NO: 1160624 - RNA, 13 nt, Homo sapiens
ccacccacaugug

SEQ ID NO: 1160625 - RNA, 23 nt, Homo sapiens
ccacccccaaauuuucuuuuuau

SEQ ID NO: 1160626 - RNA, 21 nt, Homo sapiens
ccaccccuacauuuuuugaaa

SEQ ID NO: 1160627 - RNA, 18 nt, Homo sapiens
ccaccucacaacuccuuc

SEQ ID NO: 1160628 - RNA, 13 nt, Homo sapiens
ccaccucucaggg

SEQ ID NO: 1160629 - RNA, 16 nt, Homo sapiens
ccaccugaaagccugu

SEQ ID NO: 1160630 - RNA, 23 nt, Homo sapiens
ccaccuucuacgcaauugacaaa

SEQ ID NO: 1160631 - RNA, 21 nt, Homo sapiens
ccaccuugccacccauucuuc

SEQ ID NO: 1160632 - RNA, 14 nt, Homo sapiens
ccacgaaagcacac

SEQ ID NO: 1160633 - RNA, 22 nt, Homo sapiens
ccacgagaaacauccugccagg

SEQ ID NO: 1160634 - RNA, 16 nt, Homo sapiens
ccacggagcaguucag

SEQ ID NO: 1160635 - RNA, 19 nt, Homo sapiens
ccacggugccuccagaugg

SEQ ID NO: 1160636 - RNA, 12 nt, Homo sapiens
ccacgucucucu

SEQ ID NO: 1160637 - RNA, 19 nt, Homo sapiens
ccacgucucucugccugcu

SEQ ID NO: 1160638 - RNA, 12 nt, Homo sapiens
ccacgucuuccu

SEQ ID NO: 1160639 - RNA, 19 nt, Homo sapiens
ccacguugccucuacuuua

SEQ ID NO: 1160640 - RNA, 15 nt, Homo sapiens
ccacguuuaacacaa

SEQ ID NO: 1160641 - RNA, 13 nt, Homo sapiens
ccacuaaugcaaa

SEQ ID NO: 1160642 - RNA, 12 nt, Homo sapiens
ccacuacugcua

SEQ ID NO: 1160643 - RNA, 15 nt, Homo sapiens
ccacuaggacuucaa

SEQ ID NO: 1160644 - RNA, 15 nt, Homo sapiens
ccacucaguugcaac

SEQ ID NO: 1160645 - RNA, 16 nt, Homo sapiens
ccacugaaaagcuuuc

SEQ ID NO: 1160646 - RNA, 22 nt, Homo sapiens
ccacugaauugacaugacccuc

SEQ ID NO: 1160647 - RNA, 14 nt, Homo sapiens
ccacugacccaaau

SEQ ID NO: 1160648 - RNA, 16 nt, Homo sapiens
ccacugucuagagcaa

SEQ ID NO: 1160649 - RNA, 18 nt, Homo sapiens
ccacugugacuuugccca

SEQ ID NO: 1160650 - RNA, 19 nt, Homo sapiens
ccacuguguuucugugcuc

SEQ ID NO: 1160651 - RNA, 22 nt, Homo sapiens
ccacuguguuucugugcuccaa

SEQ ID NO: 1160652 - RNA, 15 nt, Homo sapiens
ccacuguuugucuca

SEQ ID NO: 1160653 - RNA, 16 nt, Homo sapiens
ccacuguuugucucac

SEQ ID NO: 1160654 - RNA, 15 nt, Homo sapiens
ccacuucugugccac

SEQ ID NO: 1160655 - RNA, 14 nt, Homo sapiens
ccagaacccaaauc

SEQ ID NO: 1160656 - RNA, 13 nt, Homo sapiens
ccagaagcacugg

SEQ ID NO: 1160657 - RNA, 22 nt, Homo sapiens
ccagaagccuccuuacauuaaa

SEQ ID NO: 1160658 - RNA, 17 nt, Homo sapiens
ccagaagcugagcacca

SEQ ID NO: 1160659 - RNA, 15 nt, Homo sapiens
ccagaaguuccucaa

SEQ ID NO: 1160660 - RNA, 22 nt, Homo sapiens
ccagaaugcugcaggacuugag

SEQ ID NO: 1160661 - RNA, 15 nt, Homo sapiens
ccagacaugguggca

SEQ ID NO: 1160662 - RNA, 12 nt, Homo sapiens
ccagacccugaa

SEQ ID NO: 1160663 - RNA, 14 nt, Homo sapiens
ccagacgccauuua

SEQ ID NO: 1160664 - RNA, 17 nt, Homo sapiens
ccagagaaaaagggagg

SEQ ID NO: 1160665 - RNA, 16 nt, Homo sapiens
ccagagcccagcucuu

SEQ ID NO: 1160666 - RNA, 15 nt, Homo sapiens
ccagaggacugugau

SEQ ID NO: 1160667 - RNA, 18 nt, Homo sapiens
ccagaggcaccucaagaa

SEQ ID NO: 1160668 - RNA, 15 nt, Homo sapiens
ccagagggcacucug

SEQ ID NO: 1160669 - RNA, 19 nt, Homo sapiens
ccagaggugucacccaaac

SEQ ID NO: 1160670 - RNA, 23 nt, Homo sapiens
ccagaguccuuuccaaggcuucu

SEQ ID NO: 1160671 - RNA, 19 nt, Homo sapiens
ccagaugagaagucugcua

SEQ ID NO: 1160672 - RNA, 15 nt, Homo sapiens
ccagauggacuccag

SEQ ID NO: 1160673 - RNA, 18 nt, Homo sapiens
ccagaugugagggcacca

SEQ ID NO: 1160674 - RNA, 20 nt, Homo sapiens
ccagauuggggcuaguuuaa

SEQ ID NO: 1160675 - RNA, 19 nt, Homo sapiens
ccagcaacuugaacuucac

SEQ ID NO: 1160676 - RNA, 17 nt, Homo sapiens
ccagcacacagggcagu

SEQ ID NO: 1160677 - RNA, 18 nt, Homo sapiens
ccagcaccgugacaguuu

SEQ ID NO: 1160678 - RNA, 19 nt, Homo sapiens
ccagcacuuugggagacca

SEQ ID NO: 1160679 - RNA, 20 nt, Homo sapiens
ccagcacuuugggaggccaa

SEQ ID NO: 1160680 - RNA, 15 nt, Homo sapiens
ccagcagcacuggaa

SEQ ID NO: 1160681 - RNA, 16 nt, Homo sapiens
ccagcagccugccagc

SEQ ID NO: 1160682 - RNA, 16 nt, Homo sapiens
ccagcaguuacuguga

SEQ ID NO: 1160683 - RNA, 15 nt, Homo sapiens
ccagcaucaauucca

SEQ ID NO: 1160684 - RNA, 16 nt, Homo sapiens
ccagcaucaauuccau

SEQ ID NO: 1160685 - RNA, 13 nt, Homo sapiens
ccagcauucucag

SEQ ID NO: 1160686 - RNA, 22 nt, Homo sapiens
ccagccaucaaauagugaaugg

SEQ ID NO: 1160687 - RNA, 14 nt, Homo sapiens
ccagcccaggaguu

SEQ ID NO: 1160688 - RNA, 15 nt, Homo sapiens
ccagccgcacuggga

SEQ ID NO: 1160689 - RNA, 14 nt, Homo sapiens
ccagccucccacaa

SEQ ID NO: 1160690 - RNA, 12 nt, Homo sapiens
ccagccugacca

SEQ ID NO: 1160691 - RNA, 19 nt, Homo sapiens
ccagccuggccaacauggc

SEQ ID NO: 1160692 - RNA, 20 nt, Homo sapiens
ccagccugggcaacagagca

SEQ ID NO: 1160693 - RNA, 14 nt, Homo sapiens
ccagcgauggugcu

SEQ ID NO: 1160694 - RNA, 17 nt, Homo sapiens
ccagcggccucaggguc

SEQ ID NO: 1160695 - RNA, 15 nt, Homo sapiens
ccagcuauacuguau

SEQ ID NO: 1160696 - RNA, 14 nt, Homo sapiens
ccagcucacugcaa

SEQ ID NO: 1160697 - RNA, 20 nt, Homo sapiens
ccagcuccaaccugcaaaga

SEQ ID NO: 1160698 - RNA, 19 nt, Homo sapiens
ccagcucuggcuuccugcu

SEQ ID NO: 1160699 - RNA, 23 nt, Homo sapiens
ccagcugggucaggcagggugca

SEQ ID NO: 1160700 - RNA, 16 nt, Homo sapiens
ccaggaccccugagua

SEQ ID NO: 1160701 - RNA, 19 nt, Homo sapiens
ccaggacugugccagcaca

SEQ ID NO: 1160702 - RNA, 21 nt, Homo sapiens
ccaggagccggacacuucuca

SEQ ID NO: 1160703 - RNA, 16 nt, Homo sapiens
ccaggaguacacccca

SEQ ID NO: 1160704 - RNA, 19 nt, Homo sapiens
ccaggauuuuguauugcca

SEQ ID NO: 1160705 - RNA, 17 nt, Homo sapiens
ccaggcaccguggcuca

SEQ ID NO: 1160706 - RNA, 15 nt, Homo sapiens
ccaggcacuuugcau

SEQ ID NO: 1160707 - RNA, 23 nt, Homo sapiens
ccaggccuacuguaaaccccaag

SEQ ID NO: 1160708 - RNA, 16 nt, Homo sapiens
ccaggccucuuggcag

SEQ ID NO: 1160709 - RNA, 16 nt, Homo sapiens
ccaggcuagagugcaa

SEQ ID NO: 1160710 - RNA, 19 nt, Homo sapiens
ccaggcugaccacagcaca

SEQ ID NO: 1160711 - RNA, 20 nt, Homo sapiens
ccaggcuggagugcaauggu

SEQ ID NO: 1160712 - RNA, 19 nt, Homo sapiens
ccaggcuggagugcaguga

SEQ ID NO: 1160713 - RNA, 23 nt, Homo sapiens
ccaggcuggagugcaguggugca

SEQ ID NO: 1160714 - RNA, 15 nt, Homo sapiens
ccaggcugggaacuc

SEQ ID NO: 1160715 - RNA, 14 nt, Homo sapiens
cccagcagaucuca

SEQ ID NO: 1160716 - RNA, 22 nt, Homo sapiens
cccagcagugccuugugcaaug

SEQ ID NO: 1160717 - RNA, 11 nt, Homo sapiens
cccagccacag

SEQ ID NO: 1160718 - RNA, 19 nt, Homo sapiens
cccagccaugcaaugccaa

SEQ ID NO: 1160719 - RNA, 15 nt, Homo sapiens
cccagcccagagaca

SEQ ID NO: 1160720 - RNA, 20 nt, Homo sapiens
cccagcucacaggagcuuaa

SEQ ID NO: 1160721 - RNA, 21 nt, Homo sapiens
cccaggacauggcugacuuug

SEQ ID NO: 1160722 - RNA, 13 nt, Homo sapiens
cccaggaccagcu

SEQ ID NO: 1160723 - RNA, 18 nt, Homo sapiens
cccaggacccugaagggg

SEQ ID NO: 1160724 - RNA, 18 nt, Homo sapiens
cccaggauugugcaauag

SEQ ID NO: 1160725 - RNA, 21 nt, Homo sapiens
cccaggcacuuugcaucacag

SEQ ID NO: 1160726 - RNA, 19 nt, Homo sapiens
cccaggccaacaguagcca

SEQ ID NO: 1160727 - RNA, 20 nt, Homo sapiens
cccaggcccacucagggguc

SEQ ID NO: 1160728 - RNA, 16 nt, Homo sapiens
cccaggcuggucuuga

SEQ ID NO: 1160729 - RNA, 15 nt, Homo sapiens
cccagggaacagcca

SEQ ID NO: 1160730 - RNA, 17 nt, Homo sapiens
cccagggagaggcugug

SEQ ID NO: 1160731 - RNA, 17 nt, Homo sapiens
cccaggggcagccacac

SEQ ID NO: 1160732 - RNA, 15 nt, Homo sapiens
cccaggucuccagca

SEQ ID NO: 1160733 - RNA, 23 nt, Homo sapiens
cccaguagaugccacuagcccuc

SEQ ID NO: 1160734 - RNA, 19 nt, Homo sapiens
cccagucacugugagcucc

SEQ ID NO: 1160735 - RNA, 17 nt, Homo sapiens
cccagucagaaguucug

SEQ ID NO: 1160736 - RNA, 16 nt, Homo sapiens
cccagugacaaccaaa

SEQ ID NO: 1160737 - RNA, 18 nt, Homo sapiens
cccagugcaugguggcca

SEQ ID NO: 1160738 - RNA, 13 nt, Homo sapiens
cccaucagugcca

SEQ ID NO: 1160739 - RNA, 15 nt, Homo sapiens
cccauccaguucucu

SEQ ID NO: 1160740 - RNA, 14 nt, Homo sapiens
cccauccuacucuc

SEQ ID NO: 1160741 - RNA, 13 nt, Homo sapiens
cccaugaagccac

SEQ ID NO: 1160742 - RNA, 16 nt, Homo sapiens
cccaugauaguguauu

SEQ ID NO: 1160743 - RNA, 14 nt, Homo sapiens
cccaugcacuguga

SEQ ID NO: 1160744 - RNA, 17 nt, Homo sapiens
cccaugcacugugaagg

SEQ ID NO: 1160745 - RNA, 22 nt, Homo sapiens
cccaugcuuuguaggugucuca

SEQ ID NO: 1160746 - RNA, 15 nt, Homo sapiens
cccauggcaugucuu

SEQ ID NO: 1160747 - RNA, 20 nt, Homo sapiens
cccauuccacagcucugggc

SEQ ID NO: 1160748 - RNA, 17 nt, Homo sapiens
cccauucccaaagggca

SEQ ID NO: 1160749 - RNA, 14 nt, Homo sapiens
cccauuccugaaga

SEQ ID NO: 1160750 - RNA, 15 nt, Homo sapiens
cccauucuacacaga

SEQ ID NO: 1160751 - RNA, 19 nt, Homo sapiens
cccauucuacacagagcag

SEQ ID NO: 1160752 - RNA, 19 nt, Homo sapiens
cccauucuacucaaaguca

SEQ ID NO: 1160753 - RNA, 15 nt, Homo sapiens
cccauuucacccaug

SEQ ID NO: 1160754 - RNA, 16 nt, Homo sapiens
cccauuucuccagaac

SEQ ID NO: 1160755 - RNA, 15 nt, Homo sapiens
ccccaacauggaugu

SEQ ID NO: 1160756 - RNA, 20 nt, Homo sapiens
ccccaacuacccccagcugu

SEQ ID NO: 1160757 - RNA, 15 nt, Homo sapiens
ccccacccaggagua

SEQ ID NO: 1160758 - RNA, 23 nt, Homo sapiens
ccccacccccaaauccuguucca

SEQ ID NO: 1160759 - RNA, 22 nt, Homo sapiens
ccccaccgccgggguccuggga

SEQ ID NO: 1160760 - RNA, 23 nt, Homo sapiens
ccccaccuguguccccgaugcug

SEQ ID NO: 1160761 - RNA, 16 nt, Homo sapiens
ccccacuccagcuccu

SEQ ID NO: 1160762 - RNA, 23 nt, Homo sapiens
ccccacuggacugaccuggucca

SEQ ID NO: 1160763 - RNA, 19 nt, Homo sapiens
ccccagauucaugcacugu

SEQ ID NO: 1160764 - RNA, 20 nt, Homo sapiens
ccccaggaaguugugugacc

SEQ ID NO: 1160765 - RNA, 20 nt, Homo sapiens
ccccaggccggagcccagau

SEQ ID NO: 1160766 - RNA, 21 nt, Homo sapiens
ccccagggggcaacugacauu

SEQ ID NO: 1160767 - RNA, 22 nt, Homo sapiens
ccccagguucuggaacagcuuu

SEQ ID NO: 1160768 - RNA, 17 nt, Homo sapiens
ccccaguagcugggauu

SEQ ID NO: 1160769 - RNA, 16 nt, Homo sapiens
ccccaucggagucuaa

SEQ ID NO: 1160770 - RNA, 15 nt, Homo sapiens
ccccaucuuccagcc

SEQ ID NO: 1160771 - RNA, 13 nt, Homo sapiens
ccccaugcacugu

SEQ ID NO: 1160772 - RNA, 17 nt, Homo sapiens
cccccaaaaucugucac

SEQ ID NO: 1160773 - RNA, 12 nt, Homo sapiens
cccccaccacac

SEQ ID NO: 1160774 - RNA, 12 nt, Homo sapiens
cccccagcacuu

SEQ ID NO: 1160775 - RNA, 13 nt, Homo sapiens
cccccgccaaaag

SEQ ID NO: 1160776 - RNA, 23 nt, Homo sapiens
cccuguccggaaugccacccaca

SEQ ID NO: 1160777 - RNA, 15 nt, Homo sapiens
cccugucgcgucuca

SEQ ID NO: 1160778 - RNA, 13 nt, Homo sapiens
cccuguggaugag

SEQ ID NO: 1160779 - RNA, 18 nt, Homo sapiens
cccuuaagcaugcuucua

SEQ ID NO: 1160780 - RNA, 15 nt, Homo sapiens
cccuuacacagauug

SEQ ID NO: 1160781 - RNA, 18 nt, Homo sapiens
cccuucauccuugacucc

SEQ ID NO: 1160782 - RNA, 17 nt, Homo sapiens
cccuucauugauuuccu

SEQ ID NO: 1160783 - RNA, 13 nt, Homo sapiens
cccuuccaguggg

SEQ ID NO: 1160784 - RNA, 20 nt, Homo sapiens
cccuucccucaccuuggcac

SEQ ID NO: 1160785 - RNA, 15 nt, Homo sapiens
cccuuccuugccagu

SEQ ID NO: 1160786 - RNA, 17 nt, Homo sapiens
cccuugaaccucauuaa

SEQ ID NO: 1160787 - RNA, 21 nt, Homo sapiens
cccuugaauauggguggcucu

SEQ ID NO: 1160788 - RNA, 15 nt, Homo sapiens
cccuugccaucacac

SEQ ID NO: 1160789 - RNA, 19 nt, Homo sapiens
cccuuggucacaugugaca

SEQ ID NO: 1160790 - RNA, 17 nt, Homo sapiens
cccuugguucucauaac

SEQ ID NO: 1160791 - RNA, 15 nt, Homo sapiens
cccuuuacaaauaga

SEQ ID NO: 1160792 - RNA, 13 nt, Homo sapiens
cccuuugugacuu

SEQ ID NO: 1160793 - RNA, 22 nt, Homo sapiens
cccuuuuaguuugaucagacag

SEQ ID NO: 1160794 - RNA, 21 nt, Homo sapiens
ccgaaaacuucacugugcuca

SEQ ID NO: 1160795 - RNA, 21 nt, Homo sapiens
ccgaagggcccccacauuugu

SEQ ID NO: 1160796 - RNA, 20 nt, Homo sapiens
ccgaagucuuuuguucgcau

SEQ ID NO: 1160797 - RNA, 19 nt, Homo sapiens
ccgaauugacaacccaaac

SEQ ID NO: 1160798 - RNA, 22 nt, Homo sapiens
ccgacuuuuguuuaccagagaa

SEQ ID NO: 1160799 - RNA, 17 nt, Homo sapiens
ccgagaaacaggcgaua

SEQ ID NO: 1160800 - RNA, 18 nt, Homo sapiens
ccgagccuggcuccaaac

SEQ ID NO: 1160801 - RNA, 16 nt, Homo sapiens
ccgaggcccugcaugg

SEQ ID NO: 1160802 - RNA, 19 nt, Homo sapiens
ccgauauacucuagaugaa

SEQ ID NO: 1160803 - RNA, 15 nt, Homo sapiens
ccgauggccauguaa

SEQ ID NO: 1160804 - RNA, 21 nt, Homo sapiens
ccgcacugucccaguagccaa

SEQ ID NO: 1160805 - RNA, 14 nt, Homo sapiens
ccgcagcuucaggg

SEQ ID NO: 1160806 - RNA, 20 nt, Homo sapiens
ccgcagggugaacugcagcg

SEQ ID NO: 1160807 - RNA, 23 nt, Homo sapiens
ccgcauuccaggcuccucccucc

SEQ ID NO: 1160808 - RNA, 20 nt, Homo sapiens
ccgccaccgugcccggcuaa

SEQ ID NO: 1160809 - RNA, 14 nt, Homo sapiens
ccgccauucugcag

SEQ ID NO: 1160810 - RNA, 16 nt, Homo sapiens
ccgccgccucacugca

SEQ ID NO: 1160811 - RNA, 15 nt, Homo sapiens
ccgcuccaaugccua

SEQ ID NO: 1160812 - RNA, 13 nt, Homo sapiens
ccggaaaaaucua

SEQ ID NO: 1160813 - RNA, 15 nt, Homo sapiens
ccggauauauacaua

SEQ ID NO: 1160814 - RNA, 19 nt, Homo sapiens
ccggccacaacuacaccac

SEQ ID NO: 1160815 - RNA, 16 nt, Homo sapiens
ccggccuggagcuccu

SEQ ID NO: 1160816 - RNA, 22 nt, Homo sapiens
ccgggaagccacccucccagcu

SEQ ID NO: 1160817 - RNA, 14 nt, Homo sapiens
ccgggacuaccugg

SEQ ID NO: 1160818 - RNA, 20 nt, Homo sapiens
ccgggccggacgcaggugcu

SEQ ID NO: 1160819 - RNA, 17 nt, Homo sapiens
ccggggugguccaaugg

SEQ ID NO: 1160820 - RNA, 14 nt, Homo sapiens
ccgucuacuggaaa

SEQ ID NO: 1160821 - RNA, 12 nt, Homo sapiens
ccgucucaaaaa

SEQ ID NO: 1160822 - RNA, 16 nt, Homo sapiens
ccgucucuuaaguaau

SEQ ID NO: 1160823 - RNA, 22 nt, Homo sapiens
ccgugacaguuuacaaaugaca

SEQ ID NO: 1160824 - RNA, 17 nt, Homo sapiens
ccgugagcgacaaagau

SEQ ID NO: 1160825 - RNA, 19 nt, Homo sapiens
ccgugaggaugucacucag

SEQ ID NO: 1160826 - RNA, 18 nt, Homo sapiens
ccguucgcccccauguga

SEQ ID NO: 1160827 - RNA, 13 nt, Homo sapiens
ccguucucuguau

SEQ ID NO: 1160828 - RNA, 14 nt, Homo sapiens
ccuaaaacaguauu

SEQ ID NO: 1160829 - RNA, 23 nt, Homo sapiens
ccuaaaacauaagaucacugcca

SEQ ID NO: 1160830 - RNA, 17 nt, Homo sapiens
ccuaaaagcacacucau

SEQ ID NO: 1160831 - RNA, 19 nt, Homo sapiens
ccuaaaagugggcuugauu

SEQ ID NO: 1160832 - RNA, 22 nt, Homo sapiens
ccuaaaguaacaucagccauuu

SEQ ID NO: 1160833 - RNA, 15 nt, Homo sapiens
ccuaacaaaugcucc

SEQ ID NO: 1160834 - RNA, 19 nt, Homo sapiens
ccuaacacggugcucauuu

SEQ ID NO: 1160835 - RNA, 21 nt, Homo sapiens
ccuaagaucucgguuugccaa

SEQ ID NO: 1160836 - RNA, 16 nt, Homo sapiens
ccuaaguccuuuaugu

SEQ ID NO: 1160837 - RNA, 11 nt, Homo sapiens
ccuacaacuua

SEQ ID NO: 1160838 - RNA, 19 nt, Homo sapiens
ccuacauacgucuuucaca

SEQ ID NO: 1160839 - RNA, 14 nt, Homo sapiens
ccuaccacuuuucu

SEQ ID NO: 1160840 - RNA, 15 nt, Homo sapiens
ccuacucugagacaa

SEQ ID NO: 1160841 - RNA, 19 nt, Homo sapiens
ccuacucugagacaaaaga

SEQ ID NO: 1160842 - RNA, 14 nt, Homo sapiens
ccuacucugcaaac

SEQ ID NO: 1160843 - RNA, 11 nt, Homo sapiens
ccuacugcuga

SEQ ID NO: 1160844 - RNA, 19 nt, Homo sapiens
ccuacuguagcaaccugaa

SEQ ID NO: 1160845 - RNA, 15 nt, Homo sapiens
ccuagacaaugccac

SEQ ID NO: 1160846 - RNA, 15 nt, Homo sapiens
ccuagagcgcggcug

SEQ ID NO: 1160847 - RNA, 15 nt, Homo sapiens
ccuagccaauucaca

SEQ ID NO: 1160848 - RNA, 16 nt, Homo sapiens
ccuaggagacuaggag

SEQ ID NO: 1160849 - RNA, 18 nt, Homo sapiens
ccuaggauccccccaugc

SEQ ID NO: 1160850 - RNA, 14 nt, Homo sapiens
ccuaggcagaucac

SEQ ID NO: 1160851 - RNA, 22 nt, Homo sapiens
ccuaguauaucagugacaguug

SEQ ID NO: 1160852 - RNA, 17 nt, Homo sapiens
ccuagucuggacugcuu

SEQ ID NO: 1160853 - RNA, 20 nt, Homo sapiens
ccuagucuggacugcuuccc

SEQ ID NO: 1160854 - RNA, 17 nt, Homo sapiens
ccuauaaaacaggucaa

SEQ ID NO: 1160855 - RNA, 13 nt, Homo sapiens
ccuauaugcacuu

SEQ ID NO: 1160856 - RNA, 15 nt, Homo sapiens
ccuauaugcacuuau

SEQ ID NO: 1160857 - RNA, 22 nt, Homo sapiens
ccuauaugcuggagauggacaa

SEQ ID NO: 1160858 - RNA, 21 nt, Homo sapiens
ccuaucauuuccguuuugccu

SEQ ID NO: 1160859 - RNA, 14 nt, Homo sapiens
ccuaucuguuuaca

SEQ ID NO: 1160860 - RNA, 21 nt, Homo sapiens
ccuaugauuguaaaguagcug

SEQ ID NO: 1160861 - RNA, 19 nt, Homo sapiens
ccuauguacuuaauccuuu

SEQ ID NO: 1160862 - RNA, 16 nt, Homo sapiens
ccuaugugauuuuaac

SEQ ID NO: 1160863 - RNA, 18 nt, Homo sapiens
ccuauguugauccaucca

SEQ ID NO: 1160864 - RNA, 23 nt, Homo sapiens
ccuauguuuuuguucaaagccag

SEQ ID NO: 1160865 - RNA, 14 nt, Homo sapiens
ccuauuucuuaaac

SEQ ID NO: 1160866 - RNA, 18 nt, Homo sapiens
ccuauuucuuauagucaa

SEQ ID NO: 1160867 - RNA, 11 nt, Homo sapiens
ccuauuugcac

SEQ ID NO: 1160868 - RNA, 15 nt, Homo sapiens
ccucaaacacuaaag

SEQ ID NO: 1160869 - RNA, 22 nt, Homo sapiens
ccucaacugggaaccuucauau

SEQ ID NO: 1160870 - RNA, 20 nt, Homo sapiens
ccucaagaagaaaguguuca

SEQ ID NO: 1160871 - RNA, 17 nt, Homo sapiens
ccucaagaggaaugaaa

SEQ ID NO: 1160872 - RNA, 18 nt, Homo sapiens
ccucaagaucauucagug

SEQ ID NO: 1160873 - RNA, 14 nt, Homo sapiens
ccucaagugagcca

SEQ ID NO: 1160874 - RNA, 22 nt, Homo sapiens
ccucacagcacuaguauuucau

SEQ ID NO: 1160875 - RNA, 18 nt, Homo sapiens
ccucacaggccccaggaa

SEQ ID NO: 1160876 - RNA, 22 nt, Homo sapiens
ccucaccuagccugaugagauu

SEQ ID NO: 1160877 - RNA, 17 nt, Homo sapiens
ccucaccugguaccugg

SEQ ID NO: 1160878 - RNA, 16 nt, Homo sapiens
ccucacugaaaacauc

SEQ ID NO: 1160879 - RNA, 12 nt, Homo sapiens
ccucagacaucc

SEQ ID NO: 1160880 - RNA, 23 nt, Homo sapiens
ccucagacgagacccaagggcag

SEQ ID NO: 1160881 - RNA, 17 nt, Homo sapiens
ccucagacugcacccag

SEQ ID NO: 1160882 - RNA, 15 nt, Homo sapiens
ccucagcaagccaug

SEQ ID NO: 1160883 - RNA, 16 nt, Homo sapiens
ccucagcaagccaugc

SEQ ID NO: 1160884 - RNA, 18 nt, Homo sapiens
ccucagccuugccagaga

SEQ ID NO: 1160885 - RNA, 18 nt, Homo sapiens
ccucagcugcucccacac

SEQ ID NO: 1160886 - RNA, 12 nt, Homo sapiens
ccucagcuuucc

SEQ ID NO: 1160887 - RNA, 16 nt, Homo sapiens
ccucagggcacaaaga

SEQ ID NO: 1160888 - RNA, 12 nt, Homo sapiens
ccucagggccag

SEQ ID NO: 1160889 - RNA, 12 nt, Homo sapiens
ccucagugcauu

SEQ ID NO: 1160890 - RNA, 14 nt, Homo sapiens
ccucauacacagaa

SEQ ID NO: 1160891 - RNA, 21 nt, Homo sapiens
ccucaucaggaguuccagugc

SEQ ID NO: 1160892 - RNA, 17 nt, Homo sapiens
ccucauuuaucccucaa

SEQ ID NO: 1160893 - RNA, 19 nt, Homo sapiens
ccucauuugggguagcuag

SEQ ID NO: 1160894 - RNA, 22 nt, Homo sapiens
ccuccacgguccgcggccugca

SEQ ID NO: 1160895 - RNA, 18 nt, Homo sapiens
ccuccagggugauuuuau

SEQ ID NO: 1160896 - RNA, 14 nt, Homo sapiens
ccuccagugcaguc

SEQ ID NO: 1160897 - RNA, 19 nt, Homo sapiens
ccuccagugcaguccauuu

SEQ ID NO: 1160898 - RNA, 20 nt, Homo sapiens
ccucccaaagugcugagauu

SEQ ID NO: 1160899 - RNA, 20 nt, Homo sapiens
ccucccaaaguguugggauu

SEQ ID NO: 1160900 - RNA, 18 nt, Homo sapiens
ccucccaaaugagccaug

SEQ ID NO: 1160901 - RNA, 14 nt, Homo sapiens
ccucccaacucuaa

SEQ ID NO: 1160902 - RNA, 14 nt, Homo sapiens
ccucccacugcccc

SEQ ID NO: 1160903 - RNA, 21 nt, Homo sapiens
ccucccagagugcugggauua

SEQ ID NO: 1160904 - RNA, 14 nt, Homo sapiens
ccucccgggcucaa

SEQ ID NO: 1160905 - RNA, 15 nt, Homo sapiens
ccucccuaaugcuca

SEQ ID NO: 1160906 - RNA, 19 nt, Homo sapiens
ccucccuccacuccucuca

SEQ ID NO: 1160907 - RNA, 15 nt, Homo sapiens
ccucccucugccagu

SEQ ID NO: 1160908 - RNA, 15 nt, Homo sapiens
ccugcagcacuuuuu

SEQ ID NO: 1160909 - RNA, 15 nt, Homo sapiens
ccugcaucugaccag

SEQ ID NO: 1160910 - RNA, 23 nt, Homo sapiens
ccugcauuguucuuugccagaga

SEQ ID NO: 1160911 - RNA, 18 nt, Homo sapiens
ccugcccgccacauggug

SEQ ID NO: 1160912 - RNA, 19 nt, Homo sapiens
ccugcccuugucccacuca

SEQ ID NO: 1160913 - RNA, 21 nt, Homo sapiens
ccugccugugcuauuuuacuu

SEQ ID NO: 1160914 - RNA, 13 nt, Homo sapiens
ccugccuucucag

SEQ ID NO: 1160915 - RNA, 17 nt, Homo sapiens
ccugcgaggagaaauca

SEQ ID NO: 1160916 - RNA, 23 nt, Homo sapiens
ccugcgggugaacaaagcagcca

SEQ ID NO: 1160917 - RNA, 16 nt, Homo sapiens
ccugcuaugaaaggaa

SEQ ID NO: 1160918 - RNA, 19 nt, Homo sapiens
ccugcuccuaaggguagaa

SEQ ID NO: 1160919 - RNA, 20 nt, Homo sapiens
ccugcugaagcugcugcagc

SEQ ID NO: 1160920 - RNA, 17 nt, Homo sapiens
ccugcugcuggugcaca

SEQ ID NO: 1160921 - RNA, 17 nt, Homo sapiens
ccugcugcuucugcaaa

SEQ ID NO: 1160922 - RNA, 15 nt, Homo sapiens
ccugcuguccuggug

SEQ ID NO: 1160923 - RNA, 22 nt, Homo sapiens
ccugcuuggguggagaagccau

SEQ ID NO: 1160924 - RNA, 16 nt, Homo sapiens
ccugcuuuagagcuag

SEQ ID NO: 1160925 - RNA, 21 nt, Homo sapiens
ccuggacaaccagaggagaua

SEQ ID NO: 1160926 - RNA, 23 nt, Homo sapiens
ccuggagacuaaccccaccacac

SEQ ID NO: 1160927 - RNA, 18 nt, Homo sapiens
ccuggagcaaucacagau

SEQ ID NO: 1160928 - RNA, 11 nt, Homo sapiens
ccuggagcucc

SEQ ID NO: 1160929 - RNA, 17 nt, Homo sapiens
ccuggaucuaccagcau

SEQ ID NO: 1160930 - RNA, 15 nt, Homo sapiens
ccuggcacacaucag

SEQ ID NO: 1160931 - RNA, 18 nt, Homo sapiens
ccuggcaccuguguucca

SEQ ID NO: 1160932 - RNA, 22 nt, Homo sapiens
ccuggcacucuuguucccacac

SEQ ID NO: 1160933 - RNA, 14 nt, Homo sapiens
ccuggcaucugugc

SEQ ID NO: 1160934 - RNA, 18 nt, Homo sapiens
ccuggcccaaccagacuu

SEQ ID NO: 1160935 - RNA, 14 nt, Homo sapiens
ccuggccuacccag

SEQ ID NO: 1160936 - RNA, 15 nt, Homo sapiens
ccuggcgcuucggcu

SEQ ID NO: 1160937 - RNA, 14 nt, Homo sapiens
ccuggcucaucucu

SEQ ID NO: 1160938 - RNA, 17 nt, Homo sapiens
ccugggaaauaagcccc

SEQ ID NO: 1160939 - RNA, 13 nt, Homo sapiens
ccugggacacugc

SEQ ID NO: 1160940 - RNA, 21 nt, Homo sapiens
ccugggaggaaauuugaaugg

SEQ ID NO: 1160941 - RNA, 24 nt, Homo sapiens
ccugggccuggagggggagcacca

SEQ ID NO: 1160942 - RNA, 20 nt, Homo sapiens
ccugggcgcuucccuuuuaa

SEQ ID NO: 1160943 - RNA, 18 nt, Homo sapiens
ccugggcugaccccggug

SEQ ID NO: 1160944 - RNA, 19 nt, Homo sapiens
ccuggggagucugggcaca

SEQ ID NO: 1160945 - RNA, 12 nt, Homo sapiens
ccugggugacaa

SEQ ID NO: 1160946 - RNA, 17 nt, Homo sapiens
ccuggugcaagugcugu

SEQ ID NO: 1160947 - RNA, 17 nt, Homo sapiens
ccuggugcacagggcua

SEQ ID NO: 1160948 - RNA, 20 nt, Homo sapiens
ccugguuaaacaaaccagaa

SEQ ID NO: 1160949 - RNA, 22 nt, Homo sapiens
ccugguugagcuucugcuaaaa

SEQ ID NO: 1160950 - RNA, 20 nt, Homo sapiens
ccugguuuucgucaucuucc

SEQ ID NO: 1160951 - RNA, 19 nt, Homo sapiens
ccuguaaucccagaacuuu

SEQ ID NO: 1160952 - RNA, 18 nt, Homo sapiens
ccuguaaucccagcacuu

SEQ ID NO: 1160953 - RNA, 15 nt, Homo sapiens
ccuguaaucccagcu

SEQ ID NO: 1160954 - RNA, 22 nt, Homo sapiens
ccuguacccaguagaugccacc

SEQ ID NO: 1160955 - RNA, 21 nt, Homo sapiens
ccuguacccaguguuacccuc

SEQ ID NO: 1160956 - RNA, 14 nt, Homo sapiens
ccugucacaauucu

SEQ ID NO: 1160957 - RNA, 22 nt, Homo sapiens
ccugucacggagggauugaucu

SEQ ID NO: 1160958 - RNA, 15 nt, Homo sapiens
ccuguccagcuccaa

SEQ ID NO: 1160959 - RNA, 17 nt, Homo sapiens
ccuguccuccaacacca

SEQ ID NO: 1160960 - RNA, 17 nt, Homo sapiens
ccugucgauuagacugg

SEQ ID NO: 1160961 - RNA, 21 nt, Homo sapiens
ccugucucauucgccucugga

SEQ ID NO: 1160962 - RNA, 20 nt, Homo sapiens
ccugucucuuuccacuuugu

SEQ ID NO: 1160963 - RNA, 17 nt, Homo sapiens
ccugucugaacuguuaa

SEQ ID NO: 1160964 - RNA, 11 nt, Homo sapiens
ccugucuguac

SEQ ID NO: 1160965 - RNA, 23 nt, Homo sapiens
ccugugagguuucccaauggugu

SEQ ID NO: 1160966 - RNA, 18 nt, Homo sapiens
ccugugcccaucaucucu

SEQ ID NO: 1160967 - RNA, 12 nt, Homo sapiens
ccugugccucca

SEQ ID NO: 1160968 - RNA, 15 nt, Homo sapiens
ccugugccuccauca

SEQ ID NO: 1160969 - RNA, 12 nt, Homo sapiens
ccuguggaugag

SEQ ID NO: 1160970 - RNA, 16 nt, Homo sapiens
ccuguggcagcugccc

SEQ ID NO: 1160971 - RNA, 16 nt, Homo sapiens
ccuguggccacuuucc

SEQ ID NO: 1160972 - RNA, 20 nt, Homo sapiens
gaggcagacagguguaugga

SEQ ID NO: 1160973 - RNA, 20 nt, Homo sapiens
gaggcaggagaaucacuuga

SEQ ID NO: 1160974 - RNA, 20 nt, Homo sapiens
gaggcaggagaauugcuuga

SEQ ID NO: 1160975 - RNA, 13 nt, Homo sapiens
gaggcagugacag

SEQ ID NO: 1160976 - RNA, 20 nt, Homo sapiens
gaggccaaggugggcggauc

SEQ ID NO: 1160977 - RNA, 18 nt, Homo sapiens
gaggccagccagugaccu

SEQ ID NO: 1160978 - RNA, 17 nt, Homo sapiens
gaggcccaggcugggaa

SEQ ID NO: 1160979 - RNA, 19 nt, Homo sapiens
gaggccccaggucaccucg

SEQ ID NO: 1160980 - RNA, 16 nt, Homo sapiens
gaggccucucucagga

SEQ ID NO: 1160981 - RNA, 13 nt, Homo sapiens
gaggccugagaca

SEQ ID NO: 1160982 - RNA, 17 nt, Homo sapiens
gaggcgucuucaucucc

SEQ ID NO: 1160983 - RNA, 14 nt, Homo sapiens
gaggcuacagcaga

SEQ ID NO: 1160984 - RNA, 20 nt, Homo sapiens
gaggcucccacuucuuggga

SEQ ID NO: 1160985 - RNA, 22 nt, Homo sapiens
gaggcuccuguuagcuccucac

SEQ ID NO: 1160986 - RNA, 14 nt, Homo sapiens
gaggcugagacagg

SEQ ID NO: 1160987 - RNA, 16 nt, Homo sapiens
gaggcugaggcaagag

SEQ ID NO: 1160988 - RNA, 14 nt, Homo sapiens
gaggcugcacugga

SEQ ID NO: 1160989 - RNA, 15 nt, Homo sapiens
gaggcuuuaaaaaga

SEQ ID NO: 1160990 - RNA, 22 nt, Homo sapiens
gagggaaacugugaaugcuucu

SEQ ID NO: 1160991 - RNA, 18 nt, Homo sapiens
gagggaccucucccaggg

SEQ ID NO: 1160992 - RNA, 24 nt, Homo sapiens
gagggagagaacugagcaucucca

SEQ ID NO: 1160993 - RNA, 15 nt, Homo sapiens
gagggagaugggagg

SEQ ID NO: 1160994 - RNA, 20 nt, Homo sapiens
gagggaggguuucucuccca

SEQ ID NO: 1160995 - RNA, 12 nt, Homo sapiens
gagggagugcag

SEQ ID NO: 1160996 - RNA, 16 nt, Homo sapiens
gagggcagucgauaga

SEQ ID NO: 1160997 - RNA, 21 nt, Homo sapiens
gaggggaaguccagccuacca

SEQ ID NO: 1160998 - RNA, 20 nt, Homo sapiens
gaggggaggaguuccacaga

SEQ ID NO: 1160999 - RNA, 14 nt, Homo sapiens
gaggguccucaguc

SEQ ID NO: 1161000 - RNA, 21 nt, Homo sapiens
gaggguccuuuaguaccugaa

SEQ ID NO: 1161001 - RNA, 15 nt, Homo sapiens
gagggugagguugca

SEQ ID NO: 1161002 - RNA, 18 nt, Homo sapiens
gagggugggaggggccau

SEQ ID NO: 1161003 - RNA, 21 nt, Homo sapiens
gagguauucaauauccuuugc

SEQ ID NO: 1161004 - RNA, 23 nt, Homo sapiens
gaggucgucgaaaggugcagcug

SEQ ID NO: 1161005 - RNA, 23 nt, Homo sapiens
gaggugaacaagcaaacccagac

SEQ ID NO: 1161006 - RNA, 16 nt, Homo sapiens
gaggugcaacaagguc

SEQ ID NO: 1161007 - RNA, 20 nt, Homo sapiens
gagguggagguugcauugag

SEQ ID NO: 1161008 - RNA, 19 nt, Homo sapiens
gagguggagucuugcucug

SEQ ID NO: 1161009 - RNA, 17 nt, Homo sapiens
gagguggcacuagggau

SEQ ID NO: 1161010 - RNA, 16 nt, Homo sapiens
gagguggcuaaggggg

SEQ ID NO: 1161011 - RNA, 17 nt, Homo sapiens
gagguggcugccuggag

SEQ ID NO: 1161012 - RNA, 21 nt, Homo sapiens
gaguaaaauuccuucugauga

SEQ ID NO: 1161013 - RNA, 12 nt, Homo sapiens
gaguacacagcu

SEQ ID NO: 1161014 - RNA, 17 nt, Homo sapiens
gaguacaccccaacagc

SEQ ID NO: 1161015 - RNA, 18 nt, Homo sapiens
gaguacaccccaacagca

SEQ ID NO: 1161016 - RNA, 16 nt, Homo sapiens
gaguacucacuuuuca

SEQ ID NO: 1161017 - RNA, 15 nt, Homo sapiens
gagucaccaaaacca

SEQ ID NO: 1161018 - RNA, 13 nt, Homo sapiens
gagucaccaggaa

SEQ ID NO: 1161019 - RNA, 15 nt, Homo sapiens
gagucagcugacccc

SEQ ID NO: 1161020 - RNA, 17 nt, Homo sapiens
gagucaggcaauugauu

SEQ ID NO: 1161021 - RNA, 20 nt, Homo sapiens
gagucccucacguuucuucc

SEQ ID NO: 1161022 - RNA, 14 nt, Homo sapiens
gagucuccucccca

SEQ ID NO: 1161023 - RNA, 14 nt, Homo sapiens
gagucugaagcaga

SEQ ID NO: 1161024 - RNA, 16 nt, Homo sapiens
gagucugcacgggacc

SEQ ID NO: 1161025 - RNA, 23 nt, Homo sapiens
gagucugccccacauguggccau

SEQ ID NO: 1161026 - RNA, 13 nt, Homo sapiens
gagugagacucca

SEQ ID NO: 1161027 - RNA, 19 nt, Homo sapiens
gagugagacuccaucucaa

SEQ ID NO: 1161028 - RNA, 14 nt, Homo sapiens
gagugagugaugaa

SEQ ID NO: 1161029 - RNA, 15 nt, Homo sapiens
gagugcaguggugcg

SEQ ID NO: 1161030 - RNA, 13 nt, Homo sapiens
gagugccacaucc

SEQ ID NO: 1161031 - RNA, 17 nt, Homo sapiens
gagugcccccaacagca

SEQ ID NO: 1161032 - RNA, 18 nt, Homo sapiens
gagugcccccaacagcac

SEQ ID NO: 1161033 - RNA, 23 nt, Homo sapiens
gagugcggcguggagacuggcag

SEQ ID NO: 1161034 - RNA, 16 nt, Homo sapiens
gaguggacaagucaug

SEQ ID NO: 1161035 - RNA, 16 nt, Homo sapiens
gaguguaaaucuugcc

SEQ ID NO: 1161036 - RNA, 14 nt, Homo sapiens
gagugucaaccaga

SEQ ID NO: 1161037 - RNA, 16 nt, Homo sapiens
gaguguccucuucccu

SEQ ID NO: 1161038 - RNA, 21 nt, Homo sapiens
gaguguuccccuuccacugag

SEQ ID NO: 1161039 - RNA, 13 nt, Homo sapiens
gaguguuccugug

SEQ ID NO: 1161040 - RNA, 11 nt, Homo sapiens
gaguucucacu

SEQ ID NO: 1161041 - RNA, 23 nt, Homo sapiens
gaguucucacuauguuucucaga

SEQ ID NO: 1161042 - RNA, 15 nt, Homo sapiens
gaguugagugauaga

SEQ ID NO: 1161043 - RNA, 24 nt, Homo sapiens
gaguuguuuuaacagaugccaauu

SEQ ID NO: 1161044 - RNA, 23 nt, Homo sapiens
gaguuucccuuccuuaugucucc

SEQ ID NO: 1161045 - RNA, 16 nt, Homo sapiens
gaguuugacauuuaau

SEQ ID NO: 1161046 - RNA, 17 nt, Homo sapiens
gaguuugccuguacucu

SEQ ID NO: 1161047 - RNA, 22 nt, Homo sapiens
gaguuugguuaaucaguguuga

SEQ ID NO: 1161048 - RNA, 21 nt, Homo sapiens
gauaaaacugguuuuagacaa

SEQ ID NO: 1161049 - RNA, 23 nt, Homo sapiens
gauaaaagaaaaaccugugauuc

SEQ ID NO: 1161050 - RNA, 13 nt, Homo sapiens
gauaaacuuugaa

SEQ ID NO: 1161051 - RNA, 22 nt, Homo sapiens
gauaaagauggauggcuguuaa

SEQ ID NO: 1161052 - RNA, 17 nt, Homo sapiens
gauaaaugacaagcaaa

SEQ ID NO: 1161053 - RNA, 16 nt, Homo sapiens
gauaaaugcaauauuc

SEQ ID NO: 1161054 - RNA, 19 nt, Homo sapiens
gauaaauuuaaagucuaag

SEQ ID NO: 1161055 - RNA, 20 nt, Homo sapiens
gauaacucaggaagccucug

SEQ ID NO: 1161056 - RNA, 20 nt, Homo sapiens
gauaagacacccccucaaac

SEQ ID NO: 1161057 - RNA, 18 nt, Homo sapiens
gauaagcuaacaccagac

SEQ ID NO: 1161058 - RNA, 20 nt, Homo sapiens
gauaaguucuaguugcuugu

SEQ ID NO: 1161059 - RNA, 13 nt, Homo sapiens
gauaauagauucu

SEQ ID NO: 1161060 - RNA, 16 nt, Homo sapiens
gauaauagauucucuu

SEQ ID NO: 1161061 - RNA, 16 nt, Homo sapiens
gauaaugaaauaauca

SEQ ID NO: 1161062 - RNA, 19 nt, Homo sapiens
gauaaugcuguugccucau

SEQ ID NO: 1161063 - RNA, 12 nt, Homo sapiens
gauaauucucag

SEQ ID NO: 1161064 - RNA, 15 nt, Homo sapiens
gauacaaacauguuc

SEQ ID NO: 1161065 - RNA, 19 nt, Homo sapiens
gauacacuaaaaaucugag

SEQ ID NO: 1161066 - RNA, 23 nt, Homo sapiens
gauacagcuuuuugcaguauggu

SEQ ID NO: 1161067 - RNA, 21 nt, Homo sapiens
gauacauaaaagugcuuugca

SEQ ID NO: 1161068 - RNA, 21 nt, Homo sapiens
gauacauaaugggccacugaa

SEQ ID NO: 1161069 - RNA, 20 nt, Homo sapiens
gauaccacuuuucauugcaa

SEQ ID NO: 1161070 - RNA, 16 nt, Homo sapiens
gauacgggggcuguga

SEQ ID NO: 1161071 - RNA, 20 nt, Homo sapiens
gauacgggggcugugacucu

SEQ ID NO: 1161072 - RNA, 19 nt, Homo sapiens
gauacugaggcacacagag

SEQ ID NO: 1161073 - RNA, 14 nt, Homo sapiens
gauacugcugccaa

SEQ ID NO: 1161074 - RNA, 17 nt, Homo sapiens
gauacuugaacacugug

SEQ ID NO: 1161075 - RNA, 21 nt, Homo sapiens
gauagaguucuuuuaagccca

SEQ ID NO: 1161076 - RNA, 14 nt, Homo sapiens
gauagaugcuggcc

SEQ ID NO: 1161077 - RNA, 15 nt, Homo sapiens
gauagccccacagga

SEQ ID NO: 1161078 - RNA, 17 nt, Homo sapiens
gauagcuguguguguua

SEQ ID NO: 1161079 - RNA, 18 nt, Homo sapiens
gauaguacuaagcauuuc

SEQ ID NO: 1161080 - RNA, 15 nt, Homo sapiens
gauaguuuaccugaa

SEQ ID NO: 1161081 - RNA, 19 nt, Homo sapiens
gauauacuugguucucucc

SEQ ID NO: 1161082 - RNA, 16 nt, Homo sapiens
gauauaguaguaccuu

SEQ ID NO: 1161083 - RNA, 23 nt, Homo sapiens
gauauggaauucaaagcucuaau

SEQ ID NO: 1161084 - RNA, 15 nt, Homo sapiens
gauauuaugauuuga

SEQ ID NO: 1161085 - RNA, 14 nt, Homo sapiens
gaucaaaauuacuu

SEQ ID NO: 1161086 - RNA, 14 nt, Homo sapiens
gaucaacucugucu

SEQ ID NO: 1161087 - RNA, 15 nt, Homo sapiens
gaucaauuucaacau

SEQ ID NO: 1161088 - RNA, 17 nt, Homo sapiens
gaucacaaggucaggag

SEQ ID NO: 1161089 - RNA, 16 nt, Homo sapiens
gaucacguugcaaugg

SEQ ID NO: 1161090 - RNA, 19 nt, Homo sapiens
gaucacuucaggucaggag

SEQ ID NO: 1161091 - RNA, 19 nt, Homo sapiens
gaucagauugcaugugacu

SEQ ID NO: 1161092 - RNA, 21 nt, Homo sapiens
gaucagcuuucaaagcauuua

SEQ ID NO: 1161093 - RNA, 14 nt, Homo sapiens
gaucaggcacaggu

SEQ ID NO: 1161094 - RNA, 23 nt, Homo sapiens
gaucauacguaccccaaaccuca

SEQ ID NO: 1161095 - RNA, 21 nt, Homo sapiens
gaucauuuuuaacugauucuu

SEQ ID NO: 1161096 - RNA, 13 nt, Homo sapiens
gauccaagcaaga

SEQ ID NO: 1161097 - RNA, 16 nt, Homo sapiens
gaucccaauaacccag

SEQ ID NO: 1161098 - RNA, 17 nt, Homo sapiens
gaucccgcguaguguca

SEQ ID NO: 1161099 - RNA, 15 nt, Homo sapiens
gauccugggggacca

SEQ ID NO: 1161100 - RNA, 18 nt, Homo sapiens
gaucgccaaccuuucccc

SEQ ID NO: 1161101 - RNA, 20 nt, Homo sapiens
gaucgugccauugcacucca

SEQ ID NO: 1161102 - RNA, 22 nt, Homo sapiens
gaucguuuuuucccagggcaag

SEQ ID NO: 1161103 - RNA, 13 nt, Homo sapiens
gaucuacaugaau

SEQ ID NO: 1161104 - RNA, 18 nt, Homo sapiens
gaucucagcucacugcaa

SEQ ID NO: 1161105 - RNA, 17 nt, Homo sapiens
gaucucaguauuuugaa

SEQ ID NO: 1161106 - RNA, 15 nt, Homo sapiens
gaucucggcucagug

SEQ ID NO: 1161107 - RNA, 14 nt, Homo sapiens
gaucucugcaucuc

SEQ ID NO: 1161108 - RNA, 20 nt, Homo sapiens
gaucucugguuguccucacu

SEQ ID NO: 1161109 - RNA, 21 nt, Homo sapiens
gaucucuucuuuuggcuucca

SEQ ID NO: 1161110 - RNA, 19 nt, Homo sapiens
gaucuggaacccagacuca

SEQ ID NO: 1161111 - RNA, 17 nt, Homo sapiens
gaucuggaagggccaag

SEQ ID NO: 1161112 - RNA, 15 nt, Homo sapiens
gaucuggcagacuca

SEQ ID NO: 1161113 - RNA, 22 nt, Homo sapiens
gaucugguguccagcauggaug

SEQ ID NO: 1161114 - RNA, 19 nt, Homo sapiens
gaucuguaaggaacuggaa

SEQ ID NO: 1161115 - RNA, 18 nt, Homo sapiens
gaucuguguuaaucugag

SEQ ID NO: 1161116 - RNA, 13 nt, Homo sapiens
gaucuuagauucu

SEQ ID NO: 1161117 - RNA, 16 nt, Homo sapiens
gaucuuccagaagcug

SEQ ID NO: 1161118 - RNA, 22 nt, Homo sapiens
gaucuugugacccuccaugcca

SEQ ID NO: 1161119 - RNA, 13 nt, Homo sapiens
gaucuuugcaaag

SEQ ID NO: 1161120 - RNA, 21 nt, Homo sapiens
gaucuuugcuuccuugcuuuu

SEQ ID NO: 1161121 - RNA, 18 nt, Homo sapiens
gaucuuuguauauuacau

SEQ ID NO: 1161122 - RNA, 22 nt, Homo sapiens
gaugaacaauuaugaacaucca

SEQ ID NO: 1161123 - RNA, 22 nt, Homo sapiens
gaugaagcccagccacauuuca

SEQ ID NO: 1161124 - RNA, 12 nt, Homo sapiens
gaugaaggugaa

SEQ ID NO: 1161125 - RNA, 14 nt, Homo sapiens
gaugaaucacuguu

SEQ ID NO: 1161126 - RNA, 22 nt, Homo sapiens
gaugaauugucacaucuaucca

SEQ ID NO: 1161127 - RNA, 21 nt, Homo sapiens
gaugagaguacaccccaacag

SEQ ID NO: 1161128 - RNA, 13 nt, Homo sapiens
gaugagggggcca

SEQ ID NO: 1161129 - RNA, 14 nt, Homo sapiens
gaugaucaacauaa

SEQ ID NO: 1161130 - RNA, 17 nt, Homo sapiens
gaugaucagggauccaa

SEQ ID NO: 1161131 - RNA, 22 nt, Homo sapiens
gaugauccagagacauguggca

SEQ ID NO: 1161132 - RNA, 16 nt, Homo sapiens
gaugauggaugccaau

SEQ ID NO: 1161133 - RNA, 13 nt, Homo sapiens
gaugcaaccaaaa

SEQ ID NO: 1161134 - RNA, 15 nt, Homo sapiens
gaugcaaugugcuac

SEQ ID NO: 1161135 - RNA, 22 nt, Homo sapiens
gaugcacgguuucuguucugcc

SEQ ID NO: 1161136 - RNA, 16 nt, Homo sapiens
gaugcauggaguguuu

SEQ ID NO: 1161137 - RNA, 13 nt, Homo sapiens
gaugcauucgaga

SEQ ID NO: 1161138 - RNA, 22 nt, Homo sapiens
gaugccgagguaaaaguucuuu

SEQ ID NO: 1161139 - RNA, 19 nt, Homo sapiens
gaugccucgcucuuuucaa

SEQ ID NO: 1161140 - RNA, 16 nt, Homo sapiens
gaugcggccauucaag

SEQ ID NO: 1161141 - RNA, 19 nt, Homo sapiens
gaugcuccagcaacacagc

SEQ ID NO: 1161142 - RNA, 12 nt, Homo sapiens
gaugcugaccuc

SEQ ID NO: 1161143 - RNA, 19 nt, Homo sapiens
gaugcugguggcucuucag

SEQ ID NO: 1161144 - RNA, 14 nt, Homo sapiens
gaugcuguuugaca

SEQ ID NO: 1161145 - RNA, 18 nt, Homo sapiens
gaugcuuuaccaaacagc

SEQ ID NO: 1161146 - RNA, 14 nt, Homo sapiens
gauggagaugucuc

SEQ ID NO: 1161147 - RNA, 20 nt, Homo sapiens
gauggcagauucccacugcc

SEQ ID NO: 1161148 - RNA, 21 nt, Homo sapiens
gauggcagauucccacugccg

SEQ ID NO: 1161149 - RNA, 20 nt, Homo sapiens
gaugggcauaugugucagug

SEQ ID NO: 1161150 - RNA, 12 nt, Homo sapiens
gcaaaguacugu

SEQ ID NO: 1161151 - RNA, 17 nt, Homo sapiens
gcaaauaacugaucuca

SEQ ID NO: 1161152 - RNA, 21 nt, Homo sapiens
gcaaauagccuuccugaccuc

SEQ ID NO: 1161153 - RNA, 16 nt, Homo sapiens
gcaaaugaaaaaguca

SEQ ID NO: 1161154 - RNA, 19 nt, Homo sapiens
gcaaauggcuuagcuacuu

SEQ ID NO: 1161155 - RNA, 16 nt, Homo sapiens
gcaaauguaacugugc

SEQ ID NO: 1161156 - RNA, 16 nt, Homo sapiens
gcaaauguuaugcaua

SEQ ID NO: 1161157 - RNA, 20 nt, Homo sapiens
gcaaauuaguugguuugugu

SEQ ID NO: 1161158 - RNA, 21 nt, Homo sapiens
gcaaauuggcuaaagugcauu

SEQ ID NO: 1161159 - RNA, 23 nt, Homo sapiens
gcaacaagaaacucaaugcacaa

SEQ ID NO: 1161160 - RNA, 21 nt, Homo sapiens
gcaacagagcaagacuccauc

SEQ ID NO: 1161161 - RNA, 20 nt, Homo sapiens
gcaaccuccgccuccugggu

SEQ ID NO: 1161162 - RNA, 20 nt, Homo sapiens
gcaaccuccuuaucugcuaa

SEQ ID NO: 1161163 - RNA, 18 nt, Homo sapiens
gcaacucaucaucgguga

SEQ ID NO: 1161164 - RNA, 14 nt, Homo sapiens
gcaacuucaaggga

SEQ ID NO: 1161165 - RNA, 18 nt, Homo sapiens
gcaagaacucaucacugu

SEQ ID NO: 1161166 - RNA, 14 nt, Homo sapiens
gcaagacccaucuc

SEQ ID NO: 1161167 - RNA, 18 nt, Homo sapiens
gcaagagcugaaaaacuu

SEQ ID NO: 1161168 - RNA, 15 nt, Homo sapiens
gcaagauaaacacuu

SEQ ID NO: 1161169 - RNA, 18 nt, Homo sapiens
gcaagaucccaucucuuu

SEQ ID NO: 1161170 - RNA, 16 nt, Homo sapiens
gcaagcauugaauaau

SEQ ID NO: 1161171 - RNA, 13 nt, Homo sapiens
gcaagcuguguua

SEQ ID NO: 1161172 - RNA, 16 nt, Homo sapiens
gcaagcuuauaaugua

SEQ ID NO: 1161173 - RNA, 16 nt, Homo sapiens
gcaaggaaacuaugua

SEQ ID NO: 1161174 - RNA, 14 nt, Homo sapiens
gcaaguaucauaau

SEQ ID NO: 1161175 - RNA, 19 nt, Homo sapiens
gcaauaaaucugacccagu

SEQ ID NO: 1161176 - RNA, 19 nt, Homo sapiens
gcaauacguuugugcagaa

SEQ ID NO: 1161177 - RNA, 16 nt, Homo sapiens
gcaauaguuaccucaa

SEQ ID NO: 1161178 - RNA, 17 nt, Homo sapiens
gcaaucucuugcauuuc

SEQ ID NO: 1161179 - RNA, 14 nt, Homo sapiens
gcaaucuuugccaa

SEQ ID NO: 1161180 - RNA, 22 nt, Homo sapiens
gcaaugaauccccaauaauugc

SEQ ID NO: 1161181 - RNA, 13 nt, Homo sapiens
gcaaugacucagg

SEQ ID NO: 1161182 - RNA, 20 nt, Homo sapiens
gcaaugacucaggacauccc

SEQ ID NO: 1161183 - RNA, 15 nt, Homo sapiens
gcaaugcugaugaau

SEQ ID NO: 1161184 - RNA, 13 nt, Homo sapiens
gcaaugcugugaa

SEQ ID NO: 1161185 - RNA, 12 nt, Homo sapiens
gcaaugugcuac

SEQ ID NO: 1161186 - RNA, 18 nt, Homo sapiens
gcaauucuccugccuuug

SEQ ID NO: 1161187 - RNA, 23 nt, Homo sapiens
gcaauugagggacugagccagac

SEQ ID NO: 1161188 - RNA, 22 nt, Homo sapiens
gcaauuguuaaucaaagauuga

SEQ ID NO: 1161189 - RNA, 22 nt, Homo sapiens
gcacaaacacaaggucauggcc

SEQ ID NO: 1161190 - RNA, 13 nt, Homo sapiens
gcacaaagacaua

SEQ ID NO: 1161191 - RNA, 14 nt, Homo sapiens
gcacaacaaaggau

SEQ ID NO: 1161192 - RNA, 16 nt, Homo sapiens
gcacaagaaucacuug

SEQ ID NO: 1161193 - RNA, 17 nt, Homo sapiens
gcacaagauacacguca

SEQ ID NO: 1161194 - RNA, 15 nt, Homo sapiens
gcacaaggccuugcc

SEQ ID NO: 1161195 - RNA, 18 nt, Homo sapiens
gcacaagguaaauauuca

SEQ ID NO: 1161196 - RNA, 23 nt, Homo sapiens
gcacaagucauaccuacauucaa

SEQ ID NO: 1161197 - RNA, 22 nt, Homo sapiens
gcacaauuucccuucauacucc

SEQ ID NO: 1161198 - RNA, 20 nt, Homo sapiens
gcacacagggugguggcaca

SEQ ID NO: 1161199 - RNA, 21 nt, Homo sapiens
gcacacagggugguggcacau

SEQ ID NO: 1161200 - RNA, 18 nt, Homo sapiens
gcacacuuccaccauagc

SEQ ID NO: 1161201 - RNA, 15 nt, Homo sapiens
gcacagcaaacuguc

SEQ ID NO: 1161202 - RNA, 23 nt, Homo sapiens
gcacaggacaugcgguagccagc

SEQ ID NO: 1161203 - RNA, 19 nt, Homo sapiens
gcacaguuuguggcuuaua

SEQ ID NO: 1161204 - RNA, 15 nt, Homo sapiens
gcacauagcagacua

SEQ ID NO: 1161205 - RNA, 16 nt, Homo sapiens
gcacaugaaacauuau

SEQ ID NO: 1161206 - RNA, 14 nt, Homo sapiens
gcacaugaacuguc

SEQ ID NO: 1161207 - RNA, 14 nt, Homo sapiens
gcacaugcaccuac

SEQ ID NO: 1161208 - RNA, 20 nt, Homo sapiens
gcacaugucuuguacaugug

SEQ ID NO: 1161209 - RNA, 20 nt, Homo sapiens
gcacauugauuugugcuaug

SEQ ID NO: 1161210 - RNA, 19 nt, Homo sapiens
gcaccagcgguccaacgcc

SEQ ID NO: 1161211 - RNA, 21 nt, Homo sapiens
gcaccaggcacgaacccaccu

SEQ ID NO: 1161212 - RNA, 19 nt, Homo sapiens
gcaccauugcugcuccuua

SEQ ID NO: 1161213 - RNA, 17 nt, Homo sapiens
gcaccccuccuagcaac

SEQ ID NO: 1161214 - RNA, 15 nt, Homo sapiens
gcacccugcccucau

SEQ ID NO: 1161215 - RNA, 17 nt, Homo sapiens
gcaccgccggcuuucag

SEQ ID NO: 1161216 - RNA, 21 nt, Homo sapiens
gcaccgggcuggcugcuugca

SEQ ID NO: 1161217 - RNA, 16 nt, Homo sapiens
gcaccucuccugugag

SEQ ID NO: 1161218 - RNA, 13 nt, Homo sapiens
gcaccugaccaca

SEQ ID NO: 1161219 - RNA, 22 nt, Homo sapiens
gcaccugccagaggaugcucuu

SEQ ID NO: 1161220 - RNA, 20 nt, Homo sapiens
gcaccugccagggaggccau

SEQ ID NO: 1161221 - RNA, 23 nt, Homo sapiens
gcaccuggugggugguguccuga

SEQ ID NO: 1161222 - RNA, 13 nt, Homo sapiens
gcaccugugcugg

SEQ ID NO: 1161223 - RNA, 18 nt, Homo sapiens
gcacguuaugguguuucu

SEQ ID NO: 1161224 - RNA, 11 nt, Homo sapiens
gcacuaugaca

SEQ ID NO: 1161225 - RNA, 13 nt, Homo sapiens
gcacucacgcccu

SEQ ID NO: 1161226 - RNA, 22 nt, Homo sapiens
gcacuccucucgcauggugugg

SEQ ID NO: 1161227 - RNA, 18 nt, Homo sapiens
gcacucuugaacugggcg

SEQ ID NO: 1161228 - RNA, 17 nt, Homo sapiens
gcacugcccauggacag

SEQ ID NO: 1161229 - RNA, 21 nt, Homo sapiens
gcacuggugguuuuugcucuc

SEQ ID NO: 1161230 - RNA, 16 nt, Homo sapiens
gcacuguuucucucac

SEQ ID NO: 1161231 - RNA, 22 nt, Homo sapiens
gcacuuggaaagguuucaagac

SEQ ID NO: 1161232 - RNA, 22 nt, Homo sapiens
gcagaaaggaaaagauuccugu

SEQ ID NO: 1161233 - RNA, 22 nt, Homo sapiens
gcagaacagaucuuuuacuuug

SEQ ID NO: 1161234 - RNA, 15 nt, Homo sapiens
gcagaaccagugaca

SEQ ID NO: 1161235 - RNA, 21 nt, Homo sapiens
gcagaaccagugacaaucuua

SEQ ID NO: 1161236 - RNA, 19 nt, Homo sapiens
gcagaagguuacuaccuag

SEQ ID NO: 1161237 - RNA, 13 nt, Homo sapiens
gcagaaguauucu

SEQ ID NO: 1161238 - RNA, 18 nt, Homo sapiens
gcagaauacaaugggaaa

SEQ ID NO: 1161239 - RNA, 15 nt, Homo sapiens
gcagaaucucagaga

SEQ ID NO: 1161240 - RNA, 19 nt, Homo sapiens
gcagacacauugucaucag

SEQ ID NO: 1161241 - RNA, 21 nt, Homo sapiens
gcagacagcuccacccuggcc

SEQ ID NO: 1161242 - RNA, 21 nt, Homo sapiens
gcagaccacugauaaaaccau

SEQ ID NO: 1161243 - RNA, 19 nt, Homo sapiens
gcagaccugacucucuuaa

SEQ ID NO: 1161244 - RNA, 21 nt, Homo sapiens
gcagacugcaaaucugccuga

SEQ ID NO: 1161245 - RNA, 15 nt, Homo sapiens
gcagagagacaacag

SEQ ID NO: 1161246 - RNA, 12 nt, Homo sapiens
gcagagccuguc

SEQ ID NO: 1161247 - RNA, 20 nt, Homo sapiens
gcagagggccuuugcuacac

SEQ ID NO: 1161248 - RNA, 18 nt, Homo sapiens
gcagaggucccucagcug

SEQ ID NO: 1161249 - RNA, 16 nt, Homo sapiens
gcagaguaaguauuau

SEQ ID NO: 1161250 - RNA, 16 nt, Homo sapiens
gcagaguauuaaugaa

SEQ ID NO: 1161251 - RNA, 21 nt, Homo sapiens
gcagauacugucucuuucaug

SEQ ID NO: 1161252 - RNA, 14 nt, Homo sapiens
gcagauucgaguca

SEQ ID NO: 1161253 - RNA, 15 nt, Homo sapiens
gcagcaaauuuucag

SEQ ID NO: 1161254 - RNA, 20 nt, Homo sapiens
gcagcaccguucugugcaca

SEQ ID NO: 1161255 - RNA, 19 nt, Homo sapiens
gcagcacuggaaccaccug

SEQ ID NO: 1161256 - RNA, 10 nt, Homo sapiens
gcagcauucc

SEQ ID NO: 1161257 - RNA, 17 nt, Homo sapiens
gcagcauuccaugacca

SEQ ID NO: 1161258 - RNA, 21 nt, Homo sapiens
gcagccagaggcaccucaaga

SEQ ID NO: 1161259 - RNA, 16 nt, Homo sapiens
gcagccaugagaacaa

SEQ ID NO: 1161260 - RNA, 20 nt, Homo sapiens
gcagcccucagggcugcuuu

SEQ ID NO: 1161261 - RNA, 19 nt, Homo sapiens
gcagccugagcaacucuug

SEQ ID NO: 1161262 - RNA, 17 nt, Homo sapiens
gcagcgccuuucccaac

SEQ ID NO: 1161263 - RNA, 23 nt, Homo sapiens
gcagcggggcaagcaaaaacaau

SEQ ID NO: 1161264 - RNA, 20 nt, Homo sapiens
gcagcuaacaugaguaucau

SEQ ID NO: 1161265 - RNA, 12 nt, Homo sapiens
gcagcucaggga

SEQ ID NO: 1161266 - RNA, 14 nt, Homo sapiens
gcagcuccacaggg

SEQ ID NO: 1161267 - RNA, 16 nt, Homo sapiens
gcagcugccauugcag

SEQ ID NO: 1161268 - RNA, 20 nt, Homo sapiens
gcagcuuagacuaaggccau

SEQ ID NO: 1161269 - RNA, 17 nt, Homo sapiens
gcaggaaauaccaacug

SEQ ID NO: 1161270 - RNA, 21 nt, Homo sapiens
gcaggaacccuuggucacaug

SEQ ID NO: 1161271 - RNA, 15 nt, Homo sapiens
gcaggaagcucagac

SEQ ID NO: 1161272 - RNA, 13 nt, Homo sapiens
gcaggaccaaggg

SEQ ID NO: 1161273 - RNA, 16 nt, Homo sapiens
gcaggacccagcauaa

SEQ ID NO: 1161274 - RNA, 13 nt, Homo sapiens
gcaggacugcaca

SEQ ID NO: 1161275 - RNA, 17 nt, Homo sapiens
gcaggagaauugcuuga

SEQ ID NO: 1161276 - RNA, 24 nt, Homo sapiens
gcaggagggaggguuucucuccca

SEQ ID NO: 1161277 - RNA, 15 nt, Homo sapiens
gcaggaugaugcugu

SEQ ID NO: 1161278 - RNA, 21 nt, Homo sapiens
gcaggcauggcuggugccuga

SEQ ID NO: 1161279 - RNA, 23 nt, Homo sapiens
gcaggcggagcgagagagggaga

SEQ ID NO: 1161280 - RNA, 22 nt, Homo sapiens
gcaggcuguuuauauguucaca

SEQ ID NO: 1161281 - RNA, 23 nt, Homo sapiens
gcaggcuuaauaaaaaugacaga

SEQ ID NO: 1161282 - RNA, 13 nt, Homo sapiens
gcagggcugagga

SEQ ID NO: 1161283 - RNA, 22 nt, Homo sapiens
gcaggggacaagggaggcagug

SEQ ID NO: 1161284 - RNA, 21 nt, Homo sapiens
ggagaugucugaauacugcag

SEQ ID NO: 1161285 - RNA, 20 nt, Homo sapiens
ggagauuccagucuacuuga

SEQ ID NO: 1161286 - RNA, 15 nt, Homo sapiens
ggagauugaacuuuc

SEQ ID NO: 1161287 - RNA, 19 nt, Homo sapiens
ggagcaagugugcucuccu

SEQ ID NO: 1161288 - RNA, 19 nt, Homo sapiens
ggagcagaguguucccuga

SEQ ID NO: 1161289 - RNA, 16 nt, Homo sapiens
ggagcagaugcaauga

SEQ ID NO: 1161290 - RNA, 22 nt, Homo sapiens
ggagcauuuauguagacauugu

SEQ ID NO: 1161291 - RNA, 14 nt, Homo sapiens
ggagcccgcacugu

SEQ ID NO: 1161292 - RNA, 21 nt, Homo sapiens
ggagccgagggcgucagagag

SEQ ID NO: 1161293 - RNA, 13 nt, Homo sapiens
ggagcuccaacuc

SEQ ID NO: 1161294 - RNA, 11 nt, Homo sapiens
ggagcucucca

SEQ ID NO: 1161295 - RNA, 19 nt, Homo sapiens
ggagcugccugcagcacau

SEQ ID NO: 1161296 - RNA, 11 nt, Homo sapiens
ggagcugcuau

SEQ ID NO: 1161297 - RNA, 16 nt, Homo sapiens
ggagcuuaaacagcug

SEQ ID NO: 1161298 - RNA, 19 nt, Homo sapiens
ggaggagggcucagggagc

SEQ ID NO: 1161299 - RNA, 21 nt, Homo sapiens
ggaggauacugaggcacacag

SEQ ID NO: 1161300 - RNA, 17 nt, Homo sapiens
ggaggcaaauggcacug

SEQ ID NO: 1161301 - RNA, 20 nt, Homo sapiens
ggaggcagagguugcaguga

SEQ ID NO: 1161302 - RNA, 22 nt, Homo sapiens
ggaggccagugaaagcugacau

SEQ ID NO: 1161303 - RNA, 21 nt, Homo sapiens
ggaggcuucucuucugaccca

SEQ ID NO: 1161304 - RNA, 17 nt, Homo sapiens
ggagggacacuuaccca

SEQ ID NO: 1161305 - RNA, 20 nt, Homo sapiens
ggagggacacuuacccaagg

SEQ ID NO: 1161306 - RNA, 13 nt, Homo sapiens
ggagggcaggcau

SEQ ID NO: 1161307 - RNA, 15 nt, Homo sapiens
ggaggggccuuugcu

SEQ ID NO: 1161308 - RNA, 18 nt, Homo sapiens
ggaggguuucucucccaa

SEQ ID NO: 1161309 - RNA, 17 nt, Homo sapiens
ggaggugauuccaguga

SEQ ID NO: 1161310 - RNA, 17 nt, Homo sapiens
ggagguucaaaaguaag

SEQ ID NO: 1161311 - RNA, 22 nt, Homo sapiens
ggagguugcauugagcugagau

SEQ ID NO: 1161312 - RNA, 17 nt, Homo sapiens
ggaguauccucuugcca

SEQ ID NO: 1161313 - RNA, 15 nt, Homo sapiens
ggagucaccaugcaa

SEQ ID NO: 1161314 - RNA, 13 nt, Homo sapiens
ggagucaucucaa

SEQ ID NO: 1161315 - RNA, 16 nt, Homo sapiens
ggagucaugugccucu

SEQ ID NO: 1161316 - RNA, 23 nt, Homo sapiens
ggagucuaagccggcuuuccucu

SEQ ID NO: 1161317 - RNA, 20 nt, Homo sapiens
ggagugcccccaacagcacc

SEQ ID NO: 1161318 - RNA, 18 nt, Homo sapiens
ggaguguaugagugugag

SEQ ID NO: 1161319 - RNA, 19 nt, Homo sapiens
ggaguuacaacagaagcug

SEQ ID NO: 1161320 - RNA, 19 nt, Homo sapiens
ggaguucuuuggcucuauu

SEQ ID NO: 1161321 - RNA, 12 nt, Homo sapiens
ggauaaaagccc

SEQ ID NO: 1161322 - RNA, 17 nt, Homo sapiens
ggauaaccuugugccuu

SEQ ID NO: 1161323 - RNA, 20 nt, Homo sapiens
ggauaaugcuguugccucau

SEQ ID NO: 1161324 - RNA, 20 nt, Homo sapiens
ggauacaauguauaagcuac

SEQ ID NO: 1161325 - RNA, 16 nt, Homo sapiens
ggauaccacuuuucau

SEQ ID NO: 1161326 - RNA, 17 nt, Homo sapiens
ggauacuggugcaguca

SEQ ID NO: 1161327 - RNA, 23 nt, Homo sapiens
ggauagugggcaccccacugcaa

SEQ ID NO: 1161328 - RNA, 14 nt, Homo sapiens
ggauaucaaaagca

SEQ ID NO: 1161329 - RNA, 17 nt, Homo sapiens
ggauaucaaaagcaaau

SEQ ID NO: 1161330 - RNA, 19 nt, Homo sapiens
ggauauccucccuccagau

SEQ ID NO: 1161331 - RNA, 19 nt, Homo sapiens
ggauauucgguaauaucau

SEQ ID NO: 1161332 - RNA, 16 nt, Homo sapiens
ggaucccaucaaagaa

SEQ ID NO: 1161333 - RNA, 13 nt, Homo sapiens
ggaucuaccagca

SEQ ID NO: 1161334 - RNA, 21 nt, Homo sapiens
ggaucuguaaggaacuggaac

SEQ ID NO: 1161335 - RNA, 13 nt, Homo sapiens
ggaugauguuucg

SEQ ID NO: 1161336 - RNA, 23 nt, Homo sapiens
ggaugccgagguaaaaguucuuu

SEQ ID NO: 1161337 - RNA, 16 nt, Homo sapiens
ggaugcggccauucaa

SEQ ID NO: 1161338 - RNA, 17 nt, Homo sapiens
ggaugcuaaaaauguca

SEQ ID NO: 1161339 - RNA, 20 nt, Homo sapiens
ggaugcuauuucagccaauc

SEQ ID NO: 1161340 - RNA, 13 nt, Homo sapiens
ggaugcugugccu

SEQ ID NO: 1161341 - RNA, 21 nt, Homo sapiens
ggauggcgaggccucucucag

SEQ ID NO: 1161342 - RNA, 16 nt, Homo sapiens
ggaugggaaacugcuc

SEQ ID NO: 1161343 - RNA, 21 nt, Homo sapiens
ggauguacgacauuuugugac

SEQ ID NO: 1161344 - RNA, 22 nt, Homo sapiens
ggauguugaagugagcugagau

SEQ ID NO: 1161345 - RNA, 14 nt, Homo sapiens
ggauuaauuugcau

SEQ ID NO: 1161346 - RNA, 19 nt, Homo sapiens
ggauuacaggugugcacca

SEQ ID NO: 1161347 - RNA, 21 nt, Homo sapiens
ggauuagccgucccagugaaa

SEQ ID NO: 1161348 - RNA, 23 nt, Homo sapiens
ggauucagagaaaggcaagggag

SEQ ID NO: 1161349 - RNA, 12 nt, Homo sapiens
ggauuccauuua

SEQ ID NO: 1161350 - RNA, 22 nt, Homo sapiens
ggauucuagccugcacuuuggg

SEQ ID NO: 1161351 - RNA, 20 nt, Homo sapiens
ggauuguuguuuaacuugua

SEQ ID NO: 1161352 - RNA, 15 nt, Homo sapiens
ggauuuucacauucu

SEQ ID NO: 1161353 - RNA, 17 nt, Homo sapiens
ggcaaaauaaagugaca

SEQ ID NO: 1161354 - RNA, 23 nt, Homo sapiens
ggcaaaggaaauugucaucugcc

SEQ ID NO: 1161355 - RNA, 19 nt, Homo sapiens
ggcaacagagcaagacucc

SEQ ID NO: 1161356 - RNA, 12 nt, Homo sapiens
ggcaacaucaac

SEQ ID NO: 1161357 - RNA, 18 nt, Homo sapiens
ggcaacaucagcaucacu

SEQ ID NO: 1161358 - RNA, 19 nt, Homo sapiens
ggcaacauucauugccaag

SEQ ID NO: 1161359 - RNA, 18 nt, Homo sapiens
ggcaacuggaugggagac

SEQ ID NO: 1161360 - RNA, 16 nt, Homo sapiens
ggcaaggaugcauaca

SEQ ID NO: 1161361 - RNA, 17 nt, Homo sapiens
ggcacauuccccuugcc

SEQ ID NO: 1161362 - RNA, 14 nt, Homo sapiens
ggcacccacccugg

SEQ ID NO: 1161363 - RNA, 21 nt, Homo sapiens
ggcaccuccuacgucaaacau

SEQ ID NO: 1161364 - RNA, 19 nt, Homo sapiens
ggcaccugguaugugccag

SEQ ID NO: 1161365 - RNA, 17 nt, Homo sapiens
ggcaccuguaguccuag

SEQ ID NO: 1161366 - RNA, 10 nt, Homo sapiens
ggcacugggc

SEQ ID NO: 1161367 - RNA, 21 nt, Homo sapiens
ggcacuguaguucuaagacuc

SEQ ID NO: 1161368 - RNA, 15 nt, Homo sapiens
ggcagaaaagcacau

SEQ ID NO: 1161369 - RNA, 22 nt, Homo sapiens
ggcagaagaauugaacccagga

SEQ ID NO: 1161370 - RNA, 20 nt, Homo sapiens
ggcagaccugacucucuuaa

SEQ ID NO: 1161371 - RNA, 22 nt, Homo sapiens
ggcagagccaccugacucuugc

SEQ ID NO: 1161372 - RNA, 17 nt, Homo sapiens
ggcagagguuguaguga

SEQ ID NO: 1161373 - RNA, 19 nt, Homo sapiens
ggcagaguucuauaaugua

SEQ ID NO: 1161374 - RNA, 18 nt, Homo sapiens
ggcagauggccacugcuc

SEQ ID NO: 1161375 - RNA, 18 nt, Homo sapiens
ggcagcauccccuugaac

SEQ ID NO: 1161376 - RNA, 19 nt, Homo sapiens
ggcagcggggcaagcaaaa

SEQ ID NO: 1161377 - RNA, 16 nt, Homo sapiens
ggcagcuccacagggc

SEQ ID NO: 1161378 - RNA, 18 nt, Homo sapiens
ggcaggacacacauggug

SEQ ID NO: 1161379 - RNA, 19 nt, Homo sapiens
ggcaggaccgccauggugc

SEQ ID NO: 1161380 - RNA, 18 nt, Homo sapiens
ggcaggagucaccaugca

SEQ ID NO: 1161381 - RNA, 13 nt, Homo sapiens
ggcaggauccaag

SEQ ID NO: 1161382 - RNA, 16 nt, Homo sapiens
ggcaggccagggcagu

SEQ ID NO: 1161383 - RNA, 15 nt, Homo sapiens
ggcaguuuagugcau

SEQ ID NO: 1161384 - RNA, 22 nt, Homo sapiens
ggcaguuuggcaaacucuccac

SEQ ID NO: 1161385 - RNA, 13 nt, Homo sapiens
ggcauaccaaaau

SEQ ID NO: 1161386 - RNA, 13 nt, Homo sapiens
ggcaucacugggu

SEQ ID NO: 1161387 - RNA, 21 nt, Homo sapiens
ggcaucaugcagaguugacau

SEQ ID NO: 1161388 - RNA, 18 nt, Homo sapiens
ggcaucucccacacaaga

SEQ ID NO: 1161389 - RNA, 12 nt, Homo sapiens
ggcaucugugug

SEQ ID NO: 1161390 - RNA, 16 nt, Homo sapiens
ggcaugagacucagug

SEQ ID NO: 1161391 - RNA, 20 nt, Homo sapiens
ggcaugagccacugugcuug

SEQ ID NO: 1161392 - RNA, 16 nt, Homo sapiens
ggcaugcagcuaccca

SEQ ID NO: 1161393 - RNA, 16 nt, Homo sapiens
ggcaugggucgggaga

SEQ ID NO: 1161394 - RNA, 20 nt, Homo sapiens
ggcauucuuugcaauacugc

SEQ ID NO: 1161395 - RNA, 17 nt, Homo sapiens
ggcauuuguuuccucau

SEQ ID NO: 1161396 - RNA, 15 nt, Homo sapiens
ggccaaaccucuguu

SEQ ID NO: 1161397 - RNA, 12 nt, Homo sapiens
ggccaacaaaga

SEQ ID NO: 1161398 - RNA, 17 nt, Homo sapiens
ggccacacugugacaca

SEQ ID NO: 1161399 - RNA, 14 nt, Homo sapiens
ggccacauuuucag

SEQ ID NO: 1161400 - RNA, 14 nt, Homo sapiens
ggccacccaaacag

SEQ ID NO: 1161401 - RNA, 14 nt, Homo sapiens
ggccaccucucagg

SEQ ID NO: 1161402 - RNA, 23 nt, Homo sapiens
ggccacugcugcuucuccauggc

SEQ ID NO: 1161403 - RNA, 19 nt, Homo sapiens
ggccacuguuugucucacc

SEQ ID NO: 1161404 - RNA, 18 nt, Homo sapiens
ggccacuuuccagggugg

SEQ ID NO: 1161405 - RNA, 19 nt, Homo sapiens
ggccagagccgggguucca

SEQ ID NO: 1161406 - RNA, 19 nt, Homo sapiens
ggccagcauacuccgugag

SEQ ID NO: 1161407 - RNA, 13 nt, Homo sapiens
ggccagccaguga

SEQ ID NO: 1161408 - RNA, 12 nt, Homo sapiens
ggccagcccgga

SEQ ID NO: 1161409 - RNA, 19 nt, Homo sapiens
ggccaggaagaauggugug

SEQ ID NO: 1161410 - RNA, 23 nt, Homo sapiens
ggccaggaaggacagacuggccg

SEQ ID NO: 1161411 - RNA, 20 nt, Homo sapiens
ggccaggcuggucuugaacu

SEQ ID NO: 1161412 - RNA, 18 nt, Homo sapiens
ggccagggacccaaagca

SEQ ID NO: 1161413 - RNA, 16 nt, Homo sapiens
ggccagggcuggguca

SEQ ID NO: 1161414 - RNA, 22 nt, Homo sapiens
ggccagguagcagcaaauagca

SEQ ID NO: 1161415 - RNA, 22 nt, Homo sapiens
ggccagguaugcauggaaaaug

SEQ ID NO: 1161416 - RNA, 23 nt, Homo sapiens
ggccaguauaaagggacuugaag

SEQ ID NO: 1161417 - RNA, 16 nt, Homo sapiens
ggccagugagccacuc

SEQ ID NO: 1161418 - RNA, 12 nt, Homo sapiens
ggccaucacuca

SEQ ID NO: 1161419 - RNA, 21 nt, Homo sapiens
ggccauucuuuuuuucuuggc

SEQ ID NO: 1161420 - RNA, 12 nt, Homo sapiens
ggcccaaagccu

SEQ ID NO: 1161421 - RNA, 18 nt, Homo sapiens
ggcccaaccagacuucuc

SEQ ID NO: 1161422 - RNA, 22 nt, Homo sapiens
ggcccagggugccugcacuuug

SEQ ID NO: 1161423 - RNA, 23 nt, Homo sapiens
ggcccccaccgccgggguccugg

SEQ ID NO: 1161424 - RNA, 16 nt, Homo sapiens
ggccccucaccuggua

SEQ ID NO: 1161425 - RNA, 22 nt, Homo sapiens
ggccccucuccuccguggcaca

SEQ ID NO: 1161426 - RNA, 23 nt, Homo sapiens
ggccccucuccuccguggcacau

SEQ ID NO: 1161427 - RNA, 14 nt, Homo sapiens
ggccccucugcaac

SEQ ID NO: 1161428 - RNA, 20 nt, Homo sapiens
ggcccucacucuugaagucc

SEQ ID NO: 1161429 - RNA, 14 nt, Homo sapiens
ggcccuccaugaca

SEQ ID NO: 1161430 - RNA, 20 nt, Homo sapiens
ggcccugcgucaggcagugu

SEQ ID NO: 1161431 - RNA, 22 nt, Homo sapiens
ggcccugggucuugccaugugc

SEQ ID NO: 1161432 - RNA, 20 nt, Homo sapiens
ggcccugguuccugcugucc

SEQ ID NO: 1161433 - RNA, 23 nt, Homo sapiens
ggccgggcaggcgugacucagca

SEQ ID NO: 1161434 - RNA, 14 nt, Homo sapiens
ggccuacagcuuug

SEQ ID NO: 1161435 - RNA, 16 nt, Homo sapiens
ggccuauguugaucca

SEQ ID NO: 1161436 - RNA, 20 nt, Homo sapiens
ggccucccaaaugagccaug

SEQ ID NO: 1161437 - RNA, 22 nt, Homo sapiens
ggccucccagagugcugggauu

SEQ ID NO: 1161438 - RNA, 15 nt, Homo sapiens
ggccuccgaugccug

SEQ ID NO: 1161439 - RNA, 22 nt, Homo sapiens
ggccuccuaaagugcugggauu

SEQ ID NO: 1161440 - RNA, 11 nt, Homo sapiens
ggccucuccac

SEQ ID NO: 1161441 - RNA, 14 nt, Homo sapiens
ggccucucucagga

SEQ ID NO: 1161442 - RNA, 19 nt, Homo sapiens
ggccucucuguacacugcc

SEQ ID NO: 1161443 - RNA, 17 nt, Homo sapiens
ggccugccuucucaggg

SEQ ID NO: 1161444 - RNA, 18 nt, Homo sapiens
ggccugccuucucaggga

SEQ ID NO: 1161445 - RNA, 15 nt, Homo sapiens
ggccuggcagcucag

SEQ ID NO: 1161446 - RNA, 14 nt, Homo sapiens
ggccuguccuccaa

SEQ ID NO: 1161447 - RNA, 16 nt, Homo sapiens
ggccuuggccaagcug

SEQ ID NO: 1161448 - RNA, 18 nt, Homo sapiens
ggccuugguaugugccag

SEQ ID NO: 1161449 - RNA, 18 nt, Homo sapiens
ggccuuucccucuucccu

SEQ ID NO: 1161450 - RNA, 21 nt, Homo sapiens
ggcgaaauccugucuguacua

SEQ ID NO: 1161451 - RNA, 16 nt, Homo sapiens
ggcgagccugacucug

SEQ ID NO: 1161452 - RNA, 18 nt, Homo sapiens
ggcgcaaagggcaugggu

SEQ ID NO: 1161453 - RNA, 17 nt, Homo sapiens
ggcgccaucgccaagua

SEQ ID NO: 1161454 - RNA, 17 nt, Homo sapiens
ggcgcucucccuaccuu

SEQ ID NO: 1161455 - RNA, 15 nt, Homo sapiens
ggcggaucacuugag

SEQ ID NO: 1161456 - RNA, 22 nt, Homo sapiens
ggcggaucuuuggacagaagca

SEQ ID NO: 1161457 - RNA, 21 nt, Homo sapiens
gggucucucacuguugcagug

SEQ ID NO: 1161458 - RNA, 23 nt, Homo sapiens
gggucugggaaaugagcagggau

SEQ ID NO: 1161459 - RNA, 20 nt, Homo sapiens
gggucuugcuauauugccca

SEQ ID NO: 1161460 - RNA, 21 nt, Homo sapiens
gggucuugcuauauugcccag

SEQ ID NO: 1161461 - RNA, 20 nt, Homo sapiens
gggucuuugugagagugagc

SEQ ID NO: 1161462 - RNA, 21 nt, Homo sapiens
gggugacagagcgagacucca

SEQ ID NO: 1161463 - RNA, 21 nt, Homo sapiens
gggugaccaccgauuccagcu

SEQ ID NO: 1161464 - RNA, 22 nt, Homo sapiens
gggugcucccuaccaccucccc

SEQ ID NO: 1161465 - RNA, 11 nt, Homo sapiens
ggguggcugca

SEQ ID NO: 1161466 - RNA, 13 nt, Homo sapiens
ggguguguguaug

SEQ ID NO: 1161467 - RNA, 14 nt, Homo sapiens
ggguucaagugauu

SEQ ID NO: 1161468 - RNA, 21 nt, Homo sapiens
ggguuccccaaccaaagacgg

SEQ ID NO: 1161469 - RNA, 22 nt, Homo sapiens
ggguuccuuuuucaacuuggaa

SEQ ID NO: 1161470 - RNA, 12 nt, Homo sapiens
ggguuugagggu

SEQ ID NO: 1161471 - RNA, 21 nt, Homo sapiens
ggguuuugcuuuagagugcaa

SEQ ID NO: 1161472 - RNA, 21 nt, Homo sapiens
gguaaaaugccaugaugccuc

SEQ ID NO: 1161473 - RNA, 15 nt, Homo sapiens
gguaaugugaauaaa

SEQ ID NO: 1161474 - RNA, 13 nt, Homo sapiens
gguaauuugccac

SEQ ID NO: 1161475 - RNA, 14 nt, Homo sapiens
gguacagguauauu

SEQ ID NO: 1161476 - RNA, 11 nt, Homo sapiens
gguacauuucu

SEQ ID NO: 1161477 - RNA, 12 nt, Homo sapiens
gguacuaugcag

SEQ ID NO: 1161478 - RNA, 20 nt, Homo sapiens
gguagccagcacacagggca

SEQ ID NO: 1161479 - RNA, 22 nt, Homo sapiens
gguagccagcacacagggcagu

SEQ ID NO: 1161480 - RNA, 15 nt, Homo sapiens
gguagccuccuaucc

SEQ ID NO: 1161481 - RNA, 19 nt, Homo sapiens
gguagcugggauuacaggc

SEQ ID NO: 1161482 - RNA, 13 nt, Homo sapiens
gguaguuuugcca

SEQ ID NO: 1161483 - RNA, 16 nt, Homo sapiens
gguauaaagcucucaa

SEQ ID NO: 1161484 - RNA, 18 nt, Homo sapiens
gguauaguucaugucugc

SEQ ID NO: 1161485 - RNA, 18 nt, Homo sapiens
gguauuuuuuacugcuug

SEQ ID NO: 1161486 - RNA, 13 nt, Homo sapiens
ggucacacucuca

SEQ ID NO: 1161487 - RNA, 17 nt, Homo sapiens
ggucaccccuccaggaa

SEQ ID NO: 1161488 - RNA, 21 nt, Homo sapiens
ggucagaaacaggaccgggug

SEQ ID NO: 1161489 - RNA, 19 nt, Homo sapiens
ggucaggaguucgagacca

SEQ ID NO: 1161490 - RNA, 15 nt, Homo sapiens
ggucaggcagggugc

SEQ ID NO: 1161491 - RNA, 16 nt, Homo sapiens
ggucaggggugacaca

SEQ ID NO: 1161492 - RNA, 13 nt, Homo sapiens
gguccaugucuau

SEQ ID NO: 1161493 - RNA, 14 nt, Homo sapiens
gguccauuuugccu

SEQ ID NO: 1161494 - RNA, 20 nt, Homo sapiens
ggucccggggccagcacuuc

SEQ ID NO: 1161495 - RNA, 19 nt, Homo sapiens
gguccucugucagucacag

SEQ ID NO: 1161496 - RNA, 17 nt, Homo sapiens
gguccugaaaguaacuc

SEQ ID NO: 1161497 - RNA, 22 nt, Homo sapiens
gguccuucuugaauucauguac

SEQ ID NO: 1161498 - RNA, 15 nt, Homo sapiens
gguccuuuucagagu

SEQ ID NO: 1161499 - RNA, 21 nt, Homo sapiens
ggucgucgaaaggugcagcug

SEQ ID NO: 1161500 - RNA, 23 nt, Homo sapiens
ggucuagacuauuaggugcaauu

SEQ ID NO: 1161501 - RNA, 21 nt, Homo sapiens
ggucuccaagggcaucacugg

SEQ ID NO: 1161502 - RNA, 14 nt, Homo sapiens
ggucucccaaacgc

SEQ ID NO: 1161503 - RNA, 17 nt, Homo sapiens
ggucucccaauacaggc

SEQ ID NO: 1161504 - RNA, 20 nt, Homo sapiens
ggucuccuggaccuugacag

SEQ ID NO: 1161505 - RNA, 20 nt, Homo sapiens
ggucucgaacuccugaccuc

SEQ ID NO: 1161506 - RNA, 19 nt, Homo sapiens
ggucucuucuuggggccca

SEQ ID NO: 1161507 - RNA, 22 nt, Homo sapiens
ggucugggaaaugagcagggau

SEQ ID NO: 1161508 - RNA, 18 nt, Homo sapiens
ggucuuacuuugugcaaa

SEQ ID NO: 1161509 - RNA, 21 nt, Homo sapiens
ggucuuagcucuuucucuauu

SEQ ID NO: 1161510 - RNA, 17 nt, Homo sapiens
ggucuuucaaaaagcau

SEQ ID NO: 1161511 - RNA, 18 nt, Homo sapiens
ggugaaaaccccaucucu

SEQ ID NO: 1161512 - RNA, 13 nt, Homo sapiens
ggugaaacccagu

SEQ ID NO: 1161513 - RNA, 22 nt, Homo sapiens
ggugaaacccagucacugugag

SEQ ID NO: 1161514 - RNA, 18 nt, Homo sapiens
ggugaaacccccaucucu

SEQ ID NO: 1161515 - RNA, 20 nt, Homo sapiens
ggugaacaagcaaacccaga

SEQ ID NO: 1161516 - RNA, 21 nt, Homo sapiens
ggugaccaccgauuccagcug

SEQ ID NO: 1161517 - RNA, 15 nt, Homo sapiens
ggugacccaaugauu

SEQ ID NO: 1161518 - RNA, 16 nt, Homo sapiens
ggugacuucaggugga

SEQ ID NO: 1161519 - RNA, 17 nt, Homo sapiens
ggugagagugcagaaag

SEQ ID NO: 1161520 - RNA, 15 nt, Homo sapiens
ggugagaugcagcug

SEQ ID NO: 1161521 - RNA, 22 nt, Homo sapiens
ggugauuacauaaucuguacaa

SEQ ID NO: 1161522 - RNA, 19 nt, Homo sapiens
ggugauuucuagaaugguu

SEQ ID NO: 1161523 - RNA, 17 nt, Homo sapiens
ggugcaaucacagcuca

SEQ ID NO: 1161524 - RNA, 23 nt, Homo sapiens
ggugcacagggcuagaacgagag

SEQ ID NO: 1161525 - RNA, 12 nt, Homo sapiens
ggugccugcacu

SEQ ID NO: 1161526 - RNA, 15 nt, Homo sapiens
ggugcuauccauuuc

SEQ ID NO: 1161527 - RNA, 15 nt, Homo sapiens
ggugcugcagcaccg

SEQ ID NO: 1161528 - RNA, 15 nt, Homo sapiens
ggugcugccccauga

SEQ ID NO: 1161529 - RNA, 20 nt, Homo sapiens
ggugcuggggagccaaaggc

SEQ ID NO: 1161530 - RNA, 15 nt, Homo sapiens
gguggaacaagcaca

SEQ ID NO: 1161531 - RNA, 19 nt, Homo sapiens
gguggaagagcucaaggga

SEQ ID NO: 1161532 - RNA, 24 nt, Homo sapiens
gguggauaaagauggauggcuguu

SEQ ID NO: 1161533 - RNA, 21 nt, Homo sapiens
gguggcuauaaauuucuuacu

SEQ ID NO: 1161534 - RNA, 15 nt, Homo sapiens
ggugggagaugugga

SEQ ID NO: 1161535 - RNA, 15 nt, Homo sapiens
gguggggugcacucg

SEQ ID NO: 1161536 - RNA, 15 nt, Homo sapiens
gguggguggugggcu

SEQ ID NO: 1161537 - RNA, 22 nt, Homo sapiens
ggugugcaaacuuguaucugaa

SEQ ID NO: 1161538 - RNA, 20 nt, Homo sapiens
ggugugugccacucagagac

SEQ ID NO: 1161539 - RNA, 12 nt, Homo sapiens
gguguguuacac

SEQ ID NO: 1161540 - RNA, 22 nt, Homo sapiens
gguguuaaucauuucauuuuua

SEQ ID NO: 1161541 - RNA, 19 nt, Homo sapiens
gguguuuauaagcagguaa

SEQ ID NO: 1161542 - RNA, 17 nt, Homo sapiens
gguuaaacaaaccagaa

SEQ ID NO: 1161543 - RNA, 19 nt, Homo sapiens
gguuaaaggaaaagcacaa

SEQ ID NO: 1161544 - RNA, 24 nt, Homo sapiens
gguuaguagcccuucagucuuaau

SEQ ID NO: 1161545 - RNA, 16 nt, Homo sapiens
gguuauguaucagaag

SEQ ID NO: 1161546 - RNA, 17 nt, Homo sapiens
gguuauuuaggucuuau

SEQ ID NO: 1161547 - RNA, 14 nt, Homo sapiens
gguucaacuuauua

SEQ ID NO: 1161548 - RNA, 23 nt, Homo sapiens
gguucaagcaauccuccuaccuc

SEQ ID NO: 1161549 - RNA, 22 nt, Homo sapiens
gguuccuuuuucaacuuggaaa

SEQ ID NO: 1161550 - RNA, 18 nt, Homo sapiens
gguucuggaaacauucag

SEQ ID NO: 1161551 - RNA, 20 nt, Homo sapiens
gguucugugugagugcucug

SEQ ID NO: 1161552 - RNA, 19 nt, Homo sapiens
gguucuuagucucagcacu

SEQ ID NO: 1161553 - RNA, 16 nt, Homo sapiens
gguucuuugcugcauu

SEQ ID NO: 1161554 - RNA, 22 nt, Homo sapiens
gucuccuacucuguguaaauau

SEQ ID NO: 1161555 - RNA, 16 nt, Homo sapiens
gucuccucucuuggca

SEQ ID NO: 1161556 - RNA, 16 nt, Homo sapiens
gucuccucugcagcuc

SEQ ID NO: 1161557 - RNA, 21 nt, Homo sapiens
gucuccucugcagcucaggga

SEQ ID NO: 1161558 - RNA, 21 nt, Homo sapiens
gucucgaacuccugaccucaa

SEQ ID NO: 1161559 - RNA, 21 nt, Homo sapiens
gucucgaacuccuggccucaa

SEQ ID NO: 1161560 - RNA, 17 nt, Homo sapiens
gucucuacccaguagau

SEQ ID NO: 1161561 - RNA, 18 nt, Homo sapiens
gucucucuuuggcuggaa

SEQ ID NO: 1161562 - RNA, 20 nt, Homo sapiens
gucucugacaaagugugucu

SEQ ID NO: 1161563 - RNA, 18 nt, Homo sapiens
gucucugcuaaaccacca

SEQ ID NO: 1161564 - RNA, 15 nt, Homo sapiens
gucucuggcauuugu

SEQ ID NO: 1161565 - RNA, 23 nt, Homo sapiens
gucucuucuuuagaacagggaaa

SEQ ID NO: 1161566 - RNA, 20 nt, Homo sapiens
gucucuuuauauggccucaa

SEQ ID NO: 1161567 - RNA, 19 nt, Homo sapiens
gucugagagcaaagugacc

SEQ ID NO: 1161568 - RNA, 16 nt, Homo sapiens
gucugaucguucaaag

SEQ ID NO: 1161569 - RNA, 15 nt, Homo sapiens
gucuggcaucuccca

SEQ ID NO: 1161570 - RNA, 16 nt, Homo sapiens
gucugggcacagucag

SEQ ID NO: 1161571 - RNA, 19 nt, Homo sapiens
gucuguccauuaucuauau

SEQ ID NO: 1161572 - RNA, 21 nt, Homo sapiens
gucugugugcgcucuguggau

SEQ ID NO: 1161573 - RNA, 16 nt, Homo sapiens
gucuguuacacuggag

SEQ ID NO: 1161574 - RNA, 15 nt, Homo sapiens
gucuguucacugcau

SEQ ID NO: 1161575 - RNA, 18 nt, Homo sapiens
gucuguugcugcuccaug

SEQ ID NO: 1161576 - RNA, 19 nt, Homo sapiens
gucuguuuggacugcagaa

SEQ ID NO: 1161577 - RNA, 15 nt, Homo sapiens
gucuguuuguuguau

SEQ ID NO: 1161578 - RNA, 17 nt, Homo sapiens
gucuuacuuugugcaaa

SEQ ID NO: 1161579 - RNA, 17 nt, Homo sapiens
gucuugaacuccugacg

SEQ ID NO: 1161580 - RNA, 12 nt, Homo sapiens
gucuuggcucac

SEQ ID NO: 1161581 - RNA, 22 nt, Homo sapiens
gucuuggcucacugcaacuucu

SEQ ID NO: 1161582 - RNA, 16 nt, Homo sapiens
gucuuuacuccucaca

SEQ ID NO: 1161583 - RNA, 14 nt, Homo sapiens
guguaaaauguaau

SEQ ID NO: 1161584 - RNA, 23 nt, Homo sapiens
guguaaugugacuucaugcuaua

SEQ ID NO: 1161585 - RNA, 13 nt, Homo sapiens
guguacacucaga

SEQ ID NO: 1161586 - RNA, 14 nt, Homo sapiens
guguacauuucuau

SEQ ID NO: 1161587 - RNA, 19 nt, Homo sapiens
guguagggguguguguaug

SEQ ID NO: 1161588 - RNA, 18 nt, Homo sapiens
guguauggguuaaaucaa

SEQ ID NO: 1161589 - RNA, 18 nt, Homo sapiens
gugucaacuuucauuuga

SEQ ID NO: 1161590 - RNA, 13 nt, Homo sapiens
gugucaccccaga

SEQ ID NO: 1161591 - RNA, 23 nt, Homo sapiens
gugucaccccucacugugacuga

SEQ ID NO: 1161592 - RNA, 22 nt, Homo sapiens
gugucacucaaggcggugcuug

SEQ ID NO: 1161593 - RNA, 18 nt, Homo sapiens
gugucagagcccagggga

SEQ ID NO: 1161594 - RNA, 13 nt, Homo sapiens
gugucugucagac

SEQ ID NO: 1161595 - RNA, 13 nt, Homo sapiens
gugucuuuugaca

SEQ ID NO: 1161596 - RNA, 17 nt, Homo sapiens
gugugaacaaauggaaa

SEQ ID NO: 1161597 - RNA, 13 nt, Homo sapiens
gugugagugcaug

SEQ ID NO: 1161598 - RNA, 17 nt, Homo sapiens
gugugcauagcguccug

SEQ ID NO: 1161599 - RNA, 14 nt, Homo sapiens
guguggagacuuga

SEQ ID NO: 1161600 - RNA, 15 nt, Homo sapiens
guguggcagccacac

SEQ ID NO: 1161601 - RNA, 17 nt, Homo sapiens
guguggucaacgaauac

SEQ ID NO: 1161602 - RNA, 20 nt, Homo sapiens
guguguaugugugugcaugu

SEQ ID NO: 1161603 - RNA, 12 nt, Homo sapiens
guguguccaaaa

SEQ ID NO: 1161604 - RNA, 14 nt, Homo sapiens
gugugugugcacau

SEQ ID NO: 1161605 - RNA, 14 nt, Homo sapiens
guguuaaaugugau

SEQ ID NO: 1161606 - RNA, 13 nt, Homo sapiens
guguuacuugcca

SEQ ID NO: 1161607 - RNA, 12 nt, Homo sapiens
guguucaaacac

SEQ ID NO: 1161608 - RNA, 14 nt, Homo sapiens
guguucaacuguga

SEQ ID NO: 1161609 - RNA, 22 nt, Homo sapiens
guguucaacugugaguuucauc

SEQ ID NO: 1161610 - RNA, 18 nt, Homo sapiens
guguucauaucuacucuu

SEQ ID NO: 1161611 - RNA, 18 nt, Homo sapiens
guguucauccagcuacuu

SEQ ID NO: 1161612 - RNA, 16 nt, Homo sapiens
guguuccccacuguau

SEQ ID NO: 1161613 - RNA, 16 nt, Homo sapiens
guguuccuucugugaa

SEQ ID NO: 1161614 - RNA, 14 nt, Homo sapiens
guguucucuggcuc

SEQ ID NO: 1161615 - RNA, 18 nt, Homo sapiens
guguugccucuugcaaug

SEQ ID NO: 1161616 - RNA, 23 nt, Homo sapiens
guguugucucauagaacugccug

SEQ ID NO: 1161617 - RNA, 22 nt, Homo sapiens
guguuuucaucauuucagccaa

SEQ ID NO: 1161618 - RNA, 12 nt, Homo sapiens
guguuuugccau

SEQ ID NO: 1161619 - RNA, 17 nt, Homo sapiens
guguuuuuaguugcuca

SEQ ID NO: 1161620 - RNA, 19 nt, Homo sapiens
guguuuuuuccccauugua

SEQ ID NO: 1161621 - RNA, 17 nt, Homo sapiens
guuaaacauugaaguaa

SEQ ID NO: 1161622 - RNA, 22 nt, Homo sapiens
guuaaacuaaggcccucuugaa

SEQ ID NO: 1161623 - RNA, 21 nt, Homo sapiens
guuaaacucgcucacugcuaa

SEQ ID NO: 1161624 - RNA, 14 nt, Homo sapiens
guuaacaugacauu

SEQ ID NO: 1161625 - RNA, 15 nt, Homo sapiens
guuaagaaagcacuu

SEQ ID NO: 1161626 - RNA, 13 nt, Homo sapiens
guuaauaaagaag

SEQ ID NO: 1161627 - RNA, 23 nt, Homo sapiens
guuaaucauauuugaaaaccaua

SEQ ID NO: 1161628 - RNA, 13 nt, Homo sapiens
guuaauccaguga

SEQ ID NO: 1161629 - RNA, 17 nt, Homo sapiens
guuaauguuauaucaua

SEQ ID NO: 1161630 - RNA, 14 nt, Homo sapiens
guuacaaguuuaua

SEQ ID NO: 1161631 - RNA, 14 nt, Homo sapiens
guuacacauaacuu

SEQ ID NO: 1161632 - RNA, 12 nt, Homo sapiens
guuacacuggag

SEQ ID NO: 1161633 - RNA, 16 nt, Homo sapiens
guuacagcacaaaaug

SEQ ID NO: 1161634 - RNA, 15 nt, Homo sapiens
guuacaucugugcag

SEQ ID NO: 1161635 - RNA, 22 nt, Homo sapiens
guuaccugaaaacacugugcac

SEQ ID NO: 1161636 - RNA, 18 nt, Homo sapiens
guuaccugaucaaugaca

SEQ ID NO: 1161637 - RNA, 15 nt, Homo sapiens
guuaccugucuugcu

SEQ ID NO: 1161638 - RNA, 17 nt, Homo sapiens
guuacucccuacacuga

SEQ ID NO: 1161639 - RNA, 15 nt, Homo sapiens
guuagagaaaaaugc

SEQ ID NO: 1161640 - RNA, 22 nt, Homo sapiens
guuagcaccauuaacuccuccu

SEQ ID NO: 1161641 - RNA, 17 nt, Homo sapiens
guuaggccaacugccuc

SEQ ID NO: 1161642 - RNA, 14 nt, Homo sapiens
guuaguagcccuuc

SEQ ID NO: 1161643 - RNA, 14 nt, Homo sapiens
guuaguuccuucau

SEQ ID NO: 1161644 - RNA, 13 nt, Homo sapiens
guuauaacgcaag

SEQ ID NO: 1161645 - RNA, 12 nt, Homo sapiens
guuauaaugugu

SEQ ID NO: 1161646 - RNA, 16 nt, Homo sapiens
guuauacaucaauaug

SEQ ID NO: 1161647 - RNA, 20 nt, Homo sapiens
guuauaguaacaucaaagau

SEQ ID NO: 1161648 - RNA, 17 nt, Homo sapiens
guuauaucauauguaua

SEQ ID NO: 1161649 - RNA, 18 nt, Homo sapiens
guuauaucauauguauau

SEQ ID NO: 1161650 - RNA, 16 nt, Homo sapiens
guuauccugugcuaca

SEQ ID NO: 1161651 - RNA, 13 nt, Homo sapiens
guuaugaacaaag

SEQ ID NO: 1161652 - RNA, 22 nt, Homo sapiens
guuaugacugcguaggcaagaa

SEQ ID NO: 1161653 - RNA, 14 nt, Homo sapiens
guuaugguguuucu

SEQ ID NO: 1161654 - RNA, 14 nt, Homo sapiens
guuauuacuuguaa

SEQ ID NO: 1161655 - RNA, 16 nt, Homo sapiens
guuauucuucaaacac

SEQ ID NO: 1161656 - RNA, 14 nt, Homo sapiens
guuauugccucuac

SEQ ID NO: 1161657 - RNA, 18 nt, Homo sapiens
guucaacaucacugaaac

SEQ ID NO: 1161658 - RNA, 16 nt, Homo sapiens
guucaagaggcgugug

SEQ ID NO: 1161659 - RNA, 23 nt, Homo sapiens
guucaagcaauccuccuaccuca

SEQ ID NO: 1161660 - RNA, 14 nt, Homo sapiens
guucaccugaauca

SEQ ID NO: 1161661 - RNA, 20 nt, Homo sapiens
guucaccuguguacugagua

SEQ ID NO: 1161662 - RNA, 13 nt, Homo sapiens
guucacugcagua

SEQ ID NO: 1161663 - RNA, 20 nt, Homo sapiens
guucacuuaaaagcuggcuu

SEQ ID NO: 1161664 - RNA, 12 nt, Homo sapiens
guucagugccac

SEQ ID NO: 1161665 - RNA, 15 nt, Homo sapiens
guucauaacugcuac

SEQ ID NO: 1161666 - RNA, 16 nt, Homo sapiens
guucauccaucaucug

SEQ ID NO: 1161667 - RNA, 21 nt, Homo sapiens
guucaucccggcccauguuga

SEQ ID NO: 1161668 - RNA, 17 nt, Homo sapiens
guuccaaugucaaugug

SEQ ID NO: 1161669 - RNA, 17 nt, Homo sapiens
guuccacuugguucagg

SEQ ID NO: 1161670 - RNA, 20 nt, Homo sapiens
guuccagcaaacaaaaugga

SEQ ID NO: 1161671 - RNA, 15 nt, Homo sapiens
guuccagcaccacac

SEQ ID NO: 1161672 - RNA, 23 nt, Homo sapiens
guucccacaccccaacacuucca

SEQ ID NO: 1161673 - RNA, 21 nt, Homo sapiens
guuccccuaguucuacaugaa

SEQ ID NO: 1161674 - RNA, 23 nt, Homo sapiens
guucccgugacgaggcucaaaaa

SEQ ID NO: 1161675 - RNA, 16 nt, Homo sapiens
guucccucuugcucag

SEQ ID NO: 1161676 - RNA, 14 nt, Homo sapiens
guuccuagccaccg

SEQ ID NO: 1161677 - RNA, 16 nt, Homo sapiens
guuccuuacugcagaa

SEQ ID NO: 1161678 - RNA, 20 nt, Homo sapiens
guuccuuacuuuacugccug

SEQ ID NO: 1161679 - RNA, 13 nt, Homo sapiens
guucgggagcgaa

SEQ ID NO: 1161680 - RNA, 22 nt, Homo sapiens
guucuaaaaugaaauaugagaa

SEQ ID NO: 1161681 - RNA, 19 nt, Homo sapiens
guucuaacaaaacaaguug

SEQ ID NO: 1161682 - RNA, 15 nt, Homo sapiens
guucucacauaacag

SEQ ID NO: 1161683 - RNA, 18 nt, Homo sapiens
guucucagcuagauuuga

SEQ ID NO: 1161684 - RNA, 18 nt, Homo sapiens
guucucauaacucuguga

SEQ ID NO: 1161685 - RNA, 20 nt, Homo sapiens
guucucauaacucugugauc

SEQ ID NO: 1161686 - RNA, 21 nt, Homo sapiens
guucucauuuuuaucccauug

SEQ ID NO: 1161687 - RNA, 12 nt, Homo sapiens
guucuccagugu

SEQ ID NO: 1161688 - RNA, 16 nt, Homo sapiens
guucuuacugcuuaau

SEQ ID NO: 1161689 - RNA, 12 nt, Homo sapiens
guucuuacuuug

SEQ ID NO: 1161690 - RNA, 17 nt, Homo sapiens
guucuuuaaaauguaaa

SEQ ID NO: 1161691 - RNA, 14 nt, Homo sapiens
uagaauuagcuuuu

SEQ ID NO: 1161692 - RNA, 17 nt, Homo sapiens
uagaauuauaucacuuc

SEQ ID NO: 1161693 - RNA, 17 nt, Homo sapiens
uagaauucacaaugcau

SEQ ID NO: 1161694 - RNA, 17 nt, Homo sapiens
uagaauuugcacacuua

SEQ ID NO: 1161695 - RNA, 10 nt, Homo sapiens
uagacaccaa

SEQ ID NO: 1161696 - RNA, 20 nt, Homo sapiens
uagacaccuucugugcucau

SEQ ID NO: 1161697 - RNA, 18 nt, Homo sapiens
uagacacuacaacauaug

SEQ ID NO: 1161698 - RNA, 13 nt, Homo sapiens
uagaccuaaaaua

SEQ ID NO: 1161699 - RNA, 23 nt, Homo sapiens
uagaccuuuauuggguaucaaga

SEQ ID NO: 1161700 - RNA, 19 nt, Homo sapiens
uagacggacuucauugaaa

SEQ ID NO: 1161701 - RNA, 14 nt, Homo sapiens
uagacuaaggccau

SEQ ID NO: 1161702 - RNA, 13 nt, Homo sapiens
uagacuacauuua

SEQ ID NO: 1161703 - RNA, 14 nt, Homo sapiens
uagacuacauuuag

SEQ ID NO: 1161704 - RNA, 22 nt, Homo sapiens
uagacuggacuggaccagacaa

SEQ ID NO: 1161705 - RNA, 19 nt, Homo sapiens
uagacuuggagaauacugc

SEQ ID NO: 1161706 - RNA, 22 nt, Homo sapiens
uagagaaggaaagcuuuggcag

SEQ ID NO: 1161707 - RNA, 15 nt, Homo sapiens
uagagaagugccuau

SEQ ID NO: 1161708 - RNA, 14 nt, Homo sapiens
ucuguuaaccaaau

SEQ ID NO: 1161709 - RNA, 23 nt, Homo sapiens
ucuguucagcuuuucagugaaug

SEQ ID NO: 1161710 - RNA, 20 nt, Homo sapiens
ucuguucauagauauuggaa

SEQ ID NO: 1161711 - RNA, 16 nt, Homo sapiens
ucuguucuugaagcag

SEQ ID NO: 1161712 - RNA, 16 nt, Homo sapiens
ucuguugugugucaug

SEQ ID NO: 1161713 - RNA, 19 nt, Homo sapiens
ucuguuuccauagcaccau

SEQ ID NO: 1161714 - RNA, 16 nt, Homo sapiens
ucuguuuucuaaagga

SEQ ID NO: 1161715 - RNA, 19 nt, Homo sapiens
ucuuaaaccacagcacuau

SEQ ID NO: 1161716 - RNA, 20 nt, Homo sapiens
ucuuaaaguuugcaguauuc

SEQ ID NO: 1161717 - RNA, 19 nt, Homo sapiens
ucuuaacuuugaaccauaa

SEQ ID NO: 1161718 - RNA, 19 nt, Homo sapiens
ucuuaaggacaaagugcca

SEQ ID NO: 1161719 - RNA, 20 nt, Homo sapiens
ucuuaaggacaaagugccaa

SEQ ID NO: 1161720 - RNA, 20 nt, Homo sapiens
ucuuaauuuugguuguauuc

SEQ ID NO: 1161721 - RNA, 19 nt, Homo sapiens
ucuuacagucagcacagaa

SEQ ID NO: 1161722 - RNA, 17 nt, Homo sapiens
ugaacaaagcagccacg

SEQ ID NO: 1161723 - RNA, 14 nt, Homo sapiens
ugaacaaaggaauu

SEQ ID NO: 1161724 - RNA, 16 nt, Homo sapiens
ugaacaaauggccuuu

SEQ ID NO: 1161725 - RNA, 18 nt, Homo sapiens
ugaacaagcaaacccaga

SEQ ID NO: 1161726 - RNA, 22 nt, Homo sapiens
ugaacaauugcuuuaacaguca

SEQ ID NO: 1161727 - RNA, 21 nt, Homo sapiens
ugaacacugauuguccauuua

SEQ ID NO: 1161728 - RNA, 15 nt, Homo sapiens
ugaacagcggaugaa

SEQ ID NO: 1161729 - RNA, 16 nt, Homo sapiens
ugaacauaacuucuca

SEQ ID NO: 1161730 - RNA, 15 nt, Homo sapiens
ugaaccuugagcaaa

SEQ ID NO: 1161731 - RNA, 19 nt, Homo sapiens
ugaacuaaucugauguuaa

SEQ ID NO: 1161732 - RNA, 16 nt, Homo sapiens
ugaacuagagcuugca

SEQ ID NO: 1161733 - RNA, 18 nt, Homo sapiens
ugaacuagggaagcucag

SEQ ID NO: 1161734 - RNA, 16 nt, Homo sapiens
ugaacuauauuuacug

SEQ ID NO: 1161735 - RNA, 20 nt, Homo sapiens
ugaacucagccaagcacagu

SEQ ID NO: 1161736 - RNA, 15 nt, Homo sapiens
ugaacuugugagaac

SEQ ID NO: 1161737 - RNA, 18 nt, Homo sapiens
ugaacuuuuuuccacuga

SEQ ID NO: 1161738 - RNA, 19 nt, Homo sapiens
ugaagaacugcauguggcu

SEQ ID NO: 1161739 - RNA, 16 nt, Homo sapiens
ugaagaagauauguga

SEQ ID NO: 1161740 - RNA, 18 nt, Homo sapiens
ugaagaagcccuguucuc

SEQ ID NO: 1161741 - RNA, 19 nt, Homo sapiens
ugaagaagcccuguucucg

SEQ ID NO: 1161742 - RNA, 21 nt, Homo sapiens
ugaagauaguaacuguagaug

SEQ ID NO: 1161743 - RNA, 14 nt, Homo sapiens
ugaagauauggaau

SEQ ID NO: 1161744 - RNA, 21 nt, Homo sapiens
ugaagauggcauccugugaag

SEQ ID NO: 1161745 - RNA, 17 nt, Homo sapiens
ugaagauuaucacuuaa

SEQ ID NO: 1161746 - RNA, 22 nt, Homo sapiens
ugaagcaagcuguguuacuuga

SEQ ID NO: 1161747 - RNA, 22 nt, Homo sapiens
ugaagcaaggcgguggacuuga

SEQ ID NO: 1161748 - RNA, 15 nt, Homo sapiens
ugaagcagguuccca

SEQ ID NO: 1161749 - RNA, 17 nt, Homo sapiens
ugaagcagucuugcucu

SEQ ID NO: 1161750 - RNA, 13 nt, Homo sapiens
ugaagccacagca

SEQ ID NO: 1161751 - RNA, 20 nt, Homo sapiens
ugaagcccagccacauuuca

SEQ ID NO: 1161752 - RNA, 17 nt, Homo sapiens
ugaagccccucccugag

SEQ ID NO: 1161753 - RNA, 21 nt, Homo sapiens
ugaagcccuguugugccacag

SEQ ID NO: 1161754 - RNA, 18 nt, Homo sapiens
ugaagccuauguaugcca

SEQ ID NO: 1161755 - RNA, 16 nt, Homo sapiens
ugaagccuuugccagc

SEQ ID NO: 1161756 - RNA, 21 nt, Homo sapiens
ugaagcucuuuacuguaaagg

SEQ ID NO: 1161757 - RNA, 13 nt, Homo sapiens
ugaagcugagcua

SEQ ID NO: 1161758 - RNA, 15 nt, Homo sapiens
ugaaggaaacugaac

SEQ ID NO: 1161759 - RNA, 20 nt, Homo sapiens
ugaaggaaggacuaugacaa

SEQ ID NO: 1161760 - RNA, 18 nt, Homo sapiens
ugaaggagauagauuugu

SEQ ID NO: 1161761 - RNA, 19 nt, Homo sapiens
ugaaggcucauuuacuuga

SEQ ID NO: 1161762 - RNA, 16 nt, Homo sapiens
ugaagggccacuggga

SEQ ID NO: 1161763 - RNA, 19 nt, Homo sapiens
ugaagggccacugggaccc

SEQ ID NO: 1161764 - RNA, 23 nt, Homo sapiens
ugaagggcugauugggauuucca

SEQ ID NO: 1161765 - RNA, 20 nt, Homo sapiens
ugaagggggaacaagucaaa

SEQ ID NO: 1161766 - RNA, 19 nt, Homo sapiens
ugaaggugcuggaaaggga

SEQ ID NO: 1161767 - RNA, 23 nt, Homo sapiens
ugaagguuaaaggaaaagcacaa

SEQ ID NO: 1161768 - RNA, 16 nt, Homo sapiens
ugaaguagugugcagu

SEQ ID NO: 1161769 - RNA, 22 nt, Homo sapiens
ugaaguccuucaccucacugaa

SEQ ID NO: 1161770 - RNA, 22 nt, Homo sapiens
ugaagugcuacagaaagcacaa

SEQ ID NO: 1161771 - RNA, 17 nt, Homo sapiens
ugaaguggugagcuuaa

SEQ ID NO: 1161772 - RNA, 16 nt, Homo sapiens
ugaaguguaauugaga

SEQ ID NO: 1161773 - RNA, 22 nt, Homo sapiens
ugaagugugcacguugcuucag

SEQ ID NO: 1161774 - RNA, 22 nt, Homo sapiens
ugaaguguucugcugagacuga

SEQ ID NO: 1161775 - RNA, 21 nt, Homo sapiens
ugaauaaagccugcuuuuuaa

SEQ ID NO: 1161776 - RNA, 18 nt, Homo sapiens
ugaauacagcagcaagaa

SEQ ID NO: 1161777 - RNA, 15 nt, Homo sapiens
ugaauaccuauaauu

SEQ ID NO: 1161778 - RNA, 15 nt, Homo sapiens
ugaauagggguugag

SEQ ID NO: 1161779 - RNA, 22 nt, Homo sapiens
ugaauagguuccccaauccauc

SEQ ID NO: 1161780 - RNA, 13 nt, Homo sapiens
ugaauauucccaa

SEQ ID NO: 1161781 - RNA, 16 nt, Homo sapiens
ugaauauuuagcauaa

SEQ ID NO: 1161782 - RNA, 22 nt, Homo sapiens
ugaauauuuuucuguaguguga

SEQ ID NO: 1161783 - RNA, 14 nt, Homo sapiens
ugaaucauguagua

SEQ ID NO: 1161784 - RNA, 18 nt, Homo sapiens
ugaauccaaaucuguccu

SEQ ID NO: 1161785 - RNA, 22 nt, Homo sapiens
ugaaucccucuaucucuaaaga

SEQ ID NO: 1161786 - RNA, 16 nt, Homo sapiens
ugaaugauccugucuc

SEQ ID NO: 1161787 - RNA, 19 nt, Homo sapiens
ugaaugcagaagcgcucca

SEQ ID NO: 1161788 - RNA, 15 nt, Homo sapiens
ugaaugccugucacg

SEQ ID NO: 1161789 - RNA, 22 nt, Homo sapiens
ugaauggagcagaaauucaccu

SEQ ID NO: 1161790 - RNA, 18 nt, Homo sapiens
ugaauggcuuugucuuga

SEQ ID NO: 1161791 - RNA, 19 nt, Homo sapiens
ugaauggcuuugucuugaa

SEQ ID NO: 1161792 - RNA, 23 nt, Homo sapiens
ugaaugucauuauuugauaacau

SEQ ID NO: 1161793 - RNA, 17 nt, Homo sapiens
ugaaugugacuacuuag

SEQ ID NO: 1161794 - RNA, 20 nt, Homo sapiens
ugaauuauuuccugcuuauu

SEQ ID NO: 1161795 - RNA, 15 nt, Homo sapiens
ugaauucucugcuca

SEQ ID NO: 1161796 - RNA, 18 nt, Homo sapiens
ugaauucucugcucagug

SEQ ID NO: 1161797 - RNA, 18 nt, Homo sapiens
ugaauucugucauuucaa

SEQ ID NO: 1161798 - RNA, 12 nt, Homo sapiens
ugaauugcaaac

SEQ ID NO: 1161799 - RNA, 13 nt, Homo sapiens
ugaauugccaggg

SEQ ID NO: 1161800 - RNA, 14 nt, Homo sapiens
ugaauuggcauuuc

SEQ ID NO: 1161801 - RNA, 22 nt, Homo sapiens
ugaauuggccugaacagaugua

SEQ ID NO: 1161802 - RNA, 22 nt, Homo sapiens
ugaauuuaagcaugaguggccu

SEQ ID NO: 1161803 - RNA, 18 nt, Homo sapiens
ugaauuuacauauagcug

SEQ ID NO: 1161804 - RNA, 11 nt, Homo sapiens
ugaauuugacu

SEQ ID NO: 1161805 - RNA, 21 nt, Homo sapiens
ugaauuuggucuguauagucu

SEQ ID NO: 1161806 - RNA, 13 nt, Homo sapiens
ugaauuuuugcaa

SEQ ID NO: 1161807 - RNA, 14 nt, Homo sapiens
ugaauuuuugcaau

SEQ ID NO: 1161808 - RNA, 16 nt, Homo sapiens
ugaauuuuugcacauu

SEQ ID NO: 1161809 - RNA, 18 nt, Homo sapiens
ugacaaaaaugguuuuga

SEQ ID NO: 1161810 - RNA, 13 nt, Homo sapiens
ugacaaaccagag

SEQ ID NO: 1161811 - RNA, 19 nt, Homo sapiens
ugacaaccaaaagucuuca

SEQ ID NO: 1161812 - RNA, 22 nt, Homo sapiens
ugacaacucauuuucauauugu

SEQ ID NO: 1161813 - RNA, 14 nt, Homo sapiens
ugacaacucuuauu

SEQ ID NO: 1161814 - RNA, 14 nt, Homo sapiens
ugacaagcagauac

SEQ ID NO: 1161815 - RNA, 14 nt, Homo sapiens
ugacaaucugccuu

SEQ ID NO: 1161816 - RNA, 15 nt, Homo sapiens
ugacacaaugacaca

SEQ ID NO: 1161817 - RNA, 23 nt, Homo sapiens
ugacacagacauccucuaugcca

SEQ ID NO: 1161818 - RNA, 16 nt, Homo sapiens
ugacacauaugcaccu

SEQ ID NO: 1161819 - RNA, 19 nt, Homo sapiens
ugacacuagcuaauaucaa

SEQ ID NO: 1161820 - RNA, 17 nt, Homo sapiens
ugacagagcgagacucc

SEQ ID NO: 1161821 - RNA, 18 nt, Homo sapiens
ugacagaucaagcuguga

SEQ ID NO: 1161822 - RNA, 20 nt, Homo sapiens
ugacagaucaagcugugaga

SEQ ID NO: 1161823 - RNA, 16 nt, Homo sapiens
ugacagcuucuacuug

SEQ ID NO: 1161824 - RNA, 20 nt, Homo sapiens
ugacagggacaugcccugug

SEQ ID NO: 1161825 - RNA, 15 nt, Homo sapiens
ugacaguagcauuga

SEQ ID NO: 1161826 - RNA, 16 nt, Homo sapiens
ugacagucacucagcc

SEQ ID NO: 1161827 - RNA, 20 nt, Homo sapiens
ugacauaauuuacaugcaau

SEQ ID NO: 1161828 - RNA, 19 nt, Homo sapiens
ugacauauguagaugugcu

SEQ ID NO: 1161829 - RNA, 11 nt, Homo sapiens
ugacaugaccc

SEQ ID NO: 1161830 - RNA, 16 nt, Homo sapiens
ugacaugagauuuaua

SEQ ID NO: 1161831 - RNA, 15 nt, Homo sapiens
ugacaugcacucagc

SEQ ID NO: 1161832 - RNA, 14 nt, Homo sapiens
ugacaugucucaca

SEQ ID NO: 1161833 - RNA, 15 nt, Homo sapiens
ugacauguugcucuu

SEQ ID NO: 1161834 - RNA, 14 nt, Homo sapiens
ugacauuauaugca

SEQ ID NO: 1161835 - RNA, 17 nt, Homo sapiens
ugacauuauaugcacua

SEQ ID NO: 1161836 - RNA, 17 nt, Homo sapiens
ugacauucacacagaga

SEQ ID NO: 1161837 - RNA, 17 nt, Homo sapiens
ugacauugcguuugacc

SEQ ID NO: 1161838 - RNA, 19 nt, Homo sapiens
ugacauugugucaguuuca

SEQ ID NO: 1161839 - RNA, 20 nt, Homo sapiens
ugacauuuaauaacuuugcu

SEQ ID NO: 1161840 - RNA, 21 nt, Homo sapiens
ugacauuuuuccucucugcaa

SEQ ID NO: 1161841 - RNA, 15 nt, Homo sapiens
ugaccaagcaggaag

SEQ ID NO: 1161842 - RNA, 15 nt, Homo sapiens
ugaccaauacauuug

SEQ ID NO: 1161843 - RNA, 19 nt, Homo sapiens
ugaccaccgauuccagcug

SEQ ID NO: 1161844 - RNA, 12 nt, Homo sapiens
ugacccucucac

SEQ ID NO: 1161845 - RNA, 10 nt, Homo sapiens
ugacccugua

SEQ ID NO: 1161846 - RNA, 17 nt, Homo sapiens
ugaccuaaggaagacaa

SEQ ID NO: 1161847 - RNA, 22 nt, Homo sapiens
ugaccuuaguguuucugugcau

SEQ ID NO: 1161848 - RNA, 16 nt, Homo sapiens
ugaccuucagagccag

SEQ ID NO: 1161849 - RNA, 15 nt, Homo sapiens
ugaccuuccaagagc

SEQ ID NO: 1161850 - RNA, 13 nt, Homo sapiens
ugacgaacuggcu

SEQ ID NO: 1161851 - RNA, 16 nt, Homo sapiens
ugacucagagugcaag

SEQ ID NO: 1161852 - RNA, 21 nt, Homo sapiens
ugacuccuccaaggaaaggga

SEQ ID NO: 1161853 - RNA, 15 nt, Homo sapiens
ugacugauuucaaau

SEQ ID NO: 1161854 - RNA, 12 nt, Homo sapiens
ugacugcugcuc

SEQ ID NO: 1161855 - RNA, 18 nt, Homo sapiens
ugacuguguauagugcca

SEQ ID NO: 1161856 - RNA, 16 nt, Homo sapiens
ugacuguugcauagaa

SEQ ID NO: 1161857 - RNA, 14 nt, Homo sapiens
ugacuucaugcuau

SEQ ID NO: 1161858 - RNA, 21 nt, Homo sapiens
ugacuucuuggugcuguugaa

SEQ ID NO: 1161859 - RNA, 18 nt, Homo sapiens
ugacuuuugaagaacaaa

SEQ ID NO: 1161860 - RNA, 14 nt, Homo sapiens
ugagaaacaucuag

SEQ ID NO: 1161861 - RNA, 22 nt, Homo sapiens
ugagaaacucuacauguaacua

SEQ ID NO: 1161862 - RNA, 22 nt, Homo sapiens
ugagaaagcuuaaauacaccuu

SEQ ID NO: 1161863 - RNA, 19 nt, Homo sapiens
ugagaacugguucuugccu

SEQ ID NO: 1161864 - RNA, 15 nt, Homo sapiens
ugagacagauucucu

SEQ ID NO: 1161865 - RNA, 19 nt, Homo sapiens
ugagacagugcacaugaac

SEQ ID NO: 1161866 - RNA, 15 nt, Homo sapiens
ugagacucagugcag

SEQ ID NO: 1161867 - RNA, 16 nt, Homo sapiens
ugagacucagugcaga

SEQ ID NO: 1161868 - RNA, 20 nt, Homo sapiens
ugagacucagugcagaugga

SEQ ID NO: 1161869 - RNA, 12 nt, Homo sapiens
ugagagcaauau

SEQ ID NO: 1161870 - RNA, 15 nt, Homo sapiens
ugagagcugcuuuga

SEQ ID NO: 1161871 - RNA, 16 nt, Homo sapiens
ugagaggaagccugag

SEQ ID NO: 1161872 - RNA, 13 nt, Homo sapiens
ugagagggugcua

SEQ ID NO: 1161873 - RNA, 11 nt, Homo sapiens
ugagaguacac

SEQ ID NO: 1161874 - RNA, 22 nt, Homo sapiens
ugagagucuagauucucuggcu

SEQ ID NO: 1161875 - RNA, 15 nt, Homo sapiens
ugagagugagacuca

SEQ ID NO: 1161876 - RNA, 12 nt, Homo sapiens
ugagagugcaga

SEQ ID NO: 1161877 - RNA, 17 nt, Homo sapiens
ugagauaauacauuccg

SEQ ID NO: 1161878 - RNA, 18 nt, Homo sapiens
ugagauuaagaaugccag

SEQ ID NO: 1161879 - RNA, 18 nt, Homo sapiens
ugagauucccucaccugu

SEQ ID NO: 1161880 - RNA, 23 nt, Homo sapiens
ugagauugcaccacugcacucca

SEQ ID NO: 1161881 - RNA, 15 nt, Homo sapiens
ugagcagagacauga

SEQ ID NO: 1161882 - RNA, 16 nt, Homo sapiens
ugagcagcaacugugu

SEQ ID NO: 1161883 - RNA, 17 nt, Homo sapiens
ugagcagcaacuguguc

SEQ ID NO: 1161884 - RNA, 15 nt, Homo sapiens
ugagccaaagccaga

SEQ ID NO: 1161885 - RNA, 15 nt, Homo sapiens
ugagccaagaucgca

SEQ ID NO: 1161886 - RNA, 20 nt, Homo sapiens
ugagccaagaucgcaccacu

SEQ ID NO: 1161887 - RNA, 15 nt, Homo sapiens
ugagccacugugcuu

SEQ ID NO: 1161888 - RNA, 18 nt, Homo sapiens
ugagccccaggcacuuug

SEQ ID NO: 1161889 - RNA, 14 nt, Homo sapiens
ugagccuucuacuu

SEQ ID NO: 1161890 - RNA, 21 nt, Homo sapiens
ugagcguuuaaaguacugagc

SEQ ID NO: 1161891 - RNA, 13 nt, Homo sapiens
ugagcguuugcac

SEQ ID NO: 1161892 - RNA, 16 nt, Homo sapiens
ugagcuauaacuuacu

SEQ ID NO: 1161893 - RNA, 19 nt, Homo sapiens
ugagcucacugaaaagacu

SEQ ID NO: 1161894 - RNA, 20 nt, Homo sapiens
ugagcucaggaguuugagac

SEQ ID NO: 1161895 - RNA, 23 nt, Homo sapiens
ugagcucccaggugcagccagag

SEQ ID NO: 1161896 - RNA, 22 nt, Homo sapiens
ugagcucugcucucagcagauu

SEQ ID NO: 1161897 - RNA, 19 nt, Homo sapiens
ugagcugccuguaacuuga

SEQ ID NO: 1161898 - RNA, 13 nt, Homo sapiens
ugagcuucuuuag

SEQ ID NO: 1161899 - RNA, 22 nt, Homo sapiens
ugagcuugcuuuuaagagcaau

SEQ ID NO: 1161900 - RNA, 21 nt, Homo sapiens
ugaggaaacugaggugcaaag

SEQ ID NO: 1161901 - RNA, 19 nt, Homo sapiens
ugaggaacaaucacaaaag

SEQ ID NO: 1161902 - RNA, 16 nt, Homo sapiens
ugaggaagucacuuua

SEQ ID NO: 1161903 - RNA, 13 nt, Homo sapiens
ugaggaauguguu

SEQ ID NO: 1161904 - RNA, 16 nt, Homo sapiens
ugaggacuaugccaug

SEQ ID NO: 1161905 - RNA, 17 nt, Homo sapiens
ugaggaugauguuauuc

SEQ ID NO: 1161906 - RNA, 16 nt, Homo sapiens
ugaggcaggcagauca

SEQ ID NO: 1161907 - RNA, 16 nt, Homo sapiens
ugaggcugcuuuccaa

SEQ ID NO: 1161908 - RNA, 16 nt, Homo sapiens
ugaggcuuuggcaaau

SEQ ID NO: 1161909 - RNA, 20 nt, Homo sapiens
ugagggagggagccauggaa

SEQ ID NO: 1161910 - RNA, 23 nt, Homo sapiens
ugaggggaggaguuccacagauu

SEQ ID NO: 1161911 - RNA, 15 nt, Homo sapiens
ugaggggauguucuc

SEQ ID NO: 1161912 - RNA, 13 nt, Homo sapiens
ugaggggccugug

SEQ ID NO: 1161913 - RNA, 20 nt, Homo sapiens
ugaggguaucugacaaugcu

SEQ ID NO: 1161914 - RNA, 12 nt, Homo sapiens
ugaggucuugca

SEQ ID NO: 1161915 - RNA, 16 nt, Homo sapiens
ugagguuacaauuaga

SEQ ID NO: 1161916 - RNA, 22 nt, Homo sapiens
ugagguugggguguacuaguua

SEQ ID NO: 1161917 - RNA, 18 nt, Homo sapiens
ugaguaauacaucaaaga

SEQ ID NO: 1161918 - RNA, 20 nt, Homo sapiens
ugaguauugauaaacuuuga

SEQ ID NO: 1161919 - RNA, 14 nt, Homo sapiens
ugagucaugaucuc

SEQ ID NO: 1161920 - RNA, 22 nt, Homo sapiens
ugagucccuggcaagacugucu

SEQ ID NO: 1161921 - RNA, 20 nt, Homo sapiens
ugagucugcaucauccuccu

SEQ ID NO: 1161922 - RNA, 20 nt, Homo sapiens
ugagucuuugguucuaagga

SEQ ID NO: 1161923 - RNA, 14 nt, Homo sapiens
ugagugaugaauca

SEQ ID NO: 1161924 - RNA, 13 nt, Homo sapiens
ugaguggccccac

SEQ ID NO: 1161925 - RNA, 19 nt, Homo sapiens
ugagugugugugcauggaa

SEQ ID NO: 1161926 - RNA, 14 nt, Homo sapiens
ugaguuccuagcca

SEQ ID NO: 1161927 - RNA, 14 nt, Homo sapiens
ugaguuuucagugg

SEQ ID NO: 1161928 - RNA, 16 nt, Homo sapiens
ugaguuuuguucacaa

SEQ ID NO: 1161929 - RNA, 14 nt, Homo sapiens
ugauaaaauacuaa

SEQ ID NO: 1161930 - RNA, 14 nt, Homo sapiens
ugauaaacuuugcu

SEQ ID NO: 1161931 - RNA, 15 nt, Homo sapiens
ugauaauagauucuc

SEQ ID NO: 1161932 - RNA, 15 nt, Homo sapiens
ugauaauagcacuaa

SEQ ID NO: 1161933 - RNA, 22 nt, Homo sapiens
ugauaauaguuuuuucuuuuaa

SEQ ID NO: 1161934 - RNA, 16 nt, Homo sapiens
ugauacaguacuuuga

SEQ ID NO: 1161935 - RNA, 17 nt, Homo sapiens
ugauaccauaugaauga

SEQ ID NO: 1161936 - RNA, 16 nt, Homo sapiens
ugauaccuucaaugaa

SEQ ID NO: 1161937 - RNA, 16 nt, Homo sapiens
ugauacgcacuuugca

SEQ ID NO: 1161938 - RNA, 13 nt, Homo sapiens
ugauagaauacaa

SEQ ID NO: 1161939 - RNA, 16 nt, Homo sapiens
ugauagaauacaaaga

SEQ ID NO: 1161940 - RNA, 14 nt, Homo sapiens
ugauagagccuuug

SEQ ID NO: 1161941 - RNA, 16 nt, Homo sapiens
ugauagagccuuugau

SEQ ID NO: 1161942 - RNA, 21 nt, Homo sapiens
ugauaguuggggaauugugag

SEQ ID NO: 1161943 - RNA, 20 nt, Homo sapiens
ugauauuauguggcuuuuau

SEQ ID NO: 1161944 - RNA, 21 nt, Homo sapiens
ugauauuucuauuuccuggaa

SEQ ID NO: 1161945 - RNA, 16 nt, Homo sapiens
ugaucaacauaaugga

SEQ ID NO: 1161946 - RNA, 19 nt, Homo sapiens
ugaucaauuucaacaugga

SEQ ID NO: 1161947 - RNA, 14 nt, Homo sapiens
ugaucacugugaac

SEQ ID NO: 1161948 - RNA, 23 nt, Homo sapiens
ugaucaggaccuccaagccacug

SEQ ID NO: 1161949 - RNA, 12 nt, Homo sapiens
ugaucagggauc

SEQ ID NO: 1161950 - RNA, 21 nt, Homo sapiens
ugaucaucuugaugucuauga

SEQ ID NO: 1161951 - RNA, 13 nt, Homo sapiens
ugaucauuucaaa

SEQ ID NO: 1161952 - RNA, 20 nt, Homo sapiens
ugaucgugggguugaccaac

SEQ ID NO: 1161953 - RNA, 12 nt, Homo sapiens
ugaugaaugaga

SEQ ID NO: 1161954 - RNA, 14 nt, Homo sapiens
ugaugaugcaugga

SEQ ID NO: 1161955 - RNA, 21 nt, Homo sapiens
ugaugccauaaauacaagauu

SEQ ID NO: 1161956 - RNA, 14 nt, Homo sapiens
ugaugcugugcuau

SEQ ID NO: 1161957 - RNA, 19 nt, Homo sapiens
ugaugcuuagauguuccag

SEQ ID NO: 1161958 - RNA, 13 nt, Homo sapiens
ugauggaagacag

SEQ ID NO: 1161959 - RNA, 15 nt, Homo sapiens
ugauggcaacacuga

SEQ ID NO: 1161960 - RNA, 15 nt, Homo sapiens
ugaugguaggcugua

SEQ ID NO: 1161961 - RNA, 20 nt, Homo sapiens
ugaugucagcugcuguugaa

SEQ ID NO: 1161962 - RNA, 20 nt, Homo sapiens
ugaugugguuuuuugccagg

SEQ ID NO: 1161963 - RNA, 15 nt, Homo sapiens
ugauguuaaccaaug

SEQ ID NO: 1161964 - RNA, 14 nt, Homo sapiens
ugauguucuaaggc

SEQ ID NO: 1161965 - RNA, 16 nt, Homo sapiens
ugauuaaugauuuuuc

SEQ ID NO: 1161966 - RNA, 15 nt, Homo sapiens
ugauuagaggaacuu

SEQ ID NO: 1161967 - RNA, 12 nt, Homo sapiens
ugauucaaguga

SEQ ID NO: 1161968 - RNA, 13 nt, Homo sapiens
ugauucacaauga

SEQ ID NO: 1161969 - RNA, 12 nt, Homo sapiens
ugauucauaugu

SEQ ID NO: 1161970 - RNA, 16 nt, Homo sapiens
ugauucccuccugcua

SEQ ID NO: 1161971 - RNA, 20 nt, Homo sapiens
ugccauuuuaaggaaaacua

SEQ ID NO: 1161972 - RNA, 20 nt, Homo sapiens
ugcccacaggugcgggacca

SEQ ID NO: 1161973 - RNA, 18 nt, Homo sapiens
ugcccagaauaaguuauu

SEQ ID NO: 1161974 - RNA, 19 nt, Homo sapiens
ugcccaggagaaaagaaga

SEQ ID NO: 1161975 - RNA, 15 nt, Homo sapiens
ugcccagggugcagu

SEQ ID NO: 1161976 - RNA, 18 nt, Homo sapiens
ugcccauggcaugucuuu

SEQ ID NO: 1161977 - RNA, 17 nt, Homo sapiens
ugccccagacacagugc

SEQ ID NO: 1161978 - RNA, 17 nt, Homo sapiens
ugcccccaauccaugaa

SEQ ID NO: 1161979 - RNA, 15 nt, Homo sapiens
ugcccccuccacugg

SEQ ID NO: 1161980 - RNA, 18 nt, Homo sapiens
ugcccccucccccacugc

SEQ ID NO: 1161981 - RNA, 21 nt, Homo sapiens
ugccccuccagagacaggaaa

SEQ ID NO: 1161982 - RNA, 22 nt, Homo sapiens
ugccccucccagaacacacucc

SEQ ID NO: 1161983 - RNA, 21 nt, Homo sapiens
ugccccuccuccgcaugccaa

SEQ ID NO: 1161984 - RNA, 16 nt, Homo sapiens
ugccccuggcucugac

SEQ ID NO: 1161985 - RNA, 14 nt, Homo sapiens
ugccccuugacaac

SEQ ID NO: 1161986 - RNA, 23 nt, Homo sapiens
ugcccguaaacacgccugcaaac

SEQ ID NO: 1161987 - RNA, 16 nt, Homo sapiens
ugcccguaaucccagc

SEQ ID NO: 1161988 - RNA, 24 nt, Homo sapiens
ugcccguucuugaaauguaggcau

SEQ ID NO: 1161989 - RNA, 13 nt, Homo sapiens
ugcccuaaccuga

SEQ ID NO: 1161990 - RNA, 20 nt, Homo sapiens
ugcccucgccuguuccccaa

SEQ ID NO: 1161991 - RNA, 21 nt, Homo sapiens
ugcccugcccuuggcacccaa

SEQ ID NO: 1161992 - RNA, 13 nt, Homo sapiens
ugcccugcuauuu

SEQ ID NO: 1161993 - RNA, 16 nt, Homo sapiens
ugcccuggggaucaaa

SEQ ID NO: 1161994 - RNA, 19 nt, Homo sapiens
ugcccuguaccugugcacg

SEQ ID NO: 1161995 - RNA, 19 nt, Homo sapiens
ugcccugugccgcacucug

SEQ ID NO: 1161996 - RNA, 14 nt, Homo sapiens
ugcccuuuggccag

SEQ ID NO: 1161997 - RNA, 21 nt, Homo sapiens
ugccgaagaugagacugccca

SEQ ID NO: 1161998 - RNA, 13 nt, Homo sapiens
ugccgacacuguu

SEQ ID NO: 1161999 - RNA, 21 nt, Homo sapiens
ugccgacucccccaaccaagg

SEQ ID NO: 1162000 - RNA, 20 nt, Homo sapiens
ugccgccuccuugugcacaa

SEQ ID NO: 1162001 - RNA, 14 nt, Homo sapiens
ugccgcuaccuccc

SEQ ID NO: 1162002 - RNA, 19 nt, Homo sapiens
ugccgcuggaggauccgga

SEQ ID NO: 1162003 - RNA, 18 nt, Homo sapiens
ugccggggguucaggguu

SEQ ID NO: 1162004 - RNA, 16 nt, Homo sapiens
ugccguuaucauggag

SEQ ID NO: 1162005 - RNA, 16 nt, Homo sapiens
ugccguugcuccggcc

SEQ ID NO: 1162006 - RNA, 17 nt, Homo sapiens
ugccuagaaucuuuauu

SEQ ID NO: 1162007 - RNA, 14 nt, Homo sapiens
ugccucaacacuga

SEQ ID NO: 1162008 - RNA, 14 nt, Homo sapiens
ugccucauccuccu

SEQ ID NO: 1162009 - RNA, 16 nt, Homo sapiens
ugccuccccuguggaa

SEQ ID NO: 1162010 - RNA, 20 nt, Homo sapiens
ugccucccuuaaucugccag

SEQ ID NO: 1162011 - RNA, 18 nt, Homo sapiens
ugccuccuggguucaagc

SEQ ID NO: 1162012 - RNA, 14 nt, Homo sapiens
ugccucgaaagugu

SEQ ID NO: 1162013 - RNA, 22 nt, Homo sapiens
ugccucuaaucucagcacuuug

SEQ ID NO: 1162014 - RNA, 21 nt, Homo sapiens
ugccugaaacccauuuacuua

SEQ ID NO: 1162015 - RNA, 22 nt, Homo sapiens
ugccugaaacccauuuacuuag

SEQ ID NO: 1162016 - RNA, 18 nt, Homo sapiens
ugccugaagccaggccau

SEQ ID NO: 1162017 - RNA, 22 nt, Homo sapiens
ugccugagaauuuaauuuuuaa

SEQ ID NO: 1162018 - RNA, 17 nt, Homo sapiens
ugccugagccccucaga

SEQ ID NO: 1162019 - RNA, 16 nt, Homo sapiens
ugccugaucugcacau

SEQ ID NO: 1162020 - RNA, 21 nt, Homo sapiens
ugccugcagaguuuggauaaa

SEQ ID NO: 1162021 - RNA, 15 nt, Homo sapiens
ugccugccucaaagg

SEQ ID NO: 1162022 - RNA, 17 nt, Homo sapiens
ugccuggaagcuuuguc

SEQ ID NO: 1162023 - RNA, 23 nt, Homo sapiens
ugccuggccaugcugucccugca

SEQ ID NO: 1162024 - RNA, 22 nt, Homo sapiens
ugccugguucuuaagaaucacu

SEQ ID NO: 1162025 - RNA, 22 nt, Homo sapiens
ugccuguucaguuacagaaagu

SEQ ID NO: 1162026 - RNA, 17 nt, Homo sapiens
ugccuuagcaugugacu

SEQ ID NO: 1162027 - RNA, 18 nt, Homo sapiens
ugccuuagcaugugacuc

SEQ ID NO: 1162028 - RNA, 18 nt, Homo sapiens
ugccuuauuaaagcaaaa

SEQ ID NO: 1162029 - RNA, 20 nt, Homo sapiens
ugccuucaaaucaaucugua

SEQ ID NO: 1162030 - RNA, 18 nt, Homo sapiens
ugccuucuaggucacuuc

SEQ ID NO: 1162031 - RNA, 13 nt, Homo sapiens
ugccuucucaggg

SEQ ID NO: 1162032 - RNA, 18 nt, Homo sapiens
ugccuucugggaagggag

SEQ ID NO: 1162033 - RNA, 22 nt, Homo sapiens
ugccuugcaauggaucagccaa

SEQ ID NO: 1162034 - RNA, 13 nt, Homo sapiens
ugccuugcaccuc

SEQ ID NO: 1162035 - RNA, 16 nt, Homo sapiens
ugccuuggccucccac

SEQ ID NO: 1162036 - RNA, 20 nt, Homo sapiens
ugccuuguuuggauuggcac

SEQ ID NO: 1162037 - RNA, 18 nt, Homo sapiens
ugccuuuaucucagccau

SEQ ID NO: 1162038 - RNA, 18 nt, Homo sapiens
ugccuuucaaauuuagaa

SEQ ID NO: 1162039 - RNA, 20 nt, Homo sapiens
ugccuuuccauaaucacuca

SEQ ID NO: 1162040 - RNA, 14 nt, Homo sapiens
ugccuuugccucca

SEQ ID NO: 1162041 - RNA, 15 nt, Homo sapiens
ugcgaaagacccaca

SEQ ID NO: 1162042 - RNA, 15 nt, Homo sapiens
ugcgauagagucuca

SEQ ID NO: 1162043 - RNA, 16 nt, Homo sapiens
ugcgaugggggucacc

SEQ ID NO: 1162044 - RNA, 18 nt, Homo sapiens
ugcgcccaguccuuccac

SEQ ID NO: 1162045 - RNA, 14 nt, Homo sapiens
ugcgcucuguggau

SEQ ID NO: 1162046 - RNA, 22 nt, Homo sapiens
ugcggagucuccucucuuggca

SEQ ID NO: 1162047 - RNA, 21 nt, Homo sapiens
ugcgguacaggagucagccau

SEQ ID NO: 1162048 - RNA, 14 nt, Homo sapiens
ugcgugaagaccaa

SEQ ID NO: 1162049 - RNA, 15 nt, Homo sapiens
ugcgugaguaugugu

SEQ ID NO: 1162050 - RNA, 14 nt, Homo sapiens
ugcgugcgcaucuu

SEQ ID NO: 1162051 - RNA, 22 nt, Homo sapiens
ugcguucccuucaguacugcag

SEQ ID NO: 1162052 - RNA, 14 nt, Homo sapiens
ugcguuuacucuug

SEQ ID NO: 1162053 - RNA, 17 nt, Homo sapiens
ugcuaaaauucagguau

SEQ ID NO: 1162054 - RNA, 17 nt, Homo sapiens
ugcuaaauaacuauaua

SEQ ID NO: 1162055 - RNA, 14 nt, Homo sapiens
ugcuaaaugcacug

SEQ ID NO: 1162056 - RNA, 12 nt, Homo sapiens
ugcuaagcucca

SEQ ID NO: 1162057 - RNA, 17 nt, Homo sapiens
ugcuaagguucuaaggc

SEQ ID NO: 1162058 - RNA, 16 nt, Homo sapiens
ugcuacaacuacuauu

SEQ ID NO: 1162059 - RNA, 18 nt, Homo sapiens
ugcuacagaaagcacaaa

SEQ ID NO: 1162060 - RNA, 13 nt, Homo sapiens
ugcuacagugcau

SEQ ID NO: 1162061 - RNA, 16 nt, Homo sapiens
ugcuacuagaaauaaa

SEQ ID NO: 1162062 - RNA, 23 nt, Homo sapiens
ugcuacuccccagaccucaggga

SEQ ID NO: 1162063 - RNA, 13 nt, Homo sapiens
ugcuagaagaaaa

SEQ ID NO: 1162064 - RNA, 12 nt, Homo sapiens
ugcuagcuuucc

SEQ ID NO: 1162065 - RNA, 23 nt, Homo sapiens
ugcuagguuguuuuuaaaaccac

SEQ ID NO: 1162066 - RNA, 16 nt, Homo sapiens
ugcuaucgccaucaca

SEQ ID NO: 1162067 - RNA, 15 nt, Homo sapiens
ugcuaugaugauggu

SEQ ID NO: 1162068 - RNA, 16 nt, Homo sapiens
ugcuaugguuugccau

SEQ ID NO: 1162069 - RNA, 18 nt, Homo sapiens
ugcuauugugaugccaau

SEQ ID NO: 1162070 - RNA, 11 nt, Homo sapiens
ugcuauuucag

SEQ ID NO: 1162071 - RNA, 18 nt, Homo sapiens
ugcucaaugccauugugc

SEQ ID NO: 1162072 - RNA, 20 nt, Homo sapiens
ugcucacugaccugccugua

SEQ ID NO: 1162073 - RNA, 20 nt, Homo sapiens
ugcucacuugguccuaccua

SEQ ID NO: 1162074 - RNA, 15 nt, Homo sapiens
ugcucaggaaaccac

SEQ ID NO: 1162075 - RNA, 12 nt, Homo sapiens
ugcucagugucu

SEQ ID NO: 1162076 - RNA, 23 nt, Homo sapiens
ugcucauuccacacuguugagac

SEQ ID NO: 1162077 - RNA, 17 nt, Homo sapiens
ugcuccauagagcagug

SEQ ID NO: 1162078 - RNA, 12 nt, Homo sapiens
ugcuccaucucc

SEQ ID NO: 1162079 - RNA, 22 nt, Homo sapiens
ugcuccauguuuccaccaaaug

SEQ ID NO: 1162080 - RNA, 20 nt, Homo sapiens
ugcuccauuuucuugucaau

SEQ ID NO: 1162081 - RNA, 13 nt, Homo sapiens
ugcucccacagaa

SEQ ID NO: 1162082 - RNA, 17 nt, Homo sapiens
ugcucccggguccugcu

SEQ ID NO: 1162083 - RNA, 12 nt, Homo sapiens
ugcuccuuccaa

SEQ ID NO: 1162084 - RNA, 18 nt, Homo sapiens
ugcucgccuuagcacuac

SEQ ID NO: 1162085 - RNA, 14 nt, Homo sapiens
ugcucuaaugccaa

SEQ ID NO: 1162086 - RNA, 16 nt, Homo sapiens
ugcucuauauguaaua

SEQ ID NO: 1162087 - RNA, 18 nt, Homo sapiens
ugcucuccagccugggag

SEQ ID NO: 1162088 - RNA, 14 nt, Homo sapiens
ugcucucuggucuu

SEQ ID NO: 1162089 - RNA, 18 nt, Homo sapiens
ugcucucugugucugaga

SEQ ID NO: 1162090 - RNA, 23 nt, Homo sapiens
ugcucucuuuuucuccaggguca

SEQ ID NO: 1162091 - RNA, 20 nt, Homo sapiens
ugcucuggggcacuguugag

SEQ ID NO: 1162092 - RNA, 23 nt, Homo sapiens
ugcucugucccuauuauuugccc

SEQ ID NO: 1162093 - RNA, 18 nt, Homo sapiens
ugcucuuuuauacuguac

SEQ ID NO: 1162094 - RNA, 23 nt, Homo sapiens
ugcugaaaaaucauccaagacag

SEQ ID NO: 1162095 - RNA, 21 nt, Homo sapiens
ugcugaaucaucauaucuacu

SEQ ID NO: 1162096 - RNA, 20 nt, Homo sapiens
ugcugaaugucauuauuuga

SEQ ID NO: 1162097 - RNA, 23 nt, Homo sapiens
ugcugcauccaggacugugccag

SEQ ID NO: 1162098 - RNA, 17 nt, Homo sapiens
ugcugcugcucauucca

SEQ ID NO: 1162099 - RNA, 14 nt, Homo sapiens
ugugcugcuguaag

SEQ ID NO: 1162100 - RNA, 18 nt, Homo sapiens
ugugcugggugagcucuu

SEQ ID NO: 1162101 - RNA, 16 nt, Homo sapiens
ugugcuucagugccau

SEQ ID NO: 1162102 - RNA, 20 nt, Homo sapiens
ugugcuucagugccauugca

SEQ ID NO: 1162103 - RNA, 15 nt, Homo sapiens
ugugcuuugaaaaaa

SEQ ID NO: 1162104 - RNA, 11 nt, Homo sapiens
ugugcuuuuag

SEQ ID NO: 1162105 - RNA, 21 nt, Homo sapiens
uguggaccgaggaacaacuug

SEQ ID NO: 1162106 - RNA, 16 nt, Homo sapiens
uguggacgcugugcug

SEQ ID NO: 1162107 - RNA, 22 nt, Homo sapiens
uguggagaugcccaggauuuga

SEQ ID NO: 1162108 - RNA, 15 nt, Homo sapiens
uguggaguguggcag

SEQ ID NO: 1162109 - RNA, 17 nt, Homo sapiens
uguggauacagucauua

SEQ ID NO: 1162110 - RNA, 18 nt, Homo sapiens
uguggcaaacaaaaccaa

SEQ ID NO: 1162111 - RNA, 13 nt, Homo sapiens
uguggcagagcca

SEQ ID NO: 1162112 - RNA, 17 nt, Homo sapiens
uguggcaguuuggcaaa

SEQ ID NO: 1162113 - RNA, 17 nt, Homo sapiens
uguggcaucuugccaag

SEQ ID NO: 1162114 - RNA, 15 nt, Homo sapiens
uguggggaggcugca

SEQ ID NO: 1162115 - RNA, 17 nt, Homo sapiens
ugugggucugcagguga

SEQ ID NO: 1162116 - RNA, 17 nt, Homo sapiens
ugugguaaaugccacac

SEQ ID NO: 1162117 - RNA, 13 nt, Homo sapiens
ugugguagccuca

SEQ ID NO: 1162118 - RNA, 13 nt, Homo sapiens
uguggugugccau

SEQ ID NO: 1162119 - RNA, 22 nt, Homo sapiens
uguguaaauggcuggggggcca

SEQ ID NO: 1162120 - RNA, 15 nt, Homo sapiens
uguguaaauuucuca

SEQ ID NO: 1162121 - RNA, 14 nt, Homo sapiens
uguguacaacacug

SEQ ID NO: 1162122 - RNA, 17 nt, Homo sapiens
uguguacaacacuggug

SEQ ID NO: 1162123 - RNA, 22 nt, Homo sapiens
uguguaucaaaacuaccuguga

SEQ ID NO: 1162124 - RNA, 9 nt, Homo sapiens
uguguaugu

SEQ ID NO: 1162125 - RNA, 19 nt, Homo sapiens
ugugucagcgccuggccua

SEQ ID NO: 1162126 - RNA, 23 nt, Homo sapiens
ugugucagcgccuggccuaccca

SEQ ID NO: 1162127 - RNA, 14 nt, Homo sapiens
ugugucaugccagu

SEQ ID NO: 1162128 - RNA, 18 nt, Homo sapiens
ugugucccccucugucca

SEQ ID NO: 1162129 - RNA, 17 nt, Homo sapiens
uguguccccugaccugu

SEQ ID NO: 1162130 - RNA, 21 nt, Homo sapiens
ugugucccuggcgcugugcua

SEQ ID NO: 1162131 - RNA, 12 nt, Homo sapiens
ugugucugcaac

SEQ ID NO: 1162132 - RNA, 16 nt, Homo sapiens
ugugucuguacacgug

SEQ ID NO: 1162133 - RNA, 14 nt, Homo sapiens
ugugugaagaaagc

SEQ ID NO: 1162134 - RNA, 17 nt, Homo sapiens
ugugugagaauaaacua

SEQ ID NO: 1162135 - RNA, 18 nt, Homo sapiens
ugugugauugacagcuuu

SEQ ID NO: 1162136 - RNA, 15 nt, Homo sapiens
ugugugauuuucaua

SEQ ID NO: 1162137 - RNA, 10 nt, Homo sapiens
ugugugcaca

SEQ ID NO: 1162138 - RNA, 14 nt, Homo sapiens
ugugugccacucag

SEQ ID NO: 1162139 - RNA, 13 nt, Homo sapiens
ugugugugcacau

SEQ ID NO: 1162140 - RNA, 12 nt, Homo sapiens
uguguguucuca

SEQ ID NO: 1162141 - RNA, 21 nt, Homo sapiens
uguguguucuggggcaaccua

SEQ ID NO: 1162142 - RNA, 16 nt, Homo sapiens
uguguguucuguagag

SEQ ID NO: 1162143 - RNA, 18 nt, Homo sapiens
uguguuaguaaacugugc

SEQ ID NO: 1162144 - RNA, 16 nt, Homo sapiens
uguguugacugcugcu

SEQ ID NO: 1162145 - RNA, 15 nt, Homo sapiens
uguguuguuuccaua

SEQ ID NO: 1162146 - RNA, 21 nt, Homo sapiens
uguguuuccuucagugcaucu

SEQ ID NO: 1162147 - RNA, 19 nt, Homo sapiens
uguguuuguagucuugucu

SEQ ID NO: 1162148 - RNA, 16 nt, Homo sapiens
uguguuuuauuguggu

SEQ ID NO: 1162149 - RNA, 14 nt, Homo sapiens
uguguuuuuaauaa

SEQ ID NO: 1162150 - RNA, 13 nt, Homo sapiens
uguuaacauuagc

SEQ ID NO: 1162151 - RNA, 19 nt, Homo sapiens
uguuaacauuagcaaauau

SEQ ID NO: 1162152 - RNA, 15 nt, Homo sapiens
uguuaagguucaaga

SEQ ID NO: 1162153 - RNA, 19 nt, Homo sapiens
uguuaauuuuuugguacaa

SEQ ID NO: 1162154 - RNA, 12 nt, Homo sapiens
uguuaccaaaua

SEQ ID NO: 1162155 - RNA, 13 nt, Homo sapiens
uguuacccacugc

SEQ ID NO: 1162156 - RNA, 23 nt, Homo sapiens
uguuacuagagaagaagccuucu

SEQ ID NO: 1162157 - RNA, 18 nt, Homo sapiens
uguuacugccuaucagca

SEQ ID NO: 1162158 - RNA, 16 nt, Homo sapiens
uguuacuuaaacauca

SEQ ID NO: 1162159 - RNA, 17 nt, Homo sapiens
uguuaguucuagcucua

SEQ ID NO: 1162160 - RNA, 14 nt, Homo sapiens
uguuauaacuucau

SEQ ID NO: 1162161 - RNA, 20 nt, Homo sapiens
uguuaucuuauacuguacaa

SEQ ID NO: 1162162 - RNA, 12 nt, Homo sapiens
uguuauucuugu

SEQ ID NO: 1162163 - RNA, 14 nt, Homo sapiens
uguucaaauagagc

SEQ ID NO: 1162164 - RNA, 12 nt, Homo sapiens
uguucaaaugua

SEQ ID NO: 1162165 - RNA, 23 nt, Homo sapiens
uguucacacuuuucagcaaaaau

SEQ ID NO: 1162166 - RNA, 14 nt, Homo sapiens
uguucacauaugau

SEQ ID NO: 1162167 - RNA, 13 nt, Homo sapiens
uguucaccagaga

SEQ ID NO: 1162168 - RNA, 18 nt, Homo sapiens
uguucaccaucccaaagc

SEQ ID NO: 1162169 - RNA, 22 nt, Homo sapiens
uguucaugugauuaacucuuag

SEQ ID NO: 1162170 - RNA, 22 nt, Homo sapiens
uguuccacuuggaaauggcaug

SEQ ID NO: 1162171 - RNA, 22 nt, Homo sapiens
uguucccacaccccaacacuuc

SEQ ID NO: 1162172 - RNA, 20 nt, Homo sapiens
uguucccauuggaugcauuu

SEQ ID NO: 1162173 - RNA, 16 nt, Homo sapiens
uguucccccugugcag

SEQ ID NO: 1162174 - RNA, 13 nt, Homo sapiens
uguuccugucuca

SEQ ID NO: 1162175 - RNA, 23 nt, Homo sapiens
uguucuacuuuuugguacaggua

SEQ ID NO: 1162176 - RNA, 24 nt, Homo sapiens
uguucuccuaaugcucugaaagga

SEQ ID NO: 1162177 - RNA, 21 nt, Homo sapiens
uguucuggggggacccagugc

SEQ ID NO: 1162178 - RNA, 23 nt, Homo sapiens
uguucuggggggacccagugcag

SEQ ID NO: 1162179 - RNA, 17 nt, Homo sapiens
uguucuggguccauaca

SEQ ID NO: 1162180 - RNA, 13 nt, Homo sapiens
uguucuucagaga

SEQ ID NO: 1162181 - RNA, 15 nt, Homo sapiens
uguugaggauguguc

SEQ ID NO: 1162182 - RNA, 21 nt, Homo sapiens
uguugcaaaucacucugcaau

SEQ ID NO: 1162183 - RNA, 14 nt, Homo sapiens
uguugcauauacca

SEQ ID NO: 1162184 - RNA, 21 nt, Homo sapiens
uguugcucucugugucugaga

SEQ ID NO: 1162185 - RNA, 19 nt, Homo sapiens
uguugcugcugcugcucau

SEQ ID NO: 1162186 - RNA, 17 nt, Homo sapiens
uguugcuuuguugcacu

SEQ ID NO: 1162187 - RNA, 14 nt, Homo sapiens
uguuggaauucacu

SEQ ID NO: 1162188 - RNA, 19 nt, Homo sapiens
uguuggagaugcagccuuc

SEQ ID NO: 1162189 - RNA, 19 nt, Homo sapiens
uguuggagguuaaggcaua

SEQ ID NO: 1162190 - RNA, 18 nt, Homo sapiens
uguuggaguguaaaccaa

SEQ ID NO: 1162191 - RNA, 18 nt, Homo sapiens
uguuggcaaggagccagg

SEQ ID NO: 1162192 - RNA, 21 nt, Homo sapiens
uguuggcuuucccuuaucaaa

SEQ ID NO: 1162193 - RNA, 22 nt, Homo sapiens
uguuggucacauggagcucuuc

SEQ ID NO: 1162194 - RNA, 13 nt, Homo sapiens
uguuggugacaau

SEQ ID NO: 1162195 - RNA, 17 nt, Homo sapiens
uguuguaagaaagacaa

SEQ ID NO: 1162196 - RNA, 15 nt, Homo sapiens
uguugucauguguau

SEQ ID NO: 1162197 - RNA, 14 nt, Homo sapiens
uguuguuaucauga

SEQ ID NO: 1162198 - RNA, 17 nt, Homo sapiens
uguuuaaacuuugacaa

SEQ ID NO: 1162199 - RNA, 20 nt, Homo sapiens
uguuuaaauauaaaucugau

SEQ ID NO: 1162200 - RNA, 17 nt, Homo sapiens
uguuuagaaagaauauu

SEQ ID NO: 1162201 - RNA, 17 nt, Homo sapiens
uguuuagcuuccuccag

SEQ ID NO: 1162202 - RNA, 15 nt, Homo sapiens
uguuuauacagcuca

SEQ ID NO: 1162203 - RNA, 20 nt, Homo sapiens
uguuucaauugcaucuccca

SEQ ID NO: 1162204 - RNA, 15 nt, Homo sapiens
uguuucagacuuuug

SEQ ID NO: 1162205 - RNA, 18 nt, Homo sapiens
uguuucagcugcaguuga

SEQ ID NO: 1162206 - RNA, 15 nt, Homo sapiens
uguuucauuaaucaa

SEQ ID NO: 1162207 - RNA, 20 nt, Homo sapiens
uguuuccagauuacacucca

SEQ ID NO: 1162208 - RNA, 22 nt, Homo sapiens
uguuuccagauuacacuccagc

SEQ ID NO: 1162209 - RNA, 23 nt, Homo sapiens
uguuuccccccuuuucagaauag

SEQ ID NO: 1162210 - RNA, 17 nt, Homo sapiens
uguuuccuaauaucaaa

SEQ ID NO: 1162211 - RNA, 22 nt, Homo sapiens
uguuucucugccgcuaccuccc

SEQ ID NO: 1162212 - RNA, 18 nt, Homo sapiens
uguuugcccuuuggccag

SEQ ID NO: 1162213 - RNA, 22 nt, Homo sapiens
uguuugcccuuuggccagugac

SEQ ID NO: 1162214 - RNA, 19 nt, Homo sapiens
uguuugguaguuuugccaa

SEQ ID NO: 1162215 - RNA, 12 nt, Homo sapiens
uguuugucucac

SEQ ID NO: 1162216 - RNA, 16 nt, Homo sapiens
uguuuguucacacucc

SEQ ID NO: 1162217 - RNA, 17 nt, Homo sapiens
uguuuguucacacuccu

SEQ ID NO: 1162218 - RNA, 21 nt, Homo sapiens
uguuuguuuauuagaugaauu

SEQ ID NO: 1162219 - RNA, 20 nt, Homo sapiens
uguuuuaaauuuugugguuc

SEQ ID NO: 1162220 - RNA, 13 nt, Homo sapiens
uguuuuaucauua

SEQ ID NO: 1162221 - RNA, 14 nt, Homo sapiens
uguuuugcacugac

SEQ ID NO: 1162222 - RNA, 20 nt, Homo sapiens
uguuuugccauguuggccag

SEQ ID NO: 1162223 - RNA, 15 nt, Homo sapiens
uguuuuugcaccaga

SEQ ID NO: 1162224 - RNA, 19 nt, Homo sapiens
uuaaaaaaaaaaaguacaa

SEQ ID NO: 1162225 - RNA, 20 nt, Homo sapiens
uuaaaaaaaauuaaaaccaa

SEQ ID NO: 1162226 - RNA, 16 nt, Homo sapiens
uuaaaaaacacuucau

SEQ ID NO: 1162227 - RNA, 17 nt, Homo sapiens
uuccucuacagauuguc

SEQ ID NO: 1162228 - RNA, 17 nt, Homo sapiens
uuccugaauacugaaac

SEQ ID NO: 1162229 - RNA, 20 nt, Homo sapiens
uuccugaauguguucuuggu

SEQ ID NO: 1162230 - RNA, 17 nt, Homo sapiens
uuccugacuuaaaacaa

SEQ ID NO: 1162231 - RNA, 14 nt, Homo sapiens
uuccugcacauuaa

SEQ ID NO: 1162232 - RNA, 15 nt, Homo sapiens
uuccugcuuauucau

SEQ ID NO: 1162233 - RNA, 21 nt, Homo sapiens
uuccuggaaaacucaugaaua

SEQ ID NO: 1162234 - RNA, 20 nt, Homo sapiens
uuccuggucagaaccggccu

SEQ ID NO: 1162235 - RNA, 11 nt, Homo sapiens
uuccuguaaau

SEQ ID NO: 1162236 - RNA, 15 nt, Homo sapiens
uuccuguccagcucc

SEQ ID NO: 1162237 - RNA, 16 nt, Homo sapiens
uuccuguguucucuua

SEQ ID NO: 1162238 - RNA, 17 nt, Homo sapiens
uuccuguuuuaagcagc

SEQ ID NO: 1162239 - RNA, 12 nt, Homo sapiens
uuccuuaccucc

SEQ ID NO: 1162240 - RNA, 16 nt, Homo sapiens
uuccuuaucacugaca

SEQ ID NO: 1162241 - RNA, 14 nt, Homo sapiens
uuccuuccugagaa

SEQ ID NO: 1162242 - RNA, 13 nt, Homo sapiens
uugaaagaaccag

SEQ ID NO: 1162243 - RNA, 21 nt, Homo sapiens
uugaaagacuuccaaagaaug

SEQ ID NO: 1162244 - RNA, 17 nt, Homo sapiens
uugaaagcaagucauuc

SEQ ID NO: 1162245 - RNA, 19 nt, Homo sapiens
uugaaaucagcauacucaa

SEQ ID NO: 1162246 - RNA, 17 nt, Homo sapiens
uugaaauuaaccauaga

SEQ ID NO: 1162247 - RNA, 18 nt, Homo sapiens
uugaaauuccaguugcaa

SEQ ID NO: 1162248 - RNA, 12 nt, Homo sapiens
uugaacccuuuu

SEQ ID NO: 1162249 - RNA, 13 nt, Homo sapiens
uugaaccugggaa

SEQ ID NO: 1162250 - RNA, 14 nt, Homo sapiens
uugaacucagggag

SEQ ID NO: 1162251 - RNA, 14 nt, Homo sapiens
uugaacuccugacg

SEQ ID NO: 1162252 - RNA, 17 nt, Homo sapiens
uugaagaggccaaagga

SEQ ID NO: 1162253 - RNA, 21 nt, Homo sapiens
uugaagaugcuuguauuuuac

SEQ ID NO: 1162254 - RNA, 18 nt, Homo sapiens
uugaagguggcuacaaag

SEQ ID NO: 1162255 - RNA, 15 nt, Homo sapiens
uugaaguaacuauaa

SEQ ID NO: 1162256 - RNA, 18 nt, Homo sapiens
uugaaguauucaaucaag

SEQ ID NO: 1162257 - RNA, 14 nt, Homo sapiens
uugaagugagcuga

SEQ ID NO: 1162258 - RNA, 13 nt, Homo sapiens
uugaaucuaugaa

SEQ ID NO: 1162259 - RNA, 21 nt, Homo sapiens
uugaauggguccauuuugccc

SEQ ID NO: 1162260 - RNA, 17 nt, Homo sapiens
uugaauucuuuugccaa

SEQ ID NO: 1162261 - RNA, 15 nt, Homo sapiens
uugaauuucagaaaa

SEQ ID NO: 1162262 - RNA, 19 nt, Homo sapiens
uugacaaagaaacccaagu

SEQ ID NO: 1162263 - RNA, 13 nt, Homo sapiens
uugacacaggaaa

SEQ ID NO: 1162264 - RNA, 22 nt, Homo sapiens
uugaccacucuuccugaguuca

SEQ ID NO: 1162265 - RNA, 22 nt, Homo sapiens
uugacguaagcucuaucugcaa

SEQ ID NO: 1162266 - RNA, 13 nt, Homo sapiens
uugacgucacuga

SEQ ID NO: 1162267 - RNA, 15 nt, Homo sapiens
uugacuaccugaugu

SEQ ID NO: 1162268 - RNA, 17 nt, Homo sapiens
uugacugaagacauuuc

SEQ ID NO: 1162269 - RNA, 11 nt, Homo sapiens
uugagacagag

SEQ ID NO: 1162270 - RNA, 18 nt, Homo sapiens
uugagauguaagucucaa

SEQ ID NO: 1162271 - RNA, 21 nt, Homo sapiens
uugagauuuagagcaaugcau

SEQ ID NO: 1162272 - RNA, 13 nt, Homo sapiens
uugagcagcaucu

SEQ ID NO: 1162273 - RNA, 19 nt, Homo sapiens
uugagcaucagugagguua

SEQ ID NO: 1162274 - RNA, 14 nt, Homo sapiens
uugagcguuugcac

SEQ ID NO: 1162275 - RNA, 17 nt, Homo sapiens
uugagcucuucuuaaag

SEQ ID NO: 1162276 - RNA, 19 nt, Homo sapiens
uugaguacagauacuguga

SEQ ID NO: 1162277 - RNA, 16 nt, Homo sapiens
uugagucucugaacau

SEQ ID NO: 1162278 - RNA, 17 nt, Homo sapiens
uugauaagcacauuaaa

SEQ ID NO: 1162279 - RNA, 13 nt, Homo sapiens
uugauaauccaaa

SEQ ID NO: 1162280 - RNA, 16 nt, Homo sapiens
uugauaauugcauuca

SEQ ID NO: 1162281 - RNA, 23 nt, Homo sapiens
uugauagaaaugccaagcacuuc

SEQ ID NO: 1162282 - RNA, 16 nt, Homo sapiens
uugauagcagauauca

SEQ ID NO: 1162283 - RNA, 22 nt, Homo sapiens
uugaucuggaacccagacucag

SEQ ID NO: 1162284 - RNA, 20 nt, Homo sapiens
uugaugcuugagccuuugac

SEQ ID NO: 1162285 - RNA, 17 nt, Homo sapiens
uugauuauagcaaugug

SEQ ID NO: 1162286 - RNA, 17 nt, Homo sapiens
uugauucaaagcacugu

SEQ ID NO: 1162287 - RNA, 14 nt, Homo sapiens
uugauucaguauua

SEQ ID NO: 1162288 - RNA, 14 nt, Homo sapiens
uugauucugauaau

SEQ ID NO: 1162289 - RNA, 15 nt, Homo sapiens
uugauuuuuugccca

SEQ ID NO: 1162290 - RNA, 19 nt, Homo sapiens
uugcaaagguuccaacugu

SEQ ID NO: 1162291 - RNA, 21 nt, Homo sapiens
uugcaaagguuccaacuguau

SEQ ID NO: 1162292 - RNA, 20 nt, Homo sapiens
uugcaacagcuuucugagaa

SEQ ID NO: 1162293 - RNA, 14 nt, Homo sapiens
uugcaaccucgcug

SEQ ID NO: 1162294 - RNA, 22 nt, Homo sapiens
uugcaaccucgcuggacucuca

SEQ ID NO: 1162295 - RNA, 16 nt, Homo sapiens
uugcaagacccaggga

SEQ ID NO: 1162296 - RNA, 13 nt, Homo sapiens
uugcaaggcauuu

SEQ ID NO: 1162297 - RNA, 15 nt, Homo sapiens
uugcaauucauaacu

SEQ ID NO: 1162298 - RNA, 20 nt, Homo sapiens
uugcaauuggaauaaucacu

SEQ ID NO: 1162299 - RNA, 13 nt, Homo sapiens
uugcaauuguuaa

SEQ ID NO: 1162300 - RNA, 22 nt, Homo sapiens
uugcacaaacuugugagcauca

SEQ ID NO: 1162301 - RNA, 17 nt, Homo sapiens
uugcacagaagcacaug

SEQ ID NO: 1162302 - RNA, 22 nt, Homo sapiens
uugcacauaguagguacccaau

SEQ ID NO: 1162303 - RNA, 20 nt, Homo sapiens
uugcaccuaaguguguacua

SEQ ID NO: 1162304 - RNA, 18 nt, Homo sapiens
uugcacuaucuuucagcu

SEQ ID NO: 1162305 - RNA, 14 nt, Homo sapiens
uugcacuggauaaa

SEQ ID NO: 1162306 - RNA, 22 nt, Homo sapiens
uugcacuggauaaacaaaggua

SEQ ID NO: 1162307 - RNA, 16 nt, Homo sapiens
uugcagaaauacagua

SEQ ID NO: 1162308 - RNA, 19 nt, Homo sapiens
uugcagaaauacaguauga

SEQ ID NO: 1162309 - RNA, 19 nt, Homo sapiens
uugcagaaccagugacaau

SEQ ID NO: 1162310 - RNA, 13 nt, Homo sapiens
uugcagacaggaa

SEQ ID NO: 1162311 - RNA, 16 nt, Homo sapiens
uugcagcaggugguaa

SEQ ID NO: 1162312 - RNA, 12 nt, Homo sapiens
uugcagccaaag

SEQ ID NO: 1162313 - RNA, 20 nt, Homo sapiens
uugcagcuggacuucuccac

SEQ ID NO: 1162314 - RNA, 21 nt, Homo sapiens
uugcagucuguauuuuccacc

SEQ ID NO: 1162315 - RNA, 19 nt, Homo sapiens
uugcauagcagcugcuacu

SEQ ID NO: 1162316 - RNA, 21 nt, Homo sapiens
uugcauauaccaguugugaua

SEQ ID NO: 1162317 - RNA, 24 nt, Homo sapiens
uugcaucacagucacaugcccauu

SEQ ID NO: 1162318 - RNA, 22 nt, Homo sapiens
uugcauccaugcccagccaaua

SEQ ID NO: 1162319 - RNA, 18 nt, Homo sapiens
uugcaugaaauuuugccu

SEQ ID NO: 1162320 - RNA, 14 nt, Homo sapiens
uugcaugugaaaau

SEQ ID NO: 1162321 - RNA, 20 nt, Homo sapiens
uugcauuacgauaaacauua

SEQ ID NO: 1162322 - RNA, 14 nt, Homo sapiens
uugcauugauucag

SEQ ID NO: 1162323 - RNA, 13 nt, Homo sapiens
uugcauugcagag

SEQ ID NO: 1162324 - RNA, 18 nt, Homo sapiens
uugcauuuugauauugcu

SEQ ID NO: 1162325 - RNA, 15 nt, Homo sapiens
uugccaaaaccaaga

SEQ ID NO: 1162326 - RNA, 21 nt, Homo sapiens
uugccaauuuuccuacucuca

SEQ ID NO: 1162327 - RNA, 19 nt, Homo sapiens
uugccacccaagagagaac

SEQ ID NO: 1162328 - RNA, 13 nt, Homo sapiens
uugccauguguuu

SEQ ID NO: 1162329 - RNA, 20 nt, Homo sapiens
uugcccaggcuagagugcaa

SEQ ID NO: 1162330 - RNA, 22 nt, Homo sapiens
uugcccauggaagucucaaaga

SEQ ID NO: 1162331 - RNA, 19 nt, Homo sapiens
uugcccuaauucaucuuuu

SEQ ID NO: 1162332 - RNA, 18 nt, Homo sapiens
uugcccuuccuacuccuc

SEQ ID NO: 1162333 - RNA, 17 nt, Homo sapiens
uugcccuuuggccagug

SEQ ID NO: 1162334 - RNA, 23 nt, Homo sapiens
uugccuaaggugcguaguccaac

SEQ ID NO: 1162335 - RNA, 14 nt, Homo sapiens
uugccuccaggugc

SEQ ID NO: 1162336 - RNA, 22 nt, Homo sapiens
uugccucuacuuugauucugau

SEQ ID NO: 1162337 - RNA, 16 nt, Homo sapiens
uugccucuugcaaugc

SEQ ID NO: 1162338 - RNA, 22 nt, Homo sapiens
uugccugaaacccauuuacuua

SEQ ID NO: 1162339 - RNA, 16 nt, Homo sapiens
uugccuucuaggucac

SEQ ID NO: 1162340 - RNA, 13 nt, Homo sapiens
uugccuucuccac

SEQ ID NO: 1162341 - RNA, 15 nt, Homo sapiens
uugccuugcauuugu

SEQ ID NO: 1162342 - RNA, 21 nt, Homo sapiens
uugccuuuccauaaucacuca

SEQ ID NO: 1162343 - RNA, 18 nt, Homo sapiens
uugcuaagcguggcauuc

SEQ ID NO: 1162344 - RNA, 21 nt, Homo sapiens
uugcuagguuuugcuacauga

SEQ ID NO: 1162345 - RNA, 15 nt, Homo sapiens
uugcuauauugccca

SEQ ID NO: 1162346 - RNA, 23 nt, Homo sapiens
uugcucagugggggcagagccac

SEQ ID NO: 1162347 - RNA, 12 nt, Homo sapiens
uugcuccauuuu

SEQ ID NO: 1162348 - RNA, 17 nt, Homo sapiens
uugcucgaagacuguga

SEQ ID NO: 1162349 - RNA, 20 nt, Homo sapiens
uugcucuaggaagacauuuu

SEQ ID NO: 1162350 - RNA, 19 nt, Homo sapiens
uugcucucgacaguaucca

SEQ ID NO: 1162351 - RNA, 18 nt, Homo sapiens
uugcugaaugucauuauu

SEQ ID NO: 1162352 - RNA, 22 nt, Homo sapiens
uugcugaccauuuuggauguca

SEQ ID NO: 1162353 - RNA, 23 nt, Homo sapiens
uugcugaccucagcgguugccag

SEQ ID NO: 1162354 - RNA, 21 nt, Homo sapiens
uugcugauaccauaugaauga

SEQ ID NO: 1162355 - RNA, 16 nt, Homo sapiens
uugcuggaaaccaagu

SEQ ID NO: 1162356 - RNA, 15 nt, Homo sapiens
uugcuggaguacuua

SEQ ID NO: 1162357 - RNA, 16 nt, Homo sapiens
uugcuuauuacauuua

SEQ ID NO: 1162358 - RNA, 19 nt, Homo sapiens
uuuaaaccuuuuucuugau

SEQ ID NO: 1162359 - RNA, 19 nt, Homo sapiens
uuuaaacguuaaaagugua

SEQ ID NO: 1162360 - RNA, 13 nt, Homo sapiens
uuuaaagcaaaca

SEQ ID NO: 1162361 - RNA, 13 nt, Homo sapiens
uuuaaaggacaaa

SEQ ID NO: 1162362 - RNA, 18 nt, Homo sapiens
uuuaaaggcccuaucugu

SEQ ID NO: 1162363 - RNA, 15 nt, Homo sapiens
uuuaaagugcucuua

SEQ ID NO: 1162364 - RNA, 14 nt, Homo sapiens
uuuaaauaaaugga

SEQ ID NO: 1162365 - RNA, 17 nt, Homo sapiens
uuuaaaugucugcaugc

SEQ ID NO: 1162366 - RNA, 13 nt, Homo sapiens
uuuaacaguaccu

SEQ ID NO: 1162367 - RNA, 19 nt, Homo sapiens
uuuaacauuguugauuuca

SEQ ID NO: 1162368 - RNA, 14 nt, Homo sapiens
uuuaacccauuugu

SEQ ID NO: 1162369 - RNA, 18 nt, Homo sapiens
uuuaacccauuugucucu

SEQ ID NO: 1162370 - RNA, 19 nt, Homo sapiens
uuuaacugccaauccuuaa

SEQ ID NO: 1162371 - RNA, 14 nt, Homo sapiens
uuuaagaauuucac

SEQ ID NO: 1162372 - RNA, 13 nt, Homo sapiens
uuuaagacacugu

SEQ ID NO: 1162373 - RNA, 16 nt, Homo sapiens
uuuaagcagcucuaaa

SEQ ID NO: 1162374 - RNA, 12 nt, Homo sapiens
uuuaaggcagca

SEQ ID NO: 1162375 - RNA, 19 nt, Homo sapiens
uuuaaguaaaaauccaaaa

SEQ ID NO: 1162376 - RNA, 12 nt, Homo sapiens
uuuaaguaggaa

SEQ ID NO: 1162377 - RNA, 15 nt, Homo sapiens
uuuaauccuagagau

SEQ ID NO: 1162378 - RNA, 19 nt, Homo sapiens
uuuaaugccgauauacucu

SEQ ID NO: 1162379 - RNA, 22 nt, Homo sapiens
uuuaauggacacuuuucaccuc

SEQ ID NO: 1162380 - RNA, 20 nt, Homo sapiens
uuuaauguagacauuaucuu

SEQ ID NO: 1162381 - RNA, 15 nt, Homo sapiens
uuuaaugugaacucu

SEQ ID NO: 1162382 - RNA, 13 nt, Homo sapiens
uuuaauuaucuaa

SEQ ID NO: 1162383 - RNA, 15 nt, Homo sapiens
uuuaauugcauuuaa

SEQ ID NO: 1162384 - RNA, 20 nt, Homo sapiens
uuuacaaaacuacaugagaa

SEQ ID NO: 1162385 - RNA, 16 nt, Homo sapiens
uuuacaagugcugcaa

SEQ ID NO: 1162386 - RNA, 22 nt, Homo sapiens
uuuacacugaguuucuauuuag

SEQ ID NO: 1162387 - RNA, 12 nt, Homo sapiens
uuuacagaauuu

SEQ ID NO: 1162388 - RNA, 23 nt, Homo sapiens
uuuacagccagugggagauguua

SEQ ID NO: 1162389 - RNA, 17 nt, Homo sapiens
uuuacagcccucagcaa

SEQ ID NO: 1162390 - RNA, 11 nt, Homo sapiens
uuuacauauag

SEQ ID NO: 1162391 - RNA, 22 nt, Homo sapiens
uuuacaucccagacacauucac

SEQ ID NO: 1162392 - RNA, 22 nt, Homo sapiens
uuuacuaaaauggcagcuuaaa

SEQ ID NO: 1162393 - RNA, 21 nt, Homo sapiens
uuuacuaagaugacauugcua

SEQ ID NO: 1162394 - RNA, 22 nt, Homo sapiens
uuuacuagcaccugccagggag

SEQ ID NO: 1162395 - RNA, 17 nt, Homo sapiens
uuuacugagacaaugua

SEQ ID NO: 1162396 - RNA, 17 nt, Homo sapiens
uuuacuuccccuaugga

SEQ ID NO: 1162397 - RNA, 10 nt, Homo sapiens
uuuacuuuag

SEQ ID NO: 1162398 - RNA, 17 nt, Homo sapiens
uuuacuuuauugcccua

SEQ ID NO: 1162399 - RNA, 22 nt, Homo sapiens
uuuagaaaaagaacaugcaguu

SEQ ID NO: 1162400 - RNA, 18 nt, Homo sapiens
uuuagaaagaauauucau

SEQ ID NO: 1162401 - RNA, 20 nt, Homo sapiens
uuuagaacagagggaccaaa

SEQ ID NO: 1162402 - RNA, 17 nt, Homo sapiens
uuuagaagugucauguu

SEQ ID NO: 1162403 - RNA, 16 nt, Homo sapiens
uuuagcagaggagcca

SEQ ID NO: 1162404 - RNA, 18 nt, Homo sapiens
uuuagcagaggagccaug

SEQ ID NO: 1162405 - RNA, 13 nt, Homo sapiens
uuuaggcucagaa

SEQ ID NO: 1162406 - RNA, 17 nt, Homo sapiens
uuuagguucccaaaccu

SEQ ID NO: 1162407 - RNA, 21 nt, Homo sapiens
uuuagguucccaaaccuucag

SEQ ID NO: 1162408 - RNA, 17 nt, Homo sapiens
uuuaguacuuacaucag

SEQ ID NO: 1162409 - RNA, 19 nt, Homo sapiens
uuuaguagccuuacuguga

SEQ ID NO: 1162410 - RNA, 16 nt, Homo sapiens
uuuaguauuugugcau

SEQ ID NO: 1162411 - RNA, 17 nt, Homo sapiens
uuuaguuccaacaaaga

SEQ ID NO: 1162412 - RNA, 22 nt, Homo sapiens
uuuauaaaaaugagugcuuaaa

SEQ ID NO: 1162413 - RNA, 13 nt, Homo sapiens
uuuauaaaaucaa

SEQ ID NO: 1162414 - RNA, 21 nt, Homo sapiens
uuuauaaacaguuuuacuugu

SEQ ID NO: 1162415 - RNA, 13 nt, Homo sapiens
uuuauaauguugu

SEQ ID NO: 1162416 - RNA, 13 nt, Homo sapiens
uuuauacauucua

SEQ ID NO: 1162417 - RNA, 14 nt, Homo sapiens
uuuauacugcacuu

SEQ ID NO: 1162418 - RNA, 23 nt, Homo sapiens
uuuauagauggucacgcaccugg

SEQ ID NO: 1162419 - RNA, 20 nt, Homo sapiens
uuuauagucgaacaauucau

SEQ ID NO: 1162420 - RNA, 20 nt, Homo sapiens
uuuauauagcaagugcuauu

SEQ ID NO: 1162421 - RNA, 17 nt, Homo sapiens
uuuauaugaaaacacuc

SEQ ID NO: 1162422 - RNA, 13 nt, Homo sapiens
uuuauauguugcu

SEQ ID NO: 1162423 - RNA, 19 nt, Homo sapiens
uuuauauguugcuauaaua

SEQ ID NO: 1162424 - RNA, 14 nt, Homo sapiens
uuuauauucaacuc

SEQ ID NO: 1162425 - RNA, 14 nt, Homo sapiens
uuuauauuugucaa

SEQ ID NO: 1162426 - RNA, 21 nt, Homo sapiens
uuuauauuuuuuuaacuguga

SEQ ID NO: 1162427 - RNA, 20 nt, Homo sapiens
uuuaucaagagacuccugaa

SEQ ID NO: 1162428 - RNA, 14 nt, Homo sapiens
uuuaucacuguugc

SEQ ID NO: 1162429 - RNA, 20 nt, Homo sapiens
uuuaucauucaaguguaaaa

SEQ ID NO: 1162430 - RNA, 16 nt, Homo sapiens
uuuauccucacauaaa

SEQ ID NO: 1162431 - RNA, 18 nt, Homo sapiens
uuuaucuguuuuguacuu

SEQ ID NO: 1162432 - RNA, 22 nt, Homo sapiens
uuuauggcucacacagcuuaag

SEQ ID NO: 1162433 - RNA, 18 nt, Homo sapiens
uuuaugggaacccucuuu

SEQ ID NO: 1162434 - RNA, 23 nt, Homo sapiens
uuuauguguuugacgggaaacaa

SEQ ID NO: 1162435 - RNA, 14 nt, Homo sapiens
uuuauuaaagcaau

SEQ ID NO: 1162436 - RNA, 22 nt, Homo sapiens
uuuauuacuguuguaucuaugu

SEQ ID NO: 1162437 - RNA, 18 nt, Homo sapiens
uuuauucaagaaugccag

SEQ ID NO: 1162438 - RNA, 23 nt, Homo sapiens
uuuauugaagaaaugaaagguga

SEQ ID NO: 1162439 - RNA, 13 nt, Homo sapiens
uuuauugcaaugc

SEQ ID NO: 1162440 - RNA, 14 nt, Homo sapiens
uuuauugcaugaga

SEQ ID NO: 1162441 - RNA, 23 nt, Homo sapiens
uuuauuguguguucucacaguga

SEQ ID NO: 1162442 - RNA, 16 nt, Homo sapiens
uuuauuucugaucuau

SEQ ID NO: 1162443 - RNA, 21 nt, Homo sapiens
uuuauuucuucccgcacaaau

SEQ ID NO: 1162444 - RNA, 20 nt, Homo sapiens
uuucaaaaauuacacuacaa

SEQ ID NO: 1162445 - RNA, 11 nt, Homo sapiens
uuucaaaacaa

SEQ ID NO: 1162446 - RNA, 14 nt, Homo sapiens
uuucaaacauauau

SEQ ID NO: 1162447 - RNA, 14 nt, Homo sapiens
uuucaagacuugau

SEQ ID NO: 1162448 - RNA, 16 nt, Homo sapiens
uuucaagucauauucu

SEQ ID NO: 1162449 - RNA, 18 nt, Homo sapiens
uuucacuaaaagugugug

SEQ ID NO: 1162450 - RNA, 22 nt, Homo sapiens
uuucacuacaaucgcuaccuga

SEQ ID NO: 1162451 - RNA, 14 nt, Homo sapiens
uuucagaauuuugc

SEQ ID NO: 1162452 - RNA, 20 nt, Homo sapiens
uuucagauguggcaauucag

SEQ ID NO: 1162453 - RNA, 16 nt, Homo sapiens
uuucagcccacgucac

SEQ ID NO: 1162454 - RNA, 17 nt, Homo sapiens
uuucagccgagguccaa

SEQ ID NO: 1162455 - RNA, 19 nt, Homo sapiens
uuucaggcuccccagauca

SEQ ID NO: 1162456 - RNA, 19 nt, Homo sapiens
uuucauacccaugucagau

SEQ ID NO: 1162457 - RNA, 21 nt, Homo sapiens
uuucaucacacuggguggugg

SEQ ID NO: 1162458 - RNA, 20 nt, Homo sapiens
uuucaucuauuauacuuuau

SEQ ID NO: 1162459 - RNA, 21 nt, Homo sapiens
uuucaucucuuucuacucucc

SEQ ID NO: 1162460 - RNA, 14 nt, Homo sapiens
uuucaugugcuaua

SEQ ID NO: 1162461 - RNA, 13 nt, Homo sapiens
uuuccaaagacaa

SEQ ID NO: 1162462 - RNA, 17 nt, Homo sapiens
uuuccaauuauuugacu

SEQ ID NO: 1162463 - RNA, 18 nt, Homo sapiens
uuuccaauuauuugacuu

SEQ ID NO: 1162464 - RNA, 22 nt, Homo sapiens
uuuccacaagauucccagagac

SEQ ID NO: 1162465 - RNA, 18 nt, Homo sapiens
uuuccacuacugcuacca

SEQ ID NO: 1162466 - RNA, 19 nt, Homo sapiens
uuuccacucccacugccag

SEQ ID NO: 1162467 - RNA, 20 nt, Homo sapiens
uuuccagcuacuuuugccaa

SEQ ID NO: 1162468 - RNA, 21 nt, Homo sapiens
uuuccauaaucacucagugau

SEQ ID NO: 1162469 - RNA, 16 nt, Homo sapiens
uuucccaacaccucuu

SEQ ID NO: 1162470 - RNA, 18 nt, Homo sapiens
uuuccccaccuuccuuac

SEQ ID NO: 1162471 - RNA, 19 nt, Homo sapiens
uuuccccagugacaccuca

SEQ ID NO: 1162472 - RNA, 22 nt, Homo sapiens
uuucccucuucccugaccuccc

SEQ ID NO: 1162473 - RNA, 23 nt, Homo sapiens
uuucccugaaggaaccaaagcga

SEQ ID NO: 1162474 - RNA, 21 nt, Homo sapiens
uuucccugggagcuguucucu

SEQ ID NO: 1162475 - RNA, 22 nt, Homo sapiens
uuucccuuccugggucuaccac

SEQ ID NO: 1162476 - RNA, 18 nt, Homo sapiens
uuuccgugagcuaugaua

SEQ ID NO: 1162477 - RNA, 16 nt, Homo sapiens
uuuccuaggcagauca

SEQ ID NO: 1162478 - RNA, 16 nt, Homo sapiens
uuuccuaugugcugua

SEQ ID NO: 1162479 - RNA, 22 nt, Homo sapiens
uuuccucagugcauuugugcua

SEQ ID NO: 1162480 - RNA, 19 nt, Homo sapiens
uuuccuccaaaguaaugua

SEQ ID NO: 1162481 - RNA, 17 nt, Homo sapiens
uuuccuccucccagugc

SEQ ID NO: 1162482 - RNA, 12 nt, Homo sapiens
uuuccuccugag

SEQ ID NO: 1162483 - RNA, 13 nt, Homo sapiens
uuuccucuugggc

SEQ ID NO: 1162484 - RNA, 15 nt, Homo sapiens
uuuccugacaauaaa

SEQ ID NO: 1162485 - RNA, 23 nt, Homo sapiens
uuuccuguuucugaaaagaaaua

SEQ ID NO: 1162486 - RNA, 20 nt, Homo sapiens
uuuccuucggguuggcaaaa

SEQ ID NO: 1162487 - RNA, 15 nt, Homo sapiens
uuuccuuugcgcaaa

SEQ ID NO: 1162488 - RNA, 18 nt, Homo sapiens
uuuccuuugguccuucaa

SEQ ID NO: 1162489 - RNA, 15 nt, Homo sapiens
uuuccuuuuaugaga

SEQ ID NO: 1162490 - RNA, 21 nt, Homo sapiens
ucuccuacuguagcaaccuga

SEQ ID NO: 1162491 - RNA, 15 nt, Homo sapiens
ucuccucucuuggca

SEQ ID NO: 1162492 - RNA, 20 nt, Homo sapiens
ucuccucugcagcucaggga

SEQ ID NO: 1162493 - RNA, 17 nt, Homo sapiens
ucuccugacaugucuca

SEQ ID NO: 1162494 - RNA, 12 nt, Homo sapiens
ucuccugagcua

SEQ ID NO: 1162495 - RNA, 13 nt, Homo sapiens
ucuccuguaaaac

SEQ ID NO: 1162496 - RNA, 16 nt, Homo sapiens
ucuccuguccaaccua

SEQ ID NO: 1162497 - RNA, 15 nt, Homo sapiens
ucuccugugcauugu

SEQ ID NO: 1162498 - RNA, 12 nt, Homo sapiens
ucuccuugcagu

SEQ ID NO: 1162499 - RNA, 20 nt, Homo sapiens
ucucgaacuccuaaccucaa

SEQ ID NO: 1162500 - RNA, 14 nt, Homo sapiens
ucucgaugcugcug

SEQ ID NO: 1162501 - RNA, 20 nt, Homo sapiens
ucucggcucacugcaaccuc

SEQ ID NO: 1162502 - RNA, 15 nt, Homo sapiens
ucucgguuugccaaa

SEQ ID NO: 1162503 - RNA, 18 nt, Homo sapiens
ucucgucuccugacaugu

SEQ ID NO: 1162504 - RNA, 15 nt, Homo sapiens
ucucguuucaaaaac

SEQ ID NO: 1162505 - RNA, 15 nt, Homo sapiens
ucucuaaaagcuuua

SEQ ID NO: 1162506 - RNA, 18 nt, Homo sapiens
ucucuaaagaaaaucucu

SEQ ID NO: 1162507 - RNA, 14 nt, Homo sapiens
aaaagugaucucug

SEQ ID NO: 1162508 - RNA, 15 nt, Homo sapiens
aaaagugaucucugg

SEQ ID NO: 1162509 - RNA, 18 nt, Homo sapiens
aaaaguggcguuguucau

SEQ ID NO: 1162510 - RNA, 16 nt, Homo sapiens
aaaaguguuguuauca

SEQ ID NO: 1162511 - RNA, 19 nt, Homo sapiens
aaaaguuaaugaauaugcc

SEQ ID NO: 1162512 - RNA, 11 nt, Homo sapiens
aaaaguucuca

SEQ ID NO: 1162513 - RNA, 14 nt, Homo sapiens
aaaaguuucacagg

SEQ ID NO: 1162514 - RNA, 19 nt, Homo sapiens
aaaaguuuguuacuuugaa

SEQ ID NO: 1162515 - RNA, 17 nt, Homo sapiens
aaaauaaagcuguucuc

SEQ ID NO: 1162516 - RNA, 21 nt, Homo sapiens
aaaauacaaaaaucagccaga

SEQ ID NO: 1162517 - RNA, 23 nt, Homo sapiens
aaaauacuguaagucucaauuaa

SEQ ID NO: 1162518 - RNA, 19 nt, Homo sapiens
aaaauaggauugcuucaau

SEQ ID NO: 1162519 - RNA, 16 nt, Homo sapiens
aaaauagguuuguagu

SEQ ID NO: 1162520 - RNA, 18 nt, Homo sapiens
aaaauaguuaagacauga

SEQ ID NO: 1162521 - RNA, 20 nt, Homo sapiens
aaaauauuucagauaucaaa

SEQ ID NO: 1162522 - RNA, 22 nt, Homo sapiens
aaaaucaaaucauccugucaca

SEQ ID NO: 1162523 - RNA, 15 nt, Homo sapiens
aaaaucacacuguaa

SEQ ID NO: 1162524 - RNA, 11 nt, Homo sapiens
aaaauccugcu

SEQ ID NO: 1162525 - RNA, 16 nt, Homo sapiens
aaaauccuuacuucca

SEQ ID NO: 1162526 - RNA, 14 nt, Homo sapiens
aaaaucuauuauca

SEQ ID NO: 1162527 - RNA, 17 nt, Homo sapiens
aaaaugagauucaguga

SEQ ID NO: 1162528 - RNA, 14 nt, Homo sapiens
aaaaugagcaaaag

SEQ ID NO: 1162529 - RNA, 23 nt, Homo sapiens
aaaaugccaaaacuuaccuauaa

SEQ ID NO: 1162530 - RNA, 15 nt, Homo sapiens
aaaauggaauuacuc

SEQ ID NO: 1162531 - RNA, 16 nt, Homo sapiens
aaaaugggaucuuucu

SEQ ID NO: 1162532 - RNA, 19 nt, Homo sapiens
aaaaugguggcuucagcuc

SEQ ID NO: 1162533 - RNA, 16 nt, Homo sapiens
aaaauguccugccuuu

SEQ ID NO: 1162534 - RNA, 13 nt, Homo sapiens
aaaaugugaacuu

SEQ ID NO: 1162535 - RNA, 11 nt, Homo sapiens
aaaauguucuc

SEQ ID NO: 1162536 - RNA, 15 nt, Homo sapiens
aaaauguuggugcaa

SEQ ID NO: 1162537 - RNA, 20 nt, Homo sapiens
aaaauguuuuucaaaacaau

SEQ ID NO: 1162538 - RNA, 14 nt, Homo sapiens
aaaauuaacaugau

SEQ ID NO: 1162539 - RNA, 16 nt, Homo sapiens
aaaauuaauagcuuuu

SEQ ID NO: 1162540 - RNA, 13 nt, Homo sapiens
aaaauuacaaaga

SEQ ID NO: 1162541 - RNA, 21 nt, Homo sapiens
aaaauuagcugggcauggugc

SEQ ID NO: 1162542 - RNA, 17 nt, Homo sapiens
aaaauuauaguagcuua

SEQ ID NO: 1162543 - RNA, 14 nt, Homo sapiens
aaaauuaugaccau

SEQ ID NO: 1162544 - RNA, 20 nt, Homo sapiens
aaaauucagcggcagugugu

SEQ ID NO: 1162545 - RNA, 21 nt, Homo sapiens
aaaauucagguauuacugaau

SEQ ID NO: 1162546 - RNA, 15 nt, Homo sapiens
aaaauucuuggaaua

SEQ ID NO: 1162547 - RNA, 13 nt, Homo sapiens
aaaauuucuacua

SEQ ID NO: 1162548 - RNA, 19 nt, Homo sapiens
aaaauuuuaaguguucucg

SEQ ID NO: 1162549 - RNA, 22 nt, Homo sapiens
aaaauuuuuuuuguaacuggag

SEQ ID NO: 1162550 - RNA, 16 nt, Homo sapiens
aaacaaaaaugauccu

SEQ ID NO: 1162551 - RNA, 17 nt, Homo sapiens
aaacaaaauuugacuaa

SEQ ID NO: 1162552 - RNA, 15 nt, Homo sapiens
aaacaaacaaaucaa

SEQ ID NO: 1162553 - RNA, 13 nt, Homo sapiens
aaacaaagccaga

SEQ ID NO: 1162554 - RNA, 18 nt, Homo sapiens
aaacaaaggaaguucucc

SEQ ID NO: 1162555 - RNA, 16 nt, Homo sapiens
aaacaacagcuuuaaa

SEQ ID NO: 1162556 - RNA, 20 nt, Homo sapiens
aaacaacuaaauaacuguau

SEQ ID NO: 1162557 - RNA, 21 nt, Homo sapiens
acaagcaagggucuccuucaa

SEQ ID NO: 1162558 - RNA, 22 nt, Homo sapiens
acaagcaccucuccugugagug

SEQ ID NO: 1162559 - RNA, 13 nt, Homo sapiens
acaagccaagaaa

SEQ ID NO: 1162560 - RNA, 17 nt, Homo sapiens
acaagcuauucccucaa

SEQ ID NO: 1162561 - RNA, 16 nt, Homo sapiens
acaaggacacgcgccc

SEQ ID NO: 1162562 - RNA, 22 nt, Homo sapiens
acaaggcaggaggagcugauaa

SEQ ID NO: 1162563 - RNA, 22 nt, Homo sapiens
acaagggacuagugagucagca

SEQ ID NO: 1162564 - RNA, 22 nt, Homo sapiens
acaaggggcuccacaccuuugc

SEQ ID NO: 1162565 - RNA, 18 nt, Homo sapiens
acaaguauggcuccucca

SEQ ID NO: 1162566 - RNA, 20 nt, Homo sapiens
acaagucauaccuacauuca

SEQ ID NO: 1162567 - RNA, 17 nt, Homo sapiens
acaagucgaugaacuau

SEQ ID NO: 1162568 - RNA, 16 nt, Homo sapiens
acaaguuggaauucac

SEQ ID NO: 1162569 - RNA, 21 nt, Homo sapiens
acaauaaguaaauccacaggc

SEQ ID NO: 1162570 - RNA, 20 nt, Homo sapiens
acaaucugaaucccuugcaa

SEQ ID NO: 1162571 - RNA, 20 nt, Homo sapiens
acaaucuguucuacucuuaa

SEQ ID NO: 1162572 - RNA, 14 nt, Homo sapiens
acaaucuugaacau

SEQ ID NO: 1162573 - RNA, 12 nt, Homo sapiens
acaaugaaauau

SEQ ID NO: 1162574 - RNA, 16 nt, Homo sapiens
acaaugaaaugcucuc

SEQ ID NO: 1162575 - RNA, 10 nt, Homo sapiens
acaaugcaca

SEQ ID NO: 1162576 - RNA, 12 nt, Homo sapiens
acaaugcugauu

SEQ ID NO: 1162577 - RNA, 15 nt, Homo sapiens
acaauguauaagcua

SEQ ID NO: 1162578 - RNA, 12 nt, Homo sapiens
acaauguuugcu

SEQ ID NO: 1162579 - RNA, 20 nt, Homo sapiens
acaauguuuuaaacauucuu

SEQ ID NO: 1162580 - RNA, 15 nt, Homo sapiens
acaauuaacugcccu

SEQ ID NO: 1162581 - RNA, 18 nt, Homo sapiens
acaauuauaucaguccuc

SEQ ID NO: 1162582 - RNA, 21 nt, Homo sapiens
acaauuauuuuuacaguucuc

SEQ ID NO: 1162583 - RNA, 19 nt, Homo sapiens
acaauuccuccucuggcca

SEQ ID NO: 1162584 - RNA, 16 nt, Homo sapiens
acaauugacaacaguu

SEQ ID NO: 1162585 - RNA, 22 nt, Homo sapiens
acaauugacaacaguuacauaa

SEQ ID NO: 1162586 - RNA, 21 nt, Homo sapiens
acaauugcuuuaacagucaaa

SEQ ID NO: 1162587 - RNA, 23 nt, Homo sapiens
acacaaauaaaggaaacccagcu

SEQ ID NO: 1162588 - RNA, 12 nt, Homo sapiens
acacaacaugua

SEQ ID NO: 1162589 - RNA, 13 nt, Homo sapiens
acacaacauguau

SEQ ID NO: 1162590 - RNA, 20 nt, Homo sapiens
acacaaccaacgcgaaacca

SEQ ID NO: 1162591 - RNA, 19 nt, Homo sapiens
acacaaccuacucugcaaa

SEQ ID NO: 1162592 - RNA, 19 nt, Homo sapiens
acacaaguggguaguguca

SEQ ID NO: 1162593 - RNA, 18 nt, Homo sapiens
acacaaugauuuuguaca

SEQ ID NO: 1162594 - RNA, 15 nt, Homo sapiens
acacacacaguuuga

SEQ ID NO: 1162595 - RNA, 12 nt, Homo sapiens
acacacacuccu

SEQ ID NO: 1162596 - RNA, 17 nt, Homo sapiens
acacacaucuaucuaua

SEQ ID NO: 1162597 - RNA, 23 nt, Homo sapiens
acacacgccacccagccucuugu

SEQ ID NO: 1162598 - RNA, 16 nt, Homo sapiens
acacacggaggcaucc

SEQ ID NO: 1162599 - RNA, 20 nt, Homo sapiens
acacacuuuauaacccaaaa

SEQ ID NO: 1162600 - RNA, 13 nt, Homo sapiens
acacagacucauc

SEQ ID NO: 1162601 - RNA, 22 nt, Homo sapiens
acacagcccuggccucugcuca

SEQ ID NO: 1162602 - RNA, 19 nt, Homo sapiens
acacagguggugucacugu

SEQ ID NO: 1162603 - RNA, 18 nt, Homo sapiens
acacaguguuuuuguaaa

SEQ ID NO: 1162604 - RNA, 17 nt, Homo sapiens
acacaucaggaguucaa

SEQ ID NO: 1162605 - RNA, 17 nt, Homo sapiens
acacauggaaacccaua

SEQ ID NO: 1162606 - RNA, 17 nt, Homo sapiens
acacauuaaaagacaaa

SEQ ID NO: 1162607 - RNA, 23 nt, Homo sapiens
acacauuaaaagacaaauaugua

SEQ ID NO: 1162608 - RNA, 21 nt, Homo sapiens
acacauucuuaacacaugucc

SEQ ID NO: 1162609 - RNA, 20 nt, Homo sapiens
acaccacacacaacagccaa

SEQ ID NO: 1162610 - RNA, 21 nt, Homo sapiens
acaccacuuggagaucuuugc

SEQ ID NO: 1162611 - RNA, 17 nt, Homo sapiens
gcaggacuggauuuuaa

SEQ ID NO: 1162612 - RNA, 17 nt, Homo sapiens
gcaggagaaucgcuuga

SEQ ID NO: 1162613 - RNA, 18 nt, Homo sapiens
gcaggauguuggccacca

SEQ ID NO: 1162614 - RNA, 15 nt, Homo sapiens
gcaggccagggcagu

SEQ ID NO: 1162615 - RNA, 20 nt, Homo sapiens
gcaggcuguuuauauguuca

SEQ ID NO: 1162616 - RNA, 19 nt, Homo sapiens
gcaggcuuugaguccagca

SEQ ID NO: 1162617 - RNA, 14 nt, Homo sapiens
gcagggacccgggg

SEQ ID NO: 1162618 - RNA, 11 nt, Homo sapiens
gcagggccagg

SEQ ID NO: 1162619 - RNA, 20 nt, Homo sapiens
gcagggcggucuucugcucc

SEQ ID NO: 1162620 - RNA, 20 nt, Homo sapiens
gcagggcugguuuguucuga

SEQ ID NO: 1162621 - RNA, 12 nt, Homo sapiens
gcaggggacugg

SEQ ID NO: 1162622 - RNA, 22 nt, Homo sapiens
gcaggggcuggagggaggcggg

SEQ ID NO: 1162623 - RNA, 14 nt, Homo sapiens
gcaggguaccugaa

SEQ ID NO: 1162624 - RNA, 17 nt, Homo sapiens
gcagguaacuagcugag

SEQ ID NO: 1162625 - RNA, 16 nt, Homo sapiens
gcaggugaaacccagu

SEQ ID NO: 1162626 - RNA, 20 nt, Homo sapiens
gcaggugaaacccagucacu

SEQ ID NO: 1162627 - RNA, 11 nt, Homo sapiens
gcaggugcugc

SEQ ID NO: 1162628 - RNA, 16 nt, Homo sapiens
gcagguucccaagcuc

SEQ ID NO: 1162629 - RNA, 13 nt, Homo sapiens
gcagguuugcaau

SEQ ID NO: 1162630 - RNA, 13 nt, Homo sapiens
gcagucagggaca

SEQ ID NO: 1162631 - RNA, 22 nt, Homo sapiens
gcagucauuaugagaggcaaug

SEQ ID NO: 1162632 - RNA, 16 nt, Homo sapiens
gcagucuguccaggcu

SEQ ID NO: 1162633 - RNA, 15 nt, Homo sapiens
gcagugagcugagau

SEQ ID NO: 1162634 - RNA, 22 nt, Homo sapiens
gcagugauccugcaaguucaag

SEQ ID NO: 1162635 - RNA, 21 nt, Homo sapiens
gcagugaugcuggaugcuccu

SEQ ID NO: 1162636 - RNA, 18 nt, Homo sapiens
gcaguggcuucuuuccag

SEQ ID NO: 1162637 - RNA, 13 nt, Homo sapiens
gcagugguuugaa

SEQ ID NO: 1162638 - RNA, 19 nt, Homo sapiens
gcaguguauagaaaaacca

SEQ ID NO: 1162639 - RNA, 18 nt, Homo sapiens
gcaguguguccaucauau

SEQ ID NO: 1162640 - RNA, 23 nt, Homo sapiens
gcaguuacucccuacacugaugc

SEQ ID NO: 1162641 - RNA, 10 nt, Homo sapiens
gcaguuauug

SEQ ID NO: 1162642 - RNA, 13 nt, Homo sapiens
gcaguuuaaucuu

SEQ ID NO: 1162643 - RNA, 19 nt, Homo sapiens
gcauaagcuuaugcuuaaa

SEQ ID NO: 1162644 - RNA, 17 nt, Homo sapiens
gcauaaucagacaagcu

SEQ ID NO: 1162645 - RNA, 19 nt, Homo sapiens
gcauagaauucacaaugca

SEQ ID NO: 1162646 - RNA, 19 nt, Homo sapiens
gcauagaguauagcucugu

SEQ ID NO: 1162647 - RNA, 20 nt, Homo sapiens
gcauagaguauagcucugua

SEQ ID NO: 1162648 - RNA, 16 nt, Homo sapiens
gcauaguccaaaaagc

SEQ ID NO: 1162649 - RNA, 15 nt, Homo sapiens
gcauauguugaauac

SEQ ID NO: 1162650 - RNA, 18 nt, Homo sapiens
gcauauuguacacuuuuu

SEQ ID NO: 1162651 - RNA, 23 nt, Homo sapiens
gcauauuuauccaaaauguguau

SEQ ID NO: 1162652 - RNA, 21 nt, Homo sapiens
gcauauuuuguggcauuugaa

SEQ ID NO: 1162653 - RNA, 20 nt, Homo sapiens
gcaucaauuccaucagcaca

SEQ ID NO: 1162654 - RNA, 16 nt, Homo sapiens
gcaucacagaauguga

SEQ ID NO: 1162655 - RNA, 15 nt, Homo sapiens
gcaucacaugaugaa

SEQ ID NO: 1162656 - RNA, 16 nt, Homo sapiens
gcaucagagagacugu

SEQ ID NO: 1162657 - RNA, 13 nt, Homo sapiens
gcaucaguucacu

SEQ ID NO: 1162658 - RNA, 22 nt, Homo sapiens
gcauccaucugggcuaccccac

SEQ ID NO: 1162659 - RNA, 12 nt, Homo sapiens
gcauccuagucu

SEQ ID NO: 1162660 - RNA, 18 nt, Homo sapiens
gcauccuccagggggccc

SEQ ID NO: 1162661 - RNA, 12 nt, Homo sapiens
gcauccugugaa

SEQ ID NO: 1162662 - RNA, 17 nt, Homo sapiens
gcaucgaccacaccagc

SEQ ID NO: 1162663 - RNA, 16 nt, Homo sapiens
gcaucuacacaauuua

SEQ ID NO: 1162664 - RNA, 11 nt, Homo sapiens
gcaucuacccu

SEQ ID NO: 1162665 - RNA, 21 nt, Homo sapiens
gcaucucccacacaagaccca

SEQ ID NO: 1162666 - RNA, 21 nt, Homo sapiens
gcaucucugcauuuauccuau

SEQ ID NO: 1162667 - RNA, 15 nt, Homo sapiens
gcaucugaccagcag

SEQ ID NO: 1162668 - RNA, 16 nt, Homo sapiens
gcaucugcuacugugu

SEQ ID NO: 1162669 - RNA, 20 nt, Homo sapiens
gcaucugggcaggaugacuu

SEQ ID NO: 1162670 - RNA, 21 nt, Homo sapiens
gcaucuuccagaagugugauu

SEQ ID NO: 1162671 - RNA, 16 nt, Homo sapiens
gcaugaaauuuugccu

SEQ ID NO: 1162672 - RNA, 20 nt, Homo sapiens
gcaugcaaaagaaagcaaau

SEQ ID NO: 1162673 - RNA, 19 nt, Homo sapiens
gcaugcaggucuccaugaa

SEQ ID NO: 1162674 - RNA, 16 nt, Homo sapiens
gcauggaaaccaaaag

SEQ ID NO: 1162675 - RNA, 19 nt, Homo sapiens
gcauggaacuaaaauguua

SEQ ID NO: 1162676 - RNA, 16 nt, Homo sapiens
gcauggguuagugcua

SEQ ID NO: 1162677 - RNA, 18 nt, Homo sapiens
gcauguaaaaaccuugua

SEQ ID NO: 1162678 - RNA, 17 nt, Homo sapiens
gcaugugugaaacauac

SEQ ID NO: 1162679 - RNA, 21 nt, Homo sapiens
gcauguuucucccauuuagaa

SEQ ID NO: 1162680 - RNA, 16 nt, Homo sapiens
gcauuaaaacaaagga

SEQ ID NO: 1162681 - RNA, 15 nt, Homo sapiens
gcauuacaguauuuu

SEQ ID NO: 1162682 - RNA, 13 nt, Homo sapiens
gcauuagugcuga

SEQ ID NO: 1162683 - RNA, 14 nt, Homo sapiens
gcauuagugcugau

SEQ ID NO: 1162684 - RNA, 15 nt, Homo sapiens
gcauuagugcugaua

SEQ ID NO: 1162685 - RNA, 17 nt, Homo sapiens
gcauuauguccacugug

SEQ ID NO: 1162686 - RNA, 22 nt, Homo sapiens
gcauucaaaaagacagcagaca

SEQ ID NO: 1162687 - RNA, 19 nt, Homo sapiens
gcauucuaucguuauuaua

SEQ ID NO: 1162688 - RNA, 22 nt, Homo sapiens
gcauucucagccacaaccaaaa

SEQ ID NO: 1162689 - RNA, 15 nt, Homo sapiens
gcauucuuugcaaua

SEQ ID NO: 1162690 - RNA, 10 nt, Homo sapiens
gcauugcuga

SEQ ID NO: 1162691 - RNA, 14 nt, Homo sapiens
gcauugcuuuccac

SEQ ID NO: 1162692 - RNA, 17 nt, Homo sapiens
gcauuguaucgauguua

SEQ ID NO: 1162693 - RNA, 19 nt, Homo sapiens
gcauuguaucgauguuaug

SEQ ID NO: 1162694 - RNA, 20 nt, Homo sapiens
gcauuuagacccugcauuua

SEQ ID NO: 1162695 - RNA, 21 nt, Homo sapiens
gcauuugucaaugacaguuuc

SEQ ID NO: 1162696 - RNA, 17 nt, Homo sapiens
gcauuuucaagcaguua

SEQ ID NO: 1162697 - RNA, 19 nt, Homo sapiens
gcauuuuucuaaugggcua

SEQ ID NO: 1162698 - RNA, 23 nt, Homo sapiens
gccaaaccucuguucaguguaaa

SEQ ID NO: 1162699 - RNA, 20 nt, Homo sapiens
gccaacaagguuauaugaau

SEQ ID NO: 1162700 - RNA, 17 nt, Homo sapiens
gccaaccccacccagcu

SEQ ID NO: 1162701 - RNA, 16 nt, Homo sapiens
gccaacugcccaagcc

SEQ ID NO: 1162702 - RNA, 20 nt, Homo sapiens
aucauguuuuuucugcaaug

SEQ ID NO: 1162703 - RNA, 21 nt, Homo sapiens
aucauguuuuuucugcaauga

SEQ ID NO: 1162704 - RNA, 22 nt, Homo sapiens
aucauuaaccacuuaucagugu

SEQ ID NO: 1162705 - RNA, 23 nt, Homo sapiens
aucauuaaggucauuacucucaa

SEQ ID NO: 1162706 - RNA, 16 nt, Homo sapiens
aucauucccucucauc

SEQ ID NO: 1162707 - RNA, 16 nt, Homo sapiens
aucauucucauucuca

SEQ ID NO: 1162708 - RNA, 17 nt, Homo sapiens
aucauugggccaguucc

SEQ ID NO: 1162709 - RNA, 21 nt, Homo sapiens
aucauuucaaaacucauuucc

SEQ ID NO: 1162710 - RNA, 18 nt, Homo sapiens
aucauuuccguuuugccu

SEQ ID NO: 1162711 - RNA, 15 nt, Homo sapiens
aucauuuugugauuc

SEQ ID NO: 1162712 - RNA, 11 nt, Homo sapiens
auccaaaaaga

SEQ ID NO: 1162713 - RNA, 15 nt, Homo sapiens
auccaaaacacaaac

SEQ ID NO: 1162714 - RNA, 14 nt, Homo sapiens
auccaaaucugucc

SEQ ID NO: 1162715 - RNA, 22 nt, Homo sapiens
auccaaauugccugaacauggc

SEQ ID NO: 1162716 - RNA, 23 nt, Homo sapiens
auccaagcgaggucaacagagaa

SEQ ID NO: 1162717 - RNA, 21 nt, Homo sapiens
auccaaggccgcggcccagac

SEQ ID NO: 1162718 - RNA, 21 nt, Homo sapiens
augccgagcguccucuuggcu

SEQ ID NO: 1162719 - RNA, 18 nt, Homo sapiens
augccuauaaaaugccca

SEQ ID NO: 1162720 - RNA, 21 nt, Homo sapiens
augccugacuagggagccaug

SEQ ID NO: 1162721 - RNA, 22 nt, Homo sapiens
augccugauuuuaaaagguuga

SEQ ID NO: 1162722 - RNA, 12 nt, Homo sapiens
augccugugucu

SEQ ID NO: 1162723 - RNA, 15 nt, Homo sapiens
augcuaaaaauguca

SEQ ID NO: 1162724 - RNA, 17 nt, Homo sapiens
augcuaaauaacuauau

SEQ ID NO: 1162725 - RNA, 16 nt, Homo sapiens
augcuacgugugauuu

SEQ ID NO: 1162726 - RNA, 20 nt, Homo sapiens
augcuagcgcguugccuguc

SEQ ID NO: 1162727 - RNA, 13 nt, Homo sapiens
augcucaguaccu

SEQ ID NO: 1162728 - RNA, 12 nt, Homo sapiens
augcuccaagau

SEQ ID NO: 1162729 - RNA, 13 nt, Homo sapiens
augcuccuuccaa

SEQ ID NO: 1162730 - RNA, 14 nt, Homo sapiens
augcucucuggucu

SEQ ID NO: 1162731 - RNA, 18 nt, Homo sapiens
augcucuuguucuguucc

SEQ ID NO: 1162732 - RNA, 14 nt, Homo sapiens
augcugacagcucu

SEQ ID NO: 1162733 - RNA, 19 nt, Homo sapiens
augcugaccugacuugccu

SEQ ID NO: 1162734 - RNA, 22 nt, Homo sapiens
augcuggaaaauaauacugcug

SEQ ID NO: 1162735 - RNA, 17 nt, Homo sapiens
augcuggcugguggaac

SEQ ID NO: 1162736 - RNA, 14 nt, Homo sapiens
augcuguacaugac

SEQ ID NO: 1162737 - RNA, 17 nt, Homo sapiens
augcuguacaugacauc

SEQ ID NO: 1162738 - RNA, 19 nt, Homo sapiens
augcugugauugugccuac

SEQ ID NO: 1162739 - RNA, 14 nt, Homo sapiens
augcugugugagac

SEQ ID NO: 1162740 - RNA, 22 nt, Homo sapiens
augcuguuaugaguggcuuuaa

SEQ ID NO: 1162741 - RNA, 14 nt, Homo sapiens
augcuuauggaaag

SEQ ID NO: 1162742 - RNA, 21 nt, Homo sapiens
augcuuauguguugcauaaac

SEQ ID NO: 1162743 - RNA, 19 nt, Homo sapiens
acagcacccucuccagaug

SEQ ID NO: 1162744 - RNA, 15 nt, Homo sapiens
acagcagccuggggc

SEQ ID NO: 1162745 - RNA, 12 nt, Homo sapiens
acagcauugcuu

SEQ ID NO: 1162746 - RNA, 22 nt, Homo sapiens
acagccaccuggagaacuucau

SEQ ID NO: 1162747 - RNA, 20 nt, Homo sapiens
acagccacuccccuccacuc

SEQ ID NO: 1162748 - RNA, 23 nt, Homo sapiens
acagccacuuuuagcuacugcua

SEQ ID NO: 1162749 - RNA, 23 nt, Homo sapiens
acagccagugggagauguuagac

SEQ ID NO: 1162750 - RNA, 13 nt, Homo sapiens
acagccagugugu

SEQ ID NO: 1162751 - RNA, 15 nt, Homo sapiens
acagcccaacagcug

SEQ ID NO: 1162752 - RNA, 19 nt, Homo sapiens
acagcccaacagcuguucc

SEQ ID NO: 1162753 - RNA, 21 nt, Homo sapiens
acagccccugcuuuuucccuu

SEQ ID NO: 1162754 - RNA, 20 nt, Homo sapiens
acagccugagucaccugcag

SEQ ID NO: 1162755 - RNA, 14 nt, Homo sapiens
acagccuucacuuu

SEQ ID NO: 1162756 - RNA, 20 nt, Homo sapiens
acagccuuucugaacugacu

SEQ ID NO: 1162757 - RNA, 15 nt, Homo sapiens
acagccuuuucccuu

SEQ ID NO: 1162758 - RNA, 19 nt, Homo sapiens
acagcgagagggagaccca

SEQ ID NO: 1162759 - RNA, 18 nt, Homo sapiens
acagcggcuggacuugga

SEQ ID NO: 1162760 - RNA, 12 nt, Homo sapiens
acagcuacucuc

SEQ ID NO: 1162761 - RNA, 17 nt, Homo sapiens
acagcuacucuccccac

SEQ ID NO: 1162762 - RNA, 21 nt, Homo sapiens
acagcuacucuccccacgagg

SEQ ID NO: 1162763 - RNA, 23 nt, Homo sapiens
acagcucgggcccucugugagau

SEQ ID NO: 1162764 - RNA, 15 nt, Homo sapiens
acagcuuuccucaaa

SEQ ID NO: 1162765 - RNA, 20 nt, Homo sapiens
aaugagacauaggccaugaa

SEQ ID NO: 1162766 - RNA, 21 nt, Homo sapiens
aaugagacauaggccaugaaa

SEQ ID NO: 1162767 - RNA, 17 nt, Homo sapiens
aaugagccgagaucacg

SEQ ID NO: 1162768 - RNA, 22 nt, Homo sapiens
aaugaggcugcuuuccaaagcc

SEQ ID NO: 1162769 - RNA, 15 nt, Homo sapiens
aaugaguagacauug

SEQ ID NO: 1162770 - RNA, 12 nt, Homo sapiens
aaugagugcuua

SEQ ID NO: 1162771 - RNA, 17 nt, Homo sapiens
aaugaguggacaaguca

SEQ ID NO: 1162772 - RNA, 20 nt, Homo sapiens
aaugaguuaugaguuauuca

SEQ ID NO: 1162773 - RNA, 13 nt, Homo sapiens
aaugauccuguau

SEQ ID NO: 1162774 - RNA, 18 nt, Homo sapiens
aaugcaaacugggaugaa

SEQ ID NO: 1162775 - RNA, 21 nt, Homo sapiens
aaugcacacagcggcugccuc

SEQ ID NO: 1162776 - RNA, 13 nt, Homo sapiens
aaugcacuuucua

SEQ ID NO: 1162777 - RNA, 22 nt, Homo sapiens
aaugcagacaaacaaacauaaa

SEQ ID NO: 1162778 - RNA, 16 nt, Homo sapiens
aaugcagcagggaugc

SEQ ID NO: 1162779 - RNA, 15 nt, Homo sapiens
aaugcauaagcuuuu

SEQ ID NO: 1162780 - RNA, 15 nt, Homo sapiens
aaugcaucacaugau

SEQ ID NO: 1162781 - RNA, 23 nt, Homo sapiens
aaugcauuagauuaucaaaaagu

SEQ ID NO: 1162782 - RNA, 21 nt, Homo sapiens
aaugcauuguaucgauguuau

SEQ ID NO: 1162783 - RNA, 19 nt, Homo sapiens
aaugcauuucuaaagccau

SEQ ID NO: 1162784 - RNA, 12 nt, Homo sapiens
aaugccaaaaaa

SEQ ID NO: 1162785 - RNA, 19 nt, Homo sapiens
aaugccaaugucagcauca

SEQ ID NO: 1162786 - RNA, 21 nt, Homo sapiens
aaugccauaauacaaaaggcu

SEQ ID NO: 1162787 - RNA, 23 nt, Homo sapiens
aaugccgguguuuuaaguggaaa

SEQ ID NO: 1162788 - RNA, 23 nt, Homo sapiens
aaugccugacuagggagccaugu

SEQ ID NO: 1162789 - RNA, 20 nt, Homo sapiens
aaugccuuauaaaccugcag

SEQ ID NO: 1162790 - RNA, 13 nt, Homo sapiens
aaugccuuuuugu

SEQ ID NO: 1162791 - RNA, 17 nt, Homo sapiens
aaugcuacauacuccaa

SEQ ID NO: 1162792 - RNA, 16 nt, Homo sapiens
aaugcuacugaaacuu

SEQ ID NO: 1162793 - RNA, 18 nt, Homo sapiens
aaugcuacugaaacuuac

SEQ ID NO: 1162794 - RNA, 19 nt, Homo sapiens
aaugcuacugucucacuga

SEQ ID NO: 1162795 - RNA, 15 nt, Homo sapiens
aaugcucaccuuuau

SEQ ID NO: 1162796 - RNA, 13 nt, Homo sapiens
aaugcucuugucc

SEQ ID NO: 1162797 - RNA, 19 nt, Homo sapiens
aaugcugaugaaucacugu

SEQ ID NO: 1162798 - RNA, 19 nt, Homo sapiens
aaugcugugcaaacagugu

SEQ ID NO: 1162799 - RNA, 14 nt, Homo sapiens
aaugcuuacuucua

SEQ ID NO: 1162800 - RNA, 23 nt, Homo sapiens
aaugcuucucucauagugucaua

SEQ ID NO: 1162801 - RNA, 18 nt, Homo sapiens
aaugcuuucuguggacac

SEQ ID NO: 1162802 - RNA, 12 nt, Homo sapiens
aauggaaccagg

SEQ ID NO: 1162803 - RNA, 14 nt, Homo sapiens
aauggaacuaucuc

SEQ ID NO: 1162804 - RNA, 22 nt, Homo sapiens
aauggaauccgugauaccgaag

SEQ ID NO: 1162805 - RNA, 18 nt, Homo sapiens
aauggaggcaacgccaga

SEQ ID NO: 1162806 - RNA, 20 nt, Homo sapiens
aauggcuaagauaccaaaac

SEQ ID NO: 1162807 - RNA, 15 nt, Homo sapiens
aauggcucugugaaa

SEQ ID NO: 1162808 - RNA, 18 nt, Homo sapiens
aauggcuuugucuugaaa

SEQ ID NO: 1162809 - RNA, 19 nt, Homo sapiens
aaugggaauuuauaaccca

SEQ ID NO: 1162810 - RNA, 22 nt, Homo sapiens
aaugggcauugagaucuacugg

SEQ ID NO: 1162811 - RNA, 13 nt, Homo sapiens
aauggggccagau

SEQ ID NO: 1162812 - RNA, 22 nt, Homo sapiens
aaugguccacacccaauuccac

SEQ ID NO: 1162813 - RNA, 17 nt, Homo sapiens
aaugguggcuucagcuc

SEQ ID NO: 1162814 - RNA, 20 nt, Homo sapiens
aauggugugaucucggcuca

SEQ ID NO: 1162815 - RNA, 23 nt, Homo sapiens
aaugguuaguggucucuacugug

SEQ ID NO: 1162816 - RNA, 16 nt, Homo sapiens
aaugguuccauucucu

SEQ ID NO: 1162817 - RNA, 23 nt, Homo sapiens
aaugguuucacuugcucuuugac

SEQ ID NO: 1162818 - RNA, 20 nt, Homo sapiens
aaugguuuucuaauaucuua

SEQ ID NO: 1162819 - RNA, 15 nt, Homo sapiens
aauguaacugugcca

SEQ ID NO: 1162820 - RNA, 17 nt, Homo sapiens
aauguacagacauauuu

SEQ ID NO: 1162821 - RNA, 16 nt, Homo sapiens
aauguacucuugaacu

SEQ ID NO: 1162822 - RNA, 17 nt, Homo sapiens
aauguacucuugaacuu

SEQ ID NO: 1162823 - RNA, 22 nt, Homo sapiens
aauguacucuugaacuucuuac

SEQ ID NO: 1162824 - RNA, 20 nt, Homo sapiens
aauguagacugaaaagccau

SEQ ID NO: 1162825 - RNA, 22 nt, Homo sapiens
aauguagacugaaaagccaugu

SEQ ID NO: 1162826 - RNA, 12 nt, Homo sapiens
aauguauaccag

SEQ ID NO: 1162827 - RNA, 20 nt, Homo sapiens
aauguauauuuugaugagcu

SEQ ID NO: 1162828 - RNA, 15 nt, Homo sapiens
aauguaucacauuga

SEQ ID NO: 1162829 - RNA, 14 nt, Homo sapiens
aauguaugugcucu

SEQ ID NO: 1162830 - RNA, 15 nt, Homo sapiens
aauguauuaauaucu

SEQ ID NO: 1162831 - RNA, 19 nt, Homo sapiens
aauguauuuugaaaacacu

SEQ ID NO: 1162832 - RNA, 13 nt, Homo sapiens
aaugucaccaugc

SEQ ID NO: 1162833 - RNA, 13 nt, Homo sapiens
aauguccauuuau

SEQ ID NO: 1162834 - RNA, 18 nt, Homo sapiens
aauguccugaauccagca

SEQ ID NO: 1162835 - RNA, 19 nt, Homo sapiens
aaugucucggucacaucag

SEQ ID NO: 1162836 - RNA, 17 nt, Homo sapiens
aaugucugugaauuuca

SEQ ID NO: 1162837 - RNA, 20 nt, Homo sapiens
aaugucuuguguauuucucu

SEQ ID NO: 1162838 - RNA, 11 nt, Homo sapiens
aaugugaaauu

SEQ ID NO: 1162839 - RNA, 14 nt, Homo sapiens
aaugugacuacuua

SEQ ID NO: 1162840 - RNA, 22 nt, Homo sapiens
aaugugacuucaugcuauauau

SEQ ID NO: 1162841 - RNA, 21 nt, Homo sapiens
aaugugcagcucccauuuggc

SEQ ID NO: 1162842 - RNA, 19 nt, Homo sapiens
aaugugucugcaacaugga

SEQ ID NO: 1162843 - RNA, 20 nt, Homo sapiens
aauguguguauuuagugaaa

SEQ ID NO: 1162844 - RNA, 19 nt, Homo sapiens
aauguguuuuguacaugaa

SEQ ID NO: 1162845 - RNA, 14 nt, Homo sapiens
aauguuauuaccua

SEQ ID NO: 1162846 - RNA, 15 nt, Homo sapiens
aauguucacuuuuga

SEQ ID NO: 1162847 - RNA, 18 nt, Homo sapiens
aauguucaugaagguccu

SEQ ID NO: 1162848 - RNA, 15 nt, Homo sapiens
aauguugacaggcaa

SEQ ID NO: 1162849 - RNA, 15 nt, Homo sapiens
aauguuuaaacauuu

SEQ ID NO: 1162850 - RNA, 23 nt, Homo sapiens
aauguuuaaaccuuuuacguuaa

SEQ ID NO: 1162851 - RNA, 19 nt, Homo sapiens
aauguuuaagauaaacaga

SEQ ID NO: 1162852 - RNA, 15 nt, Homo sapiens
aauguuucuguguca

SEQ ID NO: 1162853 - RNA, 17 nt, Homo sapiens
aauguuucugugucauu

SEQ ID NO: 1162854 - RNA, 18 nt, Homo sapiens
aauguuuuaaacauucuu

SEQ ID NO: 1162855 - RNA, 18 nt, Homo sapiens
aauuaaaacacuuucaaa

SEQ ID NO: 1162856 - RNA, 14 nt, Homo sapiens
aauuaaaaccugau

SEQ ID NO: 1162857 - RNA, 20 nt, Homo sapiens
aauuaaugagacacacuuaa

SEQ ID NO: 1162858 - RNA, 12 nt, Homo sapiens
aauuacaaagaa

SEQ ID NO: 1162859 - RNA, 22 nt, Homo sapiens
aauuacacaguaagucauuuaa

SEQ ID NO: 1162860 - RNA, 23 nt, Homo sapiens
aauuacagcaguugacucagagu

SEQ ID NO: 1162861 - RNA, 21 nt, Homo sapiens
aauuaccgugagugacauagc

SEQ ID NO: 1162862 - RNA, 18 nt, Homo sapiens
aauuacuguaacugauua

SEQ ID NO: 1162863 - RNA, 17 nt, Homo sapiens
aauuacuuguguuacuu

SEQ ID NO: 1162864 - RNA, 23 nt, Homo sapiens
aauuacuuugugaauagaacucu

SEQ ID NO: 1162865 - RNA, 14 nt, Homo sapiens
aauuauaaaaugca

SEQ ID NO: 1162866 - RNA, 18 nt, Homo sapiens
aauuauaaacagcagggu

SEQ ID NO: 1162867 - RNA, 14 nt, Homo sapiens
aauuauauagcaaa

SEQ ID NO: 1162868 - RNA, 19 nt, Homo sapiens
aauuauauuugaugcaaau

SEQ ID NO: 1162869 - RNA, 15 nt, Homo sapiens
aauuauccacaugaa

SEQ ID NO: 1162870 - RNA, 23 nt, Homo sapiens
aauuauccacaugaaaauaaaga

SEQ ID NO: 1162871 - RNA, 12 nt, Homo sapiens
aauuaugacugc

SEQ ID NO: 1162872 - RNA, 22 nt, Homo sapiens
aauuaugcaucugcuacugugu

SEQ ID NO: 1162873 - RNA, 17 nt, Homo sapiens
aauuauggcaguaccuu

SEQ ID NO: 1162874 - RNA, 21 nt, Homo sapiens
aauuauguuuugugauucaaa

SEQ ID NO: 1162875 - RNA, 18 nt, Homo sapiens
aauuauucauuuaaucaa

SEQ ID NO: 1162876 - RNA, 11 nt, Homo sapiens
aauuauucccc

SEQ ID NO: 1162877 - RNA, 17 nt, Homo sapiens
aauuauuuuaguagugu

SEQ ID NO: 1162878 - RNA, 17 nt, Homo sapiens
aauuauuuuuguucaua

SEQ ID NO: 1162879 - RNA, 19 nt, Homo sapiens
aauucaaaaguuccaagag

SEQ ID NO: 1162880 - RNA, 14 nt, Homo sapiens
aauucacagccuuu

SEQ ID NO: 1162881 - RNA, 13 nt, Homo sapiens
aauucaugaacuu

SEQ ID NO: 1162882 - RNA, 22 nt, Homo sapiens
aauuccacacuauucucugccu

SEQ ID NO: 1162883 - RNA, 11 nt, Homo sapiens
aauuccagucu

SEQ ID NO: 1162884 - RNA, 17 nt, Homo sapiens
aauuccaucagcacaaa

SEQ ID NO: 1162885 - RNA, 20 nt, Homo sapiens
aauuccaucagcacaaagac

SEQ ID NO: 1162886 - RNA, 16 nt, Homo sapiens
acaagaguuucaaaac

SEQ ID NO: 1162887 - RNA, 22 nt, Homo sapiens
acaagaguuucaaaacauacaa

SEQ ID NO: 1162888 - RNA, 17 nt, Homo sapiens
acaagauguagcaccuu

SEQ ID NO: 1162889 - RNA, 11 nt, Homo sapiens
acaagauuccc

SEQ ID NO: 1162890 - RNA, 15 nt, Homo sapiens
acaagccaagaaaga

SEQ ID NO: 1162891 - RNA, 16 nt, Homo sapiens
acaagcugccucugac

SEQ ID NO: 1162892 - RNA, 18 nt, Homo sapiens
acaaggauagaugcuggc

SEQ ID NO: 1162893 - RNA, 19 nt, Homo sapiens
acaaggccccucugcaacu

SEQ ID NO: 1162894 - RNA, 15 nt, Homo sapiens
acaaguauccaguca

SEQ ID NO: 1162895 - RNA, 21 nt, Homo sapiens
acaagucauaccuacauucaa

SEQ ID NO: 1162896 - RNA, 17 nt, Homo sapiens
acaauaaaaacauugcc

SEQ ID NO: 1162897 - RNA, 13 nt, Homo sapiens
acaauacuugcau

SEQ ID NO: 1162898 - RNA, 21 nt, Homo sapiens
acaaucacguuauaguccaug

SEQ ID NO: 1162899 - RNA, 14 nt, Homo sapiens
acaaucagcuccuu

SEQ ID NO: 1162900 - RNA, 19 nt, Homo sapiens
acaaucaucaucauucuca

SEQ ID NO: 1162901 - RNA, 20 nt, Homo sapiens
acaaucccuuucuaaggaag

SEQ ID NO: 1162902 - RNA, 21 nt, Homo sapiens
acaaugaacccccaugaugua

SEQ ID NO: 1162903 - RNA, 19 nt, Homo sapiens
acaaugacauuuauaucac

SEQ ID NO: 1162904 - RNA, 15 nt, Homo sapiens
gaucugccugccuug

SEQ ID NO: 1162905 - RNA, 20 nt, Homo sapiens
gaucugcuuucuguucaucu

SEQ ID NO: 1162906 - RNA, 22 nt, Homo sapiens
gaucugcuuucuguucaucucu

SEQ ID NO: 1162907 - RNA, 16 nt, Homo sapiens
gaucuggaagggccaa

SEQ ID NO: 1162908 - RNA, 17 nt, Homo sapiens
gaucuggcuuacagggg

SEQ ID NO: 1162909 - RNA, 14 nt, Homo sapiens
gaucuguccaccuc

SEQ ID NO: 1162910 - RNA, 15 nt, Homo sapiens
gaucuguuaccaaua

SEQ ID NO: 1162911 - RNA, 18 nt, Homo sapiens
gaucuguuuugaaggcaa

SEQ ID NO: 1162912 - RNA, 19 nt, Homo sapiens
gaucuucagggaacugcau

SEQ ID NO: 1162913 - RNA, 14 nt, Homo sapiens
gaucuuuggacaga

SEQ ID NO: 1162914 - RNA, 16 nt, Homo sapiens
gaucuuuggacagaag

SEQ ID NO: 1162915 - RNA, 19 nt, Homo sapiens
gaugaaaauguaacuugaa

SEQ ID NO: 1162916 - RNA, 14 nt, Homo sapiens
gaugaaacuucuca

SEQ ID NO: 1162917 - RNA, 17 nt, Homo sapiens
gaugaaauuauuuguca

SEQ ID NO: 1162918 - RNA, 19 nt, Homo sapiens
gaugaaggaaggacuauga

SEQ ID NO: 1162919 - RNA, 21 nt, Homo sapiens
gaugaaggaaggacuaugaca

SEQ ID NO: 1162920 - RNA, 13 nt, Homo sapiens
gaugaaucagcaa

SEQ ID NO: 1162921 - RNA, 20 nt, Homo sapiens
gaugaauugcguuggucucu

SEQ ID NO: 1162922 - RNA, 18 nt, Homo sapiens
gaugaauugucacaucua

SEQ ID NO: 1162923 - RNA, 14 nt, Homo sapiens
gaugacauggucca

SEQ ID NO: 1162924 - RNA, 10 nt, Homo sapiens
gaugaccuca

SEQ ID NO: 1162925 - RNA, 15 nt, Homo sapiens
gaugaccugccuuau

SEQ ID NO: 1162926 - RNA, 22 nt, Homo sapiens
gaugacuuuuuauacuuuguaa

SEQ ID NO: 1162927 - RNA, 23 nt, Homo sapiens
gaugagacaggaggucagcacaa

SEQ ID NO: 1162928 - RNA, 14 nt, Homo sapiens
gaugauacauccaa

SEQ ID NO: 1162929 - RNA, 14 nt, Homo sapiens
gaugaucagggauc

SEQ ID NO: 1162930 - RNA, 18 nt, Homo sapiens
gaugauggcacugagaaa

SEQ ID NO: 1162931 - RNA, 23 nt, Homo sapiens
gaugauuguucuuuuguuucauu

SEQ ID NO: 1162932 - RNA, 18 nt, Homo sapiens
gaugcaaccaaaagggaa

SEQ ID NO: 1162933 - RNA, 18 nt, Homo sapiens
gaugcacccauugugauu

SEQ ID NO: 1162934 - RNA, 12 nt, Homo sapiens
gaugcacuacca

SEQ ID NO: 1162935 - RNA, 14 nt, Homo sapiens
gaugcagaguaagu

SEQ ID NO: 1162936 - RNA, 20 nt, Homo sapiens
gaugcaggauuuguucucug

SEQ ID NO: 1162937 - RNA, 22 nt, Homo sapiens
gaugcauagccuggacacagag

SEQ ID NO: 1162938 - RNA, 20 nt, Homo sapiens
gaugcauguugaccaugucu

SEQ ID NO: 1162939 - RNA, 23 nt, Homo sapiens
gaugccgagguaaaaguucuuuu

SEQ ID NO: 1162940 - RNA, 23 nt, Homo sapiens
gaugcucaucugagccagcaccg

SEQ ID NO: 1162941 - RNA, 21 nt, Homo sapiens
gaugcugaccucaccuggucc

SEQ ID NO: 1162942 - RNA, 22 nt, Homo sapiens
gaugcugaggguguuucuuccu

SEQ ID NO: 1162943 - RNA, 16 nt, Homo sapiens
gaugcuugagccuuug

SEQ ID NO: 1162944 - RNA, 17 nt, Homo sapiens
gaugcuugagccuuuga

SEQ ID NO: 1162945 - RNA, 14 nt, Homo sapiens
gaugcuuuaccaaa

SEQ ID NO: 1162946 - RNA, 17 nt, Homo sapiens
gauggaaaaagcgcugu

SEQ ID NO: 1162947 - RNA, 20 nt, Homo sapiens
gauggacagacucacaaccu

SEQ ID NO: 1162948 - RNA, 16 nt, Homo sapiens
gauggaccccagcauu

SEQ ID NO: 1162949 - RNA, 22 nt, Homo sapiens
gauggcgaggccucucucagga

SEQ ID NO: 1162950 - RNA, 21 nt, Homo sapiens
gauggcugacuuugcucuuuc

SEQ ID NO: 1162951 - RNA, 15 nt, Homo sapiens
gaugggccaccgggg

SEQ ID NO: 1162952 - RNA, 17 nt, Homo sapiens
gaugggcccuaugucuc

SEQ ID NO: 1162953 - RNA, 21 nt, Homo sapiens
gaugggcccuaugucucagga

SEQ ID NO: 1162954 - RNA, 19 nt, Homo sapiens
gauggggggggauguggau

SEQ ID NO: 1162955 - RNA, 14 nt, Homo sapiens
gaugguaaaguuag

SEQ ID NO: 1162956 - RNA, 17 nt, Homo sapiens
gauggugggcuucaggg

SEQ ID NO: 1162957 - RNA, 22 nt, Homo sapiens
gauguaagucucaacucugucc

SEQ ID NO: 1162958 - RNA, 18 nt, Homo sapiens
gauguaggguaaggugcc

SEQ ID NO: 1162959 - RNA, 19 nt, Homo sapiens
gauguaggguaaggugccu

SEQ ID NO: 1162960 - RNA, 16 nt, Homo sapiens
gauguaugaauacagc

SEQ ID NO: 1162961 - RNA, 12 nt, Homo sapiens
gaugucauuuga

SEQ ID NO: 1162962 - RNA, 16 nt, Homo sapiens
gaugugauuagugucu

SEQ ID NO: 1162963 - RNA, 14 nt, Homo sapiens
gaugugcacugcau

SEQ ID NO: 1162964 - RNA, 16 nt, Homo sapiens
gauguggaaaagccaa

SEQ ID NO: 1162965 - RNA, 19 nt, Homo sapiens
gauguguauauauauguga

SEQ ID NO: 1162966 - RNA, 14 nt, Homo sapiens
gauguuuccagacu

SEQ ID NO: 1162967 - RNA, 19 nt, Homo sapiens
gauguuugaccuucagagc

SEQ ID NO: 1162968 - RNA, 13 nt, Homo sapiens
gauguuuuacgca

SEQ ID NO: 1162969 - RNA, 16 nt, Homo sapiens
gauuaacggccuggau

SEQ ID NO: 1162970 - RNA, 12 nt, Homo sapiens
gauuaacuauga

SEQ ID NO: 1162971 - RNA, 21 nt, Homo sapiens
gauuaaugucaauucuugcca

SEQ ID NO: 1162972 - RNA, 18 nt, Homo sapiens
gauuacagaaacugaugc

SEQ ID NO: 1162973 - RNA, 12 nt, Homo sapiens
gauuagacugga

SEQ ID NO: 1162974 - RNA, 18 nt, Homo sapiens
gauuagugucucaugugg

SEQ ID NO: 1162975 - RNA, 13 nt, Homo sapiens
gauuaucuaccca

SEQ ID NO: 1162976 - RNA, 19 nt, Homo sapiens
gauuaugacuaaaguacca

SEQ ID NO: 1162977 - RNA, 14 nt, Homo sapiens
gauucacaucucau

SEQ ID NO: 1162978 - RNA, 14 nt, Homo sapiens
gauucaguguuaaa

SEQ ID NO: 1162979 - RNA, 14 nt, Homo sapiens
gauucaugcacugu

SEQ ID NO: 1162980 - RNA, 16 nt, Homo sapiens
gauucaugcacuguag

SEQ ID NO: 1162981 - RNA, 20 nt, Homo sapiens
gauuccagguggcaucagug

SEQ ID NO: 1162982 - RNA, 23 nt, Homo sapiens
gauucuaaaaugugauguucuaa

SEQ ID NO: 1162983 - RNA, 18 nt, Homo sapiens
gauucucugugucuaaga

SEQ ID NO: 1162984 - RNA, 19 nt, Homo sapiens
gauucugcaguaaaucuuu

SEQ ID NO: 1162985 - RNA, 21 nt, Homo sapiens
cuccugauguagcuugagaua

SEQ ID NO: 1162986 - RNA, 14 nt, Homo sapiens
cuccugccagcucu

SEQ ID NO: 1162987 - RNA, 23 nt, Homo sapiens
cuccuggcuggggccuguugaag

SEQ ID NO: 1162988 - RNA, 15 nt, Homo sapiens
cuccugggagcucau

SEQ ID NO: 1162989 - RNA, 16 nt, Homo sapiens
cuccugguaacagcua

SEQ ID NO: 1162990 - RNA, 20 nt, Homo sapiens
cuccugucucgccagaagac

SEQ ID NO: 1162991 - RNA, 18 nt, Homo sapiens
cuccuguucugaaaccuu

SEQ ID NO: 1162992 - RNA, 15 nt, Homo sapiens
cuccuucaauuccau

SEQ ID NO: 1162993 - RNA, 19 nt, Homo sapiens
cuccuuccaacaggagcug

SEQ ID NO: 1162994 - RNA, 18 nt, Homo sapiens
cuccuucccuugcuucuu

SEQ ID NO: 1162995 - RNA, 17 nt, Homo sapiens
cuccuugcuuguuacau

SEQ ID NO: 1162996 - RNA, 17 nt, Homo sapiens
cuccuugggcagggucu

SEQ ID NO: 1162997 - RNA, 16 nt, Homo sapiens
cucgagaagauucaau

SEQ ID NO: 1162998 - RNA, 22 nt, Homo sapiens
cucgaggcggaucuuuggacag

SEQ ID NO: 1162999 - RNA, 15 nt, Homo sapiens
cucgaggugccuucu

SEQ ID NO: 1163000 - RNA, 13 nt, Homo sapiens
cucgaugcugcug

SEQ ID NO: 1163001 - RNA, 21 nt, Homo sapiens
cucgccagagcugugguguca

SEQ ID NO: 1163002 - RNA, 14 nt, Homo sapiens
cucgccaggccaaa

SEQ ID NO: 1163003 - RNA, 15 nt, Homo sapiens
cucgcccacuuccuc

SEQ ID NO: 1163004 - RNA, 14 nt, Homo sapiens
cucgccgucuguga

SEQ ID NO: 1163005 - RNA, 20 nt, Homo sapiens
cucgcuuccgcauccuaguc

SEQ ID NO: 1163006 - RNA, 19 nt, Homo sapiens
cucggagcuggcccagggg

SEQ ID NO: 1163007 - RNA, 15 nt, Homo sapiens
cucggauacuugcca

SEQ ID NO: 1163008 - RNA, 20 nt, Homo sapiens
cucggcucaccgugagaaag

SEQ ID NO: 1163009 - RNA, 17 nt, Homo sapiens
cucggcucagugcaacc

SEQ ID NO: 1163010 - RNA, 21 nt, Homo sapiens
cucgggaaacuuagaucauca

SEQ ID NO: 1163011 - RNA, 15 nt, Homo sapiens
cucgggcuaggaaga

SEQ ID NO: 1163012 - RNA, 14 nt, Homo sapiens
cucggggugggggu

SEQ ID NO: 1163013 - RNA, 19 nt, Homo sapiens
cucguauaccgugccacuu

SEQ ID NO: 1163014 - RNA, 23 nt, Homo sapiens
cucuaaaaccuucugcugcccaa

SEQ ID NO: 1163015 - RNA, 17 nt, Homo sapiens
cucuaaagccaagcacu

SEQ ID NO: 1163016 - RNA, 15 nt, Homo sapiens
cucuaagaucuuaga

SEQ ID NO: 1163017 - RNA, 23 nt, Homo sapiens
cucuaauucuguaggacuuugaa

SEQ ID NO: 1163018 - RNA, 19 nt, Homo sapiens
cucuacaucuagcaauuuc

SEQ ID NO: 1163019 - RNA, 14 nt, Homo sapiens
cucuacauguaacu

SEQ ID NO: 1163020 - RNA, 12 nt, Homo sapiens
cucuacauuuaa

SEQ ID NO: 1163021 - RNA, 15 nt, Homo sapiens
cucuacuguggcaaa

SEQ ID NO: 1163022 - RNA, 23 nt, Homo sapiens
cucuagucccuguguucugcaca

SEQ ID NO: 1163023 - RNA, 12 nt, Homo sapiens
cucuaucaaaug

SEQ ID NO: 1163024 - RNA, 22 nt, Homo sapiens
cucuaucauuaaaguucuagug

SEQ ID NO: 1163025 - RNA, 13 nt, Homo sapiens
cucuaucugcaau

SEQ ID NO: 1163026 - RNA, 24 nt, Homo sapiens
cucuaugaccucgcccuccacaaa

SEQ ID NO: 1163027 - RNA, 13 nt, Homo sapiens
cucuauuaucuca

SEQ ID NO: 1163028 - RNA, 14 nt, Homo sapiens
cucuauuuacuucu

SEQ ID NO: 1163029 - RNA, 12 nt, Homo sapiens
cucucaaagggg

SEQ ID NO: 1163030 - RNA, 21 nt, Homo sapiens
cucucaaaugugaccauguga

SEQ ID NO: 1163031 - RNA, 15 nt, Homo sapiens
cucucaccacuucag

SEQ ID NO: 1163032 - RNA, 22 nt, Homo sapiens
cucucacggcuuguaaauguga

SEQ ID NO: 1163033 - RNA, 17 nt, Homo sapiens
cucucacuauaccagua

SEQ ID NO: 1163034 - RNA, 12 nt, Homo sapiens
cucucacuuugg

SEQ ID NO: 1163035 - RNA, 16 nt, Homo sapiens
cucucaguguuuugga

SEQ ID NO: 1163036 - RNA, 19 nt, Homo sapiens
cucucauuuggacuugcug

SEQ ID NO: 1163037 - RNA, 18 nt, Homo sapiens
cucuccagcaucaauucc

SEQ ID NO: 1163038 - RNA, 20 nt, Homo sapiens
cucuccagcaucaauuccau

SEQ ID NO: 1163039 - RNA, 19 nt, Homo sapiens
cucucccgaaggagaucuc

SEQ ID NO: 1163040 - RNA, 17 nt, Homo sapiens
cucuccgcaggcccacu

SEQ ID NO: 1163041 - RNA, 14 nt, Homo sapiens
cucuccugcaaaag

SEQ ID NO: 1163042 - RNA, 13 nt, Homo sapiens
cucuccugccuca

SEQ ID NO: 1163043 - RNA, 18 nt, Homo sapiens
cucucgggugggggagcc

SEQ ID NO: 1163044 - RNA, 15 nt, Homo sapiens
cucucggugcuucca

SEQ ID NO: 1163045 - RNA, 22 nt, Homo sapiens
cucucgguugaaaccuguauaa

SEQ ID NO: 1163046 - RNA, 20 nt, Homo sapiens
cucucuaagguaacauuuau

SEQ ID NO: 1163047 - RNA, 21 nt, Homo sapiens
cucucuaccagauaacugagg

SEQ ID NO: 1163048 - RNA, 14 nt, Homo sapiens
cucucuccugucca

SEQ ID NO: 1163049 - RNA, 13 nt, Homo sapiens
cucucuggucuuu

SEQ ID NO: 1163050 - RNA, 16 nt, Homo sapiens
cucucuguacacugcc

SEQ ID NO: 1163051 - RNA, 13 nt, Homo sapiens
cucucuucuucca

SEQ ID NO: 1163052 - RNA, 21 nt, Homo sapiens
cucugaaaacaaugcugagaa

SEQ ID NO: 1163053 - RNA, 21 nt, Homo sapiens
cucugaaaggauguagaaaca

SEQ ID NO: 1163054 - RNA, 22 nt, Homo sapiens
cucugaagaguggguuucacaa

SEQ ID NO: 1163055 - RNA, 23 nt, Homo sapiens
cucugaauaaauacccauugaac

SEQ ID NO: 1163056 - RNA, 20 nt, Homo sapiens
cucugaaugaaccuucuggc

SEQ ID NO: 1163057 - RNA, 16 nt, Homo sapiens
cucugaauuuauuucc

SEQ ID NO: 1163058 - RNA, 18 nt, Homo sapiens
cucugacuuaagcugccu

SEQ ID NO: 1163059 - RNA, 22 nt, Homo sapiens
cucugagagggaaaggucuguc

SEQ ID NO: 1163060 - RNA, 24 nt, Homo sapiens
cucugagagggaaaggucuguccu

SEQ ID NO: 1163061 - RNA, 17 nt, Homo sapiens
cucugaggccucacuac

SEQ ID NO: 1163062 - RNA, 18 nt, Homo sapiens
cucugauugcuuuaucca

SEQ ID NO: 1163063 - RNA, 21 nt, Homo sapiens
cucugauuugaaggcaaaaau

SEQ ID NO: 1163064 - RNA, 20 nt, Homo sapiens
cucugcaacugcucagcucu

SEQ ID NO: 1163065 - RNA, 18 nt, Homo sapiens
cucugcacaugucuugua

SEQ ID NO: 1163066 - RNA, 20 nt, Homo sapiens
cucugcagacuucccagcua

SEQ ID NO: 1163067 - RNA, 16 nt, Homo sapiens
cucugcagcucaggga

SEQ ID NO: 1163068 - RNA, 19 nt, Homo sapiens
cucugcagucgcuugccaa

SEQ ID NO: 1163069 - RNA, 21 nt, Homo sapiens
cucugcaucccccaaagccau

SEQ ID NO: 1163070 - RNA, 11 nt, Homo sapiens
cucugccaguc

SEQ ID NO: 1163071 - RNA, 15 nt, Homo sapiens
cucugccauguguuu

SEQ ID NO: 1163072 - RNA, 18 nt, Homo sapiens
cucugccuccauuuaauu

SEQ ID NO: 1163073 - RNA, 14 nt, Homo sapiens
cucugccuucuuag

SEQ ID NO: 1163074 - RNA, 22 nt, Homo sapiens
cucugcuccagcaagcaaacag

SEQ ID NO: 1163075 - RNA, 20 nt, Homo sapiens
cucugcuuucccuuuuccau

SEQ ID NO: 1163076 - RNA, 20 nt, Homo sapiens
cucuggaaagaaacauguga

SEQ ID NO: 1163077 - RNA, 19 nt, Homo sapiens
cucuggccuguacccagua

SEQ ID NO: 1163078 - RNA, 17 nt, Homo sapiens
cucugggccuucucacc

SEQ ID NO: 1163079 - RNA, 23 nt, Homo sapiens
cucuggucuccacagauggcuca

SEQ ID NO: 1163080 - RNA, 18 nt, Homo sapiens
cucugguguuugcaaagg

SEQ ID NO: 1163081 - RNA, 14 nt, Homo sapiens
ccagacggcuccac

SEQ ID NO: 1163082 - RNA, 14 nt, Homo sapiens
ccagacuaccugcc

SEQ ID NO: 1163083 - RNA, 20 nt, Homo sapiens
ccagacuucccacggcuccu

SEQ ID NO: 1163084 - RNA, 22 nt, Homo sapiens
ccagacuucucccgugagccag

SEQ ID NO: 1163085 - RNA, 18 nt, Homo sapiens
ccagagaacugacaugca

SEQ ID NO: 1163086 - RNA, 20 nt, Homo sapiens
ccagagacauacuugaaggg

SEQ ID NO: 1163087 - RNA, 19 nt, Homo sapiens
ccagagaccaaacaaggac

SEQ ID NO: 1163088 - RNA, 21 nt, Homo sapiens
ccagaggaaucuauaguuuaa

SEQ ID NO: 1163089 - RNA, 23 nt, Homo sapiens
ccagaggaauugauugucagcca

SEQ ID NO: 1163090 - RNA, 23 nt, Homo sapiens
ccagaggcagagguugcagugag

SEQ ID NO: 1163091 - RNA, 15 nt, Homo sapiens
ccagaggcaguaacc

SEQ ID NO: 1163092 - RNA, 17 nt, Homo sapiens
ccagaggccaacacugu

SEQ ID NO: 1163093 - RNA, 20 nt, Homo sapiens
ccagaggggcucaggucaca

SEQ ID NO: 1163094 - RNA, 17 nt, Homo sapiens
ccagagucaaauuugaa

SEQ ID NO: 1163095 - RNA, 21 nt, Homo sapiens
ccagagugggaccaaguccaa

SEQ ID NO: 1163096 - RNA, 12 nt, Homo sapiens
ccagauccagcc

SEQ ID NO: 1163097 - RNA, 16 nt, Homo sapiens
ccagaugcagggcagu

SEQ ID NO: 1163098 - RNA, 14 nt, Homo sapiens
agccaaacaguaug

SEQ ID NO: 1163099 - RNA, 23 nt, Homo sapiens
agccaaaccccuagagacaguga

SEQ ID NO: 1163100 - RNA, 16 nt, Homo sapiens
agccaacauggugaaa

SEQ ID NO: 1163101 - RNA, 17 nt, Homo sapiens
agccaaccaacagagaa

SEQ ID NO: 1163102 - RNA, 18 nt, Homo sapiens
agccaaguuuauauacaa

SEQ ID NO: 1163103 - RNA, 23 nt, Homo sapiens
agccaauauaggggaaaaaacuc

SEQ ID NO: 1163104 - RNA, 15 nt, Homo sapiens
agccaauuagcucua

SEQ ID NO: 1163105 - RNA, 17 nt, Homo sapiens
agccaauucacaaguua

SEQ ID NO: 1163106 - RNA, 15 nt, Homo sapiens
agccacaccaggaua

SEQ ID NO: 1163107 - RNA, 12 nt, Homo sapiens
agccacacugaa

SEQ ID NO: 1163108 - RNA, 13 nt, Homo sapiens
agccacagcauuu

SEQ ID NO: 1163109 - RNA, 15 nt, Homo sapiens
agccacagcauuuau

SEQ ID NO: 1163110 - RNA, 15 nt, Homo sapiens
agccaccaagaggga

SEQ ID NO: 1163111 - RNA, 18 nt, Homo sapiens
agccaccacaccuggcua

SEQ ID NO: 1163112 - RNA, 16 nt, Homo sapiens
agccacccucccagcu

SEQ ID NO: 1163113 - RNA, 13 nt, Homo sapiens
agccaccuagucc

SEQ ID NO: 1163114 - RNA, 14 nt, Homo sapiens
agccaccuugccac

SEQ ID NO: 1163115 - RNA, 19 nt, Homo sapiens
agccacuccccuccacucu

SEQ ID NO: 1163116 - RNA, 15 nt, Homo sapiens
agccagacuuguucu

SEQ ID NO: 1163117 - RNA, 13 nt, Homo sapiens
agccagcccggcc

SEQ ID NO: 1163118 - RNA, 19 nt, Homo sapiens
agccaggaaagaagaguug

SEQ ID NO: 1163119 - RNA, 16 nt, Homo sapiens
agccaggaacugugug

SEQ ID NO: 1163120 - RNA, 18 nt, Homo sapiens
agccaggagaccugcucu

SEQ ID NO: 1163121 - RNA, 21 nt, Homo sapiens
agccaggagggaccugcaucu

SEQ ID NO: 1163122 - RNA, 22 nt, Homo sapiens
agccagggggaugccacuccuc

SEQ ID NO: 1163123 - RNA, 16 nt, Homo sapiens
agccaggguacuccaa

SEQ ID NO: 1163124 - RNA, 16 nt, Homo sapiens
agccagguaaugugaa

SEQ ID NO: 1163125 - RNA, 15 nt, Homo sapiens
agccaguauggcaaa

SEQ ID NO: 1163126 - RNA, 20 nt, Homo sapiens
agccaguguggucaguauuc

SEQ ID NO: 1163127 - RNA, 15 nt, Homo sapiens
agccauacuuauuaa

SEQ ID NO: 1163128 - RNA, 13 nt, Homo sapiens
agccauaugaaug

SEQ ID NO: 1163129 - RNA, 23 nt, Homo sapiens
agccaucaaauagugaauggucu

SEQ ID NO: 1163130 - RNA, 15 nt, Homo sapiens
agccaucuaaugcuu

SEQ ID NO: 1163131 - RNA, 21 nt, Homo sapiens
agccaucuaaugcuuguuuau

SEQ ID NO: 1163132 - RNA, 19 nt, Homo sapiens
agccauggaaaaacuuccu

SEQ ID NO: 1163133 - RNA, 17 nt, Homo sapiens
agccauggaaggugcca

SEQ ID NO: 1163134 - RNA, 12 nt, Homo sapiens
agccauguguau

SEQ ID NO: 1163135 - RNA, 18 nt, Homo sapiens
agccauguuaacaugaca

SEQ ID NO: 1163136 - RNA, 20 nt, Homo sapiens
agcccaacagacaccaucuu

SEQ ID NO: 1163137 - RNA, 17 nt, Homo sapiens
agcccaauaucagcucu

SEQ ID NO: 1163138 - RNA, 22 nt, Homo sapiens
agcccacaucccacaugcggcu

SEQ ID NO: 1163139 - RNA, 11 nt, Homo sapiens
agcccagagac

SEQ ID NO: 1163140 - RNA, 14 nt, Homo sapiens
agcccagagaccuu

SEQ ID NO: 1163141 - RNA, 15 nt, Homo sapiens
agcccagagcccggu

SEQ ID NO: 1163142 - RNA, 16 nt, Homo sapiens
agcccagugggcugca

SEQ ID NO: 1163143 - RNA, 23 nt, Homo sapiens
agcccauuucuccagaacccauu

SEQ ID NO: 1163144 - RNA, 20 nt, Homo sapiens
agccccacccugcagaguau

SEQ ID NO: 1163145 - RNA, 20 nt, Homo sapiens
agccccagguaauggcauga

SEQ ID NO: 1163146 - RNA, 19 nt, Homo sapiens
agccccaucugugcauucu

SEQ ID NO: 1163147 - RNA, 20 nt, Homo sapiens
agcccccaccccgagucaca

SEQ ID NO: 1163148 - RNA, 18 nt, Homo sapiens
agcccccuuuucuugacc

SEQ ID NO: 1163149 - RNA, 20 nt, Homo sapiens
agccccgucuggugccagug

SEQ ID NO: 1163150 - RNA, 13 nt, Homo sapiens
agccccucagaca

SEQ ID NO: 1163151 - RNA, 14 nt, Homo sapiens
agccccuccaucug

SEQ ID NO: 1163152 - RNA, 20 nt, Homo sapiens
agccccuccucccccggcug

SEQ ID NO: 1163153 - RNA, 15 nt, Homo sapiens
agccccuccuuccuu

SEQ ID NO: 1163154 - RNA, 22 nt, Homo sapiens
agccccuccuuccuucaagcca

SEQ ID NO: 1163155 - RNA, 16 nt, Homo sapiens
agcccuaagacguccc

SEQ ID NO: 1163156 - RNA, 22 nt, Homo sapiens
agcccucagcaaugugccuucu

SEQ ID NO: 1163157 - RNA, 15 nt, Homo sapiens
agcccuccauuccaa

SEQ ID NO: 1163158 - RNA, 15 nt, Homo sapiens
agcccucccuaccua

SEQ ID NO: 1163159 - RNA, 18 nt, Homo sapiens
agcccucccuaccuacca

SEQ ID NO: 1163160 - RNA, 20 nt, Homo sapiens
agcccucuagggcagggugg

SEQ ID NO: 1163161 - RNA, 19 nt, Homo sapiens
agcccugagaaagaaugag

SEQ ID NO: 1163162 - RNA, 13 nt, Homo sapiens
agcccugcagcua

SEQ ID NO: 1163163 - RNA, 13 nt, Homo sapiens
agcccugccaguu

SEQ ID NO: 1163164 - RNA, 20 nt, Homo sapiens
agcccuggccucugcucaac

SEQ ID NO: 1163165 - RNA, 15 nt, Homo sapiens
agcccuucagucuua

SEQ ID NO: 1163166 - RNA, 18 nt, Homo sapiens
agcccuuccuugccagug

SEQ ID NO: 1163167 - RNA, 22 nt, Homo sapiens
agccgagcggggagccaggaaa

SEQ ID NO: 1163168 - RNA, 19 nt, Homo sapiens
agccgcagagacccucuca

SEQ ID NO: 1163169 - RNA, 14 nt, Homo sapiens
agccggacacuucu

SEQ ID NO: 1163170 - RNA, 15 nt, Homo sapiens
agccggccugagaaa

SEQ ID NO: 1163171 - RNA, 15 nt, Homo sapiens
agccgggaaagaaga

SEQ ID NO: 1163172 - RNA, 11 nt, Homo sapiens
agccgggaccc

SEQ ID NO: 1163173 - RNA, 17 nt, Homo sapiens
agccgggagccugaccc

SEQ ID NO: 1163174 - RNA, 18 nt, Homo sapiens
agccgugaauucaguugg

SEQ ID NO: 1163175 - RNA, 20 nt, Homo sapiens
agccuaaaagugggcuugau

SEQ ID NO: 1163176 - RNA, 15 nt, Homo sapiens
auguauccagaggaa

SEQ ID NO: 1163177 - RNA, 21 nt, Homo sapiens
auguauggaaucccacuguau

SEQ ID NO: 1163178 - RNA, 12 nt, Homo sapiens
auguauggauuu

SEQ ID NO: 1163179 - RNA, 17 nt, Homo sapiens
auguauggggaaucuaa

SEQ ID NO: 1163180 - RNA, 22 nt, Homo sapiens
auguaugucuuggacacuguac

SEQ ID NO: 1163181 - RNA, 12 nt, Homo sapiens
auguauguuucc

SEQ ID NO: 1163182 - RNA, 23 nt, Homo sapiens
auguauugcagugcggcucacau

SEQ ID NO: 1163183 - RNA, 20 nt, Homo sapiens
auguauuuuaauaacauauc

SEQ ID NO: 1163184 - RNA, 18 nt, Homo sapiens
auguauuuugaaaacacu

SEQ ID NO: 1163185 - RNA, 19 nt, Homo sapiens
auguauuuugaaaacacuu

SEQ ID NO: 1163186 - RNA, 16 nt, Homo sapiens
augucaacagagcaag

SEQ ID NO: 1163187 - RNA, 13 nt, Homo sapiens
augucacacuggc

SEQ ID NO: 1163188 - RNA, 20 nt, Homo sapiens
augucaccuacauguuauuc

SEQ ID NO: 1163189 - RNA, 22 nt, Homo sapiens
augucacgaauauggacauauc

SEQ ID NO: 1163190 - RNA, 19 nt, Homo sapiens
augucauguggcuaccugu

SEQ ID NO: 1163191 - RNA, 22 nt, Homo sapiens
augucauugcuaauccucgcaa

SEQ ID NO: 1163192 - RNA, 12 nt, Homo sapiens
augucauuuagu

SEQ ID NO: 1163193 - RNA, 16 nt, Homo sapiens
augucauuuccuucaa

SEQ ID NO: 1163194 - RNA, 20 nt, Homo sapiens
auguccagcaccuugugccu

SEQ ID NO: 1163195 - RNA, 17 nt, Homo sapiens
auguccauuuauaucau

SEQ ID NO: 1163196 - RNA, 20 nt, Homo sapiens
augucucugcuuccauggcu

SEQ ID NO: 1163197 - RNA, 17 nt, Homo sapiens
augucuguuugcugaug

SEQ ID NO: 1163198 - RNA, 15 nt, Homo sapiens
augucuuaguuauaa

SEQ ID NO: 1163199 - RNA, 17 nt, Homo sapiens
augucuuggacacugua

SEQ ID NO: 1163200 - RNA, 12 nt, Homo sapiens
augucuuuccac

SEQ ID NO: 1163201 - RNA, 20 nt, Homo sapiens
augugaagaugcauuguagu

SEQ ID NO: 1163202 - RNA, 12 nt, Homo sapiens
augugaagccaa

SEQ ID NO: 1163203 - RNA, 15 nt, Homo sapiens
augugacucuuucca

SEQ ID NO: 1163204 - RNA, 16 nt, Homo sapiens
augugacucuuuccaa

SEQ ID NO: 1163205 - RNA, 15 nt, Homo sapiens
augugaggauguauc

SEQ ID NO: 1163206 - RNA, 16 nt, Homo sapiens
augugauuagugucuc

SEQ ID NO: 1163207 - RNA, 15 nt, Homo sapiens
augugcaguuuaauc

SEQ ID NO: 1163208 - RNA, 13 nt, Homo sapiens
augugccaggccu

SEQ ID NO: 1163209 - RNA, 20 nt, Homo sapiens
augugccaggccuacuguaa

SEQ ID NO: 1163210 - RNA, 17 nt, Homo sapiens
augugccucuguccuua

SEQ ID NO: 1163211 - RNA, 16 nt, Homo sapiens
augugcuagucacugg

SEQ ID NO: 1163212 - RNA, 17 nt, Homo sapiens
augugcuggaaggacaa

SEQ ID NO: 1163213 - RNA, 13 nt, Homo sapiens
augugcuguguaa

SEQ ID NO: 1163214 - RNA, 15 nt, Homo sapiens
auguggaucugggga

SEQ ID NO: 1163215 - RNA, 15 nt, Homo sapiens
auguggccaagaaga

SEQ ID NO: 1163216 - RNA, 18 nt, Homo sapiens
auguguagccugugcaug

SEQ ID NO: 1163217 - RNA, 13 nt, Homo sapiens
auguguaugugua

SEQ ID NO: 1163218 - RNA, 13 nt, Homo sapiens
augugucaguuca

SEQ ID NO: 1163219 - RNA, 21 nt, Homo sapiens
auguguguguacaacacuggu

SEQ ID NO: 1163220 - RNA, 18 nt, Homo sapiens
auguguucaccaucccaa

SEQ ID NO: 1163221 - RNA, 20 nt, Homo sapiens
auguguucucggagugugua

SEQ ID NO: 1163222 - RNA, 18 nt, Homo sapiens
auguguuuuagaugguuu

SEQ ID NO: 1163223 - RNA, 16 nt, Homo sapiens
auguguuuucagucuu

SEQ ID NO: 1163224 - RNA, 15 nt, Homo sapiens
auguguuuuucacau

SEQ ID NO: 1163225 - RNA, 15 nt, Homo sapiens
auguuaaagcauuuc

SEQ ID NO: 1163226 - RNA, 23 nt, Homo sapiens
auguuaaaucaauaaagaccacu

SEQ ID NO: 1163227 - RNA, 19 nt, Homo sapiens
auguuaagacuugacagug

SEQ ID NO: 1163228 - RNA, 22 nt, Homo sapiens
auguuaagacuugacaguggaa

SEQ ID NO: 1163229 - RNA, 16 nt, Homo sapiens
auguuaauaaacugca

SEQ ID NO: 1163230 - RNA, 18 nt, Homo sapiens
auguuacuuaaacaucau

SEQ ID NO: 1163231 - RNA, 15 nt, Homo sapiens
auguuauaaagcaaa

SEQ ID NO: 1163232 - RNA, 21 nt, Homo sapiens
auguuaucuucucaaguucua

SEQ ID NO: 1163233 - RNA, 14 nt, Homo sapiens
auguuaugcaaaaa

SEQ ID NO: 1163234 - RNA, 22 nt, Homo sapiens
auguucacuuuugacaaaggca

SEQ ID NO: 1163235 - RNA, 19 nt, Homo sapiens
auguucccaaaacaauggu

SEQ ID NO: 1163236 - RNA, 15 nt, Homo sapiens
auguucuaaggcucu

SEQ ID NO: 1163237 - RNA, 13 nt, Homo sapiens
auguucucaugca

SEQ ID NO: 1163238 - RNA, 19 nt, Homo sapiens
auguucuuuaaaggcaucu

SEQ ID NO: 1163239 - RNA, 22 nt, Homo sapiens
auguugaagcucuuuacuguaa

SEQ ID NO: 1163240 - RNA, 21 nt, Homo sapiens
auguugaagugagcugagauu

SEQ ID NO: 1163241 - RNA, 22 nt, Homo sapiens
auguugaauucuuuugccaagg

SEQ ID NO: 1163242 - RNA, 16 nt, Homo sapiens
auguugagcagcaucu

SEQ ID NO: 1163243 - RNA, 22 nt, Homo sapiens
auguugauccauccagcuugcc

SEQ ID NO: 1163244 - RNA, 18 nt, Homo sapiens
auguugccauguguuuua

SEQ ID NO: 1163245 - RNA, 15 nt, Homo sapiens
auguugccuuuaugg

SEQ ID NO: 1163246 - RNA, 21 nt, Homo sapiens
auguugucacugguggcucau

SEQ ID NO: 1163247 - RNA, 21 nt, Homo sapiens
auguugucaggucguucuuau

SEQ ID NO: 1163248 - RNA, 13 nt, Homo sapiens
auguuuacuguaa

SEQ ID NO: 1163249 - RNA, 16 nt, Homo sapiens
auguuuccaccaaaug

SEQ ID NO: 1163250 - RNA, 14 nt, Homo sapiens
auguuuccccagac

SEQ ID NO: 1163251 - RNA, 19 nt, Homo sapiens
auguuugauacucuaguau

SEQ ID NO: 1163252 - RNA, 14 nt, Homo sapiens
auguuuguacacaa

SEQ ID NO: 1163253 - RNA, 22 nt, Homo sapiens
auguuuguacacaacaccuaaa

SEQ ID NO: 1163254 - RNA, 15 nt, Homo sapiens
auguuuugcacugac

SEQ ID NO: 1163255 - RNA, 21 nt, Homo sapiens
auguuuuuuaaacuaguuuau

SEQ ID NO: 1163256 - RNA, 22 nt, Homo sapiens
auguuuuuucugauuccauccu

SEQ ID NO: 1163257 - RNA, 20 nt, Homo sapiens
auguuuuuuuucugcuggaa

SEQ ID NO: 1163258 - RNA, 14 nt, Homo sapiens
auuaaaaagccuua

SEQ ID NO: 1163259 - RNA, 16 nt, Homo sapiens
auuaaaacacuuucaa

SEQ ID NO: 1163260 - RNA, 20 nt, Homo sapiens
auuaaaccuuuccauuuuac

SEQ ID NO: 1163261 - RNA, 15 nt, Homo sapiens
auuaaacguaugcau

SEQ ID NO: 1163262 - RNA, 18 nt, Homo sapiens
auuaaaguuaauagaacu

SEQ ID NO: 1163263 - RNA, 13 nt, Homo sapiens
auuaaauaaucuc

SEQ ID NO: 1163264 - RNA, 15 nt, Homo sapiens
auuaaauauucugua

SEQ ID NO: 1163265 - RNA, 19 nt, Homo sapiens
auuaaaucaauuuaucacu

SEQ ID NO: 1163266 - RNA, 16 nt, Homo sapiens
auuaaauuagauaucu

SEQ ID NO: 1163267 - RNA, 19 nt, Homo sapiens
auuaaauucucucuaacau

SEQ ID NO: 1163268 - RNA, 17 nt, Homo sapiens
auuaacagaaauguuuc

SEQ ID NO: 1163269 - RNA, 20 nt, Homo sapiens
auuaacagcagaaucucaga

SEQ ID NO: 1163270 - RNA, 18 nt, Homo sapiens
auuaacaugauaaaagac

SEQ ID NO: 1163271 - RNA, 22 nt, Homo sapiens
auuaaccuuacuaauuauacua

SEQ ID NO: 1163272 - RNA, 20 nt, Homo sapiens
auuaacuuaagauuugcuca

SEQ ID NO: 1163273 - RNA, 23 nt, Homo sapiens
auuaagagaacaaagagugaaau

SEQ ID NO: 1163274 - RNA, 18 nt, Homo sapiens
cauggugcgggcaccugu

SEQ ID NO: 1163275 - RNA, 13 nt, Homo sapiens
caugguggggcca

SEQ ID NO: 1163276 - RNA, 17 nt, Homo sapiens
caugguggguccauggg

SEQ ID NO: 1163277 - RNA, 20 nt, Homo sapiens
caugguguggccaucacuca

SEQ ID NO: 1163278 - RNA, 19 nt, Homo sapiens
cauguaaaugcucaaagau

SEQ ID NO: 1163279 - RNA, 21 nt, Homo sapiens
cauguaauguuaauguuauau

SEQ ID NO: 1163280 - RNA, 15 nt, Homo sapiens
cauguaauugcagau

SEQ ID NO: 1163281 - RNA, 22 nt, Homo sapiens
cauguacaaggccccucugcaa

SEQ ID NO: 1163282 - RNA, 22 nt, Homo sapiens
cauguacagacaaauacuuaga

SEQ ID NO: 1163283 - RNA, 18 nt, Homo sapiens
cauguacuguuacugugu

SEQ ID NO: 1163284 - RNA, 18 nt, Homo sapiens
cauguagccaguuaagga

SEQ ID NO: 1163285 - RNA, 21 nt, Homo sapiens
cauguagcccccuggccucug

SEQ ID NO: 1163286 - RNA, 20 nt, Homo sapiens
cauguauaucucgagugagu

SEQ ID NO: 1163287 - RNA, 17 nt, Homo sapiens
auugguuuuguacugga

SEQ ID NO: 1163288 - RNA, 17 nt, Homo sapiens
auuguaaaguagcugua

SEQ ID NO: 1163289 - RNA, 19 nt, Homo sapiens
auuguaucaaaugugacau

SEQ ID NO: 1163290 - RNA, 20 nt, Homo sapiens
auuguauccuuuauuucuga

SEQ ID NO: 1163291 - RNA, 16 nt, Homo sapiens
auuguaucuguuuaga

SEQ ID NO: 1163292 - RNA, 22 nt, Homo sapiens
auugucauaggauuaagcaguu

SEQ ID NO: 1163293 - RNA, 23 nt, Homo sapiens
auugucauggggaucaauuuuca

SEQ ID NO: 1163294 - RNA, 17 nt, Homo sapiens
auugucccacaauauua

SEQ ID NO: 1163295 - RNA, 12 nt, Homo sapiens
auugucugcaau

SEQ ID NO: 1163296 - RNA, 22 nt, Homo sapiens
auugucuucauguacauuugga

SEQ ID NO: 1163297 - RNA, 19 nt, Homo sapiens
auugucuugguugccagua

SEQ ID NO: 1163298 - RNA, 15 nt, Homo sapiens
auugugagaugauuu

SEQ ID NO: 1163299 - RNA, 16 nt, Homo sapiens
auugugauuguggaag

SEQ ID NO: 1163300 - RNA, 21 nt, Homo sapiens
auugugccuacgaauagccac

SEQ ID NO: 1163301 - RNA, 12 nt, Homo sapiens
auugugugagug

SEQ ID NO: 1163302 - RNA, 15 nt, Homo sapiens
auuguuaauuaugua

SEQ ID NO: 1163303 - RNA, 18 nt, Homo sapiens
auuguucuuugccagaga

SEQ ID NO: 1163304 - RNA, 21 nt, Homo sapiens
auuuaaaaauagaaacauauc

SEQ ID NO: 1163305 - RNA, 15 nt, Homo sapiens
auuuaaaagacaaac

SEQ ID NO: 1163306 - RNA, 21 nt, Homo sapiens
auuuaaagacaaagacauuau

SEQ ID NO: 1163307 - RNA, 23 nt, Homo sapiens
auuuaaauuacaauuuuaucugu

SEQ ID NO: 1163308 - RNA, 18 nt, Homo sapiens
auuuaagacacuguuaca

SEQ ID NO: 1163309 - RNA, 16 nt, Homo sapiens
auuuaauaacuuugcu

SEQ ID NO: 1163310 - RNA, 14 nt, Homo sapiens
auuuaauacacaau

SEQ ID NO: 1163311 - RNA, 17 nt, Homo sapiens
auuuaauacacaaugca

SEQ ID NO: 1163312 - RNA, 16 nt, Homo sapiens
auuuaauauuuugcac

SEQ ID NO: 1163313 - RNA, 19 nt, Homo sapiens
auuuaaugaauacuugcua

SEQ ID NO: 1163314 - RNA, 16 nt, Homo sapiens
auuuaauuauuuccua

SEQ ID NO: 1163315 - RNA, 17 nt, Homo sapiens
auuuacaagacugcuga

SEQ ID NO: 1163316 - RNA, 19 nt, Homo sapiens
auuuacaauguguaucaaa

SEQ ID NO: 1163317 - RNA, 20 nt, Homo sapiens
auuuacaguacuugucuuca

SEQ ID NO: 1163318 - RNA, 12 nt, Homo sapiens
auuuacauguau

SEQ ID NO: 1163319 - RNA, 19 nt, Homo sapiens
auuuacauuuaauacagau

SEQ ID NO: 1163320 - RNA, 20 nt, Homo sapiens
auuuacauuuaauacagaua

SEQ ID NO: 1163321 - RNA, 14 nt, Homo sapiens
auuuacgcuuugau

SEQ ID NO: 1163322 - RNA, 11 nt, Homo sapiens
auuuacuacag

SEQ ID NO: 1163323 - RNA, 21 nt, Homo sapiens
auuuagcuaaacggauuccaa

SEQ ID NO: 1163324 - RNA, 22 nt, Homo sapiens
auuuaggucuuauugaaaugca

SEQ ID NO: 1163325 - RNA, 22 nt, Homo sapiens
auuuaguuugauuauucagugu

SEQ ID NO: 1163326 - RNA, 16 nt, Homo sapiens
auuuauaauucaguau

SEQ ID NO: 1163327 - RNA, 21 nt, Homo sapiens
auuuauauagcaagugcuauu

SEQ ID NO: 1163328 - RNA, 22 nt, Homo sapiens
auuuauaugaagcaagcugugu

SEQ ID NO: 1163329 - RNA, 13 nt, Homo sapiens
auuuaucaccuaa

SEQ ID NO: 1163330 - RNA, 13 nt, Homo sapiens
auuuaucccucaa

SEQ ID NO: 1163331 - RNA, 18 nt, Homo sapiens
auuuauuguguguucuca

SEQ ID NO: 1163332 - RNA, 18 nt, Homo sapiens
auuuauuuaacuauucau

SEQ ID NO: 1163333 - RNA, 16 nt, Homo sapiens
auuuauuuaagacacu

SEQ ID NO: 1163334 - RNA, 13 nt, Homo sapiens
auuuauuuaugua

SEQ ID NO: 1163335 - RNA, 22 nt, Homo sapiens
auuucaaauauuuacaguacuu

SEQ ID NO: 1163336 - RNA, 13 nt, Homo sapiens
auuucaaccagca

SEQ ID NO: 1163337 - RNA, 16 nt, Homo sapiens
auuucaaccagcacau

SEQ ID NO: 1163338 - RNA, 18 nt, Homo sapiens
auuucaaccagcacauuc

SEQ ID NO: 1163339 - RNA, 14 nt, Homo sapiens
auuucacaagcuau

SEQ ID NO: 1163340 - RNA, 16 nt, Homo sapiens
auuucacaagcuauuc

SEQ ID NO: 1163341 - RNA, 16 nt, Homo sapiens
auuucacaagcuauuu

SEQ ID NO: 1163342 - RNA, 18 nt, Homo sapiens
auuucagcaacaaccauc

SEQ ID NO: 1163343 - RNA, 22 nt, Homo sapiens
auuucagcaacaaccaucucau

SEQ ID NO: 1163344 - RNA, 17 nt, Homo sapiens
auuucaguaagcugugu

SEQ ID NO: 1163345 - RNA, 21 nt, Homo sapiens
auuucauacccaugucagauu

SEQ ID NO: 1163346 - RNA, 18 nt, Homo sapiens
auuucauccuguuggcug

SEQ ID NO: 1163347 - RNA, 15 nt, Homo sapiens
auuucaugugcuaua

SEQ ID NO: 1163348 - RNA, 14 nt, Homo sapiens
auuucauugcucag

SEQ ID NO: 1163349 - RNA, 18 nt, Homo sapiens
auuucauuuuuacccuua

SEQ ID NO: 1163350 - RNA, 17 nt, Homo sapiens
auuuccaaauucacaag

SEQ ID NO: 1163351 - RNA, 20 nt, Homo sapiens
auuuccagguagauuucuca

SEQ ID NO: 1163352 - RNA, 18 nt, Homo sapiens
auuucccacugcacucca

SEQ ID NO: 1163353 - RNA, 16 nt, Homo sapiens
auuucccagugaaaua

SEQ ID NO: 1163354 - RNA, 15 nt, Homo sapiens
auuucccuacccuaa

SEQ ID NO: 1163355 - RNA, 22 nt, Homo sapiens
auuuccuuaaauguuuugccag

SEQ ID NO: 1163356 - RNA, 15 nt, Homo sapiens
auuucggagcgcaau

SEQ ID NO: 1163357 - RNA, 14 nt, Homo sapiens
auuucuaacaguac

SEQ ID NO: 1163358 - RNA, 17 nt, Homo sapiens
auuucuacaaugcacau

SEQ ID NO: 1163359 - RNA, 15 nt, Homo sapiens
auuucuagguaggaa

SEQ ID NO: 1163360 - RNA, 13 nt, Homo sapiens
auuucuaucaaaa

SEQ ID NO: 1163361 - RNA, 20 nt, Homo sapiens
auuucuauguaugugccaau

SEQ ID NO: 1163362 - RNA, 12 nt, Homo sapiens
auuucucuguga

SEQ ID NO: 1163363 - RNA, 17 nt, Homo sapiens
auuucugaaaugugcag

SEQ ID NO: 1163364 - RNA, 22 nt, Homo sapiens
auuucugcuuucuucuuuagca

SEQ ID NO: 1163365 - RNA, 21 nt, Homo sapiens
auuucuucaagugaguggcau

SEQ ID NO: 1163366 - RNA, 18 nt, Homo sapiens
auuucuucccgcacaaau

SEQ ID NO: 1163367 - RNA, 23 nt, Homo sapiens
auuucuuugucggcggcuugaua

SEQ ID NO: 1163368 - RNA, 17 nt, Homo sapiens
auuugaagaacauguga

SEQ ID NO: 1163369 - RNA, 15 nt, Homo sapiens
auuugaaugaacacu

SEQ ID NO: 1163370 - RNA, 11 nt, Homo sapiens
auuugacuuac

SEQ ID NO: 1163371 - RNA, 17 nt, Homo sapiens
auuugaugcuuuucucu

SEQ ID NO: 1163372 - RNA, 16 nt, Homo sapiens
auuugcauuaaauuca

SEQ ID NO: 1163373 - RNA, 16 nt, Homo sapiens
auuugccacaucuuaa

SEQ ID NO: 1163374 - RNA, 19 nt, Homo sapiens
auuugccuccagugcaguc

SEQ ID NO: 1163375 - RNA, 17 nt, Homo sapiens
auuugccugcagaguuu

SEQ ID NO: 1163376 - RNA, 15 nt, Homo sapiens
auuugcuaaacauuu

SEQ ID NO: 1163377 - RNA, 16 nt, Homo sapiens
auuuggcaaugccauc

SEQ ID NO: 1163378 - RNA, 18 nt, Homo sapiens
auuuggcuuacaguaaau

SEQ ID NO: 1163379 - RNA, 21 nt, Homo sapiens
auuugggauggaagcaggaca

SEQ ID NO: 1163380 - RNA, 22 nt, Homo sapiens
auuugggauggaagcaggacag

SEQ ID NO: 1163381 - RNA, 18 nt, Homo sapiens
auuuguaauggcucccaa

SEQ ID NO: 1163382 - RNA, 19 nt, Homo sapiens
auuuguaguugcauauuua

SEQ ID NO: 1163383 - RNA, 16 nt, Homo sapiens
auuuguauaugacugc

SEQ ID NO: 1163384 - RNA, 14 nt, Homo sapiens
auuugucaauuuau

SEQ ID NO: 1163385 - RNA, 17 nt, Homo sapiens
auuugucauucauucaa

SEQ ID NO: 1163386 - RNA, 14 nt, Homo sapiens
auuuguccaaacag

SEQ ID NO: 1163387 - RNA, 22 nt, Homo sapiens
auuuguggugauauagaauuag

SEQ ID NO: 1163388 - RNA, 16 nt, Homo sapiens
auuugugucacuguac

SEQ ID NO: 1163389 - RNA, 18 nt, Homo sapiens
auuuguuaagguucaaga

SEQ ID NO: 1163390 - RNA, 14 nt, Homo sapiens
auuuguugcugcug

SEQ ID NO: 1163391 - RNA, 20 nt, Homo sapiens
auuuguuuguuuucuugucu

SEQ ID NO: 1163392 - RNA, 18 nt, Homo sapiens
auuuguuuuucagagaua

SEQ ID NO: 1163393 - RNA, 21 nt, Homo sapiens
aaacacgccugcaaacgcugc

SEQ ID NO: 1163394 - RNA, 13 nt, Homo sapiens
aaacacuauuugu

SEQ ID NO: 1163395 - RNA, 12 nt, Homo sapiens
aaacacugccau

SEQ ID NO: 1163396 - RNA, 20 nt, Homo sapiens
aaacacuuccagucuggaga

SEQ ID NO: 1163397 - RNA, 12 nt, Homo sapiens
aaacacuugaac

SEQ ID NO: 1163398 - RNA, 14 nt, Homo sapiens
aaacagaagccuga

SEQ ID NO: 1163399 - RNA, 21 nt, Homo sapiens
aaacagcaggacuuguuuaca

SEQ ID NO: 1163400 - RNA, 18 nt, Homo sapiens
aaacaggaaguggacauu

SEQ ID NO: 1163401 - RNA, 22 nt, Homo sapiens
aaaggcuaagcuucacuguaaa

SEQ ID NO: 1163402 - RNA, 15 nt, Homo sapiens
aaagggaaacuggcu

SEQ ID NO: 1163403 - RNA, 21 nt, Homo sapiens
aaagggaagucuagaguuccu

SEQ ID NO: 1163404 - RNA, 15 nt, Homo sapiens
aaaggggaccccuau

SEQ ID NO: 1163405 - RNA, 15 nt, Homo sapiens
aaagguggacuggaa

SEQ ID NO: 1163406 - RNA, 22 nt, Homo sapiens
aaaggugucuucuuugacuuaa

SEQ ID NO: 1163407 - RNA, 22 nt, Homo sapiens
aaagguuggccuuacuguugaa

SEQ ID NO: 1163408 - RNA, 17 nt, Homo sapiens
aaagguuuacagaauuu

SEQ ID NO: 1163409 - RNA, 17 nt, Homo sapiens
aaaguaagaacagcuca

SEQ ID NO: 1163410 - RNA, 22 nt, Homo sapiens
aaaguaaugccucugucuagca

SEQ ID NO: 1163411 - RNA, 15 nt, Homo sapiens
aaaguaauguagcau

SEQ ID NO: 1163412 - RNA, 22 nt, Homo sapiens
aaaguaccagauuauaaugcca

SEQ ID NO: 1163413 - RNA, 15 nt, Homo sapiens
aaaguaccgcuuaaa

SEQ ID NO: 1163414 - RNA, 22 nt, Homo sapiens
aaaguacuucaggcacgcugcc

SEQ ID NO: 1163415 - RNA, 19 nt, Homo sapiens
aaaguaggcaucuaaagaa

SEQ ID NO: 1163416 - RNA, 22 nt, Homo sapiens
aaaguauuggcauucaaaaaga

SEQ ID NO: 1163417 - RNA, 15 nt, Homo sapiens
aaagucccccuucaa

SEQ ID NO: 1163418 - RNA, 13 nt, Homo sapiens
aaagucucucuuc

SEQ ID NO: 1163419 - RNA, 9 nt, Homo sapiens
aaagugaug

SEQ ID NO: 1163420 - RNA, 20 nt, Homo sapiens
aaaguggaaaggaucacaga

SEQ ID NO: 1163421 - RNA, 11 nt, Homo sapiens
aaaguguaaag

SEQ ID NO: 1163422 - RNA, 19 nt, Homo sapiens
aaagugucguaucugggag

SEQ ID NO: 1163423 - RNA, 15 nt, Homo sapiens
aaaguuaaacauuga

SEQ ID NO: 1163424 - RNA, 15 nt, Homo sapiens
aaaguuaaauuagcu

SEQ ID NO: 1163425 - RNA, 18 nt, Homo sapiens
aaaguuagguuauaagaa

SEQ ID NO: 1163426 - RNA, 21 nt, Homo sapiens
aaaguuauauuucagauguaa

SEQ ID NO: 1163427 - RNA, 23 nt, Homo sapiens
aaaguuauuuuuaaaaacaacuu

SEQ ID NO: 1163428 - RNA, 16 nt, Homo sapiens
aaaguuguuugcuuau

SEQ ID NO: 1163429 - RNA, 14 nt, Homo sapiens
aaauaaaaacccaa

SEQ ID NO: 1163430 - RNA, 20 nt, Homo sapiens
aaauaaaaaucucuuuucca

SEQ ID NO: 1163431 - RNA, 17 nt, Homo sapiens
aaauaaaaggaagccaa

SEQ ID NO: 1163432 - RNA, 18 nt, Homo sapiens
aaauaaacaccacaccca

SEQ ID NO: 1163433 - RNA, 17 nt, Homo sapiens
aaauaaacaguuugaca

SEQ ID NO: 1163434 - RNA, 13 nt, Homo sapiens
aaauaaacuguaa

SEQ ID NO: 1163435 - RNA, 13 nt, Homo sapiens
aaauaaacugugu

SEQ ID NO: 1163436 - RNA, 14 nt, Homo sapiens
aaauaaacugugug

SEQ ID NO: 1163437 - RNA, 22 nt, Homo sapiens
aaauaaagcuguucucauuccu

SEQ ID NO: 1163438 - RNA, 20 nt, Homo sapiens
aaauaaagguuagauaaguc

SEQ ID NO: 1163439 - RNA, 14 nt, Homo sapiens
aaauaaauggaaua

SEQ ID NO: 1163440 - RNA, 14 nt, Homo sapiens
aaauaaauuaugcu

SEQ ID NO: 1163441 - RNA, 15 nt, Homo sapiens
aaauaacugaucuca

SEQ ID NO: 1163442 - RNA, 10 nt, Homo sapiens
aaauaaucuc

SEQ ID NO: 1163443 - RNA, 11 nt, Homo sapiens
aaauaaucucu

SEQ ID NO: 1163444 - RNA, 22 nt, Homo sapiens
aaauacacagugcugaccagac

SEQ ID NO: 1163445 - RNA, 23 nt, Homo sapiens
aaauacacagugcugaccagaca

SEQ ID NO: 1163446 - RNA, 13 nt, Homo sapiens
aaauacacucucu

SEQ ID NO: 1163447 - RNA, 20 nt, Homo sapiens
aaauacacuuccugcuuaaa

SEQ ID NO: 1163448 - RNA, 14 nt, Homo sapiens
aaauacuaccuaua

SEQ ID NO: 1163449 - RNA, 14 nt, Homo sapiens
aaauacugcacuua

SEQ ID NO: 1163450 - RNA, 14 nt, Homo sapiens
aaauacuugcucca

SEQ ID NO: 1163451 - RNA, 21 nt, Homo sapiens
aaauacuugcuccauuuacaa

SEQ ID NO: 1163452 - RNA, 14 nt, Homo sapiens
aaauagacugugaa

SEQ ID NO: 1163453 - RNA, 17 nt, Homo sapiens
aaauagagccugaggga

SEQ ID NO: 1163454 - RNA, 16 nt, Homo sapiens
aaauagaggcuuugag

SEQ ID NO: 1163455 - RNA, 18 nt, Homo sapiens
aaauagcaaaacuaaaua

SEQ ID NO: 1163456 - RNA, 20 nt, Homo sapiens
aaauagcaguccccagugau

SEQ ID NO: 1163457 - RNA, 14 nt, Homo sapiens
aaauagccccagac

SEQ ID NO: 1163458 - RNA, 12 nt, Homo sapiens
aaauaguacuaa

SEQ ID NO: 1163459 - RNA, 17 nt, Homo sapiens
aaauauaauaugcacac

SEQ ID NO: 1163460 - RNA, 18 nt, Homo sapiens
aaauauaaucuaauacac

SEQ ID NO: 1163461 - RNA, 18 nt, Homo sapiens
aaauauaauuccuuuaaa

SEQ ID NO: 1163462 - RNA, 13 nt, Homo sapiens
aaauauacauuca

SEQ ID NO: 1163463 - RNA, 12 nt, Homo sapiens
aaauauauacac

SEQ ID NO: 1163464 - RNA, 15 nt, Homo sapiens
aaauauauaugauau

SEQ ID NO: 1163465 - RNA, 15 nt, Homo sapiens
aaauauauuuccuca

SEQ ID NO: 1163466 - RNA, 22 nt, Homo sapiens
aaauaucauaaucugaugauau

SEQ ID NO: 1163467 - RNA, 13 nt, Homo sapiens
aaauaugaagguu

SEQ ID NO: 1163468 - RNA, 15 nt, Homo sapiens
aaauaugagagcaau

SEQ ID NO: 1163469 - RNA, 23 nt, Homo sapiens
aaauauuuugcacagauuuacuc

SEQ ID NO: 1163470 - RNA, 16 nt, Homo sapiens
aaaucaacuugcuuau

SEQ ID NO: 1163471 - RNA, 15 nt, Homo sapiens
aaaucaauaaauucc

SEQ ID NO: 1163472 - RNA, 14 nt, Homo sapiens
aaaucacacuguaa

SEQ ID NO: 1163473 - RNA, 18 nt, Homo sapiens
aaaucacucagcacucca

SEQ ID NO: 1163474 - RNA, 11 nt, Homo sapiens
aaaucacuuga

SEQ ID NO: 1163475 - RNA, 10 nt, Homo sapiens
aaaucacuuu

SEQ ID NO: 1163476 - RNA, 18 nt, Homo sapiens
aaaucagaccuggcugcu

SEQ ID NO: 1163477 - RNA, 15 nt, Homo sapiens
aaaucagccagacau

SEQ ID NO: 1163478 - RNA, 12 nt, Homo sapiens
aaaucaguuuug

SEQ ID NO: 1163479 - RNA, 16 nt, Homo sapiens
aaaucauggaauuuau

SEQ ID NO: 1163480 - RNA, 18 nt, Homo sapiens
aaaucauggguccagccu

SEQ ID NO: 1163481 - RNA, 20 nt, Homo sapiens
aaaucauguuuuuucugcaa

SEQ ID NO: 1163482 - RNA, 21 nt, Homo sapiens
aaauccacagaacuagccuua

SEQ ID NO: 1163483 - RNA, 17 nt, Homo sapiens
aaaucccugucuugcuu

SEQ ID NO: 1163484 - RNA, 19 nt, Homo sapiens
aaauccuauaagauuuaaa

SEQ ID NO: 1163485 - RNA, 14 nt, Homo sapiens
aaaucguccaggga

SEQ ID NO: 1163486 - RNA, 14 nt, Homo sapiens
aaaucguccuccca

SEQ ID NO: 1163487 - RNA, 13 nt, Homo sapiens
aaaucgugccuug

SEQ ID NO: 1163488 - RNA, 16 nt, Homo sapiens
aaaucuauagaacuga

SEQ ID NO: 1163489 - RNA, 16 nt, Homo sapiens
aaaucucaaaacugua

SEQ ID NO: 1163490 - RNA, 21 nt, Homo sapiens
aaaucugucauaagcauuacu

SEQ ID NO: 1163491 - RNA, 16 nt, Homo sapiens
aaaucuguccucugua

SEQ ID NO: 1163492 - RNA, 21 nt, Homo sapiens
aaaucuguuuuucuaacuggg

SEQ ID NO: 1163493 - RNA, 23 nt, Homo sapiens
aaaucuuaaaaguguuguuauca

SEQ ID NO: 1163494 - RNA, 19 nt, Homo sapiens
aaaucuuuuuaaauucugg

SEQ ID NO: 1163495 - RNA, 19 nt, Homo sapiens
aaaugaaugcugauuguaa

SEQ ID NO: 1163496 - RNA, 14 nt, Homo sapiens
aaaugagcaaaagu

SEQ ID NO: 1163497 - RNA, 13 nt, Homo sapiens
aaaugagugcuua

SEQ ID NO: 1163498 - RNA, 15 nt, Homo sapiens
aaaugagugcuuaaa

SEQ ID NO: 1163499 - RNA, 21 nt, Homo sapiens
aaaugauagauuugaccuccu

SEQ ID NO: 1163500 - RNA, 11 nt, Homo sapiens
aaaugcaaaau

SEQ ID NO: 1163501 - RNA, 15 nt, Homo sapiens
aaaugcaaucaauuu

SEQ ID NO: 1163502 - RNA, 18 nt, Homo sapiens
aaaugcagggcacaugau

SEQ ID NO: 1163503 - RNA, 20 nt, Homo sapiens
aaaugccacuucaccaagga

SEQ ID NO: 1163504 - RNA, 21 nt, Homo sapiens
aaaugcgggcauuuaagucug

SEQ ID NO: 1163505 - RNA, 17 nt, Homo sapiens
aaaugcucagaccagcu

SEQ ID NO: 1163506 - RNA, 20 nt, Homo sapiens
aaaugcugugcaaacagugu

SEQ ID NO: 1163507 - RNA, 13 nt, Homo sapiens
aaauggcaugaca

SEQ ID NO: 1163508 - RNA, 20 nt, Homo sapiens
aaauggcuacacucaucuga

SEQ ID NO: 1163509 - RNA, 15 nt, Homo sapiens
aaaugggaacugaug

SEQ ID NO: 1163510 - RNA, 21 nt, Homo sapiens
aaaugggagaaaacgccagug

SEQ ID NO: 1163511 - RNA, 23 nt, Homo sapiens
aaauggggaaaagaaaaaccacg

SEQ ID NO: 1163512 - RNA, 23 nt, Homo sapiens
aaauggggauauguuaacuauug

SEQ ID NO: 1163513 - RNA, 19 nt, Homo sapiens
aaauggggcaaacagucua

SEQ ID NO: 1163514 - RNA, 18 nt, Homo sapiens
aaaugguaggcauuuccu

SEQ ID NO: 1163515 - RNA, 22 nt, Homo sapiens
aaaugguccaggagaaggccaa

SEQ ID NO: 1163516 - RNA, 13 nt, Homo sapiens
aaaugguccuauu

SEQ ID NO: 1163517 - RNA, 18 nt, Homo sapiens
aaauguaacugugccagu

SEQ ID NO: 1163518 - RNA, 16 nt, Homo sapiens
aaauguacagacauau

SEQ ID NO: 1163519 - RNA, 18 nt, Homo sapiens
aaauguauaccaaggcaa

SEQ ID NO: 1163520 - RNA, 12 nt, Homo sapiens
aaauguaugugc

SEQ ID NO: 1163521 - RNA, 14 nt, Homo sapiens
aaauguaugugcuc

SEQ ID NO: 1163522 - RNA, 23 nt, Homo sapiens
aaaugucaguaguuucuuauuaa

SEQ ID NO: 1163523 - RNA, 19 nt, Homo sapiens
aaauguccauuuauaucau

SEQ ID NO: 1163524 - RNA, 10 nt, Homo sapiens
aaauguccuc

SEQ ID NO: 1163525 - RNA, 22 nt, Homo sapiens
aaaugucuugcuguugacauau

SEQ ID NO: 1163526 - RNA, 15 nt, Homo sapiens
aaaugucuugcuuga

SEQ ID NO: 1163527 - RNA, 17 nt, Homo sapiens
aaauguuauugccuaau

SEQ ID NO: 1163528 - RNA, 19 nt, Homo sapiens
aaauguucuaaguuucuaa

SEQ ID NO: 1163529 - RNA, 14 nt, Homo sapiens
aaauguuuacugua

SEQ ID NO: 1163530 - RNA, 18 nt, Homo sapiens
aaauguuuuucaaaacaa

SEQ ID NO: 1163531 - RNA, 13 nt, Homo sapiens
aaauuaacaugau

SEQ ID NO: 1163532 - RNA, 12 nt, Homo sapiens
aaauuaagaagg

SEQ ID NO: 1163533 - RNA, 15 nt, Homo sapiens
aaauuagccagacau

SEQ ID NO: 1163534 - RNA, 22 nt, Homo sapiens
cauaugaaaaggcuaagcuuca

SEQ ID NO: 1163535 - RNA, 14 nt, Homo sapiens
cauaugaaugcagc

SEQ ID NO: 1163536 - RNA, 22 nt, Homo sapiens
cauaugagaaggaacuuuguca

SEQ ID NO: 1163537 - RNA, 14 nt, Homo sapiens
cauaugauacugau

SEQ ID NO: 1163538 - RNA, 19 nt, Homo sapiens
cauauguagaaacauuuag

SEQ ID NO: 1163539 - RNA, 17 nt, Homo sapiens
cauauguagaugugcug

SEQ ID NO: 1163540 - RNA, 19 nt, Homo sapiens
cauauuaaaaauauacaag

SEQ ID NO: 1163541 - RNA, 22 nt, Homo sapiens
cauauuaagaauagucucuggg

SEQ ID NO: 1163542 - RNA, 20 nt, Homo sapiens
cauauuccucucaguccuuc

SEQ ID NO: 1163543 - RNA, 19 nt, Homo sapiens
cauauuuagcuuugcacau

SEQ ID NO: 1163544 - RNA, 15 nt, Homo sapiens
cauauuugaaaacca

SEQ ID NO: 1163545 - RNA, 18 nt, Homo sapiens
cauauuugaaaaccauau

SEQ ID NO: 1163546 - RNA, 13 nt, Homo sapiens
caucaaauaguga

SEQ ID NO: 1163547 - RNA, 13 nt, Homo sapiens
caucaacaaugau

SEQ ID NO: 1163548 - RNA, 13 nt, Homo sapiens
caucaagcacuuc

SEQ ID NO: 1163549 - RNA, 16 nt, Homo sapiens
caucaagcacuuccca

SEQ ID NO: 1163550 - RNA, 16 nt, Homo sapiens
caucaauuccaucagc

SEQ ID NO: 1163551 - RNA, 16 nt, Homo sapiens
caucacaucacauuua

SEQ ID NO: 1163552 - RNA, 13 nt, Homo sapiens
caucacaugacca

SEQ ID NO: 1163553 - RNA, 16 nt, Homo sapiens
caucaccaagauuuug

SEQ ID NO: 1163554 - RNA, 13 nt, Homo sapiens
caucaccaggugc

SEQ ID NO: 1163555 - RNA, 14 nt, Homo sapiens
caucaccuuccuaa

SEQ ID NO: 1163556 - RNA, 18 nt, Homo sapiens
caucacuuguaccuucca

SEQ ID NO: 1163557 - RNA, 15 nt, Homo sapiens
caucagaaauaguca

SEQ ID NO: 1163558 - RNA, 14 nt, Homo sapiens
caucagaacugaaa

SEQ ID NO: 1163559 - RNA, 15 nt, Homo sapiens
caucagaacugaaau

SEQ ID NO: 1163560 - RNA, 15 nt, Homo sapiens
caucaggaaauuugg

SEQ ID NO: 1163561 - RNA, 21 nt, Homo sapiens
caucaggauacucaaagugga

SEQ ID NO: 1163562 - RNA, 17 nt, Homo sapiens
caucagugucuuuccac

SEQ ID NO: 1163563 - RNA, 18 nt, Homo sapiens
caucaguucacugcugca

SEQ ID NO: 1163564 - RNA, 15 nt, Homo sapiens
caucauaacccauga

SEQ ID NO: 1163565 - RNA, 18 nt, Homo sapiens
caucauagcaagaccuca

SEQ ID NO: 1163566 - RNA, 22 nt, Homo sapiens
caucaucaggaagccuguggug

SEQ ID NO: 1163567 - RNA, 18 nt, Homo sapiens
caucauccaggagguuca

SEQ ID NO: 1163568 - RNA, 24 nt, Homo sapiens
caucaucugcugcacauagcagac

SEQ ID NO: 1163569 - RNA, 12 nt, Homo sapiens
caucaugcaugu

SEQ ID NO: 1163570 - RNA, 19 nt, Homo sapiens
caucauuucccaagcagac

SEQ ID NO: 1163571 - RNA, 16 nt, Homo sapiens
cauccaagcaaacuga

SEQ ID NO: 1163572 - RNA, 20 nt, Homo sapiens
cauccaaggccuucucaggc

SEQ ID NO: 1163573 - RNA, 22 nt, Homo sapiens
cauccagcucuacgugauuugg

SEQ ID NO: 1163574 - RNA, 11 nt, Homo sapiens
ccaaagccauc

SEQ ID NO: 1163575 - RNA, 19 nt, Homo sapiens
ccaaagcccucccuaccua

SEQ ID NO: 1163576 - RNA, 15 nt, Homo sapiens
ccaaaggaaugucca

SEQ ID NO: 1163577 - RNA, 18 nt, Homo sapiens
ccaaagguuggcagugau

SEQ ID NO: 1163578 - RNA, 21 nt, Homo sapiens
ccaaaguaaaagaaaccacuu

SEQ ID NO: 1163579 - RNA, 16 nt, Homo sapiens
ccaaagugucuuuuga

SEQ ID NO: 1163580 - RNA, 19 nt, Homo sapiens
ccaaaucaaaagacuuuuu

SEQ ID NO: 1163581 - RNA, 20 nt, Homo sapiens
ccaaaucaauaagaagguag

SEQ ID NO: 1163582 - RNA, 15 nt, Homo sapiens
ccaaaucaucucuca

SEQ ID NO: 1163583 - RNA, 22 nt, Homo sapiens
ccaaaugauagaacuguacugu

SEQ ID NO: 1163584 - RNA, 22 nt, Homo sapiens
ccaaaugaucuggugguuauuu

SEQ ID NO: 1163585 - RNA, 18 nt, Homo sapiens
ccaacacuuccagcauuu

SEQ ID NO: 1163586 - RNA, 12 nt, Homo sapiens
ccaacagcaccc

SEQ ID NO: 1163587 - RNA, 14 nt, Homo sapiens
ccaacagcacccuc

SEQ ID NO: 1163588 - RNA, 21 nt, Homo sapiens
ccaacaugaaaacaauucuua

SEQ ID NO: 1163589 - RNA, 12 nt, Homo sapiens
ccaacaugguga

SEQ ID NO: 1163590 - RNA, 23 nt, Homo sapiens
ccaaccauguucccuucuucuua

SEQ ID NO: 1163591 - RNA, 15 nt, Homo sapiens
ccaacccccaucucc

SEQ ID NO: 1163592 - RNA, 21 nt, Homo sapiens
ccaacuagcucuauguuuaca

SEQ ID NO: 1163593 - RNA, 14 nt, Homo sapiens
ccaacucauccacg

SEQ ID NO: 1163594 - RNA, 17 nt, Homo sapiens
ccaacuccaaccucucg

SEQ ID NO: 1163595 - RNA, 18 nt, Homo sapiens
ccaacuguuggaauucac

SEQ ID NO: 1163596 - RNA, 23 nt, Homo sapiens
ccaagaaacacugccugcccucu

SEQ ID NO: 1163597 - RNA, 21 nt, Homo sapiens
ccaagagcagcugccauugca

SEQ ID NO: 1163598 - RNA, 19 nt, Homo sapiens
ccaagaugucaaaacaaga

SEQ ID NO: 1163599 - RNA, 15 nt, Homo sapiens
ccaagcaagacugag

SEQ ID NO: 1163600 - RNA, 22 nt, Homo sapiens
ccaagcaggaaaugaaaauguc

SEQ ID NO: 1163601 - RNA, 13 nt, Homo sapiens
ccaagcagugcac

SEQ ID NO: 1163602 - RNA, 23 nt, Homo sapiens
ccaagcagugccugccuaugaaa

SEQ ID NO: 1163603 - RNA, 11 nt, Homo sapiens
ccaagcauuua

SEQ ID NO: 1163604 - RNA, 19 nt, Homo sapiens
ccaagccaagagugccaca

SEQ ID NO: 1163605 - RNA, 14 nt, Homo sapiens
ccaagcgaauuugu

SEQ ID NO: 1163606 - RNA, 19 nt, Homo sapiens
ccaagcuguguucauccag

SEQ ID NO: 1163607 - RNA, 19 nt, Homo sapiens
ccaaggaaacccccagugu

SEQ ID NO: 1163608 - RNA, 22 nt, Homo sapiens
ccaaggaaacccccaguguaau

SEQ ID NO: 1163609 - RNA, 23 nt, Homo sapiens
ccaaggaaacccccaguguaaua

SEQ ID NO: 1163610 - RNA, 21 nt, Homo sapiens
ccaaggaaaggcauguacaaa

SEQ ID NO: 1163611 - RNA, 22 nt, Homo sapiens
ccaaggaaaggcauguacaaaa

SEQ ID NO: 1163612 - RNA, 22 nt, Homo sapiens
ccaaggaacuaauuucuucucc

SEQ ID NO: 1163613 - RNA, 19 nt, Homo sapiens
ccaaggagggugagugcaa

SEQ ID NO: 1163614 - RNA, 18 nt, Homo sapiens
ccaaggccuccugugacu

SEQ ID NO: 1163615 - RNA, 15 nt, Homo sapiens
ccaaggcugaugcag

SEQ ID NO: 1163616 - RNA, 22 nt, Homo sapiens
ccaagggggcggggacugcugg

SEQ ID NO: 1163617 - RNA, 14 nt, Homo sapiens
ccaagguaggcaga

SEQ ID NO: 1163618 - RNA, 22 nt, Homo sapiens
ccaaggucacuuccguuuaccu

SEQ ID NO: 1163619 - RNA, 18 nt, Homo sapiens
ccaaggucucacacuccu

SEQ ID NO: 1163620 - RNA, 15 nt, Homo sapiens
ccaagguuuaaagag

SEQ ID NO: 1163621 - RNA, 18 nt, Homo sapiens
ccaaguugaagacuuugu

SEQ ID NO: 1163622 - RNA, 17 nt, Homo sapiens
ccaauagacgccaguag

SEQ ID NO: 1163623 - RNA, 21 nt, Homo sapiens
ccaauagcaggggcugcagua

SEQ ID NO: 1163624 - RNA, 14 nt, Homo sapiens
ccaauaugacucag

SEQ ID NO: 1163625 - RNA, 16 nt, Homo sapiens
ccaaucacucuauaca

SEQ ID NO: 1163626 - RNA, 18 nt, Homo sapiens
ccaaucagaucaacucug

SEQ ID NO: 1163627 - RNA, 20 nt, Homo sapiens
ccaauccauccugcucagga

SEQ ID NO: 1163628 - RNA, 21 nt, Homo sapiens
ccaaucucgucaggcugccag

SEQ ID NO: 1163629 - RNA, 15 nt, Homo sapiens
ccaaucuuaguuucu

SEQ ID NO: 1163630 - RNA, 14 nt, Homo sapiens
ccaaucuuuccuac

SEQ ID NO: 1163631 - RNA, 12 nt, Homo sapiens
ccaaugaaauga

SEQ ID NO: 1163632 - RNA, 16 nt, Homo sapiens
ccaauggaaugugaug

SEQ ID NO: 1163633 - RNA, 18 nt, Homo sapiens
ccaauguuguguguugca

SEQ ID NO: 1163634 - RNA, 17 nt, Homo sapiens
ccaauuucagacuccca

SEQ ID NO: 1163635 - RNA, 21 nt, Homo sapiens
ccacaaaugggaaaaccagac

SEQ ID NO: 1163636 - RNA, 19 nt, Homo sapiens
ccacaaggcuguugcaugg

SEQ ID NO: 1163637 - RNA, 16 nt, Homo sapiens
ccacaauauuaccuua

SEQ ID NO: 1163638 - RNA, 19 nt, Homo sapiens
ccacaaucugacauucuca

SEQ ID NO: 1163639 - RNA, 22 nt, Homo sapiens
ccacacccaauuccacucugau

SEQ ID NO: 1163640 - RNA, 14 nt, Homo sapiens
ccacacccaugugu

SEQ ID NO: 1163641 - RNA, 16 nt, Homo sapiens
ccacacccugccugcu

SEQ ID NO: 1163642 - RNA, 15 nt, Homo sapiens
ccacacgcacugcac

SEQ ID NO: 1163643 - RNA, 12 nt, Homo sapiens
ccacacucagca

SEQ ID NO: 1163644 - RNA, 13 nt, Homo sapiens
ccacacuggacuc

SEQ ID NO: 1163645 - RNA, 16 nt, Homo sapiens
ccacacuugugccagc

SEQ ID NO: 1163646 - RNA, 23 nt, Homo sapiens
ccacagaacacagcaauuccuca

SEQ ID NO: 1163647 - RNA, 21 nt, Homo sapiens
ccacagaaggaagagggaucc

SEQ ID NO: 1163648 - RNA, 17 nt, Homo sapiens
ccacagacagcuuagaa

SEQ ID NO: 1163649 - RNA, 14 nt, Homo sapiens
ccacagcacagcca

SEQ ID NO: 1163650 - RNA, 12 nt, Homo sapiens
ccacagcacuau

SEQ ID NO: 1163651 - RNA, 12 nt, Homo sapiens
ccacagcauuua

SEQ ID NO: 1163652 - RNA, 21 nt, Homo sapiens
ccacagcuuauggcaucucau

SEQ ID NO: 1163653 - RNA, 14 nt, Homo sapiens
ccacaggacauuuc

SEQ ID NO: 1163654 - RNA, 17 nt, Homo sapiens
ccacaggaucaucauuu

SEQ ID NO: 1163655 - RNA, 18 nt, Homo sapiens
ccacagggcagggccuca

SEQ ID NO: 1163656 - RNA, 12 nt, Homo sapiens
ccacagucugac

SEQ ID NO: 1163657 - RNA, 23 nt, Homo sapiens
ccacauccuccacguucugcuca

SEQ ID NO: 1163658 - RNA, 20 nt, Homo sapiens
ccacaugugacacauaugca

SEQ ID NO: 1163659 - RNA, 23 nt, Homo sapiens
ccacauuuagauccugguuucau

SEQ ID NO: 1163660 - RNA, 22 nt, Homo sapiens
ccacauuugugccgacacuguu

SEQ ID NO: 1163661 - RNA, 13 nt, Homo sapiens
ccaccacuauaaa

SEQ ID NO: 1163662 - RNA, 22 nt, Homo sapiens
ccaccacuauaaaaugucuuca

SEQ ID NO: 1163663 - RNA, 13 nt, Homo sapiens
ccaccagccacuu

SEQ ID NO: 1163664 - RNA, 14 nt, Homo sapiens
ccaccagccacuuu

SEQ ID NO: 1163665 - RNA, 19 nt, Homo sapiens
cucagagaaccagugcaga

SEQ ID NO: 1163666 - RNA, 22 nt, Homo sapiens
cucagagaguacacugugucuc

SEQ ID NO: 1163667 - RNA, 12 nt, Homo sapiens
cucagagcccau

SEQ ID NO: 1163668 - RNA, 16 nt, Homo sapiens
cucagaggcgcacugu

SEQ ID NO: 1163669 - RNA, 15 nt, Homo sapiens
cucagaggguguccu

SEQ ID NO: 1163670 - RNA, 14 nt, Homo sapiens
cucagaguucuaua

SEQ ID NO: 1163671 - RNA, 18 nt, Homo sapiens
cucagaucaguguaccau

SEQ ID NO: 1163672 - RNA, 18 nt, Homo sapiens
cucagcaagccaugcccc

SEQ ID NO: 1163673 - RNA, 21 nt, Homo sapiens
cucagcagcugguaaucuugc

SEQ ID NO: 1163674 - RNA, 19 nt, Homo sapiens
cucagccauaggugcaguu

SEQ ID NO: 1163675 - RNA, 19 nt, Homo sapiens
cucagcccccaccucaggu

SEQ ID NO: 1163676 - RNA, 15 nt, Homo sapiens
cucagcccugacccu

SEQ ID NO: 1163677 - RNA, 22 nt, Homo sapiens
cucagccuguugcggaucuuca

SEQ ID NO: 1163678 - RNA, 20 nt, Homo sapiens
cucagcgcgucucagcucag

SEQ ID NO: 1163679 - RNA, 18 nt, Homo sapiens
cucagcuagacauugcaa

SEQ ID NO: 1163680 - RNA, 14 nt, Homo sapiens
cucagcucuuggcu

SEQ ID NO: 1163681 - RNA, 15 nt, Homo sapiens
cucaggaaaccacaa

SEQ ID NO: 1163682 - RNA, 13 nt, Homo sapiens
cucaggacagaug

SEQ ID NO: 1163683 - RNA, 19 nt, Homo sapiens
cucaggcacacagcuacuc

SEQ ID NO: 1163684 - RNA, 17 nt, Homo sapiens
cucaggcaccugcacuu

SEQ ID NO: 1163685 - RNA, 16 nt, Homo sapiens
cucaggcuggcaccgc

SEQ ID NO: 1163686 - RNA, 15 nt, Homo sapiens
cucagggcacaaaga

SEQ ID NO: 1163687 - RNA, 14 nt, Homo sapiens
cucagggcagccuc

SEQ ID NO: 1163688 - RNA, 17 nt, Homo sapiens
cucagggcagccucccc

SEQ ID NO: 1163689 - RNA, 23 nt, Homo sapiens
cucagggcagccucccccggcuc

SEQ ID NO: 1163690 - RNA, 17 nt, Homo sapiens
cucaggggacacuggcc

SEQ ID NO: 1163691 - RNA, 22 nt, Homo sapiens
cucaggggugauaacucaggaa

SEQ ID NO: 1163692 - RNA, 12 nt, Homo sapiens
cucaggugggag

SEQ ID NO: 1163693 - RNA, 18 nt, Homo sapiens
cucaguauccaugcucuu

SEQ ID NO: 1163694 - RNA, 17 nt, Homo sapiens
cucagucagacauggcc

SEQ ID NO: 1163695 - RNA, 21 nt, Homo sapiens
cucagucccuaaaaacacaga

SEQ ID NO: 1163696 - RNA, 11 nt, Homo sapiens
cucagugcaac

SEQ ID NO: 1163697 - RNA, 20 nt, Homo sapiens
cucagugggggcagagccac

SEQ ID NO: 1163698 - RNA, 22 nt, Homo sapiens
cucauaacucugugaucuugcu

SEQ ID NO: 1163699 - RNA, 19 nt, Homo sapiens
cucauagauguuaugcaaa

SEQ ID NO: 1163700 - RNA, 17 nt, Homo sapiens
cucauaggaugguacca

SEQ ID NO: 1163701 - RNA, 18 nt, Homo sapiens
cucaucagaaacucaaaa

SEQ ID NO: 1163702 - RNA, 21 nt, Homo sapiens
cucaucauagcaauaacauuc

SEQ ID NO: 1163703 - RNA, 22 nt, Homo sapiens
cucaucauagcaauaacauucc

SEQ ID NO: 1163704 - RNA, 23 nt, Homo sapiens
cucaucauagcaauaacauuccc

SEQ ID NO: 1163705 - RNA, 17 nt, Homo sapiens
cucaucccgagcaccuc

SEQ ID NO: 1163706 - RNA, 21 nt, Homo sapiens
cucaugaauaauccaccccuu

SEQ ID NO: 1163707 - RNA, 21 nt, Homo sapiens
cucaugcugcagaggguacuu

SEQ ID NO: 1163708 - RNA, 16 nt, Homo sapiens
cucaugggaaggggag

SEQ ID NO: 1163709 - RNA, 14 nt, Homo sapiens
cucauguccacuca

SEQ ID NO: 1163710 - RNA, 16 nt, Homo sapiens
cucauuaaugacacuu

SEQ ID NO: 1163711 - RNA, 12 nt, Homo sapiens
cucauuagacug

SEQ ID NO: 1163712 - RNA, 17 nt, Homo sapiens
cucauuauuuuucacug

SEQ ID NO: 1163713 - RNA, 16 nt, Homo sapiens
cucauugcugcccguu

SEQ ID NO: 1163714 - RNA, 16 nt, Homo sapiens
agacaguuauugcaag

SEQ ID NO: 1163715 - RNA, 19 nt, Homo sapiens
agacaguuuaccauccuca

SEQ ID NO: 1163716 - RNA, 19 nt, Homo sapiens
agacaguuuacuuugccaa

SEQ ID NO: 1163717 - RNA, 16 nt, Homo sapiens
agacauacauuucuca

SEQ ID NO: 1163718 - RNA, 17 nt, Homo sapiens
agacaucaccaacuguc

SEQ ID NO: 1163719 - RNA, 21 nt, Homo sapiens
agacaucauguaucgcauauu

SEQ ID NO: 1163720 - RNA, 15 nt, Homo sapiens
agacaugcagcuuuc

SEQ ID NO: 1163721 - RNA, 23 nt, Homo sapiens
agacaugguggcaugcaccugca

SEQ ID NO: 1163722 - RNA, 14 nt, Homo sapiens
agacauguuucaag

SEQ ID NO: 1163723 - RNA, 21 nt, Homo sapiens
agacauucagcacacugugaa

SEQ ID NO: 1163724 - RNA, 22 nt, Homo sapiens
agaccaacagaacuucacagug

SEQ ID NO: 1163725 - RNA, 15 nt, Homo sapiens
auucgaaugacacug

SEQ ID NO: 1163726 - RNA, 23 nt, Homo sapiens
auucguuuuguucauauucacua

SEQ ID NO: 1163727 - RNA, 16 nt, Homo sapiens
auucuaaaccaaucaa

SEQ ID NO: 1163728 - RNA, 18 nt, Homo sapiens
auucuacguaucugcuac

SEQ ID NO: 1163729 - RNA, 11 nt, Homo sapiens
auucuacucaa

SEQ ID NO: 1163730 - RNA, 15 nt, Homo sapiens
auucuaggccuccug

SEQ ID NO: 1163731 - RNA, 20 nt, Homo sapiens
auucuaguguaaaucaugca

SEQ ID NO: 1163732 - RNA, 16 nt, Homo sapiens
auucuaguuuugucaa

SEQ ID NO: 1163733 - RNA, 15 nt, Homo sapiens
auucuauacuguuga

SEQ ID NO: 1163734 - RNA, 16 nt, Homo sapiens
auucuauuccuaucug

SEQ ID NO: 1163735 - RNA, 17 nt, Homo sapiens
auucuauuuauauguac

SEQ ID NO: 1163736 - RNA, 21 nt, Homo sapiens
auucuauuuauauguacauga

SEQ ID NO: 1163737 - RNA, 21 nt, Homo sapiens
auucucacuccaccacccaaa

SEQ ID NO: 1163738 - RNA, 19 nt, Homo sapiens
auucucaugggaaggggag

SEQ ID NO: 1163739 - RNA, 19 nt, Homo sapiens
auucuccuuugcaguuccu

SEQ ID NO: 1163740 - RNA, 19 nt, Homo sapiens
auucucucuaacauaacaa

SEQ ID NO: 1163741 - RNA, 21 nt, Homo sapiens
auucucuggcuguaaggcucu

SEQ ID NO: 1163742 - RNA, 16 nt, Homo sapiens
auucugaauuugcaaa

SEQ ID NO: 1163743 - RNA, 20 nt, Homo sapiens
auucugauuugccacugaua

SEQ ID NO: 1163744 - RNA, 23 nt, Homo sapiens
auucugcaguaaaucuuuuacaa

SEQ ID NO: 1163745 - RNA, 17 nt, Homo sapiens
auucuguuguguucacc

SEQ ID NO: 1163746 - RNA, 17 nt, Homo sapiens
auucuuacauuuuacuu

SEQ ID NO: 1163747 - RNA, 19 nt, Homo sapiens
auucuuaugauuacuauca

SEQ ID NO: 1163748 - RNA, 21 nt, Homo sapiens
auucuucuuugguggagauaa

SEQ ID NO: 1163749 - RNA, 13 nt, Homo sapiens
auucuuggaauac

SEQ ID NO: 1163750 - RNA, 20 nt, Homo sapiens
auucuuguaaauacauaaaa

SEQ ID NO: 1163751 - RNA, 16 nt, Homo sapiens
auucuuuaucuugcaa

SEQ ID NO: 1163752 - RNA, 19 nt, Homo sapiens
auucuuucccaacaccucu

SEQ ID NO: 1163753 - RNA, 16 nt, Homo sapiens
auucuuuucacuuccu

SEQ ID NO: 1163754 - RNA, 17 nt, Homo sapiens
auucuuuuuccaucccu

SEQ ID NO: 1163755 - RNA, 17 nt, Homo sapiens
auugaaagaaccagaga

SEQ ID NO: 1163756 - RNA, 16 nt, Homo sapiens
auugaagccuuugcca

SEQ ID NO: 1163757 - RNA, 23 nt, Homo sapiens
auugaagccuuugccagccauuc

SEQ ID NO: 1163758 - RNA, 15 nt, Homo sapiens
gcaagauuucuuugu

SEQ ID NO: 1163759 - RNA, 15 nt, Homo sapiens
gcaagcaacugagau

SEQ ID NO: 1163760 - RNA, 13 nt, Homo sapiens
gcaaggagaaaaa

SEQ ID NO: 1163761 - RNA, 12 nt, Homo sapiens
gcaagugcuauu

SEQ ID NO: 1163762 - RNA, 18 nt, Homo sapiens
gcaauaaaaaucauagua

SEQ ID NO: 1163763 - RNA, 17 nt, Homo sapiens
gcaauaauaaaguacuu

SEQ ID NO: 1163764 - RNA, 14 nt, Homo sapiens
gcaauaaugcagua

SEQ ID NO: 1163765 - RNA, 22 nt, Homo sapiens
gcaauacgggagugacccagcu

SEQ ID NO: 1163766 - RNA, 21 nt, Homo sapiens
gcaauauaucugaagagcuau

SEQ ID NO: 1163767 - RNA, 18 nt, Homo sapiens
gcaauaucuacguguuuu

SEQ ID NO: 1163768 - RNA, 19 nt, Homo sapiens
gcaaucacguugaaacaag

SEQ ID NO: 1163769 - RNA, 16 nt, Homo sapiens
gcaaucuuaagcagag

SEQ ID NO: 1163770 - RNA, 18 nt, Homo sapiens
gcaaugagggagcaugua

SEQ ID NO: 1163771 - RNA, 14 nt, Homo sapiens
gcaaugcauucugg

SEQ ID NO: 1163772 - RNA, 22 nt, Homo sapiens
gcaaugcuaagcuguuugcuca

SEQ ID NO: 1163773 - RNA, 23 nt, Homo sapiens
gcaaugcuaagcuguuugcucac

SEQ ID NO: 1163774 - RNA, 22 nt, Homo sapiens
gcaauguguggcugaagacuuu

SEQ ID NO: 1163775 - RNA, 19 nt, Homo sapiens
gcaauucauaacuaaugaa

SEQ ID NO: 1163776 - RNA, 23 nt, Homo sapiens
gcaauucauaacuaaugaauuga

SEQ ID NO: 1163777 - RNA, 21 nt, Homo sapiens
gcaauugaauuaaauuaggaa

SEQ ID NO: 1163778 - RNA, 17 nt, Homo sapiens
gcaauugauuucuuuuc

SEQ ID NO: 1163779 - RNA, 21 nt, Homo sapiens
gcaauugauuucuuuucuucc

SEQ ID NO: 1163780 - RNA, 21 nt, Homo sapiens
gcaauuuaauauuuugcacag

SEQ ID NO: 1163781 - RNA, 17 nt, Homo sapiens
gcaauuuuguguaaauu

SEQ ID NO: 1163782 - RNA, 20 nt, Homo sapiens
gcacaaaaucagccaaagca

SEQ ID NO: 1163783 - RNA, 12 nt, Homo sapiens
gcacaaagaugg

SEQ ID NO: 1163784 - RNA, 13 nt, Homo sapiens
gcacaaauuccac

SEQ ID NO: 1163785 - RNA, 18 nt, Homo sapiens
gcacaagaaucacuugaa

SEQ ID NO: 1163786 - RNA, 19 nt, Homo sapiens
gcacaagguaaauauucau

SEQ ID NO: 1163787 - RNA, 14 nt, Homo sapiens
gcacacagggcagu

SEQ ID NO: 1163788 - RNA, 22 nt, Homo sapiens
gcacaccccuggggcugagucu

SEQ ID NO: 1163789 - RNA, 12 nt, Homo sapiens
gcacacuggccu

SEQ ID NO: 1163790 - RNA, 23 nt, Homo sapiens
gcacacuuacaguauacauauau

SEQ ID NO: 1163791 - RNA, 19 nt, Homo sapiens
gcacagauucccaggccag

SEQ ID NO: 1163792 - RNA, 14 nt, Homo sapiens
gcacagauuuacuc

SEQ ID NO: 1163793 - RNA, 13 nt, Homo sapiens
gcacagccuggcu

SEQ ID NO: 1163794 - RNA, 22 nt, Homo sapiens
gcacagggagacccguccauuu

SEQ ID NO: 1163795 - RNA, 20 nt, Homo sapiens
gcacauaucuccucuugggc

SEQ ID NO: 1163796 - RNA, 15 nt, Homo sapiens
gcacaugucuuguac

SEQ ID NO: 1163797 - RNA, 12 nt, Homo sapiens
gcacauuaacug

SEQ ID NO: 1163798 - RNA, 22 nt, Homo sapiens
gcacauuuuucucuuguuuucu

SEQ ID NO: 1163799 - RNA, 12 nt, Homo sapiens
gcaccaccaaga

SEQ ID NO: 1163800 - RNA, 16 nt, Homo sapiens
gcacccaacuagcucu

SEQ ID NO: 1163801 - RNA, 16 nt, Homo sapiens
gcacccacaaccagag

SEQ ID NO: 1163802 - RNA, 13 nt, Homo sapiens
gcacccucuccag

SEQ ID NO: 1163803 - RNA, 14 nt, Homo sapiens
gcacccucuccaga

SEQ ID NO: 1163804 - RNA, 13 nt, Homo sapiens
gcaccgugacagu

SEQ ID NO: 1163805 - RNA, 21 nt, Homo sapiens
gcaccucacaggccccaggaa

SEQ ID NO: 1163806 - RNA, 14 nt, Homo sapiens
gcaccucucuggga

SEQ ID NO: 1163807 - RNA, 17 nt, Homo sapiens
gcacgcggagcgaaaca

SEQ ID NO: 1163808 - RNA, 16 nt, Homo sapiens
gcacuaccauugcugu

SEQ ID NO: 1163809 - RNA, 20 nt, Homo sapiens
gcacucacgcccuaagcgca

SEQ ID NO: 1163810 - RNA, 23 nt, Homo sapiens
gcacucccuccagcacaaacaca

SEQ ID NO: 1163811 - RNA, 13 nt, Homo sapiens
gcacugacagugg

SEQ ID NO: 1163812 - RNA, 22 nt, Homo sapiens
gcacugaccccccccauuagaa

SEQ ID NO: 1163813 - RNA, 19 nt, Homo sapiens
gcacugugacccccagcuc

SEQ ID NO: 1163814 - RNA, 20 nt, Homo sapiens
gcacuguucccccugugcag

SEQ ID NO: 1163815 - RNA, 21 nt, Homo sapiens
gcacuuacaaucccaccuuuc

SEQ ID NO: 1163816 - RNA, 16 nt, Homo sapiens
gcacuuauacccauga

SEQ ID NO: 1163817 - RNA, 13 nt, Homo sapiens
gcacuuauucuca

SEQ ID NO: 1163818 - RNA, 13 nt, Homo sapiens
gcacuucacugga

SEQ ID NO: 1163819 - RNA, 13 nt, Homo sapiens
gcacuucauaucu

SEQ ID NO: 1163820 - RNA, 11 nt, Homo sapiens
gcacuugccug

SEQ ID NO: 1163821 - RNA, 20 nt, Homo sapiens
gcacuuugagaggcugaggu

SEQ ID NO: 1163822 - RNA, 16 nt, Homo sapiens
gcacuuugcaucacag

SEQ ID NO: 1163823 - RNA, 22 nt, Homo sapiens
cucucaggggugauaacucagg

SEQ ID NO: 1163824 - RNA, 22 nt, Homo sapiens
cucucaguccuucuugggggua

SEQ ID NO: 1163825 - RNA, 13 nt, Homo sapiens
cucuccaccaggu

SEQ ID NO: 1163826 - RNA, 13 nt, Homo sapiens
cucuccaugcaag

SEQ ID NO: 1163827 - RNA, 20 nt, Homo sapiens
cucuccccucagagugcaag

SEQ ID NO: 1163828 - RNA, 14 nt, Homo sapiens
cucucccuuguaca

SEQ ID NO: 1163829 - RNA, 13 nt, Homo sapiens
cucucccuugugg

SEQ ID NO: 1163830 - RNA, 17 nt, Homo sapiens
cucuccgggaccugauc

SEQ ID NO: 1163831 - RNA, 20 nt, Homo sapiens
cucuccuuuuucucuucaca

SEQ ID NO: 1163832 - RNA, 16 nt, Homo sapiens
cucucgacaguaucca

SEQ ID NO: 1163833 - RNA, 18 nt, Homo sapiens
cucucgacaguauccaca

SEQ ID NO: 1163834 - RNA, 12 nt, Homo sapiens
cucucucacuga

SEQ ID NO: 1163835 - RNA, 12 nt, Homo sapiens
cucucucaggag

SEQ ID NO: 1163836 - RNA, 15 nt, Homo sapiens
cucugaggauguaua

SEQ ID NO: 1163837 - RNA, 16 nt, Homo sapiens
cucugauugcuuuauc

SEQ ID NO: 1163838 - RNA, 12 nt, Homo sapiens
cucugcacaugu

SEQ ID NO: 1163839 - RNA, 19 nt, Homo sapiens
cucugcaccguacugugga

SEQ ID NO: 1163840 - RNA, 16 nt, Homo sapiens
cucugcagacuuccca

SEQ ID NO: 1163841 - RNA, 15 nt, Homo sapiens
cucugcaucccccaa

SEQ ID NO: 1163842 - RNA, 19 nt, Homo sapiens
cucugccaagauacuugaa

SEQ ID NO: 1163843 - RNA, 22 nt, Homo sapiens
cucugccaagauacuugaacac

SEQ ID NO: 1163844 - RNA, 13 nt, Homo sapiens
cucugcccgggag

SEQ ID NO: 1163845 - RNA, 21 nt, Homo sapiens
cucugcgccggacuuggugcg

SEQ ID NO: 1163846 - RNA, 23 nt, Homo sapiens
cucugcuccaaaggaaauccaaa

SEQ ID NO: 1163847 - RNA, 20 nt, Homo sapiens
cucugcugucuaaccuguga

SEQ ID NO: 1163848 - RNA, 20 nt, Homo sapiens
cucuggauugagauacuuga

SEQ ID NO: 1163849 - RNA, 15 nt, Homo sapiens
cucuggcgacaguuu

SEQ ID NO: 1163850 - RNA, 17 nt, Homo sapiens
cucuggcgacaguuuuc

SEQ ID NO: 1163851 - RNA, 15 nt, Homo sapiens
cucuggcucuugucc

SEQ ID NO: 1163852 - RNA, 21 nt, Homo sapiens
cucuggcuuccugcugagucc

SEQ ID NO: 1163853 - RNA, 17 nt, Homo sapiens
cucugggcucaagcaau

SEQ ID NO: 1163854 - RNA, 13 nt, Homo sapiens
cucuguacacugc

SEQ ID NO: 1163855 - RNA, 15 nt, Homo sapiens
cucuguaguggaaua

SEQ ID NO: 1163856 - RNA, 18 nt, Homo sapiens
cucugucuagcaugccaa

SEQ ID NO: 1163857 - RNA, 16 nt, Homo sapiens
cucugucuggauuugc

SEQ ID NO: 1163858 - RNA, 14 nt, Homo sapiens
cucugugaaaucag

SEQ ID NO: 1163859 - RNA, 15 nt, Homo sapiens
cucugugccuugguc

SEQ ID NO: 1163860 - RNA, 18 nt, Homo sapiens
cucuguggccacauuuuc

SEQ ID NO: 1163861 - RNA, 18 nt, Homo sapiens
cucugugggcuccaugua

SEQ ID NO: 1163862 - RNA, 14 nt, Homo sapiens
cucuuagcaaaaac

SEQ ID NO: 1163863 - RNA, 16 nt, Homo sapiens
cucuuaggaggcauuu

SEQ ID NO: 1163864 - RNA, 19 nt, Homo sapiens
cucuuauagaaaguucaaa

SEQ ID NO: 1163865 - RNA, 12 nt, Homo sapiens
cucuucaaggac

SEQ ID NO: 1163866 - RNA, 13 nt, Homo sapiens
cucuucucaaagc

SEQ ID NO: 1163867 - RNA, 13 nt, Homo sapiens
cucuucugaccca

SEQ ID NO: 1163868 - RNA, 23 nt, Homo sapiens
cucuucugagcacagauguuccc

SEQ ID NO: 1163869 - RNA, 14 nt, Homo sapiens
cucuucuuacuggu

SEQ ID NO: 1163870 - RNA, 19 nt, Homo sapiens
cucuucuuggggcccagug

SEQ ID NO: 1163871 - RNA, 22 nt, Homo sapiens
cucuucuuuuggcuuccaugau

SEQ ID NO: 1163872 - RNA, 19 nt, Homo sapiens
cucuugauuaagaucucag

SEQ ID NO: 1163873 - RNA, 15 nt, Homo sapiens
cucuuggcaccugcc

SEQ ID NO: 1163874 - RNA, 14 nt, Homo sapiens
cucuuggcagucac

SEQ ID NO: 1163875 - RNA, 21 nt, Homo sapiens
cucuugggaacugaacucacu

SEQ ID NO: 1163876 - RNA, 19 nt, Homo sapiens
cucuugggagggaguuacu

SEQ ID NO: 1163877 - RNA, 13 nt, Homo sapiens
cucuuggguucaa

SEQ ID NO: 1163878 - RNA, 15 nt, Homo sapiens
cucuugucacaugga

SEQ ID NO: 1163879 - RNA, 14 nt, Homo sapiens
cucuuguucccaca

SEQ ID NO: 1163880 - RNA, 18 nt, Homo sapiens
cucuuguucccacacccc

SEQ ID NO: 1163881 - RNA, 18 nt, Homo sapiens
cucuuuaaaaugcaaaau

SEQ ID NO: 1163882 - RNA, 21 nt, Homo sapiens
cucuuuaaugcugccugccuu

SEQ ID NO: 1163883 - RNA, 21 nt, Homo sapiens
cucuuuacugagcaguaggua

SEQ ID NO: 1163884 - RNA, 16 nt, Homo sapiens
cucuuucgcuuggcag

SEQ ID NO: 1163885 - RNA, 21 nt, Homo sapiens
cucuuugauuugugcugugua

SEQ ID NO: 1163886 - RNA, 12 nt, Homo sapiens
cucuuuggugua

SEQ ID NO: 1163887 - RNA, 23 nt, Homo sapiens
cucuuugugauaauucucaguag

SEQ ID NO: 1163888 - RNA, 17 nt, Homo sapiens
cucuuuuagcugaugaa

SEQ ID NO: 1163889 - RNA, 16 nt, Homo sapiens
cucuuuuauacuguac

SEQ ID NO: 1163890 - RNA, 17 nt, Homo sapiens
cucuuuuauacuguacu

SEQ ID NO: 1163891 - RNA, 18 nt, Homo sapiens
cugaaaaaauacuaccua

SEQ ID NO: 1163892 - RNA, 15 nt, Homo sapiens
cugaaaaacuuaccu

SEQ ID NO: 1163893 - RNA, 18 nt, Homo sapiens
cugaaaagaggagccaga

SEQ ID NO: 1163894 - RNA, 13 nt, Homo sapiens
cugaaaagccaug

SEQ ID NO: 1163895 - RNA, 14 nt, Homo sapiens
cugaaaagccaugu

SEQ ID NO: 1163896 - RNA, 13 nt, Homo sapiens
cugaaaaucaaua

SEQ ID NO: 1163897 - RNA, 23 nt, Homo sapiens
cugaaaccucugggucaucucuc

SEQ ID NO: 1163898 - RNA, 12 nt, Homo sapiens
cugaaagcacug

SEQ ID NO: 1163899 - RNA, 12 nt, Homo sapiens
cugaaagccugu

SEQ ID NO: 1163900 - RNA, 22 nt, Homo sapiens
cugaaaggguuuuuaaucucca

SEQ ID NO: 1163901 - RNA, 12 nt, Homo sapiens
cugaaagugaaa

SEQ ID NO: 1163902 - RNA, 21 nt, Homo sapiens
cugaaagugaaaguccagaaa

SEQ ID NO: 1163903 - RNA, 18 nt, Homo sapiens
cugaaaguuguacaugaa

SEQ ID NO: 1163904 - RNA, 16 nt, Homo sapiens
cugaaauaaugaucuu

SEQ ID NO: 1163905 - RNA, 19 nt, Homo sapiens
cugaaaucaagucaucuau

SEQ ID NO: 1163906 - RNA, 19 nt, Homo sapiens
cugaaaugcuagcugcaag

SEQ ID NO: 1163907 - RNA, 15 nt, Homo sapiens
cugaaauuaacucag

SEQ ID NO: 1163908 - RNA, 16 nt, Homo sapiens
gaguguucaacuguga

SEQ ID NO: 1163909 - RNA, 23 nt, Homo sapiens
gaguguuuuucauggaaaagccu

SEQ ID NO: 1163910 - RNA, 16 nt, Homo sapiens
gaguuaaaacauuucu

SEQ ID NO: 1163911 - RNA, 18 nt, Homo sapiens
gaguuacaacagaagcug

SEQ ID NO: 1163912 - RNA, 18 nt, Homo sapiens
gaguuaggcuauucacaa

SEQ ID NO: 1163913 - RNA, 17 nt, Homo sapiens
gaguuauauguucacug

SEQ ID NO: 1163914 - RNA, 19 nt, Homo sapiens
gaguucaguggcacucaac

SEQ ID NO: 1163915 - RNA, 21 nt, Homo sapiens
gaguugggaguuauuacucaa

SEQ ID NO: 1163916 - RNA, 14 nt, Homo sapiens
gaguuucugcaguu

SEQ ID NO: 1163917 - RNA, 13 nt, Homo sapiens
gaguuuucagugg

SEQ ID NO: 1163918 - RNA, 21 nt, Homo sapiens
gauaaaaaagaaaacauucca

SEQ ID NO: 1163919 - RNA, 22 nt, Homo sapiens
gauaaaagacacucccaccagc

SEQ ID NO: 1163920 - RNA, 18 nt, Homo sapiens
gauaaaagacagugaaag

SEQ ID NO: 1163921 - RNA, 16 nt, Homo sapiens
gauaaacuaacuacug

SEQ ID NO: 1163922 - RNA, 17 nt, Homo sapiens
gauaaacuaacuacugu

SEQ ID NO: 1163923 - RNA, 10 nt, Homo sapiens
gauaaacuag

SEQ ID NO: 1163924 - RNA, 13 nt, Homo sapiens
gauaaagccuaaa

SEQ ID NO: 1163925 - RNA, 14 nt, Homo sapiens
gauaaaguaguaaa

SEQ ID NO: 1163926 - RNA, 19 nt, Homo sapiens
gauaacagaaaggcuuuuu

SEQ ID NO: 1163927 - RNA, 19 nt, Homo sapiens
gauaacuuugugauguuuc

SEQ ID NO: 1163928 - RNA, 24 nt, Homo sapiens
gauaauauccagccucccacaaga

SEQ ID NO: 1163929 - RNA, 17 nt, Homo sapiens
gauaaucguguccugaa

SEQ ID NO: 1163930 - RNA, 21 nt, Homo sapiens
gauaccgaaguugaaagcaag

SEQ ID NO: 1163931 - RNA, 15 nt, Homo sapiens
gauacucuaguaugu

SEQ ID NO: 1163932 - RNA, 16 nt, Homo sapiens
gauacugcauguuugc

SEQ ID NO: 1163933 - RNA, 17 nt, Homo sapiens
gauacugucucuuucau

SEQ ID NO: 1163934 - RNA, 20 nt, Homo sapiens
gauacuugaacacuguguuu

SEQ ID NO: 1163935 - RNA, 17 nt, Homo sapiens
gauacuugccaaaauga

SEQ ID NO: 1163936 - RNA, 16 nt, Homo sapiens
gauagaauuauuucac

SEQ ID NO: 1163937 - RNA, 12 nt, Homo sapiens
gauagcaaguga

SEQ ID NO: 1163938 - RNA, 14 nt, Homo sapiens
gauagcugguguua

SEQ ID NO: 1163939 - RNA, 21 nt, Homo sapiens
gauagcuucaccccaauccca

SEQ ID NO: 1163940 - RNA, 14 nt, Homo sapiens
gauaggguggcaca

SEQ ID NO: 1163941 - RNA, 13 nt, Homo sapiens
gauagugguauga

SEQ ID NO: 1163942 - RNA, 15 nt, Homo sapiens
gauauacaaagggau

SEQ ID NO: 1163943 - RNA, 15 nt, Homo sapiens
gauauacuuacucau

SEQ ID NO: 1163944 - RNA, 12 nt, Homo sapiens
gauaucuuguaa

SEQ ID NO: 1163945 - RNA, 15 nt, Homo sapiens
gauaugacaacucuu

SEQ ID NO: 1163946 - RNA, 14 nt, Homo sapiens
gauaugcauuugac

SEQ ID NO: 1163947 - RNA, 12 nt, Homo sapiens
gauauggcuuuu

SEQ ID NO: 1163948 - RNA, 23 nt, Homo sapiens
gauauuuaacuuuuugccaaaua

SEQ ID NO: 1163949 - RNA, 19 nt, Homo sapiens
gauauuuucccuaccuaag

SEQ ID NO: 1163950 - RNA, 19 nt, Homo sapiens
gaucaacucugucuugggc

SEQ ID NO: 1163951 - RNA, 14 nt, Homo sapiens
gaucaagcugugag

SEQ ID NO: 1163952 - RNA, 22 nt, Homo sapiens
gaucaagcugugagacaguggg

SEQ ID NO: 1163953 - RNA, 11 nt, Homo sapiens
gaucacauugc

SEQ ID NO: 1163954 - RNA, 22 nt, Homo sapiens
gaucacgccauuguacuccagc

SEQ ID NO: 1163955 - RNA, 19 nt, Homo sapiens
gaucacuuccuauaugcac

SEQ ID NO: 1163956 - RNA, 11 nt, Homo sapiens
gaucacuugag

SEQ ID NO: 1163957 - RNA, 12 nt, Homo sapiens
gaucagugaaaa

SEQ ID NO: 1163958 - RNA, 16 nt, Homo sapiens
gaucauaguugcaaaa

SEQ ID NO: 1163959 - RNA, 20 nt, Homo sapiens
gaucaucacuuccuugcccc

SEQ ID NO: 1163960 - RNA, 13 nt, Homo sapiens
gaucaucagucac

SEQ ID NO: 1163961 - RNA, 17 nt, Homo sapiens
gaucaucuaauucucug

SEQ ID NO: 1163962 - RNA, 18 nt, Homo sapiens
gaucaugauguagagugu

SEQ ID NO: 1163963 - RNA, 21 nt, Homo sapiens
gaucauguaaaugcucaaaga

SEQ ID NO: 1163964 - RNA, 23 nt, Homo sapiens
gauccaaaagaagcccccagcua

SEQ ID NO: 1163965 - RNA, 20 nt, Homo sapiens
gauccaagcagccugagcaa

SEQ ID NO: 1163966 - RNA, 14 nt, Homo sapiens
gauccaauaugacu

SEQ ID NO: 1163967 - RNA, 21 nt, Homo sapiens
gauccaauaugacucagagaa

SEQ ID NO: 1163968 - RNA, 17 nt, Homo sapiens
gaucccaauaacccagc

SEQ ID NO: 1163969 - RNA, 21 nt, Homo sapiens
gaucccguucagaaaaccacu

SEQ ID NO: 1163970 - RNA, 21 nt, Homo sapiens
gauccggcagccucucuucac

SEQ ID NO: 1163971 - RNA, 19 nt, Homo sapiens
gauccuccaacagcuguca

SEQ ID NO: 1163972 - RNA, 20 nt, Homo sapiens
gaucgcaccacugcacucca

SEQ ID NO: 1163973 - RNA, 22 nt, Homo sapiens
gaucgcaccacugcacuccagc

SEQ ID NO: 1163974 - RNA, 20 nt, Homo sapiens
gaucgugccacugcacucca

SEQ ID NO: 1163975 - RNA, 18 nt, Homo sapiens
gaucguucucugccucac

SEQ ID NO: 1163976 - RNA, 16 nt, Homo sapiens
aaugugcuguguaaag

SEQ ID NO: 1163977 - RNA, 23 nt, Homo sapiens
aauguguauggguuaaaucaaag

SEQ ID NO: 1163978 - RNA, 19 nt, Homo sapiens
aaugugugccuuguucaag

SEQ ID NO: 1163979 - RNA, 23 nt, Homo sapiens
aaugugugguuuuuaugauuuau

SEQ ID NO: 1163980 - RNA, 19 nt, Homo sapiens
aauguguucaccaucccaa

SEQ ID NO: 1163981 - RNA, 14 nt, Homo sapiens
aauguugcuuuaac

SEQ ID NO: 1163982 - RNA, 21 nt, Homo sapiens
aauguuggacaccuuuagguu

SEQ ID NO: 1163983 - RNA, 16 nt, Homo sapiens
aauguuggagcuuuag

SEQ ID NO: 1163984 - RNA, 16 nt, Homo sapiens
aauguugggacugcua

SEQ ID NO: 1163985 - RNA, 13 nt, Homo sapiens
aauguuucagcug

SEQ ID NO: 1163986 - RNA, 22 nt, Homo sapiens
aauguuucuguccuuucuguga

SEQ ID NO: 1163987 - RNA, 15 nt, Homo sapiens
aauguuugauacucu

SEQ ID NO: 1163988 - RNA, 13 nt, Homo sapiens
aauguuugcugag

SEQ ID NO: 1163989 - RNA, 19 nt, Homo sapiens
aauguuugcugaguuagaa

SEQ ID NO: 1163990 - RNA, 17 nt, Homo sapiens
aauguuuucuuugcaaa

SEQ ID NO: 1163991 - RNA, 22 nt, Homo sapiens
aauuaaaaauaccaacuguaca

SEQ ID NO: 1163992 - RNA, 13 nt, Homo sapiens
aauuaaaaccaau

SEQ ID NO: 1163993 - RNA, 16 nt, Homo sapiens
aauuaaaaccaauuua

SEQ ID NO: 1163994 - RNA, 19 nt, Homo sapiens
aauuaaaauccucaaucca

SEQ ID NO: 1163995 - RNA, 18 nt, Homo sapiens
aauuaaaauggaugccuu

SEQ ID NO: 1163996 - RNA, 23 nt, Homo sapiens
aauuaaaggagaagauuccugaa

SEQ ID NO: 1163997 - RNA, 14 nt, Homo sapiens
aauuaaagugcugu

SEQ ID NO: 1163998 - RNA, 13 nt, Homo sapiens
aauuaacaaucaa

SEQ ID NO: 1163999 - RNA, 18 nt, Homo sapiens
aauuaacagcagaaucuc

SEQ ID NO: 1164000 - RNA, 15 nt, Homo sapiens
aauuaaccuuacuaa

SEQ ID NO: 1164001 - RNA, 14 nt, Homo sapiens
aauuaacucagaca

SEQ ID NO: 1164002 - RNA, 15 nt, Homo sapiens
aauuaagcuguaauc

SEQ ID NO: 1164003 - RNA, 13 nt, Homo sapiens
aauuaauagcuuu

SEQ ID NO: 1164004 - RNA, 13 nt, Homo sapiens
aauuacagcaguu

SEQ ID NO: 1164005 - RNA, 14 nt, Homo sapiens
aauuaccuugccaa

SEQ ID NO: 1164006 - RNA, 22 nt, Homo sapiens
aauuacuuugauuccauuuuaa

SEQ ID NO: 1164007 - RNA, 22 nt, Homo sapiens
aauuacuuugugaauagaacuc

SEQ ID NO: 1164008 - RNA, 16 nt, Homo sapiens
aauuagaaauaucuuc

SEQ ID NO: 1164009 - RNA, 22 nt, Homo sapiens
aauuagaacuccugaccccaga

SEQ ID NO: 1164010 - RNA, 23 nt, Homo sapiens
aauuagcuuggggccagggaagg

SEQ ID NO: 1164011 - RNA, 19 nt, Homo sapiens
aauuauaaagauaaagcug

SEQ ID NO: 1164012 - RNA, 16 nt, Homo sapiens
aauuauacuacuuugu

SEQ ID NO: 1164013 - RNA, 21 nt, Homo sapiens
aauuauaucacuucacuguuc

SEQ ID NO: 1164014 - RNA, 23 nt, Homo sapiens
aauuaugaguuugcccucuuucc

SEQ ID NO: 1164015 - RNA, 12 nt, Homo sapiens
aauuaugcuuuc

SEQ ID NO: 1164016 - RNA, 13 nt, Homo sapiens
aauuauguaaaga

SEQ ID NO: 1164017 - RNA, 19 nt, Homo sapiens
aauuaugucuuaguuauaa

SEQ ID NO: 1164018 - RNA, 17 nt, Homo sapiens
aauuauuaucuucuuaa

SEQ ID NO: 1164019 - RNA, 12 nt, Homo sapiens
aauuauuugacu

SEQ ID NO: 1164020 - RNA, 19 nt, Homo sapiens
aauuauuuuuacaguucuc

SEQ ID NO: 1164021 - RNA, 15 nt, Homo sapiens
aauucaaaaguucca

SEQ ID NO: 1164022 - RNA, 13 nt, Homo sapiens
aauucaaacuggg

SEQ ID NO: 1164023 - RNA, 13 nt, Homo sapiens
aauucaacccagc

SEQ ID NO: 1164024 - RNA, 21 nt, Homo sapiens
aauucaacccagccaugcaau

SEQ ID NO: 1164025 - RNA, 21 nt, Homo sapiens
aauucacucugaguguuuuau

SEQ ID NO: 1164026 - RNA, 17 nt, Homo sapiens
aauucagacaagcugca

SEQ ID NO: 1164027 - RNA, 11 nt, Homo sapiens
aauucagguau

SEQ ID NO: 1164028 - RNA, 15 nt, Homo sapiens
aauucagucugcucu

SEQ ID NO: 1164029 - RNA, 23 nt, Homo sapiens
aauucagugauggcaacacugaa

SEQ ID NO: 1164030 - RNA, 20 nt, Homo sapiens
aauucauauccauagauagu

SEQ ID NO: 1164031 - RNA, 12 nt, Homo sapiens
aauucauguuuc

SEQ ID NO: 1164032 - RNA, 17 nt, Homo sapiens
aauuccaguuaaccuau

SEQ ID NO: 1164033 - RNA, 14 nt, Homo sapiens
aauucccaagcuuu

SEQ ID NO: 1164034 - RNA, 20 nt, Homo sapiens
aauuccuacacucuugacua

SEQ ID NO: 1164035 - RNA, 14 nt, Homo sapiens
aauuccugaucacc

SEQ ID NO: 1164036 - RNA, 15 nt, Homo sapiens
aauuccuugcacaua

SEQ ID NO: 1164037 - RNA, 22 nt, Homo sapiens
aauucgcugcaaccuguugaua

SEQ ID NO: 1164038 - RNA, 15 nt, Homo sapiens
aauucggugugcacc

SEQ ID NO: 1164039 - RNA, 16 nt, Homo sapiens
aauucucagugccaac

SEQ ID NO: 1164040 - RNA, 13 nt, Homo sapiens
aauucucugugga

SEQ ID NO: 1164041 - RNA, 14 nt, Homo sapiens
aauucugccuuuau

SEQ ID NO: 1164042 - RNA, 17 nt, Homo sapiens
aauucugcucagauaga

SEQ ID NO: 1164043 - RNA, 20 nt, Homo sapiens
aauucuggaaacuccugaca

SEQ ID NO: 1164044 - RNA, 20 nt, Homo sapiens
aauucugucauuucaaagac

SEQ ID NO: 1164045 - RNA, 22 nt, Homo sapiens
aauucuucuguccugagaagca

SEQ ID NO: 1164046 - RNA, 16 nt, Homo sapiens
aauugaagaaugggaa

SEQ ID NO: 1164047 - RNA, 14 nt, Homo sapiens
aauugaauucugga

SEQ ID NO: 1164048 - RNA, 17 nt, Homo sapiens
aauugaauuuacauaua

SEQ ID NO: 1164049 - RNA, 20 nt, Homo sapiens
aauugacuuauacucuugag

SEQ ID NO: 1164050 - RNA, 18 nt, Homo sapiens
aauugagggacugagcca

SEQ ID NO: 1164051 - RNA, 14 nt, Homo sapiens
aauugccugaacau

SEQ ID NO: 1164052 - RNA, 21 nt, Homo sapiens
aauugcucccuaccagcugaa

SEQ ID NO: 1164053 - RNA, 19 nt, Homo sapiens
aauuggaggaaaugaaugc

SEQ ID NO: 1164054 - RNA, 15 nt, Homo sapiens
aauugggcagucuua

SEQ ID NO: 1164055 - RNA, 20 nt, Homo sapiens
aauugguauuaacuaugauc

SEQ ID NO: 1164056 - RNA, 22 nt, Homo sapiens
aauuggucauuccuaaugcauu

SEQ ID NO: 1164057 - RNA, 16 nt, Homo sapiens
aauugugaacagccaa

SEQ ID NO: 1164058 - RNA, 13 nt, Homo sapiens
aauugugccuuug

SEQ ID NO: 1164059 - RNA, 19 nt, Homo sapiens
aauuuaaaaauaaauacca

SEQ ID NO: 1164060 - RNA, 18 nt, Homo sapiens
aauuuaaagggaaaaccc

SEQ ID NO: 1164061 - RNA, 19 nt, Homo sapiens
aauuuaaagggaaaacccu

SEQ ID NO: 1164062 - RNA, 15 nt, Homo sapiens
aauuuaacugcuuaa

SEQ ID NO: 1164063 - RNA, 23 nt, Homo sapiens
aauuuaaguuggcuagagcuucu

SEQ ID NO: 1164064 - RNA, 12 nt, Homo sapiens
aauuuacuguga

SEQ ID NO: 1164065 - RNA, 18 nt, Homo sapiens
aauuuaggacacauuuag

SEQ ID NO: 1164066 - RNA, 18 nt, Homo sapiens
aauuuauuaaucuaaaaa

SEQ ID NO: 1164067 - RNA, 14 nt, Homo sapiens
aauuuauugcacau

SEQ ID NO: 1164068 - RNA, 23 nt, Homo sapiens
aauuuauuugaaaaugcaucaca

SEQ ID NO: 1164069 - RNA, 18 nt, Homo sapiens
aauuuauuuggggggaaa

SEQ ID NO: 1164070 - RNA, 12 nt, Homo sapiens
aauuucacaagc

SEQ ID NO: 1164071 - RNA, 23 nt, Homo sapiens
aauuucaccuugaaaaagcacca

SEQ ID NO: 1164072 - RNA, 20 nt, Homo sapiens
aauuucauacccaugucaga

SEQ ID NO: 1164073 - RNA, 23 nt, Homo sapiens
aauuucuacuacaggcauugaga

SEQ ID NO: 1164074 - RNA, 17 nt, Homo sapiens
aauuugcuuuaucuacu

SEQ ID NO: 1164075 - RNA, 17 nt, Homo sapiens
aauuuggaucuauuuau

SEQ ID NO: 1164076 - RNA, 22 nt, Homo sapiens
aauuuggauuuacgacugaaga

SEQ ID NO: 1164077 - RNA, 23 nt, Homo sapiens
aauuuggauuuacgacugaagaa

SEQ ID NO: 1164078 - RNA, 19 nt, Homo sapiens
aauuuggggcagauuuuag

SEQ ID NO: 1164079 - RNA, 16 nt, Homo sapiens
aauuuggguucugccu

SEQ ID NO: 1164080 - RNA, 16 nt, Homo sapiens
aauuuguaacuuuuau

SEQ ID NO: 1164081 - RNA, 16 nt, Homo sapiens
aauuugugauggaauc

SEQ ID NO: 1164082 - RNA, 22 nt, Homo sapiens
aauuuguugaacccugccacau

SEQ ID NO: 1164083 - RNA, 16 nt, Homo sapiens
aauuuuaagaauuuca

SEQ ID NO: 1164084 - RNA, 19 nt, Homo sapiens
aauuuucaaggagaaucaa

SEQ ID NO: 1164085 - RNA, 22 nt, Homo sapiens
aauuuucuaguaugucuugaaa

SEQ ID NO: 1164086 - RNA, 23 nt, Homo sapiens
aauuuucuguguuuugcuguacc

SEQ ID NO: 1164087 - RNA, 13 nt, Homo sapiens
aauuuugugguuc

SEQ ID NO: 1164088 - RNA, 23 nt, Homo sapiens
aauuuuuuuuguuguuucaguga

SEQ ID NO: 1164089 - RNA, 16 nt, Homo sapiens
acaaaaaaaacaacaa

SEQ ID NO: 1164090 - RNA, 15 nt, Homo sapiens
acaaaaaaacagacc

SEQ ID NO: 1164091 - RNA, 15 nt, Homo sapiens
acaaaaaauacuuua

SEQ ID NO: 1164092 - RNA, 21 nt, Homo sapiens
acaaaaaauuugagaaagccu

SEQ ID NO: 1164093 - RNA, 14 nt, Homo sapiens
acaaaaccacugga

SEQ ID NO: 1164094 - RNA, 18 nt, Homo sapiens
acaaaaguuaaugaauau

SEQ ID NO: 1164095 - RNA, 21 nt, Homo sapiens
acaaaaucuuuucauaauuaa

SEQ ID NO: 1164096 - RNA, 14 nt, Homo sapiens
acaaaaugauggca

SEQ ID NO: 1164097 - RNA, 17 nt, Homo sapiens
acaaacaccuuauuugu

SEQ ID NO: 1164098 - RNA, 12 nt, Homo sapiens
acaaacagugaa

SEQ ID NO: 1164099 - RNA, 15 nt, Homo sapiens
acaaacuucaaagag

SEQ ID NO: 1164100 - RNA, 18 nt, Homo sapiens
acaaagaccuugcugaua

SEQ ID NO: 1164101 - RNA, 14 nt, Homo sapiens
acaaagacuacuaa

SEQ ID NO: 1164102 - RNA, 14 nt, Homo sapiens
acaaagaugacugu

SEQ ID NO: 1164103 - RNA, 17 nt, Homo sapiens
acaaagcaaaggcaguc

SEQ ID NO: 1164104 - RNA, 18 nt, Homo sapiens
acaaaggauuugaugcuu

SEQ ID NO: 1164105 - RNA, 17 nt, Homo sapiens
acaaagucaagccacau

SEQ ID NO: 1164106 - RNA, 23 nt, Homo sapiens
acaaaguggaugccugcugcauc

SEQ ID NO: 1164107 - RNA, 22 nt, Homo sapiens
acaaauaaucaaaacccaacau

SEQ ID NO: 1164108 - RNA, 22 nt, Homo sapiens
acaaauauggaugagguggaga

SEQ ID NO: 1164109 - RNA, 16 nt, Homo sapiens
acaaaucaaacacaac

SEQ ID NO: 1164110 - RNA, 19 nt, Homo sapiens
aaauuagccugggccucua

SEQ ID NO: 1164111 - RNA, 15 nt, Homo sapiens
aaauuagugcuguaa

SEQ ID NO: 1164112 - RNA, 21 nt, Homo sapiens
aaauuaguugguuugugugau

SEQ ID NO: 1164113 - RNA, 16 nt, Homo sapiens
aaauuauacacuauga

SEQ ID NO: 1164114 - RNA, 17 nt, Homo sapiens
aaauuaugaccauggua

SEQ ID NO: 1164115 - RNA, 21 nt, Homo sapiens
aaauuauuauuuagcuucucc

SEQ ID NO: 1164116 - RNA, 20 nt, Homo sapiens
aaauuauuugaaaacauaua

SEQ ID NO: 1164117 - RNA, 21 nt, Homo sapiens
aaauuauuugaaaacauauaa

SEQ ID NO: 1164118 - RNA, 14 nt, Homo sapiens
aaauuauuugucau

SEQ ID NO: 1164119 - RNA, 13 nt, Homo sapiens
aaauucauaucca

SEQ ID NO: 1164120 - RNA, 18 nt, Homo sapiens
aaauuccaguuaaccuau

SEQ ID NO: 1164121 - RNA, 16 nt, Homo sapiens
aaauuccuacaacuua

SEQ ID NO: 1164122 - RNA, 17 nt, Homo sapiens
aaauuccuugauucaca

SEQ ID NO: 1164123 - RNA, 23 nt, Homo sapiens
aaauucgcugcaaccuguugaua

SEQ ID NO: 1164124 - RNA, 19 nt, Homo sapiens
aaauugaaaggcauucucu

SEQ ID NO: 1164125 - RNA, 15 nt, Homo sapiens
aaauugacagaugaa

SEQ ID NO: 1164126 - RNA, 13 nt, Homo sapiens
aaauugaugagag

SEQ ID NO: 1164127 - RNA, 20 nt, Homo sapiens
aaauugggaaaggaguagaa

SEQ ID NO: 1164128 - RNA, 16 nt, Homo sapiens
aaauuguaaauacaug

SEQ ID NO: 1164129 - RNA, 15 nt, Homo sapiens
aaauuguauuacaaa

SEQ ID NO: 1164130 - RNA, 17 nt, Homo sapiens
aaauugugauguggcua

SEQ ID NO: 1164131 - RNA, 23 nt, Homo sapiens
aaauuuaauguuuuuuaaacuag

SEQ ID NO: 1164132 - RNA, 13 nt, Homo sapiens
aaauuucacuuaa

SEQ ID NO: 1164133 - RNA, 20 nt, Homo sapiens
aaauuuguaaaucuuauucu

SEQ ID NO: 1164134 - RNA, 22 nt, Homo sapiens
aaauuugugguccacugagcua

SEQ ID NO: 1164135 - RNA, 17 nt, Homo sapiens
aaauuuugccugcaaca

SEQ ID NO: 1164136 - RNA, 15 nt, Homo sapiens
aaauuuuggucauag

SEQ ID NO: 1164137 - RNA, 21 nt, Homo sapiens
aacaaaaauguaauuguucau

SEQ ID NO: 1164138 - RNA, 17 nt, Homo sapiens
aacaaagaacugaagcu

SEQ ID NO: 1164139 - RNA, 12 nt, Homo sapiens
aacaaagccaga

SEQ ID NO: 1164140 - RNA, 21 nt, Homo sapiens
aacaaccguuggaaacauaac

SEQ ID NO: 1164141 - RNA, 16 nt, Homo sapiens
aacaaccugugcccag

SEQ ID NO: 1164142 - RNA, 20 nt, Homo sapiens
aacaaccuuuucucuggaca

SEQ ID NO: 1164143 - RNA, 20 nt, Homo sapiens
aacaagacuccucaucauga

SEQ ID NO: 1164144 - RNA, 22 nt, Homo sapiens
aacaagacuuuuuguacugaaa

SEQ ID NO: 1164145 - RNA, 14 nt, Homo sapiens
aacaagaugcugga

SEQ ID NO: 1164146 - RNA, 18 nt, Homo sapiens
aacaagcaaguucugaga

SEQ ID NO: 1164147 - RNA, 12 nt, Homo sapiens
aacaagcuuucg

SEQ ID NO: 1164148 - RNA, 14 nt, Homo sapiens
aacaauaagaacaa

SEQ ID NO: 1164149 - RNA, 17 nt, Homo sapiens
aacaauaugcacugaau

SEQ ID NO: 1164150 - RNA, 19 nt, Homo sapiens
aacaauauuuaaccaaaga

SEQ ID NO: 1164151 - RNA, 14 nt, Homo sapiens
aacaauguugagaa

SEQ ID NO: 1164152 - RNA, 16 nt, Homo sapiens
aacaauguuugauacu

SEQ ID NO: 1164153 - RNA, 19 nt, Homo sapiens
aacaauguuuuaaacauuc

SEQ ID NO: 1164154 - RNA, 21 nt, Homo sapiens
aacacacccaucaucugacau

SEQ ID NO: 1164155 - RNA, 19 nt, Homo sapiens
aacacagacauucugccag

SEQ ID NO: 1164156 - RNA, 20 nt, Homo sapiens
aacacauuuuguauaauugu

SEQ ID NO: 1164157 - RNA, 19 nt, Homo sapiens
aacacauuuuuuaacuaau

SEQ ID NO: 1164158 - RNA, 15 nt, Homo sapiens
aacaccaagcacagc

SEQ ID NO: 1164159 - RNA, 17 nt, Homo sapiens
aacaccacgucacuuca

SEQ ID NO: 1164160 - RNA, 22 nt, Homo sapiens
aacaccuuuccuuaugucuccu

SEQ ID NO: 1164161 - RNA, 20 nt, Homo sapiens
aacacuauauguauguacuu

SEQ ID NO: 1164162 - RNA, 22 nt, Homo sapiens
aacacucaacaauaaagacuga

SEQ ID NO: 1164163 - RNA, 14 nt, Homo sapiens
aacacugcccucuu

SEQ ID NO: 1164164 - RNA, 23 nt, Homo sapiens
aacacugguuguagucaguuuug

SEQ ID NO: 1164165 - RNA, 19 nt, Homo sapiens
aacacuuggugcugggaac

SEQ ID NO: 1164166 - RNA, 17 nt, Homo sapiens
aacagaaauuaaucuua

SEQ ID NO: 1164167 - RNA, 20 nt, Homo sapiens
aacagaaauuaaucuuacaa

SEQ ID NO: 1164168 - RNA, 23 nt, Homo sapiens
aacagaagccugaugcugacauu

SEQ ID NO: 1164169 - RNA, 19 nt, Homo sapiens
aacagaauggauugccagu

SEQ ID NO: 1164170 - RNA, 22 nt, Homo sapiens
aacagagaagcccuuacuccug

SEQ ID NO: 1164171 - RNA, 21 nt, Homo sapiens
aacagagcaagacccaucuca

SEQ ID NO: 1164172 - RNA, 16 nt, Homo sapiens
aacagaggcauuuaaa

SEQ ID NO: 1164173 - RNA, 21 nt, Homo sapiens
aacagaguuuucuguugcauu

SEQ ID NO: 1164174 - RNA, 16 nt, Homo sapiens
aacagauaaaugacaa

SEQ ID NO: 1164175 - RNA, 13 nt, Homo sapiens
aacagauaauccc

SEQ ID NO: 1164176 - RNA, 22 nt, Homo sapiens
aacagauaaucccuguauuuca

SEQ ID NO: 1164177 - RNA, 15 nt, Homo sapiens
aacagcacccucucc

SEQ ID NO: 1164178 - RNA, 22 nt, Homo sapiens
aacagcacccucuccagaugag

SEQ ID NO: 1164179 - RNA, 11 nt, Homo sapiens
aacagcacuuu

SEQ ID NO: 1164180 - RNA, 18 nt, Homo sapiens
aacagcagaacuucugaa

SEQ ID NO: 1164181 - RNA, 18 nt, Homo sapiens
aacagcaggguaccugaa

SEQ ID NO: 1164182 - RNA, 19 nt, Homo sapiens
aacagccaaaaaggacuuu

SEQ ID NO: 1164183 - RNA, 15 nt, Homo sapiens
aacagccaacuagcc

SEQ ID NO: 1164184 - RNA, 16 nt, Homo sapiens
aacagcuaugcaggga

SEQ ID NO: 1164185 - RNA, 21 nt, Homo sapiens
aacaggcacccacaaccagag

SEQ ID NO: 1164186 - RNA, 14 nt, Homo sapiens
aacaggcuguagau

SEQ ID NO: 1164187 - RNA, 20 nt, Homo sapiens
aacaggguggcccagguggc

SEQ ID NO: 1164188 - RNA, 22 nt, Homo sapiens
aacaguaccaguguaaauucag

SEQ ID NO: 1164189 - RNA, 16 nt, Homo sapiens
aacaguuuuugcuaau

SEQ ID NO: 1164190 - RNA, 18 nt, Homo sapiens
aacauaagaucacugcca

SEQ ID NO: 1164191 - RNA, 15 nt, Homo sapiens
aacauaaguuaucau

SEQ ID NO: 1164192 - RNA, 13 nt, Homo sapiens
aacauacaagaga

SEQ ID NO: 1164193 - RNA, 20 nt, Homo sapiens
aacauacuauauaagccagu

SEQ ID NO: 1164194 - RNA, 18 nt, Homo sapiens
aacauauauauacuauua

SEQ ID NO: 1164195 - RNA, 16 nt, Homo sapiens
aacauauuuaaggaac

SEQ ID NO: 1164196 - RNA, 17 nt, Homo sapiens
aacaucacacaguauac

SEQ ID NO: 1164197 - RNA, 16 nt, Homo sapiens
aacaucacucuugucu

SEQ ID NO: 1164198 - RNA, 11 nt, Homo sapiens
aacaucacuug

SEQ ID NO: 1164199 - RNA, 17 nt, Homo sapiens
aacaucgcgaugggaac

SEQ ID NO: 1164200 - RNA, 21 nt, Homo sapiens
aacaucucccauggcucuccc

SEQ ID NO: 1164201 - RNA, 17 nt, Homo sapiens
aacaucuggaguccuau

SEQ ID NO: 1164202 - RNA, 15 nt, Homo sapiens
aacaucuggcccaag

SEQ ID NO: 1164203 - RNA, 21 nt, Homo sapiens
aacaucuuuuuaaccugcaaa

SEQ ID NO: 1164204 - RNA, 21 nt, Homo sapiens
aacaugaagaagaccuuuaca

SEQ ID NO: 1164205 - RNA, 24 nt, Homo sapiens
aacaugaaucaaaagugccucaag

SEQ ID NO: 1164206 - RNA, 12 nt, Homo sapiens
aacaugacuaua

SEQ ID NO: 1164207 - RNA, 14 nt, Homo sapiens
aacaugagaugugu

SEQ ID NO: 1164208 - RNA, 17 nt, Homo sapiens
aacaugcagcucugcag

SEQ ID NO: 1164209 - RNA, 18 nt, Homo sapiens
aacauggcuaaauacaau

SEQ ID NO: 1164210 - RNA, 22 nt, Homo sapiens
aacaugguaaacgcugucccua

SEQ ID NO: 1164211 - RNA, 20 nt, Homo sapiens
aacauguacuguuacugugu

SEQ ID NO: 1164212 - RNA, 13 nt, Homo sapiens
aacauguaugugc

SEQ ID NO: 1164213 - RNA, 15 nt, Homo sapiens
aacauguaugugcau

SEQ ID NO: 1164214 - RNA, 15 nt, Homo sapiens
aacauguccuaauuc

SEQ ID NO: 1164215 - RNA, 22 nt, Homo sapiens
aacauguguuuucaucauuuca

SEQ ID NO: 1164216 - RNA, 22 nt, Homo sapiens
aacauguuccugggaucacuga

SEQ ID NO: 1164217 - RNA, 13 nt, Homo sapiens
aacauuccaagac

SEQ ID NO: 1164218 - RNA, 20 nt, Homo sapiens
aacauuccucagaaaccaaa

SEQ ID NO: 1164219 - RNA, 21 nt, Homo sapiens
aacauuccucagaaaccaaag

SEQ ID NO: 1164220 - RNA, 15 nt, Homo sapiens
aacauugugauguau

SEQ ID NO: 1164221 - RNA, 21 nt, Homo sapiens
aacauuuguguguuauaccuu

SEQ ID NO: 1164222 - RNA, 19 nt, Homo sapiens
aacauuuugagaacaaaga

SEQ ID NO: 1164223 - RNA, 19 nt, Homo sapiens
aaccaaagcuuuauuucaa

SEQ ID NO: 1164224 - RNA, 17 nt, Homo sapiens
aaccaacccccaucucc

SEQ ID NO: 1164225 - RNA, 22 nt, Homo sapiens
aaccaagcagaauguacuugau

SEQ ID NO: 1164226 - RNA, 23 nt, Homo sapiens
aaccaaggccccgagcucagggc

SEQ ID NO: 1164227 - RNA, 16 nt, Homo sapiens
aaccaaucaaaugucu

SEQ ID NO: 1164228 - RNA, 17 nt, Homo sapiens
aaccacagggcugggcu

SEQ ID NO: 1164229 - RNA, 16 nt, Homo sapiens
aaccacaguuucauua

SEQ ID NO: 1164230 - RNA, 16 nt, Homo sapiens
aaccaccucucugucu

SEQ ID NO: 1164231 - RNA, 14 nt, Homo sapiens
aaccacuaaugcuu

SEQ ID NO: 1164232 - RNA, 20 nt, Homo sapiens
aaccacugcacccaccuacu

SEQ ID NO: 1164233 - RNA, 14 nt, Homo sapiens
aaccaguucaugca

SEQ ID NO: 1164234 - RNA, 20 nt, Homo sapiens
aaccaguuugcccauucucu

SEQ ID NO: 1164235 - RNA, 22 nt, Homo sapiens
aaccauaguuauuuacuugaaa

SEQ ID NO: 1164236 - RNA, 16 nt, Homo sapiens
aaccaucaucuugcca

SEQ ID NO: 1164237 - RNA, 16 nt, Homo sapiens
aaccauuuuuuccuac

SEQ ID NO: 1164238 - RNA, 21 nt, Homo sapiens
aacccacaguguuaccugacu

SEQ ID NO: 1164239 - RNA, 13 nt, Homo sapiens
agagugucuuucc

SEQ ID NO: 1164240 - RNA, 19 nt, Homo sapiens
agaguguucaacugugagu

SEQ ID NO: 1164241 - RNA, 20 nt, Homo sapiens
agaguuauucaaaugaaggu

SEQ ID NO: 1164242 - RNA, 15 nt, Homo sapiens
agaguugcuuccagu

SEQ ID NO: 1164243 - RNA, 14 nt, Homo sapiens
agaguuuaguugua

SEQ ID NO: 1164244 - RNA, 21 nt, Homo sapiens
agaguuugcuauuagagcauu

SEQ ID NO: 1164245 - RNA, 16 nt, Homo sapiens
agauaaguguucuuca

SEQ ID NO: 1164246 - RNA, 12 nt, Homo sapiens
agauacaaugua

SEQ ID NO: 1164247 - RNA, 16 nt, Homo sapiens
agauacacgucacaaa

SEQ ID NO: 1164248 - RNA, 14 nt, Homo sapiens
agauacacugacuu

SEQ ID NO: 1164249 - RNA, 20 nt, Homo sapiens
agauacacugacuuggugca

SEQ ID NO: 1164250 - RNA, 17 nt, Homo sapiens
agauacuugaacacugu

SEQ ID NO: 1164251 - RNA, 18 nt, Homo sapiens
agauacuugaacacugug

SEQ ID NO: 1164252 - RNA, 21 nt, Homo sapiens
agauagcaucuuauacgagua

SEQ ID NO: 1164253 - RNA, 16 nt, Homo sapiens
agauagccccacagga

SEQ ID NO: 1164254 - RNA, 16 nt, Homo sapiens
agauagcuucacccca

SEQ ID NO: 1164255 - RNA, 15 nt, Homo sapiens
agauaggguggcaca

SEQ ID NO: 1164256 - RNA, 13 nt, Homo sapiens
agauaugugaaga

SEQ ID NO: 1164257 - RNA, 17 nt, Homo sapiens
agauauuacagcuuauu

SEQ ID NO: 1164258 - RNA, 17 nt, Homo sapiens
agaucacgaggucagga

SEQ ID NO: 1164259 - RNA, 21 nt, Homo sapiens
agaucacgccauuguacucca

SEQ ID NO: 1164260 - RNA, 16 nt, Homo sapiens
agaucacguugcaaug

SEQ ID NO: 1164261 - RNA, 16 nt, Homo sapiens
agaucauaguugcaaa

SEQ ID NO: 1164262 - RNA, 16 nt, Homo sapiens
agauccaguucuugaa

SEQ ID NO: 1164263 - RNA, 13 nt, Homo sapiens
agaucccaacacu

SEQ ID NO: 1164264 - RNA, 19 nt, Homo sapiens
agauccucuucucaaagcu

SEQ ID NO: 1164265 - RNA, 19 nt, Homo sapiens
agaucgguaucuuuguaau

SEQ ID NO: 1164266 - RNA, 19 nt, Homo sapiens
agaucgugccauugcacuc

SEQ ID NO: 1164267 - RNA, 13 nt, Homo sapiens
agaucuacaugaa

SEQ ID NO: 1164268 - RNA, 22 nt, Homo sapiens
agaucuacaugaaugcaaaaca

SEQ ID NO: 1164269 - RNA, 19 nt, Homo sapiens
agaucuaccugcaacacaa

SEQ ID NO: 1164270 - RNA, 18 nt, Homo sapiens
agaucucauguccucuau

SEQ ID NO: 1164271 - RNA, 22 nt, Homo sapiens
agaucucucgaaugcugagaag

SEQ ID NO: 1164272 - RNA, 15 nt, Homo sapiens
agaucugaacccagc

SEQ ID NO: 1164273 - RNA, 18 nt, Homo sapiens
agaucugcuuucuguuca

SEQ ID NO: 1164274 - RNA, 22 nt, Homo sapiens
agaucugcuuucuguucaucuc

SEQ ID NO: 1164275 - RNA, 15 nt, Homo sapiens
agaucuggacagcag

SEQ ID NO: 1164276 - RNA, 17 nt, Homo sapiens
agaucuguccucagccu

SEQ ID NO: 1164277 - RNA, 15 nt, Homo sapiens
agaucuguuaccaau

SEQ ID NO: 1164278 - RNA, 18 nt, Homo sapiens
agaucuuuauaaccugau

SEQ ID NO: 1164279 - RNA, 18 nt, Homo sapiens
agaugaaaccgucccuga

SEQ ID NO: 1164280 - RNA, 19 nt, Homo sapiens
agaugacagggaaaacugc

SEQ ID NO: 1164281 - RNA, 22 nt, Homo sapiens
agaugacagggaaaacugcaaa

SEQ ID NO: 1164282 - RNA, 14 nt, Homo sapiens
agaugacaguauuu

SEQ ID NO: 1164283 - RNA, 18 nt, Homo sapiens
agaugacauaaaauuuac

SEQ ID NO: 1164284 - RNA, 22 nt, Homo sapiens
agaugacauugcuaagaugcuc

SEQ ID NO: 1164285 - RNA, 14 nt, Homo sapiens
agaugagacugccc

SEQ ID NO: 1164286 - RNA, 14 nt, Homo sapiens
agaugagcaaugcu

SEQ ID NO: 1164287 - RNA, 20 nt, Homo sapiens
agaugaggccccggggcaug

SEQ ID NO: 1164288 - RNA, 22 nt, Homo sapiens
agaugauacauccaaagcagac

SEQ ID NO: 1164289 - RNA, 17 nt, Homo sapiens
agaugauggaugccaau

SEQ ID NO: 1164290 - RNA, 17 nt, Homo sapiens
agaugcaauugcuccca

SEQ ID NO: 1164291 - RNA, 18 nt, Homo sapiens
agaugcagggcagucauu

SEQ ID NO: 1164292 - RNA, 14 nt, Homo sapiens
agaugcagguuuga

SEQ ID NO: 1164293 - RNA, 14 nt, Homo sapiens
agaugcauacaaag

SEQ ID NO: 1164294 - RNA, 18 nt, Homo sapiens
agaugcauuguaguuuaa

SEQ ID NO: 1164295 - RNA, 19 nt, Homo sapiens
agaugcauuuuguguacag

SEQ ID NO: 1164296 - RNA, 19 nt, Homo sapiens
agaugccacuagcccuccu

SEQ ID NO: 1164297 - RNA, 14 nt, Homo sapiens
agaugcuggcccag

SEQ ID NO: 1164298 - RNA, 14 nt, Homo sapiens
agauggauucucca

SEQ ID NO: 1164299 - RNA, 19 nt, Homo sapiens
agauggcagguuugcaauc

SEQ ID NO: 1164300 - RNA, 18 nt, Homo sapiens
agauggcuaggccaucac

SEQ ID NO: 1164301 - RNA, 17 nt, Homo sapiens
agaugggagccuuuacc

SEQ ID NO: 1164302 - RNA, 23 nt, Homo sapiens
agaugggaucccacuauauugca

SEQ ID NO: 1164303 - RNA, 13 nt, Homo sapiens
agauguccagggc

SEQ ID NO: 1164304 - RNA, 16 nt, Homo sapiens
agauguguuaggaaug

SEQ ID NO: 1164305 - RNA, 17 nt, Homo sapiens
agauguuacaaguuuau

SEQ ID NO: 1164306 - RNA, 22 nt, Homo sapiens
agauguugaauucuuuugccaa

SEQ ID NO: 1164307 - RNA, 19 nt, Homo sapiens
agauuacuuuuucuuuaug

SEQ ID NO: 1164308 - RNA, 11 nt, Homo sapiens
agauucacaua

SEQ ID NO: 1164309 - RNA, 14 nt, Homo sapiens
agauucacauacag

SEQ ID NO: 1164310 - RNA, 22 nt, Homo sapiens
agauucagguauguugccuuua

SEQ ID NO: 1164311 - RNA, 15 nt, Homo sapiens
agauuccggauccua

SEQ ID NO: 1164312 - RNA, 15 nt, Homo sapiens
agauucgagucacgu

SEQ ID NO: 1164313 - RNA, 15 nt, Homo sapiens
agauucuaaagauuc

SEQ ID NO: 1164314 - RNA, 17 nt, Homo sapiens
agauucuaaagauucua

SEQ ID NO: 1164315 - RNA, 15 nt, Homo sapiens
agauucuaacauauu

SEQ ID NO: 1164316 - RNA, 17 nt, Homo sapiens
agauucuagaugauuaa

SEQ ID NO: 1164317 - RNA, 17 nt, Homo sapiens
agauucuauaguucuag

SEQ ID NO: 1164318 - RNA, 20 nt, Homo sapiens
agauucucaaaauuccuaca

SEQ ID NO: 1164319 - RNA, 17 nt, Homo sapiens
agauucuguaugcggug

SEQ ID NO: 1164320 - RNA, 13 nt, Homo sapiens
agauugaugugca

SEQ ID NO: 1164321 - RNA, 22 nt, Homo sapiens
agauugcacagucaaaacgacu

SEQ ID NO: 1164322 - RNA, 20 nt, Homo sapiens
agauugcagaaauacaguau

SEQ ID NO: 1164323 - RNA, 17 nt, Homo sapiens
agauuggccauguucca

SEQ ID NO: 1164324 - RNA, 14 nt, Homo sapiens
agauuguguucuuc

SEQ ID NO: 1164325 - RNA, 12 nt, Homo sapiens
agauuugucaca

SEQ ID NO: 1164326 - RNA, 13 nt, Homo sapiens
agauuuuugcaau

SEQ ID NO: 1164327 - RNA, 23 nt, Homo sapiens
agauuuuuguuuuccacugugcu

SEQ ID NO: 1164328 - RNA, 20 nt, Homo sapiens
agcaaaaaaauuauuuucuc

SEQ ID NO: 1164329 - RNA, 22 nt, Homo sapiens
agcaaaaguagccaucauuccu

SEQ ID NO: 1164330 - RNA, 16 nt, Homo sapiens
agcaaaauccaaacug

SEQ ID NO: 1164331 - RNA, 13 nt, Homo sapiens
agcaaacugcugc

SEQ ID NO: 1164332 - RNA, 18 nt, Homo sapiens
agcaaaggagacaaagca

SEQ ID NO: 1164333 - RNA, 19 nt, Homo sapiens
agcaaaguuaaggcuugau

SEQ ID NO: 1164334 - RNA, 20 nt, Homo sapiens
agcaaauaauuuccuggugu

SEQ ID NO: 1164335 - RNA, 18 nt, Homo sapiens
agcaaauggcagaaccaa

SEQ ID NO: 1164336 - RNA, 19 nt, Homo sapiens
agcaacaaaaucauggcuu

SEQ ID NO: 1164337 - RNA, 15 nt, Homo sapiens
agcaacaagaccacc

SEQ ID NO: 1164338 - RNA, 14 nt, Homo sapiens
agcaacuaacuaac

SEQ ID NO: 1164339 - RNA, 17 nt, Homo sapiens
agcaacuugaacuucac

SEQ ID NO: 1164340 - RNA, 23 nt, Homo sapiens
agcaacuuguguuacaaaaauac

SEQ ID NO: 1164341 - RNA, 15 nt, Homo sapiens
agcaagacugagggg

SEQ ID NO: 1164342 - RNA, 19 nt, Homo sapiens
agcaagaucccaucucuuu

SEQ ID NO: 1164343 - RNA, 13 nt, Homo sapiens
agcaagauugaaa

SEQ ID NO: 1164344 - RNA, 12 nt, Homo sapiens
agcaagccaugc

SEQ ID NO: 1164345 - RNA, 20 nt, Homo sapiens
agcaagcuguguuacuugaa

SEQ ID NO: 1164346 - RNA, 21 nt, Homo sapiens
agcaaggaguuuaaaugagac

SEQ ID NO: 1164347 - RNA, 21 nt, Homo sapiens
agcaagugaauuuuucucuaa

SEQ ID NO: 1164348 - RNA, 15 nt, Homo sapiens
agcaauaaaaugcua

SEQ ID NO: 1164349 - RNA, 18 nt, Homo sapiens
agcaauacguuugugcag

SEQ ID NO: 1164350 - RNA, 16 nt, Homo sapiens
agcaauaugcauuuaa

SEQ ID NO: 1164351 - RNA, 18 nt, Homo sapiens
agcaauccuccuaccuca

SEQ ID NO: 1164352 - RNA, 16 nt, Homo sapiens
agcaaugggucuuagc

SEQ ID NO: 1164353 - RNA, 20 nt, Homo sapiens
agcaaugguaauugugaaua

SEQ ID NO: 1164354 - RNA, 13 nt, Homo sapiens
agcaaugugauuu

SEQ ID NO: 1164355 - RNA, 16 nt, Homo sapiens
agcaaugugcacuuca

SEQ ID NO: 1164356 - RNA, 16 nt, Homo sapiens
agcaauucuccugccu

SEQ ID NO: 1164357 - RNA, 21 nt, Homo sapiens
agcaauuugaagagaaucuuu

SEQ ID NO: 1164358 - RNA, 18 nt, Homo sapiens
agcacaaaaucagccaaa

SEQ ID NO: 1164359 - RNA, 12 nt, Homo sapiens
agcacaaagaca

SEQ ID NO: 1164360 - RNA, 12 nt, Homo sapiens
agccuaacacgg

SEQ ID NO: 1164361 - RNA, 17 nt, Homo sapiens
agccuaauugucacauc

SEQ ID NO: 1164362 - RNA, 18 nt, Homo sapiens
agccuaauugucacauca

SEQ ID NO: 1164363 - RNA, 21 nt, Homo sapiens
agccuaggaggacugggguaa

SEQ ID NO: 1164364 - RNA, 20 nt, Homo sapiens
agccuaguggcuuguccuca

SEQ ID NO: 1164365 - RNA, 23 nt, Homo sapiens
agccuaugaggggguuuggcacc

SEQ ID NO: 1164366 - RNA, 13 nt, Homo sapiens
agccucaaccucc

SEQ ID NO: 1164367 - RNA, 17 nt, Homo sapiens
agccucacagaugcugg

SEQ ID NO: 1164368 - RNA, 23 nt, Homo sapiens
agccucacguauuucacagagca

SEQ ID NO: 1164369 - RNA, 23 nt, Homo sapiens
agccucagaaggacccuguugag

SEQ ID NO: 1164370 - RNA, 13 nt, Homo sapiens
agccucagugaaa

SEQ ID NO: 1164371 - RNA, 15 nt, Homo sapiens
agccucaucauuucc

SEQ ID NO: 1164372 - RNA, 18 nt, Homo sapiens
agccucauggaacaggau

SEQ ID NO: 1164373 - RNA, 14 nt, Homo sapiens
agccuccaguugua

SEQ ID NO: 1164374 - RNA, 19 nt, Homo sapiens
agccuccccaccuucuuca

SEQ ID NO: 1164375 - RNA, 18 nt, Homo sapiens
agaccaccaacguguccu

SEQ ID NO: 1164376 - RNA, 14 nt, Homo sapiens
agaccacuauucuu

SEQ ID NO: 1164377 - RNA, 14 nt, Homo sapiens
agaccacugauaaa

SEQ ID NO: 1164378 - RNA, 17 nt, Homo sapiens
agaccaggggaccagag

SEQ ID NO: 1164379 - RNA, 20 nt, Homo sapiens
agaccauuuaucugggauua

SEQ ID NO: 1164380 - RNA, 14 nt, Homo sapiens
agacccaucucucc

SEQ ID NO: 1164381 - RNA, 16 nt, Homo sapiens
agaccccggcuuccuu

SEQ ID NO: 1164382 - RNA, 23 nt, Homo sapiens
agacccuuuccuccaaacccaac

SEQ ID NO: 1164383 - RNA, 21 nt, Homo sapiens
agaccgugaccagugcugcug

SEQ ID NO: 1164384 - RNA, 12 nt, Homo sapiens
agaccuacccuc

SEQ ID NO: 1164385 - RNA, 13 nt, Homo sapiens
agaccuacccucc

SEQ ID NO: 1164386 - RNA, 18 nt, Homo sapiens
agaccugacaccuuucau

SEQ ID NO: 1164387 - RNA, 12 nt, Homo sapiens
agaccugaggga

SEQ ID NO: 1164388 - RNA, 23 nt, Homo sapiens
agaccuggcggaggcuuuuccca

SEQ ID NO: 1164389 - RNA, 22 nt, Homo sapiens
agaccuuugauuuuuugcccag

SEQ ID NO: 1164390 - RNA, 15 nt, Homo sapiens
agaccuuuggacuau

SEQ ID NO: 1164391 - RNA, 21 nt, Homo sapiens
agacggcacaggccuaggaga

SEQ ID NO: 1164392 - RNA, 23 nt, Homo sapiens
agacgggcaaaauaaagugacag

SEQ ID NO: 1164393 - RNA, 19 nt, Homo sapiens
agacgucucaagacugaaa

SEQ ID NO: 1164394 - RNA, 20 nt, Homo sapiens
agacuacaggugugagccac

SEQ ID NO: 1164395 - RNA, 19 nt, Homo sapiens
agacuacuaaugacuuugu

SEQ ID NO: 1164396 - RNA, 18 nt, Homo sapiens
agacucaagacuuaugga

SEQ ID NO: 1164397 - RNA, 19 nt, Homo sapiens
agacucaccuguucucacu

SEQ ID NO: 1164398 - RNA, 17 nt, Homo sapiens
agacucagccugcaguu

SEQ ID NO: 1164399 - RNA, 16 nt, Homo sapiens
agacucagcucugaca

SEQ ID NO: 1164400 - RNA, 22 nt, Homo sapiens
agacucaugguguguuacacaa

SEQ ID NO: 1164401 - RNA, 22 nt, Homo sapiens
agacucauugcagcagguggua

SEQ ID NO: 1164402 - RNA, 12 nt, Homo sapiens
agacuccaucuc

SEQ ID NO: 1164403 - RNA, 18 nt, Homo sapiens
agacucccuccauagcga

SEQ ID NO: 1164404 - RNA, 17 nt, Homo sapiens
agacucgccaacauggu

SEQ ID NO: 1164405 - RNA, 15 nt, Homo sapiens
agacucuagagucca

SEQ ID NO: 1164406 - RNA, 20 nt, Homo sapiens
agacucucgcaucuucccaa

SEQ ID NO: 1164407 - RNA, 16 nt, Homo sapiens
agacucuguaaccacc

SEQ ID NO: 1164408 - RNA, 16 nt, Homo sapiens
agacugaaaagccaug

SEQ ID NO: 1164409 - RNA, 13 nt, Homo sapiens
agacugagcaccu

SEQ ID NO: 1164410 - RNA, 13 nt, Homo sapiens
agacugagcucuc

SEQ ID NO: 1164411 - RNA, 20 nt, Homo sapiens
agacugcaaacccuuucaua

SEQ ID NO: 1164412 - RNA, 19 nt, Homo sapiens
agacugcugcugaauuuau

SEQ ID NO: 1164413 - RNA, 18 nt, Homo sapiens
agacuggaacuugaacug

SEQ ID NO: 1164414 - RNA, 21 nt, Homo sapiens
agacuggacuggaccagacaa

SEQ ID NO: 1164415 - RNA, 22 nt, Homo sapiens
agacuggcagggacgaggacaa

SEQ ID NO: 1164416 - RNA, 14 nt, Homo sapiens
agacuggcuuuuau

SEQ ID NO: 1164417 - RNA, 16 nt, Homo sapiens
agacugggcugaggga

SEQ ID NO: 1164418 - RNA, 16 nt, Homo sapiens
agacuguuaucaggac

SEQ ID NO: 1164419 - RNA, 15 nt, Homo sapiens
agacuuaacacuucu

SEQ ID NO: 1164420 - RNA, 19 nt, Homo sapiens
agacuuacucuaagaucuu

SEQ ID NO: 1164421 - RNA, 20 nt, Homo sapiens
agacuuauggaacagggaug

SEQ ID NO: 1164422 - RNA, 21 nt, Homo sapiens
agacuuauguggaacuguaca

SEQ ID NO: 1164423 - RNA, 14 nt, Homo sapiens
agacuuguucucag

SEQ ID NO: 1164424 - RNA, 17 nt, Homo sapiens
agacuuucaaacauaua

SEQ ID NO: 1164425 - RNA, 11 nt, Homo sapiens
agacuuucaag

SEQ ID NO: 1164426 - RNA, 16 nt, Homo sapiens
agacuuucaagggaau

SEQ ID NO: 1164427 - RNA, 14 nt, Homo sapiens
agacuuugggauag

SEQ ID NO: 1164428 - RNA, 20 nt, Homo sapiens
agacuuuucucuagaagcug

SEQ ID NO: 1164429 - RNA, 21 nt, Homo sapiens
agagaaaaacaacccagcgaa

SEQ ID NO: 1164430 - RNA, 14 nt, Homo sapiens
agagaaaacacuuu

SEQ ID NO: 1164431 - RNA, 14 nt, Homo sapiens
agagaaacuuugag

SEQ ID NO: 1164432 - RNA, 23 nt, Homo sapiens
agagaaagaaagggaaacuggcu

SEQ ID NO: 1164433 - RNA, 23 nt, Homo sapiens
agagaaagaggccagacauggug

SEQ ID NO: 1164434 - RNA, 21 nt, Homo sapiens
agagaaaguuggugcugcuca

SEQ ID NO: 1164435 - RNA, 12 nt, Homo sapiens
agagaaccauga

SEQ ID NO: 1164436 - RNA, 12 nt, Homo sapiens
agagaaggugaa

SEQ ID NO: 1164437 - RNA, 19 nt, Homo sapiens
agagaaugcccacugccug

SEQ ID NO: 1164438 - RNA, 12 nt, Homo sapiens
agagacacugcu

SEQ ID NO: 1164439 - RNA, 19 nt, Homo sapiens
agagacaguaacacaauua

SEQ ID NO: 1164440 - RNA, 14 nt, Homo sapiens
agagaccaucuccu

SEQ ID NO: 1164441 - RNA, 16 nt, Homo sapiens
agagaccauugcaaug

SEQ ID NO: 1164442 - RNA, 16 nt, Homo sapiens
agagacccaagcugcc

SEQ ID NO: 1164443 - RNA, 17 nt, Homo sapiens
agagacccucucagccc

SEQ ID NO: 1164444 - RNA, 19 nt, Homo sapiens
agagaccucaaauuacuuu

SEQ ID NO: 1164445 - RNA, 12 nt, Homo sapiens
agagacuguuau

SEQ ID NO: 1164446 - RNA, 13 nt, Homo sapiens
agagagaaaaaga

SEQ ID NO: 1164447 - RNA, 20 nt, Homo sapiens
agagagaaaguuucguuaua

SEQ ID NO: 1164448 - RNA, 18 nt, Homo sapiens
agagagaauagagcugcc

SEQ ID NO: 1164449 - RNA, 17 nt, Homo sapiens
agagagacaacagauuu

SEQ ID NO: 1164450 - RNA, 14 nt, Homo sapiens
agagagagggagca

SEQ ID NO: 1164451 - RNA, 17 nt, Homo sapiens
agagaggccuuguccca

SEQ ID NO: 1164452 - RNA, 17 nt, Homo sapiens
agagaguacacuguguc

SEQ ID NO: 1164453 - RNA, 15 nt, Homo sapiens
agagaugacagggaa

SEQ ID NO: 1164454 - RNA, 19 nt, Homo sapiens
agagauggucaauuaacaa

SEQ ID NO: 1164455 - RNA, 13 nt, Homo sapiens
agagaugugcaau

SEQ ID NO: 1164456 - RNA, 21 nt, Homo sapiens
agagauuuuucauuuuuccau

SEQ ID NO: 1164457 - RNA, 15 nt, Homo sapiens
agagcaaagugaccu

SEQ ID NO: 1164458 - RNA, 20 nt, Homo sapiens
agagcaaauuugaauaauuc

SEQ ID NO: 1164459 - RNA, 19 nt, Homo sapiens
agagcagcugccauugcag

SEQ ID NO: 1164460 - RNA, 21 nt, Homo sapiens
agagcagcuucggugugcaga

SEQ ID NO: 1164461 - RNA, 23 nt, Homo sapiens
agagccaggggggugaggagcug

SEQ ID NO: 1164462 - RNA, 17 nt, Homo sapiens
agagccggagccuccag

SEQ ID NO: 1164463 - RNA, 18 nt, Homo sapiens
agagccggagccuccagc

SEQ ID NO: 1164464 - RNA, 21 nt, Homo sapiens
agagccucgcucuguuaccca

SEQ ID NO: 1164465 - RNA, 19 nt, Homo sapiens
agagcgagacuccaucuca

SEQ ID NO: 1164466 - RNA, 19 nt, Homo sapiens
agagcuacccgcagaguuc

SEQ ID NO: 1164467 - RNA, 13 nt, Homo sapiens
agagcucaccugu

SEQ ID NO: 1164468 - RNA, 13 nt, Homo sapiens
agagcuggaggca

SEQ ID NO: 1164469 - RNA, 21 nt, Homo sapiens
agagcugugcaucagcuagaa

SEQ ID NO: 1164470 - RNA, 19 nt, Homo sapiens
agaggaaaaguaaccauca

SEQ ID NO: 1164471 - RNA, 19 nt, Homo sapiens
agaggaaagaaugaaagag

SEQ ID NO: 1164472 - RNA, 18 nt, Homo sapiens
agaggaaauuguacauaa

SEQ ID NO: 1164473 - RNA, 17 nt, Homo sapiens
agaggacaggcuacccc

SEQ ID NO: 1164474 - RNA, 13 nt, Homo sapiens
agaggacugugau

SEQ ID NO: 1164475 - RNA, 16 nt, Homo sapiens
agaggagacagccugu

SEQ ID NO: 1164476 - RNA, 14 nt, Homo sapiens
agaggagagccaga

SEQ ID NO: 1164477 - RNA, 22 nt, Homo sapiens
agaggcaaugauuguuaauuua

SEQ ID NO: 1164478 - RNA, 21 nt, Homo sapiens
agaggccggucccuuccuugg

SEQ ID NO: 1164479 - RNA, 22 nt, Homo sapiens
agaggccuuggggcaugaccca

SEQ ID NO: 1164480 - RNA, 14 nt, Homo sapiens
agaggccuuguccc

SEQ ID NO: 1164481 - RNA, 19 nt, Homo sapiens
agaggcugagacaggagaa

SEQ ID NO: 1164482 - RNA, 20 nt, Homo sapiens
agaggcugaggcuggcacag

SEQ ID NO: 1164483 - RNA, 22 nt, Homo sapiens
agagggaccaaauugcuucuag

SEQ ID NO: 1164484 - RNA, 18 nt, Homo sapiens
agagggcauauacaguga

SEQ ID NO: 1164485 - RNA, 12 nt, Homo sapiens
agagggcccaaa

SEQ ID NO: 1164486 - RNA, 13 nt, Homo sapiens
agagggccuuugc

SEQ ID NO: 1164487 - RNA, 13 nt, Homo sapiens
agagggcuuucag

SEQ ID NO: 1164488 - RNA, 18 nt, Homo sapiens
agaggggagugcauuuag

SEQ ID NO: 1164489 - RNA, 23 nt, Homo sapiens
agaggggcuccccgggucucuca

SEQ ID NO: 1164490 - RNA, 22 nt, Homo sapiens
agagggguggaguuuuaacugu

SEQ ID NO: 1164491 - RNA, 16 nt, Homo sapiens
agagggucacaguguu

SEQ ID NO: 1164492 - RNA, 22 nt, Homo sapiens
agagguacaaguaaagcccaga

SEQ ID NO: 1164493 - RNA, 13 nt, Homo sapiens
agaguacacccca

SEQ ID NO: 1164494 - RNA, 18 nt, Homo sapiens
agaguagaauugcauuga

SEQ ID NO: 1164495 - RNA, 22 nt, Homo sapiens
agaguauagcucuguaguggaa

SEQ ID NO: 1164496 - RNA, 14 nt, Homo sapiens
agaguauuaaugaa

SEQ ID NO: 1164497 - RNA, 14 nt, Homo sapiens
agagucacccugag

SEQ ID NO: 1164498 - RNA, 17 nt, Homo sapiens
agagucauuuucacuuu

SEQ ID NO: 1164499 - RNA, 16 nt, Homo sapiens
agaguccagcuaacac

SEQ ID NO: 1164500 - RNA, 21 nt, Homo sapiens
agaguccuauuugcacuguag

SEQ ID NO: 1164501 - RNA, 13 nt, Homo sapiens
agagucugugcug

SEQ ID NO: 1164502 - RNA, 20 nt, Homo sapiens
agagugagaccccaucucua

SEQ ID NO: 1164503 - RNA, 14 nt, Homo sapiens
agagugaugccggu

SEQ ID NO: 1164504 - RNA, 21 nt, Homo sapiens
agaguggacuguucccugagg

SEQ ID NO: 1164505 - RNA, 14 nt, Homo sapiens
agaguggugcugcu

SEQ ID NO: 1164506 - RNA, 15 nt, Homo sapiens
agaguggugcugcuu

SEQ ID NO: 1164507 - RNA, 19 nt, Homo sapiens
agaguggugcugcuuuaau

SEQ ID NO: 1164508 - RNA, 23 nt, Homo sapiens
agagugucuucacggcaggacaa

SEQ ID NO: 1164509 - RNA, 15 nt, Homo sapiens
aaaauaccaacucau

SEQ ID NO: 1164510 - RNA, 14 nt, Homo sapiens
aaaauacgcaauuu

SEQ ID NO: 1164511 - RNA, 21 nt, Homo sapiens
aaaauacggacguacuuugug

SEQ ID NO: 1164512 - RNA, 18 nt, Homo sapiens
aaaauacugccagaugcu

SEQ ID NO: 1164513 - RNA, 17 nt, Homo sapiens
aaaauagaaaagcacuu

SEQ ID NO: 1164514 - RNA, 15 nt, Homo sapiens
aaaauagaacagcuc

SEQ ID NO: 1164515 - RNA, 18 nt, Homo sapiens
aaaauagagccugaggga

SEQ ID NO: 1164516 - RNA, 18 nt, Homo sapiens
aaaauaggauugcuucaa

SEQ ID NO: 1164517 - RNA, 21 nt, Homo sapiens
aaaauaggauugcuucaauua

SEQ ID NO: 1164518 - RNA, 14 nt, Homo sapiens
aaaauagucuucca

SEQ ID NO: 1164519 - RNA, 15 nt, Homo sapiens
aaaauauacauucaa

SEQ ID NO: 1164520 - RNA, 23 nt, Homo sapiens
aaaauauucccacucagcacuca

SEQ ID NO: 1164521 - RNA, 21 nt, Homo sapiens
aaaaucaaacccacauauuaa

SEQ ID NO: 1164522 - RNA, 16 nt, Homo sapiens
aaaaucaaaucauccu

SEQ ID NO: 1164523 - RNA, 14 nt, Homo sapiens
aaaaucaauauuuc

SEQ ID NO: 1164524 - RNA, 11 nt, Homo sapiens
aaaaucacuug

SEQ ID NO: 1164525 - RNA, 14 nt, Homo sapiens
aaaaucacuugaac

SEQ ID NO: 1164526 - RNA, 13 nt, Homo sapiens
aaaaucacuugau

SEQ ID NO: 1164527 - RNA, 16 nt, Homo sapiens
aaaaucauaguacucu

SEQ ID NO: 1164528 - RNA, 12 nt, Homo sapiens
aaaaucauauaa

SEQ ID NO: 1164529 - RNA, 14 nt, Homo sapiens
aaaaucuaccuguu

SEQ ID NO: 1164530 - RNA, 18 nt, Homo sapiens
aaaaucuaccuguuccug

SEQ ID NO: 1164531 - RNA, 14 nt, Homo sapiens
aaaaucuguucuaa

SEQ ID NO: 1164532 - RNA, 20 nt, Homo sapiens
aaaaugaaccugcaagccuu

SEQ ID NO: 1164533 - RNA, 23 nt, Homo sapiens
aaaaugaagguggaacaagcaca

SEQ ID NO: 1164534 - RNA, 15 nt, Homo sapiens
aaaaugaauuugacu

SEQ ID NO: 1164535 - RNA, 17 nt, Homo sapiens
aaaaugaauuugacugg

SEQ ID NO: 1164536 - RNA, 13 nt, Homo sapiens
aaaaugagugcuu

SEQ ID NO: 1164537 - RNA, 16 nt, Homo sapiens
aaaaugagugcuuaaa

SEQ ID NO: 1164538 - RNA, 18 nt, Homo sapiens
aaaaugaugcaaccaaaa

SEQ ID NO: 1164539 - RNA, 20 nt, Homo sapiens
aaaaugcaauguaagcauac

SEQ ID NO: 1164540 - RNA, 11 nt, Homo sapiens
aaaaugcacac

SEQ ID NO: 1164541 - RNA, 15 nt, Homo sapiens
aaaaugcaccaaaua

SEQ ID NO: 1164542 - RNA, 22 nt, Homo sapiens
aaaaugcagcagggaugcccug

SEQ ID NO: 1164543 - RNA, 22 nt, Homo sapiens
aaaaugguauaaguaacuuuau

SEQ ID NO: 1164544 - RNA, 16 nt, Homo sapiens
aaaauguaaagccaug

SEQ ID NO: 1164545 - RNA, 14 nt, Homo sapiens
aaaauguauaccaa

SEQ ID NO: 1164546 - RNA, 17 nt, Homo sapiens
aaaauguauaucucucc

SEQ ID NO: 1164547 - RNA, 15 nt, Homo sapiens
aaaauguauuuuucc

SEQ ID NO: 1164548 - RNA, 11 nt, Homo sapiens
aaaaugugcag

SEQ ID NO: 1164549 - RNA, 15 nt, Homo sapiens
aaaaugugucugcaa

SEQ ID NO: 1164550 - RNA, 12 nt, Homo sapiens
aaaauguucucu

SEQ ID NO: 1164551 - RNA, 12 nt, Homo sapiens
aaaauuacuuug

SEQ ID NO: 1164552 - RNA, 22 nt, Homo sapiens
aaaauuagaaucugaguauaaa

SEQ ID NO: 1164553 - RNA, 19 nt, Homo sapiens
aaaauucagguauuacuga

SEQ ID NO: 1164554 - RNA, 13 nt, Homo sapiens
aaaauucauuucu

SEQ ID NO: 1164555 - RNA, 15 nt, Homo sapiens
aaaauucucuuaaac

SEQ ID NO: 1164556 - RNA, 17 nt, Homo sapiens
aaaauucuuaaguaugu

SEQ ID NO: 1164557 - RNA, 14 nt, Homo sapiens
aaaauuugacauua

SEQ ID NO: 1164558 - RNA, 19 nt, Homo sapiens
aaaauuuuuuaaauucaua

SEQ ID NO: 1164559 - RNA, 22 nt, Homo sapiens
aaacaaaaaugauccucagugc

SEQ ID NO: 1164560 - RNA, 20 nt, Homo sapiens
aaacaaacuacugugucacu

SEQ ID NO: 1164561 - RNA, 19 nt, Homo sapiens
aaacaagacugccucccuc

SEQ ID NO: 1164562 - RNA, 19 nt, Homo sapiens
aaacaaggcgagcuugagu

SEQ ID NO: 1164563 - RNA, 21 nt, Homo sapiens
aaacaccacuaauuguguaca

SEQ ID NO: 1164564 - RNA, 20 nt, Homo sapiens
aaacacgccugcaaacgcug

SEQ ID NO: 1164565 - RNA, 17 nt, Homo sapiens
aaacacucaacaauaaa

SEQ ID NO: 1164566 - RNA, 18 nt, Homo sapiens
aaacacucaacaauaaag

SEQ ID NO: 1164567 - RNA, 23 nt, Homo sapiens
aaacacucuugaauagacuucca

SEQ ID NO: 1164568 - RNA, 22 nt, Homo sapiens
aaacacuuauuuuacacagcaa

SEQ ID NO: 1164569 - RNA, 22 nt, Homo sapiens
aaacacuucaauaauuguccau

SEQ ID NO: 1164570 - RNA, 20 nt, Homo sapiens
aaacacuucuguccugugag

SEQ ID NO: 1164571 - RNA, 13 nt, Homo sapiens
aaacacuugcaac

SEQ ID NO: 1164572 - RNA, 19 nt, Homo sapiens
aaacagauuguuugcaaag

SEQ ID NO: 1164573 - RNA, 22 nt, Homo sapiens
aaacagccucuuuuugauacug

SEQ ID NO: 1164574 - RNA, 15 nt, Homo sapiens
aaacagcucucccuc

SEQ ID NO: 1164575 - RNA, 23 nt, Homo sapiens
aaacaggagccuaccacaaggcu

SEQ ID NO: 1164576 - RNA, 20 nt, Homo sapiens
aaacagugcaaggaagggca

SEQ ID NO: 1164577 - RNA, 17 nt, Homo sapiens
aaacaguuugaaaggga

SEQ ID NO: 1164578 - RNA, 11 nt, Homo sapiens
aaacaguuuua

SEQ ID NO: 1164579 - RNA, 21 nt, Homo sapiens
aaacauaugcacauucacuua

SEQ ID NO: 1164580 - RNA, 13 nt, Homo sapiens
aaacaucuggaag

SEQ ID NO: 1164581 - RNA, 17 nt, Homo sapiens
aaacaugaaaacauuga

SEQ ID NO: 1164582 - RNA, 18 nt, Homo sapiens
aaacaugaaaacauugau

SEQ ID NO: 1164583 - RNA, 18 nt, Homo sapiens
aaacauguaauauaaaga

SEQ ID NO: 1164584 - RNA, 16 nt, Homo sapiens
aaacauguaugugcau

SEQ ID NO: 1164585 - RNA, 9 nt, Homo sapiens
aaacauguu

SEQ ID NO: 1164586 - RNA, 20 nt, Homo sapiens
aaacauguuguacauuucac

SEQ ID NO: 1164587 - RNA, 22 nt, Homo sapiens
aaacauguuuaucguauuugau

SEQ ID NO: 1164588 - RNA, 18 nt, Homo sapiens
aaacauucugauuuggaa

SEQ ID NO: 1164589 - RNA, 22 nt, Homo sapiens
aaacauuggcaaucacguugaa

SEQ ID NO: 1164590 - RNA, 15 nt, Homo sapiens
aaacauugugccaug

SEQ ID NO: 1164591 - RNA, 17 nt, Homo sapiens
aaacauuuauguuuaaa

SEQ ID NO: 1164592 - RNA, 16 nt, Homo sapiens
aaacauuugcuggaga

SEQ ID NO: 1164593 - RNA, 18 nt, Homo sapiens
aaacauuuuuaucuauca

SEQ ID NO: 1164594 - RNA, 18 nt, Homo sapiens
aaaccacuaugcaaagaa

SEQ ID NO: 1164595 - RNA, 21 nt, Homo sapiens
aaaccacuaugcaaagaacuc

SEQ ID NO: 1164596 - RNA, 18 nt, Homo sapiens
aaaccagguuugcaccua

SEQ ID NO: 1164597 - RNA, 15 nt, Homo sapiens
aaaccauuauuucag

SEQ ID NO: 1164598 - RNA, 13 nt, Homo sapiens
aaacccaauccaa

SEQ ID NO: 1164599 - RNA, 13 nt, Homo sapiens
aaacccaggguga

SEQ ID NO: 1164600 - RNA, 17 nt, Homo sapiens
aaacccauuuacuuagg

SEQ ID NO: 1164601 - RNA, 14 nt, Homo sapiens
aaacccccagugua

SEQ ID NO: 1164602 - RNA, 16 nt, Homo sapiens
aaaccccuucucugug

SEQ ID NO: 1164603 - RNA, 14 nt, Homo sapiens
aaacccuuccccaa

SEQ ID NO: 1164604 - RNA, 15 nt, Homo sapiens
aaacccuuucauaaa

SEQ ID NO: 1164605 - RNA, 15 nt, Homo sapiens
aaacccuuuucaucc

SEQ ID NO: 1164606 - RNA, 19 nt, Homo sapiens
aaaccuacagcauauucuu

SEQ ID NO: 1164607 - RNA, 20 nt, Homo sapiens
aaaccucugggucaucucuc

SEQ ID NO: 1164608 - RNA, 21 nt, Homo sapiens
aaaccugagcagcaacugugu

SEQ ID NO: 1164609 - RNA, 23 nt, Homo sapiens
aaaccuguagaugcagaaaaaga

SEQ ID NO: 1164610 - RNA, 13 nt, Homo sapiens
aaaccuuugccaa

SEQ ID NO: 1164611 - RNA, 15 nt, Homo sapiens
aaacggauaccaagu

SEQ ID NO: 1164612 - RNA, 13 nt, Homo sapiens
aaacgugcgcuca

SEQ ID NO: 1164613 - RNA, 17 nt, Homo sapiens
aaacuauguaaugcuua

SEQ ID NO: 1164614 - RNA, 13 nt, Homo sapiens
aaacucagugcaa

SEQ ID NO: 1164615 - RNA, 23 nt, Homo sapiens
aaacucaugacugagucuggcaa

SEQ ID NO: 1164616 - RNA, 15 nt, Homo sapiens
aaacucccagccaca

SEQ ID NO: 1164617 - RNA, 22 nt, Homo sapiens
aaacuccuuguuaauccaguga

SEQ ID NO: 1164618 - RNA, 20 nt, Homo sapiens
aaacugagaaauuuacuaca

SEQ ID NO: 1164619 - RNA, 14 nt, Homo sapiens
aaacugaggugcaa

SEQ ID NO: 1164620 - RNA, 20 nt, Homo sapiens
aaacugauuuaucuauuuaa

SEQ ID NO: 1164621 - RNA, 21 nt, Homo sapiens
aaacugcagagagacaacaga

SEQ ID NO: 1164622 - RNA, 23 nt, Homo sapiens
aaacugcagagagacaacagauu

SEQ ID NO: 1164623 - RNA, 11 nt, Homo sapiens
aaacugcauuu

SEQ ID NO: 1164624 - RNA, 16 nt, Homo sapiens
aaauagaauuugagca

SEQ ID NO: 1164625 - RNA, 15 nt, Homo sapiens
aaauagaggcuaaau

SEQ ID NO: 1164626 - RNA, 18 nt, Homo sapiens
aaauagagugcauuugaa

SEQ ID NO: 1164627 - RNA, 20 nt, Homo sapiens
aaauagcaacuuguguuaca

SEQ ID NO: 1164628 - RNA, 16 nt, Homo sapiens
aaauagcccuguaaca

SEQ ID NO: 1164629 - RNA, 19 nt, Homo sapiens
aaauagggaugaucacucu

SEQ ID NO: 1164630 - RNA, 19 nt, Homo sapiens
aaauaguaaucuguaagca

SEQ ID NO: 1164631 - RNA, 17 nt, Homo sapiens
aaauauauagcuugaaa

SEQ ID NO: 1164632 - RNA, 21 nt, Homo sapiens
aaauaucauaaucugaugaua

SEQ ID NO: 1164633 - RNA, 12 nt, Homo sapiens
aaauaugaagcu

SEQ ID NO: 1164634 - RNA, 17 nt, Homo sapiens
aaauauuagaugugauu

SEQ ID NO: 1164635 - RNA, 14 nt, Homo sapiens
aaauauuaggagac

SEQ ID NO: 1164636 - RNA, 21 nt, Homo sapiens
aaauauuaggagacacaggga

SEQ ID NO: 1164637 - RNA, 12 nt, Homo sapiens
aaauauuaucuu

SEQ ID NO: 1164638 - RNA, 17 nt, Homo sapiens
aaauauuuacaguacuu

SEQ ID NO: 1164639 - RNA, 16 nt, Homo sapiens
aaauauuuugauauaa

SEQ ID NO: 1164640 - RNA, 13 nt, Homo sapiens
aaauauuuugcuu

SEQ ID NO: 1164641 - RNA, 21 nt, Homo sapiens
aaaucaaagauaagguuauag

SEQ ID NO: 1164642 - RNA, 23 nt, Homo sapiens
aaaucaaucuguaaaacuaagaa

SEQ ID NO: 1164643 - RNA, 13 nt, Homo sapiens
aaaucacuugaac

SEQ ID NO: 1164644 - RNA, 18 nt, Homo sapiens
aaaucacuugauucauaa

SEQ ID NO: 1164645 - RNA, 13 nt, Homo sapiens
aaaucacuuugag

SEQ ID NO: 1164646 - RNA, 13 nt, Homo sapiens
aaaucaguauuug

SEQ ID NO: 1164647 - RNA, 17 nt, Homo sapiens
aaaucauauaagcuaua

SEQ ID NO: 1164648 - RNA, 20 nt, Homo sapiens
aaaucaucucucaucacuuu

SEQ ID NO: 1164649 - RNA, 23 nt, Homo sapiens
aaaucauguuuuuucugcaauga

SEQ ID NO: 1164650 - RNA, 15 nt, Homo sapiens
aaaucccaugguugu

SEQ ID NO: 1164651 - RNA, 23 nt, Homo sapiens
aaaucccuuucaugucuuuccac

SEQ ID NO: 1164652 - RNA, 14 nt, Homo sapiens
aaauccgccagugu

SEQ ID NO: 1164653 - RNA, 20 nt, Homo sapiens
aaauccuaaagaaggugaua

SEQ ID NO: 1164654 - RNA, 14 nt, Homo sapiens
aaauccuuacuucc

SEQ ID NO: 1164655 - RNA, 15 nt, Homo sapiens
aaauccuuacuucca

SEQ ID NO: 1164656 - RNA, 17 nt, Homo sapiens
aaaucuauagaacugaa

SEQ ID NO: 1164657 - RNA, 23 nt, Homo sapiens
aaaucuaugccuaaaaaguauca

SEQ ID NO: 1164658 - RNA, 15 nt, Homo sapiens
aaaucucaaaacugu

SEQ ID NO: 1164659 - RNA, 23 nt, Homo sapiens
aaaucucuucuuugcugcaguca

SEQ ID NO: 1164660 - RNA, 23 nt, Homo sapiens
aaaucucuuuuugacucuugcaa

SEQ ID NO: 1164661 - RNA, 15 nt, Homo sapiens
aaaucugacccagug

SEQ ID NO: 1164662 - RNA, 16 nt, Homo sapiens
aaaucugucacuacaa

SEQ ID NO: 1164663 - RNA, 17 nt, Homo sapiens
aaaucugugccugagaa

SEQ ID NO: 1164664 - RNA, 18 nt, Homo sapiens
aaaucuuccuuacugucu

SEQ ID NO: 1164665 - RNA, 17 nt, Homo sapiens
aaaugaaaaugucuugu

SEQ ID NO: 1164666 - RNA, 13 nt, Homo sapiens
aaaugaaagguga

SEQ ID NO: 1164667 - RNA, 14 nt, Homo sapiens
aaaugaauguuguc

SEQ ID NO: 1164668 - RNA, 13 nt, Homo sapiens
aaaugacaagcaa

SEQ ID NO: 1164669 - RNA, 12 nt, Homo sapiens
aaaugacaugga

SEQ ID NO: 1164670 - RNA, 20 nt, Homo sapiens
aaaugacauggacacaucag

SEQ ID NO: 1164671 - RNA, 17 nt, Homo sapiens
aaaugagagcagaaagu

SEQ ID NO: 1164672 - RNA, 14 nt, Homo sapiens
aaaugagcauggca

SEQ ID NO: 1164673 - RNA, 18 nt, Homo sapiens
aaaugaguagacauugug

SEQ ID NO: 1164674 - RNA, 15 nt, Homo sapiens
aaaugaguaguuugu

SEQ ID NO: 1164675 - RNA, 23 nt, Homo sapiens
aaaugauaaguacuacauaccuc

SEQ ID NO: 1164676 - RNA, 15 nt, Homo sapiens
aaaugcacacauuuc

SEQ ID NO: 1164677 - RNA, 20 nt, Homo sapiens
aaaugcagggcacaugaucu

SEQ ID NO: 1164678 - RNA, 20 nt, Homo sapiens
aaaugcaucaaaagacuuaa

SEQ ID NO: 1164679 - RNA, 18 nt, Homo sapiens
aaaugcauccauuccuca

SEQ ID NO: 1164680 - RNA, 14 nt, Homo sapiens
aaaugccaagcacu

SEQ ID NO: 1164681 - RNA, 14 nt, Homo sapiens
aaaugcuacugaaa

SEQ ID NO: 1164682 - RNA, 22 nt, Homo sapiens
aaaugcuacugaaacuuaccug

SEQ ID NO: 1164683 - RNA, 17 nt, Homo sapiens
aaaugcucaauuucagc

SEQ ID NO: 1164684 - RNA, 19 nt, Homo sapiens
aaaugcucuugucccuguc

SEQ ID NO: 1164685 - RNA, 17 nt, Homo sapiens
aaaugggaaaaccagac

SEQ ID NO: 1164686 - RNA, 22 nt, Homo sapiens
aaaugggaaaccaguucaugca

SEQ ID NO: 1164687 - RNA, 23 nt, Homo sapiens
aaaugggaauuuauaacccagug

SEQ ID NO: 1164688 - RNA, 13 nt, Homo sapiens
aaauggggccaga

SEQ ID NO: 1164689 - RNA, 21 nt, Homo sapiens
aaauggggccagauccagccu

SEQ ID NO: 1164690 - RNA, 20 nt, Homo sapiens
aaaugguggcuucagcucca

SEQ ID NO: 1164691 - RNA, 13 nt, Homo sapiens
aaauguaacugug

SEQ ID NO: 1164692 - RNA, 19 nt, Homo sapiens
aaauguaacugugccaguu

SEQ ID NO: 1164693 - RNA, 15 nt, Homo sapiens
aaauguagacugaaa

SEQ ID NO: 1164694 - RNA, 16 nt, Homo sapiens
aaauguauauuuugau

SEQ ID NO: 1164695 - RNA, 13 nt, Homo sapiens
aaauguaugugcu

SEQ ID NO: 1164696 - RNA, 16 nt, Homo sapiens
aaauguauuaaugcua

SEQ ID NO: 1164697 - RNA, 22 nt, Homo sapiens
aaaugucuucaaggcuucaguc

SEQ ID NO: 1164698 - RNA, 16 nt, Homo sapiens
aaaugugaccauguga

SEQ ID NO: 1164699 - RNA, 14 nt, Homo sapiens
aaaugugucugcaa

SEQ ID NO: 1164700 - RNA, 14 nt, Homo sapiens
aaauguuggugcaa

SEQ ID NO: 1164701 - RNA, 24 nt, Homo sapiens
aaauguuugcugagugagugauga

SEQ ID NO: 1164702 - RNA, 14 nt, Homo sapiens
aaauuaaaaccaau

SEQ ID NO: 1164703 - RNA, 15 nt, Homo sapiens
aaauuaaaaccaauu

SEQ ID NO: 1164704 - RNA, 15 nt, Homo sapiens
aaauuaaaaccugau

SEQ ID NO: 1164705 - RNA, 16 nt, Homo sapiens
aaauuaaaaccugaua

SEQ ID NO: 1164706 - RNA, 14 nt, Homo sapiens
aaauuaacaugaua

SEQ ID NO: 1164707 - RNA, 20 nt, Homo sapiens
aaauuaacaugauaaaagac

SEQ ID NO: 1164708 - RNA, 17 nt, Homo sapiens
aaauuaacuuacuucca

SEQ ID NO: 1164709 - RNA, 13 nt, Homo sapiens
aaauuaauuccua

SEQ ID NO: 1164710 - RNA, 12 nt, Homo sapiens
aaauuagcaaaa

SEQ ID NO: 1164711 - RNA, 14 nt, Homo sapiens
aaauuagugcugua

SEQ ID NO: 1164712 - RNA, 18 nt, Homo sapiens
aaauuauaguagcuuaua

SEQ ID NO: 1164713 - RNA, 11 nt, Homo sapiens
aaauucacugu

SEQ ID NO: 1164714 - RNA, 17 nt, Homo sapiens
aaauucuauacauguau

SEQ ID NO: 1164715 - RNA, 14 nt, Homo sapiens
aaauugaacaaaga

SEQ ID NO: 1164716 - RNA, 13 nt, Homo sapiens
aaauugcuucuag

SEQ ID NO: 1164717 - RNA, 16 nt, Homo sapiens
aaauugggacuaguuu

SEQ ID NO: 1164718 - RNA, 20 nt, Homo sapiens
aaauugggacuaguuuauag

SEQ ID NO: 1164719 - RNA, 16 nt, Homo sapiens
aaauugggcagucuua

SEQ ID NO: 1164720 - RNA, 21 nt, Homo sapiens
aaauugguauuaacuaugauc

SEQ ID NO: 1164721 - RNA, 14 nt, Homo sapiens
aaauuguagcuuuu

SEQ ID NO: 1164722 - RNA, 20 nt, Homo sapiens
aaauuguaucaaaugugaca

SEQ ID NO: 1164723 - RNA, 22 nt, Homo sapiens
aaauuguaucaaaugugacauu

SEQ ID NO: 1164724 - RNA, 14 nt, Homo sapiens
aaauuguauuauca

SEQ ID NO: 1164725 - RNA, 15 nt, Homo sapiens
aaauuguauuaucaa

SEQ ID NO: 1164726 - RNA, 19 nt, Homo sapiens
aaauugucuucauguacau

SEQ ID NO: 1164727 - RNA, 14 nt, Homo sapiens
aaauugugaugugg

SEQ ID NO: 1164728 - RNA, 14 nt, Homo sapiens
aaauuuaagcuuaa

SEQ ID NO: 1164729 - RNA, 14 nt, Homo sapiens
aaauuuaaguuuau

SEQ ID NO: 1164730 - RNA, 21 nt, Homo sapiens
aaauuuauuuuacacauguca

SEQ ID NO: 1164731 - RNA, 18 nt, Homo sapiens
aaauuucgagcauaagaa

SEQ ID NO: 1164732 - RNA, 18 nt, Homo sapiens
aaauuugauugauuugaa

SEQ ID NO: 1164733 - RNA, 22 nt, Homo sapiens
aaauuuguugucauguguauga

SEQ ID NO: 1164734 - RNA, 20 nt, Homo sapiens
aaauuuuacacaguucauca

SEQ ID NO: 1164735 - RNA, 22 nt, Homo sapiens
aaauuuuaguucuuacugcuua

SEQ ID NO: 1164736 - RNA, 18 nt, Homo sapiens
aaauuuucacugcugcuc

SEQ ID NO: 1164737 - RNA, 16 nt, Homo sapiens
aaauuuugaaaacugu

SEQ ID NO: 1164738 - RNA, 18 nt, Homo sapiens
aacaaaaaaaacaacaaa

SEQ ID NO: 1164739 - RNA, 14 nt, Homo sapiens
aacaaagaacugaa

SEQ ID NO: 1164740 - RNA, 16 nt, Homo sapiens
aacaaagcagccacga

SEQ ID NO: 1164741 - RNA, 12 nt, Homo sapiens
aacaaagcccuu

SEQ ID NO: 1164742 - RNA, 13 nt, Homo sapiens
aacaaagcccuua

SEQ ID NO: 1164743 - RNA, 19 nt, Homo sapiens
aacaaagggcacagcaucu

SEQ ID NO: 1164744 - RNA, 22 nt, Homo sapiens
aacaaagggcacagcaucugua

SEQ ID NO: 1164745 - RNA, 14 nt, Homo sapiens
aacaaauggccuuu

SEQ ID NO: 1164746 - RNA, 15 nt, Homo sapiens
aacaaauguauuuca

SEQ ID NO: 1164747 - RNA, 16 nt, Homo sapiens
aacaacaauaauaaag

SEQ ID NO: 1164748 - RNA, 15 nt, Homo sapiens
aacaagaaugcauug

SEQ ID NO: 1164749 - RNA, 16 nt, Homo sapiens
aacaagcaaacccaga

SEQ ID NO: 1164750 - RNA, 23 nt, Homo sapiens
aacaagguccucugucagucaca

SEQ ID NO: 1164751 - RNA, 14 nt, Homo sapiens
aacaaggucugcuc

SEQ ID NO: 1164752 - RNA, 21 nt, Homo sapiens
aacaaggucugcucugcuccu

SEQ ID NO: 1164753 - RNA, 19 nt, Homo sapiens
aacaaguucauuauauuca

SEQ ID NO: 1164754 - RNA, 18 nt, Homo sapiens
aacaauaaagacugagac

SEQ ID NO: 1164755 - RNA, 14 nt, Homo sapiens
aacaauaacacugc

SEQ ID NO: 1164756 - RNA, 17 nt, Homo sapiens
aacaauccaaaugcauu

SEQ ID NO: 1164757 - RNA, 19 nt, Homo sapiens
aacaaugauuaaauugaau

SEQ ID NO: 1164758 - RNA, 18 nt, Homo sapiens
aacaauguuugauacucu

SEQ ID NO: 1164759 - RNA, 17 nt, Homo sapiens
aacaauuacauggcucu

SEQ ID NO: 1164760 - RNA, 14 nt, Homo sapiens
aaagaauacuugaa

SEQ ID NO: 1164761 - RNA, 12 nt, Homo sapiens
aaagaauaucuu

SEQ ID NO: 1164762 - RNA, 16 nt, Homo sapiens
aaagaaugaaacaauc

SEQ ID NO: 1164763 - RNA, 18 nt, Homo sapiens
aaagaaugggcaguuaca

SEQ ID NO: 1164764 - RNA, 20 nt, Homo sapiens
aaagaauucuguacccugau

SEQ ID NO: 1164765 - RNA, 20 nt, Homo sapiens
aaagacaagugcucaagcag

SEQ ID NO: 1164766 - RNA, 20 nt, Homo sapiens
aaagacaauucuuuauacaa

SEQ ID NO: 1164767 - RNA, 19 nt, Homo sapiens
aaagacacgguugcucuau

SEQ ID NO: 1164768 - RNA, 20 nt, Homo sapiens
aaagaccugacaccuuucau

SEQ ID NO: 1164769 - RNA, 16 nt, Homo sapiens
aaagaccuugcugaua

SEQ ID NO: 1164770 - RNA, 22 nt, Homo sapiens
aaagagcagcacaggaagcugc

SEQ ID NO: 1164771 - RNA, 15 nt, Homo sapiens
aaagaggaaccagga

SEQ ID NO: 1164772 - RNA, 16 nt, Homo sapiens
aaagaggccuguucau

SEQ ID NO: 1164773 - RNA, 22 nt, Homo sapiens
aaagaguccuauuugcacugua

SEQ ID NO: 1164774 - RNA, 16 nt, Homo sapiens
aaagaguuucuguuca

SEQ ID NO: 1164775 - RNA, 21 nt, Homo sapiens
aaagaucgccuggcucaguca

SEQ ID NO: 1164776 - RNA, 16 nt, Homo sapiens
aaagauggaguuucua

SEQ ID NO: 1164777 - RNA, 13 nt, Homo sapiens
aaagauguauaua

SEQ ID NO: 1164778 - RNA, 17 nt, Homo sapiens
aaagauucaugauuuau

SEQ ID NO: 1164779 - RNA, 21 nt, Homo sapiens
aaagauucccacccaauucaa

SEQ ID NO: 1164780 - RNA, 18 nt, Homo sapiens
aaagauucuauaguucua

SEQ ID NO: 1164781 - RNA, 20 nt, Homo sapiens
aaagauucuucuguguuuau

SEQ ID NO: 1164782 - RNA, 17 nt, Homo sapiens
aaagauugaacacugcg

SEQ ID NO: 1164783 - RNA, 17 nt, Homo sapiens
aaagauuguuggaugaa

SEQ ID NO: 1164784 - RNA, 20 nt, Homo sapiens
aaagauuucuugaguuuugu

SEQ ID NO: 1164785 - RNA, 21 nt, Homo sapiens
aaagcaaaggcagucccggga

SEQ ID NO: 1164786 - RNA, 17 nt, Homo sapiens
aaagcaaaugacuagua

SEQ ID NO: 1164787 - RNA, 22 nt, Homo sapiens
aaagcacuguagcccuggaccu

SEQ ID NO: 1164788 - RNA, 18 nt, Homo sapiens
aaagcagaagaagacaga

SEQ ID NO: 1164789 - RNA, 22 nt, Homo sapiens
aaagcagauugcagaaauacag

SEQ ID NO: 1164790 - RNA, 19 nt, Homo sapiens
aaagcagcccucugccucc

SEQ ID NO: 1164791 - RNA, 15 nt, Homo sapiens
aaagcaggacuucag

SEQ ID NO: 1164792 - RNA, 19 nt, Homo sapiens
aaagcaguuacuaauaugc

SEQ ID NO: 1164793 - RNA, 22 nt, Homo sapiens
aaagcaguuacuaauaugccua

SEQ ID NO: 1164794 - RNA, 19 nt, Homo sapiens
aaagcauccucuaccucuc

SEQ ID NO: 1164795 - RNA, 14 nt, Homo sapiens
aaagcaugcauucu

SEQ ID NO: 1164796 - RNA, 13 nt, Homo sapiens
aaagccacacucu

SEQ ID NO: 1164797 - RNA, 22 nt, Homo sapiens
aaagccacacucugggcuccag

SEQ ID NO: 1164798 - RNA, 14 nt, Homo sapiens
aaagccagucauca

SEQ ID NO: 1164799 - RNA, 16 nt, Homo sapiens
aaagccaucucagguu

SEQ ID NO: 1164800 - RNA, 12 nt, Homo sapiens
aaagccaugugu

SEQ ID NO: 1164801 - RNA, 13 nt, Homo sapiens
aaagccauugugu

SEQ ID NO: 1164802 - RNA, 18 nt, Homo sapiens
aaagccccaaaugguggu

SEQ ID NO: 1164803 - RNA, 18 nt, Homo sapiens
aaagcccucccuaccuac

SEQ ID NO: 1164804 - RNA, 18 nt, Homo sapiens
aaagcccugccucugugu

SEQ ID NO: 1164805 - RNA, 19 nt, Homo sapiens
aaagccgaacugguaccau

SEQ ID NO: 1164806 - RNA, 20 nt, Homo sapiens
aaagccucacguauuucaca

SEQ ID NO: 1164807 - RNA, 10 nt, Homo sapiens
aaagccucau

SEQ ID NO: 1164808 - RNA, 17 nt, Homo sapiens
aaagccucgccuuccau

SEQ ID NO: 1164809 - RNA, 16 nt, Homo sapiens
aaagccuuaacuaaga

SEQ ID NO: 1164810 - RNA, 17 nt, Homo sapiens
aaagcggacaucagcug

SEQ ID NO: 1164811 - RNA, 22 nt, Homo sapiens
aaagcggccgaugggagucucc

SEQ ID NO: 1164812 - RNA, 17 nt, Homo sapiens
aaagcuaaaguaucugu

SEQ ID NO: 1164813 - RNA, 16 nt, Homo sapiens
aaagcuaauuaaucau

SEQ ID NO: 1164814 - RNA, 19 nt, Homo sapiens
aaagcuaguguaccuccuc

SEQ ID NO: 1164815 - RNA, 13 nt, Homo sapiens
aaagcugcucagg

SEQ ID NO: 1164816 - RNA, 21 nt, Homo sapiens
aaagcugugucucuguauaua

SEQ ID NO: 1164817 - RNA, 23 nt, Homo sapiens
aaagcuuggagggaagccgugaa

SEQ ID NO: 1164818 - RNA, 14 nt, Homo sapiens
aaagcuuuauuuca

SEQ ID NO: 1164819 - RNA, 14 nt, Homo sapiens
aaaggaaguucucc

SEQ ID NO: 1164820 - RNA, 20 nt, Homo sapiens
aaaggaggacaagacccucu

SEQ ID NO: 1164821 - RNA, 13 nt, Homo sapiens
aaaggcauuccac

SEQ ID NO: 1164822 - RNA, 14 nt, Homo sapiens
aaagggacuugaag

SEQ ID NO: 1164823 - RNA, 19 nt, Homo sapiens
aaagggacuuuuguaaaau

SEQ ID NO: 1164824 - RNA, 15 nt, Homo sapiens
aaagggcaugggucg

SEQ ID NO: 1164825 - RNA, 18 nt, Homo sapiens
aaagggcgcaaagggcau

SEQ ID NO: 1164826 - RNA, 17 nt, Homo sapiens
aaagggguugaggaaug

SEQ ID NO: 1164827 - RNA, 23 nt, Homo sapiens
aaagguaaaacaugcuggugaac

SEQ ID NO: 1164828 - RNA, 22 nt, Homo sapiens
aaagguucuaaggggaccuaca

SEQ ID NO: 1164829 - RNA, 14 nt, Homo sapiens
aaagguucuagguu

SEQ ID NO: 1164830 - RNA, 17 nt, Homo sapiens
aaagguugauguauuua

SEQ ID NO: 1164831 - RNA, 19 nt, Homo sapiens
aaagguuucaagacuugau

SEQ ID NO: 1164832 - RNA, 18 nt, Homo sapiens
aaaguaaccugaacuaau

SEQ ID NO: 1164833 - RNA, 22 nt, Homo sapiens
aaaguaaccugaacuaaucuga

SEQ ID NO: 1164834 - RNA, 13 nt, Homo sapiens
aaaguacaauuca

SEQ ID NO: 1164835 - RNA, 13 nt, Homo sapiens
aaaguacugagca

SEQ ID NO: 1164836 - RNA, 15 nt, Homo sapiens
aaaguacuucaggca

SEQ ID NO: 1164837 - RNA, 18 nt, Homo sapiens
aaaguauuaucagaugcu

SEQ ID NO: 1164838 - RNA, 16 nt, Homo sapiens
aaaguauucuguacuc

SEQ ID NO: 1164839 - RNA, 19 nt, Homo sapiens
aaaguauucuucucuuccu

SEQ ID NO: 1164840 - RNA, 17 nt, Homo sapiens
aaaguauuuauuguaca

SEQ ID NO: 1164841 - RNA, 18 nt, Homo sapiens
aaaguauuuuugauuaac

SEQ ID NO: 1164842 - RNA, 20 nt, Homo sapiens
aaagucacacgaaucucacc

SEQ ID NO: 1164843 - RNA, 23 nt, Homo sapiens
aaagucaggaguccaagaccaga

SEQ ID NO: 1164844 - RNA, 21 nt, Homo sapiens
aaagucaucccucuguucaca

SEQ ID NO: 1164845 - RNA, 18 nt, Homo sapiens
aaagucccuuuauaaaga

SEQ ID NO: 1164846 - RNA, 21 nt, Homo sapiens
aaaguccucuggauugagaua

SEQ ID NO: 1164847 - RNA, 17 nt, Homo sapiens
aaagucuaaaaccuuaa

SEQ ID NO: 1164848 - RNA, 17 nt, Homo sapiens
aaagugaauuguugaca

SEQ ID NO: 1164849 - RNA, 21 nt, Homo sapiens
aaagugacuaauggcaugaga

SEQ ID NO: 1164850 - RNA, 21 nt, Homo sapiens
aaagugcugggauuacaggcg

SEQ ID NO: 1164851 - RNA, 18 nt, Homo sapiens
aaaguggacaaggagugu

SEQ ID NO: 1164852 - RNA, 16 nt, Homo sapiens
aaaguggagaagcaca

SEQ ID NO: 1164853 - RNA, 17 nt, Homo sapiens
aaaguggcguuguucau

SEQ ID NO: 1164854 - RNA, 16 nt, Homo sapiens
aaaguggugcucaguu

SEQ ID NO: 1164855 - RNA, 22 nt, Homo sapiens
aaagugucaccccucacuguga

SEQ ID NO: 1164856 - RNA, 20 nt, Homo sapiens
aaagugucguaucugggaga

SEQ ID NO: 1164857 - RNA, 21 nt, Homo sapiens
aaagugugcuuaacauugaca

SEQ ID NO: 1164858 - RNA, 19 nt, Homo sapiens
aaaguguguuucuauguga

SEQ ID NO: 1164859 - RNA, 18 nt, Homo sapiens
aaaguuacauguuugcac

SEQ ID NO: 1164860 - RNA, 13 nt, Homo sapiens
aaaguuguuguaa

SEQ ID NO: 1164861 - RNA, 15 nt, Homo sapiens
aaaguuguuugugcc

SEQ ID NO: 1164862 - RNA, 21 nt, Homo sapiens
aaaguuuuaggguacaguuug

SEQ ID NO: 1164863 - RNA, 15 nt, Homo sapiens
aaaguuuugguuauu

SEQ ID NO: 1164864 - RNA, 20 nt, Homo sapiens
aaauaaaaucuaauuaauuc

SEQ ID NO: 1164865 - RNA, 17 nt, Homo sapiens
aaauaaagcuguucuca

SEQ ID NO: 1164866 - RNA, 16 nt, Homo sapiens
aaauaaaucaguucau

SEQ ID NO: 1164867 - RNA, 13 nt, Homo sapiens
aaauaaccacugc

SEQ ID NO: 1164868 - RNA, 22 nt, Homo sapiens
aaauaacuauauaagacauuaa

SEQ ID NO: 1164869 - RNA, 13 nt, Homo sapiens
aaauaacuaucag

SEQ ID NO: 1164870 - RNA, 23 nt, Homo sapiens
aaauaaggacaagccuaacuuca

SEQ ID NO: 1164871 - RNA, 19 nt, Homo sapiens
aaauaagguaauacauaua

SEQ ID NO: 1164872 - RNA, 13 nt, Homo sapiens
aaauaaguuacau

SEQ ID NO: 1164873 - RNA, 13 nt, Homo sapiens
aaauaaucaagau

SEQ ID NO: 1164874 - RNA, 21 nt, Homo sapiens
aaauacagucuuccauuugca

SEQ ID NO: 1164875 - RNA, 12 nt, Homo sapiens
aaauacauguac

SEQ ID NO: 1164876 - RNA, 15 nt, Homo sapiens
aaauacucaugugua

SEQ ID NO: 1164877 - RNA, 20 nt, Homo sapiens
aacuaccagugggcauguau

SEQ ID NO: 1164878 - RNA, 23 nt, Homo sapiens
aacuaccucgcaucauugcagau

SEQ ID NO: 1164879 - RNA, 20 nt, Homo sapiens
aacuacuauuuuucuuucca

SEQ ID NO: 1164880 - RNA, 23 nt, Homo sapiens
aacuagugagcgcccccugcccc

SEQ ID NO: 1164881 - RNA, 19 nt, Homo sapiens
aacuauuaaggauguagcu

SEQ ID NO: 1164882 - RNA, 20 nt, Homo sapiens
aaggcgcuuugaaacagggg

SEQ ID NO: 1164883 - RNA, 22 nt, Homo sapiens
acccucagucgcauagacuuau

SEQ ID NO: 1164884 - RNA, 17 nt, Homo sapiens
acccucauuucucaucu

SEQ ID NO: 1164885 - RNA, 14 nt, Homo sapiens
acccucccagcucu

SEQ ID NO: 1164886 - RNA, 21 nt, Homo sapiens
acccucccuccacuccucuca

SEQ ID NO: 1164887 - RNA, 14 nt, Homo sapiens
acccuccuucccac

SEQ ID NO: 1164888 - RNA, 17 nt, Homo sapiens
acccugaaggggccaug

SEQ ID NO: 1164889 - RNA, 23 nt, Homo sapiens
acccugagacauagaccauggau

SEQ ID NO: 1164890 - RNA, 24 nt, Homo sapiens
acccuggaaacuaccagugggcau

SEQ ID NO: 1164891 - RNA, 18 nt, Homo sapiens
acccuggaacuggagaaa

SEQ ID NO: 1164892 - RNA, 14 nt, Homo sapiens
acccugggggcaca

SEQ ID NO: 1164893 - RNA, 23 nt, Homo sapiens
acccugugacccucucacuuugg

SEQ ID NO: 1164894 - RNA, 22 nt, Homo sapiens
acccuuccuaaguuuaagggaa

SEQ ID NO: 1164895 - RNA, 21 nt, Homo sapiens
acccuucuggaaacugugaag

SEQ ID NO: 1164896 - RNA, 15 nt, Homo sapiens
acccuugagcugugu

SEQ ID NO: 1164897 - RNA, 19 nt, Homo sapiens
acccuuguuuacacauacc

SEQ ID NO: 1164898 - RNA, 21 nt, Homo sapiens
accgcccugcgggccacaggg

SEQ ID NO: 1164899 - RNA, 21 nt, Homo sapiens
accgcgcccagccucaucucu

SEQ ID NO: 1164900 - RNA, 20 nt, Homo sapiens
accgcuccagguaccuugac

SEQ ID NO: 1164901 - RNA, 14 nt, Homo sapiens
accggcguccugcc

SEQ ID NO: 1164902 - RNA, 18 nt, Homo sapiens
accgggcucacuugcuca

SEQ ID NO: 1164903 - RNA, 16 nt, Homo sapiens
accggggccugggcag

SEQ ID NO: 1164904 - RNA, 16 nt, Homo sapiens
accggguggaagggau

SEQ ID NO: 1164905 - RNA, 16 nt, Homo sapiens
accguacaucugcaau

SEQ ID NO: 1164906 - RNA, 14 nt, Homo sapiens
accguaggacccaa

SEQ ID NO: 1164907 - RNA, 21 nt, Homo sapiens
accgugagugacauagccuca

SEQ ID NO: 1164908 - RNA, 20 nt, Homo sapiens
accgugccugaucugcacau

SEQ ID NO: 1164909 - RNA, 14 nt, Homo sapiens
accguucugugcac

SEQ ID NO: 1164910 - RNA, 21 nt, Homo sapiens
accguuuugaagcuacugugu

SEQ ID NO: 1164911 - RNA, 20 nt, Homo sapiens
accuaaacgguucaguuucu

SEQ ID NO: 1164912 - RNA, 17 nt, Homo sapiens
accuaacccucugucac

SEQ ID NO: 1164913 - RNA, 14 nt, Homo sapiens
accuaauccaggca

SEQ ID NO: 1164914 - RNA, 15 nt, Homo sapiens
accuaauccaggcag

SEQ ID NO: 1164915 - RNA, 16 nt, Homo sapiens
accuacaaaaugagau

SEQ ID NO: 1164916 - RNA, 12 nt, Homo sapiens
accuacauucaa

SEQ ID NO: 1164917 - RNA, 13 nt, Homo sapiens
accuacccaugac

SEQ ID NO: 1164918 - RNA, 15 nt, Homo sapiens
accuacccaugaccu

SEQ ID NO: 1164919 - RNA, 21 nt, Homo sapiens
accuacuccagcucccaacuu

SEQ ID NO: 1164920 - RNA, 13 nt, Homo sapiens
accuacugcugag

SEQ ID NO: 1164921 - RNA, 21 nt, Homo sapiens
accuagaguauaccugugguu

SEQ ID NO: 1164922 - RNA, 12 nt, Homo sapiens
accuagcaauag

SEQ ID NO: 1164923 - RNA, 18 nt, Homo sapiens
accuaguauaucagugac

SEQ ID NO: 1164924 - RNA, 12 nt, Homo sapiens
accuauguaaca

SEQ ID NO: 1164925 - RNA, 22 nt, Homo sapiens
accuauugccaggaauguuuca

SEQ ID NO: 1164926 - RNA, 16 nt, Homo sapiens
accucaccugaccuca

SEQ ID NO: 1164927 - RNA, 19 nt, Homo sapiens
accucagccucccaaagug

SEQ ID NO: 1164928 - RNA, 19 nt, Homo sapiens
accucagccuggccagaca

SEQ ID NO: 1164929 - RNA, 20 nt, Homo sapiens
accucagccuggccagacac

SEQ ID NO: 1164930 - RNA, 16 nt, Homo sapiens
accucaggccacaucu

SEQ ID NO: 1164931 - RNA, 22 nt, Homo sapiens
accucaggguauugcuugccac

SEQ ID NO: 1164932 - RNA, 21 nt, Homo sapiens
accucaguucccucuugcuca

SEQ ID NO: 1164933 - RNA, 18 nt, Homo sapiens
accucauguccacucagu

SEQ ID NO: 1164934 - RNA, 14 nt, Homo sapiens
accuccaagccacu

SEQ ID NO: 1164935 - RNA, 14 nt, Homo sapiens
accuccacugcugc

SEQ ID NO: 1164936 - RNA, 19 nt, Homo sapiens
accuccaggcuuucccacu

SEQ ID NO: 1164937 - RNA, 14 nt, Homo sapiens
accucccacugccc

SEQ ID NO: 1164938 - RNA, 18 nt, Homo sapiens
accucccuccccgucuca

SEQ ID NO: 1164939 - RNA, 14 nt, Homo sapiens
accucccucugcca

SEQ ID NO: 1164940 - RNA, 19 nt, Homo sapiens
accuccucccuaaugcuca

SEQ ID NO: 1164941 - RNA, 16 nt, Homo sapiens
accuccucuuccccca

SEQ ID NO: 1164942 - RNA, 13 nt, Homo sapiens
accucguccuccc

SEQ ID NO: 1164943 - RNA, 20 nt, Homo sapiens
accucuagacugguucauuc

SEQ ID NO: 1164944 - RNA, 16 nt, Homo sapiens
accucucccugacccu

SEQ ID NO: 1164945 - RNA, 16 nt, Homo sapiens
accucucucacugacu

SEQ ID NO: 1164946 - RNA, 17 nt, Homo sapiens
accucugggucaucucu

SEQ ID NO: 1164947 - RNA, 18 nt, Homo sapiens
accugaaauaaaauucau

SEQ ID NO: 1164948 - RNA, 14 nt, Homo sapiens
accugaaauuccaa

SEQ ID NO: 1164949 - RNA, 21 nt, Homo sapiens
accugaaggacagcugaaccc

SEQ ID NO: 1164950 - RNA, 14 nt, Homo sapiens
accugacucuugca

SEQ ID NO: 1164951 - RNA, 15 nt, Homo sapiens
accugacucuugcag

SEQ ID NO: 1164952 - RNA, 22 nt, Homo sapiens
accugacuuaugaaacuugaaa

SEQ ID NO: 1164953 - RNA, 19 nt, Homo sapiens
accugagcagcaacugugu

SEQ ID NO: 1164954 - RNA, 19 nt, Homo sapiens
accugagcaggaccucuga

SEQ ID NO: 1164955 - RNA, 15 nt, Homo sapiens
accugaugccauaaa

SEQ ID NO: 1164956 - RNA, 22 nt, Homo sapiens
accugaugugcaguuuaaucuu

SEQ ID NO: 1164957 - RNA, 16 nt, Homo sapiens
accugauuuaccucuu

SEQ ID NO: 1164958 - RNA, 22 nt, Homo sapiens
accugcaaagaucuguccucag

SEQ ID NO: 1164959 - RNA, 18 nt, Homo sapiens
accugcaaguauccagac

SEQ ID NO: 1164960 - RNA, 23 nt, Homo sapiens
accugcaccuccccccacugcag

SEQ ID NO: 1164961 - RNA, 17 nt, Homo sapiens
accugcacuucauaucu

SEQ ID NO: 1164962 - RNA, 21 nt, Homo sapiens
accugccagccgguucugcua

SEQ ID NO: 1164963 - RNA, 14 nt, Homo sapiens
accugccagggagg

SEQ ID NO: 1164964 - RNA, 15 nt, Homo sapiens
accugcucuucaaga

SEQ ID NO: 1164965 - RNA, 18 nt, Homo sapiens
accugggcaauauagcaa

SEQ ID NO: 1164966 - RNA, 14 nt, Homo sapiens
accugggucuuuau

SEQ ID NO: 1164967 - RNA, 14 nt, Homo sapiens
accuggguguuaca

SEQ ID NO: 1164968 - RNA, 15 nt, Homo sapiens
accugguaccuggac

SEQ ID NO: 1164969 - RNA, 22 nt, Homo sapiens
accuggugggagcaccugccag

SEQ ID NO: 1164970 - RNA, 17 nt, Homo sapiens
accugguugauguguau

SEQ ID NO: 1164971 - RNA, 20 nt, Homo sapiens
accuguccaggugaguguga

SEQ ID NO: 1164972 - RNA, 15 nt, Homo sapiens
accugucgcuuccua

SEQ ID NO: 1164973 - RNA, 16 nt, Homo sapiens
accugugcugaacaua

SEQ ID NO: 1164974 - RNA, 12 nt, Homo sapiens
accugugugcug

SEQ ID NO: 1164975 - RNA, 16 nt, Homo sapiens
accuguuagcagacag

SEQ ID NO: 1164976 - RNA, 15 nt, Homo sapiens
accuguugcuuacaa

SEQ ID NO: 1164977 - RNA, 15 nt, Homo sapiens
accuuaaacuuucaa

SEQ ID NO: 1164978 - RNA, 16 nt, Homo sapiens
accuuaaaugcuacug

SEQ ID NO: 1164979 - RNA, 14 nt, Homo sapiens
accuuaguguuucu

SEQ ID NO: 1164980 - RNA, 15 nt, Homo sapiens
accuuaucaauugca

SEQ ID NO: 1164981 - RNA, 18 nt, Homo sapiens
accuuauucuacaucauu

SEQ ID NO: 1164982 - RNA, 14 nt, Homo sapiens
accuucaacuucca

SEQ ID NO: 1164983 - RNA, 18 nt, Homo sapiens
accuucaagaaccaggca

SEQ ID NO: 1164984 - RNA, 18 nt, Homo sapiens
accuucaggcagccagug

SEQ ID NO: 1164985 - RNA, 13 nt, Homo sapiens
acuguguagcauc

SEQ ID NO: 1164986 - RNA, 20 nt, Homo sapiens
acugugucagggaacauauu

SEQ ID NO: 1164987 - RNA, 23 nt, Homo sapiens
acuguguguuuuaaaacaacaac

SEQ ID NO: 1164988 - RNA, 19 nt, Homo sapiens
acuguuacuaggcuauuaa

SEQ ID NO: 1164989 - RNA, 16 nt, Homo sapiens
acuguuacugugucag

SEQ ID NO: 1164990 - RNA, 17 nt, Homo sapiens
acuguuacugugucagg

SEQ ID NO: 1164991 - RNA, 18 nt, Homo sapiens
acuguucccccugugcag

SEQ ID NO: 1164992 - RNA, 22 nt, Homo sapiens
acuguugauucgucugcgauuu

SEQ ID NO: 1164993 - RNA, 14 nt, Homo sapiens
acuguuucuuggua

SEQ ID NO: 1164994 - RNA, 20 nt, Homo sapiens
acuguuugucucaccuaccc

SEQ ID NO: 1164995 - RNA, 22 nt, Homo sapiens
acuguuugucucaccuacccau

SEQ ID NO: 1164996 - RNA, 13 nt, Homo sapiens
acuguuuuaucuc

SEQ ID NO: 1164997 - RNA, 15 nt, Homo sapiens
acuuaacaacugacu

SEQ ID NO: 1164998 - RNA, 14 nt, Homo sapiens
acuuaaccuuuuaa

SEQ ID NO: 1164999 - RNA, 18 nt, Homo sapiens
acuuaacuacuuaucucu

SEQ ID NO: 1165000 - RNA, 18 nt, Homo sapiens
acuuaaguacccuuucaa

SEQ ID NO: 1165001 - RNA, 17 nt, Homo sapiens
acuuaauaauguguaca

SEQ ID NO: 1165002 - RNA, 15 nt, Homo sapiens
acuuacacucuuuua

SEQ ID NO: 1165003 - RNA, 17 nt, Homo sapiens
acuuaccuagauucuac

SEQ ID NO: 1165004 - RNA, 15 nt, Homo sapiens
acuuagacaguaugc

SEQ ID NO: 1165005 - RNA, 12 nt, Homo sapiens
acuuagacuccc

SEQ ID NO: 1165006 - RNA, 17 nt, Homo sapiens
acuuagcuggccaagga

SEQ ID NO: 1165007 - RNA, 19 nt, Homo sapiens
acuuaguauugcagccaaa

SEQ ID NO: 1165008 - RNA, 16 nt, Homo sapiens
acuuauggaacaggga

SEQ ID NO: 1165009 - RNA, 18 nt, Homo sapiens
acuuauggaacagggaug

SEQ ID NO: 1165010 - RNA, 15 nt, Homo sapiens
acuuauucucaagaa

SEQ ID NO: 1165011 - RNA, 13 nt, Homo sapiens
acuuauuuuacac

SEQ ID NO: 1165012 - RNA, 23 nt, Homo sapiens
acuucaagaacccugacuccucu

SEQ ID NO: 1165013 - RNA, 18 nt, Homo sapiens
acuucaaggugacagaag

SEQ ID NO: 1165014 - RNA, 13 nt, Homo sapiens
acuucaagugcau

SEQ ID NO: 1165015 - RNA, 23 nt, Homo sapiens
acuucaauguauugagcauguga

SEQ ID NO: 1165016 - RNA, 19 nt, Homo sapiens
acuucacagauuuguccag

SEQ ID NO: 1165017 - RNA, 18 nt, Homo sapiens
acuucaccuaacuagaga

SEQ ID NO: 1165018 - RNA, 19 nt, Homo sapiens
acuucacgaaguguugcau

SEQ ID NO: 1165019 - RNA, 17 nt, Homo sapiens
acuucagaguaagacaa

SEQ ID NO: 1165020 - RNA, 20 nt, Homo sapiens
acuucaguauguuuacuauu

SEQ ID NO: 1165021 - RNA, 13 nt, Homo sapiens
acuucauauuaau

SEQ ID NO: 1165022 - RNA, 13 nt, Homo sapiens
acuuccagcaaaa

SEQ ID NO: 1165023 - RNA, 20 nt, Homo sapiens
acuuccccuauggaauuuau

SEQ ID NO: 1165024 - RNA, 18 nt, Homo sapiens
acuuccuauaugcacuua

SEQ ID NO: 1165025 - RNA, 19 nt, Homo sapiens
acucucuucuuccauuaga

SEQ ID NO: 1165026 - RNA, 13 nt, Homo sapiens
acucugagacaaa

SEQ ID NO: 1165027 - RNA, 21 nt, Homo sapiens
acucugauagaauuauuucac

SEQ ID NO: 1165028 - RNA, 18 nt, Homo sapiens
acucugcacaugucuugu

SEQ ID NO: 1165029 - RNA, 16 nt, Homo sapiens
acucugcggcccgggc

SEQ ID NO: 1165030 - RNA, 20 nt, Homo sapiens
acucuggaccucucuuguga

SEQ ID NO: 1165031 - RNA, 20 nt, Homo sapiens
acucuggccacccaaacagg

SEQ ID NO: 1165032 - RNA, 19 nt, Homo sapiens
acucuggccuccaaaaugg

SEQ ID NO: 1165033 - RNA, 22 nt, Homo sapiens
acucugggcagggacccggggu

SEQ ID NO: 1165034 - RNA, 13 nt, Homo sapiens
acucugggcucca

SEQ ID NO: 1165035 - RNA, 17 nt, Homo sapiens
acucuguuauuuagacu

SEQ ID NO: 1165036 - RNA, 13 nt, Homo sapiens
acucuguugaaua

SEQ ID NO: 1165037 - RNA, 14 nt, Homo sapiens
acucuuaccuacaa

SEQ ID NO: 1165038 - RNA, 14 nt, Homo sapiens
acucuuaggacauu

SEQ ID NO: 1165039 - RNA, 14 nt, Homo sapiens
acucuuauuacugu

SEQ ID NO: 1165040 - RNA, 15 nt, Homo sapiens
acucuuauuacuguu

SEQ ID NO: 1165041 - RNA, 16 nt, Homo sapiens
acucuuauuugaauug

SEQ ID NO: 1165042 - RNA, 17 nt, Homo sapiens
acucuuccugaguucag

SEQ ID NO: 1165043 - RNA, 20 nt, Homo sapiens
acucuucuuacuggugcuau

SEQ ID NO: 1165044 - RNA, 10 nt, Homo sapiens
acucuugacu

SEQ ID NO: 1165045 - RNA, 12 nt, Homo sapiens
acucuugcaggg

SEQ ID NO: 1165046 - RNA, 17 nt, Homo sapiens
acugaaaagccaugugu

SEQ ID NO: 1165047 - RNA, 14 nt, Homo sapiens
acugaaaugcuagc

SEQ ID NO: 1165048 - RNA, 13 nt, Homo sapiens
acugaaccaaauu

SEQ ID NO: 1165049 - RNA, 15 nt, Homo sapiens
acugaacucacuuuc

SEQ ID NO: 1165050 - RNA, 14 nt, Homo sapiens
acugaagcucuuau

SEQ ID NO: 1165051 - RNA, 19 nt, Homo sapiens
acugaaggagaaggugccc

SEQ ID NO: 1165052 - RNA, 17 nt, Homo sapiens
acugagcgcaagccaca

SEQ ID NO: 1165053 - RNA, 16 nt, Homo sapiens
acugagcuauaacuua

SEQ ID NO: 1165054 - RNA, 16 nt, Homo sapiens
acugagcucugccuca

SEQ ID NO: 1165055 - RNA, 15 nt, Homo sapiens
acugaguagcuuuca

SEQ ID NO: 1165056 - RNA, 23 nt, Homo sapiens
acugaguauugauaaacuuugaa

SEQ ID NO: 1165057 - RNA, 16 nt, Homo sapiens
acugaguggagucuga

SEQ ID NO: 1165058 - RNA, 20 nt, Homo sapiens
acugcaaaccauggugagaa

SEQ ID NO: 1165059 - RNA, 14 nt, Homo sapiens
acugcaaaucugcc

SEQ ID NO: 1165060 - RNA, 23 nt, Homo sapiens
acugcaaccucugccucccaggu

SEQ ID NO: 1165061 - RNA, 19 nt, Homo sapiens
acugcacccaccuacuuag

SEQ ID NO: 1165062 - RNA, 20 nt, Homo sapiens
acugcacuccagccugggug

SEQ ID NO: 1165063 - RNA, 20 nt, Homo sapiens
acugcacuccagucugggug

SEQ ID NO: 1165064 - RNA, 22 nt, Homo sapiens
acugcagggaaaauuauuugca

SEQ ID NO: 1165065 - RNA, 20 nt, Homo sapiens
acugcagggguuauguggaa

SEQ ID NO: 1165066 - RNA, 16 nt, Homo sapiens
acugcagguccagugc

SEQ ID NO: 1165067 - RNA, 20 nt, Homo sapiens
acugcauguuugcuguucca

SEQ ID NO: 1165068 - RNA, 20 nt, Homo sapiens
acugccauauacucuucaag

SEQ ID NO: 1165069 - RNA, 13 nt, Homo sapiens
acugccauugucu

SEQ ID NO: 1165070 - RNA, 15 nt, Homo sapiens
acugccgacaucccu

SEQ ID NO: 1165071 - RNA, 16 nt, Homo sapiens
acugccuccuugccag

SEQ ID NO: 1165072 - RNA, 22 nt, Homo sapiens
acugcgcccagcuauacuguau

SEQ ID NO: 1165073 - RNA, 14 nt, Homo sapiens
acugcgcgcggggc

SEQ ID NO: 1165074 - RNA, 17 nt, Homo sapiens
acugcguccugccuaaa

SEQ ID NO: 1165075 - RNA, 18 nt, Homo sapiens
acugcucuguguuuacag

SEQ ID NO: 1165076 - RNA, 18 nt, Homo sapiens
acugcugagauacauaca

SEQ ID NO: 1165077 - RNA, 14 nt, Homo sapiens
acugcuguguaaug

SEQ ID NO: 1165078 - RNA, 18 nt, Homo sapiens
acugcuuaauucaaauaa

SEQ ID NO: 1165079 - RNA, 16 nt, Homo sapiens
acugcuugaccaaaga

SEQ ID NO: 1165080 - RNA, 22 nt, Homo sapiens
acugcuugcuuacaaucuuuau

SEQ ID NO: 1165081 - RNA, 19 nt, Homo sapiens
acugcuuuaaacugcauuu

SEQ ID NO: 1165082 - RNA, 23 nt, Homo sapiens
acuggaaaggaaagaugaugcuc

SEQ ID NO: 1165083 - RNA, 19 nt, Homo sapiens
acuggaacaugcuuuuacu

SEQ ID NO: 1165084 - RNA, 17 nt, Homo sapiens
acuggaaccaccuggac

SEQ ID NO: 1165085 - RNA, 18 nt, Homo sapiens
acuggaggggucauccuu

SEQ ID NO: 1165086 - RNA, 22 nt, Homo sapiens
acuggcagggacgaggacaaau

SEQ ID NO: 1165087 - RNA, 16 nt, Homo sapiens
acuggcagucgcacac

SEQ ID NO: 1165088 - RNA, 17 nt, Homo sapiens
acuggcauuuuuagcuc

SEQ ID NO: 1165089 - RNA, 15 nt, Homo sapiens
acuggccacccaagg

SEQ ID NO: 1165090 - RNA, 22 nt, Homo sapiens
acuggccagggccacgcuccag

SEQ ID NO: 1165091 - RNA, 19 nt, Homo sapiens
acuggccccugagaucucu

SEQ ID NO: 1165092 - RNA, 17 nt, Homo sapiens
acuggcgccuucucgga

SEQ ID NO: 1165093 - RNA, 17 nt, Homo sapiens
acuggcugucaguauga

SEQ ID NO: 1165094 - RNA, 19 nt, Homo sapiens
acuggcugugugaccuuag

SEQ ID NO: 1165095 - RNA, 16 nt, Homo sapiens
acuggcuucacauucu

SEQ ID NO: 1165096 - RNA, 19 nt, Homo sapiens
acuggcuucucuugaguca

SEQ ID NO: 1165097 - RNA, 22 nt, Homo sapiens
acugggacagcccaggaaacaa

SEQ ID NO: 1165098 - RNA, 23 nt, Homo sapiens
acuggggccuccagaacucacug

SEQ ID NO: 1165099 - RNA, 21 nt, Homo sapiens
acugggguguggagacuugaa

SEQ ID NO: 1165100 - RNA, 23 nt, Homo sapiens
acugguauguguggaugaugcug

SEQ ID NO: 1165101 - RNA, 23 nt, Homo sapiens
acuggucagggcaaaccugccuc

SEQ ID NO: 1165102 - RNA, 17 nt, Homo sapiens
acuggugcacuuuguaa

SEQ ID NO: 1165103 - RNA, 19 nt, Homo sapiens
acugguucauucuacguau

SEQ ID NO: 1165104 - RNA, 13 nt, Homo sapiens
acuguaaagcaaa

SEQ ID NO: 1165105 - RNA, 18 nt, Homo sapiens
acuguaaaggcaagccag

SEQ ID NO: 1165106 - RNA, 23 nt, Homo sapiens
acuguacuuguagaguggugcug

SEQ ID NO: 1165107 - RNA, 23 nt, Homo sapiens
acuguagaagaagugaacacuua

SEQ ID NO: 1165108 - RNA, 17 nt, Homo sapiens
acuguauauacuuugcc

SEQ ID NO: 1165109 - RNA, 14 nt, Homo sapiens
acuguauuuuccaa

SEQ ID NO: 1165110 - RNA, 18 nt, Homo sapiens
acuguccaccaccaccug

SEQ ID NO: 1165111 - RNA, 13 nt, Homo sapiens
acugucuccaugg

SEQ ID NO: 1165112 - RNA, 23 nt, Homo sapiens
acugucucucuugucacauggaa

SEQ ID NO: 1165113 - RNA, 17 nt, Homo sapiens
acugugaagaucucacu

SEQ ID NO: 1165114 - RNA, 19 nt, Homo sapiens
acugugagcucccaggugc

SEQ ID NO: 1165115 - RNA, 17 nt, Homo sapiens
acugugccuacaggugc

SEQ ID NO: 1165116 - RNA, 14 nt, Homo sapiens
acugugcuuggcca

SEQ ID NO: 1165117 - RNA, 22 nt, Homo sapiens
acuguggcaaacaaaaccaauu

SEQ ID NO: 1165118 - RNA, 19 nt, Homo sapiens
acugugguaaaugccacac

SEQ ID NO: 1165119 - RNA, 18 nt, Homo sapiens
aguuaacucacugagggu

SEQ ID NO: 1165120 - RNA, 12 nt, Homo sapiens
aguuaagacaug

SEQ ID NO: 1165121 - RNA, 16 nt, Homo sapiens
aguuaagcaacaucua

SEQ ID NO: 1165122 - RNA, 16 nt, Homo sapiens
aguuaauccacuguga

SEQ ID NO: 1165123 - RNA, 18 nt, Homo sapiens
aguuaauuuaauuugcag

SEQ ID NO: 1165124 - RNA, 12 nt, Homo sapiens
aguuaauuugca

SEQ ID NO: 1165125 - RNA, 12 nt, Homo sapiens
aguuacaacaga

SEQ ID NO: 1165126 - RNA, 14 nt, Homo sapiens
aguuacacuggaag

SEQ ID NO: 1165127 - RNA, 14 nt, Homo sapiens
aguuacugaagucu

SEQ ID NO: 1165128 - RNA, 17 nt, Homo sapiens
aguuagcagacagaagu

SEQ ID NO: 1165129 - RNA, 20 nt, Homo sapiens
aguuaggcuauucacaacca

SEQ ID NO: 1165130 - RNA, 15 nt, Homo sapiens
aguuaucuaagaaua

SEQ ID NO: 1165131 - RNA, 15 nt, Homo sapiens
aguuaugacaagcuu

SEQ ID NO: 1165132 - RNA, 20 nt, Homo sapiens
aguuauuacugucucuggca

SEQ ID NO: 1165133 - RNA, 18 nt, Homo sapiens
aguuauucauauucuguu

SEQ ID NO: 1165134 - RNA, 12 nt, Homo sapiens
aguucacaucag

SEQ ID NO: 1165135 - RNA, 17 nt, Homo sapiens
aguucaccugcacuuaa

SEQ ID NO: 1165136 - RNA, 23 nt, Homo sapiens
aguucagcugccccacaggugug

SEQ ID NO: 1165137 - RNA, 12 nt, Homo sapiens
aguucaguuugu

SEQ ID NO: 1165138 - RNA, 16 nt, Homo sapiens
aguucauaaacaacag

SEQ ID NO: 1165139 - RNA, 23 nt, Homo sapiens
aguucauccccugugaaucagag

SEQ ID NO: 1165140 - RNA, 15 nt, Homo sapiens
aguucauucaugcca

SEQ ID NO: 1165141 - RNA, 23 nt, Homo sapiens
caccuuucauaaucuuugcuuua

SEQ ID NO: 1165142 - RNA, 20 nt, Homo sapiens
caccuuuucccuuucauguu

SEQ ID NO: 1165143 - RNA, 13 nt, Homo sapiens
cacgaaagcacac

SEQ ID NO: 1165144 - RNA, 19 nt, Homo sapiens
cacgaagcacgaucagucc

SEQ ID NO: 1165145 - RNA, 18 nt, Homo sapiens
cacgagaaacauccugcc

SEQ ID NO: 1165146 - RNA, 14 nt, Homo sapiens
cacgcacugcacug

SEQ ID NO: 1165147 - RNA, 14 nt, Homo sapiens
cacgccugccaucu

SEQ ID NO: 1165148 - RNA, 22 nt, Homo sapiens
cacgccuguaaucccagcacuu

SEQ ID NO: 1165149 - RNA, 18 nt, Homo sapiens
cacggaugacuuaacugc

SEQ ID NO: 1165150 - RNA, 18 nt, Homo sapiens
cacgucacguguaguguc

SEQ ID NO: 1165151 - RNA, 22 nt, Homo sapiens
cacguccuuuuuuccuuccuuc

SEQ ID NO: 1165152 - RNA, 17 nt, Homo sapiens
cacguuaugguguuucu

SEQ ID NO: 1165153 - RNA, 16 nt, Homo sapiens
cacuaacaaacucuga

SEQ ID NO: 1165154 - RNA, 19 nt, Homo sapiens
cacuaacccguuuuauucu

SEQ ID NO: 1165155 - RNA, 13 nt, Homo sapiens
cacuaagccauga

SEQ ID NO: 1165156 - RNA, 14 nt, Homo sapiens
cacuaauucugcau

SEQ ID NO: 1165157 - RNA, 17 nt, Homo sapiens
cacuacaccacacacaa

SEQ ID NO: 1165158 - RNA, 21 nt, Homo sapiens
cacuacaccacacacaacagc

SEQ ID NO: 1165159 - RNA, 17 nt, Homo sapiens
cacuaccguaaaugucc

SEQ ID NO: 1165160 - RNA, 21 nt, Homo sapiens
cacuaccugccaugcauacau

SEQ ID NO: 1165161 - RNA, 22 nt, Homo sapiens
cacuacucgagcccacccagca

SEQ ID NO: 1165162 - RNA, 22 nt, Homo sapiens
cacuaguuuaugcuaccuaguc

SEQ ID NO: 1165163 - RNA, 22 nt, Homo sapiens
cacuaucugggugcaugaucuu

SEQ ID NO: 1165164 - RNA, 23 nt, Homo sapiens
cacuauguguguuguuuccauag

SEQ ID NO: 1165165 - RNA, 20 nt, Homo sapiens
cacucagcucuuggcuccac

SEQ ID NO: 1165166 - RNA, 11 nt, Homo sapiens
cacucaggggu

SEQ ID NO: 1165167 - RNA, 21 nt, Homo sapiens
cacucaucuaaagucuaguga

SEQ ID NO: 1165168 - RNA, 14 nt, Homo sapiens
cacuccuccuagcc

SEQ ID NO: 1165169 - RNA, 23 nt, Homo sapiens
cacucggcuuuggagacuuucuu

SEQ ID NO: 1165170 - RNA, 13 nt, Homo sapiens
cacucuccuguga

SEQ ID NO: 1165171 - RNA, 22 nt, Homo sapiens
cacucucuaccagauaacugag

SEQ ID NO: 1165172 - RNA, 18 nt, Homo sapiens
cacucuucaaaugccuga

SEQ ID NO: 1165173 - RNA, 21 nt, Homo sapiens
cacucuucugaauugacugua

SEQ ID NO: 1165174 - RNA, 19 nt, Homo sapiens
cacucuuugaucagaaaca

SEQ ID NO: 1165175 - RNA, 16 nt, Homo sapiens
cacucuuuugcuuuau

SEQ ID NO: 1165176 - RNA, 22 nt, Homo sapiens
cacugaaaugcuagcugcaagu

SEQ ID NO: 1165177 - RNA, 13 nt, Homo sapiens
cacugaagcacca

SEQ ID NO: 1165178 - RNA, 16 nt, Homo sapiens
cacugaccugccugua

SEQ ID NO: 1165179 - RNA, 15 nt, Homo sapiens
cacugagaaagccaa

SEQ ID NO: 1165180 - RNA, 19 nt, Homo sapiens
cacugagaaagccaaugac

SEQ ID NO: 1165181 - RNA, 22 nt, Homo sapiens
cacugauauuuuuuauacagug

SEQ ID NO: 1165182 - RNA, 18 nt, Homo sapiens
cacugcaauccugucuuu

SEQ ID NO: 1165183 - RNA, 12 nt, Homo sapiens
cacugcacucca

SEQ ID NO: 1165184 - RNA, 16 nt, Homo sapiens
cacugcacuccaggcu

SEQ ID NO: 1165185 - RNA, 21 nt, Homo sapiens
cacugccagggguucuugagc

SEQ ID NO: 1165186 - RNA, 15 nt, Homo sapiens
cacugccauuaccca

SEQ ID NO: 1165187 - RNA, 14 nt, Homo sapiens
cacugcccuucuca

SEQ ID NO: 1165188 - RNA, 16 nt, Homo sapiens
cacugccuuugucuua

SEQ ID NO: 1165189 - RNA, 18 nt, Homo sapiens
cacugccuuugucuuacu

SEQ ID NO: 1165190 - RNA, 20 nt, Homo sapiens
cacugcgcccagcuauacug

SEQ ID NO: 1165191 - RNA, 14 nt, Homo sapiens
cacuggaaaguuua

SEQ ID NO: 1165192 - RNA, 18 nt, Homo sapiens
cacuggaggggucuccuc

SEQ ID NO: 1165193 - RNA, 17 nt, Homo sapiens
cacuggcagacaucuag

SEQ ID NO: 1165194 - RNA, 22 nt, Homo sapiens
cacuggcagccugcaccuggug

SEQ ID NO: 1165195 - RNA, 17 nt, Homo sapiens
cacugggacccucagcc

SEQ ID NO: 1165196 - RNA, 21 nt, Homo sapiens
cacugggguuggaagugcaga

SEQ ID NO: 1165197 - RNA, 18 nt, Homo sapiens
cacugggugccaaguccu

SEQ ID NO: 1165198 - RNA, 16 nt, Homo sapiens
cacugguaacauguga

SEQ ID NO: 1165199 - RNA, 20 nt, Homo sapiens
cacuguacaagguaccccuu

SEQ ID NO: 1165200 - RNA, 23 nt, Homo sapiens
cacuguacuuguagaguggugcu

SEQ ID NO: 1165201 - RNA, 18 nt, Homo sapiens
cacuguauauuuugcaau

SEQ ID NO: 1165202 - RNA, 13 nt, Homo sapiens
cacugugacacac

SEQ ID NO: 1165203 - RNA, 23 nt, Homo sapiens
cacuguggagacuuucuguuacu

SEQ ID NO: 1165204 - RNA, 18 nt, Homo sapiens
cacugugguaaaugccac

SEQ ID NO: 1165205 - RNA, 21 nt, Homo sapiens
cacuguguuucugugcuccaa

SEQ ID NO: 1165206 - RNA, 15 nt, Homo sapiens
cacuguuacagagau

SEQ ID NO: 1165207 - RNA, 12 nt, Homo sapiens
cacuguugcuua

SEQ ID NO: 1165208 - RNA, 14 nt, Homo sapiens
cacuguuugucuca

SEQ ID NO: 1165209 - RNA, 19 nt, Homo sapiens
cacuguuugucucaccuac

SEQ ID NO: 1165210 - RNA, 12 nt, Homo sapiens
cacuuaccuuau

SEQ ID NO: 1165211 - RNA, 23 nt, Homo sapiens
cacuuaguauugcagccaaagaa

SEQ ID NO: 1165212 - RNA, 20 nt, Homo sapiens
cacuuauacccaugaacuua

SEQ ID NO: 1165213 - RNA, 14 nt, Homo sapiens
cacuuaugauuuca

SEQ ID NO: 1165214 - RNA, 14 nt, Homo sapiens
cacuucaccaagga

SEQ ID NO: 1165215 - RNA, 16 nt, Homo sapiens
cacuuccaagagccuu

SEQ ID NO: 1165216 - RNA, 21 nt, Homo sapiens
cacuuccauaugucauugcua

SEQ ID NO: 1165217 - RNA, 12 nt, Homo sapiens
cacuucucagga

SEQ ID NO: 1165218 - RNA, 13 nt, Homo sapiens
cacuucucaggaa

SEQ ID NO: 1165219 - RNA, 12 nt, Homo sapiens
cacuucuuccau

SEQ ID NO: 1165220 - RNA, 20 nt, Homo sapiens
cacuucuuugcagagccuuu

SEQ ID NO: 1165221 - RNA, 14 nt, Homo sapiens
cacuugaaccuggg

SEQ ID NO: 1165222 - RNA, 18 nt, Homo sapiens
cacuugaauccauugaaa

SEQ ID NO: 1165223 - RNA, 13 nt, Homo sapiens
cacuugcucaaaa

SEQ ID NO: 1165224 - RNA, 22 nt, Homo sapiens
cacuuguuguugaacauggcua

SEQ ID NO: 1165225 - RNA, 15 nt, Homo sapiens
cacuuuauugcaaug

SEQ ID NO: 1165226 - RNA, 13 nt, Homo sapiens
cacuuucuggaac

SEQ ID NO: 1165227 - RNA, 17 nt, Homo sapiens
cagaaaaaaaaauggaa

SEQ ID NO: 1165228 - RNA, 14 nt, Homo sapiens
cagaaaaccacuuu

SEQ ID NO: 1165229 - RNA, 21 nt, Homo sapiens
cagaaaauaaucugguguucu

SEQ ID NO: 1165230 - RNA, 14 nt, Homo sapiens
cagaaacacugccu

SEQ ID NO: 1165231 - RNA, 19 nt, Homo sapiens
cagaaacagugcaaggaag

SEQ ID NO: 1165232 - RNA, 13 nt, Homo sapiens
cagaaacugaugc

SEQ ID NO: 1165233 - RNA, 15 nt, Homo sapiens
cagaaacugaugcca

SEQ ID NO: 1165234 - RNA, 19 nt, Homo sapiens
cagaaaguaagcauuucca

SEQ ID NO: 1165235 - RNA, 15 nt, Homo sapiens
cagaaauacaguaug

SEQ ID NO: 1165236 - RNA, 13 nt, Homo sapiens
cagaaaugcacau

SEQ ID NO: 1165237 - RNA, 22 nt, Homo sapiens
cagaaauguuugcugagugagu

SEQ ID NO: 1165238 - RNA, 18 nt, Homo sapiens
cagaaauuaaucuuacaa

SEQ ID NO: 1165239 - RNA, 14 nt, Homo sapiens
cagaacacaaugcu

SEQ ID NO: 1165240 - RNA, 12 nt, Homo sapiens
cagaaccaaagc

SEQ ID NO: 1165241 - RNA, 16 nt, Homo sapiens
cagaaccaaagcucaa

SEQ ID NO: 1165242 - RNA, 20 nt, Homo sapiens
cagaacugcuaccuuccuag

SEQ ID NO: 1165243 - RNA, 22 nt, Homo sapiens
cagaacugucggaggaaagaca

SEQ ID NO: 1165244 - RNA, 19 nt, Homo sapiens
cagaacuucagcauuguaa

SEQ ID NO: 1165245 - RNA, 18 nt, Homo sapiens
cagaacuucaggugugac

SEQ ID NO: 1165246 - RNA, 14 nt, Homo sapiens
cagaagcauuucac

SEQ ID NO: 1165247 - RNA, 15 nt, Homo sapiens
cagaagcauuucacc

SEQ ID NO: 1165248 - RNA, 23 nt, Homo sapiens
cagaaggacaggucucugagaca

SEQ ID NO: 1165249 - RNA, 20 nt, Homo sapiens
cagaaguuaaaccaugugac

SEQ ID NO: 1165250 - RNA, 16 nt, Homo sapiens
cagaauccacaguguc

SEQ ID NO: 1165251 - RNA, 21 nt, Homo sapiens
cagaaugaggcugcuuuccaa

SEQ ID NO: 1165252 - RNA, 12 nt, Homo sapiens
cagaauggagcu

SEQ ID NO: 1165253 - RNA, 13 nt, Homo sapiens
cagaauuacugua

SEQ ID NO: 1165254 - RNA, 22 nt, Homo sapiens
cagaauuaugauggaagacagg

SEQ ID NO: 1165255 - RNA, 20 nt, Homo sapiens
cagaauuccaccggugcaag

SEQ ID NO: 1165256 - RNA, 16 nt, Homo sapiens
cagaauugagagugau

SEQ ID NO: 1165257 - RNA, 22 nt, Homo sapiens
cagacaaauacuuagacaguau

SEQ ID NO: 1165258 - RNA, 15 nt, Homo sapiens
cagacaaauuacuga

SEQ ID NO: 1165259 - RNA, 15 nt, Homo sapiens
cagacaacacuggga

SEQ ID NO: 1165260 - RNA, 21 nt, Homo sapiens
cagacaacacugggaaacaga

SEQ ID NO: 1165261 - RNA, 13 nt, Homo sapiens
cagacaagcuuga

SEQ ID NO: 1165262 - RNA, 16 nt, Homo sapiens
cagacaagcuugaaua

SEQ ID NO: 1165263 - RNA, 15 nt, Homo sapiens
cagacacauucacac

SEQ ID NO: 1165264 - RNA, 19 nt, Homo sapiens
cagacacauugucaucaga

SEQ ID NO: 1165265 - RNA, 15 nt, Homo sapiens
cagacagaaguguag

SEQ ID NO: 1165266 - RNA, 13 nt, Homo sapiens
cagacaugccaca

SEQ ID NO: 1165267 - RNA, 16 nt, Homo sapiens
cagacaugguggcaug

SEQ ID NO: 1165268 - RNA, 22 nt, Homo sapiens
agaagauaugugaagaaaaaug

SEQ ID NO: 1165269 - RNA, 14 nt, Homo sapiens
agaagaugcucugg

SEQ ID NO: 1165270 - RNA, 20 nt, Homo sapiens
agaagauucaaucacuguau

SEQ ID NO: 1165271 - RNA, 21 nt, Homo sapiens
agaagcaaugggucuuagcuc

SEQ ID NO: 1165272 - RNA, 17 nt, Homo sapiens
agaagcacccuaaugca

SEQ ID NO: 1165273 - RNA, 14 nt, Homo sapiens
agaagcaugaaguc

SEQ ID NO: 1165274 - RNA, 16 nt, Homo sapiens
agaagccagagggugg

SEQ ID NO: 1165275 - RNA, 16 nt, Homo sapiens
agaagcccuguucucg

SEQ ID NO: 1165276 - RNA, 23 nt, Homo sapiens
agaagccucugggucaguggucc

SEQ ID NO: 1165277 - RNA, 15 nt, Homo sapiens
agaagcuaauaugau

SEQ ID NO: 1165278 - RNA, 14 nt, Homo sapiens
agaaggaguguaug

SEQ ID NO: 1165279 - RNA, 15 nt, Homo sapiens
agaaggaguguauga

SEQ ID NO: 1165280 - RNA, 15 nt, Homo sapiens
agaagguuaccaaga

SEQ ID NO: 1165281 - RNA, 21 nt, Homo sapiens
agaagguuggugaauuucaca

SEQ ID NO: 1165282 - RNA, 20 nt, Homo sapiens
agaaguaacucccacuccua

SEQ ID NO: 1165283 - RNA, 13 nt, Homo sapiens
agaaguacuuugu

SEQ ID NO: 1165284 - RNA, 12 nt, Homo sapiens
agaagucucuua

SEQ ID NO: 1165285 - RNA, 23 nt, Homo sapiens
agaaguucacaucagaacagaca

SEQ ID NO: 1165286 - RNA, 20 nt, Homo sapiens
agaaguuggucuuacuuugu

SEQ ID NO: 1165287 - RNA, 17 nt, Homo sapiens
agaauacaaugggaaaa

SEQ ID NO: 1165288 - RNA, 17 nt, Homo sapiens
agaauauaccauuucaa

SEQ ID NO: 1165289 - RNA, 13 nt, Homo sapiens
agaauaugugauc

SEQ ID NO: 1165290 - RNA, 17 nt, Homo sapiens
agaaucagaucauuuca

SEQ ID NO: 1165291 - RNA, 18 nt, Homo sapiens
agaaucccucuacaugga

SEQ ID NO: 1165292 - RNA, 21 nt, Homo sapiens
agaauccugggcccccagaga

SEQ ID NO: 1165293 - RNA, 19 nt, Homo sapiens
agaaugaaauguaugugcu

SEQ ID NO: 1165294 - RNA, 21 nt, Homo sapiens
agaaugcaucucaucaacuua

SEQ ID NO: 1165295 - RNA, 22 nt, Homo sapiens
agaaugcugcaggacuugagaa

SEQ ID NO: 1165296 - RNA, 12 nt, Homo sapiens
agaauggagcug

SEQ ID NO: 1165297 - RNA, 20 nt, Homo sapiens
agaaugggggcuuucgggga

SEQ ID NO: 1165298 - RNA, 18 nt, Homo sapiens
agaaugguugaguuacau

SEQ ID NO: 1165299 - RNA, 21 nt, Homo sapiens
agaaugguugaguuacauuaa

SEQ ID NO: 1165300 - RNA, 16 nt, Homo sapiens
agaauguacuugauau

SEQ ID NO: 1165301 - RNA, 14 nt, Homo sapiens
agaaugucucgguc

SEQ ID NO: 1165302 - RNA, 21 nt, Homo sapiens
agaaugucucggucacaucag

SEQ ID NO: 1165303 - RNA, 11 nt, Homo sapiens
agaaugugauu

SEQ ID NO: 1165304 - RNA, 19 nt, Homo sapiens
agaauguuaaaaagugaaa

SEQ ID NO: 1165305 - RNA, 20 nt, Homo sapiens
agaauuagaaacaacauagc

SEQ ID NO: 1165306 - RNA, 22 nt, Homo sapiens
agaauuagaaacaacauagcaa

SEQ ID NO: 1165307 - RNA, 22 nt, Homo sapiens
agaauuauaucacuucacuguu

SEQ ID NO: 1165308 - RNA, 16 nt, Homo sapiens
agaauucaauuugaac

SEQ ID NO: 1165309 - RNA, 12 nt, Homo sapiens
agaauucacaau

SEQ ID NO: 1165310 - RNA, 23 nt, Homo sapiens
agaauucagaagaccccugacuc

SEQ ID NO: 1165311 - RNA, 23 nt, Homo sapiens
agaauucauucacucaacaaaca

SEQ ID NO: 1165312 - RNA, 14 nt, Homo sapiens
agaauucucuugcu

SEQ ID NO: 1165313 - RNA, 15 nt, Homo sapiens
agaauucuuacaugu

SEQ ID NO: 1165314 - RNA, 22 nt, Homo sapiens
agaauugaauuuacauauagcu

SEQ ID NO: 1165315 - RNA, 23 nt, Homo sapiens
agaauuggaaaucugucuuguca

SEQ ID NO: 1165316 - RNA, 17 nt, Homo sapiens
agaauuuaagcuguaaa

SEQ ID NO: 1165317 - RNA, 15 nt, Homo sapiens
agaauuucacaagcu

SEQ ID NO: 1165318 - RNA, 12 nt, Homo sapiens
agaauuugcaca

SEQ ID NO: 1165319 - RNA, 15 nt, Homo sapiens
agaauuuugcacagu

SEQ ID NO: 1165320 - RNA, 22 nt, Homo sapiens
agaauuuuuacuuagauacuaa

SEQ ID NO: 1165321 - RNA, 23 nt, Homo sapiens
agacaaacuccugaaaugccaag

SEQ ID NO: 1165322 - RNA, 13 nt, Homo sapiens
agacaaauacuua

SEQ ID NO: 1165323 - RNA, 16 nt, Homo sapiens
agacaagacauugugu

SEQ ID NO: 1165324 - RNA, 16 nt, Homo sapiens
agacaagcugcauuuc

SEQ ID NO: 1165325 - RNA, 18 nt, Homo sapiens
agacaaguaaucacuaac

SEQ ID NO: 1165326 - RNA, 14 nt, Homo sapiens
agacaauaugugag

SEQ ID NO: 1165327 - RNA, 17 nt, Homo sapiens
agacaaucacugaaaca

SEQ ID NO: 1165328 - RNA, 16 nt, Homo sapiens
agacaaucuagcacuu

SEQ ID NO: 1165329 - RNA, 12 nt, Homo sapiens
agacacagggaa

SEQ ID NO: 1165330 - RNA, 12 nt, Homo sapiens
agacacauucac

SEQ ID NO: 1165331 - RNA, 22 nt, Homo sapiens
agacacggagcccagcccuccc

SEQ ID NO: 1165332 - RNA, 16 nt, Homo sapiens
agacagaaaacauguu

SEQ ID NO: 1165333 - RNA, 18 nt, Homo sapiens
agacagacaacacuggga

SEQ ID NO: 1165334 - RNA, 16 nt, Homo sapiens
agacagacauacauag

SEQ ID NO: 1165335 - RNA, 11 nt, Homo sapiens
agacagcugcu

SEQ ID NO: 1165336 - RNA, 15 nt, Homo sapiens
agacagcuuacugca

SEQ ID NO: 1165337 - RNA, 22 nt, Homo sapiens
agacagcuuacugcagcacugu

SEQ ID NO: 1165338 - RNA, 15 nt, Homo sapiens
agacaggaagaccaa

SEQ ID NO: 1165339 - RNA, 16 nt, Homo sapiens
agacaggacaggugug

SEQ ID NO: 1165340 - RNA, 19 nt, Homo sapiens
agacaggagaaacacuuga

SEQ ID NO: 1165341 - RNA, 18 nt, Homo sapiens
agacaggaggauugccug

SEQ ID NO: 1165342 - RNA, 19 nt, Homo sapiens
agacaggaggucagcacaa

SEQ ID NO: 1165343 - RNA, 19 nt, Homo sapiens
agacaggccccgugaggca

SEQ ID NO: 1165344 - RNA, 16 nt, Homo sapiens
agacagggucuugcua

SEQ ID NO: 1165345 - RNA, 15 nt, Homo sapiens
agacagugcacauga

SEQ ID NO: 1165346 - RNA, 15 nt, Homo sapiens
agacagugggaaaua

SEQ ID NO: 1165347 - RNA, 20 nt, Homo sapiens
agacaguuuaccauccucaa

SEQ ID NO: 1165348 - RNA, 20 nt, Homo sapiens
agacaguuuacuuugccaac

SEQ ID NO: 1165349 - RNA, 13 nt, Homo sapiens
agacauacauuuc

SEQ ID NO: 1165350 - RNA, 15 nt, Homo sapiens
agacauacauuucuc

SEQ ID NO: 1165351 - RNA, 21 nt, Homo sapiens
agacauacuugaagggccaga

SEQ ID NO: 1165352 - RNA, 22 nt, Homo sapiens
agacauagcauccaaguggcau

SEQ ID NO: 1165353 - RNA, 22 nt, Homo sapiens
agacauccauaaagaagcaaua

SEQ ID NO: 1165354 - RNA, 17 nt, Homo sapiens
agacaugauuuccuuga

SEQ ID NO: 1165355 - RNA, 18 nt, Homo sapiens
agacucuuuaugcuugca

SEQ ID NO: 1165356 - RNA, 15 nt, Homo sapiens
agacugaaaagccau

SEQ ID NO: 1165357 - RNA, 21 nt, Homo sapiens
agacugcccagcuaaagcaau

SEQ ID NO: 1165358 - RNA, 14 nt, Homo sapiens
agacugcccugggu

SEQ ID NO: 1165359 - RNA, 17 nt, Homo sapiens
agacugcuacagugcau

SEQ ID NO: 1165360 - RNA, 22 nt, Homo sapiens
agacuggagaaaugcuuacuuc

SEQ ID NO: 1165361 - RNA, 19 nt, Homo sapiens
agacuggccuaggggccag

SEQ ID NO: 1165362 - RNA, 14 nt, Homo sapiens
agacuguugugcuc

SEQ ID NO: 1165363 - RNA, 13 nt, Homo sapiens
agacuucuuggcu

SEQ ID NO: 1165364 - RNA, 15 nt, Homo sapiens
agacuugacagugga

SEQ ID NO: 1165365 - RNA, 16 nt, Homo sapiens
agacuuuaucaugugu

SEQ ID NO: 1165366 - RNA, 13 nt, Homo sapiens
agagaaaauaauu

SEQ ID NO: 1165367 - RNA, 22 nt, Homo sapiens
agagaaacuuugaguacagaua

SEQ ID NO: 1165368 - RNA, 17 nt, Homo sapiens
agagaaagggacaauga

SEQ ID NO: 1165369 - RNA, 18 nt, Homo sapiens
agagaaaggucuaugcag

SEQ ID NO: 1165370 - RNA, 13 nt, Homo sapiens
agagaaaguguga

SEQ ID NO: 1165371 - RNA, 16 nt, Homo sapiens
agagaaaguuggugcu

SEQ ID NO: 1165372 - RNA, 17 nt, Homo sapiens
agagaaggaggggagca

SEQ ID NO: 1165373 - RNA, 16 nt, Homo sapiens
agagaaggugaaggua

SEQ ID NO: 1165374 - RNA, 19 nt, Homo sapiens
agagaagguggaccuggca

SEQ ID NO: 1165375 - RNA, 17 nt, Homo sapiens
agagaaguugacaugga

SEQ ID NO: 1165376 - RNA, 23 nt, Homo sapiens
agagaauaaguggcuugucugca

SEQ ID NO: 1165377 - RNA, 17 nt, Homo sapiens
agagaaucaacauuucu

SEQ ID NO: 1165378 - RNA, 14 nt, Homo sapiens
agagacaaaaucuc

SEQ ID NO: 1165379 - RNA, 13 nt, Homo sapiens
agagacaccugca

SEQ ID NO: 1165380 - RNA, 22 nt, Homo sapiens
agagacagaggaucaagggcuu

SEQ ID NO: 1165381 - RNA, 21 nt, Homo sapiens
agagacagcuugaucaaaggc

SEQ ID NO: 1165382 - RNA, 11 nt, Homo sapiens
agagacagggu

SEQ ID NO: 1165383 - RNA, 16 nt, Homo sapiens
agagacaguaacacaa

SEQ ID NO: 1165384 - RNA, 20 nt, Homo sapiens
agagacccgagggcugcuuu

SEQ ID NO: 1165385 - RNA, 12 nt, Homo sapiens
agagaccucaaa

SEQ ID NO: 1165386 - RNA, 20 nt, Homo sapiens
agagaccugccagauuauca

SEQ ID NO: 1165387 - RNA, 19 nt, Homo sapiens
agagacgguguuuugccau

SEQ ID NO: 1165388 - RNA, 15 nt, Homo sapiens
agagaggcucugaga

SEQ ID NO: 1165389 - RNA, 16 nt, Homo sapiens
agagagguuuuucuga

SEQ ID NO: 1165390 - RNA, 19 nt, Homo sapiens
agagauauugugaggacaa

SEQ ID NO: 1165391 - RNA, 13 nt, Homo sapiens
agagauccaaaga

SEQ ID NO: 1165392 - RNA, 14 nt, Homo sapiens
agagauccaaagac

SEQ ID NO: 1165393 - RNA, 17 nt, Homo sapiens
agagaucccaaguagaa

SEQ ID NO: 1165394 - RNA, 17 nt, Homo sapiens
agagauuagaauaucug

SEQ ID NO: 1165395 - RNA, 16 nt, Homo sapiens
agagauugauggguua

SEQ ID NO: 1165396 - RNA, 20 nt, Homo sapiens
agagcaaaacuccgucucaa

SEQ ID NO: 1165397 - RNA, 19 nt, Homo sapiens
agagcaagacccaucucaa

SEQ ID NO: 1165398 - RNA, 20 nt, Homo sapiens
agagcaagacucugucucaa

SEQ ID NO: 1165399 - RNA, 13 nt, Homo sapiens
agagcagcacagg

SEQ ID NO: 1165400 - RNA, 13 nt, Homo sapiens
agagcagcugcca

SEQ ID NO: 1165401 - RNA, 16 nt, Homo sapiens
agagcaggacugcaca

SEQ ID NO: 1165402 - RNA, 14 nt, Homo sapiens
agagcagugcacau

SEQ ID NO: 1165403 - RNA, 16 nt, Homo sapiens
agagcaucccacagga

SEQ ID NO: 1165404 - RNA, 13 nt, Homo sapiens
agagcccagcucc

SEQ ID NO: 1165405 - RNA, 15 nt, Homo sapiens
agagccucacaguua

SEQ ID NO: 1165406 - RNA, 14 nt, Homo sapiens
agagcucugaccca

SEQ ID NO: 1165407 - RNA, 21 nt, Homo sapiens
agagcugagggcccuguggag

SEQ ID NO: 1165408 - RNA, 17 nt, Homo sapiens
agaggaacuucugaacu

SEQ ID NO: 1165409 - RNA, 21 nt, Homo sapiens
agaggagcccagcggcccaag

SEQ ID NO: 1165410 - RNA, 14 nt, Homo sapiens
agaggagugugaag

SEQ ID NO: 1165411 - RNA, 22 nt, Homo sapiens
agaggccgcgcguccagcugcc

SEQ ID NO: 1165412 - RNA, 21 nt, Homo sapiens
agaggccuuggccaagcugcu

SEQ ID NO: 1165413 - RNA, 19 nt, Homo sapiens
agaggcugaggcuggcaca

SEQ ID NO: 1165414 - RNA, 18 nt, Homo sapiens
agaggcuggaguugucac

SEQ ID NO: 1165415 - RNA, 21 nt, Homo sapiens
agagggaccaaauugcuucua

SEQ ID NO: 1165416 - RNA, 24 nt, Homo sapiens
agagggaugggagagucaagggaa

SEQ ID NO: 1165417 - RNA, 23 nt, Homo sapiens
agagggguggaguuuuaacugua

SEQ ID NO: 1165418 - RNA, 13 nt, Homo sapiens
agaggguacuuua

SEQ ID NO: 1165419 - RNA, 17 nt, Homo sapiens
agaggguguccugcacc

SEQ ID NO: 1165420 - RNA, 16 nt, Homo sapiens
agagguaaaaaaaaga

SEQ ID NO: 1165421 - RNA, 18 nt, Homo sapiens
agaggucccucagcugcg

SEQ ID NO: 1165422 - RNA, 22 nt, Homo sapiens
agagguguuuuuauaauaucca

SEQ ID NO: 1165423 - RNA, 14 nt, Homo sapiens
agagguugcaguga

SEQ ID NO: 1165424 - RNA, 19 nt, Homo sapiens
agagguugcagugagccaa

SEQ ID NO: 1165425 - RNA, 12 nt, Homo sapiens
agaguaaccuau

SEQ ID NO: 1165426 - RNA, 11 nt, Homo sapiens
agaguacaaac

SEQ ID NO: 1165427 - RNA, 19 nt, Homo sapiens
agaguacaccccaacagca

SEQ ID NO: 1165428 - RNA, 20 nt, Homo sapiens
agaguacaccccaacagcac

SEQ ID NO: 1165429 - RNA, 19 nt, Homo sapiens
agaguacugucccaggaau

SEQ ID NO: 1165430 - RNA, 22 nt, Homo sapiens
agaguauuaaugaaaagcacaa

SEQ ID NO: 1165431 - RNA, 14 nt, Homo sapiens
agaguccucugaau

SEQ ID NO: 1165432 - RNA, 22 nt, Homo sapiens
agagucuaauagucuuugccag

SEQ ID NO: 1165433 - RNA, 14 nt, Homo sapiens
agagucugugcugg

SEQ ID NO: 1165434 - RNA, 19 nt, Homo sapiens
agagugagacccugucuca

SEQ ID NO: 1165435 - RNA, 20 nt, Homo sapiens
agagugagacuccaucucaa

SEQ ID NO: 1165436 - RNA, 20 nt, Homo sapiens
agagugagacucccucucaa

SEQ ID NO: 1165437 - RNA, 14 nt, Homo sapiens
agagugagguggaa

SEQ ID NO: 1165438 - RNA, 22 nt, Homo sapiens
agagugcaagccccugcuccag

SEQ ID NO: 1165439 - RNA, 20 nt, Homo sapiens
cacacaguuugagacuccaa

SEQ ID NO: 1165440 - RNA, 16 nt, Homo sapiens
cacacaucaccaggug

SEQ ID NO: 1165441 - RNA, 12 nt, Homo sapiens
cacacaugcaua

SEQ ID NO: 1165442 - RNA, 15 nt, Homo sapiens
cacacccauguguac

SEQ ID NO: 1165443 - RNA, 13 nt, Homo sapiens
cacacccuaccuu

SEQ ID NO: 1165444 - RNA, 14 nt, Homo sapiens
cacacccuaccuuc

SEQ ID NO: 1165445 - RNA, 21 nt, Homo sapiens
cacaccuggcccuugcaaucu

SEQ ID NO: 1165446 - RNA, 15 nt, Homo sapiens
cacaccuuagugcua

SEQ ID NO: 1165447 - RNA, 21 nt, Homo sapiens
cacacgccucccacugggguc

SEQ ID NO: 1165448 - RNA, 23 nt, Homo sapiens
cacacguuuaaucccagcacuuu

SEQ ID NO: 1165449 - RNA, 16 nt, Homo sapiens
cacacuccaagauaug

SEQ ID NO: 1165450 - RNA, 22 nt, Homo sapiens
cacacucuccugugaacacugg

SEQ ID NO: 1165451 - RNA, 14 nt, Homo sapiens
cacacucuggucuu

SEQ ID NO: 1165452 - RNA, 18 nt, Homo sapiens
cacacugagacuugaauc

SEQ ID NO: 1165453 - RNA, 14 nt, Homo sapiens
cacacugcuagcaa

SEQ ID NO: 1165454 - RNA, 18 nt, Homo sapiens
cacacuggcugguggaga

SEQ ID NO: 1165455 - RNA, 12 nt, Homo sapiens
cacacuuugcca

SEQ ID NO: 1165456 - RNA, 15 nt, Homo sapiens
cacagaaacacugcc

SEQ ID NO: 1165457 - RNA, 16 nt, Homo sapiens
cacagaagcacaugca

SEQ ID NO: 1165458 - RNA, 19 nt, Homo sapiens
cacagaaggaauaagguca

SEQ ID NO: 1165459 - RNA, 14 nt, Homo sapiens
cacagaagggugug

SEQ ID NO: 1165460 - RNA, 15 nt, Homo sapiens
cacagaaguccugua

SEQ ID NO: 1165461 - RNA, 19 nt, Homo sapiens
cacagaauauguauguaua

SEQ ID NO: 1165462 - RNA, 12 nt, Homo sapiens
cacagaauguga

SEQ ID NO: 1165463 - RNA, 18 nt, Homo sapiens
cacagaauucacuuuaug

SEQ ID NO: 1165464 - RNA, 19 nt, Homo sapiens
cacagaauucauucacuca

SEQ ID NO: 1165465 - RNA, 22 nt, Homo sapiens
cacagacagguuuucacauaaa

SEQ ID NO: 1165466 - RNA, 17 nt, Homo sapiens
cacagacccacagaagg

SEQ ID NO: 1165467 - RNA, 17 nt, Homo sapiens
cacagagcuacauggug

SEQ ID NO: 1165468 - RNA, 14 nt, Homo sapiens
cacagagucaggau

SEQ ID NO: 1165469 - RNA, 16 nt, Homo sapiens
cacagaugaccaaagu

SEQ ID NO: 1165470 - RNA, 13 nt, Homo sapiens
cacagauuuacuc

SEQ ID NO: 1165471 - RNA, 18 nt, Homo sapiens
cacagauuuguccaggcu

SEQ ID NO: 1165472 - RNA, 15 nt, Homo sapiens
cacagcacuaauuca

SEQ ID NO: 1165473 - RNA, 14 nt, Homo sapiens
cacagcagcaauug

SEQ ID NO: 1165474 - RNA, 14 nt, Homo sapiens
cacagcaucuguag

SEQ ID NO: 1165475 - RNA, 11 nt, Homo sapiens
cacagcauuua

SEQ ID NO: 1165476 - RNA, 19 nt, Homo sapiens
cacagccaccccugagauc

SEQ ID NO: 1165477 - RNA, 22 nt, Homo sapiens
cacagccccugcuuuuucccuu

SEQ ID NO: 1165478 - RNA, 17 nt, Homo sapiens
cacagccugucuuguca

SEQ ID NO: 1165479 - RNA, 14 nt, Homo sapiens
cacagcguccuguc

SEQ ID NO: 1165480 - RNA, 13 nt, Homo sapiens
cacagcugcauua

SEQ ID NO: 1165481 - RNA, 15 nt, Homo sapiens
cacagcugcauuaaa

SEQ ID NO: 1165482 - RNA, 13 nt, Homo sapiens
cacaggacaugcu

SEQ ID NO: 1165483 - RNA, 23 nt, Homo sapiens
cacaggagauuccagucuacuug

SEQ ID NO: 1165484 - RNA, 17 nt, Homo sapiens
cacaggcuccuguugua

SEQ ID NO: 1165485 - RNA, 17 nt, Homo sapiens
cacagggcaccugccac

SEQ ID NO: 1165486 - RNA, 20 nt, Homo sapiens
cacaggguaccaggauaaag

SEQ ID NO: 1165487 - RNA, 18 nt, Homo sapiens
cacagggugguggcacau

SEQ ID NO: 1165488 - RNA, 21 nt, Homo sapiens
cacaggucaggggugacacag

SEQ ID NO: 1165489 - RNA, 12 nt, Homo sapiens
cacaggugggag

SEQ ID NO: 1165490 - RNA, 24 nt, Homo sapiens
cacagguguguuucccaucccacu

SEQ ID NO: 1165491 - RNA, 15 nt, Homo sapiens
cacaguaagucauuu

SEQ ID NO: 1165492 - RNA, 16 nt, Homo sapiens
cacaguagucuugaug

SEQ ID NO: 1165493 - RNA, 17 nt, Homo sapiens
cacagucugacuucccc

SEQ ID NO: 1165494 - RNA, 15 nt, Homo sapiens
cacagucuuggcuca

SEQ ID NO: 1165495 - RNA, 16 nt, Homo sapiens
cacagugacacuggac

SEQ ID NO: 1165496 - RNA, 19 nt, Homo sapiens
cacagugaucgaugauuca

SEQ ID NO: 1165497 - RNA, 21 nt, Homo sapiens
cacaguggagagggcuacaaa

SEQ ID NO: 1165498 - RNA, 23 nt, Homo sapiens
cacaguucuuugggccagacaug

SEQ ID NO: 1165499 - RNA, 22 nt, Homo sapiens
cacaguuguuuguguaggaaca

SEQ ID NO: 1165500 - RNA, 11 nt, Homo sapiens
cacauaccugg

SEQ ID NO: 1165501 - RNA, 23 nt, Homo sapiens
cacauaguagguacccaauucaa

SEQ ID NO: 1165502 - RNA, 13 nt, Homo sapiens
cacauauggacuc

SEQ ID NO: 1165503 - RNA, 22 nt, Homo sapiens
cacauauggacucugcacauga

SEQ ID NO: 1165504 - RNA, 23 nt, Homo sapiens
cacaucacgaaggaaaacugcca

SEQ ID NO: 1165505 - RNA, 22 nt, Homo sapiens
cacaucuccuguggucucugac

SEQ ID NO: 1165506 - RNA, 15 nt, Homo sapiens
cacaucuuuccucaa

SEQ ID NO: 1165507 - RNA, 17 nt, Homo sapiens
cacaugaaaccuacaca

SEQ ID NO: 1165508 - RNA, 23 nt, Homo sapiens
cacaugaaucccacccacaugug

SEQ ID NO: 1165509 - RNA, 19 nt, Homo sapiens
cacaugaccacauagcaug

SEQ ID NO: 1165510 - RNA, 16 nt, Homo sapiens
cacaugccuugcaaug

SEQ ID NO: 1165511 - RNA, 19 nt, Homo sapiens
cacauggccuaugcacaua

SEQ ID NO: 1165512 - RNA, 20 nt, Homo sapiens
cacauggcggagaguuuuaa

SEQ ID NO: 1165513 - RNA, 17 nt, Homo sapiens
cacaugucaguaccuuc

SEQ ID NO: 1165514 - RNA, 17 nt, Homo sapiens
cacaugugacacauaug

SEQ ID NO: 1165515 - RNA, 18 nt, Homo sapiens
cacaugugacacauaugc

SEQ ID NO: 1165516 - RNA, 19 nt, Homo sapiens
cacaugugacacauaugca

SEQ ID NO: 1165517 - RNA, 19 nt, Homo sapiens
cacauucaugugggcauuu

SEQ ID NO: 1165518 - RNA, 20 nt, Homo sapiens
cacauuucaccccaggcuca

SEQ ID NO: 1165519 - RNA, 18 nt, Homo sapiens
cacauuuggaaugcacac

SEQ ID NO: 1165520 - RNA, 13 nt, Homo sapiens
caccaaaguucua

SEQ ID NO: 1165521 - RNA, 15 nt, Homo sapiens
caccaaaucaucucu

SEQ ID NO: 1165522 - RNA, 13 nt, Homo sapiens
caccaaaugaauu

SEQ ID NO: 1165523 - RNA, 24 nt, Homo sapiens
caccaacccuucauuuaacaagua

SEQ ID NO: 1165524 - RNA, 20 nt, Homo sapiens
caccaagcucuguccaauca

SEQ ID NO: 1165525 - RNA, 22 nt, Homo sapiens
caccaaggaaacgcuaccucuc

SEQ ID NO: 1165526 - RNA, 13 nt, Homo sapiens
caccacaaacugu

SEQ ID NO: 1165527 - RNA, 14 nt, Homo sapiens
caccacagagccuc

SEQ ID NO: 1165528 - RNA, 19 nt, Homo sapiens
caccacgagaaacauccug

SEQ ID NO: 1165529 - RNA, 14 nt, Homo sapiens
caccacugagcucu

SEQ ID NO: 1165530 - RNA, 16 nt, Homo sapiens
caccagacgaacagug

SEQ ID NO: 1165531 - RNA, 19 nt, Homo sapiens
caccagccagaggaugcau

SEQ ID NO: 1165532 - RNA, 16 nt, Homo sapiens
caccaggaucagccag

SEQ ID NO: 1165533 - RNA, 22 nt, Homo sapiens
caccaguaaucccagcuacuca

SEQ ID NO: 1165534 - RNA, 13 nt, Homo sapiens
caccaucaacuua

SEQ ID NO: 1165535 - RNA, 15 nt, Homo sapiens
caccaucaacuuaaa

SEQ ID NO: 1165536 - RNA, 16 nt, Homo sapiens
caccauccuauugcaa

SEQ ID NO: 1165537 - RNA, 21 nt, Homo sapiens
caccaugacccucuuccucau

SEQ ID NO: 1165538 - RNA, 19 nt, Homo sapiens
caccaugauggccaggcug

SEQ ID NO: 1165539 - RNA, 15 nt, Homo sapiens
caccauguuggccag

SEQ ID NO: 1165540 - RNA, 17 nt, Homo sapiens
cacccaaguauuuuaaa

SEQ ID NO: 1165541 - RNA, 21 nt, Homo sapiens
cacccaaguugaagacuuugu

SEQ ID NO: 1165542 - RNA, 17 nt, Homo sapiens
cacccacacacaucuau

SEQ ID NO: 1165543 - RNA, 16 nt, Homo sapiens
cacccacauaccuggc

SEQ ID NO: 1165544 - RNA, 19 nt, Homo sapiens
cacccacccuguggcucac

SEQ ID NO: 1165545 - RNA, 18 nt, Homo sapiens
cacccaggcuggagugca

SEQ ID NO: 1165546 - RNA, 22 nt, Homo sapiens
cacccagucuguugcugcucca

SEQ ID NO: 1165547 - RNA, 18 nt, Homo sapiens
cacccccucuguugcaca

SEQ ID NO: 1165548 - RNA, 20 nt, Homo sapiens
cacccucauucuacugaaaa

SEQ ID NO: 1165549 - RNA, 23 nt, Homo sapiens
caccgccuccccaccuccaggcu

SEQ ID NO: 1165550 - RNA, 21 nt, Homo sapiens
caccgcuccaaugccuacuga

SEQ ID NO: 1165551 - RNA, 12 nt, Homo sapiens
caccguucugug

SEQ ID NO: 1165552 - RNA, 17 nt, Homo sapiens
caccguucugugcacaa

SEQ ID NO: 1165553 - RNA, 22 nt, Homo sapiens
caccuaauccaggcagauccag

SEQ ID NO: 1165554 - RNA, 16 nt, Homo sapiens
caccuaccgaguucaa

SEQ ID NO: 1165555 - RNA, 18 nt, Homo sapiens
caccuauaaaacagguca

SEQ ID NO: 1165556 - RNA, 20 nt, Homo sapiens
caccuauuaccaguguuccc

SEQ ID NO: 1165557 - RNA, 13 nt, Homo sapiens
caccucacaacuc

SEQ ID NO: 1165558 - RNA, 12 nt, Homo sapiens
caccucacugaa

SEQ ID NO: 1165559 - RNA, 14 nt, Homo sapiens
caccucaugucauu

SEQ ID NO: 1165560 - RNA, 15 nt, Homo sapiens
caccucuccugugag

SEQ ID NO: 1165561 - RNA, 18 nt, Homo sapiens
caccucucuguaguuuau

SEQ ID NO: 1165562 - RNA, 19 nt, Homo sapiens
cagccagugaccugaggaa

SEQ ID NO: 1165563 - RNA, 20 nt, Homo sapiens
cagcccccaccccagcacag

SEQ ID NO: 1165564 - RNA, 16 nt, Homo sapiens
cagcccccacccggug

SEQ ID NO: 1165565 - RNA, 14 nt, Homo sapiens
cagccccuuuccaa

SEQ ID NO: 1165566 - RNA, 22 nt, Homo sapiens
cagcccggaggggacugguccc

SEQ ID NO: 1165567 - RNA, 19 nt, Homo sapiens
cagcccucagcaaugugcc

SEQ ID NO: 1165568 - RNA, 19 nt, Homo sapiens
cagccuagucuggacugcu

SEQ ID NO: 1165569 - RNA, 18 nt, Homo sapiens
cagccuccaguuguagca

SEQ ID NO: 1165570 - RNA, 20 nt, Homo sapiens
cagccuccccaccuucuuca

SEQ ID NO: 1165571 - RNA, 23 nt, Homo sapiens
cagccucccgaguagcugggauu

SEQ ID NO: 1165572 - RNA, 19 nt, Homo sapiens
cagccucccuaguagcugg

SEQ ID NO: 1165573 - RNA, 14 nt, Homo sapiens
cagccucccugaag

SEQ ID NO: 1165574 - RNA, 18 nt, Homo sapiens
cagccucccugaagccuu

SEQ ID NO: 1165575 - RNA, 16 nt, Homo sapiens
cagccucuuuguucca

SEQ ID NO: 1165576 - RNA, 21 nt, Homo sapiens
cagccugaccaacauggugaa

SEQ ID NO: 1165577 - RNA, 13 nt, Homo sapiens
cagccugccuuua

SEQ ID NO: 1165578 - RNA, 19 nt, Homo sapiens
cagccuggccaacauggca

SEQ ID NO: 1165579 - RNA, 22 nt, Homo sapiens
cagccugucucuccuuguugcc

SEQ ID NO: 1165580 - RNA, 23 nt, Homo sapiens
cagccugucucuccuuguugccc

SEQ ID NO: 1165581 - RNA, 16 nt, Homo sapiens
cagccuugccagagau

SEQ ID NO: 1165582 - RNA, 17 nt, Homo sapiens
cagcgaaaggauguaaa

SEQ ID NO: 1165583 - RNA, 13 nt, Homo sapiens
cagcgaccacugc

SEQ ID NO: 1165584 - RNA, 13 nt, Homo sapiens
cagcgagaaggag

SEQ ID NO: 1165585 - RNA, 17 nt, Homo sapiens
cagcgauguaugcagcu

SEQ ID NO: 1165586 - RNA, 17 nt, Homo sapiens
cagcggcuccaacuccu

SEQ ID NO: 1165587 - RNA, 20 nt, Homo sapiens
cagcgugcuggcgacacuca

SEQ ID NO: 1165588 - RNA, 21 nt, Homo sapiens
cagcguggucugucauccugc

SEQ ID NO: 1165589 - RNA, 21 nt, Homo sapiens
cagcuaacucugaccugggag

SEQ ID NO: 1165590 - RNA, 18 nt, Homo sapiens
cagcuaccucaaccaaug

SEQ ID NO: 1165591 - RNA, 14 nt, Homo sapiens
cagcuacucaggag

SEQ ID NO: 1165592 - RNA, 22 nt, Homo sapiens
cagcuacucaggaggcugagac

SEQ ID NO: 1165593 - RNA, 18 nt, Homo sapiens
cagcuagacauugcaauu

SEQ ID NO: 1165594 - RNA, 14 nt, Homo sapiens
cagcuauacuguau

SEQ ID NO: 1165595 - RNA, 15 nt, Homo sapiens
cagcucaaaggcaca

SEQ ID NO: 1165596 - RNA, 13 nt, Homo sapiens
cagcucacugcaa

SEQ ID NO: 1165597 - RNA, 20 nt, Homo sapiens
cagcucagcuuccccaacac

SEQ ID NO: 1165598 - RNA, 17 nt, Homo sapiens
cagcucagcuucgugcc

SEQ ID NO: 1165599 - RNA, 12 nt, Homo sapiens
cagcucagggac

SEQ ID NO: 1165600 - RNA, 11 nt, Homo sapiens
cagcucagggc

SEQ ID NO: 1165601 - RNA, 21 nt, Homo sapiens
cagcucaggggacacuggccc

SEQ ID NO: 1165602 - RNA, 13 nt, Homo sapiens
cagcucauucauu

SEQ ID NO: 1165603 - RNA, 14 nt, Homo sapiens
cagcuccucacuca

SEQ ID NO: 1165604 - RNA, 15 nt, Homo sapiens
cagcucuaagucuca

SEQ ID NO: 1165605 - RNA, 14 nt, Homo sapiens
cagcucuccaauac

SEQ ID NO: 1165606 - RNA, 17 nt, Homo sapiens
cagcucugacuuuacac

SEQ ID NO: 1165607 - RNA, 16 nt, Homo sapiens
cagcucugaggacugc

SEQ ID NO: 1165608 - RNA, 20 nt, Homo sapiens
cagcucugaggacugcacca

SEQ ID NO: 1165609 - RNA, 14 nt, Homo sapiens
cagcucugggccau

SEQ ID NO: 1165610 - RNA, 16 nt, Homo sapiens
cagcucuucacagucc

SEQ ID NO: 1165611 - RNA, 15 nt, Homo sapiens
cagcugauugggcac

SEQ ID NO: 1165612 - RNA, 16 nt, Homo sapiens
cagcugcaucugauaa

SEQ ID NO: 1165613 - RNA, 18 nt, Homo sapiens
cagcugcuuguugucaag

SEQ ID NO: 1165614 - RNA, 16 nt, Homo sapiens
cagcugguaaucuugc

SEQ ID NO: 1165615 - RNA, 12 nt, Homo sapiens
cagcuguguuac

SEQ ID NO: 1165616 - RNA, 21 nt, Homo sapiens
cagcuuaaaguuguguaucug

SEQ ID NO: 1165617 - RNA, 13 nt, Homo sapiens
cagcuuauauuca

SEQ ID NO: 1165618 - RNA, 17 nt, Homo sapiens
cagcuuauauucaucca

SEQ ID NO: 1165619 - RNA, 21 nt, Homo sapiens
cagcuuauuuuuuucuacaua

SEQ ID NO: 1165620 - RNA, 19 nt, Homo sapiens
cagcuuccuaaguagcugg

SEQ ID NO: 1165621 - RNA, 15 nt, Homo sapiens
cagcuuuacuguggc

SEQ ID NO: 1165622 - RNA, 22 nt, Homo sapiens
cagcuuugacuggaggguccau

SEQ ID NO: 1165623 - RNA, 19 nt, Homo sapiens
cagcuuuuguuguuuauau

SEQ ID NO: 1165624 - RNA, 21 nt, Homo sapiens
caggaaaauguauccagagga

SEQ ID NO: 1165625 - RNA, 19 nt, Homo sapiens
caggaaacaugaagcauaa

SEQ ID NO: 1165626 - RNA, 23 nt, Homo sapiens
caggaaaccacaaccuugcagua

SEQ ID NO: 1165627 - RNA, 16 nt, Homo sapiens
caggaaagaugcauuu

SEQ ID NO: 1165628 - RNA, 21 nt, Homo sapiens
caggaaagucguacuguucac

SEQ ID NO: 1165629 - RNA, 18 nt, Homo sapiens
caggaaaguucagaguuu

SEQ ID NO: 1165630 - RNA, 21 nt, Homo sapiens
caggaaaguucagaguuuucu

SEQ ID NO: 1165631 - RNA, 22 nt, Homo sapiens
caggaaauauaucuuaaugcag

SEQ ID NO: 1165632 - RNA, 19 nt, Homo sapiens
caggaaauggcuguggagu

SEQ ID NO: 1165633 - RNA, 15 nt, Homo sapiens
caggaaccacaccac

SEQ ID NO: 1165634 - RNA, 17 nt, Homo sapiens
caggaacccuuggucac

SEQ ID NO: 1165635 - RNA, 17 nt, Homo sapiens
caggaagaagugcgagu

SEQ ID NO: 1165636 - RNA, 16 nt, Homo sapiens
caggaaggggugugcu

SEQ ID NO: 1165637 - RNA, 16 nt, Homo sapiens
caggaauguguggccu

SEQ ID NO: 1165638 - RNA, 13 nt, Homo sapiens
caggacaagagaa

SEQ ID NO: 1165639 - RNA, 19 nt, Homo sapiens
caggacagaugccacacaa

SEQ ID NO: 1165640 - RNA, 19 nt, Homo sapiens
caggaccgccauggugcug

SEQ ID NO: 1165641 - RNA, 14 nt, Homo sapiens
caggaccucuggac

SEQ ID NO: 1165642 - RNA, 21 nt, Homo sapiens
caggacgaggcagaaaagcac

SEQ ID NO: 1165643 - RNA, 19 nt, Homo sapiens
caggacuauauuugggccu

SEQ ID NO: 1165644 - RNA, 13 nt, Homo sapiens
caggacucagaag

SEQ ID NO: 1165645 - RNA, 18 nt, Homo sapiens
caggacugugccagcaca

SEQ ID NO: 1165646 - RNA, 20 nt, Homo sapiens
caggacuugagaagaccuca

SEQ ID NO: 1165647 - RNA, 19 nt, Homo sapiens
caggacuuguuuacaaaga

SEQ ID NO: 1165648 - RNA, 15 nt, Homo sapiens
caggagaaucacuug

SEQ ID NO: 1165649 - RNA, 23 nt, Homo sapiens
caggagccggacacuucucagga

SEQ ID NO: 1165650 - RNA, 23 nt, Homo sapiens
caggagcucuccacccacucaca

SEQ ID NO: 1165651 - RNA, 19 nt, Homo sapiens
caggagcugggauccuaag

SEQ ID NO: 1165652 - RNA, 21 nt, Homo sapiens
caggaggaaagaauugcucca

SEQ ID NO: 1165653 - RNA, 19 nt, Homo sapiens
caggaggagcugauaauga

SEQ ID NO: 1165654 - RNA, 23 nt, Homo sapiens
caggaggaggcugcccugagggg

SEQ ID NO: 1165655 - RNA, 15 nt, Homo sapiens
caggaggucagcaca

SEQ ID NO: 1165656 - RNA, 17 nt, Homo sapiens
caggaggucagcacaag

SEQ ID NO: 1165657 - RNA, 20 nt, Homo sapiens
caggagguuuuuuugucaac

SEQ ID NO: 1165658 - RNA, 13 nt, Homo sapiens
caggaguacaccc

SEQ ID NO: 1165659 - RNA, 19 nt, Homo sapiens
caggaguauccucuugcca

SEQ ID NO: 1165660 - RNA, 19 nt, Homo sapiens
caggagucaccaugcaagg

SEQ ID NO: 1165661 - RNA, 14 nt, Homo sapiens
caggaguccaagac

SEQ ID NO: 1165662 - RNA, 15 nt, Homo sapiens
caggaguccaagacc

SEQ ID NO: 1165663 - RNA, 16 nt, Homo sapiens
caggaguccaagacca

SEQ ID NO: 1165664 - RNA, 19 nt, Homo sapiens
caggaguucaauaaauguc

SEQ ID NO: 1165665 - RNA, 21 nt, Homo sapiens
caggaguucagggucauagca

SEQ ID NO: 1165666 - RNA, 17 nt, Homo sapiens
caggaguuccagugcug

SEQ ID NO: 1165667 - RNA, 19 nt, Homo sapiens
caggaucucagaucacugc

SEQ ID NO: 1165668 - RNA, 15 nt, Homo sapiens
caggaucugcuccaa

SEQ ID NO: 1165669 - RNA, 16 nt, Homo sapiens
caggauuugcacagaa

SEQ ID NO: 1165670 - RNA, 21 nt, Homo sapiens
caggauuuuuagagcauuaaa

SEQ ID NO: 1165671 - RNA, 14 nt, Homo sapiens
caggcaacgcacaa

SEQ ID NO: 1165672 - RNA, 15 nt, Homo sapiens
caggcaacgcacaaa

SEQ ID NO: 1165673 - RNA, 18 nt, Homo sapiens
caggcaacgcacaaaaca

SEQ ID NO: 1165674 - RNA, 19 nt, Homo sapiens
caggcacagguccccagau

SEQ ID NO: 1165675 - RNA, 13 nt, Homo sapiens
caggcaccugcca

SEQ ID NO: 1165676 - RNA, 14 nt, Homo sapiens
caggcacgucugca

SEQ ID NO: 1165677 - RNA, 14 nt, Homo sapiens
caggcacuuugcau

SEQ ID NO: 1165678 - RNA, 20 nt, Homo sapiens
caggcagaucaccugagguc

SEQ ID NO: 1165679 - RNA, 23 nt, Homo sapiens
caggcagccagugugacacugcu

SEQ ID NO: 1165680 - RNA, 22 nt, Homo sapiens
caggcaugugccacccacccaa

SEQ ID NO: 1165681 - RNA, 14 nt, Homo sapiens
caggccagcugccu

SEQ ID NO: 1165682 - RNA, 19 nt, Homo sapiens
caggcccccaccacacauc

SEQ ID NO: 1165683 - RNA, 13 nt, Homo sapiens
caggcccuguggc

SEQ ID NO: 1165684 - RNA, 17 nt, Homo sapiens
caggccuugcugacucu

SEQ ID NO: 1165685 - RNA, 16 nt, Homo sapiens
caggcgagccugacuc

SEQ ID NO: 1165686 - RNA, 15 nt, Homo sapiens
caggcgcugugcuau

SEQ ID NO: 1165687 - RNA, 13 nt, Homo sapiens
caggcgugaucca

SEQ ID NO: 1165688 - RNA, 22 nt, Homo sapiens
caggcucaacugaggauguggc

SEQ ID NO: 1165689 - RNA, 17 nt, Homo sapiens
caggcugcagaugauca

SEQ ID NO: 1165690 - RNA, 15 nt, Homo sapiens
caggcuggagugcaa

SEQ ID NO: 1165691 - RNA, 16 nt, Homo sapiens
caggcuggagugcaau

SEQ ID NO: 1165692 - RNA, 19 nt, Homo sapiens
caggcuggagugcaauggc

SEQ ID NO: 1165693 - RNA, 12 nt, Homo sapiens
caggcuugaauc

SEQ ID NO: 1165694 - RNA, 20 nt, Homo sapiens
caggcuugaaucaaagaacu

SEQ ID NO: 1165695 - RNA, 13 nt, Homo sapiens
cagggaaaacugc

SEQ ID NO: 1165696 - RNA, 18 nt, Homo sapiens
cagggaacagccacuccc

SEQ ID NO: 1165697 - RNA, 13 nt, Homo sapiens
cagggacugugaa

SEQ ID NO: 1165698 - RNA, 13 nt, Homo sapiens
cagggcacaaaga

SEQ ID NO: 1165699 - RNA, 22 nt, Homo sapiens
cagggcauauuaguugaugaaa

SEQ ID NO: 1165700 - RNA, 13 nt, Homo sapiens
cagggccacaacu

SEQ ID NO: 1165701 - RNA, 14 nt, Homo sapiens
cagggccacucaac

SEQ ID NO: 1165702 - RNA, 19 nt, Homo sapiens
cagggcccaggccaugugg

SEQ ID NO: 1165703 - RNA, 16 nt, Homo sapiens
cagggcccccaucuca

SEQ ID NO: 1165704 - RNA, 21 nt, Homo sapiens
cagggcggucuucugcuccau

SEQ ID NO: 1165705 - RNA, 12 nt, Homo sapiens
cagggcucccug

SEQ ID NO: 1165706 - RNA, 22 nt, Homo sapiens
cagggcucuaaugugucucuca

SEQ ID NO: 1165707 - RNA, 23 nt, Homo sapiens
cagggcugagacagguuaagggg

SEQ ID NO: 1165708 - RNA, 19 nt, Homo sapiens
cagggcugaggaugggcuc

SEQ ID NO: 1165709 - RNA, 16 nt, Homo sapiens
cagggcugguuuguuc

SEQ ID NO: 1165710 - RNA, 17 nt, Homo sapiens
caggggacgugggcccu

SEQ ID NO: 1165711 - RNA, 18 nt, Homo sapiens
caggggagcccggagcuu

SEQ ID NO: 1165712 - RNA, 20 nt, Homo sapiens
caggguccucuucugggccu

SEQ ID NO: 1165713 - RNA, 16 nt, Homo sapiens
cagggugccugcacuu

SEQ ID NO: 1165714 - RNA, 17 nt, Homo sapiens
caggguggagugcagug

SEQ ID NO: 1165715 - RNA, 20 nt, Homo sapiens
caggguggugguauucuguc

SEQ ID NO: 1165716 - RNA, 18 nt, Homo sapiens
cagggugguguaccugcu

SEQ ID NO: 1165717 - RNA, 14 nt, Homo sapiens
caggguugguagca

SEQ ID NO: 1165718 - RNA, 21 nt, Homo sapiens
caggguuucaccauguuggcc

SEQ ID NO: 1165719 - RNA, 14 nt, Homo sapiens
cagguaaugugaau

SEQ ID NO: 1165720 - RNA, 14 nt, Homo sapiens
cagguacgcacaga

SEQ ID NO: 1165721 - RNA, 15 nt, Homo sapiens
cagguacuaugcaga

SEQ ID NO: 1165722 - RNA, 16 nt, Homo sapiens
cagguagcagcaaaua

SEQ ID NO: 1165723 - RNA, 17 nt, Homo sapiens
caggucaauacaguaca

SEQ ID NO: 1165724 - RNA, 16 nt, Homo sapiens
cagguccauuuugccu

SEQ ID NO: 1165725 - RNA, 20 nt, Homo sapiens
caggucucccgggaagccac

SEQ ID NO: 1165726 - RNA, 12 nt, Homo sapiens
caggucugugga

SEQ ID NO: 1165727 - RNA, 20 nt, Homo sapiens
caggucuuuccuaaggcugc

SEQ ID NO: 1165728 - RNA, 11 nt, Homo sapiens
caggugcagag

SEQ ID NO: 1165729 - RNA, 20 nt, Homo sapiens
caggugcccgccaccgugcc

SEQ ID NO: 1165730 - RNA, 17 nt, Homo sapiens
caggugccuucccagac

SEQ ID NO: 1165731 - RNA, 14 nt, Homo sapiens
caggugcugacaau

SEQ ID NO: 1165732 - RNA, 15 nt, Homo sapiens
caggugcugacaaua

SEQ ID NO: 1165733 - RNA, 22 nt, Homo sapiens
caggugcugacuucaucuccca

SEQ ID NO: 1165734 - RNA, 20 nt, Homo sapiens
caggugcuguuuuuguucua

SEQ ID NO: 1165735 - RNA, 16 nt, Homo sapiens
caggugcuuguggaca

SEQ ID NO: 1165736 - RNA, 14 nt, Homo sapiens
caggugguaaaaau

SEQ ID NO: 1165737 - RNA, 19 nt, Homo sapiens
caggugguggcugcaaggu

SEQ ID NO: 1165738 - RNA, 19 nt, Homo sapiens
cagguguauggagucaccu

SEQ ID NO: 1165739 - RNA, 19 nt, Homo sapiens
caggugugugccaccacac

SEQ ID NO: 1165740 - RNA, 14 nt, Homo sapiens
cagguguuuauaca

SEQ ID NO: 1165741 - RNA, 16 nt, Homo sapiens
cagguguuuauacagc

SEQ ID NO: 1165742 - RNA, 15 nt, Homo sapiens
cagguuaaugcugaa

SEQ ID NO: 1165743 - RNA, 17 nt, Homo sapiens
cagguuaccacucuggc

SEQ ID NO: 1165744 - RNA, 18 nt, Homo sapiens
cagguuagggcucugccc

SEQ ID NO: 1165745 - RNA, 16 nt, Homo sapiens
cagguuccaaucagaa

SEQ ID NO: 1165746 - RNA, 21 nt, Homo sapiens
cagguuuagaggaccagugag

SEQ ID NO: 1165747 - RNA, 14 nt, Homo sapiens
cagguuugggaccc

SEQ ID NO: 1165748 - RNA, 15 nt, Homo sapiens
caguaaauaucccaa

SEQ ID NO: 1165749 - RNA, 17 nt, Homo sapiens
caguaacuccccaacuc

SEQ ID NO: 1165750 - RNA, 12 nt, Homo sapiens
caguaacugaca

SEQ ID NO: 1165751 - RNA, 14 nt, Homo sapiens
caguaacuuuaugu

SEQ ID NO: 1165752 - RNA, 18 nt, Homo sapiens
caguaacuuuauguguaa

SEQ ID NO: 1165753 - RNA, 22 nt, Homo sapiens
caguaaucccagcuacucagga

SEQ ID NO: 1165754 - RNA, 16 nt, Homo sapiens
caguaaucugagcagu

SEQ ID NO: 1165755 - RNA, 22 nt, Homo sapiens
caguacauucccaucuacuaaa

SEQ ID NO: 1165756 - RNA, 20 nt, Homo sapiens
caguagacauuuuaacaaga

SEQ ID NO: 1165757 - RNA, 14 nt, Homo sapiens
caguagaugccacu

SEQ ID NO: 1165758 - RNA, 16 nt, Homo sapiens
caguagcuguggugag

SEQ ID NO: 1165759 - RNA, 21 nt, Homo sapiens
caguaguaccuuguuuugcca

SEQ ID NO: 1165760 - RNA, 17 nt, Homo sapiens
caguagucaccucuggg

SEQ ID NO: 1165761 - RNA, 20 nt, Homo sapiens
caguaucuauauauguguau

SEQ ID NO: 1165762 - RNA, 21 nt, Homo sapiens
caguaucuauauauguguaug

SEQ ID NO: 1165763 - RNA, 14 nt, Homo sapiens
caguaugacaguau

SEQ ID NO: 1165764 - RNA, 15 nt, Homo sapiens
caguauuccaucagg

SEQ ID NO: 1165765 - RNA, 19 nt, Homo sapiens
caguauucuguaaagcuua

SEQ ID NO: 1165766 - RNA, 19 nt, Homo sapiens
cagucaaaacccaccaaaa

SEQ ID NO: 1165767 - RNA, 20 nt, Homo sapiens
cagucaaaacccaccaaaac

SEQ ID NO: 1165768 - RNA, 17 nt, Homo sapiens
cagucaagguugucaau

SEQ ID NO: 1165769 - RNA, 14 nt, Homo sapiens
cagucaauuuucac

SEQ ID NO: 1165770 - RNA, 14 nt, Homo sapiens
cagucaucaucuuu

SEQ ID NO: 1165771 - RNA, 14 nt, Homo sapiens
cagucaucuacuuu

SEQ ID NO: 1165772 - RNA, 14 nt, Homo sapiens
cagucaucuugacc

SEQ ID NO: 1165773 - RNA, 15 nt, Homo sapiens
cagucaucuugacca

SEQ ID NO: 1165774 - RNA, 11 nt, Homo sapiens
caguccacugc

SEQ ID NO: 1165775 - RNA, 17 nt, Homo sapiens
cagucccccaacuaccc

SEQ ID NO: 1165776 - RNA, 19 nt, Homo sapiens
cagucccuaaaaacacaga

SEQ ID NO: 1165777 - RNA, 14 nt, Homo sapiens
caguccugcugacu

SEQ ID NO: 1165778 - RNA, 21 nt, Homo sapiens
cagucgcacacacauuuggaa

SEQ ID NO: 1165779 - RNA, 16 nt, Homo sapiens
cagucuagugcaaaag

SEQ ID NO: 1165780 - RNA, 22 nt, Homo sapiens
cagucucggguggcuagucaga

SEQ ID NO: 1165781 - RNA, 19 nt, Homo sapiens
cagucucuucuaagcaaaa

SEQ ID NO: 1165782 - RNA, 14 nt, Homo sapiens
cagucucuucugau

SEQ ID NO: 1165783 - RNA, 22 nt, Homo sapiens
cagucucuucugauuaaagaga

SEQ ID NO: 1165784 - RNA, 17 nt, Homo sapiens
cagucuguauuuuccac

SEQ ID NO: 1165785 - RNA, 16 nt, Homo sapiens
cagucuguugcugcuc

SEQ ID NO: 1165786 - RNA, 14 nt, Homo sapiens
cagucuuccauuug

SEQ ID NO: 1165787 - RNA, 23 nt, Homo sapiens
cagucuuccucccuguguauuca

SEQ ID NO: 1165788 - RNA, 23 nt, Homo sapiens
cagucuuuucucugaaaagcaaa

SEQ ID NO: 1165789 - RNA, 17 nt, Homo sapiens
cagugaagaugcagguu

SEQ ID NO: 1165790 - RNA, 21 nt, Homo sapiens
cagugaaugauucaguguuaa

SEQ ID NO: 1165791 - RNA, 22 nt, Homo sapiens
cagugacaaccaaaagucuuca

SEQ ID NO: 1165792 - RNA, 16 nt, Homo sapiens
cagugagcugagauca

SEQ ID NO: 1165793 - RNA, 19 nt, Homo sapiens
cagugagcugagaucaugc

SEQ ID NO: 1165794 - RNA, 19 nt, Homo sapiens
cagugaguucagccuuuaa

SEQ ID NO: 1165795 - RNA, 15 nt, Homo sapiens
cagugauccugcaag

SEQ ID NO: 1165796 - RNA, 19 nt, Homo sapiens
cagugauguuggcuagccc

SEQ ID NO: 1165797 - RNA, 14 nt, Homo sapiens
cagugcacaugaac

SEQ ID NO: 1165798 - RNA, 23 nt, Homo sapiens
cagugcagagauccuacuucucu

SEQ ID NO: 1165799 - RNA, 14 nt, Homo sapiens
cagugccaugaggg

SEQ ID NO: 1165800 - RNA, 15 nt, Homo sapiens
cagugcccuuugcau

SEQ ID NO: 1165801 - RNA, 22 nt, Homo sapiens
cagugccuucucucagcuccca

SEQ ID NO: 1165802 - RNA, 15 nt, Homo sapiens
cagugcgcuguagua

SEQ ID NO: 1165803 - RNA, 17 nt, Homo sapiens
cagugcgugaagaccaa

SEQ ID NO: 1165804 - RNA, 18 nt, Homo sapiens
cagugcgugaagaccaac

SEQ ID NO: 1165805 - RNA, 17 nt, Homo sapiens
cagugcuguacuugaug

SEQ ID NO: 1165806 - RNA, 22 nt, Homo sapiens
cagugcuguacuugaugacaga

SEQ ID NO: 1165807 - RNA, 18 nt, Homo sapiens
caguggauggauucauca

SEQ ID NO: 1165808 - RNA, 20 nt, Homo sapiens
caguggccacguucagggag

SEQ ID NO: 1165809 - RNA, 17 nt, Homo sapiens
caguggccuugcuucuu

SEQ ID NO: 1165810 - RNA, 21 nt, Homo sapiens
caguggcuuagcugccaucuu

SEQ ID NO: 1165811 - RNA, 17 nt, Homo sapiens
cagugggggcagagcca

SEQ ID NO: 1165812 - RNA, 18 nt, Homo sapiens
caguguaaauucagucuu

SEQ ID NO: 1165813 - RNA, 15 nt, Homo sapiens
cagugucuggcugca

SEQ ID NO: 1165814 - RNA, 14 nt, Homo sapiens
cagugucuguucau

SEQ ID NO: 1165815 - RNA, 18 nt, Homo sapiens
cagugucuguucauugcc

SEQ ID NO: 1165816 - RNA, 13 nt, Homo sapiens
cagugugaaguua

SEQ ID NO: 1165817 - RNA, 19 nt, Homo sapiens
caguguuucugugaauaga

SEQ ID NO: 1165818 - RNA, 15 nt, Homo sapiens
caguguuuugcacau

SEQ ID NO: 1165819 - RNA, 13 nt, Homo sapiens
caguguuuugcau

SEQ ID NO: 1165820 - RNA, 21 nt, Homo sapiens
caguguuuuuguaaagugugg

SEQ ID NO: 1165821 - RNA, 15 nt, Homo sapiens
caguuaaguguuucc

SEQ ID NO: 1165822 - RNA, 11 nt, Homo sapiens
caguucaugca

SEQ ID NO: 1165823 - RNA, 14 nt, Homo sapiens
caguuccagcuuuu

SEQ ID NO: 1165824 - RNA, 18 nt, Homo sapiens
caguucuaggugcuaaaa

SEQ ID NO: 1165825 - RNA, 19 nt, Homo sapiens
caguucugucauauguuaa

SEQ ID NO: 1165826 - RNA, 18 nt, Homo sapiens
caguucuuugggccagac

SEQ ID NO: 1165827 - RNA, 23 nt, Homo sapiens
caguugagcuucauauaccagca

SEQ ID NO: 1165828 - RNA, 13 nt, Homo sapiens
caguugauuucca

SEQ ID NO: 1165829 - RNA, 11 nt, Homo sapiens
caguugcauag

SEQ ID NO: 1165830 - RNA, 19 nt, Homo sapiens
caguugcuggcaugucuuc

SEQ ID NO: 1165831 - RNA, 23 nt, Homo sapiens
caguugguuuggauuuuuggacc

SEQ ID NO: 1165832 - RNA, 12 nt, Homo sapiens
caguugugauac

SEQ ID NO: 1165833 - RNA, 19 nt, Homo sapiens
caguuguggugugccaugc

SEQ ID NO: 1165834 - RNA, 16 nt, Homo sapiens
caguuuacaaaugaca

SEQ ID NO: 1165835 - RNA, 16 nt, Homo sapiens
caguuuauaaagccaa

SEQ ID NO: 1165836 - RNA, 20 nt, Homo sapiens
caguuuauaccuugccugua

SEQ ID NO: 1165837 - RNA, 13 nt, Homo sapiens
caguuucuuccau

SEQ ID NO: 1165838 - RNA, 12 nt, Homo sapiens
caguuugaacuc

SEQ ID NO: 1165839 - RNA, 18 nt, Homo sapiens
caguuugucucuuugcaa

SEQ ID NO: 1165840 - RNA, 21 nt, Homo sapiens
caguuugugcucuacggguga

SEQ ID NO: 1165841 - RNA, 14 nt, Homo sapiens
caguuuguggcauc

SEQ ID NO: 1165842 - RNA, 22 nt, Homo sapiens
caguuuuaaaaaaaacaauucc

SEQ ID NO: 1165843 - RNA, 21 nt, Homo sapiens
caguuuucggaaacacugacu

SEQ ID NO: 1165844 - RNA, 22 nt, Homo sapiens
caguuuucggaaacacugacuu

SEQ ID NO: 1165845 - RNA, 16 nt, Homo sapiens
caguuuucuugcagau

SEQ ID NO: 1165846 - RNA, 21 nt, Homo sapiens
caguuuugaccuaacauaccg

SEQ ID NO: 1165847 - RNA, 20 nt, Homo sapiens
cauaaaaauaaaucaguuca

SEQ ID NO: 1165848 - RNA, 19 nt, Homo sapiens
cauaaaacaaaagcauuuu

SEQ ID NO: 1165849 - RNA, 20 nt, Homo sapiens
cauaaaaugauccugccaau

SEQ ID NO: 1165850 - RNA, 15 nt, Homo sapiens
cauaaaucacaaaua

SEQ ID NO: 1165851 - RNA, 21 nt, Homo sapiens
cauaaaugcagcccauuucuc

SEQ ID NO: 1165852 - RNA, 18 nt, Homo sapiens
cauaaaugggaacugaug

SEQ ID NO: 1165853 - RNA, 15 nt, Homo sapiens
cauaaccccuugaaa

SEQ ID NO: 1165854 - RNA, 14 nt, Homo sapiens
cauaacucugugau

SEQ ID NO: 1165855 - RNA, 18 nt, Homo sapiens
cauaacugaucuauuuau

SEQ ID NO: 1165856 - RNA, 11 nt, Homo sapiens
cauaacugcua

SEQ ID NO: 1165857 - RNA, 15 nt, Homo sapiens
cauaagaaaagauua

SEQ ID NO: 1165858 - RNA, 21 nt, Homo sapiens
cauaagaaauaaaaucuaauu

SEQ ID NO: 1165859 - RNA, 16 nt, Homo sapiens
cauaagcauuacuuua

SEQ ID NO: 1165860 - RNA, 21 nt, Homo sapiens
cauaagccuaccaauguagac

SEQ ID NO: 1165861 - RNA, 22 nt, Homo sapiens
cauaagguuucguuucuguaua

SEQ ID NO: 1165862 - RNA, 21 nt, Homo sapiens
cauaagucgucacuaauacac

SEQ ID NO: 1165863 - RNA, 20 nt, Homo sapiens
cauaaguucauucaugccaa

SEQ ID NO: 1165864 - RNA, 14 nt, Homo sapiens
cauaaucuguacaa

SEQ ID NO: 1165865 - RNA, 14 nt, Homo sapiens
cauaauguuccuua

SEQ ID NO: 1165866 - RNA, 17 nt, Homo sapiens
cauaauuuaauuccuuc

SEQ ID NO: 1165867 - RNA, 12 nt, Homo sapiens
cauaauuuacau

SEQ ID NO: 1165868 - RNA, 16 nt, Homo sapiens
cauaauuuacaugcaa

SEQ ID NO: 1165869 - RNA, 19 nt, Homo sapiens
cauacaaacauaaggcaca

SEQ ID NO: 1165870 - RNA, 21 nt, Homo sapiens
cauacaagcaacagcaaaagc

SEQ ID NO: 1165871 - RNA, 18 nt, Homo sapiens
cauacaagccaacuggua

SEQ ID NO: 1165872 - RNA, 18 nt, Homo sapiens
cauacaaguauccaguca

SEQ ID NO: 1165873 - RNA, 21 nt, Homo sapiens
cauacagagauuguaguauuu

SEQ ID NO: 1165874 - RNA, 20 nt, Homo sapiens
cauacagggaugguguucaa

SEQ ID NO: 1165875 - RNA, 11 nt, Homo sapiens
cauacagugau

SEQ ID NO: 1165876 - RNA, 19 nt, Homo sapiens
cauacgagagcagaggucu

SEQ ID NO: 1165877 - RNA, 14 nt, Homo sapiens
cauacguacauucc

SEQ ID NO: 1165878 - RNA, 22 nt, Homo sapiens
cauacugguguuaacagucaca

SEQ ID NO: 1165879 - RNA, 20 nt, Homo sapiens
cauacuucuguuuccaucug

SEQ ID NO: 1165880 - RNA, 17 nt, Homo sapiens
cauacuugaagggccag

SEQ ID NO: 1165881 - RNA, 11 nt, Homo sapiens
cauacuuguga

SEQ ID NO: 1165882 - RNA, 18 nt, Homo sapiens
cauagagcagugcacauc

SEQ ID NO: 1165883 - RNA, 15 nt, Homo sapiens
cauagcaccauuccu

SEQ ID NO: 1165884 - RNA, 17 nt, Homo sapiens
cauagcagcugcuacua

SEQ ID NO: 1165885 - RNA, 21 nt, Homo sapiens
cauagcugugcuaugagguuu

SEQ ID NO: 1165886 - RNA, 23 nt, Homo sapiens
cauaggacaaaugauaaguacua

SEQ ID NO: 1165887 - RNA, 19 nt, Homo sapiens
cauaggacucaaaguuuca

SEQ ID NO: 1165888 - RNA, 21 nt, Homo sapiens
cauaggaugguaccaagcauu

SEQ ID NO: 1165889 - RNA, 22 nt, Homo sapiens
cauagggacauaaguucauuca

SEQ ID NO: 1165890 - RNA, 19 nt, Homo sapiens
cauaggggaguaggggugg

SEQ ID NO: 1165891 - RNA, 13 nt, Homo sapiens
cauaguaaaguau

SEQ ID NO: 1165892 - RNA, 17 nt, Homo sapiens
cauaguuauuuacuuga

SEQ ID NO: 1165893 - RNA, 18 nt, Homo sapiens
cauaguuauuuacuugaa

SEQ ID NO: 1165894 - RNA, 18 nt, Homo sapiens
cauauaaagcacuauaca

SEQ ID NO: 1165895 - RNA, 19 nt, Homo sapiens
cauauaaagcacuauacag

SEQ ID NO: 1165896 - RNA, 18 nt, Homo sapiens
cauauacucuucaaggac

SEQ ID NO: 1165897 - RNA, 21 nt, Homo sapiens
cauauagcugauaaagccuaa

SEQ ID NO: 1165898 - RNA, 20 nt, Homo sapiens
cauauauagagggagcugua

SEQ ID NO: 1165899 - RNA, 14 nt, Homo sapiens
cauauauauuacaa

SEQ ID NO: 1165900 - RNA, 13 nt, Homo sapiens
cauaucagugaac

SEQ ID NO: 1165901 - RNA, 17 nt, Homo sapiens
cauaucagugaaccuuu

SEQ ID NO: 1165902 - RNA, 23 nt, Homo sapiens
cauaugaaugcagcacugcugcc

SEQ ID NO: 1165903 - RNA, 14 nt, Homo sapiens
cauauggacacugu

SEQ ID NO: 1165904 - RNA, 16 nt, Homo sapiens
cauauggacacuguga

SEQ ID NO: 1165905 - RNA, 15 nt, Homo sapiens
cauauggacucugca

SEQ ID NO: 1165906 - RNA, 16 nt, Homo sapiens
cauauggacucugcac

SEQ ID NO: 1165907 - RNA, 20 nt, Homo sapiens
cauauguauauauauauaug

SEQ ID NO: 1165908 - RNA, 16 nt, Homo sapiens
cauauguaucuauaca

SEQ ID NO: 1165909 - RNA, 23 nt, Homo sapiens
cauauguuaauaaacugcaaaug

SEQ ID NO: 1165910 - RNA, 21 nt, Homo sapiens
cauauuaguaaaagaugccau

SEQ ID NO: 1165911 - RNA, 21 nt, Homo sapiens
cauauucacuauagaaugaua

SEQ ID NO: 1165912 - RNA, 23 nt, Homo sapiens
cauauucuuuaaauuucaucuca

SEQ ID NO: 1165913 - RNA, 22 nt, Homo sapiens
cauauuuuaaaauguauaccaa

SEQ ID NO: 1165914 - RNA, 17 nt, Homo sapiens
caucaaaagacuuaaaa

SEQ ID NO: 1165915 - RNA, 13 nt, Homo sapiens
caucaacuuaaaa

SEQ ID NO: 1165916 - RNA, 17 nt, Homo sapiens
caucaagagacugaguc

SEQ ID NO: 1165917 - RNA, 15 nt, Homo sapiens
caucaauaccugcug

SEQ ID NO: 1165918 - RNA, 19 nt, Homo sapiens
caucaauuccaucagcaca

SEQ ID NO: 1165919 - RNA, 17 nt, Homo sapiens
caucacacacauggaaa

SEQ ID NO: 1165920 - RNA, 12 nt, Homo sapiens
caucacacuggg

SEQ ID NO: 1165921 - RNA, 13 nt, Homo sapiens
caucacagggugg

SEQ ID NO: 1165922 - RNA, 19 nt, Homo sapiens
caucacgugugauugacau

SEQ ID NO: 1165923 - RNA, 13 nt, Homo sapiens
caucacuauucaa

SEQ ID NO: 1165924 - RNA, 14 nt, Homo sapiens
caucacugaaaugc

SEQ ID NO: 1165925 - RNA, 16 nt, Homo sapiens
caucacugguugcacu

SEQ ID NO: 1165926 - RNA, 17 nt, Homo sapiens
caucacuuccuugcccc

SEQ ID NO: 1165927 - RNA, 20 nt, Homo sapiens
caucagcaggaaugcucuga

SEQ ID NO: 1165928 - RNA, 16 nt, Homo sapiens
caucagcuaaacacca

SEQ ID NO: 1165929 - RNA, 20 nt, Homo sapiens
caucaggaguuccagugcug

SEQ ID NO: 1165930 - RNA, 15 nt, Homo sapiens
caucaguaacaguau

SEQ ID NO: 1165931 - RNA, 12 nt, Homo sapiens
caucaguucuuu

SEQ ID NO: 1165932 - RNA, 13 nt, Homo sapiens
caucauaucuacu

SEQ ID NO: 1165933 - RNA, 14 nt, Homo sapiens
caucauaucuacua

SEQ ID NO: 1165934 - RNA, 15 nt, Homo sapiens
caucauaucuacuau

SEQ ID NO: 1165935 - RNA, 19 nt, Homo sapiens
caucaucuccugccuuccu

SEQ ID NO: 1165936 - RNA, 22 nt, Homo sapiens
caucaugaacuggcuuguacau

SEQ ID NO: 1165937 - RNA, 22 nt, Homo sapiens
caucauuaaaagcaaggcucaa

SEQ ID NO: 1165938 - RNA, 12 nt, Homo sapiens
caucauuucagc

SEQ ID NO: 1165939 - RNA, 17 nt, Homo sapiens
cauccaagcaaacugaa

SEQ ID NO: 1165940 - RNA, 17 nt, Homo sapiens
cauccaaugcucaagaa

SEQ ID NO: 1165941 - RNA, 17 nt, Homo sapiens
cauccaauggacugcau

SEQ ID NO: 1165942 - RNA, 17 nt, Homo sapiens
cauccacauuguuuuaa

SEQ ID NO: 1165943 - RNA, 19 nt, Homo sapiens
cauccacuuuaugugcauc

SEQ ID NO: 1165944 - RNA, 17 nt, Homo sapiens
cauccagaaguuccuca

SEQ ID NO: 1165945 - RNA, 14 nt, Homo sapiens
cauccagggcugcc

SEQ ID NO: 1165946 - RNA, 21 nt, Homo sapiens
cauccauaguaacugacauga

SEQ ID NO: 1165947 - RNA, 21 nt, Homo sapiens
cccccaaugcccggccaggcu

SEQ ID NO: 1165948 - RNA, 14 nt, Homo sapiens
cccccaccucaggu

SEQ ID NO: 1165949 - RNA, 16 nt, Homo sapiens
cccccacuacaaguga

SEQ ID NO: 1165950 - RNA, 18 nt, Homo sapiens
cccccaggauugugcaau

SEQ ID NO: 1165951 - RNA, 18 nt, Homo sapiens
cccccagguuuuugccca

SEQ ID NO: 1165952 - RNA, 12 nt, Homo sapiens
cccccauuucac

SEQ ID NO: 1165953 - RNA, 14 nt, Homo sapiens
cccccuucagugcc

SEQ ID NO: 1165954 - RNA, 18 nt, Homo sapiens
cccccuuuccucuugggc

SEQ ID NO: 1165955 - RNA, 22 nt, Homo sapiens
ccccgauugaaagaaccagaga

SEQ ID NO: 1165956 - RNA, 14 nt, Homo sapiens
ccccgcuggugacc

SEQ ID NO: 1165957 - RNA, 18 nt, Homo sapiens
ccccgcuucuccugguca

SEQ ID NO: 1165958 - RNA, 12 nt, Homo sapiens
ccccguuuucca

SEQ ID NO: 1165959 - RNA, 16 nt, Homo sapiens
ccccuaaaccaaaaac

SEQ ID NO: 1165960 - RNA, 17 nt, Homo sapiens
ccccuaguaacugcugu

SEQ ID NO: 1165961 - RNA, 15 nt, Homo sapiens
ccccucagagugcaa

SEQ ID NO: 1165962 - RNA, 15 nt, Homo sapiens
ccccucauugcauuu

SEQ ID NO: 1165963 - RNA, 12 nt, Homo sapiens
ccccuccacugg

SEQ ID NO: 1165964 - RNA, 15 nt, Homo sapiens
ccccuccccaaagcc

SEQ ID NO: 1165965 - RNA, 21 nt, Homo sapiens
ccccuccucccccggcugggc

SEQ ID NO: 1165966 - RNA, 14 nt, Homo sapiens
ccccugcacaguug

SEQ ID NO: 1165967 - RNA, 20 nt, Homo sapiens
ccccugcugucucucugggc

SEQ ID NO: 1165968 - RNA, 15 nt, Homo sapiens
ccccuggaccgcuuu

SEQ ID NO: 1165969 - RNA, 18 nt, Homo sapiens
ccccuggcagugcugagg

SEQ ID NO: 1165970 - RNA, 17 nt, Homo sapiens
ccuagggauauaauucu

SEQ ID NO: 1165971 - RNA, 22 nt, Homo sapiens
ccuaggguuuuuaaaauaucug

SEQ ID NO: 1165972 - RNA, 23 nt, Homo sapiens
ccuaggugagaacccuugcacua

SEQ ID NO: 1165973 - RNA, 20 nt, Homo sapiens
ccuaguagcugggaugacag

SEQ ID NO: 1165974 - RNA, 16 nt, Homo sapiens
ccuauaaaauugucaa

SEQ ID NO: 1165975 - RNA, 15 nt, Homo sapiens
ccuauacaaaacacc

SEQ ID NO: 1165976 - RNA, 17 nt, Homo sapiens
ccuauagaaacaccagu

SEQ ID NO: 1165977 - RNA, 15 nt, Homo sapiens
ccuaugaaauuucaa

SEQ ID NO: 1165978 - RNA, 16 nt, Homo sapiens
ccuaugcacauaugga

SEQ ID NO: 1165979 - RNA, 22 nt, Homo sapiens
ccuauguacuuaauccuuuaac

SEQ ID NO: 1165980 - RNA, 20 nt, Homo sapiens
ccuauuagaguauuuuccac

SEQ ID NO: 1165981 - RNA, 17 nt, Homo sapiens
ccuauuccaguguccau

SEQ ID NO: 1165982 - RNA, 19 nt, Homo sapiens
ccuauuccugaacuauaac

SEQ ID NO: 1165983 - RNA, 20 nt, Homo sapiens
ccuauuuccauucaacaaga

SEQ ID NO: 1165984 - RNA, 15 nt, Homo sapiens
ccuauuuucauuccu

SEQ ID NO: 1165985 - RNA, 21 nt, Homo sapiens
ccucaaacuuccagucaggua

SEQ ID NO: 1165986 - RNA, 20 nt, Homo sapiens
ccucaacaucacacaguaua

SEQ ID NO: 1165987 - RNA, 20 nt, Homo sapiens
ccucaaccuccuggguucaa

SEQ ID NO: 1165988 - RNA, 11 nt, Homo sapiens
ccucaagaaga

SEQ ID NO: 1165989 - RNA, 18 nt, Homo sapiens
ccucaagggccaggacuu

SEQ ID NO: 1165990 - RNA, 12 nt, Homo sapiens
ccucaaguucca

SEQ ID NO: 1165991 - RNA, 19 nt, Homo sapiens
ccucaaucucaauccugca

SEQ ID NO: 1165992 - RNA, 18 nt, Homo sapiens
ccucaccugguugaccca

SEQ ID NO: 1165993 - RNA, 14 nt, Homo sapiens
ccucacuucuucca

SEQ ID NO: 1165994 - RNA, 14 nt, Homo sapiens
ccucagcaagccau

SEQ ID NO: 1165995 - RNA, 14 nt, Homo sapiens
ccucagccagagaa

SEQ ID NO: 1165996 - RNA, 14 nt, Homo sapiens
ccucagccuccuga

SEQ ID NO: 1165997 - RNA, 15 nt, Homo sapiens
ccucagccucucaaa

SEQ ID NO: 1165998 - RNA, 12 nt, Homo sapiens
ccucagccugau

SEQ ID NO: 1165999 - RNA, 15 nt, Homo sapiens
ccucagccuugccag

SEQ ID NO: 1166000 - RNA, 15 nt, Homo sapiens
ccucagggacagaga

SEQ ID NO: 1166001 - RNA, 18 nt, Homo sapiens
ccucagucgcauagacuu

SEQ ID NO: 1166002 - RNA, 20 nt, Homo sapiens
ccucaguucccucuugcuca

SEQ ID NO: 1166003 - RNA, 21 nt, Homo sapiens
ccucaguuucauuaacuggug

SEQ ID NO: 1166004 - RNA, 18 nt, Homo sapiens
ccucaucucucugcccaa

SEQ ID NO: 1166005 - RNA, 17 nt, Homo sapiens
ccucauguccacucagu

SEQ ID NO: 1166006 - RNA, 20 nt, Homo sapiens
ccucauugcauuuauugcag

SEQ ID NO: 1166007 - RNA, 17 nt, Homo sapiens
ccucauuggcucuugaa

SEQ ID NO: 1166008 - RNA, 20 nt, Homo sapiens
ccucauuguuggaguguaaa

SEQ ID NO: 1166009 - RNA, 21 nt, Homo sapiens
ccuccacaaagcaaaggcagu

SEQ ID NO: 1166010 - RNA, 20 nt, Homo sapiens
ccuccacuuguucagggcuu

SEQ ID NO: 1166011 - RNA, 13 nt, Homo sapiens
ccuccagaacuca

SEQ ID NO: 1166012 - RNA, 16 nt, Homo sapiens
ccuccagaauggagcu

SEQ ID NO: 1166013 - RNA, 17 nt, Homo sapiens
ccuccagagacaggaaa

SEQ ID NO: 1166014 - RNA, 22 nt, Homo sapiens
ccuccaggaaccacaccacauc

SEQ ID NO: 1166015 - RNA, 15 nt, Homo sapiens
ccuccauaugcugua

SEQ ID NO: 1166016 - RNA, 21 nt, Homo sapiens
ccucccaaagugcugggauua

SEQ ID NO: 1166017 - RNA, 14 nt, Homo sapiens
ccuccccaggaauu

SEQ ID NO: 1166018 - RNA, 22 nt, Homo sapiens
ccuccccagggaagacccugac

SEQ ID NO: 1166019 - RNA, 21 nt, Homo sapiens
ccuccccaguagcugggauua

SEQ ID NO: 1166020 - RNA, 16 nt, Homo sapiens
ccucccccccaugcac

SEQ ID NO: 1166021 - RNA, 21 nt, Homo sapiens
ccucccuagauccaggcuucu

SEQ ID NO: 1166022 - RNA, 21 nt, Homo sapiens
ccucccuagccagcacuugua

SEQ ID NO: 1166023 - RNA, 18 nt, Homo sapiens
ccucccugccuccaggaa

SEQ ID NO: 1166024 - RNA, 23 nt, Homo sapiens
ccucccugcugccagaagcagca

SEQ ID NO: 1166025 - RNA, 19 nt, Homo sapiens
ccucccuguuccccagaga

SEQ ID NO: 1166026 - RNA, 18 nt, Homo sapiens
ccuccgccuccuggguuc

SEQ ID NO: 1166027 - RNA, 16 nt, Homo sapiens
ccuccgcuuauccugc

SEQ ID NO: 1166028 - RNA, 19 nt, Homo sapiens
ccuccuauuccagugucca

SEQ ID NO: 1166029 - RNA, 16 nt, Homo sapiens
ccuccucaggcacaca

SEQ ID NO: 1166030 - RNA, 22 nt, Homo sapiens
ccuccuccaccaccgcccgucu

SEQ ID NO: 1166031 - RNA, 16 nt, Homo sapiens
ccuccucugcccggga

SEQ ID NO: 1166032 - RNA, 21 nt, Homo sapiens
ccuccugacucuucaggccag

SEQ ID NO: 1166033 - RNA, 16 nt, Homo sapiens
ccuccugggcccucuc

SEQ ID NO: 1166034 - RNA, 18 nt, Homo sapiens
ccuccugguaacagcuau

SEQ ID NO: 1166035 - RNA, 14 nt, Homo sapiens
ccucgaaaaccauc

SEQ ID NO: 1166036 - RNA, 20 nt, Homo sapiens
ccucgaauuuuaucugugga

SEQ ID NO: 1166037 - RNA, 18 nt, Homo sapiens
ccucgaggcggaucuuug

SEQ ID NO: 1166038 - RNA, 17 nt, Homo sapiens
ccucgccuguuccccaa

SEQ ID NO: 1166039 - RNA, 15 nt, Homo sapiens
ccucgcuucagccac

SEQ ID NO: 1166040 - RNA, 13 nt, Homo sapiens
ccucgggacauca

SEQ ID NO: 1166041 - RNA, 18 nt, Homo sapiens
ccucgggacaucaaaaac

SEQ ID NO: 1166042 - RNA, 17 nt, Homo sapiens
ccucgggugugcuaugg

SEQ ID NO: 1166043 - RNA, 23 nt, Homo sapiens
ccucgguucaaaaccuugcacag

SEQ ID NO: 1166044 - RNA, 15 nt, Homo sapiens
ccucuaagacaaagu

SEQ ID NO: 1166045 - RNA, 14 nt, Homo sapiens
ccucuaauucugua

SEQ ID NO: 1166046 - RNA, 14 nt, Homo sapiens
ccucucaacugccu

SEQ ID NO: 1166047 - RNA, 13 nt, Homo sapiens
ccucucacuuugg

SEQ ID NO: 1166048 - RNA, 20 nt, Homo sapiens
ccucucagggccacuggcag

SEQ ID NO: 1166049 - RNA, 15 nt, Homo sapiens
ccucucaguacuuug

SEQ ID NO: 1166050 - RNA, 11 nt, Homo sapiens
ccucucugcaa

SEQ ID NO: 1166051 - RNA, 12 nt, Homo sapiens
ccucucuuugac

SEQ ID NO: 1166052 - RNA, 14 nt, Homo sapiens
ccucugaaacagcu

SEQ ID NO: 1166053 - RNA, 14 nt, Homo sapiens
ccucugacaaagcc

SEQ ID NO: 1166054 - RNA, 21 nt, Homo sapiens
ccucugacuuaagcugccuca

SEQ ID NO: 1166055 - RNA, 12 nt, Homo sapiens
ccucugccucaa

SEQ ID NO: 1166056 - RNA, 19 nt, Homo sapiens
ccucugucagucacagcca

SEQ ID NO: 1166057 - RNA, 20 nt, Homo sapiens
ccucugucagucacagccac

SEQ ID NO: 1166058 - RNA, 18 nt, Homo sapiens
ccucuuagauauucacua

SEQ ID NO: 1166059 - RNA, 16 nt, Homo sapiens
ccucuugccaaaucaa

SEQ ID NO: 1166060 - RNA, 14 nt, Homo sapiens
ccucuuuaaaaaca

SEQ ID NO: 1166061 - RNA, 18 nt, Homo sapiens
ccucuuugugauaauucu

SEQ ID NO: 1166062 - RNA, 17 nt, Homo sapiens
ccucuuuuucucuguau

SEQ ID NO: 1166063 - RNA, 16 nt, Homo sapiens
ccugaaagcacuguag

SEQ ID NO: 1166064 - RNA, 19 nt, Homo sapiens
ccugaaauuguauaguguu

SEQ ID NO: 1166065 - RNA, 17 nt, Homo sapiens
ccugaaccuugagcaaa

SEQ ID NO: 1166066 - RNA, 16 nt, Homo sapiens
ccugaacuaaucugau

SEQ ID NO: 1166067 - RNA, 15 nt, Homo sapiens
ccugaacucugcaac

SEQ ID NO: 1166068 - RNA, 14 nt, Homo sapiens
ccugaagaaccagu

SEQ ID NO: 1166069 - RNA, 15 nt, Homo sapiens
ccugaagaaccaguc

SEQ ID NO: 1166070 - RNA, 13 nt, Homo sapiens
ccugaagauacuu

SEQ ID NO: 1166071 - RNA, 19 nt, Homo sapiens
ccugaagaugggagccuuu

SEQ ID NO: 1166072 - RNA, 21 nt, Homo sapiens
ccugaagggaaggcaaaggca

SEQ ID NO: 1166073 - RNA, 16 nt, Homo sapiens
ccugaauccagcauug

SEQ ID NO: 1166074 - RNA, 19 nt, Homo sapiens
ccugacauucacacagaga

SEQ ID NO: 1166075 - RNA, 21 nt, Homo sapiens
ccugacggagaggcagaucaa

SEQ ID NO: 1166076 - RNA, 18 nt, Homo sapiens
ccugacuuuguaguucug

SEQ ID NO: 1166077 - RNA, 18 nt, Homo sapiens
ccuuugauuuuuugccca

SEQ ID NO: 1166078 - RNA, 13 nt, Homo sapiens
ccuuugcaauuug

SEQ ID NO: 1166079 - RNA, 15 nt, Homo sapiens
ccuuugccagccauu

SEQ ID NO: 1166080 - RNA, 18 nt, Homo sapiens
ccuuugccucaaggacuu

SEQ ID NO: 1166081 - RNA, 24 nt, Homo sapiens
ccuuugcuacacugcugacagcua

SEQ ID NO: 1166082 - RNA, 12 nt, Homo sapiens
ccuuugcuuguc

SEQ ID NO: 1166083 - RNA, 22 nt, Homo sapiens
ccuuuggacuugucccgggaca

SEQ ID NO: 1166084 - RNA, 22 nt, Homo sapiens
ccuuuggagggagggcugaccc

SEQ ID NO: 1166085 - RNA, 17 nt, Homo sapiens
ccuuuggcagaguucua

SEQ ID NO: 1166086 - RNA, 21 nt, Homo sapiens
ccuuuggggugaacuaccuug

SEQ ID NO: 1166087 - RNA, 19 nt, Homo sapiens
ccuuuguggaugaauccca

SEQ ID NO: 1166088 - RNA, 18 nt, Homo sapiens
ccuuugugugugugguuc

SEQ ID NO: 1166089 - RNA, 16 nt, Homo sapiens
ccuuuguugcacaaau

SEQ ID NO: 1166090 - RNA, 13 nt, Homo sapiens
ccuuuuacauacu

SEQ ID NO: 1166091 - RNA, 17 nt, Homo sapiens
ccuuuuauacugacaaa

SEQ ID NO: 1166092 - RNA, 13 nt, Homo sapiens
ccuuuuaugcaaa

SEQ ID NO: 1166093 - RNA, 21 nt, Homo sapiens
ccuuuucuaguuuuauacaaa

SEQ ID NO: 1166094 - RNA, 21 nt, Homo sapiens
ccuuuucuccucuuugaacau

SEQ ID NO: 1166095 - RNA, 19 nt, Homo sapiens
ccuuuuugagauacuauuu

SEQ ID NO: 1166096 - RNA, 21 nt, Homo sapiens
cgaaaccugggauucaggaau

SEQ ID NO: 1166097 - RNA, 14 nt, Homo sapiens
cgaacaauucauau

SEQ ID NO: 1166098 - RNA, 20 nt, Homo sapiens
cgaacuagagaugugcaauu

SEQ ID NO: 1166099 - RNA, 18 nt, Homo sapiens
cgaagagugaagggcagu

SEQ ID NO: 1166100 - RNA, 15 nt, Homo sapiens
cgaaggauauuguca

SEQ ID NO: 1166101 - RNA, 15 nt, Homo sapiens
cgaaguccuauggaa

SEQ ID NO: 1166102 - RNA, 18 nt, Homo sapiens
cgaagugccagaacccaa

SEQ ID NO: 1166103 - RNA, 20 nt, Homo sapiens
cgaagugccagaacccaaau

SEQ ID NO: 1166104 - RNA, 14 nt, Homo sapiens
cgaaguguugcaug

SEQ ID NO: 1166105 - RNA, 18 nt, Homo sapiens
cgaaugguuccauucucu

SEQ ID NO: 1166106 - RNA, 13 nt, Homo sapiens
cgacacucagggc

SEQ ID NO: 1166107 - RNA, 12 nt, Homo sapiens
cgacaguuuucc

SEQ ID NO: 1166108 - RNA, 17 nt, Homo sapiens
cgacuaauuucaaaaug

SEQ ID NO: 1166109 - RNA, 22 nt, Homo sapiens
cgacuaauuucaaaaugcuuuu

SEQ ID NO: 1166110 - RNA, 16 nt, Homo sapiens
cgacuccuagauccag

SEQ ID NO: 1166111 - RNA, 19 nt, Homo sapiens
cgagaccagccuggccaac

SEQ ID NO: 1166112 - RNA, 17 nt, Homo sapiens
cgagaccccaucuucca

SEQ ID NO: 1166113 - RNA, 13 nt, Homo sapiens
cgagagagggaaa

SEQ ID NO: 1166114 - RNA, 13 nt, Homo sapiens
cgagauacugcau

SEQ ID NO: 1166115 - RNA, 20 nt, Homo sapiens
cgagaucgugccauugcacu

SEQ ID NO: 1166116 - RNA, 15 nt, Homo sapiens
cgagauuccgucuca

SEQ ID NO: 1166117 - RNA, 14 nt, Homo sapiens
cgagcauguuguuu

SEQ ID NO: 1166118 - RNA, 17 nt, Homo sapiens
cgagccuggcuccaaac

SEQ ID NO: 1166119 - RNA, 16 nt, Homo sapiens
cgagcggggagccagg

SEQ ID NO: 1166120 - RNA, 20 nt, Homo sapiens
cgaggccccugucucagggu

SEQ ID NO: 1166121 - RNA, 10 nt, Homo sapiens
cgaguacuuc

SEQ ID NO: 1166122 - RNA, 22 nt, Homo sapiens
cgagucaauccccucauucagg

SEQ ID NO: 1166123 - RNA, 18 nt, Homo sapiens
cgaguggaugcugugcua

SEQ ID NO: 1166124 - RNA, 20 nt, Homo sapiens
cgauaacuuugugauguuuc

SEQ ID NO: 1166125 - RNA, 22 nt, Homo sapiens
cgaugcuggaggcccucgagga

SEQ ID NO: 1166126 - RNA, 13 nt, Homo sapiens
cgauguaugcagc

SEQ ID NO: 1166127 - RNA, 16 nt, Homo sapiens
cgcaaauuuucuucca

SEQ ID NO: 1166128 - RNA, 15 nt, Homo sapiens
cgcaauuaugcuuuc

SEQ ID NO: 1166129 - RNA, 15 nt, Homo sapiens
cgcaccaagaucucc

SEQ ID NO: 1166130 - RNA, 18 nt, Homo sapiens
cgcaccugaccgcugccc

SEQ ID NO: 1166131 - RNA, 13 nt, Homo sapiens
cgcaccugccuca

SEQ ID NO: 1166132 - RNA, 22 nt, Homo sapiens
cgcaccugucgguggcugccuu

SEQ ID NO: 1166133 - RNA, 14 nt, Homo sapiens
cgcagccuuaccca

SEQ ID NO: 1166134 - RNA, 18 nt, Homo sapiens
cgcauacagauauucuaa

SEQ ID NO: 1166135 - RNA, 13 nt, Homo sapiens
cgcauucccugag

SEQ ID NO: 1166136 - RNA, 16 nt, Homo sapiens
cgccaggcgcugcagg

SEQ ID NO: 1166137 - RNA, 15 nt, Homo sapiens
cgccagugugcuguc

SEQ ID NO: 1166138 - RNA, 22 nt, Homo sapiens
cgccucccuaguuagcauccag

SEQ ID NO: 1166139 - RNA, 21 nt, Homo sapiens
cgccuccgcuacuuccagggc

SEQ ID NO: 1166140 - RNA, 11 nt, Homo sapiens
cgccucuggau

SEQ ID NO: 1166141 - RNA, 13 nt, Homo sapiens
cgccuucccucac

SEQ ID NO: 1166142 - RNA, 16 nt, Homo sapiens
cgcgcaggccugcgug

SEQ ID NO: 1166143 - RNA, 22 nt, Homo sapiens
cgcgccccacgagaccccggcu

SEQ ID NO: 1166144 - RNA, 13 nt, Homo sapiens
cgcgcuccgcgca

SEQ ID NO: 1166145 - RNA, 20 nt, Homo sapiens
cgcggaugaagcccagccac

SEQ ID NO: 1166146 - RNA, 14 nt, Homo sapiens
cgcggccaccucac

SEQ ID NO: 1166147 - RNA, 15 nt, Homo sapiens
cgcggcgguggagcc

SEQ ID NO: 1166148 - RNA, 19 nt, Homo sapiens
cgcucaucccacccgccca

SEQ ID NO: 1166149 - RNA, 12 nt, Homo sapiens
cgcucccgggac

SEQ ID NO: 1166150 - RNA, 16 nt, Homo sapiens
cgcucucccuaccuug

SEQ ID NO: 1166151 - RNA, 12 nt, Homo sapiens
cgcucuguggau

SEQ ID NO: 1166152 - RNA, 14 nt, Homo sapiens
cgcugcaaccuccu

SEQ ID NO: 1166153 - RNA, 17 nt, Homo sapiens
cgcugccucaacacuga

SEQ ID NO: 1166154 - RNA, 16 nt, Homo sapiens
cgcugccuggaacacc

SEQ ID NO: 1166155 - RNA, 17 nt, Homo sapiens
cgcuguguucaucgacu

SEQ ID NO: 1166156 - RNA, 23 nt, Homo sapiens
cgcuugaaccugggaaguggagg

SEQ ID NO: 1166157 - RNA, 12 nt, Homo sapiens
cggaacugccuu

SEQ ID NO: 1166158 - RNA, 18 nt, Homo sapiens
cggaaggucccucagaca

SEQ ID NO: 1166159 - RNA, 15 nt, Homo sapiens
cggaauugcucuccc

SEQ ID NO: 1166160 - RNA, 22 nt, Homo sapiens
cggacaagacccccagcacuug

SEQ ID NO: 1166161 - RNA, 16 nt, Homo sapiens
cggacacuucucagga

SEQ ID NO: 1166162 - RNA, 11 nt, Homo sapiens
cggacuaugua

SEQ ID NO: 1166163 - RNA, 12 nt, Homo sapiens
cggacuauguaa

SEQ ID NO: 1166164 - RNA, 21 nt, Homo sapiens
cggacucacuauggccagaaa

SEQ ID NO: 1166165 - RNA, 21 nt, Homo sapiens
cggagacuuucaaacauauau

SEQ ID NO: 1166166 - RNA, 18 nt, Homo sapiens
cggagaggcugcacuugu

SEQ ID NO: 1166167 - RNA, 15 nt, Homo sapiens
cggagccuccagcug

SEQ ID NO: 1166168 - RNA, 13 nt, Homo sapiens
cggaguuccagca

SEQ ID NO: 1166169 - RNA, 18 nt, Homo sapiens
cggauauauacauagcau

SEQ ID NO: 1166170 - RNA, 13 nt, Homo sapiens
cggaucacuugag

SEQ ID NO: 1166171 - RNA, 20 nt, Homo sapiens
cggaucccgcguagugucag

SEQ ID NO: 1166172 - RNA, 12 nt, Homo sapiens
cggcacauuccc

SEQ ID NO: 1166173 - RNA, 20 nt, Homo sapiens
cggccacggugccuccagau

SEQ ID NO: 1166174 - RNA, 18 nt, Homo sapiens
cggcccccucaccccagc

SEQ ID NO: 1166175 - RNA, 19 nt, Homo sapiens
cggccccucccacacccaa

SEQ ID NO: 1166176 - RNA, 16 nt, Homo sapiens
cggcugcggcacugug

SEQ ID NO: 1166177 - RNA, 21 nt, Homo sapiens
cggcugcggcagcucugguaa

SEQ ID NO: 1166178 - RNA, 18 nt, Homo sapiens
cggcugcggggggcacca

SEQ ID NO: 1166179 - RNA, 22 nt, Homo sapiens
cggcuguugauacgauugucug

SEQ ID NO: 1166180 - RNA, 16 nt, Homo sapiens
cggcuuguaaauguga

SEQ ID NO: 1166181 - RNA, 17 nt, Homo sapiens
cgggaagaaggggacaa

SEQ ID NO: 1166182 - RNA, 15 nt, Homo sapiens
cgggacccucaggug

SEQ ID NO: 1166183 - RNA, 16 nt, Homo sapiens
cuaccaagauauaccu

SEQ ID NO: 1166184 - RNA, 14 nt, Homo sapiens
cuaccaauguagac

SEQ ID NO: 1166185 - RNA, 14 nt, Homo sapiens
cuaccuaccaagau

SEQ ID NO: 1166186 - RNA, 10 nt, Homo sapiens
cuaccucagc

SEQ ID NO: 1166187 - RNA, 14 nt, Homo sapiens
cuaccugagcauuc

SEQ ID NO: 1166188 - RNA, 20 nt, Homo sapiens
cuaccuucaagaaccaggca

SEQ ID NO: 1166189 - RNA, 23 nt, Homo sapiens
cuaccuuccccagacuugcacug

SEQ ID NO: 1166190 - RNA, 20 nt, Homo sapiens
cuaccuucuuuggccccuug

SEQ ID NO: 1166191 - RNA, 13 nt, Homo sapiens
cuaccuugccucc

SEQ ID NO: 1166192 - RNA, 20 nt, Homo sapiens
cuaccuugcuagcuagccag

SEQ ID NO: 1166193 - RNA, 22 nt, Homo sapiens
cuaccuugguucccccacugau

SEQ ID NO: 1166194 - RNA, 16 nt, Homo sapiens
cuacguuauacugaaa

SEQ ID NO: 1166195 - RNA, 19 nt, Homo sapiens
cuacuacaaacuucaaaga

SEQ ID NO: 1166196 - RNA, 16 nt, Homo sapiens
cuacuacuaugugcag

SEQ ID NO: 1166197 - RNA, 15 nt, Homo sapiens
cuacuaucucagaga

SEQ ID NO: 1166198 - RNA, 21 nt, Homo sapiens
cuacuauuuuuagcaauguuu

SEQ ID NO: 1166199 - RNA, 20 nt, Homo sapiens
cuacucaggaggcugagaca

SEQ ID NO: 1166200 - RNA, 23 nt, Homo sapiens
cuacucaggaggcugaggcagaa

SEQ ID NO: 1166201 - RNA, 19 nt, Homo sapiens
cuacuccccuuucuuccaa

SEQ ID NO: 1166202 - RNA, 23 nt, Homo sapiens
cuacucgggaggcugaggcacaa

SEQ ID NO: 1166203 - RNA, 16 nt, Homo sapiens
cuacucucaugcugca

SEQ ID NO: 1166204 - RNA, 23 nt, Homo sapiens
cuacucuguuccuucacauccug

SEQ ID NO: 1166205 - RNA, 22 nt, Homo sapiens
cuacugggacugcaaccuagac

SEQ ID NO: 1166206 - RNA, 19 nt, Homo sapiens
cuacugggagccuacccac

SEQ ID NO: 1166207 - RNA, 22 nt, Homo sapiens
cuacugggcugcauucccauga

SEQ ID NO: 1166208 - RNA, 22 nt, Homo sapiens
cuacuggggacugugcucacua

SEQ ID NO: 1166209 - RNA, 15 nt, Homo sapiens
cuacuguacuauuua

SEQ ID NO: 1166210 - RNA, 12 nt, Homo sapiens
cuacuugaguua

SEQ ID NO: 1166211 - RNA, 23 nt, Homo sapiens
cuacuuguuucaaaugugucaaa

SEQ ID NO: 1166212 - RNA, 18 nt, Homo sapiens
cuacuuuucuuuccucag

SEQ ID NO: 1166213 - RNA, 13 nt, Homo sapiens
cuacuuuugggaa

SEQ ID NO: 1166214 - RNA, 21 nt, Homo sapiens
cucacucuugaaguccaggac

SEQ ID NO: 1166215 - RNA, 22 nt, Homo sapiens
cucacugccaucaaacuguaaa

SEQ ID NO: 1166216 - RNA, 21 nt, Homo sapiens
cucacugugggaaggccagcu

SEQ ID NO: 1166217 - RNA, 14 nt, Homo sapiens
cucacuguugcagu

SEQ ID NO: 1166218 - RNA, 15 nt, Homo sapiens
cucacuguugcagug

SEQ ID NO: 1166219 - RNA, 22 nt, Homo sapiens
cucagaaugaaaauucauuccc

SEQ ID NO: 1166220 - RNA, 20 nt, Homo sapiens
cucagacacaaauaaaggaa

SEQ ID NO: 1166221 - RNA, 12 nt, Homo sapiens
cucagaccagcu

SEQ ID NO: 1166222 - RNA, 17 nt, Homo sapiens
cucagacugcacccagg

SEQ ID NO: 1166223 - RNA, 23 nt, Homo sapiens
cucagagaaaagagauugagaug

SEQ ID NO: 1166224 - RNA, 20 nt, Homo sapiens
cucagagaccugaagugugc

SEQ ID NO: 1166225 - RNA, 17 nt, Homo sapiens
cucagagcagaguauua

SEQ ID NO: 1166226 - RNA, 18 nt, Homo sapiens
cucagaggguguccugca

SEQ ID NO: 1166227 - RNA, 21 nt, Homo sapiens
cucagaguucuauacuguaaa

SEQ ID NO: 1166228 - RNA, 23 nt, Homo sapiens
cucagauaagguaaaaugccaug

SEQ ID NO: 1166229 - RNA, 13 nt, Homo sapiens
cucagaucacugc

SEQ ID NO: 1166230 - RNA, 18 nt, Homo sapiens
cucagaugaacaauuaug

SEQ ID NO: 1166231 - RNA, 23 nt, Homo sapiens
cucagauggauugauaauugcau

SEQ ID NO: 1166232 - RNA, 14 nt, Homo sapiens
cucagcaagccaug

SEQ ID NO: 1166233 - RNA, 21 nt, Homo sapiens
cucagcacuuugggaggccaa

SEQ ID NO: 1166234 - RNA, 14 nt, Homo sapiens
cucagcauuuccac

SEQ ID NO: 1166235 - RNA, 15 nt, Homo sapiens
cucagccaagcacag

SEQ ID NO: 1166236 - RNA, 18 nt, Homo sapiens
cucagccaagcacagugg

SEQ ID NO: 1166237 - RNA, 23 nt, Homo sapiens
cucagcccugggccccaccaccu

SEQ ID NO: 1166238 - RNA, 20 nt, Homo sapiens
cucagccucccgaguagcug

SEQ ID NO: 1166239 - RNA, 17 nt, Homo sapiens
cucagccuguugcggau

SEQ ID NO: 1166240 - RNA, 14 nt, Homo sapiens
cucagcucccacaa

SEQ ID NO: 1166241 - RNA, 16 nt, Homo sapiens
cucagcucggggagcc

SEQ ID NO: 1166242 - RNA, 20 nt, Homo sapiens
cucagcucggggagccuuag

SEQ ID NO: 1166243 - RNA, 19 nt, Homo sapiens
cucagcucuuggcuccacu

SEQ ID NO: 1166244 - RNA, 13 nt, Homo sapiens
cucagcugcugaa

SEQ ID NO: 1166245 - RNA, 21 nt, Homo sapiens
cucaggaagcccccaaguuga

SEQ ID NO: 1166246 - RNA, 18 nt, Homo sapiens
cucaggaagccucugggu

SEQ ID NO: 1166247 - RNA, 21 nt, Homo sapiens
cucaggaggcugagacaggag

SEQ ID NO: 1166248 - RNA, 21 nt, Homo sapiens
cucaggccacaucuuuuccaa

SEQ ID NO: 1166249 - RNA, 22 nt, Homo sapiens
cucaggcuggcuugagugaauu

SEQ ID NO: 1166250 - RNA, 21 nt, Homo sapiens
cucagggcagcugccuggcca

SEQ ID NO: 1166251 - RNA, 22 nt, Homo sapiens
cucagguagaagguugacacag

SEQ ID NO: 1166252 - RNA, 14 nt, Homo sapiens
cucagguguagcug

SEQ ID NO: 1166253 - RNA, 15 nt, Homo sapiens
cucaguccacugcug

SEQ ID NO: 1166254 - RNA, 18 nt, Homo sapiens
cucagucucugagcagug

SEQ ID NO: 1166255 - RNA, 13 nt, Homo sapiens
cucaguggcucug

SEQ ID NO: 1166256 - RNA, 15 nt, Homo sapiens
cucaguucugccuua

SEQ ID NO: 1166257 - RNA, 23 nt, Homo sapiens
cucaguuucauuaacuggugaau

SEQ ID NO: 1166258 - RNA, 16 nt, Homo sapiens
cucauaaaguagauua

SEQ ID NO: 1166259 - RNA, 14 nt, Homo sapiens
cucauacacagaaa

SEQ ID NO: 1166260 - RNA, 14 nt, Homo sapiens
cucaucccacccgc

SEQ ID NO: 1166261 - RNA, 15 nt, Homo sapiens
cucaucugacuugaa

SEQ ID NO: 1166262 - RNA, 20 nt, Homo sapiens
cucaucugaggcauccagca

SEQ ID NO: 1166263 - RNA, 15 nt, Homo sapiens
cucaucuuacuguac

SEQ ID NO: 1166264 - RNA, 16 nt, Homo sapiens
cucaucuuucuuccaa

SEQ ID NO: 1166265 - RNA, 18 nt, Homo sapiens
cucaugugacucuuucca

SEQ ID NO: 1166266 - RNA, 18 nt, Homo sapiens
cucauucccuccccagaa

SEQ ID NO: 1166267 - RNA, 22 nt, Homo sapiens
cucauuuaauuuuuauuaaaca

SEQ ID NO: 1166268 - RNA, 16 nt, Homo sapiens
cucauuuaucccucaa

SEQ ID NO: 1166269 - RNA, 17 nt, Homo sapiens
cuccaacagccagugug

SEQ ID NO: 1166270 - RNA, 13 nt, Homo sapiens
cuccaacuccuga

SEQ ID NO: 1166271 - RNA, 19 nt, Homo sapiens
cuccaacugaaauguuaag

SEQ ID NO: 1166272 - RNA, 17 nt, Homo sapiens
cuccaagacagauuuuc

SEQ ID NO: 1166273 - RNA, 17 nt, Homo sapiens
cuccaagccacugagca

SEQ ID NO: 1166274 - RNA, 15 nt, Homo sapiens
cuccaccacgcuggg

SEQ ID NO: 1166275 - RNA, 18 nt, Homo sapiens
cuccaccccgacugcuca

SEQ ID NO: 1166276 - RNA, 16 nt, Homo sapiens
cuccacuaauacuggu

SEQ ID NO: 1166277 - RNA, 22 nt, Homo sapiens
cuccacucuuugaucagaaaca

SEQ ID NO: 1166278 - RNA, 13 nt, Homo sapiens
cuccagaagcacu

SEQ ID NO: 1166279 - RNA, 19 nt, Homo sapiens
cuccagacauacaaacaua

SEQ ID NO: 1166280 - RNA, 18 nt, Homo sapiens
cuccagaugcagggcagu

SEQ ID NO: 1166281 - RNA, 20 nt, Homo sapiens
cuccagauguuuccagacuu

SEQ ID NO: 1166282 - RNA, 16 nt, Homo sapiens
cuccagcacaaacaca

SEQ ID NO: 1166283 - RNA, 15 nt, Homo sapiens
cuccagcacuaccaa

SEQ ID NO: 1166284 - RNA, 21 nt, Homo sapiens
cuccagccugacuuggggaga

SEQ ID NO: 1166285 - RNA, 16 nt, Homo sapiens
cuccagcgauggugcu

SEQ ID NO: 1166286 - RNA, 17 nt, Homo sapiens
cuccagcgguugccuuu

SEQ ID NO: 1166287 - RNA, 14 nt, Homo sapiens
cuccaggauuuccu

SEQ ID NO: 1166288 - RNA, 18 nt, Homo sapiens
cuccaggcccaaggcucc

SEQ ID NO: 1166289 - RNA, 16 nt, Homo sapiens
cuccaggcugggugac

SEQ ID NO: 1166290 - RNA, 17 nt, Homo sapiens
cuccagggucagaaaca

SEQ ID NO: 1166291 - RNA, 13 nt, Homo sapiens
cuccaggugcaga

SEQ ID NO: 1166292 - RNA, 16 nt, Homo sapiens
cuccaguaacagccua

SEQ ID NO: 1166293 - RNA, 13 nt, Homo sapiens
cuccagugcaguc

SEQ ID NO: 1166294 - RNA, 16 nt, Homo sapiens
cuccaucgcaguguuc

SEQ ID NO: 1166295 - RNA, 14 nt, Homo sapiens
cuccaucuccugac

SEQ ID NO: 1166296 - RNA, 17 nt, Homo sapiens
cuccaugguggggccaa

SEQ ID NO: 1166297 - RNA, 14 nt, Homo sapiens
cucccaaaacauuu

SEQ ID NO: 1166298 - RNA, 19 nt, Homo sapiens
cucccaaagugcugggauu

SEQ ID NO: 1166299 - RNA, 12 nt, Homo sapiens
cucccacuuugc

SEQ ID NO: 1166300 - RNA, 17 nt, Homo sapiens
cucccagacuaccugcc

SEQ ID NO: 1166301 - RNA, 12 nt, Homo sapiens
cucccagaguuu

SEQ ID NO: 1166302 - RNA, 17 nt, Homo sapiens
cucccagauaaugugaa

SEQ ID NO: 1166303 - RNA, 21 nt, Homo sapiens
cucccaguauuacccuggaug

SEQ ID NO: 1166304 - RNA, 12 nt, Homo sapiens
cucccaucuuag

SEQ ID NO: 1166305 - RNA, 16 nt, Homo sapiens
cuccccacccaagaga

SEQ ID NO: 1166306 - RNA, 16 nt, Homo sapiens
cuccccacuagcauuu

SEQ ID NO: 1166307 - RNA, 17 nt, Homo sapiens
cuccccagcccagagac

SEQ ID NO: 1166308 - RNA, 19 nt, Homo sapiens
cuccccaguagcugggauu

SEQ ID NO: 1166309 - RNA, 20 nt, Homo sapiens
cuccccaguagcugggauua

SEQ ID NO: 1166310 - RNA, 16 nt, Homo sapiens
cuccccauuagcuuuc

SEQ ID NO: 1166311 - RNA, 15 nt, Homo sapiens
cucccccaacacaaa

SEQ ID NO: 1166312 - RNA, 14 nt, Homo sapiens
cuccccccacugca

SEQ ID NO: 1166313 - RNA, 17 nt, Homo sapiens
cucccccugccagugcc

SEQ ID NO: 1166314 - RNA, 16 nt, Homo sapiens
cuccccgagggcucag

SEQ ID NO: 1166315 - RNA, 12 nt, Homo sapiens
cuccccuaucca

SEQ ID NO: 1166316 - RNA, 13 nt, Homo sapiens
cucccuaccuugc

SEQ ID NO: 1166317 - RNA, 19 nt, Homo sapiens
cucccuaguuagcauccag

SEQ ID NO: 1166318 - RNA, 21 nt, Homo sapiens
cucccugaagccuuugcauuu

SEQ ID NO: 1166319 - RNA, 19 nt, Homo sapiens
cucccugguguaguguauu

SEQ ID NO: 1166320 - RNA, 13 nt, Homo sapiens
cuccgaggccagu

SEQ ID NO: 1166321 - RNA, 17 nt, Homo sapiens
cuccguaugaugugaua

SEQ ID NO: 1166322 - RNA, 18 nt, Homo sapiens
cuccuacccuggcccuuu

SEQ ID NO: 1166323 - RNA, 12 nt, Homo sapiens
cuccuacuguag

SEQ ID NO: 1166324 - RNA, 17 nt, Homo sapiens
cuccuagauccagggau

SEQ ID NO: 1166325 - RNA, 19 nt, Homo sapiens
cuccuagccccuucuucca

SEQ ID NO: 1166326 - RNA, 10 nt, Homo sapiens
cuccuaggcc

SEQ ID NO: 1166327 - RNA, 22 nt, Homo sapiens
cuccuaucuuuuauuucauuca

SEQ ID NO: 1166328 - RNA, 19 nt, Homo sapiens
cuccucacucaccuucagu

SEQ ID NO: 1166329 - RNA, 19 nt, Homo sapiens
cuccucaggcacacagcua

SEQ ID NO: 1166330 - RNA, 22 nt, Homo sapiens
cuccucauucagaccaaucuua

SEQ ID NO: 1166331 - RNA, 15 nt, Homo sapiens
cuccuccguggcaca

SEQ ID NO: 1166332 - RNA, 19 nt, Homo sapiens
cuccuccuuuuuccuucca

SEQ ID NO: 1166333 - RNA, 17 nt, Homo sapiens
cuccucgacaucacugu

SEQ ID NO: 1166334 - RNA, 15 nt, Homo sapiens
cuccucgagauccca

SEQ ID NO: 1166335 - RNA, 13 nt, Homo sapiens
cuccucucagcuu

SEQ ID NO: 1166336 - RNA, 16 nt, Homo sapiens
cuccucucccagugac

SEQ ID NO: 1166337 - RNA, 22 nt, Homo sapiens
cuccucugacuuggggcagcuu

SEQ ID NO: 1166338 - RNA, 18 nt, Homo sapiens
cuccucuuaauguuucca

SEQ ID NO: 1166339 - RNA, 22 nt, Homo sapiens
cuccucuuucaaccucagugau

SEQ ID NO: 1166340 - RNA, 14 nt, Homo sapiens
cuccugaagccaca

SEQ ID NO: 1166341 - RNA, 22 nt, Homo sapiens
cuccugaagggaaggcaaaggc

SEQ ID NO: 1166342 - RNA, 17 nt, Homo sapiens
cuccugaaggucugggu

SEQ ID NO: 1166343 - RNA, 17 nt, Homo sapiens
cuccugagccacucaga

SEQ ID NO: 1166344 - RNA, 23 nt, Homo sapiens
cuccugaggcuuuggauuugaca

SEQ ID NO: 1166345 - RNA, 11 nt, Homo sapiens
cuccugaggga

SEQ ID NO: 1166346 - RNA, 16 nt, Homo sapiens
cuccugagggagcucc

SEQ ID NO: 1166347 - RNA, 19 nt, Homo sapiens
cuccugaguagcuggauua

SEQ ID NO: 1166348 - RNA, 20 nt, Homo sapiens
cuccugaguagcugggauua

SEQ ID NO: 1166349 - RNA, 20 nt, Homo sapiens
gaccagccagugucuguuca

SEQ ID NO: 1166350 - RNA, 17 nt, Homo sapiens
gaccagcccaccccugu

SEQ ID NO: 1166351 - RNA, 15 nt, Homo sapiens
gaccauaaagggaaa

SEQ ID NO: 1166352 - RNA, 15 nt, Homo sapiens
gaccauaaccacuga

SEQ ID NO: 1166353 - RNA, 20 nt, Homo sapiens
gaccauaucacaagugauug

SEQ ID NO: 1166354 - RNA, 22 nt, Homo sapiens
gaccaugguagaaaaugcacca

SEQ ID NO: 1166355 - RNA, 18 nt, Homo sapiens
gaccaugguauauuccua

SEQ ID NO: 1166356 - RNA, 14 nt, Homo sapiens
gacccaaguagcug

SEQ ID NO: 1166357 - RNA, 18 nt, Homo sapiens
gacccaaguagcugcuac

SEQ ID NO: 1166358 - RNA, 17 nt, Homo sapiens
gacccacacugcuacac

SEQ ID NO: 1166359 - RNA, 20 nt, Homo sapiens
gaccccaaaaagaguuacac

SEQ ID NO: 1166360 - RNA, 17 nt, Homo sapiens
gaccccaauauauguau

SEQ ID NO: 1166361 - RNA, 20 nt, Homo sapiens
gacccccguggggcagggag

SEQ ID NO: 1166362 - RNA, 19 nt, Homo sapiens
gaccccuccuggggccagg

SEQ ID NO: 1166363 - RNA, 14 nt, Homo sapiens
gacccggcggcccu

SEQ ID NO: 1166364 - RNA, 23 nt, Homo sapiens
gaccuaaaaugaaguaacacaau

SEQ ID NO: 1166365 - RNA, 13 nt, Homo sapiens
gaccuacuguucu

SEQ ID NO: 1166366 - RNA, 18 nt, Homo sapiens
gaccuauuagaguauuuu

SEQ ID NO: 1166367 - RNA, 16 nt, Homo sapiens
gaccucaccuagaaau

SEQ ID NO: 1166368 - RNA, 21 nt, Homo sapiens
gaccucauuaaccgaugcuuu

SEQ ID NO: 1166369 - RNA, 20 nt, Homo sapiens
gaccuccagggagccuagaa

SEQ ID NO: 1166370 - RNA, 15 nt, Homo sapiens
gaccucccacugccc

SEQ ID NO: 1166371 - RNA, 17 nt, Homo sapiens
gaccucucucagcccca

SEQ ID NO: 1166372 - RNA, 14 nt, Homo sapiens
gaccugacaccuuu

SEQ ID NO: 1166373 - RNA, 20 nt, Homo sapiens
gaccugggagcccucaggca

SEQ ID NO: 1166374 - RNA, 19 nt, Homo sapiens
gaccugggggagccgacca

SEQ ID NO: 1166375 - RNA, 21 nt, Homo sapiens
gaccuggugcucuaaugccaa

SEQ ID NO: 1166376 - RNA, 18 nt, Homo sapiens
gaccuuaaaugcuacuga

SEQ ID NO: 1166377 - RNA, 17 nt, Homo sapiens
gaccuuaggccuuccuc

SEQ ID NO: 1166378 - RNA, 15 nt, Homo sapiens
gaccuucagagccag

SEQ ID NO: 1166379 - RNA, 20 nt, Homo sapiens
gacgcauuucgguugagaau

SEQ ID NO: 1166380 - RNA, 15 nt, Homo sapiens
gacgcugcugccgug

SEQ ID NO: 1166381 - RNA, 11 nt, Homo sapiens
gacgcugugcu

SEQ ID NO: 1166382 - RNA, 16 nt, Homo sapiens
gacggcugugggacca

SEQ ID NO: 1166383 - RNA, 18 nt, Homo sapiens
gacguugccaucaaaaca

SEQ ID NO: 1166384 - RNA, 22 nt, Homo sapiens
gacuaaaauguuucauuuaccu

SEQ ID NO: 1166385 - RNA, 17 nt, Homo sapiens
gacuaaacuacauuaua

SEQ ID NO: 1166386 - RNA, 19 nt, Homo sapiens
gacuaauccaauaccucuu

SEQ ID NO: 1166387 - RNA, 20 nt, Homo sapiens
gacuagcgccucuccccggg

SEQ ID NO: 1166388 - RNA, 18 nt, Homo sapiens
gacuaugauggaccagcc

SEQ ID NO: 1166389 - RNA, 21 nt, Homo sapiens
gacuauuuacaagacugcuga

SEQ ID NO: 1166390 - RNA, 20 nt, Homo sapiens
gacucaccuguucucacucc

SEQ ID NO: 1166391 - RNA, 15 nt, Homo sapiens
gacucagagugcaag

SEQ ID NO: 1166392 - RNA, 22 nt, Homo sapiens
gacucagcucugucugcucaau

SEQ ID NO: 1166393 - RNA, 15 nt, Homo sapiens
gacucaggacauccc

SEQ ID NO: 1166394 - RNA, 18 nt, Homo sapiens
gacucauccugaacagca

SEQ ID NO: 1166395 - RNA, 16 nt, Homo sapiens
gacuccaucucaaaaa

SEQ ID NO: 1166396 - RNA, 18 nt, Homo sapiens
gacuccaucuccugaccu

SEQ ID NO: 1166397 - RNA, 14 nt, Homo sapiens
gacuccaucucuca

SEQ ID NO: 1166398 - RNA, 12 nt, Homo sapiens
gacucugacccc

SEQ ID NO: 1166399 - RNA, 16 nt, Homo sapiens
gacucugcacaugucu

SEQ ID NO: 1166400 - RNA, 18 nt, Homo sapiens
gacucuuuccaaccggcu

SEQ ID NO: 1166401 - RNA, 14 nt, Homo sapiens
gacugaaaagccau

SEQ ID NO: 1166402 - RNA, 17 nt, Homo sapiens
gacugaacuuacacugu

SEQ ID NO: 1166403 - RNA, 21 nt, Homo sapiens
gacugaggcaggcauggaguu

SEQ ID NO: 1166404 - RNA, 12 nt, Homo sapiens
gacugauuucaa

SEQ ID NO: 1166405 - RNA, 13 nt, Homo sapiens
gacuggugcugca

SEQ ID NO: 1166406 - RNA, 17 nt, Homo sapiens
gacuguaggauuugaag

SEQ ID NO: 1166407 - RNA, 15 nt, Homo sapiens
gacuguauuuuccaa

SEQ ID NO: 1166408 - RNA, 21 nt, Homo sapiens
gacugugccagcacaaagugg

SEQ ID NO: 1166409 - RNA, 17 nt, Homo sapiens
gacugugcucacuaccu

SEQ ID NO: 1166410 - RNA, 18 nt, Homo sapiens
gacuguggcaaacaaaac

SEQ ID NO: 1166411 - RNA, 23 nt, Homo sapiens
gacuuacuaugggauggggucca

SEQ ID NO: 1166412 - RNA, 15 nt, Homo sapiens
gacuuagaacaccgc

SEQ ID NO: 1166413 - RNA, 20 nt, Homo sapiens
gacuucaugacaagcauuuu

SEQ ID NO: 1166414 - RNA, 14 nt, Homo sapiens
gacuuccacuuugu

SEQ ID NO: 1166415 - RNA, 16 nt, Homo sapiens
gacuuccccgcauucc

SEQ ID NO: 1166416 - RNA, 14 nt, Homo sapiens
gacuucugcaucuu

SEQ ID NO: 1166417 - RNA, 17 nt, Homo sapiens
gacuugauacugcaaua

SEQ ID NO: 1166418 - RNA, 17 nt, Homo sapiens
gacuuggagaauacugc

SEQ ID NO: 1166419 - RNA, 23 nt, Homo sapiens
gacuugggaaacccaaccaguag

SEQ ID NO: 1166420 - RNA, 16 nt, Homo sapiens
gacuuucagaguccuu

SEQ ID NO: 1166421 - RNA, 22 nt, Homo sapiens
gacuuucugaagccucacuuau

SEQ ID NO: 1166422 - RNA, 15 nt, Homo sapiens
gacuuucuguuacua

SEQ ID NO: 1166423 - RNA, 19 nt, Homo sapiens
gacuuugaauaaugugaua

SEQ ID NO: 1166424 - RNA, 17 nt, Homo sapiens
gagaaaagaaaccagag

SEQ ID NO: 1166425 - RNA, 20 nt, Homo sapiens
gagaaaaguugacaccugag

SEQ ID NO: 1166426 - RNA, 16 nt, Homo sapiens
gagaaaauguuguaua

SEQ ID NO: 1166427 - RNA, 15 nt, Homo sapiens
gagaaacaauggcua

SEQ ID NO: 1166428 - RNA, 14 nt, Homo sapiens
gagaaacacuauuu

SEQ ID NO: 1166429 - RNA, 14 nt, Homo sapiens
gagaaagaaaggga

SEQ ID NO: 1166430 - RNA, 18 nt, Homo sapiens
gagaaagggacaaugaua

SEQ ID NO: 1166431 - RNA, 19 nt, Homo sapiens
gagaaagguggacuggaag

SEQ ID NO: 1166432 - RNA, 19 nt, Homo sapiens
gagaaaucuauagaacuga

SEQ ID NO: 1166433 - RNA, 16 nt, Homo sapiens
gagaaaucuggcuucu

SEQ ID NO: 1166434 - RNA, 16 nt, Homo sapiens
gagaaccaacaaguaa

SEQ ID NO: 1166435 - RNA, 20 nt, Homo sapiens
gagaaccauaggacuguggc

SEQ ID NO: 1166436 - RNA, 14 nt, Homo sapiens
gagaacuccagcug

SEQ ID NO: 1166437 - RNA, 11 nt, Homo sapiens
gagaagcaaaa

SEQ ID NO: 1166438 - RNA, 20 nt, Homo sapiens
gagaaggaacuuugucacau

SEQ ID NO: 1166439 - RNA, 19 nt, Homo sapiens
gagaagguggaccuggcag

SEQ ID NO: 1166440 - RNA, 17 nt, Homo sapiens
gagaaguauacucuuga

SEQ ID NO: 1166441 - RNA, 14 nt, Homo sapiens
gagaaguuaagcaa

SEQ ID NO: 1166442 - RNA, 22 nt, Homo sapiens
gagaauauugaaguacuugcca

SEQ ID NO: 1166443 - RNA, 18 nt, Homo sapiens
gagaaugcccacugccug

SEQ ID NO: 1166444 - RNA, 23 nt, Homo sapiens
gagaauuagaaacaacauagcaa

SEQ ID NO: 1166445 - RNA, 14 nt, Homo sapiens
gagacagugcacau

SEQ ID NO: 1166446 - RNA, 14 nt, Homo sapiens
gagacauacuugaa

SEQ ID NO: 1166447 - RNA, 22 nt, Homo sapiens
gagacauacuugaagggccaga

SEQ ID NO: 1166448 - RNA, 22 nt, Homo sapiens
gagaccaggggaccagagggau

SEQ ID NO: 1166449 - RNA, 17 nt, Homo sapiens
gagacccaagcugccuc

SEQ ID NO: 1166450 - RNA, 22 nt, Homo sapiens
gagacccaagggcagagcauuu

SEQ ID NO: 1166451 - RNA, 13 nt, Homo sapiens
gagacccgccugg

SEQ ID NO: 1166452 - RNA, 13 nt, Homo sapiens
gagacugaucccu

SEQ ID NO: 1166453 - RNA, 19 nt, Homo sapiens
gagacugaucccuggccac

SEQ ID NO: 1166454 - RNA, 16 nt, Homo sapiens
gagacuguuaucagga

SEQ ID NO: 1166455 - RNA, 11 nt, Homo sapiens
gagacuugccu

SEQ ID NO: 1166456 - RNA, 19 nt, Homo sapiens
gagagaacugagcaucucc

SEQ ID NO: 1166457 - RNA, 13 nt, Homo sapiens
gagagacuguuau

SEQ ID NO: 1166458 - RNA, 13 nt, Homo sapiens
gagagacuuggau

SEQ ID NO: 1166459 - RNA, 16 nt, Homo sapiens
gagagcgccugccccu

SEQ ID NO: 1166460 - RNA, 19 nt, Homo sapiens
gagagcggggaugugacau

SEQ ID NO: 1166461 - RNA, 13 nt, Homo sapiens
gagagcuggccaa

SEQ ID NO: 1166462 - RNA, 14 nt, Homo sapiens
gagaggaagccuga

SEQ ID NO: 1166463 - RNA, 12 nt, Homo sapiens
gagagggcugcu

SEQ ID NO: 1166464 - RNA, 13 nt, Homo sapiens
gagaggggaccau

SEQ ID NO: 1166465 - RNA, 14 nt, Homo sapiens
gagagggugacaag

SEQ ID NO: 1166466 - RNA, 13 nt, Homo sapiens
gagaguccaucag

SEQ ID NO: 1166467 - RNA, 14 nt, Homo sapiens
gagaguccaucagc

SEQ ID NO: 1166468 - RNA, 19 nt, Homo sapiens
gagagugucuucacggcag

SEQ ID NO: 1166469 - RNA, 16 nt, Homo sapiens
gagauaaaccaauaaa

SEQ ID NO: 1166470 - RNA, 13 nt, Homo sapiens
gagauaaagaaua

SEQ ID NO: 1166471 - RNA, 17 nt, Homo sapiens
gagauagcauugugaac

SEQ ID NO: 1166472 - RNA, 16 nt, Homo sapiens
gagauaggguggcaca

SEQ ID NO: 1166473 - RNA, 17 nt, Homo sapiens
gagauaggguggcacau

SEQ ID NO: 1166474 - RNA, 22 nt, Homo sapiens
gagaucacgucacugcacucca

SEQ ID NO: 1166475 - RNA, 11 nt, Homo sapiens
gagaucccaac

SEQ ID NO: 1166476 - RNA, 19 nt, Homo sapiens
gagaucguccacugucaag

SEQ ID NO: 1166477 - RNA, 21 nt, Homo sapiens
gagaucgugccacugcacucc

SEQ ID NO: 1166478 - RNA, 16 nt, Homo sapiens
gagaugaccccaucaa

SEQ ID NO: 1166479 - RNA, 14 nt, Homo sapiens
gagaugagacugau

SEQ ID NO: 1166480 - RNA, 16 nt, Homo sapiens
gagaugauacauccaa

SEQ ID NO: 1166481 - RNA, 15 nt, Homo sapiens
gagaugcaaauagca

SEQ ID NO: 1166482 - RNA, 12 nt, Homo sapiens
gagaugcagcug

SEQ ID NO: 1166483 - RNA, 16 nt, Homo sapiens
gagauggggguguauu

SEQ ID NO: 1166484 - RNA, 17 nt, Homo sapiens
gagauggguuugacaag

SEQ ID NO: 1166485 - RNA, 14 nt, Homo sapiens
gacacaaacacaca

SEQ ID NO: 1166486 - RNA, 16 nt, Homo sapiens
gacacaaauaaaggaa

SEQ ID NO: 1166487 - RNA, 15 nt, Homo sapiens
gacacacggucaggg

SEQ ID NO: 1166488 - RNA, 19 nt, Homo sapiens
gacacagacucauccugaa

SEQ ID NO: 1166489 - RNA, 19 nt, Homo sapiens
gacacagcaccgugccaac

SEQ ID NO: 1166490 - RNA, 18 nt, Homo sapiens
gacacagcccugaaucag

SEQ ID NO: 1166491 - RNA, 12 nt, Homo sapiens
gacacagggaag

SEQ ID NO: 1166492 - RNA, 19 nt, Homo sapiens
gacacauaugcaccuugug

SEQ ID NO: 1166493 - RNA, 12 nt, Homo sapiens
gacacauucaca

SEQ ID NO: 1166494 - RNA, 18 nt, Homo sapiens
gacaccuucugugcucau

SEQ ID NO: 1166495 - RNA, 12 nt, Homo sapiens
gacacucagggc

SEQ ID NO: 1166496 - RNA, 14 nt, Homo sapiens
gacacucuccuugc

SEQ ID NO: 1166497 - RNA, 19 nt, Homo sapiens
gacacuggcguuacugcuu

SEQ ID NO: 1166498 - RNA, 20 nt, Homo sapiens
gacacuguggagacuuucug

SEQ ID NO: 1166499 - RNA, 22 nt, Homo sapiens
gacacuucuaaaugaagugcaa

SEQ ID NO: 1166500 - RNA, 18 nt, Homo sapiens
gacagacaacacugggaa

SEQ ID NO: 1166501 - RNA, 16 nt, Homo sapiens
gacagaccaaaaauca

SEQ ID NO: 1166502 - RNA, 20 nt, Homo sapiens
gacagagccucgcucuguua

SEQ ID NO: 1166503 - RNA, 20 nt, Homo sapiens
gacagaucaagcugugagac

SEQ ID NO: 1166504 - RNA, 16 nt, Homo sapiens
gacagcagccugugag

SEQ ID NO: 1166505 - RNA, 21 nt, Homo sapiens
gacagcuugaucaaaggcaca

SEQ ID NO: 1166506 - RNA, 18 nt, Homo sapiens
gacagcuuuccucaaaaa

SEQ ID NO: 1166507 - RNA, 17 nt, Homo sapiens
gacaggacgaggcagaa

SEQ ID NO: 1166508 - RNA, 20 nt, Homo sapiens
gacaggagaaacacuugaac

SEQ ID NO: 1166509 - RNA, 21 nt, Homo sapiens
gacaggaggucagcacaagau

SEQ ID NO: 1166510 - RNA, 13 nt, Homo sapiens
gacaggauguguu

SEQ ID NO: 1166511 - RNA, 19 nt, Homo sapiens
gacagguguauggagucac

SEQ ID NO: 1166512 - RNA, 15 nt, Homo sapiens
gacaguauccacaau

SEQ ID NO: 1166513 - RNA, 16 nt, Homo sapiens
gacagugaccccaguc

SEQ ID NO: 1166514 - RNA, 21 nt, Homo sapiens
gacagugcacaugaacugucu

SEQ ID NO: 1166515 - RNA, 16 nt, Homo sapiens
gacaguuaaguauuuu

SEQ ID NO: 1166516 - RNA, 21 nt, Homo sapiens
gacaguuuguggcaucuugcc

SEQ ID NO: 1166517 - RNA, 22 nt, Homo sapiens
gacaguuuguggcaucuugcca

SEQ ID NO: 1166518 - RNA, 19 nt, Homo sapiens
gacaguuuuugacauuuau

SEQ ID NO: 1166519 - RNA, 22 nt, Homo sapiens
gacauagaaaguucauggaacu

SEQ ID NO: 1166520 - RNA, 16 nt, Homo sapiens
gacauagaagagccaa

SEQ ID NO: 1166521 - RNA, 21 nt, Homo sapiens
gacauaggacucaaaguuuca

SEQ ID NO: 1166522 - RNA, 18 nt, Homo sapiens
gacauagucucuaccuau

SEQ ID NO: 1166523 - RNA, 11 nt, Homo sapiens
gacaucacugu

SEQ ID NO: 1166524 - RNA, 20 nt, Homo sapiens
gacauccccccgccaaaagc

SEQ ID NO: 1166525 - RNA, 20 nt, Homo sapiens
gacaucuuccgagaaacagg

SEQ ID NO: 1166526 - RNA, 16 nt, Homo sapiens
gacaugaaagguuggc

SEQ ID NO: 1166527 - RNA, 17 nt, Homo sapiens
gacaugcccaaggccac

SEQ ID NO: 1166528 - RNA, 18 nt, Homo sapiens
gacaugcccaaggccacg

SEQ ID NO: 1166529 - RNA, 13 nt, Homo sapiens
gacaugcccugug

SEQ ID NO: 1166530 - RNA, 15 nt, Homo sapiens
gacaugcuaaauaac

SEQ ID NO: 1166531 - RNA, 16 nt, Homo sapiens
gacaugcuaaauaacu

SEQ ID NO: 1166532 - RNA, 17 nt, Homo sapiens
gacaugcuacaacuacu

SEQ ID NO: 1166533 - RNA, 14 nt, Homo sapiens
gacauggagguucu

SEQ ID NO: 1166534 - RNA, 13 nt, Homo sapiens
gacaugucucaca

SEQ ID NO: 1166535 - RNA, 21 nt, Homo sapiens
gacaugucucacagacgcucc

SEQ ID NO: 1166536 - RNA, 13 nt, Homo sapiens
gacauuaacucau

SEQ ID NO: 1166537 - RNA, 20 nt, Homo sapiens
gacauuagauugaugugcac

SEQ ID NO: 1166538 - RNA, 14 nt, Homo sapiens
gacauugcauuugg

SEQ ID NO: 1166539 - RNA, 19 nt, Homo sapiens
gacauugggucuauuccag

SEQ ID NO: 1166540 - RNA, 14 nt, Homo sapiens
gacauuuuuccucu

SEQ ID NO: 1166541 - RNA, 22 nt, Homo sapiens
gaccaagcaggaagcucagacu

SEQ ID NO: 1166542 - RNA, 19 nt, Homo sapiens
gaccaaugucuugaugcau

SEQ ID NO: 1166543 - RNA, 13 nt, Homo sapiens
gaccacaacuauu

SEQ ID NO: 1166544 - RNA, 22 nt, Homo sapiens
gaccacaacuauuuucagaugu

SEQ ID NO: 1166545 - RNA, 17 nt, Homo sapiens
gaccacagcacagccaa

SEQ ID NO: 1166546 - RNA, 19 nt, Homo sapiens
gaccacagcacagccaaca

SEQ ID NO: 1166547 - RNA, 20 nt, Homo sapiens
gaccaccauuggaacaacca

SEQ ID NO: 1166548 - RNA, 16 nt, Homo sapiens
gaccagacugcacagg

SEQ ID NO: 1166549 - RNA, 17 nt, Homo sapiens
gaccagagugggaccaa

SEQ ID NO: 1166550 - RNA, 18 nt, Homo sapiens
gcccugggacaucaggag

SEQ ID NO: 1166551 - RNA, 19 nt, Homo sapiens
gcccuguaacaggcuugaa

SEQ ID NO: 1166552 - RNA, 22 nt, Homo sapiens
gcccuucagucuuaauacuuua

SEQ ID NO: 1166553 - RNA, 10 nt, Homo sapiens
gcccuuccag

SEQ ID NO: 1166554 - RNA, 23 nt, Homo sapiens
gcccuucuuccccuucccugacu

SEQ ID NO: 1166555 - RNA, 12 nt, Homo sapiens
gcccuuuccucc

SEQ ID NO: 1166556 - RNA, 13 nt, Homo sapiens
gccgacacuguuc

SEQ ID NO: 1166557 - RNA, 19 nt, Homo sapiens
gccgagaccccaucuucca

SEQ ID NO: 1166558 - RNA, 16 nt, Homo sapiens
gccgagaguccaucag

SEQ ID NO: 1166559 - RNA, 21 nt, Homo sapiens
gccgagaucacgucacugcac

SEQ ID NO: 1166560 - RNA, 24 nt, Homo sapiens
gccgcgcccuuuccccgacgccca

SEQ ID NO: 1166561 - RNA, 15 nt, Homo sapiens
gccgcgugugcgugg

SEQ ID NO: 1166562 - RNA, 16 nt, Homo sapiens
gccggcuuuccucuau

SEQ ID NO: 1166563 - RNA, 16 nt, Homo sapiens
gccgggcaugguggca

SEQ ID NO: 1166564 - RNA, 18 nt, Homo sapiens
gccgggugugguggcaca

SEQ ID NO: 1166565 - RNA, 16 nt, Homo sapiens
gccgucuccauggcau

SEQ ID NO: 1166566 - RNA, 17 nt, Homo sapiens
gccgugagcauguuugg

SEQ ID NO: 1166567 - RNA, 16 nt, Homo sapiens
gccguuguacuccagc

SEQ ID NO: 1166568 - RNA, 18 nt, Homo sapiens
gccguuguacuccagccu

SEQ ID NO: 1166569 - RNA, 21 nt, Homo sapiens
gccuaauaggcaccucuucaa

SEQ ID NO: 1166570 - RNA, 18 nt, Homo sapiens
gccuaauugucacaucaa

SEQ ID NO: 1166571 - RNA, 17 nt, Homo sapiens
gccuagcugcuacaaag

SEQ ID NO: 1166572 - RNA, 20 nt, Homo sapiens
gccuauaaucccagcuacug

SEQ ID NO: 1166573 - RNA, 17 nt, Homo sapiens
gccuauuccugaacuau

SEQ ID NO: 1166574 - RNA, 22 nt, Homo sapiens
gccucaaagggacugccgccau

SEQ ID NO: 1166575 - RNA, 17 nt, Homo sapiens
gccucaagugagccaag

SEQ ID NO: 1166576 - RNA, 20 nt, Homo sapiens
gccucagacugcacccagga

SEQ ID NO: 1166577 - RNA, 15 nt, Homo sapiens
gccucagccagagaa

SEQ ID NO: 1166578 - RNA, 18 nt, Homo sapiens
gccucagcugcaucugau

SEQ ID NO: 1166579 - RNA, 14 nt, Homo sapiens
gccucagggccagg

SEQ ID NO: 1166580 - RNA, 17 nt, Homo sapiens
gccucagggccaggaag

SEQ ID NO: 1166581 - RNA, 18 nt, Homo sapiens
gccucccccgaaugcauu

SEQ ID NO: 1166582 - RNA, 21 nt, Homo sapiens
gccuccccucuccuuccugug

SEQ ID NO: 1166583 - RNA, 16 nt, Homo sapiens
gcuaaacugaugacuu

SEQ ID NO: 1166584 - RNA, 17 nt, Homo sapiens
gcuaaacugaugacuua

SEQ ID NO: 1166585 - RNA, 20 nt, Homo sapiens
gcuaagaauaaacuccauuu

SEQ ID NO: 1166586 - RNA, 17 nt, Homo sapiens
gcuaagcuguuugcuca

SEQ ID NO: 1166587 - RNA, 14 nt, Homo sapiens
gcuaagcuuuacag

SEQ ID NO: 1166588 - RNA, 18 nt, Homo sapiens
gcuaaguauugaauuuca

SEQ ID NO: 1166589 - RNA, 19 nt, Homo sapiens
gcuaauauugauacaauga

SEQ ID NO: 1166590 - RNA, 21 nt, Homo sapiens
gcuacaaaaguuaaugaauau

SEQ ID NO: 1166591 - RNA, 17 nt, Homo sapiens
gcuacaaagaagacaug

SEQ ID NO: 1166592 - RNA, 19 nt, Homo sapiens
gcuacagaaaauaaucugg

SEQ ID NO: 1166593 - RNA, 18 nt, Homo sapiens
gcuacucaggaggcugaa

SEQ ID NO: 1166594 - RNA, 23 nt, Homo sapiens
gcuacugugucagggaacauauu

SEQ ID NO: 1166595 - RNA, 13 nt, Homo sapiens
gcuacuucuuauu

SEQ ID NO: 1166596 - RNA, 22 nt, Homo sapiens
gcuagaaagcauccauuaauua

SEQ ID NO: 1166597 - RNA, 22 nt, Homo sapiens
gcuagacaguucuuuguuugga

SEQ ID NO: 1166598 - RNA, 19 nt, Homo sapiens
gcuagagcaugcugccuga

SEQ ID NO: 1166599 - RNA, 20 nt, Homo sapiens
gcuagauucuaacauauugc

SEQ ID NO: 1166600 - RNA, 18 nt, Homo sapiens
gcuagcaaaaaaacucuu

SEQ ID NO: 1166601 - RNA, 15 nt, Homo sapiens
gcuagggaauaucaa

SEQ ID NO: 1166602 - RNA, 17 nt, Homo sapiens
gcuaguccucacuucua

SEQ ID NO: 1166603 - RNA, 20 nt, Homo sapiens
gcuagugaaguggccucuug

SEQ ID NO: 1166604 - RNA, 22 nt, Homo sapiens
gcuauaaauuucuuacugucag

SEQ ID NO: 1166605 - RNA, 18 nt, Homo sapiens
gcuauaauaaagaagugu

SEQ ID NO: 1166606 - RNA, 18 nt, Homo sapiens
gcuauaauucuauacugu

SEQ ID NO: 1166607 - RNA, 23 nt, Homo sapiens
gcuaucagacuguaggauuugaa

SEQ ID NO: 1166608 - RNA, 14 nt, Homo sapiens
gcuauggugagaug

SEQ ID NO: 1166609 - RNA, 22 nt, Homo sapiens
gcuaugugaagaguaagucaac

SEQ ID NO: 1166610 - RNA, 21 nt, Homo sapiens
gcuauuacagugccacugcaa

SEQ ID NO: 1166611 - RNA, 14 nt, Homo sapiens
gcuauucaccaaua

SEQ ID NO: 1166612 - RNA, 20 nt, Homo sapiens
gcuauucccucaaaucugag

SEQ ID NO: 1166613 - RNA, 15 nt, Homo sapiens
gcuauucuccaugua

SEQ ID NO: 1166614 - RNA, 15 nt, Homo sapiens
gcuauuucagccaau

SEQ ID NO: 1166615 - RNA, 22 nt, Homo sapiens
gcuauuuugagaacuccagcug

SEQ ID NO: 1166616 - RNA, 16 nt, Homo sapiens
gcucaacuagcagaua

SEQ ID NO: 1166617 - RNA, 14 nt, Homo sapiens
gcucaaugccauug

SEQ ID NO: 1166618 - RNA, 16 nt, Homo sapiens
gcucacacccuaccuu

SEQ ID NO: 1166619 - RNA, 20 nt, Homo sapiens
gcucacaccuguaaucccag

SEQ ID NO: 1166620 - RNA, 11 nt, Homo sapiens
gcucaccuguu

SEQ ID NO: 1166621 - RNA, 15 nt, Homo sapiens
gcucaccuuuaucac

SEQ ID NO: 1166622 - RNA, 21 nt, Homo sapiens
gcucaccuuuaucaccucauu

SEQ ID NO: 1166623 - RNA, 20 nt, Homo sapiens
gcucacgucuguaaucccag

SEQ ID NO: 1166624 - RNA, 21 nt, Homo sapiens
gcucagaggcgcacugugacc

SEQ ID NO: 1166625 - RNA, 20 nt, Homo sapiens
gcucagcuagacauugcaau

SEQ ID NO: 1166626 - RNA, 21 nt, Homo sapiens
gcucagcuagacauugcaauu

SEQ ID NO: 1166627 - RNA, 22 nt, Homo sapiens
gcucaggacucagaagccucug

SEQ ID NO: 1166628 - RNA, 18 nt, Homo sapiens
gcucagggaaaagcagcu

SEQ ID NO: 1166629 - RNA, 16 nt, Homo sapiens
gcucagucuguucacu

SEQ ID NO: 1166630 - RNA, 19 nt, Homo sapiens
gcucaucagaaacucaaaa

SEQ ID NO: 1166631 - RNA, 13 nt, Homo sapiens
gcucaucuucaaa

SEQ ID NO: 1166632 - RNA, 15 nt, Homo sapiens
gcucauuuacuugaa

SEQ ID NO: 1166633 - RNA, 21 nt, Homo sapiens
gcuccaaaggaaauccaaaaa

SEQ ID NO: 1166634 - RNA, 21 nt, Homo sapiens
gcuccagcucauaugcugaca

SEQ ID NO: 1166635 - RNA, 17 nt, Homo sapiens
gcuccaggaugcauucu

SEQ ID NO: 1166636 - RNA, 13 nt, Homo sapiens
gcuccaguaucuc

SEQ ID NO: 1166637 - RNA, 20 nt, Homo sapiens
gcuccauguagaagccacua

SEQ ID NO: 1166638 - RNA, 20 nt, Homo sapiens
gcuccauguuuccaccaaau

SEQ ID NO: 1166639 - RNA, 21 nt, Homo sapiens
gcuccauuucuacaaugcaca

SEQ ID NO: 1166640 - RNA, 16 nt, Homo sapiens
gcucccaagagcuucc

SEQ ID NO: 1166641 - RNA, 19 nt, Homo sapiens
gcucccacacuugugccag

SEQ ID NO: 1166642 - RNA, 21 nt, Homo sapiens
gcuccccacgucagcugggac

SEQ ID NO: 1166643 - RNA, 23 nt, Homo sapiens
gcuccccugaggaauaugucaua

SEQ ID NO: 1166644 - RNA, 21 nt, Homo sapiens
gcucccggcgggugcucugag

SEQ ID NO: 1166645 - RNA, 21 nt, Homo sapiens
gcucccucacccaggcacugg

SEQ ID NO: 1166646 - RNA, 14 nt, Homo sapiens
gcuccgaccucucu

SEQ ID NO: 1166647 - RNA, 14 nt, Homo sapiens
gcuccggccugucc

SEQ ID NO: 1166648 - RNA, 21 nt, Homo sapiens
gcuccucggacggcuccggac

SEQ ID NO: 1166649 - RNA, 16 nt, Homo sapiens
gcuccucugugaagca

SEQ ID NO: 1166650 - RNA, 15 nt, Homo sapiens
gcucgaagacuguga

SEQ ID NO: 1166651 - RNA, 13 nt, Homo sapiens
gcucgaugccuuu

SEQ ID NO: 1166652 - RNA, 19 nt, Homo sapiens
gcucgcauuugucaaugac

SEQ ID NO: 1166653 - RNA, 22 nt, Homo sapiens
gcucgccccagcaggugcugac

SEQ ID NO: 1166654 - RNA, 22 nt, Homo sapiens
gcucuaacaaugacauuuauau

SEQ ID NO: 1166655 - RNA, 15 nt, Homo sapiens
gcucuacgggugaug

SEQ ID NO: 1166656 - RNA, 22 nt, Homo sapiens
gcucuacuaccuacguuugcac

SEQ ID NO: 1166657 - RNA, 13 nt, Homo sapiens
gcucuauuuacuu

SEQ ID NO: 1166658 - RNA, 14 nt, Homo sapiens
gcucucccuaccuu

SEQ ID NO: 1166659 - RNA, 23 nt, Homo sapiens
gcucucccucucuuagggugaga

SEQ ID NO: 1166660 - RNA, 21 nt, Homo sapiens
gcucuccgcaggcccacuguc

SEQ ID NO: 1166661 - RNA, 17 nt, Homo sapiens
gcucuccugacuuuuaa

SEQ ID NO: 1166662 - RNA, 15 nt, Homo sapiens
gcucucugaguccug

SEQ ID NO: 1166663 - RNA, 18 nt, Homo sapiens
gcucucugugucugagag

SEQ ID NO: 1166664 - RNA, 21 nt, Homo sapiens
gcucucuugugacgugcacug

SEQ ID NO: 1166665 - RNA, 17 nt, Homo sapiens
gcucugaccgaaacagc

SEQ ID NO: 1166666 - RNA, 15 nt, Homo sapiens
gcucuguaguggaau

SEQ ID NO: 1166667 - RNA, 13 nt, Homo sapiens
gcucugugccuug

SEQ ID NO: 1166668 - RNA, 16 nt, Homo sapiens
gcucuguggaugccag

SEQ ID NO: 1166669 - RNA, 22 nt, Homo sapiens
gcucuucugacauuuaucaggc

SEQ ID NO: 1166670 - RNA, 14 nt, Homo sapiens
gcucuugugucauu

SEQ ID NO: 1166671 - RNA, 17 nt, Homo sapiens
gcugaaaaaucauccaa

SEQ ID NO: 1166672 - RNA, 19 nt, Homo sapiens
gcugaaaaaucauccaaga

SEQ ID NO: 1166673 - RNA, 14 nt, Homo sapiens
gcugaaacuugaac

SEQ ID NO: 1166674 - RNA, 17 nt, Homo sapiens
gcugaacaauaggcugu

SEQ ID NO: 1166675 - RNA, 19 nt, Homo sapiens
gcugaacagugcucugccu

SEQ ID NO: 1166676 - RNA, 18 nt, Homo sapiens
gcugaacauaacuucuca

SEQ ID NO: 1166677 - RNA, 14 nt, Homo sapiens
gcugaagauggcau

SEQ ID NO: 1166678 - RNA, 19 nt, Homo sapiens
gcugaauaaaguugcacug

SEQ ID NO: 1166679 - RNA, 14 nt, Homo sapiens
gcugaauucucugc

SEQ ID NO: 1166680 - RNA, 14 nt, Homo sapiens
gcugaccacagcac

SEQ ID NO: 1166681 - RNA, 18 nt, Homo sapiens
gcugaccucaccuggucc

SEQ ID NO: 1166682 - RNA, 22 nt, Homo sapiens
gcugagacaggaggauugccug

SEQ ID NO: 1166683 - RNA, 16 nt, Homo sapiens
gcugagagaaccucac

SEQ ID NO: 1166684 - RNA, 20 nt, Homo sapiens
gcugagaucaugccacugca

SEQ ID NO: 1166685 - RNA, 21 nt, Homo sapiens
gcugagaucgugccacugcac

SEQ ID NO: 1166686 - RNA, 16 nt, Homo sapiens
gcugaggccacacuca

SEQ ID NO: 1166687 - RNA, 15 nt, Homo sapiens
gcugaggccugugaa

SEQ ID NO: 1166688 - RNA, 14 nt, Homo sapiens
gcugaggcugagaa

SEQ ID NO: 1166689 - RNA, 21 nt, Homo sapiens
gcugagggguggccaucuccu

SEQ ID NO: 1166690 - RNA, 16 nt, Homo sapiens
gcugagggucugggaa

SEQ ID NO: 1166691 - RNA, 19 nt, Homo sapiens
gcugauaccauaugaauga

SEQ ID NO: 1166692 - RNA, 23 nt, Homo sapiens
gcugcaaauagccuuccugaccu

SEQ ID NO: 1166693 - RNA, 21 nt, Homo sapiens
gcugcacucuugaacugggcg

SEQ ID NO: 1166694 - RNA, 21 nt, Homo sapiens
gcugcagagugccccaucggu

SEQ ID NO: 1166695 - RNA, 17 nt, Homo sapiens
gcugcaggacuugagaa

SEQ ID NO: 1166696 - RNA, 15 nt, Homo sapiens
gcugcagucaucuac

SEQ ID NO: 1166697 - RNA, 14 nt, Homo sapiens
gcugcauccaggac

SEQ ID NO: 1166698 - RNA, 14 nt, Homo sapiens
gcugccaagcccca

SEQ ID NO: 1166699 - RNA, 22 nt, Homo sapiens
gcugccaagccccauccugccg

SEQ ID NO: 1166700 - RNA, 18 nt, Homo sapiens
gcugccagcucuguauca

SEQ ID NO: 1166701 - RNA, 21 nt, Homo sapiens
gcugcccguuuguacauggga

SEQ ID NO: 1166702 - RNA, 19 nt, Homo sapiens
gcugccugcugugcuggga

SEQ ID NO: 1166703 - RNA, 17 nt, Homo sapiens
gcugccuuggcucagac

SEQ ID NO: 1166704 - RNA, 16 nt, Homo sapiens
gcugcggcacugugcc

SEQ ID NO: 1166705 - RNA, 13 nt, Homo sapiens
gcugcggugggca

SEQ ID NO: 1166706 - RNA, 14 nt, Homo sapiens
gcugcuacuagcuc

SEQ ID NO: 1166707 - RNA, 16 nt, Homo sapiens
gcugcucacauucuga

SEQ ID NO: 1166708 - RNA, 16 nt, Homo sapiens
gcugcugagugacagc

SEQ ID NO: 1166709 - RNA, 19 nt, Homo sapiens
gcugcugccauccaugugc

SEQ ID NO: 1166710 - RNA, 15 nt, Homo sapiens
gcugcugcuuugaaa

SEQ ID NO: 1166711 - RNA, 19 nt, Homo sapiens
gcugcuucugcaaaaaacu

SEQ ID NO: 1166712 - RNA, 23 nt, Homo sapiens
gcugcuuuccaaagccaauguga

SEQ ID NO: 1166713 - RNA, 16 nt, Homo sapiens
gcuggaaacuucugua

SEQ ID NO: 1166714 - RNA, 12 nt, Homo sapiens
gcuggaaccugc

SEQ ID NO: 1166715 - RNA, 15 nt, Homo sapiens
gcuggaauuaugcug

SEQ ID NO: 1166716 - RNA, 22 nt, Homo sapiens
ggauucuccacucaguugcaac

SEQ ID NO: 1166717 - RNA, 19 nt, Homo sapiens
ggauucuguacaugcauug

SEQ ID NO: 1166718 - RNA, 20 nt, Homo sapiens
ggauugugcugauguaguga

SEQ ID NO: 1166719 - RNA, 15 nt, Homo sapiens
ggcaaagccuaguga

SEQ ID NO: 1166720 - RNA, 17 nt, Homo sapiens
ggcaaaggguccagaag

SEQ ID NO: 1166721 - RNA, 19 nt, Homo sapiens
ggcaaguucuggagcucuu

SEQ ID NO: 1166722 - RNA, 18 nt, Homo sapiens
ggcaauauagcaagaucc

SEQ ID NO: 1166723 - RNA, 16 nt, Homo sapiens
ggcacaaagaugggug

SEQ ID NO: 1166724 - RNA, 18 nt, Homo sapiens
ggcacaagaaucacuuga

SEQ ID NO: 1166725 - RNA, 19 nt, Homo sapiens
ggcacaagaaucacuugaa

SEQ ID NO: 1166726 - RNA, 12 nt, Homo sapiens
ggcacacagcua

SEQ ID NO: 1166727 - RNA, 21 nt, Homo sapiens
ggcacacaucaggaguucaau

SEQ ID NO: 1166728 - RNA, 19 nt, Homo sapiens
ggcacacgccucccacugg

SEQ ID NO: 1166729 - RNA, 20 nt, Homo sapiens
ggcacacgccucccacuggg

SEQ ID NO: 1166730 - RNA, 13 nt, Homo sapiens
ggcacaguggcuc

SEQ ID NO: 1166731 - RNA, 15 nt, Homo sapiens
ggcugaaacuugaac

SEQ ID NO: 1166732 - RNA, 15 nt, Homo sapiens
ggcugaaagaugacg

SEQ ID NO: 1166733 - RNA, 22 nt, Homo sapiens
ggcugacggugcagucugggug

SEQ ID NO: 1166734 - RNA, 16 nt, Homo sapiens
ggcugagacagguuaa

SEQ ID NO: 1166735 - RNA, 21 nt, Homo sapiens
ggcugaggcgggaggaucaca

SEQ ID NO: 1166736 - RNA, 16 nt, Homo sapiens
ggcugaggcuggcaca

SEQ ID NO: 1166737 - RNA, 21 nt, Homo sapiens
ggcugagggguggccaucucc

SEQ ID NO: 1166738 - RNA, 14 nt, Homo sapiens
ggcugcauucccau

SEQ ID NO: 1166739 - RNA, 22 nt, Homo sapiens
ggcugccgagacagacccucug

SEQ ID NO: 1166740 - RNA, 13 nt, Homo sapiens
ggcugcugaccau

SEQ ID NO: 1166741 - RNA, 15 nt, Homo sapiens
ggcuggagugcagug

SEQ ID NO: 1166742 - RNA, 20 nt, Homo sapiens
ggcuggagugcaguggugca

SEQ ID NO: 1166743 - RNA, 17 nt, Homo sapiens
ggcugggacguggcuca

SEQ ID NO: 1166744 - RNA, 21 nt, Homo sapiens
ggcugggggagggacugcuga

SEQ ID NO: 1166745 - RNA, 13 nt, Homo sapiens
ggcuggucacucu

SEQ ID NO: 1166746 - RNA, 13 nt, Homo sapiens
ggcugguggaaca

SEQ ID NO: 1166747 - RNA, 15 nt, Homo sapiens
ggcugguuaccacca

SEQ ID NO: 1166748 - RNA, 15 nt, Homo sapiens
ggcugucucaucccc

SEQ ID NO: 1166749 - RNA, 19 nt, Homo sapiens
ggcuguggaguguggcagu

SEQ ID NO: 1166750 - RNA, 19 nt, Homo sapiens
ggcuguguuuccaucucaa

SEQ ID NO: 1166751 - RNA, 15 nt, Homo sapiens
ggcuuaauaccuggg

SEQ ID NO: 1166752 - RNA, 23 nt, Homo sapiens
ggcuuccaucaaaccuuugccaa

SEQ ID NO: 1166753 - RNA, 23 nt, Homo sapiens
ggcuucccucucugaaauagccg

SEQ ID NO: 1166754 - RNA, 20 nt, Homo sapiens
ggcuucgcagcucuggccuc

SEQ ID NO: 1166755 - RNA, 15 nt, Homo sapiens
ggcuucuacacuggg

SEQ ID NO: 1166756 - RNA, 19 nt, Homo sapiens
ggcuucucuugagucacac

SEQ ID NO: 1166757 - RNA, 12 nt, Homo sapiens
ggcuugaugucc

SEQ ID NO: 1166758 - RNA, 14 nt, Homo sapiens
ggcuuuaccuuuau

SEQ ID NO: 1166759 - RNA, 14 nt, Homo sapiens
ggcuuuccugguuc

SEQ ID NO: 1166760 - RNA, 14 nt, Homo sapiens
ggcuuucuugacau

SEQ ID NO: 1166761 - RNA, 16 nt, Homo sapiens
ggcuuuguugcuggaa

SEQ ID NO: 1166762 - RNA, 16 nt, Homo sapiens
ggcuuuucccuugcuu

SEQ ID NO: 1166763 - RNA, 16 nt, Homo sapiens
ggcuuuucuuucuacc

SEQ ID NO: 1166764 - RNA, 17 nt, Homo sapiens
gggaaaacccaggguga

SEQ ID NO: 1166765 - RNA, 16 nt, Homo sapiens
gggaaaaugcacacau

SEQ ID NO: 1166766 - RNA, 20 nt, Homo sapiens
gggaacauauuuaaggaaca

SEQ ID NO: 1166767 - RNA, 17 nt, Homo sapiens
gggaacucagauccagg

SEQ ID NO: 1166768 - RNA, 20 nt, Homo sapiens
gggaagccaggauuggggac

SEQ ID NO: 1166769 - RNA, 13 nt, Homo sapiens
gggaagcucccag

SEQ ID NO: 1166770 - RNA, 17 nt, Homo sapiens
gggacaccugcccagug

SEQ ID NO: 1166771 - RNA, 22 nt, Homo sapiens
gggacaguaauaagaauggaaa

SEQ ID NO: 1166772 - RNA, 21 nt, Homo sapiens
gggacauuaguaacugcacac

SEQ ID NO: 1166773 - RNA, 23 nt, Homo sapiens
gggaccucccagcgaccacugca

SEQ ID NO: 1166774 - RNA, 19 nt, Homo sapiens
gggacgcaggccccucucc

SEQ ID NO: 1166775 - RNA, 23 nt, Homo sapiens
gggagagaaagcuuuauauuugu

SEQ ID NO: 1166776 - RNA, 15 nt, Homo sapiens
gggagcaggagccug

SEQ ID NO: 1166777 - RNA, 16 nt, Homo sapiens
gggagcaggcgguggg

SEQ ID NO: 1166778 - RNA, 14 nt, Homo sapiens
gggagcauguucau

SEQ ID NO: 1166779 - RNA, 17 nt, Homo sapiens
gggagccauggggagca

SEQ ID NO: 1166780 - RNA, 20 nt, Homo sapiens
gggagcggaaagcagcucaa

SEQ ID NO: 1166781 - RNA, 20 nt, Homo sapiens
gggaggccagugagccacuc

SEQ ID NO: 1166782 - RNA, 23 nt, Homo sapiens
gggaggcccgcggcgguggagcc

SEQ ID NO: 1166783 - RNA, 20 nt, Homo sapiens
gggaggcggagguugcaaug

SEQ ID NO: 1166784 - RNA, 18 nt, Homo sapiens
gggaggcugcagccaggc

SEQ ID NO: 1166785 - RNA, 13 nt, Homo sapiens
gggaggggguccu

SEQ ID NO: 1166786 - RNA, 18 nt, Homo sapiens
gggaggugagagugcaga

SEQ ID NO: 1166787 - RNA, 12 nt, Homo sapiens
gggauacaggcc

SEQ ID NO: 1166788 - RNA, 23 nt, Homo sapiens
gggauacuuuuaugcaaccauaa

SEQ ID NO: 1166789 - RNA, 23 nt, Homo sapiens
gggaugucuccgucucugucuca

SEQ ID NO: 1166790 - RNA, 17 nt, Homo sapiens
gggaugugacaugccca

SEQ ID NO: 1166791 - RNA, 13 nt, Homo sapiens
gggauuacaggcg

SEQ ID NO: 1166792 - RNA, 20 nt, Homo sapiens
gggauucuguacaugcauug

SEQ ID NO: 1166793 - RNA, 19 nt, Homo sapiens
gggcaaguggagccaccuc

SEQ ID NO: 1166794 - RNA, 20 nt, Homo sapiens
gggcagaagugaaugccugu

SEQ ID NO: 1166795 - RNA, 15 nt, Homo sapiens
gggcagggccacuca

SEQ ID NO: 1166796 - RNA, 23 nt, Homo sapiens
gggcauguccuuuccaucugucc

SEQ ID NO: 1166797 - RNA, 12 nt, Homo sapiens
gggccagagcca

SEQ ID NO: 1166798 - RNA, 19 nt, Homo sapiens
gggccagcauacuccguga

SEQ ID NO: 1166799 - RNA, 22 nt, Homo sapiens
gggccaggcugguccgagcuga

SEQ ID NO: 1166800 - RNA, 12 nt, Homo sapiens
gggccagggaag

SEQ ID NO: 1166801 - RNA, 19 nt, Homo sapiens
gggccauggcucagggugg

SEQ ID NO: 1166802 - RNA, 15 nt, Homo sapiens
gggccccaccaccua

SEQ ID NO: 1166803 - RNA, 22 nt, Homo sapiens
gggccccugucgucaggaccuc

SEQ ID NO: 1166804 - RNA, 16 nt, Homo sapiens
gggccugaccaaacag

SEQ ID NO: 1166805 - RNA, 15 nt, Homo sapiens
gggccuggacaccca

SEQ ID NO: 1166806 - RNA, 19 nt, Homo sapiens
gggccuguuacacaugaca

SEQ ID NO: 1166807 - RNA, 19 nt, Homo sapiens
gggccuuucccucuucccu

SEQ ID NO: 1166808 - RNA, 18 nt, Homo sapiens
gggcgaucgcggcggagc

SEQ ID NO: 1166809 - RNA, 23 nt, Homo sapiens
gggcgcucgcuuccgcauccuag

SEQ ID NO: 1166810 - RNA, 18 nt, Homo sapiens
gggcgcucucccuaccuu

SEQ ID NO: 1166811 - RNA, 20 nt, Homo sapiens
gggcggccagggacccaaag

SEQ ID NO: 1166812 - RNA, 17 nt, Homo sapiens
gggcucagggcaguggc

SEQ ID NO: 1166813 - RNA, 21 nt, Homo sapiens
gggcucccguggccuguagaa

SEQ ID NO: 1166814 - RNA, 17 nt, Homo sapiens
gggcuccuccagggugu

SEQ ID NO: 1166815 - RNA, 16 nt, Homo sapiens
gggcucucugugcaag

SEQ ID NO: 1166816 - RNA, 19 nt, Homo sapiens
gggcucugggggcagauuu

SEQ ID NO: 1166817 - RNA, 18 nt, Homo sapiens
gggcugguucagggcuga

SEQ ID NO: 1166818 - RNA, 20 nt, Homo sapiens
gggcugucaucugugcacug

SEQ ID NO: 1166819 - RNA, 22 nt, Homo sapiens
gggcugucuuugcagggcacag

SEQ ID NO: 1166820 - RNA, 18 nt, Homo sapiens
gggcuguguugacugcug

SEQ ID NO: 1166821 - RNA, 19 nt, Homo sapiens
gggcuucauacacaugaga

SEQ ID NO: 1166822 - RNA, 22 nt, Homo sapiens
gggcuucauacacaugagauaa

SEQ ID NO: 1166823 - RNA, 22 nt, Homo sapiens
gggcuuccgcagcuucagggga

SEQ ID NO: 1166824 - RNA, 18 nt, Homo sapiens
ggggaagaaacacuuucu

SEQ ID NO: 1166825 - RNA, 12 nt, Homo sapiens
ggggaagccaga

SEQ ID NO: 1166826 - RNA, 21 nt, Homo sapiens
ggggacccaucuuccaccuca

SEQ ID NO: 1166827 - RNA, 18 nt, Homo sapiens
ggggaggcggcacuccaa

SEQ ID NO: 1166828 - RNA, 13 nt, Homo sapiens
ggggaggggcgcu

SEQ ID NO: 1166829 - RNA, 14 nt, Homo sapiens
ggggcccagugcau

SEQ ID NO: 1166830 - RNA, 21 nt, Homo sapiens
ggggccugcaucaccaccuca

SEQ ID NO: 1166831 - RNA, 14 nt, Homo sapiens
ggggccuguuacac

SEQ ID NO: 1166832 - RNA, 14 nt, Homo sapiens
gggggccacugugu

SEQ ID NO: 1166833 - RNA, 15 nt, Homo sapiens
ggggguuggauuuga

SEQ ID NO: 1166834 - RNA, 16 nt, Homo sapiens
ggggucacuugcaauu

SEQ ID NO: 1166835 - RNA, 13 nt, Homo sapiens
ggggugacacaga

SEQ ID NO: 1166836 - RNA, 15 nt, Homo sapiens
ggggugggauuugga

SEQ ID NO: 1166837 - RNA, 17 nt, Homo sapiens
gggguuggaagugcaga

SEQ ID NO: 1166838 - RNA, 15 nt, Homo sapiens
ggguaaccuugauau

SEQ ID NO: 1166839 - RNA, 22 nt, Homo sapiens
ggguacuucuugaaggugcuga

SEQ ID NO: 1166840 - RNA, 17 nt, Homo sapiens
ggguauugcuugccacu

SEQ ID NO: 1166841 - RNA, 16 nt, Homo sapiens
gggucauccuugccca

SEQ ID NO: 1166842 - RNA, 18 nt, Homo sapiens
ggguccucaguccacugc

SEQ ID NO: 1166843 - RNA, 16 nt, Homo sapiens
gggucgggggagcaaa

SEQ ID NO: 1166844 - RNA, 20 nt, Homo sapiens
gggucucacucuguugccca

SEQ ID NO: 1166845 - RNA, 18 nt, Homo sapiens
gggugcaaagauguucau

SEQ ID NO: 1166846 - RNA, 17 nt, Homo sapiens
gggugccaaguccuagc

SEQ ID NO: 1166847 - RNA, 16 nt, Homo sapiens
ggguggagaagccauu

SEQ ID NO: 1166848 - RNA, 15 nt, Homo sapiens
gggugggaaggggag

SEQ ID NO: 1166849 - RNA, 17 nt, Homo sapiens
gggugggauaauggacu

SEQ ID NO: 1166850 - RNA, 14 nt, Homo sapiens
gggugguggcacau

SEQ ID NO: 1166851 - RNA, 11 nt, Homo sapiens
gggugugcuau

SEQ ID NO: 1166852 - RNA, 16 nt, Homo sapiens
ggguuaaaucaaagau

SEQ ID NO: 1166853 - RNA, 18 nt, Homo sapiens
ggguuauguaucagaaga

SEQ ID NO: 1166854 - RNA, 17 nt, Homo sapiens
accccauuccacagcuc

SEQ ID NO: 1166855 - RNA, 19 nt, Homo sapiens
acccccaccacucuugacu

SEQ ID NO: 1166856 - RNA, 16 nt, Homo sapiens
acccccaggaccccug

SEQ ID NO: 1166857 - RNA, 21 nt, Homo sapiens
acccccaucaccuacuccagc

SEQ ID NO: 1166858 - RNA, 12 nt, Homo sapiens
acccccaugaug

SEQ ID NO: 1166859 - RNA, 17 nt, Homo sapiens
acccccucuucugagca

SEQ ID NO: 1166860 - RNA, 14 nt, Homo sapiens
acccccuucagugc

SEQ ID NO: 1166861 - RNA, 16 nt, Homo sapiens
accccgacugcucagu

SEQ ID NO: 1166862 - RNA, 16 nt, Homo sapiens
accccgcggcccagac

SEQ ID NO: 1166863 - RNA, 22 nt, Homo sapiens
accccggggccucccccgugac

SEQ ID NO: 1166864 - RNA, 18 nt, Homo sapiens
accccuaaggcaacugga

SEQ ID NO: 1166865 - RNA, 22 nt, Homo sapiens
accccuagagacagugaugccu

SEQ ID NO: 1166866 - RNA, 14 nt, Homo sapiens
accccucacuguga

SEQ ID NO: 1166867 - RNA, 16 nt, Homo sapiens
accccucacugugacu

SEQ ID NO: 1166868 - RNA, 20 nt, Homo sapiens
accccuccaggaaugaucuc

SEQ ID NO: 1166869 - RNA, 20 nt, Homo sapiens
accccugagauccggcaaca

SEQ ID NO: 1166870 - RNA, 14 nt, Homo sapiens
accccugcacaguu

SEQ ID NO: 1166871 - RNA, 17 nt, Homo sapiens
accccugccuacuuccu

SEQ ID NO: 1166872 - RNA, 18 nt, Homo sapiens
accccugccuacuuccuu

SEQ ID NO: 1166873 - RNA, 22 nt, Homo sapiens
accccuuguuuagcauauaauc

SEQ ID NO: 1166874 - RNA, 16 nt, Homo sapiens
acccgcagaguucuca

SEQ ID NO: 1166875 - RNA, 23 nt, Homo sapiens
acccggaagaucagaugcaauug

SEQ ID NO: 1166876 - RNA, 16 nt, Homo sapiens
acccuaaaucuugacu

SEQ ID NO: 1166877 - RNA, 20 nt, Homo sapiens
acccuauacuguaguauucu

SEQ ID NO: 1166878 - RNA, 16 nt, Homo sapiens
acccuaucugugauuc

SEQ ID NO: 1166879 - RNA, 14 nt, Homo sapiens
acccucaucuuucu

SEQ ID NO: 1166880 - RNA, 18 nt, Homo sapiens
acccucaucuuucuucca

SEQ ID NO: 1166881 - RNA, 14 nt, Homo sapiens
acccucugcugaag

SEQ ID NO: 1166882 - RNA, 22 nt, Homo sapiens
acccucugcuucccucucucuu

SEQ ID NO: 1166883 - RNA, 16 nt, Homo sapiens
acccugccccuugcca

SEQ ID NO: 1166884 - RNA, 17 nt, Homo sapiens
acccugccccuugccau

SEQ ID NO: 1166885 - RNA, 22 nt, Homo sapiens
acccugcgcccaguccuuccac

SEQ ID NO: 1166886 - RNA, 19 nt, Homo sapiens
acccugcugcuggugcaca

SEQ ID NO: 1166887 - RNA, 15 nt, Homo sapiens
acccuggaacuggag

SEQ ID NO: 1166888 - RNA, 17 nt, Homo sapiens
acccuggaccagugguc

SEQ ID NO: 1166889 - RNA, 22 nt, Homo sapiens
acccuggaccaguggucucaca

SEQ ID NO: 1166890 - RNA, 20 nt, Homo sapiens
acccuggaucaguccuuuga

SEQ ID NO: 1166891 - RNA, 22 nt, Homo sapiens
acccuggaugauaggaauugac

SEQ ID NO: 1166892 - RNA, 23 nt, Homo sapiens
acccugggccuggcagcucagcu

SEQ ID NO: 1166893 - RNA, 19 nt, Homo sapiens
acccuucuggaaacuguga

SEQ ID NO: 1166894 - RNA, 23 nt, Homo sapiens
acccuuuaagauauccaucuuuu

SEQ ID NO: 1166895 - RNA, 20 nt, Homo sapiens
acccuuuagacuguagccug

SEQ ID NO: 1166896 - RNA, 19 nt, Homo sapiens
acccuuucaaacuauuuau

SEQ ID NO: 1166897 - RNA, 23 nt, Homo sapiens
accgaaucucaauguacauagac

SEQ ID NO: 1166898 - RNA, 20 nt, Homo sapiens
accgccauugggcuacugua

SEQ ID NO: 1166899 - RNA, 14 nt, Homo sapiens
accgccuccugcuc

SEQ ID NO: 1166900 - RNA, 17 nt, Homo sapiens
accgcugcccagguggg

SEQ ID NO: 1166901 - RNA, 22 nt, Homo sapiens
accggaugcugugccuggccuc

SEQ ID NO: 1166902 - RNA, 13 nt, Homo sapiens
accgggcaugucu

SEQ ID NO: 1166903 - RNA, 14 nt, Homo sapiens
accguacuguggaa

SEQ ID NO: 1166904 - RNA, 16 nt, Homo sapiens
accguaggacccaagc

SEQ ID NO: 1166905 - RNA, 16 nt, Homo sapiens
accgugaccagugcug

SEQ ID NO: 1166906 - RNA, 18 nt, Homo sapiens
accgugagugacauagcc

SEQ ID NO: 1166907 - RNA, 18 nt, Homo sapiens
accgugccacuuuccacc

SEQ ID NO: 1166908 - RNA, 17 nt, Homo sapiens
accgugggcucccugac

SEQ ID NO: 1166909 - RNA, 18 nt, Homo sapiens
accguggggaaggggugc

SEQ ID NO: 1166910 - RNA, 22 nt, Homo sapiens
accuugccacccauucuucccg

SEQ ID NO: 1166911 - RNA, 22 nt, Homo sapiens
accuuggcaccagacacccagg

SEQ ID NO: 1166912 - RNA, 20 nt, Homo sapiens
accuuggcccaggagcucug

SEQ ID NO: 1166913 - RNA, 17 nt, Homo sapiens
accuugguuaugacugc

SEQ ID NO: 1166914 - RNA, 19 nt, Homo sapiens
accuugucacccaggcuag

SEQ ID NO: 1166915 - RNA, 18 nt, Homo sapiens
accuugugauucugcuua

SEQ ID NO: 1166916 - RNA, 15 nt, Homo sapiens
accuugugucuguac

SEQ ID NO: 1166917 - RNA, 21 nt, Homo sapiens
accuuguguggcgcacuucag

SEQ ID NO: 1166918 - RNA, 15 nt, Homo sapiens
accuuguuuugccag

SEQ ID NO: 1166919 - RNA, 17 nt, Homo sapiens
accuuguuuugccagug

SEQ ID NO: 1166920 - RNA, 18 nt, Homo sapiens
accuuucagaacucacau

SEQ ID NO: 1166921 - RNA, 19 nt, Homo sapiens
accuuucaggcuacaagag

SEQ ID NO: 1166922 - RNA, 23 nt, Homo sapiens
accuuugacacugacagaugugu

SEQ ID NO: 1166923 - RNA, 14 nt, Homo sapiens
accuuuuacucuuc

SEQ ID NO: 1166924 - RNA, 21 nt, Homo sapiens
accuuuuaucaauaaagcacu

SEQ ID NO: 1166925 - RNA, 18 nt, Homo sapiens
acgaauauggacauauca

SEQ ID NO: 1166926 - RNA, 20 nt, Homo sapiens
acgagcauaguccaaaaagc

SEQ ID NO: 1166927 - RNA, 14 nt, Homo sapiens
acgaggcucaaaaa

SEQ ID NO: 1166928 - RNA, 13 nt, Homo sapiens
acgaucucagcuc

SEQ ID NO: 1166929 - RNA, 13 nt, Homo sapiens
acgauggaguaca

SEQ ID NO: 1166930 - RNA, 15 nt, Homo sapiens
acgauuccuucccac

SEQ ID NO: 1166931 - RNA, 11 nt, Homo sapiens
acgcacugcac

SEQ ID NO: 1166932 - RNA, 16 nt, Homo sapiens
acgcacugguaugugu

SEQ ID NO: 1166933 - RNA, 17 nt, Homo sapiens
acgcagggcggucuucu

SEQ ID NO: 1166934 - RNA, 18 nt, Homo sapiens
acgccaccaucaacuuaa

SEQ ID NO: 1166935 - RNA, 21 nt, Homo sapiens
acgccacccagccucuuguuu

SEQ ID NO: 1166936 - RNA, 17 nt, Homo sapiens
acgccuguaaucccagc

SEQ ID NO: 1166937 - RNA, 19 nt, Homo sapiens
acggaccaugcgacacugg

SEQ ID NO: 1166938 - RNA, 20 nt, Homo sapiens
acggaggacugaacugggga

SEQ ID NO: 1166939 - RNA, 17 nt, Homo sapiens
acggaugggcccuaugu

SEQ ID NO: 1166940 - RNA, 19 nt, Homo sapiens
acggcaccauuggucucug

SEQ ID NO: 1166941 - RNA, 18 nt, Homo sapiens
acggccagggagaagcuc

SEQ ID NO: 1166942 - RNA, 15 nt, Homo sapiens
acggcgcugccucag

SEQ ID NO: 1166943 - RNA, 18 nt, Homo sapiens
acggucuccugacuggug

SEQ ID NO: 1166944 - RNA, 22 nt, Homo sapiens
acggugcugagacuacaggugu

SEQ ID NO: 1166945 - RNA, 17 nt, Homo sapiens
acguaugcaugcuaaau

SEQ ID NO: 1166946 - RNA, 20 nt, Homo sapiens
acguauggaaugcuucuuaa

SEQ ID NO: 1166947 - RNA, 16 nt, Homo sapiens
acgucaaacaugaagu

SEQ ID NO: 1166948 - RNA, 17 nt, Homo sapiens
acgucaagugaucugcc

SEQ ID NO: 1166949 - RNA, 23 nt, Homo sapiens
acgucacaaagaccuugcugaua

SEQ ID NO: 1166950 - RNA, 13 nt, Homo sapiens
acgucacugauau

SEQ ID NO: 1166951 - RNA, 15 nt, Homo sapiens
acgucagacuuggcu

SEQ ID NO: 1166952 - RNA, 16 nt, Homo sapiens
acguccugucuguuuc

SEQ ID NO: 1166953 - RNA, 17 nt, Homo sapiens
acgugcaggacagcucu

SEQ ID NO: 1166954 - RNA, 13 nt, Homo sapiens
acguggaugaagc

SEQ ID NO: 1166955 - RNA, 16 nt, Homo sapiens
acguggaugaagcaga

SEQ ID NO: 1166956 - RNA, 22 nt, Homo sapiens
acguggguucaauuugccauug

SEQ ID NO: 1166957 - RNA, 14 nt, Homo sapiens
acguugauguaaug

SEQ ID NO: 1166958 - RNA, 19 nt, Homo sapiens
acguuggccucagggccag

SEQ ID NO: 1166959 - RNA, 17 nt, Homo sapiens
acguuuuuggacacugu

SEQ ID NO: 1166960 - RNA, 24 nt, Homo sapiens
acuaaaaaugcaucuggcuacuuu

SEQ ID NO: 1166961 - RNA, 22 nt, Homo sapiens
acuaaaauuguaucaaauguga

SEQ ID NO: 1166962 - RNA, 14 nt, Homo sapiens
acuaaacauaugaa

SEQ ID NO: 1166963 - RNA, 16 nt, Homo sapiens
acuaaaggaaucugaa

SEQ ID NO: 1166964 - RNA, 15 nt, Homo sapiens
acuaaauaacuguau

SEQ ID NO: 1166965 - RNA, 12 nt, Homo sapiens
acuaaauaucau

SEQ ID NO: 1166966 - RNA, 11 nt, Homo sapiens
acuaaccauag

SEQ ID NO: 1166967 - RNA, 14 nt, Homo sapiens
acuaacccuguggu

SEQ ID NO: 1166968 - RNA, 21 nt, Homo sapiens
acuuuaucaaagauuggccau

SEQ ID NO: 1166969 - RNA, 18 nt, Homo sapiens
acuuuaucuaauaccucu

SEQ ID NO: 1166970 - RNA, 17 nt, Homo sapiens
acuuuauuucugaucua

SEQ ID NO: 1166971 - RNA, 22 nt, Homo sapiens
acuuuauuucugaucuauacaa

SEQ ID NO: 1166972 - RNA, 14 nt, Homo sapiens
acuuucacugaaua

SEQ ID NO: 1166973 - RNA, 13 nt, Homo sapiens
acuuucaguuuug

SEQ ID NO: 1166974 - RNA, 16 nt, Homo sapiens
acuuuccugaaugugu

SEQ ID NO: 1166975 - RNA, 19 nt, Homo sapiens
acuuucuguucuccagugu

SEQ ID NO: 1166976 - RNA, 13 nt, Homo sapiens
acuuucuuuacau

SEQ ID NO: 1166977 - RNA, 14 nt, Homo sapiens
acuuugaaccauaa

SEQ ID NO: 1166978 - RNA, 23 nt, Homo sapiens
acuuugacuuucuucugaauauu

SEQ ID NO: 1166979 - RNA, 15 nt, Homo sapiens
acuuugggagaccaa

SEQ ID NO: 1166980 - RNA, 18 nt, Homo sapiens
acuuugggaggccaagga

SEQ ID NO: 1166981 - RNA, 20 nt, Homo sapiens
acuuuggguuuuuaacucau

SEQ ID NO: 1166982 - RNA, 18 nt, Homo sapiens
acuuuuagcuacugcuaa

SEQ ID NO: 1166983 - RNA, 18 nt, Homo sapiens
acuuuuaugcaaccauaa

SEQ ID NO: 1166984 - RNA, 22 nt, Homo sapiens
acuuuuaugugucucagaauau

SEQ ID NO: 1166985 - RNA, 17 nt, Homo sapiens
acuuuugaagaacaaaa

SEQ ID NO: 1166986 - RNA, 11 nt, Homo sapiens
acuuuuuccag

SEQ ID NO: 1166987 - RNA, 11 nt, Homo sapiens
acuuuuugcca

SEQ ID NO: 1166988 - RNA, 15 nt, Homo sapiens
acuuuuugccaaaua

SEQ ID NO: 1166989 - RNA, 20 nt, Homo sapiens
agaaaaaaaccaaaguacuu

SEQ ID NO: 1166990 - RNA, 17 nt, Homo sapiens
agaaaaauaucuuggcc

SEQ ID NO: 1166991 - RNA, 12 nt, Homo sapiens
agaaaacauguu

SEQ ID NO: 1166992 - RNA, 19 nt, Homo sapiens
agaaaagcccugagaucag

SEQ ID NO: 1166993 - RNA, 21 nt, Homo sapiens
agaaaauaacgauaaaagaca

SEQ ID NO: 1166994 - RNA, 16 nt, Homo sapiens
agaaaaugaaagacuc

SEQ ID NO: 1166995 - RNA, 19 nt, Homo sapiens
agaaaauggaauuacucca

SEQ ID NO: 1166996 - RNA, 22 nt, Homo sapiens
agaaaauguugagaaucccaaa

SEQ ID NO: 1166997 - RNA, 14 nt, Homo sapiens
agaaacacugccuu

SEQ ID NO: 1166998 - RNA, 13 nt, Homo sapiens
agaaaccucggga

SEQ ID NO: 1166999 - RNA, 24 nt, Homo sapiens
agaaacuaccuuuuuauaaugcac

SEQ ID NO: 1167000 - RNA, 11 nt, Homo sapiens
agaaacucaau

SEQ ID NO: 1167001 - RNA, 18 nt, Homo sapiens
agaaacuucugcuuuuaa

SEQ ID NO: 1167002 - RNA, 15 nt, Homo sapiens
agaaagaaacacuca

SEQ ID NO: 1167003 - RNA, 14 nt, Homo sapiens
agaaagaaagggaa

SEQ ID NO: 1167004 - RNA, 12 nt, Homo sapiens
agaaagcacuua

SEQ ID NO: 1167005 - RNA, 13 nt, Homo sapiens
agaaagcauuaca

SEQ ID NO: 1167006 - RNA, 17 nt, Homo sapiens
agaaagcccucuaggaa

SEQ ID NO: 1167007 - RNA, 14 nt, Homo sapiens
agaaaguccagcua

SEQ ID NO: 1167008 - RNA, 14 nt, Homo sapiens
agaaagucucucau

SEQ ID NO: 1167009 - RNA, 14 nt, Homo sapiens
agaaaguggugcuc

SEQ ID NO: 1167010 - RNA, 20 nt, Homo sapiens
agaaauaaaaucuaauuaau

SEQ ID NO: 1167011 - RNA, 21 nt, Homo sapiens
agaaauaaccaugaaaauagc

SEQ ID NO: 1167012 - RNA, 12 nt, Homo sapiens
agaaauaagccc

SEQ ID NO: 1167013 - RNA, 23 nt, Homo sapiens
agaaaucuggcuucuggccagga

SEQ ID NO: 1167014 - RNA, 16 nt, Homo sapiens
agaaaucugugccuga

SEQ ID NO: 1167015 - RNA, 13 nt, Homo sapiens
agaaauguauaaa

SEQ ID NO: 1167016 - RNA, 15 nt, Homo sapiens
agaaaugucaugugg

SEQ ID NO: 1167017 - RNA, 15 nt, Homo sapiens
agaaauuaacaaaug

SEQ ID NO: 1167018 - RNA, 23 nt, Homo sapiens
agaaauuaacaaaugugcugcuu

SEQ ID NO: 1167019 - RNA, 22 nt, Homo sapiens
agaaauugacacaaguggaccu

SEQ ID NO: 1167020 - RNA, 21 nt, Homo sapiens
agaaauuuggcauugaucuua

SEQ ID NO: 1167021 - RNA, 12 nt, Homo sapiens
agaacaaaaacu

SEQ ID NO: 1167022 - RNA, 22 nt, Homo sapiens
agaacaaaggacagaguaugaa

SEQ ID NO: 1167023 - RNA, 17 nt, Homo sapiens
agaacaacaaggacaac

SEQ ID NO: 1167024 - RNA, 18 nt, Homo sapiens
agaacaccagagaccuca

SEQ ID NO: 1167025 - RNA, 20 nt, Homo sapiens
agaacacccucuaaauggga

SEQ ID NO: 1167026 - RNA, 22 nt, Homo sapiens
agaacaguuguccaggaugcug

SEQ ID NO: 1167027 - RNA, 22 nt, Homo sapiens
agaacauggugugugucucuga

SEQ ID NO: 1167028 - RNA, 18 nt, Homo sapiens
agaaccacucauaauucu

SEQ ID NO: 1167029 - RNA, 20 nt, Homo sapiens
agaaccagagaggcucugag

SEQ ID NO: 1167030 - RNA, 18 nt, Homo sapiens
agaaccagcagaagccag

SEQ ID NO: 1167031 - RNA, 18 nt, Homo sapiens
agaacucaucacuguggc

SEQ ID NO: 1167032 - RNA, 14 nt, Homo sapiens
agaacugacaugca

SEQ ID NO: 1167033 - RNA, 16 nt, Homo sapiens
agaacugagcaucucc

SEQ ID NO: 1167034 - RNA, 14 nt, Homo sapiens
agaacugcacauga

SEQ ID NO: 1167035 - RNA, 21 nt, Homo sapiens
agaacuggaagguacuuuaau

SEQ ID NO: 1167036 - RNA, 18 nt, Homo sapiens
agaacugucauguaaaca

SEQ ID NO: 1167037 - RNA, 11 nt, Homo sapiens
agaacuguggc

SEQ ID NO: 1167038 - RNA, 16 nt, Homo sapiens
agaacuucaagcucuc

SEQ ID NO: 1167039 - RNA, 23 nt, Homo sapiens
agaacuucugaaaccucuggguc

SEQ ID NO: 1167040 - RNA, 22 nt, Homo sapiens
agaacuuugcauagcagcugcu

SEQ ID NO: 1167041 - RNA, 15 nt, Homo sapiens
agaagaaaacaaagu

SEQ ID NO: 1167042 - RNA, 16 nt, Homo sapiens
agaagaagugaacacu

SEQ ID NO: 1167043 - RNA, 18 nt, Homo sapiens
agaagaagugaacacuua

SEQ ID NO: 1167044 - RNA, 23 nt, Homo sapiens
agaagaccuuuacaguuugugcu

SEQ ID NO: 1167045 - RNA, 17 nt, Homo sapiens
aagcagcccuggcucuc

SEQ ID NO: 1167046 - RNA, 16 nt, Homo sapiens
aagcaggaagcucaga

SEQ ID NO: 1167047 - RNA, 16 nt, Homo sapiens
aagcagggacugugaa

SEQ ID NO: 1167048 - RNA, 22 nt, Homo sapiens
aagcaguagcauuugcuuccuc

SEQ ID NO: 1167049 - RNA, 21 nt, Homo sapiens
aagcagucaauuuucacauca

SEQ ID NO: 1167050 - RNA, 16 nt, Homo sapiens
aagcagucauaccugc

SEQ ID NO: 1167051 - RNA, 19 nt, Homo sapiens
aagcagucuugcucuguua

SEQ ID NO: 1167052 - RNA, 16 nt, Homo sapiens
aagcaguuacuaauau

SEQ ID NO: 1167053 - RNA, 14 nt, Homo sapiens
aagcauacuuugua

SEQ ID NO: 1167054 - RNA, 21 nt, Homo sapiens
aagcauauuuuguggcauuug

SEQ ID NO: 1167055 - RNA, 23 nt, Homo sapiens
aagcauccauuaauuaaugagac

SEQ ID NO: 1167056 - RNA, 14 nt, Homo sapiens
aagcaugcauucua

SEQ ID NO: 1167057 - RNA, 16 nt, Homo sapiens
aagcauggcccugcug

SEQ ID NO: 1167058 - RNA, 22 nt, Homo sapiens
aagcauggcuuuggcuuugcaa

SEQ ID NO: 1167059 - RNA, 18 nt, Homo sapiens
aagcaugucucugcuucc

SEQ ID NO: 1167060 - RNA, 21 nt, Homo sapiens
aagcauuuccagccuaucuaa

SEQ ID NO: 1167061 - RNA, 15 nt, Homo sapiens
aagccaauccucacu

SEQ ID NO: 1167062 - RNA, 22 nt, Homo sapiens
aagccacauggugacuuuugaa

SEQ ID NO: 1167063 - RNA, 21 nt, Homo sapiens
aagccaccgcagcugcugcca

SEQ ID NO: 1167064 - RNA, 13 nt, Homo sapiens
aagccagcacuca

SEQ ID NO: 1167065 - RNA, 20 nt, Homo sapiens
aagccagcacucacaccacu

SEQ ID NO: 1167066 - RNA, 17 nt, Homo sapiens
aagccaugugcuaagaa

SEQ ID NO: 1167067 - RNA, 14 nt, Homo sapiens
aagcccacuuuguu

SEQ ID NO: 1167068 - RNA, 15 nt, Homo sapiens
aagcccagccacauu

SEQ ID NO: 1167069 - RNA, 21 nt, Homo sapiens
aagcccagcucugggaacuga

SEQ ID NO: 1167070 - RNA, 23 nt, Homo sapiens
aagcccccaaguugauauuucua

SEQ ID NO: 1167071 - RNA, 20 nt, Homo sapiens
aagccccucuauacccuggu

SEQ ID NO: 1167072 - RNA, 20 nt, Homo sapiens
aagcccuuguccccaugaaa

SEQ ID NO: 1167073 - RNA, 14 nt, Homo sapiens
aagccuauaugaaa

SEQ ID NO: 1167074 - RNA, 23 nt, Homo sapiens
aagccucagcucauagugaacac

SEQ ID NO: 1167075 - RNA, 12 nt, Homo sapiens
aagccucugggu

SEQ ID NO: 1167076 - RNA, 22 nt, Homo sapiens
aagccugacccuguaaaaugga

SEQ ID NO: 1167077 - RNA, 18 nt, Homo sapiens
aagccugucucuuuccac

SEQ ID NO: 1167078 - RNA, 23 nt, Homo sapiens
aagccugucucuuuccacuuugu

SEQ ID NO: 1167079 - RNA, 14 nt, Homo sapiens
aagccugugcaaug

SEQ ID NO: 1167080 - RNA, 19 nt, Homo sapiens
aagccuucuaaaugaguca

SEQ ID NO: 1167081 - RNA, 14 nt, Homo sapiens
aagcgaacaucuuc

SEQ ID NO: 1167082 - RNA, 15 nt, Homo sapiens
aagcgauucuccugc

SEQ ID NO: 1167083 - RNA, 20 nt, Homo sapiens
aagcgauucuccugccucag

SEQ ID NO: 1167084 - RNA, 14 nt, Homo sapiens
aagcgugugugaac

SEQ ID NO: 1167085 - RNA, 23 nt, Homo sapiens
aagcuaaauauuuaacauuguug

SEQ ID NO: 1167086 - RNA, 11 nt, Homo sapiens
aagcuacaggu

SEQ ID NO: 1167087 - RNA, 12 nt, Homo sapiens
aagcuacuuucu

SEQ ID NO: 1167088 - RNA, 18 nt, Homo sapiens
aagcuaguguaccuccuc

SEQ ID NO: 1167089 - RNA, 22 nt, Homo sapiens
aagcuauuauaaaacuugaauu

SEQ ID NO: 1167090 - RNA, 15 nt, Homo sapiens
aagcucccagaguuu

SEQ ID NO: 1167091 - RNA, 14 nt, Homo sapiens
aagcucuagaaucu

SEQ ID NO: 1167092 - RNA, 21 nt, Homo sapiens
aagcucuagaaucugcaauuc

SEQ ID NO: 1167093 - RNA, 17 nt, Homo sapiens
aagcugauuaccugaag

SEQ ID NO: 1167094 - RNA, 12 nt, Homo sapiens
aagcugccucaa

SEQ ID NO: 1167095 - RNA, 12 nt, Homo sapiens
aagcugcucagg

SEQ ID NO: 1167096 - RNA, 12 nt, Homo sapiens
aagcugcugcuu

SEQ ID NO: 1167097 - RNA, 16 nt, Homo sapiens
aagcugcugugacugu

SEQ ID NO: 1167098 - RNA, 22 nt, Homo sapiens
aagcugggacucauucacauuu

SEQ ID NO: 1167099 - RNA, 21 nt, Homo sapiens
aagcugugcccugaccacccu

SEQ ID NO: 1167100 - RNA, 14 nt, Homo sapiens
aagcuguugcuauu

SEQ ID NO: 1167101 - RNA, 16 nt, Homo sapiens
aagcuuccauaguggu

SEQ ID NO: 1167102 - RNA, 19 nt, Homo sapiens
aagcuuccuagcuuaucuc

SEQ ID NO: 1167103 - RNA, 22 nt, Homo sapiens
aagcuuguauuuaacugaauaa

SEQ ID NO: 1167104 - RNA, 17 nt, Homo sapiens
aagcuuuauauaccucu

SEQ ID NO: 1167105 - RNA, 10 nt, Homo sapiens
aagcuuuauu

SEQ ID NO: 1167106 - RNA, 20 nt, Homo sapiens
aagcuuuauuucaaaucucu

SEQ ID NO: 1167107 - RNA, 22 nt, Homo sapiens
aagcuuuuggagggugauauaa

SEQ ID NO: 1167108 - RNA, 20 nt, Homo sapiens
aagcuuuuuuugaaucauca

SEQ ID NO: 1167109 - RNA, 17 nt, Homo sapiens
aaggaaaacugccauaa

SEQ ID NO: 1167110 - RNA, 20 nt, Homo sapiens
aaggaaaagacugaaucuac

SEQ ID NO: 1167111 - RNA, 15 nt, Homo sapiens
aaggaaaagcacaag

SEQ ID NO: 1167112 - RNA, 13 nt, Homo sapiens
aaggaaacccagc

SEQ ID NO: 1167113 - RNA, 17 nt, Homo sapiens
aaggaaagaugaugcuc

SEQ ID NO: 1167114 - RNA, 18 nt, Homo sapiens
aaggaaaggcacauuaca

SEQ ID NO: 1167115 - RNA, 21 nt, Homo sapiens
aaggaaauaguaccuucaaua

SEQ ID NO: 1167116 - RNA, 14 nt, Homo sapiens
aaggaaccaaagcg

SEQ ID NO: 1167117 - RNA, 12 nt, Homo sapiens
aaggaacuucca

SEQ ID NO: 1167118 - RNA, 22 nt, Homo sapiens
aaggaagcaaguuuucuuccau

SEQ ID NO: 1167119 - RNA, 15 nt, Homo sapiens
aaggaaggacuauga

SEQ ID NO: 1167120 - RNA, 15 nt, Homo sapiens
aaggaaucauuguuc

SEQ ID NO: 1167121 - RNA, 18 nt, Homo sapiens
aaggaaucuggcauucua

SEQ ID NO: 1167122 - RNA, 16 nt, Homo sapiens
aaggacaaacagugaa

SEQ ID NO: 1167123 - RNA, 19 nt, Homo sapiens
aaggacagaguaugaacac

SEQ ID NO: 1167124 - RNA, 20 nt, Homo sapiens
aaggaccacuucucauauua

SEQ ID NO: 1167125 - RNA, 16 nt, Homo sapiens
aaggacuaugacaaau

SEQ ID NO: 1167126 - RNA, 14 nt, Homo sapiens
aaggacuucauccc

SEQ ID NO: 1167127 - RNA, 13 nt, Homo sapiens
aaggagaaucaaa

SEQ ID NO: 1167128 - RNA, 13 nt, Homo sapiens
aaggagacacaga

SEQ ID NO: 1167129 - RNA, 17 nt, Homo sapiens
aaggagaggaguucuuu

SEQ ID NO: 1167130 - RNA, 20 nt, Homo sapiens
aaggaggcugaucccugaga

SEQ ID NO: 1167131 - RNA, 16 nt, Homo sapiens
aaggaguaaucugugu

SEQ ID NO: 1167132 - RNA, 13 nt, Homo sapiens
aaggaguguauga

SEQ ID NO: 1167133 - RNA, 21 nt, Homo sapiens
aaggauaugguagcauuuuau

SEQ ID NO: 1167134 - RNA, 18 nt, Homo sapiens
aaggaugccuuagcaugu

SEQ ID NO: 1167135 - RNA, 22 nt, Homo sapiens
aaggauguguuuucagucuuuc

SEQ ID NO: 1167136 - RNA, 15 nt, Homo sapiens
aaggauuucuuguau

SEQ ID NO: 1167137 - RNA, 22 nt, Homo sapiens
aaggcacacagcaagucagggu

SEQ ID NO: 1167138 - RNA, 18 nt, Homo sapiens
aaggcacuaaaaagagcu

SEQ ID NO: 1167139 - RNA, 13 nt, Homo sapiens
aaggcagcaacaa

SEQ ID NO: 1167140 - RNA, 16 nt, Homo sapiens
aaggcauccaggccag

SEQ ID NO: 1167141 - RNA, 19 nt, Homo sapiens
aaggccccgagcucagggc

SEQ ID NO: 1167142 - RNA, 13 nt, Homo sapiens
aaggccucugugg

SEQ ID NO: 1167143 - RNA, 15 nt, Homo sapiens
aaggccuuaagcuuu

SEQ ID NO: 1167144 - RNA, 22 nt, Homo sapiens
aaggccuuuuguacuacacacc

SEQ ID NO: 1167145 - RNA, 21 nt, Homo sapiens
aaggcgcuuugaaacaggggc

SEQ ID NO: 1167146 - RNA, 14 nt, Homo sapiens
aaggcuaagcuuca

SEQ ID NO: 1167147 - RNA, 16 nt, Homo sapiens
aaggcucugugccuug

SEQ ID NO: 1167148 - RNA, 21 nt, Homo sapiens
aaggcucuuacccccuuuuaa

SEQ ID NO: 1167149 - RNA, 16 nt, Homo sapiens
aaggcugcaagguuua

SEQ ID NO: 1167150 - RNA, 20 nt, Homo sapiens
aaggcugccagguguggaac

SEQ ID NO: 1167151 - RNA, 21 nt, Homo sapiens
aaggcugccagguguggaaca

SEQ ID NO: 1167152 - RNA, 14 nt, Homo sapiens
aaggcuugguccca

SEQ ID NO: 1167153 - RNA, 15 nt, Homo sapiens
aaggcuuugaguuaa

SEQ ID NO: 1167154 - RNA, 15 nt, Homo sapiens
aagggaaaacccuca

SEQ ID NO: 1167155 - RNA, 20 nt, Homo sapiens
aagggaauucggugugcacc

SEQ ID NO: 1167156 - RNA, 15 nt, Homo sapiens
aagggagaaagggag

SEQ ID NO: 1167157 - RNA, 18 nt, Homo sapiens
aagggcagcuccacaggg

SEQ ID NO: 1167158 - RNA, 22 nt, Homo sapiens
aagggcaguacaguggcuucaa

SEQ ID NO: 1167159 - RNA, 20 nt, Homo sapiens
aagggccaccuacaauacau

SEQ ID NO: 1167160 - RNA, 14 nt, Homo sapiens
aagggccacuggga

SEQ ID NO: 1167161 - RNA, 15 nt, Homo sapiens
aagggccacugggac

SEQ ID NO: 1167162 - RNA, 19 nt, Homo sapiens
aagggcgccucaccugcuc

SEQ ID NO: 1167163 - RNA, 20 nt, Homo sapiens
aaggggaagccuccugucuc

SEQ ID NO: 1167164 - RNA, 20 nt, Homo sapiens
aaggggagccaaaaucucaa

SEQ ID NO: 1167165 - RNA, 17 nt, Homo sapiens
aagggggaccaugggga

SEQ ID NO: 1167166 - RNA, 17 nt, Homo sapiens
aaggggugaaucuccuu

SEQ ID NO: 1167167 - RNA, 19 nt, Homo sapiens
aaggguggaggguaaucuc

SEQ ID NO: 1167168 - RNA, 12 nt, Homo sapiens
aaggguucuugg

SEQ ID NO: 1167169 - RNA, 21 nt, Homo sapiens
aaggguuuaugcuuacgucuc

SEQ ID NO: 1167170 - RNA, 14 nt, Homo sapiens
aagguaaaaugcca

SEQ ID NO: 1167171 - RNA, 16 nt, Homo sapiens
aagguaaaaugccaug

SEQ ID NO: 1167172 - RNA, 13 nt, Homo sapiens
aagguacacuggu

SEQ ID NO: 1167173 - RNA, 17 nt, Homo sapiens
aagguacugguacuaua

SEQ ID NO: 1167174 - RNA, 19 nt, Homo sapiens
aaggucaagaacacaguga

SEQ ID NO: 1167175 - RNA, 19 nt, Homo sapiens
aaggucauggccacacugu

SEQ ID NO: 1167176 - RNA, 22 nt, Homo sapiens
aagguccugcuauuacuaagga

SEQ ID NO: 1167177 - RNA, 17 nt, Homo sapiens
aaggucucacacuccuc

SEQ ID NO: 1167178 - RNA, 17 nt, Homo sapiens
aaggucugagcacugga

SEQ ID NO: 1167179 - RNA, 21 nt, Homo sapiens
aaggugaagguaacuauuaga

SEQ ID NO: 1167180 - RNA, 19 nt, Homo sapiens
aauagaaggauguacauuu

SEQ ID NO: 1167181 - RNA, 22 nt, Homo sapiens
aauagaauuugagcaucaguga

SEQ ID NO: 1167182 - RNA, 15 nt, Homo sapiens
aauagacacugggga

SEQ ID NO: 1167183 - RNA, 21 nt, Homo sapiens
aauagaucuuuauaaccugau

SEQ ID NO: 1167184 - RNA, 16 nt, Homo sapiens
aauagccacauuugga

SEQ ID NO: 1167185 - RNA, 15 nt, Homo sapiens
aauagcccuguaaca

SEQ ID NO: 1167186 - RNA, 18 nt, Homo sapiens
aauaguaaacacagggaa

SEQ ID NO: 1167187 - RNA, 19 nt, Homo sapiens
aauaguacauaaucuuuau

SEQ ID NO: 1167188 - RNA, 21 nt, Homo sapiens
aauaguacauaaucuuuauga

SEQ ID NO: 1167189 - RNA, 17 nt, Homo sapiens
aauaguaccuucaauac

SEQ ID NO: 1167190 - RNA, 21 nt, Homo sapiens
aauagucuagauggcuccucu

SEQ ID NO: 1167191 - RNA, 16 nt, Homo sapiens
aauagucuuccacaaa

SEQ ID NO: 1167192 - RNA, 19 nt, Homo sapiens
aauaguuccugaacauugc

SEQ ID NO: 1167193 - RNA, 22 nt, Homo sapiens
aauauaaaaggcaaauguguac

SEQ ID NO: 1167194 - RNA, 23 nt, Homo sapiens
aauauaaagccucaaaucuuccu

SEQ ID NO: 1167195 - RNA, 12 nt, Homo sapiens
aauauacauuca

SEQ ID NO: 1167196 - RNA, 18 nt, Homo sapiens
aauauacauucaaacuua

SEQ ID NO: 1167197 - RNA, 12 nt, Homo sapiens
aauauacuguaa

SEQ ID NO: 1167198 - RNA, 12 nt, Homo sapiens
aauauaguccaa

SEQ ID NO: 1167199 - RNA, 18 nt, Homo sapiens
aauauauccugaaagcau

SEQ ID NO: 1167200 - RNA, 14 nt, Homo sapiens
aauaucaaaugcag

SEQ ID NO: 1167201 - RNA, 13 nt, Homo sapiens
aauauccauauag

SEQ ID NO: 1167202 - RNA, 15 nt, Homo sapiens
aauauccugcuugau

SEQ ID NO: 1167203 - RNA, 13 nt, Homo sapiens
aauaucuauuaac

SEQ ID NO: 1167204 - RNA, 16 nt, Homo sapiens
aauaucugaaauguga

SEQ ID NO: 1167205 - RNA, 19 nt, Homo sapiens
aauaugcaccaaaucaucu

SEQ ID NO: 1167206 - RNA, 15 nt, Homo sapiens
aauaugcauaaucag

SEQ ID NO: 1167207 - RNA, 19 nt, Homo sapiens
aauaugccuuuuugaagca

SEQ ID NO: 1167208 - RNA, 13 nt, Homo sapiens
aauauggacauau

SEQ ID NO: 1167209 - RNA, 13 nt, Homo sapiens
aauauguauacac

SEQ ID NO: 1167210 - RNA, 20 nt, Homo sapiens
aauauguguggcagugaaga

SEQ ID NO: 1167211 - RNA, 21 nt, Homo sapiens
aauauguuuaucaacucaaga

SEQ ID NO: 1167212 - RNA, 15 nt, Homo sapiens
aauauuagcaaagaa

SEQ ID NO: 1167213 - RNA, 17 nt, Homo sapiens
aauauuagcuugcuuaa

SEQ ID NO: 1167214 - RNA, 17 nt, Homo sapiens
aauauuagggaguaaaa

SEQ ID NO: 1167215 - RNA, 14 nt, Homo sapiens
aauauucauuugcu

SEQ ID NO: 1167216 - RNA, 18 nt, Homo sapiens
aauauuuaaaaaugucuu

SEQ ID NO: 1167217 - RNA, 14 nt, Homo sapiens
aauauuuauugaag

SEQ ID NO: 1167218 - RNA, 21 nt, Homo sapiens
aauauuuauuuaacuauucau

SEQ ID NO: 1167219 - RNA, 20 nt, Homo sapiens
aauauuucagagcagaggca

SEQ ID NO: 1167220 - RNA, 19 nt, Homo sapiens
aauauuuuaagaauuucac

SEQ ID NO: 1167221 - RNA, 15 nt, Homo sapiens
aauauuuuaucuuuc

SEQ ID NO: 1167222 - RNA, 22 nt, Homo sapiens
aauauuuucagcaaaacuuucc

SEQ ID NO: 1167223 - RNA, 23 nt, Homo sapiens
aauauuuuucuaaagaaauuaca

SEQ ID NO: 1167224 - RNA, 19 nt, Homo sapiens
aauauuuuuggucauugua

SEQ ID NO: 1167225 - RNA, 20 nt, Homo sapiens
aaucaaaaagaggagauuaa

SEQ ID NO: 1167226 - RNA, 20 nt, Homo sapiens
aaucaaaacccaacaugacu

SEQ ID NO: 1167227 - RNA, 18 nt, Homo sapiens
aaucaaaggcgcuuugaa

SEQ ID NO: 1167228 - RNA, 12 nt, Homo sapiens
aaucaacagaua

SEQ ID NO: 1167229 - RNA, 14 nt, Homo sapiens
aaucaagauuuaau

SEQ ID NO: 1167230 - RNA, 20 nt, Homo sapiens
aaucaagucagcaacagagc

SEQ ID NO: 1167231 - RNA, 13 nt, Homo sapiens
aaucaagucucac

SEQ ID NO: 1167232 - RNA, 22 nt, Homo sapiens
aaucaaguuugaccagugcagu

SEQ ID NO: 1167233 - RNA, 21 nt, Homo sapiens
aaucaaucuguaaaacuaaga

SEQ ID NO: 1167234 - RNA, 23 nt, Homo sapiens
aaucaccacaaacuguaauacaa

SEQ ID NO: 1167235 - RNA, 16 nt, Homo sapiens
aaucaccagagaccaa

SEQ ID NO: 1167236 - RNA, 14 nt, Homo sapiens
aaucaccucucugu

SEQ ID NO: 1167237 - RNA, 18 nt, Homo sapiens
aaucacuuagacuccccu

SEQ ID NO: 1167238 - RNA, 17 nt, Homo sapiens
aaucagaacuguuggca

SEQ ID NO: 1167239 - RNA, 20 nt, Homo sapiens
aaucagacuucacacugcaa

SEQ ID NO: 1167240 - RNA, 19 nt, Homo sapiens
aaucagccagacauggugg

SEQ ID NO: 1167241 - RNA, 20 nt, Homo sapiens
aaucagccucgcucuugucu

SEQ ID NO: 1167242 - RNA, 22 nt, Homo sapiens
aaucaguucuuagauucagggg

SEQ ID NO: 1167243 - RNA, 23 nt, Homo sapiens
aaucauaaauauaaucuaauaca

SEQ ID NO: 1167244 - RNA, 23 nt, Homo sapiens
aaucauagcaauaucauaauuaa

SEQ ID NO: 1167245 - RNA, 15 nt, Homo sapiens
aaucaucucucauca

SEQ ID NO: 1167246 - RNA, 21 nt, Homo sapiens
aaucauguugaucauguacuu

SEQ ID NO: 1167247 - RNA, 20 nt, Homo sapiens
aaucauuuucauuccuaaag

SEQ ID NO: 1167248 - RNA, 16 nt, Homo sapiens
aauccaaaucuguccu

SEQ ID NO: 1167249 - RNA, 15 nt, Homo sapiens
aauccaaaugcauuc

SEQ ID NO: 1167250 - RNA, 18 nt, Homo sapiens
aauccaugggucuggcua

SEQ ID NO: 1167251 - RNA, 20 nt, Homo sapiens
aaucccagcauuagcuuccu

SEQ ID NO: 1167252 - RNA, 18 nt, Homo sapiens
aaucccagcuacucagga

SEQ ID NO: 1167253 - RNA, 10 nt, Homo sapiens
aaucccucaa

SEQ ID NO: 1167254 - RNA, 14 nt, Homo sapiens
aaucccugucuugc

SEQ ID NO: 1167255 - RNA, 22 nt, Homo sapiens
aauccgagauaggguggcacau

SEQ ID NO: 1167256 - RNA, 15 nt, Homo sapiens
aauccugcagugggg

SEQ ID NO: 1167257 - RNA, 14 nt, Homo sapiens
aauccuuccaugaa

SEQ ID NO: 1167258 - RNA, 21 nt, Homo sapiens
aauccuugugggaaaagaaau

SEQ ID NO: 1167259 - RNA, 18 nt, Homo sapiens
aaucggcauguauacuua

SEQ ID NO: 1167260 - RNA, 22 nt, Homo sapiens
aaucuaaauagauacuuuugau

SEQ ID NO: 1167261 - RNA, 15 nt, Homo sapiens
aaucuaauacacuuu

SEQ ID NO: 1167262 - RNA, 16 nt, Homo sapiens
agaauuagauuucuau

SEQ ID NO: 1167263 - RNA, 13 nt, Homo sapiens
agaauuagcuuuu

SEQ ID NO: 1167264 - RNA, 21 nt, Homo sapiens
agaauuaugauggaagacagg

SEQ ID NO: 1167265 - RNA, 19 nt, Homo sapiens
agaauucaauuugaacuca

SEQ ID NO: 1167266 - RNA, 16 nt, Homo sapiens
agaauugguugccaua

SEQ ID NO: 1167267 - RNA, 18 nt, Homo sapiens
agaauuucacaagcuauu

SEQ ID NO: 1167268 - RNA, 18 nt, Homo sapiens
agaauuuccuaaugagau

SEQ ID NO: 1167269 - RNA, 19 nt, Homo sapiens
agacaaauccuuucugccc

SEQ ID NO: 1167270 - RNA, 18 nt, Homo sapiens
agacaacagauuuacauc

SEQ ID NO: 1167271 - RNA, 13 nt, Homo sapiens
agacaagaacuau

SEQ ID NO: 1167272 - RNA, 21 nt, Homo sapiens
agacaagcucaaguguucaca

SEQ ID NO: 1167273 - RNA, 16 nt, Homo sapiens
agacaaguauggcucc

SEQ ID NO: 1167274 - RNA, 21 nt, Homo sapiens
agacaaguauggcuccuccau

SEQ ID NO: 1167275 - RNA, 19 nt, Homo sapiens
agacaauagcccaaagcca

SEQ ID NO: 1167276 - RNA, 17 nt, Homo sapiens
agacaaugguuguguag

SEQ ID NO: 1167277 - RNA, 18 nt, Homo sapiens
agacacagcccugaauca

SEQ ID NO: 1167278 - RNA, 19 nt, Homo sapiens
agacacccaggacuuauuu

SEQ ID NO: 1167279 - RNA, 18 nt, Homo sapiens
agacaccuguucacagaa

SEQ ID NO: 1167280 - RNA, 16 nt, Homo sapiens
agacaccuucugugcu

SEQ ID NO: 1167281 - RNA, 19 nt, Homo sapiens
agacaccuucugugcucau

SEQ ID NO: 1167282 - RNA, 17 nt, Homo sapiens
agacacuacaacauaug

SEQ ID NO: 1167283 - RNA, 19 nt, Homo sapiens
agacagacaacacugggaa

SEQ ID NO: 1167284 - RNA, 12 nt, Homo sapiens
agacagauacua

SEQ ID NO: 1167285 - RNA, 16 nt, Homo sapiens
agacagcuuacugcag

SEQ ID NO: 1167286 - RNA, 21 nt, Homo sapiens
agacaggaaaguucagaguuu

SEQ ID NO: 1167287 - RNA, 12 nt, Homo sapiens
agacaguaugca

SEQ ID NO: 1167288 - RNA, 17 nt, Homo sapiens
agacagugcacaugaac

SEQ ID NO: 1167289 - RNA, 17 nt, Homo sapiens
agacauacuccuuccau

SEQ ID NO: 1167290 - RNA, 19 nt, Homo sapiens
agacauacuccuuccauca

SEQ ID NO: 1167291 - RNA, 13 nt, Homo sapiens
agacauacuugaa

SEQ ID NO: 1167292 - RNA, 17 nt, Homo sapiens
agacauaggccaugaaa

SEQ ID NO: 1167293 - RNA, 21 nt, Homo sapiens
agacaugauuuccuugaaugu

SEQ ID NO: 1167294 - RNA, 12 nt, Homo sapiens
agacauggccaa

SEQ ID NO: 1167295 - RNA, 24 nt, Homo sapiens
agacaugguggcaugcaccugcaa

SEQ ID NO: 1167296 - RNA, 23 nt, Homo sapiens
agacauuaacucauuagacugga

SEQ ID NO: 1167297 - RNA, 21 nt, Homo sapiens
agaccaagcugugcccugacc

SEQ ID NO: 1167298 - RNA, 16 nt, Homo sapiens
agaccaccaacguguc

SEQ ID NO: 1167299 - RNA, 23 nt, Homo sapiens
agaccagacucgccaacauggug

SEQ ID NO: 1167300 - RNA, 15 nt, Homo sapiens
agaccauuuguauua

SEQ ID NO: 1167301 - RNA, 19 nt, Homo sapiens
agaccauuuguauuaccau

SEQ ID NO: 1167302 - RNA, 18 nt, Homo sapiens
agacccaaguagcugcua

SEQ ID NO: 1167303 - RNA, 23 nt, Homo sapiens
agacccaggagccggacacuucu

SEQ ID NO: 1167304 - RNA, 13 nt, Homo sapiens
agacccaucucaa

SEQ ID NO: 1167305 - RNA, 16 nt, Homo sapiens
agaccccaaaaagagu

SEQ ID NO: 1167306 - RNA, 16 nt, Homo sapiens
agacccccagcacuug

SEQ ID NO: 1167307 - RNA, 14 nt, Homo sapiens
agaccgaccaccag

SEQ ID NO: 1167308 - RNA, 22 nt, Homo sapiens
agaccguuauaaagugugccac

SEQ ID NO: 1167309 - RNA, 22 nt, Homo sapiens
agaccucccuguucaaggcccc

SEQ ID NO: 1167310 - RNA, 19 nt, Homo sapiens
agaccucuuuuucuuacca

SEQ ID NO: 1167311 - RNA, 19 nt, Homo sapiens
agaccugacaccuuucaua

SEQ ID NO: 1167312 - RNA, 17 nt, Homo sapiens
agaccugcgauggacuu

SEQ ID NO: 1167313 - RNA, 14 nt, Homo sapiens
agaccuggacacag

SEQ ID NO: 1167314 - RNA, 22 nt, Homo sapiens
agaccuggugcucuaaugccaa

SEQ ID NO: 1167315 - RNA, 19 nt, Homo sapiens
agaccuuccauaaugcuac

SEQ ID NO: 1167316 - RNA, 14 nt, Homo sapiens
agaccuugcugaua

SEQ ID NO: 1167317 - RNA, 17 nt, Homo sapiens
agaccuuucuuugggac

SEQ ID NO: 1167318 - RNA, 20 nt, Homo sapiens
agaccuuucuuugggacugu

SEQ ID NO: 1167319 - RNA, 21 nt, Homo sapiens
agaccuuugauuuuugcccag

SEQ ID NO: 1167320 - RNA, 19 nt, Homo sapiens
agacgcauuucgguugaga

SEQ ID NO: 1167321 - RNA, 14 nt, Homo sapiens
agacgucucaagac

SEQ ID NO: 1167322 - RNA, 20 nt, Homo sapiens
agacuaccugcccucagcuu

SEQ ID NO: 1167323 - RNA, 17 nt, Homo sapiens
agacuacuaaugacuuu

SEQ ID NO: 1167324 - RNA, 20 nt, Homo sapiens
agacuaucaucaguacauuc

SEQ ID NO: 1167325 - RNA, 16 nt, Homo sapiens
agacucaaaugcucag

SEQ ID NO: 1167326 - RNA, 17 nt, Homo sapiens
agacucaaauguucuaa

SEQ ID NO: 1167327 - RNA, 17 nt, Homo sapiens
agacucaucuuacugua

SEQ ID NO: 1167328 - RNA, 14 nt, Homo sapiens
agacucauggauug

SEQ ID NO: 1167329 - RNA, 19 nt, Homo sapiens
agacucucgcaucuuccca

SEQ ID NO: 1167330 - RNA, 20 nt, Homo sapiens
agacugaacuuacacuguau

SEQ ID NO: 1167331 - RNA, 17 nt, Homo sapiens
agacugaagauggcuuu

SEQ ID NO: 1167332 - RNA, 16 nt, Homo sapiens
agacugcuaaaugcac

SEQ ID NO: 1167333 - RNA, 14 nt, Homo sapiens
agacugguugcaua

SEQ ID NO: 1167334 - RNA, 16 nt, Homo sapiens
agacuuacucuaagau

SEQ ID NO: 1167335 - RNA, 19 nt, Homo sapiens
agacuuauggaacagggau

SEQ ID NO: 1167336 - RNA, 11 nt, Homo sapiens
agacuucccag

SEQ ID NO: 1167337 - RNA, 14 nt, Homo sapiens
agacuugcauuuaa

SEQ ID NO: 1167338 - RNA, 13 nt, Homo sapiens
agacuuguuguga

SEQ ID NO: 1167339 - RNA, 14 nt, Homo sapiens
agaugaugcucagu

SEQ ID NO: 1167340 - RNA, 14 nt, Homo sapiens
agaugauugaauaa

SEQ ID NO: 1167341 - RNA, 22 nt, Homo sapiens
agaugauugaauaacaguaguc

SEQ ID NO: 1167342 - RNA, 11 nt, Homo sapiens
agaugcaaaua

SEQ ID NO: 1167343 - RNA, 22 nt, Homo sapiens
agaugcacagaauauguaugua

SEQ ID NO: 1167344 - RNA, 16 nt, Homo sapiens
agaugcuccaagauuc

SEQ ID NO: 1167345 - RNA, 15 nt, Homo sapiens
agaugcuuggagcaa

SEQ ID NO: 1167346 - RNA, 21 nt, Homo sapiens
agaugcuuuccugcacauuaa

SEQ ID NO: 1167347 - RNA, 16 nt, Homo sapiens
agauggacuccagccu

SEQ ID NO: 1167348 - RNA, 14 nt, Homo sapiens
agauggaguucuug

SEQ ID NO: 1167349 - RNA, 20 nt, Homo sapiens
agauggaguucuugugccau

SEQ ID NO: 1167350 - RNA, 21 nt, Homo sapiens
agauggaguucuugugccaua

SEQ ID NO: 1167351 - RNA, 15 nt, Homo sapiens
agauggccacugcuc

SEQ ID NO: 1167352 - RNA, 16 nt, Homo sapiens
agauggcgacaaaagu

SEQ ID NO: 1167353 - RNA, 19 nt, Homo sapiens
agauggcuaggccaucacc

SEQ ID NO: 1167354 - RNA, 18 nt, Homo sapiens
agauggcuuuuccuggac

SEQ ID NO: 1167355 - RNA, 15 nt, Homo sapiens
agaugguugccaagc

SEQ ID NO: 1167356 - RNA, 16 nt, Homo sapiens
agaugguuucuugcaa

SEQ ID NO: 1167357 - RNA, 16 nt, Homo sapiens
agaugugagggcacca

SEQ ID NO: 1167358 - RNA, 19 nt, Homo sapiens
agaugugauauucuaagac

SEQ ID NO: 1167359 - RNA, 13 nt, Homo sapiens
agaugugcaauug

SEQ ID NO: 1167360 - RNA, 17 nt, Homo sapiens
agauguggaaaagccaa

SEQ ID NO: 1167361 - RNA, 20 nt, Homo sapiens
agauguucccccaucucgcu

SEQ ID NO: 1167362 - RNA, 23 nt, Homo sapiens
agauguugaauucuuuugccaag

SEQ ID NO: 1167363 - RNA, 21 nt, Homo sapiens
agauguugauuuuuacugugu

SEQ ID NO: 1167364 - RNA, 23 nt, Homo sapiens
agauuaagagauggguuugacaa

SEQ ID NO: 1167365 - RNA, 14 nt, Homo sapiens
agauuacacuccag

SEQ ID NO: 1167366 - RNA, 22 nt, Homo sapiens
agauuagcccuuccuugccagu

SEQ ID NO: 1167367 - RNA, 16 nt, Homo sapiens
agauuaucagaccucu

SEQ ID NO: 1167368 - RNA, 15 nt, Homo sapiens
agauucaugcacugu

SEQ ID NO: 1167369 - RNA, 15 nt, Homo sapiens
agauucccacugccg

SEQ ID NO: 1167370 - RNA, 20 nt, Homo sapiens
agauucuaacauauugccau

SEQ ID NO: 1167371 - RNA, 14 nt, Homo sapiens
agauucuagaugau

SEQ ID NO: 1167372 - RNA, 23 nt, Homo sapiens
agauucuggagcaaucugacccu

SEQ ID NO: 1167373 - RNA, 13 nt, Homo sapiens
agauucuguggaa

SEQ ID NO: 1167374 - RNA, 16 nt, Homo sapiens
agauugaagccuuugc

SEQ ID NO: 1167375 - RNA, 23 nt, Homo sapiens
agauugaucaaaguguaaacacc

SEQ ID NO: 1167376 - RNA, 14 nt, Homo sapiens
agauugaugugcac

SEQ ID NO: 1167377 - RNA, 20 nt, Homo sapiens
agauuggaccagacccugaa

SEQ ID NO: 1167378 - RNA, 20 nt, Homo sapiens
agauuguauauuuauucaca

SEQ ID NO: 1167379 - RNA, 16 nt, Homo sapiens
agauuuagaggggaaa

SEQ ID NO: 1167380 - RNA, 24 nt, Homo sapiens
agauuuccugugaguaaucuugca

SEQ ID NO: 1167381 - RNA, 13 nt, Homo sapiens
agauuugaccucc

SEQ ID NO: 1167382 - RNA, 14 nt, Homo sapiens
agauuugaggcugg

SEQ ID NO: 1167383 - RNA, 12 nt, Homo sapiens
agauuugcucau

SEQ ID NO: 1167384 - RNA, 20 nt, Homo sapiens
agauuuggugauggaaaaag

SEQ ID NO: 1167385 - RNA, 19 nt, Homo sapiens
agauuuuaucugggggaaa

SEQ ID NO: 1167386 - RNA, 15 nt, Homo sapiens
agauuuucaaacaaa

SEQ ID NO: 1167387 - RNA, 23 nt, Homo sapiens
agauuuuucauuuuuccaugaca

SEQ ID NO: 1167388 - RNA, 19 nt, Homo sapiens
agcaaaaacauguaugugc

SEQ ID NO: 1167389 - RNA, 22 nt, Homo sapiens
agcaaaagcccuaacuucuuau

SEQ ID NO: 1167390 - RNA, 20 nt, Homo sapiens
agcaaaauccuuacuuccag

SEQ ID NO: 1167391 - RNA, 13 nt, Homo sapiens
agcaaacaaguug

SEQ ID NO: 1167392 - RNA, 17 nt, Homo sapiens
agcaaacucugcugucu

SEQ ID NO: 1167393 - RNA, 22 nt, Homo sapiens
agcaaacugaauggcaaugaaa

SEQ ID NO: 1167394 - RNA, 19 nt, Homo sapiens
agcaaaggauguguuuuca

SEQ ID NO: 1167395 - RNA, 16 nt, Homo sapiens
agcaaauagaucaugc

SEQ ID NO: 1167396 - RNA, 17 nt, Homo sapiens
agcaaauagaucaugca

SEQ ID NO: 1167397 - RNA, 18 nt, Homo sapiens
agcaaauagaucaugcau

SEQ ID NO: 1167398 - RNA, 17 nt, Homo sapiens
agcaaaucgugccuugu

SEQ ID NO: 1167399 - RNA, 22 nt, Homo sapiens
agcaacaucuuuuuaaccugca

SEQ ID NO: 1167400 - RNA, 15 nt, Homo sapiens
agcaacauggugaga

SEQ ID NO: 1167401 - RNA, 12 nt, Homo sapiens
agcaaccugccu

SEQ ID NO: 1167402 - RNA, 14 nt, Homo sapiens
agcaacguguuaau

SEQ ID NO: 1167403 - RNA, 17 nt, Homo sapiens
agcaagacccaucucaa

SEQ ID NO: 1167404 - RNA, 16 nt, Homo sapiens
agcaagaccucaucuc

SEQ ID NO: 1167405 - RNA, 21 nt, Homo sapiens
agcaaggguugggcccagugu

SEQ ID NO: 1167406 - RNA, 20 nt, Homo sapiens
agcaagucuuagacaucaua

SEQ ID NO: 1167407 - RNA, 17 nt, Homo sapiens
agcaagugugcucuccu

SEQ ID NO: 1167408 - RNA, 18 nt, Homo sapiens
agcaaguuacagugaugc

SEQ ID NO: 1167409 - RNA, 15 nt, Homo sapiens
agcaaguucugagag

SEQ ID NO: 1167410 - RNA, 19 nt, Homo sapiens
agcaaguucugagagccag

SEQ ID NO: 1167411 - RNA, 16 nt, Homo sapiens
agcaaguuuucuucca

SEQ ID NO: 1167412 - RNA, 19 nt, Homo sapiens
agcaauacguuugugcaga

SEQ ID NO: 1167413 - RNA, 21 nt, Homo sapiens
agcaauaucauaauuaaugua

SEQ ID NO: 1167414 - RNA, 19 nt, Homo sapiens
agcaauccucucaccucag

SEQ ID NO: 1167415 - RNA, 20 nt, Homo sapiens
agcaaucgguuccccagauu

SEQ ID NO: 1167416 - RNA, 15 nt, Homo sapiens
agcaaucucuugcau

SEQ ID NO: 1167417 - RNA, 22 nt, Homo sapiens
agcaaugaaggagauagauuug

SEQ ID NO: 1167418 - RNA, 22 nt, Homo sapiens
agcaaugcugaugaaucacugu

SEQ ID NO: 1167419 - RNA, 24 nt, Homo sapiens
agcacaaacacaaggucauggcca

SEQ ID NO: 1167420 - RNA, 22 nt, Homo sapiens
agcacaaagugggagcccgaua

SEQ ID NO: 1167421 - RNA, 20 nt, Homo sapiens
agcacaaggccaucugggcu

SEQ ID NO: 1167422 - RNA, 17 nt, Homo sapiens
agcacagcugcauuaaa

SEQ ID NO: 1167423 - RNA, 13 nt, Homo sapiens
agcacaucaccuc

SEQ ID NO: 1167424 - RNA, 13 nt, Homo sapiens
agcacaugcaccu

SEQ ID NO: 1167425 - RNA, 16 nt, Homo sapiens
agcaccaccaggucuc

SEQ ID NO: 1167426 - RNA, 19 nt, Homo sapiens
agcacccccagccugccuu

SEQ ID NO: 1167427 - RNA, 14 nt, Homo sapiens
agcacccucuccag

SEQ ID NO: 1167428 - RNA, 19 nt, Homo sapiens
agcacccucuccagaugag

SEQ ID NO: 1167429 - RNA, 20 nt, Homo sapiens
agcacccucuccagaugcag

SEQ ID NO: 1167430 - RNA, 12 nt, Homo sapiens
agcaccgugcca

SEQ ID NO: 1167431 - RNA, 17 nt, Homo sapiens
agcaccguucugugcac

SEQ ID NO: 1167432 - RNA, 19 nt, Homo sapiens
agcaccugguugaugugua

SEQ ID NO: 1167433 - RNA, 12 nt, Homo sapiens
agcacucagaga

SEQ ID NO: 1167434 - RNA, 17 nt, Homo sapiens
agcacucucaccccaag

SEQ ID NO: 1167435 - RNA, 20 nt, Homo sapiens
agcacugcugccucagcuca

SEQ ID NO: 1167436 - RNA, 20 nt, Homo sapiens
agcacuggaaccaccuggac

SEQ ID NO: 1167437 - RNA, 16 nt, Homo sapiens
agcacuuccagaacuu

SEQ ID NO: 1167438 - RNA, 21 nt, Homo sapiens
agcacuugaagaauauuccca

SEQ ID NO: 1167439 - RNA, 12 nt, Homo sapiens
agcacuuugcaa

SEQ ID NO: 1167440 - RNA, 18 nt, Homo sapiens
agcacuuugggaggccaa

SEQ ID NO: 1167441 - RNA, 23 nt, Homo sapiens
agcagaaaggaaaagauuccugu

SEQ ID NO: 1167442 - RNA, 17 nt, Homo sapiens
agcagaacuucugaaac

SEQ ID NO: 1167443 - RNA, 19 nt, Homo sapiens
agcagacgggcaaguggag

SEQ ID NO: 1167444 - RNA, 21 nt, Homo sapiens
agcagacucagcucugacauu

SEQ ID NO: 1167445 - RNA, 17 nt, Homo sapiens
agcagagacaugacuca

SEQ ID NO: 1167446 - RNA, 19 nt, Homo sapiens
ggacaagacccucucaggc

SEQ ID NO: 1167447 - RNA, 14 nt, Homo sapiens
ggacacaucaggaa

SEQ ID NO: 1167448 - RNA, 18 nt, Homo sapiens
ggacacaucaggaaguua

SEQ ID NO: 1167449 - RNA, 18 nt, Homo sapiens
ggacacccucaccaccca

SEQ ID NO: 1167450 - RNA, 12 nt, Homo sapiens
ggacacugugac

SEQ ID NO: 1167451 - RNA, 13 nt, Homo sapiens
ggacacugugaca

SEQ ID NO: 1167452 - RNA, 15 nt, Homo sapiens
ggacagaagcagcuc

SEQ ID NO: 1167453 - RNA, 21 nt, Homo sapiens
ggacagaccuucaacuuccaa

SEQ ID NO: 1167454 - RNA, 19 nt, Homo sapiens
ggacagacuggccgggcag

SEQ ID NO: 1167455 - RNA, 12 nt, Homo sapiens
ggacagagggug

SEQ ID NO: 1167456 - RNA, 17 nt, Homo sapiens
ggacaggauguguuugc

SEQ ID NO: 1167457 - RNA, 22 nt, Homo sapiens
ggacaggauguguuugcuuucu

SEQ ID NO: 1167458 - RNA, 23 nt, Homo sapiens
ggacauaaugggguccuggccau

SEQ ID NO: 1167459 - RNA, 15 nt, Homo sapiens
ggacaucacagggug

SEQ ID NO: 1167460 - RNA, 22 nt, Homo sapiens
ggacaucagcuggucaaacaaa

SEQ ID NO: 1167461 - RNA, 20 nt, Homo sapiens
ggaccagaaaccugggagag

SEQ ID NO: 1167462 - RNA, 16 nt, Homo sapiens
ggaccagaagcauuuc

SEQ ID NO: 1167463 - RNA, 19 nt, Homo sapiens
ggaccagaagcauuucacc

SEQ ID NO: 1167464 - RNA, 20 nt, Homo sapiens
ggaccagagggaugggagag

SEQ ID NO: 1167465 - RNA, 14 nt, Homo sapiens
guaaaugaacugau

SEQ ID NO: 1167466 - RNA, 15 nt, Homo sapiens
guaaaugaauuauua

SEQ ID NO: 1167467 - RNA, 13 nt, Homo sapiens
uaaagaauuacuu

SEQ ID NO: 1167468 - RNA, 13 nt, Homo sapiens
uaaagacaggguc

SEQ ID NO: 1167469 - RNA, 23 nt, Homo sapiens
uaaagacagggucucacucucau

SEQ ID NO: 1167470 - RNA, 18 nt, Homo sapiens
uaaagagagaugaaccac

SEQ ID NO: 1167471 - RNA, 19 nt, Homo sapiens
uaaagagagaugaaccaca

SEQ ID NO: 1167472 - RNA, 22 nt, Homo sapiens
uaaagauaggaauucacugaua

SEQ ID NO: 1167473 - RNA, 15 nt, Homo sapiens
uaaagaucuucugua

SEQ ID NO: 1167474 - RNA, 18 nt, Homo sapiens
uaaagauggauggcuguu

SEQ ID NO: 1167475 - RNA, 12 nt, Homo sapiens
uaaagauuuauc

SEQ ID NO: 1167476 - RNA, 20 nt, Homo sapiens
uaaagcaucauuaaugcaca

SEQ ID NO: 1167477 - RNA, 15 nt, Homo sapiens
uaaagccagucauca

SEQ ID NO: 1167478 - RNA, 13 nt, Homo sapiens
uaaaggaaccagu

SEQ ID NO: 1167479 - RNA, 23 nt, Homo sapiens
uaaaggaagcaaguuuucuucca

SEQ ID NO: 1167480 - RNA, 17 nt, Homo sapiens
uaaaggacaaacaguga

SEQ ID NO: 1167481 - RNA, 13 nt, Homo sapiens
uaaaggcaucuac

SEQ ID NO: 1167482 - RNA, 16 nt, Homo sapiens
uaaagggaaaacccuc

SEQ ID NO: 1167483 - RNA, 20 nt, Homo sapiens
uaaagugacuaauggcauga

SEQ ID NO: 1167484 - RNA, 18 nt, Homo sapiens
uaaaguugcacugugacu

SEQ ID NO: 1167485 - RNA, 18 nt, Homo sapiens
acacuuccaccauagcuu

SEQ ID NO: 1167486 - RNA, 13 nt, Homo sapiens
acacuucucagga

SEQ ID NO: 1167487 - RNA, 15 nt, Homo sapiens
acacuugcaaccuac

SEQ ID NO: 1167488 - RNA, 14 nt, Homo sapiens
acagaaacugaugc

SEQ ID NO: 1167489 - RNA, 16 nt, Homo sapiens
acagaacacacugaga

SEQ ID NO: 1167490 - RNA, 19 nt, Homo sapiens
acagaaggugaacuuugug

SEQ ID NO: 1167491 - RNA, 21 nt, Homo sapiens
acagaaguccccucuacuuua

SEQ ID NO: 1167492 - RNA, 18 nt, Homo sapiens
ccgagauaggguggcaca

SEQ ID NO: 1167493 - RNA, 17 nt, Homo sapiens
ccgagccuggcuccaaa

SEQ ID NO: 1167494 - RNA, 14 nt, Homo sapiens
ccgaggaaggugug

SEQ ID NO: 1167495 - RNA, 15 nt, Homo sapiens
ccgagguccaaggca

SEQ ID NO: 1167496 - RNA, 19 nt, Homo sapiens
ccgagguucgagucuugcu

SEQ ID NO: 1167497 - RNA, 19 nt, Homo sapiens
ccgaguccccgggcaucuu

SEQ ID NO: 1167498 - RNA, 12 nt, Homo sapiens
ccgauucaccug

SEQ ID NO: 1167499 - RNA, 17 nt, Homo sapiens
ccgcaaauuuucuucca

SEQ ID NO: 1167500 - RNA, 22 nt, Homo sapiens
ccgcacuuggaaagguuucaag

SEQ ID NO: 1167501 - RNA, 14 nt, Homo sapiens
ccgcagccuggcau

SEQ ID NO: 1167502 - RNA, 17 nt, Homo sapiens
ccgcaggugcugguccc

SEQ ID NO: 1167503 - RNA, 23 nt, Homo sapiens
ccgccauggugcuggggagccaa

SEQ ID NO: 1167504 - RNA, 20 nt, Homo sapiens
ccgccauugggcuacuguag

SEQ ID NO: 1167505 - RNA, 20 nt, Homo sapiens
ccgcccuaaaagcacacuca

SEQ ID NO: 1167506 - RNA, 15 nt, Homo sapiens
ccgccugccugccac

SEQ ID NO: 1167507 - RNA, 13 nt, Homo sapiens
ccgcggcccagac

SEQ ID NO: 1167508 - RNA, 14 nt, Homo sapiens
ccgcguagugucag

SEQ ID NO: 1167509 - RNA, 16 nt, Homo sapiens
ccgcuuuuucacuccc

SEQ ID NO: 1167510 - RNA, 16 nt, Homo sapiens
ccggagccuccagcug

SEQ ID NO: 1167511 - RNA, 20 nt, Homo sapiens
ccggcauccuugccugucua

SEQ ID NO: 1167512 - RNA, 23 nt, Homo sapiens
ccggccacaacuacaccacgaga

SEQ ID NO: 1167513 - RNA, 17 nt, Homo sapiens
ccggcgggugcucugag

SEQ ID NO: 1167514 - RNA, 16 nt, Homo sapiens
ccgggacccucaggug

SEQ ID NO: 1167515 - RNA, 20 nt, Homo sapiens
ccgguccccuucccaggggc

SEQ ID NO: 1167516 - RNA, 19 nt, Homo sapiens
ccgguggcggcagggccag

SEQ ID NO: 1167517 - RNA, 17 nt, Homo sapiens
ccgguucuuaaauccau

SEQ ID NO: 1167518 - RNA, 22 nt, Homo sapiens
ccgucucuacuaaaaauacaaa

SEQ ID NO: 1167519 - RNA, 20 nt, Homo sapiens
ccgugacaguuuacaaauga

SEQ ID NO: 1167520 - RNA, 14 nt, Homo sapiens
ccguggccuggcau

SEQ ID NO: 1167521 - RNA, 19 nt, Homo sapiens
ccguggcucacgucuguaa

SEQ ID NO: 1167522 - RNA, 15 nt, Homo sapiens
ccgugggaguacaaa

SEQ ID NO: 1167523 - RNA, 22 nt, Homo sapiens
ccguuaucauggagaacagcau

SEQ ID NO: 1167524 - RNA, 16 nt, Homo sapiens
ccguucagaaaaccac

SEQ ID NO: 1167525 - RNA, 23 nt, Homo sapiens
ccguuuuucaagaaaacuggaaa

SEQ ID NO: 1167526 - RNA, 14 nt, Homo sapiens
ccuaaaaacacaga

SEQ ID NO: 1167527 - RNA, 19 nt, Homo sapiens
ccuaaaaaguaucauuaca

SEQ ID NO: 1167528 - RNA, 12 nt, Homo sapiens
ccuaaaaaucug

SEQ ID NO: 1167529 - RNA, 18 nt, Homo sapiens
ccuaaaaguucucaaugu

SEQ ID NO: 1167530 - RNA, 15 nt, Homo sapiens
ccuaaacauaugaau

SEQ ID NO: 1167531 - RNA, 14 nt, Homo sapiens
ccuaaaucacuuug

SEQ ID NO: 1167532 - RNA, 15 nt, Homo sapiens
ccuaaaucacuuuga

SEQ ID NO: 1167533 - RNA, 16 nt, Homo sapiens
ccuaaauuaugacugc

SEQ ID NO: 1167534 - RNA, 9 nt, Homo sapiens
ccuaaccac

SEQ ID NO: 1167535 - RNA, 11 nt, Homo sapiens
ccuaaccacua

SEQ ID NO: 1167536 - RNA, 22 nt, Homo sapiens
ccuaagaauguuuugcacugac

SEQ ID NO: 1167537 - RNA, 16 nt, Homo sapiens
ccuaagacugcugcug

SEQ ID NO: 1167538 - RNA, 18 nt, Homo sapiens
ccuaagcagaccacugau

SEQ ID NO: 1167539 - RNA, 17 nt, Homo sapiens
ccuaaguagcuggguuu

SEQ ID NO: 1167540 - RNA, 13 nt, Homo sapiens
ccuaagucuuucu

SEQ ID NO: 1167541 - RNA, 19 nt, Homo sapiens
ccuaauagucauacuagua

SEQ ID NO: 1167542 - RNA, 20 nt, Homo sapiens
ccuaauccaggcagauccag

SEQ ID NO: 1167543 - RNA, 18 nt, Homo sapiens
ccuacaccucuugaaaau

SEQ ID NO: 1167544 - RNA, 21 nt, Homo sapiens
ccuacaccucuugcauuccau

SEQ ID NO: 1167545 - RNA, 13 nt, Homo sapiens
ccuacacugaugc

SEQ ID NO: 1167546 - RNA, 11 nt, Homo sapiens
ccuacauucaa

SEQ ID NO: 1167547 - RNA, 15 nt, Homo sapiens
ccuaccaagauauac

SEQ ID NO: 1167548 - RNA, 11 nt, Homo sapiens
ccuaccucagc

SEQ ID NO: 1167549 - RNA, 17 nt, Homo sapiens
ccuacuccgcucacuga

SEQ ID NO: 1167550 - RNA, 19 nt, Homo sapiens
ccuacugcuuccucugaau

SEQ ID NO: 1167551 - RNA, 19 nt, Homo sapiens
ccuacuuuucuuuccucag

SEQ ID NO: 1167552 - RNA, 20 nt, Homo sapiens
ccuacuuuucuuuccucaga

SEQ ID NO: 1167553 - RNA, 17 nt, Homo sapiens
ccuagaaguucuuugau

SEQ ID NO: 1167554 - RNA, 16 nt, Homo sapiens
ccuagacuuguguguu

SEQ ID NO: 1167555 - RNA, 16 nt, Homo sapiens
ccuagauucuacauau

SEQ ID NO: 1167556 - RNA, 22 nt, Homo sapiens
ccuagcaucucaugagugccaa

SEQ ID NO: 1167557 - RNA, 17 nt, Homo sapiens
ccuagccaacaugguga

SEQ ID NO: 1167558 - RNA, 19 nt, Homo sapiens
ccuagccagcacuuguaua

SEQ ID NO: 1167559 - RNA, 14 nt, Homo sapiens
ccuagcccucauuu

SEQ ID NO: 1167560 - RNA, 15 nt, Homo sapiens
ccuagcccugggaca

SEQ ID NO: 1167561 - RNA, 18 nt, Homo sapiens
ccuagcggaguuccagca

SEQ ID NO: 1167562 - RNA, 24 nt, Homo sapiens
ccuagcuuagugaaaagauagcca

SEQ ID NO: 1167563 - RNA, 17 nt, Homo sapiens
ccuaggaguauccucau

SEQ ID NO: 1167564 - RNA, 18 nt, Homo sapiens
ccuagucucuacccagua

SEQ ID NO: 1167565 - RNA, 13 nt, Homo sapiens
ccuauaaagcccc

SEQ ID NO: 1167566 - RNA, 22 nt, Homo sapiens
ccuauaagcaugacauacuuuu

SEQ ID NO: 1167567 - RNA, 21 nt, Homo sapiens
ccuauauaugauuguuugcac

SEQ ID NO: 1167568 - RNA, 16 nt, Homo sapiens
ccuaucaaagcuucaa

SEQ ID NO: 1167569 - RNA, 20 nt, Homo sapiens
ccuaucuuuuauuucauuca

SEQ ID NO: 1167570 - RNA, 15 nt, Homo sapiens
ccuauggacaacuua

SEQ ID NO: 1167571 - RNA, 21 nt, Homo sapiens
ccuauuagggaguuaugcaaa

SEQ ID NO: 1167572 - RNA, 21 nt, Homo sapiens
ccucaaauacauaccuacuga

SEQ ID NO: 1167573 - RNA, 15 nt, Homo sapiens
ccucaaccaaugcca

SEQ ID NO: 1167574 - RNA, 20 nt, Homo sapiens
ccucaaccaaugccaaaaaa

SEQ ID NO: 1167575 - RNA, 22 nt, Homo sapiens
ccucaagaucaaacccaggcag

SEQ ID NO: 1167576 - RNA, 16 nt, Homo sapiens
ccucaagugauccucc

SEQ ID NO: 1167577 - RNA, 16 nt, Homo sapiens
ccucaaguuccagugc

SEQ ID NO: 1167578 - RNA, 16 nt, Homo sapiens
auuucacugaauuuca

SEQ ID NO: 1167579 - RNA, 21 nt, Homo sapiens
auuucacugaauuucaaacau

SEQ ID NO: 1167580 - RNA, 16 nt, Homo sapiens
auuucagaguaaguag

SEQ ID NO: 1167581 - RNA, 12 nt, Homo sapiens
auuucagcuuga

SEQ ID NO: 1167582 - RNA, 20 nt, Homo sapiens
auuucaguacuucagcaaga

SEQ ID NO: 1167583 - RNA, 15 nt, Homo sapiens
auuucagugcugcug

SEQ ID NO: 1167584 - RNA, 19 nt, Homo sapiens
auuucaguuuuaacaaaug

SEQ ID NO: 1167585 - RNA, 15 nt, Homo sapiens
auuucauaguuucaa

SEQ ID NO: 1167586 - RNA, 24 nt, Homo sapiens
auuucaucucuuucuacucuccua

SEQ ID NO: 1167587 - RNA, 14 nt, Homo sapiens
auuuccacaccaag

SEQ ID NO: 1167588 - RNA, 15 nt, Homo sapiens
auuucccaucuggac

SEQ ID NO: 1167589 - RNA, 17 nt, Homo sapiens
auuucccaucuggaccu

SEQ ID NO: 1167590 - RNA, 15 nt, Homo sapiens
auuuccccagccaca

SEQ ID NO: 1167591 - RNA, 20 nt, Homo sapiens
auuuccccagccacaggcca

SEQ ID NO: 1167592 - RNA, 19 nt, Homo sapiens
auuuccucagcuuaucucu

SEQ ID NO: 1167593 - RNA, 22 nt, Homo sapiens
auuuccuccucccagugccuuc

SEQ ID NO: 1167594 - RNA, 21 nt, Homo sapiens
auuuccuuugcgcaaacuuua

SEQ ID NO: 1167595 - RNA, 19 nt, Homo sapiens
auuucggagcgcaaugcca

SEQ ID NO: 1167596 - RNA, 16 nt, Homo sapiens
auuucuaccuaaguca

SEQ ID NO: 1167597 - RNA, 16 nt, Homo sapiens
auuucucaacuuugau

SEQ ID NO: 1167598 - RNA, 22 nt, Homo sapiens
auuucuccaggauuuccugcuu

SEQ ID NO: 1167599 - RNA, 22 nt, Homo sapiens
auuucucugugaauccaugggu

SEQ ID NO: 1167600 - RNA, 18 nt, Homo sapiens
auuucugaucuauacaaa

SEQ ID NO: 1167601 - RNA, 14 nt, Homo sapiens
auuucugccuauaa

SEQ ID NO: 1167602 - RNA, 19 nt, Homo sapiens
auuucuggagggcaauuug

SEQ ID NO: 1167603 - RNA, 22 nt, Homo sapiens
auuucuucccgcacaaauucca

SEQ ID NO: 1167604 - RNA, 17 nt, Homo sapiens
auuucuucuacugcuau

SEQ ID NO: 1167605 - RNA, 16 nt, Homo sapiens
auuucuuguugcucaa

SEQ ID NO: 1167606 - RNA, 23 nt, Homo sapiens
auuucuuugccuguucaguuaca

SEQ ID NO: 1167607 - RNA, 16 nt, Homo sapiens
auuugacauuauccag

SEQ ID NO: 1167608 - RNA, 13 nt, Homo sapiens
auuugaggggugg

SEQ ID NO: 1167609 - RNA, 13 nt, Homo sapiens
auuugagugcucu

SEQ ID NO: 1167610 - RNA, 18 nt, Homo sapiens
auuugauuacaauacuga

SEQ ID NO: 1167611 - RNA, 14 nt, Homo sapiens
auauauacuauuaa

SEQ ID NO: 1167612 - RNA, 13 nt, Homo sapiens
auauauagcacau

SEQ ID NO: 1167613 - RNA, 17 nt, Homo sapiens
auauaugcacuauguau

SEQ ID NO: 1167614 - RNA, 19 nt, Homo sapiens
auauaugugaggauguauc

SEQ ID NO: 1167615 - RNA, 20 nt, Homo sapiens
auauauuuuugugcacauuu

SEQ ID NO: 1167616 - RNA, 23 nt, Homo sapiens
auauauuuuuugagucuguucuu

SEQ ID NO: 1167617 - RNA, 17 nt, Homo sapiens
auaucaaaagcaaauaa

SEQ ID NO: 1167618 - RNA, 22 nt, Homo sapiens
auaucaucaaugugacauuuac

SEQ ID NO: 1167619 - RNA, 13 nt, Homo sapiens
auauccccaggga

SEQ ID NO: 1167620 - RNA, 12 nt, Homo sapiens
auaucucccuuu

SEQ ID NO: 1167621 - RNA, 20 nt, Homo sapiens
auaucugaagagcuauuaua

SEQ ID NO: 1167622 - RNA, 17 nt, Homo sapiens
auaugaagugaaaaaag

SEQ ID NO: 1167623 - RNA, 17 nt, Homo sapiens
auaugaaugucaguagu

SEQ ID NO: 1167624 - RNA, 21 nt, Homo sapiens
auaugaguaauacaucaaaga

SEQ ID NO: 1167625 - RNA, 20 nt, Homo sapiens
auaugauauauaaaugugau

SEQ ID NO: 1167626 - RNA, 19 nt, Homo sapiens
auaugauuuaaaacaugua

SEQ ID NO: 1167627 - RNA, 22 nt, Homo sapiens
auaugcaccccuggaaccagca

SEQ ID NO: 1167628 - RNA, 21 nt, Homo sapiens
auaugcacuuauucucaagaa

SEQ ID NO: 1167629 - RNA, 13 nt, Homo sapiens
auaugcagccgcu

SEQ ID NO: 1167630 - RNA, 20 nt, Homo sapiens
auaugcauugucugcaaugg

SEQ ID NO: 1167631 - RNA, 14 nt, Homo sapiens
auaugcuccugccu

SEQ ID NO: 1167632 - RNA, 15 nt, Homo sapiens
auaugcuuucaucuu

SEQ ID NO: 1167633 - RNA, 13 nt, Homo sapiens
auauggacaguua

SEQ ID NO: 1167634 - RNA, 16 nt, Homo sapiens
auauggacucugcaca

SEQ ID NO: 1167635 - RNA, 17 nt, Homo sapiens
auauggcuugaguuuaa

SEQ ID NO: 1167636 - RNA, 22 nt, Homo sapiens
caaagcaacauggcagagcagu

SEQ ID NO: 1167637 - RNA, 17 nt, Homo sapiens
caaagcagauuuuccua

SEQ ID NO: 1167638 - RNA, 23 nt, Homo sapiens
caaagccacacucugggcuccag

SEQ ID NO: 1167639 - RNA, 19 nt, Homo sapiens
caaagccacuggaaggagc

SEQ ID NO: 1167640 - RNA, 14 nt, Homo sapiens
caaagcccacuuug

SEQ ID NO: 1167641 - RNA, 22 nt, Homo sapiens
caaagcccucccuaccuaccaa

SEQ ID NO: 1167642 - RNA, 22 nt, Homo sapiens
caaagcccuuguccccaugaaa

SEQ ID NO: 1167643 - RNA, 17 nt, Homo sapiens
caaagcuuuauuucaaa

SEQ ID NO: 1167644 - RNA, 17 nt, Homo sapiens
caaagcuuucauguaaa

SEQ ID NO: 1167645 - RNA, 22 nt, Homo sapiens
caaaggaaauugucaucugcca

SEQ ID NO: 1167646 - RNA, 19 nt, Homo sapiens
caaaggagacuuaauuuca

SEQ ID NO: 1167647 - RNA, 16 nt, Homo sapiens
caaaggauaaacugca

SEQ ID NO: 1167648 - RNA, 23 nt, Homo sapiens
caaaggauguguuuucagucuuu

SEQ ID NO: 1167649 - RNA, 19 nt, Homo sapiens
caaagggcacagcaucugu

SEQ ID NO: 1167650 - RNA, 14 nt, Homo sapiens
caaagggcaugggu

SEQ ID NO: 1167651 - RNA, 16 nt, Homo sapiens
caaagggggaggcuaa

SEQ ID NO: 1167652 - RNA, 17 nt, Homo sapiens
caaaguacuguaagaau

SEQ ID NO: 1167653 - RNA, 13 nt, Homo sapiens
caaaguauuaagu

SEQ ID NO: 1167654 - RNA, 21 nt, Homo sapiens
caaagucccuuccugcuuccu

SEQ ID NO: 1167655 - RNA, 15 nt, Homo sapiens
caaagugccaaagaa

SEQ ID NO: 1167656 - RNA, 13 nt, Homo sapiens
caaagugcuaaau

SEQ ID NO: 1167657 - RNA, 17 nt, Homo sapiens
caaagugcugagauuac

SEQ ID NO: 1167658 - RNA, 20 nt, Homo sapiens
caaaguuguauguggcauga

SEQ ID NO: 1167659 - RNA, 21 nt, Homo sapiens
caaauacuuagacaguaugca

SEQ ID NO: 1167660 - RNA, 22 nt, Homo sapiens
caaauagagcuguucaacauca

SEQ ID NO: 1167661 - RNA, 18 nt, Homo sapiens
caaauauaaaucuuaaaa

SEQ ID NO: 1167662 - RNA, 21 nt, Homo sapiens
caaauauuaucuuuguucucc

SEQ ID NO: 1167663 - RNA, 16 nt, Homo sapiens
caaaucaaaagacuuu

SEQ ID NO: 1167664 - RNA, 19 nt, Homo sapiens
caaaucaauaaauucccaa

SEQ ID NO: 1167665 - RNA, 18 nt, Homo sapiens
caaaucagaaacuuguga

SEQ ID NO: 1167666 - RNA, 14 nt, Homo sapiens
caaaucaucucuca

SEQ ID NO: 1167667 - RNA, 20 nt, Homo sapiens
caaaucaucucucaucacuu

SEQ ID NO: 1167668 - RNA, 22 nt, Homo sapiens
caaaucauguuuuuucugcaau

SEQ ID NO: 1167669 - RNA, 23 nt, Homo sapiens
caaaucauguuuuuucugcaaug

SEQ ID NO: 1167670 - RNA, 19 nt, Homo sapiens
caaaucccuuucaugucuu

SEQ ID NO: 1167671 - RNA, 22 nt, Homo sapiens
caaauccuuagaucuggcaugu

SEQ ID NO: 1167672 - RNA, 19 nt, Homo sapiens
caaaucuguaaucagcaau

SEQ ID NO: 1167673 - RNA, 14 nt, Homo sapiens
caaaugagccauga

SEQ ID NO: 1167674 - RNA, 22 nt, Homo sapiens
caaaugcauuucuaaagccauu

SEQ ID NO: 1167675 - RNA, 16 nt, Homo sapiens
caaauggcagaaccaa

SEQ ID NO: 1167676 - RNA, 17 nt, Homo sapiens
caaauggggccagaucc

SEQ ID NO: 1167677 - RNA, 20 nt, Homo sapiens
caaaugguaggcauuuccua

SEQ ID NO: 1167678 - RNA, 18 nt, Homo sapiens
caaauucuuugacacuca

SEQ ID NO: 1167679 - RNA, 19 nt, Homo sapiens
caaauuugugguccacuga

SEQ ID NO: 1167680 - RNA, 19 nt, Homo sapiens
caaauuuucacugcugcuc

SEQ ID NO: 1167681 - RNA, 20 nt, Homo sapiens
caaauuuucuuccauuucau

SEQ ID NO: 1167682 - RNA, 13 nt, Homo sapiens
caacaauuuaccu

SEQ ID NO: 1167683 - RNA, 14 nt, Homo sapiens
caacaauuuaccuu

SEQ ID NO: 1167684 - RNA, 15 nt, Homo sapiens
caacacccaacuguc

SEQ ID NO: 1167685 - RNA, 17 nt, Homo sapiens
caacacugggaaacaga

SEQ ID NO: 1167686 - RNA, 19 nt, Homo sapiens
caacacuguggguguguga

SEQ ID NO: 1167687 - RNA, 22 nt, Homo sapiens
caacagaaugaaaaaugaaaga

SEQ ID NO: 1167688 - RNA, 13 nt, Homo sapiens
caacagauuuaca

SEQ ID NO: 1167689 - RNA, 14 nt, Homo sapiens
caacagcacccucu

SEQ ID NO: 1167690 - RNA, 13 nt, Homo sapiens
caacagccggcug

SEQ ID NO: 1167691 - RNA, 13 nt, Homo sapiens
caacagcuacaac

SEQ ID NO: 1167692 - RNA, 22 nt, Homo sapiens
caacaggccaaugcuacuuuca

SEQ ID NO: 1167693 - RNA, 12 nt, Homo sapiens
caacaguuccuu

SEQ ID NO: 1167694 - RNA, 14 nt, Homo sapiens
caacaguuccuuca

SEQ ID NO: 1167695 - RNA, 18 nt, Homo sapiens
caacaugaaacaccaaga

SEQ ID NO: 1167696 - RNA, 21 nt, Homo sapiens
caacauggauguguugccccu

SEQ ID NO: 1167697 - RNA, 21 nt, Homo sapiens
caacauggugaaaaccccauc

SEQ ID NO: 1167698 - RNA, 21 nt, Homo sapiens
caacauggugagaccccaucu

SEQ ID NO: 1167699 - RNA, 16 nt, Homo sapiens
caacauguaccucacc

SEQ ID NO: 1167700 - RNA, 18 nt, Homo sapiens
caacaugucacacuggcu

SEQ ID NO: 1167701 - RNA, 19 nt, Homo sapiens
caacauuuugagaacaaag

SEQ ID NO: 1167702 - RNA, 19 nt, Homo sapiens
caaccaauggaaugugaug

SEQ ID NO: 1167703 - RNA, 15 nt, Homo sapiens
caaccacucauucaa

SEQ ID NO: 1167704 - RNA, 11 nt, Homo sapiens
caaccagacag

SEQ ID NO: 1167705 - RNA, 22 nt, Homo sapiens
caaccaguuuauccaccaagaa

SEQ ID NO: 1167706 - RNA, 13 nt, Homo sapiens
caaccauauuugu

SEQ ID NO: 1167707 - RNA, 23 nt, Homo sapiens
caaccaucucauccuauuacuuu

SEQ ID NO: 1167708 - RNA, 18 nt, Homo sapiens
caacccagccaugcaaug

SEQ ID NO: 1167709 - RNA, 14 nt, Homo sapiens
caaccccacccagc

SEQ ID NO: 1167710 - RNA, 16 nt, Homo sapiens
caaccccagacacugg

SEQ ID NO: 1167711 - RNA, 13 nt, Homo sapiens
caaccccaggcug

SEQ ID NO: 1167712 - RNA, 23 nt, Homo sapiens
caacccgagucauucguucugug

SEQ ID NO: 1167713 - RNA, 14 nt, Homo sapiens
caacccuucccuca

SEQ ID NO: 1167714 - RNA, 20 nt, Homo sapiens
caacccuucuggaaacugug

SEQ ID NO: 1167715 - RNA, 18 nt, Homo sapiens
caaccggcuuuguggcac

SEQ ID NO: 1167716 - RNA, 17 nt, Homo sapiens
caaccuaaccccuuucc

SEQ ID NO: 1167717 - RNA, 22 nt, Homo sapiens
caaccuacuaauccucucugca

SEQ ID NO: 1167718 - RNA, 14 nt, Homo sapiens
caaccugaagacac

SEQ ID NO: 1167719 - RNA, 19 nt, Homo sapiens
caaccugcuuggguggaga

SEQ ID NO: 1167720 - RNA, 11 nt, Homo sapiens
caaccuuucau

SEQ ID NO: 1167721 - RNA, 14 nt, Homo sapiens
caacgaguacuuca

SEQ ID NO: 1167722 - RNA, 20 nt, Homo sapiens
caacgauggaguacacagcu

SEQ ID NO: 1167723 - RNA, 16 nt, Homo sapiens
caacuaaaaacaaacc

SEQ ID NO: 1167724 - RNA, 17 nt, Homo sapiens
caacuauauuaucaugc

SEQ ID NO: 1167725 - RNA, 20 nt, Homo sapiens
caacucaaugaaaauuuaaa

SEQ ID NO: 1167726 - RNA, 16 nt, Homo sapiens
caacucguauagcaug

SEQ ID NO: 1167727 - RNA, 23 nt, Homo sapiens
caacucuaaagccaagcacuuua

SEQ ID NO: 1167728 - RNA, 21 nt, Homo sapiens
caacucuccccugaccuguga

SEQ ID NO: 1167729 - RNA, 15 nt, Homo sapiens
caacucuuugagaaa

SEQ ID NO: 1167730 - RNA, 14 nt, Homo sapiens
caacugaauugcaa

SEQ ID NO: 1167731 - RNA, 17 nt, Homo sapiens
caacugcugcuucacca

SEQ ID NO: 1167732 - RNA, 19 nt, Homo sapiens
caacuggggggaccaaaua

SEQ ID NO: 1167733 - RNA, 17 nt, Homo sapiens
caacuuauuaacaauua

SEQ ID NO: 1167734 - RNA, 21 nt, Homo sapiens
caacuucuacuucugcccuug

SEQ ID NO: 1167735 - RNA, 22 nt, Homo sapiens
caacuuggaagaucuaccugca

SEQ ID NO: 1167736 - RNA, 15 nt, Homo sapiens
caacuuucauuugaa

SEQ ID NO: 1167737 - RNA, 20 nt, Homo sapiens
caauguauugagcaugugau

SEQ ID NO: 1167738 - RNA, 21 nt, Homo sapiens
caauguauuuuaauaacauau

SEQ ID NO: 1167739 - RNA, 15 nt, Homo sapiens
caaugugacauuuac

SEQ ID NO: 1167740 - RNA, 19 nt, Homo sapiens
caauguuaaagaugcacag

SEQ ID NO: 1167741 - RNA, 15 nt, Homo sapiens
caauguuagccucaa

SEQ ID NO: 1167742 - RNA, 18 nt, Homo sapiens
caauguucuuuauauaca

SEQ ID NO: 1167743 - RNA, 17 nt, Homo sapiens
caauguuugcuuuucac

SEQ ID NO: 1167744 - RNA, 19 nt, Homo sapiens
caauguuuuaaacauucuu

SEQ ID NO: 1167745 - RNA, 11 nt, Homo sapiens
caauuaacugc

SEQ ID NO: 1167746 - RNA, 22 nt, Homo sapiens
caauuaauugcuauuguguuau

SEQ ID NO: 1167747 - RNA, 12 nt, Homo sapiens
caauuagaacuc

SEQ ID NO: 1167748 - RNA, 21 nt, Homo sapiens
caauuagcuccuccuuuuucc

SEQ ID NO: 1167749 - RNA, 17 nt, Homo sapiens
caauuaugaacauccaa

SEQ ID NO: 1167750 - RNA, 16 nt, Homo sapiens
caauucagacaggcaa

SEQ ID NO: 1167751 - RNA, 22 nt, Homo sapiens
caauucauauauuugaagugga

SEQ ID NO: 1167752 - RNA, 12 nt, Homo sapiens
caauucaugaac

SEQ ID NO: 1167753 - RNA, 14 nt, Homo sapiens
caauuccaucagca

SEQ ID NO: 1167754 - RNA, 12 nt, Homo sapiens
caauucuagugu

SEQ ID NO: 1167755 - RNA, 19 nt, Homo sapiens
caauucuuucaacuggguu

SEQ ID NO: 1167756 - RNA, 18 nt, Homo sapiens
caauugcuuuaacaguca

SEQ ID NO: 1167757 - RNA, 18 nt, Homo sapiens
caauuggaauaaucacuu

SEQ ID NO: 1167758 - RNA, 16 nt, Homo sapiens
caauuggcacuaaaga

SEQ ID NO: 1167759 - RNA, 19 nt, Homo sapiens
caauuuacgaaaccaaaaa

SEQ ID NO: 1167760 - RNA, 22 nt, Homo sapiens
caauuuagaaaaagaacaugca

SEQ ID NO: 1167761 - RNA, 22 nt, Homo sapiens
caauuuccaagaaugaugccuu

SEQ ID NO: 1167762 - RNA, 17 nt, Homo sapiens
caauuugacaaaaccca

SEQ ID NO: 1167763 - RNA, 21 nt, Homo sapiens
caauuuuccuuggaacacaua

SEQ ID NO: 1167764 - RNA, 15 nt, Homo sapiens
cacaaaacauccuga

SEQ ID NO: 1167765 - RNA, 23 nt, Homo sapiens
cacaaagcggcucuaaaccucag

SEQ ID NO: 1167766 - RNA, 20 nt, Homo sapiens
cacaaauaaaggaaacccag

SEQ ID NO: 1167767 - RNA, 12 nt, Homo sapiens
cacaacagccaa

SEQ ID NO: 1167768 - RNA, 14 nt, Homo sapiens
cacaacuccuucca

SEQ ID NO: 1167769 - RNA, 18 nt, Homo sapiens
cacaacuugucacccaaa

SEQ ID NO: 1167770 - RNA, 19 nt, Homo sapiens
caccucaaauacauaccua

SEQ ID NO: 1167771 - RNA, 14 nt, Homo sapiens
caccucauucugaa

SEQ ID NO: 1167772 - RNA, 15 nt, Homo sapiens
caccuccuacgucaa

SEQ ID NO: 1167773 - RNA, 15 nt, Homo sapiens
caccucucccugacc

SEQ ID NO: 1167774 - RNA, 20 nt, Homo sapiens
caccucugccucaaugugaa

SEQ ID NO: 1167775 - RNA, 15 nt, Homo sapiens
caccugacucuugca

SEQ ID NO: 1167776 - RNA, 17 nt, Homo sapiens
caccuggcccuugcaau

SEQ ID NO: 1167777 - RNA, 22 nt, Homo sapiens
caccuggcuuuucuuucuacca

SEQ ID NO: 1167778 - RNA, 19 nt, Homo sapiens
caccugggcgccaacugcu

SEQ ID NO: 1167779 - RNA, 18 nt, Homo sapiens
caccugguaugugccagg

SEQ ID NO: 1167780 - RNA, 18 nt, Homo sapiens
caccuggugggugguguc

SEQ ID NO: 1167781 - RNA, 12 nt, Homo sapiens
caccuguaggca

SEQ ID NO: 1167782 - RNA, 17 nt, Homo sapiens
caccugucaauugugaa

SEQ ID NO: 1167783 - RNA, 17 nt, Homo sapiens
caccuguguacugagua

SEQ ID NO: 1167784 - RNA, 16 nt, Homo sapiens
caccuguguuccagcc

SEQ ID NO: 1167785 - RNA, 19 nt, Homo sapiens
caccuguucucacucccug

SEQ ID NO: 1167786 - RNA, 14 nt, Homo sapiens
caccuuauacauca

SEQ ID NO: 1167787 - RNA, 19 nt, Homo sapiens
caccuuauacaucacuucc

SEQ ID NO: 1167788 - RNA, 21 nt, Homo sapiens
caccuugccacccauucuucc

SEQ ID NO: 1167789 - RNA, 15 nt, Homo sapiens
caccuuggauuaaaa

SEQ ID NO: 1167790 - RNA, 16 nt, Homo sapiens
caccuuggcaccagac

SEQ ID NO: 1167791 - RNA, 15 nt, Homo sapiens
caccuugugucugua

SEQ ID NO: 1167792 - RNA, 23 nt, Homo sapiens
caccuuuccucaaauguugacau

SEQ ID NO: 1167793 - RNA, 13 nt, Homo sapiens
caccuuuuacucu

SEQ ID NO: 1167794 - RNA, 22 nt, Homo sapiens
caccuuuucagcgauguaugca

SEQ ID NO: 1167795 - RNA, 19 nt, Homo sapiens
caccuuuuuucaacaguga

SEQ ID NO: 1167796 - RNA, 16 nt, Homo sapiens
cacgaacccaccugcu

SEQ ID NO: 1167797 - RNA, 16 nt, Homo sapiens
cacgaaugauucuauu

SEQ ID NO: 1167798 - RNA, 18 nt, Homo sapiens
cacgaauuccaucuugua

SEQ ID NO: 1167799 - RNA, 16 nt, Homo sapiens
cacgagagagggaaaa

SEQ ID NO: 1167800 - RNA, 17 nt, Homo sapiens
cacgauggaauguaaaa

SEQ ID NO: 1167801 - RNA, 19 nt, Homo sapiens
cacgcaccuguagucccag

SEQ ID NO: 1167802 - RNA, 12 nt, Homo sapiens
cacgccugcaaa

SEQ ID NO: 1167803 - RNA, 13 nt, Homo sapiens
cacgccugcaaac

SEQ ID NO: 1167804 - RNA, 15 nt, Homo sapiens
cacggaccaugcgac

SEQ ID NO: 1167805 - RNA, 16 nt, Homo sapiens
cacggagggauugauc

SEQ ID NO: 1167806 - RNA, 20 nt, Homo sapiens
cacggccacaucaaagaggc

SEQ ID NO: 1167807 - RNA, 18 nt, Homo sapiens
cacggcuuguaaauguga

SEQ ID NO: 1167808 - RNA, 14 nt, Homo sapiens
cacgugaugugaua

SEQ ID NO: 1167809 - RNA, 20 nt, Homo sapiens
cacguuuaaucccagcacuu

SEQ ID NO: 1167810 - RNA, 20 nt, Homo sapiens
cacuaaacauaugaaugcag

SEQ ID NO: 1167811 - RNA, 14 nt, Homo sapiens
cacuaaauucacau

SEQ ID NO: 1167812 - RNA, 22 nt, Homo sapiens
cacuaagccaugaaaccagaga

SEQ ID NO: 1167813 - RNA, 14 nt, Homo sapiens
cacuaauacuacug

SEQ ID NO: 1167814 - RNA, 14 nt, Homo sapiens
cacuaccauugcug

SEQ ID NO: 1167815 - RNA, 13 nt, Homo sapiens
cacuagacaagcc

SEQ ID NO: 1167816 - RNA, 16 nt, Homo sapiens
cacuagacaagccaga

SEQ ID NO: 1167817 - RNA, 12 nt, Homo sapiens
cacuagcauuuu

SEQ ID NO: 1167818 - RNA, 14 nt, Homo sapiens
cacuagggaucaaa

SEQ ID NO: 1167819 - RNA, 19 nt, Homo sapiens
cacuauggacuuacccuaa

SEQ ID NO: 1167820 - RNA, 14 nt, Homo sapiens
cacuauuacuggga

SEQ ID NO: 1167821 - RNA, 20 nt, Homo sapiens
cacucaacaauaaagacuga

SEQ ID NO: 1167822 - RNA, 19 nt, Homo sapiens
cacucaaggcggugcuuga

SEQ ID NO: 1167823 - RNA, 19 nt, Homo sapiens
cacucaauaaaucuuugau

SEQ ID NO: 1167824 - RNA, 21 nt, Homo sapiens
cacucagaguucuauacugua

SEQ ID NO: 1167825 - RNA, 22 nt, Homo sapiens
cacucagauggaaccgcaggaa

SEQ ID NO: 1167826 - RNA, 13 nt, Homo sapiens
cacucagcucuug

SEQ ID NO: 1167827 - RNA, 20 nt, Homo sapiens
cacucagugauugcaauuug

SEQ ID NO: 1167828 - RNA, 15 nt, Homo sapiens
cacucaguugcaacu

SEQ ID NO: 1167829 - RNA, 13 nt, Homo sapiens
cacuccagcauca

SEQ ID NO: 1167830 - RNA, 14 nt, Homo sapiens
cacucccaccagca

SEQ ID NO: 1167831 - RNA, 15 nt, Homo sapiens
cacucccaccagcac

SEQ ID NO: 1167832 - RNA, 14 nt, Homo sapiens
cacuccccagccuc

SEQ ID NO: 1167833 - RNA, 20 nt, Homo sapiens
cacucccuguuuuaauucaa

SEQ ID NO: 1167834 - RNA, 14 nt, Homo sapiens
cacucggaaaaagc

SEQ ID NO: 1167835 - RNA, 14 nt, Homo sapiens
cacucugauagaau

SEQ ID NO: 1167836 - RNA, 15 nt, Homo sapiens
cacucugcaauggaa

SEQ ID NO: 1167837 - RNA, 13 nt, Homo sapiens
cacucuuccugag

SEQ ID NO: 1167838 - RNA, 12 nt, Homo sapiens
cacucuuugcca

SEQ ID NO: 1167839 - RNA, 15 nt, Homo sapiens
cacucuuugccacug

SEQ ID NO: 1167840 - RNA, 16 nt, Homo sapiens
cacucuuuuauacaag

SEQ ID NO: 1167841 - RNA, 13 nt, Homo sapiens
cacugaaaugcua

SEQ ID NO: 1167842 - RNA, 17 nt, Homo sapiens
cacugaagcaccacagg

SEQ ID NO: 1167843 - RNA, 23 nt, Homo sapiens
cacugacacaucagcauguuuuc

SEQ ID NO: 1167844 - RNA, 13 nt, Homo sapiens
cacugacuauuac

SEQ ID NO: 1167845 - RNA, 21 nt, Homo sapiens
cacugacuauuacaguugcau

SEQ ID NO: 1167846 - RNA, 22 nt, Homo sapiens
cacugagacuugaaucaaguca

SEQ ID NO: 1167847 - RNA, 20 nt, Homo sapiens
cacugagcuauaacuuacuu

SEQ ID NO: 1167848 - RNA, 24 nt, Homo sapiens
cacugauagcugaaauagauacaa

SEQ ID NO: 1167849 - RNA, 22 nt, Homo sapiens
cacugaugcuuagauguuccag

SEQ ID NO: 1167850 - RNA, 18 nt, Homo sapiens
cacugauuguccauuuac

SEQ ID NO: 1167851 - RNA, 21 nt, Homo sapiens
cacugcacucaaccuuaagac

SEQ ID NO: 1167852 - RNA, 13 nt, Homo sapiens
cacugcacuccag

SEQ ID NO: 1167853 - RNA, 21 nt, Homo sapiens
cacugcacugccauugucuuu

SEQ ID NO: 1167854 - RNA, 13 nt, Homo sapiens
cacugcauaccaa

SEQ ID NO: 1167855 - RNA, 19 nt, Homo sapiens
cacugccccagacacagug

SEQ ID NO: 1167856 - RNA, 23 nt, Homo sapiens
cacugcccucuuguggugcauug

SEQ ID NO: 1167857 - RNA, 19 nt, Homo sapiens
cacugccggcaggaugcag

SEQ ID NO: 1167858 - RNA, 17 nt, Homo sapiens
cacugccuguaacagcc

SEQ ID NO: 1167859 - RNA, 14 nt, Homo sapiens
cacugcguuagaug

SEQ ID NO: 1167860 - RNA, 23 nt, Homo sapiens
cacugcuugaggaaaacaagcau

SEQ ID NO: 1167861 - RNA, 20 nt, Homo sapiens
cacugcuuuaaacugcauuu

SEQ ID NO: 1167862 - RNA, 21 nt, Homo sapiens
cacugcuuuuggccuggaguu

SEQ ID NO: 1167863 - RNA, 23 nt, Homo sapiens
cacuggaggggucuccucugcag

SEQ ID NO: 1167864 - RNA, 14 nt, Homo sapiens
cacuggcagccugc

SEQ ID NO: 1167865 - RNA, 18 nt, Homo sapiens
cacuggcauaaaucugaa

SEQ ID NO: 1167866 - RNA, 20 nt, Homo sapiens
cacuggccccugagaucucu

SEQ ID NO: 1167867 - RNA, 22 nt, Homo sapiens
cacugggugguggccugguccc

SEQ ID NO: 1167868 - RNA, 14 nt, Homo sapiens
cacuggucugggaa

SEQ ID NO: 1167869 - RNA, 15 nt, Homo sapiens
cacugguguaucuca

SEQ ID NO: 1167870 - RNA, 16 nt, Homo sapiens
cacugguugcacuuau

SEQ ID NO: 1167871 - RNA, 20 nt, Homo sapiens
cagagguugcagugagccga

SEQ ID NO: 1167872 - RNA, 19 nt, Homo sapiens
cagagguugcagugagcug

SEQ ID NO: 1167873 - RNA, 16 nt, Homo sapiens
cagagucaaauuugaa

SEQ ID NO: 1167874 - RNA, 16 nt, Homo sapiens
cagagucccugccugg

SEQ ID NO: 1167875 - RNA, 20 nt, Homo sapiens
cagagucucgcucuguugcc

SEQ ID NO: 1167876 - RNA, 20 nt, Homo sapiens
cagagugagacccugucuca

SEQ ID NO: 1167877 - RNA, 12 nt, Homo sapiens
cagagugcaagc

SEQ ID NO: 1167878 - RNA, 24 nt, Homo sapiens
cagaguggccuagagcacucucac

SEQ ID NO: 1167879 - RNA, 16 nt, Homo sapiens
cagaguguucccugac

SEQ ID NO: 1167880 - RNA, 23 nt, Homo sapiens
cagaguuaaaauguuuacuguaa

SEQ ID NO: 1167881 - RNA, 14 nt, Homo sapiens
cagauaacugagga

SEQ ID NO: 1167882 - RNA, 14 nt, Homo sapiens
cagauaacuuugac

SEQ ID NO: 1167883 - RNA, 22 nt, Homo sapiens
cagauaagguaaaaugccauga

SEQ ID NO: 1167884 - RNA, 19 nt, Homo sapiens
cagauacugucucuuucau

SEQ ID NO: 1167885 - RNA, 20 nt, Homo sapiens
cagauacugucucuuucaug

SEQ ID NO: 1167886 - RNA, 22 nt, Homo sapiens
cagauagcaucuuauacgagua

SEQ ID NO: 1167887 - RNA, 22 nt, Homo sapiens
cagaucgcucccuuggcuuuga

SEQ ID NO: 1167888 - RNA, 17 nt, Homo sapiens
cagaucuagucaaucaa

SEQ ID NO: 1167889 - RNA, 15 nt, Homo sapiens
cagaugcagggcagu

SEQ ID NO: 1167890 - RNA, 23 nt, Homo sapiens
cagaugccaauuacgguguacag

SEQ ID NO: 1167891 - RNA, 21 nt, Homo sapiens
cagaugcugauguucagugua

SEQ ID NO: 1167892 - RNA, 23 nt, Homo sapiens
cagauggacuucuucaguguccu

SEQ ID NO: 1167893 - RNA, 19 nt, Homo sapiens
cagauggcagggcugagga

SEQ ID NO: 1167894 - RNA, 15 nt, Homo sapiens
cagauggcagguuug

SEQ ID NO: 1167895 - RNA, 14 nt, Homo sapiens
cagauggcauaaau

SEQ ID NO: 1167896 - RNA, 17 nt, Homo sapiens
cagauggccacugcucu

SEQ ID NO: 1167897 - RNA, 22 nt, Homo sapiens
cagaugggagugcccccaacag

SEQ ID NO: 1167898 - RNA, 22 nt, Homo sapiens
cagauuauaacuguugucauau

SEQ ID NO: 1167899 - RNA, 22 nt, Homo sapiens
cagauuauguauuaacuuguag

SEQ ID NO: 1167900 - RNA, 11 nt, Homo sapiens
cagauucagug

SEQ ID NO: 1167901 - RNA, 13 nt, Homo sapiens
cagauuggaccag

SEQ ID NO: 1167902 - RNA, 15 nt, Homo sapiens
cagauugugccacug

SEQ ID NO: 1167903 - RNA, 17 nt, Homo sapiens
cagauugugccacugcu

SEQ ID NO: 1167904 - RNA, 18 nt, Homo sapiens
cagauuguuucuauacaa

SEQ ID NO: 1167905 - RNA, 15 nt, Homo sapiens
cagauuuacauccca

SEQ ID NO: 1167906 - RNA, 17 nt, Homo sapiens
ccuucauaugugcagua

SEQ ID NO: 1167907 - RNA, 21 nt, Homo sapiens
ccuucauaugugcaguauuua

SEQ ID NO: 1167908 - RNA, 17 nt, Homo sapiens
ccuucauccuugacucc

SEQ ID NO: 1167909 - RNA, 20 nt, Homo sapiens
ccuucaucuucacugcaauu

SEQ ID NO: 1167910 - RNA, 17 nt, Homo sapiens
ccuucaugaucaucaca

SEQ ID NO: 1167911 - RNA, 23 nt, Homo sapiens
ccuuccagcccagacccccagug

SEQ ID NO: 1167912 - RNA, 19 nt, Homo sapiens
ccuuccccuugaaccucau

SEQ ID NO: 1167913 - RNA, 20 nt, Homo sapiens
ccuuccuaaauuaugacugc

SEQ ID NO: 1167914 - RNA, 23 nt, Homo sapiens
ccuuccugagaaacguccaucuc

SEQ ID NO: 1167915 - RNA, 18 nt, Homo sapiens
ccuuccugucugaacaaa

SEQ ID NO: 1167916 - RNA, 13 nt, Homo sapiens
ccuuccuuaccuc

SEQ ID NO: 1167917 - RNA, 15 nt, Homo sapiens
ccuuccuugccagug

SEQ ID NO: 1167918 - RNA, 22 nt, Homo sapiens
ccuucgcuuaagccagcacuca

SEQ ID NO: 1167919 - RNA, 21 nt, Homo sapiens
ccuucgggcugugcccgggga

SEQ ID NO: 1167920 - RNA, 19 nt, Homo sapiens
ccuucgguggaagagcuca

SEQ ID NO: 1167921 - RNA, 21 nt, Homo sapiens
ccuucguuuacuaugccugug

SEQ ID NO: 1167922 - RNA, 12 nt, Homo sapiens
ccuucucagcuc

SEQ ID NO: 1167923 - RNA, 19 nt, Homo sapiens
ccuucuccauccacauggg

SEQ ID NO: 1167924 - RNA, 18 nt, Homo sapiens
ccuucucgaccacgggaa

SEQ ID NO: 1167925 - RNA, 14 nt, Homo sapiens
ccuucucggagcug

SEQ ID NO: 1167926 - RNA, 18 nt, Homo sapiens
ccuucugaggacauucca

SEQ ID NO: 1167927 - RNA, 18 nt, Homo sapiens
ccuucuggaaacugugaa

SEQ ID NO: 1167928 - RNA, 14 nt, Homo sapiens
ccuucuuuaaacac

SEQ ID NO: 1167929 - RNA, 18 nt, Homo sapiens
ccuucuuuaccuucauuu

SEQ ID NO: 1167930 - RNA, 19 nt, Homo sapiens
ccuucuuuaccuucauuuc

SEQ ID NO: 1167931 - RNA, 19 nt, Homo sapiens
ccuugaagacauaucaugu

SEQ ID NO: 1167932 - RNA, 18 nt, Homo sapiens
ccuugacgacaagaccac

SEQ ID NO: 1167933 - RNA, 17 nt, Homo sapiens
ccuugagggaacaguca

SEQ ID NO: 1167934 - RNA, 11 nt, Homo sapiens
ccuugaugaau

SEQ ID NO: 1167935 - RNA, 15 nt, Homo sapiens
ccuugccccuaugcc

SEQ ID NO: 1167936 - RNA, 23 nt, Homo sapiens
ccuugccugcuuucuccaagaca

SEQ ID NO: 1167937 - RNA, 19 nt, Homo sapiens
ccuugcuccucuuccuccu

SEQ ID NO: 1167938 - RNA, 20 nt, Homo sapiens
ccuuggccaagcugcugcuu

SEQ ID NO: 1167939 - RNA, 18 nt, Homo sapiens
ccuuggccuugcagcugg

SEQ ID NO: 1167940 - RNA, 23 nt, Homo sapiens
ccuugggccuuucagucccaaag

SEQ ID NO: 1167941 - RNA, 19 nt, Homo sapiens
ccuuggucacaugugacau

SEQ ID NO: 1167942 - RNA, 18 nt, Homo sapiens
ccuuggucuuuucuugcc

SEQ ID NO: 1167943 - RNA, 19 nt, Homo sapiens
ccuugguggggagcacaga

SEQ ID NO: 1167944 - RNA, 19 nt, Homo sapiens
ccuugguucccccacugau

SEQ ID NO: 1167945 - RNA, 11 nt, Homo sapiens
ccuugucuccc

SEQ ID NO: 1167946 - RNA, 12 nt, Homo sapiens
ccuugugccuug

SEQ ID NO: 1167947 - RNA, 20 nt, Homo sapiens
ccuuguguuccuucugugaa

SEQ ID NO: 1167948 - RNA, 14 nt, Homo sapiens
ccuuguuauuugua

SEQ ID NO: 1167949 - RNA, 19 nt, Homo sapiens
ccuuguuccaauuugacaa

SEQ ID NO: 1167950 - RNA, 17 nt, Homo sapiens
ccuuguuuagcauauaa

SEQ ID NO: 1167951 - RNA, 14 nt, Homo sapiens
ccuuguuuugccau

SEQ ID NO: 1167952 - RNA, 20 nt, Homo sapiens
ccuuuaaauccuuccaugaa

SEQ ID NO: 1167953 - RNA, 21 nt, Homo sapiens
ccuuuaagccugcauucuuaa

SEQ ID NO: 1167954 - RNA, 14 nt, Homo sapiens
ccuuuacuaaucca

SEQ ID NO: 1167955 - RNA, 18 nt, Homo sapiens
ccuuuacuuucuuaauaa

SEQ ID NO: 1167956 - RNA, 20 nt, Homo sapiens
ccuuuagaaacucaaaaacu

SEQ ID NO: 1167957 - RNA, 16 nt, Homo sapiens
ccuuuagcuuugacag

SEQ ID NO: 1167958 - RNA, 21 nt, Homo sapiens
ccuuuaucaccucauucugaa

SEQ ID NO: 1167959 - RNA, 17 nt, Homo sapiens
ccuuucaucacacuggg

SEQ ID NO: 1167960 - RNA, 18 nt, Homo sapiens
ccuuucccucuucccuga

SEQ ID NO: 1167961 - RNA, 19 nt, Homo sapiens
ccuuucgauauaaaacucu

SEQ ID NO: 1167962 - RNA, 22 nt, Homo sapiens
ccuuugagcugcugacugccaa

SEQ ID NO: 1167963 - RNA, 16 nt, Homo sapiens
ccuuugaucaguauaa

SEQ ID NO: 1167964 - RNA, 16 nt, Homo sapiens
ccuuugauuuuugccc

SEQ ID NO: 1167965 - RNA, 21 nt, Homo sapiens
ccuuugccagccauucuuucc

SEQ ID NO: 1167966 - RNA, 18 nt, Homo sapiens
ccuuugcuacacugcuga

SEQ ID NO: 1167967 - RNA, 18 nt, Homo sapiens
ccuuuggaaagacuugaa

SEQ ID NO: 1167968 - RNA, 20 nt, Homo sapiens
ccuuuggacuugucccggga

SEQ ID NO: 1167969 - RNA, 19 nt, Homo sapiens
ccuuuggggagaaagucau

SEQ ID NO: 1167970 - RNA, 17 nt, Homo sapiens
ccuuuggugacuucaca

SEQ ID NO: 1167971 - RNA, 15 nt, Homo sapiens
ccuuuguacuuugug

SEQ ID NO: 1167972 - RNA, 13 nt, Homo sapiens
ccuuuguugucua

SEQ ID NO: 1167973 - RNA, 23 nt, Homo sapiens
ccuuuuaacaccugauguguaca

SEQ ID NO: 1167974 - RNA, 13 nt, Homo sapiens
ccuuuuguaaaau

SEQ ID NO: 1167975 - RNA, 15 nt, Homo sapiens
ccuuuuuaaaacaca

SEQ ID NO: 1167976 - RNA, 22 nt, Homo sapiens
ccuuuuuauuuauauguacugu

SEQ ID NO: 1167977 - RNA, 22 nt, Homo sapiens
ccuuuuucuucacuuacaagaa

SEQ ID NO: 1167978 - RNA, 15 nt, Homo sapiens
ccuuuuuguuauuag

SEQ ID NO: 1167979 - RNA, 18 nt, Homo sapiens
ccuuuuuuaaaaaugcaa

SEQ ID NO: 1167980 - RNA, 23 nt, Homo sapiens
ccuuuuuucaaaauccaaaaaga

SEQ ID NO: 1167981 - RNA, 23 nt, Homo sapiens
ccuuuuuugaucaggcacagugg

SEQ ID NO: 1167982 - RNA, 13 nt, Homo sapiens
cgaaacacuucaa

SEQ ID NO: 1167983 - RNA, 19 nt, Homo sapiens
cgaaacaguuugaaaggga

SEQ ID NO: 1167984 - RNA, 21 nt, Homo sapiens
cgaaaccgguggggcugguuc

SEQ ID NO: 1167985 - RNA, 19 nt, Homo sapiens
cgaaacgggggaagggagc

SEQ ID NO: 1167986 - RNA, 17 nt, Homo sapiens
cgaaguccagcuuucug

SEQ ID NO: 1167987 - RNA, 16 nt, Homo sapiens
cgaauagccacugcau

SEQ ID NO: 1167988 - RNA, 17 nt, Homo sapiens
cgaaugauucuauuaaa

SEQ ID NO: 1167989 - RNA, 23 nt, Homo sapiens
cgaaugcauuuggaaccaaaguc

SEQ ID NO: 1167990 - RNA, 17 nt, Homo sapiens
cccauuaaaaugaauuu

SEQ ID NO: 1167991 - RNA, 15 nt, Homo sapiens
cccauuauagcacaa

SEQ ID NO: 1167992 - RNA, 21 nt, Homo sapiens
cccauuuagaauaucuagcau

SEQ ID NO: 1167993 - RNA, 16 nt, Homo sapiens
cccauuugaggggugg

SEQ ID NO: 1167994 - RNA, 23 nt, Homo sapiens
cccauuuguugcugcugcugcuc

SEQ ID NO: 1167995 - RNA, 19 nt, Homo sapiens
ccccaaaaauugacuuaga

SEQ ID NO: 1167996 - RNA, 13 nt, Homo sapiens
ccccaacacuucc

SEQ ID NO: 1167997 - RNA, 11 nt, Homo sapiens
ccccaacagca

SEQ ID NO: 1167998 - RNA, 12 nt, Homo sapiens
ccccaacaugga

SEQ ID NO: 1167999 - RNA, 12 nt, Homo sapiens
ccccaauccauc

SEQ ID NO: 1168000 - RNA, 12 nt, Homo sapiens
ccccacacccau

SEQ ID NO: 1168001 - RNA, 16 nt, Homo sapiens
ccccacccccugccaa

SEQ ID NO: 1168002 - RNA, 12 nt, Homo sapiens
ccccacugacca

SEQ ID NO: 1168003 - RNA, 22 nt, Homo sapiens
ccccacuggggaaauaacagcu

SEQ ID NO: 1168004 - RNA, 16 nt, Homo sapiens
ccccagaccucaggga

SEQ ID NO: 1168005 - RNA, 21 nt, Homo sapiens
ccccagcauucucaggcacca

SEQ ID NO: 1168006 - RNA, 14 nt, Homo sapiens
ccccagcccagaga

SEQ ID NO: 1168007 - RNA, 16 nt, Homo sapiens
ccccaggaauuuggga

SEQ ID NO: 1168008 - RNA, 16 nt, Homo sapiens
ccccaggacugucauu

SEQ ID NO: 1168009 - RNA, 16 nt, Homo sapiens
ccccaggcacuuugca

SEQ ID NO: 1168010 - RNA, 19 nt, Homo sapiens
ccccaggcacuuugcauca

SEQ ID NO: 1168011 - RNA, 14 nt, Homo sapiens
ccccaggcucaacu

SEQ ID NO: 1168012 - RNA, 22 nt, Homo sapiens
ccccaugcauacguacauuccu

SEQ ID NO: 1168013 - RNA, 11 nt, Homo sapiens
cccccaacagc

SEQ ID NO: 1168014 - RNA, 21 nt, Homo sapiens
cccccagccugccuuugccac

SEQ ID NO: 1168015 - RNA, 14 nt, Homo sapiens
cccccagcuaagaa

SEQ ID NO: 1168016 - RNA, 14 nt, Homo sapiens
cccccaguguaaua

SEQ ID NO: 1168017 - RNA, 21 nt, Homo sapiens
cccccaucuucgggaccagga

SEQ ID NO: 1168018 - RNA, 23 nt, Homo sapiens
cccccgaagaaggaccagugaag

SEQ ID NO: 1168019 - RNA, 23 nt, Homo sapiens
cccccuccucugaaacagcugcc

SEQ ID NO: 1168020 - RNA, 17 nt, Homo sapiens
cccccucuguugcacau

SEQ ID NO: 1168021 - RNA, 14 nt, Homo sapiens
cccccugccagucu

SEQ ID NO: 1168022 - RNA, 15 nt, Homo sapiens
cccccugccagugcc

SEQ ID NO: 1168023 - RNA, 13 nt, Homo sapiens
cccccuucacaaa

SEQ ID NO: 1168024 - RNA, 12 nt, Homo sapiens
ccccgagcucag

SEQ ID NO: 1168025 - RNA, 14 nt, Homo sapiens
ccccgcaccuguac

SEQ ID NO: 1168026 - RNA, 23 nt, Homo sapiens
ccccgcucccaccuagugcccca

SEQ ID NO: 1168027 - RNA, 22 nt, Homo sapiens
ccccgucacgugcgcugggcac

SEQ ID NO: 1168028 - RNA, 18 nt, Homo sapiens
ccccuagagacagugaug

SEQ ID NO: 1168029 - RNA, 17 nt, Homo sapiens
ccccuauggaauuuaua

SEQ ID NO: 1168030 - RNA, 13 nt, Homo sapiens
ccccuccacucuc

SEQ ID NO: 1168031 - RNA, 19 nt, Homo sapiens
ccccucccacagcgcuggc

SEQ ID NO: 1168032 - RNA, 20 nt, Homo sapiens
ccccucuucugagcacagau

SEQ ID NO: 1168033 - RNA, 11 nt, Homo sapiens
ccccugaaaua

SEQ ID NO: 1168034 - RNA, 16 nt, Homo sapiens
ccccugcugcugucac

SEQ ID NO: 1168035 - RNA, 14 nt, Homo sapiens
ccccuggcucugac

SEQ ID NO: 1168036 - RNA, 16 nt, Homo sapiens
ccccugguaagcagag

SEQ ID NO: 1168037 - RNA, 18 nt, Homo sapiens
ccccuguggccacuuucc

SEQ ID NO: 1168038 - RNA, 20 nt, Homo sapiens
ccccuucucugugacccacu

SEQ ID NO: 1168039 - RNA, 21 nt, Homo sapiens
ccccuuguuuagcauauaauc

SEQ ID NO: 1168040 - RNA, 13 nt, Homo sapiens
cccgaaugcauuu

SEQ ID NO: 1168041 - RNA, 16 nt, Homo sapiens
cccgagccuggcucca

SEQ ID NO: 1168042 - RNA, 23 nt, Homo sapiens
cccgccaaggaaaggcauguaca

SEQ ID NO: 1168043 - RNA, 22 nt, Homo sapiens
cccgccgccugguacucaagcc

SEQ ID NO: 1168044 - RNA, 17 nt, Homo sapiens
cccggagcuuugcaagc

SEQ ID NO: 1168045 - RNA, 20 nt, Homo sapiens
cccggagggaaacugugaau

SEQ ID NO: 1168046 - RNA, 18 nt, Homo sapiens
cccggcuacaucagccuu

SEQ ID NO: 1168047 - RNA, 15 nt, Homo sapiens
cccgggacucacugg

SEQ ID NO: 1168048 - RNA, 20 nt, Homo sapiens
cccgggaggcagagguugua

SEQ ID NO: 1168049 - RNA, 22 nt, Homo sapiens
cccggggcuggcggcuacucag

SEQ ID NO: 1168050 - RNA, 21 nt, Homo sapiens
cccgguggcggccccagcacc

SEQ ID NO: 1168051 - RNA, 23 nt, Homo sapiens
cccgucacgugcgcugggcacuu

SEQ ID NO: 1168052 - RNA, 16 nt, Homo sapiens
cccgucuggugccagu

SEQ ID NO: 1168053 - RNA, 15 nt, Homo sapiens
cccguggcauuucaa

SEQ ID NO: 1168054 - RNA, 23 nt, Homo sapiens
cccguggccauuacugcauaaaa

SEQ ID NO: 1168055 - RNA, 17 nt, Homo sapiens
cccuaaaagcacacuca

SEQ ID NO: 1168056 - RNA, 15 nt, Homo sapiens
cccuaaaccaaaaac

SEQ ID NO: 1168057 - RNA, 18 nt, Homo sapiens
cccuaacacuuaccccau

SEQ ID NO: 1168058 - RNA, 18 nt, Homo sapiens
cccuaagcgcacauucau

SEQ ID NO: 1168059 - RNA, 9 nt, Homo sapiens
cccuaccuu

SEQ ID NO: 1168060 - RNA, 18 nt, Homo sapiens
cccuacuauucaguggcg

SEQ ID NO: 1168061 - RNA, 16 nt, Homo sapiens
cccuagccaauucaca

SEQ ID NO: 1168062 - RNA, 16 nt, Homo sapiens
cccuaguucucuuauc

SEQ ID NO: 1168063 - RNA, 15 nt, Homo sapiens
cccuauuauuugccc

SEQ ID NO: 1168064 - RNA, 12 nt, Homo sapiens
cccuauucccug

SEQ ID NO: 1168065 - RNA, 18 nt, Homo sapiens
cccucacagcacagagaa

SEQ ID NO: 1168066 - RNA, 21 nt, Homo sapiens
cccucaccuuggcaccagaca

SEQ ID NO: 1168067 - RNA, 14 nt, Homo sapiens
cccucagagugcaa

SEQ ID NO: 1168068 - RNA, 15 nt, Homo sapiens
cccucagagugcaag

SEQ ID NO: 1168069 - RNA, 17 nt, Homo sapiens
cccucagagugcaagcc

SEQ ID NO: 1168070 - RNA, 10 nt, Homo sapiens
cccucaggcu

SEQ ID NO: 1168071 - RNA, 13 nt, Homo sapiens
cccucaucaggag

SEQ ID NO: 1168072 - RNA, 15 nt, Homo sapiens
cccuccacaaagcaa

SEQ ID NO: 1168073 - RNA, 12 nt, Homo sapiens
cccuccauucca

SEQ ID NO: 1168074 - RNA, 14 nt, Homo sapiens
cccucccugccuaa

SEQ ID NO: 1168075 - RNA, 20 nt, Homo sapiens
cccucccuguuccccagaga

SEQ ID NO: 1168076 - RNA, 14 nt, Homo sapiens
cccuccuggccuca

SEQ ID NO: 1168077 - RNA, 19 nt, Homo sapiens
cccucuaggcucugccuuc

SEQ ID NO: 1168078 - RNA, 17 nt, Homo sapiens
cccucucaggagccauc

SEQ ID NO: 1168079 - RNA, 14 nt, Homo sapiens
cccucuucauggau

SEQ ID NO: 1168080 - RNA, 16 nt, Homo sapiens
cccucuucauggaugg

SEQ ID NO: 1168081 - RNA, 13 nt, Homo sapiens
cccucuucugagc

SEQ ID NO: 1168082 - RNA, 13 nt, Homo sapiens
cccucuugugcuc

SEQ ID NO: 1168083 - RNA, 17 nt, Homo sapiens
cccugaaccucugaugc

SEQ ID NO: 1168084 - RNA, 21 nt, Homo sapiens
cccugacaucuggaaucugga

SEQ ID NO: 1168085 - RNA, 16 nt, Homo sapiens
cccugacucaucauuu

SEQ ID NO: 1168086 - RNA, 16 nt, Homo sapiens
cccugagucaccagga

SEQ ID NO: 1168087 - RNA, 18 nt, Homo sapiens
cccugaguuccuagccac

SEQ ID NO: 1168088 - RNA, 18 nt, Homo sapiens
cccugccgugguggcagc

SEQ ID NO: 1168089 - RNA, 14 nt, Homo sapiens
cccugccuaaggaa

SEQ ID NO: 1168090 - RNA, 16 nt, Homo sapiens
cccugccucacaucuc

SEQ ID NO: 1168091 - RNA, 17 nt, Homo sapiens
cccugccucacaucucc

SEQ ID NO: 1168092 - RNA, 13 nt, Homo sapiens
cccugcucccaca

SEQ ID NO: 1168093 - RNA, 11 nt, Homo sapiens
cccugcugcuu

SEQ ID NO: 1168094 - RNA, 19 nt, Homo sapiens
cccuggagugugucagagc

SEQ ID NO: 1168095 - RNA, 15 nt, Homo sapiens
cccuggcagcugccc

SEQ ID NO: 1168096 - RNA, 22 nt, Homo sapiens
cccuggcucugaccgaaacagc

SEQ ID NO: 1168097 - RNA, 14 nt, Homo sapiens
cccugggacaucag

SEQ ID NO: 1168098 - RNA, 20 nt, Homo sapiens
cccuggggagucugggcaca

SEQ ID NO: 1168099 - RNA, 16 nt, Homo sapiens
cccugguccuucacug

SEQ ID NO: 1168100 - RNA, 20 nt, Homo sapiens
cccugucucggggcuugccc

SEQ ID NO: 1168101 - RNA, 14 nt, Homo sapiens
cccugucuugcuua

SEQ ID NO: 1168102 - RNA, 12 nt, Homo sapiens
cccugugcaacc

SEQ ID NO: 1168103 - RNA, 21 nt, Homo sapiens
cccuguggcaggacacacaug

SEQ ID NO: 1168104 - RNA, 13 nt, Homo sapiens
cccugugguugcc

SEQ ID NO: 1168105 - RNA, 21 nt, Homo sapiens
cccuuacagccucugacuuaa

SEQ ID NO: 1168106 - RNA, 17 nt, Homo sapiens
cccuuagccuugcugua

SEQ ID NO: 1168107 - RNA, 17 nt, Homo sapiens
cccuuccuugccaguga

SEQ ID NO: 1168108 - RNA, 15 nt, Homo sapiens
cccuucugcucagcu

SEQ ID NO: 1168109 - RNA, 22 nt, Homo sapiens
cccuucuugguuuccaaaggca

SEQ ID NO: 1168110 - RNA, 21 nt, Homo sapiens
cccuugcaaucuucuacuuua

SEQ ID NO: 1168111 - RNA, 14 nt, Homo sapiens
cccuugcuggaguc

SEQ ID NO: 1168112 - RNA, 22 nt, Homo sapiens
cccuugcuguaugcugaucauc

SEQ ID NO: 1168113 - RNA, 19 nt, Homo sapiens
cccuuggggguucagggaa

SEQ ID NO: 1168114 - RNA, 18 nt, Homo sapiens
cccuuguguuuugaagaa

SEQ ID NO: 1168115 - RNA, 21 nt, Homo sapiens
cccuuguuucuauacauucua

SEQ ID NO: 1168116 - RNA, 15 nt, Homo sapiens
cccuuuaacucauga

SEQ ID NO: 1168117 - RNA, 19 nt, Homo sapiens
cccuuugugacuucaagaa

SEQ ID NO: 1168118 - RNA, 18 nt, Homo sapiens
cccuuuuaauacagggac

SEQ ID NO: 1168119 - RNA, 13 nt, Homo sapiens
cccuuuuacauac

SEQ ID NO: 1168120 - RNA, 18 nt, Homo sapiens
cccuuuuacauacugcug

SEQ ID NO: 1168121 - RNA, 19 nt, Homo sapiens
cccuuuuguuuuugggaca

SEQ ID NO: 1168122 - RNA, 12 nt, Homo sapiens
ccgagaagaaca

SEQ ID NO: 1168123 - RNA, 18 nt, Homo sapiens
ccgagaaggcggaaaccc

SEQ ID NO: 1168124 - RNA, 13 nt, Homo sapiens
ccgagaccccauc

SEQ ID NO: 1168125 - RNA, 22 nt, Homo sapiens
ccgagaggcaggucaagaucug

SEQ ID NO: 1168126 - RNA, 12 nt, Homo sapiens
ccaucucagguu

SEQ ID NO: 1168127 - RNA, 17 nt, Homo sapiens
ccaucuccucagcaccc

SEQ ID NO: 1168128 - RNA, 20 nt, Homo sapiens
ccaucuggaccugguacaaa

SEQ ID NO: 1168129 - RNA, 15 nt, Homo sapiens
ccaucugugacuaua

SEQ ID NO: 1168130 - RNA, 19 nt, Homo sapiens
ccaucuucgggaccaggau

SEQ ID NO: 1168131 - RNA, 20 nt, Homo sapiens
ccaucuuuaaucaaugugac

SEQ ID NO: 1168132 - RNA, 16 nt, Homo sapiens
ccaugaaaauagccaa

SEQ ID NO: 1168133 - RNA, 23 nt, Homo sapiens
ccaugaaaauagccaaccagcag

SEQ ID NO: 1168134 - RNA, 19 nt, Homo sapiens
ccaugaaccaagaccauug

SEQ ID NO: 1168135 - RNA, 15 nt, Homo sapiens
ccaugaacuuaaaau

SEQ ID NO: 1168136 - RNA, 14 nt, Homo sapiens
ccaugaagccacag

SEQ ID NO: 1168137 - RNA, 22 nt, Homo sapiens
ccaugagagaaggaggggagca

SEQ ID NO: 1168138 - RNA, 20 nt, Homo sapiens
ccaugagaugauacauccaa

SEQ ID NO: 1168139 - RNA, 23 nt, Homo sapiens
ccaugagcuccuuaaggcucuuu

SEQ ID NO: 1168140 - RNA, 20 nt, Homo sapiens
ccaugagcuuaggcauucua

SEQ ID NO: 1168141 - RNA, 14 nt, Homo sapiens
ccaugaguggaguu

SEQ ID NO: 1168142 - RNA, 17 nt, Homo sapiens
ccaugauggcaacagau

SEQ ID NO: 1168143 - RNA, 22 nt, Homo sapiens
ccaugcaagaacucaucacugu

SEQ ID NO: 1168144 - RNA, 17 nt, Homo sapiens
ccaugcaggauuugaau

SEQ ID NO: 1168145 - RNA, 15 nt, Homo sapiens
ccaugccaaccagcu

SEQ ID NO: 1168146 - RNA, 20 nt, Homo sapiens
ccaugcucuuguucuguucc

SEQ ID NO: 1168147 - RNA, 16 nt, Homo sapiens
ccaugcugauaaacug

SEQ ID NO: 1168148 - RNA, 21 nt, Homo sapiens
ccauggcagggugcuaguggu

SEQ ID NO: 1168149 - RNA, 15 nt, Homo sapiens
ccaugggaccacaac

SEQ ID NO: 1168150 - RNA, 22 nt, Homo sapiens
ccaugggauuuuaucuguggau

SEQ ID NO: 1168151 - RNA, 13 nt, Homo sapiens
ccauggggagcaa

SEQ ID NO: 1168152 - RNA, 18 nt, Homo sapiens
ccaugggggcaacagcca

SEQ ID NO: 1168153 - RNA, 19 nt, Homo sapiens
ccauggugcuggggagcca

SEQ ID NO: 1168154 - RNA, 18 nt, Homo sapiens
ccaugugcuagucacugg

SEQ ID NO: 1168155 - RNA, 16 nt, Homo sapiens
ccauguuaacaugaca

SEQ ID NO: 1168156 - RNA, 21 nt, Homo sapiens
ccauguuaacaugacauuuac

SEQ ID NO: 1168157 - RNA, 13 nt, Homo sapiens
ccauguuggaucu

SEQ ID NO: 1168158 - RNA, 23 nt, Homo sapiens
ccauuagaaugugauuuuuguuc

SEQ ID NO: 1168159 - RNA, 13 nt, Homo sapiens
ccauucaguuuua

SEQ ID NO: 1168160 - RNA, 13 nt, Homo sapiens
ccauuccuaccca

SEQ ID NO: 1168161 - RNA, 13 nt, Homo sapiens
ccauugagacuau

SEQ ID NO: 1168162 - RNA, 13 nt, Homo sapiens
ccauugcaaugaa

SEQ ID NO: 1168163 - RNA, 13 nt, Homo sapiens
ccauugcacucca

SEQ ID NO: 1168164 - RNA, 19 nt, Homo sapiens
ccauuggacagauuucagu

SEQ ID NO: 1168165 - RNA, 15 nt, Homo sapiens
ccauugguccaagau

SEQ ID NO: 1168166 - RNA, 16 nt, Homo sapiens
ccauuguuugaaacaa

SEQ ID NO: 1168167 - RNA, 18 nt, Homo sapiens
ccauuuaaacuaaccuuu

SEQ ID NO: 1168168 - RNA, 12 nt, Homo sapiens
ccauuuacuuag

SEQ ID NO: 1168169 - RNA, 19 nt, Homo sapiens
ccauuucauauucuuucaa

SEQ ID NO: 1168170 - RNA, 23 nt, Homo sapiens
ccauuuccaaaccuccacugcug

SEQ ID NO: 1168171 - RNA, 13 nt, Homo sapiens
ccauuuccugaga

SEQ ID NO: 1168172 - RNA, 11 nt, Homo sapiens
ccauuuugccu

SEQ ID NO: 1168173 - RNA, 16 nt, Homo sapiens
ccauuuuuagugaaau

SEQ ID NO: 1168174 - RNA, 12 nt, Homo sapiens
cccaaacauguu

SEQ ID NO: 1168175 - RNA, 20 nt, Homo sapiens
cccaaacccagaacaugaag

SEQ ID NO: 1168176 - RNA, 22 nt, Homo sapiens
cccaacagcacccucuccagau

SEQ ID NO: 1168177 - RNA, 18 nt, Homo sapiens
cccaacaggaggacaauu

SEQ ID NO: 1168178 - RNA, 21 nt, Homo sapiens
cccaacaggaggacaauucau

SEQ ID NO: 1168179 - RNA, 20 nt, Homo sapiens
cccaacagugaugaugcaug

SEQ ID NO: 1168180 - RNA, 21 nt, Homo sapiens
cccaacagugaugaugcaugg

SEQ ID NO: 1168181 - RNA, 13 nt, Homo sapiens
cccaacaugacug

SEQ ID NO: 1168182 - RNA, 15 nt, Homo sapiens
cccaaccugacuuug

SEQ ID NO: 1168183 - RNA, 17 nt, Homo sapiens
cccaacugaccugccag

SEQ ID NO: 1168184 - RNA, 20 nt, Homo sapiens
cccaagagcuuccagagcuc

SEQ ID NO: 1168185 - RNA, 19 nt, Homo sapiens
cccaagcagagaagcucuc

SEQ ID NO: 1168186 - RNA, 18 nt, Homo sapiens
cccaagccagcccggccg

SEQ ID NO: 1168187 - RNA, 21 nt, Homo sapiens
cccaaggaugccuuagcaugu

SEQ ID NO: 1168188 - RNA, 21 nt, Homo sapiens
cccaaguaagaggcuggaguu

SEQ ID NO: 1168189 - RNA, 12 nt, Homo sapiens
cccaaguauuuu

SEQ ID NO: 1168190 - RNA, 17 nt, Homo sapiens
cccaagugccaagacac

SEQ ID NO: 1168191 - RNA, 15 nt, Homo sapiens
cccaauaacccagca

SEQ ID NO: 1168192 - RNA, 13 nt, Homo sapiens
cccaauaauugca

SEQ ID NO: 1168193 - RNA, 16 nt, Homo sapiens
cccaauucacaucuaa

SEQ ID NO: 1168194 - RNA, 16 nt, Homo sapiens
cccacaacgugcaacu

SEQ ID NO: 1168195 - RNA, 20 nt, Homo sapiens
cccacaacgugcaacugaca

SEQ ID NO: 1168196 - RNA, 17 nt, Homo sapiens
cccacacaagacccaag

SEQ ID NO: 1168197 - RNA, 20 nt, Homo sapiens
cccacacacaggugguguca

SEQ ID NO: 1168198 - RNA, 15 nt, Homo sapiens
cccacagcacuaauu

SEQ ID NO: 1168199 - RNA, 17 nt, Homo sapiens
cccacagguguguuucc

SEQ ID NO: 1168200 - RNA, 18 nt, Homo sapiens
cccacauccugugccucc

SEQ ID NO: 1168201 - RNA, 19 nt, Homo sapiens
cccacaugugacacauaug

SEQ ID NO: 1168202 - RNA, 23 nt, Homo sapiens
cccacaugugacacauaugcacc

SEQ ID NO: 1168203 - RNA, 14 nt, Homo sapiens
cccacccuggaaug

SEQ ID NO: 1168204 - RNA, 18 nt, Homo sapiens
cccaccuacuuagauauu

SEQ ID NO: 1168205 - RNA, 22 nt, Homo sapiens
cccaccuucuucagccaccucu

SEQ ID NO: 1168206 - RNA, 23 nt, Homo sapiens
cccaccuuuuuucuuugguugcu

SEQ ID NO: 1168207 - RNA, 18 nt, Homo sapiens
cccacgagaccccggcuu

SEQ ID NO: 1168208 - RNA, 14 nt, Homo sapiens
cccacuagcauuuu

SEQ ID NO: 1168209 - RNA, 17 nt, Homo sapiens
cccacuuucuucuacca

SEQ ID NO: 1168210 - RNA, 22 nt, Homo sapiens
cccagaaagucucucauucuag

SEQ ID NO: 1168211 - RNA, 17 nt, Homo sapiens
cccagaacaugaagaag

SEQ ID NO: 1168212 - RNA, 16 nt, Homo sapiens
cccagacuugcacugg

SEQ ID NO: 1168213 - RNA, 23 nt, Homo sapiens
cccagauguuuuacgucugggag

SEQ ID NO: 1168214 - RNA, 20 nt, Homo sapiens
cccagauucuucagcuugau

SEQ ID NO: 1168215 - RNA, 15 nt, Homo sapiens
cccagcaacucuggc

SEQ ID NO: 1168216 - RNA, 11 nt, Homo sapiens
cccagcacuug

SEQ ID NO: 1168217 - RNA, 21 nt, Homo sapiens
cccagcaggugcugacuucau

SEQ ID NO: 1168218 - RNA, 11 nt, Homo sapiens
cccagcauuuu

SEQ ID NO: 1168219 - RNA, 16 nt, Homo sapiens
cccagccgcacuggga

SEQ ID NO: 1168220 - RNA, 18 nt, Homo sapiens
cccagcgacgaacuuucc

SEQ ID NO: 1168221 - RNA, 16 nt, Homo sapiens
cccagcuaacucugac

SEQ ID NO: 1168222 - RNA, 13 nt, Homo sapiens
cccagcuacucag

SEQ ID NO: 1168223 - RNA, 14 nt, Homo sapiens
cccagcuauacugu

SEQ ID NO: 1168224 - RNA, 21 nt, Homo sapiens
cccagcuccggccuguccucc

SEQ ID NO: 1168225 - RNA, 17 nt, Homo sapiens
cccaggaauuugggacc

SEQ ID NO: 1168226 - RNA, 14 nt, Homo sapiens
cccaggacccugaa

SEQ ID NO: 1168227 - RNA, 22 nt, Homo sapiens
cccaggagccggacacuucuca

SEQ ID NO: 1168228 - RNA, 20 nt, Homo sapiens
cccaggaggggaacacugcc

SEQ ID NO: 1168229 - RNA, 12 nt, Homo sapiens
cccaggaguaca

SEQ ID NO: 1168230 - RNA, 21 nt, Homo sapiens
cccaggaguauccucuugcca

SEQ ID NO: 1168231 - RNA, 19 nt, Homo sapiens
cccaggaucagauugcaug

SEQ ID NO: 1168232 - RNA, 21 nt, Homo sapiens
cccaggcccugcucuuccuca

SEQ ID NO: 1168233 - RNA, 16 nt, Homo sapiens
cccaggccuccagcuc

SEQ ID NO: 1168234 - RNA, 20 nt, Homo sapiens
cccaggcuagagugcaaugg

SEQ ID NO: 1168235 - RNA, 18 nt, Homo sapiens
cccaggcucaacugagga

SEQ ID NO: 1168236 - RNA, 18 nt, Homo sapiens
cccaggcuggagggcagu

SEQ ID NO: 1168237 - RNA, 20 nt, Homo sapiens
cccaggcuggagugcaauga

SEQ ID NO: 1168238 - RNA, 15 nt, Homo sapiens
cccagggggccuuuc

SEQ ID NO: 1168239 - RNA, 22 nt, Homo sapiens
cccagggggcugaaacuugaac

SEQ ID NO: 1168240 - RNA, 19 nt, Homo sapiens
cccaggguggagugcagug

SEQ ID NO: 1168241 - RNA, 18 nt, Homo sapiens
cccaggugcaggugcuga

SEQ ID NO: 1168242 - RNA, 23 nt, Homo sapiens
cccaggugguggcugcaaggugg

SEQ ID NO: 1168243 - RNA, 15 nt, Homo sapiens
cccagucacugugag

SEQ ID NO: 1168244 - RNA, 11 nt, Homo sapiens
cccagugaauu

SEQ ID NO: 1168245 - RNA, 22 nt, Homo sapiens
cccagugcccccacugaccaga

SEQ ID NO: 1168246 - RNA, 11 nt, Homo sapiens
cccagugccua

SEQ ID NO: 1168247 - RNA, 12 nt, Homo sapiens
cccagugccuuc

SEQ ID NO: 1168248 - RNA, 19 nt, Homo sapiens
cccagugcgugaagaccaa

SEQ ID NO: 1168249 - RNA, 22 nt, Homo sapiens
cccaguucacccugauuuagga

SEQ ID NO: 1168250 - RNA, 17 nt, Homo sapiens
cccaguugugacaauua

SEQ ID NO: 1168251 - RNA, 21 nt, Homo sapiens
cccaguuuuuugaacauggaa

SEQ ID NO: 1168252 - RNA, 22 nt, Homo sapiens
cccauaggcccacacacaggug

SEQ ID NO: 1168253 - RNA, 14 nt, Homo sapiens
cccaucauacccuu

SEQ ID NO: 1168254 - RNA, 19 nt, Homo sapiens
cccaucgccccaccgcagc

SEQ ID NO: 1168255 - RNA, 15 nt, Homo sapiens
cccaucuccuuucau

SEQ ID NO: 1168256 - RNA, 14 nt, Homo sapiens
cccaugaagccaca

SEQ ID NO: 1168257 - RNA, 16 nt, Homo sapiens
cccaugaguccuugaa

SEQ ID NO: 1168258 - RNA, 23 nt, Homo sapiens
cccauguguguguacaacacugg

SEQ ID NO: 1168259 - RNA, 20 nt, Homo sapiens
cccauguugagccaugagug

SEQ ID NO: 1168260 - RNA, 21 nt, Homo sapiens
cagauuuacaucccagacaca

SEQ ID NO: 1168261 - RNA, 18 nt, Homo sapiens
cagauuuccucacuaccu

SEQ ID NO: 1168262 - RNA, 23 nt, Homo sapiens
cagauuuguggggaccucagccu

SEQ ID NO: 1168263 - RNA, 22 nt, Homo sapiens
cagauuuuagaggggggaaauu

SEQ ID NO: 1168264 - RNA, 18 nt, Homo sapiens
cagauuuucggaacacau

SEQ ID NO: 1168265 - RNA, 14 nt, Homo sapiens
cagcaaaucacgac

SEQ ID NO: 1168266 - RNA, 17 nt, Homo sapiens
cagcaacagcaaaucac

SEQ ID NO: 1168267 - RNA, 17 nt, Homo sapiens
cagcaagagagaaccua

SEQ ID NO: 1168268 - RNA, 22 nt, Homo sapiens
cagcaagucccagacaaggaga

SEQ ID NO: 1168269 - RNA, 23 nt, Homo sapiens
cagcaagucccagacaaggagag

SEQ ID NO: 1168270 - RNA, 17 nt, Homo sapiens
cagcaaugugccuucua

SEQ ID NO: 1168271 - RNA, 22 nt, Homo sapiens
cagcaauucuccugccucagcc

SEQ ID NO: 1168272 - RNA, 16 nt, Homo sapiens
cagcacacagggcagu

SEQ ID NO: 1168273 - RNA, 19 nt, Homo sapiens
cagcacccucuccagauga

SEQ ID NO: 1168274 - RNA, 21 nt, Homo sapiens
cagcaccgauggccauguaaa

SEQ ID NO: 1168275 - RNA, 14 nt, Homo sapiens
cagcacuaauucaa

SEQ ID NO: 1168276 - RNA, 15 nt, Homo sapiens
cagcacuaauucaac

SEQ ID NO: 1168277 - RNA, 15 nt, Homo sapiens
cagcacucagagaca

SEQ ID NO: 1168278 - RNA, 12 nt, Homo sapiens
cagcacuuguau

SEQ ID NO: 1168279 - RNA, 15 nt, Homo sapiens
cagcagaaagguuag

SEQ ID NO: 1168280 - RNA, 20 nt, Homo sapiens
cagcagaaagguuaguauca

SEQ ID NO: 1168281 - RNA, 21 nt, Homo sapiens
cagcagauuucagguguaacc

SEQ ID NO: 1168282 - RNA, 15 nt, Homo sapiens
cagcagcagcucaca

SEQ ID NO: 1168283 - RNA, 14 nt, Homo sapiens
cagcagccugugag

SEQ ID NO: 1168284 - RNA, 16 nt, Homo sapiens
cagcagggaugcccug

SEQ ID NO: 1168285 - RNA, 13 nt, Homo sapiens
cagcaggugcuga

SEQ ID NO: 1168286 - RNA, 15 nt, Homo sapiens
cagcagugccuugug

SEQ ID NO: 1168287 - RNA, 18 nt, Homo sapiens
cagcagugccuugugcaa

SEQ ID NO: 1168288 - RNA, 20 nt, Homo sapiens
cagcagugccuugugcaaug

SEQ ID NO: 1168289 - RNA, 21 nt, Homo sapiens
cagcauccuccacuuguucag

SEQ ID NO: 1168290 - RNA, 16 nt, Homo sapiens
cagcaucugaccaucu

SEQ ID NO: 1168291 - RNA, 20 nt, Homo sapiens
cagcaugccuucaaaucaau

SEQ ID NO: 1168292 - RNA, 23 nt, Homo sapiens
cagcauguuucucccauuuagaa

SEQ ID NO: 1168293 - RNA, 16 nt, Homo sapiens
cagcauugacucugug

SEQ ID NO: 1168294 - RNA, 17 nt, Homo sapiens
cagcauuuccacaccaa

SEQ ID NO: 1168295 - RNA, 11 nt, Homo sapiens
cagcauuuccc

SEQ ID NO: 1168296 - RNA, 16 nt, Homo sapiens
cagcauuugauuaaca

SEQ ID NO: 1168297 - RNA, 17 nt, Homo sapiens
cagccaaaaaggacuuu

SEQ ID NO: 1168298 - RNA, 13 nt, Homo sapiens
cagccaacagcua

SEQ ID NO: 1168299 - RNA, 21 nt, Homo sapiens
cagccaaucuggacacuucuu

SEQ ID NO: 1168300 - RNA, 13 nt, Homo sapiens
cagccacaccacu

SEQ ID NO: 1168301 - RNA, 16 nt, Homo sapiens
cagccaccccugagau

SEQ ID NO: 1168302 - RNA, 15 nt, Homo sapiens
cagccaccccugcca

SEQ ID NO: 1168303 - RNA, 15 nt, Homo sapiens
cagccaccuaguccc

SEQ ID NO: 1168304 - RNA, 18 nt, Homo sapiens
cagccacuccccggcaug

SEQ ID NO: 1168305 - RNA, 15 nt, Homo sapiens
cagccacuuuaguga

SEQ ID NO: 1168306 - RNA, 21 nt, Homo sapiens
cagccaguuuuacugugauuc

SEQ ID NO: 1168307 - RNA, 17 nt, Homo sapiens
cagccaugucugugcug

SEQ ID NO: 1168308 - RNA, 20 nt, Homo sapiens
cagcccaccccugugcccac

SEQ ID NO: 1168309 - RNA, 14 nt, Homo sapiens
cagcccaggccucc

SEQ ID NO: 1168310 - RNA, 22 nt, Homo sapiens
cagccccuuaagcaugcuucua

SEQ ID NO: 1168311 - RNA, 14 nt, Homo sapiens
cagcccugcugcuu

SEQ ID NO: 1168312 - RNA, 22 nt, Homo sapiens
cagcccuggcucucacgcuggg

SEQ ID NO: 1168313 - RNA, 14 nt, Homo sapiens
cagcccuugaggga

SEQ ID NO: 1168314 - RNA, 15 nt, Homo sapiens
cagccguccauagca

SEQ ID NO: 1168315 - RNA, 22 nt, Homo sapiens
cagccguguguucaaauguaca

SEQ ID NO: 1168316 - RNA, 16 nt, Homo sapiens
cagccuacaaagagau

SEQ ID NO: 1168317 - RNA, 15 nt, Homo sapiens
cagccucccauccag

SEQ ID NO: 1168318 - RNA, 18 nt, Homo sapiens
cagccucccauccagggc

SEQ ID NO: 1168319 - RNA, 23 nt, Homo sapiens
cagccuccccaguagcugggauu

SEQ ID NO: 1168320 - RNA, 16 nt, Homo sapiens
cagccucccccggcuc

SEQ ID NO: 1168321 - RNA, 15 nt, Homo sapiens
cagccuccucuggau

SEQ ID NO: 1168322 - RNA, 17 nt, Homo sapiens
cagccucgcucuugucu

SEQ ID NO: 1168323 - RNA, 16 nt, Homo sapiens
cagccucuccacucau

SEQ ID NO: 1168324 - RNA, 20 nt, Homo sapiens
cagccugaucaggcuuccug

SEQ ID NO: 1168325 - RNA, 15 nt, Homo sapiens
cagccuggacauaga

SEQ ID NO: 1168326 - RNA, 17 nt, Homo sapiens
cagccugggaggcacag

SEQ ID NO: 1168327 - RNA, 16 nt, Homo sapiens
cagccugggugacaga

SEQ ID NO: 1168328 - RNA, 23 nt, Homo sapiens
cagccugggugacagugcaagac

SEQ ID NO: 1168329 - RNA, 21 nt, Homo sapiens
cagccugugagggagugcaga

SEQ ID NO: 1168330 - RNA, 23 nt, Homo sapiens
cagccuugccagagauccaaaag

SEQ ID NO: 1168331 - RNA, 14 nt, Homo sapiens
cagccuuuaucaag

SEQ ID NO: 1168332 - RNA, 17 nt, Homo sapiens
cagcgaagacugcuaaa

SEQ ID NO: 1168333 - RNA, 13 nt, Homo sapiens
cagcgagccacag

SEQ ID NO: 1168334 - RNA, 15 nt, Homo sapiens
cagcgaguacuuccc

SEQ ID NO: 1168335 - RNA, 19 nt, Homo sapiens
cagcgaguacuucccgcug

SEQ ID NO: 1168336 - RNA, 15 nt, Homo sapiens
cagcgauggugcugc

SEQ ID NO: 1168337 - RNA, 21 nt, Homo sapiens
cagcgccaggcugaccacagc

SEQ ID NO: 1168338 - RNA, 15 nt, Homo sapiens
cagcgcuguauuuac

SEQ ID NO: 1168339 - RNA, 14 nt, Homo sapiens
cagcggcagugugu

SEQ ID NO: 1168340 - RNA, 16 nt, Homo sapiens
cagcggcucugguccu

SEQ ID NO: 1168341 - RNA, 19 nt, Homo sapiens
cagcuaaggacauuuccca

SEQ ID NO: 1168342 - RNA, 23 nt, Homo sapiens
cagcuaccucaaccaaugccaaa

SEQ ID NO: 1168343 - RNA, 17 nt, Homo sapiens
cagcuaguccuagugaa

SEQ ID NO: 1168344 - RNA, 19 nt, Homo sapiens
cagcuaucgccucuugccu

SEQ ID NO: 1168345 - RNA, 16 nt, Homo sapiens
cagcuauuuagugaua

SEQ ID NO: 1168346 - RNA, 11 nt, Homo sapiens
cagcucaaagg

SEQ ID NO: 1168347 - RNA, 14 nt, Homo sapiens
cagcucaaaggcac

SEQ ID NO: 1168348 - RNA, 11 nt, Homo sapiens
cagcucaggga

SEQ ID NO: 1168349 - RNA, 20 nt, Homo sapiens
cagcucccacaaaugacagc

SEQ ID NO: 1168350 - RNA, 19 nt, Homo sapiens
cagcucgggcccucuguga

SEQ ID NO: 1168351 - RNA, 17 nt, Homo sapiens
cagcucuaagucucaac

SEQ ID NO: 1168352 - RNA, 17 nt, Homo sapiens
cagcucuaauacauucc

SEQ ID NO: 1168353 - RNA, 18 nt, Homo sapiens
cagcucugaggacugcac

SEQ ID NO: 1168354 - RNA, 20 nt, Homo sapiens
cagcucugcaggcuuaauaa

SEQ ID NO: 1168355 - RNA, 21 nt, Homo sapiens
cagcucuggcuuccugcugag

SEQ ID NO: 1168356 - RNA, 16 nt, Homo sapiens
cagcucugggaacuga

SEQ ID NO: 1168357 - RNA, 14 nt, Homo sapiens
cagcugacacaucu

SEQ ID NO: 1168358 - RNA, 21 nt, Homo sapiens
ccagguccugagagcugcuuu

SEQ ID NO: 1168359 - RNA, 23 nt, Homo sapiens
ccaggucuguggaaaguggugca

SEQ ID NO: 1168360 - RNA, 18 nt, Homo sapiens
ccagguguggaacagccc

SEQ ID NO: 1168361 - RNA, 18 nt, Homo sapiens
ccagguguggugacucac

SEQ ID NO: 1168362 - RNA, 16 nt, Homo sapiens
ccagguuuaaacauca

SEQ ID NO: 1168363 - RNA, 18 nt, Homo sapiens
ccagguuuaaacaucacu

SEQ ID NO: 1168364 - RNA, 13 nt, Homo sapiens
ccaguaucuccaa

SEQ ID NO: 1168365 - RNA, 15 nt, Homo sapiens
ccaguaugacaguau

SEQ ID NO: 1168366 - RNA, 20 nt, Homo sapiens
ccagucacugugagcuccca

SEQ ID NO: 1168367 - RNA, 19 nt, Homo sapiens
ccagucccagcuaacucug

SEQ ID NO: 1168368 - RNA, 23 nt, Homo sapiens
ccagucccuguccggaaugccac

SEQ ID NO: 1168369 - RNA, 12 nt, Homo sapiens
ccaguccuuaau

SEQ ID NO: 1168370 - RNA, 16 nt, Homo sapiens
ccagucucuccagcau

SEQ ID NO: 1168371 - RNA, 20 nt, Homo sapiens
ccagucucuuguacagcguu

SEQ ID NO: 1168372 - RNA, 20 nt, Homo sapiens
ccagucuguugcugcuccau

SEQ ID NO: 1168373 - RNA, 11 nt, Homo sapiens
ccagugacacc

SEQ ID NO: 1168374 - RNA, 17 nt, Homo sapiens
ccagugccuucugggaa

SEQ ID NO: 1168375 - RNA, 20 nt, Homo sapiens
ccaguggggaaggaggccaa

SEQ ID NO: 1168376 - RNA, 12 nt, Homo sapiens
ccaguguaauaa

SEQ ID NO: 1168377 - RNA, 20 nt, Homo sapiens
ccaguuguagcagguuucac

SEQ ID NO: 1168378 - RNA, 19 nt, Homo sapiens
ccaguugugauacaauaaa

SEQ ID NO: 1168379 - RNA, 21 nt, Homo sapiens
ccaguuuugcugcuauaauuc

SEQ ID NO: 1168380 - RNA, 13 nt, Homo sapiens
ccauaacauacca

SEQ ID NO: 1168381 - RNA, 18 nt, Homo sapiens
ccauaagaggaguaggcc

SEQ ID NO: 1168382 - RNA, 15 nt, Homo sapiens
ccauaauguuccuua

SEQ ID NO: 1168383 - RNA, 14 nt, Homo sapiens
ccauacugacucaa

SEQ ID NO: 1168384 - RNA, 13 nt, Homo sapiens
ccauaggacaaau

SEQ ID NO: 1168385 - RNA, 13 nt, Homo sapiens
ccauaggcccaca

SEQ ID NO: 1168386 - RNA, 14 nt, Homo sapiens
ccauaggugcaguu

SEQ ID NO: 1168387 - RNA, 16 nt, Homo sapiens
ccauagucacauggcc

SEQ ID NO: 1168388 - RNA, 16 nt, Homo sapiens
ccauaucaugcuaaaa

SEQ ID NO: 1168389 - RNA, 23 nt, Homo sapiens
ccauaugaaaaggcuaagcuuca

SEQ ID NO: 1168390 - RNA, 14 nt, Homo sapiens
ccauauuacguugu

SEQ ID NO: 1168391 - RNA, 15 nt, Homo sapiens
ccauauugagucaaa

SEQ ID NO: 1168392 - RNA, 14 nt, Homo sapiens
ccaucaagcacuuc

SEQ ID NO: 1168393 - RNA, 18 nt, Homo sapiens
ccaucacuauucaaggau

SEQ ID NO: 1168394 - RNA, 19 nt, Homo sapiens
ccaucagcuaaacaccacg

SEQ ID NO: 1168395 - RNA, 23 nt, Homo sapiens
ccaucagcuuaggggcugcugac

SEQ ID NO: 1168396 - RNA, 21 nt, Homo sapiens
ccaucaggcagauaacugcug

SEQ ID NO: 1168397 - RNA, 14 nt, Homo sapiens
ccaucagugcuccc

SEQ ID NO: 1168398 - RNA, 13 nt, Homo sapiens
ccaucauuccuuu

SEQ ID NO: 1168399 - RNA, 16 nt, Homo sapiens
ccauccccaggcaccu

SEQ ID NO: 1168400 - RNA, 22 nt, Homo sapiens
ccauccuauuuaacuggcuuca

SEQ ID NO: 1168401 - RNA, 21 nt, Homo sapiens
ccaucggaaaggaauccacau

SEQ ID NO: 1168402 - RNA, 12 nt, Homo sapiens
ccaucucaaaaa

SEQ ID NO: 1168403 - RNA, 20 nt, Homo sapiens
aggugcugacuucaucuccc

SEQ ID NO: 1168404 - RNA, 16 nt, Homo sapiens
aggugcugaucugugg

SEQ ID NO: 1168405 - RNA, 16 nt, Homo sapiens
agguggcacuagggau

SEQ ID NO: 1168406 - RNA, 19 nt, Homo sapiens
aggugggaaaaucacuuga

SEQ ID NO: 1168407 - RNA, 21 nt, Homo sapiens
aggugggaaaaucacuugaac

SEQ ID NO: 1168408 - RNA, 19 nt, Homo sapiens
aggugggcggaucacuuga

SEQ ID NO: 1168409 - RNA, 20 nt, Homo sapiens
aggugggcggaucacuugag

SEQ ID NO: 1168410 - RNA, 20 nt, Homo sapiens
aggugguaguaaaacacaga

SEQ ID NO: 1168411 - RNA, 15 nt, Homo sapiens
agguggugucacugu

SEQ ID NO: 1168412 - RNA, 17 nt, Homo sapiens
aggugucccugccuuca

SEQ ID NO: 1168413 - RNA, 19 nt, Homo sapiens
aggugucuuaauacugucc

SEQ ID NO: 1168414 - RNA, 20 nt, Homo sapiens
aggugucuucuuugacuuaa

SEQ ID NO: 1168415 - RNA, 19 nt, Homo sapiens
aggugugaggacuucugca

SEQ ID NO: 1168416 - RNA, 18 nt, Homo sapiens
aggugugugccuagugau

SEQ ID NO: 1168417 - RNA, 17 nt, Homo sapiens
agguguuuucuguguaa

SEQ ID NO: 1168418 - RNA, 20 nt, Homo sapiens
agguuaaaggaaaagcacaa

SEQ ID NO: 1168419 - RNA, 21 nt, Homo sapiens
agguuaaaggaaaagcacaag

SEQ ID NO: 1168420 - RNA, 21 nt, Homo sapiens
agguuacccuguaacaugcaa

SEQ ID NO: 1168421 - RNA, 17 nt, Homo sapiens
agguuagcugcucccca

SEQ ID NO: 1168422 - RNA, 22 nt, Homo sapiens
agguuauuuaaacuuugggaaa

SEQ ID NO: 1168423 - RNA, 14 nt, Homo sapiens
agguucaagcgauu

SEQ ID NO: 1168424 - RNA, 16 nt, Homo sapiens
agguucaguauuaugu

SEQ ID NO: 1168425 - RNA, 16 nt, Homo sapiens
agguucccgacaccag

SEQ ID NO: 1168426 - RNA, 17 nt, Homo sapiens
agguucgagucuugcuc

SEQ ID NO: 1168427 - RNA, 17 nt, Homo sapiens
agguugaaaagacaaua

SEQ ID NO: 1168428 - RNA, 16 nt, Homo sapiens
agguugccugaaaaau

SEQ ID NO: 1168429 - RNA, 18 nt, Homo sapiens
agguuggcaaacgggcuu

SEQ ID NO: 1168430 - RNA, 17 nt, Homo sapiens
agguuggugaauuucac

SEQ ID NO: 1168431 - RNA, 22 nt, Homo sapiens
agguuggugaauuucacaagcu

SEQ ID NO: 1168432 - RNA, 17 nt, Homo sapiens
agguugugggcauugau

SEQ ID NO: 1168433 - RNA, 21 nt, Homo sapiens
agguuguuuuuaaaaccacua

SEQ ID NO: 1168434 - RNA, 18 nt, Homo sapiens
agguuuaaacaucacuug

SEQ ID NO: 1168435 - RNA, 12 nt, Homo sapiens
agguuucaagac

SEQ ID NO: 1168436 - RNA, 13 nt, Homo sapiens
agguuucuauucg

SEQ ID NO: 1168437 - RNA, 18 nt, Homo sapiens
agguuucuuugacuucaa

SEQ ID NO: 1168438 - RNA, 16 nt, Homo sapiens
agguuugccagcauuu

SEQ ID NO: 1168439 - RNA, 15 nt, Homo sapiens
agguuuguagugaaa

SEQ ID NO: 1168440 - RNA, 22 nt, Homo sapiens
agguuuugagauuuagagcaau

SEQ ID NO: 1168441 - RNA, 22 nt, Homo sapiens
agguuuuuuccuuucauuuuau

SEQ ID NO: 1168442 - RNA, 22 nt, Homo sapiens
aguaaaaaaggagacaguuuau

SEQ ID NO: 1168443 - RNA, 16 nt, Homo sapiens
aguaaaaauccaaaaa

SEQ ID NO: 1168444 - RNA, 16 nt, Homo sapiens
aguaaaagaaaccacu

SEQ ID NO: 1168445 - RNA, 18 nt, Homo sapiens
aguaaaagcaaaaugaua

SEQ ID NO: 1168446 - RNA, 19 nt, Homo sapiens
aguaaacaugugggaaaaa

SEQ ID NO: 1168447 - RNA, 19 nt, Homo sapiens
aguaaaguauuuuugauua

SEQ ID NO: 1168448 - RNA, 15 nt, Homo sapiens
aguaacauguguuaa

SEQ ID NO: 1168449 - RNA, 17 nt, Homo sapiens
aguaacugcacacuauu

SEQ ID NO: 1168450 - RNA, 11 nt, Homo sapiens
aguaacuguaa

SEQ ID NO: 1168451 - RNA, 20 nt, Homo sapiens
aguaacuuauuuuguacuag

SEQ ID NO: 1168452 - RNA, 24 nt, Homo sapiens
aguaacuuauuuuguacuaguguc

SEQ ID NO: 1168453 - RNA, 19 nt, Homo sapiens
aguaacuuggcuuucauua

SEQ ID NO: 1168454 - RNA, 23 nt, Homo sapiens
aguaagcauuuccagccuaucua

SEQ ID NO: 1168455 - RNA, 17 nt, Homo sapiens
aguaauacaucaaagag

SEQ ID NO: 1168456 - RNA, 19 nt, Homo sapiens
aguaaucuaauauggccac

SEQ ID NO: 1168457 - RNA, 12 nt, Homo sapiens
aguacacugugu

SEQ ID NO: 1168458 - RNA, 17 nt, Homo sapiens
aguacaggcagcacaga

SEQ ID NO: 1168459 - RNA, 13 nt, Homo sapiens
aguacaguauauu

SEQ ID NO: 1168460 - RNA, 18 nt, Homo sapiens
aguacaguggugccauca

SEQ ID NO: 1168461 - RNA, 13 nt, Homo sapiens
aguacauaaucuu

SEQ ID NO: 1168462 - RNA, 16 nt, Homo sapiens
aguacauaauugauua

SEQ ID NO: 1168463 - RNA, 17 nt, Homo sapiens
aguacaucucuacuaaa

SEQ ID NO: 1168464 - RNA, 15 nt, Homo sapiens
aguacccagugccua

SEQ ID NO: 1168465 - RNA, 15 nt, Homo sapiens
aguacccuuucaaac

SEQ ID NO: 1168466 - RNA, 18 nt, Homo sapiens
aguaccuuguuuugccau

SEQ ID NO: 1168467 - RNA, 16 nt, Homo sapiens
aguacuaagcauuuca

SEQ ID NO: 1168468 - RNA, 22 nt, Homo sapiens
aguacugaagagugacggacuu

SEQ ID NO: 1168469 - RNA, 18 nt, Homo sapiens
aguacugucccaggaaua

SEQ ID NO: 1168470 - RNA, 17 nt, Homo sapiens
aguacuuggguuugcaa

SEQ ID NO: 1168471 - RNA, 18 nt, Homo sapiens
aguagaaccacuugugga

SEQ ID NO: 1168472 - RNA, 17 nt, Homo sapiens
aguagacauuuuaacaa

SEQ ID NO: 1168473 - RNA, 16 nt, Homo sapiens
aguagauucuuacaag

SEQ ID NO: 1168474 - RNA, 21 nt, Homo sapiens
aguagauucuuacaaggcccu

SEQ ID NO: 1168475 - RNA, 13 nt, Homo sapiens
aguagcaccaaau

SEQ ID NO: 1168476 - RNA, 17 nt, Homo sapiens
aguagcugcuaccuucu

SEQ ID NO: 1168477 - RNA, 23 nt, Homo sapiens
aguagcuuaccagaagcuuccau

SEQ ID NO: 1168478 - RNA, 20 nt, Homo sapiens
aguaggcccugguuccugcu

SEQ ID NO: 1168479 - RNA, 22 nt, Homo sapiens
aguaguaccuuguuuugccaug

SEQ ID NO: 1168480 - RNA, 24 nt, Homo sapiens
aguaguaccuuucagaacucacau

SEQ ID NO: 1168481 - RNA, 20 nt, Homo sapiens
aguagucauacucccuggug

SEQ ID NO: 1168482 - RNA, 15 nt, Homo sapiens
aguagucuugaugac

SEQ ID NO: 1168483 - RNA, 15 nt, Homo sapiens
aguaguuuauuugaa

SEQ ID NO: 1168484 - RNA, 18 nt, Homo sapiens
aguauaaagggacuugaa

SEQ ID NO: 1168485 - RNA, 14 nt, Homo sapiens
aguauaaucuuuuc

SEQ ID NO: 1168486 - RNA, 14 nt, Homo sapiens
aguaucagcacuag

SEQ ID NO: 1168487 - RNA, 17 nt, Homo sapiens
aguaucauuacauauag

SEQ ID NO: 1168488 - RNA, 15 nt, Homo sapiens
aguauccaugcucuu

SEQ ID NO: 1168489 - RNA, 15 nt, Homo sapiens
aguauccucuugcca

SEQ ID NO: 1168490 - RNA, 11 nt, Homo sapiens
aguaucuauau

SEQ ID NO: 1168491 - RNA, 20 nt, Homo sapiens
aguauggcuccuccauaucu

SEQ ID NO: 1168492 - RNA, 12 nt, Homo sapiens
aguauuaacucu

SEQ ID NO: 1168493 - RNA, 21 nt, Homo sapiens
aguauuaagucaagaauauaa

SEQ ID NO: 1168494 - RNA, 14 nt, Homo sapiens
aguauuacugcugc

SEQ ID NO: 1168495 - RNA, 14 nt, Homo sapiens
aguauucaaucaag

SEQ ID NO: 1168496 - RNA, 18 nt, Homo sapiens
aguauugaauacuuacau

SEQ ID NO: 1168497 - RNA, 19 nt, Homo sapiens
aguauuuaggauaaccuug

SEQ ID NO: 1168498 - RNA, 21 nt, Homo sapiens
aguauuuaguuauaucacuug

SEQ ID NO: 1168499 - RNA, 16 nt, Homo sapiens
aguauuuauauuggau

SEQ ID NO: 1168500 - RNA, 22 nt, Homo sapiens
aguauuuauugcaggauggugu

SEQ ID NO: 1168501 - RNA, 23 nt, Homo sapiens
aguauuuauugcaggaugguguc

SEQ ID NO: 1168502 - RNA, 21 nt, Homo sapiens
aguauuuuagugaacuugaaa

SEQ ID NO: 1168503 - RNA, 20 nt, Homo sapiens
aguauuuucuacuagccauu

SEQ ID NO: 1168504 - RNA, 17 nt, Homo sapiens
agucaauaaacuuguag

SEQ ID NO: 1168505 - RNA, 14 nt, Homo sapiens
agucacagauucuu

SEQ ID NO: 1168506 - RNA, 13 nt, Homo sapiens
agucacagccacc

SEQ ID NO: 1168507 - RNA, 21 nt, Homo sapiens
agucacaggaugagacaggag

SEQ ID NO: 1168508 - RNA, 14 nt, Homo sapiens
agucacaucucuuc

SEQ ID NO: 1168509 - RNA, 22 nt, Homo sapiens
agucacauggccuaugcacaua

SEQ ID NO: 1168510 - RNA, 13 nt, Homo sapiens
agucaccaggaau

SEQ ID NO: 1168511 - RNA, 21 nt, Homo sapiens
agucaccaguggccuuacccc

SEQ ID NO: 1168512 - RNA, 14 nt, Homo sapiens
agucacccuuccac

SEQ ID NO: 1168513 - RNA, 15 nt, Homo sapiens
agucagaaguucugg

SEQ ID NO: 1168514 - RNA, 16 nt, Homo sapiens
agucagagaaaacacu

SEQ ID NO: 1168515 - RNA, 14 nt, Homo sapiens
agucagaggaggga

SEQ ID NO: 1168516 - RNA, 12 nt, Homo sapiens
agucagcuacaa

SEQ ID NO: 1168517 - RNA, 22 nt, Homo sapiens
uccugcccugcccccucggggg

SEQ ID NO: 1168518 - RNA, 19 nt, Homo sapiens
uccugccucagccuuccaa

SEQ ID NO: 1168519 - RNA, 21 nt, Homo sapiens
uccugccugcaguauuacaga

SEQ ID NO: 1168520 - RNA, 17 nt, Homo sapiens
uccugcuauuacuaagg

SEQ ID NO: 1168521 - RNA, 13 nt, Homo sapiens
uccugcucaggaa

SEQ ID NO: 1168522 - RNA, 18 nt, Homo sapiens
uccugcucaggaaaccac

SEQ ID NO: 1168523 - RNA, 16 nt, Homo sapiens
uccugcuuauucauaa

SEQ ID NO: 1168524 - RNA, 21 nt, Homo sapiens
uccuggagcuauucacagugc

SEQ ID NO: 1168525 - RNA, 18 nt, Homo sapiens
uccuggcccaggugaguc

SEQ ID NO: 1168526 - RNA, 14 nt, Homo sapiens
uccugggagcucau

SEQ ID NO: 1168527 - RNA, 15 nt, Homo sapiens
uccugggaucacuga

SEQ ID NO: 1168528 - RNA, 23 nt, Homo sapiens
uccugggccucagcaagccaugc

SEQ ID NO: 1168529 - RNA, 14 nt, Homo sapiens
uccugggucuacca

SEQ ID NO: 1168530 - RNA, 18 nt, Homo sapiens
uccugggucuaccacuca

SEQ ID NO: 1168531 - RNA, 13 nt, Homo sapiens
uccuggugucacc

SEQ ID NO: 1168532 - RNA, 18 nt, Homo sapiens
uccuggugucaccccaga

SEQ ID NO: 1168533 - RNA, 17 nt, Homo sapiens
uccugugaacacuggag

SEQ ID NO: 1168534 - RNA, 17 nt, Homo sapiens
uccuguuacuugcuucu

SEQ ID NO: 1168535 - RNA, 23 nt, Homo sapiens
uccuguugccuuuauauccaaaa

SEQ ID NO: 1168536 - RNA, 17 nt, Homo sapiens
uccuguuuucuaaaaaa

SEQ ID NO: 1168537 - RNA, 22 nt, Homo sapiens
uccuuacauuaaaaagccuuac

SEQ ID NO: 1168538 - RNA, 23 nt, Homo sapiens
uccuuaugacuuuucaugcagca

SEQ ID NO: 1168539 - RNA, 18 nt, Homo sapiens
uccuuaugguacacucca

SEQ ID NO: 1168540 - RNA, 14 nt, Homo sapiens
uccuuauugcauug

SEQ ID NO: 1168541 - RNA, 22 nt, Homo sapiens
uccuucaauuaaaaaaaggggg

SEQ ID NO: 1168542 - RNA, 14 nt, Homo sapiens
uccuucaccaccuc

SEQ ID NO: 1168543 - RNA, 13 nt, Homo sapiens
uccuucagugcau

SEQ ID NO: 1168544 - RNA, 18 nt, Homo sapiens
uccuucaugaucaucaca

SEQ ID NO: 1168545 - RNA, 20 nt, Homo sapiens
uccuucccaagguacagcug

SEQ ID NO: 1168546 - RNA, 20 nt, Homo sapiens
uccuuccuuaucacugacac

SEQ ID NO: 1168547 - RNA, 14 nt, Homo sapiens
uccuuccuucccug

SEQ ID NO: 1168548 - RNA, 17 nt, Homo sapiens
uccuucuccaccccagc

SEQ ID NO: 1168549 - RNA, 18 nt, Homo sapiens
uccuucuggugucugcuu

SEQ ID NO: 1168550 - RNA, 13 nt, Homo sapiens
uccuugauucaca

SEQ ID NO: 1168551 - RNA, 16 nt, Homo sapiens
uccuugcacauaguag

SEQ ID NO: 1168552 - RNA, 14 nt, Homo sapiens
uccuugccagugag

SEQ ID NO: 1168553 - RNA, 16 nt, Homo sapiens
uccuugcuuguuacau

SEQ ID NO: 1168554 - RNA, 23 nt, Homo sapiens
uccuugcuuuuauguuuguacac

SEQ ID NO: 1168555 - RNA, 19 nt, Homo sapiens
uccuuggaacacauaagaa

SEQ ID NO: 1168556 - RNA, 22 nt, Homo sapiens
uccuugggaggccccacugggg

SEQ ID NO: 1168557 - RNA, 18 nt, Homo sapiens
uccuuuaaagugaguacu

SEQ ID NO: 1168558 - RNA, 22 nt, Homo sapiens
uccuuuaaagugaguacuguua

SEQ ID NO: 1168559 - RNA, 22 nt, Homo sapiens
uccuuuacuaauccaacccaug

SEQ ID NO: 1168560 - RNA, 18 nt, Homo sapiens
uccuuuaguaccugaaaa

SEQ ID NO: 1168561 - RNA, 16 nt, Homo sapiens
uccuuuauacugugaa

SEQ ID NO: 1168562 - RNA, 22 nt, Homo sapiens
uccuuucagaaaauucccauga

SEQ ID NO: 1168563 - RNA, 22 nt, Homo sapiens
uccuuugaccacugucuuuuuc

SEQ ID NO: 1168564 - RNA, 16 nt, Homo sapiens
uccuuugccugauccu

SEQ ID NO: 1168565 - RNA, 22 nt, Homo sapiens
uccuuuggaacaagacagccuu

SEQ ID NO: 1168566 - RNA, 16 nt, Homo sapiens
uccuuuuaagcaguga

SEQ ID NO: 1168567 - RNA, 17 nt, Homo sapiens
uccuuuuaagcagugag

SEQ ID NO: 1168568 - RNA, 16 nt, Homo sapiens
uccuuuuacuacagcu

SEQ ID NO: 1168569 - RNA, 17 nt, Homo sapiens
uccuuuuucuucacuua

SEQ ID NO: 1168570 - RNA, 19 nt, Homo sapiens
uccuuuuuuaaaaaugcaa

SEQ ID NO: 1168571 - RNA, 13 nt, Homo sapiens
ucgaacacauuca

SEQ ID NO: 1168572 - RNA, 23 nt, Homo sapiens
ucgaauacaaaucaaagauuugu

SEQ ID NO: 1168573 - RNA, 22 nt, Homo sapiens
ucgaccacgggaagcaucuucc

SEQ ID NO: 1168574 - RNA, 19 nt, Homo sapiens
ucgacuuccccggccacaa

SEQ ID NO: 1168575 - RNA, 19 nt, Homo sapiens
ucgagacuuggguguuugu

SEQ ID NO: 1168576 - RNA, 15 nt, Homo sapiens
ucgagagcuggccaa

SEQ ID NO: 1168577 - RNA, 22 nt, Homo sapiens
ucgaggcugcagucagcccuga

SEQ ID NO: 1168578 - RNA, 12 nt, Homo sapiens
ucgauuagacug

SEQ ID NO: 1168579 - RNA, 20 nt, Homo sapiens
ucgauuagacuggacagcuu

SEQ ID NO: 1168580 - RNA, 16 nt, Homo sapiens
ucgcaaccuugaggaa

SEQ ID NO: 1168581 - RNA, 19 nt, Homo sapiens
ucgcaaugagggagcaugu

SEQ ID NO: 1168582 - RNA, 19 nt, Homo sapiens
ucgcaccacugcacuccag

SEQ ID NO: 1168583 - RNA, 21 nt, Homo sapiens
ucgcaccacugcacuccagcc

SEQ ID NO: 1168584 - RNA, 22 nt, Homo sapiens
ucgcagagaguguaucaucugu

SEQ ID NO: 1168585 - RNA, 15 nt, Homo sapiens
ucgcaggaccaaggg

SEQ ID NO: 1168586 - RNA, 15 nt, Homo sapiens
ucgcaucauugcaga

SEQ ID NO: 1168587 - RNA, 16 nt, Homo sapiens
ucgccacugcacucca

SEQ ID NO: 1168588 - RNA, 21 nt, Homo sapiens
ucgcccugcgguagaugggag

SEQ ID NO: 1168589 - RNA, 12 nt, Homo sapiens
ucgccucuggau

SEQ ID NO: 1168590 - RNA, 19 nt, Homo sapiens
ucgcucccauauuuauccc

SEQ ID NO: 1168591 - RNA, 18 nt, Homo sapiens
ucgcucccgggacucacu

SEQ ID NO: 1168592 - RNA, 13 nt, Homo sapiens
ucgcucuuuucaa

SEQ ID NO: 1168593 - RNA, 17 nt, Homo sapiens
ucgcuugcuagaaguag

SEQ ID NO: 1168594 - RNA, 15 nt, Homo sapiens
ucggauacuugccaa

SEQ ID NO: 1168595 - RNA, 13 nt, Homo sapiens
ucggcucacugca

SEQ ID NO: 1168596 - RNA, 19 nt, Homo sapiens
ucgggacuugaaaaccacu

SEQ ID NO: 1168597 - RNA, 17 nt, Homo sapiens
ucgggcagggccccuga

SEQ ID NO: 1168598 - RNA, 15 nt, Homo sapiens
ucggggaagccagac

SEQ ID NO: 1168599 - RNA, 18 nt, Homo sapiens
ucguagccuaaaagacaa

SEQ ID NO: 1168600 - RNA, 18 nt, Homo sapiens
ucguauaaauaucuauua

SEQ ID NO: 1168601 - RNA, 14 nt, Homo sapiens
ucguccacugucaa

SEQ ID NO: 1168602 - RNA, 19 nt, Homo sapiens
ucgugccacugcacuccag

SEQ ID NO: 1168603 - RNA, 18 nt, Homo sapiens
ucuaaaaaaaaaaacugu

SEQ ID NO: 1168604 - RNA, 14 nt, Homo sapiens
ucuaaaaugaaaua

SEQ ID NO: 1168605 - RNA, 21 nt, Homo sapiens
ucuaaacagacucauuacaaa

SEQ ID NO: 1168606 - RNA, 21 nt, Homo sapiens
ucuaaaccucaggccacaucu

SEQ ID NO: 1168607 - RNA, 12 nt, Homo sapiens
ucuaaagaccau

SEQ ID NO: 1168608 - RNA, 20 nt, Homo sapiens
ucuaaagauggaaaaaccac

SEQ ID NO: 1168609 - RNA, 22 nt, Homo sapiens
ucuaaagauggaaaaaccaccc

SEQ ID NO: 1168610 - RNA, 20 nt, Homo sapiens
ucuaaagguggugaggcaau

SEQ ID NO: 1168611 - RNA, 12 nt, Homo sapiens
ucuaaaugaagu

SEQ ID NO: 1168612 - RNA, 17 nt, Homo sapiens
ucuaaaugaagugcaaa

SEQ ID NO: 1168613 - RNA, 17 nt, Homo sapiens
ucuaacaaaacaaguug

SEQ ID NO: 1168614 - RNA, 20 nt, Homo sapiens
ucuaaccugauuuaccucuu

SEQ ID NO: 1168615 - RNA, 15 nt, Homo sapiens
ucuaacuuaagaaau

SEQ ID NO: 1168616 - RNA, 20 nt, Homo sapiens
ucuaagacuacuaugaacag

SEQ ID NO: 1168617 - RNA, 17 nt, Homo sapiens
ucuaagagagcugccau

SEQ ID NO: 1168618 - RNA, 14 nt, Homo sapiens
ucuaagauucuaau

SEQ ID NO: 1168619 - RNA, 19 nt, Homo sapiens
ucuaagcugugguguguuc

SEQ ID NO: 1168620 - RNA, 12 nt, Homo sapiens
ucuaagucacag

SEQ ID NO: 1168621 - RNA, 14 nt, Homo sapiens
ucuaagucuuucca

SEQ ID NO: 1168622 - RNA, 14 nt, Homo sapiens
ucuaauauggccac

SEQ ID NO: 1168623 - RNA, 14 nt, Homo sapiens
ucuaaugugucucu

SEQ ID NO: 1168624 - RNA, 14 nt, Homo sapiens
ucuaauuucugaaa

SEQ ID NO: 1168625 - RNA, 22 nt, Homo sapiens
ucuacaaaaugggccucaugga

SEQ ID NO: 1168626 - RNA, 22 nt, Homo sapiens
ucuacaaauggugaaauuuaau

SEQ ID NO: 1168627 - RNA, 19 nt, Homo sapiens
ucuacacauacauguaaaa

SEQ ID NO: 1168628 - RNA, 21 nt, Homo sapiens
ucuacauuaaaucacuugaau

SEQ ID NO: 1168629 - RNA, 18 nt, Homo sapiens
ucuaccagauaacugagg

SEQ ID NO: 1168630 - RNA, 17 nt, Homo sapiens
ucuaccaggcaaauuca

SEQ ID NO: 1168631 - RNA, 20 nt, Homo sapiens
ucuacccaguagaugccacu

SEQ ID NO: 1168632 - RNA, 20 nt, Homo sapiens
ucuaccucucagcugcugaa

SEQ ID NO: 1168633 - RNA, 17 nt, Homo sapiens
ucuaccuucaagaacca

SEQ ID NO: 1168634 - RNA, 17 nt, Homo sapiens
ucuacuaaaaaugaaaa

SEQ ID NO: 1168635 - RNA, 21 nt, Homo sapiens
ucuacuacaaacuucaaagag

SEQ ID NO: 1168636 - RNA, 14 nt, Homo sapiens
ucuacuguggcaaa

SEQ ID NO: 1168637 - RNA, 17 nt, Homo sapiens
ucuacuuugauucugau

SEQ ID NO: 1168638 - RNA, 19 nt, Homo sapiens
ucuagacuauuaggugcaa

SEQ ID NO: 1168639 - RNA, 19 nt, Homo sapiens
ucuagagggagaagacugu

SEQ ID NO: 1168640 - RNA, 21 nt, Homo sapiens
ucuagagggagaagacugugc

SEQ ID NO: 1168641 - RNA, 18 nt, Homo sapiens
ucuagaguucagaguccu

SEQ ID NO: 1168642 - RNA, 12 nt, Homo sapiens
ucuagauucaaa

SEQ ID NO: 1168643 - RNA, 16 nt, Homo sapiens
ucuagguaauuugcca

SEQ ID NO: 1168644 - RNA, 14 nt, Homo sapiens
ucuaggugcccuug

SEQ ID NO: 1168645 - RNA, 14 nt, Homo sapiens
ucuaguaugucuug

SEQ ID NO: 1168646 - RNA, 15 nt, Homo sapiens
ucuauaacaguuuug

SEQ ID NO: 1168647 - RNA, 14 nt, Homo sapiens
ucuauaaggccaua

SEQ ID NO: 1168648 - RNA, 19 nt, Homo sapiens
ucuauagcugcuauagcaa

SEQ ID NO: 1168649 - RNA, 15 nt, Homo sapiens
ucuauccacacuguc

SEQ ID NO: 1168650 - RNA, 21 nt, Homo sapiens
ucuaucggggucacuugcaau

SEQ ID NO: 1168651 - RNA, 18 nt, Homo sapiens
uccaugggaccacaacua

SEQ ID NO: 1168652 - RNA, 20 nt, Homo sapiens
uccaugggccauaugaaaag

SEQ ID NO: 1168653 - RNA, 20 nt, Homo sapiens
uccaugguccugucuguccu

SEQ ID NO: 1168654 - RNA, 21 nt, Homo sapiens
uccauguagaauaaaugaaga

SEQ ID NO: 1168655 - RNA, 21 nt, Homo sapiens
uccaugugcuagucacuggca

SEQ ID NO: 1168656 - RNA, 15 nt, Homo sapiens
uccauuagaaugcua

SEQ ID NO: 1168657 - RNA, 13 nt, Homo sapiens
uccauuaucuaua

SEQ ID NO: 1168658 - RNA, 19 nt, Homo sapiens
uccauuauuugaguuugac

SEQ ID NO: 1168659 - RNA, 14 nt, Homo sapiens
uccauucagcauca

SEQ ID NO: 1168660 - RNA, 14 nt, Homo sapiens
uccauucuucccuu

SEQ ID NO: 1168661 - RNA, 15 nt, Homo sapiens
uccauuguguucucu

SEQ ID NO: 1168662 - RNA, 15 nt, Homo sapiens
uccauuuacaaacua

SEQ ID NO: 1168663 - RNA, 18 nt, Homo sapiens
uccauuuacagcccucag

SEQ ID NO: 1168664 - RNA, 15 nt, Homo sapiens
uccauuuuauuacua

SEQ ID NO: 1168665 - RNA, 17 nt, Homo sapiens
ucccaaacugugaugaa

SEQ ID NO: 1168666 - RNA, 19 nt, Homo sapiens
ucccaaagugcugagauua

SEQ ID NO: 1168667 - RNA, 16 nt, Homo sapiens
ucccaaaucaauaaga

SEQ ID NO: 1168668 - RNA, 21 nt, Homo sapiens
ucccaaauccgccaguguuuc

SEQ ID NO: 1168669 - RNA, 16 nt, Homo sapiens
ucccaaauuugauuga

SEQ ID NO: 1168670 - RNA, 14 nt, Homo sapiens
ucccaacguuuuac

SEQ ID NO: 1168671 - RNA, 13 nt, Homo sapiens
ucccaacucccuu

SEQ ID NO: 1168672 - RNA, 18 nt, Homo sapiens
ucccaagcucccaagagc

SEQ ID NO: 1168673 - RNA, 13 nt, Homo sapiens
ucccaauacaaaa

SEQ ID NO: 1168674 - RNA, 14 nt, Homo sapiens
ucccaauacaggca

SEQ ID NO: 1168675 - RNA, 17 nt, Homo sapiens
ucccaauguugucauuu

SEQ ID NO: 1168676 - RNA, 22 nt, Homo sapiens
ucccaauuucagacucccauuc

SEQ ID NO: 1168677 - RNA, 17 nt, Homo sapiens
ucccacaauauuaccuu

SEQ ID NO: 1168678 - RNA, 17 nt, Homo sapiens
ucccacacgcacugcac

SEQ ID NO: 1168679 - RNA, 21 nt, Homo sapiens
ucccacagcgcuggccgggac

SEQ ID NO: 1168680 - RNA, 16 nt, Homo sapiens
ucccacccacauguga

SEQ ID NO: 1168681 - RNA, 21 nt, Homo sapiens
ucccaccuagugccccagacu

SEQ ID NO: 1168682 - RNA, 16 nt, Homo sapiens
ucccacgggaccuggg

SEQ ID NO: 1168683 - RNA, 20 nt, Homo sapiens
ucccacgggaccuggggcuu

SEQ ID NO: 1168684 - RNA, 11 nt, Homo sapiens
ucccacuauau

SEQ ID NO: 1168685 - RNA, 20 nt, Homo sapiens
ucccacucccggccugucau

SEQ ID NO: 1168686 - RNA, 21 nt, Homo sapiens
ucccacugcccccuccacugg

SEQ ID NO: 1168687 - RNA, 22 nt, Homo sapiens
ucccacuuggaggccuuucauc

SEQ ID NO: 1168688 - RNA, 21 nt, Homo sapiens
ucccagaaacuccagacuugu

SEQ ID NO: 1168689 - RNA, 18 nt, Homo sapiens
ucccagaacacacuccau

SEQ ID NO: 1168690 - RNA, 13 nt, Homo sapiens
ucccagacacugg

SEQ ID NO: 1168691 - RNA, 22 nt, Homo sapiens
ucccagcacuuugggagaccaa

SEQ ID NO: 1168692 - RNA, 18 nt, Homo sapiens
ucccagccacagcauuua

SEQ ID NO: 1168693 - RNA, 18 nt, Homo sapiens
ucccagcuacaccuuucu

SEQ ID NO: 1168694 - RNA, 17 nt, Homo sapiens
ucccagcuacucaggag

SEQ ID NO: 1168695 - RNA, 23 nt, Homo sapiens
ucccaguaguguuuggaauuuuc

SEQ ID NO: 1168696 - RNA, 13 nt, Homo sapiens
ucccagugaaaua

SEQ ID NO: 1168697 - RNA, 19 nt, Homo sapiens
ucccagugacaaccaaaag

SEQ ID NO: 1168698 - RNA, 15 nt, Homo sapiens
ucccaucccacugcu

SEQ ID NO: 1168699 - RNA, 19 nt, Homo sapiens
ucccaucuggaccugguac

SEQ ID NO: 1168700 - RNA, 19 nt, Homo sapiens
ucccaugagcuuaggcauu

SEQ ID NO: 1168701 - RNA, 23 nt, Homo sapiens
ucccaugcuuuguaggugucuca

SEQ ID NO: 1168702 - RNA, 15 nt, Homo sapiens
ucccauggaaccacu

SEQ ID NO: 1168703 - RNA, 15 nt, Homo sapiens
ucccaugugauuuaa

SEQ ID NO: 1168704 - RNA, 18 nt, Homo sapiens
ucccauuuguugcugcug

SEQ ID NO: 1168705 - RNA, 15 nt, Homo sapiens
uccccaacaauguga

SEQ ID NO: 1168706 - RNA, 24 nt, Homo sapiens
uccccaacagugugaaguuagaau

SEQ ID NO: 1168707 - RNA, 22 nt, Homo sapiens
uccccaagugcggggaguacaa

SEQ ID NO: 1168708 - RNA, 22 nt, Homo sapiens
uccccaaugagacuugccuucc

SEQ ID NO: 1168709 - RNA, 18 nt, Homo sapiens
uccccacuucugugccac

SEQ ID NO: 1168710 - RNA, 20 nt, Homo sapiens
uccccagaccucagggacaa

SEQ ID NO: 1168711 - RNA, 21 nt, Homo sapiens
uccccagcagggucuuuucau

SEQ ID NO: 1168712 - RNA, 21 nt, Homo sapiens
uccccagcccagagacauacu

SEQ ID NO: 1168713 - RNA, 13 nt, Homo sapiens
uccccagugauuu

SEQ ID NO: 1168714 - RNA, 18 nt, Homo sapiens
uccccauauuuguguuca

SEQ ID NO: 1168715 - RNA, 14 nt, Homo sapiens
uauaccauuuccuc

SEQ ID NO: 1168716 - RNA, 21 nt, Homo sapiens
uauaccgugccacuuuccacc

SEQ ID NO: 1168717 - RNA, 23 nt, Homo sapiens
uauacggaaacaaaaaugauccu

SEQ ID NO: 1168718 - RNA, 15 nt, Homo sapiens
uauacucuucaagga

SEQ ID NO: 1168719 - RNA, 21 nt, Homo sapiens
uauacugacaaaccagagaaa

SEQ ID NO: 1168720 - RNA, 20 nt, Homo sapiens
uauacugccaaagaauguga

SEQ ID NO: 1168721 - RNA, 15 nt, Homo sapiens
uauacuguuauccau

SEQ ID NO: 1168722 - RNA, 14 nt, Homo sapiens
uauacuguuuacug

SEQ ID NO: 1168723 - RNA, 15 nt, Homo sapiens
uauacuuuaucaaag

SEQ ID NO: 1168724 - RNA, 23 nt, Homo sapiens
uauacuuugccuuuccauaauca

SEQ ID NO: 1168725 - RNA, 14 nt, Homo sapiens
uauagaaaaaccaa

SEQ ID NO: 1168726 - RNA, 16 nt, Homo sapiens
uauagaauuagcuuuu

SEQ ID NO: 1168727 - RNA, 16 nt, Homo sapiens
uauagcaagaucccau

SEQ ID NO: 1168728 - RNA, 19 nt, Homo sapiens
uauaggggaaaaaacucgg

SEQ ID NO: 1168729 - RNA, 13 nt, Homo sapiens
uauagguguuugc

SEQ ID NO: 1168730 - RNA, 22 nt, Homo sapiens
uauagucgaacaauucauauau

SEQ ID NO: 1168731 - RNA, 23 nt, Homo sapiens
uauaguuguuuuauauguugcua

SEQ ID NO: 1168732 - RNA, 16 nt, Homo sapiens
uauaguuucugaggcu

SEQ ID NO: 1168733 - RNA, 21 nt, Homo sapiens
uauauaaaugugauugcagcu

SEQ ID NO: 1168734 - RNA, 12 nt, Homo sapiens
uauauaaucuau

SEQ ID NO: 1168735 - RNA, 20 nt, Homo sapiens
uauauacaguaacuuuaugu

SEQ ID NO: 1168736 - RNA, 12 nt, Homo sapiens
uauauacauaua

SEQ ID NO: 1168737 - RNA, 22 nt, Homo sapiens
uauauagcucuacacaacaugu

SEQ ID NO: 1168738 - RNA, 17 nt, Homo sapiens
uauauaggugugugaga

SEQ ID NO: 1168739 - RNA, 13 nt, Homo sapiens
uauauaguccugu

SEQ ID NO: 1168740 - RNA, 19 nt, Homo sapiens
uauauaugauuguuugcac

SEQ ID NO: 1168741 - RNA, 18 nt, Homo sapiens
uauaucaaaugagcaucu

SEQ ID NO: 1168742 - RNA, 18 nt, Homo sapiens
uauaucacuucacuguuc

SEQ ID NO: 1168743 - RNA, 19 nt, Homo sapiens
uauaucaguccucuuucaa

SEQ ID NO: 1168744 - RNA, 22 nt, Homo sapiens
uauauccgccuggcauuucaca

SEQ ID NO: 1168745 - RNA, 15 nt, Homo sapiens
uauauggccucaaga

SEQ ID NO: 1168746 - RNA, 21 nt, Homo sapiens
uauauguguguggcgugugua

SEQ ID NO: 1168747 - RNA, 15 nt, Homo sapiens
uauauuaaaauacca

SEQ ID NO: 1168748 - RNA, 14 nt, Homo sapiens
uauauuacaugguu

SEQ ID NO: 1168749 - RNA, 15 nt, Homo sapiens
uauauucaacucaua

SEQ ID NO: 1168750 - RNA, 14 nt, Homo sapiens
uagcacugccagga

SEQ ID NO: 1168751 - RNA, 23 nt, Homo sapiens
uagcagaaaccaagucuacuuca

SEQ ID NO: 1168752 - RNA, 14 nt, Homo sapiens
uagcagacaggccc

SEQ ID NO: 1168753 - RNA, 22 nt, Homo sapiens
uagcagagacuuuagucuuugg

SEQ ID NO: 1168754 - RNA, 16 nt, Homo sapiens
uagcagaugguuucca

SEQ ID NO: 1168755 - RNA, 13 nt, Homo sapiens
uagcagcugcuac

SEQ ID NO: 1168756 - RNA, 20 nt, Homo sapiens
uagcaggauaugacaacucu

SEQ ID NO: 1168757 - RNA, 21 nt, Homo sapiens
uagcaguccccagugauuugc

SEQ ID NO: 1168758 - RNA, 18 nt, Homo sapiens
uagcauacgguaugauau

SEQ ID NO: 1168759 - RNA, 13 nt, Homo sapiens
uagcaugaggcca

SEQ ID NO: 1168760 - RNA, 14 nt, Homo sapiens
uagcaugcugugau

SEQ ID NO: 1168761 - RNA, 17 nt, Homo sapiens
uagcauuuugcuaucuu

SEQ ID NO: 1168762 - RNA, 13 nt, Homo sapiens
uagccaaccugcu

SEQ ID NO: 1168763 - RNA, 15 nt, Homo sapiens
uagccacaagccuga

SEQ ID NO: 1168764 - RNA, 17 nt, Homo sapiens
uagccaucaagcacuuc

SEQ ID NO: 1168765 - RNA, 16 nt, Homo sapiens
uagcccuggaccugcc

SEQ ID NO: 1168766 - RNA, 22 nt, Homo sapiens
uagccgacugcgcugcuuuuuc

SEQ ID NO: 1168767 - RNA, 22 nt, Homo sapiens
uagccuaaaagacaauuuuccu

SEQ ID NO: 1168768 - RNA, 22 nt, Homo sapiens
uagccucgccgucugugaauug

SEQ ID NO: 1168769 - RNA, 16 nt, Homo sapiens
uagccugggguggggu

SEQ ID NO: 1168770 - RNA, 23 nt, Homo sapiens
uagccuggugggaaaaugcacac

SEQ ID NO: 1168771 - RNA, 21 nt, Homo sapiens
uagccuguggccuuugcaauu

SEQ ID NO: 1168772 - RNA, 18 nt, Homo sapiens
uagcgagaagaugcucug

SEQ ID NO: 1168773 - RNA, 14 nt, Homo sapiens
uagcgauauuuauc

SEQ ID NO: 1168774 - RNA, 12 nt, Homo sapiens
uagcuaggauuu

SEQ ID NO: 1168775 - RNA, 20 nt, Homo sapiens
uagcucuaggguauauaucc

SEQ ID NO: 1168776 - RNA, 15 nt, Homo sapiens
uagcugggcuuacag

SEQ ID NO: 1168777 - RNA, 14 nt, Homo sapiens
uagcugucucucaa

SEQ ID NO: 1168778 - RNA, 19 nt, Homo sapiens
uagcuuaagggaauaugca

SEQ ID NO: 1168779 - RNA, 13 nt, Homo sapiens
uacaaauggacau

SEQ ID NO: 1168780 - RNA, 14 nt, Homo sapiens
uacaaauugugaug

SEQ ID NO: 1168781 - RNA, 21 nt, Homo sapiens
uacaaauuuucacugcugcuc

SEQ ID NO: 1168782 - RNA, 20 nt, Homo sapiens
uacaacuggaagauacauaa

SEQ ID NO: 1168783 - RNA, 17 nt, Homo sapiens
uacaacuucaagugcau

SEQ ID NO: 1168784 - RNA, 15 nt, Homo sapiens
uacaagacugcugag

SEQ ID NO: 1168785 - RNA, 22 nt, Homo sapiens
uacaagaguuucaaaacauaca

SEQ ID NO: 1168786 - RNA, 19 nt, Homo sapiens
uacaagcuacaguugucca

SEQ ID NO: 1168787 - RNA, 14 nt, Homo sapiens
uacaaggugugugu

SEQ ID NO: 1168788 - RNA, 15 nt, Homo sapiens
uacaagguuguucau

SEQ ID NO: 1168789 - RNA, 19 nt, Homo sapiens
uacaaguuaagguaucugg

SEQ ID NO: 1168790 - RNA, 15 nt, Homo sapiens
uacaauacaucugag

SEQ ID NO: 1168791 - RNA, 21 nt, Homo sapiens
uacaaugcacauuuacuguuu

SEQ ID NO: 1168792 - RNA, 11 nt, Homo sapiens
uacaaugggaa

SEQ ID NO: 1168793 - RNA, 22 nt, Homo sapiens
uacaauuauuuuuacaguucuc

SEQ ID NO: 1168794 - RNA, 17 nt, Homo sapiens
uacaauucaggcuuugg

SEQ ID NO: 1168795 - RNA, 19 nt, Homo sapiens
uacaauucauuguuuugca

SEQ ID NO: 1168796 - RNA, 14 nt, Homo sapiens
uacacaacauguau

SEQ ID NO: 1168797 - RNA, 19 nt, Homo sapiens
uacacagaaacacugccuu

SEQ ID NO: 1168798 - RNA, 15 nt, Homo sapiens
uacacauacauguaa

SEQ ID NO: 1168799 - RNA, 15 nt, Homo sapiens
uacacgugacagagu

SEQ ID NO: 1168800 - RNA, 19 nt, Homo sapiens
uacacuaaaaaucugagaa

SEQ ID NO: 1168801 - RNA, 23 nt, Homo sapiens
uacacucuugacuagugcaauuu

SEQ ID NO: 1168802 - RNA, 12 nt, Homo sapiens
uacacuugcauc

SEQ ID NO: 1168803 - RNA, 15 nt, Homo sapiens
uacagaaacugaugc

SEQ ID NO: 1168804 - RNA, 19 nt, Homo sapiens
uacagaaagaaaaaugcau

SEQ ID NO: 1168805 - RNA, 19 nt, Homo sapiens
uacagaaaguggugcucag

SEQ ID NO: 1168806 - RNA, 23 nt, Homo sapiens
uacagaaguccccucuacuuuaa

SEQ ID NO: 1168807 - RNA, 20 nt, Homo sapiens
uacagaaucaaaugcaauuu

SEQ ID NO: 1168808 - RNA, 13 nt, Homo sapiens
uacagacagacau

SEQ ID NO: 1168809 - RNA, 14 nt, Homo sapiens
uacagcacacacuu

SEQ ID NO: 1168810 - RNA, 16 nt, Homo sapiens
uacagcaguagacauu

SEQ ID NO: 1168811 - RNA, 23 nt, Homo sapiens
uacagcccagaggccaacacugu

SEQ ID NO: 1168812 - RNA, 16 nt, Homo sapiens
uacagcccucagcaau

SEQ ID NO: 1168813 - RNA, 21 nt, Homo sapiens
uacaggcaugaaccacugcac

SEQ ID NO: 1168814 - RNA, 23 nt, Homo sapiens
uacaggggggucggaagccuguc

SEQ ID NO: 1168815 - RNA, 18 nt, Homo sapiens
uacaggugugcaccacca

SEQ ID NO: 1168816 - RNA, 18 nt, Homo sapiens
uacaggugugugccacca

SEQ ID NO: 1168817 - RNA, 15 nt, Homo sapiens
uacaguaaacggugu

SEQ ID NO: 1168818 - RNA, 22 nt, Homo sapiens
uacaguaggagcccagcucuga

SEQ ID NO: 1168819 - RNA, 16 nt, Homo sapiens
uacaguauacauauau

SEQ ID NO: 1168820 - RNA, 22 nt, Homo sapiens
uacagugaugcugugcuaugaa

SEQ ID NO: 1168821 - RNA, 17 nt, Homo sapiens
uacagugccacugcaau

SEQ ID NO: 1168822 - RNA, 15 nt, Homo sapiens
uacauaaaacaaaag

SEQ ID NO: 1168823 - RNA, 13 nt, Homo sapiens
uacauaaucuuua

SEQ ID NO: 1168824 - RNA, 15 nt, Homo sapiens
uacauaauugauuaa

SEQ ID NO: 1168825 - RNA, 15 nt, Homo sapiens
uacauacaccagcau

SEQ ID NO: 1168826 - RNA, 20 nt, Homo sapiens
uacauacagagauuguagua

SEQ ID NO: 1168827 - RNA, 21 nt, Homo sapiens
uacauagaaagccaugugcua

SEQ ID NO: 1168828 - RNA, 23 nt, Homo sapiens
uacauauagcugauaaagccuaa

SEQ ID NO: 1168829 - RNA, 15 nt, Homo sapiens
uacauaugugaauau

SEQ ID NO: 1168830 - RNA, 13 nt, Homo sapiens
uacaucaaagagu

SEQ ID NO: 1168831 - RNA, 19 nt, Homo sapiens
uacaucacucucaccuucc

SEQ ID NO: 1168832 - RNA, 22 nt, Homo sapiens
uacauccaaagcagacagcucc

SEQ ID NO: 1168833 - RNA, 22 nt, Homo sapiens
uacaucgaggcucuugcucaag

SEQ ID NO: 1168834 - RNA, 21 nt, Homo sapiens
uacaucugagguccugugauc

SEQ ID NO: 1168835 - RNA, 23 nt, Homo sapiens
uacaucugcaauaugaauucaag

SEQ ID NO: 1168836 - RNA, 21 nt, Homo sapiens
uacaucuuaaaucuuuucaau

SEQ ID NO: 1168837 - RNA, 12 nt, Homo sapiens
uacaucuuucac

SEQ ID NO: 1168838 - RNA, 21 nt, Homo sapiens
uacaugagaaggaacuuccag

SEQ ID NO: 1168839 - RNA, 23 nt, Homo sapiens
uacaugaugcuaaaggcugcgaa

SEQ ID NO: 1168840 - RNA, 21 nt, Homo sapiens
uacaugcauugagcucucuca

SEQ ID NO: 1168841 - RNA, 19 nt, Homo sapiens
uacaugggccucugaugga

SEQ ID NO: 1168842 - RNA, 15 nt, Homo sapiens
uacauguacagacaa

SEQ ID NO: 1168843 - RNA, 13 nt, Homo sapiens
uacauguguuuga

SEQ ID NO: 1168844 - RNA, 19 nt, Homo sapiens
uacauuaaaucacuugaau

SEQ ID NO: 1168845 - RNA, 17 nt, Homo sapiens
uacauuauguugcuuaa

SEQ ID NO: 1168846 - RNA, 21 nt, Homo sapiens
uacauuccaacucguauagca

SEQ ID NO: 1168847 - RNA, 18 nt, Homo sapiens
uacauucuuccugauuau

SEQ ID NO: 1168848 - RNA, 17 nt, Homo sapiens
uacauuuagucuuccuu

SEQ ID NO: 1168849 - RNA, 18 nt, Homo sapiens
uacauuuguuuguauuca

SEQ ID NO: 1168850 - RNA, 19 nt, Homo sapiens
uaccaagcauguuucacau

SEQ ID NO: 1168851 - RNA, 14 nt, Homo sapiens
uaccagcuuucuau

SEQ ID NO: 1168852 - RNA, 21 nt, Homo sapiens
uaccaguauaauugaguuuuc

SEQ ID NO: 1168853 - RNA, 13 nt, Homo sapiens
uaccagugaauuu

SEQ ID NO: 1168854 - RNA, 14 nt, Homo sapiens
uaccauacacgcaa

SEQ ID NO: 1168855 - RNA, 20 nt, Homo sapiens
uaccauaugccccauuccca

SEQ ID NO: 1168856 - RNA, 18 nt, Homo sapiens
uaccaugcaggauuugaa

SEQ ID NO: 1168857 - RNA, 12 nt, Homo sapiens
uaccaugcugaa

SEQ ID NO: 1168858 - RNA, 19 nt, Homo sapiens
uaccaugugaaacucuacc

SEQ ID NO: 1168859 - RNA, 23 nt, Homo sapiens
uaccauuuuuuaaggaaacaaua

SEQ ID NO: 1168860 - RNA, 17 nt, Homo sapiens
uacccaaggcucuucuc

SEQ ID NO: 1168861 - RNA, 14 nt, Homo sapiens
uacccacugccaug

SEQ ID NO: 1168862 - RNA, 19 nt, Homo sapiens
uacccacuuaggcuuugua

SEQ ID NO: 1168863 - RNA, 20 nt, Homo sapiens
uacccaggcuggagugcagu

SEQ ID NO: 1168864 - RNA, 17 nt, Homo sapiens
uacccccugugccuugu

SEQ ID NO: 1168865 - RNA, 14 nt, Homo sapiens
uacccugaaguguu

SEQ ID NO: 1168866 - RNA, 23 nt, Homo sapiens
uacccugcgcccaguccuuccac

SEQ ID NO: 1168867 - RNA, 16 nt, Homo sapiens
uacccuugagcugugu

SEQ ID NO: 1168868 - RNA, 17 nt, Homo sapiens
uaccguguugguuuuga

SEQ ID NO: 1168869 - RNA, 19 nt, Homo sapiens
uaccuaccaagauauaccu

SEQ ID NO: 1168870 - RNA, 13 nt, Homo sapiens
uaccuauuugacu

SEQ ID NO: 1168871 - RNA, 13 nt, Homo sapiens
uaccucaaccaau

SEQ ID NO: 1168872 - RNA, 22 nt, Homo sapiens
uaccucaaccaaugccaaaaaa

SEQ ID NO: 1168873 - RNA, 22 nt, Homo sapiens
uaccucaguucccucuugcuca

SEQ ID NO: 1168874 - RNA, 15 nt, Homo sapiens
uaccucgaguuuuaa

SEQ ID NO: 1168875 - RNA, 20 nt, Homo sapiens
uaccucgcaucauugcagau

SEQ ID NO: 1168876 - RNA, 18 nt, Homo sapiens
uaccucucagcugcugaa

SEQ ID NO: 1168877 - RNA, 21 nt, Homo sapiens
uaccucucuccucuccgcgcc

SEQ ID NO: 1168878 - RNA, 19 nt, Homo sapiens
uaccugaaguacaguauau

SEQ ID NO: 1168879 - RNA, 14 nt, Homo sapiens
uaccugacacuccc

SEQ ID NO: 1168880 - RNA, 16 nt, Homo sapiens
uaccugaucaaugaca

SEQ ID NO: 1168881 - RNA, 23 nt, Homo sapiens
uaccugccaugcauacaugcugc

SEQ ID NO: 1168882 - RNA, 20 nt, Homo sapiens
uaccuggccuuccugccagg

SEQ ID NO: 1168883 - RNA, 16 nt, Homo sapiens
uaccugggaccuccac

SEQ ID NO: 1168884 - RNA, 14 nt, Homo sapiens
uaccugggugauua

SEQ ID NO: 1168885 - RNA, 17 nt, Homo sapiens
uaccuucaagaaccagg

SEQ ID NO: 1168886 - RNA, 20 nt, Homo sapiens
uaccuucaagaaccaggcag

SEQ ID NO: 1168887 - RNA, 21 nt, Homo sapiens
uaccuucaggcagccagugug

SEQ ID NO: 1168888 - RNA, 23 nt, Homo sapiens
uaccuuccccagacuugcacugg

SEQ ID NO: 1168889 - RNA, 21 nt, Homo sapiens
uaccuugguucccccacugau

SEQ ID NO: 1168890 - RNA, 15 nt, Homo sapiens
uaccuuguuuugcca

SEQ ID NO: 1168891 - RNA, 18 nt, Homo sapiens
uaccuuguuuugccaugu

SEQ ID NO: 1168892 - RNA, 18 nt, Homo sapiens
uaccuuugcuacuacuau

SEQ ID NO: 1168893 - RNA, 18 nt, Homo sapiens
uacgcaguuacugaaauc

SEQ ID NO: 1168894 - RNA, 15 nt, Homo sapiens
uacgcucaucaccua

SEQ ID NO: 1168895 - RNA, 14 nt, Homo sapiens
uacgggggcuguga

SEQ ID NO: 1168896 - RNA, 13 nt, Homo sapiens
uacguuugugcag

SEQ ID NO: 1168897 - RNA, 17 nt, Homo sapiens
uacuaaaaaucaugaga

SEQ ID NO: 1168898 - RNA, 13 nt, Homo sapiens
uacuaccuugaaa

SEQ ID NO: 1168899 - RNA, 14 nt, Homo sapiens
uacuaggacuccuu

SEQ ID NO: 1168900 - RNA, 16 nt, Homo sapiens
uacuagggagccauuu

SEQ ID NO: 1168901 - RNA, 14 nt, Homo sapiens
uacuaggugccuuu

SEQ ID NO: 1168902 - RNA, 16 nt, Homo sapiens
uacuauauaugacugg

SEQ ID NO: 1168903 - RNA, 22 nt, Homo sapiens
uacuauccagcucuaagucuca

SEQ ID NO: 1168904 - RNA, 14 nt, Homo sapiens
uacuaucucagaga

SEQ ID NO: 1168905 - RNA, 16 nt, Homo sapiens
uacuaucucagagaua

SEQ ID NO: 1168906 - RNA, 20 nt, Homo sapiens
uacuauuuuuagcaauguuu

SEQ ID NO: 1168907 - RNA, 13 nt, Homo sapiens
uacucaaccaaau

SEQ ID NO: 1168908 - RNA, 22 nt, Homo sapiens
uacucagacgugugaccuccau

SEQ ID NO: 1168909 - RNA, 20 nt, Homo sapiens
uacucagcauuugauuaaca

SEQ ID NO: 1168910 - RNA, 20 nt, Homo sapiens
uacucaucgggcccagggac

SEQ ID NO: 1168911 - RNA, 21 nt, Homo sapiens
uacuccucacacuuacuguaa

SEQ ID NO: 1168912 - RNA, 17 nt, Homo sapiens
uacuccuggcucaagcc

SEQ ID NO: 1168913 - RNA, 13 nt, Homo sapiens
uaagaccuggcag

SEQ ID NO: 1168914 - RNA, 19 nt, Homo sapiens
uaagaccuugaugugugau

SEQ ID NO: 1168915 - RNA, 20 nt, Homo sapiens
uaagacucucgcaucuuccc

SEQ ID NO: 1168916 - RNA, 16 nt, Homo sapiens
uaagacugcugcugaa

SEQ ID NO: 1168917 - RNA, 15 nt, Homo sapiens
uaagagaacaaugug

SEQ ID NO: 1168918 - RNA, 19 nt, Homo sapiens
uaagagccuaacuccaucc

SEQ ID NO: 1168919 - RNA, 15 nt, Homo sapiens
uaagaggaguaggcc

SEQ ID NO: 1168920 - RNA, 20 nt, Homo sapiens
uaagagggcauauacaguga

SEQ ID NO: 1168921 - RNA, 23 nt, Homo sapiens
uaagauagcccuaaauguacucu

SEQ ID NO: 1168922 - RNA, 14 nt, Homo sapiens
uaagauaugcauua

SEQ ID NO: 1168923 - RNA, 21 nt, Homo sapiens
uaagaucguucucugccucac

SEQ ID NO: 1168924 - RNA, 19 nt, Homo sapiens
uaagaucucgguuugccaa

SEQ ID NO: 1168925 - RNA, 23 nt, Homo sapiens
uaagaucugaguugagaccuuug

SEQ ID NO: 1168926 - RNA, 16 nt, Homo sapiens
uaagaugagggggcca

SEQ ID NO: 1168927 - RNA, 22 nt, Homo sapiens
uaagauguguuaggaaugucaa

SEQ ID NO: 1168928 - RNA, 11 nt, Homo sapiens
uaagauucuaa

SEQ ID NO: 1168929 - RNA, 16 nt, Homo sapiens
uaagccagugagacca

SEQ ID NO: 1168930 - RNA, 22 nt, Homo sapiens
uaagccgcagagacccucucag

SEQ ID NO: 1168931 - RNA, 15 nt, Homo sapiens
uaagcuaaagccuga

SEQ ID NO: 1168932 - RNA, 19 nt, Homo sapiens
uaagcuuuggacccaagga

SEQ ID NO: 1168933 - RNA, 21 nt, Homo sapiens
uaagcuuuggacccaaggaaa

SEQ ID NO: 1168934 - RNA, 23 nt, Homo sapiens
uaaggaaaaauauuuugcacaga

SEQ ID NO: 1168935 - RNA, 13 nt, Homo sapiens
uaaggaacaacgu

SEQ ID NO: 1168936 - RNA, 16 nt, Homo sapiens
uaaggagaaaucuaua

SEQ ID NO: 1168937 - RNA, 19 nt, Homo sapiens
uaaggauguagcuuuucac

SEQ ID NO: 1168938 - RNA, 15 nt, Homo sapiens
uaaggcagaucuuug

SEQ ID NO: 1168939 - RNA, 19 nt, Homo sapiens
uaaggcccucuugaaucuc

SEQ ID NO: 1168940 - RNA, 15 nt, Homo sapiens
uaaggccuuggugcc

SEQ ID NO: 1168941 - RNA, 17 nt, Homo sapiens
uaaggcucugugccuug

SEQ ID NO: 1168942 - RNA, 19 nt, Homo sapiens
uaaggcugaggaaaggcca

SEQ ID NO: 1168943 - RNA, 21 nt, Homo sapiens
uaagggccggggauggaucuu

SEQ ID NO: 1168944 - RNA, 12 nt, Homo sapiens
uaagggggacca

SEQ ID NO: 1168945 - RNA, 15 nt, Homo sapiens
uaagguaaaaugcca

SEQ ID NO: 1168946 - RNA, 16 nt, Homo sapiens
uaagguagaacuugag

SEQ ID NO: 1168947 - RNA, 21 nt, Homo sapiens
uaagguauauaaauuuuccca

SEQ ID NO: 1168948 - RNA, 12 nt, Homo sapiens
uaaggucauuac

SEQ ID NO: 1168949 - RNA, 17 nt, Homo sapiens
uaaggucauuacucuca

SEQ ID NO: 1168950 - RNA, 14 nt, Homo sapiens
uaagguucuaauag

SEQ ID NO: 1168951 - RNA, 22 nt, Homo sapiens
uaaguauaaaauacaacaaagg

SEQ ID NO: 1168952 - RNA, 17 nt, Homo sapiens
uaagucuuaaucauuug

SEQ ID NO: 1168953 - RNA, 17 nt, Homo sapiens
uaagugaucguuacauu

SEQ ID NO: 1168954 - RNA, 16 nt, Homo sapiens
uaagugcgcaaugcua

SEQ ID NO: 1168955 - RNA, 23 nt, Homo sapiens
uaaguucauucaugccaaguauc

SEQ ID NO: 1168956 - RNA, 23 nt, Homo sapiens
uaaguuguagaaauuaacaaaug

SEQ ID NO: 1168957 - RNA, 20 nt, Homo sapiens
uaaguuuccuuccagcccag

SEQ ID NO: 1168958 - RNA, 22 nt, Homo sapiens
uaaguuuccuuccagcccagaa

SEQ ID NO: 1168959 - RNA, 20 nt, Homo sapiens
uaaguuuuguuuagcaaugu

SEQ ID NO: 1168960 - RNA, 21 nt, Homo sapiens
uaauaaaaccggucacugaug

SEQ ID NO: 1168961 - RNA, 12 nt, Homo sapiens
uaauaacuuugc

SEQ ID NO: 1168962 - RNA, 13 nt, Homo sapiens
uaauaacuuugcu

SEQ ID NO: 1168963 - RNA, 15 nt, Homo sapiens
uaauaaugcuuaaua

SEQ ID NO: 1168964 - RNA, 17 nt, Homo sapiens
uaauacacaaugcauca

SEQ ID NO: 1168965 - RNA, 12 nt, Homo sapiens
uaauacagauaa

SEQ ID NO: 1168966 - RNA, 14 nt, Homo sapiens
uaauacaucaaaga

SEQ ID NO: 1168967 - RNA, 15 nt, Homo sapiens
uaauacuacugcaca

SEQ ID NO: 1168968 - RNA, 22 nt, Homo sapiens
uaauacugguuauccugugcua

SEQ ID NO: 1168969 - RNA, 15 nt, Homo sapiens
uaauagaguauguga

SEQ ID NO: 1168970 - RNA, 11 nt, Homo sapiens
uaauagcuuuu

SEQ ID NO: 1168971 - RNA, 16 nt, Homo sapiens
uaauagcuuuugauua

SEQ ID NO: 1168972 - RNA, 17 nt, Homo sapiens
uaauaggcguaacuaau

SEQ ID NO: 1168973 - RNA, 18 nt, Homo sapiens
uaauagguguuuguuuaa

SEQ ID NO: 1168974 - RNA, 18 nt, Homo sapiens
uaauauaagcccaauauc

SEQ ID NO: 1168975 - RNA, 18 nt, Homo sapiens
uaauaucuaaaguuauau

SEQ ID NO: 1168976 - RNA, 14 nt, Homo sapiens
uaauaugauucuag

SEQ ID NO: 1168977 - RNA, 22 nt, Homo sapiens
uaauaugauuuuuuaagucuau

SEQ ID NO: 1168978 - RNA, 24 nt, Homo sapiens
uaauaugauuuuuuaagucuaugu

SEQ ID NO: 1168979 - RNA, 17 nt, Homo sapiens
uaauaugccuagcacaa

SEQ ID NO: 1168980 - RNA, 20 nt, Homo sapiens
uaauaugugaucagcuuuca

SEQ ID NO: 1168981 - RNA, 18 nt, Homo sapiens
uaauauuauuacuguuga

SEQ ID NO: 1168982 - RNA, 17 nt, Homo sapiens
uaauauuuccaauguga

SEQ ID NO: 1168983 - RNA, 19 nt, Homo sapiens
uaaucaaaaagaagacauu

SEQ ID NO: 1168984 - RNA, 22 nt, Homo sapiens
uaaucaaagauugaacacugcg

SEQ ID NO: 1168985 - RNA, 13 nt, Homo sapiens
uaaucaacagaua

SEQ ID NO: 1168986 - RNA, 21 nt, Homo sapiens
uaaucagccucgcucuugucu

SEQ ID NO: 1168987 - RNA, 14 nt, Homo sapiens
uaauccacucccuu

SEQ ID NO: 1168988 - RNA, 13 nt, Homo sapiens
uaaucccaacacu

SEQ ID NO: 1168989 - RNA, 15 nt, Homo sapiens
uaaucccagcacuuu

SEQ ID NO: 1168990 - RNA, 19 nt, Homo sapiens
uaaucccagcuacucagga

SEQ ID NO: 1168991 - RNA, 15 nt, Homo sapiens
uaaucuaauacacuu

SEQ ID NO: 1168992 - RNA, 15 nt, Homo sapiens
uaaucucacuacaca

SEQ ID NO: 1168993 - RNA, 15 nt, Homo sapiens
uaaucugagcagucu

SEQ ID NO: 1168994 - RNA, 15 nt, Homo sapiens
uaaucugauguuaac

SEQ ID NO: 1168995 - RNA, 21 nt, Homo sapiens
uaaucuuaaauuuauuagaua

SEQ ID NO: 1168996 - RNA, 20 nt, Homo sapiens
uaaucuuugcugaagcugag

SEQ ID NO: 1168997 - RNA, 14 nt, Homo sapiens
uaaucuuugcuuua

SEQ ID NO: 1168998 - RNA, 21 nt, Homo sapiens
uaaugaacuuuauuggagcau

SEQ ID NO: 1168999 - RNA, 13 nt, Homo sapiens
uaaugaauaugcc

SEQ ID NO: 1169000 - RNA, 14 nt, Homo sapiens
uaaugacauguagc

SEQ ID NO: 1169001 - RNA, 20 nt, Homo sapiens
uaaugcaaacugggaugaaa

SEQ ID NO: 1169002 - RNA, 14 nt, Homo sapiens
uaaugcacaucugc

SEQ ID NO: 1169003 - RNA, 16 nt, Homo sapiens
uaaugcagaaguauuc

SEQ ID NO: 1169004 - RNA, 23 nt, Homo sapiens
uaaugccucugucuagcaugcca

SEQ ID NO: 1169005 - RNA, 18 nt, Homo sapiens
uaaugcuugccaagaaau

SEQ ID NO: 1169006 - RNA, 17 nt, Homo sapiens
uaauguauaccagccua

SEQ ID NO: 1169007 - RNA, 14 nt, Homo sapiens
uaaugucaccaccu

SEQ ID NO: 1169008 - RNA, 22 nt, Homo sapiens
uaauguguacauuagucauuca

SEQ ID NO: 1169009 - RNA, 21 nt, Homo sapiens
uaauguuagaauugauuucca

SEQ ID NO: 1169010 - RNA, 16 nt, Homo sapiens
uaauguuauuuccacu

SEQ ID NO: 1169011 - RNA, 20 nt, Homo sapiens
uaauguucugacaguuguga

SEQ ID NO: 1169012 - RNA, 15 nt, Homo sapiens
uaauguucugugaua

SEQ ID NO: 1169013 - RNA, 19 nt, Homo sapiens
uaauguuuuauacuguuua

SEQ ID NO: 1169014 - RNA, 23 nt, Homo sapiens
uaauuaaaaagaugguugccaag

SEQ ID NO: 1169015 - RNA, 12 nt, Homo sapiens
uaauuaacaaua

SEQ ID NO: 1169016 - RNA, 15 nt, Homo sapiens
uaauuagaauucucu

SEQ ID NO: 1169017 - RNA, 12 nt, Homo sapiens
uaauuagugaac

SEQ ID NO: 1169018 - RNA, 23 nt, Homo sapiens
uaauuauaaaaugcaaucaauuu

SEQ ID NO: 1169019 - RNA, 15 nt, Homo sapiens
uaauuauaaacagca

SEQ ID NO: 1169020 - RNA, 18 nt, Homo sapiens
uaauucaacauauaccuu

SEQ ID NO: 1169021 - RNA, 19 nt, Homo sapiens
uaauucauuugguucaaau

SEQ ID NO: 1169022 - RNA, 23 nt, Homo sapiens
uaauuccccccacccccugccaa

SEQ ID NO: 1169023 - RNA, 17 nt, Homo sapiens
uaauucuauacuguuga

SEQ ID NO: 1169024 - RNA, 19 nt, Homo sapiens
uaauucuuaggguacucau

SEQ ID NO: 1169025 - RNA, 20 nt, Homo sapiens
uaauucuuauggcugcugaa

SEQ ID NO: 1169026 - RNA, 18 nt, Homo sapiens
uaauugcuuugagcacaa

SEQ ID NO: 1169027 - RNA, 13 nt, Homo sapiens
uaauuguaauuaa

SEQ ID NO: 1169028 - RNA, 15 nt, Homo sapiens
uaauuuacaugcaau

SEQ ID NO: 1169029 - RNA, 20 nt, Homo sapiens
uaauuuagaccccauacaag

SEQ ID NO: 1169030 - RNA, 16 nt, Homo sapiens
uaauuuagccaggacc

SEQ ID NO: 1169031 - RNA, 17 nt, Homo sapiens
guguugagcguuugcac

SEQ ID NO: 1169032 - RNA, 19 nt, Homo sapiens
guguugccucuugcaaugc

SEQ ID NO: 1169033 - RNA, 18 nt, Homo sapiens
guguuuuaaaacaacaac

SEQ ID NO: 1169034 - RNA, 13 nt, Homo sapiens
guguuuugcucug

SEQ ID NO: 1169035 - RNA, 23 nt, Homo sapiens
guguuuuguaggagacuugccag

SEQ ID NO: 1169036 - RNA, 18 nt, Homo sapiens
guguuuuucacauuugcg

SEQ ID NO: 1169037 - RNA, 17 nt, Homo sapiens
guuaaaaacuuguguau

SEQ ID NO: 1169038 - RNA, 22 nt, Homo sapiens
guuaaaaauaaaaaacauauac

SEQ ID NO: 1169039 - RNA, 18 nt, Homo sapiens
guuaaaggaaaagcacaa

SEQ ID NO: 1169040 - RNA, 11 nt, Homo sapiens
guuaacaucau

SEQ ID NO: 1169041 - RNA, 16 nt, Homo sapiens
guuaagaaagcacuua

SEQ ID NO: 1169042 - RNA, 19 nt, Homo sapiens
guuaagagaaugcuuugaa

SEQ ID NO: 1169043 - RNA, 12 nt, Homo sapiens
guuaaguauuuu

SEQ ID NO: 1169044 - RNA, 20 nt, Homo sapiens
guuaagugggcauuuugaca

SEQ ID NO: 1169045 - RNA, 14 nt, Homo sapiens
guuaauauggugua

SEQ ID NO: 1169046 - RNA, 13 nt, Homo sapiens
guuaauggucaca

SEQ ID NO: 1169047 - RNA, 18 nt, Homo sapiens
guuacaauaaaacuaaau

SEQ ID NO: 1169048 - RNA, 14 nt, Homo sapiens
guuacagcacaaaa

SEQ ID NO: 1169049 - RNA, 21 nt, Homo sapiens
guuacagugaugcugugcuau

SEQ ID NO: 1169050 - RNA, 14 nt, Homo sapiens
guuacccacugcca

SEQ ID NO: 1169051 - RNA, 16 nt, Homo sapiens
guuacuccagugccaa

SEQ ID NO: 1169052 - RNA, 18 nt, Homo sapiens
guuacugaaaucuuguaa

SEQ ID NO: 1169053 - RNA, 19 nt, Homo sapiens
guuacugcuugaccaaaga

SEQ ID NO: 1169054 - RNA, 21 nt, Homo sapiens
guuacugcuugaccaaagagc

SEQ ID NO: 1169055 - RNA, 16 nt, Homo sapiens
guuacugggcccugag

SEQ ID NO: 1169056 - RNA, 12 nt, Homo sapiens
guuacuguguca

SEQ ID NO: 1169057 - RNA, 15 nt, Homo sapiens
guuacuucagcccau

SEQ ID NO: 1169058 - RNA, 20 nt, Homo sapiens
guuagcuccucacuguggua

SEQ ID NO: 1169059 - RNA, 17 nt, Homo sapiens
guuagugaacuagguag

SEQ ID NO: 1169060 - RNA, 15 nt, Homo sapiens
guuagugauggagcu

SEQ ID NO: 1169061 - RNA, 19 nt, Homo sapiens
guuaguggauaaccacagg

SEQ ID NO: 1169062 - RNA, 22 nt, Homo sapiens
guuaucaguaaugcuaaaugug

SEQ ID NO: 1169063 - RNA, 14 nt, Homo sapiens
guuauccugugcua

SEQ ID NO: 1169064 - RNA, 18 nt, Homo sapiens
guuaucuuuuaaaauuca

SEQ ID NO: 1169065 - RNA, 14 nt, Homo sapiens
guuaugacugcgua

SEQ ID NO: 1169066 - RNA, 14 nt, Homo sapiens
guuauuauuuacug

SEQ ID NO: 1169067 - RNA, 15 nt, Homo sapiens
guuauucuuguuaua

SEQ ID NO: 1169068 - RNA, 17 nt, Homo sapiens
guuauugccucuacuuu

SEQ ID NO: 1169069 - RNA, 14 nt, Homo sapiens
guuauuuacuugaa

SEQ ID NO: 1169070 - RNA, 21 nt, Homo sapiens
guuauuuagggaacugcuuga

SEQ ID NO: 1169071 - RNA, 14 nt, Homo sapiens
guucaacuacaugu

SEQ ID NO: 1169072 - RNA, 15 nt, Homo sapiens
guucaauuguguauu

SEQ ID NO: 1169073 - RNA, 22 nt, Homo sapiens
guucacaguagaguaggguaga

SEQ ID NO: 1169074 - RNA, 14 nt, Homo sapiens
guucagggucauag

SEQ ID NO: 1169075 - RNA, 20 nt, Homo sapiens
guucaucaauaccugcugag

SEQ ID NO: 1169076 - RNA, 16 nt, Homo sapiens
guucauccccugugaa

SEQ ID NO: 1169077 - RNA, 11 nt, Homo sapiens
guucauuccac

SEQ ID NO: 1169078 - RNA, 14 nt, Homo sapiens
guucccaaaacaau

SEQ ID NO: 1169079 - RNA, 16 nt, Homo sapiens
guucccaauacaaaaa

SEQ ID NO: 1169080 - RNA, 22 nt, Homo sapiens
guucccagcaggaauuucuuuu

SEQ ID NO: 1169081 - RNA, 13 nt, Homo sapiens
guuccccagagaa

SEQ ID NO: 1169082 - RNA, 20 nt, Homo sapiens
guuccccauguguguguaca

SEQ ID NO: 1169083 - RNA, 14 nt, Homo sapiens
guucccccacugau

SEQ ID NO: 1169084 - RNA, 15 nt, Homo sapiens
guuccgagaagaaca

SEQ ID NO: 1169085 - RNA, 15 nt, Homo sapiens
guuccuccugcucua

SEQ ID NO: 1169086 - RNA, 16 nt, Homo sapiens
guuccuggaauggcac

SEQ ID NO: 1169087 - RNA, 21 nt, Homo sapiens
guuccuguucgguuccagaca

SEQ ID NO: 1169088 - RNA, 14 nt, Homo sapiens
guuccuucugugaa

SEQ ID NO: 1169089 - RNA, 15 nt, Homo sapiens
guucgagaccagccu

SEQ ID NO: 1169090 - RNA, 21 nt, Homo sapiens
guucguucuguacuguuacug

SEQ ID NO: 1169091 - RNA, 17 nt, Homo sapiens
guucuaaaguucuaaga

SEQ ID NO: 1169092 - RNA, 16 nt, Homo sapiens
guucuaacauguaauu

SEQ ID NO: 1169093 - RNA, 20 nt, Homo sapiens
guucucacuauguuucucag

SEQ ID NO: 1169094 - RNA, 19 nt, Homo sapiens
guucucauaacucugugau

SEQ ID NO: 1169095 - RNA, 17 nt, Homo sapiens
guucucauuccuguucu

SEQ ID NO: 1169096 - RNA, 22 nt, Homo sapiens
guucucauuuuuaucccauuga

SEQ ID NO: 1169097 - RNA, 13 nt, Homo sapiens
guucucugccuca

SEQ ID NO: 1169098 - RNA, 21 nt, Homo sapiens
guucugagggguguccgagag

SEQ ID NO: 1169099 - RNA, 21 nt, Homo sapiens
guucugcuacuccccagaccu

SEQ ID NO: 1169100 - RNA, 23 nt, Homo sapiens
guucuggggggacccagugcaga

SEQ ID NO: 1169101 - RNA, 23 nt, Homo sapiens
guucuguaguuauucugaugaua

SEQ ID NO: 1169102 - RNA, 14 nt, Homo sapiens
guucugugcacaaa

SEQ ID NO: 1169103 - RNA, 21 nt, Homo sapiens
guucuuaacuuugaaccauaa

SEQ ID NO: 1169104 - RNA, 18 nt, Homo sapiens
guucuuacagcacaucac

SEQ ID NO: 1169105 - RNA, 15 nt, Homo sapiens
guucuuccucucuca

SEQ ID NO: 1169106 - RNA, 22 nt, Homo sapiens
guucuuuaaaauguaaagccau

SEQ ID NO: 1169107 - RNA, 18 nt, Homo sapiens
guucuuugucacagggac

SEQ ID NO: 1169108 - RNA, 21 nt, Homo sapiens
guugaaaagacaauagcccaa

SEQ ID NO: 1169109 - RNA, 21 nt, Homo sapiens
guugaaacugcuugagcauca

SEQ ID NO: 1169110 - RNA, 22 nt, Homo sapiens
guugaacaauaaguaaauccac

SEQ ID NO: 1169111 - RNA, 16 nt, Homo sapiens
guugaauauuuagcau

SEQ ID NO: 1169112 - RNA, 14 nt, Homo sapiens
guugaauuccaagu

SEQ ID NO: 1169113 - RNA, 17 nt, Homo sapiens
guugaauucuuuugcca

SEQ ID NO: 1169114 - RNA, 19 nt, Homo sapiens
guugaauucuuuugccaag

SEQ ID NO: 1169115 - RNA, 16 nt, Homo sapiens
guugaauuucccacau

SEQ ID NO: 1169116 - RNA, 15 nt, Homo sapiens
guugagaaauucugc

SEQ ID NO: 1169117 - RNA, 18 nt, Homo sapiens
guugcaccguucucugua

SEQ ID NO: 1169118 - RNA, 19 nt, Homo sapiens
guugcaggcagugucuuaa

SEQ ID NO: 1169119 - RNA, 18 nt, Homo sapiens
guugcauugagcugagau

SEQ ID NO: 1169120 - RNA, 20 nt, Homo sapiens
guugcccaacuacuaucuca

SEQ ID NO: 1169121 - RNA, 18 nt, Homo sapiens
guugcccuaauucaucuu

SEQ ID NO: 1169122 - RNA, 13 nt, Homo sapiens
guugccgcagcgg

SEQ ID NO: 1169123 - RNA, 19 nt, Homo sapiens
guugccuuuauauccaaaa

SEQ ID NO: 1169124 - RNA, 20 nt, Homo sapiens
guugcguggacucugcacau

SEQ ID NO: 1169125 - RNA, 16 nt, Homo sapiens
guugcuauaauaaaga

SEQ ID NO: 1169126 - RNA, 23 nt, Homo sapiens
guugcuauuguaaggucuuugua

SEQ ID NO: 1169127 - RNA, 14 nt, Homo sapiens
guuggcaguguuug

SEQ ID NO: 1169128 - RNA, 19 nt, Homo sapiens
guuggcuagagcuucugua

SEQ ID NO: 1169129 - RNA, 16 nt, Homo sapiens
guugggcugugccugg

SEQ ID NO: 1169130 - RNA, 20 nt, Homo sapiens
guuggggaauaaauggauau

SEQ ID NO: 1169131 - RNA, 16 nt, Homo sapiens
guuggugaauuucaca

SEQ ID NO: 1169132 - RNA, 20 nt, Homo sapiens
guuggugaauuucacaagcu

SEQ ID NO: 1169133 - RNA, 19 nt, Homo sapiens
guugguguucggagcucuu

SEQ ID NO: 1169134 - RNA, 16 nt, Homo sapiens
guugguuccuuuccaa

SEQ ID NO: 1169135 - RNA, 22 nt, Homo sapiens
guugguucguucuguacuguua

SEQ ID NO: 1169136 - RNA, 22 nt, Homo sapiens
guuguagacuauggaaugucag

SEQ ID NO: 1169137 - RNA, 21 nt, Homo sapiens
guuguauuguggaacacugaa

SEQ ID NO: 1169138 - RNA, 22 nt, Homo sapiens
guugucuuuuaaaaagugugcu

SEQ ID NO: 1169139 - RNA, 16 nt, Homo sapiens
guuguuuaacugugca

SEQ ID NO: 1169140 - RNA, 12 nt, Homo sapiens
guuguuuuaaca

SEQ ID NO: 1169141 - RNA, 21 nt, Homo sapiens
guuguuuuaacagaugccaau

SEQ ID NO: 1169142 - RNA, 18 nt, Homo sapiens
guuguuuuauauguugcu

SEQ ID NO: 1169143 - RNA, 12 nt, Homo sapiens
guuuaaggccac

SEQ ID NO: 1169144 - RNA, 22 nt, Homo sapiens
guuuacaacaaacacugugaug

SEQ ID NO: 1169145 - RNA, 22 nt, Homo sapiens
guuuacaagcccccccuuccac

SEQ ID NO: 1169146 - RNA, 15 nt, Homo sapiens
guuuacaguguuccg

SEQ ID NO: 1169147 - RNA, 21 nt, Homo sapiens
guuuagagcauuucuuuugaa

SEQ ID NO: 1169148 - RNA, 18 nt, Homo sapiens
guuuagcuuccuccagag

SEQ ID NO: 1169149 - RNA, 13 nt, Homo sapiens
guuuauaauuaau

SEQ ID NO: 1169150 - RNA, 14 nt, Homo sapiens
guuuaucagcaaaa

SEQ ID NO: 1169151 - RNA, 16 nt, Homo sapiens
guuuauuagaugaauu

SEQ ID NO: 1169152 - RNA, 14 nt, Homo sapiens
guuuauuugcacua

SEQ ID NO: 1169153 - RNA, 19 nt, Homo sapiens
guuucaaaauaaaaaccaa

SEQ ID NO: 1169154 - RNA, 20 nt, Homo sapiens
guuucaacucugaaagugaa

SEQ ID NO: 1169155 - RNA, 19 nt, Homo sapiens
guuucaccaugcuggucag

SEQ ID NO: 1169156 - RNA, 16 nt, Homo sapiens
guuucacgaguguucc

SEQ ID NO: 1169157 - RNA, 16 nt, Homo sapiens
guuucagugaauaugc

SEQ ID NO: 1169158 - RNA, 13 nt, Homo sapiens
guuuccaucugcu

SEQ ID NO: 1169159 - RNA, 21 nt, Homo sapiens
guuucccaaugguguuuuucu

SEQ ID NO: 1169160 - RNA, 21 nt, Homo sapiens
guuucccauuuguugcugcug

SEQ ID NO: 1169161 - RNA, 17 nt, Homo sapiens
guuuccugcugcuuugu

SEQ ID NO: 1169162 - RNA, 15 nt, Homo sapiens
ggcacauccuaugca

SEQ ID NO: 1169163 - RNA, 18 nt, Homo sapiens
ggcacccaugccaucuca

SEQ ID NO: 1169164 - RNA, 18 nt, Homo sapiens
ggcaccugguaugugcca

SEQ ID NO: 1169165 - RNA, 17 nt, Homo sapiens
ggcacugagaaagccaa

SEQ ID NO: 1169166 - RNA, 17 nt, Homo sapiens
ggcagaaaauugcacaa

SEQ ID NO: 1169167 - RNA, 13 nt, Homo sapiens
ggcagagcuucuu

SEQ ID NO: 1169168 - RNA, 14 nt, Homo sapiens
ggcagaucaccuga

SEQ ID NO: 1169169 - RNA, 12 nt, Homo sapiens
ggcagauccagg

SEQ ID NO: 1169170 - RNA, 14 nt, Homo sapiens
ggcagcacugggaa

SEQ ID NO: 1169171 - RNA, 18 nt, Homo sapiens
ggcagcauuuuugcacug

SEQ ID NO: 1169172 - RNA, 20 nt, Homo sapiens
ggcagccuggacauagagag

SEQ ID NO: 1169173 - RNA, 22 nt, Homo sapiens
ggcagccuugggggggcugccu

SEQ ID NO: 1169174 - RNA, 22 nt, Homo sapiens
ggcagcugacaguuuguggcau

SEQ ID NO: 1169175 - RNA, 20 nt, Homo sapiens
ggcaggagaaucgcuugaac

SEQ ID NO: 1169176 - RNA, 20 nt, Homo sapiens
ggcaggagaaucucuugaac

SEQ ID NO: 1169177 - RNA, 13 nt, Homo sapiens
ggcaggaggccau

SEQ ID NO: 1169178 - RNA, 12 nt, Homo sapiens
ggcaggcagcug

SEQ ID NO: 1169179 - RNA, 16 nt, Homo sapiens
ggcaggcuccaggccu

SEQ ID NO: 1169180 - RNA, 16 nt, Homo sapiens
ggcaggcucccaggga

SEQ ID NO: 1169181 - RNA, 20 nt, Homo sapiens
ggcagggagcugggcccgac

SEQ ID NO: 1169182 - RNA, 11 nt, Homo sapiens
ggcagggccag

SEQ ID NO: 1169183 - RNA, 18 nt, Homo sapiens
ggcagggccccugacccu

SEQ ID NO: 1169184 - RNA, 15 nt, Homo sapiens
ggcagggucucugcu

SEQ ID NO: 1169185 - RNA, 14 nt, Homo sapiens
ggcaguuccaggag

SEQ ID NO: 1169186 - RNA, 17 nt, Homo sapiens
ggcaguuggaggacaca

SEQ ID NO: 1169187 - RNA, 16 nt, Homo sapiens
ggcauaauagucaauu

SEQ ID NO: 1169188 - RNA, 15 nt, Homo sapiens
ggcauauacagugaa

SEQ ID NO: 1169189 - RNA, 12 nt, Homo sapiens
ggcaucauggaa

SEQ ID NO: 1169190 - RNA, 19 nt, Homo sapiens
ggcaucgaccacaccagcc

SEQ ID NO: 1169191 - RNA, 14 nt, Homo sapiens
ggcaucugugcgug

SEQ ID NO: 1169192 - RNA, 15 nt, Homo sapiens
ggcaugaaccacugc

SEQ ID NO: 1169193 - RNA, 20 nt, Homo sapiens
ggcaugagacucagugcaga

SEQ ID NO: 1169194 - RNA, 16 nt, Homo sapiens
ggcaugcuaagaauaa

SEQ ID NO: 1169195 - RNA, 19 nt, Homo sapiens
ggcaugguggcucaugccu

SEQ ID NO: 1169196 - RNA, 16 nt, Homo sapiens
ggcauuagugcugaua

SEQ ID NO: 1169197 - RNA, 23 nt, Homo sapiens
ggcauuccccccaggucuuuuca

SEQ ID NO: 1169198 - RNA, 15 nt, Homo sapiens
ggcauugagaucuac

SEQ ID NO: 1169199 - RNA, 21 nt, Homo sapiens
ggcauuuucuucucacauuua

SEQ ID NO: 1169200 - RNA, 15 nt, Homo sapiens
ggccaacacuguggg

SEQ ID NO: 1169201 - RNA, 13 nt, Homo sapiens
ggccaacugccuc

SEQ ID NO: 1169202 - RNA, 16 nt, Homo sapiens
gggaaacacuccuugc

SEQ ID NO: 1169203 - RNA, 12 nt, Homo sapiens
gggaaacuggcu

SEQ ID NO: 1169204 - RNA, 12 nt, Homo sapiens
gggaagccagac

SEQ ID NO: 1169205 - RNA, 14 nt, Homo sapiens
gggaagcucagggg

SEQ ID NO: 1169206 - RNA, 14 nt, Homo sapiens
gggaaucuaagaga

SEQ ID NO: 1169207 - RNA, 18 nt, Homo sapiens
gggacacugcgggacaga

SEQ ID NO: 1169208 - RNA, 14 nt, Homo sapiens
gggacacuuaccca

SEQ ID NO: 1169209 - RNA, 13 nt, Homo sapiens
gggaccaaugagg

SEQ ID NO: 1169210 - RNA, 18 nt, Homo sapiens
gggaccucgaacacuagu

SEQ ID NO: 1169211 - RNA, 21 nt, Homo sapiens
gggaccuugucucccagcuca

SEQ ID NO: 1169212 - RNA, 12 nt, Homo sapiens
gggacugugaac

SEQ ID NO: 1169213 - RNA, 13 nt, Homo sapiens
gggagaacgggaa

SEQ ID NO: 1169214 - RNA, 19 nt, Homo sapiens
gggagaagaagucagagag

SEQ ID NO: 1169215 - RNA, 22 nt, Homo sapiens
gggagagugucaaccagacaga

SEQ ID NO: 1169216 - RNA, 22 nt, Homo sapiens
gggaggacccacacugcuacac

SEQ ID NO: 1169217 - RNA, 17 nt, Homo sapiens
gggaggcgggggcugcc

SEQ ID NO: 1169218 - RNA, 15 nt, Homo sapiens
gggagggacugcuga

SEQ ID NO: 1169219 - RNA, 13 nt, Homo sapiens
gggagggagcuga

SEQ ID NO: 1169220 - RNA, 19 nt, Homo sapiens
gggagguggcacuagggau

SEQ ID NO: 1169221 - RNA, 15 nt, Homo sapiens
gggagguugugcaug

SEQ ID NO: 1169222 - RNA, 14 nt, Homo sapiens
gggaguuaugcaaa

SEQ ID NO: 1169223 - RNA, 22 nt, Homo sapiens
gggaucccacuauauugcacag

SEQ ID NO: 1169224 - RNA, 13 nt, Homo sapiens
gggauuacaggca

SEQ ID NO: 1169225 - RNA, 18 nt, Homo sapiens
gggauuucuuugcuguaa

SEQ ID NO: 1169226 - RNA, 16 nt, Homo sapiens
gggcaauaugaaguua

SEQ ID NO: 1169227 - RNA, 23 nt, Homo sapiens
gggcacagauccccccacaaagu

SEQ ID NO: 1169228 - RNA, 17 nt, Homo sapiens
gggcacagcaucuguag

SEQ ID NO: 1169229 - RNA, 20 nt, Homo sapiens
gggcacauuucuggauagaa

SEQ ID NO: 1169230 - RNA, 14 nt, Homo sapiens
gggcaccugaccac

SEQ ID NO: 1169231 - RNA, 23 nt, Homo sapiens
gggcagaguuucugcaguuccau

SEQ ID NO: 1169232 - RNA, 17 nt, Homo sapiens
gggcagcagcaucccag

SEQ ID NO: 1169233 - RNA, 17 nt, Homo sapiens
gggcaggccagggcagu

SEQ ID NO: 1169234 - RNA, 22 nt, Homo sapiens
gggcagggucucugcuccagca

SEQ ID NO: 1169235 - RNA, 21 nt, Homo sapiens
gggccagcacuuccaugggaa

SEQ ID NO: 1169236 - RNA, 17 nt, Homo sapiens
gggccagcugggcugcc

SEQ ID NO: 1169237 - RNA, 19 nt, Homo sapiens
gggccaugcugugugagac

SEQ ID NO: 1169238 - RNA, 17 nt, Homo sapiens
gggcccagcgcucuccu

SEQ ID NO: 1169239 - RNA, 15 nt, Homo sapiens
gggcccuaugucuca

SEQ ID NO: 1169240 - RNA, 20 nt, Homo sapiens
gggccucuucugccucuuaa

SEQ ID NO: 1169241 - RNA, 21 nt, Homo sapiens
gggcgcugagcucccagaccc

SEQ ID NO: 1169242 - RNA, 16 nt, Homo sapiens
gggcgguccugcacag

SEQ ID NO: 1169243 - RNA, 18 nt, Homo sapiens
gggcuaccccacccaagu

SEQ ID NO: 1169244 - RNA, 23 nt, Homo sapiens
gggcuauuuuuucccccacaaac

SEQ ID NO: 1169245 - RNA, 18 nt, Homo sapiens
gggcucuaaugugucucu

SEQ ID NO: 1169246 - RNA, 17 nt, Homo sapiens
gggcugagccaaagcca

SEQ ID NO: 1169247 - RNA, 20 nt, Homo sapiens
gggcugcccacaaggcuugu

SEQ ID NO: 1169248 - RNA, 13 nt, Homo sapiens
gggcugcuuccca

SEQ ID NO: 1169249 - RNA, 17 nt, Homo sapiens
gggcugggucacaggaa

SEQ ID NO: 1169250 - RNA, 13 nt, Homo sapiens
gggcuuacaggca

SEQ ID NO: 1169251 - RNA, 21 nt, Homo sapiens
gggcuuaugacugcaccaaca

SEQ ID NO: 1169252 - RNA, 20 nt, Homo sapiens
gggcuuuuccaaaagcaaac

SEQ ID NO: 1169253 - RNA, 19 nt, Homo sapiens
gggcuuuuguucugagggg

SEQ ID NO: 1169254 - RNA, 14 nt, Homo sapiens
ggggaacaaccaga

SEQ ID NO: 1169255 - RNA, 19 nt, Homo sapiens
ggggacauagcugugcuau

SEQ ID NO: 1169256 - RNA, 19 nt, Homo sapiens
ggggaccaugcaaaggaua

SEQ ID NO: 1169257 - RNA, 16 nt, Homo sapiens
ggggaccuuggucuga

SEQ ID NO: 1169258 - RNA, 17 nt, Homo sapiens
ggggacgccuguuguuu

SEQ ID NO: 1169259 - RNA, 12 nt, Homo sapiens
ggggacugcugg

SEQ ID NO: 1169260 - RNA, 14 nt, Homo sapiens
ggggaucccucccc

SEQ ID NO: 1169261 - RNA, 14 nt, Homo sapiens
ggggaugugacaug

SEQ ID NO: 1169262 - RNA, 17 nt, Homo sapiens
ggggcauaaacuuuccu

SEQ ID NO: 1169263 - RNA, 21 nt, Homo sapiens
ggggccuggacacccaucuca

SEQ ID NO: 1169264 - RNA, 18 nt, Homo sapiens
gggggaaggcugcaaagu

SEQ ID NO: 1169265 - RNA, 23 nt, Homo sapiens
gggggcaacuggccauuugccaa

SEQ ID NO: 1169266 - RNA, 20 nt, Homo sapiens
gggggccaggcgguggcuuc

SEQ ID NO: 1169267 - RNA, 23 nt, Homo sapiens
gggggcucccguggccuguagaa

SEQ ID NO: 1169268 - RNA, 16 nt, Homo sapiens
gggggcugucuuugca

SEQ ID NO: 1169269 - RNA, 23 nt, Homo sapiens
gggguaagggauuucuuagggga

SEQ ID NO: 1169270 - RNA, 19 nt, Homo sapiens
gggguagccuccuauccac

SEQ ID NO: 1169271 - RNA, 21 nt, Homo sapiens
gggguccccgcccucucucau

SEQ ID NO: 1169272 - RNA, 23 nt, Homo sapiens
ggguaccuucaggcagccagugu

SEQ ID NO: 1169273 - RNA, 17 nt, Homo sapiens
gggucaacauuuccaaa

SEQ ID NO: 1169274 - RNA, 17 nt, Homo sapiens
ggguccccuugaaagaa

SEQ ID NO: 1169275 - RNA, 16 nt, Homo sapiens
ggguccucagcugcuc

SEQ ID NO: 1169276 - RNA, 18 nt, Homo sapiens
ggguccugggaggcugca

SEQ ID NO: 1169277 - RNA, 22 nt, Homo sapiens
gggucuucuugggcaccucucu

SEQ ID NO: 1169278 - RNA, 13 nt, Homo sapiens
gggugagugcaag

SEQ ID NO: 1169279 - RNA, 15 nt, Homo sapiens
gggugauaacucagg

SEQ ID NO: 1169280 - RNA, 13 nt, Homo sapiens
gggugauggauga

SEQ ID NO: 1169281 - RNA, 20 nt, Homo sapiens
gggugauuacauaaucugua

SEQ ID NO: 1169282 - RNA, 20 nt, Homo sapiens
ggguggagugcaguggugcg

SEQ ID NO: 1169283 - RNA, 23 nt, Homo sapiens
gggugguagugggagguugugca

SEQ ID NO: 1169284 - RNA, 15 nt, Homo sapiens
gggugguguccugaa

SEQ ID NO: 1169285 - RNA, 21 nt, Homo sapiens
ggguguggucuccacugggga

SEQ ID NO: 1169286 - RNA, 17 nt, Homo sapiens
ggguuagauguugccau

SEQ ID NO: 1169287 - RNA, 15 nt, Homo sapiens
ggguuccaggacagg

SEQ ID NO: 1169288 - RNA, 22 nt, Homo sapiens
ggguugcacuggccacccaagg

SEQ ID NO: 1169289 - RNA, 23 nt, Homo sapiens
ggguugguagcagggaguaccca

SEQ ID NO: 1169290 - RNA, 13 nt, Homo sapiens
ggguuuacaggca

SEQ ID NO: 1169291 - RNA, 18 nt, Homo sapiens
ggguuucaccauguuggc

SEQ ID NO: 1169292 - RNA, 15 nt, Homo sapiens
ggguuuuuaaucucc

SEQ ID NO: 1169293 - RNA, 19 nt, Homo sapiens
gguaaagggcgcaaagggc

SEQ ID NO: 1169294 - RNA, 20 nt, Homo sapiens
gguaauauaaaguguaauag

SEQ ID NO: 1169295 - RNA, 18 nt, Homo sapiens
gguaauuaguaacaugug

SEQ ID NO: 1169296 - RNA, 22 nt, Homo sapiens
gguaauuauguuuugugauuca

SEQ ID NO: 1169297 - RNA, 13 nt, Homo sapiens
gguacaaaaccac

SEQ ID NO: 1169298 - RNA, 24 nt, Homo sapiens
gguacagguauauuuugacgucac

SEQ ID NO: 1169299 - RNA, 20 nt, Homo sapiens
gguaccuucaggcagccagu

SEQ ID NO: 1169300 - RNA, 20 nt, Homo sapiens
gguacuucaggggcacuuca

SEQ ID NO: 1169301 - RNA, 22 nt, Homo sapiens
gguagaggugugugccuaguga

SEQ ID NO: 1169302 - RNA, 20 nt, Homo sapiens
ggaauuugcuuuaucuacuu

SEQ ID NO: 1169303 - RNA, 24 nt, Homo sapiens
ggacaaaagggguuaauguuacuu

SEQ ID NO: 1169304 - RNA, 13 nt, Homo sapiens
ggacaaagugcca

SEQ ID NO: 1169305 - RNA, 17 nt, Homo sapiens
ggacaaagugccaaaga

SEQ ID NO: 1169306 - RNA, 18 nt, Homo sapiens
ggacaaagugccaaagaa

SEQ ID NO: 1169307 - RNA, 14 nt, Homo sapiens
ggacaagaccccca

SEQ ID NO: 1169308 - RNA, 21 nt, Homo sapiens
ggacaagaggguucacacagc

SEQ ID NO: 1169309 - RNA, 22 nt, Homo sapiens
ggacaaggagugugaccacuga

SEQ ID NO: 1169310 - RNA, 21 nt, Homo sapiens
ggacacgccgucuguccucac

SEQ ID NO: 1169311 - RNA, 23 nt, Homo sapiens
ggacacuuaauacuaccuugaaa

SEQ ID NO: 1169312 - RNA, 15 nt, Homo sapiens
ggacacuucucagga

SEQ ID NO: 1169313 - RNA, 16 nt, Homo sapiens
ggacagaagcagcucu

SEQ ID NO: 1169314 - RNA, 21 nt, Homo sapiens
ggacagauggacgcaggcccu

SEQ ID NO: 1169315 - RNA, 20 nt, Homo sapiens
ggacagccaaguuauaccca

SEQ ID NO: 1169316 - RNA, 17 nt, Homo sapiens
ggacagccacacugcgc

SEQ ID NO: 1169317 - RNA, 18 nt, Homo sapiens
ggacagccccacccuggu

SEQ ID NO: 1169318 - RNA, 21 nt, Homo sapiens
ggacaguaauaagaauggaaa

SEQ ID NO: 1169319 - RNA, 16 nt, Homo sapiens
ggacaucacagggugg

SEQ ID NO: 1169320 - RNA, 17 nt, Homo sapiens
ggacaugaagauucuuu

SEQ ID NO: 1169321 - RNA, 15 nt, Homo sapiens
ggacaugcaugacac

SEQ ID NO: 1169322 - RNA, 10 nt, Homo sapiens
ggacaugccc

SEQ ID NO: 1169323 - RNA, 16 nt, Homo sapiens
ggacauggcugacuuu

SEQ ID NO: 1169324 - RNA, 19 nt, Homo sapiens
ggacauuuuuucagucaua

SEQ ID NO: 1169325 - RNA, 18 nt, Homo sapiens
ggaccaaguaguuugccc

SEQ ID NO: 1169326 - RNA, 21 nt, Homo sapiens
ggaccaccguucagucauuuu

SEQ ID NO: 1169327 - RNA, 20 nt, Homo sapiens
ggaccacuccugaaugagac

SEQ ID NO: 1169328 - RNA, 15 nt, Homo sapiens
ggaccagcccugaga

SEQ ID NO: 1169329 - RNA, 18 nt, Homo sapiens
ggaccagcccuugaggga

SEQ ID NO: 1169330 - RNA, 16 nt, Homo sapiens
ggaccagccucuccac

SEQ ID NO: 1169331 - RNA, 15 nt, Homo sapiens
ggaccaggauuugca

SEQ ID NO: 1169332 - RNA, 17 nt, Homo sapiens
ggaccaguggucucaca

SEQ ID NO: 1169333 - RNA, 19 nt, Homo sapiens
ggaccaugcgacacuggga

SEQ ID NO: 1169334 - RNA, 13 nt, Homo sapiens
ggaccuccaagcc

SEQ ID NO: 1169335 - RNA, 20 nt, Homo sapiens
ggaccuccaagccacugagc

SEQ ID NO: 1169336 - RNA, 23 nt, Homo sapiens
ggaccugccaaugauuccagacg

SEQ ID NO: 1169337 - RNA, 19 nt, Homo sapiens
ggaccuggcaacccaggaa

SEQ ID NO: 1169338 - RNA, 14 nt, Homo sapiens
ggaccugguacaaa

SEQ ID NO: 1169339 - RNA, 19 nt, Homo sapiens
ggacuagagggaccucucc

SEQ ID NO: 1169340 - RNA, 14 nt, Homo sapiens
ggacuaugcaugug

SEQ ID NO: 1169341 - RNA, 13 nt, Homo sapiens
ggacuccaucucu

SEQ ID NO: 1169342 - RNA, 22 nt, Homo sapiens
ggacuccaucucucauccucca

SEQ ID NO: 1169343 - RNA, 14 nt, Homo sapiens
ggacucuggacaau

SEQ ID NO: 1169344 - RNA, 17 nt, Homo sapiens
ggacuggcacacuggcc

SEQ ID NO: 1169345 - RNA, 18 nt, Homo sapiens
ggacuguucccugaggug

SEQ ID NO: 1169346 - RNA, 17 nt, Homo sapiens
ggacuuguuuuccugug

SEQ ID NO: 1169347 - RNA, 19 nt, Homo sapiens
gaagguggaccuggcagug

SEQ ID NO: 1169348 - RNA, 17 nt, Homo sapiens
gaagguggcuacaaaga

SEQ ID NO: 1169349 - RNA, 20 nt, Homo sapiens
gaaggugugcuacagaaaau

SEQ ID NO: 1169350 - RNA, 21 nt, Homo sapiens
gaagguguguccucaagaaga

SEQ ID NO: 1169351 - RNA, 13 nt, Homo sapiens
gaagguugcaccu

SEQ ID NO: 1169352 - RNA, 16 nt, Homo sapiens
gaagguuuucauuugc

SEQ ID NO: 1169353 - RNA, 18 nt, Homo sapiens
gaaguaaaggcauuccac

SEQ ID NO: 1169354 - RNA, 19 nt, Homo sapiens
gaaguagauuaagagccau

SEQ ID NO: 1169355 - RNA, 21 nt, Homo sapiens
gaaguagauuaagagccauau

SEQ ID NO: 1169356 - RNA, 22 nt, Homo sapiens
gaaguagauucuggacagucag

SEQ ID NO: 1169357 - RNA, 20 nt, Homo sapiens
gaaguauuuuccuccaaagu

SEQ ID NO: 1169358 - RNA, 21 nt, Homo sapiens
gaagucacaacaaaaggaaga

SEQ ID NO: 1169359 - RNA, 20 nt, Homo sapiens
gaagucaucucauuccacug

SEQ ID NO: 1169360 - RNA, 18 nt, Homo sapiens
gaaguccccucuacuuua

SEQ ID NO: 1169361 - RNA, 19 nt, Homo sapiens
gaaguccccucuacuuuaa

SEQ ID NO: 1169362 - RNA, 19 nt, Homo sapiens
gaagucgaggcugcaguca

SEQ ID NO: 1169363 - RNA, 15 nt, Homo sapiens
gaagucugagggaaa

SEQ ID NO: 1169364 - RNA, 18 nt, Homo sapiens
gaagucuuaaggacaaag

SEQ ID NO: 1169365 - RNA, 14 nt, Homo sapiens
gaagugaggacaaa

SEQ ID NO: 1169366 - RNA, 22 nt, Homo sapiens
gaagugaguguuucuaugagug

SEQ ID NO: 1169367 - RNA, 15 nt, Homo sapiens
gaaguuacaugcaua

SEQ ID NO: 1169368 - RNA, 14 nt, Homo sapiens
gaaguucacaucag

SEQ ID NO: 1169369 - RNA, 15 nt, Homo sapiens
gaaguucacaucaga

SEQ ID NO: 1169370 - RNA, 22 nt, Homo sapiens
gaaguucaccauuaaaagggau

SEQ ID NO: 1169371 - RNA, 17 nt, Homo sapiens
gaaguugccaugggaaa

SEQ ID NO: 1169372 - RNA, 17 nt, Homo sapiens
gaaguuuaaagaugccu

SEQ ID NO: 1169373 - RNA, 14 nt, Homo sapiens
gaauaaacaaaauu

SEQ ID NO: 1169374 - RNA, 13 nt, Homo sapiens
gaauaaacacugg

SEQ ID NO: 1169375 - RNA, 11 nt, Homo sapiens
gaauaaagccu

SEQ ID NO: 1169376 - RNA, 18 nt, Homo sapiens
gaauaaagccugcuuuuu

SEQ ID NO: 1169377 - RNA, 20 nt, Homo sapiens
gaauaauaaaaucaaaaacu

SEQ ID NO: 1169378 - RNA, 17 nt, Homo sapiens
gaauaaucuccuguuaa

SEQ ID NO: 1169379 - RNA, 23 nt, Homo sapiens
gaauaauucaucuuugugccaau

SEQ ID NO: 1169380 - RNA, 18 nt, Homo sapiens
gaauacacuuaacauaga

SEQ ID NO: 1169381 - RNA, 17 nt, Homo sapiens
gaauacucuucccacau

SEQ ID NO: 1169382 - RNA, 16 nt, Homo sapiens
gaauacugccaaaaca

SEQ ID NO: 1169383 - RNA, 16 nt, Homo sapiens
gaauaguaugaugcuu

SEQ ID NO: 1169384 - RNA, 18 nt, Homo sapiens
gaauauaaggaaagcaau

SEQ ID NO: 1169385 - RNA, 16 nt, Homo sapiens
gaauauucccaauauu

SEQ ID NO: 1169386 - RNA, 22 nt, Homo sapiens
gaauauuguuuuugcaccagac

SEQ ID NO: 1169387 - RNA, 21 nt, Homo sapiens
gaaucacaucuuuuaagacaa

SEQ ID NO: 1169388 - RNA, 14 nt, Homo sapiens
gaaucacucuugug

SEQ ID NO: 1169389 - RNA, 18 nt, Homo sapiens
gaaucagacuucacacug

SEQ ID NO: 1169390 - RNA, 16 nt, Homo sapiens
gaaucagauuuuaaca

SEQ ID NO: 1169391 - RNA, 14 nt, Homo sapiens
gaaucaguuuccaa

SEQ ID NO: 1169392 - RNA, 15 nt, Homo sapiens
gaaucaucauaucua

SEQ ID NO: 1169393 - RNA, 18 nt, Homo sapiens
gaaucccucuaucucuaa

SEQ ID NO: 1169394 - RNA, 17 nt, Homo sapiens
gaauccuccuccagggu

SEQ ID NO: 1169395 - RNA, 18 nt, Homo sapiens
gaauccugaccugagcca

SEQ ID NO: 1169396 - RNA, 17 nt, Homo sapiens
gaaucugcccacucggg

SEQ ID NO: 1169397 - RNA, 19 nt, Homo sapiens
gaaucuguagcugugcuuu

SEQ ID NO: 1169398 - RNA, 21 nt, Homo sapiens
gaaucuuugucagcaguuccc

SEQ ID NO: 1169399 - RNA, 15 nt, Homo sapiens
gaaugaaagacugaa

SEQ ID NO: 1169400 - RNA, 14 nt, Homo sapiens
gaaugaaccacugc

SEQ ID NO: 1169401 - RNA, 18 nt, Homo sapiens
gaaugaggcugcuuucca

SEQ ID NO: 1169402 - RNA, 19 nt, Homo sapiens
gaaugcagcacugcugccu

SEQ ID NO: 1169403 - RNA, 20 nt, Homo sapiens
gaaugcagcacugcugccuc

SEQ ID NO: 1169404 - RNA, 22 nt, Homo sapiens
gaaugccauuggaaccuguuaa

SEQ ID NO: 1169405 - RNA, 20 nt, Homo sapiens
gaaugcggccgcauucccug

SEQ ID NO: 1169406 - RNA, 15 nt, Homo sapiens
gaauguacuugauau

SEQ ID NO: 1169407 - RNA, 23 nt, Homo sapiens
gaauguaugcuucauacagggau

SEQ ID NO: 1169408 - RNA, 18 nt, Homo sapiens
gaaugugggucugcaccu

SEQ ID NO: 1169409 - RNA, 16 nt, Homo sapiens
gaauguuaacagguau

SEQ ID NO: 1169410 - RNA, 16 nt, Homo sapiens
gaauguuaagacuuga

SEQ ID NO: 1169411 - RNA, 17 nt, Homo sapiens
gaauuaaaauaaaacac

SEQ ID NO: 1169412 - RNA, 12 nt, Homo sapiens
gaauuaagcaaa

SEQ ID NO: 1169413 - RNA, 19 nt, Homo sapiens
gaauuaauucagauguuuu

SEQ ID NO: 1169414 - RNA, 21 nt, Homo sapiens
gaauuagauguuuauaucaaa

SEQ ID NO: 1169415 - RNA, 23 nt, Homo sapiens
gaauuagcuuggggccagggaag

SEQ ID NO: 1169416 - RNA, 17 nt, Homo sapiens
gaauuagucgguuagaa

SEQ ID NO: 1169417 - RNA, 15 nt, Homo sapiens
gaauucaauuugaac

SEQ ID NO: 1169418 - RNA, 15 nt, Homo sapiens
gaauuccaaguguau

SEQ ID NO: 1169419 - RNA, 20 nt, Homo sapiens
gacuauggauaaacuaaaca

SEQ ID NO: 1169420 - RNA, 11 nt, Homo sapiens
gacuauguaau

SEQ ID NO: 1169421 - RNA, 12 nt, Homo sapiens
gacuauuuccac

SEQ ID NO: 1169422 - RNA, 19 nt, Homo sapiens
gacucaaauguucuaaguu

SEQ ID NO: 1169423 - RNA, 18 nt, Homo sapiens
gacucacccuccacaaag

SEQ ID NO: 1169424 - RNA, 21 nt, Homo sapiens
gacucagagaaccagugcaga

SEQ ID NO: 1169425 - RNA, 22 nt, Homo sapiens
gacucagggcugguucagggcu

SEQ ID NO: 1169426 - RNA, 18 nt, Homo sapiens
gacucaugguguguuaca

SEQ ID NO: 1169427 - RNA, 13 nt, Homo sapiens
gacuccaucucaa

SEQ ID NO: 1169428 - RNA, 18 nt, Homo sapiens
gacucccccaaccaagga

SEQ ID NO: 1169429 - RNA, 12 nt, Homo sapiens
gacuccucauca

SEQ ID NO: 1169430 - RNA, 21 nt, Homo sapiens
gacuccucuuaauguuuccaa

SEQ ID NO: 1169431 - RNA, 18 nt, Homo sapiens
gacuccucuuugugcaga

SEQ ID NO: 1169432 - RNA, 14 nt, Homo sapiens
gacuccugaggaca

SEQ ID NO: 1169433 - RNA, 18 nt, Homo sapiens
gacuccugaggacagcug

SEQ ID NO: 1169434 - RNA, 23 nt, Homo sapiens
gacuccuuugguauuucacugaa

SEQ ID NO: 1169435 - RNA, 14 nt, Homo sapiens
gacucgggccuuag

SEQ ID NO: 1169436 - RNA, 23 nt, Homo sapiens
gacucugaccccagcauucucag

SEQ ID NO: 1169437 - RNA, 16 nt, Homo sapiens
gacucuguaaccaccu

SEQ ID NO: 1169438 - RNA, 12 nt, Homo sapiens
gacucuugcaau

SEQ ID NO: 1169439 - RNA, 17 nt, Homo sapiens
gacucuuuaugcuugca

SEQ ID NO: 1169440 - RNA, 18 nt, Homo sapiens
gacucuuuaugcuugcaa

SEQ ID NO: 1169441 - RNA, 18 nt, Homo sapiens
gacugaaaagccaugugu

SEQ ID NO: 1169442 - RNA, 20 nt, Homo sapiens
gacugaagcgaacaucuuca

SEQ ID NO: 1169443 - RNA, 21 nt, Homo sapiens
gacugaagcgaacaucuucau

SEQ ID NO: 1169444 - RNA, 13 nt, Homo sapiens
gacugaauaccua

SEQ ID NO: 1169445 - RNA, 19 nt, Homo sapiens
gacugaauaccuauaauua

SEQ ID NO: 1169446 - RNA, 17 nt, Homo sapiens
gacugauaaaacucaaa

SEQ ID NO: 1169447 - RNA, 22 nt, Homo sapiens
gacugcacagcguccuguccac

SEQ ID NO: 1169448 - RNA, 18 nt, Homo sapiens
gacugcggugaacauuuc

SEQ ID NO: 1169449 - RNA, 14 nt, Homo sapiens
gacugcuaccuuuc

SEQ ID NO: 1169450 - RNA, 21 nt, Homo sapiens
gacugcugaaucaucauaucu

SEQ ID NO: 1169451 - RNA, 13 nt, Homo sapiens
gacugcugcugaa

SEQ ID NO: 1169452 - RNA, 14 nt, Homo sapiens
gacuggcacacugg

SEQ ID NO: 1169453 - RNA, 22 nt, Homo sapiens
gacuggcagcauugacucugug

SEQ ID NO: 1169454 - RNA, 16 nt, Homo sapiens
gacuggcuuuuauuaa

SEQ ID NO: 1169455 - RNA, 19 nt, Homo sapiens
gacugggucugaccuggug

SEQ ID NO: 1169456 - RNA, 16 nt, Homo sapiens
gacuuaaaacaaaagg

SEQ ID NO: 1169457 - RNA, 18 nt, Homo sapiens
gacuuauuuaaacucugu

SEQ ID NO: 1169458 - RNA, 23 nt, Homo sapiens
gacuucacagauuuguccaggcu

SEQ ID NO: 1169459 - RNA, 21 nt, Homo sapiens
gacuucaccuaacuagagaca

SEQ ID NO: 1169460 - RNA, 22 nt, Homo sapiens
gacuucaugacaagcauuuugu

SEQ ID NO: 1169461 - RNA, 17 nt, Homo sapiens
gacuucugcaucuuaca

SEQ ID NO: 1169462 - RNA, 21 nt, Homo sapiens
gacuucugcaucuuacaguca

SEQ ID NO: 1169463 - RNA, 16 nt, Homo sapiens
gacuugaaucaaguca

SEQ ID NO: 1169464 - RNA, 16 nt, Homo sapiens
gacuuguagucuccau

SEQ ID NO: 1169465 - RNA, 15 nt, Homo sapiens
gacuuuaggcuuuca

SEQ ID NO: 1169466 - RNA, 17 nt, Homo sapiens
gacuuugcagauggaaa

SEQ ID NO: 1169467 - RNA, 15 nt, Homo sapiens
gacuuuuaaugucau

SEQ ID NO: 1169468 - RNA, 19 nt, Homo sapiens
gacuuuugaagaacaaaag

SEQ ID NO: 1169469 - RNA, 23 nt, Homo sapiens
gacuuuuuguacugaaaacaauu

SEQ ID NO: 1169470 - RNA, 22 nt, Homo sapiens
gagaaaaaaaaacacacaaaaa

SEQ ID NO: 1169471 - RNA, 14 nt, Homo sapiens
gagaaaaagggagg

SEQ ID NO: 1169472 - RNA, 12 nt, Homo sapiens
gagaaaacacuu

SEQ ID NO: 1169473 - RNA, 13 nt, Homo sapiens
gagaaaucuggcu

SEQ ID NO: 1169474 - RNA, 15 nt, Homo sapiens
gagaaaugucuuuug

SEQ ID NO: 1169475 - RNA, 21 nt, Homo sapiens
gagaacaaagagugaaauauu

SEQ ID NO: 1169476 - RNA, 17 nt, Homo sapiens
gagaacaacaugggagc

SEQ ID NO: 1169477 - RNA, 16 nt, Homo sapiens
gagaacaaugugcuau

SEQ ID NO: 1169478 - RNA, 20 nt, Homo sapiens
gagaaccagugcagacucaa

SEQ ID NO: 1169479 - RNA, 16 nt, Homo sapiens
gagaacccuugcacua

SEQ ID NO: 1169480 - RNA, 18 nt, Homo sapiens
gagaaccuuuccacuccc

SEQ ID NO: 1169481 - RNA, 18 nt, Homo sapiens
gagaacggugaccgccuc

SEQ ID NO: 1169482 - RNA, 17 nt, Homo sapiens
acuuauuauuauuguua

SEQ ID NO: 1169483 - RNA, 21 nt, Homo sapiens
acuuauuguggauaacaaaga

SEQ ID NO: 1169484 - RNA, 16 nt, Homo sapiens
acuucaaacugagauc

SEQ ID NO: 1169485 - RNA, 19 nt, Homo sapiens
acuucaagaucugaauuug

SEQ ID NO: 1169486 - RNA, 22 nt, Homo sapiens
acuucacugugcucaucaagaa

SEQ ID NO: 1169487 - RNA, 17 nt, Homo sapiens
acuucaggggcacuuca

SEQ ID NO: 1169488 - RNA, 17 nt, Homo sapiens
acuucauagaaaccucu

SEQ ID NO: 1169489 - RNA, 21 nt, Homo sapiens
acuucauagaaaccucucuau

SEQ ID NO: 1169490 - RNA, 17 nt, Homo sapiens
acuuccagcaaaaucca

SEQ ID NO: 1169491 - RNA, 14 nt, Homo sapiens
acuuccagcauuua

SEQ ID NO: 1169492 - RNA, 20 nt, Homo sapiens
acuuccccgcauuccaggcu

SEQ ID NO: 1169493 - RNA, 15 nt, Homo sapiens
acuuccuugcuuaag

SEQ ID NO: 1169494 - RNA, 14 nt, Homo sapiens
acuucgaaaccugg

SEQ ID NO: 1169495 - RNA, 15 nt, Homo sapiens
acuucgaugaugaug

SEQ ID NO: 1169496 - RNA, 15 nt, Homo sapiens
acuucuaaaugaagu

SEQ ID NO: 1169497 - RNA, 22 nt, Homo sapiens
acuucucagccugguacuugua

SEQ ID NO: 1169498 - RNA, 22 nt, Homo sapiens
acuucucugagucagcugaccc

SEQ ID NO: 1169499 - RNA, 23 nt, Homo sapiens
acuucugaacuuggaaaggggaa

SEQ ID NO: 1169500 - RNA, 22 nt, Homo sapiens
acuucugaagagaccacucaau

SEQ ID NO: 1169501 - RNA, 15 nt, Homo sapiens
acuucuggaagucau

SEQ ID NO: 1169502 - RNA, 12 nt, Homo sapiens
acuucuguguac

SEQ ID NO: 1169503 - RNA, 14 nt, Homo sapiens
acuugaacacugau

SEQ ID NO: 1169504 - RNA, 23 nt, Homo sapiens
acuugaacccgggggacagaggu

SEQ ID NO: 1169505 - RNA, 23 nt, Homo sapiens
acuugaguuagcauaauacagaa

SEQ ID NO: 1169506 - RNA, 20 nt, Homo sapiens
acuugauucauaaagauuca

SEQ ID NO: 1169507 - RNA, 14 nt, Homo sapiens
acuugcaagccuca

SEQ ID NO: 1169508 - RNA, 17 nt, Homo sapiens
acuugcaccucaugucc

SEQ ID NO: 1169509 - RNA, 13 nt, Homo sapiens
acuugcacugggg

SEQ ID NO: 1169510 - RNA, 19 nt, Homo sapiens
acuugcagaggagcccagu

SEQ ID NO: 1169511 - RNA, 12 nt, Homo sapiens
acuugcauuuau

SEQ ID NO: 1169512 - RNA, 19 nt, Homo sapiens
acuugcuuauuacauuuaa

SEQ ID NO: 1169513 - RNA, 21 nt, Homo sapiens
acuuggaaauggcaugcaaaa

SEQ ID NO: 1169514 - RNA, 16 nt, Homo sapiens
acuuggacuuguccuc

SEQ ID NO: 1169515 - RNA, 21 nt, Homo sapiens
acuuggagggcucagggcagu

SEQ ID NO: 1169516 - RNA, 15 nt, Homo sapiens
acuuggaguguucau

SEQ ID NO: 1169517 - RNA, 15 nt, Homo sapiens
acuuggccaguuuuc

SEQ ID NO: 1169518 - RNA, 21 nt, Homo sapiens
acuuggccaguuuucuguuca

SEQ ID NO: 1169519 - RNA, 18 nt, Homo sapiens
acuugggaauaaaucaua

SEQ ID NO: 1169520 - RNA, 15 nt, Homo sapiens
acuugggauucugac

SEQ ID NO: 1169521 - RNA, 19 nt, Homo sapiens
acuugucccgggacaccua

SEQ ID NO: 1169522 - RNA, 13 nt, Homo sapiens
acuugugcuauaa

SEQ ID NO: 1169523 - RNA, 12 nt, Homo sapiens
acuuguguuacu

SEQ ID NO: 1169524 - RNA, 18 nt, Homo sapiens
acuuguuugguugcaaaa

SEQ ID NO: 1169525 - RNA, 22 nt, Homo sapiens
acuuguuuuugaguuuucuuau

SEQ ID NO: 1169526 - RNA, 15 nt, Homo sapiens
acuuuaaaacuguau

SEQ ID NO: 1169527 - RNA, 17 nt, Homo sapiens
acuuuaaaagugaucua

SEQ ID NO: 1169528 - RNA, 21 nt, Homo sapiens
acuuuaguguauuuucuguca

SEQ ID NO: 1169529 - RNA, 22 nt, Homo sapiens
acuuuaucaaagauuggccaug

SEQ ID NO: 1169530 - RNA, 13 nt, Homo sapiens
acuuuaucaauua

SEQ ID NO: 1169531 - RNA, 18 nt, Homo sapiens
acuuuaugugcaucuuau

SEQ ID NO: 1169532 - RNA, 15 nt, Homo sapiens
acuuucaaacauaua

SEQ ID NO: 1169533 - RNA, 13 nt, Homo sapiens
acuuucauuugaa

SEQ ID NO: 1169534 - RNA, 14 nt, Homo sapiens
acuuucuguuacua

SEQ ID NO: 1169535 - RNA, 15 nt, Homo sapiens
acuuucuucuaccag

SEQ ID NO: 1169536 - RNA, 15 nt, Homo sapiens
acuuugaaccauaaa

SEQ ID NO: 1169537 - RNA, 22 nt, Homo sapiens
acuuugaagagaugagcaguga

SEQ ID NO: 1169538 - RNA, 22 nt, Homo sapiens
acuuugauucugauaaugcuca

SEQ ID NO: 1169539 - RNA, 14 nt, Homo sapiens
acuuugcaucacag

SEQ ID NO: 1169540 - RNA, 12 nt, Homo sapiens
acuuugccauuu

SEQ ID NO: 1169541 - RNA, 18 nt, Homo sapiens
acuuugccauuucaucug

SEQ ID NO: 1169542 - RNA, 19 nt, Homo sapiens
acuuugguuugaacacaau

SEQ ID NO: 1169543 - RNA, 15 nt, Homo sapiens
acuuuguuuacuuau

SEQ ID NO: 1169544 - RNA, 13 nt, Homo sapiens
acuuuuaauguca

SEQ ID NO: 1169545 - RNA, 16 nt, Homo sapiens
acuuuucaccuccuuc

SEQ ID NO: 1169546 - RNA, 21 nt, Homo sapiens
acuuuuuccuggcucaucucu

SEQ ID NO: 1169547 - RNA, 23 nt, Homo sapiens
agaaaaaaauucaugauacucau

SEQ ID NO: 1169548 - RNA, 17 nt, Homo sapiens
agaaaaacaccgcuucu

SEQ ID NO: 1169549 - RNA, 13 nt, Homo sapiens
agaaaacuggaaa

SEQ ID NO: 1169550 - RNA, 12 nt, Homo sapiens
agaaaagaccuu

SEQ ID NO: 1169551 - RNA, 19 nt, Homo sapiens
agaaaagauuauauauuau

SEQ ID NO: 1169552 - RNA, 13 nt, Homo sapiens
agaaaagcacauu

SEQ ID NO: 1169553 - RNA, 17 nt, Homo sapiens
agaaaagccucagcuca

SEQ ID NO: 1169554 - RNA, 17 nt, Homo sapiens
agaaaauagagcuuuua

SEQ ID NO: 1169555 - RNA, 12 nt, Homo sapiens
agaaaauuuauc

SEQ ID NO: 1169556 - RNA, 16 nt, Homo sapiens
agaaacaacacaguuu

SEQ ID NO: 1169557 - RNA, 23 nt, Homo sapiens
agaaacaaccguuggaaacauaa

SEQ ID NO: 1169558 - RNA, 22 nt, Homo sapiens
agaaacaauauuuaaccaaaga

SEQ ID NO: 1169559 - RNA, 12 nt, Homo sapiens
agaaacacuuga

SEQ ID NO: 1169560 - RNA, 10 nt, Homo sapiens
agaaacagcu

SEQ ID NO: 1169561 - RNA, 15 nt, Homo sapiens
agaaacaucuagaaa

SEQ ID NO: 1169562 - RNA, 19 nt, Homo sapiens
agaaaccaagucuacuuca

SEQ ID NO: 1169563 - RNA, 15 nt, Homo sapiens
agaaaccaggcccug

SEQ ID NO: 1169564 - RNA, 12 nt, Homo sapiens
agaaacccaagu

SEQ ID NO: 1169565 - RNA, 15 nt, Homo sapiens
agaaaccuguaucuu

SEQ ID NO: 1169566 - RNA, 23 nt, Homo sapiens
agaaacuaccuuuuuauaaugca

SEQ ID NO: 1169567 - RNA, 13 nt, Homo sapiens
agaaacucaaugc

SEQ ID NO: 1169568 - RNA, 16 nt, Homo sapiens
agaaacuccagacuug

SEQ ID NO: 1169569 - RNA, 18 nt, Homo sapiens
agaaacuuugaguacaga

SEQ ID NO: 1169570 - RNA, 19 nt, Homo sapiens
agaaacuuugaguacagau

SEQ ID NO: 1169571 - RNA, 19 nt, Homo sapiens
agaaacuuuggaagcacuu

SEQ ID NO: 1169572 - RNA, 22 nt, Homo sapiens
agaaagaaaaauuaucuugaau

SEQ ID NO: 1169573 - RNA, 13 nt, Homo sapiens
agaaagaacuguc

SEQ ID NO: 1169574 - RNA, 16 nt, Homo sapiens
agaaagacaucuuucu

SEQ ID NO: 1169575 - RNA, 14 nt, Homo sapiens
agaaagaucaaaga

SEQ ID NO: 1169576 - RNA, 15 nt, Homo sapiens
agaaagaucaaagac

SEQ ID NO: 1169577 - RNA, 16 nt, Homo sapiens
agaaagccucagugaa

SEQ ID NO: 1169578 - RNA, 22 nt, Homo sapiens
agaaagcuuaaauacaccuuuu

SEQ ID NO: 1169579 - RNA, 21 nt, Homo sapiens
agaaagggcggugaacucugg

SEQ ID NO: 1169580 - RNA, 18 nt, Homo sapiens
agaaagugaagcaaauca

SEQ ID NO: 1169581 - RNA, 16 nt, Homo sapiens
agaaaguggucuuaag

SEQ ID NO: 1169582 - RNA, 17 nt, Homo sapiens
agaaaguggugcucagu

SEQ ID NO: 1169583 - RNA, 12 nt, Homo sapiens
agaaaguguuca

SEQ ID NO: 1169584 - RNA, 14 nt, Homo sapiens
agaaauaaccacug

SEQ ID NO: 1169585 - RNA, 16 nt, Homo sapiens
agaaauaaccaugaaa

SEQ ID NO: 1169586 - RNA, 18 nt, Homo sapiens
agaaauaauaauauccag

SEQ ID NO: 1169587 - RNA, 15 nt, Homo sapiens
agaaauauauauaac

SEQ ID NO: 1169588 - RNA, 13 nt, Homo sapiens
agaaaucacuccu

SEQ ID NO: 1169589 - RNA, 22 nt, Homo sapiens
agaaaucuagaauuuuuacuua

SEQ ID NO: 1169590 - RNA, 21 nt, Homo sapiens
agaaaucuguccuguggcaug

SEQ ID NO: 1169591 - RNA, 19 nt, Homo sapiens
agaaaucugugccugagaa

SEQ ID NO: 1169592 - RNA, 20 nt, Homo sapiens
agaaaugaggaggaugcuaa

SEQ ID NO: 1169593 - RNA, 21 nt, Homo sapiens
agaaaugaggaggaugcuaaa

SEQ ID NO: 1169594 - RNA, 16 nt, Homo sapiens
agaaauggauucuauu

SEQ ID NO: 1169595 - RNA, 23 nt, Homo sapiens
agaaaugucauguggcuaccugu

SEQ ID NO: 1169596 - RNA, 19 nt, Homo sapiens
agaaaugugucaucaggag

SEQ ID NO: 1169597 - RNA, 22 nt, Homo sapiens
agaaauuaacaaaugugcugcu

SEQ ID NO: 1169598 - RNA, 21 nt, Homo sapiens
agaaauuagugccacaaauaa

SEQ ID NO: 1169599 - RNA, 21 nt, Homo sapiens
agaaauucuuaauuuggaucu

SEQ ID NO: 1169600 - RNA, 17 nt, Homo sapiens
agaaauugacagaucaa

SEQ ID NO: 1169601 - RNA, 14 nt, Homo sapiens
agaacaaaaccucu

SEQ ID NO: 1169602 - RNA, 16 nt, Homo sapiens
agaacaaaaggcuuug

SEQ ID NO: 1169603 - RNA, 20 nt, Homo sapiens
agaacaauaucgacuucccc

SEQ ID NO: 1169604 - RNA, 19 nt, Homo sapiens
agaacacagugauuuuauu

SEQ ID NO: 1169605 - RNA, 17 nt, Homo sapiens
agaacagagaagcccuu

SEQ ID NO: 1169606 - RNA, 16 nt, Homo sapiens
agaacagaggcauuua

SEQ ID NO: 1169607 - RNA, 15 nt, Homo sapiens
agaacagcagacuca

SEQ ID NO: 1169608 - RNA, 20 nt, Homo sapiens
agaacaucauaacccaugaa

SEQ ID NO: 1169609 - RNA, 22 nt, Homo sapiens
agaacaucauuagaacaaagga

SEQ ID NO: 1169610 - RNA, 21 nt, Homo sapiens
agaacaugaaucaaaagugcc

SEQ ID NO: 1169611 - RNA, 22 nt, Homo sapiens
agaacaugaaucaaaagugccu

SEQ ID NO: 1169612 - RNA, 13 nt, Homo sapiens
agaaccacugucu

SEQ ID NO: 1169613 - RNA, 23 nt, Homo sapiens
agaaccauccauaguaguaugau

SEQ ID NO: 1169614 - RNA, 19 nt, Homo sapiens
agcaucugaccaucuguga

SEQ ID NO: 1169615 - RNA, 12 nt, Homo sapiens
agcaugaagucu

SEQ ID NO: 1169616 - RNA, 22 nt, Homo sapiens
agcauggguuagugcuauggug

SEQ ID NO: 1169617 - RNA, 16 nt, Homo sapiens
agcauguguucuguua

SEQ ID NO: 1169618 - RNA, 15 nt, Homo sapiens
agcauuacaguauuu

SEQ ID NO: 1169619 - RNA, 16 nt, Homo sapiens
agcauuacaguauuuu

SEQ ID NO: 1169620 - RNA, 16 nt, Homo sapiens
agcauuccaugagcug

SEQ ID NO: 1169621 - RNA, 14 nt, Homo sapiens
agcauugcuuucug

SEQ ID NO: 1169622 - RNA, 10 nt, Homo sapiens
agcauugugu

SEQ ID NO: 1169623 - RNA, 16 nt, Homo sapiens
agcauuuaauccaaac

SEQ ID NO: 1169624 - RNA, 15 nt, Homo sapiens
agcauuuagugcaca

SEQ ID NO: 1169625 - RNA, 18 nt, Homo sapiens
agcauuuuugcacuggau

SEQ ID NO: 1169626 - RNA, 15 nt, Homo sapiens
agccaaaccccuaga

SEQ ID NO: 1169627 - RNA, 14 nt, Homo sapiens
agccaacagcuaca

SEQ ID NO: 1169628 - RNA, 17 nt, Homo sapiens
agccaagcuguguucau

SEQ ID NO: 1169629 - RNA, 20 nt, Homo sapiens
agccaaggccgagaccccau

SEQ ID NO: 1169630 - RNA, 13 nt, Homo sapiens
agccaaugugaac

SEQ ID NO: 1169631 - RNA, 15 nt, Homo sapiens
agccacacaugggca

SEQ ID NO: 1169632 - RNA, 12 nt, Homo sapiens
agccacacucug

SEQ ID NO: 1169633 - RNA, 22 nt, Homo sapiens
agccacacucugggcuccagag

SEQ ID NO: 1169634 - RNA, 23 nt, Homo sapiens
agccacccucccagcucugagga

SEQ ID NO: 1169635 - RNA, 17 nt, Homo sapiens
agccacgaggugcaaca

SEQ ID NO: 1169636 - RNA, 22 nt, Homo sapiens
agccacuuuuagcuacugcuaa

SEQ ID NO: 1169637 - RNA, 17 nt, Homo sapiens
agccagacuuguucuca

SEQ ID NO: 1169638 - RNA, 21 nt, Homo sapiens
agccagaguuggauaagccaa

SEQ ID NO: 1169639 - RNA, 14 nt, Homo sapiens
agccagcacuugua

SEQ ID NO: 1169640 - RNA, 21 nt, Homo sapiens
agccaggugugguggugcaca

SEQ ID NO: 1169641 - RNA, 13 nt, Homo sapiens
agccagucaaaac

SEQ ID NO: 1169642 - RNA, 13 nt, Homo sapiens
agccaguggugcu

SEQ ID NO: 1169643 - RNA, 14 nt, Homo sapiens
agccaguggugcua

SEQ ID NO: 1169644 - RNA, 23 nt, Homo sapiens
agccagugugacacugcuuuaaa

SEQ ID NO: 1169645 - RNA, 18 nt, Homo sapiens
agccaguuaaaauguguu

SEQ ID NO: 1169646 - RNA, 22 nt, Homo sapiens
agccaguuaauuuuaagaauuu

SEQ ID NO: 1169647 - RNA, 21 nt, Homo sapiens
agccauauaaguuugaaggaa

SEQ ID NO: 1169648 - RNA, 19 nt, Homo sapiens
agccaucaagagacugagu

SEQ ID NO: 1169649 - RNA, 23 nt, Homo sapiens
agcccaagagauuguugcuuugu

SEQ ID NO: 1169650 - RNA, 17 nt, Homo sapiens
agcccacccugcugcug

SEQ ID NO: 1169651 - RNA, 20 nt, Homo sapiens
agcccagaggccaacacugu

SEQ ID NO: 1169652 - RNA, 16 nt, Homo sapiens
agcccagcagaucuca

SEQ ID NO: 1169653 - RNA, 13 nt, Homo sapiens
agcccagcauuuc

SEQ ID NO: 1169654 - RNA, 19 nt, Homo sapiens
agcccagcucuugcucucu

SEQ ID NO: 1169655 - RNA, 20 nt, Homo sapiens
agcccagugggcugcacgcu

SEQ ID NO: 1169656 - RNA, 14 nt, Homo sapiens
agcccauccauagu

SEQ ID NO: 1169657 - RNA, 14 nt, Homo sapiens
agccccacugcccu

SEQ ID NO: 1169658 - RNA, 15 nt, Homo sapiens
agccccaucugugca

SEQ ID NO: 1169659 - RNA, 14 nt, Homo sapiens
agcccccaccucag

SEQ ID NO: 1169660 - RNA, 22 nt, Homo sapiens
agcccccagcuaagaaccugga

SEQ ID NO: 1169661 - RNA, 15 nt, Homo sapiens
agcccccccuuccac

SEQ ID NO: 1169662 - RNA, 21 nt, Homo sapiens
agcccccuguuuuaugcccuu

SEQ ID NO: 1169663 - RNA, 16 nt, Homo sapiens
agcccccuuuucuuga

SEQ ID NO: 1169664 - RNA, 22 nt, Homo sapiens
agccccuccccccaggcucagg

SEQ ID NO: 1169665 - RNA, 16 nt, Homo sapiens
agccccugcuccagaa

SEQ ID NO: 1169666 - RNA, 17 nt, Homo sapiens
agccccuucugcucagc

SEQ ID NO: 1169667 - RNA, 20 nt, Homo sapiens
agccccuuggauuacuuugu

SEQ ID NO: 1169668 - RNA, 23 nt, Homo sapiens
agcccguccuccucuaccucucu

SEQ ID NO: 1169669 - RNA, 13 nt, Homo sapiens
agcccucagggcu

SEQ ID NO: 1169670 - RNA, 16 nt, Homo sapiens
agcccucccacuuugc

SEQ ID NO: 1169671 - RNA, 20 nt, Homo sapiens
agcccuccgccuucacauuc

SEQ ID NO: 1169672 - RNA, 20 nt, Homo sapiens
agcccuccucucccagugac

SEQ ID NO: 1169673 - RNA, 23 nt, Homo sapiens
agcccuccucucccagugacaac

SEQ ID NO: 1169674 - RNA, 17 nt, Homo sapiens
agcccugccaugucaca

SEQ ID NO: 1169675 - RNA, 19 nt, Homo sapiens
agcccugccaugucacaau

SEQ ID NO: 1169676 - RNA, 13 nt, Homo sapiens
agcccugcugcuu

SEQ ID NO: 1169677 - RNA, 17 nt, Homo sapiens
agcccugggaucacugu

SEQ ID NO: 1169678 - RNA, 19 nt, Homo sapiens
agcccuggggacaccugcc

SEQ ID NO: 1169679 - RNA, 19 nt, Homo sapiens
agcccuuccuugccaguga

SEQ ID NO: 1169680 - RNA, 19 nt, Homo sapiens
agccgcagacaaguaauca

SEQ ID NO: 1169681 - RNA, 22 nt, Homo sapiens
agccgcagagacccucucagcc

SEQ ID NO: 1169682 - RNA, 12 nt, Homo sapiens
agccgcccugag

SEQ ID NO: 1169683 - RNA, 17 nt, Homo sapiens
agccggacacuucucag

SEQ ID NO: 1169684 - RNA, 19 nt, Homo sapiens
agccgggcaugauggugca

SEQ ID NO: 1169685 - RNA, 20 nt, Homo sapiens
agccguugugcgaagacaga

SEQ ID NO: 1169686 - RNA, 13 nt, Homo sapiens
agccuaaaagaca

SEQ ID NO: 1169687 - RNA, 21 nt, Homo sapiens
agccuauguaugccauggagg

SEQ ID NO: 1169688 - RNA, 14 nt, Homo sapiens
agccucaaguucca

SEQ ID NO: 1169689 - RNA, 22 nt, Homo sapiens
agccucacguauuucacagagc

SEQ ID NO: 1169690 - RNA, 12 nt, Homo sapiens
agccucacuuau

SEQ ID NO: 1169691 - RNA, 19 nt, Homo sapiens
agccucacuuggucugcca

SEQ ID NO: 1169692 - RNA, 12 nt, Homo sapiens
agccucaucucu

SEQ ID NO: 1169693 - RNA, 13 nt, Homo sapiens
agccucaucucuu

SEQ ID NO: 1169694 - RNA, 14 nt, Homo sapiens
agccucaucucuuu

SEQ ID NO: 1169695 - RNA, 13 nt, Homo sapiens
agccuccagcugc

SEQ ID NO: 1169696 - RNA, 18 nt, Homo sapiens
agccuccggcggggaccc

SEQ ID NO: 1169697 - RNA, 13 nt, Homo sapiens
agccuccucugga

SEQ ID NO: 1169698 - RNA, 16 nt, Homo sapiens
agccucgcucuugucu

SEQ ID NO: 1169699 - RNA, 15 nt, Homo sapiens
agccugaauuucuca

SEQ ID NO: 1169700 - RNA, 16 nt, Homo sapiens
agccugaccaacaugg

SEQ ID NO: 1169701 - RNA, 22 nt, Homo sapiens
agccugaguccacgaccuaggc

SEQ ID NO: 1169702 - RNA, 13 nt, Homo sapiens
agccugcagucau

SEQ ID NO: 1169703 - RNA, 22 nt, Homo sapiens
agccugccagcaguuacuguga

SEQ ID NO: 1169704 - RNA, 20 nt, Homo sapiens
agccugcucccucacccagg

SEQ ID NO: 1169705 - RNA, 16 nt, Homo sapiens
agccuggacugcuacc

SEQ ID NO: 1169706 - RNA, 18 nt, Homo sapiens
agccuggccaacauggug

SEQ ID NO: 1169707 - RNA, 14 nt, Homo sapiens
agccuggcuccaaa

SEQ ID NO: 1169708 - RNA, 16 nt, Homo sapiens
agccugggaggcacag

SEQ ID NO: 1169709 - RNA, 19 nt, Homo sapiens
agccugggaggcacagcaa

SEQ ID NO: 1169710 - RNA, 19 nt, Homo sapiens
agccugggauuucuaugca

SEQ ID NO: 1169711 - RNA, 21 nt, Homo sapiens
agccugggauuucuaugcagu

SEQ ID NO: 1169712 - RNA, 16 nt, Homo sapiens
agccuggggccaagca

SEQ ID NO: 1169713 - RNA, 17 nt, Homo sapiens
agccuggggcuugaauu

SEQ ID NO: 1169714 - RNA, 22 nt, Homo sapiens
agccuggugggaaaaugcacac

SEQ ID NO: 1169715 - RNA, 14 nt, Homo sapiens
agccugucccagga

SEQ ID NO: 1169716 - RNA, 14 nt, Homo sapiens
agccugugcaaaaa

SEQ ID NO: 1169717 - RNA, 15 nt, Homo sapiens
agccugugcaaaaaa

SEQ ID NO: 1169718 - RNA, 16 nt, Homo sapiens
agccuguggccuuugc

SEQ ID NO: 1169719 - RNA, 23 nt, Homo sapiens
agccugugguggccuggugcaca

SEQ ID NO: 1169720 - RNA, 22 nt, Homo sapiens
agccuuaguuccccaucuacaa

SEQ ID NO: 1169721 - RNA, 20 nt, Homo sapiens
agccuucugaggacauucca

SEQ ID NO: 1169722 - RNA, 13 nt, Homo sapiens
agccuuugaucuu

SEQ ID NO: 1169723 - RNA, 17 nt, Homo sapiens
agccuuugccagccauu

SEQ ID NO: 1169724 - RNA, 13 nt, Homo sapiens
agcgaacaugccu

SEQ ID NO: 1169725 - RNA, 11 nt, Homo sapiens
agcgagaagau

SEQ ID NO: 1169726 - RNA, 18 nt, Homo sapiens
agcgauguaugcagcuau

SEQ ID NO: 1169727 - RNA, 14 nt, Homo sapiens
agcgcaaugccauc

SEQ ID NO: 1169728 - RNA, 22 nt, Homo sapiens
agcgccuuucccaacucuagcu

SEQ ID NO: 1169729 - RNA, 11 nt, Homo sapiens
agcgcucuccu

SEQ ID NO: 1169730 - RNA, 16 nt, Homo sapiens
agcggaaagcagcuca

SEQ ID NO: 1169731 - RNA, 11 nt, Homo sapiens
agcggacauca

SEQ ID NO: 1169732 - RNA, 18 nt, Homo sapiens
agcggaucucacucagcc

SEQ ID NO: 1169733 - RNA, 23 nt, Homo sapiens
agcggccacggugccuccagaug

SEQ ID NO: 1169734 - RNA, 23 nt, Homo sapiens
agcggggaggggaggaacaggga

SEQ ID NO: 1169735 - RNA, 14 nt, Homo sapiens
agcgguugccagga

SEQ ID NO: 1169736 - RNA, 15 nt, Homo sapiens
agcgucugugcauuu

SEQ ID NO: 1169737 - RNA, 23 nt, Homo sapiens
agcgugcuggcgacacucagggc

SEQ ID NO: 1169738 - RNA, 23 nt, Homo sapiens
agcuaaaaccuacucacuuagca

SEQ ID NO: 1169739 - RNA, 13 nt, Homo sapiens
agcuaacaccaga

SEQ ID NO: 1169740 - RNA, 13 nt, Homo sapiens
agcuacaggacau

SEQ ID NO: 1169741 - RNA, 15 nt, Homo sapiens
agcuacaugguggag

SEQ ID NO: 1169742 - RNA, 22 nt, Homo sapiens
agcuacccauuauagcacaaaa

SEQ ID NO: 1169743 - RNA, 12 nt, Homo sapiens
agcuacucagga

SEQ ID NO: 1169744 - RNA, 18 nt, Homo sapiens
agcuacucgggaggcuga

SEQ ID NO: 1169745 - RNA, 13 nt, Homo sapiens
agcuacuucuuau

SEQ ID NO: 1169746 - RNA, 15 nt, Homo sapiens
agcuacuuuugccaa

SEQ ID NO: 1169747 - RNA, 19 nt, Homo sapiens
cagauugugccacugcucu

SEQ ID NO: 1169748 - RNA, 13 nt, Homo sapiens
cagauuuaccaua

SEQ ID NO: 1169749 - RNA, 17 nt, Homo sapiens
cagauuuguggggaccu

SEQ ID NO: 1169750 - RNA, 14 nt, Homo sapiens
cagcaaaaacagcu

SEQ ID NO: 1169751 - RNA, 17 nt, Homo sapiens
cagcaaaacuuuccaac

SEQ ID NO: 1169752 - RNA, 21 nt, Homo sapiens
cagcaaaagcccuaacuucuu

SEQ ID NO: 1169753 - RNA, 12 nt, Homo sapiens
cagcaaacuguc

SEQ ID NO: 1169754 - RNA, 13 nt, Homo sapiens
cagcaagccaugc

SEQ ID NO: 1169755 - RNA, 21 nt, Homo sapiens
cagcacaagauacacgucaca

SEQ ID NO: 1169756 - RNA, 20 nt, Homo sapiens
cagcacagaacacacugaga

SEQ ID NO: 1169757 - RNA, 17 nt, Homo sapiens
cagcacuaauucaacau

SEQ ID NO: 1169758 - RNA, 22 nt, Homo sapiens
cagcacuccuguuccucuguua

SEQ ID NO: 1169759 - RNA, 13 nt, Homo sapiens
cagcacugacaau

SEQ ID NO: 1169760 - RNA, 21 nt, Homo sapiens
cagcagaauacugcuugcuua

SEQ ID NO: 1169761 - RNA, 14 nt, Homo sapiens
cagcagcacuggaa

SEQ ID NO: 1169762 - RNA, 16 nt, Homo sapiens
cagcagcccucagggc

SEQ ID NO: 1169763 - RNA, 17 nt, Homo sapiens
cagcagccuacugagua

SEQ ID NO: 1169764 - RNA, 13 nt, Homo sapiens
cagcagccugcca

SEQ ID NO: 1169765 - RNA, 16 nt, Homo sapiens
cagcagcuacuaggga

SEQ ID NO: 1169766 - RNA, 22 nt, Homo sapiens
cagcagcucacacccuaccuuc

SEQ ID NO: 1169767 - RNA, 18 nt, Homo sapiens
cagcaggccuuucgaucc

SEQ ID NO: 1169768 - RNA, 14 nt, Homo sapiens
cagcaggugcaagg

SEQ ID NO: 1169769 - RNA, 21 nt, Homo sapiens
cagcaguagcaaacuuuucac

SEQ ID NO: 1169770 - RNA, 16 nt, Homo sapiens
cagcaguuacugugaa

SEQ ID NO: 1169771 - RNA, 16 nt, Homo sapiens
cagcaucaaacaugaa

SEQ ID NO: 1169772 - RNA, 16 nt, Homo sapiens
cagcauccacacugcc

SEQ ID NO: 1169773 - RNA, 19 nt, Homo sapiens
cagcaucccagccuugaga

SEQ ID NO: 1169774 - RNA, 12 nt, Homo sapiens
cagcaucugacc

SEQ ID NO: 1169775 - RNA, 14 nt, Homo sapiens
cagcaucugaccau

SEQ ID NO: 1169776 - RNA, 12 nt, Homo sapiens
cagcaucuguag

SEQ ID NO: 1169777 - RNA, 19 nt, Homo sapiens
cagcauggguuagugcuau

SEQ ID NO: 1169778 - RNA, 16 nt, Homo sapiens
cagcauuccaugacca

SEQ ID NO: 1169779 - RNA, 18 nt, Homo sapiens
cagcauuccaugaccaga

SEQ ID NO: 1169780 - RNA, 23 nt, Homo sapiens
cagcauuguugagcugucaucaa

SEQ ID NO: 1169781 - RNA, 18 nt, Homo sapiens
cagcauuucccgaaggcc

SEQ ID NO: 1169782 - RNA, 13 nt, Homo sapiens
cagcauuuuugca

SEQ ID NO: 1169783 - RNA, 22 nt, Homo sapiens
cagccaaccuaauuaccuguau

SEQ ID NO: 1169784 - RNA, 14 nt, Homo sapiens
cagccaacugaaaa

SEQ ID NO: 1169785 - RNA, 16 nt, Homo sapiens
cagccacagcauuuau

SEQ ID NO: 1169786 - RNA, 20 nt, Homo sapiens
cagccaccauccuauugcaa

SEQ ID NO: 1169787 - RNA, 23 nt, Homo sapiens
cagccaccuagucccccaaaggg

SEQ ID NO: 1169788 - RNA, 12 nt, Homo sapiens
cagccaccucuc

SEQ ID NO: 1169789 - RNA, 23 nt, Homo sapiens
cagccagagaaugcccacugccu

SEQ ID NO: 1169790 - RNA, 12 nt, Homo sapiens
cagccagcacuu

SEQ ID NO: 1169791 - RNA, 15 nt, Homo sapiens
cagccaucaaauagu

SEQ ID NO: 1169792 - RNA, 19 nt, Homo sapiens
cagccaucaaauagugaau

SEQ ID NO: 1169793 - RNA, 12 nt, Homo sapiens
cagccaugagaa

SEQ ID NO: 1169794 - RNA, 21 nt, Homo sapiens
cagcccaaacuguauacauua

SEQ ID NO: 1169795 - RNA, 17 nt, Homo sapiens
cagcccaacagcacuuu

SEQ ID NO: 1169796 - RNA, 20 nt, Homo sapiens
cagcccacagagccugaauu

SEQ ID NO: 1169797 - RNA, 15 nt, Homo sapiens
cagcccagcuggugg

SEQ ID NO: 1169798 - RNA, 11 nt, Homo sapiens
cagcccauucu

SEQ ID NO: 1169799 - RNA, 17 nt, Homo sapiens
cagcccccaccucaggu

SEQ ID NO: 1169800 - RNA, 15 nt, Homo sapiens
cagcccuugugaugu

SEQ ID NO: 1169801 - RNA, 17 nt, Homo sapiens
cagccgcucuccugcca

SEQ ID NO: 1169802 - RNA, 13 nt, Homo sapiens
cagccuccugggu

SEQ ID NO: 1169803 - RNA, 23 nt, Homo sapiens
cagccugaauaaaccaagacaag

SEQ ID NO: 1169804 - RNA, 23 nt, Homo sapiens
cagccugccagcaguuacuguga

SEQ ID NO: 1169805 - RNA, 19 nt, Homo sapiens
cagccugggcaacagagca

SEQ ID NO: 1169806 - RNA, 24 nt, Homo sapiens
cagccugggccccagcucgcggga

SEQ ID NO: 1169807 - RNA, 16 nt, Homo sapiens
cagccugucuugucag

SEQ ID NO: 1169808 - RNA, 19 nt, Homo sapiens
cagccuuacccaguccuau

SEQ ID NO: 1169809 - RNA, 17 nt, Homo sapiens
cagccuuucugaacuga

SEQ ID NO: 1169810 - RNA, 13 nt, Homo sapiens
cagcgcaccuguu

SEQ ID NO: 1169811 - RNA, 15 nt, Homo sapiens
cagcggccucagggu

SEQ ID NO: 1169812 - RNA, 13 nt, Homo sapiens
cagcuaaagcaau

SEQ ID NO: 1169813 - RNA, 21 nt, Homo sapiens
cagcuacaaaaguuaaugaau

SEQ ID NO: 1169814 - RNA, 12 nt, Homo sapiens
cagcuacccagg

SEQ ID NO: 1169815 - RNA, 13 nt, Homo sapiens
cagcuacucagga

SEQ ID NO: 1169816 - RNA, 23 nt, Homo sapiens
cagcuacucaggaggcugaagca

SEQ ID NO: 1169817 - RNA, 16 nt, Homo sapiens
cagcuacugaaccagc

SEQ ID NO: 1169818 - RNA, 16 nt, Homo sapiens
cagcuacuuuugccaa

SEQ ID NO: 1169819 - RNA, 19 nt, Homo sapiens
cagcuagaaauaagcccaa

SEQ ID NO: 1169820 - RNA, 17 nt, Homo sapiens
cagcuaggaugugcauu

SEQ ID NO: 1169821 - RNA, 15 nt, Homo sapiens
cagcuauaccugugc

SEQ ID NO: 1169822 - RNA, 18 nt, Homo sapiens
cagcucaaugaccuggag

SEQ ID NO: 1169823 - RNA, 20 nt, Homo sapiens
cagcucaaugaccuggagca

SEQ ID NO: 1169824 - RNA, 18 nt, Homo sapiens
cagcucagcagugacugu

SEQ ID NO: 1169825 - RNA, 19 nt, Homo sapiens
cagcucagggacuggcaca

SEQ ID NO: 1169826 - RNA, 11 nt, Homo sapiens
cagcucagggg

SEQ ID NO: 1169827 - RNA, 15 nt, Homo sapiens
cagcucaggggacac

SEQ ID NO: 1169828 - RNA, 23 nt, Homo sapiens
cagcucccucgucuucagcugca

SEQ ID NO: 1169829 - RNA, 14 nt, Homo sapiens
cagcucguucucug

SEQ ID NO: 1169830 - RNA, 19 nt, Homo sapiens
cagcucuuccgaaaaccag

SEQ ID NO: 1169831 - RNA, 22 nt, Homo sapiens
cagcucuuggcuccacugggau

SEQ ID NO: 1169832 - RNA, 17 nt, Homo sapiens
cagcucuuucucuuugu

SEQ ID NO: 1169833 - RNA, 23 nt, Homo sapiens
cagcugagguucccgacaccaga

SEQ ID NO: 1169834 - RNA, 22 nt, Homo sapiens
cagcugauugggcaccugacca

SEQ ID NO: 1169835 - RNA, 23 nt, Homo sapiens
cagcugcauuucacaugccuugc

SEQ ID NO: 1169836 - RNA, 12 nt, Homo sapiens
cagcugcuccua

SEQ ID NO: 1169837 - RNA, 11 nt, Homo sapiens
cagcugcugaa

SEQ ID NO: 1169838 - RNA, 12 nt, Homo sapiens
cagcugggacac

SEQ ID NO: 1169839 - RNA, 15 nt, Homo sapiens
cagcuguacugagga

SEQ ID NO: 1169840 - RNA, 19 nt, Homo sapiens
cagcuuagaaugcaucuca

SEQ ID NO: 1169841 - RNA, 18 nt, Homo sapiens
cagcuuauggcaucucau

SEQ ID NO: 1169842 - RNA, 19 nt, Homo sapiens
cagcuuguggcaagugaau

SEQ ID NO: 1169843 - RNA, 18 nt, Homo sapiens
cagcuuucaaagcauuua

SEQ ID NO: 1169844 - RNA, 17 nt, Homo sapiens
cagcuuuucagugaaug

SEQ ID NO: 1169845 - RNA, 21 nt, Homo sapiens
cagcuuuucccaagaugucaa

SEQ ID NO: 1169846 - RNA, 17 nt, Homo sapiens
cagcuuuuuguccugua

SEQ ID NO: 1169847 - RNA, 19 nt, Homo sapiens
caggaaacauucagugaaa

SEQ ID NO: 1169848 - RNA, 22 nt, Homo sapiens
caggaaagaagaguuggaguga

SEQ ID NO: 1169849 - RNA, 18 nt, Homo sapiens
caggaaauggcuguggag

SEQ ID NO: 1169850 - RNA, 16 nt, Homo sapiens
caggaaccauuuucac

SEQ ID NO: 1169851 - RNA, 16 nt, Homo sapiens
caggaagccgugcccu

SEQ ID NO: 1169852 - RNA, 19 nt, Homo sapiens
caggaaggacagacuggcc

SEQ ID NO: 1169853 - RNA, 20 nt, Homo sapiens
caggaaggucugauuugcag

SEQ ID NO: 1169854 - RNA, 23 nt, Homo sapiens
caggaauuucccaggacccugaa

SEQ ID NO: 1169855 - RNA, 18 nt, Homo sapiens
caggacacagauuaucaa

SEQ ID NO: 1169856 - RNA, 16 nt, Homo sapiens
caggacagaugccaca

SEQ ID NO: 1169857 - RNA, 12 nt, Homo sapiens
caggaccaaggg

SEQ ID NO: 1169858 - RNA, 13 nt, Homo sapiens
caggacccaggga

SEQ ID NO: 1169859 - RNA, 12 nt, Homo sapiens
caggaccugccu

SEQ ID NO: 1169860 - RNA, 17 nt, Homo sapiens
caggagaaacacuugaa

SEQ ID NO: 1169861 - RNA, 18 nt, Homo sapiens
caggagaaacacuugaac

SEQ ID NO: 1169862 - RNA, 19 nt, Homo sapiens
caggagauuugcuugaacc

SEQ ID NO: 1169863 - RNA, 18 nt, Homo sapiens
caggagcccugcuaugaa

SEQ ID NO: 1169864 - RNA, 21 nt, Homo sapiens
caggagccggacacuucucag

SEQ ID NO: 1169865 - RNA, 16 nt, Homo sapiens
caggagccuaccacaa

SEQ ID NO: 1169866 - RNA, 20 nt, Homo sapiens
caggaggcagagguugcagu

SEQ ID NO: 1169867 - RNA, 15 nt, Homo sapiens
caggaggcuccagga

SEQ ID NO: 1169868 - RNA, 22 nt, Homo sapiens
caggaggcuuuaagcuccagcu

SEQ ID NO: 1169869 - RNA, 21 nt, Homo sapiens
caggaggugugauuccugaag

SEQ ID NO: 1169870 - RNA, 13 nt, Homo sapiens
caggagucaccau

SEQ ID NO: 1169871 - RNA, 17 nt, Homo sapiens
caggaguggaaggugag

SEQ ID NO: 1169872 - RNA, 21 nt, Homo sapiens
caggaguguccuggcugugaa

SEQ ID NO: 1169873 - RNA, 19 nt, Homo sapiens
caggaguucgagaccagcc

SEQ ID NO: 1169874 - RNA, 14 nt, Homo sapiens
caggaugacuuuac

SEQ ID NO: 1169875 - RNA, 22 nt, Homo sapiens
caggaugguguuacugcaguug

SEQ ID NO: 1169876 - RNA, 20 nt, Homo sapiens
caggcaacgcacaaaacaga

SEQ ID NO: 1169877 - RNA, 21 nt, Homo sapiens
caggcaaucguggaugucucu

SEQ ID NO: 1169878 - RNA, 12 nt, Homo sapiens
caggcacuuugc

SEQ ID NO: 1169879 - RNA, 15 nt, Homo sapiens
caucauugcuugcuu

SEQ ID NO: 1169880 - RNA, 18 nt, Homo sapiens
caucauuguccccaugca

SEQ ID NO: 1169881 - RNA, 14 nt, Homo sapiens
caucauuuccugug

SEQ ID NO: 1169882 - RNA, 12 nt, Homo sapiens
cauccaaagcag

SEQ ID NO: 1169883 - RNA, 19 nt, Homo sapiens
cauccagaacugcuaccuu

SEQ ID NO: 1169884 - RNA, 13 nt, Homo sapiens
cauccagaggcaa

SEQ ID NO: 1169885 - RNA, 21 nt, Homo sapiens
cauccagagucccugccugga

SEQ ID NO: 1169886 - RNA, 15 nt, Homo sapiens
cauccauaaagaagc

SEQ ID NO: 1169887 - RNA, 24 nt, Homo sapiens
cauccauguuccgagaagaacaga

SEQ ID NO: 1169888 - RNA, 17 nt, Homo sapiens
caucccuagccauucug

SEQ ID NO: 1169889 - RNA, 19 nt, Homo sapiens
caucccuagucucuaccca

SEQ ID NO: 1169890 - RNA, 22 nt, Homo sapiens
caucccuagucucuacccagua

SEQ ID NO: 1169891 - RNA, 14 nt, Homo sapiens
cauccgcgugugcc

SEQ ID NO: 1169892 - RNA, 22 nt, Homo sapiens
cauccuagucucuaucauuaaa

SEQ ID NO: 1169893 - RNA, 18 nt, Homo sapiens
cauccucagcuucuuccc

SEQ ID NO: 1169894 - RNA, 15 nt, Homo sapiens
cauccugaacagcau

SEQ ID NO: 1169895 - RNA, 20 nt, Homo sapiens
cauccugcuaguuugugaug

SEQ ID NO: 1169896 - RNA, 22 nt, Homo sapiens
cauccugcucagcugcgucaug

SEQ ID NO: 1169897 - RNA, 20 nt, Homo sapiens
cauccuguuuguaugaaauu

SEQ ID NO: 1169898 - RNA, 17 nt, Homo sapiens
caucgaccacaccagcc

SEQ ID NO: 1169899 - RNA, 12 nt, Homo sapiens
caucgacuuccu

SEQ ID NO: 1169900 - RNA, 20 nt, Homo sapiens
caucgaggcucuugcucaag

SEQ ID NO: 1169901 - RNA, 17 nt, Homo sapiens
caucgcgaugggaaccg

SEQ ID NO: 1169902 - RNA, 20 nt, Homo sapiens
caucuaaauugaucauucau

SEQ ID NO: 1169903 - RNA, 23 nt, Homo sapiens
caucuaagaaguuuuguucuguc

SEQ ID NO: 1169904 - RNA, 14 nt, Homo sapiens
caucuaauguaaua

SEQ ID NO: 1169905 - RNA, 22 nt, Homo sapiens
caucuacuuuuuuuuuaauuaa

SEQ ID NO: 1169906 - RNA, 21 nt, Homo sapiens
caucuaugggagagugucaac

SEQ ID NO: 1169907 - RNA, 17 nt, Homo sapiens
caucucaaagaaggcau

SEQ ID NO: 1169908 - RNA, 21 nt, Homo sapiens
caucucaaagaaggcauuugc

SEQ ID NO: 1169909 - RNA, 23 nt, Homo sapiens
caucucagguuggcggcagacac

SEQ ID NO: 1169910 - RNA, 21 nt, Homo sapiens
caucucccagauaaugugaaa

SEQ ID NO: 1169911 - RNA, 22 nt, Homo sapiens
caucucuggccuguacccagua

SEQ ID NO: 1169912 - RNA, 14 nt, Homo sapiens
caucugaccaucug

SEQ ID NO: 1169913 - RNA, 23 nt, Homo sapiens
caucugagugcagccguuugaga

SEQ ID NO: 1169914 - RNA, 15 nt, Homo sapiens
caucugcauugccca

SEQ ID NO: 1169915 - RNA, 15 nt, Homo sapiens
caucugcuacugugu

SEQ ID NO: 1169916 - RNA, 20 nt, Homo sapiens
caucuggaccugguacaaau

SEQ ID NO: 1169917 - RNA, 17 nt, Homo sapiens
caucugucuguguuucu

SEQ ID NO: 1169918 - RNA, 21 nt, Homo sapiens
caucugugcacugcccaugga

SEQ ID NO: 1169919 - RNA, 23 nt, Homo sapiens
caucugugucucuggaacccagg

SEQ ID NO: 1169920 - RNA, 18 nt, Homo sapiens
caucuuacuguaccuguu

SEQ ID NO: 1169921 - RNA, 17 nt, Homo sapiens
caucuucacugcaauuu

SEQ ID NO: 1169922 - RNA, 12 nt, Homo sapiens
caucuucuuuca

SEQ ID NO: 1169923 - RNA, 18 nt, Homo sapiens
caucuuggggacaucucu

SEQ ID NO: 1169924 - RNA, 12 nt, Homo sapiens
caucuuugccuc

SEQ ID NO: 1169925 - RNA, 22 nt, Homo sapiens
caugaaaauagccaaccagcag

SEQ ID NO: 1169926 - RNA, 15 nt, Homo sapiens
caugaaauuuugccu

SEQ ID NO: 1169927 - RNA, 22 nt, Homo sapiens
caugaacugcggcagcaguuug

SEQ ID NO: 1169928 - RNA, 23 nt, Homo sapiens
caugaagaaauacugcacuuaca

SEQ ID NO: 1169929 - RNA, 16 nt, Homo sapiens
caugaagauucuuucc

SEQ ID NO: 1169930 - RNA, 18 nt, Homo sapiens
caugaagccuugcugaac

SEQ ID NO: 1169931 - RNA, 18 nt, Homo sapiens
caugaaggauaaaagccc

SEQ ID NO: 1169932 - RNA, 20 nt, Homo sapiens
caugaaguguguuuccuuca

SEQ ID NO: 1169933 - RNA, 14 nt, Homo sapiens
caugacagcugucu

SEQ ID NO: 1169934 - RNA, 18 nt, Homo sapiens
caugacauauguagaugu

SEQ ID NO: 1169935 - RNA, 20 nt, Homo sapiens
caugacauauguagaugugc

SEQ ID NO: 1169936 - RNA, 18 nt, Homo sapiens
caugacauuuaccagcaa

SEQ ID NO: 1169937 - RNA, 18 nt, Homo sapiens
caugaccagaaacaggga

SEQ ID NO: 1169938 - RNA, 15 nt, Homo sapiens
caugacggguuguga

SEQ ID NO: 1169939 - RNA, 16 nt, Homo sapiens
caugacuauauauaca

SEQ ID NO: 1169940 - RNA, 17 nt, Homo sapiens
caugacuauauauacau

SEQ ID NO: 1169941 - RNA, 21 nt, Homo sapiens
caugacuucagaguacaucca

SEQ ID NO: 1169942 - RNA, 21 nt, Homo sapiens
caugagagaaggaggggagca

SEQ ID NO: 1169943 - RNA, 21 nt, Homo sapiens
caugagcuccuuaaggcucuu

SEQ ID NO: 1169944 - RNA, 20 nt, Homo sapiens
caugagcuuaggcauucuaa

SEQ ID NO: 1169945 - RNA, 21 nt, Homo sapiens
caugaggaccaggguggagcu

SEQ ID NO: 1169946 - RNA, 23 nt, Homo sapiens
caugagggcagaggugcuaccug

SEQ ID NO: 1169947 - RNA, 15 nt, Homo sapiens
caugauaaacauuca

SEQ ID NO: 1169948 - RNA, 19 nt, Homo sapiens
caugaugcuagccagcaaa

SEQ ID NO: 1169949 - RNA, 18 nt, Homo sapiens
caugauggcaacagaucu

SEQ ID NO: 1169950 - RNA, 15 nt, Homo sapiens
caugauguagagugu

SEQ ID NO: 1169951 - RNA, 21 nt, Homo sapiens
caugauguuuuaagcugcuaa

SEQ ID NO: 1169952 - RNA, 12 nt, Homo sapiens
caugauuuccca

SEQ ID NO: 1169953 - RNA, 15 nt, Homo sapiens
caugcaaaggauaaa

SEQ ID NO: 1169954 - RNA, 15 nt, Homo sapiens
caugcaggauuugaa

SEQ ID NO: 1169955 - RNA, 17 nt, Homo sapiens
caugcaggucuccauga

SEQ ID NO: 1169956 - RNA, 22 nt, Homo sapiens
caugcaggugaaacccagucac

SEQ ID NO: 1169957 - RNA, 20 nt, Homo sapiens
caugcaugucuaaccugauu

SEQ ID NO: 1169958 - RNA, 19 nt, Homo sapiens
caugcauugagcucucuca

SEQ ID NO: 1169959 - RNA, 14 nt, Homo sapiens
caugcccagccaau

SEQ ID NO: 1169960 - RNA, 14 nt, Homo sapiens
caugccccuggcug

SEQ ID NO: 1169961 - RNA, 14 nt, Homo sapiens
caugcccugugcaa

SEQ ID NO: 1169962 - RNA, 13 nt, Homo sapiens
caugcccuguuca

SEQ ID NO: 1169963 - RNA, 13 nt, Homo sapiens
caugccugaugaa

SEQ ID NO: 1169964 - RNA, 19 nt, Homo sapiens
caugcgccaccaugcccua

SEQ ID NO: 1169965 - RNA, 22 nt, Homo sapiens
caugcguaagacguucugugua

SEQ ID NO: 1169966 - RNA, 18 nt, Homo sapiens
caugcucccaacucccuu

SEQ ID NO: 1169967 - RNA, 18 nt, Homo sapiens
caugcugggaaugagaca

SEQ ID NO: 1169968 - RNA, 17 nt, Homo sapiens
caugcuuugaaaaauca

SEQ ID NO: 1169969 - RNA, 21 nt, Homo sapiens
caugcuuugaaguuucuggaa

SEQ ID NO: 1169970 - RNA, 14 nt, Homo sapiens
cauggaaacccaua

SEQ ID NO: 1169971 - RNA, 17 nt, Homo sapiens
cauggaaagacugggac

SEQ ID NO: 1169972 - RNA, 17 nt, Homo sapiens
cauggaacacaaacaca

SEQ ID NO: 1169973 - RNA, 13 nt, Homo sapiens
cauggaaccacua

SEQ ID NO: 1169974 - RNA, 15 nt, Homo sapiens
cauggacauucaugc

SEQ ID NO: 1169975 - RNA, 19 nt, Homo sapiens
cauggauuucucugcucac

SEQ ID NO: 1169976 - RNA, 23 nt, Homo sapiens
cauggcacucccuccagcacaaa

SEQ ID NO: 1169977 - RNA, 14 nt, Homo sapiens
cauggcaugucuuu

SEQ ID NO: 1169978 - RNA, 19 nt, Homo sapiens
cauggccacacugugacac

SEQ ID NO: 1169979 - RNA, 17 nt, Homo sapiens
cauggcgagauacugca

SEQ ID NO: 1169980 - RNA, 21 nt, Homo sapiens
cauggcgagauacugcauguu

SEQ ID NO: 1169981 - RNA, 14 nt, Homo sapiens
caugggaaggggag

SEQ ID NO: 1169982 - RNA, 20 nt, Homo sapiens
caugggaaggggaggacccc

SEQ ID NO: 1169983 - RNA, 23 nt, Homo sapiens
caugguagaaaaugcaccaaaua

SEQ ID NO: 1169984 - RNA, 15 nt, Homo sapiens
caugguccccaagac

SEQ ID NO: 1169985 - RNA, 20 nt, Homo sapiens
cauggugaaaccccgucucu

SEQ ID NO: 1169986 - RNA, 22 nt, Homo sapiens
cauggugccccaggaccagcuc

SEQ ID NO: 1169987 - RNA, 23 nt, Homo sapiens
cauggugcuggggagccaaaggc

SEQ ID NO: 1169988 - RNA, 20 nt, Homo sapiens
caugguggcgcaugccugua

SEQ ID NO: 1169989 - RNA, 17 nt, Homo sapiens
caugguggcucaugccu

SEQ ID NO: 1169990 - RNA, 15 nt, Homo sapiens
cauguaaacauacca

SEQ ID NO: 1169991 - RNA, 16 nt, Homo sapiens
cauguaaaugcucaaa

SEQ ID NO: 1169992 - RNA, 20 nt, Homo sapiens
cauguaaggccuuucaauau

SEQ ID NO: 1169993 - RNA, 22 nt, Homo sapiens
cauguaauauaaagauguuaaa

SEQ ID NO: 1169994 - RNA, 21 nt, Homo sapiens
cauguacaaaaauuaugcaau

SEQ ID NO: 1169995 - RNA, 12 nt, Homo sapiens
cauguauacuua

SEQ ID NO: 1169996 - RNA, 19 nt, Homo sapiens
cauguauagcuagcuauuu

SEQ ID NO: 1169997 - RNA, 22 nt, Homo sapiens
cauguauggaaucccacuguau

SEQ ID NO: 1169998 - RNA, 22 nt, Homo sapiens
cauguaugucuuggacacugua

SEQ ID NO: 1169999 - RNA, 19 nt, Homo sapiens
cauguauuagccagucauu

SEQ ID NO: 1170000 - RNA, 22 nt, Homo sapiens
cauguauuagccagucauugua

SEQ ID NO: 1170001 - RNA, 20 nt, Homo sapiens
cauguauuuguucgcaauua

SEQ ID NO: 1170002 - RNA, 17 nt, Homo sapiens
cauguccuaauucuucu

SEQ ID NO: 1170003 - RNA, 23 nt, Homo sapiens
caugucuaauucauuuacucacc

SEQ ID NO: 1170004 - RNA, 18 nt, Homo sapiens
caugucuuguacaugugu

SEQ ID NO: 1170005 - RNA, 15 nt, Homo sapiens
caugugacaagcaca

SEQ ID NO: 1170006 - RNA, 15 nt, Homo sapiens
caugugacacauaug

SEQ ID NO: 1170007 - RNA, 19 nt, Homo sapiens
caugugacacauaugcacc

SEQ ID NO: 1170008 - RNA, 22 nt, Homo sapiens
caugugacacauaugcaccuug

SEQ ID NO: 1170009 - RNA, 19 nt, Homo sapiens
gaaaagagaugaugaaaau

SEQ ID NO: 1170010 - RNA, 16 nt, Homo sapiens
gaaaagagcugggauc

SEQ ID NO: 1170011 - RNA, 15 nt, Homo sapiens
gaaaagauuccuguc

SEQ ID NO: 1170012 - RNA, 13 nt, Homo sapiens
gaaaagauuuuua

SEQ ID NO: 1170013 - RNA, 20 nt, Homo sapiens
gaaaagcaaaugacuaguaa

SEQ ID NO: 1170014 - RNA, 22 nt, Homo sapiens
gaaaagcuaguguaccuccucu

SEQ ID NO: 1170015 - RNA, 15 nt, Homo sapiens
gaaaaggcugguaca

SEQ ID NO: 1170016 - RNA, 16 nt, Homo sapiens
gaaaagguugccugaa

SEQ ID NO: 1170017 - RNA, 19 nt, Homo sapiens
gaaaaguaaguuuuguuaa

SEQ ID NO: 1170018 - RNA, 18 nt, Homo sapiens
gaaaauaauccauuuuca

SEQ ID NO: 1170019 - RNA, 20 nt, Homo sapiens
gaaaauaauugcaaauaucc

SEQ ID NO: 1170020 - RNA, 17 nt, Homo sapiens
gaaaauaauuguuccaa

SEQ ID NO: 1170021 - RNA, 20 nt, Homo sapiens
gaaaauaugcauaaucagac

SEQ ID NO: 1170022 - RNA, 20 nt, Homo sapiens
gaaaaucaagcaguuucuau

SEQ ID NO: 1170023 - RNA, 16 nt, Homo sapiens
gaaaaucucugugaaa

SEQ ID NO: 1170024 - RNA, 12 nt, Homo sapiens
gaaaaucuguaa

SEQ ID NO: 1170025 - RNA, 12 nt, Homo sapiens
gaaaaucuuaca

SEQ ID NO: 1170026 - RNA, 16 nt, Homo sapiens
gaaaaugcaccaaaua

SEQ ID NO: 1170027 - RNA, 16 nt, Homo sapiens
gaaaaugcgaacaacc

SEQ ID NO: 1170028 - RNA, 23 nt, Homo sapiens
gaaaauggaauuacuccaaaaag

SEQ ID NO: 1170029 - RNA, 21 nt, Homo sapiens
gaaaauuguauaaauuacuuu

SEQ ID NO: 1170030 - RNA, 23 nt, Homo sapiens
gaaacaaaaaugauccucagugc

SEQ ID NO: 1170031 - RNA, 14 nt, Homo sapiens
gaaacaaacuggag

SEQ ID NO: 1170032 - RNA, 22 nt, Homo sapiens
gaaacaaagaagguuaccaaga

SEQ ID NO: 1170033 - RNA, 17 nt, Homo sapiens
gaaacaaggcugccagg

SEQ ID NO: 1170034 - RNA, 22 nt, Homo sapiens
gaaacaauggcuaagauaccaa

SEQ ID NO: 1170035 - RNA, 14 nt, Homo sapiens
gaaacacuccuugc

SEQ ID NO: 1170036 - RNA, 22 nt, Homo sapiens
gaaacagcaggacuuguuuaca

SEQ ID NO: 1170037 - RNA, 11 nt, Homo sapiens
gaaacauuuau

SEQ ID NO: 1170038 - RNA, 21 nt, Homo sapiens
gaaaccaaggccccgagcuca

SEQ ID NO: 1170039 - RNA, 22 nt, Homo sapiens
gaaaccagagucaaauuugaaa

SEQ ID NO: 1170040 - RNA, 14 nt, Homo sapiens
gaaaccaguucaug

SEQ ID NO: 1170041 - RNA, 15 nt, Homo sapiens
gaaacccccagugua

SEQ ID NO: 1170042 - RNA, 18 nt, Homo sapiens
gaaacccccaguguaaua

SEQ ID NO: 1170043 - RNA, 15 nt, Homo sapiens
gaaacccccaucucu

SEQ ID NO: 1170044 - RNA, 18 nt, Homo sapiens
gaaacccgacagagggaa

SEQ ID NO: 1170045 - RNA, 16 nt, Homo sapiens
gaaaccgccucuggag

SEQ ID NO: 1170046 - RNA, 21 nt, Homo sapiens
gaaaccguaucucuaauaaaa

SEQ ID NO: 1170047 - RNA, 14 nt, Homo sapiens
gaaaccuacagcau

SEQ ID NO: 1170048 - RNA, 16 nt, Homo sapiens
gaaaccuuaguuucaa

SEQ ID NO: 1170049 - RNA, 23 nt, Homo sapiens
gaaaccuucagauuuguguuaua

SEQ ID NO: 1170050 - RNA, 13 nt, Homo sapiens
gaaacgucuacgu

SEQ ID NO: 1170051 - RNA, 15 nt, Homo sapiens
gaaacuauacauuua

SEQ ID NO: 1170052 - RNA, 13 nt, Homo sapiens
gaaacuccauuga

SEQ ID NO: 1170053 - RNA, 22 nt, Homo sapiens
gaaacucccagccacagcauuu

SEQ ID NO: 1170054 - RNA, 20 nt, Homo sapiens
gaaacugaggugcaaagggg

SEQ ID NO: 1170055 - RNA, 11 nt, Homo sapiens
gaaacugcucc

SEQ ID NO: 1170056 - RNA, 19 nt, Homo sapiens
gaaacugcuugagcaucag

SEQ ID NO: 1170057 - RNA, 10 nt, Homo sapiens
gaaacuuccc

SEQ ID NO: 1170058 - RNA, 11 nt, Homo sapiens
gaaacuugaac

SEQ ID NO: 1170059 - RNA, 15 nt, Homo sapiens
gaaacuugucacuug

SEQ ID NO: 1170060 - RNA, 19 nt, Homo sapiens
gaaacuugugaaguggaaa

SEQ ID NO: 1170061 - RNA, 18 nt, Homo sapiens
gaaacuuuggaagcacuu

SEQ ID NO: 1170062 - RNA, 15 nt, Homo sapiens
gaaagaaacacucaa

SEQ ID NO: 1170063 - RNA, 19 nt, Homo sapiens
gaaagaagaauguguuuca

SEQ ID NO: 1170064 - RNA, 16 nt, Homo sapiens
gaaagacaagcucaag

SEQ ID NO: 1170065 - RNA, 22 nt, Homo sapiens
gaaagagaaaccugagugacga

SEQ ID NO: 1170066 - RNA, 15 nt, Homo sapiens
gaaagagcauaauga

SEQ ID NO: 1170067 - RNA, 18 nt, Homo sapiens
gaaagaguccuauuugca

SEQ ID NO: 1170068 - RNA, 13 nt, Homo sapiens
gaaagaguuucug

SEQ ID NO: 1170069 - RNA, 18 nt, Homo sapiens
gaaagauaggacuaaagu

SEQ ID NO: 1170070 - RNA, 12 nt, Homo sapiens
gaaagauuacuu

SEQ ID NO: 1170071 - RNA, 17 nt, Homo sapiens
gaaagcagucuguucug

SEQ ID NO: 1170072 - RNA, 18 nt, Homo sapiens
gaaagcucuaaagaccau

SEQ ID NO: 1170073 - RNA, 14 nt, Homo sapiens
gaaaggaucacaga

SEQ ID NO: 1170074 - RNA, 16 nt, Homo sapiens
gaaaggcauucucuga

SEQ ID NO: 1170075 - RNA, 20 nt, Homo sapiens
gaaaggucuaugcagaaaua

SEQ ID NO: 1170076 - RNA, 12 nt, Homo sapiens
gaaagguggugu

SEQ ID NO: 1170077 - RNA, 17 nt, Homo sapiens
gaaaguaagcauuucca

SEQ ID NO: 1170078 - RNA, 19 nt, Homo sapiens
gaaagucaugcacauaccu

SEQ ID NO: 1170079 - RNA, 13 nt, Homo sapiens
gaaaguccagcua

SEQ ID NO: 1170080 - RNA, 19 nt, Homo sapiens
gaaagucguacuguucaca

SEQ ID NO: 1170081 - RNA, 18 nt, Homo sapiens
gaaaguuaauccacugug

SEQ ID NO: 1170082 - RNA, 18 nt, Homo sapiens
gaaaguuuuuaauucaua

SEQ ID NO: 1170083 - RNA, 20 nt, Homo sapiens
gaaauaaaaaaugaaaaaca

SEQ ID NO: 1170084 - RNA, 15 nt, Homo sapiens
gaaauaaacagucua

SEQ ID NO: 1170085 - RNA, 16 nt, Homo sapiens
gaaauaaauaacuuug

SEQ ID NO: 1170086 - RNA, 14 nt, Homo sapiens
gaaauaaccacugc

SEQ ID NO: 1170087 - RNA, 14 nt, Homo sapiens
gaaauaaccaugaa

SEQ ID NO: 1170088 - RNA, 16 nt, Homo sapiens
gaaauaauaauaucca

SEQ ID NO: 1170089 - RNA, 16 nt, Homo sapiens
gaaauaguaccuucaa

SEQ ID NO: 1170090 - RNA, 16 nt, Homo sapiens
gaaauaugaaugcccc

SEQ ID NO: 1170091 - RNA, 18 nt, Homo sapiens
gaaauauuuucagcaaaa

SEQ ID NO: 1170092 - RNA, 21 nt, Homo sapiens
gaaaucucaaaacuguacugu

SEQ ID NO: 1170093 - RNA, 23 nt, Homo sapiens
gaaaucucaaaacuguacugucu

SEQ ID NO: 1170094 - RNA, 15 nt, Homo sapiens
gaaaugaaugcugau

SEQ ID NO: 1170095 - RNA, 15 nt, Homo sapiens
gaaaugaaugugcaa

SEQ ID NO: 1170096 - RNA, 16 nt, Homo sapiens
gaaaugagcagggaug

SEQ ID NO: 1170097 - RNA, 20 nt, Homo sapiens
gaaauggaacagugaggaau

SEQ ID NO: 1170098 - RNA, 17 nt, Homo sapiens
gaaauguaugugcucuu

SEQ ID NO: 1170099 - RNA, 15 nt, Homo sapiens
gaaaugucaguugcu

SEQ ID NO: 1170100 - RNA, 15 nt, Homo sapiens
gaaauuaaaugccac

SEQ ID NO: 1170101 - RNA, 21 nt, Homo sapiens
gaaauuauggaauacaaaagu

SEQ ID NO: 1170102 - RNA, 20 nt, Homo sapiens
gaaauuccaaauggugugaa

SEQ ID NO: 1170103 - RNA, 16 nt, Homo sapiens
gaaauucggagcuaua

SEQ ID NO: 1170104 - RNA, 20 nt, Homo sapiens
gaaauuuaauucauguuucu

SEQ ID NO: 1170105 - RNA, 16 nt, Homo sapiens
gaaauuuugggggaaa

SEQ ID NO: 1170106 - RNA, 17 nt, Homo sapiens
gaacaaagacuacuaau

SEQ ID NO: 1170107 - RNA, 17 nt, Homo sapiens
gaacaaagcagccacga

SEQ ID NO: 1170108 - RNA, 19 nt, Homo sapiens
gaacaauauugacuuuguc

SEQ ID NO: 1170109 - RNA, 13 nt, Homo sapiens
gaacacaaacaca

SEQ ID NO: 1170110 - RNA, 20 nt, Homo sapiens
gaacacagccgauucaccug

SEQ ID NO: 1170111 - RNA, 17 nt, Homo sapiens
gaacacaggagauucca

SEQ ID NO: 1170112 - RNA, 19 nt, Homo sapiens
gaacacccucuaaauggga

SEQ ID NO: 1170113 - RNA, 20 nt, Homo sapiens
gaacacucuuuugcuuuauu

SEQ ID NO: 1170114 - RNA, 19 nt, Homo sapiens
gaacacuggagucuugcaa

SEQ ID NO: 1170115 - RNA, 17 nt, Homo sapiens
gaacacuggcagacugu

SEQ ID NO: 1170116 - RNA, 17 nt, Homo sapiens
gaacagaaauuggguga

SEQ ID NO: 1170117 - RNA, 13 nt, Homo sapiens
gaacagacaauca

SEQ ID NO: 1170118 - RNA, 17 nt, Homo sapiens
gaacagccacuccccuc

SEQ ID NO: 1170119 - RNA, 20 nt, Homo sapiens
gaacagcuuuuuguccugua

SEQ ID NO: 1170120 - RNA, 20 nt, Homo sapiens
gaacagucagauuuauuuau

SEQ ID NO: 1170121 - RNA, 15 nt, Homo sapiens
gaacaguccuguuca

SEQ ID NO: 1170122 - RNA, 15 nt, Homo sapiens
gaacagugcucugcc

SEQ ID NO: 1170123 - RNA, 13 nt, Homo sapiens
gaacauagggaca

SEQ ID NO: 1170124 - RNA, 16 nt, Homo sapiens
gaacaugcaguuugaa

SEQ ID NO: 1170125 - RNA, 19 nt, Homo sapiens
gaacauguaaaagggugaa

SEQ ID NO: 1170126 - RNA, 13 nt, Homo sapiens
gaacauuuccuca

SEQ ID NO: 1170127 - RNA, 16 nt, Homo sapiens
gaacauuuuuuaccaa

SEQ ID NO: 1170128 - RNA, 17 nt, Homo sapiens
gaaccaaauugcacuga

SEQ ID NO: 1170129 - RNA, 14 nt, Homo sapiens
gaaccaccccggcc

SEQ ID NO: 1170130 - RNA, 13 nt, Homo sapiens
gaaccacuaugaa

SEQ ID NO: 1170131 - RNA, 21 nt, Homo sapiens
gaaccacucauaauucuucac

SEQ ID NO: 1170132 - RNA, 13 nt, Homo sapiens
gaaccagccacga

SEQ ID NO: 1170133 - RNA, 15 nt, Homo sapiens
gaaccaggaggacaa

SEQ ID NO: 1170134 - RNA, 10 nt, Homo sapiens
gaaccaugaa

SEQ ID NO: 1170135 - RNA, 18 nt, Homo sapiens
gaaccauuauagccucag

SEQ ID NO: 1170136 - RNA, 14 nt, Homo sapiens
gaacccaaauccaa

SEQ ID NO: 1170137 - RNA, 18 nt, Homo sapiens
gaacccaaauccaagcuu

SEQ ID NO: 1170138 - RNA, 15 nt, Homo sapiens
gaacccagacucaga

SEQ ID NO: 1170139 - RNA, 10 nt, Homo sapiens
gaacccagga

SEQ ID NO: 1170140 - RNA, 15 nt, Homo sapiens
gaacccugugcaauu

SEQ ID NO: 1170141 - RNA, 14 nt, Homo sapiens
gaacccuugcacua

SEQ ID NO: 1170142 - RNA, 22 nt, Homo sapiens
gaaccgacgcaugaaguggaaa

SEQ ID NO: 1170143 - RNA, 13 nt, Homo sapiens
gaaccguuuugaa

SEQ ID NO: 1170144 - RNA, 19 nt, Homo sapiens
gaaccucagccuggccaga

SEQ ID NO: 1170145 - RNA, 18 nt, Homo sapiens
gaaccugcccugcuccca

SEQ ID NO: 1170146 - RNA, 23 nt, Homo sapiens
gaaccuggcaagucacaggacua

SEQ ID NO: 1170147 - RNA, 13 nt, Homo sapiens
gaacgacauguua

SEQ ID NO: 1170148 - RNA, 14 nt, Homo sapiens
gaacgaggauuuua

SEQ ID NO: 1170149 - RNA, 13 nt, Homo sapiens
gaacggggagaaa

SEQ ID NO: 1170150 - RNA, 17 nt, Homo sapiens
gaacgguaaauuucugu

SEQ ID NO: 1170151 - RNA, 21 nt, Homo sapiens
gaacuaaguuuuguguguaua

SEQ ID NO: 1170152 - RNA, 17 nt, Homo sapiens
gaacuacauuaguacac

SEQ ID NO: 1170153 - RNA, 22 nt, Homo sapiens
gaacuagagcuugcagugaagu

SEQ ID NO: 1170154 - RNA, 14 nt, Homo sapiens
gaacugagcuugga

SEQ ID NO: 1170155 - RNA, 19 nt, Homo sapiens
gaacugaggagcggacuca

SEQ ID NO: 1170156 - RNA, 23 nt, Homo sapiens
gaacugauuccugaaauaaugca

SEQ ID NO: 1170157 - RNA, 22 nt, Homo sapiens
gaacugauuuuacaaauuaaua

SEQ ID NO: 1170158 - RNA, 17 nt, Homo sapiens
gaacugcauauguuucg

SEQ ID NO: 1170159 - RNA, 20 nt, Homo sapiens
gaacuuaagagaggggccaa

SEQ ID NO: 1170160 - RNA, 18 nt, Homo sapiens
gaacuucagaagugccau

SEQ ID NO: 1170161 - RNA, 22 nt, Homo sapiens
gaacuucuccuacuguagcaac

SEQ ID NO: 1170162 - RNA, 17 nt, Homo sapiens
gaacuugaacugauuca

SEQ ID NO: 1170163 - RNA, 24 nt, Homo sapiens
gaacuuuaagcaacaagaccacca

SEQ ID NO: 1170164 - RNA, 20 nt, Homo sapiens
gaacuuuauuggagcauuga

SEQ ID NO: 1170165 - RNA, 22 nt, Homo sapiens
gaacuuucuuauccuagcacau

SEQ ID NO: 1170166 - RNA, 17 nt, Homo sapiens
gaacuuugucacaucua

SEQ ID NO: 1170167 - RNA, 23 nt, Homo sapiens
gaacuuuuucgauaaacuaacua

SEQ ID NO: 1170168 - RNA, 13 nt, Homo sapiens
gaagaaacacuuu

SEQ ID NO: 1170169 - RNA, 11 nt, Homo sapiens
gaagaaagccu

SEQ ID NO: 1170170 - RNA, 16 nt, Homo sapiens
gaagaaagcucagagu

SEQ ID NO: 1170171 - RNA, 16 nt, Homo sapiens
gaagaagauagaucca

SEQ ID NO: 1170172 - RNA, 18 nt, Homo sapiens
gaagacauaucaugugug

SEQ ID NO: 1170173 - RNA, 18 nt, Homo sapiens
gaagacuuuuguuaugag

SEQ ID NO: 1170174 - RNA, 14 nt, Homo sapiens
gaagagacacucag

SEQ ID NO: 1170175 - RNA, 13 nt, Homo sapiens
gaagagucauuuu

SEQ ID NO: 1170176 - RNA, 22 nt, Homo sapiens
gaagaguggguuucacaaguga

SEQ ID NO: 1170177 - RNA, 19 nt, Homo sapiens
gaagaguuggagugagaug

SEQ ID NO: 1170178 - RNA, 13 nt, Homo sapiens
gaagauagaucca

SEQ ID NO: 1170179 - RNA, 14 nt, Homo sapiens
gaagauaguaacug

SEQ ID NO: 1170180 - RNA, 14 nt, Homo sapiens
gaagcaaggcacaa

SEQ ID NO: 1170181 - RNA, 12 nt, Homo sapiens
gaagcacugccu

SEQ ID NO: 1170182 - RNA, 20 nt, Homo sapiens
gaagcaucgcuccucuccag

SEQ ID NO: 1170183 - RNA, 12 nt, Homo sapiens
gaagccuguccu

SEQ ID NO: 1170184 - RNA, 19 nt, Homo sapiens
gaagccuguggugugcgga

SEQ ID NO: 1170185 - RNA, 18 nt, Homo sapiens
gaagccuugcugaacuaa

SEQ ID NO: 1170186 - RNA, 18 nt, Homo sapiens
gaagcggucacagaucac

SEQ ID NO: 1170187 - RNA, 18 nt, Homo sapiens
gaagcucgcauccagaca

SEQ ID NO: 1170188 - RNA, 20 nt, Homo sapiens
gaagcugcccucagccagag

SEQ ID NO: 1170189 - RNA, 13 nt, Homo sapiens
gaagcugcuccgu

SEQ ID NO: 1170190 - RNA, 14 nt, Homo sapiens
gaagcugcugugac

SEQ ID NO: 1170191 - RNA, 17 nt, Homo sapiens
gaagcuggagugcugcu

SEQ ID NO: 1170192 - RNA, 16 nt, Homo sapiens
gaagcuuccuuggcuu

SEQ ID NO: 1170193 - RNA, 11 nt, Homo sapiens
gaagcuuuauu

SEQ ID NO: 1170194 - RNA, 20 nt, Homo sapiens
gaagcuuuggugagaaccug

SEQ ID NO: 1170195 - RNA, 21 nt, Homo sapiens
gaaggaacuuugucacaucua

SEQ ID NO: 1170196 - RNA, 18 nt, Homo sapiens
gaaggacaguugauuucc

SEQ ID NO: 1170197 - RNA, 15 nt, Homo sapiens
gaaggagacacagau

SEQ ID NO: 1170198 - RNA, 24 nt, Homo sapiens
gaaggaugggaaaaacugcaguca

SEQ ID NO: 1170199 - RNA, 21 nt, Homo sapiens
gaaggccacuguuugucucac

SEQ ID NO: 1170200 - RNA, 12 nt, Homo sapiens
gaaggcuuugug

SEQ ID NO: 1170201 - RNA, 15 nt, Homo sapiens
gaagggaauugcuca

SEQ ID NO: 1170202 - RNA, 22 nt, Homo sapiens
gaagggacggcugugggaccag

SEQ ID NO: 1170203 - RNA, 13 nt, Homo sapiens
gaagggacuggga

SEQ ID NO: 1170204 - RNA, 20 nt, Homo sapiens
gaagggacugggaggggaga

SEQ ID NO: 1170205 - RNA, 15 nt, Homo sapiens
gaagggcucuaugga

SEQ ID NO: 1170206 - RNA, 22 nt, Homo sapiens
gaagggcugauugggauuucca

SEQ ID NO: 1170207 - RNA, 22 nt, Homo sapiens
gaaggggcuagggaggaccaaa

SEQ ID NO: 1170208 - RNA, 18 nt, Homo sapiens
gaagguccccuggcagug

SEQ ID NO: 1170209 - RNA, 22 nt, Homo sapiens
gaagguccccuggcagugcuga

SEQ ID NO: 1170210 - RNA, 16 nt, Homo sapiens
gaaggugaacuuugug

SEQ ID NO: 1170211 - RNA, 12 nt, Homo sapiens
gaaggugugcua

SEQ ID NO: 1170212 - RNA, 22 nt, Homo sapiens
gaagguuaaaggaaaagcacaa

SEQ ID NO: 1170213 - RNA, 19 nt, Homo sapiens
gaagguuggugaauuucac

SEQ ID NO: 1170214 - RNA, 18 nt, Homo sapiens
gaaguaaccauuugcacu

SEQ ID NO: 1170215 - RNA, 16 nt, Homo sapiens
gaaguagcuucagagg

SEQ ID NO: 1170216 - RNA, 15 nt, Homo sapiens
gaaguaucagcacua

SEQ ID NO: 1170217 - RNA, 21 nt, Homo sapiens
gaagucaucucauuccacugu

SEQ ID NO: 1170218 - RNA, 21 nt, Homo sapiens
gaaguccuguaugucugucau

SEQ ID NO: 1170219 - RNA, 17 nt, Homo sapiens
gaagucuuaaggacaaa

SEQ ID NO: 1170220 - RNA, 13 nt, Homo sapiens
gaagugagcugag

SEQ ID NO: 1170221 - RNA, 21 nt, Homo sapiens
gaagugauugaauauuguuaa

SEQ ID NO: 1170222 - RNA, 23 nt, Homo sapiens
gaaguggggaccccaccccucau

SEQ ID NO: 1170223 - RNA, 13 nt, Homo sapiens
gaaguguugcaug

SEQ ID NO: 1170224 - RNA, 12 nt, Homo sapiens
gaaguuccucaa

SEQ ID NO: 1170225 - RNA, 15 nt, Homo sapiens
gaauaaaccaagaca

SEQ ID NO: 1170226 - RNA, 14 nt, Homo sapiens
gaauaaauucaaua

SEQ ID NO: 1170227 - RNA, 21 nt, Homo sapiens
gaauaacucuuacagcuuugc

SEQ ID NO: 1170228 - RNA, 19 nt, Homo sapiens
gaauaagagaccuguuuua

SEQ ID NO: 1170229 - RNA, 13 nt, Homo sapiens
gaauaaugugaua

SEQ ID NO: 1170230 - RNA, 21 nt, Homo sapiens
gaauacauuuucagagccaaa

SEQ ID NO: 1170231 - RNA, 20 nt, Homo sapiens
gaauagagauggucaauuaa

SEQ ID NO: 1170232 - RNA, 15 nt, Homo sapiens
gaauaguaauuuaga

SEQ ID NO: 1170233 - RNA, 16 nt, Homo sapiens
gaauauaccauuucaa

SEQ ID NO: 1170234 - RNA, 21 nt, Homo sapiens
gaauauaccauuucaaauauu

SEQ ID NO: 1170235 - RNA, 22 nt, Homo sapiens
gaauaugcauugucugcaaugg

SEQ ID NO: 1170236 - RNA, 12 nt, Homo sapiens
gaauauucccaa

SEQ ID NO: 1170237 - RNA, 17 nt, Homo sapiens
gaaucaacauuucucaa

SEQ ID NO: 1170238 - RNA, 13 nt, Homo sapiens
gaaucacauucuu

SEQ ID NO: 1170239 - RNA, 21 nt, Homo sapiens
gaaucacuuuagaaagccagc

SEQ ID NO: 1170240 - RNA, 18 nt, Homo sapiens
gaauccacagugucccau

SEQ ID NO: 1170241 - RNA, 14 nt, Homo sapiens
gaauccuacauaca

SEQ ID NO: 1170242 - RNA, 19 nt, Homo sapiens
gaaucgcuugaaccuggga

SEQ ID NO: 1170243 - RNA, 21 nt, Homo sapiens
gaaucuauccauugaacuaaa

SEQ ID NO: 1170244 - RNA, 13 nt, Homo sapiens
gaaucucagagaa

SEQ ID NO: 1170245 - RNA, 23 nt, Homo sapiens
gaaucucccagacuuguuuccug

SEQ ID NO: 1170246 - RNA, 17 nt, Homo sapiens
gaaucucuauguauauu

SEQ ID NO: 1170247 - RNA, 21 nt, Homo sapiens
gaaugaaaauaacugaaccaa

SEQ ID NO: 1170248 - RNA, 19 nt, Homo sapiens
gaaugaaagaguaaaggaa

SEQ ID NO: 1170249 - RNA, 13 nt, Homo sapiens
gaaugaaccacug

SEQ ID NO: 1170250 - RNA, 15 nt, Homo sapiens
gaaugacacuguuca

SEQ ID NO: 1170251 - RNA, 17 nt, Homo sapiens
gaaugcagcacugcugc

SEQ ID NO: 1170252 - RNA, 17 nt, Homo sapiens
gaauggagcuggcccuc

SEQ ID NO: 1170253 - RNA, 10 nt, Homo sapiens
gaauggugug

SEQ ID NO: 1170254 - RNA, 23 nt, Homo sapiens
gaauguaaguaagugacaaugcu

SEQ ID NO: 1170255 - RNA, 23 nt, Homo sapiens
gaauguguggccugcacagugaa

SEQ ID NO: 1170256 - RNA, 12 nt, Homo sapiens
gaauguguuuca

SEQ ID NO: 1170257 - RNA, 21 nt, Homo sapiens
gaauuaagaauugguugccau

SEQ ID NO: 1170258 - RNA, 23 nt, Homo sapiens
gaauuaagcugugcaauuacugc

SEQ ID NO: 1170259 - RNA, 23 nt, Homo sapiens
gaauuacuuguguuacuugccaa

SEQ ID NO: 1170260 - RNA, 19 nt, Homo sapiens
gaauuagcguuuaauccac

SEQ ID NO: 1170261 - RNA, 18 nt, Homo sapiens
gaauuccauaguggacca

SEQ ID NO: 1170262 - RNA, 17 nt, Homo sapiens
gaauuccaucuuguaaa

SEQ ID NO: 1170263 - RNA, 16 nt, Homo sapiens
gaauucugguguuuau

SEQ ID NO: 1170264 - RNA, 14 nt, Homo sapiens
gaauucuuggggcu

SEQ ID NO: 1170265 - RNA, 15 nt, Homo sapiens
gaauucuuuugccaa

SEQ ID NO: 1170266 - RNA, 17 nt, Homo sapiens
gaauugacaacccaaac

SEQ ID NO: 1170267 - RNA, 17 nt, Homo sapiens
gaauugauugucagcca

SEQ ID NO: 1170268 - RNA, 12 nt, Homo sapiens
gaauuggcauuu

SEQ ID NO: 1170269 - RNA, 23 nt, Homo sapiens
gaauuggccugaacagauguaaa

SEQ ID NO: 1170270 - RNA, 14 nt, Homo sapiens
gaauuggugauucu

SEQ ID NO: 1170271 - RNA, 14 nt, Homo sapiens
gaauugguugccau

SEQ ID NO: 1170272 - RNA, 13 nt, Homo sapiens
gaauuguuuagaa

SEQ ID NO: 1170273 - RNA, 19 nt, Homo sapiens
gaauuucacaagcuauuuu

SEQ ID NO: 1170274 - RNA, 23 nt, Homo sapiens
gaauuucuuugauuuaacugacu

SEQ ID NO: 1170275 - RNA, 20 nt, Homo sapiens
gaauuuugcacaguuaccug

SEQ ID NO: 1170276 - RNA, 23 nt, Homo sapiens
gaauuuugucuccugcuuggaaa

SEQ ID NO: 1170277 - RNA, 22 nt, Homo sapiens
gaauuuuuacuuagauacuaau

SEQ ID NO: 1170278 - RNA, 14 nt, Homo sapiens
gaauuuuugcacau

SEQ ID NO: 1170279 - RNA, 18 nt, Homo sapiens
gaauuuuugcacauucua

SEQ ID NO: 1170280 - RNA, 15 nt, Homo sapiens
gacaaaccauugaaa

SEQ ID NO: 1170281 - RNA, 19 nt, Homo sapiens
gacaaacuccugaaaugcc

SEQ ID NO: 1170282 - RNA, 17 nt, Homo sapiens
gacaaagaaacauuuua

SEQ ID NO: 1170283 - RNA, 17 nt, Homo sapiens
gacaaagaaacccaagu

SEQ ID NO: 1170284 - RNA, 16 nt, Homo sapiens
gacaaagacauuauuu

SEQ ID NO: 1170285 - RNA, 20 nt, Homo sapiens
gacaaagugugucucaaaaa

SEQ ID NO: 1170286 - RNA, 17 nt, Homo sapiens
gacaaauacucaugugu

SEQ ID NO: 1170287 - RNA, 13 nt, Homo sapiens
gacaacacuggga

SEQ ID NO: 1170288 - RNA, 12 nt, Homo sapiens
gacaacaucuga

SEQ ID NO: 1170289 - RNA, 11 nt, Homo sapiens
gacaacauguu

SEQ ID NO: 1170290 - RNA, 17 nt, Homo sapiens
gacaacucuuauuugaa

SEQ ID NO: 1170291 - RNA, 22 nt, Homo sapiens
gacaacugccggggguucaggg

SEQ ID NO: 1170292 - RNA, 20 nt, Homo sapiens
gacaagaccaccaacguguc

SEQ ID NO: 1170293 - RNA, 19 nt, Homo sapiens
gacaagacccccagcacuu

SEQ ID NO: 1170294 - RNA, 17 nt, Homo sapiens
gacaagacccucucagg

SEQ ID NO: 1170295 - RNA, 16 nt, Homo sapiens
gacaagccuaacuuca

SEQ ID NO: 1170296 - RNA, 15 nt, Homo sapiens
gacaaguauggcucc

SEQ ID NO: 1170297 - RNA, 19 nt, Homo sapiens
gacaaguauuaauaguuca

SEQ ID NO: 1170298 - RNA, 19 nt, Homo sapiens
gacaagucauggacauuca

SEQ ID NO: 1170299 - RNA, 17 nt, Homo sapiens
gacaaugacuaagccaa

SEQ ID NO: 1170300 - RNA, 19 nt, Homo sapiens
gacaauguuguaguguccc

SEQ ID NO: 1170301 - RNA, 19 nt, Homo sapiens
gacacaauguugcacugaa

SEQ ID NO: 1170302 - RNA, 19 nt, Homo sapiens
gacacaggcccucccuguu

SEQ ID NO: 1170303 - RNA, 17 nt, Homo sapiens
gacacaggccugcucuc

SEQ ID NO: 1170304 - RNA, 14 nt, Homo sapiens
gacacagugcccaa

SEQ ID NO: 1170305 - RNA, 13 nt, Homo sapiens
gacacaucaggaa

SEQ ID NO: 1170306 - RNA, 16 nt, Homo sapiens
gacaccaaaacaaacc

SEQ ID NO: 1170307 - RNA, 14 nt, Homo sapiens
gacacccucaccac

SEQ ID NO: 1170308 - RNA, 19 nt, Homo sapiens
gacaccugcccagugggcc

SEQ ID NO: 1170309 - RNA, 17 nt, Homo sapiens
gacaccuucugugcuca

SEQ ID NO: 1170310 - RNA, 13 nt, Homo sapiens
gacacugcuuuaa

SEQ ID NO: 1170311 - RNA, 11 nt, Homo sapiens
gacacugugcu

SEQ ID NO: 1170312 - RNA, 20 nt, Homo sapiens
gacacuuaauacuaccuuga

SEQ ID NO: 1170313 - RNA, 15 nt, Homo sapiens
gacacuuacccaagg

SEQ ID NO: 1170314 - RNA, 17 nt, Homo sapiens
gacacuucaaggugaca

SEQ ID NO: 1170315 - RNA, 19 nt, Homo sapiens
gacacuucaaggugacaga

SEQ ID NO: 1170316 - RNA, 14 nt, Homo sapiens
gacagaaccuuguu

SEQ ID NO: 1170317 - RNA, 13 nt, Homo sapiens
gacagaagcagcu

SEQ ID NO: 1170318 - RNA, 14 nt, Homo sapiens
gacagaagcagcuc

SEQ ID NO: 1170319 - RNA, 15 nt, Homo sapiens
gacagaaguguagua

SEQ ID NO: 1170320 - RNA, 15 nt, Homo sapiens
gacagacccucugcc

SEQ ID NO: 1170321 - RNA, 19 nt, Homo sapiens
gacagacucauuaaauauu

SEQ ID NO: 1170322 - RNA, 19 nt, Homo sapiens
gacagaggaugagcucuac

SEQ ID NO: 1170323 - RNA, 17 nt, Homo sapiens
gacagagggagagaaua

SEQ ID NO: 1170324 - RNA, 16 nt, Homo sapiens
gacagagggcacauga

SEQ ID NO: 1170325 - RNA, 22 nt, Homo sapiens
gacagagggcucaccucuugcc

SEQ ID NO: 1170326 - RNA, 20 nt, Homo sapiens
gacagagggucacaguguuu

SEQ ID NO: 1170327 - RNA, 18 nt, Homo sapiens
gacagaggguggcuggag

SEQ ID NO: 1170328 - RNA, 19 nt, Homo sapiens
gacagaugccacacaagga

SEQ ID NO: 1170329 - RNA, 17 nt, Homo sapiens
gacagaugggcauaugu

SEQ ID NO: 1170330 - RNA, 24 nt, Homo sapiens
gacagaugggcauaugugucagug

SEQ ID NO: 1170331 - RNA, 23 nt, Homo sapiens
gacagccccuuaagcaugcuucu

SEQ ID NO: 1170332 - RNA, 14 nt, Homo sapiens
gacagcugugcccu

SEQ ID NO: 1170333 - RNA, 19 nt, Homo sapiens
gacagcuugaucaaaggca

SEQ ID NO: 1170334 - RNA, 20 nt, Homo sapiens
gacagggacaugcccugugu

SEQ ID NO: 1170335 - RNA, 23 nt, Homo sapiens
gacaggguuucaccguguuagcc

SEQ ID NO: 1170336 - RNA, 21 nt, Homo sapiens
gacagucucaccuccugccau

SEQ ID NO: 1170337 - RNA, 11 nt, Homo sapiens
gacagugaaag

SEQ ID NO: 1170338 - RNA, 16 nt, Homo sapiens
gacagugaacauucug

SEQ ID NO: 1170339 - RNA, 15 nt, Homo sapiens
gacagugaccccagu

SEQ ID NO: 1170340 - RNA, 22 nt, Homo sapiens
gacaguugauuuccaacaugag

SEQ ID NO: 1170341 - RNA, 16 nt, Homo sapiens
gacaguugcagcccuu

SEQ ID NO: 1170342 - RNA, 18 nt, Homo sapiens
gacaguuuacuuugccaa

SEQ ID NO: 1170343 - RNA, 19 nt, Homo sapiens
gacaguuuacuuugccaac

SEQ ID NO: 1170344 - RNA, 14 nt, Homo sapiens
gacauaauuuacau

SEQ ID NO: 1170345 - RNA, 21 nt, Homo sapiens
gacauauguagaugugcugca

SEQ ID NO: 1170346 - RNA, 19 nt, Homo sapiens
gacauccccccgccaaaag

SEQ ID NO: 1170347 - RNA, 16 nt, Homo sapiens
gacaugauuuccuuga

SEQ ID NO: 1170348 - RNA, 18 nt, Homo sapiens
gacaugauuuccuugaau

SEQ ID NO: 1170349 - RNA, 18 nt, Homo sapiens
gacaugcuucagugcugc

SEQ ID NO: 1170350 - RNA, 17 nt, Homo sapiens
gacaugcuuugugccau

SEQ ID NO: 1170351 - RNA, 20 nt, Homo sapiens
gacauggagaacaacccaag

SEQ ID NO: 1170352 - RNA, 19 nt, Homo sapiens
gacauggagaccgugacca

SEQ ID NO: 1170353 - RNA, 16 nt, Homo sapiens
gacaugucucacagac

SEQ ID NO: 1170354 - RNA, 14 nt, Homo sapiens
gacauguugcucuu

SEQ ID NO: 1170355 - RNA, 13 nt, Homo sapiens
gacauuagauuga

SEQ ID NO: 1170356 - RNA, 20 nt, Homo sapiens
gacauuauaaguacuugguc

SEQ ID NO: 1170357 - RNA, 18 nt, Homo sapiens
gacauuuuuucagucaua

SEQ ID NO: 1170358 - RNA, 21 nt, Homo sapiens
gacauuuuuucagucauauaa

SEQ ID NO: 1170359 - RNA, 20 nt, Homo sapiens
gacauuuuuugcuauaauca

SEQ ID NO: 1170360 - RNA, 17 nt, Homo sapiens
gaccaaagagcccucaa

SEQ ID NO: 1170361 - RNA, 22 nt, Homo sapiens
gaccaccaacguguccuuguac

SEQ ID NO: 1170362 - RNA, 11 nt, Homo sapiens
gaccaccagca

SEQ ID NO: 1170363 - RNA, 21 nt, Homo sapiens
gaccacucuuccugaguucag

SEQ ID NO: 1170364 - RNA, 22 nt, Homo sapiens
gaccacugaagcaccacaggga

SEQ ID NO: 1170365 - RNA, 17 nt, Homo sapiens
gaccacuuggaaauaaa

SEQ ID NO: 1170366 - RNA, 17 nt, Homo sapiens
gaccagccugaccaaca

SEQ ID NO: 1170367 - RNA, 20 nt, Homo sapiens
gaccagcucugggguuugua

SEQ ID NO: 1170368 - RNA, 19 nt, Homo sapiens
gaccaggggaccagaggga

SEQ ID NO: 1170369 - RNA, 11 nt, Homo sapiens
gaccauaucac

SEQ ID NO: 1170370 - RNA, 21 nt, Homo sapiens
gaccaucugaugugaugugaa

SEQ ID NO: 1170371 - RNA, 17 nt, Homo sapiens
gaccaugaaacauugua

SEQ ID NO: 1170372 - RNA, 14 nt, Homo sapiens
gaccauuuggucag

SEQ ID NO: 1170373 - RNA, 18 nt, Homo sapiens
gacccacucugcggcccg

SEQ ID NO: 1170374 - RNA, 18 nt, Homo sapiens
gacccacuucucaucaca

SEQ ID NO: 1170375 - RNA, 17 nt, Homo sapiens
gacccauccaguucucu

SEQ ID NO: 1170376 - RNA, 21 nt, Homo sapiens
gaccccaccccucaucaggag

SEQ ID NO: 1170377 - RNA, 17 nt, Homo sapiens
gaccccagcauucucag

SEQ ID NO: 1170378 - RNA, 17 nt, Homo sapiens
gaccccaucuuccagcc

SEQ ID NO: 1170379 - RNA, 15 nt, Homo sapiens
gacccccagcacuug

SEQ ID NO: 1170380 - RNA, 13 nt, Homo sapiens
gacccccaucccc

SEQ ID NO: 1170381 - RNA, 18 nt, Homo sapiens
gaccccugacucaucauu

SEQ ID NO: 1170382 - RNA, 17 nt, Homo sapiens
gacccggcggcccugcu

SEQ ID NO: 1170383 - RNA, 17 nt, Homo sapiens
gacccuggaacuggaga

SEQ ID NO: 1170384 - RNA, 16 nt, Homo sapiens
gacccugucucaaaaa

SEQ ID NO: 1170385 - RNA, 22 nt, Homo sapiens
gaccgcaggccucagcaucucc

SEQ ID NO: 1170386 - RNA, 22 nt, Homo sapiens
gaccuccaagccacugagcaau

SEQ ID NO: 1170387 - RNA, 16 nt, Homo sapiens
gaccucccacugcccc

SEQ ID NO: 1170388 - RNA, 13 nt, Homo sapiens
gaccuccugacaa

SEQ ID NO: 1170389 - RNA, 12 nt, Homo sapiens
gaccucuagccc

SEQ ID NO: 1170390 - RNA, 15 nt, Homo sapiens
gaccugacaccuuuc

SEQ ID NO: 1170391 - RNA, 17 nt, Homo sapiens
gaccugacaccuuucau

SEQ ID NO: 1170392 - RNA, 16 nt, Homo sapiens
gaccugagccagaccu

SEQ ID NO: 1170393 - RNA, 15 nt, Homo sapiens
gaccugauccuggag

SEQ ID NO: 1170394 - RNA, 15 nt, Homo sapiens
gaccugccagccggu

SEQ ID NO: 1170395 - RNA, 15 nt, Homo sapiens
gaccugccuccuucc

SEQ ID NO: 1170396 - RNA, 14 nt, Homo sapiens
gaccuggacacagg

SEQ ID NO: 1170397 - RNA, 19 nt, Homo sapiens
gaccuggagcagcugacuu

SEQ ID NO: 1170398 - RNA, 23 nt, Homo sapiens
gaccugguacaaaugcacgucac

SEQ ID NO: 1170399 - RNA, 13 nt, Homo sapiens
gaccuuaaacuga

SEQ ID NO: 1170400 - RNA, 17 nt, Homo sapiens
gaccuucaacuuccaaa

SEQ ID NO: 1170401 - RNA, 14 nt, Homo sapiens
gaccuucagcucac

SEQ ID NO: 1170402 - RNA, 14 nt, Homo sapiens
gaccuucauuucau

SEQ ID NO: 1170403 - RNA, 17 nt, Homo sapiens
gaccuugggguacaauu

SEQ ID NO: 1170404 - RNA, 19 nt, Homo sapiens
gaccuuguagagaacacgc

SEQ ID NO: 1170405 - RNA, 17 nt, Homo sapiens
gaccuuuuauccacuua

SEQ ID NO: 1170406 - RNA, 23 nt, Homo sapiens
gaccuuuuuaucuugaguguuau

SEQ ID NO: 1170407 - RNA, 15 nt, Homo sapiens
gacgaggcucaaaaa

SEQ ID NO: 1170408 - RNA, 17 nt, Homo sapiens
gacgucucaagacugaa

SEQ ID NO: 1170409 - RNA, 21 nt, Homo sapiens
gacguuggccucagggccagg

SEQ ID NO: 1170410 - RNA, 22 nt, Homo sapiens
gacuaauuucaaaaugcuuuuu

SEQ ID NO: 1170411 - RNA, 17 nt, Homo sapiens
gacuacauguuacuaag

SEQ ID NO: 1170412 - RNA, 18 nt, Homo sapiens
gacuaggauaauguccaa

SEQ ID NO: 1170413 - RNA, 19 nt, Homo sapiens
gacuaguaucaaguguucu

SEQ ID NO: 1170414 - RNA, 19 nt, Homo sapiens
gacuagugagucagcaccu

SEQ ID NO: 1170415 - RNA, 16 nt, Homo sapiens
gacuauaaagcuguua

SEQ ID NO: 1170416 - RNA, 19 nt, Homo sapiens
gacuauguaauuguaacua

SEQ ID NO: 1170417 - RNA, 17 nt, Homo sapiens
gacuauuaggugcaauu

SEQ ID NO: 1170418 - RNA, 16 nt, Homo sapiens
gacucaaauguucuaa

SEQ ID NO: 1170419 - RNA, 16 nt, Homo sapiens
gacucacccuccacaa

SEQ ID NO: 1170420 - RNA, 19 nt, Homo sapiens
gacucacccuccacaaagc

SEQ ID NO: 1170421 - RNA, 16 nt, Homo sapiens
gacucaggacaucccc

SEQ ID NO: 1170422 - RNA, 13 nt, Homo sapiens
gacucagugcaga

SEQ ID NO: 1170423 - RNA, 20 nt, Homo sapiens
gacucauuaaauauucugua

SEQ ID NO: 1170424 - RNA, 14 nt, Homo sapiens
gacuccaucucaaa

SEQ ID NO: 1170425 - RNA, 12 nt, Homo sapiens
gacuccaucucu

SEQ ID NO: 1170426 - RNA, 20 nt, Homo sapiens
gacucccuccauagcgacac

SEQ ID NO: 1170427 - RNA, 15 nt, Homo sapiens
gacuccggcccuccu

SEQ ID NO: 1170428 - RNA, 18 nt, Homo sapiens
gacucgauguguacucua

SEQ ID NO: 1170429 - RNA, 13 nt, Homo sapiens
gacucugaacaau

SEQ ID NO: 1170430 - RNA, 10 nt, Homo sapiens
gacucugcac

SEQ ID NO: 1170431 - RNA, 20 nt, Homo sapiens
gacucugcacaugucuugua

SEQ ID NO: 1170432 - RNA, 23 nt, Homo sapiens
gacucugucuuguucacugcagu

SEQ ID NO: 1170433 - RNA, 15 nt, Homo sapiens
gacucuuccaccaga

SEQ ID NO: 1170434 - RNA, 16 nt, Homo sapiens
gacucuuccaccagag

SEQ ID NO: 1170435 - RNA, 19 nt, Homo sapiens
gacugcuaaaugcacugac

SEQ ID NO: 1170436 - RNA, 16 nt, Homo sapiens
gacugcucaaccucac

SEQ ID NO: 1170437 - RNA, 11 nt, Homo sapiens
gacugcugcuc

SEQ ID NO: 1170438 - RNA, 17 nt, Homo sapiens
gacuggcacacuggccu

SEQ ID NO: 1170439 - RNA, 23 nt, Homo sapiens
gacugggacagcccaggaaacaa

SEQ ID NO: 1170440 - RNA, 16 nt, Homo sapiens
gacuggggguggggca

SEQ ID NO: 1170441 - RNA, 17 nt, Homo sapiens
gacuguagauuauuuau

SEQ ID NO: 1170442 - RNA, 16 nt, Homo sapiens
gacugugccagcacaa

SEQ ID NO: 1170443 - RNA, 17 nt, Homo sapiens
gacugugccagcacaaa

SEQ ID NO: 1170444 - RNA, 23 nt, Homo sapiens
gacuguggacguggguugcacug

SEQ ID NO: 1170445 - RNA, 18 nt, Homo sapiens
gacuguggcacuugccug

SEQ ID NO: 1170446 - RNA, 21 nt, Homo sapiens
gacuuaacgugcucaugggcu

SEQ ID NO: 1170447 - RNA, 15 nt, Homo sapiens
gacuuagaaacaaug

SEQ ID NO: 1170448 - RNA, 23 nt, Homo sapiens
gacuuaugaaacuugaaaccgcc

SEQ ID NO: 1170449 - RNA, 18 nt, Homo sapiens
gacuuauggaacagggau

SEQ ID NO: 1170450 - RNA, 14 nt, Homo sapiens
gacuuauguggaac

SEQ ID NO: 1170451 - RNA, 16 nt, Homo sapiens
gacuucacagugaagu

SEQ ID NO: 1170452 - RNA, 19 nt, Homo sapiens
gacuucagaguacauccau

SEQ ID NO: 1170453 - RNA, 23 nt, Homo sapiens
gacuucccuaacacuuaccccau

SEQ ID NO: 1170454 - RNA, 15 nt, Homo sapiens
gacuucuugaaauca

SEQ ID NO: 1170455 - RNA, 20 nt, Homo sapiens
gacuugucccgggacaccua

SEQ ID NO: 1170456 - RNA, 12 nt, Homo sapiens
gacuuguucuca

SEQ ID NO: 1170457 - RNA, 15 nt, Homo sapiens
gacuuuaucaugugu

SEQ ID NO: 1170458 - RNA, 20 nt, Homo sapiens
gagaaaaagaaagaacuguc

SEQ ID NO: 1170459 - RNA, 21 nt, Homo sapiens
gagaaaguuggugcugcucau

SEQ ID NO: 1170460 - RNA, 22 nt, Homo sapiens
gagaaauugacagaucaagcug

SEQ ID NO: 1170461 - RNA, 19 nt, Homo sapiens
gagaacaccagagaccuca

SEQ ID NO: 1170462 - RNA, 19 nt, Homo sapiens
gagaacaguuguccaggau

SEQ ID NO: 1170463 - RNA, 19 nt, Homo sapiens
gagaacaucauaacccaug

SEQ ID NO: 1170464 - RNA, 16 nt, Homo sapiens
gagaacccacugcuuu

SEQ ID NO: 1170465 - RNA, 20 nt, Homo sapiens
gagaacuaaagguggccaca

SEQ ID NO: 1170466 - RNA, 22 nt, Homo sapiens
gagaacugccuuuggcagaguu

SEQ ID NO: 1170467 - RNA, 22 nt, Homo sapiens
gagaagaaaacaucuauucucu

SEQ ID NO: 1170468 - RNA, 15 nt, Homo sapiens
gagaagcaaggguug

SEQ ID NO: 1170469 - RNA, 20 nt, Homo sapiens
gagaagccaggaauuuccca

SEQ ID NO: 1170470 - RNA, 15 nt, Homo sapiens
gagaaggaaagugau

SEQ ID NO: 1170471 - RNA, 16 nt, Homo sapiens
gagaaggaaaugcagg

SEQ ID NO: 1170472 - RNA, 15 nt, Homo sapiens
gagaaggaggggagc

SEQ ID NO: 1170473 - RNA, 19 nt, Homo sapiens
gagaagucugcaagauguc

SEQ ID NO: 1170474 - RNA, 20 nt, Homo sapiens
gagaaguuggucuuacuuug

SEQ ID NO: 1170475 - RNA, 21 nt, Homo sapiens
gagaauaaacuagacucugaa

SEQ ID NO: 1170476 - RNA, 13 nt, Homo sapiens
gagaaucacuuga

SEQ ID NO: 1170477 - RNA, 18 nt, Homo sapiens
gagaauggaaaccacaac

SEQ ID NO: 1170478 - RNA, 13 nt, Homo sapiens
gagacaaagcagg

SEQ ID NO: 1170479 - RNA, 14 nt, Homo sapiens
gagacacagggaag

SEQ ID NO: 1170480 - RNA, 22 nt, Homo sapiens
gagacagcuugaucaaaggcac

SEQ ID NO: 1170481 - RNA, 15 nt, Homo sapiens
gagacaggaggucag

SEQ ID NO: 1170482 - RNA, 21 nt, Homo sapiens
gagacaggaggucagcacaag

SEQ ID NO: 1170483 - RNA, 15 nt, Homo sapiens
gagacaggcaaacug

SEQ ID NO: 1170484 - RNA, 17 nt, Homo sapiens
gagacaggguuucaccg

SEQ ID NO: 1170485 - RNA, 23 nt, Homo sapiens
gagacauacuugaagggccagag

SEQ ID NO: 1170486 - RNA, 14 nt, Homo sapiens
gagaccaggggacc

SEQ ID NO: 1170487 - RNA, 15 nt, Homo sapiens
gagaccaggggacca

SEQ ID NO: 1170488 - RNA, 16 nt, Homo sapiens
gagacccguccauuug

SEQ ID NO: 1170489 - RNA, 14 nt, Homo sapiens
gagacccucucagc

SEQ ID NO: 1170490 - RNA, 19 nt, Homo sapiens
gagacccugucucaaaaaa

SEQ ID NO: 1170491 - RNA, 21 nt, Homo sapiens
gagaccuuugauuuuugccca

SEQ ID NO: 1170492 - RNA, 21 nt, Homo sapiens
gagaccuuugauuuuuugccc

SEQ ID NO: 1170493 - RNA, 16 nt, Homo sapiens
gagacuaggagggaau

SEQ ID NO: 1170494 - RNA, 14 nt, Homo sapiens
gagacucagugcag

SEQ ID NO: 1170495 - RNA, 15 nt, Homo sapiens
gagacucagugcaga

SEQ ID NO: 1170496 - RNA, 14 nt, Homo sapiens
gagacuccaucuca

SEQ ID NO: 1170497 - RNA, 12 nt, Homo sapiens
gagacugaguca

SEQ ID NO: 1170498 - RNA, 13 nt, Homo sapiens
gagacuggcauuu

SEQ ID NO: 1170499 - RNA, 13 nt, Homo sapiens
gagacuguuauca

SEQ ID NO: 1170500 - RNA, 22 nt, Homo sapiens
gagacuugccuuccuaagccug

SEQ ID NO: 1170501 - RNA, 21 nt, Homo sapiens
gagagaaaaagaaagaacugu

SEQ ID NO: 1170502 - RNA, 21 nt, Homo sapiens
gagagaacugagcaucuccag

SEQ ID NO: 1170503 - RNA, 18 nt, Homo sapiens
gagagaauucuguucuaa

SEQ ID NO: 1170504 - RNA, 14 nt, Homo sapiens
gagagagaaggcag

SEQ ID NO: 1170505 - RNA, 16 nt, Homo sapiens
gagagauaccuugaaa

SEQ ID NO: 1170506 - RNA, 14 nt, Homo sapiens
gagagauagccugu

SEQ ID NO: 1170507 - RNA, 17 nt, Homo sapiens
gagagcaaagugaccug

SEQ ID NO: 1170508 - RNA, 13 nt, Homo sapiens
gagagcacagccc

SEQ ID NO: 1170509 - RNA, 16 nt, Homo sapiens
gagagcacccacugaa

SEQ ID NO: 1170510 - RNA, 20 nt, Homo sapiens
gagagcacuagaagugguuu

SEQ ID NO: 1170511 - RNA, 19 nt, Homo sapiens
gagaggcccggugcagcug

SEQ ID NO: 1170512 - RNA, 22 nt, Homo sapiens
gagaggcccucuggaguggcca

SEQ ID NO: 1170513 - RNA, 12 nt, Homo sapiens
gagaggcugugu

SEQ ID NO: 1170514 - RNA, 18 nt, Homo sapiens
gagagggcugcugaccau

SEQ ID NO: 1170515 - RNA, 18 nt, Homo sapiens
gagaggggagugcauuua

SEQ ID NO: 1170516 - RNA, 18 nt, Homo sapiens
gagagguggggaguaaua

SEQ ID NO: 1170517 - RNA, 22 nt, Homo sapiens
gagaguagaugguuugagccug

SEQ ID NO: 1170518 - RNA, 13 nt, Homo sapiens
gagaguccagcua

SEQ ID NO: 1170519 - RNA, 16 nt, Homo sapiens
gagagugucaaccaga

SEQ ID NO: 1170520 - RNA, 20 nt, Homo sapiens
gagauaaauuuaaagucuaa

SEQ ID NO: 1170521 - RNA, 14 nt, Homo sapiens
gagauacugcaugu

SEQ ID NO: 1170522 - RNA, 17 nt, Homo sapiens
gagauaugggaacacug

SEQ ID NO: 1170523 - RNA, 13 nt, Homo sapiens
gagauccaaagac

SEQ ID NO: 1170524 - RNA, 16 nt, Homo sapiens
gagaucccaacacugc

SEQ ID NO: 1170525 - RNA, 16 nt, Homo sapiens
gagaucugcacaguca

SEQ ID NO: 1170526 - RNA, 11 nt, Homo sapiens
gagaugaagga

SEQ ID NO: 1170527 - RNA, 21 nt, Homo sapiens
gagaugaaggaaggacuauga

SEQ ID NO: 1170528 - RNA, 14 nt, Homo sapiens
gagaugacagggaa

SEQ ID NO: 1170529 - RNA, 17 nt, Homo sapiens
gagaugagguuucacca

SEQ ID NO: 1170530 - RNA, 18 nt, Homo sapiens
gagauggacaacucaaug

SEQ ID NO: 1170531 - RNA, 19 nt, Homo sapiens
gagauguggaaaagccaag

SEQ ID NO: 1170532 - RNA, 19 nt, Homo sapiens
gagauugcacagucaaaac

SEQ ID NO: 1170533 - RNA, 17 nt, Homo sapiens
gagauuguuguuugcca

SEQ ID NO: 1170534 - RNA, 12 nt, Homo sapiens
gagauuugccac

SEQ ID NO: 1170535 - RNA, 22 nt, Homo sapiens
gagcaaaacuccgucucaaaaa

SEQ ID NO: 1170536 - RNA, 19 nt, Homo sapiens
gagcaaaaugcucuugucc

SEQ ID NO: 1170537 - RNA, 23 nt, Homo sapiens
gagcaaacuaacuugacuuuuaa

SEQ ID NO: 1170538 - RNA, 13 nt, Homo sapiens
gagcaaacugcuc

SEQ ID NO: 1170539 - RNA, 12 nt, Homo sapiens
gagcaacaguaa

SEQ ID NO: 1170540 - RNA, 17 nt, Homo sapiens
gagcaacuaacuaacca

SEQ ID NO: 1170541 - RNA, 13 nt, Homo sapiens
gagcaagacucca

SEQ ID NO: 1170542 - RNA, 14 nt, Homo sapiens
gagcaaguccuucc

SEQ ID NO: 1170543 - RNA, 21 nt, Homo sapiens
gagcaagucuuagacaucaua

SEQ ID NO: 1170544 - RNA, 15 nt, Homo sapiens
gagcaaucacaggaa

SEQ ID NO: 1170545 - RNA, 15 nt, Homo sapiens
gagcaaucugacccu

SEQ ID NO: 1170546 - RNA, 16 nt, Homo sapiens
gagcaccgccugugaa

SEQ ID NO: 1170547 - RNA, 13 nt, Homo sapiens
gagcacucucacc

SEQ ID NO: 1170548 - RNA, 15 nt, Homo sapiens
gagcacucucacccc

SEQ ID NO: 1170549 - RNA, 22 nt, Homo sapiens
gagcagaugcaaugacucagga

SEQ ID NO: 1170550 - RNA, 15 nt, Homo sapiens
gagcauacaucuuaa

SEQ ID NO: 1170551 - RNA, 16 nt, Homo sapiens
gagcauaguccaaaaa

SEQ ID NO: 1170552 - RNA, 16 nt, Homo sapiens
gagccaaaggcaucca

SEQ ID NO: 1170553 - RNA, 15 nt, Homo sapiens
gagccaccccaggaa

SEQ ID NO: 1170554 - RNA, 13 nt, Homo sapiens
gagccauaugaau

SEQ ID NO: 1170555 - RNA, 17 nt, Homo sapiens
gagccauggaagggugg

SEQ ID NO: 1170556 - RNA, 19 nt, Homo sapiens
gagcccagauugugccacu

SEQ ID NO: 1170557 - RNA, 19 nt, Homo sapiens
gagcccccagcugccaaag

SEQ ID NO: 1170558 - RNA, 22 nt, Homo sapiens
gagccccuccucccccggcugg

SEQ ID NO: 1170559 - RNA, 23 nt, Homo sapiens
gagccccuccuuccuucaagcca

SEQ ID NO: 1170560 - RNA, 17 nt, Homo sapiens
gagcccgcagcccagac

SEQ ID NO: 1170561 - RNA, 22 nt, Homo sapiens
gagccgagcggggagccaggaa

SEQ ID NO: 1170562 - RNA, 16 nt, Homo sapiens
gagccgggagccugac

SEQ ID NO: 1170563 - RNA, 17 nt, Homo sapiens
gagccgggucugccucu

SEQ ID NO: 1170564 - RNA, 13 nt, Homo sapiens
gagccuccagcug

SEQ ID NO: 1170565 - RNA, 14 nt, Homo sapiens
gagccucgggacau

SEQ ID NO: 1170566 - RNA, 14 nt, Homo sapiens
gagccugcagggaa

SEQ ID NO: 1170567 - RNA, 20 nt, Homo sapiens
gagccugggauuucuaugca

SEQ ID NO: 1170568 - RNA, 19 nt, Homo sapiens
gagcguguggcugugcccc

SEQ ID NO: 1170569 - RNA, 16 nt, Homo sapiens
gagcuacaugguggag

SEQ ID NO: 1170570 - RNA, 17 nt, Homo sapiens
gagcuauacauaugugc

SEQ ID NO: 1170571 - RNA, 20 nt, Homo sapiens
gagcucuccacccacucaca

SEQ ID NO: 1170572 - RNA, 17 nt, Homo sapiens
gagcucuccaggccagg

SEQ ID NO: 1170573 - RNA, 13 nt, Homo sapiens
gagcucugaccca

SEQ ID NO: 1170574 - RNA, 15 nt, Homo sapiens
gagcucugcgccagg

SEQ ID NO: 1170575 - RNA, 23 nt, Homo sapiens
gagcucuugugucauuguuagaa

SEQ ID NO: 1170576 - RNA, 13 nt, Homo sapiens
gagcuggaggcac

SEQ ID NO: 1170577 - RNA, 21 nt, Homo sapiens
gagcugguuccucucucccac

SEQ ID NO: 1170578 - RNA, 21 nt, Homo sapiens
gagcuucccugacucauucug

SEQ ID NO: 1170579 - RNA, 21 nt, Homo sapiens
gagcuuggaagcuucugguga

SEQ ID NO: 1170580 - RNA, 23 nt, Homo sapiens
gaggaaaagagaaggaaagugau

SEQ ID NO: 1170581 - RNA, 16 nt, Homo sapiens
gaggaacucgccucag

SEQ ID NO: 1170582 - RNA, 22 nt, Homo sapiens
gaggacaagggaaaugucaggg

SEQ ID NO: 1170583 - RNA, 15 nt, Homo sapiens
gaggagaagcaaugg

SEQ ID NO: 1170584 - RNA, 15 nt, Homo sapiens
gaggagcaagggugg

SEQ ID NO: 1170585 - RNA, 16 nt, Homo sapiens
gaggagcacaguuugu

SEQ ID NO: 1170586 - RNA, 14 nt, Homo sapiens
gaggagccucagaa

SEQ ID NO: 1170587 - RNA, 18 nt, Homo sapiens
gaggagggcgugacucac

SEQ ID NO: 1170588 - RNA, 14 nt, Homo sapiens
gaggauaugucuca

SEQ ID NO: 1170589 - RNA, 14 nt, Homo sapiens
gaggaugagcucua

SEQ ID NO: 1170590 - RNA, 19 nt, Homo sapiens
gaggauuaggggaugggga

SEQ ID NO: 1170591 - RNA, 18 nt, Homo sapiens
gaggcaaagcuggcucac

SEQ ID NO: 1170592 - RNA, 20 nt, Homo sapiens
gaggcaaauggcacugcagg

SEQ ID NO: 1170593 - RNA, 19 nt, Homo sapiens
gaggcacaagaaucacuug

SEQ ID NO: 1170594 - RNA, 20 nt, Homo sapiens
gaggcagaggcugcauugag

SEQ ID NO: 1170595 - RNA, 17 nt, Homo sapiens
gaggcagggcugcauug

SEQ ID NO: 1170596 - RNA, 13 nt, Homo sapiens
gaggccaacacug

SEQ ID NO: 1170597 - RNA, 17 nt, Homo sapiens
gaggccaacacuguggg

SEQ ID NO: 1170598 - RNA, 16 nt, Homo sapiens
gaggccacacucagca

SEQ ID NO: 1170599 - RNA, 19 nt, Homo sapiens
gaggccaguaccuuuccau

SEQ ID NO: 1170600 - RNA, 13 nt, Homo sapiens
gaggccucaggga

SEQ ID NO: 1170601 - RNA, 21 nt, Homo sapiens
gaggcggaucaucuaauucuc

SEQ ID NO: 1170602 - RNA, 14 nt, Homo sapiens
gaggcggaucuuug

SEQ ID NO: 1170603 - RNA, 15 nt, Homo sapiens
gaggcguuugaauca

SEQ ID NO: 1170604 - RNA, 14 nt, Homo sapiens
gaggcucaaaaacu

SEQ ID NO: 1170605 - RNA, 22 nt, Homo sapiens
gaggcucaaaaacuugaucaca

SEQ ID NO: 1170606 - RNA, 13 nt, Homo sapiens
gaggcugcagcca

SEQ ID NO: 1170607 - RNA, 19 nt, Homo sapiens
gaggcugcuuuccaaagcc

SEQ ID NO: 1170608 - RNA, 21 nt, Homo sapiens
gaggcugcuuuccaaagccaa

SEQ ID NO: 1170609 - RNA, 13 nt, Homo sapiens
gagggaaggugac

SEQ ID NO: 1170610 - RNA, 20 nt, Homo sapiens
gagggaccugcaucuaagca

SEQ ID NO: 1170611 - RNA, 18 nt, Homo sapiens
gagggagaccccaaaaag

SEQ ID NO: 1170612 - RNA, 17 nt, Homo sapiens
gagggaggcucaggucc

SEQ ID NO: 1170613 - RNA, 14 nt, Homo sapiens
gagggauccgucuc

SEQ ID NO: 1170614 - RNA, 19 nt, Homo sapiens
gagggauuucuuugcugua

SEQ ID NO: 1170615 - RNA, 17 nt, Homo sapiens
gagggccacaugggagg

SEQ ID NO: 1170616 - RNA, 22 nt, Homo sapiens
gagggcgcggggcggggagcga

SEQ ID NO: 1170617 - RNA, 15 nt, Homo sapiens
gagggcuacaaagga

SEQ ID NO: 1170618 - RNA, 16 nt, Homo sapiens
gagggcucagggcagu

SEQ ID NO: 1170619 - RNA, 17 nt, Homo sapiens
gagggggccaggcggug

SEQ ID NO: 1170620 - RNA, 21 nt, Homo sapiens
gagggggcucuuguguguucu

SEQ ID NO: 1170621 - RNA, 23 nt, Homo sapiens
gaggguccucaguccacugcuga

SEQ ID NO: 1170622 - RNA, 13 nt, Homo sapiens
gagguacacucuu

SEQ ID NO: 1170623 - RNA, 14 nt, Homo sapiens
gaggucagcacaag

SEQ ID NO: 1170624 - RNA, 18 nt, Homo sapiens
gaggugccuucuucaggg

SEQ ID NO: 1170625 - RNA, 19 nt, Homo sapiens
gagguggagguugcaguga

SEQ ID NO: 1170626 - RNA, 20 nt, Homo sapiens
gagguggcuaagggggacca

SEQ ID NO: 1170627 - RNA, 13 nt, Homo sapiens
gagguggcugccu

SEQ ID NO: 1170628 - RNA, 21 nt, Homo sapiens
gaggugggaaaaucacuugaa

SEQ ID NO: 1170629 - RNA, 14 nt, Homo sapiens
gagguuaaagcaaa

SEQ ID NO: 1170630 - RNA, 17 nt, Homo sapiens
gagguucaaaaguaaga

SEQ ID NO: 1170631 - RNA, 14 nt, Homo sapiens
gagguugcagugag

SEQ ID NO: 1170632 - RNA, 20 nt, Homo sapiens
gagguugugcauggaggcca

SEQ ID NO: 1170633 - RNA, 23 nt, Homo sapiens
gagguuuuuuugucaacauugug

SEQ ID NO: 1170634 - RNA, 18 nt, Homo sapiens
gaguaauaguaaacacag

SEQ ID NO: 1170635 - RNA, 14 nt, Homo sapiens
gaguaaucugugua

SEQ ID NO: 1170636 - RNA, 19 nt, Homo sapiens
gaguacaccccaacagcac

SEQ ID NO: 1170637 - RNA, 16 nt, Homo sapiens
gaguauaaauuuacuu

SEQ ID NO: 1170638 - RNA, 14 nt, Homo sapiens
gaguauagcucugu

SEQ ID NO: 1170639 - RNA, 22 nt, Homo sapiens
gagucaauccccucauucagga

SEQ ID NO: 1170640 - RNA, 21 nt, Homo sapiens
gagucagcaccccuccuagca

SEQ ID NO: 1170641 - RNA, 15 nt, Homo sapiens
gagucauugcuguag

SEQ ID NO: 1170642 - RNA, 12 nt, Homo sapiens
gaguccaagacc

SEQ ID NO: 1170643 - RNA, 18 nt, Homo sapiens
gaguccauuguggagcca

SEQ ID NO: 1170644 - RNA, 20 nt, Homo sapiens
gaguccuuacugaagccagg

SEQ ID NO: 1170645 - RNA, 13 nt, Homo sapiens
gagucuagauucu

SEQ ID NO: 1170646 - RNA, 17 nt, Homo sapiens
gagucucugaacauccu

SEQ ID NO: 1170647 - RNA, 11 nt, Homo sapiens
gagucuguucu

SEQ ID NO: 1170648 - RNA, 17 nt, Homo sapiens
gagucuugacaaucaca

SEQ ID NO: 1170649 - RNA, 17 nt, Homo sapiens
gagugaaacauugaacu

SEQ ID NO: 1170650 - RNA, 18 nt, Homo sapiens
gagugaaacauugaacuc

SEQ ID NO: 1170651 - RNA, 14 nt, Homo sapiens
gagugaaaguacuu

SEQ ID NO: 1170652 - RNA, 23 nt, Homo sapiens
gagugaaggugcuggaaagggag

SEQ ID NO: 1170653 - RNA, 17 nt, Homo sapiens
gagugacccagcuacug

SEQ ID NO: 1170654 - RNA, 15 nt, Homo sapiens
gagugagcacucacg

SEQ ID NO: 1170655 - RNA, 12 nt, Homo sapiens
gagugcauuuag

SEQ ID NO: 1170656 - RNA, 14 nt, Homo sapiens
gagugcccccaaca

SEQ ID NO: 1170657 - RNA, 13 nt, Homo sapiens
gagugcugggauu

SEQ ID NO: 1170658 - RNA, 16 nt, Homo sapiens
gagugcuuacacuuau

SEQ ID NO: 1170659 - RNA, 14 nt, Homo sapiens
gaguggaaggugag

SEQ ID NO: 1170660 - RNA, 14 nt, Homo sapiens
gaguguaaaccaaa

SEQ ID NO: 1170661 - RNA, 22 nt, Homo sapiens
gaguguuccccuuccacugagg

SEQ ID NO: 1170662 - RNA, 19 nt, Homo sapiens
gaguguuccugugcuuaua

SEQ ID NO: 1170663 - RNA, 16 nt, Homo sapiens
gaguuaaaucuuccag

SEQ ID NO: 1170664 - RNA, 20 nt, Homo sapiens
gaguuaguggauaaccacag

SEQ ID NO: 1170665 - RNA, 19 nt, Homo sapiens
gaguucgagaccagccuga

SEQ ID NO: 1170666 - RNA, 22 nt, Homo sapiens
gaguucuugugccauagucaca

SEQ ID NO: 1170667 - RNA, 14 nt, Homo sapiens
gaguucuuugcaag

SEQ ID NO: 1170668 - RNA, 21 nt, Homo sapiens
gaguuggagugagaugaagga

SEQ ID NO: 1170669 - RNA, 18 nt, Homo sapiens
gaguuggcguugugggca

SEQ ID NO: 1170670 - RNA, 23 nt, Homo sapiens
gaguuuuaaagaagucucuuaau

SEQ ID NO: 1170671 - RNA, 23 nt, Homo sapiens
gauaaaacugguuuuagacaaaa

SEQ ID NO: 1170672 - RNA, 16 nt, Homo sapiens
gauaaaagacagugaa

SEQ ID NO: 1170673 - RNA, 20 nt, Homo sapiens
gauaaaauacuaaacuacau

SEQ ID NO: 1170674 - RNA, 18 nt, Homo sapiens
gauaaacaguuucuuugu

SEQ ID NO: 1170675 - RNA, 23 nt, Homo sapiens
gauaaacugauuuaucuauuuaa

SEQ ID NO: 1170676 - RNA, 12 nt, Homo sapiens
gauaaccaggcu

SEQ ID NO: 1170677 - RNA, 17 nt, Homo sapiens
gauaaccuugugccuug

SEQ ID NO: 1170678 - RNA, 18 nt, Homo sapiens
gauaaccuugugccuugg

SEQ ID NO: 1170679 - RNA, 18 nt, Homo sapiens
gauaacuaggaaauccau

SEQ ID NO: 1170680 - RNA, 13 nt, Homo sapiens
gauaacucaggaa

SEQ ID NO: 1170681 - RNA, 12 nt, Homo sapiens
gauaacuuugac

SEQ ID NO: 1170682 - RNA, 19 nt, Homo sapiens
gauaagccaauccucacuc

SEQ ID NO: 1170683 - RNA, 15 nt, Homo sapiens
gauaaggaaauaaga

SEQ ID NO: 1170684 - RNA, 22 nt, Homo sapiens
gauaauaaauuauacacuauga

SEQ ID NO: 1170685 - RNA, 15 nt, Homo sapiens
gauaauacacuauua

SEQ ID NO: 1170686 - RNA, 15 nt, Homo sapiens
gauaauuagcaguau

SEQ ID NO: 1170687 - RNA, 18 nt, Homo sapiens
gauacacgucacaaagac

SEQ ID NO: 1170688 - RNA, 15 nt, Homo sapiens
gauacagaacucuuu

SEQ ID NO: 1170689 - RNA, 13 nt, Homo sapiens
gauacauacagaa

SEQ ID NO: 1170690 - RNA, 14 nt, Homo sapiens
gauaccauaugaau

SEQ ID NO: 1170691 - RNA, 19 nt, Homo sapiens
gauacccaaaggucaagaa

SEQ ID NO: 1170692 - RNA, 14 nt, Homo sapiens
gauacugcaauaaa

SEQ ID NO: 1170693 - RNA, 13 nt, Homo sapiens
gauacugcugaug

SEQ ID NO: 1170694 - RNA, 23 nt, Homo sapiens
gauacuuacauguucccaaaaca

SEQ ID NO: 1170695 - RNA, 22 nt, Homo sapiens
gauacuugaaggucuaggugcu

SEQ ID NO: 1170696 - RNA, 16 nt, Homo sapiens
gauagaaagcauuaca

SEQ ID NO: 1170697 - RNA, 13 nt, Homo sapiens
gauagaaaugcca

SEQ ID NO: 1170698 - RNA, 23 nt, Homo sapiens
gauagcaucuuauacgaguaaua

SEQ ID NO: 1170699 - RNA, 15 nt, Homo sapiens
gauagcauugugaac

SEQ ID NO: 1170700 - RNA, 20 nt, Homo sapiens
gauagcuguguguguuagcu

SEQ ID NO: 1170701 - RNA, 19 nt, Homo sapiens
gauagggagcagaugcaau

SEQ ID NO: 1170702 - RNA, 22 nt, Homo sapiens
gauagugcaaggaaugacucau

SEQ ID NO: 1170703 - RNA, 14 nt, Homo sapiens
gauaguucauucau

SEQ ID NO: 1170704 - RNA, 21 nt, Homo sapiens
gauauacuugguucucuccac

SEQ ID NO: 1170705 - RNA, 13 nt, Homo sapiens
gauauauuccacc

SEQ ID NO: 1170706 - RNA, 16 nt, Homo sapiens
gauaucaaaagcaaau

SEQ ID NO: 1170707 - RNA, 18 nt, Homo sapiens
gauauccucccuccagau

SEQ ID NO: 1170708 - RNA, 22 nt, Homo sapiens
gauaugcggcuaugccugccuc

SEQ ID NO: 1170709 - RNA, 21 nt, Homo sapiens
gauauucccucuuguccuuua

SEQ ID NO: 1170710 - RNA, 17 nt, Homo sapiens
gauauucgguaauauca

SEQ ID NO: 1170711 - RNA, 13 nt, Homo sapiens
gauauugcagcuu

SEQ ID NO: 1170712 - RNA, 17 nt, Homo sapiens
gauauuggaaugcacag

SEQ ID NO: 1170713 - RNA, 16 nt, Homo sapiens
gauauugucagucuuu

SEQ ID NO: 1170714 - RNA, 18 nt, Homo sapiens
gauauuucaugugcuaua

SEQ ID NO: 1170715 - RNA, 20 nt, Homo sapiens
gauauuuccuucaccaccuc

SEQ ID NO: 1170716 - RNA, 19 nt, Homo sapiens
gauauuuuuuauacaguga

SEQ ID NO: 1170717 - RNA, 20 nt, Homo sapiens
gaucaaaguguaaacaccau

SEQ ID NO: 1170718 - RNA, 20 nt, Homo sapiens
gaucacgccauuguacucca

SEQ ID NO: 1170719 - RNA, 12 nt, Homo sapiens
gaucacuccugg

SEQ ID NO: 1170720 - RNA, 21 nt, Homo sapiens
gaucaguagccccuaaucaca

SEQ ID NO: 1170721 - RNA, 19 nt, Homo sapiens
gaucaguguuguugcucua

SEQ ID NO: 1170722 - RNA, 15 nt, Homo sapiens
gaucaucgucauuug

SEQ ID NO: 1170723 - RNA, 23 nt, Homo sapiens
gauccagggauagccccgucugg

SEQ ID NO: 1170724 - RNA, 16 nt, Homo sapiens
gaucccaacacugcca

SEQ ID NO: 1170725 - RNA, 12 nt, Homo sapiens
gaucccaugagc

SEQ ID NO: 1170726 - RNA, 15 nt, Homo sapiens
gaucccuuccuuccu

SEQ ID NO: 1170727 - RNA, 21 nt, Homo sapiens
gauccgucuuuggccuccucc

SEQ ID NO: 1170728 - RNA, 21 nt, Homo sapiens
gaucguccacugucaaguguu

SEQ ID NO: 1170729 - RNA, 12 nt, Homo sapiens
gaucgugccacu

SEQ ID NO: 1170730 - RNA, 13 nt, Homo sapiens
gaucuaccagcau

SEQ ID NO: 1170731 - RNA, 13 nt, Homo sapiens
gaucuacugggac

SEQ ID NO: 1170732 - RNA, 14 nt, Homo sapiens
gaucuagaagggac

SEQ ID NO: 1170733 - RNA, 13 nt, Homo sapiens
gaucucaaguaua

SEQ ID NO: 1170734 - RNA, 19 nt, Homo sapiens
gaucucagaucacugcaac

SEQ ID NO: 1170735 - RNA, 17 nt, Homo sapiens
gaucuccaacagccagu

SEQ ID NO: 1170736 - RNA, 20 nt, Homo sapiens
gaucucgaacuccuaaccuc

SEQ ID NO: 1170737 - RNA, 20 nt, Homo sapiens
gaucucgccacugcacucca

SEQ ID NO: 1170738 - RNA, 16 nt, Homo sapiens
gaucucgccuggaaac

SEQ ID NO: 1170739 - RNA, 18 nt, Homo sapiens
gaucucggcucacugcaa

SEQ ID NO: 1170740 - RNA, 16 nt, Homo sapiens
gaucucgguuugccaa

SEQ ID NO: 1170741 - RNA, 13 nt, Homo sapiens
gaucugagcaaaa

SEQ ID NO: 1170742 - RNA, 14 nt, Homo sapiens
gaucugcuuucugu

SEQ ID NO: 1170743 - RNA, 23 nt, Homo sapiens
gaucuggaacccagacucagaca

SEQ ID NO: 1170744 - RNA, 20 nt, Homo sapiens
gaucuguaaggaacuggaac

SEQ ID NO: 1170745 - RNA, 18 nt, Homo sapiens
gaucuugcucucggugcu

SEQ ID NO: 1170746 - RNA, 19 nt, Homo sapiens
gaucuuggagacaggccau

SEQ ID NO: 1170747 - RNA, 20 nt, Homo sapiens
gaugaaaauguaacuugaaa

SEQ ID NO: 1170748 - RNA, 22 nt, Homo sapiens
gaugaaggaaggacuaugacaa

SEQ ID NO: 1170749 - RNA, 21 nt, Homo sapiens
gaugaaguuuuacauuguuga

SEQ ID NO: 1170750 - RNA, 23 nt, Homo sapiens
gaugacaugguccaugucuaucc

SEQ ID NO: 1170751 - RNA, 17 nt, Homo sapiens
gaugaccauaaccacug

SEQ ID NO: 1170752 - RNA, 17 nt, Homo sapiens
gaugaccauacucagac

SEQ ID NO: 1170753 - RNA, 15 nt, Homo sapiens
gaugaggcuuuccau

SEQ ID NO: 1170754 - RNA, 13 nt, Homo sapiens
gaugauacaucca

SEQ ID NO: 1170755 - RNA, 20 nt, Homo sapiens
gaugaugugguuuuuugcca

SEQ ID NO: 1170756 - RNA, 16 nt, Homo sapiens
gaugauguuauucaca

SEQ ID NO: 1170757 - RNA, 18 nt, Homo sapiens
gaugcaaugacucaggac

SEQ ID NO: 1170758 - RNA, 20 nt, Homo sapiens
gaugccaaggggcugaguga

SEQ ID NO: 1170759 - RNA, 16 nt, Homo sapiens
gaugccgagcacuuuc

SEQ ID NO: 1170760 - RNA, 13 nt, Homo sapiens
gaugcgacuguaa

SEQ ID NO: 1170761 - RNA, 14 nt, Homo sapiens
gaugcugagccaua

SEQ ID NO: 1170762 - RNA, 14 nt, Homo sapiens
gaugcugugcuaug

SEQ ID NO: 1170763 - RNA, 15 nt, Homo sapiens
gaugcuuuaccaaac

SEQ ID NO: 1170764 - RNA, 20 nt, Homo sapiens
gauggaacacggccacauca

SEQ ID NO: 1170765 - RNA, 16 nt, Homo sapiens
gauggaacaugcccac

SEQ ID NO: 1170766 - RNA, 13 nt, Homo sapiens
gauggacaacuca

SEQ ID NO: 1170767 - RNA, 9 nt, Homo sapiens
gauggagcu

SEQ ID NO: 1170768 - RNA, 17 nt, Homo sapiens
gauggagggacuggggu

SEQ ID NO: 1170769 - RNA, 16 nt, Homo sapiens
gauggauggcuguuaa

SEQ ID NO: 1170770 - RNA, 20 nt, Homo sapiens
gauggauucaucauccagga

SEQ ID NO: 1170771 - RNA, 16 nt, Homo sapiens
gauggcauccugugaa

SEQ ID NO: 1170772 - RNA, 21 nt, Homo sapiens
gauggcauccugugaaguccu

SEQ ID NO: 1170773 - RNA, 18 nt, Homo sapiens
gauggcaucuccauguag

SEQ ID NO: 1170774 - RNA, 20 nt, Homo sapiens
gauggcgccaccgcacucca

SEQ ID NO: 1170775 - RNA, 14 nt, Homo sapiens
gaugggagguugug

SEQ ID NO: 1170776 - RNA, 20 nt, Homo sapiens
gaugggagugcccccaacag

SEQ ID NO: 1170777 - RNA, 21 nt, Homo sapiens
gaugggcagcccaacagcacu

SEQ ID NO: 1170778 - RNA, 22 nt, Homo sapiens
gaugggucuccgcacuuggaaa

SEQ ID NO: 1170779 - RNA, 16 nt, Homo sapiens
gaugguaggcuguaua

SEQ ID NO: 1170780 - RNA, 17 nt, Homo sapiens
gauggucacgcaccugg

SEQ ID NO: 1170781 - RNA, 23 nt, Homo sapiens
gauggugacuuuugaagaacaaa

SEQ ID NO: 1170782 - RNA, 15 nt, Homo sapiens
gauguagaaacaaua

SEQ ID NO: 1170783 - RNA, 16 nt, Homo sapiens
gaugucucacagcccu

SEQ ID NO: 1170784 - RNA, 18 nt, Homo sapiens
gaugucugccacaccucu

SEQ ID NO: 1170785 - RNA, 18 nt, Homo sapiens
gaugucuguuugcugaug

SEQ ID NO: 1170786 - RNA, 13 nt, Homo sapiens
gaugugcuuugug

SEQ ID NO: 1170787 - RNA, 22 nt, Homo sapiens
gaugugggaaucucccagacuu

SEQ ID NO: 1170788 - RNA, 17 nt, Homo sapiens
gaugugguuuuuugcca

SEQ ID NO: 1170789 - RNA, 21 nt, Homo sapiens
gauguguauucauacugacau

SEQ ID NO: 1170790 - RNA, 22 nt, Homo sapiens
gauguguccaguuugugcucua

SEQ ID NO: 1170791 - RNA, 13 nt, Homo sapiens
gauguguugcccc

SEQ ID NO: 1170792 - RNA, 19 nt, Homo sapiens
gauguuauuagauguuaca

SEQ ID NO: 1170793 - RNA, 17 nt, Homo sapiens
gauguuuccccagaccg

SEQ ID NO: 1170794 - RNA, 20 nt, Homo sapiens
gauguuuuacgucugggaga

SEQ ID NO: 1170795 - RNA, 15 nt, Homo sapiens
gauuaaugcuaucaa

SEQ ID NO: 1170796 - RNA, 17 nt, Homo sapiens
gauuacagaaacugaug

SEQ ID NO: 1170797 - RNA, 12 nt, Homo sapiens
gauuacagaucu

SEQ ID NO: 1170798 - RNA, 22 nt, Homo sapiens
gauuacaggcgugagccacugc

SEQ ID NO: 1170799 - RNA, 22 nt, Homo sapiens
gauuaccugaaggacagcugaa

SEQ ID NO: 1170800 - RNA, 17 nt, Homo sapiens
gauuagcccuuccuugc

SEQ ID NO: 1170801 - RNA, 21 nt, Homo sapiens
gauuaguauucaggcacugag

SEQ ID NO: 1170802 - RNA, 19 nt, Homo sapiens
gauuagucaaaaauaccau

SEQ ID NO: 1170803 - RNA, 18 nt, Homo sapiens
gauuaucagaccucuuca

SEQ ID NO: 1170804 - RNA, 14 nt, Homo sapiens
gauuauuccucuac

SEQ ID NO: 1170805 - RNA, 20 nt, Homo sapiens
gauucacaaugaaaugcucu

SEQ ID NO: 1170806 - RNA, 21 nt, Homo sapiens
gauucacaaugaaaugcucuc

SEQ ID NO: 1170807 - RNA, 14 nt, Homo sapiens
gauucaccuaagag

SEQ ID NO: 1170808 - RNA, 19 nt, Homo sapiens
gauucaccugagcaggacc

SEQ ID NO: 1170809 - RNA, 17 nt, Homo sapiens
gauucagaugucauuua

SEQ ID NO: 1170810 - RNA, 16 nt, Homo sapiens
gauucaucauuuucuc

SEQ ID NO: 1170811 - RNA, 22 nt, Homo sapiens
gauucaugauuuauaaaugcca

SEQ ID NO: 1170812 - RNA, 15 nt, Homo sapiens
gauuccaaccuuccu

SEQ ID NO: 1170813 - RNA, 22 nt, Homo sapiens
gauucgaaacuccauugaguca

SEQ ID NO: 1170814 - RNA, 14 nt, Homo sapiens
gauucgaaugacac

SEQ ID NO: 1170815 - RNA, 16 nt, Homo sapiens
gauucuccugccucag

SEQ ID NO: 1170816 - RNA, 18 nt, Homo sapiens
gauucugauaaugcucac

SEQ ID NO: 1170817 - RNA, 18 nt, Homo sapiens
gauucugucuuauagggu

SEQ ID NO: 1170818 - RNA, 12 nt, Homo sapiens
gauucuucagcu

SEQ ID NO: 1170819 - RNA, 17 nt, Homo sapiens
gauucuuucccaauuca

SEQ ID NO: 1170820 - RNA, 16 nt, Homo sapiens
gauugaaagaaccaga

SEQ ID NO: 1170821 - RNA, 13 nt, Homo sapiens
gauugaacuuucc

SEQ ID NO: 1170822 - RNA, 16 nt, Homo sapiens
gauugaauugugccuu

SEQ ID NO: 1170823 - RNA, 17 nt, Homo sapiens
gauugcuuuauccaaaa

SEQ ID NO: 1170824 - RNA, 12 nt, Homo sapiens
gauugggguccc

SEQ ID NO: 1170825 - RNA, 15 nt, Homo sapiens
gauuuaauguugauu

SEQ ID NO: 1170826 - RNA, 14 nt, Homo sapiens
gauuucuccaggau

SEQ ID NO: 1170827 - RNA, 13 nt, Homo sapiens
gauuugguugguu

SEQ ID NO: 1170828 - RNA, 14 nt, Homo sapiens
gauuuguauuacac

SEQ ID NO: 1170829 - RNA, 13 nt, Homo sapiens
gauuuguguuaua

SEQ ID NO: 1170830 - RNA, 13 nt, Homo sapiens
gauuuuuugccca

SEQ ID NO: 1170831 - RNA, 12 nt, Homo sapiens
gcaaaaaaauca

SEQ ID NO: 1170832 - RNA, 14 nt, Homo sapiens
gcaaaaaauacuuu

SEQ ID NO: 1170833 - RNA, 15 nt, Homo sapiens
gcaaaaaccagagaa

SEQ ID NO: 1170834 - RNA, 15 nt, Homo sapiens
gcaaaacuccgucuc

SEQ ID NO: 1170835 - RNA, 14 nt, Homo sapiens
gcaaaagcaaucau

SEQ ID NO: 1170836 - RNA, 23 nt, Homo sapiens
gcaaaaguggggcuaaaugaagu

SEQ ID NO: 1170837 - RNA, 18 nt, Homo sapiens
gcaaaaucuguucuaaca

SEQ ID NO: 1170838 - RNA, 17 nt, Homo sapiens
gcaaaaugcucuugucc

SEQ ID NO: 1170839 - RNA, 16 nt, Homo sapiens
gcaaacaaaaccaauu

SEQ ID NO: 1170840 - RNA, 15 nt, Homo sapiens
gcaaacaaaauggac

SEQ ID NO: 1170841 - RNA, 12 nt, Homo sapiens
gcaaacaaguug

SEQ ID NO: 1170842 - RNA, 21 nt, Homo sapiens
gcaaacaugcaagaugaaccu

SEQ ID NO: 1170843 - RNA, 14 nt, Homo sapiens
gcaaacccuuucau

SEQ ID NO: 1170844 - RNA, 18 nt, Homo sapiens
gcaaacuuuccugggcaa

SEQ ID NO: 1170845 - RNA, 21 nt, Homo sapiens
gcaaagaaucccuagacuuua

SEQ ID NO: 1170846 - RNA, 22 nt, Homo sapiens
gcaaagauuuucaaacaaaaua

SEQ ID NO: 1170847 - RNA, 23 nt, Homo sapiens
gcaaagcaacauggcagagcagu

SEQ ID NO: 1170848 - RNA, 18 nt, Homo sapiens
gcaaaggaaucacuuuag

SEQ ID NO: 1170849 - RNA, 21 nt, Homo sapiens
gcaaaggaugcgugaguaugu

SEQ ID NO: 1170850 - RNA, 20 nt, Homo sapiens
gcaaaguauuguaaauuaua

SEQ ID NO: 1170851 - RNA, 16 nt, Homo sapiens
gcaaaguggaauuaaa

SEQ ID NO: 1170852 - RNA, 15 nt, Homo sapiens
gcaaauaaacuguaa

SEQ ID NO: 1170853 - RNA, 23 nt, Homo sapiens
gcaaauaguaaucuguaagcaua

SEQ ID NO: 1170854 - RNA, 17 nt, Homo sapiens
gcaaaugccaacuguug

SEQ ID NO: 1170855 - RNA, 19 nt, Homo sapiens
gcaaauuaguugguuugug

SEQ ID NO: 1170856 - RNA, 19 nt, Homo sapiens
gcaaauuuucagcauuaag

SEQ ID NO: 1170857 - RNA, 23 nt, Homo sapiens
gcaacagagcaagacccaucuca

SEQ ID NO: 1170858 - RNA, 19 nt, Homo sapiens
gcaacagccacuacauuac

SEQ ID NO: 1170859 - RNA, 22 nt, Homo sapiens
gcaacagccacuacauuacuuc

SEQ ID NO: 1170860 - RNA, 14 nt, Homo sapiens
gcaaccacuaagaa

SEQ ID NO: 1170861 - RNA, 21 nt, Homo sapiens
gcaaccauuuuuagaaggaaa

SEQ ID NO: 1170862 - RNA, 18 nt, Homo sapiens
gcaacgccgugggcugcg

SEQ ID NO: 1170863 - RNA, 20 nt, Homo sapiens
gcaacuccuguaauacgguc

SEQ ID NO: 1170864 - RNA, 18 nt, Homo sapiens
gcaacugacacucccacc

SEQ ID NO: 1170865 - RNA, 15 nt, Homo sapiens
gcaacuugcuucuaa

SEQ ID NO: 1170866 - RNA, 16 nt, Homo sapiens
gcaagacccaucucaa

SEQ ID NO: 1170867 - RNA, 19 nt, Homo sapiens
gcaagauugaaauuugaac

SEQ ID NO: 1170868 - RNA, 23 nt, Homo sapiens
gcaaggauuacagaaacugaugc

SEQ ID NO: 1170869 - RNA, 13 nt, Homo sapiens
gcaaggugacauu

SEQ ID NO: 1170870 - RNA, 18 nt, Homo sapiens
gcaaguaaguaugaagga

SEQ ID NO: 1170871 - RNA, 16 nt, Homo sapiens
gcaagucccuuuguga

SEQ ID NO: 1170872 - RNA, 14 nt, Homo sapiens
gcaaguucaugugu

SEQ ID NO: 1170873 - RNA, 16 nt, Homo sapiens
gcaaguuuauagacau

SEQ ID NO: 1170874 - RNA, 13 nt, Homo sapiens
gcaauagaacccu

SEQ ID NO: 1170875 - RNA, 11 nt, Homo sapiens
gcaaucaaaaa

SEQ ID NO: 1170876 - RNA, 23 nt, Homo sapiens
gcaauccaaauccagccuuugga

SEQ ID NO: 1170877 - RNA, 17 nt, Homo sapiens
gcaaucuucuacuuuaa

SEQ ID NO: 1170878 - RNA, 17 nt, Homo sapiens
gcaauuacggggugacc

SEQ ID NO: 1170879 - RNA, 20 nt, Homo sapiens
gcaauucauaacuaaugaau

SEQ ID NO: 1170880 - RNA, 14 nt, Homo sapiens
gcaauucuagugua

SEQ ID NO: 1170881 - RNA, 21 nt, Homo sapiens
gcaauugcgaccuuaauuuaa

SEQ ID NO: 1170882 - RNA, 15 nt, Homo sapiens
gcaauuuugcauagc

SEQ ID NO: 1170883 - RNA, 17 nt, Homo sapiens
gcaauuuugcauuugaa

SEQ ID NO: 1170884 - RNA, 18 nt, Homo sapiens
gcacaaagaauugauuca

SEQ ID NO: 1170885 - RNA, 14 nt, Homo sapiens
gcacaaagugauuu

SEQ ID NO: 1170886 - RNA, 19 nt, Homo sapiens
gcacaagaaucacuugaac

SEQ ID NO: 1170887 - RNA, 21 nt, Homo sapiens
gcacaagcaccucuccuguga

SEQ ID NO: 1170888 - RNA, 20 nt, Homo sapiens
gcacaauuuaaaacaauccu

SEQ ID NO: 1170889 - RNA, 23 nt, Homo sapiens
gcacaccccuggggcugagucuc

SEQ ID NO: 1170890 - RNA, 10 nt, Homo sapiens
gcacaccucu

SEQ ID NO: 1170891 - RNA, 22 nt, Homo sapiens
gcacacuaguuuaugcuaccua

SEQ ID NO: 1170892 - RNA, 22 nt, Homo sapiens
gcacacugccagucucacugug

SEQ ID NO: 1170893 - RNA, 17 nt, Homo sapiens
gcacacuuccaccauag

SEQ ID NO: 1170894 - RNA, 11 nt, Homo sapiens
gcacagacagg

SEQ ID NO: 1170895 - RNA, 20 nt, Homo sapiens
gcacagcguccuguccacac

SEQ ID NO: 1170896 - RNA, 22 nt, Homo sapiens
gcacagcucccggcgggugcuc

SEQ ID NO: 1170897 - RNA, 14 nt, Homo sapiens
gcacagcugcauua

SEQ ID NO: 1170898 - RNA, 21 nt, Homo sapiens
gcacaggaguguccucuuccc

SEQ ID NO: 1170899 - RNA, 16 nt, Homo sapiens
gcacaggccuaggaga

SEQ ID NO: 1170900 - RNA, 21 nt, Homo sapiens
gcacaggucaggggugacaca

SEQ ID NO: 1170901 - RNA, 14 nt, Homo sapiens
gcacaguuagcaaa

SEQ ID NO: 1170902 - RNA, 17 nt, Homo sapiens
gcacauccuaugcaaua

SEQ ID NO: 1170903 - RNA, 17 nt, Homo sapiens
gcacaugaaacauuauu

SEQ ID NO: 1170904 - RNA, 18 nt, Homo sapiens
gcacaugcaccuacccau

SEQ ID NO: 1170905 - RNA, 14 nt, Homo sapiens
gcacauuacauuua

SEQ ID NO: 1170906 - RNA, 20 nt, Homo sapiens
gcacauuccccuugccuaaa

SEQ ID NO: 1170907 - RNA, 18 nt, Homo sapiens
gcacauuucauaguuuca

SEQ ID NO: 1170908 - RNA, 19 nt, Homo sapiens
gcaccaaaauuaugguguu

SEQ ID NO: 1170909 - RNA, 19 nt, Homo sapiens
gcaccaaaucaucucucau

SEQ ID NO: 1170910 - RNA, 17 nt, Homo sapiens
gcaccagacacccagga

SEQ ID NO: 1170911 - RNA, 19 nt, Homo sapiens
gcacccaagaccucagggc

SEQ ID NO: 1170912 - RNA, 13 nt, Homo sapiens
gcacccacccggc

SEQ ID NO: 1170913 - RNA, 17 nt, Homo sapiens
gcacccuggccuggucc

SEQ ID NO: 1170914 - RNA, 15 nt, Homo sapiens
gcacccuuuaccuuc

SEQ ID NO: 1170915 - RNA, 15 nt, Homo sapiens
gcaccucucugggaa

SEQ ID NO: 1170916 - RNA, 21 nt, Homo sapiens
gcaccugccagaggaugcucu

SEQ ID NO: 1170917 - RNA, 16 nt, Homo sapiens
gcaccugccuagcucu

SEQ ID NO: 1170918 - RNA, 13 nt, Homo sapiens
gcaccugccucag

SEQ ID NO: 1170919 - RNA, 20 nt, Homo sapiens
gcacuaccugaacauuguaa

SEQ ID NO: 1170920 - RNA, 23 nt, Homo sapiens
gcacucaaguuguuuaacugugc

SEQ ID NO: 1170921 - RNA, 23 nt, Homo sapiens
gcacucacaccacuaacaugccc

SEQ ID NO: 1170922 - RNA, 12 nt, Homo sapiens
gcacucagagac

SEQ ID NO: 1170923 - RNA, 21 nt, Homo sapiens
gcacuccagccugagugacag

SEQ ID NO: 1170924 - RNA, 14 nt, Homo sapiens
gcacucucacccca

SEQ ID NO: 1170925 - RNA, 16 nt, Homo sapiens
gcacugagaaagccaa

SEQ ID NO: 1170926 - RNA, 13 nt, Homo sapiens
gcacugaugcugc

SEQ ID NO: 1170927 - RNA, 19 nt, Homo sapiens
gcacuggauaaacaaaggu

SEQ ID NO: 1170928 - RNA, 18 nt, Homo sapiens
gcacugucuguaccuaaa

SEQ ID NO: 1170929 - RNA, 16 nt, Homo sapiens
gcacuguuugccauuc

SEQ ID NO: 1170930 - RNA, 16 nt, Homo sapiens
gcacuuaugauuucau

SEQ ID NO: 1170931 - RNA, 20 nt, Homo sapiens
gcacuuugcaggaugaccuc

SEQ ID NO: 1170932 - RNA, 17 nt, Homo sapiens
gcacuuugggagaccaa

SEQ ID NO: 1170933 - RNA, 13 nt, Homo sapiens
gcacuuugggagg

SEQ ID NO: 1170934 - RNA, 22 nt, Homo sapiens
gcacuuugggaggcugaggcag

SEQ ID NO: 1170935 - RNA, 22 nt, Homo sapiens
gcagaaaccaagucuacuucac

SEQ ID NO: 1170936 - RNA, 14 nt, Homo sapiens
gcagaaauacagua

SEQ ID NO: 1170937 - RNA, 17 nt, Homo sapiens
gcagaaccaaagcucaa

SEQ ID NO: 1170938 - RNA, 13 nt, Homo sapiens
gcagaagugaaug

SEQ ID NO: 1170939 - RNA, 18 nt, Homo sapiens
gcagaaugaacccauagg

SEQ ID NO: 1170940 - RNA, 17 nt, Homo sapiens
gcagaauugagagugau

SEQ ID NO: 1170941 - RNA, 23 nt, Homo sapiens
gcagaauugagagugauuccuuu

SEQ ID NO: 1170942 - RNA, 18 nt, Homo sapiens
gcagacacauugucauca

SEQ ID NO: 1170943 - RNA, 22 nt, Homo sapiens
gcagacagguguauggagucac

SEQ ID NO: 1170944 - RNA, 12 nt, Homo sapiens
gcagaccaacag

SEQ ID NO: 1170945 - RNA, 15 nt, Homo sapiens
gcagagaaagggaca

SEQ ID NO: 1170946 - RNA, 23 nt, Homo sapiens
gcagagaccagcccaccccugug

SEQ ID NO: 1170947 - RNA, 21 nt, Homo sapiens
gcagagcugagggcccugugg

SEQ ID NO: 1170948 - RNA, 20 nt, Homo sapiens
gcagaggaagagacaugaga

SEQ ID NO: 1170949 - RNA, 14 nt, Homo sapiens
gcagaggagccaug

SEQ ID NO: 1170950 - RNA, 15 nt, Homo sapiens
gcagagggcuuucag

SEQ ID NO: 1170951 - RNA, 21 nt, Homo sapiens
gcagaguauuaaugaaaagca

SEQ ID NO: 1170952 - RNA, 22 nt, Homo sapiens
gcagagucugccccacaugugg

SEQ ID NO: 1170953 - RNA, 23 nt, Homo sapiens
gcagaguuuguguguugucuuga

SEQ ID NO: 1170954 - RNA, 15 nt, Homo sapiens
gcagaugaucaggga

SEQ ID NO: 1170955 - RNA, 15 nt, Homo sapiens
gcagauucgagucac

SEQ ID NO: 1170956 - RNA, 17 nt, Homo sapiens
gcagauucgagucacgu

SEQ ID NO: 1170957 - RNA, 22 nt, Homo sapiens
gcagauugcaguucugauucau

SEQ ID NO: 1170958 - RNA, 22 nt, Homo sapiens
gcagauuuugcccuugacaaag

SEQ ID NO: 1170959 - RNA, 22 nt, Homo sapiens
gcagcacaugcgggcucgccca

SEQ ID NO: 1170960 - RNA, 13 nt, Homo sapiens
gcagcaggugcaa

SEQ ID NO: 1170961 - RNA, 18 nt, Homo sapiens
gcagccccaucugugcau

SEQ ID NO: 1170962 - RNA, 18 nt, Homo sapiens
gcagccugcaccuggugg

SEQ ID NO: 1170963 - RNA, 12 nt, Homo sapiens
gcagccuggcau

SEQ ID NO: 1170964 - RNA, 22 nt, Homo sapiens
gcagccuugggggggcugccuu

SEQ ID NO: 1170965 - RNA, 22 nt, Homo sapiens
gcagcuccacagggcagggccu

SEQ ID NO: 1170966 - RNA, 16 nt, Homo sapiens
gcagcuggcccacugc

SEQ ID NO: 1170967 - RNA, 14 nt, Homo sapiens
gcagcuucagggga

SEQ ID NO: 1170968 - RNA, 18 nt, Homo sapiens
gcaggaagccuacuauuu

SEQ ID NO: 1170969 - RNA, 21 nt, Homo sapiens
gcaggacuugagaagaccuca

SEQ ID NO: 1170970 - RNA, 18 nt, Homo sapiens
gcaggagaaucacuugaa

SEQ ID NO: 1170971 - RNA, 22 nt, Homo sapiens
gcaggagccugcagucacuggc

SEQ ID NO: 1170972 - RNA, 19 nt, Homo sapiens
gcaggaucucagaucacug

SEQ ID NO: 1170973 - RNA, 22 nt, Homo sapiens
gcaggcaaucguggaugucucu

SEQ ID NO: 1170974 - RNA, 18 nt, Homo sapiens
gcaggccgacagucggug

SEQ ID NO: 1170975 - RNA, 18 nt, Homo sapiens
gcaggccucagcaucucc

SEQ ID NO: 1170976 - RNA, 20 nt, Homo sapiens
gcaggccugccuucucaggg

SEQ ID NO: 1170977 - RNA, 16 nt, Homo sapiens
gcaggcgcugugcuau

SEQ ID NO: 1170978 - RNA, 20 nt, Homo sapiens
gcagggaaggaucccaugag

SEQ ID NO: 1170979 - RNA, 14 nt, Homo sapiens
gcagggcugacucu

SEQ ID NO: 1170980 - RNA, 16 nt, Homo sapiens
gcagggguuaugugga

SEQ ID NO: 1170981 - RNA, 15 nt, Homo sapiens
gcagggucuuuucau

SEQ ID NO: 1170982 - RNA, 19 nt, Homo sapiens
gcagggugguguaccugcu

SEQ ID NO: 1170983 - RNA, 15 nt, Homo sapiens
gcagguccagugcag

SEQ ID NO: 1170984 - RNA, 12 nt, Homo sapiens
gcaggugcugcg

SEQ ID NO: 1170985 - RNA, 20 nt, Homo sapiens
gcagguggggagacugggcu

SEQ ID NO: 1170986 - RNA, 21 nt, Homo sapiens
gcaguaacuccccaacucccu

SEQ ID NO: 1170987 - RNA, 14 nt, Homo sapiens
gcaguauagacaau

SEQ ID NO: 1170988 - RNA, 16 nt, Homo sapiens
gcaguccccagugauu

SEQ ID NO: 1170989 - RNA, 15 nt, Homo sapiens
gcagugaugcuggau

SEQ ID NO: 1170990 - RNA, 23 nt, Homo sapiens
gcaguggcuaguggggugaacag

SEQ ID NO: 1170991 - RNA, 14 nt, Homo sapiens
gcaguggugcaauc

SEQ ID NO: 1170992 - RNA, 21 nt, Homo sapiens
gcaguguauagaaaaaccaaa

SEQ ID NO: 1170993 - RNA, 18 nt, Homo sapiens
gcaguuauuucaaccagc

SEQ ID NO: 1170994 - RNA, 17 nt, Homo sapiens
gcaguucuaguuugcau

SEQ ID NO: 1170995 - RNA, 13 nt, Homo sapiens
gcaguugacucag

SEQ ID NO: 1170996 - RNA, 21 nt, Homo sapiens
gcaguugacucagagugcaag

SEQ ID NO: 1170997 - RNA, 14 nt, Homo sapiens
gcaguugaguuucu

SEQ ID NO: 1170998 - RNA, 19 nt, Homo sapiens
gcaguuguggugugccaug

SEQ ID NO: 1170999 - RNA, 17 nt, Homo sapiens
gcaguuuugacaucagc

SEQ ID NO: 1171000 - RNA, 14 nt, Homo sapiens
gcauaauagucaau

SEQ ID NO: 1171001 - RNA, 14 nt, Homo sapiens
gcauacaugcugcg

SEQ ID NO: 1171002 - RNA, 20 nt, Homo sapiens
gcauacgguaugauauugca

SEQ ID NO: 1171003 - RNA, 19 nt, Homo sapiens
gcauagauugaucaaagug

SEQ ID NO: 1171004 - RNA, 16 nt, Homo sapiens
gcauagcagcugcuac

SEQ ID NO: 1171005 - RNA, 15 nt, Homo sapiens
gcauaguccaaaaag

SEQ ID NO: 1171006 - RNA, 18 nt, Homo sapiens
gcauauuaguugaugaaa

SEQ ID NO: 1171007 - RNA, 13 nt, Homo sapiens
gcaucaaacauga

SEQ ID NO: 1171008 - RNA, 18 nt, Homo sapiens
gcaucaaggggucacuua

SEQ ID NO: 1171009 - RNA, 21 nt, Homo sapiens
gcaucaccuuaggcagggaag

SEQ ID NO: 1171010 - RNA, 12 nt, Homo sapiens
gcaucacugggg

SEQ ID NO: 1171011 - RNA, 12 nt, Homo sapiens
gcaucacugggu

SEQ ID NO: 1171012 - RNA, 14 nt, Homo sapiens
gcaucagaugaauu

SEQ ID NO: 1171013 - RNA, 17 nt, Homo sapiens
gcaucauuaaugcacau

SEQ ID NO: 1171014 - RNA, 23 nt, Homo sapiens
gcaucccugcuucuggcgcccca

SEQ ID NO: 1171015 - RNA, 18 nt, Homo sapiens
gcaucuccagcauucuca

SEQ ID NO: 1171016 - RNA, 23 nt, Homo sapiens
gcaucuccagcauucucagccac

SEQ ID NO: 1171017 - RNA, 19 nt, Homo sapiens
gcaucugaaauaggaaaca

SEQ ID NO: 1171018 - RNA, 18 nt, Homo sapiens
gcaucugaccaucuguga

SEQ ID NO: 1171019 - RNA, 13 nt, Homo sapiens
gcaugaaccacug

SEQ ID NO: 1171020 - RNA, 16 nt, Homo sapiens
gcaugaaccacugcac

SEQ ID NO: 1171021 - RNA, 16 nt, Homo sapiens
gcaugacacuuccaaa

SEQ ID NO: 1171022 - RNA, 17 nt, Homo sapiens
gcaugauccaagcaaga

SEQ ID NO: 1171023 - RNA, 18 nt, Homo sapiens
gcaugcauucuagcacaa

SEQ ID NO: 1171024 - RNA, 22 nt, Homo sapiens
gcauggcacucccuccagcaca

SEQ ID NO: 1171025 - RNA, 24 nt, Homo sapiens
gcauggcacucccuccagcacaaa

SEQ ID NO: 1171026 - RNA, 19 nt, Homo sapiens
gcauggugcgggcaccugu

SEQ ID NO: 1171027 - RNA, 18 nt, Homo sapiens
gcaugguggcucaugccu

SEQ ID NO: 1171028 - RNA, 22 nt, Homo sapiens
gcauguaccccagguacaucca

SEQ ID NO: 1171029 - RNA, 15 nt, Homo sapiens
gcaugugcguggaag

SEQ ID NO: 1171030 - RNA, 18 nt, Homo sapiens
gcauguguauauauguca

SEQ ID NO: 1171031 - RNA, 14 nt, Homo sapiens
gcauguuucuccca

SEQ ID NO: 1171032 - RNA, 20 nt, Homo sapiens
gcauuauguccacuguguau

SEQ ID NO: 1171033 - RNA, 13 nt, Homo sapiens
gcauucccaugag

SEQ ID NO: 1171034 - RNA, 19 nt, Homo sapiens
gcauuccuguaacuuuuaa

SEQ ID NO: 1171035 - RNA, 20 nt, Homo sapiens
gcauucuggcaguuuugaca

SEQ ID NO: 1171036 - RNA, 21 nt, Homo sapiens
gcauucuuugcaauacugcuu

SEQ ID NO: 1171037 - RNA, 20 nt, Homo sapiens
gcauugagccaguggugcua

SEQ ID NO: 1171038 - RNA, 21 nt, Homo sapiens
gcauugauucaguauuacaaa

SEQ ID NO: 1171039 - RNA, 14 nt, Homo sapiens
gcauugcagucaua

SEQ ID NO: 1171040 - RNA, 23 nt, Homo sapiens
gcauugcugauuuugucugccca

SEQ ID NO: 1171041 - RNA, 13 nt, Homo sapiens
gcauuggauacag

SEQ ID NO: 1171042 - RNA, 16 nt, Homo sapiens
gcauuguuucuguggg

SEQ ID NO: 1171043 - RNA, 15 nt, Homo sapiens
gcauuuccagccuau

SEQ ID NO: 1171044 - RNA, 12 nt, Homo sapiens
gcauuucuugcg

SEQ ID NO: 1171045 - RNA, 14 nt, Homo sapiens
gcauuuggaaccaa

SEQ ID NO: 1171046 - RNA, 22 nt, Homo sapiens
gcauuuguuuccucaucuuuaa

SEQ ID NO: 1171047 - RNA, 17 nt, Homo sapiens
gcauuuuccagcacuuu

SEQ ID NO: 1171048 - RNA, 19 nt, Homo sapiens
gcauuuucuucucugcacu

SEQ ID NO: 1171049 - RNA, 16 nt, Homo sapiens
gcauuuuuagcuccuu

SEQ ID NO: 1171050 - RNA, 14 nt, Homo sapiens
gccaaaacauuuau

SEQ ID NO: 1171051 - RNA, 14 nt, Homo sapiens
gccaaacaauaugc

SEQ ID NO: 1171052 - RNA, 11 nt, Homo sapiens
gccaacagcua

SEQ ID NO: 1171053 - RNA, 14 nt, Homo sapiens
gccaacauggugaa

SEQ ID NO: 1171054 - RNA, 15 nt, Homo sapiens
gccaacccuuucauu

SEQ ID NO: 1171055 - RNA, 18 nt, Homo sapiens
gccaacgcaguucaugua

SEQ ID NO: 1171056 - RNA, 13 nt, Homo sapiens
gccaacugcugau

SEQ ID NO: 1171057 - RNA, 16 nt, Homo sapiens
gccaagaaacacugcc

SEQ ID NO: 1171058 - RNA, 14 nt, Homo sapiens
gccaagagucacuu

SEQ ID NO: 1171059 - RNA, 21 nt, Homo sapiens
gccaagauacuugaacacugu

SEQ ID NO: 1171060 - RNA, 19 nt, Homo sapiens
gccaagcagccaagcuccu

SEQ ID NO: 1171061 - RNA, 19 nt, Homo sapiens
gccaagcagugccugccua

SEQ ID NO: 1171062 - RNA, 17 nt, Homo sapiens
gccaagcuguguucauc

SEQ ID NO: 1171063 - RNA, 23 nt, Homo sapiens
gccaaggaaacccccaguguaau

SEQ ID NO: 1171064 - RNA, 16 nt, Homo sapiens
gccaaggagcugcuau

SEQ ID NO: 1171065 - RNA, 21 nt, Homo sapiens
gccaaggagggcagaucacuu

SEQ ID NO: 1171066 - RNA, 22 nt, Homo sapiens
gccaaggugggcggaucacuug

SEQ ID NO: 1171067 - RNA, 24 nt, Homo sapiens
gccaaguaucuuuccagcauguuu

SEQ ID NO: 1171068 - RNA, 17 nt, Homo sapiens
gccaaucagaacuggcu

SEQ ID NO: 1171069 - RNA, 14 nt, Homo sapiens
gccacaacugcccc

SEQ ID NO: 1171070 - RNA, 19 nt, Homo sapiens
uagaauuccuucaggguga

SEQ ID NO: 1171071 - RNA, 15 nt, Homo sapiens
uagaauucugggaac

SEQ ID NO: 1171072 - RNA, 14 nt, Homo sapiens
uagaauuugcacac

SEQ ID NO: 1171073 - RNA, 18 nt, Homo sapiens
uagacaccuucugugcuc

SEQ ID NO: 1171074 - RNA, 21 nt, Homo sapiens
uagacauggagguucuaaggc

SEQ ID NO: 1171075 - RNA, 14 nt, Homo sapiens
uagaccccauacaa

SEQ ID NO: 1171076 - RNA, 14 nt, Homo sapiens
uagaccuuugguau

SEQ ID NO: 1171077 - RNA, 19 nt, Homo sapiens
uagagaacacgcguauuua

SEQ ID NO: 1171078 - RNA, 14 nt, Homo sapiens
uagagaguuaugaa

SEQ ID NO: 1171079 - RNA, 15 nt, Homo sapiens
uagagaguuaugaac

SEQ ID NO: 1171080 - RNA, 22 nt, Homo sapiens
uagagaugagguuucaccauga

SEQ ID NO: 1171081 - RNA, 18 nt, Homo sapiens
uagagauuugguguacaa

SEQ ID NO: 1171082 - RNA, 15 nt, Homo sapiens
uagagcacagccuca

SEQ ID NO: 1171083 - RNA, 12 nt, Homo sapiens
uagagcacugcc

SEQ ID NO: 1171084 - RNA, 21 nt, Homo sapiens
uagagcagauucaguguuaca

SEQ ID NO: 1171085 - RNA, 17 nt, Homo sapiens
uagagcuugcagugaag

SEQ ID NO: 1171086 - RNA, 21 nt, Homo sapiens
uagaggaauuuaaagaggaaa

SEQ ID NO: 1171087 - RNA, 18 nt, Homo sapiens
uagaggcauaaaccugug

SEQ ID NO: 1171088 - RNA, 17 nt, Homo sapiens
uagaguauaccuguggu

SEQ ID NO: 1171089 - RNA, 13 nt, Homo sapiens
uagagucauugcu

SEQ ID NO: 1171090 - RNA, 15 nt, Homo sapiens
uagaguggugcugcu

SEQ ID NO: 1171091 - RNA, 20 nt, Homo sapiens
uagagugugguuaugaacuu

SEQ ID NO: 1171092 - RNA, 13 nt, Homo sapiens
uagauagugauau

SEQ ID NO: 1171093 - RNA, 14 nt, Homo sapiens
uagauauaugccuu

SEQ ID NO: 1171094 - RNA, 19 nt, Homo sapiens
uagaugguaauaaucugga

SEQ ID NO: 1171095 - RNA, 14 nt, Homo sapiens
uagauguugccaug

SEQ ID NO: 1171096 - RNA, 21 nt, Homo sapiens
uagauguuuauucuucuagag

SEQ ID NO: 1171097 - RNA, 23 nt, Homo sapiens
uagauuaaauaaaugucuuuaua

SEQ ID NO: 1171098 - RNA, 18 nt, Homo sapiens
uagauuaccuagcuuagu

SEQ ID NO: 1171099 - RNA, 15 nt, Homo sapiens
uagauucacauacag

SEQ ID NO: 1171100 - RNA, 13 nt, Homo sapiens
uagauucagggga

SEQ ID NO: 1171101 - RNA, 18 nt, Homo sapiens
uagauuccuuuccugugu

SEQ ID NO: 1171102 - RNA, 16 nt, Homo sapiens
uagauucuaacauauu

SEQ ID NO: 1171103 - RNA, 18 nt, Homo sapiens
uagauucucugugucuaa

SEQ ID NO: 1171104 - RNA, 22 nt, Homo sapiens
uagcaaaaaaaacccauguggu

SEQ ID NO: 1171105 - RNA, 22 nt, Homo sapiens
uagcaaaugaaaaagucagcua

SEQ ID NO: 1171106 - RNA, 20 nt, Homo sapiens
uagcaaauggcagaaccaaa

SEQ ID NO: 1171107 - RNA, 21 nt, Homo sapiens
uagcaaauggcagaaccaaag

SEQ ID NO: 1171108 - RNA, 12 nt, Homo sapiens
uagcaaccugcc

SEQ ID NO: 1171109 - RNA, 18 nt, Homo sapiens
uagcaccauuccucaaga

SEQ ID NO: 1171110 - RNA, 21 nt, Homo sapiens
uagcaccauuccucaagauca

SEQ ID NO: 1171111 - RNA, 19 nt, Homo sapiens
uagcacggccaccucucag

SEQ ID NO: 1171112 - RNA, 14 nt, Homo sapiens
uagcagaaaccaag

SEQ ID NO: 1171113 - RNA, 22 nt, Homo sapiens
uagcagauacagggaugaggca

SEQ ID NO: 1171114 - RNA, 19 nt, Homo sapiens
uagcagggaguacccagug

SEQ ID NO: 1171115 - RNA, 21 nt, Homo sapiens
uagcagucaucaucuuuuugu

SEQ ID NO: 1171116 - RNA, 14 nt, Homo sapiens
uagcauccaagugg

SEQ ID NO: 1171117 - RNA, 15 nt, Homo sapiens
uagcaucucaugagu

SEQ ID NO: 1171118 - RNA, 21 nt, Homo sapiens
uagcauguaaggccuuucaau

SEQ ID NO: 1171119 - RNA, 18 nt, Homo sapiens
uagcauugaaguguuugc

SEQ ID NO: 1171120 - RNA, 22 nt, Homo sapiens
uagcauugaaguguuugcugca

SEQ ID NO: 1171121 - RNA, 23 nt, Homo sapiens
uagcauugaaguguuugcugcag

SEQ ID NO: 1171122 - RNA, 20 nt, Homo sapiens
uagcauuuucucuaccuuca

SEQ ID NO: 1171123 - RNA, 18 nt, Homo sapiens
uagccagaggacugugau

SEQ ID NO: 1171124 - RNA, 20 nt, Homo sapiens
uagccagcacacagggcagu

SEQ ID NO: 1171125 - RNA, 18 nt, Homo sapiens
uagccauguuaacaugac

SEQ ID NO: 1171126 - RNA, 20 nt, Homo sapiens
uagccauguuaacaugacau

SEQ ID NO: 1171127 - RNA, 14 nt, Homo sapiens
uagcccacucugcu

SEQ ID NO: 1171128 - RNA, 21 nt, Homo sapiens
uagcccuccucucccagugac

SEQ ID NO: 1171129 - RNA, 17 nt, Homo sapiens
uagccuauacugcauua

SEQ ID NO: 1171130 - RNA, 15 nt, Homo sapiens
uagccuccaccaucc

SEQ ID NO: 1171131 - RNA, 20 nt, Homo sapiens
uagccuggugggaaaaugca

SEQ ID NO: 1171132 - RNA, 13 nt, Homo sapiens
uagccuugcugua

SEQ ID NO: 1171133 - RNA, 16 nt, Homo sapiens
uagcggaucucacuca

SEQ ID NO: 1171134 - RNA, 16 nt, Homo sapiens
uagcucuauguuuaca

SEQ ID NO: 1171135 - RNA, 15 nt, Homo sapiens
uagcucuauuuacuu

SEQ ID NO: 1171136 - RNA, 17 nt, Homo sapiens
uagcugaggcugagaaa

SEQ ID NO: 1171137 - RNA, 16 nt, Homo sapiens
uagcuggccacauggc

SEQ ID NO: 1171138 - RNA, 13 nt, Homo sapiens
uagcuuugcacau

SEQ ID NO: 1171139 - RNA, 17 nt, Homo sapiens
uaggaaggcagcauucc

SEQ ID NO: 1171140 - RNA, 16 nt, Homo sapiens
uaggaauaaauaaaaa

SEQ ID NO: 1171141 - RNA, 17 nt, Homo sapiens
uaggacucaaaguuuca

SEQ ID NO: 1171142 - RNA, 19 nt, Homo sapiens
uaggacucaaaguuucaga

SEQ ID NO: 1171143 - RNA, 13 nt, Homo sapiens
uaggagauuuauu

SEQ ID NO: 1171144 - RNA, 12 nt, Homo sapiens
uaggcagaucac

SEQ ID NO: 1171145 - RNA, 16 nt, Homo sapiens
uaggcaggaagcccaa

SEQ ID NO: 1171146 - RNA, 12 nt, Homo sapiens
uaggcagggaag

SEQ ID NO: 1171147 - RNA, 23 nt, Homo sapiens
uaggccacagaaggugaacuuug

SEQ ID NO: 1171148 - RNA, 24 nt, Homo sapiens
uaggccauguuuaugacuguugca

SEQ ID NO: 1171149 - RNA, 12 nt, Homo sapiens
uaggccucucac

SEQ ID NO: 1171150 - RNA, 19 nt, Homo sapiens
uaggccucucaccucugug

SEQ ID NO: 1171151 - RNA, 14 nt, Homo sapiens
uaggcuagcuauuu

SEQ ID NO: 1171152 - RNA, 14 nt, Homo sapiens
uaggcuauucacaa

SEQ ID NO: 1171153 - RNA, 20 nt, Homo sapiens
uagggacauaaguucauuca

SEQ ID NO: 1171154 - RNA, 14 nt, Homo sapiens
uagggacuuggggc

SEQ ID NO: 1171155 - RNA, 23 nt, Homo sapiens
uagggagaagucugcaagauguc

SEQ ID NO: 1171156 - RNA, 16 nt, Homo sapiens
uagggaucaaagaaga

SEQ ID NO: 1171157 - RNA, 23 nt, Homo sapiens
uaggguacucaucugacuugaac

SEQ ID NO: 1171158 - RNA, 15 nt, Homo sapiens
uaggugcagcuccuc

SEQ ID NO: 1171159 - RNA, 14 nt, Homo sapiens
uaguaaaacacaga

SEQ ID NO: 1171160 - RNA, 15 nt, Homo sapiens
uaguaaacacaggga

SEQ ID NO: 1171161 - RNA, 22 nt, Homo sapiens
uaguaaagccguuguuuacuua

SEQ ID NO: 1171162 - RNA, 16 nt, Homo sapiens
uaguaaauucauaucc

SEQ ID NO: 1171163 - RNA, 16 nt, Homo sapiens
uaguaacaucaaagau

SEQ ID NO: 1171164 - RNA, 15 nt, Homo sapiens
uaguaaucacaguug

SEQ ID NO: 1171165 - RNA, 13 nt, Homo sapiens
uaguaaucuguaa

SEQ ID NO: 1171166 - RNA, 14 nt, Homo sapiens
uaguacauaaucuu

SEQ ID NO: 1171167 - RNA, 17 nt, Homo sapiens
uaguaccuucaauacuu

SEQ ID NO: 1171168 - RNA, 19 nt, Homo sapiens
uaguacuuacaucaggaaa

SEQ ID NO: 1171169 - RNA, 19 nt, Homo sapiens
uaguauucuucuuccugaa

SEQ ID NO: 1171170 - RNA, 12 nt, Homo sapiens
uagucacauggc

SEQ ID NO: 1171171 - RNA, 22 nt, Homo sapiens
uagucacauggccuaugcacau

SEQ ID NO: 1171172 - RNA, 21 nt, Homo sapiens
uaguccgugcugacagcugcu

SEQ ID NO: 1171173 - RNA, 22 nt, Homo sapiens
uaguccgugcugacagcugcuc

SEQ ID NO: 1171174 - RNA, 22 nt, Homo sapiens
uaguccucacuucuagaucuca

SEQ ID NO: 1171175 - RNA, 19 nt, Homo sapiens
uagucuaguuauuggauca

SEQ ID NO: 1171176 - RNA, 11 nt, Homo sapiens
uagucuugucu

SEQ ID NO: 1171177 - RNA, 17 nt, Homo sapiens
uagugccaccacagcuu

SEQ ID NO: 1171178 - RNA, 12 nt, Homo sapiens
uagugccuugcc

SEQ ID NO: 1171179 - RNA, 17 nt, Homo sapiens
uaguggaccacuuggaa

SEQ ID NO: 1171180 - RNA, 20 nt, Homo sapiens
uagugggcaccccacugcaa

SEQ ID NO: 1171181 - RNA, 18 nt, Homo sapiens
uagugggggaaaugccag

SEQ ID NO: 1171182 - RNA, 21 nt, Homo sapiens
uagugguuuaucagcaaaaaa

SEQ ID NO: 1171183 - RNA, 15 nt, Homo sapiens
uaguguaaaucaugc

SEQ ID NO: 1171184 - RNA, 14 nt, Homo sapiens
uaguuaacacugaa

SEQ ID NO: 1171185 - RNA, 12 nt, Homo sapiens
uaguuaaucucc

SEQ ID NO: 1171186 - RNA, 15 nt, Homo sapiens
uaguuacagcuguga

SEQ ID NO: 1171187 - RNA, 16 nt, Homo sapiens
uaguuauuuacuugaa

SEQ ID NO: 1171188 - RNA, 14 nt, Homo sapiens
uaguucaugucugc

SEQ ID NO: 1171189 - RNA, 20 nt, Homo sapiens
uaguucuguggccaucugcu

SEQ ID NO: 1171190 - RNA, 16 nt, Homo sapiens
uaguucuguguugacc

SEQ ID NO: 1171191 - RNA, 14 nt, Homo sapiens
uaguugcaguauug

SEQ ID NO: 1171192 - RNA, 19 nt, Homo sapiens
uaguugcaugaaauuuugc

SEQ ID NO: 1171193 - RNA, 22 nt, Homo sapiens
uaguugcguggacucugcacau

SEQ ID NO: 1171194 - RNA, 15 nt, Homo sapiens
uaguuuaugguucug

SEQ ID NO: 1171195 - RNA, 15 nt, Homo sapiens
uaguuugacucagua

SEQ ID NO: 1171196 - RNA, 19 nt, Homo sapiens
uaguuuucuagaugacaua

SEQ ID NO: 1171197 - RNA, 20 nt, Homo sapiens
uaguuuugucaaacuguaga

SEQ ID NO: 1171198 - RNA, 18 nt, Homo sapiens
uauaaaaaugagugcuua

SEQ ID NO: 1171199 - RNA, 17 nt, Homo sapiens
uauaaagugcuugugua

SEQ ID NO: 1171200 - RNA, 15 nt, Homo sapiens
uauaaauucuacuaa

SEQ ID NO: 1171201 - RNA, 16 nt, Homo sapiens
uauaagagagaguuaa

SEQ ID NO: 1171202 - RNA, 22 nt, Homo sapiens
uauaagagggcauauacaguga

SEQ ID NO: 1171203 - RNA, 21 nt, Homo sapiens
uauaagguguuuucuguguaa

SEQ ID NO: 1171204 - RNA, 15 nt, Homo sapiens
uauaauauuguacag

SEQ ID NO: 1171205 - RNA, 19 nt, Homo sapiens
uauaaucaagaaauaacca

SEQ ID NO: 1171206 - RNA, 22 nt, Homo sapiens
uauaauguuguauuuaauuuua

SEQ ID NO: 1171207 - RNA, 18 nt, Homo sapiens
uauaauuggugcauagca

SEQ ID NO: 1171208 - RNA, 21 nt, Homo sapiens
uauaauuuaaaauaugcucua

SEQ ID NO: 1171209 - RNA, 14 nt, Homo sapiens
uauacaacagugcu

SEQ ID NO: 1171210 - RNA, 20 nt, Homo sapiens
uauacagauucgaaacucca

SEQ ID NO: 1171211 - RNA, 14 nt, Homo sapiens
uauacagcucagcu

SEQ ID NO: 1171212 - RNA, 14 nt, Homo sapiens
uauacaguacacag

SEQ ID NO: 1171213 - RNA, 14 nt, Homo sapiens
uauacagugauaua

SEQ ID NO: 1171214 - RNA, 13 nt, Homo sapiens
uauacauuuacug

SEQ ID NO: 1171215 - RNA, 11 nt, Homo sapiens
uauaccuugcc

SEQ ID NO: 1171216 - RNA, 20 nt, Homo sapiens
uauacuagggagccauuuga

SEQ ID NO: 1171217 - RNA, 18 nt, Homo sapiens
uauacugacaaaccagag

SEQ ID NO: 1171218 - RNA, 18 nt, Homo sapiens
uauacugugaaguuacau

SEQ ID NO: 1171219 - RNA, 22 nt, Homo sapiens
uauagaaagucggcuguugaua

SEQ ID NO: 1171220 - RNA, 21 nt, Homo sapiens
uauagaaaucuagaauuuuua

SEQ ID NO: 1171221 - RNA, 12 nt, Homo sapiens
uauagacaccaa

SEQ ID NO: 1171222 - RNA, 17 nt, Homo sapiens
uauagacagcuuugacu

SEQ ID NO: 1171223 - RNA, 16 nt, Homo sapiens
uauagcaagugcuauu

SEQ ID NO: 1171224 - RNA, 15 nt, Homo sapiens
uauagcaaugugauu

SEQ ID NO: 1171225 - RNA, 14 nt, Homo sapiens
uauagcauuuugcu

SEQ ID NO: 1171226 - RNA, 17 nt, Homo sapiens
uauagcuacuaauuuua

SEQ ID NO: 1171227 - RNA, 21 nt, Homo sapiens
uauaggaaaacaauaauuuua

SEQ ID NO: 1171228 - RNA, 21 nt, Homo sapiens
uauagggaaaaaugcaaaaaa

SEQ ID NO: 1171229 - RNA, 13 nt, Homo sapiens
uauaguccaacau

SEQ ID NO: 1171230 - RNA, 22 nt, Homo sapiens
uauagugaacucccaucuauua

SEQ ID NO: 1171231 - RNA, 17 nt, Homo sapiens
uauaguggugucccuaa

SEQ ID NO: 1171232 - RNA, 14 nt, Homo sapiens
uauauaaacuuaac

SEQ ID NO: 1171233 - RNA, 13 nt, Homo sapiens
uauauacauagca

SEQ ID NO: 1171234 - RNA, 13 nt, Homo sapiens
uauauauaaucua

SEQ ID NO: 1171235 - RNA, 21 nt, Homo sapiens
uauauauuuuugugcacauuu

SEQ ID NO: 1171236 - RNA, 17 nt, Homo sapiens
uauaucaauaaauucca

SEQ ID NO: 1171237 - RNA, 15 nt, Homo sapiens
uauaucauauugcuu

SEQ ID NO: 1171238 - RNA, 21 nt, Homo sapiens
uauauccgccuggcauuucac

SEQ ID NO: 1171239 - RNA, 17 nt, Homo sapiens
uauaucgcuuaaucuua

SEQ ID NO: 1171240 - RNA, 15 nt, Homo sapiens
uauaucuauauguac

SEQ ID NO: 1171241 - RNA, 16 nt, Homo sapiens
uauaucucuccagcug

SEQ ID NO: 1171242 - RNA, 12 nt, Homo sapiens
uauaugacugga

SEQ ID NO: 1171243 - RNA, 16 nt, Homo sapiens
uauaugagacuuucaa

SEQ ID NO: 1171244 - RNA, 16 nt, Homo sapiens
uauaugcaccccugga

SEQ ID NO: 1171245 - RNA, 13 nt, Homo sapiens
uauaugcacuuau

SEQ ID NO: 1171246 - RNA, 15 nt, Homo sapiens
uauauggggcuuuag

SEQ ID NO: 1171247 - RNA, 20 nt, Homo sapiens
uauaugguauauauacauau

SEQ ID NO: 1171248 - RNA, 13 nt, Homo sapiens
uauauguacuugu

SEQ ID NO: 1171249 - RNA, 13 nt, Homo sapiens
uauauuguuucau

SEQ ID NO: 1171250 - RNA, 22 nt, Homo sapiens
uaucaaaacucuaucaaaugug

SEQ ID NO: 1171251 - RNA, 17 nt, Homo sapiens
uaucaacugcugcuuca

SEQ ID NO: 1171252 - RNA, 22 nt, Homo sapiens
uaucaacuggggggaccaaaua

SEQ ID NO: 1171253 - RNA, 17 nt, Homo sapiens
uaucaaggcugacuugu

SEQ ID NO: 1171254 - RNA, 21 nt, Homo sapiens
uaucaauguucuaguucugug

SEQ ID NO: 1171255 - RNA, 17 nt, Homo sapiens
uaucaccgugggcuccc

SEQ ID NO: 1171256 - RNA, 23 nt, Homo sapiens
uaucaccuuaagaaagugucucu

SEQ ID NO: 1171257 - RNA, 12 nt, Homo sapiens
uaucagugccau

SEQ ID NO: 1171258 - RNA, 14 nt, Homo sapiens
uaucagugccauga

SEQ ID NO: 1171259 - RNA, 19 nt, Homo sapiens
uaucaugcccugugcaacc

SEQ ID NO: 1171260 - RNA, 17 nt, Homo sapiens
uauccacuuaccuagau

SEQ ID NO: 1171261 - RNA, 24 nt, Homo sapiens
uauccacuuaccuagauucuacau

SEQ ID NO: 1171262 - RNA, 19 nt, Homo sapiens
uauccaggcuuaccaaagu

SEQ ID NO: 1171263 - RNA, 23 nt, Homo sapiens
uauccaguggauggauucaucau

SEQ ID NO: 1171264 - RNA, 16 nt, Homo sapiens
uauccauugaacuaaa

SEQ ID NO: 1171265 - RNA, 21 nt, Homo sapiens
uauccauuuaaacuaaccuuu

SEQ ID NO: 1171266 - RNA, 17 nt, Homo sapiens
uaucccugcccauuuca

SEQ ID NO: 1171267 - RNA, 13 nt, Homo sapiens
uaucccuuaccug

SEQ ID NO: 1171268 - RNA, 13 nt, Homo sapiens
uauccuagcacau

SEQ ID NO: 1171269 - RNA, 19 nt, Homo sapiens
uauccuagcacaugcuuca

SEQ ID NO: 1171270 - RNA, 21 nt, Homo sapiens
uauccuguuccgagcaacuuu

SEQ ID NO: 1171271 - RNA, 18 nt, Homo sapiens
uauccuuuauuucugaua

SEQ ID NO: 1171272 - RNA, 20 nt, Homo sapiens
uaucggccuggagaggacaa

SEQ ID NO: 1171273 - RNA, 16 nt, Homo sapiens
uaucuccauacuuugg

SEQ ID NO: 1171274 - RNA, 15 nt, Homo sapiens
uaucuccucuugggc

SEQ ID NO: 1171275 - RNA, 20 nt, Homo sapiens
uaucugagcguuuaaaguac

SEQ ID NO: 1171276 - RNA, 19 nt, Homo sapiens
uaucugcaaucuuugccaa

SEQ ID NO: 1171277 - RNA, 20 nt, Homo sapiens
uaucugcaaucuuugccaag

SEQ ID NO: 1171278 - RNA, 21 nt, Homo sapiens
uaucugggugcaugaucuuga

SEQ ID NO: 1171279 - RNA, 16 nt, Homo sapiens
uaucuguuaaccaaau

SEQ ID NO: 1171280 - RNA, 14 nt, Homo sapiens
uaucuuaucuugcu

SEQ ID NO: 1171281 - RNA, 23 nt, Homo sapiens
uaucuugaguguuaugugaauuu

SEQ ID NO: 1171282 - RNA, 16 nt, Homo sapiens
uaucuuucgugauaaa

SEQ ID NO: 1171283 - RNA, 17 nt, Homo sapiens
uaucuuugugugacaug

SEQ ID NO: 1171284 - RNA, 15 nt, Homo sapiens
uaugaaaacacucaa

SEQ ID NO: 1171285 - RNA, 22 nt, Homo sapiens
uaugaaauaaaauuacacagua

SEQ ID NO: 1171286 - RNA, 19 nt, Homo sapiens
uaugaaauuauaaucugug

SEQ ID NO: 1171287 - RNA, 18 nt, Homo sapiens
uaugaacauuagaaaaau

SEQ ID NO: 1171288 - RNA, 20 nt, Homo sapiens
uaugaaguaucuaaaagugu

SEQ ID NO: 1171289 - RNA, 14 nt, Homo sapiens
uaugaaucugcuca

SEQ ID NO: 1171290 - RNA, 16 nt, Homo sapiens
uaugacaagcuuucca

SEQ ID NO: 1171291 - RNA, 19 nt, Homo sapiens
uaugacauggaggcacuga

SEQ ID NO: 1171292 - RNA, 12 nt, Homo sapiens
uaugacugcuga

SEQ ID NO: 1171293 - RNA, 17 nt, Homo sapiens
uaugagauggaucacau

SEQ ID NO: 1171294 - RNA, 19 nt, Homo sapiens
uaugauaaaacacugcccu

SEQ ID NO: 1171295 - RNA, 14 nt, Homo sapiens
uaugauagugcaag

SEQ ID NO: 1171296 - RNA, 20 nt, Homo sapiens
uaugaugcuaugguuugcca

SEQ ID NO: 1171297 - RNA, 13 nt, Homo sapiens
uaugcccucaagu

SEQ ID NO: 1171298 - RNA, 16 nt, Homo sapiens
uaugccugccucuuuc

SEQ ID NO: 1171299 - RNA, 22 nt, Homo sapiens
uaugcugcuuuuauaucuguau

SEQ ID NO: 1171300 - RNA, 17 nt, Homo sapiens
uaugcuuuugguggcua

SEQ ID NO: 1171301 - RNA, 14 nt, Homo sapiens
uauggaaacccgag

SEQ ID NO: 1171302 - RNA, 16 nt, Homo sapiens
uauggaaauaguacua

SEQ ID NO: 1171303 - RNA, 23 nt, Homo sapiens
uauggaagaguuaaaacauuucu

SEQ ID NO: 1171304 - RNA, 16 nt, Homo sapiens
uauggacucaguuuuc

SEQ ID NO: 1171305 - RNA, 21 nt, Homo sapiens
uauggacucaguuuucuugca

SEQ ID NO: 1171306 - RNA, 16 nt, Homo sapiens
uauggcucacacagcu

SEQ ID NO: 1171307 - RNA, 18 nt, Homo sapiens
uaugggucuugagugcau

SEQ ID NO: 1171308 - RNA, 15 nt, Homo sapiens
uauggguuuaauuaa

SEQ ID NO: 1171309 - RNA, 14 nt, Homo sapiens
uauguacaugagaa

SEQ ID NO: 1171310 - RNA, 21 nt, Homo sapiens
uauguagcccgggguggucca

SEQ ID NO: 1171311 - RNA, 23 nt, Homo sapiens
uauguaguaauugacaugugcca

SEQ ID NO: 1171312 - RNA, 14 nt, Homo sapiens
uauguaugagacag

SEQ ID NO: 1171313 - RNA, 18 nt, Homo sapiens
uaugucucagaccacuau

SEQ ID NO: 1171314 - RNA, 11 nt, Homo sapiens
uaugucucagg

SEQ ID NO: 1171315 - RNA, 14 nt, Homo sapiens
uaugucuuggacac

SEQ ID NO: 1171316 - RNA, 19 nt, Homo sapiens
uaugucuuggacacuguac

SEQ ID NO: 1171317 - RNA, 22 nt, Homo sapiens
uaugugaaacuuuaucaucuuu

SEQ ID NO: 1171318 - RNA, 21 nt, Homo sapiens
uaugugaccagacugcacagg

SEQ ID NO: 1171319 - RNA, 19 nt, Homo sapiens
uaugugagugaaaguacuu

SEQ ID NO: 1171320 - RNA, 22 nt, Homo sapiens
uaugugagugaaaguacuucag

SEQ ID NO: 1171321 - RNA, 18 nt, Homo sapiens
uaugugaucagcuuucaa

SEQ ID NO: 1171322 - RNA, 14 nt, Homo sapiens
uaugugcauuucaa

SEQ ID NO: 1171323 - RNA, 12 nt, Homo sapiens
uaugugggacac

SEQ ID NO: 1171324 - RNA, 16 nt, Homo sapiens
uauguuaccuuuucau

SEQ ID NO: 1171325 - RNA, 21 nt, Homo sapiens
uauguuggaggcaugcuaaga

SEQ ID NO: 1171326 - RNA, 15 nt, Homo sapiens
uauguuuuacacugu

SEQ ID NO: 1171327 - RNA, 13 nt, Homo sapiens
uauuaaagcaaaa

SEQ ID NO: 1171328 - RNA, 13 nt, Homo sapiens
uauuaaagcaauc

SEQ ID NO: 1171329 - RNA, 15 nt, Homo sapiens
uauuaaauaaucucu

SEQ ID NO: 1171330 - RNA, 19 nt, Homo sapiens
uauuaaauauauacugacu

SEQ ID NO: 1171331 - RNA, 16 nt, Homo sapiens
uauuaacaauuaggca

SEQ ID NO: 1171332 - RNA, 19 nt, Homo sapiens
uauuaacagaaauguuucu

SEQ ID NO: 1171333 - RNA, 18 nt, Homo sapiens
uauuaacauaagaaaaga

SEQ ID NO: 1171334 - RNA, 17 nt, Homo sapiens
uauuaacuaugaucauc

SEQ ID NO: 1171335 - RNA, 15 nt, Homo sapiens
uauuaagccaggaaa

SEQ ID NO: 1171336 - RNA, 19 nt, Homo sapiens
uauuaaggauguagcuuuu

SEQ ID NO: 1171337 - RNA, 18 nt, Homo sapiens
uauuaagggauuaguauu

SEQ ID NO: 1171338 - RNA, 18 nt, Homo sapiens
uauuacaaauccaaugaa

SEQ ID NO: 1171339 - RNA, 22 nt, Homo sapiens
uauuacaaauuuucacugcugc

SEQ ID NO: 1171340 - RNA, 22 nt, Homo sapiens
uauuaccagguccauuuugccu

SEQ ID NO: 1171341 - RNA, 23 nt, Homo sapiens
uauuacccccuuuccucuugggc

SEQ ID NO: 1171342 - RNA, 18 nt, Homo sapiens
uauuacuggcaauuucau

SEQ ID NO: 1171343 - RNA, 19 nt, Homo sapiens
uauuaggagacacagggaa

SEQ ID NO: 1171344 - RNA, 15 nt, Homo sapiens
uauuaguuaaucucc

SEQ ID NO: 1171345 - RNA, 18 nt, Homo sapiens
uauuauauauagaaaaga

SEQ ID NO: 1171346 - RNA, 22 nt, Homo sapiens
uauuauccuagauuauaucaaa

SEQ ID NO: 1171347 - RNA, 20 nt, Homo sapiens
uauuauuguagucuugcauu

SEQ ID NO: 1171348 - RNA, 18 nt, Homo sapiens
uauucaaacuaccuauau

SEQ ID NO: 1171349 - RNA, 17 nt, Homo sapiens
uauucaaagcagcugua

SEQ ID NO: 1171350 - RNA, 16 nt, Homo sapiens
uauucacaucauuugg

SEQ ID NO: 1171351 - RNA, 15 nt, Homo sapiens
uauucaccaucaugu

SEQ ID NO: 1171352 - RNA, 23 nt, Homo sapiens
uauucaugaagcggucacagauc

SEQ ID NO: 1171353 - RNA, 12 nt, Homo sapiens
uauuccagcuca

SEQ ID NO: 1171354 - RNA, 18 nt, Homo sapiens
uauucccaagcccaugag

SEQ ID NO: 1171355 - RNA, 17 nt, Homo sapiens
uauucccacagcacuaa

SEQ ID NO: 1171356 - RNA, 15 nt, Homo sapiens
uauuccuaaugcuuu

SEQ ID NO: 1171357 - RNA, 16 nt, Homo sapiens
uauuccugaacuauaa

SEQ ID NO: 1171358 - RNA, 17 nt, Homo sapiens
uauucucacuccaccac

SEQ ID NO: 1171359 - RNA, 19 nt, Homo sapiens
uauucucacuccaccaccc

SEQ ID NO: 1171360 - RNA, 13 nt, Homo sapiens
uauucugauaaug

SEQ ID NO: 1171361 - RNA, 20 nt, Homo sapiens
uauucuucccuuuuaaacac

SEQ ID NO: 1171362 - RNA, 13 nt, Homo sapiens
uauucuucuagag

SEQ ID NO: 1171363 - RNA, 21 nt, Homo sapiens
uauucuuuaaauuucaucuca

SEQ ID NO: 1171364 - RNA, 13 nt, Homo sapiens
uauugaacauucu

SEQ ID NO: 1171365 - RNA, 21 nt, Homo sapiens
uauugaauacuuacauucucu

SEQ ID NO: 1171366 - RNA, 14 nt, Homo sapiens
uauugagcauguga

SEQ ID NO: 1171367 - RNA, 15 nt, Homo sapiens
uauugcagcaauuaa

SEQ ID NO: 1171368 - RNA, 15 nt, Homo sapiens
uauugcaguuuauca

SEQ ID NO: 1171369 - RNA, 10 nt, Homo sapiens
uauugcccua

SEQ ID NO: 1171370 - RNA, 16 nt, Homo sapiens
uauugccucuacuuug

SEQ ID NO: 1171371 - RNA, 20 nt, Homo sapiens
uauuggaagagagaauuugc

SEQ ID NO: 1171372 - RNA, 18 nt, Homo sapiens
uauuggauguauucugua

SEQ ID NO: 1171373 - RNA, 16 nt, Homo sapiens
uauuggauuuguccaa

SEQ ID NO: 1171374 - RNA, 23 nt, Homo sapiens
uauuguacauugggcacauaucu

SEQ ID NO: 1171375 - RNA, 12 nt, Homo sapiens
uauuguaucugu

SEQ ID NO: 1171376 - RNA, 20 nt, Homo sapiens
uauuguggaauugacucaaa

SEQ ID NO: 1171377 - RNA, 12 nt, Homo sapiens
uauugugugagu

SEQ ID NO: 1171378 - RNA, 16 nt, Homo sapiens
uauuguguguucucac

SEQ ID NO: 1171379 - RNA, 14 nt, Homo sapiens
uauuuaaccaaaga

SEQ ID NO: 1171380 - RNA, 19 nt, Homo sapiens
uauuuaacuggcuucagcc

SEQ ID NO: 1171381 - RNA, 16 nt, Homo sapiens
uauuuaagcaacaucu

SEQ ID NO: 1171382 - RNA, 12 nt, Homo sapiens
uauuuacaagac

SEQ ID NO: 1171383 - RNA, 12 nt, Homo sapiens
uauuuaccugaa

SEQ ID NO: 1171384 - RNA, 18 nt, Homo sapiens
uauuuagacucaucuuac

SEQ ID NO: 1171385 - RNA, 13 nt, Homo sapiens
uauuuaugcuaua

SEQ ID NO: 1171386 - RNA, 21 nt, Homo sapiens
uauuucaauauuagcaagaca

SEQ ID NO: 1171387 - RNA, 23 nt, Homo sapiens
uauuucagcaacaaccaucucau

SEQ ID NO: 1171388 - RNA, 15 nt, Homo sapiens
uauuucauuauguaa

SEQ ID NO: 1171389 - RNA, 19 nt, Homo sapiens
uauuuccauucaacaagag

SEQ ID NO: 1171390 - RNA, 22 nt, Homo sapiens
uauuuccguuuuccacuugugg

SEQ ID NO: 1171391 - RNA, 22 nt, Homo sapiens
uauuuccuuaaauguuuugcca

SEQ ID NO: 1171392 - RNA, 23 nt, Homo sapiens
uauuuccuuaaauguuuugccag

SEQ ID NO: 1171393 - RNA, 18 nt, Homo sapiens
uauuucuggaauggaaaa

SEQ ID NO: 1171394 - RNA, 15 nt, Homo sapiens
uauuugaaccaauaa

SEQ ID NO: 1171395 - RNA, 18 nt, Homo sapiens
uauuugacuuaccaugga

SEQ ID NO: 1171396 - RNA, 20 nt, Homo sapiens
uauuugcacuaugagccuau

SEQ ID NO: 1171397 - RNA, 17 nt, Homo sapiens
uauuuuaagaauuucac

SEQ ID NO: 1171398 - RNA, 15 nt, Homo sapiens
uauuuuacacagaaa

SEQ ID NO: 1171399 - RNA, 14 nt, Homo sapiens
uauuuuauacugca

SEQ ID NO: 1171400 - RNA, 16 nt, Homo sapiens
uauuuucaacaauuag

SEQ ID NO: 1171401 - RNA, 16 nt, Homo sapiens
uauuuuccaagugugc

SEQ ID NO: 1171402 - RNA, 11 nt, Homo sapiens
uauuuuccacc

SEQ ID NO: 1171403 - RNA, 17 nt, Homo sapiens
uauuuuccaugcuauaa

SEQ ID NO: 1171404 - RNA, 13 nt, Homo sapiens
uauuuucuguuga

SEQ ID NO: 1171405 - RNA, 21 nt, Homo sapiens
uauuuugaucuauuaagggau

SEQ ID NO: 1171406 - RNA, 22 nt, Homo sapiens
uauuuugcaauaguuaccucaa

SEQ ID NO: 1171407 - RNA, 15 nt, Homo sapiens
uauuuugcacccacu

SEQ ID NO: 1171408 - RNA, 19 nt, Homo sapiens
uauuuuggauuagugaacu

SEQ ID NO: 1171409 - RNA, 20 nt, Homo sapiens
uauuuuuaaaaacaacuuaa

SEQ ID NO: 1171410 - RNA, 12 nt, Homo sapiens
uauuuuuacuaa

SEQ ID NO: 1171411 - RNA, 18 nt, Homo sapiens
uauuuuucaaaacauaca

SEQ ID NO: 1171412 - RNA, 15 nt, Homo sapiens
uauuuuucuuuccaa

SEQ ID NO: 1171413 - RNA, 14 nt, Homo sapiens
uauuuuugugcaca

SEQ ID NO: 1171414 - RNA, 15 nt, Homo sapiens
uauuuuuucuugcau

SEQ ID NO: 1171415 - RNA, 15 nt, Homo sapiens
ucaaaaacauucuua

SEQ ID NO: 1171416 - RNA, 23 nt, Homo sapiens
ucaaaaauaccauuuuaguauga

SEQ ID NO: 1171417 - RNA, 16 nt, Homo sapiens
ucaaaacaagacuccu

SEQ ID NO: 1171418 - RNA, 12 nt, Homo sapiens
ucaaaacauaca

SEQ ID NO: 1171419 - RNA, 20 nt, Homo sapiens
ucaaaacgacucuaaacaca

SEQ ID NO: 1171420 - RNA, 21 nt, Homo sapiens
ucaaaacgacucuaaacacac

SEQ ID NO: 1171421 - RNA, 16 nt, Homo sapiens
ucaaaacuaccuguga

SEQ ID NO: 1171422 - RNA, 14 nt, Homo sapiens
ucaaaagacaauuc

SEQ ID NO: 1171423 - RNA, 16 nt, Homo sapiens
ucaaaaggcugccuaa

SEQ ID NO: 1171424 - RNA, 18 nt, Homo sapiens
ucaaaauaaaaaccaaga

SEQ ID NO: 1171425 - RNA, 20 nt, Homo sapiens
ucaaaauaaaaaccaagaag

SEQ ID NO: 1171426 - RNA, 14 nt, Homo sapiens
ucaaaauccaaaaa

SEQ ID NO: 1171427 - RNA, 16 nt, Homo sapiens
ucaaaaugaugcaacc

SEQ ID NO: 1171428 - RNA, 20 nt, Homo sapiens
ucaaacaaauagucuaucaa

SEQ ID NO: 1171429 - RNA, 15 nt, Homo sapiens
ucaaacaacauucca

SEQ ID NO: 1171430 - RNA, 15 nt, Homo sapiens
ucaaaccuguagaug

SEQ ID NO: 1171431 - RNA, 16 nt, Homo sapiens
ucaaaccuuugccaac

SEQ ID NO: 1171432 - RNA, 14 nt, Homo sapiens
ucaaacuacuggca

SEQ ID NO: 1171433 - RNA, 17 nt, Homo sapiens
ucaaacuccugaccuca

SEQ ID NO: 1171434 - RNA, 17 nt, Homo sapiens
ucaaagaggaaccagga

SEQ ID NO: 1171435 - RNA, 23 nt, Homo sapiens
ucaaagaggcugaggcuggcaca

SEQ ID NO: 1171436 - RNA, 14 nt, Homo sapiens
ucaaagauugaaca

SEQ ID NO: 1171437 - RNA, 12 nt, Homo sapiens
ucaaagcacugu

SEQ ID NO: 1171438 - RNA, 20 nt, Homo sapiens
ucaaagcacuguuucucuca

SEQ ID NO: 1171439 - RNA, 21 nt, Homo sapiens
ucaaagcacuguuucucucac

SEQ ID NO: 1171440 - RNA, 21 nt, Homo sapiens
ucaaagccauauggacacugu

SEQ ID NO: 1171441 - RNA, 15 nt, Homo sapiens
ucaaagcugggauua

SEQ ID NO: 1171442 - RNA, 15 nt, Homo sapiens
ucaaagguucuaggu

SEQ ID NO: 1171443 - RNA, 12 nt, Homo sapiens
ucaaaguaauaa

SEQ ID NO: 1171444 - RNA, 22 nt, Homo sapiens
ucaaauauuaucuuuguucucc

SEQ ID NO: 1171445 - RNA, 15 nt, Homo sapiens
ucaaaucaaucugua

SEQ ID NO: 1171446 - RNA, 17 nt, Homo sapiens
ucaaaucgaauagggaa

SEQ ID NO: 1171447 - RNA, 19 nt, Homo sapiens
ucaaaucucuugcuuucuu

SEQ ID NO: 1171448 - RNA, 23 nt, Homo sapiens
ucaaaugcucagaccagcucuuc

SEQ ID NO: 1171449 - RNA, 20 nt, Homo sapiens
ucaaauggggccagauccag

SEQ ID NO: 1171450 - RNA, 12 nt, Homo sapiens
ucaaauguguca

SEQ ID NO: 1171451 - RNA, 18 nt, Homo sapiens
ucaacaauaaagacugag

SEQ ID NO: 1171452 - RNA, 18 nt, Homo sapiens
ucaacaccaccgagcucu

SEQ ID NO: 1171453 - RNA, 16 nt, Homo sapiens
ucaacacccaacuguc

SEQ ID NO: 1171454 - RNA, 14 nt, Homo sapiens
ucaacagaaugaaa

SEQ ID NO: 1171455 - RNA, 18 nt, Homo sapiens
ucaacagauuauuuugga

SEQ ID NO: 1171456 - RNA, 17 nt, Homo sapiens
ucaacauuucucaauaa

SEQ ID NO: 1171457 - RNA, 15 nt, Homo sapiens
ucaaccaaugccaaa

SEQ ID NO: 1171458 - RNA, 19 nt, Homo sapiens
ucaaccucuucuggcucaa

SEQ ID NO: 1171459 - RNA, 17 nt, Homo sapiens
ucaaccugcacuucaua

SEQ ID NO: 1171460 - RNA, 19 nt, Homo sapiens
ucaacuagcagauacaggg

SEQ ID NO: 1171461 - RNA, 13 nt, Homo sapiens
ucaacugccucag

SEQ ID NO: 1171462 - RNA, 19 nt, Homo sapiens
ucaacugggaaccuucaua

SEQ ID NO: 1171463 - RNA, 19 nt, Homo sapiens
ucaacuguuuuugucuaca

SEQ ID NO: 1171464 - RNA, 18 nt, Homo sapiens
ucaacuuugcaaacaaca

SEQ ID NO: 1171465 - RNA, 20 nt, Homo sapiens
ucaacuuuggugaacaguuu

SEQ ID NO: 1171466 - RNA, 18 nt, Homo sapiens
ucaacuuuuccuuucaua

SEQ ID NO: 1171467 - RNA, 19 nt, Homo sapiens
ucaacuuuuuauugccuuc

SEQ ID NO: 1171468 - RNA, 22 nt, Homo sapiens
ucaagaagaagaggggcauaaa

SEQ ID NO: 1171469 - RNA, 18 nt, Homo sapiens
ucaagacuugauacugca

SEQ ID NO: 1171470 - RNA, 22 nt, Homo sapiens
ucaagagaaaugauguugucac

SEQ ID NO: 1171471 - RNA, 15 nt, Homo sapiens
ucaagagacugaguc

SEQ ID NO: 1171472 - RNA, 16 nt, Homo sapiens
ucaagaggcagaguuc

SEQ ID NO: 1171473 - RNA, 19 nt, Homo sapiens
ucaagaguccuuacugaag

SEQ ID NO: 1171474 - RNA, 20 nt, Homo sapiens
ucaagauaaaucaaaguaau

SEQ ID NO: 1171475 - RNA, 20 nt, Homo sapiens
ucaagcaauccuccuaccuc

SEQ ID NO: 1171476 - RNA, 23 nt, Homo sapiens
ucaagcagacauagaagagccaa

SEQ ID NO: 1171477 - RNA, 15 nt, Homo sapiens
ucaagccaagucauc

SEQ ID NO: 1171478 - RNA, 14 nt, Homo sapiens
ucaagccacauggu

SEQ ID NO: 1171479 - RNA, 18 nt, Homo sapiens
ucaagccugugcaaaaaa

SEQ ID NO: 1171480 - RNA, 15 nt, Homo sapiens
ucaagcugugagaca

SEQ ID NO: 1171481 - RNA, 15 nt, Homo sapiens
ucaaggcaucaugca

SEQ ID NO: 1171482 - RNA, 16 nt, Homo sapiens
ucaagggacaaguauu

SEQ ID NO: 1171483 - RNA, 13 nt, Homo sapiens
ucaaggugcucaa

SEQ ID NO: 1171484 - RNA, 16 nt, Homo sapiens
ucaaguaauugugaaa

SEQ ID NO: 1171485 - RNA, 14 nt, Homo sapiens
ucaaguaguuugac

SEQ ID NO: 1171486 - RNA, 16 nt, Homo sapiens
ucaaguauacacuguu

SEQ ID NO: 1171487 - RNA, 17 nt, Homo sapiens
ucaagucccccaagacc

SEQ ID NO: 1171488 - RNA, 17 nt, Homo sapiens
ucaagugagccaggaaa

SEQ ID NO: 1171489 - RNA, 19 nt, Homo sapiens
ucaagugauucuccugccu

SEQ ID NO: 1171490 - RNA, 21 nt, Homo sapiens
ucaauacuuaaaaauagucuu

SEQ ID NO: 1171491 - RNA, 13 nt, Homo sapiens
ucaauagcuccaa

SEQ ID NO: 1171492 - RNA, 18 nt, Homo sapiens
ucaauagcuccaagcugu

SEQ ID NO: 1171493 - RNA, 12 nt, Homo sapiens
ucaauagucuaa

SEQ ID NO: 1171494 - RNA, 14 nt, Homo sapiens
ucaauaucuuuauu

SEQ ID NO: 1171495 - RNA, 15 nt, Homo sapiens
ucaaucucaauccug

SEQ ID NO: 1171496 - RNA, 19 nt, Homo sapiens
ucaaugaaaugaugucaua

SEQ ID NO: 1171497 - RNA, 13 nt, Homo sapiens
ucaauguacauag

SEQ ID NO: 1171498 - RNA, 15 nt, Homo sapiens
ucaauguacauagac

SEQ ID NO: 1171499 - RNA, 21 nt, Homo sapiens
ucaauuaacagcagaaucuca

SEQ ID NO: 1171500 - RNA, 18 nt, Homo sapiens
ucaauucagugauggcaa

SEQ ID NO: 1171501 - RNA, 17 nt, Homo sapiens
ucaauucagugcuguac

SEQ ID NO: 1171502 - RNA, 14 nt, Homo sapiens
ucaauuugaacuca

SEQ ID NO: 1171503 - RNA, 23 nt, Homo sapiens
ucaauuuguaauuuuaguauuaa

SEQ ID NO: 1171504 - RNA, 21 nt, Homo sapiens
ucaauuuucacaucaaagaca

SEQ ID NO: 1171505 - RNA, 19 nt, Homo sapiens
ucacaaacuuuuauacucu

SEQ ID NO: 1171506 - RNA, 21 nt, Homo sapiens
ucacaaauuugucuugccuua

SEQ ID NO: 1171507 - RNA, 17 nt, Homo sapiens
ucacaaccagauuugag

SEQ ID NO: 1171508 - RNA, 21 nt, Homo sapiens
ucacaagugaaaaacauccag

SEQ ID NO: 1171509 - RNA, 12 nt, Homo sapiens
ucacaaugcauu

SEQ ID NO: 1171510 - RNA, 24 nt, Homo sapiens
ucacaaugucccuucagcaccuga

SEQ ID NO: 1171511 - RNA, 21 nt, Homo sapiens
ucacaauuucugggugaugaa

SEQ ID NO: 1171512 - RNA, 19 nt, Homo sapiens
ucacacacuuucucuucaa

SEQ ID NO: 1171513 - RNA, 18 nt, Homo sapiens
ucacacagaaaaauuccg

SEQ ID NO: 1171514 - RNA, 15 nt, Homo sapiens
ucacacauuggcuua

SEQ ID NO: 1171515 - RNA, 13 nt, Homo sapiens
ucacaccuguaau

SEQ ID NO: 1171516 - RNA, 11 nt, Homo sapiens
ucacacuccua

SEQ ID NO: 1171517 - RNA, 19 nt, Homo sapiens
ucacagagugagacuccau

SEQ ID NO: 1171518 - RNA, 23 nt, Homo sapiens
ucacagagugagacuccaucuca

SEQ ID NO: 1171519 - RNA, 15 nt, Homo sapiens
ucacagcccugggga

SEQ ID NO: 1171520 - RNA, 21 nt, Homo sapiens
ucacagccuuucugaacugac

SEQ ID NO: 1171521 - RNA, 15 nt, Homo sapiens
ucacaggacuaugga

SEQ ID NO: 1171522 - RNA, 19 nt, Homo sapiens
ucacagucacaugcccauu

SEQ ID NO: 1171523 - RNA, 16 nt, Homo sapiens
ucacaguugagcugcu

SEQ ID NO: 1171524 - RNA, 16 nt, Homo sapiens
ucacauaaaugcagcc

SEQ ID NO: 1171525 - RNA, 18 nt, Homo sapiens
ucacaucauuugggauac

SEQ ID NO: 1171526 - RNA, 14 nt, Homo sapiens
ucacauccuguguu

SEQ ID NO: 1171527 - RNA, 22 nt, Homo sapiens
ucacaucucccuuccaccucac

SEQ ID NO: 1171528 - RNA, 16 nt, Homo sapiens
ucacaugcccauucac

SEQ ID NO: 1171529 - RNA, 16 nt, Homo sapiens
ucacauggagcucuuc

SEQ ID NO: 1171530 - RNA, 17 nt, Homo sapiens
ucacaugucaguaccuu

SEQ ID NO: 1171531 - RNA, 16 nt, Homo sapiens
ucacaugugcugcaaa

SEQ ID NO: 1171532 - RNA, 21 nt, Homo sapiens
ucacauucugcauacuaaccu

SEQ ID NO: 1171533 - RNA, 14 nt, Homo sapiens
ucacauucuuggcu

SEQ ID NO: 1171534 - RNA, 23 nt, Homo sapiens
ucacauuggcuauuuaaagacaa

SEQ ID NO: 1171535 - RNA, 22 nt, Homo sapiens
ucacauuucaccccaggcucaa

SEQ ID NO: 1171536 - RNA, 14 nt, Homo sapiens
ucaccaaacaggaa

SEQ ID NO: 1171537 - RNA, 19 nt, Homo sapiens
ucaccaagcucacaguucc

SEQ ID NO: 1171538 - RNA, 15 nt, Homo sapiens
ucaccacaaacugua

SEQ ID NO: 1171539 - RNA, 15 nt, Homo sapiens
ucaccacaagccacc

SEQ ID NO: 1171540 - RNA, 13 nt, Homo sapiens
ucaccagcugcaa

SEQ ID NO: 1171541 - RNA, 15 nt, Homo sapiens
ucaccagcugcaaag

SEQ ID NO: 1171542 - RNA, 11 nt, Homo sapiens
ucaccaugcaa

SEQ ID NO: 1171543 - RNA, 22 nt, Homo sapiens
ucaccauggcccccucaucaua

SEQ ID NO: 1171544 - RNA, 13 nt, Homo sapiens
ucaccauguugcc

SEQ ID NO: 1171545 - RNA, 23 nt, Homo sapiens
ucaccauuuggcaaugccaucau

SEQ ID NO: 1171546 - RNA, 17 nt, Homo sapiens
ucacccagagccagugu

SEQ ID NO: 1171547 - RNA, 17 nt, Homo sapiens
ucacccaggcacugggc

SEQ ID NO: 1171548 - RNA, 18 nt, Homo sapiens
ucaccccugcuauaacua

SEQ ID NO: 1171549 - RNA, 12 nt, Homo sapiens
ucacccugugac

SEQ ID NO: 1171550 - RNA, 23 nt, Homo sapiens
ucaccgugccugaucugcacauu

SEQ ID NO: 1171551 - RNA, 15 nt, Homo sapiens
ucaccucauucugaa

SEQ ID NO: 1171552 - RNA, 16 nt, Homo sapiens
ucaccucuugccuucu

SEQ ID NO: 1171553 - RNA, 16 nt, Homo sapiens
ucaccugguaccugga

SEQ ID NO: 1171554 - RNA, 17 nt, Homo sapiens
ucaccuuaggcagggaa

SEQ ID NO: 1171555 - RNA, 15 nt, Homo sapiens
ucaccuuagugcaac

SEQ ID NO: 1171556 - RNA, 15 nt, Homo sapiens
ucaccuuccuaauca

SEQ ID NO: 1171557 - RNA, 17 nt, Homo sapiens
ucaccuuccuaaucacc

SEQ ID NO: 1171558 - RNA, 22 nt, Homo sapiens
ucaccuugaaaaagcaccaaaa

SEQ ID NO: 1171559 - RNA, 22 nt, Homo sapiens
ucaccuuggcaccagacaccca

SEQ ID NO: 1171560 - RNA, 20 nt, Homo sapiens
ucaccuugguuuaugagaac

SEQ ID NO: 1171561 - RNA, 18 nt, Homo sapiens
ucaccuuuucccuuucau

SEQ ID NO: 1171562 - RNA, 21 nt, Homo sapiens
ucacgagcguucaaacugcug

SEQ ID NO: 1171563 - RNA, 21 nt, Homo sapiens
ucacgccauuguacuccagcc

SEQ ID NO: 1171564 - RNA, 19 nt, Homo sapiens
ucacgccuguaaucccagc

SEQ ID NO: 1171565 - RNA, 14 nt, Homo sapiens
ucacuaaggacuua

SEQ ID NO: 1171566 - RNA, 16 nt, Homo sapiens
ucacuaccugccaugc

SEQ ID NO: 1171567 - RNA, 22 nt, Homo sapiens
ucacucaucuaaagucuaguga

SEQ ID NO: 1171568 - RNA, 17 nt, Homo sapiens
ucacucucaccuuccaa

SEQ ID NO: 1171569 - RNA, 16 nt, Homo sapiens
ucacucuuaggcacuu

SEQ ID NO: 1171570 - RNA, 18 nt, Homo sapiens
ucacucuugaaguccagg

SEQ ID NO: 1171571 - RNA, 16 nt, Homo sapiens
ucacugaaaagacuau

SEQ ID NO: 1171572 - RNA, 14 nt, Homo sapiens
ucacugcaaccucu

SEQ ID NO: 1171573 - RNA, 12 nt, Homo sapiens
ucacugcaauuu

SEQ ID NO: 1171574 - RNA, 13 nt, Homo sapiens
ucacugcacucca

SEQ ID NO: 1171575 - RNA, 21 nt, Homo sapiens
ucacugccagagauaaacuaa

SEQ ID NO: 1171576 - RNA, 21 nt, Homo sapiens
ucacugccauauacucuucaa

SEQ ID NO: 1171577 - RNA, 21 nt, Homo sapiens
ucacugccaucaaacuguaaa

SEQ ID NO: 1171578 - RNA, 21 nt, Homo sapiens
ucacugccccagacacagugc

SEQ ID NO: 1171579 - RNA, 20 nt, Homo sapiens
ucacugccgucccaaauaca

SEQ ID NO: 1171580 - RNA, 20 nt, Homo sapiens
ucacugcugauuauucacua

SEQ ID NO: 1171581 - RNA, 14 nt, Homo sapiens
ucacuguacuugua

SEQ ID NO: 1171582 - RNA, 13 nt, Homo sapiens
ucacuguccucca

SEQ ID NO: 1171583 - RNA, 17 nt, Homo sapiens
ucacuuaaaacuuuuaa

SEQ ID NO: 1171584 - RNA, 15 nt, Homo sapiens
ucacuuaaacuuuua

SEQ ID NO: 1171585 - RNA, 18 nt, Homo sapiens
ucacuuccaagagccuuu

SEQ ID NO: 1171586 - RNA, 17 nt, Homo sapiens
ucacuugaauccauuga

SEQ ID NO: 1171587 - RNA, 12 nt, Homo sapiens
ucacuugcaauu

SEQ ID NO: 1171588 - RNA, 18 nt, Homo sapiens
ucacuugguccuaccuau

SEQ ID NO: 1171589 - RNA, 23 nt, Homo sapiens
ucagaaaaccacuuuauugcaau

SEQ ID NO: 1171590 - RNA, 12 nt, Homo sapiens
ucagaaaccaaa

SEQ ID NO: 1171591 - RNA, 18 nt, Homo sapiens
ucagaaaugcugucauaa

SEQ ID NO: 1171592 - RNA, 15 nt, Homo sapiens
ucagaaccauccaua

SEQ ID NO: 1171593 - RNA, 18 nt, Homo sapiens
ucagaauauauucacuuu

SEQ ID NO: 1171594 - RNA, 22 nt, Homo sapiens
ucagaaugggggcuuucgggga

SEQ ID NO: 1171595 - RNA, 16 nt, Homo sapiens
ucagacaaauuacuga

SEQ ID NO: 1171596 - RNA, 15 nt, Homo sapiens
ucagacaagcugcau

SEQ ID NO: 1171597 - RNA, 19 nt, Homo sapiens
ucagacauuauaaguacuu

SEQ ID NO: 1171598 - RNA, 21 nt, Homo sapiens
ucagacuaggauaauguccaa

SEQ ID NO: 1171599 - RNA, 19 nt, Homo sapiens
ucagacuugucaagccugu

SEQ ID NO: 1171600 - RNA, 17 nt, Homo sapiens
ucagagagggugacaag

SEQ ID NO: 1171601 - RNA, 19 nt, Homo sapiens
ucagagcauuuuguugccu

SEQ ID NO: 1171602 - RNA, 10 nt, Homo sapiens
ucagagccag

SEQ ID NO: 1171603 - RNA, 22 nt, Homo sapiens
ucagagccagccggcuaugaaa

SEQ ID NO: 1171604 - RNA, 15 nt, Homo sapiens
ucagaguaucuuuac

SEQ ID NO: 1171605 - RNA, 12 nt, Homo sapiens
ucagauaaggua

SEQ ID NO: 1171606 - RNA, 21 nt, Homo sapiens
ucagauaagguaaaaugccau

SEQ ID NO: 1171607 - RNA, 23 nt, Homo sapiens
ucagauacgccaaguacuacaag

SEQ ID NO: 1171608 - RNA, 15 nt, Homo sapiens
ucagauccugaucuu

SEQ ID NO: 1171609 - RNA, 22 nt, Homo sapiens
ucagaugaacaauuaugaacau

SEQ ID NO: 1171610 - RNA, 23 nt, Homo sapiens
ucagauguucccgugugccucuu

SEQ ID NO: 1171611 - RNA, 22 nt, Homo sapiens
ucagauguuuuacgcaaggaag

SEQ ID NO: 1171612 - RNA, 18 nt, Homo sapiens
ucagauuauaacuguugu

SEQ ID NO: 1171613 - RNA, 15 nt, Homo sapiens
ucagauuuauuuccc

SEQ ID NO: 1171614 - RNA, 18 nt, Homo sapiens
ucagcaaaacuuuccaac

SEQ ID NO: 1171615 - RNA, 17 nt, Homo sapiens
ucagcaacaaccaucuc

SEQ ID NO: 1171616 - RNA, 13 nt, Homo sapiens
ucagcaagccaug

SEQ ID NO: 1171617 - RNA, 22 nt, Homo sapiens
ucagcagaauacugcuugcuua

SEQ ID NO: 1171618 - RNA, 14 nt, Homo sapiens
ucagcagacaagga

SEQ ID NO: 1171619 - RNA, 21 nt, Homo sapiens
ucagcaggcacuguacugggu

SEQ ID NO: 1171620 - RNA, 22 nt, Homo sapiens
ucagcaucugaccaucugugac

SEQ ID NO: 1171621 - RNA, 18 nt, Homo sapiens
ucagccacaaccaaaaaa

SEQ ID NO: 1171622 - RNA, 17 nt, Homo sapiens
ucagccaggccugucau

SEQ ID NO: 1171623 - RNA, 18 nt, Homo sapiens
ucagccaugucugugcug

SEQ ID NO: 1171624 - RNA, 19 nt, Homo sapiens
ucagccaugucugugcugu

SEQ ID NO: 1171625 - RNA, 17 nt, Homo sapiens
ucagcccugacccugug

SEQ ID NO: 1171626 - RNA, 13 nt, Homo sapiens
ucagccugcacag

SEQ ID NO: 1171627 - RNA, 22 nt, Homo sapiens
ucagccuggccagacacaggcc

SEQ ID NO: 1171628 - RNA, 14 nt, Homo sapiens
ucagcggcuccagc

SEQ ID NO: 1171629 - RNA, 16 nt, Homo sapiens
ucagcgguugccagga

SEQ ID NO: 1171630 - RNA, 14 nt, Homo sapiens
ucagcuaaacacca

SEQ ID NO: 1171631 - RNA, 16 nt, Homo sapiens
ucagcuagacauugca

SEQ ID NO: 1171632 - RNA, 21 nt, Homo sapiens
ucagcucacgcuucacaguga

SEQ ID NO: 1171633 - RNA, 18 nt, Homo sapiens
ucagcucccacaaaugac

SEQ ID NO: 1171634 - RNA, 13 nt, Homo sapiens
ucagcucugggcc

SEQ ID NO: 1171635 - RNA, 23 nt, Homo sapiens
ucagcucuuggcuccacugggau

SEQ ID NO: 1171636 - RNA, 19 nt, Homo sapiens
ucagcugcauuucacaugc

SEQ ID NO: 1171637 - RNA, 20 nt, Homo sapiens
ucagcugcuguugaacuuuu

SEQ ID NO: 1171638 - RNA, 16 nt, Homo sapiens
ucagcuuucaaagcau

SEQ ID NO: 1171639 - RNA, 21 nt, Homo sapiens
ucagcuuucaaagcauuuaca

SEQ ID NO: 1171640 - RNA, 13 nt, Homo sapiens
ucaggaacacccc

SEQ ID NO: 1171641 - RNA, 22 nt, Homo sapiens
ucaggaaccucgaguacugugg

SEQ ID NO: 1171642 - RNA, 20 nt, Homo sapiens
ucaggaagccuguggugugc

SEQ ID NO: 1171643 - RNA, 19 nt, Homo sapiens
ucaggaaucagaaaucaua

SEQ ID NO: 1171644 - RNA, 17 nt, Homo sapiens
ucaggacagaugccaca

SEQ ID NO: 1171645 - RNA, 18 nt, Homo sapiens
ucaggacagaugccacac

SEQ ID NO: 1171646 - RNA, 23 nt, Homo sapiens
ucaggaggaaagaauugcuccaa

SEQ ID NO: 1171647 - RNA, 18 nt, Homo sapiens
ucaggaguccaagaccag

SEQ ID NO: 1171648 - RNA, 18 nt, Homo sapiens
ucaggaguucgagaccaa

SEQ ID NO: 1171649 - RNA, 13 nt, Homo sapiens
ucaggaguuucau

SEQ ID NO: 1171650 - RNA, 19 nt, Homo sapiens
ucaggauggcggcuggggc

SEQ ID NO: 1171651 - RNA, 21 nt, Homo sapiens
ucaggcaauugauugugaauu

SEQ ID NO: 1171652 - RNA, 19 nt, Homo sapiens
ucaggcacaggucaggggu

SEQ ID NO: 1171653 - RNA, 15 nt, Homo sapiens
ucaggcccaaagccu

SEQ ID NO: 1171654 - RNA, 16 nt, Homo sapiens
ucaggcuuuggauguu

SEQ ID NO: 1171655 - RNA, 14 nt, Homo sapiens
ucagggaacauauu

SEQ ID NO: 1171656 - RNA, 19 nt, Homo sapiens
ucagggaccccugcccuug

SEQ ID NO: 1171657 - RNA, 16 nt, Homo sapiens
ucaggggacacuggcc

SEQ ID NO: 1171658 - RNA, 22 nt, Homo sapiens
ucaggggcggggagggugacag

SEQ ID NO: 1171659 - RNA, 13 nt, Homo sapiens
ucaggggugcaca

SEQ ID NO: 1171660 - RNA, 17 nt, Homo sapiens
ucagggucagggccauu

SEQ ID NO: 1171661 - RNA, 23 nt, Homo sapiens
ucagggugggguggucucugaua

SEQ ID NO: 1171662 - RNA, 19 nt, Homo sapiens
ucaggucccccccaggugc

SEQ ID NO: 1171663 - RNA, 14 nt, Homo sapiens
ucagguggaaaaac

SEQ ID NO: 1171664 - RNA, 21 nt, Homo sapiens
ucagguggagagcacuagaag

SEQ ID NO: 1171665 - RNA, 22 nt, Homo sapiens
ucaggugggguggagucccaga

SEQ ID NO: 1171666 - RNA, 18 nt, Homo sapiens
ucaggugugacucuagca

SEQ ID NO: 1171667 - RNA, 19 nt, Homo sapiens
ucaguaacccccacuggac

SEQ ID NO: 1171668 - RNA, 15 nt, Homo sapiens
ucaguacagcacucc

SEQ ID NO: 1171669 - RNA, 21 nt, Homo sapiens
ucaguagagaauuauuugccu

SEQ ID NO: 1171670 - RNA, 20 nt, Homo sapiens
ucaguagccccuaaucacau

SEQ ID NO: 1171671 - RNA, 15 nt, Homo sapiens
ucaguccacugcuga

SEQ ID NO: 1171672 - RNA, 16 nt, Homo sapiens
ucaguccacugcugag

SEQ ID NO: 1171673 - RNA, 23 nt, Homo sapiens
ucagucccuauguauuugcaguu

SEQ ID NO: 1171674 - RNA, 14 nt, Homo sapiens
ucaguccucuuuca

SEQ ID NO: 1171675 - RNA, 19 nt, Homo sapiens
ucaguccuggucugcucag

SEQ ID NO: 1171676 - RNA, 15 nt, Homo sapiens
ucaguccuuugauca

SEQ ID NO: 1171677 - RNA, 20 nt, Homo sapiens
ucagucugauuaauuuguua

SEQ ID NO: 1171678 - RNA, 20 nt, Homo sapiens
ucagucugugccuacauguu

SEQ ID NO: 1171679 - RNA, 21 nt, Homo sapiens
ucagucuguucacugcauuca

SEQ ID NO: 1171680 - RNA, 14 nt, Homo sapiens
ucagucuugcugag

SEQ ID NO: 1171681 - RNA, 22 nt, Homo sapiens
ucagugauugcaauuugcacaa

SEQ ID NO: 1171682 - RNA, 15 nt, Homo sapiens
ucagugcaccugccu

SEQ ID NO: 1171683 - RNA, 12 nt, Homo sapiens
ucagugcugcuc

SEQ ID NO: 1171684 - RNA, 15 nt, Homo sapiens
ucaguguuaaaugug

SEQ ID NO: 1171685 - RNA, 20 nt, Homo sapiens
ucaguguugccucuugcaau

SEQ ID NO: 1171686 - RNA, 17 nt, Homo sapiens
ucaguuaauucuuagau

SEQ ID NO: 1171687 - RNA, 18 nt, Homo sapiens
ucaguuacucagcccugg

SEQ ID NO: 1171688 - RNA, 23 nt, Homo sapiens
ucaguuagcagacagaaguguag

SEQ ID NO: 1171689 - RNA, 19 nt, Homo sapiens
ucaguuguuuaauaauuua

SEQ ID NO: 1171690 - RNA, 20 nt, Homo sapiens
ucaguuucauuaacugguga

SEQ ID NO: 1171691 - RNA, 18 nt, Homo sapiens
ucauaaaaguuugcaugu

SEQ ID NO: 1171692 - RNA, 15 nt, Homo sapiens
ucauaaacauuugag

SEQ ID NO: 1171693 - RNA, 14 nt, Homo sapiens
ucauaaauacaaga

SEQ ID NO: 1171694 - RNA, 16 nt, Homo sapiens
ucauaacucugugauc

SEQ ID NO: 1171695 - RNA, 20 nt, Homo sapiens
ucauaaucuauaaacaauga

SEQ ID NO: 1171696 - RNA, 23 nt, Homo sapiens
ucauaaucugaugauaugugguc

SEQ ID NO: 1171697 - RNA, 16 nt, Homo sapiens
ucauaccuacauucaa

SEQ ID NO: 1171698 - RNA, 21 nt, Homo sapiens
ucauacgucuuuauuacccaa

SEQ ID NO: 1171699 - RNA, 16 nt, Homo sapiens
ucauacuaguagucau

SEQ ID NO: 1171700 - RNA, 13 nt, Homo sapiens
ucauagcauucac

SEQ ID NO: 1171701 - RNA, 13 nt, Homo sapiens
ucauagugccuuu

SEQ ID NO: 1171702 - RNA, 17 nt, Homo sapiens
ucauaguuuauuuucau

SEQ ID NO: 1171703 - RNA, 22 nt, Homo sapiens
ucauauaagcuauaucauaaau

SEQ ID NO: 1171704 - RNA, 20 nt, Homo sapiens
ucauauaccagcaauauauc

SEQ ID NO: 1171705 - RNA, 16 nt, Homo sapiens
ucauaucucuugcccu

SEQ ID NO: 1171706 - RNA, 17 nt, Homo sapiens
ucauaugugcaguauuu

SEQ ID NO: 1171707 - RNA, 22 nt, Homo sapiens
ucauauuaguaaaagaugccau

SEQ ID NO: 1171708 - RNA, 23 nt, Homo sapiens
ucauauuaguaaaagaugccaua

SEQ ID NO: 1171709 - RNA, 13 nt, Homo sapiens
ucaucaccaagau

SEQ ID NO: 1171710 - RNA, 21 nt, Homo sapiens
ucaucagacuaguaucaagug

SEQ ID NO: 1171711 - RNA, 16 nt, Homo sapiens
ucaucaggaagccugu

SEQ ID NO: 1171712 - RNA, 17 nt, Homo sapiens
ucaucauguugaccagg

SEQ ID NO: 1171713 - RNA, 23 nt, Homo sapiens
ucaucauuaaaagcaaggcucaa

SEQ ID NO: 1171714 - RNA, 16 nt, Homo sapiens
ucaucauucccucuca

SEQ ID NO: 1171715 - RNA, 21 nt, Homo sapiens
ucaucauuuguggcagucccu

SEQ ID NO: 1171716 - RNA, 14 nt, Homo sapiens
ucauccccugugaa

SEQ ID NO: 1171717 - RNA, 15 nt, Homo sapiens
ucauccccugugaau

SEQ ID NO: 1171718 - RNA, 21 nt, Homo sapiens
ucauccgcaaauuuucuucca

SEQ ID NO: 1171719 - RNA, 22 nt, Homo sapiens
ucauccuugcccaucgggacca

SEQ ID NO: 1171720 - RNA, 13 nt, Homo sapiens
ucaucuauaguug

SEQ ID NO: 1171721 - RNA, 14 nt, Homo sapiens
ucaucucuuuauuc

SEQ ID NO: 1171722 - RNA, 17 nt, Homo sapiens
ucaucugcaugucuacu

SEQ ID NO: 1171723 - RNA, 12 nt, Homo sapiens
ucaucugggaaa

SEQ ID NO: 1171724 - RNA, 16 nt, Homo sapiens
ucaucuuuagagcaac

SEQ ID NO: 1171725 - RNA, 14 nt, Homo sapiens
ucaucuuuguggau

SEQ ID NO: 1171726 - RNA, 13 nt, Homo sapiens
ucaugaacuggcu

SEQ ID NO: 1171727 - RNA, 19 nt, Homo sapiens
ucaugaauuuauugcacau

SEQ ID NO: 1171728 - RNA, 22 nt, Homo sapiens
ucaugacccugagucuuugccu

SEQ ID NO: 1171729 - RNA, 20 nt, Homo sapiens
ucaugacugagucuggcaaa

SEQ ID NO: 1171730 - RNA, 17 nt, Homo sapiens
ucaugaggccggaugaa

SEQ ID NO: 1171731 - RNA, 16 nt, Homo sapiens
ucaugaguaacugauu

SEQ ID NO: 1171732 - RNA, 14 nt, Homo sapiens
ucaugcaugaagga

SEQ ID NO: 1171733 - RNA, 10 nt, Homo sapiens
ucaugcauuu

SEQ ID NO: 1171734 - RNA, 20 nt, Homo sapiens
ucaugccccuggcugggacg

SEQ ID NO: 1171735 - RNA, 14 nt, Homo sapiens
ucaugccugaugaa

SEQ ID NO: 1171736 - RNA, 17 nt, Homo sapiens
ucauguaaaugcucaaa

SEQ ID NO: 1171737 - RNA, 19 nt, Homo sapiens
ucauguauaaaacuaggaa

SEQ ID NO: 1171738 - RNA, 19 nt, Homo sapiens
ucauguccucuauaccugu

SEQ ID NO: 1171739 - RNA, 18 nt, Homo sapiens
ucaugugacucuuuccaa

SEQ ID NO: 1171740 - RNA, 16 nt, Homo sapiens
ucauguggcuaccugu

SEQ ID NO: 1171741 - RNA, 15 nt, Homo sapiens
ucauguguugcuccc

SEQ ID NO: 1171742 - RNA, 18 nt, Homo sapiens
ucauguuauuaaacguau

SEQ ID NO: 1171743 - RNA, 15 nt, Homo sapiens
ucauguucaugugau

SEQ ID NO: 1171744 - RNA, 18 nt, Homo sapiens
ucauguugaucauguacu

SEQ ID NO: 1171745 - RNA, 20 nt, Homo sapiens
ucauguuuuuucugcaauga

SEQ ID NO: 1171746 - RNA, 15 nt, Homo sapiens
ucauuaaaguucuag

SEQ ID NO: 1171747 - RNA, 16 nt, Homo sapiens
ucauuaaggucauuac

SEQ ID NO: 1171748 - RNA, 21 nt, Homo sapiens
ucauuaaugaaaagcagauug

SEQ ID NO: 1171749 - RNA, 23 nt, Homo sapiens
ucauuaaugacacuuguccccaa

SEQ ID NO: 1171750 - RNA, 15 nt, Homo sapiens
ucauucacucaacaa

SEQ ID NO: 1171751 - RNA, 23 nt, Homo sapiens
ucauucaugccaaguaucuuucc

SEQ ID NO: 1171752 - RNA, 22 nt, Homo sapiens
ucauucccucucaucucaggua

SEQ ID NO: 1171753 - RNA, 16 nt, Homo sapiens
ucauucuguaugugac

SEQ ID NO: 1171754 - RNA, 12 nt, Homo sapiens
ucauugcaaagu

SEQ ID NO: 1171755 - RNA, 11 nt, Homo sapiens
ucauugcugag

SEQ ID NO: 1171756 - RNA, 17 nt, Homo sapiens
ucauugcugagccucug

SEQ ID NO: 1171757 - RNA, 21 nt, Homo sapiens
ucauuguuuugcaaaagugua

SEQ ID NO: 1171758 - RNA, 21 nt, Homo sapiens
ucauuuaagggaguuacaucu

SEQ ID NO: 1171759 - RNA, 17 nt, Homo sapiens
ucauuuccguuuugccu

SEQ ID NO: 1171760 - RNA, 23 nt, Homo sapiens
ucauuucuuaugaaucuuuccag

SEQ ID NO: 1171761 - RNA, 22 nt, Homo sapiens
ucauuuuuacagaguuugugaa

SEQ ID NO: 1171762 - RNA, 19 nt, Homo sapiens
uccaaaaagacaagugcuc

SEQ ID NO: 1171763 - RNA, 15 nt, Homo sapiens
uccaaaagcaaacaa

SEQ ID NO: 1171764 - RNA, 24 nt, Homo sapiens
uccaaaaggccuuuggaaagacuu

SEQ ID NO: 1171765 - RNA, 12 nt, Homo sapiens
uccaaaccucca

SEQ ID NO: 1171766 - RNA, 21 nt, Homo sapiens
uccaaacuccucaacugggaa

SEQ ID NO: 1171767 - RNA, 16 nt, Homo sapiens
uccaaagcauuuccca

SEQ ID NO: 1171768 - RNA, 18 nt, Homo sapiens
uccaaaggauuuuguauc

SEQ ID NO: 1171769 - RNA, 17 nt, Homo sapiens
uccaaaucccuuucaug

SEQ ID NO: 1171770 - RNA, 23 nt, Homo sapiens
uccaaaucccuuucaugucuuuc

SEQ ID NO: 1171771 - RNA, 18 nt, Homo sapiens
uccaacagccagugugug

SEQ ID NO: 1171772 - RNA, 23 nt, Homo sapiens
uccaacaugaaaacaauucuuau

SEQ ID NO: 1171773 - RNA, 19 nt, Homo sapiens
uccaaccaggcuccuguga

SEQ ID NO: 1171774 - RNA, 19 nt, Homo sapiens
uccaacggcaagggaacaa

SEQ ID NO: 1171775 - RNA, 12 nt, Homo sapiens
uccaacuguaua

SEQ ID NO: 1171776 - RNA, 14 nt, Homo sapiens
uccaagaccagacu

SEQ ID NO: 1171777 - RNA, 14 nt, Homo sapiens
uccaagaccagaga

SEQ ID NO: 1171778 - RNA, 13 nt, Homo sapiens
uccaagauaugga

SEQ ID NO: 1171779 - RNA, 18 nt, Homo sapiens
uccaagcaagacugaggg

SEQ ID NO: 1171780 - RNA, 14 nt, Homo sapiens
uccaagccacugag

SEQ ID NO: 1171781 - RNA, 14 nt, Homo sapiens
uccaaggaacuaau

SEQ ID NO: 1171782 - RNA, 21 nt, Homo sapiens
uccaaggaugggaaucaggca

SEQ ID NO: 1171783 - RNA, 17 nt, Homo sapiens
uccaaggcaaacccugu

SEQ ID NO: 1171784 - RNA, 14 nt, Homo sapiens
uccaaguggcauaa

SEQ ID NO: 1171785 - RNA, 13 nt, Homo sapiens
uccaaucagguag

SEQ ID NO: 1171786 - RNA, 15 nt, Homo sapiens
uccaaugcguggcuc

SEQ ID NO: 1171787 - RNA, 14 nt, Homo sapiens
uccaaugcucaaga

SEQ ID NO: 1171788 - RNA, 16 nt, Homo sapiens
uccaaugucaauguga

SEQ ID NO: 1171789 - RNA, 19 nt, Homo sapiens
uccaauuauuugacuuuaa

SEQ ID NO: 1171790 - RNA, 22 nt, Homo sapiens
uccaauuuuaauuuaguaaaug

SEQ ID NO: 1171791 - RNA, 19 nt, Homo sapiens
uccacaaagcaaaggcagu

SEQ ID NO: 1171792 - RNA, 11 nt, Homo sapiens
uccacaaggaa

SEQ ID NO: 1171793 - RNA, 14 nt, Homo sapiens
uccacaaucugaca

SEQ ID NO: 1171794 - RNA, 22 nt, Homo sapiens
uccacacaagggaaggacagaa

SEQ ID NO: 1171795 - RNA, 16 nt, Homo sapiens
uccacaccauucaggu

SEQ ID NO: 1171796 - RNA, 18 nt, Homo sapiens
uccacagaacuagccuua

SEQ ID NO: 1171797 - RNA, 16 nt, Homo sapiens
uccacagaauucacuu

SEQ ID NO: 1171798 - RNA, 21 nt, Homo sapiens
uccacaggcaacgcagaccaa

SEQ ID NO: 1171799 - RNA, 18 nt, Homo sapiens
uccacaugguugugaguc

SEQ ID NO: 1171800 - RNA, 22 nt, Homo sapiens
uccaccacugcuuaagugccua

SEQ ID NO: 1171801 - RNA, 21 nt, Homo sapiens
uccaccagcaucaccugccug

SEQ ID NO: 1171802 - RNA, 20 nt, Homo sapiens
uccaccaggccucacuggcu

SEQ ID NO: 1171803 - RNA, 17 nt, Homo sapiens
uccacccacucacauuc

SEQ ID NO: 1171804 - RNA, 16 nt, Homo sapiens
uccaccccgacugcuc

SEQ ID NO: 1171805 - RNA, 12 nt, Homo sapiens
uccaccuucuac

SEQ ID NO: 1171806 - RNA, 22 nt, Homo sapiens
uccacgcccgggagugggguag

SEQ ID NO: 1171807 - RNA, 23 nt, Homo sapiens
uccacgcggccaccucacccucu

SEQ ID NO: 1171808 - RNA, 21 nt, Homo sapiens
uccacuuaccuagauucuaca

SEQ ID NO: 1171809 - RNA, 13 nt, Homo sapiens
uccagaacccauu

SEQ ID NO: 1171810 - RNA, 16 nt, Homo sapiens
uccagaagugugauug

SEQ ID NO: 1171811 - RNA, 23 nt, Homo sapiens
uccagaaucccguaacaccugau

SEQ ID NO: 1171812 - RNA, 17 nt, Homo sapiens
uccagacacguccugca

SEQ ID NO: 1171813 - RNA, 21 nt, Homo sapiens
uccagacagugggaaggggug

SEQ ID NO: 1171814 - RNA, 18 nt, Homo sapiens
uccagacauacaaacaua

SEQ ID NO: 1171815 - RNA, 12 nt, Homo sapiens
uccagagcugcu

SEQ ID NO: 1171816 - RNA, 14 nt, Homo sapiens
uccagaggaauuga

SEQ ID NO: 1171817 - RNA, 18 nt, Homo sapiens
uccagagucccugccugg

SEQ ID NO: 1171818 - RNA, 15 nt, Homo sapiens
uccagauaaguguau

SEQ ID NO: 1171819 - RNA, 17 nt, Homo sapiens
uccagaugcagggcagu

SEQ ID NO: 1171820 - RNA, 17 nt, Homo sapiens
uccagcaccauccgcca

SEQ ID NO: 1171821 - RNA, 16 nt, Homo sapiens
uccagcagcugccaga

SEQ ID NO: 1171822 - RNA, 18 nt, Homo sapiens
uccagccccuuuccaaaa

SEQ ID NO: 1171823 - RNA, 15 nt, Homo sapiens
uccagcccugcagcu

SEQ ID NO: 1171824 - RNA, 22 nt, Homo sapiens
uccagccugggaggcacagcaa

SEQ ID NO: 1171825 - RNA, 14 nt, Homo sapiens
uccagcuacuuagc

SEQ ID NO: 1171826 - RNA, 17 nt, Homo sapiens
uccagcugcaagggagu

SEQ ID NO: 1171827 - RNA, 19 nt, Homo sapiens
uccagcuugggcaacagag

SEQ ID NO: 1171828 - RNA, 20 nt, Homo sapiens
uccaggacagcaggcuuuga

SEQ ID NO: 1171829 - RNA, 21 nt, Homo sapiens
uccaggacugugccagcacaa

SEQ ID NO: 1171830 - RNA, 14 nt, Homo sapiens
uccaggaggcccug

SEQ ID NO: 1171831 - RNA, 15 nt, Homo sapiens
uccaggcagauccag

SEQ ID NO: 1171832 - RNA, 18 nt, Homo sapiens
uccaggcuggagugcaau

SEQ ID NO: 1171833 - RNA, 17 nt, Homo sapiens
uccagggcugccaggag

SEQ ID NO: 1171834 - RNA, 16 nt, Homo sapiens
uccagguaacuuugaa

SEQ ID NO: 1171835 - RNA, 16 nt, Homo sapiens
uccagguacgcacaga

SEQ ID NO: 1171836 - RNA, 20 nt, Homo sapiens
uccaguaaucugagcagucu

SEQ ID NO: 1171837 - RNA, 14 nt, Homo sapiens
uccagucagugugc

SEQ ID NO: 1171838 - RNA, 16 nt, Homo sapiens
uccagucuguucucac

SEQ ID NO: 1171839 - RNA, 16 nt, Homo sapiens
uccaguugcaauucau

SEQ ID NO: 1171840 - RNA, 19 nt, Homo sapiens
uccauaaugcuacugucuc

SEQ ID NO: 1171841 - RNA, 12 nt, Homo sapiens
uccauacuuugg

SEQ ID NO: 1171842 - RNA, 22 nt, Homo sapiens
uccauauccuucuggcuguaga

SEQ ID NO: 1171843 - RNA, 19 nt, Homo sapiens
uccauauuuuauuaucuua

SEQ ID NO: 1171844 - RNA, 23 nt, Homo sapiens
uccaucauauuaaaaauauacaa

SEQ ID NO: 1171845 - RNA, 19 nt, Homo sapiens
uccaucccccguggccauu

SEQ ID NO: 1171846 - RNA, 21 nt, Homo sapiens
uccauccuccucuccaugcaa

SEQ ID NO: 1171847 - RNA, 15 nt, Homo sapiens
uccaucucaaaaaag

SEQ ID NO: 1171848 - RNA, 21 nt, Homo sapiens
uccaucucucauccuccagua

SEQ ID NO: 1171849 - RNA, 23 nt, Homo sapiens
uccaucuggcugccuuugcuuaa

SEQ ID NO: 1171850 - RNA, 20 nt, Homo sapiens
uccaucuuuacaaaacuaca

SEQ ID NO: 1171851 - RNA, 22 nt, Homo sapiens
uccaugauuuuaaauugugauc

SEQ ID NO: 1171852 - RNA, 17 nt, Homo sapiens
uccaugcccagccaaua

SEQ ID NO: 1171853 - RNA, 15 nt, Homo sapiens
uccaugcuauaauuc

SEQ ID NO: 1171854 - RNA, 20 nt, Homo sapiens
uccauggcaggaaggcuugu

SEQ ID NO: 1171855 - RNA, 16 nt, Homo sapiens
uccaugggaccacaac

SEQ ID NO: 1171856 - RNA, 20 nt, Homo sapiens
uccauggguuccuacgccuu

SEQ ID NO: 1171857 - RNA, 16 nt, Homo sapiens
uccauguccccuccca

SEQ ID NO: 1171858 - RNA, 12 nt, Homo sapiens
uccaugugcuag

SEQ ID NO: 1171859 - RNA, 20 nt, Homo sapiens
uccaugugcuagucacuggc

SEQ ID NO: 1171860 - RNA, 19 nt, Homo sapiens
uccauguguuuugcuuuua

SEQ ID NO: 1171861 - RNA, 10 nt, Homo sapiens
uccauuagua

SEQ ID NO: 1171862 - RNA, 20 nt, Homo sapiens
uccauuccagucaaaucugg

SEQ ID NO: 1171863 - RNA, 17 nt, Homo sapiens
uccauuccugcucuccc

SEQ ID NO: 1171864 - RNA, 21 nt, Homo sapiens
uccauucuuggcaucuacucu

SEQ ID NO: 1171865 - RNA, 18 nt, Homo sapiens
uccauuuacaaacuacuu

SEQ ID NO: 1171866 - RNA, 22 nt, Homo sapiens
ucccaaagccaacgaagugcca

SEQ ID NO: 1171867 - RNA, 23 nt, Homo sapiens
ucccaaaucaauaagaagguaga

SEQ ID NO: 1171868 - RNA, 18 nt, Homo sapiens
ucccaaauucuaccucug

SEQ ID NO: 1171869 - RNA, 17 nt, Homo sapiens
ucccaacuccauucucu

SEQ ID NO: 1171870 - RNA, 13 nt, Homo sapiens
ucccaagcuccca

SEQ ID NO: 1171871 - RNA, 15 nt, Homo sapiens
ucccaagguacagcu

SEQ ID NO: 1171872 - RNA, 14 nt, Homo sapiens
ucccaauaacccag

SEQ ID NO: 1171873 - RNA, 15 nt, Homo sapiens
ucccaauacaggcau

SEQ ID NO: 1171874 - RNA, 22 nt, Homo sapiens
ucccacaaguauauacuuuuaa

SEQ ID NO: 1171875 - RNA, 14 nt, Homo sapiens
ucccacagcacuaa

SEQ ID NO: 1171876 - RNA, 17 nt, Homo sapiens
ucccacccacaugugac

SEQ ID NO: 1171877 - RNA, 20 nt, Homo sapiens
ucccacccacaugugacaca

SEQ ID NO: 1171878 - RNA, 14 nt, Homo sapiens
ucccacgaggaauc

SEQ ID NO: 1171879 - RNA, 22 nt, Homo sapiens
ucccacguacuuauaaagaagg

SEQ ID NO: 1171880 - RNA, 15 nt, Homo sapiens
ucccacuaaugcaaa

SEQ ID NO: 1171881 - RNA, 15 nt, Homo sapiens
ucccacugcacucca

SEQ ID NO: 1171882 - RNA, 22 nt, Homo sapiens
ucccacugcccccuccacugga

SEQ ID NO: 1171883 - RNA, 13 nt, Homo sapiens
ucccacuguauga

SEQ ID NO: 1171884 - RNA, 14 nt, Homo sapiens
ucccagaaacucca

SEQ ID NO: 1171885 - RNA, 15 nt, Homo sapiens
ucccagacacauuca

SEQ ID NO: 1171886 - RNA, 12 nt, Homo sapiens
ucccagcacuuu

SEQ ID NO: 1171887 - RNA, 20 nt, Homo sapiens
ucccagcagcggcaccaagg

SEQ ID NO: 1171888 - RNA, 20 nt, Homo sapiens
ucccagcccuugcauugcag

SEQ ID NO: 1171889 - RNA, 17 nt, Homo sapiens
ucccagcuacucgggag

SEQ ID NO: 1171890 - RNA, 15 nt, Homo sapiens
ucccagcucacugca

SEQ ID NO: 1171891 - RNA, 14 nt, Homo sapiens
ucccaggacccuga

SEQ ID NO: 1171892 - RNA, 20 nt, Homo sapiens
ucccaggacucugaccccag

SEQ ID NO: 1171893 - RNA, 14 nt, Homo sapiens
ucccaggaguacac

SEQ ID NO: 1171894 - RNA, 13 nt, Homo sapiens
ucccaggccaggc

SEQ ID NO: 1171895 - RNA, 22 nt, Homo sapiens
ucccagguguuaacauuccaag

SEQ ID NO: 1171896 - RNA, 15 nt, Homo sapiens
ucccaugccugagga

SEQ ID NO: 1171897 - RNA, 12 nt, Homo sapiens
ucccauggaaua

SEQ ID NO: 1171898 - RNA, 16 nt, Homo sapiens
ucccauuccugaagaa

SEQ ID NO: 1171899 - RNA, 19 nt, Homo sapiens
ucccauuugggcaguauag

SEQ ID NO: 1171900 - RNA, 12 nt, Homo sapiens
ucccauuuuccg

SEQ ID NO: 1171901 - RNA, 22 nt, Homo sapiens
uccccaaaaauugacuuagaua

SEQ ID NO: 1171902 - RNA, 13 nt, Homo sapiens
uccccaacaugga

SEQ ID NO: 1171903 - RNA, 21 nt, Homo sapiens
uccccaacauggauguguugc

SEQ ID NO: 1171904 - RNA, 17 nt, Homo sapiens
uccccaauaauugcaga

SEQ ID NO: 1171905 - RNA, 21 nt, Homo sapiens
uccccagaacaaucuggauuu

SEQ ID NO: 1171906 - RNA, 18 nt, Homo sapiens
uccccagaccucagggac

SEQ ID NO: 1171907 - RNA, 16 nt, Homo sapiens
uccccagcccagagac

SEQ ID NO: 1171908 - RNA, 16 nt, Homo sapiens
uccccaggcaccucac

SEQ ID NO: 1171909 - RNA, 18 nt, Homo sapiens
uccccaguucgccuggag

SEQ ID NO: 1171910 - RNA, 23 nt, Homo sapiens
ucccccagugcccuuugcaucgu

SEQ ID NO: 1171911 - RNA, 19 nt, Homo sapiens
ucccccauggaaacugccc

SEQ ID NO: 1171912 - RNA, 12 nt, Homo sapiens
ucccccccaugc

SEQ ID NO: 1171913 - RNA, 16 nt, Homo sapiens
ucccccuaagucuuuc

SEQ ID NO: 1171914 - RNA, 17 nt, Homo sapiens
ucccccuaauauuaggg

SEQ ID NO: 1171915 - RNA, 16 nt, Homo sapiens
ucccccucucacgcca

SEQ ID NO: 1171916 - RNA, 18 nt, Homo sapiens
uccccgaugcugaccuca

SEQ ID NO: 1171917 - RNA, 14 nt, Homo sapiens
uccccgggcaucuu

SEQ ID NO: 1171918 - RNA, 14 nt, Homo sapiens
uccccuaaaccaaa

SEQ ID NO: 1171919 - RNA, 15 nt, Homo sapiens
uccccuaaaccaaaa

SEQ ID NO: 1171920 - RNA, 14 nt, Homo sapiens
uccccuacucugcc

SEQ ID NO: 1171921 - RNA, 12 nt, Homo sapiens
uccccuauggaa

SEQ ID NO: 1171922 - RNA, 11 nt, Homo sapiens
uccccucacag

SEQ ID NO: 1171923 - RNA, 20 nt, Homo sapiens
uccccuccguggcaucaccu

SEQ ID NO: 1171924 - RNA, 22 nt, Homo sapiens
uccccuggggagucugggcaca

SEQ ID NO: 1171925 - RNA, 19 nt, Homo sapiens
uccccuugcagccugguca

SEQ ID NO: 1171926 - RNA, 14 nt, Homo sapiens
ucccgaaacuccac

SEQ ID NO: 1171927 - RNA, 20 nt, Homo sapiens
ucccgaguagcugggauuac

SEQ ID NO: 1171928 - RNA, 23 nt, Homo sapiens
ucccgaguagggaggaccacagg

SEQ ID NO: 1171929 - RNA, 18 nt, Homo sapiens
ucccggcugacccugugc

SEQ ID NO: 1171930 - RNA, 15 nt, Homo sapiens
ucccgggaagccacc

SEQ ID NO: 1171931 - RNA, 20 nt, Homo sapiens
ucccgggacaccuaggcuag

SEQ ID NO: 1171932 - RNA, 15 nt, Homo sapiens
ucccggggugcauuu

SEQ ID NO: 1171933 - RNA, 18 nt, Homo sapiens
ucccgugagccaggcaaa

SEQ ID NO: 1171934 - RNA, 14 nt, Homo sapiens
ucccuaaaaacaca

SEQ ID NO: 1171935 - RNA, 13 nt, Homo sapiens
ucccuaaccacua

SEQ ID NO: 1171936 - RNA, 14 nt, Homo sapiens
ucccuaaugcucac

SEQ ID NO: 1171937 - RNA, 13 nt, Homo sapiens
ucccuaauucuuc

SEQ ID NO: 1171938 - RNA, 13 nt, Homo sapiens
ucccuaccuugcc

SEQ ID NO: 1171939 - RNA, 14 nt, Homo sapiens
ucccuaggcccaag

SEQ ID NO: 1171940 - RNA, 15 nt, Homo sapiens
ucccucacagcacag

SEQ ID NO: 1171941 - RNA, 16 nt, Homo sapiens
ucccuccaaucuugag

SEQ ID NO: 1171942 - RNA, 23 nt, Homo sapiens
ucccuccagauauacuugguucu

SEQ ID NO: 1171943 - RNA, 14 nt, Homo sapiens
ucccuccagcacaa

SEQ ID NO: 1171944 - RNA, 17 nt, Homo sapiens
ucccuccccacccaaga

SEQ ID NO: 1171945 - RNA, 22 nt, Homo sapiens
ucccucgucuucagcugcauuu

SEQ ID NO: 1171946 - RNA, 14 nt, Homo sapiens
ucccucuggcccug

SEQ ID NO: 1171947 - RNA, 19 nt, Homo sapiens
ucccugaaaacccagagag

SEQ ID NO: 1171948 - RNA, 19 nt, Homo sapiens
ucccugaagucuugcauug

SEQ ID NO: 1171949 - RNA, 20 nt, Homo sapiens
ucccugaagucuugcauuga

SEQ ID NO: 1171950 - RNA, 16 nt, Homo sapiens
ucccugaccuucugag

SEQ ID NO: 1171951 - RNA, 14 nt, Homo sapiens
ucccugagagccac

SEQ ID NO: 1171952 - RNA, 17 nt, Homo sapiens
ucccugccuucacugug

SEQ ID NO: 1171953 - RNA, 18 nt, Homo sapiens
ucccuggcgcugugcuag

SEQ ID NO: 1171954 - RNA, 19 nt, Homo sapiens
ucccuggggaaaacuugca

SEQ ID NO: 1171955 - RNA, 16 nt, Homo sapiens
ucccuggggcacuccc

SEQ ID NO: 1171956 - RNA, 22 nt, Homo sapiens
ucccugggguggggauagggag

SEQ ID NO: 1171957 - RNA, 13 nt, Homo sapiens
ucccuuagacuuu

SEQ ID NO: 1171958 - RNA, 19 nt, Homo sapiens
ucccuuccugggucuacca

SEQ ID NO: 1171959 - RNA, 21 nt, Homo sapiens
ucccuuggggaagaagggaac

SEQ ID NO: 1171960 - RNA, 13 nt, Homo sapiens
ucccuuguguucc

SEQ ID NO: 1171961 - RNA, 23 nt, Homo sapiens
ucccuuuggagauuuuuuaaucc

SEQ ID NO: 1171962 - RNA, 20 nt, Homo sapiens
ucccuuuuaaaugcaaauca

SEQ ID NO: 1171963 - RNA, 20 nt, Homo sapiens
uccgaagagugaagggcagu

SEQ ID NO: 1171964 - RNA, 19 nt, Homo sapiens
uccgaggccccugucucag

SEQ ID NO: 1171965 - RNA, 20 nt, Homo sapiens
uccgcacagucgaagccaca

SEQ ID NO: 1171966 - RNA, 17 nt, Homo sapiens
uccgcagcuucagggga

SEQ ID NO: 1171967 - RNA, 21 nt, Homo sapiens
uccgccagggcccacaccccc

SEQ ID NO: 1171968 - RNA, 18 nt, Homo sapiens
uccgcggccugcaccgac

SEQ ID NO: 1171969 - RNA, 19 nt, Homo sapiens
uccgcggccugcaccgacc

SEQ ID NO: 1171970 - RNA, 17 nt, Homo sapiens
uccggccucugccuuug

SEQ ID NO: 1171971 - RNA, 16 nt, Homo sapiens
uccguaguucccugaa

SEQ ID NO: 1171972 - RNA, 22 nt, Homo sapiens
uccguggccccgcccucaggcu

SEQ ID NO: 1171973 - RNA, 18 nt, Homo sapiens
uccuaaaaguguaagaaa

SEQ ID NO: 1171974 - RNA, 21 nt, Homo sapiens
uccuaaacuguuuauuugcac

SEQ ID NO: 1171975 - RNA, 18 nt, Homo sapiens
uccuaaccucaagugauc

SEQ ID NO: 1171976 - RNA, 21 nt, Homo sapiens
uccuaauaucaaaugcaguau

SEQ ID NO: 1171977 - RNA, 18 nt, Homo sapiens
uccuaaucaagagucucu

SEQ ID NO: 1171978 - RNA, 15 nt, Homo sapiens
uccuaccacuuugaa

SEQ ID NO: 1171979 - RNA, 22 nt, Homo sapiens
uccuacccccugugccuuguca

SEQ ID NO: 1171980 - RNA, 17 nt, Homo sapiens
uccuacgccuugucauu

SEQ ID NO: 1171981 - RNA, 19 nt, Homo sapiens
uccuacucccagacaccca

SEQ ID NO: 1171982 - RNA, 18 nt, Homo sapiens
uccuacuguaugugggaa

SEQ ID NO: 1171983 - RNA, 14 nt, Homo sapiens
uccuagcaaccugc

SEQ ID NO: 1171984 - RNA, 19 nt, Homo sapiens
uccuagccacccaccacac

SEQ ID NO: 1171985 - RNA, 15 nt, Homo sapiens
uccuagcuaucaaga

SEQ ID NO: 1171986 - RNA, 16 nt, Homo sapiens
uccuagcuuaucuccc

SEQ ID NO: 1171987 - RNA, 15 nt, Homo sapiens
uccuauaugcacuua

SEQ ID NO: 1171988 - RNA, 14 nt, Homo sapiens
uccuaucaaagugu

SEQ ID NO: 1171989 - RNA, 18 nt, Homo sapiens
uccuaucaccuauuucca

SEQ ID NO: 1171990 - RNA, 19 nt, Homo sapiens
uccuaugcuuugaaacaga

SEQ ID NO: 1171991 - RNA, 15 nt, Homo sapiens
uccuauguaacugca

SEQ ID NO: 1171992 - RNA, 12 nt, Homo sapiens
uccuaugugauu

SEQ ID NO: 1171993 - RNA, 22 nt, Homo sapiens
uccuaugugauuuuaacucugu

SEQ ID NO: 1171994 - RNA, 17 nt, Homo sapiens
uccuauuccagugucca

SEQ ID NO: 1171995 - RNA, 14 nt, Homo sapiens
uccucaauccagcu

SEQ ID NO: 1171996 - RNA, 14 nt, Homo sapiens
uccucacuaccugc

SEQ ID NO: 1171997 - RNA, 17 nt, Homo sapiens
uccucagaaaccaaagc

SEQ ID NO: 1171998 - RNA, 22 nt, Homo sapiens
uccucaggcacacagcuacucu

SEQ ID NO: 1171999 - RNA, 18 nt, Homo sapiens
uccucaguccacugcuga

SEQ ID NO: 1172000 - RNA, 16 nt, Homo sapiens
uccucauucaaaggga

SEQ ID NO: 1172001 - RNA, 12 nt, Homo sapiens
uccuccaacagc

SEQ ID NO: 1172002 - RNA, 16 nt, Homo sapiens
uccuccacgccugucc

SEQ ID NO: 1172003 - RNA, 20 nt, Homo sapiens
uccuccagggugugugcucg

SEQ ID NO: 1172004 - RNA, 16 nt, Homo sapiens
uccuccccaccagagc

SEQ ID NO: 1172005 - RNA, 15 nt, Homo sapiens
uccuccccacuagca

SEQ ID NO: 1172006 - RNA, 18 nt, Homo sapiens
uccuccccacuagcauuu

SEQ ID NO: 1172007 - RNA, 20 nt, Homo sapiens
uccuccccccuccucugaaa

SEQ ID NO: 1172008 - RNA, 15 nt, Homo sapiens
uccuccccuugaaua

SEQ ID NO: 1172009 - RNA, 10 nt, Homo sapiens
uccuccucag

SEQ ID NO: 1172010 - RNA, 17 nt, Homo sapiens
uccuccugacucuucag

SEQ ID NO: 1172011 - RNA, 19 nt, Homo sapiens
uccuccugcccaccuguca

SEQ ID NO: 1172012 - RNA, 14 nt, Homo sapiens
uccucuaaaacccu

SEQ ID NO: 1172013 - RNA, 18 nt, Homo sapiens
uccucuacagauugucau

SEQ ID NO: 1172014 - RNA, 14 nt, Homo sapiens
uccucucucccugc

SEQ ID NO: 1172015 - RNA, 14 nt, Homo sapiens
uccucucugcaaau

SEQ ID NO: 1172016 - RNA, 19 nt, Homo sapiens
uccucugaaacagcugccu

SEQ ID NO: 1172017 - RNA, 19 nt, Homo sapiens
uccucugcagcucagggac

SEQ ID NO: 1172018 - RNA, 17 nt, Homo sapiens
uccucuggauugagaua

SEQ ID NO: 1172019 - RNA, 22 nt, Homo sapiens
uccucugugaagcaggucuuuc

SEQ ID NO: 1172020 - RNA, 19 nt, Homo sapiens
uccucugugaccaaugucu

SEQ ID NO: 1172021 - RNA, 17 nt, Homo sapiens
uccucuuaauguuucca

SEQ ID NO: 1172022 - RNA, 16 nt, Homo sapiens
uccucuuucaaccuca

SEQ ID NO: 1172023 - RNA, 16 nt, Homo sapiens
uccucuuugguggcau

SEQ ID NO: 1172024 - RNA, 19 nt, Homo sapiens
uccugaaaagauccuauua

SEQ ID NO: 1172025 - RNA, 16 nt, Homo sapiens
uccugaaacacuaaag

SEQ ID NO: 1172026 - RNA, 18 nt, Homo sapiens
uccugaccccguuuucca

SEQ ID NO: 1172027 - RNA, 15 nt, Homo sapiens
uccugaccucgugau

SEQ ID NO: 1172028 - RNA, 22 nt, Homo sapiens
uccugacuuaaaacaaaaggaa

SEQ ID NO: 1172029 - RNA, 15 nt, Homo sapiens
uccugagacagaauu

SEQ ID NO: 1172030 - RNA, 18 nt, Homo sapiens
uccugagagcugcuuuga

SEQ ID NO: 1172031 - RNA, 14 nt, Homo sapiens
uccugagggagcuc

SEQ ID NO: 1172032 - RNA, 18 nt, Homo sapiens
uccugauccugacacauu

SEQ ID NO: 1172033 - RNA, 20 nt, Homo sapiens
uccugauccugacacauucu

SEQ ID NO: 1172034 - RNA, 19 nt, Homo sapiens
uccugcaguguuuugcaua

SEQ ID NO: 1172035 - RNA, 21 nt, Homo sapiens
uccugcaucguggcacuccuc

SEQ ID NO: 1172036 - RNA, 20 nt, Homo sapiens
uccugcccaccugucaaaca

SEQ ID NO: 1172037 - RNA, 15 nt, Homo sapiens
uccugcggcaucaga

SEQ ID NO: 1172038 - RNA, 23 nt, Homo sapiens
uccugcucucccacugcacacag

SEQ ID NO: 1172039 - RNA, 13 nt, Homo sapiens
uccugcuuauuca

SEQ ID NO: 1172040 - RNA, 20 nt, Homo sapiens
uccuggaccuugacagagca

SEQ ID NO: 1172041 - RNA, 21 nt, Homo sapiens
uccuggagcaaucacagauga

SEQ ID NO: 1172042 - RNA, 23 nt, Homo sapiens
uccuggaggcugccugcugugcu

SEQ ID NO: 1172043 - RNA, 23 nt, Homo sapiens
uccuggcuccuuaucagugccau

SEQ ID NO: 1172044 - RNA, 13 nt, Homo sapiens
uccugggcccucu

SEQ ID NO: 1172045 - RNA, 16 nt, Homo sapiens
uccugggccugcagaa

SEQ ID NO: 1172046 - RNA, 15 nt, Homo sapiens
uccugggcuauauuc

SEQ ID NO: 1172047 - RNA, 15 nt, Homo sapiens
uccuggucacuggag

SEQ ID NO: 1172048 - RNA, 17 nt, Homo sapiens
uccuggucugcucagga

SEQ ID NO: 1172049 - RNA, 16 nt, Homo sapiens
uccugguuuuugccua

SEQ ID NO: 1172050 - RNA, 14 nt, Homo sapiens
uccuguaaauguga

SEQ ID NO: 1172051 - RNA, 17 nt, Homo sapiens
uccuguacuuuuuccag

SEQ ID NO: 1172052 - RNA, 21 nt, Homo sapiens
uccuguacuuuuuccagacac

SEQ ID NO: 1172053 - RNA, 14 nt, Homo sapiens
uccuguccagcucc

SEQ ID NO: 1172054 - RNA, 23 nt, Homo sapiens
uccuguccagcuccaaccugcaa

SEQ ID NO: 1172055 - RNA, 22 nt, Homo sapiens
uccugugaguaaucuugcaaau

SEQ ID NO: 1172056 - RNA, 23 nt, Homo sapiens
uccuguguccccugaccugucca

SEQ ID NO: 1172057 - RNA, 21 nt, Homo sapiens
uccuguuggauaucauacuuc

SEQ ID NO: 1172058 - RNA, 15 nt, Homo sapiens
uccuuaucacugaca

SEQ ID NO: 1172059 - RNA, 14 nt, Homo sapiens
uccuuaucagugcc

SEQ ID NO: 1172060 - RNA, 14 nt, Homo sapiens
uccuuccucaagaa

SEQ ID NO: 1172061 - RNA, 15 nt, Homo sapiens
uccuuccugagaaac

SEQ ID NO: 1172062 - RNA, 13 nt, Homo sapiens
uccuucugugaag

SEQ ID NO: 1172063 - RNA, 22 nt, Homo sapiens
uccuucuuggaguuacaacaga

SEQ ID NO: 1172064 - RNA, 12 nt, Homo sapiens
uccuugcaucaa

SEQ ID NO: 1172065 - RNA, 18 nt, Homo sapiens
uccuugcccccauuucac

SEQ ID NO: 1172066 - RNA, 15 nt, Homo sapiens
uccuugcuuguuaca

SEQ ID NO: 1172067 - RNA, 21 nt, Homo sapiens
uccuugguuguauaaagcaaa

SEQ ID NO: 1172068 - RNA, 12 nt, Homo sapiens
uccuuguugccc

SEQ ID NO: 1172069 - RNA, 22 nt, Homo sapiens
uccuuuaagagcucuggugaua

SEQ ID NO: 1172070 - RNA, 17 nt, Homo sapiens
uccuuuaauauuugcua

SEQ ID NO: 1172071 - RNA, 22 nt, Homo sapiens
uccuuuacuaaugguguugagu

SEQ ID NO: 1172072 - RNA, 14 nt, Homo sapiens
uccuuuauacugug

SEQ ID NO: 1172073 - RNA, 15 nt, Homo sapiens
uccuuucucuguaua

SEQ ID NO: 1172074 - RNA, 20 nt, Homo sapiens
uccuuugccugauccuccaa

SEQ ID NO: 1172075 - RNA, 16 nt, Homo sapiens
uccuuuggcauguuua

SEQ ID NO: 1172076 - RNA, 18 nt, Homo sapiens
uccuuuuucaacuuggaa

SEQ ID NO: 1172077 - RNA, 14 nt, Homo sapiens
uccuuuuuuauucc

SEQ ID NO: 1172078 - RNA, 23 nt, Homo sapiens
uccuuuuuucaaaauccaaaaag

SEQ ID NO: 1172079 - RNA, 18 nt, Homo sapiens
ucgaaaccugggauucag

SEQ ID NO: 1172080 - RNA, 18 nt, Homo sapiens
ucgaaaggugcagcugcg

SEQ ID NO: 1172081 - RNA, 15 nt, Homo sapiens
ucgaacaauucauau

SEQ ID NO: 1172082 - RNA, 15 nt, Homo sapiens
ucgaccacaccagcc

SEQ ID NO: 1172083 - RNA, 19 nt, Homo sapiens
ucgacugcucaaccucacc

SEQ ID NO: 1172084 - RNA, 19 nt, Homo sapiens
ucgacuucgggcuggccau

SEQ ID NO: 1172085 - RNA, 19 nt, Homo sapiens
ucgagaucaucacuuccuu

SEQ ID NO: 1172086 - RNA, 13 nt, Homo sapiens
ucgagguggauca

SEQ ID NO: 1172087 - RNA, 18 nt, Homo sapiens
ucgaucuuccagaagcug

SEQ ID NO: 1172088 - RNA, 17 nt, Homo sapiens
ucgaugcguauucugug

SEQ ID NO: 1172089 - RNA, 14 nt, Homo sapiens
ucgcaccugugcug

SEQ ID NO: 1172090 - RNA, 20 nt, Homo sapiens
ucgcaguguucaaggccauc

SEQ ID NO: 1172091 - RNA, 14 nt, Homo sapiens
ucgcauuugucaau

SEQ ID NO: 1172092 - RNA, 16 nt, Homo sapiens
ucgccaaucaucauua

SEQ ID NO: 1172093 - RNA, 16 nt, Homo sapiens
ucgcuuaagccagcac

SEQ ID NO: 1172094 - RNA, 15 nt, Homo sapiens
ucggcucagugcaac

SEQ ID NO: 1172095 - RNA, 11 nt, Homo sapiens
ucgggacauca

SEQ ID NO: 1172096 - RNA, 22 nt, Homo sapiens
ucgggcccagcuucacccugcg

SEQ ID NO: 1172097 - RNA, 23 nt, Homo sapiens
ucggggagcguucuaaauaugaa

SEQ ID NO: 1172098 - RNA, 23 nt, Homo sapiens
ucggggccauacuucuguuucca

SEQ ID NO: 1172099 - RNA, 13 nt, Homo sapiens
ucgguaauaucau

SEQ ID NO: 1172100 - RNA, 21 nt, Homo sapiens
ucgguggcugccuuugaucac

SEQ ID NO: 1172101 - RNA, 12 nt, Homo sapiens
ucggugugcacc

SEQ ID NO: 1172102 - RNA, 16 nt, Homo sapiens
ucgucuggcaucuccc

SEQ ID NO: 1172103 - RNA, 15 nt, Homo sapiens
ucguucucugccuca

SEQ ID NO: 1172104 - RNA, 15 nt, Homo sapiens
ucguuuagugccaau

SEQ ID NO: 1172105 - RNA, 15 nt, Homo sapiens
ucuaaaaucugcuag

SEQ ID NO: 1172106 - RNA, 21 nt, Homo sapiens
ucuaaacagugggaguaccaa

SEQ ID NO: 1172107 - RNA, 22 nt, Homo sapiens
ucuaaacagugggaguaccaaa

SEQ ID NO: 1172108 - RNA, 21 nt, Homo sapiens
ucuaaacuuccccaucuucua

SEQ ID NO: 1172109 - RNA, 16 nt, Homo sapiens
ucuaaagccaagcacu

SEQ ID NO: 1172110 - RNA, 16 nt, Homo sapiens
ucuaaauaugaaugaa

SEQ ID NO: 1172111 - RNA, 16 nt, Homo sapiens
ucuaaaucaccagaga

SEQ ID NO: 1172112 - RNA, 12 nt, Homo sapiens
ucuaaaugccca

SEQ ID NO: 1172113 - RNA, 18 nt, Homo sapiens
ucuaaauugaucauucau

SEQ ID NO: 1172114 - RNA, 18 nt, Homo sapiens
ucuaaccaaagagucucu

SEQ ID NO: 1172115 - RNA, 14 nt, Homo sapiens
ucuaaccauguauc

SEQ ID NO: 1172116 - RNA, 18 nt, Homo sapiens
ucuaacucagaaacauca

SEQ ID NO: 1172117 - RNA, 21 nt, Homo sapiens
ucuaacuuuugugaagaacua

SEQ ID NO: 1172118 - RNA, 19 nt, Homo sapiens
ucuaagaaguuuuguucug

SEQ ID NO: 1172119 - RNA, 14 nt, Homo sapiens
ucuaagauucugau

SEQ ID NO: 1172120 - RNA, 16 nt, Homo sapiens
ucuaagguaacauuua

SEQ ID NO: 1172121 - RNA, 21 nt, Homo sapiens
ucuaagugggacauucaaaaa

SEQ ID NO: 1172122 - RNA, 19 nt, Homo sapiens
ucuaauaaaaauacaaaaa

SEQ ID NO: 1172123 - RNA, 23 nt, Homo sapiens
ucuaauaaacagacuguuuucua

SEQ ID NO: 1172124 - RNA, 13 nt, Homo sapiens
ucuaauugcugug

SEQ ID NO: 1172125 - RNA, 11 nt, Homo sapiens
ucuacaaggac

SEQ ID NO: 1172126 - RNA, 14 nt, Homo sapiens
ucuacaaugcacau

SEQ ID NO: 1172127 - RNA, 13 nt, Homo sapiens
ucuacacauacau

SEQ ID NO: 1172128 - RNA, 16 nt, Homo sapiens
ucuacauuaaaucacu

SEQ ID NO: 1172129 - RNA, 22 nt, Homo sapiens
ucuacauuaaaucacuugaauc

SEQ ID NO: 1172130 - RNA, 22 nt, Homo sapiens
uucuucccgcacaaauuccaca

SEQ ID NO: 1172131 - RNA, 12 nt, Homo sapiens
uucuucuagcuc

SEQ ID NO: 1172132 - RNA, 15 nt, Homo sapiens
uucuucuucuaaaau

SEQ ID NO: 1172133 - RNA, 19 nt, Homo sapiens
uucuugaagcaguagccua

SEQ ID NO: 1172134 - RNA, 15 nt, Homo sapiens
uucuugaggucuuga

SEQ ID NO: 1172135 - RNA, 22 nt, Homo sapiens
uucuuuaaaaaacaacuaugga

SEQ ID NO: 1172136 - RNA, 15 nt, Homo sapiens
uucuuuaaaggcauc

SEQ ID NO: 1172137 - RNA, 17 nt, Homo sapiens
uucuuuaagucaguuca

SEQ ID NO: 1172138 - RNA, 20 nt, Homo sapiens
uucuuuauacucucuucccu

SEQ ID NO: 1172139 - RNA, 19 nt, Homo sapiens
uucuuuauauaaggucaua

SEQ ID NO: 1172140 - RNA, 15 nt, Homo sapiens
uucuuucaucauuca

SEQ ID NO: 1172141 - RNA, 17 nt, Homo sapiens
uucuuucccaacaccuc

SEQ ID NO: 1172142 - RNA, 19 nt, Homo sapiens
uucuuucucccuaaccacu

SEQ ID NO: 1172143 - RNA, 13 nt, Homo sapiens
uucuuucuuccau

SEQ ID NO: 1172144 - RNA, 20 nt, Homo sapiens
uucuuugcugcagucaucua

SEQ ID NO: 1172145 - RNA, 13 nt, Homo sapiens
uucuuuucacuuc

SEQ ID NO: 1172146 - RNA, 13 nt, Homo sapiens
uucuuuucccuca

SEQ ID NO: 1172147 - RNA, 17 nt, Homo sapiens
uugaaaaaagcugaauu

SEQ ID NO: 1172148 - RNA, 20 nt, Homo sapiens
uugaaaauguauuuccugaa

SEQ ID NO: 1172149 - RNA, 15 nt, Homo sapiens
uugaaacaaagaagg

SEQ ID NO: 1172150 - RNA, 18 nt, Homo sapiens
uugaaaccaagcuuucaa

SEQ ID NO: 1172151 - RNA, 17 nt, Homo sapiens
uugaaaccgccucugga

SEQ ID NO: 1172152 - RNA, 16 nt, Homo sapiens
uugaaaccugauguca

SEQ ID NO: 1172153 - RNA, 15 nt, Homo sapiens
uugaaagaaccagag

SEQ ID NO: 1172154 - RNA, 16 nt, Homo sapiens
uugaaagaaccagaga

SEQ ID NO: 1172155 - RNA, 19 nt, Homo sapiens
uugaaaugcagauugcuac

SEQ ID NO: 1172156 - RNA, 20 nt, Homo sapiens
uugaaauuaagaaggcaaaa

SEQ ID NO: 1172157 - RNA, 11 nt, Homo sapiens
uugaacacugc

SEQ ID NO: 1172158 - RNA, 20 nt, Homo sapiens
uugaacccgggggacagagg

SEQ ID NO: 1172159 - RNA, 22 nt, Homo sapiens
uugaaccucauuaaauggugau

SEQ ID NO: 1172160 - RNA, 16 nt, Homo sapiens
uugaacuucaccugca

SEQ ID NO: 1172161 - RNA, 16 nt, Homo sapiens
uugaagauaguaacug

SEQ ID NO: 1172162 - RNA, 18 nt, Homo sapiens
uugaagauaguaacugua

SEQ ID NO: 1172163 - RNA, 16 nt, Homo sapiens
uugaaggaucaucuga

SEQ ID NO: 1172164 - RNA, 14 nt, Homo sapiens
uugaaggcaaaaau

SEQ ID NO: 1172165 - RNA, 21 nt, Homo sapiens
uugaaguaggaaguaggaaau

SEQ ID NO: 1172166 - RNA, 15 nt, Homo sapiens
uugaaguccaggacu

SEQ ID NO: 1172167 - RNA, 18 nt, Homo sapiens
uugaagugggaaagcauu

SEQ ID NO: 1172168 - RNA, 17 nt, Homo sapiens
uugaauaauaagcagga

SEQ ID NO: 1172169 - RNA, 17 nt, Homo sapiens
uugaauagggguugagu

SEQ ID NO: 1172170 - RNA, 19 nt, Homo sapiens
uugaaugcagucuguccag

SEQ ID NO: 1172171 - RNA, 21 nt, Homo sapiens
uugaauggagauucugauuca

SEQ ID NO: 1172172 - RNA, 15 nt, Homo sapiens
uugaauuacagcagu

SEQ ID NO: 1172173 - RNA, 23 nt, Homo sapiens
uugaauucauguacaugguauua

SEQ ID NO: 1172174 - RNA, 23 nt, Homo sapiens
uugaauuguuacaucaugcugga

SEQ ID NO: 1172175 - RNA, 17 nt, Homo sapiens
uugacaaaguuacugau

SEQ ID NO: 1172176 - RNA, 17 nt, Homo sapiens
uugacaaauguaaacau

SEQ ID NO: 1172177 - RNA, 13 nt, Homo sapiens
uugacaacaguua

SEQ ID NO: 1172178 - RNA, 19 nt, Homo sapiens
uugacagcuuugcugcuga

SEQ ID NO: 1172179 - RNA, 11 nt, Homo sapiens
uugaccaaaga

SEQ ID NO: 1172180 - RNA, 18 nt, Homo sapiens
uugaccagagugggacca

SEQ ID NO: 1172181 - RNA, 13 nt, Homo sapiens
uugaccaugugau

SEQ ID NO: 1172182 - RNA, 18 nt, Homo sapiens
uugaccugaacucugcaa

SEQ ID NO: 1172183 - RNA, 15 nt, Homo sapiens
uugacgaacuggcua

SEQ ID NO: 1172184 - RNA, 22 nt, Homo sapiens
uugacuagaugauggaugccaa

SEQ ID NO: 1172185 - RNA, 23 nt, Homo sapiens
uugacuauguuuggaguuuaauu

SEQ ID NO: 1172186 - RNA, 12 nt, Homo sapiens
uugacucaaaaa

SEQ ID NO: 1172187 - RNA, 18 nt, Homo sapiens
uugacucuugcaauccac

SEQ ID NO: 1172188 - RNA, 21 nt, Homo sapiens
uugacucuuguuuucaguuuc

SEQ ID NO: 1172189 - RNA, 16 nt, Homo sapiens
uugacuggauauucau

SEQ ID NO: 1172190 - RNA, 15 nt, Homo sapiens
uugacuuaccaugga

SEQ ID NO: 1172191 - RNA, 17 nt, Homo sapiens
uugagaaagccuucaua

SEQ ID NO: 1172192 - RNA, 14 nt, Homo sapiens
uugagaaucccaaa

SEQ ID NO: 1172193 - RNA, 22 nt, Homo sapiens
uugagaccuuugauuuuuugcc

SEQ ID NO: 1172194 - RNA, 14 nt, Homo sapiens
uugagagcuuucug

SEQ ID NO: 1172195 - RNA, 15 nt, Homo sapiens
uugagcagaauacaa

SEQ ID NO: 1172196 - RNA, 18 nt, Homo sapiens
uugagccaguggugcuaa

SEQ ID NO: 1172197 - RNA, 15 nt, Homo sapiens
uugagcgugauucug

SEQ ID NO: 1172198 - RNA, 22 nt, Homo sapiens
uugagcuggauggguacagcuu

SEQ ID NO: 1172199 - RNA, 21 nt, Homo sapiens
uugagcuucauauaccagcaa

SEQ ID NO: 1172200 - RNA, 14 nt, Homo sapiens
uugaggaccucauc

SEQ ID NO: 1172201 - RNA, 18 nt, Homo sapiens
uugaggauuuagaagugu

SEQ ID NO: 1172202 - RNA, 16 nt, Homo sapiens
uugaggcaguuccagg

SEQ ID NO: 1172203 - RNA, 19 nt, Homo sapiens
uugagggacugagccagac

SEQ ID NO: 1172204 - RNA, 16 nt, Homo sapiens
uugaggguccucaguc

SEQ ID NO: 1172205 - RNA, 13 nt, Homo sapiens
uugaguacagaua

SEQ ID NO: 1172206 - RNA, 23 nt, Homo sapiens
uugauaauaaauuauacacuaug

SEQ ID NO: 1172207 - RNA, 12 nt, Homo sapiens
uugauacaguca

SEQ ID NO: 1172208 - RNA, 14 nt, Homo sapiens
uugauacgggauuu

SEQ ID NO: 1172209 - RNA, 16 nt, Homo sapiens
uugauauugugaacau

SEQ ID NO: 1172210 - RNA, 17 nt, Homo sapiens
uugauauuuuuucucuc

SEQ ID NO: 1172211 - RNA, 17 nt, Homo sapiens
uugauccugggggacca

SEQ ID NO: 1172212 - RNA, 15 nt, Homo sapiens
uugaucuagaugucu

SEQ ID NO: 1172213 - RNA, 18 nt, Homo sapiens
uugaugagcacuccugau

SEQ ID NO: 1172214 - RNA, 16 nt, Homo sapiens
uugaugcuacaggauu

SEQ ID NO: 1172215 - RNA, 19 nt, Homo sapiens
uugaugguaggcuguauag

SEQ ID NO: 1172216 - RNA, 11 nt, Homo sapiens
uugaugugcac

SEQ ID NO: 1172217 - RNA, 17 nt, Homo sapiens
uugauucacaaugaaau

SEQ ID NO: 1172218 - RNA, 22 nt, Homo sapiens
uugauucacaaugaaaugcucu

SEQ ID NO: 1172219 - RNA, 21 nt, Homo sapiens
uugauucuagaugaucaacau

SEQ ID NO: 1172220 - RNA, 14 nt, Homo sapiens
uugauuuccaacau

SEQ ID NO: 1172221 - RNA, 13 nt, Homo sapiens
uugauuuuugccc

SEQ ID NO: 1172222 - RNA, 15 nt, Homo sapiens
uugauuuuugcccag

SEQ ID NO: 1172223 - RNA, 23 nt, Homo sapiens
uugauuuuuucaucuaauguaau

SEQ ID NO: 1172224 - RNA, 14 nt, Homo sapiens
uugcaaaguacugu

SEQ ID NO: 1172225 - RNA, 21 nt, Homo sapiens
uugcaaauaccuccucccuaa

SEQ ID NO: 1172226 - RNA, 18 nt, Homo sapiens
uugcaaaucacucugcaa

SEQ ID NO: 1172227 - RNA, 16 nt, Homo sapiens
uugcaaaucuugaaau

SEQ ID NO: 1172228 - RNA, 13 nt, Homo sapiens
uugcaauacugcu

SEQ ID NO: 1172229 - RNA, 11 nt, Homo sapiens
uugcaaucaaa

SEQ ID NO: 1172230 - RNA, 18 nt, Homo sapiens
uugcaauggaucagccaa

SEQ ID NO: 1172231 - RNA, 14 nt, Homo sapiens
uugcaauguaguca

SEQ ID NO: 1172232 - RNA, 21 nt, Homo sapiens
uugcaauucauaacuaaugaa

SEQ ID NO: 1172233 - RNA, 19 nt, Homo sapiens
uugcaauuggaauaaucac

SEQ ID NO: 1172234 - RNA, 18 nt, Homo sapiens
uugcacaguuaccugcac

SEQ ID NO: 1172235 - RNA, 13 nt, Homo sapiens
uugcacauaguag

SEQ ID NO: 1172236 - RNA, 19 nt, Homo sapiens
uugcaccuaucucagccau

SEQ ID NO: 1172237 - RNA, 23 nt, Homo sapiens
uugcacugaaauggaauucccau

SEQ ID NO: 1172238 - RNA, 16 nt, Homo sapiens
uugcacugacaguggg

SEQ ID NO: 1172239 - RNA, 17 nt, Homo sapiens
uugcacuuaugauuuca

SEQ ID NO: 1172240 - RNA, 18 nt, Homo sapiens
uugcagacaggaaucuua

SEQ ID NO: 1172241 - RNA, 14 nt, Homo sapiens
uugcagacaguguu

SEQ ID NO: 1172242 - RNA, 16 nt, Homo sapiens
uugcagaggagcccag

SEQ ID NO: 1172243 - RNA, 17 nt, Homo sapiens
uugcagauaacuuugac

SEQ ID NO: 1172244 - RNA, 17 nt, Homo sapiens
uugcagcuggacuucuc

SEQ ID NO: 1172245 - RNA, 21 nt, Homo sapiens
uugcagcuuauauucauccau

SEQ ID NO: 1172246 - RNA, 16 nt, Homo sapiens
uugcaggagacauuuu

SEQ ID NO: 1172247 - RNA, 20 nt, Homo sapiens
uugcaggauggugucucuuc

SEQ ID NO: 1172248 - RNA, 22 nt, Homo sapiens
uugcaggauuuuuagagcauua

SEQ ID NO: 1172249 - RNA, 16 nt, Homo sapiens
uugcaggguccucuuc

SEQ ID NO: 1172250 - RNA, 18 nt, Homo sapiens
uugcagugagugcugcuc

SEQ ID NO: 1172251 - RNA, 19 nt, Homo sapiens
uugcauaacagcaggguac

SEQ ID NO: 1172252 - RNA, 20 nt, Homo sapiens
uugcauagaguauagcucug

SEQ ID NO: 1172253 - RNA, 18 nt, Homo sapiens
uugcauagcagcugcuac

SEQ ID NO: 1172254 - RNA, 19 nt, Homo sapiens
uugcaucacagucacaugc

SEQ ID NO: 1172255 - RNA, 24 nt, Homo sapiens
uugcaugggcuaaugaagaucaua

SEQ ID NO: 1172256 - RNA, 22 nt, Homo sapiens
uugcauugauucaguauuacaa

SEQ ID NO: 1172257 - RNA, 16 nt, Homo sapiens
uugcauuuauugcagu

SEQ ID NO: 1172258 - RNA, 18 nt, Homo sapiens
uugcauuuguacuggcaa

SEQ ID NO: 1172259 - RNA, 22 nt, Homo sapiens
uugccaaacagcccaaacugua

SEQ ID NO: 1172260 - RNA, 21 nt, Homo sapiens
uugccaccagccccacccugc

SEQ ID NO: 1172261 - RNA, 14 nt, Homo sapiens
uugccagaaccaaa

SEQ ID NO: 1172262 - RNA, 17 nt, Homo sapiens
uugccagccauucuuuc

SEQ ID NO: 1172263 - RNA, 23 nt, Homo sapiens
uugcccaacuacuaucucagaga

SEQ ID NO: 1172264 - RNA, 21 nt, Homo sapiens
uugcccaggcuagagugcaau

SEQ ID NO: 1172265 - RNA, 22 nt, Homo sapiens
uugcccaggcuagagugcaaug

SEQ ID NO: 1172266 - RNA, 21 nt, Homo sapiens
uugcccaggcuggagugcagu

SEQ ID NO: 1172267 - RNA, 23 nt, Homo sapiens
uugcccauauaaaaugcugauau

SEQ ID NO: 1172268 - RNA, 14 nt, Homo sapiens
uugcccccauuuca

SEQ ID NO: 1172269 - RNA, 13 nt, Homo sapiens
uugcccuaauuca

SEQ ID NO: 1172270 - RNA, 23 nt, Homo sapiens
uugccguuuguccuuaacuuucu

SEQ ID NO: 1172271 - RNA, 23 nt, Homo sapiens
uugccucccgggcucaagcgauu

SEQ ID NO: 1172272 - RNA, 12 nt, Homo sapiens
uugccugaacau

SEQ ID NO: 1172273 - RNA, 19 nt, Homo sapiens
uugccugcagggccauggc

SEQ ID NO: 1172274 - RNA, 13 nt, Homo sapiens
uugccuguucagu

SEQ ID NO: 1172275 - RNA, 16 nt, Homo sapiens
uugccuuugaauguua

SEQ ID NO: 1172276 - RNA, 23 nt, Homo sapiens
uugcgcaaacuuuaacagguuuu

SEQ ID NO: 1172277 - RNA, 20 nt, Homo sapiens
uugcuacagggcucacagaa

SEQ ID NO: 1172278 - RNA, 21 nt, Homo sapiens
uugcuaucggggaagccagac

SEQ ID NO: 1172279 - RNA, 14 nt, Homo sapiens
uugcucacagcuga

SEQ ID NO: 1172280 - RNA, 15 nt, Homo sapiens
uugcucacagcugau

SEQ ID NO: 1172281 - RNA, 15 nt, Homo sapiens
uugcuccauuuacaa

SEQ ID NO: 1172282 - RNA, 19 nt, Homo sapiens
uugcucucggugcuuccaa

SEQ ID NO: 1172283 - RNA, 12 nt, Homo sapiens
uugcucucugug

SEQ ID NO: 1172284 - RNA, 13 nt, Homo sapiens
uugcugagugagu

SEQ ID NO: 1172285 - RNA, 22 nt, Homo sapiens
uugcugauaaaacagauuguga

SEQ ID NO: 1172286 - RNA, 23 nt, Homo sapiens
uugcuggaccugaauucuacuga

SEQ ID NO: 1172287 - RNA, 23 nt, Homo sapiens
uugcuggggcucgugcccugcau

SEQ ID NO: 1172288 - RNA, 23 nt, Homo sapiens
uugcuguggacuauuauuacaua

SEQ ID NO: 1172289 - RNA, 20 nt, Homo sapiens
uugcuguuccacaaagcagu

SEQ ID NO: 1172290 - RNA, 11 nt, Homo sapiens
uugcuguucua

SEQ ID NO: 1172291 - RNA, 13 nt, Homo sapiens
uugcuguuuccuu

SEQ ID NO: 1172292 - RNA, 21 nt, Homo sapiens
uugcuguuuggauuauuccuc

SEQ ID NO: 1172293 - RNA, 19 nt, Homo sapiens
uugcuuauaacaagcauau

SEQ ID NO: 1172294 - RNA, 16 nt, Homo sapiens
uugcuuccaaacuccu

SEQ ID NO: 1172295 - RNA, 10 nt, Homo sapiens
uugcuucuag

SEQ ID NO: 1172296 - RNA, 21 nt, Homo sapiens
uugcuuguaaaauuucacuua

SEQ ID NO: 1172297 - RNA, 12 nt, Homo sapiens
uugcuuuccacu

SEQ ID NO: 1172298 - RNA, 20 nt, Homo sapiens
uugcuuuucacuggcauaaa

SEQ ID NO: 1172299 - RNA, 15 nt, Homo sapiens
uugcuuuuccuucag

SEQ ID NO: 1172300 - RNA, 13 nt, Homo sapiens
uuggaaacagaga

SEQ ID NO: 1172301 - RNA, 13 nt, Homo sapiens
uuggaaccaaagu

SEQ ID NO: 1172302 - RNA, 15 nt, Homo sapiens
uuggaagaaauaucc

SEQ ID NO: 1172303 - RNA, 19 nt, Homo sapiens
uuggaagggaaacuuucaa

SEQ ID NO: 1172304 - RNA, 23 nt, Homo sapiens
uuggaagugcagaggcagacagg

SEQ ID NO: 1172305 - RNA, 14 nt, Homo sapiens
uuggaauacuaaaa

SEQ ID NO: 1172306 - RNA, 15 nt, Homo sapiens
uuggaaugcacacag

SEQ ID NO: 1172307 - RNA, 13 nt, Homo sapiens
uuggaaugcacag

SEQ ID NO: 1172308 - RNA, 13 nt, Homo sapiens
uuggacacugugc

SEQ ID NO: 1172309 - RNA, 16 nt, Homo sapiens
uuggacagaagcagcu

SEQ ID NO: 1172310 - RNA, 18 nt, Homo sapiens
uuggacuaugcauguguu

SEQ ID NO: 1172311 - RNA, 12 nt, Homo sapiens
uuggacuggaaa

SEQ ID NO: 1172312 - RNA, 19 nt, Homo sapiens
uuggagaagcucaucagaa

SEQ ID NO: 1172313 - RNA, 19 nt, Homo sapiens
uuggagacccgccuggcua

SEQ ID NO: 1172314 - RNA, 13 nt, Homo sapiens
uuggagcauuuau

SEQ ID NO: 1172315 - RNA, 14 nt, Homo sapiens
uuggaggcaaagga

SEQ ID NO: 1172316 - RNA, 20 nt, Homo sapiens
uuggaggcucucuugugcau

SEQ ID NO: 1172317 - RNA, 17 nt, Homo sapiens
uuggagggaucauuuuc

SEQ ID NO: 1172318 - RNA, 23 nt, Homo sapiens
uuggagggguauuuuugcccuga

SEQ ID NO: 1172319 - RNA, 18 nt, Homo sapiens
uuggagguaaauuauguc

SEQ ID NO: 1172320 - RNA, 23 nt, Homo sapiens
uuggaggugggagcuucccacac

SEQ ID NO: 1172321 - RNA, 12 nt, Homo sapiens
uuggagugagau

SEQ ID NO: 1172322 - RNA, 18 nt, Homo sapiens
uuggauaucauacuucca

SEQ ID NO: 1172323 - RNA, 20 nt, Homo sapiens
uuggaucauacuggugauua

SEQ ID NO: 1172324 - RNA, 19 nt, Homo sapiens
uuggaugcggccauucaag

SEQ ID NO: 1172325 - RNA, 22 nt, Homo sapiens
uuggauucugagagcugugcau

SEQ ID NO: 1172326 - RNA, 13 nt, Homo sapiens
uuggcaaugccau

SEQ ID NO: 1172327 - RNA, 21 nt, Homo sapiens
uuggcacuguuugccauucuc

SEQ ID NO: 1172328 - RNA, 19 nt, Homo sapiens
uuggcagcccugaugacug

SEQ ID NO: 1172329 - RNA, 20 nt, Homo sapiens
uuggcaucgaccacaccagc

SEQ ID NO: 1172330 - RNA, 15 nt, Homo sapiens
uuggcaucugcaaag

SEQ ID NO: 1172331 - RNA, 14 nt, Homo sapiens
uuggccggcugugc

SEQ ID NO: 1172332 - RNA, 17 nt, Homo sapiens
uuggccuucagaaccau

SEQ ID NO: 1172333 - RNA, 20 nt, Homo sapiens
uuggcgcaccaagaucucca

SEQ ID NO: 1172334 - RNA, 18 nt, Homo sapiens
uuggcuuguuuggagcau

SEQ ID NO: 1172335 - RNA, 16 nt, Homo sapiens
uuggcuuucauguuau

SEQ ID NO: 1172336 - RNA, 22 nt, Homo sapiens
uugggacccugcuuuagagcua

SEQ ID NO: 1172337 - RNA, 17 nt, Homo sapiens
uugggcaccucucuggg

SEQ ID NO: 1172338 - RNA, 19 nt, Homo sapiens
uugggccuaaaacaguauu

SEQ ID NO: 1172339 - RNA, 19 nt, Homo sapiens
uugggcucagagaguacac

SEQ ID NO: 1172340 - RNA, 19 nt, Homo sapiens
uuggggaauuaaaagucau

SEQ ID NO: 1172341 - RNA, 14 nt, Homo sapiens
uuggggacaggggc

SEQ ID NO: 1172342 - RNA, 16 nt, Homo sapiens
uuggggcccagugcau

SEQ ID NO: 1172343 - RNA, 19 nt, Homo sapiens
uugguaaaaugcaucaaaa

SEQ ID NO: 1172344 - RNA, 15 nt, Homo sapiens
uugguaaauggcaaa

SEQ ID NO: 1172345 - RNA, 16 nt, Homo sapiens
uugguaccuauuugac

SEQ ID NO: 1172346 - RNA, 20 nt, Homo sapiens
uugguauucaccgugccuga

SEQ ID NO: 1172347 - RNA, 16 nt, Homo sapiens
uugguccaagauuccg

SEQ ID NO: 1172348 - RNA, 21 nt, Homo sapiens
uuggucucccaauacaggcau

SEQ ID NO: 1172349 - RNA, 16 nt, Homo sapiens
uuggucuuuucuugcc

SEQ ID NO: 1172350 - RNA, 15 nt, Homo sapiens
uuggugauucugaau

SEQ ID NO: 1172351 - RNA, 13 nt, Homo sapiens
uuggugcucuugc

SEQ ID NO: 1172352 - RNA, 18 nt, Homo sapiens
uugguguaguugaacuga

SEQ ID NO: 1172353 - RNA, 22 nt, Homo sapiens
uugguguggguucauuggcauu

SEQ ID NO: 1172354 - RNA, 22 nt, Homo sapiens
uugguucucauaacucugugau

SEQ ID NO: 1172355 - RNA, 18 nt, Homo sapiens
uugguuuuggggguguga

SEQ ID NO: 1172356 - RNA, 20 nt, Homo sapiens
uuguaaaacaaaauuugacu

SEQ ID NO: 1172357 - RNA, 17 nt, Homo sapiens
uuguaaacagaagcaac

SEQ ID NO: 1172358 - RNA, 20 nt, Homo sapiens
uuguaaagugaagaauccuu

SEQ ID NO: 1172359 - RNA, 20 nt, Homo sapiens
uuguaaauacacauagcaug

SEQ ID NO: 1172360 - RNA, 15 nt, Homo sapiens
uuguaaauaggauuu

SEQ ID NO: 1172361 - RNA, 15 nt, Homo sapiens
uuguaaaugcuauua

SEQ ID NO: 1172362 - RNA, 13 nt, Homo sapiens
uuguaacuccacc

SEQ ID NO: 1172363 - RNA, 22 nt, Homo sapiens
uuguaagaaauauauuugauaa

SEQ ID NO: 1172364 - RNA, 14 nt, Homo sapiens
uuguaagacauuuc

SEQ ID NO: 1172365 - RNA, 18 nt, Homo sapiens
uuguaaggcuuugauuag

SEQ ID NO: 1172366 - RNA, 23 nt, Homo sapiens
uuguaauaaaaugguacauuucu

SEQ ID NO: 1172367 - RNA, 14 nt, Homo sapiens
uuguaauuaaggaa

SEQ ID NO: 1172368 - RNA, 21 nt, Homo sapiens
uuguacauagugaggagcuuu

SEQ ID NO: 1172369 - RNA, 17 nt, Homo sapiens
uuguacccuggcuacaa

SEQ ID NO: 1172370 - RNA, 16 nt, Homo sapiens
uuguagcagaaaggaa

SEQ ID NO: 1172371 - RNA, 23 nt, Homo sapiens
uuguauaguguugauuugugcug

SEQ ID NO: 1172372 - RNA, 22 nt, Homo sapiens
uuguauccucugaccuacauac

SEQ ID NO: 1172373 - RNA, 13 nt, Homo sapiens
uuguaugugcaua

SEQ ID NO: 1172374 - RNA, 22 nt, Homo sapiens
uuguauuuaauacacaaugcau

SEQ ID NO: 1172375 - RNA, 14 nt, Homo sapiens
uuguauuuggacua

SEQ ID NO: 1172376 - RNA, 17 nt, Homo sapiens
uuguauuuugugaugaa

SEQ ID NO: 1172377 - RNA, 13 nt, Homo sapiens
uugucaaacugua

SEQ ID NO: 1172378 - RNA, 16 nt, Homo sapiens
uugucauauacugcuu

SEQ ID NO: 1172379 - RNA, 21 nt, Homo sapiens
uuguccaggcuggagugcaau

SEQ ID NO: 1172380 - RNA, 22 nt, Homo sapiens
uuguccaggcuggagugcaaug

SEQ ID NO: 1172381 - RNA, 17 nt, Homo sapiens
uugucccacucaagcca

SEQ ID NO: 1172382 - RNA, 14 nt, Homo sapiens
uuguccccaugcaa

SEQ ID NO: 1172383 - RNA, 15 nt, Homo sapiens
uugucccguggcauu

SEQ ID NO: 1172384 - RNA, 18 nt, Homo sapiens
uugucccuaugcauauca

SEQ ID NO: 1172385 - RNA, 20 nt, Homo sapiens
uuguccuguuuucuacaggu

SEQ ID NO: 1172386 - RNA, 23 nt, Homo sapiens
uugucuaauuaaaacacuuucaa

SEQ ID NO: 1172387 - RNA, 13 nt, Homo sapiens
uugucuacacucu

SEQ ID NO: 1172388 - RNA, 13 nt, Homo sapiens
uugucugcaaugg

SEQ ID NO: 1172389 - RNA, 23 nt, Homo sapiens
uugucuguaaaaaauguaugcua

SEQ ID NO: 1172390 - RNA, 16 nt, Homo sapiens
uugucuuuuacuacaa

SEQ ID NO: 1172391 - RNA, 16 nt, Homo sapiens
uugugaaggccaugau

SEQ ID NO: 1172392 - RNA, 19 nt, Homo sapiens
uugugaauagaacucugaa

SEQ ID NO: 1172393 - RNA, 16 nt, Homo sapiens
uugugauaauucucag

SEQ ID NO: 1172394 - RNA, 22 nt, Homo sapiens
uugugauucaaacuucugugua

SEQ ID NO: 1172395 - RNA, 15 nt, Homo sapiens
uugugccaaacuaua

SEQ ID NO: 1172396 - RNA, 17 nt, Homo sapiens
uugugccacugcucucc

SEQ ID NO: 1172397 - RNA, 18 nt, Homo sapiens
uuguggaggcagugucau

SEQ ID NO: 1172398 - RNA, 15 nt, Homo sapiens
uugugucuguacacg

SEQ ID NO: 1172399 - RNA, 21 nt, Homo sapiens
uugugugugaugugaagccaa

SEQ ID NO: 1172400 - RNA, 15 nt, Homo sapiens
uuguguucaccagag

SEQ ID NO: 1172401 - RNA, 20 nt, Homo sapiens
uuguuaauaaaauagucacu

SEQ ID NO: 1172402 - RNA, 12 nt, Homo sapiens
uuguuauaccau

SEQ ID NO: 1172403 - RNA, 14 nt, Homo sapiens
uuguucacacuccu

SEQ ID NO: 1172404 - RNA, 22 nt, Homo sapiens
uuguucaggccaucgacaugua

SEQ ID NO: 1172405 - RNA, 20 nt, Homo sapiens
uuguucagggcuuuucuuaa

SEQ ID NO: 1172406 - RNA, 16 nt, Homo sapiens
uuguuccagagcugcu

SEQ ID NO: 1172407 - RNA, 13 nt, Homo sapiens
uuguuccugcuuu

SEQ ID NO: 1172408 - RNA, 12 nt, Homo sapiens
uuguucuacucu

SEQ ID NO: 1172409 - RNA, 22 nt, Homo sapiens
uuguucuccuaaugcucugaaa

SEQ ID NO: 1172410 - RNA, 20 nt, Homo sapiens
uuguugccuucaucuucacu

SEQ ID NO: 1172411 - RNA, 12 nt, Homo sapiens
uuguugcugcug

SEQ ID NO: 1172412 - RNA, 15 nt, Homo sapiens
uuguuggaugaaauu

SEQ ID NO: 1172413 - RNA, 13 nt, Homo sapiens
uuguuguuugcca

SEQ ID NO: 1172414 - RNA, 14 nt, Homo sapiens
uuguuuaccagaga

SEQ ID NO: 1172415 - RNA, 12 nt, Homo sapiens
uuguuuacuuaa

SEQ ID NO: 1172416 - RNA, 20 nt, Homo sapiens
uuguuucucccuccaggcca

SEQ ID NO: 1172417 - RNA, 15 nt, Homo sapiens
uuguuucuuuucaca

SEQ ID NO: 1172418 - RNA, 12 nt, Homo sapiens
uuguuugcuuau

SEQ ID NO: 1172419 - RNA, 17 nt, Homo sapiens
uuguuugcuuauacuuc

SEQ ID NO: 1172420 - RNA, 21 nt, Homo sapiens
uuguuuuaaaaagcaucagag

SEQ ID NO: 1172421 - RNA, 19 nt, Homo sapiens
uuguuuugaagcuguugcu

SEQ ID NO: 1172422 - RNA, 16 nt, Homo sapiens
uuguuuuuuaagguga

SEQ ID NO: 1172423 - RNA, 20 nt, Homo sapiens
uuguuuuuuagcagugcuga

SEQ ID NO: 1172424 - RNA, 23 nt, Homo sapiens
uuuaaaaaaaaaaaaaaagccaa

SEQ ID NO: 1172425 - RNA, 18 nt, Homo sapiens
uuuaaaaaaaacaauucc

SEQ ID NO: 1172426 - RNA, 20 nt, Homo sapiens
uuuaaaaaaacucccauuaa

SEQ ID NO: 1172427 - RNA, 22 nt, Homo sapiens
uuuaaaaagaaaaucaguugau

SEQ ID NO: 1172428 - RNA, 13 nt, Homo sapiens
uuuaaaacacaug

SEQ ID NO: 1172429 - RNA, 14 nt, Homo sapiens
uuuaaaacauguaa

SEQ ID NO: 1172430 - RNA, 15 nt, Homo sapiens
uuuaaaauaaauucc

SEQ ID NO: 1172431 - RNA, 18 nt, Homo sapiens
uuuaaaauccccaugccu

SEQ ID NO: 1172432 - RNA, 17 nt, Homo sapiens
uuuaaagaaagcaacuu

SEQ ID NO: 1172433 - RNA, 17 nt, Homo sapiens
uuuaaagaagugcauga

SEQ ID NO: 1172434 - RNA, 11 nt, Homo sapiens
uuuaaagacag

SEQ ID NO: 1172435 - RNA, 19 nt, Homo sapiens
uuuaaagacagggucuugc

SEQ ID NO: 1172436 - RNA, 15 nt, Homo sapiens
uuuaaagcuuugaau

SEQ ID NO: 1172437 - RNA, 22 nt, Homo sapiens
uuuaaagugacauaauuuacau

SEQ ID NO: 1172438 - RNA, 16 nt, Homo sapiens
uuuaaagugcucuuau

SEQ ID NO: 1172439 - RNA, 22 nt, Homo sapiens
uuuaaaucaacgaguacuucaa

SEQ ID NO: 1172440 - RNA, 16 nt, Homo sapiens
uuuaacauuuaucuaa

SEQ ID NO: 1172441 - RNA, 18 nt, Homo sapiens
uuuaacccuaaucuuuca

SEQ ID NO: 1172442 - RNA, 14 nt, Homo sapiens
uuuaacguuuucau

SEQ ID NO: 1172443 - RNA, 18 nt, Homo sapiens
uuuaacuauucauaagau

SEQ ID NO: 1172444 - RNA, 19 nt, Homo sapiens
uuuaacuuaagggagaaaa

SEQ ID NO: 1172445 - RNA, 19 nt, Homo sapiens
uuuaacuuauuuauaugaa

SEQ ID NO: 1172446 - RNA, 23 nt, Homo sapiens
uuuaagacucucgcaucuuccca

SEQ ID NO: 1172447 - RNA, 20 nt, Homo sapiens
uuuaagacuuaguuauuucu

SEQ ID NO: 1172448 - RNA, 22 nt, Homo sapiens
uuuaagaggcuuuggcccaaug

SEQ ID NO: 1172449 - RNA, 20 nt, Homo sapiens
uuuaagcaaauaaacuguaa

SEQ ID NO: 1172450 - RNA, 14 nt, Homo sapiens
uuuaagcagcucua

SEQ ID NO: 1172451 - RNA, 15 nt, Homo sapiens
uuuaaggauguugcc

SEQ ID NO: 1172452 - RNA, 17 nt, Homo sapiens
uuuaaggugaguucuca

SEQ ID NO: 1172453 - RNA, 18 nt, Homo sapiens
uuuaaggugaguucucac

SEQ ID NO: 1172454 - RNA, 14 nt, Homo sapiens
uuuaaggugcuaaa

SEQ ID NO: 1172455 - RNA, 13 nt, Homo sapiens
uuuaagucuucca

SEQ ID NO: 1172456 - RNA, 13 nt, Homo sapiens
uuuaaucccagca

SEQ ID NO: 1172457 - RNA, 16 nt, Homo sapiens
uuuaauggacacuuuu

SEQ ID NO: 1172458 - RNA, 18 nt, Homo sapiens
uuuaaugugcuguguaaa

SEQ ID NO: 1172459 - RNA, 19 nt, Homo sapiens
uuuaauugacagucacuca

SEQ ID NO: 1172460 - RNA, 13 nt, Homo sapiens
uuuacacacauga

SEQ ID NO: 1172461 - RNA, 21 nt, Homo sapiens
uuuacacagaaacacugccuu

SEQ ID NO: 1172462 - RNA, 23 nt, Homo sapiens
uuuacagaaucaaaugcaauuuu

SEQ ID NO: 1172463 - RNA, 20 nt, Homo sapiens
uuuacaggaaagaugcauuu

SEQ ID NO: 1172464 - RNA, 18 nt, Homo sapiens
uuuacagucaaucuauga

SEQ ID NO: 1172465 - RNA, 19 nt, Homo sapiens
uuuacaucaucagaugauc

SEQ ID NO: 1172466 - RNA, 11 nt, Homo sapiens
uuuacauuuaa

SEQ ID NO: 1172467 - RNA, 23 nt, Homo sapiens
uuuacccauuaaauuaagacuug

SEQ ID NO: 1172468 - RNA, 21 nt, Homo sapiens
uuuacgaucuguuuccaaauc

SEQ ID NO: 1172469 - RNA, 22 nt, Homo sapiens
uuuacguuaaaauuacuuugaa

SEQ ID NO: 1172470 - RNA, 14 nt, Homo sapiens
uuuagaaacacaag

SEQ ID NO: 1172471 - RNA, 23 nt, Homo sapiens
uuuagaaaucacaacaaacugaa

SEQ ID NO: 1172472 - RNA, 15 nt, Homo sapiens
uuuagaagugucaug

SEQ ID NO: 1172473 - RNA, 18 nt, Homo sapiens
uuuagacccugcauuuau

SEQ ID NO: 1172474 - RNA, 21 nt, Homo sapiens
uuuagacuuauguggaacugu

SEQ ID NO: 1172475 - RNA, 14 nt, Homo sapiens
uuuagagcauuaaa

SEQ ID NO: 1172476 - RNA, 17 nt, Homo sapiens
uuuagcagagacuuuag

SEQ ID NO: 1172477 - RNA, 19 nt, Homo sapiens
uuuagcgugcucacugacc

SEQ ID NO: 1172478 - RNA, 22 nt, Homo sapiens
uuuagguacugaagauuaucac

SEQ ID NO: 1172479 - RNA, 14 nt, Homo sapiens
uuuaguaaauguua

SEQ ID NO: 1172480 - RNA, 13 nt, Homo sapiens
uuuagucugugua

SEQ ID NO: 1172481 - RNA, 14 nt, Homo sapiens
uuuaguuauaucac

SEQ ID NO: 1172482 - RNA, 17 nt, Homo sapiens
uuuaguucuuacugcuu

SEQ ID NO: 1172483 - RNA, 14 nt, Homo sapiens
uuuauaaugccauu

SEQ ID NO: 1172484 - RNA, 18 nt, Homo sapiens
uuuauagaugucaggaaa

SEQ ID NO: 1172485 - RNA, 16 nt, Homo sapiens
uuuauauaauaucuaa

SEQ ID NO: 1172486 - RNA, 20 nt, Homo sapiens
uuuaucaaacacacuuccag

SEQ ID NO: 1172487 - RNA, 17 nt, Homo sapiens
uuuaucaauaaagcacu

SEQ ID NO: 1172488 - RNA, 13 nt, Homo sapiens
uuuaucaccucau

SEQ ID NO: 1172489 - RNA, 22 nt, Homo sapiens
uuuaucuguugucuagagcuca

SEQ ID NO: 1172490 - RNA, 22 nt, Homo sapiens
uuuaugagacccauuccuauuu

SEQ ID NO: 1172491 - RNA, 22 nt, Homo sapiens
uuuaugucucagaccacuauuc

SEQ ID NO: 1172492 - RNA, 17 nt, Homo sapiens
uuuauuaugcaaccagu

SEQ ID NO: 1172493 - RNA, 17 nt, Homo sapiens
uuuauuguuuucaacuc

SEQ ID NO: 1172494 - RNA, 15 nt, Homo sapiens
uuuauuucugauaag

SEQ ID NO: 1172495 - RNA, 14 nt, Homo sapiens
uuuauuuugugcua

SEQ ID NO: 1172496 - RNA, 17 nt, Homo sapiens
uuuauuuuugagacaga

SEQ ID NO: 1172497 - RNA, 17 nt, Homo sapiens
uuucaaaauccaaaaag

SEQ ID NO: 1172498 - RNA, 15 nt, Homo sapiens
uuucaaagacugcca

SEQ ID NO: 1172499 - RNA, 18 nt, Homo sapiens
uuucaaccagcacauucg

SEQ ID NO: 1172500 - RNA, 16 nt, Homo sapiens
uuucaacugcagugua

SEQ ID NO: 1172501 - RNA, 18 nt, Homo sapiens
uuucaagaaaacuggaaa

SEQ ID NO: 1172502 - RNA, 21 nt, Homo sapiens
uuucaagacuugauacugcaa

SEQ ID NO: 1172503 - RNA, 22 nt, Homo sapiens
uuucaaggcacucuagauucca

SEQ ID NO: 1172504 - RNA, 16 nt, Homo sapiens
uuucacauucuuggcu

SEQ ID NO: 1172505 - RNA, 13 nt, Homo sapiens
uuucaccauuuga

SEQ ID NO: 1172506 - RNA, 13 nt, Homo sapiens
uuucacugccaua

SEQ ID NO: 1172507 - RNA, 20 nt, Homo sapiens
uuucagcaacaaccaucuca

SEQ ID NO: 1172508 - RNA, 17 nt, Homo sapiens
uuucagcgauguaugca

SEQ ID NO: 1172509 - RNA, 15 nt, Homo sapiens
uuucaggaaucagaa

SEQ ID NO: 1172510 - RNA, 19 nt, Homo sapiens
uuucagguuccaaucagaa

SEQ ID NO: 1172511 - RNA, 23 nt, Homo sapiens
uuucaguacuucagcaagagaga

SEQ ID NO: 1172512 - RNA, 18 nt, Homo sapiens
uuucagugccauacaugu

SEQ ID NO: 1172513 - RNA, 15 nt, Homo sapiens
uuucaucacacuggg

SEQ ID NO: 1172514 - RNA, 23 nt, Homo sapiens
uuucaucaggcucuguuccucaa

SEQ ID NO: 1172515 - RNA, 23 nt, Homo sapiens
uuucauccuguuggcugcugcca

SEQ ID NO: 1172516 - RNA, 22 nt, Homo sapiens
uuucaucucuuucuacucuccu

SEQ ID NO: 1172517 - RNA, 12 nt, Homo sapiens
uuucauugcaaa

SEQ ID NO: 1172518 - RNA, 21 nt, Homo sapiens
uuucauugcucagaaauguca

SEQ ID NO: 1172519 - RNA, 12 nt, Homo sapiens
uuucauuugcca

SEQ ID NO: 1172520 - RNA, 16 nt, Homo sapiens
uuucauuuuuaggaau

SEQ ID NO: 1172521 - RNA, 18 nt, Homo sapiens
uuucauuuuuccaugaca

SEQ ID NO: 1172522 - RNA, 21 nt, Homo sapiens
uuuccaaaccuccacugcugc

SEQ ID NO: 1172523 - RNA, 11 nt, Homo sapiens
uuuccaaagag

SEQ ID NO: 1172524 - RNA, 19 nt, Homo sapiens
uuuccaaaucccuuucaug

SEQ ID NO: 1172525 - RNA, 14 nt, Homo sapiens
uuuccaaccggcuu

SEQ ID NO: 1172526 - RNA, 15 nt, Homo sapiens
uuuccacuacugcua

SEQ ID NO: 1172527 - RNA, 20 nt, Homo sapiens
uuuccacugugcuauuacaa

SEQ ID NO: 1172528 - RNA, 16 nt, Homo sapiens
uuuccagauaagugua

SEQ ID NO: 1172529 - RNA, 17 nt, Homo sapiens
uuuccaguccccagaag

SEQ ID NO: 1172530 - RNA, 23 nt, Homo sapiens
uuuccaguuaaaauauugcugua

SEQ ID NO: 1172531 - RNA, 23 nt, Homo sapiens
uuuccaucagacugaacuuacac

SEQ ID NO: 1172532 - RNA, 15 nt, Homo sapiens
uuucccaaugguguu

SEQ ID NO: 1172533 - RNA, 17 nt, Homo sapiens
uuucccacgaggaaucu

SEQ ID NO: 1172534 - RNA, 20 nt, Homo sapiens
uuucccauuuguugcugcug

SEQ ID NO: 1172535 - RNA, 18 nt, Homo sapiens
uuucccuuuuugcuucca

SEQ ID NO: 1172536 - RNA, 15 nt, Homo sapiens
uuuccuaaaagugua

SEQ ID NO: 1172537 - RNA, 12 nt, Homo sapiens
uuuccugccucc

SEQ ID NO: 1172538 - RNA, 12 nt, Homo sapiens
uuuccuguguau

SEQ ID NO: 1172539 - RNA, 22 nt, Homo sapiens
uuuccugugucaauccagaugg

SEQ ID NO: 1172540 - RNA, 15 nt, Homo sapiens
uuuccuucagugcau

SEQ ID NO: 1172541 - RNA, 22 nt, Homo sapiens
uuuccuuugucauuuccuuugu

SEQ ID NO: 1172542 - RNA, 17 nt, Homo sapiens
uuuccuuuuaauucuac

SEQ ID NO: 1172543 - RNA, 17 nt, Homo sapiens
uuuccuuuucugucucu

SEQ ID NO: 1172544 - RNA, 22 nt, Homo sapiens
uuucuaaaccuugugauucugc

SEQ ID NO: 1172545 - RNA, 18 nt, Homo sapiens
uuucuaaaggaugcugcu

SEQ ID NO: 1172546 - RNA, 19 nt, Homo sapiens
uuucuaaccaaagagucuc

SEQ ID NO: 1172547 - RNA, 18 nt, Homo sapiens
uuucuaacuccagugaag

SEQ ID NO: 1172548 - RNA, 19 nt, Homo sapiens
uuucuacuagccauuggga

SEQ ID NO: 1172549 - RNA, 22 nt, Homo sapiens
uuucuacuuugaagucauacca

SEQ ID NO: 1172550 - RNA, 15 nt, Homo sapiens
uuucuagagcacugc

SEQ ID NO: 1172551 - RNA, 15 nt, Homo sapiens
uuucuagaugacaua

SEQ ID NO: 1172552 - RNA, 17 nt, Homo sapiens
uuucuagccuuaguucc

SEQ ID NO: 1172553 - RNA, 21 nt, Homo sapiens
uuucuagggcugggaaacacu

SEQ ID NO: 1172554 - RNA, 18 nt, Homo sapiens
uuucuaguuuuauacaaa

SEQ ID NO: 1172555 - RNA, 16 nt, Homo sapiens
uuucucaacuaccucg

SEQ ID NO: 1172556 - RNA, 19 nt, Homo sapiens
uuucucagauggauugaua

SEQ ID NO: 1172557 - RNA, 18 nt, Homo sapiens
uuucucauaaauuucucu

SEQ ID NO: 1172558 - RNA, 20 nt, Homo sapiens
uuucuccagaacccauuuga

SEQ ID NO: 1172559 - RNA, 22 nt, Homo sapiens
uuucuccccaaugagacuugcc

SEQ ID NO: 1172560 - RNA, 22 nt, Homo sapiens
uuucucuaccuucaagaaccag

SEQ ID NO: 1172561 - RNA, 19 nt, Homo sapiens
uuucucuggacacugggga

SEQ ID NO: 1172562 - RNA, 19 nt, Homo sapiens
uuucuggaaaguagaucuu

SEQ ID NO: 1172563 - RNA, 17 nt, Homo sapiens
uuucuggaccuugagca

SEQ ID NO: 1172564 - RNA, 21 nt, Homo sapiens
uuucuggggaaagacacugcc

SEQ ID NO: 1172565 - RNA, 23 nt, Homo sapiens
uuucuggggaaagacacugccug

SEQ ID NO: 1172566 - RNA, 22 nt, Homo sapiens
uuucugggggaaaaagccauau

SEQ ID NO: 1172567 - RNA, 12 nt, Homo sapiens
uuucugugaaua

SEQ ID NO: 1172568 - RNA, 13 nt, Homo sapiens
uuucugugcaugg

SEQ ID NO: 1172569 - RNA, 13 nt, Homo sapiens
uuucugugucauu

SEQ ID NO: 1172570 - RNA, 14 nt, Homo sapiens
uuucuguucaccuu

SEQ ID NO: 1172571 - RNA, 17 nt, Homo sapiens
uuucuuaauuuguaacu

SEQ ID NO: 1172572 - RNA, 20 nt, Homo sapiens
uuucuuauccuagcacaugc

SEQ ID NO: 1172573 - RNA, 16 nt, Homo sapiens
uuucuucagggcugcu

SEQ ID NO: 1172574 - RNA, 13 nt, Homo sapiens
uuucuuccaggau

SEQ ID NO: 1172575 - RNA, 13 nt, Homo sapiens
uuucuuccaugau

SEQ ID NO: 1172576 - RNA, 16 nt, Homo sapiens
uuucuuccauucccau

SEQ ID NO: 1172577 - RNA, 18 nt, Homo sapiens
uuucuucucgccuaggau

SEQ ID NO: 1172578 - RNA, 11 nt, Homo sapiens
uuucuuugauu

SEQ ID NO: 1172579 - RNA, 14 nt, Homo sapiens
uuucuuuucacaua

SEQ ID NO: 1172580 - RNA, 17 nt, Homo sapiens
uuucuuuuuuauacuca

SEQ ID NO: 1172581 - RNA, 18 nt, Homo sapiens
uuucuuuuuuauacucaa

SEQ ID NO: 1172582 - RNA, 19 nt, Homo sapiens
uuugaaaaauaacugacaa

SEQ ID NO: 1172583 - RNA, 14 nt, Homo sapiens
uuugaaacuuugaa

SEQ ID NO: 1172584 - RNA, 18 nt, Homo sapiens
uuugaaaugaauuccuca

SEQ ID NO: 1172585 - RNA, 22 nt, Homo sapiens
uuugaaccauaaagggugccag

SEQ ID NO: 1172586 - RNA, 18 nt, Homo sapiens
uuugaacuauauuuacug

SEQ ID NO: 1172587 - RNA, 14 nt, Homo sapiens
uuugaacucaggga

SEQ ID NO: 1172588 - RNA, 17 nt, Homo sapiens
uuugaagcagucuugcu

SEQ ID NO: 1172589 - RNA, 22 nt, Homo sapiens
uuugaagcuacuguguguguga

SEQ ID NO: 1172590 - RNA, 21 nt, Homo sapiens
uuugaauaaagaauacuugaa

SEQ ID NO: 1172591 - RNA, 21 nt, Homo sapiens
uuugaaugcagucuguccagg

SEQ ID NO: 1172592 - RNA, 15 nt, Homo sapiens
uuugaauguaugcuu

SEQ ID NO: 1172593 - RNA, 14 nt, Homo sapiens
uuugacugucagca

SEQ ID NO: 1172594 - RNA, 17 nt, Homo sapiens
uuugacuuguauaacau

SEQ ID NO: 1172595 - RNA, 20 nt, Homo sapiens
uuugacuuucuucugaauau

SEQ ID NO: 1172596 - RNA, 18 nt, Homo sapiens
uuugagacugguugcaua

SEQ ID NO: 1172597 - RNA, 22 nt, Homo sapiens
uuugagguggagucuugcucug

SEQ ID NO: 1172598 - RNA, 15 nt, Homo sapiens
uuugaguuucucuca

SEQ ID NO: 1172599 - RNA, 14 nt, Homo sapiens
uuugauauaacaaa

SEQ ID NO: 1172600 - RNA, 18 nt, Homo sapiens
uuugauccugggggacca

SEQ ID NO: 1172601 - RNA, 19 nt, Homo sapiens
uuugaugugagugccuuga

SEQ ID NO: 1172602 - RNA, 15 nt, Homo sapiens
uuugcaaaguacugu

SEQ ID NO: 1172603 - RNA, 18 nt, Homo sapiens
uuugcaagcauugaauaa

SEQ ID NO: 1172604 - RNA, 11 nt, Homo sapiens
uuugcacugac

SEQ ID NO: 1172605 - RNA, 20 nt, Homo sapiens
uuugccaaauaaaauauauu

SEQ ID NO: 1172606 - RNA, 13 nt, Homo sapiens
uuugcccagagag

SEQ ID NO: 1172607 - RNA, 15 nt, Homo sapiens
uuugcccuucacugu

SEQ ID NO: 1172608 - RNA, 18 nt, Homo sapiens
uuugcccuuuuuaaggaa

SEQ ID NO: 1172609 - RNA, 18 nt, Homo sapiens
uuugccuccagugcaguc

SEQ ID NO: 1172610 - RNA, 22 nt, Homo sapiens
uuugccuguucaguuacagaaa

SEQ ID NO: 1172611 - RNA, 22 nt, Homo sapiens
uuugcuuaccuuguuuugccag

SEQ ID NO: 1172612 - RNA, 19 nt, Homo sapiens
uuugcuucaaaaacauucu

SEQ ID NO: 1172613 - RNA, 14 nt, Homo sapiens
uuuggaaauccaaa

SEQ ID NO: 1172614 - RNA, 15 nt, Homo sapiens
uuuggagguauucaa

SEQ ID NO: 1172615 - RNA, 21 nt, Homo sapiens
uuuggauaucaaaagcaaaua

SEQ ID NO: 1172616 - RNA, 21 nt, Homo sapiens
uuuggcagagcuucuuccagg

SEQ ID NO: 1172617 - RNA, 15 nt, Homo sapiens
uuuggccuccuccag

SEQ ID NO: 1172618 - RNA, 19 nt, Homo sapiens
uuuggcuagguaucauuca

SEQ ID NO: 1172619 - RNA, 18 nt, Homo sapiens
uuuggcuggaauuacaaa

SEQ ID NO: 1172620 - RNA, 12 nt, Homo sapiens
uuugggaggcca

SEQ ID NO: 1172621 - RNA, 13 nt, Homo sapiens
uuugggccagaca

SEQ ID NO: 1172622 - RNA, 14 nt, Homo sapiens
uuugggccagacau

SEQ ID NO: 1172623 - RNA, 23 nt, Homo sapiens
uuuggggaagugaggaagccagg

SEQ ID NO: 1172624 - RNA, 12 nt, Homo sapiens
uuuggguccagu

SEQ ID NO: 1172625 - RNA, 17 nt, Homo sapiens
uuugguuggcagcauuc

SEQ ID NO: 1172626 - RNA, 22 nt, Homo sapiens
uuuguaaaaacaaagugcuaaa

SEQ ID NO: 1172627 - RNA, 20 nt, Homo sapiens
uuuguaggagacuugccaga

SEQ ID NO: 1172628 - RNA, 20 nt, Homo sapiens
uuuguauccucugaccuaca

SEQ ID NO: 1172629 - RNA, 16 nt, Homo sapiens
uuuguaugaaguacuu

SEQ ID NO: 1172630 - RNA, 21 nt, Homo sapiens
uuuguccuguuuucuacaggu

SEQ ID NO: 1172631 - RNA, 19 nt, Homo sapiens
uuugucugcccaauccauc

SEQ ID NO: 1172632 - RNA, 13 nt, Homo sapiens
uuugucuugaaug

SEQ ID NO: 1172633 - RNA, 18 nt, Homo sapiens
uuugugauaacuacuccc

SEQ ID NO: 1172634 - RNA, 17 nt, Homo sapiens
uuugugccaucacugag

SEQ ID NO: 1172635 - RNA, 11 nt, Homo sapiens
uuugugcucua

SEQ ID NO: 1172636 - RNA, 19 nt, Homo sapiens
uuuguggaggcagugucau

SEQ ID NO: 1172637 - RNA, 14 nt, Homo sapiens
uuugugucacugua

SEQ ID NO: 1172638 - RNA, 15 nt, Homo sapiens
uuuguucacacuccu

SEQ ID NO: 1172639 - RNA, 14 nt, Homo sapiens
uuuguucucucuca

SEQ ID NO: 1172640 - RNA, 18 nt, Homo sapiens
uuuguucuugccuagggu

SEQ ID NO: 1172641 - RNA, 16 nt, Homo sapiens
uuuguugagucucuga

SEQ ID NO: 1172642 - RNA, 16 nt, Homo sapiens
uuuguuggucacaugg

SEQ ID NO: 1172643 - RNA, 23 nt, Homo sapiens
uuuguuggucacauggagcucuu

SEQ ID NO: 1172644 - RNA, 12 nt, Homo sapiens
uuuguuuaccag

SEQ ID NO: 1172645 - RNA, 18 nt, Homo sapiens
uuuguuucaucaggacac

SEQ ID NO: 1172646 - RNA, 13 nt, Homo sapiens
uuuguuucucuga

SEQ ID NO: 1172647 - RNA, 20 nt, Homo sapiens
uuuguuuggguuacaguaug

SEQ ID NO: 1172648 - RNA, 21 nt, Homo sapiens
uuuguuuggguuacaguaugc

SEQ ID NO: 1172649 - RNA, 21 nt, Homo sapiens
uuuguuuucccuggcuaacag

SEQ ID NO: 1172650 - RNA, 22 nt, Homo sapiens
uuuuaaacgauuagugaugucc

SEQ ID NO: 1172651 - RNA, 19 nt, Homo sapiens
uuuuaaaguacugguguca

SEQ ID NO: 1172652 - RNA, 14 nt, Homo sapiens
uuuuaaauaggcua

SEQ ID NO: 1172653 - RNA, 23 nt, Homo sapiens
uuuuaaauaggguuguacuaugc

SEQ ID NO: 1172654 - RNA, 22 nt, Homo sapiens
uuuuaaauuaaugaacauaugu

SEQ ID NO: 1172655 - RNA, 17 nt, Homo sapiens
uuuuaacugacguagaa

SEQ ID NO: 1172656 - RNA, 23 nt, Homo sapiens
uuuuaauuuguaaagaaugugcu

SEQ ID NO: 1172657 - RNA, 23 nt, Homo sapiens
uuuuaccaaagugucuuuugaca

SEQ ID NO: 1172658 - RNA, 22 nt, Homo sapiens
uuuuacgaucuguuuccaaauc

SEQ ID NO: 1172659 - RNA, 14 nt, Homo sapiens
uuuuacuacccaaa

SEQ ID NO: 1172660 - RNA, 23 nt, Homo sapiens
uuuuagacaaaaaauagggauga

SEQ ID NO: 1172661 - RNA, 14 nt, Homo sapiens
uuuuagagcauuaa

SEQ ID NO: 1172662 - RNA, 12 nt, Homo sapiens
uuuuagcagaga

SEQ ID NO: 1172663 - RNA, 18 nt, Homo sapiens
uuuuagggagaacgggaa

SEQ ID NO: 1172664 - RNA, 18 nt, Homo sapiens
uuuuaguagagacagggu

SEQ ID NO: 1172665 - RNA, 13 nt, Homo sapiens
uuuuauacaaaga

SEQ ID NO: 1172666 - RNA, 20 nt, Homo sapiens
uuuuauacagugauauacuu

SEQ ID NO: 1172667 - RNA, 22 nt, Homo sapiens
uuuuauauguuuauauucuuuc

SEQ ID NO: 1172668 - RNA, 19 nt, Homo sapiens
uuuuaucaggccaaguuaa

SEQ ID NO: 1172669 - RNA, 18 nt, Homo sapiens
uuuuaucauuaccauuaa

SEQ ID NO: 1172670 - RNA, 15 nt, Homo sapiens
uuuuauccauggguu

SEQ ID NO: 1172671 - RNA, 22 nt, Homo sapiens
uuuuauggacaguaaguccagu

SEQ ID NO: 1172672 - RNA, 17 nt, Homo sapiens
uuuuauuagaaguuuca

SEQ ID NO: 1172673 - RNA, 12 nt, Homo sapiens
uuuuauuaucaa

SEQ ID NO: 1172674 - RNA, 12 nt, Homo sapiens
uuuuauucugaa

SEQ ID NO: 1172675 - RNA, 12 nt, Homo sapiens
uuuuauugauaa

SEQ ID NO: 1172676 - RNA, 18 nt, Homo sapiens
uuuucaaaauccaaaaag

SEQ ID NO: 1172677 - RNA, 17 nt, Homo sapiens
uuuucaaagcaguauag

SEQ ID NO: 1172678 - RNA, 14 nt, Homo sapiens
uuuucaacauugua

SEQ ID NO: 1172679 - RNA, 12 nt, Homo sapiens
uuuucacuugua

SEQ ID NO: 1172680 - RNA, 15 nt, Homo sapiens
uuuucagaccccagc

SEQ ID NO: 1172681 - RNA, 22 nt, Homo sapiens
uuuuccaagugugcauauugua

SEQ ID NO: 1172682 - RNA, 17 nt, Homo sapiens
uuuucccuuugccuuca

SEQ ID NO: 1172683 - RNA, 16 nt, Homo sapiens
uuuuccucuuagauau

SEQ ID NO: 1172684 - RNA, 12 nt, Homo sapiens
uuuucuacuugu

SEQ ID NO: 1172685 - RNA, 16 nt, Homo sapiens
uuuucuccaccuuaaa

SEQ ID NO: 1172686 - RNA, 16 nt, Homo sapiens
uuuucugucacuguag

SEQ ID NO: 1172687 - RNA, 22 nt, Homo sapiens
uuuucuuacuagaccuguaacu

SEQ ID NO: 1172688 - RNA, 19 nt, Homo sapiens
uuuucuucuuuuugcuuca

SEQ ID NO: 1172689 - RNA, 11 nt, Homo sapiens
uuuucuuuaac

SEQ ID NO: 1172690 - RNA, 13 nt, Homo sapiens
uuuugaaaacacu

SEQ ID NO: 1172691 - RNA, 22 nt, Homo sapiens
uuuugaacaaaggaauuuucaa

SEQ ID NO: 1172692 - RNA, 13 nt, Homo sapiens
uuuugaaggcaaa

SEQ ID NO: 1172693 - RNA, 14 nt, Homo sapiens
uuuugaaggcaaaa

SEQ ID NO: 1172694 - RNA, 13 nt, Homo sapiens
uuuugagaacaaa

SEQ ID NO: 1172695 - RNA, 14 nt, Homo sapiens
uuuugagaguauau

SEQ ID NO: 1172696 - RNA, 17 nt, Homo sapiens
uuuugauuaguauaaua

SEQ ID NO: 1172697 - RNA, 21 nt, Homo sapiens
uuuugauuguuuuaacaguua

SEQ ID NO: 1172698 - RNA, 14 nt, Homo sapiens
uuuugcacauucua

SEQ ID NO: 1172699 - RNA, 22 nt, Homo sapiens
uuuugcauuugaauaaagccug

SEQ ID NO: 1172700 - RNA, 22 nt, Homo sapiens
uuuugcccuugacaaagucaag

SEQ ID NO: 1172701 - RNA, 18 nt, Homo sapiens
uuuuggaauugguguaua

SEQ ID NO: 1172702 - RNA, 18 nt, Homo sapiens
uuuugguugccaugguca

SEQ ID NO: 1172703 - RNA, 17 nt, Homo sapiens
uuuuguaaauguacugg

SEQ ID NO: 1172704 - RNA, 16 nt, Homo sapiens
uuuugucaacauugug

SEQ ID NO: 1172705 - RNA, 15 nt, Homo sapiens
uuuugugaagcccug

SEQ ID NO: 1172706 - RNA, 16 nt, Homo sapiens
uuuuguucuuguugua

SEQ ID NO: 1172707 - RNA, 12 nt, Homo sapiens
uuuuuaaucucc

SEQ ID NO: 1172708 - RNA, 17 nt, Homo sapiens
uuuuuaauuuaguguga

SEQ ID NO: 1172709 - RNA, 16 nt, Homo sapiens
uuuuuacagcacacac

SEQ ID NO: 1172710 - RNA, 14 nt, Homo sapiens
uuuuuacucccuga

SEQ ID NO: 1172711 - RNA, 13 nt, Homo sapiens
uuuuuauaauauc

SEQ ID NO: 1172712 - RNA, 14 nt, Homo sapiens
uuuuucaacuugga

SEQ ID NO: 1172713 - RNA, 13 nt, Homo sapiens
uuuuucauuguau

SEQ ID NO: 1172714 - RNA, 16 nt, Homo sapiens
uuuuuccccauuguau

SEQ ID NO: 1172715 - RNA, 14 nt, Homo sapiens
uuuuucugccuugg

SEQ ID NO: 1172716 - RNA, 14 nt, Homo sapiens
uuuuugaaagucag

SEQ ID NO: 1172717 - RNA, 21 nt, Homo sapiens
uuuuugaaaucagcauacuca

SEQ ID NO: 1172718 - RNA, 20 nt, Homo sapiens
uuuuugaaauuuaagcuaag

SEQ ID NO: 1172719 - RNA, 13 nt, Homo sapiens
uuuuugacauuua

SEQ ID NO: 1172720 - RNA, 22 nt, Homo sapiens
uuuuugcccagaaaguccagcu

SEQ ID NO: 1172721 - RNA, 11 nt, Homo sapiens
uuuuugcccau

SEQ ID NO: 1172722 - RNA, 18 nt, Homo sapiens
uuuuuggcauuccaccuc

SEQ ID NO: 1172723 - RNA, 18 nt, Homo sapiens
uuuuuguuaaucauagca

SEQ ID NO: 1172724 - RNA, 19 nt, Homo sapiens
uuuuuguuaucagucaaua

SEQ ID NO: 1172725 - RNA, 17 nt, Homo sapiens
uuuuuguuucacuggaa

SEQ ID NO: 1172726 - RNA, 21 nt, Homo sapiens
gacauagcugugcuaugaggu

SEQ ID NO: 1172727 - RNA, 22 nt, Homo sapiens
gacauaucaucuguggacugac

SEQ ID NO: 1172728 - RNA, 16 nt, Homo sapiens
gacaugagaaagggag

SEQ ID NO: 1172729 - RNA, 19 nt, Homo sapiens
gacaugcuucagugcugcu

SEQ ID NO: 1172730 - RNA, 19 nt, Homo sapiens
gacaugguggcaugcaccu

SEQ ID NO: 1172731 - RNA, 14 nt, Homo sapiens
gacauuacagauga

SEQ ID NO: 1172732 - RNA, 21 nt, Homo sapiens
gacauuccaagacaguauaca

SEQ ID NO: 1172733 - RNA, 19 nt, Homo sapiens
gacauuggcaccuaaucca

SEQ ID NO: 1172734 - RNA, 15 nt, Homo sapiens
gacauuuaucaggca

SEQ ID NO: 1172735 - RNA, 15 nt, Homo sapiens
gacauuuguuuuuca

SEQ ID NO: 1172736 - RNA, 19 nt, Homo sapiens
gacauuuugugacugaaga

SEQ ID NO: 1172737 - RNA, 21 nt, Homo sapiens
gaccaaacccuuagcagccca

SEQ ID NO: 1172738 - RNA, 22 nt, Homo sapiens
gaccaaggcgggcggaucacuu

SEQ ID NO: 1172739 - RNA, 23 nt, Homo sapiens
gaccaaggcgggcggaucacuua

SEQ ID NO: 1172740 - RNA, 15 nt, Homo sapiens
gaccacucaauccau

SEQ ID NO: 1172741 - RNA, 20 nt, Homo sapiens
gaccacucuuccugaguuca

SEQ ID NO: 1172742 - RNA, 22 nt, Homo sapiens
gaccacugggccccucagggga

SEQ ID NO: 1172743 - RNA, 17 nt, Homo sapiens
gaccagaagcauuucac

SEQ ID NO: 1172744 - RNA, 14 nt, Homo sapiens
gaccagacaauguu

SEQ ID NO: 1172745 - RNA, 17 nt, Homo sapiens
gaccagccugagcaaca

SEQ ID NO: 1172746 - RNA, 17 nt, Homo sapiens
gaccaggauuugcacag

SEQ ID NO: 1172747 - RNA, 14 nt, Homo sapiens
gaccaggggaccag

SEQ ID NO: 1172748 - RNA, 15 nt, Homo sapiens
gaccagucugacccu

SEQ ID NO: 1172749 - RNA, 14 nt, Homo sapiens
gaccauaaccacug

SEQ ID NO: 1172750 - RNA, 13 nt, Homo sapiens
gaccaucccggcc

SEQ ID NO: 1172751 - RNA, 16 nt, Homo sapiens
gaccauccuauuuaac

SEQ ID NO: 1172752 - RNA, 18 nt, Homo sapiens
gacccaaacauaugcaca

SEQ ID NO: 1172753 - RNA, 23 nt, Homo sapiens
gacccagaggguggguguucaua

SEQ ID NO: 1172754 - RNA, 19 nt, Homo sapiens
gaccccagaggauugcugc

SEQ ID NO: 1172755 - RNA, 20 nt, Homo sapiens
gaccccagcugccaaggaaa

SEQ ID NO: 1172756 - RNA, 22 nt, Homo sapiens
gacccccgcccccugcccuccc

SEQ ID NO: 1172757 - RNA, 14 nt, Homo sapiens
gaccccgagccugg

SEQ ID NO: 1172758 - RNA, 14 nt, Homo sapiens
gacccgcuacaaaa

SEQ ID NO: 1172759 - RNA, 17 nt, Homo sapiens
gacccuguaaaauggag

SEQ ID NO: 1172760 - RNA, 17 nt, Homo sapiens
gaccggaguuaugacaa

SEQ ID NO: 1172761 - RNA, 19 nt, Homo sapiens
gaccgugaccagugcugcu

SEQ ID NO: 1172762 - RNA, 13 nt, Homo sapiens
gaccuaaaauaaa

SEQ ID NO: 1172763 - RNA, 13 nt, Homo sapiens
gaccuaacauacc

SEQ ID NO: 1172764 - RNA, 19 nt, Homo sapiens
gaccuacugggcugcauuc

SEQ ID NO: 1172765 - RNA, 18 nt, Homo sapiens
gaccuaguauaucaguga

SEQ ID NO: 1172766 - RNA, 17 nt, Homo sapiens
gaccuaugagcacauag

SEQ ID NO: 1172767 - RNA, 13 nt, Homo sapiens
gaccuauugccag

SEQ ID NO: 1172768 - RNA, 15 nt, Homo sapiens
gaccucaagugaucu

SEQ ID NO: 1172769 - RNA, 18 nt, Homo sapiens
gaccucagggcacaaaga

SEQ ID NO: 1172770 - RNA, 17 nt, Homo sapiens
gaccucaucucuacuaa

SEQ ID NO: 1172771 - RNA, 21 nt, Homo sapiens
gaccucccagcgaccacugca

SEQ ID NO: 1172772 - RNA, 13 nt, Homo sapiens
gaccugaacucug

SEQ ID NO: 1172773 - RNA, 19 nt, Homo sapiens
gaccugagcccgcagccca

SEQ ID NO: 1172774 - RNA, 14 nt, Homo sapiens
gaccugauccugga

SEQ ID NO: 1172775 - RNA, 13 nt, Homo sapiens
gaccugcccuccc

SEQ ID NO: 1172776 - RNA, 17 nt, Homo sapiens
gaccuggugcugccucu

SEQ ID NO: 1172777 - RNA, 18 nt, Homo sapiens
gaccuuaggccuuccucu

SEQ ID NO: 1172778 - RNA, 18 nt, Homo sapiens
gaccuuaugagaaacugc

SEQ ID NO: 1172779 - RNA, 18 nt, Homo sapiens
gaccuugacagagcagcu

SEQ ID NO: 1172780 - RNA, 20 nt, Homo sapiens
gaccuuggguucccaauaca

SEQ ID NO: 1172781 - RNA, 18 nt, Homo sapiens
gaccuuugauuuuugccc

SEQ ID NO: 1172782 - RNA, 23 nt, Homo sapiens
gaccuuugcccacacacacuccu

SEQ ID NO: 1172783 - RNA, 17 nt, Homo sapiens
gacgaagaagagccaca

SEQ ID NO: 1172784 - RNA, 13 nt, Homo sapiens
gacgauaugggga

SEQ ID NO: 1172785 - RNA, 17 nt, Homo sapiens
gacgcaccuugcugcag

SEQ ID NO: 1172786 - RNA, 19 nt, Homo sapiens
gacgcaccuugcugcagug

SEQ ID NO: 1172787 - RNA, 15 nt, Homo sapiens
gacggaauuggguuu

SEQ ID NO: 1172788 - RNA, 23 nt, Homo sapiens
gacgggcaaaauaaagugacaga

SEQ ID NO: 1172789 - RNA, 19 nt, Homo sapiens
gacgucagacuuggcucag

SEQ ID NO: 1172790 - RNA, 12 nt, Homo sapiens
gacgugcacugu

SEQ ID NO: 1172791 - RNA, 17 nt, Homo sapiens
gacuaaccccaccacac

SEQ ID NO: 1172792 - RNA, 13 nt, Homo sapiens
gacuaaguucuca

SEQ ID NO: 1172793 - RNA, 21 nt, Homo sapiens
gacuaaucuuugcugaagcug

SEQ ID NO: 1172794 - RNA, 21 nt, Homo sapiens
gacuacauuuugcucugugaa

SEQ ID NO: 1172795 - RNA, 16 nt, Homo sapiens
gacuagaugauggaug

SEQ ID NO: 1172796 - RNA, 16 nt, Homo sapiens
gacuaggaaauuccaa

SEQ ID NO: 1172797 - RNA, 18 nt, Homo sapiens
gacuauaaagcuguuauu

SEQ ID NO: 1172798 - RNA, 15 nt, Homo sapiens
gacuaucuauccuga

SEQ ID NO: 1172799 - RNA, 12 nt, Homo sapiens
gacuauguuugg

SEQ ID NO: 1172800 - RNA, 16 nt, Homo sapiens
gacuauuuaccaggga

SEQ ID NO: 1172801 - RNA, 15 nt, Homo sapiens
gacuauuuucuuuca

SEQ ID NO: 1172802 - RNA, 18 nt, Homo sapiens
gacucacuggcagcccca

SEQ ID NO: 1172803 - RNA, 22 nt, Homo sapiens
gacucaguuuucuugcagauca

SEQ ID NO: 1172804 - RNA, 18 nt, Homo sapiens
gacucauacaccagguca

SEQ ID NO: 1172805 - RNA, 19 nt, Homo sapiens
gacucauccugaacagcau

SEQ ID NO: 1172806 - RNA, 13 nt, Homo sapiens
gacuccaguuaaa

SEQ ID NO: 1172807 - RNA, 20 nt, Homo sapiens
gacuccauuucuuucuucca

SEQ ID NO: 1172808 - RNA, 15 nt, Homo sapiens
gacuccccugaagaa

SEQ ID NO: 1172809 - RNA, 18 nt, Homo sapiens
gacuccuagauccaggga

SEQ ID NO: 1172810 - RNA, 15 nt, Homo sapiens
gacuccugaagggaa

SEQ ID NO: 1172811 - RNA, 16 nt, Homo sapiens
gacucuaggugcccuu

SEQ ID NO: 1172812 - RNA, 22 nt, Homo sapiens
gacucugaccccagcauucuca

SEQ ID NO: 1172813 - RNA, 14 nt, Homo sapiens
gacucugcacaugu

SEQ ID NO: 1172814 - RNA, 15 nt, Homo sapiens
gacucugcacauguc

SEQ ID NO: 1172815 - RNA, 18 nt, Homo sapiens
gacucugcacaugucuug

SEQ ID NO: 1172816 - RNA, 20 nt, Homo sapiens
gacucuuccauucaguuuua

SEQ ID NO: 1172817 - RNA, 17 nt, Homo sapiens
gacucuugcagggguag

SEQ ID NO: 1172818 - RNA, 20 nt, Homo sapiens
gacucuuguuuucaguuuca

SEQ ID NO: 1172819 - RNA, 19 nt, Homo sapiens
gacucuuuaugcuugcaaa

SEQ ID NO: 1172820 - RNA, 15 nt, Homo sapiens
gacugaaaagccaug

SEQ ID NO: 1172821 - RNA, 17 nt, Homo sapiens
gacugaauuaaugagaa

SEQ ID NO: 1172822 - RNA, 19 nt, Homo sapiens
gacugagcgaggaaaaaca

SEQ ID NO: 1172823 - RNA, 19 nt, Homo sapiens
gacugaugacaaacccagg

SEQ ID NO: 1172824 - RNA, 17 nt, Homo sapiens
gacugcaccauugcugc

SEQ ID NO: 1172825 - RNA, 13 nt, Homo sapiens
gacugcacccagg

SEQ ID NO: 1172826 - RNA, 22 nt, Homo sapiens
gacugcacccaggaggggaaca

SEQ ID NO: 1172827 - RNA, 21 nt, Homo sapiens
gacugcagggguuauguggaa

SEQ ID NO: 1172828 - RNA, 18 nt, Homo sapiens
gacugcccagccacucca

SEQ ID NO: 1172829 - RNA, 16 nt, Homo sapiens
gacugcuaccuuucaa

SEQ ID NO: 1172830 - RNA, 16 nt, Homo sapiens
gacuggaacuugaacu

SEQ ID NO: 1172831 - RNA, 21 nt, Homo sapiens
gacuggagaaaugcuuacuuc

SEQ ID NO: 1172832 - RNA, 20 nt, Homo sapiens
gacuggguuuugugauugcc

SEQ ID NO: 1172833 - RNA, 11 nt, Homo sapiens
gacugucuucc

SEQ ID NO: 1172834 - RNA, 23 nt, Homo sapiens
gacuguggccaugguccccaaga

SEQ ID NO: 1172835 - RNA, 14 nt, Homo sapiens
gacuguuaucagga

SEQ ID NO: 1172836 - RNA, 16 nt, Homo sapiens
gacuguuuuuuucaca

SEQ ID NO: 1172837 - RNA, 16 nt, Homo sapiens
gacuuagccugaguca

SEQ ID NO: 1172838 - RNA, 18 nt, Homo sapiens
gacuuaugaaacuugaaa

SEQ ID NO: 1172839 - RNA, 14 nt, Homo sapiens
gacuucaaugauag

SEQ ID NO: 1172840 - RNA, 13 nt, Homo sapiens
gacuucacacugc

SEQ ID NO: 1172841 - RNA, 20 nt, Homo sapiens
gacuucucccgugagccagg

SEQ ID NO: 1172842 - RNA, 23 nt, Homo sapiens
gacuucuugguacccagucaccu

SEQ ID NO: 1172843 - RNA, 23 nt, Homo sapiens
gacuugaggccugagacacagcc

SEQ ID NO: 1172844 - RNA, 15 nt, Homo sapiens
gacuugauacugcaa

SEQ ID NO: 1172845 - RNA, 21 nt, Homo sapiens
gacuuguaggaaucugccuuc

SEQ ID NO: 1172846 - RNA, 16 nt, Homo sapiens
gacuugucaagccugu

SEQ ID NO: 1172847 - RNA, 15 nt, Homo sapiens
gacuuguuucuccau

SEQ ID NO: 1172848 - RNA, 19 nt, Homo sapiens
gacuuuauuucugagcaaa

SEQ ID NO: 1172849 - RNA, 16 nt, Homo sapiens
gacuuugauguguuuu

SEQ ID NO: 1172850 - RNA, 22 nt, Homo sapiens
gacuuugggcugugagcauuua

SEQ ID NO: 1172851 - RNA, 17 nt, Homo sapiens
gacuuuuuccuugggcu

SEQ ID NO: 1172852 - RNA, 22 nt, Homo sapiens
gagaaaagaaaccagagucaaa

SEQ ID NO: 1172853 - RNA, 21 nt, Homo sapiens
gagaaaaucaaagcagucaua

SEQ ID NO: 1172854 - RNA, 20 nt, Homo sapiens
gagaaagggcggugaacucu

SEQ ID NO: 1172855 - RNA, 15 nt, Homo sapiens
gagaaaugauguugu

SEQ ID NO: 1172856 - RNA, 14 nt, Homo sapiens
gagaaaugugucau

SEQ ID NO: 1172857 - RNA, 18 nt, Homo sapiens
gagaaauuccuugauuca

SEQ ID NO: 1172858 - RNA, 15 nt, Homo sapiens
gagaaauugacagau

SEQ ID NO: 1172859 - RNA, 14 nt, Homo sapiens
gagaacaacccaag

SEQ ID NO: 1172860 - RNA, 22 nt, Homo sapiens
gagaacugguucuugccuuccc

SEQ ID NO: 1172861 - RNA, 22 nt, Homo sapiens
gagaagaaaauggaaccaggcu

SEQ ID NO: 1172862 - RNA, 23 nt, Homo sapiens
gagaagaauuuucagaccccagc

SEQ ID NO: 1172863 - RNA, 11 nt, Homo sapiens
gagaagccauu

SEQ ID NO: 1172864 - RNA, 18 nt, Homo sapiens
gagaagcuccucucccca

SEQ ID NO: 1172865 - RNA, 16 nt, Homo sapiens
gagaagcugucaggga

SEQ ID NO: 1172866 - RNA, 17 nt, Homo sapiens
gagaagcugucagggac

SEQ ID NO: 1172867 - RNA, 20 nt, Homo sapiens
gagaagucugcaagauguca

SEQ ID NO: 1172868 - RNA, 15 nt, Homo sapiens
gagaaucaaaaugca

SEQ ID NO: 1172869 - RNA, 21 nt, Homo sapiens
gagaaucccaaauuugauuga

SEQ ID NO: 1172870 - RNA, 24 nt, Homo sapiens
gagaaugcugaccugacuugccuc

SEQ ID NO: 1172871 - RNA, 20 nt, Homo sapiens
gagacacacuuaacuacuua

SEQ ID NO: 1172872 - RNA, 12 nt, Homo sapiens
gagacacaggga

SEQ ID NO: 1172873 - RNA, 22 nt, Homo sapiens
gagacaggagaaacacuugaac

SEQ ID NO: 1172874 - RNA, 19 nt, Homo sapiens
gagacaggaggauugccug

SEQ ID NO: 1172875 - RNA, 20 nt, Homo sapiens
gagacaggaucguugucccu

SEQ ID NO: 1172876 - RNA, 19 nt, Homo sapiens
ccuuuguugucuacauuaa

SEQ ID NO: 1172877 - RNA, 17 nt, Homo sapiens
ccuuuuacauacugcug

SEQ ID NO: 1172878 - RNA, 18 nt, Homo sapiens
ccuuuuaccccugcacag

SEQ ID NO: 1172879 - RNA, 17 nt, Homo sapiens
ccuuuuauagaugguca

SEQ ID NO: 1172880 - RNA, 20 nt, Homo sapiens
ccuuuuaucaauaaagcacu

SEQ ID NO: 1172881 - RNA, 16 nt, Homo sapiens
ccuuuucuauguugcu

SEQ ID NO: 1172882 - RNA, 17 nt, Homo sapiens
ccuuuugaacuugucac

SEQ ID NO: 1172883 - RNA, 23 nt, Homo sapiens
ccuuuuuaaggaaggcacuaaaa

SEQ ID NO: 1172884 - RNA, 15 nt, Homo sapiens
ccuuuuuuauauaca

SEQ ID NO: 1172885 - RNA, 22 nt, Homo sapiens
ccuuuuuucaaaauccaaaaag

SEQ ID NO: 1172886 - RNA, 21 nt, Homo sapiens
ccuuuuuuguuuuuucaaaau

SEQ ID NO: 1172887 - RNA, 23 nt, Homo sapiens
ccuuuuuuugaaaaaaagcuuuu

SEQ ID NO: 1172888 - RNA, 19 nt, Homo sapiens
cgaaacuccauugagucau

SEQ ID NO: 1172889 - RNA, 23 nt, Homo sapiens
cgaaagccucucaguacagcacu

SEQ ID NO: 1172890 - RNA, 21 nt, Homo sapiens
cgaacaauucauauauuugaa

SEQ ID NO: 1172891 - RNA, 22 nt, Homo sapiens
cgaagaucgugccauugcacuc

SEQ ID NO: 1172892 - RNA, 21 nt, Homo sapiens
cgaagcugcugugacuguguc

SEQ ID NO: 1172893 - RNA, 22 nt, Homo sapiens
cgaaggaaaacugccauaacau

SEQ ID NO: 1172894 - RNA, 13 nt, Homo sapiens
cgaaugacacugu

SEQ ID NO: 1172895 - RNA, 17 nt, Homo sapiens
cgaauuaauuaccuggc

SEQ ID NO: 1172896 - RNA, 18 nt, Homo sapiens
cgaauuuuaucuguggag

SEQ ID NO: 1172897 - RNA, 12 nt, Homo sapiens
cgacaagaccac

SEQ ID NO: 1172898 - RNA, 23 nt, Homo sapiens
cgacacugggaggccagugagcc

SEQ ID NO: 1172899 - RNA, 14 nt, Homo sapiens
cgaccacaccagcc

SEQ ID NO: 1172900 - RNA, 13 nt, Homo sapiens
cgacggcugugac

SEQ ID NO: 1172901 - RNA, 11 nt, Homo sapiens
cgacuguaaau

SEQ ID NO: 1172902 - RNA, 16 nt, Homo sapiens
cgagaagguacugaaa

SEQ ID NO: 1172903 - RNA, 19 nt, Homo sapiens
cgagacaggacgaggcaga

SEQ ID NO: 1172904 - RNA, 14 nt, Homo sapiens
cgagaccccggcuu

SEQ ID NO: 1172905 - RNA, 15 nt, Homo sapiens
cgagaggcaggucaa

SEQ ID NO: 1172906 - RNA, 17 nt, Homo sapiens
cgagauaggguggcaca

SEQ ID NO: 1172907 - RNA, 22 nt, Homo sapiens
cgagcauaagaaauaaaaucua

SEQ ID NO: 1172908 - RNA, 14 nt, Homo sapiens
cgagccaggaacug

SEQ ID NO: 1172909 - RNA, 19 nt, Homo sapiens
cgagcuugaguucugcacu

SEQ ID NO: 1172910 - RNA, 23 nt, Homo sapiens
cgaggaaaagagaaggaaaguga

SEQ ID NO: 1172911 - RNA, 18 nt, Homo sapiens
cgaggccucucucaggag

SEQ ID NO: 1172912 - RNA, 17 nt, Homo sapiens
cgaggcggaucuuugga

SEQ ID NO: 1172913 - RNA, 17 nt, Homo sapiens
cgaggcucuugcucaag

SEQ ID NO: 1172914 - RNA, 19 nt, Homo sapiens
cgagguuccaguaaucuga

SEQ ID NO: 1172915 - RNA, 16 nt, Homo sapiens
cgaguccauuguggag

SEQ ID NO: 1172916 - RNA, 21 nt, Homo sapiens
cgagugcuaaguguaggauau

SEQ ID NO: 1172917 - RNA, 16 nt, Homo sapiens
cgaguuuuaaacuggu

SEQ ID NO: 1172918 - RNA, 22 nt, Homo sapiens
cgaucaggcacaggucaggggu

SEQ ID NO: 1172919 - RNA, 14 nt, Homo sapiens
cgaugcugaccuca

SEQ ID NO: 1172920 - RNA, 21 nt, Homo sapiens
cgauguuauuagauguuacaa

SEQ ID NO: 1172921 - RNA, 23 nt, Homo sapiens
cgauguuuauguucuuauagaau

SEQ ID NO: 1172922 - RNA, 16 nt, Homo sapiens
cgauugaaagaaccag

SEQ ID NO: 1172923 - RNA, 12 nt, Homo sapiens
cgcaaagggcau

SEQ ID NO: 1172924 - RNA, 17 nt, Homo sapiens
cgcaaauuuucuuccau

SEQ ID NO: 1172925 - RNA, 22 nt, Homo sapiens
cgcaaugcuucuagaguuuuau

SEQ ID NO: 1172926 - RNA, 23 nt, Homo sapiens
cgcacugggagccauggggagca

SEQ ID NO: 1172927 - RNA, 20 nt, Homo sapiens
cgcagcugcugccacucugc

SEQ ID NO: 1172928 - RNA, 15 nt, Homo sapiens
cgcaucaaaagacaa

SEQ ID NO: 1172929 - RNA, 13 nt, Homo sapiens
cgcaucuugccuc

SEQ ID NO: 1172930 - RNA, 10 nt, Homo sapiens
cgcaugccaa

SEQ ID NO: 1172931 - RNA, 19 nt, Homo sapiens
cgcauugagccaguggugc

SEQ ID NO: 1172932 - RNA, 18 nt, Homo sapiens
cgccaacugcugaucaau

SEQ ID NO: 1172933 - RNA, 14 nt, Homo sapiens
cgccagacuuccca

SEQ ID NO: 1172934 - RNA, 14 nt, Homo sapiens
cgccaggcgcugca

SEQ ID NO: 1172935 - RNA, 17 nt, Homo sapiens
cgccaggcugaccacag

SEQ ID NO: 1172936 - RNA, 16 nt, Homo sapiens
cgccagugugcugucg

SEQ ID NO: 1172937 - RNA, 15 nt, Homo sapiens
cgccauaggccaagg

SEQ ID NO: 1172938 - RNA, 20 nt, Homo sapiens
cgccauugggcuacuguaga

SEQ ID NO: 1172939 - RNA, 15 nt, Homo sapiens
cgcccaaggcccacg

SEQ ID NO: 1172940 - RNA, 20 nt, Homo sapiens
cgcccaggcuggaguacagu

SEQ ID NO: 1172941 - RNA, 20 nt, Homo sapiens
cgcccaggcuggagugcagu

SEQ ID NO: 1172942 - RNA, 14 nt, Homo sapiens
cgcccccucccuau

SEQ ID NO: 1172943 - RNA, 21 nt, Homo sapiens
cgccccucauuuaucccucaa

SEQ ID NO: 1172944 - RNA, 13 nt, Homo sapiens
cgccgaauccugu

SEQ ID NO: 1172945 - RNA, 17 nt, Homo sapiens
cgccgcccccugcccca

SEQ ID NO: 1172946 - RNA, 16 nt, Homo sapiens
cgccgccucacugcag

SEQ ID NO: 1172947 - RNA, 13 nt, Homo sapiens
cgccggcuuucag

SEQ ID NO: 1172948 - RNA, 18 nt, Homo sapiens
cgccuaggauuucagcca

SEQ ID NO: 1172949 - RNA, 11 nt, Homo sapiens
cgccugcaaac

SEQ ID NO: 1172950 - RNA, 15 nt, Homo sapiens
cgccugccugccacc

SEQ ID NO: 1172951 - RNA, 16 nt, Homo sapiens
cgccugccuucuccuu

SEQ ID NO: 1172952 - RNA, 21 nt, Homo sapiens
cgccuguaaucccaacacuuu

SEQ ID NO: 1172953 - RNA, 20 nt, Homo sapiens
cgccuguaaucccagcacuu

SEQ ID NO: 1172954 - RNA, 22 nt, Homo sapiens
cgccuguaaucccagcacuuug

SEQ ID NO: 1172955 - RNA, 18 nt, Homo sapiens
cgccuuaugagaacaugg

SEQ ID NO: 1172956 - RNA, 19 nt, Homo sapiens
cgccuuggccuugcagcug

SEQ ID NO: 1172957 - RNA, 13 nt, Homo sapiens
cgccuugucauug

SEQ ID NO: 1172958 - RNA, 14 nt, Homo sapiens
cgcgaugggaaccg

SEQ ID NO: 1172959 - RNA, 22 nt, Homo sapiens
cgcuaccucccuccccgucuca

SEQ ID NO: 1172960 - RNA, 12 nt, Homo sapiens
cgcuaguggagg

SEQ ID NO: 1172961 - RNA, 15 nt, Homo sapiens
cgcuccaguaucucc

SEQ ID NO: 1172962 - RNA, 21 nt, Homo sapiens
cgcugaaauuaaaugccacuu

SEQ ID NO: 1172963 - RNA, 16 nt, Homo sapiens
cgcugaagauggcauc

SEQ ID NO: 1172964 - RNA, 21 nt, Homo sapiens
cggaaacuaguguacauuucu

SEQ ID NO: 1172965 - RNA, 18 nt, Homo sapiens
cggaagcugucgacuuca

SEQ ID NO: 1172966 - RNA, 23 nt, Homo sapiens
cggaagcugucgacuucaugaca

SEQ ID NO: 1172967 - RNA, 15 nt, Homo sapiens
cggaaugccacccac

SEQ ID NO: 1172968 - RNA, 14 nt, Homo sapiens
cggacacuucucag

SEQ ID NO: 1172969 - RNA, 17 nt, Homo sapiens
cggacaguuuauuuguu

SEQ ID NO: 1172970 - RNA, 17 nt, Homo sapiens
cggagccuccagcugcc

SEQ ID NO: 1172971 - RNA, 17 nt, Homo sapiens
cggagcgcaaugccauc

SEQ ID NO: 1172972 - RNA, 15 nt, Homo sapiens
cggagcgccccggcc

SEQ ID NO: 1172973 - RNA, 14 nt, Homo sapiens
cggagcuauacaua

SEQ ID NO: 1172974 - RNA, 14 nt, Homo sapiens
cggaggccccggcg

SEQ ID NO: 1172975 - RNA, 13 nt, Homo sapiens
cggauagcauuug

SEQ ID NO: 1172976 - RNA, 23 nt, Homo sapiens
cggcaggcguguggcagccacac

SEQ ID NO: 1172977 - RNA, 21 nt, Homo sapiens
cggcaguauuuucuguuuuua

SEQ ID NO: 1172978 - RNA, 14 nt, Homo sapiens
cggccacaacuaca

SEQ ID NO: 1172979 - RNA, 16 nt, Homo sapiens
cggccagccaugucug

SEQ ID NO: 1172980 - RNA, 15 nt, Homo sapiens
cggcccagggagggu

SEQ ID NO: 1172981 - RNA, 15 nt, Homo sapiens
cggccccucccacac

SEQ ID NO: 1172982 - RNA, 19 nt, Homo sapiens
cggcccugcugaagcugcu

SEQ ID NO: 1172983 - RNA, 17 nt, Homo sapiens
cggccucccaaagugcu

SEQ ID NO: 1172984 - RNA, 17 nt, Homo sapiens
cggccucugccuuugca

SEQ ID NO: 1172985 - RNA, 21 nt, Homo sapiens
cggccugcaccgacccgaggc

SEQ ID NO: 1172986 - RNA, 15 nt, Homo sapiens
cggccugcucgccca

SEQ ID NO: 1172987 - RNA, 19 nt, Homo sapiens
cggccuugaagacagagca

SEQ ID NO: 1172988 - RNA, 19 nt, Homo sapiens
cggcgggagggcgcggggc

SEQ ID NO: 1172989 - RNA, 17 nt, Homo sapiens
cggcguggagacuggca

SEQ ID NO: 1172990 - RNA, 14 nt, Homo sapiens
cggcucacugcaac

SEQ ID NO: 1172991 - RNA, 14 nt, Homo sapiens
cggcucagugcaac

SEQ ID NO: 1172992 - RNA, 15 nt, Homo sapiens
cggcucagugcaacc

SEQ ID NO: 1172993 - RNA, 13 nt, Homo sapiens
cggcuuuccucua

SEQ ID NO: 1172994 - RNA, 16 nt, Homo sapiens
cgggaagaaggggaca

SEQ ID NO: 1172995 - RNA, 19 nt, Homo sapiens
cgggacacagaacuaguga

SEQ ID NO: 1172996 - RNA, 19 nt, Homo sapiens
cgggcgucaggggugcaca

SEQ ID NO: 1172997 - RNA, 14 nt, Homo sapiens
cgggcuuuccccca

SEQ ID NO: 1172998 - RNA, 17 nt, Homo sapiens
cggggaagagauccaaa

SEQ ID NO: 1172999 - RNA, 21 nt, Homo sapiens
cggggaggggaggaacaggga

SEQ ID NO: 1173000 - RNA, 23 nt, Homo sapiens
cggggaggggaggaacagggaag

SEQ ID NO: 1173001 - RNA, 18 nt, Homo sapiens
cggggccugucucaguga

SEQ ID NO: 1173002 - RNA, 16 nt, Homo sapiens
cgggucucucacuguu

SEQ ID NO: 1173003 - RNA, 17 nt, Homo sapiens
cggucagggucagggcc

SEQ ID NO: 1173004 - RNA, 15 nt, Homo sapiens
cggugcuccaucucc

SEQ ID NO: 1173005 - RNA, 22 nt, Homo sapiens
cggugcuugauagaaaugccaa

SEQ ID NO: 1173006 - RNA, 19 nt, Homo sapiens
cggugucuuguucugucac

SEQ ID NO: 1173007 - RNA, 18 nt, Homo sapiens
cgguuaagaaagcacuua

SEQ ID NO: 1173008 - RNA, 19 nt, Homo sapiens
cguaaacacgccugcaaac

SEQ ID NO: 1173009 - RNA, 18 nt, Homo sapiens
cguagagcacagccucac

SEQ ID NO: 1173010 - RNA, 21 nt, Homo sapiens
cguagagcacagccucacuca

SEQ ID NO: 1173011 - RNA, 16 nt, Homo sapiens
cguagugucaguacua

SEQ ID NO: 1173012 - RNA, 19 nt, Homo sapiens
cguauaauuuagucccuua

SEQ ID NO: 1173013 - RNA, 17 nt, Homo sapiens
cguaucuuuccuaggca

SEQ ID NO: 1173014 - RNA, 17 nt, Homo sapiens
cguaucuuuuaaugauc

SEQ ID NO: 1173015 - RNA, 15 nt, Homo sapiens
cgucaagugaucugc

SEQ ID NO: 1173016 - RNA, 20 nt, Homo sapiens
cgucaugggccccccaugca

SEQ ID NO: 1173017 - RNA, 19 nt, Homo sapiens
cguccauauuuaacaugua

SEQ ID NO: 1173018 - RNA, 18 nt, Homo sapiens
cgucuaguuaacauuuca

SEQ ID NO: 1173019 - RNA, 18 nt, Homo sapiens
cgugaaggccgagaagca

SEQ ID NO: 1173020 - RNA, 16 nt, Homo sapiens
cgugacacaaacacac

SEQ ID NO: 1173021 - RNA, 16 nt, Homo sapiens
cgugaccagugcugcu

SEQ ID NO: 1173022 - RNA, 18 nt, Homo sapiens
cgugagccaggcaaagga

SEQ ID NO: 1173023 - RNA, 17 nt, Homo sapiens
cgugagcuaugauaaga

SEQ ID NO: 1173024 - RNA, 15 nt, Homo sapiens
cgugaucaaagccac

SEQ ID NO: 1173025 - RNA, 19 nt, Homo sapiens
cgugccugaucugcacauu

SEQ ID NO: 1173026 - RNA, 22 nt, Homo sapiens
cgugccugaucugcacauuuca

SEQ ID NO: 1173027 - RNA, 14 nt, Homo sapiens
cgugcuggcgacac

SEQ ID NO: 1173028 - RNA, 15 nt, Homo sapiens
cguggaaguguuccu

SEQ ID NO: 1173029 - RNA, 21 nt, Homo sapiens
cguggacucugcacaugucuu

SEQ ID NO: 1173030 - RNA, 21 nt, Homo sapiens
cgugggcugggcccacaaagg

SEQ ID NO: 1173031 - RNA, 20 nt, Homo sapiens
cguguaacacccuuccucug

SEQ ID NO: 1173032 - RNA, 17 nt, Homo sapiens
cguguaauauucucuga

SEQ ID NO: 1173033 - RNA, 15 nt, Homo sapiens
cguguauaugugcuu

SEQ ID NO: 1173034 - RNA, 18 nt, Homo sapiens
cguguguguuauuucccc

SEQ ID NO: 1173035 - RNA, 17 nt, Homo sapiens
cguuauauuaaaacacu

SEQ ID NO: 1173036 - RNA, 13 nt, Homo sapiens
cguuaucauggag

SEQ ID NO: 1173037 - RNA, 13 nt, Homo sapiens
cguuaugguguuu

SEQ ID NO: 1173038 - RNA, 14 nt, Homo sapiens
cguucccacugccc

SEQ ID NO: 1173039 - RNA, 13 nt, Homo sapiens
cguuguacuccag

SEQ ID NO: 1173040 - RNA, 22 nt, Homo sapiens
cguuuuccagcauguguucugu

SEQ ID NO: 1173041 - RNA, 21 nt, Homo sapiens
cguuuugccugugacuguaaa

SEQ ID NO: 1173042 - RNA, 16 nt, Homo sapiens
cguuuuuggacacugu

SEQ ID NO: 1173043 - RNA, 23 nt, Homo sapiens
cuaaaaaaaaaauccagccucau

SEQ ID NO: 1173044 - RNA, 23 nt, Homo sapiens
cuaaaaaaauuuauuuuacacau

SEQ ID NO: 1173045 - RNA, 23 nt, Homo sapiens
cuaaaacagaaaaaaaaauggaa

SEQ ID NO: 1173046 - RNA, 12 nt, Homo sapiens
cuaaaacuuaac

SEQ ID NO: 1173047 - RNA, 18 nt, Homo sapiens
cuaaaacuuaacauucau

SEQ ID NO: 1173048 - RNA, 16 nt, Homo sapiens
cuaaaaguguaagaaa

SEQ ID NO: 1173049 - RNA, 13 nt, Homo sapiens
cuaaaaguucuca

SEQ ID NO: 1173050 - RNA, 21 nt, Homo sapiens
cuaaaauaauuuuauuaugca

SEQ ID NO: 1173051 - RNA, 14 nt, Homo sapiens
cuaaaauucaggua

SEQ ID NO: 1173052 - RNA, 15 nt, Homo sapiens
cuaaaauucagguau

SEQ ID NO: 1173053 - RNA, 18 nt, Homo sapiens
cuaaaccaaucaaauguc

SEQ ID NO: 1173054 - RNA, 16 nt, Homo sapiens
cuaaacucagaggcag

SEQ ID NO: 1173055 - RNA, 20 nt, Homo sapiens
cuaaagagagaugaaccaca

SEQ ID NO: 1173056 - RNA, 23 nt, Homo sapiens
cuaaagaguuauucaaaugaagg

SEQ ID NO: 1173057 - RNA, 15 nt, Homo sapiens
cuaaagauguuuuaa

SEQ ID NO: 1173058 - RNA, 17 nt, Homo sapiens
cuaaagcaauagaaaca

SEQ ID NO: 1173059 - RNA, 22 nt, Homo sapiens
cuaaaggaagaaauacauauuu

SEQ ID NO: 1173060 - RNA, 19 nt, Homo sapiens
cuaaagguccacaggucua

SEQ ID NO: 1173061 - RNA, 16 nt, Homo sapiens
cuaaagguguuuugua

SEQ ID NO: 1173062 - RNA, 17 nt, Homo sapiens
cuaaaguaccagauuau

SEQ ID NO: 1173063 - RNA, 16 nt, Homo sapiens
cuaaaguaucuguauu

SEQ ID NO: 1173064 - RNA, 12 nt, Homo sapiens
cuaaaguucuaa

SEQ ID NO: 1173065 - RNA, 14 nt, Homo sapiens
cuaaauaacuguau

SEQ ID NO: 1173066 - RNA, 15 nt, Homo sapiens
cuaaauacuugcucc

SEQ ID NO: 1173067 - RNA, 12 nt, Homo sapiens
cuaaauaucaua

SEQ ID NO: 1173068 - RNA, 23 nt, Homo sapiens
cuaaauaucauaaucugaugaua

SEQ ID NO: 1173069 - RNA, 23 nt, Homo sapiens
cuaaaucacuuugagccugggaa

SEQ ID NO: 1173070 - RNA, 20 nt, Homo sapiens
cuaaauccuuuuguuuugaa

SEQ ID NO: 1173071 - RNA, 11 nt, Homo sapiens
cuaaaugaagu

SEQ ID NO: 1173072 - RNA, 14 nt, Homo sapiens
cuaaaugagcuaaa

SEQ ID NO: 1173073 - RNA, 16 nt, Homo sapiens
cuaaauguaacagucu

SEQ ID NO: 1173074 - RNA, 14 nt, Homo sapiens
cuaaauguguacac

SEQ ID NO: 1173075 - RNA, 15 nt, Homo sapiens
cuaaauuaugacugc

SEQ ID NO: 1173076 - RNA, 20 nt, Homo sapiens
cuaaauuuucugaaacugca

SEQ ID NO: 1173077 - RNA, 14 nt, Homo sapiens
cuaacacacuuuau

SEQ ID NO: 1173078 - RNA, 16 nt, Homo sapiens
cuaacauguaauugca

SEQ ID NO: 1173079 - RNA, 13 nt, Homo sapiens
cuaaccacuaaug

SEQ ID NO: 1173080 - RNA, 15 nt, Homo sapiens
cuaacuccagugaag

SEQ ID NO: 1173081 - RNA, 21 nt, Homo sapiens
cuaacucccuccucacacucc

SEQ ID NO: 1173082 - RNA, 15 nt, Homo sapiens
cuaagaaguggggca

SEQ ID NO: 1173083 - RNA, 16 nt, Homo sapiens
cuaagaagugguguuc

SEQ ID NO: 1173084 - RNA, 18 nt, Homo sapiens
cuaagaauucaaacuggg

SEQ ID NO: 1173085 - RNA, 16 nt, Homo sapiens
cuaagagaacaaugug

SEQ ID NO: 1173086 - RNA, 20 nt, Homo sapiens
cuaagauacugcugaugcug

SEQ ID NO: 1173087 - RNA, 18 nt, Homo sapiens
cuaagaugugauauucua

SEQ ID NO: 1173088 - RNA, 22 nt, Homo sapiens
cuaagcaaaauugcuaaagaga

SEQ ID NO: 1173089 - RNA, 20 nt, Homo sapiens
cuaagccaggaggcuuuaag

SEQ ID NO: 1173090 - RNA, 21 nt, Homo sapiens
cuaagcugugguguguucccc

SEQ ID NO: 1173091 - RNA, 14 nt, Homo sapiens
cuaaggacauuucc

SEQ ID NO: 1173092 - RNA, 19 nt, Homo sapiens
cuaaggagcgcuagugccu

SEQ ID NO: 1173093 - RNA, 15 nt, Homo sapiens
cuaaggaggggaaaa

SEQ ID NO: 1173094 - RNA, 20 nt, Homo sapiens
cuaaggcucuaugagucuag

SEQ ID NO: 1173095 - RNA, 23 nt, Homo sapiens
cuaaggggcccggccagccaugu

SEQ ID NO: 1173096 - RNA, 22 nt, Homo sapiens
cuaagggucgaaagcucuagaa

SEQ ID NO: 1173097 - RNA, 15 nt, Homo sapiens
cuaagucaaauucca

SEQ ID NO: 1173098 - RNA, 14 nt, Homo sapiens
cuaaguggggaaaa

SEQ ID NO: 1173099 - RNA, 22 nt, Homo sapiens
cuaaguuauuguuaauuaugua

SEQ ID NO: 1173100 - RNA, 20 nt, Homo sapiens
cuaaguuauuuuaugacaug

SEQ ID NO: 1173101 - RNA, 17 nt, Homo sapiens
cuaauaaaucuguggau

SEQ ID NO: 1173102 - RNA, 21 nt, Homo sapiens
cuaauaagaaaaccaccccuu

SEQ ID NO: 1173103 - RNA, 15 nt, Homo sapiens
cuaauaccucugugu

SEQ ID NO: 1173104 - RNA, 23 nt, Homo sapiens
cuaauacuacugcacagagucag

SEQ ID NO: 1173105 - RNA, 16 nt, Homo sapiens
cuaauaucaaaugcag

SEQ ID NO: 1173106 - RNA, 23 nt, Homo sapiens
cuaaugaagguuuucauuugcca

SEQ ID NO: 1173107 - RNA, 18 nt, Homo sapiens
cuaaugcauaagcuuuuu

SEQ ID NO: 1173108 - RNA, 11 nt, Homo sapiens
cuaaugcucac

SEQ ID NO: 1173109 - RNA, 12 nt, Homo sapiens
cuaaugguguug

SEQ ID NO: 1173110 - RNA, 16 nt, Homo sapiens
cuaauguuacuagaga

SEQ ID NO: 1173111 - RNA, 12 nt, Homo sapiens
cuaauuaauucu

SEQ ID NO: 1173112 - RNA, 21 nt, Homo sapiens
cuaauuauaaaauuaacauga

SEQ ID NO: 1173113 - RNA, 17 nt, Homo sapiens
cuaauuauuaagauaug

SEQ ID NO: 1173114 - RNA, 13 nt, Homo sapiens
cuaauucagccau

SEQ ID NO: 1173115 - RNA, 19 nt, Homo sapiens
cuaauucagugucacauga

SEQ ID NO: 1173116 - RNA, 20 nt, Homo sapiens
cuaauucuguaggacuuuga

SEQ ID NO: 1173117 - RNA, 19 nt, Homo sapiens
cuaauucuucuguccugag

SEQ ID NO: 1173118 - RNA, 13 nt, Homo sapiens
cuaauugcuguug

SEQ ID NO: 1173119 - RNA, 21 nt, Homo sapiens
cuaauugcuguugaaagcaaa

SEQ ID NO: 1173120 - RNA, 22 nt, Homo sapiens
cuaauuucugaaaugugcagcu

SEQ ID NO: 1173121 - RNA, 21 nt, Homo sapiens
cuaauuugcauuaaauucaca

SEQ ID NO: 1173122 - RNA, 17 nt, Homo sapiens
cuacaaacuucaaagag

SEQ ID NO: 1173123 - RNA, 12 nt, Homo sapiens
cuacaacagccu

SEQ ID NO: 1173124 - RNA, 18 nt, Homo sapiens
cuacaacaugauagaacu

SEQ ID NO: 1173125 - RNA, 13 nt, Homo sapiens
cuacaaguuuaag

SEQ ID NO: 1173126 - RNA, 14 nt, Homo sapiens
cuacacacugucau

SEQ ID NO: 1173127 - RNA, 21 nt, Homo sapiens
cuacacagagcaggacugcac

SEQ ID NO: 1173128 - RNA, 14 nt, Homo sapiens
cuacacugaugcaa

SEQ ID NO: 1173129 - RNA, 22 nt, Homo sapiens
cuacagagcuucccugacucau

SEQ ID NO: 1173130 - RNA, 19 nt, Homo sapiens
cuacagggcucacagaauu

SEQ ID NO: 1173131 - RNA, 20 nt, Homo sapiens
cuacagugaauuuaaucaaa

SEQ ID NO: 1173132 - RNA, 18 nt, Homo sapiens
cuacaguuuggagcccac

SEQ ID NO: 1173133 - RNA, 10 nt, Homo sapiens
cuacaugaau

SEQ ID NO: 1173134 - RNA, 12 nt, Homo sapiens
cuacauguucuc

SEQ ID NO: 1173135 - RNA, 14 nt, Homo sapiens
cuacauucaaggag

SEQ ID NO: 1173136 - RNA, 17 nt, Homo sapiens
cuacauuuugcucugug

SEQ ID NO: 1173137 - RNA, 23 nt, Homo sapiens
cuacccugagaucugcacaguca

SEQ ID NO: 1173138 - RNA, 17 nt, Homo sapiens
cuaccuagaaguaagaa

SEQ ID NO: 1173139 - RNA, 21 nt, Homo sapiens
cuaccucaaccaaugccaaaa

SEQ ID NO: 1173140 - RNA, 15 nt, Homo sapiens
cuaccugagcauuca

SEQ ID NO: 1173141 - RNA, 20 nt, Homo sapiens
cuaccugagcauucaggcag

SEQ ID NO: 1173142 - RNA, 15 nt, Homo sapiens
cuaccugcaacacaa

SEQ ID NO: 1173143 - RNA, 12 nt, Homo sapiens
cuaccuguaacu

SEQ ID NO: 1173144 - RNA, 23 nt, Homo sapiens
cuacgugauuuggcugcacuuga

SEQ ID NO: 1173145 - RNA, 13 nt, Homo sapiens
cuacuagccauug

SEQ ID NO: 1173146 - RNA, 13 nt, Homo sapiens
cuacuauauugau

SEQ ID NO: 1173147 - RNA, 21 nt, Homo sapiens
cuacuccccagaccucaggga

SEQ ID NO: 1173148 - RNA, 20 nt, Homo sapiens
cuacuccgcagcucuagucc

SEQ ID NO: 1173149 - RNA, 23 nt, Homo sapiens
cuacucuaggcagugacagugcc

SEQ ID NO: 1173150 - RNA, 15 nt, Homo sapiens
cuacucuuaagccau

SEQ ID NO: 1173151 - RNA, 14 nt, Homo sapiens
cuacugacuguauu

SEQ ID NO: 1173152 - RNA, 19 nt, Homo sapiens
cuacugaguagggggagca

SEQ ID NO: 1173153 - RNA, 17 nt, Homo sapiens
cuacugccccucuccga

SEQ ID NO: 1173154 - RNA, 18 nt, Homo sapiens
cuacugcucuguguuuac

SEQ ID NO: 1173155 - RNA, 20 nt, Homo sapiens
cuacuggggaggcugaggca

SEQ ID NO: 1173156 - RNA, 15 nt, Homo sapiens
cuacugucucacuga

SEQ ID NO: 1173157 - RNA, 12 nt, Homo sapiens
cuacuguucuaa

SEQ ID NO: 1173158 - RNA, 18 nt, Homo sapiens
cuacuucacuaaugacga

SEQ ID NO: 1173159 - RNA, 18 nt, Homo sapiens
cuacuucugcccuugcca

SEQ ID NO: 1173160 - RNA, 17 nt, Homo sapiens
cuacuugcucagguacu

SEQ ID NO: 1173161 - RNA, 13 nt, Homo sapiens
cuacuugcugucc

SEQ ID NO: 1173162 - RNA, 18 nt, Homo sapiens
cuacuuugauaugacugu

SEQ ID NO: 1173163 - RNA, 13 nt, Homo sapiens
cuacuuuugccaa

SEQ ID NO: 1173164 - RNA, 21 nt, Homo sapiens
cuagaaaaauguucuuuaaag

SEQ ID NO: 1173165 - RNA, 20 nt, Homo sapiens
cuagaaauaagcccaacaga

SEQ ID NO: 1173166 - RNA, 22 nt, Homo sapiens
cuagaaauguagcagcagccua

SEQ ID NO: 1173167 - RNA, 15 nt, Homo sapiens
cuagaaauucuuaag

SEQ ID NO: 1173168 - RNA, 19 nt, Homo sapiens
cuagaauccugcuuuacag

SEQ ID NO: 1173169 - RNA, 20 nt, Homo sapiens
cuagacuggccuaggggcca

SEQ ID NO: 1173170 - RNA, 13 nt, Homo sapiens
cuagagacaguga

SEQ ID NO: 1173171 - RNA, 20 nt, Homo sapiens
cuagaguauaccugugguuu

SEQ ID NO: 1173172 - RNA, 19 nt, Homo sapiens
cuagaugauggaugccaau

SEQ ID NO: 1173173 - RNA, 18 nt, Homo sapiens
cuagaugauugaauaaca

SEQ ID NO: 1173174 - RNA, 12 nt, Homo sapiens
cuagcaucucau

SEQ ID NO: 1173175 - RNA, 22 nt, Homo sapiens
cuagcaucucaugagugccaag

SEQ ID NO: 1173176 - RNA, 18 nt, Homo sapiens
cuagccagaggacuguga

SEQ ID NO: 1173177 - RNA, 22 nt, Homo sapiens
cuagccuggggcuugaauuugc

SEQ ID NO: 1173178 - RNA, 18 nt, Homo sapiens
cuagcgccucuccccggg

SEQ ID NO: 1173179 - RNA, 17 nt, Homo sapiens
cuagcgcguugccuguc

SEQ ID NO: 1173180 - RNA, 16 nt, Homo sapiens
cuagcucuuugagaua

SEQ ID NO: 1173181 - RNA, 14 nt, Homo sapiens
cuagcugcaaguga

SEQ ID NO: 1173182 - RNA, 13 nt, Homo sapiens
cuaggaaaucaca

SEQ ID NO: 1173183 - RNA, 16 nt, Homo sapiens
cuaggaaauccauuca

SEQ ID NO: 1173184 - RNA, 18 nt, Homo sapiens
cuaggaagagcaggacuc

SEQ ID NO: 1173185 - RNA, 18 nt, Homo sapiens
cuaggaagaucucugcag

SEQ ID NO: 1173186 - RNA, 13 nt, Homo sapiens
cuaggagacaucu

SEQ ID NO: 1173187 - RNA, 16 nt, Homo sapiens
cuaggaguauccucau

SEQ ID NO: 1173188 - RNA, 22 nt, Homo sapiens
cuaggauaauguccaacuaaaa

SEQ ID NO: 1173189 - RNA, 21 nt, Homo sapiens
cuaggccacuccuccaaagga

SEQ ID NO: 1173190 - RNA, 15 nt, Homo sapiens
cuaggcuauuaauuu

SEQ ID NO: 1173191 - RNA, 14 nt, Homo sapiens
cuagggaucccuca

SEQ ID NO: 1173192 - RNA, 22 nt, Homo sapiens
cuaggguuuaugcuuaauuuua

SEQ ID NO: 1173193 - RNA, 13 nt, Homo sapiens
cuagguaucauuc

SEQ ID NO: 1173194 - RNA, 22 nt, Homo sapiens
cuagguaucauucaacucucca

SEQ ID NO: 1173195 - RNA, 13 nt, Homo sapiens
cuagguguucuaa

SEQ ID NO: 1173196 - RNA, 21 nt, Homo sapiens
cuagguugacagauacuuugu

SEQ ID NO: 1173197 - RNA, 15 nt, Homo sapiens
cuagguuucaaagau

SEQ ID NO: 1173198 - RNA, 14 nt, Homo sapiens
cuaguaaguauuua

SEQ ID NO: 1173199 - RNA, 17 nt, Homo sapiens
cuaguagaacaauguac

SEQ ID NO: 1173200 - RNA, 16 nt, Homo sapiens
cuaguauaucagugac

SEQ ID NO: 1173201 - RNA, 14 nt, Homo sapiens
cuaguaugaaagcu

SEQ ID NO: 1173202 - RNA, 14 nt, Homo sapiens
cuagucaagcuccu

SEQ ID NO: 1173203 - RNA, 15 nt, Homo sapiens
cuagucucuacccag

SEQ ID NO: 1173204 - RNA, 22 nt, Homo sapiens
cuagugccccagacugagcucu

SEQ ID NO: 1173205 - RNA, 22 nt, Homo sapiens
cuagugccuugcccacaggugc

SEQ ID NO: 1173206 - RNA, 22 nt, Homo sapiens
cuaguguacauuucuauaaaua

SEQ ID NO: 1173207 - RNA, 18 nt, Homo sapiens
cuaguguaccuccucuca

SEQ ID NO: 1173208 - RNA, 12 nt, Homo sapiens
cuaguucagcug

SEQ ID NO: 1173209 - RNA, 12 nt, Homo sapiens
cuaguugcuugu

SEQ ID NO: 1173210 - RNA, 18 nt, Homo sapiens
cuaguuuaugguucugca

SEQ ID NO: 1173211 - RNA, 17 nt, Homo sapiens
cuauaaaaacaaaaacu

SEQ ID NO: 1173212 - RNA, 24 nt, Homo sapiens
cuauaaaaugcaguaacauucuac

SEQ ID NO: 1173213 - RNA, 18 nt, Homo sapiens
cuauaagcaugacauacu

SEQ ID NO: 1173214 - RNA, 18 nt, Homo sapiens
cuauaaggccauaaaaca

SEQ ID NO: 1173215 - RNA, 14 nt, Homo sapiens
cuauaaugcuauuu

SEQ ID NO: 1173216 - RNA, 18 nt, Homo sapiens
cuauaauucuauacuguu

SEQ ID NO: 1173217 - RNA, 19 nt, Homo sapiens
cuauacuugguuugcuacc

SEQ ID NO: 1173218 - RNA, 21 nt, Homo sapiens
cuauaguacuuuaugcaucuc

SEQ ID NO: 1173219 - RNA, 13 nt, Homo sapiens
cuauaguucuaga

SEQ ID NO: 1173220 - RNA, 13 nt, Homo sapiens
cuauauagacuug

SEQ ID NO: 1173221 - RNA, 18 nt, Homo sapiens
cuauaucauaaauacaag

SEQ ID NO: 1173222 - RNA, 14 nt, Homo sapiens
cuauaugauaugca

SEQ ID NO: 1173223 - RNA, 14 nt, Homo sapiens
cuauaugcacuuau

SEQ ID NO: 1173224 - RNA, 16 nt, Homo sapiens
cuauaugguaguuuaa

SEQ ID NO: 1173225 - RNA, 18 nt, Homo sapiens
cuauauuaucaugcaaau

SEQ ID NO: 1173226 - RNA, 16 nt, Homo sapiens
cuauauuuugaucuau

SEQ ID NO: 1173227 - RNA, 17 nt, Homo sapiens
cuauauuuuucugcuac

SEQ ID NO: 1173228 - RNA, 18 nt, Homo sapiens
cuaucaaaacucuaucaa

SEQ ID NO: 1173229 - RNA, 19 nt, Homo sapiens
cuaucaaaugugauggcua

SEQ ID NO: 1173230 - RNA, 12 nt, Homo sapiens
cuaucacuguac

SEQ ID NO: 1173231 - RNA, 22 nt, Homo sapiens
cuaucaggcagaagaaucuuuc

SEQ ID NO: 1173232 - RNA, 16 nt, Homo sapiens
cuaucauggcauauaa

SEQ ID NO: 1173233 - RNA, 18 nt, Homo sapiens
cuauccaccacugcuuaa

SEQ ID NO: 1173234 - RNA, 17 nt, Homo sapiens
cuaucccuaacaggcug

SEQ ID NO: 1173235 - RNA, 22 nt, Homo sapiens
cuauccuauuaggauaccacuu

SEQ ID NO: 1173236 - RNA, 19 nt, Homo sapiens
cuaucggggucacuugcaa

SEQ ID NO: 1173237 - RNA, 17 nt, Homo sapiens
cuaucguuauuauaaau

SEQ ID NO: 1173238 - RNA, 22 nt, Homo sapiens
cuaugaaaccuuuuuccuagua

SEQ ID NO: 1173239 - RNA, 15 nt, Homo sapiens
cuaugaugaaugcag

SEQ ID NO: 1173240 - RNA, 22 nt, Homo sapiens
cuaugcagaacaggcagaaaua

SEQ ID NO: 1173241 - RNA, 16 nt, Homo sapiens
cuaugggagaguguca

SEQ ID NO: 1173242 - RNA, 18 nt, Homo sapiens
cuauguuuggaguuuaau

SEQ ID NO: 1173243 - RNA, 22 nt, Homo sapiens
cuauuagggaguuaugcaaaau

SEQ ID NO: 1173244 - RNA, 22 nt, Homo sapiens
cuauuccagcucauucauuuua

SEQ ID NO: 1173245 - RNA, 18 nt, Homo sapiens
cuauucccacuuucauuc

SEQ ID NO: 1173246 - RNA, 16 nt, Homo sapiens
cuauucugagaaaaca

SEQ ID NO: 1173247 - RNA, 13 nt, Homo sapiens
cuauucuuuucaa

SEQ ID NO: 1173248 - RNA, 13 nt, Homo sapiens
cuauuggucaugc

SEQ ID NO: 1173249 - RNA, 21 nt, Homo sapiens
cuauuuaagugaaaaaagcaa

SEQ ID NO: 1173250 - RNA, 21 nt, Homo sapiens
cuauuuaagugauacauaccu

SEQ ID NO: 1173251 - RNA, 14 nt, Homo sapiens
cuauuucuguauca

SEQ ID NO: 1173252 - RNA, 21 nt, Homo sapiens
cuauuugccuccagugcaguc

SEQ ID NO: 1173253 - RNA, 19 nt, Homo sapiens
cuauuuuguuaguuauaca

SEQ ID NO: 1173254 - RNA, 18 nt, Homo sapiens
cuauuuuuguacaaaaga

SEQ ID NO: 1173255 - RNA, 22 nt, Homo sapiens
cuauuuuuguacaaaagagaag

SEQ ID NO: 1173256 - RNA, 17 nt, Homo sapiens
cucaaaacuguacuguc

SEQ ID NO: 1173257 - RNA, 20 nt, Homo sapiens
cucaaacuccugaccucagg

SEQ ID NO: 1173258 - RNA, 24 nt, Homo sapiens
cucaaagaauguguaugguaucau

SEQ ID NO: 1173259 - RNA, 15 nt, Homo sapiens
cucaaagaucugaau

SEQ ID NO: 1173260 - RNA, 14 nt, Homo sapiens
cucaaaguuucaga

SEQ ID NO: 1173261 - RNA, 15 nt, Homo sapiens
cucaaauacauaccu

SEQ ID NO: 1173262 - RNA, 13 nt, Homo sapiens
cucaaauguuuuc

SEQ ID NO: 1173263 - RNA, 21 nt, Homo sapiens
cucaacaugagucaagagcau

SEQ ID NO: 1173264 - RNA, 12 nt, Homo sapiens
cucaacuaccuc

SEQ ID NO: 1173265 - RNA, 13 nt, Homo sapiens
cucaacugaggau

SEQ ID NO: 1173266 - RNA, 13 nt, Homo sapiens
cucaagacugaaa

SEQ ID NO: 1173267 - RNA, 15 nt, Homo sapiens
cucaagcagcaaaau

SEQ ID NO: 1173268 - RNA, 18 nt, Homo sapiens
cucaagcccgcggggaca

SEQ ID NO: 1173269 - RNA, 21 nt, Homo sapiens
cucaaggguggcaggucacug

SEQ ID NO: 1173270 - RNA, 19 nt, Homo sapiens
cucaagguuuuagguucua

SEQ ID NO: 1173271 - RNA, 17 nt, Homo sapiens
cucaaugaaauauguga

SEQ ID NO: 1173272 - RNA, 20 nt, Homo sapiens
cucaauggauuugaugcugu

SEQ ID NO: 1173273 - RNA, 23 nt, Homo sapiens
cucacaggacaugcuuugugcca

SEQ ID NO: 1173274 - RNA, 22 nt, Homo sapiens
cucacauaaaaaagaagcacuu

SEQ ID NO: 1173275 - RNA, 16 nt, Homo sapiens
cucacauccauucuuc

SEQ ID NO: 1173276 - RNA, 19 nt, Homo sapiens
cucacauccauucuucccu

SEQ ID NO: 1173277 - RNA, 18 nt, Homo sapiens
cucacauuucaccccagg

SEQ ID NO: 1173278 - RNA, 18 nt, Homo sapiens
cucaccaaaugagaagaa

SEQ ID NO: 1173279 - RNA, 19 nt, Homo sapiens
cucacccaccccugcacag

SEQ ID NO: 1173280 - RNA, 17 nt, Homo sapiens
cucaccugcucuucaag

SEQ ID NO: 1173281 - RNA, 17 nt, Homo sapiens
cucaccugguugaccca

SEQ ID NO: 1173282 - RNA, 12 nt, Homo sapiens
cucaccuugugu

SEQ ID NO: 1173283 - RNA, 14 nt, Homo sapiens
cucacggaccccau

SEQ ID NO: 1173284 - RNA, 17 nt, Homo sapiens
cucacgggacuauuucc

SEQ ID NO: 1173285 - RNA, 20 nt, Homo sapiens
cucacgucuguaaucccagc

SEQ ID NO: 1173286 - RNA, 16 nt, Homo sapiens
cucacgugacugccag

SEQ ID NO: 1173287 - RNA, 12 nt, Homo sapiens
cucacuaccugg

SEQ ID NO: 1173288 - RNA, 14 nt, Homo sapiens
cucacucaccuuca

SEQ ID NO: 1173289 - RNA, 21 nt, Homo sapiens
cucacugggccuccaaccaug

SEQ ID NO: 1173290 - RNA, 15 nt, Homo sapiens
cucacuugauguuuc

SEQ ID NO: 1173291 - RNA, 22 nt, Homo sapiens
cucagacaccugugugcuguag

SEQ ID NO: 1173292 - RNA, 14 nt, Homo sapiens
cucagaccagagaa

SEQ ID NO: 1173293 - RNA, 19 nt, Homo sapiens
cucagaccggcaacaucag

SEQ ID NO: 1173294 - RNA, 22 nt, Homo sapiens
cucagagaaaagagauugagau

SEQ ID NO: 1173295 - RNA, 22 nt, Homo sapiens
cucagagauauugugaggacaa

SEQ ID NO: 1173296 - RNA, 22 nt, Homo sapiens
cucagaggcgcacugugacccc

SEQ ID NO: 1173297 - RNA, 17 nt, Homo sapiens
cucagaguccugcugcc

SEQ ID NO: 1173298 - RNA, 13 nt, Homo sapiens
cucagagugcaag

SEQ ID NO: 1173299 - RNA, 22 nt, Homo sapiens
cucagaguugagaccuuugauu

SEQ ID NO: 1173300 - RNA, 12 nt, Homo sapiens
cucagcauuuaa

SEQ ID NO: 1173301 - RNA, 14 nt, Homo sapiens
cucagccagcacuu

SEQ ID NO: 1173302 - RNA, 18 nt, Homo sapiens
cucagccuacuccgcuca

SEQ ID NO: 1173303 - RNA, 21 nt, Homo sapiens
cucagccuugccagagaucca

SEQ ID NO: 1173304 - RNA, 21 nt, Homo sapiens
cucagccuuggcagcccugau

SEQ ID NO: 1173305 - RNA, 19 nt, Homo sapiens
cucagcuagacauugcaau

SEQ ID NO: 1173306 - RNA, 19 nt, Homo sapiens
cucagcucccacaaaugac

SEQ ID NO: 1173307 - RNA, 22 nt, Homo sapiens
cucagcucugguccaggcccug

SEQ ID NO: 1173308 - RNA, 13 nt, Homo sapiens
cucagcuuaucuc

SEQ ID NO: 1173309 - RNA, 16 nt, Homo sapiens
cucaggaaccgaggca

SEQ ID NO: 1173310 - RNA, 14 nt, Homo sapiens
cucaggagacuugu

SEQ ID NO: 1173311 - RNA, 13 nt, Homo sapiens
cucaggcaccugc

SEQ ID NO: 1173312 - RNA, 21 nt, Homo sapiens
cucaggccugaggugugugcc

SEQ ID NO: 1173313 - RNA, 18 nt, Homo sapiens
cucaggggacacuggccc

SEQ ID NO: 1173314 - RNA, 21 nt, Homo sapiens
cucaggggugauaacucagga

SEQ ID NO: 1173315 - RNA, 16 nt, Homo sapiens
cucaggugaccaaaac

SEQ ID NO: 1173316 - RNA, 10 nt, Homo sapiens
cucagugcag

SEQ ID NO: 1173317 - RNA, 23 nt, Homo sapiens
cucaguuauuacauguaauuuga

SEQ ID NO: 1173318 - RNA, 15 nt, Homo sapiens
cucauaaacauuuga

SEQ ID NO: 1173319 - RNA, 19 nt, Homo sapiens
cucauaacucugugaucuu

SEQ ID NO: 1173320 - RNA, 21 nt, Homo sapiens
cucauagugaacacagcagac

SEQ ID NO: 1173321 - RNA, 17 nt, Homo sapiens
cucaucagaaacucaaa

SEQ ID NO: 1173322 - RNA, 17 nt, Homo sapiens
cucaucaggaguuccag

SEQ ID NO: 1173323 - RNA, 15 nt, Homo sapiens
cucaucugccuggaa

SEQ ID NO: 1173324 - RNA, 14 nt, Homo sapiens
cucaucuuacugua

SEQ ID NO: 1173325 - RNA, 19 nt, Homo sapiens
cucaugagugccaagcaaa

SEQ ID NO: 1173326 - RNA, 20 nt, Homo sapiens
cucaugccucuaaucucagc

SEQ ID NO: 1173327 - RNA, 20 nt, Homo sapiens
cucauguauaaaacuaggaa

SEQ ID NO: 1173328 - RNA, 15 nt, Homo sapiens
cucaugugugaaaua

SEQ ID NO: 1173329 - RNA, 13 nt, Homo sapiens
cucauuagacugg

SEQ ID NO: 1173330 - RNA, 12 nt, Homo sapiens
cucauucaaaag

SEQ ID NO: 1173331 - RNA, 15 nt, Homo sapiens
cuuuuuauuccuaga

SEQ ID NO: 1173332 - RNA, 16 nt, Homo sapiens
cuuuuucauguaugua

SEQ ID NO: 1173333 - RNA, 20 nt, Homo sapiens
cuuuuugcugccugugagca

SEQ ID NO: 1173334 - RNA, 14 nt, Homo sapiens
cuuuuuuauacuca

SEQ ID NO: 1173335 - RNA, 21 nt, Homo sapiens
cuuuuuuuaaauuuucuccag

SEQ ID NO: 1173336 - RNA, 14 nt, Homo sapiens
cuuuuuuucuuggc

SEQ ID NO: 1173337 - RNA, 16 nt, Homo sapiens
gaaaaaaagugcuaaa

SEQ ID NO: 1173338 - RNA, 14 nt, Homo sapiens
gaaaaaaaguuucu

SEQ ID NO: 1173339 - RNA, 22 nt, Homo sapiens
gaaaaaacugugccuuguuuca

SEQ ID NO: 1173340 - RNA, 13 nt, Homo sapiens
gaaaaaaguuacu

SEQ ID NO: 1173341 - RNA, 16 nt, Homo sapiens
gaaaaaaucacuguuu

SEQ ID NO: 1173342 - RNA, 19 nt, Homo sapiens
gaaaaaauuagcugggcau

SEQ ID NO: 1173343 - RNA, 16 nt, Homo sapiens
gaaaaaauucucuuaa

SEQ ID NO: 1173344 - RNA, 14 nt, Homo sapiens
gaaaaacaacaaau

SEQ ID NO: 1173345 - RNA, 15 nt, Homo sapiens
gaaaaacaacccagc

SEQ ID NO: 1173346 - RNA, 16 nt, Homo sapiens
gaaaaacaacccagcg

SEQ ID NO: 1173347 - RNA, 21 nt, Homo sapiens
gaaaaacaaguuugcuaguga

SEQ ID NO: 1173348 - RNA, 18 nt, Homo sapiens
gaaaaacugcagucauca

SEQ ID NO: 1173349 - RNA, 12 nt, Homo sapiens
gaaaaacuugug

SEQ ID NO: 1173350 - RNA, 22 nt, Homo sapiens
gaaaaagccaaggugucauuua

SEQ ID NO: 1173351 - RNA, 13 nt, Homo sapiens
gaaaaagcgcugu

SEQ ID NO: 1173352 - RNA, 19 nt, Homo sapiens
gaaaaaguuaaacauugaa

SEQ ID NO: 1173353 - RNA, 15 nt, Homo sapiens
gaaaaauaauauuca

SEQ ID NO: 1173354 - RNA, 14 nt, Homo sapiens
gaaaaauaaugacu

SEQ ID NO: 1173355 - RNA, 18 nt, Homo sapiens
gaaaaauauauuggcaaa

SEQ ID NO: 1173356 - RNA, 12 nt, Homo sapiens
gaaaacaauucu

SEQ ID NO: 1173357 - RNA, 19 nt, Homo sapiens
gaaaacacuguuucuggua

SEQ ID NO: 1173358 - RNA, 22 nt, Homo sapiens
gaaaacucagaaugaaaauuca

SEQ ID NO: 1173359 - RNA, 12 nt, Homo sapiens
gaaaacuggaaa

SEQ ID NO: 1173360 - RNA, 15 nt, Homo sapiens
gaaaagaaaccagag

SEQ ID NO: 1173361 - RNA, 23 nt, Homo sapiens
gaaaagauucccacccaauucaa

SEQ ID NO: 1173362 - RNA, 15 nt, Homo sapiens
gaaaagccaugugua

SEQ ID NO: 1173363 - RNA, 14 nt, Homo sapiens
gaaaagcgucuuua

SEQ ID NO: 1173364 - RNA, 20 nt, Homo sapiens
gaaaaggaggggacgggaca

SEQ ID NO: 1173365 - RNA, 16 nt, Homo sapiens
gaaaagggucuuggga

SEQ ID NO: 1173366 - RNA, 20 nt, Homo sapiens
gaaaagugcauauuuaucca

SEQ ID NO: 1173367 - RNA, 11 nt, Homo sapiens
gaaaaguuauu

SEQ ID NO: 1173368 - RNA, 13 nt, Homo sapiens
gaaaauaaagugu

SEQ ID NO: 1173369 - RNA, 16 nt, Homo sapiens
gaaaauaaaguguaua

SEQ ID NO: 1173370 - RNA, 14 nt, Homo sapiens
gaaaauaacaaagc

SEQ ID NO: 1173371 - RNA, 21 nt, Homo sapiens
gaaaauaaucugguguucuug

SEQ ID NO: 1173372 - RNA, 14 nt, Homo sapiens
gaaaauaugcauaa

SEQ ID NO: 1173373 - RNA, 14 nt, Homo sapiens
gaaaauauuuaaag

SEQ ID NO: 1173374 - RNA, 21 nt, Homo sapiens
gaaaauauuuuguugccuuca

SEQ ID NO: 1173375 - RNA, 17 nt, Homo sapiens
gaaaaugagagcagaaa

SEQ ID NO: 1173376 - RNA, 22 nt, Homo sapiens
gaaaaugcagcagggaugcccu

SEQ ID NO: 1173377 - RNA, 15 nt, Homo sapiens
gaaaauggaaccagg

SEQ ID NO: 1173378 - RNA, 17 nt, Homo sapiens
gaaaauguguucucgga

SEQ ID NO: 1173379 - RNA, 16 nt, Homo sapiens
gaaaauguucauuuua

SEQ ID NO: 1173380 - RNA, 20 nt, Homo sapiens
gaaaauuauugaguaugagu

SEQ ID NO: 1173381 - RNA, 14 nt, Homo sapiens
gaaaauuauuugca

SEQ ID NO: 1173382 - RNA, 21 nt, Homo sapiens
gaaaauucagcggcagugugu

SEQ ID NO: 1173383 - RNA, 21 nt, Homo sapiens
gaaaauuucaacgucauuccu

SEQ ID NO: 1173384 - RNA, 19 nt, Homo sapiens
gaaacaaacuacuguguca

SEQ ID NO: 1173385 - RNA, 20 nt, Homo sapiens
gaaacaaauaauuugaacuu

SEQ ID NO: 1173386 - RNA, 22 nt, Homo sapiens
gaaacaacaauuucuacuuuga

SEQ ID NO: 1173387 - RNA, 16 nt, Homo sapiens
gaaacaacacaguuuu

SEQ ID NO: 1173388 - RNA, 13 nt, Homo sapiens
gaaacaacagcuu

SEQ ID NO: 1173389 - RNA, 13 nt, Homo sapiens
gaaacaacucuuu

SEQ ID NO: 1173390 - RNA, 15 nt, Homo sapiens
gaaacaaggcugcca

SEQ ID NO: 1173391 - RNA, 17 nt, Homo sapiens
gaaacaccaguaccuga

SEQ ID NO: 1173392 - RNA, 20 nt, Homo sapiens
gaaacacuauuugugacuuu

SEQ ID NO: 1173393 - RNA, 15 nt, Homo sapiens
gaaacacuccuugca

SEQ ID NO: 1173394 - RNA, 22 nt, Homo sapiens
gaaacaggcgcggggucucagg

SEQ ID NO: 1173395 - RNA, 21 nt, Homo sapiens
gaaaccaaagcuuuauuucaa

SEQ ID NO: 1173396 - RNA, 15 nt, Homo sapiens
gaaaccagagucaaa

SEQ ID NO: 1173397 - RNA, 17 nt, Homo sapiens
gaaacccccaguguaau

SEQ ID NO: 1173398 - RNA, 13 nt, Homo sapiens
gaaaccugaguga

SEQ ID NO: 1173399 - RNA, 12 nt, Homo sapiens
gaaacgucuccc

SEQ ID NO: 1173400 - RNA, 14 nt, Homo sapiens
gaaacuaaagcaau

SEQ ID NO: 1173401 - RNA, 20 nt, Homo sapiens
gaaacuaauauuuuauguga

SEQ ID NO: 1173402 - RNA, 21 nt, Homo sapiens
gaaacuauaaaguuuuauuug

SEQ ID NO: 1173403 - RNA, 22 nt, Homo sapiens
gaaacucuacauguaacuauuu

SEQ ID NO: 1173404 - RNA, 16 nt, Homo sapiens
gaaacucuacccugaa

SEQ ID NO: 1173405 - RNA, 17 nt, Homo sapiens
gaaacuguaugugcugu

SEQ ID NO: 1173406 - RNA, 16 nt, Homo sapiens
gaaacuguucccaccu

SEQ ID NO: 1173407 - RNA, 12 nt, Homo sapiens
gaaacuuaccug

SEQ ID NO: 1173408 - RNA, 18 nt, Homo sapiens
gaaacuuacuaaauauca

SEQ ID NO: 1173409 - RNA, 14 nt, Homo sapiens
gaaacuuagaucau

SEQ ID NO: 1173410 - RNA, 18 nt, Homo sapiens
gaaacuugugaaguggaa

SEQ ID NO: 1173411 - RNA, 15 nt, Homo sapiens
gaaagaaaaugaauu

SEQ ID NO: 1173412 - RNA, 15 nt, Homo sapiens
gaaagaaaauuuaau

SEQ ID NO: 1173413 - RNA, 16 nt, Homo sapiens
gaaagaaaauuuaaua

SEQ ID NO: 1173414 - RNA, 18 nt, Homo sapiens
gaaagaauuugccuucuc

SEQ ID NO: 1173415 - RNA, 22 nt, Homo sapiens
gaaagacaagcucaaguguuca

SEQ ID NO: 1173416 - RNA, 15 nt, Homo sapiens
gaaagacacugccug

SEQ ID NO: 1173417 - RNA, 12 nt, Homo sapiens
gaaagacaucca

SEQ ID NO: 1173418 - RNA, 13 nt, Homo sapiens
gaaagacauuuca

SEQ ID NO: 1173419 - RNA, 22 nt, Homo sapiens
gaaagaggccagacaugguguc

SEQ ID NO: 1173420 - RNA, 13 nt, Homo sapiens
gaaagaucaaaga

SEQ ID NO: 1173421 - RNA, 14 nt, Homo sapiens
gaaagaugaugcuc

SEQ ID NO: 1173422 - RNA, 13 nt, Homo sapiens
gaaagaugcauuu

SEQ ID NO: 1173423 - RNA, 13 nt, Homo sapiens
gaaagauuacuuu

SEQ ID NO: 1173424 - RNA, 11 nt, Homo sapiens
gaaagcacuua

SEQ ID NO: 1173425 - RNA, 13 nt, Homo sapiens
gaaagcauuauuu

SEQ ID NO: 1173426 - RNA, 15 nt, Homo sapiens
gaaagcucuaaagac

SEQ ID NO: 1173427 - RNA, 18 nt, Homo sapiens
gaaagcugacauugccaa

SEQ ID NO: 1173428 - RNA, 21 nt, Homo sapiens
gaaaggaaauaguaccuucaa

SEQ ID NO: 1173429 - RNA, 22 nt, Homo sapiens
gaaaggacguggaugaagcaga

SEQ ID NO: 1173430 - RNA, 16 nt, Homo sapiens
gaaaggcaagggaggu

SEQ ID NO: 1173431 - RNA, 22 nt, Homo sapiens
gaaagggaagaucuuaugccuu

SEQ ID NO: 1173432 - RNA, 14 nt, Homo sapiens
gaaagggacaauga

SEQ ID NO: 1173433 - RNA, 23 nt, Homo sapiens
gaaagggcaguggacgugcugcg

SEQ ID NO: 1173434 - RNA, 20 nt, Homo sapiens
gaaagggucuuccuucucau

SEQ ID NO: 1173435 - RNA, 15 nt, Homo sapiens
gaaaggucuaugcag

SEQ ID NO: 1173436 - RNA, 13 nt, Homo sapiens
gaaaggugcccuu

SEQ ID NO: 1173437 - RNA, 19 nt, Homo sapiens
gaaagguuggccuuacugu

SEQ ID NO: 1173438 - RNA, 22 nt, Homo sapiens
gaaagguuggccuuacuguuga

SEQ ID NO: 1173439 - RNA, 17 nt, Homo sapiens
gaaaguauucuguacuc

SEQ ID NO: 1173440 - RNA, 17 nt, Homo sapiens
gaaaguauuggcauuca

SEQ ID NO: 1173441 - RNA, 20 nt, Homo sapiens
gaaaguccagcuaacauacu

SEQ ID NO: 1173442 - RNA, 15 nt, Homo sapiens
gaaaguucauggaac

SEQ ID NO: 1173443 - RNA, 18 nt, Homo sapiens
gaaauaaaaggaagccaa

SEQ ID NO: 1173444 - RNA, 22 nt, Homo sapiens
gaaauaaaaucuaauuaauucu

SEQ ID NO: 1173445 - RNA, 17 nt, Homo sapiens
gaaauaaauuuauuuca

SEQ ID NO: 1173446 - RNA, 18 nt, Homo sapiens
gaaauaagcccaacagac

SEQ ID NO: 1173447 - RNA, 14 nt, Homo sapiens
gaaauaauagcaau

SEQ ID NO: 1173448 - RNA, 19 nt, Homo sapiens
gaaauaauuuuuagaaucu

SEQ ID NO: 1173449 - RNA, 22 nt, Homo sapiens
gaaauaguaccuucaauacuua

SEQ ID NO: 1173450 - RNA, 13 nt, Homo sapiens
gaaauauauuuga

SEQ ID NO: 1173451 - RNA, 21 nt, Homo sapiens
gaaauaugaugagauucacuu

SEQ ID NO: 1173452 - RNA, 19 nt, Homo sapiens
gaaauccgucuaguuaaca

SEQ ID NO: 1173453 - RNA, 17 nt, Homo sapiens
gaaaucuguccuguggc

SEQ ID NO: 1173454 - RNA, 20 nt, Homo sapiens
gaaaucugucuugucauuuu

SEQ ID NO: 1173455 - RNA, 18 nt, Homo sapiens
gaaaugaaaggugacaaa

SEQ ID NO: 1173456 - RNA, 15 nt, Homo sapiens
gaaaugaacuuuguc

SEQ ID NO: 1173457 - RNA, 21 nt, Homo sapiens
gaaaugaauuccucauuugga

SEQ ID NO: 1173458 - RNA, 22 nt, Homo sapiens
gaaaugaugaaaagguugccug

SEQ ID NO: 1173459 - RNA, 14 nt, Homo sapiens
gaaaugucaugugg

SEQ ID NO: 1173460 - RNA, 22 nt, Homo sapiens
gaaaugugguagccucacuuuu

SEQ ID NO: 1173461 - RNA, 20 nt, Homo sapiens
gaaauguguggucgagcuuu

SEQ ID NO: 1173462 - RNA, 14 nt, Homo sapiens
gaaauuuacuacag

SEQ ID NO: 1173463 - RNA, 13 nt, Homo sapiens
gaacaaccaagca

SEQ ID NO: 1173464 - RNA, 23 nt, Homo sapiens
gaacaagauggauggaaagggag

SEQ ID NO: 1173465 - RNA, 16 nt, Homo sapiens
gaacaagcaaacccag

SEQ ID NO: 1173466 - RNA, 23 nt, Homo sapiens
gaacaccauaccuuugcuacuac

SEQ ID NO: 1173467 - RNA, 18 nt, Homo sapiens
gaacacuaguauggccag

SEQ ID NO: 1173468 - RNA, 17 nt, Homo sapiens
gaacacugaaacuguau

SEQ ID NO: 1173469 - RNA, 21 nt, Homo sapiens
gaacagaagaaaauaauauga

SEQ ID NO: 1173470 - RNA, 15 nt, Homo sapiens
gaacagaugcugagc

SEQ ID NO: 1173471 - RNA, 21 nt, Homo sapiens
gaacaggaaugcugggcuguu

SEQ ID NO: 1173472 - RNA, 11 nt, Homo sapiens
gaacagggaag

SEQ ID NO: 1173473 - RNA, 20 nt, Homo sapiens
gaacagucauuaauuuucaa

SEQ ID NO: 1173474 - RNA, 15 nt, Homo sapiens
gaacaguuguccagg

SEQ ID NO: 1173475 - RNA, 17 nt, Homo sapiens
gaacaucauaacccaug

SEQ ID NO: 1173476 - RNA, 17 nt, Homo sapiens
gaacauccaaccuuccc

SEQ ID NO: 1173477 - RNA, 18 nt, Homo sapiens
gaacaucccugccagcuc

SEQ ID NO: 1173478 - RNA, 23 nt, Homo sapiens
gaacaugcccacaacuugucacc

SEQ ID NO: 1173479 - RNA, 19 nt, Homo sapiens
gaacauucagauuuaccau

SEQ ID NO: 1173480 - RNA, 22 nt, Homo sapiens
gaaccaggaauauuuccuccau

SEQ ID NO: 1173481 - RNA, 13 nt, Homo sapiens
gaaccaugcagga

SEQ ID NO: 1173482 - RNA, 21 nt, Homo sapiens
gaaccguaggacccaagcaga

SEQ ID NO: 1173483 - RNA, 23 nt, Homo sapiens
gaaccuaaguggggaaaauccua

SEQ ID NO: 1173484 - RNA, 17 nt, Homo sapiens
gaaccuccucugugaag

SEQ ID NO: 1173485 - RNA, 15 nt, Homo sapiens
gaaccuggaacuugg

SEQ ID NO: 1173486 - RNA, 18 nt, Homo sapiens
gaaccuggguugcagaca

SEQ ID NO: 1173487 - RNA, 23 nt, Homo sapiens
gaacucaaauggggccagaucca

SEQ ID NO: 1173488 - RNA, 14 nt, Homo sapiens
gaacucacuggggc

SEQ ID NO: 1173489 - RNA, 19 nt, Homo sapiens
gaacuccuaaccucaagug

SEQ ID NO: 1173490 - RNA, 21 nt, Homo sapiens
gaacuccugaccucaagugau

SEQ ID NO: 1173491 - RNA, 21 nt, Homo sapiens
gaacuccuggccucaagccau

SEQ ID NO: 1173492 - RNA, 19 nt, Homo sapiens
gaacucgccucagccugau

SEQ ID NO: 1173493 - RNA, 19 nt, Homo sapiens
gaacucuucacucuucaaa

SEQ ID NO: 1173494 - RNA, 14 nt, Homo sapiens
gaacucuugcuauc

SEQ ID NO: 1173495 - RNA, 22 nt, Homo sapiens
gaacugacaggcagccuggaca

SEQ ID NO: 1173496 - RNA, 16 nt, Homo sapiens
gaacugagcaucucca

SEQ ID NO: 1173497 - RNA, 18 nt, Homo sapiens
gaacugauucacaucuca

SEQ ID NO: 1173498 - RNA, 20 nt, Homo sapiens
gaacugcgcagccuuaccca

SEQ ID NO: 1173499 - RNA, 22 nt, Homo sapiens
gaacuggagccaugggcacaaa

SEQ ID NO: 1173500 - RNA, 16 nt, Homo sapiens
gaacugguaccaucua

SEQ ID NO: 1173501 - RNA, 17 nt, Homo sapiens
gaacuguauuauugcaa

SEQ ID NO: 1173502 - RNA, 19 nt, Homo sapiens
gaacuuaagagaggggcca

SEQ ID NO: 1173503 - RNA, 22 nt, Homo sapiens
gaacuuacauacuaggugccuu

SEQ ID NO: 1173504 - RNA, 20 nt, Homo sapiens
gaacuucacagugacacugg

SEQ ID NO: 1173505 - RNA, 16 nt, Homo sapiens
gaacuucacgauuccu

SEQ ID NO: 1173506 - RNA, 18 nt, Homo sapiens
gaacuucuccuacuguag

SEQ ID NO: 1173507 - RNA, 19 nt, Homo sapiens
gaacuucugaacuuggaaa

SEQ ID NO: 1173508 - RNA, 21 nt, Homo sapiens
gaacuuugcauagcagcugcu

SEQ ID NO: 1173509 - RNA, 14 nt, Homo sapiens
gaagaaaacaucua

SEQ ID NO: 1173510 - RNA, 21 nt, Homo sapiens
gaagaacagcuguuccugugu

SEQ ID NO: 1173511 - RNA, 13 nt, Homo sapiens
gaagaagagccac

SEQ ID NO: 1173512 - RNA, 17 nt, Homo sapiens
gaagaagcccuguucuc

SEQ ID NO: 1173513 - RNA, 15 nt, Homo sapiens
gaagaauauucccaa

SEQ ID NO: 1173514 - RNA, 14 nt, Homo sapiens
gaagaauugccaau

SEQ ID NO: 1173515 - RNA, 19 nt, Homo sapiens
gaagacuguugugcuccau

SEQ ID NO: 1173516 - RNA, 12 nt, Homo sapiens
gaagacuugccc

SEQ ID NO: 1173517 - RNA, 18 nt, Homo sapiens
gaagagagagacugugga

SEQ ID NO: 1173518 - RNA, 14 nt, Homo sapiens
gaagagauccaaag

SEQ ID NO: 1173519 - RNA, 16 nt, Homo sapiens
gaagagauccaaagac

SEQ ID NO: 1173520 - RNA, 18 nt, Homo sapiens
gaagagccggagccucca

SEQ ID NO: 1173521 - RNA, 15 nt, Homo sapiens
gaagagcucaaggga

SEQ ID NO: 1173522 - RNA, 12 nt, Homo sapiens
gaagagucauuu

SEQ ID NO: 1173523 - RNA, 19 nt, Homo sapiens
gaagaguggguuucacaag

SEQ ID NO: 1173524 - RNA, 15 nt, Homo sapiens
gaagaguuaaaacag

SEQ ID NO: 1173525 - RNA, 15 nt, Homo sapiens
gaagaguuggaguga

SEQ ID NO: 1173526 - RNA, 15 nt, Homo sapiens
gaagauccagcuuuu

SEQ ID NO: 1173527 - RNA, 12 nt, Homo sapiens
gaagaugcauug

SEQ ID NO: 1173528 - RNA, 19 nt, Homo sapiens
gaagauggcauccugugaa

SEQ ID NO: 1173529 - RNA, 16 nt, Homo sapiens
gaagaugggguuugua

SEQ ID NO: 1173530 - RNA, 18 nt, Homo sapiens
gaagcaaggcacaaguca

SEQ ID NO: 1173531 - RNA, 18 nt, Homo sapiens
gaagcaaguuuucuucca

SEQ ID NO: 1173532 - RNA, 22 nt, Homo sapiens
gaagcacuacagagcaucccac

SEQ ID NO: 1173533 - RNA, 20 nt, Homo sapiens
gaagcaggagauuugcuuga

SEQ ID NO: 1173534 - RNA, 21 nt, Homo sapiens
gaagcagucauaccugcuccu

SEQ ID NO: 1173535 - RNA, 22 nt, Homo sapiens
gaagccuguccucaccgucucg

SEQ ID NO: 1173536 - RNA, 14 nt, Homo sapiens
gaagccuuugccag

SEQ ID NO: 1173537 - RNA, 18 nt, Homo sapiens
gaagcucaucaaagccca

SEQ ID NO: 1173538 - RNA, 17 nt, Homo sapiens
gaagcugcccucagcca

SEQ ID NO: 1173539 - RNA, 20 nt, Homo sapiens
gaagcugcugugacuguguc

SEQ ID NO: 1173540 - RNA, 22 nt, Homo sapiens
gaagcugcugugacuguguccc

SEQ ID NO: 1173541 - RNA, 22 nt, Homo sapiens
gaagcugguccuguccagacac

SEQ ID NO: 1173542 - RNA, 13 nt, Homo sapiens
gaagcuguugcua

SEQ ID NO: 1173543 - RNA, 14 nt, Homo sapiens
gaagcuucaugcca

SEQ ID NO: 1173544 - RNA, 21 nt, Homo sapiens
gaagcuuuggugagaaccugg

SEQ ID NO: 1173545 - RNA, 19 nt, Homo sapiens
gaaggaaaagauacccaaa

SEQ ID NO: 1173546 - RNA, 15 nt, Homo sapiens
gaaggaaccaaagcg

SEQ ID NO: 1173547 - RNA, 17 nt, Homo sapiens
gaaggaagcuguguuga

SEQ ID NO: 1173548 - RNA, 20 nt, Homo sapiens
gaaggacauuuucucuuuaa

SEQ ID NO: 1173549 - RNA, 12 nt, Homo sapiens
gaaggacuauga

SEQ ID NO: 1173550 - RNA, 18 nt, Homo sapiens
gaaggagauagauuugug

SEQ ID NO: 1173551 - RNA, 23 nt, Homo sapiens
gaaggagcgugcucuacccugug

SEQ ID NO: 1173552 - RNA, 15 nt, Homo sapiens
gaaggauaaaagccc

SEQ ID NO: 1173553 - RNA, 12 nt, Homo sapiens
gaaggcaaaauu

SEQ ID NO: 1173554 - RNA, 14 nt, Homo sapiens
gaaggcaaacccau

SEQ ID NO: 1173555 - RNA, 14 nt, Homo sapiens
gaaggcagagccau

SEQ ID NO: 1173556 - RNA, 17 nt, Homo sapiens
gaaggccgaggucccau

SEQ ID NO: 1173557 - RNA, 16 nt, Homo sapiens
gaaggcuuguugugcu

SEQ ID NO: 1173558 - RNA, 15 nt, Homo sapiens
gaagggaauccuccu

SEQ ID NO: 1173559 - RNA, 17 nt, Homo sapiens
gaagggaauugcucaga

SEQ ID NO: 1173560 - RNA, 18 nt, Homo sapiens
gaagggagcuagccagag

SEQ ID NO: 1173561 - RNA, 12 nt, Homo sapiens
gaagggccagag

SEQ ID NO: 1173562 - RNA, 23 nt, Homo sapiens
gaaggugugcuacagaaaauaau

SEQ ID NO: 1173563 - RNA, 14 nt, Homo sapiens
gaagguuaccaaga

SEQ ID NO: 1173564 - RNA, 20 nt, Homo sapiens
gaaguagacucauucuucac

SEQ ID NO: 1173565 - RNA, 21 nt, Homo sapiens
gaaguagacucauucuucaca

SEQ ID NO: 1173566 - RNA, 13 nt, Homo sapiens
gaaguagauucug

SEQ ID NO: 1173567 - RNA, 20 nt, Homo sapiens
gaagucagagagggugacaa

SEQ ID NO: 1173568 - RNA, 13 nt, Homo sapiens
gaagucaucucau

SEQ ID NO: 1173569 - RNA, 22 nt, Homo sapiens
gaagucaugggaacgcagccuc

SEQ ID NO: 1173570 - RNA, 13 nt, Homo sapiens
gaagugaacacuu

SEQ ID NO: 1173571 - RNA, 19 nt, Homo sapiens
gaagugcuacagaaagcac

SEQ ID NO: 1173572 - RNA, 21 nt, Homo sapiens
gaagugcuacagaaagcacaa

SEQ ID NO: 1173573 - RNA, 11 nt, Homo sapiens
gaagugcuugc

SEQ ID NO: 1173574 - RNA, 11 nt, Homo sapiens
gaaguguaauu

SEQ ID NO: 1173575 - RNA, 17 nt, Homo sapiens
gaaguguucugcugaga

SEQ ID NO: 1173576 - RNA, 23 nt, Homo sapiens
gaaguucauuuuuaucccuuccu

SEQ ID NO: 1173577 - RNA, 15 nt, Homo sapiens
gaaguuuacaaucaa

SEQ ID NO: 1173578 - RNA, 21 nt, Homo sapiens
gaaguuuuaaauuuugacaag

SEQ ID NO: 1173579 - RNA, 19 nt, Homo sapiens
gaauaaacuagacucugaa

SEQ ID NO: 1173580 - RNA, 17 nt, Homo sapiens
gaauaacuugcuacuca

SEQ ID NO: 1173581 - RNA, 13 nt, Homo sapiens
gaauaaucacuug

SEQ ID NO: 1173582 - RNA, 12 nt, Homo sapiens
gaauaauugcau

SEQ ID NO: 1173583 - RNA, 14 nt, Homo sapiens
gaauaccagcuuuc

SEQ ID NO: 1173584 - RNA, 17 nt, Homo sapiens
gaauacuacuacaggaa

SEQ ID NO: 1173585 - RNA, 16 nt, Homo sapiens
gaauacugcagcacuc

SEQ ID NO: 1173586 - RNA, 12 nt, Homo sapiens
gaauagaacucu

SEQ ID NO: 1173587 - RNA, 21 nt, Homo sapiens
gaauauaaagccucaaaucuu

SEQ ID NO: 1173588 - RNA, 12 nt, Homo sapiens
gaauaucuagca

SEQ ID NO: 1173589 - RNA, 15 nt, Homo sapiens
gaauaucugguuucu

SEQ ID NO: 1173590 - RNA, 21 nt, Homo sapiens
gaauaugauaaaacacugccc

SEQ ID NO: 1173591 - RNA, 18 nt, Homo sapiens
gaauauucccaagcccau

SEQ ID NO: 1173592 - RNA, 14 nt, Homo sapiens
gaauauuuagcaua

SEQ ID NO: 1173593 - RNA, 20 nt, Homo sapiens
gaauauuuuaagaauuucac

SEQ ID NO: 1173594 - RNA, 15 nt, Homo sapiens
gaaucaaaagugccu

SEQ ID NO: 1173595 - RNA, 14 nt, Homo sapiens
gaaucaacauuucu

SEQ ID NO: 1173596 - RNA, 17 nt, Homo sapiens
gaaucagaucauuucaa

SEQ ID NO: 1173597 - RNA, 20 nt, Homo sapiens
gaaucccacccacaugugac

SEQ ID NO: 1173598 - RNA, 14 nt, Homo sapiens
gaaucccccaaaga

SEQ ID NO: 1173599 - RNA, 23 nt, Homo sapiens
gaauccgagauaggguggcacau

SEQ ID NO: 1173600 - RNA, 20 nt, Homo sapiens
gaauccuuggugugguuucu

SEQ ID NO: 1173601 - RNA, 17 nt, Homo sapiens
gaaucuacuaauuccac

SEQ ID NO: 1173602 - RNA, 21 nt, Homo sapiens
gaaucucaauguacauagacc

SEQ ID NO: 1173603 - RNA, 16 nt, Homo sapiens
gaaucuccacuacuua

SEQ ID NO: 1173604 - RNA, 20 nt, Homo sapiens
gaaucucuuuuugcuuucga

SEQ ID NO: 1173605 - RNA, 23 nt, Homo sapiens
gaaucugggugggauaauggacu

SEQ ID NO: 1173606 - RNA, 23 nt, Homo sapiens
gaaucuuuaaaagaugcuuuuaa

SEQ ID NO: 1173607 - RNA, 23 nt, Homo sapiens
gaaugaaaauaacugaaccaaau

SEQ ID NO: 1173608 - RNA, 15 nt, Homo sapiens
gaaugaaaauucauu

SEQ ID NO: 1173609 - RNA, 13 nt, Homo sapiens
gaaugaaacaauc

SEQ ID NO: 1173610 - RNA, 17 nt, Homo sapiens
gaaugaaccacugcccc

SEQ ID NO: 1173611 - RNA, 21 nt, Homo sapiens
gaaugaaccuucuggccuccc

SEQ ID NO: 1173612 - RNA, 15 nt, Homo sapiens
gaaugaagaacugca

SEQ ID NO: 1173613 - RNA, 19 nt, Homo sapiens
gaaugagccuacgcugaag

SEQ ID NO: 1173614 - RNA, 16 nt, Homo sapiens
gaaugauaugcauuug

SEQ ID NO: 1173615 - RNA, 18 nt, Homo sapiens
gaaugcagucuguccagg

SEQ ID NO: 1173616 - RNA, 12 nt, Homo sapiens
gaaugcauugau

SEQ ID NO: 1173617 - RNA, 17 nt, Homo sapiens
gaaugggagcugcaaac

SEQ ID NO: 1173618 - RNA, 21 nt, Homo sapiens
gaaugguugaguuacauuaaa

SEQ ID NO: 1173619 - RNA, 23 nt, Homo sapiens
gaauguauuuuucaaaacauaca

SEQ ID NO: 1173620 - RNA, 13 nt, Homo sapiens
gaaugugugccuu

SEQ ID NO: 1173621 - RNA, 21 nt, Homo sapiens
gaaugugugccuuguucaagg

SEQ ID NO: 1173622 - RNA, 20 nt, Homo sapiens
gaauguguuucaaacuguaa

SEQ ID NO: 1173623 - RNA, 19 nt, Homo sapiens
gaauuacuccaaaaagaca

SEQ ID NO: 1173624 - RNA, 13 nt, Homo sapiens
gaauuacuguaac

SEQ ID NO: 1173625 - RNA, 12 nt, Homo sapiens
gaauuacuugug

SEQ ID NO: 1173626 - RNA, 21 nt, Homo sapiens
gaauuagauuucuauaggauu

SEQ ID NO: 1173627 - RNA, 13 nt, Homo sapiens
gaauucaaacugg

SEQ ID NO: 1173628 - RNA, 16 nt, Homo sapiens
gaauucaaacuggggc

SEQ ID NO: 1173629 - RNA, 16 nt, Homo sapiens
gaauucacaaugcauu

SEQ ID NO: 1173630 - RNA, 12 nt, Homo sapiens
gaauucuacuga

SEQ ID NO: 1173631 - RNA, 16 nt, Homo sapiens
gaauucuuuugccaag

SEQ ID NO: 1173632 - RNA, 14 nt, Homo sapiens
gaauugaaacacuu

SEQ ID NO: 1173633 - RNA, 23 nt, Homo sapiens
gaauugacaacccaaacucucca

SEQ ID NO: 1173634 - RNA, 15 nt, Homo sapiens
gaauugacucaaaaa

SEQ ID NO: 1173635 - RNA, 21 nt, Homo sapiens
gaauugauauguauguuguga

SEQ ID NO: 1173636 - RNA, 21 nt, Homo sapiens
gaauuuaaaaaaacgagcaau

SEQ ID NO: 1173637 - RNA, 15 nt, Homo sapiens
gaauuuaaaaucaua

SEQ ID NO: 1173638 - RNA, 19 nt, Homo sapiens
gaauuuacauauagcugau

SEQ ID NO: 1173639 - RNA, 19 nt, Homo sapiens
gaauuuauugcacauuguu

SEQ ID NO: 1173640 - RNA, 13 nt, Homo sapiens
gaauuucaaacau

SEQ ID NO: 1173641 - RNA, 14 nt, Homo sapiens
gaauuucacaagcu

SEQ ID NO: 1173642 - RNA, 13 nt, Homo sapiens
gaauuucccacau

SEQ ID NO: 1173643 - RNA, 14 nt, Homo sapiens
gaauuugcaaagua

SEQ ID NO: 1173644 - RNA, 23 nt, Homo sapiens
gaauuuggcucuucugacauuua

SEQ ID NO: 1173645 - RNA, 15 nt, Homo sapiens
gaauuuguaagcaac

SEQ ID NO: 1173646 - RNA, 21 nt, Homo sapiens
gaauuuuuacuuagauacuaa

SEQ ID NO: 1173647 - RNA, 14 nt, Homo sapiens
gacaaaaagggugg

SEQ ID NO: 1173648 - RNA, 12 nt, Homo sapiens
gacaaacaguga

SEQ ID NO: 1173649 - RNA, 13 nt, Homo sapiens
gacaaagugccaa

SEQ ID NO: 1173650 - RNA, 15 nt, Homo sapiens
gacaaagugccaaag

SEQ ID NO: 1173651 - RNA, 18 nt, Homo sapiens
gacaaauacucaugugua

SEQ ID NO: 1173652 - RNA, 20 nt, Homo sapiens
gacaaaugugaagaugcauu

SEQ ID NO: 1173653 - RNA, 16 nt, Homo sapiens
gacaaauucaccuuca

SEQ ID NO: 1173654 - RNA, 13 nt, Homo sapiens
gacaaauucuguu

SEQ ID NO: 1173655 - RNA, 13 nt, Homo sapiens
gacaaauugagac

SEQ ID NO: 1173656 - RNA, 21 nt, Homo sapiens
gacaaauugagacagugcaca

SEQ ID NO: 1173657 - RNA, 14 nt, Homo sapiens
gacaacacugggaa

SEQ ID NO: 1173658 - RNA, 16 nt, Homo sapiens
gacaacagauuuacau

SEQ ID NO: 1173659 - RNA, 12 nt, Homo sapiens
gacaaccaaaag

SEQ ID NO: 1173660 - RNA, 17 nt, Homo sapiens
gacaacgccaacugccc

SEQ ID NO: 1173661 - RNA, 15 nt, Homo sapiens
gacaacucaaugaaa

SEQ ID NO: 1173662 - RNA, 22 nt, Homo sapiens
gacaagagcagccuggggccaa

SEQ ID NO: 1173663 - RNA, 18 nt, Homo sapiens
gacaaggaaaaaauaaca

SEQ ID NO: 1173664 - RNA, 15 nt, Homo sapiens
gacaaggaagcagag

SEQ ID NO: 1173665 - RNA, 21 nt, Homo sapiens
gacaaggagugugaccacuga

SEQ ID NO: 1173666 - RNA, 18 nt, Homo sapiens
gacaaguggacucagggc

SEQ ID NO: 1173667 - RNA, 13 nt, Homo sapiens
gacaaucacgggc

SEQ ID NO: 1173668 - RNA, 22 nt, Homo sapiens
gacaaugcugagguuaugaaca

SEQ ID NO: 1173669 - RNA, 23 nt, Homo sapiens
gacacacuacaccacacacaaca

SEQ ID NO: 1173670 - RNA, 17 nt, Homo sapiens
gacacaggucuuuccua

SEQ ID NO: 1173671 - RNA, 13 nt, Homo sapiens
gacacauaugcac

SEQ ID NO: 1173672 - RNA, 13 nt, Homo sapiens
gacacauucacac

SEQ ID NO: 1173673 - RNA, 17 nt, Homo sapiens
gacacauucacacuggg

SEQ ID NO: 1173674 - RNA, 22 nt, Homo sapiens
gacacauuuagaugcacuacca

SEQ ID NO: 1173675 - RNA, 16 nt, Homo sapiens
gacaccuaggcuaggg

SEQ ID NO: 1173676 - RNA, 20 nt, Homo sapiens
gacaccugggagaaaucugg

SEQ ID NO: 1173677 - RNA, 16 nt, Homo sapiens
gacaccuuuagguucu

SEQ ID NO: 1173678 - RNA, 19 nt, Homo sapiens
gacacuaagaaugaggaau

SEQ ID NO: 1173679 - RNA, 19 nt, Homo sapiens
gacacuccccgaagucuuu

SEQ ID NO: 1173680 - RNA, 18 nt, Homo sapiens
gacacuggccccacagga

SEQ ID NO: 1173681 - RNA, 12 nt, Homo sapiens
gacacugugcua

SEQ ID NO: 1173682 - RNA, 22 nt, Homo sapiens
gacacugugcuacugaaacucc

SEQ ID NO: 1173683 - RNA, 17 nt, Homo sapiens
gacacuuacuccaguaa

SEQ ID NO: 1173684 - RNA, 14 nt, Homo sapiens
gacacuucucagga

SEQ ID NO: 1173685 - RNA, 12 nt, Homo sapiens
gacagaccuuca

SEQ ID NO: 1173686 - RNA, 15 nt, Homo sapiens
gacagaggaugagcu

SEQ ID NO: 1173687 - RNA, 16 nt, Homo sapiens
gacagagggcucaccu

SEQ ID NO: 1173688 - RNA, 19 nt, Homo sapiens
gacagaucaagcugugaga

SEQ ID NO: 1173689 - RNA, 23 nt, Homo sapiens
gacagauggacgcaggcccuguc

SEQ ID NO: 1173690 - RNA, 19 nt, Homo sapiens
gacagauuuaaccucugcc

SEQ ID NO: 1173691 - RNA, 23 nt, Homo sapiens
gacagccacuuuuagcuacugcu

SEQ ID NO: 1173692 - RNA, 14 nt, Homo sapiens
gacagccugaguca

SEQ ID NO: 1173693 - RNA, 13 nt, Homo sapiens
gacagcucuccaa

SEQ ID NO: 1173694 - RNA, 17 nt, Homo sapiens
gacagcuuagaagccau

SEQ ID NO: 1173695 - RNA, 17 nt, Homo sapiens
gacagcuuugcugcuga

SEQ ID NO: 1173696 - RNA, 18 nt, Homo sapiens
gacaggagaaucaccuga

SEQ ID NO: 1173697 - RNA, 19 nt, Homo sapiens
gacaggaggucagcacaag

SEQ ID NO: 1173698 - RNA, 15 nt, Homo sapiens
gacaggcaaauuuca

SEQ ID NO: 1173699 - RNA, 18 nt, Homo sapiens
gacaggcagccuggacau

SEQ ID NO: 1173700 - RNA, 15 nt, Homo sapiens
gacaggcagugccau

SEQ ID NO: 1173701 - RNA, 21 nt, Homo sapiens
gacagggacaugcccugugug

SEQ ID NO: 1173702 - RNA, 17 nt, Homo sapiens
gacagugacgugacuca

SEQ ID NO: 1173703 - RNA, 16 nt, Homo sapiens
gacaguuuaccauccu

SEQ ID NO: 1173704 - RNA, 16 nt, Homo sapiens
gacauaaugggguccu

SEQ ID NO: 1173705 - RNA, 18 nt, Homo sapiens
gacauaauuuaauuccuu

SEQ ID NO: 1173706 - RNA, 14 nt, Homo sapiens
gacauacauuucuc

SEQ ID NO: 1173707 - RNA, 12 nt, Homo sapiens
gacauaccuuuu

SEQ ID NO: 1173708 - RNA, 15 nt, Homo sapiens
gacauagcauccaag

SEQ ID NO: 1173709 - RNA, 13 nt, Homo sapiens
uuuucucugaaaa

SEQ ID NO: 1173710 - RNA, 12 nt, Homo sapiens
uuuucuuuccaa

SEQ ID NO: 1173711 - RNA, 17 nt, Homo sapiens
uuuugaacguaugugcu

SEQ ID NO: 1173712 - RNA, 20 nt, Homo sapiens
uuuugaauucagaccuggaa

SEQ ID NO: 1173713 - RNA, 22 nt, Homo sapiens
uuuugaauuuauauuguuucau

SEQ ID NO: 1173714 - RNA, 14 nt, Homo sapiens
uuuugagaacuuaa

SEQ ID NO: 1173715 - RNA, 21 nt, Homo sapiens
uuuugaguaaagcuccuaucu

SEQ ID NO: 1173716 - RNA, 12 nt, Homo sapiens
uuuugaugacug

SEQ ID NO: 1173717 - RNA, 21 nt, Homo sapiens
uuuugauguauaaaacuugau

SEQ ID NO: 1173718 - RNA, 20 nt, Homo sapiens
uuuugcaauaguuaccucaa

SEQ ID NO: 1173719 - RNA, 13 nt, Homo sapiens
uuuugcacauucu

SEQ ID NO: 1173720 - RNA, 13 nt, Homo sapiens
uuuugcacuauug

SEQ ID NO: 1173721 - RNA, 14 nt, Homo sapiens
uuuugcagaaaaaa

SEQ ID NO: 1173722 - RNA, 15 nt, Homo sapiens
uuuugccaaucucaa

SEQ ID NO: 1173723 - RNA, 21 nt, Homo sapiens
uuuugcuauuccaaucuacaa

SEQ ID NO: 1173724 - RNA, 11 nt, Homo sapiens
uuuugcuggag

SEQ ID NO: 1173725 - RNA, 13 nt, Homo sapiens
uuuuggacacugu

SEQ ID NO: 1173726 - RNA, 15 nt, Homo sapiens
uuuuggagguauuca

SEQ ID NO: 1173727 - RNA, 18 nt, Homo sapiens
uuuuggucauagcauuca

SEQ ID NO: 1173728 - RNA, 17 nt, Homo sapiens
uuuuguaucuacaucuu

SEQ ID NO: 1173729 - RNA, 17 nt, Homo sapiens
uuuuguuaggcuguaaa

SEQ ID NO: 1173730 - RNA, 13 nt, Homo sapiens
uuuuuaacaugua

SEQ ID NO: 1173731 - RNA, 22 nt, Homo sapiens
uuuuuauaaaaaugagugcuua

SEQ ID NO: 1173732 - RNA, 12 nt, Homo sapiens
uuuuuaucucca

SEQ ID NO: 1173733 - RNA, 20 nt, Homo sapiens
uuuccuuuuuuaaaaaugca

SEQ ID NO: 1173734 - RNA, 20 nt, Homo sapiens
uuucgaucccugggaccaac

SEQ ID NO: 1173735 - RNA, 14 nt, Homo sapiens
uuucuaaaccuugu

SEQ ID NO: 1173736 - RNA, 13 nt, Homo sapiens
uuucuaaauuccu

SEQ ID NO: 1173737 - RNA, 23 nt, Homo sapiens
uuucucagacuuuggaaaaugca

SEQ ID NO: 1173738 - RNA, 20 nt, Homo sapiens
uuucucauguuuuccauugu

SEQ ID NO: 1173739 - RNA, 15 nt, Homo sapiens
uuucuccagggucag

SEQ ID NO: 1173740 - RNA, 12 nt, Homo sapiens
uuucuccauugu

SEQ ID NO: 1173741 - RNA, 15 nt, Homo sapiens
uuucucccauuuaga

SEQ ID NO: 1173742 - RNA, 21 nt, Homo sapiens
uuucucuacuccaugguucuc

SEQ ID NO: 1173743 - RNA, 15 nt, Homo sapiens
uuucucuagcuugau

SEQ ID NO: 1173744 - RNA, 17 nt, Homo sapiens
uuucugaaggcuuugug

SEQ ID NO: 1173745 - RNA, 17 nt, Homo sapiens
uuucugagcaaagcauc

SEQ ID NO: 1173746 - RNA, 22 nt, Homo sapiens
uuucugaugggaggaaaguagc

SEQ ID NO: 1173747 - RNA, 15 nt, Homo sapiens
uuucuggcucuccca

SEQ ID NO: 1173748 - RNA, 21 nt, Homo sapiens
uuucugucaagcauauuggaa

SEQ ID NO: 1173749 - RNA, 22 nt, Homo sapiens
uuucuguggucuuacugaucuu

SEQ ID NO: 1173750 - RNA, 18 nt, Homo sapiens
uuucuguucccuugccau

SEQ ID NO: 1173751 - RNA, 17 nt, Homo sapiens
uuucuguucgaaguuca

SEQ ID NO: 1173752 - RNA, 23 nt, Homo sapiens
uuucuguugcuguuaaaauugcu

SEQ ID NO: 1173753 - RNA, 16 nt, Homo sapiens
uuucuuaaaaaacaua

SEQ ID NO: 1173754 - RNA, 13 nt, Homo sapiens
uaccaaguauugu

SEQ ID NO: 1173755 - RNA, 15 nt, Homo sapiens
uaccaauuauggaaa

SEQ ID NO: 1173756 - RNA, 13 nt, Homo sapiens
uaccacucuggca

SEQ ID NO: 1173757 - RNA, 15 nt, Homo sapiens
uaccagcaacuugaa

SEQ ID NO: 1173758 - RNA, 14 nt, Homo sapiens
uaccagggacccug

SEQ ID NO: 1173759 - RNA, 21 nt, Homo sapiens
uaccagugaauuuuugcaaua

SEQ ID NO: 1173760 - RNA, 21 nt, Homo sapiens
uaccauaugccccauucccaa

SEQ ID NO: 1173761 - RNA, 20 nt, Homo sapiens
uaccauugcuguucuacuuu

SEQ ID NO: 1173762 - RNA, 21 nt, Homo sapiens
uaccauuucuugagguaaaag

SEQ ID NO: 1173763 - RNA, 19 nt, Homo sapiens
uaccauuuuaucuuaucuu

SEQ ID NO: 1173764 - RNA, 21 nt, Homo sapiens
uacccaggcccacccaucacg

SEQ ID NO: 1173765 - RNA, 16 nt, Homo sapiens
uacccauacacccccu

SEQ ID NO: 1173766 - RNA, 23 nt, Homo sapiens
uaccccaccacgauguggcccug

SEQ ID NO: 1173767 - RNA, 21 nt, Homo sapiens
uacccccagaggccuuggcca

SEQ ID NO: 1173768 - RNA, 18 nt, Homo sapiens
uaccccuuccagaagcaa

SEQ ID NO: 1173769 - RNA, 19 nt, Homo sapiens
uaccccuuuaagguucaga

SEQ ID NO: 1173770 - RNA, 15 nt, Homo sapiens
uaccccuuuacaaau

SEQ ID NO: 1173771 - RNA, 15 nt, Homo sapiens
gcuccuccagggugu

SEQ ID NO: 1173772 - RNA, 18 nt, Homo sapiens
gcuccuccccacuagcau

SEQ ID NO: 1173773 - RNA, 20 nt, Homo sapiens
gcuccucuccccagcccaga

SEQ ID NO: 1173774 - RNA, 16 nt, Homo sapiens
gcuccugcccagccac

SEQ ID NO: 1173775 - RNA, 18 nt, Homo sapiens
gcuccugcccagccaccc

SEQ ID NO: 1173776 - RNA, 23 nt, Homo sapiens
gcuccuggagcuauucacagugc

SEQ ID NO: 1173777 - RNA, 13 nt, Homo sapiens
gcuccuguggcag

SEQ ID NO: 1173778 - RNA, 22 nt, Homo sapiens
gcucgcuuccgcauccuagucu

SEQ ID NO: 1173779 - RNA, 14 nt, Homo sapiens
gcucuaaaccucag

SEQ ID NO: 1173780 - RNA, 15 nt, Homo sapiens
gcucuaaaccucagg

SEQ ID NO: 1173781 - RNA, 20 nt, Homo sapiens
gcucuaacaaugacauuuau

SEQ ID NO: 1173782 - RNA, 12 nt, Homo sapiens
gcucuacuguua

SEQ ID NO: 1173783 - RNA, 16 nt, Homo sapiens
gcucucaaaucccucu

SEQ ID NO: 1173784 - RNA, 21 nt, Homo sapiens
gcucucccacaucccacugga

SEQ ID NO: 1173785 - RNA, 20 nt, Homo sapiens
gcucucuuuuucuccagggu

SEQ ID NO: 1173786 - RNA, 15 nt, Homo sapiens
gcucugacauucuga

SEQ ID NO: 1173787 - RNA, 20 nt, Homo sapiens
gcucugacuuuacacucggc

SEQ ID NO: 1173788 - RNA, 22 nt, Homo sapiens
gcucugcaucccccaaagccau

SEQ ID NO: 1173789 - RNA, 17 nt, Homo sapiens
gcucugcccaccucucu

SEQ ID NO: 1173790 - RNA, 20 nt, Homo sapiens
gcucugcuugacaacaucug

SEQ ID NO: 1173791 - RNA, 16 nt, Homo sapiens
gcucugucugcucaau

SEQ ID NO: 1173792 - RNA, 16 nt, Homo sapiens
gcucuuauauuuucau

SEQ ID NO: 1173793 - RNA, 17 nt, Homo sapiens
gcucuucagaggagcau

SEQ ID NO: 1173794 - RNA, 22 nt, Homo sapiens
gcucuucagaggagcaucagcu

SEQ ID NO: 1173795 - RNA, 19 nt, Homo sapiens
gcucuuccaggagccaccu

SEQ ID NO: 1173796 - RNA, 13 nt, Homo sapiens
gcucuucugacau

SEQ ID NO: 1173797 - RNA, 21 nt, Homo sapiens
gcucuucuguggaccacugca

SEQ ID NO: 1173798 - RNA, 19 nt, Homo sapiens
gcucuuggcuccacuggga

SEQ ID NO: 1173799 - RNA, 20 nt, Homo sapiens
gcucuuucucuuuguauuuc

SEQ ID NO: 1173800 - RNA, 19 nt, Homo sapiens
gcugaaacuugaacucugg

SEQ ID NO: 1173801 - RNA, 20 nt, Homo sapiens
gcugaauaaugaguuguucc

SEQ ID NO: 1173802 - RNA, 22 nt, Homo sapiens
gcugaauuauuggacagucuca

SEQ ID NO: 1173803 - RNA, 19 nt, Homo sapiens
gcugacacagacauccucu

SEQ ID NO: 1173804 - RNA, 19 nt, Homo sapiens
gcugacaguuuguggcauc

SEQ ID NO: 1173805 - RNA, 15 nt, Homo sapiens
gcugaccuccacagc

SEQ ID NO: 1173806 - RNA, 15 nt, Homo sapiens
gcugagagaaccuca

SEQ ID NO: 1173807 - RNA, 14 nt, Homo sapiens
gcugagaguacugu

SEQ ID NO: 1173808 - RNA, 14 nt, Homo sapiens
gcugagagugcuau

SEQ ID NO: 1173809 - RNA, 14 nt, Homo sapiens
uaaaagacuuugau

SEQ ID NO: 1173810 - RNA, 14 nt, Homo sapiens
uaaaagcacacuca

SEQ ID NO: 1173811 - RNA, 17 nt, Homo sapiens
uaaaagcaucacaugaa

SEQ ID NO: 1173812 - RNA, 14 nt, Homo sapiens
uaaaagcuauggug

SEQ ID NO: 1173813 - RNA, 19 nt, Homo sapiens
uaaaagcuauggugagaug

SEQ ID NO: 1173814 - RNA, 15 nt, Homo sapiens
uaaaagcuugaugaa

SEQ ID NO: 1173815 - RNA, 13 nt, Homo sapiens
uaaaagucugccu

SEQ ID NO: 1173816 - RNA, 14 nt, Homo sapiens
uaaaagugcuuugc

SEQ ID NO: 1173817 - RNA, 20 nt, Homo sapiens
uaaaaguucuuuuugcucua

SEQ ID NO: 1173818 - RNA, 14 nt, Homo sapiens
uaaaauaaaugcaa

SEQ ID NO: 1173819 - RNA, 14 nt, Homo sapiens
uaaaauaaauuccu

SEQ ID NO: 1173820 - RNA, 18 nt, Homo sapiens
uaaaauaauuuuaucucu

SEQ ID NO: 1173821 - RNA, 19 nt, Homo sapiens
uaaaauacuaaacuacauu

SEQ ID NO: 1173822 - RNA, 18 nt, Homo sapiens
uaaaauagaggcuuugag

SEQ ID NO: 1173823 - RNA, 20 nt, Homo sapiens
uaaaauaguggaucucaguu

SEQ ID NO: 1173824 - RNA, 19 nt, Homo sapiens
uaaaauauccuuucaucaa

SEQ ID NO: 1173825 - RNA, 18 nt, Homo sapiens
uaaaauauuuaucugauu

SEQ ID NO: 1173826 - RNA, 22 nt, Homo sapiens
uaaaauauuuaucugauuaagu

SEQ ID NO: 1173827 - RNA, 12 nt, Homo sapiens
uaaaaucucaaa

SEQ ID NO: 1173828 - RNA, 21 nt, Homo sapiens
uaaaaucuuauaguucuaggc

SEQ ID NO: 1173829 - RNA, 12 nt, Homo sapiens
uaaaaucuugca

SEQ ID NO: 1173830 - RNA, 12 nt, Homo sapiens
uaaaaugauguu

SEQ ID NO: 1173831 - RNA, 16 nt, Homo sapiens
uaaaaugauuugcacu

SEQ ID NO: 1173832 - RNA, 17 nt, Homo sapiens
uaaaauggaugccuuga

SEQ ID NO: 1173833 - RNA, 18 nt, Homo sapiens
uaaaauggaugccuugaa

SEQ ID NO: 1173834 - RNA, 21 nt, Homo sapiens
uaaaauguggucugccaaucu

SEQ ID NO: 1173835 - RNA, 18 nt, Homo sapiens
uaaaauguuggugcaauu

SEQ ID NO: 1173836 - RNA, 21 nt, Homo sapiens
uaaaauguuuauagcauuccu

SEQ ID NO: 1173837 - RNA, 14 nt, Homo sapiens
uaaaauuacauucu

SEQ ID NO: 1173838 - RNA, 15 nt, Homo sapiens
uaaaauuacauucua

SEQ ID NO: 1173839 - RNA, 15 nt, Homo sapiens
uaaaauuuacauuua

SEQ ID NO: 1173840 - RNA, 14 nt, Homo sapiens
uaaaauuucacuua

SEQ ID NO: 1173841 - RNA, 15 nt, Homo sapiens
uaaaauuuggugcuu

SEQ ID NO: 1173842 - RNA, 12 nt, Homo sapiens
uaaacaacccuu

SEQ ID NO: 1173843 - RNA, 21 nt, Homo sapiens
uaaacaacuaaauaacuguau

SEQ ID NO: 1173844 - RNA, 23 nt, Homo sapiens
uaaacacgccugcaaacgcugcc

SEQ ID NO: 1173845 - RNA, 18 nt, Homo sapiens
uaaacauaugaaugcagc

SEQ ID NO: 1173846 - RNA, 14 nt, Homo sapiens
uaaacauauuuccu

SEQ ID NO: 1173847 - RNA, 23 nt, Homo sapiens
uaaacaucacagaacauccugga

SEQ ID NO: 1173848 - RNA, 14 nt, Homo sapiens
uaaacaucacuugu

SEQ ID NO: 1173849 - RNA, 19 nt, Homo sapiens
uaaaccaaaaacugaaagu

SEQ ID NO: 1173850 - RNA, 19 nt, Homo sapiens
uaaaccagguuugcaccua

SEQ ID NO: 1173851 - RNA, 16 nt, Homo sapiens
uaaacgcugucccuag

SEQ ID NO: 1173852 - RNA, 22 nt, Homo sapiens
uaaacguccauuaagcugagag

SEQ ID NO: 1173853 - RNA, 14 nt, Homo sapiens
uaaacuaacuacug

SEQ ID NO: 1173854 - RNA, 23 nt, Homo sapiens
uaaacuacuauuuuucuuuccaa

SEQ ID NO: 1173855 - RNA, 18 nt, Homo sapiens
uaaacuugacccaggugg

SEQ ID NO: 1173856 - RNA, 19 nt, Homo sapiens
uaaacuuucugaguuuuuc

SEQ ID NO: 1173857 - RNA, 15 nt, Homo sapiens
uaaagaaaauaugca

SEQ ID NO: 1173858 - RNA, 17 nt, Homo sapiens
uaaagaaaauaugcaua

SEQ ID NO: 1173859 - RNA, 18 nt, Homo sapiens
uaaagaauauaaagccuc

SEQ ID NO: 1173860 - RNA, 10 nt, Homo sapiens
uaaagacaga

SEQ ID NO: 1173861 - RNA, 14 nt, Homo sapiens
uaaagacagggucu

SEQ ID NO: 1173862 - RNA, 20 nt, Homo sapiens
uaaagaccugacaccuuuca

SEQ ID NO: 1173863 - RNA, 16 nt, Homo sapiens
uaaagagaaguuccca

SEQ ID NO: 1173864 - RNA, 14 nt, Homo sapiens
uaaagagugcuaca

SEQ ID NO: 1173865 - RNA, 21 nt, Homo sapiens
uaaagauggaguuucuaaggu

SEQ ID NO: 1173866 - RNA, 18 nt, Homo sapiens
uaaagcaauaugcauuua

SEQ ID NO: 1173867 - RNA, 19 nt, Homo sapiens
uaaagcacuauuguuuaga

SEQ ID NO: 1173868 - RNA, 16 nt, Homo sapiens
uaaagccaaacauaua

SEQ ID NO: 1173869 - RNA, 20 nt, Homo sapiens
uaaagccgaacugguaccau

SEQ ID NO: 1173870 - RNA, 15 nt, Homo sapiens
uaaagccucaagguu

SEQ ID NO: 1173871 - RNA, 12 nt, Homo sapiens
uaaagcucucaa

SEQ ID NO: 1173872 - RNA, 13 nt, Homo sapiens
uaaaggauaucaa

SEQ ID NO: 1173873 - RNA, 12 nt, Homo sapiens
uaaaggcuccug

SEQ ID NO: 1173874 - RNA, 15 nt, Homo sapiens
uaaagggacuugaag

SEQ ID NO: 1173875 - RNA, 18 nt, Homo sapiens
uaaagggcgcaaagggca

SEQ ID NO: 1173876 - RNA, 20 nt, Homo sapiens
uaaagggcgcaaagggcaug

SEQ ID NO: 1173877 - RNA, 24 nt, Homo sapiens
uaaagguaaaacaugcuggugaac

SEQ ID NO: 1173878 - RNA, 13 nt, Homo sapiens
uaaaguaacauca

SEQ ID NO: 1173879 - RNA, 20 nt, Homo sapiens
uaaaguacugagcaguauua

SEQ ID NO: 1173880 - RNA, 14 nt, Homo sapiens
uaaaguagcuguaa

SEQ ID NO: 1173881 - RNA, 19 nt, Homo sapiens
uaaaguaguaaauucauau

SEQ ID NO: 1173882 - RNA, 14 nt, Homo sapiens
uaaagucuugccuu

SEQ ID NO: 1173883 - RNA, 17 nt, Homo sapiens
uaaagugaguacuguua

SEQ ID NO: 1173884 - RNA, 22 nt, Homo sapiens
uaaagugcuaagguucuaaggc

SEQ ID NO: 1173885 - RNA, 15 nt, Homo sapiens
uaaagugcucuuaua

SEQ ID NO: 1173886 - RNA, 14 nt, Homo sapiens
uaaaguucuaguga

SEQ ID NO: 1173887 - RNA, 17 nt, Homo sapiens
uaaaguuuuauuugaau

SEQ ID NO: 1173888 - RNA, 15 nt, Homo sapiens
uaaauaaacaccaca

SEQ ID NO: 1173889 - RNA, 13 nt, Homo sapiens
uaaauaaauggaa

SEQ ID NO: 1173890 - RNA, 18 nt, Homo sapiens
uaaauaaauuaugcuuca

SEQ ID NO: 1173891 - RNA, 20 nt, Homo sapiens
uaaauaaauuaugcuucaua

SEQ ID NO: 1173892 - RNA, 13 nt, Homo sapiens
uaaauaaugcaua

SEQ ID NO: 1173893 - RNA, 21 nt, Homo sapiens
uaaauacaagauucucugaua

SEQ ID NO: 1173894 - RNA, 18 nt, Homo sapiens
uaaauacacucucuuauu

SEQ ID NO: 1173895 - RNA, 17 nt, Homo sapiens
uaaauacaucacuguau

SEQ ID NO: 1173896 - RNA, 14 nt, Homo sapiens
uaaauagaauuaug

SEQ ID NO: 1173897 - RNA, 17 nt, Homo sapiens
uaaauagaugcugugua

SEQ ID NO: 1173898 - RNA, 22 nt, Homo sapiens
uaaauaguagaaaaaucagagu

SEQ ID NO: 1173899 - RNA, 22 nt, Homo sapiens
uaaauaguuacuccagugccaa

SEQ ID NO: 1173900 - RNA, 16 nt, Homo sapiens
uaaauauauacacuua

SEQ ID NO: 1173901 - RNA, 18 nt, Homo sapiens
uaaauauuggauuauauc

SEQ ID NO: 1173902 - RNA, 20 nt, Homo sapiens
uaaaucauggguccagccua

SEQ ID NO: 1173903 - RNA, 20 nt, Homo sapiens
uaaauccuugggagucauua

SEQ ID NO: 1173904 - RNA, 15 nt, Homo sapiens
uaaaucguccuccca

SEQ ID NO: 1173905 - RNA, 21 nt, Homo sapiens
uaaaucugcagcacauugaua

SEQ ID NO: 1173906 - RNA, 19 nt, Homo sapiens
uaaaugacaaauguauuaa

SEQ ID NO: 1173907 - RNA, 13 nt, Homo sapiens
uaaaugacuuaga

SEQ ID NO: 1173908 - RNA, 16 nt, Homo sapiens
uaaaugaguaguuugu

SEQ ID NO: 1173909 - RNA, 17 nt, Homo sapiens
uaaaugcaaacuuaaga

SEQ ID NO: 1173910 - RNA, 18 nt, Homo sapiens
uaaaugcuacauacucca

SEQ ID NO: 1173911 - RNA, 14 nt, Homo sapiens
uaaaugcuacugaa

SEQ ID NO: 1173912 - RNA, 21 nt, Homo sapiens
uaaauggauaugggcuggaua

SEQ ID NO: 1173913 - RNA, 15 nt, Homo sapiens
uaaauguaacagucu

SEQ ID NO: 1173914 - RNA, 15 nt, Homo sapiens
uaaauguacucuuga

SEQ ID NO: 1173915 - RNA, 16 nt, Homo sapiens
uaaauuaccuugccaa

SEQ ID NO: 1173916 - RNA, 14 nt, Homo sapiens
uaaauuaugacugc

SEQ ID NO: 1173917 - RNA, 14 nt, Homo sapiens
uaaauucaaguuua

SEQ ID NO: 1173918 - RNA, 14 nt, Homo sapiens
uaaauucagucuuu

SEQ ID NO: 1173919 - RNA, 20 nt, Homo sapiens
uaaauuccauguuuagcaga

SEQ ID NO: 1173920 - RNA, 24 nt, Homo sapiens
uaaauucucuccuaaugaugacuu

SEQ ID NO: 1173921 - RNA, 16 nt, Homo sapiens
uaaauuuaaagucuaa

SEQ ID NO: 1173922 - RNA, 16 nt, Homo sapiens
uaaugcucaccuuuau

SEQ ID NO: 1173923 - RNA, 11 nt, Homo sapiens
uaaugcucuga

SEQ ID NO: 1173924 - RNA, 11 nt, Homo sapiens
uaaugcuuaua

SEQ ID NO: 1173925 - RNA, 15 nt, Homo sapiens
uaaugcuuauaagac

SEQ ID NO: 1173926 - RNA, 16 nt, Homo sapiens
uaauggcaugagauag

SEQ ID NO: 1173927 - RNA, 17 nt, Homo sapiens
uaauggccggcuggaaa

SEQ ID NO: 1173928 - RNA, 23 nt, Homo sapiens
uaauggucacaauaaaugccacu

SEQ ID NO: 1173929 - RNA, 18 nt, Homo sapiens
uaauggucauuugggaaa

SEQ ID NO: 1173930 - RNA, 21 nt, Homo sapiens
uaauguaucccgauaacuuug

SEQ ID NO: 1173931 - RNA, 15 nt, Homo sapiens
uaaugucaauucuug

SEQ ID NO: 1173932 - RNA, 21 nt, Homo sapiens
uaauguguuuuuaauuaucua

SEQ ID NO: 1173933 - RNA, 15 nt, Homo sapiens
uaauguuauuuccac

SEQ ID NO: 1173934 - RNA, 18 nt, Homo sapiens
uaauguuuaauauugaga

SEQ ID NO: 1173935 - RNA, 17 nt, Homo sapiens
uaauuaaaaacuaguag

SEQ ID NO: 1173936 - RNA, 13 nt, Homo sapiens
uaauuacugugga

SEQ ID NO: 1173937 - RNA, 13 nt, Homo sapiens
uaauuagcaguau

SEQ ID NO: 1173938 - RNA, 19 nt, Homo sapiens
uaauuaggaugcauguuga

SEQ ID NO: 1173939 - RNA, 17 nt, Homo sapiens
uaauuauacuacuuugu

SEQ ID NO: 1173940 - RNA, 21 nt, Homo sapiens
uaauuauuauuuaacucuuaa

SEQ ID NO: 1173941 - RNA, 16 nt, Homo sapiens
uaauucaacccagcca

SEQ ID NO: 1173942 - RNA, 12 nt, Homo sapiens
uaauucagccau

SEQ ID NO: 1173943 - RNA, 13 nt, Homo sapiens
uaauucaguguca

SEQ ID NO: 1173944 - RNA, 13 nt, Homo sapiens
uaauucauuuacu

SEQ ID NO: 1173945 - RNA, 22 nt, Homo sapiens
uaauuccgaaacaaaacuguga

SEQ ID NO: 1173946 - RNA, 14 nt, Homo sapiens
uaauucugaugcua

SEQ ID NO: 1173947 - RNA, 14 nt, Homo sapiens
uaauucugcaucug

SEQ ID NO: 1173948 - RNA, 12 nt, Homo sapiens
uaauucuucacc

SEQ ID NO: 1173949 - RNA, 18 nt, Homo sapiens
uaauuggcaugugaauua

SEQ ID NO: 1173950 - RNA, 18 nt, Homo sapiens
uaauuguacuaaagccaa

SEQ ID NO: 1173951 - RNA, 18 nt, Homo sapiens
uaauugugauauuugaca

SEQ ID NO: 1173952 - RNA, 15 nt, Homo sapiens
uaauuuauuaaucua

SEQ ID NO: 1173953 - RNA, 17 nt, Homo sapiens
uaauuuccuggugugaa

SEQ ID NO: 1173954 - RNA, 21 nt, Homo sapiens
uaauuucugaaaugugcagcu

SEQ ID NO: 1173955 - RNA, 15 nt, Homo sapiens
uaauuuguagacuua

SEQ ID NO: 1173956 - RNA, 22 nt, Homo sapiens
uaauuuuaguauuaacucugua

SEQ ID NO: 1173957 - RNA, 13 nt, Homo sapiens
uaauuuugagaua

SEQ ID NO: 1173958 - RNA, 18 nt, Homo sapiens
uaauuuugugcucuuucc

SEQ ID NO: 1173959 - RNA, 17 nt, Homo sapiens
uaauuuuugaaaacugg

SEQ ID NO: 1173960 - RNA, 16 nt, Homo sapiens
uacaaaaauaccuacu

SEQ ID NO: 1173961 - RNA, 19 nt, Homo sapiens
uacaaaaauuagcugggca

SEQ ID NO: 1173962 - RNA, 20 nt, Homo sapiens
uacaaaaauuagcugggcau

SEQ ID NO: 1173963 - RNA, 21 nt, Homo sapiens
uacaaaacgcgcagaugugca

SEQ ID NO: 1173964 - RNA, 21 nt, Homo sapiens
uacaaaauaaagcuguucuca

SEQ ID NO: 1173965 - RNA, 15 nt, Homo sapiens
uacaaacacuacaga

SEQ ID NO: 1173966 - RNA, 21 nt, Homo sapiens
uacaaacauaaggcacauugu

SEQ ID NO: 1173967 - RNA, 20 nt, Homo sapiens
uacaaagacagccacuuuua

SEQ ID NO: 1173968 - RNA, 22 nt, Homo sapiens
uacaaagcccuuguccccauga

SEQ ID NO: 1173969 - RNA, 15 nt, Homo sapiens
uacaaaggaggacaa

SEQ ID NO: 1173970 - RNA, 18 nt, Homo sapiens
uacaaaucaaagauuugu

SEQ ID NO: 1173971 - RNA, 19 nt, Homo sapiens
uacaaaucaaagauuuguc

SEQ ID NO: 1173972 - RNA, 22 nt, Homo sapiens
uacaaaugacauggacacauca

SEQ ID NO: 1173973 - RNA, 12 nt, Homo sapiens
uacaacaaugaa

SEQ ID NO: 1173974 - RNA, 23 nt, Homo sapiens
uacaagacuuguuauccauuuaa

SEQ ID NO: 1173975 - RNA, 23 nt, Homo sapiens
uacaaguaaagcccagaucucug

SEQ ID NO: 1173976 - RNA, 16 nt, Homo sapiens
uacaauaaacugguau

SEQ ID NO: 1173977 - RNA, 13 nt, Homo sapiens
uacaauacaucug

SEQ ID NO: 1173978 - RNA, 22 nt, Homo sapiens
uacaaugggaaaagagucucua

SEQ ID NO: 1173979 - RNA, 13 nt, Homo sapiens
uacaauucauugu

SEQ ID NO: 1173980 - RNA, 18 nt, Homo sapiens
uacaauuggcacuaaaga

SEQ ID NO: 1173981 - RNA, 17 nt, Homo sapiens
uacacaaagggaugugu

SEQ ID NO: 1173982 - RNA, 12 nt, Homo sapiens
uacacaacaugu

SEQ ID NO: 1173983 - RNA, 13 nt, Homo sapiens
uacacaaugcauc

SEQ ID NO: 1173984 - RNA, 17 nt, Homo sapiens
uacacaaugcaucauaa

SEQ ID NO: 1173985 - RNA, 17 nt, Homo sapiens
uacacagaaacacugcc

SEQ ID NO: 1173986 - RNA, 16 nt, Homo sapiens
uacacagcugagcaau

SEQ ID NO: 1173987 - RNA, 20 nt, Homo sapiens
uacacaggaggcugaggcag

SEQ ID NO: 1173988 - RNA, 19 nt, Homo sapiens
uacacaguucaucauugcu

SEQ ID NO: 1173989 - RNA, 21 nt, Homo sapiens
uacacaucucugucaguguga

SEQ ID NO: 1173990 - RNA, 18 nt, Homo sapiens
uacaccacacacaacagc

SEQ ID NO: 1173991 - RNA, 18 nt, Homo sapiens
uacaccauuaucuuggaa

SEQ ID NO: 1173992 - RNA, 12 nt, Homo sapiens
uacacccagaaa

SEQ ID NO: 1173993 - RNA, 15 nt, Homo sapiens
uacaccccaacagca

SEQ ID NO: 1173994 - RNA, 19 nt, Homo sapiens
uacacuggguucugcuacu

SEQ ID NO: 1173995 - RNA, 12 nt, Homo sapiens
uacagaaacuga

SEQ ID NO: 1173996 - RNA, 17 nt, Homo sapiens
uacagaaaguagugcug

SEQ ID NO: 1173997 - RNA, 14 nt, Homo sapiens
uacagaacucuuaa

SEQ ID NO: 1173998 - RNA, 16 nt, Homo sapiens
uacagacagagaauau

SEQ ID NO: 1173999 - RNA, 14 nt, Homo sapiens
uacagacgucucaa

SEQ ID NO: 1174000 - RNA, 13 nt, Homo sapiens
uacagauugucau

SEQ ID NO: 1174001 - RNA, 13 nt, Homo sapiens
uacagcacacacu

SEQ ID NO: 1174002 - RNA, 22 nt, Homo sapiens
uacaggaucauguaaaugcuca

SEQ ID NO: 1174003 - RNA, 23 nt, Homo sapiens
uacaggcacccaccaccaugccc

SEQ ID NO: 1174004 - RNA, 15 nt, Homo sapiens
uacaggcagcacaga

SEQ ID NO: 1174005 - RNA, 15 nt, Homo sapiens
uacagggacugggca

SEQ ID NO: 1174006 - RNA, 22 nt, Homo sapiens
uacaggggagaaggaaaugcag

SEQ ID NO: 1174007 - RNA, 14 nt, Homo sapiens
uacaggugaggcaa

SEQ ID NO: 1174008 - RNA, 23 nt, Homo sapiens
uacagguguauauaccucuauau

SEQ ID NO: 1174009 - RNA, 23 nt, Homo sapiens
uacagguuagaagcaaggcacaa

SEQ ID NO: 1174010 - RNA, 16 nt, Homo sapiens
uacaguauauucuugu

SEQ ID NO: 1174011 - RNA, 21 nt, Homo sapiens
uacaguauuuuucugugacca

SEQ ID NO: 1174012 - RNA, 19 nt, Homo sapiens
uacagucagcacagaacac

SEQ ID NO: 1174013 - RNA, 18 nt, Homo sapiens
uacagucuuccauuugca

SEQ ID NO: 1174014 - RNA, 12 nt, Homo sapiens
uacagugauaua

SEQ ID NO: 1174015 - RNA, 14 nt, Homo sapiens
uacaguucauaaau

SEQ ID NO: 1174016 - RNA, 16 nt, Homo sapiens
uacaguuuaacagagu

SEQ ID NO: 1174017 - RNA, 12 nt, Homo sapiens
uacauacugcug

SEQ ID NO: 1174018 - RNA, 13 nt, Homo sapiens
uacauacugcugu

SEQ ID NO: 1174019 - RNA, 23 nt, Homo sapiens
uacauaggauggcuggcucugca

SEQ ID NO: 1174020 - RNA, 18 nt, Homo sapiens
uacaucgaggcucuugcu

SEQ ID NO: 1174021 - RNA, 17 nt, Homo sapiens
uacaucucuacuaaaaa

SEQ ID NO: 1174022 - RNA, 14 nt, Homo sapiens
uacaucuuucacau

SEQ ID NO: 1174023 - RNA, 17 nt, Homo sapiens
uacaugcauugagcucu

SEQ ID NO: 1174024 - RNA, 14 nt, Homo sapiens
uacauggcucuaaa

SEQ ID NO: 1174025 - RNA, 18 nt, Homo sapiens
uacaugguugaaacccca

SEQ ID NO: 1174026 - RNA, 22 nt, Homo sapiens
uacauguauaucucgagugagu

SEQ ID NO: 1174027 - RNA, 16 nt, Homo sapiens
uacauguguagccugu

SEQ ID NO: 1174028 - RNA, 21 nt, Homo sapiens
uacauguuuauaaaucuuaug

SEQ ID NO: 1174029 - RNA, 14 nt, Homo sapiens
uacauuaaggagca

SEQ ID NO: 1174030 - RNA, 18 nt, Homo sapiens
uacauucccaucuacuaa

SEQ ID NO: 1174031 - RNA, 16 nt, Homo sapiens
uacauucugcuuucau

SEQ ID NO: 1174032 - RNA, 22 nt, Homo sapiens
uacauuugaugcaugucuuuua

SEQ ID NO: 1174033 - RNA, 18 nt, Homo sapiens
uacauuuugcucugugaa

SEQ ID NO: 1174034 - RNA, 22 nt, Homo sapiens
uaccaaaaauaucccuuuuuca

SEQ ID NO: 1174035 - RNA, 23 nt, Homo sapiens
uaccaacagcuuuucccaggaga

SEQ ID NO: 1174036 - RNA, 17 nt, Homo sapiens
uaccaaccugaagacac

SEQ ID NO: 1174037 - RNA, 13 nt, Homo sapiens
uaccaacuuuuag

SEQ ID NO: 1174038 - RNA, 16 nt, Homo sapiens
ugcugcugugucuuua

SEQ ID NO: 1174039 - RNA, 12 nt, Homo sapiens
ugcugcuuuaau

SEQ ID NO: 1174040 - RNA, 18 nt, Homo sapiens
ugcugcuuuaauucauaa

SEQ ID NO: 1174041 - RNA, 21 nt, Homo sapiens
ugcugcuuuguuguucugccu

SEQ ID NO: 1174042 - RNA, 13 nt, Homo sapiens
uggaugcauuucu

SEQ ID NO: 1174043 - RNA, 11 nt, Homo sapiens
uggaugccuug

SEQ ID NO: 1174044 - RNA, 18 nt, Homo sapiens
uggaugccuugaauaaua

SEQ ID NO: 1174045 - RNA, 17 nt, Homo sapiens
uggaugcggccauucaa

SEQ ID NO: 1174046 - RNA, 21 nt, Homo sapiens
uggaugcugugcuacguguga

SEQ ID NO: 1174047 - RNA, 15 nt, Homo sapiens
uggauggaaagggag

SEQ ID NO: 1174048 - RNA, 16 nt, Homo sapiens
uggauggaaagggagg

SEQ ID NO: 1174049 - RNA, 21 nt, Homo sapiens
uggauuacaggcaugugccac

SEQ ID NO: 1174050 - RNA, 17 nt, Homo sapiens
uggauuggucugagggg

SEQ ID NO: 1174051 - RNA, 23 nt, Homo sapiens
uggauuuguuuguuuucuugucu

SEQ ID NO: 1174052 - RNA, 21 nt, Homo sapiens
uggcaaaaguaggcaucuaaa

SEQ ID NO: 1174053 - RNA, 18 nt, Homo sapiens
uggcaacguagugacuca

SEQ ID NO: 1174054 - RNA, 18 nt, Homo sapiens
uggcaaggaugcauacau

SEQ ID NO: 1174055 - RNA, 13 nt, Homo sapiens
uggcaagugaauu

SEQ ID NO: 1174056 - RNA, 21 nt, Homo sapiens
uggcaagugaauuugccugua

SEQ ID NO: 1174057 - RNA, 21 nt, Homo sapiens
uggcacagugcuuacauaugu

SEQ ID NO: 1174058 - RNA, 13 nt, Homo sapiens
uggcacccaagac

SEQ ID NO: 1174059 - RNA, 12 nt, Homo sapiens
uggcacuauccg

SEQ ID NO: 1174060 - RNA, 12 nt, Homo sapiens
uggcacuugccu

SEQ ID NO: 1174061 - RNA, 15 nt, Homo sapiens
uggcagaaccaaagc

SEQ ID NO: 1174062 - RNA, 15 nt, Homo sapiens
uggcagcaaacugcu

SEQ ID NO: 1174063 - RNA, 12 nt, Homo sapiens
uggcagcaacuc

SEQ ID NO: 1174064 - RNA, 20 nt, Homo sapiens
uggcagcagaguguggccuu

SEQ ID NO: 1174065 - RNA, 18 nt, Homo sapiens
uggcagcauugacucugu

SEQ ID NO: 1174066 - RNA, 23 nt, Homo sapiens
uggcagcucagcuuccccaacac

SEQ ID NO: 1174067 - RNA, 17 nt, Homo sapiens
uggcaggaaucuaucca

SEQ ID NO: 1174068 - RNA, 15 nt, Homo sapiens
uggcagucacaucuc

SEQ ID NO: 1174069 - RNA, 17 nt, Homo sapiens
uggcagugauccugcaa

SEQ ID NO: 1174070 - RNA, 15 nt, Homo sapiens
uggcagugguuugaa

SEQ ID NO: 1174071 - RNA, 17 nt, Homo sapiens
uggcauaauucaggggc

SEQ ID NO: 1174072 - RNA, 19 nt, Homo sapiens
uggcaucagugucuuucca

SEQ ID NO: 1174073 - RNA, 10 nt, Homo sapiens
uggcaucugu

SEQ ID NO: 1174074 - RNA, 12 nt, Homo sapiens
uggcaugugcag

SEQ ID NO: 1174075 - RNA, 15 nt, Homo sapiens
uggcaugugcaggua

SEQ ID NO: 1174076 - RNA, 16 nt, Homo sapiens
uggccaaggagcugcu

SEQ ID NO: 1174077 - RNA, 21 nt, Homo sapiens
uggccacaaauucuuugacac

SEQ ID NO: 1174078 - RNA, 19 nt, Homo sapiens
uggccacacugugacacac

SEQ ID NO: 1174079 - RNA, 15 nt, Homo sapiens
uggccaccaguauga

SEQ ID NO: 1174080 - RNA, 21 nt, Homo sapiens
uggccaccaguaugacaguau

SEQ ID NO: 1174081 - RNA, 15 nt, Homo sapiens
uggccacccaaacag

SEQ ID NO: 1174082 - RNA, 16 nt, Homo sapiens
uggccagauuuccuca

SEQ ID NO: 1174083 - RNA, 21 nt, Homo sapiens
uggccaggccucuuggcaguc

SEQ ID NO: 1174084 - RNA, 23 nt, Homo sapiens
uggccaggcuggucuaaaacucc

SEQ ID NO: 1174085 - RNA, 18 nt, Homo sapiens
uggccaggcuggucucaa

SEQ ID NO: 1174086 - RNA, 20 nt, Homo sapiens
uggccagucuuccucuuagc

SEQ ID NO: 1174087 - RNA, 13 nt, Homo sapiens
uggccaucuccug

SEQ ID NO: 1174088 - RNA, 17 nt, Homo sapiens
uggccaugguccccaag

SEQ ID NO: 1174089 - RNA, 14 nt, Homo sapiens
uggccauguuccac

SEQ ID NO: 1174090 - RNA, 21 nt, Homo sapiens
uggcccacccaguccaugcuc

SEQ ID NO: 1174091 - RNA, 21 nt, Homo sapiens
uggcccccacccaguccugca

SEQ ID NO: 1174092 - RNA, 18 nt, Homo sapiens
uggcccguggccuggcau

SEQ ID NO: 1174093 - RNA, 16 nt, Homo sapiens
uggccuaugcacauau

SEQ ID NO: 1174094 - RNA, 22 nt, Homo sapiens
uggccuccuuccccguacuuug

SEQ ID NO: 1174095 - RNA, 20 nt, Homo sapiens
uggccugaacagauguaaau

SEQ ID NO: 1174096 - RNA, 23 nt, Homo sapiens
uggccuuccacgucuuccuccaa

SEQ ID NO: 1174097 - RNA, 13 nt, Homo sapiens
uggccuugcagcu

SEQ ID NO: 1174098 - RNA, 15 nt, Homo sapiens
uggccuuugcaauuu

SEQ ID NO: 1174099 - RNA, 23 nt, Homo sapiens
uggcgacacucagggcagcugcc

SEQ ID NO: 1174100 - RNA, 14 nt, Homo sapiens
uggcgcuggcugcg

SEQ ID NO: 1174101 - RNA, 15 nt, Homo sapiens
uggcggcagggccag

SEQ ID NO: 1174102 - RNA, 15 nt, Homo sapiens
uggcuaaagugcuuu

SEQ ID NO: 1174103 - RNA, 14 nt, Homo sapiens
uggcuacuuuuuca

SEQ ID NO: 1174104 - RNA, 20 nt, Homo sapiens
uggcucaacguuuuuggaca

SEQ ID NO: 1174105 - RNA, 23 nt, Homo sapiens
uggcucagcucggggagccuuag

SEQ ID NO: 1174106 - RNA, 13 nt, Homo sapiens
uggcucaucucuu

SEQ ID NO: 1174107 - RNA, 12 nt, Homo sapiens
uggcuccaaacc

SEQ ID NO: 1174108 - RNA, 21 nt, Homo sapiens
uggcuccaggacagaccuuca

SEQ ID NO: 1174109 - RNA, 13 nt, Homo sapiens
uggcuccucugug

SEQ ID NO: 1174110 - RNA, 20 nt, Homo sapiens
uggcuccuuaucagugccau

SEQ ID NO: 1174111 - RNA, 21 nt, Homo sapiens
uggcuccuuaucagugccaug

SEQ ID NO: 1174112 - RNA, 17 nt, Homo sapiens
uggcucgccaggccaaa

SEQ ID NO: 1174113 - RNA, 21 nt, Homo sapiens
uggcucuggguaccugcaagc

SEQ ID NO: 1174114 - RNA, 15 nt, Homo sapiens
uggcugcaagcccac

SEQ ID NO: 1174115 - RNA, 21 nt, Homo sapiens
uggcugccuuugaucacagga

SEQ ID NO: 1174116 - RNA, 15 nt, Homo sapiens
uggcuggcucugcac

SEQ ID NO: 1174117 - RNA, 14 nt, Homo sapiens
uggcugggcccagc

SEQ ID NO: 1174118 - RNA, 15 nt, Homo sapiens
uggcuguauuuagau

SEQ ID NO: 1174119 - RNA, 15 nt, Homo sapiens
uggcuguggagacaa

SEQ ID NO: 1174120 - RNA, 16 nt, Homo sapiens
uggcuguuucuguaua

SEQ ID NO: 1174121 - RNA, 19 nt, Homo sapiens
uggcuuacaguaaaugaac

SEQ ID NO: 1174122 - RNA, 15 nt, Homo sapiens
uggcuuagcugccau

SEQ ID NO: 1174123 - RNA, 16 nt, Homo sapiens
uggcuuccugcugagu

SEQ ID NO: 1174124 - RNA, 14 nt, Homo sapiens
ugggaaaaacugca

SEQ ID NO: 1174125 - RNA, 14 nt, Homo sapiens
ugggaaaaccagac

SEQ ID NO: 1174126 - RNA, 18 nt, Homo sapiens
ugggaaaacccaggguga

SEQ ID NO: 1174127 - RNA, 18 nt, Homo sapiens
ugggaaaaucacuugaac

SEQ ID NO: 1174128 - RNA, 20 nt, Homo sapiens
ugggaaacaaauaauuugaa

SEQ ID NO: 1174129 - RNA, 18 nt, Homo sapiens
ugggaaacacuccuugca

SEQ ID NO: 1174130 - RNA, 19 nt, Homo sapiens
ugggaaacacuccuugcau

SEQ ID NO: 1174131 - RNA, 20 nt, Homo sapiens
ugggaaacuugucacuugca

SEQ ID NO: 1174132 - RNA, 17 nt, Homo sapiens
ugggaaagagaaagaga

SEQ ID NO: 1174133 - RNA, 20 nt, Homo sapiens
ugggaaaguauucuguacuc

SEQ ID NO: 1174134 - RNA, 21 nt, Homo sapiens
ugggaagacuguugugcucca

SEQ ID NO: 1174135 - RNA, 16 nt, Homo sapiens
ugggaagccgugcucg

SEQ ID NO: 1174136 - RNA, 12 nt, Homo sapiens
ugggaagugaag

SEQ ID NO: 1174137 - RNA, 15 nt, Homo sapiens
ugggaaugucucuuu

SEQ ID NO: 1174138 - RNA, 17 nt, Homo sapiens
ugggaauuaagcaaaau

SEQ ID NO: 1174139 - RNA, 14 nt, Homo sapiens
ugggacaaauugca

SEQ ID NO: 1174140 - RNA, 19 nt, Homo sapiens
ugggaccugauuuauugaa

SEQ ID NO: 1174141 - RNA, 14 nt, Homo sapiens
ugggacugcuaaau

SEQ ID NO: 1174142 - RNA, 15 nt, Homo sapiens
ugggacuguguuucc

SEQ ID NO: 1174143 - RNA, 14 nt, Homo sapiens
ugggagagugucaa

SEQ ID NO: 1174144 - RNA, 21 nt, Homo sapiens
ugggagauguggaaaagccaa

SEQ ID NO: 1174145 - RNA, 19 nt, Homo sapiens
ugggagcuucccacaccug

SEQ ID NO: 1174146 - RNA, 15 nt, Homo sapiens
ugggaggccagugag

SEQ ID NO: 1174147 - RNA, 15 nt, Homo sapiens
ugggaggccgaggca

SEQ ID NO: 1174148 - RNA, 18 nt, Homo sapiens
ugggagggguccccaaca

SEQ ID NO: 1174149 - RNA, 16 nt, Homo sapiens
ugggaggguaccagca

SEQ ID NO: 1174150 - RNA, 19 nt, Homo sapiens
ugggaggguaccagcagaa

SEQ ID NO: 1174151 - RNA, 14 nt, Homo sapiens
ugggagucaucuca

SEQ ID NO: 1174152 - RNA, 23 nt, Homo sapiens
ugggaucacgaggaaaagagaag

SEQ ID NO: 1174153 - RNA, 23 nt, Homo sapiens
ugggaucccacuauauugcacag

SEQ ID NO: 1174154 - RNA, 22 nt, Homo sapiens
ugggaucguccuggauucacug

SEQ ID NO: 1174155 - RNA, 24 nt, Homo sapiens
ugggaugaaacuaaagcaauagaa

SEQ ID NO: 1174156 - RNA, 15 nt, Homo sapiens
ugggauuacagggau

SEQ ID NO: 1174157 - RNA, 21 nt, Homo sapiens
ugggauuacaggugugcacca

SEQ ID NO: 1174158 - RNA, 19 nt, Homo sapiens
ugggauuaucgucuucuaa

SEQ ID NO: 1174159 - RNA, 23 nt, Homo sapiens
ugggauuuccauguucuuauuaa

SEQ ID NO: 1174160 - RNA, 16 nt, Homo sapiens
ugggcaauauagcaag

SEQ ID NO: 1174161 - RNA, 14 nt, Homo sapiens
ugggcagagcccaa

SEQ ID NO: 1174162 - RNA, 21 nt, Homo sapiens
ugggcagcccaacagcacuuu

SEQ ID NO: 1174163 - RNA, 22 nt, Homo sapiens
ugggcagggucuguuuggacug

SEQ ID NO: 1174164 - RNA, 17 nt, Homo sapiens
ugggcagugagugcagg

SEQ ID NO: 1174165 - RNA, 12 nt, Homo sapiens
ugggcaguuaca

SEQ ID NO: 1174166 - RNA, 18 nt, Homo sapiens
ugggcaucauagcaagac

SEQ ID NO: 1174167 - RNA, 23 nt, Homo sapiens
ugggcauggugcgggcaccugua

SEQ ID NO: 1174168 - RNA, 22 nt, Homo sapiens
ugggcccacccggugggacccc

SEQ ID NO: 1174169 - RNA, 19 nt, Homo sapiens
ugggcccagcaggggcccu

SEQ ID NO: 1174170 - RNA, 17 nt, Homo sapiens
ugggccccucucauucc

SEQ ID NO: 1174171 - RNA, 15 nt, Homo sapiens
ugggcccuaugucuc

SEQ ID NO: 1174172 - RNA, 19 nt, Homo sapiens
ugggcccuaugucucagga

SEQ ID NO: 1174173 - RNA, 19 nt, Homo sapiens
ugggccucagcaagccaug

SEQ ID NO: 1174174 - RNA, 15 nt, Homo sapiens
ugggccuucucagcu

SEQ ID NO: 1174175 - RNA, 19 nt, Homo sapiens
ugggcuaaugaagaucaua

SEQ ID NO: 1174176 - RNA, 21 nt, Homo sapiens
ugggcuccccaggaagcccac

SEQ ID NO: 1174177 - RNA, 15 nt, Homo sapiens
ugggcucuucuggac

SEQ ID NO: 1174178 - RNA, 15 nt, Homo sapiens
ugggcugcauuccca

SEQ ID NO: 1174179 - RNA, 16 nt, Homo sapiens
ugggcuggaacaugua

SEQ ID NO: 1174180 - RNA, 13 nt, Homo sapiens
ugggcuuacaggc

SEQ ID NO: 1174181 - RNA, 22 nt, Homo sapiens
ugggcuuacaggcaugagccac

SEQ ID NO: 1174182 - RNA, 14 nt, Homo sapiens
uggggaaaauccua

SEQ ID NO: 1174183 - RNA, 24 nt, Homo sapiens
uggggaccccaccccucaucagga

SEQ ID NO: 1174184 - RNA, 20 nt, Homo sapiens
uggggagaggggagugcauu

SEQ ID NO: 1174185 - RNA, 15 nt, Homo sapiens
uggggagauggaguu

SEQ ID NO: 1174186 - RNA, 22 nt, Homo sapiens
uggggagcaaguguuaauaaua

SEQ ID NO: 1174187 - RNA, 20 nt, Homo sapiens
uggggaggugagagugcaga

SEQ ID NO: 1174188 - RNA, 14 nt, Homo sapiens
uggggagucaggga

SEQ ID NO: 1174189 - RNA, 15 nt, Homo sapiens
uggggagugagggga

SEQ ID NO: 1174190 - RNA, 16 nt, Homo sapiens
uggggcaaacagucua

SEQ ID NO: 1174191 - RNA, 16 nt, Homo sapiens
uggggcaggcagugau

SEQ ID NO: 1174192 - RNA, 14 nt, Homo sapiens
uggggccagaucca

SEQ ID NO: 1174193 - RNA, 15 nt, Homo sapiens
uggggccagauccag

SEQ ID NO: 1174194 - RNA, 20 nt, Homo sapiens
uggggcccuaauucagccau

SEQ ID NO: 1174195 - RNA, 19 nt, Homo sapiens
uggggccuugcuccucuuc

SEQ ID NO: 1174196 - RNA, 22 nt, Homo sapiens
uggggcuggccucccaaaugag

SEQ ID NO: 1174197 - RNA, 17 nt, Homo sapiens
uggggcuugaauuugca

SEQ ID NO: 1174198 - RNA, 21 nt, Homo sapiens
ugggggacaugcuaaauaacu

SEQ ID NO: 1174199 - RNA, 19 nt, Homo sapiens
ugggggacccaucuuccac

SEQ ID NO: 1174200 - RNA, 23 nt, Homo sapiens
ugggggcuuccgcagcuucaggg

SEQ ID NO: 1174201 - RNA, 20 nt, Homo sapiens
ugggguugucagcucucauc

SEQ ID NO: 1174202 - RNA, 14 nt, Homo sapiens
uggguaggccccac

SEQ ID NO: 1174203 - RNA, 18 nt, Homo sapiens
ugggucacagagugagac

SEQ ID NO: 1174204 - RNA, 23 nt, Homo sapiens
ugggucacaggaaggaaacaaca

SEQ ID NO: 1174205 - RNA, 15 nt, Homo sapiens
ugggucuugccaugu

SEQ ID NO: 1174206 - RNA, 13 nt, Homo sapiens
ugggugaagacau

SEQ ID NO: 1174207 - RNA, 17 nt, Homo sapiens
uggguggagaagccauu

SEQ ID NO: 1174208 - RNA, 19 nt, Homo sapiens
uggguggcucugauugcuu

SEQ ID NO: 1174209 - RNA, 21 nt, Homo sapiens
uggguggcucugauugcuuua

SEQ ID NO: 1174210 - RNA, 21 nt, Homo sapiens
uggguggggcugcuccuccag

SEQ ID NO: 1174211 - RNA, 14 nt, Homo sapiens
uggguguugaccac

SEQ ID NO: 1174212 - RNA, 20 nt, Homo sapiens
uggguucacagaucuuucug

SEQ ID NO: 1174213 - RNA, 22 nt, Homo sapiens
uggguugcagacaggaaucuua

SEQ ID NO: 1174214 - RNA, 22 nt, Homo sapiens
ugguaaaguuagguacagagac

SEQ ID NO: 1174215 - RNA, 24 nt, Homo sapiens
ugguacaucgaggcucuugcucaa

SEQ ID NO: 1174216 - RNA, 16 nt, Homo sapiens
ugguaccuauuugacu

SEQ ID NO: 1174217 - RNA, 20 nt, Homo sapiens
ugguagccaucaagcacuuc

SEQ ID NO: 1174218 - RNA, 19 nt, Homo sapiens
ugguauacauuuacuguga

SEQ ID NO: 1174219 - RNA, 14 nt, Homo sapiens
ugguaucacugaac

SEQ ID NO: 1174220 - RNA, 21 nt, Homo sapiens
ugguaucacugaacuacuaaa

SEQ ID NO: 1174221 - RNA, 22 nt, Homo sapiens
ugguaucauuuucuagcaauaa

SEQ ID NO: 1174222 - RNA, 13 nt, Homo sapiens
ugguaucugcaug

SEQ ID NO: 1174223 - RNA, 15 nt, Homo sapiens
ugguaugagacagau

SEQ ID NO: 1174224 - RNA, 14 nt, Homo sapiens
uggucacacucuca

SEQ ID NO: 1174225 - RNA, 12 nt, Homo sapiens
uggucacaugga

SEQ ID NO: 1174226 - RNA, 13 nt, Homo sapiens
uggucacauggag

SEQ ID NO: 1174227 - RNA, 14 nt, Homo sapiens
uggucaccaaacag

SEQ ID NO: 1174228 - RNA, 17 nt, Homo sapiens
uggucacuggagucucc

SEQ ID NO: 1174229 - RNA, 23 nt, Homo sapiens
uggucagaaugggugcaguuuga

SEQ ID NO: 1174230 - RNA, 17 nt, Homo sapiens
uggucaggcuggucuca

SEQ ID NO: 1174231 - RNA, 21 nt, Homo sapiens
ugguccacagggcaccugcca

SEQ ID NO: 1174232 - RNA, 14 nt, Homo sapiens
ugguccaugucuau

SEQ ID NO: 1174233 - RNA, 19 nt, Homo sapiens
uggucccagcuacuuggga

SEQ ID NO: 1174234 - RNA, 21 nt, Homo sapiens
uggucccggggccagcacuuc

SEQ ID NO: 1174235 - RNA, 16 nt, Homo sapiens
ugguccuggcugcacu

SEQ ID NO: 1174236 - RNA, 20 nt, Homo sapiens
uggucugcugaguaacaggu

SEQ ID NO: 1174237 - RNA, 20 nt, Homo sapiens
uggucuggguggaugugagc

SEQ ID NO: 1174238 - RNA, 20 nt, Homo sapiens
uggucuuaagaaauguauaa

SEQ ID NO: 1174239 - RNA, 20 nt, Homo sapiens
uggugaaaaccccaucucua

SEQ ID NO: 1174240 - RNA, 19 nt, Homo sapiens
uggugaaacccccaucucu

SEQ ID NO: 1174241 - RNA, 14 nt, Homo sapiens
uggugaauggaguc

SEQ ID NO: 1174242 - RNA, 13 nt, Homo sapiens
uggugaggcaaua

SEQ ID NO: 1174243 - RNA, 15 nt, Homo sapiens
uggugaugugccugu

SEQ ID NO: 1174244 - RNA, 16 nt, Homo sapiens
uggugccaucauugcu

SEQ ID NO: 1174245 - RNA, 23 nt, Homo sapiens
uggugcccccagacagcugcuca

SEQ ID NO: 1174246 - RNA, 23 nt, Homo sapiens
uggugcgggcaccuguaguccua

SEQ ID NO: 1174247 - RNA, 18 nt, Homo sapiens
uggugcgucuaagaugag

SEQ ID NO: 1174248 - RNA, 18 nt, Homo sapiens
ugguggaacaaccugcug

SEQ ID NO: 1174249 - RNA, 15 nt, Homo sapiens
ugguggaggagcuga

SEQ ID NO: 1174250 - RNA, 18 nt, Homo sapiens
ugguggcaugcaccugca

SEQ ID NO: 1174251 - RNA, 19 nt, Homo sapiens
ugguggcgggcgccuguag

SEQ ID NO: 1174252 - RNA, 18 nt, Homo sapiens
ugguggcucuucagagga

SEQ ID NO: 1174253 - RNA, 12 nt, Homo sapiens
ugguggggccaa

SEQ ID NO: 1174254 - RNA, 15 nt, Homo sapiens
ugguguuacugcagu

SEQ ID NO: 1174255 - RNA, 17 nt, Homo sapiens
ugguguuccaugacuuc

SEQ ID NO: 1174256 - RNA, 15 nt, Homo sapiens
ugguguuuuuacaga

SEQ ID NO: 1174257 - RNA, 14 nt, Homo sapiens
ugguuauauaguca

SEQ ID NO: 1174258 - RNA, 19 nt, Homo sapiens
ugguuauccugugcuacag

SEQ ID NO: 1174259 - RNA, 16 nt, Homo sapiens
ugguucaccuguguac

SEQ ID NO: 1174260 - RNA, 17 nt, Homo sapiens
ugguucauuaauucuau

SEQ ID NO: 1174261 - RNA, 17 nt, Homo sapiens
ugguugaguucagguag

SEQ ID NO: 1174262 - RNA, 15 nt, Homo sapiens
ugguuggacacugug

SEQ ID NO: 1174263 - RNA, 17 nt, Homo sapiens
ugguuggaccuauugcc

SEQ ID NO: 1174264 - RNA, 16 nt, Homo sapiens
ugguuguauuguggaa

SEQ ID NO: 1174265 - RNA, 20 nt, Homo sapiens
ugguuguccucacugcugau

SEQ ID NO: 1174266 - RNA, 14 nt, Homo sapiens
ugguuuacuguguu

SEQ ID NO: 1174267 - RNA, 17 nt, Homo sapiens
ugguuuauuucccagua

SEQ ID NO: 1174268 - RNA, 15 nt, Homo sapiens
ugguuuccacauuua

SEQ ID NO: 1174269 - RNA, 12 nt, Homo sapiens
ugguuuugacag

SEQ ID NO: 1174270 - RNA, 11 nt, Homo sapiens
ugguuuugcuc

SEQ ID NO: 1174271 - RNA, 22 nt, Homo sapiens
uguaaaaaaaaaaaacauacau

SEQ ID NO: 1174272 - RNA, 15 nt, Homo sapiens
uguaaaaacuuucac

SEQ ID NO: 1174273 - RNA, 14 nt, Homo sapiens
uguaaaagggauuu

SEQ ID NO: 1174274 - RNA, 17 nt, Homo sapiens
uguaaaauuucacuuaa

SEQ ID NO: 1174275 - RNA, 17 nt, Homo sapiens
uguaaacaagcaauaau

SEQ ID NO: 1174276 - RNA, 21 nt, Homo sapiens
uguaaaccuagaguuuuauca

SEQ ID NO: 1174277 - RNA, 13 nt, Homo sapiens
uguaaagcuuaaa

SEQ ID NO: 1174278 - RNA, 15 nt, Homo sapiens
uguaaaggauauuaa

SEQ ID NO: 1174279 - RNA, 21 nt, Homo sapiens
uguaaauaaauuuugugcaaa

SEQ ID NO: 1174280 - RNA, 17 nt, Homo sapiens
uguaaauacacauagca

SEQ ID NO: 1174281 - RNA, 14 nt, Homo sapiens
uguaaauacauaaa

SEQ ID NO: 1174282 - RNA, 20 nt, Homo sapiens
uguaaauacauguacagaca

SEQ ID NO: 1174283 - RNA, 14 nt, Homo sapiens
uguaaauaugaauc

SEQ ID NO: 1174284 - RNA, 16 nt, Homo sapiens
uguaaaugcuauuaua

SEQ ID NO: 1174285 - RNA, 17 nt, Homo sapiens
uguaaaugcucaaagau

SEQ ID NO: 1174286 - RNA, 14 nt, Homo sapiens
uguaaauguacugg

SEQ ID NO: 1174287 - RNA, 19 nt, Homo sapiens
uguaacacuguuuauugaa

SEQ ID NO: 1174288 - RNA, 13 nt, Homo sapiens
uguaacagucuga

SEQ ID NO: 1174289 - RNA, 19 nt, Homo sapiens
uguaacaucuucaacaugu

SEQ ID NO: 1174290 - RNA, 12 nt, Homo sapiens
uguaaccuucca

SEQ ID NO: 1174291 - RNA, 23 nt, Homo sapiens
uguaacugugccaguucuuucca

SEQ ID NO: 1174292 - RNA, 15 nt, Homo sapiens
uguaaggcucuagau

SEQ ID NO: 1174293 - RNA, 14 nt, Homo sapiens
uguaauaaaacugc

SEQ ID NO: 1174294 - RNA, 19 nt, Homo sapiens
uguaaucccagcacuuugg

SEQ ID NO: 1174295 - RNA, 17 nt, Homo sapiens
uguaaucucacuacaca

SEQ ID NO: 1174296 - RNA, 17 nt, Homo sapiens
uguaaugucaccaccuu

SEQ ID NO: 1174297 - RNA, 19 nt, Homo sapiens
uguaauuuguaacuuuuau

SEQ ID NO: 1174298 - RNA, 16 nt, Homo sapiens
uguaauuuuaguauua

SEQ ID NO: 1174299 - RNA, 23 nt, Homo sapiens
uguacacaaaggauuugaugcuu

SEQ ID NO: 1174300 - RNA, 11 nt, Homo sapiens
uguacauagac

SEQ ID NO: 1174301 - RNA, 23 nt, Homo sapiens
uguacaucuauuuuggauuguau

SEQ ID NO: 1174302 - RNA, 18 nt, Homo sapiens
uguacauuuuagugauuu

SEQ ID NO: 1174303 - RNA, 15 nt, Homo sapiens
uguaccugugcacgu

SEQ ID NO: 1174304 - RNA, 23 nt, Homo sapiens
uguaccuuccacaagacucagaa

SEQ ID NO: 1174305 - RNA, 22 nt, Homo sapiens
uguacgaaucgaauacaaauca

SEQ ID NO: 1174306 - RNA, 18 nt, Homo sapiens
uguacucuugaacuucuu

SEQ ID NO: 1174307 - RNA, 16 nt, Homo sapiens
uguacuguuacugugu

SEQ ID NO: 1174308 - RNA, 13 nt, Homo sapiens
uguagaaaaaccc

SEQ ID NO: 1174309 - RNA, 17 nt, Homo sapiens
uguagaagccacuauua

SEQ ID NO: 1174310 - RNA, 15 nt, Homo sapiens
uguagaauaaaugaa

SEQ ID NO: 1174311 - RNA, 19 nt, Homo sapiens
uguagaaugggaugugaua

SEQ ID NO: 1174312 - RNA, 24 nt, Homo sapiens
uguagcaaauuucgagcauaagaa

SEQ ID NO: 1174313 - RNA, 16 nt, Homo sapiens
uguagcagaaaccaag

SEQ ID NO: 1174314 - RNA, 15 nt, Homo sapiens
uguagccccagucag

SEQ ID NO: 1174315 - RNA, 20 nt, Homo sapiens
uguagcucuaggguauauau

SEQ ID NO: 1174316 - RNA, 19 nt, Homo sapiens
uguaggaaccaauucuuga

SEQ ID NO: 1174317 - RNA, 16 nt, Homo sapiens
uguaguaaacuauuua

SEQ ID NO: 1174318 - RNA, 14 nt, Homo sapiens
uguaguaauugaca

SEQ ID NO: 1174319 - RNA, 19 nt, Homo sapiens
uguaguguucuccacuaau

SEQ ID NO: 1174320 - RNA, 13 nt, Homo sapiens
uguaguuacucaa

SEQ ID NO: 1174321 - RNA, 16 nt, Homo sapiens
uguauaacuaggcugu

SEQ ID NO: 1174322 - RNA, 12 nt, Homo sapiens
uguauacugugg

SEQ ID NO: 1174323 - RNA, 20 nt, Homo sapiens
uguauagguuuuaaagaccu

SEQ ID NO: 1174324 - RNA, 22 nt, Homo sapiens
uguauaguuuuuagucugugua

SEQ ID NO: 1174325 - RNA, 21 nt, Homo sapiens
uguauccuuuauuucugauaa

SEQ ID NO: 1174326 - RNA, 16 nt, Homo sapiens
uguaugccaagugaga

SEQ ID NO: 1174327 - RNA, 19 nt, Homo sapiens
uguaugcuucauacaggga

SEQ ID NO: 1174328 - RNA, 18 nt, Homo sapiens
uguauguacguuuguaug

SEQ ID NO: 1174329 - RNA, 17 nt, Homo sapiens
uguauguguguagacaa

SEQ ID NO: 1174330 - RNA, 16 nt, Homo sapiens
uguaugugugugcaug

SEQ ID NO: 1174331 - RNA, 22 nt, Homo sapiens
uguauguuuuaauugcauuuaa

SEQ ID NO: 1174332 - RNA, 18 nt, Homo sapiens
uguauuacacacaguuuu

SEQ ID NO: 1174333 - RNA, 21 nt, Homo sapiens
uguauuagccagucauuguaa

SEQ ID NO: 1174334 - RNA, 14 nt, Homo sapiens
uguauucgugcauu

SEQ ID NO: 1174335 - RNA, 15 nt, Homo sapiens
uguauuuagugaaaa

SEQ ID NO: 1174336 - RNA, 17 nt, Homo sapiens
uguauuuugugaugaau

SEQ ID NO: 1174337 - RNA, 18 nt, Homo sapiens
ugucaaaaugagauucca

SEQ ID NO: 1174338 - RNA, 17 nt, Homo sapiens
ugucaaacaaagccaga

SEQ ID NO: 1174339 - RNA, 13 nt, Homo sapiens
ugucaaagugaua

SEQ ID NO: 1174340 - RNA, 18 nt, Homo sapiens
ugucaacauugugaugua

SEQ ID NO: 1174341 - RNA, 16 nt, Homo sapiens
ugucaagaaauucugc

SEQ ID NO: 1174342 - RNA, 20 nt, Homo sapiens
ugucaagccugugcaaaaaa

SEQ ID NO: 1174343 - RNA, 17 nt, Homo sapiens
ugucaaguguuuuacua

SEQ ID NO: 1174344 - RNA, 13 nt, Homo sapiens
ugucaaugugaac

SEQ ID NO: 1174345 - RNA, 23 nt, Homo sapiens
ugucacaauucuuagaucuggug

SEQ ID NO: 1174346 - RNA, 19 nt, Homo sapiens
ugucacgccagacuuccca

SEQ ID NO: 1174347 - RNA, 13 nt, Homo sapiens
ugucagcaucuga

SEQ ID NO: 1174348 - RNA, 19 nt, Homo sapiens
ugucagcccugugugguca

SEQ ID NO: 1174349 - RNA, 16 nt, Homo sapiens
ugucagcugcuguuga

SEQ ID NO: 1174350 - RNA, 16 nt, Homo sapiens
ugucagucacagccac

SEQ ID NO: 1174351 - RNA, 20 nt, Homo sapiens
ugucagugugaaaauucagc

SEQ ID NO: 1174352 - RNA, 19 nt, Homo sapiens
ugucaguuucagauccuga

SEQ ID NO: 1174353 - RNA, 21 nt, Homo sapiens
ugucauauggaagaguuaaaa

SEQ ID NO: 1174354 - RNA, 13 nt, Homo sapiens
ugucaucugccaa

SEQ ID NO: 1174355 - RNA, 22 nt, Homo sapiens
ugucauuaguauuucacaagaa

SEQ ID NO: 1174356 - RNA, 19 nt, Homo sapiens
ugucauuggaaacacugcc

SEQ ID NO: 1174357 - RNA, 16 nt, Homo sapiens
ugucauuuauguguca

SEQ ID NO: 1174358 - RNA, 17 nt, Homo sapiens
uguccaaacaggugcug

SEQ ID NO: 1174359 - RNA, 16 nt, Homo sapiens
uguccaccaccaccug

SEQ ID NO: 1174360 - RNA, 15 nt, Homo sapiens
uguccagacacgucc

SEQ ID NO: 1174361 - RNA, 17 nt, Homo sapiens
uguccagcauggaugaa

SEQ ID NO: 1174362 - RNA, 16 nt, Homo sapiens
uguccauuuauaucau

SEQ ID NO: 1174363 - RNA, 17 nt, Homo sapiens
uguccauuuugugaagc

SEQ ID NO: 1174364 - RNA, 23 nt, Homo sapiens
ugucccacuaucugggugcauga

SEQ ID NO: 1174365 - RNA, 22 nt, Homo sapiens
ugucccacucaagccaagcagc

SEQ ID NO: 1174366 - RNA, 23 nt, Homo sapiens
uguccccgccuucccucacucuu

SEQ ID NO: 1174367 - RNA, 17 nt, Homo sapiens
uguccccucauaggaug

SEQ ID NO: 1174368 - RNA, 21 nt, Homo sapiens
uguccccuuuccccagugaca

SEQ ID NO: 1174369 - RNA, 16 nt, Homo sapiens
ugucccgggacaccua

SEQ ID NO: 1174370 - RNA, 14 nt, Homo sapiens
ugucccguggcauu

SEQ ID NO: 1174371 - RNA, 12 nt, Homo sapiens
ugucccuaguaa

SEQ ID NO: 1174372 - RNA, 15 nt, Homo sapiens
ugucccugcacugug

SEQ ID NO: 1174373 - RNA, 19 nt, Homo sapiens
ugucccuggcgcugugcua

SEQ ID NO: 1174374 - RNA, 20 nt, Homo sapiens
ugucccuggcgcugugcuag

SEQ ID NO: 1174375 - RNA, 20 nt, Homo sapiens
ugucccuuuuugcaggggac

SEQ ID NO: 1174376 - RNA, 19 nt, Homo sapiens
uguccucagccuugccaga

SEQ ID NO: 1174377 - RNA, 13 nt, Homo sapiens
uguccuccaacac

SEQ ID NO: 1174378 - RNA, 15 nt, Homo sapiens
uguccuccaagccag

SEQ ID NO: 1174379 - RNA, 15 nt, Homo sapiens
uguccucuauaccug

SEQ ID NO: 1174380 - RNA, 15 nt, Homo sapiens
uguccugaagcugcu

SEQ ID NO: 1174381 - RNA, 20 nt, Homo sapiens
uguccugaugcuuuugucua

SEQ ID NO: 1174382 - RNA, 15 nt, Homo sapiens
uguccuggaauuauu

SEQ ID NO: 1174383 - RNA, 14 nt, Homo sapiens
ugucggacuaugua

SEQ ID NO: 1174384 - RNA, 16 nt, Homo sapiens
ugucggcggcuugaua

SEQ ID NO: 1174385 - RNA, 18 nt, Homo sapiens
ugucguauaggcauguaa

SEQ ID NO: 1174386 - RNA, 22 nt, Homo sapiens
ugucuaauuaaaacacuuucaa

SEQ ID NO: 1174387 - RNA, 20 nt, Homo sapiens
ugucuauuuuuuucaguuua

SEQ ID NO: 1174388 - RNA, 15 nt, Homo sapiens
ugucucaccuaccca

SEQ ID NO: 1174389 - RNA, 12 nt, Homo sapiens
ugucucagggug

SEQ ID NO: 1174390 - RNA, 11 nt, Homo sapiens
ugucucaguga

SEQ ID NO: 1174391 - RNA, 19 nt, Homo sapiens
ugucucauagaacugccug

SEQ ID NO: 1174392 - RNA, 19 nt, Homo sapiens
ugucucccagcucagggcu

SEQ ID NO: 1174393 - RNA, 15 nt, Homo sapiens
ugucucccccaacac

SEQ ID NO: 1174394 - RNA, 20 nt, Homo sapiens
ugucucuacuuuucccugua

SEQ ID NO: 1174395 - RNA, 17 nt, Homo sapiens
ugucucuuuccacuuug

SEQ ID NO: 1174396 - RNA, 15 nt, Homo sapiens
ugucugcaacaugga

SEQ ID NO: 1174397 - RNA, 12 nt, Homo sapiens
ugucugcaaugg

SEQ ID NO: 1174398 - RNA, 19 nt, Homo sapiens
ugucugccuggagugcugu

SEQ ID NO: 1174399 - RNA, 15 nt, Homo sapiens
ugucuggccaggccu

SEQ ID NO: 1174400 - RNA, 22 nt, Homo sapiens
ugucuguaaaaaauguaugcua

SEQ ID NO: 1174401 - RNA, 14 nt, Homo sapiens
ugucuuaaaucagu

SEQ ID NO: 1174402 - RNA, 18 nt, Homo sapiens
ugucuuggacacuguaca

SEQ ID NO: 1174403 - RNA, 21 nt, Homo sapiens
ugucuuuccacuccuccuagc

SEQ ID NO: 1174404 - RNA, 14 nt, Homo sapiens
ugucuuuuuacugg

SEQ ID NO: 1174405 - RNA, 23 nt, Homo sapiens
ugugaagaacuauuuuauucuaa

SEQ ID NO: 1174406 - RNA, 12 nt, Homo sapiens
ugugaagccaaa

SEQ ID NO: 1174407 - RNA, 16 nt, Homo sapiens
ugugaaguggaaaugu

SEQ ID NO: 1174408 - RNA, 18 nt, Homo sapiens
ugugaauagaacucugaa

SEQ ID NO: 1174409 - RNA, 20 nt, Homo sapiens
ugugaccaaugucuugaugc

SEQ ID NO: 1174410 - RNA, 21 nt, Homo sapiens
ugugaccaaugucuugaugca

SEQ ID NO: 1174411 - RNA, 20 nt, Homo sapiens
ugugaccagucugacccuua

SEQ ID NO: 1174412 - RNA, 18 nt, Homo sapiens
ugugaccuuaguguuucu

SEQ ID NO: 1174413 - RNA, 20 nt, Homo sapiens
ugugacuauaaagcuguuau

SEQ ID NO: 1174414 - RNA, 15 nt, Homo sapiens
ugugacucuuuccaa

SEQ ID NO: 1174415 - RNA, 15 nt, Homo sapiens
ugugagagaaagugu

SEQ ID NO: 1174416 - RNA, 19 nt, Homo sapiens
ugugagccccaggcacuuu

SEQ ID NO: 1174417 - RNA, 14 nt, Homo sapiens
ugugagccuugcug

SEQ ID NO: 1174418 - RNA, 17 nt, Homo sapiens
ugugagggcaccaccaa

SEQ ID NO: 1174419 - RNA, 17 nt, Homo sapiens
ugugagguauacauauu

SEQ ID NO: 1174420 - RNA, 17 nt, Homo sapiens
ugugaguaucagaauug

SEQ ID NO: 1174421 - RNA, 19 nt, Homo sapiens
ugugauaagaaaagccagu

SEQ ID NO: 1174422 - RNA, 14 nt, Homo sapiens
ugugaugaagccga

SEQ ID NO: 1174423 - RNA, 13 nt, Homo sapiens
ugugauguucuaa

SEQ ID NO: 1174424 - RNA, 17 nt, Homo sapiens
ugugauuuuaacucugu

SEQ ID NO: 1174425 - RNA, 14 nt, Homo sapiens
ugugcacugcauua

SEQ ID NO: 1174426 - RNA, 15 nt, Homo sapiens
ugugcagauugcagu

SEQ ID NO: 1174427 - RNA, 13 nt, Homo sapiens
ugugcaguagcau

SEQ ID NO: 1174428 - RNA, 18 nt, Homo sapiens
ugugcaguuuaaucuuuu

SEQ ID NO: 1174429 - RNA, 16 nt, Homo sapiens
ugugcauggaacuaaa

SEQ ID NO: 1174430 - RNA, 14 nt, Homo sapiens
ugugcauuuuacua

SEQ ID NO: 1174431 - RNA, 16 nt, Homo sapiens
ugugccagcacaaagu

SEQ ID NO: 1174432 - RNA, 19 nt, Homo sapiens
ugugccaguucuuuccaua

SEQ ID NO: 1174433 - RNA, 23 nt, Homo sapiens
ugugccaucacugagcauacuca

SEQ ID NO: 1174434 - RNA, 23 nt, Homo sapiens
ugugcccccugaaacagcugcca

SEQ ID NO: 1174435 - RNA, 12 nt, Homo sapiens
ugugcccgggga

SEQ ID NO: 1174436 - RNA, 15 nt, Homo sapiens
aaaaaauuauucugc

SEQ ID NO: 1174437 - RNA, 18 nt, Homo sapiens
aaaaaauuuuugcaaaua

SEQ ID NO: 1174438 - RNA, 12 nt, Homo sapiens
aaaaacaauuaa

SEQ ID NO: 1174439 - RNA, 13 nt, Homo sapiens
aaaaacauucuua

SEQ ID NO: 1174440 - RNA, 16 nt, Homo sapiens
aaaaaccagacaagau

SEQ ID NO: 1174441 - RNA, 15 nt, Homo sapiens
aaaaacuagagcaca

SEQ ID NO: 1174442 - RNA, 13 nt, Homo sapiens
aaaaacuaguagu

SEQ ID NO: 1174443 - RNA, 21 nt, Homo sapiens
aaaaacuuaccuacuggggac

SEQ ID NO: 1174444 - RNA, 20 nt, Homo sapiens
aaaaagaaacuuacuaaaua

SEQ ID NO: 1174445 - RNA, 19 nt, Homo sapiens
aaaaagaguuacacuggaa

SEQ ID NO: 1174446 - RNA, 12 nt, Homo sapiens
aaaaagcuucca

SEQ ID NO: 1174447 - RNA, 21 nt, Homo sapiens
aaaaaggauaugguagcauuu

SEQ ID NO: 1174448 - RNA, 14 nt, Homo sapiens
aaaaaggcugugcu

SEQ ID NO: 1174449 - RNA, 19 nt, Homo sapiens
aaaaaguuacugcaacuua

SEQ ID NO: 1174450 - RNA, 23 nt, Homo sapiens
aaaaauagauuugaaacauuuau

SEQ ID NO: 1174451 - RNA, 23 nt, Homo sapiens
aaaaauagguuuguagugaaaua

SEQ ID NO: 1174452 - RNA, 17 nt, Homo sapiens
aaaaauauauuuccuca

SEQ ID NO: 1174453 - RNA, 15 nt, Homo sapiens
aaaaaucagugaaua

SEQ ID NO: 1174454 - RNA, 17 nt, Homo sapiens
aaaaaucauaguacucu

SEQ ID NO: 1174455 - RNA, 13 nt, Homo sapiens
aaaaaugagcucg

SEQ ID NO: 1174456 - RNA, 11 nt, Homo sapiens
aaaaaugauuu

SEQ ID NO: 1174457 - RNA, 22 nt, Homo sapiens
aaaaaugcaaaaaagaaacaau

SEQ ID NO: 1174458 - RNA, 23 nt, Homo sapiens
aaaaauggauacuggugcaguca

SEQ ID NO: 1174459 - RNA, 16 nt, Homo sapiens
aaaaauggucaauaaa

SEQ ID NO: 1174460 - RNA, 20 nt, Homo sapiens
aaaaauguauaugcacuuau

SEQ ID NO: 1174461 - RNA, 23 nt, Homo sapiens
aaaaaugugaaauuuuuccacac

SEQ ID NO: 1174462 - RNA, 12 nt, Homo sapiens
aaaaauguucuu

SEQ ID NO: 1174463 - RNA, 18 nt, Homo sapiens
aaaaauguuuuucaaaac

SEQ ID NO: 1174464 - RNA, 18 nt, Homo sapiens
aaaacaagauuaauuuca

SEQ ID NO: 1174465 - RNA, 16 nt, Homo sapiens
aaaacaagcauucaca

SEQ ID NO: 1174466 - RNA, 13 nt, Homo sapiens
aaaacaccagacc

SEQ ID NO: 1174467 - RNA, 11 nt, Homo sapiens
aaaacacugcc

SEQ ID NO: 1174468 - RNA, 18 nt, Homo sapiens
aaaacacugcccucuugu

SEQ ID NO: 1174469 - RNA, 13 nt, Homo sapiens
aaaacacugugca

SEQ ID NO: 1174470 - RNA, 22 nt, Homo sapiens
aaaacagaaauuaaucuuacaa

SEQ ID NO: 1174471 - RNA, 18 nt, Homo sapiens
aaaacagccucacagaag

SEQ ID NO: 1174472 - RNA, 22 nt, Homo sapiens
aaaacauacaagagacauauaa

SEQ ID NO: 1174473 - RNA, 22 nt, Homo sapiens
aaaacauagacugaagauuuau

SEQ ID NO: 1174474 - RNA, 11 nt, Homo sapiens
aaaacaucacu

SEQ ID NO: 1174475 - RNA, 11 nt, Homo sapiens
aaaacauguau

SEQ ID NO: 1174476 - RNA, 16 nt, Homo sapiens
aaaacauguaugugca

SEQ ID NO: 1174477 - RNA, 20 nt, Homo sapiens
aaaacauugugccaugucaa

SEQ ID NO: 1174478 - RNA, 20 nt, Homo sapiens
aaaaccaaauuuguauuuaa

SEQ ID NO: 1174479 - RNA, 18 nt, Homo sapiens
aaaaccagagaagaucca

SEQ ID NO: 1174480 - RNA, 19 nt, Homo sapiens
aaaaccaggccuuaucucc

SEQ ID NO: 1174481 - RNA, 18 nt, Homo sapiens
aaaaccauuuuuuccuac

SEQ ID NO: 1174482 - RNA, 13 nt, Homo sapiens
aaaacccagagag

SEQ ID NO: 1174483 - RNA, 20 nt, Homo sapiens
aaaacuaaauggugcuuuau

SEQ ID NO: 1174484 - RNA, 19 nt, Homo sapiens
aaaacuacaaccaauggaa

SEQ ID NO: 1174485 - RNA, 19 nt, Homo sapiens
aaaacuaggaauccuccaa

SEQ ID NO: 1174486 - RNA, 20 nt, Homo sapiens
aaaacucagaaugaaaauuc

SEQ ID NO: 1174487 - RNA, 14 nt, Homo sapiens
aaaacuccgucuca

SEQ ID NO: 1174488 - RNA, 17 nt, Homo sapiens
aaaacugcagucaucaa

SEQ ID NO: 1174489 - RNA, 22 nt, Homo sapiens
aaaacugcagucaucaacaaug

SEQ ID NO: 1174490 - RNA, 15 nt, Homo sapiens
aaaacugugccuugu

SEQ ID NO: 1174491 - RNA, 19 nt, Homo sapiens
aaaacuugaucacaugcuu

SEQ ID NO: 1174492 - RNA, 11 nt, Homo sapiens
aaaacuuguag

SEQ ID NO: 1174493 - RNA, 17 nt, Homo sapiens
aaaacuugugcuauaaa

SEQ ID NO: 1174494 - RNA, 16 nt, Homo sapiens
aaaagaaaaucuauua

SEQ ID NO: 1174495 - RNA, 18 nt, Homo sapiens
aaaagaaacacgcacuua

SEQ ID NO: 1174496 - RNA, 12 nt, Homo sapiens
aaaagaacaugc

SEQ ID NO: 1174497 - RNA, 15 nt, Homo sapiens
aaaagaacaugcagu

SEQ ID NO: 1174498 - RNA, 16 nt, Homo sapiens
aaaagaacaugcaguu

SEQ ID NO: 1174499 - RNA, 12 nt, Homo sapiens
aaaagacugaau

SEQ ID NO: 1174500 - RNA, 22 nt, Homo sapiens
aaaagacuuuuuccuugggcuu

SEQ ID NO: 1174501 - RNA, 14 nt, Homo sapiens
aaaagagauugaga

SEQ ID NO: 1174502 - RNA, 17 nt, Homo sapiens
aaaagaggccuguucau

SEQ ID NO: 1174503 - RNA, 20 nt, Homo sapiens
aaaagcaaauagaucaugca

SEQ ID NO: 1174504 - RNA, 15 nt, Homo sapiens
aaaagccauguguau

SEQ ID NO: 1174505 - RNA, 20 nt, Homo sapiens
aaaagcccaccugaaagccu

SEQ ID NO: 1174506 - RNA, 15 nt, Homo sapiens
aaaagccucagcuca

SEQ ID NO: 1174507 - RNA, 13 nt, Homo sapiens
aaaagcuuuccug

SEQ ID NO: 1174508 - RNA, 14 nt, Homo sapiens
aaaaggaacugcag

SEQ ID NO: 1174509 - RNA, 20 nt, Homo sapiens
aaaaggacucucaggaccaa

SEQ ID NO: 1174510 - RNA, 23 nt, Homo sapiens
aaaaggcaccuauaaaacagguc

SEQ ID NO: 1174511 - RNA, 20 nt, Homo sapiens
aaaaggcuaagcuucacugu

SEQ ID NO: 1174512 - RNA, 22 nt, Homo sapiens
aaaaggcuaagcuucacuguaa

SEQ ID NO: 1174513 - RNA, 14 nt, Homo sapiens
aaaaggcugccuaa

SEQ ID NO: 1174514 - RNA, 22 nt, Homo sapiens
aaaagggaagucuagaguuccu

SEQ ID NO: 1174515 - RNA, 22 nt, Homo sapiens
aaaagggucuugggaaauauga

SEQ ID NO: 1174516 - RNA, 16 nt, Homo sapiens
aaaagguaacuguaca

SEQ ID NO: 1174517 - RNA, 18 nt, Homo sapiens
aaaaguauccugcuucug

SEQ ID NO: 1174518 - RNA, 21 nt, Homo sapiens
aaaagucauuuaauguagaau

SEQ ID NO: 1174519 - RNA, 23 nt, Homo sapiens
aaaaguccucuggauugagauac

SEQ ID NO: 1174520 - RNA, 10 nt, Homo sapiens
aaaagugaug

SEQ ID NO: 1174521 - RNA, 23 nt, Homo sapiens
aaaaguggaguuguuuuaacaga

SEQ ID NO: 1174522 - RNA, 22 nt, Homo sapiens
aaaagugucaccuuuucuugcc

SEQ ID NO: 1174523 - RNA, 15 nt, Homo sapiens
aaaaguuacauguuu

SEQ ID NO: 1174524 - RNA, 19 nt, Homo sapiens
aaaaguuacauguuugcac

SEQ ID NO: 1174525 - RNA, 23 nt, Homo sapiens
aaaaguuugaauaccagcuuucu

SEQ ID NO: 1174526 - RNA, 17 nt, Homo sapiens
aaaauaaaaaacauaua

SEQ ID NO: 1174527 - RNA, 15 nt, Homo sapiens
aaaauaaaacacauu

SEQ ID NO: 1174528 - RNA, 17 nt, Homo sapiens
aaaauaaaacacauuua

SEQ ID NO: 1174529 - RNA, 15 nt, Homo sapiens
aaaauaaaccaaaua

SEQ ID NO: 1174530 - RNA, 12 nt, Homo sapiens
aaaauaaauucc

SEQ ID NO: 1174531 - RNA, 13 nt, Homo sapiens
aaaauaaauucuc

SEQ ID NO: 1174532 - RNA, 23 nt, Homo sapiens
aaaauaaccggauauauacauag

SEQ ID NO: 1174533 - RNA, 14 nt, Homo sapiens
aaaauaaugcaguu

SEQ ID NO: 1174534 - RNA, 21 nt, Homo sapiens
aaaauacaauuaaagcaaaau

SEQ ID NO: 1174535 - RNA, 13 nt, Homo sapiens
aaaauacuaccua

SEQ ID NO: 1174536 - RNA, 13 nt, Homo sapiens
aaaauagaaacau

SEQ ID NO: 1174537 - RNA, 18 nt, Homo sapiens
aaaauagucuaguguagu

SEQ ID NO: 1174538 - RNA, 22 nt, Homo sapiens
aaaauaguggaucucaguuuuu

SEQ ID NO: 1174539 - RNA, 21 nt, Homo sapiens
aaaauaugggaaagacaugca

SEQ ID NO: 1174540 - RNA, 16 nt, Homo sapiens
aaaauauuucagauau

SEQ ID NO: 1174541 - RNA, 21 nt, Homo sapiens
aaaauauuuccugacuugagu

SEQ ID NO: 1174542 - RNA, 13 nt, Homo sapiens
aaaauauuuuaca

SEQ ID NO: 1174543 - RNA, 19 nt, Homo sapiens
aaaaucaguguuuaaauaa

SEQ ID NO: 1174544 - RNA, 18 nt, Homo sapiens
aaaaucauaggcacuuag

SEQ ID NO: 1174545 - RNA, 16 nt, Homo sapiens
aaaauccuacuuucau

SEQ ID NO: 1174546 - RNA, 14 nt, Homo sapiens
aaaauccuuacuuc

SEQ ID NO: 1174547 - RNA, 17 nt, Homo sapiens
aaaauccuuacuuccag

SEQ ID NO: 1174548 - RNA, 18 nt, Homo sapiens
aaaauccuuuuugcauau

SEQ ID NO: 1174549 - RNA, 18 nt, Homo sapiens
aaaaucgagccucuccca

SEQ ID NO: 1174550 - RNA, 15 nt, Homo sapiens
aaaaucuucagcugg

SEQ ID NO: 1174551 - RNA, 16 nt, Homo sapiens
aaaaucuucagcuggu

SEQ ID NO: 1174552 - RNA, 15 nt, Homo sapiens
aaaaugauccugcca

SEQ ID NO: 1174553 - RNA, 17 nt, Homo sapiens
aaaaugcaucacaugau

SEQ ID NO: 1174554 - RNA, 17 nt, Homo sapiens
aaaaugcgggcauuuaa

SEQ ID NO: 1174555 - RNA, 15 nt, Homo sapiens
aaaaugcucuugucc

SEQ ID NO: 1174556 - RNA, 13 nt, Homo sapiens
aaaaugcugauau

SEQ ID NO: 1174557 - RNA, 14 nt, Homo sapiens
aaaaugcugucaca

SEQ ID NO: 1174558 - RNA, 14 nt, Homo sapiens
aaaaugcuguuuuc

SEQ ID NO: 1174559 - RNA, 17 nt, Homo sapiens
aaaauggaauuacucca

SEQ ID NO: 1174560 - RNA, 19 nt, Homo sapiens
aaaauggagguggaaagac

SEQ ID NO: 1174561 - RNA, 18 nt, Homo sapiens
aaaauggcagugaugaau

SEQ ID NO: 1174562 - RNA, 17 nt, Homo sapiens
aaaauggcgaacaugug

SEQ ID NO: 1174563 - RNA, 20 nt, Homo sapiens
aaaaugggaaaccaguucau

SEQ ID NO: 1174564 - RNA, 11 nt, Homo sapiens
aaaauggucaa

SEQ ID NO: 1174565 - RNA, 16 nt, Homo sapiens
aaaauguaacuugaaa

SEQ ID NO: 1174566 - RNA, 21 nt, Homo sapiens
aaaauguaaugcaacuaccca

SEQ ID NO: 1174567 - RNA, 23 nt, Homo sapiens
aaaauguagacugaaaagccaug

SEQ ID NO: 1174568 - RNA, 17 nt, Homo sapiens
aaaauguccugccuuuu

SEQ ID NO: 1174569 - RNA, 14 nt, Homo sapiens
aacugacuaaccau

SEQ ID NO: 1174570 - RNA, 21 nt, Homo sapiens
aacugaggagcggacucacuu

SEQ ID NO: 1174571 - RNA, 13 nt, Homo sapiens
aacugccauaaca

SEQ ID NO: 1174572 - RNA, 15 nt, Homo sapiens
aacugccuccuugcc

SEQ ID NO: 1174573 - RNA, 20 nt, Homo sapiens
aacugccuuauuaaagcaaa

SEQ ID NO: 1174574 - RNA, 20 nt, Homo sapiens
aacugccuuuggcagaguuc

SEQ ID NO: 1174575 - RNA, 14 nt, Homo sapiens
aacugcuccucccc

SEQ ID NO: 1174576 - RNA, 16 nt, Homo sapiens
aacugcugcuucacca

SEQ ID NO: 1174577 - RNA, 21 nt, Homo sapiens
aacugcuuuugcccauauaaa

SEQ ID NO: 1174578 - RNA, 19 nt, Homo sapiens
aacuggaagauacauaaaa

SEQ ID NO: 1174579 - RNA, 16 nt, Homo sapiens
aacuggaauuucgcuc

SEQ ID NO: 1174580 - RNA, 18 nt, Homo sapiens
aacugggccuguagcuca

SEQ ID NO: 1174581 - RNA, 15 nt, Homo sapiens
aacugguaguguuca

SEQ ID NO: 1174582 - RNA, 23 nt, Homo sapiens
aacuggucagggcaaaccugccu

SEQ ID NO: 1174583 - RNA, 13 nt, Homo sapiens
aacuguacugaag

SEQ ID NO: 1174584 - RNA, 17 nt, Homo sapiens
aacugucccccaaaaaa

SEQ ID NO: 1174585 - RNA, 18 nt, Homo sapiens
aacugucuuuuaaugugu

SEQ ID NO: 1174586 - RNA, 20 nt, Homo sapiens
aacugugugcaacagacaaa

SEQ ID NO: 1174587 - RNA, 21 nt, Homo sapiens
aacuguuggcaaggugacauu

SEQ ID NO: 1174588 - RNA, 21 nt, Homo sapiens
aacuguugguauuaaggcaga

SEQ ID NO: 1174589 - RNA, 22 nt, Homo sapiens
aacuuacacuguauauuuugca

SEQ ID NO: 1174590 - RNA, 13 nt, Homo sapiens
aacuuacuuccaa

SEQ ID NO: 1174591 - RNA, 16 nt, Homo sapiens
aacuuauuuauaugaa

SEQ ID NO: 1174592 - RNA, 13 nt, Homo sapiens
aacuucaaaaauc

SEQ ID NO: 1174593 - RNA, 13 nt, Homo sapiens
aacuucaaagagg

SEQ ID NO: 1174594 - RNA, 22 nt, Homo sapiens
aacuucaagggacaaguauuaa

SEQ ID NO: 1174595 - RNA, 13 nt, Homo sapiens
aacuucauauuaa

SEQ ID NO: 1174596 - RNA, 15 nt, Homo sapiens
aacuucccuguucuu

SEQ ID NO: 1174597 - RNA, 16 nt, Homo sapiens
aacuugaaauauccug

SEQ ID NO: 1174598 - RNA, 19 nt, Homo sapiens
aacuuggauguaccugccc

SEQ ID NO: 1174599 - RNA, 17 nt, Homo sapiens
aacuuguaucugaagac

SEQ ID NO: 1174600 - RNA, 17 nt, Homo sapiens
aacuugucacuugcaug

SEQ ID NO: 1174601 - RNA, 22 nt, Homo sapiens
aacuuguuugguaguuagccau

SEQ ID NO: 1174602 - RNA, 21 nt, Homo sapiens
aacuuuauucuugaaagaaga

SEQ ID NO: 1174603 - RNA, 22 nt, Homo sapiens
aacuuugaagagaugagcagug

SEQ ID NO: 1174604 - RNA, 20 nt, Homo sapiens
aacuuugaauaaagaauacu

SEQ ID NO: 1174605 - RNA, 14 nt, Homo sapiens
aacuuugacuuucu

SEQ ID NO: 1174606 - RNA, 19 nt, Homo sapiens
aacuuuggugaacaguuuu

SEQ ID NO: 1174607 - RNA, 18 nt, Homo sapiens
aacuuuuaucacuguugc

SEQ ID NO: 1174608 - RNA, 21 nt, Homo sapiens
aacuuuuccuuucauacgucu

SEQ ID NO: 1174609 - RNA, 23 nt, Homo sapiens
aacuuuuuaaagaagugcaugaa

SEQ ID NO: 1174610 - RNA, 19 nt, Homo sapiens
aagaaaaaaggccuugaau

SEQ ID NO: 1174611 - RNA, 16 nt, Homo sapiens
aagaaaaacaccgcuu

SEQ ID NO: 1174612 - RNA, 13 nt, Homo sapiens
aagaaaaaccacg

SEQ ID NO: 1174613 - RNA, 20 nt, Homo sapiens
aagaaaaauuuauauuucag

SEQ ID NO: 1174614 - RNA, 18 nt, Homo sapiens
aagaaaacaccacuaauu

SEQ ID NO: 1174615 - RNA, 19 nt, Homo sapiens
aagaaaacaucuauucucu

SEQ ID NO: 1174616 - RNA, 14 nt, Homo sapiens
aagaaaacauuuug

SEQ ID NO: 1174617 - RNA, 12 nt, Homo sapiens
aagaaacaauaa

SEQ ID NO: 1174618 - RNA, 13 nt, Homo sapiens
aagaaacacugcc

SEQ ID NO: 1174619 - RNA, 17 nt, Homo sapiens
aagaaacccagacugaa

SEQ ID NO: 1174620 - RNA, 18 nt, Homo sapiens
aagaaacugcucuaauau

SEQ ID NO: 1174621 - RNA, 21 nt, Homo sapiens
aagaaacuuuggaagcacuuu

SEQ ID NO: 1174622 - RNA, 23 nt, Homo sapiens
aagaaagaaacacucaacaauaa

SEQ ID NO: 1174623 - RNA, 19 nt, Homo sapiens
aagaaagcaacuuuacuga

SEQ ID NO: 1174624 - RNA, 18 nt, Homo sapiens
aagaaaggccagcaaauu

SEQ ID NO: 1174625 - RNA, 16 nt, Homo sapiens
aagaaaguggucuuaa

SEQ ID NO: 1174626 - RNA, 18 nt, Homo sapiens
aagaaauaaaaucuaauu

SEQ ID NO: 1174627 - RNA, 15 nt, Homo sapiens
aagaaauaaccacug

SEQ ID NO: 1174628 - RNA, 16 nt, Homo sapiens
aagaaauaaccaugaa

SEQ ID NO: 1174629 - RNA, 12 nt, Homo sapiens
aagaaaucuggu

SEQ ID NO: 1174630 - RNA, 21 nt, Homo sapiens
aagaaauguuuuugcuguuaa

SEQ ID NO: 1174631 - RNA, 23 nt, Homo sapiens
aagaaauuuaauguuucucugga

SEQ ID NO: 1174632 - RNA, 15 nt, Homo sapiens
aagaaauuugaugaa

SEQ ID NO: 1174633 - RNA, 17 nt, Homo sapiens
aagaacauaaguuauca

SEQ ID NO: 1174634 - RNA, 12 nt, Homo sapiens
aagaaccagaga

SEQ ID NO: 1174635 - RNA, 16 nt, Homo sapiens
aagaaccugucccagg

SEQ ID NO: 1174636 - RNA, 16 nt, Homo sapiens
aagaacucaucacugu

SEQ ID NO: 1174637 - RNA, 16 nt, Homo sapiens
aagaacugaagcucuu

SEQ ID NO: 1174638 - RNA, 13 nt, Homo sapiens
aagaagagacugc

SEQ ID NO: 1174639 - RNA, 23 nt, Homo sapiens
aagaagcugguggagcagagugu

SEQ ID NO: 1174640 - RNA, 11 nt, Homo sapiens
aagaaggcauu

SEQ ID NO: 1174641 - RNA, 13 nt, Homo sapiens
aagaaggcauuug

SEQ ID NO: 1174642 - RNA, 19 nt, Homo sapiens
aagaagggaguuccaguca

SEQ ID NO: 1174643 - RNA, 23 nt, Homo sapiens
aagaagucuggccauuuuggaaa

SEQ ID NO: 1174644 - RNA, 16 nt, Homo sapiens
aagaagugaacacuua

SEQ ID NO: 1174645 - RNA, 15 nt, Homo sapiens
aagaaguucauuuug

SEQ ID NO: 1174646 - RNA, 12 nt, Homo sapiens
aagaaucacuug

SEQ ID NO: 1174647 - RNA, 15 nt, Homo sapiens
aagaaugaaacaauc

SEQ ID NO: 1174648 - RNA, 23 nt, Homo sapiens
aagaaugucucggucacaucagg

SEQ ID NO: 1174649 - RNA, 23 nt, Homo sapiens
aagaauugauucauguucaucaa

SEQ ID NO: 1174650 - RNA, 12 nt, Homo sapiens
aagaauugcucc

SEQ ID NO: 1174651 - RNA, 13 nt, Homo sapiens
aagaauuggccag

SEQ ID NO: 1174652 - RNA, 21 nt, Homo sapiens
aagaauuucccagugaaauaa

SEQ ID NO: 1174653 - RNA, 16 nt, Homo sapiens
aagacacucccaccag

SEQ ID NO: 1174654 - RNA, 13 nt, Homo sapiens
aagacacugccug

SEQ ID NO: 1174655 - RNA, 15 nt, Homo sapiens
aagacagcagacaaa

SEQ ID NO: 1174656 - RNA, 20 nt, Homo sapiens
aagacaugauuuccuugaau

SEQ ID NO: 1174657 - RNA, 15 nt, Homo sapiens
aagacaugcagcuuu

SEQ ID NO: 1174658 - RNA, 23 nt, Homo sapiens
aagacauuuuuugcuauaaucau

SEQ ID NO: 1174659 - RNA, 17 nt, Homo sapiens
aagaccagccuggccaa

SEQ ID NO: 1174660 - RNA, 21 nt, Homo sapiens
aagaccuaaggguuuuaucuc

SEQ ID NO: 1174661 - RNA, 19 nt, Homo sapiens
aagaccugacaccuuucau

SEQ ID NO: 1174662 - RNA, 20 nt, Homo sapiens
aagaccuggcagcucuggac

SEQ ID NO: 1174663 - RNA, 19 nt, Homo sapiens
aagaccugggguugucagc

SEQ ID NO: 1174664 - RNA, 15 nt, Homo sapiens
aagaccuugcugaua

SEQ ID NO: 1174665 - RNA, 15 nt, Homo sapiens
aagacuagucccuug

SEQ ID NO: 1174666 - RNA, 15 nt, Homo sapiens
aagacucugaacaau

SEQ ID NO: 1174667 - RNA, 23 nt, Homo sapiens
aagacugaaucuaccugcccuaa

SEQ ID NO: 1174668 - RNA, 17 nt, Homo sapiens
aagacugcaaacccuuu

SEQ ID NO: 1174669 - RNA, 18 nt, Homo sapiens
aagacuggauuugcagaa

SEQ ID NO: 1174670 - RNA, 21 nt, Homo sapiens
aagacugugcggcacaggaaa

SEQ ID NO: 1174671 - RNA, 14 nt, Homo sapiens
aagacuguugugcu

SEQ ID NO: 1174672 - RNA, 18 nt, Homo sapiens
aagacuugauacugcaau

SEQ ID NO: 1174673 - RNA, 21 nt, Homo sapiens
aagacuugauacugcaauaaa

SEQ ID NO: 1174674 - RNA, 16 nt, Homo sapiens
aagagaauguauuucc

SEQ ID NO: 1174675 - RNA, 22 nt, Homo sapiens
aagagacagagacuggcauuuu

SEQ ID NO: 1174676 - RNA, 22 nt, Homo sapiens
aagagagcaacauuuuacccac

SEQ ID NO: 1174677 - RNA, 14 nt, Homo sapiens
aagagauccaaaga

SEQ ID NO: 1174678 - RNA, 22 nt, Homo sapiens
aagagaucccaaguagaaucuc

SEQ ID NO: 1174679 - RNA, 19 nt, Homo sapiens
aagagcaaaacuccgucuc

SEQ ID NO: 1174680 - RNA, 13 nt, Homo sapiens
aagagcaaugugu

SEQ ID NO: 1174681 - RNA, 18 nt, Homo sapiens
aagagcagcuaaaaccua

SEQ ID NO: 1174682 - RNA, 15 nt, Homo sapiens
aagagccacagugag

SEQ ID NO: 1174683 - RNA, 20 nt, Homo sapiens
aagagccauauaaguuugaa

SEQ ID NO: 1174684 - RNA, 21 nt, Homo sapiens
aagagccggagccuccagcug

SEQ ID NO: 1174685 - RNA, 21 nt, Homo sapiens
aagaggaaggccucuguggca

SEQ ID NO: 1174686 - RNA, 18 nt, Homo sapiens
aagaggagccucagaaga

SEQ ID NO: 1174687 - RNA, 14 nt, Homo sapiens
aagaggccugugau

SEQ ID NO: 1174688 - RNA, 15 nt, Homo sapiens
aagaggcuccagaaa

SEQ ID NO: 1174689 - RNA, 23 nt, Homo sapiens
aagaggcuccagaaauguuugcu

SEQ ID NO: 1174690 - RNA, 14 nt, Homo sapiens
aagaggcugagaca

SEQ ID NO: 1174691 - RNA, 22 nt, Homo sapiens
aagaggcuggaguugucacugc

SEQ ID NO: 1174692 - RNA, 16 nt, Homo sapiens
aagaggggccugauga

SEQ ID NO: 1174693 - RNA, 23 nt, Homo sapiens
aagaggguccuuuaguaccugaa

SEQ ID NO: 1174694 - RNA, 18 nt, Homo sapiens
aagaguaaaggaaaugau

SEQ ID NO: 1174695 - RNA, 15 nt, Homo sapiens
aagaguauguuguaa

SEQ ID NO: 1174696 - RNA, 14 nt, Homo sapiens
aagagucauuguua

SEQ ID NO: 1174697 - RNA, 12 nt, Homo sapiens
aagagucucucc

SEQ ID NO: 1174698 - RNA, 14 nt, Homo sapiens
aagagucucuccag

SEQ ID NO: 1174699 - RNA, 19 nt, Homo sapiens
aagaguguucaacugugag

SEQ ID NO: 1174700 - RNA, 18 nt, Homo sapiens
aagaguuaaaacauuucu

SEQ ID NO: 1174701 - RNA, 10 nt, Homo sapiens
aaucuacauu

SEQ ID NO: 1174702 - RNA, 20 nt, Homo sapiens
aaucuaccugcccuaaggga

SEQ ID NO: 1174703 - RNA, 16 nt, Homo sapiens
aaucuacuaauuccac

SEQ ID NO: 1174704 - RNA, 15 nt, Homo sapiens
aaucuauagaacuga

SEQ ID NO: 1174705 - RNA, 15 nt, Homo sapiens
aaucuauccauugaa

SEQ ID NO: 1174706 - RNA, 16 nt, Homo sapiens
aaucuaugccuaaaaa

SEQ ID NO: 1174707 - RNA, 17 nt, Homo sapiens
aaucucguuuagugcca

SEQ ID NO: 1174708 - RNA, 23 nt, Homo sapiens
aaucugaggccuccucucucagu

SEQ ID NO: 1174709 - RNA, 23 nt, Homo sapiens
aaucugccugauaggacccauau

SEQ ID NO: 1174710 - RNA, 16 nt, Homo sapiens
aaucugcucacuuuaa

SEQ ID NO: 1174711 - RNA, 19 nt, Homo sapiens
aaucuggguaucuuuccag

SEQ ID NO: 1174712 - RNA, 13 nt, Homo sapiens
aaucuguauaaau

SEQ ID NO: 1174713 - RNA, 14 nt, Homo sapiens
aaucuguguacaaa

SEQ ID NO: 1174714 - RNA, 20 nt, Homo sapiens
aaucuuaaaaguguuguuau

SEQ ID NO: 1174715 - RNA, 21 nt, Homo sapiens
aaucuuacaaaagauugucau

SEQ ID NO: 1174716 - RNA, 16 nt, Homo sapiens
aaucuuaugaguauaa

SEQ ID NO: 1174717 - RNA, 14 nt, Homo sapiens
aaucuuaugcucuc

SEQ ID NO: 1174718 - RNA, 13 nt, Homo sapiens
aaucuugccuuug

SEQ ID NO: 1174719 - RNA, 20 nt, Homo sapiens
aaucuuucugcagaaacaga

SEQ ID NO: 1174720 - RNA, 17 nt, Homo sapiens
aaucuuucuucucgccu

SEQ ID NO: 1174721 - RNA, 20 nt, Homo sapiens
aaucuuuguuacucuguaaa

SEQ ID NO: 1174722 - RNA, 15 nt, Homo sapiens
aaucuuuuucuccac

SEQ ID NO: 1174723 - RNA, 12 nt, Homo sapiens
aaugaaacaauc

SEQ ID NO: 1174724 - RNA, 12 nt, Homo sapiens
aaugaaaggagu

SEQ ID NO: 1174725 - RNA, 16 nt, Homo sapiens
aaugaaaucucaggaa

SEQ ID NO: 1174726 - RNA, 12 nt, Homo sapiens
aaugaaccacug

SEQ ID NO: 1174727 - RNA, 22 nt, Homo sapiens
aaugaagacuacauuugugaac

SEQ ID NO: 1174728 - RNA, 17 nt, Homo sapiens
aaugaagaucauauacg

SEQ ID NO: 1174729 - RNA, 21 nt, Homo sapiens
aaugaagggacggcuguggga

SEQ ID NO: 1174730 - RNA, 22 nt, Homo sapiens
aaugaagggacggcugugggac

SEQ ID NO: 1174731 - RNA, 16 nt, Homo sapiens
aaugaagggucauuuc

SEQ ID NO: 1174732 - RNA, 13 nt, Homo sapiens
aaugaauagcuug

SEQ ID NO: 1174733 - RNA, 22 nt, Homo sapiens
aaugaauaugccaucuaugcag

SEQ ID NO: 1174734 - RNA, 14 nt, Homo sapiens
aaugaauuaauuca

SEQ ID NO: 1174735 - RNA, 17 nt, Homo sapiens
aaugaauuccucauuug

SEQ ID NO: 1174736 - RNA, 20 nt, Homo sapiens
aaugaauucgaugcguauuc

SEQ ID NO: 1174737 - RNA, 14 nt, Homo sapiens
aaugacuaagccaa

SEQ ID NO: 1174738 - RNA, 19 nt, Homo sapiens
aaugacucaggacaucccc

SEQ ID NO: 1174739 - RNA, 23 nt, Homo sapiens
aaugacuuagaaacaauguuugc

SEQ ID NO: 1174740 - RNA, 15 nt, Homo sapiens
aaugagcagggaugg

SEQ ID NO: 1174741 - RNA, 14 nt, Homo sapiens
aaugagccaugaga

SEQ ID NO: 1174742 - RNA, 14 nt, Homo sapiens
aaugagugcuuaaa

SEQ ID NO: 1174743 - RNA, 13 nt, Homo sapiens
aaugauacuuacu

SEQ ID NO: 1174744 - RNA, 16 nt, Homo sapiens
aaugauagaacuguac

SEQ ID NO: 1174745 - RNA, 15 nt, Homo sapiens
aaugauccucagugc

SEQ ID NO: 1174746 - RNA, 13 nt, Homo sapiens
aaugcaaacuggg

SEQ ID NO: 1174747 - RNA, 23 nt, Homo sapiens
aaugcaaaucaauaaauucccaa

SEQ ID NO: 1174748 - RNA, 20 nt, Homo sapiens
aaugcaagauaguuuaucua

SEQ ID NO: 1174749 - RNA, 18 nt, Homo sapiens
aaugcacaaaacuuugau

SEQ ID NO: 1174750 - RNA, 20 nt, Homo sapiens
aaugcagcagggaugcccug

SEQ ID NO: 1174751 - RNA, 15 nt, Homo sapiens
aaugcagucugucca

SEQ ID NO: 1174752 - RNA, 23 nt, Homo sapiens
aaugcaguuguggugugccaugc

SEQ ID NO: 1174753 - RNA, 15 nt, Homo sapiens
aaugcaucucaucaa

SEQ ID NO: 1174754 - RNA, 20 nt, Homo sapiens
aaugcauuuggaaccaaagu

SEQ ID NO: 1174755 - RNA, 15 nt, Homo sapiens
aaugcccacugccug

SEQ ID NO: 1174756 - RNA, 18 nt, Homo sapiens
aaugccuauaaaaugccc

SEQ ID NO: 1174757 - RNA, 13 nt, Homo sapiens
aaugcuacugaaa

SEQ ID NO: 1174758 - RNA, 23 nt, Homo sapiens
aaugcucaagaaacaacuucuac

SEQ ID NO: 1174759 - RNA, 12 nt, Homo sapiens
aaugcugagaag

SEQ ID NO: 1174760 - RNA, 20 nt, Homo sapiens
aaugcugcaggacuugagaa

SEQ ID NO: 1174761 - RNA, 17 nt, Homo sapiens
aaugcuucuagaguuuu

SEQ ID NO: 1174762 - RNA, 22 nt, Homo sapiens
aauggagaauuaaaaauaccaa

SEQ ID NO: 1174763 - RNA, 16 nt, Homo sapiens
aauggcagaaccaaag

SEQ ID NO: 1174764 - RNA, 20 nt, Homo sapiens
aauggcaggaucucagauca

SEQ ID NO: 1174765 - RNA, 14 nt, Homo sapiens
aauggccaucugua

SEQ ID NO: 1174766 - RNA, 14 nt, Homo sapiens
aauggcuacacuca

SEQ ID NO: 1174767 - RNA, 13 nt, Homo sapiens
aauggcucuguga

SEQ ID NO: 1174768 - RNA, 15 nt, Homo sapiens
aaugggaaaaccaga

SEQ ID NO: 1174769 - RNA, 11 nt, Homo sapiens
aaugggagaau

SEQ ID NO: 1174770 - RNA, 14 nt, Homo sapiens
aaugggcagguggc

SEQ ID NO: 1174771 - RNA, 14 nt, Homo sapiens
aauggggccuguua

SEQ ID NO: 1174772 - RNA, 20 nt, Homo sapiens
aauggucacaauaaaugcca

SEQ ID NO: 1174773 - RNA, 19 nt, Homo sapiens
aaugguuuucuaauaucuu

SEQ ID NO: 1174774 - RNA, 20 nt, Homo sapiens
aauguaaaaacuuucacuga

SEQ ID NO: 1174775 - RNA, 17 nt, Homo sapiens
aauguaacugugccagu

SEQ ID NO: 1174776 - RNA, 14 nt, Homo sapiens
aauguaacuugaaa

SEQ ID NO: 1174777 - RNA, 23 nt, Homo sapiens
aauguaagaucguucucugccuc

SEQ ID NO: 1174778 - RNA, 16 nt, Homo sapiens
aauguaaguaagugac

SEQ ID NO: 1174779 - RNA, 16 nt, Homo sapiens
aauguacagacauauu

SEQ ID NO: 1174780 - RNA, 13 nt, Homo sapiens
aauguacuugaua

SEQ ID NO: 1174781 - RNA, 16 nt, Homo sapiens
aauguauaaacuuuag

SEQ ID NO: 1174782 - RNA, 15 nt, Homo sapiens
aauguauuugauguc

SEQ ID NO: 1174783 - RNA, 21 nt, Homo sapiens
aauguauuuugaaaacacuua

SEQ ID NO: 1174784 - RNA, 19 nt, Homo sapiens
aaugucaauucuugccaaa

SEQ ID NO: 1174785 - RNA, 14 nt, Homo sapiens
aaugucaccaugcu

SEQ ID NO: 1174786 - RNA, 14 nt, Homo sapiens
aaugucagcaucaa

SEQ ID NO: 1174787 - RNA, 22 nt, Homo sapiens
aaugucauuuaagggaguuaca

SEQ ID NO: 1174788 - RNA, 16 nt, Homo sapiens
aauguccauuugcuga

SEQ ID NO: 1174789 - RNA, 19 nt, Homo sapiens
aaugucuugaugcaugcac

SEQ ID NO: 1174790 - RNA, 12 nt, Homo sapiens
aaugugaacuuc

SEQ ID NO: 1174791 - RNA, 14 nt, Homo sapiens
aaugugacauuuac

SEQ ID NO: 1174792 - RNA, 15 nt, Homo sapiens
aaugugaccauguga

SEQ ID NO: 1174793 - RNA, 15 nt, Homo sapiens
aaugugauugcagcu

SEQ ID NO: 1174794 - RNA, 18 nt, Homo sapiens
aauguggagaacuaaagg

SEQ ID NO: 1174795 - RNA, 23 nt, Homo sapiens
aaugugguugaagagcaaugugu

SEQ ID NO: 1174796 - RNA, 14 nt, Homo sapiens
aaugugucugcaac

SEQ ID NO: 1174797 - RNA, 18 nt, Homo sapiens
aaugugugguuuuuauga

SEQ ID NO: 1174798 - RNA, 18 nt, Homo sapiens
aauguuuacaugucaaga

SEQ ID NO: 1174799 - RNA, 19 nt, Homo sapiens
aauguuugugucugugguu

SEQ ID NO: 1174800 - RNA, 23 nt, Homo sapiens
aauuaaaaagaugguugccaagc

SEQ ID NO: 1174801 - RNA, 16 nt, Homo sapiens
aauuaaaauuuauucu

SEQ ID NO: 1174802 - RNA, 19 nt, Homo sapiens
aauuaagacuugugcauga

SEQ ID NO: 1174803 - RNA, 23 nt, Homo sapiens
aauuaaucaaguaccuauauuga

SEQ ID NO: 1174804 - RNA, 14 nt, Homo sapiens
aauuaaucagcucg

SEQ ID NO: 1174805 - RNA, 16 nt, Homo sapiens
aauuacaaaacucaga

SEQ ID NO: 1174806 - RNA, 12 nt, Homo sapiens
aauuacuuugaa

SEQ ID NO: 1174807 - RNA, 14 nt, Homo sapiens
aauuagggcccaau

SEQ ID NO: 1174808 - RNA, 15 nt, Homo sapiens
aauuaguaacaugug

SEQ ID NO: 1174809 - RNA, 13 nt, Homo sapiens
aauuagucacugc

SEQ ID NO: 1174810 - RNA, 19 nt, Homo sapiens
aauuauaagaggauaugaa

SEQ ID NO: 1174811 - RNA, 17 nt, Homo sapiens
aauuauaaucuguggau

SEQ ID NO: 1174812 - RNA, 14 nt, Homo sapiens
aauuaucaagcuuu

SEQ ID NO: 1174813 - RNA, 11 nt, Homo sapiens
aauuaugccuu

SEQ ID NO: 1174814 - RNA, 19 nt, Homo sapiens
aauuauguuuugugauuca

SEQ ID NO: 1174815 - RNA, 20 nt, Homo sapiens
aauuauguuuugugauucaa

SEQ ID NO: 1174816 - RNA, 17 nt, Homo sapiens
aauuauuucacaaauaa

SEQ ID NO: 1174817 - RNA, 18 nt, Homo sapiens
aauucaacauauaccuua

SEQ ID NO: 1174818 - RNA, 17 nt, Homo sapiens
aauucaauuugaacuca

SEQ ID NO: 1174819 - RNA, 21 nt, Homo sapiens
aauucacaaguuacacugcca

SEQ ID NO: 1174820 - RNA, 12 nt, Homo sapiens
aauucagucuuu

SEQ ID NO: 1174821 - RNA, 17 nt, Homo sapiens
aauucauaacuaaugaa

SEQ ID NO: 1174822 - RNA, 17 nt, Homo sapiens
aauucaugaagugaauu

SEQ ID NO: 1174823 - RNA, 18 nt, Homo sapiens
aauucauuguuuugcaaa

SEQ ID NO: 1174824 - RNA, 22 nt, Homo sapiens
aauuccacaccuuuuauugaca

SEQ ID NO: 1174825 - RNA, 14 nt, Homo sapiens
aauuccuugauuca

SEQ ID NO: 1174826 - RNA, 18 nt, Homo sapiens
aauucuaaaccaaucaaa

SEQ ID NO: 1174827 - RNA, 21 nt, Homo sapiens
aauucuauaggaacauaugaa

SEQ ID NO: 1174828 - RNA, 21 nt, Homo sapiens
aauucuguuuuuaaugcuauu

SEQ ID NO: 1174829 - RNA, 18 nt, Homo sapiens
aauucuuuaaaauuacaa

SEQ ID NO: 1174830 - RNA, 15 nt, Homo sapiens
aauucuuuugccaag

SEQ ID NO: 1174831 - RNA, 14 nt, Homo sapiens
aauugacaacccaa

SEQ ID NO: 1174832 - RNA, 16 nt, Homo sapiens
aauugacaacccaaac

SEQ ID NO: 1174833 - RNA, 13 nt, Homo sapiens
aauugacagauca

SEQ ID NO: 1174834 - RNA, 20 nt, Homo sapiens
accaagaugucugucucuga

SEQ ID NO: 1174835 - RNA, 20 nt, Homo sapiens
accaagcauuuagugcacag

SEQ ID NO: 1174836 - RNA, 21 nt, Homo sapiens
accaaggccucggcagaacuc

SEQ ID NO: 1174837 - RNA, 19 nt, Homo sapiens
accaaggucucacacuccu

SEQ ID NO: 1174838 - RNA, 16 nt, Homo sapiens
accaaguauagccuau

SEQ ID NO: 1174839 - RNA, 11 nt, Homo sapiens
accaaguccaa

SEQ ID NO: 1174840 - RNA, 17 nt, Homo sapiens
accaagucuacuucacu

SEQ ID NO: 1174841 - RNA, 21 nt, Homo sapiens
accaaugccaaaaaaagacag

SEQ ID NO: 1174842 - RNA, 18 nt, Homo sapiens
accacaaacggagccccu

SEQ ID NO: 1174843 - RNA, 22 nt, Homo sapiens
accacaaagcacaguuugaaca

SEQ ID NO: 1174844 - RNA, 15 nt, Homo sapiens
accacaaccuugcag

SEQ ID NO: 1174845 - RNA, 13 nt, Homo sapiens
accacaacuauuu

SEQ ID NO: 1174846 - RNA, 18 nt, Homo sapiens
accacaaggcuguugcau

SEQ ID NO: 1174847 - RNA, 16 nt, Homo sapiens
accacaaggggcucca

SEQ ID NO: 1174848 - RNA, 15 nt, Homo sapiens
accacacccugccug

SEQ ID NO: 1174849 - RNA, 20 nt, Homo sapiens
accacaccuggcccuugcaa

SEQ ID NO: 1174850 - RNA, 16 nt, Homo sapiens
accacauagcaugagg

SEQ ID NO: 1174851 - RNA, 13 nt, Homo sapiens
accaccagcacag

SEQ ID NO: 1174852 - RNA, 14 nt, Homo sapiens
accacgcccagcua

SEQ ID NO: 1174853 - RNA, 14 nt, Homo sapiens
accacuauucuuaa

SEQ ID NO: 1174854 - RNA, 20 nt, Homo sapiens
accacuauucuuaacuauuc

SEQ ID NO: 1174855 - RNA, 13 nt, Homo sapiens
accacugagcucu

SEQ ID NO: 1174856 - RNA, 15 nt, Homo sapiens
accacugcacccacc

SEQ ID NO: 1174857 - RNA, 15 nt, Homo sapiens
accagacacccagga

SEQ ID NO: 1174858 - RNA, 13 nt, Homo sapiens
accagacagacaa

SEQ ID NO: 1174859 - RNA, 23 nt, Homo sapiens
accagacuuuucucuagaagcug

SEQ ID NO: 1174860 - RNA, 15 nt, Homo sapiens
accagaggagccuuu

SEQ ID NO: 1174861 - RNA, 17 nt, Homo sapiens
accagagucaaauuuga

SEQ ID NO: 1174862 - RNA, 13 nt, Homo sapiens
accagcccacccc

SEQ ID NO: 1174863 - RNA, 16 nt, Homo sapiens
accagccugagcaaca

SEQ ID NO: 1174864 - RNA, 13 nt, Homo sapiens
accagcucugggg

SEQ ID NO: 1174865 - RNA, 20 nt, Homo sapiens
accagcuucccuacuccuac

SEQ ID NO: 1174866 - RNA, 23 nt, Homo sapiens
accaggacacuacccugagaucu

SEQ ID NO: 1174867 - RNA, 14 nt, Homo sapiens
accagggacccugg

SEQ ID NO: 1174868 - RNA, 18 nt, Homo sapiens
accagggacccuggagua

SEQ ID NO: 1174869 - RNA, 17 nt, Homo sapiens
accagguccauuuugcc

SEQ ID NO: 1174870 - RNA, 17 nt, Homo sapiens
accaggucucccgggaa

SEQ ID NO: 1174871 - RNA, 17 nt, Homo sapiens
accagucugacccuuac

SEQ ID NO: 1174872 - RNA, 19 nt, Homo sapiens
accagugaauuuuugcaau

SEQ ID NO: 1174873 - RNA, 20 nt, Homo sapiens
accagugaguugggaguuau

SEQ ID NO: 1174874 - RNA, 15 nt, Homo sapiens
accagugcagacuca

SEQ ID NO: 1174875 - RNA, 17 nt, Homo sapiens
accaguggccuuacccc

SEQ ID NO: 1174876 - RNA, 15 nt, Homo sapiens
accaguguaaauuca

SEQ ID NO: 1174877 - RNA, 23 nt, Homo sapiens
accaguguaaauucagucuuuuc

SEQ ID NO: 1174878 - RNA, 18 nt, Homo sapiens
accauaaguaaugaagga

SEQ ID NO: 1174879 - RNA, 22 nt, Homo sapiens
accauacuauauuaaacacauu

SEQ ID NO: 1174880 - RNA, 16 nt, Homo sapiens
accauaucacaaguga

SEQ ID NO: 1174881 - RNA, 13 nt, Homo sapiens
accauaugaauga

SEQ ID NO: 1174882 - RNA, 14 nt, Homo sapiens
accauaugaaugaa

SEQ ID NO: 1174883 - RNA, 20 nt, Homo sapiens
accauauuuauuuauaauga

SEQ ID NO: 1174884 - RNA, 11 nt, Homo sapiens
accaucaugua

SEQ ID NO: 1174885 - RNA, 23 nt, Homo sapiens
accaugaaacauuguagguauau

SEQ ID NO: 1174886 - RNA, 18 nt, Homo sapiens
accaugcuaauguuacua

SEQ ID NO: 1174887 - RNA, 22 nt, Homo sapiens
accaugcuuguggccaaugcau

SEQ ID NO: 1174888 - RNA, 19 nt, Homo sapiens
accauggcaugguuauuga

SEQ ID NO: 1174889 - RNA, 16 nt, Homo sapiens
accauuaaauaaugca

SEQ ID NO: 1174890 - RNA, 18 nt, Homo sapiens
accauugcuguucuacuu

SEQ ID NO: 1174891 - RNA, 12 nt, Homo sapiens
accauuuagugg

SEQ ID NO: 1174892 - RNA, 12 nt, Homo sapiens
accauuugcacu

SEQ ID NO: 1174893 - RNA, 14 nt, Homo sapiens
acccaacaaugagu

SEQ ID NO: 1174894 - RNA, 17 nt, Homo sapiens
acccaacucuguacaaa

SEQ ID NO: 1174895 - RNA, 13 nt, Homo sapiens
acccaagacauca

SEQ ID NO: 1174896 - RNA, 15 nt, Homo sapiens
acccaagaccucagg

SEQ ID NO: 1174897 - RNA, 16 nt, Homo sapiens
acccaaguagcugcua

SEQ ID NO: 1174898 - RNA, 14 nt, Homo sapiens
acccaagugccaag

SEQ ID NO: 1174899 - RNA, 22 nt, Homo sapiens
acccaauucaaaacauugugcc

SEQ ID NO: 1174900 - RNA, 13 nt, Homo sapiens
acccacauuggaa

SEQ ID NO: 1174901 - RNA, 13 nt, Homo sapiens
acccacucagcuc

SEQ ID NO: 1174902 - RNA, 18 nt, Homo sapiens
acccacugcccauggcau

SEQ ID NO: 1174903 - RNA, 18 nt, Homo sapiens
acccacuuaggcuuugua

SEQ ID NO: 1174904 - RNA, 22 nt, Homo sapiens
acccagaagaggagacaguuua

SEQ ID NO: 1174905 - RNA, 20 nt, Homo sapiens
acccagcacaaccuuggaca

SEQ ID NO: 1174906 - RNA, 20 nt, Homo sapiens
acccaggcuggagugcagug

SEQ ID NO: 1174907 - RNA, 15 nt, Homo sapiens
acccagggccugcag

SEQ ID NO: 1174908 - RNA, 15 nt, Homo sapiens
acccaguagaugcca

SEQ ID NO: 1174909 - RNA, 16 nt, Homo sapiens
acccaguagaugccac

SEQ ID NO: 1174910 - RNA, 15 nt, Homo sapiens
acccagucacuguga

SEQ ID NO: 1174911 - RNA, 16 nt, Homo sapiens
acccagucacugugag

SEQ ID NO: 1174912 - RNA, 17 nt, Homo sapiens
acccaguccucugccuc

SEQ ID NO: 1174913 - RNA, 9 nt, Homo sapiens
acccagugc

SEQ ID NO: 1174914 - RNA, 11 nt, Homo sapiens
acccagugcag

SEQ ID NO: 1174915 - RNA, 13 nt, Homo sapiens
acccagugcagaa

SEQ ID NO: 1174916 - RNA, 20 nt, Homo sapiens
acccauaggcccacacacag

SEQ ID NO: 1174917 - RNA, 13 nt, Homo sapiens
acccaucuuccac

SEQ ID NO: 1174918 - RNA, 16 nt, Homo sapiens
acccauuaaauuaaga

SEQ ID NO: 1174919 - RNA, 13 nt, Homo sapiens
acccauucuacac

SEQ ID NO: 1174920 - RNA, 18 nt, Homo sapiens
acccauucuacacagagc

SEQ ID NO: 1174921 - RNA, 12 nt, Homo sapiens
acccauucuucc

SEQ ID NO: 1174922 - RNA, 23 nt, Homo sapiens
acccauugucuuuacuccaugaa

SEQ ID NO: 1174923 - RNA, 14 nt, Homo sapiens
acccauugugauug

SEQ ID NO: 1174924 - RNA, 22 nt, Homo sapiens
acccauuuucgcuauaaauaaa

SEQ ID NO: 1174925 - RNA, 13 nt, Homo sapiens
accccaacagcac

SEQ ID NO: 1174926 - RNA, 15 nt, Homo sapiens
accccaacagcaccc

SEQ ID NO: 1174927 - RNA, 22 nt, Homo sapiens
accccaacagcacccucuccag

SEQ ID NO: 1174928 - RNA, 13 nt, Homo sapiens
accccaacccugg

SEQ ID NO: 1174929 - RNA, 17 nt, Homo sapiens
accccacaacgugcaac

SEQ ID NO: 1174930 - RNA, 13 nt, Homo sapiens
accccaccacuuc

SEQ ID NO: 1174931 - RNA, 13 nt, Homo sapiens
accccacccaagu

SEQ ID NO: 1174932 - RNA, 14 nt, Homo sapiens
accccacuacacag

SEQ ID NO: 1174933 - RNA, 15 nt, Homo sapiens
accccagacacuggu

SEQ ID NO: 1174934 - RNA, 17 nt, Homo sapiens
accccagcacagcuccu

SEQ ID NO: 1174935 - RNA, 19 nt, Homo sapiens
accccagcugccaaggaaa

SEQ ID NO: 1174936 - RNA, 20 nt, Homo sapiens
accccaggcucaacugagga

SEQ ID NO: 1174937 - RNA, 21 nt, Homo sapiens
accccaggcucaacugaggau

SEQ ID NO: 1174938 - RNA, 16 nt, Homo sapiens
accccaucuuccagcc

SEQ ID NO: 1174939 - RNA, 19 nt, Homo sapiens
accccaucuuuacuaaaaa

SEQ ID NO: 1174940 - RNA, 13 nt, Homo sapiens
acccccagcacuu

SEQ ID NO: 1174941 - RNA, 12 nt, Homo sapiens
acccccagugua

SEQ ID NO: 1174942 - RNA, 15 nt, Homo sapiens
acccccuauucccug

SEQ ID NO: 1174943 - RNA, 22 nt, Homo sapiens
acccccuccccccaaucccuca

SEQ ID NO: 1174944 - RNA, 15 nt, Homo sapiens
acccccugccaaugg

SEQ ID NO: 1174945 - RNA, 21 nt, Homo sapiens
accccggggugcccacaggcc

SEQ ID NO: 1174946 - RNA, 20 nt, Homo sapiens
accccgucucuacuaaaaau

SEQ ID NO: 1174947 - RNA, 19 nt, Homo sapiens
accccuagaaaggagagaa

SEQ ID NO: 1174948 - RNA, 17 nt, Homo sapiens
accccucacugugacug

SEQ ID NO: 1174949 - RNA, 20 nt, Homo sapiens
accccucaucaggaguucca

SEQ ID NO: 1174950 - RNA, 14 nt, Homo sapiens
accccugacucauc

SEQ ID NO: 1174951 - RNA, 23 nt, Homo sapiens
acccggcggcccugcugaagcug

SEQ ID NO: 1174952 - RNA, 12 nt, Homo sapiens
acccggugcucc

SEQ ID NO: 1174953 - RNA, 19 nt, Homo sapiens
acccuaaagaucuucugua

SEQ ID NO: 1174954 - RNA, 22 nt, Homo sapiens
acccuaaagcgacaucccagua

SEQ ID NO: 1174955 - RNA, 23 nt, Homo sapiens
acccuagcccucucccucuaggc

SEQ ID NO: 1174956 - RNA, 18 nt, Homo sapiens
acccucacuuaaacuuuu

SEQ ID NO: 1174957 - RNA, 19 nt, Homo sapiens
acccucaucuuucuuccaa

SEQ ID NO: 1174958 - RNA, 21 nt, Homo sapiens
acccuccacaaagcaaaggca

SEQ ID NO: 1174959 - RNA, 23 nt, Homo sapiens
acccucccucccugcugccagaa

SEQ ID NO: 1174960 - RNA, 20 nt, Homo sapiens
acccucccuguucaucccau

SEQ ID NO: 1174961 - RNA, 19 nt, Homo sapiens
acccuccuaauagucauac

SEQ ID NO: 1174962 - RNA, 20 nt, Homo sapiens
acccuccuugggacugaagg

SEQ ID NO: 1174963 - RNA, 20 nt, Homo sapiens
acccucucaggcugucccaa

SEQ ID NO: 1174964 - RNA, 19 nt, Homo sapiens
acccugaaggggccaugau

SEQ ID NO: 1174965 - RNA, 19 nt, Homo sapiens
acccuggcccuuuuauacu

SEQ ID NO: 1174966 - RNA, 16 nt, Homo sapiens
acccuguaaaauggag

SEQ ID NO: 1174967 - RNA, 12 nt, Homo sapiens
aguagauaagga

SEQ ID NO: 1174968 - RNA, 16 nt, Homo sapiens
aguagcaucaccaucu

SEQ ID NO: 1174969 - RNA, 13 nt, Homo sapiens
aguagccauucua

SEQ ID NO: 1174970 - RNA, 22 nt, Homo sapiens
aguagccuaacacacuccaaga

SEQ ID NO: 1174971 - RNA, 17 nt, Homo sapiens
aguagccuuacugugaa

SEQ ID NO: 1174972 - RNA, 12 nt, Homo sapiens
aguagcugcuac

SEQ ID NO: 1174973 - RNA, 21 nt, Homo sapiens
aguagcuguaagaauuuccca

SEQ ID NO: 1174974 - RNA, 18 nt, Homo sapiens
aguaguaaauucauaucc

SEQ ID NO: 1174975 - RNA, 14 nt, Homo sapiens
aguaguaccuuguu

SEQ ID NO: 1174976 - RNA, 15 nt, Homo sapiens
aguaguaccuuucag

SEQ ID NO: 1174977 - RNA, 15 nt, Homo sapiens
aguagucaaggugcu

SEQ ID NO: 1174978 - RNA, 15 nt, Homo sapiens
aguagugcugugauu

SEQ ID NO: 1174979 - RNA, 19 nt, Homo sapiens
aguauaaagggacuugaag

SEQ ID NO: 1174980 - RNA, 22 nt, Homo sapiens
aguauaaauaaaaugagcaaaa

SEQ ID NO: 1174981 - RNA, 15 nt, Homo sapiens
aguauaaauuuacuu

SEQ ID NO: 1174982 - RNA, 14 nt, Homo sapiens
aguauacucagcua

SEQ ID NO: 1174983 - RNA, 20 nt, Homo sapiens
aguaucaaauauuagaugug

SEQ ID NO: 1174984 - RNA, 13 nt, Homo sapiens
aguaucagaauug

SEQ ID NO: 1174985 - RNA, 21 nt, Homo sapiens
aguaucaugcccugugcaacc

SEQ ID NO: 1174986 - RNA, 19 nt, Homo sapiens
aguauccugcuucugauau

SEQ ID NO: 1174987 - RNA, 18 nt, Homo sapiens
aguaugaucucaguauuu

SEQ ID NO: 1174988 - RNA, 14 nt, Homo sapiens
aguaugcuugcucu

SEQ ID NO: 1174989 - RNA, 23 nt, Homo sapiens
aguauggccagcagacaggcugg

SEQ ID NO: 1174990 - RNA, 18 nt, Homo sapiens
aguauggcuccuccauau

SEQ ID NO: 1174991 - RNA, 11 nt, Homo sapiens
aguaugguggg

SEQ ID NO: 1174992 - RNA, 21 nt, Homo sapiens
aguauuaaugaaaagcacaaa

SEQ ID NO: 1174993 - RNA, 12 nt, Homo sapiens
aguauuacaaau

SEQ ID NO: 1174994 - RNA, 19 nt, Homo sapiens
aguauuggcauucaaaaag

SEQ ID NO: 1174995 - RNA, 18 nt, Homo sapiens
aguauuucaugcugggaa

SEQ ID NO: 1174996 - RNA, 23 nt, Homo sapiens
aguauuugggaagugaagacugg

SEQ ID NO: 1174997 - RNA, 17 nt, Homo sapiens
agucaaaaggugccugu

SEQ ID NO: 1174998 - RNA, 16 nt, Homo sapiens
agucaaaucugggcuc

SEQ ID NO: 1174999 - RNA, 15 nt, Homo sapiens
agucaaauuuguaaa

SEQ ID NO: 1175000 - RNA, 17 nt, Homo sapiens
agucaaccaauguagaa

SEQ ID NO: 1175001 - RNA, 16 nt, Homo sapiens
agucaaggugcucaau

SEQ ID NO: 1175002 - RNA, 23 nt, Homo sapiens
agucaauccccucauucaggaaa

SEQ ID NO: 1175003 - RNA, 17 nt, Homo sapiens
agucacaucucuuccuc

SEQ ID NO: 1175004 - RNA, 18 nt, Homo sapiens
agucaccagccagaggau

SEQ ID NO: 1175005 - RNA, 21 nt, Homo sapiens
agucacccucuucaagcuuuu

SEQ ID NO: 1175006 - RNA, 16 nt, Homo sapiens
agucaccgaagguccu

SEQ ID NO: 1175007 - RNA, 13 nt, Homo sapiens
agucacguccuuu

SEQ ID NO: 1175008 - RNA, 15 nt, Homo sapiens
agucacugagcauca

SEQ ID NO: 1175009 - RNA, 23 nt, Homo sapiens
agucacuucggccagagcugaag

SEQ ID NO: 1175010 - RNA, 14 nt, Homo sapiens
agucagugcaaaug

SEQ ID NO: 1175011 - RNA, 19 nt, Homo sapiens
agucaucaacaaugauuaa

SEQ ID NO: 1175012 - RNA, 15 nt, Homo sapiens
agucauuuaucuaau

SEQ ID NO: 1175013 - RNA, 12 nt, Homo sapiens
aguccaaaaagc

SEQ ID NO: 1175014 - RNA, 14 nt, Homo sapiens
aguccaauuccuug

SEQ ID NO: 1175015 - RNA, 12 nt, Homo sapiens
aguccacugcug

SEQ ID NO: 1175016 - RNA, 16 nt, Homo sapiens
aguccaggacuggguc

SEQ ID NO: 1175017 - RNA, 11 nt, Homo sapiens
agucccaagac

SEQ ID NO: 1175018 - RNA, 20 nt, Homo sapiens
agucccauccucuugucagg

SEQ ID NO: 1175019 - RNA, 16 nt, Homo sapiens
agucccccuucaaucu

SEQ ID NO: 1175020 - RNA, 20 nt, Homo sapiens
agucccuaaaaacacagaca

SEQ ID NO: 1175021 - RNA, 21 nt, Homo sapiens
agucccuaaaaacacagacau

SEQ ID NO: 1175022 - RNA, 13 nt, Homo sapiens
agucccugaagga

SEQ ID NO: 1175023 - RNA, 14 nt, Homo sapiens
aguccuauuugcac

SEQ ID NO: 1175024 - RNA, 15 nt, Homo sapiens
aguccuccuauucca

SEQ ID NO: 1175025 - RNA, 15 nt, Homo sapiens
aguccugcuggccug

SEQ ID NO: 1175026 - RNA, 23 nt, Homo sapiens
aguccugguccuggcugcacucu

SEQ ID NO: 1175027 - RNA, 17 nt, Homo sapiens
aguccuguaugucuguc

SEQ ID NO: 1175028 - RNA, 15 nt, Homo sapiens
aguccuucccuuuca

SEQ ID NO: 1175029 - RNA, 17 nt, Homo sapiens
aguccuucccuuucauu

SEQ ID NO: 1175030 - RNA, 19 nt, Homo sapiens
aguccuuggcuguauccau

SEQ ID NO: 1175031 - RNA, 22 nt, Homo sapiens
aguccuuuacuaauccaaccca

SEQ ID NO: 1175032 - RNA, 15 nt, Homo sapiens
agucgaacaauucau

SEQ ID NO: 1175033 - RNA, 20 nt, Homo sapiens
agucgucuggcaucucccac

SEQ ID NO: 1175034 - RNA, 16 nt, Homo sapiens
agucgugacuaucuau

SEQ ID NO: 1175035 - RNA, 21 nt, Homo sapiens
agucuaaagauggaguuucua

SEQ ID NO: 1175036 - RNA, 15 nt, Homo sapiens
agucuaaucaagugu

SEQ ID NO: 1175037 - RNA, 23 nt, Homo sapiens
agucuaguuauuggaucagugaa

SEQ ID NO: 1175038 - RNA, 23 nt, Homo sapiens
agucuaucaaccccagacacugg

SEQ ID NO: 1175039 - RNA, 17 nt, Homo sapiens
agucucacuggccaaga

SEQ ID NO: 1175040 - RNA, 23 nt, Homo sapiens
agucucacugugggaaggccagc

SEQ ID NO: 1175041 - RNA, 14 nt, Homo sapiens
agucucagcacuau

SEQ ID NO: 1175042 - RNA, 16 nt, Homo sapiens
agucucuaucauuaaa

SEQ ID NO: 1175043 - RNA, 14 nt, Homo sapiens
agucugaaccuauu

SEQ ID NO: 1175044 - RNA, 21 nt, Homo sapiens
agucugacccuuacagccucu

SEQ ID NO: 1175045 - RNA, 16 nt, Homo sapiens
agucugcagauagaaa

SEQ ID NO: 1175046 - RNA, 21 nt, Homo sapiens
agucuggcaaacaugugcaac

SEQ ID NO: 1175047 - RNA, 22 nt, Homo sapiens
agucuguugugugucaugccag

SEQ ID NO: 1175048 - RNA, 17 nt, Homo sapiens
agucuuaucugagcuga

SEQ ID NO: 1175049 - RNA, 19 nt, Homo sapiens
agucuuccucccuguguau

SEQ ID NO: 1175050 - RNA, 11 nt, Homo sapiens
agucuugccuu

SEQ ID NO: 1175051 - RNA, 15 nt, Homo sapiens
agucuugcucugucg

SEQ ID NO: 1175052 - RNA, 20 nt, Homo sapiens
agucuugcucuucaaugcua

SEQ ID NO: 1175053 - RNA, 19 nt, Homo sapiens
agucuuugguaaauggcaa

SEQ ID NO: 1175054 - RNA, 16 nt, Homo sapiens
agugaaaaacauuagu

SEQ ID NO: 1175055 - RNA, 13 nt, Homo sapiens
agugaaacagcug

SEQ ID NO: 1175056 - RNA, 13 nt, Homo sapiens
agugaaccuuuag

SEQ ID NO: 1175057 - RNA, 14 nt, Homo sapiens
agugaagacuggaa

SEQ ID NO: 1175058 - RNA, 12 nt, Homo sapiens
agugaaggauuu

SEQ ID NO: 1175059 - RNA, 19 nt, Homo sapiens
agugaagucaugaccucca

SEQ ID NO: 1175060 - RNA, 15 nt, Homo sapiens
agugaauuuuugcaa

SEQ ID NO: 1175061 - RNA, 18 nt, Homo sapiens
agugacagggaagcuaca

SEQ ID NO: 1175062 - RNA, 21 nt, Homo sapiens
agugacaucucuuugauguca

SEQ ID NO: 1175063 - RNA, 14 nt, Homo sapiens
agugaccauuuuag

SEQ ID NO: 1175064 - RNA, 16 nt, Homo sapiens
agugacuaauggcaug

SEQ ID NO: 1175065 - RNA, 16 nt, Homo sapiens
agugagacaggugaua

SEQ ID NO: 1175066 - RNA, 14 nt, Homo sapiens
agugagaugaagga

SEQ ID NO: 1175067 - RNA, 14 nt, Homo sapiens
agugagccaggaaa

SEQ ID NO: 1175068 - RNA, 16 nt, Homo sapiens
agugagcugagaucac

SEQ ID NO: 1175069 - RNA, 20 nt, Homo sapiens
agugagcugagaucaugcca

SEQ ID NO: 1175070 - RNA, 13 nt, Homo sapiens
agugaggacaaaa

SEQ ID NO: 1175071 - RNA, 14 nt, Homo sapiens
agugagugcugcuc

SEQ ID NO: 1175072 - RNA, 19 nt, Homo sapiens
agugaguggccccaccugu

SEQ ID NO: 1175073 - RNA, 20 nt, Homo sapiens
agugaguguuucuaugagug

SEQ ID NO: 1175074 - RNA, 11 nt, Homo sapiens
agugaguucaa

SEQ ID NO: 1175075 - RNA, 21 nt, Homo sapiens
agugaguucccuuagugaauu

SEQ ID NO: 1175076 - RNA, 18 nt, Homo sapiens
agugauaacuccuaagag

SEQ ID NO: 1175077 - RNA, 23 nt, Homo sapiens
agugauauuucucuaguaguuaa

SEQ ID NO: 1175078 - RNA, 14 nt, Homo sapiens
agugaugaugcaug

SEQ ID NO: 1175079 - RNA, 18 nt, Homo sapiens
agugauuaacuuaagauu

SEQ ID NO: 1175080 - RNA, 18 nt, Homo sapiens
agugcaauaaaucugacc

SEQ ID NO: 1175081 - RNA, 19 nt, Homo sapiens
agugcaauggcacaaucuu

SEQ ID NO: 1175082 - RNA, 20 nt, Homo sapiens
agugcaauggcaggaucuca

SEQ ID NO: 1175083 - RNA, 21 nt, Homo sapiens
agugcacuaauucugcaucug

SEQ ID NO: 1175084 - RNA, 13 nt, Homo sapiens
agugcaggggaug

SEQ ID NO: 1175085 - RNA, 17 nt, Homo sapiens
agugcaguccauuuccu

SEQ ID NO: 1175086 - RNA, 14 nt, Homo sapiens
agugcaguggugcg

SEQ ID NO: 1175087 - RNA, 20 nt, Homo sapiens
agugcaguggugugaucucg

SEQ ID NO: 1175088 - RNA, 14 nt, Homo sapiens
agugcauuuagacu

SEQ ID NO: 1175089 - RNA, 13 nt, Homo sapiens
agugccaacugug

SEQ ID NO: 1175090 - RNA, 22 nt, Homo sapiens
agugccaauguuguguguugca

SEQ ID NO: 1175091 - RNA, 20 nt, Homo sapiens
agugccagaacccaaaucca

SEQ ID NO: 1175092 - RNA, 16 nt, Homo sapiens
agugcccccaacagca

SEQ ID NO: 1175093 - RNA, 14 nt, Homo sapiens
agugcccucaucca

SEQ ID NO: 1175094 - RNA, 21 nt, Homo sapiens
agugccgaaaacuucacugug

SEQ ID NO: 1175095 - RNA, 13 nt, Homo sapiens
agugccugcugaa

SEQ ID NO: 1175096 - RNA, 14 nt, Homo sapiens
agugccuuaccucc

SEQ ID NO: 1175097 - RNA, 20 nt, Homo sapiens
agugccuucuaaagguguug

SEQ ID NO: 1175098 - RNA, 14 nt, Homo sapiens
agugccuugcccac

SEQ ID NO: 1175099 - RNA, 18 nt, Homo sapiens
agugcgaguccauugugg

SEQ ID NO: 1175100 - RNA, 23 nt, Homo sapiens
aucacgucacugcacuccagcuu

SEQ ID NO: 1175101 - RNA, 19 nt, Homo sapiens
aucacucucaccuuccaaa

SEQ ID NO: 1175102 - RNA, 16 nt, Homo sapiens
aucacuguacuuguag

SEQ ID NO: 1175103 - RNA, 18 nt, Homo sapiens
aucacuucacuguucucu

SEQ ID NO: 1175104 - RNA, 15 nt, Homo sapiens
aucacuucaggucag

SEQ ID NO: 1175105 - RNA, 17 nt, Homo sapiens
aucacuuccuauaugca

SEQ ID NO: 1175106 - RNA, 11 nt, Homo sapiens
aucacuugaac

SEQ ID NO: 1175107 - RNA, 11 nt, Homo sapiens
aucacuugagg

SEQ ID NO: 1175108 - RNA, 16 nt, Homo sapiens
aucacuuuucucugag

SEQ ID NO: 1175109 - RNA, 19 nt, Homo sapiens
aucagaauagccacauuug

SEQ ID NO: 1175110 - RNA, 15 nt, Homo sapiens
aucagacagcuugaa

SEQ ID NO: 1175111 - RNA, 12 nt, Homo sapiens
aucagacuguag

SEQ ID NO: 1175112 - RNA, 17 nt, Homo sapiens
aucagagugcacaagca

SEQ ID NO: 1175113 - RNA, 18 nt, Homo sapiens
aucagauguuuuggucaa

SEQ ID NO: 1175114 - RNA, 12 nt, Homo sapiens
aucagcacaaag

SEQ ID NO: 1175115 - RNA, 17 nt, Homo sapiens
aucagcaggaaugcucu

SEQ ID NO: 1175116 - RNA, 19 nt, Homo sapiens
aucagcaggaaugcucuga

SEQ ID NO: 1175117 - RNA, 20 nt, Homo sapiens
aucagcaucucuucuucccu

SEQ ID NO: 1175118 - RNA, 15 nt, Homo sapiens
aucagcauuuuacua

SEQ ID NO: 1175119 - RNA, 17 nt, Homo sapiens
aucagcauuuuacuacu

SEQ ID NO: 1175120 - RNA, 17 nt, Homo sapiens
aucagccagacauggug

SEQ ID NO: 1175121 - RNA, 13 nt, Homo sapiens
aucagcuuucaaa

SEQ ID NO: 1175122 - RNA, 23 nt, Homo sapiens
aucaggaaauuuggggcagauuu

SEQ ID NO: 1175123 - RNA, 15 nt, Homo sapiens
aucaggacccagagg

SEQ ID NO: 1175124 - RNA, 16 nt, Homo sapiens
aucaggcacaggucag

SEQ ID NO: 1175125 - RNA, 19 nt, Homo sapiens
aucagugaauaaaccauca

SEQ ID NO: 1175126 - RNA, 10 nt, Homo sapiens
aucagugcca

SEQ ID NO: 1175127 - RNA, 14 nt, Homo sapiens
aucaguuacucuga

SEQ ID NO: 1175128 - RNA, 12 nt, Homo sapiens
aucauacuucca

SEQ ID NO: 1175129 - RNA, 14 nt, Homo sapiens
aucauacuuccauc

SEQ ID NO: 1175130 - RNA, 19 nt, Homo sapiens
aucaucaaugugacauuua

SEQ ID NO: 1175131 - RNA, 19 nt, Homo sapiens
aucaucauaucuacuauau

SEQ ID NO: 1175132 - RNA, 16 nt, Homo sapiens
aucaucaucauucuca

SEQ ID NO: 1175133 - RNA, 23 nt, Homo sapiens
aucaucccucccugccuaaggaa

SEQ ID NO: 1175134 - RNA, 23 nt, Homo sapiens
aucaugaugcuagccagcaaaga

SEQ ID NO: 1175135 - RNA, 19 nt, Homo sapiens
aucauguuuuuucugcaau

SEQ ID NO: 1175136 - RNA, 15 nt, Homo sapiens
aucauuaaugcacau

SEQ ID NO: 1175137 - RNA, 22 nt, Homo sapiens
aucauuaggcuuacguacuacu

SEQ ID NO: 1175138 - RNA, 17 nt, Homo sapiens
aucauucucugucucau

SEQ ID NO: 1175139 - RNA, 14 nt, Homo sapiens
aucauucuggaguc

SEQ ID NO: 1175140 - RNA, 20 nt, Homo sapiens
auccaaagaauuaugcaucu

SEQ ID NO: 1175141 - RNA, 19 nt, Homo sapiens
auccaaagcgaucauguca

SEQ ID NO: 1175142 - RNA, 18 nt, Homo sapiens
auccaaauccagccuuug

SEQ ID NO: 1175143 - RNA, 21 nt, Homo sapiens
auccaaauugccugaacaugg

SEQ ID NO: 1175144 - RNA, 16 nt, Homo sapiens
auccaacuccaggaua

SEQ ID NO: 1175145 - RNA, 16 nt, Homo sapiens
auccaacucuaaaccc

SEQ ID NO: 1175146 - RNA, 13 nt, Homo sapiens
auccaauaccucu

SEQ ID NO: 1175147 - RNA, 15 nt, Homo sapiens
auccaaugcucaaga

SEQ ID NO: 1175148 - RNA, 14 nt, Homo sapiens
auccacaugggagc

SEQ ID NO: 1175149 - RNA, 14 nt, Homo sapiens
auccacauuuuaac

SEQ ID NO: 1175150 - RNA, 22 nt, Homo sapiens
auccacauuuuaacaguaccug

SEQ ID NO: 1175151 - RNA, 19 nt, Homo sapiens
auccaccaagaacauaaga

SEQ ID NO: 1175152 - RNA, 22 nt, Homo sapiens
auccacgccaaguggaagccac

SEQ ID NO: 1175153 - RNA, 23 nt, Homo sapiens
auccagcccugaguuccuagcca

SEQ ID NO: 1175154 - RNA, 19 nt, Homo sapiens
auccagccucccacaagaa

SEQ ID NO: 1175155 - RNA, 14 nt, Homo sapiens
auccagcuacuuag

SEQ ID NO: 1175156 - RNA, 20 nt, Homo sapiens
auccagggcccccaucucau

SEQ ID NO: 1175157 - RNA, 16 nt, Homo sapiens
auccagggcugccagg

SEQ ID NO: 1175158 - RNA, 20 nt, Homo sapiens
auccaguuucccaugcacca

SEQ ID NO: 1175159 - RNA, 19 nt, Homo sapiens
auccauaguaacugacaug

SEQ ID NO: 1175160 - RNA, 19 nt, Homo sapiens
auccaucagcaaugcuucu

SEQ ID NO: 1175161 - RNA, 21 nt, Homo sapiens
auccaucaucugcugcacaua

SEQ ID NO: 1175162 - RNA, 18 nt, Homo sapiens
auccauccauuguguucu

SEQ ID NO: 1175163 - RNA, 16 nt, Homo sapiens
auccauccugcucagg

SEQ ID NO: 1175164 - RNA, 17 nt, Homo sapiens
auccaugaaccaagacc

SEQ ID NO: 1175165 - RNA, 16 nt, Homo sapiens
auccauuaucaugugu

SEQ ID NO: 1175166 - RNA, 23 nt, Homo sapiens
auccauuccucagggacagagac

SEQ ID NO: 1175167 - RNA, 18 nt, Homo sapiens
auccauugaacuaaaaua

SEQ ID NO: 1175168 - RNA, 16 nt, Homo sapiens
aucccaaacugugaug

SEQ ID NO: 1175169 - RNA, 20 nt, Homo sapiens
aucccaaguagaaucucagu

SEQ ID NO: 1175170 - RNA, 18 nt, Homo sapiens
aucccacacgcacugcac

SEQ ID NO: 1175171 - RNA, 16 nt, Homo sapiens
aucccagcuaccucaa

SEQ ID NO: 1175172 - RNA, 17 nt, Homo sapiens
aucccagcucacugcaa

SEQ ID NO: 1175173 - RNA, 22 nt, Homo sapiens
aucccagggcucccugccauuu

SEQ ID NO: 1175174 - RNA, 13 nt, Homo sapiens
aucccaucaaaga

SEQ ID NO: 1175175 - RNA, 15 nt, Homo sapiens
aucccaugagcuccu

SEQ ID NO: 1175176 - RNA, 13 nt, Homo sapiens
aucccauggaaua

SEQ ID NO: 1175177 - RNA, 17 nt, Homo sapiens
aucccauguuagcucca

SEQ ID NO: 1175178 - RNA, 14 nt, Homo sapiens
aucccauucacuuc

SEQ ID NO: 1175179 - RNA, 12 nt, Homo sapiens
auccccaaggac

SEQ ID NO: 1175180 - RNA, 22 nt, Homo sapiens
auccccuaagcagaccacugau

SEQ ID NO: 1175181 - RNA, 16 nt, Homo sapiens
auccccuucugcaauc

SEQ ID NO: 1175182 - RNA, 20 nt, Homo sapiens
auccccuuugguuuuacuac

SEQ ID NO: 1175183 - RNA, 20 nt, Homo sapiens
aucccgauaacuuugugaug

SEQ ID NO: 1175184 - RNA, 19 nt, Homo sapiens
aucccgccgauagagggac

SEQ ID NO: 1175185 - RNA, 21 nt, Homo sapiens
aucccgugaguggauugugag

SEQ ID NO: 1175186 - RNA, 22 nt, Homo sapiens
aucccugacaucuggaaucugg

SEQ ID NO: 1175187 - RNA, 12 nt, Homo sapiens
aucccugagauc

SEQ ID NO: 1175188 - RNA, 22 nt, Homo sapiens
auccgcuguccagcagcugcca

SEQ ID NO: 1175189 - RNA, 21 nt, Homo sapiens
auccuaauuuagccaggaccu

SEQ ID NO: 1175190 - RNA, 19 nt, Homo sapiens
auccuacccuuuucugggg

SEQ ID NO: 1175191 - RNA, 13 nt, Homo sapiens
auccuacuucucu

SEQ ID NO: 1175192 - RNA, 13 nt, Homo sapiens
auccuaugcaaua

SEQ ID NO: 1175193 - RNA, 22 nt, Homo sapiens
auccucaagaucauucaguguu

SEQ ID NO: 1175194 - RNA, 14 nt, Homo sapiens
auccucaguucuca

SEQ ID NO: 1175195 - RNA, 21 nt, Homo sapiens
auccucccuggcagacacaac

SEQ ID NO: 1175196 - RNA, 16 nt, Homo sapiens
auccucgcucccggga

SEQ ID NO: 1175197 - RNA, 21 nt, Homo sapiens
auccucuugccaaaucaaaag

SEQ ID NO: 1175198 - RNA, 16 nt, Homo sapiens
auccugaccugagcca

SEQ ID NO: 1175199 - RNA, 18 nt, Homo sapiens
auccugcuguucuagcac

SEQ ID NO: 1175200 - RNA, 22 nt, Homo sapiens
auccugggggacccaauguagg

SEQ ID NO: 1175201 - RNA, 22 nt, Homo sapiens
auccugguuucauaacuuccug

SEQ ID NO: 1175202 - RNA, 20 nt, Homo sapiens
auccugucuguacuaaaaau

SEQ ID NO: 1175203 - RNA, 21 nt, Homo sapiens
auccugucuguacuaaaaaua

SEQ ID NO: 1175204 - RNA, 22 nt, Homo sapiens
auccuucuuucuaguucagcug

SEQ ID NO: 1175205 - RNA, 16 nt, Homo sapiens
auccuuuauuucugau

SEQ ID NO: 1175206 - RNA, 19 nt, Homo sapiens
auccuuuauuucugauaag

SEQ ID NO: 1175207 - RNA, 17 nt, Homo sapiens
auccuuugccucaagga

SEQ ID NO: 1175208 - RNA, 16 nt, Homo sapiens
aucgaaucuacuaauu

SEQ ID NO: 1175209 - RNA, 20 nt, Homo sapiens
aucgacuuagccugagucau

SEQ ID NO: 1175210 - RNA, 22 nt, Homo sapiens
aucgagauguccauagucaaau

SEQ ID NO: 1175211 - RNA, 14 nt, Homo sapiens
aucuaaaaguguca

SEQ ID NO: 1175212 - RNA, 15 nt, Homo sapiens
aucuaaaaucugcua

SEQ ID NO: 1175213 - RNA, 20 nt, Homo sapiens
aucuaagaauacagcuuucu

SEQ ID NO: 1175214 - RNA, 13 nt, Homo sapiens
aucuacaguguuu

SEQ ID NO: 1175215 - RNA, 18 nt, Homo sapiens
aucuacaugaaugcaaaa

SEQ ID NO: 1175216 - RNA, 20 nt, Homo sapiens
aucuacauuuguuuguauuc

SEQ ID NO: 1175217 - RNA, 14 nt, Homo sapiens
aucuacuaauucca

SEQ ID NO: 1175218 - RNA, 22 nt, Homo sapiens
aucuauauguacuugucaaaga

SEQ ID NO: 1175219 - RNA, 14 nt, Homo sapiens
aucuaugauuccag

SEQ ID NO: 1175220 - RNA, 21 nt, Homo sapiens
aucucaaacuacuggcaauuu

SEQ ID NO: 1175221 - RNA, 17 nt, Homo sapiens
aucucaaccauccccuc

SEQ ID NO: 1175222 - RNA, 22 nt, Homo sapiens
aucucaaguauaugucauuuac

SEQ ID NO: 1175223 - RNA, 15 nt, Homo sapiens
aucucagaucacugc

SEQ ID NO: 1175224 - RNA, 17 nt, Homo sapiens
aucucagcucacugcaa

SEQ ID NO: 1175225 - RNA, 20 nt, Homo sapiens
aucucaggcaauauggccac

SEQ ID NO: 1175226 - RNA, 16 nt, Homo sapiens
aucucauccuauuacu

SEQ ID NO: 1175227 - RNA, 15 nt, Homo sapiens
aucucauuccacugu

SEQ ID NO: 1175228 - RNA, 23 nt, Homo sapiens
aucucauuggacccuuccauggu

SEQ ID NO: 1175229 - RNA, 23 nt, Homo sapiens
aucucccaugugcauaacaaauu

SEQ ID NO: 1175230 - RNA, 16 nt, Homo sapiens
aucucccuuccaccuc

SEQ ID NO: 1175231 - RNA, 15 nt, Homo sapiens
aucuccucagcaccc

SEQ ID NO: 1175232 - RNA, 17 nt, Homo sapiens
auuaaaaugaauuucuu

SEQ ID NO: 1175233 - RNA, 16 nt, Homo sapiens
auuaaaaugagugaaa

SEQ ID NO: 1175234 - RNA, 15 nt, Homo sapiens
auuaaaccuuuccau

SEQ ID NO: 1175235 - RNA, 17 nt, Homo sapiens
auuaaacguaugcaugu

SEQ ID NO: 1175236 - RNA, 17 nt, Homo sapiens
auuaaauguuuauaauu

SEQ ID NO: 1175237 - RNA, 14 nt, Homo sapiens
auuaaauucacaaa

SEQ ID NO: 1175238 - RNA, 19 nt, Homo sapiens
auuaacaaaugugcugcuu

SEQ ID NO: 1175239 - RNA, 15 nt, Homo sapiens
auuaaccucuuguuu

SEQ ID NO: 1175240 - RNA, 21 nt, Homo sapiens
auuaacugaggcauccacuuc

SEQ ID NO: 1175241 - RNA, 13 nt, Homo sapiens
auuaagaaugcca

SEQ ID NO: 1175242 - RNA, 14 nt, Homo sapiens
auuaagaaugccag

SEQ ID NO: 1175243 - RNA, 12 nt, Homo sapiens
auuaagaucuca

SEQ ID NO: 1175244 - RNA, 18 nt, Homo sapiens
auuaagguagaacuugag

SEQ ID NO: 1175245 - RNA, 17 nt, Homo sapiens
auuaaguacaagcacau

SEQ ID NO: 1175246 - RNA, 15 nt, Homo sapiens
auuaagucaagaaua

SEQ ID NO: 1175247 - RNA, 13 nt, Homo sapiens
auuaauagcuuuu

SEQ ID NO: 1175248 - RNA, 17 nt, Homo sapiens
auuaauagcuuuugauu

SEQ ID NO: 1175249 - RNA, 13 nt, Homo sapiens
auuaauaguucag

SEQ ID NO: 1175250 - RNA, 17 nt, Homo sapiens
auuaaugaaaagcacaa

SEQ ID NO: 1175251 - RNA, 20 nt, Homo sapiens
auuaaugaaaagcagauugc

SEQ ID NO: 1175252 - RNA, 12 nt, Homo sapiens
auuaaugaacau

SEQ ID NO: 1175253 - RNA, 17 nt, Homo sapiens
auuaaugcacaucugca

SEQ ID NO: 1175254 - RNA, 14 nt, Homo sapiens
auuaaugcuaucaa

SEQ ID NO: 1175255 - RNA, 18 nt, Homo sapiens
auuaaugcuaucaaucau

SEQ ID NO: 1175256 - RNA, 17 nt, Homo sapiens
auuaauuuucaacucaa

SEQ ID NO: 1175257 - RNA, 18 nt, Homo sapiens
auuaauuuuuaaggaugu

SEQ ID NO: 1175258 - RNA, 22 nt, Homo sapiens
auuaauuuuuaaggauguugcc

SEQ ID NO: 1175259 - RNA, 17 nt, Homo sapiens
auuacaaauccaaugaa

SEQ ID NO: 1175260 - RNA, 16 nt, Homo sapiens
auuacaagugggugaa

SEQ ID NO: 1175261 - RNA, 17 nt, Homo sapiens
auuacagaaacugaugc

SEQ ID NO: 1175262 - RNA, 14 nt, Homo sapiens
auuacagaucugca

SEQ ID NO: 1175263 - RNA, 23 nt, Homo sapiens
auuacaggcgugagccacugcgc

SEQ ID NO: 1175264 - RNA, 14 nt, Homo sapiens
auuacaucuuucac

SEQ ID NO: 1175265 - RNA, 17 nt, Homo sapiens
auuacauggcucuaaaa

SEQ ID NO: 1175266 - RNA, 14 nt, Homo sapiens
auuaccaaaacaag

SEQ ID NO: 1175267 - RNA, 16 nt, Homo sapiens
auuaccaguguucccu

SEQ ID NO: 1175268 - RNA, 19 nt, Homo sapiens
auuacccccuccuucagac

SEQ ID NO: 1175269 - RNA, 20 nt, Homo sapiens
auuacuuugaaagaugaaaa

SEQ ID NO: 1175270 - RNA, 19 nt, Homo sapiens
auuagaaagauuagugauu

SEQ ID NO: 1175271 - RNA, 23 nt, Homo sapiens
auuagauuucuauaggauuuuuc

SEQ ID NO: 1175272 - RNA, 23 nt, Homo sapiens
auuagcagcaucuuuaacacagc

SEQ ID NO: 1175273 - RNA, 19 nt, Homo sapiens
auuagcugggcauggugcg

SEQ ID NO: 1175274 - RNA, 13 nt, Homo sapiens
auuaggaugguga

SEQ ID NO: 1175275 - RNA, 18 nt, Homo sapiens
auuaggcagacucuuuau

SEQ ID NO: 1175276 - RNA, 17 nt, Homo sapiens
auuagggccuacauugu

SEQ ID NO: 1175277 - RNA, 17 nt, Homo sapiens
auuaggucucuguugac

SEQ ID NO: 1175278 - RNA, 19 nt, Homo sapiens
auuaguauucaggcacuga

SEQ ID NO: 1175279 - RNA, 22 nt, Homo sapiens
auuagugccacaaauaaguuac

SEQ ID NO: 1175280 - RNA, 21 nt, Homo sapiens
auuagugccguuaucauggag

SEQ ID NO: 1175281 - RNA, 13 nt, Homo sapiens
auuagugcugaua

SEQ ID NO: 1175282 - RNA, 20 nt, Homo sapiens
auuagugcugauagcugugu

SEQ ID NO: 1175283 - RNA, 22 nt, Homo sapiens
auuaguuguuuagagaaugaga

SEQ ID NO: 1175284 - RNA, 15 nt, Homo sapiens
auuauaaaaugcaau

SEQ ID NO: 1175285 - RNA, 24 nt, Homo sapiens
auuauacgcuggcaacacagaggc

SEQ ID NO: 1175286 - RNA, 18 nt, Homo sapiens
auuauagcacaaaaucag

SEQ ID NO: 1175287 - RNA, 17 nt, Homo sapiens
auuauagcgccuguaua

SEQ ID NO: 1175288 - RNA, 14 nt, Homo sapiens
auuauauuugacau

SEQ ID NO: 1175289 - RNA, 17 nt, Homo sapiens
auuauauuugugcuaua

SEQ ID NO: 1175290 - RNA, 22 nt, Homo sapiens
auuaucaaaagugaucagcaau

SEQ ID NO: 1175291 - RNA, 12 nt, Homo sapiens
auuaucaugugu

SEQ ID NO: 1175292 - RNA, 23 nt, Homo sapiens
auuauccuauuucaguacuucag

SEQ ID NO: 1175293 - RNA, 13 nt, Homo sapiens
auuaucgucuucu

SEQ ID NO: 1175294 - RNA, 16 nt, Homo sapiens
auuaugagaggcaaug

SEQ ID NO: 1175295 - RNA, 14 nt, Homo sapiens
auuaugaggucaga

SEQ ID NO: 1175296 - RNA, 22 nt, Homo sapiens
auuaugcaucugcuacuguguc

SEQ ID NO: 1175297 - RNA, 20 nt, Homo sapiens
auuauguaaauaacucuaac

SEQ ID NO: 1175298 - RNA, 13 nt, Homo sapiens
auuauuaauugca

SEQ ID NO: 1175299 - RNA, 14 nt, Homo sapiens
auuauuauccuccu

SEQ ID NO: 1175300 - RNA, 11 nt, Homo sapiens
auuauuugccc

SEQ ID NO: 1175301 - RNA, 13 nt, Homo sapiens
auuauuuuuacag

SEQ ID NO: 1175302 - RNA, 18 nt, Homo sapiens
auucaaacuuuuauuagc

SEQ ID NO: 1175303 - RNA, 19 nt, Homo sapiens
auucaagggacccaugagu

SEQ ID NO: 1175304 - RNA, 23 nt, Homo sapiens
auucacaccacacagagguuccc

SEQ ID NO: 1175305 - RNA, 12 nt, Homo sapiens
auucacaucuca

SEQ ID NO: 1175306 - RNA, 16 nt, Homo sapiens
auucacuaaggacuua

SEQ ID NO: 1175307 - RNA, 20 nt, Homo sapiens
auucacuuuauuguagaaaa

SEQ ID NO: 1175308 - RNA, 22 nt, Homo sapiens
auucacuuuugcuauuccaauc

SEQ ID NO: 1175309 - RNA, 17 nt, Homo sapiens
auucagcuaauacaaag

SEQ ID NO: 1175310 - RNA, 22 nt, Homo sapiens
auucagggcggaauaaugggca

SEQ ID NO: 1175311 - RNA, 21 nt, Homo sapiens
auucagguauaaggcagggug

SEQ ID NO: 1175312 - RNA, 15 nt, Homo sapiens
auucaguauuacaaa

SEQ ID NO: 1175313 - RNA, 18 nt, Homo sapiens
auucagugcaccugccuc

SEQ ID NO: 1175314 - RNA, 12 nt, Homo sapiens
auucaguguuaa

SEQ ID NO: 1175315 - RNA, 17 nt, Homo sapiens
auucaguuuucauuugg

SEQ ID NO: 1175316 - RNA, 18 nt, Homo sapiens
auucauaaaucacaaaua

SEQ ID NO: 1175317 - RNA, 22 nt, Homo sapiens
auucaucuuuuaaucaugagcc

SEQ ID NO: 1175318 - RNA, 15 nt, Homo sapiens
auucaugacuaugga

SEQ ID NO: 1175319 - RNA, 20 nt, Homo sapiens
auucauguucaucaauaccu

SEQ ID NO: 1175320 - RNA, 20 nt, Homo sapiens
auucauguucaugugauuaa

SEQ ID NO: 1175321 - RNA, 15 nt, Homo sapiens
auucauuugcuucag

SEQ ID NO: 1175322 - RNA, 13 nt, Homo sapiens
auuccaaagucuc

SEQ ID NO: 1175323 - RNA, 16 nt, Homo sapiens
auuccaacaaaggguu

SEQ ID NO: 1175324 - RNA, 18 nt, Homo sapiens
auuccaagaauagcaucu

SEQ ID NO: 1175325 - RNA, 19 nt, Homo sapiens
auuccacaggaucaucauu

SEQ ID NO: 1175326 - RNA, 17 nt, Homo sapiens
auuccagaaugcuguac

SEQ ID NO: 1175327 - RNA, 19 nt, Homo sapiens
auuccagaaugcuguacau

SEQ ID NO: 1175328 - RNA, 20 nt, Homo sapiens
auuccagucaaaucugggcu

SEQ ID NO: 1175329 - RNA, 16 nt, Homo sapiens
auuccagucauuuugg

SEQ ID NO: 1175330 - RNA, 16 nt, Homo sapiens
auuccagucuacuuga

SEQ ID NO: 1175331 - RNA, 14 nt, Homo sapiens
auucccaagcuuuu

SEQ ID NO: 1175332 - RNA, 20 nt, Homo sapiens
auucccaagguuacuggaua

SEQ ID NO: 1175333 - RNA, 14 nt, Homo sapiens
auucccaagugaau

SEQ ID NO: 1175334 - RNA, 16 nt, Homo sapiens
auucccacagcacuaa

SEQ ID NO: 1175335 - RNA, 23 nt, Homo sapiens
auuccccacacucuccugugaac

SEQ ID NO: 1175336 - RNA, 18 nt, Homo sapiens
auucccuuuucuuuaagu

SEQ ID NO: 1175337 - RNA, 20 nt, Homo sapiens
auuccgucaccacgacuggc

SEQ ID NO: 1175338 - RNA, 21 nt, Homo sapiens
auuccuaagacugcugcugaa

SEQ ID NO: 1175339 - RNA, 15 nt, Homo sapiens
auuccucauccucag

SEQ ID NO: 1175340 - RNA, 19 nt, Homo sapiens
auuccugaaauaaugcaag

SEQ ID NO: 1175341 - RNA, 20 nt, Homo sapiens
auuccuguaaaugugacaaa

SEQ ID NO: 1175342 - RNA, 12 nt, Homo sapiens
auuccuugcaca

SEQ ID NO: 1175343 - RNA, 17 nt, Homo sapiens
auuccuuuccaguucau

SEQ ID NO: 1175344 - RNA, 19 nt, Homo sapiens
auucgcuguccccucagcg

SEQ ID NO: 1175345 - RNA, 20 nt, Homo sapiens
auucgugcauuuuuggauca

SEQ ID NO: 1175346 - RNA, 13 nt, Homo sapiens
auucuaacauauu

SEQ ID NO: 1175347 - RNA, 16 nt, Homo sapiens
auucuaagucacagga

SEQ ID NO: 1175348 - RNA, 18 nt, Homo sapiens
auucuagguuagucaaga

SEQ ID NO: 1175349 - RNA, 22 nt, Homo sapiens
auucuaguguaaaucaugcaag

SEQ ID NO: 1175350 - RNA, 19 nt, Homo sapiens
auucuauacauguauaucu

SEQ ID NO: 1175351 - RNA, 15 nt, Homo sapiens
auucucagugccaac

SEQ ID NO: 1175352 - RNA, 12 nt, Homo sapiens
auucuccacagc

SEQ ID NO: 1175353 - RNA, 19 nt, Homo sapiens
auucuccccugauuggaau

SEQ ID NO: 1175354 - RNA, 15 nt, Homo sapiens
auucuccugccucag

SEQ ID NO: 1175355 - RNA, 22 nt, Homo sapiens
auucucuaauaagaaaaccacc

SEQ ID NO: 1175356 - RNA, 14 nt, Homo sapiens
auucucugcucagu

SEQ ID NO: 1175357 - RNA, 17 nt, Homo sapiens
auucucugucucaucca

SEQ ID NO: 1175358 - RNA, 19 nt, Homo sapiens
auucucugucucauccauc

SEQ ID NO: 1175359 - RNA, 22 nt, Homo sapiens
auucugaaucagaaucucgcag

SEQ ID NO: 1175360 - RNA, 18 nt, Homo sapiens
auucugauaaugcucacu

SEQ ID NO: 1175361 - RNA, 18 nt, Homo sapiens
auucugauucgaaugaca

SEQ ID NO: 1175362 - RNA, 17 nt, Homo sapiens
auucugcagguaaaaga

SEQ ID NO: 1175363 - RNA, 18 nt, Homo sapiens
auucugcucuuugauuca

SEQ ID NO: 1175364 - RNA, 19 nt, Homo sapiens
caagacccaaguagcugcu

SEQ ID NO: 1175365 - RNA, 11 nt, Homo sapiens
caagaccccac

SEQ ID NO: 1175366 - RNA, 17 nt, Homo sapiens
caagacccccagcacuu

SEQ ID NO: 1175367 - RNA, 15 nt, Homo sapiens
caagacccucucagg

SEQ ID NO: 1175368 - RNA, 16 nt, Homo sapiens
caagacccucucaggc

SEQ ID NO: 1175369 - RNA, 15 nt, Homo sapiens
caagaccuaaggguu

SEQ ID NO: 1175370 - RNA, 16 nt, Homo sapiens
caagaccucugugcac

SEQ ID NO: 1175371 - RNA, 21 nt, Homo sapiens
caagacuccaucucaaaaaag

SEQ ID NO: 1175372 - RNA, 12 nt, Homo sapiens
caagacuccuca

SEQ ID NO: 1175373 - RNA, 13 nt, Homo sapiens
caagacucuagag

SEQ ID NO: 1175374 - RNA, 16 nt, Homo sapiens
caagacucugaacaau

SEQ ID NO: 1175375 - RNA, 16 nt, Homo sapiens
caagacugucuuaccu

SEQ ID NO: 1175376 - RNA, 23 nt, Homo sapiens
caagagauuguuguuugccauac

SEQ ID NO: 1175377 - RNA, 23 nt, Homo sapiens
caagagcagcuaaaaccuacuca

SEQ ID NO: 1175378 - RNA, 17 nt, Homo sapiens
caagagccugagaguga

SEQ ID NO: 1175379 - RNA, 16 nt, Homo sapiens
caagagucucuccagc

SEQ ID NO: 1175380 - RNA, 20 nt, Homo sapiens
caagauacacgucacaaaga

SEQ ID NO: 1175381 - RNA, 14 nt, Homo sapiens
caagauauggacac

SEQ ID NO: 1175382 - RNA, 16 nt, Homo sapiens
caagaugcaacuagga

SEQ ID NO: 1175383 - RNA, 15 nt, Homo sapiens
caagauggauggaaa

SEQ ID NO: 1175384 - RNA, 20 nt, Homo sapiens
caagauggauggaaagggag

SEQ ID NO: 1175385 - RNA, 23 nt, Homo sapiens
caagauguugauuuuuacugugu

SEQ ID NO: 1175386 - RNA, 14 nt, Homo sapiens
caagauuaauuuca

SEQ ID NO: 1175387 - RNA, 15 nt, Homo sapiens
caagcaauccuccua

SEQ ID NO: 1175388 - RNA, 18 nt, Homo sapiens
caagcaccucuccuguga

SEQ ID NO: 1175389 - RNA, 18 nt, Homo sapiens
caagcagaauguacuuga

SEQ ID NO: 1175390 - RNA, 19 nt, Homo sapiens
caagcagaauguacuugau

SEQ ID NO: 1175391 - RNA, 15 nt, Homo sapiens
caagcaggaagcuca

SEQ ID NO: 1175392 - RNA, 17 nt, Homo sapiens
caagcagguaagagcug

SEQ ID NO: 1175393 - RNA, 23 nt, Homo sapiens
caagcaguuaguuccuucaugau

SEQ ID NO: 1175394 - RNA, 15 nt, Homo sapiens
caagcauucuguuua

SEQ ID NO: 1175395 - RNA, 22 nt, Homo sapiens
caagcauuuagugcacaguggc

SEQ ID NO: 1175396 - RNA, 22 nt, Homo sapiens
caagccacauggugacuuuuga

SEQ ID NO: 1175397 - RNA, 16 nt, Homo sapiens
caagccagcaugugug

SEQ ID NO: 1175398 - RNA, 13 nt, Homo sapiens
caagcgauucucc

SEQ ID NO: 1175399 - RNA, 16 nt, Homo sapiens
caagcgggccgucucc

SEQ ID NO: 1175400 - RNA, 20 nt, Homo sapiens
caagcuagcaaaaaaacucu

SEQ ID NO: 1175401 - RNA, 22 nt, Homo sapiens
caagcuccuccucccugcaucu

SEQ ID NO: 1175402 - RNA, 12 nt, Homo sapiens
caagcugccucc

SEQ ID NO: 1175403 - RNA, 16 nt, Homo sapiens
caagcugguauuuuca

SEQ ID NO: 1175404 - RNA, 18 nt, Homo sapiens
caagcuguaucacugccu

SEQ ID NO: 1175405 - RNA, 16 nt, Homo sapiens
caagcuuauaauguau

SEQ ID NO: 1175406 - RNA, 22 nt, Homo sapiens
caagcuuggcugucucaucccc

SEQ ID NO: 1175407 - RNA, 20 nt, Homo sapiens
caaggaaaaacaggucuuca

SEQ ID NO: 1175408 - RNA, 15 nt, Homo sapiens
caaggaauaaaugag

SEQ ID NO: 1175409 - RNA, 18 nt, Homo sapiens
caaggacaacuuuaugua

SEQ ID NO: 1175410 - RNA, 15 nt, Homo sapiens
caaggagaauaugau

SEQ ID NO: 1175411 - RNA, 21 nt, Homo sapiens
caaggagaggggaccaugcaa

SEQ ID NO: 1175412 - RNA, 20 nt, Homo sapiens
caaggagggcagaucacuuc

SEQ ID NO: 1175413 - RNA, 19 nt, Homo sapiens
caaggagggugagugcaag

SEQ ID NO: 1175414 - RNA, 18 nt, Homo sapiens
caaggcaggccuuuccua

SEQ ID NO: 1175415 - RNA, 12 nt, Homo sapiens
caaggcugaggu

SEQ ID NO: 1175416 - RNA, 17 nt, Homo sapiens
caagggaucugguccua

SEQ ID NO: 1175417 - RNA, 19 nt, Homo sapiens
caaggggccauuuggcaua

SEQ ID NO: 1175418 - RNA, 21 nt, Homo sapiens
caagggggcggggacugcugg

SEQ ID NO: 1175419 - RNA, 22 nt, Homo sapiens
caaggguaaucuuggguuucua

SEQ ID NO: 1175420 - RNA, 20 nt, Homo sapiens
caagguauguacaguucaua

SEQ ID NO: 1175421 - RNA, 16 nt, Homo sapiens
caaggucucacacucc

SEQ ID NO: 1175422 - RNA, 17 nt, Homo sapiens
caaggugacauuuccau

SEQ ID NO: 1175423 - RNA, 13 nt, Homo sapiens
caaggugcucaau

SEQ ID NO: 1175424 - RNA, 17 nt, Homo sapiens
caagguuuuagguucua

SEQ ID NO: 1175425 - RNA, 18 nt, Homo sapiens
caaguaaaagaaaagccg

SEQ ID NO: 1175426 - RNA, 21 nt, Homo sapiens
caaguaagaaagugaagcaaa

SEQ ID NO: 1175427 - RNA, 14 nt, Homo sapiens
caaguaaguaugaa

SEQ ID NO: 1175428 - RNA, 17 nt, Homo sapiens
caaguagaacaaaaacu

SEQ ID NO: 1175429 - RNA, 19 nt, Homo sapiens
caaguagcugggacugcag

SEQ ID NO: 1175430 - RNA, 20 nt, Homo sapiens
caaguauagccuauggcaga

SEQ ID NO: 1175431 - RNA, 20 nt, Homo sapiens
caagucauaccuacauucaa

SEQ ID NO: 1175432 - RNA, 14 nt, Homo sapiens
caagucauccccuu

SEQ ID NO: 1175433 - RNA, 20 nt, Homo sapiens
caagucauggacauucaugc

SEQ ID NO: 1175434 - RNA, 15 nt, Homo sapiens
caagucccccaagac

SEQ ID NO: 1175435 - RNA, 15 nt, Homo sapiens
caagucgaugaacua

SEQ ID NO: 1175436 - RNA, 13 nt, Homo sapiens
caagucuacuuca

SEQ ID NO: 1175437 - RNA, 21 nt, Homo sapiens
caagucuacuucacuaaugac

SEQ ID NO: 1175438 - RNA, 19 nt, Homo sapiens
caagugaucuguccaccuc

SEQ ID NO: 1175439 - RNA, 21 nt, Homo sapiens
caagugauugaagcccaguga

SEQ ID NO: 1175440 - RNA, 16 nt, Homo sapiens
caagugccaagacaca

SEQ ID NO: 1175441 - RNA, 19 nt, Homo sapiens
caagugcucaagcagcaaa

SEQ ID NO: 1175442 - RNA, 15 nt, Homo sapiens
caaguggguaguguc

SEQ ID NO: 1175443 - RNA, 21 nt, Homo sapiens
caaguguaaaaagaugacuua

SEQ ID NO: 1175444 - RNA, 19 nt, Homo sapiens
caaguguguguguguuuua

SEQ ID NO: 1175445 - RNA, 16 nt, Homo sapiens
caaguguucacaaccu

SEQ ID NO: 1175446 - RNA, 20 nt, Homo sapiens
caaguguuuuacuaucucac

SEQ ID NO: 1175447 - RNA, 17 nt, Homo sapiens
caaguuacagugaugcu

SEQ ID NO: 1175448 - RNA, 13 nt, Homo sapiens
caaguuccagugc

SEQ ID NO: 1175449 - RNA, 18 nt, Homo sapiens
caaguuccagugcagaga

SEQ ID NO: 1175450 - RNA, 23 nt, Homo sapiens
caaguucuggagcucuuguguca

SEQ ID NO: 1175451 - RNA, 21 nt, Homo sapiens
caaguuguuuaacugugcaug

SEQ ID NO: 1175452 - RNA, 18 nt, Homo sapiens
caauaaacauagcuugua

SEQ ID NO: 1175453 - RNA, 18 nt, Homo sapiens
caauaaagaccacuuuac

SEQ ID NO: 1175454 - RNA, 19 nt, Homo sapiens
caauaaagaccacuuuaca

SEQ ID NO: 1175455 - RNA, 14 nt, Homo sapiens
caauaaagacugag

SEQ ID NO: 1175456 - RNA, 13 nt, Homo sapiens
caauaaagcacua

SEQ ID NO: 1175457 - RNA, 17 nt, Homo sapiens
caauaaaugccacuuca

SEQ ID NO: 1175458 - RNA, 19 nt, Homo sapiens
caauaacacugcuuauaaa

SEQ ID NO: 1175459 - RNA, 12 nt, Homo sapiens
caauaaugcagu

SEQ ID NO: 1175460 - RNA, 17 nt, Homo sapiens
caauaauugcagaacua

SEQ ID NO: 1175461 - RNA, 16 nt, Homo sapiens
caauaauuuuaacuuu

SEQ ID NO: 1175462 - RNA, 15 nt, Homo sapiens
caauacguuugauaa

SEQ ID NO: 1175463 - RNA, 21 nt, Homo sapiens
caauacuugcauuccagaguu

SEQ ID NO: 1175464 - RNA, 16 nt, Homo sapiens
caauagguaaagcuau

SEQ ID NO: 1175465 - RNA, 18 nt, Homo sapiens
caauauagcaagauccca

SEQ ID NO: 1175466 - RNA, 20 nt, Homo sapiens
caauauaggggaaaaaacuc

SEQ ID NO: 1175467 - RNA, 23 nt, Homo sapiens
caauauaguuuucuaacuccugu

SEQ ID NO: 1175468 - RNA, 19 nt, Homo sapiens
caauaucugggucaaucca

SEQ ID NO: 1175469 - RNA, 13 nt, Homo sapiens
caauaucuugcca

SEQ ID NO: 1175470 - RNA, 17 nt, Homo sapiens
caauaucuuuauugcau

SEQ ID NO: 1175471 - RNA, 17 nt, Homo sapiens
caauaugacucagagaa

SEQ ID NO: 1175472 - RNA, 23 nt, Homo sapiens
caauauguuuaucaacucaagaa

SEQ ID NO: 1175473 - RNA, 20 nt, Homo sapiens
caaucacgggcgguccugca

SEQ ID NO: 1175474 - RNA, 22 nt, Homo sapiens
caaucacguugaaacaagugca

SEQ ID NO: 1175475 - RNA, 13 nt, Homo sapiens
caaucacuguaua

SEQ ID NO: 1175476 - RNA, 20 nt, Homo sapiens
caauccauccugcucaggaa

SEQ ID NO: 1175477 - RNA, 23 nt, Homo sapiens
caauccauuuggcagaacugcug

SEQ ID NO: 1175478 - RNA, 20 nt, Homo sapiens
caaucccacguacuuauaaa

SEQ ID NO: 1175479 - RNA, 17 nt, Homo sapiens
caauccucucaccucag

SEQ ID NO: 1175480 - RNA, 14 nt, Homo sapiens
caaucuugguugcu

SEQ ID NO: 1175481 - RNA, 16 nt, Homo sapiens
caaugaaaugauguca

SEQ ID NO: 1175482 - RNA, 14 nt, Homo sapiens
caaugaaaugcucu

SEQ ID NO: 1175483 - RNA, 17 nt, Homo sapiens
caaugaauccccaauaa

SEQ ID NO: 1175484 - RNA, 15 nt, Homo sapiens
caaugacacagucuu

SEQ ID NO: 1175485 - RNA, 13 nt, Homo sapiens
caaugacauuuau

SEQ ID NO: 1175486 - RNA, 14 nt, Homo sapiens
caaugcacugagug

SEQ ID NO: 1175487 - RNA, 23 nt, Homo sapiens
caaugccaaaaaaagacagggcu

SEQ ID NO: 1175488 - RNA, 15 nt, Homo sapiens
caaugcuaagcuguu

SEQ ID NO: 1175489 - RNA, 22 nt, Homo sapiens
caaugcuaccgccccaaaguaa

SEQ ID NO: 1175490 - RNA, 21 nt, Homo sapiens
caaugcugaugaaucacuguu

SEQ ID NO: 1175491 - RNA, 21 nt, Homo sapiens
caauggggauguuguguuucu

SEQ ID NO: 1175492 - RNA, 13 nt, Homo sapiens
caauggugacuga

SEQ ID NO: 1175493 - RNA, 17 nt, Homo sapiens
caaugugacauguugcu

SEQ ID NO: 1175494 - RNA, 14 nt, Homo sapiens
caauguuagccaca

SEQ ID NO: 1175495 - RNA, 20 nt, Homo sapiens
caauguuuuaaacauucuuc

SEQ ID NO: 1175496 - RNA, 21 nt, Homo sapiens
ccggggauucuguacaugcau

SEQ ID NO: 1175497 - RNA, 22 nt, Homo sapiens
ccggggcaagagggaaggugac

SEQ ID NO: 1175498 - RNA, 15 nt, Homo sapiens
ccggggccagcacuu

SEQ ID NO: 1175499 - RNA, 14 nt, Homo sapiens
ccguaacaccugau

SEQ ID NO: 1175500 - RNA, 13 nt, Homo sapiens
ccguccacagggc

SEQ ID NO: 1175501 - RNA, 19 nt, Homo sapiens
ccgucuccauggcaucuuc

SEQ ID NO: 1175502 - RNA, 23 nt, Homo sapiens
ccgugaacuugugagaacacagc

SEQ ID NO: 1175503 - RNA, 14 nt, Homo sapiens
ccgugacaguuuac

SEQ ID NO: 1175504 - RNA, 17 nt, Homo sapiens
ccgugagugacauagcc

SEQ ID NO: 1175505 - RNA, 16 nt, Homo sapiens
ccgugcucacuaccaa

SEQ ID NO: 1175506 - RNA, 15 nt, Homo sapiens
ccguggccuggcauc

SEQ ID NO: 1175507 - RNA, 18 nt, Homo sapiens
ccguuugguagacuccuu

SEQ ID NO: 1175508 - RNA, 13 nt, Homo sapiens
ccuaaaagcacac

SEQ ID NO: 1175509 - RNA, 16 nt, Homo sapiens
ccuaaaagcacacuca

SEQ ID NO: 1175510 - RNA, 14 nt, Homo sapiens
ccuaaaaguucuca

SEQ ID NO: 1175511 - RNA, 14 nt, Homo sapiens
ccuaaaaugaauuu

SEQ ID NO: 1175512 - RNA, 17 nt, Homo sapiens
ccuaaacauaugaauua

SEQ ID NO: 1175513 - RNA, 15 nt, Homo sapiens
ccuaaagacuguaua

SEQ ID NO: 1175514 - RNA, 16 nt, Homo sapiens
ccuaacacggugcuca

SEQ ID NO: 1175515 - RNA, 20 nt, Homo sapiens
ccuaacuuuucuacguauaa

SEQ ID NO: 1175516 - RNA, 16 nt, Homo sapiens
ccuaagacgucccuuu

SEQ ID NO: 1175517 - RNA, 13 nt, Homo sapiens
ccuaagagauucu

SEQ ID NO: 1175518 - RNA, 17 nt, Homo sapiens
ccuaaucaagagucucu

SEQ ID NO: 1175519 - RNA, 20 nt, Homo sapiens
ccuaaugcucaccuuuauca

SEQ ID NO: 1175520 - RNA, 12 nt, Homo sapiens
ccuaaugcuuuu

SEQ ID NO: 1175521 - RNA, 13 nt, Homo sapiens
ccuaauucaucuu

SEQ ID NO: 1175522 - RNA, 20 nt, Homo sapiens
ccuacacgagauacagaauu

SEQ ID NO: 1175523 - RNA, 21 nt, Homo sapiens
ccuaccaagauauaccugaua

SEQ ID NO: 1175524 - RNA, 16 nt, Homo sapiens
ccuaccuaccaagaua

SEQ ID NO: 1175525 - RNA, 19 nt, Homo sapiens
ccuaccuuccccagacuug

SEQ ID NO: 1175526 - RNA, 12 nt, Homo sapiens
ccuacucugcaa

SEQ ID NO: 1175527 - RNA, 18 nt, Homo sapiens
ccuacugcuuccucugaa

SEQ ID NO: 1175528 - RNA, 18 nt, Homo sapiens
ccuacugguguaaucuca

SEQ ID NO: 1175529 - RNA, 17 nt, Homo sapiens
ccuacugucccucucag

SEQ ID NO: 1175530 - RNA, 20 nt, Homo sapiens
ccuacuucggucuggccgcu

SEQ ID NO: 1175531 - RNA, 21 nt, Homo sapiens
ccuacuuuugggaaucuguag

SEQ ID NO: 1175532 - RNA, 15 nt, Homo sapiens
ccuagaacaagccac

SEQ ID NO: 1175533 - RNA, 22 nt, Homo sapiens
ccuagacucuguaaccaccucu

SEQ ID NO: 1175534 - RNA, 14 nt, Homo sapiens
ccuagagacaguga

SEQ ID NO: 1175535 - RNA, 22 nt, Homo sapiens
ccuagagcacucucaccccaag

SEQ ID NO: 1175536 - RNA, 16 nt, Homo sapiens
ccuagcacaugcuuca

SEQ ID NO: 1175537 - RNA, 22 nt, Homo sapiens
ccuaggaggcuagaagagccaa

SEQ ID NO: 1175538 - RNA, 19 nt, Homo sapiens
ccuaggauuucagccaugc

SEQ ID NO: 1175539 - RNA, 20 nt, Homo sapiens
ccuaggguuuaugcuuaauu

SEQ ID NO: 1175540 - RNA, 19 nt, Homo sapiens
ccuauacaaaacaccagac

SEQ ID NO: 1175541 - RNA, 21 nt, Homo sapiens
ccuauagaaacaccaguaccu

SEQ ID NO: 1175542 - RNA, 18 nt, Homo sapiens
ccuaucaguuauuaauuu

SEQ ID NO: 1175543 - RNA, 14 nt, Homo sapiens
ccuauccugguuag

SEQ ID NO: 1175544 - RNA, 14 nt, Homo sapiens
ccuaugcacauaug

SEQ ID NO: 1175545 - RNA, 20 nt, Homo sapiens
ccuauggaauuuauaauuca

SEQ ID NO: 1175546 - RNA, 15 nt, Homo sapiens
ccuauggaguagcca

SEQ ID NO: 1175547 - RNA, 14 nt, Homo sapiens
ccuauguaugccau

SEQ ID NO: 1175548 - RNA, 12 nt, Homo sapiens
ccuauuacuuuu

SEQ ID NO: 1175549 - RNA, 20 nt, Homo sapiens
ccuauuaggauaccacuuuu

SEQ ID NO: 1175550 - RNA, 23 nt, Homo sapiens
ccuauuagggaguuaugcaaaau

SEQ ID NO: 1175551 - RNA, 16 nt, Homo sapiens
ccuauuccagugucca

SEQ ID NO: 1175552 - RNA, 20 nt, Homo sapiens
ccuauucccugugucugcca

SEQ ID NO: 1175553 - RNA, 11 nt, Homo sapiens
ccuauuugacu

SEQ ID NO: 1175554 - RNA, 14 nt, Homo sapiens
ccucaacacugaag

SEQ ID NO: 1175555 - RNA, 22 nt, Homo sapiens
ccucaacaucacacaguauacu

SEQ ID NO: 1175556 - RNA, 18 nt, Homo sapiens
ccucaaccuccuggguuc

SEQ ID NO: 1175557 - RNA, 20 nt, Homo sapiens
ccucaacugggaaccuucau

SEQ ID NO: 1175558 - RNA, 23 nt, Homo sapiens
ccucaagaaauaaaaggaagcca

SEQ ID NO: 1175559 - RNA, 14 nt, Homo sapiens
ccucaagugauccu

SEQ ID NO: 1175560 - RNA, 24 nt, Homo sapiens
ccucaauggccuuuugcuacgugc

SEQ ID NO: 1175561 - RNA, 20 nt, Homo sapiens
ccucacaacuccuuccaucc

SEQ ID NO: 1175562 - RNA, 14 nt, Homo sapiens
ccucacacagcccu

SEQ ID NO: 1175563 - RNA, 13 nt, Homo sapiens
ccucacauacccu

SEQ ID NO: 1175564 - RNA, 23 nt, Homo sapiens
ccucacccuuuaccuuccucagg

SEQ ID NO: 1175565 - RNA, 14 nt, Homo sapiens
ccucaccugguccu

SEQ ID NO: 1175566 - RNA, 21 nt, Homo sapiens
ccucaccuuggcaccagacac

SEQ ID NO: 1175567 - RNA, 12 nt, Homo sapiens
ccucacucagcu

SEQ ID NO: 1175568 - RNA, 14 nt, Homo sapiens
ccucacuguuugca

SEQ ID NO: 1175569 - RNA, 15 nt, Homo sapiens
ccucacuuaaacuuu

SEQ ID NO: 1175570 - RNA, 24 nt, Homo sapiens
ccucacuuguccuccugauccuga

SEQ ID NO: 1175571 - RNA, 19 nt, Homo sapiens
ccucagaagaaaacaaagu

SEQ ID NO: 1175572 - RNA, 13 nt, Homo sapiens
ccucagagugcaa

SEQ ID NO: 1175573 - RNA, 14 nt, Homo sapiens
ccucagagugcaag

SEQ ID NO: 1175574 - RNA, 14 nt, Homo sapiens
ccucagccaugagg

SEQ ID NO: 1175575 - RNA, 17 nt, Homo sapiens
ccucagccuccugggua

SEQ ID NO: 1175576 - RNA, 19 nt, Homo sapiens
ccucagccuggccagacac

SEQ ID NO: 1175577 - RNA, 23 nt, Homo sapiens
ccucagggacagagacaccugca

SEQ ID NO: 1175578 - RNA, 17 nt, Homo sapiens
ccucagugcauccccac

SEQ ID NO: 1175579 - RNA, 17 nt, Homo sapiens
ccucaguggcucugggu

SEQ ID NO: 1175580 - RNA, 22 nt, Homo sapiens
ccucaucauuucccaucuggac

SEQ ID NO: 1175581 - RNA, 16 nt, Homo sapiens
ccucaucuuucuucca

SEQ ID NO: 1175582 - RNA, 12 nt, Homo sapiens
ccucauggaaug

SEQ ID NO: 1175583 - RNA, 13 nt, Homo sapiens
ccucaugucauuu

SEQ ID NO: 1175584 - RNA, 22 nt, Homo sapiens
ccucauucuacuaaugugaugc

SEQ ID NO: 1175585 - RNA, 15 nt, Homo sapiens
ccucauucuacugaa

SEQ ID NO: 1175586 - RNA, 22 nt, Homo sapiens
ccucauugcauuuauugcaguu

SEQ ID NO: 1175587 - RNA, 15 nt, Homo sapiens
ccuccaagccacuga

SEQ ID NO: 1175588 - RNA, 14 nt, Homo sapiens
ccuccacagcagug

SEQ ID NO: 1175589 - RNA, 21 nt, Homo sapiens
ccuccacgggcucuccugggc

SEQ ID NO: 1175590 - RNA, 20 nt, Homo sapiens
ccuccagcacaaacacaagg

SEQ ID NO: 1175591 - RNA, 15 nt, Homo sapiens
ccuccaguccuuaau

SEQ ID NO: 1175592 - RNA, 22 nt, Homo sapiens
ccuccauaugcuguacaugaca

SEQ ID NO: 1175593 - RNA, 15 nt, Homo sapiens
ccucccaacgugcug

SEQ ID NO: 1175594 - RNA, 17 nt, Homo sapiens
ccucccaggccaggcuc

SEQ ID NO: 1175595 - RNA, 14 nt, Homo sapiens
ccuccccaacuccc

SEQ ID NO: 1175596 - RNA, 19 nt, Homo sapiens
ccuccccccaaucccucaa

SEQ ID NO: 1175597 - RNA, 19 nt, Homo sapiens
ccucccuaccuaccaagau

SEQ ID NO: 1175598 - RNA, 13 nt, Homo sapiens
ccucccuccagau

SEQ ID NO: 1175599 - RNA, 15 nt, Homo sapiens
ccucccugcaucuga

SEQ ID NO: 1175600 - RNA, 14 nt, Homo sapiens
ccucccuggcugca

SEQ ID NO: 1175601 - RNA, 13 nt, Homo sapiens
ccucccuguucaa

SEQ ID NO: 1175602 - RNA, 14 nt, Homo sapiens
ccuccgaccucucu

SEQ ID NO: 1175603 - RNA, 14 nt, Homo sapiens
ccuccguggcacau

SEQ ID NO: 1175604 - RNA, 21 nt, Homo sapiens
ccuccuagccccuucuuccaa

SEQ ID NO: 1175605 - RNA, 21 nt, Homo sapiens
ccuccucacccacccuguggc

SEQ ID NO: 1175606 - RNA, 20 nt, Homo sapiens
ccuccucaggcacacagcua

SEQ ID NO: 1175607 - RNA, 18 nt, Homo sapiens
ccuccugaagccacagca

SEQ ID NO: 1175608 - RNA, 23 nt, Homo sapiens
ccuccugacaacgucucuucaag

SEQ ID NO: 1175609 - RNA, 17 nt, Homo sapiens
ccuccugaggcuuuggc

SEQ ID NO: 1175610 - RNA, 14 nt, Homo sapiens
ccuccuggguucaa

SEQ ID NO: 1175611 - RNA, 18 nt, Homo sapiens
ccuccuuagaccugaggg

SEQ ID NO: 1175612 - RNA, 18 nt, Homo sapiens
ccuccuugcuuguuacau

SEQ ID NO: 1175613 - RNA, 20 nt, Homo sapiens
ccucgaaaaccaucacauga

SEQ ID NO: 1175614 - RNA, 15 nt, Homo sapiens
ccucgaacacuagua

SEQ ID NO: 1175615 - RNA, 19 nt, Homo sapiens
ccucgacguuuacaagccc

SEQ ID NO: 1175616 - RNA, 20 nt, Homo sapiens
ccucgagaucccaacacugc

SEQ ID NO: 1175617 - RNA, 17 nt, Homo sapiens
ccucgcaucauugcaga

SEQ ID NO: 1175618 - RNA, 14 nt, Homo sapiens
ccucgcugccagcu

SEQ ID NO: 1175619 - RNA, 21 nt, Homo sapiens
ccucgcuuggacggcugggca

SEQ ID NO: 1175620 - RNA, 18 nt, Homo sapiens
ccucggccccucccacac

SEQ ID NO: 1175621 - RNA, 19 nt, Homo sapiens
ccucggccucccaaagugc

SEQ ID NO: 1175622 - RNA, 18 nt, Homo sapiens
ccucgggggccuguggug

SEQ ID NO: 1175623 - RNA, 13 nt, Homo sapiens
ccucuaccucucu

SEQ ID NO: 1175624 - RNA, 21 nt, Homo sapiens
ccucuacuuuaacuuuuacaa

SEQ ID NO: 1175625 - RNA, 16 nt, Homo sapiens
ccucucagcugcugaa

SEQ ID NO: 1175626 - RNA, 15 nt, Homo sapiens
ccucucaggagccau

SEQ ID NO: 1175627 - RNA, 15 nt, Homo sapiens
ccucuccaacugccu

SEQ ID NO: 1175628 - RNA, 13 nt, Homo sapiens
ccucuccacagga

SEQ ID NO: 1175629 - RNA, 21 nt, Homo sapiens
cucaacagagaggaccaacau

SEQ ID NO: 1175630 - RNA, 16 nt, Homo sapiens
cucaacuaccauuccu

SEQ ID NO: 1175631 - RNA, 18 nt, Homo sapiens
cucaagacggggugggga

SEQ ID NO: 1175632 - RNA, 11 nt, Homo sapiens
cucaagacuga

SEQ ID NO: 1175633 - RNA, 12 nt, Homo sapiens
cucaagacugaa

SEQ ID NO: 1175634 - RNA, 15 nt, Homo sapiens
cucaagaucaaugaa

SEQ ID NO: 1175635 - RNA, 17 nt, Homo sapiens
cucaagcaauccucuca

SEQ ID NO: 1175636 - RNA, 18 nt, Homo sapiens
cucaagcagcaaaauccu

SEQ ID NO: 1175637 - RNA, 21 nt, Homo sapiens
cucaagccaagcagccaagcu

SEQ ID NO: 1175638 - RNA, 16 nt, Homo sapiens
cucaaggaaaggccug

SEQ ID NO: 1175639 - RNA, 14 nt, Homo sapiens
cucaagguuuuagg

SEQ ID NO: 1175640 - RNA, 19 nt, Homo sapiens
cucaagucccccaagaccu

SEQ ID NO: 1175641 - RNA, 21 nt, Homo sapiens
cucaaguuguuuaacugugca

SEQ ID NO: 1175642 - RNA, 19 nt, Homo sapiens
cucaaguuuuuguuuugua

SEQ ID NO: 1175643 - RNA, 13 nt, Homo sapiens
cucaauaauuucc

SEQ ID NO: 1175644 - RNA, 19 nt, Homo sapiens
cucaauccauccauguacu

SEQ ID NO: 1175645 - RNA, 12 nt, Homo sapiens
cucaauccugca

SEQ ID NO: 1175646 - RNA, 15 nt, Homo sapiens
cucaauccugcagug

SEQ ID NO: 1175647 - RNA, 23 nt, Homo sapiens
cucaaugaaaauuuaaagggaaa

SEQ ID NO: 1175648 - RNA, 17 nt, Homo sapiens
cucaaugccauugugca

SEQ ID NO: 1175649 - RNA, 11 nt, Homo sapiens
cucacacuccu

SEQ ID NO: 1175650 - RNA, 22 nt, Homo sapiens
cucacaucacuguccaccacca

SEQ ID NO: 1175651 - RNA, 13 nt, Homo sapiens
cucacauucugag

SEQ ID NO: 1175652 - RNA, 13 nt, Homo sapiens
cucacauuucacc

SEQ ID NO: 1175653 - RNA, 17 nt, Homo sapiens
cucaccccagccccacu

SEQ ID NO: 1175654 - RNA, 12 nt, Homo sapiens
cucaccgucucg

SEQ ID NO: 1175655 - RNA, 18 nt, Homo sapiens
cucaccuacccaugaccu

SEQ ID NO: 1175656 - RNA, 19 nt, Homo sapiens
cucaccugucgcuuccuag

SEQ ID NO: 1175657 - RNA, 14 nt, Homo sapiens
cucacgcuucacag

SEQ ID NO: 1175658 - RNA, 15 nt, Homo sapiens
cucacgucucccuaa

SEQ ID NO: 1175659 - RNA, 16 nt, Homo sapiens
cucacucagcucugaa

SEQ ID NO: 1175660 - RNA, 11 nt, Homo sapiens
cucacucccua

SEQ ID NO: 1175661 - RNA, 16 nt, Homo sapiens
cucacucccuguuuua

SEQ ID NO: 1175662 - RNA, 21 nt, Homo sapiens
cucacucccuucccauaagcu

SEQ ID NO: 1175663 - RNA, 22 nt, Homo sapiens
cucacugcuaagaauauuugaa

SEQ ID NO: 1175664 - RNA, 23 nt, Homo sapiens
cucacuggggccuacagcuuuga

SEQ ID NO: 1175665 - RNA, 17 nt, Homo sapiens
cucacuguugcaguggc

SEQ ID NO: 1175666 - RNA, 21 nt, Homo sapiens
cucagaaaugucauguggcua

SEQ ID NO: 1175667 - RNA, 18 nt, Homo sapiens
cucagaaugaaaauucau

SEQ ID NO: 1175668 - RNA, 16 nt, Homo sapiens
cucagaccagcucuuc

SEQ ID NO: 1175669 - RNA, 18 nt, Homo sapiens
cucagagugcaagccccu

SEQ ID NO: 1175670 - RNA, 14 nt, Homo sapiens
cucagaugcucaaa

SEQ ID NO: 1175671 - RNA, 14 nt, Homo sapiens
cucagcagauuuca

SEQ ID NO: 1175672 - RNA, 22 nt, Homo sapiens
cucagcauuugauuaacauuug

SEQ ID NO: 1175673 - RNA, 11 nt, Homo sapiens
cucagcccagc

SEQ ID NO: 1175674 - RNA, 14 nt, Homo sapiens
cucagccugaucag

SEQ ID NO: 1175675 - RNA, 19 nt, Homo sapiens
cucagccuggccagacaca

SEQ ID NO: 1175676 - RNA, 18 nt, Homo sapiens
cucagccuguuccaugaa

SEQ ID NO: 1175677 - RNA, 20 nt, Homo sapiens
cucagcuagacauugcaauu

SEQ ID NO: 1175678 - RNA, 21 nt, Homo sapiens
cucagcuagacauugcaauuu

SEQ ID NO: 1175679 - RNA, 13 nt, Homo sapiens
cucagcucagugc

SEQ ID NO: 1175680 - RNA, 17 nt, Homo sapiens
cucagcucuguccuguu

SEQ ID NO: 1175681 - RNA, 22 nt, Homo sapiens
cucagcuggaugauggucuuca

SEQ ID NO: 1175682 - RNA, 14 nt, Homo sapiens
cucaggacagugau

SEQ ID NO: 1175683 - RNA, 14 nt, Homo sapiens
cucaggcacacagc

SEQ ID NO: 1175684 - RNA, 17 nt, Homo sapiens
cucaggcucuccauuca

SEQ ID NO: 1175685 - RNA, 21 nt, Homo sapiens
cucagggacuggcacacuggc

SEQ ID NO: 1175686 - RNA, 20 nt, Homo sapiens
cucagggcagcgccaggcug

SEQ ID NO: 1175687 - RNA, 20 nt, Homo sapiens
cucaggguauugcuugccac

SEQ ID NO: 1175688 - RNA, 18 nt, Homo sapiens
cucagucagacauggcca

SEQ ID NO: 1175689 - RNA, 24 nt, Homo sapiens
cucaguccacugcugaggacacuc

SEQ ID NO: 1175690 - RNA, 19 nt, Homo sapiens
cucagucugauuaauuugu

SEQ ID NO: 1175691 - RNA, 23 nt, Homo sapiens
cucagucuuaaaaaaauaugccu

SEQ ID NO: 1175692 - RNA, 15 nt, Homo sapiens
cucagugauugcaau

SEQ ID NO: 1175693 - RNA, 22 nt, Homo sapiens
cucagugcaucuaaucacuuag

SEQ ID NO: 1175694 - RNA, 21 nt, Homo sapiens
cucaguguccaguugcagcug

SEQ ID NO: 1175695 - RNA, 21 nt, Homo sapiens
cucaguguuuuggacuccauc

SEQ ID NO: 1175696 - RNA, 17 nt, Homo sapiens
cucaguucccucuugcu

SEQ ID NO: 1175697 - RNA, 15 nt, Homo sapiens
cucauaaucuauaaa

SEQ ID NO: 1175698 - RNA, 13 nt, Homo sapiens
cucauacacagaa

SEQ ID NO: 1175699 - RNA, 16 nt, Homo sapiens
cucauagaacugccug

SEQ ID NO: 1175700 - RNA, 14 nt, Homo sapiens
cucauaggcaaguc

SEQ ID NO: 1175701 - RNA, 14 nt, Homo sapiens
cucauccccaagga

SEQ ID NO: 1175702 - RNA, 17 nt, Homo sapiens
cucaucucuacuaaaau

SEQ ID NO: 1175703 - RNA, 13 nt, Homo sapiens
cucaucugugauu

SEQ ID NO: 1175704 - RNA, 15 nt, Homo sapiens
cucaucuuucuucca

SEQ ID NO: 1175705 - RNA, 20 nt, Homo sapiens
cucaugccuguaaucccagc

SEQ ID NO: 1175706 - RNA, 18 nt, Homo sapiens
cucaugggaaggggagga

SEQ ID NO: 1175707 - RNA, 18 nt, Homo sapiens
cucauguuuuuaaagggc

SEQ ID NO: 1175708 - RNA, 22 nt, Homo sapiens
cucauucuuuauucuauuuuag

SEQ ID NO: 1175709 - RNA, 12 nt, Homo sapiens
cucauugcuugg

SEQ ID NO: 1175710 - RNA, 19 nt, Homo sapiens
cucauuuggacuugcugaa

SEQ ID NO: 1175711 - RNA, 18 nt, Homo sapiens
cuccaaaggcucagauua

SEQ ID NO: 1175712 - RNA, 13 nt, Homo sapiens
cuccaacaccaag

SEQ ID NO: 1175713 - RNA, 22 nt, Homo sapiens
cuccaacaccaagcacagcagc

SEQ ID NO: 1175714 - RNA, 22 nt, Homo sapiens
cuccaacuccuuucagccacau

SEQ ID NO: 1175715 - RNA, 12 nt, Homo sapiens
cuccaagccaag

SEQ ID NO: 1175716 - RNA, 20 nt, Homo sapiens
cuccaagggcaucacugggu

SEQ ID NO: 1175717 - RNA, 17 nt, Homo sapiens
cuccaaucuugagauug

SEQ ID NO: 1175718 - RNA, 19 nt, Homo sapiens
cuccacaaagcaaaggcag

SEQ ID NO: 1175719 - RNA, 16 nt, Homo sapiens
cuccacaacacugugu

SEQ ID NO: 1175720 - RNA, 16 nt, Homo sapiens
cuccacccacagugga

SEQ ID NO: 1175721 - RNA, 17 nt, Homo sapiens
cuccacccacaguggag

SEQ ID NO: 1175722 - RNA, 22 nt, Homo sapiens
cuccacuuguucagggcuuuuc

SEQ ID NO: 1175723 - RNA, 18 nt, Homo sapiens
cuccagaagauugggauu

SEQ ID NO: 1175724 - RNA, 20 nt, Homo sapiens
cuccagaagggcagcuccac

SEQ ID NO: 1175725 - RNA, 14 nt, Homo sapiens
cuccagacauacaa

SEQ ID NO: 1175726 - RNA, 16 nt, Homo sapiens
cuccagauaugugcca

SEQ ID NO: 1175727 - RNA, 15 nt, Homo sapiens
cuccagccugaguga

SEQ ID NO: 1175728 - RNA, 17 nt, Homo sapiens
cuccagcuguacuguag

SEQ ID NO: 1175729 - RNA, 15 nt, Homo sapiens
cuccaggaaugaucu

SEQ ID NO: 1175730 - RNA, 18 nt, Homo sapiens
cuccaguaacugcugucg

SEQ ID NO: 1175731 - RNA, 11 nt, Homo sapiens
cuccaguguug

SEQ ID NO: 1175732 - RNA, 21 nt, Homo sapiens
cuccaguguugcuaugugcaa

SEQ ID NO: 1175733 - RNA, 20 nt, Homo sapiens
cuccauacugggcuaaggaa

SEQ ID NO: 1175734 - RNA, 13 nt, Homo sapiens
cuccauacuuugg

SEQ ID NO: 1175735 - RNA, 14 nt, Homo sapiens
cuccauacuuugga

SEQ ID NO: 1175736 - RNA, 20 nt, Homo sapiens
cuccauagagcagugcacau

SEQ ID NO: 1175737 - RNA, 18 nt, Homo sapiens
cuccauaugcuguacaug

SEQ ID NO: 1175738 - RNA, 16 nt, Homo sapiens
cuccaucucaaaaaag

SEQ ID NO: 1175739 - RNA, 22 nt, Homo sapiens
cuccaucuccugaccucgugau

SEQ ID NO: 1175740 - RNA, 17 nt, Homo sapiens
cuccaucuucagcuucu

SEQ ID NO: 1175741 - RNA, 18 nt, Homo sapiens
cuccauuucuuucuucca

SEQ ID NO: 1175742 - RNA, 22 nt, Homo sapiens
cuccauuuucuugucaauggaa

SEQ ID NO: 1175743 - RNA, 23 nt, Homo sapiens
cuccauuuugaauagggguugag

SEQ ID NO: 1175744 - RNA, 20 nt, Homo sapiens
cucccaaagggcacaccccu

SEQ ID NO: 1175745 - RNA, 20 nt, Homo sapiens
cucccaaaugagccaugaga

SEQ ID NO: 1175746 - RNA, 17 nt, Homo sapiens
cucccaacuccauucuc

SEQ ID NO: 1175747 - RNA, 14 nt, Homo sapiens
cucccaacucccuu

SEQ ID NO: 1175748 - RNA, 14 nt, Homo sapiens
cucccaauacaggc

SEQ ID NO: 1175749 - RNA, 18 nt, Homo sapiens
cucccaccccacccccuu

SEQ ID NO: 1175750 - RNA, 17 nt, Homo sapiens
cucccagaacacacucc

SEQ ID NO: 1175751 - RNA, 19 nt, Homo sapiens
cucccagagugcugggauu

SEQ ID NO: 1175752 - RNA, 20 nt, Homo sapiens
cucccaggccaacaguagcc

SEQ ID NO: 1175753 - RNA, 14 nt, Homo sapiens
cucccagugacaac

SEQ ID NO: 1175754 - RNA, 11 nt, Homo sapiens
cucccauuuca

SEQ ID NO: 1175755 - RNA, 19 nt, Homo sapiens
cuccccaaugagacuugcc

SEQ ID NO: 1175756 - RNA, 19 nt, Homo sapiens
cucccccacugcaccccaa

SEQ ID NO: 1175757 - RNA, 18 nt, Homo sapiens
cuccccucgcccaucagu

SEQ ID NO: 1175758 - RNA, 11 nt, Homo sapiens
cuccccugaag

SEQ ID NO: 1175759 - RNA, 16 nt, Homo sapiens
cucccgggaagccacc

SEQ ID NO: 1175760 - RNA, 18 nt, Homo sapiens
cucccggguucacgccau

SEQ ID NO: 1175761 - RNA, 16 nt, Homo sapiens
cucccguggccuguag

SEQ ID NO: 1175762 - RNA, 22 nt, Homo sapiens
cuuccuucuuuaucuauagcaa

SEQ ID NO: 1175763 - RNA, 13 nt, Homo sapiens
cuuccuugccagu

SEQ ID NO: 1175764 - RNA, 15 nt, Homo sapiens
cuuccuugccaguga

SEQ ID NO: 1175765 - RNA, 17 nt, Homo sapiens
cuuccuuggccaagaga

SEQ ID NO: 1175766 - RNA, 18 nt, Homo sapiens
cuuccuuuugagggagca

SEQ ID NO: 1175767 - RNA, 20 nt, Homo sapiens
cuucgggagugcuuacacuu

SEQ ID NO: 1175768 - RNA, 22 nt, Homo sapiens
cuucgggcugugcccggggaaa

SEQ ID NO: 1175769 - RNA, 15 nt, Homo sapiens
cuucgucuucacucu

SEQ ID NO: 1175770 - RNA, 21 nt, Homo sapiens
cuucuaaacccaauccaaaug

SEQ ID NO: 1175771 - RNA, 19 nt, Homo sapiens
cuucuaaaugagucacuga

SEQ ID NO: 1175772 - RNA, 14 nt, Homo sapiens
cuucuaaauggcau

SEQ ID NO: 1175773 - RNA, 14 nt, Homo sapiens
cuucuaauaaacag

SEQ ID NO: 1175774 - RNA, 12 nt, Homo sapiens
cuucuacugcua

SEQ ID NO: 1175775 - RNA, 16 nt, Homo sapiens
cuucuacugcuaucua

SEQ ID NO: 1175776 - RNA, 22 nt, Homo sapiens
cuucuaggauagcuaacuguaa

SEQ ID NO: 1175777 - RNA, 18 nt, Homo sapiens
cuucuaggguuauugcau

SEQ ID NO: 1175778 - RNA, 21 nt, Homo sapiens
cuucuaggucacuucucacaa

SEQ ID NO: 1175779 - RNA, 20 nt, Homo sapiens
cuucuaguucugccaggaga

SEQ ID NO: 1175780 - RNA, 14 nt, Homo sapiens
cuucuaguuugcaa

SEQ ID NO: 1175781 - RNA, 14 nt, Homo sapiens
cuucuccuaauucu

SEQ ID NO: 1175782 - RNA, 16 nt, Homo sapiens
cuucucugcacuuaua

SEQ ID NO: 1175783 - RNA, 14 nt, Homo sapiens
cuucucugucucug

SEQ ID NO: 1175784 - RNA, 16 nt, Homo sapiens
cuucucuuuaaucuca

SEQ ID NO: 1175785 - RNA, 19 nt, Homo sapiens
cuucugaaguguguccauc

SEQ ID NO: 1175786 - RNA, 15 nt, Homo sapiens
cuucugagcacagau

SEQ ID NO: 1175787 - RNA, 19 nt, Homo sapiens
cuucugcaucuuacaguca

SEQ ID NO: 1175788 - RNA, 15 nt, Homo sapiens
cuucugcucagcucu

SEQ ID NO: 1175789 - RNA, 21 nt, Homo sapiens
cuucuggacugguuuucacau

SEQ ID NO: 1175790 - RNA, 14 nt, Homo sapiens
cuucuggcuguaga

SEQ ID NO: 1175791 - RNA, 21 nt, Homo sapiens
cuucugucccucacagcacua

SEQ ID NO: 1175792 - RNA, 16 nt, Homo sapiens
cuucuuacuggugcua

SEQ ID NO: 1175793 - RNA, 17 nt, Homo sapiens
cuucuuagcaccacaaa

SEQ ID NO: 1175794 - RNA, 22 nt, Homo sapiens
cuucuuauggaauugauuugca

SEQ ID NO: 1175795 - RNA, 18 nt, Homo sapiens
cuucuucugaucauuuca

SEQ ID NO: 1175796 - RNA, 18 nt, Homo sapiens
cuucuugaaaucaaucaa

SEQ ID NO: 1175797 - RNA, 13 nt, Homo sapiens
cuucuugggggua

SEQ ID NO: 1175798 - RNA, 19 nt, Homo sapiens
cuucuuuaccuucauuuca

SEQ ID NO: 1175799 - RNA, 17 nt, Homo sapiens
cuucuuucagacuugcc

SEQ ID NO: 1175800 - RNA, 23 nt, Homo sapiens
cuucuuuccaugggcguguucua

SEQ ID NO: 1175801 - RNA, 13 nt, Homo sapiens
cuucuuugcugca

SEQ ID NO: 1175802 - RNA, 12 nt, Homo sapiens
cuugaaaaagca

SEQ ID NO: 1175803 - RNA, 15 nt, Homo sapiens
cuugaaaauagaaca

SEQ ID NO: 1175804 - RNA, 17 nt, Homo sapiens
cuugaaagcaguuaaac

SEQ ID NO: 1175805 - RNA, 22 nt, Homo sapiens
cuugaaagucgcuccgccuccc

SEQ ID NO: 1175806 - RNA, 18 nt, Homo sapiens
cuugaaauguaggcauca

SEQ ID NO: 1175807 - RNA, 20 nt, Homo sapiens
cuugaaauuaagaaggcaaa

SEQ ID NO: 1175808 - RNA, 15 nt, Homo sapiens
cuugaaccuaugaag

SEQ ID NO: 1175809 - RNA, 22 nt, Homo sapiens
cuugaacugauucacaucucau

SEQ ID NO: 1175810 - RNA, 17 nt, Homo sapiens
cuugaagacucccugau

SEQ ID NO: 1175811 - RNA, 14 nt, Homo sapiens
cuugaaucaaagaa

SEQ ID NO: 1175812 - RNA, 22 nt, Homo sapiens
cuugacuccuuugguauuucac

SEQ ID NO: 1175813 - RNA, 18 nt, Homo sapiens
cuugagacagauucucuc

SEQ ID NO: 1175814 - RNA, 20 nt, Homo sapiens
cuugagccagccaggcccug

SEQ ID NO: 1175815 - RNA, 23 nt, Homo sapiens
cuugagcccuccccaggaauuug

SEQ ID NO: 1175816 - RNA, 20 nt, Homo sapiens
cuugagcuggauucacuugg

SEQ ID NO: 1175817 - RNA, 19 nt, Homo sapiens
cuugagucuccaacggcaa

SEQ ID NO: 1175818 - RNA, 20 nt, Homo sapiens
cuugaguguuaugugaauuu

SEQ ID NO: 1175819 - RNA, 21 nt, Homo sapiens
cuugauagaaaugccaagcac

SEQ ID NO: 1175820 - RNA, 13 nt, Homo sapiens
cuugaucacaugc

SEQ ID NO: 1175821 - RNA, 19 nt, Homo sapiens
cuugaucuccugaccucau

SEQ ID NO: 1175822 - RNA, 18 nt, Homo sapiens
cuugauuggggaauuaaa

SEQ ID NO: 1175823 - RNA, 18 nt, Homo sapiens
cuugauuuuauuguacaa

SEQ ID NO: 1175824 - RNA, 18 nt, Homo sapiens
cuugcaauggaucagcca

SEQ ID NO: 1175825 - RNA, 16 nt, Homo sapiens
cuugcaauguagucaa

SEQ ID NO: 1175826 - RNA, 22 nt, Homo sapiens
cuugcacuggggugggauuugg

SEQ ID NO: 1175827 - RNA, 18 nt, Homo sapiens
cuugccacccauucuucc

SEQ ID NO: 1175828 - RNA, 22 nt, Homo sapiens
cuugcccagggugcagugugag

SEQ ID NO: 1175829 - RNA, 20 nt, Homo sapiens
cuugccuaaauacaagggcu

SEQ ID NO: 1175830 - RNA, 20 nt, Homo sapiens
cuugccuaaggugcguaguc

SEQ ID NO: 1175831 - RNA, 19 nt, Homo sapiens
cuugccuccaggugcagag

SEQ ID NO: 1175832 - RNA, 21 nt, Homo sapiens
cuugcuaucggggaagccaga

SEQ ID NO: 1175833 - RNA, 14 nt, Homo sapiens
cuugcucaaaacac

SEQ ID NO: 1175834 - RNA, 16 nt, Homo sapiens
cuugcuccauuuacaa

SEQ ID NO: 1175835 - RNA, 18 nt, Homo sapiens
cuugcugacucucugagc

SEQ ID NO: 1175836 - RNA, 17 nt, Homo sapiens
cuugcuuucuucuuucc

SEQ ID NO: 1175837 - RNA, 16 nt, Homo sapiens
cuuggaaaaagaaaga

SEQ ID NO: 1175838 - RNA, 20 nt, Homo sapiens
cuuggaaaaagaaagaaaca

SEQ ID NO: 1175839 - RNA, 16 nt, Homo sapiens
cuuggaaccuaagguu

SEQ ID NO: 1175840 - RNA, 13 nt, Homo sapiens
cuuggacuugucc

SEQ ID NO: 1175841 - RNA, 15 nt, Homo sapiens
cuuggagcaaucaga

SEQ ID NO: 1175842 - RNA, 19 nt, Homo sapiens
cuuggaggccagccaguga

SEQ ID NO: 1175843 - RNA, 14 nt, Homo sapiens
cuuggagggcucag

SEQ ID NO: 1175844 - RNA, 20 nt, Homo sapiens
cuuggagggcucagggcagu

SEQ ID NO: 1175845 - RNA, 19 nt, Homo sapiens
cuuggcccgcggccugcac

SEQ ID NO: 1175846 - RNA, 16 nt, Homo sapiens
cuuggcgcugccauuu

SEQ ID NO: 1175847 - RNA, 20 nt, Homo sapiens
cuuggcgggugggagacucc

SEQ ID NO: 1175848 - RNA, 13 nt, Homo sapiens
cuuggcucugaga

SEQ ID NO: 1175849 - RNA, 16 nt, Homo sapiens
cuuggcuucagguuag

SEQ ID NO: 1175850 - RNA, 13 nt, Homo sapiens
cuugggcucccug

SEQ ID NO: 1175851 - RNA, 20 nt, Homo sapiens
cuuggggagauggaguucuu

SEQ ID NO: 1175852 - RNA, 22 nt, Homo sapiens
cuugguaaaguccuuuucuugc

SEQ ID NO: 1175853 - RNA, 18 nt, Homo sapiens
cuuggucacauacaauua

SEQ ID NO: 1175854 - RNA, 14 nt, Homo sapiens
cuuggugcugguuu

SEQ ID NO: 1175855 - RNA, 21 nt, Homo sapiens
cuugguucagguuucuuugaa

SEQ ID NO: 1175856 - RNA, 14 nt, Homo sapiens
cuugguuguauaaa

SEQ ID NO: 1175857 - RNA, 18 nt, Homo sapiens
cuuguaaaauuucacuua

SEQ ID NO: 1175858 - RNA, 19 nt, Homo sapiens
cuuguaaaauuucacuuaa

SEQ ID NO: 1175859 - RNA, 20 nt, Homo sapiens
cuuguaaauacauaaaacaa

SEQ ID NO: 1175860 - RNA, 14 nt, Homo sapiens
cuuguaaauguguu

SEQ ID NO: 1175861 - RNA, 21 nt, Homo sapiens
cuuguagaaugggaugugaua

SEQ ID NO: 1175862 - RNA, 16 nt, Homo sapiens
cuuguagaguggugcu

SEQ ID NO: 1175863 - RNA, 16 nt, Homo sapiens
cuuguauauacgcauc

SEQ ID NO: 1175864 - RNA, 15 nt, Homo sapiens
cuuguauguuuagag

SEQ ID NO: 1175865 - RNA, 21 nt, Homo sapiens
cuugucacgccagacuuccca

SEQ ID NO: 1175866 - RNA, 21 nt, Homo sapiens
cuugucauuggaaacacugcc

SEQ ID NO: 1175867 - RNA, 23 nt, Homo sapiens
cuugucccacucaagccaagcag

SEQ ID NO: 1175868 - RNA, 13 nt, Homo sapiens
cuuguccccauga

SEQ ID NO: 1175869 - RNA, 11 nt, Homo sapiens
cuuguccuucc

SEQ ID NO: 1175870 - RNA, 14 nt, Homo sapiens
cuugucucuggugu

SEQ ID NO: 1175871 - RNA, 19 nt, Homo sapiens
cuugucucugguguucucu

SEQ ID NO: 1175872 - RNA, 15 nt, Homo sapiens
cuugugaaaaugugu

SEQ ID NO: 1175873 - RNA, 11 nt, Homo sapiens
cuugugaaggc

SEQ ID NO: 1175874 - RNA, 21 nt, Homo sapiens
cuugugccucccuucccagug

SEQ ID NO: 1175875 - RNA, 19 nt, Homo sapiens
cuuguguaauuuaugugaa

SEQ ID NO: 1175876 - RNA, 22 nt, Homo sapiens
cuuguguguaccacacccugcc

SEQ ID NO: 1175877 - RNA, 18 nt, Homo sapiens
cuuguuaauuuuauucaa

SEQ ID NO: 1175878 - RNA, 15 nt, Homo sapiens
cuuguuacccaugaa

SEQ ID NO: 1175879 - RNA, 20 nt, Homo sapiens
cuuguuauugccucuacuuu

SEQ ID NO: 1175880 - RNA, 12 nt, Homo sapiens
cuuguuggccau

SEQ ID NO: 1175881 - RNA, 18 nt, Homo sapiens
cuuguuuccuuagcuugg

SEQ ID NO: 1175882 - RNA, 18 nt, Homo sapiens
cuuguuucuauacauucu

SEQ ID NO: 1175883 - RNA, 17 nt, Homo sapiens
cuuguuugguugcaaaa

SEQ ID NO: 1175884 - RNA, 20 nt, Homo sapiens
cuuguuugucagcaucugac

SEQ ID NO: 1175885 - RNA, 21 nt, Homo sapiens
cuuguuuuuccacuacugcua

SEQ ID NO: 1175886 - RNA, 18 nt, Homo sapiens
cuuuaaauuucaucucag

SEQ ID NO: 1175887 - RNA, 18 nt, Homo sapiens
cuuuaaccucacauaccc

SEQ ID NO: 1175888 - RNA, 18 nt, Homo sapiens
cuuuaaguaaaaauccaa

SEQ ID NO: 1175889 - RNA, 20 nt, Homo sapiens
cuuuaaguaaaaauccaaaa

SEQ ID NO: 1175890 - RNA, 13 nt, Homo sapiens
cuuuaaguauuga

SEQ ID NO: 1175891 - RNA, 14 nt, Homo sapiens
cuuuaauggguaaa

SEQ ID NO: 1175892 - RNA, 19 nt, Homo sapiens
cuuuaauuuuuuacuauuu

SEQ ID NO: 1175893 - RNA, 14 nt, Homo sapiens
cuuuacaguggcaa

SEQ ID NO: 1175894 - RNA, 12 nt, Homo sapiens
gcguuacugcuu

SEQ ID NO: 1175895 - RNA, 19 nt, Homo sapiens
gcguuacugcuugaccaaa

SEQ ID NO: 1175896 - RNA, 19 nt, Homo sapiens
gcguucaaacugcuggaaa

SEQ ID NO: 1175897 - RNA, 12 nt, Homo sapiens
gcguuguucaua

SEQ ID NO: 1175898 - RNA, 17 nt, Homo sapiens
gcguuuaaaguacugag

SEQ ID NO: 1175899 - RNA, 17 nt, Homo sapiens
gcguuugaacucaggga

SEQ ID NO: 1175900 - RNA, 18 nt, Homo sapiens
gcuaaaccaccauuuuau

SEQ ID NO: 1175901 - RNA, 18 nt, Homo sapiens
gcuaaacccagaugguuu

SEQ ID NO: 1175902 - RNA, 16 nt, Homo sapiens
gcuaaaugcacugacc

SEQ ID NO: 1175903 - RNA, 21 nt, Homo sapiens
gcuaaauuauuauuuagcuuc

SEQ ID NO: 1175904 - RNA, 17 nt, Homo sapiens
gcuaagauaccaaaacc

SEQ ID NO: 1175905 - RNA, 13 nt, Homo sapiens
gcuaagggggacc

SEQ ID NO: 1175906 - RNA, 14 nt, Homo sapiens
gcuaagggggacca

SEQ ID NO: 1175907 - RNA, 18 nt, Homo sapiens
gcuaauguuacuagagaa

SEQ ID NO: 1175908 - RNA, 19 nt, Homo sapiens
gcuacagagaaaaucaaag

SEQ ID NO: 1175909 - RNA, 19 nt, Homo sapiens
gcuacaguuuggagcccac

SEQ ID NO: 1175910 - RNA, 21 nt, Homo sapiens
gcuacauacuccaacugaaau

SEQ ID NO: 1175911 - RNA, 19 nt, Homo sapiens
gcuaccccauucucuagac

SEQ ID NO: 1175912 - RNA, 15 nt, Homo sapiens
gcuacccgcagaguu

SEQ ID NO: 1175913 - RNA, 20 nt, Homo sapiens
gcuacuuagcuggccaagga

SEQ ID NO: 1175914 - RNA, 17 nt, Homo sapiens
gcuagaaaaaacauaaa

SEQ ID NO: 1175915 - RNA, 14 nt, Homo sapiens
gcuagagugcaaug

SEQ ID NO: 1175916 - RNA, 20 nt, Homo sapiens
gcuagcaccauggcaugcgc

SEQ ID NO: 1175917 - RNA, 15 nt, Homo sapiens
gcuaggaugugcauu

SEQ ID NO: 1175918 - RNA, 17 nt, Homo sapiens
gcuauaacuuacuucug

SEQ ID NO: 1175919 - RNA, 13 nt, Homo sapiens
gcuauacauaugu

SEQ ID NO: 1175920 - RNA, 22 nt, Homo sapiens
gcuauagacccgaggaaacuca

SEQ ID NO: 1175921 - RNA, 23 nt, Homo sapiens
gcuauuucagcaacaaccaucuc

SEQ ID NO: 1175922 - RNA, 20 nt, Homo sapiens
gcuauuucuucuacugcuau

SEQ ID NO: 1175923 - RNA, 15 nt, Homo sapiens
gcuauuuguauuucu

SEQ ID NO: 1175924 - RNA, 21 nt, Homo sapiens
gcuauuuugagaacuccagcu

SEQ ID NO: 1175925 - RNA, 14 nt, Homo sapiens
gcucaagcccugaa

SEQ ID NO: 1175926 - RNA, 18 nt, Homo sapiens
gcucacacccuaccuucc

SEQ ID NO: 1175927 - RNA, 14 nt, Homo sapiens
gcucacaccuguaa

SEQ ID NO: 1175928 - RNA, 22 nt, Homo sapiens
gcucacgccuguaaucccaaca

SEQ ID NO: 1175929 - RNA, 22 nt, Homo sapiens
gcucacugaaaagacuauugug

SEQ ID NO: 1175930 - RNA, 17 nt, Homo sapiens
gcucacuugcucaaaac

SEQ ID NO: 1175931 - RNA, 21 nt, Homo sapiens
gcucagacaccugugugcugu

SEQ ID NO: 1175932 - RNA, 14 nt, Homo sapiens
gcucagacaugaua

SEQ ID NO: 1175933 - RNA, 14 nt, Homo sapiens
gcucagacugguug

SEQ ID NO: 1175934 - RNA, 22 nt, Homo sapiens
gcucagccagcacuuguccagc

SEQ ID NO: 1175935 - RNA, 15 nt, Homo sapiens
gcucagcucccacaa

SEQ ID NO: 1175936 - RNA, 21 nt, Homo sapiens
gcucaggaaggggugugcuga

SEQ ID NO: 1175937 - RNA, 14 nt, Homo sapiens
gcucaguucugccu

SEQ ID NO: 1175938 - RNA, 17 nt, Homo sapiens
gcucaucaagaacaaua

SEQ ID NO: 1175939 - RNA, 15 nt, Homo sapiens
gcucaucauucucug

SEQ ID NO: 1175940 - RNA, 14 nt, Homo sapiens
gcucaugccccuug

SEQ ID NO: 1175941 - RNA, 21 nt, Homo sapiens
gcucaugccucuaaucucagc

SEQ ID NO: 1175942 - RNA, 22 nt, Homo sapiens
gcucauuuuuucuucuccuaaa

SEQ ID NO: 1175943 - RNA, 17 nt, Homo sapiens
gcuccaaugccuacuga

SEQ ID NO: 1175944 - RNA, 20 nt, Homo sapiens
gcuccacccuggccgagucc

SEQ ID NO: 1175945 - RNA, 12 nt, Homo sapiens
gcuccagcaaca

SEQ ID NO: 1175946 - RNA, 16 nt, Homo sapiens
gcuccagcaagcaaac

SEQ ID NO: 1175947 - RNA, 18 nt, Homo sapiens
gcuccaucccauucacuu

SEQ ID NO: 1175948 - RNA, 18 nt, Homo sapiens
gcuccauuuucuugucaa

SEQ ID NO: 1175949 - RNA, 14 nt, Homo sapiens
gcucccacagaaca

SEQ ID NO: 1175950 - RNA, 19 nt, Homo sapiens
gcuccccgagaguccucag

SEQ ID NO: 1175951 - RNA, 20 nt, Homo sapiens
gcuccccucugcacggacca

SEQ ID NO: 1175952 - RNA, 23 nt, Homo sapiens
gcucccucacccaggcacugggc

SEQ ID NO: 1175953 - RNA, 17 nt, Homo sapiens
gcucccugcccugaccu

SEQ ID NO: 1175954 - RNA, 23 nt, Homo sapiens
gcuccuaaggguagaaaacucca

SEQ ID NO: 1175955 - RNA, 13 nt, Homo sapiens
gcuccuccagggu

SEQ ID NO: 1175956 - RNA, 15 nt, Homo sapiens
gcucgcccacuuccu

SEQ ID NO: 1175957 - RNA, 21 nt, Homo sapiens
gcucgcuuccgcauccuaguc

SEQ ID NO: 1175958 - RNA, 16 nt, Homo sapiens
gcucgcuuugagugac

SEQ ID NO: 1175959 - RNA, 21 nt, Homo sapiens
gcucuaaaaaguuuugcccuu

SEQ ID NO: 1175960 - RNA, 19 nt, Homo sapiens
gcucuaagucaaauuccaa

SEQ ID NO: 1175961 - RNA, 12 nt, Homo sapiens
gcucuaaugcca

SEQ ID NO: 1175962 - RNA, 22 nt, Homo sapiens
gcucuauauaugaagugaaaaa

SEQ ID NO: 1175963 - RNA, 14 nt, Homo sapiens
gcucuaucugcaau

SEQ ID NO: 1175964 - RNA, 16 nt, Homo sapiens
gcucucaaaugugacc

SEQ ID NO: 1175965 - RNA, 21 nt, Homo sapiens
gcucuccccucagagugcaag

SEQ ID NO: 1175966 - RNA, 17 nt, Homo sapiens
gcucuccugcgugauuc

SEQ ID NO: 1175967 - RNA, 18 nt, Homo sapiens
gcucuccugugcauugua

SEQ ID NO: 1175968 - RNA, 13 nt, Homo sapiens
gcucucgacagua

SEQ ID NO: 1175969 - RNA, 20 nt, Homo sapiens
gcucugagaaaccucgggaa

SEQ ID NO: 1175970 - RNA, 14 nt, Homo sapiens
gcucugagagggaa

SEQ ID NO: 1175971 - RNA, 21 nt, Homo sapiens
gcucugagagucuagauucuc

SEQ ID NO: 1175972 - RNA, 17 nt, Homo sapiens
gcucugaggacugcacc

SEQ ID NO: 1175973 - RNA, 23 nt, Homo sapiens
gcucugaggauguauaccccugg

SEQ ID NO: 1175974 - RNA, 20 nt, Homo sapiens
gcucugcgccgagccucaga

SEQ ID NO: 1175975 - RNA, 14 nt, Homo sapiens
gcucugcuugacaa

SEQ ID NO: 1175976 - RNA, 17 nt, Homo sapiens
gcucuggggcacuguug

SEQ ID NO: 1175977 - RNA, 12 nt, Homo sapiens
gcucuggugaua

SEQ ID NO: 1175978 - RNA, 16 nt, Homo sapiens
gcucuucugacauuua

SEQ ID NO: 1175979 - RNA, 12 nt, Homo sapiens
gcucuugcucaa

SEQ ID NO: 1175980 - RNA, 17 nt, Homo sapiens
gcucuugugauguuugc

SEQ ID NO: 1175981 - RNA, 13 nt, Homo sapiens
gcucuuugacaac

SEQ ID NO: 1175982 - RNA, 15 nt, Homo sapiens
gcucuuuuauacugu

SEQ ID NO: 1175983 - RNA, 16 nt, Homo sapiens
gcucuuuuauacugua

SEQ ID NO: 1175984 - RNA, 23 nt, Homo sapiens
gcugaaagggaaggacagcugug

SEQ ID NO: 1175985 - RNA, 19 nt, Homo sapiens
gcugaagacauguuucaag

SEQ ID NO: 1175986 - RNA, 20 nt, Homo sapiens
gcugagacagguuaaggggu

SEQ ID NO: 1175987 - RNA, 14 nt, Homo sapiens
gcugagagacccaa

SEQ ID NO: 1175988 - RNA, 20 nt, Homo sapiens
gcugagauugcaccacugca

SEQ ID NO: 1175989 - RNA, 15 nt, Homo sapiens
gcugagcugugacau

SEQ ID NO: 1175990 - RNA, 15 nt, Homo sapiens
gcugaggcuggcaca

SEQ ID NO: 1175991 - RNA, 21 nt, Homo sapiens
gcugaggcuggcacaggacau

SEQ ID NO: 1175992 - RNA, 19 nt, Homo sapiens
gcugagugagugaugaauc

SEQ ID NO: 1175993 - RNA, 12 nt, Homo sapiens
gcugauaaugaa

SEQ ID NO: 1175994 - RNA, 21 nt, Homo sapiens
gcugaucaguuuuuucaccug

SEQ ID NO: 1175995 - RNA, 17 nt, Homo sapiens
gcugauguagugaccaa

SEQ ID NO: 1175996 - RNA, 18 nt, Homo sapiens
gcugauugggauuuccau

SEQ ID NO: 1175997 - RNA, 21 nt, Homo sapiens
gcugcaaauagccuuccugac

SEQ ID NO: 1175998 - RNA, 23 nt, Homo sapiens
gcugcaugcgauuaucuacccac

SEQ ID NO: 1175999 - RNA, 13 nt, Homo sapiens
gcugccaaggaaa

SEQ ID NO: 1176000 - RNA, 19 nt, Homo sapiens
gcugccaccaaaucugucu

SEQ ID NO: 1176001 - RNA, 22 nt, Homo sapiens
gcugccauccaugugcuaguca

SEQ ID NO: 1176002 - RNA, 16 nt, Homo sapiens
gcugccgagugcugug

SEQ ID NO: 1176003 - RNA, 22 nt, Homo sapiens
gcugccgugggccugagaccaa

SEQ ID NO: 1176004 - RNA, 17 nt, Homo sapiens
gcugccugcugugcugg

SEQ ID NO: 1176005 - RNA, 19 nt, Homo sapiens
gcugccuggaacaccagca

SEQ ID NO: 1176006 - RNA, 20 nt, Homo sapiens
gcugccuggaacaccagcag

SEQ ID NO: 1176007 - RNA, 19 nt, Homo sapiens
gcugccuuugaucacagga

SEQ ID NO: 1176008 - RNA, 14 nt, Homo sapiens
gcugcuacugcccc

SEQ ID NO: 1176009 - RNA, 22 nt, Homo sapiens
gcugcucacauucugagaaaca

SEQ ID NO: 1176010 - RNA, 16 nt, Homo sapiens
gcugcuccugagagag

SEQ ID NO: 1176011 - RNA, 14 nt, Homo sapiens
gcugcuucugcaaa

SEQ ID NO: 1176012 - RNA, 16 nt, Homo sapiens
gcugcuuuccaaagcc

SEQ ID NO: 1176013 - RNA, 17 nt, Homo sapiens
gcuggagcccgcacugu

SEQ ID NO: 1176014 - RNA, 20 nt, Homo sapiens
gcuggaguacaguggugcca

SEQ ID NO: 1176015 - RNA, 13 nt, Homo sapiens
gcuggcaaccacu

SEQ ID NO: 1176016 - RNA, 16 nt, Homo sapiens
gcuggccagugcugcc

SEQ ID NO: 1176017 - RNA, 16 nt, Homo sapiens
gcuggcccgugacaga

SEQ ID NO: 1176018 - RNA, 22 nt, Homo sapiens
gcuggccucuuggcaccugccu

SEQ ID NO: 1176019 - RNA, 16 nt, Homo sapiens
gcuggcuggugccuga

SEQ ID NO: 1176020 - RNA, 16 nt, Homo sapiens
gcuggcugguggaaca

SEQ ID NO: 1176021 - RNA, 22 nt, Homo sapiens
gcugggauggugggcuucaggg

SEQ ID NO: 1176022 - RNA, 13 nt, Homo sapiens
gcugggauuacag

SEQ ID NO: 1176023 - RNA, 15 nt, Homo sapiens
gcugggcugagccaa

SEQ ID NO: 1176024 - RNA, 22 nt, Homo sapiens
gcuggggaggugagagugcaga

SEQ ID NO: 1176025 - RNA, 14 nt, Homo sapiens
gcuggggcugguga

SEQ ID NO: 1176026 - RNA, 16 nt, Homo sapiens
gguccaccccauguca

SEQ ID NO: 1176027 - RNA, 22 nt, Homo sapiens
gguccagcuugcucuucagugg

SEQ ID NO: 1176028 - RNA, 16 nt, Homo sapiens
gguccauacaccagca

SEQ ID NO: 1176029 - RNA, 13 nt, Homo sapiens
gguccuacccauc

SEQ ID NO: 1176030 - RNA, 13 nt, Homo sapiens
gguccucauucuu

SEQ ID NO: 1176031 - RNA, 18 nt, Homo sapiens
ggucuagccgcugcccug

SEQ ID NO: 1176032 - RNA, 20 nt, Homo sapiens
ggucucagguccagcuuuac

SEQ ID NO: 1176033 - RNA, 16 nt, Homo sapiens
ggucucuacuguggca

SEQ ID NO: 1176034 - RNA, 12 nt, Homo sapiens
ggucugccaauc

SEQ ID NO: 1176035 - RNA, 14 nt, Homo sapiens
ggucuugagugcau

SEQ ID NO: 1176036 - RNA, 16 nt, Homo sapiens
ggucuugguuccagcc

SEQ ID NO: 1176037 - RNA, 19 nt, Homo sapiens
ggucuuuaauccacucccc

SEQ ID NO: 1176038 - RNA, 21 nt, Homo sapiens
ggucuuuuacauacagugaua

SEQ ID NO: 1176039 - RNA, 23 nt, Homo sapiens
ggugaaaguuaauccacugugac

SEQ ID NO: 1176040 - RNA, 20 nt, Homo sapiens
ggugaacaaagcagccacga

SEQ ID NO: 1176041 - RNA, 14 nt, Homo sapiens
ggugagaugcagcu

SEQ ID NO: 1176042 - RNA, 14 nt, Homo sapiens
ggugaggcaauaaa

SEQ ID NO: 1176043 - RNA, 13 nt, Homo sapiens
ggugagguugcag

SEQ ID NO: 1176044 - RNA, 14 nt, Homo sapiens
ggugauuucuugcu

SEQ ID NO: 1176045 - RNA, 13 nt, Homo sapiens
ggugcagccagag

SEQ ID NO: 1176046 - RNA, 24 nt, Homo sapiens
ggugcagccagaggcaccucaaga

SEQ ID NO: 1176047 - RNA, 17 nt, Homo sapiens
ggugcaguaucaugccc

SEQ ID NO: 1176048 - RNA, 13 nt, Homo sapiens
ggugcccacaggc

SEQ ID NO: 1176049 - RNA, 23 nt, Homo sapiens
ggugcuacacccuuuuccagcug

SEQ ID NO: 1176050 - RNA, 12 nt, Homo sapiens
ggugcugagucu

SEQ ID NO: 1176051 - RNA, 12 nt, Homo sapiens
ggugcuuuccag

SEQ ID NO: 1176052 - RNA, 18 nt, Homo sapiens
gguggagaagaucgcaug

SEQ ID NO: 1176053 - RNA, 13 nt, Homo sapiens
gguggagggccac

SEQ ID NO: 1176054 - RNA, 14 nt, Homo sapiens
gguggccugugagg

SEQ ID NO: 1176055 - RNA, 17 nt, Homo sapiens
gguggcggcagggccag

SEQ ID NO: 1176056 - RNA, 17 nt, Homo sapiens
gguggcugccucauuua

SEQ ID NO: 1176057 - RNA, 23 nt, Homo sapiens
ggugggaaaaugcacacauuucu

SEQ ID NO: 1176058 - RNA, 14 nt, Homo sapiens
ggugggggagccag

SEQ ID NO: 1176059 - RNA, 14 nt, Homo sapiens
ggugggggugggca

SEQ ID NO: 1176060 - RNA, 12 nt, Homo sapiens
gguggggugcac

SEQ ID NO: 1176061 - RNA, 13 nt, Homo sapiens
ggugggugggaug

SEQ ID NO: 1176062 - RNA, 22 nt, Homo sapiens
gguggucucuucuuggggccca

SEQ ID NO: 1176063 - RNA, 17 nt, Homo sapiens
ggugguuucuacgguga

SEQ ID NO: 1176064 - RNA, 14 nt, Homo sapiens
ggugucaccccaga

SEQ ID NO: 1176065 - RNA, 15 nt, Homo sapiens
gguguccugaagcug

SEQ ID NO: 1176066 - RNA, 17 nt, Homo sapiens
ggugugguggcacacac

SEQ ID NO: 1176067 - RNA, 13 nt, Homo sapiens
gguguuuugccau

SEQ ID NO: 1176068 - RNA, 22 nt, Homo sapiens
gguguuuuguaaaggauaucaa

SEQ ID NO: 1176069 - RNA, 15 nt, Homo sapiens
gguuaaaucaaagau

SEQ ID NO: 1176070 - RNA, 13 nt, Homo sapiens
gguuaauccagcu

SEQ ID NO: 1176071 - RNA, 18 nt, Homo sapiens
gguuaccaccagccuuuc

SEQ ID NO: 1176072 - RNA, 12 nt, Homo sapiens
gguuacuacccu

SEQ ID NO: 1176073 - RNA, 23 nt, Homo sapiens
gguuagaaccagcagaagccaga

SEQ ID NO: 1176074 - RNA, 14 nt, Homo sapiens
gguuagaagcaagg

SEQ ID NO: 1176075 - RNA, 19 nt, Homo sapiens
gguucaaaaccuugcacag

SEQ ID NO: 1176076 - RNA, 19 nt, Homo sapiens
gguucagggaacugcuugc

SEQ ID NO: 1176077 - RNA, 13 nt, Homo sapiens
gguucagugccac

SEQ ID NO: 1176078 - RNA, 14 nt, Homo sapiens
gguuccaacuguau

SEQ ID NO: 1176079 - RNA, 17 nt, Homo sapiens
gguuccuugguauucac

SEQ ID NO: 1176080 - RNA, 21 nt, Homo sapiens
gguucucauaacucugugauc

SEQ ID NO: 1176081 - RNA, 22 nt, Homo sapiens
gguucugcuacuccccagaccu

SEQ ID NO: 1176082 - RNA, 16 nt, Homo sapiens
gguuggauuugaagac

SEQ ID NO: 1176083 - RNA, 22 nt, Homo sapiens
gguugguagcagggaguaccca

SEQ ID NO: 1176084 - RNA, 16 nt, Homo sapiens
gguugguuuaaugcaa

SEQ ID NO: 1176085 - RNA, 17 nt, Homo sapiens
gguuguauaaagcaaaa

SEQ ID NO: 1176086 - RNA, 20 nt, Homo sapiens
gguugucuccaaaaggccuu

SEQ ID NO: 1176087 - RNA, 18 nt, Homo sapiens
gguuucgccauuuggcca

SEQ ID NO: 1176088 - RNA, 15 nt, Homo sapiens
gguuuucauuugcca

SEQ ID NO: 1176089 - RNA, 13 nt, Homo sapiens
gguuuuccgccca

SEQ ID NO: 1176090 - RNA, 13 nt, Homo sapiens
guaaaaacauuua

SEQ ID NO: 1176091 - RNA, 12 nt, Homo sapiens
guaaaacaugcu

SEQ ID NO: 1176092 - RNA, 18 nt, Homo sapiens
guaaaacaugcuggugaa

SEQ ID NO: 1176093 - RNA, 13 nt, Homo sapiens
guaaaauguucuc

SEQ ID NO: 1176094 - RNA, 16 nt, Homo sapiens
guaaaggcaagccagc

SEQ ID NO: 1176095 - RNA, 17 nt, Homo sapiens
guaaagggcgcaaaggg

SEQ ID NO: 1176096 - RNA, 15 nt, Homo sapiens
guaaaguagcuguaa

SEQ ID NO: 1176097 - RNA, 12 nt, Homo sapiens
guaaauacaugu

SEQ ID NO: 1176098 - RNA, 21 nt, Homo sapiens
guaaaucauguugaucaugua

SEQ ID NO: 1176099 - RNA, 13 nt, Homo sapiens
guaaaugccacac

SEQ ID NO: 1176100 - RNA, 20 nt, Homo sapiens
guaaaugccacacaccuuua

SEQ ID NO: 1176101 - RNA, 16 nt, Homo sapiens
guaaauguacugguaa

SEQ ID NO: 1176102 - RNA, 18 nt, Homo sapiens
guaacacuaaaacuuucu

SEQ ID NO: 1176103 - RNA, 14 nt, Homo sapiens
guaacagcuaugca

SEQ ID NO: 1176104 - RNA, 15 nt, Homo sapiens
guaacaucagccauu

SEQ ID NO: 1176105 - RNA, 15 nt, Homo sapiens
guaacuaaaggaauc

SEQ ID NO: 1176106 - RNA, 23 nt, Homo sapiens
guaacuauaccucugguucccau

SEQ ID NO: 1176107 - RNA, 11 nt, Homo sapiens
guaacuugaaa

SEQ ID NO: 1176108 - RNA, 16 nt, Homo sapiens
guaagaaacacacuga

SEQ ID NO: 1176109 - RNA, 12 nt, Homo sapiens
guaagaaaguga

SEQ ID NO: 1176110 - RNA, 18 nt, Homo sapiens
guaagaaagugaagcaaa

SEQ ID NO: 1176111 - RNA, 20 nt, Homo sapiens
guaagaguguucaacuguga

SEQ ID NO: 1176112 - RNA, 14 nt, Homo sapiens
guaagcaacuugcu

SEQ ID NO: 1176113 - RNA, 19 nt, Homo sapiens
guaagcagaguucuuugca

SEQ ID NO: 1176114 - RNA, 18 nt, Homo sapiens
guaaguuuaccuauguaa

SEQ ID NO: 1176115 - RNA, 22 nt, Homo sapiens
guaauaauaaaucguccuccca

SEQ ID NO: 1176116 - RNA, 15 nt, Homo sapiens
guaauacaucaaaga

SEQ ID NO: 1176117 - RNA, 13 nt, Homo sapiens
guaauauucucug

SEQ ID NO: 1176118 - RNA, 17 nt, Homo sapiens
guaaucccagcuacuca

SEQ ID NO: 1176119 - RNA, 20 nt, Homo sapiens
guaaucccagcuacuuggga

SEQ ID NO: 1176120 - RNA, 15 nt, Homo sapiens
guaauccucaagaaa

SEQ ID NO: 1176121 - RNA, 18 nt, Homo sapiens
guaaucuuuuucuccacc

SEQ ID NO: 1176122 - RNA, 20 nt, Homo sapiens
guaauguuuuauacuguuua

SEQ ID NO: 1176123 - RNA, 14 nt, Homo sapiens
guaauuaaggaaua

SEQ ID NO: 1176124 - RNA, 22 nt, Homo sapiens
guaauuucuuugccuguucagu

SEQ ID NO: 1176125 - RNA, 12 nt, Homo sapiens
guaauuugccac

SEQ ID NO: 1176126 - RNA, 19 nt, Homo sapiens
guacaaaaauuaugcaauu

SEQ ID NO: 1176127 - RNA, 13 nt, Homo sapiens
guacaacacuggu

SEQ ID NO: 1176128 - RNA, 22 nt, Homo sapiens
guacaagguauguacaguucau

SEQ ID NO: 1176129 - RNA, 18 nt, Homo sapiens
guacaaguaaagcccaga

SEQ ID NO: 1176130 - RNA, 24 nt, Homo sapiens
guacaauaaaaacauugccuuuga

SEQ ID NO: 1176131 - RNA, 17 nt, Homo sapiens
guacaccacaaggguca

SEQ ID NO: 1176132 - RNA, 18 nt, Homo sapiens
guacaccacaagggucac

SEQ ID NO: 1176133 - RNA, 15 nt, Homo sapiens
guacacugugucucu

SEQ ID NO: 1176134 - RNA, 16 nt, Homo sapiens
guacagaguaaccuau

SEQ ID NO: 1176135 - RNA, 12 nt, Homo sapiens
guacaguauauu

SEQ ID NO: 1176136 - RNA, 16 nt, Homo sapiens
guacauaguaaaguau

SEQ ID NO: 1176137 - RNA, 17 nt, Homo sapiens
guacaucccauguaaca

SEQ ID NO: 1176138 - RNA, 20 nt, Homo sapiens
guacauugggcacauaucuc

SEQ ID NO: 1176139 - RNA, 13 nt, Homo sapiens
guaccaagcauuu

SEQ ID NO: 1176140 - RNA, 18 nt, Homo sapiens
guacccaauagcugccca

SEQ ID NO: 1176141 - RNA, 20 nt, Homo sapiens
guaccugcuggcacuaucca

SEQ ID NO: 1176142 - RNA, 13 nt, Homo sapiens
guaccugugcacg

SEQ ID NO: 1176143 - RNA, 12 nt, Homo sapiens
guaccuucccac

SEQ ID NO: 1176144 - RNA, 16 nt, Homo sapiens
guaccuuguuuugcca

SEQ ID NO: 1176145 - RNA, 17 nt, Homo sapiens
guacgcacagacagguu

SEQ ID NO: 1176146 - RNA, 12 nt, Homo sapiens
guacucaaugga

SEQ ID NO: 1176147 - RNA, 17 nt, Homo sapiens
guacucacuuuucacuu

SEQ ID NO: 1176148 - RNA, 22 nt, Homo sapiens
guacugaaauaaugaucuugga

SEQ ID NO: 1176149 - RNA, 14 nt, Homo sapiens
guacuguacuauau

SEQ ID NO: 1176150 - RNA, 11 nt, Homo sapiens
guacuguuacu

SEQ ID NO: 1176151 - RNA, 18 nt, Homo sapiens
guacuuuuagucugucau

SEQ ID NO: 1176152 - RNA, 23 nt, Homo sapiens
guagaaaaagcaguaacugacaa

SEQ ID NO: 1176153 - RNA, 13 nt, Homo sapiens
guagaacuuggau

SEQ ID NO: 1176154 - RNA, 16 nt, Homo sapiens
guagaauaaaugaaga

SEQ ID NO: 1176155 - RNA, 16 nt, Homo sapiens
guagaaugaaccacug

SEQ ID NO: 1176156 - RNA, 17 nt, Homo sapiens
guagacugaaaagccau

SEQ ID NO: 1176157 - RNA, 13 nt, Homo sapiens
guagaguggugcu

SEQ ID NO: 1176158 - RNA, 14 nt, Homo sapiens
guagauaccagcuu

SEQ ID NO: 1176159 - RNA, 22 nt, Homo sapiens
guagaucugcuuucuguucauc

SEQ ID NO: 1176160 - RNA, 16 nt, Homo sapiens
uaaauaugaagcucac

SEQ ID NO: 1176161 - RNA, 22 nt, Homo sapiens
uaaauauuuauuuaacuauuca

SEQ ID NO: 1176162 - RNA, 18 nt, Homo sapiens
uaaauauuuuucacauaa

SEQ ID NO: 1176163 - RNA, 14 nt, Homo sapiens
uaaaucacaggcau

SEQ ID NO: 1176164 - RNA, 23 nt, Homo sapiens
uaaaucaguuuauuaaaucugaa

SEQ ID NO: 1176165 - RNA, 23 nt, Homo sapiens
uaaaucauguugaucauguacuu

SEQ ID NO: 1176166 - RNA, 21 nt, Homo sapiens
uaaauccuuguuaccuaucuc

SEQ ID NO: 1176167 - RNA, 19 nt, Homo sapiens
uaaaucugcagcacauuga

SEQ ID NO: 1176168 - RNA, 20 nt, Homo sapiens
uaaaucugcgaucaucguca

SEQ ID NO: 1176169 - RNA, 13 nt, Homo sapiens
uaaaugacaagca

SEQ ID NO: 1176170 - RNA, 17 nt, Homo sapiens
uaaaugcacagucaugu

SEQ ID NO: 1176171 - RNA, 14 nt, Homo sapiens
uaaaugcuauuaua

SEQ ID NO: 1176172 - RNA, 18 nt, Homo sapiens
uaaauggcauaccaaaau

SEQ ID NO: 1176173 - RNA, 14 nt, Homo sapiens
uaaauggcaugaca

SEQ ID NO: 1176174 - RNA, 20 nt, Homo sapiens
uaaaugggucaugacaagau

SEQ ID NO: 1176175 - RNA, 22 nt, Homo sapiens
uaaaugguaguaaucacaguug

SEQ ID NO: 1176176 - RNA, 17 nt, Homo sapiens
uaaauguaacagucuga

SEQ ID NO: 1176177 - RNA, 15 nt, Homo sapiens
uaaauguauguauuu

SEQ ID NO: 1176178 - RNA, 20 nt, Homo sapiens
uaaauguccauccugugcca

SEQ ID NO: 1176179 - RNA, 19 nt, Homo sapiens
uaaauguccugaauccagc

SEQ ID NO: 1176180 - RNA, 13 nt, Homo sapiens
uaaauuaccuugc

SEQ ID NO: 1176181 - RNA, 17 nt, Homo sapiens
uaaauuacguagguuua

SEQ ID NO: 1176182 - RNA, 15 nt, Homo sapiens
uaaauuaugacugcu

SEQ ID NO: 1176183 - RNA, 22 nt, Homo sapiens
uaaauucagucuuuucucugaa

SEQ ID NO: 1176184 - RNA, 18 nt, Homo sapiens
uaaauucccuggggaaaa

SEQ ID NO: 1176185 - RNA, 20 nt, Homo sapiens
uaaauugauagcagauauca

SEQ ID NO: 1176186 - RNA, 15 nt, Homo sapiens
uaaauuggagaugca

SEQ ID NO: 1176187 - RNA, 22 nt, Homo sapiens
uaaauugguauuaacuaugauc

SEQ ID NO: 1176188 - RNA, 14 nt, Homo sapiens
uaaauuuagugcac

SEQ ID NO: 1176189 - RNA, 22 nt, Homo sapiens
uaaauuuccccaacagugugaa

SEQ ID NO: 1176190 - RNA, 23 nt, Homo sapiens
uaaauuuuuuugcaauccuuucc

SEQ ID NO: 1176191 - RNA, 21 nt, Homo sapiens
uaacaaagcccuuauucucuu

SEQ ID NO: 1176192 - RNA, 14 nt, Homo sapiens
uaacacacuuuaua

SEQ ID NO: 1176193 - RNA, 21 nt, Homo sapiens
uaacacauuuuuuaacuaaua

SEQ ID NO: 1176194 - RNA, 14 nt, Homo sapiens
uaacacggugcuca

SEQ ID NO: 1176195 - RNA, 16 nt, Homo sapiens
uaacacggugcucauu

SEQ ID NO: 1176196 - RNA, 15 nt, Homo sapiens
uaacagccaccugga

SEQ ID NO: 1176197 - RNA, 19 nt, Homo sapiens
uaacauccggcaaaacuga

SEQ ID NO: 1176198 - RNA, 17 nt, Homo sapiens
uaacaugauaaaagaca

SEQ ID NO: 1176199 - RNA, 19 nt, Homo sapiens
uaaccacagggcugggcua

SEQ ID NO: 1176200 - RNA, 23 nt, Homo sapiens
uaaccauaguuauuuacuugaaa

SEQ ID NO: 1176201 - RNA, 16 nt, Homo sapiens
uaaccauguaucuaau

SEQ ID NO: 1176202 - RNA, 23 nt, Homo sapiens
uaacccaugaaggauaaaagccc

SEQ ID NO: 1176203 - RNA, 14 nt, Homo sapiens
uaaccccaccacac

SEQ ID NO: 1176204 - RNA, 21 nt, Homo sapiens
uaaccuaguuuguuacuuuaa

SEQ ID NO: 1176205 - RNA, 21 nt, Homo sapiens
uaaccucaagugauccuccca

SEQ ID NO: 1176206 - RNA, 15 nt, Homo sapiens
uaaccuugugccuug

SEQ ID NO: 1176207 - RNA, 21 nt, Homo sapiens
uaacuagguugacagauacuu

SEQ ID NO: 1176208 - RNA, 11 nt, Homo sapiens
uaacuauucau

SEQ ID NO: 1176209 - RNA, 17 nt, Homo sapiens
uaacuauugaguuacag

SEQ ID NO: 1176210 - RNA, 23 nt, Homo sapiens
uaacucagaaacaucaguuacuc

SEQ ID NO: 1176211 - RNA, 22 nt, Homo sapiens
uaacucaggaagccucuggguu

SEQ ID NO: 1176212 - RNA, 22 nt, Homo sapiens
uaacucagugaaggcccaugaa

SEQ ID NO: 1176213 - RNA, 22 nt, Homo sapiens
uaacucaucuuuagagcaacag

SEQ ID NO: 1176214 - RNA, 16 nt, Homo sapiens
uaacuccagugaagua

SEQ ID NO: 1176215 - RNA, 21 nt, Homo sapiens
uaacucccuccucacacucca

SEQ ID NO: 1176216 - RNA, 19 nt, Homo sapiens
uaacucguugcagucugua

SEQ ID NO: 1176217 - RNA, 17 nt, Homo sapiens
uaacucuguaaaagugu

SEQ ID NO: 1176218 - RNA, 19 nt, Homo sapiens
uaacucuguaaaagugucu

SEQ ID NO: 1176219 - RNA, 22 nt, Homo sapiens
uaacucuguaaaagugucugua

SEQ ID NO: 1176220 - RNA, 14 nt, Homo sapiens
uaacugacaaacca

SEQ ID NO: 1176221 - RNA, 15 nt, Homo sapiens
uaacugauuugcaau

SEQ ID NO: 1176222 - RNA, 18 nt, Homo sapiens
uaacugcccucugaaaua

SEQ ID NO: 1176223 - RNA, 14 nt, Homo sapiens
uaacuuacuuccaa

SEQ ID NO: 1176224 - RNA, 21 nt, Homo sapiens
uaacuuccauuuuauuacuaa

SEQ ID NO: 1176225 - RNA, 16 nt, Homo sapiens
uaacuucuaauggcca

SEQ ID NO: 1176226 - RNA, 17 nt, Homo sapiens
uaacuugaaccuaugaa

SEQ ID NO: 1176227 - RNA, 11 nt, Homo sapiens
uaacuuugaac

SEQ ID NO: 1176228 - RNA, 16 nt, Homo sapiens
uaacuuugaaccauaa

SEQ ID NO: 1176229 - RNA, 15 nt, Homo sapiens
uaacuuuuugcacua

SEQ ID NO: 1176230 - RNA, 16 nt, Homo sapiens
uaagaaagaucaaaga

SEQ ID NO: 1176231 - RNA, 14 nt, Homo sapiens
uaagaaagcacuua

SEQ ID NO: 1176232 - RNA, 20 nt, Homo sapiens
uaagaaauauauuugauaaa

SEQ ID NO: 1176233 - RNA, 23 nt, Homo sapiens
uaagaaccacucauaauucuuca

SEQ ID NO: 1176234 - RNA, 21 nt, Homo sapiens
uaagaaccuuauuuugauaaa

SEQ ID NO: 1176235 - RNA, 23 nt, Homo sapiens
uaagaacuuugagcuacugccgu

SEQ ID NO: 1176236 - RNA, 17 nt, Homo sapiens
uaagaagaggagccuca

SEQ ID NO: 1176237 - RNA, 20 nt, Homo sapiens
uaagaagaggagccucagaa

SEQ ID NO: 1176238 - RNA, 16 nt, Homo sapiens
uaagaagucugauggu

SEQ ID NO: 1176239 - RNA, 20 nt, Homo sapiens
uaagaaguuccagcauguug

SEQ ID NO: 1176240 - RNA, 14 nt, Homo sapiens
uaagaauagaaaua

SEQ ID NO: 1176241 - RNA, 14 nt, Homo sapiens
uaagaauuucacaa

SEQ ID NO: 1176242 - RNA, 23 nt, Homo sapiens
uaagacaaacuccugaaaugcca

SEQ ID NO: 1176243 - RNA, 14 nt, Homo sapiens
uaagacaccaaaua

SEQ ID NO: 1176244 - RNA, 18 nt, Homo sapiens
uaagacaugauuuccuug

SEQ ID NO: 1176245 - RNA, 23 nt, Homo sapiens
uaagaccaagcugugcccugacc

SEQ ID NO: 1176246 - RNA, 18 nt, Homo sapiens
uaagagaacaaagaguga

SEQ ID NO: 1176247 - RNA, 14 nt, Homo sapiens
uaagagcaauguuu

SEQ ID NO: 1176248 - RNA, 16 nt, Homo sapiens
uaagaguaugugccag

SEQ ID NO: 1176249 - RNA, 15 nt, Homo sapiens
uaagagucugugcug

SEQ ID NO: 1176250 - RNA, 16 nt, Homo sapiens
uaagagucugugcugg

SEQ ID NO: 1176251 - RNA, 19 nt, Homo sapiens
uaagaguguucaacuguga

SEQ ID NO: 1176252 - RNA, 20 nt, Homo sapiens
uaagaguguucaacugugag

SEQ ID NO: 1176253 - RNA, 21 nt, Homo sapiens
uaagauaucccuaaggaauuu

SEQ ID NO: 1176254 - RNA, 19 nt, Homo sapiens
uaagaucauuuaauaucuu

SEQ ID NO: 1176255 - RNA, 14 nt, Homo sapiens
uaagaucucagugg

SEQ ID NO: 1176256 - RNA, 19 nt, Homo sapiens
uaagaucuuagauucucug

SEQ ID NO: 1176257 - RNA, 21 nt, Homo sapiens
uaagaugguuuccgugagcua

SEQ ID NO: 1176258 - RNA, 22 nt, Homo sapiens
uaagauguguagaccuugaugg

SEQ ID NO: 1176259 - RNA, 15 nt, Homo sapiens
uaagauguguuccuu

SEQ ID NO: 1176260 - RNA, 23 nt, Homo sapiens
uaagauucaguuuucccacuuuu

SEQ ID NO: 1176261 - RNA, 10 nt, Homo sapiens
uaagauuuau

SEQ ID NO: 1176262 - RNA, 11 nt, Homo sapiens
uaagauuuauu

SEQ ID NO: 1176263 - RNA, 18 nt, Homo sapiens
uaagcaacuugcuucuaa

SEQ ID NO: 1176264 - RNA, 22 nt, Homo sapiens
uaagcacucaauaaaucuuuga

SEQ ID NO: 1176265 - RNA, 14 nt, Homo sapiens
uaagcauacuuugu

SEQ ID NO: 1176266 - RNA, 19 nt, Homo sapiens
uaagccaguuuuacacuaa

SEQ ID NO: 1176267 - RNA, 17 nt, Homo sapiens
uaagcccccacuacaag

SEQ ID NO: 1176268 - RNA, 20 nt, Homo sapiens
uaagcccccucaacuaccau

SEQ ID NO: 1176269 - RNA, 14 nt, Homo sapiens
uaagccgcagagac

SEQ ID NO: 1176270 - RNA, 18 nt, Homo sapiens
uaagcgauucucuugccu

SEQ ID NO: 1176271 - RNA, 14 nt, Homo sapiens
uaagcuuuucauua

SEQ ID NO: 1176272 - RNA, 20 nt, Homo sapiens
uaaggaaguaucagcacuag

SEQ ID NO: 1176273 - RNA, 16 nt, Homo sapiens
uaaggacaaagugcca

SEQ ID NO: 1176274 - RNA, 17 nt, Homo sapiens
uaaggacaaagugccaa

SEQ ID NO: 1176275 - RNA, 21 nt, Homo sapiens
uaaggacaaagugccaaagaa

SEQ ID NO: 1176276 - RNA, 23 nt, Homo sapiens
uaagggaaaccuugagugguggu

SEQ ID NO: 1176277 - RNA, 18 nt, Homo sapiens
uaagggauuucuuagggg

SEQ ID NO: 1176278 - RNA, 17 nt, Homo sapiens
uaaggggugaaucuccu

SEQ ID NO: 1176279 - RNA, 18 nt, Homo sapiens
uaagguaaaaugccauga

SEQ ID NO: 1176280 - RNA, 21 nt, Homo sapiens
uaagguauaguguguguugca

SEQ ID NO: 1176281 - RNA, 12 nt, Homo sapiens
uaagguucaaga

SEQ ID NO: 1176282 - RNA, 17 nt, Homo sapiens
uaagguucuaaggccua

SEQ ID NO: 1176283 - RNA, 18 nt, Homo sapiens
uaaguaagugucugugau

SEQ ID NO: 1176284 - RNA, 16 nt, Homo sapiens
uaaguauuuugaucac

SEQ ID NO: 1176285 - RNA, 17 nt, Homo sapiens
uaaguauuuugaucacu

SEQ ID NO: 1176286 - RNA, 23 nt, Homo sapiens
uaagucauuuguaugaauaugug

SEQ ID NO: 1176287 - RNA, 11 nt, Homo sapiens
uaagucucaac

SEQ ID NO: 1176288 - RNA, 19 nt, Homo sapiens
uaagucuguccauuaucua

SEQ ID NO: 1176289 - RNA, 15 nt, Homo sapiens
uaagugauacauacc

SEQ ID NO: 1176290 - RNA, 20 nt, Homo sapiens
uaaguggcuugucugcaguc

SEQ ID NO: 1176291 - RNA, 22 nt, Homo sapiens
ucuacccacccccaucaccuac

SEQ ID NO: 1176292 - RNA, 22 nt, Homo sapiens
ucuaccugaccaacaguuccuu

SEQ ID NO: 1176293 - RNA, 15 nt, Homo sapiens
ucuaccugagcauuc

SEQ ID NO: 1176294 - RNA, 22 nt, Homo sapiens
ucuacgcucuccuuucuuucua

SEQ ID NO: 1176295 - RNA, 18 nt, Homo sapiens
ucuacguaucugcuacuu

SEQ ID NO: 1176296 - RNA, 16 nt, Homo sapiens
ucuacgugauuuggcu

SEQ ID NO: 1176297 - RNA, 21 nt, Homo sapiens
ucuacuaacaaucagcuccuu

SEQ ID NO: 1176298 - RNA, 15 nt, Homo sapiens
ucuacuaauuccaca

SEQ ID NO: 1176299 - RNA, 20 nt, Homo sapiens
ucuacuacaaacuucaaaga

SEQ ID NO: 1176300 - RNA, 18 nt, Homo sapiens
ucuacuccaugguucuca

SEQ ID NO: 1176301 - RNA, 16 nt, Homo sapiens
ucuacucuuaagccau

SEQ ID NO: 1176302 - RNA, 15 nt, Homo sapiens
ucuacuuuaucaauu

SEQ ID NO: 1176303 - RNA, 15 nt, Homo sapiens
ucuagaauccugcuu

SEQ ID NO: 1176304 - RNA, 20 nt, Homo sapiens
ucuagacauggagguucuaa

SEQ ID NO: 1176305 - RNA, 16 nt, Homo sapiens
ucuagagcacugccac

SEQ ID NO: 1176306 - RNA, 18 nt, Homo sapiens
ucuagagucuagacagac

SEQ ID NO: 1176307 - RNA, 15 nt, Homo sapiens
ucuagccuggggcuu

SEQ ID NO: 1176308 - RNA, 21 nt, Homo sapiens
ucuagccuggggcuugaauuu

SEQ ID NO: 1176309 - RNA, 14 nt, Homo sapiens
ucuaggcucugccu

SEQ ID NO: 1176310 - RNA, 16 nt, Homo sapiens
ucuaggguauucugua

SEQ ID NO: 1176311 - RNA, 15 nt, Homo sapiens
ucuagugaccuuaaa

SEQ ID NO: 1176312 - RNA, 16 nt, Homo sapiens
ucuaguugcaguauug

SEQ ID NO: 1176313 - RNA, 19 nt, Homo sapiens
ucuauaaauagaugcugug

SEQ ID NO: 1176314 - RNA, 17 nt, Homo sapiens
ucuauaagaaaaaggaa

SEQ ID NO: 1176315 - RNA, 22 nt, Homo sapiens
ucuauaaugugccuggcucuga

SEQ ID NO: 1176316 - RNA, 20 nt, Homo sapiens
ucuauacaaauuuucagaag

SEQ ID NO: 1176317 - RNA, 14 nt, Homo sapiens
ucuauacuguugau

SEQ ID NO: 1176318 - RNA, 18 nt, Homo sapiens
ucuauauguacuugucaa

SEQ ID NO: 1176319 - RNA, 16 nt, Homo sapiens
ucuaucaaaugugaug

SEQ ID NO: 1176320 - RNA, 16 nt, Homo sapiens
ucuaucauuaaaguuc

SEQ ID NO: 1176321 - RNA, 18 nt, Homo sapiens
ucuaucauuaaaguucua

SEQ ID NO: 1176322 - RNA, 22 nt, Homo sapiens
ucuaucauuaaaguucuaguga

SEQ ID NO: 1176323 - RNA, 18 nt, Homo sapiens
ucuaucccuuaccugcuu

SEQ ID NO: 1176324 - RNA, 18 nt, Homo sapiens
ucuaucggagaacaugaa

SEQ ID NO: 1176325 - RNA, 19 nt, Homo sapiens
ucuaucggggucacuugca

SEQ ID NO: 1176326 - RNA, 14 nt, Homo sapiens
ucuauguauauucu

SEQ ID NO: 1176327 - RNA, 19 nt, Homo sapiens
ucuauguuuacaaauggac

SEQ ID NO: 1176328 - RNA, 22 nt, Homo sapiens
ucuauuguauauauaaucuaua

SEQ ID NO: 1176329 - RNA, 13 nt, Homo sapiens
ucuauuugugcuu

SEQ ID NO: 1176330 - RNA, 21 nt, Homo sapiens
ucuauuuuaagacugauuuua

SEQ ID NO: 1176331 - RNA, 16 nt, Homo sapiens
ucucaaacuacuggca

SEQ ID NO: 1176332 - RNA, 20 nt, Homo sapiens
ucucaaacuccugaccucag

SEQ ID NO: 1176333 - RNA, 13 nt, Homo sapiens
ucucaacuaccuc

SEQ ID NO: 1176334 - RNA, 23 nt, Homo sapiens
ucucaacugcucuuuuauacugu

SEQ ID NO: 1176335 - RNA, 22 nt, Homo sapiens
ucucaacuuugauacuuacuca

SEQ ID NO: 1176336 - RNA, 12 nt, Homo sapiens
ucucaauacagc

SEQ ID NO: 1176337 - RNA, 15 nt, Homo sapiens
ucucaccacuucagu

SEQ ID NO: 1176338 - RNA, 15 nt, Homo sapiens
ucucacuauaccagu

SEQ ID NO: 1176339 - RNA, 18 nt, Homo sapiens
ucucacucuguugcccag

SEQ ID NO: 1176340 - RNA, 20 nt, Homo sapiens
ucucagaccggcaacaucag

SEQ ID NO: 1176341 - RNA, 9 nt, Homo sapiens
ucucagcug

SEQ ID NO: 1176342 - RNA, 19 nt, Homo sapiens
ucucaggaccaaagcuuuc

SEQ ID NO: 1176343 - RNA, 15 nt, Homo sapiens
ucucaggcuguccca

SEQ ID NO: 1176344 - RNA, 21 nt, Homo sapiens
ucucagguagaagguugacac

SEQ ID NO: 1176345 - RNA, 17 nt, Homo sapiens
ucucagguccagcuuua

SEQ ID NO: 1176346 - RNA, 17 nt, Homo sapiens
ucucaguacagcacucc

SEQ ID NO: 1176347 - RNA, 23 nt, Homo sapiens
ucucaguugauuuucuggauucc

SEQ ID NO: 1176348 - RNA, 23 nt, Homo sapiens
ucucauagaacugccuggauucc

SEQ ID NO: 1176349 - RNA, 13 nt, Homo sapiens
ucucauccaucau

SEQ ID NO: 1176350 - RNA, 18 nt, Homo sapiens
ucucaugggaaggggagg

SEQ ID NO: 1176351 - RNA, 23 nt, Homo sapiens
ucucauugucuguguagaguguu

SEQ ID NO: 1176352 - RNA, 17 nt, Homo sapiens
ucuccaaggaugggaau

SEQ ID NO: 1176353 - RNA, 13 nt, Homo sapiens
ucuccaauacuca

SEQ ID NO: 1176354 - RNA, 18 nt, Homo sapiens
ucuccacucaugugacuc

SEQ ID NO: 1176355 - RNA, 11 nt, Homo sapiens
ucuccacuggg

SEQ ID NO: 1176356 - RNA, 12 nt, Homo sapiens
ucuccagaugag

SEQ ID NO: 1176357 - RNA, 23 nt, Homo sapiens
ucuccagaugagaguacacccca

SEQ ID NO: 1176358 - RNA, 14 nt, Homo sapiens
ucuccauacuuugg

SEQ ID NO: 1176359 - RNA, 20 nt, Homo sapiens
ucuccaucacaaccagauuu

SEQ ID NO: 1176360 - RNA, 15 nt, Homo sapiens
ucuccauggcaucuu

SEQ ID NO: 1176361 - RNA, 18 nt, Homo sapiens
ucucccacagggugcugg

SEQ ID NO: 1176362 - RNA, 15 nt, Homo sapiens
ucuccccggggcccg

SEQ ID NO: 1176363 - RNA, 18 nt, Homo sapiens
ucuccccucagagugcaa

SEQ ID NO: 1176364 - RNA, 17 nt, Homo sapiens
ucucccgggaagccacc

SEQ ID NO: 1176365 - RNA, 16 nt, Homo sapiens
ucucccguccauucca

SEQ ID NO: 1176366 - RNA, 19 nt, Homo sapiens
ucucccucuaggcucugcc

SEQ ID NO: 1176367 - RNA, 15 nt, Homo sapiens
ucucccugcuucaua

SEQ ID NO: 1176368 - RNA, 17 nt, Homo sapiens
ucucccuuccaccucac

SEQ ID NO: 1176369 - RNA, 19 nt, Homo sapiens
ucucccuuugaagaaacua

SEQ ID NO: 1176370 - RNA, 21 nt, Homo sapiens
ucucccuuugaagaaacuaua

SEQ ID NO: 1176371 - RNA, 15 nt, Homo sapiens
ucuccgcacuuggaa

SEQ ID NO: 1176372 - RNA, 12 nt, Homo sapiens
ucuccuccgugg

SEQ ID NO: 1176373 - RNA, 13 nt, Homo sapiens
ucuccugcaaaag

SEQ ID NO: 1176374 - RNA, 15 nt, Homo sapiens
ucuccugccucagcc

SEQ ID NO: 1176375 - RNA, 13 nt, Homo sapiens
ucuccugcuugua

SEQ ID NO: 1176376 - RNA, 16 nt, Homo sapiens
ucuccugggccacccc

SEQ ID NO: 1176377 - RNA, 22 nt, Homo sapiens
ucuccuuauccccccaaaugga

SEQ ID NO: 1176378 - RNA, 23 nt, Homo sapiens
ucuccuuccucuuggcugagaua

SEQ ID NO: 1176379 - RNA, 14 nt, Homo sapiens
ucucgaacuccuga

SEQ ID NO: 1176380 - RNA, 17 nt, Homo sapiens
ucucgaaugcugagaag

SEQ ID NO: 1176381 - RNA, 12 nt, Homo sapiens
ucucgagugagu

SEQ ID NO: 1176382 - RNA, 17 nt, Homo sapiens
ucucgggugggggagcc

SEQ ID NO: 1176383 - RNA, 14 nt, Homo sapiens
ucucgguuugccaa

SEQ ID NO: 1176384 - RNA, 16 nt, Homo sapiens
ucucgucaggcugcca

SEQ ID NO: 1176385 - RNA, 14 nt, Homo sapiens
ucucuaacagggca

SEQ ID NO: 1176386 - RNA, 20 nt, Homo sapiens
ucucuagaagcugucugcgu

SEQ ID NO: 1176387 - RNA, 12 nt, Homo sapiens
ucucuaucauua

SEQ ID NO: 1176388 - RNA, 17 nt, Homo sapiens
ucucucacugacuauua

SEQ ID NO: 1176389 - RNA, 17 nt, Homo sapiens
ucucucacuguugcagu

SEQ ID NO: 1176390 - RNA, 17 nt, Homo sapiens
ucucuccaaaaaugcac

SEQ ID NO: 1176391 - RNA, 17 nt, Homo sapiens
ucucuccagccucacag

SEQ ID NO: 1176392 - RNA, 18 nt, Homo sapiens
ucucuccagcuguacugu

SEQ ID NO: 1176393 - RNA, 14 nt, Homo sapiens
ucucucccugcuuu

SEQ ID NO: 1176394 - RNA, 14 nt, Homo sapiens
ucucugagcuuugu

SEQ ID NO: 1176395 - RNA, 19 nt, Homo sapiens
ucucugaguacauugugcc

SEQ ID NO: 1176396 - RNA, 21 nt, Homo sapiens
ucucugauaaaacugguuuua

SEQ ID NO: 1176397 - RNA, 22 nt, Homo sapiens
ucucugcagggccgccagggag

SEQ ID NO: 1176398 - RNA, 20 nt, Homo sapiens
ucucuggaacccaggaccuc

SEQ ID NO: 1176399 - RNA, 15 nt, Homo sapiens
ucucuggaguauucu

SEQ ID NO: 1176400 - RNA, 21 nt, Homo sapiens
ucucuggguuggcuguggcau

SEQ ID NO: 1176401 - RNA, 14 nt, Homo sapiens
ucucuguaaccaga

SEQ ID NO: 1176402 - RNA, 22 nt, Homo sapiens
ucucugucccuugcuguaugcu

SEQ ID NO: 1176403 - RNA, 10 nt, Homo sapiens
ucucuguccu

SEQ ID NO: 1176404 - RNA, 21 nt, Homo sapiens
ucucuuaaaccacagcacuau

SEQ ID NO: 1176405 - RNA, 22 nt, Homo sapiens
ucucuuaaacucucuucuucca

SEQ ID NO: 1176406 - RNA, 18 nt, Homo sapiens
ucucuucagacucaugga

SEQ ID NO: 1176407 - RNA, 15 nt, Homo sapiens
ucucuuuaauggaau

SEQ ID NO: 1176408 - RNA, 17 nt, Homo sapiens
ucucuuuacagcuuugu

SEQ ID NO: 1176409 - RNA, 21 nt, Homo sapiens
ucucuuuauauggccucaaga

SEQ ID NO: 1176410 - RNA, 15 nt, Homo sapiens
ucugaaaacaaugcu

SEQ ID NO: 1176411 - RNA, 20 nt, Homo sapiens
ucugaaaagaacaacccuga

SEQ ID NO: 1176412 - RNA, 18 nt, Homo sapiens
ucugaaccccucccucca

SEQ ID NO: 1176413 - RNA, 17 nt, Homo sapiens
ucugaagccucacuuau

SEQ ID NO: 1176414 - RNA, 13 nt, Homo sapiens
ucugaauugacug

SEQ ID NO: 1176415 - RNA, 17 nt, Homo sapiens
ucugaauuuuaaaacau

SEQ ID NO: 1176416 - RNA, 13 nt, Homo sapiens
ucugaccagcagc

SEQ ID NO: 1176417 - RNA, 12 nt, Homo sapiens
ucugacccagug

SEQ ID NO: 1176418 - RNA, 17 nt, Homo sapiens
ucugacucagggcuccu

SEQ ID NO: 1176419 - RNA, 23 nt, Homo sapiens
ucugacuuuacacucggcuuugg

SEQ ID NO: 1176420 - RNA, 14 nt, Homo sapiens
ucugagaccaaagu

SEQ ID NO: 1176421 - RNA, 17 nt, Homo sapiens
ucugagagccaggguuu

SEQ ID NO: 1176422 - RNA, 21 nt, Homo sapiens
ucugagcacagcugcauuaaa

SEQ ID NO: 1176423 - RNA, 23 nt, Homo sapiens
ucugagcagugaaugauucagug

SEQ ID NO: 1176424 - RNA, 19 nt, Homo sapiens
ugaucucggcucacugcaa

SEQ ID NO: 1176425 - RNA, 23 nt, Homo sapiens
ugaucucuucuuuuggcuuccau

SEQ ID NO: 1176426 - RNA, 22 nt, Homo sapiens
ugaucuucagggaacugcauag

SEQ ID NO: 1176427 - RNA, 14 nt, Homo sapiens
ugaucuucagggcu

SEQ ID NO: 1176428 - RNA, 14 nt, Homo sapiens
ugaucuuggaccau

SEQ ID NO: 1176429 - RNA, 19 nt, Homo sapiens
ugaucuuuuaggccaagga

SEQ ID NO: 1176430 - RNA, 13 nt, Homo sapiens
ugaugaacugaga

SEQ ID NO: 1176431 - RNA, 19 nt, Homo sapiens
ugaugacagacacuucuaa

SEQ ID NO: 1176432 - RNA, 16 nt, Homo sapiens
ugaugagauucacuua

SEQ ID NO: 1176433 - RNA, 12 nt, Homo sapiens
ugaugagcuuag

SEQ ID NO: 1176434 - RNA, 13 nt, Homo sapiens
ugaugccauguaa

SEQ ID NO: 1176435 - RNA, 13 nt, Homo sapiens
ugaugcuaugguu

SEQ ID NO: 1176436 - RNA, 17 nt, Homo sapiens
ugauggcaacagaucug

SEQ ID NO: 1176437 - RNA, 15 nt, Homo sapiens
ugauggucauaucca

SEQ ID NO: 1176438 - RNA, 16 nt, Homo sapiens
ugauggugcaugccug

SEQ ID NO: 1176439 - RNA, 15 nt, Homo sapiens
ugauguuuccuggaa

SEQ ID NO: 1176440 - RNA, 23 nt, Homo sapiens
ugauuacccagagauaucuauga

SEQ ID NO: 1176441 - RNA, 12 nt, Homo sapiens
ugauuagacuuu

SEQ ID NO: 1176442 - RNA, 22 nt, Homo sapiens
ugauuaguauaauauuucuuaa

SEQ ID NO: 1176443 - RNA, 21 nt, Homo sapiens
ugauuaguauucaggcacuga

SEQ ID NO: 1176444 - RNA, 21 nt, Homo sapiens
ugauucacaaugaaaugcucu

SEQ ID NO: 1176445 - RNA, 11 nt, Homo sapiens
ugauucccaac

SEQ ID NO: 1176446 - RNA, 22 nt, Homo sapiens
ugauucccuccugcuacucugu

SEQ ID NO: 1176447 - RNA, 24 nt, Homo sapiens
ugauuccuuuccuaaaaguguaag

SEQ ID NO: 1176448 - RNA, 14 nt, Homo sapiens
ugauucuccugccu

SEQ ID NO: 1176449 - RNA, 15 nt, Homo sapiens
ugauugaaaaguaaa

SEQ ID NO: 1176450 - RNA, 14 nt, Homo sapiens
ugauugugcaugga

SEQ ID NO: 1176451 - RNA, 17 nt, Homo sapiens
ugauuguggaauggaga

SEQ ID NO: 1176452 - RNA, 12 nt, Homo sapiens
ugauuuauugaa

SEQ ID NO: 1176453 - RNA, 14 nt, Homo sapiens
ugauuucagaagga

SEQ ID NO: 1176454 - RNA, 20 nt, Homo sapiens
ugauuucuugcuaagcucca

SEQ ID NO: 1176455 - RNA, 18 nt, Homo sapiens
ugauuugaaggcaaaaau

SEQ ID NO: 1176456 - RNA, 12 nt, Homo sapiens
ugauuugcaaua

SEQ ID NO: 1176457 - RNA, 15 nt, Homo sapiens
ugauuugccacugau

SEQ ID NO: 1176458 - RNA, 14 nt, Homo sapiens
ugauuuuuuuccac

SEQ ID NO: 1176459 - RNA, 18 nt, Homo sapiens
ugcaaaagcaaucauaga

SEQ ID NO: 1176460 - RNA, 18 nt, Homo sapiens
ugcaaacuuguaucugaa

SEQ ID NO: 1176461 - RNA, 11 nt, Homo sapiens
ugcaaaggggu

SEQ ID NO: 1176462 - RNA, 13 nt, Homo sapiens
ugcaaaguacugu

SEQ ID NO: 1176463 - RNA, 14 nt, Homo sapiens
ugcaaaguacugua

SEQ ID NO: 1176464 - RNA, 20 nt, Homo sapiens
ugcaaaguacuguaagaaua

SEQ ID NO: 1176465 - RNA, 19 nt, Homo sapiens
ugcaaaguaugccagggga

SEQ ID NO: 1176466 - RNA, 17 nt, Homo sapiens
ugcaaauagcaaaacua

SEQ ID NO: 1176467 - RNA, 19 nt, Homo sapiens
ugcaaaucacucugcaaug

SEQ ID NO: 1176468 - RNA, 16 nt, Homo sapiens
ugcaacacaacauuug

SEQ ID NO: 1176469 - RNA, 17 nt, Homo sapiens
ugcaaccucugccuccc

SEQ ID NO: 1176470 - RNA, 21 nt, Homo sapiens
ugcaaccucuuggccugauca

SEQ ID NO: 1176471 - RNA, 15 nt, Homo sapiens
ugcaacucccuccca

SEQ ID NO: 1176472 - RNA, 16 nt, Homo sapiens
ugcaacugacacuccc

SEQ ID NO: 1176473 - RNA, 22 nt, Homo sapiens
ugcaagaacucaucacuguggc

SEQ ID NO: 1176474 - RNA, 17 nt, Homo sapiens
ugcaagagaaacugcag

SEQ ID NO: 1176475 - RNA, 14 nt, Homo sapiens
ugcaagauucugaa

SEQ ID NO: 1176476 - RNA, 22 nt, Homo sapiens
ugcaagccccugcuccagaaga

SEQ ID NO: 1176477 - RNA, 16 nt, Homo sapiens
ugcaaggauuacagaa

SEQ ID NO: 1176478 - RNA, 16 nt, Homo sapiens
ugcaauaugaauucaa

SEQ ID NO: 1176479 - RNA, 16 nt, Homo sapiens
ugcaaucaauuuaaau

SEQ ID NO: 1176480 - RNA, 16 nt, Homo sapiens
ugcaauccucccuacc

SEQ ID NO: 1176481 - RNA, 18 nt, Homo sapiens
ugcaaugacacagucuug

SEQ ID NO: 1176482 - RNA, 13 nt, Homo sapiens
ugcaauggcucaa

SEQ ID NO: 1176483 - RNA, 15 nt, Homo sapiens
ugcaauguaagcaua

SEQ ID NO: 1176484 - RNA, 13 nt, Homo sapiens
ugcaauguaguca

SEQ ID NO: 1176485 - RNA, 12 nt, Homo sapiens
ugcaauguauua

SEQ ID NO: 1176486 - RNA, 13 nt, Homo sapiens
ugcaaugugcuac

SEQ ID NO: 1176487 - RNA, 18 nt, Homo sapiens
ugcaauuguggaucuuga

SEQ ID NO: 1176488 - RNA, 15 nt, Homo sapiens
ugcacacauuucuga

SEQ ID NO: 1176489 - RNA, 19 nt, Homo sapiens
ugcacagaauauguaugua

SEQ ID NO: 1176490 - RNA, 15 nt, Homo sapiens
ugcacagauuuacuc

SEQ ID NO: 1176491 - RNA, 22 nt, Homo sapiens
ugcacagugaagugcuggcaac

SEQ ID NO: 1176492 - RNA, 19 nt, Homo sapiens
ugcacaguggccccaucau

SEQ ID NO: 1176493 - RNA, 23 nt, Homo sapiens
ugcaccaaauaggaucauaugaa

SEQ ID NO: 1176494 - RNA, 13 nt, Homo sapiens
ugcaccaaaucau

SEQ ID NO: 1176495 - RNA, 17 nt, Homo sapiens
ugcaccaaaucaucucu

SEQ ID NO: 1176496 - RNA, 16 nt, Homo sapiens
ugcaccaagcaggaaa

SEQ ID NO: 1176497 - RNA, 23 nt, Homo sapiens
ugcaccaaugcacugagugaagg

SEQ ID NO: 1176498 - RNA, 23 nt, Homo sapiens
ugcaccauucuuucuuggugcau

SEQ ID NO: 1176499 - RNA, 20 nt, Homo sapiens
ugcaccuaucucagccauag

SEQ ID NO: 1176500 - RNA, 18 nt, Homo sapiens
ugcaccugcaaucccagc

SEQ ID NO: 1176501 - RNA, 21 nt, Homo sapiens
ugcacgcggagcgaaacaguu

SEQ ID NO: 1176502 - RNA, 21 nt, Homo sapiens
ugcacuaccauugcuguucua

SEQ ID NO: 1176503 - RNA, 22 nt, Homo sapiens
ugcacuccagccugagugacag

SEQ ID NO: 1176504 - RNA, 14 nt, Homo sapiens
ugcacugaaaugga

SEQ ID NO: 1176505 - RNA, 14 nt, Homo sapiens
ugcacugacagugg

SEQ ID NO: 1176506 - RNA, 15 nt, Homo sapiens
ugcacuguagccuua

SEQ ID NO: 1176507 - RNA, 18 nt, Homo sapiens
ugcacuuauacccaugaa

SEQ ID NO: 1176508 - RNA, 15 nt, Homo sapiens
ugcacuugaacacug

SEQ ID NO: 1176509 - RNA, 16 nt, Homo sapiens
ugcacuugaacacuga

SEQ ID NO: 1176510 - RNA, 23 nt, Homo sapiens
ugcagaaaaagaaaaaaacuaua

SEQ ID NO: 1176511 - RNA, 17 nt, Homo sapiens
ugcagaaauacaguaug

SEQ ID NO: 1176512 - RNA, 15 nt, Homo sapiens
ugcagaauguugauu

SEQ ID NO: 1176513 - RNA, 19 nt, Homo sapiens
ugcagaauugagagugauu

SEQ ID NO: 1176514 - RNA, 23 nt, Homo sapiens
ugcagacaggaaucuuaaggugu

SEQ ID NO: 1176515 - RNA, 23 nt, Homo sapiens
ugcagacuggcagucgcacacac

SEQ ID NO: 1176516 - RNA, 12 nt, Homo sapiens
ugcagacuuccc

SEQ ID NO: 1176517 - RNA, 19 nt, Homo sapiens
ugcagaggccugggggacc

SEQ ID NO: 1176518 - RNA, 21 nt, Homo sapiens
ugcagaggggcccaugaaaga

SEQ ID NO: 1176519 - RNA, 14 nt, Homo sapiens
ugcagagguccaaa

SEQ ID NO: 1176520 - RNA, 16 nt, Homo sapiens
ugcagaguaaguauua

SEQ ID NO: 1176521 - RNA, 14 nt, Homo sapiens
ugcagauugcuacu

SEQ ID NO: 1176522 - RNA, 15 nt, Homo sapiens
ugcagauugcuacua

SEQ ID NO: 1176523 - RNA, 11 nt, Homo sapiens
ugcagccagag

SEQ ID NO: 1176524 - RNA, 17 nt, Homo sapiens
ugcagcccuugugaugu

SEQ ID NO: 1176525 - RNA, 21 nt, Homo sapiens
ugcagcccuugugaugugauu

SEQ ID NO: 1176526 - RNA, 17 nt, Homo sapiens
ugcagcgaguacuuccc

SEQ ID NO: 1176527 - RNA, 22 nt, Homo sapiens
ugcagcuacccaggcccaccca

SEQ ID NO: 1176528 - RNA, 18 nt, Homo sapiens
ugcagcuguacugaggau

SEQ ID NO: 1176529 - RNA, 23 nt, Homo sapiens
ugcaggaaagaauagaagugauu

SEQ ID NO: 1176530 - RNA, 16 nt, Homo sapiens
ugcaggacuugagaag

SEQ ID NO: 1176531 - RNA, 22 nt, Homo sapiens
ugcaggacuugagaagaccuca

SEQ ID NO: 1176532 - RNA, 20 nt, Homo sapiens
ugcaggccaggccagcugcc

SEQ ID NO: 1176533 - RNA, 21 nt, Homo sapiens
ugcagggcacaugaucuggcc

SEQ ID NO: 1176534 - RNA, 18 nt, Homo sapiens
ugcagggccgccagggag

SEQ ID NO: 1176535 - RNA, 19 nt, Homo sapiens
ugcaggggggcaguaacuc

SEQ ID NO: 1176536 - RNA, 18 nt, Homo sapiens
ugcagggguuauguggaa

SEQ ID NO: 1176537 - RNA, 15 nt, Homo sapiens
ugcagucaucuacuu

SEQ ID NO: 1176538 - RNA, 19 nt, Homo sapiens
ugcagucaucuugaccaag

SEQ ID NO: 1176539 - RNA, 15 nt, Homo sapiens
ugcagucgcuugcca

SEQ ID NO: 1176540 - RNA, 20 nt, Homo sapiens
ugcagucuccgccuccugag

SEQ ID NO: 1176541 - RNA, 13 nt, Homo sapiens
ugcagucugggug

SEQ ID NO: 1176542 - RNA, 13 nt, Homo sapiens
ugcagugagccaa

SEQ ID NO: 1176543 - RNA, 15 nt, Homo sapiens
ugcagugagcuauua

SEQ ID NO: 1176544 - RNA, 19 nt, Homo sapiens
ugcaguuguggugugccau

SEQ ID NO: 1176545 - RNA, 23 nt, Homo sapiens
ugcaguuuaagaugacacuuuua

SEQ ID NO: 1176546 - RNA, 21 nt, Homo sapiens
ugcauaaaauagagugcauuu

SEQ ID NO: 1176547 - RNA, 22 nt, Homo sapiens
ugcauacugguguuaacaguca

SEQ ID NO: 1176548 - RNA, 13 nt, Homo sapiens
ugcauacuuagau

SEQ ID NO: 1176549 - RNA, 21 nt, Homo sapiens
ugcauacuuagaugaucuuca

SEQ ID NO: 1176550 - RNA, 17 nt, Homo sapiens
ugcauagcagcugcuac

SEQ ID NO: 1176551 - RNA, 12 nt, Homo sapiens
ugcaucacauga

SEQ ID NO: 1176552 - RNA, 20 nt, Homo sapiens
ugcaucaguucacugcugca

SEQ ID NO: 1176553 - RNA, 17 nt, Homo sapiens
ugcauccaggacugugc

SEQ ID NO: 1176554 - RNA, 21 nt, Homo sapiens
ugcauccaggacugugccagc

SEQ ID NO: 1176555 - RNA, 18 nt, Homo sapiens
ugcauccguaguucccug

SEQ ID NO: 1176556 - RNA, 12 nt, Homo sapiens
ugggacaaagau

SEQ ID NO: 1176557 - RNA, 23 nt, Homo sapiens
ugggacagccaaguuauacccaa

SEQ ID NO: 1176558 - RNA, 21 nt, Homo sapiens
ugggagaaauugacagaucaa

SEQ ID NO: 1176559 - RNA, 20 nt, Homo sapiens
ugggagaauaugguuuucua

SEQ ID NO: 1176560 - RNA, 15 nt, Homo sapiens
ugggagagggagacc

SEQ ID NO: 1176561 - RNA, 16 nt, Homo sapiens
ugggagagucaaggga

SEQ ID NO: 1176562 - RNA, 22 nt, Homo sapiens
ugggagccgggacccucaggug

SEQ ID NO: 1176563 - RNA, 21 nt, Homo sapiens
ugggagcuucccacaccugcc

SEQ ID NO: 1176564 - RNA, 20 nt, Homo sapiens
ugggaggcacagcaaacugu

SEQ ID NO: 1176565 - RNA, 16 nt, Homo sapiens
ugggaggccaaggugg

SEQ ID NO: 1176566 - RNA, 21 nt, Homo sapiens
ugggagugcccccaacagcac

SEQ ID NO: 1176567 - RNA, 18 nt, Homo sapiens
ugggaguucuaacaaaac

SEQ ID NO: 1176568 - RNA, 18 nt, Homo sapiens
ugggaugaaacuaaagca

SEQ ID NO: 1176569 - RNA, 16 nt, Homo sapiens
ugggaugcucucuggu

SEQ ID NO: 1176570 - RNA, 18 nt, Homo sapiens
ugggauguaagaguguuc

SEQ ID NO: 1176571 - RNA, 22 nt, Homo sapiens
ugggaugugccgauccuuguca

SEQ ID NO: 1176572 - RNA, 15 nt, Homo sapiens
ugggauuacagaucu

SEQ ID NO: 1176573 - RNA, 13 nt, Homo sapiens
ugggauuacaggg

SEQ ID NO: 1176574 - RNA, 19 nt, Homo sapiens
ugggcaacaagagcaaaac

SEQ ID NO: 1176575 - RNA, 18 nt, Homo sapiens
ugggcaacagagcaagac

SEQ ID NO: 1176576 - RNA, 21 nt, Homo sapiens
ugggcaacagagcaagacucc

SEQ ID NO: 1176577 - RNA, 18 nt, Homo sapiens
ugggcaauauagcaagau

SEQ ID NO: 1176578 - RNA, 17 nt, Homo sapiens
ugggcaauucacagccu

SEQ ID NO: 1176579 - RNA, 22 nt, Homo sapiens
ugggcaucauagcaagaccuca

SEQ ID NO: 1176580 - RNA, 15 nt, Homo sapiens
ugggcaucuauggga

SEQ ID NO: 1176581 - RNA, 16 nt, Homo sapiens
ugggcccaagggcaga

SEQ ID NO: 1176582 - RNA, 21 nt, Homo sapiens
ugggcccacccggugggaccc

SEQ ID NO: 1176583 - RNA, 16 nt, Homo sapiens
ugggccccucagggga

SEQ ID NO: 1176584 - RNA, 17 nt, Homo sapiens
ugggccccuggcacucu

SEQ ID NO: 1176585 - RNA, 16 nt, Homo sapiens
ugggcccuuugagugc

SEQ ID NO: 1176586 - RNA, 13 nt, Homo sapiens
ugggccguuacau

SEQ ID NO: 1176587 - RNA, 16 nt, Homo sapiens
ugggccucuucugccu

SEQ ID NO: 1176588 - RNA, 14 nt, Homo sapiens
ugggcucuccuagg

SEQ ID NO: 1176589 - RNA, 13 nt, Homo sapiens
ugggcugagccaa

SEQ ID NO: 1176590 - RNA, 16 nt, Homo sapiens
ugggcugggcagccuu

SEQ ID NO: 1176591 - RNA, 13 nt, Homo sapiens
ugggcuucaucca

SEQ ID NO: 1176592 - RNA, 14 nt, Homo sapiens
ugggcuugauucug

SEQ ID NO: 1176593 - RNA, 17 nt, Homo sapiens
ugggcuuuugaacugua

SEQ ID NO: 1176594 - RNA, 15 nt, Homo sapiens
uggggaaaaaacugu

SEQ ID NO: 1176595 - RNA, 16 nt, Homo sapiens
uggggaaaacuugcag

SEQ ID NO: 1176596 - RNA, 23 nt, Homo sapiens
uggggaggugagagugcagaaag

SEQ ID NO: 1176597 - RNA, 24 nt, Homo sapiens
uggggagguggcacuagggaucaa

SEQ ID NO: 1176598 - RNA, 20 nt, Homo sapiens
uggggcaggcagugaugcug

SEQ ID NO: 1176599 - RNA, 13 nt, Homo sapiens
uggggcccagugc

SEQ ID NO: 1176600 - RNA, 15 nt, Homo sapiens
uggggcccagugcau

SEQ ID NO: 1176601 - RNA, 15 nt, Homo sapiens
uggggccucagacga

SEQ ID NO: 1176602 - RNA, 18 nt, Homo sapiens
uggggccuccagaacuca

SEQ ID NO: 1176603 - RNA, 19 nt, Homo sapiens
ugggggagaaaaaaucacu

SEQ ID NO: 1176604 - RNA, 19 nt, Homo sapiens
uggggggacccagugcaga

SEQ ID NO: 1176605 - RNA, 14 nt, Homo sapiens
ugggguccagggag

SEQ ID NO: 1176606 - RNA, 18 nt, Homo sapiens
ugggguggggauagggag

SEQ ID NO: 1176607 - RNA, 17 nt, Homo sapiens
ugggguuggaagugcag

SEQ ID NO: 1176608 - RNA, 18 nt, Homo sapiens
ugggguuggaagugcaga

SEQ ID NO: 1176609 - RNA, 19 nt, Homo sapiens
uggguaccugcaagcagaa

SEQ ID NO: 1176610 - RNA, 15 nt, Homo sapiens
uggguacuucuugaa

SEQ ID NO: 1176611 - RNA, 20 nt, Homo sapiens
ugggucccggggugcauuug

SEQ ID NO: 1176612 - RNA, 23 nt, Homo sapiens
uggguccucggcccaucugucca

SEQ ID NO: 1176613 - RNA, 14 nt, Homo sapiens
ugggucuaugccuu

SEQ ID NO: 1176614 - RNA, 19 nt, Homo sapiens
ugggucugcuggcuucuac

SEQ ID NO: 1176615 - RNA, 14 nt, Homo sapiens
ugggucuucaagga

SEQ ID NO: 1176616 - RNA, 21 nt, Homo sapiens
ugggugauuacauaaucugua

SEQ ID NO: 1176617 - RNA, 17 nt, Homo sapiens
ugggugcaugaucuuga

SEQ ID NO: 1176618 - RNA, 22 nt, Homo sapiens
ugggugguguuuguaacaauca

SEQ ID NO: 1176619 - RNA, 21 nt, Homo sapiens
uggguguuucaguuugaaaau

SEQ ID NO: 1176620 - RNA, 15 nt, Homo sapiens
uggguucugcuacuc

SEQ ID NO: 1176621 - RNA, 22 nt, Homo sapiens
uggguuucacgaguguuccugu

SEQ ID NO: 1176622 - RNA, 16 nt, Homo sapiens
ugguaaacuccuccac

SEQ ID NO: 1176623 - RNA, 15 nt, Homo sapiens
ugguaccaagcauuu

SEQ ID NO: 1176624 - RNA, 16 nt, Homo sapiens
ugguacuaaggagaau

SEQ ID NO: 1176625 - RNA, 14 nt, Homo sapiens
ugguagagcaauaa

SEQ ID NO: 1176626 - RNA, 17 nt, Homo sapiens
ugguagccucacuuuua

SEQ ID NO: 1176627 - RNA, 22 nt, Homo sapiens
ugguaggaucaccugaggucag

SEQ ID NO: 1176628 - RNA, 22 nt, Homo sapiens
ugguagugggagguugugcaug

SEQ ID NO: 1176629 - RNA, 21 nt, Homo sapiens
ugguauaaacguccuacugua

SEQ ID NO: 1176630 - RNA, 18 nt, Homo sapiens
ugguauaaagcucucaaa

SEQ ID NO: 1176631 - RNA, 23 nt, Homo sapiens
ugguaugaaacaaacuacugugu

SEQ ID NO: 1176632 - RNA, 18 nt, Homo sapiens
ugguauuauauaauucaa

SEQ ID NO: 1176633 - RNA, 16 nt, Homo sapiens
uggucaaguaguuuga

SEQ ID NO: 1176634 - RNA, 14 nt, Homo sapiens
uggucacauacaau

SEQ ID NO: 1176635 - RNA, 14 nt, Homo sapiens
uggucauugaggga

SEQ ID NO: 1176636 - RNA, 18 nt, Homo sapiens
ugguccccuguggugaug

SEQ ID NO: 1176637 - RNA, 14 nt, Homo sapiens
ugguccuguccaga

SEQ ID NO: 1176638 - RNA, 15 nt, Homo sapiens
uggucuccacugggg

SEQ ID NO: 1176639 - RNA, 13 nt, Homo sapiens
uggucucuacugu

SEQ ID NO: 1176640 - RNA, 18 nt, Homo sapiens
uggucugagcugucccaa

SEQ ID NO: 1176641 - RNA, 23 nt, Homo sapiens
uggucuucagccucuuucugucc

SEQ ID NO: 1176642 - RNA, 13 nt, Homo sapiens
uggucuugaucuc

SEQ ID NO: 1176643 - RNA, 17 nt, Homo sapiens
uggucuuuuuccugaaa

SEQ ID NO: 1176644 - RNA, 22 nt, Homo sapiens
uggugaacuucaaaagcuuuuu

SEQ ID NO: 1176645 - RNA, 17 nt, Homo sapiens
uggugaaugugugagaa

SEQ ID NO: 1176646 - RNA, 21 nt, Homo sapiens
uggugacagccuugggccuuu

SEQ ID NO: 1176647 - RNA, 14 nt, Homo sapiens
uggugacuuuugaa

SEQ ID NO: 1176648 - RNA, 21 nt, Homo sapiens
uggugagcuuaacccuggaaa

SEQ ID NO: 1176649 - RNA, 14 nt, Homo sapiens
uggugaggcaauaa

SEQ ID NO: 1176650 - RNA, 17 nt, Homo sapiens
uggugcaaucacagcuc

SEQ ID NO: 1176651 - RNA, 21 nt, Homo sapiens
uggugcccccagacagcugcu

SEQ ID NO: 1176652 - RNA, 20 nt, Homo sapiens
uggugccugaagaccccaga

SEQ ID NO: 1176653 - RNA, 23 nt, Homo sapiens
ugguggacucgccuguaaucuca

SEQ ID NO: 1176654 - RNA, 15 nt, Homo sapiens
ugguggagggccaca

SEQ ID NO: 1176655 - RNA, 16 nt, Homo sapiens
ugguggcucaugccuc

SEQ ID NO: 1176656 - RNA, 19 nt, Homo sapiens
ugguggcucaugccuguaa

SEQ ID NO: 1176657 - RNA, 22 nt, Homo sapiens
ugguggcucuucagaggagcau

SEQ ID NO: 1176658 - RNA, 23 nt, Homo sapiens
ugguggggagcacagacacagga

SEQ ID NO: 1176659 - RNA, 16 nt, Homo sapiens
ugguggucuuacugag

SEQ ID NO: 1176660 - RNA, 13 nt, Homo sapiens
uggugugccaugc

SEQ ID NO: 1176661 - RNA, 15 nt, Homo sapiens
uggugugugccucau

SEQ ID NO: 1176662 - RNA, 14 nt, Homo sapiens
ugguguguuacaca

SEQ ID NO: 1176663 - RNA, 17 nt, Homo sapiens
ugguguuaaucauuuca

SEQ ID NO: 1176664 - RNA, 19 nt, Homo sapiens
ugguuaccaccagccuuuc

SEQ ID NO: 1176665 - RNA, 16 nt, Homo sapiens
ugguuauaaaagugau

SEQ ID NO: 1176666 - RNA, 16 nt, Homo sapiens
ugguucaccugaauca

SEQ ID NO: 1176667 - RNA, 14 nt, Homo sapiens
ugguucagugccac

SEQ ID NO: 1176668 - RNA, 20 nt, Homo sapiens
ugguuccgccaggcgcugca

SEQ ID NO: 1176669 - RNA, 20 nt, Homo sapiens
ugguugaaaccccaucucua

SEQ ID NO: 1176670 - RNA, 11 nt, Homo sapiens
ugguugccaag

SEQ ID NO: 1176671 - RNA, 16 nt, Homo sapiens
ugguuggcagcauucc

SEQ ID NO: 1176672 - RNA, 15 nt, Homo sapiens
ugguuggcauuugcu

SEQ ID NO: 1176673 - RNA, 15 nt, Homo sapiens
ugguuugugugauca

SEQ ID NO: 1176674 - RNA, 21 nt, Homo sapiens
ugguuuugauggcuggguccu

SEQ ID NO: 1176675 - RNA, 17 nt, Homo sapiens
ugguuuuuguugagucu

SEQ ID NO: 1176676 - RNA, 23 nt, Homo sapiens
ugguuuuuguugagucucugaac

SEQ ID NO: 1176677 - RNA, 15 nt, Homo sapiens
ugguuuuuugccagg

SEQ ID NO: 1176678 - RNA, 16 nt, Homo sapiens
uguaaaagacagugua

SEQ ID NO: 1176679 - RNA, 12 nt, Homo sapiens
uguaaaauggag

SEQ ID NO: 1176680 - RNA, 15 nt, Homo sapiens
uguaaaauguucucu

SEQ ID NO: 1176681 - RNA, 19 nt, Homo sapiens
uguaaacacgccugcaaac

SEQ ID NO: 1176682 - RNA, 20 nt, Homo sapiens
uguaaacuuuuugugcugaa

SEQ ID NO: 1176683 - RNA, 18 nt, Homo sapiens
uguaaagaucuacaugaa

SEQ ID NO: 1176684 - RNA, 17 nt, Homo sapiens
uguaaaggcaagccagc

SEQ ID NO: 1176685 - RNA, 15 nt, Homo sapiens
uguaaaggccuuuaa

SEQ ID NO: 1176686 - RNA, 20 nt, Homo sapiens
uguaaagugaagaauccuuu

SEQ ID NO: 1176687 - RNA, 19 nt, Homo sapiens
uguaaauaaagacauucag

SEQ ID NO: 1176688 - RNA, 16 nt, Homo sapiens
uguugaggguccucag

SEQ ID NO: 1176689 - RNA, 17 nt, Homo sapiens
uguugaugcugucuaag

SEQ ID NO: 1176690 - RNA, 17 nt, Homo sapiens
uguugcacugaaaugga

SEQ ID NO: 1176691 - RNA, 11 nt, Homo sapiens
uguugcaugga

SEQ ID NO: 1176692 - RNA, 16 nt, Homo sapiens
uguugccauggugaug

SEQ ID NO: 1176693 - RNA, 17 nt, Homo sapiens
uguugccuucaucuuca

SEQ ID NO: 1176694 - RNA, 12 nt, Homo sapiens
uguugcuuuaac

SEQ ID NO: 1176695 - RNA, 15 nt, Homo sapiens
uguuggagaugcagc

SEQ ID NO: 1176696 - RNA, 17 nt, Homo sapiens
uguugguauuauauaau

SEQ ID NO: 1176697 - RNA, 20 nt, Homo sapiens
uguugguauuauauaauuca

SEQ ID NO: 1176698 - RNA, 12 nt, Homo sapiens
uguuggugacaa

SEQ ID NO: 1176699 - RNA, 21 nt, Homo sapiens
uguugguguucggagcucuuc

SEQ ID NO: 1176700 - RNA, 21 nt, Homo sapiens
uguuguaaaagaugcagagua

SEQ ID NO: 1176701 - RNA, 14 nt, Homo sapiens
uguuguacauuuca

SEQ ID NO: 1176702 - RNA, 15 nt, Homo sapiens
uguuguacauuucac

SEQ ID NO: 1176703 - RNA, 22 nt, Homo sapiens
uguuuaaaauucucuuugguca

SEQ ID NO: 1176704 - RNA, 23 nt, Homo sapiens
uguuuaaagaaucuacuauacuu

SEQ ID NO: 1176705 - RNA, 21 nt, Homo sapiens
uguuuaaagcauuacaguauu

SEQ ID NO: 1176706 - RNA, 21 nt, Homo sapiens
uguuuaauguuucuguccuuu

SEQ ID NO: 1176707 - RNA, 16 nt, Homo sapiens
uguuuaauugugauau

SEQ ID NO: 1176708 - RNA, 17 nt, Homo sapiens
uguuuaugacacaauga

SEQ ID NO: 1176709 - RNA, 20 nt, Homo sapiens
uguuuaugacacaaugacac

SEQ ID NO: 1176710 - RNA, 19 nt, Homo sapiens
uguuuauuugcacuaugag

SEQ ID NO: 1176711 - RNA, 20 nt, Homo sapiens
uguuucaaggcacucuagau

SEQ ID NO: 1176712 - RNA, 18 nt, Homo sapiens
uguuucaucccauguaca

SEQ ID NO: 1176713 - RNA, 16 nt, Homo sapiens
uguuucauuuaccucu

SEQ ID NO: 1176714 - RNA, 17 nt, Homo sapiens
uguuucauuuaccucua

SEQ ID NO: 1176715 - RNA, 22 nt, Homo sapiens
uguuuccuuuaauuuuuuacua

SEQ ID NO: 1176716 - RNA, 19 nt, Homo sapiens
uguuucucagacuggucuc

SEQ ID NO: 1176717 - RNA, 13 nt, Homo sapiens
uguuucugugcuc

SEQ ID NO: 1176718 - RNA, 15 nt, Homo sapiens
uguuugaaagcuuua

SEQ ID NO: 1176719 - RNA, 17 nt, Homo sapiens
uguuugacgggaaacaa

SEQ ID NO: 1176720 - RNA, 14 nt, Homo sapiens
uguuuggauuggca

SEQ ID NO: 1176721 - RNA, 23 nt, Homo sapiens
uguuugguaguuagccaucuaau

SEQ ID NO: 1176722 - RNA, 20 nt, Homo sapiens
uguuuguacacaacaccuaa

SEQ ID NO: 1176723 - RNA, 11 nt, Homo sapiens
uguuugucagc

SEQ ID NO: 1176724 - RNA, 23 nt, Homo sapiens
uguuuuaaagaauaugacuuuuu

SEQ ID NO: 1176725 - RNA, 17 nt, Homo sapiens
uguuuuaaauguacaga

SEQ ID NO: 1176726 - RNA, 16 nt, Homo sapiens
uguuuuaugcccuucu

SEQ ID NO: 1176727 - RNA, 14 nt, Homo sapiens
uguuuucaacauug

SEQ ID NO: 1176728 - RNA, 16 nt, Homo sapiens
uguuuuccacugugcu

SEQ ID NO: 1176729 - RNA, 15 nt, Homo sapiens
uguuuuguacuuuag

SEQ ID NO: 1176730 - RNA, 13 nt, Homo sapiens
uguuuugugauuc

SEQ ID NO: 1176731 - RNA, 16 nt, Homo sapiens
uguuuuuaaacuaaua

SEQ ID NO: 1176732 - RNA, 19 nt, Homo sapiens
uguuuuuaauaaagacagg

SEQ ID NO: 1176733 - RNA, 20 nt, Homo sapiens
uguuuuucuuuuuccacaag

SEQ ID NO: 1176734 - RNA, 20 nt, Homo sapiens
uguuuuugcuuuuccuucag

SEQ ID NO: 1176735 - RNA, 15 nt, Homo sapiens
uguuuuuucugcaau

SEQ ID NO: 1176736 - RNA, 22 nt, Homo sapiens
uguuuuuuuguuaaucauagca

SEQ ID NO: 1176737 - RNA, 23 nt, Homo sapiens
uguuuuuuuuuuaaaaaagacau

SEQ ID NO: 1176738 - RNA, 20 nt, Homo sapiens
uuaaaaaaagaaaacuuuaa

SEQ ID NO: 1176739 - RNA, 18 nt, Homo sapiens
uuaaaaaaauaugccuuu

SEQ ID NO: 1176740 - RNA, 23 nt, Homo sapiens
uuaaaaaaaugggguuauagaag

SEQ ID NO: 1176741 - RNA, 20 nt, Homo sapiens
uuaaaaacuagagcacagaa

SEQ ID NO: 1176742 - RNA, 21 nt, Homo sapiens
uuaaaaagaugguugccaagc

SEQ ID NO: 1176743 - RNA, 13 nt, Homo sapiens
uuaaaaaucccaa

SEQ ID NO: 1176744 - RNA, 20 nt, Homo sapiens
uuaaaacaaaggaaguucuc

SEQ ID NO: 1176745 - RNA, 13 nt, Homo sapiens
uuaaaacauuucu

SEQ ID NO: 1176746 - RNA, 23 nt, Homo sapiens
uuaaaagaucauaguugcaaaau

SEQ ID NO: 1176747 - RNA, 22 nt, Homo sapiens
uuaaaaguuaaauuagcuuucu

SEQ ID NO: 1176748 - RNA, 15 nt, Homo sapiens
uuaaaaguugcaaag

SEQ ID NO: 1176749 - RNA, 19 nt, Homo sapiens
uuaaaauaaacacaaaaac

SEQ ID NO: 1176750 - RNA, 14 nt, Homo sapiens
uuaaaauugcucau

SEQ ID NO: 1176751 - RNA, 16 nt, Homo sapiens
uuaaaauuucuugauu

SEQ ID NO: 1176752 - RNA, 14 nt, Homo sapiens
uuaaaccuuuccau

SEQ ID NO: 1176753 - RNA, 18 nt, Homo sapiens
uuaaacucucuucuucca

SEQ ID NO: 1176754 - RNA, 19 nt, Homo sapiens
uuaaagaaaauaugcauaa

SEQ ID NO: 1176755 - RNA, 22 nt, Homo sapiens
uuaaagaaaaugugucugcaac

SEQ ID NO: 1176756 - RNA, 22 nt, Homo sapiens
uuaaagaauucuguacccugau

SEQ ID NO: 1176757 - RNA, 15 nt, Homo sapiens
uuaaagagucuagau

SEQ ID NO: 1176758 - RNA, 13 nt, Homo sapiens
uuaaagaugcuga

SEQ ID NO: 1176759 - RNA, 17 nt, Homo sapiens
uuaaagcgugugugaac

SEQ ID NO: 1176760 - RNA, 22 nt, Homo sapiens
uuaaaggugugcuauuugucag

SEQ ID NO: 1176761 - RNA, 21 nt, Homo sapiens
uuaaaguuguuugcuuauacu

SEQ ID NO: 1176762 - RNA, 19 nt, Homo sapiens
uuaaaguuguuugugccuu

SEQ ID NO: 1176763 - RNA, 15 nt, Homo sapiens
uuaaauaagauucua

SEQ ID NO: 1176764 - RNA, 13 nt, Homo sapiens
uuaaauaaucucu

SEQ ID NO: 1176765 - RNA, 20 nt, Homo sapiens
uuaaauauaaauauccccag

SEQ ID NO: 1176766 - RNA, 14 nt, Homo sapiens
uuaaauauugucau

SEQ ID NO: 1176767 - RNA, 12 nt, Homo sapiens
uuaaaucaauaa

SEQ ID NO: 1176768 - RNA, 19 nt, Homo sapiens
uuaaauguuuauaauuuau

SEQ ID NO: 1176769 - RNA, 14 nt, Homo sapiens
uuaaauuacaauuu

SEQ ID NO: 1176770 - RNA, 17 nt, Homo sapiens
uuaaauuacaauuuuau

SEQ ID NO: 1176771 - RNA, 14 nt, Homo sapiens
uuaaauuaugggaa

SEQ ID NO: 1176772 - RNA, 15 nt, Homo sapiens
uuaaauucaaguuua

SEQ ID NO: 1176773 - RNA, 17 nt, Homo sapiens
uuaaauugcuugaaugu

SEQ ID NO: 1176774 - RNA, 21 nt, Homo sapiens
uuaaauuugguacaaaaccac

SEQ ID NO: 1176775 - RNA, 12 nt, Homo sapiens
uuaacaaucaaa

SEQ ID NO: 1176776 - RNA, 14 nt, Homo sapiens
uuaacaaucaaaaa

SEQ ID NO: 1176777 - RNA, 13 nt, Homo sapiens
uuaacauaagaaa

SEQ ID NO: 1176778 - RNA, 22 nt, Homo sapiens
uuaacccauuugucucuacuuu

SEQ ID NO: 1176779 - RNA, 16 nt, Homo sapiens
uuaacucagacacaaa

SEQ ID NO: 1176780 - RNA, 19 nt, Homo sapiens
uuaacuccuccugagcucu

SEQ ID NO: 1176781 - RNA, 22 nt, Homo sapiens
uuaacuggcuucagccucccca

SEQ ID NO: 1176782 - RNA, 12 nt, Homo sapiens
uuaacuggugaa

SEQ ID NO: 1176783 - RNA, 14 nt, Homo sapiens
uuaacuguacugaa

SEQ ID NO: 1176784 - RNA, 17 nt, Homo sapiens
uuaacuuacacugauca

SEQ ID NO: 1176785 - RNA, 17 nt, Homo sapiens
uuaacuuugaaccauaa

SEQ ID NO: 1176786 - RNA, 14 nt, Homo sapiens
uuaagaguccaaga

SEQ ID NO: 1176787 - RNA, 23 nt, Homo sapiens
uuaaggacaaagugccaaagaaa

SEQ ID NO: 1176788 - RNA, 14 nt, Homo sapiens
uuaaggcagcucau

SEQ ID NO: 1176789 - RNA, 17 nt, Homo sapiens
uuaaggcucugugccuu

SEQ ID NO: 1176790 - RNA, 18 nt, Homo sapiens
uuaagggaauaugcauug

SEQ ID NO: 1176791 - RNA, 22 nt, Homo sapiens
uuaagggauuuaguaacaucau

SEQ ID NO: 1176792 - RNA, 17 nt, Homo sapiens
uuaaggugaguucucac

SEQ ID NO: 1176793 - RNA, 13 nt, Homo sapiens
uuaaguucacuuu

SEQ ID NO: 1176794 - RNA, 23 nt, Homo sapiens
uuaaguugagaacuuauguguuu

SEQ ID NO: 1176795 - RNA, 15 nt, Homo sapiens
uuaaguuuaccaaau

SEQ ID NO: 1176796 - RNA, 16 nt, Homo sapiens
uuaaguuuccuuccag

SEQ ID NO: 1176797 - RNA, 17 nt, Homo sapiens
uuaaguuuuacugauaa

SEQ ID NO: 1176798 - RNA, 22 nt, Homo sapiens
uuaauaaaaaugacagacugaa

SEQ ID NO: 1176799 - RNA, 15 nt, Homo sapiens
uuaauaaacugcaaa

SEQ ID NO: 1176800 - RNA, 16 nt, Homo sapiens
uuaauaaagacagggu

SEQ ID NO: 1176801 - RNA, 23 nt, Homo sapiens
uuaauaaucagcaagaauuugau

SEQ ID NO: 1176802 - RNA, 19 nt, Homo sapiens
uuaauacacaaugcaucau

SEQ ID NO: 1176803 - RNA, 18 nt, Homo sapiens
uuaauagggaauauaucu

SEQ ID NO: 1176804 - RNA, 21 nt, Homo sapiens
uuaauauuauuacuguugaua

SEQ ID NO: 1176805 - RNA, 19 nt, Homo sapiens
uuaauauuguauugcugcu

SEQ ID NO: 1176806 - RNA, 17 nt, Homo sapiens
uuaaucauagcaggaua

SEQ ID NO: 1176807 - RNA, 20 nt, Homo sapiens
uuaauccguaguuauuuugc

SEQ ID NO: 1176808 - RNA, 21 nt, Homo sapiens
uuaaucucugcugaaacucag

SEQ ID NO: 1176809 - RNA, 19 nt, Homo sapiens
uuaaugaaggugugcuaca

SEQ ID NO: 1176810 - RNA, 15 nt, Homo sapiens
uuaaugaauaugcca

SEQ ID NO: 1176811 - RNA, 14 nt, Homo sapiens
uuaaugaaugaguc

SEQ ID NO: 1176812 - RNA, 14 nt, Homo sapiens
uuaaugauucugaa

SEQ ID NO: 1176813 - RNA, 17 nt, Homo sapiens
uuaaugcagacaaacaa

SEQ ID NO: 1176814 - RNA, 18 nt, Homo sapiens
uuaaugugcuguguaaag

SEQ ID NO: 1176815 - RNA, 16 nt, Homo sapiens
uuaauguucugugaua

SEQ ID NO: 1176816 - RNA, 15 nt, Homo sapiens
uuaauguuuuuaccc

SEQ ID NO: 1176817 - RNA, 20 nt, Homo sapiens
uuaauguuuuuuaaacuagu

SEQ ID NO: 1176818 - RNA, 15 nt, Homo sapiens
uuaauucugaugcua

SEQ ID NO: 1176819 - RNA, 19 nt, Homo sapiens
uuaauugugauauuugaca

SEQ ID NO: 1176820 - RNA, 12 nt, Homo sapiens
gcaucugaccau

SEQ ID NO: 1176821 - RNA, 17 nt, Homo sapiens
gcaucugccacaaaaau

SEQ ID NO: 1176822 - RNA, 15 nt, Homo sapiens
gcaugacaaaaguga

SEQ ID NO: 1176823 - RNA, 16 nt, Homo sapiens
gcaugaguuacugugc

SEQ ID NO: 1176824 - RNA, 23 nt, Homo sapiens
gcaugcagccagccaucaaauag

SEQ ID NO: 1176825 - RNA, 21 nt, Homo sapiens
gcaugcuucuauuagucaccu

SEQ ID NO: 1176826 - RNA, 16 nt, Homo sapiens
gcauggaaggggcuuc

SEQ ID NO: 1176827 - RNA, 14 nt, Homo sapiens
gcauggaguguuug

SEQ ID NO: 1176828 - RNA, 13 nt, Homo sapiens
gcauggcauuaau

SEQ ID NO: 1176829 - RNA, 13 nt, Homo sapiens
gcauguaugugua

SEQ ID NO: 1176830 - RNA, 13 nt, Homo sapiens
gcaugugucaugc

SEQ ID NO: 1176831 - RNA, 18 nt, Homo sapiens
gcaugugucaugcaugaa

SEQ ID NO: 1176832 - RNA, 18 nt, Homo sapiens
gcauguuuauucuguucc

SEQ ID NO: 1176833 - RNA, 13 nt, Homo sapiens
gcauuaaauucac

SEQ ID NO: 1176834 - RNA, 17 nt, Homo sapiens
gcauuacauuguuuaaa

SEQ ID NO: 1176835 - RNA, 13 nt, Homo sapiens
gcauuagaaauga

SEQ ID NO: 1176836 - RNA, 23 nt, Homo sapiens
gcauuauaaauaaauaccaaaaa

SEQ ID NO: 1176837 - RNA, 14 nt, Homo sapiens
gcauuccaugacca

SEQ ID NO: 1176838 - RNA, 17 nt, Homo sapiens
gcauuccuuuuucuuca

SEQ ID NO: 1176839 - RNA, 17 nt, Homo sapiens
gcauucuacaccuggac

SEQ ID NO: 1176840 - RNA, 14 nt, Homo sapiens
gcauuuaagaguga

SEQ ID NO: 1176841 - RNA, 20 nt, Homo sapiens
gcauuucacaugccuugcaa

SEQ ID NO: 1176842 - RNA, 19 nt, Homo sapiens
gcauuugucuguguuugaa

SEQ ID NO: 1176843 - RNA, 19 nt, Homo sapiens
gcauuuuuacagcacacac

SEQ ID NO: 1176844 - RNA, 19 nt, Homo sapiens
gccaaaagcugcucaggga

SEQ ID NO: 1176845 - RNA, 16 nt, Homo sapiens
gccaaaggaaugucca

SEQ ID NO: 1176846 - RNA, 20 nt, Homo sapiens
gccaacaaagaacacuaacu

SEQ ID NO: 1176847 - RNA, 16 nt, Homo sapiens
gccaacugaaaauccu

SEQ ID NO: 1176848 - RNA, 18 nt, Homo sapiens
gccaacugccuccuugcc

SEQ ID NO: 1176849 - RNA, 18 nt, Homo sapiens
gccaacuguccuacucau

SEQ ID NO: 1176850 - RNA, 16 nt, Homo sapiens
gccaacuugccauguu

SEQ ID NO: 1176851 - RNA, 17 nt, Homo sapiens
gccaagaaacacugccu

SEQ ID NO: 1176852 - RNA, 14 nt, Homo sapiens
gccaagacacagca

SEQ ID NO: 1176853 - RNA, 16 nt, Homo sapiens
gccaagccaaccgugg

SEQ ID NO: 1176854 - RNA, 20 nt, Homo sapiens
gccaaggaaacccccagugu

SEQ ID NO: 1176855 - RNA, 14 nt, Homo sapiens
gccaaggagcugcu

SEQ ID NO: 1176856 - RNA, 21 nt, Homo sapiens
gccaaggagggugagugcaag

SEQ ID NO: 1176857 - RNA, 13 nt, Homo sapiens
gccaagguaggca

SEQ ID NO: 1176858 - RNA, 20 nt, Homo sapiens
gccaagguaggcagaucacc

SEQ ID NO: 1176859 - RNA, 18 nt, Homo sapiens
gccaaguaagaaagugaa

SEQ ID NO: 1176860 - RNA, 22 nt, Homo sapiens
gccacaaauucuuugacacuca

SEQ ID NO: 1176861 - RNA, 16 nt, Homo sapiens
gccacaacgccuggcu

SEQ ID NO: 1176862 - RNA, 22 nt, Homo sapiens
gccacaguuuccucaucugucc

SEQ ID NO: 1176863 - RNA, 16 nt, Homo sapiens
gccaccagccacuuua

SEQ ID NO: 1176864 - RNA, 15 nt, Homo sapiens
gccacccauucuucc

SEQ ID NO: 1176865 - RNA, 23 nt, Homo sapiens
gccaccgugauagaaaaaaaauc

SEQ ID NO: 1176866 - RNA, 23 nt, Homo sapiens
gccaccucccuauacugcuugga

SEQ ID NO: 1176867 - RNA, 21 nt, Homo sapiens
gccacuagcccuccucuccca

SEQ ID NO: 1176868 - RNA, 23 nt, Homo sapiens
gccacugcgcccagcuauacugu

SEQ ID NO: 1176869 - RNA, 20 nt, Homo sapiens
gccacuguuugucucaccua

SEQ ID NO: 1176870 - RNA, 17 nt, Homo sapiens
gccagagauaaacuaau

SEQ ID NO: 1176871 - RNA, 16 nt, Homo sapiens
gccagaggacugugau

SEQ ID NO: 1176872 - RNA, 16 nt, Homo sapiens
gccagaggcaccucaa

SEQ ID NO: 1176873 - RNA, 19 nt, Homo sapiens
gccagaguuggauaagcca

SEQ ID NO: 1176874 - RNA, 22 nt, Homo sapiens
gccagauuuuuuaaaauuuaua

SEQ ID NO: 1176875 - RNA, 18 nt, Homo sapiens
gccagcacacagggcagu

SEQ ID NO: 1176876 - RNA, 21 nt, Homo sapiens
gccagcaccgccggcuuucag

SEQ ID NO: 1176877 - RNA, 14 nt, Homo sapiens
gccagccaucaaau

SEQ ID NO: 1176878 - RNA, 19 nt, Homo sapiens
gccagcccggcucggccca

SEQ ID NO: 1176879 - RNA, 21 nt, Homo sapiens
gccagccuccggcggggaccc

SEQ ID NO: 1176880 - RNA, 17 nt, Homo sapiens
gccaggauuggggaccu

SEQ ID NO: 1176881 - RNA, 18 nt, Homo sapiens
gccaggcaccguggcuca

SEQ ID NO: 1176882 - RNA, 21 nt, Homo sapiens
gccaggccaaaucacccuuag

SEQ ID NO: 1176883 - RNA, 16 nt, Homo sapiens
gccaggccacuggccc

SEQ ID NO: 1176884 - RNA, 21 nt, Homo sapiens
gccaggcccugggucuugcca

SEQ ID NO: 1176885 - RNA, 16 nt, Homo sapiens
gccaggccuacuguaa

SEQ ID NO: 1176886 - RNA, 16 nt, Homo sapiens
gccaggcgcugcaggg

SEQ ID NO: 1176887 - RNA, 22 nt, Homo sapiens
gccagggaacccacagagucac

SEQ ID NO: 1176888 - RNA, 20 nt, Homo sapiens
gccaggugugguggugcaca

SEQ ID NO: 1176889 - RNA, 20 nt, Homo sapiens
gccaguagcuaaagugcaag

SEQ ID NO: 1176890 - RNA, 16 nt, Homo sapiens
gccagugagaccagcc

SEQ ID NO: 1176891 - RNA, 16 nt, Homo sapiens
gccaguguguguuucc

SEQ ID NO: 1176892 - RNA, 18 nt, Homo sapiens
gccaguguguguuuccca

SEQ ID NO: 1176893 - RNA, 14 nt, Homo sapiens
gccaguuaaggaaa

SEQ ID NO: 1176894 - RNA, 15 nt, Homo sapiens
gccaguuaauuuuaa

SEQ ID NO: 1176895 - RNA, 22 nt, Homo sapiens
gccauaaaaauaaaucaguuca

SEQ ID NO: 1176896 - RNA, 22 nt, Homo sapiens
gccauacuucuguuuccaucug

SEQ ID NO: 1176897 - RNA, 16 nt, Homo sapiens
gccauaggagaguuug

SEQ ID NO: 1176898 - RNA, 19 nt, Homo sapiens
gccauaggguccugaaugu

SEQ ID NO: 1176899 - RNA, 15 nt, Homo sapiens
gccauaggugcaguu

SEQ ID NO: 1176900 - RNA, 18 nt, Homo sapiens
gccauauggacacuguga

SEQ ID NO: 1176901 - RNA, 19 nt, Homo sapiens
gccauauggacacugugac

SEQ ID NO: 1176902 - RNA, 17 nt, Homo sapiens
gccaucaaauagugaau

SEQ ID NO: 1176903 - RNA, 12 nt, Homo sapiens
gccaucaugccu

SEQ ID NO: 1176904 - RNA, 17 nt, Homo sapiens
gccaucaugccugacua

SEQ ID NO: 1176905 - RNA, 14 nt, Homo sapiens
gccauccaugugcu

SEQ ID NO: 1176906 - RNA, 20 nt, Homo sapiens
gccauccaugugcuagucac

SEQ ID NO: 1176907 - RNA, 21 nt, Homo sapiens
gccaucccccucucacgccac

SEQ ID NO: 1176908 - RNA, 15 nt, Homo sapiens
gccaugcaaugccaa

SEQ ID NO: 1176909 - RNA, 17 nt, Homo sapiens
gccauggugauggugua

SEQ ID NO: 1176910 - RNA, 19 nt, Homo sapiens
gccauguguggagugugcu

SEQ ID NO: 1176911 - RNA, 14 nt, Homo sapiens
gccauucuuuccca

SEQ ID NO: 1176912 - RNA, 18 nt, Homo sapiens
gccauuggaaccuguuaa

SEQ ID NO: 1176913 - RNA, 17 nt, Homo sapiens
gccauugggcuacugua

SEQ ID NO: 1176914 - RNA, 22 nt, Homo sapiens
gcccaauccauccugcucagga

SEQ ID NO: 1176915 - RNA, 19 nt, Homo sapiens
gcccuccucucccgucucg

SEQ ID NO: 1176916 - RNA, 17 nt, Homo sapiens
gcccuccuuagaccuga

SEQ ID NO: 1176917 - RNA, 18 nt, Homo sapiens
gcccugagaaagcccugu

SEQ ID NO: 1176918 - RNA, 19 nt, Homo sapiens
gcccugaguuccuagccac

SEQ ID NO: 1176919 - RNA, 20 nt, Homo sapiens
gcccugaguuccuagccacc

SEQ ID NO: 1176920 - RNA, 17 nt, Homo sapiens
gcccugcucuuccucag

SEQ ID NO: 1176921 - RNA, 20 nt, Homo sapiens
gcccugcuuuaucaggggac

SEQ ID NO: 1176922 - RNA, 13 nt, Homo sapiens
gcccugugcaacc

SEQ ID NO: 1176923 - RNA, 12 nt, Homo sapiens
gcccuguggcag

SEQ ID NO: 1176924 - RNA, 16 nt, Homo sapiens
gcccuguugugccaca

SEQ ID NO: 1176925 - RNA, 18 nt, Homo sapiens
gcccuuauugaacauucu

SEQ ID NO: 1176926 - RNA, 20 nt, Homo sapiens
gcccuucagucuuaauacuu

SEQ ID NO: 1176927 - RNA, 13 nt, Homo sapiens
gcccuuccagugg

SEQ ID NO: 1176928 - RNA, 15 nt, Homo sapiens
gcccuuccuugccag

SEQ ID NO: 1176929 - RNA, 22 nt, Homo sapiens
gcccuugacaaagucaagccac

SEQ ID NO: 1176930 - RNA, 13 nt, Homo sapiens
gcccuugagggag

SEQ ID NO: 1176931 - RNA, 13 nt, Homo sapiens
gcccuuggaagaa

SEQ ID NO: 1176932 - RNA, 16 nt, Homo sapiens
gccgacauuaaaguau

SEQ ID NO: 1176933 - RNA, 20 nt, Homo sapiens
gccgacucccccaaccaagg

SEQ ID NO: 1176934 - RNA, 19 nt, Homo sapiens
gccgagcggggagccagga

SEQ ID NO: 1176935 - RNA, 19 nt, Homo sapiens
gccgauccggggcccucuc

SEQ ID NO: 1176936 - RNA, 17 nt, Homo sapiens
gccgcaaaccacacugg

SEQ ID NO: 1176937 - RNA, 19 nt, Homo sapiens
gccgcauucccugagucac

SEQ ID NO: 1176938 - RNA, 13 nt, Homo sapiens
gccgccagggaga

SEQ ID NO: 1176939 - RNA, 13 nt, Homo sapiens
gccgcuaccuccc

SEQ ID NO: 1176940 - RNA, 21 nt, Homo sapiens
gccggacacagcaccgugcca

SEQ ID NO: 1176941 - RNA, 20 nt, Homo sapiens
gccggacgcaggugcugcgg

SEQ ID NO: 1176942 - RNA, 18 nt, Homo sapiens
gccgggcaugauggugca

SEQ ID NO: 1176943 - RNA, 18 nt, Homo sapiens
gccgggucacccugugac

SEQ ID NO: 1176944 - RNA, 21 nt, Homo sapiens
gccguuccuuaugacuuuuca

SEQ ID NO: 1176945 - RNA, 20 nt, Homo sapiens
gccuaacacacuccaagaua

SEQ ID NO: 1176946 - RNA, 15 nt, Homo sapiens
gccuaagacauguaa

SEQ ID NO: 1176947 - RNA, 15 nt, Homo sapiens
gccuacugaccaaau

SEQ ID NO: 1176948 - RNA, 12 nt, Homo sapiens
gccuacuuccuu

SEQ ID NO: 1176949 - RNA, 14 nt, Homo sapiens
gccuagagcacucu

SEQ ID NO: 1176950 - RNA, 16 nt, Homo sapiens
gccuaucagcauuuua

SEQ ID NO: 1176951 - RNA, 16 nt, Homo sapiens
gccuaugcacauaugg

SEQ ID NO: 1176952 - RNA, 13 nt, Homo sapiens
gccucaacacuga

SEQ ID NO: 1176953 - RNA, 17 nt, Homo sapiens
gccucaagaggaaugaa

SEQ ID NO: 1176954 - RNA, 13 nt, Homo sapiens
gccucaagccauc

SEQ ID NO: 1176955 - RNA, 13 nt, Homo sapiens
gccucaaggacuu

SEQ ID NO: 1176956 - RNA, 13 nt, Homo sapiens
gccucacucagcu

SEQ ID NO: 1176957 - RNA, 16 nt, Homo sapiens
gccucacuucuuccau

SEQ ID NO: 1176958 - RNA, 15 nt, Homo sapiens
gccucagcaagccau

SEQ ID NO: 1176959 - RNA, 12 nt, Homo sapiens
gccucagcucau

SEQ ID NO: 1176960 - RNA, 13 nt, Homo sapiens
gccucagggccag

SEQ ID NO: 1176961 - RNA, 17 nt, Homo sapiens
gccucaguagcaucuca

SEQ ID NO: 1176962 - RNA, 14 nt, Homo sapiens
gccucauugcuugg

SEQ ID NO: 1176963 - RNA, 18 nt, Homo sapiens
gccuccaccgcugccuaa

SEQ ID NO: 1176964 - RNA, 18 nt, Homo sapiens
gccuccaucagcuaaaca

SEQ ID NO: 1176965 - RNA, 23 nt, Homo sapiens
gccuccccccacccgaagccaau

SEQ ID NO: 1176966 - RNA, 16 nt, Homo sapiens
gccucccgaguagcug

SEQ ID NO: 1176967 - RNA, 20 nt, Homo sapiens
gccucccuucccagugggcu

SEQ ID NO: 1176968 - RNA, 22 nt, Homo sapiens
gccuccuacucugagacaaaag

SEQ ID NO: 1176969 - RNA, 16 nt, Homo sapiens
gccuccugauguuugu

SEQ ID NO: 1176970 - RNA, 14 nt, Homo sapiens
gccuccugcaaagu

SEQ ID NO: 1176971 - RNA, 19 nt, Homo sapiens
gccuccuggcccaggugag

SEQ ID NO: 1176972 - RNA, 19 nt, Homo sapiens
gccuccuugcuuguuacau

SEQ ID NO: 1176973 - RNA, 16 nt, Homo sapiens
gccucgaaacacagaa

SEQ ID NO: 1176974 - RNA, 15 nt, Homo sapiens
gccucgaaaguguca

SEQ ID NO: 1176975 - RNA, 20 nt, Homo sapiens
gccucgacacagaguggacu

SEQ ID NO: 1176976 - RNA, 17 nt, Homo sapiens
gccucgcagccuccgga

SEQ ID NO: 1176977 - RNA, 18 nt, Homo sapiens
gccucgcagccuccggaa

SEQ ID NO: 1176978 - RNA, 20 nt, Homo sapiens
gccucuacuuugauucugau

SEQ ID NO: 1176979 - RNA, 18 nt, Homo sapiens
gccucucuguacacugcc

SEQ ID NO: 1176980 - RNA, 16 nt, Homo sapiens
gccucucuucacugcu

SEQ ID NO: 1176981 - RNA, 22 nt, Homo sapiens
gccucugacagcagccugugag

SEQ ID NO: 1176982 - RNA, 21 nt, Homo sapiens
gccucugcagucgcuugccaa

SEQ ID NO: 1176983 - RNA, 16 nt, Homo sapiens
gccucugccuugcccc

SEQ ID NO: 1176984 - RNA, 14 nt, Homo sapiens
gccucuguggcacu

SEQ ID NO: 1176985 - RNA, 14 nt, Homo sapiens
gccucuugcaaugc

SEQ ID NO: 1176986 - RNA, 15 nt, Homo sapiens
gccugacucuucccu

SEQ ID NO: 1176987 - RNA, 13 nt, Homo sapiens
gccugacugccca

SEQ ID NO: 1176988 - RNA, 15 nt, Homo sapiens
gccugagacacagcc

SEQ ID NO: 1176989 - RNA, 19 nt, Homo sapiens
gccugagacccaggacucc

SEQ ID NO: 1176990 - RNA, 16 nt, Homo sapiens
gccugaggugugugcc

SEQ ID NO: 1176991 - RNA, 18 nt, Homo sapiens
gccugauaggacccauau

SEQ ID NO: 1176992 - RNA, 14 nt, Homo sapiens
gccugcaccuggug

SEQ ID NO: 1176993 - RNA, 18 nt, Homo sapiens
gccugcccguaaacacgc

SEQ ID NO: 1176994 - RNA, 20 nt, Homo sapiens
gccugcccguaaacacgccu

SEQ ID NO: 1176995 - RNA, 19 nt, Homo sapiens
gccugcccugcuauuucag

SEQ ID NO: 1176996 - RNA, 19 nt, Homo sapiens
gccugcucgcccacuuccu

SEQ ID NO: 1176997 - RNA, 18 nt, Homo sapiens
gccugcuuugacgggcca

SEQ ID NO: 1176998 - RNA, 17 nt, Homo sapiens
gccuggaccagccucuc

SEQ ID NO: 1176999 - RNA, 22 nt, Homo sapiens
gccuggagggggagcaccagcg

SEQ ID NO: 1177000 - RNA, 23 nt, Homo sapiens
gccuggcuccaaacccucgaggc

SEQ ID NO: 1177001 - RNA, 22 nt, Homo sapiens
gccuggcuguggccuaaccugc

SEQ ID NO: 1177002 - RNA, 14 nt, Homo sapiens
gccugggcaacaga

SEQ ID NO: 1177003 - RNA, 17 nt, Homo sapiens
gccugggccucuacccc

SEQ ID NO: 1177004 - RNA, 13 nt, Homo sapiens
gccuguaauccca

SEQ ID NO: 1177005 - RNA, 22 nt, Homo sapiens
gccuguacccaguagaugccac

SEQ ID NO: 1177006 - RNA, 20 nt, Homo sapiens
gccugucugugaccugcauc

SEQ ID NO: 1177007 - RNA, 20 nt, Homo sapiens
gccugugagccccaggcacu

SEQ ID NO: 1177008 - RNA, 14 nt, Homo sapiens
gggccucagacgag

SEQ ID NO: 1177009 - RNA, 16 nt, Homo sapiens
gggccugcuccagacc

SEQ ID NO: 1177010 - RNA, 21 nt, Homo sapiens
gggcggggcuccugagggagc

SEQ ID NO: 1177011 - RNA, 19 nt, Homo sapiens
gggcgucaggggugcacag

SEQ ID NO: 1177012 - RNA, 14 nt, Homo sapiens
gggcuccugaggga

SEQ ID NO: 1177013 - RNA, 14 nt, Homo sapiens
gggcugagcuggga

SEQ ID NO: 1177014 - RNA, 11 nt, Homo sapiens
gggcugagggu

SEQ ID NO: 1177015 - RNA, 22 nt, Homo sapiens
gggcugccgagugcugugcacg

SEQ ID NO: 1177016 - RNA, 23 nt, Homo sapiens
gggcuggaggcccaggcugggaa

SEQ ID NO: 1177017 - RNA, 11 nt, Homo sapiens
gggcugggaug

SEQ ID NO: 1177018 - RNA, 21 nt, Homo sapiens
gggcugugauuacugcaauca

SEQ ID NO: 1177019 - RNA, 23 nt, Homo sapiens
gggcuguuuuuguuccugccuuu

SEQ ID NO: 1177020 - RNA, 20 nt, Homo sapiens
gggcuucugcguccaccagg

SEQ ID NO: 1177021 - RNA, 20 nt, Homo sapiens
gggcuugaauuugcaugucu

SEQ ID NO: 1177022 - RNA, 23 nt, Homo sapiens
gggcuugaauuugcaugucuaau

SEQ ID NO: 1177023 - RNA, 14 nt, Homo sapiens
ggggaacaagucaa

SEQ ID NO: 1177024 - RNA, 17 nt, Homo sapiens
ggggagacuucuuggcu

SEQ ID NO: 1177025 - RNA, 17 nt, Homo sapiens
ggggagauugaacuuuc

SEQ ID NO: 1177026 - RNA, 19 nt, Homo sapiens
ggggagccaggaaagaaga

SEQ ID NO: 1177027 - RNA, 15 nt, Homo sapiens
ggggagccuuagccg

SEQ ID NO: 1177028 - RNA, 17 nt, Homo sapiens
ggggagggggguuuugu

SEQ ID NO: 1177029 - RNA, 19 nt, Homo sapiens
ggggaugacaugcacucag

SEQ ID NO: 1177030 - RNA, 21 nt, Homo sapiens
ggggcagccacaccacugcca

SEQ ID NO: 1177031 - RNA, 14 nt, Homo sapiens
ggggcaggcaguga

SEQ ID NO: 1177032 - RNA, 16 nt, Homo sapiens
ggggcagggccacuca

SEQ ID NO: 1177033 - RNA, 15 nt, Homo sapiens
ggggccagauccagc

SEQ ID NO: 1177034 - RNA, 22 nt, Homo sapiens
ggggccagcauacuccgugagg

SEQ ID NO: 1177035 - RNA, 12 nt, Homo sapiens
ggggggguucuu

SEQ ID NO: 1177036 - RNA, 14 nt, Homo sapiens
gggggucaccaggu

SEQ ID NO: 1177037 - RNA, 13 nt, Homo sapiens
ggggguuccguga

SEQ ID NO: 1177038 - RNA, 13 nt, Homo sapiens
gggguagccugag

SEQ ID NO: 1177039 - RNA, 17 nt, Homo sapiens
gggguccccagggcugu

SEQ ID NO: 1177040 - RNA, 19 nt, Homo sapiens
ggggucuccucugcagcuc

SEQ ID NO: 1177041 - RNA, 13 nt, Homo sapiens
gggguucuccccc

SEQ ID NO: 1177042 - RNA, 20 nt, Homo sapiens
ggguauaguucaugucugcu

SEQ ID NO: 1177043 - RNA, 17 nt, Homo sapiens
ggguccugccugcagua

SEQ ID NO: 1177044 - RNA, 17 nt, Homo sapiens
gggucgggggagcaaaa

SEQ ID NO: 1177045 - RNA, 15 nt, Homo sapiens
gguugaaauauuaac

SEQ ID NO: 1177046 - RNA, 16 nt, Homo sapiens
gguugaggaauguguu

SEQ ID NO: 1177047 - RNA, 18 nt, Homo sapiens
gguugauugugcauggaa

SEQ ID NO: 1177048 - RNA, 17 nt, Homo sapiens
gguuguacuaugcuguu

SEQ ID NO: 1177049 - RNA, 18 nt, Homo sapiens
gguuguauaaagcaaaag

SEQ ID NO: 1177050 - RNA, 20 nt, Homo sapiens
gguuguccucacugcugauu

SEQ ID NO: 1177051 - RNA, 23 nt, Homo sapiens
gguuuacaacaaacacugugaug

SEQ ID NO: 1177052 - RNA, 18 nt, Homo sapiens
gguuuaguuuauuuacuc

SEQ ID NO: 1177053 - RNA, 17 nt, Homo sapiens
gguuuaucagcaaaaaa

SEQ ID NO: 1177054 - RNA, 21 nt, Homo sapiens
gguuucauuuauucauguuau

SEQ ID NO: 1177055 - RNA, 21 nt, Homo sapiens
gguuugccaaaauucauuucu

SEQ ID NO: 1177056 - RNA, 14 nt, Homo sapiens
gguuuuguacugga

SEQ ID NO: 1177057 - RNA, 20 nt, Homo sapiens
guaaaaaaggagacaguuua

SEQ ID NO: 1177058 - RNA, 22 nt, Homo sapiens
guaaaaaaguaugcuuguuaau

SEQ ID NO: 1177059 - RNA, 21 nt, Homo sapiens
guaaaaggccuucaaggaaga

SEQ ID NO: 1177060 - RNA, 12 nt, Homo sapiens
guaaaauggagg

SEQ ID NO: 1177061 - RNA, 18 nt, Homo sapiens
guaaaauguuuuagcaau

SEQ ID NO: 1177062 - RNA, 13 nt, Homo sapiens
guaaaauugaaag

SEQ ID NO: 1177063 - RNA, 15 nt, Homo sapiens
guaaacacagggaag

SEQ ID NO: 1177064 - RNA, 14 nt, Homo sapiens
guaaacuccuccac

SEQ ID NO: 1177065 - RNA, 13 nt, Homo sapiens
guaaacugugcac

SEQ ID NO: 1177066 - RNA, 14 nt, Homo sapiens
guaaacugugcacc

SEQ ID NO: 1177067 - RNA, 12 nt, Homo sapiens
guaaagaucuac

SEQ ID NO: 1177068 - RNA, 15 nt, Homo sapiens
guaaagcaaauauag

SEQ ID NO: 1177069 - RNA, 22 nt, Homo sapiens
guaaagcauuccaacaaagggu

SEQ ID NO: 1177070 - RNA, 20 nt, Homo sapiens
guaaagccguuguuuacuua

SEQ ID NO: 1177071 - RNA, 20 nt, Homo sapiens
guaaagccuuaaguggcaga

SEQ ID NO: 1177072 - RNA, 20 nt, Homo sapiens
guaaagggcgcaaagggcau

SEQ ID NO: 1177073 - RNA, 14 nt, Homo sapiens
guaaauacauaaaa

SEQ ID NO: 1177074 - RNA, 17 nt, Homo sapiens
guaaauccuaaagaagg

SEQ ID NO: 1177075 - RNA, 18 nt, Homo sapiens
guaaaucuagaguuuaua

SEQ ID NO: 1177076 - RNA, 13 nt, Homo sapiens
guaaaugcucaaa

SEQ ID NO: 1177077 - RNA, 22 nt, Homo sapiens
guaaauuaguguaccuauuaaa

SEQ ID NO: 1177078 - RNA, 19 nt, Homo sapiens
guaaauucagucuuuucuc

SEQ ID NO: 1177079 - RNA, 16 nt, Homo sapiens
cucauucaaucuccag

SEQ ID NO: 1177080 - RNA, 21 nt, Homo sapiens
cucauuggacccuuccauggu

SEQ ID NO: 1177081 - RNA, 21 nt, Homo sapiens
cucauuggugguagccaucaa

SEQ ID NO: 1177082 - RNA, 21 nt, Homo sapiens
cucauuuauagaugucaggaa

SEQ ID NO: 1177083 - RNA, 15 nt, Homo sapiens
cucauuuuaggcaaa

SEQ ID NO: 1177084 - RNA, 13 nt, Homo sapiens
cuccaaacccucg

SEQ ID NO: 1177085 - RNA, 17 nt, Homo sapiens
cuccaaagcauuuccca

SEQ ID NO: 1177086 - RNA, 17 nt, Homo sapiens
cuccaacucuucggaau

SEQ ID NO: 1177087 - RNA, 14 nt, Homo sapiens
cuccaaugccuacu

SEQ ID NO: 1177088 - RNA, 14 nt, Homo sapiens
cuccacaaagcaaa

SEQ ID NO: 1177089 - RNA, 20 nt, Homo sapiens
cuccacaaagcaaaggcagu

SEQ ID NO: 1177090 - RNA, 20 nt, Homo sapiens
cuccacaaaugggaaaacca

SEQ ID NO: 1177091 - RNA, 12 nt, Homo sapiens
cuccacagggca

SEQ ID NO: 1177092 - RNA, 23 nt, Homo sapiens
cuccaccaaccccgcggcccaga

SEQ ID NO: 1177093 - RNA, 22 nt, Homo sapiens
cuccacgggcucuccugggcca

SEQ ID NO: 1177094 - RNA, 22 nt, Homo sapiens
cuccacucaguugcaacuugga

SEQ ID NO: 1177095 - RNA, 23 nt, Homo sapiens
cuccacucaugugacucuuucca

SEQ ID NO: 1177096 - RNA, 18 nt, Homo sapiens
cuccacucucuaccagau

SEQ ID NO: 1177097 - RNA, 15 nt, Homo sapiens
cuccagagacaggaa

SEQ ID NO: 1177098 - RNA, 22 nt, Homo sapiens
cuccagaugagaguacacccca

SEQ ID NO: 1177099 - RNA, 16 nt, Homo sapiens
cuccagcaucaauucc

SEQ ID NO: 1177100 - RNA, 19 nt, Homo sapiens
cuccagccugggaggcaca

SEQ ID NO: 1177101 - RNA, 20 nt, Homo sapiens
cuccagcuugggcaacagag

SEQ ID NO: 1177102 - RNA, 19 nt, Homo sapiens
cuccaguaccuugcuucuu

SEQ ID NO: 1177103 - RNA, 15 nt, Homo sapiens
cuccaguaucuccaa

SEQ ID NO: 1177104 - RNA, 17 nt, Homo sapiens
cuccauagcgacacccu

SEQ ID NO: 1177105 - RNA, 14 nt, Homo sapiens
cuccauaugcugua

SEQ ID NO: 1177106 - RNA, 21 nt, Homo sapiens
cuccauaugcuguacaugaca

SEQ ID NO: 1177107 - RNA, 17 nt, Homo sapiens
cuccaucucucauccuc

SEQ ID NO: 1177108 - RNA, 15 nt, Homo sapiens
cuccaugagguacug

SEQ ID NO: 1177109 - RNA, 14 nt, Homo sapiens
cuccauggcaucuu

SEQ ID NO: 1177110 - RNA, 19 nt, Homo sapiens
cuccaugguggggccaaga

SEQ ID NO: 1177111 - RNA, 16 nt, Homo sapiens
cuccauguacuggcaa

SEQ ID NO: 1177112 - RNA, 21 nt, Homo sapiens
cuccauguagaagccacuauu

SEQ ID NO: 1177113 - RNA, 19 nt, Homo sapiens
cuccauuaaauuugguaca

SEQ ID NO: 1177114 - RNA, 21 nt, Homo sapiens
cuccauuucuacaaugcacau

SEQ ID NO: 1177115 - RNA, 20 nt, Homo sapiens
cucccaaagugcugggauua

SEQ ID NO: 1177116 - RNA, 13 nt, Homo sapiens
cucccacacaaga

SEQ ID NO: 1177117 - RNA, 12 nt, Homo sapiens
cucccacagaac

SEQ ID NO: 1177118 - RNA, 20 nt, Homo sapiens
cucccacggggaccacuggg

SEQ ID NO: 1177119 - RNA, 21 nt, Homo sapiens
cucccacugggguccagggag

SEQ ID NO: 1177120 - RNA, 20 nt, Homo sapiens
cucccagagugcugggauua

SEQ ID NO: 1177121 - RNA, 15 nt, Homo sapiens
cucccagccacagca

SEQ ID NO: 1177122 - RNA, 17 nt, Homo sapiens
cucccauccuaaucauc

SEQ ID NO: 1177123 - RNA, 11 nt, Homo sapiens
cuccccaacuc

SEQ ID NO: 1177124 - RNA, 14 nt, Homo sapiens
cuccccacccaaga

SEQ ID NO: 1177125 - RNA, 13 nt, Homo sapiens
cuccccaccucca

SEQ ID NO: 1177126 - RNA, 21 nt, Homo sapiens
cuccccagccuuugaucaggu

SEQ ID NO: 1177127 - RNA, 20 nt, Homo sapiens
cuccccagggaagacccuga

SEQ ID NO: 1177128 - RNA, 13 nt, Homo sapiens
cuccccaggggag

SEQ ID NO: 1177129 - RNA, 13 nt, Homo sapiens
cuccccagguucu

SEQ ID NO: 1177130 - RNA, 12 nt, Homo sapiens
cuccccauggag

SEQ ID NO: 1177131 - RNA, 15 nt, Homo sapiens
cucccccaaccaagg

SEQ ID NO: 1177132 - RNA, 18 nt, Homo sapiens
cuccccccaaucccucaa

SEQ ID NO: 1177133 - RNA, 15 nt, Homo sapiens
cuccccgagaguccu

SEQ ID NO: 1177134 - RNA, 21 nt, Homo sapiens
cuccccuguuucaaucacugu

SEQ ID NO: 1177135 - RNA, 15 nt, Homo sapiens
cucccguccauucca

SEQ ID NO: 1177136 - RNA, 14 nt, Homo sapiens
cucccgucucgccu

SEQ ID NO: 1177137 - RNA, 17 nt, Homo sapiens
cucccuaccguccuccu

SEQ ID NO: 1177138 - RNA, 16 nt, Homo sapiens
cucccuaccuugccuc

SEQ ID NO: 1177139 - RNA, 22 nt, Homo sapiens
cucccucacccaggcacugggc

SEQ ID NO: 1177140 - RNA, 18 nt, Homo sapiens
cucccuccagauauacuu

SEQ ID NO: 1177141 - RNA, 14 nt, Homo sapiens
cucccucuacuggg

SEQ ID NO: 1177142 - RNA, 20 nt, Homo sapiens
cucccugagagccacaggug

SEQ ID NO: 1177143 - RNA, 18 nt, Homo sapiens
cucccugcuuugcuguga

SEQ ID NO: 1177144 - RNA, 14 nt, Homo sapiens
cucccuguccuccu

SEQ ID NO: 1177145 - RNA, 22 nt, Homo sapiens
cuccgauuuugcucugucuccu

SEQ ID NO: 1177146 - RNA, 14 nt, Homo sapiens
cuccgcacuuggaa

SEQ ID NO: 1177147 - RNA, 15 nt, Homo sapiens
cuccgcuacuuccag

SEQ ID NO: 1177148 - RNA, 14 nt, Homo sapiens
cuccgucucaaaaa

SEQ ID NO: 1177149 - RNA, 20 nt, Homo sapiens
cuccuagccacccaccacac

SEQ ID NO: 1177150 - RNA, 24 nt, Homo sapiens
cuccuagggcuaugguguggacug

SEQ ID NO: 1177151 - RNA, 13 nt, Homo sapiens
cuccucacacucc

SEQ ID NO: 1177152 - RNA, 20 nt, Homo sapiens
cuccucagcggcuccagcuc

SEQ ID NO: 1177153 - RNA, 18 nt, Homo sapiens
cuccucccuaaugcucac

SEQ ID NO: 1177154 - RNA, 16 nt, Homo sapiens
cuccuccguggcacau

SEQ ID NO: 1177155 - RNA, 13 nt, Homo sapiens
cuccuccuagcca

SEQ ID NO: 1177156 - RNA, 22 nt, Homo sapiens
cuccucuccagcccugcagcua

SEQ ID NO: 1177157 - RNA, 16 nt, Homo sapiens
cuccugaagauacuua

SEQ ID NO: 1177158 - RNA, 15 nt, Homo sapiens
cuccugaagccacag

SEQ ID NO: 1177159 - RNA, 13 nt, Homo sapiens
cuccugaaguuag

SEQ ID NO: 1177160 - RNA, 20 nt, Homo sapiens
cuccugaccucaaguaaucc

SEQ ID NO: 1177161 - RNA, 13 nt, Homo sapiens
cuccugacuuuua

SEQ ID NO: 1177162 - RNA, 21 nt, Homo sapiens
cauuagaaaugagguagcuga

SEQ ID NO: 1177163 - RNA, 15 nt, Homo sapiens
cauuagcagcaucuu

SEQ ID NO: 1177164 - RNA, 15 nt, Homo sapiens
cauuagcccaagaga

SEQ ID NO: 1177165 - RNA, 18 nt, Homo sapiens
cauuagccggacucgaaa

SEQ ID NO: 1177166 - RNA, 14 nt, Homo sapiens
cauuauaugcaaau

SEQ ID NO: 1177167 - RNA, 20 nt, Homo sapiens
cauuauccuugcuaugauga

SEQ ID NO: 1177168 - RNA, 16 nt, Homo sapiens
cauuaugagaggcaau

SEQ ID NO: 1177169 - RNA, 15 nt, Homo sapiens
cauucacaccacaca

SEQ ID NO: 1177170 - RNA, 19 nt, Homo sapiens
cauucaggcaacgcacaaa

SEQ ID NO: 1177171 - RNA, 20 nt, Homo sapiens
cauucaucuuguguuuuaua

SEQ ID NO: 1177172 - RNA, 22 nt, Homo sapiens
cauucaugccaaguaucuuucc

SEQ ID NO: 1177173 - RNA, 23 nt, Homo sapiens
cauuccaagaauagcaucuguac

SEQ ID NO: 1177174 - RNA, 11 nt, Homo sapiens
cauucccugag

SEQ ID NO: 1177175 - RNA, 19 nt, Homo sapiens
cauuccugaagaaccaguc

SEQ ID NO: 1177176 - RNA, 20 nt, Homo sapiens
cauuccugauaugauuuaaa

SEQ ID NO: 1177177 - RNA, 13 nt, Homo sapiens
cauuccuguaacu

SEQ ID NO: 1177178 - RNA, 14 nt, Homo sapiens
cauuccuguucuuu

SEQ ID NO: 1177179 - RNA, 19 nt, Homo sapiens
cauucgucuuguuguuauu

SEQ ID NO: 1177180 - RNA, 21 nt, Homo sapiens
cauucuacguaucugcuacuu

SEQ ID NO: 1177181 - RNA, 16 nt, Homo sapiens
cauucucuagacaaaa

SEQ ID NO: 1177182 - RNA, 12 nt, Homo sapiens
cauucucugucu

SEQ ID NO: 1177183 - RNA, 20 nt, Homo sapiens
cauucugcauacuaaccuau

SEQ ID NO: 1177184 - RNA, 17 nt, Homo sapiens
cauucuucccuugaugg

SEQ ID NO: 1177185 - RNA, 20 nt, Homo sapiens
cauucuuucccaacaccucu

SEQ ID NO: 1177186 - RNA, 20 nt, Homo sapiens
cauucuuugcaauacugcuu

SEQ ID NO: 1177187 - RNA, 18 nt, Homo sapiens
cauugagccaguggugcu

SEQ ID NO: 1177188 - RNA, 17 nt, Homo sapiens
cauugagucauuauccu

SEQ ID NO: 1177189 - RNA, 22 nt, Homo sapiens
cauugauucaguauuacaaaua

SEQ ID NO: 1177190 - RNA, 17 nt, Homo sapiens
cauugcuaaacugauga

SEQ ID NO: 1177191 - RNA, 12 nt, Homo sapiens
cauugcuguuca

SEQ ID NO: 1177192 - RNA, 16 nt, Homo sapiens
cauugcuguucuacuu

SEQ ID NO: 1177193 - RNA, 15 nt, Homo sapiens
cauugcuuuccacug

SEQ ID NO: 1177194 - RNA, 13 nt, Homo sapiens
cauuggaggugaa

SEQ ID NO: 1177195 - RNA, 21 nt, Homo sapiens
cauuggaggugaacaagcaaa

SEQ ID NO: 1177196 - RNA, 14 nt, Homo sapiens
cauuggcuacugac

SEQ ID NO: 1177197 - RNA, 15 nt, Homo sapiens
cauugggcuacugua

SEQ ID NO: 1177198 - RNA, 17 nt, Homo sapiens
cauugggcuacuguaga

SEQ ID NO: 1177199 - RNA, 17 nt, Homo sapiens
cauugggucuauuccag

SEQ ID NO: 1177200 - RNA, 18 nt, Homo sapiens
cauuggugagaguccaac

SEQ ID NO: 1177201 - RNA, 14 nt, Homo sapiens
cauuguaaaccaca

SEQ ID NO: 1177202 - RNA, 14 nt, Homo sapiens
cauuguaaucacug

SEQ ID NO: 1177203 - RNA, 17 nt, Homo sapiens
cauuguagaagcagcau

SEQ ID NO: 1177204 - RNA, 15 nt, Homo sapiens
cauugucugcaaugg

SEQ ID NO: 1177205 - RNA, 15 nt, Homo sapiens
cauuguggagccaaa

SEQ ID NO: 1177206 - RNA, 18 nt, Homo sapiens
cauuguuagaaaucccug

SEQ ID NO: 1177207 - RNA, 15 nt, Homo sapiens
cauuguuggcgcuga

SEQ ID NO: 1177208 - RNA, 14 nt, Homo sapiens
cauuuaaaaaacau

SEQ ID NO: 1177209 - RNA, 17 nt, Homo sapiens
cauuuaauaucuuugau

SEQ ID NO: 1177210 - RNA, 22 nt, Homo sapiens
cauuuacucaccauauuugaau

SEQ ID NO: 1177211 - RNA, 22 nt, Homo sapiens
cauuuagaaaauagagcuuuua

SEQ ID NO: 1177212 - RNA, 16 nt, Homo sapiens
cauuuauagaugucag

SEQ ID NO: 1177213 - RNA, 15 nt, Homo sapiens
cauuucaaaucugua

SEQ ID NO: 1177214 - RNA, 20 nt, Homo sapiens
guauagccuauacugcauua

SEQ ID NO: 1177215 - RNA, 21 nt, Homo sapiens
guauaguuuuuagucugugua

SEQ ID NO: 1177216 - RNA, 14 nt, Homo sapiens
guauauauaaucua

SEQ ID NO: 1177217 - RNA, 23 nt, Homo sapiens
guauauuuugacgucacugauau

SEQ ID NO: 1177218 - RNA, 23 nt, Homo sapiens
guaucagaagcgcugauggucau

SEQ ID NO: 1177219 - RNA, 21 nt, Homo sapiens
guaucagaucuaucuugucaa

SEQ ID NO: 1177220 - RNA, 21 nt, Homo sapiens
guauccucugaccuacauacg

SEQ ID NO: 1177221 - RNA, 12 nt, Homo sapiens
guaucuuuccag

SEQ ID NO: 1177222 - RNA, 22 nt, Homo sapiens
guaugagacagaaacuaauccu

SEQ ID NO: 1177223 - RNA, 23 nt, Homo sapiens
guaugagauaggcacaugcaucu

SEQ ID NO: 1177224 - RNA, 17 nt, Homo sapiens
guauguaugagacagaa

SEQ ID NO: 1177225 - RNA, 15 nt, Homo sapiens
guauguccuuuucug

SEQ ID NO: 1177226 - RNA, 19 nt, Homo sapiens
guaugucuuggacacugua

SEQ ID NO: 1177227 - RNA, 16 nt, Homo sapiens
guaugugacuauuuau

SEQ ID NO: 1177228 - RNA, 14 nt, Homo sapiens
guaugugcuguaau

SEQ ID NO: 1177229 - RNA, 17 nt, Homo sapiens
guauguuuuacacugua

SEQ ID NO: 1177230 - RNA, 14 nt, Homo sapiens
guauuaaaagcuaa

SEQ ID NO: 1177231 - RNA, 18 nt, Homo sapiens
guauuaaauuagauaucu

SEQ ID NO: 1177232 - RNA, 14 nt, Homo sapiens
guauuaacuuguag

SEQ ID NO: 1177233 - RNA, 13 nt, Homo sapiens
guauuaaugcuau

SEQ ID NO: 1177234 - RNA, 24 nt, Homo sapiens
guauuacccuccuaauagucauac

SEQ ID NO: 1177235 - RNA, 17 nt, Homo sapiens
guauuacuaauuuccau

SEQ ID NO: 1177236 - RNA, 15 nt, Homo sapiens
guauuagccagucau

SEQ ID NO: 1177237 - RNA, 22 nt, Homo sapiens
guauucacaucauuugggauac

SEQ ID NO: 1177238 - RNA, 19 nt, Homo sapiens
guauucaugacuauggaua

SEQ ID NO: 1177239 - RNA, 19 nt, Homo sapiens
guauucuuugauguuaaca

SEQ ID NO: 1177240 - RNA, 14 nt, Homo sapiens
guauugcagccaaa

SEQ ID NO: 1177241 - RNA, 23 nt, Homo sapiens
guauuuaaaaauagaaacauauc

SEQ ID NO: 1177242 - RNA, 17 nt, Homo sapiens
guauuuaaggagaacca

SEQ ID NO: 1177243 - RNA, 19 nt, Homo sapiens
guauuuaauacacaaugca

SEQ ID NO: 1177244 - RNA, 22 nt, Homo sapiens
guauuuaauauuuucaaagaga

SEQ ID NO: 1177245 - RNA, 18 nt, Homo sapiens
guauuuauuuauguacuu

SEQ ID NO: 1177246 - RNA, 13 nt, Homo sapiens
guauuucaucucu

SEQ ID NO: 1177247 - RNA, 17 nt, Homo sapiens
guauuuuccugugccuu

SEQ ID NO: 1177248 - RNA, 16 nt, Homo sapiens
guauuuucuacuagcc

SEQ ID NO: 1177249 - RNA, 13 nt, Homo sapiens
gucaaaaaucugu

SEQ ID NO: 1177250 - RNA, 17 nt, Homo sapiens
gucaaaacaagacuccu

SEQ ID NO: 1177251 - RNA, 21 nt, Homo sapiens
gucaaaacccaccaaaaccaa

SEQ ID NO: 1177252 - RNA, 14 nt, Homo sapiens
gucaaaaggugccu

SEQ ID NO: 1177253 - RNA, 20 nt, Homo sapiens
gucaaauuccaaggaacuaa

SEQ ID NO: 1177254 - RNA, 16 nt, Homo sapiens
gucaacauuuccaaaa

SEQ ID NO: 1177255 - RNA, 19 nt, Homo sapiens
gucaacuucaacauuuaca

SEQ ID NO: 1177256 - RNA, 17 nt, Homo sapiens
gucaacuuucauuugaa

SEQ ID NO: 1177257 - RNA, 23 nt, Homo sapiens
gucaagcuagcaaaaaaacucuu

SEQ ID NO: 1177258 - RNA, 17 nt, Homo sapiens
gucaaggaaagggcagu

SEQ ID NO: 1177259 - RNA, 15 nt, Homo sapiens
gucaaggugcucaau

SEQ ID NO: 1177260 - RNA, 22 nt, Homo sapiens
gucacaaagaccuugcugauaa

SEQ ID NO: 1177261 - RNA, 19 nt, Homo sapiens
gucacagagugagacucca

SEQ ID NO: 1177262 - RNA, 20 nt, Homo sapiens
gucacagaucacagugucuu

SEQ ID NO: 1177263 - RNA, 21 nt, Homo sapiens
gucaccccucacugugacuga

SEQ ID NO: 1177264 - RNA, 14 nt, Homo sapiens
gucacucacaucca

SEQ ID NO: 1177265 - RNA, 13 nt, Homo sapiens
gucacuggcagcc

SEQ ID NO: 1177266 - RNA, 19 nt, Homo sapiens
gucacuucaugcaggugaa

SEQ ID NO: 1177267 - RNA, 14 nt, Homo sapiens
gucagacauggcca

SEQ ID NO: 1177268 - RNA, 14 nt, Homo sapiens
gucagaugucacau

SEQ ID NO: 1177269 - RNA, 13 nt, Homo sapiens
gucaggcugccag

SEQ ID NO: 1177270 - RNA, 22 nt, Homo sapiens
gucaggggcggggagggugaca

SEQ ID NO: 1177271 - RNA, 16 nt, Homo sapiens
gucagguaguugcaau

SEQ ID NO: 1177272 - RNA, 19 nt, Homo sapiens
gucagugcccaacuguuau

SEQ ID NO: 1177273 - RNA, 13 nt, Homo sapiens
gucauacauaccu

SEQ ID NO: 1177274 - RNA, 11 nt, Homo sapiens
gucaugcccuc

SEQ ID NO: 1177275 - RNA, 22 nt, Homo sapiens
gucauggccacacugugacaca

SEQ ID NO: 1177276 - RNA, 13 nt, Homo sapiens
gucauuacaagcu

SEQ ID NO: 1177277 - RNA, 19 nt, Homo sapiens
gucauuauccuugcuauga

SEQ ID NO: 1177278 - RNA, 23 nt, Homo sapiens
gucauuggaaacacugccuuugu

SEQ ID NO: 1177279 - RNA, 15 nt, Homo sapiens
gucauuggaggugaa

SEQ ID NO: 1177280 - RNA, 21 nt, Homo sapiens
gucauuguaaccucgugucua

SEQ ID NO: 1177281 - RNA, 11 nt, Homo sapiens
guccaaaaagc

SEQ ID NO: 1177282 - RNA, 17 nt, Homo sapiens
guccaacgccgccuugg

SEQ ID NO: 1177283 - RNA, 10 nt, Homo sapiens
guccacaggg

SEQ ID NO: 1177284 - RNA, 18 nt, Homo sapiens
guccacagggcagccuga

SEQ ID NO: 1177285 - RNA, 19 nt, Homo sapiens
guccacuuguggguccugg

SEQ ID NO: 1177286 - RNA, 16 nt, Homo sapiens
guccagagaacugaca

SEQ ID NO: 1177287 - RNA, 13 nt, Homo sapiens
guccagcaccuug

SEQ ID NO: 1177288 - RNA, 16 nt, Homo sapiens
guccagcucguucucu

SEQ ID NO: 1177289 - RNA, 20 nt, Homo sapiens
guccaggacugggucugacc

SEQ ID NO: 1177290 - RNA, 15 nt, Homo sapiens
guccaguugcagcug

SEQ ID NO: 1177291 - RNA, 17 nt, Homo sapiens
guccaguuugugcucua

SEQ ID NO: 1177292 - RNA, 14 nt, Homo sapiens
guccaucagccucc

SEQ ID NO: 1177293 - RNA, 17 nt, Homo sapiens
guccaugguccaucacu

SEQ ID NO: 1177294 - RNA, 18 nt, Homo sapiens
guccauuguggagccaaa

SEQ ID NO: 1177295 - RNA, 15 nt, Homo sapiens
guccauuucuaccaa

SEQ ID NO: 1177296 - RNA, 14 nt, Homo sapiens
guccauuuugcccu

SEQ ID NO: 1177297 - RNA, 18 nt, Homo sapiens
gucccagccgcacuggga

SEQ ID NO: 1177298 - RNA, 20 nt, Homo sapiens
gucccaggucuucuccaagg

SEQ ID NO: 1177299 - RNA, 21 nt, Homo sapiens
gucccaugaccuugggguaca

SEQ ID NO: 1177300 - RNA, 21 nt, Homo sapiens
guccccagggcugucaucuga

SEQ ID NO: 1177301 - RNA, 17 nt, Homo sapiens
guccccaguuugcagaa

SEQ ID NO: 1177302 - RNA, 16 nt, Homo sapiens
gucccccaaacauguu

SEQ ID NO: 1177303 - RNA, 18 nt, Homo sapiens
guccccuaaaccaaaaac

SEQ ID NO: 1177304 - RNA, 18 nt, Homo sapiens
gucccggggccagcacuu

SEQ ID NO: 1177305 - RNA, 20 nt, Homo sapiens
gucccggggccagcacuucc

SEQ ID NO: 1177306 - RNA, 17 nt, Homo sapiens
gucccguggcauuucaa

SEQ ID NO: 1177307 - RNA, 15 nt, Homo sapiens
gucccucacguuucu

SEQ ID NO: 1177308 - RNA, 13 nt, Homo sapiens
gucccucuuccau

SEQ ID NO: 1177309 - RNA, 14 nt, Homo sapiens
gucccucuuccauc

SEQ ID NO: 1177310 - RNA, 22 nt, Homo sapiens
gucccuguuuucccacgaggaa

SEQ ID NO: 1177311 - RNA, 22 nt, Homo sapiens
guccgugaauggucucugucaa

SEQ ID NO: 1177312 - RNA, 16 nt, Homo sapiens
guccucaggagcaaaa

SEQ ID NO: 1177313 - RNA, 12 nt, Homo sapiens
guccucagucca

SEQ ID NO: 1177314 - RNA, 16 nt, Homo sapiens
guccucaguccacugc

SEQ ID NO: 1177315 - RNA, 19 nt, Homo sapiens
guccucaguccacugcuga

SEQ ID NO: 1177316 - RNA, 20 nt, Homo sapiens
guccucaguccacugcugag

SEQ ID NO: 1177317 - RNA, 20 nt, Homo sapiens
guccuccaacaccaagcaca

SEQ ID NO: 1177318 - RNA, 15 nt, Homo sapiens
guccuccaagccagc

SEQ ID NO: 1177319 - RNA, 20 nt, Homo sapiens
guccucccaauuucagacuc

SEQ ID NO: 1177320 - RNA, 17 nt, Homo sapiens
guccucuucugcaucuu

SEQ ID NO: 1177321 - RNA, 15 nt, Homo sapiens
guccucuucugggcc

SEQ ID NO: 1177322 - RNA, 15 nt, Homo sapiens
guccucuuugugaua

SEQ ID NO: 1177323 - RNA, 18 nt, Homo sapiens
guccugaaaguaacucau

SEQ ID NO: 1177324 - RNA, 14 nt, Homo sapiens
guccugaagcugcu

SEQ ID NO: 1177325 - RNA, 22 nt, Homo sapiens
guccugaauguuucagaccaca

SEQ ID NO: 1177326 - RNA, 19 nt, Homo sapiens
guccuggaaucacauucuu

SEQ ID NO: 1177327 - RNA, 18 nt, Homo sapiens
guccuggcugcacucuug

SEQ ID NO: 1177328 - RNA, 11 nt, Homo sapiens
guccuuuaugu

SEQ ID NO: 1177329 - RNA, 20 nt, Homo sapiens
gucggaacccaagcuuagaa

SEQ ID NO: 1177330 - RNA, 19 nt, Homo sapiens
gucggucuccuuauccccc

SEQ ID NO: 1177331 - RNA, 20 nt, Homo sapiens
gucuaaaaaaggaauccucu

SEQ ID NO: 1177332 - RNA, 13 nt, Homo sapiens
gucuaaaaccuua

SEQ ID NO: 1177333 - RNA, 14 nt, Homo sapiens
gucuaaaauccugc

SEQ ID NO: 1177334 - RNA, 18 nt, Homo sapiens
gucuaauuuauuaaucua

SEQ ID NO: 1177335 - RNA, 18 nt, Homo sapiens
gucuacucagcauuugau

SEQ ID NO: 1177336 - RNA, 22 nt, Homo sapiens
gucuagacuauuaggugcaauu

SEQ ID NO: 1177337 - RNA, 15 nt, Homo sapiens
gucuagcaugccaac

SEQ ID NO: 1177338 - RNA, 12 nt, Homo sapiens
gucucacacucc

SEQ ID NO: 1177339 - RNA, 17 nt, Homo sapiens
gucucacagauugcugc

SEQ ID NO: 1177340 - RNA, 15 nt, Homo sapiens
gucucacauggugcu

SEQ ID NO: 1177341 - RNA, 17 nt, Homo sapiens
gucucaccuacccauga

SEQ ID NO: 1177342 - RNA, 20 nt, Homo sapiens
gucucacgucucccuaaaaa

SEQ ID NO: 1177343 - RNA, 22 nt, Homo sapiens
gucucacugugggaaggccagc

SEQ ID NO: 1177344 - RNA, 18 nt, Homo sapiens
gucuccaagggcaucacu

SEQ ID NO: 1177345 - RNA, 21 nt, Homo sapiens
gucuccaagggcaucacuggg

SEQ ID NO: 1177346 - RNA, 13 nt, Homo sapiens
gucucccagcuca

SEQ ID NO: 1177347 - RNA, 13 nt, Homo sapiens
gucucccuaaaaa

SEQ ID NO: 1177348 - RNA, 20 nt, Homo sapiens
gucucccuccgacuccagau

SEQ ID NO: 1177349 - RNA, 16 nt, Homo sapiens
ucaaaggcacacagca

SEQ ID NO: 1177350 - RNA, 14 nt, Homo sapiens
ucaaaguaauaagu

SEQ ID NO: 1177351 - RNA, 21 nt, Homo sapiens
ucaaauagagcuguucaacau

SEQ ID NO: 1177352 - RNA, 21 nt, Homo sapiens
ucaaauauuaucuuuguucuc

SEQ ID NO: 1177353 - RNA, 15 nt, Homo sapiens
ucaaaucugagggag

SEQ ID NO: 1177354 - RNA, 22 nt, Homo sapiens
ucaaaucuguaaucagcaauaa

SEQ ID NO: 1177355 - RNA, 18 nt, Homo sapiens
ucaaaucuguaauuacca

SEQ ID NO: 1177356 - RNA, 17 nt, Homo sapiens
ucaaaugcgaacacuau

SEQ ID NO: 1177357 - RNA, 19 nt, Homo sapiens
ucaaaugugaccaugugaa

SEQ ID NO: 1177358 - RNA, 19 nt, Homo sapiens
ucaaauuacuuugugaaua

SEQ ID NO: 1177359 - RNA, 23 nt, Homo sapiens
ucaaauuauuuccaagagagauu

SEQ ID NO: 1177360 - RNA, 22 nt, Homo sapiens
ucaaauuguccuauugugacuc

SEQ ID NO: 1177361 - RNA, 23 nt, Homo sapiens
ucaaauuuacugucuuaaaucag

SEQ ID NO: 1177362 - RNA, 15 nt, Homo sapiens
ucaacaaacagugua

SEQ ID NO: 1177363 - RNA, 22 nt, Homo sapiens
ucaacagcauuuucaagcaguu

SEQ ID NO: 1177364 - RNA, 17 nt, Homo sapiens
ucaacagugaagacaga

SEQ ID NO: 1177365 - RNA, 17 nt, Homo sapiens
ucaacaucacacaguau

SEQ ID NO: 1177366 - RNA, 13 nt, Homo sapiens
ucaacaucacuga

SEQ ID NO: 1177367 - RNA, 13 nt, Homo sapiens
ucaacaugaguca

SEQ ID NO: 1177368 - RNA, 18 nt, Homo sapiens
ucaaccaaugccaaaaaa

SEQ ID NO: 1177369 - RNA, 15 nt, Homo sapiens
ucaaccaauguagaa

SEQ ID NO: 1177370 - RNA, 17 nt, Homo sapiens
ucaaccaccuaggcaau

SEQ ID NO: 1177371 - RNA, 17 nt, Homo sapiens
ucaaccccagacacugg

SEQ ID NO: 1177372 - RNA, 22 nt, Homo sapiens
ucaaccccagggcuccagcacu

SEQ ID NO: 1177373 - RNA, 21 nt, Homo sapiens
ucaaccugcacuucauaucua

SEQ ID NO: 1177374 - RNA, 18 nt, Homo sapiens
ucaaccugggcaaagccu

SEQ ID NO: 1177375 - RNA, 21 nt, Homo sapiens
ucaacguuuuuggacacugug

SEQ ID NO: 1177376 - RNA, 19 nt, Homo sapiens
ucaacuaauguuguuuaca

SEQ ID NO: 1177377 - RNA, 20 nt, Homo sapiens
ucaacuggggggaccaaaua

SEQ ID NO: 1177378 - RNA, 16 nt, Homo sapiens
ucaacuuaaagugaau

SEQ ID NO: 1177379 - RNA, 17 nt, Homo sapiens
ucaacuuauuaacaauu

SEQ ID NO: 1177380 - RNA, 20 nt, Homo sapiens
ucaacuuugaauaaagaaua

SEQ ID NO: 1177381 - RNA, 15 nt, Homo sapiens
ucaacuuugauacuu

SEQ ID NO: 1177382 - RNA, 16 nt, Homo sapiens
ucaagaaaacuggaaa

SEQ ID NO: 1177383 - RNA, 16 nt, Homo sapiens
ucaagaagaaaguguu

SEQ ID NO: 1177384 - RNA, 19 nt, Homo sapiens
ucaagaauauaauauguga

SEQ ID NO: 1177385 - RNA, 13 nt, Homo sapiens
ucaagaaugccag

SEQ ID NO: 1177386 - RNA, 19 nt, Homo sapiens
ucaagacaagccuggccua

SEQ ID NO: 1177387 - RNA, 19 nt, Homo sapiens
ucaagcagcaaaauccuua

SEQ ID NO: 1177388 - RNA, 14 nt, Homo sapiens
ucaagcaguuucua

SEQ ID NO: 1177389 - RNA, 16 nt, Homo sapiens
ucaagccugugcaaug

SEQ ID NO: 1177390 - RNA, 21 nt, Homo sapiens
ucaagcucuccaaaggcucag

SEQ ID NO: 1177391 - RNA, 16 nt, Homo sapiens
ucaaggaaagggcagu

SEQ ID NO: 1177392 - RNA, 16 nt, Homo sapiens
ucaaggagauauauca

SEQ ID NO: 1177393 - RNA, 16 nt, Homo sapiens
ucaaggcggugcuuga

SEQ ID NO: 1177394 - RNA, 15 nt, Homo sapiens
ucaagggacaaggac

SEQ ID NO: 1177395 - RNA, 12 nt, Homo sapiens
ucaaggugacag

SEQ ID NO: 1177396 - RNA, 19 nt, Homo sapiens
ucaagguuuuagguucuaa

SEQ ID NO: 1177397 - RNA, 23 nt, Homo sapiens
ucaagucagcaacagagcaaaau

SEQ ID NO: 1177398 - RNA, 20 nt, Homo sapiens
ucaagucaucuauaguugau

SEQ ID NO: 1177399 - RNA, 15 nt, Homo sapiens
ucaagugauccuccc

SEQ ID NO: 1177400 - RNA, 11 nt, Homo sapiens
ucaaguuccag

SEQ ID NO: 1177401 - RNA, 15 nt, Homo sapiens
ucaaguuccagugca

SEQ ID NO: 1177402 - RNA, 20 nt, Homo sapiens
ucaaguuugaccagugcagu

SEQ ID NO: 1177403 - RNA, 20 nt, Homo sapiens
ucaauaauaaacauauuucc

SEQ ID NO: 1177404 - RNA, 18 nt, Homo sapiens
ucaauaauauauuuucug

SEQ ID NO: 1177405 - RNA, 15 nt, Homo sapiens
ucaauacagccugaa

SEQ ID NO: 1177406 - RNA, 18 nt, Homo sapiens
ucaauauccuuugccuca

SEQ ID NO: 1177407 - RNA, 21 nt, Homo sapiens
ucaauauuugauugguauucu

SEQ ID NO: 1177408 - RNA, 20 nt, Homo sapiens
ucaaucaaccugcacuucau

SEQ ID NO: 1177409 - RNA, 13 nt, Homo sapiens
ucaaucacuguau

SEQ ID NO: 1177410 - RNA, 18 nt, Homo sapiens
ucaaucuguaaaacuaag

SEQ ID NO: 1177411 - RNA, 17 nt, Homo sapiens
ucaaugccauugugcag

SEQ ID NO: 1177412 - RNA, 20 nt, Homo sapiens
ucaauguauuaauaucucca

SEQ ID NO: 1177413 - RNA, 17 nt, Homo sapiens
ucaaugugacauguugc

SEQ ID NO: 1177414 - RNA, 13 nt, Homo sapiens
ucaauuacaaagc

SEQ ID NO: 1177415 - RNA, 23 nt, Homo sapiens
ucaauucgacuucuuuccauggg

SEQ ID NO: 1177416 - RNA, 23 nt, Homo sapiens
ucaauuuacuuuuuaaacagugu

SEQ ID NO: 1177417 - RNA, 17 nt, Homo sapiens
ucaauuucaacauggac

SEQ ID NO: 1177418 - RNA, 14 nt, Homo sapiens
ucaauuucuacuuc

SEQ ID NO: 1177419 - RNA, 14 nt, Homo sapiens
ucaauuugccauug

SEQ ID NO: 1177420 - RNA, 16 nt, Homo sapiens
ucacaaauaaaagcca

SEQ ID NO: 1177421 - RNA, 19 nt, Homo sapiens
ucacaaccacucauucaaa

SEQ ID NO: 1177422 - RNA, 19 nt, Homo sapiens
ucacaaccugaaccuagga

SEQ ID NO: 1177423 - RNA, 18 nt, Homo sapiens
ucacaagaaguagcuuca

SEQ ID NO: 1177424 - RNA, 13 nt, Homo sapiens
ucacaauacuguu

SEQ ID NO: 1177425 - RNA, 14 nt, Homo sapiens
ucacacacauggaa

SEQ ID NO: 1177426 - RNA, 19 nt, Homo sapiens
ucacacguuuaaucccagc

SEQ ID NO: 1177427 - RNA, 10 nt, Homo sapiens
ucacacuccu

SEQ ID NO: 1177428 - RNA, 13 nt, Homo sapiens
ucacacuuuucag

SEQ ID NO: 1177429 - RNA, 18 nt, Homo sapiens
ucacagaagggccuggau

SEQ ID NO: 1177430 - RNA, 13 nt, Homo sapiens
ucacagaauguga

SEQ ID NO: 1177431 - RNA, 23 nt, Homo sapiens
ucacagaugcuguguaacagaac

SEQ ID NO: 1177432 - RNA, 22 nt, Homo sapiens
ucacagauuuuugguaguuucu

SEQ ID NO: 1177433 - RNA, 12 nt, Homo sapiens
ucacagcacuag

SEQ ID NO: 1177434 - RNA, 22 nt, Homo sapiens
ucacagcugauugggcaccuga

SEQ ID NO: 1177435 - RNA, 17 nt, Homo sapiens
ucacaggagcaaucaca

SEQ ID NO: 1177436 - RNA, 17 nt, Homo sapiens
ucacaggccccaggaaa

SEQ ID NO: 1177437 - RNA, 22 nt, Homo sapiens
ucacaggcuucugagcacagcu

SEQ ID NO: 1177438 - RNA, 16 nt, Homo sapiens
ucacagggacugaaaa

SEQ ID NO: 1177439 - RNA, 15 nt, Homo sapiens
ucacagugacacugg

SEQ ID NO: 1177440 - RNA, 15 nt, Homo sapiens
ucacaguuccucgcc

SEQ ID NO: 1177441 - RNA, 22 nt, Homo sapiens
ucacauaaaaaagaagcacuuu

SEQ ID NO: 1177442 - RNA, 17 nt, Homo sapiens
ucacaucacauuuaaau

SEQ ID NO: 1177443 - RNA, 18 nt, Homo sapiens
ucacaucagaacagacaa

SEQ ID NO: 1177444 - RNA, 20 nt, Homo sapiens
ucacaucaugcuguuuuauc

SEQ ID NO: 1177445 - RNA, 19 nt, Homo sapiens
ucacauccauucuucccuu

SEQ ID NO: 1177446 - RNA, 21 nt, Homo sapiens
ucacaucuauccacacuguca

SEQ ID NO: 1177447 - RNA, 16 nt, Homo sapiens
ucacaucucccccaua

SEQ ID NO: 1177448 - RNA, 20 nt, Homo sapiens
ucacauggaaucuacaugug

SEQ ID NO: 1177449 - RNA, 20 nt, Homo sapiens
ucacauggccuaugcacaua

SEQ ID NO: 1177450 - RNA, 23 nt, Homo sapiens
ucacauggccuaugcacauaugg

SEQ ID NO: 1177451 - RNA, 21 nt, Homo sapiens
ucacauggugcuacgccugca

SEQ ID NO: 1177452 - RNA, 19 nt, Homo sapiens
ucacauuucaccccaggcu

SEQ ID NO: 1177453 - RNA, 11 nt, Homo sapiens
ucacauuugcg

SEQ ID NO: 1177454 - RNA, 20 nt, Homo sapiens
ucacauuuuucuacagugaa

SEQ ID NO: 1177455 - RNA, 13 nt, Homo sapiens
ucaccaaaaccag

SEQ ID NO: 1177456 - RNA, 17 nt, Homo sapiens
ucaccacccaacaguga

SEQ ID NO: 1177457 - RNA, 16 nt, Homo sapiens
ucaccagcugcaaagu

SEQ ID NO: 1177458 - RNA, 19 nt, Homo sapiens
ucaccauguauuuuguaaa

SEQ ID NO: 1177459 - RNA, 20 nt, Homo sapiens
ucaccauuuggcaaugccau

SEQ ID NO: 1177460 - RNA, 22 nt, Homo sapiens
ucacccaaagccugucccagga

SEQ ID NO: 1177461 - RNA, 22 nt, Homo sapiens
ucacccaccccugcacaguuga

SEQ ID NO: 1177462 - RNA, 17 nt, Homo sapiens
ucacccacccuguggcu

SEQ ID NO: 1177463 - RNA, 19 nt, Homo sapiens
ucacccacccuguggcuca

SEQ ID NO: 1177464 - RNA, 15 nt, Homo sapiens
ucaccccagacuccu

SEQ ID NO: 1177465 - RNA, 17 nt, Homo sapiens
ucaccccagagccacac

SEQ ID NO: 1177466 - RNA, 17 nt, Homo sapiens
ucaccccucacugugac

SEQ ID NO: 1177467 - RNA, 17 nt, Homo sapiens
ucacccgacccgugcac

SEQ ID NO: 1177468 - RNA, 20 nt, Homo sapiens
ucacccuccacaaagcaaag

SEQ ID NO: 1177469 - RNA, 14 nt, Homo sapiens
ucacccuuugccua

SEQ ID NO: 1177470 - RNA, 20 nt, Homo sapiens
ucaccuaaacuuguacuuua

SEQ ID NO: 1177471 - RNA, 19 nt, Homo sapiens
ucaccucuuuguucuuccu

SEQ ID NO: 1177472 - RNA, 12 nt, Homo sapiens
ucaccugagguc

SEQ ID NO: 1177473 - RNA, 17 nt, Homo sapiens
ucaccugaggucgggag

SEQ ID NO: 1177474 - RNA, 18 nt, Homo sapiens
ucaccuguuugaaaccaa

SEQ ID NO: 1177475 - RNA, 14 nt, Homo sapiens
ucaccuuaucugga

SEQ ID NO: 1177476 - RNA, 13 nt, Homo sapiens
ucaccuucacuua

SEQ ID NO: 1177477 - RNA, 21 nt, Homo sapiens
ucaccuugaaagcaguagcau

SEQ ID NO: 1177478 - RNA, 18 nt, Homo sapiens
ucaccuuuguagcacuca

SEQ ID NO: 1177479 - RNA, 22 nt, Homo sapiens
ucacgauuccuucccacgguca

SEQ ID NO: 1177480 - RNA, 15 nt, Homo sapiens
ucacuaauacacagu

SEQ ID NO: 1177481 - RNA, 21 nt, Homo sapiens
ucacuacaaucgcuaccugac

SEQ ID NO: 1177482 - RNA, 15 nt, Homo sapiens
ucacucacaacacuu

SEQ ID NO: 1177483 - RNA, 16 nt, Homo sapiens
ucauauccauagauag

SEQ ID NO: 1177484 - RNA, 19 nt, Homo sapiens
ucauauguccccacuggca

SEQ ID NO: 1177485 - RNA, 20 nt, Homo sapiens
ucauauguccccacuggcau

SEQ ID NO: 1177486 - RNA, 18 nt, Homo sapiens
ucauaugugcaguauuua

SEQ ID NO: 1177487 - RNA, 18 nt, Homo sapiens
ucauauuugaaaaccaua

SEQ ID NO: 1177488 - RNA, 19 nt, Homo sapiens
ucaucaaugugacauuuac

SEQ ID NO: 1177489 - RNA, 18 nt, Homo sapiens
ucaucacaucaugcuguu

SEQ ID NO: 1177490 - RNA, 15 nt, Homo sapiens
ucggacuauguaauu

SEQ ID NO: 1177491 - RNA, 19 nt, Homo sapiens
ucggagcgcaaugccaucu

SEQ ID NO: 1177492 - RNA, 21 nt, Homo sapiens
ucggagcuggcccagggggcc

SEQ ID NO: 1177493 - RNA, 20 nt, Homo sapiens
ucgggacuugaaaaccacua

SEQ ID NO: 1177494 - RNA, 16 nt, Homo sapiens
ucgggaggcugaggca

SEQ ID NO: 1177495 - RNA, 16 nt, Homo sapiens
ucgggcgccccugugg

SEQ ID NO: 1177496 - RNA, 14 nt, Homo sapiens
ucguacuguucaca

SEQ ID NO: 1177497 - RNA, 14 nt, Homo sapiens
ucguauacccugga

SEQ ID NO: 1177498 - RNA, 16 nt, Homo sapiens
ucguaucucuagaaag

SEQ ID NO: 1177499 - RNA, 14 nt, Homo sapiens
ucgucaucuucccu

SEQ ID NO: 1177500 - RNA, 22 nt, Homo sapiens
ucgucugcgauuuuaucuguua

SEQ ID NO: 1177501 - RNA, 14 nt, Homo sapiens
ucgucugggcuccc

SEQ ID NO: 1177502 - RNA, 19 nt, Homo sapiens
ucgugggucagcucugagg

SEQ ID NO: 1177503 - RNA, 19 nt, Homo sapiens
ucguucaacuccacucacu

SEQ ID NO: 1177504 - RNA, 15 nt, Homo sapiens
ucguugccucugauu

SEQ ID NO: 1177505 - RNA, 12 nt, Homo sapiens
ucguuucauuca

SEQ ID NO: 1177506 - RNA, 15 nt, Homo sapiens
ucguuuuguucauau

SEQ ID NO: 1177507 - RNA, 22 nt, Homo sapiens
ucuaaaaaaggaauccucugug

SEQ ID NO: 1177508 - RNA, 17 nt, Homo sapiens
ucucuaauaaaaauaca

SEQ ID NO: 1177509 - RNA, 21 nt, Homo sapiens
ucucuacuccaugguucucaa

SEQ ID NO: 1177510 - RNA, 23 nt, Homo sapiens
ucucuagaaggaaacgucuuuau

SEQ ID NO: 1177511 - RNA, 12 nt, Homo sapiens
ucucucauuccc

SEQ ID NO: 1177512 - RNA, 19 nt, Homo sapiens
ucucucccucuuucuagcc

SEQ ID NO: 1177513 - RNA, 15 nt, Homo sapiens
ucucucccugcuuug

SEQ ID NO: 1177514 - RNA, 23 nt, Homo sapiens
ucucugaaaacaaugcugagaau

SEQ ID NO: 1177515 - RNA, 12 nt, Homo sapiens
ucucugaaaagc

SEQ ID NO: 1177516 - RNA, 14 nt, Homo sapiens
ucucugagcaguga

SEQ ID NO: 1177517 - RNA, 15 nt, Homo sapiens
ucucugagcagugaa

SEQ ID NO: 1177518 - RNA, 21 nt, Homo sapiens
ucucugaguccuggcccaaag

SEQ ID NO: 1177519 - RNA, 13 nt, Homo sapiens
ucucugccuuuga

SEQ ID NO: 1177520 - RNA, 12 nt, Homo sapiens
ucucugcucugc

SEQ ID NO: 1177521 - RNA, 20 nt, Homo sapiens
ucucuggccuguacccagua

SEQ ID NO: 1177522 - RNA, 20 nt, Homo sapiens
ucucuggcuguaaggcucua

SEQ ID NO: 1177523 - RNA, 18 nt, Homo sapiens
ucucuguaaccagacuuu

SEQ ID NO: 1177524 - RNA, 15 nt, Homo sapiens
ucucuugguaugcau

SEQ ID NO: 1177525 - RNA, 24 nt, Homo sapiens
ucucuugucacauggaaucuacau

SEQ ID NO: 1177526 - RNA, 14 nt, Homo sapiens
ucucuuuaaucuca

SEQ ID NO: 1177527 - RNA, 15 nt, Homo sapiens
ucugaaacuucccaa

SEQ ID NO: 1177528 - RNA, 22 nt, Homo sapiens
ucugaagcucgcauccagacag

SEQ ID NO: 1177529 - RNA, 15 nt, Homo sapiens
ucugaagugcugcuc

SEQ ID NO: 1177530 - RNA, 20 nt, Homo sapiens
ucugaauaaauacccauuga

SEQ ID NO: 1177531 - RNA, 22 nt, Homo sapiens
ucugaaucgagauguccauagu

SEQ ID NO: 1177532 - RNA, 18 nt, Homo sapiens
ucugaauuugagauacaa

SEQ ID NO: 1177533 - RNA, 20 nt, Homo sapiens
ucugaauuugcaaaguacug

SEQ ID NO: 1177534 - RNA, 22 nt, Homo sapiens
ucugaauuugcaaaguacugua

SEQ ID NO: 1177535 - RNA, 15 nt, Homo sapiens
ucugacccacagccu

SEQ ID NO: 1177536 - RNA, 22 nt, Homo sapiens
ucugacccagugcccccacuga

SEQ ID NO: 1177537 - RNA, 19 nt, Homo sapiens
ucugagaaacucuacaugu

SEQ ID NO: 1177538 - RNA, 20 nt, Homo sapiens
ucugagcacagcugcauuaa

SEQ ID NO: 1177539 - RNA, 13 nt, Homo sapiens
ucugagcauuuaa

SEQ ID NO: 1177540 - RNA, 13 nt, Homo sapiens
ucugagcugugca

SEQ ID NO: 1177541 - RNA, 18 nt, Homo sapiens
ucugagcuucuaaacuga

SEQ ID NO: 1177542 - RNA, 17 nt, Homo sapiens
ucugaggaugcauucga

SEQ ID NO: 1177543 - RNA, 16 nt, Homo sapiens
ucugaggccucagagu

SEQ ID NO: 1177544 - RNA, 16 nt, Homo sapiens
ucugagugucucugcc

SEQ ID NO: 1177545 - RNA, 22 nt, Homo sapiens
ucugauaagagaaucaacauuu

SEQ ID NO: 1177546 - RNA, 15 nt, Homo sapiens
ucugauaaugcucac

SEQ ID NO: 1177547 - RNA, 17 nt, Homo sapiens
ucugauauacaaaggga

SEQ ID NO: 1177548 - RNA, 14 nt, Homo sapiens
ucugaucacauugc

SEQ ID NO: 1177549 - RNA, 22 nt, Homo sapiens
ucugaucauuucaaaauuaagu

SEQ ID NO: 1177550 - RNA, 14 nt, Homo sapiens
ucugauguuaacca

SEQ ID NO: 1177551 - RNA, 17 nt, Homo sapiens
ucugauuccauccugug

SEQ ID NO: 1177552 - RNA, 15 nt, Homo sapiens
ucugauuuucuccua

SEQ ID NO: 1177553 - RNA, 22 nt, Homo sapiens
ucugcaaauggcuuagcuacuu

SEQ ID NO: 1177554 - RNA, 14 nt, Homo sapiens
ucugcaacugaaau

SEQ ID NO: 1177555 - RNA, 22 nt, Homo sapiens
ucugcaagaugucaagggccaa

SEQ ID NO: 1177556 - RNA, 13 nt, Homo sapiens
ucugcaaugacug

SEQ ID NO: 1177557 - RNA, 15 nt, Homo sapiens
ucugcacaugucuug

SEQ ID NO: 1177558 - RNA, 23 nt, Homo sapiens
ucugcaccccccugggcugagag

SEQ ID NO: 1177559 - RNA, 23 nt, Homo sapiens
ucugcacuuauaagaaagaucaa

SEQ ID NO: 1177560 - RNA, 17 nt, Homo sapiens
ucugcagacuggcaguc

SEQ ID NO: 1177561 - RNA, 19 nt, Homo sapiens
ucugcaggugagcagacag

SEQ ID NO: 1177562 - RNA, 22 nt, Homo sapiens
ucugcagucgcuugccaaagca

SEQ ID NO: 1177563 - RNA, 19 nt, Homo sapiens
ucugcauugcccagucuuu

SEQ ID NO: 1177564 - RNA, 17 nt, Homo sapiens
ucugccaagauacuuga

SEQ ID NO: 1177565 - RNA, 17 nt, Homo sapiens
ucugccauaucagugaa

SEQ ID NO: 1177566 - RNA, 21 nt, Homo sapiens
ucugcccuugccaacggagag

SEQ ID NO: 1177567 - RNA, 14 nt, Homo sapiens
ucugccgcuaccuc

SEQ ID NO: 1177568 - RNA, 14 nt, Homo sapiens
ucugccuuagccua

SEQ ID NO: 1177569 - RNA, 14 nt, Homo sapiens
ucugccuugccuuu

SEQ ID NO: 1177570 - RNA, 20 nt, Homo sapiens
ucugcgugucaccugugcuu

SEQ ID NO: 1177571 - RNA, 13 nt, Homo sapiens
ucugcuacugugu

SEQ ID NO: 1177572 - RNA, 15 nt, Homo sapiens
ucugcuacuguguca

SEQ ID NO: 1177573 - RNA, 17 nt, Homo sapiens
ucugcuccugaagcccu

SEQ ID NO: 1177574 - RNA, 17 nt, Homo sapiens
ucugcugaagacuugcc

SEQ ID NO: 1177575 - RNA, 23 nt, Homo sapiens
ucugcuggaaacagacucgauuc

SEQ ID NO: 1177576 - RNA, 20 nt, Homo sapiens
ucugcugucuaaccugugac

SEQ ID NO: 1177577 - RNA, 20 nt, Homo sapiens
ucugcuuucuauuaccccuc

SEQ ID NO: 1177578 - RNA, 16 nt, Homo sapiens
ucugcuuucuguucau

SEQ ID NO: 1177579 - RNA, 14 nt, Homo sapiens
ucuggaaauagccc

SEQ ID NO: 1177580 - RNA, 18 nt, Homo sapiens
ucuggaagaucugcaaac

SEQ ID NO: 1177581 - RNA, 14 nt, Homo sapiens
ucuggaagucaucu

SEQ ID NO: 1177582 - RNA, 16 nt, Homo sapiens
ucuggaagucaucuca

SEQ ID NO: 1177583 - RNA, 13 nt, Homo sapiens
ucuggaaguccaa

SEQ ID NO: 1177584 - RNA, 18 nt, Homo sapiens
ucuggaaucuggagacca

SEQ ID NO: 1177585 - RNA, 14 nt, Homo sapiens
ucuggacugcacac

SEQ ID NO: 1177586 - RNA, 15 nt, Homo sapiens
ucuggaggcaaucaa

SEQ ID NO: 1177587 - RNA, 17 nt, Homo sapiens
ucuggaguuugagacca

SEQ ID NO: 1177588 - RNA, 19 nt, Homo sapiens
ucuggaucugcugcaucca

SEQ ID NO: 1177589 - RNA, 17 nt, Homo sapiens
ucugggaacccugugca

SEQ ID NO: 1177590 - RNA, 18 nt, Homo sapiens
ucugggagggucggggga

SEQ ID NO: 1177591 - RNA, 14 nt, Homo sapiens
ucugggccagguug

SEQ ID NO: 1177592 - RNA, 13 nt, Homo sapiens
ucugggccaguga

SEQ ID NO: 1177593 - RNA, 21 nt, Homo sapiens
ucugggccuucucaccacaga

SEQ ID NO: 1177594 - RNA, 20 nt, Homo sapiens
ucugggcucaagcaauccuc

SEQ ID NO: 1177595 - RNA, 11 nt, Homo sapiens
ucugggcuccc

SEQ ID NO: 1177596 - RNA, 17 nt, Homo sapiens
ucuggggagcucaggaa

SEQ ID NO: 1177597 - RNA, 21 nt, Homo sapiens
ucuggggggacccagugcaga

SEQ ID NO: 1177598 - RNA, 22 nt, Homo sapiens
ucuggggggacccagugcagaa

SEQ ID NO: 1177599 - RNA, 13 nt, Homo sapiens
ucugggucuacaa

SEQ ID NO: 1177600 - RNA, 12 nt, Homo sapiens
ucugggugcaug

SEQ ID NO: 1177601 - RNA, 15 nt, Homo sapiens
ucugguaaugaagca

SEQ ID NO: 1177602 - RNA, 14 nt, Homo sapiens
ucuguaaccaccuc

SEQ ID NO: 1177603 - RNA, 18 nt, Homo sapiens
ucuguaaggaacuggaac

SEQ ID NO: 1177604 - RNA, 13 nt, Homo sapiens
ucuguacuguuac

SEQ ID NO: 1177605 - RNA, 13 nt, Homo sapiens
ucuguacuugguc

SEQ ID NO: 1177606 - RNA, 21 nt, Homo sapiens
ucuguacuugguccaacugca

SEQ ID NO: 1177607 - RNA, 18 nt, Homo sapiens
ucuguagcuuucuggaau

SEQ ID NO: 1177608 - RNA, 16 nt, Homo sapiens
ucuguauaugauucuc

SEQ ID NO: 1177609 - RNA, 23 nt, Homo sapiens
ucuguauuaaaauuagaaucuga

SEQ ID NO: 1177610 - RNA, 19 nt, Homo sapiens
ucugucaccacaucuuguc

SEQ ID NO: 1177611 - RNA, 17 nt, Homo sapiens
ucugucagucacagcca

SEQ ID NO: 1177612 - RNA, 15 nt, Homo sapiens
ucugucauuuacaca

SEQ ID NO: 1177613 - RNA, 18 nt, Homo sapiens
ucuguccguuuacuccaa

SEQ ID NO: 1177614 - RNA, 17 nt, Homo sapiens
ucugucuagcaugccaa

SEQ ID NO: 1177615 - RNA, 18 nt, Homo sapiens
ucugucuagcaugccaac

SEQ ID NO: 1177616 - RNA, 22 nt, Homo sapiens
ucugucuccucaguuaaguguu

SEQ ID NO: 1177617 - RNA, 12 nt, Homo sapiens
ucugucuugggc

SEQ ID NO: 1177618 - RNA, 19 nt, Homo sapiens
ucugucuuguucacugcag

SEQ ID NO: 1177619 - RNA, 19 nt, Homo sapiens
ucugugacccacuucucau

SEQ ID NO: 1177620 - RNA, 16 nt, Homo sapiens
ucugugaugcucccaa

SEQ ID NO: 1177621 - RNA, 18 nt, Homo sapiens
ucugugccugucugucca

SEQ ID NO: 1177622 - RNA, 21 nt, Homo sapiens
ucugugcucaggacucagaag

SEQ ID NO: 1177623 - RNA, 16 nt, Homo sapiens
ucugugcucauguuug

SEQ ID NO: 1177624 - RNA, 17 nt, Homo sapiens
ucuguggaccacugcau

SEQ ID NO: 1177625 - RNA, 16 nt, Homo sapiens
ucuguguaagcuuuua

SEQ ID NO: 1177626 - RNA, 13 nt, Homo sapiens
ugccauaucagug

SEQ ID NO: 1177627 - RNA, 15 nt, Homo sapiens
ugccauaucagugaa

SEQ ID NO: 1177628 - RNA, 23 nt, Homo sapiens
ugccauggucaccaaacaggaag

SEQ ID NO: 1177629 - RNA, 17 nt, Homo sapiens
ugccauguuuuugccaa

SEQ ID NO: 1177630 - RNA, 23 nt, Homo sapiens
ugccauuauuuaauaaaugacaa

SEQ ID NO: 1177631 - RNA, 21 nt, Homo sapiens
ugccauugcagauucgaguca

SEQ ID NO: 1177632 - RNA, 14 nt, Homo sapiens
ugugccgcacucug

SEQ ID NO: 1177633 - RNA, 19 nt, Homo sapiens
ugugccuagugauguagaa

SEQ ID NO: 1177634 - RNA, 23 nt, Homo sapiens
ugugccugucuguuacacuggag

SEQ ID NO: 1177635 - RNA, 18 nt, Homo sapiens
ugugcgcacacaugcuuc

SEQ ID NO: 1177636 - RNA, 21 nt, Homo sapiens
ugugcggccuggucuaccugu

SEQ ID NO: 1177637 - RNA, 21 nt, Homo sapiens
uuaaaaacaaaacaucuuugu

SEQ ID NO: 1177638 - RNA, 23 nt, Homo sapiens
uuaaaaauaaaaaacauauacaa

SEQ ID NO: 1177639 - RNA, 13 nt, Homo sapiens
uuaaaacagaagc

SEQ ID NO: 1177640 - RNA, 19 nt, Homo sapiens
uuaaaaccauaucagagau

SEQ ID NO: 1177641 - RNA, 17 nt, Homo sapiens
uuaaaacuugaaguagg

SEQ ID NO: 1177642 - RNA, 15 nt, Homo sapiens
uuaaaacuuugccau

SEQ ID NO: 1177643 - RNA, 12 nt, Homo sapiens
uuaaaagacaaa

SEQ ID NO: 1177644 - RNA, 16 nt, Homo sapiens
uuacgaucuguuucca

SEQ ID NO: 1177645 - RNA, 17 nt, Homo sapiens
uuacuaaaauggcagcu

SEQ ID NO: 1177646 - RNA, 12 nt, Homo sapiens
uuacuaaauccu

SEQ ID NO: 1177647 - RNA, 17 nt, Homo sapiens
uuacuaauuauacuacu

SEQ ID NO: 1177648 - RNA, 15 nt, Homo sapiens
uuacuagcuucagaa

SEQ ID NO: 1177649 - RNA, 11 nt, Homo sapiens
uuacucagagc

SEQ ID NO: 1177650 - RNA, 20 nt, Homo sapiens
uuacucaucgggcccaggga

SEQ ID NO: 1177651 - RNA, 15 nt, Homo sapiens
uuacuccagugccaa

SEQ ID NO: 1177652 - RNA, 20 nt, Homo sapiens
uuacucccuacacugaugca

SEQ ID NO: 1177653 - RNA, 12 nt, Homo sapiens
uucaaagcauuu

SEQ ID NO: 1177654 - RNA, 22 nt, Homo sapiens
uucaaagccauauggacacugu

SEQ ID NO: 1177655 - RNA, 15 nt, Homo sapiens
uucaaaucuguaauu

SEQ ID NO: 1177656 - RNA, 18 nt, Homo sapiens
uucaacaguuuuugcuaa

SEQ ID NO: 1177657 - RNA, 18 nt, Homo sapiens
uucaacauguaccucacc

SEQ ID NO: 1177658 - RNA, 23 nt, Homo sapiens
uucaacuuggaaaugacacagac

SEQ ID NO: 1177659 - RNA, 20 nt, Homo sapiens
uucaagacuugauacugcaa

SEQ ID NO: 1177660 - RNA, 19 nt, Homo sapiens
uucaagagucuaaacccca

SEQ ID NO: 1177661 - RNA, 15 nt, Homo sapiens
uucaagccugugcaa

SEQ ID NO: 1177662 - RNA, 12 nt, Homo sapiens
uucaagcucucc

SEQ ID NO: 1177663 - RNA, 18 nt, Homo sapiens
uucaagggacccaugagu

SEQ ID NO: 1177664 - RNA, 20 nt, Homo sapiens
uucaagugaguggcaugugg

SEQ ID NO: 1177665 - RNA, 18 nt, Homo sapiens
uuccuucuuucauuuuaa

SEQ ID NO: 1177666 - RNA, 21 nt, Homo sapiens
uuccuugaauguggcuugaga

SEQ ID NO: 1177667 - RNA, 20 nt, Homo sapiens
uuccuuuuuaaccauuccaa

SEQ ID NO: 1177668 - RNA, 15 nt, Homo sapiens
uucgaaugacacugu

SEQ ID NO: 1177669 - RNA, 16 nt, Homo sapiens
uucgaaugacacuguu

SEQ ID NO: 1177670 - RNA, 13 nt, Homo sapiens
uucgagggguccu

SEQ ID NO: 1177671 - RNA, 17 nt, Homo sapiens
uucgauguacagucuca

SEQ ID NO: 1177672 - RNA, 15 nt, Homo sapiens
uucgcagcucuggcc

SEQ ID NO: 1177673 - RNA, 13 nt, Homo sapiens
uucggagcucuuc

SEQ ID NO: 1177674 - RNA, 21 nt, Homo sapiens
uucggggagggcgccuagucc

SEQ ID NO: 1177675 - RNA, 15 nt, Homo sapiens
uucggguuggcaaaa

SEQ ID NO: 1177676 - RNA, 14 nt, Homo sapiens
uucggucuuuccca

SEQ ID NO: 1177677 - RNA, 14 nt, Homo sapiens
uucgguuccagaca

SEQ ID NO: 1177678 - RNA, 13 nt, Homo sapiens
uucguaguuuuca

SEQ ID NO: 1177679 - RNA, 21 nt, Homo sapiens
uucuaaaaucuuauaguucua

SEQ ID NO: 1177680 - RNA, 17 nt, Homo sapiens
uucuaaagcucugacau

SEQ ID NO: 1177681 - RNA, 15 nt, Homo sapiens
uucuaaaguucuaag

SEQ ID NO: 1177682 - RNA, 14 nt, Homo sapiens
uucuaacaguacca

SEQ ID NO: 1177683 - RNA, 20 nt, Homo sapiens
uucuaacucauauguuccca

SEQ ID NO: 1177684 - RNA, 16 nt, Homo sapiens
uucuaacuccagugaa

SEQ ID NO: 1177685 - RNA, 23 nt, Homo sapiens
uucuaagacucaaauguucuaag

SEQ ID NO: 1177686 - RNA, 21 nt, Homo sapiens
uucuaagacuuacucuaagau

SEQ ID NO: 1177687 - RNA, 17 nt, Homo sapiens
uucuaagcaaaauugcu

SEQ ID NO: 1177688 - RNA, 16 nt, Homo sapiens
uucuaagccuauauga

SEQ ID NO: 1177689 - RNA, 17 nt, Homo sapiens
uucuaaggcucugagag

SEQ ID NO: 1177690 - RNA, 21 nt, Homo sapiens
uucuaaggcucugagagucua

SEQ ID NO: 1177691 - RNA, 17 nt, Homo sapiens
uucuaagucacaggaug

SEQ ID NO: 1177692 - RNA, 16 nt, Homo sapiens
uucuaaguuucuaaga

SEQ ID NO: 1177693 - RNA, 16 nt, Homo sapiens
uucuacacauacaugu

SEQ ID NO: 1177694 - RNA, 22 nt, Homo sapiens
uucuacagugaauuuaaucaaa

SEQ ID NO: 1177695 - RNA, 17 nt, Homo sapiens
uucuacaucauuaacca

SEQ ID NO: 1177696 - RNA, 13 nt, Homo sapiens
uucuaccaaauga

SEQ ID NO: 1177697 - RNA, 19 nt, Homo sapiens
uucuaccaaggcauaucau

SEQ ID NO: 1177698 - RNA, 22 nt, Homo sapiens
uucuacgcugccucaacacuga

SEQ ID NO: 1177699 - RNA, 13 nt, Homo sapiens
uucuaggcaaaag

SEQ ID NO: 1177700 - RNA, 16 nt, Homo sapiens
uucuagggcugggaaa

SEQ ID NO: 1177701 - RNA, 20 nt, Homo sapiens
uucuaguguaaaucaugcaa

SEQ ID NO: 1177702 - RNA, 22 nt, Homo sapiens
uucuaguguaaaucaugcaagc

SEQ ID NO: 1177703 - RNA, 19 nt, Homo sapiens
uucuaguucagcugcccca

SEQ ID NO: 1177704 - RNA, 15 nt, Homo sapiens
uucuaguucugccag

SEQ ID NO: 1177705 - RNA, 16 nt, Homo sapiens
uucuaguuugcauucc

SEQ ID NO: 1177706 - RNA, 24 nt, Homo sapiens
uucuaguuuugucaaacuguagaa

SEQ ID NO: 1177707 - RNA, 14 nt, Homo sapiens
uucuauaguucuag

SEQ ID NO: 1177708 - RNA, 15 nt, Homo sapiens
uucuaucaaauauua

SEQ ID NO: 1177709 - RNA, 16 nt, Homo sapiens
uucuaucccuuaccug

SEQ ID NO: 1177710 - RNA, 12 nt, Homo sapiens
uucuauuccuau

SEQ ID NO: 1177711 - RNA, 18 nt, Homo sapiens
uucuauucucuuuuacug

SEQ ID NO: 1177712 - RNA, 14 nt, Homo sapiens
uucucaaaauuccu

SEQ ID NO: 1177713 - RNA, 15 nt, Homo sapiens
uucucaaguucuaag

SEQ ID NO: 1177714 - RNA, 18 nt, Homo sapiens
uucucacauaacagagua

SEQ ID NO: 1177715 - RNA, 15 nt, Homo sapiens
uucucaccagcugca

SEQ ID NO: 1177716 - RNA, 16 nt, Homo sapiens
uucucacuccaccacc

SEQ ID NO: 1177717 - RNA, 21 nt, Homo sapiens
uucucaguaguuguccgugau

SEQ ID NO: 1177718 - RNA, 15 nt, Homo sapiens
uucucauaaauuucu

SEQ ID NO: 1177719 - RNA, 18 nt, Homo sapiens
uucucauaacucugugau

SEQ ID NO: 1177720 - RNA, 19 nt, Homo sapiens
uucucauaacucugugauc

SEQ ID NO: 1177721 - RNA, 19 nt, Homo sapiens
uucucaucuuuuuacuaaa

SEQ ID NO: 1177722 - RNA, 16 nt, Homo sapiens
uucuccagaacccauu

SEQ ID NO: 1177723 - RNA, 20 nt, Homo sapiens
uucuccauacgcacugguau

SEQ ID NO: 1177724 - RNA, 17 nt, Homo sapiens
uucucccuucucucacc

SEQ ID NO: 1177725 - RNA, 14 nt, Homo sapiens
uucuccuggucacu

SEQ ID NO: 1177726 - RNA, 22 nt, Homo sapiens
uucuccuuggaggacaguggga

SEQ ID NO: 1177727 - RNA, 15 nt, Homo sapiens
uucucgcucccgcca

SEQ ID NO: 1177728 - RNA, 22 nt, Homo sapiens
uucucuacuccaugguucucaa

SEQ ID NO: 1177729 - RNA, 22 nt, Homo sapiens
uucucucagcucccaggccaac

SEQ ID NO: 1177730 - RNA, 18 nt, Homo sapiens
uucucucauaggcaaguc

SEQ ID NO: 1177731 - RNA, 21 nt, Homo sapiens
uucucucuuccauaggacaaa

SEQ ID NO: 1177732 - RNA, 21 nt, Homo sapiens
uucucuggcucuuguccaucu

SEQ ID NO: 1177733 - RNA, 16 nt, Homo sapiens
uucucugugucuaaga

SEQ ID NO: 1177734 - RNA, 21 nt, Homo sapiens
uucucugugucuaagauucua

SEQ ID NO: 1177735 - RNA, 17 nt, Homo sapiens
uucugaaaagcaccauu

SEQ ID NO: 1177736 - RNA, 23 nt, Homo sapiens
uucugaaaggguuuuuaaucucc

SEQ ID NO: 1177737 - RNA, 14 nt, Homo sapiens
uucugaaaugugca

SEQ ID NO: 1177738 - RNA, 16 nt, Homo sapiens
uucugaauugacugua

SEQ ID NO: 1177739 - RNA, 16 nt, Homo sapiens
uucugaauuugcaaag

SEQ ID NO: 1177740 - RNA, 13 nt, Homo sapiens
uucugaggggugu

SEQ ID NO: 1177741 - RNA, 13 nt, Homo sapiens
uucugauuccauc

SEQ ID NO: 1177742 - RNA, 22 nt, Homo sapiens
uucugauuugucccuaugcaua

SEQ ID NO: 1177743 - RNA, 20 nt, Homo sapiens
uucugcaucaguucacugcu

SEQ ID NO: 1177744 - RNA, 15 nt, Homo sapiens
uucugcaucuugggg

SEQ ID NO: 1177745 - RNA, 18 nt, Homo sapiens
uucugccucuuaagccug

SEQ ID NO: 1177746 - RNA, 17 nt, Homo sapiens
uucugccuuuauugacu

SEQ ID NO: 1177747 - RNA, 23 nt, Homo sapiens
uucugcuacuccccagaccucag

SEQ ID NO: 1177748 - RNA, 16 nt, Homo sapiens
uucugcuagagcagac

SEQ ID NO: 1177749 - RNA, 17 nt, Homo sapiens
uucuggaagucaucuca

SEQ ID NO: 1177750 - RNA, 13 nt, Homo sapiens
uucuggacaggau

SEQ ID NO: 1177751 - RNA, 24 nt, Homo sapiens
uucuggacugcacacuuccaccau

SEQ ID NO: 1177752 - RNA, 21 nt, Homo sapiens
uucugggaacccugugcaauu

SEQ ID NO: 1177753 - RNA, 14 nt, Homo sapiens
uucugggccaguga

SEQ ID NO: 1177754 - RNA, 18 nt, Homo sapiens
uucuggguccauacacca

SEQ ID NO: 1177755 - RNA, 18 nt, Homo sapiens
uucuggguguugaccacu

SEQ ID NO: 1177756 - RNA, 14 nt, Homo sapiens
uucugguuggugua

SEQ ID NO: 1177757 - RNA, 15 nt, Homo sapiens
uucuguaugugacua

SEQ ID NO: 1177758 - RNA, 17 nt, Homo sapiens
uucugucaacuuguauu

SEQ ID NO: 1177759 - RNA, 15 nt, Homo sapiens
uucugucagaaucac

SEQ ID NO: 1177760 - RNA, 23 nt, Homo sapiens
uucuguccugagaagcauguaau

SEQ ID NO: 1177761 - RNA, 22 nt, Homo sapiens
uucuguccugugagguuuccca

SEQ ID NO: 1177762 - RNA, 11 nt, Homo sapiens
uucugugcuca

SEQ ID NO: 1177763 - RNA, 14 nt, Homo sapiens
uucugugucauuaa

SEQ ID NO: 1177764 - RNA, 22 nt, Homo sapiens
uucuguucaacauguaccucac

SEQ ID NO: 1177765 - RNA, 16 nt, Homo sapiens
uucuuaaaaauaugcu

SEQ ID NO: 1177766 - RNA, 20 nt, Homo sapiens
uucuuaaaacuuaaauugcu

SEQ ID NO: 1177767 - RNA, 17 nt, Homo sapiens
uucuuaaagcaaaguca

SEQ ID NO: 1177768 - RNA, 18 nt, Homo sapiens
uucuuaauuuguaacuuu

SEQ ID NO: 1177769 - RNA, 14 nt, Homo sapiens
uucuuaguggguua

SEQ ID NO: 1177770 - RNA, 13 nt, Homo sapiens
uucuuauaacaua

SEQ ID NO: 1177771 - RNA, 18 nt, Homo sapiens
uucuuccucucucagggg

SEQ ID NO: 1177772 - RNA, 14 nt, Homo sapiens
uucuucuacugcua

SEQ ID NO: 1177773 - RNA, 13 nt, Homo sapiens
uucuucuauaaau

SEQ ID NO: 1177774 - RNA, 16 nt, Homo sapiens
uucuucuguccugaga

SEQ ID NO: 1177775 - RNA, 16 nt, Homo sapiens
uucuucuuagcaccac

SEQ ID NO: 1177776 - RNA, 20 nt, Homo sapiens
uucuugaaauguaggcauca

SEQ ID NO: 1177777 - RNA, 15 nt, Homo sapiens
uucuugaauucaugu

SEQ ID NO: 1177778 - RNA, 17 nt, Homo sapiens
uucuugaauucauguac

SEQ ID NO: 1177779 - RNA, 22 nt, Homo sapiens
uucuugaguugcggcagaacau

SEQ ID NO: 1177780 - RNA, 21 nt, Homo sapiens
uucuuggcccccuucccaagg

SEQ ID NO: 1177781 - RNA, 20 nt, Homo sapiens
uucuuguccucauucuugcc

SEQ ID NO: 1177782 - RNA, 17 nt, Homo sapiens
uucuugugaaggccaug

SEQ ID NO: 1177783 - RNA, 22 nt, Homo sapiens
uucuuguuugucagcaucugac

SEQ ID NO: 1177784 - RNA, 18 nt, Homo sapiens
uuggagaacaacaaggac

SEQ ID NO: 1177785 - RNA, 18 nt, Homo sapiens
uuggagcuuuuuugcaua

SEQ ID NO: 1177786 - RNA, 22 nt, Homo sapiens
uuggaggaccuuaaaugcuacu

SEQ ID NO: 1177787 - RNA, 20 nt, Homo sapiens
uuggagggguauuuuugccc

SEQ ID NO: 1177788 - RNA, 14 nt, Homo sapiens
uuggauacagcagu

SEQ ID NO: 1177789 - RNA, 18 nt, Homo sapiens
uuggauacauacaccagc

SEQ ID NO: 1177790 - RNA, 20 nt, Homo sapiens
uuggauaucaaaagcaaaua

SEQ ID NO: 1177791 - RNA, 14 nt, Homo sapiens
uuggaucagugaaa

SEQ ID NO: 1177792 - RNA, 15 nt, Homo sapiens
uuggauugggguccc

SEQ ID NO: 1177793 - RNA, 20 nt, Homo sapiens
uuggcaaacucuccaccaca

SEQ ID NO: 1177794 - RNA, 14 nt, Homo sapiens
uuggcaccagacac

SEQ ID NO: 1177795 - RNA, 22 nt, Homo sapiens
uuggcaccagacacccaggacu

SEQ ID NO: 1177796 - RNA, 13 nt, Homo sapiens
uuggcacccaaga

SEQ ID NO: 1177797 - RNA, 17 nt, Homo sapiens
uuggcauaauagucaau

SEQ ID NO: 1177798 - RNA, 13 nt, Homo sapiens
uuggcaucugcaa

SEQ ID NO: 1177799 - RNA, 13 nt, Homo sapiens
uuggcaugugcag

SEQ ID NO: 1177800 - RNA, 18 nt, Homo sapiens
uuggcauucuuugcaaua

SEQ ID NO: 1177801 - RNA, 12 nt, Homo sapiens
uuggccagugac

SEQ ID NO: 1177802 - RNA, 15 nt, Homo sapiens
uuggcuuugcaaaau

SEQ ID NO: 1177803 - RNA, 16 nt, Homo sapiens
uugggccagacaugcc

SEQ ID NO: 1177804 - RNA, 15 nt, Homo sapiens
uugggcugugccugg

SEQ ID NO: 1177805 - RNA, 14 nt, Homo sapiens
uuggggcaagucau

SEQ ID NO: 1177806 - RNA, 11 nt, Homo sapiens
uugggggaaaa

SEQ ID NO: 1177807 - RNA, 22 nt, Homo sapiens
uugggggcacuuagguaccaua

SEQ ID NO: 1177808 - RNA, 13 nt, Homo sapiens
uugggggggcucc

SEQ ID NO: 1177809 - RNA, 14 nt, Homo sapiens
uugguaugagacag

SEQ ID NO: 1177810 - RNA, 14 nt, Homo sapiens
uugguauucuguuc

SEQ ID NO: 1177811 - RNA, 19 nt, Homo sapiens
uuggucacauauaugccua

SEQ ID NO: 1177812 - RNA, 21 nt, Homo sapiens
uuggucacaugugacaugucu

SEQ ID NO: 1177813 - RNA, 20 nt, Homo sapiens
uuggucaggcuggucucaaa

SEQ ID NO: 1177814 - RNA, 17 nt, Homo sapiens
uuggucauagcauucac

SEQ ID NO: 1177815 - RNA, 14 nt, Homo sapiens
uuggucaugcaaua

SEQ ID NO: 1177816 - RNA, 20 nt, Homo sapiens
uuggucuuacuuugugcaaa

SEQ ID NO: 1177817 - RNA, 20 nt, Homo sapiens
uuggugaaaauuaggguugg

SEQ ID NO: 1177818 - RNA, 15 nt, Homo sapiens
uuggugaauuucaca

SEQ ID NO: 1177819 - RNA, 18 nt, Homo sapiens
uugguuuccaaaggcauu

SEQ ID NO: 1177820 - RNA, 17 nt, Homo sapiens
uugguuugugugaucau

SEQ ID NO: 1177821 - RNA, 15 nt, Homo sapiens
uuguaaaauguucuc

SEQ ID NO: 1177822 - RNA, 17 nt, Homo sapiens
uuguaaaguagcuguaa

SEQ ID NO: 1177823 - RNA, 14 nt, Homo sapiens
uuguaaauguacug

SEQ ID NO: 1177824 - RNA, 21 nt, Homo sapiens
uuguaagaaagacaagacauu

SEQ ID NO: 1177825 - RNA, 21 nt, Homo sapiens
uuguaagaaauauauuugaua

SEQ ID NO: 1177826 - RNA, 22 nt, Homo sapiens
uuguaauggcucccaaauucca

SEQ ID NO: 1177827 - RNA, 19 nt, Homo sapiens
uuguaccuuauugaucuuu

SEQ ID NO: 1177828 - RNA, 23 nt, Homo sapiens
uuguaccuuccacaagacucaga

SEQ ID NO: 1177829 - RNA, 15 nt, Homo sapiens
uuguacuaugcuguu

SEQ ID NO: 1177830 - RNA, 21 nt, Homo sapiens
uuguacuuuguuuuuccaugu

SEQ ID NO: 1177831 - RNA, 18 nt, Homo sapiens
uuguagccacaagccuga

SEQ ID NO: 1177832 - RNA, 21 nt, Homo sapiens
uuguaggagaaacucccaugu

SEQ ID NO: 1177833 - RNA, 22 nt, Homo sapiens
uuguagguuauuuuauauuuga

SEQ ID NO: 1177834 - RNA, 18 nt, Homo sapiens
uuguaguauuuaguauau

SEQ ID NO: 1177835 - RNA, 21 nt, Homo sapiens
uuguauauuauuucuaggaag

SEQ ID NO: 1177836 - RNA, 15 nt, Homo sapiens
uuguaucuugccuaa

SEQ ID NO: 1177837 - RNA, 19 nt, Homo sapiens
uuguaugucauuuccuuca

SEQ ID NO: 1177838 - RNA, 13 nt, Homo sapiens
uuguauuaaggga

SEQ ID NO: 1177839 - RNA, 15 nt, Homo sapiens
uuguauuaccauuac

SEQ ID NO: 1177840 - RNA, 20 nt, Homo sapiens
uuguauuaguauugugaaua

SEQ ID NO: 1177841 - RNA, 18 nt, Homo sapiens
uuguauuucucuuguccu

SEQ ID NO: 1177842 - RNA, 19 nt, Homo sapiens
uugucaaaaugagauucca

SEQ ID NO: 1177843 - RNA, 18 nt, Homo sapiens
uugucaagccugugcaaa

SEQ ID NO: 1177844 - RNA, 19 nt, Homo sapiens
uugucacagggacugaaaa

SEQ ID NO: 1177845 - RNA, 22 nt, Homo sapiens
uugucacauggaaucuacaugu

SEQ ID NO: 1177846 - RNA, 22 nt, Homo sapiens
uugucacccaaagccuguccca

SEQ ID NO: 1177847 - RNA, 15 nt, Homo sapiens
uugucagaacuagaa

SEQ ID NO: 1177848 - RNA, 15 nt, Homo sapiens
uugucaucugcaugu

SEQ ID NO: 1177849 - RNA, 18 nt, Homo sapiens
uuguccaucugucugugu

SEQ ID NO: 1177850 - RNA, 19 nt, Homo sapiens
uugucccguggcauuucaa

SEQ ID NO: 1177851 - RNA, 22 nt, Homo sapiens
uuguccguguucauacauuuga

SEQ ID NO: 1177852 - RNA, 17 nt, Homo sapiens
uuguccucauuucucca

SEQ ID NO: 1177853 - RNA, 23 nt, Homo sapiens
uuguccuccugauccugacacau

SEQ ID NO: 1177854 - RNA, 18 nt, Homo sapiens
uugucuaaacaaugcuga

SEQ ID NO: 1177855 - RNA, 18 nt, Homo sapiens
uugucuaacuuuugugaa

SEQ ID NO: 1177856 - RNA, 11 nt, Homo sapiens
uugucuuuaug

SEQ ID NO: 1177857 - RNA, 21 nt, Homo sapiens
uugucuuuuuuuucauccuuu

SEQ ID NO: 1177858 - RNA, 16 nt, Homo sapiens
uugugaacagccaaaa

SEQ ID NO: 1177859 - RNA, 23 nt, Homo sapiens
uugugaaguggaaauguucuaaa

SEQ ID NO: 1177860 - RNA, 12 nt, Homo sapiens
uugugacuucaa

SEQ ID NO: 1177861 - RNA, 18 nt, Homo sapiens
uugugaggaagugagcca

SEQ ID NO: 1177862 - RNA, 13 nt, Homo sapiens
uugugauugugga

SEQ ID NO: 1177863 - RNA, 14 nt, Homo sapiens
uugugauuguggaa

SEQ ID NO: 1177864 - RNA, 22 nt, Homo sapiens
uugugauuuuuuguucuuguug

SEQ ID NO: 1177865 - RNA, 19 nt, Homo sapiens
uugugccaucacugagcau

SEQ ID NO: 1177866 - RNA, 11 nt, Homo sapiens
uugugcucagu

SEQ ID NO: 1177867 - RNA, 13 nt, Homo sapiens
uugugcucuuucc

SEQ ID NO: 1177868 - RNA, 15 nt, Homo sapiens
uuguggccaaugcau

SEQ ID NO: 1177869 - RNA, 13 nt, Homo sapiens
uuguggugugcca

SEQ ID NO: 1177870 - RNA, 15 nt, Homo sapiens
uugugugagugcaug

SEQ ID NO: 1177871 - RNA, 18 nt, Homo sapiens
uuguuacauaccugggua

SEQ ID NO: 1177872 - RNA, 14 nt, Homo sapiens
uuguuaccacagag

SEQ ID NO: 1177873 - RNA, 13 nt, Homo sapiens
uuguuacuuugaa

SEQ ID NO: 1177874 - RNA, 13 nt, Homo sapiens
uuguuauaccauu

SEQ ID NO: 1177875 - RNA, 15 nt, Homo sapiens
uuguuaucagucaau

SEQ ID NO: 1177876 - RNA, 16 nt, Homo sapiens
uuguuaucagucaaua

SEQ ID NO: 1177877 - RNA, 13 nt, Homo sapiens
uuguucacugcag

SEQ ID NO: 1177878 - RNA, 22 nt, Homo sapiens
uuguuccugcuuucucuuucag

SEQ ID NO: 1177879 - RNA, 18 nt, Homo sapiens
uuguuccuuaagucagaa

SEQ ID NO: 1177880 - RNA, 23 nt, Homo sapiens
uuguucuggguuuugguuuucuu

SEQ ID NO: 1177881 - RNA, 21 nt, Homo sapiens
uuguucuuuaaagucaggucc

SEQ ID NO: 1177882 - RNA, 11 nt, Homo sapiens
uuguugacaaa

SEQ ID NO: 1177883 - RNA, 16 nt, Homo sapiens
uuguuggauaaaucag

SEQ ID NO: 1177884 - RNA, 21 nt, Homo sapiens
uuguugucuacauuaaaucac

SEQ ID NO: 1177885 - RNA, 20 nt, Homo sapiens
uuguuguucugccuguccua

SEQ ID NO: 1177886 - RNA, 12 nt, Homo sapiens
uuguuucuguca

SEQ ID NO: 1177887 - RNA, 16 nt, Homo sapiens
uuguuugucaucuuca

SEQ ID NO: 1177888 - RNA, 19 nt, Homo sapiens
uuguuuguucacauaugau

SEQ ID NO: 1177889 - RNA, 22 nt, Homo sapiens
uuguuuuauucaccaucaugua

SEQ ID NO: 1177890 - RNA, 16 nt, Homo sapiens
uuuaaaaagaaacaag

SEQ ID NO: 1177891 - RNA, 13 nt, Homo sapiens
uuuaaaaagaaga

SEQ ID NO: 1177892 - RNA, 19 nt, Homo sapiens
uuuaaaaaugucuugcugu

SEQ ID NO: 1177893 - RNA, 20 nt, Homo sapiens
uuuaaaauaaauuccuacaa

SEQ ID NO: 1177894 - RNA, 22 nt, Homo sapiens
uuuaaaaugcucaauuucagca

SEQ ID NO: 1177895 - RNA, 21 nt, Homo sapiens
uuuaaaauuauauagcaaaga

SEQ ID NO: 1177896 - RNA, 12 nt, Homo sapiens
uuuaaacagugu

SEQ ID NO: 1177897 - RNA, 21 nt, Homo sapiens
uuuaaacauuuuuaucuauca

SEQ ID NO: 1177898 - RNA, 18 nt, Homo sapiens
uuuaaaccugacaauggu

SEQ ID NO: 1177899 - RNA, 18 nt, Homo sapiens
caaaauucuuaaguaugu

SEQ ID NO: 1177900 - RNA, 19 nt, Homo sapiens
caaaauugcaaaucuugaa

SEQ ID NO: 1177901 - RNA, 20 nt, Homo sapiens
caaaauuuaacguugaugua

SEQ ID NO: 1177902 - RNA, 16 nt, Homo sapiens
caaacaacaggggaaa

SEQ ID NO: 1177903 - RNA, 22 nt, Homo sapiens
caaacaauuuaaaaaugagugu

SEQ ID NO: 1177904 - RNA, 21 nt, Homo sapiens
caaacacaaccuacucugcaa

SEQ ID NO: 1177905 - RNA, 23 nt, Homo sapiens
caaacacaaguggguagugucau

SEQ ID NO: 1177906 - RNA, 13 nt, Homo sapiens
caaaccauugaaa

SEQ ID NO: 1177907 - RNA, 19 nt, Homo sapiens
caaacccaggcaggcauuu

SEQ ID NO: 1177908 - RNA, 22 nt, Homo sapiens
caaacccuuuucauccuggcug

SEQ ID NO: 1177909 - RNA, 17 nt, Homo sapiens
caaaccuccacugcugc

SEQ ID NO: 1177910 - RNA, 14 nt, Homo sapiens
caaaccuucaggaa

SEQ ID NO: 1177911 - RNA, 13 nt, Homo sapiens
caaacuacugugu

SEQ ID NO: 1177912 - RNA, 13 nt, Homo sapiens
caaacucuucagu

SEQ ID NO: 1177913 - RNA, 20 nt, Homo sapiens
caaacugaauggcaaugaaa

SEQ ID NO: 1177914 - RNA, 19 nt, Homo sapiens
caaacuguaaaagauuaaa

SEQ ID NO: 1177915 - RNA, 14 nt, Homo sapiens
caaacuuccaguca

SEQ ID NO: 1177916 - RNA, 19 nt, Homo sapiens
caaacuugggcccuucccu

SEQ ID NO: 1177917 - RNA, 11 nt, Homo sapiens
caaacuuuuca

SEQ ID NO: 1177918 - RNA, 17 nt, Homo sapiens
caaagaacuucuccuac

SEQ ID NO: 1177919 - RNA, 19 nt, Homo sapiens
caaagaagaguuaagaaga

SEQ ID NO: 1177920 - RNA, 13 nt, Homo sapiens
caaagaaggcauu

SEQ ID NO: 1177921 - RNA, 18 nt, Homo sapiens
caaagaagguuaccaaga

SEQ ID NO: 1177922 - RNA, 20 nt, Homo sapiens
caaagaagguuaccaagaag

SEQ ID NO: 1177923 - RNA, 22 nt, Homo sapiens
caaagacauaauuuaauuccuu

SEQ ID NO: 1177924 - RNA, 14 nt, Homo sapiens
caaagacauuauuu

SEQ ID NO: 1177925 - RNA, 16 nt, Homo sapiens
caaagagaauguauuu

SEQ ID NO: 1177926 - RNA, 16 nt, Homo sapiens
caaagagacuaugaug

SEQ ID NO: 1177927 - RNA, 16 nt, Homo sapiens
caaagagagaaaguuu

SEQ ID NO: 1177928 - RNA, 18 nt, Homo sapiens
caaagagccucacaguua

SEQ ID NO: 1177929 - RNA, 22 nt, Homo sapiens
caaagaucuguccucagccuug

SEQ ID NO: 1177930 - RNA, 22 nt, Homo sapiens
caaagaugaccauaaccacuga

SEQ ID NO: 1177931 - RNA, 14 nt, Homo sapiens
caaagcaaaggcag

SEQ ID NO: 1177932 - RNA, 16 nt, Homo sapiens
caaagcacaguuugaa

SEQ ID NO: 1177933 - RNA, 18 nt, Homo sapiens
caaagcacaguuugaaca

SEQ ID NO: 1177934 - RNA, 14 nt, Homo sapiens
caaagcagaauuuu

SEQ ID NO: 1177935 - RNA, 15 nt, Homo sapiens
caaagcaguggcuua

SEQ ID NO: 1177936 - RNA, 14 nt, Homo sapiens
caaagccacacucu

SEQ ID NO: 1177937 - RNA, 15 nt, Homo sapiens
caaagcccaugcccu

SEQ ID NO: 1177938 - RNA, 21 nt, Homo sapiens
caaagcccuuguccccaugaa

SEQ ID NO: 1177939 - RNA, 17 nt, Homo sapiens
caaagcugaauacauuc

SEQ ID NO: 1177940 - RNA, 16 nt, Homo sapiens
caaagcuuuauuucaa

SEQ ID NO: 1177941 - RNA, 22 nt, Homo sapiens
caaagcuuucauguaaacugug

SEQ ID NO: 1177942 - RNA, 23 nt, Homo sapiens
caaaggaagcauacuugugaacu

SEQ ID NO: 1177943 - RNA, 15 nt, Homo sapiens
caaaggaaucacuuu

SEQ ID NO: 1177944 - RNA, 15 nt, Homo sapiens
caaaggaaucagcug

SEQ ID NO: 1177945 - RNA, 19 nt, Homo sapiens
caaaggaggguuggccuga

SEQ ID NO: 1177946 - RNA, 20 nt, Homo sapiens
caaaggauaaacugcagaga

SEQ ID NO: 1177947 - RNA, 20 nt, Homo sapiens
caaaggaugcgugaguaugu

SEQ ID NO: 1177948 - RNA, 13 nt, Homo sapiens
caaaggauuugau

SEQ ID NO: 1177949 - RNA, 14 nt, Homo sapiens
caaaggugugcaaa

SEQ ID NO: 1177950 - RNA, 20 nt, Homo sapiens
caaaguaaaagaaaccacuu

SEQ ID NO: 1177951 - RNA, 15 nt, Homo sapiens
caaaguagcaccaaa

SEQ ID NO: 1177952 - RNA, 21 nt, Homo sapiens
caaagucaagccacaugguga

SEQ ID NO: 1177953 - RNA, 18 nt, Homo sapiens
caaaguccuuuuuuucca

SEQ ID NO: 1177954 - RNA, 19 nt, Homo sapiens
caaagugcugagauuacag

SEQ ID NO: 1177955 - RNA, 22 nt, Homo sapiens
caaagugggagcccgauaaaua

SEQ ID NO: 1177956 - RNA, 14 nt, Homo sapiens
caaauaaaaaccca

SEQ ID NO: 1177957 - RNA, 16 nt, Homo sapiens
caaauaaguuacaucu

SEQ ID NO: 1177958 - RNA, 22 nt, Homo sapiens
caaauaauagaauugcucccua

SEQ ID NO: 1177959 - RNA, 14 nt, Homo sapiens
caaauaauuggcau

SEQ ID NO: 1177960 - RNA, 19 nt, Homo sapiens
caaauacuuagacaguaug

SEQ ID NO: 1177961 - RNA, 15 nt, Homo sapiens
caaauagaucaugca

SEQ ID NO: 1177962 - RNA, 16 nt, Homo sapiens
caaauagaucaugcau

SEQ ID NO: 1177963 - RNA, 18 nt, Homo sapiens
caaauaggaucauaugaa

SEQ ID NO: 1177964 - RNA, 15 nt, Homo sapiens
caaauaguaaucugu

SEQ ID NO: 1177965 - RNA, 17 nt, Homo sapiens
caaauaguaaucuguaa

SEQ ID NO: 1177966 - RNA, 15 nt, Homo sapiens
caaauagucuaucaa

SEQ ID NO: 1177967 - RNA, 22 nt, Homo sapiens
caaauauuaucuuuguucuccu

SEQ ID NO: 1177968 - RNA, 17 nt, Homo sapiens
caaauauuauucuuaau

SEQ ID NO: 1177969 - RNA, 13 nt, Homo sapiens
caaaucaaucugu

SEQ ID NO: 1177970 - RNA, 17 nt, Homo sapiens
caaaucacgaccacuga

SEQ ID NO: 1177971 - RNA, 21 nt, Homo sapiens
caaaucagugugaggagguag

SEQ ID NO: 1177972 - RNA, 14 nt, Homo sapiens
caaaucucuuccuu

SEQ ID NO: 1177973 - RNA, 18 nt, Homo sapiens
caaaucucuugcuuucuu

SEQ ID NO: 1177974 - RNA, 13 nt, Homo sapiens
caaaucugaggga

SEQ ID NO: 1177975 - RNA, 20 nt, Homo sapiens
caaaucugagggagcugagu

SEQ ID NO: 1177976 - RNA, 20 nt, Homo sapiens
caaaucuguccucuguagua

SEQ ID NO: 1177977 - RNA, 19 nt, Homo sapiens
caaaugaacacacccauca

SEQ ID NO: 1177978 - RNA, 23 nt, Homo sapiens
caaaugaagggacggcuguggga

SEQ ID NO: 1177979 - RNA, 20 nt, Homo sapiens
caaaugacauggacacauca

SEQ ID NO: 1177980 - RNA, 16 nt, Homo sapiens
caaaugccaacuguug

SEQ ID NO: 1177981 - RNA, 22 nt, Homo sapiens
caaaugcugugcaaacagugua

SEQ ID NO: 1177982 - RNA, 20 nt, Homo sapiens
caaauggacauaggacucaa

SEQ ID NO: 1177983 - RNA, 18 nt, Homo sapiens
caaaugggaaaaccagac

SEQ ID NO: 1177984 - RNA, 20 nt, Homo sapiens
caaauguacagugguccuuu

SEQ ID NO: 1177985 - RNA, 13 nt, Homo sapiens
caaauguauuuca

SEQ ID NO: 1177986 - RNA, 13 nt, Homo sapiens
caaaugugacauu

SEQ ID NO: 1177987 - RNA, 14 nt, Homo sapiens
caaaugugcugcuu

SEQ ID NO: 1177988 - RNA, 16 nt, Homo sapiens
caaauguuaugcauaa

SEQ ID NO: 1177989 - RNA, 19 nt, Homo sapiens
caaauuaauauuugugcuu

SEQ ID NO: 1177990 - RNA, 22 nt, Homo sapiens
caaauucgcugcaaccuguuga

SEQ ID NO: 1177991 - RNA, 22 nt, Homo sapiens
caaauuguuguguugagaugau

SEQ ID NO: 1177992 - RNA, 13 nt, Homo sapiens
caacaacaacaac

SEQ ID NO: 1177993 - RNA, 14 nt, Homo sapiens
caacaacaacaaua

SEQ ID NO: 1177994 - RNA, 15 nt, Homo sapiens
caacaacaauaauaa

SEQ ID NO: 1177995 - RNA, 14 nt, Homo sapiens
caacaagaaaagaa

SEQ ID NO: 1177996 - RNA, 12 nt, Homo sapiens
caacaaggacaa

SEQ ID NO: 1177997 - RNA, 15 nt, Homo sapiens
caacacaguuuugac

SEQ ID NO: 1177998 - RNA, 21 nt, Homo sapiens
caacacaguuuugaccuaaca

SEQ ID NO: 1177999 - RNA, 18 nt, Homo sapiens
caacacuggugacuccag

SEQ ID NO: 1178000 - RNA, 14 nt, Homo sapiens
caacagacaaaaag

SEQ ID NO: 1178001 - RNA, 22 nt, Homo sapiens
caacagagaggaccaacaucca

SEQ ID NO: 1178002 - RNA, 13 nt, Homo sapiens
caacagagcaaaa

SEQ ID NO: 1178003 - RNA, 12 nt, Homo sapiens
caacagcacuuu

SEQ ID NO: 1178004 - RNA, 11 nt, Homo sapiens
caacagcauuu

SEQ ID NO: 1178005 - RNA, 11 nt, Homo sapiens
caacagccaac

SEQ ID NO: 1178006 - RNA, 17 nt, Homo sapiens
caacaggaggacaauuc

SEQ ID NO: 1178007 - RNA, 14 nt, Homo sapiens
cauaaaccugugcu

SEQ ID NO: 1178008 - RNA, 19 nt, Homo sapiens
cauaaacuuuccucuuccu

SEQ ID NO: 1178009 - RNA, 16 nt, Homo sapiens
cauaaagaagcaauaa

SEQ ID NO: 1178010 - RNA, 21 nt, Homo sapiens
cauaaagauauucuuuagugg

SEQ ID NO: 1178011 - RNA, 13 nt, Homo sapiens
cauaaaucacaaa

SEQ ID NO: 1178012 - RNA, 13 nt, Homo sapiens
cauaacaauuccu

SEQ ID NO: 1178013 - RNA, 14 nt, Homo sapiens
cauaacccaugaag

SEQ ID NO: 1178014 - RNA, 20 nt, Homo sapiens
cauaacucugugaucuugcu

SEQ ID NO: 1178015 - RNA, 15 nt, Homo sapiens
cauaacuucucaugu

SEQ ID NO: 1178016 - RNA, 21 nt, Homo sapiens
cauaagaauuuuuuauaagua

SEQ ID NO: 1178017 - RNA, 17 nt, Homo sapiens
cauaagcgaucacuucc

SEQ ID NO: 1178018 - RNA, 19 nt, Homo sapiens
cauaaguaccucagcauuu

SEQ ID NO: 1178019 - RNA, 18 nt, Homo sapiens
cauaauaaauaucuguac

SEQ ID NO: 1178020 - RNA, 15 nt, Homo sapiens
cauaauagucaauuu

SEQ ID NO: 1178021 - RNA, 21 nt, Homo sapiens
cauaauucaggggcugacacu

SEQ ID NO: 1178022 - RNA, 16 nt, Homo sapiens
cauacagcacaauguu

SEQ ID NO: 1178023 - RNA, 17 nt, Homo sapiens
cauacauaggauggcug

SEQ ID NO: 1178024 - RNA, 23 nt, Homo sapiens
cauacauauguagaaacauuuag

SEQ ID NO: 1178025 - RNA, 22 nt, Homo sapiens
cauaccaaugaaaaaauguaua

SEQ ID NO: 1178026 - RNA, 19 nt, Homo sapiens
cauacccucacuuaaacuu

SEQ ID NO: 1178027 - RNA, 15 nt, Homo sapiens
cauaccuacauucaa

SEQ ID NO: 1178028 - RNA, 18 nt, Homo sapiens
cauaccuggguaugugua

SEQ ID NO: 1178029 - RNA, 16 nt, Homo sapiens
cauacuaggugccuuu

SEQ ID NO: 1178030 - RNA, 23 nt, Homo sapiens
cauacuaguagucauacucccug

SEQ ID NO: 1178031 - RNA, 17 nt, Homo sapiens
cauacucccuauuuuca

SEQ ID NO: 1178032 - RNA, 21 nt, Homo sapiens
cauacucccuauuuucauucc

SEQ ID NO: 1178033 - RNA, 22 nt, Homo sapiens
cauacuccuuuuaagcagugag

SEQ ID NO: 1178034 - RNA, 10 nt, Homo sapiens
cauacugcug

SEQ ID NO: 1178035 - RNA, 14 nt, Homo sapiens
cauacuuccaucug

SEQ ID NO: 1178036 - RNA, 22 nt, Homo sapiens
cauagaacugccuggauuccau

SEQ ID NO: 1178037 - RNA, 14 nt, Homo sapiens
cauagaagagccaa

SEQ ID NO: 1178038 - RNA, 13 nt, Homo sapiens
cauagacugaaga

SEQ ID NO: 1178039 - RNA, 19 nt, Homo sapiens
cauagacugaagauuuauu

SEQ ID NO: 1178040 - RNA, 20 nt, Homo sapiens
cauagaguauagcucuguag

SEQ ID NO: 1178041 - RNA, 22 nt, Homo sapiens
cauagauaguucauucauucaa

SEQ ID NO: 1178042 - RNA, 22 nt, Homo sapiens
cauagauauacuugaguaacau

SEQ ID NO: 1178043 - RNA, 19 nt, Homo sapiens
cauagauguuaugcaaaaa

SEQ ID NO: 1178044 - RNA, 18 nt, Homo sapiens
cauagcagcugcuacuag

SEQ ID NO: 1178045 - RNA, 14 nt, Homo sapiens
cauagcaugacauu

SEQ ID NO: 1178046 - RNA, 11 nt, Homo sapiens
cauagccucau

SEQ ID NO: 1178047 - RNA, 17 nt, Homo sapiens
cauagcucuucacuucc

SEQ ID NO: 1178048 - RNA, 16 nt, Homo sapiens
cauagcugugcuauga

SEQ ID NO: 1178049 - RNA, 20 nt, Homo sapiens
cauaggggacugaggagcaa

SEQ ID NO: 1178050 - RNA, 21 nt, Homo sapiens
cauaggguccugaauguuuca

SEQ ID NO: 1178051 - RNA, 14 nt, Homo sapiens
cauauaaccaaaau

SEQ ID NO: 1178052 - RNA, 12 nt, Homo sapiens
cauauaccagca

SEQ ID NO: 1178053 - RNA, 22 nt, Homo sapiens
cauaucaucaaugugacauuua

SEQ ID NO: 1178054 - RNA, 18 nt, Homo sapiens
cauaucucuagucccugu

SEQ ID NO: 1178055 - RNA, 14 nt, Homo sapiens
cauaucucuugccc

SEQ ID NO: 1178056 - RNA, 16 nt, Homo sapiens
cauaugauacugaugc

SEQ ID NO: 1178057 - RNA, 20 nt, Homo sapiens
cauaugugaauauggacuca

SEQ ID NO: 1178058 - RNA, 21 nt, Homo sapiens
cauaugugagugaaaguacuu

SEQ ID NO: 1178059 - RNA, 22 nt, Homo sapiens
cauauuauuauuaauuuugcca

SEQ ID NO: 1178060 - RNA, 20 nt, Homo sapiens
cauauucaacacacugccuu

SEQ ID NO: 1178061 - RNA, 15 nt, Homo sapiens
cauauucccacagca

SEQ ID NO: 1178062 - RNA, 19 nt, Homo sapiens
cauauucccacagcacuaa

SEQ ID NO: 1178063 - RNA, 19 nt, Homo sapiens
cauauucuuuaaauuucau

SEQ ID NO: 1178064 - RNA, 22 nt, Homo sapiens
cauauuggcaguuggaggacac

SEQ ID NO: 1178065 - RNA, 16 nt, Homo sapiens
cauauuuaaugaugau

SEQ ID NO: 1178066 - RNA, 17 nt, Homo sapiens
cauauuuagcuuugcac

SEQ ID NO: 1178067 - RNA, 14 nt, Homo sapiens
caucaaagauuagg

SEQ ID NO: 1178068 - RNA, 14 nt, Homo sapiens
caucaacacaauga

SEQ ID NO: 1178069 - RNA, 14 nt, Homo sapiens
caucaagcaucauu

SEQ ID NO: 1178070 - RNA, 21 nt, Homo sapiens
caucaagucuuucacauuuaa

SEQ ID NO: 1178071 - RNA, 15 nt, Homo sapiens
caucacacacaugga

SEQ ID NO: 1178072 - RNA, 15 nt, Homo sapiens
caucacagaacaucc

SEQ ID NO: 1178073 - RNA, 21 nt, Homo sapiens
caucacagcugaacuuguuga

SEQ ID NO: 1178074 - RNA, 15 nt, Homo sapiens
caucacaugaccaca

SEQ ID NO: 1178075 - RNA, 23 nt, Homo sapiens
caucacugaaaugcuagcugcaa

SEQ ID NO: 1178076 - RNA, 21 nt, Homo sapiens
caucacuggggcugggagcag

SEQ ID NO: 1178077 - RNA, 15 nt, Homo sapiens
caucacuuguaccuu

SEQ ID NO: 1178078 - RNA, 22 nt, Homo sapiens
caucagacugaacuuacacugu

SEQ ID NO: 1178079 - RNA, 12 nt, Homo sapiens
caucagcacaaa

SEQ ID NO: 1178080 - RNA, 14 nt, Homo sapiens
caucagcacaaaga

SEQ ID NO: 1178081 - RNA, 18 nt, Homo sapiens
caucaggaguuccagugc

SEQ ID NO: 1178082 - RNA, 18 nt, Homo sapiens
caucaggauacucaaagu

SEQ ID NO: 1178083 - RNA, 21 nt, Homo sapiens
caucauagccugcagccucau

SEQ ID NO: 1178084 - RNA, 18 nt, Homo sapiens
caucaucucugccuuuga

SEQ ID NO: 1178085 - RNA, 21 nt, Homo sapiens
caucauggaaagacugggaca

SEQ ID NO: 1178086 - RNA, 16 nt, Homo sapiens
caucauuaaccaguaa

SEQ ID NO: 1178087 - RNA, 17 nt, Homo sapiens
caucauucucugucuca

SEQ ID NO: 1178088 - RNA, 16 nt, Homo sapiens
caucauuuuuguaucu

SEQ ID NO: 1178089 - RNA, 15 nt, Homo sapiens
cauccaaguggcaua

SEQ ID NO: 1178090 - RNA, 19 nt, Homo sapiens
cauccaaugcucaagaaac

SEQ ID NO: 1178091 - RNA, 13 nt, Homo sapiens
cauccacuuuaug

SEQ ID NO: 1178092 - RNA, 14 nt, Homo sapiens
cauccagacagucg

SEQ ID NO: 1178093 - RNA, 14 nt, Homo sapiens
cauccagcuacuua

SEQ ID NO: 1178094 - RNA, 17 nt, Homo sapiens
cauccaggacugugcca

SEQ ID NO: 1178095 - RNA, 22 nt, Homo sapiens
cauccaggcuggccagugcugc

SEQ ID NO: 1178096 - RNA, 18 nt, Homo sapiens
cauccaugugcuagucac

SEQ ID NO: 1178097 - RNA, 18 nt, Homo sapiens
cauccauucuucccuuga

SEQ ID NO: 1178098 - RNA, 14 nt, Homo sapiens
caucccuagccauu

SEQ ID NO: 1178099 - RNA, 16 nt, Homo sapiens
caucccucuguucaca

SEQ ID NO: 1178100 - RNA, 21 nt, Homo sapiens
cauccuacccccugugccuug

SEQ ID NO: 1178101 - RNA, 14 nt, Homo sapiens
cauccuaugcaaua

SEQ ID NO: 1178102 - RNA, 24 nt, Homo sapiens
cauccuuggaaauuggaagagcac

SEQ ID NO: 1178103 - RNA, 22 nt, Homo sapiens
caucgcccacgauggaauguaa

SEQ ID NO: 1178104 - RNA, 19 nt, Homo sapiens
caucguuuucuucacuguc

SEQ ID NO: 1178105 - RNA, 17 nt, Homo sapiens
caucuaaauugaucauu

SEQ ID NO: 1178106 - RNA, 15 nt, Homo sapiens
caucuauuauuacac

SEQ ID NO: 1178107 - RNA, 16 nt, Homo sapiens
caucuauuauuacaca

SEQ ID NO: 1178108 - RNA, 21 nt, Homo sapiens
caucuauuuuggauuguauau

SEQ ID NO: 1178109 - RNA, 22 nt, Homo sapiens
caucucccuuccaccucacaac

SEQ ID NO: 1178110 - RNA, 20 nt, Homo sapiens
caucuccgccuccacacuga

SEQ ID NO: 1178111 - RNA, 12 nt, Homo sapiens
caucucuuugau

SEQ ID NO: 1178112 - RNA, 23 nt, Homo sapiens
caucugaaugaaaauaacugaac

SEQ ID NO: 1178113 - RNA, 14 nt, Homo sapiens
caucugaccagcag

SEQ ID NO: 1178114 - RNA, 13 nt, Homo sapiens
caucugaccaucu

SEQ ID NO: 1178115 - RNA, 20 nt, Homo sapiens
caucugaccaucugugacua

SEQ ID NO: 1178116 - RNA, 18 nt, Homo sapiens
caucugcaugucuacuca

SEQ ID NO: 1178117 - RNA, 15 nt, Homo sapiens
caucuggaaucugga

SEQ ID NO: 1178118 - RNA, 17 nt, Homo sapiens
caucuggcugccuuugc

SEQ ID NO: 1178119 - RNA, 21 nt, Homo sapiens
caucuggcugccuuugcuuaa

SEQ ID NO: 1178120 - RNA, 17 nt, Homo sapiens
caucugggaaagacauc

SEQ ID NO: 1178121 - RNA, 18 nt, Homo sapiens
caucugggugcccugaaa

SEQ ID NO: 1178122 - RNA, 16 nt, Homo sapiens
caucuguaaaaggccu

SEQ ID NO: 1178123 - RNA, 15 nt, Homo sapiens
caucuguacuugguc

SEQ ID NO: 1178124 - RNA, 19 nt, Homo sapiens
caucuguguagcugcucuu

SEQ ID NO: 1178125 - RNA, 16 nt, Homo sapiens
caucugugucucugga

SEQ ID NO: 1178126 - RNA, 22 nt, Homo sapiens
caucuuagguauaacagcacaa

SEQ ID NO: 1178127 - RNA, 16 nt, Homo sapiens
caucuucacugcaauu

SEQ ID NO: 1178128 - RNA, 20 nt, Homo sapiens
caucuuccaccucaccucuu

SEQ ID NO: 1178129 - RNA, 17 nt, Homo sapiens
caucuucccacaguggc

SEQ ID NO: 1178130 - RNA, 10 nt, Homo sapiens
caucuucccu

SEQ ID NO: 1178131 - RNA, 15 nt, Homo sapiens
caucuucgggaccag

SEQ ID NO: 1178132 - RNA, 17 nt, Homo sapiens
caucuuggucacauaca

SEQ ID NO: 1178133 - RNA, 19 nt, Homo sapiens
caucuuggucacauacaau

SEQ ID NO: 1178134 - RNA, 23 nt, Homo sapiens
caucuuuccuucggguuggcaaa

SEQ ID NO: 1178135 - RNA, 23 nt, Homo sapiens
caucuuuccuucucuaagcacaa

SEQ ID NO: 1178136 - RNA, 21 nt, Homo sapiens
caucuuuguguuuugaacaaa

SEQ ID NO: 1178137 - RNA, 21 nt, Homo sapiens
caucuuuuuaaccugcaaaau

SEQ ID NO: 1178138 - RNA, 13 nt, Homo sapiens
caugaaaaaccau

SEQ ID NO: 1178139 - RNA, 13 nt, Homo sapiens
caugaaaaguuau

SEQ ID NO: 1178140 - RNA, 23 nt, Homo sapiens
caugaaagaacccaagacaucau

SEQ ID NO: 1178141 - RNA, 14 nt, Homo sapiens
ccaggcugggcuga

SEQ ID NO: 1178142 - RNA, 14 nt, Homo sapiens
ccagggaacagcca

SEQ ID NO: 1178143 - RNA, 15 nt, Homo sapiens
ccagggacccaaagc

SEQ ID NO: 1178144 - RNA, 17 nt, Homo sapiens
ccagggacccuggagua

SEQ ID NO: 1178145 - RNA, 16 nt, Homo sapiens
ccagggagugguuugg

SEQ ID NO: 1178146 - RNA, 23 nt, Homo sapiens
ccagggcucuaaugugucucuca

SEQ ID NO: 1178147 - RNA, 15 nt, Homo sapiens
ccaggggaccagagg

SEQ ID NO: 1178148 - RNA, 10 nt, Homo sapiens
ccaggggaug

SEQ ID NO: 1178149 - RNA, 21 nt, Homo sapiens
ccagggugauuuuaugaucag

SEQ ID NO: 1178150 - RNA, 17 nt, Homo sapiens
ccaggguggagugcagu

SEQ ID NO: 1178151 - RNA, 13 nt, Homo sapiens
ccagguacaucca

SEQ ID NO: 1178152 - RNA, 12 nt, Homo sapiens
ccagguaggaaa

SEQ ID NO: 1178153 - RNA, 11 nt, Homo sapiens
ccaggugggaa

SEQ ID NO: 1178154 - RNA, 22 nt, Homo sapiens
ccagguuuaaccguugcgucac

SEQ ID NO: 1178155 - RNA, 14 nt, Homo sapiens
ccaguagaugccac

SEQ ID NO: 1178156 - RNA, 19 nt, Homo sapiens
ccaguagcuaaagugcaag

SEQ ID NO: 1178157 - RNA, 13 nt, Homo sapiens
ccaguauguccuu

SEQ ID NO: 1178158 - RNA, 19 nt, Homo sapiens
ccagucacugugagcuccc

SEQ ID NO: 1178159 - RNA, 23 nt, Homo sapiens
ccagucgcccuuacuucuugccc

SEQ ID NO: 1178160 - RNA, 11 nt, Homo sapiens
ccagucuuccu

SEQ ID NO: 1178161 - RNA, 18 nt, Homo sapiens
ccagugauaagagcagug

SEQ ID NO: 1178162 - RNA, 18 nt, Homo sapiens
ccaguuugcccauucucu

SEQ ID NO: 1178163 - RNA, 17 nt, Homo sapiens
ccaguuuuuuguuguua

SEQ ID NO: 1178164 - RNA, 22 nt, Homo sapiens
ccauaaaaauaaaucaguucau

SEQ ID NO: 1178165 - RNA, 19 nt, Homo sapiens
ccauacaccagcaaugaag

SEQ ID NO: 1178166 - RNA, 20 nt, Homo sapiens
ccauacuucuguuuccaucu

SEQ ID NO: 1178167 - RNA, 22 nt, Homo sapiens
ccauaggguccugaauguuuca

SEQ ID NO: 1178168 - RNA, 16 nt, Homo sapiens
ccauagguacauugga

SEQ ID NO: 1178169 - RNA, 21 nt, Homo sapiens
ccauaguaguaugaugauaca

SEQ ID NO: 1178170 - RNA, 15 nt, Homo sapiens
ccauagucacauggc

SEQ ID NO: 1178171 - RNA, 20 nt, Homo sapiens
ccauaguuauuuacuugaaa

SEQ ID NO: 1178172 - RNA, 18 nt, Homo sapiens
ccauauacucuucaagga

SEQ ID NO: 1178173 - RNA, 21 nt, Homo sapiens
ccauauacucuucaaggacuu

SEQ ID NO: 1178174 - RNA, 13 nt, Homo sapiens
ccauaucagugaa

SEQ ID NO: 1178175 - RNA, 17 nt, Homo sapiens
ccauaucuucuguuuca

SEQ ID NO: 1178176 - RNA, 20 nt, Homo sapiens
ccauauuuucaccauuugau

SEQ ID NO: 1178177 - RNA, 12 nt, Homo sapiens
ccaucacuggag

SEQ ID NO: 1178178 - RNA, 20 nt, Homo sapiens
ccaucagcaaauauuauucu

SEQ ID NO: 1178179 - RNA, 23 nt, Homo sapiens
ccaucagugcucccucacauguc

SEQ ID NO: 1178180 - RNA, 19 nt, Homo sapiens
ccaucauccuuuguucuga

SEQ ID NO: 1178181 - RNA, 13 nt, Homo sapiens
ccaucaucugcug

SEQ ID NO: 1178182 - RNA, 15 nt, Homo sapiens
ccaucaucugcugca

SEQ ID NO: 1178183 - RNA, 22 nt, Homo sapiens
ccauccgugcuaugacauggag

SEQ ID NO: 1178184 - RNA, 18 nt, Homo sapiens
ccauccuucccuuuggag

SEQ ID NO: 1178185 - RNA, 20 nt, Homo sapiens
ccaucguauuaaaaaacaau

SEQ ID NO: 1178186 - RNA, 23 nt, Homo sapiens
ccaucguauuaaaaaacaauuaa

SEQ ID NO: 1178187 - RNA, 21 nt, Homo sapiens
ccaucuaugcagaacaggcag

SEQ ID NO: 1178188 - RNA, 14 nt, Homo sapiens
ccaucuauggugug

SEQ ID NO: 1178189 - RNA, 15 nt, Homo sapiens
ccaucuccgccucca

SEQ ID NO: 1178190 - RNA, 16 nt, Homo sapiens
ccaucugacaaauuca

SEQ ID NO: 1178191 - RNA, 19 nt, Homo sapiens
ccaucuggaauuccagucu

SEQ ID NO: 1178192 - RNA, 14 nt, Homo sapiens
ccaucugugacuau

SEQ ID NO: 1178193 - RNA, 23 nt, Homo sapiens
ccaucuuuugugagauguaauug

SEQ ID NO: 1178194 - RNA, 12 nt, Homo sapiens
ccaugaagccac

SEQ ID NO: 1178195 - RNA, 12 nt, Homo sapiens
ccaugacaugga

SEQ ID NO: 1178196 - RNA, 20 nt, Homo sapiens
ccaugacugaggcaggcaug

SEQ ID NO: 1178197 - RNA, 23 nt, Homo sapiens
ccaugagagaaggaggggagcag

SEQ ID NO: 1178198 - RNA, 12 nt, Homo sapiens
ccaugcaaagga

SEQ ID NO: 1178199 - RNA, 21 nt, Homo sapiens
cccccgugaggaugucacuca

SEQ ID NO: 1178200 - RNA, 15 nt, Homo sapiens
cccccugaguuuccu

SEQ ID NO: 1178201 - RNA, 12 nt, Homo sapiens
cccccugugcag

SEQ ID NO: 1178202 - RNA, 13 nt, Homo sapiens
ccccggaacaagc

SEQ ID NO: 1178203 - RNA, 17 nt, Homo sapiens
ccccggggugcccacag

SEQ ID NO: 1178204 - RNA, 16 nt, Homo sapiens
ccccuaguaacugcug

SEQ ID NO: 1178205 - RNA, 17 nt, Homo sapiens
ccccucagagacugaaa

SEQ ID NO: 1178206 - RNA, 23 nt, Homo sapiens
ccccuccaucuguacuuggucca

SEQ ID NO: 1178207 - RNA, 17 nt, Homo sapiens
ccccucccagaacacac

SEQ ID NO: 1178208 - RNA, 21 nt, Homo sapiens
ccccugcugcugucaccucuc

SEQ ID NO: 1178209 - RNA, 19 nt, Homo sapiens
ccccuggaucuaccagcau

SEQ ID NO: 1178210 - RNA, 15 nt, Homo sapiens
ccccuggcagugcug

SEQ ID NO: 1178211 - RNA, 15 nt, Homo sapiens
ccccuggcucugggc

SEQ ID NO: 1178212 - RNA, 17 nt, Homo sapiens
ccccugucucaggguga

SEQ ID NO: 1178213 - RNA, 18 nt, Homo sapiens
cccgagguggcugccugg

SEQ ID NO: 1178214 - RNA, 19 nt, Homo sapiens
cccgaguggucuccucuca

SEQ ID NO: 1178215 - RNA, 20 nt, Homo sapiens
cccggaauccgagauagggu

SEQ ID NO: 1178216 - RNA, 21 nt, Homo sapiens
cccggccgcuccaccagcauc

SEQ ID NO: 1178217 - RNA, 23 nt, Homo sapiens
cccggugggacccccguggggca

SEQ ID NO: 1178218 - RNA, 15 nt, Homo sapiens
cccguccacagggca

SEQ ID NO: 1178219 - RNA, 11 nt, Homo sapiens
cccgugacugc

SEQ ID NO: 1178220 - RNA, 14 nt, Homo sapiens
cccuaaaccaaaaa

SEQ ID NO: 1178221 - RNA, 20 nt, Homo sapiens
cccuacaaaaccacuggaaa

SEQ ID NO: 1178222 - RNA, 21 nt, Homo sapiens
cccuagcagcccacccugcug

SEQ ID NO: 1178223 - RNA, 15 nt, Homo sapiens
cccuaguaacugcug

SEQ ID NO: 1178224 - RNA, 16 nt, Homo sapiens
cccuauccacccagcc

SEQ ID NO: 1178225 - RNA, 14 nt, Homo sapiens
cccucaaaucugag

SEQ ID NO: 1178226 - RNA, 19 nt, Homo sapiens
cccucaccugguaccugga

SEQ ID NO: 1178227 - RNA, 14 nt, Homo sapiens
cccucagacauccc

SEQ ID NO: 1178228 - RNA, 18 nt, Homo sapiens
cccucagauuuuauauuu

SEQ ID NO: 1178229 - RNA, 15 nt, Homo sapiens
cccucagguguagcu

SEQ ID NO: 1178230 - RNA, 17 nt, Homo sapiens
cccucauucuacugaaa

SEQ ID NO: 1178231 - RNA, 20 nt, Homo sapiens
cccuccacaaagcaaaggca

SEQ ID NO: 1178232 - RNA, 21 nt, Homo sapiens
cccuccacucucuaccagaua

SEQ ID NO: 1178233 - RNA, 21 nt, Homo sapiens
cccuccauaaguuuaacuuua

SEQ ID NO: 1178234 - RNA, 12 nt, Homo sapiens
cccuccaucccc

SEQ ID NO: 1178235 - RNA, 15 nt, Homo sapiens
cccuccaucuacccc

SEQ ID NO: 1178236 - RNA, 14 nt, Homo sapiens
cccucccacaccca

SEQ ID NO: 1178237 - RNA, 15 nt, Homo sapiens
cccuccguggcauca

SEQ ID NO: 1178238 - RNA, 18 nt, Homo sapiens
cccuccguggcaucaccu

SEQ ID NO: 1178239 - RNA, 16 nt, Homo sapiens
cccucgaggaaggggg

SEQ ID NO: 1178240 - RNA, 19 nt, Homo sapiens
cccucuagaaauuuuucag

SEQ ID NO: 1178241 - RNA, 13 nt, Homo sapiens
cccucucagugcc

SEQ ID NO: 1178242 - RNA, 21 nt, Homo sapiens
cccucugucacccagucuguu

SEQ ID NO: 1178243 - RNA, 15 nt, Homo sapiens
cccucuuucuagccu

SEQ ID NO: 1178244 - RNA, 22 nt, Homo sapiens
cccugaccugugagcccagcug

SEQ ID NO: 1178245 - RNA, 14 nt, Homo sapiens
cccugagaucucug

SEQ ID NO: 1178246 - RNA, 16 nt, Homo sapiens
cccugaguuccuagcc

SEQ ID NO: 1178247 - RNA, 21 nt, Homo sapiens
cccugcaggcuguuuauaugu

SEQ ID NO: 1178248 - RNA, 12 nt, Homo sapiens
cccugcauuuau

SEQ ID NO: 1178249 - RNA, 15 nt, Homo sapiens
cccugccagcucuuc

SEQ ID NO: 1178250 - RNA, 20 nt, Homo sapiens
cccugcccuccccucucugc

SEQ ID NO: 1178251 - RNA, 15 nt, Homo sapiens
cccugcccugaccuc

SEQ ID NO: 1178252 - RNA, 16 nt, Homo sapiens
cccugccuucacugug

SEQ ID NO: 1178253 - RNA, 19 nt, Homo sapiens
cccugcgggugaacaaagc

SEQ ID NO: 1178254 - RNA, 13 nt, Homo sapiens
cccugcugugggu

SEQ ID NO: 1178255 - RNA, 12 nt, Homo sapiens
cccugcuuagaa

SEQ ID NO: 1178256 - RNA, 23 nt, Homo sapiens
cccugcuuaucugaaacuuccca

SEQ ID NO: 1178257 - RNA, 21 nt, Homo sapiens
cccugcuucagcgaaagggac

SEQ ID NO: 1178258 - RNA, 21 nt, Homo sapiens
cccugcuuuagagcuagggug

SEQ ID NO: 1178259 - RNA, 16 nt, Homo sapiens
cccuggaacuggagaa

SEQ ID NO: 1178260 - RNA, 17 nt, Homo sapiens
cccuggaccaguggucu

SEQ ID NO: 1178261 - RNA, 15 nt, Homo sapiens
cccuggcagugcuga

SEQ ID NO: 1178262 - RNA, 22 nt, Homo sapiens
cccuggcugaacagugcucugc

SEQ ID NO: 1178263 - RNA, 16 nt, Homo sapiens
cccugggccucagugu

SEQ ID NO: 1178264 - RNA, 18 nt, Homo sapiens
cccuggggacccacgugg

SEQ ID NO: 1178265 - RNA, 23 nt, Homo sapiens
cccugguaaaauaguggaucuca

SEQ ID NO: 1178266 - RNA, 20 nt, Homo sapiens
cccuggugcaagugcuguca

SEQ ID NO: 1178267 - RNA, 22 nt, Homo sapiens
cccugguuuucagucuugcuga

SEQ ID NO: 1178268 - RNA, 18 nt, Homo sapiens
cccuguaacaggcuugaa

SEQ ID NO: 1178269 - RNA, 16 nt, Homo sapiens
ccucccugaguggucc

SEQ ID NO: 1178270 - RNA, 18 nt, Homo sapiens
ccucccugcgcuuccuga

SEQ ID NO: 1178271 - RNA, 14 nt, Homo sapiens
ccucccuucugucc

SEQ ID NO: 1178272 - RNA, 16 nt, Homo sapiens
ccuccgccuccugggu

SEQ ID NO: 1178273 - RNA, 15 nt, Homo sapiens
ccuccgcuacuucca

SEQ ID NO: 1178274 - RNA, 13 nt, Homo sapiens
ccuccguggcaca

SEQ ID NO: 1178275 - RNA, 18 nt, Homo sapiens
ccuccucccuaaugcuca

SEQ ID NO: 1178276 - RNA, 19 nt, Homo sapiens
ccuccucggaucaccgaga

SEQ ID NO: 1178277 - RNA, 15 nt, Homo sapiens
ccuccugaaagccug

SEQ ID NO: 1178278 - RNA, 15 nt, Homo sapiens
ccuccugagcucuga

SEQ ID NO: 1178279 - RNA, 19 nt, Homo sapiens
ccuccugggagcucaugug

SEQ ID NO: 1178280 - RNA, 19 nt, Homo sapiens
ccuccugggcuauauuccu

SEQ ID NO: 1178281 - RNA, 18 nt, Homo sapiens
ccuccuggguucacauga

SEQ ID NO: 1178282 - RNA, 21 nt, Homo sapiens
ccuccuucaauuccauauauc

SEQ ID NO: 1178283 - RNA, 15 nt, Homo sapiens
ccuccuuggugccug

SEQ ID NO: 1178284 - RNA, 18 nt, Homo sapiens
ccucgacguuuacaagcc

SEQ ID NO: 1178285 - RNA, 13 nt, Homo sapiens
ccucgagauccca

SEQ ID NO: 1178286 - RNA, 18 nt, Homo sapiens
ccucgcaucauugcagau

SEQ ID NO: 1178287 - RNA, 16 nt, Homo sapiens
ccucgcccuccacaaa

SEQ ID NO: 1178288 - RNA, 20 nt, Homo sapiens
ccucgcggcucuccagggcu

SEQ ID NO: 1178289 - RNA, 15 nt, Homo sapiens
ccucgcuggacucuc

SEQ ID NO: 1178290 - RNA, 19 nt, Homo sapiens
ccucggcuuuucucagcug

SEQ ID NO: 1178291 - RNA, 19 nt, Homo sapiens
ccucuaaucucagcacuuu

SEQ ID NO: 1178292 - RNA, 19 nt, Homo sapiens
ccucuacuuugauucugau

SEQ ID NO: 1178293 - RNA, 16 nt, Homo sapiens
ccucuauaccuguguc

SEQ ID NO: 1178294 - RNA, 20 nt, Homo sapiens
ccucucauuucccuuugaua

SEQ ID NO: 1178295 - RNA, 13 nt, Homo sapiens
ccucuccacucau

SEQ ID NO: 1178296 - RNA, 21 nt, Homo sapiens
ccucuccagaugagaguacac

SEQ ID NO: 1178297 - RNA, 15 nt, Homo sapiens
ccucuccaugcaagu

SEQ ID NO: 1178298 - RNA, 16 nt, Homo sapiens
ccucucgcauggugug

SEQ ID NO: 1178299 - RNA, 23 nt, Homo sapiens
ccucucugcaaauggcuuagcua

SEQ ID NO: 1178300 - RNA, 12 nt, Homo sapiens
ccucugacucag

SEQ ID NO: 1178301 - RNA, 20 nt, Homo sapiens
ccucugccuccuggguucaa

SEQ ID NO: 1178302 - RNA, 15 nt, Homo sapiens
ccucugcuggucucu

SEQ ID NO: 1178303 - RNA, 13 nt, Homo sapiens
ccucugcuucuca

SEQ ID NO: 1178304 - RNA, 20 nt, Homo sapiens
ccucuggauagggaugaaga

SEQ ID NO: 1178305 - RNA, 21 nt, Homo sapiens
ccucuggcuggcuaacuggaa

SEQ ID NO: 1178306 - RNA, 17 nt, Homo sapiens
ccucuguaccccaugac

SEQ ID NO: 1178307 - RNA, 21 nt, Homo sapiens
ccucuguauacaaaacccuuu

SEQ ID NO: 1178308 - RNA, 13 nt, Homo sapiens
ccucugugaagca

SEQ ID NO: 1178309 - RNA, 14 nt, Homo sapiens
ccucuuaagccugc

SEQ ID NO: 1178310 - RNA, 21 nt, Homo sapiens
ccucuuagccucuggaucuag

SEQ ID NO: 1178311 - RNA, 17 nt, Homo sapiens
ccucuucaucuguguag

SEQ ID NO: 1178312 - RNA, 17 nt, Homo sapiens
ccucuugcaaugccuca

SEQ ID NO: 1178313 - RNA, 16 nt, Homo sapiens
ccugaaauuaacucag

SEQ ID NO: 1178314 - RNA, 19 nt, Homo sapiens
ccugaaccuugagcaaauu

SEQ ID NO: 1178315 - RNA, 21 nt, Homo sapiens
ccugaacuauaacaccugcca

SEQ ID NO: 1178316 - RNA, 17 nt, Homo sapiens
ccugaacuguugguauu

SEQ ID NO: 1178317 - RNA, 19 nt, Homo sapiens
ccugacaaguuauuacugu

SEQ ID NO: 1178318 - RNA, 22 nt, Homo sapiens
ccugacccucaucuuucuucca

SEQ ID NO: 1178319 - RNA, 12 nt, Homo sapiens
ccugacccugua

SEQ ID NO: 1178320 - RNA, 22 nt, Homo sapiens
ccugaccucaaguaauccaccu

SEQ ID NO: 1178321 - RNA, 19 nt, Homo sapiens
ccugaccuccaguccugcu

SEQ ID NO: 1178322 - RNA, 19 nt, Homo sapiens
ccugaccuccauaugcugu

SEQ ID NO: 1178323 - RNA, 15 nt, Homo sapiens
ccugaccugagccag

SEQ ID NO: 1178324 - RNA, 18 nt, Homo sapiens
ccugacuccuccaaggaa

SEQ ID NO: 1178325 - RNA, 16 nt, Homo sapiens
ccugacugcagggguu

SEQ ID NO: 1178326 - RNA, 20 nt, Homo sapiens
ccugacuuaugaaacuugaa

SEQ ID NO: 1178327 - RNA, 17 nt, Homo sapiens
ccugagcaacaugguga

SEQ ID NO: 1178328 - RNA, 17 nt, Homo sapiens
ccugaggacuaugccau

SEQ ID NO: 1178329 - RNA, 18 nt, Homo sapiens
ccugaggcaagccaugga

SEQ ID NO: 1178330 - RNA, 11 nt, Homo sapiens
ccugaggucag

SEQ ID NO: 1178331 - RNA, 16 nt, Homo sapiens
ccugagugguccccac

SEQ ID NO: 1178332 - RNA, 18 nt, Homo sapiens
ccugaucgccaaccuuuc

SEQ ID NO: 1178333 - RNA, 22 nt, Homo sapiens
ccugauuaacugaggcauccac

SEQ ID NO: 1178334 - RNA, 14 nt, Homo sapiens
ccugcaaacgcugc

SEQ ID NO: 1178335 - RNA, 14 nt, Homo sapiens
ccugcaaucccagc

SEQ ID NO: 1178336 - RNA, 18 nt, Homo sapiens
ccugcagagauauuucuu

SEQ ID NO: 1178337 - RNA, 17 nt, Homo sapiens
acucaggcccaaagccu

SEQ ID NO: 1178338 - RNA, 17 nt, Homo sapiens
acucaggggcuuggccc

SEQ ID NO: 1178339 - RNA, 21 nt, Homo sapiens
acucagucccuaaaaacacag

SEQ ID NO: 1178340 - RNA, 17 nt, Homo sapiens
acucauauguucccaau

SEQ ID NO: 1178341 - RNA, 17 nt, Homo sapiens
acucauccugaacagca

SEQ ID NO: 1178342 - RNA, 16 nt, Homo sapiens
acucauggccuugucu

SEQ ID NO: 1178343 - RNA, 23 nt, Homo sapiens
acucauggccuugucuaacuuuu

SEQ ID NO: 1178344 - RNA, 12 nt, Homo sapiens
acuguagaugau

SEQ ID NO: 1178345 - RNA, 12 nt, Homo sapiens
acuguauacauu

SEQ ID NO: 1178346 - RNA, 13 nt, Homo sapiens
acuguauggaauc

SEQ ID NO: 1178347 - RNA, 22 nt, Homo sapiens
acugucagggagggccagggag

SEQ ID NO: 1178348 - RNA, 22 nt, Homo sapiens
acuguccagguaggaaacaauu

SEQ ID NO: 1178349 - RNA, 21 nt, Homo sapiens
acugucuguaccuaaagcaau

SEQ ID NO: 1178350 - RNA, 23 nt, Homo sapiens
acugugaaccaacccccaucucc

SEQ ID NO: 1178351 - RNA, 18 nt, Homo sapiens
acugugaaugcuucugau

SEQ ID NO: 1178352 - RNA, 20 nt, Homo sapiens
acuguggagacuuucuguua

SEQ ID NO: 1178353 - RNA, 23 nt, Homo sapiens
acuguggagacuuucuguuacua

SEQ ID NO: 1178354 - RNA, 19 nt, Homo sapiens
acuguggagguacacucuu

SEQ ID NO: 1178355 - RNA, 17 nt, Homo sapiens
acuguggcaaacaaaac

SEQ ID NO: 1178356 - RNA, 20 nt, Homo sapiens
acugugucaggaaacauauu

SEQ ID NO: 1178357 - RNA, 21 nt, Homo sapiens
acugugucagggaacauauuu

SEQ ID NO: 1178358 - RNA, 20 nt, Homo sapiens
acugugugcaacagacaaaa

SEQ ID NO: 1178359 - RNA, 18 nt, Homo sapiens
acuguguggaccaaggag

SEQ ID NO: 1178360 - RNA, 14 nt, Homo sapiens
acuguguggucuca

SEQ ID NO: 1178361 - RNA, 20 nt, Homo sapiens
acuguguuaguaaacugugc

SEQ ID NO: 1178362 - RNA, 18 nt, Homo sapiens
acuguguucacacuuuuc

SEQ ID NO: 1178363 - RNA, 18 nt, Homo sapiens
acuguguuuaucuugaua

SEQ ID NO: 1178364 - RNA, 17 nt, Homo sapiens
acuguguuucugugcuc

SEQ ID NO: 1178365 - RNA, 19 nt, Homo sapiens
acuguuaucaggacuugag

SEQ ID NO: 1178366 - RNA, 18 nt, Homo sapiens
acuguucaaacucaggcc

SEQ ID NO: 1178367 - RNA, 13 nt, Homo sapiens
acuguucccugag

SEQ ID NO: 1178368 - RNA, 13 nt, Homo sapiens
acuguucuaaagc

SEQ ID NO: 1178369 - RNA, 18 nt, Homo sapiens
acuguuuagguacugaag

SEQ ID NO: 1178370 - RNA, 16 nt, Homo sapiens
acuguuucacuugcuc

SEQ ID NO: 1178371 - RNA, 20 nt, Homo sapiens
acuuaaaagcuggcuuucau

SEQ ID NO: 1178372 - RNA, 19 nt, Homo sapiens
acuuaaacuuuuaucacug

SEQ ID NO: 1178373 - RNA, 13 nt, Homo sapiens
acuuaaagugaau

SEQ ID NO: 1178374 - RNA, 14 nt, Homo sapiens
acuuaaagugaauu

SEQ ID NO: 1178375 - RNA, 15 nt, Homo sapiens
acuuaagacugugua

SEQ ID NO: 1178376 - RNA, 18 nt, Homo sapiens
acuuaagauuugcucaug

SEQ ID NO: 1178377 - RNA, 14 nt, Homo sapiens
acuuaauaaugugu

SEQ ID NO: 1178378 - RNA, 20 nt, Homo sapiens
acuuaauaauguguacauua

SEQ ID NO: 1178379 - RNA, 19 nt, Homo sapiens
acuuacacucuuuuauaca

SEQ ID NO: 1178380 - RNA, 11 nt, Homo sapiens
acuuacccaag

SEQ ID NO: 1178381 - RNA, 16 nt, Homo sapiens
acuuaccuacugggga

SEQ ID NO: 1178382 - RNA, 16 nt, Homo sapiens
acuuagacaguaugca

SEQ ID NO: 1178383 - RNA, 14 nt, Homo sapiens
acuuagauauuuca

SEQ ID NO: 1178384 - RNA, 17 nt, Homo sapiens
acuuagaucaucaguca

SEQ ID NO: 1178385 - RNA, 23 nt, Homo sapiens
acuuagaucaucagucaccgaag

SEQ ID NO: 1178386 - RNA, 22 nt, Homo sapiens
acuuaggacuacauuuugcucu

SEQ ID NO: 1178387 - RNA, 18 nt, Homo sapiens
acuuauaaaauacaucuc

SEQ ID NO: 1178388 - RNA, 21 nt, Homo sapiens
acuuauaagaaagaucaaaga

SEQ ID NO: 1178389 - RNA, 14 nt, Homo sapiens
acuuauaauuugca

SEQ ID NO: 1178390 - RNA, 21 nt, Homo sapiens
acuuaucccugcccauuucau

SEQ ID NO: 1178391 - RNA, 18 nt, Homo sapiens
acuuaugauuucaugugc

SEQ ID NO: 1178392 - RNA, 19 nt, Homo sapiens
acuuauggagcuaacauuu

SEQ ID NO: 1178393 - RNA, 16 nt, Homo sapiens
acuuauuaacaauuag

SEQ ID NO: 1178394 - RNA, 15 nt, Homo sapiens
acuucaaaagcuuuu

SEQ ID NO: 1178395 - RNA, 20 nt, Homo sapiens
acuucaaagaggaaccagga

SEQ ID NO: 1178396 - RNA, 16 nt, Homo sapiens
acuucaacauuuacau

SEQ ID NO: 1178397 - RNA, 12 nt, Homo sapiens
acuucacaguga

SEQ ID NO: 1178398 - RNA, 22 nt, Homo sapiens
acuucacagugacacuggacca

SEQ ID NO: 1178399 - RNA, 14 nt, Homo sapiens
acuucaccaaggaa

SEQ ID NO: 1178400 - RNA, 17 nt, Homo sapiens
acuucacuaaugacgau

SEQ ID NO: 1178401 - RNA, 14 nt, Homo sapiens
acuucacuccagca

SEQ ID NO: 1178402 - RNA, 20 nt, Homo sapiens
acuucaguuuauaccuugcc

SEQ ID NO: 1178403 - RNA, 17 nt, Homo sapiens
acuucauauuaauauaa

SEQ ID NO: 1178404 - RNA, 23 nt, Homo sapiens
acuucaugcaggugaaacccagu

SEQ ID NO: 1178405 - RNA, 14 nt, Homo sapiens
acuucccucaggcc

SEQ ID NO: 1178406 - RNA, 19 nt, Homo sapiens
acuuccuauaugcacuuau

SEQ ID NO: 1178407 - RNA, 23 nt, Homo sapiens
acuuccugguugagcuucugcua

SEQ ID NO: 1178408 - RNA, 20 nt, Homo sapiens
acuucgugcggaaucagcuu

SEQ ID NO: 1178409 - RNA, 21 nt, Homo sapiens
acuucuaaaugaagugcaaau

SEQ ID NO: 1178410 - RNA, 20 nt, Homo sapiens
acuucucugggucccggggu

SEQ ID NO: 1178411 - RNA, 19 nt, Homo sapiens
acuucugaaaccucugggu

SEQ ID NO: 1178412 - RNA, 11 nt, Homo sapiens
acuucuuccau

SEQ ID NO: 1178413 - RNA, 22 nt, Homo sapiens
acuucuuuaguacuuacaucag

SEQ ID NO: 1178414 - RNA, 20 nt, Homo sapiens
acuucuuuauacucucuucc

SEQ ID NO: 1178415 - RNA, 19 nt, Homo sapiens
acuucuuucagcagacuga

SEQ ID NO: 1178416 - RNA, 17 nt, Homo sapiens
acuucuuuccaugggcg

SEQ ID NO: 1178417 - RNA, 15 nt, Homo sapiens
acuugaacacugugu

SEQ ID NO: 1178418 - RNA, 15 nt, Homo sapiens
acuugaauccauuga

SEQ ID NO: 1178419 - RNA, 22 nt, Homo sapiens
acuugaggccugagacacagcc

SEQ ID NO: 1178420 - RNA, 18 nt, Homo sapiens
acuugauaaauggaacua

SEQ ID NO: 1178421 - RNA, 21 nt, Homo sapiens
acuugaugacagacacuucua

SEQ ID NO: 1178422 - RNA, 21 nt, Homo sapiens
acuugcauccaacuccaggau

SEQ ID NO: 1178423 - RNA, 23 nt, Homo sapiens
acuugcauuuauuuaagacacug

SEQ ID NO: 1178424 - RNA, 15 nt, Homo sapiens
acuugccagggcucu

SEQ ID NO: 1178425 - RNA, 16 nt, Homo sapiens
acuugccaugugacuc

SEQ ID NO: 1178426 - RNA, 19 nt, Homo sapiens
acuugcucagguacuugua

SEQ ID NO: 1178427 - RNA, 21 nt, Homo sapiens
acuugcugaauucucugcuca

SEQ ID NO: 1178428 - RNA, 19 nt, Homo sapiens
acuugcuuaucaacuuccu

SEQ ID NO: 1178429 - RNA, 17 nt, Homo sapiens
acuuggaagaucuaccu

SEQ ID NO: 1178430 - RNA, 19 nt, Homo sapiens
acuuggagaauacugccaa

SEQ ID NO: 1178431 - RNA, 20 nt, Homo sapiens
acuuggagacuugguggucu

SEQ ID NO: 1178432 - RNA, 17 nt, Homo sapiens
acuuggcgcugccauuu

SEQ ID NO: 1178433 - RNA, 21 nt, Homo sapiens
acuugggaauaaaucauagca

SEQ ID NO: 1178434 - RNA, 21 nt, Homo sapiens
acuuguaaauaaaggaaccau

SEQ ID NO: 1178435 - RNA, 19 nt, Homo sapiens
acuuguagucuccaugcaa

SEQ ID NO: 1178436 - RNA, 14 nt, Homo sapiens
acuugucccgggac

SEQ ID NO: 1178437 - RNA, 14 nt, Homo sapiens
acuuguucauuugg

SEQ ID NO: 1178438 - RNA, 17 nt, Homo sapiens
acuuguucauuuuucuc

SEQ ID NO: 1178439 - RNA, 19 nt, Homo sapiens
acuuuaaaacuguauuuaa

SEQ ID NO: 1178440 - RNA, 17 nt, Homo sapiens
acuuuacaaaaguauua

SEQ ID NO: 1178441 - RNA, 14 nt, Homo sapiens
acuuuauaguuguu

SEQ ID NO: 1178442 - RNA, 13 nt, Homo sapiens
acuuuaucaaaga

SEQ ID NO: 1178443 - RNA, 21 nt, Homo sapiens
acuuuaucaauuaacugagua

SEQ ID NO: 1178444 - RNA, 16 nt, Homo sapiens
acuuuaugaugcuaug

SEQ ID NO: 1178445 - RNA, 13 nt, Homo sapiens
acuuuauguucua

SEQ ID NO: 1178446 - RNA, 13 nt, Homo sapiens
acuuucaaacaua

SEQ ID NO: 1178447 - RNA, 13 nt, Homo sapiens
acuuucacugaau

SEQ ID NO: 1178448 - RNA, 14 nt, Homo sapiens
acuuuccaaaucca

SEQ ID NO: 1178449 - RNA, 17 nt, Homo sapiens
acuuuccucuuccugcc

SEQ ID NO: 1178450 - RNA, 21 nt, Homo sapiens
acuuucugaagccucacuuau

SEQ ID NO: 1178451 - RNA, 15 nt, Homo sapiens
acuuucuucugaaua

SEQ ID NO: 1178452 - RNA, 17 nt, Homo sapiens
acuuugaagaguacaaa

SEQ ID NO: 1178453 - RNA, 19 nt, Homo sapiens
acuuugauugaaguauuca

SEQ ID NO: 1178454 - RNA, 18 nt, Homo sapiens
acuuugcaggaugaccuc

SEQ ID NO: 1178455 - RNA, 19 nt, Homo sapiens
acuuuggguuuuuaacuca

SEQ ID NO: 1178456 - RNA, 14 nt, Homo sapiens
acuuuguaugucau

SEQ ID NO: 1178457 - RNA, 15 nt, Homo sapiens
acuuugucacaucua

SEQ ID NO: 1178458 - RNA, 17 nt, Homo sapiens
acuuuguuuacuuauaa

SEQ ID NO: 1178459 - RNA, 18 nt, Homo sapiens
acuuuuaaaacuuugcca

SEQ ID NO: 1178460 - RNA, 18 nt, Homo sapiens
acuuuuaaguuuccuucc

SEQ ID NO: 1178461 - RNA, 15 nt, Homo sapiens
acuuuuaauuucacu

SEQ ID NO: 1178462 - RNA, 13 nt, Homo sapiens
acuuuuaucacug

SEQ ID NO: 1178463 - RNA, 14 nt, Homo sapiens
acuuuucauugcaa

SEQ ID NO: 1178464 - RNA, 15 nt, Homo sapiens
acuuuucauugcaaa

SEQ ID NO: 1178465 - RNA, 18 nt, Homo sapiens
acuuuucggucuuuccca

SEQ ID NO: 1178466 - RNA, 22 nt, Homo sapiens
acuuuuguaaaaucaaaucauc

SEQ ID NO: 1178467 - RNA, 22 nt, Homo sapiens
agaaaaaaaaaugccauaauac

SEQ ID NO: 1178468 - RNA, 16 nt, Homo sapiens
agaaaaaaaccaaagu

SEQ ID NO: 1178469 - RNA, 21 nt, Homo sapiens
agaaaaaaagcaugugucaug

SEQ ID NO: 1178470 - RNA, 21 nt, Homo sapiens
agaaaaaaggguuuaugcuua

SEQ ID NO: 1178471 - RNA, 21 nt, Homo sapiens
agaaaaacaccgcuucugccu

SEQ ID NO: 1178472 - RNA, 17 nt, Homo sapiens
agaaaaaccugugauuc

SEQ ID NO: 1178473 - RNA, 14 nt, Homo sapiens
agaaaagaccuuuu

SEQ ID NO: 1178474 - RNA, 11 nt, Homo sapiens
agaaaaguaac

SEQ ID NO: 1178475 - RNA, 14 nt, Homo sapiens
agaaaagugcauau

SEQ ID NO: 1178476 - RNA, 21 nt, Homo sapiens
agaaaagugcauauuuaucca

SEQ ID NO: 1178477 - RNA, 21 nt, Homo sapiens
agaaaaguuauuagugguuua

SEQ ID NO: 1178478 - RNA, 22 nt, Homo sapiens
acauccaugcggaguccauuau

SEQ ID NO: 1178479 - RNA, 17 nt, Homo sapiens
acauccauucuucccuu

SEQ ID NO: 1178480 - RNA, 20 nt, Homo sapiens
acaucccagacacauucaca

SEQ ID NO: 1178481 - RNA, 22 nt, Homo sapiens
acauccccagagcccagcucuu

SEQ ID NO: 1178482 - RNA, 17 nt, Homo sapiens
acaucucccauggcucu

SEQ ID NO: 1178483 - RNA, 23 nt, Homo sapiens
acaucucuuccuccgaggccagu

SEQ ID NO: 1178484 - RNA, 20 nt, Homo sapiens
acaucugagagaugacaggg

SEQ ID NO: 1178485 - RNA, 12 nt, Homo sapiens
acaucugcaaua

SEQ ID NO: 1178486 - RNA, 22 nt, Homo sapiens
acaucugugucucuggaaccca

SEQ ID NO: 1178487 - RNA, 15 nt, Homo sapiens
acaucugugucuugu

SEQ ID NO: 1178488 - RNA, 17 nt, Homo sapiens
acaucuuaaagcuaaaa

SEQ ID NO: 1178489 - RNA, 12 nt, Homo sapiens
acaucuuguuaa

SEQ ID NO: 1178490 - RNA, 16 nt, Homo sapiens
acaugaaaacauugau

SEQ ID NO: 1178491 - RNA, 23 nt, Homo sapiens
acaugaaucccacccacauguga

SEQ ID NO: 1178492 - RNA, 15 nt, Homo sapiens
acaugagaaagggag

SEQ ID NO: 1178493 - RNA, 22 nt, Homo sapiens
acaugagauguguggacugugg

SEQ ID NO: 1178494 - RNA, 14 nt, Homo sapiens
acaugagucaagag

SEQ ID NO: 1178495 - RNA, 16 nt, Homo sapiens
acaugcaauuuugcau

SEQ ID NO: 1178496 - RNA, 15 nt, Homo sapiens
acaugcaccuaccca

SEQ ID NO: 1178497 - RNA, 21 nt, Homo sapiens
acaugcacucagcucuuggcu

SEQ ID NO: 1178498 - RNA, 10 nt, Homo sapiens
acaugcaguu

SEQ ID NO: 1178499 - RNA, 14 nt, Homo sapiens
acaugccacaagga

SEQ ID NO: 1178500 - RNA, 22 nt, Homo sapiens
acauggacaugcuucagugcug

SEQ ID NO: 1178501 - RNA, 23 nt, Homo sapiens
acauggacucagagaaaagagau

SEQ ID NO: 1178502 - RNA, 13 nt, Homo sapiens
acauggagcucuu

SEQ ID NO: 1178503 - RNA, 16 nt, Homo sapiens
acauggccuaugcaca

SEQ ID NO: 1178504 - RNA, 19 nt, Homo sapiens
acauggccuaugcacauau

SEQ ID NO: 1178505 - RNA, 14 nt, Homo sapiens
acauggcuaaauac

SEQ ID NO: 1178506 - RNA, 23 nt, Homo sapiens
acauggcuccggccucugccuuu

SEQ ID NO: 1178507 - RNA, 10 nt, Homo sapiens
acaugggagc

SEQ ID NO: 1178508 - RNA, 24 nt, Homo sapiens
acauggugaaaaccccaucucuac

SEQ ID NO: 1178509 - RNA, 17 nt, Homo sapiens
acaugguugugagucuu

SEQ ID NO: 1178510 - RNA, 22 nt, Homo sapiens
acauguaauugcagauaacuuu

SEQ ID NO: 1178511 - RNA, 19 nt, Homo sapiens
acauguacuguuacugugu

SEQ ID NO: 1178512 - RNA, 19 nt, Homo sapiens
acauguaugugcauuucaa

SEQ ID NO: 1178513 - RNA, 22 nt, Homo sapiens
acauguauguggauacagucau

SEQ ID NO: 1178514 - RNA, 20 nt, Homo sapiens
acauguguuugaacuauugc

SEQ ID NO: 1178515 - RNA, 15 nt, Homo sapiens
acauguuaucaaauc

SEQ ID NO: 1178516 - RNA, 20 nt, Homo sapiens
acauguuuccuaccaagcau

SEQ ID NO: 1178517 - RNA, 14 nt, Homo sapiens
acauuaaaucacuu

SEQ ID NO: 1178518 - RNA, 13 nt, Homo sapiens
acauuaugugguu

SEQ ID NO: 1178519 - RNA, 15 nt, Homo sapiens
acauucagauuuacc

SEQ ID NO: 1178520 - RNA, 20 nt, Homo sapiens
acauucaggagcuuccuguc

SEQ ID NO: 1178521 - RNA, 21 nt, Homo sapiens
acauucagugaaaaacuugua

SEQ ID NO: 1178522 - RNA, 13 nt, Homo sapiens
acauucaugcuca

SEQ ID NO: 1178523 - RNA, 15 nt, Homo sapiens
acauucucuaauaag

SEQ ID NO: 1178524 - RNA, 15 nt, Homo sapiens
acauugacacaauaa

SEQ ID NO: 1178525 - RNA, 14 nt, Homo sapiens
acauugccaaaaag

SEQ ID NO: 1178526 - RNA, 17 nt, Homo sapiens
acauuggcaccuaaucc

SEQ ID NO: 1178527 - RNA, 11 nt, Homo sapiens
acauugugccc

SEQ ID NO: 1178528 - RNA, 20 nt, Homo sapiens
acauuuaccagcaacuugaa

SEQ ID NO: 1178529 - RNA, 20 nt, Homo sapiens
acauuugugccgacacuguu

SEQ ID NO: 1178530 - RNA, 18 nt, Homo sapiens
acauuuucaauacugucc

SEQ ID NO: 1178531 - RNA, 16 nt, Homo sapiens
acauuuucauaucauc

SEQ ID NO: 1178532 - RNA, 19 nt, Homo sapiens
acauuuuuauaaaaaugag

SEQ ID NO: 1178533 - RNA, 12 nt, Homo sapiens
accaaaaacuga

SEQ ID NO: 1178534 - RNA, 16 nt, Homo sapiens
accaaaaccacagugc

SEQ ID NO: 1178535 - RNA, 16 nt, Homo sapiens
accaaaaguuacaugu

SEQ ID NO: 1178536 - RNA, 17 nt, Homo sapiens
accaaaaugauacuuac

SEQ ID NO: 1178537 - RNA, 18 nt, Homo sapiens
accaaacaggaaguggac

SEQ ID NO: 1178538 - RNA, 16 nt, Homo sapiens
accaaagaaauuauaa

SEQ ID NO: 1178539 - RNA, 22 nt, Homo sapiens
accaaagggaugguauugagaa

SEQ ID NO: 1178540 - RNA, 11 nt, Homo sapiens
accaaaucauc

SEQ ID NO: 1178541 - RNA, 14 nt, Homo sapiens
accaaaucaucucu

SEQ ID NO: 1178542 - RNA, 17 nt, Homo sapiens
accaaaucaucucucau

SEQ ID NO: 1178543 - RNA, 14 nt, Homo sapiens
accaaauugcuucu

SEQ ID NO: 1178544 - RNA, 13 nt, Homo sapiens
accaaauuuguau

SEQ ID NO: 1178545 - RNA, 14 nt, Homo sapiens
accaacauggagaa

SEQ ID NO: 1178546 - RNA, 19 nt, Homo sapiens
accaaccccgcggcccaga

SEQ ID NO: 1178547 - RNA, 18 nt, Homo sapiens
accaagaacauaagaauu

SEQ ID NO: 1178548 - RNA, 18 nt, Homo sapiens
accaagcaggaagcucag

SEQ ID NO: 1178549 - RNA, 19 nt, Homo sapiens
accaagcauuuagugcaca

SEQ ID NO: 1178550 - RNA, 15 nt, Homo sapiens
accaagcucugucca

SEQ ID NO: 1178551 - RNA, 18 nt, Homo sapiens
accaaggccccgagcuca

SEQ ID NO: 1178552 - RNA, 19 nt, Homo sapiens
accaagucaggccaggugg

SEQ ID NO: 1178553 - RNA, 14 nt, Homo sapiens
accaauacauuugu

SEQ ID NO: 1178554 - RNA, 14 nt, Homo sapiens
accaaugccaaaaa

SEQ ID NO: 1178555 - RNA, 14 nt, Homo sapiens
accacacacaacag

SEQ ID NO: 1178556 - RNA, 21 nt, Homo sapiens
accacacgcccccacaggcuc

SEQ ID NO: 1178557 - RNA, 14 nt, Homo sapiens
accacaucuugucu

SEQ ID NO: 1178558 - RNA, 13 nt, Homo sapiens
accacgacuggcc

SEQ ID NO: 1178559 - RNA, 21 nt, Homo sapiens
accacucuuccugaguucagu

SEQ ID NO: 1178560 - RNA, 15 nt, Homo sapiens
accacugacccaaau

SEQ ID NO: 1178561 - RNA, 20 nt, Homo sapiens
accacuguggaagucccuca

SEQ ID NO: 1178562 - RNA, 22 nt, Homo sapiens
accagaaguuaaaccaugugac

SEQ ID NO: 1178563 - RNA, 22 nt, Homo sapiens
accagacagacaacacugggaa

SEQ ID NO: 1178564 - RNA, 15 nt, Homo sapiens
accagacccugaauu

SEQ ID NO: 1178565 - RNA, 22 nt, Homo sapiens
accagacucgccaacaugguga

SEQ ID NO: 1178566 - RNA, 11 nt, Homo sapiens
accagaggcag

SEQ ID NO: 1178567 - RNA, 15 nt, Homo sapiens
accagagugggacca

SEQ ID NO: 1178568 - RNA, 22 nt, Homo sapiens
accagagugggaccaaguccaa

SEQ ID NO: 1178569 - RNA, 16 nt, Homo sapiens
accagauaacugagga

SEQ ID NO: 1178570 - RNA, 19 nt, Homo sapiens
accagauagcucaauacuc

SEQ ID NO: 1178571 - RNA, 15 nt, Homo sapiens
accagcaccgugaca

SEQ ID NO: 1178572 - RNA, 14 nt, Homo sapiens
accagcagcgccuu

SEQ ID NO: 1178573 - RNA, 15 nt, Homo sapiens
accagcaguacucag

SEQ ID NO: 1178574 - RNA, 16 nt, Homo sapiens
accagcccugcugcuu

SEQ ID NO: 1178575 - RNA, 14 nt, Homo sapiens
accagccugagcaa

SEQ ID NO: 1178576 - RNA, 21 nt, Homo sapiens
accagccuguccaacauggug

SEQ ID NO: 1178577 - RNA, 13 nt, Homo sapiens
accagcucagggg

SEQ ID NO: 1178578 - RNA, 15 nt, Homo sapiens
accaggaggacaaga

SEQ ID NO: 1178579 - RNA, 16 nt, Homo sapiens
accaggggaccagagg

SEQ ID NO: 1178580 - RNA, 20 nt, Homo sapiens
accaggguugaccccagagg

SEQ ID NO: 1178581 - RNA, 20 nt, Homo sapiens
accagguccauuuugccuga

SEQ ID NO: 1178582 - RNA, 23 nt, Homo sapiens
accaggucucccgggaagccacc

SEQ ID NO: 1178583 - RNA, 19 nt, Homo sapiens
accagguuugcaccuaagu

SEQ ID NO: 1178584 - RNA, 13 nt, Homo sapiens
accaguaugacag

SEQ ID NO: 1178585 - RNA, 20 nt, Homo sapiens
accagugaagacgucagggg

SEQ ID NO: 1178586 - RNA, 18 nt, Homo sapiens
accagugaaucuuuguca

SEQ ID NO: 1178587 - RNA, 13 nt, Homo sapiens
accagugcugcug

SEQ ID NO: 1178588 - RNA, 17 nt, Homo sapiens
accauaccuuugcuacu

SEQ ID NO: 1178589 - RNA, 20 nt, Homo sapiens
accauagggacccauucuac

SEQ ID NO: 1178590 - RNA, 20 nt, Homo sapiens
accaucaacuuaaagugaau

SEQ ID NO: 1178591 - RNA, 17 nt, Homo sapiens
accaucacaugaccaca

SEQ ID NO: 1178592 - RNA, 19 nt, Homo sapiens
accaucacugguugcacuu

SEQ ID NO: 1178593 - RNA, 17 nt, Homo sapiens
accaucuaugugaauau

SEQ ID NO: 1178594 - RNA, 19 nt, Homo sapiens
accaucugugacuauaaag

SEQ ID NO: 1178595 - RNA, 16 nt, Homo sapiens
accaugcgacacuggg

SEQ ID NO: 1178596 - RNA, 9 nt, Homo sapiens
accaugcug

SEQ ID NO: 1178597 - RNA, 23 nt, Homo sapiens
accauggggaagaaaucuggucu

SEQ ID NO: 1178598 - RNA, 21 nt, Homo sapiens
accaugugacuaaaaaugcau

SEQ ID NO: 1178599 - RNA, 23 nt, Homo sapiens
accaugugauuauggacaucgau

SEQ ID NO: 1178600 - RNA, 18 nt, Homo sapiens
accauguuguccaggcug

SEQ ID NO: 1178601 - RNA, 20 nt, Homo sapiens
accauuaaccagaucuaguc

SEQ ID NO: 1178602 - RNA, 15 nt, Homo sapiens
accauuauagccuca

SEQ ID NO: 1178603 - RNA, 20 nt, Homo sapiens
accauucuugagucauggau

SEQ ID NO: 1178604 - RNA, 18 nt, Homo sapiens
accauuuguuaacuguac

SEQ ID NO: 1178605 - RNA, 13 nt, Homo sapiens
accauuuuaucuu

SEQ ID NO: 1178606 - RNA, 17 nt, Homo sapiens
aacccaggcaggcauuu

SEQ ID NO: 1178607 - RNA, 22 nt, Homo sapiens
aacccagugaguucagccuuua

SEQ ID NO: 1178608 - RNA, 13 nt, Homo sapiens
aacccaguggcug

SEQ ID NO: 1178609 - RNA, 22 nt, Homo sapiens
aacccauaggcccacacacagg

SEQ ID NO: 1178610 - RNA, 16 nt, Homo sapiens
aaccccagacacuggu

SEQ ID NO: 1178611 - RNA, 21 nt, Homo sapiens
aaccccuagagacagugaugc

SEQ ID NO: 1178612 - RNA, 22 nt, Homo sapiens
aaccccucccccacgucucucu

SEQ ID NO: 1178613 - RNA, 21 nt, Homo sapiens
aacccugacuccucuuugugc

SEQ ID NO: 1178614 - RNA, 19 nt, Homo sapiens
aacccuggaccaguggucu

SEQ ID NO: 1178615 - RNA, 17 nt, Homo sapiens
aacccuuaaaaaugcac

SEQ ID NO: 1178616 - RNA, 18 nt, Homo sapiens
aacccuuagaccuguaga

SEQ ID NO: 1178617 - RNA, 14 nt, Homo sapiens
aaccgugugucaug

SEQ ID NO: 1178618 - RNA, 17 nt, Homo sapiens
aaccuaccuuaucaugu

SEQ ID NO: 1178619 - RNA, 15 nt, Homo sapiens
aaccuaugauuguaa

SEQ ID NO: 1178620 - RNA, 20 nt, Homo sapiens
aaccucaagugauccuccca

SEQ ID NO: 1178621 - RNA, 23 nt, Homo sapiens
aaccucaggccacaucuuuucca

SEQ ID NO: 1178622 - RNA, 23 nt, Homo sapiens
aaccucagugauuggcucugugg

SEQ ID NO: 1178623 - RNA, 16 nt, Homo sapiens
aaccucgaguacugug

SEQ ID NO: 1178624 - RNA, 22 nt, Homo sapiens
aaccucugggucaucucucaca

SEQ ID NO: 1178625 - RNA, 16 nt, Homo sapiens
aaccugaaauuaacuc

SEQ ID NO: 1178626 - RNA, 18 nt, Homo sapiens
aaccugcacuucauaucu

SEQ ID NO: 1178627 - RNA, 19 nt, Homo sapiens
aaccuggagccugaauaca

SEQ ID NO: 1178628 - RNA, 21 nt, Homo sapiens
aaccuguauaacccuguuaca

SEQ ID NO: 1178629 - RNA, 14 nt, Homo sapiens
aaccugugauucau

SEQ ID NO: 1178630 - RNA, 23 nt, Homo sapiens
aaccuuagaaagacuacauguua

SEQ ID NO: 1178631 - RNA, 13 nt, Homo sapiens
aaccuuaguuuca

SEQ ID NO: 1178632 - RNA, 13 nt, Homo sapiens
aaccuugaggaaa

SEQ ID NO: 1178633 - RNA, 15 nt, Homo sapiens
aaccuugguguaguu

SEQ ID NO: 1178634 - RNA, 12 nt, Homo sapiens
aaccuuugccaa

SEQ ID NO: 1178635 - RNA, 18 nt, Homo sapiens
aacgagaagguacugaaa

SEQ ID NO: 1178636 - RNA, 22 nt, Homo sapiens
aacgagauugcuggaaaccaag

SEQ ID NO: 1178637 - RNA, 15 nt, Homo sapiens
aacgcaucacugggg

SEQ ID NO: 1178638 - RNA, 23 nt, Homo sapiens
aacgcugaagcggucagacugga

SEQ ID NO: 1178639 - RNA, 21 nt, Homo sapiens
aacguagcuucuaccaugaac

SEQ ID NO: 1178640 - RNA, 15 nt, Homo sapiens
aacguccacaugaaa

SEQ ID NO: 1178641 - RNA, 15 nt, Homo sapiens
aacguccaucucucu

SEQ ID NO: 1178642 - RNA, 15 nt, Homo sapiens
aacguugacaaguuu

SEQ ID NO: 1178643 - RNA, 13 nt, Homo sapiens
aacuaaaauguua

SEQ ID NO: 1178644 - RNA, 14 nt, Homo sapiens
aacuaaacacguga

SEQ ID NO: 1178645 - RNA, 22 nt, Homo sapiens
aacuaaagguggccacaaauuc

SEQ ID NO: 1178646 - RNA, 12 nt, Homo sapiens
aacuaacuacug

SEQ ID NO: 1178647 - RNA, 16 nt, Homo sapiens
aacuacccaaaacaag

SEQ ID NO: 1178648 - RNA, 17 nt, Homo sapiens
aacuacccaaaacaagc

SEQ ID NO: 1178649 - RNA, 21 nt, Homo sapiens
aacuacuauuuuuagcaaugu

SEQ ID NO: 1178650 - RNA, 23 nt, Homo sapiens
aacuacuauuuuuagcaauguuu

SEQ ID NO: 1178651 - RNA, 15 nt, Homo sapiens
aacuacuggcaauuu

SEQ ID NO: 1178652 - RNA, 21 nt, Homo sapiens
aacuacuuaucucuaaaccau

SEQ ID NO: 1178653 - RNA, 20 nt, Homo sapiens
aacuagagcacagaaggaau

SEQ ID NO: 1178654 - RNA, 16 nt, Homo sapiens
aacuagagggaccuau

SEQ ID NO: 1178655 - RNA, 15 nt, Homo sapiens
aacuagaugaccuca

SEQ ID NO: 1178656 - RNA, 19 nt, Homo sapiens
aacuagcucuauguuuaca

SEQ ID NO: 1178657 - RNA, 22 nt, Homo sapiens
aacuauaacaccugccaccacu

SEQ ID NO: 1178658 - RNA, 12 nt, Homo sapiens
aacuauaccucu

SEQ ID NO: 1178659 - RNA, 18 nt, Homo sapiens
aacuauaugguaguuuaa

SEQ ID NO: 1178660 - RNA, 15 nt, Homo sapiens
aacuauguaaugcuu

SEQ ID NO: 1178661 - RNA, 20 nt, Homo sapiens
aacuauuggggugaggauaa

SEQ ID NO: 1178662 - RNA, 17 nt, Homo sapiens
aacuauuguauaauggg

SEQ ID NO: 1178663 - RNA, 20 nt, Homo sapiens
aacucaaaucgaauagggaa

SEQ ID NO: 1178664 - RNA, 13 nt, Homo sapiens
aacucagauccag

SEQ ID NO: 1178665 - RNA, 23 nt, Homo sapiens
aacucagauccagggacagaggc

SEQ ID NO: 1178666 - RNA, 10 nt, Homo sapiens
aacucaggga

SEQ ID NO: 1178667 - RNA, 21 nt, Homo sapiens
aacucagugaaggcccaugaa

SEQ ID NO: 1178668 - RNA, 19 nt, Homo sapiens
aacucaugaggagggaaaa

SEQ ID NO: 1178669 - RNA, 19 nt, Homo sapiens
aacucauuucuuauaucau

SEQ ID NO: 1178670 - RNA, 18 nt, Homo sapiens
aacuccaccuucccacuu

SEQ ID NO: 1178671 - RNA, 23 nt, Homo sapiens
aacuccccuguuucaaucacugu

SEQ ID NO: 1178672 - RNA, 23 nt, Homo sapiens
aacucccugagagccacaggugc

SEQ ID NO: 1178673 - RNA, 19 nt, Homo sapiens
aacuccuuccauccuugac

SEQ ID NO: 1178674 - RNA, 21 nt, Homo sapiens
aacucuaaaaaagaagcacca

SEQ ID NO: 1178675 - RNA, 17 nt, Homo sapiens
aacucuacaucuagcaa

SEQ ID NO: 1178676 - RNA, 21 nt, Homo sapiens
aacucuacaucuagcaauuuc

SEQ ID NO: 1178677 - RNA, 13 nt, Homo sapiens
aacucuggcucca

SEQ ID NO: 1178678 - RNA, 22 nt, Homo sapiens
aacucugucuucaccugauuca

SEQ ID NO: 1178679 - RNA, 20 nt, Homo sapiens
aacucuuaacugaagaaaga

SEQ ID NO: 1178680 - RNA, 23 nt, Homo sapiens
aacucuuaacugaagaaagagaa

SEQ ID NO: 1178681 - RNA, 21 nt, Homo sapiens
aacucuuguauugcuccauuu

SEQ ID NO: 1178682 - RNA, 14 nt, Homo sapiens
aacugauuuaucua

SEQ ID NO: 1178683 - RNA, 11 nt, Homo sapiens
aacugcaacuc

SEQ ID NO: 1178684 - RNA, 20 nt, Homo sapiens
aacugcagcgaguacuuccc

SEQ ID NO: 1178685 - RNA, 20 nt, Homo sapiens
aacugcagucaucaacaaug

SEQ ID NO: 1178686 - RNA, 23 nt, Homo sapiens
aacugcauaagugaaaaucuuac

SEQ ID NO: 1178687 - RNA, 17 nt, Homo sapiens
aacugcauuccuucccc

SEQ ID NO: 1178688 - RNA, 23 nt, Homo sapiens
aacugccuuauuaaagcaaaaau

SEQ ID NO: 1178689 - RNA, 14 nt, Homo sapiens
aacugcuccagcuc

SEQ ID NO: 1178690 - RNA, 17 nt, Homo sapiens
aacugcugaucaaugaa

SEQ ID NO: 1178691 - RNA, 14 nt, Homo sapiens
aacuggcaguuuuc

SEQ ID NO: 1178692 - RNA, 17 nt, Homo sapiens
aacuggcaguuuuccau

SEQ ID NO: 1178693 - RNA, 23 nt, Homo sapiens
aacugguuccuagggauguguga

SEQ ID NO: 1178694 - RNA, 14 nt, Homo sapiens
aacugguucuugcc

SEQ ID NO: 1178695 - RNA, 19 nt, Homo sapiens
aacuguacaaauugugaug

SEQ ID NO: 1178696 - RNA, 13 nt, Homo sapiens
aacuguacugaau

SEQ ID NO: 1178697 - RNA, 14 nt, Homo sapiens
aacuguagauggaa

SEQ ID NO: 1178698 - RNA, 21 nt, Homo sapiens
aacuguauacauuacaaucau

SEQ ID NO: 1178699 - RNA, 12 nt, Homo sapiens
aacuguauuuau

SEQ ID NO: 1178700 - RNA, 13 nt, Homo sapiens
aacuguauuugau

SEQ ID NO: 1178701 - RNA, 14 nt, Homo sapiens
aacugucacucauu

SEQ ID NO: 1178702 - RNA, 13 nt, Homo sapiens
aacugugaugaag

SEQ ID NO: 1178703 - RNA, 20 nt, Homo sapiens
aacuuagaucaucagucacc

SEQ ID NO: 1178704 - RNA, 14 nt, Homo sapiens
aacuuagcacuacu

SEQ ID NO: 1178705 - RNA, 12 nt, Homo sapiens
aacuucaaagag

SEQ ID NO: 1178706 - RNA, 16 nt, Homo sapiens
aacuuccauucuuucu

SEQ ID NO: 1178707 - RNA, 24 nt, Homo sapiens
aacuucuacuucugcccuugccaa

SEQ ID NO: 1178708 - RNA, 14 nt, Homo sapiens
aacuucugaacuug

SEQ ID NO: 1178709 - RNA, 12 nt, Homo sapiens
aacuucugccuc

SEQ ID NO: 1178710 - RNA, 15 nt, Homo sapiens
aacuucuuacuggaa

SEQ ID NO: 1178711 - RNA, 21 nt, Homo sapiens
aacuucuuauacgucuagccu

SEQ ID NO: 1178712 - RNA, 22 nt, Homo sapiens
aacuucuuauacgucuagccua

SEQ ID NO: 1178713 - RNA, 15 nt, Homo sapiens
aacuugcuuucacuu

SEQ ID NO: 1178714 - RNA, 12 nt, Homo sapiens
aacuuggcugca

SEQ ID NO: 1178715 - RNA, 17 nt, Homo sapiens
aacuuguuacuaaagaa

SEQ ID NO: 1178716 - RNA, 21 nt, Homo sapiens
aacuuuaagaaagguaaagac

SEQ ID NO: 1178717 - RNA, 16 nt, Homo sapiens
aacuuuuauuacuggg

SEQ ID NO: 1178718 - RNA, 19 nt, Homo sapiens
aacuuuuugcaaggcauuu

SEQ ID NO: 1178719 - RNA, 12 nt, Homo sapiens
aacuuuuugcca

SEQ ID NO: 1178720 - RNA, 21 nt, Homo sapiens
aagaaaaacaccgcuucugcc

SEQ ID NO: 1178721 - RNA, 23 nt, Homo sapiens
aagaaaaagaccuaugagcacau

SEQ ID NO: 1178722 - RNA, 14 nt, Homo sapiens
aagaaaaauuaucu

SEQ ID NO: 1178723 - RNA, 16 nt, Homo sapiens
aagaaaacaucacuga

SEQ ID NO: 1178724 - RNA, 15 nt, Homo sapiens
aagaaaaccaccccu

SEQ ID NO: 1178725 - RNA, 13 nt, Homo sapiens
aagaaaacuuuaa

SEQ ID NO: 1178726 - RNA, 14 nt, Homo sapiens
aagaaaagaccuuu

SEQ ID NO: 1178727 - RNA, 20 nt, Homo sapiens
aagaaaauuauugaguauga

SEQ ID NO: 1178728 - RNA, 22 nt, Homo sapiens
aagaaaccuucagauuuguguu

SEQ ID NO: 1178729 - RNA, 15 nt, Homo sapiens
aagaaacgcuucaga

SEQ ID NO: 1178730 - RNA, 15 nt, Homo sapiens
aagaaacgucuucua

SEQ ID NO: 1178731 - RNA, 18 nt, Homo sapiens
auuugccacugauauuca

SEQ ID NO: 1178732 - RNA, 13 nt, Homo sapiens
auuugcugucaca

SEQ ID NO: 1178733 - RNA, 14 nt, Homo sapiens
auuuggaaccaaag

SEQ ID NO: 1178734 - RNA, 14 nt, Homo sapiens
auuuggcauugauc

SEQ ID NO: 1178735 - RNA, 18 nt, Homo sapiens
auuuggcauugaucuuaa

SEQ ID NO: 1178736 - RNA, 22 nt, Homo sapiens
auuuggcucuucugacauuuau

SEQ ID NO: 1178737 - RNA, 20 nt, Homo sapiens
auuugggcuggaacauguaa

SEQ ID NO: 1178738 - RNA, 12 nt, Homo sapiens
auuugguacaaa

SEQ ID NO: 1178739 - RNA, 17 nt, Homo sapiens
auuugguacaaaaccac

SEQ ID NO: 1178740 - RNA, 22 nt, Homo sapiens
auuuggucacacucucaccuag

SEQ ID NO: 1178741 - RNA, 19 nt, Homo sapiens
auuuguaacuuuguugcau

SEQ ID NO: 1178742 - RNA, 14 nt, Homo sapiens
auuuguaguugcau

SEQ ID NO: 1178743 - RNA, 18 nt, Homo sapiens
auuuguauccuugaugaa

SEQ ID NO: 1178744 - RNA, 16 nt, Homo sapiens
auuuguguacuugugu

SEQ ID NO: 1178745 - RNA, 20 nt, Homo sapiens
auuuguucguauuuagaaug

SEQ ID NO: 1178746 - RNA, 17 nt, Homo sapiens
auuuguugagaguguga

SEQ ID NO: 1178747 - RNA, 16 nt, Homo sapiens
auuuguuuaguuuuga

SEQ ID NO: 1178748 - RNA, 16 nt, Homo sapiens
auuuguuuguauucau

SEQ ID NO: 1178749 - RNA, 20 nt, Homo sapiens
auuuuaaaauguauaccaag

SEQ ID NO: 1178750 - RNA, 17 nt, Homo sapiens
auuuuaagaauuucaca

SEQ ID NO: 1178751 - RNA, 16 nt, Homo sapiens
auuuuaauaacauauc

SEQ ID NO: 1178752 - RNA, 23 nt, Homo sapiens
auuuuaauagggaauauaucucu

SEQ ID NO: 1178753 - RNA, 16 nt, Homo sapiens
auuuuaauguuuccuu

SEQ ID NO: 1178754 - RNA, 13 nt, Homo sapiens
auuuuacacaguu

SEQ ID NO: 1178755 - RNA, 17 nt, Homo sapiens
auuuuacccuuuagacu

SEQ ID NO: 1178756 - RNA, 16 nt, Homo sapiens
auuuuauaaagaggca

SEQ ID NO: 1178757 - RNA, 14 nt, Homo sapiens
auuuuaucuguuaa

SEQ ID NO: 1178758 - RNA, 17 nt, Homo sapiens
auuuuaugacaguaucg

SEQ ID NO: 1178759 - RNA, 14 nt, Homo sapiens
auuuuauuacuaau

SEQ ID NO: 1178760 - RNA, 22 nt, Homo sapiens
auuuucaagagucuaauagucu

SEQ ID NO: 1178761 - RNA, 14 nt, Homo sapiens
auuuucaaguaauu

SEQ ID NO: 1178762 - RNA, 14 nt, Homo sapiens
auuuucagcaaaac

SEQ ID NO: 1178763 - RNA, 23 nt, Homo sapiens
auuuuccuccaucgcaguguuca

SEQ ID NO: 1178764 - RNA, 14 nt, Homo sapiens
auuuucuugucaau

SEQ ID NO: 1178765 - RNA, 17 nt, Homo sapiens
auuuucuuuuuauacua

SEQ ID NO: 1178766 - RNA, 17 nt, Homo sapiens
auuuugaaaacacuuau

SEQ ID NO: 1178767 - RNA, 22 nt, Homo sapiens
auuuugcucugugaacuauccc

SEQ ID NO: 1178768 - RNA, 21 nt, Homo sapiens
auuuugggagaguaaagcuaa

SEQ ID NO: 1178769 - RNA, 19 nt, Homo sapiens
auuuugggguuguguuguc

SEQ ID NO: 1178770 - RNA, 22 nt, Homo sapiens
auuuuguauaauuguaucguau

SEQ ID NO: 1178771 - RNA, 14 nt, Homo sapiens
auuuuguccauguc

SEQ ID NO: 1178772 - RNA, 20 nt, Homo sapiens
auuuuuaaaaaucuaccugu

SEQ ID NO: 1178773 - RNA, 18 nt, Homo sapiens
auuuuuacagcacacacu

SEQ ID NO: 1178774 - RNA, 19 nt, Homo sapiens
auuuuuacaguucucccaa

SEQ ID NO: 1178775 - RNA, 20 nt, Homo sapiens
auuuuuaguagagacagggu

SEQ ID NO: 1178776 - RNA, 22 nt, Homo sapiens
auuuuuaguuuaaaaucuugca

SEQ ID NO: 1178777 - RNA, 21 nt, Homo sapiens
auuuuuauaaaaaugagugcu

SEQ ID NO: 1178778 - RNA, 15 nt, Homo sapiens
auuuuucaaaacaua

SEQ ID NO: 1178779 - RNA, 23 nt, Homo sapiens
auuuuucaaaacauacaagcaac

SEQ ID NO: 1178780 - RNA, 22 nt, Homo sapiens
auuuuucacugccccagacaca

SEQ ID NO: 1178781 - RNA, 16 nt, Homo sapiens
auuuuucucuaacuca

SEQ ID NO: 1178782 - RNA, 17 nt, Homo sapiens
auuuuucuuuccaaguc

SEQ ID NO: 1178783 - RNA, 18 nt, Homo sapiens
auuuuucuuugguuuauu

SEQ ID NO: 1178784 - RNA, 17 nt, Homo sapiens
auuuuugugagccucuu

SEQ ID NO: 1178785 - RNA, 13 nt, Homo sapiens
auuuuugugcaca

SEQ ID NO: 1178786 - RNA, 18 nt, Homo sapiens
auuuuuuaaacagauauu

SEQ ID NO: 1178787 - RNA, 18 nt, Homo sapiens
auuuuuuccagucuuccu

SEQ ID NO: 1178788 - RNA, 15 nt, Homo sapiens
auuuuuugguacaaa

SEQ ID NO: 1178789 - RNA, 16 nt, Homo sapiens
auuuuuuuuugaagca

SEQ ID NO: 1178790 - RNA, 17 nt, Homo sapiens
caaaaaaacagacccac

SEQ ID NO: 1178791 - RNA, 14 nt, Homo sapiens
caaaaaaagacagg

SEQ ID NO: 1178792 - RNA, 11 nt, Homo sapiens
caaaaaaagca

SEQ ID NO: 1178793 - RNA, 20 nt, Homo sapiens
caaaaaaaguuuguuacuuu

SEQ ID NO: 1178794 - RNA, 24 nt, Homo sapiens
caaaaaaauacugccagaugcuga

SEQ ID NO: 1178795 - RNA, 13 nt, Homo sapiens
caaaaaaaucaua

SEQ ID NO: 1178796 - RNA, 14 nt, Homo sapiens
caaaaacacagugu

SEQ ID NO: 1178797 - RNA, 20 nt, Homo sapiens
caaaaacucuuauuacuguu

SEQ ID NO: 1178798 - RNA, 12 nt, Homo sapiens
caaaaacugaaa

SEQ ID NO: 1178799 - RNA, 21 nt, Homo sapiens
caaaaacuugaucacaugcuu

SEQ ID NO: 1178800 - RNA, 23 nt, Homo sapiens
caaaaauaccauuuuaguaugaa

SEQ ID NO: 1178801 - RNA, 15 nt, Homo sapiens
caaaaauauauucau

SEQ ID NO: 1178802 - RNA, 15 nt, Homo sapiens
caaaaaugauccuca

SEQ ID NO: 1178803 - RNA, 19 nt, Homo sapiens
caaaaaugauccucagugc

SEQ ID NO: 1178804 - RNA, 16 nt, Homo sapiens
caaaaaugugacaaua

SEQ ID NO: 1178805 - RNA, 15 nt, Homo sapiens
caaaaauguuuuuca

SEQ ID NO: 1178806 - RNA, 17 nt, Homo sapiens
caaaaauugacuuagau

SEQ ID NO: 1178807 - RNA, 17 nt, Homo sapiens
caaaaauugucccuuaa

SEQ ID NO: 1178808 - RNA, 12 nt, Homo sapiens
caaaacauacaa

SEQ ID NO: 1178809 - RNA, 21 nt, Homo sapiens
caaaacauauuuuacaucuga

SEQ ID NO: 1178810 - RNA, 13 nt, Homo sapiens
caaaaccaagaug

SEQ ID NO: 1178811 - RNA, 14 nt, Homo sapiens
caaaaccaauucau

SEQ ID NO: 1178812 - RNA, 17 nt, Homo sapiens
caaaacccaacaugacu

SEQ ID NO: 1178813 - RNA, 15 nt, Homo sapiens
caaaacccaccaaaa

SEQ ID NO: 1178814 - RNA, 18 nt, Homo sapiens
caaaaccccacuacacag

SEQ ID NO: 1178815 - RNA, 14 nt, Homo sapiens
caaaacccuuucug

SEQ ID NO: 1178816 - RNA, 14 nt, Homo sapiens
caaaacuacaaauc

SEQ ID NO: 1178817 - RNA, 14 nt, Homo sapiens
caaaacuacaugag

SEQ ID NO: 1178818 - RNA, 14 nt, Homo sapiens
caaaacuagacuuu

SEQ ID NO: 1178819 - RNA, 20 nt, Homo sapiens
caaaacucagagaaaugugu

SEQ ID NO: 1178820 - RNA, 15 nt, Homo sapiens
caaaacuccgucuca

SEQ ID NO: 1178821 - RNA, 17 nt, Homo sapiens
caaaacugaaaaucaau

SEQ ID NO: 1178822 - RNA, 12 nt, Homo sapiens
caaaacuuucca

SEQ ID NO: 1178823 - RNA, 18 nt, Homo sapiens
caaaagcuuuuugaugua

SEQ ID NO: 1178824 - RNA, 15 nt, Homo sapiens
caaaaggaagacugg

SEQ ID NO: 1178825 - RNA, 15 nt, Homo sapiens
caaaaggacucucag

SEQ ID NO: 1178826 - RNA, 19 nt, Homo sapiens
caaaaggagagauuauuaa

SEQ ID NO: 1178827 - RNA, 18 nt, Homo sapiens
caaaaggauaaugaauac

SEQ ID NO: 1178828 - RNA, 20 nt, Homo sapiens
caaaagggguuaauguuacu

SEQ ID NO: 1178829 - RNA, 23 nt, Homo sapiens
caaaaguagccaucauuccuuua

SEQ ID NO: 1178830 - RNA, 20 nt, Homo sapiens
caaaaguuaaugaauaugcc

SEQ ID NO: 1178831 - RNA, 17 nt, Homo sapiens
caaaauagaaaaguuau

SEQ ID NO: 1178832 - RNA, 17 nt, Homo sapiens
caaaauauccaauucau

SEQ ID NO: 1178833 - RNA, 14 nt, Homo sapiens
caagaaaacuggaa

SEQ ID NO: 1178834 - RNA, 15 nt, Homo sapiens
caagaaacacugccu

SEQ ID NO: 1178835 - RNA, 16 nt, Homo sapiens
caagaaacacugccug

SEQ ID NO: 1178836 - RNA, 17 nt, Homo sapiens
caagaaauaaccaugaa

SEQ ID NO: 1178837 - RNA, 14 nt, Homo sapiens
caagaacacaguga

SEQ ID NO: 1178838 - RNA, 18 nt, Homo sapiens
caagaagaaaguguucaa

SEQ ID NO: 1178839 - RNA, 15 nt, Homo sapiens
caagaagcaugcaga

SEQ ID NO: 1178840 - RNA, 19 nt, Homo sapiens
caagaauguuucuuuauag

SEQ ID NO: 1178841 - RNA, 19 nt, Homo sapiens
caagaccucaucucuacua

SEQ ID NO: 1178842 - RNA, 22 nt, Homo sapiens
caagaccugauuucugagcauu

SEQ ID NO: 1178843 - RNA, 23 nt, Homo sapiens
caagacugaauuaaugagaagau

SEQ ID NO: 1178844 - RNA, 17 nt, Homo sapiens
caagacuugauacugca

SEQ ID NO: 1178845 - RNA, 19 nt, Homo sapiens
caagacuugauacugcaau

SEQ ID NO: 1178846 - RNA, 22 nt, Homo sapiens
caagacuuuaaacauuuauguu

SEQ ID NO: 1178847 - RNA, 20 nt, Homo sapiens
caagagaaaugauguuguca

SEQ ID NO: 1178848 - RNA, 14 nt, Homo sapiens
caagagacauauaa

SEQ ID NO: 1178849 - RNA, 16 nt, Homo sapiens
caagagagacauggaa

SEQ ID NO: 1178850 - RNA, 21 nt, Homo sapiens
caagagcaaaacuccgucuca

SEQ ID NO: 1178851 - RNA, 17 nt, Homo sapiens
caagagcugaaaaacuu

SEQ ID NO: 1178852 - RNA, 15 nt, Homo sapiens
caagaggcugagaca

SEQ ID NO: 1178853 - RNA, 22 nt, Homo sapiens
caagaggguccuuuaguaccug

SEQ ID NO: 1178854 - RNA, 13 nt, Homo sapiens
caagauacacguc

SEQ ID NO: 1178855 - RNA, 19 nt, Homo sapiens
caagauacuugaacacugu

SEQ ID NO: 1178856 - RNA, 12 nt, Homo sapiens
caagaucuccaa

SEQ ID NO: 1178857 - RNA, 14 nt, Homo sapiens
caagaucugaauuu

SEQ ID NO: 1178858 - RNA, 15 nt, Homo sapiens
caagaucuguaaugu

SEQ ID NO: 1178859 - RNA, 19 nt, Homo sapiens
caagaugaggcaccaggaa

SEQ ID NO: 1178860 - RNA, 17 nt, Homo sapiens
caagaugcaacuaggaa

SEQ ID NO: 1178861 - RNA, 19 nt, Homo sapiens
caagaugggacagcaacaa

SEQ ID NO: 1178862 - RNA, 19 nt, Homo sapiens
caagaugucaagggccaag

SEQ ID NO: 1178863 - RNA, 19 nt, Homo sapiens
caagauuaauuucaucacu

SEQ ID NO: 1178864 - RNA, 20 nt, Homo sapiens
caagauucuagaugauuaaa

SEQ ID NO: 1178865 - RNA, 20 nt, Homo sapiens
caagauuuugggagaguaaa

SEQ ID NO: 1178866 - RNA, 20 nt, Homo sapiens
cagaaacuugugaaguggaa

SEQ ID NO: 1178867 - RNA, 17 nt, Homo sapiens
cagaaaugucauguggc

SEQ ID NO: 1178868 - RNA, 21 nt, Homo sapiens
cagaaauguuucugugucauu

SEQ ID NO: 1178869 - RNA, 15 nt, Homo sapiens
cagaaauuuaauuca

SEQ ID NO: 1178870 - RNA, 21 nt, Homo sapiens
cagaaauuuggcauugaucuu

SEQ ID NO: 1178871 - RNA, 18 nt, Homo sapiens
cagaacacacuccaucag

SEQ ID NO: 1178872 - RNA, 11 nt, Homo sapiens
cagaacagagg

SEQ ID NO: 1178873 - RNA, 13 nt, Homo sapiens
cagaacagccauu

SEQ ID NO: 1178874 - RNA, 23 nt, Homo sapiens
cagaaccauccauaguaguauga

SEQ ID NO: 1178875 - RNA, 19 nt, Homo sapiens
cagaaccuuguuauuucuc

SEQ ID NO: 1178876 - RNA, 14 nt, Homo sapiens
cagaacuaaacuca

SEQ ID NO: 1178877 - RNA, 14 nt, Homo sapiens
cagaacucuuucaa

SEQ ID NO: 1178878 - RNA, 15 nt, Homo sapiens
cagaacuuccaaaga

SEQ ID NO: 1178879 - RNA, 13 nt, Homo sapiens
cagaacuucugaa

SEQ ID NO: 1178880 - RNA, 19 nt, Homo sapiens
cagaagaccccugacucau

SEQ ID NO: 1178881 - RNA, 22 nt, Homo sapiens
cagaagauugaagccuuugcca

SEQ ID NO: 1178882 - RNA, 22 nt, Homo sapiens
cagaagcaucgcuccucuccag

SEQ ID NO: 1178883 - RNA, 23 nt, Homo sapiens
cagaagcgcuccaguaucuccaa

SEQ ID NO: 1178884 - RNA, 11 nt, Homo sapiens
cagaagcugcc

SEQ ID NO: 1178885 - RNA, 23 nt, Homo sapiens
cagaaggagggagaccccaaaaa

SEQ ID NO: 1178886 - RNA, 16 nt, Homo sapiens
cagaagggaauugcuc

SEQ ID NO: 1178887 - RNA, 18 nt, Homo sapiens
cagaauccacaguguccc

SEQ ID NO: 1178888 - RNA, 16 nt, Homo sapiens
cagaaucccccaaaga

SEQ ID NO: 1178889 - RNA, 21 nt, Homo sapiens
cagaaucccguaacaccugau

SEQ ID NO: 1178890 - RNA, 19 nt, Homo sapiens
cagaaucccucuacaugga

SEQ ID NO: 1178891 - RNA, 18 nt, Homo sapiens
cagaaugcugcaggacuu

SEQ ID NO: 1178892 - RNA, 13 nt, Homo sapiens
cagaauggaggca

SEQ ID NO: 1178893 - RNA, 14 nt, Homo sapiens
cagaauuaaaaggc

SEQ ID NO: 1178894 - RNA, 15 nt, Homo sapiens
cagaauuacccuucc

SEQ ID NO: 1178895 - RNA, 16 nt, Homo sapiens
cagaauuuugcacagu

SEQ ID NO: 1178896 - RNA, 19 nt, Homo sapiens
cagaauuuuuaacuguacu

SEQ ID NO: 1178897 - RNA, 16 nt, Homo sapiens
cagacaaaaagggugg

SEQ ID NO: 1178898 - RNA, 12 nt, Homo sapiens
cagacaacacug

SEQ ID NO: 1178899 - RNA, 19 nt, Homo sapiens
cagacaacacugggaaaca

SEQ ID NO: 1178900 - RNA, 22 nt, Homo sapiens
cagacaaggcaggccugaggca

SEQ ID NO: 1178901 - RNA, 16 nt, Homo sapiens
cagacaaguaaucacu

SEQ ID NO: 1178902 - RNA, 16 nt, Homo sapiens
cagacacaacacaguu

SEQ ID NO: 1178903 - RNA, 12 nt, Homo sapiens
cagacacauuca

SEQ ID NO: 1178904 - RNA, 14 nt, Homo sapiens
cagacacauucaca

SEQ ID NO: 1178905 - RNA, 14 nt, Homo sapiens
cagacacccaggac

SEQ ID NO: 1178906 - RNA, 21 nt, Homo sapiens
cagacacuggcguuacugcuu

SEQ ID NO: 1178907 - RNA, 20 nt, Homo sapiens
cagacagguguauggaguca

SEQ ID NO: 1178908 - RNA, 21 nt, Homo sapiens
cagacaguguuuugcacauca

SEQ ID NO: 1178909 - RNA, 14 nt, Homo sapiens
cagacaugauaugc

SEQ ID NO: 1178910 - RNA, 16 nt, Homo sapiens
cagaccacggcucgau

SEQ ID NO: 1178911 - RNA, 12 nt, Homo sapiens
cagaccacugau

SEQ ID NO: 1178912 - RNA, 15 nt, Homo sapiens
cagacccaucucucc

SEQ ID NO: 1178913 - RNA, 23 nt, Homo sapiens
cagaccgacguugccaucaaaac

SEQ ID NO: 1178914 - RNA, 23 nt, Homo sapiens
cagaccuggugcucuaaugccaa

SEQ ID NO: 1178915 - RNA, 18 nt, Homo sapiens
cagaccuucaacuuccaa

SEQ ID NO: 1178916 - RNA, 19 nt, Homo sapiens
cagacggcuccacuaggac

SEQ ID NO: 1178917 - RNA, 19 nt, Homo sapiens
cagacgucucaagacugaa

SEQ ID NO: 1178918 - RNA, 12 nt, Homo sapiens
cagacgugugac

SEQ ID NO: 1178919 - RNA, 16 nt, Homo sapiens
cagacucagacuccau

SEQ ID NO: 1178920 - RNA, 19 nt, Homo sapiens
cagacucagacuccauuug

SEQ ID NO: 1178921 - RNA, 20 nt, Homo sapiens
cagacugaacuuacacugua

SEQ ID NO: 1178922 - RNA, 20 nt, Homo sapiens
cagacugaacuuaccgugag

SEQ ID NO: 1178923 - RNA, 17 nt, Homo sapiens
cagacuucacacugcaa

SEQ ID NO: 1178924 - RNA, 11 nt, Homo sapiens
cagacuugcca

SEQ ID NO: 1178925 - RNA, 22 nt, Homo sapiens
cagacuuggcucagcucgggga

SEQ ID NO: 1178926 - RNA, 20 nt, Homo sapiens
cagacuuuggaaaaugcauu

SEQ ID NO: 1178927 - RNA, 20 nt, Homo sapiens
cagagaaagcuugaggccau

SEQ ID NO: 1178928 - RNA, 21 nt, Homo sapiens
cagagaaagcuugaggccaug

SEQ ID NO: 1178929 - RNA, 16 nt, Homo sapiens
cagagaaagggacaau

SEQ ID NO: 1178930 - RNA, 19 nt, Homo sapiens
cagagaaaucugcauucua

SEQ ID NO: 1178931 - RNA, 20 nt, Homo sapiens
cagagaagggaaagcagucu

SEQ ID NO: 1178932 - RNA, 19 nt, Homo sapiens
cagagaaugcccacugccu

SEQ ID NO: 1178933 - RNA, 21 nt, Homo sapiens
cagagacaaucuagcacuuua

SEQ ID NO: 1178934 - RNA, 14 nt, Homo sapiens
cagagacaccugca

SEQ ID NO: 1178935 - RNA, 14 nt, Homo sapiens
cagagacagcuuga

SEQ ID NO: 1178936 - RNA, 23 nt, Homo sapiens
cagagaccagcccaccccugugc

SEQ ID NO: 1178937 - RNA, 19 nt, Homo sapiens
cagagaccugaagugugca

SEQ ID NO: 1178938 - RNA, 22 nt, Homo sapiens
cagagagacuguuaucaggacu

SEQ ID NO: 1178939 - RNA, 20 nt, Homo sapiens
cagagagagagaaggcagca

SEQ ID NO: 1178940 - RNA, 15 nt, Homo sapiens
cagagagcacagccc

SEQ ID NO: 1178941 - RNA, 20 nt, Homo sapiens
cagagaggcacgugccuguc

SEQ ID NO: 1178942 - RNA, 17 nt, Homo sapiens
cagagaggcucugagaa

SEQ ID NO: 1178943 - RNA, 16 nt, Homo sapiens
cagagauaaagaccuu

SEQ ID NO: 1178944 - RNA, 19 nt, Homo sapiens
cagagaugccuccaccgcu

SEQ ID NO: 1178945 - RNA, 16 nt, Homo sapiens
cagagcaagacccauc

SEQ ID NO: 1178946 - RNA, 20 nt, Homo sapiens
cagagcaagacuccaucuca

SEQ ID NO: 1178947 - RNA, 15 nt, Homo sapiens
cagagcccaagggaa

SEQ ID NO: 1178948 - RNA, 16 nt, Homo sapiens
cagagccuuuuacccc

SEQ ID NO: 1178949 - RNA, 20 nt, Homo sapiens
cagagcgagauuccgucuca

SEQ ID NO: 1178950 - RNA, 20 nt, Homo sapiens
cagagcuacaugguggagca

SEQ ID NO: 1178951 - RNA, 16 nt, Homo sapiens
cagagcugagcccuca

SEQ ID NO: 1178952 - RNA, 22 nt, Homo sapiens
cagagcugguggacccagggaa

SEQ ID NO: 1178953 - RNA, 11 nt, Homo sapiens
cagagcuucuu

SEQ ID NO: 1178954 - RNA, 18 nt, Homo sapiens
cagaggagaagcaauggg

SEQ ID NO: 1178955 - RNA, 13 nt, Homo sapiens
cagaggagccaug

SEQ ID NO: 1178956 - RNA, 16 nt, Homo sapiens
cagaggagccaugucc

SEQ ID NO: 1178957 - RNA, 20 nt, Homo sapiens
cagaggagggcgugacucac

SEQ ID NO: 1178958 - RNA, 16 nt, Homo sapiens
cagaggaugagcucua

SEQ ID NO: 1178959 - RNA, 23 nt, Homo sapiens
cagaggcagcauuuuugcacugg

SEQ ID NO: 1178960 - RNA, 23 nt, Homo sapiens
cagaggcgucucacauuuuuacu

SEQ ID NO: 1178961 - RNA, 23 nt, Homo sapiens
cagaggcuaauucagugucacau

SEQ ID NO: 1178962 - RNA, 15 nt, Homo sapiens
cagaggcuucuucag

SEQ ID NO: 1178963 - RNA, 18 nt, Homo sapiens
cagagguugcagugagcc

SEQ ID NO: 1178964 - RNA, 23 nt, Homo sapiens
cagcugagcaaucucuugcauuu

SEQ ID NO: 1178965 - RNA, 23 nt, Homo sapiens
cagcugauugggcaccugaccac

SEQ ID NO: 1178966 - RNA, 22 nt, Homo sapiens
cagcugcauuaaaacaaaggaa

SEQ ID NO: 1178967 - RNA, 14 nt, Homo sapiens
cagcugccaaggaa

SEQ ID NO: 1178968 - RNA, 22 nt, Homo sapiens
cagcugccccuggcaccugugu

SEQ ID NO: 1178969 - RNA, 15 nt, Homo sapiens
cagcugcucccacac

SEQ ID NO: 1178970 - RNA, 12 nt, Homo sapiens
cagcugcugaaa

SEQ ID NO: 1178971 - RNA, 18 nt, Homo sapiens
cagcuggagguugagcuc

SEQ ID NO: 1178972 - RNA, 13 nt, Homo sapiens
cagcuguacugag

SEQ ID NO: 1178973 - RNA, 19 nt, Homo sapiens
cagcugucugucaucugcu

SEQ ID NO: 1178974 - RNA, 23 nt, Homo sapiens
cagcugugugggucauaccgugu

SEQ ID NO: 1178975 - RNA, 17 nt, Homo sapiens
cagcuguugcaggcagu

SEQ ID NO: 1178976 - RNA, 15 nt, Homo sapiens
cagcuuacugcagca

SEQ ID NO: 1178977 - RNA, 20 nt, Homo sapiens
cagcuuagaaugcaucucau

SEQ ID NO: 1178978 - RNA, 16 nt, Homo sapiens
cagcuugcucuucagu

SEQ ID NO: 1178979 - RNA, 14 nt, Homo sapiens
cagcuuuacugugg

SEQ ID NO: 1178980 - RNA, 17 nt, Homo sapiens
cagcuuuucccaggaga

SEQ ID NO: 1178981 - RNA, 13 nt, Homo sapiens
caggaaacauauu

SEQ ID NO: 1178982 - RNA, 20 nt, Homo sapiens
caggaaagaauagaagugau

SEQ ID NO: 1178983 - RNA, 12 nt, Homo sapiens
caggaaauacca

SEQ ID NO: 1178984 - RNA, 17 nt, Homo sapiens
caggaaauaccaacuga

SEQ ID NO: 1178985 - RNA, 20 nt, Homo sapiens
caggaaauaccaacugaagu

SEQ ID NO: 1178986 - RNA, 22 nt, Homo sapiens
caggaagaccaaggccucggca

SEQ ID NO: 1178987 - RNA, 21 nt, Homo sapiens
caggaaguuacccuauauguc

SEQ ID NO: 1178988 - RNA, 13 nt, Homo sapiens
caggaaugcucug

SEQ ID NO: 1178989 - RNA, 20 nt, Homo sapiens
caggaauuugggacccugcu

SEQ ID NO: 1178990 - RNA, 18 nt, Homo sapiens
caggacacacauggugag

SEQ ID NO: 1178991 - RNA, 18 nt, Homo sapiens
caggacagggaagggagc

SEQ ID NO: 1178992 - RNA, 13 nt, Homo sapiens
caggacaggugug

SEQ ID NO: 1178993 - RNA, 15 nt, Homo sapiens
caggaccuccaagcc

SEQ ID NO: 1178994 - RNA, 22 nt, Homo sapiens
caggaccuccaagccacugagc

SEQ ID NO: 1178995 - RNA, 15 nt, Homo sapiens
caggaccugccaaug

SEQ ID NO: 1178996 - RNA, 15 nt, Homo sapiens
caggaccugccugua

SEQ ID NO: 1178997 - RNA, 17 nt, Homo sapiens
caggacucacccuccac

SEQ ID NO: 1178998 - RNA, 19 nt, Homo sapiens
caggacugugccagcacaa

SEQ ID NO: 1178999 - RNA, 20 nt, Homo sapiens
caggacugugccagcacaaa

SEQ ID NO: 1179000 - RNA, 16 nt, Homo sapiens
auaugggaaagacaug

SEQ ID NO: 1179001 - RNA, 18 nt, Homo sapiens
auauggggaaaaaacugu

SEQ ID NO: 1179002 - RNA, 15 nt, Homo sapiens
auaugggguguuugu

SEQ ID NO: 1179003 - RNA, 15 nt, Homo sapiens
auaugguagagcaau

SEQ ID NO: 1179004 - RNA, 18 nt, Homo sapiens
auaugguugauaguuuac

SEQ ID NO: 1179005 - RNA, 12 nt, Homo sapiens
auaugugcuugu

SEQ ID NO: 1179006 - RNA, 17 nt, Homo sapiens
auauguguauguacguu

SEQ ID NO: 1179007 - RNA, 15 nt, Homo sapiens
auauguugacuuuau

SEQ ID NO: 1179008 - RNA, 15 nt, Homo sapiens
auauguugcuauaau

SEQ ID NO: 1179009 - RNA, 16 nt, Homo sapiens
auauuaaauguugcuu

SEQ ID NO: 1179010 - RNA, 21 nt, Homo sapiens
auauuacugaucuuaccuuua

SEQ ID NO: 1179011 - RNA, 14 nt, Homo sapiens
auauuagaugugau

SEQ ID NO: 1179012 - RNA, 16 nt, Homo sapiens
auauuagaugugauuu

SEQ ID NO: 1179013 - RNA, 19 nt, Homo sapiens
auauuaguuaaucuccuca

SEQ ID NO: 1179014 - RNA, 14 nt, Homo sapiens
auauuaucuaccug

SEQ ID NO: 1179015 - RNA, 18 nt, Homo sapiens
auauucccacagcacuaa

SEQ ID NO: 1179016 - RNA, 16 nt, Homo sapiens
auauucccacucagca

SEQ ID NO: 1179017 - RNA, 20 nt, Homo sapiens
auauucccggucagcaguau

SEQ ID NO: 1179018 - RNA, 18 nt, Homo sapiens
auauugauuauagcaaug

SEQ ID NO: 1179019 - RNA, 14 nt, Homo sapiens
auauugcuguuuau

SEQ ID NO: 1179020 - RNA, 15 nt, Homo sapiens
auauuuaaccaaaga

SEQ ID NO: 1179021 - RNA, 22 nt, Homo sapiens
auauuuaacuggugcacuuugu

SEQ ID NO: 1179022 - RNA, 23 nt, Homo sapiens
auauuuaucucuuccugcuccuc

SEQ ID NO: 1179023 - RNA, 21 nt, Homo sapiens
auauuucugggagacagaaaa

SEQ ID NO: 1179024 - RNA, 20 nt, Homo sapiens
auauuucuuaagauagcccu

SEQ ID NO: 1179025 - RNA, 16 nt, Homo sapiens
auauuucuucaaguga

SEQ ID NO: 1179026 - RNA, 23 nt, Homo sapiens
auauuugaaaaaauuaaaaucuu

SEQ ID NO: 1179027 - RNA, 17 nt, Homo sapiens
auauuugaaaaccauau

SEQ ID NO: 1179028 - RNA, 22 nt, Homo sapiens
auauuugcugugaagggagaaa

SEQ ID NO: 1179029 - RNA, 17 nt, Homo sapiens
auauuuucaacaauuag

SEQ ID NO: 1179030 - RNA, 15 nt, Homo sapiens
auauuuucuguguaa

SEQ ID NO: 1179031 - RNA, 23 nt, Homo sapiens
auauuuugcaauaguuaccucaa

SEQ ID NO: 1179032 - RNA, 18 nt, Homo sapiens
auauuuuuagauaguuag

SEQ ID NO: 1179033 - RNA, 19 nt, Homo sapiens
auauuuuuuuaacugugau

SEQ ID NO: 1179034 - RNA, 19 nt, Homo sapiens
aucaaaacccaacaugacu

SEQ ID NO: 1179035 - RNA, 16 nt, Homo sapiens
aucaaaagugaucagc

SEQ ID NO: 1179036 - RNA, 19 nt, Homo sapiens
aucaaacacacuuccagcu

SEQ ID NO: 1179037 - RNA, 12 nt, Homo sapiens
aucaaaguaaua

SEQ ID NO: 1179038 - RNA, 18 nt, Homo sapiens
aucaacaaugauuaauca

SEQ ID NO: 1179039 - RNA, 13 nt, Homo sapiens
aucaacauuucuc

SEQ ID NO: 1179040 - RNA, 16 nt, Homo sapiens
aucaacugaauugcaa

SEQ ID NO: 1179041 - RNA, 20 nt, Homo sapiens
aucaacuggggggaccaaau

SEQ ID NO: 1179042 - RNA, 19 nt, Homo sapiens
aucaagaaauaaccaugaa

SEQ ID NO: 1179043 - RNA, 12 nt, Homo sapiens
aucaagcacuuc

SEQ ID NO: 1179044 - RNA, 14 nt, Homo sapiens
aucaagcugugaga

SEQ ID NO: 1179045 - RNA, 22 nt, Homo sapiens
aucaagucaucuauaguugaua

SEQ ID NO: 1179046 - RNA, 18 nt, Homo sapiens
aucaaguuugaccagugc

SEQ ID NO: 1179047 - RNA, 20 nt, Homo sapiens
aucaauaaagaccacuuuac

SEQ ID NO: 1179048 - RNA, 13 nt, Homo sapiens
aucaauaccugcu

SEQ ID NO: 1179049 - RNA, 22 nt, Homo sapiens
aucaaucauuaaggucauuacu

SEQ ID NO: 1179050 - RNA, 18 nt, Homo sapiens
aucaaugaaaugcuuguu

SEQ ID NO: 1179051 - RNA, 23 nt, Homo sapiens
aucaaugauggcaccuacuuuug

SEQ ID NO: 1179052 - RNA, 23 nt, Homo sapiens
aucaauuccaucagcacaaagac

SEQ ID NO: 1179053 - RNA, 22 nt, Homo sapiens
aucacaauuuacgaaaccaaaa

SEQ ID NO: 1179054 - RNA, 12 nt, Homo sapiens
aucacacuguaa

SEQ ID NO: 1179055 - RNA, 12 nt, Homo sapiens
aucacagaugag

SEQ ID NO: 1179056 - RNA, 23 nt, Homo sapiens
aucacaggagcaaucacaggaaa

SEQ ID NO: 1179057 - RNA, 21 nt, Homo sapiens
aucacaugaccacauagcaug

SEQ ID NO: 1179058 - RNA, 13 nt, Homo sapiens
aucaccaccucag

SEQ ID NO: 1179059 - RNA, 21 nt, Homo sapiens
aucaccuuaagaaagugucuc

SEQ ID NO: 1179060 - RNA, 18 nt, Homo sapiens
aucaccuuaggcagggaa

SEQ ID NO: 1179061 - RNA, 22 nt, Homo sapiens
aucacgucacugcacuccagcu

SEQ ID NO: 1179062 - RNA, 16 nt, Homo sapiens
aucacuccaacccugc

SEQ ID NO: 1179063 - RNA, 19 nt, Homo sapiens
aucacugaacuacuaaagu

SEQ ID NO: 1179064 - RNA, 17 nt, Homo sapiens
aucacugguugcacuua

SEQ ID NO: 1179065 - RNA, 22 nt, Homo sapiens
aucacuuccuauaugcacuuau

SEQ ID NO: 1179066 - RNA, 14 nt, Homo sapiens
aucagaaacagggu

SEQ ID NO: 1179067 - RNA, 18 nt, Homo sapiens
aucagaugcuuuccugca

SEQ ID NO: 1179068 - RNA, 22 nt, Homo sapiens
aucagaugcuuuccugcacauu

SEQ ID NO: 1179069 - RNA, 16 nt, Homo sapiens
aucagauggcauaaau

SEQ ID NO: 1179070 - RNA, 17 nt, Homo sapiens
aucagcacaaagacaua

SEQ ID NO: 1179071 - RNA, 18 nt, Homo sapiens
aucagcaucucuucuucc

SEQ ID NO: 1179072 - RNA, 16 nt, Homo sapiens
aucagccucgcucuug

SEQ ID NO: 1179073 - RNA, 16 nt, Homo sapiens
aucagcuaaacaccac

SEQ ID NO: 1179074 - RNA, 22 nt, Homo sapiens
aucagcucguuacuucagccca

SEQ ID NO: 1179075 - RNA, 16 nt, Homo sapiens
aucagcuuaggggcug

SEQ ID NO: 1179076 - RNA, 18 nt, Homo sapiens
aucagcuucagaauggca

SEQ ID NO: 1179077 - RNA, 20 nt, Homo sapiens
aucaggaccuccaagccacu

SEQ ID NO: 1179078 - RNA, 13 nt, Homo sapiens
aucaggcaccugg

SEQ ID NO: 1179079 - RNA, 21 nt, Homo sapiens
aucagggaggguuaggaaaac

SEQ ID NO: 1179080 - RNA, 17 nt, Homo sapiens
aucaggggauacaggcc

SEQ ID NO: 1179081 - RNA, 11 nt, Homo sapiens
aucagugccau

SEQ ID NO: 1179082 - RNA, 19 nt, Homo sapiens
aucaguucuuuugucuuag

SEQ ID NO: 1179083 - RNA, 13 nt, Homo sapiens
aucaucauucuca

SEQ ID NO: 1179084 - RNA, 14 nt, Homo sapiens
aucauccaagacag

SEQ ID NO: 1179085 - RNA, 19 nt, Homo sapiens
aucauccagaaguuccuca

SEQ ID NO: 1179086 - RNA, 13 nt, Homo sapiens
aucauccugucac

SEQ ID NO: 1179087 - RNA, 23 nt, Homo sapiens
aucaucuuugcugaaugucauua

SEQ ID NO: 1179088 - RNA, 15 nt, Homo sapiens
aucaugauggaauuu

SEQ ID NO: 1179089 - RNA, 15 nt, Homo sapiens
aucaugcuguuuuau

SEQ ID NO: 1179090 - RNA, 24 nt, Homo sapiens
aucauggagaacagcaugacagcu

SEQ ID NO: 1179091 - RNA, 22 nt, Homo sapiens
aucauguaaauguauuggcaca

SEQ ID NO: 1179092 - RNA, 22 nt, Homo sapiens
aucauguuuuuucugcaaugac

SEQ ID NO: 1179093 - RNA, 21 nt, Homo sapiens
aucauuaaccacuuaucagug

SEQ ID NO: 1179094 - RNA, 17 nt, Homo sapiens
aucauuaggcuuacgua

SEQ ID NO: 1179095 - RNA, 15 nt, Homo sapiens
aucauucaacucucc

SEQ ID NO: 1179096 - RNA, 16 nt, Homo sapiens
aucauucaacucucca

SEQ ID NO: 1179097 - RNA, 22 nt, Homo sapiens
aucauucccuagaacaagccac

SEQ ID NO: 1179098 - RNA, 22 nt, Homo sapiens
aucauuucccaucuggaccugg

SEQ ID NO: 1179099 - RNA, 22 nt, Homo sapiens
aucauuucuauuucuccuccau

SEQ ID NO: 1179100 - RNA, 22 nt, Homo sapiens
aucauuugguuuuaaaauauga

SEQ ID NO: 1179101 - RNA, 21 nt, Homo sapiens
auccacaccguacaucugcaa

SEQ ID NO: 1179102 - RNA, 12 nt, Homo sapiens
auccacauggga

SEQ ID NO: 1179103 - RNA, 13 nt, Homo sapiens
auccagacagucg

SEQ ID NO: 1179104 - RNA, 13 nt, Homo sapiens
auccagaggaauu

SEQ ID NO: 1179105 - RNA, 18 nt, Homo sapiens
auccagccucacuucuag

SEQ ID NO: 1179106 - RNA, 22 nt, Homo sapiens
auccaggacugugccagcacaa

SEQ ID NO: 1179107 - RNA, 16 nt, Homo sapiens
aggaacuucugaacuu

SEQ ID NO: 1179108 - RNA, 18 nt, Homo sapiens
aggaacuuuauguucuaa

SEQ ID NO: 1179109 - RNA, 15 nt, Homo sapiens
aggaagaauggugug

SEQ ID NO: 1179110 - RNA, 21 nt, Homo sapiens
aggaagagaaaccaggcccug

SEQ ID NO: 1179111 - RNA, 15 nt, Homo sapiens
aggaagagagaggga

SEQ ID NO: 1179112 - RNA, 16 nt, Homo sapiens
aggaagagcaggacuc

SEQ ID NO: 1179113 - RNA, 15 nt, Homo sapiens
aggaagagucucuaa

SEQ ID NO: 1179114 - RNA, 14 nt, Homo sapiens
aggaagccgugccc

SEQ ID NO: 1179115 - RNA, 20 nt, Homo sapiens
aggaagcucagacugguuga

SEQ ID NO: 1179116 - RNA, 23 nt, Homo sapiens
aggaagcuguguugaaacagaaa

SEQ ID NO: 1179117 - RNA, 19 nt, Homo sapiens
aggaaggaaaacuauguau

SEQ ID NO: 1179118 - RNA, 14 nt, Homo sapiens
aggaaggacuauga

SEQ ID NO: 1179119 - RNA, 17 nt, Homo sapiens
aggaaggacuaugacaa

SEQ ID NO: 1179120 - RNA, 22 nt, Homo sapiens
aggaaggacuuacccaguauua

SEQ ID NO: 1179121 - RNA, 17 nt, Homo sapiens
aggaaguagcugucaga

SEQ ID NO: 1179122 - RNA, 15 nt, Homo sapiens
aggaauccacaucau

SEQ ID NO: 1179123 - RNA, 15 nt, Homo sapiens
aggaaucugccuucc

SEQ ID NO: 1179124 - RNA, 17 nt, Homo sapiens
aggacaaacagugaauu

SEQ ID NO: 1179125 - RNA, 15 nt, Homo sapiens
aggacaaagugccaa

SEQ ID NO: 1179126 - RNA, 21 nt, Homo sapiens
aggacacccucccacaugaug

SEQ ID NO: 1179127 - RNA, 15 nt, Homo sapiens
aggacagaaaggaga

SEQ ID NO: 1179128 - RNA, 23 nt, Homo sapiens
aggacagaaaggagaguggccau

SEQ ID NO: 1179129 - RNA, 16 nt, Homo sapiens
aggacaggaggagcuu

SEQ ID NO: 1179130 - RNA, 18 nt, Homo sapiens
aggacaggucucugagac

SEQ ID NO: 1179131 - RNA, 17 nt, Homo sapiens
aggacagugauguuggc

SEQ ID NO: 1179132 - RNA, 17 nt, Homo sapiens
aggacaguuaaguauuu

SEQ ID NO: 1179133 - RNA, 18 nt, Homo sapiens
aggacaguugauuuccaa

SEQ ID NO: 1179134 - RNA, 20 nt, Homo sapiens
aggacauggcugacuuugcc

SEQ ID NO: 1179135 - RNA, 11 nt, Homo sapiens
aggacccugaa

SEQ ID NO: 1179136 - RNA, 22 nt, Homo sapiens
aggacguuggccucagggccag

SEQ ID NO: 1179137 - RNA, 22 nt, Homo sapiens
aggacuccauuucuuucuucca

SEQ ID NO: 1179138 - RNA, 18 nt, Homo sapiens
aggacugggucugaccug

SEQ ID NO: 1179139 - RNA, 21 nt, Homo sapiens
aggacugggucugaccuggug

SEQ ID NO: 1179140 - RNA, 23 nt, Homo sapiens
aggagaaacaguuucaacucuga

SEQ ID NO: 1179141 - RNA, 13 nt, Homo sapiens
aggagaaggugcc

SEQ ID NO: 1179142 - RNA, 14 nt, Homo sapiens
aggagaagugggga

SEQ ID NO: 1179143 - RNA, 14 nt, Homo sapiens
aggagacaucuucc

SEQ ID NO: 1179144 - RNA, 20 nt, Homo sapiens
aggagaggcccggugcagcu

SEQ ID NO: 1179145 - RNA, 17 nt, Homo sapiens
aggagagugagugccuu

SEQ ID NO: 1179146 - RNA, 17 nt, Homo sapiens
aggagauuccggugccu

SEQ ID NO: 1179147 - RNA, 23 nt, Homo sapiens
aggagcacauacuaccuagaagu

SEQ ID NO: 1179148 - RNA, 21 nt, Homo sapiens
aggagcccccagcugccaaag

SEQ ID NO: 1179149 - RNA, 15 nt, Homo sapiens
aggaggacagaggga

SEQ ID NO: 1179150 - RNA, 17 nt, Homo sapiens
aggaggaggaggacaga

SEQ ID NO: 1179151 - RNA, 20 nt, Homo sapiens
aggaggaggcugcccugagg

SEQ ID NO: 1179152 - RNA, 14 nt, Homo sapiens
aggaggcuagaaga

SEQ ID NO: 1179153 - RNA, 17 nt, Homo sapiens
aggaggggaacacugcc

SEQ ID NO: 1179154 - RNA, 16 nt, Homo sapiens
aggaggucagcacaag

SEQ ID NO: 1179155 - RNA, 20 nt, Homo sapiens
aggaggugaccaaaucagug

SEQ ID NO: 1179156 - RNA, 22 nt, Homo sapiens
aggaguacaccccaacagcacc

SEQ ID NO: 1179157 - RNA, 16 nt, Homo sapiens
aggagucaaaacuaca

SEQ ID NO: 1179158 - RNA, 16 nt, Homo sapiens
aggagucauguagccc

SEQ ID NO: 1179159 - RNA, 19 nt, Homo sapiens
aggaguccaagaccagacu

SEQ ID NO: 1179160 - RNA, 20 nt, Homo sapiens
aggaguccaagaccagacuc

SEQ ID NO: 1179161 - RNA, 21 nt, Homo sapiens
aggaguguccucuucccucuc

SEQ ID NO: 1179162 - RNA, 17 nt, Homo sapiens
aggagugugaccacuga

SEQ ID NO: 1179163 - RNA, 20 nt, Homo sapiens
aggauaaccuugugccuugg

SEQ ID NO: 1179164 - RNA, 20 nt, Homo sapiens
aggauacugaggcacacaga

SEQ ID NO: 1179165 - RNA, 21 nt, Homo sapiens
aggauauccucccuccagaua

SEQ ID NO: 1179166 - RNA, 16 nt, Homo sapiens
aggauaugacaacucu

SEQ ID NO: 1179167 - RNA, 18 nt, Homo sapiens
aggauauuggaaugcaca

SEQ ID NO: 1179168 - RNA, 14 nt, Homo sapiens
aggauccgugcugu

SEQ ID NO: 1179169 - RNA, 14 nt, Homo sapiens
aggaucugcuccaa

SEQ ID NO: 1179170 - RNA, 17 nt, Homo sapiens
aggaugauggcacugag

SEQ ID NO: 1179171 - RNA, 14 nt, Homo sapiens
aggaugcauacauu

SEQ ID NO: 1179172 - RNA, 18 nt, Homo sapiens
aggaugcuaaaaauguca

SEQ ID NO: 1179173 - RNA, 19 nt, Homo sapiens
aggaugggaaucaggcaug

SEQ ID NO: 1179174 - RNA, 10 nt, Homo sapiens
aggauggugu

SEQ ID NO: 1179175 - RNA, 19 nt, Homo sapiens
aggaugugauuguggaaug

SEQ ID NO: 1179176 - RNA, 16 nt, Homo sapiens
aggaugugcauucucc

SEQ ID NO: 1179177 - RNA, 14 nt, Homo sapiens
aggauguguuuuca

SEQ ID NO: 1179178 - RNA, 11 nt, Homo sapiens
aggauguugcc

SEQ ID NO: 1179179 - RNA, 16 nt, Homo sapiens
aggauuugaacacuug

SEQ ID NO: 1179180 - RNA, 14 nt, Homo sapiens
aggauuugaugcuu

SEQ ID NO: 1179181 - RNA, 21 nt, Homo sapiens
aggauuuucacauucuuggcu

SEQ ID NO: 1179182 - RNA, 20 nt, Homo sapiens
aggcaaaaaaaucauauaag

SEQ ID NO: 1179183 - RNA, 18 nt, Homo sapiens
aggcaaaggaaauuguca

SEQ ID NO: 1179184 - RNA, 17 nt, Homo sapiens
aggcaaaggcagaggaa

SEQ ID NO: 1179185 - RNA, 17 nt, Homo sapiens
aggcaaauggcacugca

SEQ ID NO: 1179186 - RNA, 15 nt, Homo sapiens
aggcaauauggccac

SEQ ID NO: 1179187 - RNA, 18 nt, Homo sapiens
aggcaaucaagucucaca

SEQ ID NO: 1179188 - RNA, 21 nt, Homo sapiens
aggcaccguggcucacgucug

SEQ ID NO: 1179189 - RNA, 18 nt, Homo sapiens
aggcacugggcaagugaa

SEQ ID NO: 1179190 - RNA, 21 nt, Homo sapiens
aggcagagggccuuugcuaca

SEQ ID NO: 1179191 - RNA, 14 nt, Homo sapiens
aggcagaucaccug

SEQ ID NO: 1179192 - RNA, 15 nt, Homo sapiens
aggcagaucaccuga

SEQ ID NO: 1179193 - RNA, 20 nt, Homo sapiens
aggcagcagugagcuaugau

SEQ ID NO: 1179194 - RNA, 16 nt, Homo sapiens
aggcagcccugccaug

SEQ ID NO: 1179195 - RNA, 19 nt, Homo sapiens
aggcagcccugccauguca

SEQ ID NO: 1179196 - RNA, 21 nt, Homo sapiens
aggcagcccugccaugucaca

SEQ ID NO: 1179197 - RNA, 16 nt, Homo sapiens
aggcagccugccuuua

SEQ ID NO: 1179198 - RNA, 17 nt, Homo sapiens
aggcagcugacacaucu

SEQ ID NO: 1179199 - RNA, 19 nt, Homo sapiens
aggcaggagaaucacuuga

SEQ ID NO: 1179200 - RNA, 18 nt, Homo sapiens
aggcaggauuuagcccuu

SEQ ID NO: 1179201 - RNA, 21 nt, Homo sapiens
aggcagggaaggaucccauga

SEQ ID NO: 1179202 - RNA, 14 nt, Homo sapiens
aggcaggggugaga

SEQ ID NO: 1179203 - RNA, 23 nt, Homo sapiens
aggcagggugcaguaucaugccc

SEQ ID NO: 1179204 - RNA, 18 nt, Homo sapiens
aggcagggugguguaccu

SEQ ID NO: 1179205 - RNA, 14 nt, Homo sapiens
aggcagucccggga

SEQ ID NO: 1179206 - RNA, 23 nt, Homo sapiens
aggcaguuaaauaauaauaguua

SEQ ID NO: 1179207 - RNA, 18 nt, Homo sapiens
aggcaucucccaccagcu

SEQ ID NO: 1179208 - RNA, 23 nt, Homo sapiens
aggcauguacaaaaauuaugcaa

SEQ ID NO: 1179209 - RNA, 21 nt, Homo sapiens
aggcauguagcuacaggacau

SEQ ID NO: 1179210 - RNA, 17 nt, Homo sapiens
aggcauucuaagucaca

SEQ ID NO: 1179211 - RNA, 20 nt, Homo sapiens
aggcauucuaagucacagga

SEQ ID NO: 1179212 - RNA, 18 nt, Homo sapiens
aggcauuuucaucuuucc

SEQ ID NO: 1179213 - RNA, 14 nt, Homo sapiens
aggccagagccaag

SEQ ID NO: 1179214 - RNA, 20 nt, Homo sapiens
aggccagcccggaccucugg

SEQ ID NO: 1179215 - RNA, 20 nt, Homo sapiens
aggccaucuggggcuccuuc

SEQ ID NO: 1179216 - RNA, 19 nt, Homo sapiens
aggccccagccucccugaa

SEQ ID NO: 1179217 - RNA, 18 nt, Homo sapiens
aggccccaucgugaauua

SEQ ID NO: 1179218 - RNA, 18 nt, Homo sapiens
aggccccugucucagggu

SEQ ID NO: 1179219 - RNA, 21 nt, Homo sapiens
aggcccugcgucaggcagugu

SEQ ID NO: 1179220 - RNA, 18 nt, Homo sapiens
aggcccugggucuugcca

SEQ ID NO: 1179221 - RNA, 20 nt, Homo sapiens
aggccgaagcugcugugacu

SEQ ID NO: 1179222 - RNA, 16 nt, Homo sapiens
aggccuaggauucuaa

SEQ ID NO: 1179223 - RNA, 18 nt, Homo sapiens
agucaggaguccaagacc

SEQ ID NO: 1179224 - RNA, 22 nt, Homo sapiens
agucaguuucuaucauucugcu

SEQ ID NO: 1179225 - RNA, 15 nt, Homo sapiens
agucauacuaguagu

SEQ ID NO: 1179226 - RNA, 18 nt, Homo sapiens
agucaucaugaacuggcu

SEQ ID NO: 1179227 - RNA, 12 nt, Homo sapiens
agucaucuauag

SEQ ID NO: 1179228 - RNA, 15 nt, Homo sapiens
agucaucucauucca

SEQ ID NO: 1179229 - RNA, 16 nt, Homo sapiens
agucaucucauuccac

SEQ ID NO: 1179230 - RNA, 21 nt, Homo sapiens
agucauggacauucaugcuca

SEQ ID NO: 1179231 - RNA, 23 nt, Homo sapiens
agucauggauuucucugcucaca

SEQ ID NO: 1179232 - RNA, 23 nt, Homo sapiens
agucauguagccccagucagaag

SEQ ID NO: 1179233 - RNA, 19 nt, Homo sapiens
agucauuaugagaggcaau

SEQ ID NO: 1179234 - RNA, 23 nt, Homo sapiens
agucauucagcagcaaauuuuca

SEQ ID NO: 1179235 - RNA, 22 nt, Homo sapiens
aguccaagguuuaaagagucua

SEQ ID NO: 1179236 - RNA, 13 nt, Homo sapiens
aguccacugcuga

SEQ ID NO: 1179237 - RNA, 15 nt, Homo sapiens
aguccagccuagucu

SEQ ID NO: 1179238 - RNA, 13 nt, Homo sapiens
aguccagcuuucu

SEQ ID NO: 1179239 - RNA, 14 nt, Homo sapiens
aguccagucucucc

SEQ ID NO: 1179240 - RNA, 19 nt, Homo sapiens
aguccccagacucugccua

SEQ ID NO: 1179241 - RNA, 20 nt, Homo sapiens
aguccccccagcucuaagca

SEQ ID NO: 1179242 - RNA, 15 nt, Homo sapiens
agucccuuugugacu

SEQ ID NO: 1179243 - RNA, 12 nt, Homo sapiens
aaaaaagccaaa

SEQ ID NO: 1179244 - RNA, 17 nt, Homo sapiens
aaaaaauaacaaugaaa

SEQ ID NO: 1179245 - RNA, 11 nt, Homo sapiens
aaaaacaugua

SEQ ID NO: 1179246 - RNA, 17 nt, Homo sapiens
aaaaaccccaaacuguu

SEQ ID NO: 1179247 - RNA, 23 nt, Homo sapiens
aaaaaccuuguagauagcuugag

SEQ ID NO: 1179248 - RNA, 21 nt, Homo sapiens
aaaaacgugaggacucaggaa

SEQ ID NO: 1179249 - RNA, 20 nt, Homo sapiens
aaaaacucuuauuacuguug

SEQ ID NO: 1179250 - RNA, 11 nt, Homo sapiens
aaaaacuucca

SEQ ID NO: 1179251 - RNA, 17 nt, Homo sapiens
aaaaacuuucacugaau

SEQ ID NO: 1179252 - RNA, 21 nt, Homo sapiens
caccaucaacuuaaagugaau

SEQ ID NO: 1179253 - RNA, 14 nt, Homo sapiens
caccaucccaaagc

SEQ ID NO: 1179254 - RNA, 13 nt, Homo sapiens
caccaucuggaau

SEQ ID NO: 1179255 - RNA, 15 nt, Homo sapiens
caccauguauuuugu

SEQ ID NO: 1179256 - RNA, 18 nt, Homo sapiens
caccauguuugagcucag

SEQ ID NO: 1179257 - RNA, 16 nt, Homo sapiens
caccauucaggucuuu

SEQ ID NO: 1179258 - RNA, 14 nt, Homo sapiens
caccauugcugcuc

SEQ ID NO: 1179259 - RNA, 14 nt, Homo sapiens
cacccaaaagucaa

SEQ ID NO: 1179260 - RNA, 22 nt, Homo sapiens
cacccaacugucucgaugcaau

SEQ ID NO: 1179261 - RNA, 18 nt, Homo sapiens
cacccacccuguggcuca

SEQ ID NO: 1179262 - RNA, 16 nt, Homo sapiens
cacccacucacauucc

SEQ ID NO: 1179263 - RNA, 14 nt, Homo sapiens
cacccagaacagug

SEQ ID NO: 1179264 - RNA, 17 nt, Homo sapiens
cacccagagccagugug

SEQ ID NO: 1179265 - RNA, 23 nt, Homo sapiens
cacccagcucagcauuuccacac

SEQ ID NO: 1179266 - RNA, 18 nt, Homo sapiens
cacccaggaguauccucu

SEQ ID NO: 1179267 - RNA, 20 nt, Homo sapiens
cacccaggcuggagugcagu

SEQ ID NO: 1179268 - RNA, 15 nt, Homo sapiens
cacccaggucuccag

SEQ ID NO: 1179269 - RNA, 16 nt, Homo sapiens
cacccaguugugacaa

SEQ ID NO: 1179270 - RNA, 15 nt, Homo sapiens
cacccaucacgugug

SEQ ID NO: 1179271 - RNA, 22 nt, Homo sapiens
cacccauugugauuguggaaga

SEQ ID NO: 1179272 - RNA, 14 nt, Homo sapiens
caccccaacacuuc

SEQ ID NO: 1179273 - RNA, 22 nt, Homo sapiens
caccccaugcuguugauugcua

SEQ ID NO: 1179274 - RNA, 13 nt, Homo sapiens
cacccccugccaa

SEQ ID NO: 1179275 - RNA, 15 nt, Homo sapiens
caccccucaucagga

SEQ ID NO: 1179276 - RNA, 13 nt, Homo sapiens
cacccuccacaaa

SEQ ID NO: 1179277 - RNA, 12 nt, Homo sapiens
caccgacugccc

SEQ ID NO: 1179278 - RNA, 18 nt, Homo sapiens
caccguacaucugcaaua

SEQ ID NO: 1179279 - RNA, 22 nt, Homo sapiens
caccuaagaucucgguuugcca

SEQ ID NO: 1179280 - RNA, 19 nt, Homo sapiens
caccuaauaauaguaauuc

SEQ ID NO: 1179281 - RNA, 20 nt, Homo sapiens
caccuaauccaggcagaucc

SEQ ID NO: 1179282 - RNA, 15 nt, Homo sapiens
caccuagcaucucau

SEQ ID NO: 1179283 - RNA, 23 nt, Homo sapiens
caccuagcaucucaugagugcca

SEQ ID NO: 1179284 - RNA, 18 nt, Homo sapiens
caccuauauauccaagaa

SEQ ID NO: 1179285 - RNA, 19 nt, Homo sapiens
gaaaagcggacaucagcug

SEQ ID NO: 1179286 - RNA, 20 nt, Homo sapiens
gaaaagcuagguguuuaaua

SEQ ID NO: 1179287 - RNA, 23 nt, Homo sapiens
gaaaagcuccauuuuuagugaaa

SEQ ID NO: 1179288 - RNA, 13 nt, Homo sapiens
gaaaagcuuuccu

SEQ ID NO: 1179289 - RNA, 15 nt, Homo sapiens
gaaaagguugccuga

SEQ ID NO: 1179290 - RNA, 20 nt, Homo sapiens
gaaaaguugccgaagaugag

SEQ ID NO: 1179291 - RNA, 22 nt, Homo sapiens
gaaaauccucgcacacacuggc

SEQ ID NO: 1179292 - RNA, 15 nt, Homo sapiens
gaaaaugcaccaaau

SEQ ID NO: 1179293 - RNA, 18 nt, Homo sapiens
gaaaaugcaucacaugau

SEQ ID NO: 1179294 - RNA, 14 nt, Homo sapiens
gaaaaugcauugua

SEQ ID NO: 1179295 - RNA, 20 nt, Homo sapiens
gaaaaugcuguuuucaacau

SEQ ID NO: 1179296 - RNA, 21 nt, Homo sapiens
gaaaauguugagaaucccaaa

SEQ ID NO: 1179297 - RNA, 22 nt, Homo sapiens
gaaaauucauuccccugaaaua

SEQ ID NO: 1179298 - RNA, 20 nt, Homo sapiens
gaaaauuguauaaauuacuu

SEQ ID NO: 1179299 - RNA, 20 nt, Homo sapiens
gaaaauuuuacacaguucau

SEQ ID NO: 1179300 - RNA, 18 nt, Homo sapiens
gaaacaaaaggauaauga

SEQ ID NO: 1179301 - RNA, 20 nt, Homo sapiens
gaaacaaauaagaccauaaa

SEQ ID NO: 1179302 - RNA, 13 nt, Homo sapiens
gaaacaacuucua

SEQ ID NO: 1179303 - RNA, 20 nt, Homo sapiens
gaaacaaggcugccaggugu

SEQ ID NO: 1179304 - RNA, 21 nt, Homo sapiens
gaaacaauacucauaauguga

SEQ ID NO: 1179305 - RNA, 15 nt, Homo sapiens
gaaacaauggcuaag

SEQ ID NO: 1179306 - RNA, 16 nt, Homo sapiens
gaaacacucaacaaua

SEQ ID NO: 1179307 - RNA, 16 nt, Homo sapiens
gaaacacuccuugcau

SEQ ID NO: 1179308 - RNA, 18 nt, Homo sapiens
gaaacacugccugcccuc

SEQ ID NO: 1179309 - RNA, 21 nt, Homo sapiens
gaaacacugccuuugucuuac

SEQ ID NO: 1179310 - RNA, 22 nt, Homo sapiens
gaaacagaggcgucucacauuu

SEQ ID NO: 1179311 - RNA, 15 nt, Homo sapiens
gaaacagcgcugggu

SEQ ID NO: 1179312 - RNA, 14 nt, Homo sapiens
gaaacagcugccac

SEQ ID NO: 1179313 - RNA, 17 nt, Homo sapiens
gaaacaguuaauaccau

SEQ ID NO: 1179314 - RNA, 16 nt, Homo sapiens
gaaacaugaagcauaa

SEQ ID NO: 1179315 - RNA, 13 nt, Homo sapiens
gaaaccacaaccu

SEQ ID NO: 1179316 - RNA, 20 nt, Homo sapiens
gaaacccccaucucuacuaa

SEQ ID NO: 1179317 - RNA, 20 nt, Homo sapiens
gaaaccccuucucugugacc

SEQ ID NO: 1179318 - RNA, 18 nt, Homo sapiens
gaaaccuacacacuguca

SEQ ID NO: 1179319 - RNA, 22 nt, Homo sapiens
gaaaccugggagagacuuggau

SEQ ID NO: 1179320 - RNA, 20 nt, Homo sapiens
gaaaccuguauaacccuguu

SEQ ID NO: 1179321 - RNA, 15 nt, Homo sapiens
gaaaccuuugacacu

SEQ ID NO: 1179322 - RNA, 18 nt, Homo sapiens
gaaacggccccauugccu

SEQ ID NO: 1179323 - RNA, 21 nt, Homo sapiens
gaaacgucuucuaaacuuccc

SEQ ID NO: 1179324 - RNA, 17 nt, Homo sapiens
gaaacuaaagcaauaga

SEQ ID NO: 1179325 - RNA, 16 nt, Homo sapiens
gaaacucagugcaaaa

SEQ ID NO: 1179326 - RNA, 16 nt, Homo sapiens
gaaacucuacauuuaa

SEQ ID NO: 1179327 - RNA, 17 nt, Homo sapiens
gaaacugugaagaucuc

SEQ ID NO: 1179328 - RNA, 21 nt, Homo sapiens
gaaacugugaagaucucacuc

SEQ ID NO: 1179329 - RNA, 18 nt, Homo sapiens
gaaacuucccaacuuccc

SEQ ID NO: 1179330 - RNA, 16 nt, Homo sapiens
gaaacuugaacucugg

SEQ ID NO: 1179331 - RNA, 15 nt, Homo sapiens
gaaagaaacuaccuu

SEQ ID NO: 1179332 - RNA, 13 nt, Homo sapiens
gaaagaaccagag

SEQ ID NO: 1179333 - RNA, 19 nt, Homo sapiens
gaaagaagaguuggaguga

SEQ ID NO: 1179334 - RNA, 18 nt, Homo sapiens
gaaagacaagacauugug

SEQ ID NO: 1179335 - RNA, 19 nt, Homo sapiens
gaaagaguccuauuugcac

SEQ ID NO: 1179336 - RNA, 15 nt, Homo sapiens
gaaagauaggacuaa

SEQ ID NO: 1179337 - RNA, 14 nt, Homo sapiens
gaaagaucaaagac

SEQ ID NO: 1179338 - RNA, 17 nt, Homo sapiens
gaaagaugaugcucagu

SEQ ID NO: 1179339 - RNA, 20 nt, Homo sapiens
gaaagcacaagguaaauauu

SEQ ID NO: 1179340 - RNA, 18 nt, Homo sapiens
gaaagcauccauuaauua

SEQ ID NO: 1179341 - RNA, 21 nt, Homo sapiens
gaaagcaugucucugcuucca

SEQ ID NO: 1179342 - RNA, 15 nt, Homo sapiens
gaaagccaugugcua

SEQ ID NO: 1179343 - RNA, 15 nt, Homo sapiens
gaaagcccucuagga

SEQ ID NO: 1179344 - RNA, 18 nt, Homo sapiens
cuuuagaaagcugacauu

SEQ ID NO: 1179345 - RNA, 21 nt, Homo sapiens
cuuuagaaagcugacauugcc

SEQ ID NO: 1179346 - RNA, 20 nt, Homo sapiens
cuuuagaaaugucaguugcu

SEQ ID NO: 1179347 - RNA, 13 nt, Homo sapiens
cuuuagaaugaga

SEQ ID NO: 1179348 - RNA, 14 nt, Homo sapiens
cuuuagagugcaag

SEQ ID NO: 1179349 - RNA, 12 nt, Homo sapiens
cuuuaguacuua

SEQ ID NO: 1179350 - RNA, 23 nt, Homo sapiens
cuuuauaccccauuugauuucga

SEQ ID NO: 1179351 - RNA, 22 nt, Homo sapiens
cuuuauauggccucaagaucaa

SEQ ID NO: 1179352 - RNA, 14 nt, Homo sapiens
cuuuaucaccucau

SEQ ID NO: 1179353 - RNA, 17 nt, Homo sapiens
cuuuaugcaugaagaua

SEQ ID NO: 1179354 - RNA, 20 nt, Homo sapiens
cuuuauugcccuaacaauuu

SEQ ID NO: 1179355 - RNA, 16 nt, Homo sapiens
cuuuauuucugaucua

SEQ ID NO: 1179356 - RNA, 14 nt, Homo sapiens
cuuucaaacauguu

SEQ ID NO: 1179357 - RNA, 14 nt, Homo sapiens
cuuucaaagcauuu

SEQ ID NO: 1179358 - RNA, 15 nt, Homo sapiens
cuuucaaauuuacug

SEQ ID NO: 1179359 - RNA, 21 nt, Homo sapiens
cuuucaaauuuacugucuuaa

SEQ ID NO: 1179360 - RNA, 17 nt, Homo sapiens
cuuucacucacaacacu

SEQ ID NO: 1179361 - RNA, 18 nt, Homo sapiens
cuuucagaguuugguuaa

SEQ ID NO: 1179362 - RNA, 19 nt, Homo sapiens
cuuucagccacaugcccca

SEQ ID NO: 1179363 - RNA, 16 nt, Homo sapiens
cuuucauguucuugga

SEQ ID NO: 1179364 - RNA, 16 nt, Homo sapiens
cuuuccaaccggcuuu

SEQ ID NO: 1179365 - RNA, 16 nt, Homo sapiens
cuuuccaagucauuuu

SEQ ID NO: 1179366 - RNA, 19 nt, Homo sapiens
cuuuccaugggaccacaac

SEQ ID NO: 1179367 - RNA, 18 nt, Homo sapiens
cuuucccuuggauaccua

SEQ ID NO: 1179368 - RNA, 19 nt, Homo sapiens
cuuucccuuggauaccuag

SEQ ID NO: 1179369 - RNA, 17 nt, Homo sapiens
cuuuccuaaggcugcaa

SEQ ID NO: 1179370 - RNA, 22 nt, Homo sapiens
cuuuccuuuacuccuggcucaa

SEQ ID NO: 1179371 - RNA, 19 nt, Homo sapiens
cuuucguaauagcucagau

SEQ ID NO: 1179372 - RNA, 15 nt, Homo sapiens
cuuucuaccaaauga

SEQ ID NO: 1179373 - RNA, 18 nt, Homo sapiens
cuuucuauuaccccucau

SEQ ID NO: 1179374 - RNA, 22 nt, Homo sapiens
cuuucuauuaccccucauuuaa

SEQ ID NO: 1179375 - RNA, 22 nt, Homo sapiens
cuuucucccuggggaugugcuu

SEQ ID NO: 1179376 - RNA, 17 nt, Homo sapiens
cuuucugacaucagcac

SEQ ID NO: 1179377 - RNA, 13 nt, Homo sapiens
cuuucugccaaug

SEQ ID NO: 1179378 - RNA, 15 nt, Homo sapiens
cuuucuguucaucuc

SEQ ID NO: 1179379 - RNA, 13 nt, Homo sapiens
cuuucuuacauaa

SEQ ID NO: 1179380 - RNA, 16 nt, Homo sapiens
cuuucuuacauaauau

SEQ ID NO: 1179381 - RNA, 17 nt, Homo sapiens
cuuucuuccuccagucu

SEQ ID NO: 1179382 - RNA, 15 nt, Homo sapiens
cuuucuuucauucuc

SEQ ID NO: 1179383 - RNA, 22 nt, Homo sapiens
cuuucuuuuuuaaauaggguug

SEQ ID NO: 1179384 - RNA, 13 nt, Homo sapiens
cuuugaaccauaa

SEQ ID NO: 1179385 - RNA, 23 nt, Homo sapiens
cuuugaauuaaaauaaaacacau

SEQ ID NO: 1179386 - RNA, 17 nt, Homo sapiens
cuuugcaggaugaccuc

SEQ ID NO: 1179387 - RNA, 22 nt, Homo sapiens
cuuugcccauggaagucucaaa

SEQ ID NO: 1179388 - RNA, 22 nt, Homo sapiens
cuuugcccccgacggcugugac

SEQ ID NO: 1179389 - RNA, 17 nt, Homo sapiens
cuuugcuacacugcuga

SEQ ID NO: 1179390 - RNA, 23 nt, Homo sapiens
cuuugcuacuacuaugugcagga

SEQ ID NO: 1179391 - RNA, 23 nt, Homo sapiens
cuuugcugaaugucauuauuuga

SEQ ID NO: 1179392 - RNA, 16 nt, Homo sapiens
cuuugcugugaaggga

SEQ ID NO: 1179393 - RNA, 17 nt, Homo sapiens
cuuuggaaagacuugaa

SEQ ID NO: 1179394 - RNA, 16 nt, Homo sapiens
cuuuggaaauacacag

SEQ ID NO: 1179395 - RNA, 17 nt, Homo sapiens
cuuuggagaugcugagg

SEQ ID NO: 1179396 - RNA, 13 nt, Homo sapiens
cuuuggcaacaga

SEQ ID NO: 1179397 - RNA, 14 nt, Homo sapiens
cuuuggcaacagaa

SEQ ID NO: 1179398 - RNA, 22 nt, Homo sapiens
cuuuggcagaaucccccaaaga

SEQ ID NO: 1179399 - RNA, 23 nt, Homo sapiens
cuuuggcagaaucccccaaagaa

SEQ ID NO: 1179400 - RNA, 17 nt, Homo sapiens
cuuuggcagcugcaaua

SEQ ID NO: 1179401 - RNA, 21 nt, Homo sapiens
cuuuggcugaaauucuucaac

SEQ ID NO: 1179402 - RNA, 16 nt, Homo sapiens
gccuucucccugggaa

SEQ ID NO: 1179403 - RNA, 16 nt, Homo sapiens
gccuucucucagcucc

SEQ ID NO: 1179404 - RNA, 19 nt, Homo sapiens
gccuucugaggacauucca

SEQ ID NO: 1179405 - RNA, 22 nt, Homo sapiens
gccuucugggaagggagagggc

SEQ ID NO: 1179406 - RNA, 13 nt, Homo sapiens
gccuucuuauauc

SEQ ID NO: 1179407 - RNA, 22 nt, Homo sapiens
gccuucuuauaucugaagauug

SEQ ID NO: 1179408 - RNA, 16 nt, Homo sapiens
gccuucuuuaugggaa

SEQ ID NO: 1179409 - RNA, 17 nt, Homo sapiens
gccuuggccuugcagcu

SEQ ID NO: 1179410 - RNA, 23 nt, Homo sapiens
gccuugggacuuagaacaccgcc

SEQ ID NO: 1179411 - RNA, 20 nt, Homo sapiens
gccuugucacgccagacuuc

SEQ ID NO: 1179412 - RNA, 20 nt, Homo sapiens
gccuuguuuggauuggcacu

SEQ ID NO: 1179413 - RNA, 21 nt, Homo sapiens
gccuuuacauggacagaauuu

SEQ ID NO: 1179414 - RNA, 18 nt, Homo sapiens
gccuuuauauccaaaaua

SEQ ID NO: 1179415 - RNA, 22 nt, Homo sapiens
gccuuuaucaagagacuccuga

SEQ ID NO: 1179416 - RNA, 17 nt, Homo sapiens
gccuuuaucucagccau

SEQ ID NO: 1179417 - RNA, 13 nt, Homo sapiens
gccuuugcuuaag

SEQ ID NO: 1179418 - RNA, 15 nt, Homo sapiens
gccuuuguggugggc

SEQ ID NO: 1179419 - RNA, 17 nt, Homo sapiens
gccuuuugcuacgugcc

SEQ ID NO: 1179420 - RNA, 22 nt, Homo sapiens
gccuuuuuauuuauauguacug

SEQ ID NO: 1179421 - RNA, 19 nt, Homo sapiens
gcgaagcguuguccucagc

SEQ ID NO: 1179422 - RNA, 15 nt, Homo sapiens
gcgagacuccaucuc

SEQ ID NO: 1179423 - RNA, 20 nt, Homo sapiens
gcgcacggagcgccccggcc

SEQ ID NO: 1179424 - RNA, 21 nt, Homo sapiens
gcgcaggccugcgugcgcugg

SEQ ID NO: 1179425 - RNA, 20 nt, Homo sapiens
gcgccaggcugaccacagca

SEQ ID NO: 1179426 - RNA, 17 nt, Homo sapiens
gcgcccaguccuuccac

SEQ ID NO: 1179427 - RNA, 16 nt, Homo sapiens
gcgcccccaccccaga

SEQ ID NO: 1179428 - RNA, 19 nt, Homo sapiens
gcgcccccaccccagaccc

SEQ ID NO: 1179429 - RNA, 20 nt, Homo sapiens
gcgcgccuccgcuacuucca

SEQ ID NO: 1179430 - RNA, 15 nt, Homo sapiens
gcgcguccagcugcc

SEQ ID NO: 1179431 - RNA, 20 nt, Homo sapiens
gcgcguucuggcgacagggg

SEQ ID NO: 1179432 - RNA, 16 nt, Homo sapiens
gcggaaucagcuucua

SEQ ID NO: 1179433 - RNA, 14 nt, Homo sapiens
gcggacaucagcug

SEQ ID NO: 1179434 - RNA, 13 nt, Homo sapiens
gcggcagggccag

SEQ ID NO: 1179435 - RNA, 13 nt, Homo sapiens
gcggcccagaccc

SEQ ID NO: 1179436 - RNA, 12 nt, Homo sapiens
gcggccucaggg

SEQ ID NO: 1179437 - RNA, 15 nt, Homo sapiens
gcgggacagagggug

SEQ ID NO: 1179438 - RNA, 19 nt, Homo sapiens
gcgggccccucaccuggua

SEQ ID NO: 1179439 - RNA, 16 nt, Homo sapiens
gcggggaucaucugcc

SEQ ID NO: 1179440 - RNA, 18 nt, Homo sapiens
gcgggggggggggcggug

SEQ ID NO: 1179441 - RNA, 17 nt, Homo sapiens
gcgggucaacauuucca

SEQ ID NO: 1179442 - RNA, 23 nt, Homo sapiens
gcguagagggugcugccccauga

SEQ ID NO: 1179443 - RNA, 12 nt, Homo sapiens
gcgugacaauaa

SEQ ID NO: 1179444 - RNA, 19 nt, Homo sapiens
gcgugacacucuccuugca

SEQ ID NO: 1179445 - RNA, 16 nt, Homo sapiens
gcguggacucugcaca

SEQ ID NO: 1179446 - RNA, 20 nt, Homo sapiens
gcguggacucugcacauguc

SEQ ID NO: 1179447 - RNA, 21 nt, Homo sapiens
gcguggagacuggcaggcggg

SEQ ID NO: 1179448 - RNA, 16 nt, Homo sapiens
gcgugugccugugugc

SEQ ID NO: 1179449 - RNA, 22 nt, Homo sapiens
gcuaaauaaucuuacucuagau

SEQ ID NO: 1179450 - RNA, 15 nt, Homo sapiens
gcuaaauauuucuuu

SEQ ID NO: 1179451 - RNA, 17 nt, Homo sapiens
gcuaaaugcacugaccc

SEQ ID NO: 1179452 - RNA, 17 nt, Homo sapiens
gcuaacaugaguaucau

SEQ ID NO: 1179453 - RNA, 17 nt, Homo sapiens
gcuaaggacauuuccca

SEQ ID NO: 1179454 - RNA, 13 nt, Homo sapiens
gcuaaguauugaa

SEQ ID NO: 1179455 - RNA, 19 nt, Homo sapiens
gcuaaugaagaucauauac

SEQ ID NO: 1179456 - RNA, 18 nt, Homo sapiens
gcuacaaaauaaagcugu

SEQ ID NO: 1179457 - RNA, 14 nt, Homo sapiens
gcuacaaaugcauu

SEQ ID NO: 1179458 - RNA, 11 nt, Homo sapiens
gcuacaacagc

SEQ ID NO: 1179459 - RNA, 17 nt, Homo sapiens
gcuacaggucaguuuau

SEQ ID NO: 1179460 - RNA, 15 nt, Homo sapiens
gcuaccucaaccaau

SEQ ID NO: 1179461 - RNA, 13 nt, Homo sapiens
gcuacgugugauu

SEQ ID NO: 1179462 - RNA, 14 nt, Homo sapiens
gcuacuagcucuuu

SEQ ID NO: 1179463 - RNA, 21 nt, Homo sapiens
gcuacucuguuccuucacauc

SEQ ID NO: 1179464 - RNA, 17 nt, Homo sapiens
gcuacugaaacuuaccu

SEQ ID NO: 1179465 - RNA, 20 nt, Homo sapiens
gcuacugaaacuuaccugag

SEQ ID NO: 1179466 - RNA, 20 nt, Homo sapiens
gcuacugccgucagugcugu

SEQ ID NO: 1179467 - RNA, 17 nt, Homo sapiens
gcuacugucucacugaa

SEQ ID NO: 1179468 - RNA, 12 nt, Homo sapiens
gcuacuguguca

SEQ ID NO: 1179469 - RNA, 17 nt, Homo sapiens
gcuacuuagcuggccaa

SEQ ID NO: 1179470 - RNA, 13 nt, Homo sapiens
gcuacuugggagg

SEQ ID NO: 1179471 - RNA, 14 nt, Homo sapiens
gcuacuuuugccaa

SEQ ID NO: 1179472 - RNA, 20 nt, Homo sapiens
gcuagaaauaagcccaacag

SEQ ID NO: 1179473 - RNA, 13 nt, Homo sapiens
gcuagagugcaau

SEQ ID NO: 1179474 - RNA, 21 nt, Homo sapiens
gcuagcugcaagugacaucuc

SEQ ID NO: 1179475 - RNA, 16 nt, Homo sapiens
gcuagcuuuccuuuac

SEQ ID NO: 1179476 - RNA, 22 nt, Homo sapiens
gcuaggcaugguggacucgccu

SEQ ID NO: 1179477 - RNA, 13 nt, Homo sapiens
gaauuccuaacuu

SEQ ID NO: 1179478 - RNA, 14 nt, Homo sapiens
gaauucucuugcug

SEQ ID NO: 1179479 - RNA, 17 nt, Homo sapiens
gaauucugucauuucaa

SEQ ID NO: 1179480 - RNA, 23 nt, Homo sapiens
gaauucuuacauguuuucuuugc

SEQ ID NO: 1179481 - RNA, 15 nt, Homo sapiens
gaauucuuuacaaua

SEQ ID NO: 1179482 - RNA, 13 nt, Homo sapiens
gaauugauucaug

SEQ ID NO: 1179483 - RNA, 22 nt, Homo sapiens
gaauugauugucagccaccucc

SEQ ID NO: 1179484 - RNA, 12 nt, Homo sapiens
gaauuguuacau

SEQ ID NO: 1179485 - RNA, 14 nt, Homo sapiens
gaauuuacauauag

SEQ ID NO: 1179486 - RNA, 18 nt, Homo sapiens
gaauuuauaacccaguga

SEQ ID NO: 1179487 - RNA, 18 nt, Homo sapiens
gaauuucacaagcuauuu

SEQ ID NO: 1179488 - RNA, 17 nt, Homo sapiens
gaauuucccagugaaau

SEQ ID NO: 1179489 - RNA, 12 nt, Homo sapiens
gaauuugagugc

SEQ ID NO: 1179490 - RNA, 13 nt, Homo sapiens
gaauuugcaaagu

SEQ ID NO: 1179491 - RNA, 18 nt, Homo sapiens
gaauuuguggccuaccuu

SEQ ID NO: 1179492 - RNA, 16 nt, Homo sapiens
gaauuuuugcaauaau

SEQ ID NO: 1179493 - RNA, 22 nt, Homo sapiens
gaauuuuugcaauaaugcagua

SEQ ID NO: 1179494 - RNA, 16 nt, Homo sapiens
gacaaaacccacuguu

SEQ ID NO: 1179495 - RNA, 21 nt, Homo sapiens
gacaaaaucacauucugcaua

SEQ ID NO: 1179496 - RNA, 20 nt, Homo sapiens
gacaaauacuuagacaguau

SEQ ID NO: 1179497 - RNA, 12 nt, Homo sapiens
gacaaaugugaa

SEQ ID NO: 1179498 - RNA, 23 nt, Homo sapiens
gacaacacacaaaauaaugcagu

SEQ ID NO: 1179499 - RNA, 24 nt, Homo sapiens
gacaacucauuuucauauuguaau

SEQ ID NO: 1179500 - RNA, 17 nt, Homo sapiens
gacaacuucaaaauaca

SEQ ID NO: 1179501 - RNA, 16 nt, Homo sapiens
gacaagggaaauguca

SEQ ID NO: 1179502 - RNA, 13 nt, Homo sapiens
gacaagucaugga

SEQ ID NO: 1179503 - RNA, 17 nt, Homo sapiens
gacaauagggcugauaa

SEQ ID NO: 1179504 - RNA, 13 nt, Homo sapiens
gacacagaaaaug

SEQ ID NO: 1179505 - RNA, 17 nt, Homo sapiens
gacacagacauccucua

SEQ ID NO: 1179506 - RNA, 17 nt, Homo sapiens
gacacagacccacagaa

SEQ ID NO: 1179507 - RNA, 13 nt, Homo sapiens
gacacagacucau

SEQ ID NO: 1179508 - RNA, 15 nt, Homo sapiens
gacacauaugcaccu

SEQ ID NO: 1179509 - RNA, 16 nt, Homo sapiens
gacacauucacacugg

SEQ ID NO: 1179510 - RNA, 21 nt, Homo sapiens
gacacauucacacugggccaa

SEQ ID NO: 1179511 - RNA, 19 nt, Homo sapiens
gacaccagcccugcugcuu

SEQ ID NO: 1179512 - RNA, 20 nt, Homo sapiens
gacaccucaaauacauaccu

SEQ ID NO: 1179513 - RNA, 22 nt, Homo sapiens
gacacucaagucccccaagacc

SEQ ID NO: 1179514 - RNA, 16 nt, Homo sapiens
gacacucuccuugcag

SEQ ID NO: 1179515 - RNA, 19 nt, Homo sapiens
gacacucuccuugcaguuc

SEQ ID NO: 1179516 - RNA, 17 nt, Homo sapiens
gacacugggaggccagu

SEQ ID NO: 1179517 - RNA, 11 nt, Homo sapiens
gacacugggga

SEQ ID NO: 1179518 - RNA, 14 nt, Homo sapiens
gacacuuaauacua

SEQ ID NO: 1179519 - RNA, 22 nt, Homo sapiens
gacacuuaauacuaccuugaaa

SEQ ID NO: 1179520 - RNA, 11 nt, Homo sapiens
gacagacaccg

SEQ ID NO: 1179521 - RNA, 14 nt, Homo sapiens
gacagacauacauu

SEQ ID NO: 1179522 - RNA, 16 nt, Homo sapiens
gacagagcgagacucc

SEQ ID NO: 1179523 - RNA, 23 nt, Homo sapiens
gacagaugaggcuuuccauggga

SEQ ID NO: 1179524 - RNA, 12 nt, Homo sapiens
gacagcacuccu

SEQ ID NO: 1179525 - RNA, 19 nt, Homo sapiens
gacagcaucuaagaaguuu

SEQ ID NO: 1179526 - RNA, 15 nt, Homo sapiens
gacagccaaguuaua

SEQ ID NO: 1179527 - RNA, 22 nt, Homo sapiens
gacagcuuguggcaagugaauu

SEQ ID NO: 1179528 - RNA, 15 nt, Homo sapiens
gacagcuuugcugcu

SEQ ID NO: 1179529 - RNA, 22 nt, Homo sapiens
gacagcuuuucccaagauguca

SEQ ID NO: 1179530 - RNA, 15 nt, Homo sapiens
gacagggacaugccc

SEQ ID NO: 1179531 - RNA, 21 nt, Homo sapiens
gacagguguauggagucaccu

SEQ ID NO: 1179532 - RNA, 14 nt, Homo sapiens
gacaguaugcauac

SEQ ID NO: 1179533 - RNA, 21 nt, Homo sapiens
gacagucgcucagucuguuca

SEQ ID NO: 1179534 - RNA, 14 nt, Homo sapiens
gacagugaacauuc

SEQ ID NO: 1179535 - RNA, 16 nt, Homo sapiens
gacagugggaaauauu

SEQ ID NO: 1179536 - RNA, 15 nt, Homo sapiens
gacaguugauuucca

SEQ ID NO: 1179537 - RNA, 16 nt, Homo sapiens
gacaguugauuuccaa

SEQ ID NO: 1179538 - RNA, 17 nt, Homo sapiens
gacaguugauuuccaac

SEQ ID NO: 1179539 - RNA, 16 nt, Homo sapiens
gacaguuuacaaauga

SEQ ID NO: 1179540 - RNA, 23 nt, Homo sapiens
gcaguuucugacacuuguuguug

SEQ ID NO: 1179541 - RNA, 14 nt, Homo sapiens
gcauaaagaauagu

SEQ ID NO: 1179542 - RNA, 22 nt, Homo sapiens
gcauaacagcaggguaccugaa

SEQ ID NO: 1179543 - RNA, 24 nt, Homo sapiens
gcauaagggcuucuggaacccaga

SEQ ID NO: 1179544 - RNA, 22 nt, Homo sapiens
gcauacacacacacacacagcc

SEQ ID NO: 1179545 - RNA, 14 nt, Homo sapiens
gcauacagccuuug

SEQ ID NO: 1179546 - RNA, 20 nt, Homo sapiens
gcauaccauuaaauaaugca

SEQ ID NO: 1179547 - RNA, 23 nt, Homo sapiens
gcauacgguaugauauugcagcu

SEQ ID NO: 1179548 - RNA, 14 nt, Homo sapiens
gcauagauugauca

SEQ ID NO: 1179549 - RNA, 21 nt, Homo sapiens
gcauaggaacaauaagaacaa

SEQ ID NO: 1179550 - RNA, 13 nt, Homo sapiens
gcauaguccaaaa

SEQ ID NO: 1179551 - RNA, 21 nt, Homo sapiens
gcauauaaauuccccauauuu

SEQ ID NO: 1179552 - RNA, 23 nt, Homo sapiens
gcauauaaucaagaaauaaccau

SEQ ID NO: 1179553 - RNA, 17 nt, Homo sapiens
gcauauagaaaacaaag

SEQ ID NO: 1179554 - RNA, 21 nt, Homo sapiens
gcauauuggaaagugauuuua

SEQ ID NO: 1179555 - RNA, 17 nt, Homo sapiens
gcaucaauuccaucagc

SEQ ID NO: 1179556 - RNA, 14 nt, Homo sapiens
gcaucacagaaugu

SEQ ID NO: 1179557 - RNA, 18 nt, Homo sapiens
gcaucacagaaugugaua

SEQ ID NO: 1179558 - RNA, 20 nt, Homo sapiens
gcaucacagucacaugccca

SEQ ID NO: 1179559 - RNA, 20 nt, Homo sapiens
gcaucaggauacucaaagug

SEQ ID NO: 1179560 - RNA, 22 nt, Homo sapiens
gcaucauuaaugcacaucugca

SEQ ID NO: 1179561 - RNA, 17 nt, Homo sapiens
gcauccaacuccaggau

SEQ ID NO: 1179562 - RNA, 21 nt, Homo sapiens
gcauccagagucccugccugg

SEQ ID NO: 1179563 - RNA, 23 nt, Homo sapiens
gcaucccuagucucuacccagua

SEQ ID NO: 1179564 - RNA, 11 nt, Homo sapiens
gcauccuaguc

SEQ ID NO: 1179565 - RNA, 16 nt, Homo sapiens
gcauccuagucucuau

SEQ ID NO: 1179566 - RNA, 19 nt, Homo sapiens
gcauccuagucucuaucau

SEQ ID NO: 1179567 - RNA, 16 nt, Homo sapiens
gcauccucuaccucuc

SEQ ID NO: 1179568 - RNA, 17 nt, Homo sapiens
gcaucgcuccucuccag

SEQ ID NO: 1179569 - RNA, 21 nt, Homo sapiens
gcaucuaaguuauaagacucu

SEQ ID NO: 1179570 - RNA, 15 nt, Homo sapiens
gcaucuacacaauuu

SEQ ID NO: 1179571 - RNA, 21 nt, Homo sapiens
gcaucucauugaggacaaaga

SEQ ID NO: 1179572 - RNA, 15 nt, Homo sapiens
gcaucuccagcauuc

SEQ ID NO: 1179573 - RNA, 16 nt, Homo sapiens
gcaucucuucuucccu

SEQ ID NO: 1179574 - RNA, 15 nt, Homo sapiens
gcaucugaccaucug

SEQ ID NO: 1179575 - RNA, 19 nt, Homo sapiens
gcaucugaccaucugugac

SEQ ID NO: 1179576 - RNA, 21 nt, Homo sapiens
gcaucugggcaggaugacuuu

SEQ ID NO: 1179577 - RNA, 17 nt, Homo sapiens
gcaucuucccacagugg

SEQ ID NO: 1179578 - RNA, 16 nt, Homo sapiens
gcaucuuuaacacagc

SEQ ID NO: 1179579 - RNA, 13 nt, Homo sapiens
gcaugaguuuaaa

SEQ ID NO: 1179580 - RNA, 13 nt, Homo sapiens
gcaugauagacac

SEQ ID NO: 1179581 - RNA, 19 nt, Homo sapiens
gcaugauauuguucuccaa

SEQ ID NO: 1179582 - RNA, 22 nt, Homo sapiens
gcaugaucuugagcaaguuccu

SEQ ID NO: 1179583 - RNA, 13 nt, Homo sapiens
gcaugauggugca

SEQ ID NO: 1179584 - RNA, 13 nt, Homo sapiens
gcaugcauucuag

SEQ ID NO: 1179585 - RNA, 21 nt, Homo sapiens
gcaugcccccuccugcaaggg

SEQ ID NO: 1179586 - RNA, 16 nt, Homo sapiens
gcaugccuguagucuc

SEQ ID NO: 1179587 - RNA, 22 nt, Homo sapiens
gcauggcguagagggugcugcc

SEQ ID NO: 1179588 - RNA, 23 nt, Homo sapiens
gcauggcuuuggcuuugcaaaau

SEQ ID NO: 1179589 - RNA, 19 nt, Homo sapiens
gcauguaaaaucuucagcu

SEQ ID NO: 1179590 - RNA, 14 nt, Homo sapiens
gcauguaaggccuu

SEQ ID NO: 1179591 - RNA, 13 nt, Homo sapiens
gcauguauacuua

SEQ ID NO: 1179592 - RNA, 24 nt, Homo sapiens
gcauguaugucuuggacacuguac

SEQ ID NO: 1179593 - RNA, 22 nt, Homo sapiens
gcaugucuacucagcauuugau

SEQ ID NO: 1179594 - RNA, 15 nt, Homo sapiens
gcaugucucugcuuc

SEQ ID NO: 1179595 - RNA, 21 nt, Homo sapiens
gcaugugaagaaaggguguuu

SEQ ID NO: 1179596 - RNA, 17 nt, Homo sapiens
gcauguguucuguuaga

SEQ ID NO: 1179597 - RNA, 12 nt, Homo sapiens
gcauuacuuuau

SEQ ID NO: 1179598 - RNA, 18 nt, Homo sapiens
gcauucuaagucacagga

SEQ ID NO: 1179599 - RNA, 17 nt, Homo sapiens
gcauucucugaauuuau

SEQ ID NO: 1179600 - RNA, 20 nt, Homo sapiens
gcauucuuaacaaacucuuc

SEQ ID NO: 1179601 - RNA, 21 nt, Homo sapiens
gcauucuuaacaaacucuuca

SEQ ID NO: 1179602 - RNA, 19 nt, Homo sapiens
gcccccgacggcugugacg

SEQ ID NO: 1179603 - RNA, 16 nt, Homo sapiens
gcccccgccacaaccc

SEQ ID NO: 1179604 - RNA, 21 nt, Homo sapiens
gcccccuucaagccugugcaa

SEQ ID NO: 1179605 - RNA, 21 nt, Homo sapiens
gccccgcaccuguacagugga

SEQ ID NO: 1179606 - RNA, 16 nt, Homo sapiens
gccccgccgccuggua

SEQ ID NO: 1179607 - RNA, 16 nt, Homo sapiens
gccccgucucuguucc

SEQ ID NO: 1179608 - RNA, 21 nt, Homo sapiens
gccccuauagaaacaccagua

SEQ ID NO: 1179609 - RNA, 14 nt, Homo sapiens
gccccucaggggaa

SEQ ID NO: 1179610 - RNA, 15 nt, Homo sapiens
gccccuccaucugua

SEQ ID NO: 1179611 - RNA, 23 nt, Homo sapiens
gccccuccuuccuucaagccaag

SEQ ID NO: 1179612 - RNA, 21 nt, Homo sapiens
gccccucuccuccguggcaca

SEQ ID NO: 1179613 - RNA, 16 nt, Homo sapiens
gccccuggcacucuug

SEQ ID NO: 1179614 - RNA, 14 nt, Homo sapiens
gccccuuuccaaaa

SEQ ID NO: 1179615 - RNA, 15 nt, Homo sapiens
gcccgcggcggugga

SEQ ID NO: 1179616 - RNA, 15 nt, Homo sapiens
gcccgucuguccauc

SEQ ID NO: 1179617 - RNA, 22 nt, Homo sapiens
gcccguggcuuggcaucugugu

SEQ ID NO: 1179618 - RNA, 13 nt, Homo sapiens
gcccguucuugaa

SEQ ID NO: 1179619 - RNA, 20 nt, Homo sapiens
gcccuaaaagcacacucauc

SEQ ID NO: 1179620 - RNA, 20 nt, Homo sapiens
gcccuaggacaggaggagcu

SEQ ID NO: 1179621 - RNA, 16 nt, Homo sapiens
gcccuaugucucagga

SEQ ID NO: 1179622 - RNA, 14 nt, Homo sapiens
gcccucagccagag

SEQ ID NO: 1179623 - RNA, 16 nt, Homo sapiens
gcccucaggcaccugc

SEQ ID NO: 1179624 - RNA, 16 nt, Homo sapiens
gcccucauccauuuau

SEQ ID NO: 1179625 - RNA, 19 nt, Homo sapiens
gcccucuagggcagggugg

SEQ ID NO: 1179626 - RNA, 16 nt, Homo sapiens
gcccugaguccaagag

SEQ ID NO: 1179627 - RNA, 14 nt, Homo sapiens
gcccugcuaugaaa

SEQ ID NO: 1179628 - RNA, 20 nt, Homo sapiens
gcccuggaauugcagcugua

SEQ ID NO: 1179629 - RNA, 17 nt, Homo sapiens
gcccuggugcuccugcc

SEQ ID NO: 1179630 - RNA, 23 nt, Homo sapiens
gcccugugcccccugaaacagcu

SEQ ID NO: 1179631 - RNA, 23 nt, Homo sapiens
gcccuuacuccugguucagugcc

SEQ ID NO: 1179632 - RNA, 17 nt, Homo sapiens
gcccuucacccagagcc

SEQ ID NO: 1179633 - RNA, 16 nt, Homo sapiens
gcccuuccuugccagu

SEQ ID NO: 1179634 - RNA, 16 nt, Homo sapiens
gccgacagcucuccaa

SEQ ID NO: 1179635 - RNA, 19 nt, Homo sapiens
gccgacccugcggccucca

SEQ ID NO: 1179636 - RNA, 13 nt, Homo sapiens
gccgacggagccg

SEQ ID NO: 1179637 - RNA, 21 nt, Homo sapiens
gccgagaguccaucagccucc

SEQ ID NO: 1179638 - RNA, 16 nt, Homo sapiens
gccgagcggggagcca

SEQ ID NO: 1179639 - RNA, 21 nt, Homo sapiens
gccgagcggggagccaggaaa

SEQ ID NO: 1179640 - RNA, 22 nt, Homo sapiens
gccgagcggggagccaggaaag

SEQ ID NO: 1179641 - RNA, 15 nt, Homo sapiens
gccgaguccaagcug

SEQ ID NO: 1179642 - RNA, 20 nt, Homo sapiens
gccgauaucaacacuuguau

SEQ ID NO: 1179643 - RNA, 18 nt, Homo sapiens
gccggagggcaccaggga

SEQ ID NO: 1179644 - RNA, 19 nt, Homo sapiens
gccggaucucgaggcuugc

SEQ ID NO: 1179645 - RNA, 15 nt, Homo sapiens
gccggcggcuucucc

SEQ ID NO: 1179646 - RNA, 14 nt, Homo sapiens
gccgggcaggcgug

SEQ ID NO: 1179647 - RNA, 14 nt, Homo sapiens
gccgguaaacacgc

SEQ ID NO: 1179648 - RNA, 22 nt, Homo sapiens
gccgucuccauggcaucuucgu

SEQ ID NO: 1179649 - RNA, 23 nt, Homo sapiens
gccguuugagaagaaaacaucua

SEQ ID NO: 1179650 - RNA, 19 nt, Homo sapiens
gccuaaaaaguaucauuac

SEQ ID NO: 1179651 - RNA, 21 nt, Homo sapiens
gccuaaaaaguaucauuacau

SEQ ID NO: 1179652 - RNA, 22 nt, Homo sapiens
gccuaaaaaguaucauuacaua

SEQ ID NO: 1179653 - RNA, 20 nt, Homo sapiens
gccuaaaagugggcuugauu

SEQ ID NO: 1179654 - RNA, 21 nt, Homo sapiens
gccuaaaagugggcuugauuc

SEQ ID NO: 1179655 - RNA, 15 nt, Homo sapiens
gccuaacacacucca

SEQ ID NO: 1179656 - RNA, 16 nt, Homo sapiens
gccuaccucagccucc

SEQ ID NO: 1179657 - RNA, 23 nt, Homo sapiens
gccuauaaauuuacucuguugaa

SEQ ID NO: 1179658 - RNA, 15 nt, Homo sapiens
gccucaaaucuuccu

SEQ ID NO: 1179659 - RNA, 14 nt, Homo sapiens
gccucaaguuccag

SEQ ID NO: 1179660 - RNA, 19 nt, Homo sapiens
gccucacuacucgagccca

SEQ ID NO: 1179661 - RNA, 23 nt, Homo sapiens
gccucacuuaugagaugccugaa

SEQ ID NO: 1179662 - RNA, 16 nt, Homo sapiens
gccucagcaagccaug

SEQ ID NO: 1179663 - RNA, 11 nt, Homo sapiens
gccucaucucu

SEQ ID NO: 1179664 - RNA, 17 nt, Homo sapiens
gccuccagaagcacugg

SEQ ID NO: 1179665 - RNA, 15 nt, Homo sapiens
gccuccagugcaguc

SEQ ID NO: 1179666 - RNA, 13 nt, Homo sapiens
gccucccacaaga

SEQ ID NO: 1179667 - RNA, 21 nt, Homo sapiens
gccucccauucuacucaaagu

SEQ ID NO: 1179668 - RNA, 18 nt, Homo sapiens
gccuccccccucacuugu

SEQ ID NO: 1179669 - RNA, 18 nt, Homo sapiens
gccucccugaagccuuug

SEQ ID NO: 1179670 - RNA, 20 nt, Homo sapiens
gccuccgggguucagccucc

SEQ ID NO: 1179671 - RNA, 18 nt, Homo sapiens
gccuccucccuggcugca

SEQ ID NO: 1179672 - RNA, 17 nt, Homo sapiens
gccuccugaguucaagc

SEQ ID NO: 1179673 - RNA, 23 nt, Homo sapiens
gccucgagggccgccugccuuag

SEQ ID NO: 1179674 - RNA, 13 nt, Homo sapiens
gccucgcacuugc

SEQ ID NO: 1179675 - RNA, 19 nt, Homo sapiens
guuucuaagcauguagcca

SEQ ID NO: 1179676 - RNA, 20 nt, Homo sapiens
guuucuaguauguacuuuga

SEQ ID NO: 1179677 - RNA, 15 nt, Homo sapiens
guuucuccugagcua

SEQ ID NO: 1179678 - RNA, 22 nt, Homo sapiens
guuucucucacauuacuguaua

SEQ ID NO: 1179679 - RNA, 11 nt, Homo sapiens
guuucugcauc

SEQ ID NO: 1179680 - RNA, 22 nt, Homo sapiens
guuucuguauacaacccuggca

SEQ ID NO: 1179681 - RNA, 21 nt, Homo sapiens
guuucugucaagcauauugga

SEQ ID NO: 1179682 - RNA, 15 nt, Homo sapiens
guuucugugcuccaa

SEQ ID NO: 1179683 - RNA, 13 nt, Homo sapiens
guuucuguucacc

SEQ ID NO: 1179684 - RNA, 14 nt, Homo sapiens
guuucuuuuugcca

SEQ ID NO: 1179685 - RNA, 21 nt, Homo sapiens
guuugaaaauauuuuguugcc

SEQ ID NO: 1179686 - RNA, 20 nt, Homo sapiens
guuugaauaccagcuuucua

SEQ ID NO: 1179687 - RNA, 14 nt, Homo sapiens
guuugccauucucu

SEQ ID NO: 1179688 - RNA, 16 nt, Homo sapiens
guuugcccauucucuu

SEQ ID NO: 1179689 - RNA, 13 nt, Homo sapiens
guuugcuguucca

SEQ ID NO: 1179690 - RNA, 18 nt, Homo sapiens
guuuggaagauccuguga

SEQ ID NO: 1179691 - RNA, 13 nt, Homo sapiens
guuuggaguuuaa

SEQ ID NO: 1179692 - RNA, 21 nt, Homo sapiens
guuuggcuagguaucauucaa

SEQ ID NO: 1179693 - RNA, 16 nt, Homo sapiens
guuugggcuucagccu

SEQ ID NO: 1179694 - RNA, 17 nt, Homo sapiens
guuugguaguuuugcca

SEQ ID NO: 1179695 - RNA, 18 nt, Homo sapiens
guuugguaguuuugccaa

SEQ ID NO: 1179696 - RNA, 19 nt, Homo sapiens
guuugucucaccuacccau

SEQ ID NO: 1179697 - RNA, 18 nt, Homo sapiens
guuugugcucuacuguua

SEQ ID NO: 1179698 - RNA, 19 nt, Homo sapiens
guuugugcucuacuguuac

SEQ ID NO: 1179699 - RNA, 14 nt, Homo sapiens
guuuguuacuuuaa

SEQ ID NO: 1179700 - RNA, 15 nt, Homo sapiens
guuuguuacuuugaa

SEQ ID NO: 1179701 - RNA, 16 nt, Homo sapiens
guuuguucacacuccu

SEQ ID NO: 1179702 - RNA, 22 nt, Homo sapiens
guuuuaaaaaggaacugcagca

SEQ ID NO: 1179703 - RNA, 15 nt, Homo sapiens
guuuuaaacauucuu

SEQ ID NO: 1179704 - RNA, 18 nt, Homo sapiens
guuuuaaguuguuugcau

SEQ ID NO: 1179705 - RNA, 15 nt, Homo sapiens
guuuuaauguagauu

SEQ ID NO: 1179706 - RNA, 14 nt, Homo sapiens
guuuuacgcaagga

SEQ ID NO: 1179707 - RNA, 21 nt, Homo sapiens
guuuuacuaucucacugcugu

SEQ ID NO: 1179708 - RNA, 17 nt, Homo sapiens
guuuuaggguacaguuu

SEQ ID NO: 1179709 - RNA, 15 nt, Homo sapiens
guuuuauauguugcu

SEQ ID NO: 1179710 - RNA, 17 nt, Homo sapiens
guuuuauuuugugcuau

SEQ ID NO: 1179711 - RNA, 16 nt, Homo sapiens
guuuucaaugugaauu

SEQ ID NO: 1179712 - RNA, 22 nt, Homo sapiens
guuuuccuuuuaacaauaugca

SEQ ID NO: 1179713 - RNA, 13 nt, Homo sapiens
guuuucuguucuc

SEQ ID NO: 1179714 - RNA, 17 nt, Homo sapiens
guuuucuguugcauuac

SEQ ID NO: 1179715 - RNA, 18 nt, Homo sapiens
guuuugaagaaaugccaa

SEQ ID NO: 1179716 - RNA, 18 nt, Homo sapiens
guuuugaagcuguugcua

SEQ ID NO: 1179717 - RNA, 20 nt, Homo sapiens
guuuuguaaauguacuggua

SEQ ID NO: 1179718 - RNA, 18 nt, Homo sapiens
guuuuguaccaacacaca

SEQ ID NO: 1179719 - RNA, 13 nt, Homo sapiens
guuuuuauucaaa

SEQ ID NO: 1179720 - RNA, 14 nt, Homo sapiens
guuuuuauucugaa

SEQ ID NO: 1179721 - RNA, 17 nt, Homo sapiens
guuuuuauucugaauaa

SEQ ID NO: 1179722 - RNA, 16 nt, Homo sapiens
guuuuucaaaacaauu

SEQ ID NO: 1179723 - RNA, 12 nt, Homo sapiens
guuuuuccucuu

SEQ ID NO: 1179724 - RNA, 17 nt, Homo sapiens
guuuuucugaagacagu

SEQ ID NO: 1179725 - RNA, 19 nt, Homo sapiens
guuuuuuuuaagauuuauu

SEQ ID NO: 1179726 - RNA, 23 nt, Homo sapiens
uaaaaaaaaaaaaaaaagugaug

SEQ ID NO: 1179727 - RNA, 18 nt, Homo sapiens
uaaaaaaaaaaacuguug

SEQ ID NO: 1179728 - RNA, 17 nt, Homo sapiens
uaaaaaaaaagaauucu

SEQ ID NO: 1179729 - RNA, 16 nt, Homo sapiens
uaaaaaaaacaauucc

SEQ ID NO: 1179730 - RNA, 19 nt, Homo sapiens
uaaaaaaaacaauuccaca

SEQ ID NO: 1179731 - RNA, 15 nt, Homo sapiens
uaaaaaaaugcauag

SEQ ID NO: 1179732 - RNA, 12 nt, Homo sapiens
uaaaaaacaguc

SEQ ID NO: 1179733 - RNA, 14 nt, Homo sapiens
uaaaaaacauauau

SEQ ID NO: 1179734 - RNA, 16 nt, Homo sapiens
uaaaaacaaggucugc

SEQ ID NO: 1179735 - RNA, 18 nt, Homo sapiens
uaaaaaccuuguagauag

SEQ ID NO: 1179736 - RNA, 13 nt, Homo sapiens
uaaaaacuaguag

SEQ ID NO: 1179737 - RNA, 16 nt, Homo sapiens
uaaaaagaagccacag

SEQ ID NO: 1179738 - RNA, 19 nt, Homo sapiens
uaaaaagaugguugccaag

SEQ ID NO: 1179739 - RNA, 14 nt, Homo sapiens
uaaaaagcuuccau

SEQ ID NO: 1179740 - RNA, 20 nt, Homo sapiens
uaaaaagguuuacagaauuu

SEQ ID NO: 1179741 - RNA, 19 nt, Homo sapiens
uaaaaagugugcuuaacau

SEQ ID NO: 1179742 - RNA, 22 nt, Homo sapiens
uaaaaauaaaaaacauauacaa

SEQ ID NO: 1179743 - RNA, 22 nt, Homo sapiens
uaaaaauaaaucccauggaaua

SEQ ID NO: 1179744 - RNA, 17 nt, Homo sapiens
uaaaaauagucuuccac

SEQ ID NO: 1179745 - RNA, 13 nt, Homo sapiens
uaaaaaucaguuu

SEQ ID NO: 1179746 - RNA, 18 nt, Homo sapiens
uaaaaaucauaguacucu

SEQ ID NO: 1179747 - RNA, 19 nt, Homo sapiens
uaaaaaucaugagauccuu

SEQ ID NO: 1179748 - RNA, 15 nt, Homo sapiens
uaaaaaugaauccua

SEQ ID NO: 1179749 - RNA, 17 nt, Homo sapiens
uaaaaaugagugcuuaa

SEQ ID NO: 1179750 - RNA, 18 nt, Homo sapiens
uaaaaauggauacuggug

SEQ ID NO: 1179751 - RNA, 13 nt, Homo sapiens
uaaaaauguccug

SEQ ID NO: 1179752 - RNA, 17 nt, Homo sapiens
uaaaaauguccugccuu

SEQ ID NO: 1179753 - RNA, 23 nt, Homo sapiens
uaaaaauuguagcuuuuuauuaa

SEQ ID NO: 1179754 - RNA, 14 nt, Homo sapiens
uaaaacagaagccu

SEQ ID NO: 1179755 - RNA, 22 nt, Homo sapiens
uaaaacagguggagaaauuccu

SEQ ID NO: 1179756 - RNA, 23 nt, Homo sapiens
uaaaacagguggagaaauuccuu

SEQ ID NO: 1179757 - RNA, 17 nt, Homo sapiens
uaaaacuauucaugcua

SEQ ID NO: 1179758 - RNA, 17 nt, Homo sapiens
uaaaacucaagugacac

SEQ ID NO: 1179759 - RNA, 17 nt, Homo sapiens
uaaaacuuaacauucau

SEQ ID NO: 1179760 - RNA, 13 nt, Homo sapiens
uaaaagacaaaua

SEQ ID NO: 1179761 - RNA, 13 nt, Homo sapiens
uaaaagacaagga

SEQ ID NO: 1179762 - RNA, 15 nt, Homo sapiens
uaaaagacagugaaa

SEQ ID NO: 1179763 - RNA, 22 nt, Homo sapiens
uaaaagcacacucauccccuca

SEQ ID NO: 1179764 - RNA, 13 nt, Homo sapiens
uaaaagcaguuga

SEQ ID NO: 1179765 - RNA, 16 nt, Homo sapiens
uaaaaggaaucuggca

SEQ ID NO: 1179766 - RNA, 22 nt, Homo sapiens
uaaaagguuaaauauugucaua

SEQ ID NO: 1179767 - RNA, 16 nt, Homo sapiens
uaaaagugaucuacau

SEQ ID NO: 1179768 - RNA, 19 nt, Homo sapiens
uaaaagugaucuacaugag

SEQ ID NO: 1179769 - RNA, 17 nt, Homo sapiens
uaaaagugggcuugauu

SEQ ID NO: 1179770 - RNA, 14 nt, Homo sapiens
uaaaaguugcaaag

SEQ ID NO: 1179771 - RNA, 16 nt, Homo sapiens
uaaaauaaaacacauu

SEQ ID NO: 1179772 - RNA, 13 nt, Homo sapiens
uaaaauaaaccaa

SEQ ID NO: 1179773 - RNA, 15 nt, Homo sapiens
uaaaauaaaccaaau

SEQ ID NO: 1179774 - RNA, 16 nt, Homo sapiens
uaaaauaaaccaaaua

SEQ ID NO: 1179775 - RNA, 15 nt, Homo sapiens
uaaaauaacuaucag

SEQ ID NO: 1179776 - RNA, 17 nt, Homo sapiens
uaaaauacaucucaggu

SEQ ID NO: 1179777 - RNA, 19 nt, Homo sapiens
uaaaauagaguguaguuua

SEQ ID NO: 1179778 - RNA, 15 nt, Homo sapiens
uaaaauaggggagcc

SEQ ID NO: 1179779 - RNA, 19 nt, Homo sapiens
uaaaaucaaaucauccugu

SEQ ID NO: 1179780 - RNA, 21 nt, Homo sapiens
uaaaaucauaaauauaaucua

SEQ ID NO: 1179781 - RNA, 22 nt, Homo sapiens
uaaaauccccaugccuguggcu

SEQ ID NO: 1179782 - RNA, 16 nt, Homo sapiens
uaaaaugcaaucaauu

SEQ ID NO: 1179783 - RNA, 15 nt, Homo sapiens
uaaaauguauaccaa

SEQ ID NO: 1179784 - RNA, 23 nt, Homo sapiens
uaaaauguggucugccaaucugu

SEQ ID NO: 1179785 - RNA, 19 nt, Homo sapiens
uaaaauguuauugccuaau

SEQ ID NO: 1179786 - RNA, 15 nt, Homo sapiens
uaaaauuacuuugaa

SEQ ID NO: 1179787 - RNA, 22 nt, Homo sapiens
uaaaauuguauagaccuaaaau

SEQ ID NO: 1179788 - RNA, 14 nt, Homo sapiens
uaaaauuucuacua

SEQ ID NO: 1179789 - RNA, 16 nt, Homo sapiens
uaaaauuuugagauua

SEQ ID NO: 1179790 - RNA, 18 nt, Homo sapiens
uaaacaauaucagacuuu

SEQ ID NO: 1179791 - RNA, 14 nt, Homo sapiens
uaaacacagggaag

SEQ ID NO: 1179792 - RNA, 23 nt, Homo sapiens
uaaacacauuuugguucuucuca

SEQ ID NO: 1179793 - RNA, 21 nt, Homo sapiens
uaaacaccauagggacccauu

SEQ ID NO: 1179794 - RNA, 14 nt, Homo sapiens
uaaacacgccugca

SEQ ID NO: 1179795 - RNA, 11 nt, Homo sapiens
uaaacacuuuc

SEQ ID NO: 1179796 - RNA, 18 nt, Homo sapiens
uaaacagccucuuuuuga

SEQ ID NO: 1179797 - RNA, 17 nt, Homo sapiens
uaaacaguggaauauaa

SEQ ID NO: 1179798 - RNA, 17 nt, Homo sapiens
uaaacauugaaguaaug

SEQ ID NO: 1179799 - RNA, 11 nt, Homo sapiens
uaaacauuuau

SEQ ID NO: 1179800 - RNA, 15 nt, Homo sapiens
uaaaccaaaaacuga

SEQ ID NO: 1179801 - RNA, 16 nt, Homo sapiens
uaaaccagaggacaaa

SEQ ID NO: 1179802 - RNA, 19 nt, Homo sapiens
uaaaccuagaguuuuauca

SEQ ID NO: 1179803 - RNA, 20 nt, Homo sapiens
uaaaccuagaguuuuaucaa

SEQ ID NO: 1179804 - RNA, 22 nt, Homo sapiens
uaaaccucaguuauuacaugua

SEQ ID NO: 1179805 - RNA, 14 nt, Homo sapiens
uaaacuacauuaua

SEQ ID NO: 1179806 - RNA, 14 nt, Homo sapiens
uaaacuacauuuua

SEQ ID NO: 1179807 - RNA, 17 nt, Homo sapiens
uaaacuagaugaccuca

SEQ ID NO: 1179808 - RNA, 18 nt, Homo sapiens
uaaacucgagauacagcu

SEQ ID NO: 1179809 - RNA, 21 nt, Homo sapiens
uaaacucgagauacagcuuuu

SEQ ID NO: 1179810 - RNA, 22 nt, Homo sapiens
guguuccugagacagaauuaau

SEQ ID NO: 1179811 - RNA, 14 nt, Homo sapiens
guguucugcugaga

SEQ ID NO: 1179812 - RNA, 14 nt, Homo sapiens
guguugacugcugc

SEQ ID NO: 1179813 - RNA, 22 nt, Homo sapiens
ggcucgcccauacccgugacag

SEQ ID NO: 1179814 - RNA, 17 nt, Homo sapiens
ggcucucaccacuucag

SEQ ID NO: 1179815 - RNA, 17 nt, Homo sapiens
ggcucugauucuucauu

SEQ ID NO: 1179816 - RNA, 21 nt, Homo sapiens
ggcucuucugacauuuaucag

SEQ ID NO: 1179817 - RNA, 19 nt, Homo sapiens
ggcugacucuaggugcccu

SEQ ID NO: 1179818 - RNA, 20 nt, Homo sapiens
ggcugaggcaggcagaucac

SEQ ID NO: 1179819 - RNA, 16 nt, Homo sapiens
ggcugcagaugaucag

SEQ ID NO: 1179820 - RNA, 20 nt, Homo sapiens
ggcugcagaugaucagggau

SEQ ID NO: 1179821 - RNA, 20 nt, Homo sapiens
ggcugccgagugcugugcac

SEQ ID NO: 1179822 - RNA, 19 nt, Homo sapiens
ggcugccucauuuagagag

SEQ ID NO: 1179823 - RNA, 15 nt, Homo sapiens
ggcugcugaccucca

SEQ ID NO: 1179824 - RNA, 20 nt, Homo sapiens
ggcugcuuggagcagccuaa

SEQ ID NO: 1179825 - RNA, 18 nt, Homo sapiens
ggcuggaagaaccacugu

SEQ ID NO: 1179826 - RNA, 16 nt, Homo sapiens
ggcuggagugcaaugg

SEQ ID NO: 1179827 - RNA, 23 nt, Homo sapiens
ggcuggagugcaguggugcaauc

SEQ ID NO: 1179828 - RNA, 21 nt, Homo sapiens
ggcugggaugcugguggcucu

SEQ ID NO: 1179829 - RNA, 21 nt, Homo sapiens
ggcugggccucuucugccucu

SEQ ID NO: 1179830 - RNA, 18 nt, Homo sapiens
ggcuguggccuaaccugc

SEQ ID NO: 1179831 - RNA, 19 nt, Homo sapiens
ggcuguuucuugucuguua

SEQ ID NO: 1179832 - RNA, 18 nt, Homo sapiens
ggcuuaauaaaaaugaca

SEQ ID NO: 1179833 - RNA, 17 nt, Homo sapiens
ggcuuaauaccugggug

SEQ ID NO: 1179834 - RNA, 21 nt, Homo sapiens
ggcuucagguuagugacauuu

SEQ ID NO: 1179835 - RNA, 14 nt, Homo sapiens
ggcuucgcagcucu

SEQ ID NO: 1179836 - RNA, 14 nt, Homo sapiens
ggcuucuaguuugc

SEQ ID NO: 1179837 - RNA, 23 nt, Homo sapiens
ggcuugacggcuucucucuuuuu

SEQ ID NO: 1179838 - RNA, 14 nt, Homo sapiens
ggcuuuccagcuua

SEQ ID NO: 1179839 - RNA, 17 nt, Homo sapiens
ggcuuucccacuuccca

SEQ ID NO: 1179840 - RNA, 14 nt, Homo sapiens
ggcuuugcaaaaua

SEQ ID NO: 1179841 - RNA, 15 nt, Homo sapiens
ggcuuugggguccua

SEQ ID NO: 1179842 - RNA, 21 nt, Homo sapiens
ggcuuugugauaacuacuccc

SEQ ID NO: 1179843 - RNA, 20 nt, Homo sapiens
gggaaaaaaacaguugcaua

SEQ ID NO: 1179844 - RNA, 13 nt, Homo sapiens
gggaaaaccagac

SEQ ID NO: 1179845 - RNA, 19 nt, Homo sapiens
gggaaacaaauaauuugaa

SEQ ID NO: 1179846 - RNA, 18 nt, Homo sapiens
ggccaagaaaauugccuu

SEQ ID NO: 1179847 - RNA, 20 nt, Homo sapiens
ggccaaggagggcagaucac

SEQ ID NO: 1179848 - RNA, 15 nt, Homo sapiens
ggccaaugcauccaa

SEQ ID NO: 1179849 - RNA, 17 nt, Homo sapiens
ggccaaugcuacuuuca

SEQ ID NO: 1179850 - RNA, 14 nt, Homo sapiens
ggccacaacuacac

SEQ ID NO: 1179851 - RNA, 13 nt, Homo sapiens
ggccacagcgugc

SEQ ID NO: 1179852 - RNA, 18 nt, Homo sapiens
ggccaccagccacuuuag

SEQ ID NO: 1179853 - RNA, 23 nt, Homo sapiens
ggccacccaaggaugucugccac

SEQ ID NO: 1179854 - RNA, 19 nt, Homo sapiens
ggccacggugccuccagau

SEQ ID NO: 1179855 - RNA, 20 nt, Homo sapiens
ggccaguagcuaaagugcaa

SEQ ID NO: 1179856 - RNA, 23 nt, Homo sapiens
ggccaguaucuauauauguguau

SEQ ID NO: 1179857 - RNA, 18 nt, Homo sapiens
ggccagugacgugguuca

SEQ ID NO: 1179858 - RNA, 20 nt, Homo sapiens
ggccaguuccuucucuuuaa

SEQ ID NO: 1179859 - RNA, 17 nt, Homo sapiens
ggccaguuuucuguuca

SEQ ID NO: 1179860 - RNA, 22 nt, Homo sapiens
ggccauacuucuguuuccaucu

SEQ ID NO: 1179861 - RNA, 23 nt, Homo sapiens
ggccauacuucuguuuccaucug

SEQ ID NO: 1179862 - RNA, 21 nt, Homo sapiens
ggccaucuggggcuccuucuc

SEQ ID NO: 1179863 - RNA, 13 nt, Homo sapiens
ggccaugccucag

SEQ ID NO: 1179864 - RNA, 15 nt, Homo sapiens
ggccauguggccugc

SEQ ID NO: 1179865 - RNA, 18 nt, Homo sapiens
ggcccaaagaaagagcua

SEQ ID NO: 1179866 - RNA, 16 nt, Homo sapiens
ggcccaaggccagggg

SEQ ID NO: 1179867 - RNA, 11 nt, Homo sapiens
ggcccaagggc

SEQ ID NO: 1179868 - RNA, 19 nt, Homo sapiens
ggcccaaguuucuaaggga

SEQ ID NO: 1179869 - RNA, 22 nt, Homo sapiens
ggcccaggccuugcugacucuc

SEQ ID NO: 1179870 - RNA, 17 nt, Homo sapiens
ggcccagggacauugca

SEQ ID NO: 1179871 - RNA, 13 nt, Homo sapiens
ggcccaggugagu

SEQ ID NO: 1179872 - RNA, 13 nt, Homo sapiens
ggcccagugcaug

SEQ ID NO: 1179873 - RNA, 22 nt, Homo sapiens
ggcccauggaggagacaggaag

SEQ ID NO: 1179874 - RNA, 13 nt, Homo sapiens
ggccccacugggg

SEQ ID NO: 1179875 - RNA, 16 nt, Homo sapiens
ggccccaucauagccu

SEQ ID NO: 1179876 - RNA, 17 nt, Homo sapiens
ggccccauuuacccaac

SEQ ID NO: 1179877 - RNA, 21 nt, Homo sapiens
ggccccgugaggcaaugggag

SEQ ID NO: 1179878 - RNA, 17 nt, Homo sapiens
ggccccucccacaccca

SEQ ID NO: 1179879 - RNA, 17 nt, Homo sapiens
ggccccuggcacucuug

SEQ ID NO: 1179880 - RNA, 15 nt, Homo sapiens
ggcccggccagccau

SEQ ID NO: 1179881 - RNA, 23 nt, Homo sapiens
ggcccguccggcaguucugggug

SEQ ID NO: 1179882 - RNA, 21 nt, Homo sapiens
ggcccguggccuggcaucugu

SEQ ID NO: 1179883 - RNA, 17 nt, Homo sapiens
ggcccuaugucucagga

SEQ ID NO: 1179884 - RNA, 17 nt, Homo sapiens
ggcccucugccugcacu

SEQ ID NO: 1179885 - RNA, 16 nt, Homo sapiens
ggcccugcugaagcug

SEQ ID NO: 1179886 - RNA, 14 nt, Homo sapiens
ggcccugucuggag

SEQ ID NO: 1179887 - RNA, 23 nt, Homo sapiens
ggcccuucccacaggacauuucu

SEQ ID NO: 1179888 - RNA, 18 nt, Homo sapiens
ggccgccgcugacccugg

SEQ ID NO: 1179889 - RNA, 16 nt, Homo sapiens
ggccggcccugugugc

SEQ ID NO: 1179890 - RNA, 17 nt, Homo sapiens
ggccucagggccaggaa

SEQ ID NO: 1179891 - RNA, 23 nt, Homo sapiens
ggccucaguuucauuaacuggug

SEQ ID NO: 1179892 - RNA, 20 nt, Homo sapiens
ggccucccaaagugcuggga

SEQ ID NO: 1179893 - RNA, 22 nt, Homo sapiens
ggccucccaaagugcugggauu

SEQ ID NO: 1179894 - RNA, 20 nt, Homo sapiens
ggccucccagagugcuggga

SEQ ID NO: 1179895 - RNA, 12 nt, Homo sapiens
ggccucccucaa

SEQ ID NO: 1179896 - RNA, 20 nt, Homo sapiens
ggccuccucucucaguuuuu

SEQ ID NO: 1179897 - RNA, 18 nt, Homo sapiens
ggccucgaaaaccaucac

SEQ ID NO: 1179898 - RNA, 23 nt, Homo sapiens
ggccucgaaaaccaucacaugac

SEQ ID NO: 1179899 - RNA, 20 nt, Homo sapiens
ggccucucaccucugugccu

SEQ ID NO: 1179900 - RNA, 15 nt, Homo sapiens
ggccucucucaggag

SEQ ID NO: 1179901 - RNA, 15 nt, Homo sapiens
ggccugaccaaacag

SEQ ID NO: 1179902 - RNA, 22 nt, Homo sapiens
ggccugaggugugugccacuca

SEQ ID NO: 1179903 - RNA, 17 nt, Homo sapiens
ggccugcaccgaccccg

SEQ ID NO: 1179904 - RNA, 22 nt, Homo sapiens
ggccugcgacccugggggcaca

SEQ ID NO: 1179905 - RNA, 14 nt, Homo sapiens
ggccugcuccagac

SEQ ID NO: 1179906 - RNA, 11 nt, Homo sapiens
ggccuggucug

SEQ ID NO: 1179907 - RNA, 19 nt, Homo sapiens
ggccuguacccaguagaug

SEQ ID NO: 1179908 - RNA, 21 nt, Homo sapiens
ggccuuaucuccaagaccaga

SEQ ID NO: 1179909 - RNA, 11 nt, Homo sapiens
ggccuucucac

SEQ ID NO: 1179910 - RNA, 15 nt, Homo sapiens
ggccuucucagcucu

SEQ ID NO: 1179911 - RNA, 17 nt, Homo sapiens
ggccuugaagaggccaa

SEQ ID NO: 1179912 - RNA, 15 nt, Homo sapiens
ggccuugugugucag

SEQ ID NO: 1179913 - RNA, 22 nt, Homo sapiens
ggccuuugcuacacugcugaca

SEQ ID NO: 1179914 - RNA, 20 nt, Homo sapiens
ggcgacaguuuuccuucuca

SEQ ID NO: 1179915 - RNA, 21 nt, Homo sapiens
ggcgacuccuagauccaggga

SEQ ID NO: 1179916 - RNA, 20 nt, Homo sapiens
ggcgaggccucucucaggag

SEQ ID NO: 1179917 - RNA, 18 nt, Homo sapiens
ggcgccaucuauggugug

SEQ ID NO: 1179918 - RNA, 16 nt, Homo sapiens
ggcgcgguggcucaca

SEQ ID NO: 1179919 - RNA, 22 nt, Homo sapiens
ggcgcucucccuaccuugccuc

SEQ ID NO: 1179920 - RNA, 16 nt, Homo sapiens
ggcggaucuuuggaca

SEQ ID NO: 1179921 - RNA, 23 nt, Homo sapiens
ggcggaucuuuggacagaagcag

SEQ ID NO: 1179922 - RNA, 15 nt, Homo sapiens
ggcggggacugcugg

SEQ ID NO: 1179923 - RNA, 15 nt, Homo sapiens
ggcgguggagccgag

SEQ ID NO: 1179924 - RNA, 17 nt, Homo sapiens
ggcuaauucagugucac

SEQ ID NO: 1179925 - RNA, 17 nt, Homo sapiens
ggcuaccccacccaagu

SEQ ID NO: 1179926 - RNA, 23 nt, Homo sapiens
ggcuacuaguuuaagcaaauaaa

SEQ ID NO: 1179927 - RNA, 18 nt, Homo sapiens
ggcuauauauacuggaag

SEQ ID NO: 1179928 - RNA, 18 nt, Homo sapiens
ggcuaugccugccucaaa

SEQ ID NO: 1179929 - RNA, 19 nt, Homo sapiens
ggcucaaacaacauuccac

SEQ ID NO: 1179930 - RNA, 20 nt, Homo sapiens
ggcucaagggacauguuuuc

SEQ ID NO: 1179931 - RNA, 17 nt, Homo sapiens
ggcucacaccuguaauc

SEQ ID NO: 1179932 - RNA, 13 nt, Homo sapiens
ggcucagggcagu

SEQ ID NO: 1179933 - RNA, 20 nt, Homo sapiens
ggcucagugcaaccucugcu

SEQ ID NO: 1179934 - RNA, 11 nt, Homo sapiens
ggcucaucucu

SEQ ID NO: 1179935 - RNA, 18 nt, Homo sapiens
ggcuccagaugcagggca

SEQ ID NO: 1179936 - RNA, 20 nt, Homo sapiens
ggcuccagaugcagggcagu

SEQ ID NO: 1179937 - RNA, 18 nt, Homo sapiens
ggcucccacuucuuggga

SEQ ID NO: 1179938 - RNA, 19 nt, Homo sapiens
ggcuccuuaucagugccau

SEQ ID NO: 1179939 - RNA, 20 nt, Homo sapiens
ggcucgccaggccaaaucac

SEQ ID NO: 1179940 - RNA, 14 nt, Homo sapiens
ucugaggacauucc

SEQ ID NO: 1179941 - RNA, 17 nt, Homo sapiens
ucugagggagcugagua

SEQ ID NO: 1179942 - RNA, 11 nt, Homo sapiens
ucugaguauaa

SEQ ID NO: 1179943 - RNA, 18 nt, Homo sapiens
ucugauauacaaagggau

SEQ ID NO: 1179944 - RNA, 20 nt, Homo sapiens
ucugauggaagaaagcuaau

SEQ ID NO: 1179945 - RNA, 19 nt, Homo sapiens
ucugauguuuggguauugu

SEQ ID NO: 1179946 - RNA, 18 nt, Homo sapiens
ucugcaagggcccagagu

SEQ ID NO: 1179947 - RNA, 23 nt, Homo sapiens
ucugcaauaugaauucaagaaag

SEQ ID NO: 1179948 - RNA, 19 nt, Homo sapiens
ucugcaauggaaacuuuua

SEQ ID NO: 1179949 - RNA, 24 nt, Homo sapiens
ucugcaccuuguccccucauagga

SEQ ID NO: 1179950 - RNA, 11 nt, Homo sapiens
ucugcacggga

SEQ ID NO: 1179951 - RNA, 15 nt, Homo sapiens
ucugcacuccagaua

SEQ ID NO: 1179952 - RNA, 18 nt, Homo sapiens
ucugcagucgcuugccaa

SEQ ID NO: 1179953 - RNA, 16 nt, Homo sapiens
ucugcaucccccaaag

SEQ ID NO: 1179954 - RNA, 22 nt, Homo sapiens
ucugcaugucuacucagcauuu

SEQ ID NO: 1179955 - RNA, 15 nt, Homo sapiens
ucugcccaauccauc

SEQ ID NO: 1179956 - RNA, 18 nt, Homo sapiens
ucugcccggcuacaucag

SEQ ID NO: 1179957 - RNA, 21 nt, Homo sapiens
ucugcccuaaccugacagagg

SEQ ID NO: 1179958 - RNA, 13 nt, Homo sapiens
ucugcccuugcca

SEQ ID NO: 1179959 - RNA, 16 nt, Homo sapiens
ucugccgcuaccuccc

SEQ ID NO: 1179960 - RNA, 19 nt, Homo sapiens
ucugccuauaaauuuacuc

SEQ ID NO: 1179961 - RNA, 22 nt, Homo sapiens
ucugccuggagugcugugcugu

SEQ ID NO: 1179962 - RNA, 20 nt, Homo sapiens
ucugccuuuagcuuugacag

SEQ ID NO: 1179963 - RNA, 15 nt, Homo sapiens
ucugccuuuucacug

SEQ ID NO: 1179964 - RNA, 19 nt, Homo sapiens
ucugcgccgagccucagaa

SEQ ID NO: 1179965 - RNA, 19 nt, Homo sapiens
ucugcguaggaaaaugaau

SEQ ID NO: 1179966 - RNA, 13 nt, Homo sapiens
ucugcgugacaau

SEQ ID NO: 1179967 - RNA, 19 nt, Homo sapiens
ucugcucaaaacuuucaaa

SEQ ID NO: 1179968 - RNA, 12 nt, Homo sapiens
ucugcugucuaa

SEQ ID NO: 1179969 - RNA, 15 nt, Homo sapiens
ucuggaaacugugaa

SEQ ID NO: 1179970 - RNA, 15 nt, Homo sapiens
ucuggaccuagggug

SEQ ID NO: 1179971 - RNA, 21 nt, Homo sapiens
ucuggagcggaauuuaccuga

SEQ ID NO: 1179972 - RNA, 18 nt, Homo sapiens
ucuggauagggaugaaga

SEQ ID NO: 1179973 - RNA, 15 nt, Homo sapiens
ucuggaucuugugac

SEQ ID NO: 1179974 - RNA, 13 nt, Homo sapiens
ucuggauuugccu

SEQ ID NO: 1179975 - RNA, 22 nt, Homo sapiens
ucuggauuugccugcagaguuu

SEQ ID NO: 1179976 - RNA, 20 nt, Homo sapiens
ucuggcagccucccauccag

SEQ ID NO: 1179977 - RNA, 15 nt, Homo sapiens
ucuggcgacagggga

SEQ ID NO: 1179978 - RNA, 13 nt, Homo sapiens
ucuggcucuuguc

SEQ ID NO: 1179979 - RNA, 16 nt, Homo sapiens
ucugggaagauuucua

SEQ ID NO: 1179980 - RNA, 16 nt, Homo sapiens
ucuggggcacuguuga

SEQ ID NO: 1179981 - RNA, 14 nt, Homo sapiens
ucugggucaaucca

SEQ ID NO: 1179982 - RNA, 18 nt, Homo sapiens
ucugggucaucucucaca

SEQ ID NO: 1179983 - RNA, 18 nt, Homo sapiens
ucugguaucugcauguaa

SEQ ID NO: 1179984 - RNA, 19 nt, Homo sapiens
ucuggugccagauccucuu

SEQ ID NO: 1179985 - RNA, 17 nt, Homo sapiens
ucugguguuuauaagca

SEQ ID NO: 1179986 - RNA, 21 nt, Homo sapiens
ucugguuguccucacugcuga

SEQ ID NO: 1179987 - RNA, 13 nt, Homo sapiens
uugaucagacagc

SEQ ID NO: 1179988 - RNA, 21 nt, Homo sapiens
uugaucaggcacaguggcuca

SEQ ID NO: 1179989 - RNA, 21 nt, Homo sapiens
uugaucuucagggaacugcau

SEQ ID NO: 1179990 - RNA, 12 nt, Homo sapiens
uugauggugaua

SEQ ID NO: 1179991 - RNA, 19 nt, Homo sapiens
uugauguaaugaaauucca

SEQ ID NO: 1179992 - RNA, 21 nt, Homo sapiens
uugauguaaugaaauuccaga

SEQ ID NO: 1179993 - RNA, 15 nt, Homo sapiens
uugauucauguucau

SEQ ID NO: 1179994 - RNA, 20 nt, Homo sapiens
uugauucugauaaugcucac

SEQ ID NO: 1179995 - RNA, 17 nt, Homo sapiens
uugauuucuuuucuucc

SEQ ID NO: 1179996 - RNA, 13 nt, Homo sapiens
uugauuugggaga

SEQ ID NO: 1179997 - RNA, 14 nt, Homo sapiens
uugauuugugcugu

SEQ ID NO: 1179998 - RNA, 14 nt, Homo sapiens
uugauuuuuugccc

SEQ ID NO: 1179999 - RNA, 15 nt, Homo sapiens
uugcaaaaacuacaa

SEQ ID NO: 1180000 - RNA, 21 nt, Homo sapiens
uugcaaaguagccucuuucau

SEQ ID NO: 1180001 - RNA, 12 nt, Homo sapiens
uugcaaaguuug

SEQ ID NO: 1180002 - RNA, 20 nt, Homo sapiens
uugcaaaucacucugcaaug

SEQ ID NO: 1180003 - RNA, 15 nt, Homo sapiens
uugcaauaaugcagu

SEQ ID NO: 1180004 - RNA, 16 nt, Homo sapiens
uugcaaucuucuacuu

SEQ ID NO: 1180005 - RNA, 14 nt, Homo sapiens
uugcacagcagcaa

SEQ ID NO: 1180006 - RNA, 19 nt, Homo sapiens
uugcacaguuaccugcaca

SEQ ID NO: 1180007 - RNA, 17 nt, Homo sapiens
uugcacugacaguggga

SEQ ID NO: 1180008 - RNA, 20 nt, Homo sapiens
uugcagaaauacaguaugau

SEQ ID NO: 1180009 - RNA, 15 nt, Homo sapiens
uugcagacaguguuu

SEQ ID NO: 1180010 - RNA, 17 nt, Homo sapiens
uugcagaguggccuaga

SEQ ID NO: 1180011 - RNA, 20 nt, Homo sapiens
uugcaguucaccugcacuua

SEQ ID NO: 1180012 - RNA, 23 nt, Homo sapiens
uugcauaacagcaggguaccuga

SEQ ID NO: 1180013 - RNA, 17 nt, Homo sapiens
uugcauagcagcugcua

SEQ ID NO: 1180014 - RNA, 19 nt, Homo sapiens
uugcaugaaagcacaaggu

SEQ ID NO: 1180015 - RNA, 23 nt, Homo sapiens
uugcauugaauuuagucauuauu

SEQ ID NO: 1180016 - RNA, 18 nt, Homo sapiens
uugccaagaaaaugaagg

SEQ ID NO: 1180017 - RNA, 18 nt, Homo sapiens
uugccaagcagugcacau

SEQ ID NO: 1180018 - RNA, 23 nt, Homo sapiens
uugccaagcagugcacauuucau

SEQ ID NO: 1180019 - RNA, 15 nt, Homo sapiens
uugccaaguucucca

SEQ ID NO: 1180020 - RNA, 16 nt, Homo sapiens
uugccacuacccccuc

SEQ ID NO: 1180021 - RNA, 16 nt, Homo sapiens
uugccagccauucuuu

SEQ ID NO: 1180022 - RNA, 19 nt, Homo sapiens
uugccauggugauggugua

SEQ ID NO: 1180023 - RNA, 21 nt, Homo sapiens
uugccauuauagcgccuguau

SEQ ID NO: 1180024 - RNA, 17 nt, Homo sapiens
uugcccagagaugccuc

SEQ ID NO: 1180025 - RNA, 20 nt, Homo sapiens
uugcccaggcuggagugcaa

SEQ ID NO: 1180026 - RNA, 16 nt, Homo sapiens
uugcccagucuuucau

SEQ ID NO: 1180027 - RNA, 13 nt, Homo sapiens
uugcccauauaaa

SEQ ID NO: 1180028 - RNA, 14 nt, Homo sapiens
uugccccacucugc

SEQ ID NO: 1180029 - RNA, 13 nt, Homo sapiens
uucaugcagguga

SEQ ID NO: 1180030 - RNA, 13 nt, Homo sapiens
uucaugucucacg

SEQ ID NO: 1180031 - RNA, 19 nt, Homo sapiens
uucaugugcagauugcagu

SEQ ID NO: 1180032 - RNA, 17 nt, Homo sapiens
uucaugugucaacuuca

SEQ ID NO: 1180033 - RNA, 16 nt, Homo sapiens
uucauguguugcuccc

SEQ ID NO: 1180034 - RNA, 16 nt, Homo sapiens
uucauguucaugugau

SEQ ID NO: 1180035 - RNA, 18 nt, Homo sapiens
uucauguucaugugauua

SEQ ID NO: 1180036 - RNA, 23 nt, Homo sapiens
uucauuccuaaagaaaaauaucu

SEQ ID NO: 1180037 - RNA, 13 nt, Homo sapiens
uucauucugcaag

SEQ ID NO: 1180038 - RNA, 16 nt, Homo sapiens
uucauucugcaaguau

SEQ ID NO: 1180039 - RNA, 12 nt, Homo sapiens
uucauugccucu

SEQ ID NO: 1180040 - RNA, 17 nt, Homo sapiens
uucauuguuuugcaaaa

SEQ ID NO: 1180041 - RNA, 14 nt, Homo sapiens
uucauuuaccucua

SEQ ID NO: 1180042 - RNA, 19 nt, Homo sapiens
uucauuuuuaaucaugaaa

SEQ ID NO: 1180043 - RNA, 19 nt, Homo sapiens
uuccaaaccaggacacuac

SEQ ID NO: 1180044 - RNA, 19 nt, Homo sapiens
uuccaaagacucccuccau

SEQ ID NO: 1180045 - RNA, 13 nt, Homo sapiens
uuccaaagccaau

SEQ ID NO: 1180046 - RNA, 12 nt, Homo sapiens
uuccaagacagu

SEQ ID NO: 1180047 - RNA, 13 nt, Homo sapiens
uuccacacuauuc

SEQ ID NO: 1180048 - RNA, 10 nt, Homo sapiens
uuccacagau

SEQ ID NO: 1180049 - RNA, 12 nt, Homo sapiens
uuccaccucacc

SEQ ID NO: 1180050 - RNA, 16 nt, Homo sapiens
uuccaccuucuacgca

SEQ ID NO: 1180051 - RNA, 18 nt, Homo sapiens
uuccacucaaauguccug

SEQ ID NO: 1180052 - RNA, 14 nt, Homo sapiens
uuccagacaguggg

SEQ ID NO: 1180053 - RNA, 14 nt, Homo sapiens
uuccagcaccacac

SEQ ID NO: 1180054 - RNA, 18 nt, Homo sapiens
uuccagcauguuucuccc

SEQ ID NO: 1180055 - RNA, 16 nt, Homo sapiens
uuccaggaguacuuac

SEQ ID NO: 1180056 - RNA, 20 nt, Homo sapiens
uuccaucacaucacauuuaa

SEQ ID NO: 1180057 - RNA, 16 nt, Homo sapiens
uuccaucagcacaaag

SEQ ID NO: 1180058 - RNA, 20 nt, Homo sapiens
uuccaucccuagccauucug

SEQ ID NO: 1180059 - RNA, 16 nt, Homo sapiens
uuccaucugccugcca

SEQ ID NO: 1180060 - RNA, 23 nt, Homo sapiens
ugucccugccuucacugugcucc

SEQ ID NO: 1180061 - RNA, 13 nt, Homo sapiens
uguccgugauaau

SEQ ID NO: 1180062 - RNA, 17 nt, Homo sapiens
uguccucacugcugauu

SEQ ID NO: 1180063 - RNA, 18 nt, Homo sapiens
uguccucagccuugccag

SEQ ID NO: 1180064 - RNA, 16 nt, Homo sapiens
uguccuccacacaagg

SEQ ID NO: 1180065 - RNA, 22 nt, Homo sapiens
uguccuccugauccugacacau

SEQ ID NO: 1180066 - RNA, 15 nt, Homo sapiens
uguccucuucugcau

SEQ ID NO: 1180067 - RNA, 17 nt, Homo sapiens
uguccucuuugugauaa

SEQ ID NO: 1180068 - RNA, 18 nt, Homo sapiens
uguccucuuugugauaau

SEQ ID NO: 1180069 - RNA, 21 nt, Homo sapiens
uguccugaugcuuuugucuaa

SEQ ID NO: 1180070 - RNA, 14 nt, Homo sapiens
uguccugcaauuua

SEQ ID NO: 1180071 - RNA, 19 nt, Homo sapiens
uguccuuuccaucugucca

SEQ ID NO: 1180072 - RNA, 21 nt, Homo sapiens
ugucggcggcuugauaaacag

SEQ ID NO: 1180073 - RNA, 15 nt, Homo sapiens
ugucuaagauucuag

SEQ ID NO: 1180074 - RNA, 16 nt, Homo sapiens
ugucuaguagaacaau

SEQ ID NO: 1180075 - RNA, 22 nt, Homo sapiens
ugucuauuauuaugaagaauug

SEQ ID NO: 1180076 - RNA, 16 nt, Homo sapiens
ugucucacugaaacau

SEQ ID NO: 1180077 - RNA, 12 nt, Homo sapiens
ugucucauuaua

SEQ ID NO: 1180078 - RNA, 18 nt, Homo sapiens
ugucucccagcucagggc

SEQ ID NO: 1180079 - RNA, 11 nt, Homo sapiens
ugucucgccag

SEQ ID NO: 1180080 - RNA, 13 nt, Homo sapiens
ugucugcaauggu

SEQ ID NO: 1180081 - RNA, 17 nt, Homo sapiens
ugucuggagcggcugcu

SEQ ID NO: 1180082 - RNA, 15 nt, Homo sapiens
ugucugucaccacau

SEQ ID NO: 1180083 - RNA, 14 nt, Homo sapiens
ugucugugugauuu

SEQ ID NO: 1180084 - RNA, 22 nt, Homo sapiens
ugucuuaaacuagguguucuaa

SEQ ID NO: 1180085 - RNA, 20 nt, Homo sapiens
ugucuucaaagcaaagcucu

SEQ ID NO: 1180086 - RNA, 16 nt, Homo sapiens
ugucuucccucucuau

SEQ ID NO: 1180087 - RNA, 19 nt, Homo sapiens
ugucuuggacacuguacaa

SEQ ID NO: 1180088 - RNA, 22 nt, Homo sapiens
ugucuuuaaaaguauccagaga

SEQ ID NO: 1180089 - RNA, 17 nt, Homo sapiens
ugucuuuaauuucagga

SEQ ID NO: 1180090 - RNA, 21 nt, Homo sapiens
ugucuuucugagcacacuuua

SEQ ID NO: 1180091 - RNA, 18 nt, Homo sapiens
ugucuuuuaauuuagcuu

SEQ ID NO: 1180092 - RNA, 19 nt, Homo sapiens
ugugaaauaccaaccugaa

SEQ ID NO: 1180093 - RNA, 13 nt, Homo sapiens
ugugaacacugga

SEQ ID NO: 1180094 - RNA, 20 nt, Homo sapiens
ugugaagcccuguugugcca

SEQ ID NO: 1180095 - RNA, 19 nt, Homo sapiens
ugugaaguuagguucuuaa

SEQ ID NO: 1180096 - RNA, 15 nt, Homo sapiens
ugugaauauggacag

SEQ ID NO: 1180097 - RNA, 13 nt, Homo sapiens
ugugacacauaug

SEQ ID NO: 1180098 - RNA, 15 nt, Homo sapiens
ugugacacauaugca

SEQ ID NO: 1180099 - RNA, 22 nt, Homo sapiens
ugugacauuauaugcacuagca

SEQ ID NO: 1180100 - RNA, 11 nt, Homo sapiens
ugugacauuua

SEQ ID NO: 1180101 - RNA, 14 nt, Homo sapiens
ugugacccuaggcc

SEQ ID NO: 1180102 - RNA, 17 nt, Homo sapiens
ugugacuaaaaaugcau

SEQ ID NO: 1180103 - RNA, 12 nt, Homo sapiens
ugugacuauaaa

SEQ ID NO: 1180104 - RNA, 17 nt, Homo sapiens
ugugagaccaggggacc

SEQ ID NO: 1180105 - RNA, 18 nt, Homo sapiens
ugugagaccaggggacca

SEQ ID NO: 1180106 - RNA, 22 nt, Homo sapiens
ugugagcagucccucuggaaag

SEQ ID NO: 1180107 - RNA, 17 nt, Homo sapiens
ugugagcuuacauugaa

SEQ ID NO: 1180108 - RNA, 19 nt, Homo sapiens
ugugaggagguagauuugg

SEQ ID NO: 1180109 - RNA, 16 nt, Homo sapiens
ugugauguuuguccug

SEQ ID NO: 1180110 - RNA, 21 nt, Homo sapiens
ugugauucaaacuucugugua

SEQ ID NO: 1180111 - RNA, 18 nt, Homo sapiens
ugugcaauugauuucuuu

SEQ ID NO: 1180112 - RNA, 10 nt, Homo sapiens
ugugcacauc

SEQ ID NO: 1180113 - RNA, 14 nt, Homo sapiens
ugugcagccauagu

SEQ ID NO: 1180114 - RNA, 22 nt, Homo sapiens
ugugcaguguuuuuccugugua

SEQ ID NO: 1180115 - RNA, 21 nt, Homo sapiens
ugugccccuugacaacuggca

SEQ ID NO: 1180116 - RNA, 15 nt, Homo sapiens
ugugccgacacuguu

SEQ ID NO: 1180117 - RNA, 12 nt, Homo sapiens
ugugccugagaa

SEQ ID NO: 1180118 - RNA, 23 nt, Homo sapiens
ugugccugggguguuaguggcac

SEQ ID NO: 1180119 - RNA, 17 nt, Homo sapiens
ugugccuuggucucucc

SEQ ID NO: 1180120 - RNA, 17 nt, Homo sapiens
ugugcggagcagccuuu

SEQ ID NO: 1180121 - RNA, 17 nt, Homo sapiens
ugugcuaagcuuuacag

SEQ ID NO: 1180122 - RNA, 21 nt, Homo sapiens
ugugcuaucaugauggaauuu

SEQ ID NO: 1180123 - RNA, 19 nt, Homo sapiens
ugugcuauuuuacuuguaa

SEQ ID NO: 1180124 - RNA, 18 nt, Homo sapiens
ugugcucagagaccccuc

SEQ ID NO: 1180125 - RNA, 15 nt, Homo sapiens
ugugcucuacuguua

SEQ ID NO: 1180126 - RNA, 18 nt, Homo sapiens
ugugcucuacuguuacua

SEQ ID NO: 1180127 - RNA, 18 nt, Homo sapiens
ugugcucuccaagcccag

SEQ ID NO: 1180128 - RNA, 18 nt, Homo sapiens
ugugcugaucgccuuauu

SEQ ID NO: 1180129 - RNA, 22 nt, Homo sapiens
ugugcuucaaggacauugguga

SEQ ID NO: 1180130 - RNA, 14 nt, Homo sapiens
uguggaaaagccaa

SEQ ID NO: 1180131 - RNA, 23 nt, Homo sapiens
uguggaaaagccaagaggcugca

SEQ ID NO: 1180132 - RNA, 14 nt, Homo sapiens
uguggaaaguguaa

SEQ ID NO: 1180133 - RNA, 20 nt, Homo sapiens
uguggaaaguguaaagcauu

SEQ ID NO: 1180134 - RNA, 13 nt, Homo sapiens
uguggaagugugu

SEQ ID NO: 1180135 - RNA, 23 nt, Homo sapiens
uguggaauauaaagauggcugac

SEQ ID NO: 1180136 - RNA, 20 nt, Homo sapiens
uguggaauugacucaaaaau

SEQ ID NO: 1180137 - RNA, 17 nt, Homo sapiens
uguggaccucacaagau

SEQ ID NO: 1180138 - RNA, 20 nt, Homo sapiens
uguggacguggguugcacug

SEQ ID NO: 1180139 - RNA, 19 nt, Homo sapiens
uguggacugagcgaggaaa

SEQ ID NO: 1180140 - RNA, 19 nt, Homo sapiens
uguggacuguggcacuugc

SEQ ID NO: 1180141 - RNA, 17 nt, Homo sapiens
uguggagacuucaucaa

SEQ ID NO: 1180142 - RNA, 17 nt, Homo sapiens
uguggagacuugaaccc

SEQ ID NO: 1180143 - RNA, 20 nt, Homo sapiens
uguggagagagaggcuucaa

SEQ ID NO: 1180144 - RNA, 23 nt, Homo sapiens
uguggagccuuuuaacugugcaa

SEQ ID NO: 1180145 - RNA, 20 nt, Homo sapiens
uguggaugagcccucagaac

SEQ ID NO: 1180146 - RNA, 16 nt, Homo sapiens
uguggauggucauugc

SEQ ID NO: 1180147 - RNA, 14 nt, Homo sapiens
uguggauuggaaua

SEQ ID NO: 1180148 - RNA, 16 nt, Homo sapiens
uguggccacuuuccag

SEQ ID NO: 1180149 - RNA, 19 nt, Homo sapiens
uguggccaugguccccaag

SEQ ID NO: 1180150 - RNA, 17 nt, Homo sapiens
uguggcucacgugagag

SEQ ID NO: 1180151 - RNA, 10 nt, Homo sapiens
ugugggaccg

SEQ ID NO: 1180152 - RNA, 13 nt, Homo sapiens
ugugggauaucac

SEQ ID NO: 1180153 - RNA, 14 nt, Homo sapiens
uguggguaccugua

SEQ ID NO: 1180154 - RNA, 19 nt, Homo sapiens
ugugguuuuuagugcacuu

SEQ ID NO: 1180155 - RNA, 13 nt, Homo sapiens
uguguaacugaau

SEQ ID NO: 1180156 - RNA, 20 nt, Homo sapiens
uguguacugaguauugauaa

SEQ ID NO: 1180157 - RNA, 16 nt, Homo sapiens
uguguagaccuugaug

SEQ ID NO: 1180158 - RNA, 20 nt, Homo sapiens
uguguagcaaauuucgagca

SEQ ID NO: 1180159 - RNA, 19 nt, Homo sapiens
uguguaggggagccacauu

SEQ ID NO: 1180160 - RNA, 18 nt, Homo sapiens
uguguauuuaacagggag

SEQ ID NO: 1180161 - RNA, 21 nt, Homo sapiens
ugugucagagcccaggggaga

SEQ ID NO: 1180162 - RNA, 19 nt, Homo sapiens
ugugucaggaaacauauuu

SEQ ID NO: 1180163 - RNA, 18 nt, Homo sapiens
ugugucaugcaugaagga

SEQ ID NO: 1180164 - RNA, 13 nt, Homo sapiens
ugugucugcaaca

SEQ ID NO: 1180165 - RNA, 13 nt, Homo sapiens
ugugucuguacac

SEQ ID NO: 1180166 - RNA, 23 nt, Homo sapiens
ugugugaagaaagccucagugaa

SEQ ID NO: 1180167 - RNA, 20 nt, Homo sapiens
ugugugacucuuuagcaaaa

SEQ ID NO: 1180168 - RNA, 9 nt, Homo sapiens
ugugugaga

SEQ ID NO: 1180169 - RNA, 18 nt, Homo sapiens
ugugugaggacuucugca

SEQ ID NO: 1180170 - RNA, 14 nt, Homo sapiens
ugugugaucuugau

SEQ ID NO: 1180171 - RNA, 16 nt, Homo sapiens
uguguggcagagccag

SEQ ID NO: 1180172 - RNA, 13 nt, Homo sapiens
ugugugucucuga

SEQ ID NO: 1180173 - RNA, 15 nt, Homo sapiens
ugugugugugcacau

SEQ ID NO: 1180174 - RNA, 21 nt, Homo sapiens
uguguucauccagcuacuuag

SEQ ID NO: 1180175 - RNA, 23 nt, Homo sapiens
uguguuccccauguguguguaca

SEQ ID NO: 1180176 - RNA, 17 nt, Homo sapiens
uguguucuuguuuucag

SEQ ID NO: 1180177 - RNA, 21 nt, Homo sapiens
uguguuuuuuccccauuguau

SEQ ID NO: 1180178 - RNA, 20 nt, Homo sapiens
uguuaaaauaagaacaaaga

SEQ ID NO: 1180179 - RNA, 15 nt, Homo sapiens
uguuaacuguucaaa

SEQ ID NO: 1180180 - RNA, 21 nt, Homo sapiens
uguuacccaggguggagugca

SEQ ID NO: 1180181 - RNA, 22 nt, Homo sapiens
uguuacugaaaugagccucgug

SEQ ID NO: 1180182 - RNA, 19 nt, Homo sapiens
uguuagccgggauggucuu

SEQ ID NO: 1180183 - RNA, 20 nt, Homo sapiens
uguuagcuuguauauauauu

SEQ ID NO: 1180184 - RNA, 18 nt, Homo sapiens
uguuaggccaacugccuc

SEQ ID NO: 1180185 - RNA, 15 nt, Homo sapiens
uguuaucagucaaua

SEQ ID NO: 1180186 - RNA, 22 nt, Homo sapiens
uguuaucgaacacauucaguga

SEQ ID NO: 1180187 - RNA, 15 nt, Homo sapiens
uguuauuuagacuca

SEQ ID NO: 1180188 - RNA, 16 nt, Homo sapiens
uguuauuuucagugau

SEQ ID NO: 1180189 - RNA, 22 nt, Homo sapiens
uguucaaauuaaaaaagcugcu

SEQ ID NO: 1180190 - RNA, 16 nt, Homo sapiens
uguucaauuguguauu

SEQ ID NO: 1180191 - RNA, 17 nt, Homo sapiens
uguucacacacacaguu

SEQ ID NO: 1180192 - RNA, 18 nt, Homo sapiens
uguucacacacacaguuu

SEQ ID NO: 1180193 - RNA, 20 nt, Homo sapiens
uguucacacacacaguuuga

SEQ ID NO: 1180194 - RNA, 12 nt, Homo sapiens
uuaauccagcuu

SEQ ID NO: 1180195 - RNA, 20 nt, Homo sapiens
uuaauccaguguuacugugu

SEQ ID NO: 1180196 - RNA, 18 nt, Homo sapiens
uuaaucuccucagacagu

SEQ ID NO: 1180197 - RNA, 20 nt, Homo sapiens
uuaaugaggguuugugcuac

SEQ ID NO: 1180198 - RNA, 20 nt, Homo sapiens
uuaaugauucugaagcuuau

SEQ ID NO: 1180199 - RNA, 15 nt, Homo sapiens
uuaaugcagacaaac

SEQ ID NO: 1180200 - RNA, 19 nt, Homo sapiens
uuaaugcugucuuugugga

SEQ ID NO: 1180201 - RNA, 17 nt, Homo sapiens
uuaaugcuuauaagaca

SEQ ID NO: 1180202 - RNA, 15 nt, Homo sapiens
uuaauggucacaaua

SEQ ID NO: 1180203 - RNA, 18 nt, Homo sapiens
uuaauguagacauuaucu

SEQ ID NO: 1180204 - RNA, 17 nt, Homo sapiens
uuaaugugaccuagcaa

SEQ ID NO: 1180205 - RNA, 17 nt, Homo sapiens
uuaauguuauaucauau

SEQ ID NO: 1180206 - RNA, 17 nt, Homo sapiens
uuaauucauaaaucaca

SEQ ID NO: 1180207 - RNA, 14 nt, Homo sapiens
uuaauugcauuuaa

SEQ ID NO: 1180208 - RNA, 16 nt, Homo sapiens
uuaauuggagugcagc

SEQ ID NO: 1180209 - RNA, 18 nt, Homo sapiens
uuaauuucaucacuaaaa

SEQ ID NO: 1180210 - RNA, 18 nt, Homo sapiens
uuaauuuucuauguguug

SEQ ID NO: 1180211 - RNA, 22 nt, Homo sapiens
uuaauuuuuaaaagacuuugau

SEQ ID NO: 1180212 - RNA, 22 nt, Homo sapiens
uuaauuuuuaaggauguugcca

SEQ ID NO: 1180213 - RNA, 17 nt, Homo sapiens
uuaauuuuuaaugcuua

SEQ ID NO: 1180214 - RNA, 17 nt, Homo sapiens
uuaauuuuuugguacaa

SEQ ID NO: 1180215 - RNA, 15 nt, Homo sapiens
uuacaaccuugucag

SEQ ID NO: 1180216 - RNA, 21 nt, Homo sapiens
uuacaauauagaugacauuuu

SEQ ID NO: 1180217 - RNA, 17 nt, Homo sapiens
uuacacacaugagggcu

SEQ ID NO: 1180218 - RNA, 12 nt, Homo sapiens
uuacacauaccc

SEQ ID NO: 1180219 - RNA, 12 nt, Homo sapiens
uuacacugaguu

SEQ ID NO: 1180220 - RNA, 18 nt, Homo sapiens
uuacacugaucaauuuca

SEQ ID NO: 1180221 - RNA, 12 nt, Homo sapiens
uuacacuguaua

SEQ ID NO: 1180222 - RNA, 19 nt, Homo sapiens
uuacagcacacacuuccau

SEQ ID NO: 1180223 - RNA, 13 nt, Homo sapiens
uuacagccgugag

SEQ ID NO: 1180224 - RNA, 18 nt, Homo sapiens
uuacaggaaagaugcauu

SEQ ID NO: 1180225 - RNA, 17 nt, Homo sapiens
uuacaggcgugauccac

SEQ ID NO: 1180226 - RNA, 14 nt, Homo sapiens
uuacauacagugau

SEQ ID NO: 1180227 - RNA, 23 nt, Homo sapiens
uuacauauguuaauaaacugcaa

SEQ ID NO: 1180228 - RNA, 16 nt, Homo sapiens
uuacaucuacaaacag

SEQ ID NO: 1180229 - RNA, 14 nt, Homo sapiens
uuacauuguugagc

SEQ ID NO: 1180230 - RNA, 11 nt, Homo sapiens
uuacauuuaau

SEQ ID NO: 1180231 - RNA, 22 nt, Homo sapiens
uuaccagaugcugacuggcacu

SEQ ID NO: 1180232 - RNA, 16 nt, Homo sapiens
uuaccagguucacuua

SEQ ID NO: 1180233 - RNA, 23 nt, Homo sapiens
uuaccauuccuauaguacuuuau

SEQ ID NO: 1180234 - RNA, 19 nt, Homo sapiens
uuacccaggcuggagugca

SEQ ID NO: 1180235 - RNA, 19 nt, Homo sapiens
uuacccaggguggagugca

SEQ ID NO: 1180236 - RNA, 22 nt, Homo sapiens
uuaccccauggcugcacaguug

SEQ ID NO: 1180237 - RNA, 20 nt, Homo sapiens
uuaccugaaggacagcugaa

SEQ ID NO: 1180238 - RNA, 20 nt, Homo sapiens
uuaccuggcagcaaacugcu

SEQ ID NO: 1180239 - RNA, 17 nt, Homo sapiens
uuaccuucauaugcagu

SEQ ID NO: 1180240 - RNA, 15 nt, Homo sapiens
uuaccuuuaccccau

SEQ ID NO: 1180241 - RNA, 14 nt, Homo sapiens
uuacgaaaccaaaa

SEQ ID NO: 1180242 - RNA, 16 nt, Homo sapiens
uuacgcaaugcuucua

SEQ ID NO: 1180243 - RNA, 21 nt, Homo sapiens
uuacuauaagaacuuugagcu

SEQ ID NO: 1180244 - RNA, 16 nt, Homo sapiens
uuacuaucauggcaua

SEQ ID NO: 1180245 - RNA, 23 nt, Homo sapiens
uuacucuaagaucuuagauucuc

SEQ ID NO: 1180246 - RNA, 23 nt, Homo sapiens
uuacucuagauaccuaaaacaua

SEQ ID NO: 1180247 - RNA, 14 nt, Homo sapiens
uuacugaagccagg

SEQ ID NO: 1180248 - RNA, 17 nt, Homo sapiens
uuacugaagucuuacua

SEQ ID NO: 1180249 - RNA, 15 nt, Homo sapiens
uuacugagguuuuua

SEQ ID NO: 1180250 - RNA, 12 nt, Homo sapiens
uuacugcuugac

SEQ ID NO: 1180251 - RNA, 16 nt, Homo sapiens
uuacuguaaaggcaag

SEQ ID NO: 1180252 - RNA, 22 nt, Homo sapiens
uuacuguaaaggcaagccagca

SEQ ID NO: 1180253 - RNA, 18 nt, Homo sapiens
uuacuguccuaacucucc

SEQ ID NO: 1180254 - RNA, 19 nt, Homo sapiens
uuacugugcugaaagucag

SEQ ID NO: 1180255 - RNA, 22 nt, Homo sapiens
uuacugugucaggaaacauauu

SEQ ID NO: 1180256 - RNA, 16 nt, Homo sapiens
uuacuguugaacaaua

SEQ ID NO: 1180257 - RNA, 10 nt, Homo sapiens
uuacuguugg

SEQ ID NO: 1180258 - RNA, 20 nt, Homo sapiens
uuacuuaaagauuuaucaaa

SEQ ID NO: 1180259 - RNA, 15 nt, Homo sapiens
uuacuuguaucauug

SEQ ID NO: 1180260 - RNA, 20 nt, Homo sapiens
uuacuuguguuacuugccaa

SEQ ID NO: 1180261 - RNA, 16 nt, Homo sapiens
uuacuuuucaagcuau

SEQ ID NO: 1180262 - RNA, 17 nt, Homo sapiens
uuagaaacaacauagca

SEQ ID NO: 1180263 - RNA, 20 nt, Homo sapiens
uuagaaaugucaguugcugc

SEQ ID NO: 1180264 - RNA, 12 nt, Homo sapiens
uuagaacaggga

SEQ ID NO: 1180265 - RNA, 14 nt, Homo sapiens
uuagaacagugccu

SEQ ID NO: 1180266 - RNA, 22 nt, Homo sapiens
uuagaaccagcagaagccagag

SEQ ID NO: 1180267 - RNA, 12 nt, Homo sapiens
uuagaagcacag

SEQ ID NO: 1180268 - RNA, 12 nt, Homo sapiens
uuagaauaucug

SEQ ID NO: 1180269 - RNA, 18 nt, Homo sapiens
uuagaaucuccacuacuu

SEQ ID NO: 1180270 - RNA, 19 nt, Homo sapiens
uuagaaucuccacuacuua

SEQ ID NO: 1180271 - RNA, 13 nt, Homo sapiens
uuagaaugugauu

SEQ ID NO: 1180272 - RNA, 17 nt, Homo sapiens
uuagaauuccuucaggg

SEQ ID NO: 1180273 - RNA, 18 nt, Homo sapiens
uuagaauuccuucagggu

SEQ ID NO: 1180274 - RNA, 19 nt, Homo sapiens
uuagacacuacaacauaug

SEQ ID NO: 1180275 - RNA, 13 nt, Homo sapiens
uuagacaguaugc

SEQ ID NO: 1180276 - RNA, 13 nt, Homo sapiens
uuagaccaugcua

SEQ ID NO: 1180277 - RNA, 22 nt, Homo sapiens
uuagagaaacuuugaguacaga

SEQ ID NO: 1180278 - RNA, 17 nt, Homo sapiens
uuagaggaccagugagu

SEQ ID NO: 1180279 - RNA, 15 nt, Homo sapiens
uuagaggggggaaau

SEQ ID NO: 1180280 - RNA, 18 nt, Homo sapiens
uuagaguccuaguuuucc

SEQ ID NO: 1180281 - RNA, 18 nt, Homo sapiens
uuagaugggaggaugaau

SEQ ID NO: 1180282 - RNA, 21 nt, Homo sapiens
uuagauguugagaaauucugc

SEQ ID NO: 1180283 - RNA, 14 nt, Homo sapiens
uuagauucagggga

SEQ ID NO: 1180284 - RNA, 14 nt, Homo sapiens
uuagcaagacagca

SEQ ID NO: 1180285 - RNA, 12 nt, Homo sapiens
uuagcaaugcug

SEQ ID NO: 1180286 - RNA, 12 nt, Homo sapiens
uuagcagacagg

SEQ ID NO: 1180287 - RNA, 18 nt, Homo sapiens
uuagccgacugcgcugcu

SEQ ID NO: 1180288 - RNA, 21 nt, Homo sapiens
uuagccgggcaugauggugca

SEQ ID NO: 1180289 - RNA, 19 nt, Homo sapiens
uuagcuggccauucaggua

SEQ ID NO: 1180290 - RNA, 23 nt, Homo sapiens
uuagcuuugcagugagugcugcu

SEQ ID NO: 1180291 - RNA, 18 nt, Homo sapiens
uuaggaagguacugucau

SEQ ID NO: 1180292 - RNA, 17 nt, Homo sapiens
uuaggagacacagggaa

SEQ ID NO: 1180293 - RNA, 20 nt, Homo sapiens
uuaggagagagaaaauaauu

SEQ ID NO: 1180294 - RNA, 20 nt, Homo sapiens
uuaggauaaccuugugccuu

SEQ ID NO: 1180295 - RNA, 22 nt, Homo sapiens
uuagggauaguacuaagcauuu

SEQ ID NO: 1180296 - RNA, 19 nt, Homo sapiens
uuagggcuacccaaaacag

SEQ ID NO: 1180297 - RNA, 16 nt, Homo sapiens
uuaguacuuacaucag

SEQ ID NO: 1180298 - RNA, 14 nt, Homo sapiens
uuaguauuucacaa

SEQ ID NO: 1180299 - RNA, 15 nt, Homo sapiens
uuagugauggagcuu

SEQ ID NO: 1180300 - RNA, 20 nt, Homo sapiens
uuagugcuguaaaucagggu

SEQ ID NO: 1180301 - RNA, 14 nt, Homo sapiens
uuaguuaacacuga

SEQ ID NO: 1180302 - RNA, 20 nt, Homo sapiens
uuaguuauuucugccuauaa

SEQ ID NO: 1180303 - RNA, 18 nt, Homo sapiens
uuaguugaggccuucuag

SEQ ID NO: 1180304 - RNA, 17 nt, Homo sapiens
uuaguugcuaguuuagu

SEQ ID NO: 1180305 - RNA, 14 nt, Homo sapiens
uuaguuuuucuuac

SEQ ID NO: 1180306 - RNA, 21 nt, Homo sapiens
uuauaaagagugcuacauggu

SEQ ID NO: 1180307 - RNA, 14 nt, Homo sapiens
uuauaaauaugaag

SEQ ID NO: 1180308 - RNA, 15 nt, Homo sapiens
uuauaaaugagguca

SEQ ID NO: 1180309 - RNA, 18 nt, Homo sapiens
uuauaaggaaaggcacau

SEQ ID NO: 1180310 - RNA, 19 nt, Homo sapiens
uuauaauuugcauaccauu

SEQ ID NO: 1180311 - RNA, 15 nt, Homo sapiens
uuauacaacagugcu

SEQ ID NO: 1180312 - RNA, 17 nt, Homo sapiens
uuauacauuauuuuaca

SEQ ID NO: 1180313 - RNA, 14 nt, Homo sapiens
uuauaccuugccug

SEQ ID NO: 1180314 - RNA, 16 nt, Homo sapiens
uuauacugcacuuuag

SEQ ID NO: 1180315 - RNA, 18 nt, Homo sapiens
uuauagaaagauagauau

SEQ ID NO: 1180316 - RNA, 16 nt, Homo sapiens
uuauagccucagauuc

SEQ ID NO: 1180317 - RNA, 17 nt, Homo sapiens
uuauaggcaugagccac

SEQ ID NO: 1180318 - RNA, 16 nt, Homo sapiens
uuauaguaacaucaaa

SEQ ID NO: 1180319 - RNA, 18 nt, Homo sapiens
uuauaguccaugguccau

SEQ ID NO: 1180320 - RNA, 17 nt, Homo sapiens
uuauauaauuguugaac

SEQ ID NO: 1180321 - RNA, 20 nt, Homo sapiens
uuauauagcaagugcuauuu

SEQ ID NO: 1180322 - RNA, 16 nt, Homo sapiens
uuauauauaaagaagg

SEQ ID NO: 1180323 - RNA, 22 nt, Homo sapiens
uuauauauacaguaacuuuaug

SEQ ID NO: 1180324 - RNA, 16 nt, Homo sapiens
uuauauguugcuauaa

SEQ ID NO: 1180325 - RNA, 21 nt, Homo sapiens
uuauauuaaagaauucuguac

SEQ ID NO: 1180326 - RNA, 13 nt, Homo sapiens
uuauauucaucca

SEQ ID NO: 1180327 - RNA, 22 nt, Homo sapiens
uuaucaacuagaaacaguacau

SEQ ID NO: 1180328 - RNA, 21 nt, Homo sapiens
uuaucaacuuccuaaauauua

SEQ ID NO: 1180329 - RNA, 17 nt, Homo sapiens
uguucacauaacgccac

SEQ ID NO: 1180330 - RNA, 15 nt, Homo sapiens
uguucacuuccaaga

SEQ ID NO: 1180331 - RNA, 15 nt, Homo sapiens
uguucauuucugucu

SEQ ID NO: 1180332 - RNA, 22 nt, Homo sapiens
uguuccaauuugacaaaaccca

SEQ ID NO: 1180333 - RNA, 23 nt, Homo sapiens
uguuccaauuugacaaaacccac

SEQ ID NO: 1180334 - RNA, 13 nt, Homo sapiens
uguuccaugucuc

SEQ ID NO: 1180335 - RNA, 15 nt, Homo sapiens
uguucccauuggaug

SEQ ID NO: 1180336 - RNA, 18 nt, Homo sapiens
uguuccccuuccacugag

SEQ ID NO: 1180337 - RNA, 13 nt, Homo sapiens
uguuccuaucaaa

SEQ ID NO: 1180338 - RNA, 15 nt, Homo sapiens
uguuccuucugugaa

SEQ ID NO: 1180339 - RNA, 16 nt, Homo sapiens
uguuccuugcuuuuau

SEQ ID NO: 1180340 - RNA, 14 nt, Homo sapiens
uguuccuuugcucu

SEQ ID NO: 1180341 - RNA, 23 nt, Homo sapiens
uguucgggguuuuuuguuaugaa

SEQ ID NO: 1180342 - RNA, 19 nt, Homo sapiens
uguucuaaucaauguacaa

SEQ ID NO: 1180343 - RNA, 15 nt, Homo sapiens
uguucucacagugac

SEQ ID NO: 1180344 - RNA, 14 nt, Homo sapiens
uguucucuguccag

SEQ ID NO: 1180345 - RNA, 20 nt, Homo sapiens
uguucuguagcuuucuggaa

SEQ ID NO: 1180346 - RNA, 14 nt, Homo sapiens
uguugaaguuuaca

SEQ ID NO: 1180347 - RNA, 15 nt, Homo sapiens
uguugacugcugcuc

SEQ ID NO: 1180348 - RNA, 14 nt, Homo sapiens
uguugagaugauau

SEQ ID NO: 1180349 - RNA, 15 nt, Homo sapiens
uguugagcagcaucu

SEQ ID NO: 1180350 - RNA, 19 nt, Homo sapiens
uguugaugguaggcuguau

SEQ ID NO: 1180351 - RNA, 20 nt, Homo sapiens
uguugcaaaucacucugcaa

SEQ ID NO: 1180352 - RNA, 18 nt, Homo sapiens
uguugcauguauguguaa

SEQ ID NO: 1180353 - RNA, 22 nt, Homo sapiens
uguugcuucuugugaaggccau

SEQ ID NO: 1180354 - RNA, 13 nt, Homo sapiens
uguuggcaaaaga

SEQ ID NO: 1180355 - RNA, 13 nt, Homo sapiens
uguuguagacuua

SEQ ID NO: 1180356 - RNA, 18 nt, Homo sapiens
uguugucacccaagagau

SEQ ID NO: 1180357 - RNA, 14 nt, Homo sapiens
uguugucucauaga

SEQ ID NO: 1180358 - RNA, 18 nt, Homo sapiens
uguuuacagacgugugca

SEQ ID NO: 1180359 - RNA, 16 nt, Homo sapiens
uguuuauucuauaguu

SEQ ID NO: 1180360 - RNA, 16 nt, Homo sapiens
uguuuauuugcacuau

SEQ ID NO: 1180361 - RNA, 17 nt, Homo sapiens
uguuucaguucagauaa

SEQ ID NO: 1180362 - RNA, 18 nt, Homo sapiens
uguuuccccccuuuucag

SEQ ID NO: 1180363 - RNA, 14 nt, Homo sapiens
uguuucuauacaaa

SEQ ID NO: 1180364 - RNA, 15 nt, Homo sapiens
uguuucugguaugaa

SEQ ID NO: 1180365 - RNA, 17 nt, Homo sapiens
uguuucuuuuugccagc

SEQ ID NO: 1180366 - RNA, 14 nt, Homo sapiens
uguuugaaaccaag

SEQ ID NO: 1180367 - RNA, 16 nt, Homo sapiens
uguuugcacguuaugg

SEQ ID NO: 1180368 - RNA, 21 nt, Homo sapiens
uguuuggaaagcugaaaggga

SEQ ID NO: 1180369 - RNA, 21 nt, Homo sapiens
uguuugggggacguuucucau

SEQ ID NO: 1180370 - RNA, 21 nt, Homo sapiens
uguuuuaaauuuugugguucc

SEQ ID NO: 1180371 - RNA, 19 nt, Homo sapiens
uguuuuaauucaacccagc

SEQ ID NO: 1180372 - RNA, 20 nt, Homo sapiens
uguuuuaucauuaccauuaa

SEQ ID NO: 1180373 - RNA, 21 nt, Homo sapiens
uguuuuaucuccauacuuugg

SEQ ID NO: 1180374 - RNA, 20 nt, Homo sapiens
uguuuucucuggaguauucu

SEQ ID NO: 1180375 - RNA, 15 nt, Homo sapiens
uguuuucuuugcaaa

SEQ ID NO: 1180376 - RNA, 14 nt, Homo sapiens
uguuuuggcucaau

SEQ ID NO: 1180377 - RNA, 16 nt, Homo sapiens
uguuuuuaaaaccacu

SEQ ID NO: 1180378 - RNA, 20 nt, Homo sapiens
uguuuuuccuuuaauccagu

SEQ ID NO: 1180379 - RNA, 12 nt, Homo sapiens
uguuuuugccaa

SEQ ID NO: 1180380 - RNA, 18 nt, Homo sapiens
uguuuuuguaaagugugg

SEQ ID NO: 1180381 - RNA, 14 nt, Homo sapiens
uguuuuuucugcaa

SEQ ID NO: 1180382 - RNA, 23 nt, Homo sapiens
uuaaaaaaaaaaaguacaauuca

SEQ ID NO: 1180383 - RNA, 19 nt, Homo sapiens
uuaaaaaaaacaauuccac

SEQ ID NO: 1180384 - RNA, 20 nt, Homo sapiens
uuaaaaaaaacaauuccaca

SEQ ID NO: 1180385 - RNA, 22 nt, Homo sapiens
uuaaaaaaauggcagugaugaa

SEQ ID NO: 1180386 - RNA, 20 nt, Homo sapiens
uuaaaaaaauuuuugcaaau

SEQ ID NO: 1180387 - RNA, 17 nt, Homo sapiens
uuaaaaaggaacugcag

SEQ ID NO: 1180388 - RNA, 22 nt, Homo sapiens
uuaaaaauacggacguacuuug

SEQ ID NO: 1180389 - RNA, 14 nt, Homo sapiens
uuaaaacacuuuca

SEQ ID NO: 1180390 - RNA, 15 nt, Homo sapiens
uuaaaacauguaaua

SEQ ID NO: 1180391 - RNA, 11 nt, Homo sapiens
uuaaaacuauu

SEQ ID NO: 1180392 - RNA, 19 nt, Homo sapiens
uuaaaagcuggcuuucauc

SEQ ID NO: 1180393 - RNA, 22 nt, Homo sapiens
uuaaaaggcaguugcuguggaa

SEQ ID NO: 1180394 - RNA, 11 nt, Homo sapiens
uuaaaaggggg

SEQ ID NO: 1180395 - RNA, 16 nt, Homo sapiens
uuaaaagucaguauca

SEQ ID NO: 1180396 - RNA, 14 nt, Homo sapiens
uuaaaaguguacaa

SEQ ID NO: 1180397 - RNA, 22 nt, Homo sapiens
uuaaaauauuuaucugauuaag

SEQ ID NO: 1180398 - RNA, 15 nt, Homo sapiens
uuaaaaucauaaaua

SEQ ID NO: 1180399 - RNA, 23 nt, Homo sapiens
uuaaaaucuugcauggcauuaau

SEQ ID NO: 1180400 - RNA, 11 nt, Homo sapiens
uuaaaauggaa

SEQ ID NO: 1180401 - RNA, 15 nt, Homo sapiens
uuaaaauuacuuuga

SEQ ID NO: 1180402 - RNA, 16 nt, Homo sapiens
uuaaaauuagugcugu

SEQ ID NO: 1180403 - RNA, 19 nt, Homo sapiens
uuaaacaugaaugaauucu

SEQ ID NO: 1180404 - RNA, 18 nt, Homo sapiens
uuaaacauugaaguaaug

SEQ ID NO: 1180405 - RNA, 17 nt, Homo sapiens
uuaaacucuccuuugau

SEQ ID NO: 1180406 - RNA, 12 nt, Homo sapiens
uuaaacugauua

SEQ ID NO: 1180407 - RNA, 17 nt, Homo sapiens
uuaaacuggaacaugcu

SEQ ID NO: 1180408 - RNA, 22 nt, Homo sapiens
uuaaacuuagacagcauguaug

SEQ ID NO: 1180409 - RNA, 12 nt, Homo sapiens
uuaaacuuucaa

SEQ ID NO: 1180410 - RNA, 16 nt, Homo sapiens
uuaaagcauaugcuau

SEQ ID NO: 1180411 - RNA, 18 nt, Homo sapiens
uuaaagcauuacaguauu

SEQ ID NO: 1180412 - RNA, 15 nt, Homo sapiens
uuaaaggaaaagcac

SEQ ID NO: 1180413 - RNA, 18 nt, Homo sapiens
uuaaaggcaucuacacaa

SEQ ID NO: 1180414 - RNA, 16 nt, Homo sapiens
uuaaaguauucuucuc

SEQ ID NO: 1180415 - RNA, 21 nt, Homo sapiens
uuaaagucagguccaauuugu

SEQ ID NO: 1180416 - RNA, 20 nt, Homo sapiens
uuaaagucccuuuauaaaga

SEQ ID NO: 1180417 - RNA, 15 nt, Homo sapiens
uuaaaguuacuuugu

SEQ ID NO: 1180418 - RNA, 16 nt, Homo sapiens
uuaaaguucuagugac

SEQ ID NO: 1180419 - RNA, 14 nt, Homo sapiens
uuaaauaaauggaa

SEQ ID NO: 1180420 - RNA, 12 nt, Homo sapiens
uuaaauaaucuc

SEQ ID NO: 1180421 - RNA, 13 nt, Homo sapiens
uuaaauacacucu

SEQ ID NO: 1180422 - RNA, 17 nt, Homo sapiens
uuaaauacagucuucca

SEQ ID NO: 1180423 - RNA, 16 nt, Homo sapiens
uuaaauaucuggucuc

SEQ ID NO: 1180424 - RNA, 12 nt, Homo sapiens
uuaaaucaaaga

SEQ ID NO: 1180425 - RNA, 15 nt, Homo sapiens
uuaaaugcuacugaa

SEQ ID NO: 1180426 - RNA, 20 nt, Homo sapiens
uuaaaugcuuuuaaaucugc

SEQ ID NO: 1180427 - RNA, 20 nt, Homo sapiens
uuaaaugugacauucuuaaa

SEQ ID NO: 1180428 - RNA, 15 nt, Homo sapiens
uuaaauugcauuucu

SEQ ID NO: 1180429 - RNA, 18 nt, Homo sapiens
uuaacaaaugugcugcuu

SEQ ID NO: 1180430 - RNA, 16 nt, Homo sapiens
uuaacacuuaguguuc

SEQ ID NO: 1180431 - RNA, 22 nt, Homo sapiens
uuaacagagcaaauuugaauaa

SEQ ID NO: 1180432 - RNA, 22 nt, Homo sapiens
uuaacagaguuuucuguugcau

SEQ ID NO: 1180433 - RNA, 15 nt, Homo sapiens
uuaaccaaucgcaaa

SEQ ID NO: 1180434 - RNA, 21 nt, Homo sapiens
uuaaccugaaccuugagcaaa

SEQ ID NO: 1180435 - RNA, 23 nt, Homo sapiens
uuaacguauauuaaaccuguuga

SEQ ID NO: 1180436 - RNA, 23 nt, Homo sapiens
uuaacuuguaaaugaaaaaauuc

SEQ ID NO: 1180437 - RNA, 14 nt, Homo sapiens
uuaacuuuuugcca

SEQ ID NO: 1180438 - RNA, 18 nt, Homo sapiens
uuaagaauuucacaagcu

SEQ ID NO: 1180439 - RNA, 18 nt, Homo sapiens
uuaagagcucuggugaua

SEQ ID NO: 1180440 - RNA, 14 nt, Homo sapiens
uuaagagugaaguc

SEQ ID NO: 1180441 - RNA, 18 nt, Homo sapiens
uuaagcaaauaaacugua

SEQ ID NO: 1180442 - RNA, 15 nt, Homo sapiens
uuaagccagcacuca

SEQ ID NO: 1180443 - RNA, 13 nt, Homo sapiens
uuaagcugugcaa

SEQ ID NO: 1180444 - RNA, 14 nt, Homo sapiens
uuaaggauguugcc

SEQ ID NO: 1180445 - RNA, 18 nt, Homo sapiens
uuaaggcucugugccuug

SEQ ID NO: 1180446 - RNA, 19 nt, Homo sapiens
uuaaggucauuacucucaa

SEQ ID NO: 1180447 - RNA, 13 nt, Homo sapiens
uuaaguacccgag

SEQ ID NO: 1180448 - RNA, 16 nt, Homo sapiens
uuaaguaggaaucuga

SEQ ID NO: 1180449 - RNA, 17 nt, Homo sapiens
uuaagugcauaaagaau

SEQ ID NO: 1180450 - RNA, 22 nt, Homo sapiens
uuaaguuuguaagacagugccc

SEQ ID NO: 1180451 - RNA, 16 nt, Homo sapiens
uuaauaaacugcaaau

SEQ ID NO: 1180452 - RNA, 13 nt, Homo sapiens
uuaauaaagaagu

SEQ ID NO: 1180453 - RNA, 22 nt, Homo sapiens
uuaauaccugggugauuacaua

SEQ ID NO: 1180454 - RNA, 19 nt, Homo sapiens
uuaauagaaauaaauuccu

SEQ ID NO: 1180455 - RNA, 20 nt, Homo sapiens
uuaauagaaauaaauuccua

SEQ ID NO: 1180456 - RNA, 23 nt, Homo sapiens
uuaauaggugcagucuuugagau

SEQ ID NO: 1180457 - RNA, 18 nt, Homo sapiens
uuaauauaguugguacac

SEQ ID NO: 1180458 - RNA, 16 nt, Homo sapiens
uuaauauaucaauauu

SEQ ID NO: 1180459 - RNA, 20 nt, Homo sapiens
uuaauaugauucuaguacau

SEQ ID NO: 1180460 - RNA, 13 nt, Homo sapiens
uuaauauuuccaa

SEQ ID NO: 1180461 - RNA, 18 nt, Homo sapiens
uuaauauuuccaauguga

SEQ ID NO: 1180462 - RNA, 20 nt, Homo sapiens
uuaaucaguuguuuaauaau

SEQ ID NO: 1180463 - RNA, 20 nt, Homo sapiens
uuaaucaugaaauuacuuau

SEQ ID NO: 1180464 - RNA, 13 nt, Homo sapiens
ucuaucuugucaa

SEQ ID NO: 1180465 - RNA, 23 nt, Homo sapiens
ucuaugaccucgcccuccacaaa

SEQ ID NO: 1180466 - RNA, 21 nt, Homo sapiens
ucuaugccuaaaaaguaucau

SEQ ID NO: 1180467 - RNA, 14 nt, Homo sapiens
ucuauguggcugua

SEQ ID NO: 1180468 - RNA, 16 nt, Homo sapiens
ucuauucuuugccuua

SEQ ID NO: 1180469 - RNA, 21 nt, Homo sapiens
ucuauuugccuccagugcagu

SEQ ID NO: 1180470 - RNA, 20 nt, Homo sapiens
ucuauuuuuaucaugaauuc

SEQ ID NO: 1180471 - RNA, 19 nt, Homo sapiens
ucuauuuuuguacaaaaga

SEQ ID NO: 1180472 - RNA, 14 nt, Homo sapiens
ucucaaaacuguac

SEQ ID NO: 1180473 - RNA, 15 nt, Homo sapiens
ucucaaacgugcgcu

SEQ ID NO: 1180474 - RNA, 20 nt, Homo sapiens
ucucaaacuccugagcucaa

SEQ ID NO: 1180475 - RNA, 16 nt, Homo sapiens
ucucaaagaaggcauu

SEQ ID NO: 1180476 - RNA, 17 nt, Homo sapiens
ucucaaagaaggcauuu

SEQ ID NO: 1180477 - RNA, 11 nt, Homo sapiens
ucucaaagggg

SEQ ID NO: 1180478 - RNA, 14 nt, Homo sapiens
ucucaacuuugaua

SEQ ID NO: 1180479 - RNA, 19 nt, Homo sapiens
ucucaaggguuaaccagac

SEQ ID NO: 1180480 - RNA, 22 nt, Homo sapiens
ucucaaguauaugucauuuacu

SEQ ID NO: 1180481 - RNA, 11 nt, Homo sapiens
ucucacacucc

SEQ ID NO: 1180482 - RNA, 12 nt, Homo sapiens
ucucacacuccu

SEQ ID NO: 1180483 - RNA, 16 nt, Homo sapiens
ucucaccagcugcaaa

SEQ ID NO: 1180484 - RNA, 23 nt, Homo sapiens
ucucaccccugcuauaacuauga

SEQ ID NO: 1180485 - RNA, 20 nt, Homo sapiens
ucucacggcuuguaaaugug

SEQ ID NO: 1180486 - RNA, 23 nt, Homo sapiens
ucucacuaguugucagcuucucu

SEQ ID NO: 1180487 - RNA, 14 nt, Homo sapiens
ucucacugacuauu

SEQ ID NO: 1180488 - RNA, 23 nt, Homo sapiens
ucucacugccaucaaacuguaaa

SEQ ID NO: 1180489 - RNA, 11 nt, Homo sapiens
ucucacuuugg

SEQ ID NO: 1180490 - RNA, 22 nt, Homo sapiens
ucucacuuugguuggaacuuua

SEQ ID NO: 1180491 - RNA, 22 nt, Homo sapiens
ucucagaucacugcaaccucug

SEQ ID NO: 1180492 - RNA, 16 nt, Homo sapiens
ucucagcacuaugaca

SEQ ID NO: 1180493 - RNA, 17 nt, Homo sapiens
ucucagcacuaugacau

SEQ ID NO: 1180494 - RNA, 15 nt, Homo sapiens
ucucagccacaacca

SEQ ID NO: 1180495 - RNA, 22 nt, Homo sapiens
ucucaggaagcccccaaguuga

SEQ ID NO: 1180496 - RNA, 20 nt, Homo sapiens
ucucaggaccaaagcuuuca

SEQ ID NO: 1180497 - RNA, 23 nt, Homo sapiens
ucucaggcugucccaagcuccca

SEQ ID NO: 1180498 - RNA, 23 nt, Homo sapiens
ucucagguccagcuuuacugugg

SEQ ID NO: 1180499 - RNA, 14 nt, Homo sapiens
ucucaucugugauu

SEQ ID NO: 1180500 - RNA, 14 nt, Homo sapiens
ucucaugauuauua

SEQ ID NO: 1180501 - RNA, 16 nt, Homo sapiens
ucucaugggaagggga

SEQ ID NO: 1180502 - RNA, 17 nt, Homo sapiens
ucucauguauaaaacua

SEQ ID NO: 1180503 - RNA, 10 nt, Homo sapiens
ucucauuccc

SEQ ID NO: 1180504 - RNA, 11 nt, Homo sapiens
ucucauucccu

SEQ ID NO: 1180505 - RNA, 12 nt, Homo sapiens
ucucauuccugu

SEQ ID NO: 1180506 - RNA, 17 nt, Homo sapiens
ucucauuucccuuugau

SEQ ID NO: 1180507 - RNA, 10 nt, Homo sapiens
ucucauuucu

SEQ ID NO: 1180508 - RNA, 17 nt, Homo sapiens
ucucauuuggacuugcu

SEQ ID NO: 1180509 - RNA, 21 nt, Homo sapiens
ucucauuuuuaucccauugag

SEQ ID NO: 1180510 - RNA, 22 nt, Homo sapiens
ucuccaaagcccucccuaccua

SEQ ID NO: 1180511 - RNA, 20 nt, Homo sapiens
ucuccaagcccaguucagcu

SEQ ID NO: 1180512 - RNA, 23 nt, Homo sapiens
ucuccacaaaaacucuuauuacu

SEQ ID NO: 1180513 - RNA, 17 nt, Homo sapiens
ucuccacugggugccaa

SEQ ID NO: 1180514 - RNA, 13 nt, Homo sapiens
ucuccacuucacu

SEQ ID NO: 1180515 - RNA, 18 nt, Homo sapiens
ucuccagaacccauuuga

SEQ ID NO: 1180516 - RNA, 20 nt, Homo sapiens
ggacuuguuuuccuguguuc

SEQ ID NO: 1180517 - RNA, 16 nt, Homo sapiens
ggagaaacacuugaac

SEQ ID NO: 1180518 - RNA, 18 nt, Homo sapiens
ggagaagaagucagagag

SEQ ID NO: 1180519 - RNA, 19 nt, Homo sapiens
ggagaauacugccaaaaca

SEQ ID NO: 1180520 - RNA, 15 nt, Homo sapiens
ggagaaucacuugaa

SEQ ID NO: 1180521 - RNA, 14 nt, Homo sapiens
ggagacacagggaa

SEQ ID NO: 1180522 - RNA, 23 nt, Homo sapiens
ggagacauuguuuggauuuccuu

SEQ ID NO: 1180523 - RNA, 23 nt, Homo sapiens
ggagaccccaaaaagaguuacac

SEQ ID NO: 1180524 - RNA, 18 nt, Homo sapiens
ggagaccuggacacaggc

SEQ ID NO: 1180525 - RNA, 16 nt, Homo sapiens
ggagacuugccagagc

SEQ ID NO: 1180526 - RNA, 14 nt, Homo sapiens
ggagagucaaggga

SEQ ID NO: 1180527 - RNA, 18 nt, Homo sapiens
ggagcaaaucgugccuug

SEQ ID NO: 1180528 - RNA, 14 nt, Homo sapiens
ggagcaaucugacc

SEQ ID NO: 1180529 - RNA, 22 nt, Homo sapiens
ggagcagaggcccuucacccag

SEQ ID NO: 1180530 - RNA, 19 nt, Homo sapiens
ggagcagauuuuugcaaua

SEQ ID NO: 1180531 - RNA, 23 nt, Homo sapiens
ggagccagggaauccugaccuga

SEQ ID NO: 1180532 - RNA, 18 nt, Homo sapiens
ggagcccagcggcccaag

SEQ ID NO: 1180533 - RNA, 23 nt, Homo sapiens
ggagccccuccucccccggcugg

SEQ ID NO: 1180534 - RNA, 20 nt, Homo sapiens
ggagccccugaaagccucac

SEQ ID NO: 1180535 - RNA, 22 nt, Homo sapiens
ggagccccuucugcucagcucu

SEQ ID NO: 1180536 - RNA, 21 nt, Homo sapiens
ggagccggacacuucucagga

SEQ ID NO: 1180537 - RNA, 14 nt, Homo sapiens
ggagccuccagcug

SEQ ID NO: 1180538 - RNA, 18 nt, Homo sapiens
ggagccugugguggccug

SEQ ID NO: 1180539 - RNA, 23 nt, Homo sapiens
ggagcuagccagaggacugugau

SEQ ID NO: 1180540 - RNA, 16 nt, Homo sapiens
ggagcucuucugugcc

SEQ ID NO: 1180541 - RNA, 18 nt, Homo sapiens
ggagcugcugagugacag

SEQ ID NO: 1180542 - RNA, 14 nt, Homo sapiens
ggagcuggggcaag

SEQ ID NO: 1180543 - RNA, 15 nt, Homo sapiens
ggagcuuaaacagcu

SEQ ID NO: 1180544 - RNA, 18 nt, Homo sapiens
ggaggaaaugaaugcuga

SEQ ID NO: 1180545 - RNA, 20 nt, Homo sapiens
ggaggacaagacccucucag

SEQ ID NO: 1180546 - RNA, 20 nt, Homo sapiens
ggaggagcccuccauuccaa

SEQ ID NO: 1180547 - RNA, 14 nt, Homo sapiens
ggaggagcugugcu

SEQ ID NO: 1180548 - RNA, 22 nt, Homo sapiens
ggaggaggcugaggccugugaa

SEQ ID NO: 1180549 - RNA, 20 nt, Homo sapiens
ggaggcagaggcugcauuga

SEQ ID NO: 1180550 - RNA, 23 nt, Homo sapiens
ggaggccgggagaggaugucuuu

SEQ ID NO: 1180551 - RNA, 12 nt, Homo sapiens
ggaggcugagac

SEQ ID NO: 1180552 - RNA, 15 nt, Homo sapiens
ggaggcugaggcaca

SEQ ID NO: 1180553 - RNA, 14 nt, Homo sapiens
ggaggcugcagcca

SEQ ID NO: 1180554 - RNA, 16 nt, Homo sapiens
ggagggaagcacugcc

SEQ ID NO: 1180555 - RNA, 13 nt, Homo sapiens
ggagggacaagug

SEQ ID NO: 1180556 - RNA, 16 nt, Homo sapiens
ggagggugagugcaag

SEQ ID NO: 1180557 - RNA, 19 nt, Homo sapiens
ggaggugaccaaaucagug

SEQ ID NO: 1180558 - RNA, 15 nt, Homo sapiens
ggagguugagugagc

SEQ ID NO: 1180559 - RNA, 13 nt, Homo sapiens
ggaguaaucugug

SEQ ID NO: 1180560 - RNA, 16 nt, Homo sapiens
ggagucaccaugcaag

SEQ ID NO: 1180561 - RNA, 21 nt, Homo sapiens
ggagugcccccaacagcaccc

SEQ ID NO: 1180562 - RNA, 16 nt, Homo sapiens
ggaguggaaggugagg

SEQ ID NO: 1180563 - RNA, 17 nt, Homo sapiens
ggaguuacaucuuuauu

SEQ ID NO: 1180564 - RNA, 22 nt, Homo sapiens
ggaguucaagaccagccugucc

SEQ ID NO: 1180565 - RNA, 14 nt, Homo sapiens
ggaguuccacagau

SEQ ID NO: 1180566 - RNA, 16 nt, Homo sapiens
ggaguucuuuggcucu

SEQ ID NO: 1180567 - RNA, 21 nt, Homo sapiens
ggauacauaaugggccacuga

SEQ ID NO: 1180568 - RNA, 22 nt, Homo sapiens
ggauacuuuuaugcaaccauaa

SEQ ID NO: 1180569 - RNA, 20 nt, Homo sapiens
ggauaucauacuuccaucug

SEQ ID NO: 1180570 - RNA, 18 nt, Homo sapiens
ggauauuaaauguugcuu

SEQ ID NO: 1180571 - RNA, 20 nt, Homo sapiens
ggauauuuugaaaugaacuu

SEQ ID NO: 1180572 - RNA, 22 nt, Homo sapiens
ggauauuuugaaaugaacuuug

SEQ ID NO: 1180573 - RNA, 11 nt, Homo sapiens
ggaucagccag

SEQ ID NO: 1180574 - RNA, 12 nt, Homo sapiens
ggaucagugaaa

SEQ ID NO: 1180575 - RNA, 23 nt, Homo sapiens
ggaucauguaaaugcucaaagau

SEQ ID NO: 1180576 - RNA, 16 nt, Homo sapiens
ggauccucaguucuca

SEQ ID NO: 1180577 - RNA, 18 nt, Homo sapiens
ggaugaaacuaaagcaau

SEQ ID NO: 1180578 - RNA, 22 nt, Homo sapiens
ggaugaaacuaaagcaauagaa

SEQ ID NO: 1180579 - RNA, 23 nt, Homo sapiens
ggaugauguuauucacagccccu

SEQ ID NO: 1180580 - RNA, 22 nt, Homo sapiens
ggaugauuauuuucuguucuau

SEQ ID NO: 1180581 - RNA, 13 nt, Homo sapiens
ggaugccuuagca

SEQ ID NO: 1180582 - RNA, 23 nt, Homo sapiens
ggaugcucaguugcuaaacacug

SEQ ID NO: 1180583 - RNA, 13 nt, Homo sapiens
ggaugcugugcua

SEQ ID NO: 1180584 - RNA, 23 nt, Homo sapiens
ggauggaacacggccacaucaaa

SEQ ID NO: 1180585 - RNA, 20 nt, Homo sapiens
ggaugggcccuaugucucag

SEQ ID NO: 1180586 - RNA, 22 nt, Homo sapiens
ggaugucuccgucucugucuca

SEQ ID NO: 1180587 - RNA, 23 nt, Homo sapiens
ggaugucugccacaccucuccaa

SEQ ID NO: 1180588 - RNA, 16 nt, Homo sapiens
ggauuacaggcuugag

SEQ ID NO: 1180589 - RNA, 13 nt, Homo sapiens
ggauuacagggau

SEQ ID NO: 1180590 - RNA, 13 nt, Homo sapiens
ggauuggggacca

SEQ ID NO: 1180591 - RNA, 13 nt, Homo sapiens
ggauugggguccc

SEQ ID NO: 1180592 - RNA, 17 nt, Homo sapiens
ggcaacaauaaaauagc

SEQ ID NO: 1180593 - RNA, 15 nt, Homo sapiens
ggcaacaauuuaccu

SEQ ID NO: 1180594 - RNA, 22 nt, Homo sapiens
ggcaacacugaaggaacaguua

SEQ ID NO: 1180595 - RNA, 19 nt, Homo sapiens
ggcaacagagcaagaccca

SEQ ID NO: 1180596 - RNA, 20 nt, Homo sapiens
ggcaacagagcaagacucca

SEQ ID NO: 1180597 - RNA, 16 nt, Homo sapiens
ggcaacgcacaaaaca

SEQ ID NO: 1180598 - RNA, 16 nt, Homo sapiens
ggcaagaccccaccuc

SEQ ID NO: 1180599 - RNA, 16 nt, Homo sapiens
ggcaagauaaacacuu

SEQ ID NO: 1180600 - RNA, 20 nt, Homo sapiens
ggcaaggagaagagcaaagu

SEQ ID NO: 1180601 - RNA, 16 nt, Homo sapiens
ggcaaguggagccacc

SEQ ID NO: 1180602 - RNA, 23 nt, Homo sapiens
ggcaauugagggacugagccaga

SEQ ID NO: 1180603 - RNA, 13 nt, Homo sapiens
ggcacacaccagu

SEQ ID NO: 1180604 - RNA, 17 nt, Homo sapiens
ucuguaaaagugucugu

SEQ ID NO: 1180605 - RNA, 23 nt, Homo sapiens
ucuguacaaaggggaaagaacau

SEQ ID NO: 1180606 - RNA, 23 nt, Homo sapiens
ucuguacaaugaacccccaugau

SEQ ID NO: 1180607 - RNA, 14 nt, Homo sapiens
ucuguagugucacu

SEQ ID NO: 1180608 - RNA, 20 nt, Homo sapiens
ucuguauauagcucuacaca

SEQ ID NO: 1180609 - RNA, 14 nt, Homo sapiens
ucuguauguuuacg

SEQ ID NO: 1180610 - RNA, 16 nt, Homo sapiens
ucugucagaaucacau

SEQ ID NO: 1180611 - RNA, 18 nt, Homo sapiens
ucuguccagcagucacuu

SEQ ID NO: 1180612 - RNA, 20 nt, Homo sapiens
ucugucccucacagcacuag

SEQ ID NO: 1180613 - RNA, 17 nt, Homo sapiens
ucugugcgcguggcgug

SEQ ID NO: 1180614 - RNA, 17 nt, Homo sapiens
ucugugcguguggcgug

SEQ ID NO: 1180615 - RNA, 12 nt, Homo sapiens
ucugugcuccaa

SEQ ID NO: 1180616 - RNA, 22 nt, Homo sapiens
ucugugcugguugccacccaag

SEQ ID NO: 1180617 - RNA, 17 nt, Homo sapiens
ucuguggcacucagaua

SEQ ID NO: 1180618 - RNA, 23 nt, Homo sapiens
ucugugggaagcucccagaguuu

SEQ ID NO: 1180619 - RNA, 24 nt, Homo sapiens
ucugugggaagcucccagaguuug

SEQ ID NO: 1180620 - RNA, 17 nt, Homo sapiens
ucugugggauaucacau

SEQ ID NO: 1180621 - RNA, 19 nt, Homo sapiens
ucugugggauaucacauca

SEQ ID NO: 1180622 - RNA, 17 nt, Homo sapiens
ucugugugcguggcgug

SEQ ID NO: 1180623 - RNA, 17 nt, Homo sapiens
ucuguguguguggcgug

SEQ ID NO: 1180624 - RNA, 17 nt, Homo sapiens
ucuguuaucgaacacau

SEQ ID NO: 1180625 - RNA, 17 nt, Homo sapiens
ucuguucccuugccauc

SEQ ID NO: 1180626 - RNA, 17 nt, Homo sapiens
ucuguugccauggugau

SEQ ID NO: 1180627 - RNA, 14 nt, Homo sapiens
ucuguuuacugcaa

SEQ ID NO: 1180628 - RNA, 17 nt, Homo sapiens
ucuguuuccuuguucca

SEQ ID NO: 1180629 - RNA, 20 nt, Homo sapiens
ucuguuuuauauagaaacac

SEQ ID NO: 1180630 - RNA, 17 nt, Homo sapiens
ucuguuuucugugcacu

SEQ ID NO: 1180631 - RNA, 17 nt, Homo sapiens
ucuguuuugaaggcaaa

SEQ ID NO: 1180632 - RNA, 20 nt, Homo sapiens
ucuguuuuuaaacaucuuag

SEQ ID NO: 1180633 - RNA, 19 nt, Homo sapiens
ucuuaaacuggaacaugcu

SEQ ID NO: 1180634 - RNA, 19 nt, Homo sapiens
ucuuaaccuuugcuaugua

SEQ ID NO: 1180635 - RNA, 14 nt, Homo sapiens
ucuuaacuauucaa

SEQ ID NO: 1180636 - RNA, 16 nt, Homo sapiens
ucuuaacuauucaaug

SEQ ID NO: 1180637 - RNA, 12 nt, Homo sapiens
ucuuaauacugu

SEQ ID NO: 1180638 - RNA, 22 nt, Homo sapiens
ucuuaauacuuuaugaugcuau

SEQ ID NO: 1180639 - RNA, 20 nt, Homo sapiens
ucuuaaugaaccuuagaaag

SEQ ID NO: 1180640 - RNA, 23 nt, Homo sapiens
ucuuaaugcagacaaacaaacau

SEQ ID NO: 1180641 - RNA, 21 nt, Homo sapiens
ucuuaauuaagaucauugaag

SEQ ID NO: 1180642 - RNA, 17 nt, Homo sapiens
ucuuaauuuugguugua

SEQ ID NO: 1180643 - RNA, 18 nt, Homo sapiens
ucuuacaaaagauuguca

SEQ ID NO: 1180644 - RNA, 12 nt, Homo sapiens
ucuuacacaaga

SEQ ID NO: 1180645 - RNA, 13 nt, Homo sapiens
ucuuacacaagag

SEQ ID NO: 1180646 - RNA, 15 nt, Homo sapiens
ucuuaccuacaaaau

SEQ ID NO: 1180647 - RNA, 11 nt, Homo sapiens
ucuuacuuugu

SEQ ID NO: 1180648 - RNA, 20 nt, Homo sapiens
ucuuagacggucuucacugu

SEQ ID NO: 1180649 - RNA, 20 nt, Homo sapiens
ucuuagauauucacuaagga

SEQ ID NO: 1180650 - RNA, 23 nt, Homo sapiens
ucuuagauauucacuaaggacuu

SEQ ID NO: 1180651 - RNA, 16 nt, Homo sapiens
ucuuagauucagggga

SEQ ID NO: 1180652 - RNA, 22 nt, Homo sapiens
ucuuaugauuacuaucauggca

SEQ ID NO: 1180653 - RNA, 16 nt, Homo sapiens
ucuuauugacucauac

SEQ ID NO: 1180654 - RNA, 22 nt, Homo sapiens
ucuuauuuucaaagcaguauag

SEQ ID NO: 1180655 - RNA, 22 nt, Homo sapiens
ucuucaacaugucacacuggcu

SEQ ID NO: 1180656 - RNA, 13 nt, Homo sapiens
ucuucaagacucu

SEQ ID NO: 1180657 - RNA, 15 nt, Homo sapiens
ucuucaauuuggaua

SEQ ID NO: 1180658 - RNA, 19 nt, Homo sapiens
ucuucacaaucuugaacau

SEQ ID NO: 1180659 - RNA, 14 nt, Homo sapiens
ucuucaccauuugg

SEQ ID NO: 1180660 - RNA, 19 nt, Homo sapiens
ucuucacugcuacaugugc

SEQ ID NO: 1180661 - RNA, 11 nt, Homo sapiens
ucuucagccac

SEQ ID NO: 1180662 - RNA, 17 nt, Homo sapiens
ucuucaguguaauguga

SEQ ID NO: 1180663 - RNA, 15 nt, Homo sapiens
ucuucauaguuuauu

SEQ ID NO: 1180664 - RNA, 20 nt, Homo sapiens
ucuucaugcuuuugcuugca

SEQ ID NO: 1180665 - RNA, 18 nt, Homo sapiens
ucuuccagaagugugauu

SEQ ID NO: 1180666 - RNA, 23 nt, Homo sapiens
ucuuccagaagugugauugggaa

SEQ ID NO: 1180667 - RNA, 15 nt, Homo sapiens
ucuucccugaccucc

SEQ ID NO: 1180668 - RNA, 23 nt, Homo sapiens
ucuucccuuuuacauacugcugu

SEQ ID NO: 1180669 - RNA, 18 nt, Homo sapiens
ucuuccucaagucuugac

SEQ ID NO: 1180670 - RNA, 17 nt, Homo sapiens
ucuuccuguucugugac

SEQ ID NO: 1180671 - RNA, 16 nt, Homo sapiens
ucuucuaugacccagc

SEQ ID NO: 1180672 - RNA, 17 nt, Homo sapiens
ucuucucaaagcuggga

SEQ ID NO: 1180673 - RNA, 23 nt, Homo sapiens
ucuucucaaguucuaagauucua

SEQ ID NO: 1180674 - RNA, 15 nt, Homo sapiens
ucuucucccuuugaa

SEQ ID NO: 1180675 - RNA, 20 nt, Homo sapiens
ucuucuccuaaaacuuuaaa

SEQ ID NO: 1180676 - RNA, 22 nt, Homo sapiens
ucuucugaauauuuuaucuuuc

SEQ ID NO: 1180677 - RNA, 15 nt, Homo sapiens
ucuucugagcacaga

SEQ ID NO: 1180678 - RNA, 22 nt, Homo sapiens
ucuucuuuuggcuuccaugaug

SEQ ID NO: 1180679 - RNA, 15 nt, Homo sapiens
ucuugaacuccugac

SEQ ID NO: 1180680 - RNA, 20 nt, Homo sapiens
ucuugaaguuacacauaacu

SEQ ID NO: 1180681 - RNA, 14 nt, Homo sapiens
ucuugaaucucuga

SEQ ID NO: 1180682 - RNA, 19 nt, Homo sapiens
ucuugacuacagucaggaa

SEQ ID NO: 1180683 - RNA, 14 nt, Homo sapiens
ucuugacuagugca

SEQ ID NO: 1180684 - RNA, 13 nt, Homo sapiens
ucuugaucuccug

SEQ ID NO: 1180685 - RNA, 13 nt, Homo sapiens
ucuugcagaucaa

SEQ ID NO: 1180686 - RNA, 16 nt, Homo sapiens
ucuugcuguugacaua

SEQ ID NO: 1180687 - RNA, 18 nt, Homo sapiens
ucuugcuuccaagaccau

SEQ ID NO: 1180688 - RNA, 13 nt, Homo sapiens
ucuuggacacugu

SEQ ID NO: 1180689 - RNA, 17 nt, Homo sapiens
ucuuggauuagccuuug

SEQ ID NO: 1180690 - RNA, 22 nt, Homo sapiens
ucuuggcuccccacauuggccg

SEQ ID NO: 1180691 - RNA, 12 nt, Homo sapiens
uccccaucucag

SEQ ID NO: 1180692 - RNA, 14 nt, Homo sapiens
ucccccaaagccau

SEQ ID NO: 1180693 - RNA, 15 nt, Homo sapiens
ucccccaaagccauc

SEQ ID NO: 1180694 - RNA, 15 nt, Homo sapiens
ucccccaaccaagga

SEQ ID NO: 1180695 - RNA, 12 nt, Homo sapiens
ucccccacugau

SEQ ID NO: 1180696 - RNA, 23 nt, Homo sapiens
uccccccccaggcccucccacca

SEQ ID NO: 1180697 - RNA, 23 nt, Homo sapiens
ucccccgugacagugacggcugc

SEQ ID NO: 1180698 - RNA, 14 nt, Homo sapiens
ucccccugugaaag

SEQ ID NO: 1180699 - RNA, 23 nt, Homo sapiens
uccccgauugaaagaaccagaga

SEQ ID NO: 1180700 - RNA, 19 nt, Homo sapiens
uccccgcccguuuuacaaa

SEQ ID NO: 1180701 - RNA, 16 nt, Homo sapiens
uccccgggcaucuuug

SEQ ID NO: 1180702 - RNA, 15 nt, Homo sapiens
uccccgggucucuca

SEQ ID NO: 1180703 - RNA, 17 nt, Homo sapiens
uccccuaaaccaaaaac

SEQ ID NO: 1180704 - RNA, 16 nt, Homo sapiens
uccccucagagugcaa

SEQ ID NO: 1180705 - RNA, 18 nt, Homo sapiens
uccccuccccaucugugu

SEQ ID NO: 1180706 - RNA, 23 nt, Homo sapiens
uccccuucccacuagccuagguc

SEQ ID NO: 1180707 - RNA, 21 nt, Homo sapiens
uccccuucucuaaaucagggu

SEQ ID NO: 1180708 - RNA, 23 nt, Homo sapiens
uccccuucucuaaaucagggugg

SEQ ID NO: 1180709 - RNA, 19 nt, Homo sapiens
uccccuugccuaaauacaa

SEQ ID NO: 1180710 - RNA, 20 nt, Homo sapiens
uccccuuuucuauguugcua

SEQ ID NO: 1180711 - RNA, 17 nt, Homo sapiens
ucccgagaguuuccauc

SEQ ID NO: 1180712 - RNA, 16 nt, Homo sapiens
ucccgaggcuacagca

SEQ ID NO: 1180713 - RNA, 20 nt, Homo sapiens
ucccgccaacgcaucacugg

SEQ ID NO: 1180714 - RNA, 17 nt, Homo sapiens
ucccggggccagcacuu

SEQ ID NO: 1180715 - RNA, 18 nt, Homo sapiens
ucccggggccagcacuuc

SEQ ID NO: 1180716 - RNA, 16 nt, Homo sapiens
ucccguggccuguaga

SEQ ID NO: 1180717 - RNA, 19 nt, Homo sapiens
ucccgugugccucuuuuau

SEQ ID NO: 1180718 - RNA, 23 nt, Homo sapiens
ucccguuucuuaaaaaacauaua

SEQ ID NO: 1180719 - RNA, 20 nt, Homo sapiens
ucccuaaaaacacagacauu

SEQ ID NO: 1180720 - RNA, 15 nt, Homo sapiens
ucccuaaauuugcau

SEQ ID NO: 1180721 - RNA, 12 nt, Homo sapiens
ucccuaacacuu

SEQ ID NO: 1180722 - RNA, 13 nt, Homo sapiens
ucccuacuccuac

SEQ ID NO: 1180723 - RNA, 12 nt, Homo sapiens
ucccuagccauu

SEQ ID NO: 1180724 - RNA, 13 nt, Homo sapiens
ucccucaacccca

SEQ ID NO: 1180725 - RNA, 23 nt, Homo sapiens
ucccucacagcacuaguauuuca

SEQ ID NO: 1180726 - RNA, 18 nt, Homo sapiens
ucccucccccccaugcac

SEQ ID NO: 1180727 - RNA, 22 nt, Homo sapiens
ucccucccccccaugcacugug

SEQ ID NO: 1180728 - RNA, 22 nt, Homo sapiens
ucccuccccuccccguccacag

SEQ ID NO: 1180729 - RNA, 18 nt, Homo sapiens
ucccuccgggcaggggag

SEQ ID NO: 1180730 - RNA, 17 nt, Homo sapiens
ucccuccucacucccua

SEQ ID NO: 1180731 - RNA, 20 nt, Homo sapiens
ucccucggggccauacuucu

SEQ ID NO: 1180732 - RNA, 19 nt, Homo sapiens
ucccucgucuucagcugca

SEQ ID NO: 1180733 - RNA, 16 nt, Homo sapiens
ucccucuaacaucucc

SEQ ID NO: 1180734 - RNA, 17 nt, Homo sapiens
ucccucucuuccgggag

SEQ ID NO: 1180735 - RNA, 21 nt, Homo sapiens
ucccucuggaaagaaacaugu

SEQ ID NO: 1180736 - RNA, 13 nt, Homo sapiens
ucccucuuguccu

SEQ ID NO: 1180737 - RNA, 14 nt, Homo sapiens
ucccugacuccucc

SEQ ID NO: 1180738 - RNA, 21 nt, Homo sapiens
ucccugagagccacaggugcc

SEQ ID NO: 1180739 - RNA, 22 nt, Homo sapiens
ucccugagaggauguagagauu

SEQ ID NO: 1180740 - RNA, 18 nt, Homo sapiens
ucccugaucccaguuucu

SEQ ID NO: 1180741 - RNA, 22 nt, Homo sapiens
ucccugccuaaggaagcuaaaa

SEQ ID NO: 1180742 - RNA, 12 nt, Homo sapiens
ucccugccucac

SEQ ID NO: 1180743 - RNA, 13 nt, Homo sapiens
ucccugccuccac

SEQ ID NO: 1180744 - RNA, 13 nt, Homo sapiens
ucccugggcauug

SEQ ID NO: 1180745 - RNA, 19 nt, Homo sapiens
ucccugggggaagcccugg

SEQ ID NO: 1180746 - RNA, 17 nt, Homo sapiens
ucccuguuuuaauucaa

SEQ ID NO: 1180747 - RNA, 20 nt, Homo sapiens
ucccuuagacuuuaguaguu

SEQ ID NO: 1180748 - RNA, 17 nt, Homo sapiens
ucccuugaggaaacaac

SEQ ID NO: 1180749 - RNA, 14 nt, Homo sapiens
ucccuugcuguaug

SEQ ID NO: 1180750 - RNA, 20 nt, Homo sapiens
ucccuuuuggggcaagacag

SEQ ID NO: 1180751 - RNA, 19 nt, Homo sapiens
ucccuuuuuauuugcagaa

SEQ ID NO: 1180752 - RNA, 15 nt, Homo sapiens
uccgacucaacacca

SEQ ID NO: 1180753 - RNA, 16 nt, Homo sapiens
uccgacucaacaccag

SEQ ID NO: 1180754 - RNA, 13 nt, Homo sapiens
uccgcauccuagu

SEQ ID NO: 1180755 - RNA, 13 nt, Homo sapiens
uccgccuaccuca

SEQ ID NO: 1180756 - RNA, 21 nt, Homo sapiens
uccggaagcugucgacuucau

SEQ ID NO: 1180757 - RNA, 16 nt, Homo sapiens
uccgucccucugucca

SEQ ID NO: 1180758 - RNA, 13 nt, Homo sapiens
uccgucucaaaaa

SEQ ID NO: 1180759 - RNA, 19 nt, Homo sapiens
uccgugaacuugugagaac

SEQ ID NO: 1180760 - RNA, 20 nt, Homo sapiens
uccguggcacugcauacaau

SEQ ID NO: 1180761 - RNA, 12 nt, Homo sapiens
uccuaacuuauu

SEQ ID NO: 1180762 - RNA, 13 nt, Homo sapiens
uccuaaugcuuuu

SEQ ID NO: 1180763 - RNA, 16 nt, Homo sapiens
uccuacagggccacaa

SEQ ID NO: 1180764 - RNA, 19 nt, Homo sapiens
uccuacuuauaaaguagaa

SEQ ID NO: 1180765 - RNA, 18 nt, Homo sapiens
uccuagagauuuggugua

SEQ ID NO: 1180766 - RNA, 14 nt, Homo sapiens
uccuagauggaacu

SEQ ID NO: 1180767 - RNA, 21 nt, Homo sapiens
uccuagauguuuccccagacc

SEQ ID NO: 1180768 - RNA, 15 nt, Homo sapiens
uccuagcaaccugcc

SEQ ID NO: 1180769 - RNA, 22 nt, Homo sapiens
uccuagccacccaccacacuga

SEQ ID NO: 1180770 - RNA, 19 nt, Homo sapiens
uccuagccaccgccuccua

SEQ ID NO: 1180771 - RNA, 24 nt, Homo sapiens
uccuaucaccucgagaaguaauua

SEQ ID NO: 1180772 - RNA, 14 nt, Homo sapiens
uccuaugugcugua

SEQ ID NO: 1180773 - RNA, 19 nt, Homo sapiens
uccucaagggccaggacuu

SEQ ID NO: 1180774 - RNA, 13 nt, Homo sapiens
uccucacacucca

SEQ ID NO: 1180775 - RNA, 14 nt, Homo sapiens
uccucaccgucucg

SEQ ID NO: 1180776 - RNA, 12 nt, Homo sapiens
uccucacgugca

SEQ ID NO: 1180777 - RNA, 16 nt, Homo sapiens
uccucacucaccuuca

SEQ ID NO: 1180778 - RNA, 11 nt, Homo sapiens
uccucacuccc

SEQ ID NO: 1180779 - RNA, 17 nt, Homo sapiens
uccucacugcugauuau

SEQ ID NO: 1180780 - RNA, 15 nt, Homo sapiens
uccucacuucuagau

SEQ ID NO: 1180781 - RNA, 20 nt, Homo sapiens
uccucaguuuuugugaaaag

SEQ ID NO: 1180782 - RNA, 19 nt, Homo sapiens
uccucauuucuccagauua

SEQ ID NO: 1180783 - RNA, 16 nt, Homo sapiens
uccuccaacaccaagc

SEQ ID NO: 1180784 - RNA, 22 nt, Homo sapiens
uccuccaacaccaagcacagca

SEQ ID NO: 1180785 - RNA, 13 nt, Homo sapiens
uccuccaacagcu

SEQ ID NO: 1180786 - RNA, 19 nt, Homo sapiens
uccuccagucuguucucac

SEQ ID NO: 1180787 - RNA, 12 nt, Homo sapiens
uccucccaacaa

SEQ ID NO: 1180788 - RNA, 14 nt, Homo sapiens
uccucccaaucuca

SEQ ID NO: 1180789 - RNA, 17 nt, Homo sapiens
uccucccagacuaccug

SEQ ID NO: 1180790 - RNA, 22 nt, Homo sapiens
uccucccagugccuucugggaa

SEQ ID NO: 1180791 - RNA, 16 nt, Homo sapiens
uccuccgcaugccaac

SEQ ID NO: 1180792 - RNA, 17 nt, Homo sapiens
uccuccuguuacuugcu

SEQ ID NO: 1180793 - RNA, 21 nt, Homo sapiens
uccucgaauuuuaucugugga

SEQ ID NO: 1180794 - RNA, 18 nt, Homo sapiens
uccucgagaucccaacac

SEQ ID NO: 1180795 - RNA, 19 nt, Homo sapiens
uccucguugguucaugugu

SEQ ID NO: 1180796 - RNA, 22 nt, Homo sapiens
uccucguugguucauguguugu

SEQ ID NO: 1180797 - RNA, 15 nt, Homo sapiens
uccucuccaugcaag

SEQ ID NO: 1180798 - RNA, 14 nt, Homo sapiens
uccucucccaguga

SEQ ID NO: 1180799 - RNA, 15 nt, Homo sapiens
uccucucccagugac

SEQ ID NO: 1180800 - RNA, 18 nt, Homo sapiens
uccucucccagugacaac

SEQ ID NO: 1180801 - RNA, 13 nt, Homo sapiens
uccucucugcaag

SEQ ID NO: 1180802 - RNA, 13 nt, Homo sapiens
uccucucuuggca

SEQ ID NO: 1180803 - RNA, 14 nt, Homo sapiens
uccucucuuggcau

SEQ ID NO: 1180804 - RNA, 15 nt, Homo sapiens
uccucugaaacagcu

SEQ ID NO: 1180805 - RNA, 21 nt, Homo sapiens
uccucugaaacagcugccuua

SEQ ID NO: 1180806 - RNA, 13 nt, Homo sapiens
uccucugauuuga

SEQ ID NO: 1180807 - RNA, 20 nt, Homo sapiens
uccucugcccgggagcucag

SEQ ID NO: 1180808 - RNA, 16 nt, Homo sapiens
uccucuguaaacuuuu

SEQ ID NO: 1180809 - RNA, 16 nt, Homo sapiens
uccugaaacaacuugg

SEQ ID NO: 1180810 - RNA, 22 nt, Homo sapiens
uccugaaaucaagucaucuaua

SEQ ID NO: 1180811 - RNA, 21 nt, Homo sapiens
uccugaaauuugagagacaaa

SEQ ID NO: 1180812 - RNA, 23 nt, Homo sapiens
uccugaagggaaggcaaaggcag

SEQ ID NO: 1180813 - RNA, 23 nt, Homo sapiens
uccugaauuggcuacuaguuuaa

SEQ ID NO: 1180814 - RNA, 19 nt, Homo sapiens
uccugacaacgucucuuca

SEQ ID NO: 1180815 - RNA, 18 nt, Homo sapiens
uccugaccucaagugauc

SEQ ID NO: 1180816 - RNA, 19 nt, Homo sapiens
uccugacucuucaggccag

SEQ ID NO: 1180817 - RNA, 20 nt, Homo sapiens
uccugacuucaugauccacc

SEQ ID NO: 1180818 - RNA, 15 nt, Homo sapiens
uccugagagcugcuu

SEQ ID NO: 1180819 - RNA, 23 nt, Homo sapiens
uccugagggagcuccaacucaga

SEQ ID NO: 1180820 - RNA, 20 nt, Homo sapiens
uccugaguagcugggauuac

SEQ ID NO: 1180821 - RNA, 18 nt, Homo sapiens
uccugauggaacuaagga

SEQ ID NO: 1180822 - RNA, 22 nt, Homo sapiens
uccugccacauuagaacuucuc

SEQ ID NO: 1180823 - RNA, 20 nt, Homo sapiens
uccugccaccagcauccaca

SEQ ID NO: 1180824 - RNA, 21 nt, Homo sapiens
uccugccagguuuaaacauca

SEQ ID NO: 1180825 - RNA, 12 nt, Homo sapiens
uauauucacuuu

SEQ ID NO: 1180826 - RNA, 18 nt, Homo sapiens
uauauuugggccugcucc

SEQ ID NO: 1180827 - RNA, 18 nt, Homo sapiens
uauauuuguaaagcuauu

SEQ ID NO: 1180828 - RNA, 17 nt, Homo sapiens
uauauuuugaugagcuu

SEQ ID NO: 1180829 - RNA, 20 nt, Homo sapiens
uauauuuugugcuaucagac

SEQ ID NO: 1180830 - RNA, 23 nt, Homo sapiens
uaucaaagugucguaucugggag

SEQ ID NO: 1180831 - RNA, 15 nt, Homo sapiens
uaucaaaugugaugg

SEQ ID NO: 1180832 - RNA, 19 nt, Homo sapiens
uaucaaccccagacacugg

SEQ ID NO: 1180833 - RNA, 15 nt, Homo sapiens
uaucaacugcugcuu

SEQ ID NO: 1180834 - RNA, 19 nt, Homo sapiens
uaucaacuggggggaccaa

SEQ ID NO: 1180835 - RNA, 14 nt, Homo sapiens
uaucaagcuuuuaa

SEQ ID NO: 1180836 - RNA, 14 nt, Homo sapiens
uaucacaagugauu

SEQ ID NO: 1180837 - RNA, 14 nt, Homo sapiens
uaucacgauauuau

SEQ ID NO: 1180838 - RNA, 20 nt, Homo sapiens
uaucacuguugcauauacca

SEQ ID NO: 1180839 - RNA, 19 nt, Homo sapiens
uaucacuucacuguucucu

SEQ ID NO: 1180840 - RNA, 20 nt, Homo sapiens
uaucagacuguaggauuuga

SEQ ID NO: 1180841 - RNA, 18 nt, Homo sapiens
uaucagaucuaucuuguc

SEQ ID NO: 1180842 - RNA, 23 nt, Homo sapiens
uaucagccgauaucaacacuugu

SEQ ID NO: 1180843 - RNA, 11 nt, Homo sapiens
uaucaguuccc

SEQ ID NO: 1180844 - RNA, 21 nt, Homo sapiens
uaucaguugagcuucauauac

SEQ ID NO: 1180845 - RNA, 13 nt, Homo sapiens
uaucauacuucca

SEQ ID NO: 1180846 - RNA, 20 nt, Homo sapiens
uaucauauuauuauccuccu

SEQ ID NO: 1180847 - RNA, 21 nt, Homo sapiens
uaucaugcuuugaaaaaucac

SEQ ID NO: 1180848 - RNA, 22 nt, Homo sapiens
uaucauuaaccacuuaucagug

SEQ ID NO: 1180849 - RNA, 23 nt, Homo sapiens
uaucauugcuaaacugaugacuu

SEQ ID NO: 1180850 - RNA, 14 nt, Homo sapiens
uauccacuuagcac

SEQ ID NO: 1180851 - RNA, 19 nt, Homo sapiens
uauccagauggaggcacca

SEQ ID NO: 1180852 - RNA, 21 nt, Homo sapiens
uauccagauggaggcaccaaa

SEQ ID NO: 1180853 - RNA, 14 nt, Homo sapiens
uauccagccuccca

SEQ ID NO: 1180854 - RNA, 19 nt, Homo sapiens
uauccauuaucauguguaa

SEQ ID NO: 1180855 - RNA, 18 nt, Homo sapiens
uaucccuagugcuccaua

SEQ ID NO: 1180856 - RNA, 16 nt, Homo sapiens
uaucccuuaccugcuu

SEQ ID NO: 1180857 - RNA, 19 nt, Homo sapiens
uauccgugaaaaguugaua

SEQ ID NO: 1180858 - RNA, 13 nt, Homo sapiens
uauccucuugcca

SEQ ID NO: 1180859 - RNA, 16 nt, Homo sapiens
uauccugggccucagc

SEQ ID NO: 1180860 - RNA, 16 nt, Homo sapiens
uaucggggaagccaga

SEQ ID NO: 1180861 - RNA, 17 nt, Homo sapiens
uaucggggaagccagac

SEQ ID NO: 1180862 - RNA, 12 nt, Homo sapiens
uaucuacuacaa

SEQ ID NO: 1180863 - RNA, 20 nt, Homo sapiens
uaucuauacauaauggcuga

SEQ ID NO: 1180864 - RNA, 15 nt, Homo sapiens
uaucuauagcugcua

SEQ ID NO: 1180865 - RNA, 13 nt, Homo sapiens
uaucucagccaua

SEQ ID NO: 1180866 - RNA, 14 nt, Homo sapiens
uaucucagccauag

SEQ ID NO: 1180867 - RNA, 17 nt, Homo sapiens
uaucuccuccccuugaa

SEQ ID NO: 1180868 - RNA, 20 nt, Homo sapiens
uaucugggagaugaccugcc

SEQ ID NO: 1180869 - RNA, 19 nt, Homo sapiens
uaucugguaucugcaugua

SEQ ID NO: 1180870 - RNA, 17 nt, Homo sapiens
uaucuuguuuuuccacu

SEQ ID NO: 1180871 - RNA, 20 nt, Homo sapiens
uaucuuuguaauaaaacugc

SEQ ID NO: 1180872 - RNA, 17 nt, Homo sapiens
uaucuuuuggcucugaa

SEQ ID NO: 1180873 - RNA, 19 nt, Homo sapiens
uaugaaaauacaacuuaaa

SEQ ID NO: 1180874 - RNA, 13 nt, Homo sapiens
uaugacaacucuu

SEQ ID NO: 1180875 - RNA, 15 nt, Homo sapiens
uaugacaacucuuau

SEQ ID NO: 1180876 - RNA, 18 nt, Homo sapiens
uaugacauggaggcacug

SEQ ID NO: 1180877 - RNA, 23 nt, Homo sapiens
uaugaccucgcccuccacaaaug

SEQ ID NO: 1180878 - RNA, 24 nt, Homo sapiens
uaugaggggguuuggcaccaagcu

SEQ ID NO: 1180879 - RNA, 21 nt, Homo sapiens
uaugaguauaaugaacacuca

SEQ ID NO: 1180880 - RNA, 17 nt, Homo sapiens
uaugauaaaacacugcc

SEQ ID NO: 1180881 - RNA, 15 nt, Homo sapiens
uaugauauugcagcu

SEQ ID NO: 1180882 - RNA, 16 nt, Homo sapiens
uaugauggaacaguga

SEQ ID NO: 1180883 - RNA, 15 nt, Homo sapiens
uaugauucguguaau

SEQ ID NO: 1180884 - RNA, 13 nt, Homo sapiens
uaugcaaccauaa

SEQ ID NO: 1180885 - RNA, 14 nt, Homo sapiens
uaugcacugaauaa

SEQ ID NO: 1180886 - RNA, 14 nt, Homo sapiens
uaugcagaauguug

SEQ ID NO: 1180887 - RNA, 19 nt, Homo sapiens
uaugcagcuaucuggucaa

SEQ ID NO: 1180888 - RNA, 18 nt, Homo sapiens
uaugcaucugcuacugug

SEQ ID NO: 1180889 - RNA, 22 nt, Homo sapiens
uaugcaucugcuacugugucag

SEQ ID NO: 1180890 - RNA, 22 nt, Homo sapiens
uaugcauuauaaauaaauacca

SEQ ID NO: 1180891 - RNA, 17 nt, Homo sapiens
uaugcauugucugcaau

SEQ ID NO: 1180892 - RNA, 16 nt, Homo sapiens
uaugccaagagugcac

SEQ ID NO: 1180893 - RNA, 21 nt, Homo sapiens
uaugccauggaggcacuaaca

SEQ ID NO: 1180894 - RNA, 23 nt, Homo sapiens
uaugcccacauuuagucucuuua

SEQ ID NO: 1180895 - RNA, 18 nt, Homo sapiens
uaugcccauucuuuucac

SEQ ID NO: 1180896 - RNA, 21 nt, Homo sapiens
uaugcucucgcaccuuuccaa

SEQ ID NO: 1180897 - RNA, 16 nt, Homo sapiens
uaugcugacagcucuu

SEQ ID NO: 1180898 - RNA, 20 nt, Homo sapiens
uaugcugacagcucuucaca

SEQ ID NO: 1180899 - RNA, 22 nt, Homo sapiens
uaugcuggagauggacaacuca

SEQ ID NO: 1180900 - RNA, 12 nt, Homo sapiens
uauggacucugc

SEQ ID NO: 1180901 - RNA, 16 nt, Homo sapiens
uauggacuuggcugua

SEQ ID NO: 1180902 - RNA, 17 nt, Homo sapiens
uauggacuuggcuguau

SEQ ID NO: 1180903 - RNA, 13 nt, Homo sapiens
uauggaguagcca

SEQ ID NO: 1180904 - RNA, 18 nt, Homo sapiens
uauggaucgaucuacguc

SEQ ID NO: 1180905 - RNA, 15 nt, Homo sapiens
uauggauucauuuau

SEQ ID NO: 1180906 - RNA, 22 nt, Homo sapiens
uauggcaucucauugaggacaa

SEQ ID NO: 1180907 - RNA, 16 nt, Homo sapiens
uauggcuccuccauau

SEQ ID NO: 1180908 - RNA, 19 nt, Homo sapiens
uauggcuuuuagcauuuau

SEQ ID NO: 1180909 - RNA, 22 nt, Homo sapiens
uaugggugggaauaaaauuucu

SEQ ID NO: 1180910 - RNA, 18 nt, Homo sapiens
uauggguuaaaucaaaga

SEQ ID NO: 1180911 - RNA, 20 nt, Homo sapiens
uaugguauauauacauauau

SEQ ID NO: 1180912 - RNA, 18 nt, Homo sapiens
uaugguguacauucuucc

SEQ ID NO: 1180913 - RNA, 15 nt, Homo sapiens
uaugguucugcaguc

SEQ ID NO: 1180914 - RNA, 22 nt, Homo sapiens
uauguaacaaaccugcacuuau

SEQ ID NO: 1180915 - RNA, 13 nt, Homo sapiens
uauguaacaugua

SEQ ID NO: 1180916 - RNA, 16 nt, Homo sapiens
uauguaccaagaaucu

SEQ ID NO: 1180917 - RNA, 18 nt, Homo sapiens
uauguaccaagaaucuug

SEQ ID NO: 1180918 - RNA, 20 nt, Homo sapiens
uauguagaagcaugaagucu

SEQ ID NO: 1180919 - RNA, 23 nt, Homo sapiens
uagcuuguuuuauuuugugcuau

SEQ ID NO: 1180920 - RNA, 13 nt, Homo sapiens
uagcuuucaauuc

SEQ ID NO: 1180921 - RNA, 21 nt, Homo sapiens
uagcuuucaauuccguagcca

SEQ ID NO: 1180922 - RNA, 17 nt, Homo sapiens
uaggaaaaaaacuauua

SEQ ID NO: 1180923 - RNA, 19 nt, Homo sapiens
uaggaaagaagagaaccau

SEQ ID NO: 1180924 - RNA, 22 nt, Homo sapiens
uaggaaggcagcauuccaugac

SEQ ID NO: 1180925 - RNA, 20 nt, Homo sapiens
uaggacaaaugauaaguacu

SEQ ID NO: 1180926 - RNA, 16 nt, Homo sapiens
uaggacccaagcagag

SEQ ID NO: 1180927 - RNA, 14 nt, Homo sapiens
uaggagacuugcca

SEQ ID NO: 1180928 - RNA, 17 nt, Homo sapiens
uaggagauagaagaaga

SEQ ID NO: 1180929 - RNA, 21 nt, Homo sapiens
uaggagcuaaggcucuaugag

SEQ ID NO: 1180930 - RNA, 17 nt, Homo sapiens
uaggaggagugagacag

SEQ ID NO: 1180931 - RNA, 21 nt, Homo sapiens
uaggcacuguaguucuaagac

SEQ ID NO: 1180932 - RNA, 16 nt, Homo sapiens
uaggcauagcuacgug

SEQ ID NO: 1180933 - RNA, 21 nt, Homo sapiens
uaggcaugguggacucgccug

SEQ ID NO: 1180934 - RNA, 12 nt, Homo sapiens
uaggcauguaaa

SEQ ID NO: 1180935 - RNA, 21 nt, Homo sapiens
uaggcauguagcuacaggaca

SEQ ID NO: 1180936 - RNA, 19 nt, Homo sapiens
uaggcauucuaagucacag

SEQ ID NO: 1180937 - RNA, 19 nt, Homo sapiens
uaggcuuacguacuacuug

SEQ ID NO: 1180938 - RNA, 15 nt, Homo sapiens
uagggacuuugggcu

SEQ ID NO: 1180939 - RNA, 14 nt, Homo sapiens
uagggaucccucau

SEQ ID NO: 1180940 - RNA, 15 nt, Homo sapiens
uagggaugugugaga

SEQ ID NO: 1180941 - RNA, 19 nt, Homo sapiens
uaggggauggggaggaaga

SEQ ID NO: 1180942 - RNA, 23 nt, Homo sapiens
uagggggagccccuucugcucag

SEQ ID NO: 1180943 - RNA, 15 nt, Homo sapiens
uaggguccugaaugu

SEQ ID NO: 1180944 - RNA, 15 nt, Homo sapiens
uagguaauuugccac

SEQ ID NO: 1180945 - RNA, 14 nt, Homo sapiens
uagguacauuggaa

SEQ ID NO: 1180946 - RNA, 14 nt, Homo sapiens
uagguaucauucaa

SEQ ID NO: 1180947 - RNA, 11 nt, Homo sapiens
uaggugccuuu

SEQ ID NO: 1180948 - RNA, 14 nt, Homo sapiens
uaggugucucauag

SEQ ID NO: 1180949 - RNA, 22 nt, Homo sapiens
uagguuaguagcccuucagucu

SEQ ID NO: 1180950 - RNA, 16 nt, Homo sapiens
uagguugacagauacu

SEQ ID NO: 1180951 - RNA, 14 nt, Homo sapiens
uagguuggacugga

SEQ ID NO: 1180952 - RNA, 16 nt, Homo sapiens
uagguuuuuaugggaa

SEQ ID NO: 1180953 - RNA, 12 nt, Homo sapiens
uaguaacacuaa

SEQ ID NO: 1180954 - RNA, 14 nt, Homo sapiens
uaguaacauagaca

SEQ ID NO: 1180955 - RNA, 16 nt, Homo sapiens
uaguaacauagacaaa

SEQ ID NO: 1180956 - RNA, 12 nt, Homo sapiens
uaguaacaugug

SEQ ID NO: 1180957 - RNA, 20 nt, Homo sapiens
uaguaaugcuacgugugauu

SEQ ID NO: 1180958 - RNA, 16 nt, Homo sapiens
uaguacauaaucuuua

SEQ ID NO: 1180959 - RNA, 20 nt, Homo sapiens
uaguaccuuguuuugccaug

SEQ ID NO: 1180960 - RNA, 11 nt, Homo sapiens
uaguacuaagc

SEQ ID NO: 1180961 - RNA, 19 nt, Homo sapiens
uaguacuuuaugcaucucu

SEQ ID NO: 1180962 - RNA, 15 nt, Homo sapiens
uaguagagacagggu

SEQ ID NO: 1180963 - RNA, 17 nt, Homo sapiens
uaguaguguaagcuaga

SEQ ID NO: 1180964 - RNA, 20 nt, Homo sapiens
uagucaagugcguccacgag

SEQ ID NO: 1180965 - RNA, 17 nt, Homo sapiens
uagucaauuucuacuuc

SEQ ID NO: 1180966 - RNA, 20 nt, Homo sapiens
uagucacauggccuaugcac

SEQ ID NO: 1180967 - RNA, 23 nt, Homo sapiens
uagucacauggccuaugcacaua

SEQ ID NO: 1180968 - RNA, 12 nt, Homo sapiens
uagucauacucc

SEQ ID NO: 1180969 - RNA, 20 nt, Homo sapiens
uagucauacucccuggugua

SEQ ID NO: 1180970 - RNA, 14 nt, Homo sapiens
uaguccaauuccuu

SEQ ID NO: 1180971 - RNA, 19 nt, Homo sapiens
uaguccuagugaaccucac

SEQ ID NO: 1180972 - RNA, 21 nt, Homo sapiens
uagucuccacuuucucaaugc

SEQ ID NO: 1180973 - RNA, 13 nt, Homo sapiens
uagugaacuugaa

SEQ ID NO: 1180974 - RNA, 19 nt, Homo sapiens
uagugacauuuaaugccau

SEQ ID NO: 1180975 - RNA, 21 nt, Homo sapiens
uagugcaaggaaugacucaug

SEQ ID NO: 1180976 - RNA, 23 nt, Homo sapiens
uagugccaauguuguguguugca

SEQ ID NO: 1180977 - RNA, 20 nt, Homo sapiens
uagugggagguugugcaugg

SEQ ID NO: 1180978 - RNA, 21 nt, Homo sapiens
uagugggcaccccacugcaau

SEQ ID NO: 1180979 - RNA, 21 nt, Homo sapiens
uaguguauuuucugucacugu

SEQ ID NO: 1180980 - RNA, 17 nt, Homo sapiens
uagugucucauguggaa

SEQ ID NO: 1180981 - RNA, 12 nt, Homo sapiens
uaguuaaccaau

SEQ ID NO: 1180982 - RNA, 21 nt, Homo sapiens
uaguuaccacauuacucugcc

SEQ ID NO: 1180983 - RNA, 14 nt, Homo sapiens
uaguucaauagucu

SEQ ID NO: 1180984 - RNA, 14 nt, Homo sapiens
uaguucagcugccc

SEQ ID NO: 1180985 - RNA, 13 nt, Homo sapiens
uaguucugccagg

SEQ ID NO: 1180986 - RNA, 19 nt, Homo sapiens
uaguugcguggacucugca

SEQ ID NO: 1180987 - RNA, 15 nt, Homo sapiens
uaguuuaggcuggaa

SEQ ID NO: 1180988 - RNA, 22 nt, Homo sapiens
uaguuuaguagccuuacuguga

SEQ ID NO: 1180989 - RNA, 20 nt, Homo sapiens
uaguuuaucauuaaccacuu

SEQ ID NO: 1180990 - RNA, 16 nt, Homo sapiens
uaguuugcaacuucaa

SEQ ID NO: 1180991 - RNA, 22 nt, Homo sapiens
uaguuuguaugccaagugagaa

SEQ ID NO: 1180992 - RNA, 15 nt, Homo sapiens
uauaaaaagcuucca

SEQ ID NO: 1180993 - RNA, 18 nt, Homo sapiens
uauaaaauauaaacaaag

SEQ ID NO: 1180994 - RNA, 20 nt, Homo sapiens
uauaaacagacaauauguga

SEQ ID NO: 1180995 - RNA, 23 nt, Homo sapiens
uauaaagauacagaacucuuuca

SEQ ID NO: 1180996 - RNA, 15 nt, Homo sapiens
uauaaagauggcuga

SEQ ID NO: 1180997 - RNA, 18 nt, Homo sapiens
uauaaaggauuaauguca

SEQ ID NO: 1180998 - RNA, 22 nt, Homo sapiens
uauaaaguuuuauuugaaugaa

SEQ ID NO: 1180999 - RNA, 18 nt, Homo sapiens
uauaaauacacuuccugc

SEQ ID NO: 1181000 - RNA, 17 nt, Homo sapiens
uauaaauaugaagcuca

SEQ ID NO: 1181001 - RNA, 13 nt, Homo sapiens
uauaaaugugauu

SEQ ID NO: 1181002 - RNA, 22 nt, Homo sapiens
uauaacaaagacuucugucaua

SEQ ID NO: 1181003 - RNA, 12 nt, Homo sapiens
uauaacccaaaa

SEQ ID NO: 1181004 - RNA, 19 nt, Homo sapiens
uauaacccagugaguucag

SEQ ID NO: 1181005 - RNA, 14 nt, Homo sapiens
uauaacgucaugug

SEQ ID NO: 1181006 - RNA, 18 nt, Homo sapiens
uauaagaaagaucaaaga

SEQ ID NO: 1181007 - RNA, 21 nt, Homo sapiens
uauaagcccaauaucagcucu

SEQ ID NO: 1181008 - RNA, 20 nt, Homo sapiens
uauaaggacagaccaaaaau

SEQ ID NO: 1181009 - RNA, 19 nt, Homo sapiens
uauaauaaagaaguguucu

SEQ ID NO: 1181010 - RNA, 17 nt, Homo sapiens
uauaauacuacuacugu

SEQ ID NO: 1181011 - RNA, 20 nt, Homo sapiens
uauaaugccauuuuaaggaa

SEQ ID NO: 1181012 - RNA, 22 nt, Homo sapiens
uauaauucuuauggcugcugaa

SEQ ID NO: 1181013 - RNA, 23 nt, Homo sapiens
uauaauuguaucguauagcugua

SEQ ID NO: 1181014 - RNA, 17 nt, Homo sapiens
uauaauuuauauuuugg

SEQ ID NO: 1181015 - RNA, 15 nt, Homo sapiens
uauacaacuguaaag

SEQ ID NO: 1181016 - RNA, 23 nt, Homo sapiens
uauacaauaaagucuuaccucag

SEQ ID NO: 1181017 - RNA, 16 nt, Homo sapiens
uauacauuuacuguga

SEQ ID NO: 1181018 - RNA, 22 nt, Homo sapiens
aaaagcaaaggauguguuuuca

SEQ ID NO: 1181019 - RNA, 15 nt, Homo sapiens
aaaagcaugugucau

SEQ ID NO: 1181020 - RNA, 14 nt, Homo sapiens
aaaagcuguggaau

SEQ ID NO: 1181021 - RNA, 12 nt, Homo sapiens
aaaagcuuuaaa

SEQ ID NO: 1181022 - RNA, 19 nt, Homo sapiens
aaaaggaacaaaaauuaca

SEQ ID NO: 1181023 - RNA, 22 nt, Homo sapiens
aaaaggauauuaucuaccuguu

SEQ ID NO: 1181024 - RNA, 21 nt, Homo sapiens
aaaagggucaaaccuguagau

SEQ ID NO: 1181025 - RNA, 19 nt, Homo sapiens
aaaagguuaaauauuguca

SEQ ID NO: 1181026 - RNA, 20 nt, Homo sapiens
aaaagguuaaauauugucau

SEQ ID NO: 1181027 - RNA, 21 nt, Homo sapiens
aaaagguuugagauuccugua

SEQ ID NO: 1181028 - RNA, 15 nt, Homo sapiens
aaaaguaaacaacau

SEQ ID NO: 1181029 - RNA, 15 nt, Homo sapiens
aaaagucaguaucau

SEQ ID NO: 1181030 - RNA, 14 nt, Homo sapiens
aaaagugccucaag

SEQ ID NO: 1181031 - RNA, 11 nt, Homo sapiens
aaaaguuauuu

SEQ ID NO: 1181032 - RNA, 22 nt, Homo sapiens
aaaaguuuuuuuuuuguuuguu

SEQ ID NO: 1181033 - RNA, 15 nt, Homo sapiens
aaaauaaaaaaugug

SEQ ID NO: 1181034 - RNA, 14 nt, Homo sapiens
aaaauaaaccaaau

SEQ ID NO: 1181035 - RNA, 17 nt, Homo sapiens
aaaauaacaaagcccuu

SEQ ID NO: 1181036 - RNA, 14 nt, Homo sapiens
aaaauaagcauuug

SEQ ID NO: 1181037 - RNA, 14 nt, Homo sapiens
aaaauaauuguucc

SEQ ID NO: 1181038 - RNA, 22 nt, Homo sapiens
aaacugcucagcgcgucucagc

SEQ ID NO: 1181039 - RNA, 14 nt, Homo sapiens
aaacugcugccuga

SEQ ID NO: 1181040 - RNA, 16 nt, Homo sapiens
aaacugucacaaguug

SEQ ID NO: 1181041 - RNA, 14 nt, Homo sapiens
aaacuucacugugc

SEQ ID NO: 1181042 - RNA, 13 nt, Homo sapiens
aaacuugaucaca

SEQ ID NO: 1181043 - RNA, 21 nt, Homo sapiens
aaacuuuaaaucgccccagag

SEQ ID NO: 1181044 - RNA, 15 nt, Homo sapiens
aaagaaaaaccacga

SEQ ID NO: 1181045 - RNA, 19 nt, Homo sapiens
aaagaaaaauaucuuggcc

SEQ ID NO: 1181046 - RNA, 19 nt, Homo sapiens
aaagaaaaauuaucuugaa

SEQ ID NO: 1181047 - RNA, 13 nt, Homo sapiens
aaagaaaacauuc

SEQ ID NO: 1181048 - RNA, 19 nt, Homo sapiens
aaagaaaaucucugugaaa

SEQ ID NO: 1181049 - RNA, 15 nt, Homo sapiens
aaagaaacacgcacu

SEQ ID NO: 1181050 - RNA, 14 nt, Homo sapiens
aaagaaacacucaa

SEQ ID NO: 1181051 - RNA, 19 nt, Homo sapiens
aaagaacaugcaguuugaa

SEQ ID NO: 1181052 - RNA, 12 nt, Homo sapiens
aaagaagagccg

SEQ ID NO: 1181053 - RNA, 22 nt, Homo sapiens
aaagaagcuucaugccagguua

SEQ ID NO: 1181054 - RNA, 21 nt, Homo sapiens
aaagaagguuggugaauuuca

SEQ ID NO: 1181055 - RNA, 21 nt, Homo sapiens
aacaauuacauggcucuaaaa

SEQ ID NO: 1181056 - RNA, 13 nt, Homo sapiens
aacaauuccacac

SEQ ID NO: 1181057 - RNA, 18 nt, Homo sapiens
aacaauuuuuuugaaucu

SEQ ID NO: 1181058 - RNA, 13 nt, Homo sapiens
aacacaaggucau

SEQ ID NO: 1181059 - RNA, 17 nt, Homo sapiens
aacacaauuaaaugacu

SEQ ID NO: 1181060 - RNA, 13 nt, Homo sapiens
aacacagaggcag

SEQ ID NO: 1181061 - RNA, 11 nt, Homo sapiens
aacacagggaa

SEQ ID NO: 1181062 - RNA, 18 nt, Homo sapiens
aacaccacgucacuucau

SEQ ID NO: 1181063 - RNA, 23 nt, Homo sapiens
aacaccagacagacaacacuggg

SEQ ID NO: 1181064 - RNA, 10 nt, Homo sapiens
aacuauuuau

SEQ ID NO: 1181065 - RNA, 19 nt, Homo sapiens
aacuauuuuauucuaaaca

SEQ ID NO: 1181066 - RNA, 23 nt, Homo sapiens
aacucaaauggggccagauccag

SEQ ID NO: 1181067 - RNA, 21 nt, Homo sapiens
aacucagaaugaaaauucauu

SEQ ID NO: 1181068 - RNA, 22 nt, Homo sapiens
aacucaugacugagucuggcaa

SEQ ID NO: 1181069 - RNA, 17 nt, Homo sapiens
aacucauuagacuggaa

SEQ ID NO: 1181070 - RNA, 16 nt, Homo sapiens
aacuccaggcugggcu

SEQ ID NO: 1181071 - RNA, 13 nt, Homo sapiens
aacucccacuccu

SEQ ID NO: 1181072 - RNA, 20 nt, Homo sapiens
aacucccagccacagcauuu

SEQ ID NO: 1181073 - RNA, 21 nt, Homo sapiens
aacucccauuaaaaacaaaac

SEQ ID NO: 1181074 - RNA, 21 nt, Homo sapiens
aacucccuccucacacuccag

SEQ ID NO: 1181075 - RNA, 18 nt, Homo sapiens
aacuccugaaaugccaag

SEQ ID NO: 1181076 - RNA, 17 nt, Homo sapiens
aacuccugaccccagau

SEQ ID NO: 1181077 - RNA, 18 nt, Homo sapiens
aacuccuuguuaauccag

SEQ ID NO: 1181078 - RNA, 21 nt, Homo sapiens
aacuccuuguuaauccaguga

SEQ ID NO: 1181079 - RNA, 23 nt, Homo sapiens
aacucucugucuucucuccacuu

SEQ ID NO: 1181080 - RNA, 21 nt, Homo sapiens
aacucucuucuuccauuagaa

SEQ ID NO: 1181081 - RNA, 12 nt, Homo sapiens
aacucuguacaa

SEQ ID NO: 1181082 - RNA, 19 nt, Homo sapiens
aacucuguuauucuucaaa

SEQ ID NO: 1181083 - RNA, 21 nt, Homo sapiens
aacucuguugguuuacugugu

SEQ ID NO: 1181084 - RNA, 13 nt, Homo sapiens
aacucuuaagcaa

SEQ ID NO: 1181085 - RNA, 18 nt, Homo sapiens
aacucuuauuacuguugg

SEQ ID NO: 1181086 - RNA, 13 nt, Homo sapiens
aacucuucacucu

SEQ ID NO: 1181087 - RNA, 15 nt, Homo sapiens
aacucuucaguuaau

SEQ ID NO: 1181088 - RNA, 21 nt, Homo sapiens
aacucuucaguuaauucuuag

SEQ ID NO: 1181089 - RNA, 22 nt, Homo sapiens
aacugagcaucuccagcauucu

SEQ ID NO: 1181090 - RNA, 18 nt, Homo sapiens
aacugaggugcaaagggg

SEQ ID NO: 1181091 - RNA, 21 nt, Homo sapiens
aacugcagaauuuugcacagu

SEQ ID NO: 1181092 - RNA, 15 nt, Homo sapiens
aacugccauaacaua

SEQ ID NO: 1181093 - RNA, 11 nt, Homo sapiens
aacugccucag

SEQ ID NO: 1181094 - RNA, 18 nt, Homo sapiens
aacugccuccuugccagc

SEQ ID NO: 1181095 - RNA, 19 nt, Homo sapiens
aacugccucgaaacacaga

SEQ ID NO: 1181096 - RNA, 20 nt, Homo sapiens
aacuggaagauacauaaaag

SEQ ID NO: 1181097 - RNA, 14 nt, Homo sapiens
aacuggaugggaga

SEQ ID NO: 1181098 - RNA, 23 nt, Homo sapiens
aacugggaugaaacuaaagcaau

SEQ ID NO: 1181099 - RNA, 22 nt, Homo sapiens
aacugggccuguagcucaagag

SEQ ID NO: 1181100 - RNA, 17 nt, Homo sapiens
aacugggcucaagugau

SEQ ID NO: 1181101 - RNA, 17 nt, Homo sapiens
aacugguuuuagacaaa

SEQ ID NO: 1181102 - RNA, 13 nt, Homo sapiens
aacuguaagucau

SEQ ID NO: 1181103 - RNA, 20 nt, Homo sapiens
aacuguauacauuacaauca

SEQ ID NO: 1181104 - RNA, 13 nt, Homo sapiens
aacuguauggaau

SEQ ID NO: 1181105 - RNA, 21 nt, Homo sapiens
aacugucccugcuuucuggua

SEQ ID NO: 1181106 - RNA, 17 nt, Homo sapiens
aacugucugacuuauaa

SEQ ID NO: 1181107 - RNA, 17 nt, Homo sapiens
aacugugaagaucucac

SEQ ID NO: 1181108 - RNA, 13 nt, Homo sapiens
aacugugccuugu

SEQ ID NO: 1181109 - RNA, 15 nt, Homo sapiens
aacuguucaaacuca

SEQ ID NO: 1181110 - RNA, 11 nt, Homo sapiens
aacuguugcuc

SEQ ID NO: 1181111 - RNA, 19 nt, Homo sapiens
aacuuaaaagucaguauca

SEQ ID NO: 1181112 - RNA, 18 nt, Homo sapiens
aacuuaaagaucauaaac

SEQ ID NO: 1181113 - RNA, 13 nt, Homo sapiens
aacuuaacauuca

SEQ ID NO: 1181114 - RNA, 15 nt, Homo sapiens
aacuuacacugauca

SEQ ID NO: 1181115 - RNA, 22 nt, Homo sapiens
aacuuacacugaucaauuucaa

SEQ ID NO: 1181116 - RNA, 22 nt, Homo sapiens
aacuuacauacuaggugccuuu

SEQ ID NO: 1181117 - RNA, 18 nt, Homo sapiens
aacuuacuaaauaucaua

SEQ ID NO: 1181118 - RNA, 24 nt, Homo sapiens
aacuuagaaggauggcaucuccau

SEQ ID NO: 1181119 - RNA, 14 nt, Homo sapiens
aacuuagagaauaa

SEQ ID NO: 1181120 - RNA, 21 nt, Homo sapiens
aacuucaagggacaaguauua

SEQ ID NO: 1181121 - RNA, 20 nt, Homo sapiens
aacuucacagugacacugga

SEQ ID NO: 1181122 - RNA, 13 nt, Homo sapiens
aacuucaccugca

SEQ ID NO: 1181123 - RNA, 17 nt, Homo sapiens
aacuucaccugcaaagc

SEQ ID NO: 1181124 - RNA, 15 nt, Homo sapiens
aacuucaucuucccc

SEQ ID NO: 1181125 - RNA, 22 nt, Homo sapiens
aacuucugccucccaugcuuac

SEQ ID NO: 1181126 - RNA, 15 nt, Homo sapiens
aacuugaacugauuc

SEQ ID NO: 1181127 - RNA, 22 nt, Homo sapiens
aacuugcagaauugagagugau

SEQ ID NO: 1181128 - RNA, 12 nt, Homo sapiens
aacuugccaugu

SEQ ID NO: 1181129 - RNA, 23 nt, Homo sapiens
aacuugggaauaaaucauagcaa

SEQ ID NO: 1181130 - RNA, 19 nt, Homo sapiens
aacuuguccuuccucaaga

SEQ ID NO: 1181131 - RNA, 17 nt, Homo sapiens
aacuuuaagaaagguaa

SEQ ID NO: 1181132 - RNA, 22 nt, Homo sapiens
aacuuugcauagcagcugcuac

SEQ ID NO: 1181133 - RNA, 16 nt, Homo sapiens
aacuuuggaacagggu

SEQ ID NO: 1181134 - RNA, 21 nt, Homo sapiens
aacuuuggaguuaguggauaa

SEQ ID NO: 1181135 - RNA, 15 nt, Homo sapiens
aacuuuguaugucau

SEQ ID NO: 1181136 - RNA, 17 nt, Homo sapiens
aacuuugucacaucuaa

SEQ ID NO: 1181137 - RNA, 12 nt, Homo sapiens
aacuuuuaucua

SEQ ID NO: 1181138 - RNA, 19 nt, Homo sapiens
aacuuuuuaaagugacaua

SEQ ID NO: 1181139 - RNA, 15 nt, Homo sapiens
aacuuuuugccaaau

SEQ ID NO: 1181140 - RNA, 17 nt, Homo sapiens
aagaaaaaaaccaaagu

SEQ ID NO: 1181141 - RNA, 14 nt, Homo sapiens
aagaaaaauaucuu

SEQ ID NO: 1181142 - RNA, 15 nt, Homo sapiens
aagaaaaauuaucuu

SEQ ID NO: 1181143 - RNA, 12 nt, Homo sapiens
aagaaaacauuu

SEQ ID NO: 1181144 - RNA, 15 nt, Homo sapiens
aagaaaacucaaaga

SEQ ID NO: 1181145 - RNA, 12 nt, Homo sapiens
aagaaaacugga

SEQ ID NO: 1181146 - RNA, 13 nt, Homo sapiens
aagaaaagccagu

SEQ ID NO: 1181147 - RNA, 19 nt, Homo sapiens
aagaaacacucaacaauaa

SEQ ID NO: 1181148 - RNA, 13 nt, Homo sapiens
aagaaacauguga

SEQ ID NO: 1181149 - RNA, 14 nt, Homo sapiens
aagaaacuuuggaa

SEQ ID NO: 1181150 - RNA, 14 nt, Homo sapiens
aagaaagaucaaag

SEQ ID NO: 1181151 - RNA, 21 nt, Homo sapiens
aagaaaguggucuuaagaaau

SEQ ID NO: 1181152 - RNA, 18 nt, Homo sapiens
aagaaauuuaauguuucu

SEQ ID NO: 1181153 - RNA, 21 nt, Homo sapiens
aagaacaauauugacuuuguc

SEQ ID NO: 1181154 - RNA, 11 nt, Homo sapiens
aagaacacagg

SEQ ID NO: 1181155 - RNA, 13 nt, Homo sapiens
aagaacacccucu

SEQ ID NO: 1181156 - RNA, 16 nt, Homo sapiens
aagaacaucuuuaugg

SEQ ID NO: 1181157 - RNA, 12 nt, Homo sapiens
aagaacauguga

SEQ ID NO: 1181158 - RNA, 14 nt, Homo sapiens
aagaacuuaccccc

SEQ ID NO: 1181159 - RNA, 14 nt, Homo sapiens
aagaagacauguuu

SEQ ID NO: 1181160 - RNA, 11 nt, Homo sapiens
aagaagacauu

SEQ ID NO: 1181161 - RNA, 18 nt, Homo sapiens
aagaagagaaccaugaaa

SEQ ID NO: 1181162 - RNA, 21 nt, Homo sapiens
aagaagaguuggagugagaug

SEQ ID NO: 1181163 - RNA, 20 nt, Homo sapiens
aagaagauagauccaauuaa

SEQ ID NO: 1181164 - RNA, 18 nt, Homo sapiens
aagaagcuucaugccagg

SEQ ID NO: 1181165 - RNA, 15 nt, Homo sapiens
aagaaggggacaaug

SEQ ID NO: 1181166 - RNA, 15 nt, Homo sapiens
aagaagguuuguguu

SEQ ID NO: 1181167 - RNA, 14 nt, Homo sapiens
aagaagucucuuaa

SEQ ID NO: 1181168 - RNA, 21 nt, Homo sapiens
aagaaguuaaaaaacagcugc

SEQ ID NO: 1181169 - RNA, 17 nt, Homo sapiens
aagaaguucacaucaga

SEQ ID NO: 1181170 - RNA, 15 nt, Homo sapiens
aagaaguuuuguucc

SEQ ID NO: 1181171 - RNA, 15 nt, Homo sapiens
aagaauaauaauuaa

SEQ ID NO: 1181172 - RNA, 16 nt, Homo sapiens
aagaauauaaagccuc

SEQ ID NO: 1181173 - RNA, 15 nt, Homo sapiens
aagaaucacuugaac

SEQ ID NO: 1181174 - RNA, 14 nt, Homo sapiens
aagaauuacuugug

SEQ ID NO: 1181175 - RNA, 22 nt, Homo sapiens
aagaauuaugcaucugcuacug

SEQ ID NO: 1181176 - RNA, 17 nt, Homo sapiens
aagaauugaacccagga

SEQ ID NO: 1181177 - RNA, 23 nt, Homo sapiens
aagaauuuaagcuguaaauuaca

SEQ ID NO: 1181178 - RNA, 12 nt, Homo sapiens
aagaauuucaca

SEQ ID NO: 1181179 - RNA, 18 nt, Homo sapiens
aagaauuucuaacaguac

SEQ ID NO: 1181180 - RNA, 14 nt, Homo sapiens
aagacacucccacc

SEQ ID NO: 1181181 - RNA, 17 nt, Homo sapiens
aagacagaaguuugcac

SEQ ID NO: 1181182 - RNA, 11 nt, Homo sapiens
aagacagagca

SEQ ID NO: 1181183 - RNA, 13 nt, Homo sapiens
aagaccaccacuu

SEQ ID NO: 1181184 - RNA, 13 nt, Homo sapiens
aagaccucaucuc

SEQ ID NO: 1181185 - RNA, 20 nt, Homo sapiens
aagaccugcgauggacuuca

SEQ ID NO: 1181186 - RNA, 23 nt, Homo sapiens
aagacuaaugcuuucuguggaca

SEQ ID NO: 1181187 - RNA, 17 nt, Homo sapiens
aagacuauugugccuua

SEQ ID NO: 1181188 - RNA, 13 nt, Homo sapiens
aagacuauuuacc

SEQ ID NO: 1181189 - RNA, 21 nt, Homo sapiens
aagacucagaauccacagugu

SEQ ID NO: 1181190 - RNA, 23 nt, Homo sapiens
aagacucuuuuugguuguccuca

SEQ ID NO: 1181191 - RNA, 23 nt, Homo sapiens
aagacugauuuuaauagggaaua

SEQ ID NO: 1181192 - RNA, 15 nt, Homo sapiens
aagacugcugcugaa

SEQ ID NO: 1181193 - RNA, 22 nt, Homo sapiens
aagacuggaagcuaauuugcau

SEQ ID NO: 1181194 - RNA, 14 nt, Homo sapiens
aaggcggaaaccca

SEQ ID NO: 1181195 - RNA, 15 nt, Homo sapiens
aaggcucauuuacuu

SEQ ID NO: 1181196 - RNA, 17 nt, Homo sapiens
aaggcucugugccuugg

SEQ ID NO: 1181197 - RNA, 15 nt, Homo sapiens
aaggcugcagauaac

SEQ ID NO: 1181198 - RNA, 13 nt, Homo sapiens
aaggcuguugcau

SEQ ID NO: 1181199 - RNA, 15 nt, Homo sapiens
aaggcuugccgcaca

SEQ ID NO: 1181200 - RNA, 14 nt, Homo sapiens
aagggaaggacaga

SEQ ID NO: 1181201 - RNA, 22 nt, Homo sapiens
aagggacauguuuucuagccuu

SEQ ID NO: 1181202 - RNA, 17 nt, Homo sapiens
aagggacuaggaaauuc

SEQ ID NO: 1181203 - RNA, 13 nt, Homo sapiens
aagggacuugaag

SEQ ID NO: 1181204 - RNA, 17 nt, Homo sapiens
aagggagcuagccagag

SEQ ID NO: 1181205 - RNA, 13 nt, Homo sapiens
aagggaggcacuu

SEQ ID NO: 1181206 - RNA, 18 nt, Homo sapiens
aaggggaaucagaacuca

SEQ ID NO: 1181207 - RNA, 15 nt, Homo sapiens
aaggggcaggccaga

SEQ ID NO: 1181208 - RNA, 14 nt, Homo sapiens
aagggguucuuugg

SEQ ID NO: 1181209 - RNA, 21 nt, Homo sapiens
aagggguuggauugcaauauc

SEQ ID NO: 1181210 - RNA, 17 nt, Homo sapiens
aaggguggauugauguu

SEQ ID NO: 1181211 - RNA, 21 nt, Homo sapiens
aaggucauggccacacuguga

SEQ ID NO: 1181212 - RNA, 23 nt, Homo sapiens
aaggucauggccacacugugaca

SEQ ID NO: 1181213 - RNA, 12 nt, Homo sapiens
aaggugaacuuu

SEQ ID NO: 1181214 - RNA, 21 nt, Homo sapiens
aaggugggcggaucacuugag

SEQ ID NO: 1181215 - RNA, 14 nt, Homo sapiens
aaggugugcuacag

SEQ ID NO: 1181216 - RNA, 17 nt, Homo sapiens
aagguuccaacuguaua

SEQ ID NO: 1181217 - RNA, 18 nt, Homo sapiens
aagguugaaaagacaaua

SEQ ID NO: 1181218 - RNA, 23 nt, Homo sapiens
aagguugaaaagacaauagccca

SEQ ID NO: 1181219 - RNA, 18 nt, Homo sapiens
aagguuucugcacauugu

SEQ ID NO: 1181220 - RNA, 15 nt, Homo sapiens
aaguaaauguugaca

SEQ ID NO: 1181221 - RNA, 15 nt, Homo sapiens
aaguaagcauuucca

SEQ ID NO: 1181222 - RNA, 19 nt, Homo sapiens
aaguaauuccguagguuau

SEQ ID NO: 1181223 - RNA, 22 nt, Homo sapiens
aaguagauuagaaaacuagauu

SEQ ID NO: 1181224 - RNA, 19 nt, Homo sapiens
aaguagccucuuucauccc

SEQ ID NO: 1181225 - RNA, 21 nt, Homo sapiens
aaguaggaacucuuaagcaau

SEQ ID NO: 1181226 - RNA, 15 nt, Homo sapiens
aaguagugugcaguu

SEQ ID NO: 1181227 - RNA, 23 nt, Homo sapiens
aaguauacaauaaagucuuaccu

SEQ ID NO: 1181228 - RNA, 14 nt, Homo sapiens
aaguaucuuuccag

SEQ ID NO: 1181229 - RNA, 16 nt, Homo sapiens
aaguauuggcauucaa

SEQ ID NO: 1181230 - RNA, 18 nt, Homo sapiens
aaguauuuaguuauauca

SEQ ID NO: 1181231 - RNA, 14 nt, Homo sapiens
aagucaaccugccu

SEQ ID NO: 1181232 - RNA, 18 nt, Homo sapiens
aagucacaggaugagaca

SEQ ID NO: 1181233 - RNA, 15 nt, Homo sapiens
aagucaggaguccaa

SEQ ID NO: 1181234 - RNA, 19 nt, Homo sapiens
aagucaucaugaacuggcu

SEQ ID NO: 1181235 - RNA, 19 nt, Homo sapiens
aagucauggacauucaugc

SEQ ID NO: 1181236 - RNA, 10 nt, Homo sapiens
aagucauuuu

SEQ ID NO: 1181237 - RNA, 15 nt, Homo sapiens
aaguccaacaguagc

SEQ ID NO: 1181238 - RNA, 15 nt, Homo sapiens
aaguccagcuaacau

SEQ ID NO: 1181239 - RNA, 21 nt, Homo sapiens
aagucccagccgcacugggag

SEQ ID NO: 1181240 - RNA, 15 nt, Homo sapiens
aaguccccucuacuu

SEQ ID NO: 1181241 - RNA, 16 nt, Homo sapiens
aaguccccucuacuuu

SEQ ID NO: 1181242 - RNA, 17 nt, Homo sapiens
aagucccuuugugacuu

SEQ ID NO: 1181243 - RNA, 18 nt, Homo sapiens
aaguccuaaaaguucuca

SEQ ID NO: 1181244 - RNA, 21 nt, Homo sapiens
aaguccucuggauugagauac

SEQ ID NO: 1181245 - RNA, 20 nt, Homo sapiens
aaguccuguaugucugucau

SEQ ID NO: 1181246 - RNA, 19 nt, Homo sapiens
aagucgagggacuuuaugu

SEQ ID NO: 1181247 - RNA, 18 nt, Homo sapiens
aagucguacuguucacac

SEQ ID NO: 1181248 - RNA, 16 nt, Homo sapiens
aagucucaauuaacag

SEQ ID NO: 1181249 - RNA, 19 nt, Homo sapiens
aagucucacagauugcugc

SEQ ID NO: 1181250 - RNA, 21 nt, Homo sapiens
aagucucuuaauucugaugcu

SEQ ID NO: 1181251 - RNA, 14 nt, Homo sapiens
aagucucuuuauau

SEQ ID NO: 1181252 - RNA, 15 nt, Homo sapiens
aagucugcuacccuc

SEQ ID NO: 1181253 - RNA, 18 nt, Homo sapiens
aagucuguccauuaucua

SEQ ID NO: 1181254 - RNA, 21 nt, Homo sapiens
aagucuuugguaaauggcaaa

SEQ ID NO: 1181255 - RNA, 17 nt, Homo sapiens
aagugaaaaacauccag

SEQ ID NO: 1181256 - RNA, 16 nt, Homo sapiens
aagugaagcauggcau

SEQ ID NO: 1181257 - RNA, 14 nt, Homo sapiens
aagugacauugugu

SEQ ID NO: 1181258 - RNA, 23 nt, Homo sapiens
aagugagccaggaaagcagcaaa

SEQ ID NO: 1181259 - RNA, 21 nt, Homo sapiens
aagugagcugagauugcacca

SEQ ID NO: 1181260 - RNA, 14 nt, Homo sapiens
aagugauauugcca

SEQ ID NO: 1181261 - RNA, 20 nt, Homo sapiens
aagugaucugcccaccucag

SEQ ID NO: 1181262 - RNA, 20 nt, Homo sapiens
aagugaucuguccaccucgg

SEQ ID NO: 1181263 - RNA, 16 nt, Homo sapiens
aagugaugucauuuga

SEQ ID NO: 1181264 - RNA, 23 nt, Homo sapiens
aagugauugaagcccagugaauu

SEQ ID NO: 1181265 - RNA, 10 nt, Homo sapiens
aagugcagag

SEQ ID NO: 1181266 - RNA, 19 nt, Homo sapiens
aagugccaaagaaaguggu

SEQ ID NO: 1181267 - RNA, 17 nt, Homo sapiens
aagugccaagacacagc

SEQ ID NO: 1181268 - RNA, 16 nt, Homo sapiens
aagugccuuuaucuca

SEQ ID NO: 1181269 - RNA, 22 nt, Homo sapiens
aagugcuacucucacucagccu

SEQ ID NO: 1181270 - RNA, 20 nt, Homo sapiens
aagugcugagauuacaggca

SEQ ID NO: 1181271 - RNA, 22 nt, Homo sapiens
aagugcuggcccacccagucca

SEQ ID NO: 1181272 - RNA, 16 nt, Homo sapiens
aaguggaagugacauu

SEQ ID NO: 1181273 - RNA, 15 nt, Homo sapiens
aaguggagacauauu

SEQ ID NO: 1181274 - RNA, 15 nt, Homo sapiens
aagugggacauucaa

SEQ ID NO: 1181275 - RNA, 18 nt, Homo sapiens
aagugguagaaacuuuaa

SEQ ID NO: 1181276 - RNA, 17 nt, Homo sapiens
aaguggucuuaagaaau

SEQ ID NO: 1181277 - RNA, 19 nt, Homo sapiens
aaguguuugaaagcuuuau

SEQ ID NO: 1181278 - RNA, 16 nt, Homo sapiens
aaguucauggaacuca

SEQ ID NO: 1181279 - RNA, 12 nt, Homo sapiens
aaguuccaagag

SEQ ID NO: 1181280 - RNA, 12 nt, Homo sapiens
aaguucugggug

SEQ ID NO: 1181281 - RNA, 19 nt, Homo sapiens
aaguucuuaugccauguua

SEQ ID NO: 1181282 - RNA, 19 nt, Homo sapiens
aaguugaagguuaaaggaa

SEQ ID NO: 1181283 - RNA, 19 nt, Homo sapiens
aaguugacaggcagugcca

SEQ ID NO: 1181284 - RNA, 14 nt, Homo sapiens
aaguugugccaaac

SEQ ID NO: 1181285 - RNA, 13 nt, Homo sapiens
aaguuguuugcau

SEQ ID NO: 1181286 - RNA, 17 nt, Homo sapiens
aaguuuagugcccucau

SEQ ID NO: 1181287 - RNA, 14 nt, Homo sapiens
aaguuuaugguugu

SEQ ID NO: 1181288 - RNA, 14 nt, Homo sapiens
aaguuucacucaca

SEQ ID NO: 1181289 - RNA, 20 nt, Homo sapiens
aaguuucuauuuaguuauuu

SEQ ID NO: 1181290 - RNA, 17 nt, Homo sapiens
aaguuucuuaaagcaac

SEQ ID NO: 1181291 - RNA, 19 nt, Homo sapiens
aaguuucuuaaagcaacac

SEQ ID NO: 1181292 - RNA, 14 nt, Homo sapiens
aaguuuuacauugu

SEQ ID NO: 1181293 - RNA, 23 nt, Homo sapiens
aaguuuuguuuguucacacuccu

SEQ ID NO: 1181294 - RNA, 15 nt, Homo sapiens
aauaaaaaacaagaa

SEQ ID NO: 1181295 - RNA, 20 nt, Homo sapiens
aauaaaaagucacaaugagu

SEQ ID NO: 1181296 - RNA, 22 nt, Homo sapiens
aauaaaacaccuuguacuuuau

SEQ ID NO: 1181297 - RNA, 17 nt, Homo sapiens
aauaaaaccaagccucu

SEQ ID NO: 1181298 - RNA, 12 nt, Homo sapiens
aauaaaagugga

SEQ ID NO: 1181299 - RNA, 14 nt, Homo sapiens
aauaaaauguuuau

SEQ ID NO: 1181300 - RNA, 18 nt, Homo sapiens
aauaaacauuuguagcau

SEQ ID NO: 1181301 - RNA, 16 nt, Homo sapiens
aauaaagcuguucuca

SEQ ID NO: 1181302 - RNA, 19 nt, Homo sapiens
aauaaaggaaccauaauca

SEQ ID NO: 1181303 - RNA, 13 nt, Homo sapiens
aauaaaggaagca

SEQ ID NO: 1181304 - RNA, 22 nt, Homo sapiens
aauaaagguuagauaaguccuu

SEQ ID NO: 1181305 - RNA, 15 nt, Homo sapiens
aauaaaucauagcaa

SEQ ID NO: 1181306 - RNA, 14 nt, Homo sapiens
aauaaaugacaaau

SEQ ID NO: 1181307 - RNA, 23 nt, Homo sapiens
aauaaaugagagggaaucgacug

SEQ ID NO: 1181308 - RNA, 20 nt, Homo sapiens
aauaaauuauacacuaugaa

SEQ ID NO: 1181309 - RNA, 13 nt, Homo sapiens
aauaaauuaugcu

SEQ ID NO: 1181310 - RNA, 16 nt, Homo sapiens
aauaaauuuugugcaa

SEQ ID NO: 1181311 - RNA, 13 nt, Homo sapiens
aauaaccaugaaa

SEQ ID NO: 1181312 - RNA, 23 nt, Homo sapiens
aauaacgauaaaagacagugaaa

SEQ ID NO: 1181313 - RNA, 16 nt, Homo sapiens
aauaacugaaccaaau

SEQ ID NO: 1181314 - RNA, 15 nt, Homo sapiens
aauaagcccaacaga

SEQ ID NO: 1181315 - RNA, 20 nt, Homo sapiens
aauaaguggcuugucugcag

SEQ ID NO: 1181316 - RNA, 23 nt, Homo sapiens
aauaauaaaaucaaaaacuuuug

SEQ ID NO: 1181317 - RNA, 14 nt, Homo sapiens
aauaauaaacagug

SEQ ID NO: 1181318 - RNA, 20 nt, Homo sapiens
aauaauaaaucguccuccca

SEQ ID NO: 1181319 - RNA, 16 nt, Homo sapiens
aauaauacaccagaga

SEQ ID NO: 1181320 - RNA, 19 nt, Homo sapiens
aauaauacaccagagauaa

SEQ ID NO: 1181321 - RNA, 15 nt, Homo sapiens
aauaauaugauuuau

SEQ ID NO: 1181322 - RNA, 19 nt, Homo sapiens
aauaauauuuucuguguaa

SEQ ID NO: 1181323 - RNA, 15 nt, Homo sapiens
aauaauccauuuuca

SEQ ID NO: 1181324 - RNA, 12 nt, Homo sapiens
acccagugcaga

SEQ ID NO: 1181325 - RNA, 15 nt, Homo sapiens
acccaucucaacagg

SEQ ID NO: 1181326 - RNA, 12 nt, Homo sapiens
acccaucugcac

SEQ ID NO: 1181327 - RNA, 14 nt, Homo sapiens
acccauucuucccg

SEQ ID NO: 1181328 - RNA, 18 nt, Homo sapiens
accccaaacuguugauua

SEQ ID NO: 1181329 - RNA, 18 nt, Homo sapiens
accccaacagcacccucu

SEQ ID NO: 1181330 - RNA, 22 nt, Homo sapiens
accccacaauuucuuuaaaaaa

SEQ ID NO: 1181331 - RNA, 15 nt, Homo sapiens
accccacacccaugu

SEQ ID NO: 1181332 - RNA, 14 nt, Homo sapiens
accccagagccaca

SEQ ID NO: 1181333 - RNA, 19 nt, Homo sapiens
accccagagccacacaugg

SEQ ID NO: 1181334 - RNA, 12 nt, Homo sapiens
accccagauuca

SEQ ID NO: 1181335 - RNA, 22 nt, Homo sapiens
accccagcauucucaggcacca

SEQ ID NO: 1181336 - RNA, 19 nt, Homo sapiens
accccagguacauccauga

SEQ ID NO: 1181337 - RNA, 17 nt, Homo sapiens
accccaucuuuacuaaa

SEQ ID NO: 1181338 - RNA, 11 nt, Homo sapiens
accccaugcug

SEQ ID NO: 1181339 - RNA, 16 nt, Homo sapiens
accccaugcuguugau

SEQ ID NO: 1181340 - RNA, 19 nt, Homo sapiens
accccccugggcugagaga

SEQ ID NO: 1181341 - RNA, 20 nt, Homo sapiens
acccccggaacaagccuaaa

SEQ ID NO: 1181342 - RNA, 22 nt, Homo sapiens
accccgaauugacaacccaaac

SEQ ID NO: 1181343 - RNA, 20 nt, Homo sapiens
accccgagccuggcuccaaa

SEQ ID NO: 1181344 - RNA, 18 nt, Homo sapiens
accccgaggcccugcaug

SEQ ID NO: 1181345 - RNA, 22 nt, Homo sapiens
accccgccugccuccuggcuca

SEQ ID NO: 1181346 - RNA, 18 nt, Homo sapiens
accccucacugugacuga

SEQ ID NO: 1181347 - RNA, 21 nt, Homo sapiens
accccucucuacuaaaaauac

SEQ ID NO: 1181348 - RNA, 17 nt, Homo sapiens
accccuggggaugggga

SEQ ID NO: 1181349 - RNA, 20 nt, Homo sapiens
accccuucgacaugcugcca

SEQ ID NO: 1181350 - RNA, 18 nt, Homo sapiens
accccuuguuucuauaca

SEQ ID NO: 1181351 - RNA, 22 nt, Homo sapiens
acccgccuggcuaacaaggcga

SEQ ID NO: 1181352 - RNA, 23 nt, Homo sapiens
acccuaccuuccccagacuugca

SEQ ID NO: 1181353 - RNA, 23 nt, Homo sapiens
acuuccugugccuuuccuaucac

SEQ ID NO: 1181354 - RNA, 16 nt, Homo sapiens
acuucgaaaccuggga

SEQ ID NO: 1181355 - RNA, 14 nt, Homo sapiens
acuucuagacucac

SEQ ID NO: 1181356 - RNA, 22 nt, Homo sapiens
acuucuagagggagaagacugu

SEQ ID NO: 1181357 - RNA, 16 nt, Homo sapiens
acuucucaucacacac

SEQ ID NO: 1181358 - RNA, 20 nt, Homo sapiens
acuucucccgugagccaggc

SEQ ID NO: 1181359 - RNA, 17 nt, Homo sapiens
acuucucuauuaucuca

SEQ ID NO: 1181360 - RNA, 20 nt, Homo sapiens
acuucugcaucuuacaguca

SEQ ID NO: 1181361 - RNA, 19 nt, Homo sapiens
acuucuggaagucaucuca

SEQ ID NO: 1181362 - RNA, 13 nt, Homo sapiens
acuucugugccac

SEQ ID NO: 1181363 - RNA, 19 nt, Homo sapiens
acuucuugguacccaguca

SEQ ID NO: 1181364 - RNA, 22 nt, Homo sapiens
acuugaacugauucacaucuca

SEQ ID NO: 1181365 - RNA, 17 nt, Homo sapiens
acuugaaguaacuauaa

SEQ ID NO: 1181366 - RNA, 18 nt, Homo sapiens
acuugaggccugagacac

SEQ ID NO: 1181367 - RNA, 18 nt, Homo sapiens
acuugaggucuggaguuu

SEQ ID NO: 1181368 - RNA, 13 nt, Homo sapiens
acuugcaaucaaa

SEQ ID NO: 1181369 - RNA, 11 nt, Homo sapiens
acuugcaauug

SEQ ID NO: 1181370 - RNA, 22 nt, Homo sapiens
acuugcaauuguuaaucaaaga

SEQ ID NO: 1181371 - RNA, 12 nt, Homo sapiens
acuugccaagaa

SEQ ID NO: 1181372 - RNA, 14 nt, Homo sapiens
acuugcucugcucu

SEQ ID NO: 1181373 - RNA, 22 nt, Homo sapiens
acuugcuugccaacugccaagc

SEQ ID NO: 1181374 - RNA, 18 nt, Homo sapiens
acuuggcuguauguugca

SEQ ID NO: 1181375 - RNA, 23 nt, Homo sapiens
acuuggggagauggaguucuugu

SEQ ID NO: 1181376 - RNA, 16 nt, Homo sapiens
acuuggucaccuugcc

SEQ ID NO: 1181377 - RNA, 23 nt, Homo sapiens
acuugguccaacugcaacucauc

SEQ ID NO: 1181378 - RNA, 21 nt, Homo sapiens
acuugucaagccugugcaaaa

SEQ ID NO: 1181379 - RNA, 16 nt, Homo sapiens
acuugucacccaaagc

SEQ ID NO: 1181380 - RNA, 16 nt, Homo sapiens
acuuguccaguucaaa

SEQ ID NO: 1181381 - RNA, 23 nt, Homo sapiens
acuugucccgggacaccuaggcu

SEQ ID NO: 1181382 - RNA, 16 nt, Homo sapiens
acuugucuucaccaac

SEQ ID NO: 1181383 - RNA, 20 nt, Homo sapiens
acuuguuucuccaugggcuc

SEQ ID NO: 1181384 - RNA, 16 nt, Homo sapiens
acuuuagaagcacagu

SEQ ID NO: 1181385 - RNA, 14 nt, Homo sapiens
acuuucucaaugcu

SEQ ID NO: 1181386 - RNA, 17 nt, Homo sapiens
acuuucugaaacucccu

SEQ ID NO: 1181387 - RNA, 13 nt, Homo sapiens
acuuucuguuacu

SEQ ID NO: 1181388 - RNA, 20 nt, Homo sapiens
acuuucuuauccuagcacau

SEQ ID NO: 1181389 - RNA, 17 nt, Homo sapiens
acuuucuuuacauacca

SEQ ID NO: 1181390 - RNA, 13 nt, Homo sapiens
acuuugacuuucu

SEQ ID NO: 1181391 - RNA, 16 nt, Homo sapiens
acuuugagcuacugcc

SEQ ID NO: 1181392 - RNA, 18 nt, Homo sapiens
acuuugcccuucacuguu

SEQ ID NO: 1181393 - RNA, 18 nt, Homo sapiens
acuuuggguuuuuaacuc

SEQ ID NO: 1181394 - RNA, 20 nt, Homo sapiens
acuuuguauccucugaccua

SEQ ID NO: 1181395 - RNA, 22 nt, Homo sapiens
acuuugucccguggcauuucaa

SEQ ID NO: 1181396 - RNA, 21 nt, Homo sapiens
acuuuucaucuaacgugcauu

SEQ ID NO: 1181397 - RNA, 21 nt, Homo sapiens
acuuuucuuuccucagaucau

SEQ ID NO: 1181398 - RNA, 16 nt, Homo sapiens
acuuuuguaaacagcu

SEQ ID NO: 1181399 - RNA, 17 nt, Homo sapiens
acuuuuuccuggcucau

SEQ ID NO: 1181400 - RNA, 12 nt, Homo sapiens
acuuuuugccaa

SEQ ID NO: 1181401 - RNA, 17 nt, Homo sapiens
acuuuuugguacaggua

SEQ ID NO: 1181402 - RNA, 17 nt, Homo sapiens
agaaaaaaaaaugccau

SEQ ID NO: 1181403 - RNA, 18 nt, Homo sapiens
agaaaaaaaagaaacuua

SEQ ID NO: 1181404 - RNA, 15 nt, Homo sapiens
agaaaaaaagggauc

SEQ ID NO: 1181405 - RNA, 21 nt, Homo sapiens
agaaaaagaaucggcaguauu

SEQ ID NO: 1181406 - RNA, 16 nt, Homo sapiens
agaaaaaggcugugcu

SEQ ID NO: 1181407 - RNA, 23 nt, Homo sapiens
agaaaaaucuuuguuacucugua

SEQ ID NO: 1181408 - RNA, 12 nt, Homo sapiens
agaaaacaucua

SEQ ID NO: 1181409 - RNA, 11 nt, Homo sapiens
agaaaacucaa

SEQ ID NO: 1181410 - RNA, 14 nt, Homo sapiens
agaaaacuggaaau

SEQ ID NO: 1181411 - RNA, 15 nt, Homo sapiens
agaaaagaagacauu

SEQ ID NO: 1181412 - RNA, 12 nt, Homo sapiens
agaaaagauuau

SEQ ID NO: 1181413 - RNA, 16 nt, Homo sapiens
agaaaagccagucaaa

SEQ ID NO: 1181414 - RNA, 16 nt, Homo sapiens
agaaaauaacaauaaa

SEQ ID NO: 1181415 - RNA, 20 nt, Homo sapiens
agaaaauaacaauaaaagac

SEQ ID NO: 1181416 - RNA, 20 nt, Homo sapiens
agaaaauaacgauaaaagac

SEQ ID NO: 1181417 - RNA, 22 nt, Homo sapiens
agaaaauacuauuucaagucau

SEQ ID NO: 1181418 - RNA, 13 nt, Homo sapiens
agaaaauaugcau

SEQ ID NO: 1181419 - RNA, 17 nt, Homo sapiens
agaaaaugcucccugaa

SEQ ID NO: 1181420 - RNA, 14 nt, Homo sapiens
agaaaauugcacaa

SEQ ID NO: 1181421 - RNA, 14 nt, Homo sapiens
agaaacaauacaaa

SEQ ID NO: 1181422 - RNA, 23 nt, Homo sapiens
agaaacaauguuugcuuuucacu

SEQ ID NO: 1181423 - RNA, 19 nt, Homo sapiens
agaaacacuauuugugacu

SEQ ID NO: 1181424 - RNA, 12 nt, Homo sapiens
agaaacacucaa

SEQ ID NO: 1181425 - RNA, 13 nt, Homo sapiens
agaaacacuuucu

SEQ ID NO: 1181426 - RNA, 13 nt, Homo sapiens
agaaacagugcaa

SEQ ID NO: 1181427 - RNA, 23 nt, Homo sapiens
agaaaccaaggccccgagcucag

SEQ ID NO: 1181428 - RNA, 16 nt, Homo sapiens
agaaaccagagucaaa

SEQ ID NO: 1181429 - RNA, 24 nt, Homo sapiens
agaaacccuuccacguguaugcaa

SEQ ID NO: 1181430 - RNA, 13 nt, Homo sapiens
agaaacugcucua

SEQ ID NO: 1181431 - RNA, 19 nt, Homo sapiens
agaaacugcucuaauauca

SEQ ID NO: 1181432 - RNA, 18 nt, Homo sapiens
agaaacuugugaagugga

SEQ ID NO: 1181433 - RNA, 20 nt, Homo sapiens
agaaacuuuggaagcacuuu

SEQ ID NO: 1181434 - RNA, 22 nt, Homo sapiens
agaaacuuuggaagcacuuuuu

SEQ ID NO: 1181435 - RNA, 16 nt, Homo sapiens
agaaagaaacacucaa

SEQ ID NO: 1181436 - RNA, 19 nt, Homo sapiens
agaaagaauuggccaggca

SEQ ID NO: 1181437 - RNA, 21 nt, Homo sapiens
agaaagcacuuaaacagaagc

SEQ ID NO: 1181438 - RNA, 17 nt, Homo sapiens
agaaagccucagugaaa

SEQ ID NO: 1181439 - RNA, 15 nt, Homo sapiens
agaaagccuucauaa

SEQ ID NO: 1181440 - RNA, 17 nt, Homo sapiens
agaaagggaaacuggcu

SEQ ID NO: 1181441 - RNA, 23 nt, Homo sapiens
agaaagggguggaaacauaggga

SEQ ID NO: 1181442 - RNA, 19 nt, Homo sapiens
agaaaguuggugcugcuca

SEQ ID NO: 1181443 - RNA, 13 nt, Homo sapiens
cuuuuuccacaag

SEQ ID NO: 1181444 - RNA, 17 nt, Homo sapiens
cuuuuucuuuaccucca

SEQ ID NO: 1181445 - RNA, 13 nt, Homo sapiens
cuuuuugccaaau

SEQ ID NO: 1181446 - RNA, 21 nt, Homo sapiens
cuuuuuguacugaaaacaauu

SEQ ID NO: 1181447 - RNA, 19 nt, Homo sapiens
cuuuuuguccuguacccag

SEQ ID NO: 1181448 - RNA, 16 nt, Homo sapiens
cuuuuugugugcaggc

SEQ ID NO: 1181449 - RNA, 12 nt, Homo sapiens
cuuuuuuacacu

SEQ ID NO: 1181450 - RNA, 18 nt, Homo sapiens
cuuuuuuauacucaauca

SEQ ID NO: 1181451 - RNA, 20 nt, Homo sapiens
cuuuuuuucuuguccucauu

SEQ ID NO: 1181452 - RNA, 23 nt, Homo sapiens
cuuuuuuuuuuuuuaaagacaga

SEQ ID NO: 1181453 - RNA, 16 nt, Homo sapiens
gaaaaaaaaacuuaaa

SEQ ID NO: 1181454 - RNA, 15 nt, Homo sapiens
gaaaaaaaaaugcca

SEQ ID NO: 1181455 - RNA, 17 nt, Homo sapiens
gaaaaaaaaauggaagc

SEQ ID NO: 1181456 - RNA, 14 nt, Homo sapiens
gaaaaaaacauaaa

SEQ ID NO: 1181457 - RNA, 23 nt, Homo sapiens
gaaaaaaccguucaaauucucuu

SEQ ID NO: 1181458 - RNA, 12 nt, Homo sapiens
gaaaaagaacau

SEQ ID NO: 1181459 - RNA, 19 nt, Homo sapiens
gaaaaagauuguauuacuu

SEQ ID NO: 1181460 - RNA, 18 nt, Homo sapiens
gaaaaagucagcuacaaa

SEQ ID NO: 1181461 - RNA, 12 nt, Homo sapiens
gaaaaauaauca

SEQ ID NO: 1181462 - RNA, 17 nt, Homo sapiens
gaaaaauaucuuggccu

SEQ ID NO: 1181463 - RNA, 23 nt, Homo sapiens
gaaaaaugcaccuaaaaucuaau

SEQ ID NO: 1181464 - RNA, 22 nt, Homo sapiens
gaaaacaaugcugagaaugaga

SEQ ID NO: 1181465 - RNA, 14 nt, Homo sapiens
gaaaacacugugca

SEQ ID NO: 1181466 - RNA, 16 nt, Homo sapiens
gaaaacacugugcaca

SEQ ID NO: 1181467 - RNA, 14 nt, Homo sapiens
gaaaaccacuuuau

SEQ ID NO: 1181468 - RNA, 13 nt, Homo sapiens
gaaaacucaugaa

SEQ ID NO: 1181469 - RNA, 15 nt, Homo sapiens
gaaaacuggaaaucu

SEQ ID NO: 1181470 - RNA, 20 nt, Homo sapiens
gaaaagaaaccagagucaaa

SEQ ID NO: 1181471 - RNA, 15 nt, Homo sapiens
gaaaagagcugggau

SEQ ID NO: 1181472 - RNA, 19 nt, Homo sapiens
gaaaagaguggugacaaau

SEQ ID NO: 1181473 - RNA, 20 nt, Homo sapiens
gaaaagauuauauauuauuu

SEQ ID NO: 1181474 - RNA, 23 nt, Homo sapiens
gaaaagcacauuuuaaaaaccag

SEQ ID NO: 1181475 - RNA, 14 nt, Homo sapiens
gaaaagccagucaa

SEQ ID NO: 1181476 - RNA, 14 nt, Homo sapiens
gaaaagugcauauu

SEQ ID NO: 1181477 - RNA, 19 nt, Homo sapiens
gaaaaguuauuagugguuu

SEQ ID NO: 1181478 - RNA, 19 nt, Homo sapiens
gaaaauaacaaagcccuua

SEQ ID NO: 1181479 - RNA, 19 nt, Homo sapiens
gaaaauaacugaaccaaau

SEQ ID NO: 1181480 - RNA, 14 nt, Homo sapiens
gaaaauagaacaac

SEQ ID NO: 1181481 - RNA, 17 nt, Homo sapiens
gaaaauaugcauaauca

SEQ ID NO: 1181482 - RNA, 17 nt, Homo sapiens
gaaaaucaagcaguuuc

SEQ ID NO: 1181483 - RNA, 12 nt, Homo sapiens
gaaaaucacuug

SEQ ID NO: 1181484 - RNA, 14 nt, Homo sapiens
gaaaaucacuugaa

SEQ ID NO: 1181485 - RNA, 15 nt, Homo sapiens
gaaaaucucugugaa

SEQ ID NO: 1181486 - RNA, 22 nt, Homo sapiens
gaaaaugcaucacaugaugaaa

SEQ ID NO: 1181487 - RNA, 15 nt, Homo sapiens
gaaaaugcuguuuuc

SEQ ID NO: 1181488 - RNA, 16 nt, Homo sapiens
gaaaauguaacuugaa

SEQ ID NO: 1181489 - RNA, 14 nt, Homo sapiens
gaaaauuaauuccu

SEQ ID NO: 1181490 - RNA, 22 nt, Homo sapiens
gaaaauuuuacacaguucauca

SEQ ID NO: 1181491 - RNA, 23 nt, Homo sapiens
gaaacaaaacuagguaaaaucua

SEQ ID NO: 1181492 - RNA, 22 nt, Homo sapiens
gaaacaaauaauuugaacuuug

SEQ ID NO: 1181493 - RNA, 23 nt, Homo sapiens
gaaacaacaauuucuacuuugaa

SEQ ID NO: 1181494 - RNA, 12 nt, Homo sapiens
gaaacaacuugg

SEQ ID NO: 1181495 - RNA, 15 nt, Homo sapiens
gaaacacaauaccua

SEQ ID NO: 1181496 - RNA, 17 nt, Homo sapiens
gaaacacagaaaccuuu

SEQ ID NO: 1181497 - RNA, 16 nt, Homo sapiens
gaaacaccaagauguc

SEQ ID NO: 1181498 - RNA, 13 nt, Homo sapiens
gaaacacuaaaga

SEQ ID NO: 1181499 - RNA, 18 nt, Homo sapiens
gaaacacucaacaauaaa

SEQ ID NO: 1181500 - RNA, 13 nt, Homo sapiens
gaaacacugccuu

SEQ ID NO: 1181501 - RNA, 17 nt, Homo sapiens
gaaacagcugcccugug

SEQ ID NO: 1181502 - RNA, 18 nt, Homo sapiens
gaaacaugggcugugauu

SEQ ID NO: 1181503 - RNA, 20 nt, Homo sapiens
gaaacauugaacucauaucu

SEQ ID NO: 1181504 - RNA, 16 nt, Homo sapiens
gaaaccaguucaugca

SEQ ID NO: 1181505 - RNA, 15 nt, Homo sapiens
gaaaccauuuuccca

SEQ ID NO: 1181506 - RNA, 14 nt, Homo sapiens
gaaacccccagugu

SEQ ID NO: 1181507 - RNA, 14 nt, Homo sapiens
gaaaccccgucucu

SEQ ID NO: 1181508 - RNA, 19 nt, Homo sapiens
gaaaccccgucucuacuaa

SEQ ID NO: 1181509 - RNA, 19 nt, Homo sapiens
gaaaccucugggucaucuc

SEQ ID NO: 1181510 - RNA, 19 nt, Homo sapiens
gaaacuaguguacauuucu

SEQ ID NO: 1181511 - RNA, 16 nt, Homo sapiens
gaaacuauacauuuau

SEQ ID NO: 1181512 - RNA, 18 nt, Homo sapiens
gaaacucccuuguguucc

SEQ ID NO: 1181513 - RNA, 19 nt, Homo sapiens
gaaacucccuuguguuccu

SEQ ID NO: 1181514 - RNA, 15 nt, Homo sapiens
gaaacucuacccuga

SEQ ID NO: 1181515 - RNA, 12 nt, Homo sapiens
gaaacugaugcc

SEQ ID NO: 1181516 - RNA, 22 nt, Homo sapiens
gaaacugcuugagcaucaggau

SEQ ID NO: 1181517 - RNA, 19 nt, Homo sapiens
gaaacuuugaguacagaua

SEQ ID NO: 1181518 - RNA, 14 nt, Homo sapiens
gaaagaaacaugug

SEQ ID NO: 1181519 - RNA, 14 nt, Homo sapiens
gaaagaacugucau

SEQ ID NO: 1181520 - RNA, 19 nt, Homo sapiens
gaaagaaguucacaucaga

SEQ ID NO: 1181521 - RNA, 16 nt, Homo sapiens
cauccaucaucaugug

SEQ ID NO: 1181522 - RNA, 16 nt, Homo sapiens
cauccauccauugugu

SEQ ID NO: 1181523 - RNA, 13 nt, Homo sapiens
cauccaugugcua

SEQ ID NO: 1181524 - RNA, 21 nt, Homo sapiens
cauccaugugcuagucacugg

SEQ ID NO: 1181525 - RNA, 22 nt, Homo sapiens
caucccacacgcacugcacugc

SEQ ID NO: 1181526 - RNA, 16 nt, Homo sapiens
caucccacugcucccc

SEQ ID NO: 1181527 - RNA, 18 nt, Homo sapiens
caucccagacacauucac

SEQ ID NO: 1181528 - RNA, 20 nt, Homo sapiens
caucccagacacauucacac

SEQ ID NO: 1181529 - RNA, 20 nt, Homo sapiens
cauccccuuacccuuagaau

SEQ ID NO: 1181530 - RNA, 12 nt, Homo sapiens
cccaaacuguau

SEQ ID NO: 1181531 - RNA, 17 nt, Homo sapiens
cccaaauccuguuccaa

SEQ ID NO: 1181532 - RNA, 20 nt, Homo sapiens
cccaaauccuuagaucuggc

SEQ ID NO: 1181533 - RNA, 19 nt, Homo sapiens
cccaacacuuccagcauuu

SEQ ID NO: 1181534 - RNA, 10 nt, Homo sapiens
cccaacagca

SEQ ID NO: 1181535 - RNA, 14 nt, Homo sapiens
cccaacagcacuuu

SEQ ID NO: 1181536 - RNA, 13 nt, Homo sapiens
cccaacauauaaa

SEQ ID NO: 1181537 - RNA, 17 nt, Homo sapiens
cccaagaugucaaaaca

SEQ ID NO: 1181538 - RNA, 20 nt, Homo sapiens
cccaagauuuuuuauuugag

SEQ ID NO: 1181539 - RNA, 20 nt, Homo sapiens
cccaaguagcugcuaccuuc

SEQ ID NO: 1181540 - RNA, 19 nt, Homo sapiens
cccaauccauccugcucag

SEQ ID NO: 1181541 - RNA, 14 nt, Homo sapiens
cccacacacaggug

SEQ ID NO: 1181542 - RNA, 22 nt, Homo sapiens
cccacacacagguggugucacu

SEQ ID NO: 1181543 - RNA, 23 nt, Homo sapiens
cccacaucccacuggaucuggcu

SEQ ID NO: 1181544 - RNA, 19 nt, Homo sapiens
cccacauguccagcaccuu

SEQ ID NO: 1181545 - RNA, 14 nt, Homo sapiens
cccacccacaugug

SEQ ID NO: 1181546 - RNA, 17 nt, Homo sapiens
cccacggugcugagacu

SEQ ID NO: 1181547 - RNA, 19 nt, Homo sapiens
cccacugcacacagggugg

SEQ ID NO: 1181548 - RNA, 16 nt, Homo sapiens
cccacuucucaucaca

SEQ ID NO: 1181549 - RNA, 13 nt, Homo sapiens
cccagaauggagg

SEQ ID NO: 1181550 - RNA, 13 nt, Homo sapiens
cccagacacauuc

SEQ ID NO: 1181551 - RNA, 15 nt, Homo sapiens
cccagacacauucac

SEQ ID NO: 1181552 - RNA, 13 nt, Homo sapiens
cccagacacuggc

SEQ ID NO: 1181553 - RNA, 23 nt, Homo sapiens
cccagacacuggcguuacugcuu

SEQ ID NO: 1181554 - RNA, 20 nt, Homo sapiens
cccagaccauacugacucaa

SEQ ID NO: 1181555 - RNA, 22 nt, Homo sapiens
cccagaccuuuuauccacuuac

SEQ ID NO: 1181556 - RNA, 18 nt, Homo sapiens
cccagaggccaacacugu

SEQ ID NO: 1181557 - RNA, 20 nt, Homo sapiens
cccagaggccuuggccaagc

SEQ ID NO: 1181558 - RNA, 23 nt, Homo sapiens
cccagagguggguuaaacuguaa

SEQ ID NO: 1181559 - RNA, 18 nt, Homo sapiens
cccagagugcugggauua

SEQ ID NO: 1181560 - RNA, 17 nt, Homo sapiens
cccagauucuucagcuu

SEQ ID NO: 1181561 - RNA, 18 nt, Homo sapiens
cccagcagguuaccugga

SEQ ID NO: 1181562 - RNA, 16 nt, Homo sapiens
cccagcagugccuugu

SEQ ID NO: 1181563 - RNA, 20 nt, Homo sapiens
cccagcauucucaggcacca

SEQ ID NO: 1181564 - RNA, 18 nt, Homo sapiens
cccagccacagcauuuau

SEQ ID NO: 1181565 - RNA, 15 nt, Homo sapiens
cccagccacauuuca

SEQ ID NO: 1181566 - RNA, 15 nt, Homo sapiens
cccagccucaucucu

SEQ ID NO: 1181567 - RNA, 15 nt, Homo sapiens
cccagcgagccacag

SEQ ID NO: 1181568 - RNA, 15 nt, Homo sapiens
cccagcgagcucuca

SEQ ID NO: 1181569 - RNA, 18 nt, Homo sapiens
cccagcuaagaaccugga

SEQ ID NO: 1181570 - RNA, 22 nt, Homo sapiens
cccagcuguugggaacagcaug

SEQ ID NO: 1181571 - RNA, 15 nt, Homo sapiens
cccaggacauggcug

SEQ ID NO: 1181572 - RNA, 15 nt, Homo sapiens
cccaggaccucugga

SEQ ID NO: 1181573 - RNA, 15 nt, Homo sapiens
cccaggaccuggcug

SEQ ID NO: 1181574 - RNA, 18 nt, Homo sapiens
cccaggaggaggauugug

SEQ ID NO: 1181575 - RNA, 17 nt, Homo sapiens
cccaggaggcuccagga

SEQ ID NO: 1181576 - RNA, 21 nt, Homo sapiens
cccaggaggugugauuccuga

SEQ ID NO: 1181577 - RNA, 14 nt, Homo sapiens
cccaggcacugggc

SEQ ID NO: 1181578 - RNA, 14 nt, Homo sapiens
cccaggcaggucug

SEQ ID NO: 1181579 - RNA, 17 nt, Homo sapiens
cccaggcuagagugcaa

SEQ ID NO: 1181580 - RNA, 19 nt, Homo sapiens
cccaggcuagagugcaaug

SEQ ID NO: 1181581 - RNA, 14 nt, Homo sapiens
cccaggcuggagug

SEQ ID NO: 1181582 - RNA, 19 nt, Homo sapiens
cccaggcuggagugcaaug

SEQ ID NO: 1181583 - RNA, 20 nt, Homo sapiens
cccaggcuggagugcaaugg

SEQ ID NO: 1181584 - RNA, 17 nt, Homo sapiens
cccaggcuggagugcag

SEQ ID NO: 1181585 - RNA, 19 nt, Homo sapiens
cccaggcuggagugcagug

SEQ ID NO: 1181586 - RNA, 20 nt, Homo sapiens
cccaggcuggagugcaguga

SEQ ID NO: 1181587 - RNA, 17 nt, Homo sapiens
cccaggcugggaacuca

SEQ ID NO: 1181588 - RNA, 20 nt, Homo sapiens
cccagggccugcaggaccug

SEQ ID NO: 1181589 - RNA, 23 nt, Homo sapiens
cccagggcgucccugacagaggu

SEQ ID NO: 1181590 - RNA, 13 nt, Homo sapiens
cccagggggcaug

SEQ ID NO: 1181591 - RNA, 14 nt, Homo sapiens
cccaggguggagug

SEQ ID NO: 1181592 - RNA, 18 nt, Homo sapiens
cccaggguggagugcagu

SEQ ID NO: 1181593 - RNA, 16 nt, Homo sapiens
cccagguaauggcaug

SEQ ID NO: 1181594 - RNA, 21 nt, Homo sapiens
cccaggucuuuucaugugcag

SEQ ID NO: 1181595 - RNA, 18 nt, Homo sapiens
cccagguggcugacccag

SEQ ID NO: 1181596 - RNA, 16 nt, Homo sapiens
cccaguaguguuugga

SEQ ID NO: 1181597 - RNA, 17 nt, Homo sapiens
cccagugcccccacuga

SEQ ID NO: 1181598 - RNA, 20 nt, Homo sapiens
cccagugcccccacugacca

SEQ ID NO: 1181599 - RNA, 18 nt, Homo sapiens
cccagugcccuuugcauc

SEQ ID NO: 1181600 - RNA, 14 nt, Homo sapiens
cccaguuagcacca

SEQ ID NO: 1181601 - RNA, 17 nt, Homo sapiens
cccauaggcccacacac

SEQ ID NO: 1181602 - RNA, 20 nt, Homo sapiens
cccaucaaagaaccuugaag

SEQ ID NO: 1181603 - RNA, 12 nt, Homo sapiens
cccaucaucucu

SEQ ID NO: 1181604 - RNA, 18 nt, Homo sapiens
cccaucaucucugccuuu

SEQ ID NO: 1181605 - RNA, 14 nt, Homo sapiens
cccaucggucaccu

SEQ ID NO: 1181606 - RNA, 20 nt, Homo sapiens
cccaucuuccaccucaccuc

SEQ ID NO: 1181607 - RNA, 16 nt, Homo sapiens
cccaucuucgggacca

SEQ ID NO: 1181608 - RNA, 22 nt, Homo sapiens
cccaugccugaggacuaugcca

SEQ ID NO: 1181609 - RNA, 14 nt, Homo sapiens
cccaugggacaaau

SEQ ID NO: 1181610 - RNA, 18 nt, Homo sapiens
cccauggggagacaguug

SEQ ID NO: 1181611 - RNA, 21 nt, Homo sapiens
cccaugggggcugucuuugca

SEQ ID NO: 1181612 - RNA, 23 nt, Homo sapiens
cccaugucagauugaauguauuu

SEQ ID NO: 1181613 - RNA, 20 nt, Homo sapiens
cccaugugcccauaagcaca

SEQ ID NO: 1181614 - RNA, 22 nt, Homo sapiens
cccauguuagcuccaaagcauu

SEQ ID NO: 1181615 - RNA, 16 nt, Homo sapiens
cccauuagaaugugau

SEQ ID NO: 1181616 - RNA, 17 nt, Homo sapiens
cccauuccuauuucuua

SEQ ID NO: 1181617 - RNA, 18 nt, Homo sapiens
cccauuuguaauuuguaa

SEQ ID NO: 1181618 - RNA, 14 nt, Homo sapiens
cccauuuguugcug

SEQ ID NO: 1181619 - RNA, 22 nt, Homo sapiens
ccccaacaaugugagggguccc

SEQ ID NO: 1181620 - RNA, 14 nt, Homo sapiens
ccccaacacgcagg

SEQ ID NO: 1181621 - RNA, 22 nt, Homo sapiens
ccccaagugcggggaguacaag

SEQ ID NO: 1181622 - RNA, 16 nt, Homo sapiens
ccccacaccugcagug

SEQ ID NO: 1181623 - RNA, 24 nt, Homo sapiens
ccccacccugagcgccugggucca

SEQ ID NO: 1181624 - RNA, 21 nt, Homo sapiens
ccccacgcgcaagacagccca

SEQ ID NO: 1181625 - RNA, 22 nt, Homo sapiens
ccccacguugccucuacuuuau

SEQ ID NO: 1181626 - RNA, 14 nt, Homo sapiens
ccccacuagcauuu

SEQ ID NO: 1181627 - RNA, 13 nt, Homo sapiens
ccccagacacugg

SEQ ID NO: 1181628 - RNA, 18 nt, Homo sapiens
ccccagaggccuuggcca

SEQ ID NO: 1181629 - RNA, 12 nt, Homo sapiens
ccccagcacuug

SEQ ID NO: 1181630 - RNA, 20 nt, Homo sapiens
ccccaggcacuuugcaucac

SEQ ID NO: 1181631 - RNA, 22 nt, Homo sapiens
ccccaggcacuuugcaucacag

SEQ ID NO: 1181632 - RNA, 13 nt, Homo sapiens
ccccaggcccacu

SEQ ID NO: 1181633 - RNA, 16 nt, Homo sapiens
ccccaggccccaggaa

SEQ ID NO: 1181634 - RNA, 14 nt, Homo sapiens
ccccagggcuguca

SEQ ID NO: 1181635 - RNA, 17 nt, Homo sapiens
ccccauaaaaugauccu

SEQ ID NO: 1181636 - RNA, 17 nt, Homo sapiens
ccccaugacauugcauu

SEQ ID NO: 1181637 - RNA, 15 nt, Homo sapiens
ccccaugcacuguga

SEQ ID NO: 1181638 - RNA, 19 nt, Homo sapiens
ccccaugcucccuuuuaca

SEQ ID NO: 1181639 - RNA, 16 nt, Homo sapiens
ccccauuagaauguga

SEQ ID NO: 1181640 - RNA, 16 nt, Homo sapiens
ccccauuccuacccac

SEQ ID NO: 1181641 - RNA, 15 nt, Homo sapiens
ccccauuccugggaa

SEQ ID NO: 1181642 - RNA, 22 nt, Homo sapiens
ccuaagcgggggugaaagagga

SEQ ID NO: 1181643 - RNA, 18 nt, Homo sapiens
ccuaaggguuuuaucucc

SEQ ID NO: 1181644 - RNA, 20 nt, Homo sapiens
ccuaaucacaugugcugcaa

SEQ ID NO: 1181645 - RNA, 19 nt, Homo sapiens
ccuaauccaggcagaucca

SEQ ID NO: 1181646 - RNA, 14 nt, Homo sapiens
ccuaauuaccugua

SEQ ID NO: 1181647 - RNA, 17 nt, Homo sapiens
ccuaauuauaagaauuu

SEQ ID NO: 1181648 - RNA, 16 nt, Homo sapiens
ccuacaccucuugaaa

SEQ ID NO: 1181649 - RNA, 14 nt, Homo sapiens
ccuacacugaugca

SEQ ID NO: 1181650 - RNA, 15 nt, Homo sapiens
ccuacagggccacaa

SEQ ID NO: 1181651 - RNA, 20 nt, Homo sapiens
ccuaccaggcacgucugcag

SEQ ID NO: 1181652 - RNA, 19 nt, Homo sapiens
ccuacccccugugccuugu

SEQ ID NO: 1181653 - RNA, 22 nt, Homo sapiens
ccuacuaauccucucugcaagu

SEQ ID NO: 1181654 - RNA, 13 nt, Homo sapiens
ccuacucugcaaa

SEQ ID NO: 1181655 - RNA, 17 nt, Homo sapiens
ccuacugaguagcuuuc

SEQ ID NO: 1181656 - RNA, 20 nt, Homo sapiens
ccuacugucccucucagugc

SEQ ID NO: 1181657 - RNA, 18 nt, Homo sapiens
ccuacugucuaagcaguu

SEQ ID NO: 1181658 - RNA, 19 nt, Homo sapiens
ccuacuucucugagucagc

SEQ ID NO: 1181659 - RNA, 16 nt, Homo sapiens
ccuacuuucauaauaa

SEQ ID NO: 1181660 - RNA, 15 nt, Homo sapiens
ccuagagacagugau

SEQ ID NO: 1181661 - RNA, 13 nt, Homo sapiens
ccuagagcacucu

SEQ ID NO: 1181662 - RNA, 16 nt, Homo sapiens
ccuagauccagggaua

SEQ ID NO: 1181663 - RNA, 23 nt, Homo sapiens
ccuagcagcaccguucugugcac

SEQ ID NO: 1181664 - RNA, 11 nt, Homo sapiens
ccuagccaccc

SEQ ID NO: 1181665 - RNA, 12 nt, Homo sapiens
ccuaggcccaag

SEQ ID NO: 1181666 - RNA, 15 nt, Homo sapiens
ccuaggcuagggugg

SEQ ID NO: 1181667 - RNA, 23 nt, Homo sapiens
ccugccuccacccacaguggaga

SEQ ID NO: 1181668 - RNA, 17 nt, Homo sapiens
ccugccuccagcuguca

SEQ ID NO: 1181669 - RNA, 18 nt, Homo sapiens
ccugccuucacugugcuc

SEQ ID NO: 1181670 - RNA, 20 nt, Homo sapiens
ccugcgacccugggggcaca

SEQ ID NO: 1181671 - RNA, 23 nt, Homo sapiens
ccugcgguggggcugaggggugg

SEQ ID NO: 1181672 - RNA, 20 nt, Homo sapiens
ccugcguucuccccaugaac

SEQ ID NO: 1181673 - RNA, 12 nt, Homo sapiens
ccugcucaggaa

SEQ ID NO: 1181674 - RNA, 13 nt, Homo sapiens
ccugcuccagaag

SEQ ID NO: 1181675 - RNA, 18 nt, Homo sapiens
ccugcugaagcugcugca

SEQ ID NO: 1181676 - RNA, 13 nt, Homo sapiens
ccugcugcaucuu

SEQ ID NO: 1181677 - RNA, 14 nt, Homo sapiens
ccugcuucauaucu

SEQ ID NO: 1181678 - RNA, 17 nt, Homo sapiens
ccugcuuucugguauaa

SEQ ID NO: 1181679 - RNA, 16 nt, Homo sapiens
ccuggaaaacucauga

SEQ ID NO: 1181680 - RNA, 15 nt, Homo sapiens
ccuggacaaccagag

SEQ ID NO: 1181681 - RNA, 16 nt, Homo sapiens
ccuggacaaccagagg

SEQ ID NO: 1181682 - RNA, 21 nt, Homo sapiens
ccuggacgcccccgcccgcac

SEQ ID NO: 1181683 - RNA, 20 nt, Homo sapiens
ccuggagcauggacagugug

SEQ ID NO: 1181684 - RNA, 18 nt, Homo sapiens
ccuggagggcagagacaa

SEQ ID NO: 1181685 - RNA, 13 nt, Homo sapiens
ccuggaugugaau

SEQ ID NO: 1181686 - RNA, 22 nt, Homo sapiens
ccuggcagccacaacugcaguc

SEQ ID NO: 1181687 - RNA, 20 nt, Homo sapiens
ccuggcagggggugaaggca

SEQ ID NO: 1181688 - RNA, 18 nt, Homo sapiens
ccuggccaacauggcaaa

SEQ ID NO: 1181689 - RNA, 13 nt, Homo sapiens
ccuggccagacac

SEQ ID NO: 1181690 - RNA, 22 nt, Homo sapiens
ccuggccaugcugucccugcac

SEQ ID NO: 1181691 - RNA, 15 nt, Homo sapiens
ccuggccgaguccaa

SEQ ID NO: 1181692 - RNA, 20 nt, Homo sapiens
ccuggccgggucacccugug

SEQ ID NO: 1181693 - RNA, 15 nt, Homo sapiens
ccuggcgcugugcua

SEQ ID NO: 1181694 - RNA, 23 nt, Homo sapiens
ccuggcggguggcugcaagccca

SEQ ID NO: 1181695 - RNA, 13 nt, Homo sapiens
ccugggaggcaga

SEQ ID NO: 1181696 - RNA, 14 nt, Homo sapiens
ccugggcaaagccu

SEQ ID NO: 1181697 - RNA, 16 nt, Homo sapiens
ccuggggacaccugcc

SEQ ID NO: 1181698 - RNA, 20 nt, Homo sapiens
ccuggggcuugaauuugcau

SEQ ID NO: 1181699 - RNA, 12 nt, Homo sapiens
ccugggggacca

SEQ ID NO: 1181700 - RNA, 21 nt, Homo sapiens
ccugggggacccaucuuccac

SEQ ID NO: 1181701 - RNA, 22 nt, Homo sapiens
ccugggggcaggccagggcagu

SEQ ID NO: 1181702 - RNA, 18 nt, Homo sapiens
ccugggggccgugcucac

SEQ ID NO: 1181703 - RNA, 18 nt, Homo sapiens
ccugggucacagagugag

SEQ ID NO: 1181704 - RNA, 20 nt, Homo sapiens
ccugggucuuuaugcaugaa

SEQ ID NO: 1181705 - RNA, 15 nt, Homo sapiens
ccugguacaaaugca

SEQ ID NO: 1181706 - RNA, 20 nt, Homo sapiens
ccuggugggaaaaugcacac

SEQ ID NO: 1181707 - RNA, 14 nt, Homo sapiens
ccugguggguggug

SEQ ID NO: 1181708 - RNA, 22 nt, Homo sapiens
ccuggugggugguguccugaag

SEQ ID NO: 1181709 - RNA, 21 nt, Homo sapiens
ccugguuaaacaaaccagaau

SEQ ID NO: 1181710 - RNA, 19 nt, Homo sapiens
ccugguuuucgucaucuuc

SEQ ID NO: 1181711 - RNA, 15 nt, Homo sapiens
ccuguaauucagugu

SEQ ID NO: 1181712 - RNA, 15 nt, Homo sapiens
ccuguagcucaagag

SEQ ID NO: 1181713 - RNA, 15 nt, Homo sapiens
ccuguagucccagcu

SEQ ID NO: 1181714 - RNA, 18 nt, Homo sapiens
ccuguauaaguagaucug

SEQ ID NO: 1181715 - RNA, 17 nt, Homo sapiens
ccugucaaacaaagcca

SEQ ID NO: 1181716 - RNA, 21 nt, Homo sapiens
ccugucaaacaaagccagaag

SEQ ID NO: 1181717 - RNA, 16 nt, Homo sapiens
ccuguccugccaugca

SEQ ID NO: 1181718 - RNA, 13 nt, Homo sapiens
ccugucuacugac

SEQ ID NO: 1181719 - RNA, 13 nt, Homo sapiens
ccugucucagggu

SEQ ID NO: 1181720 - RNA, 17 nt, Homo sapiens
ccugucuugcuuacugu

SEQ ID NO: 1181721 - RNA, 14 nt, Homo sapiens
ccugugaacacugg

SEQ ID NO: 1181722 - RNA, 18 nt, Homo sapiens
ccugugacuggcagcauu

SEQ ID NO: 1181723 - RNA, 13 nt, Homo sapiens
ccugugagggagu

SEQ ID NO: 1181724 - RNA, 22 nt, Homo sapiens
ccugugugggacugaguggcaa

SEQ ID NO: 1181725 - RNA, 16 nt, Homo sapiens
ccuguguucugcacau

SEQ ID NO: 1181726 - RNA, 16 nt, Homo sapiens
ccuguuacacaugaca

SEQ ID NO: 1181727 - RNA, 18 nt, Homo sapiens
ccuguuaccugucuugcu

SEQ ID NO: 1181728 - RNA, 14 nt, Homo sapiens
ccuguucaucccau

SEQ ID NO: 1181729 - RNA, 12 nt, Homo sapiens
ccuguuccagaa

SEQ ID NO: 1181730 - RNA, 23 nt, Homo sapiens
ccuguuccccagagaaaggggag

SEQ ID NO: 1181731 - RNA, 21 nt, Homo sapiens
ccuguuccugacuuaaaacaa

SEQ ID NO: 1181732 - RNA, 21 nt, Homo sapiens
ccuguucugguauacauuuac

SEQ ID NO: 1181733 - RNA, 18 nt, Homo sapiens
ccuguuguuuuggcucaa

SEQ ID NO: 1181734 - RNA, 16 nt, Homo sapiens
ccuguuugaaaccaag

SEQ ID NO: 1181735 - RNA, 21 nt, Homo sapiens
ccuguuuggggagcaaguguu

SEQ ID NO: 1181736 - RNA, 23 nt, Homo sapiens
ccuguuuggggagcaaguguuaa

SEQ ID NO: 1181737 - RNA, 15 nt, Homo sapiens
ccuuaaaaaucacac

SEQ ID NO: 1181738 - RNA, 15 nt, Homo sapiens
ccuuaaaucacacau

SEQ ID NO: 1181739 - RNA, 19 nt, Homo sapiens
ccuuaaauguuuugccagc

SEQ ID NO: 1181740 - RNA, 23 nt, Homo sapiens
ccuuaagcaugcuucuauuaguc

SEQ ID NO: 1181741 - RNA, 23 nt, Homo sapiens
ccuuaagcuuuggacccaaggaa

SEQ ID NO: 1181742 - RNA, 16 nt, Homo sapiens
ccuuaauauacuacuu

SEQ ID NO: 1181743 - RNA, 14 nt, Homo sapiens
ccuuacaguaggag

SEQ ID NO: 1181744 - RNA, 21 nt, Homo sapiens
ccuuaccccugccuuugggag

SEQ ID NO: 1181745 - RNA, 23 nt, Homo sapiens
ccuuagaacuuugcauagcagcu

SEQ ID NO: 1181746 - RNA, 23 nt, Homo sapiens
ccuuagaugccucgcucuuuuca

SEQ ID NO: 1181747 - RNA, 22 nt, Homo sapiens
ccuuagauugaaguaaacugca

SEQ ID NO: 1181748 - RNA, 13 nt, Homo sapiens
ccuuaguguuucu

SEQ ID NO: 1181749 - RNA, 12 nt, Homo sapiens
ccuuauacauca

SEQ ID NO: 1181750 - RNA, 20 nt, Homo sapiens
ccuuaucuaaaucaccagag

SEQ ID NO: 1181751 - RNA, 14 nt, Homo sapiens
ccuuaucugugcuc

SEQ ID NO: 1181752 - RNA, 13 nt, Homo sapiens
ccuuauugaucuu

SEQ ID NO: 1181753 - RNA, 19 nt, Homo sapiens
ccuuauuuauauucaucaa

SEQ ID NO: 1181754 - RNA, 21 nt, Homo sapiens
ccuucaacuugugccugggag

SEQ ID NO: 1181755 - RNA, 14 nt, Homo sapiens
ccuucaaugaauua

SEQ ID NO: 1181756 - RNA, 22 nt, Homo sapiens
ccuucaccucacugaaaacauc

SEQ ID NO: 1181757 - RNA, 17 nt, Homo sapiens
ccuucacuguugcuuaa

SEQ ID NO: 1181758 - RNA, 20 nt, Homo sapiens
ccuucagaacagaggcauuu

SEQ ID NO: 1181759 - RNA, 21 nt, Homo sapiens
ccuucagaacagaggcauuua

SEQ ID NO: 1181760 - RNA, 15 nt, Homo sapiens
ccuucaguacugcag

SEQ ID NO: 1181761 - RNA, 15 nt, Homo sapiens
ccuucauaugcagua

SEQ ID NO: 1181762 - RNA, 19 nt, Homo sapiens
ccuucauaugugcaguauu

SEQ ID NO: 1181763 - RNA, 19 nt, Homo sapiens
ccuuccaccucacaacucc

SEQ ID NO: 1181764 - RNA, 12 nt, Homo sapiens
ccuucccagugg

SEQ ID NO: 1181765 - RNA, 23 nt, Homo sapiens
ccuuccggugcgugugaagccac

SEQ ID NO: 1181766 - RNA, 18 nt, Homo sapiens
ccuucggguuggcaaaau

SEQ ID NO: 1181767 - RNA, 12 nt, Homo sapiens
ccuucuaccuua

SEQ ID NO: 1181768 - RNA, 22 nt, Homo sapiens
ccuucuaggucacuucucacaa

SEQ ID NO: 1181769 - RNA, 12 nt, Homo sapiens
ccuucucaggga

SEQ ID NO: 1181770 - RNA, 19 nt, Homo sapiens
ccuucugaggacauuccaa

SEQ ID NO: 1181771 - RNA, 23 nt, Homo sapiens
ccuucugcucagcucugggccau

SEQ ID NO: 1181772 - RNA, 15 nt, Homo sapiens
ccuucugcugcccaa

SEQ ID NO: 1181773 - RNA, 14 nt, Homo sapiens
cgggagcugcacua

SEQ ID NO: 1181774 - RNA, 19 nt, Homo sapiens
cgggcagucgcugcaggga

SEQ ID NO: 1181775 - RNA, 19 nt, Homo sapiens
cggggaagagauccaaaga

SEQ ID NO: 1181776 - RNA, 20 nt, Homo sapiens
cggggaggggcgcucgcuuc

SEQ ID NO: 1181777 - RNA, 13 nt, Homo sapiens
cggggaugcauag

SEQ ID NO: 1181778 - RNA, 18 nt, Homo sapiens
cggggccagcacuuccau

SEQ ID NO: 1181779 - RNA, 14 nt, Homo sapiens
cgggggaugaauga

SEQ ID NO: 1181780 - RNA, 15 nt, Homo sapiens
cggggucacuugcaa

SEQ ID NO: 1181781 - RNA, 18 nt, Homo sapiens
cgguaaacacgccugcaa

SEQ ID NO: 1181782 - RNA, 20 nt, Homo sapiens
cgguggaagagcucaaggga

SEQ ID NO: 1181783 - RNA, 18 nt, Homo sapiens
cgguggacuugaacuuuc

SEQ ID NO: 1181784 - RNA, 18 nt, Homo sapiens
cgguggcucaugccugua

SEQ ID NO: 1181785 - RNA, 11 nt, Homo sapiens
cgguguucuaa

SEQ ID NO: 1181786 - RNA, 14 nt, Homo sapiens
cguaaagaacuuuu

SEQ ID NO: 1181787 - RNA, 11 nt, Homo sapiens
cguaagcacug

SEQ ID NO: 1181788 - RNA, 23 nt, Homo sapiens
cgucacaaagaccuugcugauaa

SEQ ID NO: 1181789 - RNA, 14 nt, Homo sapiens
cgucucaagacuga

SEQ ID NO: 1181790 - RNA, 15 nt, Homo sapiens
cgucucaagacugaa

SEQ ID NO: 1181791 - RNA, 14 nt, Homo sapiens
cgucucugcuaaac

SEQ ID NO: 1181792 - RNA, 20 nt, Homo sapiens
cgugagugacauagccucau

SEQ ID NO: 1181793 - RNA, 19 nt, Homo sapiens
cgugauuuggcugcacuug

SEQ ID NO: 1181794 - RNA, 21 nt, Homo sapiens
cgugcauuguguguaggggug

SEQ ID NO: 1181795 - RNA, 20 nt, Homo sapiens
cgugcauuuuuggaucauuu

SEQ ID NO: 1181796 - RNA, 15 nt, Homo sapiens
cgugcccuaccacac

SEQ ID NO: 1181797 - RNA, 13 nt, Homo sapiens
cguggaaaggggc

SEQ ID NO: 1181798 - RNA, 14 nt, Homo sapiens
cguggacucugcac

SEQ ID NO: 1181799 - RNA, 15 nt, Homo sapiens
cguggagacuggcag

SEQ ID NO: 1181800 - RNA, 13 nt, Homo sapiens
cguggaugaagca

SEQ ID NO: 1181801 - RNA, 17 nt, Homo sapiens
cgugggccugagaccaa

SEQ ID NO: 1181802 - RNA, 16 nt, Homo sapiens
cguucaaaaguggagu

SEQ ID NO: 1181803 - RNA, 18 nt, Homo sapiens
cuagaacccugagacaua

SEQ ID NO: 1181804 - RNA, 15 nt, Homo sapiens
cuagaauucuggugu

SEQ ID NO: 1181805 - RNA, 20 nt, Homo sapiens
cuagacuauuaggugcaauu

SEQ ID NO: 1181806 - RNA, 15 nt, Homo sapiens
cuagagacaggcaaa

SEQ ID NO: 1181807 - RNA, 17 nt, Homo sapiens
cuagaggagacagccug

SEQ ID NO: 1181808 - RNA, 20 nt, Homo sapiens
cuagagggagaagacugugc

SEQ ID NO: 1181809 - RNA, 12 nt, Homo sapiens
cuagaguuuuau

SEQ ID NO: 1181810 - RNA, 20 nt, Homo sapiens
cuagaucucagccauucuaa

SEQ ID NO: 1181811 - RNA, 15 nt, Homo sapiens
cuagauuauaucaaa

SEQ ID NO: 1181812 - RNA, 17 nt, Homo sapiens
cuagauucuaacauauu

SEQ ID NO: 1181813 - RNA, 23 nt, Homo sapiens
cuagauuucuagaaaagcuuccu

SEQ ID NO: 1181814 - RNA, 24 nt, Homo sapiens
cuagcaaauaguaaucuguaagca

SEQ ID NO: 1181815 - RNA, 14 nt, Homo sapiens
cuagcaaccugccu

SEQ ID NO: 1181816 - RNA, 13 nt, Homo sapiens
cuagcagcaccgu

SEQ ID NO: 1181817 - RNA, 22 nt, Homo sapiens
cuagcauguaaggccuuucaau

SEQ ID NO: 1181818 - RNA, 19 nt, Homo sapiens
cuagccagaggacugugau

SEQ ID NO: 1181819 - RNA, 21 nt, Homo sapiens
cuagcuggagccugggauuuc

SEQ ID NO: 1181820 - RNA, 18 nt, Homo sapiens
cuaggaaauccauucaca

SEQ ID NO: 1181821 - RNA, 16 nt, Homo sapiens
cuaggauuucagccau

SEQ ID NO: 1181822 - RNA, 16 nt, Homo sapiens
cuaggcagugacagug

SEQ ID NO: 1181823 - RNA, 22 nt, Homo sapiens
cuaggcuaggguggggagagac

SEQ ID NO: 1181824 - RNA, 15 nt, Homo sapiens
cuagggaucccucau

SEQ ID NO: 1181825 - RNA, 23 nt, Homo sapiens
cuaggggcuugguccuagggugg

SEQ ID NO: 1181826 - RNA, 16 nt, Homo sapiens
cuaggguaugggaaau

SEQ ID NO: 1181827 - RNA, 15 nt, Homo sapiens
cuaggguuucuuaaa

SEQ ID NO: 1181828 - RNA, 16 nt, Homo sapiens
cuagguaauuugccac

SEQ ID NO: 1181829 - RNA, 16 nt, Homo sapiens
cuaggucacuucucac

SEQ ID NO: 1181830 - RNA, 20 nt, Homo sapiens
cuaguagcggaucucacuca

SEQ ID NO: 1181831 - RNA, 17 nt, Homo sapiens
cuaguauaucagugaca

SEQ ID NO: 1181832 - RNA, 21 nt, Homo sapiens
cuaguauuucaugcugggaau

SEQ ID NO: 1181833 - RNA, 14 nt, Homo sapiens
cuagucuccuuuga

SEQ ID NO: 1181834 - RNA, 14 nt, Homo sapiens
cuaguguacauuuc

SEQ ID NO: 1181835 - RNA, 14 nt, Homo sapiens
cuaguguaccuccu

SEQ ID NO: 1181836 - RNA, 15 nt, Homo sapiens
cuaguuaacauuuca

SEQ ID NO: 1181837 - RNA, 22 nt, Homo sapiens
cuaguuauuggaucagugaaaa

SEQ ID NO: 1181838 - RNA, 23 nt, Homo sapiens
cuaguugugaccuuaguguuucu

SEQ ID NO: 1181839 - RNA, 20 nt, Homo sapiens
cuaguuuuauacaaagacag

SEQ ID NO: 1181840 - RNA, 18 nt, Homo sapiens
cuauaaaauuaacaguau

SEQ ID NO: 1181841 - RNA, 19 nt, Homo sapiens
cuauaaauuuacucuguug

SEQ ID NO: 1181842 - RNA, 19 nt, Homo sapiens
cuauaacuaugaccaugcu

SEQ ID NO: 1181843 - RNA, 16 nt, Homo sapiens
cuauaacuuacuucug

SEQ ID NO: 1181844 - RNA, 15 nt, Homo sapiens
cuauacauaugugca

SEQ ID NO: 1181845 - RNA, 22 nt, Homo sapiens
cuauagcaacucauugguggua

SEQ ID NO: 1181846 - RNA, 14 nt, Homo sapiens
cuauagugaacucu

SEQ ID NO: 1181847 - RNA, 16 nt, Homo sapiens
cuauauaugacuggaa

SEQ ID NO: 1181848 - RNA, 14 nt, Homo sapiens
cuauauauguguau

SEQ ID NO: 1181849 - RNA, 20 nt, Homo sapiens
cuaucaaagcuucaaaaacu

SEQ ID NO: 1181850 - RNA, 15 nt, Homo sapiens
cuaucaaaugugaug

SEQ ID NO: 1181851 - RNA, 23 nt, Homo sapiens
cuaucagcauuuuacuacuuuaa

SEQ ID NO: 1181852 - RNA, 18 nt, Homo sapiens
cuaucauuaaaguucuag

SEQ ID NO: 1181853 - RNA, 17 nt, Homo sapiens
cuauccugggcauccuu

SEQ ID NO: 1181854 - RNA, 21 nt, Homo sapiens
cuaucggggucacuugcaauu

SEQ ID NO: 1181855 - RNA, 14 nt, Homo sapiens
cuaucuacuacaaa

SEQ ID NO: 1181856 - RNA, 16 nt, Homo sapiens
cuaugagcacauagga

SEQ ID NO: 1181857 - RNA, 17 nt, Homo sapiens
cuaugagcacauaggac

SEQ ID NO: 1181858 - RNA, 18 nt, Homo sapiens
cuaugauaagauugaaau

SEQ ID NO: 1181859 - RNA, 22 nt, Homo sapiens
cuaugauaagauugaaauucca

SEQ ID NO: 1181860 - RNA, 14 nt, Homo sapiens
cuaugcacauaugg

SEQ ID NO: 1181861 - RNA, 23 nt, Homo sapiens
cuaugcacauauggacucugcac

SEQ ID NO: 1181862 - RNA, 15 nt, Homo sapiens
cuaugcagaggccug

SEQ ID NO: 1181863 - RNA, 16 nt, Homo sapiens
cuaugccugccucaaa

SEQ ID NO: 1181864 - RNA, 22 nt, Homo sapiens
cuauggacagcuuuucccaaga

SEQ ID NO: 1181865 - RNA, 18 nt, Homo sapiens
cuauggugagaugcagcu

SEQ ID NO: 1181866 - RNA, 14 nt, Homo sapiens
cuauguaacaugua

SEQ ID NO: 1181867 - RNA, 14 nt, Homo sapiens
cuaugucucaggag

SEQ ID NO: 1181868 - RNA, 16 nt, Homo sapiens
cuaugugaaacuugaa

SEQ ID NO: 1181869 - RNA, 16 nt, Homo sapiens
cuaugugcacacuuac

SEQ ID NO: 1181870 - RNA, 13 nt, Homo sapiens
cuaugugggacac

SEQ ID NO: 1181871 - RNA, 23 nt, Homo sapiens
cuaugugggacaccucaaauaca

SEQ ID NO: 1181872 - RNA, 14 nt, Homo sapiens
cuauguuauauuga

SEQ ID NO: 1181873 - RNA, 23 nt, Homo sapiens
cuauguuccaagugcuacucuca

SEQ ID NO: 1181874 - RNA, 22 nt, Homo sapiens
cuauguuccgaauugagcacaa

SEQ ID NO: 1181875 - RNA, 17 nt, Homo sapiens
cuauguuuggaguuuaa

SEQ ID NO: 1181876 - RNA, 22 nt, Homo sapiens
cuauguuuuuguucaaagccag

SEQ ID NO: 1181877 - RNA, 23 nt, Homo sapiens
cuauuaaaaagguuuacagaauu

SEQ ID NO: 1181878 - RNA, 15 nt, Homo sapiens
cuauuaccaguguuc

SEQ ID NO: 1181879 - RNA, 18 nt, Homo sapiens
cuauuaccaguguucccu

SEQ ID NO: 1181880 - RNA, 23 nt, Homo sapiens
cuauuaggugcaauuucaagguu

SEQ ID NO: 1181881 - RNA, 22 nt, Homo sapiens
cuauucauccggggaggaaaca

SEQ ID NO: 1181882 - RNA, 17 nt, Homo sapiens
cuauucaugcuacccag

SEQ ID NO: 1181883 - RNA, 22 nt, Homo sapiens
cuauuccaaucuacaacuggaa

SEQ ID NO: 1181884 - RNA, 17 nt, Homo sapiens
cuauuccccacacucuc

SEQ ID NO: 1181885 - RNA, 19 nt, Homo sapiens
cuauucccuggggcugcug

SEQ ID NO: 1181886 - RNA, 16 nt, Homo sapiens
cuauucucuccaaaaa

SEQ ID NO: 1181887 - RNA, 16 nt, Homo sapiens
cuauugacuucaauga

SEQ ID NO: 1181888 - RNA, 23 nt, Homo sapiens
cuauugaguuacaggggauuuua

SEQ ID NO: 1181889 - RNA, 14 nt, Homo sapiens
cuauuuaagugaaa

SEQ ID NO: 1181890 - RNA, 19 nt, Homo sapiens
cuauuuauauguacaugag

SEQ ID NO: 1181891 - RNA, 14 nt, Homo sapiens
cuauuuaucuguag

SEQ ID NO: 1181892 - RNA, 16 nt, Homo sapiens
cuauuuauuaucgcau

SEQ ID NO: 1181893 - RNA, 18 nt, Homo sapiens
cuauuucuucuacugcua

SEQ ID NO: 1181894 - RNA, 19 nt, Homo sapiens
cuauuucuuuaaaugcuuu

SEQ ID NO: 1181895 - RNA, 16 nt, Homo sapiens
cuauuuuucuuuccaa

SEQ ID NO: 1181896 - RNA, 16 nt, Homo sapiens
cucaaaacacuuccag

SEQ ID NO: 1181897 - RNA, 14 nt, Homo sapiens
cucaaaacuuucaa

SEQ ID NO: 1181898 - RNA, 20 nt, Homo sapiens
cucaaaagaaggccacuguu

SEQ ID NO: 1181899 - RNA, 18 nt, Homo sapiens
cucaaacuccugaccuca

SEQ ID NO: 1181900 - RNA, 13 nt, Homo sapiens
cucaaaggcacag

SEQ ID NO: 1181901 - RNA, 13 nt, Homo sapiens
cucaaaguuuuau

SEQ ID NO: 1181902 - RNA, 19 nt, Homo sapiens
cucaaaguuuuauuauaaa

SEQ ID NO: 1181903 - RNA, 20 nt, Homo sapiens
cucaaauggggccagaucca

SEQ ID NO: 1181904 - RNA, 17 nt, Homo sapiens
cuucuacggccaugaga

SEQ ID NO: 1181905 - RNA, 18 nt, Homo sapiens
cuucuagaagauaacauu

SEQ ID NO: 1181906 - RNA, 21 nt, Homo sapiens
cuucuagagggagaagacugu

SEQ ID NO: 1181907 - RNA, 18 nt, Homo sapiens
cuucuagcgucagugcug

SEQ ID NO: 1181908 - RNA, 18 nt, Homo sapiens
cuucuaggucacuucuca

SEQ ID NO: 1181909 - RNA, 23 nt, Homo sapiens
cuucuauuuuuaucaugaauucc

SEQ ID NO: 1181910 - RNA, 17 nt, Homo sapiens
cuucucaaguucuaaga

SEQ ID NO: 1181911 - RNA, 18 nt, Homo sapiens
cuucucaccagcugcaaa

SEQ ID NO: 1181912 - RNA, 22 nt, Homo sapiens
cuucucccgugagccaggcaaa

SEQ ID NO: 1181913 - RNA, 22 nt, Homo sapiens
cuucuccuaggauuccuaagac

SEQ ID NO: 1181914 - RNA, 15 nt, Homo sapiens
cuucucugaaaacaa

SEQ ID NO: 1181915 - RNA, 16 nt, Homo sapiens
cuucucuugacagucu

SEQ ID NO: 1181916 - RNA, 16 nt, Homo sapiens
cuucucuugagucaca

SEQ ID NO: 1181917 - RNA, 17 nt, Homo sapiens
cuucugaaaaaguaucc

SEQ ID NO: 1181918 - RNA, 16 nt, Homo sapiens
cuucugaacuuggaaa

SEQ ID NO: 1181919 - RNA, 21 nt, Homo sapiens
cuucugagccugccuuucucc

SEQ ID NO: 1181920 - RNA, 15 nt, Homo sapiens
cuucugcaacugaaa

SEQ ID NO: 1181921 - RNA, 22 nt, Homo sapiens
cuucugcaacugaaauuacaua

SEQ ID NO: 1181922 - RNA, 19 nt, Homo sapiens
cuucugcauuccuguaacu

SEQ ID NO: 1181923 - RNA, 21 nt, Homo sapiens
cuucugccucccacuccauac

SEQ ID NO: 1181924 - RNA, 12 nt, Homo sapiens
cuucugcuacug

SEQ ID NO: 1181925 - RNA, 15 nt, Homo sapiens
cuucugcuccaugcu

SEQ ID NO: 1181926 - RNA, 17 nt, Homo sapiens
cuucuggaacccagaag

SEQ ID NO: 1181927 - RNA, 19 nt, Homo sapiens
cuucuguguacugggugau

SEQ ID NO: 1181928 - RNA, 20 nt, Homo sapiens
cuucuguuugaucacuguga

SEQ ID NO: 1181929 - RNA, 13 nt, Homo sapiens
cuucuuacuggaa

SEQ ID NO: 1181930 - RNA, 22 nt, Homo sapiens
cuucuucaggcugccuaagaca

SEQ ID NO: 1181931 - RNA, 18 nt, Homo sapiens
cuucuuccccuucccuga

SEQ ID NO: 1181932 - RNA, 14 nt, Homo sapiens
cuucuucuuagcac

SEQ ID NO: 1181933 - RNA, 15 nt, Homo sapiens
cuucuucuucuaaaa

SEQ ID NO: 1181934 - RNA, 13 nt, Homo sapiens
cuucuugaauuca

SEQ ID NO: 1181935 - RNA, 13 nt, Homo sapiens
cuucuuggaguua

SEQ ID NO: 1181936 - RNA, 15 nt, Homo sapiens
cuucuuggauuagcc

SEQ ID NO: 1181937 - RNA, 11 nt, Homo sapiens
cuucuugugaa

SEQ ID NO: 1181938 - RNA, 23 nt, Homo sapiens
cuucuuucagacuugccauguga

SEQ ID NO: 1181939 - RNA, 17 nt, Homo sapiens
cuucuuuuggcuuccau

SEQ ID NO: 1181940 - RNA, 20 nt, Homo sapiens
cuucuuuuggcuuccaugau

SEQ ID NO: 1181941 - RNA, 16 nt, Homo sapiens
cuucuuuuugcuucaa

SEQ ID NO: 1181942 - RNA, 17 nt, Homo sapiens
cuucuuuuugcuucaaa

SEQ ID NO: 1181943 - RNA, 21 nt, Homo sapiens
cuugaaaagcuaguguaccuc

SEQ ID NO: 1181944 - RNA, 21 nt, Homo sapiens
cuugaaaggaagagcuaauaa

SEQ ID NO: 1181945 - RNA, 13 nt, Homo sapiens
cuugaacugauuc

SEQ ID NO: 1181946 - RNA, 18 nt, Homo sapiens
cuugaacuucaccugcaa

SEQ ID NO: 1181947 - RNA, 19 nt, Homo sapiens
cuugaacuucaccugcaaa

SEQ ID NO: 1181948 - RNA, 18 nt, Homo sapiens
cuugaagggccagagcca

SEQ ID NO: 1181949 - RNA, 19 nt, Homo sapiens
cuugaagggccagagccag

SEQ ID NO: 1181950 - RNA, 14 nt, Homo sapiens
cuugaagguggcua

SEQ ID NO: 1181951 - RNA, 20 nt, Homo sapiens
cuugaaucucugaauuugag

SEQ ID NO: 1181952 - RNA, 14 nt, Homo sapiens
cuugacaacaucug

SEQ ID NO: 1181953 - RNA, 11 nt, Homo sapiens
cuugacagucu

SEQ ID NO: 1181954 - RNA, 23 nt, Homo sapiens
cuugaccaagcaggaagcucaga

SEQ ID NO: 1181955 - RNA, 19 nt, Homo sapiens
cuugacccugagcugacca

SEQ ID NO: 1181956 - RNA, 23 nt, Homo sapiens
cuugacugaagcgaacaucuuca

SEQ ID NO: 1181957 - RNA, 14 nt, Homo sapiens
cuugagaguguucc

SEQ ID NO: 1181958 - RNA, 17 nt, Homo sapiens
cuugagauauaaaggaa

SEQ ID NO: 1181959 - RNA, 13 nt, Homo sapiens
cuugagcaucagg

SEQ ID NO: 1181960 - RNA, 13 nt, Homo sapiens
cuugagccuguga

SEQ ID NO: 1181961 - RNA, 18 nt, Homo sapiens
cuugagcugugugccaca

SEQ ID NO: 1181962 - RNA, 21 nt, Homo sapiens
cuugaggaaacugaggugcaa

SEQ ID NO: 1181963 - RNA, 16 nt, Homo sapiens
cuugaguaacauuuau

SEQ ID NO: 1181964 - RNA, 18 nt, Homo sapiens
cuugaguuuaaauuguaa

SEQ ID NO: 1181965 - RNA, 14 nt, Homo sapiens
cuugauaaacuagg

SEQ ID NO: 1181966 - RNA, 14 nt, Homo sapiens
cuugaucaaaggca

SEQ ID NO: 1181967 - RNA, 16 nt, Homo sapiens
cuugauuagaccuaau

SEQ ID NO: 1181968 - RNA, 12 nt, Homo sapiens
cuugauucacaa

SEQ ID NO: 1181969 - RNA, 22 nt, Homo sapiens
cuugcaaauaccuccucccuaa

SEQ ID NO: 1181970 - RNA, 17 nt, Homo sapiens
cuugcaagacccaggga

SEQ ID NO: 1181971 - RNA, 21 nt, Homo sapiens
cuugcacaggucccacugccc

SEQ ID NO: 1181972 - RNA, 18 nt, Homo sapiens
cuugccaaauauaaauaa

SEQ ID NO: 1181973 - RNA, 22 nt, Homo sapiens
cuugccaaaucaaaagacuuuu

SEQ ID NO: 1181974 - RNA, 14 nt, Homo sapiens
cuugccaugugcug

SEQ ID NO: 1181975 - RNA, 16 nt, Homo sapiens
cuugcccccauuucac

SEQ ID NO: 1181976 - RNA, 20 nt, Homo sapiens
cuugcccucgccuguucccc

SEQ ID NO: 1181977 - RNA, 19 nt, Homo sapiens
cuugccuuccuaagccugu

SEQ ID NO: 1181978 - RNA, 18 nt, Homo sapiens
cuugccuugcugaacucc

SEQ ID NO: 1181979 - RNA, 23 nt, Homo sapiens
cuugcgaacuagagaugugcaau

SEQ ID NO: 1181980 - RNA, 16 nt, Homo sapiens
cuugcuacucauggca

SEQ ID NO: 1181981 - RNA, 18 nt, Homo sapiens
cuugcucagguacuugua

SEQ ID NO: 1181982 - RNA, 21 nt, Homo sapiens
cuugcucuaagucaaauucca

SEQ ID NO: 1181983 - RNA, 15 nt, Homo sapiens
cuugcucuucaaugc

SEQ ID NO: 1181984 - RNA, 16 nt, Homo sapiens
cuugcuggaccugaau

SEQ ID NO: 1181985 - RNA, 19 nt, Homo sapiens
cuugcuggaccugaauucu

SEQ ID NO: 1181986 - RNA, 22 nt, Homo sapiens
cuugcuggguugaucuagaugu

SEQ ID NO: 1181987 - RNA, 19 nt, Homo sapiens
cuugcuucuaaaugcccag

SEQ ID NO: 1181988 - RNA, 15 nt, Homo sapiens
cuugcuucugcugua

SEQ ID NO: 1181989 - RNA, 14 nt, Homo sapiens
cuugcuuguuacau

SEQ ID NO: 1181990 - RNA, 19 nt, Homo sapiens
cuuggagaauacugccaaa

SEQ ID NO: 1181991 - RNA, 15 nt, Homo sapiens
cuuggauaccagcuc

SEQ ID NO: 1181992 - RNA, 18 nt, Homo sapiens
cuuggauuugcucagugu

SEQ ID NO: 1181993 - RNA, 15 nt, Homo sapiens
cuuggccaguuuucu

SEQ ID NO: 1181994 - RNA, 22 nt, Homo sapiens
cuuggccucucuguacacugcc

SEQ ID NO: 1181995 - RNA, 14 nt, Homo sapiens
cuuggcggguggga

SEQ ID NO: 1181996 - RNA, 21 nt, Homo sapiens
cuugggaaaggugguguuucu

SEQ ID NO: 1181997 - RNA, 16 nt, Homo sapiens
cuugggaauaaaucau

SEQ ID NO: 1181998 - RNA, 17 nt, Homo sapiens
cuugggagcaccgccug

SEQ ID NO: 1181999 - RNA, 23 nt, Homo sapiens
cuugggcguuugaacucagggag

SEQ ID NO: 1182000 - RNA, 15 nt, Homo sapiens
cuuggggcccagugc

SEQ ID NO: 1182001 - RNA, 20 nt, Homo sapiens
cuuggggcggaacucacugc

SEQ ID NO: 1182002 - RNA, 23 nt, Homo sapiens
cuugguaauuguacuaaagccaa

SEQ ID NO: 1182003 - RNA, 14 nt, Homo sapiens
cuugguaugcaucu

SEQ ID NO: 1182004 - RNA, 16 nt, Homo sapiens
cuugguaugugccagg

SEQ ID NO: 1182005 - RNA, 13 nt, Homo sapiens
cuuggucacaugu

SEQ ID NO: 1182006 - RNA, 17 nt, Homo sapiens
cuuggucccuccagaac

SEQ ID NO: 1182007 - RNA, 17 nt, Homo sapiens
cuugguuaaaauggcua

SEQ ID NO: 1182008 - RNA, 18 nt, Homo sapiens
cuugguuuccaaaggcau

SEQ ID NO: 1182009 - RNA, 19 nt, Homo sapiens
cuugguuuccaaaggcauu

SEQ ID NO: 1182010 - RNA, 14 nt, Homo sapiens
cuuguaaaugugac

SEQ ID NO: 1182011 - RNA, 13 nt, Homo sapiens
cuuguaaaugugu

SEQ ID NO: 1182012 - RNA, 21 nt, Homo sapiens
cuuguaaauguguuggacaaa

SEQ ID NO: 1182013 - RNA, 22 nt, Homo sapiens
cuuguaccuuccacaagacuca

SEQ ID NO: 1182014 - RNA, 21 nt, Homo sapiens
cuuguaguuccauguacugua

SEQ ID NO: 1182015 - RNA, 20 nt, Homo sapiens
cuuguauaacaucacuguca

SEQ ID NO: 1182016 - RNA, 12 nt, Homo sapiens
cuuguaucugaa

SEQ ID NO: 1182017 - RNA, 15 nt, Homo sapiens
cuuguaucugaagac

SEQ ID NO: 1182018 - RNA, 13 nt, Homo sapiens
cuuguauugguga

SEQ ID NO: 1182019 - RNA, 19 nt, Homo sapiens
cuugucaagccugugcaaa

SEQ ID NO: 1182020 - RNA, 14 nt, Homo sapiens
cuugucacauggaa

SEQ ID NO: 1182021 - RNA, 24 nt, Homo sapiens
cuugucacgaauuccaucuuguaa

SEQ ID NO: 1182022 - RNA, 16 nt, Homo sapiens
cuugucacuugcaugu

SEQ ID NO: 1182023 - RNA, 16 nt, Homo sapiens
cuugugacgugcacug

SEQ ID NO: 1182024 - RNA, 16 nt, Homo sapiens
cuugugccauagucac

SEQ ID NO: 1182025 - RNA, 19 nt, Homo sapiens
cuuguggucucgaugcugc

SEQ ID NO: 1182026 - RNA, 21 nt, Homo sapiens
cuuguggucucgaugcugcug

SEQ ID NO: 1182027 - RNA, 15 nt, Homo sapiens
cuuguguguuuugag

SEQ ID NO: 1182028 - RNA, 16 nt, Homo sapiens
cuuguguuacuugcca

SEQ ID NO: 1182029 - RNA, 17 nt, Homo sapiens
cuuguguuacuugccaa

SEQ ID NO: 1182030 - RNA, 17 nt, Homo sapiens
cuuguguugugugaucu

SEQ ID NO: 1182031 - RNA, 13 nt, Homo sapiens
cuuguucccacac

SEQ ID NO: 1182032 - RNA, 13 nt, Homo sapiens
cuuguuuagcaua

SEQ ID NO: 1182033 - RNA, 20 nt, Homo sapiens
cuuguuuuauuuugugcuau

SEQ ID NO: 1182034 - RNA, 13 nt, Homo sapiens
cuuguuuugccag

SEQ ID NO: 1182035 - RNA, 17 nt, Homo sapiens
cuuguuuugccagugau

SEQ ID NO: 1182036 - RNA, 22 nt, Homo sapiens
cuuuaaaacuguauuuaaggaa

SEQ ID NO: 1182037 - RNA, 20 nt, Homo sapiens
cuuuaaaaguauccagagau

SEQ ID NO: 1182038 - RNA, 16 nt, Homo sapiens
cuuuaaaaugcaaaau

SEQ ID NO: 1182039 - RNA, 19 nt, Homo sapiens
cuuuaaaauguaaagccau

SEQ ID NO: 1182040 - RNA, 20 nt, Homo sapiens
cuuuaaaauuacaacuaagu

SEQ ID NO: 1182041 - RNA, 18 nt, Homo sapiens
cuuuaaaauuacauucua

SEQ ID NO: 1182042 - RNA, 16 nt, Homo sapiens
cuuuaaaggcaucuac

SEQ ID NO: 1182043 - RNA, 19 nt, Homo sapiens
cuuuaaagucagguccaau

SEQ ID NO: 1182044 - RNA, 15 nt, Homo sapiens
cuuuaaauccuucca

SEQ ID NO: 1182045 - RNA, 22 nt, Homo sapiens
cuuuaacucugcggauagcauu

SEQ ID NO: 1182046 - RNA, 14 nt, Homo sapiens
cuuuaagccugcau

SEQ ID NO: 1182047 - RNA, 14 nt, Homo sapiens
cuuuaauauuugcu

SEQ ID NO: 1182048 - RNA, 15 nt, Homo sapiens
cuuuaauauuugcua

SEQ ID NO: 1182049 - RNA, 18 nt, Homo sapiens
cuuuaaucuguuguuuga

SEQ ID NO: 1182050 - RNA, 14 nt, Homo sapiens
cuuuaaugaauaaa

SEQ ID NO: 1182051 - RNA, 22 nt, Homo sapiens
cuuuaaugaauaaacauuugua

SEQ ID NO: 1182052 - RNA, 18 nt, Homo sapiens
cuuuacaaaaguauuauc

SEQ ID NO: 1182053 - RNA, 23 nt, Homo sapiens
cuuuacagcuuuguuucugcauc

SEQ ID NO: 1182054 - RNA, 16 nt, Homo sapiens
cuuuacaggaucaugu

SEQ ID NO: 1182055 - RNA, 11 nt, Homo sapiens
cuuuaccuucu

SEQ ID NO: 1182056 - RNA, 14 nt, Homo sapiens
cuuuacugccugaa

SEQ ID NO: 1182057 - RNA, 14 nt, Homo sapiens
cuuuagaacaggga

SEQ ID NO: 1182058 - RNA, 16 nt, Homo sapiens
cuuuagaacagggaaa

SEQ ID NO: 1182059 - RNA, 19 nt, Homo sapiens
cuuuagaccuauuuuugaa

SEQ ID NO: 1182060 - RNA, 16 nt, Homo sapiens
cuuuaggagauuuauu

SEQ ID NO: 1182061 - RNA, 23 nt, Homo sapiens
cuuuagugaccccugccuacuuc

SEQ ID NO: 1182062 - RNA, 17 nt, Homo sapiens
cuuuauaaagagugcua

SEQ ID NO: 1182063 - RNA, 13 nt, Homo sapiens
cuuuauaacccaa

SEQ ID NO: 1182064 - RNA, 15 nt, Homo sapiens
cuuuauaaccugaug

SEQ ID NO: 1182065 - RNA, 11 nt, Homo sapiens
cuuuauacuua

SEQ ID NO: 1182066 - RNA, 21 nt, Homo sapiens
cuuuaucaaagauuggccaug

SEQ ID NO: 1182067 - RNA, 17 nt, Homo sapiens
cuuuaucaccucauucu

SEQ ID NO: 1182068 - RNA, 13 nt, Homo sapiens
cuuuauccaaaag

SEQ ID NO: 1182069 - RNA, 18 nt, Homo sapiens
cuuuaucuaauaccucug

SEQ ID NO: 1182070 - RNA, 15 nt, Homo sapiens
cuuuaugaagugcua

SEQ ID NO: 1182071 - RNA, 22 nt, Homo sapiens
cuuuaugcaugaagauaaugua

SEQ ID NO: 1182072 - RNA, 17 nt, Homo sapiens
cuuuaugggaacccucu

SEQ ID NO: 1182073 - RNA, 16 nt, Homo sapiens
cuuuaugugagaucuc

SEQ ID NO: 1182074 - RNA, 14 nt, Homo sapiens
cuuuauugcaaugc

SEQ ID NO: 1182075 - RNA, 20 nt, Homo sapiens
cuuuauuucggagcgcaaug

SEQ ID NO: 1182076 - RNA, 12 nt, Homo sapiens
cuuuauuuuaga

SEQ ID NO: 1182077 - RNA, 23 nt, Homo sapiens
cuuuauuuuuuucuguguacugu

SEQ ID NO: 1182078 - RNA, 16 nt, Homo sapiens
cuuucaaccucaguga

SEQ ID NO: 1182079 - RNA, 13 nt, Homo sapiens
cuuucaagaauga

SEQ ID NO: 1182080 - RNA, 21 nt, Homo sapiens
cuuucaauuacaaagcaguua

SEQ ID NO: 1182081 - RNA, 18 nt, Homo sapiens
cuuucacaguuucuucca

SEQ ID NO: 1182082 - RNA, 18 nt, Homo sapiens
cuuucaccccagggccug

SEQ ID NO: 1182083 - RNA, 20 nt, Homo sapiens
cuuucagaaaauucccauga

SEQ ID NO: 1182084 - RNA, 13 nt, Homo sapiens
cuuucagucccaa

SEQ ID NO: 1182085 - RNA, 16 nt, Homo sapiens
cuuucagucccaaagc

SEQ ID NO: 1182086 - RNA, 17 nt, Homo sapiens
cuuucauaaagucuugc

SEQ ID NO: 1182087 - RNA, 16 nt, Homo sapiens
cuuucaucuuugugga

SEQ ID NO: 1182088 - RNA, 22 nt, Homo sapiens
cuuucaugaauucugucauuuc

SEQ ID NO: 1182089 - RNA, 16 nt, Homo sapiens
cuuucaugucuuucca

SEQ ID NO: 1182090 - RNA, 15 nt, Homo sapiens
cuuucauuuacugau

SEQ ID NO: 1182091 - RNA, 15 nt, Homo sapiens
cuuuccagcuuagaa

SEQ ID NO: 1182092 - RNA, 12 nt, Homo sapiens
cuuuccaguucc

SEQ ID NO: 1182093 - RNA, 22 nt, Homo sapiens
cuuuccccagugacaccucagc

SEQ ID NO: 1182094 - RNA, 13 nt, Homo sapiens
cuuuccucaaaaa

SEQ ID NO: 1182095 - RNA, 18 nt, Homo sapiens
cuuuccuccaaacccaac

SEQ ID NO: 1182096 - RNA, 13 nt, Homo sapiens
cuuuccuccugag

SEQ ID NO: 1182097 - RNA, 15 nt, Homo sapiens
cuuuccugcacauuc

SEQ ID NO: 1182098 - RNA, 13 nt, Homo sapiens
cuuuccuucucua

SEQ ID NO: 1182099 - RNA, 21 nt, Homo sapiens
cuuuccuucuuucauuuuaaa

SEQ ID NO: 1182100 - RNA, 18 nt, Homo sapiens
cuuucugaaauuagggcc

SEQ ID NO: 1182101 - RNA, 16 nt, Homo sapiens
cuuucuguugccaugg

SEQ ID NO: 1182102 - RNA, 18 nt, Homo sapiens
cuuucuuauccuagcaca

SEQ ID NO: 1182103 - RNA, 13 nt, Homo sapiens
cuuucuugacucu

SEQ ID NO: 1182104 - RNA, 18 nt, Homo sapiens
cuuucuuucuaacuccag

SEQ ID NO: 1182105 - RNA, 16 nt, Homo sapiens
cuuugaagaguacaaa

SEQ ID NO: 1182106 - RNA, 16 nt, Homo sapiens
cuuugaauaaugugau

SEQ ID NO: 1182107 - RNA, 20 nt, Homo sapiens
cuuugaauuuuuuuaauugc

SEQ ID NO: 1182108 - RNA, 16 nt, Homo sapiens
cuuugagcaacuaacu

SEQ ID NO: 1182109 - RNA, 16 nt, Homo sapiens
cuuugagugacugggu

SEQ ID NO: 1182110 - RNA, 14 nt, Homo sapiens
cuuugaucaguaua

SEQ ID NO: 1182111 - RNA, 21 nt, Homo sapiens
cuuugauuuuuugcccagaga

SEQ ID NO: 1182112 - RNA, 22 nt, Homo sapiens
cuuugauuuuuugcccagagag

SEQ ID NO: 1182113 - RNA, 21 nt, Homo sapiens
cuuugcauagcagcugcuacu

SEQ ID NO: 1182114 - RNA, 20 nt, Homo sapiens
cuuugcccacacacacuccu

SEQ ID NO: 1182115 - RNA, 21 nt, Homo sapiens
cuuugccuccagaagcacugg

SEQ ID NO: 1182116 - RNA, 17 nt, Homo sapiens
cuuugccuucauucugc

SEQ ID NO: 1182117 - RNA, 23 nt, Homo sapiens
cuuugccuuuccauaaucacuca

SEQ ID NO: 1182118 - RNA, 14 nt, Homo sapiens
cuuugcuacuacua

SEQ ID NO: 1182119 - RNA, 14 nt, Homo sapiens
cuuugcuguggcag

SEQ ID NO: 1182120 - RNA, 18 nt, Homo sapiens
cuuuggaaagacuugaau

SEQ ID NO: 1182121 - RNA, 19 nt, Homo sapiens
cuuuggacagaagcagcuc

SEQ ID NO: 1182122 - RNA, 21 nt, Homo sapiens
cuuuggacagaagcagcucuu

SEQ ID NO: 1182123 - RNA, 14 nt, Homo sapiens
cuuuggcauguuua

SEQ ID NO: 1182124 - RNA, 15 nt, Homo sapiens
cuuuggcgaccuccu

SEQ ID NO: 1182125 - RNA, 14 nt, Homo sapiens
cuuuggcuuugcaa

SEQ ID NO: 1182126 - RNA, 21 nt, Homo sapiens
cuuugggccagacaugccaca

SEQ ID NO: 1182127 - RNA, 21 nt, Homo sapiens
cuuuggggagguguucacuga

SEQ ID NO: 1182128 - RNA, 18 nt, Homo sapiens
cuuuggguuuuuaacuca

SEQ ID NO: 1182129 - RNA, 20 nt, Homo sapiens
cuuuggugacuucacaguga

SEQ ID NO: 1182130 - RNA, 15 nt, Homo sapiens
cuuuggugcuuucca

SEQ ID NO: 1182131 - RNA, 15 nt, Homo sapiens
cuuuguauauuacau

SEQ ID NO: 1182132 - RNA, 13 nt, Homo sapiens
cuuugucugaaaa

SEQ ID NO: 1182133 - RNA, 17 nt, Homo sapiens
cuuugucuuacuggcaa

SEQ ID NO: 1182134 - RNA, 18 nt, Homo sapiens
cuuugugccaucacugag

SEQ ID NO: 1182135 - RNA, 19 nt, Homo sapiens
cuuugugccaucacugagc

SEQ ID NO: 1182136 - RNA, 15 nt, Homo sapiens
cuuuguuaaaaccaa

SEQ ID NO: 1182137 - RNA, 14 nt, Homo sapiens
cuuuguuccagaag

SEQ ID NO: 1182138 - RNA, 14 nt, Homo sapiens
cuuuguucucucuc

SEQ ID NO: 1182139 - RNA, 20 nt, Homo sapiens
cuuuguugcacugaaaugga

SEQ ID NO: 1182140 - RNA, 20 nt, Homo sapiens
cuuuguugcauuuuggcaac

SEQ ID NO: 1182141 - RNA, 13 nt, Homo sapiens
cuuuguuuacuua

SEQ ID NO: 1182142 - RNA, 15 nt, Homo sapiens
cuuuuaaaaaugucc

SEQ ID NO: 1182143 - RNA, 18 nt, Homo sapiens
cuuuuaagcagugaguua

SEQ ID NO: 1182144 - RNA, 17 nt, Homo sapiens
cuuuuaagucuuccacc

SEQ ID NO: 1182145 - RNA, 17 nt, Homo sapiens
cuuuuaaucaacuguag

SEQ ID NO: 1182146 - RNA, 23 nt, Homo sapiens
cuuuuacaaaaaaguaaccugaa

SEQ ID NO: 1182147 - RNA, 18 nt, Homo sapiens
cuuuuacauacagugaua

SEQ ID NO: 1182148 - RNA, 18 nt, Homo sapiens
cuuuuacuuguucauuuc

SEQ ID NO: 1182149 - RNA, 13 nt, Homo sapiens
cuuuuauaacuag

SEQ ID NO: 1182150 - RNA, 17 nt, Homo sapiens
cuuuuauugacacagaa

SEQ ID NO: 1182151 - RNA, 15 nt, Homo sapiens
cuuuuauuuuacaca

SEQ ID NO: 1182152 - RNA, 20 nt, Homo sapiens
cuuuucaagcuauaaugcua

SEQ ID NO: 1182153 - RNA, 20 nt, Homo sapiens
cuuuucacaugcuaaugugc

SEQ ID NO: 1182154 - RNA, 13 nt, Homo sapiens
cuuuucaccuuua

SEQ ID NO: 1182155 - RNA, 22 nt, Homo sapiens
cuuuucagcgauguaugcagcu

SEQ ID NO: 1182156 - RNA, 14 nt, Homo sapiens
cuuuucauugcaaa

SEQ ID NO: 1182157 - RNA, 16 nt, Homo sapiens
cuuuuccacuccauug

SEQ ID NO: 1182158 - RNA, 14 nt, Homo sapiens
cuuuucccauuugu

SEQ ID NO: 1182159 - RNA, 18 nt, Homo sapiens
cuuuucuugaccauauca

SEQ ID NO: 1182160 - RNA, 23 nt, Homo sapiens
cuuuucuuucucccuaaccacua

SEQ ID NO: 1182161 - RNA, 23 nt, Homo sapiens
cuuuugaaaaauaaugacucuua

SEQ ID NO: 1182162 - RNA, 15 nt, Homo sapiens
cuuuugaacccagga

SEQ ID NO: 1182163 - RNA, 21 nt, Homo sapiens
cuuuugaaguguuuuagucua

SEQ ID NO: 1182164 - RNA, 17 nt, Homo sapiens
cuuuugacaaaggcaag

SEQ ID NO: 1182165 - RNA, 13 nt, Homo sapiens
cuuuugcuugcaa

SEQ ID NO: 1182166 - RNA, 17 nt, Homo sapiens
cuuuuggcucugaagaa

SEQ ID NO: 1182167 - RNA, 23 nt, Homo sapiens
cuuuugguguguuggacagagaa

SEQ ID NO: 1182168 - RNA, 15 nt, Homo sapiens
cuuuuuaaacagugu

SEQ ID NO: 1182169 - RNA, 17 nt, Homo sapiens
cuuuuuaaacucacaua

SEQ ID NO: 1182170 - RNA, 17 nt, Homo sapiens
cuuuuuaaaugugauca

SEQ ID NO: 1182171 - RNA, 17 nt, Homo sapiens
cuuuuuaaccauuccaa

SEQ ID NO: 1182172 - RNA, 17 nt, Homo sapiens
cuuuuuaaccugcaaaa

SEQ ID NO: 1182173 - RNA, 22 nt, Homo sapiens
gaacaugcccacaacuugucac

SEQ ID NO: 1182174 - RNA, 18 nt, Homo sapiens
gaacaugcuuuuacuuua

SEQ ID NO: 1182175 - RNA, 23 nt, Homo sapiens
gaacauuugugauauauguauua

SEQ ID NO: 1182176 - RNA, 21 nt, Homo sapiens
gaaccacaccacaucuaagcc

SEQ ID NO: 1182177 - RNA, 17 nt, Homo sapiens
gaaccauuuucaccuau

SEQ ID NO: 1182178 - RNA, 22 nt, Homo sapiens
gaacccaagcuuagaacuuuaa

SEQ ID NO: 1182179 - RNA, 15 nt, Homo sapiens
gaacccuacacccca

SEQ ID NO: 1182180 - RNA, 22 nt, Homo sapiens
gaacccuuucgcuggcuuucca

SEQ ID NO: 1182181 - RNA, 16 nt, Homo sapiens
gaaccgaggcagggaa

SEQ ID NO: 1182182 - RNA, 23 nt, Homo sapiens
gaaccgcaggaugaaaaugaaga

SEQ ID NO: 1182183 - RNA, 14 nt, Homo sapiens
gaaccucugaugcc

SEQ ID NO: 1182184 - RNA, 11 nt, Homo sapiens
gaaccugacau

SEQ ID NO: 1182185 - RNA, 21 nt, Homo sapiens
gaaccugcccugcucccacag

SEQ ID NO: 1182186 - RNA, 21 nt, Homo sapiens
gaaccuucauaugugcaguau

SEQ ID NO: 1182187 - RNA, 15 nt, Homo sapiens
gaacgagagugccuc

SEQ ID NO: 1182188 - RNA, 16 nt, Homo sapiens
gaacguaucaauacag

SEQ ID NO: 1182189 - RNA, 21 nt, Homo sapiens
gaacguaucaauacaguuuau

SEQ ID NO: 1182190 - RNA, 17 nt, Homo sapiens
gaacuaaacucauuuau

SEQ ID NO: 1182191 - RNA, 13 nt, Homo sapiens
gaacuacuaaagu

SEQ ID NO: 1182192 - RNA, 21 nt, Homo sapiens
gaacuagagcuugcagugaag

SEQ ID NO: 1182193 - RNA, 19 nt, Homo sapiens
gaacucaaauggggccaga

SEQ ID NO: 1182194 - RNA, 13 nt, Homo sapiens
gaacucagaucca

SEQ ID NO: 1182195 - RNA, 11 nt, Homo sapiens
gaacucaggga

SEQ ID NO: 1182196 - RNA, 19 nt, Homo sapiens
gaacucauuuccauuugag

SEQ ID NO: 1182197 - RNA, 19 nt, Homo sapiens
gaacuccagcuggugcccc

SEQ ID NO: 1182198 - RNA, 17 nt, Homo sapiens
gaacucuacaucuagca

SEQ ID NO: 1182199 - RNA, 19 nt, Homo sapiens
gaacucugguggcacagga

SEQ ID NO: 1182200 - RNA, 23 nt, Homo sapiens
gaacugaggccuugugugucagg

SEQ ID NO: 1182201 - RNA, 13 nt, Homo sapiens
gaacuggagccau

SEQ ID NO: 1182202 - RNA, 14 nt, Homo sapiens
gaacuuacacugua

SEQ ID NO: 1182203 - RNA, 14 nt, Homo sapiens
gaacuucacaguga

SEQ ID NO: 1182204 - RNA, 16 nt, Homo sapiens
gaacuucaccugcaaa

SEQ ID NO: 1182205 - RNA, 19 nt, Homo sapiens
gaacuugugagaacacagc

SEQ ID NO: 1182206 - RNA, 14 nt, Homo sapiens
gaacuuugagcuac

SEQ ID NO: 1182207 - RNA, 23 nt, Homo sapiens
gaagaaagcuaaucuguuuagua

SEQ ID NO: 1182208 - RNA, 23 nt, Homo sapiens
gaagaaaugaaaggugacaaaag

SEQ ID NO: 1182209 - RNA, 23 nt, Homo sapiens
gaagaaccugacauccacuguuu

SEQ ID NO: 1182210 - RNA, 16 nt, Homo sapiens
gaagaaggaccaguga

SEQ ID NO: 1182211 - RNA, 17 nt, Homo sapiens
gaagaaggggacaaugg

SEQ ID NO: 1182212 - RNA, 23 nt, Homo sapiens
gaagaagguaggagaaagggcgg

SEQ ID NO: 1182213 - RNA, 14 nt, Homo sapiens
gaagaauggugugu

SEQ ID NO: 1182214 - RNA, 21 nt, Homo sapiens
gaagacaggaaaguucagagu

SEQ ID NO: 1182215 - RNA, 11 nt, Homo sapiens
gaagacauaaa

SEQ ID NO: 1182216 - RNA, 14 nt, Homo sapiens
gaagaccaaaugau

SEQ ID NO: 1182217 - RNA, 19 nt, Homo sapiens
gaagacugcccuacuauag

SEQ ID NO: 1182218 - RNA, 15 nt, Homo sapiens
gaagacuguugugcu

SEQ ID NO: 1182219 - RNA, 13 nt, Homo sapiens
gaagacuugcccc

SEQ ID NO: 1182220 - RNA, 19 nt, Homo sapiens
gaagaguuaagaagaaaau

SEQ ID NO: 1182221 - RNA, 21 nt, Homo sapiens
gaagauaggagagauaccuug

SEQ ID NO: 1182222 - RNA, 19 nt, Homo sapiens
gaagaucauauacgugaaa

SEQ ID NO: 1182223 - RNA, 16 nt, Homo sapiens
gaagaucgcauggcag

SEQ ID NO: 1182224 - RNA, 17 nt, Homo sapiens
gaagaugagacugccca

SEQ ID NO: 1182225 - RNA, 20 nt, Homo sapiens
gaagauggcauccugugaag

SEQ ID NO: 1182226 - RNA, 16 nt, Homo sapiens
gaagcagcauccucca

SEQ ID NO: 1182227 - RNA, 13 nt, Homo sapiens
gaagcauccuccc

SEQ ID NO: 1182228 - RNA, 22 nt, Homo sapiens
gaagcauggcauauagugcccu

SEQ ID NO: 1182229 - RNA, 18 nt, Homo sapiens
gaagccacccucccagcu

SEQ ID NO: 1182230 - RNA, 18 nt, Homo sapiens
gaagccaggaauuuccca

SEQ ID NO: 1182231 - RNA, 18 nt, Homo sapiens
gaagcccagcucugggaa

SEQ ID NO: 1182232 - RNA, 23 nt, Homo sapiens
gaagcccuguucucguugcccua

SEQ ID NO: 1182233 - RNA, 14 nt, Homo sapiens
gaagccgugcccug

SEQ ID NO: 1182234 - RNA, 17 nt, Homo sapiens
gaagccugaugcugaca

SEQ ID NO: 1182235 - RNA, 16 nt, Homo sapiens
gaagccuguccucacc

SEQ ID NO: 1182236 - RNA, 18 nt, Homo sapiens
gaagcuggagugcugcuu

SEQ ID NO: 1182237 - RNA, 21 nt, Homo sapiens
gaagcuguguccuugcaccug

SEQ ID NO: 1182238 - RNA, 22 nt, Homo sapiens
gaagcuguguccuugcaccugc

SEQ ID NO: 1182239 - RNA, 17 nt, Homo sapiens
gaagcuucaugccaggu

SEQ ID NO: 1182240 - RNA, 13 nt, Homo sapiens
gaaggaaacugaa

SEQ ID NO: 1182241 - RNA, 18 nt, Homo sapiens
gaaggaaggacuaugaca

SEQ ID NO: 1182242 - RNA, 21 nt, Homo sapiens
gaaggaaggacuaugacaaau

SEQ ID NO: 1182243 - RNA, 14 nt, Homo sapiens
gaaggacauuuucu

SEQ ID NO: 1182244 - RNA, 13 nt, Homo sapiens
gaaggaucaucug

SEQ ID NO: 1182245 - RNA, 12 nt, Homo sapiens
gaaggaucccau

SEQ ID NO: 1182246 - RNA, 18 nt, Homo sapiens
gaaggccgagaagcaaga

SEQ ID NO: 1182247 - RNA, 12 nt, Homo sapiens
ggcacauugugu

SEQ ID NO: 1182248 - RNA, 12 nt, Homo sapiens
ggcaccagacac

SEQ ID NO: 1182249 - RNA, 19 nt, Homo sapiens
ggcaccagacacccaggac

SEQ ID NO: 1182250 - RNA, 13 nt, Homo sapiens
ggcacccaagacc

SEQ ID NO: 1182251 - RNA, 22 nt, Homo sapiens
ggcaccuccuacgucaaacaug

SEQ ID NO: 1182252 - RNA, 14 nt, Homo sapiens
ggcaccuguagucc

SEQ ID NO: 1182253 - RNA, 22 nt, Homo sapiens
ggcacucccuccagcacaaaca

SEQ ID NO: 1182254 - RNA, 15 nt, Homo sapiens
ggcacugaagcccga

SEQ ID NO: 1182255 - RNA, 12 nt, Homo sapiens
ggcacugugccu

SEQ ID NO: 1182256 - RNA, 13 nt, Homo sapiens
ggcacuucauuga

SEQ ID NO: 1182257 - RNA, 15 nt, Homo sapiens
ggcacuucauugaga

SEQ ID NO: 1182258 - RNA, 17 nt, Homo sapiens
ggcacuuugcaucacag

SEQ ID NO: 1182259 - RNA, 20 nt, Homo sapiens
ggcagacucuuuaugcuugc

SEQ ID NO: 1182260 - RNA, 17 nt, Homo sapiens
ggcagagaaagggacaa

SEQ ID NO: 1182261 - RNA, 12 nt, Homo sapiens
ggcagagccaug

SEQ ID NO: 1182262 - RNA, 16 nt, Homo sapiens
ggcagauaacugcugu

SEQ ID NO: 1182263 - RNA, 21 nt, Homo sapiens
ggcagauacugucucuuucau

SEQ ID NO: 1182264 - RNA, 16 nt, Homo sapiens
ggcagccacaacugca

SEQ ID NO: 1182265 - RNA, 19 nt, Homo sapiens
ggcagcccaacagcacuuu

SEQ ID NO: 1182266 - RNA, 22 nt, Homo sapiens
ggcagcccugccaugucacaau

SEQ ID NO: 1182267 - RNA, 24 nt, Homo sapiens
ggcagccucucuucacugcuacau

SEQ ID NO: 1182268 - RNA, 17 nt, Homo sapiens
ggcagggaccaggccag

SEQ ID NO: 1182269 - RNA, 13 nt, Homo sapiens
ggcagggugcagu

SEQ ID NO: 1182270 - RNA, 14 nt, Homo sapiens
ggcagggugcagua

SEQ ID NO: 1182271 - RNA, 17 nt, Homo sapiens
ggcagguggccucugcu

SEQ ID NO: 1182272 - RNA, 19 nt, Homo sapiens
ggcaguccuggaaucacau

SEQ ID NO: 1182273 - RNA, 23 nt, Homo sapiens
ggcagugaugcuggaugcuccuu

SEQ ID NO: 1182274 - RNA, 11 nt, Homo sapiens
ggcaguuacau

SEQ ID NO: 1182275 - RNA, 17 nt, Homo sapiens
ggcaucuaauucuuauu

SEQ ID NO: 1182276 - RNA, 14 nt, Homo sapiens
ggcaucugcaaagg

SEQ ID NO: 1182277 - RNA, 12 nt, Homo sapiens
ggcaucuugcca

SEQ ID NO: 1182278 - RNA, 20 nt, Homo sapiens
ggcaugagauagcugguguu

SEQ ID NO: 1182279 - RNA, 16 nt, Homo sapiens
ggcauguauacuuaau

SEQ ID NO: 1182280 - RNA, 22 nt, Homo sapiens
ggcauuagugcugauagcugug

SEQ ID NO: 1182281 - RNA, 21 nt, Homo sapiens
ggcauucuaagucacaggaug

SEQ ID NO: 1182282 - RNA, 19 nt, Homo sapiens
ggcauuucccaauauuugc

SEQ ID NO: 1182283 - RNA, 23 nt, Homo sapiens
ggccaaggugggcggaucacuug

SEQ ID NO: 1182284 - RNA, 19 nt, Homo sapiens
ggccacuguguuucugugc

SEQ ID NO: 1182285 - RNA, 13 nt, Homo sapiens
ggccagauccagc

SEQ ID NO: 1182286 - RNA, 13 nt, Homo sapiens
ggccagccagcca

SEQ ID NO: 1182287 - RNA, 21 nt, Homo sapiens
ggccagccuuucccccuguga

SEQ ID NO: 1182288 - RNA, 18 nt, Homo sapiens
ggccaggggaguuuccaa

SEQ ID NO: 1182289 - RNA, 19 nt, Homo sapiens
ggccaggugugguggcuca

SEQ ID NO: 1182290 - RNA, 12 nt, Homo sapiens
ggccauacuucu

SEQ ID NO: 1182291 - RNA, 21 nt, Homo sapiens
ggccauacuucuguuuccauc

SEQ ID NO: 1182292 - RNA, 22 nt, Homo sapiens
ggccaucugguuaggauggcag

SEQ ID NO: 1182293 - RNA, 23 nt, Homo sapiens
ggccaugauggcaacagaucugg

SEQ ID NO: 1182294 - RNA, 14 nt, Homo sapiens
ggccaugcugugug

SEQ ID NO: 1182295 - RNA, 18 nt, Homo sapiens
ggccauggcucagggugg

SEQ ID NO: 1182296 - RNA, 21 nt, Homo sapiens
ggcccaagugaagcauggcau

SEQ ID NO: 1182297 - RNA, 14 nt, Homo sapiens
ggcccacccacuaa

SEQ ID NO: 1182298 - RNA, 15 nt, Homo sapiens
ggcccacccaucacg

SEQ ID NO: 1182299 - RNA, 15 nt, Homo sapiens
ggcccacucaggggu

SEQ ID NO: 1182300 - RNA, 19 nt, Homo sapiens
ggcccagagcccagcucca

SEQ ID NO: 1182301 - RNA, 18 nt, Homo sapiens
ggcccaguucacccugau

SEQ ID NO: 1182302 - RNA, 19 nt, Homo sapiens
ggcccaugaaauugaugaa

SEQ ID NO: 1182303 - RNA, 17 nt, Homo sapiens
ggccccagggggucuca

SEQ ID NO: 1182304 - RNA, 16 nt, Homo sapiens
ggccccucucauuccc

SEQ ID NO: 1182305 - RNA, 21 nt, Homo sapiens
ggcccguggcuuggcaucugu

SEQ ID NO: 1182306 - RNA, 22 nt, Homo sapiens
ggcccgugggagucaucucaac

SEQ ID NO: 1182307 - RNA, 23 nt, Homo sapiens
ggcccuaagagguuuuuccucuu

SEQ ID NO: 1182308 - RNA, 20 nt, Homo sapiens
ggcccucuugaaucucugaa

SEQ ID NO: 1182309 - RNA, 19 nt, Homo sapiens
ggcccugacugucagggag

SEQ ID NO: 1182310 - RNA, 12 nt, Homo sapiens
ggcccugcugaa

SEQ ID NO: 1182311 - RNA, 22 nt, Homo sapiens
ggcccuggaauugcagcuguac

SEQ ID NO: 1182312 - RNA, 18 nt, Homo sapiens
ggccgaagcugcugugac

SEQ ID NO: 1182313 - RNA, 22 nt, Homo sapiens
ggccgccaucugcgcagggugg

SEQ ID NO: 1182314 - RNA, 17 nt, Homo sapiens
ggccgcccugcggguga

SEQ ID NO: 1182315 - RNA, 17 nt, Homo sapiens
ggccgcggcccagaccc

SEQ ID NO: 1182316 - RNA, 18 nt, Homo sapiens
ggccgcucgaugccuuug

SEQ ID NO: 1182317 - RNA, 17 nt, Homo sapiens
ggccggcugugcucaga

SEQ ID NO: 1182318 - RNA, 20 nt, Homo sapiens
ggccuagacuuguguguucu

SEQ ID NO: 1182319 - RNA, 13 nt, Homo sapiens
ggccuaugcacau

SEQ ID NO: 1182320 - RNA, 21 nt, Homo sapiens
ggccucaaaugacaguagcau

SEQ ID NO: 1182321 - RNA, 16 nt, Homo sapiens
ggccucagcaagccau

SEQ ID NO: 1182322 - RNA, 18 nt, Homo sapiens
ggccucccacagacucaa

SEQ ID NO: 1182323 - RNA, 15 nt, Homo sapiens
ggccuccugugacug

SEQ ID NO: 1182324 - RNA, 20 nt, Homo sapiens
ggccucggcagaacucucug

SEQ ID NO: 1182325 - RNA, 21 nt, Homo sapiens
ggccucugccugggacacugc

SEQ ID NO: 1182326 - RNA, 15 nt, Homo sapiens
ggccugagacccagg

SEQ ID NO: 1182327 - RNA, 13 nt, Homo sapiens
ggccugcuccaga

SEQ ID NO: 1182328 - RNA, 18 nt, Homo sapiens
ggccugcuccagaccuga

SEQ ID NO: 1182329 - RNA, 20 nt, Homo sapiens
ggccugcucgcccacuuccu

SEQ ID NO: 1182330 - RNA, 14 nt, Homo sapiens
ggccuuagaacuuu

SEQ ID NO: 1182331 - RNA, 11 nt, Homo sapiens
ggccuugcccg

SEQ ID NO: 1182332 - RNA, 19 nt, Homo sapiens
ggccuuguccucagccagu

SEQ ID NO: 1182333 - RNA, 13 nt, Homo sapiens
ggcgacaguuuuc

SEQ ID NO: 1182334 - RNA, 19 nt, Homo sapiens
ggcgacuccuagauccagg

SEQ ID NO: 1182335 - RNA, 22 nt, Homo sapiens
ggcgaggccgccagacauacac

SEQ ID NO: 1182336 - RNA, 12 nt, Homo sapiens
ggcgcaaagggc

SEQ ID NO: 1182337 - RNA, 19 nt, Homo sapiens
ggcgcacuucagaaucaga

SEQ ID NO: 1182338 - RNA, 21 nt, Homo sapiens
ggcgcagaugugugucagaag

SEQ ID NO: 1182339 - RNA, 14 nt, Homo sapiens
ggcgccuucucgga

SEQ ID NO: 1182340 - RNA, 20 nt, Homo sapiens
ggcggagguugcaaugagcc

SEQ ID NO: 1182341 - RNA, 14 nt, Homo sapiens
ggcggaucaucuaa

SEQ ID NO: 1182342 - RNA, 20 nt, Homo sapiens
ggcggguccgggucgcagga

SEQ ID NO: 1182343 - RNA, 22 nt, Homo sapiens
ggcggugggcacccacccuggg

SEQ ID NO: 1182344 - RNA, 16 nt, Homo sapiens
ggcguggcccguggcu

SEQ ID NO: 1182345 - RNA, 22 nt, Homo sapiens
ggcguuacugcuugaccaaaga

SEQ ID NO: 1182346 - RNA, 14 nt, Homo sapiens
ggcguugugggcag

SEQ ID NO: 1182347 - RNA, 18 nt, Homo sapiens
ggcguuuuuauaguuuau

SEQ ID NO: 1182348 - RNA, 18 nt, Homo sapiens
ggcuaaagagaugagaca

SEQ ID NO: 1182349 - RNA, 18 nt, Homo sapiens
ggcuaaagugcauuuuua

SEQ ID NO: 1182350 - RNA, 23 nt, Homo sapiens
ggcuaagacccaaacauaugcac

SEQ ID NO: 1182351 - RNA, 15 nt, Homo sapiens
ggcuaagggggacca

SEQ ID NO: 1182352 - RNA, 14 nt, Homo sapiens
ggcuacaacuucag

SEQ ID NO: 1182353 - RNA, 16 nt, Homo sapiens
ggcuacacucaucuga

SEQ ID NO: 1182354 - RNA, 14 nt, Homo sapiens
ggcuacccaaaaca

SEQ ID NO: 1182355 - RNA, 13 nt, Homo sapiens
ggcuagacaguuc

SEQ ID NO: 1182356 - RNA, 15 nt, Homo sapiens
ggcuagagugcaaug

SEQ ID NO: 1182357 - RNA, 20 nt, Homo sapiens
ggcuagagugcaauggugca

SEQ ID NO: 1182358 - RNA, 17 nt, Homo sapiens
ggcuagugaaguggccu

SEQ ID NO: 1182359 - RNA, 15 nt, Homo sapiens
ggcuaguggggugaa

SEQ ID NO: 1182360 - RNA, 20 nt, Homo sapiens
ggcuaugccugccucaaagg

SEQ ID NO: 1182361 - RNA, 23 nt, Homo sapiens
ggcucaacguuuuuggacacugu

SEQ ID NO: 1182362 - RNA, 17 nt, Homo sapiens
ggcucagacauguuuuc

SEQ ID NO: 1182363 - RNA, 20 nt, Homo sapiens
ggcucagcuagacauugcaa

SEQ ID NO: 1182364 - RNA, 18 nt, Homo sapiens
ggcucagugcaaccucug

SEQ ID NO: 1182365 - RNA, 13 nt, Homo sapiens
ggcuccacuggga

SEQ ID NO: 1182366 - RNA, 18 nt, Homo sapiens
gagauguccauagucaaa

SEQ ID NO: 1182367 - RNA, 15 nt, Homo sapiens
gagauguuugccaaa

SEQ ID NO: 1182368 - RNA, 17 nt, Homo sapiens
gagauuaccuccugaga

SEQ ID NO: 1182369 - RNA, 15 nt, Homo sapiens
gagauugagauguaa

SEQ ID NO: 1182370 - RNA, 20 nt, Homo sapiens
gagcaaacucugcugucuaa

SEQ ID NO: 1182371 - RNA, 17 nt, Homo sapiens
gagcaacauggugagac

SEQ ID NO: 1182372 - RNA, 23 nt, Homo sapiens
gagcacaauuucccuucauacuc

SEQ ID NO: 1182373 - RNA, 16 nt, Homo sapiens
gagcacagcugcauua

SEQ ID NO: 1182374 - RNA, 13 nt, Homo sapiens
gagcagcacagga

SEQ ID NO: 1182375 - RNA, 14 nt, Homo sapiens
gagcaguagcugga

SEQ ID NO: 1182376 - RNA, 23 nt, Homo sapiens
gagcagugggaggguaccagcag

SEQ ID NO: 1182377 - RNA, 19 nt, Homo sapiens
gagcaucacagaaugugau

SEQ ID NO: 1182378 - RNA, 23 nt, Homo sapiens
gagcaugugagggguagugggau

SEQ ID NO: 1182379 - RNA, 15 nt, Homo sapiens
gagcauuaagcccaa

SEQ ID NO: 1182380 - RNA, 21 nt, Homo sapiens
gagcauuggauacagcaguag

SEQ ID NO: 1182381 - RNA, 12 nt, Homo sapiens
gagccaaaaacu

SEQ ID NO: 1182382 - RNA, 13 nt, Homo sapiens
gagccaccccagg

SEQ ID NO: 1182383 - RNA, 22 nt, Homo sapiens
gagccagaccuucggagaguaa

SEQ ID NO: 1182384 - RNA, 18 nt, Homo sapiens
gagccaggaaagcagcaa

SEQ ID NO: 1182385 - RNA, 13 nt, Homo sapiens
gagccaggguaga

SEQ ID NO: 1182386 - RNA, 15 nt, Homo sapiens
gagccaguggugcua

SEQ ID NO: 1182387 - RNA, 18 nt, Homo sapiens
gagccauauaaguuugaa

SEQ ID NO: 1182388 - RNA, 17 nt, Homo sapiens
gagcccagauugugcca

SEQ ID NO: 1182389 - RNA, 19 nt, Homo sapiens
gagcccgcagcccagaccc

SEQ ID NO: 1182390 - RNA, 17 nt, Homo sapiens
gagccggacacuucuca

SEQ ID NO: 1182391 - RNA, 14 nt, Homo sapiens
gagccugacccuca

SEQ ID NO: 1182392 - RNA, 20 nt, Homo sapiens
gagcgaggaaaaacaacaaa

SEQ ID NO: 1182393 - RNA, 21 nt, Homo sapiens
gagcggcgcccuggacuuggu

SEQ ID NO: 1182394 - RNA, 12 nt, Homo sapiens
gagcguuugcac

SEQ ID NO: 1182395 - RNA, 12 nt, Homo sapiens
gagcuauaacuu

SEQ ID NO: 1182396 - RNA, 14 nt, Homo sapiens
gagcucccaggugc

SEQ ID NO: 1182397 - RNA, 21 nt, Homo sapiens
gagcucccaggugcagccaga

SEQ ID NO: 1182398 - RNA, 19 nt, Homo sapiens
gagcucgcauuugucaaug

SEQ ID NO: 1182399 - RNA, 14 nt, Homo sapiens
gagcugcugaguga

SEQ ID NO: 1182400 - RNA, 14 nt, Homo sapiens
gagcuuacauugaa

SEQ ID NO: 1182401 - RNA, 17 nt, Homo sapiens
gagcuucccacaccugc

SEQ ID NO: 1182402 - RNA, 20 nt, Homo sapiens
gagcuuuuaaaaauguccug

SEQ ID NO: 1182403 - RNA, 21 nt, Homo sapiens
gaggaaauucggagcuauaca

SEQ ID NO: 1182404 - RNA, 24 nt, Homo sapiens
gaggaaucacucuuguggauguuu

SEQ ID NO: 1182405 - RNA, 16 nt, Homo sapiens
gaggaauuuggcugcu

SEQ ID NO: 1182406 - RNA, 16 nt, Homo sapiens
gaggacacaguuucua

SEQ ID NO: 1182407 - RNA, 22 nt, Homo sapiens
gaggacacaguuucuauuguaa

SEQ ID NO: 1182408 - RNA, 15 nt, Homo sapiens
gaggacuaugccaug

SEQ ID NO: 1182409 - RNA, 15 nt, Homo sapiens
gaggacuucugcauc

SEQ ID NO: 1182410 - RNA, 14 nt, Homo sapiens
gaggagccagagaa

SEQ ID NO: 1182411 - RNA, 15 nt, Homo sapiens
gaggaggaagucaug

SEQ ID NO: 1182412 - RNA, 13 nt, Homo sapiens
gaggaggggcccg

SEQ ID NO: 1182413 - RNA, 18 nt, Homo sapiens
gaggagguauuguaagcu

SEQ ID NO: 1182414 - RNA, 19 nt, Homo sapiens
gaggaguucuuuggcucua

SEQ ID NO: 1182415 - RNA, 14 nt, Homo sapiens
gaggcaccucaaga

SEQ ID NO: 1182416 - RNA, 19 nt, Homo sapiens
gaggcagaaaauugcacaa

SEQ ID NO: 1182417 - RNA, 20 nt, Homo sapiens
gaggcagagguugcagugag

SEQ ID NO: 1182418 - RNA, 19 nt, Homo sapiens
gaggcaggaaaaugcuucu

SEQ ID NO: 1182419 - RNA, 20 nt, Homo sapiens
gaggcaggagaaucgcuuga

SEQ ID NO: 1182420 - RNA, 20 nt, Homo sapiens
gaggcaggggacaagggagg

SEQ ID NO: 1182421 - RNA, 17 nt, Homo sapiens
gaggcagugucauuugc

SEQ ID NO: 1182422 - RNA, 16 nt, Homo sapiens
gaggcaugcuaagaau

SEQ ID NO: 1182423 - RNA, 17 nt, Homo sapiens
gaggccauucuuuccca

SEQ ID NO: 1182424 - RNA, 14 nt, Homo sapiens
gaggccucagggag

SEQ ID NO: 1182425 - RNA, 18 nt, Homo sapiens
gccucccugaaacacugc

SEQ ID NO: 1182426 - RNA, 16 nt, Homo sapiens
gccuccgcuacuucca

SEQ ID NO: 1182427 - RNA, 20 nt, Homo sapiens
gccuccuauccaccacugcu

SEQ ID NO: 1182428 - RNA, 21 nt, Homo sapiens
gccuccuucccucggggccau

SEQ ID NO: 1182429 - RNA, 15 nt, Homo sapiens
gccucgaaaaccauc

SEQ ID NO: 1182430 - RNA, 17 nt, Homo sapiens
gccucgguggcccugac

SEQ ID NO: 1182431 - RNA, 14 nt, Homo sapiens
gccucucuauucau

SEQ ID NO: 1182432 - RNA, 15 nt, Homo sapiens
gccucuggaucugcu

SEQ ID NO: 1182433 - RNA, 21 nt, Homo sapiens
gccucugguguuugcaaagga

SEQ ID NO: 1182434 - RNA, 18 nt, Homo sapiens
gccugaagaguccucuga

SEQ ID NO: 1182435 - RNA, 12 nt, Homo sapiens
gccugacauuca

SEQ ID NO: 1182436 - RNA, 23 nt, Homo sapiens
gccugagaacaccagagaccuca

SEQ ID NO: 1182437 - RNA, 17 nt, Homo sapiens
gccugagcaacauggug

SEQ ID NO: 1182438 - RNA, 21 nt, Homo sapiens
gccugaggucaggaguucaag

SEQ ID NO: 1182439 - RNA, 18 nt, Homo sapiens
gccugaguuaggaaacaa

SEQ ID NO: 1182440 - RNA, 22 nt, Homo sapiens
gccugaucagcgccgcaccagc

SEQ ID NO: 1182441 - RNA, 18 nt, Homo sapiens
gccugaugcugacauuca

SEQ ID NO: 1182442 - RNA, 21 nt, Homo sapiens
gccugcacagugaagugcugg

SEQ ID NO: 1182443 - RNA, 12 nt, Homo sapiens
gccugcaggacc

SEQ ID NO: 1182444 - RNA, 18 nt, Homo sapiens
gccugcauguaaacacgc

SEQ ID NO: 1182445 - RNA, 16 nt, Homo sapiens
gccugcccgcacccug

SEQ ID NO: 1182446 - RNA, 16 nt, Homo sapiens
gccugccuggcaggcu

SEQ ID NO: 1182447 - RNA, 16 nt, Homo sapiens
gccuggaacaccagca

SEQ ID NO: 1182448 - RNA, 17 nt, Homo sapiens
gccuggaacaccagcag

SEQ ID NO: 1182449 - RNA, 20 nt, Homo sapiens
gccuggaacaccagcagcac

SEQ ID NO: 1182450 - RNA, 19 nt, Homo sapiens
gccuggagccccacugccc

SEQ ID NO: 1182451 - RNA, 17 nt, Homo sapiens
gccuggaguacuuuuag

SEQ ID NO: 1182452 - RNA, 15 nt, Homo sapiens
gccuggcauuucaca

SEQ ID NO: 1182453 - RNA, 18 nt, Homo sapiens
gccuggccaacaugguga

SEQ ID NO: 1182454 - RNA, 14 nt, Homo sapiens
gccuggccuaccca

SEQ ID NO: 1182455 - RNA, 15 nt, Homo sapiens
gccuggcuccaaacc

SEQ ID NO: 1182456 - RNA, 23 nt, Homo sapiens
gccuggcuucacucucccugacg

SEQ ID NO: 1182457 - RNA, 21 nt, Homo sapiens
gccugggauuucuaugcagug

SEQ ID NO: 1182458 - RNA, 23 nt, Homo sapiens
gccuggggccaagcagacgggca

SEQ ID NO: 1182459 - RNA, 15 nt, Homo sapiens
gccuggggucuggag

SEQ ID NO: 1182460 - RNA, 22 nt, Homo sapiens
gccugggguggggucaugcccu

SEQ ID NO: 1182461 - RNA, 21 nt, Homo sapiens
gccugggguguuaguggcacc

SEQ ID NO: 1182462 - RNA, 17 nt, Homo sapiens
gccuguagccccaguga

SEQ ID NO: 1182463 - RNA, 18 nt, Homo sapiens
gccuguccaacaugguga

SEQ ID NO: 1182464 - RNA, 13 nt, Homo sapiens
gccugugcaugua

SEQ ID NO: 1182465 - RNA, 17 nt, Homo sapiens
gccuguggccuuugcaa

SEQ ID NO: 1182466 - RNA, 17 nt, Homo sapiens
gccuguuacacaugaca

SEQ ID NO: 1182467 - RNA, 11 nt, Homo sapiens
gccuguucaua

SEQ ID NO: 1182468 - RNA, 14 nt, Homo sapiens
gccuguuccaugaa

SEQ ID NO: 1182469 - RNA, 21 nt, Homo sapiens
gccuuaguugcuaguuuagua

SEQ ID NO: 1182470 - RNA, 17 nt, Homo sapiens
gccuuauuaaagcaaaa

SEQ ID NO: 1182471 - RNA, 20 nt, Homo sapiens
gccuucauaagccuaccaau

SEQ ID NO: 1182472 - RNA, 14 nt, Homo sapiens
gccuucaucuucac

SEQ ID NO: 1182473 - RNA, 21 nt, Homo sapiens
gccuucaucuucacugcaauu

SEQ ID NO: 1182474 - RNA, 17 nt, Homo sapiens
gccuuccggguucaagu

SEQ ID NO: 1182475 - RNA, 17 nt, Homo sapiens
gccuucucaccacagag

SEQ ID NO: 1182476 - RNA, 16 nt, Homo sapiens
gccuucucaccagcug

SEQ ID NO: 1182477 - RNA, 16 nt, Homo sapiens
gccuucuccacuuugg

SEQ ID NO: 1182478 - RNA, 11 nt, Homo sapiens
gccuucuuaua

SEQ ID NO: 1182479 - RNA, 16 nt, Homo sapiens
gccuugguaugugcca

SEQ ID NO: 1182480 - RNA, 22 nt, Homo sapiens
gccuugugcgguuguguucuca

SEQ ID NO: 1182481 - RNA, 15 nt, Homo sapiens
gccuuuauugacuac

SEQ ID NO: 1182482 - RNA, 17 nt, Homo sapiens
gccuuucccucuucccu

SEQ ID NO: 1182483 - RNA, 18 nt, Homo sapiens
gccuuugucuuacuggca

SEQ ID NO: 1182484 - RNA, 15 nt, Homo sapiens
gccuuuucacugugu

SEQ ID NO: 1182485 - RNA, 19 nt, Homo sapiens
gccuuuuggaaauccaaau

SEQ ID NO: 1182486 - RNA, 17 nt, Homo sapiens
gcgaaaaaaucagugaa

SEQ ID NO: 1182487 - RNA, 19 nt, Homo sapiens
gcgaaaccccucucuacua

SEQ ID NO: 1182488 - RNA, 14 nt, Homo sapiens
gcgaacaucuucau

SEQ ID NO: 1182489 - RNA, 13 nt, Homo sapiens
gcgacacugggag

SEQ ID NO: 1182490 - RNA, 21 nt, Homo sapiens
gcgagaaggaguguaugagug

SEQ ID NO: 1182491 - RNA, 16 nt, Homo sapiens
gcgagacuccaucucu

SEQ ID NO: 1182492 - RNA, 14 nt, Homo sapiens
gcgagccugacucu

SEQ ID NO: 1182493 - RNA, 20 nt, Homo sapiens
gcgaggaaaaacaacaaaua

SEQ ID NO: 1182494 - RNA, 15 nt, Homo sapiens
gcgauguaugcagcu

SEQ ID NO: 1182495 - RNA, 18 nt, Homo sapiens
gcgauucuccugccucag

SEQ ID NO: 1182496 - RNA, 18 nt, Homo sapiens
gcgauucucuugccucag

SEQ ID NO: 1182497 - RNA, 21 nt, Homo sapiens
gcgcaagacagcccaacagcu

SEQ ID NO: 1182498 - RNA, 22 nt, Homo sapiens
gcgcaagccuguaaucccagcu

SEQ ID NO: 1182499 - RNA, 17 nt, Homo sapiens
gcgcagaugugcagcag

SEQ ID NO: 1182500 - RNA, 16 nt, Homo sapiens
gcgcauugagccagug

SEQ ID NO: 1182501 - RNA, 24 nt, Homo sapiens
gcgccuccaccccgacugcucagu

SEQ ID NO: 1182502 - RNA, 16 nt, Homo sapiens
gcgcguggugcugagu

SEQ ID NO: 1182503 - RNA, 16 nt, Homo sapiens
gcgcucuggacagaug

SEQ ID NO: 1182504 - RNA, 16 nt, Homo sapiens
gcgcugggcacuuccc

SEQ ID NO: 1182505 - RNA, 17 nt, Homo sapiens
gcggagguugcaaugag

SEQ ID NO: 1182506 - RNA, 14 nt, Homo sapiens
gcggaucacuugag

SEQ ID NO: 1182507 - RNA, 13 nt, Homo sapiens
gcggaucaucuaa

SEQ ID NO: 1182508 - RNA, 18 nt, Homo sapiens
gcggaucuuuggacagaa

SEQ ID NO: 1182509 - RNA, 15 nt, Homo sapiens
gcggcccagacccac

SEQ ID NO: 1182510 - RNA, 13 nt, Homo sapiens
gcggcccucagug

SEQ ID NO: 1182511 - RNA, 17 nt, Homo sapiens
gcggcucuaaaccucag

SEQ ID NO: 1182512 - RNA, 20 nt, Homo sapiens
gcggcucugcccaccucucu

SEQ ID NO: 1182513 - RNA, 16 nt, Homo sapiens
gcgggacccgaccccc

SEQ ID NO: 1182514 - RNA, 23 nt, Homo sapiens
gcggggcuuuccugcacauucuc

SEQ ID NO: 1182515 - RNA, 17 nt, Homo sapiens
gcgguaccuguguuucc

SEQ ID NO: 1182516 - RNA, 15 nt, Homo sapiens
gcggugaacauuucc

SEQ ID NO: 1182517 - RNA, 24 nt, Homo sapiens
gcgguggccacagcgugcuggcga

SEQ ID NO: 1182518 - RNA, 14 nt, Homo sapiens
gcguacagaucucu

SEQ ID NO: 1182519 - RNA, 22 nt, Homo sapiens
gcgucaggcagugugaguuugc

SEQ ID NO: 1182520 - RNA, 16 nt, Homo sapiens
gcgucugugcauuuau

SEQ ID NO: 1182521 - RNA, 17 nt, Homo sapiens
gcgugacucacccaagc

SEQ ID NO: 1182522 - RNA, 15 nt, Homo sapiens
gcguggaaguguucc

SEQ ID NO: 1182523 - RNA, 14 nt, Homo sapiens
gcguggagacuggc

SEQ ID NO: 1182524 - RNA, 22 nt, Homo sapiens
gcguggcccuaggacaggagga

SEQ ID NO: 1182525 - RNA, 18 nt, Homo sapiens
gcguuggucucugcauuu

SEQ ID NO: 1182526 - RNA, 18 nt, Homo sapiens
ggguucugcuacucccca

SEQ ID NO: 1182527 - RNA, 16 nt, Homo sapiens
ggguuggaagugcaga

SEQ ID NO: 1182528 - RNA, 21 nt, Homo sapiens
ggguugggggacagccuucag

SEQ ID NO: 1182529 - RNA, 15 nt, Homo sapiens
gguaaaaaauauagc

SEQ ID NO: 1182530 - RNA, 23 nt, Homo sapiens
gguaaauuuccccaacaguguga

SEQ ID NO: 1182531 - RNA, 22 nt, Homo sapiens
gguaacuaagaagugguguucc

SEQ ID NO: 1182532 - RNA, 21 nt, Homo sapiens
guaaauguuaucuuauacugu

SEQ ID NO: 1182533 - RNA, 13 nt, Homo sapiens
guaaauucagucu

SEQ ID NO: 1182534 - RNA, 23 nt, Homo sapiens
guaaauugauucaagugagccag

SEQ ID NO: 1182535 - RNA, 14 nt, Homo sapiens
guaacaucaaagau

SEQ ID NO: 1182536 - RNA, 14 nt, Homo sapiens
guaacaucagccau

SEQ ID NO: 1182537 - RNA, 23 nt, Homo sapiens
guaacccucccuguucaucccau

SEQ ID NO: 1182538 - RNA, 16 nt, Homo sapiens
guaacuuuuugcacua

SEQ ID NO: 1182539 - RNA, 17 nt, Homo sapiens
guaagacagugcccuga

SEQ ID NO: 1182540 - RNA, 21 nt, Homo sapiens
guaagacauuaguaacauaau

SEQ ID NO: 1182541 - RNA, 22 nt, Homo sapiens
guaagaucguucucugccucac

SEQ ID NO: 1182542 - RNA, 22 nt, Homo sapiens
guaagaugucuguuugcugaug

SEQ ID NO: 1182543 - RNA, 14 nt, Homo sapiens
guaaggaacuggaa

SEQ ID NO: 1182544 - RNA, 15 nt, Homo sapiens
guaaggaacuggaac

SEQ ID NO: 1182545 - RNA, 13 nt, Homo sapiens
guaagucauuuau

SEQ ID NO: 1182546 - RNA, 22 nt, Homo sapiens
guaagugucugugaugcuccca

SEQ ID NO: 1182547 - RNA, 12 nt, Homo sapiens
guaaguuuugaa

SEQ ID NO: 1182548 - RNA, 23 nt, Homo sapiens
guaauaauaaaucguccucccag

SEQ ID NO: 1182549 - RNA, 20 nt, Homo sapiens
guaauaguaaacacagggaa

SEQ ID NO: 1182550 - RNA, 15 nt, Homo sapiens
guaaucccagcacuu

SEQ ID NO: 1182551 - RNA, 16 nt, Homo sapiens
guaaucccagcacuuu

SEQ ID NO: 1182552 - RNA, 17 nt, Homo sapiens
guaaucuuggguuucua

SEQ ID NO: 1182553 - RNA, 17 nt, Homo sapiens
guaaucuuuggcuguaa

SEQ ID NO: 1182554 - RNA, 23 nt, Homo sapiens
guaaugaguuuaaaaaucaacuu

SEQ ID NO: 1182555 - RNA, 21 nt, Homo sapiens
guaaugauguugauaauuuca

SEQ ID NO: 1182556 - RNA, 12 nt, Homo sapiens
guaauucagugu

SEQ ID NO: 1182557 - RNA, 14 nt, Homo sapiens
guaauuucugcaca

SEQ ID NO: 1182558 - RNA, 22 nt, Homo sapiens
guacaaaaauaaauuuauauga

SEQ ID NO: 1182559 - RNA, 22 nt, Homo sapiens
guacacacccacacacaucuau

SEQ ID NO: 1182560 - RNA, 22 nt, Homo sapiens
guacacagugagaguacucacu

SEQ ID NO: 1182561 - RNA, 12 nt, Homo sapiens
guacacauuuau

SEQ ID NO: 1182562 - RNA, 19 nt, Homo sapiens
guacaccccaacagcaccc

SEQ ID NO: 1182563 - RNA, 17 nt, Homo sapiens
guacacguguccuguag

SEQ ID NO: 1182564 - RNA, 17 nt, Homo sapiens
guacacugccccaggac

SEQ ID NO: 1182565 - RNA, 20 nt, Homo sapiens
guacagacgucucaagacug

SEQ ID NO: 1182566 - RNA, 13 nt, Homo sapiens
guacagguauauu

SEQ ID NO: 1182567 - RNA, 19 nt, Homo sapiens
guacaguauauucuuguaa

SEQ ID NO: 1182568 - RNA, 18 nt, Homo sapiens
guacaguggugugauccc

SEQ ID NO: 1182569 - RNA, 23 nt, Homo sapiens
guacaucgaggcucuugcucaag

SEQ ID NO: 1182570 - RNA, 18 nt, Homo sapiens
guacauguaacauuaaag

SEQ ID NO: 1182571 - RNA, 11 nt, Homo sapiens
guacauuucac

SEQ ID NO: 1182572 - RNA, 19 nt, Homo sapiens
guacauuuuagugauuuga

SEQ ID NO: 1182573 - RNA, 21 nt, Homo sapiens
guacccuuucaaacuauuuau

SEQ ID NO: 1182574 - RNA, 18 nt, Homo sapiens
guaccugaaagcacugua

SEQ ID NO: 1182575 - RNA, 19 nt, Homo sapiens
guaccugaaagcacuguag

SEQ ID NO: 1182576 - RNA, 21 nt, Homo sapiens
guaccugcaaguauccagacc

SEQ ID NO: 1182577 - RNA, 17 nt, Homo sapiens
guaccugcuggcacuau

SEQ ID NO: 1182578 - RNA, 22 nt, Homo sapiens
guaccuucaggcagccagugug

SEQ ID NO: 1182579 - RNA, 22 nt, Homo sapiens
guaccuuuguguccuuguucau
